United States Patent 8,461,315 (MICRORNAS AND USES THEREOF) - sequence listing, part 14

SEQ ID NO: 371686 - RNA, 63 nt, Homo Sapiens
ggaggucaaggccuugggcucuccccagggucuaacgguuaaggggacccacauaccagugcc

SEQ ID NO: 371687 - RNA, 63 nt, Homo Sapiens
uuacaggcauugcaggaugguaacuauuaaauaaacgguuauuacuggaguuuuuuuuuuuuu

SEQ ID NO: 371688 - RNA, 63 nt, Homo Sapiens
cuuaggugccauggaucgauuuaaaaacguggcaacgguuacuugcugagaauaaaugucuug

SEQ ID NO: 371689 - RNA, 63 nt, Homo Sapiens
aaguuuuguaccauuuauuuauauagccggauuaacgguuauauagugacauguacauacugu

SEQ ID NO: 371690 - RNA, 63 nt, Homo Sapiens
uuugaagaaauaacaaauuaaaagcuauauauaaacgguuaacaauauuagguggacauauuu

SEQ ID NO: 371691 - RNA, 63 nt, Homo Sapiens
uucauuguaggaucagcagcagguuaaagacugaacgguuagugaagacaaaugucuuaagag

SEQ ID NO: 371692 - RNA, 63 nt, Homo Sapiens
aauucuuugagaccuucguaaauauuuuuggauaacgguuauucacucagccuuaaauguuau

SEQ ID NO: 371693 - RNA, 63 nt, Homo Sapiens
cuguaaugaaaguuguaaauaauaauaaaauguaacgguuauaagagauugacaacaauaacu

SEQ ID NO: 371694 - RNA, 63 nt, Homo Sapiens
uuuaagugaauuuuugaccuuaucuuaauggaaaacgguuaacuccaaacacaaaagacucua

SEQ ID NO: 371695 - RNA, 63 nt, Homo Sapiens
aaggaaaacuggaaauacugaggggacugcguuaacgguuacuugagaagaaaaaaaagagga

SEQ ID NO: 371696 - RNA, 63 nt, Homo Sapiens
aauaccucugucuuguggcuuagaauaaagaaaaacgguuauauuucugggugccccacuaag

SEQ ID NO: 371697 - RNA, 63 nt, Homo Sapiens
aaagcacuuaaacagaagcauagccugagucauaacgguuaagguuuaaaaacuucaucgacu

SEQ ID NO: 371698 - RNA, 63 nt, Homo Sapiens
cauuauuagauuacuuuaauugagauuuguuaaaacgguuaggacuguuuuguccaggaaaga

SEQ ID NO: 371699 - RNA, 63 nt, Homo Sapiens
acgcgcucuacauccgcuuuacaaugguuagggaacgguuagaccccggccuuucgcggugac

SEQ ID NO: 371700 - RNA, 63 nt, Homo Sapiens
uguaacguuuucuuucacacugagagcaauuguaacgguuaacgaugaggugguggaguggag

SEQ ID NO: 371701 - RNA, 63 nt, Homo Sapiens
gugauaucaaugaagaaauauuuguagcauguaaacgguuauuucuguuucuuaaaaaguauu

SEQ ID NO: 371702 - RNA, 63 nt, Homo Sapiens
cccgugaacaacuuugucagguucacguccuauaacgguuaaaaaacacacacacacauacac

SEQ ID NO: 371703 - RNA, 63 nt, Homo Sapiens
gagcucugccuguuggagcuccaaagccuggggaacgguuaggucaccuucuccuucuugauu

SEQ ID NO: 371704 - RNA, 63 nt, Homo Sapiens
caagucccauggcacagagcaaggcgggcagggaacgguuauuuuucuaaauaaaugcuuuaa

SEQ ID NO: 371705 - RNA, 63 nt, Homo Sapiens
ucuucucuuguguauaugcacuucucacccaguaacgguuaaccucugcugaagccuuaccuc

SEQ ID NO: 371706 - RNA, 63 nt, Homo Sapiens
uuuuaaaaacaaguugacuuuuucaguuucuugaacgguuaaggguggauuuaaaaacuagac

SEQ ID NO: 371707 - RNA, 63 nt, Homo Sapiens
cuauaaaaucugcuuuucacccccucauuuaaaaacgguuauaagccacugcccucucuuagg

SEQ ID NO: 371708 - RNA, 63 nt, Homo Sapiens
acugucccuuucugugugaacaugaaaacagaaaacgguuaaaggccaacaguuaaaugagaa

SEQ ID NO: 371709 - RNA, 63 nt, Homo Sapiens
gugauacugccaaagaacugucugacuucaaucaacgguuaguggauuagaaaacucuaaagu

SEQ ID NO: 371710 - RNA, 63 nt, Homo Sapiens
guaaggaaccgaugggccauuaaacaugaacugaacgguuaaaagcacagucuauggaacgcu

SEQ ID NO: 371711 - RNA, 63 nt, Homo Sapiens
aaacuguuuuuggaaauucaagccacacucuucaacgguuaccgugcagagggacaaagccac

SEQ ID NO: 371712 - RNA, 63 nt, Homo Sapiens
uauguuggaaaacagcuguauacauuuuugggcaacgguuaugcauaauauuuaccaggagaa

SEQ ID NO: 371713 - RNA, 63 nt, Homo Sapiens
uauauagaagucacaaguaguaucuauacacaaaacgguuauuuuuucaagcaacucaaagau

SEQ ID NO: 371714 - RNA, 64 nt, Homo Sapiens
cucaaacucuccaguguggugugaacucagaagaaacgguuacuggggcugcauggagaauuuc

SEQ ID NO: 371715 - RNA, 64 nt, Homo Sapiens
cggaggucaaggccuugggcucuccccagggucuaacgguuaaggggacccacauaccagugcc

SEQ ID NO: 371716 - RNA, 64 nt, Homo Sapiens
uuacaggcauugcaggaugguuaacuauuaaauaaacgguuauucacuggaguuuuuuuuuuuu

SEQ ID NO: 371717 - RNA, 64 nt, Homo Sapiens
cuuaggugccauggaucgauguuaaaaacguggcaacgguuacucugcugagaauaaaugucuu

SEQ ID NO: 371718 - RNA, 64 nt, Homo Sapiens
aaguuuuguaccauuuauuuuauauagccggauuaacgguuauacuagugacauguacauacug

SEQ ID NO: 371719 - RNA, 64 nt, Homo Sapiens
guuugaagaaauaacaaauuaaaagcuauauauaaacgguuaacaauauuagguggacauauuu

SEQ ID NO: 371720 - RNA, 64 nt, Homo Sapiens
uuucauuguaggaucagcagcagguuaaagacugaacgguuagugaagacaaaugucuuaagag

SEQ ID NO: 371721 - RNA, 64 nt, Homo Sapiens
aauucuuugagaccuucguauaauauuuuuggauaacgguuauuucacucagccuuaaauguua

SEQ ID NO: 371722 - RNA, 64 nt, Homo Sapiens
cuguaaugaaaguuguaaauuaauaauaaaauguaacgguuauaaagagauugacaacaauaac

SEQ ID NO: 371723 - RNA, 64 nt, Homo Sapiens
uuuuaagugaauuuuugaccuuaucuuaauggaaaacgguuaacuccaaacacaaaagacucua

SEQ ID NO: 371724 - RNA, 64 nt, Homo Sapiens
aaggaaaacuggaaauacugaaggggacugcguuaacgguuacucugagaagaaaaaaaagagg

SEQ ID NO: 371725 - RNA, 64 nt, Homo Sapiens
aauaccucugucuuguggcuguagaauaaagaaaaacgguuauaguuucugggugccccacuaa

SEQ ID NO: 371726 - RNA, 64 nt, Homo Sapiens
aaagcacuuaaacagaagcauuagccugagucauaacgguuaaguguuuaaaaacuucaucgac

SEQ ID NO: 371727 - RNA, 64 nt, Homo Sapiens
acauuauuagauuacuuuaauugagauuuguuaaaacgguuaggacuguuuuguccaggaaaga

SEQ ID NO: 371728 - RNA, 64 nt, Homo Sapiens
acgcgcucuacauccgcuuucacaaugguuagggaacgguuagagccccggccuuucgcgguga

SEQ ID NO: 371729 - RNA, 64 nt, Homo Sapiens
uguaacguuuucuuucacacgugagagcaauuguaacgguuaacggaugaggugguggagugga

SEQ ID NO: 371730 - RNA, 64 nt, Homo Sapiens
ugugauaucaaugaagaaauauuuguagcauguaaacgguuauuucuguuucuuaaaaaguauu

SEQ ID NO: 371731 - RNA, 64 nt, Homo Sapiens
acccgugaacaacuuugucagguucacguccuauaacgguuaaaaaacacacacacacauacac

SEQ ID NO: 371732 - RNA, 64 nt, Homo Sapiens
gagcucugccuguuggagcuuccaaagccuggggaacgguuaggcucaccuucuccuucuugau

SEQ ID NO: 371733 - RNA, 64 nt, Homo Sapiens
ucaagucccauggcacagagcaaggcgggcagggaacgguuauuuuucuaaauaaaugcuuuaa

SEQ ID NO: 371734 - RNA, 64 nt, Homo Sapiens
ucuucucuuguguauaugcaccuucucacccaguaacgguuaacccucugcugaagccuuaccu

SEQ ID NO: 371735 - RNA, 64 nt, Homo Sapiens
auuuuaaaaacaaguugacuuuuucaguuucuugaacgguuaaggguggauuuaaaaacuagac

SEQ ID NO: 371736 - RNA, 64 nt, Homo Sapiens
cuauaaaaucugcuuuucacgccccucauuuaaaaacgguuauacagccacugcccucucuuag

SEQ ID NO: 371737 - RNA, 64 nt, Homo Sapiens
acugucccuuucugugugaaacaugaaaacagaaaacgguuaaacggccaacaguuaaaugaga

SEQ ID NO: 371738 - RNA, 64 nt, Homo Sapiens
gugauacugccaaagaacuguucugacuucaaucaacgguuaguaggauuagaaaacucuaaag

SEQ ID NO: 371739 - RNA, 64 nt, Homo Sapiens
uguaaggaaccgaugggccauuaaacaugaacugaacgguuaaaagcacagucuauggaacgcu

SEQ ID NO: 371740 - RNA, 64 nt, Homo Sapiens
aaacuguuuuuggaaauucacagccacacucuucaacgguuaccugugcagagggacaaagcca

SEQ ID NO: 371741 - RNA, 64 nt, Homo Sapiens
auauguuggaaaacagcuguauacauuuuugggcaacgguuaugcauaauauuuaccaggagaa

SEQ ID NO: 371742 - RNA, 64 nt, Homo Sapiens
uauauagaagucacaaguaguuaucuauacacaaaacgguuauuauuuucaagcaacucaaaga

SEQ ID NO: 371743 - RNA, 65 nt, Homo Sapiens
ucucaaacucuccaguguggugugaacucagaagaaacgguuacuggggcugcauggagaauuuc

SEQ ID NO: 371744 - RNA, 65 nt, Homo Sapiens
ccggaggucaaggccuugggcucuccccagggucuaacgguuaaggggacccacauaccagugcc

SEQ ID NO: 371745 - RNA, 65 nt, Homo Sapiens
uuacaggcauugcaggaugguuuaacuauuaaauaaacgguuauuucacuggaguuuuuuuuuuu

SEQ ID NO: 371746 - RNA, 65 nt, Homo Sapiens
cuuaggugccauggaucgauuguuaaaaacguggcaacgguuacugcugcugagaauaaaugucu

SEQ ID NO: 371747 - RNA, 65 nt, Homo Sapiens
aaguuuuguaccauuuauuuguauauagccggauuaacgguuauagcuagugacauguacauacu

SEQ ID NO: 371748 - RNA, 65 nt, Homo Sapiens
gguuugaagaaauaacaaauuaaaagcuauauauaaacgguuaacaauauuagguggacauauuu

SEQ ID NO: 371749 - RNA, 65 nt, Homo Sapiens
uuuucauuguaggaucagcagcagguuaaagacugaacgguuagugaagacaaaugucuuaagag

SEQ ID NO: 371750 - RNA, 65 nt, Homo Sapiens
aauucuuugagaccuucguaauaauauuuuuggauaacgguuauuuucacucagccuuaaauguu

SEQ ID NO: 371751 - RNA, 65 nt, Homo Sapiens
cuguaaugaaaguuguaaaucuaauaauaaaauguaacgguuauauaagagauugacaacaauaa

SEQ ID NO: 371752 - RNA, 65 nt, Homo Sapiens
guuuuaagugaauuuuugaccuuaucuuaauggaaaacgguuaacuccaaacacaaaagacucua

SEQ ID NO: 371753 - RNA, 65 nt, Homo Sapiens
aaggaaaacuggaaauacuggaaggggacugcguuaacgguuacuucugagaagaaaaaaaagag

SEQ ID NO: 371754 - RNA, 65 nt, Homo Sapiens
aauaccucugucuuguggcuaguagaauaaagaaaaacgguuauaaguuucugggugccccacua

SEQ ID NO: 371755 - RNA, 65 nt, Homo Sapiens
aaagcacuuaaacagaagcacuuagccugagucauaacgguuaagauguuuaaaaacuucaucga

SEQ ID NO: 371756 - RNA, 65 nt, Homo Sapiens
uacauuauuagauuacuuuaauugagauuuguuaaaacgguuaggacuguuuuguccaggaaaga

SEQ ID NO: 371757 - RNA, 65 nt, Homo Sapiens
acgcgcucuacauccgcuuuacacaaugguuagggaacgguuagaagccccggccuuucgcggug

SEQ ID NO: 371758 - RNA, 65 nt, Homo Sapiens
uguaacguuuucuuucacacagugagagcaauuguaacgguuaacaggaugaggugguggagugg

SEQ ID NO: 371759 - RNA, 65 nt, Homo Sapiens
augugauaucaaugaagaaauauuuguagcauguaaacgguuauuucuguuucuuaaaaaguauu

SEQ ID NO: 371760 - RNA, 65 nt, Homo Sapiens
gacccgugaacaacuuugucagguucacguccuauaacgguuaaaaaacacacacacacauacac

SEQ ID NO: 371761 - RNA, 65 nt, Homo Sapiens
gagcucugccuguuggagcuuuccaaagccuggggaacgguuaggccucaccuucuccuucuuga

SEQ ID NO: 371762 - RNA, 65 nt, Homo Sapiens
cucaagucccauggcacagagcaaggcgggcagggaacgguuauuuuucuaaauaaaugcuuuaa

SEQ ID NO: 371763 - RNA, 65 nt, Homo Sapiens
ucuucucuuguguauaugcauccuucucacccaguaacgguuaacuccucugcugaagccuuacc

SEQ ID NO: 371764 - RNA, 65 nt, Homo Sapiens
uauuuuaaaaacaaguugacuuuuucaguuucuugaacgguuaaggguggauuuaaaaacuagac

SEQ ID NO: 371765 - RNA, 65 nt, Homo Sapiens
cuauaaaaucugcuuuucacggccccucauuuaaaaacgguuauaccagccacugcccucucuua

SEQ ID NO: 371766 - RNA, 65 nt, Homo Sapiens
acugucccuuucugugugaaaacaugaaaacagaaaacgguuaaaccggccaacaguuaaaugag

SEQ ID NO: 371767 - RNA, 65 nt, Homo Sapiens
gugauacugccaaagaacugguucugacuucaaucaacgguuaguaaggauuagaaaacucuaaa

SEQ ID NO: 371768 - RNA, 65 nt, Homo Sapiens
auguaaggaaccgaugggccauuaaacaugaacugaacgguuaaaagcacagucuauggaacgcu

SEQ ID NO: 371769 - RNA, 65 nt, Homo Sapiens
aaacuguuuuuggaaauucaacagccacacucuucaacgguuaccuugugcagagggacaaagcc

SEQ ID NO: 371770 - RNA, 65 nt, Homo Sapiens
aauauguuggaaaacagcuguauacauuuuugggcaacgguuaugcauaauauuuaccaggagaa

SEQ ID NO: 371771 - RNA, 65 nt, Homo Sapiens
uauauagaagucacaaguagauuaucuauacacaaaacgguuauuaauuuucaagcaacucaaag

SEQ ID NO: 371772 - RNA, 65 nt, Homo Sapiens
caaaagagggugcaagaaugugggaguaugucugccgguuucaacacacacagacaaacacagcc

SEQ ID NO: 371773 - RNA, 65 nt, Homo Sapiens
uccccacuugccagucaacuggaccccuuccuccucgguuucagacugccuacauuaggaaacaa

SEQ ID NO: 371774 - RNA, 65 nt, Homo Sapiens
cagcaaagcaaauguugggaaaguauuuacuuuuucgguuucaaagugauagaaaaguguggcuu

SEQ ID NO: 371775 - RNA, 65 nt, Homo Sapiens
auauguaacaucucuccugaucagugccauucccacgguuucaaagaaaacagcuacaaggaaug

SEQ ID NO: 371776 - RNA, 65 nt, Homo Sapiens
uuuucuguggcaaacagggcugacucagaaaccugcgguuucagcagggauugggcgguguaaau

SEQ ID NO: 371777 - RNA, 65 nt, Homo Sapiens
auguuggccaggcuggucucuuuuuaguauagacacgguuucacccuggcuaauuuuuuugugug

SEQ ID NO: 371778 - RNA, 56 nt, Homo Sapiens
aaaacccaaugauuacccuucuuuuccgguuucagaaaaaagagagagacucguga

SEQ ID NO: 371779 - RNA, 65 nt, Homo Sapiens
caguuaaguccauucucugguacuagcuacaaauucgguuucauauucuacuuaacaauuuaaau

SEQ ID NO: 371780 - RNA, 65 nt, Homo Sapiens
auaguuauuagaaucagcagccucuuaacuaauugcgguuucauaggauauauaaauguuucaag

SEQ ID NO: 371781 - RNA, 65 nt, Homo Sapiens
uuuuaaaucuggcagagccugaaguaaaauacgaucgguuucauaucuccuguauucuuguuccc

SEQ ID NO: 371782 - RNA, 65 nt, Homo Sapiens
guucaaaacggggggaguuuaggagacuuuaaucccgguuucagaagcugcagcuggucuguuuc

SEQ ID NO: 371783 - RNA, 65 nt, Homo Sapiens
ugagcauaagaccuugaugugugauuccugaugaccgguuucauuuauucauguuauaaagcaaa

SEQ ID NO: 371784 - RNA, 65 nt, Homo Sapiens
uuuguugauucugcccaucuaaauguguccucaggcgguuucauccccuagaaauguuacuuguu

SEQ ID NO: 371785 - RNA, 65 nt, Homo Sapiens
ccuuugaacugguaugguuucaccaaagcaaagaacgguuucagaauuuauuuuaaccaaacauu

SEQ ID NO: 371786 - RNA, 65 nt, Homo Sapiens
uaaaaaguaacuuuuuuuuugcaguguucuuuaaacgguuucauuagaccacauauuuuuauuca

SEQ ID NO: 371787 - RNA, 65 nt, Homo Sapiens
gcaccauguguuugcuuuguaagcugguaacaccucgguuucaguaaauggcagaacaguaugua

SEQ ID NO: 371788 - RNA, 65 nt, Homo Sapiens
gcuuguagcuggacagagucaaaaagaagaaaauacgguuucaggcuuucuugcagauaugaagu

SEQ ID NO: 371789 - RNA, 65 nt, Homo Sapiens
uuccucuaaacuucucacccguucuaccauuaccacgguuucagcaccucagccaucuguagaag

SEQ ID NO: 371790 - RNA, 65 nt, Homo Sapiens
cuagcucauuuaacagauaaagaaacugaggcccacgguuucagcuagacaaugauuuggccagg

SEQ ID NO: 371791 - RNA, 65 nt, Homo Sapiens
ggaugggugaaugaugaaagcucuucugcaugagccgguuucaucaucuuggguggguugauuac

SEQ ID NO: 371792 - RNA, 65 nt, Homo Sapiens
ucuggauauuuuuauaaaacuaguuacauuauaaacgguuucaaacauguuuaauuuacauuagg

SEQ ID NO: 371793 - RNA, 65 nt, Homo Sapiens
cauuuuuuuaaagggcauuuauuuuugcuauuguacgguuucaugaauacagucugugcucuuug

SEQ ID NO: 371794 - RNA, 65 nt, Homo Sapiens
uuuccggccuccacagcuguugcuugcugaccccccgguuucagauucacaggggggcacggccc

SEQ ID NO: 371795 - RNA, 65 nt, Homo Sapiens
cacccgccaggcggaaagucacccuguucccagcgcgguuucagcauuuaauuuuaagggagcua

SEQ ID NO: 371796 - RNA, 65 nt, Homo Sapiens
cugaaaacauguuucacaggcuaugaagaaagauacgguuucagaaaauuacuuuaugucagguc

SEQ ID NO: 371797 - RNA, 65 nt, Homo Sapiens
aagaaacaaugcaagacauacauuuccacuauggucgguuucaggaauuucaaaagaaaucugac

SEQ ID NO: 371798 - RNA, 65 nt, Homo Sapiens
aaaacugaauagcaaauaguuuauugguaaguacacgguuucaacgggaguaauaaauucacaug

SEQ ID NO: 371799 - RNA, 65 nt, Homo Sapiens
gacagccgagaauaauguugaagccagaaguugggcgguuucaggcacuuuggguccagcugugg

SEQ ID NO: 371800 - RNA, 65 nt, Homo Sapiens
ggcgcaacaaagcaccacuugacccacccagggagcgguuucaguccaacacaugauacggggaa

SEQ ID NO: 371801 - RNA, 65 nt, Homo Sapiens
ggguggccccucucucucucaacaaaaaguuguuacgguuucauguuccaauuuacuggauuuaa

SEQ ID NO: 371802 - RNA, 65 nt, Homo Sapiens
ugacaccauucccucuccauuggcuguagaucucucgguuucaguccuuugggaagccccaucua

SEQ ID NO: 371803 - RNA, 65 nt, Homo Sapiens
cccuuucaacaguuuugccacugaccggauagaaacgguuucagucucuggauggauguguuugu

SEQ ID NO: 371804 - RNA, 65 nt, Homo Sapiens
guuguauauauaaauaugcacccuaaguuauugaccgguuucaguuacaggucacuccgagaagc

SEQ ID NO: 371805 - RNA, 65 nt, Homo Sapiens
ucccagccuccacccgggugucuccugccuggguucgguuucagcugcaccuccgccgucgccca

SEQ ID NO: 371806 - RNA, 65 nt, Homo Sapiens
ugauuuuguucuaguuuuugugccagcugauaacucgguuucacacuuacagaccaguucaucaa

SEQ ID NO: 371807 - RNA, 65 nt, Homo Sapiens
cacgcccagcuaauuuuuuguauuuuuaguagagacgguuucaccguguuagccaggauggucuc

SEQ ID NO: 371808 - RNA, 65 nt, Homo Sapiens
uggagaauucucuuaguaaacacaaaagauuguuacgguuucauuaguaguaugguuguggggcc

SEQ ID NO: 371809 - RNA, 65 nt, Homo Sapiens
gacgcaaccuuaacuuacuacaagacaaggugcaccgguuucauacuuuuuaaagcucguagaaa

SEQ ID NO: 371810 - RNA, 65 nt, Homo Sapiens
aaaugaagcugaaagggguguuuuacaucuguaaacgguuucaaacagguagagagaaaaacacc

SEQ ID NO: 371811 - RNA, 65 nt, Homo Sapiens
uacuuugacuaauacccaaacccuaaaccucuucacgguuucacuuuuaagacuuaaucuuugcu

SEQ ID NO: 371812 - RNA, 65 nt, Homo Sapiens
agacacagagaccacauagcccagugauuaaaccccgguuucacucuggccccaggaguggagcc

SEQ ID NO: 371813 - RNA, 65 nt, Homo Sapiens
gcaacuggauggucugcuuuuguaaugaauauaaucgguuucaguccggacagugauuaaaacua

SEQ ID NO: 371814 - RNA, 65 nt, Homo Sapiens
gcagggaauuaugggagaagugggggcagcccaggcgguuucacgccccacacuuuguacagacc

SEQ ID NO: 371815 - RNA, 65 nt, Homo Sapiens
uucuuuauaaaguucaccucugagaguaaccaaaucgguuucaucccauaucaaaaagccuuugg

SEQ ID NO: 371816 - RNA, 65 nt, Homo Sapiens
ccaggauuuuguguuuuuucccuuuggggcaacgacgguuucaaaggguuuccacaguugcugcu

SEQ ID NO: 371817 - RNA, 65 nt, Homo Sapiens
uccccgauuccgugcccacuucugauggaaaauggcgguuucaaggauugauucucaccagcguu

SEQ ID NO: 371818 - RNA, 65 nt, Homo Sapiens
cccagaugugccccagagcaugacgccugcagcuccgguuucaugcaggaaauugguuuuggaga

SEQ ID NO: 371819 - RNA, 65 nt, Homo Sapiens
caacguuccacaacagucccgcugggggauugaagcgguuucacuccgcaaauauccuccacuuu

SEQ ID NO: 371820 - RNA, 65 nt, Homo Sapiens
cgccuggcuaauuuuuuguauuuuuaguagagacucgguuucaccauguuggucaggcuggcuuu

SEQ ID NO: 371821 - RNA, 65 nt, Homo Sapiens
uccacucaagagucacaaggcccgcugugcauaaucgguuucacuuuuaccuuuuuuuuuuuuuu

SEQ ID NO: 371822 - RNA, 65 nt, Homo Sapiens
gaaauuaaauccaaaaaguugggaaauguuaucaacgguuucauuuugccagagauuguugcgga

SEQ ID NO: 371823 - RNA, 65 nt, Homo Sapiens
aaguuaugaugcuugaaaguucucaauaaaguucacgguuucauuaccacauuguguugcaguag

SEQ ID NO: 371824 - RNA, 64 nt, Homo Sapiens; identical to SEQ ID NO: 218381

SEQ ID NO: 371825 - RNA, 64 nt, Homo Sapiens; identical to SEQ ID NO: 218382

SEQ ID NO: 371826 - RNA, 64 nt, Homo Sapiens; identical to SEQ ID NO: 218383

SEQ ID NO: 371827 - RNA, 64 nt, Homo Sapiens; identical to SEQ ID NO: 218384

SEQ ID NO: 371828 - RNA, 64 nt, Homo Sapiens; identical to SEQ ID NO: 218385

SEQ ID NO: 371829 - RNA, 64 nt, Homo Sapiens; identical to SEQ ID NO: 218386

SEQ ID NO: 371830 - RNA, 64 nt, Homo Sapiens; identical to SEQ ID NO: 218387

SEQ ID NO: 371831 - RNA, 64 nt, Homo Sapiens; identical to SEQ ID NO: 218388

SEQ ID NO: 371832 - RNA, 64 nt, Homo Sapiens; identical to SEQ ID NO: 218389

SEQ ID NO: 371833 - RNA, 64 nt, Homo Sapiens; identical to SEQ ID NO: 218390

SEQ ID NO: 371834 - RNA, 64 nt, Homo Sapiens; identical to SEQ ID NO: 218391

SEQ ID NO: 371835 - RNA, 64 nt, Homo Sapiens; identical to SEQ ID NO: 218392

SEQ ID NO: 371836 - RNA, 64 nt, Homo Sapiens; identical to SEQ ID NO: 218393

SEQ ID NO: 371837 - RNA, 64 nt, Homo Sapiens; identical to SEQ ID NO: 218394

SEQ ID NO: 371838 - RNA, 64 nt, Homo Sapiens; identical to SEQ ID NO: 218395

SEQ ID NO: 371839 - RNA, 64 nt, Homo Sapiens; identical to SEQ ID NO: 218396

SEQ ID NO: 371840 - RNA, 64 nt, Homo Sapiens; identical to SEQ ID NO: 218397

SEQ ID NO: 371841 - RNA, 64 nt, Homo Sapiens; identical to SEQ ID NO: 218398

SEQ ID NO: 371842 - RNA, 64 nt, Homo Sapiens; identical to SEQ ID NO: 218399

SEQ ID NO: 371843 - RNA, 64 nt, Homo Sapiens; identical to SEQ ID NO: 218400

SEQ ID NO: 371844 - RNA, 64 nt, Homo Sapiens; identical to SEQ ID NO: 218401

SEQ ID NO: 371845 - RNA, 64 nt, Homo Sapiens; identical to SEQ ID NO: 218402

SEQ ID NO: 371846 - RNA, 64 nt, Homo Sapiens; identical to SEQ ID NO: 218403

SEQ ID NO: 371847 - RNA, 64 nt, Homo Sapiens; identical to SEQ ID NO: 218404

SEQ ID NO: 371848 - RNA, 64 nt, Homo Sapiens; identical to SEQ ID NO: 218405

SEQ ID NO: 371849 - RNA, 64 nt, Homo Sapiens; identical to SEQ ID NO: 218406

SEQ ID NO: 371850 - RNA, 64 nt, Homo Sapiens; identical to SEQ ID NO: 218407

SEQ ID NO: 371851 - RNA, 64 nt, Homo Sapiens; identical to SEQ ID NO: 218408

SEQ ID NO: 371852 - RNA, 64 nt, Homo Sapiens; identical to SEQ ID NO: 218409

SEQ ID NO: 371853 - RNA, 64 nt, Homo Sapiens; identical to SEQ ID NO: 218410

SEQ ID NO: 371854 - RNA, 64 nt, Homo Sapiens; identical to SEQ ID NO: 218411

SEQ ID NO: 371855 - RNA, 64 nt, Homo Sapiens; identical to SEQ ID NO: 218412

SEQ ID NO: 371856 - RNA, 64 nt, Homo Sapiens; identical to SEQ ID NO: 218413

SEQ ID NO: 371857 - RNA, 64 nt, Homo Sapiens; identical to SEQ ID NO: 218414

SEQ ID NO: 371858 - RNA, 64 nt, Homo Sapiens; identical to SEQ ID NO: 218415

SEQ ID NO: 371859 - RNA, 64 nt, Homo Sapiens; identical to SEQ ID NO: 218416

SEQ ID NO: 371860 - RNA, 64 nt, Homo Sapiens
ggcacuucagauauuauauccacuaaaaugauuugugagaaacuaaucacuagauuuaaauaau

SEQ ID NO: 371861 - RNA, 64 nt, Homo Sapiens
cuggccuaaacaauccauccggaaagaagaaagggugagaaaccaccacucgucacguguguug

SEQ ID NO: 371862 - RNA, 64 nt, Homo Sapiens
agaaauaaaauccauucucacggcaggcaaaucagugagaaaaauguaaagaucuggaggauuu

SEQ ID NO: 371863 - RNA, 64 nt, Homo Sapiens
cugcuuuucuaggaauugacuccaaugcagaauagugagaaaucaacaaaaagcaaaauaagac

SEQ ID NO: 371864 - RNA, 64 nt, Homo Sapiens
agcugguuuagaaaaguuuaaauaaauacugucugugagaaaccgucuuaaauuauuuuaaaaa

SEQ ID NO: 371865 - RNA, 64 nt, Homo Sapiens
ucacuuggauguuauguaaggccaagguagcacugugagaaauccuagauauuuuuaguuuguu

SEQ ID NO: 371866 - RNA, 64 nt, Homo Sapiens
uauuaaaauauaguucuaaauuaaauauuagaaugugagaaauuuaaaauuuaaaaaauaaaaa

SEQ ID NO: 371867 - RNA, 64 nt, Homo Sapiens
uucugagggcuuuuuuuuuuuaguugccuuauuugugagaaauugauuuugagauaucaggcau

SEQ ID NO: 371868 - RNA, 64 nt, Homo Sapiens
auuccugaaaguagaacugaguuggaagauguaggugagaaaauauucaaaaguaauuaauagu

SEQ ID NO: 371869 - RNA, 64 nt, Homo Sapiens
uauguuucguaaauauuugcggcaucuauguaaagugagaaaaauuuuuacaaaugaaaugaua

SEQ ID NO: 371870 - RNA, 64 nt, Homo Sapiens
ucaaaccucauucgacaccagagaauucauacgggugagaaacccuaugcauguacaguaugug

SEQ ID NO: 371871 - RNA, 64 nt, Homo Sapiens
ucauuacuuauuauacauaugagaagucauacuggugagaaacccuuugaauguaaugaaugug

SEQ ID NO: 371872 - RNA, 64 nt, Homo Sapiens
cuaugaauguaaugaaugugaagaauuccuacuggugagaaaccgcgcaucuuacucaacauca

SEQ ID NO: 371873 - RNA, 64 nt, Homo Sapiens
cuuugaaugucaggaauguagagaauucacacuggugagaaaccuuguucaacucuuaacacca

SEQ ID NO: 371874 - RNA, 64 nt, Homo Sapiens
guaucaguguaaaaaauguagagaauucacacuagugagaaaccuccuaccuuaauagaaauca

SEQ ID NO: 371875 - RNA, 64 nt, Homo Sapiens
cuaugaguuuaaggaaugugaaauauucauacuggugagaaaccgcccaucuuagucaacauca

SEQ ID NO: 371876 - RNA, 64 nt, Homo Sapiens
uuuuauaucacuaaaauaagaucauguuuuaauugugagaaacagggccgagcacaguggcuca

SEQ ID NO: 371877 - RNA, 64 nt, Homo Sapiens
agacuccaucucaaaaaaaaaaaaaaaaaaaauugugagaaacagaaauacuuaaaaugaggaa

SEQ ID NO: 371878 - RNA, 64 nt, Homo Sapiens
uauauccaguaauaguauuguucauuucucuaaugugagaaaaauauguuuuauugaaauuaga

SEQ ID NO: 371879 - RNA, 64 nt, Homo Sapiens
guagauuggugaagacagacgcaucuggagacaagugagaaacaaacuucugucaaucauggac

SEQ ID NO: 371880 - RNA, 64 nt, Homo Sapiens
guaauauuuggccauuauucguauucauaggaaagugagaaacuacaugaaauaaacagugcca

SEQ ID NO: 371881 - RNA, 64 nt, Homo Sapiens
gacugugaauucaaaacaaucucuuaagguuuuugugagaaaaguguauuaugaauucuuugaa

SEQ ID NO: 371882 - RNA, 64 nt, Homo Sapiens
gucaguuacaacuugucugucacgaggacauaguggucaccacuagggguagcaaaaauaaagu

SEQ ID NO: 371883 - RNA, 64 nt, Homo Sapiens
caggguggcuccccagguccggccgaggacgaguggucaccaaacaaagcccuuguguugaaaa

SEQ ID NO: 371884 - RNA, 64 nt, Homo Sapiens
aucgcccgaucacagacgaggaucacagacgagcggucaccagaagcagucaucggacucaccc

SEQ ID NO: 371885 - RNA, 64 nt, Homo Sapiens
cucgcccgaucacagacgaggaucacagacgagcggucaccagaagcagucaucggacucaccc

SEQ ID NO: 371886 - RNA, 64 nt, Homo Sapiens
ggaacaagucauucugaaaggucccucugacccaggucaccaaauuugggccagaacuggcacu

SEQ ID NO: 371887 - RNA, 64 nt, Homo Sapiens
guuacggacuucccggccgccacugggcccugccggucaccaggccacugugcagugggcgcag

SEQ ID NO: 371888 - RNA, 64 nt, Homo Sapiens
aggcuguuuacaaagcagaaucuugggugcugugggucaccaaccauucucccaaacuaaugau

SEQ ID NO: 371889 - RNA, 64 nt, Homo Sapiens
acaauuaauuguaauuaagguugaggagaaugauggucaccaccucuucuuucucucuuuuucu

SEQ ID NO: 371890 - RNA, 64 nt, Homo Sapiens
gaaaguuccuuuccccaguucugguuaaguauagggucaccagauuaagaugauugaagcuuua

SEQ ID NO: 371891 - RNA, 64 nt, Homo Sapiens
aaaccuguucuuuaaucaagccuuggcucccucaggucaccaauagugagggucacaaaggaga

SEQ ID NO: 371892 - RNA, 64 nt, Homo Sapiens
auucauuguaagguuuaauacaauggaaaaucauaugccacaacccagcuaauaaauugucaca

SEQ ID NO: 371893 - RNA, 64 nt, Homo Sapiens
aagggcucuuuuaacuuaagucacagauuugcuaaugccacagaucucucucucacucacucac

SEQ ID NO: 371894 - RNA, 64 nt, Homo Sapiens
aggauagaugcuggcccaggccagcucaggacagaugccacacacuaugcauggugccccagga

SEQ ID NO: 371895 - RNA, 64 nt, Homo Sapiens
gacuuccuguccagcuccaaucuuugggccagacaugccacaagcuaggaaauccauucacagu

SEQ ID NO: 371896 - RNA, 64 nt, Homo Sapiens
caaauaugacucauuugauuauucaucuagaagaaugccacacaaucaaugacagcaucucccc

SEQ ID NO: 371897 - RNA, 64 nt, Homo Sapiens
gccccugcgaagaaaaggcagcaacagagaacguaugccacauacaaagcaauuaauuugagau

SEQ ID NO: 371898 - RNA, 64 nt, Homo Sapiens
cagaccgaggccccagcaggcagcggcuggagggaugccacaccccucacagggcagcccccaa

SEQ ID NO: 371899 - RNA, 64 nt, Homo Sapiens
caucaccagacccugggauuggcuaugggaaagcaugccacagccacucgccuuccuacccccg

SEQ ID NO: 371900 - RNA, 64 nt, Homo Sapiens; identical to SEQ ID NO: 21812

SEQ ID NO: 371901 - RNA, 64 nt, Homo Sapiens; identical to SEQ ID NO: 21813

SEQ ID NO: 371902 - RNA, 64 nt, Homo Sapiens; identical to SEQ ID NO: 21814

SEQ ID NO: 371903 - RNA, 64 nt, Homo Sapiens; identical to SEQ ID NO: 21815

SEQ ID NO: 371904 - RNA, 64 nt, Homo Sapiens; identical to SEQ ID NO: 21816

SEQ ID NO: 371905 - RNA, 64 nt, Homo Sapiens; identical to SEQ ID NO: 21817

SEQ ID NO: 371906 - RNA, 64 nt, Homo Sapiens; identical to SEQ ID NO: 21818

SEQ ID NO: 371907 - RNA, 64 nt, Homo Sapiens; identical to SEQ ID NO: 21819

SEQ ID NO: 371908 - RNA, 64 nt, Homo Sapiens; identical to SEQ ID NO: 21820

SEQ ID NO: 371909 - RNA, 64 nt, Homo Sapiens; identical to SEQ ID NO: 21821

SEQ ID NO: 371910 - RNA, 64 nt, Homo Sapiens; identical to SEQ ID NO: 21822

SEQ ID NO: 371911 - RNA, 64 nt, Homo Sapiens; identical to SEQ ID NO: 21823

SEQ ID NO: 371912 - RNA, 64 nt, Homo Sapiens; identical to SEQ ID NO: 21824

SEQ ID NO: 371913 - RNA, 64 nt, Homo Sapiens; identical to SEQ ID NO: 21825

SEQ ID NO: 371914 - RNA, 64 nt, Homo Sapiens; identical to SEQ ID NO: 21826

SEQ ID NO: 371915 - RNA, 64 nt, Homo Sapiens; identical to SEQ ID NO: 21827

SEQ ID NO: 371916 - RNA, 64 nt, Homo Sapiens; identical to SEQ ID NO: 21828

SEQ ID NO: 371917 - RNA, 64 nt, Homo Sapiens; identical to SEQ ID NO: 21829

SEQ ID NO: 371918 - RNA, 64 nt, Homo Sapiens; identical to SEQ ID NO: 21830

SEQ ID NO: 371919 - RNA, 64 nt, Homo Sapiens; identical to SEQ ID NO: 21831

SEQ ID NO: 371920 - RNA, 50 nt, Homo Sapiens; identical to SEQ ID NO: 21832

SEQ ID NO: 371921 - RNA, 64 nt, Homo Sapiens; identical to SEQ ID NO: 21833

SEQ ID NO: 371922 - RNA, 64 nt, Homo Sapiens; identical to SEQ ID NO: 21834

SEQ ID NO: 371923 - RNA, 64 nt, Homo Sapiens; identical to SEQ ID NO: 21835

SEQ ID NO: 371924 - RNA, 64 nt, Homo Sapiens; identical to SEQ ID NO: 21836

SEQ ID NO: 371925 - RNA, 64 nt, Homo Sapiens; identical to SEQ ID NO: 21837

SEQ ID NO: 371926 - RNA, 64 nt, Homo Sapiens; identical to SEQ ID NO: 21838

SEQ ID NO: 371927 - RNA, 64 nt, Homo Sapiens; identical to SEQ ID NO: 21839

SEQ ID NO: 371928 - RNA, 64 nt, Homo Sapiens; identical to SEQ ID NO: 21840

SEQ ID NO: 371929 - RNA, 64 nt, Homo Sapiens; identical to SEQ ID NO: 21841

SEQ ID NO: 371930 - RNA, 64 nt, Homo Sapiens; identical to SEQ ID NO: 21842

SEQ ID NO: 371931 - RNA, 64 nt, Homo Sapiens; identical to SEQ ID NO: 21843

SEQ ID NO: 371932 - RNA, 64 nt, Homo Sapiens; identical to SEQ ID NO: 21844

SEQ ID NO: 371933 - RNA, 64 nt, Homo Sapiens; identical to SEQ ID NO: 21845

SEQ ID NO: 371934 - RNA, 64 nt, Homo Sapiens; identical to SEQ ID NO: 21846

SEQ ID NO: 371935 - RNA, 64 nt, Homo Sapiens; identical to SEQ ID NO: 21847

SEQ ID NO: 371936 - RNA, 64 nt, Homo Sapiens; identical to SEQ ID NO: 21848

SEQ ID NO: 371937 - RNA, 64 nt, Homo Sapiens; identical to SEQ ID NO: 21849

SEQ ID NO: 371938 - RNA, 64 nt, Homo Sapiens; identical to SEQ ID NO: 21850

SEQ ID NO: 371939 - RNA, 64 nt, Homo Sapiens; identical to SEQ ID NO: 21851

SEQ ID NO: 371940 - RNA, 64 nt, Homo Sapiens; identical to SEQ ID NO: 21852

SEQ ID NO: 371941 - RNA, 64 nt, Homo Sapiens; identical to SEQ ID NO: 21853

SEQ ID NO: 371942 - RNA, 64 nt, Homo Sapiens; identical to SEQ ID NO: 21854

SEQ ID NO: 371943 - RNA, 64 nt, Homo Sapiens; identical to SEQ ID NO: 21855

SEQ ID NO: 371944 - RNA, 64 nt, Homo Sapiens; identical to SEQ ID NO: 21856

SEQ ID NO: 371945 - RNA, 64 nt, Homo Sapiens; identical to SEQ ID NO: 21857

SEQ ID NO: 371946 - RNA, 64 nt, Homo Sapiens; identical to SEQ ID NO: 21858

SEQ ID NO: 371947 - RNA, 64 nt, Homo Sapiens; identical to SEQ ID NO: 21859

SEQ ID NO: 371948 - RNA, 64 nt, Homo Sapiens; identical to SEQ ID NO: 21860

SEQ ID NO: 371949 - RNA, 64 nt, Homo Sapiens; identical to SEQ ID NO: 21861

SEQ ID NO: 371950 - RNA, 64 nt, Homo Sapiens; identical to SEQ ID NO: 21862

SEQ ID NO: 371951 - RNA, 64 nt, Homo Sapiens; identical to SEQ ID NO: 21863

SEQ ID NO: 371952 - RNA, 64 nt, Homo Sapiens; identical to SEQ ID NO: 21864

SEQ ID NO: 371953 - RNA, 64 nt, Homo Sapiens; identical to SEQ ID NO: 21865

SEQ ID NO: 371954 - RNA, 64 nt, Homo Sapiens; identical to SEQ ID NO: 21866

SEQ ID NO: 371955 - RNA, 64 nt, Homo Sapiens; identical to SEQ ID NO: 21867

SEQ ID NO: 371956 - RNA, 64 nt, Homo Sapiens; identical to SEQ ID NO: 21868

SEQ ID NO: 371957 - RNA, 64 nt, Homo Sapiens; identical to SEQ ID NO: 21869

SEQ ID NO: 371958 - RNA, 64 nt, Homo Sapiens; identical to SEQ ID NO: 21870

SEQ ID NO: 371959 - RNA, 64 nt, Homo Sapiens; identical to SEQ ID NO: 21871

SEQ ID NO: 371960 - RNA, 64 nt, Homo Sapiens; identical to SEQ ID NO: 21872

SEQ ID NO: 371961 - RNA, 64 nt, Homo Sapiens; identical to SEQ ID NO: 21873

SEQ ID NO: 371962 - RNA, 64 nt, Homo Sapiens; identical to SEQ ID NO: 21874

SEQ ID NO: 371963 - RNA, 64 nt, Homo Sapiens
uuuuguaacugugugcuuauaguuuacaagugagacccgauaugucauuaugcauacuuauauu

SEQ ID NO: 371964 - RNA, 64 nt, Homo Sapiens
agcccaucacaacuccaaaguggccaccggaaucacccgauaacaucacccgaucacagacgag

SEQ ID NO: 371965 - RNA, 64 nt, Homo Sapiens
gacuuauuaacuauauugaaagcuggcaccagagacccgauaggaagaaaguuauaccauuuaa

SEQ ID NO: 371966 - RNA, 64 nt, Homo Sapiens
cauguuuguagugagagaaaaaaaccccaagguaacccgauaugauuuaggaugcauaucaguu

SEQ ID NO: 371967 - RNA, 64 nt, Homo Sapiens
uucauuugaagguguguuagaggaugggguaaauacccgauagcugucuuuuuggugaaagaaa

SEQ ID NO: 371968 - RNA, 64 nt, Homo Sapiens
gaggcaggccucugccuacuuuagaaguuaaaccacccgauaggccuucgagcaaaagcaaaga

SEQ ID NO: 371969 - RNA, 64 nt, Homo Sapiens
uuuauuuuauuucuuauuuaagugcuucagccccacccgauaaugacuauuuagccucuccccc

SEQ ID NO: 371970 - RNA, 64 nt, Homo Sapiens
aucaggaacaugauauaggagcuaauaaaaugaaacccgauaaauaguucuaauccaauacaau

SEQ ID NO: 371971 - RNA, 64 nt, Homo Sapiens
cuccgauggguaggaauugucacauacccaugugacccgauaggaggcaaaagaaaugagacuu

SEQ ID NO: 371972 - RNA, 64 nt, Homo Sapiens
ucccaaaagggggaggaaugaacaucaggaaguuacccgauaugcaguuuacaaaugccauggc

SEQ ID NO: 371973 - RNA, 64 nt, Homo Sapiens
acugcccacaggcucagccagaaccucuugguguacccgauaagcugcagguuaucccuugcuc

SEQ ID NO: 371974 - RNA, 64 nt, Homo Sapiens; identical to SEQ ID NO: 253872

SEQ ID NO: 371975 - RNA, 64 nt, Homo Sapiens; identical to SEQ ID NO: 253873

SEQ ID NO: 371976 - RNA, 64 nt, Homo Sapiens; identical to SEQ ID NO: 253874

SEQ ID NO: 371977 - RNA, 64 nt, Homo Sapiens; identical to SEQ ID NO: 253875

SEQ ID NO: 371978 - RNA, 64 nt, Homo Sapiens; identical to SEQ ID NO: 253876

SEQ ID NO: 371979 - RNA, 64 nt, Homo Sapiens; identical to SEQ ID NO: 253877

SEQ ID NO: 371980 - RNA, 64 nt, Homo Sapiens; identical to SEQ ID NO: 253878

SEQ ID NO: 371981 - RNA, 64 nt, Homo Sapiens; identical to SEQ ID NO: 253879

SEQ ID NO: 371982 - RNA, 64 nt, Homo Sapiens; identical to SEQ ID NO: 253880

SEQ ID NO: 371983 - RNA, 64 nt, Homo Sapiens; identical to SEQ ID NO: 253881

SEQ ID NO: 371984 - RNA, 64 nt, Homo Sapiens; identical to SEQ ID NO: 253882

SEQ ID NO: 371985 - RNA, 64 nt, Homo Sapiens; identical to SEQ ID NO: 253883

SEQ ID NO: 371986 - RNA, 64 nt, Homo Sapiens; identical to SEQ ID NO: 253884

SEQ ID NO: 371987 - RNA, 64 nt, Homo Sapiens; identical to SEQ ID NO: 253885

SEQ ID NO: 371988 - RNA, 64 nt, Homo Sapiens
gcagcggcuucgguggguauuuucugccuaagugcuacgugauccucugccgcccagaccucaa

SEQ ID NO: 371989 - RNA, 64 nt, Homo Sapiens
uuggggagaugaggguuggguuuuuuuuuuaaugcuacgugacaguuugaaaccuucacaguua

SEQ ID NO: 371990 - RNA, 64 nt, Homo Sapiens
auuuuguugguguuucagaugggcaguguuauggcuacgugauauuugaagggaaggauaagug

SEQ ID NO: 371991 - RNA, 64 nt, Homo Sapiens
cuucugccaaaaugucgaaaagaagguaaaaucccuacgugaucuuuuaaccuagcauccauga

SEQ ID NO: 371992 - RNA, 64 nt, Homo Sapiens
uagcuuuuucucagauguuguuuuacuuucaguucuacgugaaugguguuugccuuauuuaauu

SEQ ID NO: 371993 - RNA, 64 nt, Homo Sapiens
uugcggugggaccccugaaacuggaccugcauagcuacgugaggccugcacagugagucagcug

SEQ ID NO: 371994 - RNA, 64 nt, Homo Sapiens
agcgcccucaacccugugauacgacauggcugggcuacgugaauccccagagcuuuacagugcc

SEQ ID NO: 371995 - RNA, 64 nt, Homo Sapiens
gauguugagagacagaagccgagagacacagcugcuacgugauagagaggugggugccuggguu

SEQ ID NO: 371996 - RNA, 64 nt, Homo Sapiens
guauaauguuuuucucuucugcagacugucuccucuacgugaccuguaucguguuaauaucagu

SEQ ID NO: 371997 - RNA, 64 nt, Homo Sapiens
ggcggcggcggcugcugggccuccgccuucuuuucuacgugaaaucagugaggugagacuuccc

SEQ ID NO: 371998 - RNA, 64 nt, Homo Sapiens
aaaaaaaacaaaacaaaacuagacaagugagugccuacgugacacucaaauguugccagcauac

SEQ ID NO: 371999 - RNA, 64 nt, Homo Sapiens
gcagguuugggcggcggcgucugcugcugguagccuacgugaguacccuggugcugggccuggc

SEQ ID NO: 372000 - RNA, 64 nt, Homo Sapiens
caaggagacaugggcuagggaccugggccagggccuacgugacacagcugagccaaagaagauc

SEQ ID NO: 372001 - RNA, 64 nt, Homo Sapiens
ucccggggacaguggcugugcaggauaauccaaccuacgugacccuucguugcucaacuaagaa

SEQ ID NO: 372002 - RNA, 64 nt, Homo Sapiens
uuggaagcaccuacaggccauuacauuguucaggcuacgugaacuuuauuuuccucaaguguca

SEQ ID NO: 372003 - RNA, 64 nt, Homo Sapiens
ugcacgcauuuggauaccuugugauuuccaagaacuacgugaagauuaagcuuugcuuacugau

SEQ ID NO: 372004 - RNA, 64 nt, Homo Sapiens
auguggccagggcaugcccgcccagaaaacaguccuacgugaucuuaaaaaucaacuauuacca

SEQ ID NO: 372005 - RNA, 64 nt, Homo Sapiens
ucugcaagacaaagcggcuuguaaaccacaugaacuacgugaccuguuuuaccauccuuacaau

SEQ ID NO: 372006 - RNA, 64 nt, Homo Sapiens
gacaauuucagcuagccacauuuauaucuaaaugcuacgugauaaacaaacuagcaugaggcuu

SEQ ID NO: 372007 - RNA, 64 nt, Homo Sapiens
cgcaauucauguaguuucugggucuucugggagccuacgugaguacaucaccuaacagaauauu

SEQ ID NO: 372008 - RNA, 64 nt, Homo Sapiens
uggcugcacuugaacacugacuucccauccagcucuacgugauucacaaauuccacauagaggc

SEQ ID NO: 372009 - RNA, 64 nt, Homo Sapiens
cugccuugggccucaucugcgaggcugcaguucccuacgugaaccgaccuggggugggcacagg

SEQ ID NO: 372010 - RNA, 64 nt, Homo Sapiens
ucagaagagcacugggcaccugccaagggacuuacuacgugagcggaaacaaggcuggaagagc

SEQ ID NO: 372011 - RNA, 64 nt, Homo Sapiens
uugaucaggucacuagugucccccugcccacucccuacgugacuccuggguucaaguccucagu

SEQ ID NO: 372012 - RNA, 64 nt, Homo Sapiens
uaggaauguuuugagauuaaugugcuuaaaaguccuacgugacugauuuuaaacauugugauaa

SEQ ID NO: 372013 - RNA, 64 nt, Homo Sapiens
aggcucgaggccugcguccaggacuugcagagcccuacgugaagguccagcucaugcugaacca

SEQ ID NO: 372014 - RNA, 64 nt, Homo Sapiens
aaauguucucacuacaaaaaaagaaaaaagauaacuacgugaggugauggauauguuaauuagc

SEQ ID NO: 372015 - RNA, 64 nt, Homo Sapiens
aaaugguauugcaguguggauuuuauugagguagcuacgugauuugcaauguggagacauggag

SEQ ID NO: 372016 - RNA, 64 nt, Homo Sapiens
cauuuuucugugucacuguggacucagcccagaucuacgugagagagcucaagguuuggguggg

SEQ ID NO: 372017 - RNA, 64 nt, Homo Sapiens
uaagucaagcaccuagcacacuguugucagaauucuacgugaugguaugauguaccuugaaggg

SEQ ID NO: 372018 - RNA, 64 nt, Homo Sapiens
acacaaauuugggagggugacuaucugcuuuugccuacgugacaugaccacauagaacaugugu

SEQ ID NO: 372019 - RNA, 64 nt, Homo Sapiens
caacaagaagcaggggccucguguugagcguggccuacgugagcaaggguguggcacaggcuac

SEQ ID NO: 372020 - RNA, 64 nt, Homo Sapiens
gugugucagggggagacuugugaaggguauggaccuacgugaauucauuaacccuuuaggacuc

SEQ ID NO: 372021 - RNA, 64 nt, Homo Sapiens
uucugcuggcagaaagcaaaugugaccugugucacuacgugacuguggcacacgccuuguucuu

SEQ ID NO: 372022 - RNA, 64 nt, Homo Sapiens
aauguccuaaaacuagauuauggcaauaguugcacuacgugaucaguuuauuaaaaaucguuga

SEQ ID NO: 372023 - RNA, 64 nt, Homo Sapiens
uuuaguccucuaccucagagccaaggaguggggucuacgugaccguucaccugccacguucucu

SEQ ID NO: 372024 - RNA, 64 nt, Homo Sapiens
accuccugguaggaucugucacaaaggccuucaccuacgugaaguugcaaccaaaaaggucagc

SEQ ID NO: 372025 - RNA, 64 nt, Homo Sapiens
cacccaugaaauccagacauuuuuauucuugacccuacgugaguuauuucaacagaaaguauuu

SEQ ID NO: 372026 - RNA, 64 nt, Homo Sapiens
uuccuuggcguuguuuaagguugcugggggucuucuacgugaggagcaucugaugccuuuuucu

SEQ ID NO: 372027 - RNA, 64 nt, Homo Sapiens
ugggaaagccuucaguccuuucuguuucuuucaacuacgugaaaggauucacaguggagaaaga

SEQ ID NO: 372028 - RNA, 64 nt, Homo Sapiens
uugggauuccaaagccagcuaggaaucccugucucuacgugaacaaccagacuucauguugcca

SEQ ID NO: 372029 - RNA, 64 nt, Homo Sapiens
ugauugagauguacauaguuccuauuuaaagacacuacgugaucuacagacggcaaugcaauag

SEQ ID NO: 372030 - RNA, 64 nt, Homo Sapiens
aucggggcagguuccccgauaaauagaaaagaaccuacgugaccaaccggccaacacuuaggga

SEQ ID NO: 372031 - RNA, 64 nt, Homo Sapiens
cuuuauguuguguuguuuuguaggcagccccaugcuacgugauuggaaaagaggaccugucaga

SEQ ID NO: 372032 - RNA, 64 nt, Homo Sapiens; identical to SEQ ID NO: 312521

SEQ ID NO: 372033 - RNA, 64 nt, Homo Sapiens; identical to SEQ ID NO: 312522

SEQ ID NO: 372034 - RNA, 64 nt, Homo Sapiens; identical to SEQ ID NO: 312523

SEQ ID NO: 372035 - RNA, 64 nt, Homo Sapiens; identical to SEQ ID NO: 312524

SEQ ID NO: 372036 - RNA, 64 nt, Homo Sapiens; identical to SEQ ID NO: 312525

SEQ ID NO: 372037 - RNA, 64 nt, Homo Sapiens; identical to SEQ ID NO: 312526

SEQ ID NO: 372038 - RNA, 64 nt, Homo Sapiens; identical to SEQ ID NO: 312527

SEQ ID NO: 372039 - RNA, 64 nt, Homo Sapiens; identical to SEQ ID NO: 312528

SEQ ID NO: 372040 - RNA, 64 nt, Homo Sapiens; identical to SEQ ID NO: 312529

SEQ ID NO: 372041 - RNA, 64 nt, Homo Sapiens; identical to SEQ ID NO: 312530

SEQ ID NO: 372042 - RNA, 64 nt, Homo Sapiens; identical to SEQ ID NO: 312531

SEQ ID NO: 372043 - RNA, 64 nt, Homo Sapiens; identical to SEQ ID NO: 312532

SEQ ID NO: 372044 - RNA, 64 nt, Homo Sapiens; identical to SEQ ID NO: 312533

SEQ ID NO: 372045 - RNA, 64 nt, Homo Sapiens; identical to SEQ ID NO: 312534

SEQ ID NO: 372046 - RNA, 64 nt, Homo Sapiens; identical to SEQ ID NO: 312535

SEQ ID NO: 372047 - RNA, 64 nt, Homo Sapiens; identical to SEQ ID NO: 312536

SEQ ID NO: 372048 - RNA, 64 nt, Homo Sapiens; identical to SEQ ID NO: 312537

SEQ ID NO: 372049 - RNA, 64 nt, Homo Sapiens; identical to SEQ ID NO: 312538

SEQ ID NO: 372050 - RNA, 64 nt, Homo Sapiens; identical to SEQ ID NO: 312539

SEQ ID NO: 372051 - RNA, 64 nt, Homo Sapiens; identical to SEQ ID NO: 312540

SEQ ID NO: 372052 - RNA, 64 nt, Homo Sapiens; identical to SEQ ID NO: 312541

SEQ ID NO: 372053 - RNA, 64 nt, Homo Sapiens; identical to SEQ ID NO: 312542

SEQ ID NO: 372054 - RNA, 64 nt, Homo Sapiens; identical to SEQ ID NO: 312543

SEQ ID NO: 372055 - RNA, 64 nt, Homo Sapiens; identical to SEQ ID NO: 312544

SEQ ID NO: 372056 - RNA, 64 nt, Homo Sapiens; identical to SEQ ID NO: 312545

SEQ ID NO: 372057 - RNA, 64 nt, Homo Sapiens; identical to SEQ ID NO: 312546

SEQ ID NO: 372058 - RNA, 64 nt, Homo Sapiens; identical to SEQ ID NO: 312547

SEQ ID NO: 372059 - RNA, 64 nt, Homo Sapiens; identical to SEQ ID NO: 312548

SEQ ID NO: 372060 - RNA, 64 nt, Homo Sapiens; identical to SEQ ID NO: 312549

SEQ ID NO: 372061 - RNA, 64 nt, Homo Sapiens; identical to SEQ ID NO: 312550

SEQ ID NO: 372062 - RNA, 64 nt, Homo Sapiens; identical to SEQ ID NO: 312551

SEQ ID NO: 372063 - RNA, 64 nt, Homo Sapiens; identical to SEQ ID NO: 312552

SEQ ID NO: 372064 - RNA, 64 nt, Homo Sapiens; identical to SEQ ID NO: 312553

SEQ ID NO: 372065 - RNA, 64 nt, Homo Sapiens; identical to SEQ ID NO: 312554

SEQ ID NO: 372066 - RNA, 64 nt, Homo Sapiens; identical to SEQ ID NO: 312555

SEQ ID NO: 372067 - RNA, 64 nt, Homo Sapiens; identical to SEQ ID NO: 312556

SEQ ID NO: 372068 - RNA, 64 nt, Homo Sapiens; identical to SEQ ID NO: 312557

SEQ ID NO: 372069 - RNA, 64 nt, Homo Sapiens; identical to SEQ ID NO: 312558

SEQ ID NO: 372070 - RNA, 64 nt, Homo Sapiens; identical to SEQ ID NO: 312559

SEQ ID NO: 372071 - RNA, 64 nt, Homo Sapiens; identical to SEQ ID NO: 312560

SEQ ID NO: 372072 - RNA, 64 nt, Homo Sapiens; identical to SEQ ID NO: 312561

SEQ ID NO: 372073 - RNA, 64 nt, Homo Sapiens; identical to SEQ ID NO: 312562

SEQ ID NO: 372074 - RNA, 64 nt, Homo Sapiens; identical to SEQ ID NO: 312563

SEQ ID NO: 372075 - RNA, 64 nt, Homo Sapiens; identical to SEQ ID NO: 312564

SEQ ID NO: 372076 - RNA, 64 nt, Homo Sapiens; identical to SEQ ID NO: 312565

SEQ ID NO: 372077 - RNA, 64 nt, Homo Sapiens; identical to SEQ ID NO: 312566

SEQ ID NO: 372078 - RNA, 64 nt, Homo Sapiens; identical to SEQ ID NO: 312567

SEQ ID NO: 372079 - RNA, 64 nt, Homo Sapiens; identical to SEQ ID NO: 312568

SEQ ID NO: 372080 - RNA, 64 nt, Homo Sapiens
gcaccauccaugagaagacgccauggaaugcacgaagucacaauuugguugccauauggaaugg

SEQ ID NO: 372081 - RNA, 64 nt, Homo Sapiens
ccugagggagacacucugucggccugccauagaaaagucacauggcauaaugugacuguaaagg

SEQ ID NO: 372082 - RNA, 64 nt, Homo Sapiens
cauccugcaccugccacuagucccacacacgacaaagucacagaauccugagaaaggucauuuc

SEQ ID NO: 372083 - RNA, 64 nt, Homo Sapiens
cagcaaaugcagggucacauaaugacuugaaaaaaagucacaucaaugagacaauggacguguc

SEQ ID NO: 372084 - RNA, 64 nt, Homo Sapiens
cuuaagacagaauuuuuaacaaaaugagcaguaaaagucacaugaaccacuccaaaaaucagug

SEQ ID NO: 372085 - RNA, 64 nt, Homo Sapiens
ccccagggaggucaauaaugucuuuuaaagccagaagucacauuuuaccaauaugcauuuauca

SEQ ID NO: 372086 - RNA, 64 nt, Homo Sapiens
cagugcugugaucccgagggaaguccuccagucuaagucacagugcccugacaggugagaagca

SEQ ID NO: 372087 - RNA, 64 nt, Homo Sapiens
cugcugcuguugucgugaaauauaauaacaguggaagucacaaaaauguccccugcccagcccc

SEQ ID NO: 372088 - RNA, 64 nt, Homo Sapiens
guuguucuccagugauguagacaguucccuucacaagucacaguucuucccauaaaugaggccc

SEQ ID NO: 372089 - RNA, 64 nt, Homo Sapiens
accuuaggccaggagaugaaggaguucaguagcaaagucacaccuguccaauucccugagcuuu

SEQ ID NO: 372090 - RNA, 64 nt, Homo Sapiens
uagagagagaccacuuuucauaaccuagccuuagaagucacacaguauuacuucugcuacauau

SEQ ID NO: 372091 - RNA, 64 nt, Homo Sapiens
gaaagggcccagagaggguggugaccucugccugaagucacacagugagucgaggacagggagg

SEQ ID NO: 372092 - RNA, 64 nt, Homo Sapiens
gaauguaaauuuuguacaguaaaagugaauaaauaagucacagaacauaaguuacuagaaagug

SEQ ID NO: 372093 - RNA, 64 nt, Homo Sapiens
uuguacaagaaccuuugcuuacuguuucuuccaaaagucacaauaccuuuuguugucaacuguc

SEQ ID NO: 372094 - RNA, 64 nt, Homo Sapiens
gccuuucauccaucuccacucucucaacugccuaaagucacagcacagauacugcccagugccu

SEQ ID NO: 372095 - RNA, 64 nt, Homo Sapiens
cacuauagggggucaauauuuacacaaaaaaggaaagucacaagccuguuuaaaaugaagugac

SEQ ID NO: 372096 - RNA, 64 nt, Homo Sapiens
guuuuagaguaaaacuauuuuuuuccacaccuugaagucacagugcuaaaaaacugaaaggaau

SEQ ID NO: 372097 - RNA, 64 nt, Homo Sapiens
uuguacaaucugcucauguggaagugugaccauaaagucacaucuuucacaagggacaugcuua

SEQ ID NO: 372098 - RNA, 64 nt, Homo Sapiens
uuuuacugucgccauaguuccaugaucuuucuuuggcaaccacuauccauguuccugcaaagga

SEQ ID NO: 372099 - RNA, 64 nt, Homo Sapiens
uuaaaaaaaaaauuagguucuucccuaauccccuggcaaccacuuucaccuguucaucccuuuc

SEQ ID NO: 372100 - RNA, 64 nt, Homo Sapiens
agugaauguggagcugagagauuuucacggagcgggcaaccaaccauuucaagagucuauaucu

SEQ ID NO: 372101 - RNA, 64 nt, Homo Sapiens
acugcagaaaccacuccaggagcugcacccuacaggcaaccagcaguggagaaaugcuggagaa

SEQ ID NO: 372102 - RNA, 64 nt, Homo Sapiens
cgccacagcaaucaggcaagagaaagaaauaaaaggcaaccaaaaagaaaggaagucgaaguau

SEQ ID NO: 372103 - RNA, 64 nt, Homo Sapiens
gugagccgagauccugccacugcacuccagccugggcaaccaagcgagacucugccuuaaaaaa

SEQ ID NO: 372104 - RNA, 64 nt, Homo Sapiens
ucugcuuugauggagaucuguaauaaaagaagguggcaaccaccugaauuucuauugguccaug

SEQ ID NO: 372105 - RNA, 64 nt, Homo Sapiens
uuaaaaugcuguaaccaacuuaucuaauaaaauuggcaaccagccacuauuuuguugacuauga

SEQ ID NO: 372106 - RNA, 64 nt, Homo Sapiens
cuauaaauguuuuucccugcacaacaaaaacagugaaagaaaugcuuaucuguaauuuuguaug

SEQ ID NO: 372107 - RNA, 64 nt, Homo Sapiens
cugagguuuaugaauauucaaaccuuugcugggggaaagaaaugaaaguuaaugagcaugcuug

SEQ ID NO: 372108 - RNA, 64 nt, Homo Sapiens
uuuaauguacagagguagauuucaauuugaaucagaaagaaauaucauuaccaaugaaaugugu

SEQ ID NO: 372109 - RNA, 64 nt, Homo Sapiens
uuguacagaaaugaaaauaaaauaugaaaauaaugaaagaaaugaaaagauagcuuuuaauugu

SEQ ID NO: 372110 - RNA, 56 nt, Homo Sapiens
uugacuuugcagccauguagugaauggaaagaaauuaugcaccuuuuauggaccaa

SEQ ID NO: 372111 - RNA, 64 nt, Homo Sapiens
cccacaaaaccaguauuacuuuuuuuuaaaaaaagaaagaaauuggaaaucugugcuauacgua

SEQ ID NO: 372112 - RNA, 64 nt, Homo Sapiens
uaucuuuccuugccauuucuauggauuuuauaaugaaagaaaaaggcauuggagacugaaggca

SEQ ID NO: 372113 - RNA, 64 nt, Homo Sapiens
gguagaucaaggcuuuguuucauuugaaaaaaaagaaagaaagaaagaaagaaagaaauccuac

SEQ ID NO: 372114 - RNA, 64 nt, Homo Sapiens
gaucaaggcuuuguuucauuugaaaaaaaagaaagaaagaaagaaagaaagaaauccuacuacg

SEQ ID NO: 372115 - RNA, 64 nt, Homo Sapiens
aaggcuuuguuucauuugaaaaaaaagaaagaaagaaagaaagaaagaaauccuacuacgagcg

SEQ ID NO: 372116 - RNA, 64 nt, Homo Sapiens
cuuuguuucauuugaaaaaaaagaaagaaagaaagaaagaaagaaauccuacuacgagcgauca

SEQ ID NO: 372117 - RNA, 64 nt, Homo Sapiens
guuucauuugaaaaaaaagaaagaaagaaagaaagaaagaaauccuacuacgagcgaucacacc

SEQ ID NO: 372118 - RNA, 64 nt, Homo Sapiens
cuggguaacagagcaagacuccaucucaaaaaaagaaagaaagaaaaaagaaaguacaaguuua

SEQ ID NO: 372119 - RNA, 64 nt, Homo Sapiens
guaacagagcaagacuccaucucaaaaaaagaaagaaagaaaaaagaaaguacaaguuuauaaa

SEQ ID NO: 372120 - RNA, 64 nt, Homo Sapiens
aacaauaaagaauuuucauaauauaucuguuggagaaagaaauugcuccauauuucaacuaaaa

SEQ ID NO: 372121 - RNA, 64 nt, Homo Sapiens
aagugcgcuuugcaauauuuauuugacuugaaaagaaagaaaccucugggacauuagucguuau

SEQ ID NO: 372122 - RNA, 64 nt, Homo Sapiens
gcagaguaaaagccagacucaaaaucuaaagugugaaagaaacaauuccuugagacguacuuuu

SEQ ID NO: 372123 - RNA, 64 nt, Homo Sapiens
uuccuugagacguacuuuuagaguucucaaauuggaaagaaagauuuccauuuuaaagugaguu

SEQ ID NO: 372124 - RNA, 64 nt, Homo Sapiens
ccuuggggauaaguuuaguguuguacaacugaccgaaagaaaacuuguggagaaacuaaaaaug

SEQ ID NO: 372125 - RNA, 64 nt, Homo Sapiens
caggggugcuuuuggaagcaauuagugggaugaagaaagaaaaguugacaacaucuaagacaau

SEQ ID NO: 372126 - RNA, 64 nt, Homo Sapiens
ugugaguaagugagagagaggagcagucccucuggaaagaaacaaggcucuuuuugcugccugu

SEQ ID NO: 372127 - RNA, 64 nt, Homo Sapiens
cugaagagaguggaggagagauggcuuguuuuuggaaagaaauucacuguuugccuuggauagu

SEQ ID NO: 372128 - RNA, 64 nt, Homo Sapiens
agacuguguuuuugccacugcuccuugaaagaaagaaagaaagaccacuuaauugcuuuccugc

SEQ ID NO: 372129 - RNA, 64 nt, Homo Sapiens
aagaagacuguguuuuugcccugccuccuugaaagaaagaaagagugaccacuuaauugcuuuc

SEQ ID NO: 372130 - RNA, 64 nt, Homo Sapiens
aagaaagaagacuguguuuuuuuccugccuccuugaaagaaagaugaggugaccacuuaauugc

SEQ ID NO: 372131 - RNA, 64 nt, Homo Sapiens
gagauaauauauauauagaagguuuaucuaagaagaaagaaacaaggauaugacauauaugaaa

SEQ ID NO: 372132 - RNA, 64 nt, Homo Sapiens
augcugagggaccuagugaagggugagaagaugagaaagaaaugcugaugggggaagauaccug

SEQ ID NO: 372133 - RNA, 64 nt, Homo Sapiens
cuaugguguaauuuaaacucaugauuugcagaaagaaagaaaaaaaaacugcaaaucagaaaga

SEQ ID NO: 372134 - RNA, 64 nt, Homo Sapiens
aaaacuaugguguaauuuaaaagaaugauuugcagaaagaaagaggaaaaaacugcaaaucaga

SEQ ID NO: 372135 - RNA, 64 nt, Homo Sapiens
uuaauaacugcugguggaaauaagccaauggaaagaaagaaauagaaaguuuaacugaaauuaa

SEQ ID NO: 372136 - RNA, 64 nt, Homo Sapiens
aauauuaauaacugcugguguuaauaagccaauggaaagaaagaaguagaaaguuuaacugaaa

SEQ ID NO: 372137 - RNA, 64 nt, Homo Sapiens
uucucuccccaacuaaaggauauuaaaguuaggggaaagaaaagaucauugaaagucaugauaa

SEQ ID NO: 372138 - RNA, 64 nt, Homo Sapiens
auauguaaguagcuaaugaaguaaagaucaugaagaaagaaauugauagguguaaaugagagac

SEQ ID NO: 372139 - RNA, 64 nt, Homo Sapiens
aguagcuggcgagguuaccuuaacuaucacugaagaaagaaauuuucugacacacugauggcau

SEQ ID NO: 372140 - RNA, 64 nt, Homo Sapiens
cauagauaguacuagguauuaauagauauguaaagaaagaaaucacaccauuaauaaugguaag

SEQ ID NO: 372141 - RNA, 64 nt, Homo Sapiens
caauaaguagcaacuauacuuuccaaugacuaaagaaagaaaaucucaguauauucguucucau

SEQ ID NO: 372142 - RNA, 64 nt, Homo Sapiens
uuauaauagcuguggaugagcacaggagagagaggaaagaaaagaacagucgaaaugagcaacu

SEQ ID NO: 372143 - RNA, 64 nt, Homo Sapiens
ucacaauaaaacacagcuuaaaaauaaaauaacugaaagaaauagaauucagcaaauaguuauu

SEQ ID NO: 372144 - RNA, 64 nt, Homo Sapiens
aaaaggaaaaaaaaaaaaaaugcaguaaaagaaagaaagaaaaauccagcaucuuaccuucaua

SEQ ID NO: 372145 - RNA, 64 nt, Homo Sapiens
aaaaaaaaggaaaaaaaaaacauaugcaguaaaagaaagaaagaacauuccagcaucuuaccuu

SEQ ID NO: 372146 - RNA, 64 nt, Homo Sapiens
aggggagcagcagaagccacagaagagaggcucugaaagaaaggaacccauaaacauagcccag

SEQ ID NO: 372147 - RNA, 64 nt, Homo Sapiens
caaguguucagggcauaacaacaaaggaagaaaagaaagaaaaaaacaauaaagaaaaaaaaau

SEQ ID NO: 372148 - RNA, 64 nt, Homo Sapiens
cauucucuauuuuuccaugggucagaaagaaaaagaaagaaaacgauuucuugagcauguauug

SEQ ID NO: 372149 - RNA, 64 nt, Homo Sapiens
gaaagaaaaccauucucuaugcauguauuggucagaaagaaaaaucagauauuugauuucuuga

SEQ ID NO: 372150 - RNA, 64 nt, Homo Sapiens
cacaaggauucagcaauuuacaguaggaaguugagaaagaaagcaaccccaagacguuugaggc

SEQ ID NO: 372151 - RNA, 64 nt, Homo Sapiens
gcaaacacuuaagauucagcuccccuuucgcagugaaagaaacaauaaaugugugacuuucaaa

SEQ ID NO: 372152 - RNA, 64 nt, Homo Sapiens
gaaaguggauuuaaaauauaacacagggggccuggaaagaaaggccgccugguggauuccuaug

SEQ ID NO: 372153 - RNA, 64 nt, Homo Sapiens
ugcauccuaaccauuccaucuaaugcuuuaauuugaaagaaaaaugcuauuuuuucucaguuuu

SEQ ID NO: 372154 - RNA, 64 nt, Homo Sapiens
auuuuaguauguguaaauuggaguuauuucuagagaaagaaaguuaaugauuagguuuuguucu

SEQ ID NO: 372155 - RNA, 64 nt, Homo Sapiens
acugugguauaguguccaaacugacugucauugagaaagaaagaaaguaguuugcgauugcagu

SEQ ID NO: 372156 - RNA, 64 nt, Homo Sapiens
ugguauaguguccaaacugacugucauugagaaagaaagaaaguaguuugcgauugcaguagaa

SEQ ID NO: 372157 - RNA, 64 nt, Homo Sapiens
ccuacuugaggugggcaucugggaauacaggguagaaagaaauuccugcuuuucagauaaagcc

SEQ ID NO: 372158 - RNA, 64 nt, Homo Sapiens
caauaucuaucucagaggaaauaugguuacccaggaaagaaauggucugcuagagugauaagac

SEQ ID NO: 372159 - RNA, 64 nt, Homo Sapiens
uguccaggagaacagaagggaaaaaaagauacuugaaagaaacugaaggaaauuuaaacaaaga

SEQ ID NO: 372160 - RNA, 64 nt, Homo Sapiens
agaaacugaaggaaauuuaaacaaagaaacacuugaaagaaacuggaaagaaaaauaauuuuuu

SEQ ID NO: 372161 - RNA, 64 nt, Homo Sapiens
gaaauuuaaacaaagaaacacuugaaagaaacuggaaagaaaaauaauuuuuuuaugugaacaa

SEQ ID NO: 372162 - RNA, 64 nt, Homo Sapiens
aagaauguaaagcaaccaaaaagaaaaaaaaaaagaaagaaagaggaaaagaaauccauacuaa

SEQ ID NO: 372163 - RNA, 64 nt, Homo Sapiens
cacuggugguuuuccgcauucuuuguacacccaugaaagaaaacuuuuaugcaaggucuugcau

SEQ ID NO: 372164 - RNA, 64 nt, Homo Sapiens
uuuauuucagcaaacuuguugaauuuauuuuuaagaaagaaauacuguauugggaaguuacugu

SEQ ID NO: 372165 - RNA, 64 nt, Homo Sapiens
accaugguuaagcaaccauauagaaagcuuuguugaaagaaaguauggcaucuuguaccacugc

SEQ ID NO: 372166 - RNA, 64 nt, Homo Sapiens
agaccgagacuccgccucaaaaaaaaaaaaaaaagaaagaaagaaagaaagaaagaaaucuacc

SEQ ID NO: 372167 - RNA, 64 nt, Homo Sapiens
cgagacuccgccucaaaaaaaaaaaaaaaagaaagaaagaaagaaagaaagaaaucuaccuguc

SEQ ID NO: 372168 - RNA, 64 nt, Homo Sapiens
acuccgccucaaaaaaaaaaaaaaaagaaagaaagaaagaaagaaagaaaucuaccugucaagg

SEQ ID NO: 372169 - RNA, 64 nt, Homo Sapiens
cgccucaaaaaaaaaaaaaaaagaaagaaagaaagaaagaaagaaaucuaccugucaaggaacu

SEQ ID NO: 372170 - RNA, 64 nt, Homo Sapiens
ucaaaaaaaaaaaaaaaagaaagaaagaaagaaagaaagaaaucuaccugucaaggaacuaagg

SEQ ID NO: 372171 - RNA, 64 nt, Homo Sapiens
auuaucuauuacucuugagagcuggcuguccuuugaaagaaagaaguaauguucuuugaaagaa

SEQ ID NO: 372172 - RNA, 64 nt, Homo Sapiens
ggcuguccuuugaaagaaagaaguaauguucuuugaaagaaagaaaaaucucuugcugugucaa

SEQ ID NO: 372173 - RNA, 64 nt, Homo Sapiens
guccuuugaaagaaagaaguaauguucuuugaaagaaagaaaaaucucuugcugugucaaaccu

SEQ ID NO: 372174 - RNA, 64 nt, Homo Sapiens
ugccaacaccacagaaauggggaauucucuaaucgaaagaaaaugggcccuaggggucacugua

SEQ ID NO: 372175 - RNA, 64 nt, Homo Sapiens
aauccaguucuacuauggcugaguucuggucaaagaaagaaaguuuagaagcugagacacaaag

SEQ ID NO: 372176 - RNA, 64 nt, Homo Sapiens
uugaccaugauaauucaguuuauauucaccacaugaaagaaaaauggguaacagaagaacccuu

SEQ ID NO: 372177 - RNA, 64 nt, Homo Sapiens
uuaaaacagguuaauuuggauuguaacguucagugaaagaaauuucaacccuucauagccagcg

SEQ ID NO: 372178 - RNA, 64 nt, Homo Sapiens
acaggaccauauuuauuuacuucugucaacuauagaaagaaagaccuucagcuguauuuccaca

SEQ ID NO: 372179 - RNA, 64 nt, Homo Sapiens
gaaagcuagguauuuaucaacugcagauguuauugaaagaaaauaaaauucagucucaagagua

SEQ ID NO: 372180 - RNA, 64 nt, Homo Sapiens
uuguauuuauuuauucuagauguauguaucugaggaaagaaaucugguauuuuugcuuuccaau

SEQ ID NO: 372181 - RNA, 64 nt, Homo Sapiens
ugauuuauuaauuuuaaaacauucagaacuuguugaaagaaaaauuauaucugaaucaagauuc

SEQ ID NO: 372182 - RNA, 64 nt, Homo Sapiens
uucacuucucuagaaagcugccaagacagaggcagaaagaaauggaugauaguucugucaagca

SEQ ID NO: 372183 - RNA, 64 nt, Homo Sapiens
uaggcauagaucuuuguaacacuauaaaaucuuagaaagaaacaaucuaaauauaagagcugaa

SEQ ID NO: 372184 - RNA, 64 nt, Homo Sapiens
aaagaaggcuuaaauaaaugaaacuacaaaauuggaaagaaauucaaaacaagugcaagacuga

SEQ ID NO: 372185 - RNA, 64 nt, Homo Sapiens
gaaauaaauguauccagauauaagaagcauuugggaaagaaaaaauguuuaagaagcuaauguu

SEQ ID NO: 372186 - RNA, 64 nt, Homo Sapiens
uuauguuucacauauaguuuguuucauuuugaaagaaagaaauuucuaucuguuucacuuggac

SEQ ID NO: 372187 - RNA, 64 nt, Homo Sapiens
aauuuuauguuucacauauaggacguuucauuuugaaagaaagauagcucuaucuguuucacuu

SEQ ID NO: 372188 - RNA, 64 nt, Homo Sapiens
guuaucucauuggggaagaaugguucaucauugugaaagaaaugcauuuuuccguaaaaaggga

SEQ ID NO: 372189 - RNA, 64 nt, Homo Sapiens
cauuuuuccguaaaaagggaccugauccaauggagaaagaaagcccaagaagugaugucuuugu

SEQ ID NO: 372190 - RNA, 64 nt, Homo Sapiens
agcaaauuauuuuuuuuuaugcugcuaaaugaaagaaagaaaaacaguggccaaacuuauuuau

SEQ ID NO: 372191 - RNA, 64 nt, Homo Sapiens
aaaaagcaaauuauuuuuuuuuaugcugcuaaaugaaagaaagacucccaguggccaaacuuau

SEQ ID NO: 372192 - RNA, 64 nt, Homo Sapiens
aaaucaguugugauuuaaaacuugcauuuuggcagaaagaaaaagugacccccagaucacuaag

SEQ ID NO: 372193 - RNA, 64 nt, Homo Sapiens
aagcuccuaguaaaguuauuuuucuuuuggauuggaaagaaauaauaaagucacuaucuuaugu

SEQ ID NO: 372194 - RNA, 64 nt, Homo Sapiens
gaccuaugagcacauaggacuuauacuguuuacugaaagaaaaacaaaggaaaauaguaauguu

SEQ ID NO: 372195 - RNA, 64 nt, Homo Sapiens
aauauuuuaugugagagaaaauguuuaauauugagaaagaaacuguuguaaaaaaauaauaaua

SEQ ID NO: 372196 - RNA, 64 nt, Homo Sapiens
ggaaggcugguagaagcaguuuuuugacuugaaggaaagaaagaauuuuucaagaaacugcaag

SEQ ID NO: 372197 - RNA, 64 nt, Homo Sapiens
gacagaaggaaggaaggaagaugaugcucuugaugaaagaaaaacucuuuaaaaagcccucuua

SEQ ID NO: 372198 - RNA, 64 nt, Homo Sapiens
acuugaaugaaauggauuuuaaauuacagacaaggaaagaaaaacacaauaauguagauagaac

SEQ ID NO: 372199 - RNA, 64 nt, Homo Sapiens
uaaagagucuagaguuuauucugagugaagucuagaaagaaaggucuuuuaauuuuauuugucc

SEQ ID NO: 372200 - RNA, 64 nt, Homo Sapiens
agaaaaaauauauauugcucuucaacuagugaaugaaagaaacuucagaaagcuagaauugcuu

SEQ ID NO: 372201 - RNA, 64 nt, Homo Sapiens
aacaauauucucaagagucuucuacuggaagcuagaaagaaauaggaauuuaaguccauagaau

SEQ ID NO: 372202 - RNA, 64 nt, Homo Sapiens
uaauuuuuaaaaauagcuuucguuuugaguucuggaaagaaaacugucaaaaucaguauauacu

SEQ ID NO: 372203 - RNA, 64 nt, Homo Sapiens
caugucuuuaaaucagauaccaaauauuuuuuaggaaagaaaaauguuauuacugucauuaggu

SEQ ID NO: 372204 - RNA, 64 nt, Homo Sapiens
guuaaccguccuuccccuagcaaauuuaaaaacagaaagaaaauguuguaccaguuaccauucc

SEQ ID NO: 372205 - RNA, 64 nt, Homo Sapiens
ugcugguuagaaacuagaauauugauauuuucaggaaagaaaucagcucagcucuccacucauu

SEQ ID NO: 372206 - RNA, 64 nt, Homo Sapiens
ugccaaaugucacuaaaggguuuaguuuuaaggagaaagaaaaggaaaaaaaaaaaaaacaaaa

SEQ ID NO: 372207 - RNA, 64 nt, Homo Sapiens
cuguuaccagaaagccaaauuuuauaaugcgggugaaagaaaaauauagauuaaaauugcuggg

SEQ ID NO: 372208 - RNA, 64 nt, Homo Sapiens
cugggcacugaaaaggggugggaguuggaaaucagaaagaaagagaaauauuucauuauguuaa

SEQ ID NO: 372209 - RNA, 64 nt, Homo Sapiens
uaaaagaagcucuagcaugaaauuaaaggaaagggaaagaaauagaucuggugcacccgaacau

SEQ ID NO: 372210 - RNA, 64 nt, Homo Sapiens
gauuccaaaaaaaaaaaaaaaaagaagaaagagagaaagaaagaaacagaaaaaccuaaaagaa

SEQ ID NO: 372211 - RNA, 64 nt, Homo Sapiens
ccaaaaaaaaaaaaaaaaagaagaaagagagaaagaaagaaacagaaaaaccuaaaagaaagcg

SEQ ID NO: 372212 - RNA, 64 nt, Homo Sapiens
aaaaacaaaccucguaaggguuggcuacagaacagaaagaaaacagacgggcugguaaauuggu

SEQ ID NO: 372213 - RNA, 64 nt, Homo Sapiens
aauaacucaccaaagcucaacaucaagacaaauugaaagaaagcgaccuccagccucucgaagg

SEQ ID NO: 372214 - RNA, 64 nt, Homo Sapiens
agauuauuacccagaauucaaacacaacucuauagaaagaaaggugaugcaggaauuaaguuua

SEQ ID NO: 372215 - RNA, 60 nt, Homo Sapiens
ugcauuauugacgaacuggcacauucuacagaaagaaaaaaaacugacucauccaacuag

SEQ ID NO: 372216 - RNA, 64 nt, Homo Sapiens
cccaccaccucaaccucugcgcgucauaugagaagaaagaaaucguaagaagucaccgacggua

SEQ ID NO: 372217 - RNA, 64 nt, Homo Sapiens
agucuuccauagauuuuuaacacaaauuuaaaaagaaagaaaacgcccucugcugccauaauca

SEQ ID NO: 372218 - RNA, 64 nt, Homo Sapiens
uaacccuuaacuguagauaagaaaauucauacuggaaagaaacccuacaaaugugaagucugug

SEQ ID NO: 372219 - RNA, 64 nt, Homo Sapiens
ucaacucuuacuacauguaagaguauuuauacuggaaagaaacccuacaaauguaaaaaacgug

SEQ ID NO: 372220 - RNA, 64 nt, Homo Sapiens
gacuagcaaaacuccaucucaaaaaaaaaaaaaagaaagaaagaaacugaaaagugaggugugg

SEQ ID NO: 372221 - RNA, 64 nt, Homo Sapiens
agcaaaacuccaucucaaaaaaaaaaaaaagaaagaaagaaacugaaaagugagguguggaacu

SEQ ID NO: 372222 - RNA, 64 nt, Homo Sapiens
agccugagaucaauaagaaauguucaggagagaggaaagaaaaaaaauauaugcuccacaauuu

SEQ ID NO: 372223 - RNA, 64 nt, Homo Sapiens
ccuuuccaaucaugucauugaaagugccuuuaacgaaagaaauggucacugaaugggaauucuc

SEQ ID NO: 372224 - RNA, 64 nt, Homo Sapiens
uaauagcccauuucuguuaaccucuuaucacuaagaaagaaaggaaagaaggagaugaauagaa

SEQ ID NO: 372225 - RNA, 64 nt, Homo Sapiens
cuaagaaagaaaggaaagaaggagaugaauagaagaaagaaaauggaaagaaggaaaaaaggag

SEQ ID NO: 372226 - RNA, 64 nt, Homo Sapiens
acuuaaaacuggagugacaggagacauaagaaaggaaagaaaaguaaaacuugaauauaggugg

SEQ ID NO: 372227 - RNA, 64 nt, Homo Sapiens
augaugaaguugcaaauggcaaguacagccgcaagaaagaaaaaucacacauuuaauuccuauu

SEQ ID NO: 372228 - RNA, 64 nt, Homo Sapiens
ugauaagaaaacuuugaggguucaaugcuaauuugaaagaaaauucaaacccaaagaaaguuua

SEQ ID NO: 372229 - RNA, 64 nt, Homo Sapiens
aggauuuucuccuguaucugccauuaacacacaagaaagaaagcacuuuauugaaaauugccuu

SEQ ID NO: 372230 - RNA, 64 nt, Homo Sapiens
auauaggaagagagggaagcaagaaggcaggaaggaaagaaaggaagaagaaauggaaaaauga

SEQ ID NO: 372231 - RNA, 64 nt, Homo Sapiens
acauguucagagccuaauucaaacuaguguuagggaaagaaaucaauaaauuaguagauuggaa

SEQ ID NO: 372232 - RNA, 64 nt, Homo Sapiens
aguggaucaugaaaagugcuguuuuguccuuugagaaagaaauaauuguuugagcgcagaguaa

SEQ ID NO: 372233 - RNA, 64 nt, Homo Sapiens
acucacucuuaugaaaugggcuuuaacaaaacaagaaagaaacguacuuaacugugugaagaaa

SEQ ID NO: 372234 - RNA, 64 nt, Homo Sapiens
cacugauuugugaugucaauaggauggcaccuuggaaagaaaaaugaagaacaacuuuaucaag

SEQ ID NO: 372235 - RNA, 64 nt, Homo Sapiens
aguaguugcuuacgugaagcucaagauaccuguagaaagaaauaugguauauuuguauaguuuu

SEQ ID NO: 372236 - RNA, 64 nt, Homo Sapiens
guacauguauauauuuguccucaaaaaaaagaaagaaagaaaaggcaacgggcgagacucuguc

SEQ ID NO: 372237 - RNA, 64 nt, Homo Sapiens
aaagguacauguauauauuuugucucaaaaaaaagaaagaaagacugggcaacgggcgagacuc

SEQ ID NO: 372238 - RNA, 64 nt, Homo Sapiens
cuuaagcaaagccuuuuucauauuugaaaauguggaaagaaaagauguuccuaaaagguuagau

SEQ ID NO: 372239 - RNA, 64 nt, Homo Sapiens
ucacuuuuuguuuuaauaucuugcucucugacaggaaagaaacaauucacuuaccagccuccuc

SEQ ID NO: 372240 - RNA, 64 nt, Homo Sapiens
uuuuuacuucagaaagaauuuuacagguuaaagggaaagaaauggugggaaacucuccccguaa

SEQ ID NO: 372241 - RNA, 64 nt, Homo Sapiens
uuguagucaaaaugcuacaauaaaacaaaaaagagaaagaaaaugaagagcauuugacucccgc

SEQ ID NO: 372242 - RNA, 64 nt, Homo Sapiens
aagcuuucuuuaaggcuuugauuuuuaugauuaugaaagaaauaaggcacaaccacaguuuuuc

SEQ ID NO: 372243 - RNA, 64 nt, Homo Sapiens
agcauuuuaucauuccauggaaggagaaucuuuugaaagaaagcauugccuccuaccagaacua

SEQ ID NO: 372244 - RNA, 64 nt, Homo Sapiens
uucuaauuaucauuugcaacuagaacuguaaucagaaagaaauuuuguauuuuuguauaacuug

SEQ ID NO: 372245 - RNA, 64 nt, Homo Sapiens
aaaugaagacuauauauauggaauggaggugacagaaagaaagaaauucuuuguuugagggaga

SEQ ID NO: 372246 - RNA, 64 nt, Homo Sapiens
gaagacuauauauauggaauggaggugacagaaagaaagaaauucuuuguuugagggagacuuc

SEQ ID NO: 372247 - RNA, 64 nt, Homo Sapiens
uggauuccuuuuggaucaaucagaaaggaaacacgaaagaaaagucaggaagguagagagagaa

SEQ ID NO: 372248 - RNA, 64 nt, Homo Sapiens
uucuggaugagaaaauuuucaauucuggccaugagaaagaaaaaaaaauaaacagccuucuuuu

SEQ ID NO: 372249 - RNA, 64 nt, Homo Sapiens
gggguucuugggccaugcuccguguguggauaaggaaagaaauacuguuucugggacucuccca

SEQ ID NO: 372250 - RNA, 64 nt, Homo Sapiens
uuucccaagcuccuagccaacacuauccuugggagaaagaaauuugcagaaacugcuaagacca

SEQ ID NO: 372251 - RNA, 64 nt, Homo Sapiens
auugucaauuuguuguuauaggucuuaccugugugaaagaaagaaaaagaaagaaagaaagaaa

SEQ ID NO: 372252 - RNA, 64 nt, Homo Sapiens
ucaauuuguuguuauaggucuuaccugugugaaagaaagaaaaagaaagaaagaaagaaagaga

SEQ ID NO: 372253 - RNA, 64 nt, Homo Sapiens
guuauaggucuuaccugugugaaagaaagaaaaagaaagaaagaaagaaagagaaaggaaauua

SEQ ID NO: 372254 - RNA, 64 nt, Homo Sapiens
uaggucuuaccugugugaaagaaagaaaaagaaagaaagaaagaaagagaaaggaaauuauaag

SEQ ID NO: 372255 - RNA, 64 nt, Homo Sapiens
ucuuaccugugugaaagaaagaaaaagaaagaaagaaagaaagagaaaggaaauuauaagguca

SEQ ID NO: 372256 - RNA, 64 nt, Homo Sapiens
ugaucaagcagauguuuaauuaggaugagcuuuagaaagaaaauaaagaaagugagcuugaaca

SEQ ID NO: 372257 - RNA, 64 nt, Homo Sapiens
gagcuugaacauaggaugagauuucaauuccacagaaagaaaguaaaacuagagccuuuaaaug

SEQ ID NO: 372258 - RNA, 64 nt, Homo Sapiens
uuguuuuaucuaauacuguacagguguuuaaaaagaaagaaaaggaauuuuugaaagacuauug

SEQ ID NO: 372259 - RNA, 64 nt, Homo Sapiens
aaagcaaagucagugaaagaucacagaaagaaacgaaagaaagcuguaaaaagucaucuuuccc

SEQ ID NO: 372260 - RNA, 64 nt, Homo Sapiens
aaagaaagcaaagcaaagucaucuuucccucacagaaagaaacguugcuaacuuguaaaaaguc

SEQ ID NO: 372261 - RNA, 64 nt, Homo Sapiens
aggugaauuuuaguggcauaaaugagugcagguugaaagaaaacccagaguuccaggcaaucaa

SEQ ID NO: 372262 - RNA, 64 nt, Homo Sapiens
auaaaagcuggagagagagugaccuagggaaagagaaagaaagagaguugggucaagugcauug

SEQ ID NO: 372263 - RNA, 64 nt, Homo Sapiens
ucaaauauuuugccucauuauucuuguuuuaaaagaaagaaaacaggccgggcacaguggcuca

SEQ ID NO: 372264 - RNA, 64 nt, Homo Sapiens
cuccagccugggugacagagggagacucugucucgaaagaaagaaagaaaaaaaggaaggaagg

SEQ ID NO: 372265 - RNA, 64 nt, Homo Sapiens
agccugggugacagagggagacucugucucgaaagaaagaaagaaaaaaaggaaggaaggagaa

SEQ ID NO: 372266 - RNA, 64 nt, Homo Sapiens
ugggugacagagggagacucugucucgaaagaaagaaagaaaaaaaggaaggaaggagaaggaa

SEQ ID NO: 372267 - RNA, 64 nt, Homo Sapiens
uuuuucagggaagcugccaaagaaugucgacgucgaaagaaagaauauguaaaaugucuggaga

SEQ ID NO: 372268 - RNA, 64 nt, Homo Sapiens
aguaaaccacaaaaaaauaccucaggaaagaauagaaagaaagucuaucuaaugacaugccuau

SEQ ID NO: 372269 - RNA, 64 nt, Homo Sapiens
cugcuuucuccuguccaaaagcaaaaaggcaaaggaaagaaagaaagcuucagaccgcuaguaa

SEQ ID NO: 372270 - RNA, 64 nt, Homo Sapiens
uuucuccuguccaaaagcaaaaaggcaaaggaaagaaagaaagcuucagaccgcuaguaaggcu

SEQ ID NO: 372271 - RNA, 64 nt, Homo Sapiens
gcgagacucugucuccccccgcaaaaaaaaaaaagaaagaaagaaagagaaaagaaaagaaaag

SEQ ID NO: 372272 - RNA, 64 nt, Homo Sapiens
gacucugucuccccccgcaaaaaaaaaaaagaaagaaagaaagagaaaagaaaagaaaagcaac

SEQ ID NO: 372273 - RNA, 64 nt, Homo Sapiens
gaugauauucagacgaagcauugauguuauggaagaaagaaagaaacaaacaaaauauauauau

SEQ ID NO: 372274 - RNA, 64 nt, Homo Sapiens
auauucagacgaagcauugauguuauggaagaaagaaagaaacaaacaaaauauauauauauau

SEQ ID NO: 372275 - RNA, 64 nt, Homo Sapiens
caaaaacaugaaacacagugaccaccgacagaaagaaagaaacagaucgucacaacccucagga

SEQ ID NO: 372276 - RNA, 64 nt, Homo Sapiens
aacacaaaaacaugaaacacaggaaccaccgacagaaagaaagacccugaucgucacaacccuc

SEQ ID NO: 372277 - RNA, 64 nt, Homo Sapiens
caagcaagcaaguugcugcccuaguaugcucuuggaaagaaaacuuuugauuacucuuguuugu

SEQ ID NO: 372278 - RNA, 64 nt, Homo Sapiens
guugccauguuuugauuuucagccuguucucuaagaaagaaauuuuuuuuaguacaggcccaag

SEQ ID NO: 372279 - RNA, 64 nt, Homo Sapiens
auacaaauuggcuuucaaguagugauaaguugaggaaagaaauauguuggcauuuaguagaaau

SEQ ID NO: 372280 - RNA, 64 nt, Homo Sapiens
ugcagcuuuaaccugcuggguugccauuguccaggaaagaaacucucucuuagaauuggaggau

SEQ ID NO: 372281 - RNA, 64 nt, Homo Sapiens
uaacugacauuauauauaacaaagguuauauucugaaagaaaaacuagaauagguuacuacaaa

SEQ ID NO: 372282 - RNA, 64 nt, Homo Sapiens
gccacuaauucauucacacuaauccuguucucaggaaagaaacuuucucccuauuguucuuuca

SEQ ID NO: 372283 - RNA, 64 nt, Homo Sapiens
uaaguuuucuuucacagaacgagagggguaaagagaaagaaacuaacuuugagcugagugaggg

SEQ ID NO: 372284 - RNA, 64 nt, Homo Sapiens
guggguuucagaagugucaguggcagagaugaaagaaagaaagaccucucagucuuaggggaca

SEQ ID NO: 372285 - RNA, 64 nt, Homo Sapiens
aagaguggguuucagaaguggacauggcagagaugaaagaaagaaaugccucucagucuuaggg

SEQ ID NO: 372286 - RNA, 64 nt, Homo Sapiens
uuaaauaaaggggaaguccaugaauuuguacacugaaagaaaauaauuuuuguagccaguuuug

SEQ ID NO: 372287 - RNA, 64 nt, Homo Sapiens
gccuuuagcugguuucaugucccuucugcuuagagaaagaaaugggggagaaaaugguggcuau

SEQ ID NO: 372288 - RNA, 64 nt, Homo Sapiens
guauuguuuagauuuuguucucaucuauguuaaugaaagaaauuggccuguauuuuuacauucu

SEQ ID NO: 372289 - RNA, 64 nt, Homo Sapiens
aaaacaauccaauacauauuuuucucucagaauagaaagaaaacacaaagagaaaauaugaaca

SEQ ID NO: 372290 - RNA, 64 nt, Homo Sapiens
agcaagacuccaucucaaaaauaaaauaaaaaaagaaagaaagaaaagaagaagaaaagagaag

SEQ ID NO: 372291 - RNA, 64 nt, Homo Sapiens
agacuccaucucaaaaauaaaauaaaaaaagaaagaaagaaaagaagaagaaaagagaagaagg

SEQ ID NO: 372292 - RNA, 64 nt, Homo Sapiens
aacaggauuuguagccuugugcuucuugcuaagagaaagaaaaacaaaaucagagggcauuaaa

SEQ ID NO: 372293 - RNA, 64 nt, Homo Sapiens
aauuuuuuuuguuuuguuuugucuuuuaagaaaggaaagaaaggaugaaaaaaauaaacagaaa

SEQ ID NO: 372294 - RNA, 64 nt, Homo Sapiens
aagauugggguguaacaccuacaccauuaucuuggaaagaaacaaccguuggaaacauaaccau

SEQ ID NO: 372295 - RNA, 64 nt, Homo Sapiens
uggucuggauuucuuuuuauuuucuuuucaacuugaaagaaacuggacauuaggccacuaugug

SEQ ID NO: 372296 - RNA, 64 nt, Homo Sapiens
cagcagagagcuuuuugcacuuuaaaaaaaaaaagaaagaaagaaaggucggaauuucuuuugg

SEQ ID NO: 372297 - RNA, 64 nt, Homo Sapiens
agagagcuuuuugcacuuuaaaaaaaaaaagaaagaaagaaaggucggaauuucuuuuggguca

SEQ ID NO: 372298 - RNA, 64 nt, Homo Sapiens
uacuuuuuaaaaaguaacuuuuuuaauaauauaagaaagaaaaaugcccuuucacacugaaucu

SEQ ID NO: 372299 - RNA, 64 nt, Homo Sapiens
uaguaaucucuugggcaaaagguaucaaauaauugaaagaaaaguuuaaacacauuuccgagag

SEQ ID NO: 372300 - RNA, 64 nt, Homo Sapiens
uuucagguaagcuucucagguuccaugagagaaggaaagaaauagagggguggcuuuuauggac

SEQ ID NO: 372301 - RNA, 64 nt, Homo Sapiens
uguuuauauagaccccauuggauucugucacaaugaaagaaaacguuuuuauuugccggcugag

SEQ ID NO: 372302 - RNA, 64 nt, Homo Sapiens
ucuuuuuucuucccucauuuucugggauucucaagaaagaaaaaguaacccauuaucacucuga

SEQ ID NO: 372303 - RNA, 64 nt, Homo Sapiens
uaaagagcacuuuauuucuuugaagccuuucuaagaaagaaaugggggugcgaguggcuugaau

SEQ ID NO: 372304 - RNA, 64 nt, Homo Sapiens
aagagaaaaaaauaaaaaucaaaaaaaaaaaaaagaaagaaagaaaccuccagcguauuuuauc

SEQ ID NO: 372305 - RNA, 64 nt, Homo Sapiens
gaaaaaaauaaaaaucaaaaaaaaaaaaaagaaagaaagaaaccuccagcguauuuuaucacua

SEQ ID NO: 372306 - RNA, 64 nt, Homo Sapiens
aagaaaccuccagcguauuuuaucacuaccuauagaaagaaauccugcuuugagaguauuugua

SEQ ID NO: 372307 - RNA, 64 nt, Homo Sapiens
ucugucuugaauucucuguuuaugcaaugugcucgaaagaaaaaaauguuaaaaauauaucuau

SEQ ID NO: 372308 - RNA, 64 nt, Homo Sapiens
acuuuaaguuccuuguuccagcccggaguuuugggaaagaaagaaaggaaaggucacagugacc

SEQ ID NO: 372309 - RNA, 64 nt, Homo Sapiens
uaaguuccuuguuccagcccggaguuuugggaaagaaagaaaggaaaggucacagugaccuagg

SEQ ID NO: 372310 - RNA, 64 nt, Homo Sapiens
cacaaagauuauauaugacaaucaguauugcaaugaaagaaaaacuaaaaacagaaaugauauu

SEQ ID NO: 372311 - RNA, 64 nt, Homo Sapiens
agguuuuucacuccaccaaaucuuacaaaucauugaaagaaauauauucuaacaguacgcacug

SEQ ID NO: 372312 - RNA, 64 nt, Homo Sapiens
aaaugacuauccugaacaggguggaggggugugggaaagaaaccagccauauugguuuugguuu

SEQ ID NO: 372313 - RNA, 64 nt, Homo Sapiens
acuuaaaaaaaaaaguagggagauuaaaaaaaaagaaagaaaaugcuuccuuaucuggaagccu

SEQ ID NO: 372314 - RNA, 64 nt, Homo Sapiens
aggcagaagcccuggauucaaaagaaaaaagaaagaaagaaaaaccucugucucaaaaaaaaaa

SEQ ID NO: 372315 - RNA, 64 nt, Homo Sapiens
aaaaaggcagaagcccuggaaaaaaaagaaaaaagaaagaaagacgaaccucugucucaaaaaa

SEQ ID NO: 372316 - RNA, 64 nt, Homo Sapiens
guaugaauggucaaaaugaauaucuucuuagaaagaaagaaaaaugcaaagcacucagcucaau

SEQ ID NO: 372317 - RNA, 64 nt, Homo Sapiens
aaaaguaugaauggucaaaacaauuaucuucuuagaaagaaagacauuugcaaagcacucagcu

SEQ ID NO: 372318 - RNA, 64 nt, Homo Sapiens
ccuuucaagaaucaaacuuggguaagccuucaaagaaagaaaggauggaggagguugugauggu

SEQ ID NO: 372319 - RNA, 64 nt, Homo Sapiens
caacuguggucauccagagaaauaucauuugguagaaagaaaacauuuauaugauuccuaacau

SEQ ID NO: 372320 - RNA, 64 nt, Homo Sapiens
gcaauaauaauuaauucacacaacaauguggccagaaagaaagaugguacaguaaaccaaaacc

SEQ ID NO: 372321 - RNA, 64 nt, Homo Sapiens
cagugggaauuaagaaagcccuguuuacggcauggaaagaaaauuacauaugacauuuuaugag

SEQ ID NO: 372322 - RNA, 64 nt, Homo Sapiens
gauaaaaagaggcauuccagaaaaaaaaaggaaagaaagaaacuacaaaaaaaacaaaaagaaa

SEQ ID NO: 372323 - RNA, 64 nt, Homo Sapiens
aacugauaaaaagaggcauugaaaaaaaaaaaaggaaagaaagacugaacaaaaaaaacaaaaa

SEQ ID NO: 372324 - RNA, 64 nt, Homo Sapiens
uuagcuauauuaggaaacugcuucuaccuagauugaaagaaauuugacucauaaacuuccaagu

SEQ ID NO: 372325 - RNA, 64 nt, Homo Sapiens
ccaauauaccacuuccuaaauauccaucuuuggugaaagaaaauagugugguaagaguacccau

SEQ ID NO: 372326 - RNA, 64 nt, Homo Sapiens
aaaaacugaaagcuuguucuuagugaauguaaaggaaagaaaggugcaccuguuucacugugaa

SEQ ID NO: 372327 - RNA, 64 nt, Homo Sapiens
guauuucagaguaaaaucucaaauagugggggaagaaagaaacuauucauuuagcccagauuuc

SEQ ID NO: 372328 - RNA, 64 nt, Homo Sapiens
gaugaaaagaguaguucaagaagaaagaaaugaagaaagaaaauagguaaaaggugaucccucu

SEQ ID NO: 372329 - RNA, 64 nt, Homo Sapiens
aagaaagaaaaugaugaaaaggugaucccucuaagaaagaaauguucgaaccuuucagguaaaa

SEQ ID NO: 372330 - RNA, 64 nt, Homo Sapiens
ccauuauuguacagagguaucaauuaaaaugaaugaaagaaaaaucaaaaaauuaauaugugua

SEQ ID NO: 372331 - RNA, 64 nt, Homo Sapiens
uagguaagcagcuuaccucacucauacauauguagaaagaaauaggagacccaaguaaauauuu

SEQ ID NO: 372332 - RNA, 64 nt, Homo Sapiens
ccagaaggaguaaugagacaagcagaaaguccaggaaagaaagaucuugggaagcagauuaagu

SEQ ID NO: 372333 - RNA, 64 nt, Homo Sapiens
gggcccacuuucuaacagggggggaagguagagugaaagaaagaacaucugggcuucuugugga

SEQ ID NO: 372334 - RNA, 64 nt, Homo Sapiens
uacuggaaguccucgccacagcaaucaggcaagagaaagaaauaaaaggcaaccaaaaagaaag

SEQ ID NO: 372335 - RNA, 64 nt, Homo Sapiens
aagaucucuacaacaaaaauuacaaaacacugcugaaagaaaucagagaugacacaaauggaaa

SEQ ID NO: 372336 - RNA, 64 nt, Homo Sapiens
gaacauacacauaguuauuuuaguaauauuuccugaaagaaaaaccaaauucugcuauaagucu

SEQ ID NO: 372337 - RNA, 64 nt, Homo Sapiens
auguaguucaguaagaugugcccaagucauuucagaaagaaagacccuucaguuuugaugcauu

SEQ ID NO: 372338 - RNA, 64 nt, Homo Sapiens
gaaacccaagagcugccuggaaaaaaaaaagaaagaaagaaaaggagcgagacuccgucucaaa

SEQ ID NO: 372339 - RNA, 64 nt, Homo Sapiens
aaaggaaacccaagagcugccaaaaaaaaaaaaagaaagaaagaaacagagcgagacuccgucu

SEQ ID NO: 372340 - RNA, 64 nt, Homo Sapiens
cugccuuugcaaaaauccuagagagagaaagaaagaaagaaaggaagaaagaaagaaagagaga

SEQ ID NO: 372341 - RNA, 64 nt, Homo Sapiens
aaggcugccuuugcaaaaaugagagagagagaaagaaagaaagauggaaagaaagaaagaaaga

SEQ ID NO: 372342 - RNA, 64 nt, Homo Sapiens
aagaaaggcugccuuugcaaaagagagagagagagaaagaaagauauuuggaaagaaagaaaga

SEQ ID NO: 372343 - RNA, 64 nt, Homo Sapiens
gagagagagagaaagaaagauauuuggaaagaaagaaagaaagacaccauaaugaggaaaaagu

SEQ ID NO: 372344 - RNA, 64 nt, Homo Sapiens
aagagagagagagagaaagaaaguuauuuggaaagaaagaaagaaaagcaccauaaugaggaaa

SEQ ID NO: 372345 - RNA, 64 nt, Homo Sapiens
aagaaagagagagagagagagaaaaaguuauuuggaaagaaagauucuaaagcaccauaaugag

SEQ ID NO: 372346 - RNA, 64 nt, Homo Sapiens
cugaaaaauguucuauauucucauuuuucuaaaagaaagaaaaaaggaaacccgauuuauuucu

SEQ ID NO: 372347 - RNA, 64 nt, Homo Sapiens
agauggagaaaaugaacaggacauggggcuccuggaaagaaagggcccgggaaguucaaggaag

SEQ ID NO: 372348 - RNA, 64 nt, Homo Sapiens
gauucucucucucaaaaaaaaaaaaaaaaaaaaggaaagaaagaaagaaaagaaaagaaaaucc

SEQ ID NO: 372349 - RNA, 64 nt, Homo Sapiens
cucucucucaaaaaaaaaaaaaaaaaaaaggaaagaaagaaagaaaagaaaagaaaauccuuuu

SEQ ID NO: 372350 - RNA, 64 nt, Homo Sapiens
cucucaaaaaaaaaaaaaaaaaaaaggaaagaaagaaagaaaagaaaagaaaauccuuuuugcu

SEQ ID NO: 372351 - RNA, 64 nt, Homo Sapiens
uuaaaaaagcaccguggagaauggcccucuucaggaaagaaaaauaagcaaaugaaugguccac

SEQ ID NO: 372352 - RNA, 64 nt, Homo Sapiens
agcaaaugaaugguccaccuagggguucaguaaagaaagaaauguguuaacugagccugaaucc

SEQ ID NO: 372353 - RNA, 64 nt, Homo Sapiens
augaauguaaggaauguggaaaagccuucagcaggaaagaaaaucucauuacacaucagaaaau

SEQ ID NO: 372354 - RNA, 64 nt, Homo Sapiens
uacuuuguuaaaagguguaagacuggaauaaauggaaagaaauaccauauacauagauggaaaa

SEQ ID NO: 372355 - RNA, 64 nt, Homo Sapiens
acuccagccugcgggacagagugagacccugucugaaagaaagagagaaagaaagaaagaaaga

SEQ ID NO: 372356 - RNA, 64 nt, Homo Sapiens
gggacagagugagacccugucugaaagaaagagagaaagaaagaaagaaagagagagaaagaaa

SEQ ID NO: 372357 - RNA, 64 nt, Homo Sapiens
cagagugagacccugucugaaagaaagagagaaagaaagaaagaaagagagagaaagaaagaaa

SEQ ID NO: 372358 - RNA, 64 nt, Homo Sapiens
gugagacccugucugaaagaaagagagaaagaaagaaagaaagagagagaaagaaagaaagaaa

SEQ ID NO: 372359 - RNA, 64 nt, Homo Sapiens
gaaagaaagagagaaagaaagaaagaaagagagagaaagaaagaaagaaagaaagggaaagaug

SEQ ID NO: 372360 - RNA, 64 nt, Homo Sapiens
gaaagagagaaagaaagaaagaaagagagagaaagaaagaaagaaagaaagggaaagauggaag

SEQ ID NO: 372361 - RNA, 64 nt, Homo Sapiens
gagagaaagaaagaaagaaagagagagaaagaaagaaagaaagaaagggaaagauggaaggaag

SEQ ID NO: 372362 - RNA, 64 nt, Homo Sapiens
gaaagaaagaaagaaagagagagaaagaaagaaagaaagaaagggaaagauggaaggaaggaag

SEQ ID NO: 372363 - RNA, 64 nt, Homo Sapiens
aggaaggaaaaagaaagagaaagagagagagagagaaagaaaaagaaagaaaaguaagaaagaa

SEQ ID NO: 372364 - RNA, 64 nt, Homo Sapiens
aagaaagagaaagagagagagagagaaagaaaaagaaagaaaaguaagaaagaaaaaagaaaaa

SEQ ID NO: 372365 - RNA, 64 nt, Homo Sapiens
agagagagagagaaagaaaaagaaagaaaaguaagaaagaaaaaagaaaaagaaagaaaaguaa

SEQ ID NO: 372366 - RNA, 64 nt, Homo Sapiens
aaaagaaagaaaaguaagaaagaaaaaagaaaaagaaagaaaaguaagaaagaaaaaaagaaaa

SEQ ID NO: 372367 - RNA, 64 nt, Homo Sapiens
acaaaacaaaaacacccagcuggaacaaaaguucgaaagaaaaaaagacaaaacuuccuguuug

SEQ ID NO: 372368 - RNA, 64 nt, Homo Sapiens
accuguuuuuacaaauucuugcccccagcagauggaaagaaagcuuuuuucguuccccccaccc

SEQ ID NO: 372369 - RNA, 64 nt, Homo Sapiens
agggcaugcgcuuguuggcauucucuccucaaaggaaagaaaacccuccccgggacuccagaau

SEQ ID NO: 372370 - RNA, 64 nt, Homo Sapiens
aaaaagagacaaauuacccaagacccugucucaagaaagaaaagucagccugggcgacacagcg

SEQ ID NO: 372371 - RNA, 64 nt, Homo Sapiens
caaaaaguggcuugaugguuaauuaaagaaagaggaaagaaacacaccacuaggucaguguaag

SEQ ID NO: 372372 - RNA, 64 nt, Homo Sapiens
acuuuguucuguguguuucaagccaucuagaggggaaagaaaaggaaaaucugaacaaucuuug

SEQ ID NO: 372373 - RNA, 64 nt, Homo Sapiens
ccccucaaaaaaaaaaaaaaaaaaaaaaaaaacagaaagaaagaaaaagaaaacugcagauaac

SEQ ID NO: 372374 - RNA, 64 nt, Homo Sapiens
ucaaaaaaaaaaaaaaaaaaaaaaaaaacagaaagaaagaaaaagaaaacugcagauaacccua

SEQ ID NO: 372375 - RNA, 64 nt, Homo Sapiens
cuuguacucagcuguguucaugugguggucuguggaaagaaaagaagacucauuuggaaaugaa

SEQ ID NO: 372376 - RNA, 64 nt, Homo Sapiens
auuugugugggcaaucccaaccugccuggucccugaaagaaagccccaccaccuucccagguca

SEQ ID NO: 372377 - RNA, 64 nt, Homo Sapiens
gaauguauucaucugcuucugaaaguuuguaauugaaagaaaaauggaaaauaugcuacagaau

SEQ ID NO: 372378 - RNA, 64 nt, Homo Sapiens
aaaaagaaaaucuuuuuuaaacuauguagaaguagaaagaaaagauuguauuaauuuaaccagg

SEQ ID NO: 372379 - RNA, 64 nt, Homo Sapiens
aaaacaaaaagcacuuuuuuaaaaaaaaaaaaaagaaagaaaggaaagaauacuuuucuggcaa

SEQ ID NO: 372380 - RNA, 64 nt, Homo Sapiens
uaacuccuuuauuaaaaacauuuuauauaggauugaaagaaaaugaaguuuuuaauugcuauug

SEQ ID NO: 372381 - RNA, 64 nt, Homo Sapiens
acguuucuguaacagagagacagcucuucagugugaaagaaaacuuauauuccuguuucuaaau

SEQ ID NO: 372382 - RNA, 64 nt, Homo Sapiens
caguaacuacagagaggacguuucccuguuuagggaaagaaaaaacaucuucagaucauagguc

SEQ ID NO: 372383 - RNA, 64 nt, Homo Sapiens
guguucucacagcaccguuccgacagggaccagugaaagaaaagagacaaaguuagaacgugcu

SEQ ID NO: 372384 - RNA, 64 nt, Homo Sapiens
uugauggagcuuucagcuuuagcugaaauuaguggaaagaaaguguuuucucucuuccaguccc

SEQ ID NO: 372385 - RNA, 64 nt, Homo Sapiens
guuaucgauacuaaacaccaccucguauuaccaagaaagaaaauguuuuugccccccucauuua

SEQ ID NO: 372386 - RNA, 64 nt, Homo Sapiens
caugcucauccuuugagucaaugugccgaagaaagaaagaaaaaggagccgccacacccagcca

SEQ ID NO: 372387 - RNA, 64 nt, Homo Sapiens
aaaacaugcucauccuuugagccaaugugccgaagaaagaaagagcauggagccgccacaccca

SEQ ID NO: 372388 - RNA, 64 nt, Homo Sapiens
ugagcagcagagcgggaccucgucucuaagaauagaaagaaagaaagagaaacgguguccuccg

SEQ ID NO: 372389 - RNA, 64 nt, Homo Sapiens
cagcagagcgggaccucgucucuaagaauagaaagaaagaaagagaaacgguguccuccgcaca

SEQ ID NO: 372390 - RNA, 64 nt, Homo Sapiens
agcuuuguuaaauccaaacucggaauuccugcaggaaagaaaucuaauauaugucaaaggcuuu

SEQ ID NO: 372391 - RNA, 64 nt, Homo Sapiens
agacccuguaugacaagugggguccugaggccaagaaagaaaccucacacucggccacuagugg

SEQ ID NO: 372392 - RNA, 64 nt, Homo Sapiens
cuauacuauguauauagaagaacauguauauugagaaagaaaacauacuuauauagaggaauuu

SEQ ID NO: 372393 - RNA, 64 nt, Homo Sapiens
ucuauguugguucacauguacaucuacuuuauaugaaagaaaaaacaguugucugccuguaaaa

SEQ ID NO: 372394 - RNA, 64 nt, Homo Sapiens
uguguaucaucaauaaaauuguauguuaaugcuggaaagaaaaaaagaagaaagaaagaaacca

SEQ ID NO: 372395 - RNA, 64 nt, Homo Sapiens
aaauuguauguuaaugcuggaaagaaaaaaagaagaaagaaagaaaccaucccuguccuucagu

SEQ ID NO: 372396 - RNA, 64 nt, Homo Sapiens
uguauguuaaugcuggaaagaaaaaaagaagaaagaaagaaaccaucccuguccuucaguuuau

SEQ ID NO: 372397 - RNA, 64 nt, Homo Sapiens
cacaaauaugagugggaaauaaaucagcacauuugaaagaaaguguuaaaacugaaggccucac

SEQ ID NO: 372398 - RNA, 64 nt, Homo Sapiens
augaaagaauaucuaauugggggaggugugaagggaaagaaauucuuuucaaaagcugaccaca

SEQ ID NO: 372399 - RNA, 64 nt, Homo Sapiens
guuggacgagaaaacaauaacgauaaaagacagugaaagaaaauaacgauaaaagacagugaaa

SEQ ID NO: 372400 - RNA, 64 nt, Homo Sapiens
aagacagugaaagaaaauaacgauaaaagacagugaaagaaaauaacaauaaaagacaaggaaa

SEQ ID NO: 372401 - RNA, 64 nt, Homo Sapiens
ucauaaaauauugagcugaucucccuuagaaugggaaagaaaaaaaaaguaagaaagaaaagga

SEQ ID NO: 372402 - RNA, 64 nt, Homo Sapiens
gacucccuuagaaugggaaaaaaaaaaaaaguaagaaagaaaagcgagacuccaucucaaaaaa

SEQ ID NO: 372403 - RNA, 64 nt, Homo Sapiens
caaggaguaagggggauuuacuuccagccagaaagaaagaaagaacugguugcauguaaaauuc

SEQ ID NO: 372404 - RNA, 64 nt, Homo Sapiens
aagacaaggaguaagggggaauuccuuccagccagaaagaaagaaauaacugguugcauguaaa

SEQ ID NO: 372405 - RNA, 64 nt, Homo Sapiens
uggaucccaaucugagaaaaggagauccuaauaugaaagaaaaacccagggcaaauggaaaaca

SEQ ID NO: 372406 - RNA, 64 nt, Homo Sapiens
gaugaugacauuaggcuucuuuugugauggccaagaaagaaaauauaacaaugucuucuugaaa

SEQ ID NO: 372407 - RNA, 64 nt, Homo Sapiens
uucagaggagaggcagucuucaaguucuacauucauucagaaaaauguuuuuugagccuacaau

SEQ ID NO: 372408 - RNA, 64 nt, Homo Sapiens
cuaucuucuggaaacuauggcauggacaguaaggauucagaagugcaugaaggcacccugccuc

SEQ ID NO: 372409 - RNA, 64 nt, Homo Sapiens
agccaaaccaaacaacgaaaaacaagaacaacuaauucagaaucaaauagaguuuuugagcauu

SEQ ID NO: 372410 - RNA, 64 nt, Homo Sapiens
guuugaucccaaauggugcuuaucuugauugaacauucagaacaaggauauuauuuucagugau

SEQ ID NO: 372411 - RNA, 64 nt, Homo Sapiens
uuagacccuuuggccuugggccaccagauucagaauucagaauuggaagggugugaggaggagg

SEQ ID NO: 372412 - RNA, 64 nt, Homo Sapiens
cagaauuuuagacccuuugggaggaggccaccagauucagaauugcuccagggaagggugugag

SEQ ID NO: 372413 - RNA, 64 nt, Homo Sapiens
uuuucacaugcaaaguguuuccuacugcuuaauaauucagaaaaccaagucucacugagaucac

SEQ ID NO: 372414 - RNA, 64 nt, Homo Sapiens
ugagcaguuucuaacuuagcacagugucauuuucauucagaaaccaguagaguaaaaauaaaaa

SEQ ID NO: 372415 - RNA, 64 nt, Homo Sapiens
caccccauggcacugccgcgugauucccgcggccauucagaaguucaagccgagaugcugacgu

SEQ ID NO: 372416 - RNA, 64 nt, Homo Sapiens
auuaaacucuucuaacuuucuucuuucugugauaauucagaagauaguuauggaucuucaaugc

SEQ ID NO: 372417 - RNA, 64 nt, Homo Sapiens
caauuaauaagaagcacaacuuguucacaaacucauucagaaaugauucucccaacaaugcgua

SEQ ID NO: 372418 - RNA, 64 nt, Homo Sapiens
aauauggaaagcagagcaguacauauucaaauguauucagaaagucaaaagauuaccuaucguu

SEQ ID NO: 372419 - RNA, 64 nt, Homo Sapiens
cuccacugccauggagacugugggagcugccuaaauucagaagcgugggcugaguggaggugcc

SEQ ID NO: 372420 - RNA, 64 nt, Homo Sapiens
cagguggccugugcuccccacaucccaaaauaaaauucagaagcaucucccaggugaggauuca

SEQ ID NO: 372421 - RNA, 64 nt, Homo Sapiens
aaaguuuuugagaaaaaaaggaagaaaccaacucauucagaaggcucggauuccucuuccaauu

SEQ ID NO: 372422 - RNA, 64 nt, Homo Sapiens
aauuaugcugguaguaaaugggacucugagucaaauucagaacgagaugucacuaaaaacagua

SEQ ID NO: 372423 - RNA, 64 nt, Homo Sapiens
acaccuaagagaaaaagaucgaauuuuucagaugauucagaaauuuucauucagguauuuguaa

SEQ ID NO: 372424 - RNA, 64 nt, Homo Sapiens
uguuucuuucauaugaaaaaaaugcauuuuauaaauucagaaagucauagauuucugaaggcgu

SEQ ID NO: 372425 - RNA, 64 nt, Homo Sapiens
acaggggaacuaugucacaguuuaccucuuccugauucagaaauguguaugguuugcagcuuuu

SEQ ID NO: 372426 - RNA, 64 nt, Homo Sapiens
uucugaaaauaaaaauuauacaguaguaaagauaauucagaaagaaaaagcuaccuguuagaau

SEQ ID NO: 372427 - RNA, 64 nt, Homo Sapiens
uugaugcacugaugccuuaaaaauuaacaaggucauucagaaguagauuacauugccuaaagua

SEQ ID NO: 372428 - RNA, 64 nt, Homo Sapiens
cuguuucugucuguuuugugcuguaccuuuucugauucagaauuauagaaaacuugauaaauac

SEQ ID NO: 372429 - RNA, 64 nt, Homo Sapiens
aauggucuauuacaccucccguuuuggcaaguaaauucagaauaauuuuagguucuuuuguuau

SEQ ID NO: 372430 - RNA, 64 nt, Homo Sapiens
auauucaucagaacaaggaucacugagaaaaaauauucagaaacaacuuuaauaaaaccugaau

SEQ ID NO: 372431 - RNA, 64 nt, Homo Sapiens
uuaagcuguuagucuuaaagauuauuguuaaaaaauucagaagaaaagagagacaagugcucuu

SEQ ID NO: 372432 - RNA, 64 nt, Homo Sapiens
aguuugaguuaaguguuuuuaauucagucagugaauucagaauaaguacauucauguauaacau

SEQ ID NO: 372433 - RNA, 64 nt, Homo Sapiens
guauugggggguggaggagaauggauuaaaaaauauucagaaauaugcaaguacucagugauaa

SEQ ID NO: 372434 - RNA, 64 nt, Homo Sapiens
uuauuucugaauguaacaucaaguguucuaugaaauucagaacuuaaagaugaggcagagaaua

SEQ ID NO: 372435 - RNA, 64 nt, Homo Sapiens
auacuuggaacuaaugaaggagagguuuuagauuauucagaagcacuuauaaacucaaauuuug

SEQ ID NO: 372436 - RNA, 64 nt, Homo Sapiens
guaguucuccauggcaugauccucccuucccugaauucagaacuuuuuuacaaagacuaucuuc

SEQ ID NO: 372437 - RNA, 64 nt, Homo Sapiens
cuuauuauuuaacccagaagugccugguuuucaaauucagaaauaggcgugagccaccaggccc

SEQ ID NO: 372438 - RNA, 64 nt, Homo Sapiens
aaaacuguagaacuguguaugucuuuaaacagccauucagaaaccuaaguuauaauuuaggauu

SEQ ID NO: 372439 - RNA, 64 nt, Homo Sapiens
gacuuguaugcuguuuuucuacauaacuuaguugauucagaaagguauuaauaagaaaauuugc

SEQ ID NO: 372440 - RNA, 64 nt, Homo Sapiens
uagucuggucuuuaggaaguacauaggaaucauuauucagaauguugaaaauuaccagugugau

SEQ ID NO: 372441 - RNA, 64 nt, Homo Sapiens
ugcauuuuucaaaugcaaugacuaagugaagcuuauucagaaaaacuugaaaggcauccuuggu

SEQ ID NO: 372442 - RNA, 64 nt, Homo Sapiens
uagaagcugacuugaaaggcccauuauguacuuuauucagaaugucuaaagauuuacuuaaauc

SEQ ID NO: 372443 - RNA, 64 nt, Homo Sapiens
acaguucccuggccggguuuggacugaacaguggauucagaacugcagcguucaaagccccugc

SEQ ID NO: 372444 - RNA, 64 nt, Homo Sapiens
acacacuccguucaugcauggacaccagaagacgauucagaacacaagaggagaaugagcugga

SEQ ID NO: 372445 - RNA, 64 nt, Homo Sapiens
uuauacuuucccuacccucucacucgacaugaaaauucagaauuaguuccucuaacuuggcuca

SEQ ID NO: 372446 - RNA, 64 nt, Homo Sapiens
gaggccauggacucuguccucaaugacaaagcagauucagaaauaugccaguaacaggcucaaa

SEQ ID NO: 372447 - RNA, 64 nt, Homo Sapiens
uuacguggauaggacuuuagugggaagacaacagauucagaaauccuuaaggagaugugacaua

SEQ ID NO: 372448 - RNA, 64 nt, Homo Sapiens
uaucccagaucucagcuagagugaacacuucugaauucagaaacuaauacaugcaauguggcug

SEQ ID NO: 372449 - RNA, 64 nt, Homo Sapiens
uagcauugguugccuauuuuuccagagaccuaacauucagaauaggugggugggugggacucag

SEQ ID NO: 372450 - RNA, 64 nt, Homo Sapiens
cacuccugaguggguggguggaggucugagggccauucagaacccccauuaagacucaccagga

SEQ ID NO: 372451 - RNA, 64 nt, Homo Sapiens
ucacucaagcacuccacuaauauauuuacguugcauucagaaauacugaugaccuucauauacg

SEQ ID NO: 372452 - RNA, 64 nt, Homo Sapiens
ggcuaccaaacacauucuccuuugaauuguuaaaauucagaacauucaaaauaacuguuuugcu

SEQ ID NO: 372453 - RNA, 64 nt, Homo Sapiens
cauggauuuuaaaaauauuuaaagagaaaaacucauucagaaauauucaacuaaaguuauaaau

SEQ ID NO: 372454 - RNA, 64 nt, Homo Sapiens
uggaacagaauguuuuacugacuuuauauggaugauucagaaauaucuguucuugcuacccaug

SEQ ID NO: 372455 - RNA, 64 nt, Homo Sapiens
cuuuucauugcacuucuaaaauucagccuuguucauucagaaaauaaggauggauuuugugaau

SEQ ID NO: 372456 - RNA, 64 nt, Homo Sapiens
cugugauuucucacauuuuuauuugcugagaaacauucagaaaauuauuccaaaaaugaaggua

SEQ ID NO: 372457 - RNA, 64 nt, Homo Sapiens
ugaugcagaaaguccagccaguuuacucauuucgauucagaauauuucaaauuuagcaauaaac

SEQ ID NO: 372458 - RNA, 64 nt, Homo Sapiens
cuguauaaauauuauuugccaaaaguuuguuuauauucagaagucugacuaugaugaauaaauc

SEQ ID NO: 372459 - RNA, 64 nt, Homo Sapiens
guaauaauuuuuuuuaaaacauuaaggaauuggaauucagaaagguuacccccuuccucugugu

SEQ ID NO: 372460 - RNA, 64 nt, Homo Sapiens
ucuuuguaaggauacauuuggaagaacauacaguauucagaaacuaaccuauauaaaauguaaa

SEQ ID NO: 372461 - RNA, 64 nt, Homo Sapiens
agaaaaauccuaacccaauacaaaaggugauucuauucagaauguaguggucaugagaauaaaa

SEQ ID NO: 372462 - RNA, 64 nt, Homo Sapiens
uuaaugagugguuuuccagacacuaaauagcagcauucagaaagugaagauguuccuuggauaa

SEQ ID NO: 372463 - RNA, 64 nt, Homo Sapiens
uuuuaguuauuauaauuaaauaauuuaaaguaaaauucagaagguaugugaaauuacauuucuu

SEQ ID NO: 372464 - RNA, 64 nt, Homo Sapiens
agugcuucugaauuugugauucaucuuuuucaccauucagaaacugaacuauauaguuuguaug

SEQ ID NO: 372465 - RNA, 64 nt, Homo Sapiens
uuuuauaccuaaaaguaauuuauagaauuugcaaauucagaacaauauaaauucucauaagcac

SEQ ID NO: 372466 - RNA, 64 nt, Homo Sapiens
ccuucccaaaucauaagggcaauuugaaaagaauauucagaaauaugugggacuaaagcccaga

SEQ ID NO: 372467 - RNA, 64 nt, Homo Sapiens
uucugcuugguggaaaguaacaugugaguggaccauucagaaacucggcaaaucgcaauggcag

SEQ ID NO: 372468 - RNA, 64 nt, Homo Sapiens
acuuguaaauagucugcuuucauguguucaugcuauucagaauccaaguauccaguaugacugg

SEQ ID NO: 372469 - RNA, 64 nt, Homo Sapiens; identical to SEQ ID NO: 74296

SEQ ID NO: 372470 - RNA, 64 nt, Homo Sapiens; identical to SEQ ID NO: 74297

SEQ ID NO: 372471 - RNA, 64 nt, Homo Sapiens; identical to SEQ ID NO: 74298

SEQ ID NO: 372472 - RNA, 64 nt, Homo Sapiens; identical to SEQ ID NO: 74299

SEQ ID NO: 372473 - RNA, 64 nt, Homo Sapiens; identical to SEQ ID NO: 74300

SEQ ID NO: 372474 - RNA, 64 nt, Homo Sapiens; identical to SEQ ID NO: 74301

SEQ ID NO: 372475 - RNA, 64 nt, Homo Sapiens; identical to SEQ ID NO: 74302

SEQ ID NO: 372476 - RNA, 64 nt, Homo Sapiens; identical to SEQ ID NO: 74303

SEQ ID NO: 372477 - RNA, 64 nt, Homo Sapiens; identical to SEQ ID NO: 74304

SEQ ID NO: 372478 - RNA, 64 nt, Homo Sapiens; identical to SEQ ID NO: 74305

SEQ ID NO: 372479 - RNA, 64 nt, Homo Sapiens; identical to SEQ ID NO: 74306

SEQ ID NO: 372480 - RNA, 64 nt, Homo Sapiens; identical to SEQ ID NO: 74307

SEQ ID NO: 372481 - RNA, 64 nt, Homo Sapiens; identical to SEQ ID NO: 74308

SEQ ID NO: 372482 - RNA, 64 nt, Homo Sapiens; identical to SEQ ID NO: 74309

SEQ ID NO: 372483 - RNA, 64 nt, Homo Sapiens; identical to SEQ ID NO: 74310

SEQ ID NO: 372484 - RNA, 64 nt, Homo Sapiens; identical to SEQ ID NO: 74311

SEQ ID NO: 372485 - RNA, 64 nt, Homo Sapiens; identical to SEQ ID NO: 74312

SEQ ID NO: 372486 - RNA, 64 nt, Homo Sapiens; identical to SEQ ID NO: 74313

SEQ ID NO: 372487 - RNA, 64 nt, Homo Sapiens
gugggaggaucgcuugugccuuggaggucaaaacugcagugagccaugguugcaccacugcucu

SEQ ID NO: 372488 - RNA, 64 nt, Homo Sapiens
gcaggagaauugcuugaaccugggagguggagguugcagugagccaagaucgugccacugcacu

SEQ ID NO: 372489 - RNA, 64 nt, Homo Sapiens
gcaggagaaucgcuugaacccgggaggcggagguugcagugagcugagaucgcaccauuacacu

SEQ ID NO: 372490 - RNA, 64 nt, Homo Sapiens
ggggugguuugggaggauccaugucggcucugccugcagugaccagugcucuguggggcagagg

SEQ ID NO: 372491 - RNA, 64 nt, Homo Sapiens
uuccauaugggagccccaaaggaacuggaugggcugcagugaggugggggcgggugggcaggga

SEQ ID NO: 372492 - RNA, 64 nt, Homo Sapiens
gcgggagaaucgcuugagccggggaggcggagguugcagugaggcgagauugugccacugcacu

SEQ ID NO: 372493 - RNA, 64 nt, Homo Sapiens
gcaggagaauugcuugaacccuggaggcagaaguugcagugagccgagaucgcaccacugcacu

SEQ ID NO: 372494 - RNA, 64 nt, Homo Sapiens
cgagauuaugccacuguacuggggaggcagaaguugcagugagcgcaggagaauugcuugaacc

SEQ ID NO: 372495 - RNA, 64 nt, Homo Sapiens
ugagauugcgccacugcacuugggaggcagagcuugcagugagcgcaggagaauggcaugaacc

SEQ ID NO: 372496 - RNA, 64 nt, Homo Sapiens
aauauuuuuaugagaauuuaaucauuuacugauuugcagugaugagcgaauuucccauuuggca

SEQ ID NO: 372497 - RNA, 64 nt, Homo Sapiens
ggaaagguuuaagagaauccacguuaccuuucugugcagugaagcugcaagacaccagacccua

SEQ ID NO: 372498 - RNA, 64 nt, Homo Sapiens
uguguucuugccacugcacucaggaauuugaagcugcagugagcgugggaggaucacuugagcc

SEQ ID NO: 372499 - RNA, 64 nt, Homo Sapiens
cgagaucacgccacugcacuugggaggcagagguugcagugagcgcaggagaauugcuugaacc

SEQ ID NO: 372500 - RNA, 64 nt, Homo Sapiens
gaagaagcaggaaaagcaagcagagagcagagcaugcagugaugaggugguggaaccagggaag

SEQ ID NO: 372501 - RNA, 64 nt, Homo Sapiens
acgacaaccagggguccaagaagacuuggagagcugcagugaugagguggagagaagccaaaca

SEQ ID NO: 372502 - RNA, 64 nt, Homo Sapiens
ugagaucacaccauugcgcuugggaguuagagguugcagugagcgcaggagaaucgcuugaacc

SEQ ID NO: 372503 - RNA, 64 nt, Homo Sapiens
cgagaucaugccaccgcacuugggaggcagagguugcagugaacgugggagaaucgcuugagac

SEQ ID NO: 372504 - RNA, 64 nt, Homo Sapiens
uaauaagaaucaccuggaguuaggagguggugguugcagugagccaaucucaccauugcacuuc

SEQ ID NO: 372505 - RNA, 64 nt, Homo Sapiens
gugggaggaucacuugagccuuggaggucaaggcugcagugaaucaugaucaugccacuguacu

SEQ ID NO: 372506 - RNA, 64 nt, Homo Sapiens
ggcaggagaauugccucaaccgggaggcggagguugcagugagccaagaucgcaccacugcacu

SEQ ID NO: 372507 - RNA, 64 nt, Homo Sapiens
gcgcgagaaucgcuugaacccuggagauggagguugcagugagcagagaucgcaccacugcacu

SEQ ID NO: 372508 - RNA, 64 nt, Homo Sapiens
gcaagagaaucgcuugaauccgguagguggagguugcagugagccgagaucauaccauugcacu

SEQ ID NO: 372509 - RNA, 64 nt, Homo Sapiens
gcaggagaauagcuugaacccgggagguggagguugcagugagucgagaucgugccacuggacu

SEQ ID NO: 372510 - RNA, 64 nt, Homo Sapiens
gcaggagaauuguuugaaccugggaggcggaggcugcagugagcugggauuacaccauugcauu

SEQ ID NO: 372511 - RNA, 64 nt, Homo Sapiens
uuguggucaucagcuucaugacauuuuacccauuugcagugauccuguguaaaacugccaagga

SEQ ID NO: 372512 - RNA, 64 nt, Homo Sapiens
ggacaccaagggcccauuuccuccccucucuaccugcagugaguuccagaccugcccguccccu

SEQ ID NO: 372513 - RNA, 64 nt, Homo Sapiens
ucuccagccccugguaccacaguccucacgauggugcagugauuucuagccaggcgucaagaug

SEQ ID NO: 372514 - RNA, 64 nt, Homo Sapiens
gugaguguaaaaucugcuuagcucuuucuauccaugcagugauauaaaaacaaaaauguauaug

SEQ ID NO: 372515 - RNA, 64 nt, Homo Sapiens
ugagaugacuuauaaaaacacuaaugugccauguugcagugaucugugucucugaaucucuguu

SEQ ID NO: 372516 - RNA, 64 nt, Homo Sapiens
cgagauugcaccacuacacucaggcggcagagguugcagugagugcagaagaauugcuugaacc

SEQ ID NO: 372517 - RNA, 64 nt, Homo Sapiens
ugagauggcgccacugcacucgggaggcggagcuugcagugagcgcaggagaauggcgugaacc

SEQ ID NO: 372518 - RNA, 64 nt, Homo Sapiens
caaggucauaccagugcacucaggaggcagagguugcagugagcgcaggggaauggcuugaacc

SEQ ID NO: 372519 - RNA, 64 nt, Homo Sapiens
ugagauugugccacugcacuugggaggcagaaguugcagugagcgcaggagaaucgcuugaacc

SEQ ID NO: 372520 - RNA, 64 nt, Homo Sapiens
gaaggagaauugcuugaaccugggagguggagguugcagugagcugaggucgcaccacugcacu

SEQ ID NO: 372521 - RNA, 64 nt, Homo Sapiens
guaagagcaucccuugagccacagaggucgaggcugcagugagcugugacugugccacugcacu

SEQ ID NO: 372522 - RNA, 64 nt, Homo Sapiens
gaaauguucuguauuugcguccaguggagcuuucugcagugacgguggucuugcccaguaccau

SEQ ID NO: 372523 - RNA, 64 nt, Homo Sapiens
cgagaucaugcgacugcacucugggagguggaguugcagugagcggcaggagaaucgcuugaac

SEQ ID NO: 372524 - RNA, 64 nt, Homo Sapiens
gcacgagaaucacuugaacccgggagggagagguugcagugagccaagaucguaccacugcacu

SEQ ID NO: 372525 - RNA, 64 nt, Homo Sapiens
ggcaggaaaauucuugaacccaggagacggaaguugcagugagcugagaucacaccacugcacu

SEQ ID NO: 372526 - RNA, 64 nt, Homo Sapiens
uuuguaaguuuguuugcuuuuucagguuuaucuuugcagugaauuaugcuuugcuuuaaaacau

SEQ ID NO: 372527 - RNA, 64 nt, Homo Sapiens
gcaggagaaucacuugaacccaggagguggagguugcagugagccgagaucacgccacugcacu

SEQ ID NO: 372528 - RNA, 64 nt, Homo Sapiens
agucuacaaaccagaaagcaucagggaugcuaagugcagugaugaggaauaaagccaaggggag

SEQ ID NO: 372529 - RNA, 64 nt, Homo Sapiens
gcgggagaauggcaugaacccgggagguggagcuugcagugagccaagaucguaccacugcacu

SEQ ID NO: 372530 - RNA, 64 nt, Homo Sapiens
gauacggggucuugcucugucucccaggcuggagugcagugacacaaucucagcucacugugac

SEQ ID NO: 372531 - RNA, 64 nt, Homo Sapiens
auauguauugggcagcagacuguguuucgugaacugcagugauguauacaucuuauagaugcaa

SEQ ID NO: 372532 - RNA, 64 nt, Homo Sapiens
augggaguuauuuuuaccauccccuccuuggaggugcagugaugaaggaucugugcuacccgcu

SEQ ID NO: 372533 - RNA, 64 nt, Homo Sapiens
ggagauuguaccauggcacuuagaaggcggagguugcagugagcgcaggagaaucgcuugaacc

SEQ ID NO: 372534 - RNA, 64 nt, Homo Sapiens
cuuggauuguuuucucauguugaucauuucuuccugcagugauuagaacaugauugagcuuaaa

SEQ ID NO: 372535 - RNA, 64 nt, Homo Sapiens
uguggcuguauaugcaugcuaacuucaaaacagaugcagugaacuugaaugagcagcacuuugc

SEQ ID NO: 372536 - RNA, 64 nt, Homo Sapiens
acagaucacaccacugcacuugggagguugagguugcagugagcgugggagguucacuugaacc

SEQ ID NO: 372537 - RNA, 64 nt, Homo Sapiens
gccuugauuccagagcucuuccccacccagguacugcagugagguacaggccaggccauggaca

SEQ ID NO: 372538 - RNA, 64 nt, Homo Sapiens
gguaacacuggcauuccucuagccucugcuggagugcagugaggauuuucuagcauguugcugc

SEQ ID NO: 372539 - RNA, 64 nt, Homo Sapiens
guaggagaaucacuugaaccuaggaggcaaagguugcagugagccgagguugcaccacugcacu

SEQ ID NO: 372540 - RNA, 64 nt, Homo Sapiens
cuauggaagagcgguagggaguccacggagaagaugcagugaaugcuugcaugcauucacacgu

SEQ ID NO: 372541 - RNA, 64 nt, Homo Sapiens
ccgugcgugguggaggcuggccucucuggcugggugcagugaauggccagcggguuucuuuucu

SEQ ID NO: 372542 - RNA, 64 nt, Homo Sapiens
ucauugcacaaaaaucuaggguugacuugguaaaugcagugacauuuucucauggaguuccuuu

SEQ ID NO: 372543 - RNA, 64 nt, Homo Sapiens
gcaggagaacugcuugaaccugggaggcggagguugcagugagccgagauugcaccacugcacu

SEQ ID NO: 372544 - RNA, 64 nt, Homo Sapiens
gcacaagaauugcuuggacccuggagguagaggcugcagugagccaagauuguaccacuguacu

SEQ ID NO: 372545 - RNA, 64 nt, Homo Sapiens
gcaggagaaucgcuugaaccugggaggcggauguugcagugagcagagaucgugccauugcacu

SEQ ID NO: 372546 - RNA, 64 nt, Homo Sapiens
caagauugugccacugcacuugggaggcagagguugcagugagcgcaggagaaucacuugaacc

SEQ ID NO: 372547 - RNA, 64 nt, Homo Sapiens
guugagggcaccucuccuccaacccgugcgccacugcagugagugaugcuguccccccauccaa

SEQ ID NO: 372548 - RNA, 64 nt, Homo Sapiens
cgagaucgcaccacugcacucgcgaggcggagacugcagugagcgaggcagaauugccugaacc

SEQ ID NO: 372549 - RNA, 64 nt, Homo Sapiens
caagauugcgccacuguacucgggagacagagguugcagugagcgcauaagaauuguuugagcc

SEQ ID NO: 372550 - RNA, 64 nt, Homo Sapiens
guucaacaguuugcccaggauuggucuuuuugucugcagugaauacacagaugacucuuuggug

SEQ ID NO: 372551 - RNA, 64 nt, Homo Sapiens
uugccgagaccugaagaggggaaucccuucauucugcagugagaacuuuauagaugaacuagug

SEQ ID NO: 372552 - RNA, 64 nt, Homo Sapiens
agagcgugccgcuacacucccaggagguugaggcugcagugagcagaggaggcucacuugagcc

SEQ ID NO: 372553 - RNA, 64 nt, Homo Sapiens
ugagauugcaccacugcauucaggagguggagguugcagugagcguggauggaucgcuugagcc

SEQ ID NO: 372554 - RNA, 64 nt, Homo Sapiens
gcaggagaauugccugaacccgggaggcggagguugcagugagcugagaucgcaccacugcacu

SEQ ID NO: 372555 - RNA, 64 nt, Homo Sapiens
guagaagaauugcuugaaccugggaggcagagauugcagugagccgagaucacgccauugcacu

SEQ ID NO: 372556 - RNA, 64 nt, Homo Sapiens
gcaggagaaucgcuugaacccgggaggcggagguugcagugagccgagaucgcaccauugcacu

SEQ ID NO: 372557 - RNA, 64 nt, Homo Sapiens
guuggaggauggcuugagcccacgagauggaaguugcagugaacugaaauugugccacugcacu

SEQ ID NO: 372558 - RNA, 64 nt, Homo Sapiens
gcaggagaauggugugaaccugggagguggagcuugcagugagcagagcuugcagugagacgag

SEQ ID NO: 372559 - RNA, 64 nt, Homo Sapiens
aaccugggagguggagcuugcagugagcagagcuugcagugagacgagcuugugccacugcacu

SEQ ID NO: 372560 - RNA, 64 nt, Homo Sapiens
gcaggagaaucacuugaacucgggagguggagguugcagugagccaagaucgcgccacugcacu

SEQ ID NO: 372561 - RNA, 64 nt, Homo Sapiens
guggaaggauugcuugagcgagggaggucgaggcugcagugagccacgaucacaccacugcacu

SEQ ID NO: 372562 - RNA, 64 nt, Homo Sapiens
gcaggagaaucacuugaaccuaggaggcggagguugcagugagccaagauggcgccauugcacu

SEQ ID NO: 372563 - RNA, 64 nt, Homo Sapiens
gcaggagaaucgcuugaacccaggaggcggagguugcagugagccaagauggcgccauugcacu

SEQ ID NO: 372564 - RNA, 64 nt, Homo Sapiens
gcaagagaaucgcuugaaucugggaggcggagguugcagugagccaggaucacaccauugcugu

SEQ ID NO: 372565 - RNA, 64 nt, Homo Sapiens
gcaggagaauugcuugaaccuggaaggcagagguugcagugagccgaaauggcgccacuguacu

SEQ ID NO: 372566 - RNA, 64 nt, Homo Sapiens
gcaggagaaucgcuugaacccaggagguggagguugcagugagcugagauccugccacugcacu

SEQ ID NO: 372567 - RNA, 64 nt, Homo Sapiens
gcaugagaaucgcuuaaacccaggaggcggagguugcagugagcugagaucacaccauugcacu

SEQ ID NO: 372568 - RNA, 64 nt, Homo Sapiens
gcagcagaaucguuugaacccgggaggcggagguugcagugaguggagaucgugccugugugcu

SEQ ID NO: 372569 - RNA, 64 nt, Homo Sapiens
ugagauugugucauugcacuugggagguggugguugcagugagcgcaggagaaucacuugaacc

SEQ ID NO: 372570 - RNA, 64 nt, Homo Sapiens
caugacugugccacugcacccaggagauugaggcugcagugagcccuugaggaucacuugagcc

SEQ ID NO: 372571 - RNA, 64 nt, Homo Sapiens
caagaucacaggagccacugcaggagguggagguugcagugagcgcacgagaauugcuugaacc

SEQ ID NO: 372572 - RNA, 64 nt, Homo Sapiens
ugagaucaugccacugcacuugggagauggagguugcagugagcgcaggagaauugcuugagcc

SEQ ID NO: 372573 - RNA, 64 nt, Homo Sapiens
ccaaaaaaaaaggaaauaaagaagugcuaucuaaugcagugauaugcuuuucagcauuguacug

SEQ ID NO: 372574 - RNA, 64 nt, Homo Sapiens
caagauugugccacuguacuugggagguggagguugcagugagcgcagaagaaucacuugaacc

SEQ ID NO: 372575 - RNA, 64 nt, Homo Sapiens
ccaggaggauuacuucaaccugggagguugaggcugcagugagcuguguuucgccacugcacac

SEQ ID NO: 372576 - RNA, 64 nt, Homo Sapiens
gcaggagaaucguuugaacccaggagguagagguugcagugagcugagauugcaccacugcacc

SEQ ID NO: 372577 - RNA, 64 nt, Homo Sapiens
gugggaggaucguuugagccugggaggcagagguugcagugaucaggaauugugccacugcacu

SEQ ID NO: 372578 - RNA, 64 nt, Homo Sapiens
cagccuagguuaaauagagaaaauuagugccaacugcagugagugagagggcuguggcaauaga

SEQ ID NO: 372579 - RNA, 64 nt, Homo Sapiens
gcuugaguggguucucugcagggaagaccagcuuugcagugacaaugcuuccuccuuugcucuu

SEQ ID NO: 372580 - RNA, 64 nt, Homo Sapiens
caagaucacaucacugcacucagaaggcagagguugcagugagccaggagaaaucgccugaacc

SEQ ID NO: 372581 - RNA, 64 nt, Homo Sapiens
cgggauugcgccauuguacuugggaggcagagguugcagugagcgcaggagaaucgcuugaacc

SEQ ID NO: 372582 - RNA, 64 nt, Homo Sapiens
cgagauagugccauuguacucuagaggcggaguuugcagugagcacaggagaaucgcuugaacc

SEQ ID NO: 372583 - RNA, 64 nt, Homo Sapiens
caagaucacgccacugcauucgggaggcagagcuugcagugagcgcaggagaauggcgugaacc

SEQ ID NO: 372584 - RNA, 64 nt, Homo Sapiens
caauccuaacugacuguaacugcccaggcuggagugcagugacggagacggggucaaacacugu

SEQ ID NO: 372585 - RNA, 64 nt, Homo Sapiens
accucagaggcagagguugcaaugaagcggagguugcagugagccgagagcaugccgcugcacu

SEQ ID NO: 372586 - RNA, 64 nt, Homo Sapiens
gaaggagaauugcuugaacccaggugguggagguugcagugagcugagaucgugccacugcucu

SEQ ID NO: 372587 - RNA, 64 nt, Homo Sapiens
gcaggagaaucgcuugagcccaagagguagagguugcagugagccaagaucgcgccacugcacu

SEQ ID NO: 372588 - RNA, 64 nt, Homo Sapiens
gcagaagaaucgcuugaacccaggaaguggagguugcagugagccgagauugugcugcugcacu

SEQ ID NO: 372589 - RNA, 64 nt, Homo Sapiens
uucacucgcaucuucaccccaaacuucccugaauugcagugauuucuguuauaaggcacauagc

SEQ ID NO: 372590 - RNA, 64 nt, Homo Sapiens
agccauggacacaucauuauuuucagcaaccagcugcagugaaacuccauuuacagcaacccca

SEQ ID NO: 372591 - RNA, 64 nt, Homo Sapiens
caagaucgcgccacugcacuugggaggcagagguugcagugagcgcaggagaaucgcuugaacc

SEQ ID NO: 372592 - RNA, 64 nt, Homo Sapiens
cgagauugcaccacugcaguugggaggcggaaguugcagugagcgcaggagaaucgcuugaacc

SEQ ID NO: 372593 - RNA, 64 nt, Homo Sapiens
aacaggaugacaagauucauccaggcacuggcaaugcagugaugaacuacguucccagccucuu

SEQ ID NO: 372594 - RNA, 64 nt, Homo Sapiens
cgcugauagcugcgcaacagguccaaccgccaacugcagugacccugaauccaugcccugcaau

SEQ ID NO: 372595 - RNA, 64 nt, Homo Sapiens
ccugggugaaaaucaggagcauuauguccugcgcugcagugagaugugugugugauacuucuuc

SEQ ID NO: 372596 - RNA, 64 nt, Homo Sapiens
aucacuacagucucagucaauuuguuuuguuuuuugcagugagcuuuaaauaaggguuuuuugu

SEQ ID NO: 372597 - RNA, 64 nt, Homo Sapiens
ggcuuccaagcugauguuuguacuuuuguguuacugcagugaccugcccuacauaucuaaaucg

SEQ ID NO: 372598 - RNA, 64 nt, Homo Sapiens
accuagagggcccccuacuuguuuuauuuaacugugcagugacuguaguuacuuaagagaaaau

SEQ ID NO: 372599 - RNA, 64 nt, Homo Sapiens
aguuaguccucuggccucaauucuguuguggaugugcagugauaagcgggcauugcgugccucg

SEQ ID NO: 372600 - RNA, 64 nt, Homo Sapiens
guaggagaaucacuugaaccucagcggcggagguugcagugagucgagaucgcgccagugcacu

SEQ ID NO: 372601 - RNA, 64 nt, Homo Sapiens
gcaggggaaucgcuuaaacccaggaggcggagauugcagugagccaagguuccaccacugcacu

SEQ ID NO: 372602 - RNA, 64 nt, Homo Sapiens
gcaggagaaucacuugaacccgggagguggaggcugcagugaacagagacagugccacugcaca

SEQ ID NO: 372603 - RNA, 64 nt, Homo Sapiens
gcacaagaauugccugaacccaggagguggagguugcagugagcugggaucgcgccauugcacu

SEQ ID NO: 372604 - RNA, 64 nt, Homo Sapiens
gaggcugagaugggaggaugagggaggucggggcugcagugagccaagaucacgccacugcacu

SEQ ID NO: 372605 - RNA, 64 nt, Homo Sapiens
caagacaaugccacuacacuugggaggcagaggcugcagugagcgcaugagaauugcuugaacc

SEQ ID NO: 372606 - RNA, 64 nt, Homo Sapiens
caagaucacagcacugcacuuggaaggcggagguugcagugagcaaaagagaauuguuugaacc

SEQ ID NO: 372607 - RNA, 64 nt, Homo Sapiens
uaugacgaugccacucgcugugagagauugagccugcagugagcgggcaaggauugcuugaggc

SEQ ID NO: 372608 - RNA, 64 nt, Homo Sapiens
gcaggagaauugcuugaacccaggaggcagagguugcagugagcugagauugugccacugcacu

SEQ ID NO: 372609 - RNA, 64 nt, Homo Sapiens
gcaggagaaucguuugaaccugggagguggagguugcagugagccaagaucaugucacugcauu

SEQ ID NO: 372610 - RNA, 64 nt, Homo Sapiens
caagaucgcacuacugcacuugguaggcugaggcugcagugagcgagauagggucaccugagcc

SEQ ID NO: 372611 - RNA, 64 nt, Homo Sapiens
cgagaucgcgccacugcacucgggaggaagagcuugcagugagcgcaggagaauggggugaacc

SEQ ID NO: 372612 - RNA, 64 nt, Homo Sapiens
cgagaucgcuccacugcacucaggaggcggagguugcagugagcgcaggagaaucucuugaacc

SEQ ID NO: 372613 - RNA, 64 nt, Homo Sapiens
caagaucgggccacugcacuugggaggcggagauugcagugaacgcaguagaaucgcuugaacc

SEQ ID NO: 372614 - RNA, 64 nt, Homo Sapiens
gcagaauucaacaagcacaauugaccugcacaucugcagugaggucccauugaccacuuugggu

SEQ ID NO: 372615 - RNA, 64 nt, Homo Sapiens
ugagauugugccacuucacucaggagguggaggcugcagugagcgcaggaaaauuguuugaacc

SEQ ID NO: 372616 - RNA, 64 nt, Homo Sapiens
cgagaucgcgccacugcacucgggaggcggagcuugcagugagcgcaggagaauggcgugaacc

SEQ ID NO: 372617 - RNA, 64 nt, Homo Sapiens
cgagaucgugccacugcacucaggaggcggagcuugcagugagcgcaggagaaucgccugaacc

SEQ ID NO: 372618 - RNA, 64 nt, Homo Sapiens
ugagauugcgccaccgcacuugggaggcaaagguugcagugaacgcaggagaaucgcuugaacc

SEQ ID NO: 372619 - RNA, 64 nt, Homo Sapiens
uaugagggugccucugugcucaggaguuugaggcugcagugagcgcgggaggaucgccagagcc

SEQ ID NO: 372620 - RNA, 64 nt, Homo Sapiens
caaggucgcgacacugcacuugggagguggagguugcagugagcuggggagaauugcuugaacc

SEQ ID NO: 372621 - RNA, 64 nt, Homo Sapiens
ccacgguuaggccccccuggaucucagaggaaauugcagugauuuccugguuguccaagucggg

SEQ ID NO: 372622 - RNA, 64 nt, Homo Sapiens
guuguaaaaguaauggauuucuuuggaugcugaaugcagugauguuaucagucagauucuuucc

SEQ ID NO: 372623 - RNA, 64 nt, Homo Sapiens
gugggagaauugcuugaaccuggaaggcagaaguugcagugagcugagaucacaccacugcacu

SEQ ID NO: 372624 - RNA, 64 nt, Homo Sapiens
cucccaggacagaccagccuuguuucucauguaaugcagugacgcugucauuaaacacguggau

SEQ ID NO: 372625 - RNA, 64 nt, Homo Sapiens
ugcaacuuuucuguugauccuggaauguagcuggugcagugagagggaaagagaauugaaaaac

SEQ ID NO: 372626 - RNA, 64 nt, Homo Sapiens
gcaggagaauggugugaacccgggaagcggagcuugcagugagccgagauugcgccacugcagu

SEQ ID NO: 372627 - RNA, 64 nt, Homo Sapiens
gcaggaggaucgccugagcccaggagguggagguugcagugagccaugaucgagccacugcacu

SEQ ID NO: 372628 - RNA, 64 nt, Homo Sapiens
gcagaaggaucgcuugaaccugggaggcagagguugcagugagccgagauugcgccacuggacu

SEQ ID NO: 372629 - RNA, 64 nt, Homo Sapiens
gcgggaggaucacuugagccugggagguugugguugcagugagcuaugauuguaccacugcacu

SEQ ID NO: 372630 - RNA, 64 nt, Homo Sapiens
gcaggagaaucguuugaaccugggaggcagagguugcagugagccaagaucacacuauugcacu

SEQ ID NO: 372631 - RNA, 64 nt, Homo Sapiens
gugggaggaugccuugagcuugagagguugaagcugcagugagcugugaucgcaccacugcacu

SEQ ID NO: 372632 - RNA, 64 nt, Homo Sapiens
gcaggagaauggcgugaacccgggaggcggagcuugcagugagccgagaucgcgccacugcacu

SEQ ID NO: 372633 - RNA, 64 nt, Homo Sapiens
aggcaggauugcuugauaugagggagauugaggcugcagugagcuguguucacaccacugcacu

SEQ ID NO: 372634 - RNA, 64 nt, Homo Sapiens
gcaggaggaucaguugaacgugggaggcagagguugcagugagcugagaucucaccacugcacu

SEQ ID NO: 372635 - RNA, 64 nt, Homo Sapiens
uguuuucuuugucauaccuaaucuguugaguuugugcagugaguuuucauuuugguuuuguauu

SEQ ID NO: 372636 - RNA, 64 nt, Homo Sapiens
ucagagaguucacucuggagagaggccuuaugaaugcagugaauguggcaaauucuuuguggac

SEQ ID NO: 372637 - RNA, 64 nt, Homo Sapiens
ugagagaguucauacuggagaaaagccuuaugagugcagugaaugugggaaagucuuuagauac

SEQ ID NO: 372638 - RNA, 64 nt, Homo Sapiens
ucggagaauucacacuggagagagaccuuaucagugcagugaauguggaagagucuuuaaccaa

SEQ ID NO: 372639 - RNA, 64 nt, Homo Sapiens
gugggaggaucacuugagcuugggaggcggugguugcagugagcugugaucaugccaucacacc

SEQ ID NO: 372640 - RNA, 64 nt, Homo Sapiens
gcaggagaauggcgcgaacaugggaggcguagcuugcagugagcugagaucacacuacugcacu

SEQ ID NO: 372641 - RNA, 64 nt, Homo Sapiens
ugagaucacgccacugcacucgggaggcagagguugcagugagcgcaggagaauggcgggaacc

SEQ ID NO: 372642 - RNA, 64 nt, Homo Sapiens
agcccuggcugggggugcagccacaggcccuuugugcagugaacccuagccuucuuuggggccc

SEQ ID NO: 372643 - RNA, 64 nt, Homo Sapiens
ugagaucacgccacugcauucuggagacagagguugcagugagcggcaggagaaucacuugaac

SEQ ID NO: 372644 - RNA, 64 nt, Homo Sapiens
ucuguuuuguuuuuuguuuugacaggacucgugcugcagugaaauugaccuaauucauuucaaa

SEQ ID NO: 372645 - RNA, 64 nt, Homo Sapiens
cgagauggcgccacugcacucaggagguggagguugcagugagcgcaggagaauugcuucaauc

SEQ ID NO: 372646 - RNA, 64 nt, Homo Sapiens
cugcaucuuuuugucucgcggcuuccucugaagaugcagugaucaaucugacugccccagcgcg

SEQ ID NO: 372647 - RNA, 64 nt, Homo Sapiens
caagaucgcgccacugcacuugggaggcggagcuugcagugagcgcaggagaauggcgugaacc

SEQ ID NO: 372648 - RNA, 64 nt, Homo Sapiens
uaugaucgugcuacugcacuagggauggugaggcugcagugagccaggagaaugguuugaacac

SEQ ID NO: 372649 - RNA, 64 nt, Homo Sapiens
cgagauugcaccacugcacuugggaggcauagguugcagugagcgcaggagaauucguuaaacc

SEQ ID NO: 372650 - RNA, 51 nt, Homo Sapiens
augggaaaucguuugcugaagugcagugaauacaggagaaaggccuuauga

SEQ ID NO: 372651 - RNA, 64 nt, Homo Sapiens
gaaggaaccaccuaugcuuaaaauacuguaaauaugcagugagguuuggcaaaaucuauuccau

SEQ ID NO: 372652 - RNA, 64 nt, Homo Sapiens
augcacaaaaaaaucaaucuacauuaucagaaccugcagugaaauuaaacuuauguuaaauaaa

SEQ ID NO: 372653 - RNA, 64 nt, Homo Sapiens
gugggaggaucaugugagccugggaggucaaggcugcagugagccgugauugcaccacugcacu

SEQ ID NO: 372654 - RNA, 64 nt, Homo Sapiens
gcaggagaauggcgugaaccugggaggcggagcuugcagugagccgagaucacaccacugcacu

SEQ ID NO: 372655 - RNA, 64 nt, Homo Sapiens
augggaggauugcuugagcccaggaggucgaggcugcagugagcuaugaucacaccaccacacu

SEQ ID NO: 372656 - RNA, 64 nt, Homo Sapiens
gcacaagaauugcuugaaccugggaggcggagguugcagugagcugagauaacgccacugcacu

SEQ ID NO: 372657 - RNA, 52 nt, Homo Sapiens
ugacagagcaccuaggauaaagugcagugaugcaaucacagcucaccucagu

SEQ ID NO: 372658 - RNA, 64 nt, Homo Sapiens
gauuaucauauuuuuuuuuguagagguggggaagugcagugaugcaaucacagcucaccucagu

SEQ ID NO: 372659 - RNA, 64 nt, Homo Sapiens
gcaugagaauugcuugaaccugggagguggagguugcagugagcugagcucaugcgacugcacu

SEQ ID NO: 372660 - RNA, 64 nt, Homo Sapiens
gcaggagaauggcgugaacccagaaggcagagcuugcagugagccaagaucgcgccacugcacu

SEQ ID NO: 372661 - RNA, 64 nt, Homo Sapiens
gcaggagaauugcuugaaccagggaguuggagguugcagugagcuaagacugcaccacugcacu

SEQ ID NO: 372662 - RNA, 64 nt, Homo Sapiens
gugggaggauugcuugaacccaggaggucgaggcugcagugagcugugaucucaccacugcauu

SEQ ID NO: 372663 - RNA, 64 nt, Homo Sapiens
gcaggaggaucacuugaaccugggaggcggagguugcagugagcugagauugcgccauugcacu

SEQ ID NO: 372664 - RNA, 64 nt, Homo Sapiens
gcaggagaaucgucuaagcccgggagguggagguugcagugagcccagauggcgcugcugcacu

SEQ ID NO: 372665 - RNA, 64 nt, Homo Sapiens
caagaucgcgccacugcacucaggaggcggagguugcagugagcgcacgagaaucacuugaacc

SEQ ID NO: 372666 - RNA, 64 nt, Homo Sapiens
uaagaucaugccaucgcacuugggacacggagguugcagugagcgcaggagaaucacuugaacc

SEQ ID NO: 372667 - RNA, 64 nt, Homo Sapiens
uauauagaagucauuauggcagaugcacaaauugugcagugauguaaauauacauacuucacag

SEQ ID NO: 372668 - RNA, 64 nt, Homo Sapiens
guaggaggauggcuugagcucaagagguugaggcugcagugagcccugauugugccagugcacu

SEQ ID NO: 372669 - RNA, 64 nt, Homo Sapiens
gaguauacccuugccauguguuagugaaaaugugugcagugagaagccaguuggguccccucgg

SEQ ID NO: 372670 - RNA, 64 nt, Homo Sapiens
gccugcaggugagcaggcagggcugggccaggucuccggggaggcagggguccugcagguccug

SEQ ID NO: 372671 - RNA, 64 nt, Homo Sapiens
gccaccuagaagucucccugcacagccucuaguguccggggaccuugugggaccagucccacac

SEQ ID NO: 372672 - RNA, 64 nt, Homo Sapiens
cccagcucucuugcacugcaggcccuggggccagcccgcacacaccaugccuccugucucaaca

SEQ ID NO: 372673 - RNA, 64 nt, Homo Sapiens
agcacgccuccuugcagggaucugagccacccuccccgcacagcccugcaccccgccccugggg

SEQ ID NO: 372674 - RNA, 64 nt, Homo Sapiens
cucacucugccagggcagugcaugcuccucacugcccgcacacccugcaguguucgcuuggcuc

SEQ ID NO: 372675 - RNA, 62 nt, Homo Sapiens
agccugcuucccaccucccucucugcugccugcccgcacagcugaagauccuccacugcuga

SEQ ID NO: 372676 - RNA, 64 nt, Homo Sapiens
caacacuuguccagacaccucuggccagguuggacccgcacacuuacuuucaucuauguugguu

SEQ ID NO: 372677 - RNA, 64 nt, Homo Sapiens
uguccucgccugcagccucagaggggcaggcauccccgcacagacuugacuggcagggcgguca

SEQ ID NO: 372678 - RNA, 64 nt, Homo Sapiens
ucuguuuguuaaaagggacaauguggccacuucucuguggaaagggaguugguugggggguuga

SEQ ID NO: 372679 - RNA, 64 nt, Homo Sapiens
agcucuggaaaaaccugggaguugaugccggaggcuguggaagaacucugcucgagggcagggu

SEQ ID NO: 372680 - RNA, 64 nt, Homo Sapiens
accccuguagcagagccuccuguucuucuacagccuguggaagacacagcuguggaaguggcug

SEQ ID NO: 372681 - RNA, 64 nt, Homo Sapiens
ggcuguguucuucuacagccucaacacagcacagcuguggaagugacccaggccccuguggcuu

SEQ ID NO: 372682 - RNA, 64 nt, Homo Sapiens
agccacccugagcagaacuuugugaugcuucauucuguggaauuuugugcuugcuacuguauag

SEQ ID NO: 372683 - RNA, 64 nt, Homo Sapiens
auuguaaaugguggaugacaaaagaaaaucugcucuguggaaagaaagaacugucucuaccagg

SEQ ID NO: 372684 - RNA, 64 nt, Homo Sapiens
cuaaccugugagaggggcccgagagaaggaacagcuguggaacaggcuuuuuacaccccaagug

SEQ ID NO: 372685 - RNA, 64 nt, Homo Sapiens
gugagagacuuuggcccccucccucccuauaaggcuguggaaccugaggaaguagauacuugaa

SEQ ID NO: 372686 - RNA, 64 nt, Homo Sapiens
acacauuauuuuauguaaauuuauugguaugacccuguggaaacauaucuaguaccauacugag

SEQ ID NO: 372687 - RNA, 64 nt, Homo Sapiens
gaagcuggauuccaucagauuuacugaagacaaccuguggaauaccaucuucggacguugauuc

SEQ ID NO: 372688 - RNA, 64 nt, Homo Sapiens
ccgggcccccugcugcgggcgcaagcuucccuagcuguggaaccugggugugcugccugucuga

SEQ ID NO: 372689 - RNA, 64 nt, Homo Sapiens
cagaggcagugagggagguguauagcaggccuuccuguggaaggggccgagggcacacagccuc

SEQ ID NO: 372690 - RNA, 64 nt, Homo Sapiens
agauacuggacuccucuucccagacauacagguucuguggaauauuugcccucugccuguuuuc

SEQ ID NO: 372691 - RNA, 64 nt, Homo Sapiens
gaaaaagcagaaggcuaggaguccagagaggaaacuguggaauggaugcaaauuggacuggcga

SEQ ID NO: 372692 - RNA, 64 nt, Homo Sapiens
gaccugccccacaugaaaagaacaccaaagaaagcuguggaaaguuuuuuucuuuuaaugaaga

SEQ ID NO: 372693 - RNA, 64 nt, Homo Sapiens
gcgagcagaaaacuccggcggugggguuugacaacuguggaaaggauauaccaagugacugugu

SEQ ID NO: 372694 - RNA, 64 nt, Homo Sapiens
uucuacuccugcaguaagcaggaauuugcuagaacuguggaagcggcaguaugaccagaaucau

SEQ ID NO: 372695 - RNA, 64 nt, Homo Sapiens
agcuaggucuacugauauacuuaaccacugauaacuguggaaagauaucccugguaguuuugug

SEQ ID NO: 372696 - RNA, 64 nt, Homo Sapiens
acugcuuccccaggcgggaaugggauugccuuuccuguggaaccggcccccuagccagcaagag

SEQ ID NO: 372697 - RNA, 64 nt, Homo Sapiens
auuguucugugucucauuccuaggcagaugggggcuguggaaaggacccuugacagccccagcc

SEQ ID NO: 372698 - RNA, 64 nt, Homo Sapiens
aaaccaucuccuaaaauucaaaguucagucaguccuguggaaugcauuuuccaugguagaaagg

SEQ ID NO: 372699 - RNA, 64 nt, Homo Sapiens
aaugcaagcaugauuuuggcuucuuuuuggucaccuguggaauguuggugaacuucaaacucug

SEQ ID NO: 372700 - RNA, 64 nt, Homo Sapiens
ccucuuguauacuuguauucccuuaacucuaacccuguggaagcauggcugucugcacagaggg

SEQ ID NO: 372701 - RNA, 64 nt, Homo Sapiens
cuauccauggcacuaaaccacuucucugcugccucuguggaagagauuccuauuacugcaguac

SEQ ID NO: 372702 - RNA, 64 nt, Homo Sapiens
uuuuggggucaaauucugccucaccucugauauucuguggaaggcucaagaguggaaggaccaa

SEQ ID NO: 372703 - RNA, 64 nt, Homo Sapiens
ccgauggacaggaaggagugcagugcaaaucacccuguggaaaacuugccuccuuucucucagg

SEQ ID NO: 372704 - RNA, 64 nt, Homo Sapiens
ccuggguauucuuuaaaguuucccuucccuuagccuguggaaacuccuuccacccggaaauucu

SEQ ID NO: 372705 - RNA, 64 nt, Homo Sapiens
ugaguuuccagaaccccaacuuccgguggaggagcuguggaaccaaagaauguugucgucugug

SEQ ID NO: 372706 - RNA, 64 nt, Homo Sapiens
ucuccugggacccgccuguugcuucugcccuccccuguggaaaggucuauaugacgggccgccu

SEQ ID NO: 372707 - RNA, 64 nt, Homo Sapiens
cucaguugccagggauggggccaccacugucacacuguggaauacaagacagugaacucugucu

SEQ ID NO: 372708 - RNA, 64 nt, Homo Sapiens
ggucuccguucuuggugcugcaggagggucgcugcuguggaaggaaagcacccaaagugguggu

SEQ ID NO: 372709 - RNA, 64 nt, Homo Sapiens
acaucuucaccgucuccaugcaggaagaguugggcuguggaaggcuugauuccaaauccuaaac

SEQ ID NO: 372710 - RNA, 64 nt, Homo Sapiens
ccaaaacccagccaucggggaagggucagggcuucuguggaacuuggaacgugccaggaccacc

SEQ ID NO: 372711 - RNA, 64 nt, Homo Sapiens
guugguagagucaucccuguaaucaagaaauggccuguggaauguuauuguucaacguuguuua

SEQ ID NO: 372712 - RNA, 64 nt, Homo Sapiens; identical to SEQ ID NO: 221093

SEQ ID NO: 372713 - RNA, 64 nt, Homo Sapiens; identical to SEQ ID NO: 221094

SEQ ID NO: 372714 - RNA, 64 nt, Homo Sapiens; identical to SEQ ID NO: 221095

SEQ ID NO: 372715 - RNA, 64 nt, Homo Sapiens; identical to SEQ ID NO: 221096

SEQ ID NO: 372716 - RNA, 64 nt, Homo Sapiens; identical to SEQ ID NO: 221097

SEQ ID NO: 372717 - RNA, 64 nt, Homo Sapiens; identical to SEQ ID NO: 221098

SEQ ID NO: 372718 - RNA, 64 nt, Homo Sapiens; identical to SEQ ID NO: 221099

SEQ ID NO: 372719 - RNA, 64 nt, Homo Sapiens; identical to SEQ ID NO: 221100

SEQ ID NO: 372720 - RNA, 64 nt, Homo Sapiens; identical to SEQ ID NO: 221101

SEQ ID NO: 372721 - RNA, 64 nt, Homo Sapiens; identical to SEQ ID NO: 221102

SEQ ID NO: 372722 - RNA, 64 nt, Homo Sapiens; identical to SEQ ID NO: 221103

SEQ ID NO: 372723 - RNA, 64 nt, Homo Sapiens; identical to SEQ ID NO: 221104

SEQ ID NO: 372724 - RNA, 64 nt, Homo Sapiens; identical to SEQ ID NO: 221105

SEQ ID NO: 372725 - RNA, 64 nt, Homo Sapiens; identical to SEQ ID NO: 221106

SEQ ID NO: 372726 - RNA, 64 nt, Homo Sapiens; identical to SEQ ID NO: 221107

SEQ ID NO: 372727 - RNA, 64 nt, Homo Sapiens; identical to SEQ ID NO: 221108

SEQ ID NO: 372728 - RNA, 64 nt, Homo Sapiens; identical to SEQ ID NO: 221109

SEQ ID NO: 372729 - RNA, 64 nt, Homo Sapiens; identical to SEQ ID NO: 221110

SEQ ID NO: 372730 - RNA, 64 nt, Homo Sapiens; identical to SEQ ID NO: 221111

SEQ ID NO: 372731 - RNA, 64 nt, Homo Sapiens; identical to SEQ ID NO: 221112

SEQ ID NO: 372732 - RNA, 64 nt, Homo Sapiens; identical to SEQ ID NO: 221113

SEQ ID NO: 372733 - RNA, 64 nt, Homo Sapiens; identical to SEQ ID NO: 221114

SEQ ID NO: 372734 - RNA, 64 nt, Homo Sapiens; identical to SEQ ID NO: 221115

SEQ ID NO: 372735 - RNA, 64 nt, Homo Sapiens; identical to SEQ ID NO: 221116

SEQ ID NO: 372736 - RNA, 64 nt, Homo Sapiens; identical to SEQ ID NO: 221117

SEQ ID NO: 372737 - RNA, 64 nt, Homo Sapiens; identical to SEQ ID NO: 221118

SEQ ID NO: 372738 - RNA, 64 nt, Homo Sapiens; identical to SEQ ID NO: 221119

SEQ ID NO: 372739 - RNA, 64 nt, Homo Sapiens; identical to SEQ ID NO: 221120

SEQ ID NO: 372740 - RNA, 64 nt, Homo Sapiens; identical to SEQ ID NO: 221121

SEQ ID NO: 372741 - RNA, 64 nt, Homo Sapiens; identical to SEQ ID NO: 221122

SEQ ID NO: 372742 - RNA, 64 nt, Homo Sapiens; identical to SEQ ID NO: 221123

SEQ ID NO: 372743 - RNA, 64 nt, Homo Sapiens; identical to SEQ ID NO: 221124

SEQ ID NO: 372744 - RNA, 64 nt, Homo Sapiens; identical to SEQ ID NO: 221125

SEQ ID NO: 372745 - RNA, 64 nt, Homo Sapiens; identical to SEQ ID NO: 221126

SEQ ID NO: 372746 - RNA, 64 nt, Homo Sapiens; identical to SEQ ID NO: 221127

SEQ ID NO: 372747 - RNA, 64 nt, Homo Sapiens; identical to SEQ ID NO: 221128

SEQ ID NO: 372748 - RNA, 64 nt, Homo Sapiens; identical to SEQ ID NO: 221129

SEQ ID NO: 372749 - RNA, 64 nt, Homo Sapiens; identical to SEQ ID NO: 221130

SEQ ID NO: 372750 - RNA, 64 nt, Homo Sapiens; identical to SEQ ID NO: 221131

SEQ ID NO: 372751 - RNA, 64 nt, Homo Sapiens; identical to SEQ ID NO: 221132

SEQ ID NO: 372752 - RNA, 64 nt, Homo Sapiens; identical to SEQ ID NO: 221133

SEQ ID NO: 372753 - RNA, 64 nt, Homo Sapiens; identical to SEQ ID NO: 221134

SEQ ID NO: 372754 - RNA, 64 nt, Homo Sapiens; identical to SEQ ID NO: 221135

SEQ ID NO: 372755 - RNA, 64 nt, Homo Sapiens; identical to SEQ ID NO: 221136

SEQ ID NO: 372756 - RNA, 64 nt, Homo Sapiens; identical to SEQ ID NO: 221137

SEQ ID NO: 372757 - RNA, 64 nt, Homo Sapiens; identical to SEQ ID NO: 221138

SEQ ID NO: 372758 - RNA, 64 nt, Homo Sapiens; identical to SEQ ID NO: 221139

SEQ ID NO: 372759 - RNA, 64 nt, Homo Sapiens; identical to SEQ ID NO: 221140

SEQ ID NO: 372760 - RNA, 64 nt, Homo Sapiens; identical to SEQ ID NO: 221141

SEQ ID NO: 372761 - RNA, 64 nt, Homo Sapiens; identical to SEQ ID NO: 221142

SEQ ID NO: 372762 - RNA, 64 nt, Homo Sapiens; identical to SEQ ID NO: 221143

SEQ ID NO: 372763 - RNA, 64 nt, Homo Sapiens; identical to SEQ ID NO: 221144

SEQ ID NO: 372764 - RNA, 64 nt, Homo Sapiens; identical to SEQ ID NO: 221145

SEQ ID NO: 372765 - RNA, 64 nt, Homo Sapiens; identical to SEQ ID NO: 221146

SEQ ID NO: 372766 - RNA, 64 nt, Homo Sapiens; identical to SEQ ID NO: 221147

SEQ ID NO: 372767 - RNA, 64 nt, Homo Sapiens; identical to SEQ ID NO: 221148

SEQ ID NO: 372768 - RNA, 64 nt, Homo Sapiens; identical to SEQ ID NO: 221149

SEQ ID NO: 372769 - RNA, 64 nt, Homo Sapiens; identical to SEQ ID NO: 221150

SEQ ID NO: 372770 - RNA, 64 nt, Homo Sapiens; identical to SEQ ID NO: 221151

SEQ ID NO: 372771 - RNA, 64 nt, Homo Sapiens; identical to SEQ ID NO: 221152

SEQ ID NO: 372772 - RNA, 64 nt, Homo Sapiens; identical to SEQ ID NO: 221153

SEQ ID NO: 372773 - RNA, 64 nt, Homo Sapiens; identical to SEQ ID NO: 221154

SEQ ID NO: 372774 - RNA, 64 nt, Homo Sapiens; identical to SEQ ID NO: 244624

SEQ ID NO: 372775 - RNA, 64 nt, Homo Sapiens; identical to SEQ ID NO: 244625

SEQ ID NO: 372776 - RNA, 64 nt, Homo Sapiens; identical to SEQ ID NO: 244626

SEQ ID NO: 372777 - RNA, 64 nt, Homo Sapiens; identical to SEQ ID NO: 244627

SEQ ID NO: 372778 - RNA, 64 nt, Homo Sapiens; identical to SEQ ID NO: 244628

SEQ ID NO: 372779 - RNA, 64 nt, Homo Sapiens; identical to SEQ ID NO: 244629

SEQ ID NO: 372780 - RNA, 64 nt, Homo Sapiens
uguguuuaagaagauaauuaaaggauguuaucauaggcuauauguguuuuacuuauucagacug

SEQ ID NO: 372781 - RNA, 64 nt, Homo Sapiens
cagcaaacgccuguuuaauaaagaacuuugaccaaggcuauaaaugccacguacauuauuuuca

SEQ ID NO: 372782 - RNA, 64 nt, Homo Sapiens
auauaugcauacacuuuuuuauauuaaaauuuugaggcuauacagccacugugcccuguggaau

SEQ ID NO: 372783 - RNA, 64 nt, Homo Sapiens
auuuguauaaaauauaaacacucuguugucauauaggcuauaugcgaaauuguuaauuuuaaaa

SEQ ID NO: 372784 - RNA, 64 nt, Homo Sapiens
ucaaaguagcugcggauuuucuuuaaguuuuuagaggcuauaccauaacacaucuaugaugcug

SEQ ID NO: 372785 - RNA, 64 nt, Homo Sapiens
ucagaccaaauuauaccuaaauacuuuaauuucuaggcuauaacuuuacauauuuuuacaauuc

SEQ ID NO: 372786 - RNA, 64 nt, Homo Sapiens; identical to SEQ ID NO: 156991

SEQ ID NO: 372787 - RNA, 64 nt, Homo Sapiens; identical to SEQ ID NO: 156992

SEQ ID NO: 372788 - RNA, 64 nt, Homo Sapiens; identical to SEQ ID NO: 156993

SEQ ID NO: 372789 - RNA, 64 nt, Homo Sapiens; identical to SEQ ID NO: 156994

SEQ ID NO: 372790 - RNA, 64 nt, Homo Sapiens; identical to SEQ ID NO: 156995

SEQ ID NO: 372791 - RNA, 64 nt, Homo Sapiens; identical to SEQ ID NO: 156996

SEQ ID NO: 372792 - RNA, 64 nt, Homo Sapiens; identical to SEQ ID NO: 156997

SEQ ID NO: 372793 - RNA, 64 nt, Homo Sapiens; identical to SEQ ID NO: 156998

SEQ ID NO: 372794 - RNA, 64 nt, Homo Sapiens; identical to SEQ ID NO: 156999

SEQ ID NO: 372795 - RNA, 64 nt, Homo Sapiens; identical to SEQ ID NO: 157000

SEQ ID NO: 372796 - RNA, 64 nt, Homo Sapiens; identical to SEQ ID NO: 157001

SEQ ID NO: 372797 - RNA, 64 nt, Homo Sapiens; identical to SEQ ID NO: 157002

SEQ ID NO: 372798 - RNA, 64 nt, Homo Sapiens; identical to SEQ ID NO: 157003

SEQ ID NO: 372799 - RNA, 64 nt, Homo Sapiens; identical to SEQ ID NO: 157004

SEQ ID NO: 372800 - RNA, 64 nt, Homo Sapiens; identical to SEQ ID NO: 157005

SEQ ID NO: 372801 - RNA, 64 nt, Homo Sapiens; identical to SEQ ID NO: 157006

SEQ ID NO: 372802 - RNA, 64 nt, Homo Sapiens; identical to SEQ ID NO: 157007

SEQ ID NO: 372803 - RNA, 64 nt, Homo Sapiens; identical to SEQ ID NO: 157008

SEQ ID NO: 372804 - RNA, 64 nt, Homo Sapiens; identical to SEQ ID NO: 157009

SEQ ID NO: 372805 - RNA, 64 nt, Homo Sapiens; identical to SEQ ID NO: 157010

SEQ ID NO: 372806 - RNA, 64 nt, Homo Sapiens; identical to SEQ ID NO: 157011

SEQ ID NO: 372807 - RNA, 64 nt, Homo Sapiens; identical to SEQ ID NO: 157012

SEQ ID NO: 372808 - RNA, 64 nt, Homo Sapiens; identical to SEQ ID NO: 157013

SEQ ID NO: 372809 - RNA, 64 nt, Homo Sapiens; identical to SEQ ID NO: 157014

SEQ ID NO: 372810 - RNA, 64 nt, Homo Sapiens; identical to SEQ ID NO: 157015

SEQ ID NO: 372811 - RNA, 64 nt, Homo Sapiens; identical to SEQ ID NO: 157016

SEQ ID NO: 372812 - RNA, 64 nt, Homo Sapiens; identical to SEQ ID NO: 157017

SEQ ID NO: 372813 - RNA, 64 nt, Homo Sapiens; identical to SEQ ID NO: 157018

SEQ ID NO: 372814 - RNA, 64 nt, Homo Sapiens; identical to SEQ ID NO: 157019

SEQ ID NO: 372815 - RNA, 64 nt, Homo Sapiens; identical to SEQ ID NO: 157020

SEQ ID NO: 372816 - RNA, 64 nt, Homo Sapiens; identical to SEQ ID NO: 157021

SEQ ID NO: 372817 - RNA, 64 nt, Homo Sapiens; identical to SEQ ID NO: 157022

SEQ ID NO: 372818 - RNA, 64 nt, Homo Sapiens; identical to SEQ ID NO: 157023

SEQ ID NO: 372819 - RNA, 64 nt, Homo Sapiens; identical to SEQ ID NO: 157024

SEQ ID NO: 372820 - RNA, 64 nt, Homo Sapiens; identical to SEQ ID NO: 157025

SEQ ID NO: 372821 - RNA, 64 nt, Homo Sapiens; identical to SEQ ID NO: 157026

SEQ ID NO: 372822 - RNA, 64 nt, Homo Sapiens; identical to SEQ ID NO: 157027

SEQ ID NO: 372823 - RNA, 64 nt, Homo Sapiens; identical to SEQ ID NO: 157028

SEQ ID NO: 372824 - RNA, 64 nt, Homo Sapiens; identical to SEQ ID NO: 157029

SEQ ID NO: 372825 - RNA, 64 nt, Homo Sapiens; identical to SEQ ID NO: 157030

SEQ ID NO: 372826 - RNA, 64 nt, Homo Sapiens; identical to SEQ ID NO: 157031

SEQ ID NO: 372827 - RNA, 64 nt, Homo Sapiens; identical to SEQ ID NO: 157032

SEQ ID NO: 372828 - RNA, 64 nt, Homo Sapiens; identical to SEQ ID NO: 157033

SEQ ID NO: 372829 - RNA, 64 nt, Homo Sapiens; identical to SEQ ID NO: 157034

SEQ ID NO: 372830 - RNA, 64 nt, Homo Sapiens; identical to SEQ ID NO: 157035

SEQ ID NO: 372831 - RNA, 64 nt, Homo Sapiens; identical to SEQ ID NO: 157036

SEQ ID NO: 372832 - RNA, 64 nt, Homo Sapiens; identical to SEQ ID NO: 157037

SEQ ID NO: 372833 - RNA, 64 nt, Homo Sapiens; identical to SEQ ID NO: 157038

SEQ ID NO: 372834 - RNA, 64 nt, Homo Sapiens; identical to SEQ ID NO: 157039

SEQ ID NO: 372835 - RNA, 64 nt, Homo Sapiens; identical to SEQ ID NO: 157040

SEQ ID NO: 372836 - RNA, 64 nt, Homo Sapiens; identical to SEQ ID NO: 157041

SEQ ID NO: 372837 - RNA, 64 nt, Homo Sapiens; identical to SEQ ID NO: 157042

SEQ ID NO: 372838 - RNA, 64 nt, Homo Sapiens; identical to SEQ ID NO: 157043

SEQ ID NO: 372839 - RNA, 64 nt, Homo Sapiens; identical to SEQ ID NO: 157044

SEQ ID NO: 372840 - RNA, 64 nt, Homo Sapiens; identical to SEQ ID NO: 157045

SEQ ID NO: 372841 - RNA, 64 nt, Homo Sapiens; identical to SEQ ID NO: 157046

SEQ ID NO: 372842 - RNA, 64 nt, Homo Sapiens; identical to SEQ ID NO: 157047

SEQ ID NO: 372843 - RNA, 64 nt, Homo Sapiens; identical to SEQ ID NO: 157048

SEQ ID NO: 372844 - RNA, 64 nt, Homo Sapiens; identical to SEQ ID NO: 157049

SEQ ID NO: 372845 - RNA, 64 nt, Homo Sapiens; identical to SEQ ID NO: 157050

SEQ ID NO: 372846 - RNA, 64 nt, Homo Sapiens; identical to SEQ ID NO: 157051

SEQ ID NO: 372847 - RNA, 64 nt, Homo Sapiens; identical to SEQ ID NO: 157052

SEQ ID NO: 372848 - RNA, 64 nt, Homo Sapiens; identical to SEQ ID NO: 157053

SEQ ID NO: 372849 - RNA, 64 nt, Homo Sapiens; identical to SEQ ID NO: 157054

SEQ ID NO: 372850 - RNA, 64 nt, Homo Sapiens; identical to SEQ ID NO: 157055

SEQ ID NO: 372851 - RNA, 64 nt, Homo Sapiens; identical to SEQ ID NO: 157056

SEQ ID NO: 372852 - RNA, 64 nt, Homo Sapiens; identical to SEQ ID NO: 157057

SEQ ID NO: 372853 - RNA, 64 nt, Homo Sapiens; identical to SEQ ID NO: 157058

SEQ ID NO: 372854 - RNA, 64 nt, Homo Sapiens; identical to SEQ ID NO: 157059

SEQ ID NO: 372855 - RNA, 64 nt, Homo Sapiens; identical to SEQ ID NO: 157060

SEQ ID NO: 372856 - RNA, 64 nt, Homo Sapiens; identical to SEQ ID NO: 157061

SEQ ID NO: 372857 - RNA, 64 nt, Homo Sapiens; identical to SEQ ID NO: 157062

SEQ ID NO: 372858 - RNA, 64 nt, Homo Sapiens; identical to SEQ ID NO: 157063

SEQ ID NO: 372859 - RNA, 64 nt, Homo Sapiens; identical to SEQ ID NO: 157064

SEQ ID NO: 372860 - RNA, 64 nt, Homo Sapiens; identical to SEQ ID NO: 157065

SEQ ID NO: 372861 - RNA, 64 nt, Homo Sapiens; identical to SEQ ID NO: 157066

SEQ ID NO: 372862 - RNA, 64 nt, Homo Sapiens; identical to SEQ ID NO: 157067

SEQ ID NO: 372863 - RNA, 64 nt, Homo Sapiens; identical to SEQ ID NO: 157068

SEQ ID NO: 372864 - RNA, 64 nt, Homo Sapiens; identical to SEQ ID NO: 157069

SEQ ID NO: 372865 - RNA, 64 nt, Homo Sapiens; identical to SEQ ID NO: 157070

SEQ ID NO: 372866 - RNA, 64 nt, Homo Sapiens; identical to SEQ ID NO: 157071

SEQ ID NO: 372867 - RNA, 64 nt, Homo Sapiens; identical to SEQ ID NO: 157072

SEQ ID NO: 372868 - RNA, 64 nt, Homo Sapiens; identical to SEQ ID NO: 157073

SEQ ID NO: 372869 - RNA, 64 nt, Homo Sapiens; identical to SEQ ID NO: 157074

SEQ ID NO: 372870 - RNA, 64 nt, Homo Sapiens; identical to SEQ ID NO: 157075

SEQ ID NO: 372871 - RNA, 64 nt, Homo Sapiens; identical to SEQ ID NO: 157076

SEQ ID NO: 372872 - RNA, 64 nt, Homo Sapiens; identical to SEQ ID NO: 157077

SEQ ID NO: 372873 - RNA, 64 nt, Homo Sapiens; identical to SEQ ID NO: 157078

SEQ ID NO: 372874 - RNA, 64 nt, Homo Sapiens; identical to SEQ ID NO: 157079

SEQ ID NO: 372875 - RNA, 64 nt, Homo Sapiens; identical to SEQ ID NO: 157080

SEQ ID NO: 372876 - RNA, 64 nt, Homo Sapiens; identical to SEQ ID NO: 157081

SEQ ID NO: 372877 - RNA, 64 nt, Homo Sapiens; identical to SEQ ID NO: 157082

SEQ ID NO: 372878 - RNA, 64 nt, Homo Sapiens; identical to SEQ ID NO: 157083

SEQ ID NO: 372879 - RNA, 64 nt, Homo Sapiens; identical to SEQ ID NO: 157084

SEQ ID NO: 372880 - RNA, 64 nt, Homo Sapiens; identical to SEQ ID NO: 157085

SEQ ID NO: 372881 - RNA, 64 nt, Homo Sapiens; identical to SEQ ID NO: 157086

SEQ ID NO: 372882 - RNA, 64 nt, Homo Sapiens; identical to SEQ ID NO: 157087

SEQ ID NO: 372883 - RNA, 64 nt, Homo Sapiens; identical to SEQ ID NO: 157088

SEQ ID NO: 372884 - RNA, 64 nt, Homo Sapiens; identical to SEQ ID NO: 157089

SEQ ID NO: 372885 - RNA, 64 nt, Homo Sapiens; identical to SEQ ID NO: 157090

SEQ ID NO: 372886 - RNA, 64 nt, Homo Sapiens; identical to SEQ ID NO: 157091

SEQ ID NO: 372887 - RNA, 64 nt, Homo Sapiens; identical to SEQ ID NO: 157092

SEQ ID NO: 372888 - RNA, 64 nt, Homo Sapiens; identical to SEQ ID NO: 157093

SEQ ID NO: 372889 - RNA, 64 nt, Homo Sapiens; identical to SEQ ID NO: 157094

SEQ ID NO: 372890 - RNA, 64 nt, Homo Sapiens; identical to SEQ ID NO: 157095

SEQ ID NO: 372891 - RNA, 64 nt, Homo Sapiens; identical to SEQ ID NO: 157096

SEQ ID NO: 372892 - RNA, 64 nt, Homo Sapiens; identical to SEQ ID NO: 157097

SEQ ID NO: 372893 - RNA, 64 nt, Homo Sapiens; identical to SEQ ID NO: 157098

SEQ ID NO: 372894 - RNA, 64 nt, Homo Sapiens; identical to SEQ ID NO: 157099

SEQ ID NO: 372895 - RNA, 64 nt, Homo Sapiens; identical to SEQ ID NO: 157100

SEQ ID NO: 372896 - RNA, 64 nt, Homo Sapiens; identical to SEQ ID NO: 157101

SEQ ID NO: 372897 - RNA, 64 nt, Homo Sapiens; identical to SEQ ID NO: 157102

SEQ ID NO: 372898 - RNA, 64 nt, Homo Sapiens; identical to SEQ ID NO: 157103

SEQ ID NO: 372899 - RNA, 64 nt, Homo Sapiens; identical to SEQ ID NO: 157104

SEQ ID NO: 372900 - RNA, 64 nt, Homo Sapiens; identical to SEQ ID NO: 157105

SEQ ID NO: 372901 - RNA, 64 nt, Homo Sapiens; identical to SEQ ID NO: 157106

SEQ ID NO: 372902 - RNA, 64 nt, Homo Sapiens; identical to SEQ ID NO: 157107

SEQ ID NO: 372903 - RNA, 64 nt, Homo Sapiens; identical to SEQ ID NO: 157108

SEQ ID NO: 372904 - RNA, 64 nt, Homo Sapiens; identical to SEQ ID NO: 157109

SEQ ID NO: 372905 - RNA, 64 nt, Homo Sapiens; identical to SEQ ID NO: 157110

SEQ ID NO: 372906 - RNA, 64 nt, Homo Sapiens; identical to SEQ ID NO: 157111

SEQ ID NO: 372907 - RNA, 64 nt, Homo Sapiens; identical to SEQ ID NO: 157112

SEQ ID NO: 372908 - RNA, 64 nt, Homo Sapiens; identical to SEQ ID NO: 157113

SEQ ID NO: 372909 - RNA, 64 nt, Homo Sapiens; identical to SEQ ID NO: 157114

SEQ ID NO: 372910 - RNA, 64 nt, Homo Sapiens; identical to SEQ ID NO: 157115

SEQ ID NO: 372911 - RNA, 64 nt, Homo Sapiens; identical to SEQ ID NO: 157116

SEQ ID NO: 372912 - RNA, 64 nt, Homo Sapiens; identical to SEQ ID NO: 157117

SEQ ID NO: 372913 - RNA, 64 nt, Homo Sapiens; identical to SEQ ID NO: 157118

SEQ ID NO: 372914 - RNA, 64 nt, Homo Sapiens; identical to SEQ ID NO: 157119

SEQ ID NO: 372915 - RNA, 64 nt, Homo Sapiens; identical to SEQ ID NO: 157120

SEQ ID NO: 372916 - RNA, 50 nt, Homo Sapiens; identical to SEQ ID NO: 157121

SEQ ID NO: 372917 - RNA, 52 nt, Homo Sapiens; identical to SEQ ID NO: 157122

SEQ ID NO: 372918 - RNA, 54 nt, Homo Sapiens; identical to SEQ ID NO: 157123

SEQ ID NO: 372919 - RNA, 56 nt, Homo Sapiens; identical to SEQ ID NO: 157124

SEQ ID NO: 372920 - RNA, 58 nt, Homo Sapiens; identical to SEQ ID NO: 157125

SEQ ID NO: 372921 - RNA, 60 nt, Homo Sapiens; identical to SEQ ID NO: 157126

SEQ ID NO: 372922 - RNA, 62 nt, Homo Sapiens; identical to SEQ ID NO: 157127

SEQ ID NO: 372923 - RNA, 64 nt, Homo Sapiens; identical to SEQ ID NO: 157128

SEQ ID NO: 372924 - RNA, 64 nt, Homo Sapiens; identical to SEQ ID NO: 157129

SEQ ID NO: 372925 - RNA, 64 nt, Homo Sapiens; identical to SEQ ID NO: 157130

SEQ ID NO: 372926 - RNA, 64 nt, Homo Sapiens; identical to SEQ ID NO: 157131

SEQ ID NO: 372927 - RNA, 64 nt, Homo Sapiens; identical to SEQ ID NO: 157132

SEQ ID NO: 372928 - RNA, 64 nt, Homo Sapiens; identical to SEQ ID NO: 157133

SEQ ID NO: 372929 - RNA, 64 nt, Homo Sapiens; identical to SEQ ID NO: 157134

SEQ ID NO: 372930 - RNA, 64 nt, Homo Sapiens; identical to SEQ ID NO: 157135

SEQ ID NO: 372931 - RNA, 64 nt, Homo Sapiens; identical to SEQ ID NO: 157136

SEQ ID NO: 372932 - RNA, 64 nt, Homo Sapiens; identical to SEQ ID NO: 157137

SEQ ID NO: 372933 - RNA, 64 nt, Homo Sapiens; identical to SEQ ID NO: 157138

SEQ ID NO: 372934 - RNA, 64 nt, Homo Sapiens; identical to SEQ ID NO: 157139

SEQ ID NO: 372935 - RNA, 64 nt, Homo Sapiens; identical to SEQ ID NO: 157140

SEQ ID NO: 372936 - RNA, 64 nt, Homo Sapiens; identical to SEQ ID NO: 157141

SEQ ID NO: 372937 - RNA, 64 nt, Homo Sapiens; identical to SEQ ID NO: 157142

SEQ ID NO: 372938 - RNA, 64 nt, Homo Sapiens; identical to SEQ ID NO: 157143

SEQ ID NO: 372939 - RNA, 64 nt, Homo Sapiens; identical to SEQ ID NO: 157144

SEQ ID NO: 372940 - RNA, 64 nt, Homo Sapiens; identical to SEQ ID NO: 157145

SEQ ID NO: 372941 - RNA, 64 nt, Homo Sapiens; identical to SEQ ID NO: 157146

SEQ ID NO: 372942 - RNA, 64 nt, Homo Sapiens; identical to SEQ ID NO: 157147

SEQ ID NO: 372943 - RNA, 64 nt, Homo Sapiens; identical to SEQ ID NO: 157148

SEQ ID NO: 372944 - RNA, 64 nt, Homo Sapiens; identical to SEQ ID NO: 157149

SEQ ID NO: 372945 - RNA, 64 nt, Homo Sapiens; identical to SEQ ID NO: 157150

SEQ ID NO: 372946 - RNA, 64 nt, Homo Sapiens; identical to SEQ ID NO: 157151

SEQ ID NO: 372947 - RNA, 64 nt, Homo Sapiens; identical to SEQ ID NO: 157152

SEQ ID NO: 372948 - RNA, 64 nt, Homo Sapiens; identical to SEQ ID NO: 157153

SEQ ID NO: 372949 - RNA, 64 nt, Homo Sapiens; identical to SEQ ID NO: 157154

SEQ ID NO: 372950 - RNA, 64 nt, Homo Sapiens; identical to SEQ ID NO: 157155

SEQ ID NO: 372951 - RNA, 64 nt, Homo Sapiens; identical to SEQ ID NO: 157156

SEQ ID NO: 372952 - RNA, 64 nt, Homo Sapiens; identical to SEQ ID NO: 157157

SEQ ID NO: 372953 - RNA, 64 nt, Homo Sapiens; identical to SEQ ID NO: 157158

SEQ ID NO: 372954 - RNA, 64 nt, Homo Sapiens; identical to SEQ ID NO: 157159

SEQ ID NO: 372955 - RNA, 64 nt, Homo Sapiens; identical to SEQ ID NO: 157160

SEQ ID NO: 372956 - RNA, 64 nt, Homo Sapiens; identical to SEQ ID NO: 157161

SEQ ID NO: 372957 - RNA, 64 nt, Homo Sapiens; identical to SEQ ID NO: 157162

SEQ ID NO: 372958 - RNA, 64 nt, Homo Sapiens; identical to SEQ ID NO: 157163

SEQ ID NO: 372959 - RNA, 64 nt, Homo Sapiens; identical to SEQ ID NO: 157164

SEQ ID NO: 372960 - RNA, 64 nt, Homo Sapiens; identical to SEQ ID NO: 157165

SEQ ID NO: 372961 - RNA, 64 nt, Homo Sapiens; identical to SEQ ID NO: 157166

SEQ ID NO: 372962 - RNA, 64 nt, Homo Sapiens; identical to SEQ ID NO: 157167

SEQ ID NO: 372963 - RNA, 64 nt, Homo Sapiens; identical to SEQ ID NO: 157168

SEQ ID NO: 372964 - RNA, 64 nt, Homo Sapiens; identical to SEQ ID NO: 157169

SEQ ID NO: 372965 - RNA, 64 nt, Homo Sapiens; identical to SEQ ID NO: 157170

SEQ ID NO: 372966 - RNA, 64 nt, Homo Sapiens; identical to SEQ ID NO: 157171

SEQ ID NO: 372967 - RNA, 64 nt, Homo Sapiens; identical to SEQ ID NO: 157172

SEQ ID NO: 372968 - RNA, 64 nt, Homo Sapiens; identical to SEQ ID NO: 157173

SEQ ID NO: 372969 - RNA, 64 nt, Homo Sapiens; identical to SEQ ID NO: 157174

SEQ ID NO: 372970 - RNA, 64 nt, Homo Sapiens; identical to SEQ ID NO: 157175

SEQ ID NO: 372971 - RNA, 64 nt, Homo Sapiens; identical to SEQ ID NO: 157176

SEQ ID NO: 372972 - RNA, 64 nt, Homo Sapiens; identical to SEQ ID NO: 157177

SEQ ID NO: 372973 - RNA, 64 nt, Homo Sapiens; identical to SEQ ID NO: 157178

SEQ ID NO: 372974 - RNA, 64 nt, Homo Sapiens; identical to SEQ ID NO: 157179

SEQ ID NO: 372975 - RNA, 64 nt, Homo Sapiens; identical to SEQ ID NO: 157180

SEQ ID NO: 372976 - RNA, 64 nt, Homo Sapiens; identical to SEQ ID NO: 157181

SEQ ID NO: 372977 - RNA, 64 nt, Homo Sapiens; identical to SEQ ID NO: 157182

SEQ ID NO: 372978 - RNA, 64 nt, Homo Sapiens; identical to SEQ ID NO: 157183

SEQ ID NO: 372979 - RNA, 64 nt, Homo Sapiens; identical to SEQ ID NO: 157184

SEQ ID NO: 372980 - RNA, 64 nt, Homo Sapiens; identical to SEQ ID NO: 157185

SEQ ID NO: 372981 - RNA, 64 nt, Homo Sapiens; identical to SEQ ID NO: 157186

SEQ ID NO: 372982 - RNA, 64 nt, Homo Sapiens; identical to SEQ ID NO: 157187

SEQ ID NO: 372983 - RNA, 64 nt, Homo Sapiens; identical to SEQ ID NO: 157188

SEQ ID NO: 372984 - RNA, 64 nt, Homo Sapiens; identical to SEQ ID NO: 157189

SEQ ID NO: 372985 - RNA, 64 nt, Homo Sapiens; identical to SEQ ID NO: 157190

SEQ ID NO: 372986 - RNA, 64 nt, Homo Sapiens; identical to SEQ ID NO: 157191

SEQ ID NO: 372987 - RNA, 64 nt, Homo Sapiens; identical to SEQ ID NO: 157192

SEQ ID NO: 372988 - RNA, 64 nt, Homo Sapiens; identical to SEQ ID NO: 157193

SEQ ID NO: 372989 - RNA, 64 nt, Homo Sapiens; identical to SEQ ID NO: 157194

SEQ ID NO: 372990 - RNA, 64 nt, Homo Sapiens; identical to SEQ ID NO: 157195

SEQ ID NO: 372991 - RNA, 64 nt, Homo Sapiens; identical to SEQ ID NO: 157196

SEQ ID NO: 372992 - RNA, 64 nt, Homo Sapiens; identical to SEQ ID NO: 157197

SEQ ID NO: 372993 - RNA, 64 nt, Homo Sapiens; identical to SEQ ID NO: 157198

SEQ ID NO: 372994 - RNA, 64 nt, Homo Sapiens; identical to SEQ ID NO: 157199

SEQ ID NO: 372995 - RNA, 64 nt, Homo Sapiens; identical to SEQ ID NO: 157200

SEQ ID NO: 372996 - RNA, 64 nt, Homo Sapiens; identical to SEQ ID NO: 157201

SEQ ID NO: 372997 - RNA, 64 nt, Homo Sapiens; identical to SEQ ID NO: 157202

SEQ ID NO: 372998 - RNA, 64 nt, Homo Sapiens; identical to SEQ ID NO: 157203

SEQ ID NO: 372999 - RNA, 64 nt, Homo Sapiens; identical to SEQ ID NO: 157204

SEQ ID NO: 373000 - RNA, 64 nt, Homo Sapiens; identical to SEQ ID NO: 157205

SEQ ID NO: 373001 - RNA, 64 nt, Homo Sapiens; identical to SEQ ID NO: 157206

SEQ ID NO: 373002 - RNA, 64 nt, Homo Sapiens; identical to SEQ ID NO: 157207

SEQ ID NO: 373003 - RNA, 64 nt, Homo Sapiens; identical to SEQ ID NO: 157208

SEQ ID NO: 373004 - RNA, 64 nt, Homo Sapiens; identical to SEQ ID NO: 157209

SEQ ID NO: 373005 - RNA, 64 nt, Homo Sapiens; identical to SEQ ID NO: 157210

SEQ ID NO: 373006 - RNA, 64 nt, Homo Sapiens; identical to SEQ ID NO: 157211

SEQ ID NO: 373007 - RNA, 64 nt, Homo Sapiens; identical to SEQ ID NO: 157212

SEQ ID NO: 373008 - RNA, 64 nt, Homo Sapiens; identical to SEQ ID NO: 157213

SEQ ID NO: 373009 - RNA, 64 nt, Homo Sapiens; identical to SEQ ID NO: 157214

SEQ ID NO: 373010 - RNA, 64 nt, Homo Sapiens; identical to SEQ ID NO: 157215

SEQ ID NO: 373011 - RNA, 64 nt, Homo Sapiens; identical to SEQ ID NO: 157216

SEQ ID NO: 373012 - RNA, 64 nt, Homo Sapiens; identical to SEQ ID NO: 157217

SEQ ID NO: 373013 - RNA, 64 nt, Homo Sapiens; identical to SEQ ID NO: 157218

SEQ ID NO: 373014 - RNA, 64 nt, Homo Sapiens; identical to SEQ ID NO: 157219

SEQ ID NO: 373015 - RNA, 64 nt, Homo Sapiens; identical to SEQ ID NO: 157220

SEQ ID NO: 373016 - RNA, 64 nt, Homo Sapiens; identical to SEQ ID NO: 157221

SEQ ID NO: 373017 - RNA, 64 nt, Homo Sapiens; identical to SEQ ID NO: 157222

SEQ ID NO: 373018 - RNA, 64 nt, Homo Sapiens; identical to SEQ ID NO: 157223

SEQ ID NO: 373019 - RNA, 64 nt, Homo Sapiens; identical to SEQ ID NO: 157224

SEQ ID NO: 373020 - RNA, 64 nt, Homo Sapiens; identical to SEQ ID NO: 157225

SEQ ID NO: 373021 - RNA, 64 nt, Homo Sapiens; identical to SEQ ID NO: 157226

SEQ ID NO: 373022 - RNA, 64 nt, Homo Sapiens; identical to SEQ ID NO: 157227

SEQ ID NO: 373023 - RNA, 64 nt, Homo Sapiens; identical to SEQ ID NO: 157228

SEQ ID NO: 373024 - RNA, 64 nt, Homo Sapiens; identical to SEQ ID NO: 157229

SEQ ID NO: 373025 - RNA, 64 nt, Homo Sapiens; identical to SEQ ID NO: 157230

SEQ ID NO: 373026 - RNA, 64 nt, Homo Sapiens; identical to SEQ ID NO: 157231

SEQ ID NO: 373027 - RNA, 63 nt, Homo Sapiens; identical to SEQ ID NO: 157232

SEQ ID NO: 373028 - RNA, 64 nt, Homo Sapiens; identical to SEQ ID NO: 157233

SEQ ID NO: 373029 - RNA, 64 nt, Homo Sapiens; identical to SEQ ID NO: 157234

SEQ ID NO: 373030 - RNA, 64 nt, Homo Sapiens; identical to SEQ ID NO: 157235

SEQ ID NO: 373031 - RNA, 64 nt, Homo Sapiens; identical to SEQ ID NO: 157236

SEQ ID NO: 373032 - RNA, 64 nt, Homo Sapiens; identical to SEQ ID NO: 157237

SEQ ID NO: 373033 - RNA, 64 nt, Homo Sapiens; identical to SEQ ID NO: 157238

SEQ ID NO: 373034 - RNA, 64 nt, Homo Sapiens; identical to SEQ ID NO: 157239

SEQ ID NO: 373035 - RNA, 64 nt, Homo Sapiens; identical to SEQ ID NO: 157240

SEQ ID NO: 373036 - RNA, 64 nt, Homo Sapiens; identical to SEQ ID NO: 157241

SEQ ID NO: 373037 - RNA, 64 nt, Homo Sapiens; identical to SEQ ID NO: 157242

SEQ ID NO: 373038 - RNA, 64 nt, Homo Sapiens; identical to SEQ ID NO: 157243

SEQ ID NO: 373039 - RNA, 64 nt, Homo Sapiens; identical to SEQ ID NO: 157244

SEQ ID NO: 373040 - RNA, 64 nt, Homo Sapiens; identical to SEQ ID NO: 157245

SEQ ID NO: 373041 - RNA, 64 nt, Homo Sapiens; identical to SEQ ID NO: 157246

SEQ ID NO: 373042 - RNA, 64 nt, Homo Sapiens; identical to SEQ ID NO: 157247

SEQ ID NO: 373043 - RNA, 64 nt, Homo Sapiens; identical to SEQ ID NO: 157248

SEQ ID NO: 373044 - RNA, 64 nt, Homo Sapiens; identical to SEQ ID NO: 157249

SEQ ID NO: 373045 - RNA, 64 nt, Homo Sapiens; identical to SEQ ID NO: 157250

SEQ ID NO: 373046 - RNA, 64 nt, Homo Sapiens; identical to SEQ ID NO: 157251

SEQ ID NO: 373047 - RNA, 64 nt, Homo Sapiens; identical to SEQ ID NO: 157252

SEQ ID NO: 373048 - RNA, 64 nt, Homo Sapiens; identical to SEQ ID NO: 157253

SEQ ID NO: 373049 - RNA, 64 nt, Homo Sapiens; identical to SEQ ID NO: 157254

SEQ ID NO: 373050 - RNA, 64 nt, Homo Sapiens; identical to SEQ ID NO: 157255

SEQ ID NO: 373051 - RNA, 64 nt, Homo Sapiens; identical to SEQ ID NO: 157256

SEQ ID NO: 373052 - RNA, 64 nt, Homo Sapiens; identical to SEQ ID NO: 157257

SEQ ID NO: 373053 - RNA, 64 nt, Homo Sapiens; identical to SEQ ID NO: 157258

SEQ ID NO: 373054 - RNA, 64 nt, Homo Sapiens; identical to SEQ ID NO: 157259

SEQ ID NO: 373055 - RNA, 64 nt, Homo Sapiens; identical to SEQ ID NO: 157260

SEQ ID NO: 373056 - RNA, 64 nt, Homo Sapiens; identical to SEQ ID NO: 157261

SEQ ID NO: 373057 - RNA, 64 nt, Homo Sapiens; identical to SEQ ID NO: 157262

SEQ ID NO: 373058 - RNA, 64 nt, Homo Sapiens; identical to SEQ ID NO: 157263

SEQ ID NO: 373059 - RNA, 64 nt, Homo Sapiens; identical to SEQ ID NO: 157264

SEQ ID NO: 373060 - RNA, 64 nt, Homo Sapiens; identical to SEQ ID NO: 157265

SEQ ID NO: 373061 - RNA, 64 nt, Homo Sapiens; identical to SEQ ID NO: 157266

SEQ ID NO: 373062 - RNA, 64 nt, Homo Sapiens; identical to SEQ ID NO: 157267

SEQ ID NO: 373063 - RNA, 64 nt, Homo Sapiens; identical to SEQ ID NO: 157268

SEQ ID NO: 373064 - RNA, 64 nt, Homo Sapiens; identical to SEQ ID NO: 157269

SEQ ID NO: 373065 - RNA, 64 nt, Homo Sapiens; identical to SEQ ID NO: 157270

SEQ ID NO: 373066 - RNA, 64 nt, Homo Sapiens; identical to SEQ ID NO: 157271

SEQ ID NO: 373067 - RNA, 64 nt, Homo Sapiens; identical to SEQ ID NO: 157272

SEQ ID NO: 373068 - RNA, 64 nt, Homo Sapiens; identical to SEQ ID NO: 157273

SEQ ID NO: 373069 - RNA, 64 nt, Homo Sapiens; identical to SEQ ID NO: 157274

SEQ ID NO: 373070 - RNA, 64 nt, Homo Sapiens; identical to SEQ ID NO: 157275

SEQ ID NO: 373071 - RNA, 64 nt, Homo Sapiens; identical to SEQ ID NO: 157276

SEQ ID NO: 373072 - RNA, 64 nt, Homo Sapiens; identical to SEQ ID NO: 157277

SEQ ID NO: 373073 - RNA, 64 nt, Homo Sapiens; identical to SEQ ID NO: 157278

SEQ ID NO: 373074 - RNA, 64 nt, Homo Sapiens; identical to SEQ ID NO: 157279

SEQ ID NO: 373075 - RNA, 64 nt, Homo Sapiens; identical to SEQ ID NO: 157280

SEQ ID NO: 373076 - RNA, 64 nt, Homo Sapiens; identical to SEQ ID NO: 157281

SEQ ID NO: 373077 - RNA, 64 nt, Homo Sapiens; identical to SEQ ID NO: 157282

SEQ ID NO: 373078 - RNA, 64 nt, Homo Sapiens; identical to SEQ ID NO: 157283

SEQ ID NO: 373079 - RNA, 64 nt, Homo Sapiens; identical to SEQ ID NO: 157284

SEQ ID NO: 373080 - RNA, 64 nt, Homo Sapiens; identical to SEQ ID NO: 157285

SEQ ID NO: 373081 - RNA, 64 nt, Homo Sapiens; identical to SEQ ID NO: 157286

SEQ ID NO: 373082 - RNA, 64 nt, Homo Sapiens; identical to SEQ ID NO: 157287

SEQ ID NO: 373083 - RNA, 64 nt, Homo Sapiens; identical to SEQ ID NO: 157288

SEQ ID NO: 373084 - RNA, 64 nt, Homo Sapiens; identical to SEQ ID NO: 157289

SEQ ID NO: 373085 - RNA, 64 nt, Homo Sapiens; identical to SEQ ID NO: 157290

SEQ ID NO: 373086 - RNA, 64 nt, Homo Sapiens; identical to SEQ ID NO: 157291

SEQ ID NO: 373087 - RNA, 64 nt, Homo Sapiens; identical to SEQ ID NO: 157292

SEQ ID NO: 373088 - RNA, 64 nt, Homo Sapiens; identical to SEQ ID NO: 157293

SEQ ID NO: 373089 - RNA, 64 nt, Homo Sapiens; identical to SEQ ID NO: 157294

SEQ ID NO: 373090 - RNA, 64 nt, Homo Sapiens; identical to SEQ ID NO: 157295

SEQ ID NO: 373091 - RNA, 64 nt, Homo Sapiens; identical to SEQ ID NO: 157296

SEQ ID NO: 373092 - RNA, 64 nt, Homo Sapiens; identical to SEQ ID NO: 157297

SEQ ID NO: 373093 - RNA, 64 nt, Homo Sapiens; identical to SEQ ID NO: 157298

SEQ ID NO: 373094 - RNA, 64 nt, Homo Sapiens; identical to SEQ ID NO: 157299

SEQ ID NO: 373095 - RNA, 64 nt, Homo Sapiens; identical to SEQ ID NO: 157300

SEQ ID NO: 373096 - RNA, 64 nt, Homo Sapiens; identical to SEQ ID NO: 157301

SEQ ID NO: 373097 - RNA, 64 nt, Homo Sapiens; identical to SEQ ID NO: 157302

SEQ ID NO: 373098 - RNA, 64 nt, Homo Sapiens; identical to SEQ ID NO: 157303

SEQ ID NO: 373099 - RNA, 64 nt, Homo Sapiens; identical to SEQ ID NO: 157304

SEQ ID NO: 373100 - RNA, 64 nt, Homo Sapiens; identical to SEQ ID NO: 157305

SEQ ID NO: 373101 - RNA, 64 nt, Homo Sapiens; identical to SEQ ID NO: 157306

SEQ ID NO: 373102 - RNA, 64 nt, Homo Sapiens; identical to SEQ ID NO: 157307

SEQ ID NO: 373103 - RNA, 64 nt, Homo Sapiens; identical to SEQ ID NO: 157308

SEQ ID NO: 373104 - RNA, 64 nt, Homo Sapiens; identical to SEQ ID NO: 157309

SEQ ID NO: 373105 - RNA, 64 nt, Homo Sapiens; identical to SEQ ID NO: 157310

SEQ ID NO: 373106 - RNA, 64 nt, Homo Sapiens; identical to SEQ ID NO: 157311

SEQ ID NO: 373107 - RNA, 64 nt, Homo Sapiens; identical to SEQ ID NO: 157312

SEQ ID NO: 373108 - RNA, 64 nt, Homo Sapiens; identical to SEQ ID NO: 157313

SEQ ID NO: 373109 - RNA, 64 nt, Homo Sapiens; identical to SEQ ID NO: 157314

SEQ ID NO: 373110 - RNA, 64 nt, Homo Sapiens; identical to SEQ ID NO: 157315

SEQ ID NO: 373111 - RNA, 64 nt, Homo Sapiens; identical to SEQ ID NO: 157316

SEQ ID NO: 373112 - RNA, 64 nt, Homo Sapiens; identical to SEQ ID NO: 157317

SEQ ID NO: 373113 - RNA, 64 nt, Homo Sapiens; identical to SEQ ID NO: 157318

SEQ ID NO: 373114 - RNA, 64 nt, Homo Sapiens; identical to SEQ ID NO: 157319

SEQ ID NO: 373115 - RNA, 64 nt, Homo Sapiens; identical to SEQ ID NO: 157320

SEQ ID NO: 373116 - RNA, 64 nt, Homo Sapiens; identical to SEQ ID NO: 157321

SEQ ID NO: 373117 - RNA, 64 nt, Homo Sapiens; identical to SEQ ID NO: 157322

SEQ ID NO: 373118 - RNA, 64 nt, Homo Sapiens; identical to SEQ ID NO: 157323

SEQ ID NO: 373119 - RNA, 64 nt, Homo Sapiens; identical to SEQ ID NO: 157324

SEQ ID NO: 373120 - RNA, 64 nt, Homo Sapiens; identical to SEQ ID NO: 157325

SEQ ID NO: 373121 - RNA, 64 nt, Homo Sapiens; identical to SEQ ID NO: 157326

SEQ ID NO: 373122 - RNA, 64 nt, Homo Sapiens; identical to SEQ ID NO: 157327

SEQ ID NO: 373123 - RNA, 64 nt, Homo Sapiens; identical to SEQ ID NO: 157328

SEQ ID NO: 373124 - RNA, 64 nt, Homo Sapiens; identical to SEQ ID NO: 157329

SEQ ID NO: 373125 - RNA, 64 nt, Homo Sapiens; identical to SEQ ID NO: 157330

SEQ ID NO: 373126 - RNA, 64 nt, Homo Sapiens; identical to SEQ ID NO: 157331

SEQ ID NO: 373127 - RNA, 64 nt, Homo Sapiens; identical to SEQ ID NO: 157332

SEQ ID NO: 373128 - RNA, 64 nt, Homo Sapiens; identical to SEQ ID NO: 157333

SEQ ID NO: 373129 - RNA, 64 nt, Homo Sapiens; identical to SEQ ID NO: 157334

SEQ ID NO: 373130 - RNA, 64 nt, Homo Sapiens; identical to SEQ ID NO: 157335

SEQ ID NO: 373131 - RNA, 64 nt, Homo Sapiens; identical to SEQ ID NO: 157336

SEQ ID NO: 373132 - RNA, 64 nt, Homo Sapiens; identical to SEQ ID NO: 157337

SEQ ID NO: 373133 - RNA, 64 nt, Homo Sapiens; identical to SEQ ID NO: 157338

SEQ ID NO: 373134 - RNA, 64 nt, Homo Sapiens; identical to SEQ ID NO: 157339

SEQ ID NO: 373135 - RNA, 64 nt, Homo Sapiens; identical to SEQ ID NO: 157340

SEQ ID NO: 373136 - RNA, 64 nt, Homo Sapiens; identical to SEQ ID NO: 157341

SEQ ID NO: 373137 - RNA, 64 nt, Homo Sapiens; identical to SEQ ID NO: 157342

SEQ ID NO: 373138 - RNA, 64 nt, Homo Sapiens; identical to SEQ ID NO: 157343

SEQ ID NO: 373139 - RNA, 64 nt, Homo Sapiens; identical to SEQ ID NO: 157344

SEQ ID NO: 373140 - RNA, 64 nt, Homo Sapiens; identical to SEQ ID NO: 157345

SEQ ID NO: 373141 - RNA, 64 nt, Homo Sapiens; identical to SEQ ID NO: 157346

SEQ ID NO: 373142 - RNA, 64 nt, Homo Sapiens; identical to SEQ ID NO: 157347

SEQ ID NO: 373143 - RNA, 64 nt, Homo Sapiens; identical to SEQ ID NO: 157348

SEQ ID NO: 373144 - RNA, 64 nt, Homo Sapiens; identical to SEQ ID NO: 157349

SEQ ID NO: 373145 - RNA, 64 nt, Homo Sapiens; identical to SEQ ID NO: 157350

SEQ ID NO: 373146 - RNA, 64 nt, Homo Sapiens; identical to SEQ ID NO: 157351

SEQ ID NO: 373147 - RNA, 64 nt, Homo Sapiens; identical to SEQ ID NO: 157352

SEQ ID NO: 373148 - RNA, 64 nt, Homo Sapiens; identical to SEQ ID NO: 157353

SEQ ID NO: 373149 - RNA, 64 nt, Homo Sapiens; identical to SEQ ID NO: 157354

SEQ ID NO: 373150 - RNA, 64 nt, Homo Sapiens; identical to SEQ ID NO: 157355

SEQ ID NO: 373151 - RNA, 64 nt, Homo Sapiens; identical to SEQ ID NO: 157356

SEQ ID NO: 373152 - RNA, 64 nt, Homo Sapiens; identical to SEQ ID NO: 157357

SEQ ID NO: 373153 - RNA, 64 nt, Homo Sapiens; identical to SEQ ID NO: 157358

SEQ ID NO: 373154 - RNA, 64 nt, Homo Sapiens; identical to SEQ ID NO: 157359

SEQ ID NO: 373155 - RNA, 64 nt, Homo Sapiens; identical to SEQ ID NO: 157360

SEQ ID NO: 373156 - RNA, 64 nt, Homo Sapiens; identical to SEQ ID NO: 157361

SEQ ID NO: 373157 - RNA, 64 nt, Homo Sapiens; identical to SEQ ID NO: 157362

SEQ ID NO: 373158 - RNA, 64 nt, Homo Sapiens; identical to SEQ ID NO: 157363

SEQ ID NO: 373159 - RNA, 64 nt, Homo Sapiens; identical to SEQ ID NO: 157364

SEQ ID NO: 373160 - RNA, 64 nt, Homo Sapiens; identical to SEQ ID NO: 157365

SEQ ID NO: 373161 - RNA, 64 nt, Homo Sapiens; identical to SEQ ID NO: 157366

SEQ ID NO: 373162 - RNA, 64 nt, Homo Sapiens; identical to SEQ ID NO: 157367

SEQ ID NO: 373163 - RNA, 64 nt, Homo Sapiens; identical to SEQ ID NO: 157368

SEQ ID NO: 373164 - RNA, 64 nt, Homo Sapiens; identical to SEQ ID NO: 157369

SEQ ID NO: 373165 - RNA, 64 nt, Homo Sapiens; identical to SEQ ID NO: 157370

SEQ ID NO: 373166 - RNA, 64 nt, Homo Sapiens; identical to SEQ ID NO: 157371

SEQ ID NO: 373167 - RNA, 64 nt, Homo Sapiens; identical to SEQ ID NO: 157372

SEQ ID NO: 373168 - RNA, 64 nt, Homo Sapiens; identical to SEQ ID NO: 157373

SEQ ID NO: 373169 - RNA, 64 nt, Homo Sapiens; identical to SEQ ID NO: 157374

SEQ ID NO: 373170 - RNA, 64 nt, Homo Sapiens; identical to SEQ ID NO: 157375

SEQ ID NO: 373171 - RNA, 64 nt, Homo Sapiens; identical to SEQ ID NO: 157376

SEQ ID NO: 373172 - RNA, 64 nt, Homo Sapiens; identical to SEQ ID NO: 157377

SEQ ID NO: 373173 - RNA, 64 nt, Homo Sapiens; identical to SEQ ID NO: 157378

SEQ ID NO: 373174 - RNA, 64 nt, Homo Sapiens; identical to SEQ ID NO: 157379

SEQ ID NO: 373175 - RNA, 64 nt, Homo Sapiens; identical to SEQ ID NO: 157380

SEQ ID NO: 373176 - RNA, 64 nt, Homo Sapiens; identical to SEQ ID NO: 157381

SEQ ID NO: 373177 - RNA, 64 nt, Homo Sapiens; identical to SEQ ID NO: 157382

SEQ ID NO: 373178 - RNA, 64 nt, Homo Sapiens; identical to SEQ ID NO: 157383

SEQ ID NO: 373179 - RNA, 64 nt, Homo Sapiens; identical to SEQ ID NO: 157384

SEQ ID NO: 373180 - RNA, 64 nt, Homo Sapiens; identical to SEQ ID NO: 157385

SEQ ID NO: 373181 - RNA, 64 nt, Homo Sapiens; identical to SEQ ID NO: 157386

SEQ ID NO: 373182 - RNA, 64 nt, Homo Sapiens; identical to SEQ ID NO: 157387

SEQ ID NO: 373183 - RNA, 64 nt, Homo Sapiens; identical to SEQ ID NO: 157388

SEQ ID NO: 373184 - RNA, 64 nt, Homo Sapiens; identical to SEQ ID NO: 157389

SEQ ID NO: 373185 - RNA, 64 nt, Homo Sapiens; identical to SEQ ID NO: 157390

SEQ ID NO: 373186 - RNA, 64 nt, Homo Sapiens; identical to SEQ ID NO: 157391

SEQ ID NO: 373187 - RNA, 64 nt, Homo Sapiens; identical to SEQ ID NO: 157392

SEQ ID NO: 373188 - RNA, 64 nt, Homo Sapiens; identical to SEQ ID NO: 157393

SEQ ID NO: 373189 - RNA, 64 nt, Homo Sapiens; identical to SEQ ID NO: 157394

SEQ ID NO: 373190 - RNA, 64 nt, Homo Sapiens; identical to SEQ ID NO: 157395

SEQ ID NO: 373191 - RNA, 64 nt, Homo Sapiens; identical to SEQ ID NO: 157396

SEQ ID NO: 373192 - RNA, 64 nt, Homo Sapiens; identical to SEQ ID NO: 157397

SEQ ID NO: 373193 - RNA, 64 nt, Homo Sapiens; identical to SEQ ID NO: 157398

SEQ ID NO: 373194 - RNA, 64 nt, Homo Sapiens; identical to SEQ ID NO: 157399

SEQ ID NO: 373195 - RNA, 64 nt, Homo Sapiens; identical to SEQ ID NO: 157400

SEQ ID NO: 373196 - RNA, 64 nt, Homo Sapiens; identical to SEQ ID NO: 157401

SEQ ID NO: 373197 - RNA, 64 nt, Homo Sapiens; identical to SEQ ID NO: 157402

SEQ ID NO: 373198 - RNA, 64 nt, Homo Sapiens; identical to SEQ ID NO: 157403

SEQ ID NO: 373199 - RNA, 64 nt, Homo Sapiens; identical to SEQ ID NO: 157404

SEQ ID NO: 373200 - RNA, 64 nt, Homo Sapiens; identical to SEQ ID NO: 157405

SEQ ID NO: 373201 - RNA, 64 nt, Homo Sapiens; identical to SEQ ID NO: 157406

SEQ ID NO: 373202 - RNA, 64 nt, Homo Sapiens; identical to SEQ ID NO: 157407

SEQ ID NO: 373203 - RNA, 64 nt, Homo Sapiens; identical to SEQ ID NO: 157408

SEQ ID NO: 373204 - RNA, 64 nt, Homo Sapiens; identical to SEQ ID NO: 157409

SEQ ID NO: 373205 - RNA, 64 nt, Homo Sapiens; identical to SEQ ID NO: 157410

SEQ ID NO: 373206 - RNA, 64 nt, Homo Sapiens; identical to SEQ ID NO: 157411

SEQ ID NO: 373207 - RNA, 64 nt, Homo Sapiens; identical to SEQ ID NO: 157412

SEQ ID NO: 373208 - RNA, 64 nt, Homo Sapiens; identical to SEQ ID NO: 157413

SEQ ID NO: 373209 - RNA, 64 nt, Homo Sapiens; identical to SEQ ID NO: 157414

SEQ ID NO: 373210 - RNA, 64 nt, Homo Sapiens; identical to SEQ ID NO: 157415

SEQ ID NO: 373211 - RNA, 64 nt, Homo Sapiens; identical to SEQ ID NO: 157416

SEQ ID NO: 373212 - RNA, 64 nt, Homo Sapiens; identical to SEQ ID NO: 157417

SEQ ID NO: 373213 - RNA, 64 nt, Homo Sapiens; identical to SEQ ID NO: 157418

SEQ ID NO: 373214 - RNA, 64 nt, Homo Sapiens; identical to SEQ ID NO: 157419

SEQ ID NO: 373215 - RNA, 64 nt, Homo Sapiens; identical to SEQ ID NO: 157420

SEQ ID NO: 373216 - RNA, 64 nt, Homo Sapiens; identical to SEQ ID NO: 157421

SEQ ID NO: 373217 - RNA, 64 nt, Homo Sapiens; identical to SEQ ID NO: 157422

SEQ ID NO: 373218 - RNA, 64 nt, Homo Sapiens; identical to SEQ ID NO: 157423

SEQ ID NO: 373219 - RNA, 64 nt, Homo Sapiens; identical to SEQ ID NO: 157424

SEQ ID NO: 373220 - RNA, 64 nt, Homo Sapiens; identical to SEQ ID NO: 157425

SEQ ID NO: 373221 - RNA, 64 nt, Homo Sapiens; identical to SEQ ID NO: 157426

SEQ ID NO: 373222 - RNA, 64 nt, Homo Sapiens; identical to SEQ ID NO: 157427

SEQ ID NO: 373223 - RNA, 64 nt, Homo Sapiens; identical to SEQ ID NO: 157428

SEQ ID NO: 373224 - RNA, 64 nt, Homo Sapiens; identical to SEQ ID NO: 157429

SEQ ID NO: 373225 - RNA, 64 nt, Homo Sapiens; identical to SEQ ID NO: 157430

SEQ ID NO: 373226 - RNA, 64 nt, Homo Sapiens; identical to SEQ ID NO: 157431

SEQ ID NO: 373227 - RNA, 64 nt, Homo Sapiens; identical to SEQ ID NO: 157432

SEQ ID NO: 373228 - RNA, 64 nt, Homo Sapiens; identical to SEQ ID NO: 157433

SEQ ID NO: 373229 - RNA, 64 nt, Homo Sapiens; identical to SEQ ID NO: 157434

SEQ ID NO: 373230 - RNA, 64 nt, Homo Sapiens; identical to SEQ ID NO: 157435

SEQ ID NO: 373231 - RNA, 64 nt, Homo Sapiens; identical to SEQ ID NO: 157436

SEQ ID NO: 373232 - RNA, 64 nt, Homo Sapiens; identical to SEQ ID NO: 157437

SEQ ID NO: 373233 - RNA, 64 nt, Homo Sapiens; identical to SEQ ID NO: 157438

SEQ ID NO: 373234 - RNA, 64 nt, Homo Sapiens; identical to SEQ ID NO: 157439

SEQ ID NO: 373235 - RNA, 64 nt, Homo Sapiens; identical to SEQ ID NO: 157440

SEQ ID NO: 373236 - RNA, 64 nt, Homo Sapiens; identical to SEQ ID NO: 157441

SEQ ID NO: 373237 - RNA, 64 nt, Homo Sapiens; identical to SEQ ID NO: 157442

SEQ ID NO: 373238 - RNA, 64 nt, Homo Sapiens; identical to SEQ ID NO: 157443

SEQ ID NO: 373239 - RNA, 64 nt, Homo Sapiens; identical to SEQ ID NO: 157444

SEQ ID NO: 373240 - RNA, 64 nt, Homo Sapiens; identical to SEQ ID NO: 157445

SEQ ID NO: 373241 - RNA, 64 nt, Homo Sapiens; identical to SEQ ID NO: 157446

SEQ ID NO: 373242 - RNA, 64 nt, Homo Sapiens; identical to SEQ ID NO: 157447

SEQ ID NO: 373243 - RNA, 64 nt, Homo Sapiens; identical to SEQ ID NO: 157448

SEQ ID NO: 373244 - RNA, 64 nt, Homo Sapiens; identical to SEQ ID NO: 157449

SEQ ID NO: 373245 - RNA, 64 nt, Homo Sapiens; identical to SEQ ID NO: 157450

SEQ ID NO: 373246 - RNA, 64 nt, Homo Sapiens; identical to SEQ ID NO: 157451

SEQ ID NO: 373247 - RNA, 64 nt, Homo Sapiens; identical to SEQ ID NO: 157452

SEQ ID NO: 373248 - RNA, 64 nt, Homo Sapiens; identical to SEQ ID NO: 157453

SEQ ID NO: 373249 - RNA, 64 nt, Homo Sapiens; identical to SEQ ID NO: 157454

SEQ ID NO: 373250 - RNA, 64 nt, Homo Sapiens; identical to SEQ ID NO: 157455

SEQ ID NO: 373251 - RNA, 64 nt, Homo Sapiens; identical to SEQ ID NO: 157456

SEQ ID NO: 373252 - RNA, 64 nt, Homo Sapiens; identical to SEQ ID NO: 157457

SEQ ID NO: 373253 - RNA, 64 nt, Homo Sapiens; identical to SEQ ID NO: 157458

SEQ ID NO: 373254 - RNA, 64 nt, Homo Sapiens; identical to SEQ ID NO: 157459

SEQ ID NO: 373255 - RNA, 64 nt, Homo Sapiens; identical to SEQ ID NO: 157460

SEQ ID NO: 373256 - RNA, 64 nt, Homo Sapiens; identical to SEQ ID NO: 157461

SEQ ID NO: 373257 - RNA, 64 nt, Homo Sapiens; identical to SEQ ID NO: 157462

SEQ ID NO: 373258 - RNA, 64 nt, Homo Sapiens; identical to SEQ ID NO: 157463

SEQ ID NO: 373259 - RNA, 64 nt, Homo Sapiens; identical to SEQ ID NO: 157464

SEQ ID NO: 373260 - RNA, 64 nt, Homo Sapiens; identical to SEQ ID NO: 157465

SEQ ID NO: 373261 - RNA, 64 nt, Homo Sapiens; identical to SEQ ID NO: 157466

SEQ ID NO: 373262 - RNA, 64 nt, Homo Sapiens; identical to SEQ ID NO: 157467

SEQ ID NO: 373263 - RNA, 64 nt, Homo Sapiens; identical to SEQ ID NO: 157468

SEQ ID NO: 373264 - RNA, 64 nt, Homo Sapiens; identical to SEQ ID NO: 157469

SEQ ID NO: 373265 - RNA, 64 nt, Homo Sapiens; identical to SEQ ID NO: 157470

SEQ ID NO: 373266 - RNA, 64 nt, Homo Sapiens; identical to SEQ ID NO: 157471

SEQ ID NO: 373267 - RNA, 64 nt, Homo Sapiens; identical to SEQ ID NO: 157472

SEQ ID NO: 373268 - RNA, 64 nt, Homo Sapiens; identical to SEQ ID NO: 157473

SEQ ID NO: 373269 - RNA, 64 nt, Homo Sapiens; identical to SEQ ID NO: 157474

SEQ ID NO: 373270 - RNA, 64 nt, Homo Sapiens; identical to SEQ ID NO: 157475

SEQ ID NO: 373271 - RNA, 64 nt, Homo Sapiens; identical to SEQ ID NO: 157476

SEQ ID NO: 373272 - RNA, 64 nt, Homo Sapiens; identical to SEQ ID NO: 157477

SEQ ID NO: 373273 - RNA, 64 nt, Homo Sapiens; identical to SEQ ID NO: 157478

SEQ ID NO: 373274 - RNA, 64 nt, Homo Sapiens; identical to SEQ ID NO: 157479

SEQ ID NO: 373275 - RNA, 64 nt, Homo Sapiens; identical to SEQ ID NO: 157480

SEQ ID NO: 373276 - RNA, 64 nt, Homo Sapiens; identical to SEQ ID NO: 157481

SEQ ID NO: 373277 - RNA, 64 nt, Homo Sapiens; identical to SEQ ID NO: 157482

SEQ ID NO: 373278 - RNA, 64 nt, Homo Sapiens; identical to SEQ ID NO: 157483

SEQ ID NO: 373279 - RNA, 64 nt, Homo Sapiens; identical to SEQ ID NO: 157484

SEQ ID NO: 373280 - RNA, 64 nt, Homo Sapiens; identical to SEQ ID NO: 157485

SEQ ID NO: 373281 - RNA, 64 nt, Homo Sapiens; identical to SEQ ID NO: 157486

SEQ ID NO: 373282 - RNA, 64 nt, Homo Sapiens; identical to SEQ ID NO: 157487

SEQ ID NO: 373283 - RNA, 64 nt, Homo Sapiens; identical to SEQ ID NO: 157488

SEQ ID NO: 373284 - RNA, 64 nt, Homo Sapiens; identical to SEQ ID NO: 157489

SEQ ID NO: 373285 - RNA, 64 nt, Homo Sapiens; identical to SEQ ID NO: 157490

SEQ ID NO: 373286 - RNA, 64 nt, Homo Sapiens; identical to SEQ ID NO: 157491

SEQ ID NO: 373287 - RNA, 64 nt, Homo Sapiens; identical to SEQ ID NO: 157492

SEQ ID NO: 373288 - RNA, 64 nt, Homo Sapiens; identical to SEQ ID NO: 157493

SEQ ID NO: 373289 - RNA, 64 nt, Homo Sapiens; identical to SEQ ID NO: 157494

SEQ ID NO: 373290 - RNA, 64 nt, Homo Sapiens; identical to SEQ ID NO: 157495

SEQ ID NO: 373291 - RNA, 64 nt, Homo Sapiens; identical to SEQ ID NO: 157496

SEQ ID NO: 373292 - RNA, 64 nt, Homo Sapiens; identical to SEQ ID NO: 157497

SEQ ID NO: 373293 - RNA, 64 nt, Homo Sapiens; identical to SEQ ID NO: 157498

SEQ ID NO: 373294 - RNA, 64 nt, Homo Sapiens; identical to SEQ ID NO: 157499

SEQ ID NO: 373295 - RNA, 64 nt, Homo Sapiens; identical to SEQ ID NO: 157500

SEQ ID NO: 373296 - RNA, 64 nt, Homo Sapiens; identical to SEQ ID NO: 157501

SEQ ID NO: 373297 - RNA, 64 nt, Homo Sapiens; identical to SEQ ID NO: 157502

SEQ ID NO: 373298 - RNA, 64 nt, Homo Sapiens; identical to SEQ ID NO: 157503

SEQ ID NO: 373299 - RNA, 64 nt, Homo Sapiens; identical to SEQ ID NO: 157504

SEQ ID NO: 373300 - RNA, 64 nt, Homo Sapiens; identical to SEQ ID NO: 157505

SEQ ID NO: 373301 - RNA, 64 nt, Homo Sapiens; identical to SEQ ID NO: 157506

SEQ ID NO: 373302 - RNA, 64 nt, Homo Sapiens; identical to SEQ ID NO: 157507

SEQ ID NO: 373303 - RNA, 64 nt, Homo Sapiens; identical to SEQ ID NO: 157508

SEQ ID NO: 373304 - RNA, 64 nt, Homo Sapiens; identical to SEQ ID NO: 157509

SEQ ID NO: 373305 - RNA, 64 nt, Homo Sapiens; identical to SEQ ID NO: 157510

SEQ ID NO: 373306 - RNA, 64 nt, Homo Sapiens; identical to SEQ ID NO: 157511

SEQ ID NO: 373307 - RNA, 64 nt, Homo Sapiens; identical to SEQ ID NO: 157512

SEQ ID NO: 373308 - RNA, 64 nt, Homo Sapiens; identical to SEQ ID NO: 157513

SEQ ID NO: 373309 - RNA, 64 nt, Homo Sapiens; identical to SEQ ID NO: 157514

SEQ ID NO: 373310 - RNA, 64 nt, Homo Sapiens; identical to SEQ ID NO: 157515

SEQ ID NO: 373311 - RNA, 64 nt, Homo Sapiens; identical to SEQ ID NO: 157516

SEQ ID NO: 373312 - RNA, 64 nt, Homo Sapiens; identical to SEQ ID NO: 157517

SEQ ID NO: 373313 - RNA, 64 nt, Homo Sapiens; identical to SEQ ID NO: 157518

SEQ ID NO: 373314 - RNA, 64 nt, Homo Sapiens; identical to SEQ ID NO: 157519

SEQ ID NO: 373315 - RNA, 64 nt, Homo Sapiens; identical to SEQ ID NO: 157520

SEQ ID NO: 373316 - RNA, 64 nt, Homo Sapiens; identical to SEQ ID NO: 157521

SEQ ID NO: 373317 - RNA, 64 nt, Homo Sapiens; identical to SEQ ID NO: 157522

SEQ ID NO: 373318 - RNA, 64 nt, Homo Sapiens; identical to SEQ ID NO: 157523

SEQ ID NO: 373319 - RNA, 64 nt, Homo Sapiens; identical to SEQ ID NO: 157524

SEQ ID NO: 373320 - RNA, 64 nt, Homo Sapiens; identical to SEQ ID NO: 157525

SEQ ID NO: 373321 - RNA, 64 nt, Homo Sapiens; identical to SEQ ID NO: 157526

SEQ ID NO: 373322 - RNA, 64 nt, Homo Sapiens; identical to SEQ ID NO: 157527

SEQ ID NO: 373323 - RNA, 64 nt, Homo Sapiens; identical to SEQ ID NO: 157528

SEQ ID NO: 373324 - RNA, 64 nt, Homo Sapiens; identical to SEQ ID NO: 157529

SEQ ID NO: 373325 - RNA, 64 nt, Homo Sapiens; identical to SEQ ID NO: 157530

SEQ ID NO: 373326 - RNA, 64 nt, Homo Sapiens; identical to SEQ ID NO: 157531

SEQ ID NO: 373327 - RNA, 64 nt, Homo Sapiens; identical to SEQ ID NO: 157532

SEQ ID NO: 373328 - RNA, 64 nt, Homo Sapiens; identical to SEQ ID NO: 157533

SEQ ID NO: 373329 - RNA, 64 nt, Homo Sapiens; identical to SEQ ID NO: 157534

SEQ ID NO: 373330 - RNA, 64 nt, Homo Sapiens; identical to SEQ ID NO: 157535

SEQ ID NO: 373331 - RNA, 64 nt, Homo Sapiens; identical to SEQ ID NO: 157536

SEQ ID NO: 373332 - RNA, 64 nt, Homo Sapiens; identical to SEQ ID NO: 157537

SEQ ID NO: 373333 - RNA, 64 nt, Homo Sapiens; identical to SEQ ID NO: 157538

SEQ ID NO: 373334 - RNA, 64 nt, Homo Sapiens; identical to SEQ ID NO: 157539

SEQ ID NO: 373335 - RNA, 64 nt, Homo Sapiens; identical to SEQ ID NO: 157540

SEQ ID NO: 373336 - RNA, 64 nt, Homo Sapiens; identical to SEQ ID NO: 157541

SEQ ID NO: 373337 - RNA, 64 nt, Homo Sapiens; identical to SEQ ID NO: 157542

SEQ ID NO: 373338 - RNA, 64 nt, Homo Sapiens; identical to SEQ ID NO: 157543

SEQ ID NO: 373339 - RNA, 64 nt, Homo Sapiens; identical to SEQ ID NO: 157544

SEQ ID NO: 373340 - RNA, 64 nt, Homo Sapiens; identical to SEQ ID NO: 157545

SEQ ID NO: 373341 - RNA, 64 nt, Homo Sapiens; identical to SEQ ID NO: 157546

SEQ ID NO: 373342 - RNA, 64 nt, Homo Sapiens; identical to SEQ ID NO: 157547

SEQ ID NO: 373343 - RNA, 64 nt, Homo Sapiens; identical to SEQ ID NO: 157548

SEQ ID NO: 373344 - RNA, 64 nt, Homo Sapiens; identical to SEQ ID NO: 157549

SEQ ID NO: 373345 - RNA, 64 nt, Homo Sapiens; identical to SEQ ID NO: 157550

SEQ ID NO: 373346 - RNA, 64 nt, Homo Sapiens; identical to SEQ ID NO: 157551

SEQ ID NO: 373347 - RNA, 64 nt, Homo Sapiens; identical to SEQ ID NO: 157552

SEQ ID NO: 373348 - RNA, 64 nt, Homo Sapiens; identical to SEQ ID NO: 157553

SEQ ID NO: 373349 - RNA, 64 nt, Homo Sapiens; identical to SEQ ID NO: 157554

SEQ ID NO: 373350 - RNA, 64 nt, Homo Sapiens; identical to SEQ ID NO: 157555

SEQ ID NO: 373351 - RNA, 64 nt, Homo Sapiens; identical to SEQ ID NO: 157556

SEQ ID NO: 373352 - RNA, 64 nt, Homo Sapiens; identical to SEQ ID NO: 157557

SEQ ID NO: 373353 - RNA, 64 nt, Homo Sapiens; identical to SEQ ID NO: 157558

SEQ ID NO: 373354 - RNA, 64 nt, Homo Sapiens; identical to SEQ ID NO: 157559

SEQ ID NO: 373355 - RNA, 64 nt, Homo Sapiens; identical to SEQ ID NO: 157560

SEQ ID NO: 373356 - RNA, 64 nt, Homo Sapiens; identical to SEQ ID NO: 157561

SEQ ID NO: 373357 - RNA, 64 nt, Homo Sapiens; identical to SEQ ID NO: 157562

SEQ ID NO: 373358 - RNA, 64 nt, Homo Sapiens; identical to SEQ ID NO: 157563

SEQ ID NO: 373359 - RNA, 64 nt, Homo Sapiens; identical to SEQ ID NO: 157564

SEQ ID NO: 373360 - RNA, 64 nt, Homo Sapiens; identical to SEQ ID NO: 157565

SEQ ID NO: 373361 - RNA, 64 nt, Homo Sapiens; identical to SEQ ID NO: 157566

SEQ ID NO: 373362 - RNA, 64 nt, Homo Sapiens; identical to SEQ ID NO: 157567

SEQ ID NO: 373363 - RNA, 64 nt, Homo Sapiens; identical to SEQ ID NO: 157568

SEQ ID NO: 373364 - RNA, 64 nt, Homo Sapiens; identical to SEQ ID NO: 157569

SEQ ID NO: 373365 - RNA, 64 nt, Homo Sapiens; identical to SEQ ID NO: 157570

SEQ ID NO: 373366 - RNA, 64 nt, Homo Sapiens; identical to SEQ ID NO: 157571

SEQ ID NO: 373367 - RNA, 64 nt, Homo Sapiens; identical to SEQ ID NO: 157572

SEQ ID NO: 373368 - RNA, 64 nt, Homo Sapiens; identical to SEQ ID NO: 157573

SEQ ID NO: 373369 - RNA, 64 nt, Homo Sapiens; identical to SEQ ID NO: 157574

SEQ ID NO: 373370 - RNA, 64 nt, Homo Sapiens; identical to SEQ ID NO: 157575

SEQ ID NO: 373371 - RNA, 64 nt, Homo Sapiens; identical to SEQ ID NO: 157576

SEQ ID NO: 373372 - RNA, 64 nt, Homo Sapiens; identical to SEQ ID NO: 157577

SEQ ID NO: 373373 - RNA, 64 nt, Homo Sapiens; identical to SEQ ID NO: 157578

SEQ ID NO: 373374 - RNA, 64 nt, Homo Sapiens; identical to SEQ ID NO: 157579

SEQ ID NO: 373375 - RNA, 64 nt, Homo Sapiens; identical to SEQ ID NO: 157580

SEQ ID NO: 373376 - RNA, 64 nt, Homo Sapiens; identical to SEQ ID NO: 157581

SEQ ID NO: 373377 - RNA, 64 nt, Homo Sapiens; identical to SEQ ID NO: 157582

SEQ ID NO: 373378 - RNA, 64 nt, Homo Sapiens; identical to SEQ ID NO: 157583

SEQ ID NO: 373379 - RNA, 64 nt, Homo Sapiens; identical to SEQ ID NO: 157584

SEQ ID NO: 373380 - RNA, 64 nt, Homo Sapiens; identical to SEQ ID NO: 157585

SEQ ID NO: 373381 - RNA, 64 nt, Homo Sapiens; identical to SEQ ID NO: 157586

SEQ ID NO: 373382 - RNA, 64 nt, Homo Sapiens; identical to SEQ ID NO: 157587

SEQ ID NO: 373383 - RNA, 64 nt, Homo Sapiens; identical to SEQ ID NO: 157588

SEQ ID NO: 373384 - RNA, 64 nt, Homo Sapiens; identical to SEQ ID NO: 157589

SEQ ID NO: 373385 - RNA, 64 nt, Homo Sapiens; identical to SEQ ID NO: 157590

SEQ ID NO: 373386 - RNA, 64 nt, Homo Sapiens; identical to SEQ ID NO: 157591

SEQ ID NO: 373387 - RNA, 64 nt, Homo Sapiens; identical to SEQ ID NO: 157592

SEQ ID NO: 373388 - RNA, 64 nt, Homo Sapiens; identical to SEQ ID NO: 157593

SEQ ID NO: 373389 - RNA, 64 nt, Homo Sapiens; identical to SEQ ID NO: 157594

SEQ ID NO: 373390 - RNA, 64 nt, Homo Sapiens; identical to SEQ ID NO: 157595

SEQ ID NO: 373391 - RNA, 64 nt, Homo Sapiens; identical to SEQ ID NO: 157596

SEQ ID NO: 373392 - RNA, 64 nt, Homo Sapiens; identical to SEQ ID NO: 157597

SEQ ID NO: 373393 - RNA, 64 nt, Homo Sapiens; identical to SEQ ID NO: 157598

SEQ ID NO: 373394 - RNA, 64 nt, Homo Sapiens; identical to SEQ ID NO: 157599

SEQ ID NO: 373395 - RNA, 64 nt, Homo Sapiens; identical to SEQ ID NO: 157600

SEQ ID NO: 373396 - RNA, 64 nt, Homo Sapiens; identical to SEQ ID NO: 157601

SEQ ID NO: 373397 - RNA, 64 nt, Homo Sapiens; identical to SEQ ID NO: 157602

SEQ ID NO: 373398 - RNA, 64 nt, Homo Sapiens; identical to SEQ ID NO: 157603

SEQ ID NO: 373399 - RNA, 64 nt, Homo Sapiens; identical to SEQ ID NO: 157604

SEQ ID NO: 373400 - RNA, 64 nt, Homo Sapiens; identical to SEQ ID NO: 157605

SEQ ID NO: 373401 - RNA, 64 nt, Homo Sapiens; identical to SEQ ID NO: 157606

SEQ ID NO: 373402 - RNA, 64 nt, Homo Sapiens
aggcacauacauaguuaagacaaaaaagaacucaguguaagagagugugagcagcugaaaggag

SEQ ID NO: 373403 - RNA, 64 nt, Homo Sapiens
uuauuuuugagauguaauuuuaucaucaagaaaaguguaagaaaauauauagccaggaaccauu

SEQ ID NO: 373404 - RNA, 64 nt, Homo Sapiens
ccaucucguguuuagaggcuguauauguuagcuuguguaagaauguguuuucaaaacagugugu

SEQ ID NO: 373405 - RNA, 64 nt, Homo Sapiens
uggaaucaggaagucgagacaccaucccagguguguguaagagagagagagagaacagggagga

SEQ ID NO: 373406 - RNA, 64 nt, Homo Sapiens
ucacaaucccauuauucagacaguuugagaauugguguaagacauucggcugcagcuggccgcc

SEQ ID NO: 373407 - RNA, 56 nt, Homo Sapiens
ucacaaucccauuauucagagaauugguguaagacacagcuggccgcccaguuuga

SEQ ID NO: 373408 - RNA, 64 nt, Homo Sapiens
aaaauuuaucaauacuuaugugaauguaaauucaguguaagauguguaagaagaaaguuaaguc

SEQ ID NO: 373409 - RNA, 64 nt, Homo Sapiens
aaaguuaagucugaauguaaaauucauuaauuuaguguaagaaggaaucuuuaugauuuauguu

SEQ ID NO: 373410 - RNA, 64 nt, Homo Sapiens
cucuugauagcuaugucuauaaacucuaagccaaguguaagaaaggagaugauuuuucaccuuu

SEQ ID NO: 373411 - RNA, 64 nt, Homo Sapiens
cuuuaaaacauuuguuauuuuaucuauaccuguuguguaagaaaauuugaagaaauucuuuuua

SEQ ID NO: 373412 - RNA, 64 nt, Homo Sapiens; identical to SEQ ID NO: 70765

SEQ ID NO: 373413 - RNA, 64 nt, Homo Sapiens; identical to SEQ ID NO: 70766

SEQ ID NO: 373414 - RNA, 64 nt, Homo Sapiens; identical to SEQ ID NO: 70767

SEQ ID NO: 373415 - RNA, 64 nt, Homo Sapiens; identical to SEQ ID NO: 70768

SEQ ID NO: 373416 - RNA, 64 nt, Homo Sapiens; identical to SEQ ID NO: 70769

SEQ ID NO: 373417 - RNA, 64 nt, Homo Sapiens; identical to SEQ ID NO: 70770

SEQ ID NO: 373418 - RNA, 64 nt, Homo Sapiens; identical to SEQ ID NO: 70771

SEQ ID NO: 373419 - RNA, 64 nt, Homo Sapiens; identical to SEQ ID NO: 70772

SEQ ID NO: 373420 - RNA, 64 nt, Homo Sapiens; identical to SEQ ID NO: 70773

SEQ ID NO: 373421 - RNA, 64 nt, Homo Sapiens; identical to SEQ ID NO: 70774

SEQ ID NO: 373422 - RNA, 64 nt, Homo Sapiens; identical to SEQ ID NO: 70775

SEQ ID NO: 373423 - RNA, 64 nt, Homo Sapiens; identical to SEQ ID NO: 70776

SEQ ID NO: 373424 - RNA, 64 nt, Homo Sapiens; identical to SEQ ID NO: 70777

SEQ ID NO: 373425 - RNA, 64 nt, Homo Sapiens; identical to SEQ ID NO: 70778

SEQ ID NO: 373426 - RNA, 64 nt, Homo Sapiens; identical to SEQ ID NO: 70779

SEQ ID NO: 373427 - RNA, 64 nt, Homo Sapiens; identical to SEQ ID NO: 70780

SEQ ID NO: 373428 - RNA, 64 nt, Homo Sapiens; identical to SEQ ID NO: 70781

SEQ ID NO: 373429 - RNA, 64 nt, Homo Sapiens; identical to SEQ ID NO: 70782

SEQ ID NO: 373430 - RNA, 64 nt, Homo Sapiens; identical to SEQ ID NO: 70783

SEQ ID NO: 373431 - RNA, 64 nt, Homo Sapiens; identical to SEQ ID NO: 70784

SEQ ID NO: 373432 - RNA, 64 nt, Homo Sapiens; identical to SEQ ID NO: 70785

SEQ ID NO: 373433 - RNA, 64 nt, Homo Sapiens; identical to SEQ ID NO: 70786

SEQ ID NO: 373434 - RNA, 64 nt, Homo Sapiens; identical to SEQ ID NO: 70787

SEQ ID NO: 373435 - RNA, 64 nt, Homo Sapiens; identical to SEQ ID NO: 70788

SEQ ID NO: 373436 - RNA, 64 nt, Homo Sapiens; identical to SEQ ID NO: 70789

SEQ ID NO: 373437 - RNA, 64 nt, Homo Sapiens; identical to SEQ ID NO: 70790

SEQ ID NO: 373438 - RNA, 64 nt, Homo Sapiens; identical to SEQ ID NO: 70791

SEQ ID NO: 373439 - RNA, 64 nt, Homo Sapiens; identical to SEQ ID NO: 70792

SEQ ID NO: 373440 - RNA, 64 nt, Homo Sapiens; identical to SEQ ID NO: 70793

SEQ ID NO: 373441 - RNA, 64 nt, Homo Sapiens; identical to SEQ ID NO: 70794

SEQ ID NO: 373442 - RNA, 64 nt, Homo Sapiens; identical to SEQ ID NO: 70795

SEQ ID NO: 373443 - RNA, 64 nt, Homo Sapiens; identical to SEQ ID NO: 70796

SEQ ID NO: 373444 - RNA, 64 nt, Homo Sapiens; identical to SEQ ID NO: 70797

SEQ ID NO: 373445 - RNA, 64 nt, Homo Sapiens; identical to SEQ ID NO: 70798

SEQ ID NO: 373446 - RNA, 64 nt, Homo Sapiens; identical to SEQ ID NO: 70799

SEQ ID NO: 373447 - RNA, 64 nt, Homo Sapiens; identical to SEQ ID NO: 70800

SEQ ID NO: 373448 - RNA, 64 nt, Homo Sapiens; identical to SEQ ID NO: 70801

SEQ ID NO: 373449 - RNA, 64 nt, Homo Sapiens; identical to SEQ ID NO: 70802

SEQ ID NO: 373450 - RNA, 64 nt, Homo Sapiens; identical to SEQ ID NO: 70803

SEQ ID NO: 373451 - RNA, 64 nt, Homo Sapiens; identical to SEQ ID NO: 70804

SEQ ID NO: 373452 - RNA, 64 nt, Homo Sapiens; identical to SEQ ID NO: 70805

SEQ ID NO: 373453 - RNA, 64 nt, Homo Sapiens; identical to SEQ ID NO: 70806

SEQ ID NO: 373454 - RNA, 64 nt, Homo Sapiens; identical to SEQ ID NO: 70807

SEQ ID NO: 373455 - RNA, 64 nt, Homo Sapiens; identical to SEQ ID NO: 70808

SEQ ID NO: 373456 - RNA, 64 nt, Homo Sapiens; identical to SEQ ID NO: 70809

SEQ ID NO: 373457 - RNA, 64 nt, Homo Sapiens; identical to SEQ ID NO: 70810

SEQ ID NO: 373458 - RNA, 64 nt, Homo Sapiens; identical to SEQ ID NO: 70811

SEQ ID NO: 373459 - RNA, 64 nt, Homo Sapiens; identical to SEQ ID NO: 70812

SEQ ID NO: 373460 - RNA, 64 nt, Homo Sapiens; identical to SEQ ID NO: 70813

SEQ ID NO: 373461 - RNA, 64 nt, Homo Sapiens; identical to SEQ ID NO: 70814

SEQ ID NO: 373462 - RNA, 64 nt, Homo Sapiens; identical to SEQ ID NO: 70814

SEQ ID NO: 373463 - RNA, 64 nt, Homo Sapiens; identical to SEQ ID NO: 70816

SEQ ID NO: 373464 - RNA, 64 nt, Homo Sapiens; identical to SEQ ID NO: 70817

SEQ ID NO: 373465 - RNA, 64 nt, Homo Sapiens; identical to SEQ ID NO: 70818

SEQ ID NO: 373466 - RNA, 64 nt, Homo Sapiens; identical to SEQ ID NO: 70819

SEQ ID NO: 373467 - RNA, 64 nt, Homo Sapiens; identical to SEQ ID NO: 70820

SEQ ID NO: 373468 - RNA, 64 nt, Homo Sapiens; identical to SEQ ID NO: 70821

SEQ ID NO: 373469 - RNA, 64 nt, Homo Sapiens; identical to SEQ ID NO: 70822

SEQ ID NO: 373470 - RNA, 64 nt, Homo Sapiens; identical to SEQ ID NO: 70823

SEQ ID NO: 373471 - RNA, 64 nt, Homo Sapiens; identical to SEQ ID NO: 70824

SEQ ID NO: 373472 - RNA, 64 nt, Homo Sapiens; identical to SEQ ID NO: 70825

SEQ ID NO: 373473 - RNA, 64 nt, Homo Sapiens; identical to SEQ ID NO: 70826

SEQ ID NO: 373474 - RNA, 64 nt, Homo Sapiens; identical to SEQ ID NO: 70827

SEQ ID NO: 373475 - RNA, 64 nt, Homo Sapiens; identical to SEQ ID NO: 70828

SEQ ID NO: 373476 - RNA, 64 nt, Homo Sapiens; identical to SEQ ID NO: 70829

SEQ ID NO: 373477 - RNA, 64 nt, Homo Sapiens
acuuauugguucaccucagugauauuacagcuaaaaaaaucauucauuagcaaaaggaaaagug

SEQ ID NO: 373478 - RNA, 64 nt, Homo Sapiens
ucuagauuguuaaaauuggcaaaugaacuuuuuuaaaaaucaucuuccauguugcaguuagucu

SEQ ID NO: 373479 - RNA, 64 nt, Homo Sapiens
ucuaaaggcuuaugcuaacccauuuauaauugguaaaaaucagaaaauacaagauuuacauaaa

SEQ ID NO: 373480 - RNA, 64 nt, Homo Sapiens
auagauguagcucuaucaugucuagcauaauuuaaaaaaucaguguuuuuaggauuugggaaaa

SEQ ID NO: 373481 - RNA, 64 nt, Homo Sapiens
uuucagcucaggauuauauuuguaaucaaaaaaaaaaaaucacuuggcgcaggagggagaacuu

SEQ ID NO: 373482 - RNA, 64 nt, Homo Sapiens
uaauagaaugccuagucucauugaccaaucguuaaaaaaucauauuugugugucuuaagauuca

SEQ ID NO: 373483 - RNA, 64 nt, Homo Sapiens
ucauaacuuagaaaccgaugcaaaaaaaaaaaaaaaaaaucaacgacagagcgaaacuccgucu

SEQ ID NO: 373484 - RNA, 64 nt, Homo Sapiens
ucauugccuguaaucccagcuaaacccaguaguuaaaaaucaacaggccugggccugccuggcc

SEQ ID NO: 373485 - RNA, 64 nt, Homo Sapiens
aaagacagaaaaugccugacccagaauuaaaaaaaaaaaucaucaagaggcaauaaggcaaaug

SEQ ID NO: 373486 - RNA, 64 nt, Homo Sapiens
agacugcacugauaauuuaguaguuaacaacaucaaaaaucaacugucgaagaaacuuagaguu

SEQ ID NO: 373487 - RNA, 64 nt, Homo Sapiens
auugucgaagagcaaccuguuaaugaaucauguuaaaaaucaagguuuggcuucaguuuaaauc

SEQ ID NO: 373488 - RNA, 64 nt, Homo Sapiens
uauggaucuucaaugccucugagucauuguuauaaaaaaucaguuaucacuauaccaugcuaua

SEQ ID NO: 373489 - RNA, 64 nt, Homo Sapiens
agggaugcaaauugguucuucaguaaggauaaaaaaaaaucacaagcaguuguuuguggcccuc

SEQ ID NO: 373490 - RNA, 64 nt, Homo Sapiens
gcgagacuccauuucaaaaaaaaaaaaaaaaaaaaaaaaucacuuguagucuuggugugguauc

SEQ ID NO: 373491 - RNA, 64 nt, Homo Sapiens
uuuuggggggcauaugugugguugggggguccuuaaaaaucaaaauuugccauuucaguuggau

SEQ ID NO: 373492 - RNA, 64 nt, Homo Sapiens
cugcugugaaaaacaauuuauguuugcaggguuuaaaaaucaguaaaaaugggaaugauugagc

SEQ ID NO: 373493 - RNA, 64 nt, Homo Sapiens
ucaggcucuaauuagcugagggaaugaaacacacaaaaaucacugaauuccuaagaguuccuua

SEQ ID NO: 373494 - RNA, 64 nt, Homo Sapiens
auggcuggguggaucgcacguaaagcuugccacuaaaaaucaaagcagagguuaacaggaaacc

SEQ ID NO: 373495 - RNA, 64 nt, Homo Sapiens
uucauaaucuuguuaugaagauuaccaaaauaauaaaaaucacuauuacuuauacugggacacc

SEQ ID NO: 373496 - RNA, 64 nt, Homo Sapiens
ccaguauuuuuaaaggcauuacuucuugaauauaaaaaaucauguuuuaaaauuucauagcugu

SEQ ID NO: 373497 - RNA, 64 nt, Homo Sapiens
uauacaaaagaaguccuggguuauuguuuauaauaaaaaucaucguugagacauuacauauauu

SEQ ID NO: 373498 - RNA, 64 nt, Homo Sapiens
gcacaagaauugggcugguuagaaauggggaaaaaaaaaucaguauagaaaauuuuaaaacccg

SEQ ID NO: 373499 - RNA, 64 nt, Homo Sapiens
ucaucucuucaguaacuguuaguuuuucaacugcaaaaaucauguuuaaggaggguggauacau

SEQ ID NO: 373500 - RNA, 64 nt, Homo Sapiens
ucuagaguuuagagacauacucaaguguggcuguaaaaaucagauuuaaguuuacgucauuguc

SEQ ID NO: 373501 - RNA, 64 nt, Homo Sapiens
uuacagcaacaauacgauuaucuuauaggaaaaaaaaaaucauuguaaaguaucaagacaauac

SEQ ID NO: 373502 - RNA, 64 nt, Homo Sapiens
gugugggauauaaauuaguuuuuauuauucucuuaaaaaucaaagaugaucucuaucacuuugc

SEQ ID NO: 373503 - RNA, 64 nt, Homo Sapiens
uauaugaaauaguacccucuaaaaaagagaaaaaaaaaaucaggcggucaaacuuagagcaaca

SEQ ID NO: 373504 - RNA, 64 nt, Homo Sapiens
uaucuacugauaacagaaucugggucacaugaaaaaaaaucauuuuauccgucuuuuaaguaua

SEQ ID NO: 373505 - RNA, 64 nt, Homo Sapiens
ugcuucuaauauuacaguuuuguauuuuguaaacaaaaaucaaauaaugcauaucagaaucuuu

SEQ ID NO: 373506 - RNA, 64 nt, Homo Sapiens
uguuguacaauuuuaauuuacaacuguuggaaauaaaaaucacuuaauuuuuuuccagugcuuc

SEQ ID NO: 373507 - RNA, 64 nt, Homo Sapiens
cuucuuuuaaaacaauauccguuucuaaagagauaaaaaucaaaugccccguuaguuucaaacc

SEQ ID NO: 373508 - RNA, 64 nt, Homo Sapiens
caguggagucuucuuuagugaacacagugaaaaaaaaaaucaaacagugaauaggggaaaaaua

SEQ ID NO: 373509 - RNA, 64 nt, Homo Sapiens
aaaaauuucaaauguuuauuuggauuuuaaauuuaaaaaucaauaacaauuuugugguuaaaac

SEQ ID NO: 373510 - RNA, 64 nt, Homo Sapiens
uugaucagaguauggguucuaagcauuacacacaaaaaaucaaggggaaguuaccugguagauc

SEQ ID NO: 373511 - RNA, 64 nt, Homo Sapiens
ugguaauucugaaacacuguucuacuuuguguuuaaaaaucaacagccaccauuagcaucuaua

SEQ ID NO: 373512 - RNA, 64 nt, Homo Sapiens
aauuucccucaaaauagacugauuuuugcaugaaaaaaaucauacaucaaaacuaauuugugua

SEQ ID NO: 373513 - RNA, 64 nt, Homo Sapiens
aguuaccauguauagaauguuuguagcaaauguuaaaaaucacgccaauauuuguuguacuuuu

SEQ ID NO: 373514 - RNA, 64 nt, Homo Sapiens
uuaucaaaaacugucaguuaacaaauccuuaaacaaaaaucaugucagccuguguagggcaaac

SEQ ID NO: 373515 - RNA, 64 nt, Homo Sapiens
uuauaaaaucauguaggccacaaaacuuuaaaggaaaaaucaauucacaaaauuaugccuucau

SEQ ID NO: 373516 - RNA, 64 nt, Homo Sapiens
auuuuuuuacugcuuuaauuaauguauacagcuaaaaaaucacaaugaaaucuggugacccccu

SEQ ID NO: 373517 - RNA, 64 nt, Homo Sapiens
aaaauaaauaacauuuaauuugacggaaaauucuaaaaaucaacauuugguaacuuaaauauuc

SEQ ID NO: 373518 - RNA, 64 nt, Homo Sapiens
uguuuuuggcaugaacaaaagaaacaagagagaaaaaaaucaaaauaauuaaaauaaauuguua

SEQ ID NO: 373519 - RNA, 64 nt, Homo Sapiens
cacuccucgguacucccauaauccucucggagaaaaaaaucacaaggcaacugugaguccggga

SEQ ID NO: 373520 - RNA, 64 nt, Homo Sapiens
aaguucaaucuguuuuucauguaaauuuuguaugaaaaaucaaugucaaguaccaaaauguuaa

SEQ ID NO: 373521 - RNA, 64 nt, Homo Sapiens
uaaaaucuaaccauuuuauuagaaugcaagaugaaaaaaucaggaagccaccagucauuuuuua

SEQ ID NO: 373522 - RNA, 64 nt, Homo Sapiens
agaagucugacuaaauucagucuacuucauaagcaaaaaucaaaggcuaucuuuacuuauaaaa

SEQ ID NO: 373523 - RNA, 64 nt, Homo Sapiens
cuccucauuugcuuuuuaaagcucuagauaggaaaaaaaucagucuucacuugaauuuaaacca

SEQ ID NO: 373524 - RNA, 64 nt, Homo Sapiens
acaaaaaauaccacagcuuaagauaggaauuuuuaaaaaucaaaugcuguauuugauuacuuag

SEQ ID NO: 373525 - RNA, 64 nt, Homo Sapiens
uauuggaauuuccacuuaaauucauugcuauuggaaaaaucaguacaaaauaauauguagcagc

SEQ ID NO: 373526 - RNA, 64 nt, Homo Sapiens
augccagaccugaacuuuaaauguuuggcauuguaaaaaucagcauuuuuaauucccgagaggg

SEQ ID NO: 373527 - RNA, 64 nt, Homo Sapiens
uuaucuggaaucacuuugccucuaaaggccagagaaaaaucacagcuuccuugucggaggggaa

SEQ ID NO: 373528 - RNA, 64 nt, Homo Sapiens
uaacaaagcaaaaaaaaaugcuuuaauucaaauuaaaaaucaugauacuagagaugggagucug

SEQ ID NO: 373529 - RNA, 64 nt, Homo Sapiens
uaguaguccacuuuaugcuuaaaauaaaaucauaaaaaaucaaguuuuaagguuauauuuuuua

SEQ ID NO: 373530 - RNA, 64 nt, Homo Sapiens
auaugacugaauugcaaucuauauuuuuaaaaagaaaaaucaaaauacauuaggguuuacuugg

SEQ ID NO: 373531 - RNA, 64 nt, Homo Sapiens
gucuuaaaguguugaucucaaacaaguacauuagaaaaaucauguuucuucucucucaucuuac

SEQ ID NO: 373532 - RNA, 64 nt, Homo Sapiens
acucuauuguaaaacaugucaauggugugugaagaaaaaucaaccaaucuguagguguugauaa

SEQ ID NO: 373533 - RNA, 64 nt, Homo Sapiens
cuuacuauuaguaucuauggguuauuuuuuaaaaaaaaaucauauuugccauuugucuuagaaa

SEQ ID NO: 373534 - RNA, 64 nt, Homo Sapiens
caaaaccuguuuauaaccaaauacuucauagaacaaaaaucacugauaucagcagaaucacuua

SEQ ID NO: 373535 - RNA, 64 nt, Homo Sapiens
auuuuuugccuuccauuuuuacuuuccaguugaaaaaaaucaaaagccaaggcuagcgaggcau

SEQ ID NO: 373536 - RNA, 64 nt, Homo Sapiens
ucagauaaguaaccuauuuuaucuacccaucaucaaaaaucacacaaagaaugugaaguauaau

SEQ ID NO: 373537 - RNA, 64 nt, Homo Sapiens
uugauuccagggauauuucuaucuugaaugcgugaaaaaucaguuagcuucacaccuucaaaug

SEQ ID NO: 373538 - RNA, 64 nt, Homo Sapiens
uuaaagccaagaaaauaucuuaugcauauacaaaaaaaaucauuucuuauccucauugcauuuc

SEQ ID NO: 373539 - RNA, 64 nt, Homo Sapiens
aacagggcggcugguuaauaucucacacaguuuaaaaaaucagccccuaauuucuccauguuua

SEQ ID NO: 373540 - RNA, 64 nt, Homo Sapiens
ggccacaaaaacaauguuugggggaaaaaaaagaaaaaaucaugccagcuaaucaugucaaguu

SEQ ID NO: 373541 - RNA, 64 nt, Homo Sapiens
ccccuuggucaaugguguucuggcuuacuuaugaaaaaaucagagagaugaguggagucagucc

SEQ ID NO: 373542 - RNA, 64 nt, Homo Sapiens
aggaagguguacuuuuucuugucagaaagauaaaaaaaaucaaguugagaugauguuugaauuu

SEQ ID NO: 373543 - RNA, 64 nt, Homo Sapiens
aaaagaaaaagaaaagaagagaaaaaauuaagaaaaaaaucaaaaaaggaagaaaacuaaaaaa

SEQ ID NO: 373544 - RNA, 64 nt, Homo Sapiens
aaaaaaucaaaaaaggaagaaaacuaaaaaaaaaaaaaaucaaaucaccuugugauucagugua

SEQ ID NO: 373545 - RNA, 64 nt, Homo Sapiens
gagaggagggcacaugucccaucuguugcuauuuaaaaaucagggacaccaacacuuacccaga

SEQ ID NO: 373546 - RNA, 64 nt, Homo Sapiens
aguucugaugccuugaccccgagaaaauuuuuugaaaaaucagcgcugugguugcugcugcuuc

SEQ ID NO: 373547 - RNA, 64 nt, Homo Sapiens
uauaucauguuucaguaaauguacccuaggacauaaaaaucacagucugaguaggcuuguauug

SEQ ID NO: 373548 - RNA, 64 nt, Homo Sapiens
gagugaauucauauuagagagguuggaacuugggaaaaaucaguaguacggaaaagucuucaga

SEQ ID NO: 373549 - RNA, 64 nt, Homo Sapiens
uagaugcacuuuuuuguguguguuuuuaaaaaaaaaaaaucauuauaugaggaauuaaagacau

SEQ ID NO: 373550 - RNA, 64 nt, Homo Sapiens
uuauuuccuuuuauaauacucccccuucaaaccuaaaaaucaagcuuuuauuauuagauuggga

SEQ ID NO: 373551 - RNA, 64 nt, Homo Sapiens
cgggucucauggcaggcaccucuacuaaaaauacaaaaaucagccaacauggugaaaccccauc

SEQ ID NO: 373552 - RNA, 64 nt, Homo Sapiens
guggccuuugaguucaguugcaaguuguggguggaaaaaucaacgacucuagaaaaaucagaau

SEQ ID NO: 373553 - RNA, 64 nt, Homo Sapiens
aucaaguuguggguggaaaaaugaaugacucuagaaaaaucagaauccacuacuucuuguucuu

SEQ ID NO: 373554 - RNA, 64 nt, Homo Sapiens
uggucaagcgagucacgaaugauuaaucauaaagaaaaaucaguuuuugacugaccuggauauc

SEQ ID NO: 373555 - RNA, 64 nt, Homo Sapiens
gauuccaguauuguauaugaguuuuaacaaauuaaaaaaucaaaucauguacauuugaaaauau

SEQ ID NO: 373556 - RNA, 64 nt, Homo Sapiens
uacaaacguguuucuguacaagugaacaaggauuaaaaaucacuaauaacaugguugacaaaua

SEQ ID NO: 373557 - RNA, 64 nt, Homo Sapiens
ggcacaguuacacuuaauaaucacuacccuauauaaaaaucauuagagagacagaggacccucc

SEQ ID NO: 373558 - RNA, 64 nt, Homo Sapiens
guagaaacuacuaauuuuuuaaaucaucaaaaagaaaaaucaaaagacuucuaaauaaggugug

SEQ ID NO: 373559 - RNA, 64 nt, Homo Sapiens
aaccuaccccaugaagauauuuauucaggaagauaaaaaucaguugucacugaccuuuguuucc

SEQ ID NO: 373560 - RNA, 64 nt, Homo Sapiens
gcaacauaauucacuuuccaaaauaauuuguaauaaaaaucaugcuuauuuuuucuguuuuugg

SEQ ID NO: 373561 - RNA, 64 nt, Homo Sapiens
ucaguauaggccaucaauauauuaucuuuaaaaaaaaaaucacaaaguguggguagcaaaaaca

SEQ ID NO: 373562 - RNA, 64 nt, Homo Sapiens
uuuucaaagaaaaauuugucaaugggccaaugcaaaaaaucauuauuauuuaucuauguuuauu

SEQ ID NO: 373563 - RNA, 64 nt, Homo Sapiens
uaacucugguguguuaacauguguauacagacagaaaaaucacaaaucuaaaugaauuaucacu

SEQ ID NO: 373564 - RNA, 64 nt, Homo Sapiens
uguuaguaagaagauucgcuuaguuauuuuauguaaaaaucaguauguguuuaguuuuagugua

SEQ ID NO: 373565 - RNA, 64 nt, Homo Sapiens
aagugguacuuucacaauccaaagauuuuuaguuaaaaaucauguagucuaauaugcugcaguu

SEQ ID NO: 373566 - RNA, 64 nt, Homo Sapiens
uucuuguuuaaauaguuucuuacuuagaauuuuuaaaaaucauuuuugcuuguacuagauuucu

SEQ ID NO: 373567 - RNA, 64 nt, Homo Sapiens
ggaaaggaggcugccauuccgugccaucgguaaaaaaaaucagacaggcccaccccugaagugu

SEQ ID NO: 373568 - RNA, 64 nt, Homo Sapiens
aaagauaccaauaacacuaacaauaccgaucuugaaaaaucaucagcagugcggauucugacau

SEQ ID NO: 373569 - RNA, 64 nt, Homo Sapiens
auaaguggaugguuuuuguuucuaaaaagaaaaaaaaaaucaguguucacccuuauagagacau

SEQ ID NO: 373570 - RNA, 64 nt, Homo Sapiens
uuuuaaauuucaaaaugacauaauuuuauuaggaaaaaaucauguaagaugucagaauaacuaa

SEQ ID NO: 373571 - RNA, 64 nt, Homo Sapiens
ggauuuuuuuuuuuuguauuuucaaguauauuuuaaaaaucaagaaauaacucugaguuugaua

SEQ ID NO: 373572 - RNA, 64 nt, Homo Sapiens
uuuauuagggcaaucaaaagauuuauuauuuuaaaaaaaucaguguggacuuccauuccucuuu

SEQ ID NO: 373573 - RNA, 64 nt, Homo Sapiens
gaaugaaacuagacccccaucucuuagcauauacaaaaaucaaaauuaauuaaaaaguuaaauc

SEQ ID NO: 373574 - RNA, 64 nt, Homo Sapiens
agucccaggagcugcccagaguugcugggagcugaaaaaucacauccuggccuggcacaucaga

SEQ ID NO: 373575 - RNA, 64 nt, Homo Sapiens
uuuuacuaaagaaagauuacuuagaggaaauaagaaaaaucauguuugcucucccgguucuucc

SEQ ID NO: 373576 - RNA, 64 nt, Homo Sapiens
gcaguggccucuacguuuuacuccuuugcugaaaaaaaaucaucuugcccacaggccuguggca

SEQ ID NO: 373577 - RNA, 64 nt, Homo Sapiens
cuauucuaauuaccuuaaaucuaaaggggaaaaaaaaaaucacaaacaggacuggguaguuuuu

SEQ ID NO: 373578 - RNA, 64 nt, Homo Sapiens
caaggagaacaaauauucagaauauucauauuggaaaaaucacaauuuuuaauggcagcagaaa

SEQ ID NO: 373579 - RNA, 64 nt, Homo Sapiens
agaugucuuuuauaguggaaaaacacauggggaaaaaaaucaucuauuuugaugcagcauuuga

SEQ ID NO: 373580 - RNA, 64 nt, Homo Sapiens
cucuauuaccaauuuuucaguuuacugcaauugaaaaaaucauaaaauuuuacauuauguauau

SEQ ID NO: 373581 - RNA, 64 nt, Homo Sapiens
uauuuagagguggauaaauuaaauuuuucuucuuaaaaaucagcauauuacaagauuuuaauuc

SEQ ID NO: 373582 - RNA, 64 nt, Homo Sapiens
aagauagugaucucucugugaagaaauucacaggaaaaaucaacuuuuaagcuugaaacugcag

SEQ ID NO: 373583 - RNA, 64 nt, Homo Sapiens
gucuagggacuaguugaucucuuacauccuucccaaaaaucaguaaaucugagucaguaauucu

SEQ ID NO: 373584 - RNA, 64 nt, Homo Sapiens
gucuagggacugguugaucuuaaaaauccuucccaaaaaucaguaaucugagucaguaauucuc

SEQ ID NO: 373585 - RNA, 64 nt, Homo Sapiens
gagugcaccugauuuacuguaguuauguuaccugaaaaaucaaguuagaauuguuuuuuucuaa

SEQ ID NO: 373586 - RNA, 64 nt, Homo Sapiens
aaugcacaacuuacaaagugaauaccuucuugacaaaaaucaacacaaaaaggagggacuuuaa

SEQ ID NO: 373587 - RNA, 64 nt, Homo Sapiens
agcaauugaaaugcuacaaaaacaguaucuucaaaaaaaucagcuauuaagacaugcugaugga

SEQ ID NO: 373588 - RNA, 64 nt, Homo Sapiens
aguucuggugagacggagaccccgguggcaguggaaaaaucagaagcacaaaggaaaacucuug

SEQ ID NO: 373589 - RNA, 64 nt, Homo Sapiens
guugaaauugaacauacucuagugaaugugccuuaaaaaucaagacacuaguucagaggaagca

SEQ ID NO: 373590 - RNA, 64 nt, Homo Sapiens
gcauuucuuucacugugcuacuaugugguuuuuaaaaaaucaaugcuuuauauuccauaugugg

SEQ ID NO: 373591 - RNA, 64 nt, Homo Sapiens
agagggacuccuuccaauaaaguucaaacuuaaaaaaaaucauuuuaauaaauauuuuugccau

SEQ ID NO: 373592 - RNA, 64 nt, Homo Sapiens
uauuuuauuuauugagugccucgguauuuguuaaaaaaaucagucaacuccaucacuucuuaaa

SEQ ID NO: 373593 - RNA, 64 nt, Homo Sapiens
acguugaucacuuuagcaggcuuucaaagcugugaaaaaucaaaauggaaaagccaguuagagg

SEQ ID NO: 373594 - RNA, 64 nt, Homo Sapiens
ggaagacagucgggaucuuuugucugaaugaaguaaaaaucaaugaaauaauagaugacagaca

SEQ ID NO: 373595 - RNA, 64 nt, Homo Sapiens
auucaugaucauggcauacauuaaauaauuuuugaaaaaucauuguauacguauugguucuuua

SEQ ID NO: 373596 - RNA, 64 nt, Homo Sapiens
uuuuauuaauguaaauuucucuuuuguguaucaaaaaaaucacagauuauuuacaaccuaaaag

SEQ ID NO: 373597 - RNA, 64 nt, Homo Sapiens
agaugaggcuuucuuacauagcaucuuguauauuaaaaaucaaaaucuugcucucuuaaagaaa

SEQ ID NO: 373598 - RNA, 64 nt, Homo Sapiens
acugagguagcuuagagaugagcaggugcuuuuuaaaaaucagagcaagaugaaaaaaaggaaa

SEQ ID NO: 373599 - RNA, 64 nt, Homo Sapiens
caugaaaaagugucuugaguguccaaucauuuuuaaaaaucaucacagagaaagagacuaaugu

SEQ ID NO: 373600 - RNA, 64 nt, Homo Sapiens
gaaugcguuggauuucagagaauaaacauuuuguaaaaaucacuugguaaggauuauaaacuua

SEQ ID NO: 373601 - RNA, 64 nt, Homo Sapiens
uuuauuuauuugguucuuuagauggaggaauuuaaaaaaucaaauuuuucucuucaccuuuaug

SEQ ID NO: 373602 - RNA, 64 nt, Homo Sapiens
ucaucaguaaaccuuguuaagauuggcuuaucacaaaaaucauuuaguuaauuacauacaaauu

SEQ ID NO: 373603 - RNA, 64 nt, Homo Sapiens
auauuccgaaaacaaaaaaaguuuggucuuuauuaaaaaucacaugggaccaguguucaaguug

SEQ ID NO: 373604 - RNA, 64 nt, Homo Sapiens
gauuacaaaaugguguuuguccauuuucagagauaaaaaucauuuucugucaaaacacuugcuu

SEQ ID NO: 373605 - RNA, 64 nt, Homo Sapiens
uggauucauauuaccaccgcaacaggaagacuugaaaaaucacgggucauuuugaugacuguac

SEQ ID NO: 373606 - RNA, 64 nt, Homo Sapiens
gaacuugaagaguaagaauaacagaaaaagaagaaaaaaucaaucccgaguggagagauuagau

SEQ ID NO: 373607 - RNA, 64 nt, Homo Sapiens
agaaacccagaaaagacagacuuauaaccaggagaaaaaucaguaaagaagcaauaaaauauga

SEQ ID NO: 373608 - RNA, 64 nt, Homo Sapiens
cugggcgacagaaaaagaaaauuuagguggggaaaaaaaucagaauugcgucugugggaacagg

SEQ ID NO: 373609 - RNA, 64 nt, Homo Sapiens
caauauggugaaaccccaucucuacuaaaaauauaaaaaucagcaaaaaaaauuuagccaggcu

SEQ ID NO: 373610 - RNA, 64 nt, Homo Sapiens
aaaacaaacuuuuuuuauucaaagaaaaagagaaaaaaaucacauggauuccuuugaagaaaaa

SEQ ID NO: 373611 - RNA, 64 nt, Homo Sapiens
gauuuccacauucagccaguggauuuaucuuugcaaaaaucaguggaguuugcaauuaauauca

SEQ ID NO: 373612 - RNA, 64 nt, Homo Sapiens
uuuuguaaagaugucaguaauguguugaguggaaaaaaaucaguagaccagaugggaaauuauu

SEQ ID NO: 373613 - RNA, 64 nt, Homo Sapiens
uuucugaccuguacuuauuuuuugcagaaaaaaaaaaaaucacagugcuuaauauuguuauugc

SEQ ID NO: 373614 - RNA, 64 nt, Homo Sapiens
uuucuauaauuuguaaaguucuguaaagaagaggaaaaaucauuacgauuugggagugacauuu

SEQ ID NO: 373615 - RNA, 64 nt, Homo Sapiens
gggaucauuuuugaauuccagucauguuucucauaaaaaucaguugagacacccaagaggaaca

SEQ ID NO: 373616 - RNA, 64 nt, Homo Sapiens
uuuguaaaacuuuugauauuucuguauacauuuaaaaaaucaauugccacuacaguaguuccuu

SEQ ID NO: 373617 - RNA, 64 nt, Homo Sapiens
uuuugaauuuuaaaacuaaucuauuuuauuuaaaaaaaaucaaguacuuuggaagugaauaaag

SEQ ID NO: 373618 - RNA, 64 nt, Homo Sapiens
acuucagacacaggaaaaauaaacguggauuuuaaaaaaucaaucaauggugcaaaaaaaaacu

SEQ ID NO: 373619 - RNA, 64 nt, Homo Sapiens
aaaaguucaucuuuggacagaaagccuuuaaaaaaaaaaucacucccucuucccccuccucccu

SEQ ID NO: 373620 - RNA, 64 nt, Homo Sapiens
acuauaagccaauauuccuuauuaauacaaacacaaaaaucauuaacaaaaauauuagcaaacu

SEQ ID NO: 373621 - RNA, 64 nt, Homo Sapiens
uuuaucccaggaauucaagguugguucaacaucuaaaaaucaaauaagcuaauauacagucagu

SEQ ID NO: 373622 - RNA, 64 nt, Homo Sapiens
guuagguuaggaauucaagguuuguucaacaucuaaaaaucaaauaagcuaauaaagaaaagag

SEQ ID NO: 373623 - RNA, 64 nt, Homo Sapiens
ccuugaauggaaccuacuaaaaagagagaugaaaaaaaaucagcgagguugauguagauaauaa

SEQ ID NO: 373624 - RNA, 64 nt, Homo Sapiens
gcauauuucauguuugauuuagaugacauucaaaaaaaaucaugggacugaauauaccuggggu

SEQ ID NO: 373625 - RNA, 64 nt, Homo Sapiens
cagguuagucagucuaagaauauuuauacaggaaaaaaaucaccccaaauaaaauaaauauuug

SEQ ID NO: 373626 - RNA, 64 nt, Homo Sapiens
gaaaauucuuacuugugaauguuaaaaaugaaaaaaaaaucauuuauuauauuuugccucaacu

SEQ ID NO: 373627 - RNA, 64 nt, Homo Sapiens
ggagaaaauaaaauuacaacauuacgacauacuaaaaaaucaauauucuuuuuuuuuuuuuuuu

SEQ ID NO: 373628 - RNA, 64 nt, Homo Sapiens
uguaacauggauaguuaaaacaauguugaaugaaaaaaaucaaaauacaaaugaaacauugugu

SEQ ID NO: 373629 - RNA, 64 nt, Homo Sapiens
gcaacauaguaagacccugucucuauuaaaaaaaaaaaaucaacccuucuuccccaccaaacca

SEQ ID NO: 373630 - RNA, 64 nt, Homo Sapiens
uuggugacuggguguucauuuuagcucuaagaaaaaaaaucaguguuucgugaagguguuggag

SEQ ID NO: 373631 - RNA, 64 nt, Homo Sapiens
uauugaaacuggaccccuauccuucacgauauacaaaaaucaacucaagauggauuaaagacuu

SEQ ID NO: 373632 - RNA, 64 nt, Homo Sapiens
gucugaauggguauuaucagaauggguauuauuaaaaaaucaaaacauagaugcuagugaggcu

SEQ ID NO: 373633 - RNA, 64 nt, Homo Sapiens
aaggugaaaguucucaacuuaaaaaagaaaagaaaaaaaucauauacugagguugcuaagaucu

SEQ ID NO: 373634 - RNA, 64 nt, Homo Sapiens
cagaagucauucuagaggcaaauuugaagaguggaaaaaucacuuuuucugaaugaucuuguuu

SEQ ID NO: 373635 - RNA, 64 nt, Homo Sapiens
cauagaaaauauaaagaaucccucaaguugaaaaaaaaaucaauuuaaaggggagaaaacuuca

SEQ ID NO: 373636 - RNA, 64 nt, Homo Sapiens
ugaaugaauaggccagcugggacaaaugaauuuaaaaaaucagaaaaaugcaagauuuauaugc

SEQ ID NO: 373637 - RNA, 64 nt, Homo Sapiens
agaauuagaaaacuuugcaagauuugacuuguuuaaaaaucacauuuauaagugaaccguauua

SEQ ID NO: 373638 - RNA, 64 nt, Homo Sapiens
guagaaacaauuuugaaagccccuugaggaaaauaaaaaucaagaagaacacuuuucucccuuu

SEQ ID NO: 373639 - RNA, 64 nt, Homo Sapiens
gcuauauaauggagaagaauuugaaaaugcacaaaaaaaucaaucuacauuaucagaaccugca

SEQ ID NO: 373640 - RNA, 64 nt, Homo Sapiens
cccagcuuuagguuaugaagauuuuacucacaaaaaaaaucaacaaaaaucacgaaacuagaaa

SEQ ID NO: 373641 - RNA, 64 nt, Homo Sapiens
gguuaugaagauuuuacucacaaaaaaaaucaacaaaaaucacgaaacuagaaaacuuuuuuuu

SEQ ID NO: 373642 - RNA, 64 nt, Homo Sapiens
gggaaagaauagauauggggaaauaaacuuaaaaaaaaaucaggaauuuaaaaaaacgagcaau

SEQ ID NO: 373643 - RNA, 64 nt, Homo Sapiens
uuugacaccuguuuuagucaguugggaggaagggaaaaaucaaguuuaauucccuuuaucuggg

SEQ ID NO: 373644 - RNA, 64 nt, Homo Sapiens
auaauuuauuuauguaagaaagcuguuaaauccuaaaaaucaaugaagcagaaaggguuuuuuc

SEQ ID NO: 373645 - RNA, 64 nt, Homo Sapiens
cagauguaucuucaaaaaguaaaucaugacugaaaaaaaucaaugcaucucaaagaagucuguu

SEQ ID NO: 373646 - RNA, 64 nt, Homo Sapiens
ggaaaaaaauaaacuuucaauauucuggauguauaaaaaucaaugaacuguugguuauuugugu

SEQ ID NO: 373647 - RNA, 64 nt, Homo Sapiens
cuguaguuguuuuggcgauauuaauuguuucaaaaaaaaucaaacuuaccagcauauauaguau

SEQ ID NO: 373648 - RNA, 64 nt, Homo Sapiens
uucuuuuuucuccugugguggauaaaucugccuuaaaaaucaauguaacuugggggcugggggc

SEQ ID NO: 373649 - RNA, 64 nt, Homo Sapiens
guauaaagaaauaaaauuuuguacuuauauuauuaaaaaucacauuuuuaauauuuguagucca

SEQ ID NO: 373650 - RNA, 64 nt, Homo Sapiens
aaaauaauaaacuucauuuuaacaaaaaaaaucaaaaaaucaaauuuuauuuaaaaaaacaaaa

SEQ ID NO: 373651 - RNA, 64 nt, Homo Sapiens
aaaucaaaaaaauaauaaacaaacaaaaaacaaaaaaaaucaaaacaaacaguuuuauuuaaaa

SEQ ID NO: 373652 - RNA, 64 nt, Homo Sapiens
cauuaaaaauucaaauguaaauugaauucacaugaaaaaucauguuugguuguaaaccuccaau

SEQ ID NO: 373653 - RNA, 64 nt, Homo Sapiens
guuaauuguaaagauaaggaaugcauuaugggucaaaaaucaaacauuccucucauguuaugua

SEQ ID NO: 373654 - RNA, 64 nt, Homo Sapiens
aguggaacuaaacaguugagcacuguccauuaaaaaaaaucaccaacaccaaaucauuugaaau

SEQ ID NO: 373655 - RNA, 64 nt, Homo Sapiens
ucacaugcauuuuauaguuuuugcaugcauuaaaaaaaaucaucgacaacaucugaaggguaug

SEQ ID NO: 373656 - RNA, 64 nt, Homo Sapiens
gaaugcuuuuagauauugaaucagauacaaaaagaaaaaucacugccauauuuuuacauaggag

SEQ ID NO: 373657 - RNA, 64 nt, Homo Sapiens
ucacuuauauuaagcaaugaggaacuuuuaaaaaaaaaaucacuuucacaaagagaaaacaaaa

SEQ ID NO: 373658 - RNA, 64 nt, Homo Sapiens
ccaaaugacuuggcaaauaacuaaaaaucaggccaaaaaucagggaguccugcuaaaaaucagg

SEQ ID NO: 373659 - RNA, 64 nt, Homo Sapiens
ccaaaaaucaggccaaaugacuaaaaaucaggcuaaaaaucaggcucagucgggaagaguccug

SEQ ID NO: 373660 - RNA, 64 nt, Homo Sapiens
cuaaaaaucaggccaaaaauggaagaguccugcuaaaaaucaggaaucuuugccuccucagucg

SEQ ID NO: 373661 - RNA, 64 nt, Homo Sapiens
gaggaaaauugucauuagccugccuaugcagaagaaaaaucauucuuuugugauuucauuauca

SEQ ID NO: 373662 - RNA, 64 nt, Homo Sapiens
gaacuaguucuguggcaguggacuagcauaaguggaugucuaagaaauuuuucaguucacuaga

SEQ ID NO: 373663 - RNA, 64 nt, Homo Sapiens
gcuugcugcuuaaucaaaggauuaaagauuuaaagaugucuaugucuucuauuuuuauauaauu

SEQ ID NO: 373664 - RNA, 64 nt, Homo Sapiens
ccaaugauaauuauuuuugaaaaaaaaaaaaccggaugucuaggagugagacuccgucucaaaa

SEQ ID NO: 373665 - RNA, 64 nt, Homo Sapiens
cccggcugggcgugguggcuuuaugucuugucaagaugucuagguuuagguucaggguggaccu

SEQ ID NO: 373666 - RNA, 64 nt, Homo Sapiens
uuuaaacagucagccugacucuguacugcucaguuucacucacaggaaacuugugacuugugua

SEQ ID NO: 373667 - RNA, 64 nt, Homo Sapiens
cuugugacuuguguauuaucgucauugaggauguuucacucaugucugucauuuuauaagcaua

SEQ ID NO: 373668 - RNA, 64 nt, Homo Sapiens
uagggcagaguacuauucuaauaguuugagacuguucacucaaacauuaaauaucauguacuuc

SEQ ID NO: 373669 - RNA, 64 nt, Homo Sapiens
aaaagagcaguacauguaagguugguuaacuguguucacucaguuuuaagguuuaugaaguuuu

SEQ ID NO: 373670 - RNA, 64 nt, Homo Sapiens
uugaauaaagaugaacaguaugauguugccagaauucacucaauuggccugagccaccagauua

SEQ ID NO: 373671 - RNA, 64 nt, Homo Sapiens
aguaauauaaauuaccucuugaaaggcaaaauuauucacucagaccacuuauauuuaucacagu

SEQ ID NO: 373672 - RNA, 64 nt, Homo Sapiens
ccuugcagaagcugauggggcaaacucaagcuucuucacucacagcacccuauauacacuugga

SEQ ID NO: 373673 - RNA, 64 nt, Homo Sapiens
guauccuuucacacauuugccuugacaaacuucuuucacucacaucuuuuucacugacuuuuuu

SEQ ID NO: 373674 - RNA, 64 nt, Homo Sapiens
cugucuacaccuggcaguuuucucugacgugcuguucacucacaucccuaccuugcaugguaau

SEQ ID NO: 373675 - RNA, 64 nt, Homo Sapiens
cuagggguucauuucccauuucagcggaaaguacuucacucaacaacaauauucucaagagucu

SEQ ID NO: 373676 - RNA, 64 nt, Homo Sapiens
acaagccaggcauggcuuaaaauaucaugcagucuucacucacauacuaauuugacuuuggaaa

SEQ ID NO: 373677 - RNA, 64 nt, Homo Sapiens
aaucuauuguaugauggaaugaauagaaaacuuuuucacucaauaaauuauuauuugauauggu

SEQ ID NO: 373678 - RNA, 64 nt, Homo Sapiens
auaaaagaaaugcaacuuaauguaaaaauauucuuucacucauaaaauaagucacucuuacgca

SEQ ID NO: 373679 - RNA, 64 nt, Homo Sapiens
gaagcaaggcugauauuagcuggcagaagaucccuucacucagacauucucugaccccaaggag

SEQ ID NO: 373680 - RNA, 64 nt, Homo Sapiens
cugagcccugguguguuuccagaucgauccuggauucacucacucacucauuccuucacucauc

SEQ ID NO: 373681 - RNA, 64 nt, Homo Sapiens
agaucgauccuggauucacucacucacucauuccuucacucauccagccaccuaaaaacauuua

SEQ ID NO: 373682 - RNA, 64 nt, Homo Sapiens
ggcacugugguugcugugguaaauuucuguuuauuucacucaggccguagcccggugcacgccg

SEQ ID NO: 373683 - RNA, 64 nt, Homo Sapiens
guagagaaacaagcaaagccaagggucuccaggcuucacucaggcugcagaggcaccggugagg

SEQ ID NO: 373684 - RNA, 64 nt, Homo Sapiens
auuauaugugcuuauggugaauuuucgcaauaaacuugauuauuucucuguaucaauugucaua

SEQ ID NO: 373685 - RNA, 64 nt, Homo Sapiens
uuccauuaauggaaaugguucauggcaccuauaccuugauuaaucaagaacgugacuggaaagg

SEQ ID NO: 373686 - RNA, 64 nt, Homo Sapiens
aauagugucuacucagaauacguuuacccuccgucuugauuagguggccuuuucugugcaguua

SEQ ID NO: 373687 - RNA, 64 nt, Homo Sapiens
ugccuauuuagucucaaaauaagguaacuauuaacuugauuauacuauauaauauucucaauua

SEQ ID NO: 373688 - RNA, 64 nt, Homo Sapiens
ucucaauuacauuugaauuuaaaaauauugagcucuugauuacaauuuaauacauuguaaaaag

SEQ ID NO: 373689 - RNA, 64 nt, Homo Sapiens
cucuguuggacaaaccgaguguugaaaaaaaacccuugauuauaggaggaauuucuugauuaau

SEQ ID NO: 373690 - RNA, 64 nt, Homo Sapiens
guugaaaaaaaacccuugauagauggaggaauuucuugauuaauuggcauaggcugacuuuugc

SEQ ID NO: 373691 - RNA, 64 nt, Homo Sapiens
gauugaguggaauucuagaugggacuucucccuacuugauuaaagauauuuuuuuuuuuaagug

SEQ ID NO: 373692 - RNA, 64 nt, Homo Sapiens
agcaaauuggcaauuuaacgcugcucaugaaggacuugauuaaucagcaugguugccuggcuac

SEQ ID NO: 373693 - RNA, 64 nt, Homo Sapiens
ugguuagagguauguaguuauccacugaaauuuccuugauuauacaacauuucacuuugauuuc

SEQ ID NO: 373694 - RNA, 64 nt, Homo Sapiens
caucuuuagaaagcuauugcacuuagaagcaacacuugauuaaacaccugaauugggcuuuuua

SEQ ID NO: 373695 - RNA, 64 nt, Homo Sapiens
augugcuggguaaacagaaagugguuuagacauucuugauuaguuuccauauuuuaaguagcug

SEQ ID NO: 373696 - RNA, 64 nt, Homo Sapiens
gaaguucccuaauaaucuggaauauucuacauggcuugauuacauagcaaacaagaccaagauu

SEQ ID NO: 373697 - RNA, 64 nt, Homo Sapiens
gcugaaacgacuccaacagcuaguucacagcccagcuuuguacguugguuaccauagcuacugc

SEQ ID NO: 373698 - RNA, 64 nt, Homo Sapiens
acacacacacaguaaccacggguaggcaccaggggcuuuguacauucaggagcugcagagagga

SEQ ID NO: 373699 - RNA, 64 nt, Homo Sapiens
caaagcaaaaugagaauuucgacugcuauggcuagcuuuguaacacuggagcuuuguauucugu

SEQ ID NO: 373700 - RNA, 64 nt, Homo Sapiens
cugugacugcuauggcuagcucuugaaaacuggagcuuuguauuaggaguaugguuaagcacac

SEQ ID NO: 373701 - RNA, 64 nt, Homo Sapiens
auccacccccugcccacaaagccauugagaaugugcuuuguaaguauuuuguaauauucucucc

SEQ ID NO: 373702 - RNA, 64 nt, Homo Sapiens
auucuccccacccaccccacacccuugagaaggugcuuuguaauugugacaauacaccuucccc

SEQ ID NO: 373703 - RNA, 64 nt, Homo Sapiens
ggcagggaccauauaagccucugcuagacuguaagcuuuguaaguuguuacugcuuauugauca

SEQ ID NO: 373704 - RNA, 51 nt, Homo Sapiens
acaagauugaaaaacucaacggcuuuguagugaaaugaaucuaauccauaa

SEQ ID NO: 373705 - RNA, 64 nt, Homo Sapiens
cauuucuauuuugcaaacacugugauuacucuuugcuuuguaguuugcuuugcuuuguaggguu

SEQ ID NO: 373706 - RNA, 64 nt, Homo Sapiens
cacugugauuacucuuugcuuuguaguuugcuuugcuuuguaggguucugcuuuuaaguuuuuc

SEQ ID NO: 373707 - RNA, 64 nt, Homo Sapiens
gucaaguccucaucuguuauauaaaauccuuucugcuuuguaaguuuucucuuuuugggauuuu

SEQ ID NO: 373708 - RNA, 64 nt, Homo Sapiens
ucuuccccucccauguugucgcacugaucacacugcuuuguaauuauuuucuuuauuguuggua

SEQ ID NO: 373709 - RNA, 64 nt, Homo Sapiens
auuguuuuguuuggguuuugauuaauucgcaguugcuuuguauccauuugcacuccauuuuuac

SEQ ID NO: 373710 - RNA, 64 nt, Homo Sapiens
aacuauccaugaagggaaaguuuuaauacuuaaggcuuuguaaagaaguauguccucauagaac

SEQ ID NO: 373711 - RNA, 64 nt, Homo Sapiens
aauaggaacuucagaggcuuuguuuaaacgcaaagcuuuguaaaagccacaaggucugagcuga

SEQ ID NO: 373712 - RNA, 64 nt, Homo Sapiens
gcaucgugucgcuuuaucugcccccgcacaguuugcuuuguacgucugccaagaaucuuccagu

SEQ ID NO: 373713 - RNA, 64 nt, Homo Sapiens
uguuuucaaaagcacaacuggcucccaugccucagcuuuguaccggagggcgacuucagucaca

SEQ ID NO: 373714 - RNA, 64 nt, Homo Sapiens
uuacaccugcgcccccaggcuggaccuucaaagggcuuuguauuacaucuuuacucuuauuguc

SEQ ID NO: 373715 - RNA, 64 nt, Homo Sapiens
aaccccugcccagguauuuuauuggcucacuauugcuuuguagucugucucugcuugguuaaaa

SEQ ID NO: 373716 - RNA, 64 nt, Homo Sapiens
cuuuuauugguuauuuagaauauuuucaggauaggcuuuguauaauauuuaauaccuccaaaga

SEQ ID NO: 373717 - RNA, 64 nt, Homo Sapiens
ccaaguugucaaagcaucaaaaauguaguuccuagcuuuguacuaaaugaaacaguguuaagug

SEQ ID NO: 373718 - RNA, 64 nt, Homo Sapiens
guaugaaggauuuguaaagcuuauuuucucauuugcuuuguauggggguagaaaugaauugaca

SEQ ID NO: 373719 - RNA, 64 nt, Homo Sapiens
uauuuugggguuauaauuucgggggaagggagaugcuuuguacaggggaucaggcuaagaaagu

SEQ ID NO: 373720 - RNA, 64 nt, Homo Sapiens
uaucgcucacugcaugcucgccucuuacgugcuagcuuuguaccuugcccaccuugccgugcuu

SEQ ID NO: 373721 - RNA, 63 nt, Homo Sapiens
uuggaugccaguuuuguaauugagcuugugcuuaguauuuacaccaccugaccaagagggaag

SEQ ID NO: 373722 - RNA, 63 nt, Homo Sapiens
auaccauuuaauaugccccggagguauacaacuaguauuuaagauagcugccuuagacauuau

SEQ ID NO: 373723 - RNA, 63 nt, Homo Sapiens
aaaugggcagugaaggcuaaugaacacaucuugaguauuuaggaugaucuuuacguggcaaaa

SEQ ID NO: 373724 - RNA, 63 nt, Homo Sapiens
uuuuagugaugagaauuguauuuauauugcaguaguauuuauuaauguccuuuuaugauuuug

SEQ ID NO: 373725 - RNA, 63 nt, Homo Sapiens
aggcagcauuaaauagaauugaagaaauaccauaguauuuauuuuacacccccucucccacga

SEQ ID NO: 373726 - RNA, 63 nt, Homo Sapiens
uaagggugaaaacauuguacauguugugaagaaaguauuuaaauccaacuuuugaacagauuu

SEQ ID NO: 373727 - RNA, 63 nt, Homo Sapiens
cuaugauaaaguuguaaauaauuuuacauuuagaguauuuacauguauaaaauccauagauuu

SEQ ID NO: 373728 - RNA, 63 nt, Homo Sapiens
cugcuccaaaguagaacucuaugucccagugucaguauuuacuugagaaauuagucacuuaaa

SEQ ID NO: 373729 - RNA, 63 nt, Homo Sapiens
aguucaaaaaggaaugucucaucuuugaagaaaaguauuuaaguggcuuucugccccucuuga

SEQ ID NO: 373730 - RNA, 63 nt, Homo Sapiens
cuuacaauauuuuuccuugcauuguaauuuuuaaguauuuaucauuuuauaguacacauguaa

SEQ ID NO: 373731 - RNA, 63 nt, Homo Sapiens
gauuuuaaacuuucugauguuguucuuaaauaaaguauuuaauuccuaacuugguaaacaaac

SEQ ID NO: 373732 - RNA, 63 nt, Homo Sapiens
ggacacugauuaguugucaauugccaaaauaagaguauuuagaaaaguuaaccuugugggcug

SEQ ID NO: 373733 - RNA, 63 nt, Homo Sapiens
uaauguuauguuguguucuaaauuugguaaauuaguauuuauuguauuuaugaaaugguuaag

SEQ ID NO: 373734 - RNA, 63 nt, Homo Sapiens
aaaugguuaagaauuugguacuguuaacuuaauaguauuuaugcuuaacauucuguaaaaugu

SEQ ID NO: 373735 - RNA, 63 nt, Homo Sapiens
agaaacuaacuccguaaugaucuagcaucaguaaguauuuagccucagaugccaggggucugc

SEQ ID NO: 373736 - RNA, 63 nt, Homo Sapiens
caucugagccaaagcagauauccaaacuguuuaaguauuuaaauacacacagaaaaaagucuu

SEQ ID NO: 373737 - RNA, 63 nt, Homo Sapiens
guaauuaaucuuuaauccaucauuccaaaauucaguauuuaauacauuaucuauuuuagcacu

SEQ ID NO: 373738 - RNA, 63 nt, Homo Sapiens
gauguguaccugcuuaguuacuuaaaugccaguaguauuuagaauaaucaucccucuauuauu

SEQ ID NO: 373739 - RNA, 63 nt, Homo Sapiens
ucugcacagcguguauuuuguggauuuuuacagaguauuuauaggggccccuggauguuuuug

SEQ ID NO: 373740 - RNA, 63 nt, Homo Sapiens
caaauccaaauacuuuguuuuaucaaguucuaaaguauuuagauaauguacuugauacauuua

SEQ ID NO: 373741 - RNA, 63 nt, Homo Sapiens
aaaaguccaaaugacagauuuucuuauaaugauaguauuuaaauguuuauaacauaguuuaau

SEQ ID NO: 373742 - RNA, 63 nt, Homo Sapiens
auaacauaguuuaauuuuauauuuauuccagauaguauuuaauuuagugcuuuuuacccauuu

SEQ ID NO: 373743 - RNA, 63 nt, Homo Sapiens
acccuacuugaugaggaccauuugcuugugcucaguauuuagaaaugcauacacuccacauuu

SEQ ID NO: 373744 - RNA, 63 nt, Homo Sapiens
uggcuggaaaggagacuagaguaucuaguuuuuaguauuuaaacuacuuuuaauuauuuauau

SEQ ID NO: 373745 - RNA, 63 nt, Homo Sapiens
aaaaauguaagucuauugguagagauuaaguaaaguauuuauugcuacaucauaguugauaaa

SEQ ID NO: 373746 - RNA, 63 nt, Homo Sapiens
cacguauuuuuacaucauuuguuuuuccugaccaguauuuaaaaccaaaaggauauucugaaa

SEQ ID NO: 373747 - RNA, 63 nt, Homo Sapiens
gcuucugcacauccaaaaauucugggucuuuucaguauuuacuguguaauacuuaagugccac

SEQ ID NO: 373748 - RNA, 63 nt, Homo Sapiens
gaaaacagcaucugcuuuccucuuggccaugagaguauuuagugcaguuuggguuuacucuua

SEQ ID NO: 373749 - RNA, 63 nt, Homo Sapiens
aauucuguaaaauaaguauuaaguaucucauucaguauuuagcacuuaagaggaaaacaguau

SEQ ID NO: 373750 - RNA, 63 nt, Homo Sapiens
agccaguauucuaaaaauaagauaguaucaauaaguauuuaaaaugaauugaauuccugaugg

SEQ ID NO: 373751 - RNA, 63 nt, Homo Sapiens
ugcccaugauauguauuuuauguagcagggggaaguauuuaauauauauauuaucaucccuaa

SEQ ID NO: 373752 - RNA, 63 nt, Homo Sapiens
uuacaaaguuggcauacaggugauucuuauuguaguauuuauacuuaaucguugcuuccaaua

SEQ ID NO: 373753 - RNA, 63 nt, Homo Sapiens
uaaugcauugaaugaaguugugagcuaauaugcaguauuuaggcaguauuacacaauaccgca

SEQ ID NO: 373754 - RNA, 63 nt, Homo Sapiens
cacaggcugaugcuucugagaaagucuuuuccuaguauuuaacagaacccaagugaacagagg

SEQ ID NO: 373755 - RNA, 63 nt, Homo Sapiens
cugguuggauggacauaacuauuguaacuauucaguauuuacugguaggcacuguccucugau

SEQ ID NO: 373756 - RNA, 63 nt, Homo Sapiens
auugcuuucuauguacagaacuuuaaacaauauaguauuuauggcgaggacagcuguagucug

SEQ ID NO: 373757 - RNA, 63 nt, Homo Sapiens
ucaucugcaaguuucaagaaguauucugccaaaaguauuuacaaguauggacucaugagcuau

SEQ ID NO: 373758 - RNA, 63 nt, Homo Sapiens
guagcauuagugguccagcauaaaaaaaaagacaguauuuaucauauauaaaaauauauauau

SEQ ID NO: 373759 - RNA, 63 nt, Homo Sapiens
ucuggagaguuugugcugagugacugagccaccaguauuuaucguuuuuaaauuuuuuucucc

SEQ ID NO: 373760 - RNA, 63 nt, Homo Sapiens
ugagaaauccuagaaauguggagaauguaacaaaguauuuaaaugguugucacacuugauuau

SEQ ID NO: 373761 - RNA, 63 nt, Homo Sapiens
uuucagaaaauauuauccuuuaaagugaaggagaguauuuauauuaaagaugaacauuacaac

SEQ ID NO: 373762 - RNA, 63 nt, Homo Sapiens
ccucaguuuccccauugacuugcacaucucugcaguauuuauaagaagaauauucuaugaagu

SEQ ID NO: 373763 - RNA, 63 nt, Homo Sapiens
uauggaauuuaggauagaauauuuacaauaaagaguauuuacaauaaagaguuuguuauuauu

SEQ ID NO: 373764 - RNA, 63 nt, Homo Sapiens
ccaaauggcuuugcagaaaggaaaugagaugacaguauuuaaucgcagcaguagcaaacuuuu

SEQ ID NO: 373765 - RNA, 63 nt, Homo Sapiens
uguaaauaucaauaacagugcuacuuaguuaucaguauuuaauaucugaggugaguugggggu

SEQ ID NO: 373766 - RNA, 63 nt, Homo Sapiens
aauccaagucaauugugacugcaauuccaaguuaguauuuaaaaauagagaaauugcacuucc

SEQ ID NO: 373767 - RNA, 63 nt, Homo Sapiens
auucuguaaauuauuuaauuuugucaagauguaaguauuuauauucacagccucuuauguuaa

SEQ ID NO: 373768 - RNA, 63 nt, Homo Sapiens
cccugcuuugguucacauuuauauuuuuggucaaguauuuauucccaacacccacuuacuuac

SEQ ID NO: 373769 - RNA, 63 nt, Homo Sapiens
uauguuuauauauguuuauaaaauguuccuugaaguauuuauuauauauccuaaaucuauccu

SEQ ID NO: 373770 - RNA, 63 nt, Homo Sapiens
caaagcugaacucuacagagcgagugcugagacaguauuuaggguuucugggagugaggcugg

SEQ ID NO: 373771 - RNA, 63 nt, Homo Sapiens
acauuccuccuuguuugccgcugcugagauugcaguauuuauugcaauguaaauguauccuga

SEQ ID NO: 373772 - RNA, 63 nt, Homo Sapiens
aacuccauuccccuguguucuucugucuucuguaguauuuauuuuauuaguauuuaauuugua

SEQ ID NO: 373773 - RNA, 63 nt, Homo Sapiens
uguucuucugucuucuguaguauuuauuuuauuaguauuuaauuuguauuguuucauugguuu

SEQ ID NO: 373774 - RNA, 63 nt, Homo Sapiens
gagagcuuacugugugcuaguaaaauaauagcaaguauuuacuagggcauauuuaggucaaua

SEQ ID NO: 373775 - RNA, 63 nt, Homo Sapiens
guaauaaauaaaauuuauacucaaugugauuuuaguauuuacagacuuaacuuuaagguguuu

SEQ ID NO: 373776 - RNA, 63 nt, Homo Sapiens
uaaaagagugcaucgcuuuagaagaaguuuggcaguauuuaaaucuguuggauccucucagcu

SEQ ID NO: 373777 - RNA, 63 nt, Homo Sapiens
aaaaguaaaggaauaaauuuuugucuuuguugaaguauuuaauagaguaagguaaagaagaua

SEQ ID NO: 373778 - RNA, 63 nt, Homo Sapiens; identical to SEQ ID NO: 373776

SEQ ID NO: 373779 - RNA, 63 nt, Homo Sapiens; identical to SEQ ID NO: 373777

SEQ ID NO: 373780 - RNA, 64 nt, Homo Sapiens; identical to SEQ ID NO: 293572

SEQ ID NO: 373781 - RNA, 64 nt, Homo Sapiens; identical to SEQ ID NO: 293573

SEQ ID NO: 373782 - RNA, 64 nt, Homo Sapiens; identical to SEQ ID NO: 293574

SEQ ID NO: 373783 - RNA, 64 nt, Homo Sapiens; identical to SEQ ID NO: 293575

SEQ ID NO: 373784 - RNA, 64 nt, Homo Sapiens; identical to SEQ ID NO: 293576

SEQ ID NO: 373785 - RNA, 64 nt, Homo Sapiens; identical to SEQ ID NO: 293577

SEQ ID NO: 373786 - RNA, 64 nt, Homo Sapiens
uugagauucugcuuuggaggguaaaguggggaagaaaucggauucccagaggugaaucagcucc

SEQ ID NO: 373787 - RNA, 64 nt, Homo Sapiens
ccuuguguccuuugugcuagaauauuuuguaaauaaaucggauuagaugauuaacugacuuuuu

SEQ ID NO: 373788 - RNA, 64 nt, Homo Sapiens
uuucuggaauuugaaucagacagacuuauuaguuaaaucggauuucuuggcauucuugcugauu

SEQ ID NO: 373789 - RNA, 64 nt, Homo Sapiens
guaccauaauaaauccaaacuauguauuaaauagaaaucggaauaaaauuuuaaucagguaccu

SEQ ID NO: 373790 - RNA, 64 nt, Homo Sapiens
uggggcucugggauagcugaauuagaggucuccaaaaucggauccuauagacucuaggacauaa

SEQ ID NO: 373791 - RNA, 58 nt, Homo Sapiens
gugaggcuggacagcgauagaaccccugaaaucggaagggacuuccucuuucucuccu

SEQ ID NO: 373792 - RNA, 64 nt, Homo Sapiens
guggagguggggggaagguggggaaaagauugagaaaucggaugguugccgugucuguguagaa

SEQ ID NO: 373793 - RNA, 64 nt, Homo Sapiens
caagguuaggcugagugaggggauuuccuuaauaaaaucggaaggaaaccucuucugauugauu

SEQ ID NO: 373794 - RNA, 64 nt, Homo Sapiens
uauuucauguaaauuuucuacacauuuguauacaaaaucggauacaggaagaaaagggagaggu

SEQ ID NO: 373795 - RNA, 64 nt, Homo Sapiens
cccagucagaaaucuguucuauucugcuccaggaaaaucggaaaccugugagucagagucagag

SEQ ID NO: 373796 - RNA, 64 nt, Homo Sapiens
ggauuaacauccuauuuuguuguacuaaagugacaaaucggaauaauauaauugguauggccau

SEQ ID NO: 373797 - RNA, 64 nt, Homo Sapiens
gggaagagacacagggaaauucuauucaaugaagaaaucggaguuucccaagggaugaaagguu

SEQ ID NO: 373798 - RNA, 64 nt, Homo Sapiens
cacuuaggaggcagcaugagucuaccagggcugaaaaucggagugcaucagcugucuuccuuau

SEQ ID NO: 373799 - RNA, 64 nt, Homo Sapiens
aaaagccuaaacaggaacaauggcuguucgagagaaaucggaauaagauaaacaugcguguuaa

SEQ ID NO: 373800 - RNA, 64 nt, Homo Sapiens
cuaaacaugagaaaaacgcuaacuuauuggaagaaaaucggagaaacguuggugucaaugcuuu

SEQ ID NO: 373801 - RNA, 64 nt, Homo Sapiens
ccugccauucauugguauuuuaaagaaccacuugaaaucggaucauuuuauuuaaaaauaaaaa

SEQ ID NO: 373802 - RNA, 64 nt, Homo Sapiens
ucagcuuuaguccgucuucaagcaagcacagccaaaaucggaccauguuaccaaucagugagca

SEQ ID NO: 373803 - RNA, 64 nt, Homo Sapiens
guaauuuaugcuuuggagaaagggcccuaaccuaaaaucggagacaaauaaccauggcuuccaa

SEQ ID NO: 373804 - RNA, 64 nt, Homo Sapiens
ucugucuuuaauccaucuuuuuaaucaugaauggaaaucggaaguaguaugcuucugaaacucu

SEQ ID NO: 373805 - RNA, 64 nt, Homo Sapiens
uuuuaguucugagaaaggcaguuacugauaccucaaaucggaaguucccacguucuuaggcuuu

SEQ ID NO: 373806 - RNA, 64 nt, Homo Sapiens
aacaaugucaguugcaugccaaauaauacuggggaaaucggagcaaguaaaaguuuacauggug

SEQ ID NO: 373807 - RNA, 64 nt, Homo Sapiens
guucuggggcugcuaaaugauuucauuaaaguuaaaaucggaaagguuauuuauguacuuaaag

SEQ ID NO: 373808 - RNA, 64 nt, Homo Sapiens
gcaaaucauuccaaggccaaauuugcugaaggaaaaaucggacucaacuacaaucaaaagagcg

SEQ ID NO: 373809 - RNA, 64 nt, Homo Sapiens
gcuuuguuuuuccugucaguucacauuuauucccaaaucggaauggauauuuggguuaaaagaa

SEQ ID NO: 373810 - RNA, 64 nt, Homo Sapiens
acuuuuuuuccguugcgggucauuuugaagacagaaaucggauuuuuggaguccugguuuaucg

SEQ ID NO: 373811 - RNA, 62 nt, Homo Sapiens
ugucuugacucugauguauuugccuaaaauacuuaaaucggacugaaguuauuuauuaaaua

SEQ ID NO: 373812 - RNA, 64 nt, Homo Sapiens
uauuuuagggguguggaggagagaauuucugagcaaaucggagaagauuccaggagucagggua

SEQ ID NO: 373813 - RNA, 64 nt, Homo Sapiens
acaauccuccuccagggacugcugugaaaucaagaaaucggaaaauacuuucagaaguuaaaau

SEQ ID NO: 373814 - RNA, 64 nt, Homo Sapiens
ucccagaagcuucuccacugguguagggaagaggaaaucggagacugagcucaagacuuugaag

SEQ ID NO: 373815 - RNA, 64 nt, Homo Sapiens
ggaagacuuaaaguuguuagggggaaaauuauuuaaaucggaaaaacaaaacaaaaaaaauuaa

SEQ ID NO: 373816 - RNA, 64 nt, Homo Sapiens
gugcuaugacagaggugugaauaaaagcaucaggaaaucggauggagaaccaccauucacccaa

SEQ ID NO: 373817 - RNA, 64 nt, Homo Sapiens
agguguccaagagggucaguaggaggaacaagaaaaaucggagaguuaaucaagaauuugguca

SEQ ID NO: 373818 - RNA, 64 nt, Homo Sapiens
uauucuaggaaugccugauucuuuaauauugccuaaaucggaaccuuuuucuauguugcacaca

SEQ ID NO: 373819 - RNA, 64 nt, Homo Sapiens
ccuguugccgauuuuccauucccuguggcaaagaaaaucggaacgagcuuucaacaggcggguc

SEQ ID NO: 373820 - RNA, 64 nt, Homo Sapiens
ggcccccacuccuucguguccucccgcuaucuccaaaucggacguucuuucuagcugagauuuu

SEQ ID NO: 373821 - RNA, 64 nt, Homo Sapiens
aaccuugcaaguuuuaccgccuuuugaggaacacaaaucggagaacaaacccaggguucaggcg

SEQ ID NO: 373822 - RNA, 64 nt, Homo Sapiens
uucuaaaaugaguaggaaguaauauaggguugccaaaucggauuaagaaagagaugacagaguc

SEQ ID NO: 373823 - RNA, 64 nt, Homo Sapiens
cguauuccugacacuggccacagaaugccuuuggaaaucggauguacuguucucuuguucacgu

SEQ ID NO: 373824 - RNA, 64 nt, Homo Sapiens
cccggaaacugaucagggcaaagagcccccgugcaaaucggagagagaggcgggcugguguucu

SEQ ID NO: 373825 - RNA, 64 nt, Homo Sapiens
aggagcgauccucagagaguugcuucugcaacacaaaucggaacucuuccaggaacggugcucc

SEQ ID NO: 373826 - RNA, 64 nt, Homo Sapiens
ucuaauccaagcauauugcuaugcauuuaaguggaaaucggaccauugccaagaagagaagaaa

SEQ ID NO: 373827 - RNA, 64 nt, Homo Sapiens; identical to SEQ ID NO: 155383

SEQ ID NO: 373828 - RNA, 64 nt, Homo Sapiens; identical to SEQ ID NO: 155384

SEQ ID NO: 373829 - RNA, 64 nt, Homo Sapiens; identical to SEQ ID NO: 155385

SEQ ID NO: 373830 - RNA, 64 nt, Homo Sapiens; identical to SEQ ID NO: 155386

SEQ ID NO: 373831 - RNA, 64 nt, Homo Sapiens; identical to SEQ ID NO: 155387

SEQ ID NO: 373832 - RNA, 64 nt, Homo Sapiens; identical to SEQ ID NO: 155388

SEQ ID NO: 373833 - RNA, 64 nt, Homo Sapiens; identical to SEQ ID NO: 155389

SEQ ID NO: 373834 - RNA, 64 nt, Homo Sapiens; identical to SEQ ID NO: 155390

SEQ ID NO: 373835 - RNA, 64 nt, Homo Sapiens; identical to SEQ ID NO: 155391

SEQ ID NO: 373836 - RNA, 64 nt, Homo Sapiens; identical to SEQ ID NO: 155392

SEQ ID NO: 373837 - RNA, 64 nt, Homo Sapiens; identical to SEQ ID NO: 155393

SEQ ID NO: 373838 - RNA, 64 nt, Homo Sapiens; identical to SEQ ID NO: 155394

SEQ ID NO: 373839 - RNA, 64 nt, Homo Sapiens; identical to SEQ ID NO: 155395

SEQ ID NO: 373840 - RNA, 64 nt, Homo Sapiens; identical to SEQ ID NO: 155396

SEQ ID NO: 373841 - RNA, 64 nt, Homo Sapiens; identical to SEQ ID NO: 155397

SEQ ID NO: 373842 - RNA, 64 nt, Homo Sapiens; identical to SEQ ID NO: 155398

SEQ ID NO: 373843 - RNA, 64 nt, Homo Sapiens; identical to SEQ ID NO: 155399

SEQ ID NO: 373844 - RNA, 64 nt, Homo Sapiens; identical to SEQ ID NO: 155400

SEQ ID NO: 373845 - RNA, 64 nt, Homo Sapiens; identical to SEQ ID NO: 155401

SEQ ID NO: 373846 - RNA, 64 nt, Homo Sapiens; identical to SEQ ID NO: 155402

SEQ ID NO: 373847 - RNA, 64 nt, Homo Sapiens; identical to SEQ ID NO: 155403

SEQ ID NO: 373848 - RNA, 64 nt, Homo Sapiens; identical to SEQ ID NO: 155404

SEQ ID NO: 373849 - RNA, 64 nt, Homo Sapiens; identical to SEQ ID NO: 155405

SEQ ID NO: 373850 - RNA, 64 nt, Homo Sapiens; identical to SEQ ID NO: 155406

SEQ ID NO: 373851 - RNA, 64 nt, Homo Sapiens; identical to SEQ ID NO: 155407

SEQ ID NO: 373852 - RNA, 64 nt, Homo Sapiens; identical to SEQ ID NO: 155408

SEQ ID NO: 373853 - RNA, 64 nt, Homo Sapiens; identical to SEQ ID NO: 155409

SEQ ID NO: 373854 - RNA, 64 nt, Homo Sapiens; identical to SEQ ID NO: 155410

SEQ ID NO: 373855 - RNA, 64 nt, Homo Sapiens; identical to SEQ ID NO: 155411

SEQ ID NO: 373856 - RNA, 64 nt, Homo Sapiens; identical to SEQ ID NO: 155412

SEQ ID NO: 373857 - RNA, 64 nt, Homo Sapiens; identical to SEQ ID NO: 155413

SEQ ID NO: 373858 - RNA, 64 nt, Homo Sapiens; identical to SEQ ID NO: 155414

SEQ ID NO: 373859 - RNA, 64 nt, Homo Sapiens; identical to SEQ ID NO: 155415

SEQ ID NO: 373860 - RNA, 64 nt, Homo Sapiens; identical to SEQ ID NO: 155416

SEQ ID NO: 373861 - RNA, 64 nt, Homo Sapiens; identical to SEQ ID NO: 155417

SEQ ID NO: 373862 - RNA, 64 nt, Homo Sapiens; identical to SEQ ID NO: 155418

SEQ ID NO: 373863 - RNA, 64 nt, Homo Sapiens; identical to SEQ ID NO: 155419

SEQ ID NO: 373864 - RNA, 64 nt, Homo Sapiens; identical to SEQ ID NO: 155420

SEQ ID NO: 373865 - RNA, 64 nt, Homo Sapiens; identical to SEQ ID NO: 155421

SEQ ID NO: 373866 - RNA, 64 nt, Homo Sapiens; identical to SEQ ID NO: 155422

SEQ ID NO: 373867 - RNA, 64 nt, Homo Sapiens; identical to SEQ ID NO: 155423

SEQ ID NO: 373868 - RNA, 64 nt, Homo Sapiens; identical to SEQ ID NO: 155424

SEQ ID NO: 373869 - RNA, 64 nt, Homo Sapiens; identical to SEQ ID NO: 155425

SEQ ID NO: 373870 - RNA, 64 nt, Homo Sapiens; identical to SEQ ID NO: 155426

SEQ ID NO: 373871 - RNA, 64 nt, Homo Sapiens; identical to SEQ ID NO: 155427

SEQ ID NO: 373872 - RNA, 64 nt, Homo Sapiens; identical to SEQ ID NO: 155428

SEQ ID NO: 373873 - RNA, 64 nt, Homo Sapiens; identical to SEQ ID NO: 155429

SEQ ID NO: 373874 - RNA, 64 nt, Homo Sapiens; identical to SEQ ID NO: 155430

SEQ ID NO: 373875 - RNA, 64 nt, Homo Sapiens; identical to SEQ ID NO: 155431

SEQ ID NO: 373876 - RNA, 64 nt, Homo Sapiens; identical to SEQ ID NO: 155432

SEQ ID NO: 373877 - RNA, 64 nt, Homo Sapiens; identical to SEQ ID NO: 155433

SEQ ID NO: 373878 - RNA, 64 nt, Homo Sapiens; identical to SEQ ID NO: 155434

SEQ ID NO: 373879 - RNA, 64 nt, Homo Sapiens; identical to SEQ ID NO: 155435

SEQ ID NO: 373880 - RNA, 64 nt, Homo Sapiens; identical to SEQ ID NO: 155436

SEQ ID NO: 373881 - RNA, 64 nt, Homo Sapiens; identical to SEQ ID NO: 155437

SEQ ID NO: 373882 - RNA, 64 nt, Homo Sapiens; identical to SEQ ID NO: 155438

SEQ ID NO: 373883 - RNA, 64 nt, Homo Sapiens; identical to SEQ ID NO: 155439

SEQ ID NO: 373884 - RNA, 64 nt, Homo Sapiens; identical to SEQ ID NO: 155440

SEQ ID NO: 373885 - RNA, 64 nt, Homo Sapiens; identical to SEQ ID NO: 155441

SEQ ID NO: 373886 - RNA, 64 nt, Homo Sapiens; identical to SEQ ID NO: 155442

SEQ ID NO: 373887 - RNA, 64 nt, Homo Sapiens; identical to SEQ ID NO: 155443

SEQ ID NO: 373888 - RNA, 64 nt, Homo Sapiens; identical to SEQ ID NO: 155444

SEQ ID NO: 373889 - RNA, 64 nt, Homo Sapiens; identical to SEQ ID NO: 155445

SEQ ID NO: 373890 - RNA, 64 nt, Homo Sapiens; identical to SEQ ID NO: 155446

SEQ ID NO: 373891 - RNA, 64 nt, Homo Sapiens; identical to SEQ ID NO: 155447

SEQ ID NO: 373892 - RNA, 64 nt, Homo Sapiens; identical to SEQ ID NO: 155448

SEQ ID NO: 373893 - RNA, 64 nt, Homo Sapiens; identical to SEQ ID NO: 155449

SEQ ID NO: 373894 - RNA, 64 nt, Homo Sapiens; identical to SEQ ID NO: 155450

SEQ ID NO: 373895 - RNA, 64 nt, Homo Sapiens; identical to SEQ ID NO: 155451

SEQ ID NO: 373896 - RNA, 64 nt, Homo Sapiens; identical to SEQ ID NO: 155452

SEQ ID NO: 373897 - RNA, 64 nt, Homo Sapiens; identical to SEQ ID NO: 155453

SEQ ID NO: 373898 - RNA, 64 nt, Homo Sapiens; identical to SEQ ID NO: 155454

SEQ ID NO: 373899 - RNA, 64 nt, Homo Sapiens; identical to SEQ ID NO: 155455

SEQ ID NO: 373900 - RNA, 64 nt, Homo Sapiens; identical to SEQ ID NO: 155456

SEQ ID NO: 373901 - RNA, 64 nt, Homo Sapiens; identical to SEQ ID NO: 155457

SEQ ID NO: 373902 - RNA, 64 nt, Homo Sapiens; identical to SEQ ID NO: 155458

SEQ ID NO: 373903 - RNA, 64 nt, Homo Sapiens; identical to SEQ ID NO: 155459

SEQ ID NO: 373904 - RNA, 64 nt, Homo Sapiens; identical to SEQ ID NO: 155460

SEQ ID NO: 373905 - RNA, 64 nt, Homo Sapiens; identical to SEQ ID NO: 155461

SEQ ID NO: 373906 - RNA, 64 nt, Homo Sapiens; identical to SEQ ID NO: 155462

SEQ ID NO: 373907 - RNA, 64 nt, Homo Sapiens; identical to SEQ ID NO: 155463

SEQ ID NO: 373908 - RNA, 64 nt, Homo Sapiens; identical to SEQ ID NO: 155464

SEQ ID NO: 373909 - RNA, 64 nt, Homo Sapiens; identical to SEQ ID NO: 155465

SEQ ID NO: 373910 - RNA, 64 nt, Homo Sapiens; identical to SEQ ID NO: 155466

SEQ ID NO: 373911 - RNA, 64 nt, Homo Sapiens; identical to SEQ ID NO: 155467

SEQ ID NO: 373912 - RNA, 64 nt, Homo Sapiens; identical to SEQ ID NO: 155468

SEQ ID NO: 373913 - RNA, 64 nt, Homo Sapiens; identical to SEQ ID NO: 155469

SEQ ID NO: 373914 - RNA, 64 nt, Homo Sapiens; identical to SEQ ID NO: 155470

SEQ ID NO: 373915 - RNA, 64 nt, Homo Sapiens; identical to SEQ ID NO: 155471

SEQ ID NO: 373916 - RNA, 64 nt, Homo Sapiens; identical to SEQ ID NO: 155472

SEQ ID NO: 373917 - RNA, 64 nt, Homo Sapiens; identical to SEQ ID NO: 155473

SEQ ID NO: 373918 - RNA, 64 nt, Homo Sapiens; identical to SEQ ID NO: 155474

SEQ ID NO: 373919 - RNA, 64 nt, Homo Sapiens; identical to SEQ ID NO: 155475

SEQ ID NO: 373920 - RNA, 64 nt, Homo Sapiens; identical to SEQ ID NO: 155476

SEQ ID NO: 373921 - RNA, 64 nt, Homo Sapiens; identical to SEQ ID NO: 155477

SEQ ID NO: 373922 - RNA, 64 nt, Homo Sapiens; identical to SEQ ID NO: 155478

SEQ ID NO: 373923 - RNA, 64 nt, Homo Sapiens; identical to SEQ ID NO: 155479

SEQ ID NO: 373924 - RNA, 64 nt, Homo Sapiens; identical to SEQ ID NO: 155480

SEQ ID NO: 373925 - RNA, 64 nt, Homo Sapiens; identical to SEQ ID NO: 155481

SEQ ID NO: 373926 - RNA, 64 nt, Homo Sapiens; identical to SEQ ID NO: 155482

SEQ ID NO: 373927 - RNA, 64 nt, Homo Sapiens; identical to SEQ ID NO: 155483

SEQ ID NO: 373928 - RNA, 64 nt, Homo Sapiens; identical to SEQ ID NO: 155484

SEQ ID NO: 373929 - RNA, 64 nt, Homo Sapiens; identical to SEQ ID NO: 155485

SEQ ID NO: 373930 - RNA, 64 nt, Homo Sapiens; identical to SEQ ID NO: 155486

SEQ ID NO: 373931 - RNA, 64 nt, Homo Sapiens; identical to SEQ ID NO: 155487

SEQ ID NO: 373932 - RNA, 64 nt, Homo Sapiens; identical to SEQ ID NO: 155488

SEQ ID NO: 373933 - RNA, 64 nt, Homo Sapiens; identical to SEQ ID NO: 234057

SEQ ID NO: 373934 - RNA, 64 nt, Homo Sapiens; identical to SEQ ID NO: 234058

SEQ ID NO: 373935 - RNA, 64 nt, Homo Sapiens; identical to SEQ ID NO: 234059

SEQ ID NO: 373936 - RNA, 64 nt, Homo Sapiens; identical to SEQ ID NO: 234060

SEQ ID NO: 373937 - RNA, 64 nt, Homo Sapiens
uguuuucuacuuuggcaacucacgucacacacauauuacacacaugugcgcauuacacacacac

SEQ ID NO: 373938 - RNA, 64 nt, Homo Sapiens
acucacgucacacacauauuacacacaugugcgcauuacacacacacaauacacauacaugcau

SEQ ID NO: 373939 - RNA, 64 nt, Homo Sapiens
uauuaucuucuaucauuuuguccaccacaaaugaauuacacauuggaaauugugauuuguucuc

SEQ ID NO: 373940 - RNA, 64 nt, Homo Sapiens
uuaaaacaacauauauauuucuuuucugauaauuauuacacaauguaugguagauggguugaag

SEQ ID NO: 373941 - RNA, 64 nt, Homo Sapiens
auguggcaaagccuuuaaccaguuuucaacccuuauuacacauaagauaauucauagcggagag

SEQ ID NO: 373942 - RNA, 64 nt, Homo Sapiens
augcggaaaagccuuuaacugguccucaacucuuauuacacauaagauaauucacaguggagaa

SEQ ID NO: 373943 - RNA, 64 nt, Homo Sapiens
uuauuaaauuuuuuuacaagauauacuguggcaaauuacacagauuguuuuauuucacugauua

SEQ ID NO: 373944 - RNA, 64 nt, Homo Sapiens
uaacuguuauuuaaauacuuuguccugggcuuauauuacacauauuaauaaagcuuuacuauuc

SEQ ID NO: 373945 - RNA, 64 nt, Homo Sapiens
gaggacuucaccguaccaacccugaagagauuguauuacacauuaaggaccuugguagcugugc

SEQ ID NO: 373946 - RNA, 64 nt, Homo Sapiens
aacaaguugaaauaaucuugccuuagugaucaugauuacacaaaagaggugcacugccaauaag

SEQ ID NO: 373947 - RNA, 64 nt, Homo Sapiens
guugacaugcuucucuccugauuguugaaauuaaauuacacauuaccuaauguuuaaauuacac

SEQ ID NO: 373948 - RNA, 64 nt, Homo Sapiens
guugaaauuaaauuacacauaaccuaauguuuaaauuacacauuuuguuaccaguuguuaucca

SEQ ID NO: 373949 - RNA, 64 nt, Homo Sapiens
auuaugacuagaaguauguauaauauauauauguauuacacauuuguuuugaaagugaaucuca

SEQ ID NO: 373950 - RNA, 64 nt, Homo Sapiens
ugaaauaauuaaagcuuaaaaagaguuucacauaauuacacacgauaguaugggaaaaaaacug

SEQ ID NO: 373951 - RNA, 64 nt, Homo Sapiens
uucaacaucccuucauuuuaaaaacccucaacaaauuacacauugagggaacauacuucaauaa

SEQ ID NO: 373952 - RNA, 64 nt, Homo Sapiens
cauguucucacuuauaagugggagcuaaacauugauuacacauggacucaaagaagggaacagu

SEQ ID NO: 373953 - RNA, 64 nt, Homo Sapiens
auccaaacauuggagauuagucucaaaacaaacacaaauacaguggcgacagagcaagacucug

SEQ ID NO: 373954 - RNA, 64 nt, Homo Sapiens
cagcuuacugaucacuauaggguuagaagugaagcaaauacauuucaagaucacuuuuaaaaaa

SEQ ID NO: 373955 - RNA, 64 nt, Homo Sapiens
aguggccucucccagccuggcacaagccaccugccaaauacaggauagccuugaugccacuggg

SEQ ID NO: 373956 - RNA, 64 nt, Homo Sapiens
cuuggaggugagacauggccguggugugggcuugcaaauacaagaaagaggguauuaugggugg

SEQ ID NO: 373957 - RNA, 64 nt, Homo Sapiens
uauucuggaaagaaagccugccaggaaauaaauucaaauacaguaugagcugcggggauauuuu

SEQ ID NO: 373958 - RNA, 64 nt, Homo Sapiens
uuuuugugucuacaccagguuugaaauaaguaaacaaauacaagagguucauauaaaagggcaa

SEQ ID NO: 373959 - RNA, 64 nt, Homo Sapiens
uacaaugaaauauuuuacagagaucuucuaagcacaaauacagcuuucuguuuuuaaaucuaga

SEQ ID NO: 373960 - RNA, 64 nt, Homo Sapiens
uaucuuucuuauaugcacauuuuucagaggccuacaaauacaagcucucuaccuaccuagaugu

SEQ ID NO: 373961 - RNA, 64 nt, Homo Sapiens
cauauuagacagugcagaucuauacucauuccuucaaauacauuacucuguuaaucucaaagug

SEQ ID NO: 373962 - RNA, 64 nt, Homo Sapiens
gcaagaguauuuggagcaagaagcugcaaugcgccaaauacacaauaggccuuuucuuuaucau

SEQ ID NO: 373963 - RNA, 64 nt, Homo Sapiens
aauggcucacauucuuucaaaaggucuaauuugacaaauacauaagacccauuauuuccuagaa

SEQ ID NO: 373964 - RNA, 64 nt, Homo Sapiens
cagaccaagaaaugagugagcugggaaguguuuccaaauacaguuagugccuaaaauagugucc

SEQ ID NO: 373965 - RNA, 64 nt, Homo Sapiens
gcaaugaauggcacacaagucaaaaugccauacccaaauacacauuuucuguuacuuucguugu

SEQ ID NO: 373966 - RNA, 64 nt, Homo Sapiens
aaaauucccuuuaugaacuuuaaccaaauaguuucaaauacaacaacaauaucaggauuuuaua

SEQ ID NO: 373967 - RNA, 64 nt, Homo Sapiens
cuaagcuuuaauccacuguguuaggucaaaacuucaaauacaugcauuuuucaauauaggguau

SEQ ID NO: 373968 - RNA, 64 nt, Homo Sapiens
auuggaaaugcacgugguuucuuaggcuuuuaaacaaauacauggaaugguugaaagauuuauu

SEQ ID NO: 373969 - RNA, 64 nt, Homo Sapiens
aauuuuaaaauuauucuuccguaaauuuaguuaacaaauacauaauuaacaucagguauauuuu

SEQ ID NO: 373970 - RNA, 64 nt, Homo Sapiens
uccagguaacucaacuaugagccacuggaaaggacaaauacauugaaaagcuuguauauacuuu

SEQ ID NO: 373971 - RNA, 64 nt, Homo Sapiens
augugggaggggcuuuuauucugccaagucauuucaaauacaugaaaaaucuuacacuggagag

SEQ ID NO: 373972 - RNA, 64 nt, Homo Sapiens
auguagaaaagcauuccauaauuucucuucuuugcaaauacaugaaaggaugcacagaggagag

SEQ ID NO: 373973 - RNA, 64 nt, Homo Sapiens
ugcgaaauuagaaaaaaauuuauucaacuuuggccaaauacaaacaucuagcagcacuaaaacu

SEQ ID NO: 373974 - RNA, 64 nt, Homo Sapiens
agauaucgagcaaaugguuuaaauagauggguuacaaauacaucauuuagucauguugggagaa

SEQ ID NO: 373975 - RNA, 64 nt, Homo Sapiens
acucuaaaauagcaccuauaguacacaaaaucuacaaauacauuucuauuuuuguuuagaguuu

SEQ ID NO: 373976 - RNA, 64 nt, Homo Sapiens
cuugucucaaaaaccauuacaaaaucuuaaccuucaaauacauucuaaaucacuuuaauuuaga

SEQ ID NO: 373977 - RNA, 64 nt, Homo Sapiens
uguaaaugggaaaauauauauuaaaauugauugucaaauacagcauuucuuuggaaaccaccuu

SEQ ID NO: 373978 - RNA, 64 nt, Homo Sapiens
ugguuaaucugacauacauuaaaaauauugucaucaaauacagguuuaaaaaauugagcucauc

SEQ ID NO: 373979 - RNA, 64 nt, Homo Sapiens
auucacacauaacacuaagcaaaaaggagaguaacaaauacacaggagcaccaaacuccgcccc

SEQ ID NO: 373980 - RNA, 64 nt, Homo Sapiens; identical to SEQ ID NO: 227757

SEQ ID NO: 373981 - RNA, 64 nt, Homo Sapiens; identical to SEQ ID NO: 227758

SEQ ID NO: 373982 - RNA, 64 nt, Homo Sapiens; identical to SEQ ID NO: 227759

SEQ ID NO: 373983 - RNA, 64 nt, Homo Sapiens; identical to SEQ ID NO: 227760

SEQ ID NO: 373984 - RNA, 64 nt, Homo Sapiens; identical to SEQ ID NO: 227761

SEQ ID NO: 373985 - RNA, 64 nt, Homo Sapiens; identical to SEQ ID NO: 227762

SEQ ID NO: 373986 - RNA, 64 nt, Homo Sapiens; identical to SEQ ID NO: 227763

SEQ ID NO: 373987 - RNA, 64 nt, Homo Sapiens; identical to SEQ ID NO: 227764

SEQ ID NO: 373988 - RNA, 64 nt, Homo Sapiens; identical to SEQ ID NO: 227765

SEQ ID NO: 373989 - RNA, 64 nt, Homo Sapiens; identical to SEQ ID NO: 227766

SEQ ID NO: 373990 - RNA, 64 nt, Homo Sapiens; identical to SEQ ID NO: 318317

SEQ ID NO: 373991 - RNA, 64 nt, Homo Sapiens; identical to SEQ ID NO: 318318

SEQ ID NO: 373992 - RNA, 64 nt, Homo Sapiens; identical to SEQ ID NO: 318319

SEQ ID NO: 373993 - RNA, 64 nt, Homo Sapiens; identical to SEQ ID NO: 318320

SEQ ID NO: 373994 - RNA, 64 nt, Homo Sapiens; identical to SEQ ID NO: 318321

SEQ ID NO: 373995 - RNA, 64 nt, Homo Sapiens; identical to SEQ ID NO: 318322

SEQ ID NO: 373996 - RNA, 64 nt, Homo Sapiens; identical to SEQ ID NO: 318323

SEQ ID NO: 373997 - RNA, 51 nt, Homo Sapiens; identical to SEQ ID NO: 318324

SEQ ID NO: 373998 - RNA, 64 nt, Homo Sapiens; identical to SEQ ID NO: 318325

SEQ ID NO: 373999 - RNA, 64 nt, Homo Sapiens; identical to SEQ ID NO: 318326

SEQ ID NO: 374000 - RNA, 64 nt, Homo Sapiens; identical to SEQ ID NO: 318327

SEQ ID NO: 374001 - RNA, 64 nt, Homo Sapiens; identical to SEQ ID NO: 318328

SEQ ID NO: 374002 - RNA, 64 nt, Homo Sapiens; identical to SEQ ID NO: 171556

SEQ ID NO: 374003 - RNA, 64 nt, Homo Sapiens; identical to SEQ ID NO: 171557

SEQ ID NO: 374004 - RNA, 64 nt, Homo Sapiens; identical to SEQ ID NO: 171558

SEQ ID NO: 374005 - RNA, 64 nt, Homo Sapiens; identical to SEQ ID NO: 171559

SEQ ID NO: 374006 - RNA, 64 nt, Homo Sapiens; identical to SEQ ID NO: 171560

SEQ ID NO: 374007 - RNA, 64 nt, Homo Sapiens; identical to SEQ ID NO: 171561

SEQ ID NO: 374008 - RNA, 64 nt, Homo Sapiens; identical to SEQ ID NO: 171562

SEQ ID NO: 374009 - RNA, 64 nt, Homo Sapiens; identical to SEQ ID NO: 171563

SEQ ID NO: 374010 - RNA, 64 nt, Homo Sapiens; identical to SEQ ID NO: 171564

SEQ ID NO: 374011 - RNA, 64 nt, Homo Sapiens; identical to SEQ ID NO: 171565

SEQ ID NO: 374012 - RNA, 64 nt, Homo Sapiens; identical to SEQ ID NO: 171566

SEQ ID NO: 374013 - RNA, 64 nt, Homo Sapiens; identical to SEQ ID NO: 171567

SEQ ID NO: 374014 - RNA, 64 nt, Homo Sapiens; identical to SEQ ID NO: 171568

SEQ ID NO: 374015 - RNA, 64 nt, Homo Sapiens; identical to SEQ ID NO: 171569

SEQ ID NO: 374016 - RNA, 64 nt, Homo Sapiens; identical to SEQ ID NO: 171570

SEQ ID NO: 374017 - RNA, 64 nt, Homo Sapiens; identical to SEQ ID NO: 171571

SEQ ID NO: 374018 - RNA, 64 nt, Homo Sapiens; identical to SEQ ID NO: 171572

SEQ ID NO: 374019 - RNA, 64 nt, Homo Sapiens; identical to SEQ ID NO: 171573

SEQ ID NO: 374020 - RNA, 64 nt, Homo Sapiens; identical to SEQ ID NO: 171574

SEQ ID NO: 374021 - RNA, 64 nt, Homo Sapiens; identical to SEQ ID NO: 171575

SEQ ID NO: 374022 - RNA, 64 nt, Homo Sapiens; identical to SEQ ID NO: 171576

SEQ ID NO: 374023 - RNA, 64 nt, Homo Sapiens; identical to SEQ ID NO: 171577

SEQ ID NO: 374024 - RNA, 64 nt, Homo Sapiens; identical to SEQ ID NO: 171578

SEQ ID NO: 374025 - RNA, 64 nt, Homo Sapiens; identical to SEQ ID NO: 171579

SEQ ID NO: 374026 - RNA, 64 nt, Homo Sapiens; identical to SEQ ID NO: 171580

SEQ ID NO: 374027 - RNA, 64 nt, Homo Sapiens; identical to SEQ ID NO: 171581

SEQ ID NO: 374028 - RNA, 64 nt, Homo Sapiens; identical to SEQ ID NO: 171582

SEQ ID NO: 374029 - RNA, 64 nt, Homo Sapiens; identical to SEQ ID NO: 171583

SEQ ID NO: 374030 - RNA, 64 nt, Homo Sapiens; identical to SEQ ID NO: 171584

SEQ ID NO: 374031 - RNA, 64 nt, Homo Sapiens; identical to SEQ ID NO: 171585

SEQ ID NO: 374032 - RNA, 64 nt, Homo Sapiens; identical to SEQ ID NO: 171586

SEQ ID NO: 374033 - RNA, 64 nt, Homo Sapiens; identical to SEQ ID NO: 171587

SEQ ID NO: 374034 - RNA, 64 nt, Homo Sapiens; identical to SEQ ID NO: 171588

SEQ ID NO: 374035 - RNA, 64 nt, Homo Sapiens; identical to SEQ ID NO: 171589

SEQ ID NO: 374036 - RNA, 64 nt, Homo Sapiens; identical to SEQ ID NO: 171590

SEQ ID NO: 374037 - RNA, 64 nt, Homo Sapiens; identical to SEQ ID NO: 171591

SEQ ID NO: 374038 - RNA, 64 nt, Homo Sapiens; identical to SEQ ID NO: 171592

SEQ ID NO: 374039 - RNA, 64 nt, Homo Sapiens; identical to SEQ ID NO: 171593

SEQ ID NO: 374040 - RNA, 64 nt, Homo Sapiens; identical to SEQ ID NO: 171594

SEQ ID NO: 374041 - RNA, 64 nt, Homo Sapiens; identical to SEQ ID NO: 171595

SEQ ID NO: 374042 - RNA, 64 nt, Homo Sapiens; identical to SEQ ID NO: 171596

SEQ ID NO: 374043 - RNA, 64 nt, Homo Sapiens; identical to SEQ ID NO: 171597

SEQ ID NO: 374044 - RNA, 64 nt, Homo Sapiens; identical to SEQ ID NO: 171598

SEQ ID NO: 374045 - RNA, 64 nt, Homo Sapiens; identical to SEQ ID NO: 171599

SEQ ID NO: 374046 - RNA, 64 nt, Homo Sapiens; identical to SEQ ID NO: 171600

SEQ ID NO: 374047 - RNA, 64 nt, Homo Sapiens; identical to SEQ ID NO: 171601

SEQ ID NO: 374048 - RNA, 64 nt, Homo Sapiens; identical to SEQ ID NO: 171602

SEQ ID NO: 374049 - RNA, 64 nt, Homo Sapiens; identical to SEQ ID NO: 171603

SEQ ID NO: 374050 - RNA, 64 nt, Homo Sapiens; identical to SEQ ID NO: 171604

SEQ ID NO: 374051 - RNA, 64 nt, Homo Sapiens; identical to SEQ ID NO: 171605

SEQ ID NO: 374052 - RNA, 64 nt, Homo Sapiens; identical to SEQ ID NO: 171606

SEQ ID NO: 374053 - RNA, 64 nt, Homo Sapiens; identical to SEQ ID NO: 171607

SEQ ID NO: 374054 - RNA, 64 nt, Homo Sapiens; identical to SEQ ID NO: 171608

SEQ ID NO: 374055 - RNA, 64 nt, Homo Sapiens; identical to SEQ ID NO: 171609

SEQ ID NO: 374056 - RNA, 64 nt, Homo Sapiens; identical to SEQ ID NO: 171610

SEQ ID NO: 374057 - RNA, 64 nt, Homo Sapiens; identical to SEQ ID NO: 171611

SEQ ID NO: 374058 - RNA, 64 nt, Homo Sapiens; identical to SEQ ID NO: 171612

SEQ ID NO: 374059 - RNA, 64 nt, Homo Sapiens; identical to SEQ ID NO: 171613

SEQ ID NO: 374060 - RNA, 64 nt, Homo Sapiens; identical to SEQ ID NO: 171614

SEQ ID NO: 374061 - RNA, 64 nt, Homo Sapiens; identical to SEQ ID NO: 171615

SEQ ID NO: 374062 - RNA, 64 nt, Homo Sapiens; identical to SEQ ID NO: 171616

SEQ ID NO: 374063 - RNA, 64 nt, Homo Sapiens; identical to SEQ ID NO: 171617

SEQ ID NO: 374064 - RNA, 64 nt, Homo Sapiens; identical to SEQ ID NO: 171618

SEQ ID NO: 374065 - RNA, 64 nt, Homo Sapiens; identical to SEQ ID NO: 171619

SEQ ID NO: 374066 - RNA, 64 nt, Homo Sapiens; identical to SEQ ID NO: 171620

SEQ ID NO: 374067 - RNA, 64 nt, Homo Sapiens; identical to SEQ ID NO: 171621

SEQ ID NO: 374068 - RNA, 64 nt, Homo Sapiens; identical to SEQ ID NO: 171622

SEQ ID NO: 374069 - RNA, 64 nt, Homo Sapiens; identical to SEQ ID NO: 171623

SEQ ID NO: 374070 - RNA, 64 nt, Homo Sapiens; identical to SEQ ID NO: 171624

SEQ ID NO: 374071 - RNA, 64 nt, Homo Sapiens; identical to SEQ ID NO: 171625

SEQ ID NO: 374072 - RNA, 64 nt, Homo Sapiens; identical to SEQ ID NO: 171626

SEQ ID NO: 374073 - RNA, 64 nt, Homo Sapiens; identical to SEQ ID NO: 171627

SEQ ID NO: 374074 - RNA, 64 nt, Homo Sapiens; identical to SEQ ID NO: 171628

SEQ ID NO: 374075 - RNA, 64 nt, Homo Sapiens; identical to SEQ ID NO: 51647

SEQ ID NO: 374076 - RNA, 64 nt, Homo Sapiens; identical to SEQ ID NO: 51648

SEQ ID NO: 374077 - RNA, 64 nt, Homo Sapiens; identical to SEQ ID NO: 51649

SEQ ID NO: 374078 - RNA, 64 nt, Homo Sapiens; identical to SEQ ID NO: 51650

SEQ ID NO: 374079 - RNA, 64 nt, Homo Sapiens; identical to SEQ ID NO: 51651

SEQ ID NO: 374080 - RNA, 64 nt, Homo Sapiens; identical to SEQ ID NO: 51652

SEQ ID NO: 374081 - RNA, 64 nt, Homo Sapiens; identical to SEQ ID NO: 51653

SEQ ID NO: 374082 - RNA, 64 nt, Homo Sapiens; identical to SEQ ID NO: 51654

SEQ ID NO: 374083 - RNA, 64 nt, Homo Sapiens; identical to SEQ ID NO: 51655

SEQ ID NO: 374084 - RNA, 64 nt, Homo Sapiens; identical to SEQ ID NO: 51656

SEQ ID NO: 374085 - RNA, 64 nt, Homo Sapiens; identical to SEQ ID NO: 51657

SEQ ID NO: 374086 - RNA, 64 nt, Homo Sapiens; identical to SEQ ID NO: 51658

SEQ ID NO: 374087 - RNA, 64 nt, Homo Sapiens; identical to SEQ ID NO: 51659

SEQ ID NO: 374088 - RNA, 64 nt, Homo Sapiens; identical to SEQ ID NO: 51660

SEQ ID NO: 374089 - RNA, 64 nt, Homo Sapiens; identical to SEQ ID NO: 51661

SEQ ID NO: 374090 - RNA, 64 nt, Homo Sapiens; identical to SEQ ID NO: 51662

SEQ ID NO: 374091 - RNA, 64 nt, Homo Sapiens; identical to SEQ ID NO: 51663

SEQ ID NO: 374092 - RNA, 64 nt, Homo Sapiens; identical to SEQ ID NO: 51664

SEQ ID NO: 374093 - RNA, 64 nt, Homo Sapiens; identical to SEQ ID NO: 107704

SEQ ID NO: 374094 - RNA, 64 nt, Homo Sapiens; identical to SEQ ID NO: 107705

SEQ ID NO: 374095 - RNA, 64 nt, Homo Sapiens; identical to SEQ ID NO: 107706

SEQ ID NO: 374096 - RNA, 64 nt, Homo Sapiens; identical to SEQ ID NO: 107707

SEQ ID NO: 374097 - RNA, 64 nt, Homo Sapiens; identical to SEQ ID NO: 107708

SEQ ID NO: 374098 - RNA, 64 nt, Homo Sapiens; identical to SEQ ID NO: 107709

SEQ ID NO: 374099 - RNA, 64 nt, Homo Sapiens; identical to SEQ ID NO: 107710

SEQ ID NO: 374100 - RNA, 64 nt, Homo Sapiens; identical to SEQ ID NO: 107711

SEQ ID NO: 374101 - RNA, 64 nt, Homo Sapiens; identical to SEQ ID NO: 107712

SEQ ID NO: 374102 - RNA, 64 nt, Homo Sapiens; identical to SEQ ID NO: 107713

SEQ ID NO: 374103 - RNA, 64 nt, Homo Sapiens; identical to SEQ ID NO: 107714

SEQ ID NO: 374104 - RNA, 64 nt, Homo Sapiens; identical to SEQ ID NO: 107715

SEQ ID NO: 374105 - RNA, 64 nt, Homo Sapiens; identical to SEQ ID NO: 107716

SEQ ID NO: 374106 - RNA, 64 nt, Homo Sapiens; identical to SEQ ID NO: 107717

SEQ ID NO: 374107 - RNA, 64 nt, Homo Sapiens; identical to SEQ ID NO: 107718

SEQ ID NO: 374108 - RNA, 64 nt, Homo Sapiens; identical to SEQ ID NO: 107719

SEQ ID NO: 374109 - RNA, 64 nt, Homo Sapiens; identical to SEQ ID NO: 107720

SEQ ID NO: 374110 - RNA, 64 nt, Homo Sapiens; identical to SEQ ID NO: 107721

SEQ ID NO: 374111 - RNA, 64 nt, Homo Sapiens; identical to SEQ ID NO: 107722

SEQ ID NO: 374112 - RNA, 64 nt, Homo Sapiens; identical to SEQ ID NO: 107723

SEQ ID NO: 374113 - RNA, 64 nt, Homo Sapiens; identical to SEQ ID NO: 107724

SEQ ID NO: 374114 - RNA, 64 nt, Homo Sapiens; identical to SEQ ID NO: 107725

SEQ ID NO: 374115 - RNA, 64 nt, Homo Sapiens; identical to SEQ ID NO: 107726

SEQ ID NO: 374116 - RNA, 64 nt, Homo Sapiens; identical to SEQ ID NO: 107727

SEQ ID NO: 374117 - RNA, 64 nt, Homo Sapiens; identical to SEQ ID NO: 107728

SEQ ID NO: 374118 - RNA, 64 nt, Homo Sapiens; identical to SEQ ID NO: 107729

SEQ ID NO: 374119 - RNA, 64 nt, Homo Sapiens; identical to SEQ ID NO: 107730

SEQ ID NO: 374120 - RNA, 64 nt, Homo Sapiens; identical to SEQ ID NO: 107731

SEQ ID NO: 374121 - RNA, 64 nt, Homo Sapiens; identical to SEQ ID NO: 107732

SEQ ID NO: 374122 - RNA, 64 nt, Homo Sapiens; identical to SEQ ID NO: 107733

SEQ ID NO: 374123 - RNA, 64 nt, Homo Sapiens; identical to SEQ ID NO: 107734

SEQ ID NO: 374124 - RNA, 64 nt, Homo Sapiens; identical to SEQ ID NO: 107735

SEQ ID NO: 374125 - RNA, 64 nt, Homo Sapiens; identical to SEQ ID NO: 107736

SEQ ID NO: 374126 - RNA, 64 nt, Homo Sapiens; identical to SEQ ID NO: 107737

SEQ ID NO: 374127 - RNA, 64 nt, Homo Sapiens; identical to SEQ ID NO: 107738

SEQ ID NO: 374128 - RNA, 64 nt, Homo Sapiens; identical to SEQ ID NO: 107739

SEQ ID NO: 374129 - RNA, 60 nt, Homo Sapiens; identical to SEQ ID NO: 107740

SEQ ID NO: 374130 - RNA, 64 nt, Homo Sapiens; identical to SEQ ID NO: 107741

SEQ ID NO: 374131 - RNA, 64 nt, Homo Sapiens; identical to SEQ ID NO: 107742

SEQ ID NO: 374132 - RNA, 64 nt, Homo Sapiens; identical to SEQ ID NO: 107743

SEQ ID NO: 374133 - RNA, 64 nt, Homo Sapiens; identical to SEQ ID NO: 107744

SEQ ID NO: 374134 - RNA, 64 nt, Homo Sapiens; identical to SEQ ID NO: 107745

SEQ ID NO: 374135 - RNA, 64 nt, Homo Sapiens; identical to SEQ ID NO: 107746

SEQ ID NO: 374136 - RNA, 64 nt, Homo Sapiens; identical to SEQ ID NO: 107747

SEQ ID NO: 374137 - RNA, 64 nt, Homo Sapiens; identical to SEQ ID NO: 107748

SEQ ID NO: 374138 - RNA, 64 nt, Homo Sapiens; identical to SEQ ID NO: 107749

SEQ ID NO: 374139 - RNA, 64 nt, Homo Sapiens; identical to SEQ ID NO: 107750

SEQ ID NO: 374140 - RNA, 64 nt, Homo Sapiens; identical to SEQ ID NO: 107751

SEQ ID NO: 374141 - RNA, 64 nt, Homo Sapiens; identical to SEQ ID NO: 107752

SEQ ID NO: 374142 - RNA, 64 nt, Homo Sapiens; identical to SEQ ID NO: 107753

SEQ ID NO: 374143 - RNA, 64 nt, Homo Sapiens; identical to SEQ ID NO: 107754

SEQ ID NO: 374144 - RNA, 64 nt, Homo Sapiens; identical to SEQ ID NO: 107755

SEQ ID NO: 374145 - RNA, 64 nt, Homo Sapiens; identical to SEQ ID NO: 107756

SEQ ID NO: 374146 - RNA, 64 nt, Homo Sapiens; identical to SEQ ID NO: 107757

SEQ ID NO: 374147 - RNA, 64 nt, Homo Sapiens; identical to SEQ ID NO: 107758

SEQ ID NO: 374148 - RNA, 64 nt, Homo Sapiens; identical to SEQ ID NO: 107759

SEQ ID NO: 374149 - RNA, 64 nt, Homo Sapiens; identical to SEQ ID NO: 107760

SEQ ID NO: 374150 - RNA, 64 nt, Homo Sapiens; identical to SEQ ID NO: 107761

SEQ ID NO: 374151 - RNA, 64 nt, Homo Sapiens; identical to SEQ ID NO: 107762

SEQ ID NO: 374152 - RNA, 64 nt, Homo Sapiens; identical to SEQ ID NO: 107763

SEQ ID NO: 374153 - RNA, 64 nt, Homo Sapiens; identical to SEQ ID NO: 107764

SEQ ID NO: 374154 - RNA, 64 nt, Homo Sapiens; identical to SEQ ID NO: 107765

SEQ ID NO: 374155 - RNA, 64 nt, Homo Sapiens; identical to SEQ ID NO: 107766

SEQ ID NO: 374156 - RNA, 64 nt, Homo Sapiens; identical to SEQ ID NO: 107767

SEQ ID NO: 374157 - RNA, 64 nt, Homo Sapiens; identical to SEQ ID NO: 107768

SEQ ID NO: 374158 - RNA, 64 nt, Homo Sapiens
auuuuguaucuuucuaaucuauuugcauuuaugccuuuaggauaguauuugccauaaaaaauuu

SEQ ID NO: 374159 - RNA, 64 nt, Homo Sapiens
agaugucuugcaucagucuuaguuguuuacuaaacuuuaggaaagggaaaaaggagcuuauuaa

SEQ ID NO: 374160 - RNA, 64 nt, Homo Sapiens
agaggcagcuugccuuccacggggcggguccccacuuuaggacaagccucaucuccccagguga

SEQ ID NO: 374161 - RNA, 64 nt, Homo Sapiens
aggcagagaaacagauguugggcgaagauauugucuuuaggauaauuauuuauuuuacaaaaug

SEQ ID NO: 374162 - RNA, 64 nt, Homo Sapiens
ucacuguuucuucaaguacacacugacucugcuacuuuaggauaaauauauuuuacucagaacu

SEQ ID NO: 374163 - RNA, 64 nt, Homo Sapiens
gguuuuuuauauucagauguauauauggugcucacuuuaggaucagcaguguugaccauuuaug

SEQ ID NO: 374164 - RNA, 64 nt, Homo Sapiens
ugucaucaccucccggaaggcugcuacuguacagcuuuaggauuugucagauguaccuuacucu

SEQ ID NO: 374165 - RNA, 64 nt, Homo Sapiens
cuacuaaaaugcugugggagucagaaugaguaagcuuuaggaaauaguagcuuacuaagacugc

SEQ ID NO: 374166 - RNA, 64 nt, Homo Sapiens
guuucauaauuucuuacaacaugagccaguaacccuuuaggaacucucuauggagaacaggccu

SEQ ID NO: 374167 - RNA, 64 nt, Homo Sapiens
gugcuacauauauauuuuuaagaaaggaccaucucuuuaggauauauuuuuaaauucuuugaaa

SEQ ID NO: 374168 - RNA, 64 nt, Homo Sapiens
uuuagcccuggucugcaggaaggaggacagcagacuuuaggaccccacagcauggcagugcuga

SEQ ID NO: 374169 - RNA, 64 nt, Homo Sapiens
ccugccuugcugaugaguaggaugugauuuggcucuuuaggaaacugaauuugcagaacuuaag

SEQ ID NO: 374170 - RNA, 64 nt, Homo Sapiens; identical to SEQ ID NO: 144364

SEQ ID NO: 374171 - RNA, 64 nt, Homo Sapiens; identical to SEQ ID NO: 144365

SEQ ID NO: 374172 - RNA, 64 nt, Homo Sapiens; identical to SEQ ID NO: 144366

SEQ ID NO: 374173 - RNA, 64 nt, Homo Sapiens; identical to SEQ ID NO: 144367

SEQ ID NO: 374174 - RNA, 64 nt, Homo Sapiens; identical to SEQ ID NO: 144368

SEQ ID NO: 374175 - RNA, 64 nt, Homo Sapiens; identical to SEQ ID NO: 144369

SEQ ID NO: 374176 - RNA, 64 nt, Homo Sapiens; identical to SEQ ID NO: 144370

SEQ ID NO: 374177 - RNA, 64 nt, Homo Sapiens; identical to SEQ ID NO: 144371

SEQ ID NO: 374178 - RNA, 64 nt, Homo Sapiens; identical to SEQ ID NO: 144372

SEQ ID NO: 374179 - RNA, 64 nt, Homo Sapiens; identical to SEQ ID NO: 144373

SEQ ID NO: 374180 - RNA, 64 nt, Homo Sapiens; identical to SEQ ID NO: 144374

SEQ ID NO: 374181 - RNA, 64 nt, Homo Sapiens; identical to SEQ ID NO: 144375

SEQ ID NO: 374182 - RNA, 64 nt, Homo Sapiens; identical to SEQ ID NO: 144376

SEQ ID NO: 374183 - RNA, 64 nt, Homo Sapiens; identical to SEQ ID NO: 144377

SEQ ID NO: 374184 - RNA, 64 nt, Homo Sapiens; identical to SEQ ID NO: 144378

SEQ ID NO: 374185 - RNA, 64 nt, Homo Sapiens; identical to SEQ ID NO: 144379

SEQ ID NO: 374186 - RNA, 64 nt, Homo Sapiens; identical to SEQ ID NO: 144380

SEQ ID NO: 374187 - RNA, 64 nt, Homo Sapiens; identical to SEQ ID NO: 144381

SEQ ID NO: 374188 - RNA, 64 nt, Homo Sapiens; identical to SEQ ID NO: 144382

SEQ ID NO: 374189 - RNA, 64 nt, Homo Sapiens; identical to SEQ ID NO: 144383

SEQ ID NO: 374190 - RNA, 64 nt, Homo Sapiens; identical to SEQ ID NO: 144384

SEQ ID NO: 374191 - RNA, 64 nt, Homo Sapiens; identical to SEQ ID NO: 144385

SEQ ID NO: 374192 - RNA, 64 nt, Homo Sapiens; identical to SEQ ID NO: 144386

SEQ ID NO: 374193 - RNA, 64 nt, Homo Sapiens; identical to SEQ ID NO: 144387

SEQ ID NO: 374194 - RNA, 64 nt, Homo Sapiens; identical to SEQ ID NO: 144388

SEQ ID NO: 374195 - RNA, 64 nt, Homo Sapiens; identical to SEQ ID NO: 144389

SEQ ID NO: 374196 - RNA, 64 nt, Homo Sapiens; identical to SEQ ID NO: 144390

SEQ ID NO: 374197 - RNA, 64 nt, Homo Sapiens; identical to SEQ ID NO: 144391

SEQ ID NO: 374198 - RNA, 64 nt, Homo Sapiens; identical to SEQ ID NO: 144392

SEQ ID NO: 374199 - RNA, 64 nt, Homo Sapiens; identical to SEQ ID NO: 144393

SEQ ID NO: 374200 - RNA, 64 nt, Homo Sapiens; identical to SEQ ID NO: 144394

SEQ ID NO: 374201 - RNA, 64 nt, Homo Sapiens; identical to SEQ ID NO: 144395

SEQ ID NO: 374202 - RNA, 64 nt, Homo Sapiens; identical to SEQ ID NO: 144396

SEQ ID NO: 374203 - RNA, 64 nt, Homo Sapiens; identical to SEQ ID NO: 144397

SEQ ID NO: 374204 - RNA, 64 nt, Homo Sapiens; identical to SEQ ID NO: 144398

SEQ ID NO: 374205 - RNA, 64 nt, Homo Sapiens; identical to SEQ ID NO: 144399

SEQ ID NO: 374206 - RNA, 64 nt, Homo Sapiens; identical to SEQ ID NO: 144400

SEQ ID NO: 374207 - RNA, 64 nt, Homo Sapiens
auuguaugcauauauguguagggagcaugccuuaaaacuuaaagauaacagguuagcuaaaauu

SEQ ID NO: 374208 - RNA, 64 nt, Homo Sapiens
uacuacuuacugguacucucuauagaucauuuugaaacuuaaugguaaucucuucucuuagaag

SEQ ID NO: 374209 - RNA, 64 nt, Homo Sapiens
uaguuuguuccuugaucaaauaaucagagaaaagaaacuuaaagaucuuugucugugaagaaga

SEQ ID NO: 374210 - RNA, 64 nt, Homo Sapiens
aaauuguuguuuaaauguaaugucaacucuuuauaaacuuaaaaauaaacaaguaauuaaccac

SEQ ID NO: 374211 - RNA, 64 nt, Homo Sapiens
agaaaauuuccuaaaggugacagaauuugcaucaaaacuuaaucgagccucaaaauuugcugca

SEQ ID NO: 374212 - RNA, 64 nt, Homo Sapiens
cuuacauauuuuuugugggcugggauggauucugaaacuuaaguaaccuacauagguguccugg

SEQ ID NO: 374213 - RNA, 64 nt, Homo Sapiens
ucuacuguacugugggucauuuagaugagaugaaaaacuuaauuaaaucugaagugucagaggc

SEQ ID NO: 374214 - RNA, 64 nt, Homo Sapiens
cgcuuaguaagccuuaguaaaguugugauugaagaaacuuaauacaaaugaacuagagguuugu

SEQ ID NO: 374215 - RNA, 64 nt, Homo Sapiens
caaaaaaauuaauaccucuguggagaaaacuucaaaacuuaaaaaaggacauagaaaauguuuu

SEQ ID NO: 374216 - RNA, 64 nt, Homo Sapiens
gguaugaaugugucccccacagcucaugcguuggaaacuuaauccccaaagcaacagcuuugag

SEQ ID NO: 374217 - RNA, 64 nt, Homo Sapiens
ucauauaucagaauuuuauuguauaugaugaacaaaacuuaaaauuuuuuaaauuuaauuuuua

SEQ ID NO: 374218 - RNA, 64 nt, Homo Sapiens
cuguuucagaguucuaaaaaggcaguuuuuuaaaaaacuuaaguugauaaaaacuguaagaaua

SEQ ID NO: 374219 - RNA, 64 nt, Homo Sapiens
guggcuguccuuuuaauuaagaguguggagucauaaacuuaaguucuucauauagugacaagag

SEQ ID NO: 374220 - RNA, 64 nt, Homo Sapiens
gaaauguguuugguuacugauuauaguuugagagaaacuuaacacagacaccugcccuaaauga

SEQ ID NO: 374221 - RNA, 64 nt, Homo Sapiens
uggagccugauuuccuacuguaaaguuaguggcaaaacuuaauuuaauuugccuaaugauacau

SEQ ID NO: 374222 - RNA, 64 nt, Homo Sapiens
uuuaaaguuguaucuugacacaggaaaugggaaaaaacuuaaaaauuaauaugguguauuuuuc

SEQ ID NO: 374223 - RNA, 64 nt, Homo Sapiens
ugaaaaaucucaauugaaagcuuuuaaaauguagaaacuuaaacacaccuuccuguggaggcug

SEQ ID NO: 374224 - RNA, 64 nt, Homo Sapiens
gcagucauuuggugcucugcuaaccauuuauauaaaacuuaaaaacaagagaaaagaaaaauca

SEQ ID NO: 374225 - RNA, 64 nt, Homo Sapiens
agagacuuuaugauuagaauugcauauauuuaugaaacuuaaagaugaauguuuuauugaauuu

SEQ ID NO: 374226 - RNA, 64 nt, Homo Sapiens
ucaucucugagaguaaccuguauuuuaauuguugaaacuuaaccaaaauaagauacugucucag

SEQ ID NO: 374227 - RNA, 64 nt, Homo Sapiens
uuaccaaugucuuugaguuucaaaauauacauucaaacuuaaaaguuauuuuccauuuuuauuu

SEQ ID NO: 374228 - RNA, 64 nt, Homo Sapiens
uucauagagggguggaguuugacuuuuaaggcuaaaacuuaacaaagugugagcaaacuaacuu

SEQ ID NO: 374229 - RNA, 64 nt, Homo Sapiens
gcuacaguuuaaaugauagccucauucgcaauguaaacuuaacaacaaaauaauagugaucuuu

SEQ ID NO: 374230 - RNA, 64 nt, Homo Sapiens
aagugugugcagcauuucuaacauuuaaagaauuaaacuuaaaucacaaaacuaaggguaaaag

SEQ ID NO: 374231 - RNA, 64 nt, Homo Sapiens
cuuuguagaaagcaaacaaaaccggcauuuuauuaaacuuaaaaggaggaaaacaguggugauu

SEQ ID NO: 374232 - RNA, 64 nt, Homo Sapiens
uaaaauuauauaccccacagccugcaggaaauauaaacuuaaaagaaaagauguauguugcuau

SEQ ID NO: 374233 - RNA, 64 nt, Homo Sapiens
cagugggcaguguccacguuauagggagcacuuuaaacuuaauguacuuuuacugucuauauau

SEQ ID NO: 374234 - RNA, 64 nt, Homo Sapiens
auugugccuaaaaacuaugguugccccuaggagaaaacuuaauaauugcacugaaugauuucuu

SEQ ID NO: 374235 - RNA, 64 nt, Homo Sapiens
cuaucaagaaucuuuuucauugcuguuguuacugaaacuuaauuguauuauguaugcauaauuu

SEQ ID NO: 374236 - RNA, 64 nt, Homo Sapiens
uugcccauagucauuuaggcuggaaaaaaguugaaaacuuaacgaaauauugccaagagauugu

SEQ ID NO: 374237 - RNA, 64 nt, Homo Sapiens
cauaaagcuguauuucuuaaucaucuuuaauuugaaacuuaagaaaaugaauuuauucuguuau

SEQ ID NO: 374238 - RNA, 64 nt, Homo Sapiens
cuguauuaauaaauucaguguuuuuuacacaaagaaacuuaauguuauuacuguguacaaagau

SEQ ID NO: 374239 - RNA, 64 nt, Homo Sapiens
cuuuuguugcagauagucauauacggaaaaucagaaacuuaacugcaaaggcauaagaugcuug

SEQ ID NO: 374240 - RNA, 64 nt, Homo Sapiens
auauccauggcaagcuuuguugcugguuaaauggaaacuuaaaauuuguuaucucaaaccaguc

SEQ ID NO: 374241 - RNA, 64 nt, Homo Sapiens
auauucuguucacuugagugauauauugaaaugcaaacuuaaacauuuuuaagaaaacacccau

SEQ ID NO: 374242 - RNA, 64 nt, Homo Sapiens
auuguucauccauauauaagaaauuaucgaauuaaaacuuaauguaugucaauuauuuucaaau

SEQ ID NO: 374243 - RNA, 64 nt, Homo Sapiens
auuguugcuagauccaccucauuugcagauguccaaacuuaaauucaucuguucuuaaaaugcu

SEQ ID NO: 374244 - RNA, 64 nt, Homo Sapiens
uuuuaauacuguuuauuuuucauauguauuauauaaacuuaaccaaaacaccacuaauugugua

SEQ ID NO: 374245 - RNA, 64 nt, Homo Sapiens
acccuuucaaacuauuuauaacaauuugggugaaaaacuuaaguuaauaaccuuuuuguauauc

SEQ ID NO: 374246 - RNA, 64 nt, Homo Sapiens
acauaggcuaaggcuaagcucuuuguacuacugcaaacuuaaaaguuuuucaaaugugggaaac

SEQ ID NO: 374247 - RNA, 64 nt, Homo Sapiens
ugugcucccauucucgacccuguuguugaaauucaaacuuaaauagccugacuucuuguugggu

SEQ ID NO: 374248 - RNA, 64 nt, Homo Sapiens
augucccuuuaaacagacugcugccuucagcuaaaaacuuaauguucuuuauaccuuuguaugu

SEQ ID NO: 374249 - RNA, 64 nt, Homo Sapiens
acuuagguuauuuuugcuuccgaauuugaaugaaaaacuuaaugccauggauuuuuuucuuuug

SEQ ID NO: 374250 - RNA, 64 nt, Homo Sapiens
gcaucagaagccuauuguaaaaaaauuggcauuaaaacuuaaccuauauaauuauguuauugaa

SEQ ID NO: 374251 - RNA, 64 nt, Homo Sapiens
gauugcaagggccagaucugcaaccccccaucacaaacuuaaagagggacaaauuuaaaacaaa

SEQ ID NO: 374252 - RNA, 64 nt, Homo Sapiens
ggggugggaagauggaauacugaccuaauguauaaaacuuaaaacaauucuccaauccccucuc

SEQ ID NO: 374253 - RNA, 64 nt, Homo Sapiens
ggcuuuaaauagucauguacauacaaauaugaacaaacuuaaaaaaaaaauacaaacccuugga

SEQ ID NO: 374254 - RNA, 64 nt, Homo Sapiens
uaaaauugcugaauuuacccucauauucuuuaaaaaacuuaaagcauuaugaauguagagaaau

SEQ ID NO: 374255 - RNA, 64 nt, Homo Sapiens
aaaaaaauaaagacacuguugccaaugugacccaaaacuuaagaacauacuaauggcauauauu

SEQ ID NO: 374256 - RNA, 64 nt, Homo Sapiens
agcccccguuuacauguaggaagcuugcuuugaaaaacuuaaaaccuauagcuucccuuccgga

SEQ ID NO: 374257 - RNA, 64 nt, Homo Sapiens
aaacaaacacaaaaagaugacuuguuuugucucaaaacuuaaaaaauuuuaaaaaugugacuuu

SEQ ID NO: 374258 - RNA, 64 nt, Homo Sapiens
acaauuuuggguucccaacuuaucuuacaagugaaaacuuaaauuguaaaacauguugaaauuu

SEQ ID NO: 374259 - RNA, 64 nt, Homo Sapiens
guuuagaguauuaucuuuuaauuaaguguagucuaaacuuaacuuucuguaaaggcacuuugug

SEQ ID NO: 374260 - RNA, 64 nt, Homo Sapiens
auucaauucacucuuggcauuucuaggaacagauaaacuuaaguccauugugguguucauaguc

SEQ ID NO: 374261 - RNA, 64 nt, Homo Sapiens
guuuacuauuucuuauuuggcugcuuucuggguaaaacuuaaaaaggaguggaucggaauacuu

SEQ ID NO: 374262 - RNA, 64 nt, Homo Sapiens
cuguaccuguuaaagggggugcuuuucgaucuaaaaacuuaauuuuauaaaauugacuuauuuu

SEQ ID NO: 374263 - RNA, 64 nt, Homo Sapiens
aaaugcugcuggguucauucauucauuccauaagaaacuuaauaccagcaaaugcauuaaaucc

SEQ ID NO: 374264 - RNA, 64 nt, Homo Sapiens
aagcaagcguguauuuuccucuuaaaaugaauuuaaacuuaagcuuuaaauuuaauauagcaaa

SEQ ID NO: 374265 - RNA, 64 nt, Homo Sapiens
ugaauuuaaacuuaagcaagaaauuuaauauagcaaacuuaaaauugauauuuuuuuaauuuuu

SEQ ID NO: 374266 - RNA, 64 nt, Homo Sapiens
uguauauuuugaaaaauaaacgguugugaaauaaaaacuuaaauggaauaaauauacaaaacua

SEQ ID NO: 374267 - RNA, 64 nt, Homo Sapiens
aacucgccaaguguaaaggcaccauuacuacuugaaacuuaaaagguuccuuucuuacccacaa

SEQ ID NO: 374268 - RNA, 64 nt, Homo Sapiens
gccuacacuuaggacuuuugccgaaauuucccauaaacuuaaguuuugcuaugauccucuaaca

SEQ ID NO: 374269 - RNA, 64 nt, Homo Sapiens
ucauucagaaaguugccacuaguacuaguagcaaaaacuuaaauaaguuuucaucaguagcuua

SEQ ID NO: 374270 - RNA, 64 nt, Homo Sapiens
uggacacagcugacuggaccaaaaaaaaaaaaaaaaacuuaagaacagagugagacuccaucuc

SEQ ID NO: 374271 - RNA, 64 nt, Homo Sapiens
ugggccaggugcgguggcucgaacuauuuauuaaaaacuuaagaaccagccugggcagcagcaa

SEQ ID NO: 374272 - RNA, 64 nt, Homo Sapiens
cagagagcauuuuacuacugagcugcaaagggaaaaacuuaaaauggauaugaaaagugaagaa

SEQ ID NO: 374273 - RNA, 64 nt, Homo Sapiens
agccauggccccagacuugucgcacggaugcagaaaacuuaauggaggaggcugaggucagaau

SEQ ID NO: 374274 - RNA, 64 nt, Homo Sapiens
uuauucuucauguagucugcugaucucagucuggaaacuuaacauuaugagccuuuucugcuca

SEQ ID NO: 374275 - RNA, 64 nt, Homo Sapiens
cagugccgguucagacucaccuauguggcaccuuaaacuuaaauauccaaagaugccuuuugaa

SEQ ID NO: 374276 - RNA, 64 nt, Homo Sapiens
uuugaauauuuuuuucccucgaaaacucauguugaaacuuaacuccuaauguagcaguacugag

SEQ ID NO: 374277 - RNA, 64 nt, Homo Sapiens
agggcacucaaacauaacugugcuugucucagucaaacuuaauugggaaaaggaggaguaagag

SEQ ID NO: 374278 - RNA, 64 nt, Homo Sapiens
aucuuuuaaaauguauuauuuauuuaauuuugugaaacuuaaucuuaauaugauuaauuuaugc

SEQ ID NO: 374279 - RNA, 64 nt, Homo Sapiens
auugaauugcccgaacuucuuacauugaaacaucaaacuuaaacccuuaggauuuuaaaaaaau

SEQ ID NO: 374280 - RNA, 64 nt, Homo Sapiens; identical to SEQ ID NO: 179946

SEQ ID NO: 374281 - RNA, 64 nt, Homo Sapiens; identical to SEQ ID NO: 179947

SEQ ID NO: 374282 - RNA, 64 nt, Homo Sapiens; identical to SEQ ID NO: 179948

SEQ ID NO: 374283 - RNA, 64 nt, Homo Sapiens; identical to SEQ ID NO: 179949

SEQ ID NO: 374284 - RNA, 64 nt, Homo Sapiens; identical to SEQ ID NO: 179950

SEQ ID NO: 374285 - RNA, 64 nt, Homo Sapiens; identical to SEQ ID NO: 179951

SEQ ID NO: 374286 - RNA, 64 nt, Homo Sapiens; identical to SEQ ID NO: 179952

SEQ ID NO: 374287 - RNA, 64 nt, Homo Sapiens; identical to SEQ ID NO: 179953

SEQ ID NO: 374288 - RNA, 64 nt, Homo Sapiens; identical to SEQ ID NO: 179954

SEQ ID NO: 374289 - RNA, 64 nt, Homo Sapiens; identical to SEQ ID NO: 179955

SEQ ID NO: 374290 - RNA, 64 nt, Homo Sapiens; identical to SEQ ID NO: 179956

SEQ ID NO: 374291 - RNA, 64 nt, Homo Sapiens; identical to SEQ ID NO: 179957

SEQ ID NO: 374292 - RNA, 64 nt, Homo Sapiens; identical to SEQ ID NO: 179958

SEQ ID NO: 374293 - RNA, 64 nt, Homo Sapiens; identical to SEQ ID NO: 179959

SEQ ID NO: 374294 - RNA, 64 nt, Homo Sapiens; identical to SEQ ID NO: 179960

SEQ ID NO: 374295 - RNA, 64 nt, Homo Sapiens; identical to SEQ ID NO: 179961

SEQ ID NO: 374296 - RNA, 64 nt, Homo Sapiens; identical to SEQ ID NO: 179962

SEQ ID NO: 374297 - RNA, 64 nt, Homo Sapiens; identical to SEQ ID NO: 179963

SEQ ID NO: 374298 - RNA, 64 nt, Homo Sapiens; identical to SEQ ID NO: 179964

SEQ ID NO: 374299 - RNA, 64 nt, Homo Sapiens; identical to SEQ ID NO: 179965

SEQ ID NO: 374300 - RNA, 64 nt, Homo Sapiens; identical to SEQ ID NO: 179966

SEQ ID NO: 374301 - RNA, 64 nt, Homo Sapiens; identical to SEQ ID NO: 179967

SEQ ID NO: 374302 - RNA, 64 nt, Homo Sapiens; identical to SEQ ID NO: 179968

SEQ ID NO: 374303 - RNA, 64 nt, Homo Sapiens; identical to SEQ ID NO: 179969

SEQ ID NO: 374304 - RNA, 64 nt, Homo Sapiens; identical to SEQ ID NO: 179970

SEQ ID NO: 374305 - RNA, 64 nt, Homo Sapiens; identical to SEQ ID NO: 179971

SEQ ID NO: 374306 - RNA, 64 nt, Homo Sapiens; identical to SEQ ID NO: 179972

SEQ ID NO: 374307 - RNA, 64 nt, Homo Sapiens; identical to SEQ ID NO: 179973

SEQ ID NO: 374308 - RNA, 64 nt, Homo Sapiens; identical to SEQ ID NO: 179974

SEQ ID NO: 374309 - RNA, 64 nt, Homo Sapiens; identical to SEQ ID NO: 179975

SEQ ID NO: 374310 - RNA, 64 nt, Homo Sapiens; identical to SEQ ID NO: 179976

SEQ ID NO: 374311 - RNA, 64 nt, Homo Sapiens; identical to SEQ ID NO: 179977

SEQ ID NO: 374312 - RNA, 64 nt, Homo Sapiens; identical to SEQ ID NO: 179978

SEQ ID NO: 374313 - RNA, 64 nt, Homo Sapiens; identical to SEQ ID NO: 179979

SEQ ID NO: 374314 - RNA, 64 nt, Homo Sapiens; identical to SEQ ID NO: 179980

SEQ ID NO: 374315 - RNA, 64 nt, Homo Sapiens; identical to SEQ ID NO: 179981

SEQ ID NO: 374316 - RNA, 64 nt, Homo Sapiens; identical to SEQ ID NO: 179982

SEQ ID NO: 374317 - RNA, 64 nt, Homo Sapiens; identical to SEQ ID NO: 179983

SEQ ID NO: 374318 - RNA, 64 nt, Homo Sapiens; identical to SEQ ID NO: 179984

SEQ ID NO: 374319 - RNA, 64 nt, Homo Sapiens; identical to SEQ ID NO: 179985

SEQ ID NO: 374320 - RNA, 64 nt, Homo Sapiens; identical to SEQ ID NO: 179986

SEQ ID NO: 374321 - RNA, 64 nt, Homo Sapiens; identical to SEQ ID NO: 179987

SEQ ID NO: 374322 - RNA, 64 nt, Homo Sapiens; identical to SEQ ID NO: 179988

SEQ ID NO: 374323 - RNA, 64 nt, Homo Sapiens; identical to SEQ ID NO: 179989

SEQ ID NO: 374324 - RNA, 64 nt, Homo Sapiens; identical to SEQ ID NO: 179990

SEQ ID NO: 374325 - RNA, 64 nt, Homo Sapiens; identical to SEQ ID NO: 179991

SEQ ID NO: 374326 - RNA, 64 nt, Homo Sapiens; identical to SEQ ID NO: 179992

SEQ ID NO: 374327 - RNA, 64 nt, Homo Sapiens; identical to SEQ ID NO: 179993

SEQ ID NO: 374328 - RNA, 64 nt, Homo Sapiens; identical to SEQ ID NO: 179994

SEQ ID NO: 374329 - RNA, 64 nt, Homo Sapiens; identical to SEQ ID NO: 179995

SEQ ID NO: 374330 - RNA, 64 nt, Homo Sapiens; identical to SEQ ID NO: 179996

SEQ ID NO: 374331 - RNA, 64 nt, Homo Sapiens; identical to SEQ ID NO: 179997

SEQ ID NO: 374332 - RNA, 64 nt, Homo Sapiens; identical to SEQ ID NO: 179998

SEQ ID NO: 374333 - RNA, 64 nt, Homo Sapiens; identical to SEQ ID NO: 179999

SEQ ID NO: 374334 - RNA, 64 nt, Homo Sapiens; identical to SEQ ID NO: 180000

SEQ ID NO: 374335 - RNA, 64 nt, Homo Sapiens; identical to SEQ ID NO: 180001

SEQ ID NO: 374336 - RNA, 64 nt, Homo Sapiens; identical to SEQ ID NO: 180002

SEQ ID NO: 374337 - RNA, 64 nt, Homo Sapiens; identical to SEQ ID NO: 180003

SEQ ID NO: 374338 - RNA, 64 nt, Homo Sapiens; identical to SEQ ID NO: 180004

SEQ ID NO: 374339 - RNA, 64 nt, Homo Sapiens; identical to SEQ ID NO: 180005

SEQ ID NO: 374340 - RNA, 64 nt, Homo Sapiens; identical to SEQ ID NO: 180006

SEQ ID NO: 374341 - RNA, 64 nt, Homo Sapiens; identical to SEQ ID NO: 180007

SEQ ID NO: 374342 - RNA, 64 nt, Homo Sapiens; identical to SEQ ID NO: 180008

SEQ ID NO: 374343 - RNA, 64 nt, Homo Sapiens; identical to SEQ ID NO: 180009

SEQ ID NO: 374344 - RNA, 64 nt, Homo Sapiens; identical to SEQ ID NO: 180010

SEQ ID NO: 374345 - RNA, 64 nt, Homo Sapiens; identical to SEQ ID NO: 180011

SEQ ID NO: 374346 - RNA, 64 nt, Homo Sapiens; identical to SEQ ID NO: 180012

SEQ ID NO: 374347 - RNA, 64 nt, Homo Sapiens; identical to SEQ ID NO: 180013

SEQ ID NO: 374348 - RNA, 64 nt, Homo Sapiens; identical to SEQ ID NO: 180014

SEQ ID NO: 374349 - RNA, 64 nt, Homo Sapiens; identical to SEQ ID NO: 180015

SEQ ID NO: 374350 - RNA, 64 nt, Homo Sapiens; identical to SEQ ID NO: 180016

SEQ ID NO: 374351 - RNA, 64 nt, Homo Sapiens; identical to SEQ ID NO: 180017

SEQ ID NO: 374352 - RNA, 64 nt, Homo Sapiens; identical to SEQ ID NO: 180018

SEQ ID NO: 374353 - RNA, 64 nt, Homo Sapiens; identical to SEQ ID NO: 180019

SEQ ID NO: 374354 - RNA, 64 nt, Homo Sapiens; identical to SEQ ID NO: 180020

SEQ ID NO: 374355 - RNA, 64 nt, Homo Sapiens; identical to SEQ ID NO: 180021

SEQ ID NO: 374356 - RNA, 64 nt, Homo Sapiens; identical to SEQ ID NO: 180022

SEQ ID NO: 374357 - RNA, 64 nt, Homo Sapiens; identical to SEQ ID NO: 180023

SEQ ID NO: 374358 - RNA, 64 nt, Homo Sapiens; identical to SEQ ID NO: 180024

SEQ ID NO: 374359 - RNA, 64 nt, Homo Sapiens; identical to SEQ ID NO: 180025

SEQ ID NO: 374360 - RNA, 64 nt, Homo Sapiens; identical to SEQ ID NO: 180026

SEQ ID NO: 374361 - RNA, 64 nt, Homo Sapiens; identical to SEQ ID NO: 180027

SEQ ID NO: 374362 - RNA, 64 nt, Homo Sapiens; identical to SEQ ID NO: 180028

SEQ ID NO: 374363 - RNA, 64 nt, Homo Sapiens; identical to SEQ ID NO: 180029

SEQ ID NO: 374364 - RNA, 64 nt, Homo Sapiens; identical to SEQ ID NO: 180030

SEQ ID NO: 374365 - RNA, 64 nt, Homo Sapiens; identical to SEQ ID NO: 180031

SEQ ID NO: 374366 - RNA, 64 nt, Homo Sapiens; identical to SEQ ID NO: 180032

SEQ ID NO: 374367 - RNA, 64 nt, Homo Sapiens; identical to SEQ ID NO: 180033

SEQ ID NO: 374368 - RNA, 64 nt, Homo Sapiens; identical to SEQ ID NO: 180034

SEQ ID NO: 374369 - RNA, 64 nt, Homo Sapiens; identical to SEQ ID NO: 180035

SEQ ID NO: 374370 - RNA, 64 nt, Homo Sapiens; identical to SEQ ID NO: 180036

SEQ ID NO: 374371 - RNA, 64 nt, Homo Sapiens; identical to SEQ ID NO: 180037

SEQ ID NO: 374372 - RNA, 64 nt, Homo Sapiens; identical to SEQ ID NO: 180038

SEQ ID NO: 374373 - RNA, 64 nt, Homo Sapiens; identical to SEQ ID NO: 180039

SEQ ID NO: 374374 - RNA, 64 nt, Homo Sapiens; identical to SEQ ID NO: 180040

SEQ ID NO: 374375 - RNA, 64 nt, Homo Sapiens; identical to SEQ ID NO: 180041

SEQ ID NO: 374376 - RNA, 64 nt, Homo Sapiens; identical to SEQ ID NO: 180042

SEQ ID NO: 374377 - RNA, 64 nt, Homo Sapiens; identical to SEQ ID NO: 180043

SEQ ID NO: 374378 - RNA, 64 nt, Homo Sapiens; identical to SEQ ID NO: 180044

SEQ ID NO: 374379 - RNA, 64 nt, Homo Sapiens; identical to SEQ ID NO: 180045

SEQ ID NO: 374380 - RNA, 64 nt, Homo Sapiens; identical to SEQ ID NO: 180046

SEQ ID NO: 374381 - RNA, 64 nt, Homo Sapiens; identical to SEQ ID NO: 180047

SEQ ID NO: 374382 - RNA, 64 nt, Homo Sapiens; identical to SEQ ID NO: 180048

SEQ ID NO: 374383 - RNA, 64 nt, Homo Sapiens; identical to SEQ ID NO: 180049

SEQ ID NO: 374384 - RNA, 64 nt, Homo Sapiens; identical to SEQ ID NO: 180050

SEQ ID NO: 374385 - RNA, 64 nt, Homo Sapiens; identical to SEQ ID NO: 180051

SEQ ID NO: 374386 - RNA, 64 nt, Homo Sapiens; identical to SEQ ID NO: 180052

SEQ ID NO: 374387 - RNA, 64 nt, Homo Sapiens; identical to SEQ ID NO: 180053

SEQ ID NO: 374388 - RNA, 64 nt, Homo Sapiens; identical to SEQ ID NO: 180054

SEQ ID NO: 374389 - RNA, 64 nt, Homo Sapiens; identical to SEQ ID NO: 180055

SEQ ID NO: 374390 - RNA, 64 nt, Homo Sapiens; identical to SEQ ID NO: 180056

SEQ ID NO: 374391 - RNA, 64 nt, Homo Sapiens; identical to SEQ ID NO: 180057

SEQ ID NO: 374392 - RNA, 64 nt, Homo Sapiens; identical to SEQ ID NO: 180058

SEQ ID NO: 374393 - RNA, 64 nt, Homo Sapiens; identical to SEQ ID NO: 180059

SEQ ID NO: 374394 - RNA, 64 nt, Homo Sapiens; identical to SEQ ID NO: 180060

SEQ ID NO: 374395 - RNA, 64 nt, Homo Sapiens; identical to SEQ ID NO: 180061

SEQ ID NO: 374396 - RNA, 64 nt, Homo Sapiens; identical to SEQ ID NO: 180062

SEQ ID NO: 374397 - RNA, 64 nt, Homo Sapiens; identical to SEQ ID NO: 180063

SEQ ID NO: 374398 - RNA, 64 nt, Homo Sapiens; identical to SEQ ID NO: 180064

SEQ ID NO: 374399 - RNA, 64 nt, Homo Sapiens; identical to SEQ ID NO: 180065

SEQ ID NO: 374400 - RNA, 64 nt, Homo Sapiens; identical to SEQ ID NO: 180066

SEQ ID NO: 374401 - RNA, 64 nt, Homo Sapiens; identical to SEQ ID NO: 180067

SEQ ID NO: 374402 - RNA, 64 nt, Homo Sapiens; identical to SEQ ID NO: 180068

SEQ ID NO: 374403 - RNA, 64 nt, Homo Sapiens; identical to SEQ ID NO: 180069

SEQ ID NO: 374404 - RNA, 64 nt, Homo Sapiens; identical to SEQ ID NO: 180070

SEQ ID NO: 374405 - RNA, 64 nt, Homo Sapiens; identical to SEQ ID NO: 180071

SEQ ID NO: 374406 - RNA, 64 nt, Homo Sapiens; identical to SEQ ID NO: 180072

SEQ ID NO: 374407 - RNA, 64 nt, Homo Sapiens; identical to SEQ ID NO: 180073

SEQ ID NO: 374408 - RNA, 64 nt, Homo Sapiens; identical to SEQ ID NO: 180074

SEQ ID NO: 374409 - RNA, 64 nt, Homo Sapiens; identical to SEQ ID NO: 180075

SEQ ID NO: 374410 - RNA, 64 nt, Homo Sapiens; identical to SEQ ID NO: 180076

SEQ ID NO: 374411 - RNA, 64 nt, Homo Sapiens; identical to SEQ ID NO: 180077

SEQ ID NO: 374412 - RNA, 64 nt, Homo Sapiens; identical to SEQ ID NO: 180078

SEQ ID NO: 374413 - RNA, 64 nt, Homo Sapiens; identical to SEQ ID NO: 180079

SEQ ID NO: 374414 - RNA, 64 nt, Homo Sapiens; identical to SEQ ID NO: 180080

SEQ ID NO: 374415 - RNA, 64 nt, Homo Sapiens; identical to SEQ ID NO: 180081

SEQ ID NO: 374416 - RNA, 64 nt, Homo Sapiens; identical to SEQ ID NO: 180082

SEQ ID NO: 374417 - RNA, 64 nt, Homo Sapiens; identical to SEQ ID NO: 180083

SEQ ID NO: 374418 - RNA, 64 nt, Homo Sapiens; identical to SEQ ID NO: 180084

SEQ ID NO: 374419 - RNA, 64 nt, Homo Sapiens; identical to SEQ ID NO: 180085

SEQ ID NO: 374420 - RNA, 64 nt, Homo Sapiens; identical to SEQ ID NO: 180086

SEQ ID NO: 374421 - RNA, 64 nt, Homo Sapiens; identical to SEQ ID NO: 180087

SEQ ID NO: 374422 - RNA, 64 nt, Homo Sapiens; identical to SEQ ID NO: 180088

SEQ ID NO: 374423 - RNA, 64 nt, Homo Sapiens; identical to SEQ ID NO: 180089

SEQ ID NO: 374424 - RNA, 64 nt, Homo Sapiens; identical to SEQ ID NO: 180090

SEQ ID NO: 374425 - RNA, 64 nt, Homo Sapiens; identical to SEQ ID NO: 180091

SEQ ID NO: 374426 - RNA, 64 nt, Homo Sapiens; identical to SEQ ID NO: 180092

SEQ ID NO: 374427 - RNA, 64 nt, Homo Sapiens; identical to SEQ ID NO: 180093

SEQ ID NO: 374428 - RNA, 64 nt, Homo Sapiens; identical to SEQ ID NO: 180094

SEQ ID NO: 374429 - RNA, 64 nt, Homo Sapiens; identical to SEQ ID NO: 180095

SEQ ID NO: 374430 - RNA, 64 nt, Homo Sapiens; identical to SEQ ID NO: 180096

SEQ ID NO: 374431 - RNA, 64 nt, Homo Sapiens; identical to SEQ ID NO: 180097

SEQ ID NO: 374432 - RNA, 64 nt, Homo Sapiens; identical to SEQ ID NO: 180098

SEQ ID NO: 374433 - RNA, 64 nt, Homo Sapiens; identical to SEQ ID NO: 180099

SEQ ID NO: 374434 - RNA, 64 nt, Homo Sapiens; identical to SEQ ID NO: 180100

SEQ ID NO: 374435 - RNA, 64 nt, Homo Sapiens; identical to SEQ ID NO: 180101

SEQ ID NO: 374436 - RNA, 64 nt, Homo Sapiens; identical to SEQ ID NO: 180102

SEQ ID NO: 374437 - RNA, 64 nt, Homo Sapiens; identical to SEQ ID NO: 180103

SEQ ID NO: 374438 - RNA, 64 nt, Homo Sapiens; identical to SEQ ID NO: 180104

SEQ ID NO: 374439 - RNA, 64 nt, Homo Sapiens; identical to SEQ ID NO: 180105

SEQ ID NO: 374440 - RNA, 64 nt, Homo Sapiens; identical to SEQ ID NO: 180106

SEQ ID NO: 374441 - RNA, 64 nt, Homo Sapiens; identical to SEQ ID NO: 180107

SEQ ID NO: 374442 - RNA, 64 nt, Homo Sapiens; identical to SEQ ID NO: 180108

SEQ ID NO: 374443 - RNA, 64 nt, Homo Sapiens; identical to SEQ ID NO: 180109

SEQ ID NO: 374444 - RNA, 64 nt, Homo Sapiens; identical to SEQ ID NO: 180110

SEQ ID NO: 374445 - RNA, 64 nt, Homo Sapiens; identical to SEQ ID NO: 180111

SEQ ID NO: 374446 - RNA, 64 nt, Homo Sapiens; identical to SEQ ID NO: 180112

SEQ ID NO: 374447 - RNA, 64 nt, Homo Sapiens; identical to SEQ ID NO: 180113

SEQ ID NO: 374448 - RNA, 64 nt, Homo Sapiens; identical to SEQ ID NO: 180114

SEQ ID NO: 374449 - RNA, 64 nt, Homo Sapiens; identical to SEQ ID NO: 180115

SEQ ID NO: 374450 - RNA, 64 nt, Homo Sapiens; identical to SEQ ID NO: 180116

SEQ ID NO: 374451 - RNA, 64 nt, Homo Sapiens; identical to SEQ ID NO: 180117

SEQ ID NO: 374452 - RNA, 64 nt, Homo Sapiens; identical to SEQ ID NO: 180118

SEQ ID NO: 374453 - RNA, 64 nt, Homo Sapiens; identical to SEQ ID NO: 180119

SEQ ID NO: 374454 - RNA, 64 nt, Homo Sapiens; identical to SEQ ID NO: 180120

SEQ ID NO: 374455 - RNA, 64 nt, Homo Sapiens; identical to SEQ ID NO: 180121

SEQ ID NO: 374456 - RNA, 64 nt, Homo Sapiens; identical to SEQ ID NO: 180122

SEQ ID NO: 374457 - RNA, 64 nt, Homo Sapiens; identical to SEQ ID NO: 180123

SEQ ID NO: 374458 - RNA, 64 nt, Homo Sapiens; identical to SEQ ID NO: 180124

SEQ ID NO: 374459 - RNA, 64 nt, Homo Sapiens; identical to SEQ ID NO: 180125

SEQ ID NO: 374460 - RNA, 64 nt, Homo Sapiens; identical to SEQ ID NO: 180126

SEQ ID NO: 374461 - RNA, 64 nt, Homo Sapiens; identical to SEQ ID NO: 180127

SEQ ID NO: 374462 - RNA, 64 nt, Homo Sapiens; identical to SEQ ID NO: 180128

SEQ ID NO: 374463 - RNA, 64 nt, Homo Sapiens; identical to SEQ ID NO: 180129

SEQ ID NO: 374464 - RNA, 64 nt, Homo Sapiens; identical to SEQ ID NO: 180130

SEQ ID NO: 374465 - RNA, 64 nt, Homo Sapiens; identical to SEQ ID NO: 180131

SEQ ID NO: 374466 - RNA, 64 nt, Homo Sapiens; identical to SEQ ID NO: 180132

SEQ ID NO: 374467 - RNA, 64 nt, Homo Sapiens; identical to SEQ ID NO: 180133

SEQ ID NO: 374468 - RNA, 64 nt, Homo Sapiens; identical to SEQ ID NO: 180134

SEQ ID NO: 374469 - RNA, 64 nt, Homo Sapiens; identical to SEQ ID NO: 180135

SEQ ID NO: 374470 - RNA, 64 nt, Homo Sapiens; identical to SEQ ID NO: 180136

SEQ ID NO: 374471 - RNA, 64 nt, Homo Sapiens; identical to SEQ ID NO: 180137

SEQ ID NO: 374472 - RNA, 64 nt, Homo Sapiens; identical to SEQ ID NO: 180138

SEQ ID NO: 374473 - RNA, 64 nt, Homo Sapiens; identical to SEQ ID NO: 180139

SEQ ID NO: 374474 - RNA, 64 nt, Homo Sapiens; identical to SEQ ID NO: 180140

SEQ ID NO: 374475 - RNA, 64 nt, Homo Sapiens; identical to SEQ ID NO: 180141

SEQ ID NO: 374476 - RNA, 64 nt, Homo Sapiens; identical to SEQ ID NO: 180142

SEQ ID NO: 374477 - RNA, 64 nt, Homo Sapiens; identical to SEQ ID NO: 180143

SEQ ID NO: 374478 - RNA, 64 nt, Homo Sapiens; identical to SEQ ID NO: 180144

SEQ ID NO: 374479 - RNA, 64 nt, Homo Sapiens; identical to SEQ ID NO: 180145

SEQ ID NO: 374480 - RNA, 64 nt, Homo Sapiens; identical to SEQ ID NO: 180146

SEQ ID NO: 374481 - RNA, 64 nt, Homo Sapiens; identical to SEQ ID NO: 180147

SEQ ID NO: 374482 - RNA, 64 nt, Homo Sapiens; identical to SEQ ID NO: 180148

SEQ ID NO: 374483 - RNA, 64 nt, Homo Sapiens; identical to SEQ ID NO: 180149

SEQ ID NO: 374484 - RNA, 64 nt, Homo Sapiens; identical to SEQ ID NO: 180150

SEQ ID NO: 374485 - RNA, 64 nt, Homo Sapiens; identical to SEQ ID NO: 180151

SEQ ID NO: 374486 - RNA, 64 nt, Homo Sapiens; identical to SEQ ID NO: 180152

SEQ ID NO: 374487 - RNA, 64 nt, Homo Sapiens; identical to SEQ ID NO: 180153

SEQ ID NO: 374488 - RNA, 64 nt, Homo Sapiens; identical to SEQ ID NO: 180154

SEQ ID NO: 374489 - RNA, 64 nt, Homo Sapiens; identical to SEQ ID NO: 180155

SEQ ID NO: 374490 - RNA, 64 nt, Homo Sapiens; identical to SEQ ID NO: 180156

SEQ ID NO: 374491 - RNA, 64 nt, Homo Sapiens; identical to SEQ ID NO: 180157

SEQ ID NO: 374492 - RNA, 64 nt, Homo Sapiens; identical to SEQ ID NO: 180158

SEQ ID NO: 374493 - RNA, 64 nt, Homo Sapiens; identical to SEQ ID NO: 180159

SEQ ID NO: 374494 - RNA, 64 nt, Homo Sapiens; identical to SEQ ID NO: 180160

SEQ ID NO: 374495 - RNA, 64 nt, Homo Sapiens; identical to SEQ ID NO: 180161

SEQ ID NO: 374496 - RNA, 64 nt, Homo Sapiens; identical to SEQ ID NO: 180162

SEQ ID NO: 374497 - RNA, 64 nt, Homo Sapiens; identical to SEQ ID NO: 180163

SEQ ID NO: 374498 - RNA, 64 nt, Homo Sapiens; identical to SEQ ID NO: 180164

SEQ ID NO: 374499 - RNA, 64 nt, Homo Sapiens; identical to SEQ ID NO: 180165

SEQ ID NO: 374500 - RNA, 64 nt, Homo Sapiens; identical to SEQ ID NO: 180166

SEQ ID NO: 374501 - RNA, 64 nt, Homo Sapiens; identical to SEQ ID NO: 180167

SEQ ID NO: 374502 - RNA, 64 nt, Homo Sapiens; identical to SEQ ID NO: 180168

SEQ ID NO: 374503 - RNA, 64 nt, Homo Sapiens; identical to SEQ ID NO: 180169

SEQ ID NO: 374504 - RNA, 64 nt, Homo Sapiens; identical to SEQ ID NO: 180170

SEQ ID NO: 374505 - RNA, 64 nt, Homo Sapiens; identical to SEQ ID NO: 180171

SEQ ID NO: 374506 - RNA, 64 nt, Homo Sapiens; identical to SEQ ID NO: 180172

SEQ ID NO: 374507 - RNA, 64 nt, Homo Sapiens; identical to SEQ ID NO: 180173

SEQ ID NO: 374508 - RNA, 64 nt, Homo Sapiens; identical to SEQ ID NO: 180174

SEQ ID NO: 374509 - RNA, 64 nt, Homo Sapiens; identical to SEQ ID NO: 180175

SEQ ID NO: 374510 - RNA, 64 nt, Homo Sapiens; identical to SEQ ID NO: 180176

SEQ ID NO: 374511 - RNA, 64 nt, Homo Sapiens; identical to SEQ ID NO: 180177

SEQ ID NO: 374512 - RNA, 64 nt, Homo Sapiens; identical to SEQ ID NO: 180178

SEQ ID NO: 374513 - RNA, 64 nt, Homo Sapiens; identical to SEQ ID NO: 180179

SEQ ID NO: 374514 - RNA, 64 nt, Homo Sapiens; identical to SEQ ID NO: 180180

SEQ ID NO: 374515 - RNA, 64 nt, Homo Sapiens; identical to SEQ ID NO: 180181

SEQ ID NO: 374516 - RNA, 64 nt, Homo Sapiens; identical to SEQ ID NO: 180182

SEQ ID NO: 374517 - RNA, 64 nt, Homo Sapiens; identical to SEQ ID NO: 180183

SEQ ID NO: 374518 - RNA, 64 nt, Homo Sapiens; identical to SEQ ID NO: 180184

SEQ ID NO: 374519 - RNA, 64 nt, Homo Sapiens; identical to SEQ ID NO: 180185

SEQ ID NO: 374520 - RNA, 64 nt, Homo Sapiens; identical to SEQ ID NO: 180186

SEQ ID NO: 374521 - RNA, 64 nt, Homo Sapiens; identical to SEQ ID NO: 180187

SEQ ID NO: 374522 - RNA, 64 nt, Homo Sapiens; identical to SEQ ID NO: 180188

SEQ ID NO: 374523 - RNA, 64 nt, Homo Sapiens; identical to SEQ ID NO: 180189

SEQ ID NO: 374524 - RNA, 64 nt, Homo Sapiens; identical to SEQ ID NO: 180190

SEQ ID NO: 374525 - RNA, 64 nt, Homo Sapiens; identical to SEQ ID NO: 180191

SEQ ID NO: 374526 - RNA, 64 nt, Homo Sapiens; identical to SEQ ID NO: 180192

SEQ ID NO: 374527 - RNA, 64 nt, Homo Sapiens; identical to SEQ ID NO: 180193

SEQ ID NO: 374528 - RNA, 64 nt, Homo Sapiens; identical to SEQ ID NO: 180194

SEQ ID NO: 374529 - RNA, 64 nt, Homo Sapiens; identical to SEQ ID NO: 180195

SEQ ID NO: 374530 - RNA, 64 nt, Homo Sapiens; identical to SEQ ID NO: 180196

SEQ ID NO: 374531 - RNA, 64 nt, Homo Sapiens; identical to SEQ ID NO: 180197

SEQ ID NO: 374532 - RNA, 64 nt, Homo Sapiens; identical to SEQ ID NO: 180198

SEQ ID NO: 374533 - RNA, 64 nt, Homo Sapiens; identical to SEQ ID NO: 180199

SEQ ID NO: 374534 - RNA, 64 nt, Homo Sapiens; identical to SEQ ID NO: 180200

SEQ ID NO: 374535 - RNA, 64 nt, Homo Sapiens; identical to SEQ ID NO: 180201

SEQ ID NO: 374536 - RNA, 64 nt, Homo Sapiens; identical to SEQ ID NO: 180202

SEQ ID NO: 374537 - RNA, 64 nt, Homo Sapiens; identical to SEQ ID NO: 180203

SEQ ID NO: 374538 - RNA, 64 nt, Homo Sapiens; identical to SEQ ID NO: 180204

SEQ ID NO: 374539 - RNA, 64 nt, Homo Sapiens; identical to SEQ ID NO: 180205

SEQ ID NO: 374540 - RNA, 64 nt, Homo Sapiens; identical to SEQ ID NO: 180206

SEQ ID NO: 374541 - RNA, 64 nt, Homo Sapiens; identical to SEQ ID NO: 180207

SEQ ID NO: 374542 - RNA, 64 nt, Homo Sapiens; identical to SEQ ID NO: 180208

SEQ ID NO: 374543 - RNA, 64 nt, Homo Sapiens; identical to SEQ ID NO: 180209

SEQ ID NO: 374544 - RNA, 64 nt, Homo Sapiens; identical to SEQ ID NO: 180210

SEQ ID NO: 374545 - RNA, 64 nt, Homo Sapiens; identical to SEQ ID NO: 180211

SEQ ID NO: 374546 - RNA, 64 nt, Homo Sapiens; identical to SEQ ID NO: 180212

SEQ ID NO: 374547 - RNA, 64 nt, Homo Sapiens; identical to SEQ ID NO: 180213

SEQ ID NO: 374548 - RNA, 64 nt, Homo Sapiens; identical to SEQ ID NO: 180214

SEQ ID NO: 374549 - RNA, 64 nt, Homo Sapiens; identical to SEQ ID NO: 180215

SEQ ID NO: 374550 - RNA, 64 nt, Homo Sapiens; identical to SEQ ID NO: 180216

SEQ ID NO: 374551 - RNA, 64 nt, Homo Sapiens; identical to SEQ ID NO: 180217

SEQ ID NO: 374552 - RNA, 64 nt, Homo Sapiens; identical to SEQ ID NO: 180218

SEQ ID NO: 374553 - RNA, 64 nt, Homo Sapiens; identical to SEQ ID NO: 180219

SEQ ID NO: 374554 - RNA, 64 nt, Homo Sapiens; identical to SEQ ID NO: 180220

SEQ ID NO: 374555 - RNA, 64 nt, Homo Sapiens; identical to SEQ ID NO: 180221

SEQ ID NO: 374556 - RNA, 64 nt, Homo Sapiens; identical to SEQ ID NO: 180222

SEQ ID NO: 374557 - RNA, 64 nt, Homo Sapiens; identical to SEQ ID NO: 180223

SEQ ID NO: 374558 - RNA, 64 nt, Homo Sapiens; identical to SEQ ID NO: 180224

SEQ ID NO: 374559 - RNA, 64 nt, Homo Sapiens; identical to SEQ ID NO: 180225

SEQ ID NO: 374560 - RNA, 64 nt, Homo Sapiens; identical to SEQ ID NO: 180226

SEQ ID NO: 374561 - RNA, 64 nt, Homo Sapiens; identical to SEQ ID NO: 180227

SEQ ID NO: 374562 - RNA, 64 nt, Homo Sapiens; identical to SEQ ID NO: 180228

SEQ ID NO: 374563 - RNA, 64 nt, Homo Sapiens; identical to SEQ ID NO: 180229

SEQ ID NO: 374564 - RNA, 64 nt, Homo Sapiens; identical to SEQ ID NO: 180230

SEQ ID NO: 374565 - RNA, 64 nt, Homo Sapiens; identical to SEQ ID NO: 180231

SEQ ID NO: 374566 - RNA, 64 nt, Homo Sapiens; identical to SEQ ID NO: 180232

SEQ ID NO: 374567 - RNA, 64 nt, Homo Sapiens; identical to SEQ ID NO: 180233

SEQ ID NO: 374568 - RNA, 64 nt, Homo Sapiens; identical to SEQ ID NO: 180234

SEQ ID NO: 374569 - RNA, 64 nt, Homo Sapiens; identical to SEQ ID NO: 180235

SEQ ID NO: 374570 - RNA, 64 nt, Homo Sapiens; identical to SEQ ID NO: 180236

SEQ ID NO: 374571 - RNA, 64 nt, Homo Sapiens; identical to SEQ ID NO: 180237

SEQ ID NO: 374572 - RNA, 64 nt, Homo Sapiens; identical to SEQ ID NO: 180238

SEQ ID NO: 374573 - RNA, 64 nt, Homo Sapiens; identical to SEQ ID NO: 180239

SEQ ID NO: 374574 - RNA, 64 nt, Homo Sapiens; identical to SEQ ID NO: 180240

SEQ ID NO: 374575 - RNA, 64 nt, Homo Sapiens; identical to SEQ ID NO: 180241

SEQ ID NO: 374576 - RNA, 64 nt, Homo Sapiens; identical to SEQ ID NO: 180242

SEQ ID NO: 374577 - RNA, 64 nt, Homo Sapiens; identical to SEQ ID NO: 180243

SEQ ID NO: 374578 - RNA, 64 nt, Homo Sapiens; identical to SEQ ID NO: 180244

SEQ ID NO: 374579 - RNA, 64 nt, Homo Sapiens; identical to SEQ ID NO: 180245

SEQ ID NO: 374580 - RNA, 64 nt, Homo Sapiens; identical to SEQ ID NO: 180246

SEQ ID NO: 374581 - RNA, 64 nt, Homo Sapiens; identical to SEQ ID NO: 180247

SEQ ID NO: 374582 - RNA, 64 nt, Homo Sapiens; identical to SEQ ID NO: 180248

SEQ ID NO: 374583 - RNA, 64 nt, Homo Sapiens; identical to SEQ ID NO: 180249

SEQ ID NO: 374584 - RNA, 64 nt, Homo Sapiens; identical to SEQ ID NO: 180250

SEQ ID NO: 374585 - RNA, 64 nt, Homo Sapiens; identical to SEQ ID NO: 180251

SEQ ID NO: 374586 - RNA, 64 nt, Homo Sapiens; identical to SEQ ID NO: 180252

SEQ ID NO: 374587 - RNA, 64 nt, Homo Sapiens; identical to SEQ ID NO: 180253

SEQ ID NO: 374588 - RNA, 64 nt, Homo Sapiens; identical to SEQ ID NO: 180254

SEQ ID NO: 374589 - RNA, 64 nt, Homo Sapiens; identical to SEQ ID NO: 180255

SEQ ID NO: 374590 - RNA, 64 nt, Homo Sapiens; identical to SEQ ID NO: 180256

SEQ ID NO: 374591 - RNA, 64 nt, Homo Sapiens; identical to SEQ ID NO: 180257

SEQ ID NO: 374592 - RNA, 64 nt, Homo Sapiens; identical to SEQ ID NO: 180258

SEQ ID NO: 374593 - RNA, 64 nt, Homo Sapiens; identical to SEQ ID NO: 180259

SEQ ID NO: 374594 - RNA, 64 nt, Homo Sapiens; identical to SEQ ID NO: 180260

SEQ ID NO: 374595 - RNA, 64 nt, Homo Sapiens; identical to SEQ ID NO: 180261

SEQ ID NO: 374596 - RNA, 64 nt, Homo Sapiens; identical to SEQ ID NO: 180262

SEQ ID NO: 374597 - RNA, 64 nt, Homo Sapiens; identical to SEQ ID NO: 180263

SEQ ID NO: 374598 - RNA, 64 nt, Homo Sapiens; identical to SEQ ID NO: 180264

SEQ ID NO: 374599 - RNA, 64 nt, Homo Sapiens; identical to SEQ ID NO: 180265

SEQ ID NO: 374600 - RNA, 64 nt, Homo Sapiens; identical to SEQ ID NO: 180266

SEQ ID NO: 374601 - RNA, 64 nt, Homo Sapiens; identical to SEQ ID NO: 180267

SEQ ID NO: 374602 - RNA, 64 nt, Homo Sapiens; identical to SEQ ID NO: 180268

SEQ ID NO: 374603 - RNA, 64 nt, Homo Sapiens; identical to SEQ ID NO: 180269

SEQ ID NO: 374604 - RNA, 64 nt, Homo Sapiens; identical to SEQ ID NO: 180270

SEQ ID NO: 374605 - RNA, 64 nt, Homo Sapiens; identical to SEQ ID NO: 180271

SEQ ID NO: 374606 - RNA, 64 nt, Homo Sapiens; identical to SEQ ID NO: 180272

SEQ ID NO: 374607 - RNA, 64 nt, Homo Sapiens; identical to SEQ ID NO: 180273

SEQ ID NO: 374608 - RNA, 64 nt, Homo Sapiens; identical to SEQ ID NO: 180274

SEQ ID NO: 374609 - RNA, 64 nt, Homo Sapiens
cauguacuucgcuugaaggcagaacgcuguuaccucacuggauagaagaaagcuuuccaagccc

SEQ ID NO: 374610 - RNA, 64 nt, Homo Sapiens
aagaacagaauggagggcucugggaggaggcagcucacuggagagccuacauuccuuacacaag

SEQ ID NO: 374611 - RNA, 64 nt, Homo Sapiens
cccuagcuuuagacccugggugggcucugugcagucacuggagguugaagccaaguggggugcu

SEQ ID NO: 374612 - RNA, 64 nt, Homo Sapiens
gccaaguggggugcugggaggagggagagggaggucacuggaaaggggagagccugcuggcacc

SEQ ID NO: 374613 - RNA, 64 nt, Homo Sapiens
gauauuauucgacuccaucaaagucuuacaggacucacuggauagauggaaguggaagugccug

SEQ ID NO: 374614 - RNA, 64 nt, Homo Sapiens
uuauucaacuccuuccaguuaagucuugcaggacucacuggauggcuggagguaguagagccug

SEQ ID NO: 374615 - RNA, 64 nt, Homo Sapiens
gauguuauucgacuccuucaaagucuugcaggacucacuggauagcuggcugagaaagagccug

SEQ ID NO: 374616 - RNA, 64 nt, Homo Sapiens
gauguuauucaacuccuucaaagucuugcaggacucacuggauagcuggaugagaaagagccug

SEQ ID NO: 374617 - RNA, 64 nt, Homo Sapiens
aagacaaggacugaaagugcucugaacuugaaacucacuggagagcugaagggagcugccaugu

SEQ ID NO: 374618 - RNA, 64 nt, Homo Sapiens
auucaugugguccuuugaaaggguauucuagaaaucacuggaaagaggagaggaaagaaccagg

SEQ ID NO: 374619 - RNA, 64 nt, Homo Sapiens
uaauuuauucauugcagauaggaucugcagugcuucacuggaaaguuagcagacuggugugugu

SEQ ID NO: 374620 - RNA, 64 nt, Homo Sapiens
cagugaagugccauuuguugaaaacauuucagggucacuggaaaagcccaggccccacuuacgu

SEQ ID NO: 374621 - RNA, 64 nt, Homo Sapiens
agucuaauguagaauccaggagugcacagaaaagucacuggaugacacagcaagaggcaacauu

SEQ ID NO: 374622 - RNA, 64 nt, Homo Sapiens
caagaggcaacauuuuggaagcagagggcaacucucacuggaaaccaaaucuccuggcaccuug

SEQ ID NO: 374623 - RNA, 64 nt, Homo Sapiens
uuaaauuuuauguauuguuuacagucagaguaaaucacuggauuucuuuuguuuguuuugauuu

SEQ ID NO: 374624 - RNA, 64 nt, Homo Sapiens
aaugcuuaaaugugcuguaaaacuauuguagaugucacuggauuuuaccaaguaauauccuuuc

SEQ ID NO: 374625 - RNA, 64 nt, Homo Sapiens
uuggggccugcugcaaugggggccuauggaagccucacuggagugagccaaacccauucuccau

SEQ ID NO: 374626 - RNA, 64 nt, Homo Sapiens
aacugguuuaagcaaauagaucagcauguaagcgucacuggaaaaucuauagaaaccaagaaag

SEQ ID NO: 374627 - RNA, 64 nt, Homo Sapiens
gcgaagcuuagcguucauccguguaacccgcucaucacuggaugaagauucuccugugcuagau

SEQ ID NO: 374628 - RNA, 64 nt, Homo Sapiens
uauuccugauaauaauugaucaaauucauuuuuuucacuggaguuacauuaauguuaauucagc

SEQ ID NO: 374629 - RNA, 64 nt, Homo Sapiens
ccagauccccucacuccaccuccuggggcccccaucacuggaucugacaaccacaaugccugga

SEQ ID NO: 374630 - RNA, 64 nt, Homo Sapiens
cugcagccccacauccuaagccccaucccccaaaucacuggaucuccacaccccagcccuuaau

SEQ ID NO: 374631 - RNA, 64 nt, Homo Sapiens
ucuagcucagguuuucuuacguucuguaagagaaaugccugagucauucuacccugcaagccaa

SEQ ID NO: 374632 - RNA, 64 nt, Homo Sapiens
ggauuaucuucagcuuguugaaggccuaugggaaaugccugaugucucagugaacagaguugac

SEQ ID NO: 374633 - RNA, 64 nt, Homo Sapiens
cacuguuucaaauauaagcuugauagaccaaaagaugccugacauagagccaaauucugaaaau

SEQ ID NO: 374634 - RNA, 64 nt, Homo Sapiens
auaaaaaaucagugaaaagauuaagauguggcaaaugccugaccaccuacuguaaugcagaagc

SEQ ID NO: 374635 - RNA, 64 nt, Homo Sapiens
ucccauguccaaaccauccuauauaaagauaaauaugccugagcuuaaaaggggggccagggau

SEQ ID NO: 374636 - RNA, 64 nt, Homo Sapiens
aucacagaggacuugaucuauauagcaugauuugaugccugauaacuguuugaaaugcauaccu

SEQ ID NO: 374637 - RNA, 64 nt, Homo Sapiens
cccaagaugcuuuaagugcacaacauuacagggaaugccugagugccuggccaaagggauauuu

SEQ ID NO: 374638 - RNA, 64 nt, Homo Sapiens
uggccaaagggauauuugguuuggccaucucuggaugccugauugccaagcucaggaccaggca

SEQ ID NO: 374639 - RNA, 64 nt, Homo Sapiens
ugacagguggcuucaggccuaggaaggacaggggaugccugaccagcagaucaggaguagggac

SEQ ID NO: 374640 - RNA, 64 nt, Homo Sapiens
aggauagauuugaagugcaaccacaauuacuuccaugccugagccaaccagacagacuuucaca

SEQ ID NO: 374641 - RNA, 64 nt, Homo Sapiens
ggaacagucuguggauggacgggugaugcaggauaugccugacacccucaucuguaaaggugaa

SEQ ID NO: 374642 - RNA, 64 nt, Homo Sapiens
cugggaaggcucccugguaguguaggggaaaagaaugccugaccgccagcucaccccuuuuggg

SEQ ID NO: 374643 - RNA, 63 nt, Homo Sapiens
gacuaguugaucuggaugagcuucccaaaaaucagugucuagggucaguaauucucuuacauc

SEQ ID NO: 374644 - RNA, 63 nt, Homo Sapiens
gacugguugaucuagaugagcuucccaaaaaucagugucuaggucaguaauucucuaaaaauc

SEQ ID NO: 374645 - RNA, 64 nt, Homo Sapiens; identical to SEQ ID NO: 144364

SEQ ID NO: 374646 - RNA, 64 nt, Homo Sapiens; identical to SEQ ID NO: 144365

SEQ ID NO: 374647 - RNA, 64 nt, Homo Sapiens; identical to SEQ ID NO: 144366

SEQ ID NO: 374648 - RNA, 64 nt, Homo Sapiens; identical to SEQ ID NO: 144367

SEQ ID NO: 374649 - RNA, 64 nt, Homo Sapiens; identical to SEQ ID NO: 144368

SEQ ID NO: 374650 - RNA, 64 nt, Homo Sapiens; identical to SEQ ID NO: 144369

SEQ ID NO: 374651 - RNA, 64 nt, Homo Sapiens; identical to SEQ ID NO: 144370

SEQ ID NO: 374652 - RNA, 64 nt, Homo Sapiens; identical to SEQ ID NO: 144371

SEQ ID NO: 374653 - RNA, 64 nt, Homo Sapiens; identical to SEQ ID NO: 144372

SEQ ID NO: 374654 - RNA, 64 nt, Homo Sapiens; identical to SEQ ID NO: 144373

SEQ ID NO: 374655 - RNA, 64 nt, Homo Sapiens; identical to SEQ ID NO: 144374

SEQ ID NO: 374656 - RNA, 64 nt, Homo Sapiens; identical to SEQ ID NO: 144375

SEQ ID NO: 374657 - RNA, 64 nt, Homo Sapiens; identical to SEQ ID NO: 144376

SEQ ID NO: 374658 - RNA, 64 nt, Homo Sapiens; identical to SEQ ID NO: 144377

SEQ ID NO: 374659 - RNA, 64 nt, Homo Sapiens; identical to SEQ ID NO: 144378

SEQ ID NO: 374660 - RNA, 64 nt, Homo Sapiens; identical to SEQ ID NO: 144379

SEQ ID NO: 374661 - RNA, 64 nt, Homo Sapiens; identical to SEQ ID NO: 144380

SEQ ID NO: 374662 - RNA, 64 nt, Homo Sapiens; identical to SEQ ID NO: 144381

SEQ ID NO: 374663 - RNA, 64 nt, Homo Sapiens; identical to SEQ ID NO: 144382

SEQ ID NO: 374664 - RNA, 64 nt, Homo Sapiens; identical to SEQ ID NO: 144383

SEQ ID NO: 374665 - RNA, 64 nt, Homo Sapiens; identical to SEQ ID NO: 144384

SEQ ID NO: 374666 - RNA, 64 nt, Homo Sapiens; identical to SEQ ID NO: 144385

SEQ ID NO: 374667 - RNA, 64 nt, Homo Sapiens; identical to SEQ ID NO: 144386

SEQ ID NO: 374668 - RNA, 64 nt, Homo Sapiens; identical to SEQ ID NO: 144387

SEQ ID NO: 374669 - RNA, 64 nt, Homo Sapiens; identical to SEQ ID NO: 144388

SEQ ID NO: 374670 - RNA, 64 nt, Homo Sapiens; identical to SEQ ID NO: 144389

SEQ ID NO: 374671 - RNA, 64 nt, Homo Sapiens; identical to SEQ ID NO: 144390

SEQ ID NO: 374672 - RNA, 64 nt, Homo Sapiens; identical to SEQ ID NO: 144391

SEQ ID NO: 374673 - RNA, 64 nt, Homo Sapiens; identical to SEQ ID NO: 144392

SEQ ID NO: 374674 - RNA, 64 nt, Homo Sapiens; identical to SEQ ID NO: 144393

SEQ ID NO: 374675 - RNA, 64 nt, Homo Sapiens; identical to SEQ ID NO: 144394

SEQ ID NO: 374676 - RNA, 64 nt, Homo Sapiens; identical to SEQ ID NO: 144395

SEQ ID NO: 374677 - RNA, 64 nt, Homo Sapiens; identical to SEQ ID NO: 144396

SEQ ID NO: 374678 - RNA, 64 nt, Homo Sapiens; identical to SEQ ID NO: 144397

SEQ ID NO: 374679 - RNA, 64 nt, Homo Sapiens; identical to SEQ ID NO: 144398

SEQ ID NO: 374680 - RNA, 64 nt, Homo Sapiens; identical to SEQ ID NO: 144399

SEQ ID NO: 374681 - RNA, 64 nt, Homo Sapiens; identical to SEQ ID NO: 144400

SEQ ID NO: 374682 - RNA, 64 nt, Homo Sapiens
gcagaaacuauucaguuuuuuuauugcucugaguaacugacaaaggaaaacaacuguuacaguu

SEQ ID NO: 374683 - RNA, 64 nt, Homo Sapiens
auauuuuaaaaauauauaaaaacguacaucguaaaacugacaaaagggcuguggugaauggaug

SEQ ID NO: 374684 - RNA, 64 nt, Homo Sapiens
agaggcgucugcugucucauagaugacaaaccauaacugacaagcuaagaaggaaaagaagaag

SEQ ID NO: 374685 - RNA, 64 nt, Homo Sapiens
gucuaaaugagcacauguauguucugcuuugacaaacugacaaaauagauguauuacuuggaaa

SEQ ID NO: 374686 - RNA, 64 nt, Homo Sapiens
ccaaauuaauuggcuuuguguuccaauuaccuguaacugacagauaucauuauguuuuauuacu

SEQ ID NO: 374687 - RNA, 64 nt, Homo Sapiens
uaccuuuuaaaauuugcacagacuuuccuuacuuaacugacaguuuccaguuuaguuucuucug

SEQ ID NO: 374688 - RNA, 64 nt, Homo Sapiens
aaaaaaguaacuuaaaaacaauuuucauugguggaacugacacauuuaaaguacaagccaaaug

SEQ ID NO: 374689 - RNA, 64 nt, Homo Sapiens
ggcgggucugggcgucugcaccuggggccuagggaacugacacgugggaagcgcagugagccgg

SEQ ID NO: 374690 - RNA, 64 nt, Homo Sapiens
uaaaaugguuuaaauaccccacagcaaauagaguaacugacaaaccaccaaaaacugaaacccc

SEQ ID NO: 374691 - RNA, 64 nt, Homo Sapiens
ugugcagaccccaaccucccugacuuccuucaguaacugacaguguagcauuguucuugauuag

SEQ ID NO: 374692 - RNA, 64 nt, Homo Sapiens
auuuacccaaaaucacacagcucagaagcagcagaacugacauugggacccagguccauuggag

SEQ ID NO: 374693 - RNA, 64 nt, Homo Sapiens
aaucacugggacccgcaugguguuccuccaaagaauaggguaaaggagagcugggagggagccc

SEQ ID NO: 374694 - RNA, 64 nt, Homo Sapiens
cuuucuuuuucuguuuugaguuggugagugagugauaggguaacaugggccuucaggaugaccc

SEQ ID NO: 374695 - RNA, 64 nt, Homo Sapiens
agcauguguucuuuagggccgguagaaccaaaugauaggguagggaggacuuccaggcgcauag

SEQ ID NO: 374696 - RNA, 64 nt, Homo Sapiens
accaaaugauaggguaggagggacuuccaggcgcauaggguagaaugcagggacugggauucga

SEQ ID NO: 374697 - RNA, 64 nt, Homo Sapiens
gcuuugucuaaaguccucauagauuugcuuuguuauaggguaaaaauuugguuuaaagcuggac

SEQ ID NO: 374698 - RNA, 64 nt, Homo Sapiens
ucuucauauugcugugauuaucacaucauuuuuuauaggguagaacuuguauuaggguagccau

SEQ ID NO: 374699 - RNA, 64 nt, Homo Sapiens
aaucgguguugucacucacugucauucucuguuuaggcacuaaaacaucacaggucaaguugaa

SEQ ID NO: 374700 - RNA, 64 nt, Homo Sapiens
acuccagcuggaagucacggcuagacaaggagagaggcacuagaaaaaaaaaaaaacaaaaaaa

SEQ ID NO: 374701 - RNA, 64 nt, Homo Sapiens
ucaacagauaguucagaaacacuuuuuaucugcaaggcacuauucuagauccagaagaugcaau

SEQ ID NO: 374702 - RNA, 64 nt, Homo Sapiens
agaagaaaaauagccucaaucucccaccccauguaggcacuaccuccccaauuacccuuagaaa

SEQ ID NO: 374703 - RNA, 64 nt, Homo Sapiens; identical to SEQ ID NO: 246998

SEQ ID NO: 374704 - RNA, 64 nt, Homo Sapiens; identical to SEQ ID NO: 246999

SEQ ID NO: 374705 - RNA, 64 nt, Homo Sapiens; identical to SEQ ID NO: 247000

SEQ ID NO: 374706 - RNA, 64 nt, Homo Sapiens; identical to SEQ ID NO: 247001

SEQ ID NO: 374707 - RNA, 64 nt, Homo Sapiens; identical to SEQ ID NO: 247002

SEQ ID NO: 374708 - RNA, 64 nt, Homo Sapiens; identical to SEQ ID NO: 247003

SEQ ID NO: 374709 - RNA, 64 nt, Homo Sapiens; identical to SEQ ID NO: 247004

SEQ ID NO: 374710 - RNA, 64 nt, Homo Sapiens; identical to SEQ ID NO: 247005

SEQ ID NO: 374711 - RNA, 64 nt, Homo Sapiens; identical to SEQ ID NO: 247006

SEQ ID NO: 374712 - RNA, 64 nt, Homo Sapiens; identical to SEQ ID NO: 247007

SEQ ID NO: 374713 - RNA, 64 nt, Homo Sapiens; identical to SEQ ID NO: 247008

SEQ ID NO: 374714 - RNA, 64 nt, Homo Sapiens; identical to SEQ ID NO: 247009

SEQ ID NO: 374715 - RNA, 64 nt, Homo Sapiens; identical to SEQ ID NO: 247010

SEQ ID NO: 374716 - RNA, 64 nt, Homo Sapiens; identical to SEQ ID NO: 247011

SEQ ID NO: 374717 - RNA, 62 nt, Homo Sapiens
gacucuuuuucuuguuuugucugccauucuugaaagugcaucuugagagcccccauuuguug

SEQ ID NO: 374718 - RNA, 62 nt, Homo Sapiens
uugugauccuuuaauauuauccaugcuuuuauaaagugcaguacacauuuugacauugccac

SEQ ID NO: 374719 - RNA, 62 nt, Homo Sapiens
caaaaggauuguuuuaauccccauuauucuggaaagugcauccuagucucccagucuauaac

SEQ ID NO: 374720 - RNA, 62 nt, Homo Sapiens
aagugcccuugagaacuuguagagggaguaaaaaagugcauggauaaaugacugcagcaaau

SEQ ID NO: 374721 - RNA, 62 nt, Homo Sapiens
cuuauauuugagaauuaaugaacuacaacacaaaagugcagauugguauucacaucucagag

SEQ ID NO: 374722 - RNA, 62 nt, Homo Sapiens
gauagggaccuuugucucuuugucaccaacaaaaagugcauugauuccuaagguuuccagug

SEQ ID NO: 374723 - RNA, 62 nt, Homo Sapiens
auuaaauguuugcuuuauaguguuagcaaaacaaagugcaauaggaaaaguaaaauccaaaa

SEQ ID NO: 374724 - RNA, 62 nt, Homo Sapiens
uauuuuuauacagaguuacuggaaaggagggaaaagugcauuggaaguuuuccauucacugg

SEQ ID NO: 374725 - RNA, 62 nt, Homo Sapiens
agacggaaaaggacuuucuucuguuuucuuccaaagugcaaccacaguggagagcccacggu

SEQ ID NO: 374726 - RNA, 62 nt, Homo Sapiens
uucucuucuuugaccgugcuaggaauuccaggaaagugcauuccugcccuggugaccuuuuc

SEQ ID NO: 374727 - RNA, 62 nt, Homo Sapiens
ucacugaaauaaugagauuugguuugaaacuuaaagugcacauuuuuccuuuuuucucacau

SEQ ID NO: 374728 - RNA, 62 nt, Homo Sapiens
gaagaucauuuauuacuuuugucaugcaucuaaaagugcaugcaaaucaguaacuggucaug

SEQ ID NO: 374729 - RNA, 62 nt, Homo Sapiens
aaccguuguuaauuuuaaaacuagcaaucuauaaagugcaccaggucaacuugaauaaaaac

SEQ ID NO: 374730 - RNA, 62 nt, Homo Sapiens
caagagcaaaacugcacaaacuugcacauuggaaagugcaacaaguucccgugauugcagua

SEQ ID NO: 374731 - RNA, 62 nt, Homo Sapiens
agaaaaaccuaccaauuaacguaucuuaaugaaaagugcaaaucuaccugcucguucccaau

SEQ ID NO: 374732 - RNA, 62 nt, Homo Sapiens
gaacuucaaaacaaaacaaauuacuguaaaaaaaagugcacuguuccuaaauuuuuguaauc

SEQ ID NO: 374733 - RNA, 62 nt, Homo Sapiens
uaagauagaguuuuuauuaaaaaaagcaugugaaagugcacuguuguuuguuuauuauaaac

SEQ ID NO: 374734 - RNA, 62 nt, Homo Sapiens
uggccaaaugaaaugguaguaguuuacuggggaaagugcauuuuguucucguuguuguuuua

SEQ ID NO: 374735 - RNA, 62 nt, Homo Sapiens
gaggugugacauggcccccaagcagagcggguaaagugcaauggguaagggagggaagggga

SEQ ID NO: 374736 - RNA, 62 nt, Homo Sapiens
accagcagggaguuagcacugaacugcuuuuaaaagugcacauuaaaaaggaaaguuugcca

SEQ ID NO: 374737 - RNA, 64 nt, Homo Sapiens
gaagaagaagaagaacuucuagguccuaaacuagaagaggaagaagaagaggaaguaguugaaa

SEQ ID NO: 374738 - RNA, 64 nt, Homo Sapiens
gaacuucuagguccuaaacuagaagaggaagaagaagaggaaguaguugaaaaugaugaggaga

SEQ ID NO: 374739 - RNA, 64 nt, Homo Sapiens
acuuaauuaugagacuguauugcugggugugauaaagaggaaugaugggcagcaguggacuaag

SEQ ID NO: 374740 - RNA, 64 nt, Homo Sapiens
agccauauauuggggaaaaucaagcugagaugagaagaggaauguacaacucuggguucacaca

SEQ ID NO: 374741 - RNA, 64 nt, Homo Sapiens
uuagaauuucucauugggagggcaccaggcucaaaagaggaaauugcaguucugagaaggugga

SEQ ID NO: 374742 - RNA, 64 nt, Homo Sapiens
gcuucucacacuuucaugugggaaacuguucagcaagaggaaggaagagaaggagcuuggauga

SEQ ID NO: 374743 - RNA, 64 nt, Homo Sapiens
gucaggaaucaagccacugauaagauuccucuuaaagaggaaaucaugauuucagaagaugaca

SEQ ID NO: 374744 - RNA, 64 nt, Homo Sapiens
aguaccaguuuuaaauugcccaguggugcucuugaagaggaaugaucaauuccaaagauguuuc

SEQ ID NO: 374745 - RNA, 64 nt, Homo Sapiens
acagaagccugaauaaucuaagacagcuaucaggaagaggaaauaguagugaaaugaugcggaa

SEQ ID NO: 374746 - RNA, 64 nt, Homo Sapiens
aagauaaaacuaugccaguuauauauauuuugucaagaggaaaggaugaaaggacguuuaaagu

SEQ ID NO: 374747 - RNA, 64 nt, Homo Sapiens
cauaaaaucauccuagaagacaucacauuuggagaagaggaaaucuaucacauauuuaagcaaa

SEQ ID NO: 374748 - RNA, 64 nt, Homo Sapiens
uuucauaaaaacaauucagcuccuuacagaauccaagaggaagcuguggauucagauacucuga

SEQ ID NO: 374749 - RNA, 64 nt, Homo Sapiens
uaaguuaaauuaagcccaagauacaaaaaucaaaaagaggaaaauuaaaagugcccucuuaaaa

SEQ ID NO: 374750 - RNA, 64 nt, Homo Sapiens
aaaaaaagauaauuuuuaggcacacaugcuccaaaagaggaaaggaaauacuccucccaccaca

SEQ ID NO: 374751 - RNA, 64 nt, Homo Sapiens
uucuguucuauuuuagugauagucacaugauccuaagaggaaagaucugcacaaaauucugaag

SEQ ID NO: 374752 - RNA, 64 nt, Homo Sapiens
gcauuuuuccccuugucuuuguuguaagagacaaaagaggaaacaaaagugucucccuguggaa

SEQ ID NO: 374753 - RNA, 64 nt, Homo Sapiens
guugggaggcgaucagcagauaccauagugaacgaagaggaagguuugaaccaugggccccauc

SEQ ID NO: 374754 - RNA, 64 nt, Homo Sapiens
gcucucacuauccaccucaacacacauccaucucaagaggaacauuuauaccaggcagucagag

SEQ ID NO: 374755 - RNA, 64 nt, Homo Sapiens
cuggggcuaaaguuugggguagagcacaagggacaagaggaacucuuggaguuggcugggugag

SEQ ID NO: 374756 - RNA, 64 nt, Homo Sapiens
caggaacccaccaaaccaacuccuagcguuuuggaagaggaaaaacaagagucaaugguacuug

SEQ ID NO: 374757 - RNA, 64 nt, Homo Sapiens
ucugucacuccucaugccugauaccgucuccuugaagaggaaacuguguaugucaacagaaggg

SEQ ID NO: 374758 - RNA, 64 nt, Homo Sapiens
ugccuccauggcagaagucagcucuugcucagugaagaggaaaacuucccuuaagagucaucca

SEQ ID NO: 374759 - RNA, 64 nt, Homo Sapiens
accagcugccuuccaacuuccaggccuccuuggcaagaggaauguacagggcagaucaacggga

SEQ ID NO: 374760 - RNA, 64 nt, Homo Sapiens
agcaacaacagcaacaacacguuugaauguguagaagaggaaaaugguuuguacaagaaaguuu

SEQ ID NO: 374761 - RNA, 64 nt, Homo Sapiens
uugaccugcagacuaugguuugacauugaaaauaaagaggaacacagugguaacucaugauuua

SEQ ID NO: 374762 - RNA, 64 nt, Homo Sapiens
uuuuauaggaauuugcuuccuaagucuacuuuugaagaggaaaacaggaacguaccauauauuu

SEQ ID NO: 374763 - RNA, 64 nt, Homo Sapiens
auuagaggugauuuucagauuucuuguucuauggaagaggaagcugagcucagggagauaugag

SEQ ID NO: 374764 - RNA, 64 nt, Homo Sapiens
guaauucucggcuguaguugcauaagcauugcucaagaggaaaauccaaaagugcagcaggaga

SEQ ID NO: 374765 - RNA, 64 nt, Homo Sapiens
aauguccuuaaauccaucuuacuugccaacagguaagaggaagcuuacauuacauguccagucc

SEQ ID NO: 374766 - RNA, 64 nt, Homo Sapiens
gaagucaaucagcagaggagagcauuugauaacuaagaggaagacuugcaaagccguuuucuca

SEQ ID NO: 374767 - RNA, 64 nt, Homo Sapiens
uuuguuucaacgguccaaacgcccaaccuucagaaagaggaagucagauagaaauagucccuga

SEQ ID NO: 374768 - RNA, 64 nt, Homo Sapiens
ucccuuucaccuccaauucccgugaucccaaaagaagaggaagacuccaggagggguauagauu

SEQ ID NO: 374769 - RNA, 64 nt, Homo Sapiens
aaacaaaacucauuagaauggucaaaucgcauaaaagaggaaaauuuguucucaguggaacccu

SEQ ID NO: 374770 - RNA, 64 nt, Homo Sapiens
ugggagauugggacagcugauugagugauugugaaagaggaaugggggaugugugaccuguuug

SEQ ID NO: 374771 - RNA, 64 nt, Homo Sapiens
aucaggggcuggggacaauuucuuuccaaagcaaaagaggaagccagaccuugggaccgagaac

SEQ ID NO: 374772 - RNA, 64 nt, Homo Sapiens
aaggaggaaagaacaauaaugauuccaucaugauaagaggaaugaacgugucugcaacuaaugg

SEQ ID NO: 374773 - RNA, 64 nt, Homo Sapiens
agcagagaacuggcuggaugagaagcaucuuaagaagaggaaacucaauagggaaaagagggga

SEQ ID NO: 374774 - RNA, 64 nt, Homo Sapiens
uacagcacaguguggugggugacagagaaacauaaagaggaaauucugaaagagcucuugggaa

SEQ ID NO: 374775 - RNA, 64 nt, Homo Sapiens
ggagucauuuugccuuugaaagccaagcaagggaaagaggaaguugaagugcugauuccauuuc

SEQ ID NO: 374776 - RNA, 64 nt, Homo Sapiens
cgaggauggaaaaccuuuuaggaaagaagacuccaagaggaaaaaaauucaugcagauauggau

SEQ ID NO: 374777 - RNA, 64 nt, Homo Sapiens
cuuuuagcauucagagaaaaagccaacuugcuuaaagaggaaucacuuaaaagguaggcauauc

SEQ ID NO: 374778 - RNA, 64 nt, Homo Sapiens
acuuaaaagguaggcauaucuaagaugcucauagaagaggaagaaugggacauggccccaugcu

SEQ ID NO: 374779 - RNA, 64 nt, Homo Sapiens
cuucaacauaugugguacaagcaacauuaaagcuaagaggaacauauuucauagaaaaaugacu

SEQ ID NO: 374780 - RNA, 64 nt, Homo Sapiens
cuaaugacaguguauaacuggaacugauuuuuuuaagaggaaaaaaacacaucuaaaagcccag

SEQ ID NO: 374781 - RNA, 64 nt, Homo Sapiens
ggcuuuggguuuuuaaaguaggcccaggcaggugaagaggaagucacaagcgcagagacgcuga

SEQ ID NO: 374782 - RNA, 64 nt, Homo Sapiens
auuggccuagagcuccuguggugcagaaacagucaagaggaaccgcagccccuccucucauuug

SEQ ID NO: 374783 - RNA, 64 nt, Homo Sapiens
cauuuucuugagcaauacugaagcaggaugaaguaagaggaaugcauucauuuaaacaugcuuu

SEQ ID NO: 374784 - RNA, 64 nt, Homo Sapiens
cuacuuaauauaugaccaugacuuugaaaggcaaaagaggaaucaagaauaaauaaaacaaacu

SEQ ID NO: 374785 - RNA, 64 nt, Homo Sapiens
ugagucagacauguagaguuugggucacacaggcaagaggaauuuucccucggccuuacugaca

SEQ ID NO: 374786 - RNA, 64 nt, Homo Sapiens
auccuuuagggagaugaggguauccccacagaaaaagaggaauaauagaccaauggauuuucuc

SEQ ID NO: 374787 - RNA, 64 nt, Homo Sapiens
ccgcaugggacuuguccaaaaaaacucuaaucaaaagaggaaaauuuuggaauaugccaggaau

SEQ ID NO: 374788 - RNA, 64 nt, Homo Sapiens
auaccuacccuagaguacauaaaaauuauauuaaaagaggaaguagcaguaugcauaauuuuaa

SEQ ID NO: 374789 - RNA, 64 nt, Homo Sapiens
gaaggacgcgguuaaugccugagaaagcgagagaaagaggaacuguggcagagagugugcaugu

SEQ ID NO: 374790 - RNA, 64 nt, Homo Sapiens
uaaagugacgaguguggcagcaucaaacucagggaagaggaagccugaguuuugcccaguguga

SEQ ID NO: 374791 - RNA, 64 nt, Homo Sapiens
uuuguuuauuuuuuugauaaugacuggacaucagaagaggaaaaaaacucaaaacaaaagcgag

SEQ ID NO: 374792 - RNA, 64 nt, Homo Sapiens
uguuccuguccauucacccagccaaauuguguuaaagaggaaagccccacaaacuaaaacagcc

SEQ ID NO: 374793 - RNA, 64 nt, Homo Sapiens
aaagccccacaaacuaaaacagccuuuccuagggaagaggaaggggaggugggcuggaucugug

SEQ ID NO: 374794 - RNA, 64 nt, Homo Sapiens
ugguuuauauucugguugucuuuuucuuuuuguaaagaggaaacaauguacagaaaaacaauaa

SEQ ID NO: 374795 - RNA, 64 nt, Homo Sapiens
ggcuccggauuuaagccauuggcaauuccaugccaagaggaaguauagaauuguacaaaucagu

SEQ ID NO: 374796 - RNA, 64 nt, Homo Sapiens
uaugagaaaguaagucucuguguagaccaucaagaagaggaagaaccaaacuaaaggagaucau

SEQ ID NO: 374797 - RNA, 64 nt, Homo Sapiens
aucauuuuucuauaauuuguacauuucuguaaagaagaggaaaacccgguacgauuugggagug

SEQ ID NO: 374798 - RNA, 64 nt, Homo Sapiens
gucauguuucucauaaaaaugacuugagacacccaagaggaacacuaggcgguugccuuguuuu

SEQ ID NO: 374799 - RNA, 64 nt, Homo Sapiens
cuauuguuugggggaaaaaaagauuugacuaaugaagaggaaauuauuaaugaauaucacuauc

SEQ ID NO: 374800 - RNA, 64 nt, Homo Sapiens
aaacugucucgcauaggagcaguauucucuugcuaagaggaaggaaagcaguguugcuggaugc

SEQ ID NO: 374801 - RNA, 64 nt, Homo Sapiens
ggcuuggaagaaaauaaucaucagaugaugaagaaagaggaacgugagugacaaggaauugguu

SEQ ID NO: 374802 - RNA, 64 nt, Homo Sapiens
ugcaacauucucugcccacuuccaggaaaugcagaagaggaaugucauuugcuccguuuucaaa

SEQ ID NO: 374803 - RNA, 64 nt, Homo Sapiens
uaaaugcgagagggcaauccagaaaugaauauucaagaggaagagaagaauaccuggcaguaga

SEQ ID NO: 374804 - RNA, 64 nt, Homo Sapiens
gggagucucaaagcuggagacagagcaugguuagaagaggaaagaagcacaauacugggcaauu

SEQ ID NO: 374805 - RNA, 64 nt, Homo Sapiens
uauuuaaauauuuugagugagggggagugggucaaagaggaaguagagguguaauccuguauua

SEQ ID NO: 374806 - RNA, 64 nt, Homo Sapiens
uccugggguauauuaauuuaguuauauuuagcagaagaggaauauaaccaaaugugacuaaaau

SEQ ID NO: 374807 - RNA, 64 nt, Homo Sapiens
uggguuuauaagaaaauggauagagcugcaccuaaagaggaaaugaaagguuccuuucaaauag

SEQ ID NO: 374808 - RNA, 64 nt, Homo Sapiens
ggacuggcauuuauggugaaaagccaguucauuuaagaggaaaucaccuuaugaccuugaggga

SEQ ID NO: 374809 - RNA, 64 nt, Homo Sapiens
uuuaauaauuuuaugaaauggcaaagguuuagccaagaggaaauuuuggcaugaauacaggcuu

SEQ ID NO: 374810 - RNA, 64 nt, Homo Sapiens
ucaugggcuucaauaaugucuagaaaguaaaauaaagaggaauguuaccauccccagcugcccu

SEQ ID NO: 374811 - RNA, 64 nt, Homo Sapiens
uacagagaaacaggauuguuugagaaccaaaaucaagaggaacagaaaucuuaacuugauuuca

SEQ ID NO: 374812 - RNA, 64 nt, Homo Sapiens
aggggcaggccagggcuguucacgcccaugagggaagaggaaagugccacugggcaaggugucc

SEQ ID NO: 374813 - RNA, 64 nt, Homo Sapiens
cugcugcugucccagucuugggcuggggccuggaaagaggaagaggcugccuggggcugggcca

SEQ ID NO: 374814 - RNA, 64 nt, Homo Sapiens
aucccaaagagcuaaacaauuccuuacauuuaccaagaggaaagcuuuuacuguguugaagcua

SEQ ID NO: 374815 - RNA, 64 nt, Homo Sapiens
aauaggcagacugugucuagagucaugcauggacaagaggaaagugaaaguugaauacucucuu

SEQ ID NO: 374816 - RNA, 64 nt, Homo Sapiens; identical to SEQ ID NO: 58312

SEQ ID NO: 374817 - RNA, 64 nt, Homo Sapiens; identical to SEQ ID NO: 58313

SEQ ID NO: 374818 - RNA, 64 nt, Homo Sapiens; identical to SEQ ID NO: 58314

SEQ ID NO: 374819 - RNA, 64 nt, Homo Sapiens; identical to SEQ ID NO: 58315

SEQ ID NO: 374820 - RNA, 64 nt, Homo Sapiens; identical to SEQ ID NO: 58316

SEQ ID NO: 374821 - RNA, 64 nt, Homo Sapiens; identical to SEQ ID NO: 58317

SEQ ID NO: 374822 - RNA, 64 nt, Homo Sapiens; identical to SEQ ID NO: 58318

SEQ ID NO: 374823 - RNA, 64 nt, Homo Sapiens; identical to SEQ ID NO: 58319

SEQ ID NO: 374824 - RNA, 64 nt, Homo Sapiens; identical to SEQ ID NO: 58320

SEQ ID NO: 374825 - RNA, 64 nt, Homo Sapiens; identical to SEQ ID NO: 58321

SEQ ID NO: 374826 - RNA, 64 nt, Homo Sapiens; identical to SEQ ID NO: 58322

SEQ ID NO: 374827 - RNA, 64 nt, Homo Sapiens; identical to SEQ ID NO: 58323

SEQ ID NO: 374828 - RNA, 64 nt, Homo Sapiens; identical to SEQ ID NO: 58324

SEQ ID NO: 374829 - RNA, 64 nt, Homo Sapiens; identical to SEQ ID NO: 58325

SEQ ID NO: 374830 - RNA, 64 nt, Homo Sapiens; identical to SEQ ID NO: 58326

SEQ ID NO: 374831 - RNA, 64 nt, Homo Sapiens; identical to SEQ ID NO: 58327

SEQ ID NO: 374832 - RNA, 64 nt, Homo Sapiens; identical to SEQ ID NO: 58328

SEQ ID NO: 374833 - RNA, 64 nt, Homo Sapiens; identical to SEQ ID NO: 58329

SEQ ID NO: 374834 - RNA, 64 nt, Homo Sapiens; identical to SEQ ID NO: 58330

SEQ ID NO: 374835 - RNA, 64 nt, Homo Sapiens; identical to SEQ ID NO: 58331

SEQ ID NO: 374836 - RNA, 64 nt, Homo Sapiens; identical to SEQ ID NO: 58332

SEQ ID NO: 374837 - RNA, 64 nt, Homo Sapiens; identical to SEQ ID NO: 58333

SEQ ID NO: 374838 - RNA, 64 nt, Homo Sapiens; identical to SEQ ID NO: 58334

SEQ ID NO: 374839 - RNA, 64 nt, Homo Sapiens; identical to SEQ ID NO: 58335

SEQ ID NO: 374840 - RNA, 64 nt, Homo Sapiens; identical to SEQ ID NO: 58336

SEQ ID NO: 374841 - RNA, 64 nt, Homo Sapiens; identical to SEQ ID NO: 58337

SEQ ID NO: 374842 - RNA, 64 nt, Homo Sapiens; identical to SEQ ID NO: 58338

SEQ ID NO: 374843 - RNA, 64 nt, Homo Sapiens; identical to SEQ ID NO: 58339

SEQ ID NO: 374844 - RNA, 64 nt, Homo Sapiens; identical to SEQ ID NO: 58340

SEQ ID NO: 374845 - RNA, 64 nt, Homo Sapiens; identical to SEQ ID NO: 58341

SEQ ID NO: 374846 - RNA, 64 nt, Homo Sapiens; identical to SEQ ID NO: 58342

SEQ ID NO: 374847 - RNA, 64 nt, Homo Sapiens; identical to SEQ ID NO: 58343

SEQ ID NO: 374848 - RNA, 64 nt, Homo Sapiens; identical to SEQ ID NO: 58344

SEQ ID NO: 374849 - RNA, 64 nt, Homo Sapiens; identical to SEQ ID NO: 58345

SEQ ID NO: 374850 - RNA, 64 nt, Homo Sapiens; identical to SEQ ID NO: 58346

SEQ ID NO: 374851 - RNA, 64 nt, Homo Sapiens; identical to SEQ ID NO: 58347

SEQ ID NO: 374852 - RNA, 64 nt, Homo Sapiens; identical to SEQ ID NO: 58348

SEQ ID NO: 374853 - RNA, 64 nt, Homo Sapiens; identical to SEQ ID NO: 58349

SEQ ID NO: 374854 - RNA, 64 nt, Homo Sapiens; identical to SEQ ID NO: 58350

SEQ ID NO: 374855 - RNA, 64 nt, Homo Sapiens; identical to SEQ ID NO: 58351

SEQ ID NO: 374856 - RNA, 64 nt, Homo Sapiens; identical to SEQ ID NO: 58352

SEQ ID NO: 374857 - RNA, 64 nt, Homo Sapiens; identical to SEQ ID NO: 58353

SEQ ID NO: 374858 - RNA, 64 nt, Homo Sapiens; identical to SEQ ID NO: 58354

SEQ ID NO: 374859 - RNA, 64 nt, Homo Sapiens; identical to SEQ ID NO: 58355

SEQ ID NO: 374860 - RNA, 64 nt, Homo Sapiens; identical to SEQ ID NO: 58356

SEQ ID NO: 374861 - RNA, 64 nt, Homo Sapiens; identical to SEQ ID NO: 58357

SEQ ID NO: 374862 - RNA, 64 nt, Homo Sapiens; identical to SEQ ID NO: 58358

SEQ ID NO: 374863 - RNA, 64 nt, Homo Sapiens; identical to SEQ ID NO: 58359

SEQ ID NO: 374864 - RNA, 64 nt, Homo Sapiens; identical to SEQ ID NO: 58360

SEQ ID NO: 374865 - RNA, 64 nt, Homo Sapiens; identical to SEQ ID NO: 58361

SEQ ID NO: 374866 - RNA, 64 nt, Homo Sapiens; identical to SEQ ID NO: 58362

SEQ ID NO: 374867 - RNA, 64 nt, Homo Sapiens; identical to SEQ ID NO: 58363

SEQ ID NO: 374868 - RNA, 64 nt, Homo Sapiens; identical to SEQ ID NO: 58364

SEQ ID NO: 374869 - RNA, 64 nt, Homo Sapiens; identical to SEQ ID NO: 58365

SEQ ID NO: 374870 - RNA, 64 nt, Homo Sapiens; identical to SEQ ID NO: 58366

SEQ ID NO: 374871 - RNA, 64 nt, Homo Sapiens; identical to SEQ ID NO: 58367

SEQ ID NO: 374872 - RNA, 64 nt, Homo Sapiens; identical to SEQ ID NO: 58368

SEQ ID NO: 374873 - RNA, 64 nt, Homo Sapiens; identical to SEQ ID NO: 58369

SEQ ID NO: 374874 - RNA, 64 nt, Homo Sapiens; identical to SEQ ID NO: 58370

SEQ ID NO: 374875 - RNA, 64 nt, Homo Sapiens; identical to SEQ ID NO: 58371

SEQ ID NO: 374876 - RNA, 64 nt, Homo Sapiens; identical to SEQ ID NO: 58372

SEQ ID NO: 374877 - RNA, 64 nt, Homo Sapiens; identical to SEQ ID NO: 58373

SEQ ID NO: 374878 - RNA, 64 nt, Homo Sapiens; identical to SEQ ID NO: 58374

SEQ ID NO: 374879 - RNA, 64 nt, Homo Sapiens; identical to SEQ ID NO: 58375

SEQ ID NO: 374880 - RNA, 64 nt, Homo Sapiens; identical to SEQ ID NO: 58376

SEQ ID NO: 374881 - RNA, 64 nt, Homo Sapiens; identical to SEQ ID NO: 58377

SEQ ID NO: 374882 - RNA, 64 nt, Homo Sapiens; identical to SEQ ID NO: 58378

SEQ ID NO: 374883 - RNA, 64 nt, Homo Sapiens; identical to SEQ ID NO: 58379

SEQ ID NO: 374884 - RNA, 64 nt, Homo Sapiens; identical to SEQ ID NO: 58380

SEQ ID NO: 374885 - RNA, 64 nt, Homo Sapiens; identical to SEQ ID NO: 58381

SEQ ID NO: 374886 - RNA, 64 nt, Homo Sapiens; identical to SEQ ID NO: 58382

SEQ ID NO: 374887 - RNA, 64 nt, Homo Sapiens; identical to SEQ ID NO: 58383

SEQ ID NO: 374888 - RNA, 64 nt, Homo Sapiens; identical to SEQ ID NO: 58384

SEQ ID NO: 374889 - RNA, 64 nt, Homo Sapiens; identical to SEQ ID NO: 58385

SEQ ID NO: 374890 - RNA, 64 nt, Homo Sapiens; identical to SEQ ID NO: 58386

SEQ ID NO: 374891 - RNA, 64 nt, Homo Sapiens; identical to SEQ ID NO: 58387

SEQ ID NO: 374892 - RNA, 64 nt, Homo Sapiens; identical to SEQ ID NO: 58388

SEQ ID NO: 374893 - RNA, 64 nt, Homo Sapiens; identical to SEQ ID NO: 58389

SEQ ID NO: 374894 - RNA, 64 nt, Homo Sapiens; identical to SEQ ID NO: 58390

SEQ ID NO: 374895 - RNA, 64 nt, Homo Sapiens; identical to SEQ ID NO: 58391

SEQ ID NO: 374896 - RNA, 64 nt, Homo Sapiens; identical to SEQ ID NO: 58392

SEQ ID NO: 374897 - RNA, 64 nt, Homo Sapiens; identical to SEQ ID NO: 58393

SEQ ID NO: 374898 - RNA, 64 nt, Homo Sapiens; identical to SEQ ID NO: 58394

SEQ ID NO: 374899 - RNA, 64 nt, Homo Sapiens; identical to SEQ ID NO: 58395

SEQ ID NO: 374900 - RNA, 64 nt, Homo Sapiens; identical to SEQ ID NO: 58396

SEQ ID NO: 374901 - RNA, 64 nt, Homo Sapiens; identical to SEQ ID NO: 58397

SEQ ID NO: 374902 - RNA, 64 nt, Homo Sapiens; identical to SEQ ID NO: 58398

SEQ ID NO: 374903 - RNA, 64 nt, Homo Sapiens; identical to SEQ ID NO: 58399

SEQ ID NO: 374904 - RNA, 64 nt, Homo Sapiens; identical to SEQ ID NO: 58400

SEQ ID NO: 374905 - RNA, 64 nt, Homo Sapiens; identical to SEQ ID NO: 58401

SEQ ID NO: 374906 - RNA, 64 nt, Homo Sapiens; identical to SEQ ID NO: 58402

SEQ ID NO: 374907 - RNA, 64 nt, Homo Sapiens; identical to SEQ ID NO: 58403

SEQ ID NO: 374908 - RNA, 64 nt, Homo Sapiens; identical to SEQ ID NO: 58404

SEQ ID NO: 374909 - RNA, 64 nt, Homo Sapiens; identical to SEQ ID NO: 58405

SEQ ID NO: 374910 - RNA, 64 nt, Homo Sapiens; identical to SEQ ID NO: 58406

SEQ ID NO: 374911 - RNA, 64 nt, Homo Sapiens; identical to SEQ ID NO: 58407

SEQ ID NO: 374912 - RNA, 64 nt, Homo Sapiens; identical to SEQ ID NO: 58408

SEQ ID NO: 374913 - RNA, 64 nt, Homo Sapiens; identical to SEQ ID NO: 58409

SEQ ID NO: 374914 - RNA, 64 nt, Homo Sapiens; identical to SEQ ID NO: 58410

SEQ ID NO: 374915 - RNA, 64 nt, Homo Sapiens; identical to SEQ ID NO: 58411

SEQ ID NO: 374916 - RNA, 64 nt, Homo Sapiens; identical to SEQ ID NO: 58412

SEQ ID NO: 374917 - RNA, 64 nt, Homo Sapiens; identical to SEQ ID NO: 58413

SEQ ID NO: 374918 - RNA, 64 nt, Homo Sapiens; identical to SEQ ID NO: 58414

SEQ ID NO: 374919 - RNA, 64 nt, Homo Sapiens; identical to SEQ ID NO: 58415

SEQ ID NO: 374920 - RNA, 64 nt, Homo Sapiens; identical to SEQ ID NO: 58416

SEQ ID NO: 374921 - RNA, 64 nt, Homo Sapiens; identical to SEQ ID NO: 58417

SEQ ID NO: 374922 - RNA, 64 nt, Homo Sapiens; identical to SEQ ID NO: 58418

SEQ ID NO: 374923 - RNA, 64 nt, Homo Sapiens; identical to SEQ ID NO: 58419

SEQ ID NO: 374924 - RNA, 64 nt, Homo Sapiens; identical to SEQ ID NO: 58420

SEQ ID NO: 374925 - RNA, 64 nt, Homo Sapiens; identical to SEQ ID NO: 58421

SEQ ID NO: 374926 - RNA, 64 nt, Homo Sapiens; identical to SEQ ID NO: 58422

SEQ ID NO: 374927 - RNA, 64 nt, Homo Sapiens; identical to SEQ ID NO: 58423

SEQ ID NO: 374928 - RNA, 64 nt, Homo Sapiens; identical to SEQ ID NO: 58424

SEQ ID NO: 374929 - RNA, 64 nt, Homo Sapiens; identical to SEQ ID NO: 58425

SEQ ID NO: 374930 - RNA, 64 nt, Homo Sapiens; identical to SEQ ID NO: 58426

SEQ ID NO: 374931 - RNA, 64 nt, Homo Sapiens; identical to SEQ ID NO: 58427

SEQ ID NO: 374932 - RNA, 64 nt, Homo Sapiens; identical to SEQ ID NO: 58428

SEQ ID NO: 374933 - RNA, 64 nt, Homo Sapiens; identical to SEQ ID NO: 58429

SEQ ID NO: 374934 - RNA, 64 nt, Homo Sapiens; identical to SEQ ID NO: 58430

SEQ ID NO: 374935 - RNA, 64 nt, Homo Sapiens; identical to SEQ ID NO: 58431

SEQ ID NO: 374936 - RNA, 64 nt, Homo Sapiens; identical to SEQ ID NO: 58432

SEQ ID NO: 374937 - RNA, 64 nt, Homo Sapiens; identical to SEQ ID NO: 58433

SEQ ID NO: 374938 - RNA, 64 nt, Homo Sapiens; identical to SEQ ID NO: 58434

SEQ ID NO: 374939 - RNA, 64 nt, Homo Sapiens; identical to SEQ ID NO: 58435

SEQ ID NO: 374940 - RNA, 50 nt, Homo Sapiens; identical to SEQ ID NO: 58436

SEQ ID NO: 374941 - RNA, 64 nt, Homo Sapiens; identical to SEQ ID NO: 58437

SEQ ID NO: 374942 - RNA, 64 nt, Homo Sapiens; identical to SEQ ID NO: 58438

SEQ ID NO: 374943 - RNA, 64 nt, Homo Sapiens; identical to SEQ ID NO: 58439

SEQ ID NO: 374944 - RNA, 64 nt, Homo Sapiens; identical to SEQ ID NO: 58440

SEQ ID NO: 374945 - RNA, 64 nt, Homo Sapiens; identical to SEQ ID NO: 58441

SEQ ID NO: 374946 - RNA, 64 nt, Homo Sapiens; identical to SEQ ID NO: 58442

SEQ ID NO: 374947 - RNA, 64 nt, Homo Sapiens; identical to SEQ ID NO: 58443

SEQ ID NO: 374948 - RNA, 64 nt, Homo Sapiens; identical to SEQ ID NO: 58444

SEQ ID NO: 374949 - RNA, 64 nt, Homo Sapiens; identical to SEQ ID NO: 58445

SEQ ID NO: 374950 - RNA, 64 nt, Homo Sapiens; identical to SEQ ID NO: 58446

SEQ ID NO: 374951 - RNA, 64 nt, Homo Sapiens; identical to SEQ ID NO: 58447

SEQ ID NO: 374952 - RNA, 64 nt, Homo Sapiens; identical to SEQ ID NO: 58448

SEQ ID NO: 374953 - RNA, 64 nt, Homo Sapiens; identical to SEQ ID NO: 58449

SEQ ID NO: 374954 - RNA, 64 nt, Homo Sapiens; identical to SEQ ID NO: 58450

SEQ ID NO: 374955 - RNA, 64 nt, Homo Sapiens; identical to SEQ ID NO: 58451

SEQ ID NO: 374956 - RNA, 64 nt, Homo Sapiens; identical to SEQ ID NO: 58452

SEQ ID NO: 374957 - RNA, 64 nt, Homo Sapiens; identical to SEQ ID NO: 58453

SEQ ID NO: 374958 - RNA, 64 nt, Homo Sapiens; identical to SEQ ID NO: 58454

SEQ ID NO: 374959 - RNA, 64 nt, Homo Sapiens; identical to SEQ ID NO: 58455

SEQ ID NO: 374960 - RNA, 64 nt, Homo Sapiens; identical to SEQ ID NO: 58456

SEQ ID NO: 374961 - RNA, 64 nt, Homo Sapiens; identical to SEQ ID NO: 58457

SEQ ID NO: 374962 - RNA, 64 nt, Homo Sapiens; identical to SEQ ID NO: 58458

SEQ ID NO: 374963 - RNA, 64 nt, Homo Sapiens; identical to SEQ ID NO: 58459

SEQ ID NO: 374964 - RNA, 64 nt, Homo Sapiens; identical to SEQ ID NO: 58460

SEQ ID NO: 374965 - RNA, 64 nt, Homo Sapiens; identical to SEQ ID NO: 58461

SEQ ID NO: 374966 - RNA, 64 nt, Homo Sapiens; identical to SEQ ID NO: 58462

SEQ ID NO: 374967 - RNA, 64 nt, Homo Sapiens; identical to SEQ ID NO: 58463

SEQ ID NO: 374968 - RNA, 64 nt, Homo Sapiens; identical to SEQ ID NO: 58464

SEQ ID NO: 374969 - RNA, 64 nt, Homo Sapiens; identical to SEQ ID NO: 58465

SEQ ID NO: 374970 - RNA, 64 nt, Homo Sapiens; identical to SEQ ID NO: 58466

SEQ ID NO: 374971 - RNA, 64 nt, Homo Sapiens; identical to SEQ ID NO: 58467

SEQ ID NO: 374972 - RNA, 50 nt, Homo Sapiens
cucacgugccucucggguagcauggagaaguugccaagaguucuuuaggu

SEQ ID NO: 374973 - RNA, 64 nt, Homo Sapiens
gcccucucugaauguuugaacugccaagaaaaggcauggagacagcgaacuagaagaaagggca

SEQ ID NO: 374974 - RNA, 64 nt, Homo Sapiens
caggacacaagcacaguuuuaagaguuguaugaacauggagaggacuuuugguuuuuauauuuc

SEQ ID NO: 374975 - RNA, 64 nt, Homo Sapiens
uccuggaggucccaaguagcucuaugccugcaaucauggagacacaggcagacagauaagcuuc

SEQ ID NO: 374976 - RNA, 64 nt, Homo Sapiens
uaugcuaggcacuuuuguccagagccugcugucccauggagaaaaaguuuuaagcacugaaaaa

SEQ ID NO: 374977 - RNA, 64 nt, Homo Sapiens
caucacacacgcggcaaaaguggagucagagcaacauggagaucgcuuaccgagaguagaaaug

SEQ ID NO: 374978 - RNA, 64 nt, Homo Sapiens
aaaauuaacugagcuccuagagaagaacaauccucauggagaaacucuggaaaccuugacaaug

SEQ ID NO: 374979 - RNA, 64 nt, Homo Sapiens
aggaggcacccgcuccuuguugaguaaaaccacccauggagacuggaaccucaucucccugggu

SEQ ID NO: 374980 - RNA, 64 nt, Homo Sapiens
cugagacagccugauacguucccgucugugcacccauggagauccaggcgugggcccgugucug

SEQ ID NO: 374981 - RNA, 64 nt, Homo Sapiens
accugggcuuagcaaucuccugcugugcgcugcucauggagaagcccgguggcuuggcaggcag

SEQ ID NO: 374982 - RNA, 59 nt, Homo Sapiens
uucauuuccacauuuucccaucuaugaugcauggagacuaaaagagucagcuacauuga

SEQ ID NO: 374983 - RNA, 64 nt, Homo Sapiens
ccgccgggaugguucuucuccaguuagaaugcaccauggagacguggugggacuccagcucgug

SEQ ID NO: 374984 - RNA, 64 nt, Homo Sapiens
uggagacguggugggacuccagcucguguguccucauggagaacccaggggacagcuggugcaa

SEQ ID NO: 374985 - RNA, 64 nt, Homo Sapiens
gauccuagaaaaggucagaccuggaggacagcagcauggagaaauguaaauuugccaugacuuc

SEQ ID NO: 374986 - RNA, 64 nt, Homo Sapiens
cgcagagcaguccagaaccaaagaaacaaauggccauggagaaaccuuugagcagcuccaggcc

SEQ ID NO: 374987 - RNA, 64 nt, Homo Sapiens
augucuucuuagagcaaaugcccugccugggggucauggagaccacagagacaucuuggccugu

SEQ ID NO: 374988 - RNA, 64 nt, Homo Sapiens
cugaccccauggcucugccaugccucuccuacagcauggagagggcugaaaagacggacuugcu

SEQ ID NO: 374989 - RNA, 64 nt, Homo Sapiens
ucuucagccccuucucuggcccagacccugugggcauggagauggacagaccugggccuggcuc

SEQ ID NO: 374990 - RNA, 64 nt, Homo Sapiens
accugggccuggcucuugagaggucccagucagccauggagagcuggggaaaccacauuaaggu

SEQ ID NO: 374991 - RNA, 64 nt, Homo Sapiens
ccagacagaauuuggaaacauuuucauaaagcuccauggagaguuuuaaagaaacauauguagc

SEQ ID NO: 374992 - RNA, 64 nt, Homo Sapiens
acuguggccaggauggcagagacuuccuugucaucauggagaagugccagcaggggacugggaa

SEQ ID NO: 374993 - RNA, 64 nt, Homo Sapiens
gucccugccucaccucugccccauccugucuguucauggagaggaggccacagcaaccuucugc

SEQ ID NO: 374994 - RNA, 64 nt, Homo Sapiens
agugauuuuuuuuuagaacagacacucguauaagcauggagaacaacacauugugucacaucau

SEQ ID NO: 374995 - RNA, 64 nt, Homo Sapiens
gguuccauuugugggagggagggcucauccacaucauggagacuugcuggaugccccauggcaa

SEQ ID NO: 374996 - RNA, 64 nt, Homo Sapiens
cagguaaaugcucauucccaaguagcaaagagaccauggagaaggugcguguaaagagauauau

SEQ ID NO: 374997 - RNA, 64 nt, Homo Sapiens
ccacuaauccaggggggacccagaccccacaagccauggagacucaggaccccagaaggcaugg

SEQ ID NO: 374998 - RNA, 64 nt, Homo Sapiens
cacuagcccagggaggacccagaccuccacacuccauggagacucaguucuccuaggaccauuu

SEQ ID NO: 374999 - RNA, 64 nt, Homo Sapiens
guagaauuagugaaccccugcauuuccccgacugcauggagacaggcugggccagccgcuccac

SEQ ID NO: 375000 - RNA, 55 nt, Homo Sapiens
gccagguaaggagacugcaggugaucauggagacucggcuuucuauggggucuag

SEQ ID NO: 375001 - RNA, 64 nt, Homo Sapiens
uaggaaaacuuucugugagccagugggcuuuuugcauggagaacauuuuggggcugaacuuacc

SEQ ID NO: 375002 - RNA, 64 nt, Homo Sapiens
uuuugcauggagaacauuuuggggcugaacuuaccauggagaucccucaguucgaaucugguaa

SEQ ID NO: 375003 - RNA, 64 nt, Homo Sapiens
gggagggauuccaaaaagucuguucuuggcaggacauggagagaaagauggaaaacuuuacuuc

SEQ ID NO: 375004 - RNA, 64 nt, Homo Sapiens
cucagccauggcaaguccaugcguccuuuuaccccauggagagcccaccuccugcccauucucc

SEQ ID NO: 375005 - RNA, 64 nt, Homo Sapiens
ccacggugccagagguucaggagauccaggggcgcauggagaggagagccgggggcgcagcuug

SEQ ID NO: 375006 - RNA, 60 nt, Homo Sapiens
aaugcugugacagcuuuuuggcugcuuuaaccauaagaaaaaugauugguggaugauuuu

SEQ ID NO: 375007 - RNA, 60 nt, Homo Sapiens
uuucuagucaaaaaugagacuucgaucaaaccauaagauuuuauacugcagauagucagc

SEQ ID NO: 375008 - RNA, 60 nt, Homo Sapiens
uguggccaaaaagaacaguugcuuaauugaccauaagaacaguauuuggaaauaauuuca

SEQ ID NO: 375009 - RNA, 60 nt, Homo Sapiens
ucacauuaucccuuuguaagauuuuuuuacccauaagacauuugugcccuguguuuuaua

SEQ ID NO: 375010 - RNA, 60 nt, Homo Sapiens
aguuggcauuagaauuggaauguugacauuccauaagaugagauucaugagaaaauuuug

SEQ ID NO: 375011 - RNA, 60 nt, Homo Sapiens
aaaugaauugucucaacaaaguacaaccugccauaagauggucucaugucugugaaacug

SEQ ID NO: 375012 - RNA, 60 nt, Homo Sapiens
agggaaguggagagcacaucccuguaaggcccauaagagaaagaggaguuuguuacauuu

SEQ ID NO: 375013 - RNA, 60 nt, Homo Sapiens
auuguccuggcuguuuauugauaguccuucccauaagaaaaugggguuaaacauggggua

SEQ ID NO: 375014 - RNA, 60 nt, Homo Sapiens
uuuuucuccucuaccuucuaaaaaaaaauaccauaagaagaaucagaauguaccauaaga

SEQ ID NO: 375015 - RNA, 60 nt, Homo Sapiens
aaaaaauaccauaagaagaaucagaauguaccauaagaaaucagaugcaaagcacguuaa

SEQ ID NO: 375016 - RNA, 60 nt, Homo Sapiens
uggcuacacccaggggggccgcagucucgaccauaagagacuggggucuauuucaccccu

SEQ ID NO: 375017 - RNA, 60 nt, Homo Sapiens
auaccgcagaccaaauggcugcucagacaaccauaagagaaccaauaucugccuuaguca

SEQ ID NO: 375018 - RNA, 64 nt, Homo Sapiens
acagucccaacaagcaggcuucugagagcccguggccgcacacuggccgccacggaaaagcagu

SEQ ID NO: 375019 - RNA, 64 nt, Homo Sapiens
cacagugccuaacccuagaaaagccaugucuucagccgcacaugcucaggcagcuaagggagga

SEQ ID NO: 375020 - RNA, 64 nt, Homo Sapiens
gcguguguguguguggcggggggugcugagggaggggagugagucacaggagccugucccccaa

SEQ ID NO: 375021 - RNA, 64 nt, Homo Sapiens
ccucuguggguuggucuucagccagcauucuggugggagugacuggcauuaacaagacuggaaa

SEQ ID NO: 375022 - RNA, 64 nt, Homo Sapiens
agaguugaauagcuuuucuucugcaaugggaguugggagugaugcguuugauucugcccacagg

SEQ ID NO: 375023 - RNA, 64 nt, Homo Sapiens
gccaauccuccauucuuccucuccagauauuuuugggagugacaaacauucucucauccuacuu

SEQ ID NO: 375024 - RNA, 64 nt, Homo Sapiens
acacuugauaccagacucugaaagugaugugacagggagugaagauaaugaaaguguugggaaa

SEQ ID NO: 375025 - RNA, 64 nt, Homo Sapiens
agugccuauuguugaaaagugaacugagauggaggggagugaaccugccugaucacugaauaaa

SEQ ID NO: 375026 - RNA, 64 nt, Homo Sapiens
ucuccaugguuccugcuuugugugagguggaugggggagugaaagguggaugggggagugaaau

SEQ ID NO: 375027 - RNA, 64 nt, Homo Sapiens
uugugagguggaugggggagugugagguggaugggggagugaaaaugugcuagauuaauuucau

SEQ ID NO: 375028 - RNA, 64 nt, Homo Sapiens
ggccuuugugcccaacuccaacaccaugaagacagggagugaggcuguuggcagccaagaaccc

SEQ ID NO: 375029 - RNA, 64 nt, Homo Sapiens
uaagcaauggugucuggaguucucugugugagaggggagugauuugcacuugccagggguuuuc

SEQ ID NO: 375030 - RNA, 64 nt, Homo Sapiens
gaaggacauugcggacagccacggccaggccagagggagugacagaggcagccccauucugccu

SEQ ID NO: 375031 - RNA, 64 nt, Homo Sapiens
guuugccucugccucugacacacagcucuguccugggagugagcugguuuuuagcggagacgga

SEQ ID NO: 375032 - RNA, 64 nt, Homo Sapiens
ugaguaauucagggaagagaggacauacaagauggggagugagauuuguuugagagauuuccca

SEQ ID NO: 375033 - RNA, 64 nt, Homo Sapiens
acaaucagaacuuugagagugugacaucauucaagggagugaagagggaucauugaggcuucug

SEQ ID NO: 375034 - RNA, 64 nt, Homo Sapiens
ggccaggccuuguuuuguuuuccccacaaacugugggagugauuaugguucuguggacauauga

SEQ ID NO: 375035 - RNA, 64 nt, Homo Sapiens
uuggggacuuccuucgucaggccgcuggaacugagggagugagccaaacgccuucacuggauca

SEQ ID NO: 375036 - RNA, 64 nt, Homo Sapiens
cagaggggcugugccgugcuagaguccucagggagggagugaccucgacccuggcugugcugca

SEQ ID NO: 375037 - RNA, 64 nt, Homo Sapiens
caaggcaggggaggcucagcauggaaugaaacaggggagugagggacacaaggaggugggaagu

SEQ ID NO: 375038 - RNA, 64 nt, Homo Sapiens
agaauccaggcuggcagagcguccccugcugguugggagugaaggccaguguugucacugagug

SEQ ID NO: 375039 - RNA, 54 nt, Homo Sapiens
cagccagaagugggggcagagcaggggagugaggaauucaaaaucaagcuuuga

SEQ ID NO: 375040 - RNA, 64 nt, Homo Sapiens; identical to SEQ ID NO: 235822

SEQ ID NO: 375041 - RNA, 64 nt, Homo Sapiens; identical to SEQ ID NO: 235823

SEQ ID NO: 375042 - RNA, 64 nt, Homo Sapiens; identical to SEQ ID NO: 235824

SEQ ID NO: 375043 - RNA, 64 nt, Homo Sapiens; identical to SEQ ID NO: 235825

SEQ ID NO: 375044 - RNA, 64 nt, Homo Sapiens; identical to SEQ ID NO: 235826

SEQ ID NO: 375045 - RNA, 64 nt, Homo Sapiens; identical to SEQ ID NO: 235827

SEQ ID NO: 375046 - RNA, 64 nt, Homo Sapiens; identical to SEQ ID NO: 235828

SEQ ID NO: 375047 - RNA, 64 nt, Homo Sapiens; identical to SEQ ID NO: 235829

SEQ ID NO: 375048 - RNA, 64 nt, Homo Sapiens; identical to SEQ ID NO: 235830

SEQ ID NO: 375049 - RNA, 64 nt, Homo Sapiens; identical to SEQ ID NO: 235831

SEQ ID NO: 375050 - RNA, 64 nt, Homo Sapiens; identical to SEQ ID NO: 235832

SEQ ID NO: 375051 - RNA, 64 nt, Homo Sapiens; identical to SEQ ID NO: 235833

SEQ ID NO: 375052 - RNA, 64 nt, Homo Sapiens; identical to SEQ ID NO: 235834

SEQ ID NO: 375053 - RNA, 64 nt, Homo Sapiens; identical to SEQ ID NO: 235835

SEQ ID NO: 375054 - RNA, 64 nt, Homo Sapiens; identical to SEQ ID NO: 235836

SEQ ID NO: 375055 - RNA, 64 nt, Homo Sapiens; identical to SEQ ID NO: 235837

SEQ ID NO: 375056 - RNA, 64 nt, Homo Sapiens; identical to SEQ ID NO: 235838

SEQ ID NO: 375057 - RNA, 64 nt, Homo Sapiens; identical to SEQ ID NO: 235839

SEQ ID NO: 375058 - RNA, 64 nt, Homo Sapiens; identical to SEQ ID NO: 235840

SEQ ID NO: 375059 - RNA, 64 nt, Homo Sapiens; identical to SEQ ID NO: 235841

SEQ ID NO: 375060 - RNA, 64 nt, Homo Sapiens; identical to SEQ ID NO: 235842

SEQ ID NO: 375061 - RNA, 64 nt, Homo Sapiens; identical to SEQ ID NO: 235843

SEQ ID NO: 375062 - RNA, 64 nt, Homo Sapiens; identical to SEQ ID NO: 235844

SEQ ID NO: 375063 - RNA, 64 nt, Homo Sapiens; identical to SEQ ID NO: 235845

SEQ ID NO: 375064 - RNA, 55 nt, Homo Sapiens; identical to SEQ ID NO: 235846

SEQ ID NO: 375065 - RNA, 64 nt, Homo Sapiens; identical to SEQ ID NO: 235847

SEQ ID NO: 375066 - RNA, 64 nt, Homo Sapiens; identical to SEQ ID NO: 235848

SEQ ID NO: 375067 - RNA, 64 nt, Homo Sapiens; identical to SEQ ID NO: 235849

SEQ ID NO: 375068 - RNA, 64 nt, Homo Sapiens; identical to SEQ ID NO: 235850

SEQ ID NO: 375069 - RNA, 64 nt, Homo Sapiens; identical to SEQ ID NO: 235851

SEQ ID NO: 375070 - RNA, 64 nt, Homo Sapiens; identical to SEQ ID NO: 235852

SEQ ID NO: 375071 - RNA, 64 nt, Homo Sapiens; identical to SEQ ID NO: 235853

SEQ ID NO: 375072 - RNA, 64 nt, Homo Sapiens; identical to SEQ ID NO: 235854

SEQ ID NO: 375073 - RNA, 64 nt, Homo Sapiens; identical to SEQ ID NO: 235855

SEQ ID NO: 375074 - RNA, 64 nt, Homo Sapiens; identical to SEQ ID NO: 235856

SEQ ID NO: 375075 - RNA, 64 nt, Homo Sapiens; identical to SEQ ID NO: 235857

SEQ ID NO: 375076 - RNA, 64 nt, Homo Sapiens; identical to SEQ ID NO: 235858

SEQ ID NO: 375077 - RNA, 64 nt, Homo Sapiens; identical to SEQ ID NO: 235859

SEQ ID NO: 375078 - RNA, 64 nt, Homo Sapiens; identical to SEQ ID NO: 235860

SEQ ID NO: 375079 - RNA, 64 nt, Homo Sapiens; identical to SEQ ID NO: 235861

SEQ ID NO: 375080 - RNA, 64 nt, Homo Sapiens; identical to SEQ ID NO: 235862

SEQ ID NO: 375081 - RNA, 64 nt, Homo Sapiens; identical to SEQ ID NO: 235863

SEQ ID NO: 375082 - RNA, 64 nt, Homo Sapiens; identical to SEQ ID NO: 235864

SEQ ID NO: 375083 - RNA, 64 nt, Homo Sapiens; identical to SEQ ID NO: 235865

SEQ ID NO: 375084 - RNA, 64 nt, Homo Sapiens; identical to SEQ ID NO: 235866

SEQ ID NO: 375085 - RNA, 64 nt, Homo Sapiens; identical to SEQ ID NO: 235867

SEQ ID NO: 375086 - RNA, 64 nt, Homo Sapiens; identical to SEQ ID NO: 235868

SEQ ID NO: 375087 - RNA, 64 nt, Homo Sapiens; identical to SEQ ID NO: 235869

SEQ ID NO: 375088 - RNA, 64 nt, Homo Sapiens; identical to SEQ ID NO: 235870

SEQ ID NO: 375089 - RNA, 64 nt, Homo Sapiens; identical to SEQ ID NO: 235871

SEQ ID NO: 375090 - RNA, 64 nt, Homo Sapiens; identical to SEQ ID NO: 235872

SEQ ID NO: 375091 - RNA, 64 nt, Homo Sapiens; identical to SEQ ID NO: 235873

SEQ ID NO: 375092 - RNA, 64 nt, Homo Sapiens; identical to SEQ ID NO: 235874

SEQ ID NO: 375093 - RNA, 64 nt, Homo Sapiens; identical to SEQ ID NO: 235875

SEQ ID NO: 375094 - RNA, 64 nt, Homo Sapiens; identical to SEQ ID NO: 235876

SEQ ID NO: 375095 - RNA, 64 nt, Homo Sapiens; identical to SEQ ID NO: 235877

SEQ ID NO: 375096 - RNA, 64 nt, Homo Sapiens; identical to SEQ ID NO: 235878

SEQ ID NO: 375097 - RNA, 64 nt, Homo Sapiens; identical to SEQ ID NO: 235879

SEQ ID NO: 375098 - RNA, 64 nt, Homo Sapiens; identical to SEQ ID NO: 235880

SEQ ID NO: 375099 - RNA, 64 nt, Homo Sapiens; identical to SEQ ID NO: 235881

SEQ ID NO: 375100 - RNA, 64 nt, Homo Sapiens; identical to SEQ ID NO: 235882

SEQ ID NO: 375101 - RNA, 64 nt, Homo Sapiens; identical to SEQ ID NO: 235883

SEQ ID NO: 375102 - RNA, 64 nt, Homo Sapiens; identical to SEQ ID NO: 235884

SEQ ID NO: 375103 - RNA, 64 nt, Homo Sapiens; identical to SEQ ID NO: 235885

SEQ ID NO: 375104 - RNA, 64 nt, Homo Sapiens; identical to SEQ ID NO: 235886

SEQ ID NO: 375105 - RNA, 64 nt, Homo Sapiens
ggauguggggaaguuaggaaucuggguuuuggggggacgcuauacuggcucuggacaggcacua

SEQ ID NO: 375106 - RNA, 64 nt, Homo Sapiens
ucacaaauggugugcuauucuugggcaagaacagggacgcuagggccuuccuuccaccggcgug

SEQ ID NO: 375107 - RNA, 64 nt, Homo Sapiens
uuacaauaacuagacaaagguggugguaaaucuuggacgcuaccgaccaucuguaaucaugaug

SEQ ID NO: 375108 - RNA, 64 nt, Homo Sapiens
uuguuuaucuuuuguuuauugcgcauauaggacaggacgcuagguaauugagucaucugguaga

SEQ ID NO: 375109 - RNA, 64 nt, Homo Sapiens
aucuuucuccccgcuuccccagucuuuaaacauuggacgcuauuuacucagcuacccaguagag

SEQ ID NO: 375110 - RNA, 64 nt, Homo Sapiens
gaaaguggaaugaaucugaacccagaaguggaagggacgcuaauucggguacccauuccccagu

SEQ ID NO: 375111 - RNA, 64 nt, Homo Sapiens
uugcuuuucuggcacaggaaaagaaagagauaagggacgcuaccagggugguauucugguaaag

SEQ ID NO: 375112 - RNA, 64 nt, Homo Sapiens
uuguuagcacuucaucuacacagucaaauucacaggacgcuaagauagacuucgagaguugugg

SEQ ID NO: 375113 - RNA, 64 nt, Homo Sapiens
aucugcugcccagggaagcgcaggcgccugcuagggacgcuauggacaccgugaguccaaggcg

SEQ ID NO: 375114 - RNA, 64 nt, Homo Sapiens
cuacuauaaguucauccagaaagccaugaaagagggacgcuacacuguccuggcagaaaacaaa

SEQ ID NO: 375115 - RNA, 64 nt, Homo Sapiens
ccucaugcccguuuuggguguuugcgaggaugagggacgcuaugucaagagccugagugggugg

SEQ ID NO: 375116 - RNA, 64 nt, Homo Sapiens
gaaagugcugagugucccgacccagugagauggaggacgcuagaggcuuccgggcuguccucug

SEQ ID NO: 375117 - RNA, 64 nt, Homo Sapiens
uguuuuccaugaguccccuguuuguuucugaaagggacgcuacccgggaagggggcugggacau

SEQ ID NO: 375118 - RNA, 64 nt, Homo Sapiens
acuuauuguaaagaccuugggcuguguuggaccuggacgcuauaguggcuuuguaugcaaauau

SEQ ID NO: 375119 - RNA, 64 nt, Homo Sapiens
uaugagggaggcguguagcucaaggaauuucccuggacgcuaauuuccgucuguccuuugucca

SEQ ID NO: 375120 - RNA, 64 nt, Homo Sapiens
cuauuuuaaugauuggauaugagcacugggaaggggacgcuaacuccccuugauaaagucucgg

SEQ ID NO: 375121 - RNA, 64 nt, Homo Sapiens
uaauaggauugcucauaccacaaaacaacuggaaggacgcuaaaaaaugugcgagcuaauaugg

SEQ ID NO: 375122 - RNA, 64 nt, Homo Sapiens
uucuauuuuuguuguaauguccucgcggcucuggggacgcuaaaagaaccgggccugccccgcc

SEQ ID NO: 375123 - RNA, 64 nt, Homo Sapiens
gcaggcagcacaccuggaugugguuuggccuugaggacgcuagggcuggggguggguggguggg

SEQ ID NO: 375124 - RNA, 64 nt, Homo Sapiens
aaaacugugagacaugcuauggaagcugaaugccggacgcuagcacaguuuacuuuuucccuuu

SEQ ID NO: 375125 - RNA, 64 nt, Homo Sapiens
agggucauguguuaacuauaaaaaacacuggcugggacgcuagauccaaagaacagaggucagg

SEQ ID NO: 375126 - RNA, 64 nt, Homo Sapiens; identical to SEQ ID NO: 58312

SEQ ID NO: 375127 - RNA, 64 nt, Homo Sapiens; identical to SEQ ID NO: 58313

SEQ ID NO: 375128 - RNA, 64 nt, Homo Sapiens; identical to SEQ ID NO: 58314

SEQ ID NO: 375129 - RNA, 64 nt, Homo Sapiens; identical to SEQ ID NO: 58315

SEQ ID NO: 375130 - RNA, 64 nt, Homo Sapiens; identical to SEQ ID NO: 58316

SEQ ID NO: 375131 - RNA, 64 nt, Homo Sapiens; identical to SEQ ID NO: 58317

SEQ ID NO: 375132 - RNA, 64 nt, Homo Sapiens; identical to SEQ ID NO: 58318

SEQ ID NO: 375133 - RNA, 64 nt, Homo Sapiens; identical to SEQ ID NO: 58319

SEQ ID NO: 375134 - RNA, 64 nt, Homo Sapiens; identical to SEQ ID NO: 58320

SEQ ID NO: 375135 - RNA, 64 nt, Homo Sapiens; identical to SEQ ID NO: 58321

SEQ ID NO: 375136 - RNA, 64 nt, Homo Sapiens; identical to SEQ ID NO: 58322

SEQ ID NO: 375137 - RNA, 64 nt, Homo Sapiens; identical to SEQ ID NO: 58323

SEQ ID NO: 375138 - RNA, 64 nt, Homo Sapiens; identical to SEQ ID NO: 58324

SEQ ID NO: 375139 - RNA, 64 nt, Homo Sapiens; identical to SEQ ID NO: 58325

SEQ ID NO: 375140 - RNA, 64 nt, Homo Sapiens; identical to SEQ ID NO: 58326

SEQ ID NO: 375141 - RNA, 64 nt, Homo Sapiens; identical to SEQ ID NO: 58327

SEQ ID NO: 375142 - RNA, 64 nt, Homo Sapiens; identical to SEQ ID NO: 58328

SEQ ID NO: 375143 - RNA, 64 nt, Homo Sapiens; identical to SEQ ID NO: 58329

SEQ ID NO: 375144 - RNA, 64 nt, Homo Sapiens; identical to SEQ ID NO: 58330

SEQ ID NO: 375145 - RNA, 64 nt, Homo Sapiens; identical to SEQ ID NO: 58331

SEQ ID NO: 375146 - RNA, 64 nt, Homo Sapiens; identical to SEQ ID NO: 58332

SEQ ID NO: 375147 - RNA, 64 nt, Homo Sapiens; identical to SEQ ID NO: 58333

SEQ ID NO: 375148 - RNA, 64 nt, Homo Sapiens; identical to SEQ ID NO: 58334

SEQ ID NO: 375149 - RNA, 64 nt, Homo Sapiens; identical to SEQ ID NO: 58335

SEQ ID NO: 375150 - RNA, 64 nt, Homo Sapiens; identical to SEQ ID NO: 58336

SEQ ID NO: 375151 - RNA, 64 nt, Homo Sapiens; identical to SEQ ID NO: 58337

SEQ ID NO: 375152 - RNA, 64 nt, Homo Sapiens; identical to SEQ ID NO: 58338

SEQ ID NO: 375153 - RNA, 64 nt, Homo Sapiens; identical to SEQ ID NO: 58339

SEQ ID NO: 375154 - RNA, 64 nt, Homo Sapiens; identical to SEQ ID NO: 58340

SEQ ID NO: 375155 - RNA, 64 nt, Homo Sapiens; identical to SEQ ID NO: 58341

SEQ ID NO: 375156 - RNA, 64 nt, Homo Sapiens; identical to SEQ ID NO: 58342

SEQ ID NO: 375157 - RNA, 64 nt, Homo Sapiens; identical to SEQ ID NO: 58343

SEQ ID NO: 375158 - RNA, 64 nt, Homo Sapiens; identical to SEQ ID NO: 58344

SEQ ID NO: 375159 - RNA, 64 nt, Homo Sapiens; identical to SEQ ID NO: 58345

SEQ ID NO: 375160 - RNA, 64 nt, Homo Sapiens; identical to SEQ ID NO: 58346

SEQ ID NO: 375161 - RNA, 64 nt, Homo Sapiens; identical to SEQ ID NO: 58347

SEQ ID NO: 375162 - RNA, 64 nt, Homo Sapiens; identical to SEQ ID NO: 58348

SEQ ID NO: 375163 - RNA, 64 nt, Homo Sapiens; identical to SEQ ID NO: 58349

SEQ ID NO: 375164 - RNA, 64 nt, Homo Sapiens; identical to SEQ ID NO: 58350

SEQ ID NO: 375165 - RNA, 64 nt, Homo Sapiens; identical to SEQ ID NO: 58351

SEQ ID NO: 375166 - RNA, 64 nt, Homo Sapiens; identical to SEQ ID NO: 58352

SEQ ID NO: 375167 - RNA, 64 nt, Homo Sapiens; identical to SEQ ID NO: 58353

SEQ ID NO: 375168 - RNA, 64 nt, Homo Sapiens; identical to SEQ ID NO: 58354

SEQ ID NO: 375169 - RNA, 64 nt, Homo Sapiens; identical to SEQ ID NO: 58355

SEQ ID NO: 375170 - RNA, 64 nt, Homo Sapiens; identical to SEQ ID NO: 58356

SEQ ID NO: 375171 - RNA, 64 nt, Homo Sapiens; identical to SEQ ID NO: 58357

SEQ ID NO: 375172 - RNA, 64 nt, Homo Sapiens; identical to SEQ ID NO: 58358

SEQ ID NO: 375173 - RNA, 64 nt, Homo Sapiens; identical to SEQ ID NO: 58359

SEQ ID NO: 375174 - RNA, 64 nt, Homo Sapiens; identical to SEQ ID NO: 58360

SEQ ID NO: 375175 - RNA, 64 nt, Homo Sapiens; identical to SEQ ID NO: 58361

SEQ ID NO: 375176 - RNA, 64 nt, Homo Sapiens; identical to SEQ ID NO: 58362

SEQ ID NO: 375177 - RNA, 64 nt, Homo Sapiens; identical to SEQ ID NO: 58363

SEQ ID NO: 375178 - RNA, 64 nt, Homo Sapiens; identical to SEQ ID NO: 58364

SEQ ID NO: 375179 - RNA, 64 nt, Homo Sapiens; identical to SEQ ID NO: 58365

SEQ ID NO: 375180 - RNA, 64 nt, Homo Sapiens; identical to SEQ ID NO: 58366

SEQ ID NO: 375181 - RNA, 64 nt, Homo Sapiens; identical to SEQ ID NO: 58367

SEQ ID NO: 375182 - RNA, 64 nt, Homo Sapiens; identical to SEQ ID NO: 58368

SEQ ID NO: 375183 - RNA, 64 nt, Homo Sapiens; identical to SEQ ID NO: 58369

SEQ ID NO: 375184 - RNA, 64 nt, Homo Sapiens; identical to SEQ ID NO: 58370

SEQ ID NO: 375185 - RNA, 64 nt, Homo Sapiens; identical to SEQ ID NO: 58371

SEQ ID NO: 375186 - RNA, 64 nt, Homo Sapiens; identical to SEQ ID NO: 58372

SEQ ID NO: 375187 - RNA, 64 nt, Homo Sapiens; identical to SEQ ID NO: 58373

SEQ ID NO: 375188 - RNA, 64 nt, Homo Sapiens; identical to SEQ ID NO: 58374

SEQ ID NO: 375189 - RNA, 64 nt, Homo Sapiens; identical to SEQ ID NO: 58375

SEQ ID NO: 375190 - RNA, 64 nt, Homo Sapiens; identical to SEQ ID NO: 58376

SEQ ID NO: 375191 - RNA, 64 nt, Homo Sapiens; identical to SEQ ID NO: 58377

SEQ ID NO: 375192 - RNA, 64 nt, Homo Sapiens; identical to SEQ ID NO: 58378

SEQ ID NO: 375193 - RNA, 64 nt, Homo Sapiens; identical to SEQ ID NO: 58379

SEQ ID NO: 375194 - RNA, 64 nt, Homo Sapiens; identical to SEQ ID NO: 58380

SEQ ID NO: 375195 - RNA, 64 nt, Homo Sapiens; identical to SEQ ID NO: 58381

SEQ ID NO: 375196 - RNA, 64 nt, Homo Sapiens; identical to SEQ ID NO: 58382

SEQ ID NO: 375197 - RNA, 64 nt, Homo Sapiens; identical to SEQ ID NO: 58383

SEQ ID NO: 375198 - RNA, 64 nt, Homo Sapiens; identical to SEQ ID NO: 58384

SEQ ID NO: 375199 - RNA, 64 nt, Homo Sapiens; identical to SEQ ID NO: 58385

SEQ ID NO: 375200 - RNA, 64 nt, Homo Sapiens; identical to SEQ ID NO: 58386

SEQ ID NO: 375201 - RNA, 64 nt, Homo Sapiens; identical to SEQ ID NO: 58387

SEQ ID NO: 375202 - RNA, 64 nt, Homo Sapiens; identical to SEQ ID NO: 58388

SEQ ID NO: 375203 - RNA, 64 nt, Homo Sapiens; identical to SEQ ID NO: 58389

SEQ ID NO: 375204 - RNA, 64 nt, Homo Sapiens; identical to SEQ ID NO: 58390

SEQ ID NO: 375205 - RNA, 64 nt, Homo Sapiens; identical to SEQ ID NO: 58391

SEQ ID NO: 375206 - RNA, 64 nt, Homo Sapiens; identical to SEQ ID NO: 58392

SEQ ID NO: 375207 - RNA, 64 nt, Homo Sapiens; identical to SEQ ID NO: 58393

SEQ ID NO: 375208 - RNA, 64 nt, Homo Sapiens; identical to SEQ ID NO: 58394

SEQ ID NO: 375209 - RNA, 64 nt, Homo Sapiens; identical to SEQ ID NO: 58395

SEQ ID NO: 375210 - RNA, 64 nt, Homo Sapiens; identical to SEQ ID NO: 58396

SEQ ID NO: 375211 - RNA, 64 nt, Homo Sapiens; identical to SEQ ID NO: 58397

SEQ ID NO: 375212 - RNA, 64 nt, Homo Sapiens; identical to SEQ ID NO: 58398

SEQ ID NO: 375213 - RNA, 64 nt, Homo Sapiens; identical to SEQ ID NO: 58399

SEQ ID NO: 375214 - RNA, 64 nt, Homo Sapiens; identical to SEQ ID NO: 58400

SEQ ID NO: 375215 - RNA, 64 nt, Homo Sapiens; identical to SEQ ID NO: 58401

SEQ ID NO: 375216 - RNA, 64 nt, Homo Sapiens; identical to SEQ ID NO: 58402

SEQ ID NO: 375217 - RNA, 64 nt, Homo Sapiens; identical to SEQ ID NO: 58403

SEQ ID NO: 375218 - RNA, 64 nt, Homo Sapiens; identical to SEQ ID NO: 58404

SEQ ID NO: 375219 - RNA, 64 nt, Homo Sapiens; identical to SEQ ID NO: 58405

SEQ ID NO: 375220 - RNA, 64 nt, Homo Sapiens; identical to SEQ ID NO: 58406

SEQ ID NO: 375221 - RNA, 64 nt, Homo Sapiens; identical to SEQ ID NO: 58407

SEQ ID NO: 375222 - RNA, 64 nt, Homo Sapiens; identical to SEQ ID NO: 58408

SEQ ID NO: 375223 - RNA, 64 nt, Homo Sapiens; identical to SEQ ID NO: 58409

SEQ ID NO: 375224 - RNA, 64 nt, Homo Sapiens; identical to SEQ ID NO: 58410

SEQ ID NO: 375225 - RNA, 64 nt, Homo Sapiens; identical to SEQ ID NO: 58411

SEQ ID NO: 375226 - RNA, 64 nt, Homo Sapiens; identical to SEQ ID NO: 58412

SEQ ID NO: 375227 - RNA, 64 nt, Homo Sapiens; identical to SEQ ID NO: 58413

SEQ ID NO: 375228 - RNA, 64 nt, Homo Sapiens; identical to SEQ ID NO: 58414

SEQ ID NO: 375229 - RNA, 64 nt, Homo Sapiens; identical to SEQ ID NO: 58415

SEQ ID NO: 375230 - RNA, 64 nt, Homo Sapiens; identical to SEQ ID NO: 58416

SEQ ID NO: 375231 - RNA, 64 nt, Homo Sapiens; identical to SEQ ID NO: 58417

SEQ ID NO: 375232 - RNA, 64 nt, Homo Sapiens; identical to SEQ ID NO: 58418

SEQ ID NO: 375233 - RNA, 64 nt, Homo Sapiens; identical to SEQ ID NO: 58419

SEQ ID NO: 375234 - RNA, 64 nt, Homo Sapiens; identical to SEQ ID NO: 58420

SEQ ID NO: 375235 - RNA, 64 nt, Homo Sapiens; identical to SEQ ID NO: 58421

SEQ ID NO: 375236 - RNA, 64 nt, Homo Sapiens; identical to SEQ ID NO: 58422

SEQ ID NO: 375237 - RNA, 64 nt, Homo Sapiens; identical to SEQ ID NO: 58423

SEQ ID NO: 375238 - RNA, 64 nt, Homo Sapiens; identical to SEQ ID NO: 58424

SEQ ID NO: 375239 - RNA, 64 nt, Homo Sapiens; identical to SEQ ID NO: 58425

SEQ ID NO: 375240 - RNA, 64 nt, Homo Sapiens; identical to SEQ ID NO: 58426

SEQ ID NO: 375241 - RNA, 64 nt, Homo Sapiens; identical to SEQ ID NO: 58427

SEQ ID NO: 375242 - RNA, 64 nt, Homo Sapiens; identical to SEQ ID NO: 58428

SEQ ID NO: 375243 - RNA, 64 nt, Homo Sapiens; identical to SEQ ID NO: 58429

SEQ ID NO: 375244 - RNA, 64 nt, Homo Sapiens; identical to SEQ ID NO: 58430

SEQ ID NO: 375245 - RNA, 64 nt, Homo Sapiens; identical to SEQ ID NO: 58431

SEQ ID NO: 375246 - RNA, 64 nt, Homo Sapiens; identical to SEQ ID NO: 58432

SEQ ID NO: 375247 - RNA, 64 nt, Homo Sapiens; identical to SEQ ID NO: 58433

SEQ ID NO: 375248 - RNA, 64 nt, Homo Sapiens; identical to SEQ ID NO: 58434

SEQ ID NO: 375249 - RNA, 64 nt, Homo Sapiens; identical to SEQ ID NO: 58435

SEQ ID NO: 375250 - RNA, 50 nt, Homo Sapiens; identical to SEQ ID NO: 58436

SEQ ID NO: 375251 - RNA, 64 nt, Homo Sapiens; identical to SEQ ID NO: 58437

SEQ ID NO: 375252 - RNA, 64 nt, Homo Sapiens; identical to SEQ ID NO: 58438

SEQ ID NO: 375253 - RNA, 64 nt, Homo Sapiens; identical to SEQ ID NO: 58439

SEQ ID NO: 375254 - RNA, 64 nt, Homo Sapiens; identical to SEQ ID NO: 58440

SEQ ID NO: 375255 - RNA, 64 nt, Homo Sapiens; identical to SEQ ID NO: 58441

SEQ ID NO: 375256 - RNA, 64 nt, Homo Sapiens; identical to SEQ ID NO: 58442

SEQ ID NO: 375257 - RNA, 64 nt, Homo Sapiens; identical to SEQ ID NO: 58443

SEQ ID NO: 375258 - RNA, 64 nt, Homo Sapiens; identical to SEQ ID NO: 58444

SEQ ID NO: 375259 - RNA, 64 nt, Homo Sapiens; identical to SEQ ID NO: 58445

SEQ ID NO: 375260 - RNA, 64 nt, Homo Sapiens; identical to SEQ ID NO: 58446

SEQ ID NO: 375261 - RNA, 64 nt, Homo Sapiens; identical to SEQ ID NO: 58447

SEQ ID NO: 375262 - RNA, 64 nt, Homo Sapiens; identical to SEQ ID NO: 58448

SEQ ID NO: 375263 - RNA, 64 nt, Homo Sapiens; identical to SEQ ID NO: 58449

SEQ ID NO: 375264 - RNA, 64 nt, Homo Sapiens; identical to SEQ ID NO: 58450

SEQ ID NO: 375265 - RNA, 64 nt, Homo Sapiens; identical to SEQ ID NO: 58451

SEQ ID NO: 375266 - RNA, 64 nt, Homo Sapiens; identical to SEQ ID NO: 58452

SEQ ID NO: 375267 - RNA, 64 nt, Homo Sapiens; identical to SEQ ID NO: 58453

SEQ ID NO: 375268 - RNA, 64 nt, Homo Sapiens; identical to SEQ ID NO: 58454

SEQ ID NO: 375269 - RNA, 64 nt, Homo Sapiens; identical to SEQ ID NO: 58455

SEQ ID NO: 375270 - RNA, 64 nt, Homo Sapiens; identical to SEQ ID NO: 58456

SEQ ID NO: 375271 - RNA, 64 nt, Homo Sapiens; identical to SEQ ID NO: 58457

SEQ ID NO: 375272 - RNA, 64 nt, Homo Sapiens; identical to SEQ ID NO: 58458

SEQ ID NO: 375273 - RNA, 64 nt, Homo Sapiens; identical to SEQ ID NO: 58459

SEQ ID NO: 375274 - RNA, 64 nt, Homo Sapiens; identical to SEQ ID NO: 58460

SEQ ID NO: 375275 - RNA, 64 nt, Homo Sapiens; identical to SEQ ID NO: 58461

SEQ ID NO: 375276 - RNA, 64 nt, Homo Sapiens; identical to SEQ ID NO: 58462

SEQ ID NO: 375277 - RNA, 64 nt, Homo Sapiens; identical to SEQ ID NO: 58463

SEQ ID NO: 375278 - RNA, 64 nt, Homo Sapiens; identical to SEQ ID NO: 58464

SEQ ID NO: 375279 - RNA, 64 nt, Homo Sapiens; identical to SEQ ID NO: 58465

SEQ ID NO: 375280 - RNA, 64 nt, Homo Sapiens; identical to SEQ ID NO: 58466

SEQ ID NO: 375281 - RNA, 64 nt, Homo Sapiens; identical to SEQ ID NO: 58467

SEQ ID NO: 375282 - RNA, 63 nt, Homo Sapiens
ggcacgugccuguagucccagcuacuugggaggcugaggcaggagaaucacuugaccccaggu

SEQ ID NO: 375283 - RNA, 63 nt, Homo Sapiens
gccgcauaacuauaaucccagcuacuugggaggcugaggcaggagaaucgcuugaacccggga

SEQ ID NO: 375284 - RNA, 63 nt, Homo Sapiens
ggugggcuccuguagucccagcuacuugggaggcugaggcaggagaaucgcuugaaccuggga

SEQ ID NO: 375285 - RNA, 63 nt, Homo Sapiens
ggcaugugccuguggucccagcuacucaggaggcugaggcaggaggaucacuugagcacagga

SEQ ID NO: 375286 - RNA, 63 nt, Homo Sapiens
ggcucacgccuguaaucccaaaacuuuggaaggcugaggcagguggaucaccugaggucagga

SEQ ID NO: 375287 - RNA, 63 nt, Homo Sapiens
ggcacacgccuguagucccaguuacuugggaggcugaggcaggagaauugcuugaaccuggga

SEQ ID NO: 375288 - RNA, 63 nt, Homo Sapiens
ggcaccugccuguaaucccagcuacuugggaggcugaggcaggagaaucgcuugaacccggga

SEQ ID NO: 375289 - RNA, 63 nt, Homo Sapiens
gguacaugccuguagucccagcuacuugggaggcugaggcaggagaauugcuugaacccugga

SEQ ID NO: 375290 - RNA, 63 nt, Homo Sapiens
cuaaauugucgaaggucucccaggagcucuguacugaggcagacacagaaagacacaaaacgg

SEQ ID NO: 375291 - RNA, 63 nt, Homo Sapiens
agaauugcuugaaccggggagcuacucgggaggcugaggcaggggcaggagccuguaguccca

SEQ ID NO: 375292 - RNA, 63 nt, Homo Sapiens
agaauggcaugaaccugggagcuacuugggaggcugaggcaggggcgggcgccuguaauccca

SEQ ID NO: 375293 - RNA, 63 nt, Homo Sapiens
agaauggcgugaauccgggagcuacucagggggcugaggcaggcgugggcaccuguaguccca

SEQ ID NO: 375294 - RNA, 63 nt, Homo Sapiens
agaaucacuuggaccugggagcuauucaggaggcugaggcaggggugggugccuguaauccca

SEQ ID NO: 375295 - RNA, 63 nt, Homo Sapiens
cagaucaccuggggucaggaacacuuaggguggcugaggcaggggcucaugccuguaauccca

SEQ ID NO: 375296 - RNA, 63 nt, Homo Sapiens
ugcagucacccacacucugguccagccagggggcugaggcaccuuuguguguggcuagcuguu

SEQ ID NO: 375297 - RNA, 63 nt, Homo Sapiens
acccaggagcuccaagaaagcauuucaugggggcugaggcagacaagucccaggcaaugccag

SEQ ID NO: 375298 - RNA, 63 nt, Homo Sapiens
gguacgcuaccugggguagcguggccccagcaccugaggcaggccccaggugcugaaauggcu

SEQ ID NO: 375299 - RNA, 63 nt, Homo Sapiens
agaauugcuugagcccaagagcuacuugggaggcugaggcaggggcacacgccuguaguccca

SEQ ID NO: 375300 - RNA, 63 nt, Homo Sapiens
agaaucgcuugaaccugggagcuacuugggaggcugaggcagggguggguaccuauaauccca

SEQ ID NO: 375301 - RNA, 63 nt, Homo Sapiens
agaauugcuugaacccaggagcuacucaggaggcugaggcaggggcguacgccuguaguccca

SEQ ID NO: 375302 - RNA, 63 nt, Homo Sapiens
agaaucgcuugaacccgggagcuacucaggaggcugaggcaggggugggcgccuguaauccca

SEQ ID NO: 375303 - RNA, 63 nt, Homo Sapiens
gggauuucucaggucauuuguacugucccagagcugaggcaagcucccuacagcuguaggaac

SEQ ID NO: 375304 - RNA, 63 nt, Homo Sapiens
cggaucaccugaggucaggaauaaucccagaggcugaggcagggggcgcaguggcucacgccu

SEQ ID NO: 375305 - RNA, 63 nt, Homo Sapiens
agaaucacuugaacccgggagcuacuugggaggcugaggcaggggcacgcaccaguaauccca

SEQ ID NO: 375306 - RNA, 63 nt, Homo Sapiens
agaaucgcuugaaccugggagauacucaggaggcugaggcaggggugcaugccuguaauccaa

SEQ ID NO: 375307 - RNA, 63 nt, Homo Sapiens
agaaucgcuugaaccugggagcuacuugggagacugaggcaggggcgggcaccuguaauccca

SEQ ID NO: 375308 - RNA, 63 nt, Homo Sapiens
uggaucgccugaggucaggagcacuuugggaggcugaggcaggggcucacaccuguaauccca

SEQ ID NO: 375309 - RNA, 63 nt, Homo Sapiens
ucccagcuacuguaaucucagcuacuugggaggcugaggcaggagaauugccucaaccgggag

SEQ ID NO: 375310 - RNA, 63 nt, Homo Sapiens
cuggguaugguggcucaccagcacuuugggaggcugaggcagguggaucucuugaggucggga

SEQ ID NO: 375311 - RNA, 63 nt, Homo Sapiens
ggugcaugccuguaauuccagcuacucgggaggcugaggcaagagaaucgcuugaauccggua

SEQ ID NO: 375312 - RNA, 63 nt, Homo Sapiens
gcagaucccuuguagucccagcuacucgggaggcugaggcaggagaauagcuugaacccggga

SEQ ID NO: 375313 - RNA, 51 nt, Homo Sapiens
aagacuguaccauguccuaagcugaggcaggcggcaggcgcggugcacagg

SEQ ID NO: 375314 - RNA, 63 nt, Homo Sapiens
ggugggcgccuguaaucccagccacuccagaggcugaggcaggagaaucgcuugaaccugcga

SEQ ID NO: 375315 - RNA, 63 nt, Homo Sapiens
ggggaaagaccugacagcuacuguguagaaaggcugaggcaacaggggaaguugaaggccagu

SEQ ID NO: 375316 - RNA, 63 nt, Homo Sapiens
gcucaagcuggggggugguggagggugagcuggcugaggcaucuuucuagcgauuguguggau

SEQ ID NO: 375317 - RNA, 63 nt, Homo Sapiens
agaauugcuugaauccgggagcuacuagauaggcugaggcagggacgugcaccuguaguccca

SEQ ID NO: 375318 - RNA, 63 nt, Homo Sapiens
agaauugcuugaacccaggcgcuacucaggaggcugaggcagagguacaugccuguaauccca

SEQ ID NO: 375319 - RNA, 63 nt, Homo Sapiens
agaauggcgugaacccgggagcuacuccggaggcugaggcaggggcacgugccuguaguccca

SEQ ID NO: 375320 - RNA, 63 nt, Homo Sapiens
cggaucacgaggucaggagagcacuuugggaggcugaggcaggggcucacgcuuguaauccca

SEQ ID NO: 375321 - RNA, 63 nt, Homo Sapiens
ggaauggcuugaacccaggagcuacucagggggcugaggcaggggcaggugccuguaauccca

SEQ ID NO: 375322 - RNA, 63 nt, Homo Sapiens
agaaucgcuugaaccugggagcuacuugggaggcugaggcaggggugcgugccuguaguccca

SEQ ID NO: 375323 - RNA, 63 nt, Homo Sapiens
ggcgcaugccuguaaucccagcuacuagagaggcugaggcaggagaaucacuugaaucccuga

SEQ ID NO: 375324 - RNA, 63 nt, Homo Sapiens
agagaggcugaggcaggagaaucacuugaaucccugaggcagagguugcagugagcugagauc

SEQ ID NO: 375325 - RNA, 63 nt, Homo Sapiens
agaauugcuugaacccaggagcuacucaggaggcugaggcaggggugggcacccguaauccca

SEQ ID NO: 375326 - RNA, 63 nt, Homo Sapiens
cagguuguuugagcccaggagcacuaugggaggcugaggcaagggcucacaccuauaauccca

SEQ ID NO: 375327 - RNA, 63 nt, Homo Sapiens
agaaucgcuugaaccugggagcuacucaggaggcugaggcaggggcaguugccuguaauccua

SEQ ID NO: 375328 - RNA, 63 nt, Homo Sapiens
ggcacgcgccuguaaucccagcuacucaagaggcugaggcacgagaaucacuugaacccggga

SEQ ID NO: 375329 - RNA, 63 nt, Homo Sapiens
ggggcgugccuguagucccauguacuugggaggcugaggcaggaaaauucuugaacccaggag

SEQ ID NO: 375330 - RNA, 63 nt, Homo Sapiens
agaaucgcuugaacccgggagcuacucgggaggcugaggcaggggcaggcaccuauaaugcca

SEQ ID NO: 375331 - RNA, 63 nt, Homo Sapiens
ugggcagauaugcagagggaagguguggaccagcugaggcagggcugguacagccaacccccu

SEQ ID NO: 375332 - RNA, 63 nt, Homo Sapiens
ggcucacgccuguaauaccagcacuuugggaggcugaggcaggcggaucacuugaggucagga

SEQ ID NO: 375333 - RNA, 63 nt, Homo Sapiens
ggugcaugccuguagucccagcuacuugggaugcugaggcaggaagaauugcuugaaccuggg

SEQ ID NO: 375334 - RNA, 63 nt, Homo Sapiens
gccucaugccuguaauccuagcacuuugggaggcugaggcaggcaaucacuugaggucaggag

SEQ ID NO: 375335 - RNA, 63 nt, Homo Sapiens
ggugcacguuuguaaucccaguuacucaggaggcugaggcacaagaauugaguaucacuuuaa

SEQ ID NO: 375336 - RNA, 63 nt, Homo Sapiens
ggcucaggccuguaaucccagcauuuugggaggcugaggcaaguggauaacuugaggucauga

SEQ ID NO: 375337 - RNA, 63 nt, Homo Sapiens
ggcgcacaccuguaaucccagcuacucaggaagcugaggcaggaaaaucgcuugaaccuggga

SEQ ID NO: 375338 - RNA, 63 nt, Homo Sapiens
ucuccaugccuauaaucccggcuacucgggaggcugaggcaggagaaucaccugaacccggga

SEQ ID NO: 375339 - RNA, 63 nt, Homo Sapiens
ggcgcaugccuguagucccaacuacuagggaggcugaggcaggagaaucacuugaacccagga

SEQ ID NO: 375340 - RNA, 63 nt, Homo Sapiens
ggcucacaccuguaaucccagcacuuugggaggcugaggcaggcagaucaugaugucaggagu

SEQ ID NO: 375341 - RNA, 63 nt, Homo Sapiens
ggugcgugccugaagucccagcuacucgggaagcugaggcagaagaaucacuugaaccuggga

SEQ ID NO: 375342 - RNA, 63 nt, Homo Sapiens
agaauugcuugaaccugggagcuacuagggaggcugaggcaggggugcaugccuguaauccca

SEQ ID NO: 375343 - RNA, 63 nt, Homo Sapiens
agaaucgcuugaaccugggagcuacuugagaggcugaggcaggggcaugugccuguagucuua

SEQ ID NO: 375344 - RNA, 63 nt, Homo Sapiens
aagaauugcuugaaccuggggcuacuugggaugcugaggcaggggugcaugccuguaguccca

SEQ ID NO: 375345 - RNA, 63 nt, Homo Sapiens
cggaucacuugaggucaggagcacuuugggaggcugaggcaggggcucacgccuguaauacca

SEQ ID NO: 375346 - RNA, 63 nt, Homo Sapiens
ggcacaugccuguaaucccagcacuuugggaggcugaggcaggugaaucaccugaggucagga

SEQ ID NO: 375347 - RNA, 63 nt, Homo Sapiens
ggcuggcgccuguaauuccagcuacucagaaggcugaggcagggagaauugcuugaacccagg

SEQ ID NO: 375348 - RNA, 63 nt, Homo Sapiens
agagggaaaguagggcagaaacuggauacaguucugaggcacagccagacuugcucagggugg

SEQ ID NO: 375349 - RNA, 63 nt, Homo Sapiens
aaaaaaaaacucuugccucugcuuucccccacucugaggcaaguuaaaauguaaaagauguga

SEQ ID NO: 375350 - RNA, 63 nt, Homo Sapiens
agaauugcuugacccaggagguaaucccaucuacugaggcagggggucucauggcaggcaccu

SEQ ID NO: 375351 - RNA, 63 nt, Homo Sapiens
uggaucaccuaaggucaggagcaccuugggaggcugaggcagggccucaugccuguaauccua

SEQ ID NO: 375352 - RNA, 63 nt, Homo Sapiens
ugccccagaaucugccgaggugagaacagcauccugaggcacagcucccaggggacagaggug

SEQ ID NO: 375353 - RNA, 63 nt, Homo Sapiens
agcacacaccuguaguaccagcuacucuggaggcugaggcaggaggaucacuugagcccagga

SEQ ID NO: 375354 - RNA, 63 nt, Homo Sapiens
ggcucuugucuguaaucccagcgcucugggaggcugaggcaggaggaucacuugaggucagga

SEQ ID NO: 375355 - RNA, 63 nt, Homo Sapiens
gggucacgccuguaaucccagcacuuugggaggcugaggcagguggaucaccucaagucagga

SEQ ID NO: 375356 - RNA, 63 nt, Homo Sapiens
ggugcacgucuguagucccagcuacucaggaggcugaggcagaagaaucgcuugaacccugga

SEQ ID NO: 375357 - RNA, 63 nt, Homo Sapiens
ggcuuaugccuguaauugcagcacuuuuagaggcugaggcaggagaauugguugaacccagga

SEQ ID NO: 375358 - RNA, 63 nt, Homo Sapiens
ggugcaugccuguaaucccagcuacucgggaggcugaggcaggagaauugcuugaacucggga

SEQ ID NO: 375359 - RNA, 63 nt, Homo Sapiens
ggcacaugcugguaauagcagcuacugagguggcugaggcacaagaauugcuuggacccugga

SEQ ID NO: 375360 - RNA, 63 nt, Homo Sapiens
ggcaggcaccuguaaucccagcuacucgggaggcugaggcaggagaaucgcuugaaccuggga

SEQ ID NO: 375361 - RNA, 63 nt, Homo Sapiens
uggcucccucucucugcccuacaacaggcaacccugaggcagcgugcccagagagcaggucag

SEQ ID NO: 375362 - RNA, 63 nt, Homo Sapiens
agaaucacuugaaccugggagguacucaggaggcugaggcaggggcgcaugccuauaauccca

SEQ ID NO: 375363 - RNA, 63 nt, Homo Sapiens
acucuggcccauugacagauuuucuagcggugccugaggcaucgccuccuguccggcccuggg

SEQ ID NO: 375364 - RNA, 63 nt, Homo Sapiens
uagaguauaugccaagaacaauguggaaguggucugaggcauauaauuagcugaauagaaaga

SEQ ID NO: 375365 - RNA, 63 nt, Homo Sapiens
aaugaaaauuuaaguugcaguuaaguuucaacucugaggcagcauuagguuugcagaaacuau

SEQ ID NO: 375366 - RNA, 63 nt, Homo Sapiens
agaauugcuugagccugggagcuacucagguggcugaggcauaggcacacgccuguaauacca

SEQ ID NO: 375367 - RNA, 63 nt, Homo Sapiens
agaauuguuugagcccgggagcuacuugggaggcugaggcauagccgcgugccuguaauccca

SEQ ID NO: 375368 - RNA, 63 nt, Homo Sapiens
agaauugcuugaacccaggagcuacucgggaggcugaggcaggagcgcacgccuguaguccca

SEQ ID NO: 375369 - RNA, 63 nt, Homo Sapiens
gaagugccucccagauguggaaagggggugauucugaggcacugccuccauucucuuuuaaaa

SEQ ID NO: 375370 - RNA, 63 nt, Homo Sapiens
ggagucaguagcgcuguccccaccgugccugcccugaggcagucagaggaagugguagagcag

SEQ ID NO: 375371 - RNA, 63 nt, Homo Sapiens
agaaucacuugaacccaggagcuacucgggaggcugaggcagguggcaggcgccuguaaucca

SEQ ID NO: 375372 - RNA, 63 nt, Homo Sapiens
agaauggcgggaaccugggagcuacuugggaggcugaggcaggggcgggcgccuguaguccca

SEQ ID NO: 375373 - RNA, 63 nt, Homo Sapiens
agaauugcuugaagcugggagcuacuugggagccugaggcagaggcaggcgccuguaaugccu

SEQ ID NO: 375374 - RNA, 63 nt, Homo Sapiens
uagaucaccugaaguuaggagcacuuugggaggcugaggcaggggcucaugccuguaauccca

SEQ ID NO: 375375 - RNA, 63 nt, Homo Sapiens
ggcgcauaccuguagucccagcuacuugggaggcugaggcaggagaaucacuugaacucggga

SEQ ID NO: 375376 - RNA, 63 nt, Homo Sapiens
ggugcgugccuguagucucagcuacucaggaggcugaggcaggagaaucgccugaacccgggc

SEQ ID NO: 375377 - RNA, 63 nt, Homo Sapiens
ggugggcgccuguaaucccagcuacucagaaggcugaggcaggagaaucacuugaaccuagga

SEQ ID NO: 375378 - RNA, 63 nt, Homo Sapiens
ggugcauaccuauaguccuggcuauuugggaggcugaggcaggaggauugcuuuagcccugga

SEQ ID NO: 375379 - RNA, 63 nt, Homo Sapiens
ggugcaugccuguaaucccagcuacucgggaggcugaggcaggagaaucgcuugaacccagga

SEQ ID NO: 375380 - RNA, 63 nt, Homo Sapiens
acuacuugucuguggcccagggcaguggcuuuccugaggcagcagccuucguggcaagaacua

SEQ ID NO: 375381 - RNA, 63 nt, Homo Sapiens
cccuagagguggcccccugcccgauccaccguccugaggcagaguguugagccucauaccugu

SEQ ID NO: 375382 - RNA, 63 nt, Homo Sapiens
agaauggcgugaacccgggagcuacucaugaggcugaggcaggggcaugugccuguauuccca

SEQ ID NO: 375383 - RNA, 63 nt, Homo Sapiens
aggauccccugaggucaggagcacuuugggaagcugaggcaggggcucaugccuguaauccca

SEQ ID NO: 375384 - RNA, 63 nt, Homo Sapiens
acaguggggcuaacuguagacacagagaggcagcugaggcaggggggggcucccaucuucuua

SEQ ID NO: 375385 - RNA, 63 nt, Homo Sapiens
agaaucgcuugaaccugggagcuacucgggaggcugaggcaggggcacgugccuguaauccca

SEQ ID NO: 375386 - RNA, 63 nt, Homo Sapiens
ggugggcaccugugaucccagcuuccugggaggcugaggcaagagaaucgcuugaaucuggga

SEQ ID NO: 375387 - RNA, 63 nt, Homo Sapiens
ggcaugcgcuuguagucucagcuacuccggaggcugaggcaggagaauugcuugaaccuggaa

SEQ ID NO: 375388 - RNA, 63 nt, Homo Sapiens
ggugggugucuguaaucccagcuauucgggaggcugaggcaggagaaucgcuugaacccagga

SEQ ID NO: 375389 - RNA, 63 nt, Homo Sapiens
ggcacacacuuguaaucccagcuacucaggaggcugaggcaugagaaucgcuuaaacccagga

SEQ ID NO: 375390 - RNA, 63 nt, Homo Sapiens
ggcucacgccuguaaucccggcacuuugggaggcugaggcaggcggauugccugagaucggga

SEQ ID NO: 375391 - RNA, 63 nt, Homo Sapiens
ggcgggcgccuguaaucccagcuacucaggaggcugaggcagcagaaucguuugaacccggga

SEQ ID NO: 375392 - RNA, 63 nt, Homo Sapiens
uugggaucucagccugcccuaaucuuuccccaucugaggcagguuucuaggaggugucuguag

SEQ ID NO: 375393 - RNA, 63 nt, Homo Sapiens
cuuugugugugggguaccugggaaaggguguggcugaggcagucauaaugcaguaucuucccc

SEQ ID NO: 375394 - RNA, 63 nt, Homo Sapiens
agaaucgcuugaaccaggcagcuacuugggaggcugaggcaggggugcgugccuguaguucca

SEQ ID NO: 375395 - RNA, 63 nt, Homo Sapiens
gagugccguggagugguuuuccagauagggaaacugaggcagacuguuguccagaaaaucuuc

SEQ ID NO: 375396 - RNA, 63 nt, Homo Sapiens
acggaaggacuugaguuguuuacaagcccugcacugaggcagauuggugcuguucgcagagua

SEQ ID NO: 375397 - RNA, 63 nt, Homo Sapiens
aagcauaaccaguggccagaggagugggagggccugaggcaucacaucuugcagaucagaaug

SEQ ID NO: 375398 - RNA, 63 nt, Homo Sapiens
aggaucacuggaaccugggacggccacucggggcugaggcaggaguguucacaccuguagucc

SEQ ID NO: 375399 - RNA, 63 nt, Homo Sapiens
cgggagcuggcguaaugccucgaauucacgaggcugaggcaucgggcccugagcguccugccc

SEQ ID NO: 375400 - RNA, 63 nt, Homo Sapiens
aggauugcuugaggccaggagcgcuuugggaggcugaggcaggggcucacaucuguaauacca

SEQ ID NO: 375401 - RNA, 63 nt, Homo Sapiens
agaauugcuugaaccuaggagcuacucgggaggcugaggcaggggugggcaccuguaguccca

SEQ ID NO: 375402 - RNA, 63 nt, Homo Sapiens
uggaucacaaugucaggagugcacuuugggaggcugaggcaggggcucacgccuguaauccca

SEQ ID NO: 375403 - RNA, 63 nt, Homo Sapiens
ggcucaugccuguaaucucagcacuuugggaggcugaggcagaaggauuaccugaggcaagga

SEQ ID NO: 375404 - RNA, 63 nt, Homo Sapiens
cagcacuuugggaggcugaggcagaaggauuaccugaggcaaggaguuugagaccagcuuagc

SEQ ID NO: 375405 - RNA, 63 nt, Homo Sapiens
ugguucagcauguaauccgagcacuuugggaggcugaggcaggcggaucacuugaggucagca

SEQ ID NO: 375406 - RNA, 63 nt, Homo Sapiens
auacaaaaauaagccaggcgugguggcgggaggcugaggcaaggagaaucacuugaauacaag

SEQ ID NO: 375407 - RNA, 63 nt, Homo Sapiens
uccagaggacaagccugccuugaguucaagggccugaggcagaucucuguugaacuggucuaa

SEQ ID NO: 375408 - RNA, 63 nt, Homo Sapiens
cggugaggguggcccaggagcuaaggaagaagucugaggcagaaaaaguggacacagaccaga

SEQ ID NO: 375409 - RNA, 63 nt, Homo Sapiens
agcugaggcccuguccaaagucugaaacucaggcugaggcagcaccaggacuccuacacacuc

SEQ ID NO: 375410 - RNA, 63 nt, Homo Sapiens
gugcucggaaguuagacccacaacuaugacaaccugaggcacugugucucucuucaauuucca

SEQ ID NO: 375411 - RNA, 63 nt, Homo Sapiens
agaaaucgccugaacccagagcuacuugggaggcugaggcaggggcaggcaccuguaauccca

SEQ ID NO: 375412 - RNA, 63 nt, Homo Sapiens
cggaucacuugaggucaggagcacuuugggaggcugaggcaggggcucaugccuguaauccca

SEQ ID NO: 375413 - RNA, 63 nt, Homo Sapiens
agaaucgcuugaaccugggagcuacuggggaggcugaggcaggggugcaugccuguaauccca

SEQ ID NO: 375414 - RNA, 63 nt, Homo Sapiens
agaauggcgugaacccgggagcuacuuggaaggcugaggcaggggcgggcgccuguaguccca

SEQ ID NO: 375415 - RNA, 63 nt, Homo Sapiens
aggauugcuuaaacgcaggauuacagaggaaggcugaggcaggggccacccaaagugguagaa

SEQ ID NO: 375416 - RNA, 63 nt, Homo Sapiens
agaaucgcuagaaacugggaucuucuugggaggcugaggcaggagcgcacgccuguaauccca

SEQ ID NO: 375417 - RNA, 63 nt, Homo Sapiens
agaaucgcuugaacccgggagcuacucaggaggcugaggcaggggcgcacgccuguaguucca

SEQ ID NO: 375418 - RNA, 63 nt, Homo Sapiens
ggcacgugccuguaaucccagcuacucaggaggcugaggcaggagaaucgcuugaacccggga

SEQ ID NO: 375419 - RNA, 63 nt, Homo Sapiens
gagauuuaacuagauauguucaauagaaagagucugaggcaaguggaaaugaggaacggaaac

SEQ ID NO: 375420 - RNA, 63 nt, Homo Sapiens
ggcucacaccuauaauccuagcacuuggggaggcugaggcagacggauuaccugaggucagga

SEQ ID NO: 375421 - RNA, 63 nt, Homo Sapiens
ggcgugcaccuguaaucccagcuacucuggaggcugaggcaggagaaucaccugaaccuggga

SEQ ID NO: 375422 - RNA, 63 nt, Homo Sapiens
agaaucgcuugaaccugggaccaccucaggaggcugaggcagggguggcaagugccuuuaauc

SEQ ID NO: 375423 - RNA, 63 nt, Homo Sapiens
agaaucgcuugaaccugggagcuacuugggaggcugaggcaggggcggaugccuguaauccca

SEQ ID NO: 375424 - RNA, 63 nt, Homo Sapiens
aacuugugucaguuggaggaaaaccuccauacacugaggcagacaguuuccuauuacugagga

SEQ ID NO: 375425 - RNA, 63 nt, Homo Sapiens
agaaucgcuugaacccgggagcuacucuggaggcugaggcaaaggugcacaccuguaauccca

SEQ ID NO: 375426 - RNA, 63 nt, Homo Sapiens
ccugaagcacugcgcaagcauuucugugcuagacugaggcagcguggggaggcaguagaguau

SEQ ID NO: 375427 - RNA, 63 nt, Homo Sapiens
agaaucgcuugaacccaggaccuacuugguaggcugaggcaggggcgggcaccuauaauccca

SEQ ID NO: 375428 - RNA, 63 nt, Homo Sapiens
uggcucacuugaggucaggagcacuuugggaggcugaggcaggggcucacaccuguaauccua

SEQ ID NO: 375429 - RNA, 63 nt, Homo Sapiens
gccucacaccuguaaucccagcacuuuggggggcugaggcagguggaucacuugaggucagga

SEQ ID NO: 375430 - RNA, 63 nt, Homo Sapiens
agugcacgccuguaaucccagcuacucaggaggcugaggcacgagacuugcuugaacccagga

SEQ ID NO: 375431 - RNA, 63 nt, Homo Sapiens
agaaucgcuugaacccgggagcugcucaggaggcugaggcaggggugggcgccuguaauccca

SEQ ID NO: 375432 - RNA, 63 nt, Homo Sapiens
cagaucaccugaggcuaggagcacuuugggaggcugaggcaggggcucacgccuguaauccca

SEQ ID NO: 375433 - RNA, 63 nt, Homo Sapiens
agcucacaccugaaaucuuagcacuucgggaggcugaggcagguggaucacuugagguuagga

SEQ ID NO: 375434 - RNA, 63 nt, Homo Sapiens
ggugcaugccuuuaaacccagcuacugaggaggcugaggcaugagaauugcuugaaccaggag

SEQ ID NO: 375435 - RNA, 63 nt, Homo Sapiens
aggauuacuugaggccagacgcaauucagaaagcugaggcaggggcucaugccgauaauccca

SEQ ID NO: 375436 - RNA, 63 nt, Homo Sapiens
cagggagacccagugaggauugcccugcccuagcugaggcacaaaaaaacgcacaagagcccc

SEQ ID NO: 375437 - RNA, 63 nt, Homo Sapiens
agaauugcuugaaccugggagcuacucaggauccugaggcaugggcgugcaccuguaguccca

SEQ ID NO: 375438 - RNA, 63 nt, Homo Sapiens
agaauugcuugaacccgggaccuacucgagaggcugaggcagcggaaugugccuguaauccca

SEQ ID NO: 375439 - RNA, 63 nt, Homo Sapiens
ggcucaugccuguaaucccagcacuuugggaggcugaggcagguggaucacuggaggucagga

SEQ ID NO: 375440 - RNA, 63 nt, Homo Sapiens
ccagcuggccuguaaucccagcuacuugggaggcugaggcagaacugcuugaacccaggaggu

SEQ ID NO: 375441 - RNA, 63 nt, Homo Sapiens
uggugggugccuguaauccagcuacuugggagacugaggcaggagaauugcuugaacccagga

SEQ ID NO: 375442 - RNA, 63 nt, Homo Sapiens
agcucaugccuguaaucccaacacuuugggaggcugaggcaggcggaucacgaggucaggaga

SEQ ID NO: 375443 - RNA, 63 nt, Homo Sapiens
uguaguccccuguagucccagcuacucgggaggcugaggcaggagaaucguuugaaccuggga

SEQ ID NO: 375444 - RNA, 63 nt, Homo Sapiens
ccagcuggugauggcccuuuugcuccuggcagccugaggcacagcugccuguauuguccucau

SEQ ID NO: 375445 - RNA, 63 nt, Homo Sapiens
ggcggguaccuguaguccuagcuacuugggaggcugaggcaggagaauggcgugaaccuggga

SEQ ID NO: 375446 - RNA, 63 nt, Homo Sapiens
aggauugcuugagcucaggagguacuugggagccugaggcaggggcucacgccuguaguccca

SEQ ID NO: 375447 - RNA, 63 nt, Homo Sapiens
cggaucaccugaagucagaagcacuuugggaggcugaggcaggggcucacgccuguaauccca

SEQ ID NO: 375448 - RNA, 63 nt, Homo Sapiens
agaaucgccugaacccaggaccuguaaucguagcugaggcagggccaggcaugguggcacaca

SEQ ID NO: 375449 - RNA, 63 nt, Homo Sapiens
agaaucgcuugaaccugggagcuacucaagaggcugaggcaggggcaggcgccugaaauccca

SEQ ID NO: 375450 - RNA, 63 nt, Homo Sapiens
agaaucgcuugaacucaggagcuacucgggaggcugaggcaggcacuucaagggcccucccca

SEQ ID NO: 375451 - RNA, 63 nt, Homo Sapiens
agaauggccugaacccgggagcuacuugggaggcugaggcaggugcaggcgccuguaguccca

SEQ ID NO: 375452 - RNA, 63 nt, Homo Sapiens
ggcaggugccuguaaucccagcuacuugggaggcugaggcaugagaaucacuuaaaccugaga

SEQ ID NO: 375453 - RNA, 63 nt, Homo Sapiens
ggugcaugccuguaaucccagcuacucgggaggcugaggcaggagaacugcuugaacccagga

SEQ ID NO: 375454 - RNA, 63 nt, Homo Sapiens
ggcgggcaccuguagucccagcuacucgggaggcugaggcaggagaauggugugaacccggga

SEQ ID NO: 375455 - RNA, 63 nt, Homo Sapiens
ggcacgugccugugaucccagcuacuugggaggcugaggcaggaggaucgccugagcccagga

SEQ ID NO: 375456 - RNA, 63 nt, Homo Sapiens
ggagaccauccaguuauucaucugacugccuaccugaggcaagcaccacacuuaccacuguau

SEQ ID NO: 375457 - RNA, 63 nt, Homo Sapiens
gcgggcgccugugguggccagcuacucaggaggcugaggcaggagaauggcgugaacccggga

SEQ ID NO: 375458 - RNA, 63 nt, Homo Sapiens
ggcucacgcuugcaaucccagugcuuugggagacugaggcaggaggaucacuuaaggccagga

SEQ ID NO: 375459 - RNA, 63 nt, Homo Sapiens
ggcacaugccuguaauccgagugcuuugggaggcugaggcaggaggaucacucgagcucaaga

SEQ ID NO: 375460 - RNA, 63 nt, Homo Sapiens
agaaucacuugagcccaggagcuacuugggaggcugaggcaggggcaccugccuguaauccca

SEQ ID NO: 375461 - RNA, 63 nt, Homo Sapiens
cgaauugcuugaaccugggagcuccucaggcugcugaggcagggucgcgugccuguaguccca

SEQ ID NO: 375462 - RNA, 63 nt, Homo Sapiens
agaaucacuugaauucaggagcuacuggggaggcugaggcaggggcgggugccuguaauccca

SEQ ID NO: 375463 - RNA, 63 nt, Homo Sapiens
uggaucaccugagguuaggagcacuuugggaggcugaggcaggggcccaugccuauaauccca

SEQ ID NO: 375464 - RNA, 63 nt, Homo Sapiens
agaauugcuugagcccgggagcuacucgggaggcugaggcaggggugugcaccuguaauucca

SEQ ID NO: 375465 - RNA, 63 nt, Homo Sapiens
cggaucaccugaggucaggagcacuuugggaggcugaggcaggggcucaugccuguaauccca

SEQ ID NO: 375466 - RNA, 63 nt, Homo Sapiens
agaauugcuugaacuugggagcuacuugggaggcugaggcaggggugggugccuguaauccua

SEQ ID NO: 375467 - RNA, 63 nt, Homo Sapiens
agaauugcuugaacccaugagcuacucgggaggcugaggcaggggggugcgcuuguaauccca

SEQ ID NO: 375468 - RNA, 63 nt, Homo Sapiens
ugaauugcuugaauccaggagcuacucaggaggcugaggcagaggcgcgcgccuguaauccca

SEQ ID NO: 375469 - RNA, 63 nt, Homo Sapiens
ucgaucacgaggucaggcgugcacuuugggaggcugaggcaggggcucacgccuguaauccca

SEQ ID NO: 375470 - RNA, 63 nt, Homo Sapiens
agaauggcaugaaccugggagcuacucgggaggcugaggcaggggcgggcaccuguaguccca

SEQ ID NO: 375471 - RNA, 63 nt, Homo Sapiens
aagaucccuugacccugagagcuacucaggaagcugaggcagaggcacaugccugugauccca

SEQ ID NO: 375472 - RNA, 63 nt, Homo Sapiens
agagucgcuuaaaccugggagcuacuugagaggcugaggcacaggugugcaccuuuaguucca

SEQ ID NO: 375473 - RNA, 63 nt, Homo Sapiens
agaauggugugaauccuggagcugcuugggaggcugaggcaggggcaggugccuguaguccua

SEQ ID NO: 375474 - RNA, 63 nt, Homo Sapiens
agaauugcuugaauccaagagcuacuugggaggcugaggcaggggugcaugccuguagucuca

SEQ ID NO: 375475 - RNA, 63 nt, Homo Sapiens
agagugcuugaacccaggaggcuacuugggaggcugaggcaggggcaggugccuguaauccca

SEQ ID NO: 375476 - RNA, 63 nt, Homo Sapiens
uggaucaccugaggucgggagcacuuugggaggcugaggcaggggcucacaccuguaauccca

SEQ ID NO: 375477 - RNA, 63 nt, Homo Sapiens
agaauggcgugaaccugggagcuacucgggaggcugaggcaggagcaggugccuguaguccca

SEQ ID NO: 375478 - RNA, 63 nt, Homo Sapiens
agaaugguuugaacacaggggcaacuuaggagccugaggcaggagugugcaucuguagucuca

SEQ ID NO: 375479 - RNA, 63 nt, Homo Sapiens
ggugcauaccuguaaucccagcuacucgggaaccugaggcaggagaauggcuugaacccagga

SEQ ID NO: 375480 - RNA, 63 nt, Homo Sapiens
gcagguaacaguucccauuuuagagaugaagaacugaggcacagauuaaaggacuugccugug

SEQ ID NO: 375481 - RNA, 63 nt, Homo Sapiens
agacuggugugaacccgggagcuacgugggaggcugaggcagcggugggcgccuguaguccca

SEQ ID NO: 375482 - RNA, 63 nt, Homo Sapiens
uggaucacgaggucaggagagcacuuugggaggcugaggcaggggcucaugccuguaauccca

SEQ ID NO: 375483 - RNA, 63 nt, Homo Sapiens
ggcucacaccuguaaucccagcacuuugggaggcugaggcaggcagaucaugaggucaagaga

SEQ ID NO: 375484 - RNA, 63 nt, Homo Sapiens
ggcgcgcgccuguugucuuagcuacucaggaggcugaggcaggagaaucgcuugaaaacagga

SEQ ID NO: 375485 - RNA, 63 nt, Homo Sapiens
agaauggcgugaacccaggagcuacucugaagacugaggcaggggcgggcgccuguaguccca

SEQ ID NO: 375486 - RNA, 63 nt, Homo Sapiens
agaaucgcuugaacccgggagcuacucaggaggcugaggcaggggugcacgccuguagucuca

SEQ ID NO: 375487 - RNA, 63 nt, Homo Sapiens
gauacaugccuguaauccuggcuacuugggaggcugaggcaugagaauugcuugaaccuggga

SEQ ID NO: 375488 - RNA, 63 nt, Homo Sapiens
ggcggaugccuguagucccagcuacucaggaggcugaggcaggagaauggcgugaacccagaa

SEQ ID NO: 375489 - RNA, 63 nt, Homo Sapiens
ggcacaugacuguaaucccagcuacucaggaggcugaggcaggaggaucacuugaaccuggga

SEQ ID NO: 375490 - RNA, 63 nt, Homo Sapiens
ggcacaugccaguaauuccaucuacucgggaggcugaggcaggagaaucgucuaagcccggga

SEQ ID NO: 375491 - RNA, 63 nt, Homo Sapiens
agaaucgcuugaacccaagagcuacuagggaugcugaggcaggggcgcacgccuguaaucuca

SEQ ID NO: 375492 - RNA, 63 nt, Homo Sapiens
gccugaagucuguacacgugccgcaggacuccucugaggcagggaggggccgguccuggacuc

SEQ ID NO: 375493 - RNA, 63 nt, Homo Sapiens
ggcucacgccuguaaucccagcacuuugggaggcugaggcagguggaucacgaggucaggaga

SEQ ID NO: 375494 - RNA, 63 nt, Homo Sapiens
ggcgggcgccuguagucccagcuacucgggaggcugaggcaggagaauggugugaacccggga

SEQ ID NO: 375495 - RNA, 63 nt, Homo Sapiens
agaaucgcuugaacccgggagcuacucgggaggcugaggcaggggcgggcaccuguaauccug

SEQ ID NO: 375496 - RNA, 63 nt, Homo Sapiens
aagauugagccuaggaguucggacuuugggaagcugaggcaggggugcacuccuguaacccug

SEQ ID NO: 375497 - RNA, 63 nt, Homo Sapiens
agaaucacuugaacucaggagcuacacaggaggcugaggcacgggcaggagccuguaauccca

SEQ ID NO: 375498 - RNA, 63 nt, Homo Sapiens
agacuugcuuaauaccuggggcuacuugggaggcugaggcacgggcucaugccuauaauccua

SEQ ID NO: 375499 - RNA, 64 nt, Homo Sapiens; identical to SEQ ID NO: 220362

SEQ ID NO: 375500 - RNA, 64 nt, Homo Sapiens; identical to SEQ ID NO: 220363

SEQ ID NO: 375501 - RNA, 64 nt, Homo Sapiens; identical to SEQ ID NO: 220364

SEQ ID NO: 375502 - RNA, 64 nt, Homo Sapiens; identical to SEQ ID NO: 220365

SEQ ID NO: 375503 - RNA, 64 nt, Homo Sapiens; identical to SEQ ID NO: 220366

SEQ ID NO: 375504 - RNA, 64 nt, Homo Sapiens; identical to SEQ ID NO: 220367

SEQ ID NO: 375505 - RNA, 64 nt, Homo Sapiens; identical to SEQ ID NO: 220368

SEQ ID NO: 375506 - RNA, 64 nt, Homo Sapiens; identical to SEQ ID NO: 220369

SEQ ID NO: 375507 - RNA, 64 nt, Homo Sapiens; identical to SEQ ID NO: 220370

SEQ ID NO: 375508 - RNA, 64 nt, Homo Sapiens; identical to SEQ ID NO: 220371

SEQ ID NO: 375509 - RNA, 64 nt, Homo Sapiens; identical to SEQ ID NO: 220372

SEQ ID NO: 375510 - RNA, 64 nt, Homo Sapiens; identical to SEQ ID NO: 220373

SEQ ID NO: 375511 - RNA, 64 nt, Homo Sapiens; identical to SEQ ID NO: 220374

SEQ ID NO: 375512 - RNA, 64 nt, Homo Sapiens; identical to SEQ ID NO: 220375

SEQ ID NO: 375513 - RNA, 64 nt, Homo Sapiens; identical to SEQ ID NO: 220376

SEQ ID NO: 375514 - RNA, 64 nt, Homo Sapiens; identical to SEQ ID NO: 220377

SEQ ID NO: 375515 - RNA, 64 nt, Homo Sapiens; identical to SEQ ID NO: 220378

SEQ ID NO: 375516 - RNA, 64 nt, Homo Sapiens; identical to SEQ ID NO: 220379

SEQ ID NO: 375517 - RNA, 64 nt, Homo Sapiens; identical to SEQ ID NO: 220380

SEQ ID NO: 375518 - RNA, 64 nt, Homo Sapiens; identical to SEQ ID NO: 220381

SEQ ID NO: 375519 - RNA, 64 nt, Homo Sapiens; identical to SEQ ID NO: 220382

SEQ ID NO: 375520 - RNA, 64 nt, Homo Sapiens; identical to SEQ ID NO: 220383

SEQ ID NO: 375521 - RNA, 64 nt, Homo Sapiens; identical to SEQ ID NO: 220384

SEQ ID NO: 375522 - RNA, 64 nt, Homo Sapiens; identical to SEQ ID NO: 220385

SEQ ID NO: 375523 - RNA, 64 nt, Homo Sapiens; identical to SEQ ID NO: 220386

SEQ ID NO: 375524 - RNA, 64 nt, Homo Sapiens; identical to SEQ ID NO: 220387

SEQ ID NO: 375525 - RNA, 64 nt, Homo Sapiens; identical to SEQ ID NO: 220388

SEQ ID NO: 375526 - RNA, 64 nt, Homo Sapiens; identical to SEQ ID NO: 220389

SEQ ID NO: 375527 - RNA, 64 nt, Homo Sapiens; identical to SEQ ID NO: 220390

SEQ ID NO: 375528 - RNA, 64 nt, Homo Sapiens; identical to SEQ ID NO: 220391

SEQ ID NO: 375529 - RNA, 64 nt, Homo Sapiens; identical to SEQ ID NO: 220392

SEQ ID NO: 375530 - RNA, 64 nt, Homo Sapiens; identical to SEQ ID NO: 220393

SEQ ID NO: 375531 - RNA, 64 nt, Homo Sapiens; identical to SEQ ID NO: 220394

SEQ ID NO: 375532 - RNA, 64 nt, Homo Sapiens; identical to SEQ ID NO: 220395

SEQ ID NO: 375533 - RNA, 64 nt, Homo Sapiens; identical to SEQ ID NO: 220396

SEQ ID NO: 375534 - RNA, 64 nt, Homo Sapiens; identical to SEQ ID NO: 220397

SEQ ID NO: 375535 - RNA, 64 nt, Homo Sapiens; identical to SEQ ID NO: 220398

SEQ ID NO: 375536 - RNA, 64 nt, Homo Sapiens; identical to SEQ ID NO: 220399

SEQ ID NO: 375537 - RNA, 64 nt, Homo Sapiens; identical to SEQ ID NO: 220400

SEQ ID NO: 375538 - RNA, 64 nt, Homo Sapiens; identical to SEQ ID NO: 220401

SEQ ID NO: 375539 - RNA, 64 nt, Homo Sapiens; identical to SEQ ID NO: 220402

SEQ ID NO: 375540 - RNA, 64 nt, Homo Sapiens; identical to SEQ ID NO: 220403

SEQ ID NO: 375541 - RNA, 64 nt, Homo Sapiens; identical to SEQ ID NO: 220404

SEQ ID NO: 375542 - RNA, 64 nt, Homo Sapiens; identical to SEQ ID NO: 220405

SEQ ID NO: 375543 - RNA, 64 nt, Homo Sapiens; identical to SEQ ID NO: 220406

SEQ ID NO: 375544 - RNA, 64 nt, Homo Sapiens; identical to SEQ ID NO: 220407

SEQ ID NO: 375545 - RNA, 64 nt, Homo Sapiens; identical to SEQ ID NO: 220408

SEQ ID NO: 375546 - RNA, 64 nt, Homo Sapiens; identical to SEQ ID NO: 220409

SEQ ID NO: 375547 - RNA, 64 nt, Homo Sapiens; identical to SEQ ID NO: 220410

SEQ ID NO: 375548 - RNA, 64 nt, Homo Sapiens; identical to SEQ ID NO: 220411

SEQ ID NO: 375549 - RNA, 64 nt, Homo Sapiens; identical to SEQ ID NO: 220412

SEQ ID NO: 375550 - RNA, 64 nt, Homo Sapiens; identical to SEQ ID NO: 220413

SEQ ID NO: 375551 - RNA, 64 nt, Homo Sapiens; identical to SEQ ID NO: 220414

SEQ ID NO: 375552 - RNA, 64 nt, Homo Sapiens; identical to SEQ ID NO: 220415

SEQ ID NO: 375553 - RNA, 64 nt, Homo Sapiens; identical to SEQ ID NO: 220416

SEQ ID NO: 375554 - RNA, 64 nt, Homo Sapiens; identical to SEQ ID NO: 220417

SEQ ID NO: 375555 - RNA, 64 nt, Homo Sapiens; identical to SEQ ID NO: 220418

SEQ ID NO: 375556 - RNA, 64 nt, Homo Sapiens; identical to SEQ ID NO: 220419

SEQ ID NO: 375557 - RNA, 64 nt, Homo Sapiens; identical to SEQ ID NO: 220420

SEQ ID NO: 375558 - RNA, 64 nt, Homo Sapiens; identical to SEQ ID NO: 220421

SEQ ID NO: 375559 - RNA, 64 nt, Homo Sapiens; identical to SEQ ID NO: 220422

SEQ ID NO: 375560 - RNA, 61 nt, Homo Sapiens
caaagauucuguuucaaauauagccacagaaauaaaggagggaccaauaucugggacaggu

SEQ ID NO: 375561 - RNA, 61 nt, Homo Sapiens
gacagauucugcuuugaauauagcuacagaaauaaaggauggacuacagugugggacaggu

SEQ ID NO: 375562 - RNA, 61 nt, Homo Sapiens
ggaagacucuguuucgaauauagccacagaaauaaaggauggagaaaaaucugggacaggu

SEQ ID NO: 375563 - RNA, 61 nt, Homo Sapiens
gaaagauucuguuucgaacauagccacagaaauaaaggauggagaaaaaucugggacaggu

SEQ ID NO: 375564 - RNA, 61 nt, Homo Sapiens
caaagagguuuuuguacuuguccagacguuaauaaaggacuaauuguauguaccacacauc

SEQ ID NO: 375565 - RNA, 61 nt, Homo Sapiens
uguuccuuaguucccgugugggaacauugaaauaaaggaagguuuugguuuuuuccaaagu

SEQ ID NO: 375566 - RNA, 61 nt, Homo Sapiens
aaauuuuaguaugguuugaggaaaucaagugauaaaggaguaugcugaauaugcaaucauu

SEQ ID NO: 375567 - RNA, 61 nt, Homo Sapiens
ggaaaaugaaguuggauuuuuguauucauguauaaaggaaagucucccagugcugucaaag

SEQ ID NO: 375568 - RNA, 61 nt, Homo Sapiens
augacaaaaucaaauuauaaaauagcggagcauaaaggaucaaaagaguugagauuuaacc

SEQ ID NO: 375569 - RNA, 61 nt, Homo Sapiens
uucaugagaaaucgacuacccugaaaggugaauaaaggacguuucagcauccaccaaugaa

SEQ ID NO: 375570 - RNA, 61 nt, Homo Sapiens
guucacucacaucccuaccuugcaugguaauauaaaggacuaggaagcagucauacuucca

SEQ ID NO: 375571 - RNA, 61 nt, Homo Sapiens
accuaguuuaaaaggaauaaucaacaauuuuauaaaggagauggcuuauucaaccauagcc

SEQ ID NO: 375572 - RNA, 61 nt, Homo Sapiens
guucccauacuuuguuauuuaaagcuauuguauaaaggaugguuuuuuuaauuauuauuuu

SEQ ID NO: 375573 - RNA, 54 nt, Homo Sapiens
acacugucgcacuacauuguaguuauaaaggagcuauggggauugaaccacuga

SEQ ID NO: 375574 - RNA, 61 nt, Homo Sapiens
uucuggagaaaaugaagguagugggcaauagauaaaggaaauaaaaauuauucauaaaaca

SEQ ID NO: 375575 - RNA, 61 nt, Homo Sapiens
ugggccauacaaauguuuucagagcaagauaauaaaggagagaacaggaacauuguuuucu

SEQ ID NO: 375576 - RNA, 61 nt, Homo Sapiens
ugaaagaaagagugcacugacaaccaauuuaauaaaggaguaagaauguauaucuuuuuug

SEQ ID NO: 375577 - RNA, 61 nt, Homo Sapiens
cuaagugagguauaugaugaaauuaugcaucauaaaggaacucacaaaugaaugauuaagg

SEQ ID NO: 375578 - RNA, 61 nt, Homo Sapiens
agugaaaaagcauaagaaauguuaggguuagauaaaggaaaauaaacaggaaauuagaagu

SEQ ID NO: 375579 - RNA, 61 nt, Homo Sapiens
uuccauuagagggacacagggugguggccacauaaaggaucuuggucuccucuggcaggcu

SEQ ID NO: 375580 - RNA, 61 nt, Homo Sapiens
cuaaguauauugcugcacuuccauuucguagauaaaggaaaaguuuugaauuggaauugca

SEQ ID NO: 375581 - RNA, 61 nt, Homo Sapiens
aacagcaaaacaaaaagcaaagucccugaguauaaaggaaacuguuuaaguugaaagcaag

SEQ ID NO: 375582 - RNA, 61 nt, Homo Sapiens
aagaaguuaccuacuccauaaaaaaaugaaaauaaaggaauauuaaaaaaauacaaaaaag

SEQ ID NO: 375583 - RNA, 61 nt, Homo Sapiens
aucacagcucuuuuagaauuuuauucagaaaauaaaggaguagaguaaaguggaaggaagu

SEQ ID NO: 375584 - RNA, 61 nt, Homo Sapiens
ucagagaaacuuuaugcauaauguuuuuaucauaaaggaugcaaaauuguuaguguuuaug

SEQ ID NO: 375585 - RNA, 61 nt, Homo Sapiens
ucacaaaaacgguaauguaaaagcuuugaaaauaaaggacuuguuaaagccauugucagca

SEQ ID NO: 375586 - RNA, 61 nt, Homo Sapiens
uuuuuuauuuugggaggggacguuuuugacuauaaaggagcauauuuugauuacuuguuuu

SEQ ID NO: 375587 - RNA, 61 nt, Homo Sapiens
uuuaaauuugauacauaugcugaucauucugauaaaggaaauucucaaaggugaaaccaga

SEQ ID NO: 375588 - RNA, 61 nt, Homo Sapiens
agggaaaauguuuuguaagaaaccaaucaagauaaaggacagugaaguaauccguaccuug

SEQ ID NO: 375589 - RNA, 61 nt, Homo Sapiens
uuucugauauagaauugcaauuuuaacacacauaaaggauaaacuuuuagaaacuuaucuu

SEQ ID NO: 375590 - RNA, 64 nt, Homo Sapiens
cagaaucuggccaauuuaagugaaaaagaaaaaaaguacacauugguucuucaugagugcauuu

SEQ ID NO: 375591 - RNA, 64 nt, Homo Sapiens
ucuguggcuugauuucuugaagccuagcaauacaaguacacauuaaaucuuuaauauugcaggg

SEQ ID NO: 375592 - RNA, 64 nt, Homo Sapiens
ucacacagccaauagauuuggaaucaggccuaagaguacacauggaggguaaauauuaaagugc

SEQ ID NO: 375593 - RNA, 64 nt, Homo Sapiens
uucuauccauugagcaugcauggauauacccaauaguacacacaaaauaaauguuuacuuaaga

SEQ ID NO: 375594 - RNA, 64 nt, Homo Sapiens; identical to SEQ ID NO: 259970

SEQ ID NO: 375595 - RNA, 64 nt, Homo Sapiens; identical to SEQ ID NO: 259971

SEQ ID NO: 375596 - RNA, 64 nt, Homo Sapiens; identical to SEQ ID NO: 259972

SEQ ID NO: 375597 - RNA, 64 nt, Homo Sapiens; identical to SEQ ID NO: 259973

SEQ ID NO: 375598 - RNA, 64 nt, Homo Sapiens; identical to SEQ ID NO: 259974

SEQ ID NO: 375599 - RNA, 64 nt, Homo Sapiens; identical to SEQ ID NO: 259975

SEQ ID NO: 375600 - RNA, 64 nt, Homo Sapiens; identical to SEQ ID NO: 259976

SEQ ID NO: 375601 - RNA, 64 nt, Homo Sapiens; identical to SEQ ID NO: 259977

SEQ ID NO: 375602 - RNA, 64 nt, Homo Sapiens; identical to SEQ ID NO: 259978

SEQ ID NO: 375603 - RNA, 64 nt, Homo Sapiens; identical to SEQ ID NO: 259979

SEQ ID NO: 375604 - RNA, 64 nt, Homo Sapiens; identical to SEQ ID NO: 259980

SEQ ID NO: 375605 - RNA, 64 nt, Homo Sapiens; identical to SEQ ID NO: 259981

SEQ ID NO: 375606 - RNA, 64 nt, Homo Sapiens; identical to SEQ ID NO: 259982

SEQ ID NO: 375607 - RNA, 64 nt, Homo Sapiens; identical to SEQ ID NO: 259983

SEQ ID NO: 375608 - RNA, 64 nt, Homo Sapiens; identical to SEQ ID NO: 259984

SEQ ID NO: 375609 - RNA, 64 nt, Homo Sapiens; identical to SEQ ID NO: 259985

SEQ ID NO: 375610 - RNA, 64 nt, Homo Sapiens; identical to SEQ ID NO: 259986

SEQ ID NO: 375611 - RNA, 64 nt, Homo Sapiens; identical to SEQ ID NO: 259987

SEQ ID NO: 375612 - RNA, 64 nt, Homo Sapiens; identical to SEQ ID NO: 259988

SEQ ID NO: 375613 - RNA, 64 nt, Homo Sapiens; identical to SEQ ID NO: 259989

SEQ ID NO: 375614 - RNA, 64 nt, Homo Sapiens; identical to SEQ ID NO: 259990

SEQ ID NO: 375615 - RNA, 64 nt, Homo Sapiens; identical to SEQ ID NO: 259991

SEQ ID NO: 375616 - RNA, 64 nt, Homo Sapiens; identical to SEQ ID NO: 259992

SEQ ID NO: 375617 - RNA, 64 nt, Homo Sapiens; identical to SEQ ID NO: 259993

SEQ ID NO: 375618 - RNA, 64 nt, Homo Sapiens; identical to SEQ ID NO: 259994

SEQ ID NO: 375619 - RNA, 64 nt, Homo Sapiens; identical to SEQ ID NO: 259995

SEQ ID NO: 375620 - RNA, 64 nt, Homo Sapiens; identical to SEQ ID NO: 259996

SEQ ID NO: 375621 - RNA, 64 nt, Homo Sapiens; identical to SEQ ID NO: 259997

SEQ ID NO: 375622 - RNA, 64 nt, Homo Sapiens; identical to SEQ ID NO: 259998

SEQ ID NO: 375623 - RNA, 64 nt, Homo Sapiens; identical to SEQ ID NO: 79402

SEQ ID NO: 375624 - RNA, 64 nt, Homo Sapiens; identical to SEQ ID NO: 79403

SEQ ID NO: 375625 - RNA, 64 nt, Homo Sapiens; identical to SEQ ID NO: 79404

SEQ ID NO: 375626 - RNA, 64 nt, Homo Sapiens; identical to SEQ ID NO: 79405

SEQ ID NO: 375627 - RNA, 64 nt, Homo Sapiens; identical to SEQ ID NO: 79406

SEQ ID NO: 375628 - RNA, 64 nt, Homo Sapiens; identical to SEQ ID NO: 79407

SEQ ID NO: 375629 - RNA, 64 nt, Homo Sapiens; identical to SEQ ID NO: 79408

SEQ ID NO: 375630 - RNA, 64 nt, Homo Sapiens; identical to SEQ ID NO: 79409

SEQ ID NO: 375631 - RNA, 64 nt, Homo Sapiens; identical to SEQ ID NO: 79410

SEQ ID NO: 375632 - RNA, 64 nt, Homo Sapiens; identical to SEQ ID NO: 79411

SEQ ID NO: 375633 - RNA, 64 nt, Homo Sapiens; identical to SEQ ID NO: 79412

SEQ ID NO: 375634 - RNA, 64 nt, Homo Sapiens; identical to SEQ ID NO: 79413

SEQ ID NO: 375635 - RNA, 64 nt, Homo Sapiens; identical to SEQ ID NO: 79414

SEQ ID NO: 375636 - RNA, 64 nt, Homo Sapiens; identical to SEQ ID NO: 79415

SEQ ID NO: 375637 - RNA, 64 nt, Homo Sapiens; identical to SEQ ID NO: 79416

SEQ ID NO: 375638 - RNA, 64 nt, Homo Sapiens; identical to SEQ ID NO: 79417

SEQ ID NO: 375639 - RNA, 64 nt, Homo Sapiens; identical to SEQ ID NO: 79418

SEQ ID NO: 375640 - RNA, 64 nt, Homo Sapiens; identical to SEQ ID NO: 79419

SEQ ID NO: 375641 - RNA, 64 nt, Homo Sapiens; identical to SEQ ID NO: 79420

SEQ ID NO: 375642 - RNA, 64 nt, Homo Sapiens; identical to SEQ ID NO: 79421

SEQ ID NO: 375643 - RNA, 64 nt, Homo Sapiens; identical to SEQ ID NO: 79422

SEQ ID NO: 375644 - RNA, 64 nt, Homo Sapiens; identical to SEQ ID NO: 79423

SEQ ID NO: 375645 - RNA, 64 nt, Homo Sapiens; identical to SEQ ID NO: 79424

SEQ ID NO: 375646 - RNA, 64 nt, Homo Sapiens; identical to SEQ ID NO: 79425

SEQ ID NO: 375647 - RNA, 64 nt, Homo Sapiens; identical to SEQ ID NO: 79426

SEQ ID NO: 375648 - RNA, 64 nt, Homo Sapiens; identical to SEQ ID NO: 79427

SEQ ID NO: 375649 - RNA, 64 nt, Homo Sapiens; identical to SEQ ID NO: 79428

SEQ ID NO: 375650 - RNA, 64 nt, Homo Sapiens; identical to SEQ ID NO: 79429

SEQ ID NO: 375651 - RNA, 64 nt, Homo Sapiens; identical to SEQ ID NO: 80598

SEQ ID NO: 375652 - RNA, 64 nt, Homo Sapiens; identical to SEQ ID NO: 80599

SEQ ID NO: 375653 - RNA, 64 nt, Homo Sapiens; identical to SEQ ID NO: 80600

SEQ ID NO: 375654 - RNA, 64 nt, Homo Sapiens; identical to SEQ ID NO: 80601

SEQ ID NO: 375655 - RNA, 64 nt, Homo Sapiens; identical to SEQ ID NO: 80602

SEQ ID NO: 375656 - RNA, 64 nt, Homo Sapiens; identical to SEQ ID NO: 80603

SEQ ID NO: 375657 - RNA, 64 nt, Homo Sapiens; identical to SEQ ID NO: 80604

SEQ ID NO: 375658 - RNA, 64 nt, Homo Sapiens; identical to SEQ ID NO: 80605

SEQ ID NO: 375659 - RNA, 64 nt, Homo Sapiens; identical to SEQ ID NO: 80606

SEQ ID NO: 375660 - RNA, 64 nt, Homo Sapiens; identical to SEQ ID NO: 80607

SEQ ID NO: 375661 - RNA, 64 nt, Homo Sapiens; identical to SEQ ID NO: 80608

SEQ ID NO: 375662 - RNA, 64 nt, Homo Sapiens; identical to SEQ ID NO: 80609

SEQ ID NO: 375663 - RNA, 64 nt, Homo Sapiens; identical to SEQ ID NO: 80610

SEQ ID NO: 375664 - RNA, 64 nt, Homo Sapiens; identical to SEQ ID NO: 80611

SEQ ID NO: 375665 - RNA, 64 nt, Homo Sapiens; identical to SEQ ID NO: 80612

SEQ ID NO: 375666 - RNA, 64 nt, Homo Sapiens; identical to SEQ ID NO: 80613

SEQ ID NO: 375667 - RNA, 64 nt, Homo Sapiens; identical to SEQ ID NO: 80614

SEQ ID NO: 375668 - RNA, 64 nt, Homo Sapiens; identical to SEQ ID NO: 80615

SEQ ID NO: 375669 - RNA, 64 nt, Homo Sapiens; identical to SEQ ID NO: 80616

SEQ ID NO: 375670 - RNA, 64 nt, Homo Sapiens; identical to SEQ ID NO: 80617

SEQ ID NO: 375671 - RNA, 64 nt, Homo Sapiens; identical to SEQ ID NO: 226265

SEQ ID NO: 375672 - RNA, 64 nt, Homo Sapiens; identical to SEQ ID NO: 226266

SEQ ID NO: 375673 - RNA, 64 nt, Homo Sapiens; identical to SEQ ID NO: 226267

SEQ ID NO: 375674 - RNA, 64 nt, Homo Sapiens; identical to SEQ ID NO: 226268

SEQ ID NO: 375675 - RNA, 64 nt, Homo Sapiens; identical to SEQ ID NO: 226269

SEQ ID NO: 375676 - RNA, 64 nt, Homo Sapiens; identical to SEQ ID NO: 226270

SEQ ID NO: 375677 - RNA, 64 nt, Homo Sapiens; identical to SEQ ID NO: 226271

SEQ ID NO: 375678 - RNA, 64 nt, Homo Sapiens; identical to SEQ ID NO: 226272

SEQ ID NO: 375679 - RNA, 64 nt, Homo Sapiens; identical to SEQ ID NO: 226273

SEQ ID NO: 375680 - RNA, 64 nt, Homo Sapiens; identical to SEQ ID NO: 226274

SEQ ID NO: 375681 - RNA, 64 nt, Homo Sapiens; identical to SEQ ID NO: 226275

SEQ ID NO: 375682 - RNA, 64 nt, Homo Sapiens; identical to SEQ ID NO: 226276

SEQ ID NO: 375683 - RNA, 64 nt, Homo Sapiens; identical to SEQ ID NO: 226277

SEQ ID NO: 375684 - RNA, 64 nt, Homo Sapiens; identical to SEQ ID NO: 226278

SEQ ID NO: 375685 - RNA, 64 nt, Homo Sapiens; identical to SEQ ID NO: 226279

SEQ ID NO: 375686 - RNA, 64 nt, Homo Sapiens; identical to SEQ ID NO: 226280

SEQ ID NO: 375687 - RNA, 64 nt, Homo Sapiens; identical to SEQ ID NO: 226281

SEQ ID NO: 375688 - RNA, 64 nt, Homo Sapiens; identical to SEQ ID NO: 226282

SEQ ID NO: 375689 - RNA, 64 nt, Homo Sapiens; identical to SEQ ID NO: 226283

SEQ ID NO: 375690 - RNA, 64 nt, Homo Sapiens; identical to SEQ ID NO: 226284

SEQ ID NO: 375691 - RNA, 64 nt, Homo Sapiens; identical to SEQ ID NO: 226285

SEQ ID NO: 375692 - RNA, 64 nt, Homo Sapiens; identical to SEQ ID NO: 226286

SEQ ID NO: 375693 - RNA, 64 nt, Homo Sapiens; identical to SEQ ID NO: 226287

SEQ ID NO: 375694 - RNA, 64 nt, Homo Sapiens; identical to SEQ ID NO: 226288

SEQ ID NO: 375695 - RNA, 64 nt, Homo Sapiens; identical to SEQ ID NO: 226289

SEQ ID NO: 375696 - RNA, 64 nt, Homo Sapiens; identical to SEQ ID NO: 226290

SEQ ID NO: 375697 - RNA, 64 nt, Homo Sapiens; identical to SEQ ID NO: 226291

SEQ ID NO: 375698 - RNA, 64 nt, Homo Sapiens; identical to SEQ ID NO: 226292

SEQ ID NO: 375699 - RNA, 64 nt, Homo Sapiens; identical to SEQ ID NO: 226293

SEQ ID NO: 375700 - RNA, 64 nt, Homo Sapiens; identical to SEQ ID NO: 226294

SEQ ID NO: 375701 - RNA, 64 nt, Homo Sapiens; identical to SEQ ID NO: 226295

SEQ ID NO: 375702 - RNA, 64 nt, Homo Sapiens; identical to SEQ ID NO: 226296

SEQ ID NO: 375703 - RNA, 64 nt, Homo Sapiens; identical to SEQ ID NO: 226297

SEQ ID NO: 375704 - RNA, 64 nt, Homo Sapiens; identical to SEQ ID NO: 226298

SEQ ID NO: 375705 - RNA, 64 nt, Homo Sapiens; identical to SEQ ID NO: 226299

SEQ ID NO: 375706 - RNA, 64 nt, Homo Sapiens; identical to SEQ ID NO: 226300

SEQ ID NO: 375707 - RNA, 64 nt, Homo Sapiens; identical to SEQ ID NO: 226301

SEQ ID NO: 375708 - RNA, 64 nt, Homo Sapiens; identical to SEQ ID NO: 226302

SEQ ID NO: 375709 - RNA, 64 nt, Homo Sapiens; identical to SEQ ID NO: 226303

SEQ ID NO: 375710 - RNA, 64 nt, Homo Sapiens; identical to SEQ ID NO: 226304

SEQ ID NO: 375711 - RNA, 64 nt, Homo Sapiens; identical to SEQ ID NO: 226305

SEQ ID NO: 375712 - RNA, 64 nt, Homo Sapiens; identical to SEQ ID NO: 226306

SEQ ID NO: 375713 - RNA, 64 nt, Homo Sapiens; identical to SEQ ID NO: 226307

SEQ ID NO: 375714 - RNA, 64 nt, Homo Sapiens; identical to SEQ ID NO: 226308

SEQ ID NO: 375715 - RNA, 64 nt, Homo Sapiens; identical to SEQ ID NO: 226309

SEQ ID NO: 375716 - RNA, 64 nt, Homo Sapiens; identical to SEQ ID NO: 226310

SEQ ID NO: 375717 - RNA, 64 nt, Homo Sapiens; identical to SEQ ID NO: 226311

SEQ ID NO: 375718 - RNA, 64 nt, Homo Sapiens; identical to SEQ ID NO: 226312

SEQ ID NO: 375719 - RNA, 64 nt, Homo Sapiens; identical to SEQ ID NO: 226313

SEQ ID NO: 375720 - RNA, 64 nt, Homo Sapiens
ugcuucuugugauugaacugaaccuguaaggauucauggauaaaaugaacaggaauagaucuga

SEQ ID NO: 375721 - RNA, 64 nt, Homo Sapiens
uugcccuugauuuugauauuagaauaggugauuacauggauauuuaauauuucuauauucugcu

SEQ ID NO: 375722 - RNA, 64 nt, Homo Sapiens
auauauauauauauauauaguuuuacuagguuuucauggauaaguuuuuaaauguaagacagga

SEQ ID NO: 375723 - RNA, 64 nt, Homo Sapiens
aaguucccaggcaacucgaauuugcaaacacagccauggauacacuauuuaccuuacaguaguu

SEQ ID NO: 375724 - RNA, 64 nt, Homo Sapiens
agccuaacugccaauaucaaguugcagauuuuaauccauggaaauuguguuuugugcugaauug

SEQ ID NO: 375725 - RNA, 64 nt, Homo Sapiens
ucuccaacguugagacuuugcagauggcacagacuccauggauaauagguaaacuuggggccgg

SEQ ID NO: 375726 - RNA, 59 nt, Homo Sapiens
agauuccagcucaucacuagaggcagcccuccauggacccaugaaaacugagaugagga

SEQ ID NO: 375727 - RNA, 64 nt, Homo Sapiens
aaggugguauaaaaacauagacuggaggagguaauccauggagagagaaaaagaagagggcuca

SEQ ID NO: 375728 - RNA, 64 nt, Homo Sapiens
caauggacucauccauuugucccccacuccaaaguccauggauuccauucuuuggaacaaaucc

SEQ ID NO: 375729 - RNA, 64 nt, Homo Sapiens
cuugccucggugcagucucccccucuuggccccauccauggacugauacagcgccacuccugcc

SEQ ID NO: 375730 - RNA, 64 nt, Homo Sapiens
guccgucaacugaugaguggauuaauaaaauguuuccauggaauauuccuuggauuacucagcc

SEQ ID NO: 375731 - RNA, 64 nt, Homo Sapiens
auuccauuuauaugaaauauacauacuaggcaaauccauggagauggaacauagauuagugguu

SEQ ID NO: 375732 - RNA, 64 nt, Homo Sapiens
uuucuuucucugcuuucuugugguuuauuuuauauccauggaccuuucauggcuuauaccccau

SEQ ID NO: 375733 - RNA, 64 nt, Homo Sapiens
guuuuuaauaaguaggcaaggaaaccaucuacauuccauggaauagagaggggaaggguacaga

SEQ ID NO: 375734 - RNA, 64 nt, Homo Sapiens
caggaagagcagcgcuguguugcagaauggaguuuccauggauuucuaccagaccacugaagga

SEQ ID NO: 375735 - RNA, 64 nt, Homo Sapiens
uuuaauaccucauucugucuaugcaagaugaaaauccauggaguuuuuucuuggcuuuuguacc

SEQ ID NO: 375736 - RNA, 64 nt, Homo Sapiens
guuuauagacauggaggcaggauuguauuuuguguccauggaacgguuuccagggaauuugaau

SEQ ID NO: 375737 - RNA, 64 nt, Homo Sapiens
uagcaccacaggaagcaggcggaauacaaagguauccauggaggugacaguaaagggcaggaag

SEQ ID NO: 375738 - RNA, 64 nt, Homo Sapiens
cugcuuccagaaggcaucugguuuuagggcagaauccauggagaagcuccaucuuccauuccug

SEQ ID NO: 375739 - RNA, 64 nt, Homo Sapiens
ggguggggaggugguggggguccuccucugccucuccauggaguugucccccuggccuccaggc

SEQ ID NO: 375740 - RNA, 64 nt, Homo Sapiens
aaauguaauccauuuuuacuucagcucauccaaaagcagccagcagaccgguugacugagaccg

SEQ ID NO: 375741 - RNA, 64 nt, Homo Sapiens
cauggugaaacccgucucuaccaaacagacaaaaagcagccaggcgugguggcacaucuguggu

SEQ ID NO: 375742 - RNA, 64 nt, Homo Sapiens
acauggccauagaggcccaggcaccaccaggagcagcagccagcaccaccuacacaggagucuu

SEQ ID NO: 375743 - RNA, 64 nt, Homo Sapiens
gccaagggccccaggggcagcaaggccuugguggagcagccagagcugugccugcucagcagcc

SEQ ID NO: 375744 - RNA, 64 nt, Homo Sapiens
ggccuugguggagcagccagagcugugccugcucagcagccagucucagagaccagcacucagc

SEQ ID NO: 375745 - RNA, 64 nt, Homo Sapiens
agaugccagggguacugaaucugcaaagcaaaugagcagccaaggaccagcaucuguccgcauu

SEQ ID NO: 375746 - RNA, 64 nt, Homo Sapiens
cucuacuuccugucugcaugcccaaggcuucugaagcagccaaugucgaugcaacaacauuugu

SEQ ID NO: 375747 - RNA, 64 nt, Homo Sapiens
guguuaagucauuaugagcuuaguuuacccucacagcagccauauucuaaguucuuuuauguuu

SEQ ID NO: 375748 - RNA, 64 nt, Homo Sapiens
uauuuaaaaaauauuuuuaauacauuucagcuccagcagccagcaugaaagaaguacuucuuuu

SEQ ID NO: 375749 - RNA, 64 nt, Homo Sapiens
caugccccagggaccgccacugcccaccgccuccagcagccaugcaugugcgcccgcagcccug

SEQ ID NO: 375750 - RNA, 64 nt, Homo Sapiens
gugcuuuugaguuuuagaauuagucauucuuuagagcagccagcuaguggcauuucuaggaaaa

SEQ ID NO: 375751 - RNA, 64 nt, Homo Sapiens
ccugugaagccagcauguucaccacuggucguucagcagccacgacagcaccaugugagauggc

SEQ ID NO: 375752 - RNA, 64 nt, Homo Sapiens
cggccaguccagccuuuuaaagaacgucagguggagcagccaggugaaaggccuggcggggagg

SEQ ID NO: 375753 - RNA, 64 nt, Homo Sapiens
ucccuacccuguuuccuaacagagauguuuccacagcagccauuaaguagagguggaaaaccag

SEQ ID NO: 375754 - RNA, 64 nt, Homo Sapiens
aggcuggaggugacgaugagugcucccagcccagagcagccaucgcacggcugugcuccucccc

SEQ ID NO: 375755 - RNA, 64 nt, Homo Sapiens
ucguggcaaccauagagaucgagcuucaggacagagcagccaaugaaaacggccgccugaaccc

SEQ ID NO: 375756 - RNA, 64 nt, Homo Sapiens
auguguggccaauggagacagaggcuuagugcagagcagccaauggguacugagcuggcugagc

SEQ ID NO: 375757 - RNA, 64 nt, Homo Sapiens
aggguucuguggcaguugcagggcaauguuauggagcagccaacggccuggcagaggagcccaa

SEQ ID NO: 375758 - RNA, 64 nt, Homo Sapiens
uucugcagggcugcucaguucacaggaggcucccagcagccaccccacauccagccuacacaga

SEQ ID NO: 375759 - RNA, 64 nt, Homo Sapiens
uucugcagauguaagcacuggcuuuuauaagagcagcagccaacacguuuagcagacacugcgc

SEQ ID NO: 375760 - RNA, 55 nt, Homo Sapiens
cugcccgggaugaacucugagggguagcagccagaaagccaaagcagccaucggu

SEQ ID NO: 375761 - RNA, 64 nt, Homo Sapiens
gaugaacucugagggguagcagccagaaagccaaagcagccaucgguggcccaggcuccacgug

SEQ ID NO: 375762 - RNA, 64 nt, Homo Sapiens
cccuccccacgucgcccccuccugcacagccaccagcagccagcccccuccgauacaccucccg

SEQ ID NO: 375763 - RNA, 64 nt, Homo Sapiens
ucaggcaggaaagcaacuuaaaggagggccugcaagcagccagggucagagacagggcuugguu

SEQ ID NO: 375764 - RNA, 64 nt, Homo Sapiens
guccuuggcugccacggagggauuugaucaccgaagcagccaccugcuguaguuggaccugagg

SEQ ID NO: 375765 - RNA, 64 nt, Homo Sapiens
ucagaggcucaaggugcugagaagccaccgggaaagcagccagcacaaagggcccaggaagcca

SEQ ID NO: 375766 - RNA, 64 nt, Homo Sapiens
cacacguggaccauugugggucccuugggaggccagcagccagacuacggaauccacaugugga

SEQ ID NO: 375767 - RNA, 64 nt, Homo Sapiens
gcugacccguggccccagcucacucauugcccucagcagccacccgaggcugugcagaagggua

SEQ ID NO: 375768 - RNA, 64 nt, Homo Sapiens
uaugugaucuuuaaauccaaccucagcuccucugagcagccaccauggggaggauggagcuucu

SEQ ID NO: 375769 - RNA, 64 nt, Homo Sapiens
cgucugucuguguuuagagacucaagugccagggagcagccacauugaaggaaagauuucuccu

SEQ ID NO: 375770 - RNA, 64 nt, Homo Sapiens
aaacuguaaccucaaggaaaugaaauacacuaagagcagccacauucguccaucugcuuuuuuc

SEQ ID NO: 375771 - RNA, 64 nt, Homo Sapiens
aaaauuggacuuuguauuguccuaaguauuuuauagcagccaucaguaaaguauugcagagauu

SEQ ID NO: 375772 - RNA, 64 nt, Homo Sapiens
ggucgccugggccccugcugacccccuccuccagagcagccagcccagcccgggaacaagacgg

SEQ ID NO: 375773 - RNA, 64 nt, Homo Sapiens
aagcuggguccucuggaggaggggcgagcuguggagcagccacccacugcugccccaagcucac

SEQ ID NO: 375774 - RNA, 64 nt, Homo Sapiens
cugcccuacgugcacuacaggaaggggugaggagagcagccagaggaaaaccagccccagaaug

SEQ ID NO: 375775 - RNA, 64 nt, Homo Sapiens
gcccugccucugucaccucauugguccaugaaggagcagccaggggugguggaaggagcacugg

SEQ ID NO: 375776 - RNA, 64 nt, Homo Sapiens
uaggaggauuaaaauauuaucucauacuuauaaacaguaugagaagugaguuugucaaaaguau

SEQ ID NO: 375777 - RNA, 64 nt, Homo Sapiens
uacuuaugacaaacucgcucagccuuaugacaaacaguaugagaaaucuagauacucauuaagu

SEQ ID NO: 375778 - RNA, 64 nt, Homo Sapiens
agcggaugaggauacagaagagcauaauccaacucaguaugaagagccuuaagccucagcaaag

SEQ ID NO: 375779 - RNA, 64 nt, Homo Sapiens
ugccacuggauugacgcaaagauauuauucauugcaguaugaguggacuuuaaaauagguucaa

SEQ ID NO: 375780 - RNA, 64 nt, Homo Sapiens
aaaagcuuguucugugugacaguuuccagaccaccaguaugaaucuuagcacauguacuggugg

SEQ ID NO: 375781 - RNA, 64 nt, Homo Sapiens
uaaucugagcaggucugaauugugaaauagugcacaguaugaguuuggugacauuuugcuuuua

SEQ ID NO: 375782 - RNA, 64 nt, Homo Sapiens
auaguuuuuuagauacccagacuuuacaugaaaucaguaugaaaugacucauaugguagagagg

SEQ ID NO: 375783 - RNA, 64 nt, Homo Sapiens
aucucauuggaccucagaaaaguugugcugcagacaguaugaacuuuuaaaugccuucaguguc

SEQ ID NO: 375784 - RNA, 64 nt, Homo Sapiens
uccaucugaacuugaaaagucagagacugguguacaguaugacuuuugugcuguuaccuaaaau

SEQ ID NO: 375785 - RNA, 64 nt, Homo Sapiens
uggcucuaacugccagucagaauauuuaaaauugcaguaugaccauuuccuguguuugaguugg

SEQ ID NO: 375786 - RNA, 64 nt, Homo Sapiens; identical to SEQ ID NO: 375782

SEQ ID NO: 375787 - RNA, 64 nt, Homo Sapiens; identical to SEQ ID NO: 375783

SEQ ID NO: 375788 - RNA, 64 nt, Homo Sapiens
uuacuguauacgucgaccuauuuuagaugcgcaucaguaugaaauugucucaaucuuggauguu

SEQ ID NO: 375789 - RNA, 64 nt, Homo Sapiens
ugcuguuuaaaaaaauuguguauuuauacaguaacaguaugaauucauuaaucucaccuguaac

SEQ ID NO: 375790 - RNA, 63 nt, Homo Sapiens
gcccagccgccucccucucuugggacgcaacuucuuccccacucggaugggcuuuaaauuauu

SEQ ID NO: 375791 - RNA, 63 nt, Homo Sapiens
uuccaagggcccuggcguccucugccuuccccgcuuccccaugagcgucugcaaaacacuugc

SEQ ID NO: 375792 - RNA, 63 nt, Homo Sapiens
ucugugcucacugaagggugagccaggccagugcuuccccagccccugggccuggucacuaca

SEQ ID NO: 375793 - RNA, 63 nt, Homo Sapiens
gucacuacacaguggaaaacagacaagcggccccuuccccaaaucccaagagugucuugcugc

SEQ ID NO: 375794 - RNA, 63 nt, Homo Sapiens
auuccuuuccuuucuauccuuuuauauuuuucccuuccccacccccucacucaaugguauaaa

SEQ ID NO: 375795 - RNA, 63 nt, Homo Sapiens
agaucucucuuuugcaacauuuuacccauuucccuuccccaaaccaugugcuuauuagauggu

SEQ ID NO: 375796 - RNA, 63 nt, Homo Sapiens
ggccuaccccccauauguccccaagcaaagacccuuccccagaggacuuggcccugccugaug

SEQ ID NO: 375797 - RNA, 63 nt, Homo Sapiens
ggccaccaacugaccuggggcccacuccagggccuuccccagcggaggagggagccugcucac

SEQ ID NO: 375798 - RNA, 63 nt, Homo Sapiens
aggggacagucuggccaacuuuuuguuuaauaccuuccccaaggaggagauacuuauuggucu

SEQ ID NO: 375799 - RNA, 63 nt, Homo Sapiens
cugucaauugaaaucuuaacagccagcacaucccuuccccaaaucuaaagucauuuaacuaau

SEQ ID NO: 375800 - RNA, 63 nt, Homo Sapiens
uuuaaaggcccugcagaaauauuauuauaugugcuuccccaagaaauaacaauauagaacaac

SEQ ID NO: 375801 - RNA, 63 nt, Homo Sapiens
ccaaaccauagcugucugucuacuuccuaaucucuuccccaauaaaaagggucuuuaagaacc

SEQ ID NO: 375802 - RNA, 63 nt, Homo Sapiens
ucucugugcacucugucuugaaaguucagcuuccuuccccagggcaccuguccucaucucugc

SEQ ID NO: 375803 - RNA, 63 nt, Homo Sapiens
cuccagagggagggaggugguggauucucuccucuuccccauuggaggcuggaauggagaauc

SEQ ID NO: 375804 - RNA, 63 nt, Homo Sapiens
uuuucucuaagauauacaguauugagccccucccuuccccaguaagggcuaggcagggggcaa

SEQ ID NO: 375805 - RNA, 63 nt, Homo Sapiens
acaguuccaaugugccuguucacucaccucucccuuccccaacccuucucuacuuggcugcug

SEQ ID NO: 375806 - RNA, 63 nt, Homo Sapiens
cuucucuacuuggcugcuguuuuaaaguuugcccuuccccaaauuuggauuuuuauuacagau

SEQ ID NO: 375807 - RNA, 63 nt, Homo Sapiens
gucccuuuccagugcuguggcauucuguggcagcuuccccagguguggugacggggggggggc

SEQ ID NO: 375808 - RNA, 63 nt, Homo Sapiens
cuugaggguggacggcgugccucucccaggagccuuccccauguccuugccuugcugagaauu

SEQ ID NO: 375809 - RNA, 63 nt, Homo Sapiens
cuccucuuccucccccggaacccuuuacaugcccuuccccaguacaaauuaaagguuaaaggc

SEQ ID NO: 375810 - RNA, 63 nt, Homo Sapiens
uuauuguaaaagaguuuaacuccuguuuauacccuuccccacgcaaauggaaauugugcacuu

SEQ ID NO: 375811 - RNA, 63 nt, Homo Sapiens
cccuugggugccagagugagacacagcaggacccuuccccaaauacuaggcucagagcaaccu

SEQ ID NO: 375812 - RNA, 63 nt, Homo Sapiens
cccuguguccuuggacagcagauccacacaccacuuccccacccacacacaguacccugggcu

SEQ ID NO: 375813 - RNA, 63 nt, Homo Sapiens
aaggagggacagcauuucuccuguuugccaccacuuccccaggcagagagagccuuggcgccu

SEQ ID NO: 375814 - RNA, 63 nt, Homo Sapiens
caguuuaucuuccgucacauggccucaguuucucuuccccacagggcagcuuuauuccuguug

SEQ ID NO: 375815 - RNA, 63 nt, Homo Sapiens
cccccguccugccauccccccccgccguccugccuuccccaccccacccuuaggucccaggua

SEQ ID NO: 375816 - RNA, 63 nt, Homo Sapiens
ucucuguuuacugccuuugaacagaacuucuuccuuccccaugcuuugggucaccucgggcug

SEQ ID NO: 375817 - RNA, 63 nt, Homo Sapiens
gaguggugcuuacugugcugacuguguacuuaucuuccccaagagaaaaugcuucuuuugagc

SEQ ID NO: 375818 - RNA, 63 nt, Homo Sapiens
agagaggaguuugcucugaauuuguaaauaagucuuccccauuccucauacucgagccucucc

SEQ ID NO: 375819 - RNA, 63 nt, Homo Sapiens
gccuucuggggaggggcuccgcacagagagcggcuuccccaucccuucuggcugcugcaguca

SEQ ID NO: 375820 - RNA, 63 nt, Homo Sapiens
gccuucuggcugcugcagucacacagaggacagcuuccccaucccauugccuucuggggaggg

SEQ ID NO: 375821 - RNA, 63 nt, Homo Sapiens
gccuucuggggagggacacagcacagagagcggcuuccccauuccuucuggccgcugcaguca

SEQ ID NO: 375822 - RNA, 63 nt, Homo Sapiens
gccuucuggccgcugcagucacacagaggacggcuuccccaucccauugccuucuggggaggg

SEQ ID NO: 375823 - RNA, 63 nt, Homo Sapiens
gccuucuggggagggacacagcacagaggauggcuuccccauucugccaggcagcugcaguua

SEQ ID NO: 375824 - RNA, 63 nt, Homo Sapiens
gacagcuuugcuccgcucccaccgcccccaccccuuccccaggcccaccaucaccaccgccuc

SEQ ID NO: 375825 - RNA, 63 nt, Homo Sapiens
gucuuugucaccacguggggcucacuuuucauccuuccccaacuucccuaguccccguacuag

SEQ ID NO: 375826 - RNA, 63 nt, Homo Sapiens
uuacauucuccucuggggcucuaccucuccacacuuccccagaagggaaaagggcacccugga

SEQ ID NO: 375827 - RNA, 63 nt, Homo Sapiens
ggaaaucacuccuuggugggcagcauccugaggcuuccccagaaccaggccucugcucuggcc

SEQ ID NO: 375828 - RNA, 63 nt, Homo Sapiens
aguauaaaugggcccauauuauagucucacacccuuccccauacuccaaacucauccuugugu

SEQ ID NO: 375829 - RNA, 63 nt, Homo Sapiens
gaucuaaggacugggcuaccaagggcucagggccuuccccacacuugccacuccuagcuccag

SEQ ID NO: 375830 - RNA, 63 nt, Homo Sapiens
ucagauacugucaacuccaucuucacucucugccuuccccauccaaccuucccccacagcuau

SEQ ID NO: 375831 - RNA, 63 nt, Homo Sapiens
cacucacguucauguccuuaccaucuucacuggcuuccccagcccuugagucucuccucuucu

SEQ ID NO: 375832 - RNA, 63 nt, Homo Sapiens
gauggcgguggaggggguucgcuggugugggaacuuccccacgguggggcuggugggucugca

SEQ ID NO: 375833 - RNA, 63 nt, Homo Sapiens
cugcccacucuggggacccggacaacacagcugcuuccccaggcugaggcuggcugggggcag

SEQ ID NO: 375834 - RNA, 63 nt, Homo Sapiens
uguccugccagcccuucucgcucaggcaccccucuuccccagccccacccuaccucaccucuu

SEQ ID NO: 375835 - RNA, 63 nt, Homo Sapiens
ucggguccccaagccgcugguuuaccccaaacucuuccccaccuugagcugaacugggcugug

SEQ ID NO: 375836 - RNA, 63 nt, Homo Sapiens
agggauuacuuagaagacauuuuuguacaugcucuuccccaaggauuguacguauuauacaaa

SEQ ID NO: 375837 - RNA, 63 nt, Homo Sapiens
uacugaugagaugaaaccuauuuguaaggagaucuuccccaggagcauuucuguugccuucuu

SEQ ID NO: 375838 - RNA, 63 nt, Homo Sapiens
guggacugggcugcuggccugcuugcuuccucccuuccccauuccuagcagggccugaggccc

SEQ ID NO: 375839 - RNA, 63 nt, Homo Sapiens
ugacgggaagcugagugacccugaggccuuaagcuuccccagucuuggccccaaaugcaguca

SEQ ID NO: 375840 - RNA, 63 nt, Homo Sapiens
gcccuuccaagcccggcuuugggccaggaaaggcuuccccagguggcucuucuaccaggcuuu

SEQ ID NO: 375841 - RNA, 63 nt, Homo Sapiens
cgccugcagaaaggaccugcccugauaaugucccuuccccagauucucaagcagaugcccaag

SEQ ID NO: 375842 - RNA, 63 nt, Homo Sapiens
cuccuggcagagggagaggacaggaggaggagccuuccccaggaggaacgaggagagguggcc

SEQ ID NO: 375843 - RNA, 63 nt, Homo Sapiens
ugacaagcgacaaguguacccagaguagaaggccuuccccacucccaccucaaacccaggagc

SEQ ID NO: 375844 - RNA, 63 nt, Homo Sapiens
auguuucuggcaggcccagaagugcuggccguucuuccccagccuccccacugcucccuccuc

SEQ ID NO: 375845 - RNA, 63 nt, Homo Sapiens
gcuggccugacugugcugggucaugaaugaggccuuccccagguuggccccugggguccugcc

SEQ ID NO: 375846 - RNA, 63 nt, Homo Sapiens
ugccuccuaccagcaguuucuggccaucgccaccuuccccagcggccaggccugccugcccac

SEQ ID NO: 375847 - RNA, 63 nt, Homo Sapiens
caccaacccucagggcaaagggcugcugaucgccuuccccacccuccucuuccccagacgccu

SEQ ID NO: 375848 - RNA, 63 nt, Homo Sapiens
cgccuggcugcugaucgccuuggccaugcuccucuuccccagacucacccuggaggcaccugg

SEQ ID NO: 375849 - RNA, 63 nt, Homo Sapiens
gcccagaaacaagaaacacgauaccauucuggccuuccccaccccacauccucucuuggccuu

SEQ ID NO: 375850 - RNA, 63 nt, Homo Sapiens
uuuugauuuggugugugcccuaggguauguacccuuccccaucugagccucgguguguccaug

SEQ ID NO: 375851 - RNA, 63 nt, Homo Sapiens
ccuggaucaggguuguucugggaguccugucagcuuccccaggagcucucugcugagcagccc

SEQ ID NO: 375852 - RNA, 63 nt, Homo Sapiens
ccccagaacaauucugcagaguggugaaguucacuuccccaacucuucuccaagucuagcuuu

SEQ ID NO: 375853 - RNA, 63 nt, Homo Sapiens
uggggcggcuuuggucccuuuuccuggcccuuccuuccccacuucuaagccaaagaaaggaga

SEQ ID NO: 375854 - RNA, 63 nt, Homo Sapiens
cccgggcagcccugcccagcucaggccccuuuccuuccccauugagguugggguagguggggg

SEQ ID NO: 375855 - RNA, 63 nt, Homo Sapiens
guugugguuuuucaugcccucuaccaugugggccuuccccaggagaugauccuguuaaguguu

SEQ ID NO: 375856 - RNA, 63 nt, Homo Sapiens
auguucuagcugauggugagcggcacagucccacuuccccaucuccccaaguaggugguguua

SEQ ID NO: 375857 - RNA, 53 nt, Homo Sapiens; identical to SEQ ID NO: 156210

SEQ ID NO: 375858 - RNA, 63 nt, Homo Sapiens
uuuauccucauggugcccacuacgagucauacucuuccccaugcugcucauccuccugggccc

SEQ ID NO: 375859 - RNA, 63 nt, Homo Sapiens
uaggagcaaagucucaccccuuugucuacguugcuuccccaaaccaugagcagagggacuucg

SEQ ID NO: 375860 - RNA, 63 nt, Homo Sapiens
ugccaaaccagacucggguccccuccugcuucccuuccccacuuaucccccaagugccuuccc

SEQ ID NO: 375861 - RNA, 63 nt, Homo Sapiens
agaaaagaguuccuuuugccuuauuccuuaugccuuccccacugguauugaggguuuugauaa

SEQ ID NO: 375862 - RNA, 63 nt, Homo Sapiens
gguaggaaaaaaaaguaccuccuagaaggaagccuuccccaccauuuccaggugccaacugcu

SEQ ID NO: 375863 - RNA, 63 nt, Homo Sapiens
uugugcuccaggggagccccgcccaagggucgccuuccccagccugcguguggagggggugcu

SEQ ID NO: 375864 - RNA, 63 nt, Homo Sapiens
cuccagggcagaaagagcccugcugacccaggacuuccccaacaggacgcccgagcccacccc

SEQ ID NO: 375865 - RNA, 63 nt, Homo Sapiens
ucuuguacacauuuuaauaaucugguccuuuuccuuccccaucuguacauggccacaguacag

SEQ ID NO: 375866 - RNA, 63 nt, Homo Sapiens
uuucaguuauacgaaugccacugaccugguggucuuccccaacuacaaaaccucuccacucca

SEQ ID NO: 375867 - RNA, 63 nt, Homo Sapiens
gccccaccaccaccacgugcgaccaggcuugggcuuccccagcccccacccaggcacauuagc

SEQ ID NO: 375868 - RNA, 63 nt, Homo Sapiens
cccugguccccgggagcagccugucuucucacccuuccccacuucaccugaccuucuccagga

SEQ ID NO: 375869 - RNA, 63 nt, Homo Sapiens
ugggccuucauaaaaugcaguccagaguucuuccuuccccauccccagcaccccuaucccauu

SEQ ID NO: 375870 - RNA, 63 nt, Homo Sapiens
ccccucagaggcccccgccaaagggcuaguccucuuccccagucuacaggccacucuaggccc

SEQ ID NO: 375871 - RNA, 63 nt, Homo Sapiens
cuuaagggggagggcuagugugggggagggaggcuuccccagccuuaagagacccucucagcc

SEQ ID NO: 375872 - RNA, 63 nt, Homo Sapiens
cauaaauuuucuuauggaacucucccacauccucuuccccaacuucauuugcuucucucaaca

SEQ ID NO: 375873 - RNA, 63 nt, Homo Sapiens
aaucuuacaaaguguugguccagagucccaucucuuccccaacccuggauaccaguagcuucc

SEQ ID NO: 375874 - RNA, 63 nt, Homo Sapiens
aagcaagggcacagggauuagaccuguggcacacuuccccaauucccucaucuguaggauuug

SEQ ID NO: 375875 - RNA, 63 nt, Homo Sapiens
uaguguccugggacaugguaaggaauuuccuggcuuccccagagguuugauggacagaggcug

SEQ ID NO: 375876 - RNA, 63 nt, Homo Sapiens
ccagccaggugucccuccuacugguccugggcacuuccccacccaauaccugcauccccagca

SEQ ID NO: 375877 - RNA, 63 nt, Homo Sapiens
uugaggagagaaguggaagcacugcccuguggucuuccccaggaggcagguccugaggcaggc

SEQ ID NO: 375878 - RNA, 63 nt, Homo Sapiens
aagcugaauaggguagaaccagaugucuccuggcuuccccaagguggcgcuacauuaauuuca

SEQ ID NO: 375879 - RNA, 63 nt, Homo Sapiens
agcagagacccuggagcacauaccccaggaccccuuccccagcgcuuuucuucauuuacuuca

SEQ ID NO: 375880 - RNA, 63 nt, Homo Sapiens
uccuucccaaacccucuugggccuuccagccuccuuccccaccagggcagggaggcuuccugg

SEQ ID NO: 375881 - RNA, 63 nt, Homo Sapiens
agggacugggguuucuggggacccacccuagaucuuccccaaguuaccgcucuguuuauagug

SEQ ID NO: 375882 - RNA, 63 nt, Homo Sapiens
ucugcuccuccccuuucacaucugggcauaucccuuccccagacuuuggucuuguugauuucc

SEQ ID NO: 375883 - RNA, 63 nt, Homo Sapiens
cagcauccccaacugcgacuugucucugccccccuuccccagcucugcuaggugcccugcccc

SEQ ID NO: 375884 - RNA, 63 nt, Homo Sapiens
ggauugcucuccaaggccauaaugaccccuugccuuccccaugauucucuacaaagcucuugc

SEQ ID NO: 375885 - RNA, 63 nt, Homo Sapiens
ccuccucccacauuucuggagcuuuuuuuuuuccuuccccauugaccuuuguggucuucugug

SEQ ID NO: 375886 - RNA, 63 nt, Homo Sapiens
acccucuggccucucaccccacuucagugcucucuuccccaacuucucucgggcucuuugcuc

SEQ ID NO: 375887 - RNA, 63 nt, Homo Sapiens
uccccucucaaccaggaguggagggcuaggucccuuccccauggggaguacacuuggguguuc

SEQ ID NO: 375888 - RNA, 63 nt, Homo Sapiens
uacgggcuuagcccucgccucccucacugggagcuuccccauccucccugccuuccccagugg

SEQ ID NO: 375889 - RNA, 63 nt, Homo Sapiens
cucccucacugggagcuuccccauccucccugccuuccccagugggaaguuagggaagcucag

SEQ ID NO: 375890 - RNA, 63 nt, Homo Sapiens
cacaaagguguuugugauucucaagcccauuuccuuccccaacccgcacacacuucuucccca

SEQ ID NO: 375891 - RNA, 63 nt, Homo Sapiens
aagcccauuuccuuccccaauccgcacacacuucuuccccaucgaacaugcuccgcaaaguuc

SEQ ID NO: 375892 - RNA, 63 nt, Homo Sapiens
caggcacccccucccggggcgaccccaacauagcuuccccacccgggcagggcccccacacca

SEQ ID NO: 375893 - RNA, 63 nt, Homo Sapiens
ucaggcacaacagagucuggcgagacagggucccuuccccagcucauagaacuuugcucuucc

SEQ ID NO: 375894 - RNA, 63 nt, Homo Sapiens
gccucaggcuccuuccuggucuggcccagcuggcuuccccagccccucagccauccagggcua

SEQ ID NO: 375895 - RNA, 63 nt, Homo Sapiens
gggcugguccagguagcucuccugaaccuccuccuuccccaagcugagaagcugagagcugga

SEQ ID NO: 375896 - RNA, 63 nt, Homo Sapiens
caacauccauuguagggggaaucuaugauucugcuuccccagcggauucccacucuguccacc

SEQ ID NO: 375897 - RNA, 63 nt, Homo Sapiens
gagccucccucugacacagaggagguggcuccccuuccccacaccuuagaguggcugggaggg

SEQ ID NO: 375898 - RNA, 63 nt, Homo Sapiens
acuuuaacaccagguuuauggaaaaugucaggccuuccccacaacuccugucuaacugcuguc

SEQ ID NO: 375899 - RNA, 63 nt, Homo Sapiens
ccugugaggcagccuucugauggccuggcccaccuuccccagaaccaggggaggccugaggcu

SEQ ID NO: 375900 - RNA, 63 nt, Homo Sapiens
uggagccagggacuguccgggggaucagcuucccuuccccaccagagcagugggaccagcaug

SEQ ID NO: 375901 - RNA, 63 nt, Homo Sapiens
ccuuaauuuuaacuuugugguuuuuucuuucuucuuccccacccacuggaaagucuguuuuuu

SEQ ID NO: 375902 - RNA, 63 nt, Homo Sapiens
uaaagccuagaagagcuucucaacaacaaaaagcuuccccaacgugagacuccgucacaacaa

SEQ ID NO: 375903 - RNA, 63 nt, Homo Sapiens
cuggacgugguggcucacgccaguuacaaaaaccuuccccaggcagauucuaccacacagcag

SEQ ID NO: 375904 - RNA, 63 nt, Homo Sapiens
gccccagcuuagccucuucuagaauagcacccccuuccccauuaccucuuccagauuucucua

SEQ ID NO: 375905 - RNA, 63 nt, Homo Sapiens
gcagcaggccccgagccccugcuggcuaccacucuuccccagacagacaugugccccuuugcu

SEQ ID NO: 375906 - RNA, 63 nt, Homo Sapiens
accccugagaggggcuuauucacccacccugcccuuccccaggaggccagagcucggcagagu

SEQ ID NO: 375907 - RNA, 63 nt, Homo Sapiens
cugccacccacgcuggcggaggccaggccuccucuuccccaggcagacccaccacagcuggag

SEQ ID NO: 375908 - RNA, 63 nt, Homo Sapiens
ucuccuccaggccccccgggcuccugggggggccuuccccaucuuugucucucuguccaccca

SEQ ID NO: 375909 - RNA, 63 nt, Homo Sapiens
uuccugggcuccccuucucuuucuccaaucccccuuccccagggggagacagccccaacccuu

SEQ ID NO: 375910 - RNA, 63 nt, Homo Sapiens
acggaaggggccccugggcaagagagcacugcacuuccccaaagcuccagcuucuggguaucc

SEQ ID NO: 375911 - RNA, 63 nt, Homo Sapiens
uaaauacccugccugcaacugagagaauuuccucuuccccagcuuaccuuggagaggguccug

SEQ ID NO: 375912 - RNA, 63 nt, Homo Sapiens
ccagucugucuggggacaggaucccugcugcaccuuccccacccccuccugggaagugccccc

SEQ ID NO: 375913 - RNA, 63 nt, Homo Sapiens
acagcugcccccagaacucccuucaagggaggacuuccccagcuaugggaagugccaucaggg

SEQ ID NO: 375914 - RNA, 63 nt, Homo Sapiens
uuaaaugcagugccuagagagagaguauugucucuuccccaacacuaaccccacucccaugaa

SEQ ID NO: 375915 - RNA, 63 nt, Homo Sapiens
caaaggaccaguuuuccuaggccaaagaagucucuuccccauguuaguccuaugccuugaaau

SEQ ID NO: 375916 - RNA, 63 nt, Homo Sapiens
uccagcaguauuacuuguaacaaacccccaucccuuccccaccguccuaucccaacucacccc

SEQ ID NO: 375917 - RNA, 63 nt, Homo Sapiens
uggacugggaggucaggaagagggaccgucuggcuuccccagcuuaaucucuuggccucaccc

SEQ ID NO: 375918 - RNA, 63 nt, Homo Sapiens
gucccccgacccacuucaucacuuccacaccgucuuccccagcaacccccaaacccacgacuc

SEQ ID NO: 375919 - RNA, 63 nt, Homo Sapiens
acagcugcauggcucccgcucacuucucugcuucuuccccaacuuggaaaagucaaaucauau

SEQ ID NO: 375920 - RNA, 63 nt, Homo Sapiens
cucagcuccaaacgccuccuagcuggcgagaaccuuccccacaaagcucagccugagagaagg

SEQ ID NO: 375921 - RNA, 63 nt, Homo Sapiens
auaggcuuagugcuuggcucaggguggaugucccuuccccacaucuggggucugugaugggga

SEQ ID NO: 375922 - RNA, 63 nt, Homo Sapiens
cucagcucagcauuguguaccuuauaugugccccuuccccaugggagugcauucauucauccu

SEQ ID NO: 375923 - RNA, 63 nt, Homo Sapiens
gucucaccuuuucuuccaauuccuaggcagucucuuccccaaaucaugcucagcacaucaucu

SEQ ID NO: 375924 - RNA, 63 nt, Homo Sapiens
gaccccauaaccccagaccaccccuccaucucucuuccccauacagaguccccaguguccccu

SEQ ID NO: 375925 - RNA, 63 nt, Homo Sapiens
cugcaaggagccuguagcauugccccagcuggccuuccccagccucccucggcuccagcccaa

SEQ ID NO: 375926 - RNA, 63 nt, Homo Sapiens
cugggccuugaccguccagcccauucuguaccccuuccccagcgcauggggcuucgcccacaa

SEQ ID NO: 375927 - RNA, 63 nt, Homo Sapiens
ucacagaaauuugugaucugaaaacccggcucccuuccccacaaggcuccugggccuccggga

SEQ ID NO: 375928 - RNA, 63 nt, Homo Sapiens
cggacucuccaagggguacccccaccccgcuaccuuccccacggacgggccccuccuggagcc

SEQ ID NO: 375929 - RNA, 63 nt, Homo Sapiens
gcucucuguggugagaaauuugccuccucuugacuuccccacugguguucugucccagugcgg

SEQ ID NO: 375930 - RNA, 63 nt, Homo Sapiens
uggcucuagucacuggcaucccagagagagauucuuccccaaucugcugaccaugcagccgca

SEQ ID NO: 375931 - RNA, 63 nt, Homo Sapiens
aacccugcccugcucugcccuuaagcucugccccuuccccauggaggucccagcccugggggu

SEQ ID NO: 375932 - RNA, 63 nt, Homo Sapiens
ggaaccgcccagugcagguaugaggcccugcaccuuccccaaaggcaaggaggaggagucaga

SEQ ID NO: 375933 - RNA, 63 nt, Homo Sapiens
uugcauuggaggucccagaacuacaucuucucucuuccccaucgcagggccugccgccacugc

SEQ ID NO: 375934 - RNA, 63 nt, Homo Sapiens
accaugccaaaaggucuuauucccuucucuacucuuccccagccuucucugcccugugcccac

SEQ ID NO: 375935 - RNA, 64 nt, Homo Sapiens; identical to SEQ ID NO: 109449

SEQ ID NO: 375936 - RNA, 64 nt, Homo Sapiens; identical to SEQ ID NO: 109450

SEQ ID NO: 375937 - RNA, 64 nt, Homo Sapiens; identical to SEQ ID NO: 109451

SEQ ID NO: 375938 - RNA, 64 nt, Homo Sapiens; identical to SEQ ID NO: 109452

SEQ ID NO: 375939 - RNA, 64 nt, Homo Sapiens
ugccugauaaccccuugucaguugucagcucuucccaaaacaaagcucuggaguuucugcugga

SEQ ID NO: 375940 - RNA, 64 nt, Homo Sapiens
uugggaguugcagugaaugucauuaaaauuucuuccaaaacaaaacuagaaauaauugcugagg

SEQ ID NO: 375941 - RNA, 64 nt, Homo Sapiens
auggggccugacaucuucugccacuuuucccaccccaaaacagcaggcuguugagaauucuuug

SEQ ID NO: 375942 - RNA, 64 nt, Homo Sapiens
uugacgaaaggguuuuaugucucucucucaccccccaaaacaagacaucuucccuaagcacugc

SEQ ID NO: 375943 - RNA, 64 nt, Homo Sapiens
uaauucucuguccuuucccuuucacuguuucacuccaaaacauguaagaauggcaauguuugaa

SEQ ID NO: 375944 - RNA, 64 nt, Homo Sapiens
cacugugcaagguguuggagaaauccaaagcugaccaaaacaugguccccaccuuuuggagcuu

SEQ ID NO: 375945 - RNA, 64 nt, Homo Sapiens
cacuuuuaacugaaaaaaacaaaagcacaacaaaccaaaacaugggaugaagcuaaaucaaugc

SEQ ID NO: 375946 - RNA, 64 nt, Homo Sapiens
ggcugagauuacaggugugagcuaccucaccuggccaaaacaguuuuuuuagaaaugaaguaua

SEQ ID NO: 375947 - RNA, 64 nt, Homo Sapiens
uauauguauuucuauauagacuuggagaauacugccaaaacauuuaugacaagcuguaucacug

SEQ ID NO: 375948 - RNA, 64 nt, Homo Sapiens
uagaaauaauaaaaagaaagauacuuacauguucccaaaacaaugguguggugaaugugugaga

SEQ ID NO: 375949 - RNA, 64 nt, Homo Sapiens
uuccucccuucugauaagacuggaaaauaguccuccaaaacacaagggaggauuuuggguggcc

SEQ ID NO: 375950 - RNA, 64 nt, Homo Sapiens
aguccaaaaucauuccccccgugaagucugcuuaccaaaacauaagacgacuuauauauuugaa

SEQ ID NO: 375951 - RNA, 64 nt, Homo Sapiens
caaauggcuucagaggucaccaaguucagucgucccaaaacauggguguguuucaaaauuaccu

SEQ ID NO: 375952 - RNA, 64 nt, Homo Sapiens
uaugaaaaggagccugguggggagaccacugcacccaaaacaaauccuuucuucuucugagaau

SEQ ID NO: 375953 - RNA, 64 nt, Homo Sapiens
gcuaguauuucuaugccccagggaaugccuucaaccaaaacacaucuaaaaugacuuguuccug

SEQ ID NO: 375954 - RNA, 64 nt, Homo Sapiens
uaccauuagagaggggggauuaucuauggacauuccaaaacauucuccacgccguccauuuucu

SEQ ID NO: 375955 - RNA, 64 nt, Homo Sapiens
aaucuacacugggucucaauaagcuauuguuuuuccaaaacacaaucucaauuaaugcuaaaua

SEQ ID NO: 375956 - RNA, 64 nt, Homo Sapiens
aaagagaaacacaagcucacugaccacaaggggcccaaaacagaagacagcauggacacaaaga

SEQ ID NO: 375957 - RNA, 64 nt, Homo Sapiens
aaaaauccuggaagacaaccacuuaauguaaaacccaaaacaguuaacucaagauggauuaaag

SEQ ID NO: 375958 - RNA, 64 nt, Homo Sapiens
auaguacuggcacaaaaacacaaggcuacaguaaccaaaacagccccagcuucaaacuauacua

SEQ ID NO: 375959 - RNA, 64 nt, Homo Sapiens
aagcaaauacuuggugagugauuuaaaaauaaaaccaaaacaaaacacaaaaagauauuccaca

SEQ ID NO: 375960 - RNA, 64 nt, Homo Sapiens
ugcuuuucaaaagaguaacugaaauuguugcaggccaaaacagcaauaugauaucucagauuua

SEQ ID NO: 375961 - RNA, 64 nt, Homo Sapiens
gggaguggcuuuucuugaaaauuaaaauuguuuaccaaaacaguauuuugaagcaagaucauau

SEQ ID NO: 375962 - RNA, 64 nt, Homo Sapiens
uuucuguuagcugcuucucagugugacugacaacccaaaacauauauacagauuguuggcauuu

SEQ ID NO: 375963 - RNA, 64 nt, Homo Sapiens
acuaccaacaagaggauuuuuaaagaaugcaugcccaaaacacuuuauuuuugcuuuuaugcuu

SEQ ID NO: 375964 - RNA, 64 nt, Homo Sapiens
acuuuagguauucuaauguacuuaguuuauuuuuccaaaacauaaaagaggccaaaaaggucac

SEQ ID NO: 375965 - RNA, 64 nt, Homo Sapiens
agcugauuggaugucuaggaaugacugaaagaaaccaaaacagccuguccacugcugcuguggg

SEQ ID NO: 375966 - RNA, 64 nt, Homo Sapiens
agugcauucggugccaacauuuuuuagagcuguaccaaaacaaaaagccuguacucacaucaca

SEQ ID NO: 375967 - RNA, 64 nt, Homo Sapiens
guaccccugguaaaccaagccucccacacugaaaccaaaacauaaaaaccaaacccagacaacc

SEQ ID NO: 375968 - RNA, 64 nt, Homo Sapiens
cugaaaccaaaacauaaaaaccaaacccagacaaccaaaacauauucaaagcagcagccaccgc

SEQ ID NO: 375969 - RNA, 64 nt, Homo Sapiens
gugaagacccaggagagacagagaugcgaaccacccaaaacacgcacacccugccccuggugcc

SEQ ID NO: 375970 - RNA, 64 nt, Homo Sapiens
aguuacuuuacaacacggucuguuggucagaggcccaaaacaguuauacagaugacgguacugg

SEQ ID NO: 375971 - RNA, 64 nt, Homo Sapiens
cgcuucaaaguggcaaguauuuggcuauuaacugccaaaacaagagccugauuuuuugaggcca

SEQ ID NO: 375972 - RNA, 64 nt, Homo Sapiens
ugacuccagugagggcucaaagcaaauugaauggccaaaacauugagaguuuacccauacauuu

SEQ ID NO: 375973 - RNA, 64 nt, Homo Sapiens
auaucuucuguccgccuuacaggaauauucaguuccaaaacaagauacuuguagggaugagguu

SEQ ID NO: 375974 - RNA, 64 nt, Homo Sapiens
uuuggaauuuauccacuucuuuugguuccccaguccaaaacacagucauuucaccuggacuauu

SEQ ID NO: 375975 - RNA, 64 nt, Homo Sapiens
ugaaagcaguauggcagucauaaaaauuuuggaaccaaaacaguaucuuuuuuuaagcuaaaaa

SEQ ID NO: 375976 - RNA, 64 nt, Homo Sapiens
aauucuagcaaucucuuuucaccccucugccuuuccaaaacauugacaagacucauuuccaguu

SEQ ID NO: 375977 - RNA, 64 nt, Homo Sapiens
auccagagauuuugcacaauucguguugaaccuuccaaaacaaaaauaaagaccuguccaaaag

SEQ ID NO: 375978 - RNA, 64 nt, Homo Sapiens; identical to SEQ ID NO: 134190

SEQ ID NO: 375979 - RNA, 64 nt, Homo Sapiens; identical to SEQ ID NO: 134191

SEQ ID NO: 375980 - RNA, 64 nt, Homo Sapiens; identical to SEQ ID NO: 134192

SEQ ID NO: 375981 - RNA, 64 nt, Homo Sapiens; identical to SEQ ID NO: 134193

SEQ ID NO: 375982 - RNA, 64 nt, Homo Sapiens; identical to SEQ ID NO: 134194

SEQ ID NO: 375983 - RNA, 64 nt, Homo Sapiens; identical to SEQ ID NO: 134195

SEQ ID NO: 375984 - RNA, 64 nt, Homo Sapiens; identical to SEQ ID NO: 134196

SEQ ID NO: 375985 - RNA, 64 nt, Homo Sapiens; identical to SEQ ID NO: 134197

SEQ ID NO: 375986 - RNA, 64 nt, Homo Sapiens; identical to SEQ ID NO: 134198

SEQ ID NO: 375987 - RNA, 64 nt, Homo Sapiens; identical to SEQ ID NO: 134199

SEQ ID NO: 375988 - RNA, 64 nt, Homo Sapiens; identical to SEQ ID NO: 134200

SEQ ID NO: 375989 - RNA, 64 nt, Homo Sapiens; identical to SEQ ID NO: 134201

SEQ ID NO: 375990 - RNA, 64 nt, Homo Sapiens; identical to SEQ ID NO: 134202

SEQ ID NO: 375991 - RNA, 64 nt, Homo Sapiens; identical to SEQ ID NO: 134203

SEQ ID NO: 375992 - RNA, 64 nt, Homo Sapiens; identical to SEQ ID NO: 134204

SEQ ID NO: 375993 - RNA, 64 nt, Homo Sapiens; identical to SEQ ID NO: 134205

SEQ ID NO: 375994 - RNA, 64 nt, Homo Sapiens; identical to SEQ ID NO: 134206

SEQ ID NO: 375995 - RNA, 64 nt, Homo Sapiens; identical to SEQ ID NO: 134207

SEQ ID NO: 375996 - RNA, 64 nt, Homo Sapiens; identical to SEQ ID NO: 134208

SEQ ID NO: 375997 - RNA, 64 nt, Homo Sapiens; identical to SEQ ID NO: 134209

SEQ ID NO: 375998 - RNA, 64 nt, Homo Sapiens; identical to SEQ ID NO: 134210

SEQ ID NO: 375999 - RNA, 64 nt, Homo Sapiens; identical to SEQ ID NO: 134211

SEQ ID NO: 376000 - RNA, 64 nt, Homo Sapiens; identical to SEQ ID NO: 134212

SEQ ID NO: 376001 - RNA, 64 nt, Homo Sapiens; identical to SEQ ID NO: 134213

SEQ ID NO: 376002 - RNA, 64 nt, Homo Sapiens; identical to SEQ ID NO: 134214

SEQ ID NO: 376003 - RNA, 64 nt, Homo Sapiens; identical to SEQ ID NO: 134215

SEQ ID NO: 376004 - RNA, 64 nt, Homo Sapiens; identical to SEQ ID NO: 134216

SEQ ID NO: 376005 - RNA, 64 nt, Homo Sapiens; identical to SEQ ID NO: 134217

SEQ ID NO: 376006 - RNA, 64 nt, Homo Sapiens; identical to SEQ ID NO: 134218

SEQ ID NO: 376007 - RNA, 64 nt, Homo Sapiens; identical to SEQ ID NO: 134219

SEQ ID NO: 376008 - RNA, 64 nt, Homo Sapiens; identical to SEQ ID NO: 134220

SEQ ID NO: 376009 - RNA, 64 nt, Homo Sapiens; identical to SEQ ID NO: 134221

SEQ ID NO: 376010 - RNA, 64 nt, Homo Sapiens; identical to SEQ ID NO: 134222

SEQ ID NO: 376011 - RNA, 64 nt, Homo Sapiens; identical to SEQ ID NO: 134223

SEQ ID NO: 376012 - RNA, 64 nt, Homo Sapiens; identical to SEQ ID NO: 134224

SEQ ID NO: 376013 - RNA, 64 nt, Homo Sapiens; identical to SEQ ID NO: 134225

SEQ ID NO: 376014 - RNA, 64 nt, Homo Sapiens; identical to SEQ ID NO: 134226

SEQ ID NO: 376015 - RNA, 64 nt, Homo Sapiens; identical to SEQ ID NO: 134227

SEQ ID NO: 376016 - RNA, 64 nt, Homo Sapiens; identical to SEQ ID NO: 134228

SEQ ID NO: 376017 - RNA, 64 nt, Homo Sapiens; identical to SEQ ID NO: 81987

SEQ ID NO: 376018 - RNA, 64 nt, Homo Sapiens; identical to SEQ ID NO: 81988

SEQ ID NO: 376019 - RNA, 64 nt, Homo Sapiens; identical to SEQ ID NO: 81989

SEQ ID NO: 376020 - RNA, 64 nt, Homo Sapiens; identical to SEQ ID NO: 81990

SEQ ID NO: 376021 - RNA, 64 nt, Homo Sapiens; identical to SEQ ID NO: 81991

SEQ ID NO: 376022 - RNA, 64 nt, Homo Sapiens; identical to SEQ ID NO: 81992

SEQ ID NO: 376023 - RNA, 64 nt, Homo Sapiens; identical to SEQ ID NO: 81993

SEQ ID NO: 376024 - RNA, 64 nt, Homo Sapiens; identical to SEQ ID NO: 81994

SEQ ID NO: 376025 - RNA, 64 nt, Homo Sapiens; identical to SEQ ID NO: 81995

SEQ ID NO: 376026 - RNA, 64 nt, Homo Sapiens; identical to SEQ ID NO: 81996

SEQ ID NO: 376027 - RNA, 64 nt, Homo Sapiens; identical to SEQ ID NO: 81997

SEQ ID NO: 376028 - RNA, 64 nt, Homo Sapiens; identical to SEQ ID NO: 81998

SEQ ID NO: 376029 - RNA, 64 nt, Homo Sapiens; identical to SEQ ID NO: 81999

SEQ ID NO: 376030 - RNA, 64 nt, Homo Sapiens; identical to SEQ ID NO: 82000

SEQ ID NO: 376031 - RNA, 64 nt, Homo Sapiens; identical to SEQ ID NO: 82001

SEQ ID NO: 376032 - RNA, 64 nt, Homo Sapiens; identical to SEQ ID NO: 82002

SEQ ID NO: 376033 - RNA, 64 nt, Homo Sapiens; identical to SEQ ID NO: 82003

SEQ ID NO: 376034 - RNA, 64 nt, Homo Sapiens; identical to SEQ ID NO: 82004

SEQ ID NO: 376035 - RNA, 64 nt, Homo Sapiens; identical to SEQ ID NO: 82005

SEQ ID NO: 376036 - RNA, 64 nt, Homo Sapiens; identical to SEQ ID NO: 82006

SEQ ID NO: 376037 - RNA, 64 nt, Homo Sapiens; identical to SEQ ID NO: 82007

SEQ ID NO: 376038 - RNA, 64 nt, Homo Sapiens; identical to SEQ ID NO: 82008

SEQ ID NO: 376039 - RNA, 58 nt, Homo Sapiens; identical to SEQ ID NO: 82009

SEQ ID NO: 376040 - RNA, 64 nt, Homo Sapiens; identical to SEQ ID NO: 82010

SEQ ID NO: 376041 - RNA, 64 nt, Homo Sapiens; identical to SEQ ID NO: 82011

SEQ ID NO: 376042 - RNA, 64 nt, Homo Sapiens; identical to SEQ ID NO: 82012

SEQ ID NO: 376043 - RNA, 64 nt, Homo Sapiens; identical to SEQ ID NO: 82013

SEQ ID NO: 376044 - RNA, 64 nt, Homo Sapiens; identical to SEQ ID NO: 82014

SEQ ID NO: 376045 - RNA, 64 nt, Homo Sapiens; identical to SEQ ID NO: 82015

SEQ ID NO: 376046 - RNA, 64 nt, Homo Sapiens; identical to SEQ ID NO: 82016

SEQ ID NO: 376047 - RNA, 64 nt, Homo Sapiens; identical to SEQ ID NO: 296379

SEQ ID NO: 376048 - RNA, 64 nt, Homo Sapiens; identical to SEQ ID NO: 296380

SEQ ID NO: 376049 - RNA, 64 nt, Homo Sapiens; identical to SEQ ID NO: 296381

SEQ ID NO: 376050 - RNA, 64 nt, Homo Sapiens; identical to SEQ ID NO: 296382

SEQ ID NO: 376051 - RNA, 64 nt, Homo Sapiens; identical to SEQ ID NO: 296383

SEQ ID NO: 376052 - RNA, 64 nt, Homo Sapiens; identical to SEQ ID NO: 296384

SEQ ID NO: 376053 - RNA, 64 nt, Homo Sapiens; identical to SEQ ID NO: 296385

SEQ ID NO: 376054 - RNA, 64 nt, Homo Sapiens; identical to SEQ ID NO: 296386

SEQ ID NO: 376055 - RNA, 64 nt, Homo Sapiens; identical to SEQ ID NO: 296387

SEQ ID NO: 376056 - RNA, 64 nt, Homo Sapiens; identical to SEQ ID NO: 296388

SEQ ID NO: 376057 - RNA, 64 nt, Homo Sapiens; identical to SEQ ID NO: 296389

SEQ ID NO: 376058 - RNA, 64 nt, Homo Sapiens; identical to SEQ ID NO: 296390

SEQ ID NO: 376059 - RNA, 64 nt, Homo Sapiens; identical to SEQ ID NO: 296391

SEQ ID NO: 376060 - RNA, 64 nt, Homo Sapiens; identical to SEQ ID NO: 296392

SEQ ID NO: 376061 - RNA, 64 nt, Homo Sapiens; identical to SEQ ID NO: 296393

SEQ ID NO: 376062 - RNA, 64 nt, Homo Sapiens; identical to SEQ ID NO: 296394

SEQ ID NO: 376063 - RNA, 64 nt, Homo Sapiens; identical to SEQ ID NO: 296395

SEQ ID NO: 376064 - RNA, 64 nt, Homo Sapiens; identical to SEQ ID NO: 296396

SEQ ID NO: 376065 - RNA, 64 nt, Homo Sapiens; identical to SEQ ID NO: 296397

SEQ ID NO: 376066 - RNA, 64 nt, Homo Sapiens; identical to SEQ ID NO: 296398

SEQ ID NO: 376067 - RNA, 64 nt, Homo Sapiens; identical to SEQ ID NO: 296399

SEQ ID NO: 376068 - RNA, 64 nt, Homo Sapiens; identical to SEQ ID NO: 296400

SEQ ID NO: 376069 - RNA, 64 nt, Homo Sapiens; identical to SEQ ID NO: 296401

SEQ ID NO: 376070 - RNA, 64 nt, Homo Sapiens; identical to SEQ ID NO: 296402

SEQ ID NO: 376071 - RNA, 64 nt, Homo Sapiens; identical to SEQ ID NO: 296403

SEQ ID NO: 376072 - RNA, 64 nt, Homo Sapiens; identical to SEQ ID NO: 296404

SEQ ID NO: 376073 - RNA, 64 nt, Homo Sapiens; identical to SEQ ID NO: 296405

SEQ ID NO: 376074 - RNA, 64 nt, Homo Sapiens; identical to SEQ ID NO: 296406

SEQ ID NO: 376075 - RNA, 64 nt, Homo Sapiens; identical to SEQ ID NO: 296407

SEQ ID NO: 376076 - RNA, 64 nt, Homo Sapiens; identical to SEQ ID NO: 296408

SEQ ID NO: 376077 - RNA, 64 nt, Homo Sapiens; identical to SEQ ID NO: 296409

SEQ ID NO: 376078 - RNA, 64 nt, Homo Sapiens; identical to SEQ ID NO: 296410

SEQ ID NO: 376079 - RNA, 64 nt, Homo Sapiens; identical to SEQ ID NO: 296402

SEQ ID NO: 376080 - RNA, 64 nt, Homo Sapiens; identical to SEQ ID NO: 296403

SEQ ID NO: 376081 - RNA, 64 nt, Homo Sapiens; identical to SEQ ID NO: 296404

SEQ ID NO: 376082 - RNA, 64 nt, Homo Sapiens; identical to SEQ ID NO: 296414

SEQ ID NO: 376083 - RNA, 64 nt, Homo Sapiens; identical to SEQ ID NO: 296415

SEQ ID NO: 376084 - RNA, 64 nt, Homo Sapiens; identical to SEQ ID NO: 296416

SEQ ID NO: 376085 - RNA, 64 nt, Homo Sapiens; identical to SEQ ID NO: 296417

SEQ ID NO: 376086 - RNA, 64 nt, Homo Sapiens; identical to SEQ ID NO: 296418

SEQ ID NO: 376087 - RNA, 64 nt, Homo Sapiens; identical to SEQ ID NO: 296419

SEQ ID NO: 376088 - RNA, 64 nt, Homo Sapiens; identical to SEQ ID NO: 296420

SEQ ID NO: 376089 - RNA, 64 nt, Homo Sapiens; identical to SEQ ID NO: 296421

SEQ ID NO: 376090 - RNA, 64 nt, Homo Sapiens; identical to SEQ ID NO: 296422

SEQ ID NO: 376091 - RNA, 64 nt, Homo Sapiens; identical to SEQ ID NO: 296423

SEQ ID NO: 376092 - RNA, 64 nt, Homo Sapiens; identical to SEQ ID NO: 296424

SEQ ID NO: 376093 - RNA, 64 nt, Homo Sapiens; identical to SEQ ID NO: 296425

SEQ ID NO: 376094 - RNA, 64 nt, Homo Sapiens; identical to SEQ ID NO: 296426

SEQ ID NO: 376095 - RNA, 64 nt, Homo Sapiens; identical to SEQ ID NO: 296427

SEQ ID NO: 376096 - RNA, 64 nt, Homo Sapiens; identical to SEQ ID NO: 296428

SEQ ID NO: 376097 - RNA, 64 nt, Homo Sapiens; identical to SEQ ID NO: 296429

SEQ ID NO: 376098 - RNA, 64 nt, Homo Sapiens; identical to SEQ ID NO: 296430

SEQ ID NO: 376099 - RNA, 64 nt, Homo Sapiens; identical to SEQ ID NO: 296431

SEQ ID NO: 376100 - RNA, 64 nt, Homo Sapiens
uuucuuuuuugaccuuucuucucucaacaggaaccugccugaggacacccuucuagagcaagga

SEQ ID NO: 376101 - RNA, 64 nt, Homo Sapiens
aagcugcuucucccaacaccguccaaagucuccacugccugaguuuuguuucggcugguuugaa

SEQ ID NO: 376102 - RNA, 64 nt, Homo Sapiens
agcuuacaucaaacgaacauguagugcaugcccacugccugauggccagauggccuguaggaag

SEQ ID NO: 376103 - RNA, 64 nt, Homo Sapiens
ugaaguggaccuugacuuccucuuccuucugauucugccugaauagcugagagguuccagcaaa

SEQ ID NO: 376104 - RNA, 64 nt, Homo Sapiens
acuuccuccccagcucacgcugcuguauucugugcugccugaacugaagaaauaaaauccagaa

SEQ ID NO: 376105 - RNA, 64 nt, Homo Sapiens
uaagggaggucuuaucucuccucaggagcacccccugccugagcuggggaaucucacacagaaa

SEQ ID NO: 376106 - RNA, 64 nt, Homo Sapiens
ggaggccuuccaaggggguucccagucucuagggcugccugacugggcgucccucuccucucuc

SEQ ID NO: 376107 - RNA, 64 nt, Homo Sapiens
gucccugaucgggucucccucgcccgccacggagcugccugagucccuagucugccugccugcc

SEQ ID NO: 376108 - RNA, 64 nt, Homo Sapiens
cucuggaaacuuguggguggugcccgggagaacccugccugaagagugaggccacgcagccgcc

SEQ ID NO: 376109 - RNA, 64 nt, Homo Sapiens
ggaaccagagcagacgcacacuuccccagcuuugcugccugagagaggcuccugccugagcuuc

SEQ ID NO: 376110 - RNA, 64 nt, Homo Sapiens
uuccuuccccagcuuugcugcgucggggaggcuccugccugagcugcugcuugugccgcugugg

SEQ ID NO: 376111 - RNA, 64 nt, Homo Sapiens
gauaaaauugcugaaugcuccuggcggucugccacugccugauuggugguggcgcccugaacug

SEQ ID NO: 376112 - RNA, 64 nt, Homo Sapiens
aaacccaggcaauacuauuuuccaaagauucucacugccugagaagguagaggaggagaaagaa

SEQ ID NO: 376113 - RNA, 64 nt, Homo Sapiens
cccucccugcaacaccgagugccuuagacagcugcugccugagaacuggccuccagccgguguc

SEQ ID NO: 376114 - RNA, 64 nt, Homo Sapiens
gauuuccauuucugcugccagagcugguauuugccugccugauucucuguguuuccuguuucac

SEQ ID NO: 376115 - RNA, 57 nt, Homo Sapiens
guggggcccucuggaguugauacaagccugccugagcccuggcacacccguuugggg

SEQ ID NO: 376116 - RNA, 64 nt, Homo Sapiens
gcuucuuuccugccaccgugcagccccacaagcacugccugaggcccaucugcuuccccggcua

SEQ ID NO: 376117 - RNA, 64 nt, Homo Sapiens
aucaaaacucagaggcaaagaaccagcauaaauacugccugaggccagagaagaauuacucauu

SEQ ID NO: 376118 - RNA, 64 nt, Homo Sapiens
ucuccuauucuacucugaaccagagguugccaggcugccugagggaaggcauuucccacgaggc

SEQ ID NO: 376119 - RNA, 64 nt, Homo Sapiens
ccacgcugcuauggaggcugcuguccagccaggccugccugaggggcacccaguggcccugcug

SEQ ID NO: 376120 - RNA, 64 nt, Homo Sapiens
acgccaucucggcucccgggcugacccacugccccugccugagauggacagcguaucgagcauc

SEQ ID NO: 376121 - RNA, 64 nt, Homo Sapiens
ccuacacaccaugaugccccauggcuuacaaguccugccugauaccagaauuugacuugacggg

SEQ ID NO: 376122 - RNA, 64 nt, Homo Sapiens
agcuuuaaacugcacuucccucccucacccacaucugccugaaggcgagugcccagcccacgag

SEQ ID NO: 376123 - RNA, 64 nt, Homo Sapiens
ccacagucauuggcagagguccugagccaaccugcugccugacgcccaaaagccaccccacaag

SEQ ID NO: 376124 - RNA, 64 nt, Homo Sapiens
guguuuacagaagcuucugauugccucucuaauccugccugauugcuuuuaguguuaccgcuca

SEQ ID NO: 376125 - RNA, 64 nt, Homo Sapiens
ccucgcggugaccccucucucugguucccagcaccugccugagaccugccccaggcacccauaa

SEQ ID NO: 376126 - RNA, 64 nt, Homo Sapiens
guucccaggggugagaggccucauguauccuaggcugccugagauuucugugugcugaucgcau

SEQ ID NO: 376127 - RNA, 64 nt, Homo Sapiens
auggacggugcuccaggcaggcuaaggcguggagcugccugauauuucccuccccuggggacag

SEQ ID NO: 376128 - RNA, 64 nt, Homo Sapiens
cacacgguuugaagccuggaacaucaucaaggcacugccugauggaccugucacgauugucauc

SEQ ID NO: 376129 - RNA, 64 nt, Homo Sapiens
uagcugggaggaggggaugcucccagggcuggggcugccugaagagaauggcacgcaccuugua

SEQ ID NO: 376130 - RNA, 64 nt, Homo Sapiens
aguguccucugcagcagggccaggggacgcacaccugccugacucuuuccucacagggaaggcg

SEQ ID NO: 376131 - RNA, 64 nt, Homo Sapiens
acaugacgcucucaagcuuggcuucccaccauagcugccugaaaaaaaucgguugugccucccu

SEQ ID NO: 376132 - RNA, 64 nt, Homo Sapiens
gggagugucggcugugaaaugugugcuuaagaaccugccugauggccuuuccugucaugaccca

SEQ ID NO: 376133 - RNA, 64 nt, Homo Sapiens
uguacugcugccaucucggcucacugcaaccucccugccugauucuccugccucagccugccga

SEQ ID NO: 376134 - RNA, 64 nt, Homo Sapiens
gcuccacaacguaugggcaaaaguuuaaggacuacugccugauguaccaggaauccugaguucu

SEQ ID NO: 376135 - RNA, 64 nt, Homo Sapiens
ccaagaaaaugccccgacaggggugcccagcacacugccugagggacaacagacaucagaacaa

SEQ ID NO: 376136 - RNA, 64 nt, Homo Sapiens
gggggaugcuuugggaaguccuugccccugagcacugccugauugccagggccuguggaggucu

SEQ ID NO: 376137 - RNA, 64 nt, Homo Sapiens
aaggaaggacccgcuuccugcggccagccugaggcugccugaggccuggcccccacccccuccc

SEQ ID NO: 376138 - RNA, 64 nt, Homo Sapiens
acaaaggcuugcacugucucgcccacagccguaccugccugaggcaccugccccucggcugcau

SEQ ID NO: 376139 - RNA, 64 nt, Homo Sapiens
ucucuggccucaccccugcuaauccccccaauuccugccugaaaaggaguggggcagggcagag

SEQ ID NO: 376140 - RNA, 64 nt, Homo Sapiens
caccuccuccucccaccagggguuucccucccaucugccugauccucaacugacauucccaugg

SEQ ID NO: 376141 - RNA, 64 nt, Homo Sapiens
cgcccugaccaccagcucuacuucccaacccccacugccugagaggucucuaucaguguccugc

SEQ ID NO: 376142 - RNA, 64 nt, Homo Sapiens
aacccccacugccugagaggucucuaucaguguccugccugaauucuuuccuucaagugaagau

SEQ ID NO: 376143 - RNA, 64 nt, Homo Sapiens
cuggacauggggcccuuccuugaggcagccgcuccugccugagcgugccugcccugccucugcc

SEQ ID NO: 376144 - RNA, 64 nt, Homo Sapiens
cagccgcuccugccugagccugccugcccugccucugccugaggcuuggggcacggggcagcug

SEQ ID NO: 376145 - RNA, 64 nt, Homo Sapiens
ccgccacgcccugccguccagccugauccugccccugccugaccccugugcuauaaaccacccu

SEQ ID NO: 376146 - RNA, 64 nt, Homo Sapiens
cugccccugccugaccccgcugcuauaaaccacccugccugaucccaagugccaggaagaccug

SEQ ID NO: 376147 - RNA, 64 nt, Homo Sapiens
aacagcccaggcguuggcagcaggguuagaacagcugccugaggcuccucccugaaggacaccu

SEQ ID NO: 376148 - RNA, 64 nt, Homo Sapiens
gaacagcugccugaggcuccucccugaaggacaccugccugagagcagagauggaggccuucug

SEQ ID NO: 376149 - RNA, 64 nt, Homo Sapiens
cugugcuugcuccuggcuuugucugcaauggcagcugccugagaaccuaaauuucagcaacagu

SEQ ID NO: 376150 - RNA, 64 nt, Homo Sapiens
auggugaugaguagcaacacacacuucucugcuucugccugaaaugugcuuagagcucaguuau

SEQ ID NO: 376151 - RNA, 64 nt, Homo Sapiens
ggacuguguugcuugugaagcgugcaacccaaugaguagugaagacaggguagaagagagacau

SEQ ID NO: 376152 - RNA, 64 nt, Homo Sapiens
gauucaguacuccucaaccaaccugugucaucaaaguagugaugaaaugugaaucuggaauauu

SEQ ID NO: 376153 - RNA, 64 nt, Homo Sapiens
gugacaacaucuuaggauugccaucccauaaaagaguagugauaauaucucugugccucaguuc

SEQ ID NO: 376154 - RNA, 64 nt, Homo Sapiens
cugguuguuaauauuuguaugcacauuaagucucaguagugacuauuauguguaugaagauguu

SEQ ID NO: 376155 - RNA, 64 nt, Homo Sapiens
caaagagaaaauuaaauauaaacaccuaccuugcaguagugaagaucuguaaaaggagauaaua

SEQ ID NO: 376156 - RNA, 64 nt, Homo Sapiens
ucugugaaaucacagguuugucauuuucaucccaaguagugauaucuaacauuguuauccuaua

SEQ ID NO: 376157 - RNA, 64 nt, Homo Sapiens; identical to SEQ ID NO: 277107

SEQ ID NO: 376158 - RNA, 64 nt, Homo Sapiens; identical to SEQ ID NO: 277108

SEQ ID NO: 376159 - RNA, 64 nt, Homo Sapiens; identical to SEQ ID NO: 245756

SEQ ID NO: 376160 - RNA, 64 nt, Homo Sapiens; identical to SEQ ID NO: 245757

SEQ ID NO: 376161 - RNA, 64 nt, Homo Sapiens; identical to SEQ ID NO: 245758

SEQ ID NO: 376162 - RNA, 64 nt, Homo Sapiens; identical to SEQ ID NO: 245759

SEQ ID NO: 376163 - RNA, 64 nt, Homo Sapiens; identical to SEQ ID NO: 172960

SEQ ID NO: 376164 - RNA, 64 nt, Homo Sapiens; identical to SEQ ID NO: 172961

SEQ ID NO: 376165 - RNA, 64 nt, Homo Sapiens; identical to SEQ ID NO: 172962

SEQ ID NO: 376166 - RNA, 64 nt, Homo Sapiens; identical to SEQ ID NO: 172963

SEQ ID NO: 376167 - RNA, 64 nt, Homo Sapiens; identical to SEQ ID NO: 172964

SEQ ID NO: 376168 - RNA, 64 nt, Homo Sapiens; identical to SEQ ID NO: 172965

SEQ ID NO: 376169 - RNA, 64 nt, Homo Sapiens; identical to SEQ ID NO: 51559

SEQ ID NO: 376170 - RNA, 64 nt, Homo Sapiens; identical to SEQ ID NO: 51560

SEQ ID NO: 376171 - RNA, 64 nt, Homo Sapiens; identical to SEQ ID NO: 51561

SEQ ID NO: 376172 - RNA, 64 nt, Homo Sapiens; identical to SEQ ID NO: 51562

SEQ ID NO: 376173 - RNA, 64 nt, Homo Sapiens; identical to SEQ ID NO: 51563

SEQ ID NO: 376174 - RNA, 64 nt, Homo Sapiens; identical to SEQ ID NO: 51564

SEQ ID NO: 376175 - RNA, 64 nt, Homo Sapiens; identical to SEQ ID NO: 51565

SEQ ID NO: 376176 - RNA, 64 nt, Homo Sapiens; identical to SEQ ID NO: 51566

SEQ ID NO: 376177 - RNA, 64 nt, Homo Sapiens; identical to SEQ ID NO: 51567

SEQ ID NO: 376178 - RNA, 64 nt, Homo Sapiens; identical to SEQ ID NO: 51568

SEQ ID NO: 376179 - RNA, 64 nt, Homo Sapiens; identical to SEQ ID NO: 51569

SEQ ID NO: 376180 - RNA, 64 nt, Homo Sapiens; identical to SEQ ID NO: 51570

SEQ ID NO: 376181 - RNA, 64 nt, Homo Sapiens; identical to SEQ ID NO: 51571

SEQ ID NO: 376182 - RNA, 64 nt, Homo Sapiens; identical to SEQ ID NO: 51572

SEQ ID NO: 376183 - RNA, 64 nt, Homo Sapiens; identical to SEQ ID NO: 51573

SEQ ID NO: 376184 - RNA, 64 nt, Homo Sapiens; identical to SEQ ID NO: 51574

SEQ ID NO: 376185 - RNA, 64 nt, Homo Sapiens; identical to SEQ ID NO: 51575

SEQ ID NO: 376186 - RNA, 64 nt, Homo Sapiens; identical to SEQ ID NO: 51576

SEQ ID NO: 376187 - RNA, 64 nt, Homo Sapiens; identical to SEQ ID NO: 51577

SEQ ID NO: 376188 - RNA, 64 nt, Homo Sapiens; identical to SEQ ID NO: 51578

SEQ ID NO: 376189 - RNA, 64 nt, Homo Sapiens
gagcacucuucugugcacuaucaaauaggaaacaucacaaaacuuccuggggaaaaagcaucug

SEQ ID NO: 376190 - RNA, 64 nt, Homo Sapiens
aaaaagguuugccaagcucaugaaagcauuuuuaucacaaaauauaguuaagaugaaauuuaua

SEQ ID NO: 376191 - RNA, 64 nt, Homo Sapiens
cacccaggcuggaauacagugguacagucacggcucacaaaagccuugaccuccugggcucagg

SEQ ID NO: 376192 - RNA, 64 nt, Homo Sapiens
gauuuuugaaggugagaugauaaacuugcaaaacucacaaaauaaagagucaaacuuuuagaau

SEQ ID NO: 376193 - RNA, 64 nt, Homo Sapiens
ccucucaaugaaaaauguaaaaguaccuagaaauucacaaaaaaauuaauaccucuguggagaa

SEQ ID NO: 376194 - RNA, 64 nt, Homo Sapiens
guguacuuuaaaaaauauauguuucauuuaaucuucacaaaagaucuguagaguaagcaaagag

SEQ ID NO: 376195 - RNA, 64 nt, Homo Sapiens
gauaugaacuuacauuucugugcaaguuguuuuuucacaaaauaucuuccuaagaggcagcaug

SEQ ID NO: 376196 - RNA, 64 nt, Homo Sapiens
agaucaguuucugccaauuucagugguuuauuguucacaaaaaaaucuucaaaacaaguauuga

SEQ ID NO: 376197 - RNA, 64 nt, Homo Sapiens
uucacaaaaaaaucuucaaaacaaguauugacuuucacaaaauuuaaaucauaaacaggcaaac

SEQ ID NO: 376198 - RNA, 64 nt, Homo Sapiens
augccuucaucaaaacuuuaagguuacuugaaugucacaaaauuggaauaaaaguauguuuuaa

SEQ ID NO: 376199 - RNA, 64 nt, Homo Sapiens
aaaccccaguucaaaauguguuuuuuuuuuuuaaucacaaaaaauaugcagcaaaaagaagcuc

SEQ ID NO: 376200 - RNA, 64 nt, Homo Sapiens
uuauauaggcuugaaaaaaauuggcggguaaaaaucacaaaaugcagucgaauauauauaugaa

SEQ ID NO: 376201 - RNA, 64 nt, Homo Sapiens
auauuuugccuguaaaaguuaguaacuaggugguucacaaaauuacaacaucaaaauaguuaca

SEQ ID NO: 376202 - RNA, 64 nt, Homo Sapiens
aagccagugccuauugaguacaaaaaaagccacaucacaaaaaauaguguggaaagccacauca

SEQ ID NO: 376203 - RNA, 64 nt, Homo Sapiens
agccacaucacaaaaaaaaguguggaaagccacaucacaaaaaaauucuggacuucuacaauag

SEQ ID NO: 376204 - RNA, 64 nt, Homo Sapiens
gacuccugaaguagacagagaauuucaggagguuucacaaaaugugagauccucaaauaaucuc

SEQ ID NO: 376205 - RNA, 64 nt, Homo Sapiens
ggagaaagaaaacaugaacuaagaauauagaugaucacaaaaaggcuaaaauaagaaacgugau

SEQ ID NO: 376206 - RNA, 64 nt, Homo Sapiens
gcaauggaauauaauggaauauucuugagacugaucacaaaaaaaaaaaccuuuuuaauauuuc

SEQ ID NO: 376207 - RNA, 64 nt, Homo Sapiens
ucucagugccuaauccugcuuugucauucacaucucacaaaaucuugacaucuuacauuccaau

SEQ ID NO: 376208 - RNA, 64 nt, Homo Sapiens
uccaagcccuuugggagccagaagaugcucagccucacaaaagcccagugcaugcaccugguug

SEQ ID NO: 376209 - RNA, 64 nt, Homo Sapiens
ugacauuuuaaacaaaucauccauccccuucaguucacaaaagcgacagcauccugccuucugc

SEQ ID NO: 376210 - RNA, 64 nt, Homo Sapiens
guuacuagacaugaucuugaaagaggccaugauuucacaaaacucauuuuuauuuuauucucag

SEQ ID NO: 376211 - RNA, 64 nt, Homo Sapiens
cuaagggaccuuucccugguaguaguggucucauucacaaaaaagaauaauagauguaacugga

SEQ ID NO: 376212 - RNA, 64 nt, Homo Sapiens
aacuaaucuuuuugccucagcaaggcauacagauucacaaaauuccauccagguacuaaggacc

SEQ ID NO: 376213 - RNA, 64 nt, Homo Sapiens
uauacuuaauauaguaaaucauacacuuacgacuucacaaaaccuagcaagaaacuauauaggu

SEQ ID NO: 376214 - RNA, 64 nt, Homo Sapiens
agguggaaauaucauucaaaauagucacuugagcucacaaaaaaagcaaggaagaauucucaug

SEQ ID NO: 376215 - RNA, 64 nt, Homo Sapiens
agauuucaagagagccuacaguaugaaaucauuuucacaaaauaagcagcuugcuucugaaaug

SEQ ID NO: 376216 - RNA, 64 nt, Homo Sapiens
aguccuuugucauuacauuauuaaaaaacacuuuucacaaaaaucacugaaaucuaaagauguu

SEQ ID NO: 376217 - RNA, 64 nt, Homo Sapiens
acaaaauaacccgaccuuuaggauauagggcaugucacaaaagaugucacuuuggcgagggagu

SEQ ID NO: 376218 - RNA, 64 nt, Homo Sapiens
uccugaaaauucgugcguggguuauuggguuuggucacaaaacauagggucuauuuguguggca

SEQ ID NO: 376219 - RNA, 64 nt, Homo Sapiens
uauuuuacaucugaacaaaaguuugacaauaaucucacaaaacaucuuuuauacaugaaaauuu

SEQ ID NO: 376220 - RNA, 64 nt, Homo Sapiens; identical to SEQ ID NO: 315813

SEQ ID NO: 376221 - RNA, 64 nt, Homo Sapiens; identical to SEQ ID NO: 315814

SEQ ID NO: 376222 - RNA, 64 nt, Homo Sapiens; identical to SEQ ID NO: 315815

SEQ ID NO: 376223 - RNA, 64 nt, Homo Sapiens; identical to SEQ ID NO: 315816

SEQ ID NO: 376224 - RNA, 64 nt, Homo Sapiens; identical to SEQ ID NO: 315817

SEQ ID NO: 376225 - RNA, 64 nt, Homo Sapiens; identical to SEQ ID NO: 315818

SEQ ID NO: 376226 - RNA, 64 nt, Homo Sapiens; identical to SEQ ID NO: 315819

SEQ ID NO: 376227 - RNA, 64 nt, Homo Sapiens; identical to SEQ ID NO: 315820

SEQ ID NO: 376228 - RNA, 64 nt, Homo Sapiens; identical to SEQ ID NO: 315821

SEQ ID NO: 376229 - RNA, 64 nt, Homo Sapiens; identical to SEQ ID NO: 315822

SEQ ID NO: 376230 - RNA, 64 nt, Homo Sapiens; identical to SEQ ID NO: 315823

SEQ ID NO: 376231 - RNA, 64 nt, Homo Sapiens; identical to SEQ ID NO: 315824

SEQ ID NO: 376232 - RNA, 64 nt, Homo Sapiens; identical to SEQ ID NO: 315825

SEQ ID NO: 376233 - RNA, 64 nt, Homo Sapiens; identical to SEQ ID NO: 315826

SEQ ID NO: 376234 - RNA, 64 nt, Homo Sapiens; identical to SEQ ID NO: 315827

SEQ ID NO: 376235 - RNA, 64 nt, Homo Sapiens; identical to SEQ ID NO: 315828

SEQ ID NO: 376236 - RNA, 64 nt, Homo Sapiens; identical to SEQ ID NO: 315829

SEQ ID NO: 376237 - RNA, 64 nt, Homo Sapiens; identical to SEQ ID NO: 315830

SEQ ID NO: 376238 - RNA, 64 nt, Homo Sapiens; identical to SEQ ID NO: 315831

SEQ ID NO: 376239 - RNA, 64 nt, Homo Sapiens; identical to SEQ ID NO: 315832

SEQ ID NO: 376240 - RNA, 64 nt, Homo Sapiens; identical to SEQ ID NO: 315833

SEQ ID NO: 376241 - RNA, 64 nt, Homo Sapiens; identical to SEQ ID NO: 315834

SEQ ID NO: 376242 - RNA, 64 nt, Homo Sapiens; identical to SEQ ID NO: 315835

SEQ ID NO: 376243 - RNA, 64 nt, Homo Sapiens; identical to SEQ ID NO: 315836

SEQ ID NO: 376244 - RNA, 64 nt, Homo Sapiens; identical to SEQ ID NO: 315837

SEQ ID NO: 376245 - RNA, 64 nt, Homo Sapiens; identical to SEQ ID NO: 315838

SEQ ID NO: 376246 - RNA, 64 nt, Homo Sapiens; identical to SEQ ID NO: 315839

SEQ ID NO: 376247 - RNA, 64 nt, Homo Sapiens; identical to SEQ ID NO: 315840

SEQ ID NO: 376248 - RNA, 64 nt, Homo Sapiens; identical to SEQ ID NO: 315841

SEQ ID NO: 376249 - RNA, 64 nt, Homo Sapiens; identical to SEQ ID NO: 315842

SEQ ID NO: 376250 - RNA, 64 nt, Homo Sapiens; identical to SEQ ID NO: 315843

SEQ ID NO: 376251 - RNA, 64 nt, Homo Sapiens; identical to SEQ ID NO: 315844

SEQ ID NO: 376252 - RNA, 64 nt, Homo Sapiens; identical to SEQ ID NO: 315845

SEQ ID NO: 376253 - RNA, 64 nt, Homo Sapiens; identical to SEQ ID NO: 315846

SEQ ID NO: 376254 - RNA, 64 nt, Homo Sapiens; identical to SEQ ID NO: 315847

SEQ ID NO: 376255 - RNA, 64 nt, Homo Sapiens; identical to SEQ ID NO: 315848

SEQ ID NO: 376256 - RNA, 64 nt, Homo Sapiens; identical to SEQ ID NO: 315849

SEQ ID NO: 376257 - RNA, 64 nt, Homo Sapiens; identical to SEQ ID NO: 315850

SEQ ID NO: 376258 - RNA, 64 nt, Homo Sapiens; identical to SEQ ID NO: 315851

SEQ ID NO: 376259 - RNA, 64 nt, Homo Sapiens; identical to SEQ ID NO: 315852

SEQ ID NO: 376260 - RNA, 64 nt, Homo Sapiens; identical to SEQ ID NO: 315853

SEQ ID NO: 376261 - RNA, 64 nt, Homo Sapiens; identical to SEQ ID NO: 315854

SEQ ID NO: 376262 - RNA, 64 nt, Homo Sapiens; identical to SEQ ID NO: 315855

SEQ ID NO: 376263 - RNA, 64 nt, Homo Sapiens; identical to SEQ ID NO: 315856

SEQ ID NO: 376264 - RNA, 64 nt, Homo Sapiens; identical to SEQ ID NO: 315857

SEQ ID NO: 376265 - RNA, 64 nt, Homo Sapiens; identical to SEQ ID NO: 315858

SEQ ID NO: 376266 - RNA, 64 nt, Homo Sapiens; identical to SEQ ID NO: 315859

SEQ ID NO: 376267 - RNA, 64 nt, Homo Sapiens; identical to SEQ ID NO: 315860

SEQ ID NO: 376268 - RNA, 64 nt, Homo Sapiens; identical to SEQ ID NO: 315861

SEQ ID NO: 376269 - RNA, 64 nt, Homo Sapiens; identical to SEQ ID NO: 315862

SEQ ID NO: 376270 - RNA, 64 nt, Homo Sapiens; identical to SEQ ID NO: 315863

SEQ ID NO: 376271 - RNA, 64 nt, Homo Sapiens; identical to SEQ ID NO: 315864

SEQ ID NO: 376272 - RNA, 64 nt, Homo Sapiens; identical to SEQ ID NO: 315865

SEQ ID NO: 376273 - RNA, 64 nt, Homo Sapiens; identical to SEQ ID NO: 315866

SEQ ID NO: 376274 - RNA, 60 nt, Homo Sapiens
ugaaauacuugaaauagaccuuuaaaucuaacagaacaacauuuaaacuuuauccuaaag

SEQ ID NO: 376275 - RNA, 60 nt, Homo Sapiens
uaguaauacccaaguaauauaucuuugucuacagaacaaugcuaaugaucuucagauuuu

SEQ ID NO: 376276 - RNA, 60 nt, Homo Sapiens
guucgguucacacguuccaauaagaaauuaacagaacauuauaauuuaguucauacugaa

SEQ ID NO: 376277 - RNA, 60 nt, Homo Sapiens
cccuccucaguuccgucuaaguggaagaaaacagaacacauccuguugauuacaaagccc

SEQ ID NO: 376278 - RNA, 60 nt, Homo Sapiens
cuguucuuaaagauuucaugguuggcucagacagaacaaucaucuguuugacuucuuugg

SEQ ID NO: 376279 - RNA, 60 nt, Homo Sapiens
cagugccguugccuuuucuucauuagagacacagaacaauguauuagaauuuccagcugu

SEQ ID NO: 376280 - RNA, 60 nt, Homo Sapiens
caaugaguuccuauguggauuuuuaaaagaacagaacaguaaugaaauauuugaaguacu

SEQ ID NO: 376281 - RNA, 60 nt, Homo Sapiens
uauaucuauauguauauuuucauauauaugacagaacaagaauauguauuaauagugccu

SEQ ID NO: 376282 - RNA, 60 nt, Homo Sapiens
aaacccugauuuaucacaaugcccacugugacagaacaagacacucacagauuagugaua

SEQ ID NO: 376283 - RNA, 60 nt, Homo Sapiens
uucaguuuggcaaaggaaaagcagauaaaaacagaacauuccauauguuucuuucuccau

SEQ ID NO: 376284 - RNA, 60 nt, Homo Sapiens
agaaaaaauguaucaucuaaaggacuagacacagaacaauuggaagucaacuucaaacac

SEQ ID NO: 376285 - RNA, 60 nt, Homo Sapiens
uuuuuuucuuuuuaacucuccugguaacucacagaacagcucagguucauuucuagguga

SEQ ID NO: 376286 - RNA, 60 nt, Homo Sapiens
auccccuaccaugggcacccaugugcuggcacagaacaguuccagaucuagacuggagag

SEQ ID NO: 376287 - RNA, 60 nt, Homo Sapiens
ccagacucccuucucucaaggggaggcucaacagaacauugaccugggggcaaacuuucc

SEQ ID NO: 376288 - RNA, 60 nt, Homo Sapiens
gaucucagagaaauagcuggcuuaacaaugacagaacagcuuaaaauuugugccuacacc

SEQ ID NO: 376289 - RNA, 60 nt, Homo Sapiens
ucauaacuuacagugaaaaagcccaauaauacagaacaagacaugaugggcaauacccua

SEQ ID NO: 376290 - RNA, 60 nt, Homo Sapiens
cugugugucaucacagauugugugcauuaaacagaacaaguuucuuccuuuuguguuaca

SEQ ID NO: 376291 - RNA, 60 nt, Homo Sapiens
aggugguccccaugucccugaggaaacagcacagaacacgccaugggaaagggacaugca

SEQ ID NO: 376292 - RNA, 60 nt, Homo Sapiens
uauguuauacaauacagaucuaacuggaaaacagaacacuugugcaaguuuaucaguaaa

SEQ ID NO: 376293 - RNA, 60 nt, Homo Sapiens
uaugcaaagaugaacccgaguugugauuagacagaacaccaagacccuaaacauccauaa

SEQ ID NO: 376294 - RNA, 60 nt, Homo Sapiens
uuuucaauuuauuaaaaaaaauuauguuguacagaacaucuuuugauuuccuaugacucu

SEQ ID NO: 376295 - RNA, 60 nt, Homo Sapiens
gguagguaacaagaugcaaguuauaauggaacagaacauuugaaauuuuaguauugaauu

SEQ ID NO: 376296 - RNA, 60 nt, Homo Sapiens
uugugauuucuauugcuguagauuaaaaccacagaacaguuucuaaaucagaaauaggaa

SEQ ID NO: 376297 - RNA, 60 nt, Homo Sapiens
ucuaggacugggggucuuuucuccucaggaacagaacacuucuuuucaccucuuuaacca

SEQ ID NO: 376298 - RNA, 60 nt, Homo Sapiens
ugagaaaagaaaaaaaaccuaacauugaaaacagaacaaacauccuuuaaucauaacuaa

SEQ ID NO: 376299 - RNA, 60 nt, Homo Sapiens
uguguuuccuuuuacuuguuuugggcgaaaacagaacaacguuucaaagaggucugcaug

SEQ ID NO: 376300 - RNA, 60 nt, Homo Sapiens
agcaaaggaaaaugcuuuagcuaaaacaaaacagaacaaaacuagacaaauaaagacaaa

SEQ ID NO: 376301 - RNA, 60 nt, Homo Sapiens
uagguguggcugggggccaggagagcaggaacagaacagagaaaugcccuuggaagaagu

SEQ ID NO: 376302 - RNA, 60 nt, Homo Sapiens
agcugagcaggcugggcaauuugcccucaaacagaacagcuccccuuguagcugucuuac

SEQ ID NO: 376303 - RNA, 60 nt, Homo Sapiens
ccugaaccaggccugucaccccauagaaucacagaacaauagagugauguacagucuauu

SEQ ID NO: 376304 - RNA, 60 nt, Homo Sapiens
agagucucagggaaagagaaagaguuggagacagaacaacgagggcagcgucagacaccc

SEQ ID NO: 376305 - RNA, 60 nt, Homo Sapiens
gaauuugaaccauaaaacacuaucugaugcacagaacaccucuacuuugagacucaccuc

SEQ ID NO: 376306 - RNA, 60 nt, Homo Sapiens
ccuccucucaugagcucccccaucccugcuacagaacacagcacccauggcgccugcagu

SEQ ID NO: 376307 - RNA, 60 nt, Homo Sapiens
gguuuucauggcugccuuugucaaccacguacagaacacgacucagagaggaggaccuuc

SEQ ID NO: 376308 - RNA, 60 nt, Homo Sapiens
gagagcaaccuggaaaaucgagagaaggggacagaacagcccaaaacaaaucacgagaag

SEQ ID NO: 376309 - RNA, 60 nt, Homo Sapiens
cacaaaguuacaggguaggcaccugucaggacagaacagcagcagcgcuacagcccagag

SEQ ID NO: 376310 - RNA, 60 nt, Homo Sapiens
agcgcuacagcccagagguuauacauuucaacagaacagggauccuuggcuacuguagaa

SEQ ID NO: 376311 - RNA, 60 nt, Homo Sapiens
caaaacccuuacucacaugaggauggaggaacagaacagaggacuugggaaaagucucaa

SEQ ID NO: 376312 - RNA, 60 nt, Homo Sapiens
uaaguagaggacauggacuaguuguagcaaacagaacaugcuguuugcucuugccaaagg

SEQ ID NO: 376313 - RNA, 60 nt, Homo Sapiens
ugagaaauuagaagcgauuccuccagccauacagaacaaauuacagacgucgugaucagc

SEQ ID NO: 376314 - RNA, 60 nt, Homo Sapiens
gccacccuuuuucaucagugaauuacagaaacagaacauaaaaagauguuaaaacaguga

SEQ ID NO: 376315 - RNA, 60 nt, Homo Sapiens
aaaagauguuaaaacagugaaauuacagaaacagaacauagccacccuguuucaucagug

SEQ ID NO: 376316 - RNA, 60 nt, Homo Sapiens
uuacagacaucaugaucagccuccagccauacagaacaaaugagaaauuagaagcaauuc

SEQ ID NO: 376317 - RNA, 64 nt, Homo Sapiens
aaagccaauacaaaaaucaguuuuagcucuaauaauucuguagcacccagcaaagaagcauagc

SEQ ID NO: 376318 - RNA, 64 nt, Homo Sapiens
cagcauauacaguauaguuuuuauguucccacaaauucuguacuuguagcuuucauuugcagca

SEQ ID NO: 376319 - RNA, 64 nt, Homo Sapiens
ugccaguuuccacagcaugaaacaaacaagcuacauucuguauugucaucuucaaggcuaagaa

SEQ ID NO: 376320 - RNA, 64 nt, Homo Sapiens
uuuuuucuuuucugucugaguccgaucuucucaaauucuguacuuuuuguacguuuucuucauc

SEQ ID NO: 376321 - RNA, 64 nt, Homo Sapiens
ccucuugcccucucacaucacucaagagagcaagauucuguaaugaccagggugagaacuaaug

SEQ ID NO: 376322 - RNA, 64 nt, Homo Sapiens
cagcuaauccgccgaagaaaaggugaagaaaggaauucuguaaagaaaccaucagauuuguuaa

SEQ ID NO: 376323 - RNA, 64 nt, Homo Sapiens
aaauaaauaaaacuuuguuucuuaggagaaaaugauucuguaauuccagugucacuaauuuaua

SEQ ID NO: 376324 - RNA, 64 nt, Homo Sapiens
cucugacauuuuggaaaugaccacagagucuaagauucuguaucagauucugaguucagccuag

SEQ ID NO: 376325 - RNA, 64 nt, Homo Sapiens
guuccccuggccuaaaugaucaaacauggucaguauucuguaaagugguuccuaucucuucagg

SEQ ID NO: 376326 - RNA, 64 nt, Homo Sapiens
acugggaauuaaauauacucuuguaucauuuuaaauucuguaacauuuuaaagacaugcaguau

SEQ ID NO: 376327 - RNA, 64 nt, Homo Sapiens
agccacauagaaaaaaguugagcuguaacauccgauucuguauaaagccuuuacaauuacuuuu

SEQ ID NO: 376328 - RNA, 64 nt, Homo Sapiens
ugcauggcagucuuuuuuuuuucuguauuaaguaauucuguaacaaaaaguguauuuuacuguu

SEQ ID NO: 376329 - RNA, 64 nt, Homo Sapiens
ucuacuaagauaaucugcuucacagauugcaguaauucuguauuuauuuaaaagcagucuuauu

SEQ ID NO: 376330 - RNA, 64 nt, Homo Sapiens
acaaggugaugucuguuuccaacuauaaugugugauucuguauaugaaaaacaacuucaguuaa

SEQ ID NO: 376331 - RNA, 64 nt, Homo Sapiens
cuagaauuucuuaaaaggguaauuuggacaugucauucuguagaagaaauuaauaggaccaaac

SEQ ID NO: 376332 - RNA, 64 nt, Homo Sapiens
uucagugauuauaaauuguaaugugcauauauuuauucuguaaucacacaaagauucaaaagaa

SEQ ID NO: 376333 - RNA, 64 nt, Homo Sapiens
uguauuaacaaugcaguuugucaucauggcacagauucuguacaauuuguggcuuucuuucuua

SEQ ID NO: 376334 - RNA, 64 nt, Homo Sapiens
uagcuuucuuccuucuuuucucucucccucaaccauucuguauuuagcuuucuaauccucaucu

SEQ ID NO: 376335 - RNA, 64 nt, Homo Sapiens
uauuuuaaucacacauugaaaaauucauuaacuuauucuguauaaaacugucuuuuaagaauua

SEQ ID NO: 376336 - RNA, 64 nt, Homo Sapiens
cuaauuccauuugcauuccuugcaacauucuuucauucuguaaauguauuaaaauggaauuaua

SEQ ID NO: 376337 - RNA, 64 nt, Homo Sapiens
aaaauggaauuauaugcaacgauuuuauuuauaaauucuguauuaugcuauaaguauaaacuau

SEQ ID NO: 376338 - RNA, 64 nt, Homo Sapiens
uuccuagguguaaaauuuuaauaguuaaugcagaauucuguaaucauugaaucauuagugguua

SEQ ID NO: 376339 - RNA, 64 nt, Homo Sapiens
auuugcuguucaaguuaaucuagaaauuuauucaauucuguaugaacaccuggaagcaaaauca

SEQ ID NO: 376340 - RNA, 64 nt, Homo Sapiens
aguauguuuucacgguguauauuuuuuuucaaaaauucuguaacaaauauauuuaauguguugc

SEQ ID NO: 376341 - RNA, 64 nt, Homo Sapiens
ugguguaaacuaauguauuucuuuauuggcuguuauucuguauaacacucauaucuuugccaaa

SEQ ID NO: 376342 - RNA, 64 nt, Homo Sapiens
caaaauguucuuuuuguuacaauauucccacgauauucuguacaagcacuaauuuuagucuuaa

SEQ ID NO: 376343 - RNA, 64 nt, Homo Sapiens
guaugguaagucauaucagaaucccccuuuuaaaauucuguaguccaccgcacccggccuccau

SEQ ID NO: 376344 - RNA, 64 nt, Homo Sapiens
gauuagagaguguugaaacgcuguauagauuagaauucuguauaguaauuauaucugaggaauu

SEQ ID NO: 376345 - RNA, 64 nt, Homo Sapiens
gauuagaauucuguauagauauuauaucugaggaauucuguauauggaacgcguugaaauugua

SEQ ID NO: 376346 - RNA, 64 nt, Homo Sapiens
uuggaacuuauuuccaaacagauucuugcaacuuauucuguaaguguuuucuuugagacagucu

SEQ ID NO: 376347 - RNA, 64 nt, Homo Sapiens
agagguaacauaagugcuccuaauacuagacuggauucuguaccugacaacuaaacauaguaag

SEQ ID NO: 376348 - RNA, 64 nt, Homo Sapiens
uucacucaacgauuaagucuuuuuuccuuugcaaauucuguaaucugugcucaaauuuuacauu

SEQ ID NO: 376349 - RNA, 64 nt, Homo Sapiens
aauagcuuauagugagaagugacauuuuuucugaauucuguauauuaaaaaucuuacuaggauu

SEQ ID NO: 376350 - RNA, 64 nt, Homo Sapiens
uuucuuuuguaauuuguaacuuguuauuggauguauucuguaucuguuccucagucugauuaau

SEQ ID NO: 376351 - RNA, 64 nt, Homo Sapiens
acuuugaauaaugugauauucagauucuccucuaauucuguaggaugcaaaaauaugaguagua

SEQ ID NO: 376352 - RNA, 64 nt, Homo Sapiens
acaucuguauuaaaaagacaugcuguaauuaaacauucuguaccuuuaacuggaaucacugccc

SEQ ID NO: 376353 - RNA, 64 nt, Homo Sapiens
uauauguauuacauuucuacaauacaguccuggcauucuguacaguuauguacauaucauuguu

SEQ ID NO: 376354 - RNA, 64 nt, Homo Sapiens
cgcgucggggccgggcccgccaguucuuuuccggauucuguagaaaauacauacuuccugugcc

SEQ ID NO: 376355 - RNA, 64 nt, Homo Sapiens
ugucagcuuacauaucauuguauagagacuguuuauucuguaccaaacugauuucaaaaguacu

SEQ ID NO: 376356 - RNA, 64 nt, Homo Sapiens
auaaguauuaucucuauuuuuucaguauuuagcaauucuguaaaaaaacaguauaaguaucuca

SEQ ID NO: 376357 - RNA, 64 nt, Homo Sapiens
uuuuuguaaaacagaauauucuuuuauauuggccauucuguaugauucucaagcaagguuuuca

SEQ ID NO: 376358 - RNA, 64 nt, Homo Sapiens
aaugcacauguaauccaaguauaacaugcauauaauucuguaggagguauuuugauauuggaga

SEQ ID NO: 376359 - RNA, 64 nt, Homo Sapiens
uucuuugguuuccuguaucuaaguacauugaugaauucuguaucuuuaguguaaccuguauuac

SEQ ID NO: 376360 - RNA, 64 nt, Homo Sapiens
uaaaguuuuaaguggcagguuguuuuuuuccugcauucuguacacuauuuggaagugccucuua

SEQ ID NO: 376361 - RNA, 64 nt, Homo Sapiens
caacauuagaauuacuuuggggagugggaaagugauucuguaacacaccuggacuuuuacuggg

SEQ ID NO: 376362 - RNA, 64 nt, Homo Sapiens
agggcaaguuuccacucuaacauguauuuugaauauucuguaacgucaaaugcuacagugugaa

SEQ ID NO: 376363 - RNA, 64 nt, Homo Sapiens
uaauauauucauguuugaaagcuaaggaauuguaauucuguacucuuucacagcauaauuucaa

SEQ ID NO: 376364 - RNA, 64 nt, Homo Sapiens
caaauaaccaaaacucaaaauguuaauucugauuauucuguaucaucaccaguacuuuguacuu

SEQ ID NO: 376365 - RNA, 64 nt, Homo Sapiens
uaugagaguucaccagauuuuggaaauauuuucuauucuguaaccuaccuuuucauuuacauaa

SEQ ID NO: 376366 - RNA, 64 nt, Homo Sapiens
caagguuuggcaaaaaaaaaaauauuaacaaaauauucuguaagaaucaauugucuauauggaa

SEQ ID NO: 376367 - RNA, 64 nt, Homo Sapiens
cuguaaaauuuauacacacaaaaauuaacaaaagauucuguaagaauuaauuggcuauauggaa

SEQ ID NO: 376368 - RNA, 64 nt, Homo Sapiens
uccuggaaaaaauuaaaaaguaguuaguuuaauuauucuguaaauuauuuaauuuugucaagau

SEQ ID NO: 376369 - RNA, 64 nt, Homo Sapiens
ccuuuuguuucaggcacggauaacagcaaauggaauucuguauuuauuauuauuuaaguguagc

SEQ ID NO: 376370 - RNA, 64 nt, Homo Sapiens
uuuuugguuuuguuucugaguccaccccuacucuauucuguagucuggaaaugcaugacuuccc

SEQ ID NO: 376371 - RNA, 64 nt, Homo Sapiens
agaaaugaaacagacccucauuguuuuugugauuauucuguauccuacagccagcggcauauac

SEQ ID NO: 376372 - RNA, 64 nt, Homo Sapiens; identical to SEQ ID NO: 51753

SEQ ID NO: 376373 - RNA, 64 nt, Homo Sapiens; identical to SEQ ID NO: 51754

SEQ ID NO: 376374 - RNA, 64 nt, Homo Sapiens; identical to SEQ ID NO: 51755

SEQ ID NO: 376375 - RNA, 64 nt, Homo Sapiens; identical to SEQ ID NO: 51756

SEQ ID NO: 376376 - RNA, 64 nt, Homo Sapiens; identical to SEQ ID NO: 51757

SEQ ID NO: 376377 - RNA, 64 nt, Homo Sapiens; identical to SEQ ID NO: 51758

SEQ ID NO: 376378 - RNA, 64 nt, Homo Sapiens; identical to SEQ ID NO: 51759

SEQ ID NO: 376379 - RNA, 64 nt, Homo Sapiens; identical to SEQ ID NO: 51760

SEQ ID NO: 376380 - RNA, 64 nt, Homo Sapiens; identical to SEQ ID NO: 51761

SEQ ID NO: 376381 - RNA, 64 nt, Homo Sapiens; identical to SEQ ID NO: 51762

SEQ ID NO: 376382 - RNA, 64 nt, Homo Sapiens; identical to SEQ ID NO: 51763

SEQ ID NO: 376383 - RNA, 64 nt, Homo Sapiens; identical to SEQ ID NO: 51764

SEQ ID NO: 376384 - RNA, 64 nt, Homo Sapiens
cuuuucggagacagugacuggugccagugucauccgggccuacaaccgcagccgggauuuugag

SEQ ID NO: 376385 - RNA, 64 nt, Homo Sapiens
guggaguuccggaauuauucugugcgcuaccggccgggccuagaccuggugcugagagaccuga

SEQ ID NO: 376386 - RNA, 64 nt, Homo Sapiens; identical to SEQ ID NO: 270835

SEQ ID NO: 376387 - RNA, 64 nt, Homo Sapiens; identical to SEQ ID NO: 270836

SEQ ID NO: 376388 - RNA, 64 nt, Homo Sapiens; identical to SEQ ID NO: 270837

SEQ ID NO: 376389 - RNA, 64 nt, Homo Sapiens; identical to SEQ ID NO: 270838

SEQ ID NO: 376390 - RNA, 64 nt, Homo Sapiens; identical to SEQ ID NO: 129112

SEQ ID NO: 376391 - RNA, 64 nt, Homo Sapiens; identical to SEQ ID NO: 129113

SEQ ID NO: 376392 - RNA, 64 nt, Homo Sapiens; identical to SEQ ID NO: 129114

SEQ ID NO: 376393 - RNA, 64 nt, Homo Sapiens; identical to SEQ ID NO: 129115

SEQ ID NO: 376394 - RNA, 64 nt, Homo Sapiens; identical to SEQ ID NO: 129116

SEQ ID NO: 376395 - RNA, 64 nt, Homo Sapiens; identical to SEQ ID NO: 129117

SEQ ID NO: 376396 - RNA, 64 nt, Homo Sapiens; identical to SEQ ID NO: 129118

SEQ ID NO: 376397 - RNA, 64 nt, Homo Sapiens; identical to SEQ ID NO: 129119

SEQ ID NO: 376398 - RNA, 64 nt, Homo Sapiens; identical to SEQ ID NO: 129120

SEQ ID NO: 376399 - RNA, 64 nt, Homo Sapiens; identical to SEQ ID NO: 129121

SEQ ID NO: 376400 - RNA, 64 nt, Homo Sapiens; identical to SEQ ID NO: 129122

SEQ ID NO: 376401 - RNA, 64 nt, Homo Sapiens; identical to SEQ ID NO: 129123

SEQ ID NO: 376402 - RNA, 64 nt, Homo Sapiens; identical to SEQ ID NO: 129124

SEQ ID NO: 376403 - RNA, 64 nt, Homo Sapiens; identical to SEQ ID NO: 129125

SEQ ID NO: 376404 - RNA, 64 nt, Homo Sapiens; identical to SEQ ID NO: 129126

SEQ ID NO: 376405 - RNA, 64 nt, Homo Sapiens; identical to SEQ ID NO: 129127

SEQ ID NO: 376406 - RNA, 64 nt, Homo Sapiens; identical to SEQ ID NO: 129128

SEQ ID NO: 376407 - RNA, 64 nt, Homo Sapiens; identical to SEQ ID NO: 129129

SEQ ID NO: 376408 - RNA, 64 nt, Homo Sapiens; identical to SEQ ID NO: 196032

SEQ ID NO: 376409 - RNA, 64 nt, Homo Sapiens; identical to SEQ ID NO: 196033

SEQ ID NO: 376410 - RNA, 64 nt, Homo Sapiens; identical to SEQ ID NO: 196034

SEQ ID NO: 376411 - RNA, 64 nt, Homo Sapiens; identical to SEQ ID NO: 196035

SEQ ID NO: 376412 - RNA, 64 nt, Homo Sapiens; identical to SEQ ID NO: 196036

SEQ ID NO: 376413 - RNA, 64 nt, Homo Sapiens; identical to SEQ ID NO: 196037

SEQ ID NO: 376414 - RNA, 64 nt, Homo Sapiens; identical to SEQ ID NO: 196038

SEQ ID NO: 376415 - RNA, 64 nt, Homo Sapiens; identical to SEQ ID NO: 196039

SEQ ID NO: 376416 - RNA, 64 nt, Homo Sapiens; identical to SEQ ID NO: 196040

SEQ ID NO: 376417 - RNA, 64 nt, Homo Sapiens; identical to SEQ ID NO: 196041

SEQ ID NO: 376418 - RNA, 64 nt, Homo Sapiens; identical to SEQ ID NO: 196042

SEQ ID NO: 376419 - RNA, 64 nt, Homo Sapiens; identical to SEQ ID NO: 196043

SEQ ID NO: 376420 - RNA, 64 nt, Homo Sapiens; identical to SEQ ID NO: 196044

SEQ ID NO: 376421 - RNA, 64 nt, Homo Sapiens; identical to SEQ ID NO: 196045

SEQ ID NO: 376422 - RNA, 64 nt, Homo Sapiens; identical to SEQ ID NO: 196046

SEQ ID NO: 376423 - RNA, 64 nt, Homo Sapiens; identical to SEQ ID NO: 196047

SEQ ID NO: 376424 - RNA, 64 nt, Homo Sapiens; identical to SEQ ID NO: 196048

SEQ ID NO: 376425 - RNA, 64 nt, Homo Sapiens; identical to SEQ ID NO: 196049

SEQ ID NO: 376426 - RNA, 64 nt, Homo Sapiens; identical to SEQ ID NO: 196050

SEQ ID NO: 376427 - RNA, 64 nt, Homo Sapiens; identical to SEQ ID NO: 196051

SEQ ID NO: 376428 - RNA, 64 nt, Homo Sapiens; identical to SEQ ID NO: 196052

SEQ ID NO: 376429 - RNA, 64 nt, Homo Sapiens; identical to SEQ ID NO: 196053

SEQ ID NO: 376430 - RNA, 64 nt, Homo Sapiens; identical to SEQ ID NO: 196054

SEQ ID NO: 376431 - RNA, 64 nt, Homo Sapiens; identical to SEQ ID NO: 196055

SEQ ID NO: 376432 - RNA, 64 nt, Homo Sapiens; identical to SEQ ID NO: 190093

SEQ ID NO: 376433 - RNA, 64 nt, Homo Sapiens; identical to SEQ ID NO: 190094

SEQ ID NO: 376434 - RNA, 64 nt, Homo Sapiens; identical to SEQ ID NO: 190095

SEQ ID NO: 376435 - RNA, 64 nt, Homo Sapiens; identical to SEQ ID NO: 190096

SEQ ID NO: 376436 - RNA, 64 nt, Homo Sapiens; identical to SEQ ID NO: 190097

SEQ ID NO: 376437 - RNA, 64 nt, Homo Sapiens; identical to SEQ ID NO: 190098

SEQ ID NO: 376438 - RNA, 64 nt, Homo Sapiens; identical to SEQ ID NO: 190099

SEQ ID NO: 376439 - RNA, 64 nt, Homo Sapiens; identical to SEQ ID NO: 190100

SEQ ID NO: 376440 - RNA, 64 nt, Homo Sapiens; identical to SEQ ID NO: 190101

SEQ ID NO: 376441 - RNA, 64 nt, Homo Sapiens; identical to SEQ ID NO: 190102

SEQ ID NO: 376442 - RNA, 64 nt, Homo Sapiens; identical to SEQ ID NO: 190103

SEQ ID NO: 376443 - RNA, 64 nt, Homo Sapiens; identical to SEQ ID NO: 190104

SEQ ID NO: 376444 - RNA, 64 nt, Homo Sapiens; identical to SEQ ID NO: 190105

SEQ ID NO: 376445 - RNA, 64 nt, Homo Sapiens; identical to SEQ ID NO: 190106

SEQ ID NO: 376446 - RNA, 64 nt, Homo Sapiens; identical to SEQ ID NO: 190107

SEQ ID NO: 376447 - RNA, 64 nt, Homo Sapiens; identical to SEQ ID NO: 190108

SEQ ID NO: 376448 - RNA, 64 nt, Homo Sapiens; identical to SEQ ID NO: 190109

SEQ ID NO: 376449 - RNA, 64 nt, Homo Sapiens; identical to SEQ ID NO: 190110

SEQ ID NO: 376450 - RNA, 64 nt, Homo Sapiens; identical to SEQ ID NO: 190111

SEQ ID NO: 376451 - RNA, 64 nt, Homo Sapiens; identical to SEQ ID NO: 190112

SEQ ID NO: 376452 - RNA, 64 nt, Homo Sapiens; identical to SEQ ID NO: 190113

SEQ ID NO: 376453 - RNA, 64 nt, Homo Sapiens; identical to SEQ ID NO: 190114

SEQ ID NO: 376454 - RNA, 64 nt, Homo Sapiens; identical to SEQ ID NO: 190115

SEQ ID NO: 376455 - RNA, 64 nt, Homo Sapiens; identical to SEQ ID NO: 190116

SEQ ID NO: 376456 - RNA, 64 nt, Homo Sapiens; identical to SEQ ID NO: 190117

SEQ ID NO: 376457 - RNA, 64 nt, Homo Sapiens; identical to SEQ ID NO: 190118

SEQ ID NO: 376458 - RNA, 63 nt, Homo Sapiens
gaauaucagcaccuuccuaguuugggauuugaaaaguggaauuaauugcaguagggauaaagu

SEQ ID NO: 376459 - RNA, 63 nt, Homo Sapiens
agaauuaggguggguugucugucuggaaguguuaaguggaaugggcuuuguccuccaggaggu

SEQ ID NO: 376460 - RNA, 63 nt, Homo Sapiens
aaauugagcauaguaauuacccacagaaggaggaaguggaagggacaggagcacauagguaga

SEQ ID NO: 376461 - RNA, 63 nt, Homo Sapiens
uucuacuuaaauauauuauaaaaaauaaaggcaaaguggaaugauaaccuaaaaucugguaug

SEQ ID NO: 376462 - RNA, 63 nt, Homo Sapiens
gccugaagucuuacaggacuagcgugcugauggaaguggaaguucuccuuuuccaggcucagc

SEQ ID NO: 376463 - RNA, 63 nt, Homo Sapiens
agaccaagacccaucaugccgaaaaguaccaagaaguggaagacugaacuuauugcagaaauu

SEQ ID NO: 376464 - RNA, 63 nt, Homo Sapiens
ccuauuuuuguagaucuccagcgacauuucuccaaguggaaaugacacgguuuaacuguccca

SEQ ID NO: 376465 - RNA, 63 nt, Homo Sapiens
caguguggcucccacaggucguucucaaagcagaaguggaaucuauggagcagccggaagucu

SEQ ID NO: 376466 - RNA, 63 nt, Homo Sapiens
auucaauaaaauuggggugccuaaugcuacuggaaguggaacuugagauagggccuaauuugu

SEQ ID NO: 376467 - RNA, 63 nt, Homo Sapiens
ucaggaaauauaauuugagaauacuuuaaagggaaguggaaguauaagugaaugauauuuuuc

SEQ ID NO: 376468 - RNA, 63 nt, Homo Sapiens
gcagcaaguuuuucagugcacuaucauuucagcaaguggaacagguuuugguuucuauugucc

SEQ ID NO: 376469 - RNA, 63 nt, Homo Sapiens
gccacaaacauuggugcccuaucuuagauuaaaaaguggaagauaugaugcagaauauuguug

SEQ ID NO: 376470 - RNA, 63 nt, Homo Sapiens
ugaaaaugaaucuguuaugauaaagaaaaaauaaaguggaaacuuuuagaguauuacuucaua

SEQ ID NO: 376471 - RNA, 63 nt, Homo Sapiens
uguuaaaaggguucuguuuucauuaacaguacuaaguggaagggaucugcagauuccaaacug

SEQ ID NO: 376472 - RNA, 63 nt, Homo Sapiens
guguacagcugcagcuaucaaggcuauaagagaaaguggaaugaaucugaacccagaagugga

SEQ ID NO: 376473 - RNA, 63 nt, Homo Sapiens
cuauaagagaaaguggaaugaaucugaacccagaaguggaagggacgcuaauucggguaccca

SEQ ID NO: 376474 - RNA, 63 nt, Homo Sapiens
agaugcagaagaggaaaugagauacauggaaggaaguggaaccuugauaaggugauuauaaaa

SEQ ID NO: 376475 - RNA, 63 nt, Homo Sapiens
aagauuugguuugguuuuauauguuggaaacucaaguggaagggcagagaguaagguguccuu

SEQ ID NO: 376476 - RNA, 63 nt, Homo Sapiens
agaaggcuaaugggucacaucuuucugcacugaaaguggaagcucaccuguaucacugcaggg

SEQ ID NO: 376477 - RNA, 63 nt, Homo Sapiens
ucagaccagaugaugcucuguuccuuaucugcaaaguggaaggucuucuuccuagcuuucagu

SEQ ID NO: 376478 - RNA, 63 nt, Homo Sapiens
uggcggcagcaagagaaaaugagaaagaagcaaaaguggaaaccccuaauaaaccuaucagau

SEQ ID NO: 376479 - RNA, 63 nt, Homo Sapiens
uggugguggcaagagaaaaugaagaagaagcaaaaguggaaaccccugauaaacccaucagau

SEQ ID NO: 376480 - RNA, 63 nt, Homo Sapiens
aagaacaguuaauuuaagaaagucacacaagggaaguggaaggacuuucuuauuuugcuacug

SEQ ID NO: 376481 - RNA, 63 nt, Homo Sapiens
acgggagugagcuggggagcagucaaaggacggaaguggaagggcagacagagaugaaaagac

SEQ ID NO: 376482 - RNA, 63 nt, Homo Sapiens
uacuacuguugucaguaucguuuccucaaaacgaaguggaauuuuguauuugcuagucucuga

SEQ ID NO: 376483 - RNA, 63 nt, Homo Sapiens
aaaaacaaaaucuuucaaaaccuucacugugucaaguggaaacggauuuauauauauauuuuu

SEQ ID NO: 376484 - RNA, 63 nt, Homo Sapiens
augugucuuugacagcuagugucuaguguaugaaaguggaaaaggacauuucuguaguagcug

SEQ ID NO: 376485 - RNA, 63 nt, Homo Sapiens
ugcaguaaaguguauauauuaugcaguuucucuaaguggaaaaacuugacaugacuuuaauag

SEQ ID NO: 376486 - RNA, 63 nt, Homo Sapiens
ucaaccugaguccggcucuucagcaggcugcacaaguggaagcaacuaauucuggugcucagg

SEQ ID NO: 376487 - RNA, 63 nt, Homo Sapiens
ucacuuuugauugaggcaaagggguccuacuguaaguggaaaagacucacuccccuaacauaa

SEQ ID NO: 376488 - RNA, 63 nt, Homo Sapiens
ccuguucacagguucuccuucuucaucaagaaaaaguggaaccagcugucccuccagcaaaaa

SEQ ID NO: 376489 - RNA, 63 nt, Homo Sapiens
cuguccauuccuaccuggacaugucccauuaaaaaguggaagauuuuaaauaauuucuuuaca

SEQ ID NO: 376490 - RNA, 63 nt, Homo Sapiens
aaaaagucaaaccuuuauaucgaucaggcaaaaaaguggaauugccacaugccaucuucccug

SEQ ID NO: 376491 - RNA, 63 nt, Homo Sapiens
uguguguuggcgugccacgguuugauguuccugaaguggaagcgcagguauuuucuacgggug

SEQ ID NO: 376492 - RNA, 63 nt, Homo Sapiens
uauauauauucucacaugguugagccuacuugcaaguggaagaacacuuuucuaaguuuacuu

SEQ ID NO: 376493 - RNA, 63 nt, Homo Sapiens
uaggcaggauuuuggauuaaccugaguacagggaaguggaacagaauaaaaaaugcagcuggc

SEQ ID NO: 376494 - RNA, 64 nt, Homo Sapiens
cccagggggaagaaaggagggcugugaggagauaccucauuaaacuuggcuuagugaagaagag

SEQ ID NO: 376495 - RNA, 64 nt, Homo Sapiens
uccccacucucagccugggagacuccugccaagcccucauuaaagaugccacccugggcugccc

SEQ ID NO: 376496 - RNA, 64 nt, Homo Sapiens
ccuucuuccuauccccaucuucuagaacuauccaccucauuaggauucagcauucuuucugauu

SEQ ID NO: 376497 - RNA, 64 nt, Homo Sapiens
ucccacaacuagaccgccauccacaccuucugggccucauuaucccacaccaccaugucucuca

SEQ ID NO: 376498 - RNA, 64 nt, Homo Sapiens
ucuuuuacaaucaccucacuguuucuggagaucuccucauuacccuucaucaauuccggaaaca

SEQ ID NO: 376499 - RNA, 64 nt, Homo Sapiens
uaccaugacugucucucagcaagacuugcaccccccucauuaucaguccccacugucaucuacc

SEQ ID NO: 376500 - RNA, 64 nt, Homo Sapiens
ggguucacaccaucacccuuucuucccucuagguggggggaaagggugagucaaaggaacucca

SEQ ID NO: 376501 - RNA, 64 nt, Homo Sapiens
caaaugcaagugaggguucugggggcaaccaggaggggggaaucacccuacaaccugcauacuu

SEQ ID NO: 376502 - RNA, 64 nt, Homo Sapiens
ggugugucagcuggguagaucuggggggaagggaggggggaaugggaacaagaaaucacuugcu

SEQ ID NO: 376503 - RNA, 64 nt, Homo Sapiens
gaggggggaaugggugugucaaaucacuugcucuggggggaaggaagcugcaggguggaacaag

SEQ ID NO: 376504 - RNA, 64 nt, Homo Sapiens
auaugugguuuuuguacaaacugauuuugugaggggggggaauauauuccuguaauucagccac

SEQ ID NO: 376505 - RNA, 64 nt, Homo Sapiens
gccacaggggacaaaccuuaaugaugggcagaagggggggaauauuaauaggaaccaaaaaaua

SEQ ID NO: 376506 - RNA, 64 nt, Homo Sapiens
ggaaagugaaaagcuccuuagcccuggggcuugaggggggaaagggguaggguggguaagaguc

SEQ ID NO: 376507 - RNA, 64 nt, Homo Sapiens
ccugggaacaagggaugaggaggaguugggggcuggggggaauccugccaguuggugaagcccu

SEQ ID NO: 376508 - RNA, 64 nt, Homo Sapiens
ggagggggccaccggggcagggagggggcggcaaggggggaaugggaguugucuccccuucucc

SEQ ID NO: 376509 - RNA, 64 nt, Homo Sapiens
ccuucucucuucuuggucucuacucccagggggaggggggaacuuacucuaggaaaagccaugu

SEQ ID NO: 376510 - RNA, 64 nt, Homo Sapiens
uuuaucuuuguaaaucuuuuugagucugggggguggggggaaggggggcuucauuaauuauuua

SEQ ID NO: 376511 - RNA, 64 nt, Homo Sapiens
ucagaggaguacgcaguuguaugcaguuaugguuggggggaauguuugugagggucuugaacua

SEQ ID NO: 376512 - RNA, 64 nt, Homo Sapiens
accaacacauuccagagcuuuaggacccauuuugggggggaaaaacaagucacuuuacccuccu

SEQ ID NO: 376513 - RNA, 64 nt, Homo Sapiens
gagggaaaaacguuaggugcggacuuaagaauuuggggggaaguaagcagugaaauggaccaaa

SEQ ID NO: 376514 - RNA, 64 nt, Homo Sapiens
aagcaaaaaacaaaauuaaaaggcaucuggaaagggggggaaaaaguguacuaggucaaucagg

SEQ ID NO: 376515 - RNA, 64 nt, Homo Sapiens
cuccucucuuuguggguuuuugacacaucguuuuggggggaaugaaaaggcucguuuggaucug

SEQ ID NO: 376516 - RNA, 64 nt, Homo Sapiens
cugggccaaccucaaggugggggcuucagaggguggggggaagauuggggaacggggggaaugg

SEQ ID NO: 376517 - RNA, 64 nt, Homo Sapiens
ggggcuucagaggguggggggaagauuggggaacggggggaauggucauuuaguuuuacuccug

SEQ ID NO: 376518 - RNA, 64 nt, Homo Sapiens
cucggaagagggaggagucuggggagucagggagggggggaaauccaagcgcuggggggaagac

SEQ ID NO: 376519 - RNA, 64 nt, Homo Sapiens
cggggagucagggaggggggcagggccaagcgcuggggggaagagccgccccagccuuaguccc

SEQ ID NO: 376520 - RNA, 64 nt, Homo Sapiens; identical to SEQ ID NO: 200848

SEQ ID NO: 376521 - RNA, 64 nt, Homo Sapiens; identical to SEQ ID NO: 200849

SEQ ID NO: 376522 - RNA, 64 nt, Homo Sapiens; identical to SEQ ID NO: 200850

SEQ ID NO: 376523 - RNA, 64 nt, Homo Sapiens; identical to SEQ ID NO: 200851

SEQ ID NO: 376524 - RNA, 64 nt, Homo Sapiens; identical to SEQ ID NO: 200852

SEQ ID NO: 376525 - RNA, 64 nt, Homo Sapiens; identical to SEQ ID NO: 200853

SEQ ID NO: 376526 - RNA, 64 nt, Homo Sapiens; identical to SEQ ID NO: 290645

SEQ ID NO: 376527 - RNA, 64 nt, Homo Sapiens; identical to SEQ ID NO: 290646

SEQ ID NO: 376528 - RNA, 64 nt, Homo Sapiens; identical to SEQ ID NO: 290647

SEQ ID NO: 376529 - RNA, 64 nt, Homo Sapiens; identical to SEQ ID NO: 290648

SEQ ID NO: 376530 - RNA, 64 nt, Homo Sapiens
ccaggucugcgcagcaggaauuacuuuuuguuguuuuugccaccguggagagcaacuauuugga

SEQ ID NO: 376531 - RNA, 64 nt, Homo Sapiens
uauuuggagugcacagccuauugaacuaccucauuuuugccaauaagagcuggcuuuucugcca

SEQ ID NO: 376532 - RNA, 64 nt, Homo Sapiens
auaauuauuauuucuuugaguagcucagacuugguuuugccaaaacucuugguaauuuuugaag

SEQ ID NO: 376533 - RNA, 64 nt, Homo Sapiens
guauuugagagguuaguuuuuuuccuacacuuuuuuuugccaacugacuuaacaacauugcugu

SEQ ID NO: 376534 - RNA, 64 nt, Homo Sapiens
aauccugggccuucuugcuguuguuguggccuuuuuuugccaacuucaaugguccuagucagca

SEQ ID NO: 376535 - RNA, 64 nt, Homo Sapiens
uuugggaggcccuuuacauagaaaacagcauucuuuuugccaaauaugaccaaauuacuuuuau

SEQ ID NO: 376536 - RNA, 64 nt, Homo Sapiens
agcuucgacauucucuccaguuucugauucuaauuuuugccacgugucacaacuuuuccagucu

SEQ ID NO: 376537 - RNA, 64 nt, Homo Sapiens
aaauauguauccaaagugggaggccccugugacauuuugccaacuuaaacgagaaaaagacccc

SEQ ID NO: 376538 - RNA, 64 nt, Homo Sapiens
cugauacuaaaccagagaaacgugcugcugcuuuuuuugccacuccagcagcugaucucuucca

SEQ ID NO: 376539 - RNA, 64 nt, Homo Sapiens
cuaaaggcauugucauguggucugcuucccagaguuuugccaauaggaaucuauugcucauacu

SEQ ID NO: 376540 - RNA, 64 nt, Homo Sapiens
uggccagagggaaucagagaguggcucagguaauuuuugccauuaacugugguagagccgggcu

SEQ ID NO: 376541 - RNA, 64 nt, Homo Sapiens
aacuucugaagacugagaacuuuuuugaggccuuuuuugccagacucuagguuauacaauaacc

SEQ ID NO: 376542 - RNA, 64 nt, Homo Sapiens
cuuuuuuacacugauaaaaguuuugauauuuauuuuuugccauuuuaugucuuaaugguauccu

SEQ ID NO: 376543 - RNA, 64 nt, Homo Sapiens
aagaacuauuuguuuaaauuauauagcugggauauuuugccacuguuaaaauggauucagaaga

SEQ ID NO: 376544 - RNA, 64 nt, Homo Sapiens
ccugugggggcaaauguguagauauuuuuaaacauuuugccauaauugcacaauuuuuugcauu

SEQ ID NO: 376545 - RNA, 64 nt, Homo Sapiens
cuggccaauuuuuguguuuuuuguagagacgagguuuugccauguugcccaggcuggucuccaa

SEQ ID NO: 376546 - RNA, 64 nt, Homo Sapiens
cccagcuaauuuuuguauuuuuaguagggacagguuuugccauguugcccaggcuggccucaaa

SEQ ID NO: 376547 - RNA, 64 nt, Homo Sapiens
guccuaguggagcaagcccuaaagcagauuuaauuuuugccauuuuccaagaaugacgguggug

SEQ ID NO: 376548 - RNA, 64 nt, Homo Sapiens
cccucagagcugacauucuggggugggaauuucauuuugccacguacuaacguucugcacaaaa

SEQ ID NO: 376549 - RNA, 64 nt, Homo Sapiens
ccuaaccaugacugcagcacagcagacuuuguccuuuugccagggacuuuacaaaagcaaacaa

SEQ ID NO: 376550 - RNA, 64 nt, Homo Sapiens
uacacuaaaagaaaauggccggaugaucagagacuuuugccagcuucuccuaaacuaauuauaa

SEQ ID NO: 376551 - RNA, 64 nt, Homo Sapiens
gaaacuugagccaucugugcauggaaaaaagacuuuuugccacuaaauuugcucuaguuugguu

SEQ ID NO: 376552 - RNA, 64 nt, Homo Sapiens
cauugccaaugucaaucaauuuuuuuuuuuuuuuuuuugccaacguacaguuaucaugaaaagc

SEQ ID NO: 376553 - RNA, 64 nt, Homo Sapiens
gauuaugcuuaguuuuaguucuccagguaguuacuuuugccauguccuauugaucagugacacu

SEQ ID NO: 376554 - RNA, 64 nt, Homo Sapiens
ccuuacugauaguugggaaaagaagauuggguuauuuugccauaucauuuagcuggaagugaca

SEQ ID NO: 376555 - RNA, 64 nt, Homo Sapiens
auuaauagaaaauaaacuaaaccuuauauuuuauuuuugccaaaauauuuuauuauaaaauaug

SEQ ID NO: 376556 - RNA, 64 nt, Homo Sapiens
uaccuauaaaucgugcaauaaccauaugcgacuauuuugccauggagaaaucugacagcauugc

SEQ ID NO: 376557 - RNA, 64 nt, Homo Sapiens
agaaaaggaaccuguuucuuagaagaaguaacauuuuugccaaaagaugacugggguuuuccgu

SEQ ID NO: 376558 - RNA, 64 nt, Homo Sapiens
gguuuuugaaaaacaucugaguguuuuucagauguuuugccauguggagcauauaaugauaugu

SEQ ID NO: 376559 - RNA, 64 nt, Homo Sapiens
aaaauaaaugauuucucacucugauauguaaaaauuuugccauuuuuaaguauaacagauuuua

SEQ ID NO: 376560 - RNA, 64 nt, Homo Sapiens
aauguacuguauacauaguuagauguauaagguuuuuugccagaacuuugucuugacaacugaa

SEQ ID NO: 376561 - RNA, 64 nt, Homo Sapiens
uucacaaauuccucuggcccauaaaucauauuauuuuugccaaucugaguugcauauacuguag

SEQ ID NO: 376562 - RNA, 64 nt, Homo Sapiens
uuuaauaagaaacuaagcuuugccaauugacaaguuuugccaauuuuaacagcauuacauuuca

SEQ ID NO: 376563 - RNA, 64 nt, Homo Sapiens
uugauccuuuuacuuuguuuaucagaguaaagaauuuugccauugugauuaaucaaaugauaug

SEQ ID NO: 376564 - RNA, 64 nt, Homo Sapiens
guuuguuuguuacuacagaauagagaugacuguuuuuugccacagcccuauggaauuugcaauc

SEQ ID NO: 376565 - RNA, 64 nt, Homo Sapiens
uaauguagccaaaagaauguaaauuugaggauuuuuuugccaauaguuuauagaaaauauauga

SEQ ID NO: 376566 - RNA, 64 nt, Homo Sapiens
uggucccaggcuggucucaauuguagagauggaguuuugccaugaccaugcccagcuaauuuuu

SEQ ID NO: 376567 - RNA, 64 nt, Homo Sapiens
uuaaaaggauuaaaguaacgauugggaauggugcuuuugccaacacuguagaacuguguauuug

SEQ ID NO: 376568 - RNA, 64 nt, Homo Sapiens
ugacaccguccugccuuccuuauuuaaccucuucuuuugccacucgccucuaucuuugaaucau

SEQ ID NO: 376569 - RNA, 64 nt, Homo Sapiens
auugcacuucugaaugaaguagcagcucauaagcuuuugccacaggcucugucuuuuggggaau

SEQ ID NO: 376570 - RNA, 64 nt, Homo Sapiens
auugguuuuaugcauugaugguuuuuuuuuucuuuuuugccaaauugacugucacgcggcagcu

SEQ ID NO: 376571 - RNA, 64 nt, Homo Sapiens
aggaacccuccuccugucaauggggguguaguauuuuugccaaaauaucauguucaauuucagu

SEQ ID NO: 376572 - RNA, 64 nt, Homo Sapiens
gaacagagaucuuucagggguucaaacccucgguuuuugccacacaucuuuaucaaauugacuc

SEQ ID NO: 376573 - RNA, 64 nt, Homo Sapiens
gucaucuuuaucaaauugacuacacugggguuuauuuugccaagacaguuuugucucucaucca

SEQ ID NO: 376574 - RNA, 64 nt, Homo Sapiens
uuaauuuuuuaaagacuuuuucugaucuuugaacuuuugccacauuguauacuuauaaugggaa

SEQ ID NO: 376575 - RNA, 64 nt, Homo Sapiens
aaggacauuuuugggaagcaaugcugggcagcguuuuugccauugaggguugcagaauuugcuc

SEQ ID NO: 376576 - RNA, 64 nt, Homo Sapiens
uuaaaacuuucaauggagauagggcuagaaauacuuuugccaaauagcauucuuauucacuuua

SEQ ID NO: 376577 - RNA, 64 nt, Homo Sapiens
auaaaugcagucaucuuaauacuagucuauacauuuuugccaaauggcgcaaauauaccuccau

SEQ ID NO: 376578 - RNA, 64 nt, Homo Sapiens
gggugugcccucaccacccacuugauuuuuuucauuuugccaaaaagggguaugucuuuaucaa

SEQ ID NO: 376579 - RNA, 64 nt, Homo Sapiens
agaacaaauguuuguuuguaaagcguuccaaguauuuugccacguucuggacugucuucucccu

SEQ ID NO: 376580 - RNA, 64 nt, Homo Sapiens
gaaacuguagaacuaugccaaaaaaaaccuuuaauuuugccauugcuucauuaucucuucaaca

SEQ ID NO: 376581 - RNA, 64 nt, Homo Sapiens
gaaauuuaaguuuuaaaauaccucuguuaccuacuuuugccaguccugcacugaaucugugucu

SEQ ID NO: 376582 - RNA, 64 nt, Homo Sapiens
uauucuggauaucgucauuuugcagugugcauaauuuugccaaccguugcuuucguagccccug

SEQ ID NO: 376583 - RNA, 64 nt, Homo Sapiens
ugcaaauuuuuuuguauuuuuaguagagacaguguuuugccauguuggccaggcuggucucgaa

SEQ ID NO: 376584 - RNA, 64 nt, Homo Sapiens
gccuuguugaugggccuucagauuauuuccaguuuuuugccacugcaaacaauaaacauccuug

SEQ ID NO: 376585 - RNA, 64 nt, Homo Sapiens
ucacuguucugcuuuaagcuagggcucuguacaguuuugccauuucagagugaaauguaaaguc

SEQ ID NO: 376586 - RNA, 64 nt, Homo Sapiens
cucuggagccagauccugggggcaaaauucccaguuuugccacugguccugaguaauuucccuu

SEQ ID NO: 376587 - RNA, 64 nt, Homo Sapiens
uuugcuucugauuuuuaaaucccuucacauacuauuuugccauaauaauauaaaugcccuugua

SEQ ID NO: 376588 - RNA, 64 nt, Homo Sapiens
cuuaaaaauugugcccaaaaagugaaaaccugccuuuugccacuuaauaggcugaaguggagua

SEQ ID NO: 376589 - RNA, 64 nt, Homo Sapiens
ggccuuuauugucuugguugccaguaguaccuuguuuugccauguagcagacaacacacaaaau

SEQ ID NO: 376590 - RNA, 64 nt, Homo Sapiens
uggggguacuuuagggaaaccuuugcuuaccuuguuuugccagugauaagagcaguggguugga

SEQ ID NO: 376591 - RNA, 64 nt, Homo Sapiens
gaacauuuuauuuuugaaaagggaugaugugguuuuuugccagguguuuauaauuaauccuuua

SEQ ID NO: 376592 - RNA, 64 nt, Homo Sapiens
uggauuucuguuucauuacuuccguuuuaaaaguuuuugccagagaguuuugcuaaauacucuc

SEQ ID NO: 376593 - RNA, 64 nt, Homo Sapiens
acaguuauuguagcacuuuggcagugcacuaaaauuuugccacuaugaaauguuucuuuauugu

SEQ ID NO: 376594 - RNA, 64 nt, Homo Sapiens
uuccccuucaucccacccugcucagcauuuacauuuuugccaccagcacacuuguucccagacc

SEQ ID NO: 376595 - RNA, 64 nt, Homo Sapiens
uauuguguuccugucacccacccuuucaucaucuuuuugccaggcauuccuggcugucacuugg

SEQ ID NO: 376596 - RNA, 64 nt, Homo Sapiens; identical to SEQ ID NO: 279530

SEQ ID NO: 376597 - RNA, 64 nt, Homo Sapiens; identical to SEQ ID NO: 279531

SEQ ID NO: 376598 - RNA, 64 nt, Homo Sapiens; identical to SEQ ID NO: 279532

SEQ ID NO: 376599 - RNA, 64 nt, Homo Sapiens; identical to SEQ ID NO: 279533

SEQ ID NO: 376600 - RNA, 64 nt, Homo Sapiens; identical to SEQ ID NO: 279534

SEQ ID NO: 376601 - RNA, 64 nt, Homo Sapiens; identical to SEQ ID NO: 279535

SEQ ID NO: 376602 - RNA, 64 nt, Homo Sapiens; identical to SEQ ID NO: 279536

SEQ ID NO: 376603 - RNA, 64 nt, Homo Sapiens; identical to SEQ ID NO: 279537

SEQ ID NO: 376604 - RNA, 64 nt, Homo Sapiens; identical to SEQ ID NO: 279538

SEQ ID NO: 376605 - RNA, 64 nt, Homo Sapiens; identical to SEQ ID NO: 279539

SEQ ID NO: 376606 - RNA, 64 nt, Homo Sapiens; identical to SEQ ID NO: 279540

SEQ ID NO: 376607 - RNA, 64 nt, Homo Sapiens; identical to SEQ ID NO: 279541

SEQ ID NO: 376608 - RNA, 64 nt, Homo Sapiens; identical to SEQ ID NO: 279542

SEQ ID NO: 376609 - RNA, 64 nt, Homo Sapiens; identical to SEQ ID NO: 279543

SEQ ID NO: 376610 - RNA, 64 nt, Homo Sapiens; identical to SEQ ID NO: 279544

SEQ ID NO: 376611 - RNA, 64 nt, Homo Sapiens
augcaucguuugaaaucaucgugccaaaugauucggauacuaaguuauuuuggauacuaaggau

SEQ ID NO: 376612 - RNA, 64 nt, Homo Sapiens
gaugugccaaaugauucggaacugauuuuauuuuggauacuaagauuauauuacuuuuauuucu

SEQ ID NO: 376613 - RNA, 64 nt, Homo Sapiens; identical to SEQ ID NO: 180799

SEQ ID NO: 376614 - RNA, 64 nt, Homo Sapiens; identical to SEQ ID NO: 180800

SEQ ID NO: 376615 - RNA, 64 nt, Homo Sapiens; identical to SEQ ID NO: 180801

SEQ ID NO: 376616 - RNA, 64 nt, Homo Sapiens; identical to SEQ ID NO: 180802

SEQ ID NO: 376617 - RNA, 64 nt, Homo Sapiens; identical to SEQ ID NO: 180803

SEQ ID NO: 376618 - RNA, 64 nt, Homo Sapiens; identical to SEQ ID NO: 180804

SEQ ID NO: 376619 - RNA, 64 nt, Homo Sapiens; identical to SEQ ID NO: 180805

SEQ ID NO: 376620 - RNA, 64 nt, Homo Sapiens; identical to SEQ ID NO: 180806

SEQ ID NO: 376621 - RNA, 64 nt, Homo Sapiens; identical to SEQ ID NO: 180807

SEQ ID NO: 376622 - RNA, 64 nt, Homo Sapiens; identical to SEQ ID NO: 180808

SEQ ID NO: 376623 - RNA, 64 nt, Homo Sapiens; identical to SEQ ID NO: 180809

SEQ ID NO: 376624 - RNA, 64 nt, Homo Sapiens; identical to SEQ ID NO: 180810

SEQ ID NO: 376625 - RNA, 64 nt, Homo Sapiens; identical to SEQ ID NO: 180811

SEQ ID NO: 376626 - RNA, 64 nt, Homo Sapiens; identical to SEQ ID NO: 180812

SEQ ID NO: 376627 - RNA, 64 nt, Homo Sapiens; identical to SEQ ID NO: 180813

SEQ ID NO: 376628 - RNA, 64 nt, Homo Sapiens
aucacuuucucauuuggguuauaaaagggaagguaagauggauacuugaauugugugguaucua

SEQ ID NO: 376629 - RNA, 64 nt, Homo Sapiens
cuuauugaagcccagacauuucuauuuggagaauaagauggauguggguccauguuuacucucu

SEQ ID NO: 376630 - RNA, 64 nt, Homo Sapiens
aaggguaauuaauagacaugauggaauauuauauaagauggaggauaaaaguucauuacugaag

SEQ ID NO: 376631 - RNA, 64 nt, Homo Sapiens
auuauauaagauggaggaagaaaguucauuacugaagauggaauggggauuucuuaauuagaua

SEQ ID NO: 376632 - RNA, 64 nt, Homo Sapiens
uugcccuuccuagaaaauaugacccauuucacaaaagauggaauucccuaugauaaagccuaau

SEQ ID NO: 376633 - RNA, 64 nt, Homo Sapiens
cuagugcagaaaccucuugucagcacgagucuggaagauggaagcugguggcuacuggauuaga

SEQ ID NO: 376634 - RNA, 64 nt, Homo Sapiens
uccucaaaagagaaggaacacucccuccccuaagaagauggaugccagguccaccuaacacccc

SEQ ID NO: 376635 - RNA, 64 nt, Homo Sapiens
agaagaacuuggauuccccugagagagagagagaaagauggaggaagagagagagagagagaga

SEQ ID NO: 376636 - RNA, 64 nt, Homo Sapiens
gcaggugaggaugucaggauccucauuccuucacaagauggaaggcauccugcagguagagcag

SEQ ID NO: 376637 - RNA, 64 nt, Homo Sapiens
aagcaaacagccuauuuacaggaaaguugaguguaagauggaaacuccuguucugcaggcauca

SEQ ID NO: 376638 - RNA, 64 nt, Homo Sapiens
uaaugagauaaaugaaaagagccaaguuagagaaaagauggauucaucuuuugcuauaaccuuu

SEQ ID NO: 376639 - RNA, 64 nt, Homo Sapiens
aacauaccuuugacaaauaagcuagugacagaugaagauggaagcuuuaaaggagaugccgaca

SEQ ID NO: 376640 - RNA, 64 nt, Homo Sapiens
aacaugccauuuuucagugacuuauugcaugaaaaagauggagaucagauuuaagauggacuuu

SEQ ID NO: 376641 - RNA, 64 nt, Homo Sapiens
uucuuauugcaugaaaaagaaaaaaaucagauuuaagauggacuaauacagcaauuauuuauuu

SEQ ID NO: 376642 - RNA, 64 nt, Homo Sapiens
uagaauaugacaugugagcuguuuuuggaaaacgaagauggagagagcacuuccccguaacgaa

SEQ ID NO: 376643 - RNA, 64 nt, Homo Sapiens
cuuuguguaaauaaauguuuacaauuuuauaugaaagauggaauaagcgcuagagcuuccaacu

SEQ ID NO: 376644 - RNA, 64 nt, Homo Sapiens
aaguauuuuaucugccuuaguaguuuuaagacugaagauggaaaaaccagcgcaaggaauccuc

SEQ ID NO: 376645 - RNA, 64 nt, Homo Sapiens
uuugucaaaaaguggaucuuacuuugacaaauugaagauggaugagugcgccuugcaaaaaaaa

SEQ ID NO: 376646 - RNA, 64 nt, Homo Sapiens
ugggccacaucagaauaaggcauccccagagugaaagauggagcgggaauuugugacccuggaa

SEQ ID NO: 376647 - RNA, 64 nt, Homo Sapiens
ugcuaacgaaacugagaaggaccucggucuucccaagauggagacgaggccggggguuucccuc

SEQ ID NO: 376648 - RNA, 64 nt, Homo Sapiens
gauauauaaauauacauuucacagccuagaaaacaagauggaaaguccaagaagaacuugcuac

SEQ ID NO: 376649 - RNA, 64 nt, Homo Sapiens
cagccagacaccaaacuggggaaacagaaacagcaagauggagggugcuacagcagggaaccau

SEQ ID NO: 376650 - RNA, 64 nt, Homo Sapiens
cagauuucaccacccacacucuuuuuagguguaaaagauggagucccacggaggaggggcagag

SEQ ID NO: 376651 - RNA, 64 nt, Homo Sapiens
gaagggggaacccggagcaccuccacuucuagggaagauggacagcgugggggcacaccugggc

SEQ ID NO: 376652 - RNA, 64 nt, Homo Sapiens
ucauaauucuuaacaccuggcauuuccauuucuaaagauggacaggcccuuuggcgugguacca

SEQ ID NO: 376653 - RNA, 64 nt, Homo Sapiens
auauguccagagauggaaacucacuccccuacaaaagauggagcuuaauggagaaauugcaacu

SEQ ID NO: 376654 - RNA, 64 nt, Homo Sapiens
gugcuuguuggguggguaagcuugggcaaacccaaagauggaaacuuucauuuaugguaaacau

SEQ ID NO: 376655 - RNA, 64 nt, Homo Sapiens
caauguucauggaaacugcuguauaacaaagaggaagauggaaauuaaaucugugucucugugu

SEQ ID NO: 376656 - RNA, 64 nt, Homo Sapiens
cguuuuaauauuucucuuaacccuauucucagggaagauggaauuuaguuuuaaggaaaagagg

SEQ ID NO: 376657 - RNA, 64 nt, Homo Sapiens
cgacacugugucuucucacauaaccaccuguagcaagauggaucauaaaugagaaguguuugcc

SEQ ID NO: 376658 - RNA, 64 nt, Homo Sapiens
gccucacuuuccacuuuuuaagauuauugccgaaaagauggauuggcauuauuauaagaagaga

SEQ ID NO: 376659 - RNA, 58 nt, Homo Sapiens
aaaaccuauuacauauuuguuuaggaagaagauggauaugcaacaaugcauugaguag

SEQ ID NO: 376660 - RNA, 64 nt, Homo Sapiens
uauacauaaaaccaccaaaauacauagcuucgacaagauggaaguuuauuucucucucccauaa

SEQ ID NO: 376661 - RNA, 64 nt, Homo Sapiens
agguauccagccucaagucaucauuguggccaggaagauggaauacaccaaauggacaggccug

SEQ ID NO: 376662 - RNA, 64 nt, Homo Sapiens
acaaaaagaacaaaaaaaaauuuuuaaauaccacaagauggaaaaaaaaaacaaaaaaauuuaa

SEQ ID NO: 376663 - RNA, 64 nt, Homo Sapiens
cacaagauggaaaaaaaaaacaaaaaaauuuaaaaagauggaauguaguguuuacauuaaagcc

SEQ ID NO: 376664 - RNA, 64 nt, Homo Sapiens
gcauuugguauuguuucauuuacaauuugggacuaagauggaaacacuuuuuuuauaaguuuuu

SEQ ID NO: 376665 - RNA, 64 nt, Homo Sapiens
uugcuaauaugcguaaguauuaucgguaaguuacaagauggaagaagaauaacaguagggcaca

SEQ ID NO: 376666 - RNA, 64 nt, Homo Sapiens
acaagaaauacugucaaggagauuaguaguaucaaagauggaaacauacauagcaucucauuag

SEQ ID NO: 376667 - RNA, 64 nt, Homo Sapiens
ccuuguaauugggauuaguuuggaggacaucaugaagauggaggucucuggugguuuuuaggau

SEQ ID NO: 376668 - RNA, 64 nt, Homo Sapiens
uauucacugauagagaaucuucaugugcugcccgcccccauauuagccgccuaaggcccgcggc

SEQ ID NO: 376669 - RNA, 64 nt, Homo Sapiens
ugcccucccuugcucccccugggagggcgaguggcccccauacuugugggagggggccggaacg

SEQ ID NO: 376670 - RNA, 64 nt, Homo Sapiens
acauuucccccuuccuuucccagaagccacuggccccccauagcacccagugcauccuuuuuac

SEQ ID NO: 376671 - RNA, 64 nt, Homo Sapiens
ggaaaccacuuccccaggcuucucccuccccccacccccauaggaacaggauuuggccuuagcu

SEQ ID NO: 376672 - RNA, 64 nt, Homo Sapiens
agccccuuggaugugaugguacacagugggugggcccccauaauaaguuccuaaagcaugggau

SEQ ID NO: 376673 - RNA, 64 nt, Homo Sapiens
uuugaccccagcagcuuggauggggugccgggcucccccauaguucacugacugucuccuuugg

SEQ ID NO: 376674 - RNA, 64 nt, Homo Sapiens
gaggcucaacccgacggaucacagugaaagggauuccucccacgccagaucugcacaacgaggc

SEQ ID NO: 376675 - RNA, 64 nt, Homo Sapiens
cugcacugcagccuugugggggagggcaaggcucuccucccagccagggacgccaggacauagc

SEQ ID NO: 376676 - RNA, 64 nt, Homo Sapiens
ggggccuccagagaccccaggaacaauaagugucuccucccaccagacacuugccuuauuucuu

SEQ ID NO: 376677 - RNA, 64 nt, Homo Sapiens
cacggagaccuacagucccugggcuuucauuuucuccucccagcccccugcugccuucucuaug

SEQ ID NO: 376678 - RNA, 64 nt, Homo Sapiens
auaagaugcuccuccuccucaccccuucucagccuccucccaagucuuccucuucugcaccacc

SEQ ID NO: 376679 - RNA, 64 nt, Homo Sapiens
cuacccuggccuccugcauccccucgccucauguuccucccaccuucaaagaaugaagagcccc

SEQ ID NO: 376680 - RNA, 64 nt, Homo Sapiens
augcucuggggaggcggcucggcucuggugccccuccucccagcccagcaugcucuagagaggc

SEQ ID NO: 376681 - RNA, 64 nt, Homo Sapiens
augcucuagagaggcggcucggcucuggugcccauccucccagcccagcacgcucuggggaggc

SEQ ID NO: 376682 - RNA, 64 nt, Homo Sapiens
acgcucuggggaggcggcucggcucuggugcccauccucccagcccagcaugcucuagagaggc

SEQ ID NO: 376683 - RNA, 64 nt, Homo Sapiens
uucacugcagccucgaccucccaggcucaagugauccucccaccucagccuccagaguagcuag

SEQ ID NO: 376684 - RNA, 64 nt, Homo Sapiens
uccaagcuggucucaaacuccuggguucaagccauccucccaccucagccucccaaaaugcugg

SEQ ID NO: 376685 - RNA, 64 nt, Homo Sapiens
cucacuguagucucgaccucccaggcucaagcuguccucccaccucagccucccaaguagcuga

SEQ ID NO: 376686 - RNA, 64 nt, Homo Sapiens
ccuaagcuggucucaaacuccugggcucaagcgauccucccaccucagcuucucaaaguucugg

SEQ ID NO: 376687 - RNA, 64 nt, Homo Sapiens
gagcccacagcgagccugugccuuccuccccgccuccucccacugggacucccagcagagccca

SEQ ID NO: 376688 - RNA, 64 nt, Homo Sapiens
gagacagcaccacugcugaggagucugaggacuguccucccacagaccugcagugaggggcccu

SEQ ID NO: 376689 - RNA, 64 nt, Homo Sapiens
cacuuccuguccuuguucauggagagcuguucgcuccucccagauggcuucggagggccgcagg

SEQ ID NO: 376690 - RNA, 64 nt, Homo Sapiens
uuuuccaagcaaguacacacaugccacuuguuauuccucccaagguaaguaaucagaggggcaa

SEQ ID NO: 376691 - RNA, 64 nt, Homo Sapiens
cugcccaugauuaaacaucauuguuuuaugcuacuccucccaccagagagagaauaaucgugcu

SEQ ID NO: 376692 - RNA, 64 nt, Homo Sapiens
gcagcugaucuagggguuucaccccccugccucuuccucccacuuccagccucuccaagggccc

SEQ ID NO: 376693 - RNA, 64 nt, Homo Sapiens
ugccagguggucuuccagcccugcccguggccccuccucccaggcagcagcccaggcccucccg

SEQ ID NO: 376694 - RNA, 64 nt, Homo Sapiens
uccaacuggccccuguccuuccucucucuugcucuccucccaucucaucugcaccuagcagcca

SEQ ID NO: 376695 - RNA, 64 nt, Homo Sapiens
cucacugcagccaccaccuccugagcucaagugauccucccaucuaagcccccaaguagcuagg

SEQ ID NO: 376696 - RNA, 64 nt, Homo Sapiens
cucacaaaagccuugaccuccugggcucaggugauccucccaccucagccuccugaguagcuag

SEQ ID NO: 376697 - RNA, 64 nt, Homo Sapiens
cucacugcagccucugccuccugggcucaaacaguccucccaccucagccuucugaguagcuga

SEQ ID NO: 376698 - RNA, 64 nt, Homo Sapiens
agcucccgggcuguagucucccaggcucgagcaauccucccacuucacccuccugcauagcuag

SEQ ID NO: 376699 - RNA, 64 nt, Homo Sapiens
cccaggccagucucaaacuccuggacucaagcaauccucccaccuuggccuuccaaaucacugg

SEQ ID NO: 376700 - RNA, 64 nt, Homo Sapiens
ucagacuccccaagugcuagcugggcuuaagcaauccucccacacccaggcuggucuugaacaa

SEQ ID NO: 376701 - RNA, 64 nt, Homo Sapiens
ucagccucccaaaguguuggcuggcaucaagugauccucccacccccaggcuggucuugaacuc

SEQ ID NO: 376702 - RNA, 64 nt, Homo Sapiens
ucagugguuccauggcgcucguggcuuccucccauccucccauccuuggccucugaggcugagg

SEQ ID NO: 376703 - RNA, 64 nt, Homo Sapiens
cucccaucucagugguuccaggcugaggguggcuuccucccauccccagccccuuggccucuga

SEQ ID NO: 376704 - RNA, 64 nt, Homo Sapiens
cucacugcagcuuugaccucccagacccaagugauccucccaccucagccucccucagagcugg

SEQ ID NO: 376705 - RNA, 64 nt, Homo Sapiens
cucaggcugaucucgagcuccugggcucaagugauccucccaccucagccucccaaagugcugg

SEQ ID NO: 376706 - RNA, 64 nt, Homo Sapiens
uggagugcagccucaaccuccuggguccaagugauccucccaccucagcacacaacaccaugcc

SEQ ID NO: 376707 - RNA, 64 nt, Homo Sapiens
cccaggcuggucucaaacuccugcgcucaagcaauccucccaccugggccucccaaaaugcugg

SEQ ID NO: 376708 - RNA, 64 nt, Homo Sapiens
cugccaugagcaauuguuuggcuuuccuggggccuccucccauccugacucucacuccucugag

SEQ ID NO: 376709 - RNA, 64 nt, Homo Sapiens
cuccuccaggaaccuccacaggccgccucugagcuccucccaccaacccugaagaagcaugucu

SEQ ID NO: 376710 - RNA, 64 nt, Homo Sapiens
auaaauaucucucaucuacaugguugcuuccucuuccucccaaaucccuuaguuuuccuaaaug

SEQ ID NO: 376711 - RNA, 64 nt, Homo Sapiens
aguuacccaucuucucuacuguccccauucucucuccucccaccuucaccccagauucaaguuu

SEQ ID NO: 376712 - RNA, 64 nt, Homo Sapiens
ugucugugucacugcuugugauaaugugauugucuccucccaggccaugcugacugaugguuaa

SEQ ID NO: 376713 - RNA, 64 nt, Homo Sapiens
ucaccugucgcacccacuguccucccucccaccuuccucccaccgguuucagggcugaacccca

SEQ ID NO: 376714 - RNA, 64 nt, Homo Sapiens
auugcuacugcucagcuucucaauacacaguacuuccucccagcuccuuuuagggaauaauauu

SEQ ID NO: 376715 - RNA, 64 nt, Homo Sapiens
gucccccuccucagccagccuugcugacuuagccuccucccaaagaaccucagaggccacuugc

SEQ ID NO: 376716 - RNA, 64 nt, Homo Sapiens
agguccuccugaccacuccccucccagcccuggguccucccacccucucuccucccaccccaca

SEQ ID NO: 376717 - RNA, 64 nt, Homo Sapiens
cuccccucccagcccuggguccucccacccucucuccucccaccccacagcucggacugcucug

SEQ ID NO: 376718 - RNA, 64 nt, Homo Sapiens
cccaggcuggucuugaacuccuggccucaagcgauccucccaccuguccucccaaagugcuggg

SEQ ID NO: 376719 - RNA, 64 nt, Homo Sapiens
uugaacuccuggccucaagcgauccucccaccuguccucccaaagugcugggguuacaggcgug

SEQ ID NO: 376720 - RNA, 64 nt, Homo Sapiens
cccaguggguggaaucuguccaaggugcuuuucuuccucccaggacuccucccugacuaguggc

SEQ ID NO: 376721 - RNA, 64 nt, Homo Sapiens
uggaagccuuucagaaggagacugcugccaucuuuccucccaggggaucuggccuccucauggc

SEQ ID NO: 376722 - RNA, 64 nt, Homo Sapiens
ccuggacugauucccacccacgacucacaggcauuccucccacagcccuuucauuuccucccca

SEQ ID NO: 376723 - RNA, 64 nt, Homo Sapiens
guagagaccaaaggccgcccccgccugcugggguuccucccagcaccccagcuugcuggcugcc

SEQ ID NO: 376724 - RNA, 64 nt, Homo Sapiens
cucacugcagccuccaccucccaggcucaagagauccucccacagccucccagguagcugggac

SEQ ID NO: 376725 - RNA, 64 nt, Homo Sapiens
cccaggcuggucucgaacuucgggccccaagccauccucccaccuuggcuuuccaaaguguugg

SEQ ID NO: 376726 - RNA, 64 nt, Homo Sapiens
ucuggcucuuguucuuugguguggcagccaucucuccucccagggguccugaggguuucagcac

SEQ ID NO: 376727 - RNA, 64 nt, Homo Sapiens
uccccagcgcucuguaggcucucagcuuugugcuuccucccacggguacuagcuccagcugagc

SEQ ID NO: 376728 - RNA, 64 nt, Homo Sapiens
ccccucucuuuuuacucugcucaaaaagcaucucuccucccauuacccaaccuuggucauaagu

SEQ ID NO: 376729 - RNA, 64 nt, Homo Sapiens
ugcauugcugaagagucauccugguguuccucauuccucccaccuucccguggucauuuuaauu

SEQ ID NO: 376730 - RNA, 64 nt, Homo Sapiens
cccuugcugaccucaaauucugggguucaagcaauccucccaccucaacccacaaguagcuacg

SEQ ID NO: 376731 - RNA, 64 nt, Homo Sapiens
gcccagcuggucucauacuccucaguucacgcauuccucccaccuccaccucccaaacugcugg

SEQ ID NO: 376732 - RNA, 62 nt, Homo Sapiens
cgugccugacaggugacugaccacccccacacuccucccacggcuuguggcugcccuuggcu

SEQ ID NO: 376733 - RNA, 64 nt, Homo Sapiens
cucuguucauacagacgccuauggcccugcuucuuccucccaggccucccuccuacugccugug

SEQ ID NO: 376734 - RNA, 64 nt, Homo Sapiens
ugccagcccaggguaccccaccagcugggcgccuuccucccaccauggaccagaguggcccagg

SEQ ID NO: 376735 - RNA, 55 nt, Homo Sapiens
gucuggcuggcugguagccagggcauccucccagguugccaagggcaucuucuga

SEQ ID NO: 376736 - RNA, 64 nt, Homo Sapiens
ccuccugcucccagggagcuccagggccccucucuccucccaccuggacuuggggggaacugag

SEQ ID NO: 376737 - RNA, 64 nt, Homo Sapiens
ucuuuccugccuucugcugugagcccugagauccuccucccagcucaagggacagguccugggu

SEQ ID NO: 376738 - RNA, 64 nt, Homo Sapiens
ucagacauucuguuucaucucccauucaucucccuccucccaccgugucaguuuuucugccuuu

SEQ ID NO: 376739 - RNA, 64 nt, Homo Sapiens
ccccuccuuaggccccagccugggcccagacccauccucccagccagguuucccuccagcaggc

SEQ ID NO: 376740 - RNA, 64 nt, Homo Sapiens
caaugacuuccugccauguucgaacagaacuucuuccucccaaacguuucauucuacccugggg

SEQ ID NO: 376741 - RNA, 64 nt, Homo Sapiens
caccuccucucuacucugcccccucucccguucuuccucccauccccuucccaucuccccucuc

SEQ ID NO: 376742 - RNA, 64 nt, Homo Sapiens
uugaccucccaaagugcuggcuguacugaagcgauccucccaccccuaggcuggucuuggacuc

SEQ ID NO: 376743 - RNA, 64 nt, Homo Sapiens
ucagcuucucaaguagcucuuuucuuccuucaucuccucccacccucgcccuccuaccuaccug

SEQ ID NO: 376744 - RNA, 64 nt, Homo Sapiens
cacgccacaggccagccuaccucuccguccccucuccucccaccauugcagcgggccgagugcc

SEQ ID NO: 376745 - RNA, 64 nt, Homo Sapiens
uccuauggagccucucuauuugccccucccccacuccucccaauuccauuucggccaccaggac

SEQ ID NO: 376746 - RNA, 64 nt, Homo Sapiens
ucucucucuucccucccugcaacucucucuccccuccucccacucucuucccccuccccccucc

SEQ ID NO: 376747 - RNA, 64 nt, Homo Sapiens
ucuccccuccucccacucucuucccccuccccccuccucccacugucucucaccucccccaccc

SEQ ID NO: 376748 - RNA, 64 nt, Homo Sapiens
ucagccucccaaagugcuugcuaggcucaagugauccucccaccccaggcuggucucuuaacuc

SEQ ID NO: 376749 - RNA, 64 nt, Homo Sapiens
ggaaauagaauuacagguaaagauaucucuuaaauccucccauacccuuuaaauaguguuccua

SEQ ID NO: 376750 - RNA, 64 nt, Homo Sapiens
caggugagcugggccuuuccuuuaugaaccuccauccucccagccagcuacaguagggccuccu

SEQ ID NO: 376751 - RNA, 64 nt, Homo Sapiens
accccacagcuagacagugucagcacucaucuccuccucccacauuucuggagcuuuuuuuuuu

SEQ ID NO: 376752 - RNA, 64 nt, Homo Sapiens
auucaagcuccuccucuuagaggaagcagcuccuuccucccacaggagccccaagggagcacuc

SEQ ID NO: 376753 - RNA, 64 nt, Homo Sapiens
uccucccacaggagccccaagggagcacucacccuccucccaauuggaucugaauagcuguguu

SEQ ID NO: 376754 - RNA, 64 nt, Homo Sapiens
cuggggaaauggcaggugguugaaacccugcacauccucccagggccagccccagaaugggccu

SEQ ID NO: 376755 - RNA, 64 nt, Homo Sapiens
acagcagccuccuagaguuagcaacaccagguguuccucccaacucgucugcaaggggcuggcu

SEQ ID NO: 376756 - RNA, 64 nt, Homo Sapiens
gccgccagcccagagccuccucacccuauccuguuccucccaccaggccuguggccagucuucc

SEQ ID NO: 376757 - RNA, 64 nt, Homo Sapiens
cacuguauucucaaccuccugggcucaaaugaucuccucccaccucagccucccaaguagcuga

SEQ ID NO: 376758 - RNA, 64 nt, Homo Sapiens
cccaggcuggucucaaacuccuggccucaagcaauccucccaccucagccuccuaaagcacugg

SEQ ID NO: 376759 - RNA, 64 nt, Homo Sapiens
ugcaguggugcaaucacagcucacugcagccuuguccucccaggcucaagcuauccuugcaccu

SEQ ID NO: 376760 - RNA, 64 nt, Homo Sapiens
cccaggcuggucucaaacuccugggcucaagugauccucccaucuuggccucccagaguauugg

SEQ ID NO: 376761 - RNA, 64 nt, Homo Sapiens
aggagaguuggggguuggccccugauccaccuccuccucccaccugggguuucccucccaucug

SEQ ID NO: 376762 - RNA, 64 nt, Homo Sapiens
cuggccuuccuuuccucuuuauuuagcugauccuuccucccaccuuuccuucuucuucccucag

SEQ ID NO: 376763 - RNA, 64 nt, Homo Sapiens
uuggccuuucaagaugcugguuggauucaagcgauccucccaccuuucaccuggucuuaaacuc

SEQ ID NO: 376764 - RNA, 64 nt, Homo Sapiens
ucagccucucgaguagccggcugugcuuaagcgauccucccacccucacugcagccuccacguc

SEQ ID NO: 376765 - RNA, 64 nt, Homo Sapiens
ccagggugguagugcugggcauuuuguggucuuguccucccaguaggagguucagggaagcugc

SEQ ID NO: 376766 - RNA, 64 nt, Homo Sapiens
ucagccuccugaguagcuggcuggccuuaagugauccucccacccccaagcuugucuugaacuc

SEQ ID NO: 376767 - RNA, 64 nt, Homo Sapiens
aauuaauaaaugugaagagagaagccucccucauuccucccaggggggucucuggggggcugga

SEQ ID NO: 376768 - RNA, 64 nt, Homo Sapiens
acuggugacuguuuaaugaggccccugaccagccuccucccauguacugugagcaaguccccua

SEQ ID NO: 376769 - RNA, 64 nt, Homo Sapiens
cccaagacugaguuuuggggcuuuuucacucucuuccucccacccucagcccuuauaucucucu

SEQ ID NO: 376770 - RNA, 64 nt, Homo Sapiens
ucagccuccuaaaguccuagcuggauucaagugauccucccacccccaggcuggucucgaauuc

SEQ ID NO: 376771 - RNA, 64 nt, Homo Sapiens
ucagccucccaagggugugucugagcucaagugauccucccacccucacugcaaccucugccuc

SEQ ID NO: 376772 - RNA, 64 nt, Homo Sapiens
uauccugucuuuccuuuccuuccccacuccuguguccucccaucccugucuuuucuccuugccu

SEQ ID NO: 376773 - RNA, 64 nt, Homo Sapiens
ugucccuuuuccgggaaguuccccucauuggucuuccucccaccagcaaaggaggaagucugag

SEQ ID NO: 376774 - RNA, 64 nt, Homo Sapiens
aguccaguuagcuucccuuccacagugcucugucuccucccaccucaguuugaauaucccagaa

SEQ ID NO: 376775 - RNA, 64 nt, Homo Sapiens
cugccccacuuugauuuaauaaucccaucccccuuccucccaccuaaccaggacauugauauuc

SEQ ID NO: 376776 - RNA, 64 nt, Homo Sapiens
ccuccugcacacagccgucucgcugggggagggcuccucccaugcugccaccacggcugggaca

SEQ ID NO: 376777 - RNA, 64 nt, Homo Sapiens
gggccgcugaggcaugagcaccccgccugcucuuuccucccauguuuccucccccgaggugagg

SEQ ID NO: 376778 - RNA, 64 nt, Homo Sapiens
aggggcagccaauuccuaucauucagaucuuccuuccucccaaguacucaccaaccccuuccac

SEQ ID NO: 376779 - RNA, 64 nt, Homo Sapiens
ucacugcagccucaaccucuccagauucaagugauccucccaucucagccucccaaguagcugg

SEQ ID NO: 376780 - RNA, 64 nt, Homo Sapiens
cucagugcggccuugaacuccuggacucaaucgauccucccaccucugccucccaaguaacugg

SEQ ID NO: 376781 - RNA, 64 nt, Homo Sapiens
cucagugcggccuugaacuccuggacucaauugauccucccacuucugccucccaaguaacugg

SEQ ID NO: 376782 - RNA, 64 nt, Homo Sapiens
guggaacacggaucuaaacucagguguguccaaguccucccaaaggacagcagugauggagagg

SEQ ID NO: 376783 - RNA, 64 nt, Homo Sapiens
gaaccccaggcccaacucuguccgguaucccuuuuccucccagcugcccuccccuacuucuccc

SEQ ID NO: 376784 - RNA, 64 nt, Homo Sapiens
uaccuugucaccacccgggaagcugaaggccacuuccucccagauggccucagccaggaccauc

SEQ ID NO: 376785 - RNA, 64 nt, Homo Sapiens
ggcccagcagacccugcugucccaagcccaccccuccucccaccaucaccucccucaccucggg

SEQ ID NO: 376786 - RNA, 64 nt, Homo Sapiens
gagccuccuucuagauguaggcauuuggcuuuuaaaggggaacucagcucugauucugcuuuuu

SEQ ID NO: 376787 - RNA, 64 nt, Homo Sapiens
uagaaucuaaccugcugucuucgugcucugugugaaggggaagcugggggguuagcaugaaguc

SEQ ID NO: 376788 - RNA, 64 nt, Homo Sapiens
caccaucucuuauacuuaagugaaaaacauggggaaggggaaaggggaauggcugcuuuugaua

SEQ ID NO: 376789 - RNA, 64 nt, Homo Sapiens
ucuuauacuuaagugaaaaacauggggaaggggaaaggggaauggcugcuuuugauauguuccc

SEQ ID NO: 376790 - RNA, 64 nt, Homo Sapiens
agaucaaaacccaccaugccaaggggaagaaaagaaggggaagaagaucaaagaagaaaagaag

SEQ ID NO: 376791 - RNA, 64 nt, Homo Sapiens
aaagaaggggaagaagaucaaagaagaaaagaagaaggggaagaaaagaaggggaagaagauca

SEQ ID NO: 376792 - RNA, 64 nt, Homo Sapiens
agaucaaagaagaaaagaagaaggggaagaaaagaaggggaagacagaaauugaaaagaagggg

SEQ ID NO: 376793 - RNA, 64 nt, Homo Sapiens
aaagaaggggaagaagaucauugaaaagaaggggaaggggaagagucugaauuuauugcagaaa

SEQ ID NO: 376794 - RNA, 64 nt, Homo Sapiens
ggaagaaaagaaggggaagagagaaauugaaaagaaggggaagguggcuuuucucuugacgugg

SEQ ID NO: 376795 - RNA, 64 nt, Homo Sapiens
auucaaaggagaugcaggugacacacccgcaccaaaggggaaacuaugcaccuggggagucccc

SEQ ID NO: 376796 - RNA, 64 nt, Homo Sapiens
agagcuugggggugggagaggaggcccuguggacaaggggaaggaucuggagcgcaaggauuga

SEQ ID NO: 376797 - RNA, 64 nt, Homo Sapiens
ugggaccagaaaccacuguuuaguaaauaaguucaaggggaacuuaggaguaaaaagaccauug

SEQ ID NO: 376798 - RNA, 64 nt, Homo Sapiens
ucaagaaggcaguuuuaucauucuuuuggagagcaaggggaagguuguuaauuguuuaaaccac

SEQ ID NO: 376799 - RNA, 64 nt, Homo Sapiens
cucuuuuccuauauauguucauguaauggaacaaaaggggaauuaagcuucaaaagguuucuau

SEQ ID NO: 376800 - RNA, 64 nt, Homo Sapiens
aacacauacccuaacuuagcgauaguauagaaugaaggggaaaugguaauacaagacuucuuuu

SEQ ID NO: 376801 - RNA, 64 nt, Homo Sapiens
ggaagaagagugaaacaaagggaaggugaaggggaaggggaagacucauuguggaaacgaugga

SEQ ID NO: 376802 - RNA, 64 nt, Homo Sapiens
ggaagaggaagaagagugaagauggaggaaggugaaggggaagggcagagcucauuguggaaac

SEQ ID NO: 376803 - RNA, 64 nt, Homo Sapiens
acuuuaguaaacccuaaguaaagucaaaauggagaaggggaaauauacagauggcuaguugcau

SEQ ID NO: 376804 - RNA, 64 nt, Homo Sapiens
uucccuucuuaaacagaaauaaauauuuggaaugaaggggaauguacuagaacacccuuuuugc

SEQ ID NO: 376805 - RNA, 64 nt, Homo Sapiens
aagcaguaaccuuauacacuacuuauaaguuugaaaggggaaagguuaccuuuacaauggagac

SEQ ID NO: 376806 - RNA, 64 nt, Homo Sapiens
uguucaauaauguauauguaucaguucuguaauaaaggggaaaacacuuuuuuuaaauacucau

SEQ ID NO: 376807 - RNA, 64 nt, Homo Sapiens
gagagaaggugccuuugacuagggaguccuuggaaaggggaauguagagggggaguuuacuaaa

SEQ ID NO: 376808 - RNA, 64 nt, Homo Sapiens
acuguuucuucagugauuacguagugggugggaaaaggggaaaacucugaagggaauagggcug

SEQ ID NO: 376809 - RNA, 64 nt, Homo Sapiens
uuuccaccaacugaaucauuuaacaaugaaggggaaggggaagauauuuuaaguuugaaaacuu

SEQ ID NO: 376810 - RNA, 64 nt, Homo Sapiens
ggaagauuuccaccaacugaaaacuuuaacaaugaaggggaagguagcacuauuuuaaguuuga

SEQ ID NO: 376811 - RNA, 64 nt, Homo Sapiens
caaauguaguuuccacagugauuuaagggcacucaaggggaaaacaugaggaagcaggcuguag

SEQ ID NO: 376812 - RNA, 64 nt, Homo Sapiens
uucgucuuuuuaaauguguuauuauaacuacugaaaggggaaccagcagucuugaauaauacag

SEQ ID NO: 376813 - RNA, 64 nt, Homo Sapiens
acaggacacagccuuauuacugcuggggugggauaaggggaaggagaagagggagaauggagca

SEQ ID NO: 376814 - RNA, 64 nt, Homo Sapiens
cuguggacgaaagggagagcggguccuccagggcaaggggaacgggaaauaggucuccuaggug

SEQ ID NO: 376815 - RNA, 64 nt, Homo Sapiens
aaucaacucuugguucuuucuaacagcuccaggaaaggggaauguuaaagcaacaaccaacuag

SEQ ID NO: 376816 - RNA, 64 nt, Homo Sapiens
guuugcaguagcagccgcugagcgcagagcugcgaaggggaacugcacacugaugggcgagcug

SEQ ID NO: 376817 - RNA, 64 nt, Homo Sapiens
aaacuacuuuagagccucuuguggguaaagaauaaaggggaaagaaguuaagcacuuccuuggu

SEQ ID NO: 376818 - RNA, 64 nt, Homo Sapiens
ucccaaaauuuaaaaacaaaccagguggaggagaaaggggaaucgccccagaguguguaugcuu

SEQ ID NO: 376819 - RNA, 64 nt, Homo Sapiens
cacacacacggaaaaaaaauuuuaaauacaaaaaaaggggaaaacaggccaucaagacuauuua

SEQ ID NO: 376820 - RNA, 64 nt, Homo Sapiens
ccuuauaggggagagggaacggucuucucaauggaaggggaaucucauaguggugcuugggcca

SEQ ID NO: 376821 - RNA, 64 nt, Homo Sapiens
agauaaaauaaccccuauuuuucuuguuuuuaauaaggggaaaauuuagaccuugguuugguag

SEQ ID NO: 376822 - RNA, 64 nt, Homo Sapiens
aaaugucaucuccccccaccuuuucuuuuauugcaaggggaaaauccuuuccguuucaagaccu

SEQ ID NO: 376823 - RNA, 64 nt, Homo Sapiens
ugacuuaaaacuuuuuuuuuucuauuaaaacuuaaaggggaacaaaacuugaaaaagcccuguu

SEQ ID NO: 376824 - RNA, 64 nt, Homo Sapiens
gauuuuuuauauuugccacuguuaaauaguuggaaaggggaaauucugauuaagcgaaaguggu

SEQ ID NO: 376825 - RNA, 64 nt, Homo Sapiens
ucuugugggaggagcagaggccgugcccggcccaaaggggaaacgggauuacaggcgugagcca

SEQ ID NO: 376826 - RNA, 64 nt, Homo Sapiens
uuuuuuuuggagaaggcgucuucauuuggggccaaaggggaaacccucugcugccagccaaguc

SEQ ID NO: 376827 - RNA, 64 nt, Homo Sapiens
aauuacucuuuguuagcacuauuucuaccagugaaaggggaauuaaaaggagaaaaacaaagag

SEQ ID NO: 376828 - RNA, 64 nt, Homo Sapiens
guacugaaaacaccauccaugccaaagaugacacaaggggaaggaacaauaggggaagccugga

SEQ ID NO: 376829 - RNA, 64 nt, Homo Sapiens
aaaaacaucuugaaaagacuuuugagucacaauuaaggggaagcuuucucucaauuugauuagc

SEQ ID NO: 376830 - RNA, 64 nt, Homo Sapiens
aucaccagggguuuguuggcuauaauucagcaggaaggggaaacucccuuugaugauuggguuu

SEQ ID NO: 376831 - RNA, 64 nt, Homo Sapiens
aaaaaaaaagagaaacccuuuguauagcuucuaaaaggggaaaaagaaggaaaacaacuuuuua

SEQ ID NO: 376832 - RNA, 64 nt, Homo Sapiens
uagauggacuaggagagacuuuuaaguggggaggaaggggaagcugauuuaauuuuuucuuuuu

SEQ ID NO: 376833 - RNA, 64 nt, Homo Sapiens
augagggcauuucaugaaccgggggccuuagcagaaggggaacagacagcaggagggaggcguc

SEQ ID NO: 376834 - RNA, 64 nt, Homo Sapiens
aaggggcuuugggaucuggaugagcgagauggagaaggggaaggagggagccaggccccgaggg

SEQ ID NO: 376835 - RNA, 64 nt, Homo Sapiens
gaaggcccagagaagggaagccuacuuacuccguaaggggaaauuagucaguaagacgauauaa

SEQ ID NO: 376836 - RNA, 64 nt, Homo Sapiens
ggauuucucacuucaauuauuuugaaguauugagaaggggaaggaugccaaauuuccaggccuu

SEQ ID NO: 376837 - RNA, 64 nt, Homo Sapiens
auacacuucucugaggaucaccugcugucaaauugccaucuacaguauuacagcuuugcauuug

SEQ ID NO: 376838 - RNA, 64 nt, Homo Sapiens
gaagacaccucguguauuauaggacucacgggaugccaucuagcaaguggagaaauagcagucc

SEQ ID NO: 376839 - RNA, 64 nt, Homo Sapiens; identical to SEQ ID NO: 21758

SEQ ID NO: 376840 - RNA, 64 nt, Homo Sapiens; identical to SEQ ID NO: 21759

SEQ ID NO: 376841 - RNA, 64 nt, Homo Sapiens; identical to SEQ ID NO: 21760

SEQ ID NO: 376842 - RNA, 64 nt, Homo Sapiens; identical to SEQ ID NO: 21761

SEQ ID NO: 376843 - RNA, 64 nt, Homo Sapiens; identical to SEQ ID NO: 21762

SEQ ID NO: 376844 - RNA, 64 nt, Homo Sapiens; identical to SEQ ID NO: 21763

SEQ ID NO: 376845 - RNA, 64 nt, Homo Sapiens; identical to SEQ ID NO: 21764

SEQ ID NO: 376846 - RNA, 64 nt, Homo Sapiens; identical to SEQ ID NO: 21765

SEQ ID NO: 376847 - RNA, 64 nt, Homo Sapiens; identical to SEQ ID NO: 21766

SEQ ID NO: 376848 - RNA, 64 nt, Homo Sapiens; identical to SEQ ID NO: 21767

SEQ ID NO: 376849 - RNA, 64 nt, Homo Sapiens; identical to SEQ ID NO: 21768

SEQ ID NO: 376850 - RNA, 64 nt, Homo Sapiens; identical to SEQ ID NO: 21769

SEQ ID NO: 376851 - RNA, 64 nt, Homo Sapiens; identical to SEQ ID NO: 21770

SEQ ID NO: 376852 - RNA, 64 nt, Homo Sapiens; identical to SEQ ID NO: 21771

SEQ ID NO: 376853 - RNA, 64 nt, Homo Sapiens; identical to SEQ ID NO: 21772

SEQ ID NO: 376854 - RNA, 64 nt, Homo Sapiens; identical to SEQ ID NO: 21773

SEQ ID NO: 376855 - RNA, 64 nt, Homo Sapiens; identical to SEQ ID NO: 21774

SEQ ID NO: 376856 - RNA, 64 nt, Homo Sapiens; identical to SEQ ID NO: 21775

SEQ ID NO: 376857 - RNA, 64 nt, Homo Sapiens; identical to SEQ ID NO: 21776

SEQ ID NO: 376858 - RNA, 64 nt, Homo Sapiens; identical to SEQ ID NO: 21777

SEQ ID NO: 376859 - RNA, 64 nt, Homo Sapiens; identical to SEQ ID NO: 21778

SEQ ID NO: 376860 - RNA, 64 nt, Homo Sapiens; identical to SEQ ID NO: 21779

SEQ ID NO: 376861 - RNA, 64 nt, Homo Sapiens; identical to SEQ ID NO: 21780

SEQ ID NO: 376862 - RNA, 64 nt, Homo Sapiens; identical to SEQ ID NO: 21781

SEQ ID NO: 376863 - RNA, 64 nt, Homo Sapiens
aaugaauguuuuucuucuuuaaauuuaaaguuaguaucuacagauggaauuguaucuacaacca

SEQ ID NO: 376864 - RNA, 64 nt, Homo Sapiens
uuaaauuuaaaguuaguaucuacagauggaauuguaucuacaaccaaaugccucuuaucccuga

SEQ ID NO: 376865 - RNA, 64 nt, Homo Sapiens
uauauaaucuuacauuuaaauaucuaucuaucuauaucuacaucuauaucuauauaucuacaua

SEQ ID NO: 376866 - RNA, 64 nt, Homo Sapiens
uaucuaucuaucuauaucuaacauuauaucuauauaucuacauaugccuuauagugauauugug

SEQ ID NO: 376867 - RNA, 64 nt, Homo Sapiens
cauuaucuuagacuugcaguuguacugccagaauuaucuacagcacugguguaaaagaaggguc

SEQ ID NO: 376868 - RNA, 64 nt, Homo Sapiens
ucagguggcuggcuugaacaugagucugcugugcuaucuacauaaaugucuaaguuguauaaag

SEQ ID NO: 376869 - RNA, 64 nt, Homo Sapiens
uguauuuuguagcugucacacuacacgcauccuguaucuacacgagauguucagcauccuguau

SEQ ID NO: 376870 - RNA, 64 nt, Homo Sapiens
cauccuguaucuacacguguuguucagcauccuguaucuacacguuggaaagacaacccagaga

SEQ ID NO: 376871 - RNA, 64 nt, Homo Sapiens
uuuagaauuuaucaacauuuucaauaaugcuaaauaucuacauucuaacaaaaauauuuggucu

SEQ ID NO: 376872 - RNA, 64 nt, Homo Sapiens
cuaaguuacacauaaguuucaugggaaauccaucuaucuacagcuuauuuguaaaauuaugaau

SEQ ID NO: 376873 - RNA, 64 nt, Homo Sapiens
uugaaggguuuaugugcaaauauuuuucauuuguuaucuacauuuuauugaguggguuccacuu

SEQ ID NO: 376874 - RNA, 64 nt, Homo Sapiens
gaugcgaaucagucaaggggcaaaauuuaguguuuaucuacaaauaaguguaaauaaucuuuau

SEQ ID NO: 376875 - RNA, 64 nt, Homo Sapiens
uacagaaagaagcaguucucaucuacaauacauauaucuacacaacgaugauaucuauauaugu

SEQ ID NO: 376876 - RNA, 64 nt, Homo Sapiens
acauauaucuacacauacaggauaucuauauauguaucuacaaucccccuuuucuccccacgau

SEQ ID NO: 376877 - RNA, 64 nt, Homo Sapiens
uguucuucccuaccuucucugguaagaaggacuguaucuacacccucucuuaucccugagggug

SEQ ID NO: 376878 - RNA, 64 nt, Homo Sapiens
gccuggaccuuguucuuggcugugugcucccuguuaucuacauuuuaagcacacauacuuuaga

SEQ ID NO: 376879 - RNA, 64 nt, Homo Sapiens
uuucauauguguucagacagacagaaacuaucacuaucuacauuagcuguaagccagcccauau

SEQ ID NO: 376880 - RNA, 64 nt, Homo Sapiens
uuccucagccucuaucugaacuguuggugcacauuaucuacauuccaugaagcggccacagaaa

SEQ ID NO: 376881 - RNA, 64 nt, Homo Sapiens
ucccuuaccaauuugucacagugcagguugagaauaucuacaaauguuacagacugcagaggau

SEQ ID NO: 376882 - RNA, 63 nt, Homo Sapiens
ccuuuuauacuuuugaccaauucguauuucaaauaaggucagaucuuccaaguacucagcuuu

SEQ ID NO: 376883 - RNA, 63 nt, Homo Sapiens
uugauuggauacuuaaguuuugugggauuuuaguaaggucaguacauuaauugacuuauaauu

SEQ ID NO: 376884 - RNA, 63 nt, Homo Sapiens
uaugcacuagacaauggaucugcaacuuuggacuaaggucauucaauguacccaaacuugaac

SEQ ID NO: 376885 - RNA, 63 nt, Homo Sapiens
ugccuucccauguucaucuguauguuuuccagcuaaggucacaaaccaaaacugaauaaaguc

SEQ ID NO: 376886 - RNA, 63 nt, Homo Sapiens
aggguuguauucaguaaaaaagaauaguaaauauaaggucacugagauucuaaguaagauagu

SEQ ID NO: 376887 - RNA, 63 nt, Homo Sapiens
aggucacugagauucuaaguaagauaguaaaucuaaggucacugagccaaauccuuuucaaua

SEQ ID NO: 376888 - RNA, 63 nt, Homo Sapiens
auuaauaacacugaaacaggaccaggaaucuauuaaggucaauuuuuaaaaauaaugauuuuu

SEQ ID NO: 376889 - RNA, 63 nt, Homo Sapiens
auggaacuugauaguuuuuugacucuauaauucuaaggucaaaucaaagugaaucauuuaguu

SEQ ID NO: 376890 - RNA, 64 nt, Homo Sapiens; identical to SEQ ID NO: 376863

SEQ ID NO: 376891 - RNA, 64 nt, Homo Sapiens; identical to SEQ ID NO: 376864

SEQ ID NO: 376892 - RNA, 64 nt, Homo Sapiens; identical to SEQ ID NO: 376865

SEQ ID NO: 376893 - RNA, 64 nt, Homo Sapiens; identical to SEQ ID NO: 376866

SEQ ID NO: 376894 - RNA, 64 nt, Homo Sapiens; identical to SEQ ID NO: 376867

SEQ ID NO: 376895 - RNA, 64 nt, Homo Sapiens; identical to SEQ ID NO: 376868

SEQ ID NO: 376896 - RNA, 64 nt, Homo Sapiens; identical to SEQ ID NO: 376869

SEQ ID NO: 376897 - RNA, 64 nt, Homo Sapiens; identical to SEQ ID NO: 376870

SEQ ID NO: 376898 - RNA, 64 nt, Homo Sapiens; identical to SEQ ID NO: 376871

SEQ ID NO: 376899 - RNA, 64 nt, Homo Sapiens; identical to SEQ ID NO: 376872

SEQ ID NO: 376900 - RNA, 64 nt, Homo Sapiens; identical to SEQ ID NO: 376873

SEQ ID NO: 376901 - RNA, 64 nt, Homo Sapiens; identical to SEQ ID NO: 376874

SEQ ID NO: 376902 - RNA, 64 nt, Homo Sapiens; identical to SEQ ID NO: 376875

SEQ ID NO: 376903 - RNA, 64 nt, Homo Sapiens; identical to SEQ ID NO: 376876

SEQ ID NO: 376904 - RNA, 64 nt, Homo Sapiens; identical to SEQ ID NO: 376877

SEQ ID NO: 376905 - RNA, 64 nt, Homo Sapiens; identical to SEQ ID NO: 376878

SEQ ID NO: 376906 - RNA, 64 nt, Homo Sapiens; identical to SEQ ID NO: 376879

SEQ ID NO: 376907 - RNA, 64 nt, Homo Sapiens; identical to SEQ ID NO: 376880

SEQ ID NO: 376908 - RNA, 64 nt, Homo Sapiens; identical to SEQ ID NO: 376881

SEQ ID NO: 376909 - RNA, 63 nt, Homo Sapiens; identical to SEQ ID NO: 376882

SEQ ID NO: 376910 - RNA, 63 nt, Homo Sapiens; identical to SEQ ID NO: 376883

SEQ ID NO: 376911 - RNA, 63 nt, Homo Sapiens; identical to SEQ ID NO: 376884

SEQ ID NO: 376912 - RNA, 63 nt, Homo Sapiens; identical to SEQ ID NO: 376885

SEQ ID NO: 376913 - RNA, 63 nt, Homo Sapiens; identical to SEQ ID NO: 376886

SEQ ID NO: 376914 - RNA, 63 nt, Homo Sapiens; identical to SEQ ID NO: 376887

SEQ ID NO: 376915 - RNA, 63 nt, Homo Sapiens; identical to SEQ ID NO: 376888

SEQ ID NO: 376916 - RNA, 63 nt, Homo Sapiens; identical to SEQ ID NO: 376889

SEQ ID NO: 376917 - RNA, 64 nt, Homo Sapiens; identical to SEQ ID NO: 376863

SEQ ID NO: 376918 - RNA, 64 nt, Homo Sapiens; identical to SEQ ID NO: 376864

SEQ ID NO: 376919 - RNA, 64 nt, Homo Sapiens; identical to SEQ ID NO: 376865

SEQ ID NO: 376920 - RNA, 64 nt, Homo Sapiens; identical to SEQ ID NO: 376866

SEQ ID NO: 376921 - RNA, 64 nt, Homo Sapiens; identical to SEQ ID NO: 376867

SEQ ID NO: 376922 - RNA, 64 nt, Homo Sapiens; identical to SEQ ID NO: 376868

SEQ ID NO: 376923 - RNA, 64 nt, Homo Sapiens; identical to SEQ ID NO: 376869

SEQ ID NO: 376924 - RNA, 64 nt, Homo Sapiens; identical to SEQ ID NO: 376870

SEQ ID NO: 376925 - RNA, 64 nt, Homo Sapiens; identical to SEQ ID NO: 376871

SEQ ID NO: 376926 - RNA, 64 nt, Homo Sapiens; identical to SEQ ID NO: 376872

SEQ ID NO: 376927 - RNA, 64 nt, Homo Sapiens; identical to SEQ ID NO: 376873

SEQ ID NO: 376928 - RNA, 64 nt, Homo Sapiens; identical to SEQ ID NO: 376874

SEQ ID NO: 376929 - RNA, 64 nt, Homo Sapiens; identical to SEQ ID NO: 376875

SEQ ID NO: 376930 - RNA, 64 nt, Homo Sapiens; identical to SEQ ID NO: 376876

SEQ ID NO: 376931 - RNA, 64 nt, Homo Sapiens; identical to SEQ ID NO: 376877

SEQ ID NO: 376932 - RNA, 64 nt, Homo Sapiens; identical to SEQ ID NO: 376878

SEQ ID NO: 376933 - RNA, 64 nt, Homo Sapiens; identical to SEQ ID NO: 376879

SEQ ID NO: 376934 - RNA, 64 nt, Homo Sapiens; identical to SEQ ID NO: 376880

SEQ ID NO: 376935 - RNA, 64 nt, Homo Sapiens; identical to SEQ ID NO: 376881

SEQ ID NO: 376936 - RNA, 63 nt, Homo Sapiens; identical to SEQ ID NO: 376882

SEQ ID NO: 376937 - RNA, 63 nt, Homo Sapiens; identical to SEQ ID NO: 376883

SEQ ID NO: 376938 - RNA, 63 nt, Homo Sapiens; identical to SEQ ID NO: 376884

SEQ ID NO: 376939 - RNA, 63 nt, Homo Sapiens; identical to SEQ ID NO: 376885

SEQ ID NO: 376940 - RNA, 63 nt, Homo Sapiens; identical to SEQ ID NO: 376886

SEQ ID NO: 376941 - RNA, 63 nt, Homo Sapiens; identical to SEQ ID NO: 376887

SEQ ID NO: 376942 - RNA, 63 nt, Homo Sapiens; identical to SEQ ID NO: 376888

SEQ ID NO: 376943 - RNA, 63 nt, Homo Sapiens; identical to SEQ ID NO: 376889

SEQ ID NO: 376944 - RNA, 64 nt, Homo Sapiens; identical to SEQ ID NO: 106228

SEQ ID NO: 376945 - RNA, 64 nt, Homo Sapiens; identical to SEQ ID NO: 106229

SEQ ID NO: 376946 - RNA, 64 nt, Homo Sapiens; identical to SEQ ID NO: 106230

SEQ ID NO: 376947 - RNA, 64 nt, Homo Sapiens; identical to SEQ ID NO: 106231

SEQ ID NO: 376948 - RNA, 64 nt, Homo Sapiens; identical to SEQ ID NO: 106232

SEQ ID NO: 376949 - RNA, 64 nt, Homo Sapiens; identical to SEQ ID NO: 106233

SEQ ID NO: 376950 - RNA, 64 nt, Homo Sapiens; identical to SEQ ID NO: 106234

SEQ ID NO: 376951 - RNA, 64 nt, Homo Sapiens; identical to SEQ ID NO: 106235

SEQ ID NO: 376952 - RNA, 64 nt, Homo Sapiens; identical to SEQ ID NO: 106236

SEQ ID NO: 376953 - RNA, 64 nt, Homo Sapiens; identical to SEQ ID NO: 106237

SEQ ID NO: 376954 - RNA, 64 nt, Homo Sapiens; identical to SEQ ID NO: 106238

SEQ ID NO: 376955 - RNA, 64 nt, Homo Sapiens; identical to SEQ ID NO: 106239

SEQ ID NO: 376956 - RNA, 64 nt, Homo Sapiens; identical to SEQ ID NO: 106240

SEQ ID NO: 376957 - RNA, 64 nt, Homo Sapiens; identical to SEQ ID NO: 106241

SEQ ID NO: 376958 - RNA, 64 nt, Homo Sapiens; identical to SEQ ID NO: 106242

SEQ ID NO: 376959 - RNA, 64 nt, Homo Sapiens; identical to SEQ ID NO: 106243

SEQ ID NO: 376960 - RNA, 64 nt, Homo Sapiens; identical to SEQ ID NO: 106244

SEQ ID NO: 376961 - RNA, 64 nt, Homo Sapiens; identical to SEQ ID NO: 106245

SEQ ID NO: 376962 - RNA, 64 nt, Homo Sapiens; identical to SEQ ID NO: 106246

SEQ ID NO: 376963 - RNA, 64 nt, Homo Sapiens; identical to SEQ ID NO: 106247

SEQ ID NO: 376964 - RNA, 64 nt, Homo Sapiens; identical to SEQ ID NO: 106248

SEQ ID NO: 376965 - RNA, 64 nt, Homo Sapiens; identical to SEQ ID NO: 106249

SEQ ID NO: 376966 - RNA, 64 nt, Homo Sapiens; identical to SEQ ID NO: 106250

SEQ ID NO: 376967 - RNA, 64 nt, Homo Sapiens; identical to SEQ ID NO: 106251

SEQ ID NO: 376968 - RNA, 64 nt, Homo Sapiens; identical to SEQ ID NO: 106252

SEQ ID NO: 376969 - RNA, 64 nt, Homo Sapiens; identical to SEQ ID NO: 106253

SEQ ID NO: 376970 - RNA, 64 nt, Homo Sapiens; identical to SEQ ID NO: 106254

SEQ ID NO: 376971 - RNA, 64 nt, Homo Sapiens; identical to SEQ ID NO: 106255

SEQ ID NO: 376972 - RNA, 64 nt, Homo Sapiens; identical to SEQ ID NO: 106256

SEQ ID NO: 376973 - RNA, 64 nt, Homo Sapiens; identical to SEQ ID NO: 106257

SEQ ID NO: 376974 - RNA, 64 nt, Homo Sapiens; identical to SEQ ID NO: 106258

SEQ ID NO: 376975 - RNA, 64 nt, Homo Sapiens; identical to SEQ ID NO: 106259

SEQ ID NO: 376976 - RNA, 64 nt, Homo Sapiens; identical to SEQ ID NO: 106260

SEQ ID NO: 376977 - RNA, 64 nt, Homo Sapiens; identical to SEQ ID NO: 106261

SEQ ID NO: 376978 - RNA, 64 nt, Homo Sapiens; identical to SEQ ID NO: 106262

SEQ ID NO: 376979 - RNA, 64 nt, Homo Sapiens; identical to SEQ ID NO: 106263

SEQ ID NO: 376980 - RNA, 64 nt, Homo Sapiens; identical to SEQ ID NO: 106264

SEQ ID NO: 376981 - RNA, 64 nt, Homo Sapiens; identical to SEQ ID NO: 106265

SEQ ID NO: 376982 - RNA, 64 nt, Homo Sapiens; identical to SEQ ID NO: 106266

SEQ ID NO: 376983 - RNA, 64 nt, Homo Sapiens; identical to SEQ ID NO: 106267

SEQ ID NO: 376984 - RNA, 64 nt, Homo Sapiens; identical to SEQ ID NO: 106268

SEQ ID NO: 376985 - RNA, 64 nt, Homo Sapiens; identical to SEQ ID NO: 106269

SEQ ID NO: 376986 - RNA, 64 nt, Homo Sapiens; identical to SEQ ID NO: 106270

SEQ ID NO: 376987 - RNA, 64 nt, Homo Sapiens; identical to SEQ ID NO: 106271

SEQ ID NO: 376988 - RNA, 64 nt, Homo Sapiens; identical to SEQ ID NO: 106272

SEQ ID NO: 376989 - RNA, 64 nt, Homo Sapiens; identical to SEQ ID NO: 106273

SEQ ID NO: 376990 - RNA, 64 nt, Homo Sapiens; identical to SEQ ID NO: 106274

SEQ ID NO: 376991 - RNA, 64 nt, Homo Sapiens; identical to SEQ ID NO: 106275

SEQ ID NO: 376992 - RNA, 64 nt, Homo Sapiens; identical to SEQ ID NO: 106276

SEQ ID NO: 376993 - RNA, 64 nt, Homo Sapiens; identical to SEQ ID NO: 106277

SEQ ID NO: 376994 - RNA, 64 nt, Homo Sapiens; identical to SEQ ID NO: 106278

SEQ ID NO: 376995 - RNA, 64 nt, Homo Sapiens; identical to SEQ ID NO: 106279

SEQ ID NO: 376996 - RNA, 64 nt, Homo Sapiens; identical to SEQ ID NO: 106280

SEQ ID NO: 376997 - RNA, 64 nt, Homo Sapiens; identical to SEQ ID NO: 106281

SEQ ID NO: 376998 - RNA, 64 nt, Homo Sapiens; identical to SEQ ID NO: 106282

SEQ ID NO: 376999 - RNA, 64 nt, Homo Sapiens; identical to SEQ ID NO: 106283

SEQ ID NO: 377000 - RNA, 64 nt, Homo Sapiens; identical to SEQ ID NO: 106284

SEQ ID NO: 377001 - RNA, 64 nt, Homo Sapiens; identical to SEQ ID NO: 106285

SEQ ID NO: 377002 - RNA, 64 nt, Homo Sapiens; identical to SEQ ID NO: 106286

SEQ ID NO: 377003 - RNA, 64 nt, Homo Sapiens; identical to SEQ ID NO: 106287

SEQ ID NO: 377004 - RNA, 64 nt, Homo Sapiens; identical to SEQ ID NO: 106288

SEQ ID NO: 377005 - RNA, 64 nt, Homo Sapiens; identical to SEQ ID NO: 106289

SEQ ID NO: 377006 - RNA, 64 nt, Homo Sapiens; identical to SEQ ID NO: 106290

SEQ ID NO: 377007 - RNA, 64 nt, Homo Sapiens; identical to SEQ ID NO: 106291

SEQ ID NO: 377008 - RNA, 64 nt, Homo Sapiens; identical to SEQ ID NO: 106292

SEQ ID NO: 377009 - RNA, 64 nt, Homo Sapiens; identical to SEQ ID NO: 106293

SEQ ID NO: 377010 - RNA, 64 nt, Homo Sapiens; identical to SEQ ID NO: 106294

SEQ ID NO: 377011 - RNA, 64 nt, Homo Sapiens; identical to SEQ ID NO: 106295

SEQ ID NO: 377012 - RNA, 64 nt, Homo Sapiens; identical to SEQ ID NO: 106296

SEQ ID NO: 377013 - RNA, 64 nt, Homo Sapiens; identical to SEQ ID NO: 106297

SEQ ID NO: 377014 - RNA, 64 nt, Homo Sapiens; identical to SEQ ID NO: 106298

SEQ ID NO: 377015 - RNA, 64 nt, Homo Sapiens; identical to SEQ ID NO: 106299

SEQ ID NO: 377016 - RNA, 64 nt, Homo Sapiens; identical to SEQ ID NO: 106300

SEQ ID NO: 377017 - RNA, 64 nt, Homo Sapiens; identical to SEQ ID NO: 106301

SEQ ID NO: 377018 - RNA, 64 nt, Homo Sapiens; identical to SEQ ID NO: 106302

SEQ ID NO: 377019 - RNA, 64 nt, Homo Sapiens; identical to SEQ ID NO: 106303

SEQ ID NO: 377020 - RNA, 64 nt, Homo Sapiens; identical to SEQ ID NO: 106304

SEQ ID NO: 377021 - RNA, 64 nt, Homo Sapiens; identical to SEQ ID NO: 106305

SEQ ID NO: 377022 - RNA, 64 nt, Homo Sapiens; identical to SEQ ID NO: 106306

SEQ ID NO: 377023 - RNA, 64 nt, Homo Sapiens; identical to SEQ ID NO: 106307

SEQ ID NO: 377024 - RNA, 64 nt, Homo Sapiens; identical to SEQ ID NO: 106308

SEQ ID NO: 377025 - RNA, 64 nt, Homo Sapiens; identical to SEQ ID NO: 106309

SEQ ID NO: 377026 - RNA, 64 nt, Homo Sapiens; identical to SEQ ID NO: 106310

SEQ ID NO: 377027 - RNA, 64 nt, Homo Sapiens; identical to SEQ ID NO: 106311

SEQ ID NO: 377028 - RNA, 64 nt, Homo Sapiens; identical to SEQ ID NO: 106312

SEQ ID NO: 377029 - RNA, 64 nt, Homo Sapiens; identical to SEQ ID NO: 106313

SEQ ID NO: 377030 - RNA, 64 nt, Homo Sapiens; identical to SEQ ID NO: 106314

SEQ ID NO: 377031 - RNA, 64 nt, Homo Sapiens; identical to SEQ ID NO: 106315

SEQ ID NO: 377032 - RNA, 64 nt, Homo Sapiens; identical to SEQ ID NO: 106316

SEQ ID NO: 377033 - RNA, 55 nt, Homo Sapiens; identical to SEQ ID NO: 106317

SEQ ID NO: 377034 - RNA, 64 nt, Homo Sapiens; identical to SEQ ID NO: 106318

SEQ ID NO: 377035 - RNA, 64 nt, Homo Sapiens; identical to SEQ ID NO: 106319

SEQ ID NO: 377036 - RNA, 64 nt, Homo Sapiens; identical to SEQ ID NO: 106320

SEQ ID NO: 377037 - RNA, 64 nt, Homo Sapiens; identical to SEQ ID NO: 106321

SEQ ID NO: 377038 - RNA, 64 nt, Homo Sapiens; identical to SEQ ID NO: 106322

SEQ ID NO: 377039 - RNA, 64 nt, Homo Sapiens; identical to SEQ ID NO: 106323

SEQ ID NO: 377040 - RNA, 64 nt, Homo Sapiens; identical to SEQ ID NO: 106324

SEQ ID NO: 377041 - RNA, 64 nt, Homo Sapiens; identical to SEQ ID NO: 106325

SEQ ID NO: 377042 - RNA, 64 nt, Homo Sapiens; identical to SEQ ID NO: 106326

SEQ ID NO: 377043 - RNA, 64 nt, Homo Sapiens; identical to SEQ ID NO: 106327

SEQ ID NO: 377044 - RNA, 64 nt, Homo Sapiens; identical to SEQ ID NO: 106328

SEQ ID NO: 377045 - RNA, 64 nt, Homo Sapiens; identical to SEQ ID NO: 106329

SEQ ID NO: 377046 - RNA, 64 nt, Homo Sapiens; identical to SEQ ID NO: 106330

SEQ ID NO: 377047 - RNA, 64 nt, Homo Sapiens; identical to SEQ ID NO: 106331

SEQ ID NO: 377048 - RNA, 64 nt, Homo Sapiens; identical to SEQ ID NO: 106332

SEQ ID NO: 377049 - RNA, 64 nt, Homo Sapiens; identical to SEQ ID NO: 106333

SEQ ID NO: 377050 - RNA, 64 nt, Homo Sapiens; identical to SEQ ID NO: 106334

SEQ ID NO: 377051 - RNA, 64 nt, Homo Sapiens; identical to SEQ ID NO: 106335

SEQ ID NO: 377052 - RNA, 64 nt, Homo Sapiens; identical to SEQ ID NO: 106336

SEQ ID NO: 377053 - RNA, 64 nt, Homo Sapiens; identical to SEQ ID NO: 106337

SEQ ID NO: 377054 - RNA, 64 nt, Homo Sapiens; identical to SEQ ID NO: 106338

SEQ ID NO: 377055 - RNA, 64 nt, Homo Sapiens; identical to SEQ ID NO: 106339

SEQ ID NO: 377056 - RNA, 64 nt, Homo Sapiens; identical to SEQ ID NO: 106340

SEQ ID NO: 377057 - RNA, 64 nt, Homo Sapiens; identical to SEQ ID NO: 106341

SEQ ID NO: 377058 - RNA, 64 nt, Homo Sapiens; identical to SEQ ID NO: 106342

SEQ ID NO: 377059 - RNA, 64 nt, Homo Sapiens; identical to SEQ ID NO: 106343

SEQ ID NO: 377060 - RNA, 64 nt, Homo Sapiens; identical to SEQ ID NO: 106344

SEQ ID NO: 377061 - RNA, 64 nt, Homo Sapiens; identical to SEQ ID NO: 106345

SEQ ID NO: 377062 - RNA, 64 nt, Homo Sapiens; identical to SEQ ID NO: 106346

SEQ ID NO: 377063 - RNA, 64 nt, Homo Sapiens; identical to SEQ ID NO: 106347

SEQ ID NO: 377064 - RNA, 64 nt, Homo Sapiens; identical to SEQ ID NO: 106348

SEQ ID NO: 377065 - RNA, 64 nt, Homo Sapiens; identical to SEQ ID NO: 106349

SEQ ID NO: 377066 - RNA, 64 nt, Homo Sapiens; identical to SEQ ID NO: 106350

SEQ ID NO: 377067 - RNA, 64 nt, Homo Sapiens; identical to SEQ ID NO: 106351

SEQ ID NO: 377068 - RNA, 64 nt, Homo Sapiens; identical to SEQ ID NO: 106352

SEQ ID NO: 377069 - RNA, 64 nt, Homo Sapiens; identical to SEQ ID NO: 106353

SEQ ID NO: 377070 - RNA, 64 nt, Homo Sapiens; identical to SEQ ID NO: 106354

SEQ ID NO: 377071 - RNA, 64 nt, Homo Sapiens; identical to SEQ ID NO: 106355

SEQ ID NO: 377072 - RNA, 64 nt, Homo Sapiens; identical to SEQ ID NO: 106356

SEQ ID NO: 377073 - RNA, 64 nt, Homo Sapiens; identical to SEQ ID NO: 106357

SEQ ID NO: 377074 - RNA, 64 nt, Homo Sapiens; identical to SEQ ID NO: 106358

SEQ ID NO: 377075 - RNA, 64 nt, Homo Sapiens; identical to SEQ ID NO: 106359

SEQ ID NO: 377076 - RNA, 64 nt, Homo Sapiens; identical to SEQ ID NO: 106360

SEQ ID NO: 377077 - RNA, 64 nt, Homo Sapiens; identical to SEQ ID NO: 106361

SEQ ID NO: 377078 - RNA, 64 nt, Homo Sapiens; identical to SEQ ID NO: 106362

SEQ ID NO: 377079 - RNA, 64 nt, Homo Sapiens; identical to SEQ ID NO: 106363

SEQ ID NO: 377080 - RNA, 64 nt, Homo Sapiens; identical to SEQ ID NO: 106364

SEQ ID NO: 377081 - RNA, 64 nt, Homo Sapiens; identical to SEQ ID NO: 106365

SEQ ID NO: 377082 - RNA, 64 nt, Homo Sapiens; identical to SEQ ID NO: 106366

SEQ ID NO: 377083 - RNA, 64 nt, Homo Sapiens; identical to SEQ ID NO: 106367

SEQ ID NO: 377084 - RNA, 64 nt, Homo Sapiens; identical to SEQ ID NO: 106368

SEQ ID NO: 377085 - RNA, 64 nt, Homo Sapiens; identical to SEQ ID NO: 106369

SEQ ID NO: 377086 - RNA, 64 nt, Homo Sapiens; identical to SEQ ID NO: 106370

SEQ ID NO: 377087 - RNA, 64 nt, Homo Sapiens; identical to SEQ ID NO: 106371

SEQ ID NO: 377088 - RNA, 64 nt, Homo Sapiens; identical to SEQ ID NO: 106372

SEQ ID NO: 377089 - RNA, 64 nt, Homo Sapiens; identical to SEQ ID NO: 106373

SEQ ID NO: 377090 - RNA, 64 nt, Homo Sapiens; identical to SEQ ID NO: 106374

SEQ ID NO: 377091 - RNA, 64 nt, Homo Sapiens; identical to SEQ ID NO: 106375

SEQ ID NO: 377092 - RNA, 61 nt, Homo Sapiens; identical to SEQ ID NO: 106376

SEQ ID NO: 377093 - RNA, 64 nt, Homo Sapiens; identical to SEQ ID NO: 106377

SEQ ID NO: 377094 - RNA, 64 nt, Homo Sapiens; identical to SEQ ID NO: 106378

SEQ ID NO: 377095 - RNA, 64 nt, Homo Sapiens; identical to SEQ ID NO: 106379

SEQ ID NO: 377096 - RNA, 64 nt, Homo Sapiens; identical to SEQ ID NO: 106380

SEQ ID NO: 377097 - RNA, 64 nt, Homo Sapiens; identical to SEQ ID NO: 106381

SEQ ID NO: 377098 - RNA, 64 nt, Homo Sapiens; identical to SEQ ID NO: 106382

SEQ ID NO: 377099 - RNA, 64 nt, Homo Sapiens; identical to SEQ ID NO: 106383

SEQ ID NO: 377100 - RNA, 64 nt, Homo Sapiens; identical to SEQ ID NO: 106384

SEQ ID NO: 377101 - RNA, 64 nt, Homo Sapiens; identical to SEQ ID NO: 106385

SEQ ID NO: 377102 - RNA, 64 nt, Homo Sapiens; identical to SEQ ID NO: 106386

SEQ ID NO: 377103 - RNA, 64 nt, Homo Sapiens; identical to SEQ ID NO: 106387

SEQ ID NO: 377104 - RNA, 64 nt, Homo Sapiens; identical to SEQ ID NO: 106388

SEQ ID NO: 377105 - RNA, 64 nt, Homo Sapiens; identical to SEQ ID NO: 106389

SEQ ID NO: 377106 - RNA, 64 nt, Homo Sapiens; identical to SEQ ID NO: 106390

SEQ ID NO: 377107 - RNA, 64 nt, Homo Sapiens; identical to SEQ ID NO: 106391

SEQ ID NO: 377108 - RNA, 64 nt, Homo Sapiens; identical to SEQ ID NO: 106392

SEQ ID NO: 377109 - RNA, 64 nt, Homo Sapiens; identical to SEQ ID NO: 106393

SEQ ID NO: 377110 - RNA, 64 nt, Homo Sapiens; identical to SEQ ID NO: 106394

SEQ ID NO: 377111 - RNA, 64 nt, Homo Sapiens; identical to SEQ ID NO: 106395

SEQ ID NO: 377112 - RNA, 64 nt, Homo Sapiens; identical to SEQ ID NO: 106396

SEQ ID NO: 377113 - RNA, 64 nt, Homo Sapiens; identical to SEQ ID NO: 106397

SEQ ID NO: 377114 - RNA, 64 nt, Homo Sapiens; identical to SEQ ID NO: 106398

SEQ ID NO: 377115 - RNA, 64 nt, Homo Sapiens; identical to SEQ ID NO: 106399

SEQ ID NO: 377116 - RNA, 64 nt, Homo Sapiens; identical to SEQ ID NO: 106400

SEQ ID NO: 377117 - RNA, 64 nt, Homo Sapiens; identical to SEQ ID NO: 106401

SEQ ID NO: 377118 - RNA, 64 nt, Homo Sapiens; identical to SEQ ID NO: 106402

SEQ ID NO: 377119 - RNA, 64 nt, Homo Sapiens; identical to SEQ ID NO: 106403

SEQ ID NO: 377120 - RNA, 64 nt, Homo Sapiens; identical to SEQ ID NO: 106404

SEQ ID NO: 377121 - RNA, 64 nt, Homo Sapiens; identical to SEQ ID NO: 106405

SEQ ID NO: 377122 - RNA, 64 nt, Homo Sapiens; identical to SEQ ID NO: 106406

SEQ ID NO: 377123 - RNA, 64 nt, Homo Sapiens; identical to SEQ ID NO: 106407

SEQ ID NO: 377124 - RNA, 64 nt, Homo Sapiens; identical to SEQ ID NO: 106408

SEQ ID NO: 377125 - RNA, 64 nt, Homo Sapiens; identical to SEQ ID NO: 106409

SEQ ID NO: 377126 - RNA, 64 nt, Homo Sapiens; identical to SEQ ID NO: 106410

SEQ ID NO: 377127 - RNA, 64 nt, Homo Sapiens; identical to SEQ ID NO: 106411

SEQ ID NO: 377128 - RNA, 64 nt, Homo Sapiens; identical to SEQ ID NO: 106412

SEQ ID NO: 377129 - RNA, 64 nt, Homo Sapiens; identical to SEQ ID NO: 106413

SEQ ID NO: 377130 - RNA, 64 nt, Homo Sapiens; identical to SEQ ID NO: 106414

SEQ ID NO: 377131 - RNA, 63 nt, Homo Sapiens
gcagcuuguaggugauuguacaagugagaauuaaagagagaacagauauuuaaacaggugcug

SEQ ID NO: 377132 - RNA, 63 nt, Homo Sapiens
acagguuccuaccagcagcacuggugugaaugaaagagagacccagccgcgucucacacaggu

SEQ ID NO: 377133 - RNA, 63 nt, Homo Sapiens
gucucccuuucccugucuggcuucucccuuaagaagagagagauacuuguagaauuggguggg

SEQ ID NO: 377134 - RNA, 63 nt, Homo Sapiens
aauaaggagccuuucuuauggaagaaaugggagaagagagacaggguucuuuucagcagaguc

SEQ ID NO: 377135 - RNA, 63 nt, Homo Sapiens
auccugagccaucggugaaacuaacagauaagcaagagagauguuuuggggacucauuucauu

SEQ ID NO: 377136 - RNA, 63 nt, Homo Sapiens
guguguguguguguguguguguguguaugacuaaagagagaauguagauauugugaaguacau

SEQ ID NO: 377137 - RNA, 63 nt, Homo Sapiens
accaacguuccuaaaaguacgacuaaggaaucaaagagagagaugaaccauacuguccccaau

SEQ ID NO: 377138 - RNA, 63 nt, Homo Sapiens
gaagccagcccugccaaaggaggucucuaacugaagagagaugugcugcugaacuuuuaaaag

SEQ ID NO: 377139 - RNA, 63 nt, Homo Sapiens
caaaaaagugugacauuacacaaaaaaaaaaaaaagagagaaaugcaaauuauuuguaugcuu

SEQ ID NO: 377140 - RNA, 63 nt, Homo Sapiens
gagagaaaaagaccaugcugguucugagagaaaaagagagagaauguugcuguuuccaguucc

SEQ ID NO: 377141 - RNA, 63 nt, Homo Sapiens
ugugaaagaaccaaaagagaucacaauacucaaaagagagagagagagaaaaaagagagaucu

SEQ ID NO: 377142 - RNA, 63 nt, Homo Sapiens
aucacaauacucaaaagagagagagagagaaaaaagagagaucuugauccacagaaauacaug

SEQ ID NO: 377143 - RNA, 63 nt, Homo Sapiens
aaagagacccuacacauggccuagaaaugagagaagagagagguauuuacccagaggauuuuc

SEQ ID NO: 377144 - RNA, 63 nt, Homo Sapiens
auugccccuuuuucuguuccuaaaaggaaggauaagagagaacauuccaggugaggcacuuca

SEQ ID NO: 377145 - RNA, 63 nt, Homo Sapiens
agguugacuuuuugcacuucuguauauagucaaaagagagaaaccuguauaauaguaagaucu

SEQ ID NO: 377146 - RNA, 63 nt, Homo Sapiens
aaaacuacugcauguuuaaaacuucaacaaaaaaagagagaaagaacuauacuaagaacauau

SEQ ID NO: 377147 - RNA, 63 nt, Homo Sapiens
aaagaggaaguguucacuuuuaguuaaauguagaagagagaagguuuuuuuuaaacaugauuc

SEQ ID NO: 377148 - RNA, 63 nt, Homo Sapiens
aauauacauuauaaaagcagauaugaaaaacagaagagagaaaauagcauuuagaaguuuugg

SEQ ID NO: 377149 - RNA, 63 nt, Homo Sapiens
cagugacuguguugugauucauaguacauuaaaaagagagagagagagaaagaaucccacagg

SEQ ID NO: 377150 - RNA, 63 nt, Homo Sapiens
aauucuugcacaccuuuccuaaaaauuucucccaagagagacuuguuugggccuuuuguggug

SEQ ID NO: 377151 - RNA, 63 nt, Homo Sapiens
gagagaggugugagggacaauuuaauaaaaaaaaagagagagaucuacuuuugcuaagaugca

SEQ ID NO: 377152 - RNA, 63 nt, Homo Sapiens
uuaggaagcaugagggcaacgaguuauuagagcaagagagagcuugggcuuggcccagaauua

SEQ ID NO: 377153 - RNA, 63 nt, Homo Sapiens
gauuaccugccacuuccaggagcccagagggccaagagagacauugccuccaccucuccuugg

SEQ ID NO: 377154 - RNA, 63 nt, Homo Sapiens
ggaguucguggcugcaaaagaaguuucuggagcaagagagagcucgcucuugggagucaggac

SEQ ID NO: 377155 - RNA, 63 nt, Homo Sapiens
gauguaauuuaaaaaguuuaauuuuaaaaaaaaaagagagagauuugacauaaaagagccuug

SEQ ID NO: 377156 - RNA, 63 nt, Homo Sapiens
uccacggacgaaacauacggggggaaugaauucaagagagauggcgaggagaggagaaggcca

SEQ ID NO: 377157 - RNA, 63 nt, Homo Sapiens
ggaaacacacucuuucauugguaguugcauuggaagagagaaacaauguuaagggguuguugu

SEQ ID NO: 377158 - RNA, 63 nt, Homo Sapiens
guggacucugaaucccuuuuugggacaacuaagaagagagaauggaagugaggacuguccugc

SEQ ID NO: 377159 - RNA, 63 nt, Homo Sapiens
guugcugcugucaugaccuaccauugaacuaagaagagagaccaaguucagaaacuagacauu

SEQ ID NO: 377160 - RNA, 63 nt, Homo Sapiens
uagcauugugucugagguuaaucuuuuuuaaaaaagagagaauaaaacugcucuaaaaaaaau

SEQ ID NO: 377161 - RNA, 56 nt, Homo Sapiens; identical to SEQ ID NO: 363474

SEQ ID NO: 377162 - RNA, 63 nt, Homo Sapiens
caaacauguaggaaaaaauaaaggaaagagaggaagagagaaguacacacacacgagagacag

SEQ ID NO: 377163 - RNA, 63 nt, Homo Sapiens
aguaccacuguggcuagauaaauguaauaacaaaagagagagacauuauacacuaugagguaa

SEQ ID NO: 377164 - RNA, 63 nt, Homo Sapiens
uuuagguaagagaaaagaaaaagauaaggaaagaagagagaagagagacaaagaucacuacag

SEQ ID NO: 377165 - RNA, 63 nt, Homo Sapiens
aagagaaaagaaaaagauaaggaaagaagagagaagagagacaaagaucacuacagaccaaaa

SEQ ID NO: 377166 - RNA, 63 nt, Homo Sapiens
agauaccaaacaucacgagaauucguauuaggaaagagagacuuggaguccuaauaguacucu

SEQ ID NO: 377167 - RNA, 63 nt, Homo Sapiens
agauuucacauuauccaucaacagacauagacaaagagagauauuuuagccaguugcucugcc

SEQ ID NO: 377168 - RNA, 63 nt, Homo Sapiens
guaucuuugccaagaccgugaucaagguagcuuaagagagauggucaggagaaaacacuguuu

SEQ ID NO: 377169 - RNA, 63 nt, Homo Sapiens
acacccaguauuugcagaagggcaaagcugcuuaagagagaggaucagggugaaguuuggcac

SEQ ID NO: 377170 - RNA, 63 nt, Homo Sapiens
aauaaauguaaaguuugaccuuuuuaaaacgaaaagagagacaaagucucagcacauuccaag

SEQ ID NO: 377171 - RNA, 63 nt, Homo Sapiens
agcucaucuguggugucagaauccuuggagcugaagagagaaaucaaaagagcaugaugaugg

SEQ ID NO: 377172 - RNA, 63 nt, Homo Sapiens
agagagaaggagaaagagggagggagagagagaaagagagagaaagagagagagagagagaga

SEQ ID NO: 377173 - RNA, 63 nt, Homo Sapiens
agaaagagggagggagagagagaaagagagagaaagagagagagagagagagagagagaaagc

SEQ ID NO: 377174 - RNA, 63 nt, Homo Sapiens
gugauaugugcuaagaagggaaugaacuuaaucaagagagacuuggggagacugacacaggaa

SEQ ID NO: 377175 - RNA, 63 nt, Homo Sapiens
ccccugugacgcccgggcugggggccagaucagaagagagaggcaggacgucuguucuuugug

SEQ ID NO: 377176 - RNA, 63 nt, Homo Sapiens
augauggacccuuuccuaaugagccuccucaauaagagagaaguucucauugugggaaucuga

SEQ ID NO: 377177 - RNA, 63 nt, Homo Sapiens
uauugaaaaucauuuacauuggccuauauuuggaagagagauagucuuuuguuuuuaauaagu

SEQ ID NO: 377178 - RNA, 63 nt, Homo Sapiens
auuaaucucauggaugguucucaaagguaaaaaaagagagagaaagagagagagcuagcugug

SEQ ID NO: 377179 - RNA, 63 nt, Homo Sapiens
uggaugguucucaaagguaaaaaaagagagagaaagagagagagcuagcugugggauucugug

SEQ ID NO: 377180 - RNA, 63 nt, Homo Sapiens
agagaaugcgauggauuuuauuacacaugguggaagagagaagaggcguguagguuugcaaac

SEQ ID NO: 377181 - RNA, 63 nt, Homo Sapiens
caugaaggccccuccccugggaucacuguguuuaagagagagugguuccugcuguuuauucuc

SEQ ID NO: 377182 - RNA, 63 nt, Homo Sapiens
uuccucaguggaaaaacuuaugaaacuucuuauaagagagaguaaucucaggccggacaugcu

SEQ ID NO: 377183 - RNA, 63 nt, Homo Sapiens
agagcaacacucugucuuaaaagaaaaaaaaaaaagagagagauaguaaucucuugggcaaaa

SEQ ID NO: 377184 - RNA, 63 nt, Homo Sapiens
aguucggggauauauuaagauauuuuuguacauaagagagaaagagagagaaaaauuuauaga

SEQ ID NO: 377185 - RNA, 63 nt, Homo Sapiens
gauauauuaagauauuuuuguacauaagagagaaagagagagaaaaauuuauagaaguuuugu

SEQ ID NO: 377186 - RNA, 63 nt, Homo Sapiens
gagagaaagagaacaauauuaaaaaaaaaaaaaaagagagagagagcaagacucugucucaga

SEQ ID NO: 377187 - RNA, 63 nt, Homo Sapiens
gccgggcgugguggcucacgaaaaaaaaaaagaaagagagagguccugucucucaaaaaaaaa

SEQ ID NO: 377188 - RNA, 63 nt, Homo Sapiens
aggagagagacaguagccaagagagagaggagaaagagagagaacauuuccuagagaaagaga

SEQ ID NO: 377189 - RNA, 63 nt, Homo Sapiens
gagaggagaaagagagagaacauuuccuagagaaagagagagagaggccugcuucacaacaga

SEQ ID NO: 377190 - RNA, 63 nt, Homo Sapiens
cagugagaccccuucucaaaaaaaaaaaaaaaaaagagagagugugugauuagaagcuaaaua

SEQ ID NO: 377191 - RNA, 63 nt, Homo Sapiens
gcaacaagagcgagacuccguuuccaaaaaaauaagagagaauagaagaagcuacugcaugau

SEQ ID NO: 377192 - RNA, 63 nt, Homo Sapiens
guuucacuccggagugagaagcuuugcccuccuaagagagagagacagagagacagagagaga

SEQ ID NO: 377193 - RNA, 63 nt, Homo Sapiens
uaagagagagagacagagagacagagagagagaaagagagagugugugggucuauguaaaugc

SEQ ID NO: 377194 - RNA, 63 nt, Homo Sapiens
ccugcgggacagagugagacccugucugaaagaaagagagaaagaaagaaagaaagagagaga

SEQ ID NO: 377195 - RNA, 63 nt, Homo Sapiens
ccugucugaaagaaagagagaaagaaagaaagaaagagagagaaagaaagaaagaaagaaagg

SEQ ID NO: 377196 - RNA, 63 nt, Homo Sapiens
aaagauggaaggaaggaaggaaaaagaaagagaaagagagagagagagaaagaaaaagaaaga

SEQ ID NO: 377197 - RNA, 63 nt, Homo Sapiens
caccauuuggaagcuugagagaaaccaaaauuaaagagagaaagagagagcgugcacgcuccu

SEQ ID NO: 377198 - RNA, 62 nt, Homo Sapiens
ggaagcuugagagaaaccaaaauuaaagagagaaagagagagcgugcacgcuccugcuuugu

SEQ ID NO: 377199 - RNA, 63 nt, Homo Sapiens
gcacaggcagccccacggacagagaaggggcccaagagagacaagagaaagagagagagagag

SEQ ID NO: 377200 - RNA, 63 nt, Homo Sapiens
gagagagagaaggggcccaaagagagagagagaaagagagagaccccuccccgggcagcagag

SEQ ID NO: 377201 - RNA, 63 nt, Homo Sapiens
aguugucagagugaagaguuaaaagaaaaacugaagagagaguaaaacuccaucuaaagaaga

SEQ ID NO: 377202 - RNA, 63 nt, Homo Sapiens
ccaggcgcgguggcucacacuguuuugaaauugaagagagagggagugaugaaaaauugaucu

SEQ ID NO: 377203 - RNA, 63 nt, Homo Sapiens
ucuccgggcccuuauuuauugagagaguuuaccaagagagaugccugggccuggccggaggaa

SEQ ID NO: 377204 - RNA, 63 nt, Homo Sapiens
uuaccaagagagaugucuccgccuggccggaggaagagagagucugguguggaccacaccugg

SEQ ID NO: 377205 - RNA, 63 nt, Homo Sapiens
gaaagaaagucuccagaccaaaagagagaaggaaagagagagagcaacauagaagagggaagg

SEQ ID NO: 377206 - RNA, 63 nt, Homo Sapiens
gaaagagagagagaaagaaagaagagggaaggaaagagagaagccuacccgcucagcaacaua

SEQ ID NO: 377207 - RNA, 64 nt, Homo Sapiens
acugugauuuuuagaagaacuguuguaaagccuuugagauuagacagacuagagcuacauuacu

SEQ ID NO: 377208 - RNA, 64 nt, Homo Sapiens
agauaaccuugugguuaaaagauaaggaaaaauaugagauuaugagaaauuaaauguauacuau

SEQ ID NO: 377209 - RNA, 64 nt, Homo Sapiens
aguugguuagcagggaagacccagaguuguagauugagauuaggguguacuggcugaacugugg

SEQ ID NO: 377210 - RNA, 64 nt, Homo Sapiens
guggaaaacauacaauucuguguuccucaguaaaugagauuagcgucuaaugaguagcaccccu

SEQ ID NO: 377211 - RNA, 64 nt, Homo Sapiens
caagugauucuccugccucauccucccaagaagcugagauuacagaugaccaccaccacuccug

SEQ ID NO: 377212 - RNA, 64 nt, Homo Sapiens
caggugauccaccugccucagccucccaaagugcugagauuacaggcaugagccaccacgccca

SEQ ID NO: 377213 - RNA, 64 nt, Homo Sapiens
caggcgauucuccugccucagcuucccgaguaacugagauuacaggcacccaccaccaugccca

SEQ ID NO: 377214 - RNA, 64 nt, Homo Sapiens
caggugaucuaccugccucagccucccaaagugcugagauuacagacaugagccuccgcgccuu

SEQ ID NO: 377215 - RNA, 64 nt, Homo Sapiens
uccauauuuuucaaacaucaugaacucuuucaauugagauuaagagcucugugguaagaaaaaa

SEQ ID NO: 377216 - RNA, 64 nt, Homo Sapiens
ccagagcauuaauuguaucaaaucgggaaggcugugagauuaauggccugguuuccuuuguacu

SEQ ID NO: 377217 - RNA, 64 nt, Homo Sapiens
agaacccuuuuuaggcuuuagggguagaggcuccugagauuaggggugcacccccaacuucaua

SEQ ID NO: 377218 - RNA, 64 nt, Homo Sapiens
agaacuccaaauagcccaagauuagauuagacaaugagauuaaggaaggggaggggugcuggag

SEQ ID NO: 377219 - RNA, 64 nt, Homo Sapiens
gaauccagaaucuuuuuucaucuugccagcaaggugagauuauguuucugcugaaaugguaguu

SEQ ID NO: 377220 - RNA, 64 nt, Homo Sapiens
aguacaccacaccaugcccggccucccaaggagcugagauuacgcaagugauucuccuaccuca

SEQ ID NO: 377221 - RNA, 64 nt, Homo Sapiens
uuaaaaaucaauuuaaaucaugacuaauaugguaaaaagauaaagcaucaaagcaguauuucuc

SEQ ID NO: 377222 - RNA, 64 nt, Homo Sapiens
uauauacauauauauauauauuuccuaaaagaagaaaagauaccuuucuguucaacuuguauca

SEQ ID NO: 377223 - RNA, 64 nt, Homo Sapiens
uuucugugggaaucacaagaguuuauccacuaaaaaaagauauguaaaaaagauacuuuccagc

SEQ ID NO: 377224 - RNA, 64 nt, Homo Sapiens
cacaagaguuuauccacuaaaaaaagauauguaaaaaagauacuuuccagcacauaaauaaagg

SEQ ID NO: 377225 - RNA, 64 nt, Homo Sapiens
ugaugucagaagaaauggcucgagcucagaagauaaaagauaaguaggguaugcugauccucuu

SEQ ID NO: 377226 - RNA, 64 nt, Homo Sapiens
uacaaaguggcauauauugcaauuuauuuuaauuaaaagauaccuauuuauauauuucuuuaua

SEQ ID NO: 377227 - RNA, 64 nt, Homo Sapiens
aggguuuauuccuggaaaguccagcaauguauaaaaaagauaauaaauaauuagcaaaucaaau

SEQ ID NO: 377228 - RNA, 64 nt, Homo Sapiens
uggaaaaaauugaauauauugcaaauuguuguucaaaagauaauggaaacuguaaauauauuuu

SEQ ID NO: 377229 - RNA, 64 nt, Homo Sapiens
auuuucuuuucuuaguccucggcaggucugcaguaaaagauaacaguaauggagucuuuuuuuu

SEQ ID NO: 377230 - RNA, 64 nt, Homo Sapiens
caagugucuuacaagcagcugacugauuggugauaaaagauagcucauggagguucaccuuugu

SEQ ID NO: 377231 - RNA, 64 nt, Homo Sapiens
aaaacauuuuuacugcugcuuaguuuuuggacugaaaagauauuaaaacucaagaaggaccaag

SEQ ID NO: 377232 - RNA, 64 nt, Homo Sapiens
gaaauagacuacuguacacgucuaccuagguucaaaaagauaacugucuugcuuucauggaaua

SEQ ID NO: 377233 - RNA, 64 nt, Homo Sapiens
gagaacugacugaacuugggaaauaauuugaacaaaaagauaaaucuucacagauaugaauacu

SEQ ID NO: 377234 - RNA, 64 nt, Homo Sapiens
agaugauacagguaagauuggaacucaugaagacaaaagauaagacaguggcauagaguuaaua

SEQ ID NO: 377235 - RNA, 64 nt, Homo Sapiens
aacuguuccauuuguuuauguaaagugauauuaaaaaagauauaaacuauaacuguccguuacu

SEQ ID NO: 377236 - RNA, 64 nt, Homo Sapiens
aagauauaaacuauaacuguccguuacuuuuggcaaaagauacaaccacauaauguauauaauu

SEQ ID NO: 377237 - RNA, 64 nt, Homo Sapiens
aguucaaaagucagaaaugauucuaauuuaaacaaaaagauacuaaauauacagaaguuaaauu

SEQ ID NO: 377238 - RNA, 64 nt, Homo Sapiens
auuugacauaggaugagagucagaguauagguuuaaaagauaaaaucuuuaguuaauaauuuug

SEQ ID NO: 377239 - RNA, 64 nt, Homo Sapiens
gggauugugaaaagagcauuaaaaaaagaaaagaaaaagauaaaagacucugucucaaaaaaaa

SEQ ID NO: 377240 - RNA, 64 nt, Homo Sapiens
ggggccgggugugguggcucuguuuucaggaaucaaaagauaaaaauacugaaguuaagugcau

SEQ ID NO: 377241 - RNA, 64 nt, Homo Sapiens
gcacgaugagauugccuacccaagucugagcacaaaaagauaauguagagacugaaugugaagu

SEQ ID NO: 377242 - RNA, 64 nt, Homo Sapiens
uuuuuacccaccauaaauguuaauauauuguuucaaaagauacauuucagcuaaaaauggaguc

SEQ ID NO: 377243 - RNA, 64 nt, Homo Sapiens
uauauaauugccuggccuuauuuacuaacuuguuaaaagauaucgccagaaaaguccccacuau

SEQ ID NO: 377244 - RNA, 64 nt, Homo Sapiens
ugaucugaguuucuaucacuccuccaacccacaaaaaagauauugcuugauuuguuaacuucua

SEQ ID NO: 377245 - RNA, 64 nt, Homo Sapiens
caaguaaauauuacaagaagauaaccuugugguuaaaagauaaggaaaaauaugagauuaugag

SEQ ID NO: 377246 - RNA, 64 nt, Homo Sapiens
aagagaauuauuauuaaggauugacuagaaccuuaaaagauauauguggauguuuguuuuguac

SEQ ID NO: 377247 - RNA, 64 nt, Homo Sapiens
cagcuuuagaauauggcgcaucuccaaaaaacaaaaaagauaagggggacagagcaagacucua

SEQ ID NO: 377248 - RNA, 64 nt, Homo Sapiens
cagcugacugggcacggugcaauucacuuuauuuaaaagauaaguaugaaguaucuguuuuuga

SEQ ID NO: 377249 - RNA, 64 nt, Homo Sapiens
uaugauaugaaaaaaucaccaauuuuuuacauauaaaagauaccuuuuuaaaaaaauagguuuu

SEQ ID NO: 377250 - RNA, 64 nt, Homo Sapiens
auuaaaucucuauuuccuaaauaucauucuauacaaaagauauuuuuuaaacgguaaggauuaa

SEQ ID NO: 377251 - RNA, 64 nt, Homo Sapiens
uuuuuuuucacguuagaagacaugaagaaauuuuaaaagauaaacaucuauauugugaaccauc

SEQ ID NO: 377252 - RNA, 64 nt, Homo Sapiens
aaagauaaacaucuauauugugaaccaucagcugaaaagauaaauuuguguucaauauauaggc

SEQ ID NO: 377253 - RNA, 64 nt, Homo Sapiens
uuuuugauauauuuaauuaucauuuucuaggcuuaaaagauauagaagguaauccaaaggcauc

SEQ ID NO: 377254 - RNA, 64 nt, Homo Sapiens
ggugucagaauaccagcauucucuuguucacaucaaaagauauucuaagacugauauuuuaggc

SEQ ID NO: 377255 - RNA, 64 nt, Homo Sapiens
auuuacucaaguagcauuuggcccaaagaaggcaaaaagauaagaggcauaggcagccuauagg

SEQ ID NO: 377256 - RNA, 64 nt, Homo Sapiens
gccuaaugugcaccugugagcaccaauagugccaaaaagauauugggacaagcaggcuuguuuc

SEQ ID NO: 377257 - RNA, 64 nt, Homo Sapiens
gaacccauccacucugggcagguaagagaaaagaaaaagauaaggaaagaagagagaagagaga

SEQ ID NO: 377258 - RNA, 64 nt, Homo Sapiens
uuuuucaaagaaaauuauucucaucucaaugccaaaaagauaguuucuacacaucaccugcuug

SEQ ID NO: 377259 - RNA, 64 nt, Homo Sapiens
auacuguauaauuccauuuacaugaagcauccagaaaagauaaauguauagggacaaaaaguag

SEQ ID NO: 377260 - RNA, 64 nt, Homo Sapiens
aucggcuuagaaacaugccucauuucuaggaaauaaaagauagaggugagagaugauuuacuuu

SEQ ID NO: 377261 - RNA, 64 nt, Homo Sapiens
uaauuuugauccugcccucuccagcugcuccuucaaaagauacaucaaaagauagaaacucugg

SEQ ID NO: 377262 - RNA, 64 nt, Homo Sapiens
ugcccucuccagcugcuccuucaaaagauacaucaaaagauagaaacucugggcugggcacagu

SEQ ID NO: 377263 - RNA, 64 nt, Homo Sapiens
gcgacaagagcaaaacuccgucucaaaaaaaaaaaaaagauacaaagucugcauuugauauaau

SEQ ID NO: 377264 - RNA, 64 nt, Homo Sapiens
ggugagagaugauuuacuuucauuucuaggaaauaaaagauagaaucggcuuagaaacaugccu

SEQ ID NO: 377265 - RNA, 64 nt, Homo Sapiens
uguauagggacaaaaaguagcaugaagcauccagaaaagauaaaauacuguauaauuccauuua

SEQ ID NO: 377266 - RNA, 64 nt, Homo Sapiens
ccaaaacuguaauacagauauauagaaaguggauaaaagauauagaucuuuaauaacacauccc

SEQ ID NO: 377267 - RNA, 64 nt, Homo Sapiens
ggaaguucaagggauguacccaagacuuuuucuaaaaagauaguaacacucugggaaugaggaa

SEQ ID NO: 377268 - RNA, 64 nt, Homo Sapiens
agauacuuuuaagacaacuuaaccuaaucuuuuuaaaagauagacuuuauucuaauguauccca

SEQ ID NO: 377269 - RNA, 64 nt, Homo Sapiens
ggagacuccaucucaaaaaaaaaaaaaaaaaaaaaaaagauaaaaagucagaaaucugaaaagu

SEQ ID NO: 377270 - RNA, 64 nt, Homo Sapiens
caagcuaagaaaaaauucuguuuauaaaagaaggaaaagauaguuuauguuuuuagccuaagua

SEQ ID NO: 377271 - RNA, 64 nt, Homo Sapiens
ugccugcggugaggaagcuggaggaaaaaaaaagaaaagauacgacacagcgagacuccgucuc

SEQ ID NO: 377272 - RNA, 64 nt, Homo Sapiens
ugccggggccaggugugguguggugucauuccuuaaaagauacguuuggucagaagccaggaac

SEQ ID NO: 377273 - RNA, 64 nt, Homo Sapiens
ccauauuuuaaaaguaccaauuuuguuuuuacagaaaagauaaaacucaaaagagaacagugua

SEQ ID NO: 377274 - RNA, 64 nt, Homo Sapiens
uaggcuuuugggcauaugcuagucugagcuuccgaaaagauacauauauguuucccuuuucauu

SEQ ID NO: 377275 - RNA, 64 nt, Homo Sapiens
ugaaauuucauuauaaaaucgaaaaaauauauuaaaaagauauuuauuauuauugucaucccaa

SEQ ID NO: 377276 - RNA, 64 nt, Homo Sapiens
uuaaaaauuuauuugaaaagugucaucccaagaaaaaagauauuuaucauguuaauacuauuau

SEQ ID NO: 377277 - RNA, 64 nt, Homo Sapiens
uuagaaucaauuuauaaaggagguuuugaaugccaaaagauauuaaaauguaaaaugcucauga

SEQ ID NO: 377278 - RNA, 64 nt, Homo Sapiens
cggagccuccagucugucaugggauggauguugcaaaagauaucaaaaugcauuuuggcauggu

SEQ ID NO: 377279 - RNA, 64 nt, Homo Sapiens
ucucucuuuuuaaaaucuuuauguggguaaauauaaaagauauuaaguucugaaaauggugaau

SEQ ID NO: 377280 - RNA, 64 nt, Homo Sapiens
acauacacaugaacaaagaaaacaccuugagaaaaaaagauaaugauaaacagaauacuuuuaa

SEQ ID NO: 377281 - RNA, 64 nt, Homo Sapiens
uuuaaggaugugcaaguacauuuacuuauauaaaaaaagauaacgugaauuuauuuguguguuc

SEQ ID NO: 377282 - RNA, 64 nt, Homo Sapiens
uauauuuugucuauuuuuguuuaauuucauuguaaaaagauauacaguauuccacaggcacacc

SEQ ID NO: 377283 - RNA, 64 nt, Homo Sapiens
uuaaacucuuuguaaaacuuuaguuacauuucacaaaagauauuucaggaaaacuauggggaaa

SEQ ID NO: 377284 - RNA, 64 nt, Homo Sapiens
acaaaacuuaagacuuaccucccuuaugaaaaagaaaagauagccaguguucuuccucuuuucu

SEQ ID NO: 377285 - RNA, 64 nt, Homo Sapiens
gggacggucuuuucuaaacuuuaacaugagacuuaaaagauauaauaagggaaaagauaagcag

SEQ ID NO: 377286 - RNA, 64 nt, Homo Sapiens
acuuuaacaugagacuuaaaagauauaauaagggaaaagauaagcagauuucgcaaccaaaaaa

SEQ ID NO: 377287 - RNA, 64 nt, Homo Sapiens
uaaaaaagacagcaaacuuuuuuuuuuauuuaaaaaaagauauauuaacaguuuuagaagucag

SEQ ID NO: 377288 - RNA, 64 nt, Homo Sapiens
uccuucaauuucuguauaaaagcagaucuuuuuaaaaagauacuucuguaacuuaagaaaccug

SEQ ID NO: 377289 - RNA, 64 nt, Homo Sapiens
auaugugaaagcaugugacuaauuguugcugcauaaaagauaugagauucuuuuuuauuaggca

SEQ ID NO: 377290 - RNA, 64 nt, Homo Sapiens
uuuuuauuaggcauuauuuaugaccuuuucuaugaaaagauaaggacauuaaaauguaagaugc

SEQ ID NO: 377291 - RNA, 64 nt, Homo Sapiens
gaagguagauaacuuuuaggaccuugaugugaggaaaagauaaaauuuaaacaauaaauuugcc

SEQ ID NO: 377292 - RNA, 64 nt, Homo Sapiens
auuugccacuuagauuuucuagcagcaaaguccgaaaagauaguuauauacaaaauucuguuuu

SEQ ID NO: 377293 - RNA, 64 nt, Homo Sapiens
cuucccuguacguauuggugaggcugaaaagcacaaaagauaguguggggauuaucuuggggag

SEQ ID NO: 377294 - RNA, 64 nt, Homo Sapiens
ccauccgugggguagaugcagucugauggaaagaaaaagauaaagccacauaaccuugcggcaa

SEQ ID NO: 377295 - RNA, 64 nt, Homo Sapiens
gccuggccaacauggugaaaccccgucuccacgaaaaagauaaaaauaagcugggcgugguggc

SEQ ID NO: 377296 - RNA, 64 nt, Homo Sapiens
uuucaaaaaaauaaaaauuggaagaagagcuuaaaaaagauaagauuuuaaagagucccaaguu

SEQ ID NO: 377297 - RNA, 64 nt, Homo Sapiens
ucuggauaggaacuacuugaaauaguaauuuguuaaaagauaugacaaaaugaaaaugcuuaaa

SEQ ID NO: 377298 - RNA, 64 nt, Homo Sapiens
agaaauaaugccgcauuuuucccccauuguaccaaaaagauaaaaaaaugguaaacacugauca

SEQ ID NO: 377299 - RNA, 64 nt, Homo Sapiens
cuuucaucuggauucuacaaaaaaccaggaugcccaccguuaggauucaggcagcagugucugu

SEQ ID NO: 377300 - RNA, 64 nt, Homo Sapiens
acagcaaaucauauaaaucgaauuaaauggacaacaccguuagauguguauguaaaaauuuucu

SEQ ID NO: 377301 - RNA, 64 nt, Homo Sapiens
agcugguacuuuggugauuuguguacucuuauaacaccguuauuuuuuucauuuucaguuaaca

SEQ ID NO: 377302 - RNA, 64 nt, Homo Sapiens
ugcuuucccuuagcaacccucauauaccucccugcaccguuacgcugugauggcaacuggggau

SEQ ID NO: 377303 - RNA, 64 nt, Homo Sapiens
uuuaaggaaaagugaagagcagugugcugucacacaccguuaagccagagguucugacuucgcu

SEQ ID NO: 377304 - RNA, 64 nt, Homo Sapiens
gaugacuuuaaucuugaaugauaaaguccugcugcaccguuagaugcugauacuggacuucucc

SEQ ID NO: 377305 - RNA, 64 nt, Homo Sapiens
uggauacccuuacccuuuccuccuuuaucacaaccaccguuacaaguauacuuauauuucccua

SEQ ID NO: 377306 - RNA, 64 nt, Homo Sapiens
agugccuaggaauguucaagagcaacaaccuaagcaccguuaucgcugaucuuucaguguuucc

SEQ ID NO: 377307 - RNA, 64 nt, Homo Sapiens
ucagcugaaucuguguuucagccucaguugguugcaccguuagccccucuccucccggaugguc

SEQ ID NO: 377308 - RNA, 64 nt, Homo Sapiens
ucccuugaaagcgagggugacaaaaacaacaaaacaccguuauaaacacaucaaagguucauuc

SEQ ID NO: 377309 - RNA, 64 nt, Homo Sapiens
caguguaacagaaagagaauguagccauucuagccaccguuaaaagauacacagugagguguug

SEQ ID NO: 377310 - RNA, 64 nt, Homo Sapiens
uuucuugucaccuugagguccccucgccccgucacaccguuaugcauuacucugugucuacuau

SEQ ID NO: 377311 - RNA, 64 nt, Homo Sapiens
gcguacuuucuguauuuaaaaauggccccucaagcaccguuaauuuacauuccaguuauuuaca

SEQ ID NO: 377312 - RNA, 64 nt, Homo Sapiens
gaacaaauucaugagcauauuuucucuuucuccccaccguuaauuugggaguugccguuuuggg

SEQ ID NO: 377313 - RNA, 64 nt, Homo Sapiens
augaugcgugaaucccgagggagccgguggcauacaccguuagcuuaaccuuagcuuaaacuag

SEQ ID NO: 377314 - RNA, 64 nt, Homo Sapiens
cggcccagacucuucuguguggcgccgccgaagccaccguuagcgcgagcugcuccguucgccc

SEQ ID NO: 377315 - RNA, 64 nt, Homo Sapiens
guacacagcagcauccugcaugccaaaguagcuucaccguuaguaaucccucacuuuaauaccu

SEQ ID NO: 377316 - RNA, 64 nt, Homo Sapiens
caagaaccugguuagaggcauaaagaccuuuuuucaccguuaccuaauuuuuuccccuuucaag

SEQ ID NO: 377317 - RNA, 64 nt, Homo Sapiens
cauauuuucacuacagcaaacuaauuuugcacggcaccguuaacagaacuacuuuucaacaaau

SEQ ID NO: 377318 - RNA, 64 nt, Homo Sapiens
guaagcuugcaggccucagcucuguccccucagacaccguuacugggcuccccccuccccuguu

SEQ ID NO: 377319 - RNA, 64 nt, Homo Sapiens
caugcuuuuucaacacauuauggagaacaaaggacaccguuaccucuucccuucaucacauacu

SEQ ID NO: 377320 - RNA, 64 nt, Homo Sapiens
uuuuaauacccauuuauuggaggauuggauuuagcaccguuaacuuuuucuaaauaauuuggaa

SEQ ID NO: 377321 - RNA, 64 nt, Homo Sapiens
cuggaaacugaggcagacacggcugaggccauugcaccguuauccagcagccagcaccuggccu

SEQ ID NO: 377322 - RNA, 64 nt, Homo Sapiens
agcaguaugcuuacagguuugcuuaguuuggggacaccguuaccaccagaauggcugcucugac

SEQ ID NO: 377323 - RNA, 64 nt, Homo Sapiens
ccuacuucauuaagccuuccuggggugcgguacacaccguuaauucagcaacccucaguacaua

SEQ ID NO: 377324 - RNA, 64 nt, Homo Sapiens
ugcggagcacacuggcucacccaguccugcccgccaccguuaucggugucauucaccuuucgug

SEQ ID NO: 377325 - RNA, 64 nt, Homo Sapiens
cacucuuucucugcuguugcaaauacauggauaacaccguuaauuccauguguuuucauaauaa

SEQ ID NO: 377326 - RNA, 64 nt, Homo Sapiens
gaaugaguuccauggaggggcauaugugugauuccaccguuagaugagcccuuggggcaggcag

SEQ ID NO: 377327 - RNA, 64 nt, Homo Sapiens
gugguaacucauuuugauuguuauaacaucucagcaccguuauucccauuuuaaugaugaggaa

SEQ ID NO: 377328 - RNA, 64 nt, Homo Sapiens
aagugccaucuuuaagggggaaacuacaugaagucaccguuacaguaacuugauguguauauua

SEQ ID NO: 377329 - RNA, 64 nt, Homo Sapiens
gguugucaccuggacagggggcagccguggaggccaccguuaccaacugaagcugggggccugg

SEQ ID NO: 377330 - RNA, 64 nt, Homo Sapiens
cccaggagauccuggacugcacuccugagacucccaccguuacccgggcgucuccccccgugcc

SEQ ID NO: 377331 - RNA, 64 nt, Homo Sapiens
ccugcacacggcacagagcaacugccuggccuggcaccguuaucaaacacacgcgugauuggua

SEQ ID NO: 377332 - RNA, 64 nt, Homo Sapiens
guacaaacugcaccaagcccuggagacccauuaccaccguuaacccucaauacagcucugcuag

SEQ ID NO: 377333 - RNA, 64 nt, Homo Sapiens; identical to SEQ ID NO: 200816

SEQ ID NO: 377334 - RNA, 64 nt, Homo Sapiens; identical to SEQ ID NO: 200817

SEQ ID NO: 377335 - RNA, 64 nt, Homo Sapiens; identical to SEQ ID NO: 200818

SEQ ID NO: 377336 - RNA, 64 nt, Homo Sapiens; identical to SEQ ID NO: 200819

SEQ ID NO: 377337 - RNA, 64 nt, Homo Sapiens; identical to SEQ ID NO: 200820

SEQ ID NO: 377338 - RNA, 64 nt, Homo Sapiens; identical to SEQ ID NO: 200821

SEQ ID NO: 377339 - RNA, 64 nt, Homo Sapiens; identical to SEQ ID NO: 200822

SEQ ID NO: 377340 - RNA, 64 nt, Homo Sapiens; identical to SEQ ID NO: 200823

SEQ ID NO: 377341 - RNA, 64 nt, Homo Sapiens; identical to SEQ ID NO: 200824

SEQ ID NO: 377342 - RNA, 64 nt, Homo Sapiens; identical to SEQ ID NO: 200825

SEQ ID NO: 377343 - RNA, 64 nt, Homo Sapiens; identical to SEQ ID NO: 200826

SEQ ID NO: 377344 - RNA, 64 nt, Homo Sapiens; identical to SEQ ID NO: 200827

SEQ ID NO: 377345 - RNA, 64 nt, Homo Sapiens
gagacagagggucgucccaaagugccgccagugguccaaggagguauaaagcagguccaaggaa

SEQ ID NO: 377346 - RNA, 64 nt, Homo Sapiens
gugccgccagugguccaagggauuauaaagcagguccaaggaaaacaaggcaggacaugauaaa

SEQ ID NO: 377347 - RNA, 64 nt, Homo Sapiens
uucuauguguuuggaagacaacucugcuugcucauccaaggauuaaaucuggucagcaggugga

SEQ ID NO: 377348 - RNA, 64 nt, Homo Sapiens
uuuugcucuuucagaacaaacauuaaauggugccuccaaggaaacuuugccaaauauaaucuca

SEQ ID NO: 377349 - RNA, 64 nt, Homo Sapiens
ucuuuuaacuuuaauuuccauuuacuuagaaguauccaaggaagcccuuccauuaucauuuacu

SEQ ID NO: 377350 - RNA, 64 nt, Homo Sapiens
caaagagucaaacuguggacugcuuccguugcuuuccaaggaaaauauucaaacccaagcuaag

SEQ ID NO: 377351 - RNA, 64 nt, Homo Sapiens
ucagugucuuuuacguuguucugcacuuuguuuuuccaaggaaagugacuccuuuauauucgua

SEQ ID NO: 377352 - RNA, 64 nt, Homo Sapiens
agucgugucugaccuacauuaaagucuuccccaguccaaggagccuauggacugacaaccaagg

SEQ ID NO: 377353 - RNA, 64 nt, Homo Sapiens
caggagagacugaauuaauauucauuauguuucuuccaaggaaacuuuaguaaguucuucucau

SEQ ID NO: 377354 - RNA, 64 nt, Homo Sapiens
cugcggagacucuggccaagugagugcuuggcuuuccaaggauaccagagcaaucuagaaucuu

SEQ ID NO: 377355 - RNA, 64 nt, Homo Sapiens
aguguucuuuguguauuucuauaaauauuuaaauuccaaggagacaccuucuaacaaaaaauaa

SEQ ID NO: 377356 - RNA, 64 nt, Homo Sapiens
aaguccugguguggguuguuugguuuuucauacauccaaggaaggagaucagaaccaugcuucc

SEQ ID NO: 377357 - RNA, 64 nt, Homo Sapiens
auacagaccaacuaggcuacugacaccguugucauccaaggauaguacccuagauagugucaca

SEQ ID NO: 377358 - RNA, 64 nt, Homo Sapiens
agggcugggaagucuuuaguucaaguauaguaccuccaaggacccugcuaaacuuggcacagua

SEQ ID NO: 377359 - RNA, 64 nt, Homo Sapiens
uuuggaugaccagaacaagguucccucugagaauuccaaggaguuccaugaagaccacauccac

SEQ ID NO: 377360 - RNA, 64 nt, Homo Sapiens
acaguguuugcaaugguguugcccugaguggaucuccaaggaccagguuauuuuaaaaagauuu

SEQ ID NO: 377361 - RNA, 64 nt, Homo Sapiens
uguuuuugcuaucacacagugggugguggaucuguccaaggaaacuugaaucaaagcaguuaac

SEQ ID NO: 377362 - RNA, 64 nt, Homo Sapiens
cgcauagcucgagguccucugcccaccucuucucuccaaggaaaaugaggacugccccuucccc

SEQ ID NO: 377363 - RNA, 64 nt, Homo Sapiens
cuggccacaacccacugcucugaugggugguuuguccaaggaugcugaauguaaugccugguca

SEQ ID NO: 377364 - RNA, 64 nt, Homo Sapiens
gggauagggagaugugccagaguccuuccuccccuccaaggacagguaguaggugccagccuag

SEQ ID NO: 377365 - RNA, 64 nt, Homo Sapiens
aaggacagguaguaggugccagccuaggggagcuuccaaggaggggaaggcaaagcccuggccc

SEQ ID NO: 377366 - RNA, 64 nt, Homo Sapiens
guguccugguccauguggugcacgugucuccaccuccaaggagaggcuccucagugugcaccuc

SEQ ID NO: 377367 - RNA, 64 nt, Homo Sapiens
cuuguccaccgcuucacuggcaagagucccaggcuccaaggacacccucccugcacaugauugg

SEQ ID NO: 377368 - RNA, 64 nt, Homo Sapiens
cugaagcugccucccuucacccugggacugugguuccaaggaugagagcagggguuggagccau

SEQ ID NO: 377369 - RNA, 64 nt, Homo Sapiens
ccauggccuucugggaaccuauggagaaagggaauccaaggaagcagccaaggcugcucgcagc

SEQ ID NO: 377370 - RNA, 64 nt, Homo Sapiens
ggggucuacgugaccuuuagccugccacguucucuccaaggaguggauucgauugcucaguuca

SEQ ID NO: 377371 - RNA, 64 nt, Homo Sapiens
aacucuacagagcaucuuuuagcucacacgaaucuccaaggaaaaucagcuuugacuggaccuc

SEQ ID NO: 377372 - RNA, 64 nt, Homo Sapiens
aggguucaguccacguuguguuuucacaccuuucuccaaggaucgaaccaaagaugugucucca

SEQ ID NO: 377373 - RNA, 64 nt, Homo Sapiens
ccaccucuguggccaccucagauagucaucucaguccaaggaucccaaaacacaaaucuagaau

SEQ ID NO: 377374 - RNA, 59 nt, Homo Sapiens
acaguucaaugcaaaggugauuagaaacuuccaaggaugacccaaccuuugccuuugcc

SEQ ID NO: 377375 - RNA, 64 nt, Homo Sapiens
uggauaguguuuacaaaaguacaaaaguacuacuuccaaggaaaaugcucugauucucuguuua

SEQ ID NO: 377376 - RNA, 64 nt, Homo Sapiens
aucaaaauucugguuguauuuagcaggcaugcaguccaaggaaugcuguucuuuaaucuuccuc

SEQ ID NO: 377377 - RNA, 64 nt, Homo Sapiens
aucaaaauucugauuguauguagcaggcaugcaguccaaggaaugcugcucuuuaauuuuccuc

SEQ ID NO: 377378 - RNA, 64 nt, Homo Sapiens; identical to SEQ ID NO: 49894

SEQ ID NO: 377379 - RNA, 64 nt, Homo Sapiens; identical to SEQ ID NO: 49895

SEQ ID NO: 377380 - RNA, 64 nt, Homo Sapiens; identical to SEQ ID NO: 49896

SEQ ID NO: 377381 - RNA, 64 nt, Homo Sapiens; identical to SEQ ID NO: 49897

SEQ ID NO: 377382 - RNA, 64 nt, Homo Sapiens; identical to SEQ ID NO: 49898

SEQ ID NO: 377383 - RNA, 64 nt, Homo Sapiens; identical to SEQ ID NO: 49899

SEQ ID NO: 377384 - RNA, 64 nt, Homo Sapiens; identical to SEQ ID NO: 49900

SEQ ID NO: 377385 - RNA, 64 nt, Homo Sapiens; identical to SEQ ID NO: 49901

SEQ ID NO: 377386 - RNA, 64 nt, Homo Sapiens; identical to SEQ ID NO: 49902

SEQ ID NO: 377387 - RNA, 64 nt, Homo Sapiens; identical to SEQ ID NO: 49903

SEQ ID NO: 377388 - RNA, 64 nt, Homo Sapiens; identical to SEQ ID NO: 49904

SEQ ID NO: 377389 - RNA, 64 nt, Homo Sapiens; identical to SEQ ID NO: 49905

SEQ ID NO: 377390 - RNA, 64 nt, Homo Sapiens; identical to SEQ ID NO: 49906

SEQ ID NO: 377391 - RNA, 64 nt, Homo Sapiens; identical to SEQ ID NO: 49907

SEQ ID NO: 377392 - RNA, 64 nt, Homo Sapiens; identical to SEQ ID NO: 49908

SEQ ID NO: 377393 - RNA, 64 nt, Homo Sapiens; identical to SEQ ID NO: 49909

SEQ ID NO: 377394 - RNA, 64 nt, Homo Sapiens; identical to SEQ ID NO: 49910

SEQ ID NO: 377395 - RNA, 64 nt, Homo Sapiens; identical to SEQ ID NO: 49911

SEQ ID NO: 377396 - RNA, 64 nt, Homo Sapiens; identical to SEQ ID NO: 49912

SEQ ID NO: 377397 - RNA, 64 nt, Homo Sapiens; identical to SEQ ID NO: 49913

SEQ ID NO: 377398 - RNA, 64 nt, Homo Sapiens; identical to SEQ ID NO: 49914

SEQ ID NO: 377399 - RNA, 64 nt, Homo Sapiens; identical to SEQ ID NO: 49915

SEQ ID NO: 377400 - RNA, 64 nt, Homo Sapiens; identical to SEQ ID NO: 49916

SEQ ID NO: 377401 - RNA, 64 nt, Homo Sapiens; identical to SEQ ID NO: 49917

SEQ ID NO: 377402 - RNA, 64 nt, Homo Sapiens; identical to SEQ ID NO: 49918

SEQ ID NO: 377403 - RNA, 64 nt, Homo Sapiens; identical to SEQ ID NO: 49919

SEQ ID NO: 377404 - RNA, 64 nt, Homo Sapiens; identical to SEQ ID NO: 49920

SEQ ID NO: 377405 - RNA, 64 nt, Homo Sapiens; identical to SEQ ID NO: 49921

SEQ ID NO: 377406 - RNA, 52 nt, Homo Sapiens; identical to SEQ ID NO: 49922

SEQ ID NO: 377407 - RNA, 64 nt, Homo Sapiens; identical to SEQ ID NO: 49923

SEQ ID NO: 377408 - RNA, 64 nt, Homo Sapiens; identical to SEQ ID NO: 49924

SEQ ID NO: 377409 - RNA, 64 nt, Homo Sapiens; identical to SEQ ID NO: 49925

SEQ ID NO: 377410 - RNA, 64 nt, Homo Sapiens; identical to SEQ ID NO: 49926

SEQ ID NO: 377411 - RNA, 64 nt, Homo Sapiens; identical to SEQ ID NO: 49927

SEQ ID NO: 377412 - RNA, 64 nt, Homo Sapiens; identical to SEQ ID NO: 49928

SEQ ID NO: 377413 - RNA, 64 nt, Homo Sapiens; identical to SEQ ID NO: 49929

SEQ ID NO: 377414 - RNA, 64 nt, Homo Sapiens; identical to SEQ ID NO: 49930

SEQ ID NO: 377415 - RNA, 64 nt, Homo Sapiens; identical to SEQ ID NO: 49931

SEQ ID NO: 377416 - RNA, 64 nt, Homo Sapiens; identical to SEQ ID NO: 49932

SEQ ID NO: 377417 - RNA, 64 nt, Homo Sapiens; identical to SEQ ID NO: 49933

SEQ ID NO: 377418 - RNA, 64 nt, Homo Sapiens; identical to SEQ ID NO: 49934

SEQ ID NO: 377419 - RNA, 64 nt, Homo Sapiens; identical to SEQ ID NO: 298084

SEQ ID NO: 377420 - RNA, 64 nt, Homo Sapiens; identical to SEQ ID NO: 298085

SEQ ID NO: 377421 - RNA, 64 nt, Homo Sapiens; identical to SEQ ID NO: 298086

SEQ ID NO: 377422 - RNA, 64 nt, Homo Sapiens; identical to SEQ ID NO: 298087

SEQ ID NO: 377423 - RNA, 64 nt, Homo Sapiens; identical to SEQ ID NO: 298088

SEQ ID NO: 377424 - RNA, 64 nt, Homo Sapiens; identical to SEQ ID NO: 298089

SEQ ID NO: 377425 - RNA, 64 nt, Homo Sapiens
gugggaauaaaggucacauauaggacucguuuauuugggacaugguccaccuucuaggaaaucc

SEQ ID NO: 377426 - RNA, 64 nt, Homo Sapiens
uuuucugaacauucuaagcaaccagaagagagcuuugggacauuauucugauugucuuguaugg

SEQ ID NO: 377427 - RNA, 64 nt, Homo Sapiens
agaggagccggcaggcgaagcuaccaaaaggcccuugggacaucuugcuaaaugaugcuaacug

SEQ ID NO: 377428 - RNA, 64 nt, Homo Sapiens
cugcuaguaucuauuuuacagagcuguacacaucuugggacaauccucgcugggcugugagaau

SEQ ID NO: 377429 - RNA, 64 nt, Homo Sapiens
ccuuugccuugagacuucugugucuccuucccauuugggacacccaggugagggcccagacauc

SEQ ID NO: 377430 - RNA, 64 nt, Homo Sapiens
ugggaucuuucuguugauucgucuuuucuggagauugggacagagcaucugugguccagggaag

SEQ ID NO: 377431 - RNA, 64 nt, Homo Sapiens
auagaugaaauucacaccccugcagaucagaaaaaacaaauagaagaaaaugaggguuacagua

SEQ ID NO: 377432 - RNA, 64 nt, Homo Sapiens
aauauuucaguuggguaucuuuuuaaguaaaaacaacaaauaaacucuguacauguaaaacgug

SEQ ID NO: 377433 - RNA, 64 nt, Homo Sapiens
uuuuagguggggguggcagguguauuucuuuuuuaacaaauaaaaggcauuuaaguaaaacuaa

SEQ ID NO: 377434 - RNA, 64 nt, Homo Sapiens
acuaacauuuuccccuucuguaguuguaugaaaaaacaaauauuguuagcauaguagauaaauu

SEQ ID NO: 377435 - RNA, 64 nt, Homo Sapiens
aauugauggucagagccagcacuggaauuuugaaaacaaauaaggugauuaucuauuuuaggua

SEQ ID NO: 377436 - RNA, 64 nt, Homo Sapiens
ugaauaauuauggaaguugggacauguuaaggaaaacaaauauguucaucaccaacaaucagcu

SEQ ID NO: 377437 - RNA, 64 nt, Homo Sapiens
uucuucugguuuaauuuuaauuuucuauuuucaaaacaaauauuuacuucauuugccaaucaga

SEQ ID NO: 377438 - RNA, 64 nt, Homo Sapiens
guccuauaauuuucagcuuaauuauaaacaaaggaacaaauaaguggaagggcagcuauuacca

SEQ ID NO: 377439 - RNA, 64 nt, Homo Sapiens
accuuuuuaagucauagaccaaagucugcuguagaacaaauaugggaggacaaagaaucgcaaa

SEQ ID NO: 377440 - RNA, 64 nt, Homo Sapiens
uaacuauuuggagggucuuuaacauugccaaaaaaacaaauauguugauuuuuauuuuauuuua

SEQ ID NO: 377441 - RNA, 64 nt, Homo Sapiens
uauuuugaagacucaaugaaaauacugauuccaaaacaaauaaaucuuugacucuuuaaauucc

SEQ ID NO: 377442 - RNA, 64 nt, Homo Sapiens
gcuaaaccuuacugugaauugcacagcuuuugguaacaaauaucaaaacacuuaacuugcaugu

SEQ ID NO: 377443 - RNA, 64 nt, Homo Sapiens
gucaguaaaacuccuaccaagaaacaucugagcaaacaaauacacagugggggacaccacuaaa

SEQ ID NO: 377444 - RNA, 64 nt, Homo Sapiens
aaaauauucagcaguggggguaaauuucuacaaaaacaaauaauaaucuuuuaaauucucuucc

SEQ ID NO: 377445 - RNA, 64 nt, Homo Sapiens
aaaauccaaaguauuaauuaaucagcaucaaaagaacaaauaguuuaagcagaacagccauuaa

SEQ ID NO: 377446 - RNA, 64 nt, Homo Sapiens
uuacuaucacucaggauuaugcaaacaauacagcaacaaauaauaaaugcaaaauaaaauauug

SEQ ID NO: 377447 - RNA, 64 nt, Homo Sapiens
acaaauguaaauauguuuaccuuaaaggcucaauaacaaauacacuguucauucugggccuaac

SEQ ID NO: 377448 - RNA, 64 nt, Homo Sapiens
aaaggugcauaauuuauuuauaaucccaaaaacuaacaaauaacuaaaaugugauuggcuuagg

SEQ ID NO: 377449 - RNA, 64 nt, Homo Sapiens
caaaaagaugcacuuaguauuaaguugaaacuugaacaaauagauggucacauugcugaacaua

SEQ ID NO: 377450 - RNA, 64 nt, Homo Sapiens
ggcuuaaugaauuuauggcagguuuuuauauaauaacaaauaaauuaaaggaaaauuaccaaau

SEQ ID NO: 377451 - RNA, 64 nt, Homo Sapiens
uacuugaauauguuuguagaacauaauaacccaaaacaaauaauauauauaauuauuucauguu

SEQ ID NO: 377452 - RNA, 64 nt, Homo Sapiens
uuuggccgggcacgguggcugauaaauaagcuuaaacaaauaacuuguggcugaugguguugaa

SEQ ID NO: 377453 - RNA, 64 nt, Homo Sapiens
ccuuagaaagucuucugcaacuuuuaaacaauaaaacaaauacccaaaguuauuaccacauaau

SEQ ID NO: 377454 - RNA, 64 nt, Homo Sapiens
aaugucgauaauaaaacauuaaaucuucagcaugaacaaauauuuugcccauuacuucaucccu

SEQ ID NO: 377455 - RNA, 64 nt, Homo Sapiens
uguaaaguauuauuuauuugaaucuacaaaaaacaacaaauaauuuuuaaauauaaggauuuuc

SEQ ID NO: 377456 - RNA, 64 nt, Homo Sapiens
uggguacccaguuaaauuuucauuucagauaaacaacaaauaauuuuuuaguauaaguacauua

SEQ ID NO: 377457 - RNA, 64 nt, Homo Sapiens
uuuguucacauaaccacuuuuacugauaguggauaacaaauauaucaaaauauuuuucagccuc

SEQ ID NO: 377458 - RNA, 64 nt, Homo Sapiens
cuuuacuaaaauaaaaacucuguuuuuaaauauaaacaaauauuaugcagaaugucuuuuuaaa

SEQ ID NO: 377459 - RNA, 64 nt, Homo Sapiens
aaauaaauaaauaaaagcauacuauaguuguaaaaacaaauaauuuuaauaguauauucagugg

SEQ ID NO: 377460 - RNA, 64 nt, Homo Sapiens
ggaagaaaacagacaaaagacauguaacaacagaaacaaauaaaccacuuacuguaaaauuuca

SEQ ID NO: 377461 - RNA, 64 nt, Homo Sapiens
cuuuuccauaaguggccuuuuaaagcucauacaaaacaaauagggaccugguuaaauacugucu

SEQ ID NO: 377462 - RNA, 64 nt, Homo Sapiens
ccagcauucaugauagcauuuucuguuggcucauaacaaauauaaguuuauauuaaagguaauu

SEQ ID NO: 377463 - RNA, 64 nt, Homo Sapiens
caguuugguuggguaaaucuguuguguacauuucaacaaauacuuuuacauuugacauuacuga

SEQ ID NO: 377464 - RNA, 64 nt, Homo Sapiens
ugugugcaugcacucaggugcccuuuguuucaugaacaaauacauuucauuguacauguuuucu

SEQ ID NO: 377465 - RNA, 64 nt, Homo Sapiens
ucaauuaaguacacuuuauuaaaguuuaugucugaacaaauaagacagaucacaggggccuuac

SEQ ID NO: 377466 - RNA, 64 nt, Homo Sapiens
uaaauauuuuaagaaaaauuuucauuguaaaaugaacaaauacaugcucauaaucacuugcaau

SEQ ID NO: 377467 - RNA, 64 nt, Homo Sapiens
ugaaauaaaaaacauguuaaaguucauuugcagaaacaaauaacguagguacauggauacauca

SEQ ID NO: 377468 - RNA, 64 nt, Homo Sapiens
gguucuuguacccagagugacaaauaauaauuggaacaaauaaacacagguucuaaauuuaaaa

SEQ ID NO: 377469 - RNA, 64 nt, Homo Sapiens
aauuggaacaaauaaagguugguucuaaauuuaaaacaaauaaugguauuuuagacccaacaca

SEQ ID NO: 377470 - RNA, 64 nt, Homo Sapiens
ucuaguuuuuccaccaucagcugaaaguuuuugaaacaaauauuugaaaaccagguauccacac

SEQ ID NO: 377471 - RNA, 64 nt, Homo Sapiens
uuguucaguuuuaacuauuuuuaauuaucuucuuaacaaauaagaaguugcuuuaaacauuaac

SEQ ID NO: 377472 - RNA, 64 nt, Homo Sapiens
uuaggcuuugauuggcacuuuuugaaaaauaugcaacaaauaugggauguaauccggauggccg

SEQ ID NO: 377473 - RNA, 64 nt, Homo Sapiens
cggacaguaguuucaguucugaugguauaagcaaaacaaauaaaacguuuauaaaaguuguauc

SEQ ID NO: 377474 - RNA, 64 nt, Homo Sapiens
aaguuuuuuuucaaucauuguaccuugauauuaaaacaaauauccuuuaaguauuucuaaucag

SEQ ID NO: 377475 - RNA, 64 nt, Homo Sapiens
uggacacacuaucaccuauuacauuuuacugauuaacaaauaaauuggaauuuaaaaauaucga

SEQ ID NO: 377476 - RNA, 64 nt, Homo Sapiens
cucacuuuucccuacuuccucugcaaaaagauuuaacaaauacauucauaaggaaauguguguu

SEQ ID NO: 377477 - RNA, 64 nt, Homo Sapiens
uuaacaaauacauucauaaggaaauguguguuguaacaaauauauugcaaaaacauaguuugua

SEQ ID NO: 377478 - RNA, 64 nt, Homo Sapiens
uaaacaagagugauagagagcugcaggcugcuacaacaaauaccauagacagguugguuuauaa

SEQ ID NO: 377479 - RNA, 64 nt, Homo Sapiens
uacacagaaaugauauaugcugcuuuuaucauauaacaaauauuuucccacuauuacagccuga

SEQ ID NO: 377480 - RNA, 64 nt, Homo Sapiens
aacaaaaaccucuugcuuuuagggguucuuacccaacaaauaaccuguuugaacucucuuauau

SEQ ID NO: 377481 - RNA, 64 nt, Homo Sapiens
uuuauuuuuauugguuccugaagacgggacaaggaacaaauacauacguuaauaugagagauca

SEQ ID NO: 377482 - RNA, 64 nt, Homo Sapiens
cgucuuuauuaauccaucauucuuuucuucauucaacaaauauguauugaacaccuccuauaug

SEQ ID NO: 377483 - RNA, 64 nt, Homo Sapiens
guuuacuucugguggaggagacagaugauaaguaaacaaauaaauaauguaguuugagauagug

SEQ ID NO: 377484 - RNA, 64 nt, Homo Sapiens
ugccauuauucuauguagugguuuuaggauacuuaacaaauacauucaaauucuuuuuuuauua

SEQ ID NO: 377485 - RNA, 64 nt, Homo Sapiens
auuuguggcuuucugcaucacccaaucaauaaaaaacaaauauauauauguauauauauguaug

SEQ ID NO: 377486 - RNA, 64 nt, Homo Sapiens
auacaugugaauucuacugcuuuaagagaaauaaaacaaauaagccuagggaaauauuagaguc

SEQ ID NO: 377487 - RNA, 64 nt, Homo Sapiens
aauuaaaggugccagaucaaaauaguaauaaaucaacaaauaauuuuugauugacugguggaau

SEQ ID NO: 377488 - RNA, 64 nt, Homo Sapiens
cuuuguuccucaaaccccaucugucagaccacugaacaaauacacauacuaggccucaagugug

SEQ ID NO: 377489 - RNA, 64 nt, Homo Sapiens
aaagagcugauaacaguacucagaagaaucugugaacaaauacuugaaaauggguucaauguag

SEQ ID NO: 377490 - RNA, 64 nt, Homo Sapiens
cauuuaaacaacaggaaaugugucccuaaauggaaacaaauauaaucccacaaaaccaacaauu

SEQ ID NO: 377491 - RNA, 64 nt, Homo Sapiens
aucuuaccccuuuaugccaccuacugaaaagaaaaacaaauagcuagguuugguuuccuguuuu

SEQ ID NO: 377492 - RNA, 64 nt, Homo Sapiens
caaauaagaauugaauugugcuuguccagauaugaacaaauauguagugaguauagaguuuacc

SEQ ID NO: 377493 - RNA, 64 nt, Homo Sapiens
auauguagugaguauagaguuuaccaauaaucauaacaaauauuaaagauuuccuuggagucag

SEQ ID NO: 377494 - RNA, 64 nt, Homo Sapiens
aguaacccugucccaaucacauuuaagaaaauuuaacaaauacgccaaggcucagccagucucu

SEQ ID NO: 377495 - RNA, 64 nt, Homo Sapiens
ccgucuggugucacagagccccuucaguauugugaacaaauagacuguagcuaauucuagaugc

SEQ ID NO: 377496 - RNA, 64 nt, Homo Sapiens
aaagauuuccuuggagucaauuaucaauaaucauaacaaauauuauauguagugaguauagagu

SEQ ID NO: 377497 - RNA, 64 nt, Homo Sapiens
uagugaguauagaguuuauccuuguccagauaugaacaaauaugcaaauaagaauucaauugug

SEQ ID NO: 377498 - RNA, 64 nt, Homo Sapiens
aaagauuuccuuggagucaguuuaccauaaucauaacaaauauuaauauguagugaguauagag

SEQ ID NO: 377499 - RNA, 64 nt, Homo Sapiens
uagugaguauagaguuuacccuuguccagauaugaacaaauaugcaaauaagaauucaauugug

SEQ ID NO: 377500 - RNA, 64 nt, Homo Sapiens
uaaauuuuaaaauuauucuuuuguaaauuuaguuaacaaauacaaaauuaacaucagguauauu

SEQ ID NO: 377501 - RNA, 64 nt, Homo Sapiens
auccuucauuacucaucacaaauauguaacccagaacaaauaacauuaguuuacauaggaauga

SEQ ID NO: 377502 - RNA, 64 nt, Homo Sapiens
uuauaaaugugaacuuaaacugaacuuauccuaaaacaaauaguaaauagucucuauuuguaau

SEQ ID NO: 377503 - RNA, 64 nt, Homo Sapiens
caaaagguucacuaaagcagacaugccugccccaaacaaauaugcugggccacaagugaaguca

SEQ ID NO: 377504 - RNA, 64 nt, Homo Sapiens
ccugccuuuuacaggugaaaaaauuaaaauuaaaaacaaauaauagacugucucaaaaaaauua

SEQ ID NO: 377505 - RNA, 64 nt, Homo Sapiens
ccugccuuuggccgggugcgacugcaacccgcuuaacaaauaaugguggggggucugguagaac

SEQ ID NO: 377506 - RNA, 64 nt, Homo Sapiens
gugcauuuuaacaguaauauuaagcaauggagguaacaaauauucauguuuuuaucacucaaag

SEQ ID NO: 377507 - RNA, 64 nt, Homo Sapiens
gucgggacauauauuuacauuuuaacauuaguguaacaaauaagcauauggcacuaauuuugau

SEQ ID NO: 377508 - RNA, 64 nt, Homo Sapiens
aucuuagcugauaaaucuaauugguaauuuauagaacaaauauuugauaagcuccuauuaauug

SEQ ID NO: 377509 - RNA, 64 nt, Homo Sapiens
uuuuaacauaccucgaguccaacuaaucucauuaaacaaauauucuccaugggccugucuagua

SEQ ID NO: 377510 - RNA, 64 nt, Homo Sapiens; identical to SEQ ID NO: 169004

SEQ ID NO: 377511 - RNA, 64 nt, Homo Sapiens; identical to SEQ ID NO: 169005

SEQ ID NO: 377512 - RNA, 64 nt, Homo Sapiens; identical to SEQ ID NO: 169006

SEQ ID NO: 377513 - RNA, 64 nt, Homo Sapiens; identical to SEQ ID NO: 169007

SEQ ID NO: 377514 - RNA, 64 nt, Homo Sapiens; identical to SEQ ID NO: 169008

SEQ ID NO: 377515 - RNA, 64 nt, Homo Sapiens; identical to SEQ ID NO: 169009

SEQ ID NO: 377516 - RNA, 64 nt, Homo Sapiens; identical to SEQ ID NO: 169010

SEQ ID NO: 377517 - RNA, 64 nt, Homo Sapiens; identical to SEQ ID NO: 169011

SEQ ID NO: 377518 - RNA, 64 nt, Homo Sapiens; identical to SEQ ID NO: 169012

SEQ ID NO: 377519 - RNA, 64 nt, Homo Sapiens; identical to SEQ ID NO: 169013

SEQ ID NO: 377520 - RNA, 64 nt, Homo Sapiens; identical to SEQ ID NO: 169014

SEQ ID NO: 377521 - RNA, 64 nt, Homo Sapiens; identical to SEQ ID NO: 169015

SEQ ID NO: 377522 - RNA, 64 nt, Homo Sapiens; identical to SEQ ID NO: 169016

SEQ ID NO: 377523 - RNA, 64 nt, Homo Sapiens; identical to SEQ ID NO: 169017

SEQ ID NO: 377524 - RNA, 64 nt, Homo Sapiens; identical to SEQ ID NO: 169018

SEQ ID NO: 377525 - RNA, 64 nt, Homo Sapiens; identical to SEQ ID NO: 169019

SEQ ID NO: 377526 - RNA, 64 nt, Homo Sapiens; identical to SEQ ID NO: 169020

SEQ ID NO: 377527 - RNA, 64 nt, Homo Sapiens; identical to SEQ ID NO: 169021

SEQ ID NO: 377528 - RNA, 64 nt, Homo Sapiens; identical to SEQ ID NO: 169022

SEQ ID NO: 377529 - RNA, 64 nt, Homo Sapiens; identical to SEQ ID NO: 169023

SEQ ID NO: 377530 - RNA, 64 nt, Homo Sapiens; identical to SEQ ID NO: 169024

SEQ ID NO: 377531 - RNA, 64 nt, Homo Sapiens; identical to SEQ ID NO: 169025

SEQ ID NO: 377532 - RNA, 64 nt, Homo Sapiens; identical to SEQ ID NO: 169026

SEQ ID NO: 377533 - RNA, 64 nt, Homo Sapiens; identical to SEQ ID NO: 169027

SEQ ID NO: 377534 - RNA, 64 nt, Homo Sapiens; identical to SEQ ID NO: 169028

SEQ ID NO: 377535 - RNA, 64 nt, Homo Sapiens; identical to SEQ ID NO: 169029

SEQ ID NO: 377536 - RNA, 64 nt, Homo Sapiens; identical to SEQ ID NO: 169030

SEQ ID NO: 377537 - RNA, 64 nt, Homo Sapiens; identical to SEQ ID NO: 169031

SEQ ID NO: 377538 - RNA, 64 nt, Homo Sapiens; identical to SEQ ID NO: 169032

SEQ ID NO: 377539 - RNA, 64 nt, Homo Sapiens; identical to SEQ ID NO: 169033

SEQ ID NO: 377540 - RNA, 64 nt, Homo Sapiens; identical to SEQ ID NO: 169034

SEQ ID NO: 377541 - RNA, 64 nt, Homo Sapiens; identical to SEQ ID NO: 169035

SEQ ID NO: 377542 - RNA, 64 nt, Homo Sapiens; identical to SEQ ID NO: 169036

SEQ ID NO: 377543 - RNA, 64 nt, Homo Sapiens; identical to SEQ ID NO: 169037

SEQ ID NO: 377544 - RNA, 64 nt, Homo Sapiens; identical to SEQ ID NO: 169038

SEQ ID NO: 377545 - RNA, 64 nt, Homo Sapiens; identical to SEQ ID NO: 169039

SEQ ID NO: 377546 - RNA, 64 nt, Homo Sapiens; identical to SEQ ID NO: 169040

SEQ ID NO: 377547 - RNA, 59 nt, Homo Sapiens; identical to SEQ ID NO: 169041

SEQ ID NO: 377548 - RNA, 64 nt, Homo Sapiens; identical to SEQ ID NO: 169042

SEQ ID NO: 377549 - RNA, 64 nt, Homo Sapiens; identical to SEQ ID NO: 169043

SEQ ID NO: 377550 - RNA, 64 nt, Homo Sapiens; identical to SEQ ID NO: 169044

SEQ ID NO: 377551 - RNA, 64 nt, Homo Sapiens; identical to SEQ ID NO: 169045

SEQ ID NO: 377552 - RNA, 64 nt, Homo Sapiens; identical to SEQ ID NO: 169046

SEQ ID NO: 377553 - RNA, 64 nt, Homo Sapiens; identical to SEQ ID NO: 169047

SEQ ID NO: 377554 - RNA, 64 nt, Homo Sapiens; identical to SEQ ID NO: 169048

SEQ ID NO: 377555 - RNA, 64 nt, Homo Sapiens; identical to SEQ ID NO: 169049

SEQ ID NO: 377556 - RNA, 64 nt, Homo Sapiens; identical to SEQ ID NO: 169050

SEQ ID NO: 377557 - RNA, 64 nt, Homo Sapiens; identical to SEQ ID NO: 169051

SEQ ID NO: 377558 - RNA, 64 nt, Homo Sapiens; identical to SEQ ID NO: 169052

SEQ ID NO: 377559 - RNA, 64 nt, Homo Sapiens; identical to SEQ ID NO: 169053

SEQ ID NO: 377560 - RNA, 64 nt, Homo Sapiens; identical to SEQ ID NO: 169054

SEQ ID NO: 377561 - RNA, 64 nt, Homo Sapiens; identical to SEQ ID NO: 169055

SEQ ID NO: 377562 - RNA, 64 nt, Homo Sapiens; identical to SEQ ID NO: 169056

SEQ ID NO: 377563 - RNA, 64 nt, Homo Sapiens; identical to SEQ ID NO: 169057

SEQ ID NO: 377564 - RNA, 64 nt, Homo Sapiens; identical to SEQ ID NO: 169058

SEQ ID NO: 377565 - RNA, 64 nt, Homo Sapiens; identical to SEQ ID NO: 169059

SEQ ID NO: 377566 - RNA, 64 nt, Homo Sapiens; identical to SEQ ID NO: 169060

SEQ ID NO: 377567 - RNA, 64 nt, Homo Sapiens; identical to SEQ ID NO: 169061

SEQ ID NO: 377568 - RNA, 64 nt, Homo Sapiens; identical to SEQ ID NO: 169062

SEQ ID NO: 377569 - RNA, 64 nt, Homo Sapiens; identical to SEQ ID NO: 169063

SEQ ID NO: 377570 - RNA, 64 nt, Homo Sapiens; identical to SEQ ID NO: 169064

SEQ ID NO: 377571 - RNA, 64 nt, Homo Sapiens; identical to SEQ ID NO: 169065

SEQ ID NO: 377572 - RNA, 64 nt, Homo Sapiens; identical to SEQ ID NO: 169066

SEQ ID NO: 377573 - RNA, 64 nt, Homo Sapiens; identical to SEQ ID NO: 169067

SEQ ID NO: 377574 - RNA, 64 nt, Homo Sapiens; identical to SEQ ID NO: 169068

SEQ ID NO: 377575 - RNA, 64 nt, Homo Sapiens; identical to SEQ ID NO: 169069

SEQ ID NO: 377576 - RNA, 64 nt, Homo Sapiens; identical to SEQ ID NO: 169070

SEQ ID NO: 377577 - RNA, 64 nt, Homo Sapiens; identical to SEQ ID NO: 169071

SEQ ID NO: 377578 - RNA, 64 nt, Homo Sapiens; identical to SEQ ID NO: 169072

SEQ ID NO: 377579 - RNA, 64 nt, Homo Sapiens; identical to SEQ ID NO: 169073

SEQ ID NO: 377580 - RNA, 64 nt, Homo Sapiens; identical to SEQ ID NO: 169074

SEQ ID NO: 377581 - RNA, 64 nt, Homo Sapiens; identical to SEQ ID NO: 169075

SEQ ID NO: 377582 - RNA, 64 nt, Homo Sapiens; identical to SEQ ID NO: 169076

SEQ ID NO: 377583 - RNA, 64 nt, Homo Sapiens; identical to SEQ ID NO: 169077

SEQ ID NO: 377584 - RNA, 64 nt, Homo Sapiens; identical to SEQ ID NO: 169078

SEQ ID NO: 377585 - RNA, 64 nt, Homo Sapiens; identical to SEQ ID NO: 169079

SEQ ID NO: 377586 - RNA, 64 nt, Homo Sapiens; identical to SEQ ID NO: 169080

SEQ ID NO: 377587 - RNA, 64 nt, Homo Sapiens; identical to SEQ ID NO: 169081

SEQ ID NO: 377588 - RNA, 64 nt, Homo Sapiens; identical to SEQ ID NO: 169082

SEQ ID NO: 377589 - RNA, 64 nt, Homo Sapiens; identical to SEQ ID NO: 169083

SEQ ID NO: 377590 - RNA, 64 nt, Homo Sapiens; identical to SEQ ID NO: 169084

SEQ ID NO: 377591 - RNA, 64 nt, Homo Sapiens; identical to SEQ ID NO: 169085

SEQ ID NO: 377592 - RNA, 64 nt, Homo Sapiens; identical to SEQ ID NO: 169086

SEQ ID NO: 377593 - RNA, 64 nt, Homo Sapiens; identical to SEQ ID NO: 169087

SEQ ID NO: 377594 - RNA, 64 nt, Homo Sapiens; identical to SEQ ID NO: 169088

SEQ ID NO: 377595 - RNA, 64 nt, Homo Sapiens
caucugcuuuacucuggaccauaggaaacaagaccguuuggagguuucaucaggauuuuggguu

SEQ ID NO: 377596 - RNA, 64 nt, Homo Sapiens
ccaugucucggagaaacgggugagcugagcuuggcguuuggacccaguucagugagguucuugg

SEQ ID NO: 377597 - RNA, 64 nt, Homo Sapiens
uaugaagugcaauuagauagauguagguuccugccguuuggagagaaugacuagcauuuaucuu

SEQ ID NO: 377598 - RNA, 64 nt, Homo Sapiens
ggaugggccggcuccuuauuuuccugggcugagccguuuggagggagggugggcacagcugggc

SEQ ID NO: 377599 - RNA, 64 nt, Homo Sapiens
gcagguucugugggacccccguguucagcagcagcguuuggaaaugguguucauuucaaggcca

SEQ ID NO: 377600 - RNA, 64 nt, Homo Sapiens
auccugugaggagccccaucugguuccuuuccaacguuuggaagguuuuggugaaaauuagggu

SEQ ID NO: 377601 - RNA, 64 nt, Homo Sapiens
acuaacaccaucaucuaaauuuacuuauuaaagacguuuggaaaauuuuacauugcuccuuuau

SEQ ID NO: 377602 - RNA, 64 nt, Homo Sapiens
aaaccuagucauuaaugagugugucagcaggggccguuuggaacgccacacaaaaggaucaugu

SEQ ID NO: 377603 - RNA, 64 nt, Homo Sapiens
acuugaucaaugagcuuuuaaucuaacacacugacguuuggaaaauuuuucuuuuuguguuuga

SEQ ID NO: 377604 - RNA, 64 nt, Homo Sapiens
aauuuuuuaaaugagugcuuuaacuuaaaacaggcguuuggaauagcugcugcaauguagucuu

SEQ ID NO: 377605 - RNA, 64 nt, Homo Sapiens
ccgguggugcgguaaccugcguggcuccugauagcguuuggaagaacgcgggggagacugaaga

SEQ ID NO: 377606 - RNA, 64 nt, Homo Sapiens
uaagggauucuccguuuugguuccauuuuguacacguuuggaaaauaaucugcagaaacgagcu

SEQ ID NO: 377607 - RNA, 64 nt, Homo Sapiens
uuugcguggauuuuuuuuuuuuuaaggaaaaauacguuuggaaaauaaacuguuauggugauaa

SEQ ID NO: 377608 - RNA, 64 nt, Homo Sapiens
aaucuaaaaguuuaaagcucuuccccccuagaaacguuuggaacgcuaugggagcagcuuuuuu

SEQ ID NO: 377609 - RNA, 64 nt, Homo Sapiens
ugcugcccccuuucuuccugauaauaaaugcaaucguuuggagcuagggucuguacacuuguuu

SEQ ID NO: 377610 - RNA, 64 nt, Homo Sapiens
gaauauuaaaaagagaaaaaagcaacacuggucacguuuggaaacaguuacuugagugucacuc

SEQ ID NO: 377611 - RNA, 64 nt, Homo Sapiens
gacuccaugccuucucucucaaccacuuacuuagcguuuggauaagccagucuguaaaauaacc

SEQ ID NO: 377612 - RNA, 64 nt, Homo Sapiens
ggggugguuugggagugcacagcugaacgcuucccguuuggauuuuacacucaccuucguguuu

SEQ ID NO: 377613 - RNA, 64 nt, Homo Sapiens
gcuuuucucagcuuggcccuuccccgggugaggccguuuggaauuaacauggccaguguuucac

SEQ ID NO: 377614 - RNA, 64 nt, Homo Sapiens
aggucuguggugcaguguguuggggucggagaggcguuuggagagcagcugggugcagaagcug

SEQ ID NO: 377615 - RNA, 64 nt, Homo Sapiens
gggaagggaaagacuggggaaccaccccaagugccguuuggaugcaccacagagcuccagacca

SEQ ID NO: 377616 - RNA, 64 nt, Homo Sapiens
auuacauacauaaauagccacaugaaguuuuagacguuuggacuugaagccucaaagaucaacc

SEQ ID NO: 377617 - RNA, 64 nt, Homo Sapiens
ugggacuauuuacgguuguuaccuaaauccacuccguuuggauguuuuuccuugaaaaagugaa

SEQ ID NO: 377618 - RNA, 64 nt, Homo Sapiens
ggaagacgucaaauguguagugacuagauuagagcguuuggagucgaagagcugugcucuuuuc

SEQ ID NO: 377619 - RNA, 64 nt, Homo Sapiens
auuuugcuggcuauaaaauauuguuuucuuaaugcguuuggaccuggcagagcuaaguuaucuu

SEQ ID NO: 377620 - RNA, 64 nt, Homo Sapiens
ugcuguuuuguuucguuucugugaucucccggcacguuuggagcugggaagaccacacuggugg

SEQ ID NO: 377621 - RNA, 64 nt, Homo Sapiens
uguuuccugcagcauuagguuguaucuucauacacguuuggaaaaauuagcucugccaccaaua

SEQ ID NO: 377622 - RNA, 64 nt, Homo Sapiens
guuuuauauagauguaucuuuuaaaaauaguucacguuuggagaauucuuuuguacucauuugc

SEQ ID NO: 377623 - RNA, 64 nt, Homo Sapiens
ugugacacaucguuuuggggaauuacaaaaggcucguuuggaucuucuucuguaggcuuugaca

SEQ ID NO: 377624 - RNA, 64 nt, Homo Sapiens
uagaaauucuuaaaaccagauuuuucuuucauuccguuuggaugucuacauuccuuaucaaagg

SEQ ID NO: 377625 - RNA, 64 nt, Homo Sapiens
ggcuuuuuaauggaaaccaagccaauguuauagacguuuggacugauuuguggaaaggaggggg

SEQ ID NO: 377626 - RNA, 64 nt, Homo Sapiens
uaaaugcagauaaccaucauucacgucacaaaaacguuuggagcaaccugggcuugucuccacu

SEQ ID NO: 377627 - RNA, 64 nt, Homo Sapiens
guauagcucuagagcauggcugucuagcggcuaccguuuggacaauuaaauuuagguagccacg

SEQ ID NO: 377628 - RNA, 64 nt, Homo Sapiens
uugauauauacauggcaaauagguauacuaccagcguuuggauacuagcaggagacaacugcac

SEQ ID NO: 377629 - RNA, 64 nt, Homo Sapiens
uuaugguaaaauuugccugauuucuuacaggcagcguuuggaaaccuuuuauuauauaguuguu

SEQ ID NO: 377630 - RNA, 64 nt, Homo Sapiens
uguuuuccuguuuuuccuuacagagucaauccuucguuuggaauuauuuuuguuguaagccuau

SEQ ID NO: 377631 - RNA, 64 nt, Homo Sapiens
uauuguuuuuauuccacacuccagccuggggcugcguuuggauugggcuucauggaaaacaggc

SEQ ID NO: 377632 - RNA, 64 nt, Homo Sapiens
cuacuggguuauaauuaaaucaugugauauuccacguuuggauaugcucauuuaauuucuacag

SEQ ID NO: 377633 - RNA, 64 nt, Homo Sapiens
aggcuggggaggcccgaagucaaaaagugaccuucguuuggauauucuugugacaguggaauua

SEQ ID NO: 377634 - RNA, 64 nt, Homo Sapiens
gcacgguauucuaaaccagcagagcacuuguuaacguuuggaggcacaguuucacccagggcga

SEQ ID NO: 377635 - RNA, 64 nt, Homo Sapiens
uucaacuugguuucguaucuguuccacgaguguacguuuggauuuuccugguguuuguguucca

SEQ ID NO: 377636 - RNA, 64 nt, Homo Sapiens
aagauauuuuuucuuuccugaacaguuuuuaagucguuuggaacuuccuuuuuacacuccuuaa

SEQ ID NO: 377637 - RNA, 64 nt, Homo Sapiens
cuuucaagcuucccuuuggaauauacaagacaugcguuuggaguuaccuuuguuuuucuaucgu

SEQ ID NO: 377638 - RNA, 64 nt, Homo Sapiens
ccggagaggccagaggguuggagcugcagggacccguuuggacccacagccucuguucuagaga

SEQ ID NO: 377639 - RNA, 64 nt, Homo Sapiens
ccccugggcucucacccagugucucugccgccugcguuuggaggcagagccaagcacugcucac

SEQ ID NO: 377640 - RNA, 64 nt, Homo Sapiens
agcauaguaacuccuuucagauuuuuuggagggacguuuggaaguggcuuacucucuucugccc

SEQ ID NO: 377641 - RNA, 64 nt, Homo Sapiens
gccccugaaccuaaaaaaaaaguuaaaagaaaaacguuuggauuauuuucccucuuucgaacaa

SEQ ID NO: 377642 - RNA, 64 nt, Homo Sapiens
caugaaguucuauaccucagccagcagcugccuucguuuggaacugaaguccagccagcagacu

SEQ ID NO: 377643 - RNA, 64 nt, Homo Sapiens
cucuccugcauuugccacuggauuugcacugcaucguuuggagauacaaagcgagcaguucuug

SEQ ID NO: 377644 - RNA, 64 nt, Homo Sapiens
gaaaucuuguaauaaaacuguuggccugaucuugcguuuggaaacgucagagucgcugagcuug

SEQ ID NO: 377645 - RNA, 64 nt, Homo Sapiens
uuugggggaggggagcacugguugauuuuguuuccguuuggauucugccguaauuuaaagcucu

SEQ ID NO: 377646 - RNA, 64 nt, Homo Sapiens
uaggacucugcagggcugccuucugcgccuucugcguuuggacacggcccucccccugcucugc

SEQ ID NO: 377647 - RNA, 64 nt, Homo Sapiens
gguguuugaggcguuugccagcugggacaaacugcguuuggagcugugguuaagcugacuaagg

SEQ ID NO: 377648 - RNA, 64 nt, Homo Sapiens
auauuugccucaaggauugucuauauaugagaaacguuuggauacaaugaugagcaauagaaau

SEQ ID NO: 377649 - RNA, 64 nt, Homo Sapiens
ugucugaagauggggggcucagggggcacguuugcguuuggaccugucugugcguucuccugcg

SEQ ID NO: 377650 - RNA, 64 nt, Homo Sapiens
accaguuugacccugguuugaauaaagagaagugcguuuggauuagaaaccacuuuguguccgu

SEQ ID NO: 377651 - RNA, 64 nt, Homo Sapiens
agaaauauccugucccuggauggaaacuaggucucguuuggauuuuuuuuuuuuuuugccgugu

SEQ ID NO: 377652 - RNA, 64 nt, Homo Sapiens
ggaauaaaggucagagaaggucagagcugagugacguuuggaauccaccccguuuauuguagaa

SEQ ID NO: 377653 - RNA, 64 nt, Homo Sapiens
uucaaaacuucugucuucgucaccuagacccccacguuuggagaccccccacccccgcccgguc

SEQ ID NO: 377654 - RNA, 64 nt, Homo Sapiens
gugcagccuuucguuuuaccaaauucuuugcugucguuuggaaaaaaugggccaugugguggag

SEQ ID NO: 377655 - RNA, 64 nt, Homo Sapiens
gacugcaggcacgcaaaauaaaauaacuccugcucguuuggaauguaacuccuggcacaguguu

SEQ ID NO: 377656 - RNA, 64 nt, Homo Sapiens
acguaucaccuuucccagauggaagccaggaaagcguuuggaaauuguuguuuuacaucuuuug

SEQ ID NO: 377657 - RNA, 64 nt, Homo Sapiens
uccagagaccggagaacugugcagggccuaaggccguuuggaugaauugucaaaacaagaugcu

SEQ ID NO: 377658 - RNA, 64 nt, Homo Sapiens
ggcgguuucugguaguugugugacuccuuugagccguuuggaggccgucuuggcuuauccacuu

SEQ ID NO: 377659 - RNA, 64 nt, Homo Sapiens
acgcuguagacaccguuccuagcggggccguggccguuuggagcuuaaacuuugaucuguaagg

SEQ ID NO: 377660 - RNA, 64 nt, Homo Sapiens
cacuuaauuuacaaauuguguucuagauuaccuacguuuggaaauuggaaaaguacauuccaag

SEQ ID NO: 377661 - RNA, 64 nt, Homo Sapiens
uguucuuugauauuacaguugagccuauuuuagccguuuggaagaucacuuuaauagugaccuu

SEQ ID NO: 377662 - RNA, 64 nt, Homo Sapiens
ucugcuauacccuaugcaugcgguuaacuacacacguuuggaagauccuuagagucuauugaaa

SEQ ID NO: 377663 - RNA, 64 nt, Homo Sapiens
ccaagcagcagaugcaggugcugacccaugagaccguuuggagaccaggaagcaggcaacuggc

SEQ ID NO: 377664 - RNA, 64 nt, Homo Sapiens; identical to SEQ ID NO: 155381

SEQ ID NO: 377665 - RNA, 64 nt, Homo Sapiens; identical to SEQ ID NO: 155382

SEQ ID NO: 377666 - RNA, 64 nt, Homo Sapiens
ggagauacugcaauaaaaugcaucagagcaugauaucuauaauauaauuaccaaaacucuccug

SEQ ID NO: 377667 - RNA, 64 nt, Homo Sapiens
uuuuaugugaggacuuuguaagaggguugauuaaaucuauaagugacacaaaagacaguggcaa

SEQ ID NO: 377668 - RNA, 64 nt, Homo Sapiens
uuuaccuucauaugcagagaaaaacuguagcacaaucuauaauuucaaugcaaacaguacauua

SEQ ID NO: 377669 - RNA, 64 nt, Homo Sapiens
cuuguuuuaaaaauacauauugggcaucacaauuaucuauaaauugucauacuggcuuccaaag

SEQ ID NO: 377670 - RNA, 64 nt, Homo Sapiens
cagauagaagaagaggugguugcugcucauguagaucuauaaauauguguuguaugucuuuuuu

SEQ ID NO: 377671 - RNA, 64 nt, Homo Sapiens
ugauaaaaggagaagacaacagugagcuuagaauaucuauaaagcaaaaaauguagucucuugu

SEQ ID NO: 377672 - RNA, 64 nt, Homo Sapiens
ugaauguucaacaacaaugaacaaaaaauuaaauaucuauaaaggauauuuucacaaauuuuaa

SEQ ID NO: 377673 - RNA, 64 nt, Homo Sapiens
uaauucaagagaaugcuuuuauuuuuauacuaaaaucuauaauugagcucccuccgaagagaaa

SEQ ID NO: 377674 - RNA, 64 nt, Homo Sapiens
ucuugcauuucacuugaguggagguuuauaguuaaucuauaacuacauauugaauagggcuagg

SEQ ID NO: 377675 - RNA, 64 nt, Homo Sapiens
uagaaagcaagauguacuauaacauagaauugcaaucuauaauauuuguguguucacuaaacuc

SEQ ID NO: 377676 - RNA, 64 nt, Homo Sapiens
gaaaauauauaccguggggguaguuuuacccuauaucuauaaacacuguuuguuccagaaucug

SEQ ID NO: 377677 - RNA, 64 nt, Homo Sapiens
guguuuaaaaagcaacuuggaaauuuacacauuagcauuguacuuucuagcccuaauuugugag

SEQ ID NO: 377678 - RNA, 64 nt, Homo Sapiens
uaugcaagacuguguagaguuuuuuuuuuuuuuggcauuguacuuuuuguuuuuguuauaaagg

SEQ ID NO: 377679 - RNA, 64 nt, Homo Sapiens
ucuguuugcauuugauacauuuuuguacuaacuagcauuguaaaauuauuucaugauuagaaau

SEQ ID NO: 377680 - RNA, 64 nt, Homo Sapiens
uuuuuuauaaaaguguucauuguuucguaacacagcauuguauaugugaagcaaacucuaaaau

SEQ ID NO: 377681 - RNA, 64 nt, Homo Sapiens
acaguauuuuagggugcauccaguauaccauugagcauuguaaccucaggaaacaguuuauuuu

SEQ ID NO: 377682 - RNA, 64 nt, Homo Sapiens
uguaacaauuguauaucuuacaauauuuuuccuugcauuguaauuuuuaaguauuuaucauuuu

SEQ ID NO: 377683 - RNA, 64 nt, Homo Sapiens
uuauauacucaguuuuauaaagcuaucaagggcugcauuguauuuggcguuuauaaagauucuu

SEQ ID NO: 377684 - RNA, 64 nt, Homo Sapiens
cacauauuuucacuuuaacuauacagaaacaucagcauuguauaugugucuuaguauauaguga

SEQ ID NO: 377685 - RNA, 64 nt, Homo Sapiens
auaaucaguaugguuuauauaggaggauuuuucugcauuguaaaaaacuggcauauagaaaaaa

SEQ ID NO: 377686 - RNA, 64 nt, Homo Sapiens
caaaguugcagugaaggcauuuucaaaauucaaagcauuguauuucaaacauuuuauucaagug

SEQ ID NO: 377687 - RNA, 64 nt, Homo Sapiens
aaaaaaccuaaaagcaguauccuaaaguuuagaugcauuguauaggcagcacuuaaauuucgaa

SEQ ID NO: 377688 - RNA, 64 nt, Homo Sapiens
uaaucaucacaaugaucaaaaacguaaauagauagcauuguaaauaucaggauuauuuauugcu

SEQ ID NO: 377689 - RNA, 64 nt, Homo Sapiens
cuuauauaaaaauaaguagaaugaauauuuuguugcauuguauucaucacuguuugugcaauau

SEQ ID NO: 377690 - RNA, 64 nt, Homo Sapiens
agauauuauaagaaaucuaggaagugauguguaggcauuguauuuauguugaauucauguaaau

SEQ ID NO: 377691 - RNA, 64 nt, Homo Sapiens
uguugcaugcauuuuuaaaaaaaucaucucauaugcauuguauaguuugggggaauaagauauc

SEQ ID NO: 377692 - RNA, 64 nt, Homo Sapiens
gaauccacaaugacuuugaaguuguuggagcaaugcauuguauucagaaaaccugugucacauu

SEQ ID NO: 377693 - RNA, 64 nt, Homo Sapiens
auucaguauguuuuacacuguuuacuuccccuauggaauuuauagaguuguuguggguucuaug

SEQ ID NO: 377694 - RNA, 64 nt, Homo Sapiens
agcaguccauuucuaccaaguuguuuauuuugugggaauuuaaguuguuucuuuaucaccuggc

SEQ ID NO: 377695 - RNA, 64 nt, Homo Sapiens
uauucuccuucugucaaagucagaacaaauucagggaauuuauuuucuggcaguugugcuccag

SEQ ID NO: 377696 - RNA, 64 nt, Homo Sapiens
ucaugcagguuagaaauaaugucaaaaauauuuaggaauuuaauaaccuuuaagucagaaacua

SEQ ID NO: 377697 - RNA, 64 nt, Homo Sapiens
gcugcagagcaguagugguuaaaaauaagauauuggaauuuauuaaaagauuuuuguucaauac

SEQ ID NO: 377698 - RNA, 64 nt, Homo Sapiens
aauaguguaucaguucuuuuguuuuguuaaaguuggaauuuauucuguugccagcauuuaagua

SEQ ID NO: 377699 - RNA, 64 nt, Homo Sapiens
uuuaauuaucuuuacaauuacaccgcgcccagccggaauuuauucugggauuacaggcgugagc

SEQ ID NO: 377700 - RNA, 64 nt, Homo Sapiens
uauuuauuuauuuauuuauuaaauuaauuugcuuggaauuuauuuuuaggaguuacagauguuc

SEQ ID NO: 377701 - RNA, 64 nt, Homo Sapiens
aagacacaaaauuauuuuuuggagagguacucuaggaauuuaaaacuuaaauugugauugaagu

SEQ ID NO: 377702 - RNA, 64 nt, Homo Sapiens
uuuacuuuucaauauuuucaccauucagcuuuguggaauuuauguuaagaaauauuuuuugcug

SEQ ID NO: 377703 - RNA, 64 nt, Homo Sapiens
uaauugauaagcauuuuuaaucuguguaaacacaggaauuuaaauaggaauuuacuauuuuuuu

SEQ ID NO: 377704 - RNA, 64 nt, Homo Sapiens
auuuuuaaucuguguaaacacaggaauuuaaauaggaauuuacuauuuuuuuauaaagcuuuug

SEQ ID NO: 377705 - RNA, 64 nt, Homo Sapiens
aaaauauuacuggaauuaaauuauauuuuuaacaggaauuuaaguuugcugacuuuaauauuga

SEQ ID NO: 377706 - RNA, 64 nt, Homo Sapiens
cguaagccaugaucauaaugaguguuugucauauggaauuuaauaaugacggcugcuauauaua

SEQ ID NO: 377707 - RNA, 64 nt, Homo Sapiens
augcaguugugcuauguucuuguccauuaagcauggaauuuaccaggugcuuuauucccucgaa

SEQ ID NO: 377708 - RNA, 64 nt, Homo Sapiens
gucauguaaauaguugagcuauguuuugaguuuuggaauuuauuuuuacaguuguaaauguuuu

SEQ ID NO: 377709 - RNA, 64 nt, Homo Sapiens
uuuuauuagaagagaaacaaauuccaugcuuuauggaauuuauguagacuggagucuucgugaa

SEQ ID NO: 377710 - RNA, 64 nt, Homo Sapiens
gauuacauggugucuaaccaaaugagcaggcuuaggaauuuagaugagauguguaagauucacu

SEQ ID NO: 377711 - RNA, 64 nt, Homo Sapiens
acuuuauguccugcucucuaugugauauauaugaggaauuuacuuuuuagguuaauuuucuugc

SEQ ID NO: 377712 - RNA, 64 nt, Homo Sapiens
ggcuuaaacauuacgacugagagaacauacagaaggaauuuagguacacacuauuuuggaauua

SEQ ID NO: 377713 - RNA, 64 nt, Homo Sapiens
gguggaccuauagaauccaguacuuuuaauggugggaauuuacaguagaagcauccuuugcuga

SEQ ID NO: 377714 - RNA, 64 nt, Homo Sapiens
uuucuuacaauaaauguugagucuuaguuaagcaggaauuuaugaacacccauuuccugacuuu

SEQ ID NO: 377715 - RNA, 64 nt, Homo Sapiens
aaaugaauaaagcugcugugacacacacacaaaaggaauuuaauaguauaauauauauauaaau

SEQ ID NO: 377716 - RNA, 64 nt, Homo Sapiens
cuaucauauuccuguuuuauuagcagaaccuaaaggaauuuauuuaaugauguugugacauuac

SEQ ID NO: 377717 - RNA, 64 nt, Homo Sapiens
ccuuuucugcuguaacgaaacaaugguuugguugggaauuuauucaauggagaaaaaugggaag

SEQ ID NO: 377718 - RNA, 64 nt, Homo Sapiens
cuaagaaaauacuuaaggaugaauucuaucuuugggaauuuauccuccaugucauuugaccuac

SEQ ID NO: 377719 - RNA, 64 nt, Homo Sapiens
ucucccuuuacuacagcauguauuuguaacuuaaggaauuuauugaaaauaauuuuuauauuua

SEQ ID NO: 377720 - RNA, 64 nt, Homo Sapiens
uauuuaaauugcuucauagugaugucguuuugagggaauuuaagcaucuauuuguguacaaaau

SEQ ID NO: 377721 - RNA, 64 nt, Homo Sapiens
aacaaaauauucuguaagaaucaauugucuauauggaauuuaggauaaagaauauuuacaauaa

SEQ ID NO: 377722 - RNA, 64 nt, Homo Sapiens
aacaaaagauucuguaagaauuaauuggcuauauggaauuuaggauagaauauuuacaauaaag

SEQ ID NO: 377723 - RNA, 64 nt, Homo Sapiens
uccagcuucucagaaagaaucaacaauguucucuaguuucaagcucucagcuuggccagccuuu

SEQ ID NO: 377724 - RNA, 64 nt, Homo Sapiens
gaccauuucccugaugcucugaaucuguuuucuuaguuucaaaucgguuuucucagaauaauuu

SEQ ID NO: 377725 - RNA, 64 nt, Homo Sapiens
gauggucauauuuaaacagaaguauacguuuuucaguuucaacaugaauuuuuuuauuucuguc

SEQ ID NO: 377726 - RNA, 64 nt, Homo Sapiens
uuuggguuuuguucuuguauugcuuucuuucaacaguuucaaaauaaaauaucauauaaauauu

SEQ ID NO: 377727 - RNA, 64 nt, Homo Sapiens
aaacccuuauaauaaaauccuucuguaauaauaaaguuucaaaagaaaauguuuauuuguucuc

SEQ ID NO: 377728 - RNA, 64 nt, Homo Sapiens
aaaauaaaaacucaaucacauucaauuccagaguaguuucaaguuucacaucguaaccauuuuc

SEQ ID NO: 377729 - RNA, 64 nt, Homo Sapiens
cugaggcagcaaugaaaauugcagaaacuauuuaaguuucaacugagaagcuagcauuagguuu

SEQ ID NO: 377730 - RNA, 64 nt, Homo Sapiens
uugacaaaaaauuuucaaaguccguuacuaaaauaguuucaaaguagcaaugcuuggaguagaa

SEQ ID NO: 377731 - RNA, 64 nt, Homo Sapiens
uguuccagcagcagcgacuuagccccaggagcccaguuucaauggccuugcugugugguguuuc

SEQ ID NO: 377732 - RNA, 64 nt, Homo Sapiens
aaaugauaggaaaaaaaccaauggugaaauuucaaguuucaaaaaccaaccuuucauuaccaau

SEQ ID NO: 377733 - RNA, 64 nt, Homo Sapiens
uuuuuuugcaugaagaaaaaugucuaucauuuacaguuucaauagcacauaauuuauuuucuau

SEQ ID NO: 377734 - RNA, 64 nt, Homo Sapiens
aaacauucagaucccucuuccuuuacucaaauacaguuucaaaaggaagacucaugagaaauuu

SEQ ID NO: 377735 - RNA, 64 nt, Homo Sapiens
guccucuacauuggaaagcuaauccuaccuugucaguuucaaccaacugaguuuuuucuuuaag

SEQ ID NO: 377736 - RNA, 64 nt, Homo Sapiens
gguuccaaacuaauauggcauauaucaacucuacaguuucaaauaaaugacuuuuuaauuguaa

SEQ ID NO: 377737 - RNA, 64 nt, Homo Sapiens
ccuuguggguuugucauuuauugguuaaugcucuaguuucaaaaccacccuguugaaaguucca

SEQ ID NO: 377738 - RNA, 64 nt, Homo Sapiens
uggaauuucugacugugcccuuuagggccuccugaguuucaaaaggaggaaguguucgugcuug

SEQ ID NO: 377739 - RNA, 64 nt, Homo Sapiens
uauuuugaaacugucugcuuuuugcuauuucugcaguuucaaguuaguuagaagcauguuguca

SEQ ID NO: 377740 - RNA, 64 nt, Homo Sapiens
gccuagaucuuguuaacccaucaggugcagugucaguuucaaaucaaauuaucuaagaaaacaa

SEQ ID NO: 377741 - RNA, 64 nt, Homo Sapiens
gaagucauuacaaacuccuuguacauucacugugaguuucaaagggagucagucccuaauuuac

SEQ ID NO: 377742 - RNA, 64 nt, Homo Sapiens
cucucccaacucuguucugcgguccuccucuagaaguuucaaaucuccuuucagaaaaauucaa

SEQ ID NO: 377743 - RNA, 64 nt, Homo Sapiens
auacccaaauuccccuaaagagcugcagacugacaguuucaagguugccucucagggguaguga

SEQ ID NO: 377744 - RNA, 64 nt, Homo Sapiens
cugaguucaaaaccagcccucuuuauuuucgucaaguuucaagugugagaguuuugacagagca

SEQ ID NO: 377745 - RNA, 64 nt, Homo Sapiens
caugugaauacuaccaaguuaaaaaagcaccuggaguuucaaaauuccaguuuuaaucauugua

SEQ ID NO: 377746 - RNA, 64 nt, Homo Sapiens
uuugguuauagugcaauauauuuuguaugcaagcaguuucaauaaaguuugaucuuccucugcu

SEQ ID NO: 377747 - RNA, 64 nt, Homo Sapiens
guucaaagucaugauguuuuuaaaaucuuauuaaaguuucaaaaaucugaagauuguuuaucua

SEQ ID NO: 377748 - RNA, 64 nt, Homo Sapiens; identical to SEQ ID NO: 239468

SEQ ID NO: 377749 - RNA, 64 nt, Homo Sapiens; identical to SEQ ID NO: 239469

SEQ ID NO: 377750 - RNA, 64 nt, Homo Sapiens; identical to SEQ ID NO: 239470

SEQ ID NO: 377751 - RNA, 64 nt, Homo Sapiens; identical to SEQ ID NO: 239471

SEQ ID NO: 377752 - RNA, 64 nt, Homo Sapiens; identical to SEQ ID NO: 239472

SEQ ID NO: 377753 - RNA, 64 nt, Homo Sapiens; identical to SEQ ID NO: 239473

SEQ ID NO: 377754 - RNA, 64 nt, Homo Sapiens; identical to SEQ ID NO: 239474

SEQ ID NO: 377755 - RNA, 64 nt, Homo Sapiens; identical to SEQ ID NO: 239475

SEQ ID NO: 377756 - RNA, 64 nt, Homo Sapiens; identical to SEQ ID NO: 239476

SEQ ID NO: 377757 - RNA, 64 nt, Homo Sapiens; identical to SEQ ID NO: 239477

SEQ ID NO: 377758 - RNA, 64 nt, Homo Sapiens; identical to SEQ ID NO: 239478

SEQ ID NO: 377759 - RNA, 64 nt, Homo Sapiens; identical to SEQ ID NO: 239479

SEQ ID NO: 377760 - RNA, 64 nt, Homo Sapiens; identical to SEQ ID NO: 239480

SEQ ID NO: 377761 - RNA, 64 nt, Homo Sapiens; identical to SEQ ID NO: 239481

SEQ ID NO: 377762 - RNA, 64 nt, Homo Sapiens; identical to SEQ ID NO: 239482

SEQ ID NO: 377763 - RNA, 64 nt, Homo Sapiens; identical to SEQ ID NO: 239483

SEQ ID NO: 377764 - RNA, 64 nt, Homo Sapiens; identical to SEQ ID NO: 239484

SEQ ID NO: 377765 - RNA, 64 nt, Homo Sapiens; identical to SEQ ID NO: 239485

SEQ ID NO: 377766 - RNA, 64 nt, Homo Sapiens; identical to SEQ ID NO: 239486

SEQ ID NO: 377767 - RNA, 64 nt, Homo Sapiens; identical to SEQ ID NO: 239487

SEQ ID NO: 377768 - RNA, 64 nt, Homo Sapiens; identical to SEQ ID NO: 239488

SEQ ID NO: 377769 - RNA, 64 nt, Homo Sapiens; identical to SEQ ID NO: 239489

SEQ ID NO: 377770 - RNA, 64 nt, Homo Sapiens; identical to SEQ ID NO: 239490

SEQ ID NO: 377771 - RNA, 64 nt, Homo Sapiens; identical to SEQ ID NO: 239491

SEQ ID NO: 377772 - RNA, 64 nt, Homo Sapiens; identical to SEQ ID NO: 239492

SEQ ID NO: 377773 - RNA, 64 nt, Homo Sapiens; identical to SEQ ID NO: 239493

SEQ ID NO: 377774 - RNA, 64 nt, Homo Sapiens; identical to SEQ ID NO: 239494

SEQ ID NO: 377775 - RNA, 64 nt, Homo Sapiens; identical to SEQ ID NO: 239495

SEQ ID NO: 377776 - RNA, 64 nt, Homo Sapiens; identical to SEQ ID NO: 239496

SEQ ID NO: 377777 - RNA, 64 nt, Homo Sapiens; identical to SEQ ID NO: 239497

SEQ ID NO: 377778 - RNA, 64 nt, Homo Sapiens; identical to SEQ ID NO: 239498

SEQ ID NO: 377779 - RNA, 64 nt, Homo Sapiens; identical to SEQ ID NO: 239499

SEQ ID NO: 377780 - RNA, 64 nt, Homo Sapiens; identical to SEQ ID NO: 239500

SEQ ID NO: 377781 - RNA, 64 nt, Homo Sapiens; identical to SEQ ID NO: 239501

SEQ ID NO: 377782 - RNA, 64 nt, Homo Sapiens; identical to SEQ ID NO: 239502

SEQ ID NO: 377783 - RNA, 64 nt, Homo Sapiens; identical to SEQ ID NO: 239503

SEQ ID NO: 377784 - RNA, 64 nt, Homo Sapiens; identical to SEQ ID NO: 239504

SEQ ID NO: 377785 - RNA, 64 nt, Homo Sapiens; identical to SEQ ID NO: 239505

SEQ ID NO: 377786 - RNA, 64 nt, Homo Sapiens; identical to SEQ ID NO: 239506

SEQ ID NO: 377787 - RNA, 64 nt, Homo Sapiens; identical to SEQ ID NO: 239507

SEQ ID NO: 377788 - RNA, 64 nt, Homo Sapiens; identical to SEQ ID NO: 239508

SEQ ID NO: 377789 - RNA, 64 nt, Homo Sapiens; identical to SEQ ID NO: 239509

SEQ ID NO: 377790 - RNA, 64 nt, Homo Sapiens; identical to SEQ ID NO: 239510

SEQ ID NO: 377791 - RNA, 64 nt, Homo Sapiens; identical to SEQ ID NO: 239511

SEQ ID NO: 377792 - RNA, 64 nt, Homo Sapiens; identical to SEQ ID NO: 239512

SEQ ID NO: 377793 - RNA, 64 nt, Homo Sapiens; identical to SEQ ID NO: 239513

SEQ ID NO: 377794 - RNA, 64 nt, Homo Sapiens; identical to SEQ ID NO: 239514

SEQ ID NO: 377795 - RNA, 64 nt, Homo Sapiens
uuccagcuaccuuccuguguaugcugagguacagaagccccauguguaccuacagagcagccag

SEQ ID NO: 377796 - RNA, 64 nt, Homo Sapiens
caugaagaagccacugguucuaggcauuucugggaagccccagggacugcaaguggccauuacc

SEQ ID NO: 377797 - RNA, 64 nt, Homo Sapiens
guucguuuuuaauucaguccuacaaaauggugguaagccccagucucaggggucacccugucuu

SEQ ID NO: 377798 - RNA, 64 nt, Homo Sapiens
uuguuuuugaggcccuaggccugcugucuuuuugaagccccacauucugaauuugucagauugu

SEQ ID NO: 377799 - RNA, 64 nt, Homo Sapiens
uuuucuugucuuuaucuaaugccccaauuuccccaagccccauuugcuccuuaaaaccccagaa

SEQ ID NO: 377800 - RNA, 64 nt, Homo Sapiens
uuccccaagccccauuuuuuccuuaaaaccccagaagccccaauuuacguucuuucagcaugcu

SEQ ID NO: 377801 - RNA, 64 nt, Homo Sapiens
aggggagucggaagagcuugauuuuaguguuaggaagccccagcagaugaugaaaaaagagucu

SEQ ID NO: 377802 - RNA, 62 nt, Homo Sapiens
gcucugccuggaaaccuggucaguuugugucgaagccccaguggcccgacaagccuuucuga

SEQ ID NO: 377803 - RNA, 64 nt, Homo Sapiens
aaauuccuguuacccgcugaggagaggcaaggaaaagccccacagugugucauuuccacaugaa

SEQ ID NO: 377804 - RNA, 64 nt, Homo Sapiens
ugucaacuaaaagagacggacaacagguuuccucaagccccauuugaaauaaugucaacaguca

SEQ ID NO: 377805 - RNA, 64 nt, Homo Sapiens
ggcacggcguggggacuggacagaaaaccacugcaagccccaaggagccagcugaagccuccca

SEQ ID NO: 377806 - RNA, 64 nt, Homo Sapiens
ugugcaucccucaccugccaguuauguggcugccaagccccacaggcugucaugguggcucuug

SEQ ID NO: 377807 - RNA, 64 nt, Homo Sapiens
cugugaguggcucgagcccugggggugcuccuggaagccccaagagcauccaggauugccuccc

SEQ ID NO: 377808 - RNA, 64 nt, Homo Sapiens
ccucccggcucugcccugcacauccuguugagccaagccccagugacccggagagcuggccuga

SEQ ID NO: 377809 - RNA, 64 nt, Homo Sapiens
cccccugccaccgggcgaucugaccacacuucagaagccccaucgccuccgggcauaaggcccc

SEQ ID NO: 377810 - RNA, 64 nt, Homo Sapiens
cuucccgccuccgggcauaauggguacacugcagaagccccauccagccucugcauaaggcccc

SEQ ID NO: 377811 - RNA, 64 nt, Homo Sapiens
ugccuuccuuuuggauuccccucgccugcccuccaagccccagcugguggugugccgauaccuc

SEQ ID NO: 377812 - RNA, 64 nt, Homo Sapiens
uucucuuuucuuauugaggaccaagaaggaagaaaagccccagggaggacuaacuuccagggug

SEQ ID NO: 377813 - RNA, 64 nt, Homo Sapiens
ccucacuugagcaugugaauauucucacggagagaagccccagcgagauuuuccggugaauacg

SEQ ID NO: 377814 - RNA, 64 nt, Homo Sapiens
uacucuuucaucacggaaacagaccccccgagagaagccccaacgagauuuuccggugaauacg

SEQ ID NO: 377815 - RNA, 64 nt, Homo Sapiens
auguagcaaaagcauuucuuucaaaaaaagaaaaaagccccagccgacggagugagacucccuc

SEQ ID NO: 377816 - RNA, 64 nt, Homo Sapiens
auggccgggcaugguggcucuuguguucuuagaaaagccccagcugucuuacccuccggugugc

SEQ ID NO: 377817 - RNA, 64 nt, Homo Sapiens
agagaaggccggagggagggguacugggugugugaagccccagcugcagaacauucccugcucu

SEQ ID NO: 377818 - RNA, 64 nt, Homo Sapiens
ccccaccuguccuuccucuacccaagggaguaggaagccccauugaaguugggccucccauggg

SEQ ID NO: 377819 - RNA, 64 nt, Homo Sapiens
aagcugguuuucuccugauaagaagaaaggaagaaagccccagacgcuugguuuuucucagaac

SEQ ID NO: 377820 - RNA, 64 nt, Homo Sapiens
uaucuauacauuaccuuguagcagcaguaccuggaagccccagcccgucacagaaguguggagg

SEQ ID NO: 377821 - RNA, 64 nt, Homo Sapiens
auuuuacuuccugaaugugccaacuuuggggauuuuucuuuauagugagcugugggaacccaga

SEQ ID NO: 377822 - RNA, 64 nt, Homo Sapiens
uuuuaaaguacuucucuagucauugaaguuuuuuuuucuuuacauaaauauugauauauucuuu

SEQ ID NO: 377823 - RNA, 64 nt, Homo Sapiens
uucaucaagagaagaauaacuuuacuaaauuuuauuucuuuauuugcaaaagaaucuuuauuaa

SEQ ID NO: 377824 - RNA, 64 nt, Homo Sapiens
uggaaaguucugcaauaagauucuaguucucucuuuucuuuaagcuuaugguugaagguuaacc

SEQ ID NO: 377825 - RNA, 64 nt, Homo Sapiens
uuacagaugguauaacuguauuauauaauggaauuuucuuuaggugugggaaaacuugaucuga

SEQ ID NO: 377826 - RNA, 64 nt, Homo Sapiens
auggaaugucagucagucucuguaguuaaaacuuuuucuuuaaaauucaauuaagguacuucuc

SEQ ID NO: 377827 - RNA, 64 nt, Homo Sapiens
auggaaugucagucagucucuguaguuaaaacuuuuucuuuaaaauucaauuaaguuacaccag

SEQ ID NO: 377828 - RNA, 64 nt, Homo Sapiens
cuccauugguuaaauuagcauuacuuaaaauuuguuucuuuagaaaauaaaugcagguuauaaa

SEQ ID NO: 377829 - RNA, 64 nt, Homo Sapiens
uucaauuugauugaacuguucagccuuuucaagauuucuuuauuuacaaaugauuacauuuaaa

SEQ ID NO: 377830 - RNA, 64 nt, Homo Sapiens
ccuuaaguuucuuaaguuaaggauguuuggcuuuuuucuuuaauuuuuuaaaaaccauuuuccu

SEQ ID NO: 377831 - RNA, 64 nt, Homo Sapiens
uguuaguuaaguagacacagugguuauggaagcauuucuuuacaguacccuuuacauguuuggu

SEQ ID NO: 377832 - RNA, 64 nt, Homo Sapiens
ugcagaagauacgugcaugaaaaaacaucuuuauuuucuuuaugucgaccuuucuuuucuuaga

SEQ ID NO: 377833 - RNA, 64 nt, Homo Sapiens
gauuuugugagguuuuuuuuuuuuccuuuagucuuuucuuuagugggggaggguaagaaaagca

SEQ ID NO: 377834 - RNA, 64 nt, Homo Sapiens
aaaaaaaaaguucuguugcacacuguuuucuuuauuucuuuaaagcuuggguagcgggauaagu

SEQ ID NO: 377835 - RNA, 64 nt, Homo Sapiens
ucuuuaaaaaaaaaaaaguuggauaagucacuguuuucuuuauucucuacacgcuuggguagcg

SEQ ID NO: 377836 - RNA, 64 nt, Homo Sapiens
cugcacacuuucuagauagauucaggauauuuuguuucuuuaaugauuugcuuguaacaguuau

SEQ ID NO: 377837 - RNA, 64 nt, Homo Sapiens
auucugucaauucaaagaagucuuggcagugcuuuuucuuuagcaguugaaaagaauuguauau

SEQ ID NO: 377838 - RNA, 64 nt, Homo Sapiens
uuuuuuagauuuuccuggaucguuuauaugcacguuucuuuaauuucauguucugcuaugcaau

SEQ ID NO: 377839 - RNA, 64 nt, Homo Sapiens
guuugcaguuaauguucaugauuucuaacuuucauuucuuuacuaccuuuguauauuugauagu

SEQ ID NO: 377840 - RNA, 64 nt, Homo Sapiens
gagcagaagcagaagaguaagaaaaaauaagauuuuucuuuagaauuccaugagcuucuuaugu

SEQ ID NO: 377841 - RNA, 64 nt, Homo Sapiens
uaacauucgauuccaugagcuacuuacccuaucuuuucuuuaauuacugucuuucccccaguug

SEQ ID NO: 377842 - RNA, 64 nt, Homo Sapiens
ugaaccuaccucuuuuauuugauguaauaggcauuuucuuuauucauuuuaaugaaaaucuaau

SEQ ID NO: 377843 - RNA, 64 nt, Homo Sapiens
uuuccuuauagaaccauuaaaaugucuuuauagauuucuuuaaauucuuguuuuauauauuuug

SEQ ID NO: 377844 - RNA, 64 nt, Homo Sapiens
uucaaacauuaccucugaaaauaugguggauauuuuucuuuaauauuaaaagaucuguuguaau

SEQ ID NO: 377845 - RNA, 64 nt, Homo Sapiens
uggaauugccaaaucauuugauuccagugucagcuuucuuuagcguggagauuaacuuuggcau

SEQ ID NO: 377846 - RNA, 64 nt, Homo Sapiens
cugucauuccagucagaaacugucuuuugaaauauuucuuuacaaccuaccaaaaaaggaaggu

SEQ ID NO: 377847 - RNA, 64 nt, Homo Sapiens
acggagggagccuguugguguuaaauuguuuacauuucuuuauacaaauaaugugcuuucagug

SEQ ID NO: 377848 - RNA, 64 nt, Homo Sapiens
aaaggcuuuaaauaggcuuccuuuagaaaauguguuucuuuaaauuuggauuuugguaucuuug

SEQ ID NO: 377849 - RNA, 64 nt, Homo Sapiens
ggauuaggugugagccaccgcaccuggccgauauuuucuuuaaugaaauuuauaaauaugcuuc

SEQ ID NO: 377850 - RNA, 64 nt, Homo Sapiens
ugcacagccaaauuuaaaacuguuggaauggauuuuucuuuaacugccguaauuuaacuuucug

SEQ ID NO: 377851 - RNA, 64 nt, Homo Sapiens
uuauacuuauuuguauaugguauuuauuuuuucuuuucuuuacaaaccauuuuguuauugacua

SEQ ID NO: 377852 - RNA, 64 nt, Homo Sapiens
acagguguuauuucaggugauguacuugcauuauuuucuuuagccauaguaacuuuuugucaca

SEQ ID NO: 377853 - RNA, 64 nt, Homo Sapiens
aaucauuuugucaguuacaucaagaaagcagauuuuucuuuagucaugaaaaauaucucaagug

SEQ ID NO: 377854 - RNA, 64 nt, Homo Sapiens
ucuguaugcuauaagcaagggagcuuagguguuauuucuuuaauuuaugcuugaaucugaaaaa

SEQ ID NO: 377855 - RNA, 64 nt, Homo Sapiens
agaaguuuuauauucucucaaaaaugguauuaucuuucuuuauuugcuagauucuuacaaaucu

SEQ ID NO: 377856 - RNA, 64 nt, Homo Sapiens
aaguaaugacagaacaugcuguuauuuagguauuuuucuuuaaccaaacaauauugcuccauga

SEQ ID NO: 377857 - RNA, 64 nt, Homo Sapiens
ugaagauuuaauauuacagauaaaauguaaacuguuucuuuaaaauuggggcuucaacuuugga

SEQ ID NO: 377858 - RNA, 64 nt, Homo Sapiens
uuauacugaauuaacaguuagucuauuaaagauauuucuuuaaauuugaugacucaucaauuuu

SEQ ID NO: 377859 - RNA, 64 nt, Homo Sapiens
uacuaauugagccauuuaauugaaaaguuuaguguuucuuuaucaugauugguaggaaauagaa

SEQ ID NO: 377860 - RNA, 63 nt, Homo Sapiens
aaccuaguuacuaccuguaauacuuaggagauaauuucuuuagucaaaauuuauauuaaaauc

SEQ ID NO: 377861 - RNA, 64 nt, Homo Sapiens
guucccuuauguauucaagccaggucuaaucagguuucuuuauuggugugacuuuuaauuaguu

SEQ ID NO: 377862 - RNA, 64 nt, Homo Sapiens
ucgauuauauauauauaugguguuuaucaaaugauuucuuuaaauuucuuuacucgauuaguuu

SEQ ID NO: 377863 - RNA, 64 nt, Homo Sapiens
cgauuaguuuuguuuaucaagacuucaaaggauuuuucuuuacuuguaaugaugaagauguuag

SEQ ID NO: 377864 - RNA, 64 nt, Homo Sapiens
uaauugaugguuauugaaagaagcaugguauucuuuucuuuaugcagaguuuguaauaaaaugg

SEQ ID NO: 377865 - RNA, 64 nt, Homo Sapiens
cuuuugucuuuuaaaauaauaacauugcaacccuuuucuuuaccaagccauuucuuccaaaaac

SEQ ID NO: 377866 - RNA, 64 nt, Homo Sapiens
guaagaagaaucauuuuucuaaugaggaauggauuuucuuuaauugcauuuuccuacaccucca

SEQ ID NO: 377867 - RNA, 64 nt, Homo Sapiens
guuuuguuuaauauuuacagugcuuuaaagucuauuucuuuaaaucugaugaauuaaaggagua

SEQ ID NO: 377868 - RNA, 64 nt, Homo Sapiens
uagucuuauuuaauuuuaaauugcucugaagacauuucuuuagcaugcagauuucccaguuauc

SEQ ID NO: 377869 - RNA, 64 nt, Homo Sapiens
guaugaaaacaggaaaauaagugcugcguuuuguuuucuuuacuuuccucgggaaaaugugaau

SEQ ID NO: 377870 - RNA, 64 nt, Homo Sapiens
uucuucacaugcgacaauuuaaaaaaaauccaucuuucuuuauuauucuguauagaauuauuaa

SEQ ID NO: 377871 - RNA, 64 nt, Homo Sapiens
aaggaggccuguagaaauugcccauuguuacacauuucuuuacagguagaauuaugacuuuccc

SEQ ID NO: 377872 - RNA, 64 nt, Homo Sapiens
cagugcaauagauuuguuugugugcaaaccaaacuuucuuuacccuggacaagugguuuguuug

SEQ ID NO: 377873 - RNA, 64 nt, Homo Sapiens
gugugugcuuacacaggugugcaucaagucauguuuucuuuaguauuuguuuacgugaugccaa

SEQ ID NO: 377874 - RNA, 64 nt, Homo Sapiens
uuccccucauggaaacagagagcauugagagcacuuucuuuaaaaggaccaaaaauaaauuccu

SEQ ID NO: 377875 - RNA, 64 nt, Homo Sapiens
uguccuaagagaguguuuuuuuuucuagcaucauuuucuuuacaugccacucaugucauaaggc

SEQ ID NO: 377876 - RNA, 64 nt, Homo Sapiens
ggagccaggacaauagggccuguuguuuagugaauuucuuuauuauuuucagccuuuaaaaugu

SEQ ID NO: 377877 - RNA, 64 nt, Homo Sapiens
uugacaaaaccaaaagaaauuaacaggccacagguuucuuuaaagcuguguuaacauaucuugc

SEQ ID NO: 377878 - RNA, 64 nt, Homo Sapiens
ugccuugauuuccagaauggauucagcccugcacuuucuuuagaauauuccauuuacaaaauaa

SEQ ID NO: 377879 - RNA, 64 nt, Homo Sapiens
aaauauguagcugucaucaugaaauguagcugcuuuucuuuagacugccucggaugagagguug

SEQ ID NO: 377880 - RNA, 64 nt, Homo Sapiens
guugguuaaaaaaaaaagccaaaacccaaaaaguuuucuuuacucaucucaaaaaagaaacaaa

SEQ ID NO: 377881 - RNA, 64 nt, Homo Sapiens
auuuuauaaaaauuauucauauguuauuaguuguuuucuuuauaauuuaaugugaauuucauac

SEQ ID NO: 377882 - RNA, 64 nt, Homo Sapiens
uauuuuacuuaagcauaauauuuuuuuucuuuuuuuucuuuagcauauugucaucuuuucuguu

SEQ ID NO: 377883 - RNA, 64 nt, Homo Sapiens
caaagcaagauaacggcauaaucucucauguuguuuucuuuauaaccaaacuccaguauuaaaa

SEQ ID NO: 377884 - RNA, 64 nt, Homo Sapiens
uacccugguuuggauuuuuuagauuugguuuuccuuucuuuacuauuuguuguaaaugcuguau

SEQ ID NO: 377885 - RNA, 64 nt, Homo Sapiens
ucuuggacuuuaaacccuacguuuuguuuuccuuuuucuuuaaaaauuuccauuucaucaguuu

SEQ ID NO: 377886 - RNA, 64 nt, Homo Sapiens
gcacauaggaauagaaguguguuauaaaucuagcuuucuuuaugauguuucugauaauacgaga

SEQ ID NO: 377887 - RNA, 64 nt, Homo Sapiens
cuguauauugaaagucauauuauaaaagguuugcuuucuuuaaguguuauuuaucuuaaauuau

SEQ ID NO: 377888 - RNA, 64 nt, Homo Sapiens
uauuucugaguugaccaauaaauaaaaauaccacuuucuuuaaaaaagccuagggaauugaagc

SEQ ID NO: 377889 - RNA, 64 nt, Homo Sapiens
aaaaaaaaagaaaagaaaaagcagcauccuuauauuucuuuaaaauacauagaaauaaaguuag

SEQ ID NO: 377890 - RNA, 64 nt, Homo Sapiens
uagguuugggggcgggggcuuguuuggguuccuuuuucuuuauucugauuaugugaaaccauau

SEQ ID NO: 377891 - RNA, 64 nt, Homo Sapiens
acugugccagaaucucaggugccugcuuagaguauuucuuuaaucacagucacugggaaguaag

SEQ ID NO: 377892 - RNA, 64 nt, Homo Sapiens
uuugcugauaaaugucuguuggauucuuuuuggauuucuuuaauuaauuuguaaguaaccaaga

SEQ ID NO: 377893 - RNA, 64 nt, Homo Sapiens
ccuuuuuaaauuuuuuuuauuuuuuuuauuuuuauuucuuuaagauggagucuugcucuguugc

SEQ ID NO: 377894 - RNA, 64 nt, Homo Sapiens
aaaaacaccauguuucuaagcauccauuuuucccuuucuuuaaaagaaacuuaacuguucuaug

SEQ ID NO: 377895 - RNA, 64 nt, Homo Sapiens
ccuaauauaaacugguauaagaagacuuuccuuuuuucuuuaugcauggaagcaucaauaaauu

SEQ ID NO: 377896 - RNA, 64 nt, Homo Sapiens
acauguuauauauaauccauaagcuccaucccuuuuucuuuaggaacaaaauauauuuucucac

SEQ ID NO: 377897 - RNA, 64 nt, Homo Sapiens
auacauugguuuaugacauauacuuagcuuuugcuuucuuuaaaagaaagauaacauuuucaaa

SEQ ID NO: 377898 - RNA, 64 nt, Homo Sapiens
aaugguugaaaaugcuucuacaauguuauaagcauuucuuuagagaaaguaguucuauauauaa

SEQ ID NO: 377899 - RNA, 64 nt, Homo Sapiens
guaaauauuccauucugauuaaagcuuuuuaauuuuucuuuacaucgauaauggccuuuauuug

SEQ ID NO: 377900 - RNA, 64 nt, Homo Sapiens
aaguuuuuaaaauugaucaaaaguuaaagacagauuucuuuaauaauuggaggcauuuuauuuu

SEQ ID NO: 377901 - RNA, 64 nt, Homo Sapiens
uuuuaugaaaguguugcagugaaaugauuauuuuuuucuuuaugaugcaaauuaaaugcagaga

SEQ ID NO: 377902 - RNA, 64 nt, Homo Sapiens
uuacuuauauguuauuauaaauuuuuacuuaaauuuucuuuaauguagguuaaaauacucacau

SEQ ID NO: 377903 - RNA, 64 nt, Homo Sapiens
uuaggauccaaacauguccaucacaaucugauuguuucuuuaacucuaguuagaaagucuuauu

SEQ ID NO: 377904 - RNA, 64 nt, Homo Sapiens
caaggaguggaugucuuauuucaauguacucauuuuucuuuaugcuauuguucaucauauuuga

SEQ ID NO: 377905 - RNA, 64 nt, Homo Sapiens
aaauucuuuucuuuuccauuuagagauauguuuuuuucuuuaccuucauaccuuucuauuucuu

SEQ ID NO: 377906 - RNA, 64 nt, Homo Sapiens
aagguuauuuucaugauuuugcaaaugggaaggauuucuuuaaagcaagacacaaaagcauaca

SEQ ID NO: 377907 - RNA, 64 nt, Homo Sapiens
gaucauuguuaagaauacugagguucuaauauacuuucuuuaguucugugagccaacaguaauu

SEQ ID NO: 377908 - RNA, 64 nt, Homo Sapiens
aaugauuuaauaauaguccagguuuuuguguguuuuucuuuauacugcaaauuaauaaugauuc

SEQ ID NO: 377909 - RNA, 64 nt, Homo Sapiens
auuagcuagcauuauauuuauauacagggucuuuuuucuuuaccgauguauuuuccuacucaua

SEQ ID NO: 377910 - RNA, 64 nt, Homo Sapiens
gccaugauauggggaaaugguguaaacuaauguauuucuuuauuggcuguuauucuguauaaca

SEQ ID NO: 377911 - RNA, 64 nt, Homo Sapiens
uuuguuuuuguccuucauuccuuuucauucucucuuucuuuaucauuuuaaauuccugaaugac

SEQ ID NO: 377912 - RNA, 64 nt, Homo Sapiens
acuuuggaguguaaaucuuccauuggaaggagucuuucuuuagauuuuauaaaugugccaccca

SEQ ID NO: 377913 - RNA, 64 nt, Homo Sapiens
augauacaguguuaaaagaaucauuuauaccaguuuucuuuauggauauuugaaauagauuuuu

SEQ ID NO: 377914 - RNA, 64 nt, Homo Sapiens
uucucccaguauguuuuaacauggauuuccaguuuuucuuuacuuucaaacuuuugaaagaugu

SEQ ID NO: 377915 - RNA, 64 nt, Homo Sapiens
auggaauacuuucuguggaaucauucuagauaaguuucuuuacaaguccucaauucauaaguua

SEQ ID NO: 377916 - RNA, 64 nt, Homo Sapiens
augcauuuacugauuaaaaauuuuaguucaacuguuucuuuaaaaguaucaugaauggccuccu

SEQ ID NO: 377917 - RNA, 64 nt, Homo Sapiens
aggauugcaccuaucaauuucuuuugaaaagaaauuucuuuaacucagagggguuuuucauuua

SEQ ID NO: 377918 - RNA, 64 nt, Homo Sapiens
uaaugaguauuaaauagugcaaucuucauugacuuuucuuuagucuuuguguuuccuauuuggu

SEQ ID NO: 377919 - RNA, 64 nt, Homo Sapiens
gcuccuccuucccuucauaaggacuuuuuuugucuuucuuuaacgcccaggcuucgucuuauuu

SEQ ID NO: 377920 - RNA, 64 nt, Homo Sapiens
gguucucuaacuguggucuccuugggccaagcaauuucuuuaaaggaaaaguugauuauguaug

SEQ ID NO: 377921 - RNA, 64 nt, Homo Sapiens
caggcaaugauuuuaugacaacuugaugugcuuuuuucuuuauuuuucuuuuacauuagaaguu

SEQ ID NO: 377922 - RNA, 64 nt, Homo Sapiens
guuggcaacaguuccaugucaguacauaguuuccuuucuuuauuacagcugccuguuuuuucau

SEQ ID NO: 377923 - RNA, 64 nt, Homo Sapiens
uaccaaaguacuuuugguguuugguuggugugcauuucuuuagugucgauaguaacuggauuuu

SEQ ID NO: 377924 - RNA, 64 nt, Homo Sapiens
uucucuaggcugcuaaacgcugugcauugaaccuuuucuuuagaaguuucagcguaacuaaugu

SEQ ID NO: 377925 - RNA, 64 nt, Homo Sapiens
aaaaucccacagcuauuggaucauccacagauuuuuucuuuacaaucuuguucuccuuguccau

SEQ ID NO: 377926 - RNA, 64 nt, Homo Sapiens
gcaugucuagaugaacaaauaaaaauaaagauaauuucuuuaaaauaucacaagaugaaaauau

SEQ ID NO: 377927 - RNA, 64 nt, Homo Sapiens
uugccguggcaucuuaaaaguucggaugggagaguuucuuuacauggccuacaaaucaguaauu

SEQ ID NO: 377928 - RNA, 64 nt, Homo Sapiens
cuuuagcuauuacuggaucugcgacaucucugacuuucuuuaguagcauauugacuuuuuuuga

SEQ ID NO: 377929 - RNA, 64 nt, Homo Sapiens
uagcucagccaaaucuuguugucacucuuuugguuuucuuuauaugucaccaauugaaaaucuu

SEQ ID NO: 377930 - RNA, 64 nt, Homo Sapiens
aaauuccuuccuuuuaaaaaacuugacuuuuauauuucuuuaaauguugcuauuucacuuuuug

SEQ ID NO: 377931 - RNA, 64 nt, Homo Sapiens
guuucaacaacaaaccccaaguaagagucauguuuuucuuuaaauauaaguccccugugaguaa

SEQ ID NO: 377932 - RNA, 64 nt, Homo Sapiens
uugcuuaccuuauagauuauaccuaugauggcccuuucuuuaucauucucacuuuuagaauuau

SEQ ID NO: 377933 - RNA, 64 nt, Homo Sapiens
cauucaucagcugauggacauaugauaugccauguuucuuuaucuggccgaaauuacuccauug

SEQ ID NO: 377934 - RNA, 64 nt, Homo Sapiens
guaacagcauuauugagauagucgaugaccuuuuuuucuuuagaugugaguaguagauaaucau

SEQ ID NO: 377935 - RNA, 64 nt, Homo Sapiens
uuaagcugcuguauauagcuugugagaaaccucuuuucuuuaaaauuuacauaaucacaagaaa

SEQ ID NO: 377936 - RNA, 64 nt, Homo Sapiens
aaauaagauuccaaccacaaaaaaaauuuagccauuucuuuacuaaaaaaaaccaaaaaacaaa

SEQ ID NO: 377937 - RNA, 64 nt, Homo Sapiens
gacaaaaugcuaauuauuucccugauuaggaaaguuucuuuaaaaaacacguaauuuugccuag

SEQ ID NO: 377938 - RNA, 64 nt, Homo Sapiens
gagaaaugugugcuuuuguuuucggauagacuuauuucuuuaguucugcacuuuuccacauuau

SEQ ID NO: 377939 - RNA, 64 nt, Homo Sapiens
uuuuuaacuuuuuggggggaccuaccuauuagcuuuucuuuauuaggggucucaagacauucug

SEQ ID NO: 377940 - RNA, 64 nt, Homo Sapiens
auucacacauauaugcagaggucauucucaugcuuuucuuuauaccauguuuguugaacuuaga

SEQ ID NO: 377941 - RNA, 64 nt, Homo Sapiens
cauuuccagugucuucgccacauaaaauagccauuuucuuuaaaauaguuuuggacuaacgaag

SEQ ID NO: 377942 - RNA, 64 nt, Homo Sapiens
uugcucauuuuaacaaauaugaccgagucuaguuuuucuuuaaaaggauaguuuaugaguaauc

SEQ ID NO: 377943 - RNA, 64 nt, Homo Sapiens
cuaacaggcauauaaggaaaaccaucuagagaguuuucuuuagaagugacucccauuagccugg

SEQ ID NO: 377944 - RNA, 64 nt, Homo Sapiens
uagcugaaguccaccauaaaguggauuuacuuuuuuucuuuaaggauggauguuguguucucuu

SEQ ID NO: 377945 - RNA, 64 nt, Homo Sapiens
uucuguucggcuccuauuuuucucaucauuuuguuuucuuuaauuggguugaauggaguagaua

SEQ ID NO: 377946 - RNA, 64 nt, Homo Sapiens
auauacugggcagaaugaaguauguuuguuuauuuuucuuuaaaaauaaaggauuuuggaacuc

SEQ ID NO: 377947 - RNA, 64 nt, Homo Sapiens
aggugauccuguugagauucuggauccagagcaauuucuuuagcuuuugacuuugccaaagugu

SEQ ID NO: 377948 - RNA, 64 nt, Homo Sapiens
augaaauuauauaauguaacuuuggaccucaguuuuucuuuagaaaugggugggagaaugaaaa

SEQ ID NO: 377949 - RNA, 64 nt, Homo Sapiens
aaugguggggaaugguguguaccgauauauaguauuucuuuagacaacuugcagauaauuucuu

SEQ ID NO: 377950 - RNA, 64 nt, Homo Sapiens
auauauaguauuucuuuagacaacuugcagauaauuucuuuauugaaacuaucaggaaguuuua

SEQ ID NO: 377951 - RNA, 64 nt, Homo Sapiens
guucugacaguugugugguaugcucaaugcaugcuuucuuuauuauuuucacgauguuccuguc

SEQ ID NO: 377952 - RNA, 64 nt, Homo Sapiens
uaaucccaaauagaccagaacuuguacuuccaauuuucuuuaaagccugaaggaaucugaaaca

SEQ ID NO: 377953 - RNA, 64 nt, Homo Sapiens
guaugggacugaaaucaaaccuuuaaaaaauuuuuuucuuuaaucacagccagugggcuaagac

SEQ ID NO: 377954 - RNA, 64 nt, Homo Sapiens
gacggacuucauugaaaucucuuccccaagaauguuucuuuauacacacacaccucuugaaacc

SEQ ID NO: 377955 - RNA, 64 nt, Homo Sapiens
uaccacauggacagaauuugaaaaagagccuuacuuucuuuacacacaaaaucuuuucauaauu

SEQ ID NO: 377956 - RNA, 64 nt, Homo Sapiens
uugaagaacauaaacuguuauuuacuaugucauuuuucuuuaccuuaaaaauuuuaaacaauca

SEQ ID NO: 377957 - RNA, 64 nt, Homo Sapiens
guccuucauagcaggccaagaaaaaaguuuguuuuuucuuuauuucuuuucucucaagaaaaaa

SEQ ID NO: 377958 - RNA, 64 nt, Homo Sapiens
ugagugaaauacccucaagugaguaaaguggcaauuucuuuagacuuuucaacaaggcaaaaug

SEQ ID NO: 377959 - RNA, 64 nt, Homo Sapiens
uccaaggaaagaacuacuagaaguuuggguguauuuucuuuaccuucugaauccugguaauuaa

SEQ ID NO: 377960 - RNA, 64 nt, Homo Sapiens
agugcaagggcuacccuaaucuuuuugaggaagguuucuuuauauucaucauuuuguacauuuc

SEQ ID NO: 377961 - RNA, 64 nt, Homo Sapiens
guuuuaaaacucuugagcugugacuuaggcuguguuucuuuaugcugaauaguguaccagcaau

SEQ ID NO: 377962 - RNA, 64 nt, Homo Sapiens
aucauauugcucuucuucuuuuugaaucuuucuauuucuuuagccauaagguuucccauuccaa

SEQ ID NO: 377963 - RNA, 64 nt, Homo Sapiens
uaagauugaguuaugacuuuaaaugaggcauuguuuucuuuauuaucugccauucauucuuguu

SEQ ID NO: 377964 - RNA, 64 nt, Homo Sapiens
agguuuuccuaaaguuagaauagucgaauguucuuuucuuuaccuuuacaauuaagacaaaaug

SEQ ID NO: 377965 - RNA, 64 nt, Homo Sapiens
cuugcuuccccauuuccuacucuuuaaggaaugauuucuuuagccucagauagaaggaccuuua

SEQ ID NO: 377966 - RNA, 64 nt, Homo Sapiens
uaaaaugggauuuauaaaaauauuagauuguuuauuucuuuacuguggaaaaguacaaugucau

SEQ ID NO: 377967 - RNA, 64 nt, Homo Sapiens
auaaaauagcaugcugggaaccugagaaggaagguuucuuuaguacugccacagauguccugga

SEQ ID NO: 377968 - RNA, 64 nt, Homo Sapiens
aguguuccuuuugucacuuaauuuaucaccaacuuuucuuuaaauuaguauuuuagccuaacau

SEQ ID NO: 377969 - RNA, 64 nt, Homo Sapiens
auuugauagagauuauauuaacauuuugauagaauuucuuuauacugacuucuuuaugugguca

SEQ ID NO: 377970 - RNA, 64 nt, Homo Sapiens
aaaccagguuaugugguguauacuuuaccuguuuuuucuuuagcaaaauaccauuuuuaagcag

SEQ ID NO: 377971 - RNA, 64 nt, Homo Sapiens
uuucuuauguguucaccucuuaauguaauuaaccuuucuuuacaaaucagaagcuauuuuauuu

SEQ ID NO: 377972 - RNA, 64 nt, Homo Sapiens
aaugauuaucugaacaaaugagauuuugugguguuuucuuuaacccaugugauguccuccaaaa

SEQ ID NO: 377973 - RNA, 64 nt, Homo Sapiens
guggguauauuuuauuuuccaguuuauuuucauauuucuuuacuguguuauuucuggaaacuuu

SEQ ID NO: 377974 - RNA, 64 nt, Homo Sapiens
uccuuauaguauuguaggcccugaaaguagaauuuuucuuuaacuuauuuugagauuugagauu

SEQ ID NO: 377975 - RNA, 64 nt, Homo Sapiens
ggcaaagugaaaagauacagucaaaaaucuagaauuucuuuaauuuugcuucucugacgaguug

SEQ ID NO: 377976 - RNA, 64 nt, Homo Sapiens
gcuccaacuucucauuaaaucauggacuguaacauuucuuuacuuucuaucauagcacuuccua

SEQ ID NO: 377977 - RNA, 64 nt, Homo Sapiens
auucuucuguugaaauagccccuuccugaagcccuuucuuuauaugcuugagucacucccaauc

SEQ ID NO: 377978 - RNA, 64 nt, Homo Sapiens
ugguauuaaauauuuucaacuuucaaauguugguuuucuuuaagcaggagacugcuauuuuagu

SEQ ID NO: 377979 - RNA, 64 nt, Homo Sapiens
uuuaguugacaaggugccuaugccauuguuaaauuuucuuuaaguaauuuaacaacagauuugc

SEQ ID NO: 377980 - RNA, 64 nt, Homo Sapiens
ugguguucccaagagcuuuuaaacuguuuaggauuuucuuuaagaguuccuggguuuagcugug

SEQ ID NO: 377981 - RNA, 64 nt, Homo Sapiens
aaggaaaaaaaugcguauauugauauaaacaagcuuucuuuaaagcguauccuaugguaacuga

SEQ ID NO: 377982 - RNA, 64 nt, Homo Sapiens
gaaaguuuuauuuuacuguuguuuuuguucuuuuuuucuuuaaguuucucuuucuuuaauuuuu

SEQ ID NO: 377983 - RNA, 64 nt, Homo Sapiens
uuuuguuuuuguucuuuuuuacguuucuuuucucuuucuuuaauugugugugaauugaauggag

SEQ ID NO: 377984 - RNA, 64 nt, Homo Sapiens
gcaaguuuaaauaguuguacagcaauuuaaaaucuuucuuuacuagaaugaacacauaaaauuu

SEQ ID NO: 377985 - RNA, 64 nt, Homo Sapiens
ucugcaaaucuguuagcauacagcuuugcuuagcuuucuuuauuaguuuggaugggaucgugcc

SEQ ID NO: 377986 - RNA, 64 nt, Homo Sapiens
gagauaaauaaaaauauaggugaugggcagaucuuuucuuuaaaauaaaaaagcaaaaacucuu

SEQ ID NO: 377987 - RNA, 64 nt, Homo Sapiens
agauucugucuaaagggguuuuuugggaagacguuuucuuuaucgcccugagaagaucuacccc

SEQ ID NO: 377988 - RNA, 64 nt, Homo Sapiens
uaccccagggagaaucugagacaucuugccuacuuuucuuuauuagcuuucuccucauccauuu

SEQ ID NO: 377989 - RNA, 64 nt, Homo Sapiens
uuaaaaaauugcugaauauaaaaucuuugaaaauuuucuuuaugugugaagacacaaaguaugg

SEQ ID NO: 377990 - RNA, 64 nt, Homo Sapiens
aaucaaaacuaacuuuuuguagauagccauuucauuucuuuaaacuguuucaacgccaauaugu

SEQ ID NO: 377991 - RNA, 64 nt, Homo Sapiens
caaaaaugauuuaaaacauuuuaccucagacuaauuucuuuaaaggauucagguucaaaacuua

SEQ ID NO: 377992 - RNA, 64 nt, Homo Sapiens
uggcucuaggaagaagugacacuaagccaacaccuuucuuuaugugggagcagaaucagcugau

SEQ ID NO: 377993 - RNA, 64 nt, Homo Sapiens
ggcguauugggggguuugauuuacuuuccuuuuauuucuuuauuuuuugcuuauacuuguuuuu

SEQ ID NO: 377994 - RNA, 64 nt, Homo Sapiens
uuuacaguuuuuuggguuuggcuuccuucucacauuucuuuagcuuugaauuuuuacuaaauaa

SEQ ID NO: 377995 - RNA, 64 nt, Homo Sapiens
agugaaccccugggccacugaaccuggacugaucuuucuuuaauguuuaggccaugugcccaga

SEQ ID NO: 377996 - RNA, 64 nt, Homo Sapiens
uaaaaaaaaaaugccaagaauuugagacacuggauuucuuuaauuaaacacauuuucacaaguu

SEQ ID NO: 377997 - RNA, 64 nt, Homo Sapiens
aaauugaaguuuuaagggacguuugcagaagaauuuucuuuauauguuacauaaaggggaugug

SEQ ID NO: 377998 - RNA, 64 nt, Homo Sapiens
uucaaaaugauuuccuuugcuuauaauagcuuuuuuucuuuauuuacuggaaauccuuaaccaa

SEQ ID NO: 377999 - RNA, 64 nt, Homo Sapiens
guauuuuaauuuuuuaauguaaaauuuacuuacauuucuuuaagugcuuacuauuugauuaaau

SEQ ID NO: 378000 - RNA, 64 nt, Homo Sapiens
aaaaaaaaaaaaaaaaaaaaggaaaauaauaccuuuucuuuaaaacuugcuuugcuucauuugg

SEQ ID NO: 378001 - RNA, 64 nt, Homo Sapiens
uacaugucaccuuagguaguaggaagaauuacaauuucuuuaaaucauuuaucuggauuuuuau

SEQ ID NO: 378002 - RNA, 64 nt, Homo Sapiens
cuucuauauauacaaugaguaaaaucacagauuuuuucuuuaaauaaaaauaagucauuuuaau

SEQ ID NO: 378003 - RNA, 64 nt, Homo Sapiens
guaccauuuauuugcuugaugaagggagcucuauuuucuuuaccagaaauguugcuaaguaauu

SEQ ID NO: 378004 - RNA, 64 nt, Homo Sapiens
auauguaaauucugugauacucuaugaucaucucuuucuuuauauuauuuucauagacaugaaa

SEQ ID NO: 378005 - RNA, 64 nt, Homo Sapiens
uauuuacugaaaauuucaguaaaaugugugaauguuucuuuauguauuaaccucauagcaguaa

SEQ ID NO: 378006 - RNA, 64 nt, Homo Sapiens
uuaugcauagaucagaauuuuaaauuaaagguuuuuucuuuaaaugauuuguauuacuuuauua

SEQ ID NO: 378007 - RNA, 64 nt, Homo Sapiens
aaaaccucagcaugucucccgacaaggccaagcuuuucuuuauugaacuuuguuaaguguucug

SEQ ID NO: 378008 - RNA, 64 nt, Homo Sapiens
uaguuugcguuugauauuaguaguacuaauuuuguuucuuuauaaaaauuaaaaaaaaacucca

SEQ ID NO: 378009 - RNA, 64 nt, Homo Sapiens
acuaucuuguugauagcuuuuuuuuggcuagcauuuucuuuacccuauuucucaauaguguuau

SEQ ID NO: 378010 - RNA, 64 nt, Homo Sapiens
guuuugugagguaauacugacagcagaagugauauuucuuuacuguucaucuuagaggauucuu

SEQ ID NO: 378011 - RNA, 64 nt, Homo Sapiens
uacucaaaaccaagauagaaagaaacaauuauaauuucuuuacacuuuaacauacugauaagua

SEQ ID NO: 378012 - RNA, 64 nt, Homo Sapiens
uuggaccgaagucauuaaaaucacuguauuucauuuucuuuauacaucuugaaagaagaacuau

SEQ ID NO: 378013 - RNA, 64 nt, Homo Sapiens
uguaaaaguuuagguauaaaaugcuaugcaacuuuuucuuuauaguaagagcuuuauuuucuuu

SEQ ID NO: 378014 - RNA, 64 nt, Homo Sapiens
cuaugcaacuuuuucuuuauaguaagagcuuuauuuucuuuaauaauauagcccaacuuauaug

SEQ ID NO: 378015 - RNA, 64 nt, Homo Sapiens
uuauauuguacaugaaaaguuauuuccagauaaauuucuuuauuuuacuuuucaggaauuuaau

SEQ ID NO: 378016 - RNA, 64 nt, Homo Sapiens
uagacuuguaggcacucuucggcauuugccuaaguuucuuuaauaaaaaaaaaaaacuucuuua

SEQ ID NO: 378017 - RNA, 64 nt, Homo Sapiens
cuuguauaaauuauucaguaguuuauuuucuacguuucuuuaacaccaaaaacaaaaaccaaau

SEQ ID NO: 378018 - RNA, 64 nt, Homo Sapiens
uuguguaaaaaaaccaccaaggccaugugcauaguuucuuuauucugccggacccggaggccga

SEQ ID NO: 378019 - RNA, 64 nt, Homo Sapiens
ugauauuuuaguauauaguagaacauacuuuuuuuuucuuuaagccaaaugaaaagagguaacu

SEQ ID NO: 378020 - RNA, 64 nt, Homo Sapiens
aacauaguuugugguauuucaguauagaaguuguuuucuuuaggagucuaccuuuguguaugug

SEQ ID NO: 378021 - RNA, 64 nt, Homo Sapiens
aucauaugcucuuuuaaauguuugguuuauauauuuucuuuaaaaauccugggcuggcacauug

SEQ ID NO: 378022 - RNA, 64 nt, Homo Sapiens
uuguguuuuuccaaaggauacuuccuuggcccuuuuucuuuauugacuagaccaccagaggagg

SEQ ID NO: 378023 - RNA, 64 nt, Homo Sapiens
caggcuucccuuccuucccccuccuuagugauuuuuucuuuaacagcauaaguaaagaggacuu

SEQ ID NO: 378024 - RNA, 64 nt, Homo Sapiens
caccauccugucuucucagcaucuccuugccuguuuucuuuauuaguccaaaggaaaacaacag

SEQ ID NO: 378025 - RNA, 64 nt, Homo Sapiens
ugcaaagauucucugguuuuauggcuuuuuucccuuucuuuacaccauccucucccauaagcac

SEQ ID NO: 378026 - RNA, 64 nt, Homo Sapiens
ucacagaggucaguuucucuuugguuuuccagauuuucuuuagaacggugacugacccuccuac

SEQ ID NO: 378027 - RNA, 64 nt, Homo Sapiens
ugccucccaaaguuacuuuaagauccuuagaauauuucuuuaaauauuuuauagacaaaaaauu

SEQ ID NO: 378028 - RNA, 64 nt, Homo Sapiens
auuuaaagacuaucuguauugcaaaauuaaacuauuucuuuaaugaauauauugcuuauuuuaa

SEQ ID NO: 378029 - RNA, 64 nt, Homo Sapiens
ggaaugcauucaaaguggcuuuauaaaagaagauuuucuuuagcaagaauaaugaggucauguc

SEQ ID NO: 378030 - RNA, 64 nt, Homo Sapiens
guauacaugauuuaauuucuaauaaucuuuauguuuucuuuaaggauggugguguauugcucuu

SEQ ID NO: 378031 - RNA, 64 nt, Homo Sapiens
guauuaagaaauuugccuaaaucugaguugugccuuucuuuacucacaaggcaugggcuuuguc

SEQ ID NO: 378032 - RNA, 64 nt, Homo Sapiens
aaaaggguguccagaacuagcgaccgggagagcuuuucuuuaacgauaucaacucuguggugcc

SEQ ID NO: 378033 - RNA, 64 nt, Homo Sapiens
gagacauguggaauuagaguauuuugagguguccuuucuuuacaaaauaauggggucuugggca

SEQ ID NO: 378034 - RNA, 64 nt, Homo Sapiens
acacacuaggcucuuuguguacuccucuuucgucuuucuuuaacggcaugagccacugcaccca

SEQ ID NO: 378035 - RNA, 64 nt, Homo Sapiens
uggguuuaaauuuaacauaauucuuccucuccccuuucuuuauauuuuuuuuuuuuuuuugcuc

SEQ ID NO: 378036 - RNA, 64 nt, Homo Sapiens
uuaaaguaaaauucagaagguaugugaaauuacauuucuuuaauuuuaggcuuagguaauuagg

SEQ ID NO: 378037 - RNA, 64 nt, Homo Sapiens
uaaaacguauguauaauuaauuguguguuuugcuuuucuuuaaaccuuaauugaaaugcugugg

SEQ ID NO: 378038 - RNA, 64 nt, Homo Sapiens
ucaguuuuuucauugcugguacaaugacucaguauuucuuuauaaaaaucuguuguucugaaaa

SEQ ID NO: 378039 - RNA, 64 nt, Homo Sapiens
aauuucaaugaugugaauuuuuaaauuaccuuuauuucuuuaaacuaauuccauugauuguuac

SEQ ID NO: 378040 - RNA, 64 nt, Homo Sapiens
ucucucucuccucaggacccucagcccuggccuuuuucuuuaaggucccccgaccaauccccag

SEQ ID NO: 378041 - RNA, 64 nt, Homo Sapiens
accccgccguucccugcgcuucaucucaugaggauuucuuuaugaggcaaauuuauauuuuuua

SEQ ID NO: 378042 - RNA, 64 nt, Homo Sapiens
ucuugauacauuucuagagauuuauaucauuggcuuucuuuagucagagccacugaaaacuauu

SEQ ID NO: 378043 - RNA, 64 nt, Homo Sapiens
cagagccacugaaaacuauucucauccacacaccuuucuuuacccgugaugugaacccacacuc

SEQ ID NO: 378044 - RNA, 64 nt, Homo Sapiens
uuuugccgagacaugguuaucaauguucucuuuguuucuuuaaguuugcaaguuaaaggaacga

SEQ ID NO: 378045 - RNA, 64 nt, Homo Sapiens
aaaaaaaaauuccaacagaaucgcccuaguuuucuuucuuuaaagcuucugucuggacauugca

SEQ ID NO: 378046 - RNA, 64 nt, Homo Sapiens
aaaagagugaaagcaaauauauuuaucuguaauauuucuuuaaugguuuggugggaguuguuau

SEQ ID NO: 378047 - RNA, 64 nt, Homo Sapiens
aaacauguaaacauggaauauuaggguaacaagauuucuuuaaaugaaaguagaauccguuacu

SEQ ID NO: 378048 - RNA, 64 nt, Homo Sapiens
gaaggucaugucaucuacaaugacucuuugugauuuucuuuacaaguuccaguugcauuuuggc

SEQ ID NO: 378049 - RNA, 64 nt, Homo Sapiens
aaaaaguuauagagacuucuuggccuguuuuuuguuucuuuaaccaggagugagccacugugcc

SEQ ID NO: 378050 - RNA, 64 nt, Homo Sapiens
uuagauguuuaaaggacccuauauguggcauuccuuucuuuaaacuauagguaauuaaggcagc

SEQ ID NO: 378051 - RNA, 64 nt, Homo Sapiens
aauggucagugugcaaagaaaagaacugcuugcauuucuuuauuucugucucauaauugucaaa

SEQ ID NO: 378052 - RNA, 64 nt, Homo Sapiens
cuagacugaagcgauggauuuuuuuuuucuuuuuuuucuuuaguguuuuucccuuuguucuuga

SEQ ID NO: 378053 - RNA, 64 nt, Homo Sapiens
gaagccuccuagcugggauugucuuuguuucaccuuucuuuaaauuagaauuacagaagccccu

SEQ ID NO: 378054 - RNA, 64 nt, Homo Sapiens
ugaagaaaggguauguguguuacagccugaauccuuucuuuaguuuaagacacuuugcuaaaau

SEQ ID NO: 378055 - RNA, 64 nt, Homo Sapiens
gcuuuuuccaugcauucagcuugaaauacuuaguuuucuuuacaauacagaauucauagaauuu

SEQ ID NO: 378056 - RNA, 64 nt, Homo Sapiens
gauuuauuucaauaaaacuaaaaugcuuuaucuuuuucuuuaaagcauuuugacuugucuuuuu

SEQ ID NO: 378057 - RNA, 64 nt, Homo Sapiens
aaucauuuuggauuuuuuucuuaauucuuauauuuuucuuuacuaaacaaauuuaaagggccug

SEQ ID NO: 378058 - RNA, 64 nt, Homo Sapiens
acucuuaccgcauaccacuucacacuuguuuuauuuucuuuaguuuuguuucuuguuauagaau

SEQ ID NO: 378059 - RNA, 64 nt, Homo Sapiens
auccagugaacuguguauguaugugugggguuuuuuucuuuauuuuuaaaugaaaauuaagaca

SEQ ID NO: 378060 - RNA, 64 nt, Homo Sapiens
cccuaugguaauguuugcuuuccucuauccucuguuucuuuaauuugcuaguuaugucuagaga

SEQ ID NO: 378061 - RNA, 64 nt, Homo Sapiens
uggcagugcacuaaaauuuugccacuaugaaauguuucuuuauugugugugcguguguguuuug

SEQ ID NO: 378062 - RNA, 64 nt, Homo Sapiens
gcagaaggagcaaucaagcuuaucuggauauuucuuucuuuauuuauuuuacauggaaauaaua

SEQ ID NO: 378063 - RNA, 64 nt, Homo Sapiens
auuuauuuuacauggaaauaauaugauuucacuuuuucuuuaguuucuuugcucuacgugggca

SEQ ID NO: 378064 - RNA, 64 nt, Homo Sapiens
ucucagccugccuaacuguaagaaauuaauucuuuuucuuuauaaauuacccagguucuguuuu

SEQ ID NO: 378065 - RNA, 64 nt, Homo Sapiens
gauuuuucaguugcuauuucucuucguaaugaauuuucuuuacauccuguccacacugcuggag

SEQ ID NO: 378066 - RNA, 64 nt, Homo Sapiens
aauguuuuuucaaaaaaugugaaauguauuuuauuuucuuuauuuguauucuuguuucauuuuu

SEQ ID NO: 378067 - RNA, 64 nt, Homo Sapiens
agccauuauaugagaacugugaaaccaauaugguuuucuuuaugucuuggcugcuugaaaauua

SEQ ID NO: 378068 - RNA, 64 nt, Homo Sapiens
caaggauuuuuaaaacucaggugacgcuggaccuuuucuuuacccuugcauuuuuuuccuuuau

SEQ ID NO: 378069 - RNA, 64 nt, Homo Sapiens
uggaacgcauuuuggguuguuaaauaacuugccauuucuuuauaacauguaaaaucuugauagc

SEQ ID NO: 378070 - RNA, 64 nt, Homo Sapiens
gccauuuuggagggagcaggaguauaaggaaauguuucuuuauguuccaucuuacuuuuaaucg

SEQ ID NO: 378071 - RNA, 64 nt, Homo Sapiens
auaaccuuugaaccaacaauccaaauggauauauuuucuuuaggauauguacuacuagaaaaua

SEQ ID NO: 378072 - RNA, 64 nt, Homo Sapiens
uguguaaaaauagaauuauugcuucuaguccacuuuucuuuacauuuuauucaauacgcugucc

SEQ ID NO: 378073 - RNA, 64 nt, Homo Sapiens
uuuuauucaauacgcuguccugaauccuauucaguuucuuuaauagaugaggaaaaauagcaac

SEQ ID NO: 378074 - RNA, 64 nt, Homo Sapiens
uuucaacaugaauuuuuuuauuucugucaguuaugacauccacaagcaucacuuuuugugucug

SEQ ID NO: 378075 - RNA, 64 nt, Homo Sapiens
uguggucccuacccugugugaaugugaggauguagacauccaucagugcaacucgagcuccauc

SEQ ID NO: 378076 - RNA, 64 nt, Homo Sapiens
aguggaagagccgggaccuucccccugcacccccgacauccagggacggggugugaggaagacg

SEQ ID NO: 378077 - RNA, 64 nt, Homo Sapiens
aaaguuuuguagugggaccagaaauuacuuaccugacauccacccccauucccccucauccugc

SEQ ID NO: 378078 - RNA, 64 nt, Homo Sapiens
gcggggugacaagugccgugccaccaccuuccaggacauccagcgcugcggaugggcuuuccug

SEQ ID NO: 378079 - RNA, 64 nt, Homo Sapiens
augguggaugaugucuucuagagaagggccagcugacauccagccuguggcucuggacaccuau

SEQ ID NO: 378080 - RNA, 64 nt, Homo Sapiens
uaguguuuguaacaccguccgaaaauccugacaaaagggacacaggcacaaguauuacacauca

SEQ ID NO: 378081 - RNA, 64 nt, Homo Sapiens
cauguugauucuagguugaaauaaauacauaaaaaagggacaaguguuugcaaaaaaaaagaaa

SEQ ID NO: 378082 - RNA, 64 nt, Homo Sapiens
accugugauauuuuacuugaauuugucuccccgaaagggacacaauguggcaugacuaaguacu

SEQ ID NO: 378083 - RNA, 64 nt, Homo Sapiens
uuuucucuuuuuuuggaguugggggcccagggagaagggacaagacuuuuaaaagacuuguuag

SEQ ID NO: 378084 - RNA, 64 nt, Homo Sapiens
cacacugaguuuguacaauuguguuaacugcuggaagggacagaugcacugauauauaugcauu

SEQ ID NO: 378085 - RNA, 64 nt, Homo Sapiens
acgaagccaccagucucccccagggagcaucaggaagggacauggaugugcuccugccacaggg

SEQ ID NO: 378086 - RNA, 64 nt, Homo Sapiens
gaagcauuagcucugauaggucuauaaguguauuaagggacauccuuccauuucauuagagcag

SEQ ID NO: 378087 - RNA, 64 nt, Homo Sapiens
gaaaagcucucauucaggaacucugaagagcaaaaagggacaaacacuaacugcugagcugggc

SEQ ID NO: 378088 - RNA, 64 nt, Homo Sapiens
uacaaaccaggucaccauccuccugguguggguaaagggacagugacuguuccuuauuucucuc

SEQ ID NO: 378089 - RNA, 64 nt, Homo Sapiens
ugggccuggcggccugugggcugggcacugcuccaagggacaggucucugaccucugcugagug

SEQ ID NO: 378090 - RNA, 64 nt, Homo Sapiens
aagcugauagaaagugaacagcaaccugucuggcaagggacaggaaaaagcacugcuaggguua

SEQ ID NO: 378091 - RNA, 64 nt, Homo Sapiens
gggcugaaucucagacuucugugguugcuuggagaagggacauggaugcuggacucauugaaag

SEQ ID NO: 378092 - RNA, 64 nt, Homo Sapiens
guacaaaagagagaaauuuucaacuugagaaauaaagggacagauauuuucccuaagugucagc

SEQ ID NO: 378093 - RNA, 64 nt, Homo Sapiens
cucuggcuuguuaucugcaaccuuaugagaaagaaagggacaggguagaucagcuauaaguauu

SEQ ID NO: 378094 - RNA, 64 nt, Homo Sapiens
aagcugauuuuuuuuuuaacuugaaaagauugcaaagggacauugaaguguuuaaaagagccau

SEQ ID NO: 378095 - RNA, 64 nt, Homo Sapiens
uuacauucuaaguguguucaggcuucugaagguaaagggacacuggauccagaagcuauggaac

SEQ ID NO: 378096 - RNA, 64 nt, Homo Sapiens
gcugagcugggcaugugcugccuguaggggagugaagggacaugcaccacccuggcaguuccag

SEQ ID NO: 378097 - RNA, 64 nt, Homo Sapiens
caguaguguucaacagugcaguauugauugauaaaagggacaggucuaaauuuuaggagaacgg

SEQ ID NO: 378098 - RNA, 64 nt, Homo Sapiens
gagggaaaauguuaaugugugagaacuuacauucaagggacauacaguauacagaaaauuuuaa

SEQ ID NO: 378099 - RNA, 64 nt, Homo Sapiens
augugguucguauugaucaaacuuagucuuugagaagggacaguauuugggugaaaaauaagga

SEQ ID NO: 378100 - RNA, 64 nt, Homo Sapiens; identical to SEQ ID NO: 56766

SEQ ID NO: 378101 - RNA, 64 nt, Homo Sapiens; identical to SEQ ID NO: 56767

SEQ ID NO: 378102 - RNA, 64 nt, Homo Sapiens; identical to SEQ ID NO: 56768

SEQ ID NO: 378103 - RNA, 64 nt, Homo Sapiens; identical to SEQ ID NO: 56769

SEQ ID NO: 378104 - RNA, 64 nt, Homo Sapiens; identical to SEQ ID NO: 56770

SEQ ID NO: 378105 - RNA, 64 nt, Homo Sapiens; identical to SEQ ID NO: 56771

SEQ ID NO: 378106 - RNA, 64 nt, Homo Sapiens; identical to SEQ ID NO: 56772

SEQ ID NO: 378107 - RNA, 64 nt, Homo Sapiens; identical to SEQ ID NO: 56773

SEQ ID NO: 378108 - RNA, 64 nt, Homo Sapiens; identical to SEQ ID NO: 56774

SEQ ID NO: 378109 - RNA, 64 nt, Homo Sapiens; identical to SEQ ID NO: 56775

SEQ ID NO: 378110 - RNA, 64 nt, Homo Sapiens; identical to SEQ ID NO: 56776

SEQ ID NO: 378111 - RNA, 64 nt, Homo Sapiens; identical to SEQ ID NO: 56777

SEQ ID NO: 378112 - RNA, 64 nt, Homo Sapiens; identical to SEQ ID NO: 56778

SEQ ID NO: 378113 - RNA, 64 nt, Homo Sapiens; identical to SEQ ID NO: 56779

SEQ ID NO: 378114 - RNA, 64 nt, Homo Sapiens; identical to SEQ ID NO: 56780

SEQ ID NO: 378115 - RNA, 64 nt, Homo Sapiens; identical to SEQ ID NO: 56781

SEQ ID NO: 378116 - RNA, 64 nt, Homo Sapiens; identical to SEQ ID NO: 56782

SEQ ID NO: 378117 - RNA, 64 nt, Homo Sapiens; identical to SEQ ID NO: 56783

SEQ ID NO: 378118 - RNA, 64 nt, Homo Sapiens; identical to SEQ ID NO: 56784

SEQ ID NO: 378119 - RNA, 64 nt, Homo Sapiens; identical to SEQ ID NO: 56785

SEQ ID NO: 378120 - RNA, 64 nt, Homo Sapiens; identical to SEQ ID NO: 56786

SEQ ID NO: 378121 - RNA, 64 nt, Homo Sapiens; identical to SEQ ID NO: 56787

SEQ ID NO: 378122 - RNA, 64 nt, Homo Sapiens; identical to SEQ ID NO: 56788

SEQ ID NO: 378123 - RNA, 64 nt, Homo Sapiens; identical to SEQ ID NO: 56789

SEQ ID NO: 378124 - RNA, 64 nt, Homo Sapiens; identical to SEQ ID NO: 56790

SEQ ID NO: 378125 - RNA, 64 nt, Homo Sapiens; identical to SEQ ID NO: 56791

SEQ ID NO: 378126 - RNA, 64 nt, Homo Sapiens; identical to SEQ ID NO: 56792

SEQ ID NO: 378127 - RNA, 64 nt, Homo Sapiens; identical to SEQ ID NO: 56793

SEQ ID NO: 378128 - RNA, 64 nt, Homo Sapiens; identical to SEQ ID NO: 56794

SEQ ID NO: 378129 - RNA, 64 nt, Homo Sapiens; identical to SEQ ID NO: 56795

SEQ ID NO: 378130 - RNA, 64 nt, Homo Sapiens; identical to SEQ ID NO: 56796

SEQ ID NO: 378131 - RNA, 64 nt, Homo Sapiens; identical to SEQ ID NO: 56797

SEQ ID NO: 378132 - RNA, 64 nt, Homo Sapiens; identical to SEQ ID NO: 56798

SEQ ID NO: 378133 - RNA, 64 nt, Homo Sapiens; identical to SEQ ID NO: 56799

SEQ ID NO: 378134 - RNA, 64 nt, Homo Sapiens; identical to SEQ ID NO: 56800

SEQ ID NO: 378135 - RNA, 64 nt, Homo Sapiens; identical to SEQ ID NO: 56801

SEQ ID NO: 378136 - RNA, 64 nt, Homo Sapiens; identical to SEQ ID NO: 56802

SEQ ID NO: 378137 - RNA, 64 nt, Homo Sapiens; identical to SEQ ID NO: 56803

SEQ ID NO: 378138 - RNA, 64 nt, Homo Sapiens; identical to SEQ ID NO: 56804

SEQ ID NO: 378139 - RNA, 64 nt, Homo Sapiens; identical to SEQ ID NO: 56805

SEQ ID NO: 378140 - RNA, 64 nt, Homo Sapiens; identical to SEQ ID NO: 56806

SEQ ID NO: 378141 - RNA, 64 nt, Homo Sapiens; identical to SEQ ID NO: 56807

SEQ ID NO: 378142 - RNA, 64 nt, Homo Sapiens; identical to SEQ ID NO: 56808

SEQ ID NO: 378143 - RNA, 64 nt, Homo Sapiens; identical to SEQ ID NO: 56809

SEQ ID NO: 378144 - RNA, 64 nt, Homo Sapiens; identical to SEQ ID NO: 56810

SEQ ID NO: 378145 - RNA, 64 nt, Homo Sapiens; identical to SEQ ID NO: 56811

SEQ ID NO: 378146 - RNA, 63 nt, Homo Sapiens; identical to SEQ ID NO: 56812

SEQ ID NO: 378147 - RNA, 64 nt, Homo Sapiens; identical to SEQ ID NO: 56813

SEQ ID NO: 378148 - RNA, 64 nt, Homo Sapiens; identical to SEQ ID NO: 56814

SEQ ID NO: 378149 - RNA, 64 nt, Homo Sapiens; identical to SEQ ID NO: 56815

SEQ ID NO: 378150 - RNA, 64 nt, Homo Sapiens; identical to SEQ ID NO: 56816

SEQ ID NO: 378151 - RNA, 64 nt, Homo Sapiens; identical to SEQ ID NO: 56817

SEQ ID NO: 378152 - RNA, 64 nt, Homo Sapiens; identical to SEQ ID NO: 56818

SEQ ID NO: 378153 - RNA, 64 nt, Homo Sapiens; identical to SEQ ID NO: 56819

SEQ ID NO: 378154 - RNA, 64 nt, Homo Sapiens; identical to SEQ ID NO: 56820

SEQ ID NO: 378155 - RNA, 64 nt, Homo Sapiens; identical to SEQ ID NO: 56821

SEQ ID NO: 378156 - RNA, 64 nt, Homo Sapiens; identical to SEQ ID NO: 56822

SEQ ID NO: 378157 - RNA, 64 nt, Homo Sapiens; identical to SEQ ID NO: 56823

SEQ ID NO: 378158 - RNA, 64 nt, Homo Sapiens; identical to SEQ ID NO: 56824

SEQ ID NO: 378159 - RNA, 64 nt, Homo Sapiens; identical to SEQ ID NO: 56825

SEQ ID NO: 378160 - RNA, 64 nt, Homo Sapiens; identical to SEQ ID NO: 56826

SEQ ID NO: 378161 - RNA, 64 nt, Homo Sapiens; identical to SEQ ID NO: 56827

SEQ ID NO: 378162 - RNA, 64 nt, Homo Sapiens; identical to SEQ ID NO: 56828

SEQ ID NO: 378163 - RNA, 64 nt, Homo Sapiens; identical to SEQ ID NO: 56829

SEQ ID NO: 378164 - RNA, 64 nt, Homo Sapiens; identical to SEQ ID NO: 56830

SEQ ID NO: 378165 - RNA, 64 nt, Homo Sapiens; identical to SEQ ID NO: 56831

SEQ ID NO: 378166 - RNA, 64 nt, Homo Sapiens; identical to SEQ ID NO: 56832

SEQ ID NO: 378167 - RNA, 64 nt, Homo Sapiens; identical to SEQ ID NO: 56833

SEQ ID NO: 378168 - RNA, 64 nt, Homo Sapiens; identical to SEQ ID NO: 56834

SEQ ID NO: 378169 - RNA, 64 nt, Homo Sapiens; identical to SEQ ID NO: 212978

SEQ ID NO: 378170 - RNA, 64 nt, Homo Sapiens; identical to SEQ ID NO: 212979

SEQ ID NO: 378171 - RNA, 64 nt, Homo Sapiens; identical to SEQ ID NO: 212980

SEQ ID NO: 378172 - RNA, 64 nt, Homo Sapiens; identical to SEQ ID NO: 212981

SEQ ID NO: 378173 - RNA, 64 nt, Homo Sapiens; identical to SEQ ID NO: 212982

SEQ ID NO: 378174 - RNA, 64 nt, Homo Sapiens; identical to SEQ ID NO: 212983

SEQ ID NO: 378175 - RNA, 64 nt, Homo Sapiens; identical to SEQ ID NO: 212984

SEQ ID NO: 378176 - RNA, 64 nt, Homo Sapiens; identical to SEQ ID NO: 212985

SEQ ID NO: 378177 - RNA, 64 nt, Homo Sapiens; identical to SEQ ID NO: 212986

SEQ ID NO: 378178 - RNA, 64 nt, Homo Sapiens; identical to SEQ ID NO: 212987

SEQ ID NO: 378179 - RNA, 64 nt, Homo Sapiens; identical to SEQ ID NO: 212988

SEQ ID NO: 378180 - RNA, 64 nt, Homo Sapiens; identical to SEQ ID NO: 212989

SEQ ID NO: 378181 - RNA, 64 nt, Homo Sapiens; identical to SEQ ID NO: 212990

SEQ ID NO: 378182 - RNA, 64 nt, Homo Sapiens; identical to SEQ ID NO: 212991

SEQ ID NO: 378183 - RNA, 64 nt, Homo Sapiens; identical to SEQ ID NO: 212992

SEQ ID NO: 378184 - RNA, 64 nt, Homo Sapiens; identical to SEQ ID NO: 212993

SEQ ID NO: 378185 - RNA, 64 nt, Homo Sapiens; identical to SEQ ID NO: 212994

SEQ ID NO: 378186 - RNA, 64 nt, Homo Sapiens; identical to SEQ ID NO: 212995

SEQ ID NO: 378187 - RNA, 64 nt, Homo Sapiens; identical to SEQ ID NO: 212996

SEQ ID NO: 378188 - RNA, 64 nt, Homo Sapiens; identical to SEQ ID NO: 212997

SEQ ID NO: 378189 - RNA, 64 nt, Homo Sapiens; identical to SEQ ID NO: 212998

SEQ ID NO: 378190 - RNA, 64 nt, Homo Sapiens; identical to SEQ ID NO: 212999

SEQ ID NO: 378191 - RNA, 64 nt, Homo Sapiens; identical to SEQ ID NO: 213000

SEQ ID NO: 378192 - RNA, 64 nt, Homo Sapiens; identical to SEQ ID NO: 213001

SEQ ID NO: 378193 - RNA, 64 nt, Homo Sapiens; identical to SEQ ID NO: 213002

SEQ ID NO: 378194 - RNA, 64 nt, Homo Sapiens; identical to SEQ ID NO: 213003

SEQ ID NO: 378195 - RNA, 64 nt, Homo Sapiens; identical to SEQ ID NO: 213004

SEQ ID NO: 378196 - RNA, 64 nt, Homo Sapiens; identical to SEQ ID NO: 213005

SEQ ID NO: 378197 - RNA, 64 nt, Homo Sapiens; identical to SEQ ID NO: 213006

SEQ ID NO: 378198 - RNA, 64 nt, Homo Sapiens; identical to SEQ ID NO: 213007

SEQ ID NO: 378199 - RNA, 64 nt, Homo Sapiens; identical to SEQ ID NO: 213008

SEQ ID NO: 378200 - RNA, 64 nt, Homo Sapiens; identical to SEQ ID NO: 213009

SEQ ID NO: 378201 - RNA, 64 nt, Homo Sapiens; identical to SEQ ID NO: 213010

SEQ ID NO: 378202 - RNA, 64 nt, Homo Sapiens; identical to SEQ ID NO: 213011

SEQ ID NO: 378203 - RNA, 64 nt, Homo Sapiens; identical to SEQ ID NO: 213012

SEQ ID NO: 378204 - RNA, 64 nt, Homo Sapiens; identical to SEQ ID NO: 213013

SEQ ID NO: 378205 - RNA, 64 nt, Homo Sapiens; identical to SEQ ID NO: 213014

SEQ ID NO: 378206 - RNA, 64 nt, Homo Sapiens; identical to SEQ ID NO: 213015

SEQ ID NO: 378207 - RNA, 64 nt, Homo Sapiens; identical to SEQ ID NO: 213016

SEQ ID NO: 378208 - RNA, 64 nt, Homo Sapiens; identical to SEQ ID NO: 213017

SEQ ID NO: 378209 - RNA, 64 nt, Homo Sapiens; identical to SEQ ID NO: 213018

SEQ ID NO: 378210 - RNA, 64 nt, Homo Sapiens; identical to SEQ ID NO: 213019

SEQ ID NO: 378211 - RNA, 64 nt, Homo Sapiens; identical to SEQ ID NO: 213020

SEQ ID NO: 378212 - RNA, 64 nt, Homo Sapiens; identical to SEQ ID NO: 213021

SEQ ID NO: 378213 - RNA, 64 nt, Homo Sapiens; identical to SEQ ID NO: 213022

SEQ ID NO: 378214 - RNA, 64 nt, Homo Sapiens; identical to SEQ ID NO: 213023

SEQ ID NO: 378215 - RNA, 64 nt, Homo Sapiens; identical to SEQ ID NO: 213024

SEQ ID NO: 378216 - RNA, 64 nt, Homo Sapiens; identical to SEQ ID NO: 213025

SEQ ID NO: 378217 - RNA, 64 nt, Homo Sapiens; identical to SEQ ID NO: 213026

SEQ ID NO: 378218 - RNA, 64 nt, Homo Sapiens; identical to SEQ ID NO: 213027

SEQ ID NO: 378219 - RNA, 64 nt, Homo Sapiens; identical to SEQ ID NO: 213028

SEQ ID NO: 378220 - RNA, 64 nt, Homo Sapiens; identical to SEQ ID NO: 213029

SEQ ID NO: 378221 - RNA, 64 nt, Homo Sapiens; identical to SEQ ID NO: 213030

SEQ ID NO: 378222 - RNA, 64 nt, Homo Sapiens; identical to SEQ ID NO: 213031

SEQ ID NO: 378223 - RNA, 64 nt, Homo Sapiens; identical to SEQ ID NO: 213032

SEQ ID NO: 378224 - RNA, 64 nt, Homo Sapiens; identical to SEQ ID NO: 213033

SEQ ID NO: 378225 - RNA, 64 nt, Homo Sapiens; identical to SEQ ID NO: 213034

SEQ ID NO: 378226 - RNA, 64 nt, Homo Sapiens; identical to SEQ ID NO: 213035

SEQ ID NO: 378227 - RNA, 64 nt, Homo Sapiens; identical to SEQ ID NO: 213036

SEQ ID NO: 378228 - RNA, 64 nt, Homo Sapiens; identical to SEQ ID NO: 213037

SEQ ID NO: 378229 - RNA, 64 nt, Homo Sapiens; identical to SEQ ID NO: 213038

SEQ ID NO: 378230 - RNA, 64 nt, Homo Sapiens; identical to SEQ ID NO: 213039

SEQ ID NO: 378231 - RNA, 64 nt, Homo Sapiens; identical to SEQ ID NO: 213040

SEQ ID NO: 378232 - RNA, 64 nt, Homo Sapiens; identical to SEQ ID NO: 213041

SEQ ID NO: 378233 - RNA, 64 nt, Homo Sapiens; identical to SEQ ID NO: 213042

SEQ ID NO: 378234 - RNA, 64 nt, Homo Sapiens; identical to SEQ ID NO: 213043

SEQ ID NO: 378235 - RNA, 64 nt, Homo Sapiens; identical to SEQ ID NO: 213044

SEQ ID NO: 378236 - RNA, 64 nt, Homo Sapiens; identical to SEQ ID NO: 213045

SEQ ID NO: 378237 - RNA, 64 nt, Homo Sapiens; identical to SEQ ID NO: 213046

SEQ ID NO: 378238 - RNA, 57 nt, Homo Sapiens; identical to SEQ ID NO: 213047

SEQ ID NO: 378239 - RNA, 64 nt, Homo Sapiens; identical to SEQ ID NO: 213048

SEQ ID NO: 378240 - RNA, 64 nt, Homo Sapiens; identical to SEQ ID NO: 213049

SEQ ID NO: 378241 - RNA, 64 nt, Homo Sapiens; identical to SEQ ID NO: 213050

SEQ ID NO: 378242 - RNA, 64 nt, Homo Sapiens; identical to SEQ ID NO: 213051

SEQ ID NO: 378243 - RNA, 64 nt, Homo Sapiens; identical to SEQ ID NO: 213052

SEQ ID NO: 378244 - RNA, 64 nt, Homo Sapiens; identical to SEQ ID NO: 213053

SEQ ID NO: 378245 - RNA, 64 nt, Homo Sapiens; identical to SEQ ID NO: 213054

SEQ ID NO: 378246 - RNA, 64 nt, Homo Sapiens; identical to SEQ ID NO: 213055

SEQ ID NO: 378247 - RNA, 64 nt, Homo Sapiens; identical to SEQ ID NO: 213056

SEQ ID NO: 378248 - RNA, 64 nt, Homo Sapiens; identical to SEQ ID NO: 213057

SEQ ID NO: 378249 - RNA, 64 nt, Homo Sapiens; identical to SEQ ID NO: 213058

SEQ ID NO: 378250 - RNA, 64 nt, Homo Sapiens; identical to SEQ ID NO: 213059

SEQ ID NO: 378251 - RNA, 64 nt, Homo Sapiens; identical to SEQ ID NO: 213060

SEQ ID NO: 378252 - RNA, 64 nt, Homo Sapiens; identical to SEQ ID NO: 213061

SEQ ID NO: 378253 - RNA, 64 nt, Homo Sapiens; identical to SEQ ID NO: 213062

SEQ ID NO: 378254 - RNA, 64 nt, Homo Sapiens; identical to SEQ ID NO: 213063

SEQ ID NO: 378255 - RNA, 64 nt, Homo Sapiens; identical to SEQ ID NO: 213064

SEQ ID NO: 378256 - RNA, 64 nt, Homo Sapiens; identical to SEQ ID NO: 213065

SEQ ID NO: 378257 - RNA, 64 nt, Homo Sapiens; identical to SEQ ID NO: 213066

SEQ ID NO: 378258 - RNA, 64 nt, Homo Sapiens; identical to SEQ ID NO: 213067

SEQ ID NO: 378259 - RNA, 64 nt, Homo Sapiens; identical to SEQ ID NO: 213068

SEQ ID NO: 378260 - RNA, 64 nt, Homo Sapiens; identical to SEQ ID NO: 213069

SEQ ID NO: 378261 - RNA, 64 nt, Homo Sapiens; identical to SEQ ID NO: 213070

SEQ ID NO: 378262 - RNA, 64 nt, Homo Sapiens; identical to SEQ ID NO: 213071

SEQ ID NO: 378263 - RNA, 64 nt, Homo Sapiens; identical to SEQ ID NO: 213072

SEQ ID NO: 378264 - RNA, 64 nt, Homo Sapiens; identical to SEQ ID NO: 213073

SEQ ID NO: 378265 - RNA, 64 nt, Homo Sapiens; identical to SEQ ID NO: 213074

SEQ ID NO: 378266 - RNA, 64 nt, Homo Sapiens; identical to SEQ ID NO: 213075

SEQ ID NO: 378267 - RNA, 64 nt, Homo Sapiens; identical to SEQ ID NO: 213076

SEQ ID NO: 378268 - RNA, 64 nt, Homo Sapiens; identical to SEQ ID NO: 213077

SEQ ID NO: 378269 - RNA, 64 nt, Homo Sapiens; identical to SEQ ID NO: 213078

SEQ ID NO: 378270 - RNA, 64 nt, Homo Sapiens; identical to SEQ ID NO: 213079

SEQ ID NO: 378271 - RNA, 64 nt, Homo Sapiens; identical to SEQ ID NO: 213080

SEQ ID NO: 378272 - RNA, 64 nt, Homo Sapiens; identical to SEQ ID NO: 213081

SEQ ID NO: 378273 - RNA, 64 nt, Homo Sapiens; identical to SEQ ID NO: 213082

SEQ ID NO: 378274 - RNA, 64 nt, Homo Sapiens; identical to SEQ ID NO: 213083

SEQ ID NO: 378275 - RNA, 64 nt, Homo Sapiens; identical to SEQ ID NO: 213084

SEQ ID NO: 378276 - RNA, 64 nt, Homo Sapiens; identical to SEQ ID NO: 213085

SEQ ID NO: 378277 - RNA, 64 nt, Homo Sapiens; identical to SEQ ID NO: 213086

SEQ ID NO: 378278 - RNA, 64 nt, Homo Sapiens; identical to SEQ ID NO: 213087

SEQ ID NO: 378279 - RNA, 64 nt, Homo Sapiens; identical to SEQ ID NO: 213088

SEQ ID NO: 378280 - RNA, 64 nt, Homo Sapiens; identical to SEQ ID NO: 213089

SEQ ID NO: 378281 - RNA, 64 nt, Homo Sapiens; identical to SEQ ID NO: 213090

SEQ ID NO: 378282 - RNA, 64 nt, Homo Sapiens; identical to SEQ ID NO: 213091

SEQ ID NO: 378283 - RNA, 64 nt, Homo Sapiens; identical to SEQ ID NO: 213092

SEQ ID NO: 378284 - RNA, 64 nt, Homo Sapiens; identical to SEQ ID NO: 213093

SEQ ID NO: 378285 - RNA, 64 nt, Homo Sapiens; identical to SEQ ID NO: 213094

SEQ ID NO: 378286 - RNA, 64 nt, Homo Sapiens; identical to SEQ ID NO: 213095

SEQ ID NO: 378287 - RNA, 64 nt, Homo Sapiens; identical to SEQ ID NO: 213096

SEQ ID NO: 378288 - RNA, 64 nt, Homo Sapiens; identical to SEQ ID NO: 213097

SEQ ID NO: 378289 - RNA, 64 nt, Homo Sapiens; identical to SEQ ID NO: 213098

SEQ ID NO: 378290 - RNA, 64 nt, Homo Sapiens; identical to SEQ ID NO: 213099

SEQ ID NO: 378291 - RNA, 64 nt, Homo Sapiens; identical to SEQ ID NO: 213100

SEQ ID NO: 378292 - RNA, 64 nt, Homo Sapiens; identical to SEQ ID NO: 213101

SEQ ID NO: 378293 - RNA, 64 nt, Homo Sapiens; identical to SEQ ID NO: 213102

SEQ ID NO: 378294 - RNA, 64 nt, Homo Sapiens; identical to SEQ ID NO: 213103

SEQ ID NO: 378295 - RNA, 64 nt, Homo Sapiens; identical to SEQ ID NO: 213104

SEQ ID NO: 378296 - RNA, 64 nt, Homo Sapiens; identical to SEQ ID NO: 213105

SEQ ID NO: 378297 - RNA, 64 nt, Homo Sapiens; identical to SEQ ID NO: 213106

SEQ ID NO: 378298 - RNA, 64 nt, Homo Sapiens; identical to SEQ ID NO: 213107

SEQ ID NO: 378299 - RNA, 64 nt, Homo Sapiens; identical to SEQ ID NO: 213108

SEQ ID NO: 378300 - RNA, 64 nt, Homo Sapiens; identical to SEQ ID NO: 213109

SEQ ID NO: 378301 - RNA, 64 nt, Homo Sapiens; identical to SEQ ID NO: 213110

SEQ ID NO: 378302 - RNA, 64 nt, Homo Sapiens; identical to SEQ ID NO: 213111

SEQ ID NO: 378303 - RNA, 64 nt, Homo Sapiens; identical to SEQ ID NO: 213112

SEQ ID NO: 378304 - RNA, 64 nt, Homo Sapiens; identical to SEQ ID NO: 213113

SEQ ID NO: 378305 - RNA, 64 nt, Homo Sapiens; identical to SEQ ID NO: 213114

SEQ ID NO: 378306 - RNA, 64 nt, Homo Sapiens; identical to SEQ ID NO: 213115

SEQ ID NO: 378307 - RNA, 64 nt, Homo Sapiens; identical to SEQ ID NO: 213116

SEQ ID NO: 378308 - RNA, 64 nt, Homo Sapiens; identical to SEQ ID NO: 213117

SEQ ID NO: 378309 - RNA, 64 nt, Homo Sapiens; identical to SEQ ID NO: 213118

SEQ ID NO: 378310 - RNA, 64 nt, Homo Sapiens; identical to SEQ ID NO: 213119

SEQ ID NO: 378311 - RNA, 64 nt, Homo Sapiens; identical to SEQ ID NO: 213120

SEQ ID NO: 378312 - RNA, 64 nt, Homo Sapiens; identical to SEQ ID NO: 213121

SEQ ID NO: 378313 - RNA, 64 nt, Homo Sapiens; identical to SEQ ID NO: 213122

SEQ ID NO: 378314 - RNA, 64 nt, Homo Sapiens; identical to SEQ ID NO: 213123

SEQ ID NO: 378315 - RNA, 64 nt, Homo Sapiens; identical to SEQ ID NO: 213124

SEQ ID NO: 378316 - RNA, 64 nt, Homo Sapiens; identical to SEQ ID NO: 213125

SEQ ID NO: 378317 - RNA, 64 nt, Homo Sapiens; identical to SEQ ID NO: 213126

SEQ ID NO: 378318 - RNA, 64 nt, Homo Sapiens; identical to SEQ ID NO: 213127

SEQ ID NO: 378319 - RNA, 60 nt, Homo Sapiens; identical to SEQ ID NO: 213128

SEQ ID NO: 378320 - RNA, 64 nt, Homo Sapiens; identical to SEQ ID NO: 213129

SEQ ID NO: 378321 - RNA, 64 nt, Homo Sapiens; identical to SEQ ID NO: 213130

SEQ ID NO: 378322 - RNA, 64 nt, Homo Sapiens; identical to SEQ ID NO: 213131

SEQ ID NO: 378323 - RNA, 64 nt, Homo Sapiens; identical to SEQ ID NO: 213132

SEQ ID NO: 378324 - RNA, 64 nt, Homo Sapiens; identical to SEQ ID NO: 213133

SEQ ID NO: 378325 - RNA, 64 nt, Homo Sapiens; identical to SEQ ID NO: 213134

SEQ ID NO: 378326 - RNA, 64 nt, Homo Sapiens; identical to SEQ ID NO: 213135

SEQ ID NO: 378327 - RNA, 64 nt, Homo Sapiens; identical to SEQ ID NO: 213136

SEQ ID NO: 378328 - RNA, 64 nt, Homo Sapiens; identical to SEQ ID NO: 213137

SEQ ID NO: 378329 - RNA, 64 nt, Homo Sapiens; identical to SEQ ID NO: 213138

SEQ ID NO: 378330 - RNA, 64 nt, Homo Sapiens; identical to SEQ ID NO: 213139

SEQ ID NO: 378331 - RNA, 64 nt, Homo Sapiens; identical to SEQ ID NO: 213140

SEQ ID NO: 378332 - RNA, 64 nt, Homo Sapiens; identical to SEQ ID NO: 213141

SEQ ID NO: 378333 - RNA, 64 nt, Homo Sapiens; identical to SEQ ID NO: 213142

SEQ ID NO: 378334 - RNA, 64 nt, Homo Sapiens; identical to SEQ ID NO: 213143

SEQ ID NO: 378335 - RNA, 64 nt, Homo Sapiens; identical to SEQ ID NO: 213144

SEQ ID NO: 378336 - RNA, 64 nt, Homo Sapiens; identical to SEQ ID NO: 213145

SEQ ID NO: 378337 - RNA, 64 nt, Homo Sapiens; identical to SEQ ID NO: 213146

SEQ ID NO: 378338 - RNA, 64 nt, Homo Sapiens; identical to SEQ ID NO: 213147

SEQ ID NO: 378339 - RNA, 64 nt, Homo Sapiens; identical to SEQ ID NO: 213148

SEQ ID NO: 378340 - RNA, 64 nt, Homo Sapiens; identical to SEQ ID NO: 213149

SEQ ID NO: 378341 - RNA, 64 nt, Homo Sapiens; identical to SEQ ID NO: 80933

SEQ ID NO: 378342 - RNA, 64 nt, Homo Sapiens; identical to SEQ ID NO: 80934

SEQ ID NO: 378343 - RNA, 64 nt, Homo Sapiens; identical to SEQ ID NO: 80935

SEQ ID NO: 378344 - RNA, 64 nt, Homo Sapiens; identical to SEQ ID NO: 80936

SEQ ID NO: 378345 - RNA, 64 nt, Homo Sapiens; identical to SEQ ID NO: 80937

SEQ ID NO: 378346 - RNA, 64 nt, Homo Sapiens; identical to SEQ ID NO: 80938

SEQ ID NO: 378347 - RNA, 64 nt, Homo Sapiens; identical to SEQ ID NO: 80939

SEQ ID NO: 378348 - RNA, 64 nt, Homo Sapiens; identical to SEQ ID NO: 80940

SEQ ID NO: 378349 - RNA, 64 nt, Homo Sapiens; identical to SEQ ID NO: 80941

SEQ ID NO: 378350 - RNA, 64 nt, Homo Sapiens; identical to SEQ ID NO: 80942

SEQ ID NO: 378351 - RNA, 64 nt, Homo Sapiens; identical to SEQ ID NO: 80943

SEQ ID NO: 378352 - RNA, 64 nt, Homo Sapiens; identical to SEQ ID NO: 80944

SEQ ID NO: 378353 - RNA, 64 nt, Homo Sapiens; identical to SEQ ID NO: 80945

SEQ ID NO: 378354 - RNA, 64 nt, Homo Sapiens; identical to SEQ ID NO: 80946

SEQ ID NO: 378355 - RNA, 64 nt, Homo Sapiens; identical to SEQ ID NO: 80947

SEQ ID NO: 378356 - RNA, 64 nt, Homo Sapiens; identical to SEQ ID NO: 80948

SEQ ID NO: 378357 - RNA, 64 nt, Homo Sapiens; identical to SEQ ID NO: 80949

SEQ ID NO: 378358 - RNA, 64 nt, Homo Sapiens; identical to SEQ ID NO: 80950

SEQ ID NO: 378359 - RNA, 64 nt, Homo Sapiens; identical to SEQ ID NO: 80951

SEQ ID NO: 378360 - RNA, 64 nt, Homo Sapiens; identical to SEQ ID NO: 80952

SEQ ID NO: 378361 - RNA, 64 nt, Homo Sapiens; identical to SEQ ID NO: 80953

SEQ ID NO: 378362 - RNA, 64 nt, Homo Sapiens; identical to SEQ ID NO: 80954

SEQ ID NO: 378363 - RNA, 63 nt, Homo Sapiens; identical to SEQ ID NO: 80955

SEQ ID NO: 378364 - RNA, 64 nt, Homo Sapiens; identical to SEQ ID NO: 80956

SEQ ID NO: 378365 - RNA, 64 nt, Homo Sapiens; identical to SEQ ID NO: 80957

SEQ ID NO: 378366 - RNA, 64 nt, Homo Sapiens; identical to SEQ ID NO: 80958

SEQ ID NO: 378367 - RNA, 64 nt, Homo Sapiens; identical to SEQ ID NO: 80959

SEQ ID NO: 378368 - RNA, 64 nt, Homo Sapiens; identical to SEQ ID NO: 80960

SEQ ID NO: 378369 - RNA, 64 nt, Homo Sapiens; identical to SEQ ID NO: 80961

SEQ ID NO: 378370 - RNA, 64 nt, Homo Sapiens; identical to SEQ ID NO: 80962

SEQ ID NO: 378371 - RNA, 64 nt, Homo Sapiens; identical to SEQ ID NO: 80963

SEQ ID NO: 378372 - RNA, 64 nt, Homo Sapiens; identical to SEQ ID NO: 80964

SEQ ID NO: 378373 - RNA, 64 nt, Homo Sapiens; identical to SEQ ID NO: 80965

SEQ ID NO: 378374 - RNA, 64 nt, Homo Sapiens; identical to SEQ ID NO: 80966

SEQ ID NO: 378375 - RNA, 64 nt, Homo Sapiens; identical to SEQ ID NO: 80967

SEQ ID NO: 378376 - RNA, 64 nt, Homo Sapiens; identical to SEQ ID NO: 80968

SEQ ID NO: 378377 - RNA, 64 nt, Homo Sapiens; identical to SEQ ID NO: 80969

SEQ ID NO: 378378 - RNA, 64 nt, Homo Sapiens; identical to SEQ ID NO: 80970

SEQ ID NO: 378379 - RNA, 64 nt, Homo Sapiens; identical to SEQ ID NO: 80971

SEQ ID NO: 378380 - RNA, 64 nt, Homo Sapiens; identical to SEQ ID NO: 80972

SEQ ID NO: 378381 - RNA, 64 nt, Homo Sapiens; identical to SEQ ID NO: 80973

SEQ ID NO: 378382 - RNA, 64 nt, Homo Sapiens; identical to SEQ ID NO: 80974

SEQ ID NO: 378383 - RNA, 64 nt, Homo Sapiens; identical to SEQ ID NO: 80975

SEQ ID NO: 378384 - RNA, 64 nt, Homo Sapiens; identical to SEQ ID NO: 80976

SEQ ID NO: 378385 - RNA, 64 nt, Homo Sapiens; identical to SEQ ID NO: 80977

SEQ ID NO: 378386 - RNA, 64 nt, Homo Sapiens; identical to SEQ ID NO: 80978

SEQ ID NO: 378387 - RNA, 64 nt, Homo Sapiens; identical to SEQ ID NO: 80979

SEQ ID NO: 378388 - RNA, 64 nt, Homo Sapiens; identical to SEQ ID NO: 80980

SEQ ID NO: 378389 - RNA, 64 nt, Homo Sapiens; identical to SEQ ID NO: 80981

SEQ ID NO: 378390 - RNA, 64 nt, Homo Sapiens; identical to SEQ ID NO: 80982

SEQ ID NO: 378391 - RNA, 64 nt, Homo Sapiens; identical to SEQ ID NO: 80983

SEQ ID NO: 378392 - RNA, 64 nt, Homo Sapiens; identical to SEQ ID NO: 80984

SEQ ID NO: 378393 - RNA, 64 nt, Homo Sapiens; identical to SEQ ID NO: 80985

SEQ ID NO: 378394 - RNA, 64 nt, Homo Sapiens; identical to SEQ ID NO: 80986

SEQ ID NO: 378395 - RNA, 64 nt, Homo Sapiens; identical to SEQ ID NO: 80987

SEQ ID NO: 378396 - RNA, 64 nt, Homo Sapiens; identical to SEQ ID NO: 80988

SEQ ID NO: 378397 - RNA, 64 nt, Homo Sapiens; identical to SEQ ID NO: 80989

SEQ ID NO: 378398 - RNA, 64 nt, Homo Sapiens; identical to SEQ ID NO: 80990

SEQ ID NO: 378399 - RNA, 64 nt, Homo Sapiens; identical to SEQ ID NO: 80991

SEQ ID NO: 378400 - RNA, 64 nt, Homo Sapiens; identical to SEQ ID NO: 80992

SEQ ID NO: 378401 - RNA, 64 nt, Homo Sapiens; identical to SEQ ID NO: 80993

SEQ ID NO: 378402 - RNA, 64 nt, Homo Sapiens; identical to SEQ ID NO: 80994

SEQ ID NO: 378403 - RNA, 64 nt, Homo Sapiens; identical to SEQ ID NO: 80995

SEQ ID NO: 378404 - RNA, 64 nt, Homo Sapiens; identical to SEQ ID NO: 80996

SEQ ID NO: 378405 - RNA, 64 nt, Homo Sapiens; identical to SEQ ID NO: 80997

SEQ ID NO: 378406 - RNA, 64 nt, Homo Sapiens; identical to SEQ ID NO: 80998

SEQ ID NO: 378407 - RNA, 64 nt, Homo Sapiens; identical to SEQ ID NO: 80999

SEQ ID NO: 378408 - RNA, 64 nt, Homo Sapiens; identical to SEQ ID NO: 81000

SEQ ID NO: 378409 - RNA, 64 nt, Homo Sapiens; identical to SEQ ID NO: 81001

SEQ ID NO: 378410 - RNA, 64 nt, Homo Sapiens; identical to SEQ ID NO: 81002

SEQ ID NO: 378411 - RNA, 64 nt, Homo Sapiens; identical to SEQ ID NO: 81003

SEQ ID NO: 378412 - RNA, 64 nt, Homo Sapiens; identical to SEQ ID NO: 81004

SEQ ID NO: 378413 - RNA, 64 nt, Homo Sapiens; identical to SEQ ID NO: 81005

SEQ ID NO: 378414 - RNA, 64 nt, Homo Sapiens; identical to SEQ ID NO: 81006

SEQ ID NO: 378415 - RNA, 64 nt, Homo Sapiens; identical to SEQ ID NO: 81007

SEQ ID NO: 378416 - RNA, 64 nt, Homo Sapiens; identical to SEQ ID NO: 81008

SEQ ID NO: 378417 - RNA, 64 nt, Homo Sapiens; identical to SEQ ID NO: 81009

SEQ ID NO: 378418 - RNA, 64 nt, Homo Sapiens; identical to SEQ ID NO: 81010

SEQ ID NO: 378419 - RNA, 64 nt, Homo Sapiens; identical to SEQ ID NO: 81011

SEQ ID NO: 378420 - RNA, 64 nt, Homo Sapiens; identical to SEQ ID NO: 81012

SEQ ID NO: 378421 - RNA, 64 nt, Homo Sapiens; identical to SEQ ID NO: 81013

SEQ ID NO: 378422 - RNA, 64 nt, Homo Sapiens; identical to SEQ ID NO: 81014

SEQ ID NO: 378423 - RNA, 64 nt, Homo Sapiens; identical to SEQ ID NO: 81015

SEQ ID NO: 378424 - RNA, 64 nt, Homo Sapiens; identical to SEQ ID NO: 81016

SEQ ID NO: 378425 - RNA, 64 nt, Homo Sapiens; identical to SEQ ID NO: 81017

SEQ ID NO: 378426 - RNA, 64 nt, Homo Sapiens; identical to SEQ ID NO: 81018

SEQ ID NO: 378427 - RNA, 64 nt, Homo Sapiens; identical to SEQ ID NO: 81019

SEQ ID NO: 378428 - RNA, 64 nt, Homo Sapiens; identical to SEQ ID NO: 81020

SEQ ID NO: 378429 - RNA, 64 nt, Homo Sapiens; identical to SEQ ID NO: 81021

SEQ ID NO: 378430 - RNA, 64 nt, Homo Sapiens; identical to SEQ ID NO: 81022

SEQ ID NO: 378431 - RNA, 64 nt, Homo Sapiens; identical to SEQ ID NO: 81023

SEQ ID NO: 378432 - RNA, 64 nt, Homo Sapiens; identical to SEQ ID NO: 81024

SEQ ID NO: 378433 - RNA, 64 nt, Homo Sapiens; identical to SEQ ID NO: 81025

SEQ ID NO: 378434 - RNA, 64 nt, Homo Sapiens; identical to SEQ ID NO: 81026

SEQ ID NO: 378435 - RNA, 64 nt, Homo Sapiens; identical to SEQ ID NO: 81027

SEQ ID NO: 378436 - RNA, 64 nt, Homo Sapiens; identical to SEQ ID NO: 81028

SEQ ID NO: 378437 - RNA, 64 nt, Homo Sapiens; identical to SEQ ID NO: 81029

SEQ ID NO: 378438 - RNA, 64 nt, Homo Sapiens; identical to SEQ ID NO: 81030

SEQ ID NO: 378439 - RNA, 64 nt, Homo Sapiens; identical to SEQ ID NO: 81031

SEQ ID NO: 378440 - RNA, 64 nt, Homo Sapiens; identical to SEQ ID NO: 81032

SEQ ID NO: 378441 - RNA, 64 nt, Homo Sapiens; identical to SEQ ID NO: 81033

SEQ ID NO: 378442 - RNA, 64 nt, Homo Sapiens; identical to SEQ ID NO: 81034

SEQ ID NO: 378443 - RNA, 64 nt, Homo Sapiens; identical to SEQ ID NO: 81035

SEQ ID NO: 378444 - RNA, 64 nt, Homo Sapiens; identical to SEQ ID NO: 81036

SEQ ID NO: 378445 - RNA, 64 nt, Homo Sapiens; identical to SEQ ID NO: 81037

SEQ ID NO: 378446 - RNA, 64 nt, Homo Sapiens; identical to SEQ ID NO: 81038

SEQ ID NO: 378447 - RNA, 64 nt, Homo Sapiens; identical to SEQ ID NO: 81039

SEQ ID NO: 378448 - RNA, 64 nt, Homo Sapiens; identical to SEQ ID NO: 81040

SEQ ID NO: 378449 - RNA, 64 nt, Homo Sapiens; identical to SEQ ID NO: 81041

SEQ ID NO: 378450 - RNA, 64 nt, Homo Sapiens; identical to SEQ ID NO: 81042

SEQ ID NO: 378451 - RNA, 64 nt, Homo Sapiens
ucgccagguuggccaggcuggucuugugaacuccuggccucaggugaucugcccaccucauccu

SEQ ID NO: 378452 - RNA, 64 nt, Homo Sapiens
aagugcugggauuacaggcaugagccacugcgccuggccucagaaugcauucuuacacaucuau

SEQ ID NO: 378453 - RNA, 64 nt, Homo Sapiens
aucucauaacucauuugcuuccuggcccagccuguggccucagccccugccagaggccuggugc

SEQ ID NO: 378454 - RNA, 64 nt, Homo Sapiens
agaaggccuugccuuguguauuuggaccugcaguuggccucagccugggaagggggcaggcccc

SEQ ID NO: 378455 - RNA, 64 nt, Homo Sapiens
caauuucacauucccuaauuuaguugggaugaaauggccucaggagugacucuugagguuaagg

SEQ ID NO: 378456 - RNA, 64 nt, Homo Sapiens
gcccuuccuguugauuacaaagauucugcuaucuuggccucacacucuuuuaucuacagggagu

SEQ ID NO: 378457 - RNA, 64 nt, Homo Sapiens
cugccugccucccgccugugcacucuggaaccucuggccucaggggaccugccuguccucagcu

SEQ ID NO: 378458 - RNA, 64 nt, Homo Sapiens
auaaauaagcugacuguucucucuugagaaccuguggccucaaccagccaccaagcugaugugg

SEQ ID NO: 378459 - RNA, 61 nt, Homo Sapiens
caaugaagaguaaccguuaacaucacugcuguggccucauacucuuuuuuccauuuucuac

SEQ ID NO: 378460 - RNA, 64 nt, Homo Sapiens
aagugcugcaguuacaggcgugagccacugcaccuggccucauguuuuuuaaauaauugccuuu

SEQ ID NO: 378461 - RNA, 64 nt, Homo Sapiens
ucuggaggccacccccaggauguuucaaaaaguguggccucagcuuuacuccuuuugaaaaguc

SEQ ID NO: 378462 - RNA, 64 nt, Homo Sapiens
ugcacgacuccagaggcuccagcucugcccagaguggccucagcucaucugugugacggcagga

SEQ ID NO: 378463 - RNA, 64 nt, Homo Sapiens
agccaguugcuguggaaggagaaugcuuucuuuguggccucaucugugguuucgugucccucug

SEQ ID NO: 378464 - RNA, 64 nt, Homo Sapiens
ucucgcucuguugcccaggguggucucgaacuccuggccucaagcgauccucccaccucgaccu

SEQ ID NO: 378465 - RNA, 64 nt, Homo Sapiens
caguagagacaagaucuccguauguuauacaggcuggccucaagugauccucuuaccuuggccu

SEQ ID NO: 378466 - RNA, 64 nt, Homo Sapiens
aaacaccgggauuauaggcgugagcccccgugccuggccucaaauuuuauuuuagcucgacccu

SEQ ID NO: 378467 - RNA, 64 nt, Homo Sapiens
acuggcugcuuccuuugguacccccauccccucguggccucaggugaacauuccaggaacauuc

SEQ ID NO: 378468 - RNA, 64 nt, Homo Sapiens
ccugggcaaaauccaacucuccagauucccuccauggccucacccaaacugggaacucagacac

SEQ ID NO: 378469 - RNA, 64 nt, Homo Sapiens
cgauccuccuuccucauccuuggucuugaacucuuggccucaagucucacuguguugcccaggc

SEQ ID NO: 378470 - RNA, 64 nt, Homo Sapiens
cagcagaaugacucuggaacucucacuucaguuguggccucauugcggcugaacaggccgcaca

SEQ ID NO: 378471 - RNA, 64 nt, Homo Sapiens
cugggcagcuaagugggcgcauccugucuucagcuggccucacugacaccccggccucccuggg

SEQ ID NO: 378472 - RNA, 64 nt, Homo Sapiens
aggacaaggguucccuuggaaaugugaagggucuuggccucaucccucagguccccccacagca

SEQ ID NO: 378473 - RNA, 64 nt, Homo Sapiens
ucuugcuauguugcccagguuggucuugaacuccuggccucaagagauccccccaaccuuggcc

SEQ ID NO: 378474 - RNA, 64 nt, Homo Sapiens
aagugcugggauuacaggcaugagccaccgcgccuggccucaaguaaguuuuuauaccaugaua

SEQ ID NO: 378475 - RNA, 64 nt, Homo Sapiens
gcaucauuccuguguguuacaguauuauuuuaauuggccucaaugguugcagcaaucagagucc

SEQ ID NO: 378476 - RNA, 64 nt, Homo Sapiens
gcuuuuaucugugucuuuuggaaaaggagcugcauggccucagugccuccauaaaaagcuuaag

SEQ ID NO: 378477 - RNA, 64 nt, Homo Sapiens
gcucagcccucuucuauuucuuauggggccaucuuggccucaccauccccacacgugccgaugu

SEQ ID NO: 378478 - RNA, 64 nt, Homo Sapiens
acacauaccccaucucccgagggcugaccuccucuggccucagccugcagggugugggcagaga

SEQ ID NO: 378479 - RNA, 64 nt, Homo Sapiens
acagagcaucugugguccagggaaguuaguccucuggccucaauucuguuguggaugugcagug

SEQ ID NO: 378480 - RNA, 64 nt, Homo Sapiens
ugccgcaccuccagguucugggcaugagaggccguggccucauuucugguggauaaccuuuuua

SEQ ID NO: 378481 - RNA, 64 nt, Homo Sapiens
caaagggaacugcagugcuggguggaguguccuguggccucaggacccuuugggacaguuacuu

SEQ ID NO: 378482 - RNA, 64 nt, Homo Sapiens
cccugggcaggaggcaguggagaaccaagccccauggccucagaauuuccccccaguuccccaa

SEQ ID NO: 378483 - RNA, 64 nt, Homo Sapiens
gcaggccugcugggcccggacacccucacgugcuuggccucaauacccacaugugggugggggg

SEQ ID NO: 378484 - RNA, 64 nt, Homo Sapiens
ccagcccacccucaccugcugauaguggcggcaauggccucagccucacggauuuuauuacaca

SEQ ID NO: 378485 - RNA, 64 nt, Homo Sapiens
ggaaguaaagcaagguaaaaggugggagacuccauggccucagaaggauuagcucugauuuuga

SEQ ID NO: 378486 - RNA, 64 nt, Homo Sapiens
caauuguauuucuagaacuccauagaaauaggaguggccucauacagagaaaguaaaaguacga

SEQ ID NO: 378487 - RNA, 64 nt, Homo Sapiens
aaucaacuuaggcaguucccggcuccccaggcuguggccucaggcuuaugcgugauuucguguc

SEQ ID NO: 378488 - RNA, 64 nt, Homo Sapiens
agaagcgagcacaggcugggggagacuguuucucuggccucagagacagagaguuacagaaaug

SEQ ID NO: 378489 - RNA, 64 nt, Homo Sapiens
caacccuccugccucagucuuggucuugaacuccuggccucaagucuugcuauguugcccaggc

SEQ ID NO: 378490 - RNA, 64 nt, Homo Sapiens
ugauccaccuaccuuagucuuggucucaaacuccuggccucaaguuucaccguguuggccaggc

SEQ ID NO: 378491 - RNA, 64 nt, Homo Sapiens
acccccucuccaugcuccccgccccaacccacucuggccucaguagauuuuuuuuucaguugug

SEQ ID NO: 378492 - RNA, 64 nt, Homo Sapiens
uuuccccauguuggccaggcuggucucgaacuccuggccucaggugugauccgcccgccuccgc

SEQ ID NO: 378493 - RNA, 64 nt, Homo Sapiens
ucccccaagaucuggauaucuggggacaagaugguggccucaggccugccucccaggcaguugg

SEQ ID NO: 378494 - RNA, 64 nt, Homo Sapiens
cuucuccaccccaccccagcacccgucccaaauguggccucagcuuguccuccccuuccccaaa

SEQ ID NO: 378495 - RNA, 64 nt, Homo Sapiens
cacugucccaaucccacucaggcccaccuccagcuggccucacuccgcuggugacuucguaccu

SEQ ID NO: 378496 - RNA, 64 nt, Homo Sapiens
cacugucccagucccacucaggcccaucucuggcuggccucacugcgcugggacuccgccuuca

SEQ ID NO: 378497 - RNA, 64 nt, Homo Sapiens
gaauacugucauuuuucugugcgugcagugaaaauggccucaucucauaccauggcuccaccuu

SEQ ID NO: 378498 - RNA, 64 nt, Homo Sapiens
ugggggccagcacccaaauaagccuggcaugcaguggccucaauaaaaugugacuguauugagu

SEQ ID NO: 378499 - RNA, 64 nt, Homo Sapiens
ugaguauuuuuauaaugucuugagccaccgugccuggccucauuaagugcugggauuacaggca

SEQ ID NO: 378500 - RNA, 64 nt, Homo Sapiens
ugauccacccaccucagccuugguuuugaacuccuggccucaaguuuugcuauguuggccaggc

SEQ ID NO: 378501 - RNA, 64 nt, Homo Sapiens
ucaccaggugugauagccccagccaggucacaccuggccucacacuuugagcugagacuugaaa

SEQ ID NO: 378502 - RNA, 64 nt, Homo Sapiens
uaaaaccuuuggcaaaggugccaucggcagggcuuggccucaugaagucucagguccguguucc

SEQ ID NO: 378503 - RNA, 64 nt, Homo Sapiens
ugccucacuuccuacaagagcccagagcuguuuauggccucagcacugggcccaagacagaugc

SEQ ID NO: 378504 - RNA, 64 nt, Homo Sapiens
auugaucauuuuccccccacuguuuugauguuuguggccucagaaaaggagacuagauugccuu

SEQ ID NO: 378505 - RNA, 64 nt, Homo Sapiens
auucacaaaauuuccacaaacaccucaguucccuuggccucagaacacuucugugagaccccca

SEQ ID NO: 378506 - RNA, 64 nt, Homo Sapiens
ucauuuugccuuccuacaugucaggaaguggaaauggccucagggaaauccacauuccagaggc

SEQ ID NO: 378507 - RNA, 64 nt, Homo Sapiens
uccucccuggggaaggaacuaggggugagguucuuggccucagccaggacugcacaacucugcc

SEQ ID NO: 378508 - RNA, 64 nt, Homo Sapiens; identical to SEQ ID NO: 102277

SEQ ID NO: 378509 - RNA, 64 nt, Homo Sapiens; identical to SEQ ID NO: 102278

SEQ ID NO: 378510 - RNA, 64 nt, Homo Sapiens; identical to SEQ ID NO: 102279

SEQ ID NO: 378511 - RNA, 64 nt, Homo Sapiens; identical to SEQ ID NO: 102280

SEQ ID NO: 378512 - RNA, 56 nt, Homo Sapiens; identical to SEQ ID NO: 102281

SEQ ID NO: 378513 - RNA, 64 nt, Homo Sapiens; identical to SEQ ID NO: 102282

SEQ ID NO: 378514 - RNA, 64 nt, Homo Sapiens; identical to SEQ ID NO: 102283

SEQ ID NO: 378515 - RNA, 64 nt, Homo Sapiens; identical to SEQ ID NO: 102284

SEQ ID NO: 378516 - RNA, 64 nt, Homo Sapiens; identical to SEQ ID NO: 102285

SEQ ID NO: 378517 - RNA, 64 nt, Homo Sapiens; identical to SEQ ID NO: 102286

SEQ ID NO: 378518 - RNA, 64 nt, Homo Sapiens; identical to SEQ ID NO: 102287

SEQ ID NO: 378519 - RNA, 64 nt, Homo Sapiens; identical to SEQ ID NO: 102288

SEQ ID NO: 378520 - RNA, 64 nt, Homo Sapiens; identical to SEQ ID NO: 102289

SEQ ID NO: 378521 - RNA, 64 nt, Homo Sapiens; identical to SEQ ID NO: 102290

SEQ ID NO: 378522 - RNA, 64 nt, Homo Sapiens; identical to SEQ ID NO: 102291

SEQ ID NO: 378523 - RNA, 64 nt, Homo Sapiens; identical to SEQ ID NO: 378451

SEQ ID NO: 378524 - RNA, 64 nt, Homo Sapiens; identical to SEQ ID NO: 378452

SEQ ID NO: 378525 - RNA, 64 nt, Homo Sapiens; identical to SEQ ID NO: 378453

SEQ ID NO: 378526 - RNA, 64 nt, Homo Sapiens; identical to SEQ ID NO: 378454

SEQ ID NO: 378527 - RNA, 64 nt, Homo Sapiens; identical to SEQ ID NO: 378455

SEQ ID NO: 378528 - RNA, 64 nt, Homo Sapiens; identical to SEQ ID NO: 378456

SEQ ID NO: 378529 - RNA, 64 nt, Homo Sapiens; identical to SEQ ID NO: 378457

SEQ ID NO: 378530 - RNA, 64 nt, Homo Sapiens; identical to SEQ ID NO: 378458

SEQ ID NO: 378531 - RNA, 61 nt, Homo Sapiens; identical to SEQ ID NO: 378459

SEQ ID NO: 378532 - RNA, 64 nt, Homo Sapiens; identical to SEQ ID NO: 378460

SEQ ID NO: 378533 - RNA, 64 nt, Homo Sapiens; identical to SEQ ID NO: 378461

SEQ ID NO: 378534 - RNA, 64 nt, Homo Sapiens; identical to SEQ ID NO: 378462

SEQ ID NO: 378535 - RNA, 64 nt, Homo Sapiens; identical to SEQ ID NO: 378463

SEQ ID NO: 378536 - RNA, 64 nt, Homo Sapiens; identical to SEQ ID NO: 378464

SEQ ID NO: 378537 - RNA, 64 nt, Homo Sapiens; identical to SEQ ID NO: 378465

SEQ ID NO: 378538 - RNA, 64 nt, Homo Sapiens; identical to SEQ ID NO: 378466

SEQ ID NO: 378539 - RNA, 64 nt, Homo Sapiens; identical to SEQ ID NO: 378467

SEQ ID NO: 378540 - RNA, 64 nt, Homo Sapiens; identical to SEQ ID NO: 378468

SEQ ID NO: 378541 - RNA, 64 nt, Homo Sapiens; identical to SEQ ID NO: 378469

SEQ ID NO: 378542 - RNA, 64 nt, Homo Sapiens; identical to SEQ ID NO: 378470

SEQ ID NO: 378543 - RNA, 64 nt, Homo Sapiens; identical to SEQ ID NO: 378471

SEQ ID NO: 378544 - RNA, 64 nt, Homo Sapiens; identical to SEQ ID NO: 378472

SEQ ID NO: 378545 - RNA, 64 nt, Homo Sapiens; identical to SEQ ID NO: 378473

SEQ ID NO: 378546 - RNA, 64 nt, Homo Sapiens; identical to SEQ ID NO: 378474

SEQ ID NO: 378547 - RNA, 64 nt, Homo Sapiens; identical to SEQ ID NO: 378475

SEQ ID NO: 378548 - RNA, 64 nt, Homo Sapiens; identical to SEQ ID NO: 378476

SEQ ID NO: 378549 - RNA, 64 nt, Homo Sapiens; identical to SEQ ID NO: 378477

SEQ ID NO: 378550 - RNA, 64 nt, Homo Sapiens; identical to SEQ ID NO: 378478

SEQ ID NO: 378551 - RNA, 64 nt, Homo Sapiens; identical to SEQ ID NO: 378479

SEQ ID NO: 378552 - RNA, 64 nt, Homo Sapiens; identical to SEQ ID NO: 378480

SEQ ID NO: 378553 - RNA, 64 nt, Homo Sapiens; identical to SEQ ID NO: 378481

SEQ ID NO: 378554 - RNA, 64 nt, Homo Sapiens; identical to SEQ ID NO: 378482

SEQ ID NO: 378555 - RNA, 64 nt, Homo Sapiens; identical to SEQ ID NO: 378483

SEQ ID NO: 378556 - RNA, 64 nt, Homo Sapiens; identical to SEQ ID NO: 378484

SEQ ID NO: 378557 - RNA, 64 nt, Homo Sapiens; identical to SEQ ID NO: 378485

SEQ ID NO: 378558 - RNA, 64 nt, Homo Sapiens; identical to SEQ ID NO: 378486

SEQ ID NO: 378559 - RNA, 64 nt, Homo Sapiens; identical to SEQ ID NO: 378487

SEQ ID NO: 378560 - RNA, 64 nt, Homo Sapiens; identical to SEQ ID NO: 378488

SEQ ID NO: 378561 - RNA, 64 nt, Homo Sapiens; identical to SEQ ID NO: 378489

SEQ ID NO: 378562 - RNA, 64 nt, Homo Sapiens; identical to SEQ ID NO: 378490

SEQ ID NO: 378563 - RNA, 64 nt, Homo Sapiens; identical to SEQ ID NO: 378491

SEQ ID NO: 378564 - RNA, 64 nt, Homo Sapiens; identical to SEQ ID NO: 378492

SEQ ID NO: 378565 - RNA, 64 nt, Homo Sapiens; identical to SEQ ID NO: 378493

SEQ ID NO: 378566 - RNA, 64 nt, Homo Sapiens; identical to SEQ ID NO: 378494

SEQ ID NO: 378567 - RNA, 64 nt, Homo Sapiens; identical to SEQ ID NO: 378495

SEQ ID NO: 378568 - RNA, 64 nt, Homo Sapiens; identical to SEQ ID NO: 378496

SEQ ID NO: 378569 - RNA, 64 nt, Homo Sapiens; identical to SEQ ID NO: 378497

SEQ ID NO: 378570 - RNA, 64 nt, Homo Sapiens; identical to SEQ ID NO: 378498

SEQ ID NO: 378571 - RNA, 64 nt, Homo Sapiens; identical to SEQ ID NO: 378499

SEQ ID NO: 378572 - RNA, 64 nt, Homo Sapiens; identical to SEQ ID NO: 378500

SEQ ID NO: 378573 - RNA, 64 nt, Homo Sapiens; identical to SEQ ID NO: 378501

SEQ ID NO: 378574 - RNA, 64 nt, Homo Sapiens; identical to SEQ ID NO: 378502

SEQ ID NO: 378575 - RNA, 64 nt, Homo Sapiens; identical to SEQ ID NO: 378503

SEQ ID NO: 378576 - RNA, 64 nt, Homo Sapiens; identical to SEQ ID NO: 378504

SEQ ID NO: 378577 - RNA, 64 nt, Homo Sapiens; identical to SEQ ID NO: 378505

SEQ ID NO: 378578 - RNA, 64 nt, Homo Sapiens; identical to SEQ ID NO: 378506

SEQ ID NO: 378579 - RNA, 64 nt, Homo Sapiens; identical to SEQ ID NO: 378507

SEQ ID NO: 378580 - RNA, 64 nt, Homo Sapiens; identical to SEQ ID NO: 102277

SEQ ID NO: 378581 - RNA, 64 nt, Homo Sapiens; identical to SEQ ID NO: 102278

SEQ ID NO: 378582 - RNA, 64 nt, Homo Sapiens; identical to SEQ ID NO: 102279

SEQ ID NO: 378583 - RNA, 64 nt, Homo Sapiens; identical to SEQ ID NO: 102280

SEQ ID NO: 378584 - RNA, 56 nt, Homo Sapiens; identical to SEQ ID NO: 102281

SEQ ID NO: 378585 - RNA, 64 nt, Homo Sapiens; identical to SEQ ID NO: 102282

SEQ ID NO: 378586 - RNA, 64 nt, Homo Sapiens; identical to SEQ ID NO: 102283

SEQ ID NO: 378587 - RNA, 64 nt, Homo Sapiens; identical to SEQ ID NO: 102284

SEQ ID NO: 378588 - RNA, 64 nt, Homo Sapiens; identical to SEQ ID NO: 102285

SEQ ID NO: 378589 - RNA, 64 nt, Homo Sapiens; identical to SEQ ID NO: 102286

SEQ ID NO: 378590 - RNA, 64 nt, Homo Sapiens; identical to SEQ ID NO: 102287

SEQ ID NO: 378591 - RNA, 64 nt, Homo Sapiens; identical to SEQ ID NO: 102288

SEQ ID NO: 378592 - RNA, 64 nt, Homo Sapiens; identical to SEQ ID NO: 102289

SEQ ID NO: 378593 - RNA, 64 nt, Homo Sapiens; identical to SEQ ID NO: 102290

SEQ ID NO: 378594 - RNA, 64 nt, Homo Sapiens; identical to SEQ ID NO: 102291

SEQ ID NO: 378595 - RNA, 64 nt, Homo Sapiens; identical to SEQ ID NO: 336871

SEQ ID NO: 378596 - RNA, 64 nt, Homo Sapiens; identical to SEQ ID NO: 336872

SEQ ID NO: 378597 - RNA, 64 nt, Homo Sapiens; identical to SEQ ID NO: 336873

SEQ ID NO: 378598 - RNA, 64 nt, Homo Sapiens; identical to SEQ ID NO: 336874

SEQ ID NO: 378599 - RNA, 64 nt, Homo Sapiens; identical to SEQ ID NO: 336875

SEQ ID NO: 378600 - RNA, 64 nt, Homo Sapiens; identical to SEQ ID NO: 336876

SEQ ID NO: 378601 - RNA, 64 nt, Homo Sapiens; identical to SEQ ID NO: 336877

SEQ ID NO: 378602 - RNA, 64 nt, Homo Sapiens; identical to SEQ ID NO: 336878

SEQ ID NO: 378603 - RNA, 64 nt, Homo Sapiens; identical to SEQ ID NO: 336879

SEQ ID NO: 378604 - RNA, 64 nt, Homo Sapiens; identical to SEQ ID NO: 336880

SEQ ID NO: 378605 - RNA, 64 nt, Homo Sapiens; identical to SEQ ID NO: 336881

SEQ ID NO: 378606 - RNA, 64 nt, Homo Sapiens; identical to SEQ ID NO: 336882

SEQ ID NO: 378607 - RNA, 64 nt, Homo Sapiens; identical to SEQ ID NO: 336883

SEQ ID NO: 378608 - RNA, 64 nt, Homo Sapiens; identical to SEQ ID NO: 336884

SEQ ID NO: 378609 - RNA, 64 nt, Homo Sapiens; identical to SEQ ID NO: 336885

SEQ ID NO: 378610 - RNA, 64 nt, Homo Sapiens; identical to SEQ ID NO: 336886

SEQ ID NO: 378611 - RNA, 64 nt, Homo Sapiens; identical to SEQ ID NO: 336887

SEQ ID NO: 378612 - RNA, 64 nt, Homo Sapiens; identical to SEQ ID NO: 336888

SEQ ID NO: 378613 - RNA, 64 nt, Homo Sapiens; identical to SEQ ID NO: 336889

SEQ ID NO: 378614 - RNA, 64 nt, Homo Sapiens; identical to SEQ ID NO: 336890

SEQ ID NO: 378615 - RNA, 64 nt, Homo Sapiens; identical to SEQ ID NO: 336891

SEQ ID NO: 378616 - RNA, 64 nt, Homo Sapiens; identical to SEQ ID NO: 336892

SEQ ID NO: 378617 - RNA, 64 nt, Homo Sapiens; identical to SEQ ID NO: 336893

SEQ ID NO: 378618 - RNA, 64 nt, Homo Sapiens; identical to SEQ ID NO: 336894

SEQ ID NO: 378619 - RNA, 64 nt, Homo Sapiens; identical to SEQ ID NO: 336895

SEQ ID NO: 378620 - RNA, 64 nt, Homo Sapiens; identical to SEQ ID NO: 336896

SEQ ID NO: 378621 - RNA, 64 nt, Homo Sapiens; identical to SEQ ID NO: 336897

SEQ ID NO: 378622 - RNA, 64 nt, Homo Sapiens; identical to SEQ ID NO: 336898

SEQ ID NO: 378623 - RNA, 64 nt, Homo Sapiens; identical to SEQ ID NO: 336899

SEQ ID NO: 378624 - RNA, 64 nt, Homo Sapiens; identical to SEQ ID NO: 336900

SEQ ID NO: 378625 - RNA, 64 nt, Homo Sapiens; identical to SEQ ID NO: 336901

SEQ ID NO: 378626 - RNA, 64 nt, Homo Sapiens; identical to SEQ ID NO: 336902

SEQ ID NO: 378627 - RNA, 64 nt, Homo Sapiens; identical to SEQ ID NO: 336903

SEQ ID NO: 378628 - RNA, 64 nt, Homo Sapiens; identical to SEQ ID NO: 336904

SEQ ID NO: 378629 - RNA, 64 nt, Homo Sapiens; identical to SEQ ID NO: 336905

SEQ ID NO: 378630 - RNA, 64 nt, Homo Sapiens; identical to SEQ ID NO: 336906

SEQ ID NO: 378631 - RNA, 64 nt, Homo Sapiens; identical to SEQ ID NO: 336907

SEQ ID NO: 378632 - RNA, 64 nt, Homo Sapiens; identical to SEQ ID NO: 336908

SEQ ID NO: 378633 - RNA, 64 nt, Homo Sapiens; identical to SEQ ID NO: 336909

SEQ ID NO: 378634 - RNA, 64 nt, Homo Sapiens; identical to SEQ ID NO: 336910

SEQ ID NO: 378635 - RNA, 64 nt, Homo Sapiens; identical to SEQ ID NO: 336911

SEQ ID NO: 378636 - RNA, 64 nt, Homo Sapiens; identical to SEQ ID NO: 336912

SEQ ID NO: 378637 - RNA, 64 nt, Homo Sapiens; identical to SEQ ID NO: 336913

SEQ ID NO: 378638 - RNA, 64 nt, Homo Sapiens; identical to SEQ ID NO: 336914

SEQ ID NO: 378639 - RNA, 64 nt, Homo Sapiens; identical to SEQ ID NO: 336915

SEQ ID NO: 378640 - RNA, 64 nt, Homo Sapiens; identical to SEQ ID NO: 336916

SEQ ID NO: 378641 - RNA, 64 nt, Homo Sapiens; identical to SEQ ID NO: 336917

SEQ ID NO: 378642 - RNA, 64 nt, Homo Sapiens; identical to SEQ ID NO: 336918

SEQ ID NO: 378643 - RNA, 64 nt, Homo Sapiens; identical to SEQ ID NO: 336919

SEQ ID NO: 378644 - RNA, 64 nt, Homo Sapiens; identical to SEQ ID NO: 336920

SEQ ID NO: 378645 - RNA, 64 nt, Homo Sapiens; identical to SEQ ID NO: 336921

SEQ ID NO: 378646 - RNA, 64 nt, Homo Sapiens; identical to SEQ ID NO: 336922

SEQ ID NO: 378647 - RNA, 64 nt, Homo Sapiens; identical to SEQ ID NO: 336923

SEQ ID NO: 378648 - RNA, 64 nt, Homo Sapiens; identical to SEQ ID NO: 336924

SEQ ID NO: 378649 - RNA, 64 nt, Homo Sapiens; identical to SEQ ID NO: 336925

SEQ ID NO: 378650 - RNA, 64 nt, Homo Sapiens; identical to SEQ ID NO: 336926

SEQ ID NO: 378651 - RNA, 64 nt, Homo Sapiens; identical to SEQ ID NO: 336927

SEQ ID NO: 378652 - RNA, 64 nt, Homo Sapiens; identical to SEQ ID NO: 336928

SEQ ID NO: 378653 - RNA, 64 nt, Homo Sapiens; identical to SEQ ID NO: 336929

SEQ ID NO: 378654 - RNA, 64 nt, Homo Sapiens; identical to SEQ ID NO: 336930

SEQ ID NO: 378655 - RNA, 64 nt, Homo Sapiens; identical to SEQ ID NO: 336931

SEQ ID NO: 378656 - RNA, 64 nt, Homo Sapiens; identical to SEQ ID NO: 336932

SEQ ID NO: 378657 - RNA, 64 nt, Homo Sapiens; identical to SEQ ID NO: 336933

SEQ ID NO: 378658 - RNA, 64 nt, Homo Sapiens; identical to SEQ ID NO: 336934

SEQ ID NO: 378659 - RNA, 64 nt, Homo Sapiens; identical to SEQ ID NO: 336935

SEQ ID NO: 378660 - RNA, 64 nt, Homo Sapiens; identical to SEQ ID NO: 336936

SEQ ID NO: 378661 - RNA, 64 nt, Homo Sapiens; identical to SEQ ID NO: 336937

SEQ ID NO: 378662 - RNA, 51 nt, Homo Sapiens; identical to SEQ ID NO: 336938

SEQ ID NO: 378663 - RNA, 62 nt, Homo Sapiens; identical to SEQ ID NO: 336939

SEQ ID NO: 378664 - RNA, 64 nt, Homo Sapiens; identical to SEQ ID NO: 336940

SEQ ID NO: 378665 - RNA, 64 nt, Homo Sapiens; identical to SEQ ID NO: 336941

SEQ ID NO: 378666 - RNA, 64 nt, Homo Sapiens; identical to SEQ ID NO: 336942

SEQ ID NO: 378667 - RNA, 64 nt, Homo Sapiens; identical to SEQ ID NO: 336943

SEQ ID NO: 378668 - RNA, 64 nt, Homo Sapiens; identical to SEQ ID NO: 336944

SEQ ID NO: 378669 - RNA, 64 nt, Homo Sapiens; identical to SEQ ID NO: 336945

SEQ ID NO: 378670 - RNA, 57 nt, Homo Sapiens; identical to SEQ ID NO: 336946

SEQ ID NO: 378671 - RNA, 64 nt, Homo Sapiens; identical to SEQ ID NO: 336947

SEQ ID NO: 378672 - RNA, 64 nt, Homo Sapiens; identical to SEQ ID NO: 336948

SEQ ID NO: 378673 - RNA, 64 nt, Homo Sapiens; identical to SEQ ID NO: 336949

SEQ ID NO: 378674 - RNA, 56 nt, Homo Sapiens; identical to SEQ ID NO: 336950

SEQ ID NO: 378675 - RNA, 64 nt, Homo Sapiens; identical to SEQ ID NO: 336951

SEQ ID NO: 378676 - RNA, 64 nt, Homo Sapiens; identical to SEQ ID NO: 336952

SEQ ID NO: 378677 - RNA, 64 nt, Homo Sapiens; identical to SEQ ID NO: 336953

SEQ ID NO: 378678 - RNA, 64 nt, Homo Sapiens; identical to SEQ ID NO: 336954

SEQ ID NO: 378679 - RNA, 64 nt, Homo Sapiens; identical to SEQ ID NO: 336955

SEQ ID NO: 378680 - RNA, 64 nt, Homo Sapiens; identical to SEQ ID NO: 336956

SEQ ID NO: 378681 - RNA, 64 nt, Homo Sapiens; identical to SEQ ID NO: 336957

SEQ ID NO: 378682 - RNA, 64 nt, Homo Sapiens; identical to SEQ ID NO: 336958

SEQ ID NO: 378683 - RNA, 64 nt, Homo Sapiens; identical to SEQ ID NO: 336959

SEQ ID NO: 378684 - RNA, 64 nt, Homo Sapiens; identical to SEQ ID NO: 336960

SEQ ID NO: 378685 - RNA, 64 nt, Homo Sapiens; identical to SEQ ID NO: 336961

SEQ ID NO: 378686 - RNA, 64 nt, Homo Sapiens; identical to SEQ ID NO: 336962

SEQ ID NO: 378687 - RNA, 64 nt, Homo Sapiens; identical to SEQ ID NO: 336963

SEQ ID NO: 378688 - RNA, 64 nt, Homo Sapiens; identical to SEQ ID NO: 336964

SEQ ID NO: 378689 - RNA, 64 nt, Homo Sapiens; identical to SEQ ID NO: 336965

SEQ ID NO: 378690 - RNA, 64 nt, Homo Sapiens; identical to SEQ ID NO: 336966

SEQ ID NO: 378691 - RNA, 64 nt, Homo Sapiens; identical to SEQ ID NO: 336967

SEQ ID NO: 378692 - RNA, 64 nt, Homo Sapiens; identical to SEQ ID NO: 336968

SEQ ID NO: 378693 - RNA, 64 nt, Homo Sapiens; identical to SEQ ID NO: 336969

SEQ ID NO: 378694 - RNA, 64 nt, Homo Sapiens; identical to SEQ ID NO: 336970

SEQ ID NO: 378695 - RNA, 64 nt, Homo Sapiens; identical to SEQ ID NO: 336971

SEQ ID NO: 378696 - RNA, 64 nt, Homo Sapiens; identical to SEQ ID NO: 336972

SEQ ID NO: 378697 - RNA, 64 nt, Homo Sapiens; identical to SEQ ID NO: 336973

SEQ ID NO: 378698 - RNA, 64 nt, Homo Sapiens; identical to SEQ ID NO: 336974

SEQ ID NO: 378699 - RNA, 64 nt, Homo Sapiens; identical to SEQ ID NO: 336975

SEQ ID NO: 378700 - RNA, 64 nt, Homo Sapiens; identical to SEQ ID NO: 336976

SEQ ID NO: 378701 - RNA, 64 nt, Homo Sapiens; identical to SEQ ID NO: 336977

SEQ ID NO: 378702 - RNA, 64 nt, Homo Sapiens; identical to SEQ ID NO: 336978

SEQ ID NO: 378703 - RNA, 64 nt, Homo Sapiens; identical to SEQ ID NO: 336979

SEQ ID NO: 378704 - RNA, 64 nt, Homo Sapiens; identical to SEQ ID NO: 336980

SEQ ID NO: 378705 - RNA, 64 nt, Homo Sapiens; identical to SEQ ID NO: 336981

SEQ ID NO: 378706 - RNA, 64 nt, Homo Sapiens; identical to SEQ ID NO: 336982

SEQ ID NO: 378707 - RNA, 64 nt, Homo Sapiens; identical to SEQ ID NO: 336983

SEQ ID NO: 378708 - RNA, 64 nt, Homo Sapiens; identical to SEQ ID NO: 336984

SEQ ID NO: 378709 - RNA, 64 nt, Homo Sapiens; identical to SEQ ID NO: 336985

SEQ ID NO: 378710 - RNA, 64 nt, Homo Sapiens; identical to SEQ ID NO: 336986

SEQ ID NO: 378711 - RNA, 64 nt, Homo Sapiens; identical to SEQ ID NO: 336987

SEQ ID NO: 378712 - RNA, 64 nt, Homo Sapiens; identical to SEQ ID NO: 336988

SEQ ID NO: 378713 - RNA, 64 nt, Homo Sapiens; identical to SEQ ID NO: 336989

SEQ ID NO: 378714 - RNA, 64 nt, Homo Sapiens; identical to SEQ ID NO: 336990

SEQ ID NO: 378715 - RNA, 64 nt, Homo Sapiens; identical to SEQ ID NO: 336991

SEQ ID NO: 378716 - RNA, 64 nt, Homo Sapiens; identical to SEQ ID NO: 336992

SEQ ID NO: 378717 - RNA, 64 nt, Homo Sapiens; identical to SEQ ID NO: 336993

SEQ ID NO: 378718 - RNA, 64 nt, Homo Sapiens; identical to SEQ ID NO: 336994

SEQ ID NO: 378719 - RNA, 64 nt, Homo Sapiens; identical to SEQ ID NO: 336995

SEQ ID NO: 378720 - RNA, 64 nt, Homo Sapiens; identical to SEQ ID NO: 336996

SEQ ID NO: 378721 - RNA, 64 nt, Homo Sapiens; identical to SEQ ID NO: 336997

SEQ ID NO: 378722 - RNA, 64 nt, Homo Sapiens; identical to SEQ ID NO: 336998

SEQ ID NO: 378723 - RNA, 64 nt, Homo Sapiens; identical to SEQ ID NO: 336999

SEQ ID NO: 378724 - RNA, 64 nt, Homo Sapiens; identical to SEQ ID NO: 337000

SEQ ID NO: 378725 - RNA, 64 nt, Homo Sapiens; identical to SEQ ID NO: 337001

SEQ ID NO: 378726 - RNA, 64 nt, Homo Sapiens; identical to SEQ ID NO: 337002

SEQ ID NO: 378727 - RNA, 64 nt, Homo Sapiens; identical to SEQ ID NO: 337003

SEQ ID NO: 378728 - RNA, 64 nt, Homo Sapiens; identical to SEQ ID NO: 337004

SEQ ID NO: 378729 - RNA, 64 nt, Homo Sapiens; identical to SEQ ID NO: 337005

SEQ ID NO: 378730 - RNA, 64 nt, Homo Sapiens; identical to SEQ ID NO: 337006

SEQ ID NO: 378731 - RNA, 64 nt, Homo Sapiens; identical to SEQ ID NO: 337007

SEQ ID NO: 378732 - RNA, 64 nt, Homo Sapiens; identical to SEQ ID NO: 337008

SEQ ID NO: 378733 - RNA, 64 nt, Homo Sapiens; identical to SEQ ID NO: 337009

SEQ ID NO: 378734 - RNA, 64 nt, Homo Sapiens; identical to SEQ ID NO: 337010

SEQ ID NO: 378735 - RNA, 64 nt, Homo Sapiens; identical to SEQ ID NO: 337011

SEQ ID NO: 378736 - RNA, 64 nt, Homo Sapiens; identical to SEQ ID NO: 337012

SEQ ID NO: 378737 - RNA, 64 nt, Homo Sapiens; identical to SEQ ID NO: 337013

SEQ ID NO: 378738 - RNA, 64 nt, Homo Sapiens; identical to SEQ ID NO: 337014

SEQ ID NO: 378739 - RNA, 64 nt, Homo Sapiens; identical to SEQ ID NO: 337015

SEQ ID NO: 378740 - RNA, 64 nt, Homo Sapiens; identical to SEQ ID NO: 337016

SEQ ID NO: 378741 - RNA, 64 nt, Homo Sapiens; identical to SEQ ID NO: 55280

SEQ ID NO: 378742 - RNA, 64 nt, Homo Sapiens; identical to SEQ ID NO: 55281

SEQ ID NO: 378743 - RNA, 64 nt, Homo Sapiens; identical to SEQ ID NO: 55282

SEQ ID NO: 378744 - RNA, 64 nt, Homo Sapiens; identical to SEQ ID NO: 55283

SEQ ID NO: 378745 - RNA, 64 nt, Homo Sapiens; identical to SEQ ID NO: 55284

SEQ ID NO: 378746 - RNA, 64 nt, Homo Sapiens; identical to SEQ ID NO: 55285

SEQ ID NO: 378747 - RNA, 64 nt, Homo Sapiens; identical to SEQ ID NO: 55286

SEQ ID NO: 378748 - RNA, 64 nt, Homo Sapiens; identical to SEQ ID NO: 55287

SEQ ID NO: 378749 - RNA, 64 nt, Homo Sapiens; identical to SEQ ID NO: 55288

SEQ ID NO: 378750 - RNA, 64 nt, Homo Sapiens; identical to SEQ ID NO: 55289

SEQ ID NO: 378751 - RNA, 64 nt, Homo Sapiens; identical to SEQ ID NO: 55290

SEQ ID NO: 378752 - RNA, 64 nt, Homo Sapiens; identical to SEQ ID NO: 55291

SEQ ID NO: 378753 - RNA, 64 nt, Homo Sapiens; identical to SEQ ID NO: 55292

SEQ ID NO: 378754 - RNA, 64 nt, Homo Sapiens; identical to SEQ ID NO: 55293

SEQ ID NO: 378755 - RNA, 64 nt, Homo Sapiens; identical to SEQ ID NO: 55294

SEQ ID NO: 378756 - RNA, 64 nt, Homo Sapiens; identical to SEQ ID NO: 55295

SEQ ID NO: 378757 - RNA, 64 nt, Homo Sapiens; identical to SEQ ID NO: 55296

SEQ ID NO: 378758 - RNA, 64 nt, Homo Sapiens; identical to SEQ ID NO: 55297

SEQ ID NO: 378759 - RNA, 64 nt, Homo Sapiens; identical to SEQ ID NO: 55298

SEQ ID NO: 378760 - RNA, 64 nt, Homo Sapiens; identical to SEQ ID NO: 55299

SEQ ID NO: 378761 - RNA, 64 nt, Homo Sapiens; identical to SEQ ID NO: 55300

SEQ ID NO: 378762 - RNA, 64 nt, Homo Sapiens; identical to SEQ ID NO: 55301

SEQ ID NO: 378763 - RNA, 64 nt, Homo Sapiens; identical to SEQ ID NO: 55302

SEQ ID NO: 378764 - RNA, 64 nt, Homo Sapiens; identical to SEQ ID NO: 55303

SEQ ID NO: 378765 - RNA, 64 nt, Homo Sapiens; identical to SEQ ID NO: 55304

SEQ ID NO: 378766 - RNA, 64 nt, Homo Sapiens; identical to SEQ ID NO: 55305

SEQ ID NO: 378767 - RNA, 64 nt, Homo Sapiens; identical to SEQ ID NO: 55306

SEQ ID NO: 378768 - RNA, 64 nt, Homo Sapiens; identical to SEQ ID NO: 55307

SEQ ID NO: 378769 - RNA, 64 nt, Homo Sapiens; identical to SEQ ID NO: 55308

SEQ ID NO: 378770 - RNA, 64 nt, Homo Sapiens; identical to SEQ ID NO: 55309

SEQ ID NO: 378771 - RNA, 64 nt, Homo Sapiens; identical to SEQ ID NO: 55310

SEQ ID NO: 378772 - RNA, 64 nt, Homo Sapiens; identical to SEQ ID NO: 55311

SEQ ID NO: 378773 - RNA, 64 nt, Homo Sapiens; identical to SEQ ID NO: 55312

SEQ ID NO: 378774 - RNA, 64 nt, Homo Sapiens; identical to SEQ ID NO: 55313

SEQ ID NO: 378775 - RNA, 64 nt, Homo Sapiens; identical to SEQ ID NO: 55314

SEQ ID NO: 378776 - RNA, 64 nt, Homo Sapiens; identical to SEQ ID NO: 55315

SEQ ID NO: 378777 - RNA, 64 nt, Homo Sapiens; identical to SEQ ID NO: 55316

SEQ ID NO: 378778 - RNA, 64 nt, Homo Sapiens; identical to SEQ ID NO: 55317

SEQ ID NO: 378779 - RNA, 64 nt, Homo Sapiens; identical to SEQ ID NO: 55318

SEQ ID NO: 378780 - RNA, 64 nt, Homo Sapiens; identical to SEQ ID NO: 55319

SEQ ID NO: 378781 - RNA, 64 nt, Homo Sapiens; identical to SEQ ID NO: 55320

SEQ ID NO: 378782 - RNA, 64 nt, Homo Sapiens; identical to SEQ ID NO: 55321

SEQ ID NO: 378783 - RNA, 64 nt, Homo Sapiens; identical to SEQ ID NO: 55322

SEQ ID NO: 378784 - RNA, 64 nt, Homo Sapiens; identical to SEQ ID NO: 55323

SEQ ID NO: 378785 - RNA, 64 nt, Homo Sapiens; identical to SEQ ID NO: 55324

SEQ ID NO: 378786 - RNA, 64 nt, Homo Sapiens; identical to SEQ ID NO: 55325

SEQ ID NO: 378787 - RNA, 64 nt, Homo Sapiens; identical to SEQ ID NO: 55326

SEQ ID NO: 378788 - RNA, 64 nt, Homo Sapiens; identical to SEQ ID NO: 55327

SEQ ID NO: 378789 - RNA, 64 nt, Homo Sapiens; identical to SEQ ID NO: 55328

SEQ ID NO: 378790 - RNA, 64 nt, Homo Sapiens; identical to SEQ ID NO: 55329

SEQ ID NO: 378791 - RNA, 64 nt, Homo Sapiens; identical to SEQ ID NO: 55330

SEQ ID NO: 378792 - RNA, 64 nt, Homo Sapiens; identical to SEQ ID NO: 55331

SEQ ID NO: 378793 - RNA, 64 nt, Homo Sapiens; identical to SEQ ID NO: 55332

SEQ ID NO: 378794 - RNA, 64 nt, Homo Sapiens; identical to SEQ ID NO: 55333

SEQ ID NO: 378795 - RNA, 64 nt, Homo Sapiens; identical to SEQ ID NO: 55334

SEQ ID NO: 378796 - RNA, 64 nt, Homo Sapiens; identical to SEQ ID NO: 55335

SEQ ID NO: 378797 - RNA, 64 nt, Homo Sapiens; identical to SEQ ID NO: 182371

SEQ ID NO: 378798 - RNA, 64 nt, Homo Sapiens; identical to SEQ ID NO: 182372

SEQ ID NO: 378799 - RNA, 64 nt, Homo Sapiens; identical to SEQ ID NO: 182373

SEQ ID NO: 378800 - RNA, 64 nt, Homo Sapiens; identical to SEQ ID NO: 182374

SEQ ID NO: 378801 - RNA, 64 nt, Homo Sapiens; identical to SEQ ID NO: 182375

SEQ ID NO: 378802 - RNA, 64 nt, Homo Sapiens; identical to SEQ ID NO: 182376

SEQ ID NO: 378803 - RNA, 64 nt, Homo Sapiens; identical to SEQ ID NO: 182377

SEQ ID NO: 378804 - RNA, 64 nt, Homo Sapiens; identical to SEQ ID NO: 182378

SEQ ID NO: 378805 - RNA, 64 nt, Homo Sapiens; identical to SEQ ID NO: 182379

SEQ ID NO: 378806 - RNA, 64 nt, Homo Sapiens; identical to SEQ ID NO: 182380

SEQ ID NO: 378807 - RNA, 64 nt, Homo Sapiens; identical to SEQ ID NO: 182381

SEQ ID NO: 378808 - RNA, 64 nt, Homo Sapiens; identical to SEQ ID NO: 182382

SEQ ID NO: 378809 - RNA, 64 nt, Homo Sapiens; identical to SEQ ID NO: 182383

SEQ ID NO: 378810 - RNA, 64 nt, Homo Sapiens; identical to SEQ ID NO: 182384

SEQ ID NO: 378811 - RNA, 64 nt, Homo Sapiens; identical to SEQ ID NO: 182385

SEQ ID NO: 378812 - RNA, 64 nt, Homo Sapiens; identical to SEQ ID NO: 182386

SEQ ID NO: 378813 - RNA, 64 nt, Homo Sapiens; identical to SEQ ID NO: 182387

SEQ ID NO: 378814 - RNA, 64 nt, Homo Sapiens; identical to SEQ ID NO: 182388

SEQ ID NO: 378815 - RNA, 64 nt, Homo Sapiens; identical to SEQ ID NO: 182389

SEQ ID NO: 378816 - RNA, 64 nt, Homo Sapiens; identical to SEQ ID NO: 182390

SEQ ID NO: 378817 - RNA, 64 nt, Homo Sapiens; identical to SEQ ID NO: 182391

SEQ ID NO: 378818 - RNA, 64 nt, Homo Sapiens; identical to SEQ ID NO: 182392

SEQ ID NO: 378819 - RNA, 64 nt, Homo Sapiens; identical to SEQ ID NO: 182393

SEQ ID NO: 378820 - RNA, 64 nt, Homo Sapiens; identical to SEQ ID NO: 182394

SEQ ID NO: 378821 - RNA, 64 nt, Homo Sapiens; identical to SEQ ID NO: 182395

SEQ ID NO: 378822 - RNA, 64 nt, Homo Sapiens; identical to SEQ ID NO: 182396

SEQ ID NO: 378823 - RNA, 64 nt, Homo Sapiens; identical to SEQ ID NO: 182397

SEQ ID NO: 378824 - RNA, 64 nt, Homo Sapiens; identical to SEQ ID NO: 182398

SEQ ID NO: 378825 - RNA, 64 nt, Homo Sapiens; identical to SEQ ID NO: 182399

SEQ ID NO: 378826 - RNA, 64 nt, Homo Sapiens; identical to SEQ ID NO: 182400

SEQ ID NO: 378827 - RNA, 64 nt, Homo Sapiens; identical to SEQ ID NO: 182401

SEQ ID NO: 378828 - RNA, 64 nt, Homo Sapiens; identical to SEQ ID NO: 182402

SEQ ID NO: 378829 - RNA, 64 nt, Homo Sapiens; identical to SEQ ID NO: 182403

SEQ ID NO: 378830 - RNA, 64 nt, Homo Sapiens; identical to SEQ ID NO: 182404

SEQ ID NO: 378831 - RNA, 64 nt, Homo Sapiens; identical to SEQ ID NO: 182405

SEQ ID NO: 378832 - RNA, 64 nt, Homo Sapiens; identical to SEQ ID NO: 182406

SEQ ID NO: 378833 - RNA, 64 nt, Homo Sapiens; identical to SEQ ID NO: 182407

SEQ ID NO: 378834 - RNA, 64 nt, Homo Sapiens; identical to SEQ ID NO: 182408

SEQ ID NO: 378835 - RNA, 64 nt, Homo Sapiens; identical to SEQ ID NO: 182409

SEQ ID NO: 378836 - RNA, 64 nt, Homo Sapiens; identical to SEQ ID NO: 182410

SEQ ID NO: 378837 - RNA, 64 nt, Homo Sapiens; identical to SEQ ID NO: 182411

SEQ ID NO: 378838 - RNA, 64 nt, Homo Sapiens; identical to SEQ ID NO: 182412

SEQ ID NO: 378839 - RNA, 64 nt, Homo Sapiens; identical to SEQ ID NO: 182413

SEQ ID NO: 378840 - RNA, 64 nt, Homo Sapiens; identical to SEQ ID NO: 182414

SEQ ID NO: 378841 - RNA, 64 nt, Homo Sapiens; identical to SEQ ID NO: 182415

SEQ ID NO: 378842 - RNA, 64 nt, Homo Sapiens; identical to SEQ ID NO: 182416

SEQ ID NO: 378843 - RNA, 64 nt, Homo Sapiens; identical to SEQ ID NO: 182417

SEQ ID NO: 378844 - RNA, 64 nt, Homo Sapiens; identical to SEQ ID NO: 182418

SEQ ID NO: 378845 - RNA, 64 nt, Homo Sapiens; identical to SEQ ID NO: 182419

SEQ ID NO: 378846 - RNA, 64 nt, Homo Sapiens; identical to SEQ ID NO: 182420

SEQ ID NO: 378847 - RNA, 64 nt, Homo Sapiens; identical to SEQ ID NO: 182421

SEQ ID NO: 378848 - RNA, 64 nt, Homo Sapiens; identical to SEQ ID NO: 182422

SEQ ID NO: 378849 - RNA, 64 nt, Homo Sapiens; identical to SEQ ID NO: 182423

SEQ ID NO: 378850 - RNA, 64 nt, Homo Sapiens; identical to SEQ ID NO: 182424

SEQ ID NO: 378851 - RNA, 64 nt, Homo Sapiens; identical to SEQ ID NO: 182425

SEQ ID NO: 378852 - RNA, 64 nt, Homo Sapiens; identical to SEQ ID NO: 182426

SEQ ID NO: 378853 - RNA, 64 nt, Homo Sapiens; identical to SEQ ID NO: 182427

SEQ ID NO: 378854 - RNA, 64 nt, Homo Sapiens; identical to SEQ ID NO: 182428

SEQ ID NO: 378855 - RNA, 64 nt, Homo Sapiens; identical to SEQ ID NO: 182429

SEQ ID NO: 378856 - RNA, 64 nt, Homo Sapiens; identical to SEQ ID NO: 165753

SEQ ID NO: 378857 - RNA, 64 nt, Homo Sapiens; identical to SEQ ID NO: 165754

SEQ ID NO: 378858 - RNA, 64 nt, Homo Sapiens; identical to SEQ ID NO: 165755

SEQ ID NO: 378859 - RNA, 64 nt, Homo Sapiens; identical to SEQ ID NO: 165756

SEQ ID NO: 378860 - RNA, 64 nt, Homo Sapiens; identical to SEQ ID NO: 165757

SEQ ID NO: 378861 - RNA, 64 nt, Homo Sapiens; identical to SEQ ID NO: 165758

SEQ ID NO: 378862 - RNA, 64 nt, Homo Sapiens; identical to SEQ ID NO: 165759

SEQ ID NO: 378863 - RNA, 64 nt, Homo Sapiens; identical to SEQ ID NO: 165760

SEQ ID NO: 378864 - RNA, 64 nt, Homo Sapiens; identical to SEQ ID NO: 165761

SEQ ID NO: 378865 - RNA, 64 nt, Homo Sapiens; identical to SEQ ID NO: 165762

SEQ ID NO: 378866 - RNA, 64 nt, Homo Sapiens; identical to SEQ ID NO: 165763

SEQ ID NO: 378867 - RNA, 64 nt, Homo Sapiens; identical to SEQ ID NO: 165764

SEQ ID NO: 378868 - RNA, 64 nt, Homo Sapiens; identical to SEQ ID NO: 165765

SEQ ID NO: 378869 - RNA, 64 nt, Homo Sapiens; identical to SEQ ID NO: 165766

SEQ ID NO: 378870 - RNA, 64 nt, Homo Sapiens; identical to SEQ ID NO: 165767

SEQ ID NO: 378871 - RNA, 64 nt, Homo Sapiens; identical to SEQ ID NO: 165768

SEQ ID NO: 378872 - RNA, 64 nt, Homo Sapiens; identical to SEQ ID NO: 165769

SEQ ID NO: 378873 - RNA, 64 nt, Homo Sapiens; identical to SEQ ID NO: 165770

SEQ ID NO: 378874 - RNA, 64 nt, Homo Sapiens; identical to SEQ ID NO: 165771

SEQ ID NO: 378875 - RNA, 64 nt, Homo Sapiens; identical to SEQ ID NO: 165772

SEQ ID NO: 378876 - RNA, 64 nt, Homo Sapiens; identical to SEQ ID NO: 165773

SEQ ID NO: 378877 - RNA, 64 nt, Homo Sapiens; identical to SEQ ID NO: 165774

SEQ ID NO: 378878 - RNA, 64 nt, Homo Sapiens; identical to SEQ ID NO: 165775

SEQ ID NO: 378879 - RNA, 64 nt, Homo Sapiens; identical to SEQ ID NO: 165776

SEQ ID NO: 378880 - RNA, 64 nt, Homo Sapiens; identical to SEQ ID NO: 165777

SEQ ID NO: 378881 - RNA, 64 nt, Homo Sapiens
cuggccagucgggaugacuguugucagggggauuggguugaaaaaagaggcggcuacgugcggu

SEQ ID NO: 378882 - RNA, 64 nt, Homo Sapiens
ccuuccccggcuccgggcaugcccccagggccuaggguugaaagggggucucuggucaaaccca

SEQ ID NO: 378883 - RNA, 64 nt, Homo Sapiens
gcuagucucuaugagguccuuauugcacuuauugggguugaagcucuucagaggagcuggaacu

SEQ ID NO: 378884 - RNA, 64 nt, Homo Sapiens
ccacuuccauuggucuccaggccccaauaaucugggguugaaacuuugaggaaaugccagugac

SEQ ID NO: 378885 - RNA, 64 nt, Homo Sapiens
uaaccugaaagauacgacauugcugagccuuacuggguugaaaaggaguagcucagaccuguuu

SEQ ID NO: 378886 - RNA, 64 nt, Homo Sapiens
gggaaacuaucaacucuuucuuuaaaaagaaagaggguugaaaauccucuggacgaacagaagu

SEQ ID NO: 378887 - RNA, 61 nt, Homo Sapiens
acagccagcagggcccaggcagccaccaagcccaccccaggucaugccagcggcagaggac

SEQ ID NO: 378888 - RNA, 61 nt, Homo Sapiens
acgaucugggggggggauccugucuuccuccccaccccaccccacucuuacccaauuucug

SEQ ID NO: 378889 - RNA, 61 nt, Homo Sapiens
cugggggggggauccugucuuccuccccaccccaccccacucuuacccaauuucugggcuc

SEQ ID NO: 378890 - RNA, 61 nt, Homo Sapiens
gugccuggccuccagugucccaccuccuucaccaccccacuuggcuccuuugccaucuuga

SEQ ID NO: 378891 - RNA, 61 nt, Homo Sapiens
auuucuguaaagaugguuauuuaacccuccuccaccccaucacgguggcccugagggcuga

SEQ ID NO: 378892 - RNA, 61 nt, Homo Sapiens
guuucaagucuggguucugguguccacucacccaccccaccccccaaaaucagacaaaugc

SEQ ID NO: 378893 - RNA, 61 nt, Homo Sapiens
gaccagguccuguuccucuuucuccccgacuccaccccagcucccugugaagagagaguua

SEQ ID NO: 378894 - RNA, 61 nt, Homo Sapiens
caaccucuaugcuuucuucuuagcaagccccccaccccaauuuuuuuuaaauggaagcuuc

SEQ ID NO: 378895 - RNA, 61 nt, Homo Sapiens
cacgcccccuaccuuucccaucaacccccucccaccccaucagggcaucucccugcucccc

SEQ ID NO: 378896 - RNA, 61 nt, Homo Sapiens
uguaguuaauuucagugccuuccaccacuccccaccccagcucaucccucuuuuucuuucu

SEQ ID NO: 378897 - RNA, 61 nt, Homo Sapiens
caccacugaguccacucggaggccugcaggcccaccccagccccuuccuccuucaugccug

SEQ ID NO: 378898 - RNA, 61 nt, Homo Sapiens
cccacugcccuccagggccaagggaccacauccaccccagcauccaggaaagaugucccac

SEQ ID NO: 378899 - RNA, 61 nt, Homo Sapiens
ccuggcugaccugcuguggaacagacccugcccaccccaucgccucaccucccagggcuac

SEQ ID NO: 378900 - RNA, 61 nt, Homo Sapiens
uguauauaacccagccccugucugcaucuguccaccccauguguauuuagcuuugaguuuc

SEQ ID NO: 378901 - RNA, 61 nt, Homo Sapiens
accccggggucucuggggaaggaaccacugcccaccccaccccaaggugugugugucugga

SEQ ID NO: 378902 - RNA, 61 nt, Homo Sapiens
accauacacacauacaaguccacacacacucccaccccagccaaaaauauauaaaaaacaa

SEQ ID NO: 378903 - RNA, 61 nt, Homo Sapiens
aacaacccccaaccaccaucuaccacuacggccaccccaaaggaccccgacgccaacagac

SEQ ID NO: 378904 - RNA, 61 nt, Homo Sapiens
gugucguuuuguuuuuaaaggaccugcuuccccaccccacggccagcugccacagcugcau

SEQ ID NO: 378905 - RNA, 61 nt, Homo Sapiens
ucuucuuuccauuuauuucguccacagcaccccaccccauaggaggguggcuggcccggcc

SEQ ID NO: 378906 - RNA, 61 nt, Homo Sapiens
uccccaccaccaccucugugccccuucucucccaccccaucgaggcccuuuucugaucaug

SEQ ID NO: 378907 - RNA, 61 nt, Homo Sapiens
cuuuuccuuucaucugaacaauccaccagucccaccccagcgcccaacagguccacgaugg

SEQ ID NO: 378908 - RNA, 61 nt, Homo Sapiens
acgccacucauuucaucucaagcgccucccuccaccccaggccccagccccgacuccagcc

SEQ ID NO: 378909 - RNA, 61 nt, Homo Sapiens
ggaaaaucgucuaacuggagaagggcgguauccaccccacauucggaucccaggguccuga

SEQ ID NO: 378910 - RNA, 61 nt, Homo Sapiens
aaggcacaauguggagccuggggugucucccccaccccaggaccgucagguuuaccagugu

SEQ ID NO: 378911 - RNA, 61 nt, Homo Sapiens
gcagggccccucccccagcuccauuccgcucccaccccagccggcugcguuccucucucca

SEQ ID NO: 378912 - RNA, 61 nt, Homo Sapiens
uuuauucagcuacaucaucccucuauuaaccccaccccaucaggcacgugugcaaaccucu

SEQ ID NO: 378913 - RNA, 61 nt, Homo Sapiens
ugccuuuggagguuaaggcuagcuguucuccccaccccagguuuccuguuguaggggagga

SEQ ID NO: 378914 - RNA, 61 nt, Homo Sapiens
uguacuggaagggacccuggcacagcucagcccaccccaucggucgcuuugauucuuccug

SEQ ID NO: 378915 - RNA, 61 nt, Homo Sapiens
gauugcccgugaagacuuugaucccagacucccaccccagguauccuucauuauccacccc

SEQ ID NO: 378916 - RNA, 61 nt, Homo Sapiens
ccagacucccaccccagggauccuucauuauccaccccauccacuucugcaaccccaggua

SEQ ID NO: 378917 - RNA, 61 nt, Homo Sapiens
ucugcaaccccagguauccucccagggauucccaccccacucaccuccuguggacugaugc

SEQ ID NO: 378918 - RNA, 61 nt, Homo Sapiens
gucgagguuccccuaccccugcaggagcaacccaccccaugcuugccccuaguacccccug

SEQ ID NO: 378919 - RNA, 61 nt, Homo Sapiens
agcccugaccucauuugggccccccgucccuccaccccagauucccccgccgccacugugc

SEQ ID NO: 378920 - RNA, 52 nt, Homo Sapiens; identical to SEQ ID NO: 80232

SEQ ID NO: 378921 - RNA, 61 nt, Homo Sapiens
gacaccuuugcagggauucuuguccugcuggccaccccacccacaccugucccuggccagc

SEQ ID NO: 378922 - RNA, 61 nt, Homo Sapiens
ugagguaccuuuccacccagacccuccuuccccaccccauaagcccugagacucccgccuu

SEQ ID NO: 378923 - RNA, 61 nt, Homo Sapiens
ccccgcgucuucagcuguuucgcauccaccgccaccccacugagagcugcuccuuuggggg

SEQ ID NO: 378924 - RNA, 61 nt, Homo Sapiens
cucaaccaggaggugauuuugcccccugacuccaccccagggacauucaaaaaugucuggu

SEQ ID NO: 378925 - RNA, 61 nt, Homo Sapiens
cacagcacaaccuacaacagcaaagaaucauccaccccaaaauaucaguagugccgagauu

SEQ ID NO: 378926 - RNA, 61 nt, Homo Sapiens
ccugccauccccccccgccguccugccuuccccaccccacccuuaggucccagguaguugc

SEQ ID NO: 378927 - RNA, 61 nt, Homo Sapiens
caauguaagggccucagcuuccuuggagaagccaccccagguuuccagacauagauguuga

SEQ ID NO: 378928 - RNA, 61 nt, Homo Sapiens
caggcccauccaucccaugccucccuccuccccaccccacuccaacaguuccucuuucccg

SEQ ID NO: 378929 - RNA, 61 nt, Homo Sapiens
aagcgcuucucuucgcauagucacguagcucccaccccacccucuuccugugucucacgca

SEQ ID NO: 378930 - RNA, 61 nt, Homo Sapiens
cuauugacagucaccccguaagguucacaaaccaccccauugaacagaugaggaacugagg

SEQ ID NO: 378931 - RNA, 61 nt, Homo Sapiens
ugagaggagugguguguaccccuaaauccucccaccccagcacugcccaucuguaaaaucu

SEQ ID NO: 378932 - RNA, 61 nt, Homo Sapiens
cccagguagggacgccccuuguuccucacccccaccccacuuagguccugggcccccacug

SEQ ID NO: 378933 - RNA, 61 nt, Homo Sapiens
cuaucagggggacagcuggugggcaaagcagccaccccacagccuuguggcuagaguacag

SEQ ID NO: 378934 - RNA, 61 nt, Homo Sapiens
ucuggaaagcucucccaggaggaagcauuccccaccccaccuugccucuguccugcgcugg

SEQ ID NO: 378935 - RNA, 61 nt, Homo Sapiens
ucuccuguggcccucuaguccaccccccgccccaccccagccccuggcaaccacugaucug

SEQ ID NO: 378936 - RNA, 61 nt, Homo Sapiens
agcacggcacacaguucagccccaccccaccccaccccaggcgacagccaggacugcccuc

SEQ ID NO: 378937 - RNA, 61 nt, Homo Sapiens
ccaggagcacggcacacagucccuccccaccccaccccaccgcccacgacagccaggacug

SEQ ID NO: 378938 - RNA, 61 nt, Homo Sapiens
ccaccccaggagcacggcacgacugcccuccccaccccacccgacagcccacgacagccag

SEQ ID NO: 378939 - RNA, 61 nt, Homo Sapiens
acaaaguugccacagguuuuguagcccauuuccaccccaccaacuucauuucccccucacu

SEQ ID NO: 378940 - RNA, 61 nt, Homo Sapiens
uugucccugaugucuuggggcccaucucacuccaccccacuucuauaccuucuucuccuuc

SEQ ID NO: 378941 - RNA, 61 nt, Homo Sapiens
uuccggcucccucuucuccccccucuacccgccaccccaccccaccccacccccgcccacu

SEQ ID NO: 378942 - RNA, 61 nt, Homo Sapiens
gcucccucuucuccccccucuacccgccaccccaccccaccccacccccgcccacucguug

SEQ ID NO: 378943 - RNA, 61 nt, Homo Sapiens
cucuucuccccccucuacccgccaccccaccccaccccacccccgcccacucguugccuga

SEQ ID NO: 378944 - RNA, 61 nt, Homo Sapiens
ggaggacuccuggguggacagccuuugacguccaccccacgcugaugcagaagcucccaga

SEQ ID NO: 378945 - RNA, 61 nt, Homo Sapiens
acugcauggccucugcccauccugcaccuguccaccccaccccaacacccuggaagccacu

SEQ ID NO: 378946 - RNA, 61 nt, Homo Sapiens
auggccucugcccauccugcaccuguccaccccaccccaacacccuggaagccacugucaa

SEQ ID NO: 378947 - RNA, 61 nt, Homo Sapiens
gagggaggggcccuggaggccacauccugccccaccccacccccacucccacggacacuaa

SEQ ID NO: 378948 - RNA, 61 nt, Homo Sapiens
aucuggggcuguuccccccccuccguuuuuuccaccccacaguuccuccugggaucuggcc

SEQ ID NO: 378949 - RNA, 61 nt, Homo Sapiens
ucccuucccaccuccaaccuagcccuacugcccaccccaccccaacccaccccaugcccag

SEQ ID NO: 378950 - RNA, 61 nt, Homo Sapiens
ucccaccuccaaccuagcccuacugcccaccccaccccaacccaccccaugcccagugguc

SEQ ID NO: 378951 - RNA, 61 nt, Homo Sapiens
aaccuagcccuacugcccaccccaccccaacccaccccaugcccaguggucucaguagaua

SEQ ID NO: 378952 - RNA, 61 nt, Homo Sapiens
cggcagccacuagaccgcgcccggcagccacccaccccacgugccaacuuccccuccccgu

SEQ ID NO: 378953 - RNA, 61 nt, Homo Sapiens
uuugcugugcuucccgccguggagggcagagccaccccacaucaggaucggacgugcuacc

SEQ ID NO: 378954 - RNA, 61 nt, Homo Sapiens
uuacccccccggccugggcaucugaccucccccaccccagugugauuuaacauccaggaac

SEQ ID NO: 378955 - RNA, 61 nt, Homo Sapiens
cccagccguguguggugucagguuccucuccccaccccagcuucaagcagaggccucgggg

SEQ ID NO: 378956 - RNA, 61 nt, Homo Sapiens
agcuguguuuuuuaaagccaccucucugucuccaccccaugggcccacacccagguggggg

SEQ ID NO: 378957 - RNA, 61 nt, Homo Sapiens
cuuccacaugagcuaaagcccucccgcgcccccaccccagaccccgagccaccccaggaaa

SEQ ID NO: 378958 - RNA, 61 nt, Homo Sapiens
gcccucccgcgcccccaccccagaccccgagccaccccaggaaaagcacaaggacugccgc

SEQ ID NO: 378959 - RNA, 61 nt, Homo Sapiens
ucaacagaauauacauucuuuacagaacgcuccaccccaaaaagcggaccuaggagacauc

SEQ ID NO: 378960 - RNA, 61 nt, Homo Sapiens
ugggacuuccauggcuucuguacaccacuagccaccccacgccauccgagaccucuguccu

SEQ ID NO: 378961 - RNA, 61 nt, Homo Sapiens
augcuuguccugaagagagguuuggcuauccccaccccaccccaccccacccuguuccuuu

SEQ ID NO: 378962 - RNA, 61 nt, Homo Sapiens
uguccugaagagagguuuggcuauccccaccccaccccaccccacccuguuccuuuuuuau

SEQ ID NO: 378963 - RNA, 61 nt, Homo Sapiens
ugaagagagguuuggcuauccccaccccaccccaccccacccuguuccuuuuuuaucagga

SEQ ID NO: 378964 - RNA, 61 nt, Homo Sapiens
ugccuucaggucuucuucacaauaagcacccccaccccaucccccuucuccacuguagcaa

SEQ ID NO: 378965 - RNA, 61 nt, Homo Sapiens
uacacagcagaauaguacaaccaguuuaccaccaccccaaguugaaagcuccgaguuuggg

SEQ ID NO: 378966 - RNA, 61 nt, Homo Sapiens
cugcccccacccucacccaccugccaccagcccaccccaccucaccaaugcaucuaucugu

SEQ ID NO: 378967 - RNA, 61 nt, Homo Sapiens
gaagccaugaacucccaagcggggcuuggccccaccccagcguggggggaucacaaagcca

SEQ ID NO: 378968 - RNA, 61 nt, Homo Sapiens
ugcauucccagcucuacccuuccugcuuuaaccaccccaucuggccuugccacacucuuuc

SEQ ID NO: 378969 - RNA, 61 nt, Homo Sapiens
cuggccuugccacacucuuucccuggagcagccaccccaugaaggaggcuaugcucagggg

SEQ ID NO: 378970 - RNA, 61 nt, Homo Sapiens
gcucuuuccuuccccuccuccaucuguagggccaccccacacugccuuggugcagcagggu

SEQ ID NO: 378971 - RNA, 61 nt, Homo Sapiens
cugggaaggagagcuugcuuauccaucauaaccaccccagccuccagcugucugacuaucc

SEQ ID NO: 378972 - RNA, 61 nt, Homo Sapiens
cucagcgucucugccccuaaucuccauccuuccaccccaccgcuccaccccaccacugucu

SEQ ID NO: 378973 - RNA, 61 nt, Homo Sapiens
acugucuucuccauccuucccccccaccgcuccaccccaccuuccuccacccacccucuau

SEQ ID NO: 378974 - RNA, 61 nt, Homo Sapiens
uaaccuccucaguucccuagcucuccccaccccaccccagagaaucuucaaucaaccuggg

SEQ ID NO: 378975 - RNA, 61 nt, Homo Sapiens
ccagauaaccuccucaguuccugggcucuccccaccccacccacuagaaucuucaaucaac

SEQ ID NO: 378976 - RNA, 61 nt, Homo Sapiens
accacccaaaggguggugggcacugcugugaccaccccagcugcagagucagugcccuggg

SEQ ID NO: 378977 - RNA, 61 nt, Homo Sapiens
gguccugggaccucuaaugugggcaugucguccaccccaggacgagccaucagggacagac

SEQ ID NO: 378978 - RNA, 61 nt, Homo Sapiens
gaaggaugggccugcugcacgucucccuccuccaccccauaccacacuggggggucugagc

SEQ ID NO: 378979 - RNA, 61 nt, Homo Sapiens
ggucacccuccugguucugcccugucccauuccaccccaccccagggggaacaguagcuuc

SEQ ID NO: 378980 - RNA, 61 nt, Homo Sapiens
cccuccugguucugcccugucccauuccaccccaccccagggggaacaguagcuucaccuu

SEQ ID NO: 378981 - RNA, 61 nt, Homo Sapiens
cuggggcccagauugugaggcuccucagcucccaccccaggcugugggacuuucugguggg

SEQ ID NO: 378982 - RNA, 61 nt, Homo Sapiens
cagcugggcagggccggugucagcacccgcuccaccccagcaggacccccaggccugagcc

SEQ ID NO: 378983 - RNA, 61 nt, Homo Sapiens
ugccaagcccugggccagcacaggguacccuccaccccagcguucuggguggcuggaucuc

SEQ ID NO: 378984 - RNA, 61 nt, Homo Sapiens
acaagccgacacacagggagagagcaaacacccaccccagacugaaggggagcucugagac

SEQ ID NO: 378985 - RNA, 61 nt, Homo Sapiens
acaauaccucgaauuuccaaccggagucccuccaccccauaagccccgccccuuucuuucc

SEQ ID NO: 378986 - RNA, 61 nt, Homo Sapiens
ccccggcaugaggccuuuccggcagcucucaccaccccaggccuccguccucugcuuuccg

SEQ ID NO: 378987 - RNA, 61 nt, Homo Sapiens
cuaauagcuaggauuacagguguguggccucccaccccaccccacccuucacaccuggcug

SEQ ID NO: 378988 - RNA, 61 nt, Homo Sapiens
agcuaggauuacagguguguggccucccaccccaccccacccuucacaccuggcugauuuu

SEQ ID NO: 378989 - RNA, 61 nt, Homo Sapiens
cacucuccccaguccucaggcagcagcuuuuccaccccaggaaucucuguuccuucucugu

SEQ ID NO: 378990 - RNA, 61 nt, Homo Sapiens
ccagcauggaugugucucaggcaccucauccccaccccaccucaccccaacaaacuccucu

SEQ ID NO: 378991 - RNA, 61 nt, Homo Sapiens
aggcuacauccugauaccuauaaguucacccccaccccacagcugcuggagagaaauccca

SEQ ID NO: 378992 - RNA, 61 nt, Homo Sapiens
ucuguauauacuuucccagcccugucugucuccaccccauccccucuugucucugagaacc

SEQ ID NO: 378993 - RNA, 61 nt, Homo Sapiens
ccauccccucuugucucugagaaccauucucccaccccaaguuccaccuucuauguuucua

SEQ ID NO: 378994 - RNA, 61 nt, Homo Sapiens
cuucccucacccacuuuggccuccguucaccccaccccaccccaccucuccccaccuuacc

SEQ ID NO: 378995 - RNA, 61 nt, Homo Sapiens
cucacccacuuuggccuccguucaccccaccccaccccaccucuccccaccuuacccccgc

SEQ ID NO: 378996 - RNA, 61 nt, Homo Sapiens
gcucugcucccggucuugggcccugggaaccccaccccaccccaccccacaggcguuguaa

SEQ ID NO: 378997 - RNA, 61 nt, Homo Sapiens
gcucccggucuugggcccugggaaccccaccccaccccaccccacaggcguuguaaccuug

SEQ ID NO: 378998 - RNA, 61 nt, Homo Sapiens
cggucuugggcccugggaaccccaccccaccccaccccacaggcguuguaaccuugaaucu

SEQ ID NO: 378999 - RNA, 61 nt, Homo Sapiens
uugccucucuccugugggccuccucagcucuccaccccagggugaguccuugugcuccugc

SEQ ID NO: 379000 - RNA, 61 nt, Homo Sapiens
caggugucccuccuaugcacugggcacuuccccaccccagcugcauccccagcacuggucc

SEQ ID NO: 379001 - RNA, 61 nt, Homo Sapiens
aagccuuggcaaccucauuuggucuuucccaccaccccacuugacuuuaguguaguggugg

SEQ ID NO: 379002 - RNA, 61 nt, Homo Sapiens
gacucaggacucaggucucccccagccccagccaccccauggaugacauauuacccgcuga

SEQ ID NO: 379003 - RNA, 61 nt, Homo Sapiens
gggcccaaccaugggcucagcccggacccuuccaccccacuuagcuucccucucccucauu

SEQ ID NO: 379004 - RNA, 61 nt, Homo Sapiens
ccucugguccaucccucccuuagccgguugcccaccccagcugcuuuuauuuauuuuggau

SEQ ID NO: 379005 - RNA, 61 nt, Homo Sapiens
guuggugagaugccaaguuugcccagcuugcccaccccauauggugucucccagcuucccc

SEQ ID NO: 379006 - RNA, 61 nt, Homo Sapiens
cagggcucccuguccagaaucauaccugcacccaccccagcucuuuccugccccuccccau

SEQ ID NO: 379007 - RNA, 61 nt, Homo Sapiens
gucacuuuccuacccugauggucacacuagcccaccccaagcuccgacauugagguuuuca

SEQ ID NO: 379008 - RNA, 61 nt, Homo Sapiens
uuuucaucucugcagggagagguuccaauguccaccccacccccagguacccgccucuucc

SEQ ID NO: 379009 - RNA, 61 nt, Homo Sapiens
uccacccagccugaggcucaagcugcccuuaccaccccaucccccacgcaggaccaacuac

SEQ ID NO: 379010 - RNA, 61 nt, Homo Sapiens
caaaccacuuacuucccuguucaccucugccccaccccagcccagaggaguuugagccacc

SEQ ID NO: 379011 - RNA, 61 nt, Homo Sapiens
caccccgggguggcccuggaggccccugaccccaccccacccacagagcacgagggccccg

SEQ ID NO: 379012 - RNA, 61 nt, Homo Sapiens
caucagaggacgccccgugcgcugucaccuuccaccccacaaggccaaccuuuuucugugg

SEQ ID NO: 379013 - RNA, 51 nt, Homo Sapiens; identical to SEQ ID NO: 80325

SEQ ID NO: 379014 - RNA, 61 nt, Homo Sapiens
caccacuagggggugauggagaggaagggggccaccccagggccauuaacaaccaguacuc

SEQ ID NO: 379015 - RNA, 61 nt, Homo Sapiens
cacuccgucugcuccaaugacugagcagcauccaccccaccccaucuuugcugccagcucu

SEQ ID NO: 379016 - RNA, 61 nt, Homo Sapiens
cgucugcuccaaugacugagcagcauccaccccaccccaucuuugcugccagcucucagga

SEQ ID NO: 379017 - RNA, 61 nt, Homo Sapiens
accucuguguaucuguacagccucgcuccugccaccccacccuugcguucugcauuaggua

SEQ ID NO: 379018 - RNA, 61 nt, Homo Sapiens
cgggcacugcacagccugucugggggccagaccaccccauuguccauccuuguuguccgug

SEQ ID NO: 379019 - RNA, 61 nt, Homo Sapiens
ccgcaucaacaaaaccugaggccccuuccucccaccccaucucucuccuguggaugcuccu

SEQ ID NO: 379020 - RNA, 61 nt, Homo Sapiens
ugucccugacccugccugaucccucccucacccaccccaaagguauuuuugauaacagagc

SEQ ID NO: 379021 - RNA, 61 nt, Homo Sapiens
acugagccagggccugcauuuuugguuuuccccaccccacacauucucaaccauaguccuu

SEQ ID NO: 379022 - RNA, 61 nt, Homo Sapiens
ggacuuaauaccagccggauaccucuggcccccaccccauuacuguaccucuggagucacu

SEQ ID NO: 379023 - RNA, 54 nt, Homo Sapiens; identical to SEQ ID NO: 80335

SEQ ID NO: 379024 - RNA, 61 nt, Homo Sapiens
cccggaaccggacggcacagggcguucuugcccaccccaggggccaggcuugcggaggggg

SEQ ID NO: 379025 - RNA, 61 nt, Homo Sapiens
acguggcacacauuccacgugggugcugccgccaccccagucggucguggcgugcagcugg

SEQ ID NO: 379026 - RNA, 61 nt, Homo Sapiens
uuuggccucuguuuguccccuuuccaguccuccaccccaccccuggagcccagccugggag

SEQ ID NO: 379027 - RNA, 61 nt, Homo Sapiens
cugagaagugaggagccccuccgcccggcagccaccccaucugggaagugaggagcgucua

SEQ ID NO: 379028 - RNA, 61 nt, Homo Sapiens
cugggaagugaggagccccucugccuggccaccaccccaucugggaggugugcccagcagc

SEQ ID NO: 379029 - RNA, 61 nt, Homo Sapiens
uuugccuggugucuuccuuucccguguccgcccaccccagcgucuguugguacuuaccugu

SEQ ID NO: 379030 - RNA, 61 nt, Homo Sapiens
aacaccagucagcccuauacccuaacucacuccaccccauuuucuccggcugccuggccgg

SEQ ID NO: 379031 - RNA, 61 nt, Homo Sapiens
uauuuuguuuuuguucucaccugcugcccccccaccccaccaccccagggauaaauuggau

SEQ ID NO: 379032 - RNA, 61 nt, Homo Sapiens
uuuuguucucaccugcugcccccccaccccaccaccccagggauaaauuggauauaaacac

SEQ ID NO: 379033 - RNA, 61 nt, Homo Sapiens
cauccauguguggcucugcuccaccccugugccaccccagagcccugggggguggucucca

SEQ ID NO: 379034 - RNA, 61 nt, Homo Sapiens
ugucuccacggugcucucgcccugcccauggccaccccagacucugaucuccaggaacccc

SEQ ID NO: 379035 - RNA, 61 nt, Homo Sapiens
cuacucuccagacgcccugaucaucuccaccccaccccacccauuucuccccucucuuccu

SEQ ID NO: 379036 - RNA, 61 nt, Homo Sapiens
ccacccuacucuccagacgcuuccuucaucuccaccccaccccugccauuucuccccucuc

SEQ ID NO: 379037 - RNA, 61 nt, Homo Sapiens
aagggcaagagcuguggaaaaccccaccuccccaccccaaaaucauucacauguaaaaaua

SEQ ID NO: 379038 - RNA, 61 nt, Homo Sapiens
cccaccuucacccucuuccucccaacuacccccaccccaauacuaaggacugagcccccua

SEQ ID NO: 379039 - RNA, 61 nt, Homo Sapiens
cacuucugcacuugcgguucaccagccuggcccaccccaccucagacuaagccagcaccgg

SEQ ID NO: 379040 - RNA, 59 nt, Homo Sapiens; identical to SEQ ID NO: 80352

SEQ ID NO: 379041 - RNA, 61 nt, Homo Sapiens
gcacccacucugcuuugacuggcugacacguccaccccaguccuggaggccgggugcucag

SEQ ID NO: 379042 - RNA, 61 nt, Homo Sapiens
gugaccggcugcuuuucccuucugacccucuccaccccauacaguaagccacugccacacg

SEQ ID NO: 379043 - RNA, 61 nt, Homo Sapiens
ugcuccccucccuccucuguugagcuccccaccaccccagccuggcacauuuccccagacc

SEQ ID NO: 379044 - RNA, 61 nt, Homo Sapiens
uccugcccuggaaaucuggacccucccugccccaccccagcagacggucuugccucucagc

SEQ ID NO: 379045 - RNA, 61 nt, Homo Sapiens
augaccuuugacccuacggcucucccugcccccaccccacugggagcucuuggcugcaucu

SEQ ID NO: 379046 - RNA, 61 nt, Homo Sapiens
cccgccaugcaacgggauugcccaccccaccccaccccaccccggaggucacuccaccauc

SEQ ID NO: 379047 - RNA, 61 nt, Homo Sapiens
ccacccccgccaugcaacggccauccccaccccaccccaccugccaccggaggucacucca

SEQ ID NO: 379048 - RNA, 61 nt, Homo Sapiens
ccaccccacccccgccaugccuccaccauccccaccccaccccgccugccaccggagguca

SEQ ID NO: 379049 - RNA, 61 nt, Homo Sapiens
aucaggaucucuuucucauucaaggggggaaccaccccaggucagcgcugcgccugcugug

SEQ ID NO: 379050 - RNA, 61 nt, Homo Sapiens
ccuuuccuuugaaugauagcugugauucaccccaccccauuuucuuguuucugguccaucc

SEQ ID NO: 379051 - RNA, 61 nt, Homo Sapiens
uuucuucauuucuuuccagaacaacucuuucccaccccaacaccacugccaccaccccucu

SEQ ID NO: 379052 - RNA, 61 nt, Homo Sapiens
caggugcaacaaaaacaagaaacaaaugugcccaccccacuuuccgcuuaacugaaaagcu

SEQ ID NO: 379053 - RNA, 61 nt, Homo Sapiens
agaugaggggaggggccgcagugcgcagaacccaccccaccccccagugcagacuucgggg

SEQ ID NO: 379054 - RNA, 61 nt, Homo Sapiens
accccaccccccagugcagacuucggggucuccaccccaggccagcagcgcccacugggcu

SEQ ID NO: 379055 - RNA, 61 nt, Homo Sapiens
accaggagggggagagcagccuccacuuaccccaccccacccuugggcuaaaagcccccag

SEQ ID NO: 379056 - RNA, 61 nt, Homo Sapiens
aggggcaccccagccccgccucugcucccccccaccccacccacccucggggcgccccccu

SEQ ID NO: 379057 - RNA, 61 nt, Homo Sapiens
ggcuguugccccucccuccaucuccccacacccaccccaccccacagcagggcuccuggcc

SEQ ID NO: 379058 - RNA, 61 nt, Homo Sapiens
uugccccucccuccaucuccccacacccaccccaccccacagcagggcuccuggcccccac

SEQ ID NO: 379059 - RNA, 61 nt, Homo Sapiens
caccccuccucuccccccgccuccuggccugccaccccaccccagcguuuaccccaaagca

SEQ ID NO: 379060 - RNA, 61 nt, Homo Sapiens
cuccucuccccccgccuccuggccugccaccccaccccagcguuuaccccaaagcacaaug

SEQ ID NO: 379061 - RNA, 61 nt, Homo Sapiens
acugagucccucugggcagcagcucccuucuccaccccaccccagcacccgucccaaaugu

SEQ ID NO: 379062 - RNA, 61 nt, Homo Sapiens
gucccucugggcagcagcucccuucuccaccccaccccagcacccgucccaaauguggccu

SEQ ID NO: 379063 - RNA, 61 nt, Homo Sapiens
gaaagaagcuaaaccuugcacaucccaacacccaccccagggagaguucccgugugugccu

SEQ ID NO: 379064 - RNA, 61 nt, Homo Sapiens
acugaguuuauccaccgccauccaccucuauccaccccauaaggucccuacagcaaguggg

SEQ ID NO: 379065 - RNA, 61 nt, Homo Sapiens
auguccccauuacaccagagcaccccccaccccaccccaccgcucaggagccagcacagga

SEQ ID NO: 379066 - RNA, 61 nt, Homo Sapiens
ccaccauguccccauuacaccaggacaccccccaccccaccaugcugcucaggagccagca

SEQ ID NO: 379067 - RNA, 61 nt, Homo Sapiens
caccccucuuuuuacucaaacgccccucuccccaccccaggcuccagggccuuagaaccac

SEQ ID NO: 379068 - RNA, 61 nt, Homo Sapiens
ucuccuggccacugagacacccccccgucgcccaccccacguccaacccugccugcggccu

SEQ ID NO: 379069 - RNA, 61 nt, Homo Sapiens
gcuggguuucggggcuugguccuuccccccaccaccccaucccccggcccucccuggcucc

SEQ ID NO: 379070 - RNA, 61 nt, Homo Sapiens
uuccuccaggccaagucaugcuacuuguuucccaccccagguggccucugagguuggggga

SEQ ID NO: 379071 - RNA, 61 nt, Homo Sapiens
ggcagcguccaggugcggggcccacccgcccccaccccaccuuuguccgucuauccacccg

SEQ ID NO: 379072 - RNA, 61 nt, Homo Sapiens
cagcggccccaucggaacugcgcaccgcuccccaccccacuccggagccccugggagcccu

SEQ ID NO: 379073 - RNA, 61 nt, Homo Sapiens
cccugccccagacgcucccuggcaggaggucccaccccagacauagcaucccacaggccca

SEQ ID NO: 379074 - RNA, 61 nt, Homo Sapiens
cugggcuguucacucucucguccuccugcccccaccccaggcccggggaucccccgcccca

SEQ ID NO: 379075 - RNA, 61 nt, Homo Sapiens
acuauugugcgauucgugagccgugcgacccccaccccauggaccacgcuucuccuccgug

SEQ ID NO: 379076 - RNA, 61 nt, Homo Sapiens
gggcaggcaggcaggcccccccguccucccaccaccccaggccagcgucuucuccccagcc

SEQ ID NO: 379077 - RNA, 61 nt, Homo Sapiens
cauccccguauuucccccucccgcuggggagccaccccauucguaauagaaaaguggggag

SEQ ID NO: 379078 - RNA, 61 nt, Homo Sapiens
cuccaggguuagggggagcauaauuucacccccaccccaccgccccagaguuccuugcauc

SEQ ID NO: 379079 - RNA, 61 nt, Homo Sapiens
caucugaaccauuccugucuccccccaccuuccaccccaaccuuccucugacgguuacccu

SEQ ID NO: 379080 - RNA, 53 nt, Homo Sapiens; identical to SEQ ID NO: 80392

SEQ ID NO: 379081 - RNA, 61 nt, Homo Sapiens
uacagggugagcucagccuggucuccccaccccaccccauuaacaccaccacccccagggg

SEQ ID NO: 379082 - RNA, 61 nt, Homo Sapiens
ccauuuacagggugagcucaagggggucuccccaccccaccgagccaacaccaccaccccc

SEQ ID NO: 379083 - RNA, 61 nt, Homo Sapiens
uugaaaaacaguugucuggccccccagugcaccaccccauaaacauugugagccagcuaga

SEQ ID NO: 379084 - RNA, 61 nt, Homo Sapiens
uacagcaagggacuccccagggcucagcuucccaccccacgaagaaggcuggugagggaag

SEQ ID NO: 379085 - RNA, 61 nt, Homo Sapiens
cucugaaaugugaaaagccucccaccccaccccaccccaccaagccaggggcccaccccgc

SEQ ID NO: 379086 - RNA, 61 nt, Homo Sapiens
ccacccucugaaaugugaaacccgccccaccccaccccaccgcccaaagccaggggcccac

SEQ ID NO: 379087 - RNA, 61 nt, Homo Sapiens
ccaccccacccucugaaaugcccaccccgccccaccccaccgggcagcccaaagccagggg

SEQ ID NO: 379088 - RNA, 61 nt, Homo Sapiens
uucuaauuugcuguaggcugauauccgccccccaccccaguaggguauuacugguggaaua

SEQ ID NO: 379089 - RNA, 61 nt, Homo Sapiens
aucaucaggcaccuuucccccuaaugagauuccaccccaauuggggguucucgccaauucc

SEQ ID NO: 379090 - RNA, 61 nt, Homo Sapiens
ccaccaacuucucugccccagggacccgaggccaccccagccugguguggacccaucggcg

SEQ ID NO: 379091 - RNA, 61 nt, Homo Sapiens
ccucaggcccucccugccaaacuggagaaccccaccccaaggcaugccacguccgcagccc

SEQ ID NO: 379092 - RNA, 61 nt, Homo Sapiens
gucccagggcggggcagggaauucuaaguguccaccccagggaggcaaggggcugcuuucc

SEQ ID NO: 379093 - RNA, 61 nt, Homo Sapiens
uauggaucccuugggcugugggccuucccauccaccccaccacaacugcccagguagcugg

SEQ ID NO: 379094 - RNA, 61 nt, Homo Sapiens
uuugucugaugcucugggauucuggccagacccaccccagggcacauguccugcgggggcg

SEQ ID NO: 379095 - RNA, 61 nt, Homo Sapiens
gccuuucgcgucaccuggaggccacaucuucccaccccaccugccagccccugucucuccu

SEQ ID NO: 379096 - RNA, 61 nt, Homo Sapiens
cagggacaagaggggcccccucgccccagccccaccccacauggagcucagggggaagcag

SEQ ID NO: 379097 - RNA, 61 nt, Homo Sapiens
ugcuagcgcaccccugcaguccagcgugcauccaccccacgcacgccccgugcuguguucc

SEQ ID NO: 379098 - RNA, 61 nt, Homo Sapiens
cccccaccucccacccugacccagcugccugccaccccagaacucucuucaccccuuuauu

SEQ ID NO: 379099 - RNA, 61 nt, Homo Sapiens
aagugcggggaggagguuauucuuggcauccccaccccaggcuuuaugcaacacccaaaca

SEQ ID NO: 379100 - RNA, 61 nt, Homo Sapiens
uggcaccacagcugcaucuugaugagaaaagccaccccaucaaaauaauaauaaucuuaaa

SEQ ID NO: 379101 - RNA, 61 nt, Homo Sapiens
uguuacacuguauaguaguccuauggcacccccaccccaucccuuucgugccacucccguc

SEQ ID NO: 379102 - RNA, 61 nt, Homo Sapiens
caucccuuucgugccacucccguccccacccccaccccaguguguauaagcuggcauuucg

SEQ ID NO: 379103 - RNA, 61 nt, Homo Sapiens
gggggaaugacacaucccccccaaccuacccccaccccaaaagcagcuccaacagaauggc

SEQ ID NO: 379104 - RNA, 61 nt, Homo Sapiens
cuccaccucaaagucauuugacugcccccauccaccccaccacccuaaucuuccaccaccu

SEQ ID NO: 379105 - RNA, 61 nt, Homo Sapiens
ccuccuauccaccccuccccacucacccaucccaccccaccccagucaccauugucaccac

SEQ ID NO: 379106 - RNA, 61 nt, Homo Sapiens
agcccucucuucccccaccucacccuaccucccaccccagcaggaccgggcccugccccgc

SEQ ID NO: 379107 - RNA, 64 nt, Homo Sapiens; identical to SEQ ID NO: 228970

SEQ ID NO: 379108 - RNA, 64 nt, Homo Sapiens; identical to SEQ ID NO: 228971

SEQ ID NO: 379109 - RNA, 64 nt, Homo Sapiens; identical to SEQ ID NO: 228972

SEQ ID NO: 379110 - RNA, 64 nt, Homo Sapiens; identical to SEQ ID NO: 228973

SEQ ID NO: 379111 - RNA, 64 nt, Homo Sapiens; identical to SEQ ID NO: 228974

SEQ ID NO: 379112 - RNA, 64 nt, Homo Sapiens; identical to SEQ ID NO: 228975

SEQ ID NO: 379113 - RNA, 64 nt, Homo Sapiens; identical to SEQ ID NO: 228976

SEQ ID NO: 379114 - RNA, 64 nt, Homo Sapiens; identical to SEQ ID NO: 228977

SEQ ID NO: 379115 - RNA, 64 nt, Homo Sapiens; identical to SEQ ID NO: 228978

SEQ ID NO: 379116 - RNA, 64 nt, Homo Sapiens; identical to SEQ ID NO: 228979

SEQ ID NO: 379117 - RNA, 64 nt, Homo Sapiens
aaaugccaacuuguccuuuuguaccauggugugaaagucagaugcccagagggcccaggcaggc

SEQ ID NO: 379118 - RNA, 64 nt, Homo Sapiens
aacagagugagacccugucucuuaaagaaaaaaaaagucagacugcugggacuggccagguuuc

SEQ ID NO: 379119 - RNA, 64 nt, Homo Sapiens
auagugaucccauguuuguuaauugccaucauggaagucagagaauuaaccaauuaagugacgg

SEQ ID NO: 379120 - RNA, 64 nt, Homo Sapiens
guucuggauuuaaguacucuauagaaaauuugugaagucagaccagaauuuucuuugucccaug

SEQ ID NO: 379121 - RNA, 64 nt, Homo Sapiens
uuuuacuccagguuauugcagcugacaaccauuaaagucagaagaccggagagagaauguauuu

SEQ ID NO: 379122 - RNA, 64 nt, Homo Sapiens
cagaagauagucuuggaagcgccugcuuuuuggaaagucagaauuuuugaaaguuaacauuaau

SEQ ID NO: 379123 - RNA, 64 nt, Homo Sapiens
ugagaauuuuuuccccgauauucuccuucugucaaagucagaacaaauucagggaauuuauuuu

SEQ ID NO: 379124 - RNA, 64 nt, Homo Sapiens
aaugucaaaaauauuuaggaauuuaauaaccuuuaagucagaaacuaaaacaaauacugaaaua

SEQ ID NO: 379125 - RNA, 64 nt, Homo Sapiens
ccuaaaagaaauggggaaaaaagaaaacaacagcaagucagaaaaaaaaaacaagagagagaaa

SEQ ID NO: 379126 - RNA, 64 nt, Homo Sapiens
cugcugacaaccaugcagaggaauuuuuccacuuaagucagagccuuccuccccaucuggaauu

SEQ ID NO: 379127 - RNA, 64 nt, Homo Sapiens
gccgaagcugcuuacaguagcugggacaagcugaaagucagacuaagaaauaaagagagggccu

SEQ ID NO: 379128 - RNA, 64 nt, Homo Sapiens
ggaaaggaaaguuccaaagaggugguuucugaggaagucagagcgcccagggccagagcaguca

SEQ ID NO: 379129 - RNA, 64 nt, Homo Sapiens
uccucgcagugucgccgccaccccagcguaguccaagucagacuauuucacaaagucagagcga

SEQ ID NO: 379130 - RNA, 64 nt, Homo Sapiens
caccccagcguaguccaagucagacuauuucacaaagucagagcgauaggaaagcacccugccc

SEQ ID NO: 379131 - RNA, 64 nt, Homo Sapiens
uccucagucaccagaggacaagggcuuuagccggaagucagaccacgucugcagagaguguggg

SEQ ID NO: 379132 - RNA, 64 nt, Homo Sapiens
uuauuacacaccaaaggacaaagguuucagugauaagucagaugcaaauauggagagugugggc

SEQ ID NO: 379133 - RNA, 64 nt, Homo Sapiens
ccaggcccgauccuaccaccucgccuugacccugaagucagagcaggccagccaagcaggaagc

SEQ ID NO: 379134 - RNA, 64 nt, Homo Sapiens
guuuccaccauuuccuuuuaguggagaagagaggaagucagaggguagggaccuuugccugccc

SEQ ID NO: 379135 - RNA, 64 nt, Homo Sapiens
gaucaucugaacagaagugcacaggcuacuuguacagagaaaaaauuaauacucaaaggaaauc

SEQ ID NO: 379136 - RNA, 64 nt, Homo Sapiens
ugacauucugcaccagcuaccucugccuccauggcagagaaaaggccauaagaacaguggaaga

SEQ ID NO: 379137 - RNA, 64 nt, Homo Sapiens
caagugacgaggaagguucuguuuugaguauagccagagaaaacaaggauggagaaaaaucuag

SEQ ID NO: 379138 - RNA, 64 nt, Homo Sapiens
caagugaugagaaggauucuuuuucgaauauaaccagagaaaaaaaggauggagaaauaucuag

SEQ ID NO: 379139 - RNA, 64 nt, Homo Sapiens
caagugacgaggaagauucuguuuuggguauagccagagaaaacaaggauggagaaaaaucuag

SEQ ID NO: 379140 - RNA, 64 nt, Homo Sapiens
ccacguguaaggugaugugcacauaucaagaagucagagaaaacacuuuccuggauaaaaaaga

SEQ ID NO: 379141 - RNA, 64 nt, Homo Sapiens
aguguucuccacuaauacugguuauccugugcuacagagaaaaucaaagcagucauaagcucca

SEQ ID NO: 379142 - RNA, 64 nt, Homo Sapiens
cagccaaaggacugagaaggaguuaccuuaaggucagagaaaaccaagagagugugguguucug

SEQ ID NO: 379143 - RNA, 64 nt, Homo Sapiens
cuccuuucuuuccucaccccaaccuuuacuccaccagagaaacuuccuuuugaacucagugggg

SEQ ID NO: 379144 - RNA, 64 nt, Homo Sapiens
aaucaaaugcaaauguuaccuguuaaagauauuacagagaaauuuuauugauuacaaaauaugu

SEQ ID NO: 379145 - RNA, 64 nt, Homo Sapiens
guaauuuuauacuuucuauagacagaaagguuuucagagaaaaagaaaugguuaaauaucuucc

SEQ ID NO: 379146 - RNA, 64 nt, Homo Sapiens
gaauuugggauacuaaaguauaauuauauuucuacagagaaaauuuagcgcacccagagaaaau

SEQ ID NO: 379147 - RNA, 64 nt, Homo Sapiens
uaauuauauuucuacagagaauauuuagcgcacccagagaaaauaauugauuuguuaugguuac

SEQ ID NO: 379148 - RNA, 64 nt, Homo Sapiens
cuguuugcaauccaaauccauaacagcagaaucucagagaaaagaaaauacuguaagucucaau

SEQ ID NO: 379149 - RNA, 64 nt, Homo Sapiens
uggaccuuuuuccaguuaaauuauacugacaaaccagagaaaaauauauaaauaaaggaaccuu

SEQ ID NO: 379150 - RNA, 64 nt, Homo Sapiens
auuucccacuacucccuuacugucuuuuagcauucagagaaaaagccaacuugcuuaaagagga

SEQ ID NO: 379151 - RNA, 64 nt, Homo Sapiens
uuuuguuuacaacguaacauggcaugagagagggcagagaaacuaaguugcuggggaaaguuag

SEQ ID NO: 379152 - RNA, 64 nt, Homo Sapiens
aaagaucucaaaaaagccaaucuuuguacucuugcagagaaaauucagacuaucauccucaagg

SEQ ID NO: 379153 - RNA, 64 nt, Homo Sapiens
aauucuagccugguuuggagauacuaacugcucucagagaaaguagcuuugugacaugucauga

SEQ ID NO: 379154 - RNA, 64 nt, Homo Sapiens
caauguaauucccuucccagcuacccaaaugcuacagagaaauguuuucuacuuggccacuauc

SEQ ID NO: 379155 - RNA, 64 nt, Homo Sapiens
cuuuuuuauuuuucuucuguacagucuaaagcuacagagaaaaaaaaaugcacucuucccuugc

SEQ ID NO: 379156 - RNA, 64 nt, Homo Sapiens
auuacccacucacuacaugaaguccugaaaauaacagagaaacuguuauaucuuuuuaaugauu

SEQ ID NO: 379157 - RNA, 64 nt, Homo Sapiens
gaauaugagauuaacuuccuacaggggccaaaaccagagaaaggcuuccagcaacuucgaugaa

SEQ ID NO: 379158 - RNA, 64 nt, Homo Sapiens
gaucagcgcauguguguaaggaaccaccucaggccagagaaagagccaugugagaagauuagaa

SEQ ID NO: 379159 - RNA, 64 nt, Homo Sapiens
aggcaugaaaagcaggaaaauacauugcauaauacagagaaaaauuaaucacaacugaccugga

SEQ ID NO: 379160 - RNA, 64 nt, Homo Sapiens
aaagccauucccacaaagugaccuaaaauagaaccagagaaacggauguacgacauuaccgaac

SEQ ID NO: 379161 - RNA, 64 nt, Homo Sapiens
aauaagaauccucuauuauugcccaccccagccccagagaaacccaaaugaagagaaaagccau

SEQ ID NO: 379162 - RNA, 64 nt, Homo Sapiens
gagcggcagcuagagguagccagacuguagagcucagagaaagggugcugcugacagaugcuuu

SEQ ID NO: 379163 - RNA, 64 nt, Homo Sapiens
aagacuguggucggggaagucuugggcgaaacagcagagaaagagcggacggauaccgggagcg

SEQ ID NO: 379164 - RNA, 64 nt, Homo Sapiens
uggccuggguugucucaaauugcuucccauggaccagagaaacccagggcaaaaagcauacgca

SEQ ID NO: 379165 - RNA, 64 nt, Homo Sapiens
acacugcuauggggaaaaucugccuucugccuggcagagaaaacuuuuucagccaggguuucuc

SEQ ID NO: 379166 - RNA, 64 nt, Homo Sapiens
gaggcuguucauugauccacggaauuucuucaaacagagaaagauggaauuaacuuuagccagu

SEQ ID NO: 379167 - RNA, 64 nt, Homo Sapiens
caugggaauauuuuuuccuuauacaaagaaaggucagagaaaugugggagcaaaaacuagaaug

SEQ ID NO: 379168 - RNA, 64 nt, Homo Sapiens
ccuuuuacucuggggagaacguacugccaagucccagagaaaacuuguuaguccgggaccuuca

SEQ ID NO: 379169 - RNA, 64 nt, Homo Sapiens
ucauuccagggacugauuguagggucuaacuugccagagaaaucuuaagagaucucaauucuua

SEQ ID NO: 379170 - RNA, 64 nt, Homo Sapiens
auguuuucauccauuaaaauuucagagaaaacuucagagaaauugcucaucaucagucuuaaua

SEQ ID NO: 379171 - RNA, 64 nt, Homo Sapiens
uucagagaaauuauguuuucucagucuuaauauucagagaaaacugaacaaagagagcucauca

SEQ ID NO: 379172 - RNA, 64 nt, Homo Sapiens
cgggucagagcccugggggugagccugaaggccacagagaaagaaccuugcccaaacucaggca

SEQ ID NO: 379173 - RNA, 64 nt, Homo Sapiens
gcccaggcagcguggaggggaaggguagggcagccagagaaaggagcagagaaggcacacaaac

SEQ ID NO: 379174 - RNA, 64 nt, Homo Sapiens
gguguggcugggggccaggagagcaggaacagaacagagaaaugcccuuggaagaaguggaguu

SEQ ID NO: 379175 - RNA, 64 nt, Homo Sapiens
aguugguggaugggugggcauggaacaggaugggcagagaaaggguagugugugagggagcuga

SEQ ID NO: 379176 - RNA, 64 nt, Homo Sapiens
aagucuggacccacuccaugucuacggcuggcagcagagaaacagaucugacagcccagaccuu

SEQ ID NO: 379177 - RNA, 51 nt, Homo Sapiens
aaaaguacgacauagaaauagcagagaaaguuuguuuuuuccuucuuuuga

SEQ ID NO: 379178 - RNA, 64 nt, Homo Sapiens
ccuuugaccacaucgcucuaggauaacuggcacccagagaaaaggacuccucagaaaaaacagg

SEQ ID NO: 379179 - RNA, 64 nt, Homo Sapiens
auacacacacacaaaaacagaaacaaaaucaaaacagagaaagcagaaaaucuaccaagaacag

SEQ ID NO: 379180 - RNA, 64 nt, Homo Sapiens
aguaccuucugccagaagacucacuguguggccucagagaaaucacugaaccucucaggaucaa

SEQ ID NO: 379181 - RNA, 64 nt, Homo Sapiens
uaagaauagauggaagacagcaggauaaacauuccagagaaaaucauguuuauucccugcugua

SEQ ID NO: 379182 - RNA, 64 nt, Homo Sapiens
ccccgaauaacuuucaguaguauggcagauggcacagagaaagggaaggggcucuggggacuuc

SEQ ID NO: 379183 - RNA, 64 nt, Homo Sapiens
caagagucacaggcauccauccagucguaucuuucagagaaaaaaaaaguuagauguagccaag

SEQ ID NO: 379184 - RNA, 64 nt, Homo Sapiens
agcuaaagggcauauguccucugcagauccacagcagagaaaaagucccgugcuugcuagucag

SEQ ID NO: 379185 - RNA, 64 nt, Homo Sapiens
gugagagggaugcaggcauggguuggggguggcccagagaaacuuaugacagcuguacacaaac

SEQ ID NO: 379186 - RNA, 64 nt, Homo Sapiens
uuacaaaugugaagacuguguagucuucauacugcagagaaaucucacaccuugcaagucauca

SEQ ID NO: 379187 - RNA, 64 nt, Homo Sapiens
uuacaaauaggaagaauguguagaauucauacugcagagaaacuacaacccuugcacgucauca

SEQ ID NO: 379188 - RNA, 64 nt, Homo Sapiens
aagccuuuuggccagaagucaauuuguuuuggaucagagaaauuuccugacaagguauauuugu

SEQ ID NO: 379189 - RNA, 64 nt, Homo Sapiens
cuguuauugcuugagcauuuggaacucgagcuuccagagaaauuugagguccucgcuuguucuc

SEQ ID NO: 379190 - RNA, 64 nt, Homo Sapiens
aguucuuuaaauaagagauauccccucaacaauccagagaaaguguaauguaauuauaagcgau

SEQ ID NO: 379191 - RNA, 64 nt, Homo Sapiens
uuaugcauauuaaaaauguaaucauaaaggaugucagagaaacuuuaguguuuaugauguuuuu

SEQ ID NO: 379192 - RNA, 64 nt, Homo Sapiens
uuuuuuccuaugugcaacacugaauuguacguuucagagaaauuguccucauuggucgucccua

SEQ ID NO: 379193 - RNA, 64 nt, Homo Sapiens
aguacagguuaucccgaaaguugaaaagguccugcagagaaaucucucucuugaagaggauucu

SEQ ID NO: 379194 - RNA, 64 nt, Homo Sapiens
cguuuguacaugggacugauucuguuguguucaccagagaaagcuugaggccauggcgagauac

SEQ ID NO: 379195 - RNA, 64 nt, Homo Sapiens
accuccgugcccaggcccaaucucgucaggcugccagagaaaguuggugcugcucauacugguc

SEQ ID NO: 379196 - RNA, 64 nt, Homo Sapiens
ugcuguggagugagguguauugguguugcagccgcagagaaaugccccaguguuauuuauuccc

SEQ ID NO: 379197 - RNA, 64 nt, Homo Sapiens
uguugcacuaaaaugaggauccagggcagcaggccagagaaagcaaaggugcacuccagacucu

SEQ ID NO: 379198 - RNA, 64 nt, Homo Sapiens
uguuuauguaacuuccuguggaugcaaauagauucagagaaauuuagagcuaaaaaggcccuua

SEQ ID NO: 379199 - RNA, 64 nt, Homo Sapiens
gcaguccaagcauaaaaggaaggcaaagaaaggccagagaaagaagaaaacgacaccuagaaga

SEQ ID NO: 379200 - RNA, 64 nt, Homo Sapiens
guugaugucagacccagacagaaacacacaggaacagagaaaugagauaggagauagcucugua

SEQ ID NO: 379201 - RNA, 64 nt, Homo Sapiens
guugauucuggacccagaucgauacucauggguacagagaaaugagaugagagagaacucugug

SEQ ID NO: 379202 - RNA, 64 nt, Homo Sapiens; identical to SEQ ID NO: 256887

SEQ ID NO: 379203 - RNA, 64 nt, Homo Sapiens; identical to SEQ ID NO: 256888

SEQ ID NO: 379204 - RNA, 64 nt, Homo Sapiens; identical to SEQ ID NO: 256889

SEQ ID NO: 379205 - RNA, 64 nt, Homo Sapiens; identical to SEQ ID NO: 256890

SEQ ID NO: 379206 - RNA, 64 nt, Homo Sapiens; identical to SEQ ID NO: 256891

SEQ ID NO: 379207 - RNA, 64 nt, Homo Sapiens; identical to SEQ ID NO: 256892

SEQ ID NO: 379208 - RNA, 64 nt, Homo Sapiens; identical to SEQ ID NO: 256893

SEQ ID NO: 379209 - RNA, 64 nt, Homo Sapiens; identical to SEQ ID NO: 256894

SEQ ID NO: 379210 - RNA, 64 nt, Homo Sapiens; identical to SEQ ID NO: 256895

SEQ ID NO: 379211 - RNA, 64 nt, Homo Sapiens; identical to SEQ ID NO: 256896

SEQ ID NO: 379212 - RNA, 64 nt, Homo Sapiens; identical to SEQ ID NO: 256897

SEQ ID NO: 379213 - RNA, 64 nt, Homo Sapiens; identical to SEQ ID NO: 256898

SEQ ID NO: 379214 - RNA, 64 nt, Homo Sapiens; identical to SEQ ID NO: 256899

SEQ ID NO: 379215 - RNA, 64 nt, Homo Sapiens; identical to SEQ ID NO: 256900

SEQ ID NO: 379216 - RNA, 64 nt, Homo Sapiens; identical to SEQ ID NO: 256901

SEQ ID NO: 379217 - RNA, 64 nt, Homo Sapiens; identical to SEQ ID NO: 256902

SEQ ID NO: 379218 - RNA, 64 nt, Homo Sapiens; identical to SEQ ID NO: 256903

SEQ ID NO: 379219 - RNA, 64 nt, Homo Sapiens; identical to SEQ ID NO: 256904

SEQ ID NO: 379220 - RNA, 64 nt, Homo Sapiens; identical to SEQ ID NO: 256905

SEQ ID NO: 379221 - RNA, 64 nt, Homo Sapiens; identical to SEQ ID NO: 256906

SEQ ID NO: 379222 - RNA, 64 nt, Homo Sapiens; identical to SEQ ID NO: 256907

SEQ ID NO: 379223 - RNA, 64 nt, Homo Sapiens; identical to SEQ ID NO: 256908

SEQ ID NO: 379224 - RNA, 64 nt, Homo Sapiens; identical to SEQ ID NO: 256909

SEQ ID NO: 379225 - RNA, 64 nt, Homo Sapiens; identical to SEQ ID NO: 256910

SEQ ID NO: 379226 - RNA, 64 nt, Homo Sapiens; identical to SEQ ID NO: 256911

SEQ ID NO: 379227 - RNA, 64 nt, Homo Sapiens; identical to SEQ ID NO: 256912

SEQ ID NO: 379228 - RNA, 64 nt, Homo Sapiens; identical to SEQ ID NO: 256913

SEQ ID NO: 379229 - RNA, 64 nt, Homo Sapiens
caguaaggauucagaagugcaugaaggcacccugccucugcagagcagaaagaucauagacaac

SEQ ID NO: 379230 - RNA, 64 nt, Homo Sapiens
aaugugcccagugcugccaagaagagaagccgguccucugcaggcucaagccuaucugggccuc

SEQ ID NO: 379231 - RNA, 64 nt, Homo Sapiens
ccugggguccugagggggucaggaacucauguuaccucugcaggccuucacagcuaauggggag

SEQ ID NO: 379232 - RNA, 64 nt, Homo Sapiens
caggcccaucacuguccaugaguuuuuagugagaccucugcagauuuagcagggagguuguucu

SEQ ID NO: 379233 - RNA, 64 nt, Homo Sapiens
cuuucucucugggggcuguauuuaugacauccccccucugcaacccucucuggccugggucaca

SEQ ID NO: 379234 - RNA, 64 nt, Homo Sapiens
ccuucauggcugggacaguuaacaccuacuaauuccucugcacuugacuuccagcggucccaag

SEQ ID NO: 379235 - RNA, 64 nt, Homo Sapiens
aauuuccuuaugugugaaguagcaagucaaugaaccucugcaucucuuggcaggauugaucuug

SEQ ID NO: 379236 - RNA, 64 nt, Homo Sapiens
auagccugcggcuccccuaugccccuaggaguggccucugcaccgagcccuucuggagacuccg

SEQ ID NO: 379237 - RNA, 64 nt, Homo Sapiens
ucucugcaggugcccagcaggagggcauagguggccucugcagaggggaccucagccugucacu

SEQ ID NO: 379238 - RNA, 64 nt, Homo Sapiens
cauggcccugaauccuccucugcuccagggcuggccucugcagagcugauuaaacaguguugug

SEQ ID NO: 379239 - RNA, 64 nt, Homo Sapiens
cugcuagagagagauggcaauaggagaaugcauuccucugcagaacccuccccaggggaaaauc

SEQ ID NO: 379240 - RNA, 64 nt, Homo Sapiens
acuuccuggaguucagcccaggggaucacaggucccucugcaaauguaagcucccaagagccug

SEQ ID NO: 379241 - RNA, 64 nt, Homo Sapiens
ugcuacuggcaacagccugaaguuuucucauucaccucugcaagcacccaaggucuccaaugaa

SEQ ID NO: 379242 - RNA, 64 nt, Homo Sapiens
gaaaacgacaacacgaaauggaaaaggcuacagcccucugcauaaaccaaggacuuggcugccu

SEQ ID NO: 379243 - RNA, 64 nt, Homo Sapiens
cagaugcucugaugcagagggcacgcccauagucccucugcagagccucgcacuggggccaggg

SEQ ID NO: 379244 - RNA, 64 nt, Homo Sapiens
acacaguuaccagaugggaaccccuaagucccagccucugcaauccagagaacagaaacaagag

SEQ ID NO: 379245 - RNA, 64 nt, Homo Sapiens
uccacacauggcacaguucuuguccacgaggaagccucugcacugaccguucuggcuggggaau

SEQ ID NO: 379246 - RNA, 64 nt, Homo Sapiens
cuuuaaauguuguaaucuuaauaugcgaagugugccucugcaagauacuaacacaaagcucaug

SEQ ID NO: 379247 - RNA, 64 nt, Homo Sapiens
cuguguuuuugucuuuaaaucucuuaauuucauuccucugcaaaaaaaaaaaaaaaaaaaaaaa

SEQ ID NO: 379248 - RNA, 64 nt, Homo Sapiens
cucuggagacaggggccgagccucacccaucugcccucugcagcccagggccgccgugagcggg

SEQ ID NO: 379249 - RNA, 64 nt, Homo Sapiens
cuucggacucaggcaugacucagcccggcugaugccucugcagugcugagucaggauuuggggc

SEQ ID NO: 379250 - RNA, 64 nt, Homo Sapiens
uccacccaugaugcugugccuuccagaaaccuguccucugcagcucggucuugaccccaagccu

SEQ ID NO: 379251 - RNA, 64 nt, Homo Sapiens
ccccgggcgucugagcagucauuccaugccagcaccucugcagccugcugggccucagguucuc

SEQ ID NO: 379252 - RNA, 64 nt, Homo Sapiens
ccuggaagauguggggugcuggguuggggagaagccucugcaguagcccccucugcagagaaaa

SEQ ID NO: 379253 - RNA, 64 nt, Homo Sapiens
gaaaaggguuggggagaagcgauccaggcagcccccucugcagaggcucugccgucugaccccu

SEQ ID NO: 379254 - RNA, 64 nt, Homo Sapiens
cuccaccuuggggauaguggagggggccuucagcccucugcacccugccugccucacaccccgc

SEQ ID NO: 379255 - RNA, 64 nt, Homo Sapiens
ggcgggggucagucaagccgugguccagcaaacuccucugcagauggcuggaguguugacccag

SEQ ID NO: 379256 - RNA, 64 nt, Homo Sapiens
ugcaccuaccuuagaaaacaaguauugucgguuaccucugcauggaacagcauuacccuccucu

SEQ ID NO: 379257 - RNA, 64 nt, Homo Sapiens
agggcaguucugaguguuuaauuucagauuuuuuccucugcauuuacacacacacgcacacaaa

SEQ ID NO: 379258 - RNA, 64 nt, Homo Sapiens
uacacacacacacaaaccacauuucagauuuuuuccucugcauuagggcaguucugaguguuua

SEQ ID NO: 379259 - RNA, 64 nt, Homo Sapiens
gaacagcauuacccuccucuaguauugucaguuaccucugcaugugcaccuaccuuagaaaaca

SEQ ID NO: 379260 - RNA, 64 nt, Homo Sapiens
cacaaguuucaugccaauaaaagagacuggugugaucccacaugcaaaauuuaauccuaagggu

SEQ ID NO: 379261 - RNA, 64 nt, Homo Sapiens
cagcaggauggaguaguugugucagagacuauguaucccacaaagcauagauuacuuacuauuu

SEQ ID NO: 379262 - RNA, 64 nt, Homo Sapiens
gguacagguguuauucaguauccuagcugaugucaucccacauuaccaggcaaauuacuuugcu

SEQ ID NO: 379263 - RNA, 64 nt, Homo Sapiens
cccaaauacaaagcagcugagccaaggccauuacaucccacaaaguucaggccccaccauuccu

SEQ ID NO: 379264 - RNA, 64 nt, Homo Sapiens
uaguuaaugacagaucucccacaacuuuuccaaaaucccacagccugcggcccaaggacaggaa

SEQ ID NO: 379265 - RNA, 64 nt, Homo Sapiens
uggaagguaggggaugggggccccuguccaagccaucccacagcaugggugaccucaaagaugc

SEQ ID NO: 379266 - RNA, 64 nt, Homo Sapiens
uaaaugauugccucuggaacuauucuucuagacuaucccacaucagaaucacugggaaauuuaa

SEQ ID NO: 379267 - RNA, 64 nt, Homo Sapiens
cacaucagaaucacugggaaauuuaaguuugcagaucccacacucacccugaauccucacucag

SEQ ID NO: 379268 - RNA, 64 nt, Homo Sapiens
cacuggugcccagagccggccccagucacagaguaucccacacaccaagucuagauccuggcag

SEQ ID NO: 379269 - RNA, 64 nt, Homo Sapiens
aaucagugaauggaucccaagucuuaaccacuggaucccacacaacuggauccuggaccucuac

SEQ ID NO: 379270 - RNA, 64 nt, Homo Sapiens
auaugugcuuucgcagcugauaauauaaaaggaaaucccacagucuagauauagccccauuacu

SEQ ID NO: 379271 - RNA, 64 nt, Homo Sapiens
aggugauaauauguuuaauuagcuugauuuaaucaucccacacuguauacauaugccaaaauau

SEQ ID NO: 379272 - RNA, 64 nt, Homo Sapiens
agaacauauuucagaaucugucaaacuuuuguguaucccacagauucaaucuucaggugagaau

SEQ ID NO: 379273 - RNA, 64 nt, Homo Sapiens
accaucauggauuuaggaguagauucuucuugaaaucccacauccagaaacuagacauuagaau

SEQ ID NO: 379274 - RNA, 64 nt, Homo Sapiens; identical to SEQ ID NO: 85480

SEQ ID NO: 379275 - RNA, 64 nt, Homo Sapiens; identical to SEQ ID NO: 85481

SEQ ID NO: 379276 - RNA, 64 nt, Homo Sapiens; identical to SEQ ID NO: 85482

SEQ ID NO: 379277 - RNA, 64 nt, Homo Sapiens; identical to SEQ ID NO: 85483

SEQ ID NO: 379278 - RNA, 64 nt, Homo Sapiens; identical to SEQ ID NO: 85484

SEQ ID NO: 379279 - RNA, 64 nt, Homo Sapiens; identical to SEQ ID NO: 85485

SEQ ID NO: 379280 - RNA, 64 nt, Homo Sapiens; identical to SEQ ID NO: 85486

SEQ ID NO: 379281 - RNA, 64 nt, Homo Sapiens; identical to SEQ ID NO: 85487

SEQ ID NO: 379282 - RNA, 64 nt, Homo Sapiens; identical to SEQ ID NO: 85488

SEQ ID NO: 379283 - RNA, 64 nt, Homo Sapiens; identical to SEQ ID NO: 85489

SEQ ID NO: 379284 - RNA, 64 nt, Homo Sapiens; identical to SEQ ID NO: 85490

SEQ ID NO: 379285 - RNA, 64 nt, Homo Sapiens; identical to SEQ ID NO: 85491

SEQ ID NO: 379286 - RNA, 64 nt, Homo Sapiens; identical to SEQ ID NO: 85492

SEQ ID NO: 379287 - RNA, 64 nt, Homo Sapiens; identical to SEQ ID NO: 85493

SEQ ID NO: 379288 - RNA, 64 nt, Homo Sapiens; identical to SEQ ID NO: 85494

SEQ ID NO: 379289 - RNA, 64 nt, Homo Sapiens; identical to SEQ ID NO: 85495

SEQ ID NO: 379290 - RNA, 64 nt, Homo Sapiens; identical to SEQ ID NO: 85496

SEQ ID NO: 379291 - RNA, 64 nt, Homo Sapiens; identical to SEQ ID NO: 85497

SEQ ID NO: 379292 - RNA, 64 nt, Homo Sapiens; identical to SEQ ID NO: 85498

SEQ ID NO: 379293 - RNA, 64 nt, Homo Sapiens; identical to SEQ ID NO: 85499

SEQ ID NO: 379294 - RNA, 64 nt, Homo Sapiens; identical to SEQ ID NO: 85500

SEQ ID NO: 379295 - RNA, 64 nt, Homo Sapiens; identical to SEQ ID NO: 85501

SEQ ID NO: 379296 - RNA, 64 nt, Homo Sapiens; identical to SEQ ID NO: 85502

SEQ ID NO: 379297 - RNA, 64 nt, Homo Sapiens; identical to SEQ ID NO: 85503

SEQ ID NO: 379298 - RNA, 64 nt, Homo Sapiens; identical to SEQ ID NO: 85504

SEQ ID NO: 379299 - RNA, 64 nt, Homo Sapiens; identical to SEQ ID NO: 85505

SEQ ID NO: 379300 - RNA, 64 nt, Homo Sapiens; identical to SEQ ID NO: 85506

SEQ ID NO: 379301 - RNA, 64 nt, Homo Sapiens; identical to SEQ ID NO: 85507

SEQ ID NO: 379302 - RNA, 64 nt, Homo Sapiens; identical to SEQ ID NO: 85508

SEQ ID NO: 379303 - RNA, 64 nt, Homo Sapiens; identical to SEQ ID NO: 85509

SEQ ID NO: 379304 - RNA, 64 nt, Homo Sapiens; identical to SEQ ID NO: 85510

SEQ ID NO: 379305 - RNA, 64 nt, Homo Sapiens; identical to SEQ ID NO: 85511

SEQ ID NO: 379306 - RNA, 64 nt, Homo Sapiens; identical to SEQ ID NO: 85512

SEQ ID NO: 379307 - RNA, 64 nt, Homo Sapiens; identical to SEQ ID NO: 85513

SEQ ID NO: 379308 - RNA, 64 nt, Homo Sapiens; identical to SEQ ID NO: 85514

SEQ ID NO: 379309 - RNA, 64 nt, Homo Sapiens; identical to SEQ ID NO: 85515

SEQ ID NO: 379310 - RNA, 64 nt, Homo Sapiens; identical to SEQ ID NO: 85516

SEQ ID NO: 379311 - RNA, 64 nt, Homo Sapiens; identical to SEQ ID NO: 85517

SEQ ID NO: 379312 - RNA, 64 nt, Homo Sapiens; identical to SEQ ID NO: 85518

SEQ ID NO: 379313 - RNA, 64 nt, Homo Sapiens; identical to SEQ ID NO: 85519

SEQ ID NO: 379314 - RNA, 64 nt, Homo Sapiens; identical to SEQ ID NO: 85520

SEQ ID NO: 379315 - RNA, 64 nt, Homo Sapiens; identical to SEQ ID NO: 85521

SEQ ID NO: 379316 - RNA, 64 nt, Homo Sapiens; identical to SEQ ID NO: 85522

SEQ ID NO: 379317 - RNA, 64 nt, Homo Sapiens; identical to SEQ ID NO: 85523

SEQ ID NO: 379318 - RNA, 64 nt, Homo Sapiens; identical to SEQ ID NO: 145890

SEQ ID NO: 379319 - RNA, 64 nt, Homo Sapiens; identical to SEQ ID NO: 145891

SEQ ID NO: 379320 - RNA, 64 nt, Homo Sapiens; identical to SEQ ID NO: 145892

SEQ ID NO: 379321 - RNA, 64 nt, Homo Sapiens; identical to SEQ ID NO: 145893

SEQ ID NO: 379322 - RNA, 64 nt, Homo Sapiens; identical to SEQ ID NO: 145894

SEQ ID NO: 379323 - RNA, 64 nt, Homo Sapiens; identical to SEQ ID NO: 145895

SEQ ID NO: 379324 - RNA, 64 nt, Homo Sapiens; identical to SEQ ID NO: 145896

SEQ ID NO: 379325 - RNA, 64 nt, Homo Sapiens; identical to SEQ ID NO: 145897

SEQ ID NO: 379326 - RNA, 64 nt, Homo Sapiens; identical to SEQ ID NO: 145898

SEQ ID NO: 379327 - RNA, 64 nt, Homo Sapiens; identical to SEQ ID NO: 145899

SEQ ID NO: 379328 - RNA, 64 nt, Homo Sapiens; identical to SEQ ID NO: 145900

SEQ ID NO: 379329 - RNA, 64 nt, Homo Sapiens; identical to SEQ ID NO: 145901

SEQ ID NO: 379330 - RNA, 64 nt, Homo Sapiens; identical to SEQ ID NO: 145902

SEQ ID NO: 379331 - RNA, 64 nt, Homo Sapiens; identical to SEQ ID NO: 145903

SEQ ID NO: 379332 - RNA, 64 nt, Homo Sapiens; identical to SEQ ID NO: 145904

SEQ ID NO: 379333 - RNA, 64 nt, Homo Sapiens; identical to SEQ ID NO: 145905

SEQ ID NO: 379334 - RNA, 64 nt, Homo Sapiens; identical to SEQ ID NO: 145906

SEQ ID NO: 379335 - RNA, 64 nt, Homo Sapiens; identical to SEQ ID NO: 145907

SEQ ID NO: 379336 - RNA, 62 nt, Homo Sapiens; identical to SEQ ID NO: 145908

SEQ ID NO: 379337 - RNA, 64 nt, Homo Sapiens; identical to SEQ ID NO: 145909

SEQ ID NO: 379338 - RNA, 64 nt, Homo Sapiens; identical to SEQ ID NO: 145910

SEQ ID NO: 379339 - RNA, 64 nt, Homo Sapiens; identical to SEQ ID NO: 145911

SEQ ID NO: 379340 - RNA, 64 nt, Homo Sapiens; identical to SEQ ID NO: 145912

SEQ ID NO: 379341 - RNA, 64 nt, Homo Sapiens; identical to SEQ ID NO: 145913

SEQ ID NO: 379342 - RNA, 64 nt, Homo Sapiens; identical to SEQ ID NO: 145914

SEQ ID NO: 379343 - RNA, 64 nt, Homo Sapiens; identical to SEQ ID NO: 145915

SEQ ID NO: 379344 - RNA, 64 nt, Homo Sapiens; identical to SEQ ID NO: 145916

SEQ ID NO: 379345 - RNA, 64 nt, Homo Sapiens; identical to SEQ ID NO: 145917

SEQ ID NO: 379346 - RNA, 64 nt, Homo Sapiens; identical to SEQ ID NO: 145918

SEQ ID NO: 379347 - RNA, 64 nt, Homo Sapiens; identical to SEQ ID NO: 145919

SEQ ID NO: 379348 - RNA, 64 nt, Homo Sapiens; identical to SEQ ID NO: 145920

SEQ ID NO: 379349 - RNA, 64 nt, Homo Sapiens; identical to SEQ ID NO: 145921

SEQ ID NO: 379350 - RNA, 64 nt, Homo Sapiens; identical to SEQ ID NO: 145922

SEQ ID NO: 379351 - RNA, 64 nt, Homo Sapiens; identical to SEQ ID NO: 145923

SEQ ID NO: 379352 - RNA, 64 nt, Homo Sapiens; identical to SEQ ID NO: 145924

SEQ ID NO: 379353 - RNA, 64 nt, Homo Sapiens; identical to SEQ ID NO: 145925

SEQ ID NO: 379354 - RNA, 64 nt, Homo Sapiens; identical to SEQ ID NO: 145926

SEQ ID NO: 379355 - RNA, 64 nt, Homo Sapiens; identical to SEQ ID NO: 145927

SEQ ID NO: 379356 - RNA, 64 nt, Homo Sapiens; identical to SEQ ID NO: 145928

SEQ ID NO: 379357 - RNA, 64 nt, Homo Sapiens; identical to SEQ ID NO: 145929

SEQ ID NO: 379358 - RNA, 64 nt, Homo Sapiens; identical to SEQ ID NO: 145930

SEQ ID NO: 379359 - RNA, 64 nt, Homo Sapiens; identical to SEQ ID NO: 145931

SEQ ID NO: 379360 - RNA, 64 nt, Homo Sapiens; identical to SEQ ID NO: 145932

SEQ ID NO: 379361 - RNA, 64 nt, Homo Sapiens; identical to SEQ ID NO: 145933

SEQ ID NO: 379362 - RNA, 64 nt, Homo Sapiens; identical to SEQ ID NO: 145934

SEQ ID NO: 379363 - RNA, 64 nt, Homo Sapiens; identical to SEQ ID NO: 145935

SEQ ID NO: 379364 - RNA, 64 nt, Homo Sapiens; identical to SEQ ID NO: 145936

SEQ ID NO: 379365 - RNA, 64 nt, Homo Sapiens; identical to SEQ ID NO: 145937

SEQ ID NO: 379366 - RNA, 64 nt, Homo Sapiens; identical to SEQ ID NO: 145938

SEQ ID NO: 379367 - RNA, 64 nt, Homo Sapiens; identical to SEQ ID NO: 145939

SEQ ID NO: 379368 - RNA, 64 nt, Homo Sapiens; identical to SEQ ID NO: 145940

SEQ ID NO: 379369 - RNA, 64 nt, Homo Sapiens; identical to SEQ ID NO: 145941

SEQ ID NO: 379370 - RNA, 64 nt, Homo Sapiens; identical to SEQ ID NO: 145942

SEQ ID NO: 379371 - RNA, 64 nt, Homo Sapiens; identical to SEQ ID NO: 145943

SEQ ID NO: 379372 - RNA, 64 nt, Homo Sapiens; identical to SEQ ID NO: 145944

SEQ ID NO: 379373 - RNA, 64 nt, Homo Sapiens; identical to SEQ ID NO: 145945

SEQ ID NO: 379374 - RNA, 64 nt, Homo Sapiens; identical to SEQ ID NO: 145946

SEQ ID NO: 379375 - RNA, 64 nt, Homo Sapiens; identical to SEQ ID NO: 145947

SEQ ID NO: 379376 - RNA, 64 nt, Homo Sapiens; identical to SEQ ID NO: 145948

SEQ ID NO: 379377 - RNA, 64 nt, Homo Sapiens; identical to SEQ ID NO: 145949

SEQ ID NO: 379378 - RNA, 64 nt, Homo Sapiens; identical to SEQ ID NO: 145950

SEQ ID NO: 379379 - RNA, 64 nt, Homo Sapiens; identical to SEQ ID NO: 145951

SEQ ID NO: 379380 - RNA, 64 nt, Homo Sapiens; identical to SEQ ID NO: 145952

SEQ ID NO: 379381 - RNA, 64 nt, Homo Sapiens; identical to SEQ ID NO: 145953

SEQ ID NO: 379382 - RNA, 64 nt, Homo Sapiens; identical to SEQ ID NO: 145954

SEQ ID NO: 379383 - RNA, 64 nt, Homo Sapiens; identical to SEQ ID NO: 145955

SEQ ID NO: 379384 - RNA, 64 nt, Homo Sapiens; identical to SEQ ID NO: 145956

SEQ ID NO: 379385 - RNA, 64 nt, Homo Sapiens; identical to SEQ ID NO: 145957

SEQ ID NO: 379386 - RNA, 64 nt, Homo Sapiens; identical to SEQ ID NO: 145958

SEQ ID NO: 379387 - RNA, 64 nt, Homo Sapiens; identical to SEQ ID NO: 145959

SEQ ID NO: 379388 - RNA, 64 nt, Homo Sapiens; identical to SEQ ID NO: 145960

SEQ ID NO: 379389 - RNA, 64 nt, Homo Sapiens; identical to SEQ ID NO: 145961

SEQ ID NO: 379390 - RNA, 64 nt, Homo Sapiens; identical to SEQ ID NO: 145962

SEQ ID NO: 379391 - RNA, 64 nt, Homo Sapiens; identical to SEQ ID NO: 145963

SEQ ID NO: 379392 - RNA, 64 nt, Homo Sapiens; identical to SEQ ID NO: 145964

SEQ ID NO: 379393 - RNA, 64 nt, Homo Sapiens; identical to SEQ ID NO: 145965

SEQ ID NO: 379394 - RNA, 64 nt, Homo Sapiens; identical to SEQ ID NO: 145966

SEQ ID NO: 379395 - RNA, 64 nt, Homo Sapiens; identical to SEQ ID NO: 145967

SEQ ID NO: 379396 - RNA, 64 nt, Homo Sapiens; identical to SEQ ID NO: 145968

SEQ ID NO: 379397 - RNA, 64 nt, Homo Sapiens; identical to SEQ ID NO: 145969

SEQ ID NO: 379398 - RNA, 64 nt, Homo Sapiens; identical to SEQ ID NO: 145970

SEQ ID NO: 379399 - RNA, 64 nt, Homo Sapiens; identical to SEQ ID NO: 145971

SEQ ID NO: 379400 - RNA, 64 nt, Homo Sapiens; identical to SEQ ID NO: 145972

SEQ ID NO: 379401 - RNA, 64 nt, Homo Sapiens; identical to SEQ ID NO: 145973

SEQ ID NO: 379402 - RNA, 64 nt, Homo Sapiens; identical to SEQ ID NO: 145974

SEQ ID NO: 379403 - RNA, 64 nt, Homo Sapiens; identical to SEQ ID NO: 145975

SEQ ID NO: 379404 - RNA, 64 nt, Homo Sapiens; identical to SEQ ID NO: 145976

SEQ ID NO: 379405 - RNA, 64 nt, Homo Sapiens; identical to SEQ ID NO: 145977

SEQ ID NO: 379406 - RNA, 64 nt, Homo Sapiens; identical to SEQ ID NO: 145978

SEQ ID NO: 379407 - RNA, 64 nt, Homo Sapiens; identical to SEQ ID NO: 145979

SEQ ID NO: 379408 - RNA, 64 nt, Homo Sapiens; identical to SEQ ID NO: 145980

SEQ ID NO: 379409 - RNA, 64 nt, Homo Sapiens; identical to SEQ ID NO: 145981

SEQ ID NO: 379410 - RNA, 64 nt, Homo Sapiens; identical to SEQ ID NO: 145982

SEQ ID NO: 379411 - RNA, 64 nt, Homo Sapiens; identical to SEQ ID NO: 145983

SEQ ID NO: 379412 - RNA, 64 nt, Homo Sapiens; identical to SEQ ID NO: 145984

SEQ ID NO: 379413 - RNA, 64 nt, Homo Sapiens; identical to SEQ ID NO: 145985

SEQ ID NO: 379414 - RNA, 64 nt, Homo Sapiens; identical to SEQ ID NO: 145986

SEQ ID NO: 379415 - RNA, 64 nt, Homo Sapiens; identical to SEQ ID NO: 145987

SEQ ID NO: 379416 - RNA, 64 nt, Homo Sapiens; identical to SEQ ID NO: 145988

SEQ ID NO: 379417 - RNA, 64 nt, Homo Sapiens; identical to SEQ ID NO: 145989

SEQ ID NO: 379418 - RNA, 64 nt, Homo Sapiens; identical to SEQ ID NO: 145990

SEQ ID NO: 379419 - RNA, 64 nt, Homo Sapiens; identical to SEQ ID NO: 145991

SEQ ID NO: 379420 - RNA, 64 nt, Homo Sapiens; identical to SEQ ID NO: 145992

SEQ ID NO: 379421 - RNA, 64 nt, Homo Sapiens; identical to SEQ ID NO: 145993

SEQ ID NO: 379422 - RNA, 64 nt, Homo Sapiens; identical to SEQ ID NO: 145994

SEQ ID NO: 379423 - RNA, 64 nt, Homo Sapiens; identical to SEQ ID NO: 145995

SEQ ID NO: 379424 - RNA, 64 nt, Homo Sapiens; identical to SEQ ID NO: 145996

SEQ ID NO: 379425 - RNA, 64 nt, Homo Sapiens; identical to SEQ ID NO: 145997

SEQ ID NO: 379426 - RNA, 64 nt, Homo Sapiens; identical to SEQ ID NO: 145998

SEQ ID NO: 379427 - RNA, 64 nt, Homo Sapiens; identical to SEQ ID NO: 199316

SEQ ID NO: 379428 - RNA, 64 nt, Homo Sapiens; identical to SEQ ID NO: 199317

SEQ ID NO: 379429 - RNA, 64 nt, Homo Sapiens; identical to SEQ ID NO: 199318

SEQ ID NO: 379430 - RNA, 64 nt, Homo Sapiens; identical to SEQ ID NO: 199319

SEQ ID NO: 379431 - RNA, 64 nt, Homo Sapiens; identical to SEQ ID NO: 199320

SEQ ID NO: 379432 - RNA, 64 nt, Homo Sapiens; identical to SEQ ID NO: 199321

SEQ ID NO: 379433 - RNA, 64 nt, Homo Sapiens; identical to SEQ ID NO: 199322

SEQ ID NO: 379434 - RNA, 64 nt, Homo Sapiens; identical to SEQ ID NO: 199323

SEQ ID NO: 379435 - RNA, 64 nt, Homo Sapiens; identical to SEQ ID NO: 128601

SEQ ID NO: 379436 - RNA, 64 nt, Homo Sapiens; identical to SEQ ID NO: 128602

SEQ ID NO: 379437 - RNA, 64 nt, Homo Sapiens; identical to SEQ ID NO: 128603

SEQ ID NO: 379438 - RNA, 64 nt, Homo Sapiens; identical to SEQ ID NO: 128604

SEQ ID NO: 379439 - RNA, 64 nt, Homo Sapiens; identical to SEQ ID NO: 128605

SEQ ID NO: 379440 - RNA, 64 nt, Homo Sapiens; identical to SEQ ID NO: 128606

SEQ ID NO: 379441 - RNA, 64 nt, Homo Sapiens; identical to SEQ ID NO: 128607

SEQ ID NO: 379442 - RNA, 64 nt, Homo Sapiens; identical to SEQ ID NO: 128608

SEQ ID NO: 379443 - RNA, 64 nt, Homo Sapiens; identical to SEQ ID NO: 128609

SEQ ID NO: 379444 - RNA, 64 nt, Homo Sapiens; identical to SEQ ID NO: 128610

SEQ ID NO: 379445 - RNA, 64 nt, Homo Sapiens; identical to SEQ ID NO: 128611

SEQ ID NO: 379446 - RNA, 64 nt, Homo Sapiens; identical to SEQ ID NO: 128612

SEQ ID NO: 379447 - RNA, 64 nt, Homo Sapiens; identical to SEQ ID NO: 128613

SEQ ID NO: 379448 - RNA, 64 nt, Homo Sapiens; identical to SEQ ID NO: 128614

SEQ ID NO: 379449 - RNA, 64 nt, Homo Sapiens; identical to SEQ ID NO: 128615

SEQ ID NO: 379450 - RNA, 64 nt, Homo Sapiens; identical to SEQ ID NO: 128616

SEQ ID NO: 379451 - RNA, 64 nt, Homo Sapiens; identical to SEQ ID NO: 128617

SEQ ID NO: 379452 - RNA, 64 nt, Homo Sapiens; identical to SEQ ID NO: 128618

SEQ ID NO: 379453 - RNA, 64 nt, Homo Sapiens; identical to SEQ ID NO: 128619

SEQ ID NO: 379454 - RNA, 64 nt, Homo Sapiens; identical to SEQ ID NO: 128620

SEQ ID NO: 379455 - RNA, 64 nt, Homo Sapiens; identical to SEQ ID NO: 128621

SEQ ID NO: 379456 - RNA, 64 nt, Homo Sapiens; identical to SEQ ID NO: 128622

SEQ ID NO: 379457 - RNA, 64 nt, Homo Sapiens; identical to SEQ ID NO: 128623

SEQ ID NO: 379458 - RNA, 64 nt, Homo Sapiens; identical to SEQ ID NO: 128624

SEQ ID NO: 379459 - RNA, 64 nt, Homo Sapiens; identical to SEQ ID NO: 128625

SEQ ID NO: 379460 - RNA, 64 nt, Homo Sapiens; identical to SEQ ID NO: 128626

SEQ ID NO: 379461 - RNA, 64 nt, Homo Sapiens; identical to SEQ ID NO: 128627

SEQ ID NO: 379462 - RNA, 64 nt, Homo Sapiens; identical to SEQ ID NO: 128628

SEQ ID NO: 379463 - RNA, 64 nt, Homo Sapiens; identical to SEQ ID NO: 128629

SEQ ID NO: 379464 - RNA, 64 nt, Homo Sapiens; identical to SEQ ID NO: 128630

SEQ ID NO: 379465 - RNA, 64 nt, Homo Sapiens; identical to SEQ ID NO: 128631

SEQ ID NO: 379466 - RNA, 64 nt, Homo Sapiens; identical to SEQ ID NO: 128632

SEQ ID NO: 379467 - RNA, 64 nt, Homo Sapiens; identical to SEQ ID NO: 128633

SEQ ID NO: 379468 - RNA, 64 nt, Homo Sapiens; identical to SEQ ID NO: 128634

SEQ ID NO: 379469 - RNA, 64 nt, Homo Sapiens; identical to SEQ ID NO: 128635

SEQ ID NO: 379470 - RNA, 64 nt, Homo Sapiens; identical to SEQ ID NO: 128636

SEQ ID NO: 379471 - RNA, 64 nt, Homo Sapiens; identical to SEQ ID NO: 128637

SEQ ID NO: 379472 - RNA, 64 nt, Homo Sapiens; identical to SEQ ID NO: 128638

SEQ ID NO: 379473 - RNA, 64 nt, Homo Sapiens; identical to SEQ ID NO: 128639

SEQ ID NO: 379474 - RNA, 64 nt, Homo Sapiens; identical to SEQ ID NO: 128640

SEQ ID NO: 379475 - RNA, 64 nt, Homo Sapiens; identical to SEQ ID NO: 128641

SEQ ID NO: 379476 - RNA, 64 nt, Homo Sapiens; identical to SEQ ID NO: 128642

SEQ ID NO: 379477 - RNA, 64 nt, Homo Sapiens; identical to SEQ ID NO: 128643

SEQ ID NO: 379478 - RNA, 64 nt, Homo Sapiens; identical to SEQ ID NO: 128644

SEQ ID NO: 379479 - RNA, 64 nt, Homo Sapiens; identical to SEQ ID NO: 128645

SEQ ID NO: 379480 - RNA, 64 nt, Homo Sapiens; identical to SEQ ID NO: 128646

SEQ ID NO: 379481 - RNA, 64 nt, Homo Sapiens; identical to SEQ ID NO: 128647

SEQ ID NO: 379482 - RNA, 64 nt, Homo Sapiens; identical to SEQ ID NO: 137985

SEQ ID NO: 379483 - RNA, 64 nt, Homo Sapiens; identical to SEQ ID NO: 137986

SEQ ID NO: 379484 - RNA, 64 nt, Homo Sapiens; identical to SEQ ID NO: 137987

SEQ ID NO: 379485 - RNA, 64 nt, Homo Sapiens; identical to SEQ ID NO: 137988

SEQ ID NO: 379486 - RNA, 64 nt, Homo Sapiens; identical to SEQ ID NO: 137989

SEQ ID NO: 379487 - RNA, 64 nt, Homo Sapiens; identical to SEQ ID NO: 137990

SEQ ID NO: 379488 - RNA, 64 nt, Homo Sapiens; identical to SEQ ID NO: 137991

SEQ ID NO: 379489 - RNA, 64 nt, Homo Sapiens; identical to SEQ ID NO: 137992

SEQ ID NO: 379490 - RNA, 64 nt, Homo Sapiens; identical to SEQ ID NO: 137993

SEQ ID NO: 379491 - RNA, 64 nt, Homo Sapiens; identical to SEQ ID NO: 137994

SEQ ID NO: 379492 - RNA, 64 nt, Homo Sapiens; identical to SEQ ID NO: 137995

SEQ ID NO: 379493 - RNA, 64 nt, Homo Sapiens; identical to SEQ ID NO: 137996

SEQ ID NO: 379494 - RNA, 64 nt, Homo Sapiens; identical to SEQ ID NO: 137997

SEQ ID NO: 379495 - RNA, 64 nt, Homo Sapiens; identical to SEQ ID NO: 137998

SEQ ID NO: 379496 - RNA, 64 nt, Homo Sapiens; identical to SEQ ID NO: 137999

SEQ ID NO: 379497 - RNA, 64 nt, Homo Sapiens; identical to SEQ ID NO: 138000

SEQ ID NO: 379498 - RNA, 64 nt, Homo Sapiens; identical to SEQ ID NO: 138001

SEQ ID NO: 379499 - RNA, 64 nt, Homo Sapiens; identical to SEQ ID NO: 138002

SEQ ID NO: 379500 - RNA, 64 nt, Homo Sapiens; identical to SEQ ID NO: 138003

SEQ ID NO: 379501 - RNA, 64 nt, Homo Sapiens; identical to SEQ ID NO: 138004

SEQ ID NO: 379502 - RNA, 64 nt, Homo Sapiens; identical to SEQ ID NO: 138005

SEQ ID NO: 379503 - RNA, 64 nt, Homo Sapiens; identical to SEQ ID NO: 138006

SEQ ID NO: 379504 - RNA, 64 nt, Homo Sapiens; identical to SEQ ID NO: 138007

SEQ ID NO: 379505 - RNA, 64 nt, Homo Sapiens; identical to SEQ ID NO: 138008

SEQ ID NO: 379506 - RNA, 64 nt, Homo Sapiens; identical to SEQ ID NO: 138009

SEQ ID NO: 379507 - RNA, 64 nt, Homo Sapiens; identical to SEQ ID NO: 138010

SEQ ID NO: 379508 - RNA, 64 nt, Homo Sapiens; identical to SEQ ID NO: 193368

SEQ ID NO: 379509 - RNA, 64 nt, Homo Sapiens; identical to SEQ ID NO: 193369

SEQ ID NO: 379510 - RNA, 64 nt, Homo Sapiens
uuuauaaccagucuauuaaagccuuaaaauuguccaauuauaguaaagggaaaaguauaaacug

SEQ ID NO: 379511 - RNA, 64 nt, Homo Sapiens
ucucuuuugagauauccaagguaugaaauaagugcaauuauacuccguuauuaugcuaauuguu

SEQ ID NO: 379512 - RNA, 64 nt, Homo Sapiens
auuuacauauauuccacauauauaacaggauuugcaauuauacauagcuagcuaaaaaguuggg

SEQ ID NO: 379513 - RNA, 64 nt, Homo Sapiens
acccaccucuggcugaaggugcucaagagggaagcaauuauaagguggguggcaggagggaaca

SEQ ID NO: 379514 - RNA, 64 nt, Homo Sapiens
acauucugggagaggcaaaaauguuguaugauugcaauuauaugccaaucugaaaaggcuuucu

SEQ ID NO: 379515 - RNA, 64 nt, Homo Sapiens
aggguuguagaauguagucccugacauuaauaagcaauuauagcuucuaaauaacaaaaaccug

SEQ ID NO: 379516 - RNA, 64 nt, Homo Sapiens
ggccauggguggcucaaaacaaauagaaagguugcaauuauauaaaauaguaauagugaagaaa

SEQ ID NO: 379517 - RNA, 64 nt, Homo Sapiens
uaguaauagugaagaaaaaaaaacuggaacuugacaauuauaaaucuugcaauaaaugcaaaag

SEQ ID NO: 379518 - RNA, 64 nt, Homo Sapiens
agcuguguuauuguuuucuagaggaaaaugugcucaauuauaaaccucauauuuaguuuugaau

SEQ ID NO: 379519 - RNA, 64 nt, Homo Sapiens
cuaguuccuuuauguccuguauaauagaaauacccaauuauauuuucaaauguuucagcaccau

SEQ ID NO: 379520 - RNA, 64 nt, Homo Sapiens
acuucuaagguagcugcagagagagaacauagaucaauuauacuacuaggaaaaaauugcuuuu

SEQ ID NO: 379521 - RNA, 64 nt, Homo Sapiens
gucaugcagaguauuucuaauuagcaucuaauuucaauuauagucagccacugagggacaaaac

SEQ ID NO: 379522 - RNA, 64 nt, Homo Sapiens
aggaacugaccagcuuauauugcccaguauucccacucuccaaacucagcagaagaagcagcca

SEQ ID NO: 379523 - RNA, 64 nt, Homo Sapiens
uggaguguuggaaaauguucagccauguagacacacucuccaaacugucagaguuguggcucuc

SEQ ID NO: 379524 - RNA, 64 nt, Homo Sapiens
auuacaacccuuaauugccacgugugcacuuacuacucuccaguaugucuuauuacucuccagu

SEQ ID NO: 379525 - RNA, 64 nt, Homo Sapiens
cgugugcacuuacuacucuccaguaugucuuauuacucuccaguaugucacgcaucuuuaacuu

SEQ ID NO: 379526 - RNA, 64 nt, Homo Sapiens
ccuccugcagugcaguugcugaggaacugagcagacucuccagcagacucuccagcccucuucc

SEQ ID NO: 379527 - RNA, 64 nt, Homo Sapiens
caguugcugaggaacugagcagacucuccagcagacucuccagcccucuuccuccuuccucugg

SEQ ID NO: 379528 - RNA, 64 nt, Homo Sapiens
gaacuugaccuaccuuauggucuucauucucaacacucuccaaagauagccagaguuuaauaca

SEQ ID NO: 379529 - RNA, 64 nt, Homo Sapiens
ucucuuuccccuuccaccugcugcagauguucaaacucuccauuccacuuuauuccaaaguaca

SEQ ID NO: 379530 - RNA, 64 nt, Homo Sapiens
gaccggaugaagaaguacauauggaggccaagaaacucuccaaguaaugaaagauaccaagaac

SEQ ID NO: 379531 - RNA, 64 nt, Homo Sapiens
ccuuccgccuucuuuuccguacugugaagaaagaacucuccaccccagcucccacccugcccug

SEQ ID NO: 379532 - RNA, 64 nt, Homo Sapiens
guggauucuagcaaaagagcuggaaaaaagucagacucuccacagacccccuaugggggacccc

SEQ ID NO: 379533 - RNA, 64 nt, Homo Sapiens
aaucacccuucccacaaaucaccaaacugcuggaacucuccagccaaaugcugggagaaggacc

SEQ ID NO: 379534 - RNA, 64 nt, Homo Sapiens
gagagguagcauuuuugcugaaaucgggccugucacucuccaauaaagguucuggcacuucaau

SEQ ID NO: 379535 - RNA, 64 nt, Homo Sapiens
aacacagaacacaggaguuugcuuuuggcuucucacucuccaaguaacccugaauuaggcccag

SEQ ID NO: 379536 - RNA, 64 nt, Homo Sapiens
guacaugcuuuaaaaccgacucugcugcaccuucacucuccagggacucaaaucaguauaccua

SEQ ID NO: 379537 - RNA, 64 nt, Homo Sapiens
uuaguaauggcagagcagucgcugaugucaucacacucuccaugaggggcugacucuccaggga

SEQ ID NO: 379538 - RNA, 64 nt, Homo Sapiens
gagcugaugucaucacacucacuuucaggggcugacucuccagggcuuuuucauaccaauucca

SEQ ID NO: 379539 - RNA, 64 nt, Homo Sapiens
guaaauauaugaguauuugacuguuuuuuuucuuacucuccaauggcaaugugugagcuaagga

SEQ ID NO: 379540 - RNA, 64 nt, Homo Sapiens
ugugauggcggaacugacuggguucugagcgucaacucuccagcgucacacugacagaauuucu

SEQ ID NO: 379541 - RNA, 64 nt, Homo Sapiens
gaaaugguaccaaggagaggucuugcucacagggacucuccauaugugagcacuaucuuucagg

SEQ ID NO: 379542 - RNA, 64 nt, Homo Sapiens
uacaaauuuucccagugaauaaauauuuuaggaaacucuccaugauuauuaguugaccaacuau

SEQ ID NO: 379543 - RNA, 64 nt, Homo Sapiens
aauuuuuuagcuucuuaaugaauauggauuuaaaacucuccaguucuuauuuuaugaaaugacu

SEQ ID NO: 379544 - RNA, 64 nt, Homo Sapiens
aguuaugauguggauccuacguauuuuuuaaaaaacucuccagauaauuuugaugucacgaguc

SEQ ID NO: 379545 - RNA, 64 nt, Homo Sapiens
ucaguacccagccagguucucuggguccagggugacucuccaaagaaauuggccuucagcugga

SEQ ID NO: 379546 - RNA, 64 nt, Homo Sapiens
cacgauauugaggaagcacaggacauccaaggguacucuccaguuuggcuguggagacuugagc

SEQ ID NO: 379547 - RNA, 64 nt, Homo Sapiens
caccaugggcggaggcgccacgagggccguguacacucuccagggccgaggcuacgcauguccu

SEQ ID NO: 379548 - RNA, 64 nt, Homo Sapiens
gacuaagcggggagaugcggccagucguguccgaacucuccaauagcccuggcugggggugcag

SEQ ID NO: 379549 - RNA, 64 nt, Homo Sapiens
gccacccaugccugucugcugcagccauccuugcacucuccagcgacacucucgcaccucccua

SEQ ID NO: 379550 - RNA, 64 nt, Homo Sapiens
cucagccccggguagcaccuguaguuucagugccacucuccacuguccccuuguggaccagcuu

SEQ ID NO: 379551 - RNA, 64 nt, Homo Sapiens
auugucuacuaggcugacuauaccugcguaugcacaugcucagaauuuaauauagccuggacuu

SEQ ID NO: 379552 - RNA, 64 nt, Homo Sapiens
gcuuacauugugcgguucgauuugaaaauuugcacaugcucaauggaugauuuccuucuuuuga

SEQ ID NO: 379553 - RNA, 64 nt, Homo Sapiens
ggacaaggguuccucccagggguagagacgaagacaugcucaccaaugucccacuagggaauuu

SEQ ID NO: 379554 - RNA, 64 nt, Homo Sapiens
cauuuaaagcauucaacauuagcccagcacucuucaugcucauucacccaucucaucacuuucc

SEQ ID NO: 379555 - RNA, 64 nt, Homo Sapiens
uguaaugguuuuaacguuacggaagcgauucucccaugcucaugucucucuguccuaaacuaau

SEQ ID NO: 379556 - RNA, 64 nt, Homo Sapiens
cacacaaagggcacgugucugccaucacuugguucaugcucauugcuuaguuuccaugugggau

SEQ ID NO: 379557 - RNA, 64 nt, Homo Sapiens
uuuuauugccaaagucaaauaaacgggagacugucaugcucaugcaugaauagaauuuagucaa

SEQ ID NO: 379558 - RNA, 64 nt, Homo Sapiens
aaauugugcuaaccaguuaaaaguacuguacacccaugcucaauauauaguccuggaaauagca

SEQ ID NO: 379559 - RNA, 64 nt, Homo Sapiens
agcggggcagcaccuacuaccugcauguccagagcaugcucacccagcucugcuccaaggccuu

SEQ ID NO: 379560 - RNA, 64 nt, Homo Sapiens
acuacaugcaggaaucuccagggaccagccaccccaugcucagguuugacuauguccccagcuu

SEQ ID NO: 379561 - RNA, 64 nt, Homo Sapiens
gcuccccaggcaaaaacaaaagugggaggggacacaugcucauuaucagggugcccucggugca

SEQ ID NO: 379562 - RNA, 64 nt, Homo Sapiens
gcuccuauuuacaguuccucaggauccucuuccgcaugcucaucaggcuccuggagguggacgu

SEQ ID NO: 379563 - RNA, 64 nt, Homo Sapiens; identical to SEQ ID NO: 124395

SEQ ID NO: 379564 - RNA, 54 nt, Homo Sapiens; identical to SEQ ID NO: 124396

SEQ ID NO: 379565 - RNA, 64 nt, Homo Sapiens; identical to SEQ ID NO: 124397

SEQ ID NO: 379566 - RNA, 64 nt, Homo Sapiens; identical to SEQ ID NO: 124398

SEQ ID NO: 379567 - RNA, 64 nt, Homo Sapiens; identical to SEQ ID NO: 124399

SEQ ID NO: 379568 - RNA, 64 nt, Homo Sapiens; identical to SEQ ID NO: 124400

SEQ ID NO: 379569 - RNA, 64 nt, Homo Sapiens; identical to SEQ ID NO: 124401

SEQ ID NO: 379570 - RNA, 64 nt, Homo Sapiens
auaguguuaucugacuaauuccaccuucucaauuuauaacuaaaccaaauauucucuucaaaug

SEQ ID NO: 379571 - RNA, 64 nt, Homo Sapiens
cgucuaugugagaaaauauaaauguugauuuacuuauaacuagagagaggaaaaguuguagcua

SEQ ID NO: 379572 - RNA, 64 nt, Homo Sapiens
agguggcuggugcuagucuaacuuaauucauguguauaacuagauggauuuaaauggucugagc

SEQ ID NO: 379573 - RNA, 64 nt, Homo Sapiens
uauauauuugucacacauugaaaacuggacuggguauaacuauguuauaggaaaguagaaauug

SEQ ID NO: 379574 - RNA, 64 nt, Homo Sapiens
aaaggcugcuuuaacuuguuuguuugucuuuguauauaacuacuucuaaucuaaucacuagagu

SEQ ID NO: 379575 - RNA, 64 nt, Homo Sapiens
uuuuuaucacaaauauguauaugugauauugauauauaacuauauauauugccaucacacacga

SEQ ID NO: 379576 - RNA, 64 nt, Homo Sapiens
aaaaaaaaaacaaaaacaagaauauuauuauuguuauaacuaaagcaaaacaaacagcaauaac

SEQ ID NO: 379577 - RNA, 64 nt, Homo Sapiens
agaccaaauacugaaguuaauuauuuuuaagaauuauaacuaaauuaauauguuuuaaaauguc

SEQ ID NO: 379578 - RNA, 64 nt, Homo Sapiens
auagaugguuuuguuugacuaaagaauaaucucauauaacuagaauacuuguggcuuuuauuau

SEQ ID NO: 379579 - RNA, 64 nt, Homo Sapiens
ucuuugauuucuacaaugucuauaucuuauuaccuauaacuauuaauuuuucauagaauuauaa

SEQ ID NO: 379580 - RNA, 64 nt, Homo Sapiens
auuuuuauucacuuuaaauaacuacauuuuuguuuauaacuaaguuuggagggauccuaagagc

SEQ ID NO: 379581 - RNA, 64 nt, Homo Sapiens
auugcugauauaaugcaagauuuaaauuuauacauauaacuaauuucaaauguaauuaucacac

SEQ ID NO: 379582 - RNA, 64 nt, Homo Sapiens
augcuuauaaaaaugaaguauaaguaaauugacauauaacuacugggguuucccucucuaauuu

SEQ ID NO: 379583 - RNA, 64 nt, Homo Sapiens
gaccgguauucagugaauacguuaaaagaaaaaauauaacuauggauguauguauuuaagccac

SEQ ID NO: 379584 - RNA, 64 nt, Homo Sapiens
uaugaguaaauuauuucaauuuuauuuuagacgguauaacuauuucaauuugauuaauccacua

SEQ ID NO: 379585 - RNA, 64 nt, Homo Sapiens
uuggcauugauaauaauaaaaucaguaguuuuucuauaacuauggcucuauuaacuuuuuuccu

SEQ ID NO: 379586 - RNA, 62 nt, Homo Sapiens
augcaugggaaauaaugagaagcagcucacagaguuuaaacuauuuucuuguccccaccacc

SEQ ID NO: 379587 - RNA, 62 nt, Homo Sapiens
uugagagaauaaaguucguauuugcugaugccaguuuaaaauucccagguuacgucugagga

SEQ ID NO: 379588 - RNA, 62 nt, Homo Sapiens
uuggaugugugauuaauuuucaaaucaucuaaaguuuaaaaguaguauucaugauuucuggc

SEQ ID NO: 379589 - RNA, 62 nt, Homo Sapiens
cauuauuucaaguaauaaaucugaauucuauuaguuuaaaaauuguaaaauucaaguuaaau

SEQ ID NO: 379590 - RNA, 62 nt, Homo Sapiens
cacuuuuuaaaaaguggagucuucugaaguacaguuuaaaaaagaucugaguuuucagagug

SEQ ID NO: 379591 - RNA, 62 nt, Homo Sapiens
cuuguuuggaaaacuuuauuucuguguaaugaaguuuaaauggauaccauucuuguugcucu

SEQ ID NO: 379592 - RNA, 62 nt, Homo Sapiens
gcuauauuuuuaaacaugaauaaauagaagcaaguuuaaagagauaaauuaagaaagaugcc

SEQ ID NO: 379593 - RNA, 62 nt, Homo Sapiens
uaacagaacaacugaaauacacuuuauccuaaaguuuaaaucauaguaaaagucauauuuaa

SEQ ID NO: 379594 - RNA, 62 nt, Homo Sapiens
aauggugauauagaccucagagcuguuaucuuaguuuaaagauuguauauguacuguacuau

SEQ ID NO: 379595 - RNA, 62 nt, Homo Sapiens
uuuuuagcaaaaaagaaaaaaaaaaggcacauaguuuaaaaaguuucucauuuugugcaaua

SEQ ID NO: 379596 - RNA, 62 nt, Homo Sapiens
auauauaauuaauaaaaccuuuugcuguuggcaguuuaaaaugggguuuuuuguuuuuguuu

SEQ ID NO: 379597 - RNA, 62 nt, Homo Sapiens
cuaucacuaaugcauguuaauucauuaaacauaguuuaaaggcagggauguauccuguauca

SEQ ID NO: 379598 - RNA, 62 nt, Homo Sapiens
cuuuuaauuuuugcuuagaauagaauggaacaaguuuaaauuucaaggaaauaugaaggcac

SEQ ID NO: 379599 - RNA, 62 nt, Homo Sapiens
aauuuugcucuuguauggcaaaauaauuagugaguuuaaaaaaaaucuauaguuuccaauaa

SEQ ID NO: 379600 - RNA, 62 nt, Homo Sapiens
aguguucaaauugcaaaauuaaggacauucaaaguuuaaaauaaaguaaguuuaaagacuuu

SEQ ID NO: 379601 - RNA, 62 nt, Homo Sapiens
cuuuaaggacauucaaaguuuuuuagaaaguaaguuuaaagauuuauuccaacaauuauuua

SEQ ID NO: 379602 - RNA, 62 nt, Homo Sapiens
ccugucauucucuggcucuugaauucauuccaaguuuaaaauguaauuuagcauaauauucu

SEQ ID NO: 379603 - RNA, 62 nt, Homo Sapiens
aucauuaagacacugcuaggggaucuaaauaaaguuuaaauuuuaacuugauauagcucuca

SEQ ID NO: 379604 - RNA, 62 nt, Homo Sapiens
uaugcucauucaacuugaaugaccacccccaaaguuuaaaaauuugagaugggguggacuaa

SEQ ID NO: 379605 - RNA, 62 nt, Homo Sapiens
uuagcaggauauuuguguauugcugauuucagaguuuaaaugaauggacuccuuucacuaac

SEQ ID NO: 379606 - RNA, 62 nt, Homo Sapiens
ucucuuagcaucagacaacucuauuuagagagaguuuaaaguaagcaaucaguagguguguu

SEQ ID NO: 379607 - RNA, 62 nt, Homo Sapiens
cguaauacaccauuaauuuccugccuaucuggaguuuaaauguuaacacuugguuccaguuc

SEQ ID NO: 379608 - RNA, 62 nt, Homo Sapiens
gcuuaauaucaauagaaugauugcaaaggaaaaguuuaaauaaaagagggggaagaguuggu

SEQ ID NO: 379609 - RNA, 62 nt, Homo Sapiens
gggggaagaguugguuugcauaacgaauugaaaguuuaaagacgucaaacgcuaaaucuaag

SEQ ID NO: 379610 - RNA, 62 nt, Homo Sapiens
cuuaaaaaaaauauuaugaaaugcaaauaaaaaguuuaaaaagaaugcacaauuuuuuuaau

SEQ ID NO: 379611 - RNA, 62 nt, Homo Sapiens
acugugcugccccuuucacagagguuggaucaaguuuaaauguuaacuuuguaagaugcaaa

SEQ ID NO: 379612 - RNA, 62 nt, Homo Sapiens
gaagcaauuuauaucuuuauaaacacuaaauuaguuuaaaauaaaguucauauaauuuaaag

SEQ ID NO: 379613 - RNA, 62 nt, Homo Sapiens
caugucagagguuuggagccaacaguuucucaaguuuaaaguugguugauucacacuuguuc

SEQ ID NO: 379614 - RNA, 62 nt, Homo Sapiens
gugaaaaaaagaaacgaaaaggacagacgaagaguuuaaagagaaaagggaaaaaagaaaga

SEQ ID NO: 379615 - RNA, 62 nt, Homo Sapiens
uuauaacagggcggcugguuaauaucucacacaguuuaaaaaaucagccccuaauuucucca

SEQ ID NO: 379616 - RNA, 62 nt, Homo Sapiens
ugccuuguugcaacauacaauugcaaaagaugaguuuaaaaaauuacauacaaacagcuugu

SEQ ID NO: 379617 - RNA, 62 nt, Homo Sapiens
uaaaugugaacaguuuacuaaugcacuacugaaguuuaaaucuguggcacaaucaauguaag

SEQ ID NO: 379618 - RNA, 62 nt, Homo Sapiens
gggcuuuugcuuuucuaggugaggcuuuaaguaguuuaaaauugacucauuggacuagugca

SEQ ID NO: 379619 - RNA, 62 nt, Homo Sapiens
uaguaauuuuaauuuagugaauggcucuuggcaguuuaaauuugucuugugcagacaacauc

SEQ ID NO: 379620 - RNA, 62 nt, Homo Sapiens
uuuauauuaaauuuauuaaagaaauaaguaucaguuuaaaaaaaaaguuuuuuucaagaauu

SEQ ID NO: 379621 - RNA, 62 nt, Homo Sapiens
acaaaauuggaucaagacauaaauuuuaauuaaguuuaaaauuuuucaacagaaggcuauca

SEQ ID NO: 379622 - RNA, 62 nt, Homo Sapiens
cuuaaacuugucuuuuuccuuucuguggacacaguuuaaaauaagauuuagauuguuuauuc

SEQ ID NO: 379623 - RNA, 62 nt, Homo Sapiens
gaaauugagguuguucaaaguaguacuuuauuaguuuaaaaaugauuucacauauugcaacc

SEQ ID NO: 379624 - RNA, 62 nt, Homo Sapiens
auuccuguuguauaugucuagaaugguuaagcaguuuaaauaauaccuacucauuuuugugg

SEQ ID NO: 379625 - RNA, 62 nt, Homo Sapiens
gcauuauaaauuuuauaacagagagaaaucauaguuuaaacugugagagacaucaucaagug

SEQ ID NO: 379626 - RNA, 62 nt, Homo Sapiens
agauuuuuuuauuuguauuaaugaaaagcuuuaguuuaaaauaaggagauccagaauaaaaa

SEQ ID NO: 379627 - RNA, 62 nt, Homo Sapiens
uuauuuuuggaauuuuaaagaugacauaaauaaguuuaaauaucaauuuggggaguaagguu

SEQ ID NO: 379628 - RNA, 62 nt, Homo Sapiens
auguauuuaaacaauuuccgaugcccaugaugaguuuaaaaaccagcauugacaccaucccc

SEQ ID NO: 379629 - RNA, 62 nt, Homo Sapiens
cucuacgauuuuuaaguaaguuggggaccaucaguuuaaaauaaaugcaauacuauuucaug

SEQ ID NO: 379630 - RNA, 62 nt, Homo Sapiens
uaaacacuuuucgugaagaaauuuugcacaguaguuuaaaucuuuuguuaaugcuccuccga

SEQ ID NO: 379631 - RNA, 62 nt, Homo Sapiens
cuuuuauaacaaauuauuagcuuugaucuuguaguuuaaaauugcagggaacugggguaauc

SEQ ID NO: 379632 - RNA, 62 nt, Homo Sapiens
cacaauuguauuuucaguuuucugcccaauagaguuuaaauaacuguauaaaugaugacuuu

SEQ ID NO: 379633 - RNA, 62 nt, Homo Sapiens
ggguuuuguaucugaucccugcuuggaguuuuaguuuaaagaaucuauauguagcaaggaaa

SEQ ID NO: 379634 - RNA, 62 nt, Homo Sapiens
auguguaauauuuuuuucuuagugauuuugacaguuuaaauguuuaacaacuuaaagcauua

SEQ ID NO: 379635 - RNA, 62 nt, Homo Sapiens
gagguuaagauguauuagaauuauacaauaucaguuuaaaaaucuguaugcauaaagaaugc

SEQ ID NO: 379636 - RNA, 62 nt, Homo Sapiens
uguacaaguccuuucagugauaggagacuggaaguuuaaaaaucugauuaaauacugugccu

SEQ ID NO: 379637 - RNA, 62 nt, Homo Sapiens
gaggaauuuuauauuuaaagaagacaaggcagaguuuaaaguaaguucuguugguaucacag

SEQ ID NO: 379638 - RNA, 62 nt, Homo Sapiens
auacugaaugcaaucuagauugugaagaaugcaguuuaaaauguagaacauuugauucacau

SEQ ID NO: 379639 - RNA, 62 nt, Homo Sapiens
uauacaucagcauacagacuugccaggaaaacaguuuaaaauuaugcuuggcaugaauaagg

SEQ ID NO: 379640 - RNA, 62 nt, Homo Sapiens
ucaaggacuguuccugauuaacauuuucaugaaguuuaaaaaacagaauggaauaucagagu

SEQ ID NO: 379641 - RNA, 62 nt, Homo Sapiens
auaaaggcauuuuggguuuuguuucuuuaaucaguuuaaaagucugccuuccaagaguauau

SEQ ID NO: 379642 - RNA, 62 nt, Homo Sapiens
aaacagccaaacaccuggaaguauuagauacaaguuuaaaauaucuuuuauagguuuuauau

SEQ ID NO: 379643 - RNA, 62 nt, Homo Sapiens
uaaugauauguuagugccucuguuauaugucaaguuuaaagcagggcacauuguugcagcaa

SEQ ID NO: 379644 - RNA, 62 nt, Homo Sapiens
ggugucauccuuuccucuguuugaugugagguaguuuaaagauacaaggacuuugugugaag

SEQ ID NO: 379645 - RNA, 62 nt, Homo Sapiens
gucauuuguaacaggucacuuccuuuucacucaguuuaaauuggugauggacguugcuugau

SEQ ID NO: 379646 - RNA, 62 nt, Homo Sapiens
gacuaaaacguucuuucaaauuuuuuaaacucaguuuaaaaauaaaaauugcauuguuauuu

SEQ ID NO: 379647 - RNA, 62 nt, Homo Sapiens
aaaaaaaaaacuacuucaucaauaaacagauaaguuuaaaaaaacaagaaacuugguuauug

SEQ ID NO: 379648 - RNA, 62 nt, Homo Sapiens
cugauauuugguggaaguaguauuuucauaagaguuuaaaugguggacuagugaugaauaga

SEQ ID NO: 379649 - RNA, 62 nt, Homo Sapiens
uucuuuaaacagguauuuugacucacccaggaaguuuaaaaaauuuccagagagaagagaaa

SEQ ID NO: 379650 - RNA, 62 nt, Homo Sapiens
uauuuaguaaagaucagaagaaauccuuuaagaguuuaaaugucccuggaacacgcauacag

SEQ ID NO: 379651 - RNA, 62 nt, Homo Sapiens
cugaacuugauguuuuugcauucuuugaguucaguuuaaagacaacuacgagcaucuguaac

SEQ ID NO: 379652 - RNA, 62 nt, Homo Sapiens
gagucacuuacuucauauccagugguauugcuaguuuaaaauuaaucuuugaaaacucauac

SEQ ID NO: 379653 - RNA, 62 nt, Homo Sapiens
ucagaaagacauucuuaguuguuagauguuuuaguuuaaaaaugugucuuguauuaucauaa

SEQ ID NO: 379654 - RNA, 62 nt, Homo Sapiens
gaagaaauggugggaaggaauauaaauccuguaguuuaaaagugaaauaaaacauuuuaaaa

SEQ ID NO: 379655 - RNA, 62 nt, Homo Sapiens
ucucugaaacaggcauacagaaauccuuuaagaguuuaaauguauuuagugaagaucauaag

SEQ ID NO: 379656 - RNA, 62 nt, Homo Sapiens
uugauguugccuaccuuauugugguaucguggaguuuaaaagaucaaguuaggaugcugacu

SEQ ID NO: 379657 - RNA, 62 nt, Homo Sapiens
aagagcaugguucucaggaaaaccaguuccccaguuuaaaaaaaaaaaaaaaaauuccuugu

SEQ ID NO: 379658 - RNA, 62 nt, Homo Sapiens
uauuuuccuaggcgcaauuuccuuaaacguacaguuuaaauucaaggcuggaccacucaguu

SEQ ID NO: 379659 - RNA, 62 nt, Homo Sapiens
ugauaaauuauguucugauauccuccuacaguaguuuaaauugacagaaaaauuugaauguu

SEQ ID NO: 379660 - RNA, 62 nt, Homo Sapiens
uuuagccaaugcaaaucuguuuuaaaacaaauaguuuaaaaaaagaacaaguuuuuaagggc

SEQ ID NO: 379661 - RNA, 62 nt, Homo Sapiens
acuuuugaccagcuuuggcuagaaaguccugaaguuuaaaaccauuggagagagaauugcac

SEQ ID NO: 379662 - RNA, 62 nt, Homo Sapiens
ugugauuuguacuccuuguuuuuccucuugcuaguuuaaagguaacauuugggaggggauuc

SEQ ID NO: 379663 - RNA, 62 nt, Homo Sapiens
uacuacauauugugaagagacuuucuuaaguaaguuuaaauuuguccuuaguuagggacuga

SEQ ID NO: 379664 - RNA, 62 nt, Homo Sapiens
uccuuaguuagggacugacucuuuccuaaggaaguuuaaaugacaucauucagugagcucuc

SEQ ID NO: 379665 - RNA, 58 nt, Homo Sapiens
uaaagaagauuccccuuuaauuguggauaguuuaaaguuuaaaaaauaaaguucuugc

SEQ ID NO: 379666 - RNA, 62 nt, Homo Sapiens
agaagauuccccuuuaauuguggauaguuuaaaguuuaaaaaauaaaguucuugcugggcac

SEQ ID NO: 379667 - RNA, 62 nt, Homo Sapiens
caucagaaaggaaaaacaaacuguucuuuaagaguuuaaaauucuucuuaccagaugcuuuc

SEQ ID NO: 379668 - RNA, 62 nt, Homo Sapiens
cacgacaguggaugcugggugucccaggaaucaguuuaaaagcuguuccagugguaagcuau

SEQ ID NO: 379669 - RNA, 62 nt, Homo Sapiens
uuaacuuuguaagaugcaaagagguuggaucaaguuuaaaugacugugcugccccuuucaca

SEQ ID NO: 379670 - RNA, 62 nt, Homo Sapiens
gaaugcacaauuuuuuuaauaugcaaauaaaaaguuuaaaaacuuagcuggugugucuguuu

SEQ ID NO: 379671 - RNA, 62 nt, Homo Sapiens
cuagccaaaugugggcauacuauuacagggaaaguuuaaaggucugauaacuugaaauaggu

SEQ ID NO: 379672 - RNA, 62 nt, Homo Sapiens
uauuuuuguaagccuaaaagugauucuuugaaaguuuaaagaaacuugaccaaaagacagua

SEQ ID NO: 379673 - RNA, 62 nt, Homo Sapiens
aaaaccacaaacagacaaacuauauagcugugaguuuaaacacuuuguaaaaaagaaaaaug

SEQ ID NO: 379674 - RNA, 62 nt, Homo Sapiens
uuucuuucugugccacacaaaauuacaauggaaguuuaaacaaaggacacuugauauuuuuu

SEQ ID NO: 379675 - RNA, 64 nt, Homo Sapiens
cagcaacucacaaaacguagcacaaacauucauuauggagaaagcaucaggacuguugaguaac

SEQ ID NO: 379676 - RNA, 64 nt, Homo Sapiens
gagauuauuccuguuugaaagguggugcaugcagauggagaagugguguuggcagcaagcuuug

SEQ ID NO: 379677 - RNA, 64 nt, Homo Sapiens
caauuguugcuuaugaaagaccaaugagguggggauggagaagaaauccuucaucaugucaguu

SEQ ID NO: 379678 - RNA, 64 nt, Homo Sapiens
gacccucaagacaaaugaccgaccauaaauuuaaauggagaaaggcucaacaagagacuggaag

SEQ ID NO: 379679 - RNA, 64 nt, Homo Sapiens
gacucuguuucgaauauagccacagaaauaaaggauggagaaaaaucugggacagguaauuuug

SEQ ID NO: 379680 - RNA, 64 nt, Homo Sapiens
gauucuguuucgaacauagccacagaaauaaaggauggagaaaaaucugggacagguaauuuug

SEQ ID NO: 379681 - RNA, 64 nt, Homo Sapiens
gguucuguuuugaguauagccagagaaaacaaggauggagaaaaaucuaggacagguaauuuug

SEQ ID NO: 379682 - RNA, 64 nt, Homo Sapiens
gauucuuuuucgaauauaaccagaggaaaaaaggauggagaaauaucuaggaaagguaauuuug

SEQ ID NO: 379683 - RNA, 64 nt, Homo Sapiens
gauucuuuuucgaauauaaccagagaaaaaaaggauggagaaauaucuaggaaagguaauuuug

SEQ ID NO: 379684 - RNA, 64 nt, Homo Sapiens
gauucuguuuuggguauagccagagaaaacaaggauggagaaaaaucuaggacagguaauuuug

SEQ ID NO: 379685 - RNA, 64 nt, Homo Sapiens
uagcacagggcuugguagaggguauaucuagugaauggagaauacauggagaaacuuaacuaag

SEQ ID NO: 379686 - RNA, 64 nt, Homo Sapiens
uugguagaggguauaucuagugaauggagaauacauggagaaacuuaacuaaguuacacaagca

SEQ ID NO: 379687 - RNA, 64 nt, Homo Sapiens
cuggcugccaugugguugauuguccuaccagcggauggagaaucgccuguccccaggguagaaa

SEQ ID NO: 379688 - RNA, 64 nt, Homo Sapiens
ccagggaagaagcagaacuuugcagggccggggcauggagaagaugaggagagguugcagaggc

SEQ ID NO: 379689 - RNA, 64 nt, Homo Sapiens
aaauuaacugagcuccuagagaagaacaauccucauggagaaacucuggaaaccuugacaaugg

SEQ ID NO: 379690 - RNA, 64 nt, Homo Sapiens
aaagcucucaaggcaaugacucgaaguuugcaguauggagaacaggugagucugcauagaguca

SEQ ID NO: 379691 - RNA, 64 nt, Homo Sapiens
uuacaaaggaugugugaggauuucccaguacuggauggagaaugagaagagaaagucagccuuu

SEQ ID NO: 379692 - RNA, 64 nt, Homo Sapiens
ggcagaagagaacgggcagaaguacagaacagaaauggagaagcugaccacgacuccaucucuu

SEQ ID NO: 379693 - RNA, 64 nt, Homo Sapiens
uugagccuaggaguucgagaccagccuaggcaacauggagaaaccccgucucuaucagaaauac

SEQ ID NO: 379694 - RNA, 64 nt, Homo Sapiens
gguaguaagcuuggaaaaauaauuuaagaauacaauggagaaauguaaauaaguaucuauguaa

SEQ ID NO: 379695 - RNA, 64 nt, Homo Sapiens
aaaauccucaggaaauuagaugaaaggguuugauauggagaaacaaaguucauguuggccaugg

SEQ ID NO: 379696 - RNA, 64 nt, Homo Sapiens
cccgucucuacuaaaaaugcccagccugaccaacauggagaagccugaggucgggaguucgaga

SEQ ID NO: 379697 - RNA, 64 nt, Homo Sapiens
guauuucaagaucuaguccagcaacccuguagucauggagaaagcaauaugcucugguuggcag

SEQ ID NO: 379698 - RNA, 64 nt, Homo Sapiens
gugccuguuugggggaaaacuggaggugggcaggauggagaacaugccccgaugcucuaguguu

SEQ ID NO: 379699 - RNA, 64 nt, Homo Sapiens
ccuacuaaugucucuucuaacaucuuagagguccauggagaaggcauauggagaacauguuuua

SEQ ID NO: 379700 - RNA, 64 nt, Homo Sapiens
cuucuaacaucuuagagguccauggagaaggcauauggagaacauguuuuauacugcucuauaa

SEQ ID NO: 379701 - RNA, 64 nt, Homo Sapiens
aaaaccaauaucuaguuacacaggugaucuuacuauggagaagaaagcauaaauuaucaaauau

SEQ ID NO: 379702 - RNA, 64 nt, Homo Sapiens
ggugcaaaaagcugacuucuuuuuauucuguagcauggagaauguauuuggcuguagucucaaa

SEQ ID NO: 379703 - RNA, 64 nt, Homo Sapiens
auccuagaaaaggucagaccuggaggacagcagcauggagaaagguaaauuugccaugacuucc

SEQ ID NO: 379704 - RNA, 64 nt, Homo Sapiens
gcagagcaguccagaaccagagaaacaaauggccauggagaaaccuuugagcagcuccaggcca

SEQ ID NO: 379705 - RNA, 64 nt, Homo Sapiens
ucauaacaguucauucuacuaguaaaccuggaauauggagaauuuaaauaguacuuuucuaugu

SEQ ID NO: 379706 - RNA, 64 nt, Homo Sapiens
agucacuguagacuuucuucugggugaacuccaaauggagaagucuaagguauuugcugagaug

SEQ ID NO: 379707 - RNA, 64 nt, Homo Sapiens
auaaauguuuccuggguuugcucuuugacaauaaauggagaaggaaggucacccaacuccauug

SEQ ID NO: 379708 - RNA, 64 nt, Homo Sapiens
cuguggccaggauggcagagacuuccuugucaucauggagaagugccagcaggggacugggaaa

SEQ ID NO: 379709 - RNA, 64 nt, Homo Sapiens
ccccgucucuacaaaaaauaccagccuggccaacauggagaaccuugaggucaggaguuugaga

SEQ ID NO: 379710 - RNA, 64 nt, Homo Sapiens
gagugagugcugugaacgguggugaguggaugaaauggagaacaguguacagaccuuuugcaug

SEQ ID NO: 379711 - RNA, 64 nt, Homo Sapiens
ugaauggacaaagcucaggacuguggaagggccaauggagaaaaaagaauuucuggaagaaagg

SEQ ID NO: 379712 - RNA, 64 nt, Homo Sapiens
gaagcagaggaaggaaacaucugagguuagcccaauggagaaauaugugugcagacaauucucc

SEQ ID NO: 379713 - RNA, 64 nt, Homo Sapiens
cauuuaaaauuguuuuaaaucagaucauagauuaauggagaaaauaauaucuuuuaucaguguu

SEQ ID NO: 379714 - RNA, 64 nt, Homo Sapiens
ucugaagaauuuucaaggcguuguccuguaggacauggagaacucccauuuuaugcuaaagguu

SEQ ID NO: 379715 - RNA, 64 nt, Homo Sapiens
ugacaaugccaaucauaggccagcuuguuuucccauggagaagaaaaauauuuggaccuuuaaa

SEQ ID NO: 379716 - RNA, 64 nt, Homo Sapiens
agcccaugccucacagacaguagaaaagacuuaaauggagaaccggaucagagaacuugccaga

SEQ ID NO: 379717 - RNA, 64 nt, Homo Sapiens
aagccaaagcugggcucaguggggaaggucaggaauggagaaauugccuuuucucguuagccuc

SEQ ID NO: 379718 - RNA, 64 nt, Homo Sapiens
cugaggucaggaguucgaaaccagccuggccaacauggagaaaccccaucucuacuaaaaauac

SEQ ID NO: 379719 - RNA, 64 nt, Homo Sapiens
uggagaucauuauucuaagugaaauaacucaggaauggagaaccaaauauuguacauccucacu

SEQ ID NO: 379720 - RNA, 64 nt, Homo Sapiens
acucacgccgggggugaaaauguacgucuguagcauggagaagccuucaggguacauucagcuc

SEQ ID NO: 379721 - RNA, 64 nt, Homo Sapiens
uagugguuccaucuuuaaggaagaagaauguuugauggagaaaauuuguggccaaugaagucug

SEQ ID NO: 379722 - RNA, 64 nt, Homo Sapiens
gagguuugugaaacaguaggauucucuuuuggcaauggagaauugcaucugaugguucaagugu

SEQ ID NO: 379723 - RNA, 64 nt, Homo Sapiens
guggcuuuuguugaguuaaauaagaugcuauauaauggagaagaauuugaaaaugcacaaaaaa

SEQ ID NO: 379724 - RNA, 64 nt, Homo Sapiens; identical to SEQ ID NO: 58278

SEQ ID NO: 379725 - RNA, 64 nt, Homo Sapiens; identical to SEQ ID NO: 58279

SEQ ID NO: 379726 - RNA, 64 nt, Homo Sapiens; identical to SEQ ID NO: 58280

SEQ ID NO: 379727 - RNA, 64 nt, Homo Sapiens; identical to SEQ ID NO: 58281

SEQ ID NO: 379728 - RNA, 64 nt, Homo Sapiens; identical to SEQ ID NO: 58282

SEQ ID NO: 379729 - RNA, 64 nt, Homo Sapiens; identical to SEQ ID NO: 58283

SEQ ID NO: 379730 - RNA, 64 nt, Homo Sapiens; identical to SEQ ID NO: 58284

SEQ ID NO: 379731 - RNA, 64 nt, Homo Sapiens; identical to SEQ ID NO: 58285

SEQ ID NO: 379732 - RNA, 64 nt, Homo Sapiens
gccucaaggccggggcuggagcggagaccccagggccucucaggagacagugaggcugccccuc

SEQ ID NO: 379733 - RNA, 64 nt, Homo Sapiens
cgaacuccuuaccucaggugaucugcuugccucagccucucaaagugcugggauuacaggugug

SEQ ID NO: 379734 - RNA, 64 nt, Homo Sapiens
acguucccccuauggccuccagcagagcugaucugccucucacacagguccuggugucugccuc

SEQ ID NO: 379735 - RNA, 64 nt, Homo Sapiens
uuuggccuuaauauuauuggauuaaagaauuacugccucucacuaggagcaucauuuauuuacc

SEQ ID NO: 379736 - RNA, 64 nt, Homo Sapiens
acugcuuuucucaagcuucucagaaaaucuucuggccucucaucaaaauuucaguggaaaugca

SEQ ID NO: 379737 - RNA, 64 nt, Homo Sapiens
agcaggggggugcuacccuucaucuccagagagagccucucagccucccuuccuucccuccccg

SEQ ID NO: 379738 - RNA, 64 nt, Homo Sapiens
uuuggcagcgagcgcucggggcacuucuauccccgccucucaaaggguggggacagccguuucc

SEQ ID NO: 379739 - RNA, 64 nt, Homo Sapiens
caccccucccccggccccccgacugagaacucgggccucucacccgccccccagccucccgcuc

SEQ ID NO: 379740 - RNA, 64 nt, Homo Sapiens
cuggcugcacggcaccuguuccaacaccuacugugccucucaucaggugucacgauuuuucugc

SEQ ID NO: 379741 - RNA, 64 nt, Homo Sapiens
auguaucuggggagagaaugagcuggaggagggggccucucauggcccuucccuggccuguggc

SEQ ID NO: 379742 - RNA, 64 nt, Homo Sapiens
ugggcuuuuggcugcaguggggguggauuucagagccucucauggcagcaucuaagugaccaga

SEQ ID NO: 379743 - RNA, 64 nt, Homo Sapiens
gggcauugucuuuggagcagcaggagaauaggaugccucucacucacaugccaguuccuggcug

SEQ ID NO: 379744 - RNA, 64 nt, Homo Sapiens
caagcuccugcccuaaaguaggccuccugccuuugccucucaaagugcugggauuucaggcaug

SEQ ID NO: 379745 - RNA, 64 nt, Homo Sapiens
caaacuccugaccucaagugaucugccugccucggccucucaaauugcuggaauuacaguugug

SEQ ID NO: 379746 - RNA, 64 nt, Homo Sapiens
cagagucagggcugacaaagcuuggcuccugucugccucucaguuccuggagcuucaauggggc

SEQ ID NO: 379747 - RNA, 64 nt, Homo Sapiens
uccacccacugacugcagaccaggggcccaggcugccucucaucgauucagggcccagccccug

SEQ ID NO: 379748 - RNA, 64 nt, Homo Sapiens
auucuuuuuaauugaagaugauaagggcuucucugccucucagagcacccauccaggauggaga

SEQ ID NO: 379749 - RNA, 64 nt, Homo Sapiens
ggacaccugaugcucaccuguccucaguccuguggccucucagaaggccccggcaugaggccuu

SEQ ID NO: 379750 - RNA, 64 nt, Homo Sapiens
cccaccaauacccaggugaggaacagacccucuggccucucaccccacuucagugcucucuucc

SEQ ID NO: 379751 - RNA, 64 nt, Homo Sapiens
acagcaagaccagcccaggagcccaccagcaccugccucucagcuacuugcugaccauuuccug

SEQ ID NO: 379752 - RNA, 64 nt, Homo Sapiens
auugucaucaccgagggcuguacaagguggacuggccucucaacugagcugccuggagcucagg

SEQ ID NO: 379753 - RNA, 64 nt, Homo Sapiens
ucacagguuagguggaugcacucucuccaaauuggccucucaacggagcggggacacugaggac

SEQ ID NO: 379754 - RNA, 64 nt, Homo Sapiens
cuggaaccucaggacccgcccauuucucggcaguacugugaauuuugaaguuaaacuaaauuuu

SEQ ID NO: 379755 - RNA, 64 nt, Homo Sapiens
cugacaugaagaguuuaguuuuuuuacuuuauaaacugugaauaugaguaugccagcugcauac

SEQ ID NO: 379756 - RNA, 64 nt, Homo Sapiens
caacaacaacaacaaaccacaaaauuauuugaguacugugaaggauuauuugucuaacaguuca

SEQ ID NO: 379757 - RNA, 64 nt, Homo Sapiens
uuguggaaagagcguccauaggagaagugagaauacugugaaaaagggauguuagcauucauua

SEQ ID NO: 379758 - RNA, 64 nt, Homo Sapiens
ugaguaugccagcugcauuauuuuuacuuuauaaacugugaauaccgacaugaagaguuuaguu

SEQ ID NO: 379759 - RNA, 64 nt, Homo Sapiens
uugaaguuaaacuaaauuuucauuucucggcaguacugugaauucuggaaccucaggacccgcc

SEQ ID NO: 379760 - RNA, 64 nt, Homo Sapiens
ugguuuaacacuguauccuaacaacucaagcugaacugugaaagugccucauucuccaagagcc

SEQ ID NO: 379761 - RNA, 64 nt, Homo Sapiens
guuuuuguacaguuaucaugagcuuaaaaaaauuacugugaauuucauuuuucuggaguggaaa

SEQ ID NO: 379762 - RNA, 64 nt, Homo Sapiens
auggccauauauaauuuuuucuuuuggcugcguaacugugaacuaaaggcuguaauuggagcag

SEQ ID NO: 379763 - RNA, 64 nt, Homo Sapiens
uacuuccugaaggggagggacagaggacuuuggaacugugaauaucuguugagagcauuucagc

SEQ ID NO: 379764 - RNA, 64 nt, Homo Sapiens
guauuaugggauugcuaccuguauaaacaauggcacugugaaaauacuguuaguuuuaauacaa

SEQ ID NO: 379765 - RNA, 64 nt, Homo Sapiens
guuaacacuagcuuuguauuuuuuuuucuguaaaacugugaacugauauauuuuccuuuaucac

SEQ ID NO: 379766 - RNA, 64 nt, Homo Sapiens
ucagaaucgccucagcauuugggaaccuccuagcacugugaaaggacuccuugaaguguugcaa

SEQ ID NO: 379767 - RNA, 64 nt, Homo Sapiens
uagcaauauaguacuggacauuaaaguccguuuuacugugaauaauagacugaucacucagaaa

SEQ ID NO: 379768 - RNA, 64 nt, Homo Sapiens
ugagaaauacagaagaaaauaaaacuuauuaacaacugugaauagcaucuuugggacaccucag

SEQ ID NO: 379769 - RNA, 64 nt, Homo Sapiens
auuuugaagaaaacacaacaaaaaaucaaaaggcacugugaacugauuucaaggccauauuuua

SEQ ID NO: 379770 - RNA, 64 nt, Homo Sapiens
agaugcccuggucuugcuuuucuggucacaggugacugugaaacuuaguaaucauguuggcugg

SEQ ID NO: 379771 - RNA, 61 nt, Homo Sapiens
guccaaaagucucuuaacugcauuuguugacacugugaacuuacuuggucggagccuguga

SEQ ID NO: 379772 - RNA, 64 nt, Homo Sapiens
aaaguucauucuguagugcaagcaucccucauuuacugugaacuaaauuuauuucuuaagaaaa

SEQ ID NO: 379773 - RNA, 64 nt, Homo Sapiens
ucacccaggcaaaauggcuaugucuccugagccaacugugaaccagugguuaaugaucagaaga

SEQ ID NO: 379774 - RNA, 64 nt, Homo Sapiens
uugggauuuauguccuugccccuuccccacaaggacugugaauagggagauacaauaucacacc

SEQ ID NO: 379775 - RNA, 64 nt, Homo Sapiens
aucugguuccucauucacugucauaugagguacuacugugaaggggccuccccccaugguguuu

SEQ ID NO: 379776 - RNA, 64 nt, Homo Sapiens
ccucagccuuuuccuccucaguuuucucuuuaaaacugugaaguacuaacuuuccaaggccugc

SEQ ID NO: 379777 - RNA, 64 nt, Homo Sapiens
ucagggcccacaucaucuaggcuccccagcccccacugugaaggggcuggccaggggcccgagc

SEQ ID NO: 379778 - RNA, 64 nt, Homo Sapiens
ccaucagaugugccaaaugguaauauugaguucaacugugaaauggugcauuaggcuguaguuc

SEQ ID NO: 379779 - RNA, 64 nt, Homo Sapiens
aaguugaauggugguuuuuaaggggggauuucagacugugaagacucuucacuggaaaacaggg

SEQ ID NO: 379780 - RNA, 64 nt, Homo Sapiens
guaaacauaauuaaugauggagagaaaccauacaacugugaagaauguggcaaagcuuuuaacc

SEQ ID NO: 379781 - RNA, 64 nt, Homo Sapiens
ucauuuauauuugagaaaaauuguagaaauauagacugugaaaaagacgucaauaucugcucac

SEQ ID NO: 379782 - RNA, 64 nt, Homo Sapiens
auaugagccuuugaaaguucacaggugagaagaaacugugaaguucaauuauucugaugcuggg

SEQ ID NO: 379783 - RNA, 64 nt, Homo Sapiens
ugaugacgggcuuguagcacugucuuaagcuucaacugugaaaauagcauucaacagagaacuc

SEQ ID NO: 379784 - RNA, 64 nt, Homo Sapiens
agccauuaauacaugcucacguacaaauauaaagacugugaaaaauuuauacuugagaaauauu

SEQ ID NO: 379785 - RNA, 64 nt, Homo Sapiens
auauggcaaagccuuuaauaagggaacuccugugacugugaagacauaaaaaaauucauacugg

SEQ ID NO: 379786 - RNA, 64 nt, Homo Sapiens
uuuguuuuccaagcuguuuuugggcuguauugauacugugaaugcaggguagcaccgugagaaa

SEQ ID NO: 379787 - RNA, 64 nt, Homo Sapiens
gaaaggaugggucaccucuccccccugugcugucacugugaaugaugucacaaaaaggaggugc

SEQ ID NO: 379788 - RNA, 64 nt, Homo Sapiens
ggcugaaagacaccuucccgucaauugucuugagacugugaagaagcaaugccuguggcuucag

SEQ ID NO: 379789 - RNA, 64 nt, Homo Sapiens
uaauggaaacguaggagcauguuuugugaaagaaacugugaaugucccuucuccuuugaaugcu

SEQ ID NO: 379790 - RNA, 64 nt, Homo Sapiens
agucagacaaauaaagcaaggagcagggggcugaacugugaacaagcuggcccguugguuuucu

SEQ ID NO: 379791 - RNA, 64 nt, Homo Sapiens
acagacccugggucccacaccccuuccaccuccuacugugaagagugauaaagaacuuagucau

SEQ ID NO: 379792 - RNA, 64 nt, Homo Sapiens; identical to SEQ ID NO: 82791

SEQ ID NO: 379793 - RNA, 64 nt, Homo Sapiens; identical to SEQ ID NO: 82792

SEQ ID NO: 379794 - RNA, 64 nt, Homo Sapiens; identical to SEQ ID NO: 82793

SEQ ID NO: 379795 - RNA, 64 nt, Homo Sapiens; identical to SEQ ID NO: 82794

SEQ ID NO: 379796 - RNA, 64 nt, Homo Sapiens; identical to SEQ ID NO: 82795

SEQ ID NO: 379797 - RNA, 64 nt, Homo Sapiens; identical to SEQ ID NO: 82796

SEQ ID NO: 379798 - RNA, 64 nt, Homo Sapiens; identical to SEQ ID NO: 82797

SEQ ID NO: 379799 - RNA, 64 nt, Homo Sapiens; identical to SEQ ID NO: 82798

SEQ ID NO: 379800 - RNA, 64 nt, Homo Sapiens; identical to SEQ ID NO: 82799

SEQ ID NO: 379801 - RNA, 64 nt, Homo Sapiens; identical to SEQ ID NO: 82800

SEQ ID NO: 379802 - RNA, 64 nt, Homo Sapiens; identical to SEQ ID NO: 82801

SEQ ID NO: 379803 - RNA, 64 nt, Homo Sapiens; identical to SEQ ID NO: 82802

SEQ ID NO: 379804 - RNA, 64 nt, Homo Sapiens; identical to SEQ ID NO: 82803

SEQ ID NO: 379805 - RNA, 64 nt, Homo Sapiens; identical to SEQ ID NO: 82804

SEQ ID NO: 379806 - RNA, 64 nt, Homo Sapiens; identical to SEQ ID NO: 82805

SEQ ID NO: 379807 - RNA, 64 nt, Homo Sapiens; identical to SEQ ID NO: 82806

SEQ ID NO: 379808 - RNA, 64 nt, Homo Sapiens; identical to SEQ ID NO: 82807

SEQ ID NO: 379809 - RNA, 64 nt, Homo Sapiens; identical to SEQ ID NO: 82808

SEQ ID NO: 379810 - RNA, 64 nt, Homo Sapiens; identical to SEQ ID NO: 82809

SEQ ID NO: 379811 - RNA, 64 nt, Homo Sapiens; identical to SEQ ID NO: 82810

SEQ ID NO: 379812 - RNA, 61 nt, Homo Sapiens; identical to SEQ ID NO: 82811

SEQ ID NO: 379813 - RNA, 64 nt, Homo Sapiens; identical to SEQ ID NO: 82812

SEQ ID NO: 379814 - RNA, 64 nt, Homo Sapiens; identical to SEQ ID NO: 82813

SEQ ID NO: 379815 - RNA, 64 nt, Homo Sapiens; identical to SEQ ID NO: 82814

SEQ ID NO: 379816 - RNA, 64 nt, Homo Sapiens; identical to SEQ ID NO: 82815

SEQ ID NO: 379817 - RNA, 64 nt, Homo Sapiens; identical to SEQ ID NO: 82816

SEQ ID NO: 379818 - RNA, 64 nt, Homo Sapiens; identical to SEQ ID NO: 82817

SEQ ID NO: 379819 - RNA, 64 nt, Homo Sapiens; identical to SEQ ID NO: 82818

SEQ ID NO: 379820 - RNA, 64 nt, Homo Sapiens; identical to SEQ ID NO: 82819

SEQ ID NO: 379821 - RNA, 64 nt, Homo Sapiens; identical to SEQ ID NO: 82820

SEQ ID NO: 379822 - RNA, 64 nt, Homo Sapiens; identical to SEQ ID NO: 82821

SEQ ID NO: 379823 - RNA, 64 nt, Homo Sapiens; identical to SEQ ID NO: 82822

SEQ ID NO: 379824 - RNA, 64 nt, Homo Sapiens; identical to SEQ ID NO: 82823

SEQ ID NO: 379825 - RNA, 64 nt, Homo Sapiens; identical to SEQ ID NO: 82824

SEQ ID NO: 379826 - RNA, 64 nt, Homo Sapiens; identical to SEQ ID NO: 82825

SEQ ID NO: 379827 - RNA, 64 nt, Homo Sapiens; identical to SEQ ID NO: 82826

SEQ ID NO: 379828 - RNA, 64 nt, Homo Sapiens; identical to SEQ ID NO: 82827

SEQ ID NO: 379829 - RNA, 64 nt, Homo Sapiens; identical to SEQ ID NO: 82828

SEQ ID NO: 379830 - RNA, 64 nt, Homo Sapiens; identical to SEQ ID NO: 82829

SEQ ID NO: 379831 - RNA, 64 nt, Homo Sapiens; identical to SEQ ID NO: 82830

SEQ ID NO: 379832 - RNA, 64 nt, Homo Sapiens; identical to SEQ ID NO: 82831

SEQ ID NO: 379833 - RNA, 64 nt, Homo Sapiens; identical to SEQ ID NO: 82832

SEQ ID NO: 379834 - RNA, 64 nt, Homo Sapiens; identical to SEQ ID NO: 82833

SEQ ID NO: 379835 - RNA, 64 nt, Homo Sapiens; identical to SEQ ID NO: 82834

SEQ ID NO: 379836 - RNA, 64 nt, Homo Sapiens; identical to SEQ ID NO: 82835

SEQ ID NO: 379837 - RNA, 64 nt, Homo Sapiens; identical to SEQ ID NO: 82836

SEQ ID NO: 379838 - RNA, 64 nt, Homo Sapiens; identical to SEQ ID NO: 82837

SEQ ID NO: 379839 - RNA, 64 nt, Homo Sapiens; identical to SEQ ID NO: 82838

SEQ ID NO: 379840 - RNA, 64 nt, Homo Sapiens; identical to SEQ ID NO: 82839

SEQ ID NO: 379841 - RNA, 64 nt, Homo Sapiens; identical to SEQ ID NO: 82840

SEQ ID NO: 379842 - RNA, 64 nt, Homo Sapiens
uugcgggguauauaaauuggggugaugaccccauagaccuaacugugaacaaucagauuagaca

SEQ ID NO: 379843 - RNA, 64 nt, Homo Sapiens
caugcaagugagaaagacaucugaggaaaauggaagaccuaaggcagacaggaaggaagcacaa

SEQ ID NO: 379844 - RNA, 64 nt, Homo Sapiens
ucaccacagagcagcugaggcauuaugccuuggaagaccuaaaucucccauccaguucaggagg

SEQ ID NO: 379845 - RNA, 64 nt, Homo Sapiens
agacuuugccugagaacuuguaaauuaaucagugagaccuaauuugugacaugucaguagcauc

SEQ ID NO: 379846 - RNA, 64 nt, Homo Sapiens
uccuggccaucaucucuuauuuuggugagugagaagaccuaaacugucuuaugggucacguguc

SEQ ID NO: 379847 - RNA, 64 nt, Homo Sapiens
cuauuggauguaaacaagacggaggcuucuuuggagaccuaaguaggaaauaauacaacaaaaa

SEQ ID NO: 379848 - RNA, 64 nt, Homo Sapiens
aucagugccuccugcucugcccaaacacacucccauggggcaagcacuggaguggaugcugggc

SEQ ID NO: 379849 - RNA, 64 nt, Homo Sapiens
uuuuugguugggugggugggaaggucucuuuaaaauggggcaggccacacccccauuccgugcc

SEQ ID NO: 379850 - RNA, 64 nt, Homo Sapiens
gcggggcuccuccugaaggaggcggggcucuaggauggggcacggcucugggguaggcugcucc

SEQ ID NO: 379851 - RNA, 64 nt, Homo Sapiens
gugggguuuuaugguggaugaggcuucuuccuggauggggcagagcuucuccugaccagggcaa

SEQ ID NO: 379852 - RNA, 63 nt, Homo Sapiens
gugauucagacucaggcuaaggggucaggccagauggggcaggaaggcuccgcaggaccggac

SEQ ID NO: 379853 - RNA, 64 nt, Homo Sapiens
gagugaucucuuggacacagagcccccauucaaaauggggcagggcaagggugggagugugcaa

SEQ ID NO: 379854 - RNA, 64 nt, Homo Sapiens
ucguugaauuuucccagaaaagagaauggggcagauggggcaaacaacucagacuuuucauuuu

SEQ ID NO: 379855 - RNA, 64 nt, Homo Sapiens
uggggcaaaucguugaauuuuuucauuuuagagaauggggcagaugucccuuucaacucagacu

SEQ ID NO: 379856 - RNA, 64 nt, Homo Sapiens
uagcagcauuuccuauccuccucucuuaggggcuauggggcaguguuugaauggggcauguuca

SEQ ID NO: 379857 - RNA, 64 nt, Homo Sapiens
uucacucucuuaggggcuauguauauguguuugaauggggcauguuaaauggcuaaguaaaugg

SEQ ID NO: 379858 - RNA, 64 nt, Homo Sapiens
aaauugggguguguuacuguuuaccauggcaguaauggggcaaacaauaaaaugcaaugugaaa

SEQ ID NO: 379859 - RNA, 64 nt, Homo Sapiens
ccugccaguuuguccuacccgcaagcugguugauauggggcagagguuuaauagacuucucuca

SEQ ID NO: 379860 - RNA, 64 nt, Homo Sapiens; identical to SEQ ID NO: 300694

SEQ ID NO: 379861 - RNA, 64 nt, Homo Sapiens; identical to SEQ ID NO: 300695

SEQ ID NO: 379862 - RNA, 64 nt, Homo Sapiens; identical to SEQ ID NO: 300696

SEQ ID NO: 379863 - RNA, 64 nt, Homo Sapiens; identical to SEQ ID NO: 300697

SEQ ID NO: 379864 - RNA, 64 nt, Homo Sapiens; identical to SEQ ID NO: 300698

SEQ ID NO: 379865 - RNA, 64 nt, Homo Sapiens; identical to SEQ ID NO: 300699

SEQ ID NO: 379866 - RNA, 64 nt, Homo Sapiens; identical to SEQ ID NO: 300700

SEQ ID NO: 379867 - RNA, 64 nt, Homo Sapiens; identical to SEQ ID NO: 300701

SEQ ID NO: 379868 - RNA, 64 nt, Homo Sapiens; identical to SEQ ID NO: 300923

SEQ ID NO: 379869 - RNA, 64 nt, Homo Sapiens; identical to SEQ ID NO: 300924

SEQ ID NO: 379870 - RNA, 64 nt, Homo Sapiens; identical to SEQ ID NO: 300925

SEQ ID NO: 379871 - RNA, 64 nt, Homo Sapiens; identical to SEQ ID NO: 300926

SEQ ID NO: 379872 - RNA, 64 nt, Homo Sapiens; identical to SEQ ID NO: 300927

SEQ ID NO: 379873 - RNA, 64 nt, Homo Sapiens; identical to SEQ ID NO: 300928

SEQ ID NO: 379874 - RNA, 64 nt, Homo Sapiens; identical to SEQ ID NO: 300929

SEQ ID NO: 379875 - RNA, 64 nt, Homo Sapiens; identical to SEQ ID NO: 300930

SEQ ID NO: 379876 - RNA, 64 nt, Homo Sapiens; identical to SEQ ID NO: 131680

SEQ ID NO: 379877 - RNA, 64 nt, Homo Sapiens; identical to SEQ ID NO: 131681

SEQ ID NO: 379878 - RNA, 64 nt, Homo Sapiens; identical to SEQ ID NO: 131682

SEQ ID NO: 379879 - RNA, 64 nt, Homo Sapiens; identical to SEQ ID NO: 131683

SEQ ID NO: 379880 - RNA, 64 nt, Homo Sapiens; identical to SEQ ID NO: 131684

SEQ ID NO: 379881 - RNA, 64 nt, Homo Sapiens; identical to SEQ ID NO: 131685

SEQ ID NO: 379882 - RNA, 64 nt, Homo Sapiens; identical to SEQ ID NO: 131686

SEQ ID NO: 379883 - RNA, 64 nt, Homo Sapiens; identical to SEQ ID NO: 131687

SEQ ID NO: 379884 - RNA, 64 nt, Homo Sapiens
cucaccuugguuuccgcacaccuucgcaaugugaacaggucaggagucccucccguccaccucc

SEQ ID NO: 379885 - RNA, 64 nt, Homo Sapiens
cccuuucucuuccuucuaaacaugugucucucccacaggucauucuccugugacacguguacug

SEQ ID NO: 379886 - RNA, 64 nt, Homo Sapiens
ugaucccuggucaagaucuguugcccaagauguuacaggucacaaugaccacauuugaaauugu

SEQ ID NO: 379887 - RNA, 64 nt, Homo Sapiens
aggugcucuaagcuuaaucccucagaauguguggacaggucagcuuagaagagauggggagauu

SEQ ID NO: 379888 - RNA, 64 nt, Homo Sapiens
cccacaggccaggcccagucacagcugggcuuccacaggucagaauaugggacaggacaugguc

SEQ ID NO: 379889 - RNA, 64 nt, Homo Sapiens
cuacaagaagcaaaacugcccaugcaaagagaacacaggucacuuuucaaaacacuugcaucau

SEQ ID NO: 379890 - RNA, 64 nt, Homo Sapiens
ucauuuauuucauuuuggucuuaaugcuuuguaaacaggucaaaaaauacugucauacucuaag

SEQ ID NO: 379891 - RNA, 64 nt, Homo Sapiens
uuccagugggguggggggagggcaagcuggauuuacaggucacggcuggacugaaugggccuuu

SEQ ID NO: 379892 - RNA, 64 nt, Homo Sapiens
cuggaccucaaagaauucuucagaccucauaguuacaggucauuauaucuacuauguugauuua

SEQ ID NO: 379893 - RNA, 64 nt, Homo Sapiens
acagggccacauuugcaugagacauggcugucucacaggucacagagccauuacaacagcuuac

SEQ ID NO: 379894 - RNA, 64 nt, Homo Sapiens
cgcagagcccaucuacgcccaacacagagcucacacaggucacugcucucuaggcggacacacc

SEQ ID NO: 379895 - RNA, 64 nt, Homo Sapiens
ucggucccagaggaggaccuagugacaucaugggacaggucaaagcauuagggccaccuccaug

SEQ ID NO: 379896 - RNA, 64 nt, Homo Sapiens; identical to SEQ ID NO: 219290

SEQ ID NO: 379897 - RNA, 64 nt, Homo Sapiens; identical to SEQ ID NO: 219291

SEQ ID NO: 379898 - RNA, 64 nt, Homo Sapiens; identical to SEQ ID NO: 219292

SEQ ID NO: 379899 - RNA, 64 nt, Homo Sapiens; identical to SEQ ID NO: 219293

SEQ ID NO: 379900 - RNA, 64 nt, Homo Sapiens; identical to SEQ ID NO: 219294

SEQ ID NO: 379901 - RNA, 64 nt, Homo Sapiens; identical to SEQ ID NO: 219295

SEQ ID NO: 379902 - RNA, 64 nt, Homo Sapiens; identical to SEQ ID NO: 219296

SEQ ID NO: 379903 - RNA, 64 nt, Homo Sapiens; identical to SEQ ID NO: 219297

SEQ ID NO: 379904 - RNA, 64 nt, Homo Sapiens; identical to SEQ ID NO: 219298

SEQ ID NO: 379905 - RNA, 64 nt, Homo Sapiens; identical to SEQ ID NO: 219299

SEQ ID NO: 379906 - RNA, 64 nt, Homo Sapiens; identical to SEQ ID NO: 219300

SEQ ID NO: 379907 - RNA, 64 nt, Homo Sapiens; identical to SEQ ID NO: 219301

SEQ ID NO: 379908 - RNA, 64 nt, Homo Sapiens; identical to SEQ ID NO: 219302

SEQ ID NO: 379909 - RNA, 64 nt, Homo Sapiens; identical to SEQ ID NO: 219303

SEQ ID NO: 379910 - RNA, 64 nt, Homo Sapiens; identical to SEQ ID NO: 219304

SEQ ID NO: 379911 - RNA, 64 nt, Homo Sapiens; identical to SEQ ID NO: 219305

SEQ ID NO: 379912 - RNA, 64 nt, Homo Sapiens; identical to SEQ ID NO: 219306

SEQ ID NO: 379913 - RNA, 64 nt, Homo Sapiens; identical to SEQ ID NO: 219307

SEQ ID NO: 379914 - RNA, 64 nt, Homo Sapiens; identical to SEQ ID NO: 219308

SEQ ID NO: 379915 - RNA, 64 nt, Homo Sapiens; identical to SEQ ID NO: 219309

SEQ ID NO: 379916 - RNA, 64 nt, Homo Sapiens; identical to SEQ ID NO: 219310

SEQ ID NO: 379917 - RNA, 64 nt, Homo Sapiens; identical to SEQ ID NO: 219311

SEQ ID NO: 379918 - RNA, 64 nt, Homo Sapiens; identical to SEQ ID NO: 219312

SEQ ID NO: 379919 - RNA, 64 nt, Homo Sapiens; identical to SEQ ID NO: 219313

SEQ ID NO: 379920 - RNA, 64 nt, Homo Sapiens; identical to SEQ ID NO: 219314

SEQ ID NO: 379921 - RNA, 64 nt, Homo Sapiens; identical to SEQ ID NO: 219315

SEQ ID NO: 379922 - RNA, 64 nt, Homo Sapiens; identical to SEQ ID NO: 219316

SEQ ID NO: 379923 - RNA, 64 nt, Homo Sapiens; identical to SEQ ID NO: 219317

SEQ ID NO: 379924 - RNA, 64 nt, Homo Sapiens; identical to SEQ ID NO: 219318

SEQ ID NO: 379925 - RNA, 64 nt, Homo Sapiens; identical to SEQ ID NO: 219319

SEQ ID NO: 379926 - RNA, 64 nt, Homo Sapiens; identical to SEQ ID NO: 219320

SEQ ID NO: 379927 - RNA, 64 nt, Homo Sapiens; identical to SEQ ID NO: 219321

SEQ ID NO: 379928 - RNA, 64 nt, Homo Sapiens; identical to SEQ ID NO: 219322

SEQ ID NO: 379929 - RNA, 64 nt, Homo Sapiens; identical to SEQ ID NO: 219323

SEQ ID NO: 379930 - RNA, 64 nt, Homo Sapiens; identical to SEQ ID NO: 219324

SEQ ID NO: 379931 - RNA, 64 nt, Homo Sapiens; identical to SEQ ID NO: 219325

SEQ ID NO: 379932 - RNA, 64 nt, Homo Sapiens; identical to SEQ ID NO: 219326

SEQ ID NO: 379933 - RNA, 64 nt, Homo Sapiens; identical to SEQ ID NO: 219327

SEQ ID NO: 379934 - RNA, 64 nt, Homo Sapiens; identical to SEQ ID NO: 219328

SEQ ID NO: 379935 - RNA, 64 nt, Homo Sapiens; identical to SEQ ID NO: 219329

SEQ ID NO: 379936 - RNA, 64 nt, Homo Sapiens; identical to SEQ ID NO: 219330

SEQ ID NO: 379937 - RNA, 64 nt, Homo Sapiens; identical to SEQ ID NO: 219331

SEQ ID NO: 379938 - RNA, 64 nt, Homo Sapiens; identical to SEQ ID NO: 219332

SEQ ID NO: 379939 - RNA, 64 nt, Homo Sapiens; identical to SEQ ID NO: 219333

SEQ ID NO: 379940 - RNA, 64 nt, Homo Sapiens; identical to SEQ ID NO: 219334

SEQ ID NO: 379941 - RNA, 64 nt, Homo Sapiens; identical to SEQ ID NO: 219335

SEQ ID NO: 379942 - RNA, 64 nt, Homo Sapiens; identical to SEQ ID NO: 219336

SEQ ID NO: 379943 - RNA, 64 nt, Homo Sapiens; identical to SEQ ID NO: 219337

SEQ ID NO: 379944 - RNA, 64 nt, Homo Sapiens; identical to SEQ ID NO: 219338

SEQ ID NO: 379945 - RNA, 64 nt, Homo Sapiens; identical to SEQ ID NO: 219339

SEQ ID NO: 379946 - RNA, 64 nt, Homo Sapiens; identical to SEQ ID NO: 219340

SEQ ID NO: 379947 - RNA, 64 nt, Homo Sapiens; identical to SEQ ID NO: 219341

SEQ ID NO: 379948 - RNA, 64 nt, Homo Sapiens; identical to SEQ ID NO: 219342

SEQ ID NO: 379949 - RNA, 64 nt, Homo Sapiens; identical to SEQ ID NO: 219343

SEQ ID NO: 379950 - RNA, 64 nt, Homo Sapiens; identical to SEQ ID NO: 219344

SEQ ID NO: 379951 - RNA, 64 nt, Homo Sapiens; identical to SEQ ID NO: 219345

SEQ ID NO: 379952 - RNA, 64 nt, Homo Sapiens; identical to SEQ ID NO: 219346

SEQ ID NO: 379953 - RNA, 64 nt, Homo Sapiens; identical to SEQ ID NO: 219347

SEQ ID NO: 379954 - RNA, 64 nt, Homo Sapiens; identical to SEQ ID NO: 219348

SEQ ID NO: 379955 - RNA, 64 nt, Homo Sapiens; identical to SEQ ID NO: 219349

SEQ ID NO: 379956 - RNA, 64 nt, Homo Sapiens; identical to SEQ ID NO: 219350

SEQ ID NO: 379957 - RNA, 64 nt, Homo Sapiens; identical to SEQ ID NO: 219351

SEQ ID NO: 379958 - RNA, 64 nt, Homo Sapiens; identical to SEQ ID NO: 219352

SEQ ID NO: 379959 - RNA, 64 nt, Homo Sapiens; identical to SEQ ID NO: 219353

SEQ ID NO: 379960 - RNA, 64 nt, Homo Sapiens; identical to SEQ ID NO: 219354

SEQ ID NO: 379961 - RNA, 64 nt, Homo Sapiens; identical to SEQ ID NO: 219355

SEQ ID NO: 379962 - RNA, 64 nt, Homo Sapiens; identical to SEQ ID NO: 219356

SEQ ID NO: 379963 - RNA, 64 nt, Homo Sapiens; identical to SEQ ID NO: 219357

SEQ ID NO: 379964 - RNA, 64 nt, Homo Sapiens; identical to SEQ ID NO: 219358

SEQ ID NO: 379965 - RNA, 64 nt, Homo Sapiens; identical to SEQ ID NO: 219359

SEQ ID NO: 379966 - RNA, 64 nt, Homo Sapiens; identical to SEQ ID NO: 219360

SEQ ID NO: 379967 - RNA, 64 nt, Homo Sapiens; identical to SEQ ID NO: 219361

SEQ ID NO: 379968 - RNA, 64 nt, Homo Sapiens; identical to SEQ ID NO: 219362

SEQ ID NO: 379969 - RNA, 64 nt, Homo Sapiens; identical to SEQ ID NO: 219363

SEQ ID NO: 379970 - RNA, 64 nt, Homo Sapiens; identical to SEQ ID NO: 219364

SEQ ID NO: 379971 - RNA, 64 nt, Homo Sapiens; identical to SEQ ID NO: 219365

SEQ ID NO: 379972 - RNA, 64 nt, Homo Sapiens; identical to SEQ ID NO: 219366

SEQ ID NO: 379973 - RNA, 64 nt, Homo Sapiens; identical to SEQ ID NO: 219367

SEQ ID NO: 379974 - RNA, 64 nt, Homo Sapiens; identical to SEQ ID NO: 219368

SEQ ID NO: 379975 - RNA, 64 nt, Homo Sapiens; identical to SEQ ID NO: 219369

SEQ ID NO: 379976 - RNA, 64 nt, Homo Sapiens; identical to SEQ ID NO: 245118

SEQ ID NO: 379977 - RNA, 64 nt, Homo Sapiens; identical to SEQ ID NO: 245119

SEQ ID NO: 379978 - RNA, 64 nt, Homo Sapiens; identical to SEQ ID NO: 245120

SEQ ID NO: 379979 - RNA, 64 nt, Homo Sapiens; identical to SEQ ID NO: 245121

SEQ ID NO: 379980 - RNA, 64 nt, Homo Sapiens; identical to SEQ ID NO: 245122

SEQ ID NO: 379981 - RNA, 64 nt, Homo Sapiens; identical to SEQ ID NO: 245123

SEQ ID NO: 379982 - RNA, 64 nt, Homo Sapiens; identical to SEQ ID NO: 245124

SEQ ID NO: 379983 - RNA, 64 nt, Homo Sapiens; identical to SEQ ID NO: 245125

SEQ ID NO: 379984 - RNA, 64 nt, Homo Sapiens
uuagauauuuuaccauauagauauguuuuuauuugacucaaaaaucagcaaaacuuauaccugu

SEQ ID NO: 379985 - RNA, 64 nt, Homo Sapiens
gaaauugugcacuuuccugucagccuuuaaauuugacucaaaugucucaagauuuuucuaaaua

SEQ ID NO: 379986 - RNA, 64 nt, Homo Sapiens
cacagauccacaccagaguugagaaagcuuauuggacucaaaccuaaauaagaugaauguaaaa

SEQ ID NO: 379987 - RNA, 64 nt, Homo Sapiens
auuaagaaguuucauugauaaauaugcauuuucagacucaaauagucaaucuuuuaauguuuua

SEQ ID NO: 379988 - RNA, 64 nt, Homo Sapiens
gaauugaauccuagcuuuuagaauauuaauaggagacucaaaguuaauauucuuaacaacuuaa

SEQ ID NO: 379989 - RNA, 64 nt, Homo Sapiens
aauaguugauuguauuuugccaacuacuaguauagacucaaauuugcuauuuaauuuuuaaaau

SEQ ID NO: 379990 - RNA, 64 nt, Homo Sapiens
uccaaaaagguggucaaauuaaaacauuuccagggacucaaaauuuucaaucacacuuugugga

SEQ ID NO: 379991 - RNA, 64 nt, Homo Sapiens
agguauuuuuauagaauuuucauuuuauguuaaugacucaaaaauuggcugcugcuguuuucuu

SEQ ID NO: 379992 - RNA, 64 nt, Homo Sapiens
guuucuacacguggcaggccaagaaugggaggcugacucaaaacuagauagaaaaauauaaaau

SEQ ID NO: 379993 - RNA, 64 nt, Homo Sapiens
augaguuuaaauccaguagcuaaucccuuccugagacucaaagaucgugacgcugguuggaauu

SEQ ID NO: 379994 - RNA, 64 nt, Homo Sapiens
ccacaggaagugaagaaucuguuucccagcaguggacucaaaacccaucugggcuccuaaccuu

SEQ ID NO: 379995 - RNA, 64 nt, Homo Sapiens
acaucuuggcacauuuaagagacagucaccccaggacucaaaaauagggaaguaacaguaacgc

SEQ ID NO: 379996 - RNA, 64 nt, Homo Sapiens; identical to SEQ ID NO: 51595

SEQ ID NO: 379997 - RNA, 64 nt, Homo Sapiens; identical to SEQ ID NO: 51596

SEQ ID NO: 379998 - RNA, 64 nt, Homo Sapiens; identical to SEQ ID NO: 51597

SEQ ID NO: 379999 - RNA, 64 nt, Homo Sapiens; identical to SEQ ID NO: 51598

SEQ ID NO: 380000 - RNA, 64 nt, Homo Sapiens; identical to SEQ ID NO: 51599

SEQ ID NO: 380001 - RNA, 64 nt, Homo Sapiens; identical to SEQ ID NO: 51600

SEQ ID NO: 380002 - RNA, 64 nt, Homo Sapiens; identical to SEQ ID NO: 51601

SEQ ID NO: 380003 - RNA, 64 nt, Homo Sapiens; identical to SEQ ID NO: 51602

SEQ ID NO: 380004 - RNA, 64 nt, Homo Sapiens; identical to SEQ ID NO: 51603

SEQ ID NO: 380005 - RNA, 64 nt, Homo Sapiens; identical to SEQ ID NO: 51604

SEQ ID NO: 380006 - RNA, 64 nt, Homo Sapiens; identical to SEQ ID NO: 51605

SEQ ID NO: 380007 - RNA, 64 nt, Homo Sapiens; identical to SEQ ID NO: 51606

SEQ ID NO: 380008 - RNA, 64 nt, Homo Sapiens; identical to SEQ ID NO: 51607

SEQ ID NO: 380009 - RNA, 64 nt, Homo Sapiens; identical to SEQ ID NO: 51608

SEQ ID NO: 380010 - RNA, 64 nt, Homo Sapiens; identical to SEQ ID NO: 51609

SEQ ID NO: 380011 - RNA, 64 nt, Homo Sapiens; identical to SEQ ID NO: 51610

SEQ ID NO: 380012 - RNA, 64 nt, Homo Sapiens; identical to SEQ ID NO: 51611

SEQ ID NO: 380013 - RNA, 64 nt, Homo Sapiens; identical to SEQ ID NO: 51612

SEQ ID NO: 380014 - RNA, 64 nt, Homo Sapiens; identical to SEQ ID NO: 51613

SEQ ID NO: 380015 - RNA, 64 nt, Homo Sapiens; identical to SEQ ID NO: 51614

SEQ ID NO: 380016 - RNA, 64 nt, Homo Sapiens; identical to SEQ ID NO: 51615

SEQ ID NO: 380017 - RNA, 64 nt, Homo Sapiens; identical to SEQ ID NO: 51616

SEQ ID NO: 380018 - RNA, 64 nt, Homo Sapiens; identical to SEQ ID NO: 51617

SEQ ID NO: 380019 - RNA, 64 nt, Homo Sapiens; identical to SEQ ID NO: 51618

SEQ ID NO: 380020 - RNA, 64 nt, Homo Sapiens; identical to SEQ ID NO: 51619

SEQ ID NO: 380021 - RNA, 64 nt, Homo Sapiens; identical to SEQ ID NO: 51620

SEQ ID NO: 380022 - RNA, 64 nt, Homo Sapiens
cccuccuuuggaaguacggcuaauagaagcccuagauccgaauaagauccgaauaagaauaugu

SEQ ID NO: 380023 - RNA, 64 nt, Homo Sapiens
aaguacggcuaauagaagcccuagauccgaauaagauccgaauaagaauauguaauggaccagg

SEQ ID NO: 380024 - RNA, 64 nt, Homo Sapiens
uguuuucuuguuuccaugaaauuugaauaaagaugaacaguauuauguugccagaauucacuca

SEQ ID NO: 380025 - RNA, 64 nt, Homo Sapiens
uuuccauaaaguucuagucaguagauuuaauguugaacaguacuucuuccauaaaccuuuguuu

SEQ ID NO: 380026 - RNA, 64 nt, Homo Sapiens
uucuauugcacgucuacaaucuucagaugagagggaacaguauauauucuuuuuuuccuagagc

SEQ ID NO: 380027 - RNA, 64 nt, Homo Sapiens
uucuuuuuuuccuagagccuuuaaauuuuuaaaagaacaguauacacccaugaccaccauucac

SEQ ID NO: 380028 - RNA, 64 nt, Homo Sapiens
cuguugggauggagauuuuaauguguaauguuuugaacaguauugacggaauuacaaccauaaa

SEQ ID NO: 380029 - RNA, 64 nt, Homo Sapiens
aauuaugaugaagaugauagaaguaggaaaaaaugaacaguaauacaaguuuuccauuuucuua

SEQ ID NO: 380030 - RNA, 64 nt, Homo Sapiens; identical to SEQ ID NO: 209686

SEQ ID NO: 380031 - RNA, 64 nt, Homo Sapiens; identical to SEQ ID NO: 209687

SEQ ID NO: 380032 - RNA, 64 nt, Homo Sapiens; identical to SEQ ID NO: 209688

SEQ ID NO: 380033 - RNA, 64 nt, Homo Sapiens; identical to SEQ ID NO: 209689

SEQ ID NO: 380034 - RNA, 64 nt, Homo Sapiens
gaaaguaaauccucaugaggaaaaguacaaauggaaaucguauuaauuugugaggcagggaguu

SEQ ID NO: 380035 - RNA, 64 nt, Homo Sapiens
uguguaugaaaaccuucuauagaaaucucuacauaaaucguauuaucauugcaauuauguuaaa

SEQ ID NO: 380036 - RNA, 64 nt, Homo Sapiens
uaugagcuauacuuuaacauuugacuuaauuuugaaaucguauaugaaggauguauuaaaauuu

SEQ ID NO: 380037 - RNA, 64 nt, Homo Sapiens
uauguacgcacgcauaucaaacacuuugugaaacaaaucguaagcugcaauaccagucuaauga

SEQ ID NO: 380038 - RNA, 63 nt, Homo Sapiens
acuccauggaaauagguuugaaaacuuugaaguuaaaucguaauguccuucacuugcuuucag

SEQ ID NO: 380039 - RNA, 64 nt, Homo Sapiens
acaaauuaauuaaaauauugaguuuuaaagaauuaaaucguagguuuuauaauaaaauuuaaaa

SEQ ID NO: 380040 - RNA, 64 nt, Homo Sapiens
ucucauuugccaggaagauggguucccacguagcaaaucguacauugugcccuguagcuccuua

SEQ ID NO: 380041 - RNA, 64 nt, Homo Sapiens
aaaggucaguaggaugugcauccuagggaagauaaaaucguauaugguaaaggcauuugaguua

SEQ ID NO: 380042 - RNA, 64 nt, Homo Sapiens
aguuccuguaagcauuuccaccagaacuugaggcaaaucguaaggaagcuguuucuuuuaaaac

SEQ ID NO: 380043 - RNA, 54 nt, Homo Sapiens
cucuucaucaggagaaauaaauuaaaaucguacucauaaucagcucugcauaca

SEQ ID NO: 380044 - RNA, 64 nt, Homo Sapiens
caugucacucucuuccuuuuuguauccacucuccaaaucguacccuaaauuuuucuugacccag

SEQ ID NO: 380045 - RNA, 64 nt, Homo Sapiens
uugaucauacuugaaagugaacuuuaacauugaaaaaucguacagucauuucaagaauaagaaa

SEQ ID NO: 380046 - RNA, 64 nt, Homo Sapiens
aaaucuggauuuuuuuuuuuauguccugggccuaaaaucguauauugcuuaacucuaaagcucc

SEQ ID NO: 380047 - RNA, 64 nt, Homo Sapiens
cauggauugaaaaaagauuauuaaaguauuuagcaaaucguaaauaguacccaugcuuuaaauu

SEQ ID NO: 380048 - RNA, 64 nt, Homo Sapiens
ugguaagacaagcacaaagcaacgugcaauacaaaaaucguaucucaagggaaaauacucaaag

SEQ ID NO: 380049 - RNA, 64 nt, Homo Sapiens
cguaacucccccugaaauaaauuacaaaaguuuuaaaucguagagcuaaaauuuuggccagaac

SEQ ID NO: 380050 - RNA, 64 nt, Homo Sapiens
guggauauuuuuguuugguaacaauuaaaauuuuaaaucguaaaaaauguacauuugcccuuuc

SEQ ID NO: 380051 - RNA, 64 nt, Homo Sapiens
ggaagaauccccuauuuaucuuaucaagaacgaaaaaucguauguacuucucuuugaagcuacc

SEQ ID NO: 380052 - RNA, 64 nt, Homo Sapiens
auauuugaauaugaucucccauaauuugaaauugaaaucguauuguguggcucuguauauucug

SEQ ID NO: 380053 - RNA, 64 nt, Homo Sapiens
ccuuauucagcaucacaaaaugcauaggaaagagaaaucguaugaauguaaugaguaugagggc

SEQ ID NO: 380054 - RNA, 64 nt, Homo Sapiens
aacagaaaaugucauaggaacauugcugaaaagaaaaucguaaaaagagaacaucagagguuuu

SEQ ID NO: 380055 - RNA, 64 nt, Homo Sapiens
aacuuaacagaugccuccucuccaaagagaauuaaaaucguagcuuguacagaucaagagaaua

SEQ ID NO: 380056 - RNA, 64 nt, Homo Sapiens
gguaaacauucauauggccauuaauuuuaacauuaaaucguagguagggcaauguaguaaaaug

SEQ ID NO: 380057 - RNA, 64 nt, Homo Sapiens
ucaugguugaguuucagaacuaaucauauugaugaaaucguaauacaucuuuaugacucuagaa

SEQ ID NO: 380058 - RNA, 64 nt, Homo Sapiens
auucaggguuuccugacugcuaaugcagaaaggaaaaucguaaaggaaacagaaagaugaaaua

SEQ ID NO: 380059 - RNA, 64 nt, Homo Sapiens
uuuaaagaaaauguuuguuuuaacauaaauaaacaaaucguaucaguguuugugaauaaaauac

SEQ ID NO: 380060 - RNA, 64 nt, Homo Sapiens
cuaauucuucauuauaguaauccucauuuuacuaaaaucguauuucaaaaucaaaguuaugguu

SEQ ID NO: 380061 - RNA, 64 nt, Homo Sapiens
gacguuaccaauuauggagugucaccagcugccaaaaucguagguguuggcucugcuggucacu

SEQ ID NO: 380062 - RNA, 64 nt, Homo Sapiens
aacacccagcuaggaccauuacugccagagaaaaaaaucguauugaauggccauuucccuacuu

SEQ ID NO: 380063 - RNA, 64 nt, Homo Sapiens
gaaguagagguggccgagguuggggcacacgaggaaaucguagucggggaagacucuacugaau

SEQ ID NO: 380064 - RNA, 64 nt, Homo Sapiens
uugaauaccuuguaauuuuuuagagauuaucuaaaaaucguaacauaauuugaugucucaaaug

SEQ ID NO: 380065 - RNA, 64 nt, Homo Sapiens
uuuggucugauacuucauguauuugaauauaguuaaaucguauuauuuuuuucuuaacagaaau

SEQ ID NO: 380066 - RNA, 64 nt, Homo Sapiens
gagcagaucuguggaagaacaauccagggcugagaaaucguagagcagugaggcaggcugggag

SEQ ID NO: 380067 - RNA, 64 nt, Homo Sapiens
ccuuauuaacaaaauagaauauuuuugagaaagcaaaucguauaugugucuggccagaaaaggc

SEQ ID NO: 380068 - RNA, 64 nt, Homo Sapiens
guaauuuucuugcauuuagagauugugcaguaugaaaucguauuuuccaguuguagaccuugau

SEQ ID NO: 380069 - RNA, 64 nt, Homo Sapiens
cuaugaaguuuauuuucuauauugggcuuaauauaaaucguaacacugucauuagaauugaauu

SEQ ID NO: 380070 - RNA, 64 nt, Homo Sapiens
aaaaaagauuacuuaauuuugauuuaaaaacaaaaaaucguaaaauacaaaaaccaguuaaugu

SEQ ID NO: 380071 - RNA, 64 nt, Homo Sapiens
ugaauuuguauaauaaagcuuucagguguuacagaaaucguagacaagcaagugcacaugauaa

SEQ ID NO: 380072 - RNA, 64 nt, Homo Sapiens
agccauuuaauuguucuagaguuuuagcauuuaaaaaucguaugaaagucuacaucagcugaau

SEQ ID NO: 380073 - RNA, 64 nt, Homo Sapiens
guuuguuaccagagguugugucugcgucgucaccaaaucguagcaaaggagagagcaaagggug

SEQ ID NO: 380074 - RNA, 64 nt, Homo Sapiens
aagcaauaaacaacuuucacguauuuugccuguuaaaucguaacgguauuacaucccugguguc

SEQ ID NO: 380075 - RNA, 64 nt, Homo Sapiens
auaaauauuucaauuaauuuaauaacuguguaacaaaucguauucgucuugauuguauauugga

SEQ ID NO: 380076 - RNA, 64 nt, Homo Sapiens
gucccagggucgugagguuucuggugaaaagguuaaaucguagaagcuaguauauuuuuuauau

SEQ ID NO: 380077 - RNA, 64 nt, Homo Sapiens
uugggggaaucuauguuuuacauaaauagaauccaaaucguaugaacaguuauuuaaauaaaca

SEQ ID NO: 380078 - RNA, 64 nt, Homo Sapiens
cuugccaaguaaccaccacugaagacauuaaaagaaaucguauuugagcuaaaacucaacuaua

SEQ ID NO: 380079 - RNA, 64 nt, Homo Sapiens
ucacuguguuuucaauuuauauuuaaaaggaaaaaaaucguauucuaguuuccuuguguuggaa

SEQ ID NO: 380080 - RNA, 63 nt, Homo Sapiens
guugaaugcccacaccaccauccucucaucccagccaguaagaauuucaguugugggccucca

SEQ ID NO: 380081 - RNA, 63 nt, Homo Sapiens
ucuguaaaauauccuguacaaaacaagacuauugccaguaauguauacaaauugucuuuuugu

SEQ ID NO: 380082 - RNA, 64 nt, Homo Sapiens; identical to SEQ ID NO: 360198

SEQ ID NO: 380083 - RNA, 64 nt, Homo Sapiens; identical to SEQ ID NO: 360199

SEQ ID NO: 380084 - RNA, 64 nt, Homo Sapiens; identical to SEQ ID NO: 360200

SEQ ID NO: 380085 - RNA, 64 nt, Homo Sapiens; identical to SEQ ID NO: 360201

SEQ ID NO: 380086 - RNA, 64 nt, Homo Sapiens; identical to SEQ ID NO: 360202

SEQ ID NO: 380087 - RNA, 64 nt, Homo Sapiens; identical to SEQ ID NO: 360203

SEQ ID NO: 380088 - RNA, 64 nt, Homo Sapiens; identical to SEQ ID NO: 360204

SEQ ID NO: 380089 - RNA, 64 nt, Homo Sapiens; identical to SEQ ID NO: 360205

SEQ ID NO: 380090 - RNA, 64 nt, Homo Sapiens; identical to SEQ ID NO: 360206

SEQ ID NO: 380091 - RNA, 64 nt, Homo Sapiens; identical to SEQ ID NO: 360207

SEQ ID NO: 380092 - RNA, 64 nt, Homo Sapiens
auagggucauuccauaugaucuguguugggaucauaccaggacaaaaaccucaguacugcauca

SEQ ID NO: 380093 - RNA, 64 nt, Homo Sapiens
aggaagagaagaaaugaggauuuugggcacuguguaccaggaugcauaauggcauuucuaaagc

SEQ ID NO: 380094 - RNA, 64 nt, Homo Sapiens
auaggaguggauuccugcccgagcgggaucagauuaccaggaacaugaauuaccaggauucaug

SEQ ID NO: 380095 - RNA, 64 nt, Homo Sapiens
cauggagcgggaucagauuauagggaggaugaauuaccaggauuaaaucauaauguggauagga

SEQ ID NO: 380096 - RNA, 64 nt, Homo Sapiens
ccucuagcagauaaauaaaaaguacuuuuuugccucuuaugauucuguuuuguccaauauuggu

SEQ ID NO: 380097 - RNA, 64 nt, Homo Sapiens
aguuuucauccagggauauaauccaguuaggucuucuuaugaagaaagccaagaaguuggucuu

SEQ ID NO: 380098 - RNA, 64 nt, Homo Sapiens
aaccuuuauuuaggccuucuugcaacaaugggacucuuaugaaauugucaccauauggccaauu

SEQ ID NO: 380099 - RNA, 64 nt, Homo Sapiens
gaccaauucaggucccuuauaaugugcaaagaccucuuaugaggaauucaaacugcauuugcaa

SEQ ID NO: 380100 - RNA, 64 nt, Homo Sapiens
aaauaacuuucaggauguauuuaaaggaauuacaucuuaugaucuuuaagucaaaaacuaugcu

SEQ ID NO: 380101 - RNA, 64 nt, Homo Sapiens
aucauaguacccuauuuucauuaaauacaauaauucuuaugaaaucagucaaauuggcuucuua

SEQ ID NO: 380102 - RNA, 64 nt, Homo Sapiens
ggcuggaagcgcugucgauaagcuucacgcacuggcuugccaguucuucagcucuaggacuugu

SEQ ID NO: 380103 - RNA, 64 nt, Homo Sapiens
cuggcccuccucuucacugccuccaccugcucccgcuugccaucccugucuccuccauccuggc

SEQ ID NO: 380104 - RNA, 64 nt, Homo Sapiens
gccuggcccacucagaauccacggugaccucuccgcuugccaaaauaaccgaaggaaagaccgu

SEQ ID NO: 380105 - RNA, 64 nt, Homo Sapiens
gacacuccaccacaaacuuuucacuuuagagguagcuugccaucucucaggagcccucaccauu

SEQ ID NO: 380106 - RNA, 64 nt, Homo Sapiens
uuugaacacuuggugcugggaaccucaggguauugcuugccacuaagccaugaaaccagagaca

SEQ ID NO: 380107 - RNA, 64 nt, Homo Sapiens
auguguuggcccuggggcggcccaccccugccaagcuugccaacuucccugagguggaugucuu

SEQ ID NO: 380108 - RNA, 64 nt, Homo Sapiens
cacugugccugugcuucucuguccuucucccuuugcuugccaugaauccgcauaccuuggaaua

SEQ ID NO: 380109 - RNA, 64 nt, Homo Sapiens
cuaugcuaaauaaauuguauuguauauggaauaugcuugccauuaugaagaacagcuggguaua

SEQ ID NO: 380110 - RNA, 64 nt, Homo Sapiens
ucuucaacuccuggugugugugagcaugcccuuugcuugccacaccauauccuuuccccagauc

SEQ ID NO: 380111 - RNA, 64 nt, Homo Sapiens
cugauuaacaaaauuacaugucuuuuuguaaauggcuugccaucuuuuaauuuucuauuuagaa

SEQ ID NO: 380112 - RNA, 64 nt, Homo Sapiens
caaacagcuaauaggaaauucuauuaauauguuagcuugccauuuuaaauauguucugaggguu

SEQ ID NO: 380113 - RNA, 64 nt, Homo Sapiens
gagaggggcuuuuccuagagaaagagaacaaggagcuugccaggcuucauguagccgacacacg

SEQ ID NO: 380114 - RNA, 64 nt, Homo Sapiens
ggaagcacugggaaguaauggggccacggauggagcuugccaugcuccuccacuugccacggau

SEQ ID NO: 380115 - RNA, 64 nt, Homo Sapiens
aagugggcucucaauaaauagcaccuagcacagugcuugccacaggacccacugcugauucccu

SEQ ID NO: 380116 - RNA, 58 nt, Homo Sapiens
gccugccuuauaggcauguagcacagcugcuugccauuuuggcagugagccucuguga

SEQ ID NO: 380117 - RNA, 64 nt, Homo Sapiens
ugccccaucucauucuauaccauggcuuucaaaggcuugccauguucgcaaccacacagaauuu

SEQ ID NO: 380118 - RNA, 64 nt, Homo Sapiens
ugcugcagagucacaagccuuguugauccauccagcuugccagacccaucuucacccaggccua

SEQ ID NO: 380119 - RNA, 64 nt, Homo Sapiens
acucugcucccugcuugccuagggcagccucccugcuugccaccgcagcuacacaacacuacag

SEQ ID NO: 380120 - RNA, 64 nt, Homo Sapiens
cagcaguccuagcuuggugaacauuaaggugguggcuugccacuuccucauccccccucuucuc

SEQ ID NO: 380121 - RNA, 64 nt, Homo Sapiens
guccccuggggccccuucugaggaauugguggcugcuugccagggggaucugaagggagggcua

SEQ ID NO: 380122 - RNA, 64 nt, Homo Sapiens
uuggguuuugagauuagggucuaccuuccccagagcuugccaggucucaaauugucucuaagca

SEQ ID NO: 380123 - RNA, 64 nt, Homo Sapiens
cacuccuuugcugucagaggccaugcuccuuggggcuugccaccaaaacccccagcucugugcc

SEQ ID NO: 380124 - RNA, 64 nt, Homo Sapiens
gcugccugggcuagagcagcgagaagugcccugggcuugccaccagcucugcccuggcugggga

SEQ ID NO: 380125 - RNA, 64 nt, Homo Sapiens
gaucccucuugcuucuuuucccuccugcaccgcagcuugccaucccugcccuucuguccuggag

SEQ ID NO: 380126 - RNA, 64 nt, Homo Sapiens
auauuccugcuguuggaagcaguugaccagaaaugcuugccaguacugccaaagcacugcugug

SEQ ID NO: 380127 - RNA, 64 nt, Homo Sapiens
cugucuuuugauuuggucauucucuuuauuuucugcuugccaugucuuuucuggaacauacuug

SEQ ID NO: 380128 - RNA, 64 nt, Homo Sapiens
uccaaguccccagcccggccaguggugccaggcagcuugccacuugggagggcagaagccagga

SEQ ID NO: 380129 - RNA, 64 nt, Homo Sapiens
agccagaacaauggcuggguggaucgcacguaaagcuugccacuaaaaaucaaagcagagguua

SEQ ID NO: 380130 - RNA, 64 nt, Homo Sapiens
agaguguguguauguauaguguaugccuuuccaagcuugccagucuuuuuggcuuugaacacug

SEQ ID NO: 380131 - RNA, 64 nt, Homo Sapiens
cuaggcgaguucagcuuggggugugagugagacagcuugccagcugcaucccugcagacagagg

SEQ ID NO: 380132 - RNA, 64 nt, Homo Sapiens
auagugugaguauauccauugcuggcaguggagggcuugccaugaaaaugcaacuuauuuaaga

SEQ ID NO: 380133 - RNA, 64 nt, Homo Sapiens
cuguuuuuuaaaggaucaggccguuuuucucgucgcuugccaaucaucucaagcaugugaggca

SEQ ID NO: 380134 - RNA, 64 nt, Homo Sapiens
guacagaauuugaauuaucaguuguaccucuuuugcuugccaaauuguaaaacuccaaggugau

SEQ ID NO: 380135 - RNA, 64 nt, Homo Sapiens
guucauucucuccuucuguccuucuagauuucuagcuugccaccccucuccuuguauugcuuuc

SEQ ID NO: 380136 - RNA, 64 nt, Homo Sapiens
acugacccuccuccucgauggaggggcugcuccugcuugccaauccugagggcaggccagagcu

SEQ ID NO: 380137 - RNA, 64 nt, Homo Sapiens
auauuucuuuuuggcuccuuuguguaagcauuuagcuugccagcuuaaaagucuaacuuuuuug

SEQ ID NO: 380138 - RNA, 64 nt, Homo Sapiens
accagaugagaaguuaagcaaucaggauuuuagugcuugccaccuuuacuacuauucuguuaaa

SEQ ID NO: 380139 - RNA, 64 nt, Homo Sapiens
gccccaggagaggaauuuggggugccaacacugggcuugccacagucugugccuggccaaggga

SEQ ID NO: 380140 - RNA, 64 nt, Homo Sapiens
ugccgggggcagucagcauuggccacccugggaggcuugccagagaggguugcuuaggaugccc

SEQ ID NO: 380141 - RNA, 64 nt, Homo Sapiens
aacgaggcggcugggaugccgcccucaguaagcagcuugccaaucacuccaggucugaaaagca

SEQ ID NO: 380142 - RNA, 64 nt, Homo Sapiens
aaaagaaaauagcagagauggguccagugcaguggcuugccacucaaaagaaggcagcagacaa

SEQ ID NO: 380143 - RNA, 64 nt, Homo Sapiens
aaccgugauucaucuggaaguuauuacagggccagcuugccauauuccaggcacacguuaucaa

SEQ ID NO: 380144 - RNA, 64 nt, Homo Sapiens
caaacaauuucuuauacugcugcccaccaaagcagcuugccaacagucaaaucacugauugggg

SEQ ID NO: 380145 - RNA, 64 nt, Homo Sapiens
auuuaauuaaaagaacgaaaacacuugccuuuaagcuugccagguuguucugcucucucaugag

SEQ ID NO: 380146 - RNA, 64 nt, Homo Sapiens
aaucuuggauagauucuuuaaggcauuccacuuagcuugccaguugagacaaucaccacaguua

SEQ ID NO: 380147 - RNA, 64 nt, Homo Sapiens
cuuuuacauuacauuuacaauagugcuuguacaagcuugccaaagauagaauauggaucgccag

SEQ ID NO: 380148 - RNA, 59 nt, Homo Sapiens
aaugcuuuacaucagaaugaugaaaauaggcuugccacuuucucuuauuuuaauuccau

SEQ ID NO: 380149 - RNA, 64 nt, Homo Sapiens
uuuauucaaacuuuuauuagccagugaaacacuugcuugccaacugccaagccauacuuauuaa

SEQ ID NO: 380150 - RNA, 64 nt, Homo Sapiens
cccaccauccccuucccccauuaacuuccccccugcuugccauccugcaguaguauaaaucaug

SEQ ID NO: 380151 - RNA, 64 nt, Homo Sapiens
uuaaggccugucuguaaugguccuuagagaauaagcuugccaauuuugcccuugauagcacgua

SEQ ID NO: 380152 - RNA, 64 nt, Homo Sapiens
accuccaguuuggcuucugagggaugggggcuaggcuugccaucgcagaggauggucuugggca

SEQ ID NO: 380153 - RNA, 64 nt, Homo Sapiens
ccgggcacgguggcucacgcuucuucaagaagaagcuugccagguugcugagaacuguucaucc

SEQ ID NO: 380154 - RNA, 64 nt, Homo Sapiens
aaaucgccuuaugagaacauuuuaaaccacuaaugcuugccaagguuggaaaagaaaucaauuu

SEQ ID NO: 380155 - RNA, 64 nt, Homo Sapiens
uuugguuaguccuuggaucaaaggucugacaacagcuugccaaagcucugaaaggcauguccau

SEQ ID NO: 380156 - RNA, 64 nt, Homo Sapiens
ggcaucuggccaccaaggaaccaggauaauuucugcuugccaugucgaccucuuagugaugcug

SEQ ID NO: 380157 - RNA, 64 nt, Homo Sapiens
aaaaaaaaaaaaaaaaaaucgcuucucagauauggcuugccaaagcaggggaagggcagagaug

SEQ ID NO: 380158 - RNA, 64 nt, Homo Sapiens
gccaacaggaagugagcccaggacaugcaccaaggcuugccagacacuauugguggcaccugga

SEQ ID NO: 380159 - RNA, 64 nt, Homo Sapiens
gcucuuguuugaaagaacuuagggaggaccauuggcuugccaagaguacagaaauucauuaugc

SEQ ID NO: 380160 - RNA, 64 nt, Homo Sapiens
gccacgccccucgcuggcgccccagagccguggugcuugccaagggcugugcggagcuggugcu

SEQ ID NO: 380161 - RNA, 64 nt, Homo Sapiens
caccgaagcgcaucugccguccgggcccugccaggcuugccaggcugccagugguaacugugga

SEQ ID NO: 380162 - RNA, 54 nt, Homo Sapiens
acccugagcuagacuccuaaucuagcuugccauuauuguguguguaauuauggc

SEQ ID NO: 380163 - RNA, 64 nt, Homo Sapiens
gaagcgggaagugugcuucucagggaggaaaccggcuugccagcaaguagauucuuacgaacuc

SEQ ID NO: 380164 - RNA, 64 nt, Homo Sapiens
uauagcuacauauuuaccuugaauguuacaauuagcuugccaauaaauauuaguagcucuuaag

SEQ ID NO: 380165 - RNA, 64 nt, Homo Sapiens
uuuaagauaggagagacuuagcagaaaauacuuggcuugccagggccacguucuacuucauugc

SEQ ID NO: 380166 - RNA, 64 nt, Homo Sapiens
acauugaagggagauuggcaccuaguggcugggagcuugccaggaacccaguggccagggagcg

SEQ ID NO: 380167 - RNA, 64 nt, Homo Sapiens
guaguuaauccuugcauauucuccuuucauccuggcuugccaacgcagucuuaauuccgccuuu

SEQ ID NO: 380168 - RNA, 64 nt, Homo Sapiens
ucuuggagcuccucuccuaggcuggagcucuccugcuugccaccugccugucaagaccauaguu

SEQ ID NO: 380169 - RNA, 64 nt, Homo Sapiens
gcugggccaggacacguggggugccugggacgcugcuugccaugcacagugaucagagagaggc

SEQ ID NO: 380170 - RNA, 64 nt, Homo Sapiens
gcauaaucugccuuuugguguaguccaauuuccugcuugccaaacucagaaaaaucucaaagaa

SEQ ID NO: 380171 - RNA, 64 nt, Homo Sapiens
auuugacuuuuauuaugauauuucccauggccuugcuugccagacaaugaauaagcaugccugu

SEQ ID NO: 380172 - RNA, 64 nt, Homo Sapiens
ccagaucuaggcaucuaggagucaguggcaugaugcuugccaaguacaaaaagagcuaaagcau

SEQ ID NO: 380173 - RNA, 64 nt, Homo Sapiens
guuuacucucuuauuuaccauuccuguggugggggcuugccauugaugccauguuaccaaugau

SEQ ID NO: 380174 - RNA, 64 nt, Homo Sapiens
uucaucaaucccguagcuacccauauugcacugagcuugccaguggugacugccaggaacgucc

SEQ ID NO: 380175 - RNA, 64 nt, Homo Sapiens
gccugccucugccaugcccagagaaucagggcaggcuugccaccggggaacccagcccuggggu

SEQ ID NO: 380176 - RNA, 64 nt, Homo Sapiens
ugugacaaaagccacacgcauuaucaguaacuuugcuugccacggaaaagguguuuuugaaaga

SEQ ID NO: 380177 - RNA, 64 nt, Homo Sapiens
ucucugaaguucugcuacaaccucuagaucugcagcuugccacaucagcuuaaaaucugucauc

SEQ ID NO: 380178 - RNA, 64 nt, Homo Sapiens
auagauauauauaugcccacacacacugggccaugcuugccaaggaacagcccacguggacaug

SEQ ID NO: 380179 - RNA, 64 nt, Homo Sapiens
cuguuaugaagcugcuauguacuaauaauacuuugcuugccaaaguguuuggguuuuguuguug

SEQ ID NO: 380180 - RNA, 64 nt, Homo Sapiens
auuuugcacuagaacgcuucgggaaaauauucaugcuugccaucuguucauuucuaaauuuaua

SEQ ID NO: 380181 - RNA, 64 nt, Homo Sapiens
cagugugguaugguccuugggagcucugcucugagcuugccacacugcugagagcacccacugu

SEQ ID NO: 380182 - RNA, 64 nt, Homo Sapiens
ucagcccuucccucguuuccaggccucuccccaggcuugccaucagccuucuuuacuuuuugag

SEQ ID NO: 380183 - RNA, 64 nt, Homo Sapiens
gaugggcagcccaacagcacagggcacaugaacagcuugccagguguggacaggaugaggacag

SEQ ID NO: 380184 - RNA, 64 nt, Homo Sapiens
uuccgaggacccaguguucuccauuauuucaaccgcuugccauaccaugccauagaaacugagg

SEQ ID NO: 380185 - RNA, 64 nt, Homo Sapiens
gcagauuuuccuaaggccacgagccucugcagucgcuugccaaauuuucacuuccucuccacag

SEQ ID NO: 380186 - RNA, 64 nt, Homo Sapiens
aggauugagucugagacuuaagcacucggucccagcuugccaguuccugguucuguguccuugg

SEQ ID NO: 380187 - RNA, 64 nt, Homo Sapiens
auaucggccgcccaagugacccuguccagugucugcuugccauccugccagaacaggcccucaa

SEQ ID NO: 380188 - RNA, 64 nt, Homo Sapiens
ucaggacuccagguucuucggccuuuggacucaggcuugccacagaggccucccagggcucucg

SEQ ID NO: 380189 - RNA, 64 nt, Homo Sapiens
ucuagggauugggggauugggcuuucagccagaugcuugccaucgguuuccauaggaaaggcau

SEQ ID NO: 380190 - RNA, 64 nt, Homo Sapiens
ggcggacucaaacgccgcugcgacacccagcccagcuugccaauccgaggagcccugccugccc

SEQ ID NO: 380191 - RNA, 64 nt, Homo Sapiens
gcaaauugccuauuggaaucuucuguaguccagugcuugccaauuuucagaaaacagugaugaa

SEQ ID NO: 380192 - RNA, 64 nt, Homo Sapiens
cuugucaaauagcaaggccaccuccaggacuggggcuugccaggacaaauggaacuccccaggg

SEQ ID NO: 380193 - RNA, 64 nt, Homo Sapiens
cuggacucugaacaagaauucgguggccugcagagcuugccauuugcacuuuucaaaugccuuu

SEQ ID NO: 380194 - RNA, 64 nt, Homo Sapiens
acaguccagcaauuccacaaccaccuugacgaaugcuugccaagcuguuuuaaagccaagaaca

SEQ ID NO: 380195 - RNA, 64 nt, Homo Sapiens
gggucuggugaacaagaaauguaauaaacacguggcuugccauucaagagaugagucugaccau

SEQ ID NO: 380196 - RNA, 58 nt, Homo Sapiens
aguuugagcgcgucuucugagggccggcgcuugccacuagggcucuuguguuuuuuuu

SEQ ID NO: 380197 - RNA, 64 nt, Homo Sapiens
ggugcacagcacagccugcggguaaagugugagagcuugccauccagcucacgaagacagaguu

SEQ ID NO: 380198 - RNA, 64 nt, Homo Sapiens
uuuuguuuucguacucucacaggaccuugauguugcuugccaccuuggccacuccugcacaccc

SEQ ID NO: 380199 - RNA, 64 nt, Homo Sapiens
cgagaugggagccuagcuaagcugcacccacagcgcuugccagcacuacuauggaauucccuuu

SEQ ID NO: 380200 - RNA, 64 nt, Homo Sapiens
uaaacagcccagaaggagcaaggagagggaagcagcuugccagucauucgggaaacggaugcuu

SEQ ID NO: 380201 - RNA, 64 nt, Homo Sapiens
aaggccaaagcaaacgguuugccuagcagaugaagcuugccagcugggggacagcugaggaugg

SEQ ID NO: 380202 - RNA, 64 nt, Homo Sapiens
uucugcagccgugccuuugcgcagggcccggcaggcuugccacgggggaggcgcaguuacaaag

SEQ ID NO: 380203 - RNA, 64 nt, Homo Sapiens
cagaggcgcugaggugugcuaccuucuucuccuggcuugccagccaccucgcccacggccucgc

SEQ ID NO: 380204 - RNA, 64 nt, Homo Sapiens
cugauuaucacacaucaugagcugagugacugcagcuugccaaaucuuuguguuucugggucug

SEQ ID NO: 380205 - RNA, 64 nt, Homo Sapiens
aggaacccagagccacccagcagacaccacuguggcuugccagcugccaagauggagaagcaug

SEQ ID NO: 380206 - RNA, 64 nt, Homo Sapiens
uugaucagugucaugugagcauaagccaaugguagcuugccacaugccccaucucccauugcug

SEQ ID NO: 380207 - RNA, 64 nt, Homo Sapiens
uggagagcagcaccuuuaagagcccucucucucugcuugccacccugcucagagcuuuccaccc

SEQ ID NO: 380208 - RNA, 64 nt, Homo Sapiens
gauccugagagggagagacugcaauuucuccaaagcuugccacuuuccagccuguuuccccaau

SEQ ID NO: 380209 - RNA, 64 nt, Homo Sapiens
guuccccaugacgagagccucuccagccacccuugcuugccacugucugccuuugcauccuguc

SEQ ID NO: 380210 - RNA, 63 nt, Homo Sapiens
agcggcuuugcugccuaugaaggcgccuucacugcuugccagagccccuuccucucuuguuuc

SEQ ID NO: 380211 - RNA, 64 nt, Homo Sapiens
gagcacucacacauaaauggcuguguguggaauugcuugccaaagaaguuucuagccuuucccu

SEQ ID NO: 380212 - RNA, 64 nt, Homo Sapiens
gcggacuuucuuucccugccuucuuauuuagucagcuugccaucccuccucuucacuagcagug

SEQ ID NO: 380213 - RNA, 64 nt, Homo Sapiens
cucucccacccuuaccuccaucucacacacuugagcuugccacucuguauaauucuaacauccu

SEQ ID NO: 380214 - RNA, 64 nt, Homo Sapiens
aacuugcugcuaaauucccagagauuuuguaacugcuugccauuuuuuaaauguagaaaaauag

SEQ ID NO: 380215 - RNA, 64 nt, Homo Sapiens
ccucccuccaccucccugcagccuccccuccucugcuugccauccugcccucuccugggcagcu

SEQ ID NO: 380216 - RNA, 64 nt, Homo Sapiens
cucuugcauugugacaagaaugcuacagaaagcugcuugccauucugagagcuguuaacuuuca

SEQ ID NO: 380217 - RNA, 64 nt, Homo Sapiens
cuuaagccaaaucugccuuaucccugaggggccagcuugccaggugccauacccuggugcugaa

SEQ ID NO: 380218 - RNA, 64 nt, Homo Sapiens
cccaaauuacagucagcauuuaaagcuguuuauggcuugccaucagcauuauucugguaggcuu

SEQ ID NO: 380219 - RNA, 64 nt, Homo Sapiens
aaaauuucccccaccugcagcgcugggccccaaggcuugccaagacucauugcuggagguagag

SEQ ID NO: 380220 - RNA, 64 nt, Homo Sapiens
uagauccuuugugagcaaguucuauuuguucauugcuugccagagaugaacacagaauguucug

SEQ ID NO: 380221 - RNA, 64 nt, Homo Sapiens
aaguauccauaccuauugccuuucuuguagcccagcuugccagagguccaaauauugggagggg

SEQ ID NO: 380222 - RNA, 64 nt, Homo Sapiens
cucaguugcacacguguacguaucagugggaagugcuugccauuacuccaaagccuagaaccuu

SEQ ID NO: 380223 - RNA, 64 nt, Homo Sapiens
guccuuuuugccccucccugagacaaguggaucugcuugccagaguucuucacugcagggaccc

SEQ ID NO: 380224 - RNA, 64 nt, Homo Sapiens
cagaccuaugagaugguauggacgacaaggugcagcuugccauggcaagugcaaggaauuuggu

SEQ ID NO: 380225 - RNA, 64 nt, Homo Sapiens
acuccugagcagguaggcucauuaguuucugaaggcuugccaggacugaauuuuggguggaaua

SEQ ID NO: 380226 - RNA, 64 nt, Homo Sapiens
ccuacccuucccugucugucggauuaaaauggcagcuugccaugagggaggccucuugccugag

SEQ ID NO: 380227 - RNA, 64 nt, Homo Sapiens
gugaggggcuggggcauggcgauucccuugcccagcuugccaaguuuauaaauuguaauauaau

SEQ ID NO: 380228 - RNA, 64 nt, Homo Sapiens
cacucucuuuaccccaugcacucucuagaccacugcuugccaaugcccugacagucucucuugg

SEQ ID NO: 380229 - RNA, 64 nt, Homo Sapiens
auuugucugagaaggaaucuauuuaugcuccagugcuugccauacgaaggaauaccacgaagga

SEQ ID NO: 380230 - RNA, 64 nt, Homo Sapiens
ugcugcgggugcagggcgugacucaccgcugggugcuugccaaagagauagggacgcauaugcu

SEQ ID NO: 380231 - RNA, 64 nt, Homo Sapiens
gauuuccuucuagcuaugagaauagucaaauugagcuugccaggcugucucauuccuaacaugu

SEQ ID NO: 380232 - RNA, 64 nt, Homo Sapiens
caaauggccuaaaugguguucccuuugaaauaacgcuugccacaaguauauaauaagcuauauu

SEQ ID NO: 380233 - RNA, 64 nt, Homo Sapiens
acaacauuuauuaacuguuauguuucuggaaacugcuugccaaguuauuaccaguuguuaguau

SEQ ID NO: 380234 - RNA, 64 nt, Homo Sapiens
cucuucuucaaguugaggaguccccagccagggagcuugccacaccugcuuccuggcucacaca

SEQ ID NO: 380235 - RNA, 64 nt, Homo Sapiens
uucuuaguguuuuuaaccugugauuucaauugcggcuugccauuuuuucuuaugcuauugacuu

SEQ ID NO: 380236 - RNA, 51 nt, Homo Sapiens
ccaaucccaagcaagccuagagcuugccaucaagcaguggggcucucagua

SEQ ID NO: 380237 - RNA, 64 nt, Homo Sapiens
uccuaagaauucuuguagaagccuuugggugucugcuugccacuauugaguuuuuuucuuccuu

SEQ ID NO: 380238 - RNA, 64 nt, Homo Sapiens
ugccaggcacugugcugaguauaacuuauugaaugcuugccaugcucugauuguuagccaucac

SEQ ID NO: 380239 - RNA, 64 nt, Homo Sapiens
uucagggucuuccauuuuugugguuuauggccaugcuugccaguuuuggugggguugaggaacc

SEQ ID NO: 380240 - RNA, 64 nt, Homo Sapiens
gggucucaccggcucucaccuggcccugcuuccugcuugccaaggcagaggccugggcugggaa

SEQ ID NO: 380241 - RNA, 64 nt, Homo Sapiens
uggcugaacucaugagaaguugauauagaacagugcuugccacagagcggggacucgguaagca

SEQ ID NO: 380242 - RNA, 64 nt, Homo Sapiens
gaagauuuaaagacagagcacucuucuucaaagagcuugccaauuuauuauuauuuuuggggga

SEQ ID NO: 380243 - RNA, 64 nt, Homo Sapiens
acaaugaagauaauaccuacgcaaaaguuugcuugcuugccaacauaauuuguuuagcucuaag

SEQ ID NO: 380244 - RNA, 64 nt, Homo Sapiens
gcuucucuaguaacuagacaggugauacgcauuugcuugccacauuaagggaaaauggugucau

SEQ ID NO: 380245 - RNA, 64 nt, Homo Sapiens
guaccacggaaauugugaccgcuucagaggcaaggcuugccacuugggucuggguggaaucaga

SEQ ID NO: 380246 - RNA, 64 nt, Homo Sapiens
aaggggaucuggaugaccugcugauggagauccagcuugccagggacuuagguuuauccuguuu

SEQ ID NO: 380247 - RNA, 64 nt, Homo Sapiens
ugccucugucgugugugcugauuugaguggcuuagcuugccacagcgcagccucuucugucccu

SEQ ID NO: 380248 - RNA, 64 nt, Homo Sapiens
cgcuacgccuucugagcccuccuuucccgguggggcuugccagagacuguguguuuuguuuccc

SEQ ID NO: 380249 - RNA, 64 nt, Homo Sapiens
aaagccuucgauaaacgcuuuccccacauuuccugcuugccaguucagagcuaacauccacacu

SEQ ID NO: 380250 - RNA, 64 nt, Homo Sapiens
ccccccaccccuaggacuuacaggauccaggccggcuugccacaggaggaaggaggacccagga

SEQ ID NO: 380251 - RNA, 64 nt, Homo Sapiens
cuugcaguuggaguuuuaagacuuccucugugcugcuugccagcgugacacaggaaggaucugc

SEQ ID NO: 380252 - RNA, 64 nt, Homo Sapiens
agguuggaagggaaauggcuguggaacucaucaggcuugccaagggugugcccgucagcgggga

SEQ ID NO: 380253 - RNA, 64 nt, Homo Sapiens
auaauuuugccugcccgguugcucaccaguuguagcuugccagcucccaacacccuuccuggug

SEQ ID NO: 380254 - RNA, 64 nt, Homo Sapiens
cccucuuaccgcuagcgaggugauaggacaucuggcuugccacaaaggucuguucgaccagaca

SEQ ID NO: 380255 - RNA, 64 nt, Homo Sapiens
accuucgcuguaccuuugccacaugguacuguaugcuugccagcuagaaggagggucagggauu

SEQ ID NO: 380256 - RNA, 64 nt, Homo Sapiens
agguuguguugugucuucuaagcgugguacuagugcuugccaccuggucaccagaccuccaaau

SEQ ID NO: 380257 - RNA, 64 nt, Homo Sapiens
aacucuaaaguggaagaaccuuguuagaccgagagcuugccauccagccaagcugcucgaggcc

SEQ ID NO: 380258 - RNA, 64 nt, Homo Sapiens
agaagugauguccugugugcuccacagcucaccugcuugccaagguacgucuggguaguaguuu

SEQ ID NO: 380259 - RNA, 64 nt, Homo Sapiens
gagcguccuggcagagacgcaguugucucugggcgcuugccagagccacgaaccccagaccugu

SEQ ID NO: 380260 - RNA, 64 nt, Homo Sapiens
ugaugugaaguacagcaauaggcugaauguuacugcuugccauacagugaguugggagccguua

SEQ ID NO: 380261 - RNA, 64 nt, Homo Sapiens
cacagugcaccacaggccaacaggacgacaccuggcuugccaccggaaucugaguugccaacuu

SEQ ID NO: 380262 - RNA, 64 nt, Homo Sapiens
agcuaggaugcuucaggcccugagucuccugccugcuugccaaaguuccuauuuugauuuuugu

SEQ ID NO: 380263 - RNA, 64 nt, Homo Sapiens
uucugcccagcaaaagcacgagggagcacugccagcuugccagugcgcccgugaaacuggugcc

SEQ ID NO: 380264 - RNA, 64 nt, Homo Sapiens
aaucgcagagaagcugaagacagugugaaacggugcuugccaacuccuggaugagaugcgcugu

SEQ ID NO: 380265 - RNA, 64 nt, Homo Sapiens
gggggcguccuugcuccccagagcacauaaagaagcuugccaaggccacuuuccccacccuggg

SEQ ID NO: 380266 - RNA, 64 nt, Homo Sapiens
ggggccccccgugugugcccuucaucugcgucaggcuugccaggccggcagucggcccugucua

SEQ ID NO: 380267 - RNA, 64 nt, Homo Sapiens
uaucuacacucugagggcccuggacugggccugagcuugccacagaggcuccgucugacugugg

SEQ ID NO: 380268 - RNA, 64 nt, Homo Sapiens
cauccugcgcccaggcuggaggcccugccucgcugcuugccagccucaccugcuggggcuggag

SEQ ID NO: 380269 - RNA, 64 nt, Homo Sapiens
uuacugauuuugucaaagaaugauucuuugacaagcuugccaauaguaaaauguuagacugaaa

SEQ ID NO: 380270 - RNA, 64 nt, Homo Sapiens
gugaugauaaagcccaggucgaugaggcaguuuagcuugccaggacuuuugcagggacaguguu

SEQ ID NO: 380271 - RNA, 64 nt, Homo Sapiens
aacauauugagaguaauacacuggagccaaccaagcuugccaccuggguauuacaaguuuuugu

SEQ ID NO: 380272 - RNA, 64 nt, Homo Sapiens
ccgcaaaccacggccagcugcuugucuuuguauggcuugccagcuaacaauagugguuccaucu

SEQ ID NO: 380273 - RNA, 64 nt, Homo Sapiens
guugagcucccagguaccaaaaagcuuggccaacgcuugccagccagccagcugcagguggcau

SEQ ID NO: 380274 - RNA, 64 nt, Homo Sapiens
cucuccauauugugggguugaagucuggaugggagcuugccaagucccuuuuuaggcuuuuuaa

SEQ ID NO: 380275 - RNA, 64 nt, Homo Sapiens
gggccgcccuuacggggcagggcucaguccugacgcuugccaccugcuccuacccggccaggau

SEQ ID NO: 380276 - RNA, 64 nt, Homo Sapiens
ugugccagagaacccaauaugaguguuguuggcagcuugccaagaaggacugucuuuuucaaga

SEQ ID NO: 380277 - RNA, 64 nt, Homo Sapiens
augcgcaccaagguuuccccgguccgcauccccugcuugccacuucucggcuuggguuuggggu

SEQ ID NO: 380278 - RNA, 64 nt, Homo Sapiens
gacacucacaguuuccuucacugcgggaaacggggcuugccagaggagcugccuggaacagagc

SEQ ID NO: 380279 - RNA, 64 nt, Homo Sapiens
agcagagaucaugcuacugcaccgaggagguggagcuugccauggaggcaggagaauggcauga

SEQ ID NO: 380280 - RNA, 50 nt, Homo Sapiens
ucuggcucacggugaaauaagcuugccaggaggcuggcaguacagagugc

SEQ ID NO: 380281 - RNA, 64 nt, Homo Sapiens
caucucgacaagcauggucuaggucugguggccagcuugccaguaccugagccggucgggucau

SEQ ID NO: 380282 - RNA, 63 nt, Homo Sapiens
guccucugcggggagcgugaggaggaggcacgggcuugccacgccacccacaaccgugccugc

SEQ ID NO: 380283 - RNA, 64 nt, Homo Sapiens
uucucuaguguaauaacuccagcuguuuugcagugcuugccaauucugaaagggaaaaaccaaa

SEQ ID NO: 380284 - RNA, 64 nt, Homo Sapiens
cugucauuccugucgaugacgugcagucacugcagcuugccaggggagcucacaggguagcugu

SEQ ID NO: 380285 - RNA, 64 nt, Homo Sapiens
gccuugggguuugguagugagcccuaguuggauggcuugccagguuggguuccugaaaaagaac

SEQ ID NO: 380286 - RNA, 64 nt, Homo Sapiens
ggcccucggucagcgacuggaugucugcaccuccgcuugccagacccgcacccccgccaggcgc

SEQ ID NO: 380287 - RNA, 64 nt, Homo Sapiens
uacccacaugacaacugucuauaaugaguuuacugcuugccagcuucuagcuugagagaaggga

SEQ ID NO: 380288 - RNA, 64 nt, Homo Sapiens
gaggcaggaagcaccuccgguuggaggcacccaggcuugccagccacagagcgccccaaaguca

SEQ ID NO: 380289 - RNA, 64 nt, Homo Sapiens
ugugaggccauuccagugucuucuagaaagacucgcuugccaggagugcguucuuuguugaaaa

SEQ ID NO: 380290 - RNA, 64 nt, Homo Sapiens
ggagaggccaugaaagaaccaggugguugguuaagcuugccaaauuggaagugagagugcuugu

SEQ ID NO: 380291 - RNA, 64 nt, Homo Sapiens
gcucuugaggaugucaccaagcggccgagacauggcuugccacacaccaugucugccccaucac

SEQ ID NO: 380292 - RNA, 64 nt, Homo Sapiens
guuucucagagcccaggugccuccucuaggaccagcuugccacgcuugugcuccagggguccuc

SEQ ID NO: 380293 - RNA, 64 nt, Homo Sapiens
gaguuccucuacccagcaaaauaucgaugguccugcuugccagauccugaggccagcugcucua

SEQ ID NO: 380294 - RNA, 64 nt, Homo Sapiens
cccuccucucccuucacccacuaguguacuggcagcuugccaccagcaucaccaggagugccug

SEQ ID NO: 380295 - RNA, 64 nt, Homo Sapiens
uguaggagucugggcacaagauguguguacaugugcuugccauggcauguaugcaugcacaaac

SEQ ID NO: 380296 - RNA, 64 nt, Homo Sapiens
agccgccagaccucagagaucucaccagcggggugcuugccauucugaugauaauaaaaugaau

SEQ ID NO: 380297 - RNA, 64 nt, Homo Sapiens
acaauguucacauugaugauucccaagucaauaagcuugccaacauaauggacuugaacaaaga

SEQ ID NO: 380298 - RNA, 64 nt, Homo Sapiens
agaugaccugaacucagaucucccucuaucacaugcuugccaccacuguaccuugagcaagaau

SEQ ID NO: 380299 - RNA, 64 nt, Homo Sapiens
guguauaagcuggcauuucgccagcuuguacguagcuugccacucagugaaaauaauaacauua

SEQ ID NO: 380300 - RNA, 64 nt, Homo Sapiens
caguggaaaagaucaaaggaccuuuugcagccuagcuugccaaucuuccaguaacaacgaggug

SEQ ID NO: 380301 - RNA, 64 nt, Homo Sapiens
cagguggagggcuggguuuggccugcaggcuguagcuugccaaucagugacuuaaauuguugau

SEQ ID NO: 380302 - RNA, 64 nt, Homo Sapiens
aguucaugcaauaauacaagaaaaaaaauccuuugcuugccaagagguagagugaugugcauuu

SEQ ID NO: 380303 - RNA, 64 nt, Homo Sapiens
cacugccagccgccaccggggcacacgggccucugcuugccagccaggagugcggacaccaugu

SEQ ID NO: 380304 - RNA, 64 nt, Homo Sapiens
cugaagauaauaaaaugaaucucaccagcggggugcuugccauuagccgccagaccucagagau

SEQ ID NO: 380305 - RNA, 64 nt, Homo Sapiens; identical to SEQ ID NO: 380304

SEQ ID NO: 380306 - RNA, 64 nt, Homo Sapiens
uaaugacgaaaacuuaauggauuauaccccaugggcuugccagguccuccguauucuucuaaaa

SEQ ID NO: 380307 - RNA, 64 nt, Homo Sapiens
uuucaaaaaguaaaaaggucuuguuaaguccuuggcuugccauuauuuguguuuuaguuggcag

SEQ ID NO: 380308 - RNA, 64 nt, Homo Sapiens
ccgacugcagcagcuccagcugcagagccaacgggcuugccaggcugccagggacugcucacuc

SEQ ID NO: 380309 - RNA, 64 nt, Homo Sapiens
gccaauugagggcauuaguacuuuagagauaauugcuugccaguuucaauccauuuuuuaggug

SEQ ID NO: 380310 - RNA, 64 nt, Homo Sapiens
aguuguuuuguuuuguggacuucucccuuucugugcuugccaauaccccugauuuuugugguuu

SEQ ID NO: 380311 - RNA, 64 nt, Homo Sapiens
aagucagaaggauuugaaccugucgaggagcaaggcuugccagcugccccccaccccaaacuuc

SEQ ID NO: 380312 - RNA, 64 nt, Homo Sapiens; identical to SEQ ID NO: 218520

SEQ ID NO: 380313 - RNA, 64 nt, Homo Sapiens; identical to SEQ ID NO: 218521

SEQ ID NO: 380314 - RNA, 64 nt, Homo Sapiens; identical to SEQ ID NO: 218522

SEQ ID NO: 380315 - RNA, 64 nt, Homo Sapiens; identical to SEQ ID NO: 218523

SEQ ID NO: 380316 - RNA, 64 nt, Homo Sapiens; identical to SEQ ID NO: 218524

SEQ ID NO: 380317 - RNA, 64 nt, Homo Sapiens; identical to SEQ ID NO: 218525

SEQ ID NO: 380318 - RNA, 64 nt, Homo Sapiens; identical to SEQ ID NO: 218526

SEQ ID NO: 380319 - RNA, 64 nt, Homo Sapiens; identical to SEQ ID NO: 218527

SEQ ID NO: 380320 - RNA, 64 nt, Homo Sapiens; identical to SEQ ID NO: 218528

SEQ ID NO: 380321 - RNA, 64 nt, Homo Sapiens; identical to SEQ ID NO: 218529

SEQ ID NO: 380322 - RNA, 64 nt, Homo Sapiens; identical to SEQ ID NO: 218530

SEQ ID NO: 380323 - RNA, 64 nt, Homo Sapiens; identical to SEQ ID NO: 218531

SEQ ID NO: 380324 - RNA, 64 nt, Homo Sapiens; identical to SEQ ID NO: 218532

SEQ ID NO: 380325 - RNA, 64 nt, Homo Sapiens; identical to SEQ ID NO: 218533

SEQ ID NO: 380326 - RNA, 64 nt, Homo Sapiens; identical to SEQ ID NO: 218534

SEQ ID NO: 380327 - RNA, 64 nt, Homo Sapiens; identical to SEQ ID NO: 218535

SEQ ID NO: 380328 - RNA, 64 nt, Homo Sapiens; identical to SEQ ID NO: 218536

SEQ ID NO: 380329 - RNA, 64 nt, Homo Sapiens; identical to SEQ ID NO: 218537

SEQ ID NO: 380330 - RNA, 64 nt, Homo Sapiens; identical to SEQ ID NO: 218538

SEQ ID NO: 380331 - RNA, 61 nt, Homo Sapiens; identical to SEQ ID NO: 218539

SEQ ID NO: 380332 - RNA, 64 nt, Homo Sapiens; identical to SEQ ID NO: 218540

SEQ ID NO: 380333 - RNA, 64 nt, Homo Sapiens; identical to SEQ ID NO: 218541

SEQ ID NO: 380334 - RNA, 64 nt, Homo Sapiens; identical to SEQ ID NO: 218542

SEQ ID NO: 380335 - RNA, 64 nt, Homo Sapiens; identical to SEQ ID NO: 218543

SEQ ID NO: 380336 - RNA, 64 nt, Homo Sapiens; identical to SEQ ID NO: 218544

SEQ ID NO: 380337 - RNA, 64 nt, Homo Sapiens; identical to SEQ ID NO: 218545

SEQ ID NO: 380338 - RNA, 64 nt, Homo Sapiens; identical to SEQ ID NO: 218546

SEQ ID NO: 380339 - RNA, 64 nt, Homo Sapiens; identical to SEQ ID NO: 218547

SEQ ID NO: 380340 - RNA, 64 nt, Homo Sapiens; identical to SEQ ID NO: 218548

SEQ ID NO: 380341 - RNA, 64 nt, Homo Sapiens; identical to SEQ ID NO: 218549

SEQ ID NO: 380342 - RNA, 64 nt, Homo Sapiens; identical to SEQ ID NO: 218550

SEQ ID NO: 380343 - RNA, 64 nt, Homo Sapiens; identical to SEQ ID NO: 218551

SEQ ID NO: 380344 - RNA, 64 nt, Homo Sapiens; identical to SEQ ID NO: 218552

SEQ ID NO: 380345 - RNA, 64 nt, Homo Sapiens; identical to SEQ ID NO: 218553

SEQ ID NO: 380346 - RNA, 63 nt, Homo Sapiens; identical to SEQ ID NO: 218554

SEQ ID NO: 380347 - RNA, 64 nt, Homo Sapiens; identical to SEQ ID NO: 218555

SEQ ID NO: 380348 - RNA, 64 nt, Homo Sapiens; identical to SEQ ID NO: 218556

SEQ ID NO: 380349 - RNA, 64 nt, Homo Sapiens; identical to SEQ ID NO: 218557

SEQ ID NO: 380350 - RNA, 64 nt, Homo Sapiens; identical to SEQ ID NO: 218558

SEQ ID NO: 380351 - RNA, 64 nt, Homo Sapiens; identical to SEQ ID NO: 218559

SEQ ID NO: 380352 - RNA, 64 nt, Homo Sapiens; identical to SEQ ID NO: 218560

SEQ ID NO: 380353 - RNA, 64 nt, Homo Sapiens; identical to SEQ ID NO: 218561

SEQ ID NO: 380354 - RNA, 64 nt, Homo Sapiens; identical to SEQ ID NO: 218562

SEQ ID NO: 380355 - RNA, 64 nt, Homo Sapiens; identical to SEQ ID NO: 218563

SEQ ID NO: 380356 - RNA, 64 nt, Homo Sapiens; identical to SEQ ID NO: 218564

SEQ ID NO: 380357 - RNA, 64 nt, Homo Sapiens; identical to SEQ ID NO: 218565

SEQ ID NO: 380358 - RNA, 64 nt, Homo Sapiens; identical to SEQ ID NO: 218566

SEQ ID NO: 380359 - RNA, 64 nt, Homo Sapiens; identical to SEQ ID NO: 218567

SEQ ID NO: 380360 - RNA, 64 nt, Homo Sapiens; identical to SEQ ID NO: 218568

SEQ ID NO: 380361 - RNA, 64 nt, Homo Sapiens; identical to SEQ ID NO: 218569

SEQ ID NO: 380362 - RNA, 64 nt, Homo Sapiens; identical to SEQ ID NO: 218570

SEQ ID NO: 380363 - RNA, 64 nt, Homo Sapiens; identical to SEQ ID NO: 218571

SEQ ID NO: 380364 - RNA, 64 nt, Homo Sapiens; identical to SEQ ID NO: 218572

SEQ ID NO: 380365 - RNA, 64 nt, Homo Sapiens; identical to SEQ ID NO: 218573

SEQ ID NO: 380366 - RNA, 64 nt, Homo Sapiens; identical to SEQ ID NO: 218574

SEQ ID NO: 380367 - RNA, 64 nt, Homo Sapiens; identical to SEQ ID NO: 218575

SEQ ID NO: 380368 - RNA, 64 nt, Homo Sapiens; identical to SEQ ID NO: 218576

SEQ ID NO: 380369 - RNA, 64 nt, Homo Sapiens; identical to SEQ ID NO: 218577

SEQ ID NO: 380370 - RNA, 64 nt, Homo Sapiens; identical to SEQ ID NO: 218578

SEQ ID NO: 380371 - RNA, 64 nt, Homo Sapiens; identical to SEQ ID NO: 218579

SEQ ID NO: 380372 - RNA, 64 nt, Homo Sapiens; identical to SEQ ID NO: 218580

SEQ ID NO: 380373 - RNA, 64 nt, Homo Sapiens; identical to SEQ ID NO: 218581

SEQ ID NO: 380374 - RNA, 64 nt, Homo Sapiens; identical to SEQ ID NO: 218582

SEQ ID NO: 380375 - RNA, 64 nt, Homo Sapiens; identical to SEQ ID NO: 218583

SEQ ID NO: 380376 - RNA, 64 nt, Homo Sapiens; identical to SEQ ID NO: 218584

SEQ ID NO: 380377 - RNA, 64 nt, Homo Sapiens; identical to SEQ ID NO: 218585

SEQ ID NO: 380378 - RNA, 64 nt, Homo Sapiens; identical to SEQ ID NO: 218586

SEQ ID NO: 380379 - RNA, 64 nt, Homo Sapiens; identical to SEQ ID NO: 218587

SEQ ID NO: 380380 - RNA, 64 nt, Homo Sapiens; identical to SEQ ID NO: 218588

SEQ ID NO: 380381 - RNA, 64 nt, Homo Sapiens; identical to SEQ ID NO: 218589

SEQ ID NO: 380382 - RNA, 64 nt, Homo Sapiens; identical to SEQ ID NO: 218590

SEQ ID NO: 380383 - RNA, 64 nt, Homo Sapiens; identical to SEQ ID NO: 218591

SEQ ID NO: 380384 - RNA, 64 nt, Homo Sapiens; identical to SEQ ID NO: 218592

SEQ ID NO: 380385 - RNA, 64 nt, Homo Sapiens; identical to SEQ ID NO: 218593

SEQ ID NO: 380386 - RNA, 64 nt, Homo Sapiens; identical to SEQ ID NO: 218594

SEQ ID NO: 380387 - RNA, 64 nt, Homo Sapiens; identical to SEQ ID NO: 218595

SEQ ID NO: 380388 - RNA, 64 nt, Homo Sapiens; identical to SEQ ID NO: 218596

SEQ ID NO: 380389 - RNA, 64 nt, Homo Sapiens; identical to SEQ ID NO: 218597

SEQ ID NO: 380390 - RNA, 64 nt, Homo Sapiens; identical to SEQ ID NO: 218598

SEQ ID NO: 380391 - RNA, 64 nt, Homo Sapiens; identical to SEQ ID NO: 218599

SEQ ID NO: 380392 - RNA, 64 nt, Homo Sapiens; identical to SEQ ID NO: 218600

SEQ ID NO: 380393 - RNA, 64 nt, Homo Sapiens; identical to SEQ ID NO: 218601

SEQ ID NO: 380394 - RNA, 64 nt, Homo Sapiens; identical to SEQ ID NO: 218602

SEQ ID NO: 380395 - RNA, 64 nt, Homo Sapiens; identical to SEQ ID NO: 218603

SEQ ID NO: 380396 - RNA, 64 nt, Homo Sapiens; identical to SEQ ID NO: 218604

SEQ ID NO: 380397 - RNA, 64 nt, Homo Sapiens; identical to SEQ ID NO: 218605

SEQ ID NO: 380398 - RNA, 64 nt, Homo Sapiens; identical to SEQ ID NO: 218606

SEQ ID NO: 380399 - RNA, 64 nt, Homo Sapiens; identical to SEQ ID NO: 218607

SEQ ID NO: 380400 - RNA, 64 nt, Homo Sapiens; identical to SEQ ID NO: 218608

SEQ ID NO: 380401 - RNA, 64 nt, Homo Sapiens; identical to SEQ ID NO: 218609

SEQ ID NO: 380402 - RNA, 64 nt, Homo Sapiens; identical to SEQ ID NO: 218610

SEQ ID NO: 380403 - RNA, 64 nt, Homo Sapiens; identical to SEQ ID NO: 218611

SEQ ID NO: 380404 - RNA, 64 nt, Homo Sapiens; identical to SEQ ID NO: 218612

SEQ ID NO: 380405 - RNA, 62 nt, Homo Sapiens; identical to SEQ ID NO: 218613

SEQ ID NO: 380406 - RNA, 64 nt, Homo Sapiens; identical to SEQ ID NO: 218614

SEQ ID NO: 380407 - RNA, 64 nt, Homo Sapiens; identical to SEQ ID NO: 218615

SEQ ID NO: 380408 - RNA, 64 nt, Homo Sapiens; identical to SEQ ID NO: 218616

SEQ ID NO: 380409 - RNA, 64 nt, Homo Sapiens; identical to SEQ ID NO: 218617

SEQ ID NO: 380410 - RNA, 64 nt, Homo Sapiens; identical to SEQ ID NO: 218618

SEQ ID NO: 380411 - RNA, 64 nt, Homo Sapiens; identical to SEQ ID NO: 218619

SEQ ID NO: 380412 - RNA, 64 nt, Homo Sapiens; identical to SEQ ID NO: 218620

SEQ ID NO: 380413 - RNA, 64 nt, Homo Sapiens; identical to SEQ ID NO: 218621

SEQ ID NO: 380414 - RNA, 64 nt, Homo Sapiens; identical to SEQ ID NO: 218622

SEQ ID NO: 380415 - RNA, 64 nt, Homo Sapiens; identical to SEQ ID NO: 218623

SEQ ID NO: 380416 - RNA, 64 nt, Homo Sapiens; identical to SEQ ID NO: 218624

SEQ ID NO: 380417 - RNA, 64 nt, Homo Sapiens; identical to SEQ ID NO: 218625

SEQ ID NO: 380418 - RNA, 64 nt, Homo Sapiens; identical to SEQ ID NO: 218626

SEQ ID NO: 380419 - RNA, 64 nt, Homo Sapiens; identical to SEQ ID NO: 218627

SEQ ID NO: 380420 - RNA, 64 nt, Homo Sapiens; identical to SEQ ID NO: 218628

SEQ ID NO: 380421 - RNA, 64 nt, Homo Sapiens; identical to SEQ ID NO: 218629

SEQ ID NO: 380422 - RNA, 64 nt, Homo Sapiens; identical to SEQ ID NO: 218630

SEQ ID NO: 380423 - RNA, 64 nt, Homo Sapiens; identical to SEQ ID NO: 218631

SEQ ID NO: 380424 - RNA, 64 nt, Homo Sapiens; identical to SEQ ID NO: 218632

SEQ ID NO: 380425 - RNA, 64 nt, Homo Sapiens; identical to SEQ ID NO: 218633

SEQ ID NO: 380426 - RNA, 64 nt, Homo Sapiens; identical to SEQ ID NO: 218634

SEQ ID NO: 380427 - RNA, 64 nt, Homo Sapiens; identical to SEQ ID NO: 218635

SEQ ID NO: 380428 - RNA, 64 nt, Homo Sapiens; identical to SEQ ID NO: 218636

SEQ ID NO: 380429 - RNA, 64 nt, Homo Sapiens; identical to SEQ ID NO: 218637

SEQ ID NO: 380430 - RNA, 64 nt, Homo Sapiens; identical to SEQ ID NO: 218638

SEQ ID NO: 380431 - RNA, 64 nt, Homo Sapiens; identical to SEQ ID NO: 218639

SEQ ID NO: 380432 - RNA, 64 nt, Homo Sapiens; identical to SEQ ID NO: 218640

SEQ ID NO: 380433 - RNA, 64 nt, Homo Sapiens; identical to SEQ ID NO: 218641

SEQ ID NO: 380434 - RNA, 64 nt, Homo Sapiens; identical to SEQ ID NO: 218642

SEQ ID NO: 380435 - RNA, 64 nt, Homo Sapiens; identical to SEQ ID NO: 218643

SEQ ID NO: 380436 - RNA, 64 nt, Homo Sapiens; identical to SEQ ID NO: 218644

SEQ ID NO: 380437 - RNA, 64 nt, Homo Sapiens; identical to SEQ ID NO: 218645

SEQ ID NO: 380438 - RNA, 64 nt, Homo Sapiens; identical to SEQ ID NO: 218646

SEQ ID NO: 380439 - RNA, 64 nt, Homo Sapiens; identical to SEQ ID NO: 218647

SEQ ID NO: 380440 - RNA, 64 nt, Homo Sapiens; identical to SEQ ID NO: 218648

SEQ ID NO: 380441 - RNA, 64 nt, Homo Sapiens; identical to SEQ ID NO: 218649

SEQ ID NO: 380442 - RNA, 64 nt, Homo Sapiens; identical to SEQ ID NO: 218650

SEQ ID NO: 380443 - RNA, 64 nt, Homo Sapiens; identical to SEQ ID NO: 218651

SEQ ID NO: 380444 - RNA, 64 nt, Homo Sapiens; identical to SEQ ID NO: 218652

SEQ ID NO: 380445 - RNA, 64 nt, Homo Sapiens; identical to SEQ ID NO: 218653

SEQ ID NO: 380446 - RNA, 64 nt, Homo Sapiens; identical to SEQ ID NO: 218654

SEQ ID NO: 380447 - RNA, 64 nt, Homo Sapiens; identical to SEQ ID NO: 218655

SEQ ID NO: 380448 - RNA, 64 nt, Homo Sapiens; identical to SEQ ID NO: 218656

SEQ ID NO: 380449 - RNA, 64 nt, Homo Sapiens; identical to SEQ ID NO: 218657

SEQ ID NO: 380450 - RNA, 64 nt, Homo Sapiens; identical to SEQ ID NO: 218658

SEQ ID NO: 380451 - RNA, 64 nt, Homo Sapiens; identical to SEQ ID NO: 218659

SEQ ID NO: 380452 - RNA, 64 nt, Homo Sapiens; identical to SEQ ID NO: 218660

SEQ ID NO: 380453 - RNA, 64 nt, Homo Sapiens; identical to SEQ ID NO: 218661

SEQ ID NO: 380454 - RNA, 61 nt, Homo Sapiens; identical to SEQ ID NO: 218662

SEQ ID NO: 380455 - RNA, 64 nt, Homo Sapiens; identical to SEQ ID NO: 218663

SEQ ID NO: 380456 - RNA, 64 nt, Homo Sapiens; identical to SEQ ID NO: 218664

SEQ ID NO: 380457 - RNA, 64 nt, Homo Sapiens; identical to SEQ ID NO: 218665

SEQ ID NO: 380458 - RNA, 64 nt, Homo Sapiens; identical to SEQ ID NO: 218666

SEQ ID NO: 380459 - RNA, 64 nt, Homo Sapiens; identical to SEQ ID NO: 218667

SEQ ID NO: 380460 - RNA, 64 nt, Homo Sapiens; identical to SEQ ID NO: 218668

SEQ ID NO: 380461 - RNA, 64 nt, Homo Sapiens; identical to SEQ ID NO: 218669

SEQ ID NO: 380462 - RNA, 64 nt, Homo Sapiens; identical to SEQ ID NO: 218670

SEQ ID NO: 380463 - RNA, 64 nt, Homo Sapiens; identical to SEQ ID NO: 218671

SEQ ID NO: 380464 - RNA, 64 nt, Homo Sapiens; identical to SEQ ID NO: 218672

SEQ ID NO: 380465 - RNA, 64 nt, Homo Sapiens; identical to SEQ ID NO: 218673

SEQ ID NO: 380466 - RNA, 64 nt, Homo Sapiens; identical to SEQ ID NO: 218674

SEQ ID NO: 380467 - RNA, 64 nt, Homo Sapiens; identical to SEQ ID NO: 218675

SEQ ID NO: 380468 - RNA, 64 nt, Homo Sapiens; identical to SEQ ID NO: 218676

SEQ ID NO: 380469 - RNA, 64 nt, Homo Sapiens; identical to SEQ ID NO: 218677

SEQ ID NO: 380470 - RNA, 64 nt, Homo Sapiens; identical to SEQ ID NO: 218678

SEQ ID NO: 380471 - RNA, 64 nt, Homo Sapiens; identical to SEQ ID NO: 218679

SEQ ID NO: 380472 - RNA, 64 nt, Homo Sapiens; identical to SEQ ID NO: 218680

SEQ ID NO: 380473 - RNA, 64 nt, Homo Sapiens; identical to SEQ ID NO: 218681

SEQ ID NO: 380474 - RNA, 64 nt, Homo Sapiens; identical to SEQ ID NO: 218682

SEQ ID NO: 380475 - RNA, 64 nt, Homo Sapiens; identical to SEQ ID NO: 218683

SEQ ID NO: 380476 - RNA, 64 nt, Homo Sapiens; identical to SEQ ID NO: 218684

SEQ ID NO: 380477 - RNA, 64 nt, Homo Sapiens; identical to SEQ ID NO: 218685

SEQ ID NO: 380478 - RNA, 59 nt, Homo Sapiens; identical to SEQ ID NO: 218686

SEQ ID NO: 380479 - RNA, 64 nt, Homo Sapiens; identical to SEQ ID NO: 218687

SEQ ID NO: 380480 - RNA, 64 nt, Homo Sapiens; identical to SEQ ID NO: 218688

SEQ ID NO: 380481 - RNA, 64 nt, Homo Sapiens; identical to SEQ ID NO: 218689

SEQ ID NO: 380482 - RNA, 64 nt, Homo Sapiens; identical to SEQ ID NO: 218690

SEQ ID NO: 380483 - RNA, 64 nt, Homo Sapiens; identical to SEQ ID NO: 218691

SEQ ID NO: 380484 - RNA, 64 nt, Homo Sapiens; identical to SEQ ID NO: 218692

SEQ ID NO: 380485 - RNA, 64 nt, Homo Sapiens; identical to SEQ ID NO: 218693

SEQ ID NO: 380486 - RNA, 64 nt, Homo Sapiens; identical to SEQ ID NO: 218694

SEQ ID NO: 380487 - RNA, 64 nt, Homo Sapiens; identical to SEQ ID NO: 218695

SEQ ID NO: 380488 - RNA, 64 nt, Homo Sapiens; identical to SEQ ID NO: 218696

SEQ ID NO: 380489 - RNA, 64 nt, Homo Sapiens; identical to SEQ ID NO: 218697

SEQ ID NO: 380490 - RNA, 64 nt, Homo Sapiens; identical to SEQ ID NO: 218698

SEQ ID NO: 380491 - RNA, 64 nt, Homo Sapiens; identical to SEQ ID NO: 218699

SEQ ID NO: 380492 - RNA, 64 nt, Homo Sapiens; identical to SEQ ID NO: 218700

SEQ ID NO: 380493 - RNA, 64 nt, Homo Sapiens; identical to SEQ ID NO: 218701

SEQ ID NO: 380494 - RNA, 64 nt, Homo Sapiens; identical to SEQ ID NO: 218702

SEQ ID NO: 380495 - RNA, 64 nt, Homo Sapiens; identical to SEQ ID NO: 218703

SEQ ID NO: 380496 - RNA, 64 nt, Homo Sapiens; identical to SEQ ID NO: 218704

SEQ ID NO: 380497 - RNA, 64 nt, Homo Sapiens; identical to SEQ ID NO: 218705

SEQ ID NO: 380498 - RNA, 64 nt, Homo Sapiens; identical to SEQ ID NO: 218706

SEQ ID NO: 380499 - RNA, 64 nt, Homo Sapiens; identical to SEQ ID NO: 218707

SEQ ID NO: 380500 - RNA, 64 nt, Homo Sapiens; identical to SEQ ID NO: 218708

SEQ ID NO: 380501 - RNA, 64 nt, Homo Sapiens; identical to SEQ ID NO: 218709

SEQ ID NO: 380502 - RNA, 64 nt, Homo Sapiens; identical to SEQ ID NO: 218710

SEQ ID NO: 380503 - RNA, 64 nt, Homo Sapiens; identical to SEQ ID NO: 218711

SEQ ID NO: 380504 - RNA, 64 nt, Homo Sapiens; identical to SEQ ID NO: 218712

SEQ ID NO: 380505 - RNA, 64 nt, Homo Sapiens; identical to SEQ ID NO: 218713

SEQ ID NO: 380506 - RNA, 64 nt, Homo Sapiens; identical to SEQ ID NO: 218714

SEQ ID NO: 380507 - RNA, 64 nt, Homo Sapiens; identical to SEQ ID NO: 218715

SEQ ID NO: 380508 - RNA, 64 nt, Homo Sapiens; identical to SEQ ID NO: 218716

SEQ ID NO: 380509 - RNA, 64 nt, Homo Sapiens; identical to SEQ ID NO: 218717

SEQ ID NO: 380510 - RNA, 64 nt, Homo Sapiens; identical to SEQ ID NO: 218718

SEQ ID NO: 380511 - RNA, 64 nt, Homo Sapiens; identical to SEQ ID NO: 218719

SEQ ID NO: 380512 - RNA, 64 nt, Homo Sapiens; identical to SEQ ID NO: 218720

SEQ ID NO: 380513 - RNA, 64 nt, Homo Sapiens; identical to SEQ ID NO: 218721

SEQ ID NO: 380514 - RNA, 64 nt, Homo Sapiens; identical to SEQ ID NO: 218722

SEQ ID NO: 380515 - RNA, 64 nt, Homo Sapiens; identical to SEQ ID NO: 218723

SEQ ID NO: 380516 - RNA, 64 nt, Homo Sapiens; identical to SEQ ID NO: 218724

SEQ ID NO: 380517 - RNA, 64 nt, Homo Sapiens; identical to SEQ ID NO: 218725

SEQ ID NO: 380518 - RNA, 64 nt, Homo Sapiens; identical to SEQ ID NO: 218726

SEQ ID NO: 380519 - RNA, 64 nt, Homo Sapiens; identical to SEQ ID NO: 218727

SEQ ID NO: 380520 - RNA, 64 nt, Homo Sapiens; identical to SEQ ID NO: 218728

SEQ ID NO: 380521 - RNA, 64 nt, Homo Sapiens; identical to SEQ ID NO: 218729

SEQ ID NO: 380522 - RNA, 64 nt, Homo Sapiens; identical to SEQ ID NO: 218730

SEQ ID NO: 380523 - RNA, 64 nt, Homo Sapiens; identical to SEQ ID NO: 218731

SEQ ID NO: 380524 - RNA, 64 nt, Homo Sapiens; identical to SEQ ID NO: 218732

SEQ ID NO: 380525 - RNA, 64 nt, Homo Sapiens; identical to SEQ ID NO: 218733

SEQ ID NO: 380526 - RNA, 64 nt, Homo Sapiens; identical to SEQ ID NO: 218734

SEQ ID NO: 380527 - RNA, 64 nt, Homo Sapiens; identical to SEQ ID NO: 218735

SEQ ID NO: 380528 - RNA, 64 nt, Homo Sapiens; identical to SEQ ID NO: 218736

SEQ ID NO: 380529 - RNA, 64 nt, Homo Sapiens; identical to SEQ ID NO: 218737

SEQ ID NO: 380530 - RNA, 64 nt, Homo Sapiens; identical to SEQ ID NO: 218738

SEQ ID NO: 380531 - RNA, 64 nt, Homo Sapiens; identical to SEQ ID NO: 218739

SEQ ID NO: 380532 - RNA, 64 nt, Homo Sapiens; identical to SEQ ID NO: 218740

SEQ ID NO: 380533 - RNA, 64 nt, Homo Sapiens; identical to SEQ ID NO: 218741

SEQ ID NO: 380534 - RNA, 64 nt, Homo Sapiens; identical to SEQ ID NO: 218742

SEQ ID NO: 380535 - RNA, 64 nt, Homo Sapiens; identical to SEQ ID NO: 218743

SEQ ID NO: 380536 - RNA, 64 nt, Homo Sapiens; identical to SEQ ID NO: 218744

SEQ ID NO: 380537 - RNA, 64 nt, Homo Sapiens; identical to SEQ ID NO: 218745

SEQ ID NO: 380538 - RNA, 64 nt, Homo Sapiens; identical to SEQ ID NO: 218746

SEQ ID NO: 380539 - RNA, 64 nt, Homo Sapiens; identical to SEQ ID NO: 218747

SEQ ID NO: 380540 - RNA, 64 nt, Homo Sapiens; identical to SEQ ID NO: 218748

SEQ ID NO: 380541 - RNA, 64 nt, Homo Sapiens; identical to SEQ ID NO: 218749

SEQ ID NO: 380542 - RNA, 64 nt, Homo Sapiens; identical to SEQ ID NO: 218750

SEQ ID NO: 380543 - RNA, 64 nt, Homo Sapiens; identical to SEQ ID NO: 218751

SEQ ID NO: 380544 - RNA, 64 nt, Homo Sapiens; identical to SEQ ID NO: 218752

SEQ ID NO: 380545 - RNA, 64 nt, Homo Sapiens; identical to SEQ ID NO: 218753

SEQ ID NO: 380546 - RNA, 64 nt, Homo Sapiens; identical to SEQ ID NO: 218754

SEQ ID NO: 380547 - RNA, 64 nt, Homo Sapiens; identical to SEQ ID NO: 218755

SEQ ID NO: 380548 - RNA, 64 nt, Homo Sapiens; identical to SEQ ID NO: 218756

SEQ ID NO: 380549 - RNA, 64 nt, Homo Sapiens; identical to SEQ ID NO: 218757

SEQ ID NO: 380550 - RNA, 64 nt, Homo Sapiens; identical to SEQ ID NO: 218758

SEQ ID NO: 380551 - RNA, 64 nt, Homo Sapiens; identical to SEQ ID NO: 218759

SEQ ID NO: 380552 - RNA, 64 nt, Homo Sapiens; identical to SEQ ID NO: 218760

SEQ ID NO: 380553 - RNA, 64 nt, Homo Sapiens; identical to SEQ ID NO: 218761

SEQ ID NO: 380554 - RNA, 64 nt, Homo Sapiens; identical to SEQ ID NO: 218762

SEQ ID NO: 380555 - RNA, 64 nt, Homo Sapiens; identical to SEQ ID NO: 218763

SEQ ID NO: 380556 - RNA, 64 nt, Homo Sapiens; identical to SEQ ID NO: 218764

SEQ ID NO: 380557 - RNA, 64 nt, Homo Sapiens; identical to SEQ ID NO: 218765

SEQ ID NO: 380558 - RNA, 64 nt, Homo Sapiens; identical to SEQ ID NO: 218766

SEQ ID NO: 380559 - RNA, 64 nt, Homo Sapiens; identical to SEQ ID NO: 218767

SEQ ID NO: 380560 - RNA, 64 nt, Homo Sapiens; identical to SEQ ID NO: 218768

SEQ ID NO: 380561 - RNA, 64 nt, Homo Sapiens; identical to SEQ ID NO: 218769

SEQ ID NO: 380562 - RNA, 64 nt, Homo Sapiens; identical to SEQ ID NO: 218770

SEQ ID NO: 380563 - RNA, 64 nt, Homo Sapiens; identical to SEQ ID NO: 218771

SEQ ID NO: 380564 - RNA, 64 nt, Homo Sapiens; identical to SEQ ID NO: 218772

SEQ ID NO: 380565 - RNA, 64 nt, Homo Sapiens; identical to SEQ ID NO: 218773

SEQ ID NO: 380566 - RNA, 64 nt, Homo Sapiens; identical to SEQ ID NO: 218774

SEQ ID NO: 380567 - RNA, 64 nt, Homo Sapiens; identical to SEQ ID NO: 218775

SEQ ID NO: 380568 - RNA, 64 nt, Homo Sapiens; identical to SEQ ID NO: 218776

SEQ ID NO: 380569 - RNA, 64 nt, Homo Sapiens; identical to SEQ ID NO: 218777

SEQ ID NO: 380570 - RNA, 64 nt, Homo Sapiens; identical to SEQ ID NO: 218778

SEQ ID NO: 380571 - RNA, 64 nt, Homo Sapiens; identical to SEQ ID NO: 218779

SEQ ID NO: 380572 - RNA, 64 nt, Homo Sapiens; identical to SEQ ID NO: 218780

SEQ ID NO: 380573 - RNA, 64 nt, Homo Sapiens; identical to SEQ ID NO: 218781

SEQ ID NO: 380574 - RNA, 64 nt, Homo Sapiens; identical to SEQ ID NO: 218782

SEQ ID NO: 380575 - RNA, 64 nt, Homo Sapiens; identical to SEQ ID NO: 218783

SEQ ID NO: 380576 - RNA, 64 nt, Homo Sapiens; identical to SEQ ID NO: 218784

SEQ ID NO: 380577 - RNA, 64 nt, Homo Sapiens; identical to SEQ ID NO: 218785

SEQ ID NO: 380578 - RNA, 64 nt, Homo Sapiens; identical to SEQ ID NO: 218786

SEQ ID NO: 380579 - RNA, 64 nt, Homo Sapiens; identical to SEQ ID NO: 218787

SEQ ID NO: 380580 - RNA, 64 nt, Homo Sapiens; identical to SEQ ID NO: 218788

SEQ ID NO: 380581 - RNA, 64 nt, Homo Sapiens; identical to SEQ ID NO: 218789

SEQ ID NO: 380582 - RNA, 64 nt, Homo Sapiens; identical to SEQ ID NO: 218790

SEQ ID NO: 380583 - RNA, 64 nt, Homo Sapiens; identical to SEQ ID NO: 218791

SEQ ID NO: 380584 - RNA, 64 nt, Homo Sapiens; identical to SEQ ID NO: 218792

SEQ ID NO: 380585 - RNA, 64 nt, Homo Sapiens; identical to SEQ ID NO: 218793

SEQ ID NO: 380586 - RNA, 64 nt, Homo Sapiens; identical to SEQ ID NO: 218794

SEQ ID NO: 380587 - RNA, 64 nt, Homo Sapiens; identical to SEQ ID NO: 218795

SEQ ID NO: 380588 - RNA, 64 nt, Homo Sapiens; identical to SEQ ID NO: 218796

SEQ ID NO: 380589 - RNA, 64 nt, Homo Sapiens; identical to SEQ ID NO: 218797

SEQ ID NO: 380590 - RNA, 64 nt, Homo Sapiens; identical to SEQ ID NO: 218798

SEQ ID NO: 380591 - RNA, 64 nt, Homo Sapiens; identical to SEQ ID NO: 218799

SEQ ID NO: 380592 - RNA, 64 nt, Homo Sapiens; identical to SEQ ID NO: 218800

SEQ ID NO: 380593 - RNA, 64 nt, Homo Sapiens; identical to SEQ ID NO: 218801

SEQ ID NO: 380594 - RNA, 64 nt, Homo Sapiens; identical to SEQ ID NO: 218802

SEQ ID NO: 380595 - RNA, 64 nt, Homo Sapiens; identical to SEQ ID NO: 218803

SEQ ID NO: 380596 - RNA, 64 nt, Homo Sapiens; identical to SEQ ID NO: 218804

SEQ ID NO: 380597 - RNA, 64 nt, Homo Sapiens; identical to SEQ ID NO: 218805

SEQ ID NO: 380598 - RNA, 64 nt, Homo Sapiens; identical to SEQ ID NO: 218806

SEQ ID NO: 380599 - RNA, 64 nt, Homo Sapiens; identical to SEQ ID NO: 218807

SEQ ID NO: 380600 - RNA, 64 nt, Homo Sapiens; identical to SEQ ID NO: 218808

SEQ ID NO: 380601 - RNA, 59 nt, Homo Sapiens; identical to SEQ ID NO: 218809

SEQ ID NO: 380602 - RNA, 64 nt, Homo Sapiens; identical to SEQ ID NO: 218810

SEQ ID NO: 380603 - RNA, 64 nt, Homo Sapiens; identical to SEQ ID NO: 218811

SEQ ID NO: 380604 - RNA, 63 nt, Homo Sapiens
aaagaagcuaggccuaaaagucuacauguugggcgauucuauuuauaugacauucuggaaaag

SEQ ID NO: 380605 - RNA, 63 nt, Homo Sapiens
caaacaacacccaguccuauuccaaacucucaacgauucuaucuuguuccuguuuuucuaugu

SEQ ID NO: 380606 - RNA, 63 nt, Homo Sapiens
agcaacuguaaacgaaccugugccucuaacaagcgauucuaaaccaccuaugaguauuucuuu

SEQ ID NO: 380607 - RNA, 63 nt, Homo Sapiens
ggaagaagcacuaaauggcaguggggccaguugcgauucuaaagugcuccaaaccguuccaag

SEQ ID NO: 380608 - RNA, 63 nt, Homo Sapiens
cuuuucaugcugcacacgaucuuaggugcagcucgauucuaauaguaacuuugggauuuuuuu

SEQ ID NO: 380609 - RNA, 63 nt, Homo Sapiens
uagugugaugauuucugucacauagcagcauuccgauucuauguaacugaauggagaugauaa

SEQ ID NO: 380610 - RNA, 63 nt, Homo Sapiens
guucuucagaaguucuggcaaggaaagaaauaucgauucuaaugaauuacggaugcucuuuga

SEQ ID NO: 380611 - RNA, 63 nt, Homo Sapiens
gggucuuuuauauauuagggauccugagauacccgauucuauauguaaaagcuaauauacaaa

SEQ ID NO: 380612 - RNA, 63 nt, Homo Sapiens
gucaaugugaaggacuagaauggaagccacaggcgauucuaugcaaacugcuuacgacagguu

SEQ ID NO: 380613 - RNA, 63 nt, Homo Sapiens
gucaggcauccugucuguggccuucuggggcaccgauucuaccaggcccuccagcugcguggu

SEQ ID NO: 380614 - RNA, 63 nt, Homo Sapiens
uuagaaugagagugugaaauaaaaggucaucaucgauucuacuuuauggggcugaacggggag

SEQ ID NO: 380615 - RNA, 63 nt, Homo Sapiens
gagaauagagagugguaauucagauuuggucaacgauucuagucacauauuuuccuccaaaag

SEQ ID NO: 380616 - RNA, 63 nt, Homo Sapiens
aguuaaaaaagaaacauauuccaagggcagguucgauucuagcucuaauuacugucaugucau

SEQ ID NO: 380617 - RNA, 63 nt, Homo Sapiens
uuugagaccagccugaccaacaugaugaaaccucgauucuacuaaaaauacaaaaauuagcca

SEQ ID NO: 380618 - RNA, 63 nt, Homo Sapiens
uaauaaaaaggggggagaugaugauggcgauggcgauucuaguuccgaagucaacaacaagca

SEQ ID NO: 380619 - RNA, 63 nt, Homo Sapiens
caagaaaaguccaugagaucuaagcuuaugggucgauucuaacggagcuuuggcuuuugaucu

SEQ ID NO: 380620 - RNA, 64 nt, Homo Sapiens
cauucaccaacuauuauuuucccuuguuuaucuacuuagauaucuguuuaaucuuacuaagaaa

SEQ ID NO: 380621 - RNA, 64 nt, Homo Sapiens
uuaauuaccuuuauaauguuucuuaaaagugaaacuuagauacaauugugauuggauacuuaga

SEQ ID NO: 380622 - RNA, 64 nt, Homo Sapiens
aaaagugaaacuuagauacaauugugauuggauacuuagauacuaagugaaacuuaguguaaca

SEQ ID NO: 380623 - RNA, 64 nt, Homo Sapiens
ucuuauugauauuuuuguaacagaauauagcucuuaacugaaaauccagaaccagaaacauaaa

SEQ ID NO: 380624 - RNA, 64 nt, Homo Sapiens
auugcucuggucaaaaccaagcacaccauagccuuaacugaauauuuaggaaaucugccuaauc

SEQ ID NO: 380625 - RNA, 64 nt, Homo Sapiens
uagagacuauguuagaaaaugcaaugaugcacuuuaacugaagaauuuuaguaauguauaacau

SEQ ID NO: 380626 - RNA, 64 nt, Homo Sapiens
aauuuuagaauuuggaacaaccuaacccaaggcauaacugaaaccaacagagcuuuucugucau

SEQ ID NO: 380627 - RNA, 64 nt, Homo Sapiens
uuuuaagaauuguuccuuggucuucucuucccuguaacugaaagacuguuagaagguacaauuu

SEQ ID NO: 380628 - RNA, 64 nt, Homo Sapiens
gaauuaagccuucauagcguaaauuuaccuuaaauaacugaaaucauuuaaagggaaaaguccu

SEQ ID NO: 380629 - RNA, 64 nt, Homo Sapiens
auggcagaauuuaucucuuuuuuguaaacucucauaacugaauugcuuaaguauaauuuauaga

SEQ ID NO: 380630 - RNA, 64 nt, Homo Sapiens
gaaguuauaucaaguucuaguguuugcuucuuaguaacugaacugaauuuacaguucuguccua

SEQ ID NO: 380631 - RNA, 64 nt, Homo Sapiens
cgcauguaagguaugguuuuaaaacuuauauguguaacugaacguucauauuugucaguaauuc

SEQ ID NO: 380632 - RNA, 64 nt, Homo Sapiens
auucacuacucuuguaaaccuuucuuucuguccauaacugaaguuccguuucagaguuuguguc

SEQ ID NO: 380633 - RNA, 64 nt, Homo Sapiens
uauuuuauuuugguauauuuaaacagugaaaaacuaacugaaagcacaugaagaguuguaacuu

SEQ ID NO: 380634 - RNA, 64 nt, Homo Sapiens
acuauuuacguaaauggaauguaagccaugacuuuaacugaaguguucacauucacuaauuuug

SEQ ID NO: 380635 - RNA, 64 nt, Homo Sapiens
aacuauaaagacaaaguaauucuauuaaaugaacuaacugaaaauaauaauuauaggaagugau

SEQ ID NO: 380636 - RNA, 64 nt, Homo Sapiens
gcaaauagaaaauaauuuaucauacuuguacaauuaacugaagaauugauaauaacugaaugug

SEQ ID NO: 380637 - RNA, 64 nt, Homo Sapiens
aucauacuuguacaauuaacugaagaauugauaauaacugaaugugaaacaucaauaaagacca

SEQ ID NO: 380638 - RNA, 64 nt, Homo Sapiens
uguuugucuuccuuugguauuuaauauuuauuaauaacugaaacguccagauccauuuagaaau

SEQ ID NO: 380639 - RNA, 64 nt, Homo Sapiens
uuuccaauugcauauaauacauaccaaagugcgauaacugaacauuuuuuuuuuucugaaaagg

SEQ ID NO: 380640 - RNA, 64 nt, Homo Sapiens
gaauuaaacauagcaauuguacaaaauggaauguuaacugaaugucccccaauuuuuuaaacua

SEQ ID NO: 380641 - RNA, 64 nt, Homo Sapiens
cuuugaucagcauugagguguuagguuaaucuguuaacugaaugaauguauuaauauauugcua

SEQ ID NO: 380642 - RNA, 64 nt, Homo Sapiens
uaauaauguuuuauguuuugugcuuuauuuauaguaacugaagccucuaaaauuaagauucgga

SEQ ID NO: 380643 - RNA, 64 nt, Homo Sapiens
uaauagagacuguccuuuuuauuuuuuaaaaugcuaacugaaagauaaaaucacaguagauuuu

SEQ ID NO: 380644 - RNA, 64 nt, Homo Sapiens
aauaggcagaggaaaauagcaacuaaauauuugguaacugaagcuaacaaugguguaacuugua

SEQ ID NO: 380645 - RNA, 64 nt, Homo Sapiens
gacuauguagugaaauguaucugccauuaaauaauaacugaaaagaauccacuggaggucauua

SEQ ID NO: 380646 - RNA, 64 nt, Homo Sapiens
aaaaaacauguuaauccuuguuugcagaaacaaauaacugaaauacauggauacaucaaguuca

SEQ ID NO: 380647 - RNA, 64 nt, Homo Sapiens
uccaaaaucuugaucaguuaauaguuuucauccauaacugaacaggggguaaaguuaaguugag

SEQ ID NO: 380648 - RNA, 64 nt, Homo Sapiens
ccacucuguaauugcaaaaaaauuguuguucuguuaacugaauaugaugcagcuuauacgaaau

SEQ ID NO: 380649 - RNA, 64 nt, Homo Sapiens
acuuuacuuuuucucauaucaguugugccuuuuauaacugaaaugcauuacaugacuauuggug

SEQ ID NO: 380650 - RNA, 64 nt, Homo Sapiens
augugaaacaguaucauccuuguuucagcauacauaacugaagcaaagauguauaggcaucugg

SEQ ID NO: 380651 - RNA, 64 nt, Homo Sapiens
caaguauuuuuucaaugcaauuacaaagugaacauaacugaacagcaauuaggcuuuaaugacc

SEQ ID NO: 380652 - RNA, 64 nt, Homo Sapiens
agggaccugauuguuuaaagguauaacaacauacuaacugaaagccauaacacucauguauuca

SEQ ID NO: 380653 - RNA, 64 nt, Homo Sapiens
guccuuucugcagcuucuaacccuuaguugagggagucagcacaggagcaagcgguaguaccac

SEQ ID NO: 380654 - RNA, 64 nt, Homo Sapiens
guccagaaagccaaaaagaaaaggaaagagcuggagucagcacuagaggcagcagcaucccaag

SEQ ID NO: 380655 - RNA, 64 nt, Homo Sapiens
cuuccaagccaaucaaucagccaguuccuagcagagucagcacaugaacaagaucuaagucauu

SEQ ID NO: 380656 - RNA, 64 nt, Homo Sapiens
ugugugugugugcgcgcgcacgcacgccuugagcagucagcauugcaccugcuauggagaaggg

SEQ ID NO: 380657 - RNA, 64 nt, Homo Sapiens
cgagcacuuuauaucccuuugggcacuggcugggagucagcaaguuccuuugcaaaggccuugg

SEQ ID NO: 380658 - RNA, 64 nt, Homo Sapiens
aaugaaacucauguuuaaaccagaugccgggggcagucagcauuggccacccugggaggcuugc

SEQ ID NO: 380659 - RNA, 64 nt, Homo Sapiens
gagagcggcuuccccaucgccuucuggcugcugcagucagcacagaggacagcuuccccaucgc

SEQ ID NO: 380660 - RNA, 64 nt, Homo Sapiens
gagagcggcuuccccauugccuucuggccgcugcagucagcacagaggacggcuuccccaucgc

SEQ ID NO: 380661 - RNA, 64 nt, Homo Sapiens
gaugggagaaugaggaguaaaaugcucacggcaaagucagcagcacugguaagccaagacugag

SEQ ID NO: 380662 - RNA, 64 nt, Homo Sapiens
ccugguccaggauucgcccucucccaugccuucaagucagcaucaggcuuagggcaaagaccag

SEQ ID NO: 380663 - RNA, 64 nt, Homo Sapiens
uuuucuugccagcuugggccauucuugcuuagacagucagcauuugucuccuccuuuaacugag

SEQ ID NO: 380664 - RNA, 64 nt, Homo Sapiens
aggaugggacuggucguguuugugcuuuucuccaagucagcacccaaaggucaaugcacagaga

SEQ ID NO: 380665 - RNA, 63 nt, Homo Sapiens
aacaaaggcuacccuuugaccaaaugucuuucucugcaacauggcuucggccuaaaauaugca

SEQ ID NO: 380666 - RNA, 63 nt, Homo Sapiens
uaaccgacugaaaucacuuugggauauuuuuuccugcaacacuggaaaguuuuaguuuuuuaa

SEQ ID NO: 380667 - RNA, 63 nt, Homo Sapiens
augcuguuuagcacaauuucuauugagucuuaccugcaacaaugaaccuuaaagauuuuuuua

SEQ ID NO: 380668 - RNA, 63 nt, Homo Sapiens
uucuguguuguuuccuuagaccugugguguccgcugcaacagcuacuagccacguguagcuaa

SEQ ID NO: 380669 - RNA, 63 nt, Homo Sapiens
guccugcaggaaaaguuuuuggucccugacuuccugcaacaaucagccaguccccccguuugg

SEQ ID NO: 380670 - RNA, 63 nt, Homo Sapiens
aauauguccuuaaggcacaaucuggcuuguuaucugcaacaggugagaaagaaagggacaggc

SEQ ID NO: 380671 - RNA, 63 nt, Homo Sapiens
cgccucugggguucaagugaggaucucagcucacugcaacauccaggcuggagugcaguggug

SEQ ID NO: 380672 - RNA, 63 nt, Homo Sapiens
uccaguuggccagaucacuuagauggggaaauacugcaacaugacuagcacuacgauaguguu

SEQ ID NO: 380673 - RNA, 64 nt, Homo Sapiens
agggaagcaugccugaucucccucccauggucaugccacccaccaacacugaggucaagccagu

SEQ ID NO: 380674 - RNA, 64 nt, Homo Sapiens
gagcucauccucuguggaaugagcuccaagaaaggccacccauaggggcugaggcagaacccag

SEQ ID NO: 380675 - RNA, 64 nt, Homo Sapiens
gaacauuaugugggagaacaccaagguagccuaggccacccaaaagugaguccugcgagguugc

SEQ ID NO: 380676 - RNA, 64 nt, Homo Sapiens
ccagacuaauaggaagcauuucuguaaccaaccugccacccacugauucagaaauggaaaucac

SEQ ID NO: 380677 - RNA, 63 nt, Homo Sapiens
acuccagcggcagccacuagaccgcgcccggcagccacccaccccacgugccaacuuccccuc

SEQ ID NO: 380678 - RNA, 64 nt, Homo Sapiens
cccuccccgugccagcacugccgcuuccaccugggccacccaccggacccucgcacgccgugcc

SEQ ID NO: 380679 - RNA, 64 nt, Homo Sapiens
aacgcugcugccagccgaugccccagcccugcacgccacccacuaucccggcacgcucccucug

SEQ ID NO: 380680 - RNA, 64 nt, Homo Sapiens
agcaggggccacguggagcccgggccgcucacccgccacccagugcuggccgccuucuuggugc

SEQ ID NO: 380681 - RNA, 64 nt, Homo Sapiens
ggaugcugcccugcguauuuggcagcaauggugggccacccagggccucugaguagccacccaa

SEQ ID NO: 380682 - RNA, 64 nt, Homo Sapiens
gcagcaauggugggccacccagggccucugaguagccacccaaagccuagccgcuguucuaggg

SEQ ID NO: 380683 - RNA, 64 nt, Homo Sapiens
gucuggccuaaugagggagccggggcuccccauugccacccacagugcccggaauggcccuagg

SEQ ID NO: 380684 - RNA, 64 nt, Homo Sapiens
uuagggacauccccaaaggguauacccuggcucugccacccaugaaccagcccagcauccagcc

SEQ ID NO: 380685 - RNA, 64 nt, Homo Sapiens
cccuccagugcccucuccucugaccaaggggccugccacccagcagcuccuugauuugugaccu

SEQ ID NO: 380686 - RNA, 64 nt, Homo Sapiens
ggccauguccagccccacuuccugccaggggagagccacccacaucugagaccaugaucuuccu

SEQ ID NO: 380687 - RNA, 58 nt, Homo Sapiens
aagagaacacugggguauaggggccggggccacccaaauguguacaccugcggggcca

SEQ ID NO: 380688 - RNA, 64 nt, Homo Sapiens
gggccggggccacccaaauguguacaccugcggggccacccaucguccaccccagugugcacgc

SEQ ID NO: 380689 - RNA, 64 nt, Homo Sapiens
gcuacaaagaugacuguggacguggguugcacuggccacccaaggaugucugccacaccucucc

SEQ ID NO: 380690 - RNA, 64 nt, Homo Sapiens
guugagcagcaucucuggccuguacccaguagaugccacccaguugugacaauuaaaagugucu

SEQ ID NO: 380691 - RNA, 64 nt, Homo Sapiens
ucuccaggcuguuaaccuuuuccguugcucccccgccacccaccuccuccuccccaggccaccc

SEQ ID NO: 380692 - RNA, 64 nt, Homo Sapiens
guugcucccccgccacccaccuccuccuccccaggccacccaacuugggcaccucccugggccc

SEQ ID NO: 380693 - RNA, 64 nt, Homo Sapiens
aggacagccagagccagggucggugccugggauggccacccaucacccgccaccucuccagggg

SEQ ID NO: 380694 - RNA, 64 nt, Homo Sapiens
ggggcuccucccugccggggcaccagcugccccugccacccacgcuaggggaauaggagaagcc

SEQ ID NO: 380695 - RNA, 64 nt, Homo Sapiens
ucaucccuugguccagcacauccacgcuguauacgccacccacccugcuagugacuuaguagcc

SEQ ID NO: 380696 - RNA, 64 nt, Homo Sapiens
ugcuaauguaacacgugagaaagccuuuggucaugccacccacucuaccaguuguccccaccau

SEQ ID NO: 380697 - RNA, 64 nt, Homo Sapiens
gaccuccucaauucacaaccuguagcugacuuuagccacccacaaguacagaaaaguaagcaua

SEQ ID NO: 380698 - RNA, 64 nt, Homo Sapiens
uggguccucuggaggaggggcgagcuguggagcagccacccacugcugccccaagcucacucag

SEQ ID NO: 380699 - RNA, 64 nt, Homo Sapiens
caccaucaacucuguuagccguccgcagacuacugccacccacugacauucagugguugcuggg

SEQ ID NO: 380700 - RNA, 64 nt, Homo Sapiens
caccaucugugggucuccaaacugcagcccugcagccacccacgucaggugccauguggccuuc

SEQ ID NO: 380701 - RNA, 64 nt, Homo Sapiens
uagcauacgcucuuugcuguugguagcgucugcagccacccagguuuaagaauccgccagcacu

SEQ ID NO: 380702 - RNA, 64 nt, Homo Sapiens; identical to SEQ ID NO: 293850

SEQ ID NO: 380703 - RNA, 64 nt, Homo Sapiens; identical to SEQ ID NO: 293851

SEQ ID NO: 380704 - RNA, 64 nt, Homo Sapiens; identical to SEQ ID NO: 293852

SEQ ID NO: 380705 - RNA, 64 nt, Homo Sapiens; identical to SEQ ID NO: 293853

SEQ ID NO: 380706 - RNA, 64 nt, Homo Sapiens; identical to SEQ ID NO: 293854

SEQ ID NO: 380707 - RNA, 64 nt, Homo Sapiens; identical to SEQ ID NO: 293855

SEQ ID NO: 380708 - RNA, 64 nt, Homo Sapiens; identical to SEQ ID NO: 293856

SEQ ID NO: 380709 - RNA, 64 nt, Homo Sapiens; identical to SEQ ID NO: 293857

SEQ ID NO: 380710 - RNA, 64 nt, Homo Sapiens; identical to SEQ ID NO: 293858

SEQ ID NO: 380711 - RNA, 64 nt, Homo Sapiens; identical to SEQ ID NO: 293859

SEQ ID NO: 380712 - RNA, 64 nt, Homo Sapiens; identical to SEQ ID NO: 293860

SEQ ID NO: 380713 - RNA, 64 nt, Homo Sapiens; identical to SEQ ID NO: 293861

SEQ ID NO: 380714 - RNA, 64 nt, Homo Sapiens; identical to SEQ ID NO: 293862

SEQ ID NO: 380715 - RNA, 64 nt, Homo Sapiens; identical to SEQ ID NO: 293863

SEQ ID NO: 380716 - RNA, 64 nt, Homo Sapiens; identical to SEQ ID NO: 293864

SEQ ID NO: 380717 - RNA, 64 nt, Homo Sapiens; identical to SEQ ID NO: 293865

SEQ ID NO: 380718 - RNA, 64 nt, Homo Sapiens; identical to SEQ ID NO: 293866

SEQ ID NO: 380719 - RNA, 64 nt, Homo Sapiens; identical to SEQ ID NO: 293867

SEQ ID NO: 380720 - RNA, 64 nt, Homo Sapiens; identical to SEQ ID NO: 293868

SEQ ID NO: 380721 - RNA, 64 nt, Homo Sapiens; identical to SEQ ID NO: 293869

SEQ ID NO: 380722 - RNA, 64 nt, Homo Sapiens; identical to SEQ ID NO: 293870

SEQ ID NO: 380723 - RNA, 64 nt, Homo Sapiens; identical to SEQ ID NO: 293871

SEQ ID NO: 380724 - RNA, 64 nt, Homo Sapiens; identical to SEQ ID NO: 293872

SEQ ID NO: 380725 - RNA, 64 nt, Homo Sapiens; identical to SEQ ID NO: 293873

SEQ ID NO: 380726 - RNA, 64 nt, Homo Sapiens; identical to SEQ ID NO: 293874

SEQ ID NO: 380727 - RNA, 64 nt, Homo Sapiens; identical to SEQ ID NO: 293875

SEQ ID NO: 380728 - RNA, 64 nt, Homo Sapiens; identical to SEQ ID NO: 293876

SEQ ID NO: 380729 - RNA, 64 nt, Homo Sapiens; identical to SEQ ID NO: 293877

SEQ ID NO: 380730 - RNA, 64 nt, Homo Sapiens; identical to SEQ ID NO: 293878

SEQ ID NO: 380731 - RNA, 64 nt, Homo Sapiens; identical to SEQ ID NO: 293879

SEQ ID NO: 380732 - RNA, 64 nt, Homo Sapiens; identical to SEQ ID NO: 293880

SEQ ID NO: 380733 - RNA, 64 nt, Homo Sapiens; identical to SEQ ID NO: 293881

SEQ ID NO: 380734 - RNA, 64 nt, Homo Sapiens; identical to SEQ ID NO: 293882

SEQ ID NO: 380735 - RNA, 64 nt, Homo Sapiens; identical to SEQ ID NO: 293883

SEQ ID NO: 380736 - RNA, 64 nt, Homo Sapiens; identical to SEQ ID NO: 293884

SEQ ID NO: 380737 - RNA, 64 nt, Homo Sapiens; identical to SEQ ID NO: 293885

SEQ ID NO: 380738 - RNA, 64 nt, Homo Sapiens; identical to SEQ ID NO: 293886

SEQ ID NO: 380739 - RNA, 64 nt, Homo Sapiens; identical to SEQ ID NO: 293887

SEQ ID NO: 380740 - RNA, 64 nt, Homo Sapiens; identical to SEQ ID NO: 293888

SEQ ID NO: 380741 - RNA, 64 nt, Homo Sapiens; identical to SEQ ID NO: 293889

SEQ ID NO: 380742 - RNA, 64 nt, Homo Sapiens; identical to SEQ ID NO: 293890

SEQ ID NO: 380743 - RNA, 64 nt, Homo Sapiens; identical to SEQ ID NO: 293891

SEQ ID NO: 380744 - RNA, 64 nt, Homo Sapiens; identical to SEQ ID NO: 293892

SEQ ID NO: 380745 - RNA, 64 nt, Homo Sapiens; identical to SEQ ID NO: 293893

SEQ ID NO: 380746 - RNA, 64 nt, Homo Sapiens; identical to SEQ ID NO: 293894

SEQ ID NO: 380747 - RNA, 64 nt, Homo Sapiens; identical to SEQ ID NO: 293895

SEQ ID NO: 380748 - RNA, 64 nt, Homo Sapiens; identical to SEQ ID NO: 293896

SEQ ID NO: 380749 - RNA, 64 nt, Homo Sapiens; identical to SEQ ID NO: 293897

SEQ ID NO: 380750 - RNA, 64 nt, Homo Sapiens; identical to SEQ ID NO: 293898

SEQ ID NO: 380751 - RNA, 64 nt, Homo Sapiens; identical to SEQ ID NO: 293899

SEQ ID NO: 380752 - RNA, 64 nt, Homo Sapiens; identical to SEQ ID NO: 293900

SEQ ID NO: 380753 - RNA, 64 nt, Homo Sapiens; identical to SEQ ID NO: 293901

SEQ ID NO: 380754 - RNA, 64 nt, Homo Sapiens; identical to SEQ ID NO: 293902

SEQ ID NO: 380755 - RNA, 64 nt, Homo Sapiens; identical to SEQ ID NO: 293903

SEQ ID NO: 380756 - RNA, 64 nt, Homo Sapiens; identical to SEQ ID NO: 293904

SEQ ID NO: 380757 - RNA, 64 nt, Homo Sapiens; identical to SEQ ID NO: 293905

SEQ ID NO: 380758 - RNA, 64 nt, Homo Sapiens; identical to SEQ ID NO: 293906

SEQ ID NO: 380759 - RNA, 64 nt, Homo Sapiens; identical to SEQ ID NO: 293907

SEQ ID NO: 380760 - RNA, 64 nt, Homo Sapiens; identical to SEQ ID NO: 293908

SEQ ID NO: 380761 - RNA, 64 nt, Homo Sapiens; identical to SEQ ID NO: 293909

SEQ ID NO: 380762 - RNA, 64 nt, Homo Sapiens; identical to SEQ ID NO: 293910

SEQ ID NO: 380763 - RNA, 64 nt, Homo Sapiens; identical to SEQ ID NO: 293911

SEQ ID NO: 380764 - RNA, 64 nt, Homo Sapiens; identical to SEQ ID NO: 293912

SEQ ID NO: 380765 - RNA, 64 nt, Homo Sapiens
auuugcuuuacucuuucuuuaugauugcaucugaccgcaccaaggugggccaugcguuguuugg

SEQ ID NO: 380766 - RNA, 64 nt, Homo Sapiens
ugcucugccccuugggcaucccacucaccaggguccgcaccagccaguguggagaggggugcac

SEQ ID NO: 380767 - RNA, 64 nt, Homo Sapiens
gaacuguaccaugugcuacacucaggccucugugccgcaccauuggcagcgggagccucccugc

SEQ ID NO: 380768 - RNA, 64 nt, Homo Sapiens
ggggaaacauucaaaggagagaguccccacacacccgcaccaaaguccugcauaugcaccuggg

SEQ ID NO: 380769 - RNA, 64 nt, Homo Sapiens
ucugucacucacauggacccagaucuuucccaggccgcaccauuagagaaaauguaaaggaggg

SEQ ID NO: 380770 - RNA, 64 nt, Homo Sapiens
uccacaccugcccaccucaccucacugcaccgcaccgcaccagagccagagcagcugcuugucu

SEQ ID NO: 380771 - RNA, 64 nt, Homo Sapiens
uucacugaugugcuucccuuuguggugggaugauccgcaccaucaucgcguuccaggguuuuga

SEQ ID NO: 380772 - RNA, 64 nt, Homo Sapiens
agcgagguggaccccgaaacggacggcccggagcccgcaccagccccgcgccuacccgggccgc

SEQ ID NO: 380773 - RNA, 64 nt, Homo Sapiens
caccccaaagcccuccuccuggccgcuguguccgccgcaccagcaagcccugugcuccggccau

SEQ ID NO: 380774 - RNA, 64 nt, Homo Sapiens
gguuguguaucacuuucacuccucccccccccccccgcaccauuguuucuagaguuguuuucuu

SEQ ID NO: 380775 - RNA, 64 nt, Homo Sapiens
ucaaaaccaaguaucacacuuuaauguacaugggccgcaccauaaugagaugugagccuugugc

SEQ ID NO: 380776 - RNA, 58 nt, Homo Sapiens
cgggccggcggccggagcggccgccccgccgcaccacgcgugccaguacaacagcuga

SEQ ID NO: 380777 - RNA, 64 nt, Homo Sapiens
cccucaaaacccauccaagaccguucaccggacaccgcaccagacagccuaaccugcauugcag

SEQ ID NO: 380778 - RNA, 64 nt, Homo Sapiens
uggagcagaugccuccccacccaucugcagggccccgcaccaguggacccagccugagaugguc

SEQ ID NO: 380779 - RNA, 64 nt, Homo Sapiens
gugccaaugcuugucagacagcuuagagacccugccgcaccacaguucacugacugugcacugu

SEQ ID NO: 380780 - RNA, 64 nt, Homo Sapiens
ucgggcgggugaacgcagacccugacuaccugccccgcaccauggacuuuggccucaacgugcg

SEQ ID NO: 380781 - RNA, 64 nt, Homo Sapiens
auuuuggaaccugcagagaguccuagagcccaucccgcaccagcgucggcacuuggcuuucugu

SEQ ID NO: 380782 - RNA, 64 nt, Homo Sapiens
agacgugcacuuggugcugcgcccagggaggaagccgcaccaccagccagcgcaggcccuggug

SEQ ID NO: 380783 - RNA, 64 nt, Homo Sapiens
gagacgugagcacaguuauggcagagaaguuucuccgcaccagaauuauccacagcaacuuggc

SEQ ID NO: 380784 - RNA, 64 nt, Homo Sapiens
aguuggacacuccgagagugcagcuguucuccccccgcaccauccguguccugcauucugcgag

SEQ ID NO: 380785 - RNA, 64 nt, Homo Sapiens
caucugcuccucugcugcaggacggccggcugccccgcaccaucccucuccccagcugcaaacu

SEQ ID NO: 380786 - RNA, 64 nt, Homo Sapiens
ucauauccaccucuguccagggugccgccagcugccgcaccagcccgaacaccauugagggagc

SEQ ID NO: 380787 - RNA, 64 nt, Homo Sapiens
cuggcccuccuuccucccucgccccccagcccugccgcaccaagccggcgggcccgggccugcc

SEQ ID NO: 380788 - RNA, 64 nt, Homo Sapiens
uuuuccaccugggagccugugcccucagaccgccccgcaccagagccacgggcuguggggcggg

SEQ ID NO: 380789 - RNA, 64 nt, Homo Sapiens
gggcagaugguggcgccuucuucaucuauguggaccgcaccacuacuucccaggcuuggugcac

SEQ ID NO: 380790 - RNA, 64 nt, Homo Sapiens
caugggaaacagugcagugacucacccccugcccccgcaccaaccacccauauucaggagaaga

SEQ ID NO: 380791 - RNA, 64 nt, Homo Sapiens
uucugaacucaagcugcguuuauuaaugccucucccgcaccaggccgggcuugggcccugcaca

SEQ ID NO: 380792 - RNA, 64 nt, Homo Sapiens
cagagccguaccugucaccccggccccagaguccccgcaccagguccggaugcaggcgaggccg

SEQ ID NO: 380793 - RNA, 64 nt, Homo Sapiens
guagaacgguggcuacugugaguggggagcagaaccgcaccacuguuauacugggauaacaauu

SEQ ID NO: 380794 - RNA, 64 nt, Homo Sapiens
ccacccuccacacacuaacacuguuuugcucaucccgcaccaccuauguguacauucggaguuc

SEQ ID NO: 380795 - RNA, 64 nt, Homo Sapiens
gggugcuguaugcucuaggcaccugugcacagccccgcaccaagaggaaguugagagucuuuag

SEQ ID NO: 380796 - RNA, 64 nt, Homo Sapiens
cccuagccccaggucuagccucacugugcccgccccgcaccaugugguuuuaccgccugcaacc

SEQ ID NO: 380797 - RNA, 64 nt, Homo Sapiens
ucaaguaguuuggacaucacacagucucuccgccccgcaccagaucacuuggaucaaaagcaaa

SEQ ID NO: 380798 - RNA, 64 nt, Homo Sapiens
ugccacaaacagaauucgaggcugagcuccagagccgcaccaucugggaaucaggccgccgagg

SEQ ID NO: 380799 - RNA, 64 nt, Homo Sapiens
cagugcucccugcccugccuguggaggacacgggccgcaccacaggagauugucccagggccuu

SEQ ID NO: 380800 - RNA, 64 nt, Homo Sapiens
cgagggccaauucaaccccauucuuuccagcgccccgcaccauagcaccugcccaccugagaac

SEQ ID NO: 380801 - RNA, 64 nt, Homo Sapiens
ucuuuggcugaccuucaauucccucuccaggacuccgcaccacuccccuacacccagagcauuc

SEQ ID NO: 380802 - RNA, 54 nt, Homo Sapiens
cgccgcgccccgggccggcggucgccgcaccagcagcugcgcaagaagagcuga

SEQ ID NO: 380803 - RNA, 64 nt, Homo Sapiens
gcccagacugagggucugggauggggugaaccuuccgcaccagagggacacuccacagaagcca

SEQ ID NO: 380804 - RNA, 64 nt, Homo Sapiens
ccuggagcccuccgagggguuccugcaucuuccaccgcaccauaccagaagagccccacgggcu

SEQ ID NO: 380805 - RNA, 64 nt, Homo Sapiens
cagacaaagucaauaaaagacacccccccaacccccgcaccaagggccgcuucuagagccucga

SEQ ID NO: 380806 - RNA, 64 nt, Homo Sapiens
ucagcgggcaggaggucccaucccugaggccucuccgcaccacccugcccuguugccaaacaac

SEQ ID NO: 380807 - RNA, 64 nt, Homo Sapiens
ggcuuuucucugccuuucuaccgaccaugugaccccgcaccagcccugcccccaccugcccucc

SEQ ID NO: 380808 - RNA, 64 nt, Homo Sapiens
cccuaaguaggcccuccccucccuaaaucugcuuccgcaccaccuggucuuagccccaaagaug

SEQ ID NO: 380809 - RNA, 64 nt, Homo Sapiens
gaacccgggagguggagguugcagggagccgaggccgcaccacugcacuccagccugggugaca

SEQ ID NO: 380810 - RNA, 64 nt, Homo Sapiens
ccgcggagcacguacccagggcugccugcgagccccgcaccaccacgcuggccaaguguugaga

SEQ ID NO: 380811 - RNA, 64 nt, Homo Sapiens
aaagccuucaaacucccuaaugugcccucagauuccgcaccaauaaaguuggcgggggcuuggc

SEQ ID NO: 380812 - RNA, 64 nt, Homo Sapiens
gaccucuugucuccuguuguccauccccuccccuccgcaccacucagccccaggccccucugua

SEQ ID NO: 380813 - RNA, 64 nt, Homo Sapiens
cuugccugcgcuggcccaguacguggccuucuucccgcaccaccggacauggccuauguaccua

SEQ ID NO: 380814 - RNA, 64 nt, Homo Sapiens
caugccagcaggccccaccauggaaaucaaaacaccgcaccagccagcagaauggacauucuga

SEQ ID NO: 380815 - RNA, 64 nt, Homo Sapiens
ugagugcagaagggugcgccucuucccucuacccccgcaccaccugcugugugccagccugaga

SEQ ID NO: 380816 - RNA, 64 nt, Homo Sapiens
gagagauucuuccccaauugugcugaccaugcagccgcaccagauccuuuucuacaugaugccc

SEQ ID NO: 380817 - RNA, 64 nt, Homo Sapiens
caggauggggaggagggcgacugggaggcaagagccgcaccaugaggaugaaaaguagaggcug

SEQ ID NO: 380818 - RNA, 64 nt, Homo Sapiens
gauuguugacauugacagcucggccgagaguuauccgcaccaguuccucuuuccuucuccagga

SEQ ID NO: 380819 - RNA, 64 nt, Homo Sapiens; identical to SEQ ID NO: 52393

SEQ ID NO: 380820 - RNA, 64 nt, Homo Sapiens; identical to SEQ ID NO: 52394

SEQ ID NO: 380821 - RNA, 64 nt, Homo Sapiens; identical to SEQ ID NO: 52395

SEQ ID NO: 380822 - RNA, 64 nt, Homo Sapiens; identical to SEQ ID NO: 52396

SEQ ID NO: 380823 - RNA, 64 nt, Homo Sapiens; identical to SEQ ID NO: 52397

SEQ ID NO: 380824 - RNA, 64 nt, Homo Sapiens; identical to SEQ ID NO: 52398

SEQ ID NO: 380825 - RNA, 64 nt, Homo Sapiens; identical to SEQ ID NO: 52399

SEQ ID NO: 380826 - RNA, 64 nt, Homo Sapiens; identical to SEQ ID NO: 52400

SEQ ID NO: 380827 - RNA, 64 nt, Homo Sapiens; identical to SEQ ID NO: 52401

SEQ ID NO: 380828 - RNA, 64 nt, Homo Sapiens; identical to SEQ ID NO: 52402

SEQ ID NO: 380829 - RNA, 64 nt, Homo Sapiens; identical to SEQ ID NO: 52403

SEQ ID NO: 380830 - RNA, 64 nt, Homo Sapiens; identical to SEQ ID NO: 52404

SEQ ID NO: 380831 - RNA, 64 nt, Homo Sapiens; identical to SEQ ID NO: 52405

SEQ ID NO: 380832 - RNA, 64 nt, Homo Sapiens; identical to SEQ ID NO: 52406

SEQ ID NO: 380833 - RNA, 64 nt, Homo Sapiens; identical to SEQ ID NO: 52407

SEQ ID NO: 380834 - RNA, 64 nt, Homo Sapiens; identical to SEQ ID NO: 52408

SEQ ID NO: 380835 - RNA, 64 nt, Homo Sapiens; identical to SEQ ID NO: 52409

SEQ ID NO: 380836 - RNA, 64 nt, Homo Sapiens; identical to SEQ ID NO: 52410

SEQ ID NO: 380837 - RNA, 64 nt, Homo Sapiens; identical to SEQ ID NO: 52411

SEQ ID NO: 380838 - RNA, 64 nt, Homo Sapiens; identical to SEQ ID NO: 52412

SEQ ID NO: 380839 - RNA, 64 nt, Homo Sapiens; identical to SEQ ID NO: 52413

SEQ ID NO: 380840 - RNA, 64 nt, Homo Sapiens; identical to SEQ ID NO: 52414

SEQ ID NO: 380841 - RNA, 64 nt, Homo Sapiens; identical to SEQ ID NO: 52415

SEQ ID NO: 380842 - RNA, 64 nt, Homo Sapiens; identical to SEQ ID NO: 52416

SEQ ID NO: 380843 - RNA, 64 nt, Homo Sapiens; identical to SEQ ID NO: 52417

SEQ ID NO: 380844 - RNA, 64 nt, Homo Sapiens; identical to SEQ ID NO: 52418

SEQ ID NO: 380845 - RNA, 64 nt, Homo Sapiens; identical to SEQ ID NO: 52419

SEQ ID NO: 380846 - RNA, 64 nt, Homo Sapiens; identical to SEQ ID NO: 52420

SEQ ID NO: 380847 - RNA, 64 nt, Homo Sapiens; identical to SEQ ID NO: 52421

SEQ ID NO: 380848 - RNA, 64 nt, Homo Sapiens; identical to SEQ ID NO: 52422

SEQ ID NO: 380849 - RNA, 64 nt, Homo Sapiens; identical to SEQ ID NO: 52423

SEQ ID NO: 380850 - RNA, 64 nt, Homo Sapiens; identical to SEQ ID NO: 52424

SEQ ID NO: 380851 - RNA, 64 nt, Homo Sapiens; identical to SEQ ID NO: 52425

SEQ ID NO: 380852 - RNA, 64 nt, Homo Sapiens; identical to SEQ ID NO: 52426

SEQ ID NO: 380853 - RNA, 64 nt, Homo Sapiens; identical to SEQ ID NO: 52427

SEQ ID NO: 380854 - RNA, 64 nt, Homo Sapiens; identical to SEQ ID NO: 52428

SEQ ID NO: 380855 - RNA, 64 nt, Homo Sapiens; identical to SEQ ID NO: 52429

SEQ ID NO: 380856 - RNA, 64 nt, Homo Sapiens; identical to SEQ ID NO: 52430

SEQ ID NO: 380857 - RNA, 64 nt, Homo Sapiens; identical to SEQ ID NO: 52431

SEQ ID NO: 380858 - RNA, 64 nt, Homo Sapiens; identical to SEQ ID NO: 52432

SEQ ID NO: 380859 - RNA, 64 nt, Homo Sapiens; identical to SEQ ID NO: 52433

SEQ ID NO: 380860 - RNA, 64 nt, Homo Sapiens; identical to SEQ ID NO: 52434

SEQ ID NO: 380861 - RNA, 64 nt, Homo Sapiens; identical to SEQ ID NO: 52435

SEQ ID NO: 380862 - RNA, 64 nt, Homo Sapiens; identical to SEQ ID NO: 52436

SEQ ID NO: 380863 - RNA, 64 nt, Homo Sapiens; identical to SEQ ID NO: 52437

SEQ ID NO: 380864 - RNA, 64 nt, Homo Sapiens; identical to SEQ ID NO: 52438

SEQ ID NO: 380865 - RNA, 64 nt, Homo Sapiens; identical to SEQ ID NO: 52439

SEQ ID NO: 380866 - RNA, 64 nt, Homo Sapiens
auuuauuccucuugauuguggaauuaauuugauugcuugcuaaugguacuaguaguacuccuuu

SEQ ID NO: 380867 - RNA, 64 nt, Homo Sapiens
gaaaauugugcuacagauuauuacuaauaacccagcuugcuaaauuaggcuauaccuagguaau

SEQ ID NO: 380868 - RNA, 61 nt, Homo Sapiens
aaggaugucugggaugugaagaggcaaggcagaaauggaugaugaacaucaaaaacuguca

SEQ ID NO: 380869 - RNA, 61 nt, Homo Sapiens
uacuauuuuugaaguuuacauuguuacauaugaaauggaaacauuauuuugaaacguuguc

SEQ ID NO: 380870 - RNA, 61 nt, Homo Sapiens
ccccucaccuucaauaagguuuuucaaaaaggaaauggaaacuuuuuaaccaauuugugaa

SEQ ID NO: 380871 - RNA, 61 nt, Homo Sapiens
aaauuauuuuuaauaccaaaagaguucuuuugaaauggaacugauuaaaagggcagagggu

SEQ ID NO: 380872 - RNA, 61 nt, Homo Sapiens
gaaacaagcccucccaugccacaccagauuggaaauggaguauagauaaggaauuuccugu

SEQ ID NO: 380873 - RNA, 61 nt, Homo Sapiens
guuauagauaaggaauuuccuuaacuggggggaaauggacaugaguuuguuggaaaagcag

SEQ ID NO: 380874 - RNA, 61 nt, Homo Sapiens
cucuagaaagcugccaagacagaggcagaaagaaauggaugauaguucugucaagcacacu

SEQ ID NO: 380875 - RNA, 61 nt, Homo Sapiens
acgcauuggcuuuuuuuuucuuguuuugauagaaauggaauuaagcaaaaguaguuuuugu

SEQ ID NO: 380876 - RNA, 61 nt, Homo Sapiens
gauuguuccuuagagcuucuucugaugcuuugaaauggaagugaauugagcuccuggcccu

SEQ ID NO: 380877 - RNA, 61 nt, Homo Sapiens
uagugacucuuggauuacaguagaagaacaagaaauggaaauaagaggcaacagagccauc

SEQ ID NO: 380878 - RNA, 61 nt, Homo Sapiens
ccauuccccuguugcucuccuuaaaccaaaggaaauggaagcuugucuugggcuuucguca

SEQ ID NO: 380879 - RNA, 61 nt, Homo Sapiens
auuucaggucuccacgucugcaguuuacagugaaauggagacuuucucuggacaacuggcc

SEQ ID NO: 380880 - RNA, 61 nt, Homo Sapiens
agacccuguggagaaauucguuguucccacugaaauggacugacuguaacgauugacacca

SEQ ID NO: 380881 - RNA, 61 nt, Homo Sapiens
ucuagagagucuccuuacucauuaauucaaugaaauggauugguaagaugucuugaaaaca

SEQ ID NO: 380882 - RNA, 61 nt, Homo Sapiens
ugcuuucauuuuucugaccuaauaauuacgggaaauggaaagucugggccagcaucaauaa

SEQ ID NO: 380883 - RNA, 61 nt, Homo Sapiens
uggugugaggcaaagugaaaaagggaugggggaaauggagauggcacgggcuccucagagc

SEQ ID NO: 380884 - RNA, 61 nt, Homo Sapiens
ugguguccuuuuuucucccaaacuuuauuuagaaauggaaggaguucaauuuuuucuuguu

SEQ ID NO: 380885 - RNA, 61 nt, Homo Sapiens
uaaaaguuuucaucgccuugguaaagcuccagaaauggacaaugcuagugacugcacaaua

SEQ ID NO: 380886 - RNA, 61 nt, Homo Sapiens
cauuugagucucuuaauagcuauuaguugaugaaauggagugaaguagaauugacagggca

SEQ ID NO: 380887 - RNA, 61 nt, Homo Sapiens
agugaggaauggaggccauauuagagaaugagaaauggaaccacuacaacugauuaguugu

SEQ ID NO: 380888 - RNA, 61 nt, Homo Sapiens
gguucuuuccaugucuuaguuggaugucccugaaauggacacaggcugugccauugugcca

SEQ ID NO: 380889 - RNA, 61 nt, Homo Sapiens
uauaaguagaaaauuacuuaauuucauacuagaaauggauggaugcugcaaguugaaaugg

SEQ ID NO: 380890 - RNA, 61 nt, Homo Sapiens
ucauacuagaaauggauggaugcugcaaguugaaauggacuguccauugacguuccuaaug

SEQ ID NO: 380891 - RNA, 61 nt, Homo Sapiens
uaaaauauaugugcuuauuauuaguugcuuagaaauggaaaagguauucuaauguauuuug

SEQ ID NO: 380892 - RNA, 61 nt, Homo Sapiens
aggaaaaauagcuuuuaucaaaaugcuuuaagaaauggagaacauuuuuuucauaaaaauu

SEQ ID NO: 380893 - RNA, 61 nt, Homo Sapiens
augagaagccguugagcuuuguccauucaaggaaauggauuauuugucagcccgauuauuu

SEQ ID NO: 380894 - RNA, 61 nt, Homo Sapiens
acugccaucuucaaauuuaaauguaauuuaggaaauggaagcuuuuaauuuuaauuucuuu

SEQ ID NO: 380895 - RNA, 61 nt, Homo Sapiens
cugggcagugcugagucccuauagagcuaaugaaauggaagguacugaaggcucagcagca

SEQ ID NO: 380896 - RNA, 61 nt, Homo Sapiens
ccaaaauaaauuuuccaauucugaaauccaagaaauggaauuucuugacaggcacaccuuu

SEQ ID NO: 380897 - RNA, 61 nt, Homo Sapiens
cuauucuauucugcugccccucuuucucugggaaauggaugcaugggaaauguaaaggcag

SEQ ID NO: 380898 - RNA, 61 nt, Homo Sapiens
uuuucccaggguggaaaauaaaagucaucacgaaauggaagauagugaaugcuuuaaaauu

SEQ ID NO: 380899 - RNA, 61 nt, Homo Sapiens
ggcaaauaauggaacauaaaaaauuuaaaaagaaauggaaucaccuaccauguacccauaa

SEQ ID NO: 380900 - RNA, 61 nt, Homo Sapiens
ggcacuucauauauucucaugcuuuguuuaagaaauggaauauagcuuacagacagucuau

SEQ ID NO: 380901 - RNA, 61 nt, Homo Sapiens
ggucucuuugauuuaaaauacuguuuguuaggaaauggaauggacuacuuuuguaacuuac

SEQ ID NO: 380902 - RNA, 61 nt, Homo Sapiens
aaauuuuguuaaauaggcaacaaagccuuaugaaauggauggugcugggaaucacuuauac

SEQ ID NO: 380903 - RNA, 61 nt, Homo Sapiens
uuaaaauauucuaaaauuuacauucacugaagaaauggacaauucuaauaauuucaaaaug

SEQ ID NO: 380904 - RNA, 61 nt, Homo Sapiens
ucucacaccguaucuagggaauuccagcucugaaauggaguggauuuaaucuggggagcaa

SEQ ID NO: 380905 - RNA, 61 nt, Homo Sapiens
cagagccugaggugguaggaggaggacccuggaaauggacugguuugagauugccccaggu

SEQ ID NO: 380906 - RNA, 61 nt, Homo Sapiens
caaugguccugacuuugggcgcuggguauuggaaauggaugcaaaguacaauguguuuuuc

SEQ ID NO: 380907 - RNA, 61 nt, Homo Sapiens
ccucuaugcaaauaaacuagaaaaucuagaagaaauggauaaauuccucaacacguacacc

SEQ ID NO: 380908 - RNA, 61 nt, Homo Sapiens
cacugcuuaacgaaauaaaagaggaugcaaagaaauggaagagcauuccaugcucaugggu

SEQ ID NO: 380909 - RNA, 61 nt, Homo Sapiens
uuuaaguguguguguguguuuguggaggagugaaauggagcaaggaggugccucuguucuu

SEQ ID NO: 380910 - RNA, 61 nt, Homo Sapiens
cucaccauguuggucaggcuucuauuuaguagaaauggagucgccaccacaccuggcuaau

SEQ ID NO: 380911 - RNA, 64 nt, Homo Sapiens
ucacugucauuuaagauaugugaacauuaaaaaaaaccauuauuaauguaagcuuuuaaaguaa

SEQ ID NO: 380912 - RNA, 64 nt, Homo Sapiens
gaaaagcaaagcuugaguuuaauauggaaaaguuaaccauuauaagaaaguugauucuuaugau

SEQ ID NO: 380913 - RNA, 64 nt, Homo Sapiens
aaaugguggcuaaagaaaauagggacucugaagaugucgaaaucuuuauuccugguuaggaagg

SEQ ID NO: 380914 - RNA, 64 nt, Homo Sapiens
cauuuuuuacaaacugaaaauacaguagauaagcugucgaaaauggaaaacaauucaauuuuaa

SEQ ID NO: 380915 - RNA, 64 nt, Homo Sapiens
agacccugacaaacuggccauccuucugccaaaaugucgaaaucaagguaaaaucccuacguga

SEQ ID NO: 380916 - RNA, 64 nt, Homo Sapiens
ucagagaccugaaaccacuucagaauggugcauaugucgaaagagcuggcugggggccuugccc

SEQ ID NO: 380917 - RNA, 64 nt, Homo Sapiens
gugucuguuugauguggugugauugugcuggccuugucgaaaaagaugugaugcuucucagaac

SEQ ID NO: 380918 - RNA, 64 nt, Homo Sapiens
uuuuucucucugacugcugcgaagaaaacuuggcugucgaaacaauucugucacauaauauuuu

SEQ ID NO: 380919 - RNA, 64 nt, Homo Sapiens
uccuuguuuuaaaaaaugauuauuuuacuucaacugucgaaacuuuagaagccaugaauuauuu

SEQ ID NO: 380920 - RNA, 64 nt, Homo Sapiens
acaggagagccgccuacccuacgcgacguccauuugucgaaagacuuuaauuuucagcucgaag

SEQ ID NO: 380921 - RNA, 64 nt, Homo Sapiens
uacaagauuuccuuaaaaucuuuguuguggccaaugucgaaaccaagaaaaaaagagguuuaag

SEQ ID NO: 380922 - RNA, 64 nt, Homo Sapiens
aauuuaaauuuuuuaauuuaaaaguaaauuuuacugucgaaaaugcaaacuuggggagggcgga

SEQ ID NO: 380923 - RNA, 64 nt, Homo Sapiens
acccagucccaaccccccaaaggcugaaagauacugucgaaauccauagaaucaacacauuuua

SEQ ID NO: 380924 - RNA, 64 nt, Homo Sapiens
auauaaugacccagcaaaacacaucacaucuuacugucgaaauuaaaugugugauccauccuag

SEQ ID NO: 380925 - RNA, 64 nt, Homo Sapiens
aagagcaaaaccguuuuaaauuugaaaggauauuugucgaaaaagucucuuuggguucuuucug

SEQ ID NO: 380926 - RNA, 64 nt, Homo Sapiens
acucaacucugccguccuagagccgugaggucucugucgaaacuccaguacuuucaguuuggcg

SEQ ID NO: 380927 - RNA, 64 nt, Homo Sapiens
cuucaggguacuucguagacucugccucacuacaugucgaaagaguuauuugaguucucuucug

SEQ ID NO: 380928 - RNA, 64 nt, Homo Sapiens
aauuaucuuguaaguagcuugucaucaauccccuugucgaaaacuagaaaaaaaggaguugacc

SEQ ID NO: 380929 - RNA, 64 nt, Homo Sapiens
uacgucagaugccucuaaggaaaauacacuagguugucgaaauaauaauuccacagccucuucu

SEQ ID NO: 380930 - RNA, 64 nt, Homo Sapiens
aguguaagcacuucugagcucuuuagcauugaagugucgaaagcaacucacacgggaagaucau

SEQ ID NO: 380931 - RNA, 64 nt, Homo Sapiens
gcagccaggccucucggguucucucuuuuuuaaaugucgaaauaaacuucuuacaaaugaccag

SEQ ID NO: 380932 - RNA, 64 nt, Homo Sapiens
ucaucucuacuaaaaauacacagcuuggccaacaugucgaaacuaccugaggucaguucgagac

SEQ ID NO: 380933 - RNA, 64 nt, Homo Sapiens
aaaccaccaggcauccggccguggaagggcugggugucgaaaucgccgggggaggugggugugg

SEQ ID NO: 380934 - RNA, 64 nt, Homo Sapiens
guaauaugaaagauuuuaaaaaauuucaacugauugucgaaagguuuaaauguucuuaguuuua

SEQ ID NO: 380935 - RNA, 64 nt, Homo Sapiens
gaaaacagagagcuuaaauaauuugccacaguaaugucgaaacuaggccuuugaaccaaggcag

SEQ ID NO: 380936 - RNA, 64 nt, Homo Sapiens
aaguucuuauaagcuguuuuuuaaacaaugacauugucgaaagaaaaguaauuuaguuacauuc

SEQ ID NO: 380937 - RNA, 64 nt, Homo Sapiens
auuccggacaagacuacccucaguacauguuacuugucgaaaaaaaagaagaaaagcaaucucg

SEQ ID NO: 380938 - RNA, 64 nt, Homo Sapiens
caguaauauuuguauuuggccgaggugcucuguuugucgaaacaggcggcgcccacccgcugcc

SEQ ID NO: 380939 - RNA, 64 nt, Homo Sapiens
aucuucugguuuaaacuuguuugcugugaacaauugucgaaaagagucuuccaauuaaugcuuu

SEQ ID NO: 380940 - RNA, 64 nt, Homo Sapiens
auuauaacuguaacguucuugaaguagaaaaaaaugucgaaagcuaucuugaaaaagcaucaca

SEQ ID NO: 380941 - RNA, 64 nt, Homo Sapiens
gcauuguaaaaagagaagaacucuaccaauguuaugucgaaacuggcuugugguuuguuguuua

SEQ ID NO: 380942 - RNA, 64 nt, Homo Sapiens
auucugagguaaauagauggauuuuaucuggcagugucgaaaauaguaggagccuaaaacuuug

SEQ ID NO: 380943 - RNA, 64 nt, Homo Sapiens
ggcaccaggcugccucugcucuuggaaaacuaggaaaggggaucagaaacauccucuccccgcu

SEQ ID NO: 380944 - RNA, 64 nt, Homo Sapiens
aaacauccucuccccgcucuagguuucuucucccaaaggggacccaaggcugugacacuuaccu

SEQ ID NO: 380945 - RNA, 64 nt, Homo Sapiens
gccacgacuuggccugugccugguucucuaucagaaaggggaugcugaacaaaaccuccuucca

SEQ ID NO: 380946 - RNA, 64 nt, Homo Sapiens
aaguaaguaccuuaaugcuaaugagguccacuaaaaaggggaggaaggcagaccuccugggaga

SEQ ID NO: 380947 - RNA, 64 nt, Homo Sapiens
uuucagaagacgggcgaaacaggcacagguguaaaaaggggagauaaaaaggggagauuucggu

SEQ ID NO: 380948 - RNA, 64 nt, Homo Sapiens
uuucgguaggcacagguguaaggcacaguuguaaaaaggggagauggaauaucagcagaguagu

SEQ ID NO: 380949 - RNA, 64 nt, Homo Sapiens
ccaugccgcugagguguuaggugguuuagggccaaaaggggaaaaccacuugagucuuguggug

SEQ ID NO: 380950 - RNA, 64 nt, Homo Sapiens
gagcugcagugguaaugugugggacaccuugaccaaaggggagcuuugucucguguguuuugaa

SEQ ID NO: 380951 - RNA, 64 nt, Homo Sapiens
ugagaaagggaauacuaucucuacuucuguuuaaaaaggggagaucacuaaauuguacaguauu

SEQ ID NO: 380952 - RNA, 64 nt, Homo Sapiens
gaaauauaacuaaaugcuucggugguucauuuugaaaggggacauucugacuugcuuuucucua

SEQ ID NO: 380953 - RNA, 64 nt, Homo Sapiens
aaagcaguaaccuuauacacuacuuauaaguuugaaaggggaaagguuaccuuuacaauggaga

SEQ ID NO: 380954 - RNA, 64 nt, Homo Sapiens
auguucaauaauguauauguaucaguucuguaauaaaggggaaaacacuuuuuuuaaauacuca

SEQ ID NO: 380955 - RNA, 64 nt, Homo Sapiens
ggagagaaggugccuuugacaagggaguccuuggaaaggggaaucuagagggggaguuuacuaa

SEQ ID NO: 380956 - RNA, 64 nt, Homo Sapiens
aacuguuucuucagugauuagguagugggugggaaaaggggaaaucucugaagggaauagggcu

SEQ ID NO: 380957 - RNA, 64 nt, Homo Sapiens
aagggcugauggacaggggucaggcaacuaucccaaaggggagggcacuacacuuccuugagag

SEQ ID NO: 380958 - RNA, 64 nt, Homo Sapiens
uacacuuccuugagagaaaccgcugucauuaauaaaaggggagcagccccugagcaccccugcu

SEQ ID NO: 380959 - RNA, 64 nt, Homo Sapiens
gaaacuacuuuagagccucuuguggguaaagaauaaaggggaaacaaguuaagcacuuccuugg

SEQ ID NO: 380960 - RNA, 64 nt, Homo Sapiens
cucccaaaauuuaaaaacaauccagguggaggagaaaggggaauggccccagaguguguaugcu

SEQ ID NO: 380961 - RNA, 64 nt, Homo Sapiens
ggaugugguaagcggaaacaacacccuacugugaaaaggggagguguuuaguaagagcaugcuu

SEQ ID NO: 380962 - RNA, 64 nt, Homo Sapiens
augacuuaaaacuuuuuuuuuucuauuaaaacuuaaaggggaacaaaacuugaaaaagcccugu

SEQ ID NO: 380963 - RNA, 64 nt, Homo Sapiens
agauuuuuuauauuugccacuguuaaauaguuggaaaggggaaauucugauuaagcgaaagugg

SEQ ID NO: 380964 - RNA, 64 nt, Homo Sapiens
cucuugugggaggagcagagaccgugcccggcccaaaggggaaaugggauuacaggcgugagcc

SEQ ID NO: 380965 - RNA, 64 nt, Homo Sapiens
cuuuuuuuuggagaaggcgucuucauuuggggccaaaggggaaagccucugcugccagccaagu

SEQ ID NO: 380966 - RNA, 64 nt, Homo Sapiens
uuguggaugaccuguguuacauuaauaucaauaaaaaggggauggacaagaccucauaacugug

SEQ ID NO: 380967 - RNA, 64 nt, Homo Sapiens
aggacaacugugaacucacagacauuauugaaggaaaggggauguuuuuuuaaaggcaaagauu

SEQ ID NO: 380968 - RNA, 64 nt, Homo Sapiens
guuuuuacccuaaagugcaaauuaacgguggugaaaaggggacagaggaaaacuuauucugaau

SEQ ID NO: 380969 - RNA, 64 nt, Homo Sapiens
uguuuugaucuuuagauagcacuacuguccaaucaaaggggaaauaaggcaauauauaauugaa

SEQ ID NO: 380970 - RNA, 64 nt, Homo Sapiens
aaaauauugaugagaaggaguccuccaguuagugaaaggggaguuucguuuucagcuuucuuug

SEQ ID NO: 380971 - RNA, 64 nt, Homo Sapiens
cugguggccaagccucaguuucccccaaaugagcaaaggggauaaagaggggcccgacuuuugc

SEQ ID NO: 380972 - RNA, 64 nt, Homo Sapiens
uuagacaaguggauuuauaccaaugcacacagccucaugcaaguaaacucuuuauggcauuuua

SEQ ID NO: 380973 - RNA, 64 nt, Homo Sapiens
cugcugccuucauguaacccauuguccacauccuucaugcaagagcaaaacgcagaaccuuaag

SEQ ID NO: 380974 - RNA, 64 nt, Homo Sapiens
augaauauaccucugauaugugccucagauauacucaugcaaauaauacuaugugcauguaucu

SEQ ID NO: 380975 - RNA, 64 nt, Homo Sapiens
ugaaauuccauauaaguuuuugaaguuuuaaacuucaugcaauucuccuuaaugugaaacuuca

SEQ ID NO: 380976 - RNA, 64 nt, Homo Sapiens
cuagauaaguuuguuuacuuaugcccuccggaaaucaugcaagacugcucccugcaaagggggg

SEQ ID NO: 380977 - RNA, 64 nt, Homo Sapiens
ggcugcacuaaagcuggcacucccccagccguucucaugcaaaauaccugugucagaauacucc

SEQ ID NO: 380978 - RNA, 64 nt, Homo Sapiens
agcucaucucugucccacuuggcaucagcuggcgucaugcaaagucaugcaaaggcugggacca

SEQ ID NO: 380979 - RNA, 64 nt, Homo Sapiens
ugucccacuuggcaucagcuggcgucaugcaaagucaugcaaaggcugggaccacgugagauca

SEQ ID NO: 380980 - RNA, 64 nt, Homo Sapiens
aaauuaugcaauuuuuuuuuugugaaaaugaauaucaugcaaauuuuaaacuguaaaguucaau

SEQ ID NO: 380981 - RNA, 64 nt, Homo Sapiens
ccauuugcaggaucugucugcuugaaauggaaagucaugcaaucuucuacagcuaggacuuaac

SEQ ID NO: 380982 - RNA, 64 nt, Homo Sapiens; identical to SEQ ID NO: 184094

SEQ ID NO: 380983 - RNA, 64 nt, Homo Sapiens; identical to SEQ ID NO: 184095

SEQ ID NO: 380984 - RNA, 64 nt, Homo Sapiens; identical to SEQ ID NO: 184096

SEQ ID NO: 380985 - RNA, 64 nt, Homo Sapiens; identical to SEQ ID NO: 184097

SEQ ID NO: 380986 - RNA, 64 nt, Homo Sapiens; identical to SEQ ID NO: 184098

SEQ ID NO: 380987 - RNA, 64 nt, Homo Sapiens; identical to SEQ ID NO: 184099

SEQ ID NO: 380988 - RNA, 64 nt, Homo Sapiens; identical to SEQ ID NO: 184100

SEQ ID NO: 380989 - RNA, 64 nt, Homo Sapiens; identical to SEQ ID NO: 184101

SEQ ID NO: 380990 - RNA, 64 nt, Homo Sapiens; identical to SEQ ID NO: 184102

SEQ ID NO: 380991 - RNA, 64 nt, Homo Sapiens; identical to SEQ ID NO: 184103

SEQ ID NO: 380992 - RNA, 64 nt, Homo Sapiens; identical to SEQ ID NO: 184104

SEQ ID NO: 380993 - RNA, 64 nt, Homo Sapiens; identical to SEQ ID NO: 184105

SEQ ID NO: 380994 - RNA, 64 nt, Homo Sapiens; identical to SEQ ID NO: 184106

SEQ ID NO: 380995 - RNA, 64 nt, Homo Sapiens; identical to SEQ ID NO: 184107

SEQ ID NO: 380996 - RNA, 64 nt, Homo Sapiens; identical to SEQ ID NO: 184108

SEQ ID NO: 380997 - RNA, 64 nt, Homo Sapiens; identical to SEQ ID NO: 184109

SEQ ID NO: 380998 - RNA, 64 nt, Homo Sapiens; identical to SEQ ID NO: 184110

SEQ ID NO: 380999 - RNA, 64 nt, Homo Sapiens; identical to SEQ ID NO: 184111

SEQ ID NO: 381000 - RNA, 64 nt, Homo Sapiens; identical to SEQ ID NO: 184112

SEQ ID NO: 381001 - RNA, 64 nt, Homo Sapiens; identical to SEQ ID NO: 184113

SEQ ID NO: 381002 - RNA, 64 nt, Homo Sapiens; identical to SEQ ID NO: 184114

SEQ ID NO: 381003 - RNA, 64 nt, Homo Sapiens; identical to SEQ ID NO: 184115

SEQ ID NO: 381004 - RNA, 64 nt, Homo Sapiens; identical to SEQ ID NO: 184116

SEQ ID NO: 381005 - RNA, 64 nt, Homo Sapiens; identical to SEQ ID NO: 184117

SEQ ID NO: 381006 - RNA, 64 nt, Homo Sapiens; identical to SEQ ID NO: 184118

SEQ ID NO: 381007 - RNA, 64 nt, Homo Sapiens; identical to SEQ ID NO: 184119

SEQ ID NO: 381008 - RNA, 64 nt, Homo Sapiens; identical to SEQ ID NO: 184120

SEQ ID NO: 381009 - RNA, 64 nt, Homo Sapiens; identical to SEQ ID NO: 184121

SEQ ID NO: 381010 - RNA, 64 nt, Homo Sapiens; identical to SEQ ID NO: 361150

SEQ ID NO: 381011 - RNA, 64 nt, Homo Sapiens; identical to SEQ ID NO: 361151

SEQ ID NO: 381012 - RNA, 64 nt, Homo Sapiens; identical to SEQ ID NO: 361152

SEQ ID NO: 381013 - RNA, 64 nt, Homo Sapiens; identical to SEQ ID NO: 361153

SEQ ID NO: 381014 - RNA, 64 nt, Homo Sapiens; identical to SEQ ID NO: 361154

SEQ ID NO: 381015 - RNA, 64 nt, Homo Sapiens; identical to SEQ ID NO: 361155

SEQ ID NO: 381016 - RNA, 64 nt, Homo Sapiens; identical to SEQ ID NO: 361156

SEQ ID NO: 381017 - RNA, 64 nt, Homo Sapiens; identical to SEQ ID NO: 361157

SEQ ID NO: 381018 - RNA, 64 nt, Homo Sapiens; identical to SEQ ID NO: 361158

SEQ ID NO: 381019 - RNA, 64 nt, Homo Sapiens; identical to SEQ ID NO: 361159

SEQ ID NO: 381020 - RNA, 64 nt, Homo Sapiens; identical to SEQ ID NO: 361160

SEQ ID NO: 381021 - RNA, 64 nt, Homo Sapiens; identical to SEQ ID NO: 361161

SEQ ID NO: 381022 - RNA, 64 nt, Homo Sapiens; identical to SEQ ID NO: 361162

SEQ ID NO: 381023 - RNA, 64 nt, Homo Sapiens; identical to SEQ ID NO: 361163

SEQ ID NO: 381024 - RNA, 64 nt, Homo Sapiens; identical to SEQ ID NO: 361164

SEQ ID NO: 381025 - RNA, 64 nt, Homo Sapiens; identical to SEQ ID NO: 361165

SEQ ID NO: 381026 - RNA, 64 nt, Homo Sapiens; identical to SEQ ID NO: 361166

SEQ ID NO: 381027 - RNA, 64 nt, Homo Sapiens; identical to SEQ ID NO: 361167

SEQ ID NO: 381028 - RNA, 64 nt, Homo Sapiens; identical to SEQ ID NO: 361168

SEQ ID NO: 381029 - RNA, 64 nt, Homo Sapiens; identical to SEQ ID NO: 361169

SEQ ID NO: 381030 - RNA, 64 nt, Homo Sapiens; identical to SEQ ID NO: 361170

SEQ ID NO: 381031 - RNA, 64 nt, Homo Sapiens; identical to SEQ ID NO: 361171

SEQ ID NO: 381032 - RNA, 63 nt, Homo Sapiens
accugaggugucauaucuuuauaaagaaacugcagcgccuuagcaucucuauaaaaagaaaaa

SEQ ID NO: 381033 - RNA, 64 nt, Homo Sapiens
gauguucuagcauggcugccgacacaagccuucggcgccuuaagagcuugaccgugaggccaga

SEQ ID NO: 381034 - RNA, 64 nt, Homo Sapiens
gauaggucaucucagcccaagcauggaggcaguggcgccuuaugucauaaccaaaguuguaggg

SEQ ID NO: 381035 - RNA, 64 nt, Homo Sapiens
guaucaauuuuaggagcuuuaaaaacuuaagguggcgccuuauaaaugcacaguugcagccugg

SEQ ID NO: 381036 - RNA, 64 nt, Homo Sapiens
ccuccguauuucagacugaauggggguggggggggcgccuuagguacuuauuccagaugccuuc

SEQ ID NO: 381037 - RNA, 64 nt, Homo Sapiens
aaucauaaauucucaucagagggucuagggagucgcgccuuacaugcccaaauuccuaccuaag

SEQ ID NO: 381038 - RNA, 64 nt, Homo Sapiens
cccgucccgccccaggcccgggccugacaagaaagcgccuuacguuucuccgccccccgcccgc

SEQ ID NO: 381039 - RNA, 64 nt, Homo Sapiens
ucgagucggauccguguuggaggcccggccgagagcgccuuagccaaguugcccucuccgagcu

SEQ ID NO: 381040 - RNA, 64 nt, Homo Sapiens
gcauaucaaaugguaguuagaagggucggcuuuugcgccuuaaauuagauuuuuuagaaaaacu

SEQ ID NO: 381041 - RNA, 64 nt, Homo Sapiens
ucugccccugugguagagcccacuauaggcccaggcgccuuacgugcuucuccccuggaccuau

SEQ ID NO: 381042 - RNA, 64 nt, Homo Sapiens
gguuugccaaagccauccuugccucggacccggcgcgccuuacuccuucaccaguaugagggua

SEQ ID NO: 381043 - RNA, 64 nt, Homo Sapiens
ugagaagcauaaguguaacuggaagccuugccuugcgccuuaggccauguuuauuuggguagga

SEQ ID NO: 381044 - RNA, 64 nt, Homo Sapiens
aguagcuccagggaacgcauguggauccuagacagcgccuuaucuaugauugaguguccgugua

SEQ ID NO: 381045 - RNA, 64 nt, Homo Sapiens
uuauuggacuaucuaauaucgcuccguugcacgggcgccuuaagucccgugcgcgcggauccuc

SEQ ID NO: 381046 - RNA, 64 nt, Homo Sapiens
gccccuaagccagcaugggcaccugugagucugggcgccuuagaauaaaggagcucuucacagc

SEQ ID NO: 381047 - RNA, 64 nt, Homo Sapiens
guucuugaagaaaggcaaaucugacuuuuucugugcgccuuaaacaauucuuguaacuuucuuc

SEQ ID NO: 381048 - RNA, 64 nt, Homo Sapiens
uaccacauccuuagagccaucaccuggcacgcaggcgccuuacauucuacgguagaacgugggg

SEQ ID NO: 381049 - RNA, 64 nt, Homo Sapiens
uuccugguugcacaaaaggugaccaugggauccggcgccuuacuccuagaaagcuacccugguu

SEQ ID NO: 381050 - RNA, 64 nt, Homo Sapiens
cugcugcccugggcuuuugggguccuggccgauggcgccuuaccggggcugccccugccgugca

SEQ ID NO: 381051 - RNA, 64 nt, Homo Sapiens
agucaugauaggacaauauuuuaugugugugugugcgccuuauguauauaagcauauauauaau

SEQ ID NO: 381052 - RNA, 64 nt, Homo Sapiens
uucucugugauacaacaauaguauuucuucaaaugcgccuuaugcuacuuaucucagaaacagg

SEQ ID NO: 381053 - RNA, 64 nt, Homo Sapiens
cagacagcagcaagccggauccaccaacaccgcagcgccuuaugaccccggaaccgagccagcc

SEQ ID NO: 381054 - RNA, 64 nt, Homo Sapiens
uugggaggccucauuggccacguuccuggaggcggcgccuuagaaaggaaugggccuggcuuuc

SEQ ID NO: 381055 - RNA, 64 nt, Homo Sapiens; identical to SEQ ID NO: 45477

SEQ ID NO: 381056 - RNA, 64 nt, Homo Sapiens; identical to SEQ ID NO: 45478

SEQ ID NO: 381057 - RNA, 64 nt, Homo Sapiens; identical to SEQ ID NO: 45479

SEQ ID NO: 381058 - RNA, 64 nt, Homo Sapiens; identical to SEQ ID NO: 45480

SEQ ID NO: 381059 - RNA, 64 nt, Homo Sapiens; identical to SEQ ID NO: 45481

SEQ ID NO: 381060 - RNA, 64 nt, Homo Sapiens; identical to SEQ ID NO: 45482

SEQ ID NO: 381061 - RNA, 64 nt, Homo Sapiens; identical to SEQ ID NO: 45483

SEQ ID NO: 381062 - RNA, 64 nt, Homo Sapiens; identical to SEQ ID NO: 45484

SEQ ID NO: 381063 - RNA, 64 nt, Homo Sapiens; identical to SEQ ID NO: 45485

SEQ ID NO: 381064 - RNA, 64 nt, Homo Sapiens; identical to SEQ ID NO: 45486

SEQ ID NO: 381065 - RNA, 64 nt, Homo Sapiens; identical to SEQ ID NO: 45487

SEQ ID NO: 381066 - RNA, 56 nt, Homo Sapiens; identical to SEQ ID NO: 45488

SEQ ID NO: 381067 - RNA, 64 nt, Homo Sapiens; identical to SEQ ID NO: 45489

SEQ ID NO: 381068 - RNA, 64 nt, Homo Sapiens; identical to SEQ ID NO: 45490

SEQ ID NO: 381069 - RNA, 64 nt, Homo Sapiens; identical to SEQ ID NO: 45491

SEQ ID NO: 381070 - RNA, 64 nt, Homo Sapiens; identical to SEQ ID NO: 45492

SEQ ID NO: 381071 - RNA, 64 nt, Homo Sapiens; identical to SEQ ID NO: 45493

SEQ ID NO: 381072 - RNA, 64 nt, Homo Sapiens; identical to SEQ ID NO: 45494

SEQ ID NO: 381073 - RNA, 64 nt, Homo Sapiens; identical to SEQ ID NO: 45495

SEQ ID NO: 381074 - RNA, 64 nt, Homo Sapiens; identical to SEQ ID NO: 45496

SEQ ID NO: 381075 - RNA, 64 nt, Homo Sapiens; identical to SEQ ID NO: 45497

SEQ ID NO: 381076 - RNA, 64 nt, Homo Sapiens; identical to SEQ ID NO: 45498

SEQ ID NO: 381077 - RNA, 64 nt, Homo Sapiens; identical to SEQ ID NO: 45499

SEQ ID NO: 381078 - RNA, 64 nt, Homo Sapiens; identical to SEQ ID NO: 45500

SEQ ID NO: 381079 - RNA, 64 nt, Homo Sapiens; identical to SEQ ID NO: 45501

SEQ ID NO: 381080 - RNA, 64 nt, Homo Sapiens; identical to SEQ ID NO: 45502

SEQ ID NO: 381081 - RNA, 64 nt, Homo Sapiens; identical to SEQ ID NO: 45503

SEQ ID NO: 381082 - RNA, 64 nt, Homo Sapiens; identical to SEQ ID NO: 45504

SEQ ID NO: 381083 - RNA, 64 nt, Homo Sapiens; identical to SEQ ID NO: 45505

SEQ ID NO: 381084 - RNA, 64 nt, Homo Sapiens; identical to SEQ ID NO: 45506

SEQ ID NO: 381085 - RNA, 64 nt, Homo Sapiens; identical to SEQ ID NO: 45507

SEQ ID NO: 381086 - RNA, 64 nt, Homo Sapiens; identical to SEQ ID NO: 45508

SEQ ID NO: 381087 - RNA, 64 nt, Homo Sapiens; identical to SEQ ID NO: 45509

SEQ ID NO: 381088 - RNA, 64 nt, Homo Sapiens; identical to SEQ ID NO: 45510

SEQ ID NO: 381089 - RNA, 64 nt, Homo Sapiens; identical to SEQ ID NO: 45511

SEQ ID NO: 381090 - RNA, 64 nt, Homo Sapiens; identical to SEQ ID NO: 45512

SEQ ID NO: 381091 - RNA, 64 nt, Homo Sapiens; identical to SEQ ID NO: 45513

SEQ ID NO: 381092 - RNA, 64 nt, Homo Sapiens; identical to SEQ ID NO: 45514

SEQ ID NO: 381093 - RNA, 64 nt, Homo Sapiens; identical to SEQ ID NO: 45515

SEQ ID NO: 381094 - RNA, 64 nt, Homo Sapiens; identical to SEQ ID NO: 45516

SEQ ID NO: 381095 - RNA, 64 nt, Homo Sapiens; identical to SEQ ID NO: 45517

SEQ ID NO: 381096 - RNA, 64 nt, Homo Sapiens; identical to SEQ ID NO: 45518

SEQ ID NO: 381097 - RNA, 64 nt, Homo Sapiens; identical to SEQ ID NO: 45519

SEQ ID NO: 381098 - RNA, 64 nt, Homo Sapiens; identical to SEQ ID NO: 45520

SEQ ID NO: 381099 - RNA, 64 nt, Homo Sapiens; identical to SEQ ID NO: 45521

SEQ ID NO: 381100 - RNA, 64 nt, Homo Sapiens; identical to SEQ ID NO: 45522

SEQ ID NO: 381101 - RNA, 64 nt, Homo Sapiens; identical to SEQ ID NO: 45523

SEQ ID NO: 381102 - RNA, 64 nt, Homo Sapiens; identical to SEQ ID NO: 45524

SEQ ID NO: 381103 - RNA, 64 nt, Homo Sapiens; identical to SEQ ID NO: 45525

SEQ ID NO: 381104 - RNA, 64 nt, Homo Sapiens; identical to SEQ ID NO: 45526

SEQ ID NO: 381105 - RNA, 64 nt, Homo Sapiens; identical to SEQ ID NO: 45527

SEQ ID NO: 381106 - RNA, 64 nt, Homo Sapiens; identical to SEQ ID NO: 45528

SEQ ID NO: 381107 - RNA, 64 nt, Homo Sapiens; identical to SEQ ID NO: 45529

SEQ ID NO: 381108 - RNA, 64 nt, Homo Sapiens; identical to SEQ ID NO: 45530

SEQ ID NO: 381109 - RNA, 64 nt, Homo Sapiens; identical to SEQ ID NO: 45531

SEQ ID NO: 381110 - RNA, 64 nt, Homo Sapiens; identical to SEQ ID NO: 45532

SEQ ID NO: 381111 - RNA, 64 nt, Homo Sapiens; identical to SEQ ID NO: 45533

SEQ ID NO: 381112 - RNA, 64 nt, Homo Sapiens; identical to SEQ ID NO: 45534

SEQ ID NO: 381113 - RNA, 64 nt, Homo Sapiens; identical to SEQ ID NO: 45535

SEQ ID NO: 381114 - RNA, 64 nt, Homo Sapiens; identical to SEQ ID NO: 45536

SEQ ID NO: 381115 - RNA, 64 nt, Homo Sapiens; identical to SEQ ID NO: 45537

SEQ ID NO: 381116 - RNA, 64 nt, Homo Sapiens; identical to SEQ ID NO: 45538

SEQ ID NO: 381117 - RNA, 64 nt, Homo Sapiens; identical to SEQ ID NO: 45539

SEQ ID NO: 381118 - RNA, 64 nt, Homo Sapiens; identical to SEQ ID NO: 45540

SEQ ID NO: 381119 - RNA, 64 nt, Homo Sapiens; identical to SEQ ID NO: 45541

SEQ ID NO: 381120 - RNA, 64 nt, Homo Sapiens; identical to SEQ ID NO: 45542

SEQ ID NO: 381121 - RNA, 64 nt, Homo Sapiens; identical to SEQ ID NO: 45543

SEQ ID NO: 381122 - RNA, 64 nt, Homo Sapiens; identical to SEQ ID NO: 45544

SEQ ID NO: 381123 - RNA, 64 nt, Homo Sapiens; identical to SEQ ID NO: 45545

SEQ ID NO: 381124 - RNA, 64 nt, Homo Sapiens; identical to SEQ ID NO: 45546

SEQ ID NO: 381125 - RNA, 64 nt, Homo Sapiens; identical to SEQ ID NO: 45547

SEQ ID NO: 381126 - RNA, 64 nt, Homo Sapiens; identical to SEQ ID NO: 45548

SEQ ID NO: 381127 - RNA, 64 nt, Homo Sapiens; identical to SEQ ID NO: 45549

SEQ ID NO: 381128 - RNA, 64 nt, Homo Sapiens; identical to SEQ ID NO: 45550

SEQ ID NO: 381129 - RNA, 64 nt, Homo Sapiens; identical to SEQ ID NO: 45551

SEQ ID NO: 381130 - RNA, 64 nt, Homo Sapiens; identical to SEQ ID NO: 45552

SEQ ID NO: 381131 - RNA, 64 nt, Homo Sapiens; identical to SEQ ID NO: 45553

SEQ ID NO: 381132 - RNA, 64 nt, Homo Sapiens; identical to SEQ ID NO: 45554

SEQ ID NO: 381133 - RNA, 64 nt, Homo Sapiens; identical to SEQ ID NO: 45555

SEQ ID NO: 381134 - RNA, 64 nt, Homo Sapiens; identical to SEQ ID NO: 45556

SEQ ID NO: 381135 - RNA, 64 nt, Homo Sapiens; identical to SEQ ID NO: 45557

SEQ ID NO: 381136 - RNA, 64 nt, Homo Sapiens; identical to SEQ ID NO: 45558

SEQ ID NO: 381137 - RNA, 64 nt, Homo Sapiens; identical to SEQ ID NO: 45559

SEQ ID NO: 381138 - RNA, 64 nt, Homo Sapiens; identical to SEQ ID NO: 45560

SEQ ID NO: 381139 - RNA, 64 nt, Homo Sapiens; identical to SEQ ID NO: 45561

SEQ ID NO: 381140 - RNA, 64 nt, Homo Sapiens; identical to SEQ ID NO: 45562

SEQ ID NO: 381141 - RNA, 64 nt, Homo Sapiens; identical to SEQ ID NO: 45563

SEQ ID NO: 381142 - RNA, 64 nt, Homo Sapiens; identical to SEQ ID NO: 45564

SEQ ID NO: 381143 - RNA, 64 nt, Homo Sapiens; identical to SEQ ID NO: 45565

SEQ ID NO: 381144 - RNA, 64 nt, Homo Sapiens; identical to SEQ ID NO: 45566

SEQ ID NO: 381145 - RNA, 64 nt, Homo Sapiens; identical to SEQ ID NO: 45567

SEQ ID NO: 381146 - RNA, 64 nt, Homo Sapiens; identical to SEQ ID NO: 45568

SEQ ID NO: 381147 - RNA, 64 nt, Homo Sapiens; identical to SEQ ID NO: 45569

SEQ ID NO: 381148 - RNA, 64 nt, Homo Sapiens; identical to SEQ ID NO: 45570

SEQ ID NO: 381149 - RNA, 64 nt, Homo Sapiens; identical to SEQ ID NO: 45571

SEQ ID NO: 381150 - RNA, 64 nt, Homo Sapiens; identical to SEQ ID NO: 45572

SEQ ID NO: 381151 - RNA, 64 nt, Homo Sapiens; identical to SEQ ID NO: 45573

SEQ ID NO: 381152 - RNA, 64 nt, Homo Sapiens; identical to SEQ ID NO: 45574

SEQ ID NO: 381153 - RNA, 64 nt, Homo Sapiens; identical to SEQ ID NO: 45575

SEQ ID NO: 381154 - RNA, 64 nt, Homo Sapiens; identical to SEQ ID NO: 45576

SEQ ID NO: 381155 - RNA, 64 nt, Homo Sapiens; identical to SEQ ID NO: 45577

SEQ ID NO: 381156 - RNA, 64 nt, Homo Sapiens; identical to SEQ ID NO: 45578

SEQ ID NO: 381157 - RNA, 64 nt, Homo Sapiens; identical to SEQ ID NO: 45579

SEQ ID NO: 381158 - RNA, 64 nt, Homo Sapiens; identical to SEQ ID NO: 45580

SEQ ID NO: 381159 - RNA, 64 nt, Homo Sapiens; identical to SEQ ID NO: 45581

SEQ ID NO: 381160 - RNA, 64 nt, Homo Sapiens; identical to SEQ ID NO: 45582

SEQ ID NO: 381161 - RNA, 64 nt, Homo Sapiens; identical to SEQ ID NO: 45583

SEQ ID NO: 381162 - RNA, 64 nt, Homo Sapiens; identical to SEQ ID NO: 45584

SEQ ID NO: 381163 - RNA, 64 nt, Homo Sapiens; identical to SEQ ID NO: 45585

SEQ ID NO: 381164 - RNA, 64 nt, Homo Sapiens; identical to SEQ ID NO: 45586

SEQ ID NO: 381165 - RNA, 64 nt, Homo Sapiens; identical to SEQ ID NO: 45587

SEQ ID NO: 381166 - RNA, 64 nt, Homo Sapiens; identical to SEQ ID NO: 45588

SEQ ID NO: 381167 - RNA, 64 nt, Homo Sapiens; identical to SEQ ID NO: 45589

SEQ ID NO: 381168 - RNA, 64 nt, Homo Sapiens; identical to SEQ ID NO: 45590

SEQ ID NO: 381169 - RNA, 64 nt, Homo Sapiens; identical to SEQ ID NO: 45591

SEQ ID NO: 381170 - RNA, 64 nt, Homo Sapiens; identical to SEQ ID NO: 45592

SEQ ID NO: 381171 - RNA, 64 nt, Homo Sapiens; identical to SEQ ID NO: 45593

SEQ ID NO: 381172 - RNA, 64 nt, Homo Sapiens; identical to SEQ ID NO: 45594

SEQ ID NO: 381173 - RNA, 64 nt, Homo Sapiens; identical to SEQ ID NO: 45595

SEQ ID NO: 381174 - RNA, 64 nt, Homo Sapiens; identical to SEQ ID NO: 45596

SEQ ID NO: 381175 - RNA, 64 nt, Homo Sapiens; identical to SEQ ID NO: 45597

SEQ ID NO: 381176 - RNA, 64 nt, Homo Sapiens; identical to SEQ ID NO: 45598

SEQ ID NO: 381177 - RNA, 64 nt, Homo Sapiens; identical to SEQ ID NO: 45599

SEQ ID NO: 381178 - RNA, 64 nt, Homo Sapiens; identical to SEQ ID NO: 45600

SEQ ID NO: 381179 - RNA, 64 nt, Homo Sapiens; identical to SEQ ID NO: 45601

SEQ ID NO: 381180 - RNA, 64 nt, Homo Sapiens; identical to SEQ ID NO: 45602

SEQ ID NO: 381181 - RNA, 64 nt, Homo Sapiens; identical to SEQ ID NO: 45603

SEQ ID NO: 381182 - RNA, 64 nt, Homo Sapiens; identical to SEQ ID NO: 45604

SEQ ID NO: 381183 - RNA, 64 nt, Homo Sapiens; identical to SEQ ID NO: 45605

SEQ ID NO: 381184 - RNA, 64 nt, Homo Sapiens; identical to SEQ ID NO: 45606

SEQ ID NO: 381185 - RNA, 64 nt, Homo Sapiens; identical to SEQ ID NO: 45607

SEQ ID NO: 381186 - RNA, 64 nt, Homo Sapiens; identical to SEQ ID NO: 45608

SEQ ID NO: 381187 - RNA, 64 nt, Homo Sapiens; identical to SEQ ID NO: 45609

SEQ ID NO: 381188 - RNA, 64 nt, Homo Sapiens; identical to SEQ ID NO: 45610

SEQ ID NO: 381189 - RNA, 64 nt, Homo Sapiens; identical to SEQ ID NO: 45611

SEQ ID NO: 381190 - RNA, 64 nt, Homo Sapiens; identical to SEQ ID NO: 45612

SEQ ID NO: 381191 - RNA, 64 nt, Homo Sapiens; identical to SEQ ID NO: 45613

SEQ ID NO: 381192 - RNA, 64 nt, Homo Sapiens; identical to SEQ ID NO: 45614

SEQ ID NO: 381193 - RNA, 64 nt, Homo Sapiens; identical to SEQ ID NO: 45615

SEQ ID NO: 381194 - RNA, 64 nt, Homo Sapiens; identical to SEQ ID NO: 45616

SEQ ID NO: 381195 - RNA, 64 nt, Homo Sapiens; identical to SEQ ID NO: 45617

SEQ ID NO: 381196 - RNA, 64 nt, Homo Sapiens; identical to SEQ ID NO: 45618

SEQ ID NO: 381197 - RNA, 64 nt, Homo Sapiens; identical to SEQ ID NO: 45619

SEQ ID NO: 381198 - RNA, 64 nt, Homo Sapiens; identical to SEQ ID NO: 45620

SEQ ID NO: 381199 - RNA, 64 nt, Homo Sapiens; identical to SEQ ID NO: 45621

SEQ ID NO: 381200 - RNA, 64 nt, Homo Sapiens; identical to SEQ ID NO: 45622

SEQ ID NO: 381201 - RNA, 64 nt, Homo Sapiens; identical to SEQ ID NO: 45623

SEQ ID NO: 381202 - RNA, 64 nt, Homo Sapiens; identical to SEQ ID NO: 45624

SEQ ID NO: 381203 - RNA, 64 nt, Homo Sapiens; identical to SEQ ID NO: 45625

SEQ ID NO: 381204 - RNA, 64 nt, Homo Sapiens; identical to SEQ ID NO: 45626

SEQ ID NO: 381205 - RNA, 64 nt, Homo Sapiens; identical to SEQ ID NO: 45627

SEQ ID NO: 381206 - RNA, 64 nt, Homo Sapiens; identical to SEQ ID NO: 45628

SEQ ID NO: 381207 - RNA, 64 nt, Homo Sapiens; identical to SEQ ID NO: 45629

SEQ ID NO: 381208 - RNA, 64 nt, Homo Sapiens; identical to SEQ ID NO: 45630

SEQ ID NO: 381209 - RNA, 64 nt, Homo Sapiens; identical to SEQ ID NO: 45631

SEQ ID NO: 381210 - RNA, 64 nt, Homo Sapiens; identical to SEQ ID NO: 45632

SEQ ID NO: 381211 - RNA, 64 nt, Homo Sapiens; identical to SEQ ID NO: 45633

SEQ ID NO: 381212 - RNA, 64 nt, Homo Sapiens; identical to SEQ ID NO: 45634

SEQ ID NO: 381213 - RNA, 64 nt, Homo Sapiens; identical to SEQ ID NO: 45635

SEQ ID NO: 381214 - RNA, 64 nt, Homo Sapiens; identical to SEQ ID NO: 45636

SEQ ID NO: 381215 - RNA, 64 nt, Homo Sapiens; identical to SEQ ID NO: 45637

SEQ ID NO: 381216 - RNA, 64 nt, Homo Sapiens; identical to SEQ ID NO: 45638

SEQ ID NO: 381217 - RNA, 64 nt, Homo Sapiens; identical to SEQ ID NO: 45639

SEQ ID NO: 381218 - RNA, 64 nt, Homo Sapiens; identical to SEQ ID NO: 45640

SEQ ID NO: 381219 - RNA, 64 nt, Homo Sapiens; identical to SEQ ID NO: 45641

SEQ ID NO: 381220 - RNA, 64 nt, Homo Sapiens; identical to SEQ ID NO: 45642

SEQ ID NO: 381221 - RNA, 64 nt, Homo Sapiens; identical to SEQ ID NO: 45643

SEQ ID NO: 381222 - RNA, 64 nt, Homo Sapiens; identical to SEQ ID NO: 45644

SEQ ID NO: 381223 - RNA, 64 nt, Homo Sapiens; identical to SEQ ID NO: 45645

SEQ ID NO: 381224 - RNA, 64 nt, Homo Sapiens; identical to SEQ ID NO: 45646

SEQ ID NO: 381225 - RNA, 64 nt, Homo Sapiens; identical to SEQ ID NO: 45647

SEQ ID NO: 381226 - RNA, 64 nt, Homo Sapiens; identical to SEQ ID NO: 45648

SEQ ID NO: 381227 - RNA, 64 nt, Homo Sapiens; identical to SEQ ID NO: 45649

SEQ ID NO: 381228 - RNA, 64 nt, Homo Sapiens; identical to SEQ ID NO: 45650

SEQ ID NO: 381229 - RNA, 64 nt, Homo Sapiens; identical to SEQ ID NO: 45651

SEQ ID NO: 381230 - RNA, 64 nt, Homo Sapiens; identical to SEQ ID NO: 45652

SEQ ID NO: 381231 - RNA, 64 nt, Homo Sapiens; identical to SEQ ID NO: 45653

SEQ ID NO: 381232 - RNA, 64 nt, Homo Sapiens; identical to SEQ ID NO: 45654

SEQ ID NO: 381233 - RNA, 64 nt, Homo Sapiens; identical to SEQ ID NO: 45655

SEQ ID NO: 381234 - RNA, 64 nt, Homo Sapiens; identical to SEQ ID NO: 201839

SEQ ID NO: 381235 - RNA, 64 nt, Homo Sapiens; identical to SEQ ID NO: 201840

SEQ ID NO: 381236 - RNA, 64 nt, Homo Sapiens; identical to SEQ ID NO: 201841

SEQ ID NO: 381237 - RNA, 64 nt, Homo Sapiens; identical to SEQ ID NO: 201842

SEQ ID NO: 381238 - RNA, 64 nt, Homo Sapiens; identical to SEQ ID NO: 201843

SEQ ID NO: 381239 - RNA, 64 nt, Homo Sapiens; identical to SEQ ID NO: 201844

SEQ ID NO: 381240 - RNA, 64 nt, Homo Sapiens; identical to SEQ ID NO: 201845

SEQ ID NO: 381241 - RNA, 64 nt, Homo Sapiens; identical to SEQ ID NO: 201846

SEQ ID NO: 381242 - RNA, 64 nt, Homo Sapiens; identical to SEQ ID NO: 89598

SEQ ID NO: 381243 - RNA, 64 nt, Homo Sapiens; identical to SEQ ID NO: 89599

SEQ ID NO: 381244 - RNA, 64 nt, Homo Sapiens; identical to SEQ ID NO: 89600

SEQ ID NO: 381245 - RNA, 64 nt, Homo Sapiens; identical to SEQ ID NO: 89601

SEQ ID NO: 381246 - RNA, 64 nt, Homo Sapiens; identical to SEQ ID NO: 89602

SEQ ID NO: 381247 - RNA, 64 nt, Homo Sapiens; identical to SEQ ID NO: 89603

SEQ ID NO: 381248 - RNA, 64 nt, Homo Sapiens; identical to SEQ ID NO: 89604

SEQ ID NO: 381249 - RNA, 64 nt, Homo Sapiens; identical to SEQ ID NO: 89605

SEQ ID NO: 381250 - RNA, 64 nt, Homo Sapiens; identical to SEQ ID NO: 89606

SEQ ID NO: 381251 - RNA, 64 nt, Homo Sapiens; identical to SEQ ID NO: 89607

SEQ ID NO: 381252 - RNA, 64 nt, Homo Sapiens; identical to SEQ ID NO: 89608

SEQ ID NO: 381253 - RNA, 64 nt, Homo Sapiens; identical to SEQ ID NO: 89609

SEQ ID NO: 381254 - RNA, 64 nt, Homo Sapiens; identical to SEQ ID NO: 89610

SEQ ID NO: 381255 - RNA, 64 nt, Homo Sapiens; identical to SEQ ID NO: 89611

SEQ ID NO: 381256 - RNA, 64 nt, Homo Sapiens; identical to SEQ ID NO: 89612

SEQ ID NO: 381257 - RNA, 64 nt, Homo Sapiens; identical to SEQ ID NO: 89613

SEQ ID NO: 381258 - RNA, 64 nt, Homo Sapiens; identical to SEQ ID NO: 89614

SEQ ID NO: 381259 - RNA, 64 nt, Homo Sapiens; identical to SEQ ID NO: 89615

SEQ ID NO: 381260 - RNA, 64 nt, Homo Sapiens; identical to SEQ ID NO: 89616

SEQ ID NO: 381261 - RNA, 64 nt, Homo Sapiens; identical to SEQ ID NO: 89617

SEQ ID NO: 381262 - RNA, 64 nt, Homo Sapiens; identical to SEQ ID NO: 89618

SEQ ID NO: 381263 - RNA, 64 nt, Homo Sapiens; identical to SEQ ID NO: 89619

SEQ ID NO: 381264 - RNA, 64 nt, Homo Sapiens; identical to SEQ ID NO: 89620

SEQ ID NO: 381265 - RNA, 64 nt, Homo Sapiens; identical to SEQ ID NO: 89621

SEQ ID NO: 381266 - RNA, 64 nt, Homo Sapiens; identical to SEQ ID NO: 89622

SEQ ID NO: 381267 - RNA, 64 nt, Homo Sapiens; identical to SEQ ID NO: 89623

SEQ ID NO: 381268 - RNA, 64 nt, Homo Sapiens; identical to SEQ ID NO: 89624

SEQ ID NO: 381269 - RNA, 64 nt, Homo Sapiens; identical to SEQ ID NO: 89625

SEQ ID NO: 381270 - RNA, 64 nt, Homo Sapiens; identical to SEQ ID NO: 89626

SEQ ID NO: 381271 - RNA, 64 nt, Homo Sapiens; identical to SEQ ID NO: 89627

SEQ ID NO: 381272 - RNA, 64 nt, Homo Sapiens; identical to SEQ ID NO: 89628

SEQ ID NO: 381273 - RNA, 64 nt, Homo Sapiens; identical to SEQ ID NO: 89629

SEQ ID NO: 381274 - RNA, 64 nt, Homo Sapiens; identical to SEQ ID NO: 89630

SEQ ID NO: 381275 - RNA, 64 nt, Homo Sapiens; identical to SEQ ID NO: 89631

SEQ ID NO: 381276 - RNA, 64 nt, Homo Sapiens; identical to SEQ ID NO: 89632

SEQ ID NO: 381277 - RNA, 64 nt, Homo Sapiens; identical to SEQ ID NO: 89633

SEQ ID NO: 381278 - RNA, 64 nt, Homo Sapiens; identical to SEQ ID NO: 201839

SEQ ID NO: 381279 - RNA, 64 nt, Homo Sapiens; identical to SEQ ID NO: 201840

SEQ ID NO: 381280 - RNA, 64 nt, Homo Sapiens; identical to SEQ ID NO: 201841

SEQ ID NO: 381281 - RNA, 64 nt, Homo Sapiens; identical to SEQ ID NO: 201842

SEQ ID NO: 381282 - RNA, 64 nt, Homo Sapiens; identical to SEQ ID NO: 201843

SEQ ID NO: 381283 - RNA, 64 nt, Homo Sapiens; identical to SEQ ID NO: 201844

SEQ ID NO: 381284 - RNA, 64 nt, Homo Sapiens; identical to SEQ ID NO: 201845

SEQ ID NO: 381285 - RNA, 64 nt, Homo Sapiens; identical to SEQ ID NO: 201846

SEQ ID NO: 381286 - RNA, 64 nt, Homo Sapiens; identical to SEQ ID NO: 89598

SEQ ID NO: 381287 - RNA, 64 nt, Homo Sapiens; identical to SEQ ID NO: 89599

SEQ ID NO: 381288 - RNA, 64 nt, Homo Sapiens; identical to SEQ ID NO: 89600

SEQ ID NO: 381289 - RNA, 64 nt, Homo Sapiens; identical to SEQ ID NO: 89601

SEQ ID NO: 381290 - RNA, 64 nt, Homo Sapiens; identical to SEQ ID NO: 89602

SEQ ID NO: 381291 - RNA, 64 nt, Homo Sapiens; identical to SEQ ID NO: 89603

SEQ ID NO: 381292 - RNA, 64 nt, Homo Sapiens; identical to SEQ ID NO: 89604

SEQ ID NO: 381293 - RNA, 64 nt, Homo Sapiens; identical to SEQ ID NO: 89605

SEQ ID NO: 381294 - RNA, 64 nt, Homo Sapiens; identical to SEQ ID NO: 89606

SEQ ID NO: 381295 - RNA, 64 nt, Homo Sapiens; identical to SEQ ID NO: 89607

SEQ ID NO: 381296 - RNA, 64 nt, Homo Sapiens; identical to SEQ ID NO: 89608

SEQ ID NO: 381297 - RNA, 64 nt, Homo Sapiens; identical to SEQ ID NO: 89609

SEQ ID NO: 381298 - RNA, 64 nt, Homo Sapiens; identical to SEQ ID NO: 89610

SEQ ID NO: 381299 - RNA, 64 nt, Homo Sapiens; identical to SEQ ID NO: 89611

SEQ ID NO: 381300 - RNA, 64 nt, Homo Sapiens; identical to SEQ ID NO: 89612

SEQ ID NO: 381301 - RNA, 64 nt, Homo Sapiens; identical to SEQ ID NO: 89613

SEQ ID NO: 381302 - RNA, 64 nt, Homo Sapiens; identical to SEQ ID NO: 89614

SEQ ID NO: 381303 - RNA, 64 nt, Homo Sapiens; identical to SEQ ID NO: 89615

SEQ ID NO: 381304 - RNA, 64 nt, Homo Sapiens; identical to SEQ ID NO: 89616

SEQ ID NO: 381305 - RNA, 64 nt, Homo Sapiens; identical to SEQ ID NO: 89617

SEQ ID NO: 381306 - RNA, 64 nt, Homo Sapiens; identical to SEQ ID NO: 89618

SEQ ID NO: 381307 - RNA, 64 nt, Homo Sapiens; identical to SEQ ID NO: 89619

SEQ ID NO: 381308 - RNA, 64 nt, Homo Sapiens; identical to SEQ ID NO: 89620

SEQ ID NO: 381309 - RNA, 64 nt, Homo Sapiens; identical to SEQ ID NO: 89621

SEQ ID NO: 381310 - RNA, 64 nt, Homo Sapiens; identical to SEQ ID NO: 89622

SEQ ID NO: 381311 - RNA, 64 nt, Homo Sapiens; identical to SEQ ID NO: 89623

SEQ ID NO: 381312 - RNA, 64 nt, Homo Sapiens; identical to SEQ ID NO: 89624

SEQ ID NO: 381313 - RNA, 64 nt, Homo Sapiens; identical to SEQ ID NO: 89625

SEQ ID NO: 381314 - RNA, 64 nt, Homo Sapiens; identical to SEQ ID NO: 89626

SEQ ID NO: 381315 - RNA, 64 nt, Homo Sapiens; identical to SEQ ID NO: 89627

SEQ ID NO: 381316 - RNA, 64 nt, Homo Sapiens; identical to SEQ ID NO: 89628

SEQ ID NO: 381317 - RNA, 64 nt, Homo Sapiens; identical to SEQ ID NO: 89629

SEQ ID NO: 381318 - RNA, 64 nt, Homo Sapiens; identical to SEQ ID NO: 89630

SEQ ID NO: 381319 - RNA, 64 nt, Homo Sapiens; identical to SEQ ID NO: 89631

SEQ ID NO: 381320 - RNA, 64 nt, Homo Sapiens; identical to SEQ ID NO: 89632

SEQ ID NO: 381321 - RNA, 64 nt, Homo Sapiens; identical to SEQ ID NO: 89633

SEQ ID NO: 381322 - RNA, 64 nt, Homo Sapiens; identical to SEQ ID NO: 161976

SEQ ID NO: 381323 - RNA, 64 nt, Homo Sapiens; identical to SEQ ID NO: 161977

SEQ ID NO: 381324 - RNA, 64 nt, Homo Sapiens; identical to SEQ ID NO: 161978

SEQ ID NO: 381325 - RNA, 64 nt, Homo Sapiens; identical to SEQ ID NO: 161979

SEQ ID NO: 381326 - RNA, 64 nt, Homo Sapiens; identical to SEQ ID NO: 161980

SEQ ID NO: 381327 - RNA, 64 nt, Homo Sapiens; identical to SEQ ID NO: 161981

SEQ ID NO: 381328 - RNA, 64 nt, Homo Sapiens; identical to SEQ ID NO: 161982

SEQ ID NO: 381329 - RNA, 64 nt, Homo Sapiens; identical to SEQ ID NO: 161983

SEQ ID NO: 381330 - RNA, 64 nt, Homo Sapiens; identical to SEQ ID NO: 161984

SEQ ID NO: 381331 - RNA, 64 nt, Homo Sapiens; identical to SEQ ID NO: 161985

SEQ ID NO: 381332 - RNA, 64 nt, Homo Sapiens; identical to SEQ ID NO: 161986

SEQ ID NO: 381333 - RNA, 64 nt, Homo Sapiens; identical to SEQ ID NO: 161987

SEQ ID NO: 381334 - RNA, 64 nt, Homo Sapiens; identical to SEQ ID NO: 161988

SEQ ID NO: 381335 - RNA, 64 nt, Homo Sapiens; identical to SEQ ID NO: 161989

SEQ ID NO: 381336 - RNA, 64 nt, Homo Sapiens; identical to SEQ ID NO: 161990

SEQ ID NO: 381337 - RNA, 64 nt, Homo Sapiens; identical to SEQ ID NO: 161991

SEQ ID NO: 381338 - RNA, 64 nt, Homo Sapiens; identical to SEQ ID NO: 161992

SEQ ID NO: 381339 - RNA, 64 nt, Homo Sapiens; identical to SEQ ID NO: 161993

SEQ ID NO: 381340 - RNA, 64 nt, Homo Sapiens; identical to SEQ ID NO: 161994

SEQ ID NO: 381341 - RNA, 64 nt, Homo Sapiens; identical to SEQ ID NO: 161995

SEQ ID NO: 381342 - RNA, 64 nt, Homo Sapiens; identical to SEQ ID NO: 161996

SEQ ID NO: 381343 - RNA, 64 nt, Homo Sapiens; identical to SEQ ID NO: 161997

SEQ ID NO: 381344 - RNA, 64 nt, Homo Sapiens; identical to SEQ ID NO: 161998

SEQ ID NO: 381345 - RNA, 64 nt, Homo Sapiens; identical to SEQ ID NO: 161999

SEQ ID NO: 381346 - RNA, 64 nt, Homo Sapiens; identical to SEQ ID NO: 162000

SEQ ID NO: 381347 - RNA, 64 nt, Homo Sapiens; identical to SEQ ID NO: 162001

SEQ ID NO: 381348 - RNA, 64 nt, Homo Sapiens; identical to SEQ ID NO: 162002

SEQ ID NO: 381349 - RNA, 64 nt, Homo Sapiens; identical to SEQ ID NO: 162003

SEQ ID NO: 381350 - RNA, 64 nt, Homo Sapiens; identical to SEQ ID NO: 162004

SEQ ID NO: 381351 - RNA, 64 nt, Homo Sapiens; identical to SEQ ID NO: 162005

SEQ ID NO: 381352 - RNA, 64 nt, Homo Sapiens; identical to SEQ ID NO: 162006

SEQ ID NO: 381353 - RNA, 64 nt, Homo Sapiens; identical to SEQ ID NO: 162007

SEQ ID NO: 381354 - RNA, 64 nt, Homo Sapiens; identical to SEQ ID NO: 162008

SEQ ID NO: 381355 - RNA, 64 nt, Homo Sapiens
uaaucacucauaugguagaauuuuauaaacacauacaugauaccauccaaauucuugcuuuuaa

SEQ ID NO: 381356 - RNA, 64 nt, Homo Sapiens
uuggagauugaaagaugcuguaauuuagaaauuaacaugauaucuuaaauuaccuuuaugaaau

SEQ ID NO: 381357 - RNA, 64 nt, Homo Sapiens
ggcagcccuagaguucauagcuuuaaugugcugcacaugauacuaagcuauuuggauaguguag

SEQ ID NO: 381358 - RNA, 64 nt, Homo Sapiens
cuuuaugcucauaacugaugagagauuugagguuacaugauauguguuuaagccuuccacuguu

SEQ ID NO: 381359 - RNA, 64 nt, Homo Sapiens
uuccauaacagagacagccuauaaccuuuucauaacaugauagugauaguuuccuaaccuuuuc

SEQ ID NO: 381360 - RNA, 64 nt, Homo Sapiens
uuccuaaccuuuucauaaccauuagcuuuucauaacaugauaguuuguuuuuaaaagauucaau

SEQ ID NO: 381361 - RNA, 64 nt, Homo Sapiens
ucaaguuuuucauacuguacacauuucuuaaaacacaugauaccagcagcaacugaaaaugaau

SEQ ID NO: 381362 - RNA, 64 nt, Homo Sapiens
uuaagguacaucauuauuguaguuugaaaguuguacaugauaagacauuuuguuuuuacuguau

SEQ ID NO: 381363 - RNA, 64 nt, Homo Sapiens
cuuccauaaucuuuagcauuguucuuucagucagacaugauaugcgcaacauucagacaugaua

SEQ ID NO: 381364 - RNA, 64 nt, Homo Sapiens
ucuuucagucagacaugauaugcgcaacauucagacaugauaugcgcaucauucagacaugaua

SEQ ID NO: 381365 - RNA, 64 nt, Homo Sapiens
cgcaacauucagacaugauaugcgcaucauucagacaugauaugcggggucaaguucuuaaggg

SEQ ID NO: 381366 - RNA, 64 nt, Homo Sapiens
uaugaauggagacuaccgccccagcauuaguuucacaugauauacccuuuaaacccgaaucauu

SEQ ID NO: 381367 - RNA, 64 nt, Homo Sapiens
uggaaauuugggcuaaaacuuagaaaaaauucuuacaugauaacucagugaugcuuacucauag

SEQ ID NO: 381368 - RNA, 64 nt, Homo Sapiens
ugggaugaggugacuauucucacacaggaaccuaaugggccaacuuuucucacagaagaugaag

SEQ ID NO: 381369 - RNA, 64 nt, Homo Sapiens
ucuaugugguagguggaucaaaauggcuguacucaugggccagcaacaccaagagcccgauuuc

SEQ ID NO: 381370 - RNA, 64 nt, Homo Sapiens
aaggaagaccggcugguggagcugcugguguuuuaugggccaccuuucccgcugcgggaccaag

SEQ ID NO: 381371 - RNA, 64 nt, Homo Sapiens
ccugagcgggugccgaagcuacuggacuaugcugaugggccagcaggagccagccaaggccgcu

SEQ ID NO: 381372 - RNA, 64 nt, Homo Sapiens
gcauuccugcuucucaagggacacaguggccugcaugggccagcauggacccugggcugaucau

SEQ ID NO: 381373 - RNA, 64 nt, Homo Sapiens
cauuccugcuucucuggggacacagugggcccacaugggccagcauggacccugggcuagagca

SEQ ID NO: 381374 - RNA, 64 nt, Homo Sapiens
ggcuucuagguccccgagauaagugugcagggggaugggccagggccaggcuaaggguggcuca

SEQ ID NO: 381375 - RNA, 64 nt, Homo Sapiens
ccggccagcccugacgccccccucguggccacgaggccacgaacgaaccccuucuaccaagcuc

SEQ ID NO: 381376 - RNA, 64 nt, Homo Sapiens
ccacgaacccggccagcccuccaagcucccucguggccacgaggauacagaagaaccccuucua

SEQ ID NO: 381377 - RNA, 64 nt, Homo Sapiens; identical to SEQ ID NO: 381368

SEQ ID NO: 381378 - RNA, 64 nt, Homo Sapiens; identical to SEQ ID NO: 381369

SEQ ID NO: 381379 - RNA, 64 nt, Homo Sapiens; identical to SEQ ID NO: 381370

SEQ ID NO: 381380 - RNA, 64 nt, Homo Sapiens; identical to SEQ ID NO: 381371

SEQ ID NO: 381381 - RNA, 64 nt, Homo Sapiens; identical to SEQ ID NO: 381372

SEQ ID NO: 381382 - RNA, 64 nt, Homo Sapiens; identical to SEQ ID NO: 381373

SEQ ID NO: 381383 - RNA, 64 nt, Homo Sapiens; identical to SEQ ID NO: 381374

SEQ ID NO: 381384 - RNA, 64 nt, Homo Sapiens; identical to SEQ ID NO: 90189

SEQ ID NO: 381385 - RNA, 64 nt, Homo Sapiens; identical to SEQ ID NO: 90190

SEQ ID NO: 381386 - RNA, 64 nt, Homo Sapiens; identical to SEQ ID NO: 90191

SEQ ID NO: 381387 - RNA, 64 nt, Homo Sapiens; identical to SEQ ID NO: 90192

SEQ ID NO: 381388 - RNA, 64 nt, Homo Sapiens; identical to SEQ ID NO: 90193

SEQ ID NO: 381389 - RNA, 64 nt, Homo Sapiens; identical to SEQ ID NO: 90194

SEQ ID NO: 381390 - RNA, 64 nt, Homo Sapiens; identical to SEQ ID NO: 90195

SEQ ID NO: 381391 - RNA, 64 nt, Homo Sapiens; identical to SEQ ID NO: 90196

SEQ ID NO: 381392 - RNA, 64 nt, Homo Sapiens; identical to SEQ ID NO: 90197

SEQ ID NO: 381393 - RNA, 64 nt, Homo Sapiens; identical to SEQ ID NO: 90198

SEQ ID NO: 381394 - RNA, 64 nt, Homo Sapiens; identical to SEQ ID NO: 90199

SEQ ID NO: 381395 - RNA, 59 nt, Homo Sapiens
uaggacuguauauaauuguaauaaauaccaguugccacuauuuaauuucugccuguggc

SEQ ID NO: 381396 - RNA, 59 nt, Homo Sapiens
ugcauuuuuacuuuugauagauauuggcaaguugccaucuauaaggauugugccaguuu

SEQ ID NO: 381397 - RNA, 59 nt, Homo Sapiens
guuacgcuguucuuacuucauggcuugggaguugccaaaaagagcuuauagccggaagc

SEQ ID NO: 381398 - RNA, 59 nt, Homo Sapiens
auaguauuaaguaauuaaauuccuaugucaguugccaaaucuuuuaaacuuauguauuc

SEQ ID NO: 381399 - RNA, 59 nt, Homo Sapiens
gugaagcccuaggugugcccaccaguaugaguugccauuaagaccucaagcccuuuauu

SEQ ID NO: 381400 - RNA, 59 nt, Homo Sapiens
uuuccuaccccacagcucuguuccauguaaguugccaacaguuucacugaacagugggg

SEQ ID NO: 381401 - RNA, 59 nt, Homo Sapiens
gaaaagaugaagcuggagagagaggaaccaguugccaagguagagagcugcccgcuccu

SEQ ID NO: 381402 - RNA, 59 nt, Homo Sapiens
gacccacccugaauucgccauagaggaggaguugccacgaacaccacuccuggaugagg

SEQ ID NO: 381403 - RNA, 59 nt, Homo Sapiens
gaccuuuaguugucccaugguguuaauaaaguugccaaagaagauguauuaugaacaau

SEQ ID NO: 381404 - RNA, 59 nt, Homo Sapiens
ugacuugcuugacccugagcuuucugaccaguugccacaugagagguuugacaguaucu

SEQ ID NO: 381405 - RNA, 59 nt, Homo Sapiens
ugucauuuuuguuucugaaaacaaaggcaaguugccacucugauacucuuuaaucuuuu

SEQ ID NO: 381406 - RNA, 59 nt, Homo Sapiens
auauucugaagaaugucuucaaauuauuuaguugccaguugucuguauuuuugguguga

SEQ ID NO: 381407 - RNA, 59 nt, Homo Sapiens
acucagaaguuuauucuuccgggaucaugaguugccaccaccucuguaccaacagagga

SEQ ID NO: 381408 - RNA, 59 nt, Homo Sapiens
aaccugaagaagcuggcauuauuaaggguaguugccaauaaaggaucugggcuagguau

SEQ ID NO: 381409 - RNA, 59 nt, Homo Sapiens
uucuagcgcuaccaaaugaauuagcccacaguugccaguuuuaggucuaugggcuagau

SEQ ID NO: 381410 - RNA, 59 nt, Homo Sapiens
aggaaaugagaugcagaaucuccuguuguaguugccauaggcauuuccagcuggauucc

SEQ ID NO: 381411 - RNA, 59 nt, Homo Sapiens
guggcucaggguuguaaaauaccuaaaguaguugccaaagacugugaaaauuaugugaa

SEQ ID NO: 381412 - RNA, 59 nt, Homo Sapiens
uuuuagcugccaccgcuucaacuggcagcaguugccaggaagcaagacacauuggggac

SEQ ID NO: 381413 - RNA, 59 nt, Homo Sapiens
aaugcugcugagcauucuccuguuccaucaguugccauccacuaccccguuuucucuuc

SEQ ID NO: 381414 - RNA, 59 nt, Homo Sapiens
gagaugccaaugauuaccaaacaacagacaguugccaaauacugguuucucuuuccccu

SEQ ID NO: 381415 - RNA, 59 nt, Homo Sapiens
aaacugaguuuccuuuaacuuacaaagcuaguugccauauuucuauuuuauuuuaaaaa

SEQ ID NO: 381416 - RNA, 59 nt, Homo Sapiens
aucauuuguucauauuuguguuuucugacaguugccacuuguagcauugccuguacuac

SEQ ID NO: 381417 - RNA, 59 nt, Homo Sapiens
gaugaccagucacaagugaaccacuucucaguugccaaucuuugcucauauuaaaaaca

SEQ ID NO: 381418 - RNA, 59 nt, Homo Sapiens
ccccuuucugcuucucugcccaccugcugaguugccacucgcaguguugucaguucccg

SEQ ID NO: 381419 - RNA, 58 nt, Homo Sapiens
cucacgugccucucggguagcauggagaaguugccaagaguucuuuaggugccuccug

SEQ ID NO: 381420 - RNA, 59 nt, Homo Sapiens
gaaauuccagugcagcacugauugaccacaguugccaaucuaaaagcacaaagacagaa

SEQ ID NO: 381421 - RNA, 59 nt, Homo Sapiens
aaaauucaauauugggguuggaacauuucaguugccauugacagaacacccaauucaaa

SEQ ID NO: 381422 - RNA, 59 nt, Homo Sapiens
cuccccucccaauaaaaauuugcuguuuaaguugccaaccuuauucacucuuuauuugc

SEQ ID NO: 381423 - RNA, 59 nt, Homo Sapiens
ugauuucccaacuuguccggcagcuucucaguugccauuucucguuagucugcauucca

SEQ ID NO: 381424 - RNA, 59 nt, Homo Sapiens
cauucucuucaugacuuuuacuucccuuaaguugccauuucaacuucuccaguauguug

SEQ ID NO: 381425 - RNA, 59 nt, Homo Sapiens
gggacagugggagcgacugaaccaucuguaguugccaugcaccacugccacggccuuug

SEQ ID NO: 381426 - RNA, 59 nt, Homo Sapiens
cauccagaauagauuguuuuauagcucaaaguugccauuucuaaaucugaaacagggug

SEQ ID NO: 381427 - RNA, 59 nt, Homo Sapiens
gcaucggcuagugucuaaagaaaggccagaguugccauggagacauaucuaaaaaaccg

SEQ ID NO: 381428 - RNA, 59 nt, Homo Sapiens
ggauugacgcaaaguuuugaugcaguaugaguugccacuagguucaagauauuauucau

SEQ ID NO: 381429 - RNA, 59 nt, Homo Sapiens
caugugucauuugugagccacaaaugcaaaguugccauuugaauucagucaggcuacag

SEQ ID NO: 381430 - RNA, 59 nt, Homo Sapiens
acaaacuuaccucuaaacucugaggauaaaguugccaguccuuuuaauggucagccuaa

SEQ ID NO: 381431 - RNA, 59 nt, Homo Sapiens
uaaaauggucaugaauagucauuaaaaacaguugccagugauaaucugcaugaaggaaa

SEQ ID NO: 381432 - RNA, 59 nt, Homo Sapiens
ccaugaguuuacagaauuacccacauuccaguugccacugggaugaaaagcuuugugcu

SEQ ID NO: 381433 - RNA, 59 nt, Homo Sapiens
uguacagaauuuuggaagauuuucagucuaguugccaaaucuggcuccuuuacaaaaga

SEQ ID NO: 381434 - RNA, 59 nt, Homo Sapiens
gcuccugagucuccagauguuguucugucaguugccaaaggacuuugcugaccacugca

SEQ ID NO: 381435 - RNA, 59 nt, Homo Sapiens
augccagaauaauauaguucaagaccugaaguugccaauccaaguuugcacucuucugg

SEQ ID NO: 381436 - RNA, 59 nt, Homo Sapiens
uuggcuaaugcuauggggguuuuuaccacaguugccauuguggaagaaauuauuuggua

SEQ ID NO: 381437 - RNA, 59 nt, Homo Sapiens
uguuuguacccuucaugaaauaauucugaaguugccaucaguuuuacuaaucuucugug

SEQ ID NO: 381438 - RNA, 59 nt, Homo Sapiens
uugaaaacagaguaaaaaagugauagaaaaguugccaguuugggguuaaagcauuuuua

SEQ ID NO: 381439 - RNA, 59 nt, Homo Sapiens
aaggagagacaccuagcuuagucauggcaaguugccauuuuguaaacuaaggauuuugg

SEQ ID NO: 381440 - RNA, 59 nt, Homo Sapiens
cugagggguuuaacaacaugaugcuaccgaguugccaucgaggcucaggcagaagccaa

SEQ ID NO: 381441 - RNA, 59 nt, Homo Sapiens
cccaaggcaucuuaccaacaaacuaggugaguugccaaaucuugggcaauuugugcuaa

SEQ ID NO: 381442 - RNA, 59 nt, Homo Sapiens
ucucaagaugguaaauuguuucuguguugaguugccaucgucacuuccuucccaucagu

SEQ ID NO: 381443 - RNA, 59 nt, Homo Sapiens
ggccuugggugcucugcgauguggaaccaaguugccauggccuuggaaggcucucccuu

SEQ ID NO: 381444 - RNA, 59 nt, Homo Sapiens
augugauuguugaaguacaaaccagaguaaguugccaaacuugaauccaacuuuuaauu

SEQ ID NO: 381445 - RNA, 59 nt, Homo Sapiens
uucucuuuuuaaucaaccagugcuucuacaguugccacuuuuaauaacuguacuauucc

SEQ ID NO: 381446 - RNA, 59 nt, Homo Sapiens
ucucuaagauugccuaguacuauaaaauaaguugccagauuggucacagaugccuuaua

SEQ ID NO: 381447 - RNA, 59 nt, Homo Sapiens
cuaccuguuguacuuuugaacaagaagcgaguugccaaagcuaauggcuuuguauguaa

SEQ ID NO: 381448 - RNA, 59 nt, Homo Sapiens
auaguauaaaacaguaaaaucaguacacaaguugccauaccucaaaauagacuguguug

SEQ ID NO: 381449 - RNA, 59 nt, Homo Sapiens
guugaucugaaacaggcaggagggacuccaguugccaagggaaucuguagaugagguua

SEQ ID NO: 381450 - RNA, 59 nt, Homo Sapiens
caucucaguacacucuuuuaggucauaguaguugccauuuuguaaaauuucuuuuuucu

SEQ ID NO: 381451 - RNA, 59 nt, Homo Sapiens
uuucggaaacacugacuuagguuucaggaaguugccaugggaaacaaauaauuugaacu

SEQ ID NO: 381452 - RNA, 59 nt, Homo Sapiens
cuucaugauguguauugagcgguacgcccaguugccaccaugacugagucuucucaguu

SEQ ID NO: 381453 - RNA, 59 nt, Homo Sapiens
uaggucuaaagaaugaacacauuguaaacaguugccacaguaguuucuaauaaauugau

SEQ ID NO: 381454 - RNA, 59 nt, Homo Sapiens
auauuuauacccucagcacuacauaacagaguugccaaguggcacacuggaguaacaau

SEQ ID NO: 381455 - RNA, 59 nt, Homo Sapiens
aggauaccaacuugauagcagauugggacaguugccaggugugacugcaacgucuuacu

SEQ ID NO: 381456 - RNA, 59 nt, Homo Sapiens
auaugacuggauuguauauuauuaaaaacaguugccaaauaaacauggauugaaaaaag

SEQ ID NO: 381457 - RNA, 59 nt, Homo Sapiens
ggccauuccuaucauauaguaagcagaagaguugccaugaaaguaaaagacuacuguca

SEQ ID NO: 381458 - RNA, 59 nt, Homo Sapiens
gguuuuuucaauuuaugcugcucauccaaaguugccacagaugauacuuccaagugaua

SEQ ID NO: 381459 - RNA, 59 nt, Homo Sapiens
acauaagggaaugucagaugggagaugcuaguugccauuuuaacaaagcagguaaaucg

SEQ ID NO: 381460 - RNA, 59 nt, Homo Sapiens
aacuuucaaaauauauuuucaguacacccaguugccaaaguuuugcugucucuuagaga

SEQ ID NO: 381461 - RNA, 59 nt, Homo Sapiens
uguccuaagacuugaaagugcauuugucuaguugccaaaaguucuaaaaaugagauggu

SEQ ID NO: 381462 - RNA, 59 nt, Homo Sapiens
cccagugccuacuagauugcuugauauguaguugccacucaauaaagauuuguugaguc

SEQ ID NO: 381463 - RNA, 59 nt, Homo Sapiens
cacccuuccacuuucaugcaagaaggcccaguugccacagauuauacaaccauuaccca

SEQ ID NO: 381464 - RNA, 59 nt, Homo Sapiens
acaaagcuguaguucuuucuuaguauuauaguugccauguuucuuaaaaucaaguaaaa

SEQ ID NO: 381465 - RNA, 59 nt, Homo Sapiens
caugaucaucaucuucuagccaggggcauaguugccaaggccauuuaccucuuucuaag

SEQ ID NO: 381466 - RNA, 59 nt, Homo Sapiens
uuuuuuacuucuccugaaggaaauauguuaguugccacuaagucaugauaaaauugauc

SEQ ID NO: 381467 - RNA, 59 nt, Homo Sapiens
uucugucagacuccaucuccuagaccuggaguugccaagaugaaaauaguauauaaucc

SEQ ID NO: 381468 - RNA, 59 nt, Homo Sapiens
ucauaucacaauagcccuuucaggaauguaguugccaguuguaacugagaugggcuuca

SEQ ID NO: 381469 - RNA, 59 nt, Homo Sapiens
gguuuucuuuguauagaauaccaccacaaaguugccacacacuguagcccauuuccacc

SEQ ID NO: 381470 - RNA, 59 nt, Homo Sapiens
accaauuuguguguguguuuaggcccucuaguugccaugaaccucccggaagugguuuc

SEQ ID NO: 381471 - RNA, 59 nt, Homo Sapiens
ggccuucaugcuauuuaaaucagcucucaaguugccauguaauuuauguauagauuuuc

SEQ ID NO: 381472 - RNA, 59 nt, Homo Sapiens
aguuguauguuugcugauuauuuuuuuuuaguugccaacggaaaauaccaguguugggu

SEQ ID NO: 381473 - RNA, 59 nt, Homo Sapiens
aaagcaaucuaggucacuagcacagaggaaguugccaggaagguggcuucagcaccucc

SEQ ID NO: 381474 - RNA, 59 nt, Homo Sapiens
ccaguucuuacccaucaugcacccuguacaguugccacguuacugccuuuuuuaaaaau

SEQ ID NO: 381475 - RNA, 59 nt, Homo Sapiens
cuaauguaguucugaagacuguuuuuagcaguugccaaaucuaggaaacuaacauuuau

SEQ ID NO: 381476 - RNA, 59 nt, Homo Sapiens
ccauuauuuuauguugugccagugaauccaguugccagaaauaagucugaauguuuuca

SEQ ID NO: 381477 - RNA, 59 nt, Homo Sapiens
gcacagcuguuugggacugauagggucacaguugccagguugggaaugcuagauguagu

SEQ ID NO: 381478 - RNA, 59 nt, Homo Sapiens
guccgggaagcguaucauaaccaccugggaguugccaagaagcagacagucucccagug

SEQ ID NO: 381479 - RNA, 59 nt, Homo Sapiens
uuccaaugcaaagguggcgucuaaugcucaguugccaggcccauuuacaaauguaccuu

SEQ ID NO: 381480 - RNA, 59 nt, Homo Sapiens
auaauaaaaugaacuguguuaauaucacuaguugccagauuuaaggccuauaaucauga

SEQ ID NO: 381481 - RNA, 59 nt, Homo Sapiens
agcucugauauuuuuuaaaagaaaaugcaaguugccaaggcuaauuggcagguagucaa

SEQ ID NO: 381482 - RNA, 59 nt, Homo Sapiens
uacuugaaguaggagauuaauugccgaaaaguugccaaaauaaugucuuuuuggagaaa

SEQ ID NO: 381483 - RNA, 59 nt, Homo Sapiens
guuggggcauugaggaagagcaugacaaaaguugccagaccgccugcacccacucugaa

SEQ ID NO: 381484 - RNA, 59 nt, Homo Sapiens
uggcaaagaaagucuaauguaaaauucuaaguugccaacuauuaauaaucaccucugca

SEQ ID NO: 381485 - RNA, 59 nt, Homo Sapiens
gaaucuaggaaauuaguuguauucugaucaguugccaaaauagcgagacauagaauagu

SEQ ID NO: 381486 - RNA, 59 nt, Homo Sapiens
ggaggaaauaagguuagaaggagcuggucaguugccaaacaucacuaguaugugugcgu

SEQ ID NO: 381487 - RNA, 59 nt, Homo Sapiens
cuggacauugugcaauaaagauagcugaaaguugccaaacuuuuguuuagcuucacagc

SEQ ID NO: 381488 - RNA, 59 nt, Homo Sapiens
guuaaugauuauucuuuuuaccuaguggcaguugccaauguauguggcauauacaccuu

SEQ ID NO: 381489 - RNA, 59 nt, Homo Sapiens
uucccuccguggagcuccaugcuucugaaaguugccaucuguguucaguuuucuugugg

SEQ ID NO: 381490 - RNA, 59 nt, Homo Sapiens
gcgccccccccauucuuguucagauuaagaguugccaaaauaccuucugaacuacacug

SEQ ID NO: 381491 - RNA, 59 nt, Homo Sapiens
acucucuauugaccaccaguuaacguauuaguugccaauaugccagcuuggacaucagu

SEQ ID NO: 381492 - RNA, 59 nt, Homo Sapiens
guggaguuagguggaagccagauuuuaaaaguugccaaccaggagauuuaacagguaca

SEQ ID NO: 381493 - RNA, 59 nt, Homo Sapiens
gaggacgccccuacagacccagcaacccaaguugccagcccguguuucucagacuuuaa

SEQ ID NO: 381494 - RNA, 59 nt, Homo Sapiens
ccaugacucuggaguaaacuaacgucucgaguugccauuggaagccccauuguccucau

SEQ ID NO: 381495 - RNA, 59 nt, Homo Sapiens
ccugcgaggaguaccucagccagauccacaguugccaaacguugcaggaccgcacggag

SEQ ID NO: 381496 - RNA, 59 nt, Homo Sapiens
uuucuuggguaauggaaaacauuaccuagaguugccaguggcacauuacaccaguacag

SEQ ID NO: 381497 - RNA, 59 nt, Homo Sapiens
uauucgauuucauucaugugauuaaaacaaguugccauauuucaaagccuugaacuaag

SEQ ID NO: 381498 - RNA, 59 nt, Homo Sapiens
gccugugcuccugguccucaccgggcuggaguugccacaacacaggucccggccccugc

SEQ ID NO: 381499 - RNA, 59 nt, Homo Sapiens
ugccuuauagacaaauguaguguauaaaaaguugccaucaagcaccauauuuuagaucu

SEQ ID NO: 381500 - RNA, 59 nt, Homo Sapiens
guuuaauacacuuguaacuuugauaacauaguugccaguauauaauucaguauucccuc

SEQ ID NO: 381501 - RNA, 59 nt, Homo Sapiens
augacacaauuuuauucgccuuugguguuaguugccauagugcuguauuugaaaaucga

SEQ ID NO: 381502 - RNA, 59 nt, Homo Sapiens
gugucuuuaauucuuugaugauaguuuauaguugccacacuuuauugauuaguacuuga

SEQ ID NO: 381503 - RNA, 59 nt, Homo Sapiens
acacauaauggaaacuucuuucuucuaaaaguugccagugccacuuuuaagaagugaau

SEQ ID NO: 381504 - RNA, 59 nt, Homo Sapiens
uugaagggaaacgguagcuauucauucacaguugccaagagcagcuccgcgccugcugg

SEQ ID NO: 381505 - RNA, 59 nt, Homo Sapiens
cuacauuauacgcagugcugauagaaccaaguugccaagggagauaucaucucuccugc

SEQ ID NO: 381506 - RNA, 59 nt, Homo Sapiens
ucaaagccaugggagaguuuacauuuuauaguugccauaucaaacuuugugguaacccu

SEQ ID NO: 381507 - RNA, 59 nt, Homo Sapiens
gaguagcaaagccacgcuccuugaaauccaguugccauuccccacccuuccugaaacuc

SEQ ID NO: 381508 - RNA, 59 nt, Homo Sapiens
gagcaaaguuauuuaaaugacuuuagagaaguugccauuuagaauuguguaaacuagau

SEQ ID NO: 381509 - RNA, 59 nt, Homo Sapiens
cugcuaggaaauuguccuuuugcaguuuaaguugccaugaguugcagaccuauuagauc

SEQ ID NO: 381510 - RNA, 59 nt, Homo Sapiens
gauauaauggaauuauggcuacaggugauaguugccaugacacacuaacauuagcauua

SEQ ID NO: 381511 - RNA, 59 nt, Homo Sapiens
aauaacucaauggaaauauucugacugcuaguugccauaagucaccugacuaagaaauu

SEQ ID NO: 381512 - RNA, 59 nt, Homo Sapiens
uuuaguccuguacuguauggccaaugcacaguugccacaauugaggaaauauuaauuuu

SEQ ID NO: 381513 - RNA, 59 nt, Homo Sapiens
cuccuuggaauuuugaaaaccucgauuaaaguugccaaauugauuacuggauccagaac

SEQ ID NO: 381514 - RNA, 59 nt, Homo Sapiens
gaauguaagugacuuggaaaaggaagaggaguugccagaaacagcuaaaaugucaguag

SEQ ID NO: 381515 - RNA, 59 nt, Homo Sapiens
cucccuggaugucuguauguuugaauaccaguugccauguuaggaaggucagcugcaca

SEQ ID NO: 381516 - RNA, 59 nt, Homo Sapiens
uuaucaauauuuuacauuaaugguuucacaguugccaauuacuuggccuuaaggguaaa

SEQ ID NO: 381517 - RNA, 59 nt, Homo Sapiens
agcccugauggaagccauaggaacuccagaguugccaagccauagcugagaagccuggu

SEQ ID NO: 381518 - RNA, 59 nt, Homo Sapiens
uacggaugagugaccugcacuaagaagugaguugccacagugaaaauggguugguuuuu

SEQ ID NO: 381519 - RNA, 59 nt, Homo Sapiens
gauguucuggaaauaaugggcaaguuucuaguugccaguauaaaaaucacccuugcaua

SEQ ID NO: 381520 - RNA, 59 nt, Homo Sapiens
aaaucuaguucuauacaguuuuaauugccaguugccaacugcuuuguuuuuccugucag

SEQ ID NO: 381521 - RNA, 59 nt, Homo Sapiens
ugcgugacaauaaaacauuacauaaacccaguugccaucaaaaauauaaaauaugaaga

SEQ ID NO: 381522 - RNA, 59 nt, Homo Sapiens
agcugcaucaggggaaugcgcugccuuucaguugccaaaaggugcacucagcgagagcc

SEQ ID NO: 381523 - RNA, 59 nt, Homo Sapiens
gaugccuuucagaaauuuguauauuuugcaguugccagaccaauaaaauaccugguuga

SEQ ID NO: 381524 - RNA, 59 nt, Homo Sapiens
cuaaaauuaugccucccucuguuuuuauaaguugccaucgaaaagugauuuaaauaagc

SEQ ID NO: 381525 - RNA, 59 nt, Homo Sapiens
ucaauacguuguauccuuugauccaaucaaguugccacucaguauuaaccaugacaccu

SEQ ID NO: 381526 - RNA, 59 nt, Homo Sapiens
gguuagaaacuagugccuaucccucacuaaguugccagauggauuuaacagcaccucaa

SEQ ID NO: 381527 - RNA, 59 nt, Homo Sapiens
auaauacagaugaaccaaagaugucacacaguugccauccacugcuuugggaaaaaacu

SEQ ID NO: 381528 - RNA, 59 nt, Homo Sapiens
cguucagccuccaaggggcucacucccccaguugccaaacacuguggaucucucugucc

SEQ ID NO: 381529 - RNA, 59 nt, Homo Sapiens
gcugaggagaagcaaaauggcacagggcuaguugccaccaaccaauuuacugaugaaug

SEQ ID NO: 381530 - RNA, 57 nt, Homo Sapiens
gcagauccucaccagggugaaugacagaguugccaggcacuuugagucucagucuga

SEQ ID NO: 381531 - RNA, 59 nt, Homo Sapiens
gcauguaguagaaaaccacauagucacggaguugccaugauguaaucgacuuuauaucu

SEQ ID NO: 381532 - RNA, 59 nt, Homo Sapiens
aagcuucucacauuuaauaaccauguuucaguugccaguggcaaugacuuucugcuggc

SEQ ID NO: 381533 - RNA, 59 nt, Homo Sapiens
caaaauguuaguucucucuccugcuacuuaguugccaguuaagaaauaaagggaagugu

SEQ ID NO: 381534 - RNA, 59 nt, Homo Sapiens
ccacugcgcagugagaugaggggacucacaguugccaagaggggucuuugccgugggcc

SEQ ID NO: 381535 - RNA, 59 nt, Homo Sapiens
uggaauagauucucccucagaguuccaguaguugccaacccugcuaacaugguuuugca

SEQ ID NO: 381536 - RNA, 59 nt, Homo Sapiens
ggaaccaguguuuacaaguaauaccagaaaguugccaaacccuucucuauccucucgua

SEQ ID NO: 381537 - RNA, 59 nt, Homo Sapiens
cucgccuuuuaggcucaggacggaaggucaguugccaugguuaccgaggacccugguua

SEQ ID NO: 381538 - RNA, 59 nt, Homo Sapiens
guauugaugaagagaaaaaacuaguacuuaguugccacacucaugcuuacauagaaaga

SEQ ID NO: 381539 - RNA, 59 nt, Homo Sapiens
gauugggccugaauuucuccacagaaauaaguugccauccucagguuggcccuuuccca

SEQ ID NO: 381540 - RNA, 59 nt, Homo Sapiens
uauugaugacagaauuucugcacaauuuaaguugccacuuauuuuccuaaaccagggua

SEQ ID NO: 381541 - RNA, 59 nt, Homo Sapiens
cagauugauaucacacagacaagaaucucaguugccaagggacgucugcgcagcaagaa

SEQ ID NO: 381542 - RNA, 59 nt, Homo Sapiens
gcaagucacugcgcugggagaguggugccaguugccagggcagcguugagaagggggug

SEQ ID NO: 381543 - RNA, 59 nt, Homo Sapiens
cagaccccccacccccuggacuucaccccaguugccaaacagcagggggagggcaaucc

SEQ ID NO: 381544 - RNA, 59 nt, Homo Sapiens
gaagaagguuugaaagauacacagagaggaguugccagguugggagagauuuugucggg

SEQ ID NO: 381545 - RNA, 59 nt, Homo Sapiens
aaagccauuuucuuuuaauugaaauuaaaaguugccaucugaauucuggcguggcuuau

SEQ ID NO: 381546 - RNA, 59 nt, Homo Sapiens
ucuuuuuuuuccccagaaaucuuguccaaaguugccauuacugacuuuuaaacuuuguu

SEQ ID NO: 381547 - RNA, 59 nt, Homo Sapiens
ggaggggaaguagggaggggcaaauuuugaguugccacaguuccuuuuauauaagugga

SEQ ID NO: 381548 - RNA, 59 nt, Homo Sapiens
agguaauaaauaaauguagucagacccaaaguugccagaaaguuuacaguuagaagaaa

SEQ ID NO: 381549 - RNA, 59 nt, Homo Sapiens
ccccaccacacugaaucuccccuccucacaguugccauguagaccccuugaagagggga

SEQ ID NO: 381550 - RNA, 59 nt, Homo Sapiens
aaccucucacuccccaugccacguuccacaguugccaccaccucuguggcauugaaaug

SEQ ID NO: 381551 - RNA, 59 nt, Homo Sapiens
agaaagcaggaguaaugugccgauucugaaguugccacaaaaaauaagacacuggugaa

SEQ ID NO: 381552 - RNA, 59 nt, Homo Sapiens
cagcagucuaaauuuucuaaauaaccaauaguugccaaucuaaaauggcagagaagaug

SEQ ID NO: 381553 - RNA, 59 nt, Homo Sapiens
gagggaacuuugaucuuccuaagaauuaaaguugccaaauuauucugauuggucuuuaa

SEQ ID NO: 381554 - RNA, 59 nt, Homo Sapiens
aaaaguuguggugcguuaugucaccaugcaguugccagugugauuagugccuagggguc

SEQ ID NO: 381555 - RNA, 59 nt, Homo Sapiens
ucucuuccuuuuaguauucuuaguuguucaguugccaaggaucccugaucccauuuucc

SEQ ID NO: 381556 - RNA, 59 nt, Homo Sapiens
uuccagguguacuagugaauguaauuuauaguugccaaaaaaaaaaaaaaccugaaaua

SEQ ID NO: 381557 - RNA, 59 nt, Homo Sapiens
guauucauggaauuugauuuagcaugcucaguugccaguucccauuaucgauacucuuu

SEQ ID NO: 381558 - RNA, 59 nt, Homo Sapiens
ucugcugaacauuccccagugccauggccaguugccaggccccagcgccagccagucug

SEQ ID NO: 381559 - RNA, 59 nt, Homo Sapiens
acaaacaacagaguuaaucugucaccugaaguugccagauaauauuuuccaacagcuga

SEQ ID NO: 381560 - RNA, 59 nt, Homo Sapiens
cuuaggauugagcgucccgucugacguggaguugccaccaaccgcuaaaaugcacgcca

SEQ ID NO: 381561 - RNA, 59 nt, Homo Sapiens
uugagugaugugcuuggguggaagguuaaaguugccagcuccugcaguaggaugggagg

SEQ ID NO: 381562 - RNA, 59 nt, Homo Sapiens
ucaguccuuguacuucguuacuccguagcaguugccaacaauaacuacaauucucuuaa

SEQ ID NO: 381563 - RNA, 59 nt, Homo Sapiens
uuaauguucagugugaaucauauuuggaaaguugccauucucuucgauagaagucuccu

SEQ ID NO: 381564 - RNA, 59 nt, Homo Sapiens
augaggucccacguggcuucguuggaaagaguugccauaagcugguuaaaguggaugag

SEQ ID NO: 381565 - RNA, 59 nt, Homo Sapiens
uauuaccauguaaauaaucugugagugaaaguugccauuauucuauguagugguuuuag

SEQ ID NO: 381566 - RNA, 59 nt, Homo Sapiens
acauuggagaaaaaaacugccagaggaggaguugccaauuggcagugugucuuaucucc

SEQ ID NO: 381567 - RNA, 59 nt, Homo Sapiens
auaauccguguuggcacuggauucuaaguaguugccaucuugaauccuuuguaauaaag

SEQ ID NO: 381568 - RNA, 59 nt, Homo Sapiens
aggacugaacuuuugacucaaauugcuacaguugccaucaccuuucugugguaauacua

SEQ ID NO: 381569 - RNA, 59 nt, Homo Sapiens
gggcccaguaagauggaauuuagaugaggaguugccacugucauuaccaaauuuaaagc

SEQ ID NO: 381570 - RNA, 59 nt, Homo Sapiens
uguuuuucuuaaaucuauacguugcuggaaguugccauuuauaguuuaaucugauacca

SEQ ID NO: 381571 - RNA, 59 nt, Homo Sapiens
agucacuaucacauggacugucacuuugcaguugccaaauaaagcaagccaugucucag

SEQ ID NO: 381572 - RNA, 59 nt, Homo Sapiens
uugucucauuguuuucuuugagacugugaaguugccauucagggauucuauuuacuuga

SEQ ID NO: 381573 - RNA, 59 nt, Homo Sapiens
agccauacaaguacaaaguguauuaaguaaguugccagaaaaggugugagaaacagagu

SEQ ID NO: 381574 - RNA, 59 nt, Homo Sapiens
aaguuuguguguuuuuuuuucuucucccuaguugccaaaauuaaaaaggugguguuuuc

SEQ ID NO: 381575 - RNA, 59 nt, Homo Sapiens
cgggagaucauccggugcuaaaacauuacaguugccaaggaggaaaauacugaaugacu

SEQ ID NO: 381576 - RNA, 59 nt, Homo Sapiens
ccacugcuuccagccucuggugccaacacaguugccaaacccauugagcuuggggcugc

SEQ ID NO: 381577 - RNA, 59 nt, Homo Sapiens
acaaaucaacagaagcauuuauguaucugaguugccaaguuaaacuguuagcacuguug

SEQ ID NO: 381578 - RNA, 59 nt, Homo Sapiens
ggaaauguuggguugguucauauguugacaguugccaguacagugcucaugucauaagc

SEQ ID NO: 381579 - RNA, 59 nt, Homo Sapiens
gugaaagugagggacuggccuggagugggaguugccacacugccccaacagugauuccc

SEQ ID NO: 381580 - RNA, 59 nt, Homo Sapiens
cuccaucucucccacuguaugguuuguucaguugccagcauguugguuugaacccuuuu

SEQ ID NO: 381581 - RNA, 59 nt, Homo Sapiens
gacgaguaugcccaugcuccaaaaaaaaaaguugccagaagagagagaccauauccaaa

SEQ ID NO: 381582 - RNA, 59 nt, Homo Sapiens
ucuugaaaaauucccuugauuuuucugauaguugccauuuacuggaggguguggggaua

SEQ ID NO: 381583 - RNA, 59 nt, Homo Sapiens
aaauaugacaacugcuuuauaacaaaauuaguugccauauugugaugaggaaaucccua

SEQ ID NO: 381584 - RNA, 59 nt, Homo Sapiens
uguuggagccaagaauguauucuccuuccaguugccacccuuccuuaaguaaugacuua

SEQ ID NO: 381585 - RNA, 59 nt, Homo Sapiens
cagugccuuuccauuuauuucauucuugcaguugccauaugcgcaggucucauugguuu

SEQ ID NO: 381586 - RNA, 59 nt, Homo Sapiens
cacauugggagucuguuuguuacccccgcaguugccagccuacuuugccugaguucuuc

SEQ ID NO: 381587 - RNA, 59 nt, Homo Sapiens
uaaauguuucuuauucauaauagguuaagaguugccauuggaaucugguguuugcacua

SEQ ID NO: 381588 - RNA, 59 nt, Homo Sapiens
agugcuaaggcuggaaauggcccccucuuaguugccaugggaaccuaguaacagacucu

SEQ ID NO: 381589 - RNA, 59 nt, Homo Sapiens
aaccugauugugucucuugguccugcugcaguugccagucaccccggccaccugcggug

SEQ ID NO: 381590 - RNA, 59 nt, Homo Sapiens
aguaucauuacagcuguguuccuuucaguaguugccaucuuggccaugcaagaaaagaa

SEQ ID NO: 381591 - RNA, 59 nt, Homo Sapiens
aacucaaggguuuuccagguguagcuaacaguugccacaucacacagaccucgaguuuc

SEQ ID NO: 381592 - RNA, 59 nt, Homo Sapiens
gggaaauggucauuugcugagcgccuccuaguugccaggcacuggagggcgcaucaaag

SEQ ID NO: 381593 - RNA, 59 nt, Homo Sapiens
aguuuaaaaauaaaauacuuugcauucuaaguugccaauaaaauagaccuucaaguuau

SEQ ID NO: 381594 - RNA, 59 nt, Homo Sapiens
ccaccuaaguucucuucgcugcuccuaacaguugccagcgauggugcuugcucuauuug

SEQ ID NO: 381595 - RNA, 59 nt, Homo Sapiens
cggaggcugaggaaaggaagagggcacggaguugccaggagcaaaccaaagugaagaga

SEQ ID NO: 381596 - RNA, 59 nt, Homo Sapiens
ggccccgcccaugcugagggaaggggagcaguugccaauauuugcaccaucuucacaug

SEQ ID NO: 381597 - RNA, 59 nt, Homo Sapiens
aaaagucauugccauucaucauuaauaaaaguugccauuucaacuacgucccaacauuc

SEQ ID NO: 381598 - RNA, 59 nt, Homo Sapiens
cuuguaaauccuagggcuuccuggaaguuaguugccaaagucaugcaagcaucaccugu

SEQ ID NO: 381599 - RNA, 59 nt, Homo Sapiens
cucuguuucugcaggggaugauauuggugaguugccaaagaagcaauacagcauaucug

SEQ ID NO: 381600 - RNA, 59 nt, Homo Sapiens
aaguagaauagccaauuauuuaaauguuuaguugccacagugaaccaggagucacugag

SEQ ID NO: 381601 - RNA, 59 nt, Homo Sapiens
gucgaauugagguuuuagguaaagcauagaguugccagaguaccccgcauucccaugaa

SEQ ID NO: 381602 - RNA, 59 nt, Homo Sapiens
cuuggaguggggaaggcuguuucuuugaaaguugccaaauguguuauguugugucucag

SEQ ID NO: 381603 - RNA, 59 nt, Homo Sapiens
ucugaaugaguagagcaggacauucagaaaguugccacuuaguagcaaaaacuuaaauu

SEQ ID NO: 381604 - RNA, 59 nt, Homo Sapiens
uuucucucuaacugggcacccacauacacaguugccauuuuguguguguaggugacucc

SEQ ID NO: 381605 - RNA, 59 nt, Homo Sapiens
ugguuugccuuccagcacuacugcaaacaaguugccaucuugggucucaguuucuuucu

SEQ ID NO: 381606 - RNA, 59 nt, Homo Sapiens
uucaggacgacaccuggcuuaggaaucugaguugccaacguggccaccaccaaaggaug

SEQ ID NO: 381607 - RNA, 59 nt, Homo Sapiens
gccugggugaagaaaaagcaucugggaggaguugccacuaaaaacugcauugaaauguu

SEQ ID NO: 381608 - RNA, 59 nt, Homo Sapiens
auuugcaccaucuucacaugaaggggagcaguugccaauggccccgcccaugcugaggg

SEQ ID NO: 381609 - RNA, 59 nt, Homo Sapiens
caccaacuuucuugccucaaagggacacaaguugccagcaauugaacuugucaagguga

SEQ ID NO: 381610 - RNA, 59 nt, Homo Sapiens
ccuggucaguuuugauucuugccaucuauaguugccagcacuuuccagagcuacaacau

SEQ ID NO: 381611 - RNA, 59 nt, Homo Sapiens
uuggagauggaaauugacgaaguuaccaaaguugccauuaaggacuaagccuguucaua

SEQ ID NO: 381612 - RNA, 59 nt, Homo Sapiens
uauucucaggccaagggccauucccauggaguugccaacgcugcagcauugccauacca

SEQ ID NO: 381613 - RNA, 59 nt, Homo Sapiens
cuuugccauugugcuccugcgcccaaaacaguugccaaauucuuucauacucauaauua

SEQ ID NO: 381614 - RNA, 59 nt, Homo Sapiens
auuugcaccaucuucacaugaaggggagcaguugccaauggccccacccaugcugaggg

SEQ ID NO: 381615 - RNA, 59 nt, Homo Sapiens
aaauuuuuuuuuuuuuuuucgaggaacuuaguugccagguacuucaccucuuggcugug

SEQ ID NO: 381616 - RNA, 59 nt, Homo Sapiens
ccagugcccaccagccuuguggcccuggaaguugccacucccuccccagugccucuccu

SEQ ID NO: 381617 - RNA, 59 nt, Homo Sapiens
ccugcagcccccuuccccaggguccucacaguugccagcaaccuaugguggggucucga

SEQ ID NO: 381618 - RNA, 59 nt, Homo Sapiens
accuaugguggggucucgagugaauugcaaguugccacacuccucuccccagaccaaaa

SEQ ID NO: 381619 - RNA, 59 nt, Homo Sapiens
cugccugacagaaacacacacacagccacaguugccaaaucccguacuccuugccaccg

SEQ ID NO: 381620 - RNA, 59 nt, Homo Sapiens
aaugauaaaaagacauccuaaaauggugaaguugccaugacaauaaaggucauagaacc

SEQ ID NO: 381621 - RNA, 59 nt, Homo Sapiens
ugaccucuccagcacgagcacccacuccuaguugccacauuggagcacucaguucagca

SEQ ID NO: 381622 - RNA, 59 nt, Homo Sapiens
aaacuugggacagacuauuggggucgaggaguugccaauuauguugcacuaagaaggug

SEQ ID NO: 381623 - RNA, 59 nt, Homo Sapiens
uugcuucauuaaaacaagagaaggguccaaguugccacaaucacaugggacagauguaa

SEQ ID NO: 381624 - RNA, 59 nt, Homo Sapiens
aagcagugcaaaauuaaucgccaugcuagaguugccauuacuuuuacuuaaaaacaauc

SEQ ID NO: 381625 - RNA, 59 nt, Homo Sapiens
ugccuucgcccaugcccgccccugcccgcaguugccaaagagccgccuugucgcugugg

SEQ ID NO: 381626 - RNA, 59 nt, Homo Sapiens
uugggacuccgugucuucaaugguuuguuaguugccauuacaacuuugucuggguagag

SEQ ID NO: 381627 - RNA, 57 nt, Homo Sapiens
cccaaaaaugaaaccaucaauaaagacugaguugccagcaguguguagaguggaauu

SEQ ID NO: 381628 - RNA, 59 nt, Homo Sapiens
agggagacaacagcccugucucaaaaccgaguugccagcucccauguaccagcagcugg

SEQ ID NO: 381629 - RNA, 59 nt, Homo Sapiens
cuaugaauaaccaagauggagccgggugcaguugccaacacuuguaaucccagcaguuu

SEQ ID NO: 381630 - RNA, 59 nt, Homo Sapiens
ugugacuccccugcaugaugucuaugaaaaguugccaagggggucuggagggggcuucg

SEQ ID NO: 381631 - RNA, 59 nt, Homo Sapiens
gcugaaccagugccacugguuaaaagaauaguugccaaguuucuguuacugauguucaa

SEQ ID NO: 381632 - RNA, 59 nt, Homo Sapiens
gccaacaugagaccaaagugcucauuguaaguugccacuccagugcucagaccuuuaga

SEQ ID NO: 381633 - RNA, 59 nt, Homo Sapiens
aaacuuugaaauucugccuguucuguaaaaguugccauacgcugucucuuuucugugau

SEQ ID NO: 381634 - RNA, 59 nt, Homo Sapiens
cccaaaaauuccaaugauucggaggguccaguugccaccggauggaaauaggaagcgug

SEQ ID NO: 381635 - RNA, 59 nt, Homo Sapiens
caagcucuguguucccagccaagucgugaaguugccacuagcacaggcaccacaaauaa

SEQ ID NO: 381636 - RNA, 59 nt, Homo Sapiens
uauauagcaucuuugaugaacaagugcuuaguugccaucgauguuaagcauuuuuuccc

SEQ ID NO: 381637 - RNA, 59 nt, Homo Sapiens
uaugagacagaucuggcuucaaauccaagaguugccaugcacuugcugugugaccuugg

SEQ ID NO: 381638 - RNA, 59 nt, Homo Sapiens
ugggucccagucugggacucugcugcugaaguugccacaguagaggucccuggcuuagu

SEQ ID NO: 381639 - RNA, 59 nt, Homo Sapiens
uuuaacaggcacuuaaucucaguaaagucaguugccaguuaaguuccacccaguaguca

SEQ ID NO: 381640 - RNA, 59 nt, Homo Sapiens
uuuuuuuuuccugaaacagagucucacuaaguugccaggcuggucucaagcgccugggu

SEQ ID NO: 381641 - RNA, 59 nt, Homo Sapiens
aacuuuuacaguucaaauuaauuugcagaaguugccauaaauguuugcauaaugacaua

SEQ ID NO: 381642 - RNA, 59 nt, Homo Sapiens
aggcgagugcuugggcagaauccagccagaguugccagcccagaagcugggccaagccc

SEQ ID NO: 381643 - RNA, 59 nt, Homo Sapiens
ccagaauauuagaaguuacaucaugcuguaguugccagcguaacugcacuaaacauuug

SEQ ID NO: 381644 - RNA, 59 nt, Homo Sapiens
guuacauuuuugaagcaccuuguuggcagaguugccaggggaagcccgagcccaggacc

SEQ ID NO: 381645 - RNA, 59 nt, Homo Sapiens
uggccuccccccgacccgccacggcccucaguugccagggauggggccaccacugucac

SEQ ID NO: 381646 - RNA, 59 nt, Homo Sapiens
cacuaaugcuguuacuaacucauugugccaguugccaaucucccauugacuagauggac

SEQ ID NO: 381647 - RNA, 59 nt, Homo Sapiens
aggaaguuuucugaggcuggucuagccuuaguugccacuccagaccacucuacagcugc

SEQ ID NO: 381648 - RNA, 59 nt, Homo Sapiens
ggguuuccuuccagauucgaacccccagcaguugccauggccuugggacccguccucuc

SEQ ID NO: 381649 - RNA, 59 nt, Homo Sapiens
aguaaccaugaaauugaacgagaguugggaguugccaagauuuucuggguauuuuagga

SEQ ID NO: 381650 - RNA, 59 nt, Homo Sapiens
ggucccugcccugugucaccaaggaugccaguugccacaggcugccuccaaggacacag

SEQ ID NO: 381651 - RNA, 64 nt, Homo Sapiens; identical to SEQ ID NO: 73185

SEQ ID NO: 381652 - RNA, 64 nt, Homo Sapiens; identical to SEQ ID NO: 73186

SEQ ID NO: 381653 - RNA, 64 nt, Homo Sapiens; identical to SEQ ID NO: 73187

SEQ ID NO: 381654 - RNA, 64 nt, Homo Sapiens; identical to SEQ ID NO: 73188

SEQ ID NO: 381655 - RNA, 64 nt, Homo Sapiens; identical to SEQ ID NO: 73189

SEQ ID NO: 381656 - RNA, 64 nt, Homo Sapiens; identical to SEQ ID NO: 73190

SEQ ID NO: 381657 - RNA, 64 nt, Homo Sapiens; identical to SEQ ID NO: 73191

SEQ ID NO: 381658 - RNA, 64 nt, Homo Sapiens; identical to SEQ ID NO: 73192

SEQ ID NO: 381659 - RNA, 64 nt, Homo Sapiens; identical to SEQ ID NO: 73193

SEQ ID NO: 381660 - RNA, 64 nt, Homo Sapiens; identical to SEQ ID NO: 73194

SEQ ID NO: 381661 - RNA, 64 nt, Homo Sapiens; identical to SEQ ID NO: 73195

SEQ ID NO: 381662 - RNA, 64 nt, Homo Sapiens; identical to SEQ ID NO: 73196

SEQ ID NO: 381663 - RNA, 64 nt, Homo Sapiens; identical to SEQ ID NO: 73197

SEQ ID NO: 381664 - RNA, 64 nt, Homo Sapiens; identical to SEQ ID NO: 73198

SEQ ID NO: 381665 - RNA, 64 nt, Homo Sapiens; identical to SEQ ID NO: 73199

SEQ ID NO: 381666 - RNA, 64 nt, Homo Sapiens; identical to SEQ ID NO: 73200

SEQ ID NO: 381667 - RNA, 64 nt, Homo Sapiens; identical to SEQ ID NO: 73201

SEQ ID NO: 381668 - RNA, 64 nt, Homo Sapiens; identical to SEQ ID NO: 73202

SEQ ID NO: 381669 - RNA, 64 nt, Homo Sapiens; identical to SEQ ID NO: 73203

SEQ ID NO: 381670 - RNA, 64 nt, Homo Sapiens; identical to SEQ ID NO: 73204

SEQ ID NO: 381671 - RNA, 64 nt, Homo Sapiens; identical to SEQ ID NO: 73205

SEQ ID NO: 381672 - RNA, 64 nt, Homo Sapiens; identical to SEQ ID NO: 73206

SEQ ID NO: 381673 - RNA, 64 nt, Homo Sapiens; identical to SEQ ID NO: 73207

SEQ ID NO: 381674 - RNA, 64 nt, Homo Sapiens; identical to SEQ ID NO: 73208

SEQ ID NO: 381675 - RNA, 64 nt, Homo Sapiens; identical to SEQ ID NO: 73209

SEQ ID NO: 381676 - RNA, 64 nt, Homo Sapiens; identical to SEQ ID NO: 73210

SEQ ID NO: 381677 - RNA, 64 nt, Homo Sapiens; identical to SEQ ID NO: 73211

SEQ ID NO: 381678 - RNA, 64 nt, Homo Sapiens; identical to SEQ ID NO: 73212

SEQ ID NO: 381679 - RNA, 64 nt, Homo Sapiens; identical to SEQ ID NO: 73213

SEQ ID NO: 381680 - RNA, 64 nt, Homo Sapiens; identical to SEQ ID NO: 73214

SEQ ID NO: 381681 - RNA, 64 nt, Homo Sapiens; identical to SEQ ID NO: 73215

SEQ ID NO: 381682 - RNA, 64 nt, Homo Sapiens; identical to SEQ ID NO: 73216

SEQ ID NO: 381683 - RNA, 64 nt, Homo Sapiens; identical to SEQ ID NO: 73217

SEQ ID NO: 381684 - RNA, 64 nt, Homo Sapiens; identical to SEQ ID NO: 73218

SEQ ID NO: 381685 - RNA, 64 nt, Homo Sapiens; identical to SEQ ID NO: 73219

SEQ ID NO: 381686 - RNA, 64 nt, Homo Sapiens; identical to SEQ ID NO: 73220

SEQ ID NO: 381687 - RNA, 64 nt, Homo Sapiens; identical to SEQ ID NO: 73221

SEQ ID NO: 381688 - RNA, 64 nt, Homo Sapiens; identical to SEQ ID NO: 73222

SEQ ID NO: 381689 - RNA, 64 nt, Homo Sapiens; identical to SEQ ID NO: 73223

SEQ ID NO: 381690 - RNA, 64 nt, Homo Sapiens; identical to SEQ ID NO: 73224

SEQ ID NO: 381691 - RNA, 64 nt, Homo Sapiens; identical to SEQ ID NO: 73225

SEQ ID NO: 381692 - RNA, 64 nt, Homo Sapiens; identical to SEQ ID NO: 73226

SEQ ID NO: 381693 - RNA, 64 nt, Homo Sapiens; identical to SEQ ID NO: 73227

SEQ ID NO: 381694 - RNA, 64 nt, Homo Sapiens; identical to SEQ ID NO: 73228

SEQ ID NO: 381695 - RNA, 64 nt, Homo Sapiens; identical to SEQ ID NO: 73229

SEQ ID NO: 381696 - RNA, 64 nt, Homo Sapiens; identical to SEQ ID NO: 73230

SEQ ID NO: 381697 - RNA, 64 nt, Homo Sapiens; identical to SEQ ID NO: 73231

SEQ ID NO: 381698 - RNA, 64 nt, Homo Sapiens; identical to SEQ ID NO: 73232

SEQ ID NO: 381699 - RNA, 64 nt, Homo Sapiens; identical to SEQ ID NO: 73233

SEQ ID NO: 381700 - RNA, 64 nt, Homo Sapiens; identical to SEQ ID NO: 73234

SEQ ID NO: 381701 - RNA, 64 nt, Homo Sapiens; identical to SEQ ID NO: 73235

SEQ ID NO: 381702 - RNA, 64 nt, Homo Sapiens; identical to SEQ ID NO: 73236

SEQ ID NO: 381703 - RNA, 64 nt, Homo Sapiens; identical to SEQ ID NO: 73237

SEQ ID NO: 381704 - RNA, 64 nt, Homo Sapiens; identical to SEQ ID NO: 73238

SEQ ID NO: 381705 - RNA, 64 nt, Homo Sapiens; identical to SEQ ID NO: 73239

SEQ ID NO: 381706 - RNA, 64 nt, Homo Sapiens; identical to SEQ ID NO: 73240

SEQ ID NO: 381707 - RNA, 64 nt, Homo Sapiens; identical to SEQ ID NO: 73241

SEQ ID NO: 381708 - RNA, 64 nt, Homo Sapiens; identical to SEQ ID NO: 73242

SEQ ID NO: 381709 - RNA, 64 nt, Homo Sapiens; identical to SEQ ID NO: 73243

SEQ ID NO: 381710 - RNA, 64 nt, Homo Sapiens; identical to SEQ ID NO: 73244

SEQ ID NO: 381711 - RNA, 64 nt, Homo Sapiens; identical to SEQ ID NO: 73245

SEQ ID NO: 381712 - RNA, 64 nt, Homo Sapiens; identical to SEQ ID NO: 73246

SEQ ID NO: 381713 - RNA, 64 nt, Homo Sapiens; identical to SEQ ID NO: 73247

SEQ ID NO: 381714 - RNA, 64 nt, Homo Sapiens; identical to SEQ ID NO: 73248

SEQ ID NO: 381715 - RNA, 64 nt, Homo Sapiens; identical to SEQ ID NO: 73249

SEQ ID NO: 381716 - RNA, 64 nt, Homo Sapiens; identical to SEQ ID NO: 73250

SEQ ID NO: 381717 - RNA, 64 nt, Homo Sapiens; identical to SEQ ID NO: 73251

SEQ ID NO: 381718 - RNA, 64 nt, Homo Sapiens; identical to SEQ ID NO: 73252

SEQ ID NO: 381719 - RNA, 64 nt, Homo Sapiens; identical to SEQ ID NO: 73253

SEQ ID NO: 381720 - RNA, 64 nt, Homo Sapiens; identical to SEQ ID NO: 73254

SEQ ID NO: 381721 - RNA, 64 nt, Homo Sapiens; identical to SEQ ID NO: 73255

SEQ ID NO: 381722 - RNA, 64 nt, Homo Sapiens; identical to SEQ ID NO: 73256

SEQ ID NO: 381723 - RNA, 64 nt, Homo Sapiens; identical to SEQ ID NO: 73257

SEQ ID NO: 381724 - RNA, 64 nt, Homo Sapiens; identical to SEQ ID NO: 73258

SEQ ID NO: 381725 - RNA, 64 nt, Homo Sapiens; identical to SEQ ID NO: 73259

SEQ ID NO: 381726 - RNA, 64 nt, Homo Sapiens; identical to SEQ ID NO: 73260

SEQ ID NO: 381727 - RNA, 64 nt, Homo Sapiens; identical to SEQ ID NO: 73261

SEQ ID NO: 381728 - RNA, 64 nt, Homo Sapiens; identical to SEQ ID NO: 73262

SEQ ID NO: 381729 - RNA, 64 nt, Homo Sapiens; identical to SEQ ID NO: 73263

SEQ ID NO: 381730 - RNA, 64 nt, Homo Sapiens; identical to SEQ ID NO: 73264

SEQ ID NO: 381731 - RNA, 64 nt, Homo Sapiens; identical to SEQ ID NO: 73265

SEQ ID NO: 381732 - RNA, 63 nt, Homo Sapiens; identical to SEQ ID NO: 73266

SEQ ID NO: 381733 - RNA, 64 nt, Homo Sapiens; identical to SEQ ID NO: 73267

SEQ ID NO: 381734 - RNA, 64 nt, Homo Sapiens; identical to SEQ ID NO: 73268

SEQ ID NO: 381735 - RNA, 64 nt, Homo Sapiens; identical to SEQ ID NO: 73269

SEQ ID NO: 381736 - RNA, 64 nt, Homo Sapiens; identical to SEQ ID NO: 73270

SEQ ID NO: 381737 - RNA, 64 nt, Homo Sapiens; identical to SEQ ID NO: 73271

SEQ ID NO: 381738 - RNA, 64 nt, Homo Sapiens; identical to SEQ ID NO: 73272

SEQ ID NO: 381739 - RNA, 64 nt, Homo Sapiens; identical to SEQ ID NO: 73273

SEQ ID NO: 381740 - RNA, 64 nt, Homo Sapiens; identical to SEQ ID NO: 73274

SEQ ID NO: 381741 - RNA, 64 nt, Homo Sapiens; identical to SEQ ID NO: 73275

SEQ ID NO: 381742 - RNA, 64 nt, Homo Sapiens; identical to SEQ ID NO: 73276

SEQ ID NO: 381743 - RNA, 64 nt, Homo Sapiens; identical to SEQ ID NO: 73277

SEQ ID NO: 381744 - RNA, 64 nt, Homo Sapiens; identical to SEQ ID NO: 73278

SEQ ID NO: 381745 - RNA, 64 nt, Homo Sapiens; identical to SEQ ID NO: 73279

SEQ ID NO: 381746 - RNA, 64 nt, Homo Sapiens; identical to SEQ ID NO: 73280

SEQ ID NO: 381747 - RNA, 64 nt, Homo Sapiens; identical to SEQ ID NO: 73281

SEQ ID NO: 381748 - RNA, 64 nt, Homo Sapiens; identical to SEQ ID NO: 73282

SEQ ID NO: 381749 - RNA, 64 nt, Homo Sapiens; identical to SEQ ID NO: 73283

SEQ ID NO: 381750 - RNA, 64 nt, Homo Sapiens; identical to SEQ ID NO: 73284

SEQ ID NO: 381751 - RNA, 64 nt, Homo Sapiens; identical to SEQ ID NO: 73285

SEQ ID NO: 381752 - RNA, 64 nt, Homo Sapiens; identical to SEQ ID NO: 73286

SEQ ID NO: 381753 - RNA, 64 nt, Homo Sapiens; identical to SEQ ID NO: 73287

SEQ ID NO: 381754 - RNA, 64 nt, Homo Sapiens; identical to SEQ ID NO: 73288

SEQ ID NO: 381755 - RNA, 64 nt, Homo Sapiens; identical to SEQ ID NO: 73289

SEQ ID NO: 381756 - RNA, 64 nt, Homo Sapiens; identical to SEQ ID NO: 73290

SEQ ID NO: 381757 - RNA, 64 nt, Homo Sapiens; identical to SEQ ID NO: 73291

SEQ ID NO: 381758 - RNA, 64 nt, Homo Sapiens; identical to SEQ ID NO: 73292

SEQ ID NO: 381759 - RNA, 64 nt, Homo Sapiens; identical to SEQ ID NO: 73293

SEQ ID NO: 381760 - RNA, 64 nt, Homo Sapiens; identical to SEQ ID NO: 73294

SEQ ID NO: 381761 - RNA, 64 nt, Homo Sapiens; identical to SEQ ID NO: 73295

SEQ ID NO: 381762 - RNA, 64 nt, Homo Sapiens; identical to SEQ ID NO: 73296

SEQ ID NO: 381763 - RNA, 64 nt, Homo Sapiens; identical to SEQ ID NO: 73297

SEQ ID NO: 381764 - RNA, 64 nt, Homo Sapiens; identical to SEQ ID NO: 73298

SEQ ID NO: 381765 - RNA, 64 nt, Homo Sapiens; identical to SEQ ID NO: 73299

SEQ ID NO: 381766 - RNA, 64 nt, Homo Sapiens; identical to SEQ ID NO: 73300

SEQ ID NO: 381767 - RNA, 64 nt, Homo Sapiens; identical to SEQ ID NO: 73301

SEQ ID NO: 381768 - RNA, 64 nt, Homo Sapiens; identical to SEQ ID NO: 73302

SEQ ID NO: 381769 - RNA, 64 nt, Homo Sapiens; identical to SEQ ID NO: 73303

SEQ ID NO: 381770 - RNA, 64 nt, Homo Sapiens; identical to SEQ ID NO: 73304

SEQ ID NO: 381771 - RNA, 64 nt, Homo Sapiens; identical to SEQ ID NO: 73305

SEQ ID NO: 381772 - RNA, 64 nt, Homo Sapiens; identical to SEQ ID NO: 73306

SEQ ID NO: 381773 - RNA, 64 nt, Homo Sapiens; identical to SEQ ID NO: 73307

SEQ ID NO: 381774 - RNA, 64 nt, Homo Sapiens; identical to SEQ ID NO: 73308

SEQ ID NO: 381775 - RNA, 64 nt, Homo Sapiens; identical to SEQ ID NO: 73309

SEQ ID NO: 381776 - RNA, 64 nt, Homo Sapiens; identical to SEQ ID NO: 73310

SEQ ID NO: 381777 - RNA, 64 nt, Homo Sapiens; identical to SEQ ID NO: 73311

SEQ ID NO: 381778 - RNA, 64 nt, Homo Sapiens; identical to SEQ ID NO: 73312

SEQ ID NO: 381779 - RNA, 64 nt, Homo Sapiens; identical to SEQ ID NO: 73313

SEQ ID NO: 381780 - RNA, 64 nt, Homo Sapiens; identical to SEQ ID NO: 73314

SEQ ID NO: 381781 - RNA, 64 nt, Homo Sapiens; identical to SEQ ID NO: 73315

SEQ ID NO: 381782 - RNA, 64 nt, Homo Sapiens; identical to SEQ ID NO: 73316

SEQ ID NO: 381783 - RNA, 64 nt, Homo Sapiens; identical to SEQ ID NO: 73317

SEQ ID NO: 381784 - RNA, 64 nt, Homo Sapiens; identical to SEQ ID NO: 73318

SEQ ID NO: 381785 - RNA, 64 nt, Homo Sapiens; identical to SEQ ID NO: 73319

SEQ ID NO: 381786 - RNA, 64 nt, Homo Sapiens; identical to SEQ ID NO: 73320

SEQ ID NO: 381787 - RNA, 64 nt, Homo Sapiens; identical to SEQ ID NO: 73311

SEQ ID NO: 381788 - RNA, 64 nt, Homo Sapiens; identical to SEQ ID NO: 73312

SEQ ID NO: 381789 - RNA, 64 nt, Homo Sapiens
auagccacagguggggauuagagccuuuugccaugcaagacaacguuccuucaucauccuggaa

SEQ ID NO: 381790 - RNA, 64 nt, Homo Sapiens
gaaaaugaugaauuccaaucgacucauucuaagggcaagacauucaacuucacauugcucagug

SEQ ID NO: 381791 - RNA, 64 nt, Homo Sapiens
ugguuuaacucacgcaggaaguaaaauuccuauagcaagacauaguuucauuuuagaggacccc

SEQ ID NO: 381792 - RNA, 64 nt, Homo Sapiens
ucaugauuuugcaaaugggaaggauuucuuuaaagcaagacacaaaagcauacacaggaaaaaa

SEQ ID NO: 381793 - RNA, 64 nt, Homo Sapiens
cuuaguguguauuucucucuucuaugaaguaguagcaagacaugcauaaacgggucuuaugaca

SEQ ID NO: 381794 - RNA, 64 nt, Homo Sapiens
gagcccuggaucguugaauuaggaguaaaacugggcaagacaaaccuggaugggagagagaggg

SEQ ID NO: 381795 - RNA, 64 nt, Homo Sapiens
aauuaagaugaaacauuccgguuuucucacaacacauuagcacauacuguccauuagcauaucu

SEQ ID NO: 381796 - RNA, 64 nt, Homo Sapiens
ccgguuuucucacaacacauuagcacauacuguccauuagcauaucugggauaaccagguuuug

SEQ ID NO: 381797 - RNA, 64 nt, Homo Sapiens
uucucaucauugggagaucuuaaaucuuagcaagcauuagcaauauuaaaugccaaaauuccau

SEQ ID NO: 381798 - RNA, 64 nt, Homo Sapiens
gguuucuacaaauaggguaauuguaaauuuaaagcauuagcauuuauuggugaauaauguauau

SEQ ID NO: 381799 - RNA, 64 nt, Homo Sapiens
ugaacaccuuaguaauaaauuuaucuuuugaggucauuagcaaacaugaacucacagggaucca

SEQ ID NO: 381800 - RNA, 64 nt, Homo Sapiens
gccuauggucaaccuauccuuagaccugcuaacgcauuagcauuagcagcaccuaaguccucau

SEQ ID NO: 381801 - RNA, 64 nt, Homo Sapiens
ggucaaccuauccuuagaccugcuaacgcauuagcauuagcagcaccuaaguccucauugaaug

SEQ ID NO: 381802 - RNA, 64 nt, Homo Sapiens
uaccagaguacuguaaaaucuagguuuuuuucaacauuagcaguaaauugagcacuguuuacug

SEQ ID NO: 381803 - RNA, 64 nt, Homo Sapiens
guagaaguauguaagaauaugugauggguguagucauuagcaaagcauuuaaaucacuugagua

SEQ ID NO: 381804 - RNA, 64 nt, Homo Sapiens
cgcaauuuucuuuuucaauuucaugauuguaggucauuagcaugcauauugaguuugcccuuac

SEQ ID NO: 381805 - RNA, 64 nt, Homo Sapiens
uuguuugaucuaaucuuaaucacagugagcucuucauuagcacaauaugugguuugccccaagu

SEQ ID NO: 381806 - RNA, 64 nt, Homo Sapiens
auaugugguuugccccaagucacagugagcucuucauuagcacauuguuugaucuaaucuuaau

SEQ ID NO: 381807 - RNA, 64 nt, Homo Sapiens
cauauugaguuugcccuuacucauaauuguaggucauuagcaugcgcaauuuucuuuuucaauu

SEQ ID NO: 381808 - RNA, 64 nt, Homo Sapiens; identical to SEQ ID NO: 302224

SEQ ID NO: 381809 - RNA, 64 nt, Homo Sapiens; identical to SEQ ID NO: 302225

SEQ ID NO: 381810 - RNA, 64 nt, Homo Sapiens; identical to SEQ ID NO: 302226

SEQ ID NO: 381811 - RNA, 64 nt, Homo Sapiens; identical to SEQ ID NO: 302227

SEQ ID NO: 381812 - RNA, 64 nt, Homo Sapiens; identical to SEQ ID NO: 302228

SEQ ID NO: 381813 - RNA, 64 nt, Homo Sapiens; identical to SEQ ID NO: 302229

SEQ ID NO: 381814 - RNA, 64 nt, Homo Sapiens; identical to SEQ ID NO: 302230

SEQ ID NO: 381815 - RNA, 64 nt, Homo Sapiens; identical to SEQ ID NO: 302231

SEQ ID NO: 381816 - RNA, 64 nt, Homo Sapiens; identical to SEQ ID NO: 302232

SEQ ID NO: 381817 - RNA, 64 nt, Homo Sapiens; identical to SEQ ID NO: 302233

SEQ ID NO: 381818 - RNA, 64 nt, Homo Sapiens; identical to SEQ ID NO: 302234

SEQ ID NO: 381819 - RNA, 64 nt, Homo Sapiens; identical to SEQ ID NO: 302235

SEQ ID NO: 381820 - RNA, 64 nt, Homo Sapiens; identical to SEQ ID NO: 302236

SEQ ID NO: 381821 - RNA, 64 nt, Homo Sapiens; identical to SEQ ID NO: 302237

SEQ ID NO: 381822 - RNA, 64 nt, Homo Sapiens; identical to SEQ ID NO: 302238

SEQ ID NO: 381823 - RNA, 64 nt, Homo Sapiens; identical to SEQ ID NO: 302239

SEQ ID NO: 381824 - RNA, 64 nt, Homo Sapiens; identical to SEQ ID NO: 302240

SEQ ID NO: 381825 - RNA, 64 nt, Homo Sapiens; identical to SEQ ID NO: 302241

SEQ ID NO: 381826 - RNA, 64 nt, Homo Sapiens; identical to SEQ ID NO: 302242

SEQ ID NO: 381827 - RNA, 64 nt, Homo Sapiens; identical to SEQ ID NO: 302243

SEQ ID NO: 381828 - RNA, 64 nt, Homo Sapiens; identical to SEQ ID NO: 302244

SEQ ID NO: 381829 - RNA, 64 nt, Homo Sapiens; identical to SEQ ID NO: 302245

SEQ ID NO: 381830 - RNA, 64 nt, Homo Sapiens; identical to SEQ ID NO: 302246

SEQ ID NO: 381831 - RNA, 64 nt, Homo Sapiens; identical to SEQ ID NO: 302247

SEQ ID NO: 381832 - RNA, 64 nt, Homo Sapiens; identical to SEQ ID NO: 302248

SEQ ID NO: 381833 - RNA, 64 nt, Homo Sapiens; identical to SEQ ID NO: 302249

SEQ ID NO: 381834 - RNA, 64 nt, Homo Sapiens; identical to SEQ ID NO: 302250

SEQ ID NO: 381835 - RNA, 64 nt, Homo Sapiens; identical to SEQ ID NO: 302251

SEQ ID NO: 381836 - RNA, 64 nt, Homo Sapiens; identical to SEQ ID NO: 167990

SEQ ID NO: 381837 - RNA, 64 nt, Homo Sapiens; identical to SEQ ID NO: 167991

SEQ ID NO: 381838 - RNA, 64 nt, Homo Sapiens; identical to SEQ ID NO: 167992

SEQ ID NO: 381839 - RNA, 64 nt, Homo Sapiens; identical to SEQ ID NO: 167993

SEQ ID NO: 381840 - RNA, 64 nt, Homo Sapiens; identical to SEQ ID NO: 167994

SEQ ID NO: 381841 - RNA, 64 nt, Homo Sapiens; identical to SEQ ID NO: 167995

SEQ ID NO: 381842 - RNA, 64 nt, Homo Sapiens; identical to SEQ ID NO: 167996

SEQ ID NO: 381843 - RNA, 64 nt, Homo Sapiens; identical to SEQ ID NO: 167997

SEQ ID NO: 381844 - RNA, 64 nt, Homo Sapiens; identical to SEQ ID NO: 167998

SEQ ID NO: 381845 - RNA, 64 nt, Homo Sapiens; identical to SEQ ID NO: 167999

SEQ ID NO: 381846 - RNA, 64 nt, Homo Sapiens; identical to SEQ ID NO: 168000

SEQ ID NO: 381847 - RNA, 64 nt, Homo Sapiens; identical to SEQ ID NO: 168001

SEQ ID NO: 381848 - RNA, 64 nt, Homo Sapiens; identical to SEQ ID NO: 168002

SEQ ID NO: 381849 - RNA, 64 nt, Homo Sapiens; identical to SEQ ID NO: 168003

SEQ ID NO: 381850 - RNA, 64 nt, Homo Sapiens; identical to SEQ ID NO: 168004

SEQ ID NO: 381851 - RNA, 64 nt, Homo Sapiens; identical to SEQ ID NO: 168005

SEQ ID NO: 381852 - RNA, 64 nt, Homo Sapiens; identical to SEQ ID NO: 168006

SEQ ID NO: 381853 - RNA, 64 nt, Homo Sapiens; identical to SEQ ID NO: 168007

SEQ ID NO: 381854 - RNA, 64 nt, Homo Sapiens; identical to SEQ ID NO: 168008

SEQ ID NO: 381855 - RNA, 64 nt, Homo Sapiens; identical to SEQ ID NO: 168009

SEQ ID NO: 381856 - RNA, 64 nt, Homo Sapiens; identical to SEQ ID NO: 168010

SEQ ID NO: 381857 - RNA, 64 nt, Homo Sapiens; identical to SEQ ID NO: 168011

SEQ ID NO: 381858 - RNA, 64 nt, Homo Sapiens; identical to SEQ ID NO: 168012

SEQ ID NO: 381859 - RNA, 64 nt, Homo Sapiens; identical to SEQ ID NO: 168013

SEQ ID NO: 381860 - RNA, 64 nt, Homo Sapiens; identical to SEQ ID NO: 168014

SEQ ID NO: 381861 - RNA, 64 nt, Homo Sapiens; identical to SEQ ID NO: 168015

SEQ ID NO: 381862 - RNA, 64 nt, Homo Sapiens; identical to SEQ ID NO: 168016

SEQ ID NO: 381863 - RNA, 64 nt, Homo Sapiens; identical to SEQ ID NO: 168017

SEQ ID NO: 381864 - RNA, 64 nt, Homo Sapiens; identical to SEQ ID NO: 168018

SEQ ID NO: 381865 - RNA, 64 nt, Homo Sapiens; identical to SEQ ID NO: 168018

SEQ ID NO: 381866 - RNA, 64 nt, Homo Sapiens; identical to SEQ ID NO: 168020

SEQ ID NO: 381867 - RNA, 64 nt, Homo Sapiens; identical to SEQ ID NO: 168021

SEQ ID NO: 381868 - RNA, 64 nt, Homo Sapiens; identical to SEQ ID NO: 168022

SEQ ID NO: 381869 - RNA, 64 nt, Homo Sapiens; identical to SEQ ID NO: 168023

SEQ ID NO: 381870 - RNA, 64 nt, Homo Sapiens; identical to SEQ ID NO: 168024

SEQ ID NO: 381871 - RNA, 64 nt, Homo Sapiens; identical to SEQ ID NO: 168025

SEQ ID NO: 381872 - RNA, 64 nt, Homo Sapiens; identical to SEQ ID NO: 168026

SEQ ID NO: 381873 - RNA, 64 nt, Homo Sapiens
ugaagucugaaacaaacaaaagcaauucaaugucaauagacauuaagcaacauaauagacaaac

SEQ ID NO: 381874 - RNA, 64 nt, Homo Sapiens
aagcaauucaaugucaauagacauuaagcaacauaauagacaaacaucuccuaagggaacauuu

SEQ ID NO: 381875 - RNA, 64 nt, Homo Sapiens
uuuucuuauacuauguguauauuguguaauaaauaauagacauugguuguugguggucagaauu

SEQ ID NO: 381876 - RNA, 64 nt, Homo Sapiens
acuucagcagcagcuuuuuuuacuacuuuucuaaaauagacauguauguagaaaaacucauuca

SEQ ID NO: 381877 - RNA, 64 nt, Homo Sapiens
aauaagauugucucuaauuucacgaugcugcuccaauagacagcaucauugccugcugaugugc

SEQ ID NO: 381878 - RNA, 64 nt, Homo Sapiens
uacauuuuuaugauauugucaauauagcugccaaaauagacagcagauagucaagaaauucugc

SEQ ID NO: 381879 - RNA, 64 nt, Homo Sapiens
aauguuuugaguaucuuuuaaaugugcucccaggaauagacacaaaucugugcaauaauuuuaa

SEQ ID NO: 381880 - RNA, 64 nt, Homo Sapiens
uugggguuuuauaauaggaaccuggaaacagaccaauagacauuuuuuauauucuucuaccaca

SEQ ID NO: 381881 - RNA, 64 nt, Homo Sapiens
aaaauacuauucucauuaugguuuuucuauuaaaaauagacaguauagauauguauauauacau

SEQ ID NO: 381882 - RNA, 64 nt, Homo Sapiens
caaauauuaacaaguaagauucaugucucuauaaaauagacaguauaucaugaccacacugguu

SEQ ID NO: 381883 - RNA, 64 nt, Homo Sapiens
uauuuuaacaaaaggaaugaaaaauuaucaucucaauagacaaagcuuuugucugagcaccuuu

SEQ ID NO: 381884 - RNA, 64 nt, Homo Sapiens
cugccuucucuaugcagccugcccuccaucauccaccccagaauugcucucuuuccucucuuag

SEQ ID NO: 381885 - RNA, 64 nt, Homo Sapiens
aguccuggaggcagguugugcagcuuaggggaggaccccagaaucuggaccccagagucuggaa

SEQ ID NO: 381886 - RNA, 64 nt, Homo Sapiens
guugugcagcuuaggggaggaccccagaaucuggaccccagagucuggaagcaggccagaaagg

SEQ ID NO: 381887 - RNA, 64 nt, Homo Sapiens
caguuaacugugcuucagggggcccccaguuccuaccccagaacaaccagaacccugucccucc

SEQ ID NO: 381888 - RNA, 64 nt, Homo Sapiens
ccuguucugcugagguuugaagggcccucuggggaccccagaguccuccucacccagugugagg

SEQ ID NO: 381889 - RNA, 64 nt, Homo Sapiens
cuccccucagguuguucucugauucuuccucccaaccccagagacugcagauuugugccaugcg

SEQ ID NO: 381890 - RNA, 64 nt, Homo Sapiens
agagacugcagauuugugccaugcggcugccugcaccccagacaauaaagggaccaaaaccacc

SEQ ID NO: 381891 - RNA, 64 nt, Homo Sapiens
agacugauagguccgugggacccagcaggucagcaccccagagcgggaaagacccugcucagga

SEQ ID NO: 381892 - RNA, 59 nt, Homo Sapiens
cuucuuagugugacaccaaagugugccacaccccagagcugggcaaccucgggcaguag

SEQ ID NO: 381893 - RNA, 64 nt, Homo Sapiens
gaacacacuuguccucagcuuaccaucuccucacaccccagaguggaaaggugaacaccugcag

SEQ ID NO: 381894 - RNA, 64 nt, Homo Sapiens
gugaucugaauuaucuggcacccuccugaauggaaccccagaguaccuccuguguggaaggguc

SEQ ID NO: 381895 - RNA, 64 nt, Homo Sapiens
uuuauuuggccagcagucucacccacugaucuccaccccagaccuucccugauuggugucucag

SEQ ID NO: 381896 - RNA, 64 nt, Homo Sapiens
cucuacuguccccauucucucuccucccaccuucaccccagauucaaguuuuccuccuuguagg

SEQ ID NO: 381897 - RNA, 64 nt, Homo Sapiens
cagcccugagagggguggugaggcagcccccuggaccccagaaccccagacaagggggcaggcg

SEQ ID NO: 381898 - RNA, 64 nt, Homo Sapiens
agagggguggugaggcagcccccuggaccccagaaccccagacaagggggcaggcgggggacca

SEQ ID NO: 381899 - RNA, 64 nt, Homo Sapiens
ugaagguuugggaagucugcccucguguggcuucaccccagaugguuguauggcagauuuguag

SEQ ID NO: 381900 - RNA, 64 nt, Homo Sapiens
acuucccuaaaaagcacaagacaccuucacagccaccccagaggcaagcgggaggaugggggcu

SEQ ID NO: 381901 - RNA, 64 nt, Homo Sapiens
acccacugugaccacugcagcugugcccaugggcaccccagagccaggugugggucacugccac

SEQ ID NO: 381902 - RNA, 64 nt, Homo Sapiens
ccaguuucauccugaaccucugccagcccaggguaccccagacucugggcgccuuccucccacc

SEQ ID NO: 381903 - RNA, 64 nt, Homo Sapiens
caggaaccucucagccgaugggggcacagcacagaccccagagcccaaccaaccacacccggug

SEQ ID NO: 381904 - RNA, 64 nt, Homo Sapiens
caggaaccucucagccgaugggggcacagcacagaccccagaggccaaccagccacacccggug

SEQ ID NO: 381905 - RNA, 64 nt, Homo Sapiens
caggaaccucucagccgaugggggcacagcacagaccccagagcccaaccagccacacccagug

SEQ ID NO: 381906 - RNA, 64 nt, Homo Sapiens
aagcaauacauuuuggggguucccucagccccccaccccagaucuuagcuggcaggucugggug

SEQ ID NO: 381907 - RNA, 64 nt, Homo Sapiens
gaccugggaaugggguggagaggacauccucuucaccccagaauugcgcugcuucagccccauc

SEQ ID NO: 381908 - RNA, 64 nt, Homo Sapiens
gcccagacucuggaggccuucacugaucccagccaccccagaaaagcugcagccugcaggcacc

SEQ ID NO: 381909 - RNA, 64 nt, Homo Sapiens
uggugcuggcgcugcugggucagggcugcccgugaccccagacaccacuguccauccugugagg

SEQ ID NO: 381910 - RNA, 64 nt, Homo Sapiens
cuccugcuagagaggguggcaggccugcugcuggaccccagaggccacugugaccgccaagggg

SEQ ID NO: 381911 - RNA, 64 nt, Homo Sapiens
gaagcucaggccauaguuucagagaaucacccuuaccccagaccuucaugagacagugcucaug

SEQ ID NO: 381912 - RNA, 64 nt, Homo Sapiens
aaugcggcggugcacuuucgcucuugggggcugcaccccagacauagcuggcaccagagcaggg

SEQ ID NO: 381913 - RNA, 64 nt, Homo Sapiens
acauccauguguggcucugcuccaccccugugccaccccagagcccugggggguggucuccaug

SEQ ID NO: 381914 - RNA, 64 nt, Homo Sapiens
gugucuccacggugcucucgcccugcccauggccaccccagacucugaucuccaggaaccccau

SEQ ID NO: 381915 - RNA, 64 nt, Homo Sapiens
ccauggccugacugcacagcgaccagugggggauaccccagagcccaggggcaaaucuuaaugg

SEQ ID NO: 381916 - RNA, 64 nt, Homo Sapiens
uaccacacacccuuccugcucucuucuaccauccaccccagacucagcagcccugggcccccac

SEQ ID NO: 381917 - RNA, 64 nt, Homo Sapiens
ccgaguaaagcgggcgguagccacgccccuccacaccccagacugguagacgagauagcgccac

SEQ ID NO: 381918 - RNA, 64 nt, Homo Sapiens
aggccccaccuucuucauccgagcugccugcaccaccccagagaccaaaccuaccuugcuuugg

SEQ ID NO: 381919 - RNA, 64 nt, Homo Sapiens
ggucccaacaacccggucucucacccagggccugaccccagaguugugugcagccuccugugcc

SEQ ID NO: 381920 - RNA, 64 nt, Homo Sapiens
caacuggauggugccuuuaguccagaccaaucucaccccagaggcccagaccccugggcugacg

SEQ ID NO: 381921 - RNA, 64 nt, Homo Sapiens
gccugaugacaacaagaguuuagucauuuagaucaccccagaugcuacccuaugguccuguucc

SEQ ID NO: 381922 - RNA, 64 nt, Homo Sapiens
gcaguccuuaggaagcacuuugcaauaccccaagaccccagagggugguggggugugagaagcc

SEQ ID NO: 381923 - RNA, 64 nt, Homo Sapiens
gccagggcgcuagaugcaagcuggccccccagggaccccagaggccccuuuuucguugugcagc

SEQ ID NO: 381924 - RNA, 64 nt, Homo Sapiens
ggaaguuccucagccagacucccuccucccguccaccccagaggggaagaguuugggcugccuc

SEQ ID NO: 381925 - RNA, 64 nt, Homo Sapiens
gcuuccccaacauccccgccccagccucccucuuaccccagaaaggucagguaugaccucccgg

SEQ ID NO: 381926 - RNA, 64 nt, Homo Sapiens
ugaccucccggggaggaaucccaccugccuguauaccccagacuugccucuggggccugauuaa

SEQ ID NO: 381927 - RNA, 64 nt, Homo Sapiens
auggccaugccccgugccugaccccugagccaggaccccagaggucccagcacugccgcucccc

SEQ ID NO: 381928 - RNA, 64 nt, Homo Sapiens
cagucgggacaccccccgcagugcuuuccccagcaccccagagcgacagggugcccgccccaca

SEQ ID NO: 381929 - RNA, 64 nt, Homo Sapiens; identical to SEQ ID NO: 276706

SEQ ID NO: 381930 - RNA, 64 nt, Homo Sapiens; identical to SEQ ID NO: 276707

SEQ ID NO: 381931 - RNA, 64 nt, Homo Sapiens; identical to SEQ ID NO: 276708

SEQ ID NO: 381932 - RNA, 64 nt, Homo Sapiens; identical to SEQ ID NO: 276709

SEQ ID NO: 381933 - RNA, 64 nt, Homo Sapiens; identical to SEQ ID NO: 276710

SEQ ID NO: 381934 - RNA, 64 nt, Homo Sapiens; identical to SEQ ID NO: 276711

SEQ ID NO: 381935 - RNA, 64 nt, Homo Sapiens; identical to SEQ ID NO: 276712

SEQ ID NO: 381936 - RNA, 62 nt, Homo Sapiens; identical to SEQ ID NO: 276713

SEQ ID NO: 381937 - RNA, 64 nt, Homo Sapiens; identical to SEQ ID NO: 276714

SEQ ID NO: 381938 - RNA, 64 nt, Homo Sapiens; identical to SEQ ID NO: 276715

SEQ ID NO: 381939 - RNA, 64 nt, Homo Sapiens; identical to SEQ ID NO: 276716

SEQ ID NO: 381940 - RNA, 64 nt, Homo Sapiens; identical to SEQ ID NO: 276717

SEQ ID NO: 381941 - RNA, 64 nt, Homo Sapiens; identical to SEQ ID NO: 276718

SEQ ID NO: 381942 - RNA, 64 nt, Homo Sapiens; identical to SEQ ID NO: 276719

SEQ ID NO: 381943 - RNA, 64 nt, Homo Sapiens; identical to SEQ ID NO: 276720

SEQ ID NO: 381944 - RNA, 64 nt, Homo Sapiens; identical to SEQ ID NO: 276721

SEQ ID NO: 381945 - RNA, 64 nt, Homo Sapiens; identical to SEQ ID NO: 276722

SEQ ID NO: 381946 - RNA, 64 nt, Homo Sapiens; identical to SEQ ID NO: 276723

SEQ ID NO: 381947 - RNA, 64 nt, Homo Sapiens; identical to SEQ ID NO: 276724

SEQ ID NO: 381948 - RNA, 64 nt, Homo Sapiens; identical to SEQ ID NO: 276725

SEQ ID NO: 381949 - RNA, 64 nt, Homo Sapiens; identical to SEQ ID NO: 276726

SEQ ID NO: 381950 - RNA, 64 nt, Homo Sapiens; identical to SEQ ID NO: 276727

SEQ ID NO: 381951 - RNA, 64 nt, Homo Sapiens; identical to SEQ ID NO: 276728

SEQ ID NO: 381952 - RNA, 64 nt, Homo Sapiens; identical to SEQ ID NO: 276729

SEQ ID NO: 381953 - RNA, 64 nt, Homo Sapiens; identical to SEQ ID NO: 276730

SEQ ID NO: 381954 - RNA, 64 nt, Homo Sapiens; identical to SEQ ID NO: 276731

SEQ ID NO: 381955 - RNA, 64 nt, Homo Sapiens; identical to SEQ ID NO: 276732

SEQ ID NO: 381956 - RNA, 64 nt, Homo Sapiens; identical to SEQ ID NO: 276733

SEQ ID NO: 381957 - RNA, 64 nt, Homo Sapiens; identical to SEQ ID NO: 276734

SEQ ID NO: 381958 - RNA, 64 nt, Homo Sapiens; identical to SEQ ID NO: 276735

SEQ ID NO: 381959 - RNA, 64 nt, Homo Sapiens; identical to SEQ ID NO: 276736

SEQ ID NO: 381960 - RNA, 64 nt, Homo Sapiens; identical to SEQ ID NO: 276737

SEQ ID NO: 381961 - RNA, 64 nt, Homo Sapiens; identical to SEQ ID NO: 276738

SEQ ID NO: 381962 - RNA, 64 nt, Homo Sapiens; identical to SEQ ID NO: 276739

SEQ ID NO: 381963 - RNA, 64 nt, Homo Sapiens; identical to SEQ ID NO: 276740

SEQ ID NO: 381964 - RNA, 64 nt, Homo Sapiens; identical to SEQ ID NO: 276741

SEQ ID NO: 381965 - RNA, 64 nt, Homo Sapiens; identical to SEQ ID NO: 276742

SEQ ID NO: 381966 - RNA, 64 nt, Homo Sapiens; identical to SEQ ID NO: 276743

SEQ ID NO: 381967 - RNA, 64 nt, Homo Sapiens; identical to SEQ ID NO: 276744

SEQ ID NO: 381968 - RNA, 64 nt, Homo Sapiens; identical to SEQ ID NO: 276745

SEQ ID NO: 381969 - RNA, 64 nt, Homo Sapiens; identical to SEQ ID NO: 276746

SEQ ID NO: 381970 - RNA, 64 nt, Homo Sapiens; identical to SEQ ID NO: 276747

SEQ ID NO: 381971 - RNA, 64 nt, Homo Sapiens; identical to SEQ ID NO: 276748

SEQ ID NO: 381972 - RNA, 64 nt, Homo Sapiens; identical to SEQ ID NO: 276749

SEQ ID NO: 381973 - RNA, 64 nt, Homo Sapiens; identical to SEQ ID NO: 276750

SEQ ID NO: 381974 - RNA, 64 nt, Homo Sapiens; identical to SEQ ID NO: 276751

SEQ ID NO: 381975 - RNA, 64 nt, Homo Sapiens; identical to SEQ ID NO: 276752

SEQ ID NO: 381976 - RNA, 64 nt, Homo Sapiens; identical to SEQ ID NO: 276753

SEQ ID NO: 381977 - RNA, 64 nt, Homo Sapiens; identical to SEQ ID NO: 276754

SEQ ID NO: 381978 - RNA, 64 nt, Homo Sapiens; identical to SEQ ID NO: 276755

SEQ ID NO: 381979 - RNA, 64 nt, Homo Sapiens; identical to SEQ ID NO: 276756

SEQ ID NO: 381980 - RNA, 64 nt, Homo Sapiens; identical to SEQ ID NO: 276757

SEQ ID NO: 381981 - RNA, 64 nt, Homo Sapiens; identical to SEQ ID NO: 276758

SEQ ID NO: 381982 - RNA, 64 nt, Homo Sapiens; identical to SEQ ID NO: 276759

SEQ ID NO: 381983 - RNA, 64 nt, Homo Sapiens; identical to SEQ ID NO: 276760

SEQ ID NO: 381984 - RNA, 64 nt, Homo Sapiens; identical to SEQ ID NO: 276759

SEQ ID NO: 381985 - RNA, 64 nt, Homo Sapiens
aaagcguuaccucucauuucucuuugugauucuugacggugacucuuguauguaauccuguggc

SEQ ID NO: 381986 - RNA, 64 nt, Homo Sapiens
uugacugcuaggggagggaaccuggguauggugagacggugacgagagaaaagggucacaaagg

SEQ ID NO: 381987 - RNA, 64 nt, Homo Sapiens
cugcccacaagccccagcauccggccaauggcgagacggugacgcaggggucaacugcuacaug

SEQ ID NO: 381988 - RNA, 64 nt, Homo Sapiens
agucuccaccuggucuuccaagguuuuuuacuuugacggugagauugcccuugacauggacaau

SEQ ID NO: 381989 - RNA, 64 nt, Homo Sapiens
ugauguaaugacagagaaggaccauccaugagaagacggugaaaaaugcacgaagucacaaugc

SEQ ID NO: 381990 - RNA, 64 nt, Homo Sapiens
gccguaacaguaaauuuggcggcagaaaauuugagacggugauccuucaccuuauucuuuaaag

SEQ ID NO: 381991 - RNA, 64 nt, Homo Sapiens
caucagaccugaaaaaacaacacugggggagggggacggugaaggccaaguucccaaugagggu

SEQ ID NO: 381992 - RNA, 64 nt, Homo Sapiens
cagggcugaaaucagguggcuuccuuagcccaaagacggugagauuuucggucuuugcgugaug

SEQ ID NO: 381993 - RNA, 64 nt, Homo Sapiens
ugggugccuguccucuccugccuccugggauucagacggugaagacugacuucugggacgagga

SEQ ID NO: 381994 - RNA, 64 nt, Homo Sapiens
cuaaacugugagacucacagaggggaaagauacugacggugaaaccagcauggaaaacgucuuu

SEQ ID NO: 381995 - RNA, 64 nt, Homo Sapiens
cacgaggucaggagauugagaccauccuggcuacgacggugaaaccccgucucuacuaaaaaua

SEQ ID NO: 381996 - RNA, 64 nt, Homo Sapiens
ccccaucucuauuaaaaauaaccauccuuacuaagacggugaaccauuaggucaggagaucgag

SEQ ID NO: 381997 - RNA, 64 nt, Homo Sapiens
ccagugcuggacccggccagcucgagggcgccgagacggugacucgggcacucccgagcugcug

SEQ ID NO: 381998 - RNA, 64 nt, Homo Sapiens
aaauguuugccaggguccagggcccaaccucacugacggugaaaacuguggagaugaugcaguu

SEQ ID NO: 381999 - RNA, 64 nt, Homo Sapiens
caaaauggagagcguauucugauagaaggacgucgacggugaauguucuggugguuguugccug

SEQ ID NO: 382000 - RNA, 64 nt, Homo Sapiens
uuugaagcacaacucccuuaaggucuccaaaccagacggugacgccugcgggaccaucuggggc

SEQ ID NO: 382001 - RNA, 60 nt, Homo Sapiens
acccagcuggcaugcaauaacaaggcugcagacggugacuggcccuggcuuccugggugg

SEQ ID NO: 382002 - RNA, 64 nt, Homo Sapiens
cgcauggaacagugcaggacucagauacuuggcugacggugaaccuuuucggcaucgggccauc

SEQ ID NO: 382003 - RNA, 64 nt, Homo Sapiens
ggacagaggggacucugggcuauggacacagggugacggugacaaagauggcucagagggggac

SEQ ID NO: 382004 - RNA, 64 nt, Homo Sapiens
ugcaugaggccugcagguggccuauuuugacucagacggugaaaaaagcaaauuaacucauuug

SEQ ID NO: 382005 - RNA, 64 nt, Homo Sapiens
acccagcagcaacugaaaggccugcugcaggagugacggugaugucuguaggaccugguccugc

SEQ ID NO: 382006 - RNA, 57 nt, Homo Sapiens
ccagcuaccccacugugugagcugguggacggugaugaggaaggacuugacugggga

SEQ ID NO: 382007 - RNA, 64 nt, Homo Sapiens
uuuuuuccaauaaaauauuucccccucuugcgaagacggugacucgaugucgcuggggccccua

SEQ ID NO: 382008 - RNA, 64 nt, Homo Sapiens
guaucuaccuugcuguguuaaaucaugacagugagacggugagauggauucguuuugcacacaa

SEQ ID NO: 382009 - RNA, 64 nt, Homo Sapiens
cuugcccuuaauucauaauuuguauucacaggaagacggugauugaauucuuaaauuaugggaa

SEQ ID NO: 382010 - RNA, 56 nt, Homo Sapiens
auaaaagaguuuuacuucucuguuuggacggugaaaucucccaguauauugacuga

SEQ ID NO: 382011 - RNA, 64 nt, Homo Sapiens
caaugauacuucuuuuuaucgugcugcucagcaggacggugaaagggagucagaaacagaguug

SEQ ID NO: 382012 - RNA, 64 nt, Homo Sapiens
gcagaccugucuacauccaccaccuguggggcaggacggugacuccacuuggccucagucuccc

SEQ ID NO: 382013 - RNA, 64 nt, Homo Sapiens
auguuuacaagcaccacauuugggucucugugcggacggugacaccauucagacacauggaugu

SEQ ID NO: 382014 - RNA, 64 nt, Homo Sapiens
ggaaauuagaaucuguuugcgccaguuuggugcugacggugagaacccagggguggugguccca

SEQ ID NO: 382015 - RNA, 64 nt, Homo Sapiens
auauaguuuuuuuaauuuuuaaaaaaccuguggagacggugaucuugucuuuaaaacaugauag

SEQ ID NO: 382016 - RNA, 64 nt, Homo Sapiens
guggcccaggagccauggccagaagucugaggcagacggugagggacacagaccagacuaagga

SEQ ID NO: 382017 - RNA, 64 nt, Homo Sapiens
ggaagacacuuaccuaacaaaaugauucagucuugacggugaauuauguggugauaaugaaaag

SEQ ID NO: 382018 - RNA, 64 nt, Homo Sapiens
aaacugagguucaguacucuaagucugaauuuaagacggugauguuucccaguuuacaugaaug

SEQ ID NO: 382019 - RNA, 64 nt, Homo Sapiens
ccuccaagagcccauugaagaagcccagugaugagacggugagaugguuugaguccucggugcc

SEQ ID NO: 382020 - RNA, 64 nt, Homo Sapiens
cacaguuauuucuauccacgccuaugaaucuuuggacggugagaucucacagaugucagaacug

SEQ ID NO: 382021 - RNA, 64 nt, Homo Sapiens
accucaggcgguggacgucggcgauagccguguggacggugaccggcucacucugcggcgccgu

SEQ ID NO: 382022 - RNA, 64 nt, Homo Sapiens
uuaagugucacacaagguguuguugcaauggcaugacggugaccuguugacguaacuaagccuu

SEQ ID NO: 382023 - RNA, 64 nt, Homo Sapiens
cgcagcugcaucaaccuccucccccacuguagaggacggugagcccccucgugucucuuugugu

SEQ ID NO: 382024 - RNA, 64 nt, Homo Sapiens
agcugccgcccggugccaccucgugguagacuaugacggugacucuuggcagcagaccaguggg

SEQ ID NO: 382025 - RNA, 64 nt, Homo Sapiens
acgacugggugaacagccauaagauugagaugaugacggugaugggacacugcugaugauuccc

SEQ ID NO: 382026 - RNA, 64 nt, Homo Sapiens
guggccuugaagccuggaggggcagucucugagugacggugacuuuuucucucuugccaaauga

SEQ ID NO: 382027 - RNA, 64 nt, Homo Sapiens
aagggggaggcagcaagagucaaggugucggcgggacggugagggccuugccaagggccugggg

SEQ ID NO: 382028 - RNA, 64 nt, Homo Sapiens
aagggaaacagauacuugauaugaaagccauaaugacggugacuugugucgugggggaaaacau

SEQ ID NO: 382029 - RNA, 64 nt, Homo Sapiens
uguucacuuuuggcauauguauauaaguaauauugacggugauaugaaaacuuuuguuauguga

SEQ ID NO: 382030 - RNA, 64 nt, Homo Sapiens
auccuaaaugucuucaugucuaucagucugagcagacggugaguagggcgggcacauucuccag

SEQ ID NO: 382031 - RNA, 64 nt, Homo Sapiens
cguccuggcugggccuggucccaggcccacgaaagacggugacucuuggcucugcccgaggaug

SEQ ID NO: 382032 - RNA, 64 nt, Homo Sapiens
gagcaugaucgcgacacugcacuccagccugggugacggugagacuuugucucaaaaaaaaaaa

SEQ ID NO: 382033 - RNA, 64 nt, Homo Sapiens
accacagaaccucagcuuugaacccuggagugaggacggugaugcccuguguguauuaauaugc

SEQ ID NO: 382034 - RNA, 64 nt, Homo Sapiens
ggccauguguuaauguuacgucccaucgcugggggacggugaacacccugggccccaggccagc

SEQ ID NO: 382035 - RNA, 64 nt, Homo Sapiens
augucacacacagacacagugauggcaucacacagacggugauguaaugucacacagacgcggc

SEQ ID NO: 382036 - RNA, 64 nt, Homo Sapiens
gcacuucugucuuaaagguuggcugggcguguaggacggugagacagguggggaggcuuuggcu

SEQ ID NO: 382037 - RNA, 64 nt, Homo Sapiens
ugcucccuaucugcgcacccggagguggggugaggacggugacgaagguacccaggucuggggc

SEQ ID NO: 382038 - RNA, 64 nt, Homo Sapiens
cugggggccagccagagcccgugccucaucacaggacggugacuuugguauuuccuuuugugga

SEQ ID NO: 382039 - RNA, 64 nt, Homo Sapiens
aagguacccaggucuggggcggagguggggugaggacggugacgugcucccuaugugcacaccc

SEQ ID NO: 382040 - RNA, 64 nt, Homo Sapiens
uggaaggcagaugguaccccuauccgggaaucuugacggugaccugugucucaugaaugacuuu

SEQ ID NO: 382041 - RNA, 64 nt, Homo Sapiens
uuuucggauuuucuguauuugaagcucagagagagacggugauggauaaauugacaacucugua

SEQ ID NO: 382042 - RNA, 64 nt, Homo Sapiens
uggugccuccucaaacccagucucagacacuaaaugcagacaacaccuuccuccugcagacacc

SEQ ID NO: 382043 - RNA, 64 nt, Homo Sapiens
ucucagacacuaaaugcagacaacaccuuccuccugcagacaccuggacugagccaaggaggcc

SEQ ID NO: 382044 - RNA, 64 nt, Homo Sapiens
agcaaucccugacaugacaucucccaauauagggugcagacaagucagacaugccacucugugg

SEQ ID NO: 382045 - RNA, 64 nt, Homo Sapiens
cguggcucugggccccucuccuuggagugguuauugcagacagacugcuccugcagcaaccaaa

SEQ ID NO: 382046 - RNA, 64 nt, Homo Sapiens
gcuucuuacuaaguuuuuaaaauuauucauaaaaugcagacauuuuuggugaauguuuagccau

SEQ ID NO: 382047 - RNA, 64 nt, Homo Sapiens
aaagaucuuugcaguguaauucuuuguuuuuaauugcagacauuuaaaaaugucauuuucuacu

SEQ ID NO: 382048 - RNA, 64 nt, Homo Sapiens
uggcuacaaacuuuccauacaagccaaucggggaugcagacaagauccuccuggccagccacau

SEQ ID NO: 382049 - RNA, 64 nt, Homo Sapiens
uucugcaauaagcucucagaauacuaagggcaccugcagacacuaacuuagcucagccugacac

SEQ ID NO: 382050 - RNA, 64 nt, Homo Sapiens
acagcagaggcuccagacaaggcuauucccauuuugcagacagggaugacccuggacagagcgg

SEQ ID NO: 382051 - RNA, 64 nt, Homo Sapiens
auacagagccuucaggcucuccaggugccaagugugcagacacauguugcauuuauguuagcua

SEQ ID NO: 382052 - RNA, 64 nt, Homo Sapiens
agugcucacaaggugcacacugcuguguguaccuugcagacaggccggcguucagccuccaagg

SEQ ID NO: 382053 - RNA, 64 nt, Homo Sapiens
uauuuuugcaugaauuaagacguuuuaauuucuuugcagacaaggucuagaugcggagucagag

SEQ ID NO: 382054 - RNA, 64 nt, Homo Sapiens
uugccagggcuccaggaagggcucuggcucagguugcagacagcugagaaaagauggcccuguc

SEQ ID NO: 382055 - RNA, 64 nt, Homo Sapiens
aucugcugggacugccuggagauuugucaggagcugcagacaaguaccuuggagcauucuguua

SEQ ID NO: 382056 - RNA, 64 nt, Homo Sapiens
uuacucuagucuccaagccucuagcauagagcacugcagacaggcccuggcucagaaucagagc

SEQ ID NO: 382057 - RNA, 64 nt, Homo Sapiens
ggcccuggcucagaaucagagcccagaaaguggcugcagacaaaaucaauaaaacuaauguccc

SEQ ID NO: 382058 - RNA, 64 nt, Homo Sapiens
ggugaggugggaugauuucacccgcaggcagcccugcagacaccagcuggaccuugcugugucg

SEQ ID NO: 382059 - RNA, 64 nt, Homo Sapiens
ccaauugcugcucuguugcugggggugcaggcucugcagacaccaggaugggucugccugcucu

SEQ ID NO: 382060 - RNA, 64 nt, Homo Sapiens
cuucuguuggguggcaucauagcgccagugcgggugcagacaauggcggaagcugcuacucgug

SEQ ID NO: 382061 - RNA, 64 nt, Homo Sapiens
gggccagaacaccacacauuuugcuuuugcucgaugcagacaggucuucuugaauggcaauguu

SEQ ID NO: 382062 - RNA, 64 nt, Homo Sapiens; identical to SEQ ID NO: 274946

SEQ ID NO: 382063 - RNA, 64 nt, Homo Sapiens; identical to SEQ ID NO: 274947

SEQ ID NO: 382064 - RNA, 64 nt, Homo Sapiens; identical to SEQ ID NO: 274948

SEQ ID NO: 382065 - RNA, 64 nt, Homo Sapiens; identical to SEQ ID NO: 274949

SEQ ID NO: 382066 - RNA, 64 nt, Homo Sapiens; identical to SEQ ID NO: 274950

SEQ ID NO: 382067 - RNA, 64 nt, Homo Sapiens; identical to SEQ ID NO: 274951

SEQ ID NO: 382068 - RNA, 64 nt, Homo Sapiens; identical to SEQ ID NO: 274952

SEQ ID NO: 382069 - RNA, 64 nt, Homo Sapiens; identical to SEQ ID NO: 274953

SEQ ID NO: 382070 - RNA, 64 nt, Homo Sapiens; identical to SEQ ID NO: 274954

SEQ ID NO: 382071 - RNA, 64 nt, Homo Sapiens; identical to SEQ ID NO: 274955

SEQ ID NO: 382072 - RNA, 64 nt, Homo Sapiens; identical to SEQ ID NO: 274956

SEQ ID NO: 382073 - RNA, 64 nt, Homo Sapiens; identical to SEQ ID NO: 274957

SEQ ID NO: 382074 - RNA, 64 nt, Homo Sapiens; identical to SEQ ID NO: 274958

SEQ ID NO: 382075 - RNA, 64 nt, Homo Sapiens; identical to SEQ ID NO: 274959

SEQ ID NO: 382076 - RNA, 64 nt, Homo Sapiens; identical to SEQ ID NO: 274960

SEQ ID NO: 382077 - RNA, 64 nt, Homo Sapiens; identical to SEQ ID NO: 274961

SEQ ID NO: 382078 - RNA, 64 nt, Homo Sapiens; identical to SEQ ID NO: 274962

SEQ ID NO: 382079 - RNA, 64 nt, Homo Sapiens; identical to SEQ ID NO: 274963

SEQ ID NO: 382080 - RNA, 64 nt, Homo Sapiens; identical to SEQ ID NO: 274964

SEQ ID NO: 382081 - RNA, 64 nt, Homo Sapiens; identical to SEQ ID NO: 274965

SEQ ID NO: 382082 - RNA, 64 nt, Homo Sapiens; identical to SEQ ID NO: 274966

SEQ ID NO: 382083 - RNA, 64 nt, Homo Sapiens; identical to SEQ ID NO: 274967

SEQ ID NO: 382084 - RNA, 64 nt, Homo Sapiens; identical to SEQ ID NO: 274968

SEQ ID NO: 382085 - RNA, 64 nt, Homo Sapiens; identical to SEQ ID NO: 274969

SEQ ID NO: 382086 - RNA, 64 nt, Homo Sapiens; identical to SEQ ID NO: 274970

SEQ ID NO: 382087 - RNA, 64 nt, Homo Sapiens; identical to SEQ ID NO: 274971

SEQ ID NO: 382088 - RNA, 64 nt, Homo Sapiens; identical to SEQ ID NO: 274972

SEQ ID NO: 382089 - RNA, 64 nt, Homo Sapiens; identical to SEQ ID NO: 274973

SEQ ID NO: 382090 - RNA, 64 nt, Homo Sapiens; identical to SEQ ID NO: 274974

SEQ ID NO: 382091 - RNA, 64 nt, Homo Sapiens; identical to SEQ ID NO: 274975

SEQ ID NO: 382092 - RNA, 64 nt, Homo Sapiens; identical to SEQ ID NO: 274976

SEQ ID NO: 382093 - RNA, 64 nt, Homo Sapiens; identical to SEQ ID NO: 274977

SEQ ID NO: 382094 - RNA, 64 nt, Homo Sapiens; identical to SEQ ID NO: 274978

SEQ ID NO: 382095 - RNA, 64 nt, Homo Sapiens; identical to SEQ ID NO: 274979

SEQ ID NO: 382096 - RNA, 64 nt, Homo Sapiens; identical to SEQ ID NO: 274980

SEQ ID NO: 382097 - RNA, 64 nt, Homo Sapiens; identical to SEQ ID NO: 274981

SEQ ID NO: 382098 - RNA, 59 nt, Homo Sapiens; identical to SEQ ID NO: 274982

SEQ ID NO: 382099 - RNA, 64 nt, Homo Sapiens
aagccacugaggcagggcagagggaccuuugauaggcuacgauacuauuuuccugugcaucaca

SEQ ID NO: 382100 - RNA, 64 nt, Homo Sapiens
gggaccacguggugcuauggugaagggaggccggggcuacgacccgaaggccagauccuggacg

SEQ ID NO: 382101 - RNA, 64 nt, Homo Sapiens
gggccgcagggggcgcggggcgcggcgggacccaggcuacgagcgggagggaggcgggagucgg

SEQ ID NO: 382102 - RNA, 64 nt, Homo Sapiens
aggaauagcgaaaaagcaaaaacaacgaauuuggggcuacgaagacacagcggagaccgccucc

SEQ ID NO: 382103 - RNA, 64 nt, Homo Sapiens
acugggcaagaagaaagauguuuaaaaaaagaaaggcuacgaugugaguacuagggaucaugug

SEQ ID NO: 382104 - RNA, 64 nt, Homo Sapiens
uggucuacagcccccagagcgcgauggcuacaagggcuacgaccgcugaaggcuuacuucagau

SEQ ID NO: 382105 - RNA, 64 nt, Homo Sapiens
gcggaucacgaggucaggagauugagaccauccuggcuacgacggugaaaccccgucucuacua

SEQ ID NO: 382106 - RNA, 64 nt, Homo Sapiens
uucagaagaacugagcaaacuaacagaaauacaaggcuacgaacaguuuaguggacaacuaaau

SEQ ID NO: 382107 - RNA, 64 nt, Homo Sapiens
gcagcaggcgugaggcacugugcgucugcagaggggcuacgaaccaggugcagggucccagcug

SEQ ID NO: 382108 - RNA, 64 nt, Homo Sapiens
uggcccgggauagaagaggggagguaagucugggggcuacgaagccgggcccccacacccuggc

SEQ ID NO: 382109 - RNA, 64 nt, Homo Sapiens
gagcugacagccuuggaguucagugcuuccccagggcuacgaaggaagcugaacacgcguccag

SEQ ID NO: 382110 - RNA, 64 nt, Homo Sapiens
aauacuauagcuucacacagauccuaugccgaaaggcuacgagcaugauuuauuuucuucuuag

SEQ ID NO: 382111 - RNA, 64 nt, Homo Sapiens
cuugcauucuggguuuggcuccacgugcucugcuggcuacgauucugcaacuuggacguuguuu

SEQ ID NO: 382112 - RNA, 64 nt, Homo Sapiens
ccugcgcucugccacuguccggaaauucaugguuggcuacgaaaugcuugcucaggcucagagg

SEQ ID NO: 382113 - RNA, 64 nt, Homo Sapiens
cuuccgauggaugaaucuccugacuggaccugguggcuacgaaugaaagugcauaugaaauccu

SEQ ID NO: 382114 - RNA, 64 nt, Homo Sapiens
uauuuagagggugguuuuuuuuaauuuaucuaauggcuacgauauagccagauucaaauaacau

SEQ ID NO: 382115 - RNA, 64 nt, Homo Sapiens
uuuucuuauugcaaagcuuccauuccaaauucaaggcuacgauauugcuuugcuuacagcuugg

SEQ ID NO: 382116 - RNA, 64 nt, Homo Sapiens
auuuguuccacuuccuugagaggcagagacgccuggcuacgacgcggauuucggguuuccggag

SEQ ID NO: 382117 - RNA, 64 nt, Homo Sapiens
auuggugguagccccuggagacauugugcaauggggcuacgaggcugcaucuggcuccagggaa

SEQ ID NO: 382118 - RNA, 64 nt, Homo Sapiens
ugaacaguggauguuucugacauucuucaaggacggcuacgagcagcuuaggcagcucucccag

SEQ ID NO: 382119 - RNA, 64 nt, Homo Sapiens
aaggcuaugaauaaggguuagcaugguuuuuagaggcuacgaauagccaacauccgucucuuga

SEQ ID NO: 382120 - RNA, 64 nt, Homo Sapiens
caauguuaaguacaacauucugaaaauacaauuuggcuacgaagaguauucaucuucuuugaag

SEQ ID NO: 382121 - RNA, 64 nt, Homo Sapiens
gguggaucaccugaggucagccagcacuuugggaggcuacgauggguggcuuaugccuguaauc

SEQ ID NO: 382122 - RNA, 64 nt, Homo Sapiens
uuccagaccuaacccagaccaucuccccccgccgggcuacgaugacauguaccugugaaggccu

SEQ ID NO: 382123 - RNA, 64 nt, Homo Sapiens
auguagaauguuaaaagcacaaaauagcguucauggcuacgaauguacauugagggaauaucaa

SEQ ID NO: 382124 - RNA, 64 nt, Homo Sapiens
auccggcugggagcaugacccaucacggcggcgaggcuacgacauggggccuccacaccugccu

SEQ ID NO: 382125 - RNA, 64 nt, Homo Sapiens
ugggacggaaguggccugaggggagaauggcucuggcuacgacuauggguuuuguuaggggugg

SEQ ID NO: 382126 - RNA, 64 nt, Homo Sapiens; identical to SEQ ID NO: 175619

SEQ ID NO: 382127 - RNA, 64 nt, Homo Sapiens; identical to SEQ ID NO: 175620

SEQ ID NO: 382128 - RNA, 64 nt, Homo Sapiens; identical to SEQ ID NO: 175621

SEQ ID NO: 382129 - RNA, 64 nt, Homo Sapiens; identical to SEQ ID NO: 175622

SEQ ID NO: 382130 - RNA, 64 nt, Homo Sapiens; identical to SEQ ID NO: 175623

SEQ ID NO: 382131 - RNA, 64 nt, Homo Sapiens; identical to SEQ ID NO: 175624

SEQ ID NO: 382132 - RNA, 64 nt, Homo Sapiens; identical to SEQ ID NO: 175625

SEQ ID NO: 382133 - RNA, 64 nt, Homo Sapiens; identical to SEQ ID NO: 175626

SEQ ID NO: 382134 - RNA, 64 nt, Homo Sapiens; identical to SEQ ID NO: 175627

SEQ ID NO: 382135 - RNA, 64 nt, Homo Sapiens; identical to SEQ ID NO: 175628

SEQ ID NO: 382136 - RNA, 64 nt, Homo Sapiens; identical to SEQ ID NO: 175629

SEQ ID NO: 382137 - RNA, 64 nt, Homo Sapiens; identical to SEQ ID NO: 175630

SEQ ID NO: 382138 - RNA, 64 nt, Homo Sapiens; identical to SEQ ID NO: 175631

SEQ ID NO: 382139 - RNA, 64 nt, Homo Sapiens; identical to SEQ ID NO: 175632

SEQ ID NO: 382140 - RNA, 64 nt, Homo Sapiens; identical to SEQ ID NO: 22266

SEQ ID NO: 382141 - RNA, 64 nt, Homo Sapiens; identical to SEQ ID NO: 22267

SEQ ID NO: 382142 - RNA, 64 nt, Homo Sapiens; identical to SEQ ID NO: 22268

SEQ ID NO: 382143 - RNA, 64 nt, Homo Sapiens; identical to SEQ ID NO: 22269

SEQ ID NO: 382144 - RNA, 64 nt, Homo Sapiens; identical to SEQ ID NO: 22270

SEQ ID NO: 382145 - RNA, 64 nt, Homo Sapiens; identical to SEQ ID NO: 22271

SEQ ID NO: 382146 - RNA, 64 nt, Homo Sapiens; identical to SEQ ID NO: 22272

SEQ ID NO: 382147 - RNA, 64 nt, Homo Sapiens; identical to SEQ ID NO: 22273

SEQ ID NO: 382148 - RNA, 64 nt, Homo Sapiens; identical to SEQ ID NO: 22274

SEQ ID NO: 382149 - RNA, 64 nt, Homo Sapiens; identical to SEQ ID NO: 22275

SEQ ID NO: 382150 - RNA, 64 nt, Homo Sapiens; identical to SEQ ID NO: 22276

SEQ ID NO: 382151 - RNA, 64 nt, Homo Sapiens; identical to SEQ ID NO: 22277

SEQ ID NO: 382152 - RNA, 64 nt, Homo Sapiens
uuugaauuauuucuaagccuuuacuacuugggccucuuucuaguagcaagagccauagguagcc

SEQ ID NO: 382153 - RNA, 64 nt, Homo Sapiens
cacacacacaucagacuggcuuauuuucuaucauucuuucuagacucuugaacucaagaacucu

SEQ ID NO: 382154 - RNA, 64 nt, Homo Sapiens
ccccagacuuuggccucugagggucaagcuuccuucuuucuaaccuguaaaugaaacuuuguuu

SEQ ID NO: 382155 - RNA, 64 nt, Homo Sapiens
ccucccucuugggcaugggcuccauuugcuuggcucuuucuacauggcuguccucuuucuccac

SEQ ID NO: 382156 - RNA, 64 nt, Homo Sapiens
acaaggaaauagauaaacuguggacuauaccguaucuuucuagcauacccagucacugcauuuu

SEQ ID NO: 382157 - RNA, 64 nt, Homo Sapiens
aucagguaccugcuuucauuguuuuuuuauuguuucuuucuaugaugaagaacuauugaugcaa

SEQ ID NO: 382158 - RNA, 64 nt, Homo Sapiens
acuugaggauguugaaauguauuacauuuuggcuucuuucuacauguuaacugcacuguagaug

SEQ ID NO: 382159 - RNA, 64 nt, Homo Sapiens
uuuaccuuaaauuggaagacuuuuaauugcagucucuuucuaccuucccucuguuagucauuug

SEQ ID NO: 382160 - RNA, 64 nt, Homo Sapiens
cagauaggccauugcuuucacaggcgaagugacaucuuucuaacgguguuugaaaggaugcuau

SEQ ID NO: 382161 - RNA, 64 nt, Homo Sapiens
guaaaauggcgccuuuaaaaaggcccacuuguauucuuucuacugaggccagugccuguccccc

SEQ ID NO: 382162 - RNA, 64 nt, Homo Sapiens
caaagguauuauguaaaaauauuuaauaauuuauucuuucuauuacugaauuaaaaaaucagag

SEQ ID NO: 382163 - RNA, 64 nt, Homo Sapiens
uguauuucuugcuuauuauauguaaaguugagcuucuuucuagauauuaggccuuugaauaaaa

SEQ ID NO: 382164 - RNA, 64 nt, Homo Sapiens
aaggauuaggagccauaccucccagagcaagguaucuuucuagagcaaauuucucuuucuagaa

SEQ ID NO: 382165 - RNA, 64 nt, Homo Sapiens
ucccagagcaagguaucuuucuagagcaaauuucucuuucuagaaggggagggucacaggguca

SEQ ID NO: 382166 - RNA, 64 nt, Homo Sapiens
uaucacuacacaaaccaggcacucucccuuucugucuuucuaguuuccuuuccuugucucucuc

SEQ ID NO: 382167 - RNA, 64 nt, Homo Sapiens
ccuguccacaccuaauaagugcaaucauuuugagucuuucuauguugucuagacggagggguuu

SEQ ID NO: 382168 - RNA, 64 nt, Homo Sapiens
augcauucuuucuuaugaauuguauauuuagaaaucuuucuaaauaccauuaaggcuugacugg

SEQ ID NO: 382169 - RNA, 64 nt, Homo Sapiens
uuuauaccaaguucaaaacacuuucagauagaagucuuucuaugcaaagauuaaaguaugacuu

SEQ ID NO: 382170 - RNA, 64 nt, Homo Sapiens
gauuucuaaauauauaaaaucaaacaagaaccucucuuucuagguacuauuaauaagaaaccaa

SEQ ID NO: 382171 - RNA, 64 nt, Homo Sapiens
cacuugucccauuucauucuauaaaauaauugguucuuucuaaacuauuucagguauaggaauu

SEQ ID NO: 382172 - RNA, 64 nt, Homo Sapiens
cugccuaaacucuaggccauaauguagcaaaauuucuuucuaacggacugaacgagcauaaaua

SEQ ID NO: 382173 - RNA, 64 nt, Homo Sapiens
auugucuauuaaagcagaggcccccguuaacaugucuuucuaaaccuuaguauugugugauuuu

SEQ ID NO: 382174 - RNA, 64 nt, Homo Sapiens
ccuauuugauaguuugagucaaaacuguguguucucuuucuauuagccuuuucuauuugcguuc

SEQ ID NO: 382175 - RNA, 64 nt, Homo Sapiens
accaaaggaugacuguaggccgugugcuggccuuucuuucuaagaagcugcuuugagcuccugg

SEQ ID NO: 382176 - RNA, 64 nt, Homo Sapiens
ucugugaaauucguuuucuuuuucauggugccuuucuuucuaagaaaagauagaaagaaugggg

SEQ ID NO: 382177 - RNA, 64 nt, Homo Sapiens
gcaaaaggcuucaaggaauuuaucucaacauuauucuuucuauguccuaacuaaauuucucaac

SEQ ID NO: 382178 - RNA, 64 nt, Homo Sapiens
guguuuuuguucuacauauuuuucaauaauuuauucuuucuaauguugaaauuauaucaggcuu

SEQ ID NO: 382179 - RNA, 64 nt, Homo Sapiens
ucucuuuauuuuucuuucuuuuucuuucccuuucucuuucuaucguguuuguuuuuucucucuc

SEQ ID NO: 382180 - RNA, 64 nt, Homo Sapiens
aucucuccccacccucugaggcuauuccuuuuguucuuucuagccaacuugagauuuaaaaacu

SEQ ID NO: 382181 - RNA, 64 nt, Homo Sapiens
uccacaggugcagcccuccccagguagaggaaguucuuucuacuucuccagcuucuugcuuggg

SEQ ID NO: 382182 - RNA, 64 nt, Homo Sapiens
ugugccacuaugggcacuagcucuugaggcuggaucuuucuacucucaaccauguccgccccag

SEQ ID NO: 382183 - RNA, 64 nt, Homo Sapiens
aauuuagaaaauguuaucuuaugaaugugaauauucuuucuaaacacgugaaacccaugacaaa

SEQ ID NO: 382184 - RNA, 64 nt, Homo Sapiens
aacugaacacaaaacucagguaguuguaugagucucuuucuauguaguccucuuauuaugcuuu

SEQ ID NO: 382185 - RNA, 64 nt, Homo Sapiens
caccuuagaacuuuuugguuauccagcauucagaucuuucuaguucucauuagaacaaugaauu

SEQ ID NO: 382186 - RNA, 64 nt, Homo Sapiens
caacucgggcuguuuguuuuuccuuauuugcacuucuuucuacauaagugguuuaugaauuguu

SEQ ID NO: 382187 - RNA, 64 nt, Homo Sapiens
ggccucuuuucauuuucucccacaggccucucuuucuuucuagguugcuggggagaaaugggua

SEQ ID NO: 382188 - RNA, 64 nt, Homo Sapiens
ccucuugggaugcccugaguugcuucccauuuccucuuucuagccguccuuuucuagugugugc

SEQ ID NO: 382189 - RNA, 64 nt, Homo Sapiens
cuugcugguuucaagauuagggauggccucauucucuuucuaaucugggaaagucugagugaaa

SEQ ID NO: 382190 - RNA, 64 nt, Homo Sapiens
aauguuugcuccugguuggaaaauaugcccuggcucuuucuaccaaauucuggguguaaagagu

SEQ ID NO: 382191 - RNA, 64 nt, Homo Sapiens
aagggguuauuggucaguggugugcuuuuaugugucuuucuacaaggcauauuucuuugagcac

SEQ ID NO: 382192 - RNA, 64 nt, Homo Sapiens
gaaaugucaauucaaucccacaucugaguaugccucuuucuauugcccucaauccauguaggga

SEQ ID NO: 382193 - RNA, 62 nt, Homo Sapiens
guaauaaguauauaauaugugagaauauuauauaugacuauuacuuauacaugcacaugcac

SEQ ID NO: 382194 - RNA, 62 nt, Homo Sapiens
gugucuucaacugaaaaauacaaucuguggauuaugacuaccagcaauuuuuuucuaggaaa

SEQ ID NO: 382195 - RNA, 62 nt, Homo Sapiens
uaaaugagaacauggaugaguggacuucauauuaugacuagcuuuacuauuuuaauucaccu

SEQ ID NO: 382196 - RNA, 62 nt, Homo Sapiens
aagcuauguguucagacugaaacuggagaaauuaugacuauuuuauuuauaguaguaguuaa

SEQ ID NO: 382197 - RNA, 62 nt, Homo Sapiens
acauguuaaauaaaaauagcauggaguugcuuuaugacuauugauaucagaaaacuaaauau

SEQ ID NO: 382198 - RNA, 62 nt, Homo Sapiens
uguuacugauuuagagacuauuuguaugguguuaugacuaauuuccugaauauuuaaaugug

SEQ ID NO: 382199 - RNA, 64 nt, Homo Sapiens
aaaaauuggcaguauuggcauuagaaaagcaucccugaauaaucaagccugaauaaucuauggg

SEQ ID NO: 382200 - RNA, 64 nt, Homo Sapiens
uauggguuagaaaagcauccggaaauacagaagccugaauaaucaaagacagcuaucaggaaga

SEQ ID NO: 382201 - RNA, 64 nt, Homo Sapiens
aauuaacagaacauuguucguaauuuaguucauacugaauaagaagaauguauaaggcauauua

SEQ ID NO: 382202 - RNA, 57 nt, Homo Sapiens
ucaaaacucuugaaauuagugccaguacugaauaaacgcagaaugguucccgucuga

SEQ ID NO: 382203 - RNA, 64 nt, Homo Sapiens
aggaacauuuugcuggugaugaggaagcauuuagcugaauaaguuuaaagcccuuuauacagag

SEQ ID NO: 382204 - RNA, 64 nt, Homo Sapiens
auccuaagagcuaguauguuguaaaaccugccaccugaauaaaaugaaaaaaaaaguguuuuuu

SEQ ID NO: 382205 - RNA, 64 nt, Homo Sapiens
gaccuacuagauugaauuuauuuagugaaugcuccugaauaaaugugcauuccucuuuuagagu

SEQ ID NO: 382206 - RNA, 64 nt, Homo Sapiens
agcagugcauguuucuaauugacuuacugggaaacugaauaaaauaugccucuuauuaucauau

SEQ ID NO: 382207 - RNA, 64 nt, Homo Sapiens
gaaaagaugccauuuguuuccuucugaucucucacugaauaauguuuacuguacagucuuccca

SEQ ID NO: 382208 - RNA, 64 nt, Homo Sapiens
aguaaaucugauggcucacugauuuuugaaaagccugaauaaaauuggaaagacuggaaaguua

SEQ ID NO: 382209 - RNA, 64 nt, Homo Sapiens
gaaggggguaugcacccccuccuuauggaagcuacugaauaaaaauaacuuccguaaguuacau

SEQ ID NO: 382210 - RNA, 64 nt, Homo Sapiens
acugaaucccuuuacuguuauuccaaaccuuauacugaauaacuuaauggcuggaguuuuugaa

SEQ ID NO: 382211 - RNA, 64 nt, Homo Sapiens
acaggagauggggcccugcugccagucaucuccacugaauaaagaauaaugcuccucuuucagg

SEQ ID NO: 382212 - RNA, 64 nt, Homo Sapiens
agaguagaaaacugauuucuuuguuaauuguacacugaauaaugccuuuuaaaaaucaaaauaa

SEQ ID NO: 382213 - RNA, 64 nt, Homo Sapiens
gguuuuuccuuuuguuuuuuuaaaggauguguuucugaauaaguugguuuuagagggaaagguu

SEQ ID NO: 382214 - RNA, 64 nt, Homo Sapiens
ggcuugguagccucugagugaaucugaugcucugcugaauaauuucauuaccucugcacaugcc

SEQ ID NO: 382215 - RNA, 64 nt, Homo Sapiens
guugcagaauuugcucuuuuugggauggguugcccugaauaacauuacggaccagguaaauaau

SEQ ID NO: 382216 - RNA, 64 nt, Homo Sapiens
auaugaauucccuguuaguugauuuaaauccuuucugaauaaagaucagauaaacaguaacuga

SEQ ID NO: 382217 - RNA, 64 nt, Homo Sapiens
uacuuuugauaauaacucacucugugcgauauuccugaauaaguccaucucaaaaguuugggau

SEQ ID NO: 382218 - RNA, 64 nt, Homo Sapiens
aguggaaugugaccagucaauugagugaucuaugcugaauaaacccagcacaucacuguagaau

SEQ ID NO: 382219 - RNA, 64 nt, Homo Sapiens
ugacacguggugauugugaagcgguuucccuuuacugaauaagauguuuucagguaucuuugua

SEQ ID NO: 382220 - RNA, 64 nt, Homo Sapiens
aauaaauaaaauggauagaacauuccauuaauaacugaauaaaacaaucaaaggaucuuuuguc

SEQ ID NO: 382221 - RNA, 64 nt, Homo Sapiens
acuacauuagggaagcuacuaagaaaagacuuaccugaauaauugaugcaugcuuugagaccag

SEQ ID NO: 382222 - RNA, 64 nt, Homo Sapiens
guuuagaaacuguugcuaagaaaagugguccauccugaauaaacauguaauacuccagcaggga

SEQ ID NO: 382223 - RNA, 63 nt, Homo Sapiens
cagcgcuggcaauuuuugacagucucuacggagacugaauaagaaaaaagaaaagaaaagaaa

SEQ ID NO: 382224 - RNA, 64 nt, Homo Sapiens
uaagauaaaaugauuaauaaaacaauugguaauucugaauaaggaucugaauaaauccagauca

SEQ ID NO: 382225 - RNA, 64 nt, Homo Sapiens
auuaauaaaacaauugguaauucugaauaaggaucugaauaaauccagaucacagacuguuccu

SEQ ID NO: 382226 - RNA, 64 nt, Homo Sapiens
cauucaguuucucacauuuuacucaguauucuuccugaauaauaaacuuuaguuaaaugaaggc

SEQ ID NO: 382227 - RNA, 64 nt, Homo Sapiens
acuuugaaacuguaguaucauuauauucagaguucugaauaauucuuuaagguuuagggcuauu

SEQ ID NO: 382228 - RNA, 64 nt, Homo Sapiens
caacauccaacccaggucauaauaaacuacucuccugaauaaaaucuuccuauggucuugucug

SEQ ID NO: 382229 - RNA, 64 nt, Homo Sapiens
uacucuccugaauaaaacaauccuauggucuugucugaauaaacucuuuuuuucuuuucuuucu

SEQ ID NO: 382230 - RNA, 64 nt, Homo Sapiens
guuuuuaacuggagaguuuguauuuuuuaaugcacugaauaauuugcacccagcugaaaguugg

SEQ ID NO: 382231 - RNA, 64 nt, Homo Sapiens
auuuuuaaaguuuucuaauauacauuucugaggccugaauaaguuagaaguauaauaaaauccc

SEQ ID NO: 382232 - RNA, 64 nt, Homo Sapiens
ggcaagggaaucuguuuacucccucuucccucuacugaauaauuuucccucuacugaauaauuu

SEQ ID NO: 382233 - RNA, 64 nt, Homo Sapiens
ucccucuucccucuacugaauaauuuucccucuacugaauaauuuucccucuaagaauugcugu

SEQ ID NO: 382234 - RNA, 64 nt, Homo Sapiens
uuccauuguaugaauauaccauuccuuucuauggcugaauaaaaguagcaugugucagaauuuc

SEQ ID NO: 382235 - RNA, 64 nt, Homo Sapiens
aauugauuuacagccuuguucuugggagggaaugcugaauaauuaagauugcagagugucccau

SEQ ID NO: 382236 - RNA, 64 nt, Homo Sapiens
aaauacaucuguuccagaaaaacauuuggcauuccugaauaauuuccaaauguuuuuaauccaa

SEQ ID NO: 382237 - RNA, 64 nt, Homo Sapiens
agguuuaaagcuuauuucccuuucuuauacacaccugaauaaaauugaugugcauguuuuaggg

SEQ ID NO: 382238 - RNA, 64 nt, Homo Sapiens; identical to SEQ ID NO: 58801

SEQ ID NO: 382239 - RNA, 64 nt, Homo Sapiens; identical to SEQ ID NO: 58802

SEQ ID NO: 382240 - RNA, 64 nt, Homo Sapiens; identical to SEQ ID NO: 58803

SEQ ID NO: 382241 - RNA, 64 nt, Homo Sapiens; identical to SEQ ID NO: 58804

SEQ ID NO: 382242 - RNA, 64 nt, Homo Sapiens; identical to SEQ ID NO: 58805

SEQ ID NO: 382243 - RNA, 57 nt, Homo Sapiens; identical to SEQ ID NO: 58806

SEQ ID NO: 382244 - RNA, 64 nt, Homo Sapiens; identical to SEQ ID NO: 58807

SEQ ID NO: 382245 - RNA, 57 nt, Homo Sapiens; identical to SEQ ID NO: 58808

SEQ ID NO: 382246 - RNA, 64 nt, Homo Sapiens; identical to SEQ ID NO: 58809

SEQ ID NO: 382247 - RNA, 64 nt, Homo Sapiens; identical to SEQ ID NO: 58810

SEQ ID NO: 382248 - RNA, 64 nt, Homo Sapiens; identical to SEQ ID NO: 58811

SEQ ID NO: 382249 - RNA, 64 nt, Homo Sapiens
aggccggccaucacuucugaggagcagaguugagggagccgagcugagccacgcugggaggcca

SEQ ID NO: 382250 - RNA, 64 nt, Homo Sapiens
uuucucugccaucagcccuacguccagagggagaggagccgacacccccagagccagugcccca

SEQ ID NO: 382251 - RNA, 64 nt, Homo Sapiens
cuccucugagcagccuuagauaguguccauggcuggagccgacccuuugaguccccuugagugu

SEQ ID NO: 382252 - RNA, 64 nt, Homo Sapiens; identical to SEQ ID NO: 106495

SEQ ID NO: 382253 - RNA, 64 nt, Homo Sapiens; identical to SEQ ID NO: 106496

SEQ ID NO: 382254 - RNA, 64 nt, Homo Sapiens; identical to SEQ ID NO: 106497

SEQ ID NO: 382255 - RNA, 64 nt, Homo Sapiens; identical to SEQ ID NO: 106498

SEQ ID NO: 382256 - RNA, 64 nt, Homo Sapiens; identical to SEQ ID NO: 106499

SEQ ID NO: 382257 - RNA, 64 nt, Homo Sapiens; identical to SEQ ID NO: 106500

SEQ ID NO: 382258 - RNA, 64 nt, Homo Sapiens; identical to SEQ ID NO: 106501

SEQ ID NO: 382259 - RNA, 64 nt, Homo Sapiens; identical to SEQ ID NO: 106502

SEQ ID NO: 382260 - RNA, 64 nt, Homo Sapiens; identical to SEQ ID NO: 106503

SEQ ID NO: 382261 - RNA, 64 nt, Homo Sapiens; identical to SEQ ID NO: 106504

SEQ ID NO: 382262 - RNA, 64 nt, Homo Sapiens; identical to SEQ ID NO: 106505

SEQ ID NO: 382263 - RNA, 64 nt, Homo Sapiens; identical to SEQ ID NO: 106506

SEQ ID NO: 382264 - RNA, 64 nt, Homo Sapiens
uuucaaagugccuuuguauccaaaaauguauuugccagcauagaaauguaccaucaagagucau

SEQ ID NO: 382265 - RNA, 64 nt, Homo Sapiens
caguaauguauacaaauugucuuuuuguguacuuccagcauagguuuggauauaugaacauuuu

SEQ ID NO: 382266 - RNA, 64 nt, Homo Sapiens
gacuuggcuucauuuuggucuugagauaaaauggccagcauaaaugcuguuuauauucacguuu

SEQ ID NO: 382267 - RNA, 64 nt, Homo Sapiens
auaaauguguuucuuucuuaauaguauccuaguuccagcauauauucaacaugaauuuuaucau

SEQ ID NO: 382268 - RNA, 64 nt, Homo Sapiens
gcacuauaaacuauuucauugcuuccaaaagaaaccagcauaugaaagauaauaugaagaacca

SEQ ID NO: 382269 - RNA, 64 nt, Homo Sapiens
gggugaguuuuagggauguguuuauuuuuacacuccagcauaucuaaaacaaaugauaaaaaug

SEQ ID NO: 382270 - RNA, 64 nt, Homo Sapiens
uagaaacacauuaacugguuuacucauugagaauccagcauauuuaagaggugacccuguguuu

SEQ ID NO: 382271 - RNA, 64 nt, Homo Sapiens
acccggggugccaggaacacacacauccuccaucccagcauagagaauggggacucccugagua

SEQ ID NO: 382272 - RNA, 64 nt, Homo Sapiens
uuucuuuuguaaucagugcauuugaaaauucaagccagcauauuccuaguagauggaagcaaaa

SEQ ID NO: 382273 - RNA, 64 nt, Homo Sapiens
gacaagggcccguaguuguuuggauaagagaacuccagcauagagccuuauagcaacugacuuc

SEQ ID NO: 382274 - RNA, 64 nt, Homo Sapiens; identical to SEQ ID NO: 199527

SEQ ID NO: 382275 - RNA, 64 nt, Homo Sapiens; identical to SEQ ID NO: 199528

SEQ ID NO: 382276 - RNA, 64 nt, Homo Sapiens; identical to SEQ ID NO: 199529

SEQ ID NO: 382277 - RNA, 64 nt, Homo Sapiens; identical to SEQ ID NO: 199530

SEQ ID NO: 382278 - RNA, 64 nt, Homo Sapiens; identical to SEQ ID NO: 199531

SEQ ID NO: 382279 - RNA, 64 nt, Homo Sapiens; identical to SEQ ID NO: 199532

SEQ ID NO: 382280 - RNA, 64 nt, Homo Sapiens; identical to SEQ ID NO: 199533

SEQ ID NO: 382281 - RNA, 64 nt, Homo Sapiens; identical to SEQ ID NO: 199534

SEQ ID NO: 382282 - RNA, 64 nt, Homo Sapiens; identical to SEQ ID NO: 199535

SEQ ID NO: 382283 - RNA, 64 nt, Homo Sapiens; identical to SEQ ID NO: 199536

SEQ ID NO: 382284 - RNA, 64 nt, Homo Sapiens; identical to SEQ ID NO: 199537

SEQ ID NO: 382285 - RNA, 64 nt, Homo Sapiens; identical to SEQ ID NO: 199538

SEQ ID NO: 382286 - RNA, 64 nt, Homo Sapiens; identical to SEQ ID NO: 199539

SEQ ID NO: 382287 - RNA, 64 nt, Homo Sapiens; identical to SEQ ID NO: 199540

SEQ ID NO: 382288 - RNA, 64 nt, Homo Sapiens; identical to SEQ ID NO: 199541

SEQ ID NO: 382289 - RNA, 64 nt, Homo Sapiens; identical to SEQ ID NO: 199542

SEQ ID NO: 382290 - RNA, 64 nt, Homo Sapiens; identical to SEQ ID NO: 199543

SEQ ID NO: 382291 - RNA, 64 nt, Homo Sapiens; identical to SEQ ID NO: 199544

SEQ ID NO: 382292 - RNA, 64 nt, Homo Sapiens; identical to SEQ ID NO: 199545

SEQ ID NO: 382293 - RNA, 64 nt, Homo Sapiens; identical to SEQ ID NO: 199546

SEQ ID NO: 382294 - RNA, 64 nt, Homo Sapiens; identical to SEQ ID NO: 199547

SEQ ID NO: 382295 - RNA, 64 nt, Homo Sapiens; identical to SEQ ID NO: 199548

SEQ ID NO: 382296 - RNA, 64 nt, Homo Sapiens; identical to SEQ ID NO: 199549

SEQ ID NO: 382297 - RNA, 64 nt, Homo Sapiens; identical to SEQ ID NO: 199550

SEQ ID NO: 382298 - RNA, 64 nt, Homo Sapiens; identical to SEQ ID NO: 199551

SEQ ID NO: 382299 - RNA, 64 nt, Homo Sapiens; identical to SEQ ID NO: 199552

SEQ ID NO: 382300 - RNA, 64 nt, Homo Sapiens; identical to SEQ ID NO: 199553

SEQ ID NO: 382301 - RNA, 64 nt, Homo Sapiens; identical to SEQ ID NO: 199554

SEQ ID NO: 382302 - RNA, 64 nt, Homo Sapiens; identical to SEQ ID NO: 199555

SEQ ID NO: 382303 - RNA, 64 nt, Homo Sapiens; identical to SEQ ID NO: 199556

SEQ ID NO: 382304 - RNA, 64 nt, Homo Sapiens; identical to SEQ ID NO: 199557

SEQ ID NO: 382305 - RNA, 64 nt, Homo Sapiens; identical to SEQ ID NO: 199558

SEQ ID NO: 382306 - RNA, 64 nt, Homo Sapiens; identical to SEQ ID NO: 199559

SEQ ID NO: 382307 - RNA, 64 nt, Homo Sapiens; identical to SEQ ID NO: 199560

SEQ ID NO: 382308 - RNA, 64 nt, Homo Sapiens; identical to SEQ ID NO: 199561

SEQ ID NO: 382309 - RNA, 64 nt, Homo Sapiens; identical to SEQ ID NO: 199562

SEQ ID NO: 382310 - RNA, 64 nt, Homo Sapiens; identical to SEQ ID NO: 199563

SEQ ID NO: 382311 - RNA, 64 nt, Homo Sapiens; identical to SEQ ID NO: 199564

SEQ ID NO: 382312 - RNA, 64 nt, Homo Sapiens; identical to SEQ ID NO: 199565

SEQ ID NO: 382313 - RNA, 64 nt, Homo Sapiens; identical to SEQ ID NO: 199566

SEQ ID NO: 382314 - RNA, 64 nt, Homo Sapiens; identical to SEQ ID NO: 199567

SEQ ID NO: 382315 - RNA, 64 nt, Homo Sapiens; identical to SEQ ID NO: 199568

SEQ ID NO: 382316 - RNA, 64 nt, Homo Sapiens; identical to SEQ ID NO: 199569

SEQ ID NO: 382317 - RNA, 64 nt, Homo Sapiens; identical to SEQ ID NO: 199570

SEQ ID NO: 382318 - RNA, 64 nt, Homo Sapiens; identical to SEQ ID NO: 199571

SEQ ID NO: 382319 - RNA, 64 nt, Homo Sapiens; identical to SEQ ID NO: 199572

SEQ ID NO: 382320 - RNA, 64 nt, Homo Sapiens; identical to SEQ ID NO: 199573

SEQ ID NO: 382321 - RNA, 64 nt, Homo Sapiens; identical to SEQ ID NO: 199574

SEQ ID NO: 382322 - RNA, 64 nt, Homo Sapiens; identical to SEQ ID NO: 199575

SEQ ID NO: 382323 - RNA, 64 nt, Homo Sapiens; identical to SEQ ID NO: 199576

SEQ ID NO: 382324 - RNA, 64 nt, Homo Sapiens; identical to SEQ ID NO: 199577

SEQ ID NO: 382325 - RNA, 64 nt, Homo Sapiens; identical to SEQ ID NO: 199578

SEQ ID NO: 382326 - RNA, 64 nt, Homo Sapiens; identical to SEQ ID NO: 199579

SEQ ID NO: 382327 - RNA, 64 nt, Homo Sapiens; identical to SEQ ID NO: 199580

SEQ ID NO: 382328 - RNA, 64 nt, Homo Sapiens; identical to SEQ ID NO: 199581

SEQ ID NO: 382329 - RNA, 64 nt, Homo Sapiens; identical to SEQ ID NO: 199582

SEQ ID NO: 382330 - RNA, 64 nt, Homo Sapiens; identical to SEQ ID NO: 199583

SEQ ID NO: 382331 - RNA, 64 nt, Homo Sapiens; identical to SEQ ID NO: 199584

SEQ ID NO: 382332 - RNA, 64 nt, Homo Sapiens; identical to SEQ ID NO: 199585

SEQ ID NO: 382333 - RNA, 64 nt, Homo Sapiens; identical to SEQ ID NO: 199586

SEQ ID NO: 382334 - RNA, 64 nt, Homo Sapiens; identical to SEQ ID NO: 199587

SEQ ID NO: 382335 - RNA, 64 nt, Homo Sapiens; identical to SEQ ID NO: 199588

SEQ ID NO: 382336 - RNA, 64 nt, Homo Sapiens; identical to SEQ ID NO: 199589

SEQ ID NO: 382337 - RNA, 64 nt, Homo Sapiens; identical to SEQ ID NO: 199590

SEQ ID NO: 382338 - RNA, 64 nt, Homo Sapiens; identical to SEQ ID NO: 199591

SEQ ID NO: 382339 - RNA, 64 nt, Homo Sapiens; identical to SEQ ID NO: 199592

SEQ ID NO: 382340 - RNA, 64 nt, Homo Sapiens; identical to SEQ ID NO: 199593

SEQ ID NO: 382341 - RNA, 64 nt, Homo Sapiens; identical to SEQ ID NO: 199594

SEQ ID NO: 382342 - RNA, 64 nt, Homo Sapiens; identical to SEQ ID NO: 199595

SEQ ID NO: 382343 - RNA, 64 nt, Homo Sapiens; identical to SEQ ID NO: 199596

SEQ ID NO: 382344 - RNA, 64 nt, Homo Sapiens; identical to SEQ ID NO: 199597

SEQ ID NO: 382345 - RNA, 64 nt, Homo Sapiens; identical to SEQ ID NO: 199598

SEQ ID NO: 382346 - RNA, 64 nt, Homo Sapiens; identical to SEQ ID NO: 199599

SEQ ID NO: 382347 - RNA, 64 nt, Homo Sapiens; identical to SEQ ID NO: 199600

SEQ ID NO: 382348 - RNA, 64 nt, Homo Sapiens; identical to SEQ ID NO: 199601

SEQ ID NO: 382349 - RNA, 64 nt, Homo Sapiens; identical to SEQ ID NO: 199602

SEQ ID NO: 382350 - RNA, 64 nt, Homo Sapiens; identical to SEQ ID NO: 199603

SEQ ID NO: 382351 - RNA, 64 nt, Homo Sapiens; identical to SEQ ID NO: 199604

SEQ ID NO: 382352 - RNA, 64 nt, Homo Sapiens; identical to SEQ ID NO: 199877

SEQ ID NO: 382353 - RNA, 64 nt, Homo Sapiens; identical to SEQ ID NO: 199878

SEQ ID NO: 382354 - RNA, 64 nt, Homo Sapiens; identical to SEQ ID NO: 199879

SEQ ID NO: 382355 - RNA, 64 nt, Homo Sapiens; identical to SEQ ID NO: 199880

SEQ ID NO: 382356 - RNA, 64 nt, Homo Sapiens; identical to SEQ ID NO: 199881

SEQ ID NO: 382357 - RNA, 64 nt, Homo Sapiens; identical to SEQ ID NO: 199882

SEQ ID NO: 382358 - RNA, 64 nt, Homo Sapiens; identical to SEQ ID NO: 199883

SEQ ID NO: 382359 - RNA, 64 nt, Homo Sapiens; identical to SEQ ID NO: 199884

SEQ ID NO: 382360 - RNA, 64 nt, Homo Sapiens; identical to SEQ ID NO: 199885

SEQ ID NO: 382361 - RNA, 64 nt, Homo Sapiens; identical to SEQ ID NO: 199886

SEQ ID NO: 382362 - RNA, 64 nt, Homo Sapiens; identical to SEQ ID NO: 199887

SEQ ID NO: 382363 - RNA, 64 nt, Homo Sapiens; identical to SEQ ID NO: 199888

SEQ ID NO: 382364 - RNA, 64 nt, Homo Sapiens; identical to SEQ ID NO: 199889

SEQ ID NO: 382365 - RNA, 64 nt, Homo Sapiens; identical to SEQ ID NO: 199890

SEQ ID NO: 382366 - RNA, 64 nt, Homo Sapiens; identical to SEQ ID NO: 199891

SEQ ID NO: 382367 - RNA, 64 nt, Homo Sapiens; identical to SEQ ID NO: 199892

SEQ ID NO: 382368 - RNA, 64 nt, Homo Sapiens; identical to SEQ ID NO: 199893

SEQ ID NO: 382369 - RNA, 64 nt, Homo Sapiens; identical to SEQ ID NO: 199894

SEQ ID NO: 382370 - RNA, 64 nt, Homo Sapiens; identical to SEQ ID NO: 199895

SEQ ID NO: 382371 - RNA, 64 nt, Homo Sapiens; identical to SEQ ID NO: 199896

SEQ ID NO: 382372 - RNA, 64 nt, Homo Sapiens; identical to SEQ ID NO: 199897

SEQ ID NO: 382373 - RNA, 64 nt, Homo Sapiens; identical to SEQ ID NO: 68813

SEQ ID NO: 382374 - RNA, 64 nt, Homo Sapiens; identical to SEQ ID NO: 68814

SEQ ID NO: 382375 - RNA, 64 nt, Homo Sapiens; identical to SEQ ID NO: 334267

SEQ ID NO: 382376 - RNA, 64 nt, Homo Sapiens; identical to SEQ ID NO: 334268

SEQ ID NO: 382377 - RNA, 64 nt, Homo Sapiens; identical to SEQ ID NO: 334269

SEQ ID NO: 382378 - RNA, 64 nt, Homo Sapiens; identical to SEQ ID NO: 334270

SEQ ID NO: 382379 - RNA, 64 nt, Homo Sapiens; identical to SEQ ID NO: 334271

SEQ ID NO: 382380 - RNA, 64 nt, Homo Sapiens; identical to SEQ ID NO: 334272

SEQ ID NO: 382381 - RNA, 64 nt, Homo Sapiens; identical to SEQ ID NO: 334273

SEQ ID NO: 382382 - RNA, 64 nt, Homo Sapiens; identical to SEQ ID NO: 334274

SEQ ID NO: 382383 - RNA, 64 nt, Homo Sapiens; identical to SEQ ID NO: 334275

SEQ ID NO: 382384 - RNA, 64 nt, Homo Sapiens; identical to SEQ ID NO: 334276

SEQ ID NO: 382385 - RNA, 64 nt, Homo Sapiens; identical to SEQ ID NO: 293850

SEQ ID NO: 382386 - RNA, 64 nt, Homo Sapiens; identical to SEQ ID NO: 293851

SEQ ID NO: 382387 - RNA, 64 nt, Homo Sapiens; identical to SEQ ID NO: 293852

SEQ ID NO: 382388 - RNA, 64 nt, Homo Sapiens; identical to SEQ ID NO: 293853

SEQ ID NO: 382389 - RNA, 64 nt, Homo Sapiens; identical to SEQ ID NO: 293854

SEQ ID NO: 382390 - RNA, 64 nt, Homo Sapiens; identical to SEQ ID NO: 293855

SEQ ID NO: 382391 - RNA, 64 nt, Homo Sapiens; identical to SEQ ID NO: 293856

SEQ ID NO: 382392 - RNA, 64 nt, Homo Sapiens; identical to SEQ ID NO: 293857

SEQ ID NO: 382393 - RNA, 64 nt, Homo Sapiens; identical to SEQ ID NO: 293858

SEQ ID NO: 382394 - RNA, 64 nt, Homo Sapiens; identical to SEQ ID NO: 293859

SEQ ID NO: 382395 - RNA, 64 nt, Homo Sapiens; identical to SEQ ID NO: 293860

SEQ ID NO: 382396 - RNA, 64 nt, Homo Sapiens; identical to SEQ ID NO: 293861

SEQ ID NO: 382397 - RNA, 64 nt, Homo Sapiens; identical to SEQ ID NO: 293862

SEQ ID NO: 382398 - RNA, 64 nt, Homo Sapiens; identical to SEQ ID NO: 293863

SEQ ID NO: 382399 - RNA, 64 nt, Homo Sapiens; identical to SEQ ID NO: 293864

SEQ ID NO: 382400 - RNA, 64 nt, Homo Sapiens; identical to SEQ ID NO: 293865

SEQ ID NO: 382401 - RNA, 64 nt, Homo Sapiens; identical to SEQ ID NO: 293866

SEQ ID NO: 382402 - RNA, 64 nt, Homo Sapiens; identical to SEQ ID NO: 293867

SEQ ID NO: 382403 - RNA, 64 nt, Homo Sapiens; identical to SEQ ID NO: 293868

SEQ ID NO: 382404 - RNA, 64 nt, Homo Sapiens; identical to SEQ ID NO: 293869

SEQ ID NO: 382405 - RNA, 64 nt, Homo Sapiens; identical to SEQ ID NO: 293870

SEQ ID NO: 382406 - RNA, 64 nt, Homo Sapiens; identical to SEQ ID NO: 293871

SEQ ID NO: 382407 - RNA, 64 nt, Homo Sapiens; identical to SEQ ID NO: 293872

SEQ ID NO: 382408 - RNA, 64 nt, Homo Sapiens; identical to SEQ ID NO: 293873

SEQ ID NO: 382409 - RNA, 64 nt, Homo Sapiens; identical to SEQ ID NO: 293874

SEQ ID NO: 382410 - RNA, 64 nt, Homo Sapiens; identical to SEQ ID NO: 293875

SEQ ID NO: 382411 - RNA, 64 nt, Homo Sapiens; identical to SEQ ID NO: 293876

SEQ ID NO: 382412 - RNA, 64 nt, Homo Sapiens; identical to SEQ ID NO: 293877

SEQ ID NO: 382413 - RNA, 64 nt, Homo Sapiens; identical to SEQ ID NO: 293878

SEQ ID NO: 382414 - RNA, 64 nt, Homo Sapiens; identical to SEQ ID NO: 293879

SEQ ID NO: 382415 - RNA, 64 nt, Homo Sapiens; identical to SEQ ID NO: 293880

SEQ ID NO: 382416 - RNA, 64 nt, Homo Sapiens; identical to SEQ ID NO: 293881

SEQ ID NO: 382417 - RNA, 64 nt, Homo Sapiens; identical to SEQ ID NO: 293882

SEQ ID NO: 382418 - RNA, 64 nt, Homo Sapiens; identical to SEQ ID NO: 293883

SEQ ID NO: 382419 - RNA, 64 nt, Homo Sapiens; identical to SEQ ID NO: 293884

SEQ ID NO: 382420 - RNA, 64 nt, Homo Sapiens; identical to SEQ ID NO: 293885

SEQ ID NO: 382421 - RNA, 64 nt, Homo Sapiens; identical to SEQ ID NO: 293886

SEQ ID NO: 382422 - RNA, 64 nt, Homo Sapiens; identical to SEQ ID NO: 293887

SEQ ID NO: 382423 - RNA, 64 nt, Homo Sapiens; identical to SEQ ID NO: 293888

SEQ ID NO: 382424 - RNA, 64 nt, Homo Sapiens; identical to SEQ ID NO: 293889

SEQ ID NO: 382425 - RNA, 64 nt, Homo Sapiens; identical to SEQ ID NO: 293890

SEQ ID NO: 382426 - RNA, 64 nt, Homo Sapiens; identical to SEQ ID NO: 293891

SEQ ID NO: 382427 - RNA, 64 nt, Homo Sapiens; identical to SEQ ID NO: 293892

SEQ ID NO: 382428 - RNA, 64 nt, Homo Sapiens; identical to SEQ ID NO: 293893

SEQ ID NO: 382429 - RNA, 64 nt, Homo Sapiens; identical to SEQ ID NO: 293894

SEQ ID NO: 382430 - RNA, 64 nt, Homo Sapiens; identical to SEQ ID NO: 293895

SEQ ID NO: 382431 - RNA, 64 nt, Homo Sapiens; identical to SEQ ID NO: 293896

SEQ ID NO: 382432 - RNA, 64 nt, Homo Sapiens; identical to SEQ ID NO: 293897

SEQ ID NO: 382433 - RNA, 64 nt, Homo Sapiens; identical to SEQ ID NO: 293898

SEQ ID NO: 382434 - RNA, 64 nt, Homo Sapiens; identical to SEQ ID NO: 293899

SEQ ID NO: 382435 - RNA, 64 nt, Homo Sapiens; identical to SEQ ID NO: 293900

SEQ ID NO: 382436 - RNA, 64 nt, Homo Sapiens; identical to SEQ ID NO: 293901

SEQ ID NO: 382437 - RNA, 64 nt, Homo Sapiens; identical to SEQ ID NO: 293902

SEQ ID NO: 382438 - RNA, 64 nt, Homo Sapiens; identical to SEQ ID NO: 293903

SEQ ID NO: 382439 - RNA, 64 nt, Homo Sapiens; identical to SEQ ID NO: 293904

SEQ ID NO: 382440 - RNA, 64 nt, Homo Sapiens; identical to SEQ ID NO: 293905

SEQ ID NO: 382441 - RNA, 64 nt, Homo Sapiens; identical to SEQ ID NO: 293906

SEQ ID NO: 382442 - RNA, 64 nt, Homo Sapiens; identical to SEQ ID NO: 293907

SEQ ID NO: 382443 - RNA, 64 nt, Homo Sapiens; identical to SEQ ID NO: 293908

SEQ ID NO: 382444 - RNA, 64 nt, Homo Sapiens; identical to SEQ ID NO: 293909

SEQ ID NO: 382445 - RNA, 64 nt, Homo Sapiens; identical to SEQ ID NO: 293910

SEQ ID NO: 382446 - RNA, 64 nt, Homo Sapiens; identical to SEQ ID NO: 293911

SEQ ID NO: 382447 - RNA, 64 nt, Homo Sapiens; identical to SEQ ID NO: 293912

SEQ ID NO: 382448 - RNA, 64 nt, Homo Sapiens
caggaaaaaugaggaauccaugagucaucuugugaguggauaauaucauggucaaguucccaac

SEQ ID NO: 382449 - RNA, 59 nt, Homo Sapiens
acccacacugccagaagagaaucccagacaguggauaugacaugaagaggcauuuuuaa

SEQ ID NO: 382450 - RNA, 64 nt, Homo Sapiens
ccaggaauguuuugcagcuuuaaaauauuuaaaaaguggauauugaaacccauuuccugugugu

SEQ ID NO: 382451 - RNA, 64 nt, Homo Sapiens
ucagaagucacuguacuccaccauuccugggaagaguggauaacgaauucaugcagaugccugg

SEQ ID NO: 382452 - RNA, 64 nt, Homo Sapiens
gaauaaaguucagugugcugaucauucacaauacaguggauagcuugauaucuucuguuuuccc

SEQ ID NO: 382453 - RNA, 64 nt, Homo Sapiens
ccucugacuugccaaagaaaaagaagggaaccacaguggauaugcuagcauuuuagcugugcaa

SEQ ID NO: 382454 - RNA, 64 nt, Homo Sapiens; identical to SEQ ID NO: 112962

SEQ ID NO: 382455 - RNA, 64 nt, Homo Sapiens; identical to SEQ ID NO: 112963

SEQ ID NO: 382456 - RNA, 64 nt, Homo Sapiens; identical to SEQ ID NO: 292981

SEQ ID NO: 382457 - RNA, 64 nt, Homo Sapiens; identical to SEQ ID NO: 292982

SEQ ID NO: 382458 - RNA, 64 nt, Homo Sapiens; identical to SEQ ID NO: 292983

SEQ ID NO: 382459 - RNA, 64 nt, Homo Sapiens; identical to SEQ ID NO: 292984

SEQ ID NO: 382460 - RNA, 64 nt, Homo Sapiens; identical to SEQ ID NO: 292985

SEQ ID NO: 382461 - RNA, 64 nt, Homo Sapiens; identical to SEQ ID NO: 292986

SEQ ID NO: 382462 - RNA, 64 nt, Homo Sapiens; identical to SEQ ID NO: 292987

SEQ ID NO: 382463 - RNA, 64 nt, Homo Sapiens; identical to SEQ ID NO: 292988

SEQ ID NO: 382464 - RNA, 64 nt, Homo Sapiens; identical to SEQ ID NO: 292989

SEQ ID NO: 382465 - RNA, 64 nt, Homo Sapiens; identical to SEQ ID NO: 292990

SEQ ID NO: 382466 - RNA, 64 nt, Homo Sapiens; identical to SEQ ID NO: 292991

SEQ ID NO: 382467 - RNA, 64 nt, Homo Sapiens; identical to SEQ ID NO: 292992

SEQ ID NO: 382468 - RNA, 64 nt, Homo Sapiens; identical to SEQ ID NO: 292993

SEQ ID NO: 382469 - RNA, 64 nt, Homo Sapiens; identical to SEQ ID NO: 292994

SEQ ID NO: 382470 - RNA, 64 nt, Homo Sapiens; identical to SEQ ID NO: 129356

SEQ ID NO: 382471 - RNA, 64 nt, Homo Sapiens; identical to SEQ ID NO: 129357

SEQ ID NO: 382472 - RNA, 64 nt, Homo Sapiens; identical to SEQ ID NO: 129358

SEQ ID NO: 382473 - RNA, 64 nt, Homo Sapiens; identical to SEQ ID NO: 129359

SEQ ID NO: 382474 - RNA, 64 nt, Homo Sapiens; identical to SEQ ID NO: 129360

SEQ ID NO: 382475 - RNA, 64 nt, Homo Sapiens; identical to SEQ ID NO: 129361

SEQ ID NO: 382476 - RNA, 64 nt, Homo Sapiens; identical to SEQ ID NO: 129362

SEQ ID NO: 382477 - RNA, 64 nt, Homo Sapiens; identical to SEQ ID NO: 129363

SEQ ID NO: 382478 - RNA, 64 nt, Homo Sapiens; identical to SEQ ID NO: 129364

SEQ ID NO: 382479 - RNA, 64 nt, Homo Sapiens; identical to SEQ ID NO: 129365

SEQ ID NO: 382480 - RNA, 64 nt, Homo Sapiens; identical to SEQ ID NO: 129366

SEQ ID NO: 382481 - RNA, 64 nt, Homo Sapiens; identical to SEQ ID NO: 129367

SEQ ID NO: 382482 - RNA, 64 nt, Homo Sapiens; identical to SEQ ID NO: 129368

SEQ ID NO: 382483 - RNA, 64 nt, Homo Sapiens; identical to SEQ ID NO: 129369

SEQ ID NO: 382484 - RNA, 64 nt, Homo Sapiens; identical to SEQ ID NO: 129370

SEQ ID NO: 382485 - RNA, 64 nt, Homo Sapiens; identical to SEQ ID NO: 129371

SEQ ID NO: 382486 - RNA, 64 nt, Homo Sapiens; identical to SEQ ID NO: 129372

SEQ ID NO: 382487 - RNA, 55 nt, Homo Sapiens; identical to SEQ ID NO: 129373

SEQ ID NO: 382488 - RNA, 64 nt, Homo Sapiens; identical to SEQ ID NO: 129374

SEQ ID NO: 382489 - RNA, 64 nt, Homo Sapiens; identical to SEQ ID NO: 129375

SEQ ID NO: 382490 - RNA, 64 nt, Homo Sapiens; identical to SEQ ID NO: 129376

SEQ ID NO: 382491 - RNA, 64 nt, Homo Sapiens; identical to SEQ ID NO: 129377

SEQ ID NO: 382492 - RNA, 64 nt, Homo Sapiens; identical to SEQ ID NO: 129378

SEQ ID NO: 382493 - RNA, 64 nt, Homo Sapiens; identical to SEQ ID NO: 129379

SEQ ID NO: 382494 - RNA, 64 nt, Homo Sapiens
ucaguuuauaaauuuggcgcucuuuuaauuacacucuguagaagguuaauagagcuugagcccu

SEQ ID NO: 382495 - RNA, 64 nt, Homo Sapiens
uugagcccugcuuuaauauguagugaaagauaauucuguagaaaaacgucagccaguaggguaa

SEQ ID NO: 382496 - RNA, 64 nt, Homo Sapiens
aagauguguauacagcugcuggcuguauagggugucuguagaucgaggguugucuauugugugu

SEQ ID NO: 382497 - RNA, 64 nt, Homo Sapiens
ggcgaaggggcaguuccuaucggaguugugugucucuguagaaaaccuaaagguuggggugggg

SEQ ID NO: 382498 - RNA, 64 nt, Homo Sapiens
ucacuuuaguaaaauaccaauuuagauguuugcuucuguagauguaaaacuccuauuaaaaaug

SEQ ID NO: 382499 - RNA, 64 nt, Homo Sapiens
uagaauaccuuuuguuguugagcuaauauucaguucuguagaguugcuuaacagcugccguuga

SEQ ID NO: 382500 - RNA, 64 nt, Homo Sapiens
aaaaauguccauagaacuuuuuucuuagugcaaaucuguagaguugugaugauaguguccugug

SEQ ID NO: 382501 - RNA, 64 nt, Homo Sapiens
aguagaauuaaaccugcgaaucaaacaaagaugcucuguagacacuucucuaaaugcgguagau

SEQ ID NO: 382502 - RNA, 64 nt, Homo Sapiens
cccuugcugccgugugcuccugccuuccugauccucuguagaaaggauuuuuaucuucuguaga

SEQ ID NO: 382503 - RNA, 64 nt, Homo Sapiens
ccuuccugauccucuguagaaaggauuuuuaucuucuguagagcuagccgcccugacugccuuc

SEQ ID NO: 382504 - RNA, 64 nt, Homo Sapiens; identical to SEQ ID NO: 235049

SEQ ID NO: 382505 - RNA, 64 nt, Homo Sapiens; identical to SEQ ID NO: 235050

SEQ ID NO: 382506 - RNA, 64 nt, Homo Sapiens; identical to SEQ ID NO: 235051

SEQ ID NO: 382507 - RNA, 64 nt, Homo Sapiens; identical to SEQ ID NO: 235052

SEQ ID NO: 382508 - RNA, 64 nt, Homo Sapiens; identical to SEQ ID NO: 235053

SEQ ID NO: 382509 - RNA, 64 nt, Homo Sapiens; identical to SEQ ID NO: 235054

SEQ ID NO: 382510 - RNA, 64 nt, Homo Sapiens; identical to SEQ ID NO: 235055

SEQ ID NO: 382511 - RNA, 64 nt, Homo Sapiens; identical to SEQ ID NO: 235056

SEQ ID NO: 382512 - RNA, 64 nt, Homo Sapiens; identical to SEQ ID NO: 235057

SEQ ID NO: 382513 - RNA, 64 nt, Homo Sapiens; identical to SEQ ID NO: 235058

SEQ ID NO: 382514 - RNA, 64 nt, Homo Sapiens; identical to SEQ ID NO: 235059

SEQ ID NO: 382515 - RNA, 64 nt, Homo Sapiens; identical to SEQ ID NO: 235060

SEQ ID NO: 382516 - RNA, 64 nt, Homo Sapiens; identical to SEQ ID NO: 235061

SEQ ID NO: 382517 - RNA, 64 nt, Homo Sapiens; identical to SEQ ID NO: 235062

SEQ ID NO: 382518 - RNA, 64 nt, Homo Sapiens; identical to SEQ ID NO: 235063

SEQ ID NO: 382519 - RNA, 64 nt, Homo Sapiens; identical to SEQ ID NO: 235064

SEQ ID NO: 382520 - RNA, 64 nt, Homo Sapiens; identical to SEQ ID NO: 235065

SEQ ID NO: 382521 - RNA, 64 nt, Homo Sapiens; identical to SEQ ID NO: 235066

SEQ ID NO: 382522 - RNA, 64 nt, Homo Sapiens; identical to SEQ ID NO: 235067

SEQ ID NO: 382523 - RNA, 64 nt, Homo Sapiens; identical to SEQ ID NO: 235068

SEQ ID NO: 382524 - RNA, 64 nt, Homo Sapiens; identical to SEQ ID NO: 235069

SEQ ID NO: 382525 - RNA, 64 nt, Homo Sapiens; identical to SEQ ID NO: 235070

SEQ ID NO: 382526 - RNA, 64 nt, Homo Sapiens; identical to SEQ ID NO: 235071

SEQ ID NO: 382527 - RNA, 64 nt, Homo Sapiens; identical to SEQ ID NO: 235072

SEQ ID NO: 382528 - RNA, 64 nt, Homo Sapiens; identical to SEQ ID NO: 235073

SEQ ID NO: 382529 - RNA, 64 nt, Homo Sapiens; identical to SEQ ID NO: 235074

SEQ ID NO: 382530 - RNA, 64 nt, Homo Sapiens; identical to SEQ ID NO: 235075

SEQ ID NO: 382531 - RNA, 64 nt, Homo Sapiens; identical to SEQ ID NO: 235076

SEQ ID NO: 382532 - RNA, 64 nt, Homo Sapiens; identical to SEQ ID NO: 235077

SEQ ID NO: 382533 - RNA, 64 nt, Homo Sapiens; identical to SEQ ID NO: 235078

SEQ ID NO: 382534 - RNA, 64 nt, Homo Sapiens; identical to SEQ ID NO: 235079

SEQ ID NO: 382535 - RNA, 64 nt, Homo Sapiens; identical to SEQ ID NO: 235080

SEQ ID NO: 382536 - RNA, 62 nt, Homo Sapiens; identical to SEQ ID NO: 235081

SEQ ID NO: 382537 - RNA, 64 nt, Homo Sapiens; identical to SEQ ID NO: 235082

SEQ ID NO: 382538 - RNA, 64 nt, Homo Sapiens; identical to SEQ ID NO: 235083

SEQ ID NO: 382539 - RNA, 64 nt, Homo Sapiens; identical to SEQ ID NO: 235084

SEQ ID NO: 382540 - RNA, 64 nt, Homo Sapiens; identical to SEQ ID NO: 235085

SEQ ID NO: 382541 - RNA, 64 nt, Homo Sapiens; identical to SEQ ID NO: 235086

SEQ ID NO: 382542 - RNA, 64 nt, Homo Sapiens; identical to SEQ ID NO: 235087

SEQ ID NO: 382543 - RNA, 64 nt, Homo Sapiens; identical to SEQ ID NO: 235088

SEQ ID NO: 382544 - RNA, 64 nt, Homo Sapiens; identical to SEQ ID NO: 235089

SEQ ID NO: 382545 - RNA, 64 nt, Homo Sapiens; identical to SEQ ID NO: 114554

SEQ ID NO: 382546 - RNA, 64 nt, Homo Sapiens; identical to SEQ ID NO: 114555

SEQ ID NO: 382547 - RNA, 64 nt, Homo Sapiens; identical to SEQ ID NO: 114556

SEQ ID NO: 382548 - RNA, 64 nt, Homo Sapiens; identical to SEQ ID NO: 114557

SEQ ID NO: 382549 - RNA, 64 nt, Homo Sapiens; identical to SEQ ID NO: 114558

SEQ ID NO: 382550 - RNA, 64 nt, Homo Sapiens; identical to SEQ ID NO: 114559

SEQ ID NO: 382551 - RNA, 64 nt, Homo Sapiens; identical to SEQ ID NO: 114560

SEQ ID NO: 382552 - RNA, 64 nt, Homo Sapiens; identical to SEQ ID NO: 114561

SEQ ID NO: 382553 - RNA, 64 nt, Homo Sapiens; identical to SEQ ID NO: 114562

SEQ ID NO: 382554 - RNA, 64 nt, Homo Sapiens; identical to SEQ ID NO: 114563

SEQ ID NO: 382555 - RNA, 64 nt, Homo Sapiens; identical to SEQ ID NO: 114564

SEQ ID NO: 382556 - RNA, 64 nt, Homo Sapiens; identical to SEQ ID NO: 114565

SEQ ID NO: 382557 - RNA, 64 nt, Homo Sapiens; identical to SEQ ID NO: 114566

SEQ ID NO: 382558 - RNA, 64 nt, Homo Sapiens; identical to SEQ ID NO: 114567

SEQ ID NO: 382559 - RNA, 64 nt, Homo Sapiens; identical to SEQ ID NO: 114568

SEQ ID NO: 382560 - RNA, 64 nt, Homo Sapiens; identical to SEQ ID NO: 114569

SEQ ID NO: 382561 - RNA, 64 nt, Homo Sapiens; identical to SEQ ID NO: 114570

SEQ ID NO: 382562 - RNA, 55 nt, Homo Sapiens; identical to SEQ ID NO: 114571

SEQ ID NO: 382563 - RNA, 64 nt, Homo Sapiens; identical to SEQ ID NO: 114572

SEQ ID NO: 382564 - RNA, 64 nt, Homo Sapiens; identical to SEQ ID NO: 114573

SEQ ID NO: 382565 - RNA, 64 nt, Homo Sapiens; identical to SEQ ID NO: 114574

SEQ ID NO: 382566 - RNA, 64 nt, Homo Sapiens; identical to SEQ ID NO: 114575

SEQ ID NO: 382567 - RNA, 64 nt, Homo Sapiens; identical to SEQ ID NO: 114576

SEQ ID NO: 382568 - RNA, 64 nt, Homo Sapiens; identical to SEQ ID NO: 114577

SEQ ID NO: 382569 - RNA, 64 nt, Homo Sapiens; identical to SEQ ID NO: 114578

SEQ ID NO: 382570 - RNA, 64 nt, Homo Sapiens; identical to SEQ ID NO: 114579

SEQ ID NO: 382571 - RNA, 64 nt, Homo Sapiens; identical to SEQ ID NO: 114580

SEQ ID NO: 382572 - RNA, 64 nt, Homo Sapiens; identical to SEQ ID NO: 114581

SEQ ID NO: 382573 - RNA, 64 nt, Homo Sapiens; identical to SEQ ID NO: 114582

SEQ ID NO: 382574 - RNA, 64 nt, Homo Sapiens; identical to SEQ ID NO: 114583

SEQ ID NO: 382575 - RNA, 64 nt, Homo Sapiens; identical to SEQ ID NO: 21683

SEQ ID NO: 382576 - RNA, 64 nt, Homo Sapiens; identical to SEQ ID NO: 21684

SEQ ID NO: 382577 - RNA, 64 nt, Homo Sapiens; identical to SEQ ID NO: 21685

SEQ ID NO: 382578 - RNA, 64 nt, Homo Sapiens; identical to SEQ ID NO: 21686

SEQ ID NO: 382579 - RNA, 64 nt, Homo Sapiens; identical to SEQ ID NO: 21687

SEQ ID NO: 382580 - RNA, 64 nt, Homo Sapiens; identical to SEQ ID NO: 21688

SEQ ID NO: 382581 - RNA, 64 nt, Homo Sapiens; identical to SEQ ID NO: 21689

SEQ ID NO: 382582 - RNA, 64 nt, Homo Sapiens; identical to SEQ ID NO: 21690

SEQ ID NO: 382583 - RNA, 64 nt, Homo Sapiens; identical to SEQ ID NO: 21691

SEQ ID NO: 382584 - RNA, 64 nt, Homo Sapiens; identical to SEQ ID NO: 21692

SEQ ID NO: 382585 - RNA, 64 nt, Homo Sapiens; identical to SEQ ID NO: 21693

SEQ ID NO: 382586 - RNA, 64 nt, Homo Sapiens; identical to SEQ ID NO: 21694

SEQ ID NO: 382587 - RNA, 52 nt, Homo Sapiens; identical to SEQ ID NO: 21695

SEQ ID NO: 382588 - RNA, 64 nt, Homo Sapiens; identical to SEQ ID NO: 21696

SEQ ID NO: 382589 - RNA, 64 nt, Homo Sapiens; identical to SEQ ID NO: 21697

SEQ ID NO: 382590 - RNA, 64 nt, Homo Sapiens; identical to SEQ ID NO: 21698

SEQ ID NO: 382591 - RNA, 64 nt, Homo Sapiens; identical to SEQ ID NO: 21699

SEQ ID NO: 382592 - RNA, 64 nt, Homo Sapiens; identical to SEQ ID NO: 21700

SEQ ID NO: 382593 - RNA, 64 nt, Homo Sapiens; identical to SEQ ID NO: 21701

SEQ ID NO: 382594 - RNA, 64 nt, Homo Sapiens; identical to SEQ ID NO: 21702

SEQ ID NO: 382595 - RNA, 64 nt, Homo Sapiens; identical to SEQ ID NO: 21703

SEQ ID NO: 382596 - RNA, 64 nt, Homo Sapiens; identical to SEQ ID NO: 21704

SEQ ID NO: 382597 - RNA, 64 nt, Homo Sapiens; identical to SEQ ID NO: 21705

SEQ ID NO: 382598 - RNA, 64 nt, Homo Sapiens; identical to SEQ ID NO: 21706

SEQ ID NO: 382599 - RNA, 64 nt, Homo Sapiens; identical to SEQ ID NO: 21707

SEQ ID NO: 382600 - RNA, 64 nt, Homo Sapiens; identical to SEQ ID NO: 21708

SEQ ID NO: 382601 - RNA, 64 nt, Homo Sapiens; identical to SEQ ID NO: 21709

SEQ ID NO: 382602 - RNA, 64 nt, Homo Sapiens; identical to SEQ ID NO: 21710

SEQ ID NO: 382603 - RNA, 64 nt, Homo Sapiens; identical to SEQ ID NO: 21711

SEQ ID NO: 382604 - RNA, 64 nt, Homo Sapiens; identical to SEQ ID NO: 21712

SEQ ID NO: 382605 - RNA, 64 nt, Homo Sapiens; identical to SEQ ID NO: 21713

SEQ ID NO: 382606 - RNA, 64 nt, Homo Sapiens; identical to SEQ ID NO: 21714

SEQ ID NO: 382607 - RNA, 64 nt, Homo Sapiens; identical to SEQ ID NO: 21715

SEQ ID NO: 382608 - RNA, 64 nt, Homo Sapiens; identical to SEQ ID NO: 21716

SEQ ID NO: 382609 - RNA, 64 nt, Homo Sapiens; identical to SEQ ID NO: 21717

SEQ ID NO: 382610 - RNA, 64 nt, Homo Sapiens; identical to SEQ ID NO: 21718

SEQ ID NO: 382611 - RNA, 64 nt, Homo Sapiens; identical to SEQ ID NO: 21719

SEQ ID NO: 382612 - RNA, 64 nt, Homo Sapiens; identical to SEQ ID NO: 21720

SEQ ID NO: 382613 - RNA, 64 nt, Homo Sapiens; identical to SEQ ID NO: 21721

SEQ ID NO: 382614 - RNA, 64 nt, Homo Sapiens; identical to SEQ ID NO: 21722

SEQ ID NO: 382615 - RNA, 64 nt, Homo Sapiens; identical to SEQ ID NO: 21723

SEQ ID NO: 382616 - RNA, 64 nt, Homo Sapiens; identical to SEQ ID NO: 21724

SEQ ID NO: 382617 - RNA, 64 nt, Homo Sapiens; identical to SEQ ID NO: 21725

SEQ ID NO: 382618 - RNA, 64 nt, Homo Sapiens; identical to SEQ ID NO: 21726

SEQ ID NO: 382619 - RNA, 64 nt, Homo Sapiens; identical to SEQ ID NO: 21727

SEQ ID NO: 382620 - RNA, 64 nt, Homo Sapiens; identical to SEQ ID NO: 21728

SEQ ID NO: 382621 - RNA, 64 nt, Homo Sapiens; identical to SEQ ID NO: 21729

SEQ ID NO: 382622 - RNA, 64 nt, Homo Sapiens; identical to SEQ ID NO: 21730

SEQ ID NO: 382623 - RNA, 64 nt, Homo Sapiens; identical to SEQ ID NO: 21731

SEQ ID NO: 382624 - RNA, 64 nt, Homo Sapiens; identical to SEQ ID NO: 21732

SEQ ID NO: 382625 - RNA, 64 nt, Homo Sapiens; identical to SEQ ID NO: 21733

SEQ ID NO: 382626 - RNA, 64 nt, Homo Sapiens; identical to SEQ ID NO: 21734

SEQ ID NO: 382627 - RNA, 64 nt, Homo Sapiens; identical to SEQ ID NO: 21735

SEQ ID NO: 382628 - RNA, 64 nt, Homo Sapiens; identical to SEQ ID NO: 21736

SEQ ID NO: 382629 - RNA, 64 nt, Homo Sapiens; identical to SEQ ID NO: 21737

SEQ ID NO: 382630 - RNA, 64 nt, Homo Sapiens; identical to SEQ ID NO: 21738

SEQ ID NO: 382631 - RNA, 64 nt, Homo Sapiens; identical to SEQ ID NO: 21739

SEQ ID NO: 382632 - RNA, 64 nt, Homo Sapiens; identical to SEQ ID NO: 21740

SEQ ID NO: 382633 - RNA, 64 nt, Homo Sapiens; identical to SEQ ID NO: 21741

SEQ ID NO: 382634 - RNA, 64 nt, Homo Sapiens; identical to SEQ ID NO: 21742

SEQ ID NO: 382635 - RNA, 64 nt, Homo Sapiens; identical to SEQ ID NO: 21743

SEQ ID NO: 382636 - RNA, 64 nt, Homo Sapiens; identical to SEQ ID NO: 21744

SEQ ID NO: 382637 - RNA, 64 nt, Homo Sapiens; identical to SEQ ID NO: 21745

SEQ ID NO: 382638 - RNA, 64 nt, Homo Sapiens; identical to SEQ ID NO: 21746

SEQ ID NO: 382639 - RNA, 64 nt, Homo Sapiens; identical to SEQ ID NO: 21747

SEQ ID NO: 382640 - RNA, 64 nt, Homo Sapiens
aguccacagggagauccacagcucacggagccuggccgcggaccccucccaccccugccuugcc

SEQ ID NO: 382641 - RNA, 64 nt, Homo Sapiens
gcugagccaggccggggucugggcccuucagggagccgcggauuuuuauguucagaaagugauc

SEQ ID NO: 382642 - RNA, 64 nt, Homo Sapiens
ggggcguggccuuaccuucuccugcucgcccucagccgcggagccucugcggaggcugagcccc

SEQ ID NO: 382643 - RNA, 64 nt, Homo Sapiens
gaggugccugugguuugcacccaccacugaaaaagccgcggagaugcgcagcgcguacacugac

SEQ ID NO: 382644 - RNA, 64 nt, Homo Sapiens
ugcccuuuuccuggugcuuuccuggcuggggauggccgcggaggggcacggagcgcugugcugg

SEQ ID NO: 382645 - RNA, 64 nt, Homo Sapiens
agaggcugcccccucagcugucgaggagggggccgccgcggacccuggcagcgaugggucucca

SEQ ID NO: 382646 - RNA, 64 nt, Homo Sapiens
ccccuucccagaccagguuaggauuccugggaaggccgcggauuccggcccuggaagaggcagg

SEQ ID NO: 382647 - RNA, 64 nt, Homo Sapiens
gaguaggccccagggcgcggccacagacuggcgggccgcggaaggggguagggcccgagcuccg

SEQ ID NO: 382648 - RNA, 64 nt, Homo Sapiens
ucacaccugcgcagcccccuccccagcucaccgcgccgcggaccgcggggccccggcucgcaag

SEQ ID NO: 382649 - RNA, 64 nt, Homo Sapiens
aggcaggcggcccccacacucccccgcccgccgggccgcggaggggcccuaggagcuggugcug

SEQ ID NO: 382650 - RNA, 64 nt, Homo Sapiens
cucuggagggguccaggugcccccgccccacaaggccgcggagccucagcaggagggguggcga

SEQ ID NO: 382651 - RNA, 64 nt, Homo Sapiens
ggaagccagccugcugucgcccuaccaguggcuggccgcggauuugggucccgugacucgagcu

SEQ ID NO: 382652 - RNA, 64 nt, Homo Sapiens
acaaaacaguguuuguaacaauaacguacucaccgccgcggacaaucccccaccccgaucccuc

SEQ ID NO: 382653 - RNA, 64 nt, Homo Sapiens
gaggcugagagggccgggcccacguucgcgccgcgccgcggaggggguggguucgccaggaggg

SEQ ID NO: 382654 - RNA, 64 nt, Homo Sapiens
acagugacaccagggcacauggcuggagcacagugccgcggaaaccugauuuuguacucucuuu

SEQ ID NO: 382655 - RNA, 64 nt, Homo Sapiens
cucgcccuccagccccaacccccggcccggcgccgccgcggagccccgcgcgcugggguugcgc

SEQ ID NO: 382656 - RNA, 64 nt, Homo Sapiens
gucccucaggugaggacugaaugcccgcauagaugccgcggaaggggcaccagaggcaguaacc

SEQ ID NO: 382657 - RNA, 64 nt, Homo Sapiens
gacauuaguggaaccgggcucuucuuuaacuccagccgcggaauuuggugacguagaccguuug

SEQ ID NO: 382658 - RNA, 64 nt, Homo Sapiens
caguaggacuccuuauuuggcgugacccgaccuggccgcggagccugcauuuccucgcagccuc

SEQ ID NO: 382659 - RNA, 64 nt, Homo Sapiens
aucucuggaagccuuugcuacucaagcuccucuggccgcggaacaauuccucugaucauguuug

SEQ ID NO: 382660 - RNA, 64 nt, Homo Sapiens
uccugagaccaaagaccuugugcccuucccaggagccgcggaggaggacagugagggaggaaug

SEQ ID NO: 382661 - RNA, 64 nt, Homo Sapiens
cgggccgcgugugagcgcacccccacagcucucggccgcggacccgacccggcccgcuccagau

SEQ ID NO: 382662 - RNA, 64 nt, Homo Sapiens
gccagccagauccggacccuguggaagcagcggugccgcggaggggcuuuuccuuuuguucugg

SEQ ID NO: 382663 - RNA, 64 nt, Homo Sapiens
agccggcgcccaucuccaccgccuggacgcccgcgccgcggaggagcucgcugggagcaucacc

SEQ ID NO: 382664 - RNA, 64 nt, Homo Sapiens
cgagcaguucaccuggcgucugaaagagaauuacgccgcggaguacgcgaacgcacuggagaag

SEQ ID NO: 382665 - RNA, 64 nt, Homo Sapiens
gccuggggggcgagaaaggcccccaugcucaugggccgcggaguguggaccuguagauaggcac

SEQ ID NO: 382666 - RNA, 64 nt, Homo Sapiens
gggcugugcacauaccaguuggcucaagauuagggccgcggaggagugugaacacugcuuggcu

SEQ ID NO: 382667 - RNA, 58 nt, Homo Sapiens
acaucagggacuugcucuaguucucugagccgcggacaugcccucgcauugcuucccg

SEQ ID NO: 382668 - RNA, 64 nt, Homo Sapiens
cuccgggaccucccuuggguccuuccagcucagugccgcggacagaguagguggccgcuuugcg

SEQ ID NO: 382669 - RNA, 64 nt, Homo Sapiens
ccggccggccccacacccgcucuuccucuucuuugccgcggacucccuuuccugccuccaagac

SEQ ID NO: 382670 - RNA, 64 nt, Homo Sapiens
acagagugauuuggaacuccaaagaaaucgggaugccgcggagcugucgggagguuagcugcgg

SEQ ID NO: 382671 - RNA, 64 nt, Homo Sapiens
ggaggcuucagaagcagcagggaugcuggcugccgccgcggaacccccgugacccugcgucgaa

SEQ ID NO: 382672 - RNA, 64 nt, Homo Sapiens
cguuuucacugucacccucgccccgagggccaaugccgcggacaggguggaccccucgccuccu

SEQ ID NO: 382673 - RNA, 64 nt, Homo Sapiens
agccgaaagggcguugggaugcugccuggcgggggccgcggaggccucgcgggcgggcgccggc

SEQ ID NO: 382674 - RNA, 64 nt, Homo Sapiens
gaccucgcgccucaccggaagaccuugccucugugccgcggagguccaggaggaaacggggcgg

SEQ ID NO: 382675 - RNA, 64 nt, Homo Sapiens
uggcaggguggcgccugcggcucccaggccccaggccgcggagcaaguuauugcccgcucaccu

SEQ ID NO: 382676 - RNA, 64 nt, Homo Sapiens
cggggagugcccacagacccccaaagagcagcgagccgcggagcgggggcacggccuccagcuu

SEQ ID NO: 382677 - RNA, 64 nt, Homo Sapiens
ugacgucacgcaagcaacggacccagagcacacggccgcggagacccgcgccucacgaucccuc

SEQ ID NO: 382678 - RNA, 64 nt, Homo Sapiens
ggggcuccgagggggcgcagccuuuguacaccgcgccgcggaagacccgcgcgucucggcugcc

SEQ ID NO: 382679 - RNA, 64 nt, Homo Sapiens
cugcgcacucucuggucaucacuggucccgggccgccgcggaccaccggccccgcccucagccc

SEQ ID NO: 382680 - RNA, 64 nt, Homo Sapiens
aauuauucccuccccgacccugccacccaccgcugccgcggauagcuacugcccucugccccuu

SEQ ID NO: 382681 - RNA, 64 nt, Homo Sapiens
gaagauaagggacauuaacugugagagaagcugugccgcggagucgcuuacagaacaguuucuc

SEQ ID NO: 382682 - RNA, 64 nt, Homo Sapiens
gugcugggcuuggggguaaggaccccagagcuaggccgcggaguacgggagaccgauauuuaag

SEQ ID NO: 382683 - RNA, 64 nt, Homo Sapiens
ggaggcggacguccccacucuggccucccagaaggccgcggaggagccggaugcugagccggga

SEQ ID NO: 382684 - RNA, 64 nt, Homo Sapiens
ggaugaagcagcagaugcaggaccagugacgcucgccgcggacacaccguccgucuccgggacg

SEQ ID NO: 382685 - RNA, 64 nt, Homo Sapiens
guggugaggggacguccuugcagagcucuuucauuggggcgaguuucccuggggugcuccaggc

SEQ ID NO: 382686 - RNA, 64 nt, Homo Sapiens
gucggccuggacuucccugguucagugagguggcuggggcgagagggagaauggggagaggguc

SEQ ID NO: 382687 - RNA, 64 nt, Homo Sapiens
gcugugcauugacaucacaggcugugccaacauguggggcgaguacugggacaaccucaucugc

SEQ ID NO: 382688 - RNA, 64 nt, Homo Sapiens
uuauggucuccaggcccuucuccguuucucaagauggggcgagccaggaccacagagcuccugg

SEQ ID NO: 382689 - RNA, 64 nt, Homo Sapiens
acagcgcuggggaggugacggcgcccgccgcagguggggcgaggcugggggagggcggcgccgc

SEQ ID NO: 382690 - RNA, 64 nt, Homo Sapiens
ggaccccaucccagaggagaugcuggcuaccagcuggggcgaccccaagggucgcuggagucag

SEQ ID NO: 382691 - RNA, 64 nt, Homo Sapiens
ggcugagcagagagcggggaaaaugcaggcugaguggggcgaccuccugccugccaggagcccc

SEQ ID NO: 382692 - RNA, 64 nt, Homo Sapiens; identical to SEQ ID NO: 308983

SEQ ID NO: 382693 - RNA, 64 nt, Homo Sapiens; identical to SEQ ID NO: 308984

SEQ ID NO: 382694 - RNA, 64 nt, Homo Sapiens; identical to SEQ ID NO: 308985

SEQ ID NO: 382695 - RNA, 64 nt, Homo Sapiens; identical to SEQ ID NO: 308986

SEQ ID NO: 382696 - RNA, 64 nt, Homo Sapiens; identical to SEQ ID NO: 308987

SEQ ID NO: 382697 - RNA, 64 nt, Homo Sapiens; identical to SEQ ID NO: 308988

SEQ ID NO: 382698 - RNA, 64 nt, Homo Sapiens; identical to SEQ ID NO: 308989

SEQ ID NO: 382699 - RNA, 64 nt, Homo Sapiens; identical to SEQ ID NO: 308990

SEQ ID NO: 382700 - RNA, 64 nt, Homo Sapiens; identical to SEQ ID NO: 308991

SEQ ID NO: 382701 - RNA, 64 nt, Homo Sapiens; identical to SEQ ID NO: 308992

SEQ ID NO: 382702 - RNA, 64 nt, Homo Sapiens; identical to SEQ ID NO: 308993

SEQ ID NO: 382703 - RNA, 64 nt, Homo Sapiens; identical to SEQ ID NO: 308994

SEQ ID NO: 382704 - RNA, 64 nt, Homo Sapiens; identical to SEQ ID NO: 308995

SEQ ID NO: 382705 - RNA, 64 nt, Homo Sapiens; identical to SEQ ID NO: 308996

SEQ ID NO: 382706 - RNA, 64 nt, Homo Sapiens; identical to SEQ ID NO: 308997

SEQ ID NO: 382707 - RNA, 64 nt, Homo Sapiens; identical to SEQ ID NO: 308998

SEQ ID NO: 382708 - RNA, 64 nt, Homo Sapiens; identical to SEQ ID NO: 308999

SEQ ID NO: 382709 - RNA, 64 nt, Homo Sapiens; identical to SEQ ID NO: 309000

SEQ ID NO: 382710 - RNA, 64 nt, Homo Sapiens; identical to SEQ ID NO: 309001

SEQ ID NO: 382711 - RNA, 64 nt, Homo Sapiens; identical to SEQ ID NO: 309002

SEQ ID NO: 382712 - RNA, 64 nt, Homo Sapiens; identical to SEQ ID NO: 309003

SEQ ID NO: 382713 - RNA, 64 nt, Homo Sapiens; identical to SEQ ID NO: 309004

SEQ ID NO: 382714 - RNA, 64 nt, Homo Sapiens; identical to SEQ ID NO: 309005

SEQ ID NO: 382715 - RNA, 64 nt, Homo Sapiens; identical to SEQ ID NO: 309006

SEQ ID NO: 382716 - RNA, 64 nt, Homo Sapiens; identical to SEQ ID NO: 309007

SEQ ID NO: 382717 - RNA, 64 nt, Homo Sapiens; identical to SEQ ID NO: 309008

SEQ ID NO: 382718 - RNA, 64 nt, Homo Sapiens; identical to SEQ ID NO: 309009

SEQ ID NO: 382719 - RNA, 64 nt, Homo Sapiens; identical to SEQ ID NO: 309010

SEQ ID NO: 382720 - RNA, 64 nt, Homo Sapiens; identical to SEQ ID NO: 309011

SEQ ID NO: 382721 - RNA, 64 nt, Homo Sapiens; identical to SEQ ID NO: 309012

SEQ ID NO: 382722 - RNA, 64 nt, Homo Sapiens; identical to SEQ ID NO: 309013

SEQ ID NO: 382723 - RNA, 64 nt, Homo Sapiens; identical to SEQ ID NO: 309014

SEQ ID NO: 382724 - RNA, 64 nt, Homo Sapiens; identical to SEQ ID NO: 309015

SEQ ID NO: 382725 - RNA, 64 nt, Homo Sapiens; identical to SEQ ID NO: 309016

SEQ ID NO: 382726 - RNA, 64 nt, Homo Sapiens; identical to SEQ ID NO: 309017

SEQ ID NO: 382727 - RNA, 64 nt, Homo Sapiens; identical to SEQ ID NO: 309018

SEQ ID NO: 382728 - RNA, 64 nt, Homo Sapiens; identical to SEQ ID NO: 309019

SEQ ID NO: 382729 - RNA, 64 nt, Homo Sapiens; identical to SEQ ID NO: 309020

SEQ ID NO: 382730 - RNA, 64 nt, Homo Sapiens; identical to SEQ ID NO: 309021

SEQ ID NO: 382731 - RNA, 64 nt, Homo Sapiens; identical to SEQ ID NO: 309022

SEQ ID NO: 382732 - RNA, 64 nt, Homo Sapiens; identical to SEQ ID NO: 309023

SEQ ID NO: 382733 - RNA, 64 nt, Homo Sapiens; identical to SEQ ID NO: 309024

SEQ ID NO: 382734 - RNA, 64 nt, Homo Sapiens; identical to SEQ ID NO: 309025

SEQ ID NO: 382735 - RNA, 64 nt, Homo Sapiens; identical to SEQ ID NO: 309026

SEQ ID NO: 382736 - RNA, 64 nt, Homo Sapiens; identical to SEQ ID NO: 309027

SEQ ID NO: 382737 - RNA, 64 nt, Homo Sapiens; identical to SEQ ID NO: 309028

SEQ ID NO: 382738 - RNA, 64 nt, Homo Sapiens; identical to SEQ ID NO: 309029

SEQ ID NO: 382739 - RNA, 64 nt, Homo Sapiens; identical to SEQ ID NO: 309030

SEQ ID NO: 382740 - RNA, 64 nt, Homo Sapiens; identical to SEQ ID NO: 309031

SEQ ID NO: 382741 - RNA, 64 nt, Homo Sapiens; identical to SEQ ID NO: 309032

SEQ ID NO: 382742 - RNA, 64 nt, Homo Sapiens; identical to SEQ ID NO: 309033

SEQ ID NO: 382743 - RNA, 64 nt, Homo Sapiens; identical to SEQ ID NO: 309034

SEQ ID NO: 382744 - RNA, 64 nt, Homo Sapiens; identical to SEQ ID NO: 309035

SEQ ID NO: 382745 - RNA, 64 nt, Homo Sapiens; identical to SEQ ID NO: 309036

SEQ ID NO: 382746 - RNA, 64 nt, Homo Sapiens; identical to SEQ ID NO: 309037

SEQ ID NO: 382747 - RNA, 64 nt, Homo Sapiens; identical to SEQ ID NO: 309038

SEQ ID NO: 382748 - RNA, 64 nt, Homo Sapiens; identical to SEQ ID NO: 309039

SEQ ID NO: 382749 - RNA, 64 nt, Homo Sapiens; identical to SEQ ID NO: 309040

SEQ ID NO: 382750 - RNA, 64 nt, Homo Sapiens; identical to SEQ ID NO: 309041

SEQ ID NO: 382751 - RNA, 64 nt, Homo Sapiens; identical to SEQ ID NO: 309042

SEQ ID NO: 382752 - RNA, 64 nt, Homo Sapiens; identical to SEQ ID NO: 309043

SEQ ID NO: 382753 - RNA, 64 nt, Homo Sapiens; identical to SEQ ID NO: 309044

SEQ ID NO: 382754 - RNA, 64 nt, Homo Sapiens; identical to SEQ ID NO: 309045

SEQ ID NO: 382755 - RNA, 64 nt, Homo Sapiens; identical to SEQ ID NO: 309046

SEQ ID NO: 382756 - RNA, 64 nt, Homo Sapiens; identical to SEQ ID NO: 309047

SEQ ID NO: 382757 - RNA, 64 nt, Homo Sapiens; identical to SEQ ID NO: 309048

SEQ ID NO: 382758 - RNA, 64 nt, Homo Sapiens; identical to SEQ ID NO: 309049

SEQ ID NO: 382759 - RNA, 64 nt, Homo Sapiens; identical to SEQ ID NO: 309050

SEQ ID NO: 382760 - RNA, 64 nt, Homo Sapiens; identical to SEQ ID NO: 309051

SEQ ID NO: 382761 - RNA, 64 nt, Homo Sapiens; identical to SEQ ID NO: 309052

SEQ ID NO: 382762 - RNA, 64 nt, Homo Sapiens; identical to SEQ ID NO: 309053

SEQ ID NO: 382763 - RNA, 64 nt, Homo Sapiens; identical to SEQ ID NO: 309054

SEQ ID NO: 382764 - RNA, 64 nt, Homo Sapiens; identical to SEQ ID NO: 309055

SEQ ID NO: 382765 - RNA, 64 nt, Homo Sapiens; identical to SEQ ID NO: 309056

SEQ ID NO: 382766 - RNA, 64 nt, Homo Sapiens; identical to SEQ ID NO: 309057

SEQ ID NO: 382767 - RNA, 64 nt, Homo Sapiens; identical to SEQ ID NO: 309058

SEQ ID NO: 382768 - RNA, 64 nt, Homo Sapiens; identical to SEQ ID NO: 309059

SEQ ID NO: 382769 - RNA, 64 nt, Homo Sapiens; identical to SEQ ID NO: 309060

SEQ ID NO: 382770 - RNA, 64 nt, Homo Sapiens; identical to SEQ ID NO: 309061

SEQ ID NO: 382771 - RNA, 64 nt, Homo Sapiens; identical to SEQ ID NO: 309062

SEQ ID NO: 382772 - RNA, 64 nt, Homo Sapiens; identical to SEQ ID NO: 309063

SEQ ID NO: 382773 - RNA, 64 nt, Homo Sapiens; identical to SEQ ID NO: 309064

SEQ ID NO: 382774 - RNA, 64 nt, Homo Sapiens; identical to SEQ ID NO: 309065

SEQ ID NO: 382775 - RNA, 64 nt, Homo Sapiens; identical to SEQ ID NO: 309066

SEQ ID NO: 382776 - RNA, 64 nt, Homo Sapiens; identical to SEQ ID NO: 309067

SEQ ID NO: 382777 - RNA, 64 nt, Homo Sapiens; identical to SEQ ID NO: 309068

SEQ ID NO: 382778 - RNA, 64 nt, Homo Sapiens; identical to SEQ ID NO: 309069

SEQ ID NO: 382779 - RNA, 64 nt, Homo Sapiens; identical to SEQ ID NO: 309070

SEQ ID NO: 382780 - RNA, 64 nt, Homo Sapiens; identical to SEQ ID NO: 309071

SEQ ID NO: 382781 - RNA, 64 nt, Homo Sapiens; identical to SEQ ID NO: 309072

SEQ ID NO: 382782 - RNA, 64 nt, Homo Sapiens; identical to SEQ ID NO: 309073

SEQ ID NO: 382783 - RNA, 64 nt, Homo Sapiens; identical to SEQ ID NO: 309074

SEQ ID NO: 382784 - RNA, 64 nt, Homo Sapiens; identical to SEQ ID NO: 309075

SEQ ID NO: 382785 - RNA, 64 nt, Homo Sapiens; identical to SEQ ID NO: 309076

SEQ ID NO: 382786 - RNA, 64 nt, Homo Sapiens; identical to SEQ ID NO: 309077

SEQ ID NO: 382787 - RNA, 64 nt, Homo Sapiens; identical to SEQ ID NO: 309078

SEQ ID NO: 382788 - RNA, 64 nt, Homo Sapiens; identical to SEQ ID NO: 309079

SEQ ID NO: 382789 - RNA, 64 nt, Homo Sapiens; identical to SEQ ID NO: 309080

SEQ ID NO: 382790 - RNA, 64 nt, Homo Sapiens; identical to SEQ ID NO: 309081

SEQ ID NO: 382791 - RNA, 64 nt, Homo Sapiens; identical to SEQ ID NO: 309082

SEQ ID NO: 382792 - RNA, 64 nt, Homo Sapiens; identical to SEQ ID NO: 309083

SEQ ID NO: 382793 - RNA, 64 nt, Homo Sapiens; identical to SEQ ID NO: 309084

SEQ ID NO: 382794 - RNA, 64 nt, Homo Sapiens; identical to SEQ ID NO: 309085

SEQ ID NO: 382795 - RNA, 64 nt, Homo Sapiens; identical to SEQ ID NO: 309086

SEQ ID NO: 382796 - RNA, 64 nt, Homo Sapiens; identical to SEQ ID NO: 309087

SEQ ID NO: 382797 - RNA, 64 nt, Homo Sapiens; identical to SEQ ID NO: 309088

SEQ ID NO: 382798 - RNA, 64 nt, Homo Sapiens; identical to SEQ ID NO: 309089

SEQ ID NO: 382799 - RNA, 64 nt, Homo Sapiens; identical to SEQ ID NO: 309090

SEQ ID NO: 382800 - RNA, 64 nt, Homo Sapiens; identical to SEQ ID NO: 309091

SEQ ID NO: 382801 - RNA, 64 nt, Homo Sapiens; identical to SEQ ID NO: 309092

SEQ ID NO: 382802 - RNA, 64 nt, Homo Sapiens; identical to SEQ ID NO: 309093

SEQ ID NO: 382803 - RNA, 64 nt, Homo Sapiens; identical to SEQ ID NO: 309094

SEQ ID NO: 382804 - RNA, 64 nt, Homo Sapiens; identical to SEQ ID NO: 309095

SEQ ID NO: 382805 - RNA, 64 nt, Homo Sapiens; identical to SEQ ID NO: 309096

SEQ ID NO: 382806 - RNA, 64 nt, Homo Sapiens; identical to SEQ ID NO: 309097

SEQ ID NO: 382807 - RNA, 64 nt, Homo Sapiens; identical to SEQ ID NO: 309098

SEQ ID NO: 382808 - RNA, 64 nt, Homo Sapiens; identical to SEQ ID NO: 309099

SEQ ID NO: 382809 - RNA, 64 nt, Homo Sapiens; identical to SEQ ID NO: 309100

SEQ ID NO: 382810 - RNA, 64 nt, Homo Sapiens; identical to SEQ ID NO: 309101

SEQ ID NO: 382811 - RNA, 64 nt, Homo Sapiens; identical to SEQ ID NO: 309102

SEQ ID NO: 382812 - RNA, 64 nt, Homo Sapiens; identical to SEQ ID NO: 309103

SEQ ID NO: 382813 - RNA, 64 nt, Homo Sapiens; identical to SEQ ID NO: 309104

SEQ ID NO: 382814 - RNA, 64 nt, Homo Sapiens; identical to SEQ ID NO: 309105

SEQ ID NO: 382815 - RNA, 64 nt, Homo Sapiens; identical to SEQ ID NO: 309106

SEQ ID NO: 382816 - RNA, 64 nt, Homo Sapiens; identical to SEQ ID NO: 309107

SEQ ID NO: 382817 - RNA, 64 nt, Homo Sapiens; identical to SEQ ID NO: 309108

SEQ ID NO: 382818 - RNA, 64 nt, Homo Sapiens; identical to SEQ ID NO: 309109

SEQ ID NO: 382819 - RNA, 64 nt, Homo Sapiens; identical to SEQ ID NO: 309110

SEQ ID NO: 382820 - RNA, 64 nt, Homo Sapiens; identical to SEQ ID NO: 309111

SEQ ID NO: 382821 - RNA, 64 nt, Homo Sapiens; identical to SEQ ID NO: 309112

SEQ ID NO: 382822 - RNA, 64 nt, Homo Sapiens; identical to SEQ ID NO: 309113

SEQ ID NO: 382823 - RNA, 64 nt, Homo Sapiens; identical to SEQ ID NO: 309114

SEQ ID NO: 382824 - RNA, 64 nt, Homo Sapiens; identical to SEQ ID NO: 309115

SEQ ID NO: 382825 - RNA, 64 nt, Homo Sapiens; identical to SEQ ID NO: 309116

SEQ ID NO: 382826 - RNA, 64 nt, Homo Sapiens; identical to SEQ ID NO: 309117

SEQ ID NO: 382827 - RNA, 64 nt, Homo Sapiens; identical to SEQ ID NO: 309118

SEQ ID NO: 382828 - RNA, 64 nt, Homo Sapiens; identical to SEQ ID NO: 309119

SEQ ID NO: 382829 - RNA, 64 nt, Homo Sapiens; identical to SEQ ID NO: 309120

SEQ ID NO: 382830 - RNA, 64 nt, Homo Sapiens; identical to SEQ ID NO: 309121

SEQ ID NO: 382831 - RNA, 64 nt, Homo Sapiens; identical to SEQ ID NO: 309122

SEQ ID NO: 382832 - RNA, 64 nt, Homo Sapiens; identical to SEQ ID NO: 309123

SEQ ID NO: 382833 - RNA, 64 nt, Homo Sapiens; identical to SEQ ID NO: 309124

SEQ ID NO: 382834 - RNA, 53 nt, Homo Sapiens; identical to SEQ ID NO: 309125

SEQ ID NO: 382835 - RNA, 64 nt, Homo Sapiens; identical to SEQ ID NO: 309126

SEQ ID NO: 382836 - RNA, 64 nt, Homo Sapiens; identical to SEQ ID NO: 309127

SEQ ID NO: 382837 - RNA, 64 nt, Homo Sapiens; identical to SEQ ID NO: 309128

SEQ ID NO: 382838 - RNA, 64 nt, Homo Sapiens; identical to SEQ ID NO: 309129

SEQ ID NO: 382839 - RNA, 64 nt, Homo Sapiens; identical to SEQ ID NO: 309130

SEQ ID NO: 382840 - RNA, 64 nt, Homo Sapiens; identical to SEQ ID NO: 309131

SEQ ID NO: 382841 - RNA, 64 nt, Homo Sapiens; identical to SEQ ID NO: 309132

SEQ ID NO: 382842 - RNA, 64 nt, Homo Sapiens; identical to SEQ ID NO: 309133

SEQ ID NO: 382843 - RNA, 64 nt, Homo Sapiens; identical to SEQ ID NO: 309134

SEQ ID NO: 382844 - RNA, 64 nt, Homo Sapiens; identical to SEQ ID NO: 309135

SEQ ID NO: 382845 - RNA, 64 nt, Homo Sapiens; identical to SEQ ID NO: 309136

SEQ ID NO: 382846 - RNA, 64 nt, Homo Sapiens; identical to SEQ ID NO: 309137

SEQ ID NO: 382847 - RNA, 64 nt, Homo Sapiens; identical to SEQ ID NO: 309138

SEQ ID NO: 382848 - RNA, 64 nt, Homo Sapiens; identical to SEQ ID NO: 309139

SEQ ID NO: 382849 - RNA, 64 nt, Homo Sapiens; identical to SEQ ID NO: 309140

SEQ ID NO: 382850 - RNA, 64 nt, Homo Sapiens; identical to SEQ ID NO: 309141

SEQ ID NO: 382851 - RNA, 64 nt, Homo Sapiens; identical to SEQ ID NO: 309142

SEQ ID NO: 382852 - RNA, 64 nt, Homo Sapiens; identical to SEQ ID NO: 309143

SEQ ID NO: 382853 - RNA, 64 nt, Homo Sapiens; identical to SEQ ID NO: 309144

SEQ ID NO: 382854 - RNA, 64 nt, Homo Sapiens; identical to SEQ ID NO: 309145

SEQ ID NO: 382855 - RNA, 64 nt, Homo Sapiens; identical to SEQ ID NO: 309146

SEQ ID NO: 382856 - RNA, 64 nt, Homo Sapiens; identical to SEQ ID NO: 309147

SEQ ID NO: 382857 - RNA, 64 nt, Homo Sapiens; identical to SEQ ID NO: 309148

SEQ ID NO: 382858 - RNA, 64 nt, Homo Sapiens; identical to SEQ ID NO: 309149

SEQ ID NO: 382859 - RNA, 64 nt, Homo Sapiens; identical to SEQ ID NO: 309150

SEQ ID NO: 382860 - RNA, 64 nt, Homo Sapiens; identical to SEQ ID NO: 309151

SEQ ID NO: 382861 - RNA, 64 nt, Homo Sapiens; identical to SEQ ID NO: 309152

SEQ ID NO: 382862 - RNA, 64 nt, Homo Sapiens
uuauugauacaugugggcuuuuaaaaacuccauccuuuauaaauagucaagguuugggccacac

SEQ ID NO: 382863 - RNA, 64 nt, Homo Sapiens
caagccguaauguugaacagaauuggaguauuuucuuuauaauuucuugaacaggcaaaugaaa

SEQ ID NO: 382864 - RNA, 64 nt, Homo Sapiens
guacuuuuaccuguagacuauuuuuacuaaggugcuuuauaauguguuuuaaagcauugcauuu

SEQ ID NO: 382865 - RNA, 64 nt, Homo Sapiens
caucagguccaguacaguacuaggagucauaauacuuuauaaucaauuaaauaaauagaaccac

SEQ ID NO: 382866 - RNA, 64 nt, Homo Sapiens
uaguugcaccacugcagcuggcaagaaucaccuucuuuauaaagcgucagucaugcuuccagca

SEQ ID NO: 382867 - RNA, 64 nt, Homo Sapiens
ucaugcuuccagcaagaggcagcaucagucauggcuuuauaacagcuucauggugccucaaaga

SEQ ID NO: 382868 - RNA, 64 nt, Homo Sapiens
uauacauuacaucugaguauacguuuuucuggugcuuuauaaugaugaauaauaauacugucuu

SEQ ID NO: 382869 - RNA, 64 nt, Homo Sapiens
uuaugugguguuauugguacauuuauaccuagcacuuuauaaauuacuggcccaagauuauuca

SEQ ID NO: 382870 - RNA, 64 nt, Homo Sapiens
uuauaaaaucuucauuaugaaauauuaucaguugcuuuauaaacucacucuuuuuauggauccu

SEQ ID NO: 382871 - RNA, 64 nt, Homo Sapiens
auacaaacuaugucucugacaugcacauacacugcuuuauaaugaaaaugaggacacuuucuga

SEQ ID NO: 382872 - RNA, 64 nt, Homo Sapiens
ggccucacacccagaggguagggcagcagaucuucuuuauaacuauuuauuguucgaaucacuu

SEQ ID NO: 382873 - RNA, 64 nt, Homo Sapiens
acuauuuauuguucgaaucacuuuuaggauguaacuuuauaaauaaacaugagcgcugaugauu

SEQ ID NO: 382874 - RNA, 64 nt, Homo Sapiens
aauuguugacugacuuauuuugaaguguuaaauacuuuauaaaauuuugccuauguuucuacaa

SEQ ID NO: 382875 - RNA, 64 nt, Homo Sapiens
uauugauuuauguaauacuaugccauauugaggccuuuauaaacuacuaccuauuucuaaacuu

SEQ ID NO: 382876 - RNA, 64 nt, Homo Sapiens
cuuuaaaaaaaaaacccaaaauuuauuucuuuaacuuuauaagaggauugcaaauaauugaggg

SEQ ID NO: 382877 - RNA, 64 nt, Homo Sapiens
agguuuuuucaaauuucuccgagaaguuuuuuagcuuuauaaagguaaaaaaguuaguguauua

SEQ ID NO: 382878 - RNA, 64 nt, Homo Sapiens
uuuagccccuuugauaguccaugguuaagacauccuuuauaaaccaaagauggccagcacacug

SEQ ID NO: 382879 - RNA, 64 nt, Homo Sapiens
uacagauggcuaguugcauaaaauuaaauuuuaccuuuauaagacaauggugaaaucuggcuug

SEQ ID NO: 382880 - RNA, 64 nt, Homo Sapiens
uauauauauaauuuaaaggaaaaauaggugccuccuuuauaaacaguaauagcuacguuuggga

SEQ ID NO: 382881 - RNA, 64 nt, Homo Sapiens
agugaucuucaacuuaacaaacacuuacguucuccuuuauaaaaugcauaguaaaccacuaacg

SEQ ID NO: 382882 - RNA, 64 nt, Homo Sapiens
agcaaaggggcugaaaaacugaauaaggaaacaacuuuauaagagaaacaguggucuucaaucu

SEQ ID NO: 382883 - RNA, 64 nt, Homo Sapiens
auauucaccaauuucaggaaaaccaaccauagaacuuuauaauaggacaguuauaaccugacug

SEQ ID NO: 382884 - RNA, 64 nt, Homo Sapiens
cugaucuuuuacauaaagcaaauaaaaauuaugucuuuauaacucugaugcuuagauccuuuga

SEQ ID NO: 382885 - RNA, 64 nt, Homo Sapiens
uagcgugugucugaaccuuauuccccuugugcugcuuuauaauuuuauaguaagaaaaagguuu

SEQ ID NO: 382886 - RNA, 64 nt, Homo Sapiens
gaacauguucacauugacagaaaaacaagcugcucuuuauaauaugcaccuuuuaaaaaauuag

SEQ ID NO: 382887 - RNA, 64 nt, Homo Sapiens
cccuuagagcccccuaaguuuuucccagacgaaucuuuauaauuucuuuccaaagauaccaaau

SEQ ID NO: 382888 - RNA, 59 nt, Homo Sapiens
ucuucuccccaugggguuaacaacauucucuuuauaaauauuuuugcucccucagauuu

SEQ ID NO: 382889 - RNA, 64 nt, Homo Sapiens
auuuuuaaacuucuaagugaaaguagucugagcgcuuuauaaaauucauauuauuguguguguu

SEQ ID NO: 382890 - RNA, 64 nt, Homo Sapiens
uuuggagaaaacugaagauuuaguuuccauuuuucuuuauaauaaaauauuugagccacuguau

SEQ ID NO: 382891 - RNA, 64 nt, Homo Sapiens
cauuacauugcagagggggacuaaucuauuaaaucuuuauaaaaaggggaagaaagauaucuau

SEQ ID NO: 382892 - RNA, 64 nt, Homo Sapiens
guaauuacuuaaaaagaaauagaaacuaaauggucuuuauaaaaucagaagcaugcuuacuuau

SEQ ID NO: 382893 - RNA, 64 nt, Homo Sapiens
acaguucucaccauuucacguaccuuaauccaaucuuuauaaaagaggcagucuagagaacuag

SEQ ID NO: 382894 - RNA, 64 nt, Homo Sapiens
uguuuuucaguuccaucucugcucuguccuauagcuuuauaaaaccagaguguguggggcugag

SEQ ID NO: 382895 - RNA, 64 nt, Homo Sapiens
uucacuucugcaauagcuuucauuuucucauaggcuuuauaagagauggguucagugguaugag

SEQ ID NO: 382896 - RNA, 64 nt, Homo Sapiens
ggaaagauuuauuaaagaauuauauuuguguauacuuuauaaauuagucccucauuagauuuuu

SEQ ID NO: 382897 - RNA, 64 nt, Homo Sapiens
cuuuuauaaaaaggaaacuaacuuuuuacauaaacuuuauaaacaacuugguauuuuuaaguug

SEQ ID NO: 382898 - RNA, 64 nt, Homo Sapiens
uauauuauuauuguauuuuucauagaagaguguucuuuauaaauuuuuggugguggugguuguu

SEQ ID NO: 382899 - RNA, 64 nt, Homo Sapiens
caaauuuuaagaaaaugugggaauaccaaauguccuuuauaagaaaaauaaauuuuauuuuaag

SEQ ID NO: 382900 - RNA, 64 nt, Homo Sapiens
auuuuuccauuuccaaaaaauaaaauuuauuaugcuuuauaaccucuucuguauuuucuaauuu

SEQ ID NO: 382901 - RNA, 64 nt, Homo Sapiens
ggcagaaaagucaucauauguauaugucauaugacuuuauaaaauauuuaaugugacaaaaagu

SEQ ID NO: 382902 - RNA, 64 nt, Homo Sapiens
gguuuuaucauuccauuuugcuaauauuuacuagcuuuauaaauuacaguaagguacaaaaacu

SEQ ID NO: 382903 - RNA, 64 nt, Homo Sapiens
acuggucaacgauuagaaaagaagcucagaaagucuuuauaaccgaguuucauugcuuuaaaaa

SEQ ID NO: 382904 - RNA, 64 nt, Homo Sapiens
uugcaguaccuaaucuguuaugaucuaggcaaaccuuuauaaagugugugugugcgcugcuucu

SEQ ID NO: 382905 - RNA, 64 nt, Homo Sapiens
guguagagcuuguguucuuggcccauccuuggagcuuuauaagugaccugagugggaugcauuu

SEQ ID NO: 382906 - RNA, 64 nt, Homo Sapiens
caugucuuccauuuggcuguuucugaguuguagccuuuauaauaaagugguaaauguuguaacu

SEQ ID NO: 382907 - RNA, 64 nt, Homo Sapiens
cagcuaugaaaaguuacuucaaaugugugccacccuuuauaauacaagagugucugaggcuguc

SEQ ID NO: 382908 - RNA, 64 nt, Homo Sapiens
aacaaaaaccuuaccgguagacauauauucauuucuuuauaaaauauaacuaaugguugaaaau

SEQ ID NO: 382909 - RNA, 64 nt, Homo Sapiens
ucauuuguguugugaaaauugccagcgaagacaacuuuauaaugccagugguccccaguaccag

SEQ ID NO: 382910 - RNA, 64 nt, Homo Sapiens
gcucugggggcugagcccugggcuuuagagaucccuuuauaaaaauaauauggaagggaguuug

SEQ ID NO: 382911 - RNA, 64 nt, Homo Sapiens
accaaguauuaaacuguaaauuucguguuguguucuuuauaacccauaauuaauuuggacauua

SEQ ID NO: 382912 - RNA, 64 nt, Homo Sapiens
cuuucuuuuuccuucauaauuuauuuucuuuuuccuuuauaauuuucaccacuuguccauugcg

SEQ ID NO: 382913 - RNA, 64 nt, Homo Sapiens
aaaaguuguuuauaaaaaccuaaacuaaagugugcuuuauaaaaacaguuauaaagaaagauug

SEQ ID NO: 382914 - RNA, 64 nt, Homo Sapiens; identical to SEQ ID NO: 227872

SEQ ID NO: 382915 - RNA, 64 nt, Homo Sapiens; identical to SEQ ID NO: 227873

SEQ ID NO: 382916 - RNA, 64 nt, Homo Sapiens; identical to SEQ ID NO: 227874

SEQ ID NO: 382917 - RNA, 64 nt, Homo Sapiens; identical to SEQ ID NO: 227875

SEQ ID NO: 382918 - RNA, 64 nt, Homo Sapiens; identical to SEQ ID NO: 227876

SEQ ID NO: 382919 - RNA, 64 nt, Homo Sapiens; identical to SEQ ID NO: 227877

SEQ ID NO: 382920 - RNA, 64 nt, Homo Sapiens
guauaaacacuaacauuuuccccuucuguaguuguaugaaaaaacaaauauuguuagcauagua

SEQ ID NO: 382921 - RNA, 64 nt, Homo Sapiens
ugaugugugcgucugauuauugcuuuuuuaauuuuaugaaaauuguguaaaauuacauuuuuuu

SEQ ID NO: 382922 - RNA, 64 nt, Homo Sapiens
cguuauacauucauauuuuguauugauuuuugauuaugaaaaucaaaaauuuucacauuugauu

SEQ ID NO: 382923 - RNA, 64 nt, Homo Sapiens
uugauuaugaaaaucaaaaauuuucacauuugauuaugaaaaucuccaaacauaugcacaagca

SEQ ID NO: 382924 - RNA, 64 nt, Homo Sapiens
guuaauuuuaauuuagcaaaagagccagucauuuuaugaaaaaucaaaauuauaagugauuuua

SEQ ID NO: 382925 - RNA, 64 nt, Homo Sapiens
cuggccagucccugguguuuguaauguucuuuaauaugaaaaaguaguucuccaacucuaucau

SEQ ID NO: 382926 - RNA, 64 nt, Homo Sapiens
aguuuggaccuuuuuuucaguuaaaugcuaaauauaugaaaauuacuauaccucuaaguauuuu

SEQ ID NO: 382927 - RNA, 64 nt, Homo Sapiens
cuagcuaaaguucagauuuuguuagguucaacccuaugaaaaaaacuauuuucauaggucaaaa

SEQ ID NO: 382928 - RNA, 64 nt, Homo Sapiens
uacacugugcuaggcgcauuuacaauguugcauuuaugaaaaacacucuggauucaucuauguc

SEQ ID NO: 382929 - RNA, 64 nt, Homo Sapiens
cccaggaccuucuuucuuugcuuuuugagcuuucuaugaaaaacggauagcaucaaagguugaa

SEQ ID NO: 382930 - RNA, 64 nt, Homo Sapiens
ugauacauaacuaaauuugauacuuauauuuucguaugaaaaugaguugugaaaguuuugagua

SEQ ID NO: 382931 - RNA, 64 nt, Homo Sapiens
cugcaucuuauagcacuuugaaauaccucauguuuaugaaaauaaauagcuuaaaauuaaauga

SEQ ID NO: 382932 - RNA, 64 nt, Homo Sapiens
cuuuuaauaacaaagguacaauauuuuguuuuaguaugaaaaucugguagauccuauuacacuu

SEQ ID NO: 382933 - RNA, 64 nt, Homo Sapiens
uuuuuuaucaugauuaaauaucaaaaaauugcccuaugaaaacuuuaaaucucuaaaacauuug

SEQ ID NO: 382934 - RNA, 64 nt, Homo Sapiens
aaccauguuuucucucacccuuuucauauaaauguaugaaaauccugugaaauaauaaggccga

SEQ ID NO: 382935 - RNA, 64 nt, Homo Sapiens
agccucauuauuuauaguuguucugugaguuuuguaugaaaaucguauauguaauaagguuuau

SEQ ID NO: 382936 - RNA, 64 nt, Homo Sapiens
gagacuauauuuauauucuuacguauugaauauuuaugaaaagaucaaaccaaugugucaaaua

SEQ ID NO: 382937 - RNA, 64 nt, Homo Sapiens
gaaauaauuaucuuagaauaacuguacuaguuacuaugaaaaugcugagagaaugcuagucaua

SEQ ID NO: 382938 - RNA, 64 nt, Homo Sapiens
aucaucagcuaauucucugaaagaugaauucacauaugaaaaaggguaaguaauggauauaaaa

SEQ ID NO: 382939 - RNA, 64 nt, Homo Sapiens
uuaacagaacuaaugauguauugaaacacuguauuaugaaaagcuaaauuauacaucauuguaa

SEQ ID NO: 382940 - RNA, 64 nt, Homo Sapiens
auagcuggcuucuuuacagauucagugcaauccuuaugaaaaucuauccuaacugacaugcaga

SEQ ID NO: 382941 - RNA, 64 nt, Homo Sapiens
aaguuaaauaauuccauuuacuagcaacaaacaauaugaaaacgaugaauuguauuucuuuaua

SEQ ID NO: 382942 - RNA, 64 nt, Homo Sapiens
uuuauaguaaaauuuuuuauccuauuagaaaagguaugaaaaucacuugaaaaagauccaagcu

SEQ ID NO: 382943 - RNA, 64 nt, Homo Sapiens
aguggcuuccaucaaaccuuuacccagagauaucuaugaaaacccuuagcacugcccuggugau

SEQ ID NO: 382944 - RNA, 64 nt, Homo Sapiens
auauggaaacuucuaaaaugcaaacuuuguuuucuaugaaaaugguuuaaauguuacuuguuuu

SEQ ID NO: 382945 - RNA, 64 nt, Homo Sapiens
uuuccauaucaucaaaacuaugaauguuugaugcuaugaaaagccccugugcauuugcaccaga

SEQ ID NO: 382946 - RNA, 64 nt, Homo Sapiens
acguggcagagccuucagaccauccacaaaccuuuaugaaaauucauauuugagaguagaagau

SEQ ID NO: 382947 - RNA, 64 nt, Homo Sapiens
uaagagaaaugauauuggugagaagccacaaaaauaugaaaaauguggcaaagccuucaaaugc

SEQ ID NO: 382948 - RNA, 64 nt, Homo Sapiens
aggauggaaguauuaaggauuuuguaacaccuuuuaugaaaauguugaaggaacuuaaaacuuu

SEQ ID NO: 382949 - RNA, 64 nt, Homo Sapiens
cucuuaugccaguuuucauaaaacccaaaccacauaugaaaaaauccauuaaggguccaagaag

SEQ ID NO: 382950 - RNA, 64 nt, Homo Sapiens
aaaaaauccauuaaggguccaagaagucuguccauaugaaaaugaggguaaauauaguuuauuu

SEQ ID NO: 382951 - RNA, 64 nt, Homo Sapiens
ugaaagucucuggggaucaugggaauugagugucuaugaaaaccauauuccagacaagaauaua

SEQ ID NO: 382952 - RNA, 64 nt, Homo Sapiens
aaaauaugucaacugaagaucugacuguacuaaauaugaaaaauaaagcagcacauacuuucuc

SEQ ID NO: 382953 - RNA, 55 nt, Homo Sapiens
auuuauuauaucguacauaaguuaguaugaaaaacagacuaucaccuuuauugag

SEQ ID NO: 382954 - RNA, 64 nt, Homo Sapiens
uucagaaucaaaauuaagaaaguuggacugaaaauaugaaaaaugcuuaacuauuguucucuuc

SEQ ID NO: 382955 - RNA, 64 nt, Homo Sapiens
ggagacuuccauaaguuuguguauuauguuagucuaugaaaacgugcaaauguauuguagagac

SEQ ID NO: 382956 - RNA, 64 nt, Homo Sapiens
aaucaauauuggaaguauugcuaaaaucuuauaauaugaaaagagauccacuaauguagcuuaa

SEQ ID NO: 382957 - RNA, 64 nt, Homo Sapiens
ucacaaguucaaucuguuuuucauguaaauuuuguaugaaaaaucaaugucaaguaccaaaaug

SEQ ID NO: 382958 - RNA, 64 nt, Homo Sapiens
auugucuuuuuuucaagaugcuuuguuucuuucauaugaaaaaaaugcauuuuauaaauucaga

SEQ ID NO: 382959 - RNA, 64 nt, Homo Sapiens
cggguaaaaaucacaaaaugcagucgaauauauauaugaaaacuugcauuaggugauaaaguga

SEQ ID NO: 382960 - RNA, 64 nt, Homo Sapiens
uuaacuuuuaaaauguuguuuaaaagugugaagcuaugaaaagccugauaaugugacuacagau

SEQ ID NO: 382961 - RNA, 64 nt, Homo Sapiens
uugacuaugucaaucuguauauauuguaccuuaauaugaaaaacaaauuuuuuaauucauaaaa

SEQ ID NO: 382962 - RNA, 64 nt, Homo Sapiens
accagagauacaaagacauuguaagauccuaucauaugaaaauauuuauccuauaauucuacuu

SEQ ID NO: 382963 - RNA, 64 nt, Homo Sapiens
gucguaucuuaacagugaacauggccacuaaguauaugaaaaaaucacagaagagagaaugcaa

SEQ ID NO: 382964 - RNA, 64 nt, Homo Sapiens
aaaaucacagaagagagaauaaaaaaaagguagauaugaaaagaaagaaccaagucuuacauag

SEQ ID NO: 382965 - RNA, 64 nt, Homo Sapiens
ucuugagagcauugggauaucuccugaaaagguuuaugaaaaagaagaaucucaucucagugaa

SEQ ID NO: 382966 - RNA, 64 nt, Homo Sapiens
gauaauuuuaaauucucucucuugcaggaaggacuaugaaaagcuagaauugaguguuuaaagu

SEQ ID NO: 382967 - RNA, 64 nt, Homo Sapiens
uuuucagaccagaggcaacuuauucaugaauuuuuaugaaaacuaucuacuaggacagauaagc

SEQ ID NO: 382968 - RNA, 64 nt, Homo Sapiens
uuuuuaaaauacuguuuaacauuugugagaauuuuaugaaaaugcuuuuguaugagcuguggcu

SEQ ID NO: 382969 - RNA, 64 nt, Homo Sapiens
uccaucucaaaaauaaugcaauauuaauagauaauaugaaaaucaaugguggugcuuuaaaaag

SEQ ID NO: 382970 - RNA, 64 nt, Homo Sapiens
auuugaugauguaggagguuaacuucaauuuacuuaugaaaagaccaaguaacugaaccauucc

SEQ ID NO: 382971 - RNA, 64 nt, Homo Sapiens
caaguauugggucuuaaacuucaagugcaauguauaugaaaaccaaucugagccuuguaucucu

SEQ ID NO: 382972 - RNA, 64 nt, Homo Sapiens
augaaaaaaauuuccaaugaagaugucagcauuuuaugaaaaaccagaaguuauuagaugaaag

SEQ ID NO: 382973 - RNA, 64 nt, Homo Sapiens
agggggaggauuguucacucauuguauuaagugguaugaaaaaaaauaaauaagaaaauuaaua

SEQ ID NO: 382974 - RNA, 64 nt, Homo Sapiens
uuaaguaugccaguaguuuaaauguuuucagugauaugaaaaggcuacauacaauagaugaaua

SEQ ID NO: 382975 - RNA, 64 nt, Homo Sapiens
uuguaugcuuugaaggcugcgcagagcucagauauaugaaaaauuuccucuuguuccugcuuau

SEQ ID NO: 382976 - RNA, 64 nt, Homo Sapiens
accugaugaaaauauuuguaacaaaaaugauguguaugaaaagcgaaaacaggcauguggaaac

SEQ ID NO: 382977 - RNA, 64 nt, Homo Sapiens
uauaacaaccuaugguugaaggguuaccuccaaauaugaaaaucauaaacaauaucuaucaaau

SEQ ID NO: 382978 - RNA, 64 nt, Homo Sapiens
ugguuugauacuuuguuuauauacccguguauguuaugaaaacaaugcuccacauuuaaaggac

SEQ ID NO: 382979 - RNA, 64 nt, Homo Sapiens
uacaucggauaugugaaaagugaggaauguuuaauaugaaaacauucuuuccuucccaagaaac

SEQ ID NO: 382980 - RNA, 64 nt, Homo Sapiens
ucauggaauaauagggauuuuauauacuaguugcuaugaaaauauugugaaaaauauauugaua

SEQ ID NO: 382981 - RNA, 64 nt, Homo Sapiens
uaaaaugacuuuucaaauuaggaugcauuuuuauuaugaaaaaagcugaauugcaucagaucau

SEQ ID NO: 382982 - RNA, 64 nt, Homo Sapiens
gagauugaagcacuaauuccauauauacauguaauaugaaaauuauccaauuggauuauucuua

SEQ ID NO: 382983 - RNA, 64 nt, Homo Sapiens
uuagaaaaggcaaacuccgguuguuuucaccugauaugaaaaugcaaucacccauaugaaaaaa

SEQ ID NO: 382984 - RNA, 64 nt, Homo Sapiens
uuguuuucaccugauaugaaaauacaaucacccauaugaaaaaagacauuugcucauguuggua

SEQ ID NO: 382985 - RNA, 64 nt, Homo Sapiens
uuccacauugaaacacuuugcagacacaaauaucuaugaaaagaugcuuugucagccacugugc

SEQ ID NO: 382986 - RNA, 64 nt, Homo Sapiens
aacgaaagccaaagugucauuuaagagagauauauaugaaaaaguaacauuaauauauagaacu

SEQ ID NO: 382987 - RNA, 64 nt, Homo Sapiens
ugaagucuaagagaaauaaaauuuaguggacagguaugaaaaguguaauugcgccuaacuacca

SEQ ID NO: 382988 - RNA, 64 nt, Homo Sapiens
uugaguuugauuauggaaauccauucaaagucacuaugaaaauuuuacucauguaguuuggaaa

SEQ ID NO: 382989 - RNA, 64 nt, Homo Sapiens
auuuggcagcgccauaacauucauuuaaaaaguuuaugaaaacauucauuugaaaguuccaugc

SEQ ID NO: 382990 - RNA, 64 nt, Homo Sapiens
cuuaaaaauaaauguaauaaagucagaguggugguaugaaaacauuccuagugaucauguagua

SEQ ID NO: 382991 - RNA, 64 nt, Homo Sapiens
aucaugguaccuauaauggugauauauuuguuucuaugaaaaauguauugugcuuugauacuaa

SEQ ID NO: 382992 - RNA, 64 nt, Homo Sapiens
auauucacugcagagcaauuagcucacccuagacuaugaaaauuaaaauuauucaccauuuuga

SEQ ID NO: 382993 - RNA, 64 nt, Homo Sapiens
gaaaaaagugcccaguucuuuacuuuaaugcagcuaugaaaagguggugcaugucauugagaac

SEQ ID NO: 382994 - RNA, 64 nt, Homo Sapiens
gaucuuuucuugacucucccauuuuuuuaauuguuaugaaaauggaaguuuugaaauuaccuug

SEQ ID NO: 382995 - RNA, 64 nt, Homo Sapiens
aauaaauacuaugcaaaccaaucagccuuguguauaugaaaaacaaaguguaaacuguacagua

SEQ ID NO: 382996 - RNA, 64 nt, Homo Sapiens
guuauguaacuacauauuacgaaaugaguagugauaugaaaaugagaugaauugguaaauaaug

SEQ ID NO: 382997 - RNA, 64 nt, Homo Sapiens
gcagcuguaaauuauguauuuaaacugcuuuuaauaugaaaauucuuugaauuacucauaguuu

SEQ ID NO: 382998 - RNA, 64 nt, Homo Sapiens
auacaugagaaauaaggaaaaaaccauggaauuauaugaaaauguguaacauauaauauuagug

SEQ ID NO: 382999 - RNA, 64 nt, Homo Sapiens
guugggaaucuugguuucaggugugcccggcugcuaugaaaaacuucucguuggggucaccaaa

SEQ ID NO: 383000 - RNA, 64 nt, Homo Sapiens
gccucaaggaguacguguucuugagaguaguuauuaugaaaaaguuagguugcagagagcuggc

SEQ ID NO: 383001 - RNA, 64 nt, Homo Sapiens
ccauagugguauuuuuuugggguuggauauugcuuaugaaaauuuguacuguguuuuacugauu

SEQ ID NO: 383002 - RNA, 64 nt, Homo Sapiens
guuaugggauuaaagaaaguaaaaaaaaaaaaauuaugaaaaaacagagugagacucugucuca

SEQ ID NO: 383003 - RNA, 64 nt, Homo Sapiens
ggccaggugcaguggcucacuaugguauaaaaguuaugaaaaaaaaaaaagguuauggguaacu

SEQ ID NO: 383004 - RNA, 64 nt, Homo Sapiens
uguagacuauucucaagguauagcucagacaaacuaugaaaaacuuuuacagguacaaguuuuc

SEQ ID NO: 383005 - RNA, 64 nt, Homo Sapiens
uucauguuucagacauugaaucaguucuuuuugauaugaaaacauuuagaggguggcagguaca

SEQ ID NO: 383006 - RNA, 64 nt, Homo Sapiens
aaucugaaggucaugaaaagcccaugucuugaaauaugaaaagguagugucuauaggaaaguag

SEQ ID NO: 383007 - RNA, 64 nt, Homo Sapiens
ucaaagauuuuuuugacuauuuauguuaguuuauuaugaaaacaaguucuuggcuuauguuagu

SEQ ID NO: 383008 - RNA, 64 nt, Homo Sapiens
agguauauuugguuuaguucuauaauguuguauauaugaaaaacgcauauauucugcaaagugg

SEQ ID NO: 383009 - RNA, 64 nt, Homo Sapiens
ugucauugugacaucacaggcuuuccuugauuguuaugaaaaagaaauuggcaagaaaauggua

SEQ ID NO: 383010 - RNA, 64 nt, Homo Sapiens
aaagcuuaauugucccagaaaaaauauauauauauaugaaaaauuguauguauauauauauaug

SEQ ID NO: 383011 - RNA, 64 nt, Homo Sapiens
uauauauauaugaaaaauaauauguauauauauauaugaaaauaaauuguuuccuuuauauaug

SEQ ID NO: 383012 - RNA, 64 nt, Homo Sapiens
uuugaauauacauauauauaugaaagcucaucucuaugaaaaaagaccagccugggcaacaugg

SEQ ID NO: 383013 - RNA, 64 nt, Homo Sapiens
auaguacccuauuuucagacaauacaauaauucuuaugaaaaucgucaaauuggcuucuuauua

SEQ ID NO: 383014 - RNA, 64 nt, Homo Sapiens
uaugcauaccuaaugaaguaugugaaaagaaaauuaugaaaaaagccuauucucuuaaaaagua

SEQ ID NO: 383015 - RNA, 64 nt, Homo Sapiens
cugcuuaaugugcuuaagagaguuugcuugagcauaugaaaaucuuuauuuaaccaaugguuuc

SEQ ID NO: 383016 - RNA, 64 nt, Homo Sapiens
ucuuaacacccacccuacaucacucuucuagggauaugaaaaucugcagcucuccaucagaauc

SEQ ID NO: 383017 - RNA, 64 nt, Homo Sapiens
aaaaauaacaucuucaguuuucuuggaaagucuauaugaaaaacgcaaauucuauauuuuacau

SEQ ID NO: 383018 - RNA, 64 nt, Homo Sapiens
uguagagacuuguaugcaaagguuggcauauuuauaugaaaauuaguugcuauagaaacauuug

SEQ ID NO: 383019 - RNA, 64 nt, Homo Sapiens
auguaaaauauuuaggauuugaccacacaauggcuaugaaaaugcaaguaguuuccucgcguga

SEQ ID NO: 383020 - RNA, 64 nt, Homo Sapiens
uccaaauacagugacuuuuuuuucauacauuuaguaugaaaacuugaacagcgaaagcagagca

SEQ ID NO: 383021 - RNA, 64 nt, Homo Sapiens
uagcuugauuagcaaagguuuuugacaaacaguuuaugaaaaaauaaaacuuaaauacauuaca

SEQ ID NO: 383022 - RNA, 64 nt, Homo Sapiens
aaaagauagcacaaaacuuaccucuuuucucccuuaugaaaaagcucuuuuauucaguguucuu

SEQ ID NO: 383023 - RNA, 64 nt, Homo Sapiens
auuuuaaaggaaagaaaauauugauuauacaggcuaugaaaaccguuauaaauaccaugucaaa

SEQ ID NO: 383024 - RNA, 64 nt, Homo Sapiens
cugagaaggagaugaaggaguaaugcggcugggguaugaaaacagaagaugugccuggugugug

SEQ ID NO: 383025 - RNA, 64 nt, Homo Sapiens
cagaauacuggcaagaaaugguuggcauaaauguuaugaaaaggugggaaugaccagauaucuu

SEQ ID NO: 383026 - RNA, 64 nt, Homo Sapiens
cacacauucucucucaauuucagcuucggaacgcuaugaaaauaauacaugauuaaaguuucac

SEQ ID NO: 383027 - RNA, 64 nt, Homo Sapiens
aaagcagguaugcagguaugugggugaaagugacuaugaaaagacuuaaugaauucugggauuu

SEQ ID NO: 383028 - RNA, 64 nt, Homo Sapiens
ucacaggcagugcaugugaagcaugcuuugcugcuaugaaaaugagcaucagagaguguacauc

SEQ ID NO: 383029 - RNA, 64 nt, Homo Sapiens
cuguuguaaacaacguguauagugccuaaaauuguaugaaaauccuuuuaaccauuuuaaccua

SEQ ID NO: 383030 - RNA, 64 nt, Homo Sapiens
ugugaaguaauggaauuauguugguuauuuucuuuaugaaaauaaaccaguucuuccaaggaag

SEQ ID NO: 383031 - RNA, 64 nt, Homo Sapiens
uaaccacucaaaacuuuucauuucacugaaaaaauaugaaaaaccaugacaauagggcugggug

SEQ ID NO: 383032 - RNA, 64 nt, Homo Sapiens
auauaggaauauuccagucaaucucugaaauguuuaugaaaaacagguuaauauguuguauuuu

SEQ ID NO: 383033 - RNA, 64 nt, Homo Sapiens
uuaaaagcuaauuuauaaaagcaauacuuuuuaauaugaaaacuuacugcaaaguuuguuuaua

SEQ ID NO: 383034 - RNA, 64 nt, Homo Sapiens
agcaaaaaacaacuaccaguguuacucauaugauuaugaaaaucguccauucuuuuaaauguug

SEQ ID NO: 383035 - RNA, 64 nt, Homo Sapiens
uggggagauuccuaggcuagaaauugcugggccauaugaaaaaucaauaguuagcuuuguaaga

SEQ ID NO: 383036 - RNA, 64 nt, Homo Sapiens
gcuauagacaaucauaaaugaacuuccauugugauaugaaaacacuuuacagacacugaacuug

SEQ ID NO: 383037 - RNA, 64 nt, Homo Sapiens
gcuauagacaaucauaaauguucuaccacugugguaugaaaacaagguauuuacagcaacucaa

SEQ ID NO: 383038 - RNA, 64 nt, Homo Sapiens
aaccauguguaacaauaaaugcaggggauuacguuaugaaaacugaguccugaguugcucuggg

SEQ ID NO: 383039 - RNA, 64 nt, Homo Sapiens
ugaucagagagaaaagugggcucuuagaaucucuuaugaaaaaaaguugguacuuuuucacucc

SEQ ID NO: 383040 - RNA, 64 nt, Homo Sapiens
uacccaauauauauuuuuuggcacaggacagcccuaugaaaaaagucugucuaccuuuagccag

SEQ ID NO: 383041 - RNA, 64 nt, Homo Sapiens
caaaccaaaauaugcucuugcuuuaccccuagucuaugaaaaaaauuuucuuaguagugcagac

SEQ ID NO: 383042 - RNA, 64 nt, Homo Sapiens
aacucuguauuuucuauuagcuauccaacucucuuaugaaaagguaugaaaaauacuguuucuu

SEQ ID NO: 383043 - RNA, 64 nt, Homo Sapiens
acuguuucuucuauccaacuuuugcaaauaagaauaugaaaaauauugacauauuagaaagguu

SEQ ID NO: 383044 - RNA, 64 nt, Homo Sapiens; identical to SEQ ID NO: 237135

SEQ ID NO: 383045 - RNA, 64 nt, Homo Sapiens; identical to SEQ ID NO: 237136

SEQ ID NO: 383046 - RNA, 64 nt, Homo Sapiens; identical to SEQ ID NO: 237137

SEQ ID NO: 383047 - RNA, 64 nt, Homo Sapiens; identical to SEQ ID NO: 237138

SEQ ID NO: 383048 - RNA, 64 nt, Homo Sapiens; identical to SEQ ID NO: 237139

SEQ ID NO: 383049 - RNA, 64 nt, Homo Sapiens; identical to SEQ ID NO: 237140

SEQ ID NO: 383050 - RNA, 64 nt, Homo Sapiens; identical to SEQ ID NO: 237141

SEQ ID NO: 383051 - RNA, 64 nt, Homo Sapiens; identical to SEQ ID NO: 237142

SEQ ID NO: 383052 - RNA, 64 nt, Homo Sapiens; identical to SEQ ID NO: 237143

SEQ ID NO: 383053 - RNA, 64 nt, Homo Sapiens; identical to SEQ ID NO: 237144

SEQ ID NO: 383054 - RNA, 64 nt, Homo Sapiens; identical to SEQ ID NO: 237145

SEQ ID NO: 383055 - RNA, 64 nt, Homo Sapiens; identical to SEQ ID NO: 237146

SEQ ID NO: 383056 - RNA, 64 nt, Homo Sapiens; identical to SEQ ID NO: 237147

SEQ ID NO: 383057 - RNA, 64 nt, Homo Sapiens; identical to SEQ ID NO: 237148

SEQ ID NO: 383058 - RNA, 64 nt, Homo Sapiens; identical to SEQ ID NO: 237149

SEQ ID NO: 383059 - RNA, 64 nt, Homo Sapiens; identical to SEQ ID NO: 237150

SEQ ID NO: 383060 - RNA, 64 nt, Homo Sapiens
cuggcuguuucuuuggaucccucugucccagagccacccagaacccugacucuugagaaucaag

SEQ ID NO: 383061 - RNA, 64 nt, Homo Sapiens
cacccagaacccugacucuugagaaucaagaaaacacccagaaaggccuuaaugaccucauagg

SEQ ID NO: 383062 - RNA, 64 nt, Homo Sapiens
uuguuggaguucagcggggcggggcugcugagcccacccagaggagcucucgcuuaacuuccua

SEQ ID NO: 383063 - RNA, 64 nt, Homo Sapiens
agugggacaugagcaggggucccuccagaggcugcacccagaaccaaaacaccucagagggcug

SEQ ID NO: 383064 - RNA, 64 nt, Homo Sapiens
ugccaccgucccucugcagauacacugcucuccccacccagaccugccugucucccacccuuuc

SEQ ID NO: 383065 - RNA, 64 nt, Homo Sapiens
auggcugaagugcaugggucagggugugaggccacacccagaguagccaugaggaggcagagag

SEQ ID NO: 383066 - RNA, 64 nt, Homo Sapiens
acucuuucggggagcucagcugauuaaggcccaacacccagacucagcagugagaugagggcug

SEQ ID NO: 383067 - RNA, 64 nt, Homo Sapiens
aaacagagcaugagcccacagccccaucuucauucacccagaaguggagcugcauauuuuuaug

SEQ ID NO: 383068 - RNA, 64 nt, Homo Sapiens
caaggggaaaaugugaagcugaacccccuccagacacccagaauguagcaucugagaaggcccu

SEQ ID NO: 383069 - RNA, 64 nt, Homo Sapiens
ccagcagggcugugaugggcgagucccggagccccacccagaccugaaugcuucugagagcaaa

SEQ ID NO: 383070 - RNA, 64 nt, Homo Sapiens
uucgccuuugcugaagucuccccgcagcccucuccacccagaggucucccuauaccgagaccca

SEQ ID NO: 383071 - RNA, 64 nt, Homo Sapiens
cugacagccuccuaggcucccugagguaccuuuccacccagacccuccuuccccaccccauaag

SEQ ID NO: 383072 - RNA, 64 nt, Homo Sapiens
cugaguccccagacagcagaguaugaacugcugacacccagauuccauuaaaaauucugcuaau

SEQ ID NO: 383073 - RNA, 64 nt, Homo Sapiens
auucagggcagaacuccuguaucagccucauggacacccagaauugguaucucauggcuggaga

SEQ ID NO: 383074 - RNA, 64 nt, Homo Sapiens
ucuggccaaaaauggcucucggccccaagucucccacccagaaccucagagucugggucucacu

SEQ ID NO: 383075 - RNA, 64 nt, Homo Sapiens
gggacaagauaggacauggcucuguuuccauuaucacccagagaacugacugcuacuuccuguc

SEQ ID NO: 383076 - RNA, 64 nt, Homo Sapiens
caggggaagauuuagaaacaccagcgugaacccucacccagagugaaggccagaauacuggaga

SEQ ID NO: 383077 - RNA, 64 nt, Homo Sapiens
uccauuugagucugcuccuuuuucccuccuuuaccacccagaaauugagagcuuucuuguuugu

SEQ ID NO: 383078 - RNA, 64 nt, Homo Sapiens
ugggccagggacucaacaaucacgcuccacugaccacccagagccagagcugggccagggagga

SEQ ID NO: 383079 - RNA, 51 nt, Homo Sapiens; identical to SEQ ID NO: 111105

SEQ ID NO: 383080 - RNA, 64 nt, Homo Sapiens
ugugcagaugaaaugucaaugauuaaugaauuaucacccagacagggucccuacguuuuacauu

SEQ ID NO: 383081 - RNA, 64 nt, Homo Sapiens
aauuuugugagcaugcauguauguugguuucacucacccagaguauucaugggugugugugcac

SEQ ID NO: 383082 - RNA, 64 nt, Homo Sapiens
ccugagaugacuaggacagucuguacccagaggccacccagaagcccucagauguacauacaca

SEQ ID NO: 383083 - RNA, 64 nt, Homo Sapiens
uggaucccacuguuccucuuugccacagagaaagcacccagacgccacaggcucugucgcauuu

SEQ ID NO: 383084 - RNA, 64 nt, Homo Sapiens
gcccagccacucccgggaccacggcaaaaggaaccacccagacccaccacccguacacccucag

SEQ ID NO: 383085 - RNA, 64 nt, Homo Sapiens
uuuuguaaugauguuucuuuggauacugucuagucacccagaaaaauguauggaugaauuuuuu

SEQ ID NO: 383086 - RNA, 64 nt, Homo Sapiens
cucagggguuuggucacaaaggauggacucuucccacccagaggaugcagggaaagcacacugu

SEQ ID NO: 383087 - RNA, 64 nt, Homo Sapiens
acccucacugcccucaaggacaacagcagggugucacccagagcccgaugaggggugccagcag

SEQ ID NO: 383088 - RNA, 64 nt, Homo Sapiens
uagacauuguuuuuguagaaagaagagaucaguccacccagaguagcccugcccugggcuguug

SEQ ID NO: 383089 - RNA, 64 nt, Homo Sapiens
agcugggucuccaggcugccagugagcuaaggcucacccagagcaagucccaggaaccacagga

SEQ ID NO: 383090 - RNA, 64 nt, Homo Sapiens
gacccccaccauaaaucacaucauuagcaugaaccacccagaguggcccaagacucccagauca

SEQ ID NO: 383091 - RNA, 64 nt, Homo Sapiens
uuugguggcacguaagcuccuugucugucuccagcacccagaaucucauuaaagcuuauuuauu

SEQ ID NO: 383092 - RNA, 64 nt, Homo Sapiens
uggagcagguggcuuaggggagcucacucuuuuacacccagaggucgguucuccaacagcccag

SEQ ID NO: 383093 - RNA, 64 nt, Homo Sapiens
ccugccacucuuuaccuaguccuccccugggaggcacccagaagauagaagcacauuucugcca

SEQ ID NO: 383094 - RNA, 64 nt, Homo Sapiens
ccaucucaagagcucgcccagcaaccucuccugccacccagaucaggcagcuuuccucugaaaa

SEQ ID NO: 383095 - RNA, 64 nt, Homo Sapiens
ggacucagcuucaaagcugcuggaacccaguaugcacccagaggucaagccaaggaucaucccc

SEQ ID NO: 383096 - RNA, 57 nt, Homo Sapiens; identical to SEQ ID NO: 130560

SEQ ID NO: 383097 - RNA, 64 nt, Homo Sapiens; identical to SEQ ID NO: 130561

SEQ ID NO: 383098 - RNA, 64 nt, Homo Sapiens; identical to SEQ ID NO: 130562

SEQ ID NO: 383099 - RNA, 64 nt, Homo Sapiens; identical to SEQ ID NO: 130563

SEQ ID NO: 383100 - RNA, 64 nt, Homo Sapiens; identical to SEQ ID NO: 130564

SEQ ID NO: 383101 - RNA, 64 nt, Homo Sapiens; identical to SEQ ID NO: 130565

SEQ ID NO: 383102 - RNA, 64 nt, Homo Sapiens; identical to SEQ ID NO: 130566

SEQ ID NO: 383103 - RNA, 64 nt, Homo Sapiens; identical to SEQ ID NO: 130567

SEQ ID NO: 383104 - RNA, 64 nt, Homo Sapiens; identical to SEQ ID NO: 130568

SEQ ID NO: 383105 - RNA, 64 nt, Homo Sapiens; identical to SEQ ID NO: 130569

SEQ ID NO: 383106 - RNA, 64 nt, Homo Sapiens; identical to SEQ ID NO: 130570

SEQ ID NO: 383107 - RNA, 64 nt, Homo Sapiens; identical to SEQ ID NO: 130571

SEQ ID NO: 383108 - RNA, 64 nt, Homo Sapiens; identical to SEQ ID NO: 130572

SEQ ID NO: 383109 - RNA, 64 nt, Homo Sapiens; identical to SEQ ID NO: 130573

SEQ ID NO: 383110 - RNA, 64 nt, Homo Sapiens; identical to SEQ ID NO: 130574

SEQ ID NO: 383111 - RNA, 64 nt, Homo Sapiens; identical to SEQ ID NO: 130575

SEQ ID NO: 383112 - RNA, 64 nt, Homo Sapiens; identical to SEQ ID NO: 130576

SEQ ID NO: 383113 - RNA, 64 nt, Homo Sapiens; identical to SEQ ID NO: 130577

SEQ ID NO: 383114 - RNA, 64 nt, Homo Sapiens; identical to SEQ ID NO: 130578

SEQ ID NO: 383115 - RNA, 64 nt, Homo Sapiens; identical to SEQ ID NO: 130579

SEQ ID NO: 383116 - RNA, 64 nt, Homo Sapiens; identical to SEQ ID NO: 130580

SEQ ID NO: 383117 - RNA, 64 nt, Homo Sapiens; identical to SEQ ID NO: 130581

SEQ ID NO: 383118 - RNA, 64 nt, Homo Sapiens; identical to SEQ ID NO: 130582

SEQ ID NO: 383119 - RNA, 64 nt, Homo Sapiens; identical to SEQ ID NO: 130583

SEQ ID NO: 383120 - RNA, 64 nt, Homo Sapiens; identical to SEQ ID NO: 130584

SEQ ID NO: 383121 - RNA, 64 nt, Homo Sapiens; identical to SEQ ID NO: 130585

SEQ ID NO: 383122 - RNA, 64 nt, Homo Sapiens; identical to SEQ ID NO: 130586

SEQ ID NO: 383123 - RNA, 64 nt, Homo Sapiens; identical to SEQ ID NO: 130587

SEQ ID NO: 383124 - RNA, 64 nt, Homo Sapiens; identical to SEQ ID NO: 130588

SEQ ID NO: 383125 - RNA, 64 nt, Homo Sapiens; identical to SEQ ID NO: 130589

SEQ ID NO: 383126 - RNA, 64 nt, Homo Sapiens; identical to SEQ ID NO: 130590

SEQ ID NO: 383127 - RNA, 64 nt, Homo Sapiens; identical to SEQ ID NO: 130591

SEQ ID NO: 383128 - RNA, 64 nt, Homo Sapiens; identical to SEQ ID NO: 130592

SEQ ID NO: 383129 - RNA, 64 nt, Homo Sapiens; identical to SEQ ID NO: 130593

SEQ ID NO: 383130 - RNA, 64 nt, Homo Sapiens; identical to SEQ ID NO: 130594

SEQ ID NO: 383131 - RNA, 64 nt, Homo Sapiens; identical to SEQ ID NO: 130595

SEQ ID NO: 383132 - RNA, 64 nt, Homo Sapiens; identical to SEQ ID NO: 130596

SEQ ID NO: 383133 - RNA, 64 nt, Homo Sapiens; identical to SEQ ID NO: 130597

SEQ ID NO: 383134 - RNA, 64 nt, Homo Sapiens; identical to SEQ ID NO: 130598

SEQ ID NO: 383135 - RNA, 64 nt, Homo Sapiens; identical to SEQ ID NO: 130599

SEQ ID NO: 383136 - RNA, 64 nt, Homo Sapiens; identical to SEQ ID NO: 130600

SEQ ID NO: 383137 - RNA, 64 nt, Homo Sapiens; identical to SEQ ID NO: 130601

SEQ ID NO: 383138 - RNA, 64 nt, Homo Sapiens; identical to SEQ ID NO: 130602

SEQ ID NO: 383139 - RNA, 64 nt, Homo Sapiens; identical to SEQ ID NO: 130603

SEQ ID NO: 383140 - RNA, 64 nt, Homo Sapiens; identical to SEQ ID NO: 130604

SEQ ID NO: 383141 - RNA, 64 nt, Homo Sapiens; identical to SEQ ID NO: 130605

SEQ ID NO: 383142 - RNA, 64 nt, Homo Sapiens; identical to SEQ ID NO: 130606

SEQ ID NO: 383143 - RNA, 64 nt, Homo Sapiens; identical to SEQ ID NO: 130607

SEQ ID NO: 383144 - RNA, 64 nt, Homo Sapiens; identical to SEQ ID NO: 130608

SEQ ID NO: 383145 - RNA, 64 nt, Homo Sapiens; identical to SEQ ID NO: 130609

SEQ ID NO: 383146 - RNA, 64 nt, Homo Sapiens; identical to SEQ ID NO: 130610

SEQ ID NO: 383147 - RNA, 64 nt, Homo Sapiens; identical to SEQ ID NO: 130611

SEQ ID NO: 383148 - RNA, 64 nt, Homo Sapiens; identical to SEQ ID NO: 245412

SEQ ID NO: 383149 - RNA, 64 nt, Homo Sapiens; identical to SEQ ID NO: 245413

SEQ ID NO: 383150 - RNA, 64 nt, Homo Sapiens; identical to SEQ ID NO: 245414

SEQ ID NO: 383151 - RNA, 64 nt, Homo Sapiens; identical to SEQ ID NO: 245415

SEQ ID NO: 383152 - RNA, 64 nt, Homo Sapiens; identical to SEQ ID NO: 245416

SEQ ID NO: 383153 - RNA, 64 nt, Homo Sapiens; identical to SEQ ID NO: 245417

SEQ ID NO: 383154 - RNA, 64 nt, Homo Sapiens; identical to SEQ ID NO: 245418

SEQ ID NO: 383155 - RNA, 64 nt, Homo Sapiens; identical to SEQ ID NO: 245419

SEQ ID NO: 383156 - RNA, 64 nt, Homo Sapiens; identical to SEQ ID NO: 245420

SEQ ID NO: 383157 - RNA, 64 nt, Homo Sapiens; identical to SEQ ID NO: 245421

SEQ ID NO: 383158 - RNA, 64 nt, Homo Sapiens; identical to SEQ ID NO: 245422

SEQ ID NO: 383159 - RNA, 64 nt, Homo Sapiens; identical to SEQ ID NO: 245423

SEQ ID NO: 383160 - RNA, 64 nt, Homo Sapiens; identical to SEQ ID NO: 245424

SEQ ID NO: 383161 - RNA, 50 nt, Homo Sapiens; identical to SEQ ID NO: 245425

SEQ ID NO: 383162 - RNA, 64 nt, Homo Sapiens; identical to SEQ ID NO: 245426

SEQ ID NO: 383163 - RNA, 64 nt, Homo Sapiens; identical to SEQ ID NO: 245427

SEQ ID NO: 383164 - RNA, 64 nt, Homo Sapiens; identical to SEQ ID NO: 245428

SEQ ID NO: 383165 - RNA, 64 nt, Homo Sapiens; identical to SEQ ID NO: 245429

SEQ ID NO: 383166 - RNA, 64 nt, Homo Sapiens; identical to SEQ ID NO: 245430

SEQ ID NO: 383167 - RNA, 64 nt, Homo Sapiens; identical to SEQ ID NO: 245431

SEQ ID NO: 383168 - RNA, 64 nt, Homo Sapiens; identical to SEQ ID NO: 245432

SEQ ID NO: 383169 - RNA, 64 nt, Homo Sapiens; identical to SEQ ID NO: 245433

SEQ ID NO: 383170 - RNA, 64 nt, Homo Sapiens; identical to SEQ ID NO: 245434

SEQ ID NO: 383171 - RNA, 64 nt, Homo Sapiens; identical to SEQ ID NO: 245435

SEQ ID NO: 383172 - RNA, 64 nt, Homo Sapiens; identical to SEQ ID NO: 245436

SEQ ID NO: 383173 - RNA, 64 nt, Homo Sapiens; identical to SEQ ID NO: 245437

SEQ ID NO: 383174 - RNA, 64 nt, Homo Sapiens; identical to SEQ ID NO: 245438

SEQ ID NO: 383175 - RNA, 64 nt, Homo Sapiens; identical to SEQ ID NO: 245439

SEQ ID NO: 383176 - RNA, 64 nt, Homo Sapiens; identical to SEQ ID NO: 245440

SEQ ID NO: 383177 - RNA, 53 nt, Homo Sapiens; identical to SEQ ID NO: 245441

SEQ ID NO: 383178 - RNA, 64 nt, Homo Sapiens; identical to SEQ ID NO: 245442

SEQ ID NO: 383179 - RNA, 64 nt, Homo Sapiens; identical to SEQ ID NO: 245443

SEQ ID NO: 383180 - RNA, 64 nt, Homo Sapiens; identical to SEQ ID NO: 245444

SEQ ID NO: 383181 - RNA, 64 nt, Homo Sapiens; identical to SEQ ID NO: 245445

SEQ ID NO: 383182 - RNA, 64 nt, Homo Sapiens; identical to SEQ ID NO: 245446

SEQ ID NO: 383183 - RNA, 64 nt, Homo Sapiens; identical to SEQ ID NO: 245447

SEQ ID NO: 383184 - RNA, 64 nt, Homo Sapiens; identical to SEQ ID NO: 245448

SEQ ID NO: 383185 - RNA, 64 nt, Homo Sapiens; identical to SEQ ID NO: 245449

SEQ ID NO: 383186 - RNA, 64 nt, Homo Sapiens; identical to SEQ ID NO: 245450

SEQ ID NO: 383187 - RNA, 64 nt, Homo Sapiens; identical to SEQ ID NO: 245451

SEQ ID NO: 383188 - RNA, 64 nt, Homo Sapiens; identical to SEQ ID NO: 245452

SEQ ID NO: 383189 - RNA, 64 nt, Homo Sapiens; identical to SEQ ID NO: 245453

SEQ ID NO: 383190 - RNA, 64 nt, Homo Sapiens; identical to SEQ ID NO: 245454

SEQ ID NO: 383191 - RNA, 64 nt, Homo Sapiens; identical to SEQ ID NO: 245455

SEQ ID NO: 383192 - RNA, 64 nt, Homo Sapiens; identical to SEQ ID NO: 245456

SEQ ID NO: 383193 - RNA, 64 nt, Homo Sapiens; identical to SEQ ID NO: 245457

SEQ ID NO: 383194 - RNA, 64 nt, Homo Sapiens; identical to SEQ ID NO: 245458

SEQ ID NO: 383195 - RNA, 64 nt, Homo Sapiens; identical to SEQ ID NO: 245459

SEQ ID NO: 383196 - RNA, 64 nt, Homo Sapiens; identical to SEQ ID NO: 245460

SEQ ID NO: 383197 - RNA, 64 nt, Homo Sapiens; identical to SEQ ID NO: 245461

SEQ ID NO: 383198 - RNA, 64 nt, Homo Sapiens; identical to SEQ ID NO: 245462

SEQ ID NO: 383199 - RNA, 64 nt, Homo Sapiens; identical to SEQ ID NO: 245463

SEQ ID NO: 383200 - RNA, 64 nt, Homo Sapiens; identical to SEQ ID NO: 245464

SEQ ID NO: 383201 - RNA, 64 nt, Homo Sapiens; identical to SEQ ID NO: 245465

SEQ ID NO: 383202 - RNA, 64 nt, Homo Sapiens; identical to SEQ ID NO: 245466

SEQ ID NO: 383203 - RNA, 64 nt, Homo Sapiens; identical to SEQ ID NO: 245467

SEQ ID NO: 383204 - RNA, 64 nt, Homo Sapiens; identical to SEQ ID NO: 245468

SEQ ID NO: 383205 - RNA, 64 nt, Homo Sapiens; identical to SEQ ID NO: 245469

SEQ ID NO: 383206 - RNA, 64 nt, Homo Sapiens; identical to SEQ ID NO: 245470

SEQ ID NO: 383207 - RNA, 64 nt, Homo Sapiens; identical to SEQ ID NO: 245471

SEQ ID NO: 383208 - RNA, 64 nt, Homo Sapiens; identical to SEQ ID NO: 245472

SEQ ID NO: 383209 - RNA, 64 nt, Homo Sapiens; identical to SEQ ID NO: 245473

SEQ ID NO: 383210 - RNA, 64 nt, Homo Sapiens; identical to SEQ ID NO: 245474

SEQ ID NO: 383211 - RNA, 64 nt, Homo Sapiens; identical to SEQ ID NO: 245475

SEQ ID NO: 383212 - RNA, 64 nt, Homo Sapiens; identical to SEQ ID NO: 245476

SEQ ID NO: 383213 - RNA, 64 nt, Homo Sapiens; identical to SEQ ID NO: 245477

SEQ ID NO: 383214 - RNA, 64 nt, Homo Sapiens; identical to SEQ ID NO: 245478

SEQ ID NO: 383215 - RNA, 64 nt, Homo Sapiens; identical to SEQ ID NO: 245479

SEQ ID NO: 383216 - RNA, 64 nt, Homo Sapiens; identical to SEQ ID NO: 245480

SEQ ID NO: 383217 - RNA, 64 nt, Homo Sapiens; identical to SEQ ID NO: 245481

SEQ ID NO: 383218 - RNA, 64 nt, Homo Sapiens; identical to SEQ ID NO: 245482

SEQ ID NO: 383219 - RNA, 64 nt, Homo Sapiens; identical to SEQ ID NO: 245483

SEQ ID NO: 383220 - RNA, 64 nt, Homo Sapiens; identical to SEQ ID NO: 245484

SEQ ID NO: 383221 - RNA, 64 nt, Homo Sapiens; identical to SEQ ID NO: 245485

SEQ ID NO: 383222 - RNA, 64 nt, Homo Sapiens; identical to SEQ ID NO: 245486

SEQ ID NO: 383223 - RNA, 64 nt, Homo Sapiens; identical to SEQ ID NO: 245487

SEQ ID NO: 383224 - RNA, 64 nt, Homo Sapiens; identical to SEQ ID NO: 245488

SEQ ID NO: 383225 - RNA, 64 nt, Homo Sapiens; identical to SEQ ID NO: 245489

SEQ ID NO: 383226 - RNA, 64 nt, Homo Sapiens; identical to SEQ ID NO: 245490

SEQ ID NO: 383227 - RNA, 64 nt, Homo Sapiens; identical to SEQ ID NO: 245491

SEQ ID NO: 383228 - RNA, 64 nt, Homo Sapiens; identical to SEQ ID NO: 245492

SEQ ID NO: 383229 - RNA, 64 nt, Homo Sapiens; identical to SEQ ID NO: 245493

SEQ ID NO: 383230 - RNA, 64 nt, Homo Sapiens; identical to SEQ ID NO: 245494

SEQ ID NO: 383231 - RNA, 64 nt, Homo Sapiens; identical to SEQ ID NO: 245495

SEQ ID NO: 383232 - RNA, 64 nt, Homo Sapiens; identical to SEQ ID NO: 245496

SEQ ID NO: 383233 - RNA, 64 nt, Homo Sapiens; identical to SEQ ID NO: 245497

SEQ ID NO: 383234 - RNA, 64 nt, Homo Sapiens; identical to SEQ ID NO: 245498

SEQ ID NO: 383235 - RNA, 64 nt, Homo Sapiens; identical to SEQ ID NO: 245499

SEQ ID NO: 383236 - RNA, 64 nt, Homo Sapiens; identical to SEQ ID NO: 245500

SEQ ID NO: 383237 - RNA, 64 nt, Homo Sapiens; identical to SEQ ID NO: 245501

SEQ ID NO: 383238 - RNA, 64 nt, Homo Sapiens; identical to SEQ ID NO: 245502

SEQ ID NO: 383239 - RNA, 64 nt, Homo Sapiens; identical to SEQ ID NO: 245503

SEQ ID NO: 383240 - RNA, 64 nt, Homo Sapiens; identical to SEQ ID NO: 245504

SEQ ID NO: 383241 - RNA, 64 nt, Homo Sapiens; identical to SEQ ID NO: 245505

SEQ ID NO: 383242 - RNA, 64 nt, Homo Sapiens; identical to SEQ ID NO: 245506

SEQ ID NO: 383243 - RNA, 64 nt, Homo Sapiens; identical to SEQ ID NO: 245507

SEQ ID NO: 383244 - RNA, 64 nt, Homo Sapiens; identical to SEQ ID NO: 245508

SEQ ID NO: 383245 - RNA, 64 nt, Homo Sapiens; identical to SEQ ID NO: 245509

SEQ ID NO: 383246 - RNA, 64 nt, Homo Sapiens; identical to SEQ ID NO: 245510

SEQ ID NO: 383247 - RNA, 64 nt, Homo Sapiens; identical to SEQ ID NO: 245511

SEQ ID NO: 383248 - RNA, 64 nt, Homo Sapiens; identical to SEQ ID NO: 245512

SEQ ID NO: 383249 - RNA, 64 nt, Homo Sapiens; identical to SEQ ID NO: 245513

SEQ ID NO: 383250 - RNA, 64 nt, Homo Sapiens; identical to SEQ ID NO: 245514

SEQ ID NO: 383251 - RNA, 64 nt, Homo Sapiens; identical to SEQ ID NO: 245515

SEQ ID NO: 383252 - RNA, 64 nt, Homo Sapiens; identical to SEQ ID NO: 245516

SEQ ID NO: 383253 - RNA, 64 nt, Homo Sapiens; identical to SEQ ID NO: 245517

SEQ ID NO: 383254 - RNA, 64 nt, Homo Sapiens; identical to SEQ ID NO: 245518

SEQ ID NO: 383255 - RNA, 64 nt, Homo Sapiens; identical to SEQ ID NO: 245519

SEQ ID NO: 383256 - RNA, 64 nt, Homo Sapiens; identical to SEQ ID NO: 245520

SEQ ID NO: 383257 - RNA, 64 nt, Homo Sapiens; identical to SEQ ID NO: 245521

SEQ ID NO: 383258 - RNA, 64 nt, Homo Sapiens; identical to SEQ ID NO: 245522

SEQ ID NO: 383259 - RNA, 64 nt, Homo Sapiens; identical to SEQ ID NO: 245523

SEQ ID NO: 383260 - RNA, 64 nt, Homo Sapiens; identical to SEQ ID NO: 245524

SEQ ID NO: 383261 - RNA, 64 nt, Homo Sapiens; identical to SEQ ID NO: 245525

SEQ ID NO: 383262 - RNA, 64 nt, Homo Sapiens; identical to SEQ ID NO: 245526

SEQ ID NO: 383263 - RNA, 64 nt, Homo Sapiens; identical to SEQ ID NO: 245527

SEQ ID NO: 383264 - RNA, 64 nt, Homo Sapiens; identical to SEQ ID NO: 245528

SEQ ID NO: 383265 - RNA, 64 nt, Homo Sapiens; identical to SEQ ID NO: 245529

SEQ ID NO: 383266 - RNA, 64 nt, Homo Sapiens; identical to SEQ ID NO: 245530

SEQ ID NO: 383267 - RNA, 64 nt, Homo Sapiens; identical to SEQ ID NO: 245531

SEQ ID NO: 383268 - RNA, 64 nt, Homo Sapiens; identical to SEQ ID NO: 245532

SEQ ID NO: 383269 - RNA, 64 nt, Homo Sapiens; identical to SEQ ID NO: 245533

SEQ ID NO: 383270 - RNA, 64 nt, Homo Sapiens; identical to SEQ ID NO: 245534

SEQ ID NO: 383271 - RNA, 64 nt, Homo Sapiens; identical to SEQ ID NO: 245535

SEQ ID NO: 383272 - RNA, 64 nt, Homo Sapiens; identical to SEQ ID NO: 245536

SEQ ID NO: 383273 - RNA, 64 nt, Homo Sapiens; identical to SEQ ID NO: 245537

SEQ ID NO: 383274 - RNA, 64 nt, Homo Sapiens; identical to SEQ ID NO: 245538

SEQ ID NO: 383275 - RNA, 64 nt, Homo Sapiens; identical to SEQ ID NO: 245539

SEQ ID NO: 383276 - RNA, 64 nt, Homo Sapiens; identical to SEQ ID NO: 245540

SEQ ID NO: 383277 - RNA, 64 nt, Homo Sapiens; identical to SEQ ID NO: 245541

SEQ ID NO: 383278 - RNA, 64 nt, Homo Sapiens; identical to SEQ ID NO: 245542

SEQ ID NO: 383279 - RNA, 64 nt, Homo Sapiens; identical to SEQ ID NO: 245543

SEQ ID NO: 383280 - RNA, 64 nt, Homo Sapiens; identical to SEQ ID NO: 245544

SEQ ID NO: 383281 - RNA, 64 nt, Homo Sapiens; identical to SEQ ID NO: 245545

SEQ ID NO: 383282 - RNA, 64 nt, Homo Sapiens; identical to SEQ ID NO: 245546

SEQ ID NO: 383283 - RNA, 64 nt, Homo Sapiens; identical to SEQ ID NO: 245547

SEQ ID NO: 383284 - RNA, 64 nt, Homo Sapiens; identical to SEQ ID NO: 245548

SEQ ID NO: 383285 - RNA, 64 nt, Homo Sapiens; identical to SEQ ID NO: 245549

SEQ ID NO: 383286 - RNA, 64 nt, Homo Sapiens; identical to SEQ ID NO: 245550

SEQ ID NO: 383287 - RNA, 64 nt, Homo Sapiens; identical to SEQ ID NO: 245551

SEQ ID NO: 383288 - RNA, 64 nt, Homo Sapiens; identical to SEQ ID NO: 245552

SEQ ID NO: 383289 - RNA, 64 nt, Homo Sapiens; identical to SEQ ID NO: 245553

SEQ ID NO: 383290 - RNA, 64 nt, Homo Sapiens; identical to SEQ ID NO: 245554

SEQ ID NO: 383291 - RNA, 64 nt, Homo Sapiens; identical to SEQ ID NO: 245555

SEQ ID NO: 383292 - RNA, 64 nt, Homo Sapiens; identical to SEQ ID NO: 245556

SEQ ID NO: 383293 - RNA, 64 nt, Homo Sapiens; identical to SEQ ID NO: 245557

SEQ ID NO: 383294 - RNA, 64 nt, Homo Sapiens; identical to SEQ ID NO: 245558

SEQ ID NO: 383295 - RNA, 64 nt, Homo Sapiens; identical to SEQ ID NO: 245559

SEQ ID NO: 383296 - RNA, 64 nt, Homo Sapiens; identical to SEQ ID NO: 245560

SEQ ID NO: 383297 - RNA, 64 nt, Homo Sapiens; identical to SEQ ID NO: 245561

SEQ ID NO: 383298 - RNA, 64 nt, Homo Sapiens; identical to SEQ ID NO: 245562

SEQ ID NO: 383299 - RNA, 64 nt, Homo Sapiens; identical to SEQ ID NO: 245563

SEQ ID NO: 383300 - RNA, 64 nt, Homo Sapiens; identical to SEQ ID NO: 245564

SEQ ID NO: 383301 - RNA, 64 nt, Homo Sapiens; identical to SEQ ID NO: 245565

SEQ ID NO: 383302 - RNA, 64 nt, Homo Sapiens; identical to SEQ ID NO: 245566

SEQ ID NO: 383303 - RNA, 64 nt, Homo Sapiens; identical to SEQ ID NO: 245567

SEQ ID NO: 383304 - RNA, 64 nt, Homo Sapiens; identical to SEQ ID NO: 245568

SEQ ID NO: 383305 - RNA, 64 nt, Homo Sapiens; identical to SEQ ID NO: 245569

SEQ ID NO: 383306 - RNA, 64 nt, Homo Sapiens; identical to SEQ ID NO: 245570

SEQ ID NO: 383307 - RNA, 64 nt, Homo Sapiens; identical to SEQ ID NO: 245571

SEQ ID NO: 383308 - RNA, 64 nt, Homo Sapiens; identical to SEQ ID NO: 245572

SEQ ID NO: 383309 - RNA, 64 nt, Homo Sapiens; identical to SEQ ID NO: 245573

SEQ ID NO: 383310 - RNA, 64 nt, Homo Sapiens; identical to SEQ ID NO: 245574

SEQ ID NO: 383311 - RNA, 64 nt, Homo Sapiens; identical to SEQ ID NO: 245575

SEQ ID NO: 383312 - RNA, 64 nt, Homo Sapiens; identical to SEQ ID NO: 245576

SEQ ID NO: 383313 - RNA, 64 nt, Homo Sapiens; identical to SEQ ID NO: 245577

SEQ ID NO: 383314 - RNA, 64 nt, Homo Sapiens; identical to SEQ ID NO: 245578

SEQ ID NO: 383315 - RNA, 50 nt, Homo Sapiens; identical to SEQ ID NO: 245579

SEQ ID NO: 383316 - RNA, 64 nt, Homo Sapiens; identical to SEQ ID NO: 245580

SEQ ID NO: 383317 - RNA, 64 nt, Homo Sapiens; identical to SEQ ID NO: 245581

SEQ ID NO: 383318 - RNA, 64 nt, Homo Sapiens; identical to SEQ ID NO: 245582

SEQ ID NO: 383319 - RNA, 64 nt, Homo Sapiens; identical to SEQ ID NO: 245583

SEQ ID NO: 383320 - RNA, 64 nt, Homo Sapiens; identical to SEQ ID NO: 245584

SEQ ID NO: 383321 - RNA, 64 nt, Homo Sapiens; identical to SEQ ID NO: 245585

SEQ ID NO: 383322 - RNA, 64 nt, Homo Sapiens; identical to SEQ ID NO: 245586

SEQ ID NO: 383323 - RNA, 64 nt, Homo Sapiens; identical to SEQ ID NO: 245587

SEQ ID NO: 383324 - RNA, 64 nt, Homo Sapiens; identical to SEQ ID NO: 245588

SEQ ID NO: 383325 - RNA, 64 nt, Homo Sapiens; identical to SEQ ID NO: 245589

SEQ ID NO: 383326 - RNA, 64 nt, Homo Sapiens; identical to SEQ ID NO: 245590

SEQ ID NO: 383327 - RNA, 64 nt, Homo Sapiens; identical to SEQ ID NO: 245591

SEQ ID NO: 383328 - RNA, 64 nt, Homo Sapiens; identical to SEQ ID NO: 245592

SEQ ID NO: 383329 - RNA, 64 nt, Homo Sapiens; identical to SEQ ID NO: 245593

SEQ ID NO: 383330 - RNA, 64 nt, Homo Sapiens; identical to SEQ ID NO: 245594

SEQ ID NO: 383331 - RNA, 64 nt, Homo Sapiens; identical to SEQ ID NO: 245595

SEQ ID NO: 383332 - RNA, 64 nt, Homo Sapiens; identical to SEQ ID NO: 245596

SEQ ID NO: 383333 - RNA, 64 nt, Homo Sapiens; identical to SEQ ID NO: 245597

SEQ ID NO: 383334 - RNA, 64 nt, Homo Sapiens; identical to SEQ ID NO: 245598

SEQ ID NO: 383335 - RNA, 64 nt, Homo Sapiens; identical to SEQ ID NO: 245599

SEQ ID NO: 383336 - RNA, 64 nt, Homo Sapiens; identical to SEQ ID NO: 245600

SEQ ID NO: 383337 - RNA, 64 nt, Homo Sapiens; identical to SEQ ID NO: 245601

SEQ ID NO: 383338 - RNA, 64 nt, Homo Sapiens; identical to SEQ ID NO: 245602

SEQ ID NO: 383339 - RNA, 64 nt, Homo Sapiens; identical to SEQ ID NO: 245603

SEQ ID NO: 383340 - RNA, 64 nt, Homo Sapiens; identical to SEQ ID NO: 245604

SEQ ID NO: 383341 - RNA, 64 nt, Homo Sapiens; identical to SEQ ID NO: 245605

SEQ ID NO: 383342 - RNA, 64 nt, Homo Sapiens; identical to SEQ ID NO: 245606

SEQ ID NO: 383343 - RNA, 64 nt, Homo Sapiens; identical to SEQ ID NO: 245607

SEQ ID NO: 383344 - RNA, 64 nt, Homo Sapiens; identical to SEQ ID NO: 245608

SEQ ID NO: 383345 - RNA, 64 nt, Homo Sapiens; identical to SEQ ID NO: 245609

SEQ ID NO: 383346 - RNA, 64 nt, Homo Sapiens; identical to SEQ ID NO: 245610

SEQ ID NO: 383347 - RNA, 64 nt, Homo Sapiens; identical to SEQ ID NO: 245611

SEQ ID NO: 383348 - RNA, 64 nt, Homo Sapiens; identical to SEQ ID NO: 245612

SEQ ID NO: 383349 - RNA, 64 nt, Homo Sapiens; identical to SEQ ID NO: 245613

SEQ ID NO: 383350 - RNA, 64 nt, Homo Sapiens; identical to SEQ ID NO: 245614

SEQ ID NO: 383351 - RNA, 64 nt, Homo Sapiens; identical to SEQ ID NO: 245615

SEQ ID NO: 383352 - RNA, 64 nt, Homo Sapiens; identical to SEQ ID NO: 245616

SEQ ID NO: 383353 - RNA, 64 nt, Homo Sapiens; identical to SEQ ID NO: 245617

SEQ ID NO: 383354 - RNA, 64 nt, Homo Sapiens; identical to SEQ ID NO: 245618

SEQ ID NO: 383355 - RNA, 64 nt, Homo Sapiens; identical to SEQ ID NO: 245619

SEQ ID NO: 383356 - RNA, 64 nt, Homo Sapiens; identical to SEQ ID NO: 245620

SEQ ID NO: 383357 - RNA, 64 nt, Homo Sapiens; identical to SEQ ID NO: 245621

SEQ ID NO: 383358 - RNA, 64 nt, Homo Sapiens; identical to SEQ ID NO: 245622

SEQ ID NO: 383359 - RNA, 64 nt, Homo Sapiens; identical to SEQ ID NO: 245623

SEQ ID NO: 383360 - RNA, 64 nt, Homo Sapiens; identical to SEQ ID NO: 245624

SEQ ID NO: 383361 - RNA, 64 nt, Homo Sapiens; identical to SEQ ID NO: 245625

SEQ ID NO: 383362 - RNA, 64 nt, Homo Sapiens; identical to SEQ ID NO: 245626

SEQ ID NO: 383363 - RNA, 64 nt, Homo Sapiens; identical to SEQ ID NO: 245627

SEQ ID NO: 383364 - RNA, 64 nt, Homo Sapiens; identical to SEQ ID NO: 245628

SEQ ID NO: 383365 - RNA, 64 nt, Homo Sapiens; identical to SEQ ID NO: 245629

SEQ ID NO: 383366 - RNA, 64 nt, Homo Sapiens; identical to SEQ ID NO: 245630

SEQ ID NO: 383367 - RNA, 64 nt, Homo Sapiens; identical to SEQ ID NO: 245631

SEQ ID NO: 383368 - RNA, 64 nt, Homo Sapiens; identical to SEQ ID NO: 245632

SEQ ID NO: 383369 - RNA, 64 nt, Homo Sapiens; identical to SEQ ID NO: 245633

SEQ ID NO: 383370 - RNA, 64 nt, Homo Sapiens; identical to SEQ ID NO: 245634

SEQ ID NO: 383371 - RNA, 64 nt, Homo Sapiens; identical to SEQ ID NO: 245635

SEQ ID NO: 383372 - RNA, 64 nt, Homo Sapiens; identical to SEQ ID NO: 245636

SEQ ID NO: 383373 - RNA, 64 nt, Homo Sapiens; identical to SEQ ID NO: 245637

SEQ ID NO: 383374 - RNA, 64 nt, Homo Sapiens; identical to SEQ ID NO: 235301

SEQ ID NO: 383375 - RNA, 64 nt, Homo Sapiens; identical to SEQ ID NO: 235302

SEQ ID NO: 383376 - RNA, 64 nt, Homo Sapiens; identical to SEQ ID NO: 235303

SEQ ID NO: 383377 - RNA, 64 nt, Homo Sapiens; identical to SEQ ID NO: 235304

SEQ ID NO: 383378 - RNA, 64 nt, Homo Sapiens; identical to SEQ ID NO: 235305

SEQ ID NO: 383379 - RNA, 64 nt, Homo Sapiens; identical to SEQ ID NO: 235306

SEQ ID NO: 383380 - RNA, 64 nt, Homo Sapiens; identical to SEQ ID NO: 235307

SEQ ID NO: 383381 - RNA, 64 nt, Homo Sapiens; identical to SEQ ID NO: 235308

SEQ ID NO: 383382 - RNA, 64 nt, Homo Sapiens; identical to SEQ ID NO: 235309

SEQ ID NO: 383383 - RNA, 64 nt, Homo Sapiens; identical to SEQ ID NO: 235310

SEQ ID NO: 383384 - RNA, 64 nt, Homo Sapiens; identical to SEQ ID NO: 235311

SEQ ID NO: 383385 - RNA, 64 nt, Homo Sapiens; identical to SEQ ID NO: 235312

SEQ ID NO: 383386 - RNA, 64 nt, Homo Sapiens; identical to SEQ ID NO: 235313

SEQ ID NO: 383387 - RNA, 64 nt, Homo Sapiens; identical to SEQ ID NO: 235314

SEQ ID NO: 383388 - RNA, 64 nt, Homo Sapiens; identical to SEQ ID NO: 235315

SEQ ID NO: 383389 - RNA, 64 nt, Homo Sapiens; identical to SEQ ID NO: 235316

SEQ ID NO: 383390 - RNA, 64 nt, Homo Sapiens; identical to SEQ ID NO: 235317

SEQ ID NO: 383391 - RNA, 64 nt, Homo Sapiens; identical to SEQ ID NO: 235318

SEQ ID NO: 383392 - RNA, 64 nt, Homo Sapiens; identical to SEQ ID NO: 235319

SEQ ID NO: 383393 - RNA, 64 nt, Homo Sapiens; identical to SEQ ID NO: 235320

SEQ ID NO: 383394 - RNA, 64 nt, Homo Sapiens; identical to SEQ ID NO: 235321

SEQ ID NO: 383395 - RNA, 64 nt, Homo Sapiens; identical to SEQ ID NO: 235322

SEQ ID NO: 383396 - RNA, 64 nt, Homo Sapiens; identical to SEQ ID NO: 235323

SEQ ID NO: 383397 - RNA, 64 nt, Homo Sapiens; identical to SEQ ID NO: 235324

SEQ ID NO: 383398 - RNA, 64 nt, Homo Sapiens; identical to SEQ ID NO: 235325

SEQ ID NO: 383399 - RNA, 64 nt, Homo Sapiens; identical to SEQ ID NO: 235326

SEQ ID NO: 383400 - RNA, 64 nt, Homo Sapiens; identical to SEQ ID NO: 235327

SEQ ID NO: 383401 - RNA, 64 nt, Homo Sapiens; identical to SEQ ID NO: 235328

SEQ ID NO: 383402 - RNA, 64 nt, Homo Sapiens; identical to SEQ ID NO: 235329

SEQ ID NO: 383403 - RNA, 64 nt, Homo Sapiens; identical to SEQ ID NO: 235330

SEQ ID NO: 383404 - RNA, 64 nt, Homo Sapiens; identical to SEQ ID NO: 235331

SEQ ID NO: 383405 - RNA, 64 nt, Homo Sapiens; identical to SEQ ID NO: 235332

SEQ ID NO: 383406 - RNA, 64 nt, Homo Sapiens; identical to SEQ ID NO: 235333

SEQ ID NO: 383407 - RNA, 64 nt, Homo Sapiens; identical to SEQ ID NO: 235334

SEQ ID NO: 383408 - RNA, 64 nt, Homo Sapiens; identical to SEQ ID NO: 235335

SEQ ID NO: 383409 - RNA, 64 nt, Homo Sapiens; identical to SEQ ID NO: 235336

SEQ ID NO: 383410 - RNA, 64 nt, Homo Sapiens; identical to SEQ ID NO: 235337

SEQ ID NO: 383411 - RNA, 64 nt, Homo Sapiens; identical to SEQ ID NO: 235338

SEQ ID NO: 383412 - RNA, 64 nt, Homo Sapiens; identical to SEQ ID NO: 235339

SEQ ID NO: 383413 - RNA, 64 nt, Homo Sapiens; identical to SEQ ID NO: 235340

SEQ ID NO: 383414 - RNA, 64 nt, Homo Sapiens; identical to SEQ ID NO: 235341

SEQ ID NO: 383415 - RNA, 64 nt, Homo Sapiens; identical to SEQ ID NO: 235342

SEQ ID NO: 383416 - RNA, 64 nt, Homo Sapiens; identical to SEQ ID NO: 235343

SEQ ID NO: 383417 - RNA, 64 nt, Homo Sapiens; identical to SEQ ID NO: 235344

SEQ ID NO: 383418 - RNA, 64 nt, Homo Sapiens; identical to SEQ ID NO: 235345

SEQ ID NO: 383419 - RNA, 64 nt, Homo Sapiens; identical to SEQ ID NO: 235346

SEQ ID NO: 383420 - RNA, 64 nt, Homo Sapiens; identical to SEQ ID NO: 235347

SEQ ID NO: 383421 - RNA, 64 nt, Homo Sapiens; identical to SEQ ID NO: 235348

SEQ ID NO: 383422 - RNA, 64 nt, Homo Sapiens; identical to SEQ ID NO: 235349

SEQ ID NO: 383423 - RNA, 64 nt, Homo Sapiens; identical to SEQ ID NO: 235350

SEQ ID NO: 383424 - RNA, 64 nt, Homo Sapiens; identical to SEQ ID NO: 235351

SEQ ID NO: 383425 - RNA, 64 nt, Homo Sapiens; identical to SEQ ID NO: 235352

SEQ ID NO: 383426 - RNA, 64 nt, Homo Sapiens; identical to SEQ ID NO: 235353

SEQ ID NO: 383427 - RNA, 64 nt, Homo Sapiens; identical to SEQ ID NO: 237917

SEQ ID NO: 383428 - RNA, 64 nt, Homo Sapiens; identical to SEQ ID NO: 237918

SEQ ID NO: 383429 - RNA, 64 nt, Homo Sapiens; identical to SEQ ID NO: 237919

SEQ ID NO: 383430 - RNA, 64 nt, Homo Sapiens; identical to SEQ ID NO: 237920

SEQ ID NO: 383431 - RNA, 64 nt, Homo Sapiens; identical to SEQ ID NO: 237921

SEQ ID NO: 383432 - RNA, 64 nt, Homo Sapiens; identical to SEQ ID NO: 237922

SEQ ID NO: 383433 - RNA, 64 nt, Homo Sapiens; identical to SEQ ID NO: 237923

SEQ ID NO: 383434 - RNA, 64 nt, Homo Sapiens; identical to SEQ ID NO: 237924

SEQ ID NO: 383435 - RNA, 64 nt, Homo Sapiens; identical to SEQ ID NO: 237925

SEQ ID NO: 383436 - RNA, 64 nt, Homo Sapiens; identical to SEQ ID NO: 237926

SEQ ID NO: 383437 - RNA, 64 nt, Homo Sapiens; identical to SEQ ID NO: 237927

SEQ ID NO: 383438 - RNA, 64 nt, Homo Sapiens; identical to SEQ ID NO: 237928

SEQ ID NO: 383439 - RNA, 64 nt, Homo Sapiens; identical to SEQ ID NO: 237927

SEQ ID NO: 383440 - RNA, 64 nt, Homo Sapiens; identical to SEQ ID NO: 237930

SEQ ID NO: 383441 - RNA, 64 nt, Homo Sapiens; identical to SEQ ID NO: 237931

SEQ ID NO: 383442 - RNA, 64 nt, Homo Sapiens; identical to SEQ ID NO: 237932

SEQ ID NO: 383443 - RNA, 64 nt, Homo Sapiens; identical to SEQ ID NO: 237933

SEQ ID NO: 383444 - RNA, 64 nt, Homo Sapiens; identical to SEQ ID NO: 237934

SEQ ID NO: 383445 - RNA, 64 nt, Homo Sapiens; identical to SEQ ID NO: 237935

SEQ ID NO: 383446 - RNA, 64 nt, Homo Sapiens; identical to SEQ ID NO: 237936

SEQ ID NO: 383447 - RNA, 64 nt, Homo Sapiens; identical to SEQ ID NO: 237937

SEQ ID NO: 383448 - RNA, 64 nt, Homo Sapiens; identical to SEQ ID NO: 237938

SEQ ID NO: 383449 - RNA, 64 nt, Homo Sapiens; identical to SEQ ID NO: 237939

SEQ ID NO: 383450 - RNA, 64 nt, Homo Sapiens; identical to SEQ ID NO: 237940

SEQ ID NO: 383451 - RNA, 64 nt, Homo Sapiens; identical to SEQ ID NO: 237941

SEQ ID NO: 383452 - RNA, 64 nt, Homo Sapiens; identical to SEQ ID NO: 237942

SEQ ID NO: 383453 - RNA, 64 nt, Homo Sapiens; identical to SEQ ID NO: 237943

SEQ ID NO: 383454 - RNA, 64 nt, Homo Sapiens; identical to SEQ ID NO: 237944

SEQ ID NO: 383455 - RNA, 64 nt, Homo Sapiens; identical to SEQ ID NO: 237945

SEQ ID NO: 383456 - RNA, 64 nt, Homo Sapiens; identical to SEQ ID NO: 237946

SEQ ID NO: 383457 - RNA, 64 nt, Homo Sapiens; identical to SEQ ID NO: 237947

SEQ ID NO: 383458 - RNA, 64 nt, Homo Sapiens; identical to SEQ ID NO: 237948

SEQ ID NO: 383459 - RNA, 64 nt, Homo Sapiens; identical to SEQ ID NO: 237949

SEQ ID NO: 383460 - RNA, 64 nt, Homo Sapiens; identical to SEQ ID NO: 237950

SEQ ID NO: 383461 - RNA, 64 nt, Homo Sapiens; identical to SEQ ID NO: 237951

SEQ ID NO: 383462 - RNA, 64 nt, Homo Sapiens; identical to SEQ ID NO: 237952

SEQ ID NO: 383463 - RNA, 64 nt, Homo Sapiens; identical to SEQ ID NO: 237953

SEQ ID NO: 383464 - RNA, 64 nt, Homo Sapiens; identical to SEQ ID NO: 237954

SEQ ID NO: 383465 - RNA, 64 nt, Homo Sapiens; identical to SEQ ID NO: 237955

SEQ ID NO: 383466 - RNA, 64 nt, Homo Sapiens; identical to SEQ ID NO: 237956

SEQ ID NO: 383467 - RNA, 64 nt, Homo Sapiens; identical to SEQ ID NO: 237957

SEQ ID NO: 383468 - RNA, 64 nt, Homo Sapiens; identical to SEQ ID NO: 237958

SEQ ID NO: 383469 - RNA, 64 nt, Homo Sapiens; identical to SEQ ID NO: 237959

SEQ ID NO: 383470 - RNA, 64 nt, Homo Sapiens; identical to SEQ ID NO: 237960

SEQ ID NO: 383471 - RNA, 64 nt, Homo Sapiens; identical to SEQ ID NO: 237961

SEQ ID NO: 383472 - RNA, 64 nt, Homo Sapiens; identical to SEQ ID NO: 237962

SEQ ID NO: 383473 - RNA, 64 nt, Homo Sapiens; identical to SEQ ID NO: 237963

SEQ ID NO: 383474 - RNA, 64 nt, Homo Sapiens; identical to SEQ ID NO: 237964

SEQ ID NO: 383475 - RNA, 64 nt, Homo Sapiens; identical to SEQ ID NO: 237965

SEQ ID NO: 383476 - RNA, 64 nt, Homo Sapiens; identical to SEQ ID NO: 237966

SEQ ID NO: 383477 - RNA, 64 nt, Homo Sapiens; identical to SEQ ID NO: 237967

SEQ ID NO: 383478 - RNA, 64 nt, Homo Sapiens
cuccacagacaauguccucuguucaauuccuaacgcaaacuacaauaaauggugacacacguuc

SEQ ID NO: 383479 - RNA, 64 nt, Homo Sapiens
aauccacucacauugcagaacaauuccgaaaauggcaaacuacuacuacuacuguucaguuuuu

SEQ ID NO: 383480 - RNA, 64 nt, Homo Sapiens
uaguccucaucauaaacuuuuuaaaggaaaauaagcaaacuaaaaagaacauugguuuagauaa

SEQ ID NO: 383481 - RNA, 64 nt, Homo Sapiens
uuaacuaugacuaagaaauuaaagaagaaaaccagcaaacuaaaacuucugggcagcaaaaaua

SEQ ID NO: 383482 - RNA, 64 nt, Homo Sapiens
cccuguucauuguuaccugguggagaaaaacuaggcaaacuacaugcuugauuugaaaacagug

SEQ ID NO: 383483 - RNA, 64 nt, Homo Sapiens
gcagccacuggugggaagcgugguaaaauaaaaggcaaacuaaagacuuuauuguuguuauuuu

SEQ ID NO: 383484 - RNA, 64 nt, Homo Sapiens
accaagugccagaguccuggauguggaaacaacagcaaacuaacaaaauagguaguguuugccu

SEQ ID NO: 383485 - RNA, 64 nt, Homo Sapiens
agugauaagggcccuacuacagaggggaaaccuagcaaacuaagcuaaaucugcucauuauuuc

SEQ ID NO: 383486 - RNA, 64 nt, Homo Sapiens
caugggaauagcuuaauguguugaaaugugugaggcaaacuaugagcaaaaagaaaaccucgaa

SEQ ID NO: 383487 - RNA, 64 nt, Homo Sapiens
uuagcacucagauuaucugauauaaauccaggaggcaaacuauuuuuuuucaauuaaaaauuac

SEQ ID NO: 383488 - RNA, 64 nt, Homo Sapiens
ggacuuagaggguuucugcccacugcagcagugugcaaacuauguuccaguccucugcacugua

SEQ ID NO: 383489 - RNA, 64 nt, Homo Sapiens
aguuguuuccuuuccagaagaucuuugaguucuugcaaacuacacucuguaguggauccaaagu

SEQ ID NO: 383490 - RNA, 64 nt, Homo Sapiens
uagccaacauuucugaacccgcugugaccuacaagcaaacuaaauuuucuuuuuuuuaagccau

SEQ ID NO: 383491 - RNA, 64 nt, Homo Sapiens
ugcauuuauauaggcaacucgauauaggaugggagcaaacuaggaaugaauuggguagcuagac

SEQ ID NO: 383492 - RNA, 64 nt, Homo Sapiens
aauauauaaaaaacaagaaaauaacaaauuaaccgcaaacuaucaacaacccccaaccaccauc

SEQ ID NO: 383493 - RNA, 64 nt, Homo Sapiens
aaauuaaugcuguguaaaaugguugaauuaguuugcaaacuauauaaagacauaugcaguaaaa

SEQ ID NO: 383494 - RNA, 64 nt, Homo Sapiens
gagaggagacuguugggaacaguuaugucaaugagcaaacuagaaauuggcuucaaagucuaau

SEQ ID NO: 383495 - RNA, 64 nt, Homo Sapiens
uaucugaucaaagcacauaagaauauaaauaauagcaaacuacuauuaaacaacagaacaacuu

SEQ ID NO: 383496 - RNA, 64 nt, Homo Sapiens
uccauucagaguauuugguggaguuugaauuugagcaaacuaaaugccuucaucuuagguagaa

SEQ ID NO: 383497 - RNA, 64 nt, Homo Sapiens
ugguauauuuaaccacgggagcgugucuggaaacgcaaacuaucauuaauuucauacuaguuug

SEQ ID NO: 383498 - RNA, 64 nt, Homo Sapiens
uugugaagcuauaguacauguaaagauuauaaaagcaaacuaaguugaacacggccaaaaucca

SEQ ID NO: 383499 - RNA, 64 nt, Homo Sapiens
guuguuugggucuaucuuccggaugugagaauuggcaaacuaaucauuuggccucucugcccgu

SEQ ID NO: 383500 - RNA, 64 nt, Homo Sapiens
guauucuagaccuaucuuagugugugugcacaaugcaaacuaaguuauauucaacacagccauu

SEQ ID NO: 383501 - RNA, 64 nt, Homo Sapiens
guugaaaagcaguuagcauucucaucuagaaaaugcaaacuauuaaauuauacaaggauagaau

SEQ ID NO: 383502 - RNA, 64 nt, Homo Sapiens
aagcauuuaaaagagaaucuucugaccccucuaagcaaacuacuuuaagcuucaagaaacuugc

SEQ ID NO: 383503 - RNA, 64 nt, Homo Sapiens
uuagcugggaaaauucauuugguuguuccuaauggcaaacuacucaagagacuugagaaauguc

SEQ ID NO: 383504 - RNA, 64 nt, Homo Sapiens
ggggucccuaauuuuggauuguaaccaacuuaaagcaaacuauaaaaauuuaagauuacuacca

SEQ ID NO: 383505 - RNA, 64 nt, Homo Sapiens
ugcaaagaguuugcauuugaaaaauuguaaaauagcaaacuaaagucuuuuauaccuaguuugu

SEQ ID NO: 383506 - RNA, 64 nt, Homo Sapiens
ggaagacuugguccguaacucaaggcuguuguaugcaaacuacucuucuagugguuaaugcacu

SEQ ID NO: 383507 - RNA, 64 nt, Homo Sapiens
ugcuccuggaauagggaauagggaucucaugcuugcaaacuacacaaugcugcaggugcuuccc

SEQ ID NO: 383508 - RNA, 64 nt, Homo Sapiens
uugaaccuguugugguaaagaucuuguacaggaugcaaacuaaaaaccuaaucccugccaucaa

SEQ ID NO: 383509 - RNA, 64 nt, Homo Sapiens
aaagguuguacaauuauacaaaaaaaaaaaaaaggcaaacuauaggauaacacagagcccuuuu

SEQ ID NO: 383510 - RNA, 64 nt, Homo Sapiens
caguaccccucuagcuuuguuuagucuuuauacugcaaacuauuuaaagaaauauguauucugu

SEQ ID NO: 383511 - RNA, 64 nt, Homo Sapiens
uaucgauacaugaauuuaacuuacuuuaauguaggcaaacuaucaauuuuuuguccauuuuccu

SEQ ID NO: 383512 - RNA, 64 nt, Homo Sapiens
gauaucaggaaguaguaagaaaaggaguuaauaugcaaacuaaaucacucgcucaauugaauaa

SEQ ID NO: 383513 - RNA, 64 nt, Homo Sapiens
ucaaaaacuuucuauuccuuucuuaaaccuaccagcaaacuaggauugugauagcaaugaaugg

SEQ ID NO: 383514 - RNA, 64 nt, Homo Sapiens
auguacuauccaaauuagaagcggauuuggaaaugcaaacuaacgugcacuuagauauccaagu

SEQ ID NO: 383515 - RNA, 64 nt, Homo Sapiens
cuugaaguaugaugcauauugcauuauuuuauuugcaaacuaggaauugcagucugaggaucau

SEQ ID NO: 383516 - RNA, 64 nt, Homo Sapiens
cuuauuuucuagauguuacaaaucaggucacuaugcaaacuagaauauccucagcagguggccu

SEQ ID NO: 383517 - RNA, 64 nt, Homo Sapiens
uauggaugagcauaaaccuagucuuaguuuaaaggcaaacuaaaguugaggggaaauaauuaau

SEQ ID NO: 383518 - RNA, 64 nt, Homo Sapiens
agccugggugacagagugagauucugucucaaaagcaaacuaacaaagaaaaacaauacuuccu

SEQ ID NO: 383519 - RNA, 64 nt, Homo Sapiens
aaugucauucacaacagaaaacccaaaauauuaugcaaacuacuguaagcaagaaaaauaaagg

SEQ ID NO: 383520 - RNA, 64 nt, Homo Sapiens
ugaaauaaaaaauuauggauacguguuuugaauugcaaacuauuccucaggaauuccaauuaaa

SEQ ID NO: 383521 - RNA, 64 nt, Homo Sapiens
aagagcaauguuuucagucucauuaaaaauucccgcaaacuauaguuggaguuucuguuuaggg

SEQ ID NO: 383522 - RNA, 64 nt, Homo Sapiens
cccaaugccaacuuugugcacagaauggaaaaaugcaaacuaaaaauccaaggagggccaucuu

SEQ ID NO: 383523 - RNA, 64 nt, Homo Sapiens
acccccaggccaaaucuagcuaaaccagggaucagcaaacuauacucaaauuauaucuauccuc

SEQ ID NO: 383524 - RNA, 64 nt, Homo Sapiens
cuuuauuagugcugcaacuaagcauggauaaagagcaaacuaagugcuaaacaaaaaauggggu

SEQ ID NO: 383525 - RNA, 64 nt, Homo Sapiens
aauguaaaagguaauaauuaaauuaugccugucugcaaacuaauauuucugcaacugaggaccu

SEQ ID NO: 383526 - RNA, 64 nt, Homo Sapiens
cucucagggaaauacaaauacccuugaacucaaagcaaacuacgacauauacacauacaccaug

SEQ ID NO: 383527 - RNA, 64 nt, Homo Sapiens
uuuauuucaggaggaaaauggguucacacaaaaagcaaacuacauucuggucugcucagggaga

SEQ ID NO: 383528 - RNA, 64 nt, Homo Sapiens
aaaguagaugagacuucuccaagcugcuucacaagcaaacuaaccgaaaaaccgaaaauauaca

SEQ ID NO: 383529 - RNA, 64 nt, Homo Sapiens
caucauauggacucuauguaacacaaauucaaaagcaaacuaaaagcuauaugcagaguuuugu

SEQ ID NO: 383530 - RNA, 64 nt, Homo Sapiens
uuaaaguguacuuauaaacuauuuuuuucuuaaagcaaacuaugauuuauuuuggugcacaaau

SEQ ID NO: 383531 - RNA, 64 nt, Homo Sapiens
uuuccaaaauauagaaagcaguaggucaguaggagcaaacuagccaacagguacugucuuugaa

SEQ ID NO: 383532 - RNA, 64 nt, Homo Sapiens
aggguuaugucuauguucauucuauagaagaaaugcaaacuaucacuguauuuuaauauuuguu

SEQ ID NO: 383533 - RNA, 64 nt, Homo Sapiens
acagccaacucaaaagcuaaauagagaccuuuaagcaaacuacuaugcaugcuuuguucugugc

SEQ ID NO: 383534 - RNA, 64 nt, Homo Sapiens
gucuuguuuuaagaaacugcuuuggaaaugaagggcaaacuaauuauaucuuauuuucaaggca

SEQ ID NO: 383535 - RNA, 64 nt, Homo Sapiens
ugaaaagauuaggggcuuccagcuuaaugauuaggcaaacuagaaguauuauaauugguuaagu

SEQ ID NO: 383536 - RNA, 64 nt, Homo Sapiens
ugaaauuugaauccggacauuacaugaagaucaugcaaacuacuugaaggugugucccagauau

SEQ ID NO: 383537 - RNA, 64 nt, Homo Sapiens
uugacuuuuaaggcuaaaacgagagaaagugugagcaaacuaacaagaaacuaauauuuuaugu

SEQ ID NO: 383538 - RNA, 64 nt, Homo Sapiens
acugcugaggacaguaguaaacaagcgagucccugcaaacuacccauaaagcuaaugcucuggc

SEQ ID NO: 383539 - RNA, 64 nt, Homo Sapiens
accagaucacccuuguuaaaaaucauucuuguuagcaaacuaaaauaguaacuuuuauuaugga

SEQ ID NO: 383540 - RNA, 64 nt, Homo Sapiens
ccugacuuuggcagacccccauuucaucuuuccugcaaacuacuuucccaucuuugugccugua

SEQ ID NO: 383541 - RNA, 64 nt, Homo Sapiens
uuaugcaagaccauauucucaauuauuuggauaugcaaacuaaaguauuaagagcuaaugucau

SEQ ID NO: 383542 - RNA, 64 nt, Homo Sapiens
cuccagaauuuuuaaagaacucuauaauuggauugcaaacuaggaugcuacauaggauucuggu

SEQ ID NO: 383543 - RNA, 64 nt, Homo Sapiens
guuugcuuaagguuugacccuagagcagaggugggcaaacuaugaccuggaaaccaaaucugac

SEQ ID NO: 383544 - RNA, 64 nt, Homo Sapiens
cauuuaacauaaugguugugaaauguaacaugaagcaaacuaacuuuuuuuuuuuuaacaucuu

SEQ ID NO: 383545 - RNA, 64 nt, Homo Sapiens
uaucaauguggcuuugcuguggguuugaaauuuugcaaacuaagaguuggguggcggggagaag

SEQ ID NO: 383546 - RNA, 64 nt, Homo Sapiens
acuagauaauaaggaaaugguuugggcucccguagcaaacuaauuaagugauucgguuaaagag

SEQ ID NO: 383547 - RNA, 64 nt, Homo Sapiens
cacggucguccaucaaaauccaaguucagcaggggcaaacuauagugguuaaguuucuuauuuu

SEQ ID NO: 383548 - RNA, 64 nt, Homo Sapiens
guggggauuuuaucuggacacuacuagauacacugcaaacuacagcuaagcaauaguuuauguc

SEQ ID NO: 383549 - RNA, 64 nt, Homo Sapiens
uacccuccuuuaucugugaagaauguaacugugggcaaacuauucaauuucugccacugaggau

SEQ ID NO: 383550 - RNA, 64 nt, Homo Sapiens
cuuccucauuccuugucuugauaaaguggaauuggcaaacuagaauuuaguuuguacucagugg

SEQ ID NO: 383551 - RNA, 64 nt, Homo Sapiens
auuuugguugaacuuuacccuaggucaggggucagcaaacuacugccugugggccaaauuugcc

SEQ ID NO: 383552 - RNA, 64 nt, Homo Sapiens
ucgagauuauuuucauuuauacuauaaaacaaaagcaaacuaguccaguuuaauuuuuuguacu

SEQ ID NO: 383553 - RNA, 64 nt, Homo Sapiens
aaaaaggaaguauuucucccaaaauugggaguaggcaaacuacuaaucaguuuagcuuuguguu

SEQ ID NO: 383554 - RNA, 64 nt, Homo Sapiens
auggacuagaaaaggaccauuagaucagggguuggcaaacuauggcccacgaaucaaaccuggc

SEQ ID NO: 383555 - RNA, 64 nt, Homo Sapiens
uagccuggguuaccugggaugaagaauaaagagagcaaacuaccacaaccaaugguugagcccc

SEQ ID NO: 383556 - RNA, 64 nt, Homo Sapiens
augguguuuaaaacaauuuguucagaagaacugagcaaacuaacagaaauacaaggcuacgaac

SEQ ID NO: 383557 - RNA, 64 nt, Homo Sapiens
acccgacucaguguaaacaggguuccagcaccaagcaaacuaacgguaacaguuccaccauuua

SEQ ID NO: 383558 - RNA, 64 nt, Homo Sapiens
ugcaaaaaugaguaugaggaacauugaaaugccugcaaacuauacaaauauaugaaauuacuau

SEQ ID NO: 383559 - RNA, 64 nt, Homo Sapiens
ugaaguuauuuauaauuaauuuuugaaaugcugggcaaacuacaaacaugauaguccauaacca

SEQ ID NO: 383560 - RNA, 64 nt, Homo Sapiens
augccauuuaaaacucauacagaaccaaaaaaaugcaaacuauggcaauaugucugcauugaaa

SEQ ID NO: 383561 - RNA, 64 nt, Homo Sapiens
uccaaacuaaaaaugugauauucuauauugauaagcaaacuauucauugugcaauaaaguagaa

SEQ ID NO: 383562 - RNA, 64 nt, Homo Sapiens
aacgguuuuuuauucaagauaauugcuaucaagagcaaacuauguuugcuugcacugaaaauua

SEQ ID NO: 383563 - RNA, 64 nt, Homo Sapiens
ugcucauuguaauguugaaauguuugcagauucugcaaacuaaucuucugacacuacauuuaaa

SEQ ID NO: 383564 - RNA, 64 nt, Homo Sapiens
gucucaguauugagaaacgcauuuagaagucagagcaaacuagggaugaaggaugagagagcuc

SEQ ID NO: 383565 - RNA, 64 nt, Homo Sapiens
aggagaaugugcaauuuugauuuaaauuaugcaagcaaacuaggaucauucuguauauacauau

SEQ ID NO: 383566 - RNA, 64 nt, Homo Sapiens
caucugagaaaggucugaaagggagaaaauuguugcaaacuaugaaacagacagcuuacagaau

SEQ ID NO: 383567 - RNA, 64 nt, Homo Sapiens
auuucugccuuuguguagacugaugauuaaguaggcaaacuacuucuacuuucaaagagcccca

SEQ ID NO: 383568 - RNA, 64 nt, Homo Sapiens
cccccauauaaggaaguuacuguuuuaaaauaaagcaaacuaacuguuuuauuuuccuuggacc

SEQ ID NO: 383569 - RNA, 64 nt, Homo Sapiens
agcaaaugacauuuuuacaguauuuuuuuguaaagcaaacuauuuugugccuugaauuugguau

SEQ ID NO: 383570 - RNA, 64 nt, Homo Sapiens
guagaugcuauuauucauaagaacugugauuccagcaaacuaggguaauuggugccuuuuuaca

SEQ ID NO: 383571 - RNA, 64 nt, Homo Sapiens
ccuauauaagcaaaaaaccaaccacuguauuaaagcaaacuaagccugcauuuauaucugaauu

SEQ ID NO: 383572 - RNA, 64 nt, Homo Sapiens
caaaugcuaaggggaacauacauguaaaaagccagcaaacuaucuucaaacucuuccguccuua

SEQ ID NO: 383573 - RNA, 64 nt, Homo Sapiens
aaaacaggcagucaucuuuaagggcuaugccuaggcaaacuacuaacaugcauugugagaaugc

SEQ ID NO: 383574 - RNA, 64 nt, Homo Sapiens
cuuuuuuuuuuuuuaaucacuaggguaaauucuggcaaacuaccauugcacuaaugaacucuuc

SEQ ID NO: 383575 - RNA, 64 nt, Homo Sapiens
ucuguaugcagauguaguuuuuuaaaaauuagaugcaaacuagagaugaccccuuuuguguguu

SEQ ID NO: 383576 - RNA, 64 nt, Homo Sapiens
cuguaauuuuuuuaaacgucuuguuuuuaauauagcaaacuaucucaauacuggcuggauuagg

SEQ ID NO: 383577 - RNA, 64 nt, Homo Sapiens
cauuacauaaaacaauggaggaugccucauuuuagcaaacuagguuucuuuguauucuucaguc

SEQ ID NO: 383578 - RNA, 64 nt, Homo Sapiens
uaccacaaacccugcugaacacagugucuguucagcaaacuaaccagcauucccuacagccuag

SEQ ID NO: 383579 - RNA, 64 nt, Homo Sapiens
accagguugccuuauuuuggauugagccuauugggcaaacuauaacuucaagugguguuggccc

SEQ ID NO: 383580 - RNA, 64 nt, Homo Sapiens
gucgcucagcaacaccaaaaugauuggagaauuugcaaacuaccgucauauugaggcccaaacu

SEQ ID NO: 383581 - RNA, 64 nt, Homo Sapiens
aggccugucccuugccucugcccuggauugguuggcaaacuaaaggacuugauguacauaacuc

SEQ ID NO: 383582 - RNA, 64 nt, Homo Sapiens
acuacauaaaauauguuucuauuuagaugaaguggcaaacuaaucuguaguguuaaaaauuaga

SEQ ID NO: 383583 - RNA, 64 nt, Homo Sapiens
uaaucuaaaucaccauuuagauuaagcuugacuugcaaacuaggaagaagcaccuaggcuuucu

SEQ ID NO: 383584 - RNA, 64 nt, Homo Sapiens
gcauuauguuuuacaaagauaucuaaggauccaagcaaacuacuuuaagcaaauauuuguaaaa

SEQ ID NO: 383585 - RNA, 64 nt, Homo Sapiens
aaguuaggcugcaucucggacucaucuugcugaugcaaacuaggucuuuccaugguggugccug

SEQ ID NO: 383586 - RNA, 64 nt, Homo Sapiens
cacaucaaucucucuugauugauuggacaccccugcaaacuaauguggcccagggaggccaaaa

SEQ ID NO: 383587 - RNA, 64 nt, Homo Sapiens
cuuuaaaaaaaacucauugcaaccgugccaucuugcaaacuacaugaaagccagugagccuacu

SEQ ID NO: 383588 - RNA, 64 nt, Homo Sapiens
ugcgacucacccacaauugccugccuacuucugagcaaacuauuuugaaguugcuuuuuugacu

SEQ ID NO: 383589 - RNA, 64 nt, Homo Sapiens
acaugcaaaugccccuuguucaucugugucuucugcaaacuagucucaugaagaauucuggcgu

SEQ ID NO: 383590 - RNA, 64 nt, Homo Sapiens
cagaaagcaucacuuuaaaaguucguuuguucaugcaaacuauauuugcauucuuacauuaguu

SEQ ID NO: 383591 - RNA, 64 nt, Homo Sapiens
cuuguccugggggauugaccaucaugucuucccugcaaacuaugaccuggugcugggggcugau

SEQ ID NO: 383592 - RNA, 64 nt, Homo Sapiens
aguuccuucccuuccacaaaaugcaagagcaaaagcaaacuacaaacaggccuugugcucaacc

SEQ ID NO: 383593 - RNA, 64 nt, Homo Sapiens
cuagcucuuucuccgccgugagcucgcuuggucagcaaacuaaguacuggguaaacucuccucc

SEQ ID NO: 383594 - RNA, 64 nt, Homo Sapiens
cauugguuuaaaugcguuauuaaccaucuuaagugcaaacuaaucauuguaaauuauauuuuag

SEQ ID NO: 383595 - RNA, 64 nt, Homo Sapiens
auugauuucauuuagauuucccuccacgaggucagcaaacuaucauguucuuauguaaacuuag

SEQ ID NO: 383596 - RNA, 64 nt, Homo Sapiens
uacacaaagcaugccuuaaaaaaguuuuauuuuugcaaacuaaauauaaaaaaaauuuguacua

SEQ ID NO: 383597 - RNA, 64 nt, Homo Sapiens
gcaaggauagaaaaccaaacaaccaucauucugagcaaacuaucgggacauggaugaagcugga

SEQ ID NO: 383598 - RNA, 64 nt, Homo Sapiens
auugguucaugugcuuguguaaaucccuguucuagcaaacuaauaaaugucugaguaacuucuu

SEQ ID NO: 383599 - RNA, 64 nt, Homo Sapiens
uuguacuguuuauaagccuuugcagucagaaaaggcaaacuauuuuugcacuaauguauaauua

SEQ ID NO: 383600 - RNA, 64 nt, Homo Sapiens
guguguauaaaacauuaauugcuaacaauuguuagcaaacuauuucagugauaauguucauuuu

SEQ ID NO: 383601 - RNA, 64 nt, Homo Sapiens
gccagucagaaaugcacuuuauuacgauuauuuugcaaacuauuauaaagaaauaaguaguuuc

SEQ ID NO: 383602 - RNA, 64 nt, Homo Sapiens
auuuaagugaacauuagcauucauguuuuaaagugcaaacuaacgugaugauuccuauuuccuc

SEQ ID NO: 383603 - RNA, 64 nt, Homo Sapiens
agaguuggauuaaauucuggagaacccuuugggagcaaacuaguugaaguugguugugauugac

SEQ ID NO: 383604 - RNA, 64 nt, Homo Sapiens
ccagcauuauuacucaaacuuugcuaauuuuuuagcaaacuagagcucaagguaaaggagaaug

SEQ ID NO: 383605 - RNA, 64 nt, Homo Sapiens
cuugccaugaaggcaccugcccccacagcuccuugcaaacuaugaguucacaugugcccugccu

SEQ ID NO: 383606 - RNA, 59 nt, Homo Sapiens
cccccgcuguaaugaaacaccuacaggaagcaaacuaagaaaccaugaaacgcuacuaa

SEQ ID NO: 383607 - RNA, 64 nt, Homo Sapiens
uccugcaggccaaaucugucuuagaacggggcaggcaaacuacaguaauaaaaaaugaaauuau

SEQ ID NO: 383608 - RNA, 64 nt, Homo Sapiens
uuauaaagugcacuguuuaaaaaguaugaauaaagcaaacuauuguaauauugcacuuuauaaa

SEQ ID NO: 383609 - RNA, 64 nt, Homo Sapiens
guuaagccaaaaacagcuaaucuuugcaucuaaagcaaacuaauguauauuucacauuuuauug

SEQ ID NO: 383610 - RNA, 64 nt, Homo Sapiens
aaggagaauaugguucaagcaaguccuuguuaaggcaaacuauugauauuucauuaauuuuaaa

SEQ ID NO: 383611 - RNA, 64 nt, Homo Sapiens
aacuccugcuggaauacaaaauucuugagcaucugcaaacuaaaaauugacuugagguuuuuuu

SEQ ID NO: 383612 - RNA, 64 nt, Homo Sapiens
ugcaucccuucuuaccuaacucuuuggggacagggcaaacuaaauggcuuagcuauuuacccgc

SEQ ID NO: 383613 - RNA, 64 nt, Homo Sapiens
caagucaaauucuaauguguagaggcacaaagaggcaaacuaaguaauuaucuuugauaaaggu

SEQ ID NO: 383614 - RNA, 64 nt, Homo Sapiens
uuaguguaauuuggcuucauauuugagguuguaagcaaacuaaggaauguguacugggaguaag

SEQ ID NO: 383615 - RNA, 64 nt, Homo Sapiens
uucugagaaauaaacgagucgguaauaucaagcagcaaacuaaagugauugccucacauuugca

SEQ ID NO: 383616 - RNA, 58 nt, Homo Sapiens
aagggacaguacagucuugacaauaguagcaaacuacuaacccagcaaaucuaagccc

SEQ ID NO: 383617 - RNA, 64 nt, Homo Sapiens
cagccuuucacaggacucugcagauagugccucugcaaacuaaggagugacuagguggguuggg

SEQ ID NO: 383618 - RNA, 64 nt, Homo Sapiens
aggaaacaguauaaauuuuaauuaaaaaaaaaaggcaaacuaaaauuucuugaaauaucacuuc

SEQ ID NO: 383619 - RNA, 64 nt, Homo Sapiens
ucguagugacaguguggagaucuuuuuaaugaaagcaaacuauguggccucugcaaagaaagga

SEQ ID NO: 383620 - RNA, 64 nt, Homo Sapiens
gcaaagcuaauugcaaauagcaaccucaauccccgcaaacuaaaacagacacguaauaccagac

SEQ ID NO: 383621 - RNA, 64 nt, Homo Sapiens
auaaaugauugccacauugcaauuuguccgcguugcaaacuauugaggaagggguuaaaaaaaa

SEQ ID NO: 383622 - RNA, 64 nt, Homo Sapiens
agguucacacugcaaauaguguucucaucucaaagcaaacuaucauuccagaaggaaaagugug

SEQ ID NO: 383623 - RNA, 64 nt, Homo Sapiens
aggaugcccuggccgauuggaaaugcuguaaaaugcaaacuaaguuauuauauuuuuuuuuggu

SEQ ID NO: 383624 - RNA, 64 nt, Homo Sapiens
cuucugagcuuguuagcuucagguguguuuucaugcaaacuauauaauaaacccugacuguaga

SEQ ID NO: 383625 - RNA, 64 nt, Homo Sapiens
cagagcuccaaggacagccucucuuucucauuuugcaaacuaccuuuaucccuacugauaguuc

SEQ ID NO: 383626 - RNA, 64 nt, Homo Sapiens
acaggaacagaaaaccaaacaaccaucauccucagcaaacuaacgggacauggaugaagcugga

SEQ ID NO: 383627 - RNA, 64 nt, Homo Sapiens
ucuuuguuucugauuccuuuuaggggaauugcaugcaaacuagacugaaaugauacaaacuucc

SEQ ID NO: 383628 - RNA, 64 nt, Homo Sapiens
gagcuuucugugguauggcagaaauggguggauggcaaacuaagagcccucagccauuuuuuca

SEQ ID NO: 383629 - RNA, 64 nt, Homo Sapiens
ucacccucacaucacagcaccuuaaaucuaaucagcaaacuauaauuuguacguugaaaccugc

SEQ ID NO: 383630 - RNA, 64 nt, Homo Sapiens
gcugcccuguccccuggggcuuuaucucauccaugcaaacuaccaucugcucaacuuccagcua

SEQ ID NO: 383631 - RNA, 64 nt, Homo Sapiens
cauugugagguaaacugauccagaauaggggucagcaaacuaugacucauggccacagucucac

SEQ ID NO: 383632 - RNA, 64 nt, Homo Sapiens
uugagugugaguaauugggauuggggagauuguggcaaacuagaggggaagugcccauuguaaa

SEQ ID NO: 383633 - RNA, 64 nt, Homo Sapiens
gugugguauucugcagugacguucacauuacugagcaaacuauagaauacccuacagcaaaagu

SEQ ID NO: 383634 - RNA, 64 nt, Homo Sapiens
guacgugagucaggcccugacccgggcguccagugcaaacuacagggcuuugggacagggaggg

SEQ ID NO: 383635 - RNA, 64 nt, Homo Sapiens
aacagcucaugaaggcaugaguggaacaccuuuagcaaacuaucgaacaugcuaucaaauaaau

SEQ ID NO: 383636 - RNA, 64 nt, Homo Sapiens
ugaauaaauuaccugugaaucucguugcaggagggcaaacuagguccugcaauaaugcugagga

SEQ ID NO: 383637 - RNA, 64 nt, Homo Sapiens
caagaauuagguuugaacucgagcuggaaccucagcaaacuagaguauauauuguucaguauuu

SEQ ID NO: 383638 - RNA, 64 nt, Homo Sapiens
ugucuggcacccagcugccagccuucuguccugggcaaacuacucccuacuuaagggaauaggc

SEQ ID NO: 383639 - RNA, 64 nt, Homo Sapiens
aaccacuagcucuuacuggaagaauuuccacaaagcaaacuacuuccuuggaggacuugggaga

SEQ ID NO: 383640 - RNA, 64 nt, Homo Sapiens
ccucaaagauucugcauuuuaaggaugggcauaagcaaacuauauuuuaauaauuuauaguuaa

SEQ ID NO: 383641 - RNA, 64 nt, Homo Sapiens
guuuuuuucccccuaauuacccaaaagaucuuuugcaaacuauguuacaugaaugcuucugccu

SEQ ID NO: 383642 - RNA, 64 nt, Homo Sapiens
acaugccaguuggaaggcugcaccagacucaaaagcaaacuaaacaauaaaggacagcucucuu

SEQ ID NO: 383643 - RNA, 64 nt, Homo Sapiens
augaauucaaggaagggagcauagcauaucuguggcaaacuauuuuccacucaaauccugaguu

SEQ ID NO: 383644 - RNA, 64 nt, Homo Sapiens
uugaaaauuuuagaaacaguaugguuuauuuauagcaaacuaaggcaaaaggcuuuacuucaga

SEQ ID NO: 383645 - RNA, 64 nt, Homo Sapiens
aucugcuguaaaacaaccuaccaucugaagcuuggcaaacuaguauucacaacuuagcauuuug

SEQ ID NO: 383646 - RNA, 64 nt, Homo Sapiens
cugcccaucuuuguugccauagcuaucagauaaggcaaacuaccuguggucagcaguccccacc

SEQ ID NO: 383647 - RNA, 64 nt, Homo Sapiens
uuuuaugacaagccuaaaccaacugauugauugugcaaacuacuuaacaauuggaaaaugaaca

SEQ ID NO: 383648 - RNA, 64 nt, Homo Sapiens
aggaggggucaacacuuucacuuggccgaugucugauugggacccuuaccuuggacagguaagg

SEQ ID NO: 383649 - RNA, 64 nt, Homo Sapiens
ucugccagccaguggcuucauucuccaucugcaugauugggaaaagaacuucuucaguaugaug

SEQ ID NO: 383650 - RNA, 64 nt, Homo Sapiens
aaauuuaauaccagauaccuuaucuuacaauauugauugggaaaacauuugcugccauuacaga

SEQ ID NO: 383651 - RNA, 64 nt, Homo Sapiens
cauuugcuacuguuguaagaauucugauugauuugauugggaugaaugccaucuaucuaguucu

SEQ ID NO: 383652 - RNA, 64 nt, Homo Sapiens
uggauuaugcuuaacagugaaaauuuuuaucugagauugggaugcaauggauuuauauauugug

SEQ ID NO: 383653 - RNA, 64 nt, Homo Sapiens
gcugaucccuggauuuguguagaggaaugugggagauugggacaguuuguugagugauugugaa

SEQ ID NO: 383654 - RNA, 64 nt, Homo Sapiens
ccagccuucucaccagguaagacaucaucuuacagauugggaucgcuacccuccacucuaaaga

SEQ ID NO: 383655 - RNA, 64 nt, Homo Sapiens
ccagggcccgggguuugggagcggagauauuggagauugggagaagagacauauggcuugagaa

SEQ ID NO: 383656 - RNA, 64 nt, Homo Sapiens
cagcagcauaagugugcuaccucaccacagaauggauugggacagcagacucuugugacuuaua

SEQ ID NO: 383657 - RNA, 64 nt, Homo Sapiens
acugagcauguguccuguuuaacacuuuaaaacagauugggaaacagaagaguauccuaaugaa

SEQ ID NO: 383658 - RNA, 64 nt, Homo Sapiens
gaaaauccuggagagacacuguugacugcugacugauugggaaaaaggacauucuuccaggaaa

SEQ ID NO: 383659 - RNA, 64 nt, Homo Sapiens
ucugagccucugcaaacuguagcuggagguggacgauugggaguccugguaacaaaccuggaag

SEQ ID NO: 383660 - RNA, 64 nt, Homo Sapiens
uguuuugggggcagggguuauuauuccuuuugcagauugggaugaaaugauauuugaguuuuug

SEQ ID NO: 383661 - RNA, 64 nt, Homo Sapiens
ggguaaggcaaacagcgacuugccaggagauugugauugggagaugugagacugcucggucaag

SEQ ID NO: 383662 - RNA, 64 nt, Homo Sapiens; identical to SEQ ID NO: 365461

SEQ ID NO: 383663 - RNA, 64 nt, Homo Sapiens; identical to SEQ ID NO: 365462

SEQ ID NO: 383664 - RNA, 64 nt, Homo Sapiens; identical to SEQ ID NO: 365463

SEQ ID NO: 383665 - RNA, 64 nt, Homo Sapiens; identical to SEQ ID NO: 365464

SEQ ID NO: 383666 - RNA, 64 nt, Homo Sapiens; identical to SEQ ID NO: 365465

SEQ ID NO: 383667 - RNA, 64 nt, Homo Sapiens; identical to SEQ ID NO: 365466

SEQ ID NO: 383668 - RNA, 64 nt, Homo Sapiens; identical to SEQ ID NO: 365467

SEQ ID NO: 383669 - RNA, 64 nt, Homo Sapiens; identical to SEQ ID NO: 365468

SEQ ID NO: 383670 - RNA, 64 nt, Homo Sapiens; identical to SEQ ID NO: 365469

SEQ ID NO: 383671 - RNA, 64 nt, Homo Sapiens; identical to SEQ ID NO: 365470

SEQ ID NO: 383672 - RNA, 64 nt, Homo Sapiens; identical to SEQ ID NO: 365471

SEQ ID NO: 383673 - RNA, 64 nt, Homo Sapiens; identical to SEQ ID NO: 365472

SEQ ID NO: 383674 - RNA, 64 nt, Homo Sapiens; identical to SEQ ID NO: 365473

SEQ ID NO: 383675 - RNA, 64 nt, Homo Sapiens; identical to SEQ ID NO: 365474

SEQ ID NO: 383676 - RNA, 64 nt, Homo Sapiens; identical to SEQ ID NO: 365475

SEQ ID NO: 383677 - RNA, 64 nt, Homo Sapiens; identical to SEQ ID NO: 365476

SEQ ID NO: 383678 - RNA, 64 nt, Homo Sapiens; identical to SEQ ID NO: 365477

SEQ ID NO: 383679 - RNA, 64 nt, Homo Sapiens; identical to SEQ ID NO: 365478

SEQ ID NO: 383680 - RNA, 64 nt, Homo Sapiens; identical to SEQ ID NO: 365479

SEQ ID NO: 383681 - RNA, 62 nt, Homo Sapiens; identical to SEQ ID NO: 365480

SEQ ID NO: 383682 - RNA, 64 nt, Homo Sapiens; identical to SEQ ID NO: 365481

SEQ ID NO: 383683 - RNA, 64 nt, Homo Sapiens; identical to SEQ ID NO: 365482

SEQ ID NO: 383684 - RNA, 64 nt, Homo Sapiens; identical to SEQ ID NO: 365483

SEQ ID NO: 383685 - RNA, 64 nt, Homo Sapiens; identical to SEQ ID NO: 365484

SEQ ID NO: 383686 - RNA, 64 nt, Homo Sapiens; identical to SEQ ID NO: 365485

SEQ ID NO: 383687 - RNA, 64 nt, Homo Sapiens; identical to SEQ ID NO: 365486

SEQ ID NO: 383688 - RNA, 64 nt, Homo Sapiens; identical to SEQ ID NO: 365487

SEQ ID NO: 383689 - RNA, 64 nt, Homo Sapiens; identical to SEQ ID NO: 365488

SEQ ID NO: 383690 - RNA, 64 nt, Homo Sapiens; identical to SEQ ID NO: 365489

SEQ ID NO: 383691 - RNA, 64 nt, Homo Sapiens; identical to SEQ ID NO: 365490

SEQ ID NO: 383692 - RNA, 64 nt, Homo Sapiens; identical to SEQ ID NO: 365491

SEQ ID NO: 383693 - RNA, 64 nt, Homo Sapiens; identical to SEQ ID NO: 365492

SEQ ID NO: 383694 - RNA, 64 nt, Homo Sapiens; identical to SEQ ID NO: 365493

SEQ ID NO: 383695 - RNA, 64 nt, Homo Sapiens; identical to SEQ ID NO: 365494

SEQ ID NO: 383696 - RNA, 64 nt, Homo Sapiens; identical to SEQ ID NO: 365495

SEQ ID NO: 383697 - RNA, 64 nt, Homo Sapiens; identical to SEQ ID NO: 365496

SEQ ID NO: 383698 - RNA, 64 nt, Homo Sapiens; identical to SEQ ID NO: 365497

SEQ ID NO: 383699 - RNA, 64 nt, Homo Sapiens; identical to SEQ ID NO: 365498

SEQ ID NO: 383700 - RNA, 64 nt, Homo Sapiens; identical to SEQ ID NO: 365499

SEQ ID NO: 383701 - RNA, 64 nt, Homo Sapiens; identical to SEQ ID NO: 365500

SEQ ID NO: 383702 - RNA, 64 nt, Homo Sapiens; identical to SEQ ID NO: 365501

SEQ ID NO: 383703 - RNA, 64 nt, Homo Sapiens; identical to SEQ ID NO: 365502

SEQ ID NO: 383704 - RNA, 64 nt, Homo Sapiens; identical to SEQ ID NO: 365503

SEQ ID NO: 383705 - RNA, 64 nt, Homo Sapiens; identical to SEQ ID NO: 365504

SEQ ID NO: 383706 - RNA, 56 nt, Homo Sapiens; identical to SEQ ID NO: 365505

SEQ ID NO: 383707 - RNA, 64 nt, Homo Sapiens; identical to SEQ ID NO: 365506

SEQ ID NO: 383708 - RNA, 64 nt, Homo Sapiens; identical to SEQ ID NO: 365507

SEQ ID NO: 383709 - RNA, 64 nt, Homo Sapiens; identical to SEQ ID NO: 365508

SEQ ID NO: 383710 - RNA, 64 nt, Homo Sapiens; identical to SEQ ID NO: 365509

SEQ ID NO: 383711 - RNA, 64 nt, Homo Sapiens; identical to SEQ ID NO: 365510

SEQ ID NO: 383712 - RNA, 64 nt, Homo Sapiens; identical to SEQ ID NO: 365511

SEQ ID NO: 383713 - RNA, 64 nt, Homo Sapiens; identical to SEQ ID NO: 365512

SEQ ID NO: 383714 - RNA, 64 nt, Homo Sapiens; identical to SEQ ID NO: 365513

SEQ ID NO: 383715 - RNA, 64 nt, Homo Sapiens; identical to SEQ ID NO: 365514

SEQ ID NO: 383716 - RNA, 64 nt, Homo Sapiens; identical to SEQ ID NO: 365515

SEQ ID NO: 383717 - RNA, 64 nt, Homo Sapiens; identical to SEQ ID NO: 365516

SEQ ID NO: 383718 - RNA, 64 nt, Homo Sapiens; identical to SEQ ID NO: 365517

SEQ ID NO: 383719 - RNA, 64 nt, Homo Sapiens; identical to SEQ ID NO: 365518

SEQ ID NO: 383720 - RNA, 64 nt, Homo Sapiens; identical to SEQ ID NO: 365519

SEQ ID NO: 383721 - RNA, 64 nt, Homo Sapiens; identical to SEQ ID NO: 365520

SEQ ID NO: 383722 - RNA, 64 nt, Homo Sapiens; identical to SEQ ID NO: 365521

SEQ ID NO: 383723 - RNA, 64 nt, Homo Sapiens; identical to SEQ ID NO: 365522

SEQ ID NO: 383724 - RNA, 64 nt, Homo Sapiens; identical to SEQ ID NO: 365523

SEQ ID NO: 383725 - RNA, 64 nt, Homo Sapiens; identical to SEQ ID NO: 365524

SEQ ID NO: 383726 - RNA, 64 nt, Homo Sapiens; identical to SEQ ID NO: 365525

SEQ ID NO: 383727 - RNA, 64 nt, Homo Sapiens
uaaaugccacugucaaucccccacuuuucuaaaaggucucuauuuuauuuauuuuucuacuuuc

SEQ ID NO: 383728 - RNA, 64 nt, Homo Sapiens
uauguauuuauuauuuauuuguucaucauuuacaggucucuauuacuucuccaccaaguucacu

SEQ ID NO: 383729 - RNA, 64 nt, Homo Sapiens; identical to SEQ ID NO: 95465

SEQ ID NO: 383730 - RNA, 64 nt, Homo Sapiens; identical to SEQ ID NO: 95466

SEQ ID NO: 383731 - RNA, 64 nt, Homo Sapiens; identical to SEQ ID NO: 95467

SEQ ID NO: 383732 - RNA, 64 nt, Homo Sapiens; identical to SEQ ID NO: 95468

SEQ ID NO: 383733 - RNA, 64 nt, Homo Sapiens; identical to SEQ ID NO: 95469

SEQ ID NO: 383734 - RNA, 64 nt, Homo Sapiens; identical to SEQ ID NO: 95470

SEQ ID NO: 383735 - RNA, 64 nt, Homo Sapiens; identical to SEQ ID NO: 95471

SEQ ID NO: 383736 - RNA, 64 nt, Homo Sapiens; identical to SEQ ID NO: 95472

SEQ ID NO: 383737 - RNA, 64 nt, Homo Sapiens; identical to SEQ ID NO: 95473

SEQ ID NO: 383738 - RNA, 64 nt, Homo Sapiens; identical to SEQ ID NO: 95474

SEQ ID NO: 383739 - RNA, 64 nt, Homo Sapiens; identical to SEQ ID NO: 95475

SEQ ID NO: 383740 - RNA, 64 nt, Homo Sapiens; identical to SEQ ID NO: 95476

SEQ ID NO: 383741 - RNA, 64 nt, Homo Sapiens; identical to SEQ ID NO: 95477

SEQ ID NO: 383742 - RNA, 64 nt, Homo Sapiens; identical to SEQ ID NO: 38209

SEQ ID NO: 383743 - RNA, 64 nt, Homo Sapiens; identical to SEQ ID NO: 38210

SEQ ID NO: 383744 - RNA, 64 nt, Homo Sapiens; identical to SEQ ID NO: 38211

SEQ ID NO: 383745 - RNA, 64 nt, Homo Sapiens; identical to SEQ ID NO: 38212

SEQ ID NO: 383746 - RNA, 64 nt, Homo Sapiens; identical to SEQ ID NO: 38213

SEQ ID NO: 383747 - RNA, 64 nt, Homo Sapiens; identical to SEQ ID NO: 38214

SEQ ID NO: 383748 - RNA, 64 nt, Homo Sapiens; identical to SEQ ID NO: 38215

SEQ ID NO: 383749 - RNA, 64 nt, Homo Sapiens; identical to SEQ ID NO: 38216

SEQ ID NO: 383750 - RNA, 64 nt, Homo Sapiens; identical to SEQ ID NO: 38217

SEQ ID NO: 383751 - RNA, 64 nt, Homo Sapiens; identical to SEQ ID NO: 38218

SEQ ID NO: 383752 - RNA, 64 nt, Homo Sapiens; identical to SEQ ID NO: 38219

SEQ ID NO: 383753 - RNA, 64 nt, Homo Sapiens; identical to SEQ ID NO: 38220

SEQ ID NO: 383754 - RNA, 64 nt, Homo Sapiens; identical to SEQ ID NO: 38221

SEQ ID NO: 383755 - RNA, 64 nt, Homo Sapiens; identical to SEQ ID NO: 38222

SEQ ID NO: 383756 - RNA, 64 nt, Homo Sapiens; identical to SEQ ID NO: 38223

SEQ ID NO: 383757 - RNA, 64 nt, Homo Sapiens; identical to SEQ ID NO: 38224

SEQ ID NO: 383758 - RNA, 64 nt, Homo Sapiens; identical to SEQ ID NO: 38225

SEQ ID NO: 383759 - RNA, 64 nt, Homo Sapiens; identical to SEQ ID NO: 38226

SEQ ID NO: 383760 - RNA, 64 nt, Homo Sapiens; identical to SEQ ID NO: 38227

SEQ ID NO: 383761 - RNA, 64 nt, Homo Sapiens; identical to SEQ ID NO: 38228

SEQ ID NO: 383762 - RNA, 64 nt, Homo Sapiens; identical to SEQ ID NO: 38229

SEQ ID NO: 383763 - RNA, 64 nt, Homo Sapiens; identical to SEQ ID NO: 38230

SEQ ID NO: 383764 - RNA, 64 nt, Homo Sapiens; identical to SEQ ID NO: 38231

SEQ ID NO: 383765 - RNA, 64 nt, Homo Sapiens; identical to SEQ ID NO: 38232

SEQ ID NO: 383766 - RNA, 64 nt, Homo Sapiens; identical to SEQ ID NO: 38233

SEQ ID NO: 383767 - RNA, 64 nt, Homo Sapiens; identical to SEQ ID NO: 38234

SEQ ID NO: 383768 - RNA, 64 nt, Homo Sapiens; identical to SEQ ID NO: 38235

SEQ ID NO: 383769 - RNA, 64 nt, Homo Sapiens; identical to SEQ ID NO: 38236

SEQ ID NO: 383770 - RNA, 64 nt, Homo Sapiens; identical to SEQ ID NO: 172267

SEQ ID NO: 383771 - RNA, 64 nt, Homo Sapiens; identical to SEQ ID NO: 172268

SEQ ID NO: 383772 - RNA, 64 nt, Homo Sapiens; identical to SEQ ID NO: 172269

SEQ ID NO: 383773 - RNA, 64 nt, Homo Sapiens; identical to SEQ ID NO: 172270

SEQ ID NO: 383774 - RNA, 64 nt, Homo Sapiens; identical to SEQ ID NO: 172271

SEQ ID NO: 383775 - RNA, 64 nt, Homo Sapiens; identical to SEQ ID NO: 172272

SEQ ID NO: 383776 - RNA, 64 nt, Homo Sapiens; identical to SEQ ID NO: 172273

SEQ ID NO: 383777 - RNA, 64 nt, Homo Sapiens; identical to SEQ ID NO: 172274

SEQ ID NO: 383778 - RNA, 64 nt, Homo Sapiens; identical to SEQ ID NO: 172275

SEQ ID NO: 383779 - RNA, 64 nt, Homo Sapiens; identical to SEQ ID NO: 172276

SEQ ID NO: 383780 - RNA, 64 nt, Homo Sapiens; identical to SEQ ID NO: 172277

SEQ ID NO: 383781 - RNA, 64 nt, Homo Sapiens; identical to SEQ ID NO: 172278

SEQ ID NO: 383782 - RNA, 64 nt, Homo Sapiens; identical to SEQ ID NO: 172279

SEQ ID NO: 383783 - RNA, 64 nt, Homo Sapiens; identical to SEQ ID NO: 172280

SEQ ID NO: 383784 - RNA, 64 nt, Homo Sapiens; identical to SEQ ID NO: 172281

SEQ ID NO: 383785 - RNA, 64 nt, Homo Sapiens; identical to SEQ ID NO: 172282

SEQ ID NO: 383786 - RNA, 64 nt, Homo Sapiens; identical to SEQ ID NO: 172283

SEQ ID NO: 383787 - RNA, 64 nt, Homo Sapiens; identical to SEQ ID NO: 172284

SEQ ID NO: 383788 - RNA, 64 nt, Homo Sapiens; identical to SEQ ID NO: 172285

SEQ ID NO: 383789 - RNA, 64 nt, Homo Sapiens; identical to SEQ ID NO: 172286

SEQ ID NO: 383790 - RNA, 64 nt, Homo Sapiens; identical to SEQ ID NO: 172287

SEQ ID NO: 383791 - RNA, 64 nt, Homo Sapiens; identical to SEQ ID NO: 172288

SEQ ID NO: 383792 - RNA, 64 nt, Homo Sapiens; identical to SEQ ID NO: 172289

SEQ ID NO: 383793 - RNA, 64 nt, Homo Sapiens; identical to SEQ ID NO: 172290

SEQ ID NO: 383794 - RNA, 64 nt, Homo Sapiens; identical to SEQ ID NO: 172291

SEQ ID NO: 383795 - RNA, 64 nt, Homo Sapiens; identical to SEQ ID NO: 172292

SEQ ID NO: 383796 - RNA, 64 nt, Homo Sapiens; identical to SEQ ID NO: 172293

SEQ ID NO: 383797 - RNA, 64 nt, Homo Sapiens; identical to SEQ ID NO: 172294

SEQ ID NO: 383798 - RNA, 64 nt, Homo Sapiens; identical to SEQ ID NO: 172295

SEQ ID NO: 383799 - RNA, 64 nt, Homo Sapiens; identical to SEQ ID NO: 172296

SEQ ID NO: 383800 - RNA, 64 nt, Homo Sapiens; identical to SEQ ID NO: 172297

SEQ ID NO: 383801 - RNA, 64 nt, Homo Sapiens; identical to SEQ ID NO: 172298

SEQ ID NO: 383802 - RNA, 64 nt, Homo Sapiens; identical to SEQ ID NO: 172299

SEQ ID NO: 383803 - RNA, 64 nt, Homo Sapiens; identical to SEQ ID NO: 172300

SEQ ID NO: 383804 - RNA, 64 nt, Homo Sapiens; identical to SEQ ID NO: 172301

SEQ ID NO: 383805 - RNA, 64 nt, Homo Sapiens; identical to SEQ ID NO: 172302

SEQ ID NO: 383806 - RNA, 64 nt, Homo Sapiens; identical to SEQ ID NO: 172303

SEQ ID NO: 383807 - RNA, 64 nt, Homo Sapiens; identical to SEQ ID NO: 172304

SEQ ID NO: 383808 - RNA, 64 nt, Homo Sapiens; identical to SEQ ID NO: 172305

SEQ ID NO: 383809 - RNA, 64 nt, Homo Sapiens; identical to SEQ ID NO: 172306

SEQ ID NO: 383810 - RNA, 64 nt, Homo Sapiens; identical to SEQ ID NO: 172307

SEQ ID NO: 383811 - RNA, 64 nt, Homo Sapiens; identical to SEQ ID NO: 172308

SEQ ID NO: 383812 - RNA, 64 nt, Homo Sapiens; identical to SEQ ID NO: 172309

SEQ ID NO: 383813 - RNA, 64 nt, Homo Sapiens; identical to SEQ ID NO: 172310

SEQ ID NO: 383814 - RNA, 64 nt, Homo Sapiens; identical to SEQ ID NO: 77887

SEQ ID NO: 383815 - RNA, 64 nt, Homo Sapiens; identical to SEQ ID NO: 77888

SEQ ID NO: 383816 - RNA, 64 nt, Homo Sapiens; identical to SEQ ID NO: 77889

SEQ ID NO: 383817 - RNA, 64 nt, Homo Sapiens; identical to SEQ ID NO: 77890

SEQ ID NO: 383818 - RNA, 64 nt, Homo Sapiens; identical to SEQ ID NO: 77891

SEQ ID NO: 383819 - RNA, 64 nt, Homo Sapiens; identical to SEQ ID NO: 77892

SEQ ID NO: 383820 - RNA, 64 nt, Homo Sapiens; identical to SEQ ID NO: 77893

SEQ ID NO: 383821 - RNA, 64 nt, Homo Sapiens; identical to SEQ ID NO: 77894

SEQ ID NO: 383822 - RNA, 64 nt, Homo Sapiens; identical to SEQ ID NO: 77895

SEQ ID NO: 383823 - RNA, 64 nt, Homo Sapiens; identical to SEQ ID NO: 77896

SEQ ID NO: 383824 - RNA, 64 nt, Homo Sapiens; identical to SEQ ID NO: 77897

SEQ ID NO: 383825 - RNA, 64 nt, Homo Sapiens; identical to SEQ ID NO: 77898

SEQ ID NO: 383826 - RNA, 64 nt, Homo Sapiens; identical to SEQ ID NO: 77899

SEQ ID NO: 383827 - RNA, 64 nt, Homo Sapiens; identical to SEQ ID NO: 77900

SEQ ID NO: 383828 - RNA, 64 nt, Homo Sapiens; identical to SEQ ID NO: 77901

SEQ ID NO: 383829 - RNA, 64 nt, Homo Sapiens; identical to SEQ ID NO: 77902

SEQ ID NO: 383830 - RNA, 64 nt, Homo Sapiens; identical to SEQ ID NO: 77903

SEQ ID NO: 383831 - RNA, 64 nt, Homo Sapiens; identical to SEQ ID NO: 77904

SEQ ID NO: 383832 - RNA, 64 nt, Homo Sapiens; identical to SEQ ID NO: 77905

SEQ ID NO: 383833 - RNA, 64 nt, Homo Sapiens; identical to SEQ ID NO: 77906

SEQ ID NO: 383834 - RNA, 64 nt, Homo Sapiens; identical to SEQ ID NO: 77907

SEQ ID NO: 383835 - RNA, 64 nt, Homo Sapiens; identical to SEQ ID NO: 77908

SEQ ID NO: 383836 - RNA, 64 nt, Homo Sapiens; identical to SEQ ID NO: 77909

SEQ ID NO: 383837 - RNA, 64 nt, Homo Sapiens; identical to SEQ ID NO: 77910

SEQ ID NO: 383838 - RNA, 64 nt, Homo Sapiens; identical to SEQ ID NO: 77911

SEQ ID NO: 383839 - RNA, 64 nt, Homo Sapiens; identical to SEQ ID NO: 77912

SEQ ID NO: 383840 - RNA, 64 nt, Homo Sapiens; identical to SEQ ID NO: 77913

SEQ ID NO: 383841 - RNA, 64 nt, Homo Sapiens; identical to SEQ ID NO: 77914

SEQ ID NO: 383842 - RNA, 64 nt, Homo Sapiens; identical to SEQ ID NO: 77915

SEQ ID NO: 383843 - RNA, 64 nt, Homo Sapiens; identical to SEQ ID NO: 77916

SEQ ID NO: 383844 - RNA, 64 nt, Homo Sapiens; identical to SEQ ID NO: 77917

SEQ ID NO: 383845 - RNA, 64 nt, Homo Sapiens; identical to SEQ ID NO: 77918

SEQ ID NO: 383846 - RNA, 64 nt, Homo Sapiens; identical to SEQ ID NO: 77919

SEQ ID NO: 383847 - RNA, 64 nt, Homo Sapiens; identical to SEQ ID NO: 77920

SEQ ID NO: 383848 - RNA, 64 nt, Homo Sapiens; identical to SEQ ID NO: 77921

SEQ ID NO: 383849 - RNA, 64 nt, Homo Sapiens; identical to SEQ ID NO: 77922

SEQ ID NO: 383850 - RNA, 64 nt, Homo Sapiens; identical to SEQ ID NO: 77923

SEQ ID NO: 383851 - RNA, 64 nt, Homo Sapiens; identical to SEQ ID NO: 77924

SEQ ID NO: 383852 - RNA, 64 nt, Homo Sapiens; identical to SEQ ID NO: 77925

SEQ ID NO: 383853 - RNA, 64 nt, Homo Sapiens; identical to SEQ ID NO: 77926

SEQ ID NO: 383854 - RNA, 64 nt, Homo Sapiens; identical to SEQ ID NO: 77927

SEQ ID NO: 383855 - RNA, 64 nt, Homo Sapiens; identical to SEQ ID NO: 77928

SEQ ID NO: 383856 - RNA, 64 nt, Homo Sapiens; identical to SEQ ID NO: 77929

SEQ ID NO: 383857 - RNA, 64 nt, Homo Sapiens; identical to SEQ ID NO: 77930

SEQ ID NO: 383858 - RNA, 64 nt, Homo Sapiens; identical to SEQ ID NO: 77931

SEQ ID NO: 383859 - RNA, 64 nt, Homo Sapiens; identical to SEQ ID NO: 77932

SEQ ID NO: 383860 - RNA, 64 nt, Homo Sapiens; identical to SEQ ID NO: 77933

SEQ ID NO: 383861 - RNA, 64 nt, Homo Sapiens; identical to SEQ ID NO: 77934

SEQ ID NO: 383862 - RNA, 64 nt, Homo Sapiens; identical to SEQ ID NO: 77935

SEQ ID NO: 383863 - RNA, 64 nt, Homo Sapiens; identical to SEQ ID NO: 77936

SEQ ID NO: 383864 - RNA, 64 nt, Homo Sapiens; identical to SEQ ID NO: 77937

SEQ ID NO: 383865 - RNA, 64 nt, Homo Sapiens; identical to SEQ ID NO: 77938

SEQ ID NO: 383866 - RNA, 64 nt, Homo Sapiens; identical to SEQ ID NO: 165842

SEQ ID NO: 383867 - RNA, 64 nt, Homo Sapiens; identical to SEQ ID NO: 165843

SEQ ID NO: 383868 - RNA, 64 nt, Homo Sapiens
gcaggggauccugaagcugauauaaauaagucuagcucuauaauccccaaguucuaaaaguuau

SEQ ID NO: 383869 - RNA, 64 nt, Homo Sapiens
gguuuucuauuaaggucucugccccaggcauggugcucuauaucuuggccaaauaaauuacuuu

SEQ ID NO: 383870 - RNA, 64 nt, Homo Sapiens
cugaaugcaaagaauucauagcaguuaauuccccuuuuuugacccuuuugagauggaacuuuca

SEQ ID NO: 383871 - RNA, 64 nt, Homo Sapiens
auuuggucaaucuaaaugcauucauucuaaaaaauuuuuugaaccagauaaauaaaauuuuuuu

SEQ ID NO: 383872 - RNA, 64 nt, Homo Sapiens
cuaaaaaauuuuuugaaccagauaaauaaaauuuuuuuuugacaccacaguuuagugucuggag

SEQ ID NO: 383873 - RNA, 64 nt, Homo Sapiens
cuuuaugaaagcggcuuuuuauaaguauacugcauuuuuugagccuaucauuaauuagcuuagu

SEQ ID NO: 383874 - RNA, 64 nt, Homo Sapiens
ggaaagcucucuauucuaguugauaaaacuucccuuuuuugauguagaugcagauauucuauac

SEQ ID NO: 383875 - RNA, 64 nt, Homo Sapiens
uauuauuauuccuuguuuuuuuuuuuuuuuuuuuuuuuuugagauguagucuuacucugucacc

SEQ ID NO: 383876 - RNA, 64 nt, Homo Sapiens
auaccacuagagucuucagauuuuuauacuuuuuuuuuuugaaacggagucucacucugucacc

SEQ ID NO: 383877 - RNA, 64 nt, Homo Sapiens
uauugaaauuauugauagcuuucauaaucucagcuuuuuugaacuuccacaauuuuuggaauau

SEQ ID NO: 383878 - RNA, 64 nt, Homo Sapiens
uuccucauagagucuuuugccaugauuuaugguguuuuuugaaauuugucuuaauugaaaaaag

SEQ ID NO: 383879 - RNA, 64 nt, Homo Sapiens
augacaaggaauguggcucagagaaggguuuuucuuuuuugaccuuucuucucucaacaggaac

SEQ ID NO: 383880 - RNA, 64 nt, Homo Sapiens
auuccugguaaggauuuggggcauaguuuuuuguuuuuuugagacggaguuucgcucuuguugc

SEQ ID NO: 383881 - RNA, 64 nt, Homo Sapiens
auuggcuaugccacuugaaaacaauuugagaaguuuuuuugaaguuuuucucacuaaaauaugg

SEQ ID NO: 383882 - RNA, 64 nt, Homo Sapiens
cucuagagaaucaccuucuuucgcuuuuuuuuuuuuuuuugagguagagucucacuauguugcc

SEQ ID NO: 383883 - RNA, 64 nt, Homo Sapiens
aaaacuaaugcuguugcauacaugaagccuuuuguuuuuugaggagcuauuuuuguuauucuug

SEQ ID NO: 383884 - RNA, 64 nt, Homo Sapiens
aucagcuagggaaaaaccaucaagcucauuauuauuuuuugaucuucaguuguauuuuugugaa

SEQ ID NO: 383885 - RNA, 64 nt, Homo Sapiens
uccaaagaaaauuauaguuuagguuugagcuaguuuuuuugaaauuuucuagauaccacuuaac

SEQ ID NO: 383886 - RNA, 64 nt, Homo Sapiens
gggucucacucugucacccaaccacuuuuuuuuuuuuuuugacagaguuggccuuuaaaaaugc

SEQ ID NO: 383887 - RNA, 64 nt, Homo Sapiens
aaaaagcaaauaauauugccgaugcauuuuuuucuuuuuugauaagucaauccacauuuacaaa

SEQ ID NO: 383888 - RNA, 64 nt, Homo Sapiens
agcuacauuaccuugugaagcuuuaauucuacucuuuuuugauuaauugcucauuauguaaaua

SEQ ID NO: 383889 - RNA, 64 nt, Homo Sapiens
cagggucucacuuugacaccuuguuuuguuuuuguuuuuugaaaacuuuguuaauuguuucauu

SEQ ID NO: 383890 - RNA, 64 nt, Homo Sapiens
cuucuuauagauucuggauauuuucgcuuguaaauuuuuugaaguuuuuaaugggguugcuugu

SEQ ID NO: 383891 - RNA, 64 nt, Homo Sapiens
acauaauuuaaaugaauuuguggcaauucccugcuuuuuugacauagacguaagccaccacacc

SEQ ID NO: 383892 - RNA, 64 nt, Homo Sapiens
ugaagucucacugcacucaguguuuuuauuuuuguuuuuugagacucaauucucuguuuuguuu

SEQ ID NO: 383893 - RNA, 64 nt, Homo Sapiens
guuuugcucugucacccagguugaaauuuuacuuuuuuuugagaguuuauauugugaagcuuuu

SEQ ID NO: 383894 - RNA, 64 nt, Homo Sapiens
uuuuacuuuuuuuugagaguuuauauugugaagcuuuuuugaaauaugucauuaaaauuaaggu

SEQ ID NO: 383895 - RNA, 64 nt, Homo Sapiens
cagagucucguucgguccccuguuuuuuucuuuuuuuuuugagacccuuauucuguguguuuuu

SEQ ID NO: 383896 - RNA, 64 nt, Homo Sapiens
uaguuggaugugcuuuuaaauuucuaauccucccuuuuuugauuugaaggaugaacuaguguga

SEQ ID NO: 383897 - RNA, 64 nt, Homo Sapiens
caaagucucacugugucaccuuuuuucuuuucuuuuuuuugagaagccaccgcguccggccucu

SEQ ID NO: 383898 - RNA, 64 nt, Homo Sapiens
cggagucucucacugucgccucuuuuucuuuuuuuuuuuugagauuggaagagugaagcguuuu

SEQ ID NO: 383899 - RNA, 64 nt, Homo Sapiens
ucauuacacaggacuucacuguuuucuuuguucuuuuuuugaagcugaguaggaagaguuaauu

SEQ ID NO: 383900 - RNA, 64 nt, Homo Sapiens
aucacuuccuuaaagacucugauuugucugaguguuuuuugacacauguugcccacuucuugug

SEQ ID NO: 383901 - RNA, 64 nt, Homo Sapiens
ugcagauauagcaaaggauuuuugcaaaaugcacuuuuuugagagcauaucauaaauugauaau

SEQ ID NO: 383902 - RNA, 64 nt, Homo Sapiens
uuuuucuuuuuucuuucuuuuuuuuuuuuuuuuuuuuuuugaguuguuguuuguuuuuagaucc

SEQ ID NO: 383903 - RNA, 64 nt, Homo Sapiens
uguuuguuuuuagauccacaguacaugagaauccuuuuuugacaagccuuggaaagcugacacu

SEQ ID NO: 383904 - RNA, 64 nt, Homo Sapiens
gaguugguuuucuuuucuuuucuugccuuuuuuuuuuuuugaaauuugccgagcaguggagccc

SEQ ID NO: 383905 - RNA, 64 nt, Homo Sapiens
ugugagaugaaccuccuguaacuucuaucuguucuuuuuugaggcucagggagaaacuagcauu

SEQ ID NO: 383906 - RNA, 64 nt, Homo Sapiens
ccuaauaacuucacaguaugaaugugcaucuuuuuuuuuugaacaaaugaugguguaacauuuu

SEQ ID NO: 383907 - RNA, 64 nt, Homo Sapiens
cauaccuauugucauuguuugccuuguaaucuguuuuuuugaauucauuuugggcugauaguuu

SEQ ID NO: 383908 - RNA, 64 nt, Homo Sapiens
uugugcuuuuuaucuugggugccuagcauucuguuuuuuugauccuaugucauaauuuuuugag

SEQ ID NO: 383909 - RNA, 64 nt, Homo Sapiens
ccuagcauucuguuuuuuugauccuaugucauaauuuuuugagaaaauguuugauacugcaaga

SEQ ID NO: 383910 - RNA, 64 nt, Homo Sapiens
uuuagaaauauccuaaucuaaaugggcaugugucuuuuuugaaggcuuuugaggucucagcaaa

SEQ ID NO: 383911 - RNA, 64 nt, Homo Sapiens
uuaacagaaaccaaucuuaggagggcuguuuuuuuuuuuugauggcagugaucgggaaggcucu

SEQ ID NO: 383912 - RNA, 64 nt, Homo Sapiens
guuaacauuaaugccugcuuucucuucuagaugauuuuuugaaaccauuacaacugaccaaguu

SEQ ID NO: 383913 - RNA, 64 nt, Homo Sapiens
caaagacuuaaagggcccaaagcuucugggagauuuuuuugaguugaguagugggcuaugcagg

SEQ ID NO: 383914 - RNA, 64 nt, Homo Sapiens
cucugaaaauuauuauacuuauucuuuacaacuauuuuuugaccacuggcuguuuuuucccugu

SEQ ID NO: 383915 - RNA, 64 nt, Homo Sapiens
caucugacaaagucacaaagacugaucacuuuuuuuuuuugagguccggaaguguuuccagaau

SEQ ID NO: 383916 - RNA, 64 nt, Homo Sapiens
uuuauauuaguaacaaaauuacugguaugaagaauuuuuugauggcagugaggacuugugauuc

SEQ ID NO: 383917 - RNA, 64 nt, Homo Sapiens
cauuaagucauuacuuauuauaaauuuguugauguuuuuugaagaccauguuuggccuuucuuu

SEQ ID NO: 383918 - RNA, 64 nt, Homo Sapiens
cagggucuggcucugucaccuuuuuuuaauuguauuuuuugagauugccauuuuucuuuuauuu

SEQ ID NO: 383919 - RNA, 64 nt, Homo Sapiens
aaauguacacaauaaaacauuuuuguggguuuuuuuuuuugagacuccuauuuguggguucugu

SEQ ID NO: 383920 - RNA, 64 nt, Homo Sapiens
ggggaagcaagggguaauguuuuucucuauagccuuuuuugacuuagaguacaauuuaaagugu

SEQ ID NO: 383921 - RNA, 64 nt, Homo Sapiens
acaguacauauaucuauuucuuguguguuugauuuuuuuugacagucuuuuaauauuccaguau

SEQ ID NO: 383922 - RNA, 64 nt, Homo Sapiens
uuuuuucuuucuuucuuucuuuucuuuuuuuuuuuuuuuugagacggagucucacucuuguugc

SEQ ID NO: 383923 - RNA, 64 nt, Homo Sapiens
gaaaugaagaacaaaaaaaaagauugauuuuuuuuuuuuugagacaggaucucacucugucauc

SEQ ID NO: 383924 - RNA, 64 nt, Homo Sapiens
uaggacagugguuuuggggguuauccacuuuuauuuuuuugaaacuagcucucauucugucacc

SEQ ID NO: 383925 - RNA, 64 nt, Homo Sapiens
acagaugcucgccaccacaccuggcuaauuuuuuuuuuuugagacugagucucgcacugucacc

SEQ ID NO: 383926 - RNA, 64 nt, Homo Sapiens
acuaaucagucaaagggcaccauucuuuuuuuuuuuuuuugaaaccaaagcugucucagaaaug

SEQ ID NO: 383927 - RNA, 64 nt, Homo Sapiens
guuuuuaagaauggaaucauccaaaggaauuccuuuuuuugagguuuggauguugcagcuagua

SEQ ID NO: 383928 - RNA, 64 nt, Homo Sapiens
uuauucagauacuccccuuuuuaaagcccuuuuguuuuuugauuuauauacucuguuuuacaga

SEQ ID NO: 383929 - RNA, 64 nt, Homo Sapiens
acaaagcccccucuugggggguuggggaagucucuuuuuugaaacacuucagaacugcugcuau

SEQ ID NO: 383930 - RNA, 64 nt, Homo Sapiens
ccaggguauagccagauaagagaaacaaacuauuuuuuuugauggauugcaguaaacgaucacu

SEQ ID NO: 383931 - RNA, 64 nt, Homo Sapiens
gaaugauacuuuuucauucacauucaagaauuaauuuuuugaagauuuaaguuacauaauggaa

SEQ ID NO: 383932 - RNA, 64 nt, Homo Sapiens
caggagcuucucugaugugauauccacuuuuuuuuuuuuugagauggagucucacucugucacc

SEQ ID NO: 383933 - RNA, 64 nt, Homo Sapiens
ccuugugaucugcccgccuccauuuuuguuguuauuuuuugagaaagauagauaugagguuuag

SEQ ID NO: 383934 - RNA, 64 nt, Homo Sapiens
uccuccuuuucuuucucucucucucucucucucuuuuuuugacagacucucguucuguggcccu

SEQ ID NO: 383935 - RNA, 64 nt, Homo Sapiens
aucugaaucaagauucauguuuuuuauuuuuauuuuuuuugauacagagucucacucugucacu

SEQ ID NO: 383936 - RNA, 64 nt, Homo Sapiens
cucccacaguagguauugaaacugguaaaaucaguuuuuugauaguguguguauauaagaaaaa

SEQ ID NO: 383937 - RNA, 64 nt, Homo Sapiens
cggagucucacucuguuacccugaauuuuuuuuuuuuuuugauagcaaagaaugaagugaaaaa

SEQ ID NO: 383938 - RNA, 64 nt, Homo Sapiens
caggguugcccaggguggaguacugucuuuuuuauuuuuugagaccccaguauagggauauuuu

SEQ ID NO: 383939 - RNA, 64 nt, Homo Sapiens
uuuuaauaauagccauucuaacuguacccagccauuuuuugacuugggauuacaggcaugagcc

SEQ ID NO: 383940 - RNA, 64 nt, Homo Sapiens
aacuuuuuguaauuuuuaugucugacuaccaaucuuuuuugagcagcacaucuagaauucagcu

SEQ ID NO: 383941 - RNA, 64 nt, Homo Sapiens
acauacauuauucacuuccagacuggguaucuuuuuuuuugaagaaaguuucauauauuuacuu

SEQ ID NO: 383942 - RNA, 64 nt, Homo Sapiens
cuguauuuuuagagcugaauauguagauaugugauuuuuugagauuuacuugucuuaguauuau

SEQ ID NO: 383943 - RNA, 64 nt, Homo Sapiens
uggaguuucacucuugucacuguguuuguuuuguuuuuuugagaugauuuacuuguuuuguuuu

SEQ ID NO: 383944 - RNA, 64 nt, Homo Sapiens
uuaauguauuuauuaaacaacauuucuaaguagauuuuuugacaacacccagccccuuuccaac

SEQ ID NO: 383945 - RNA, 64 nt, Homo Sapiens
cugagucucacuccaucagcuuuuuuuuuuuuuuuuuuuugagaaauacuccuuuccaacuucc

SEQ ID NO: 383946 - RNA, 64 nt, Homo Sapiens
uuuguagauauguuuccuaucaauauguauaauuuuuuuugaaugauaauuuuuaaaaaauuau

SEQ ID NO: 383947 - RNA, 64 nt, Homo Sapiens
auagagaaacuucgcuaaccaaguauuuuuaaauuuuuuugauagaaggcaucaaauaaacuca

SEQ ID NO: 383948 - RNA, 64 nt, Homo Sapiens
cggaguuucacucuugucacuaaauuuguuuuuguuuuuugagaacuuaacuccuuuuccacuu

SEQ ID NO: 383949 - RNA, 64 nt, Homo Sapiens
uuuaaaucacaaacucauuuuuuucuacaaacuauuuuuugaaaaacaguugauucuuuuugug

SEQ ID NO: 383950 - RNA, 64 nt, Homo Sapiens
gagauauauaaucaaaguacggccauuauuuugauuuuuugaauccuugcuguuagaagaaugu

SEQ ID NO: 383951 - RNA, 64 nt, Homo Sapiens
guuuucuuugcaugagaguuguuuuuuuuguuuguuuuuugaggaagaaaacaacuaacugagg

SEQ ID NO: 383952 - RNA, 64 nt, Homo Sapiens
gcauggaacauuguucuuaauaguugagaauugcuuuuuugaaaauuuucaugaaggaauuuug

SEQ ID NO: 383953 - RNA, 64 nt, Homo Sapiens
auuuuuccaacagucagcuauuuuauggcacacuuuuuuugacugaugacaucuccuuugcuau

SEQ ID NO: 383954 - RNA, 64 nt, Homo Sapiens
acgucauuuguuucaaugugacugaaacaaaauguuuuuugauaggaaggaaacuggaauucuu

SEQ ID NO: 383955 - RNA, 64 nt, Homo Sapiens
gucuuuacuggccauacaaaaugauuuuuuuuuuuuuuuugagacagagucuugcucugucacc

SEQ ID NO: 383956 - RNA, 54 nt, Homo Sapiens
aaucuugcuggcaagucugauucuuuuuuugauauggaccuguuggucuauguc

SEQ ID NO: 383957 - RNA, 64 nt, Homo Sapiens
aauacaaauguauaauauuccuuuuuuuuuuuuuuuuuuugagauggagucucacucuguugcc

SEQ ID NO: 383958 - RNA, 64 nt, Homo Sapiens
caacugguauuaauguuuuucuccugaaacuacuuuuuuugaugugggcaagagauuugaagug

SEQ ID NO: 383959 - RNA, 64 nt, Homo Sapiens
aauaaaguuucaaaauuugaauaaaauaauuaaauuuuuugaggaaguggagaagacauuuuua

SEQ ID NO: 383960 - RNA, 64 nt, Homo Sapiens
gaaacuuagauguaacuuagcacuuuuuuuuuuuuuuuuugagauggagucucacucugucacc

SEQ ID NO: 383961 - RNA, 64 nt, Homo Sapiens
acgcgcugccacacccagguaauuuauuuauuuuuuuuuugagacagagucucgcacuguugcc

SEQ ID NO: 383962 - RNA, 54 nt, Homo Sapiens
aacguugcuggcaagucugauucuuuuuuugauauggaccuguugguccauauc

SEQ ID NO: 383963 - RNA, 64 nt, Homo Sapiens
uauaauacaaauguauaauauucuuuuuuuuuuuuuuuuugagauggagucucacucuguugcc

SEQ ID NO: 383964 - RNA, 64 nt, Homo Sapiens
ugugaugaugcugugacaauaaguuugaaccuuuuuuuuugaaacagcagucccaguauucuca

SEQ ID NO: 383965 - RNA, 64 nt, Homo Sapiens
guggcaaaauaugguuugguuuuucuuuuuuuuuuuuuuugaaaguguuuuuucuucguccuuu

SEQ ID NO: 383966 - RNA, 64 nt, Homo Sapiens
uauugggcugcauccccagagaggauaugaauuauuuuuugaaaagacaggguuuugccaucgu

SEQ ID NO: 383967 - RNA, 64 nt, Homo Sapiens
cacgagccaccacaccuggccaaaaaaauuuauauuuuuugagacaaggucucacucugucacc

SEQ ID NO: 383968 - RNA, 64 nt, Homo Sapiens
gugccuggcuggauaugaaauuuuuuuuuuuuuuuuuuuugagacaggguuucgcucuuguugc

SEQ ID NO: 383969 - RNA, 64 nt, Homo Sapiens
aauguugacugaaauuuugucuacacuuagaacauuuuuugaaauucaguuuacagaaauugga

SEQ ID NO: 383970 - RNA, 64 nt, Homo Sapiens
uacuaugucaucaauaaucauaaaacguauuuuuuuuuuugagucagagucucgcucuguugcc

SEQ ID NO: 383971 - RNA, 64 nt, Homo Sapiens
uuaauuuuuucuuuucucccccaauuuuuuuuuuuuuuuugagaccgagucucauucugucgcc

SEQ ID NO: 383972 - RNA, 64 nt, Homo Sapiens
ugcgcccggccuuuuuuuuuucuuuucuuuucuuuuuuuugauacagagucuuagucacccaga

SEQ ID NO: 383973 - RNA, 64 nt, Homo Sapiens
ugacacauuuuuuuucuccccuuuuugguacacuuuuuuugaaugguuuucuaacaacuugaag

SEQ ID NO: 383974 - RNA, 64 nt, Homo Sapiens
aauuguguugaauuacuguaucuuuuacuuuuuuuuuuuugaaaagauaaacuuguaaauagag

SEQ ID NO: 383975 - RNA, 64 nt, Homo Sapiens
auuugaugagguuuuuuauuuguguuuuuguuuguuuuuugagauggagucucacucuguggcc

SEQ ID NO: 383976 - RNA, 64 nt, Homo Sapiens
uauguuuaaaaacugaauaaaaggaauagaauuuuuuuuugauaaaggaucacaaaacaauucu

SEQ ID NO: 383977 - RNA, 64 nt, Homo Sapiens
aaugcaacugauaggcuuuucuugaacuguuaguuuuuuugaaguaguuuuuucauguuuaauu

SEQ ID NO: 383978 - RNA, 64 nt, Homo Sapiens
gaaaugccacugugcauuuucugcagaugaaggguuuuuugaaugccaccucccuuccgcaggu

SEQ ID NO: 383979 - RNA, 64 nt, Homo Sapiens
ucugaaaugaauugauuuuuuuuguuuggaaaauuuuuuugauuccuaaagcaaaggcuccggg

SEQ ID NO: 383980 - RNA, 64 nt, Homo Sapiens
uggagucuuacucuuuugccaaauuuugugggguuuuuuugagaacugaaaaaggaaguaauau

SEQ ID NO: 383981 - RNA, 64 nt, Homo Sapiens
agggaaaugacccaaaggaaucccuuaagcaaaguuuuuugagauaagcucuuuagcuccaauu

SEQ ID NO: 383982 - RNA, 64 nt, Homo Sapiens
uggagucucgcucugucaccuuuuuuuuuuuuuuuuuuuugagaauaauguuauuucuuuccaa

SEQ ID NO: 383983 - RNA, 64 nt, Homo Sapiens
agacaagguucccuauguugcccagcuaauuuuauuuuuugaaauacaggcauauaccgccaca

SEQ ID NO: 383984 - RNA, 64 nt, Homo Sapiens
guuuuucaucaacugucaaacaggcuuguuacaauuuuuugacacuccaaaaauaugcauuuac

SEQ ID NO: 383985 - RNA, 64 nt, Homo Sapiens
cagaguuucacucuuguugcaagaacuuuuuuuuuuuuuugagacauacaggaagcucuuagaa

SEQ ID NO: 383986 - RNA, 64 nt, Homo Sapiens
cacagaugaguaaauuuaauuuaaauuuguguuauuuuuugaacgauggauuauaauaaaauac

SEQ ID NO: 383987 - RNA, 64 nt, Homo Sapiens
guacucuguagcaugacaauuguuacaaacuuaauuuuuugaaaaaacacuguuuucuuauguu

SEQ ID NO: 383988 - RNA, 64 nt, Homo Sapiens
ugaagucucgcucuguugccguuuuguguuuuguuuuuuugagauuugcuuguuugucgguuuu

SEQ ID NO: 383989 - RNA, 64 nt, Homo Sapiens
cggaguuucugucuuguugcuuuuuuuuuuuuuuuuuuuugagauuaauuauauggaucucuuu

SEQ ID NO: 383990 - RNA, 64 nt, Homo Sapiens
ccauuguauaaaauuaaaacaugaagaauauuuuuuuuuugagcauggcuaguggauuuaaaac

SEQ ID NO: 383991 - RNA, 64 nt, Homo Sapiens
caaauuaacagcugaacaccugcaacugcaaauguuuuuugauccgacguacugaaauaggaag

SEQ ID NO: 383992 - RNA, 64 nt, Homo Sapiens
ugaauccuauuccuauagcaauugcaaaucagcauuuuuugauuuuucccaaauucauuccaua

SEQ ID NO: 383993 - RNA, 64 nt, Homo Sapiens
uaaauuuacuaucauugcuaaacaucucgucaacuuuuuugauauagugcauugcuccuguuga

SEQ ID NO: 383994 - RNA, 64 nt, Homo Sapiens
cuuuuuugauauagugcauugcuccuguugaauguuuuuugacuacuuuuuauaacuuaagaau

SEQ ID NO: 383995 - RNA, 64 nt, Homo Sapiens
acagcugcugcuucuauuuugugaagggacuauauuuuuugagaaaggaaaaucucaguuagau

SEQ ID NO: 383996 - RNA, 64 nt, Homo Sapiens
augugccaucuccccaccccauuuuuuuuuuuuuuuuuuugaucagcaaagaaauacaggagac

SEQ ID NO: 383997 - RNA, 64 nt, Homo Sapiens
auaugauagaagguuuuuuuuuuuuuuuuuuuuuuuuuuugagacggagucccacucuugucgc

SEQ ID NO: 383998 - RNA, 64 nt, Homo Sapiens
uuuuguguuauugauuauauacaaaggagacuuuuuuuuugagauaacacucaaauaguauucu

SEQ ID NO: 383999 - RNA, 64 nt, Homo Sapiens
uuagucacuggggcagggggcuuuuuuaaaaaaauuuuuugaucugccaucuugagauuuuuua

SEQ ID NO: 384000 - RNA, 64 nt, Homo Sapiens
aaucagcaguucugaugccucugcuucgagaaaauuuuuugaaagaaaacugcugugguugcug

SEQ ID NO: 384001 - RNA, 64 nt, Homo Sapiens
cggagucucgcucugucgccacuuuuuuuuuuuuuuuuuugagauagaaugaagaaggcaaaaa

SEQ ID NO: 384002 - RNA, 64 nt, Homo Sapiens
cggagucucacucuuccgccuuucuuuuuuuuuuuuuuuugagacacuuauauaagggauaauu

SEQ ID NO: 384003 - RNA, 64 nt, Homo Sapiens
uggaguuuugcucuuguugcaauaaauauauauauuuuuugagaagguuuugcuuuucuguccu

SEQ ID NO: 384004 - RNA, 64 nt, Homo Sapiens
cagagucuugcucugcuggauuuuuuuuuuuuuuuuuuuugagggauguguagcuguguucaau

SEQ ID NO: 384005 - RNA, 64 nt, Homo Sapiens
ucagaagcuuccuauucuuuuuuuuuuuuuuuuuuuuuuugagacagggucuuucucuguugcc

SEQ ID NO: 384006 - RNA, 64 nt, Homo Sapiens
gggacuacaagugugcaccaccaugccuggcuaauuuuuugaauuuuuguagugaugggaucuc

SEQ ID NO: 384007 - RNA, 64 nt, Homo Sapiens
aauaauaaagagauuuucaugguuuauaaaaaucuuuuuugauaugauaauaaucaugaucaca

SEQ ID NO: 384008 - RNA, 64 nt, Homo Sapiens
cugacauaaaaacagugcuauucugagugaaaauuuuuuugaugugcuuacauaaccaugguga

SEQ ID NO: 384009 - RNA, 64 nt, Homo Sapiens
uucauuuggaauguacauacugaaaaauacagguuuuuuugaccaaaaguuuuuauaucuuuuc

SEQ ID NO: 384010 - RNA, 64 nt, Homo Sapiens
ccuuuguucaauaaaggaaauaugcacugcucacuuuuuugaaggaaaugccaaaguuacguuu

SEQ ID NO: 384011 - RNA, 64 nt, Homo Sapiens
aucauugucuguuaauguauuauauuuugagauuuuuuuugaucuaagguuuuauuguuuguau

SEQ ID NO: 384012 - RNA, 64 nt, Homo Sapiens
agaaguucaaaaaccaucccuuaaaggugauuguuuuuuugagacagagucuugcucugucacc

SEQ ID NO: 384013 - RNA, 64 nt, Homo Sapiens
augaauucagaauugcuuuuaaauauauaggggguuuuuugaaauuuauuacagugcaauugaa

SEQ ID NO: 384014 - RNA, 64 nt, Homo Sapiens
uuuguuuguaagaugaucacgcucucugaauugauuuuuugaguguggucuccaaggccacgcu

SEQ ID NO: 384015 - RNA, 64 nt, Homo Sapiens
cuuuugacacaguuauuaguaauuaauuucaggguuuuuugagguggugacaguaaagcuggaa

SEQ ID NO: 384016 - RNA, 64 nt, Homo Sapiens
auuuuauauacuuuauaaugcaaaauuguuccuuuuuuuugaaauucaguaauacaaugaaaag

SEQ ID NO: 384017 - RNA, 64 nt, Homo Sapiens
uaauuucacucuuguugcccuuuuuuauuuuuauuuuuuugagauuaaaaugugauucuguaac

SEQ ID NO: 384018 - RNA, 64 nt, Homo Sapiens
cauggucacgcugugucgccuggcguuuaguuuguuuuuugagaccuuccaucuuggcuaguug

SEQ ID NO: 384019 - RNA, 64 nt, Homo Sapiens
cugauuuuaaguacauuuuuaaaacuuaaaaccauuuuuugacugggagcuaauuaagaguauu

SEQ ID NO: 384020 - RNA, 64 nt, Homo Sapiens
uggagaggaaaaacuuggggagauaaaauagugcuuuuuugaaacaaccagcucuuggauguga

SEQ ID NO: 384021 - RNA, 64 nt, Homo Sapiens
auguaaauacagugaccaugacauauacacauauuuuuuugauaaagaacaaguucaaacugau

SEQ ID NO: 384022 - RNA, 64 nt, Homo Sapiens
auauacuggagaaacuuugaucuugagcuuuaucuuuuuugacagaaaguuuauuuaaaccacu

SEQ ID NO: 384023 - RNA, 64 nt, Homo Sapiens
cagagucuugcucuguugccauuuauuauuauuauuuuuugagauucucucuguacuuuauuua

SEQ ID NO: 384024 - RNA, 64 nt, Homo Sapiens
uucucugacaaucugucuuaauaaaugggucauguuuuuugaucgguuuuuuuauagacaguau

SEQ ID NO: 384025 - RNA, 64 nt, Homo Sapiens
uaagaguauuuuaagauguacuaugcuauuuuacuuuuuugauauaaaaucaagauauuucuuu

SEQ ID NO: 384026 - RNA, 64 nt, Homo Sapiens
acauauuugaaaauaagcuuauauguauuugaacuuuuuugaaauccuauucaaguauuuuuau

SEQ ID NO: 384027 - RNA, 64 nt, Homo Sapiens
gaacaacucauacuuuggaacuaaacuguuucguuuuuuugaaaacaguaucacagacauuaag

SEQ ID NO: 384028 - RNA, 64 nt, Homo Sapiens
uuagcauauuauuuccuguaaagacaguuguugguuuuuugauucaugcauaacagugugcuga

SEQ ID NO: 384029 - RNA, 64 nt, Homo Sapiens
gcgggagggaggaaguacgauuggagucucuucuuuuuuugauaccaggcucuacuccauccca

SEQ ID NO: 384030 - RNA, 64 nt, Homo Sapiens
agagaauuuuggaaaguaccugcuucccuuauacuuuuuugaucacuguaauuuuuuaauggug

SEQ ID NO: 384031 - RNA, 64 nt, Homo Sapiens
uuuauuccuuauucccucuuaaggaaauuguacauuuuuugaaauugguucugaaacuucucua

SEQ ID NO: 384032 - RNA, 64 nt, Homo Sapiens
cuugccuaacaugcaugugcuuugugauuuuuuuuuuuuugauauuuuuuuuaggauuuuugcu

SEQ ID NO: 384033 - RNA, 64 nt, Homo Sapiens
uauuaaagccuuuauuccauacacuaaacacuccuuuuuugacaagagacaaaaauuuauuaua

SEQ ID NO: 384034 - RNA, 64 nt, Homo Sapiens
gagacaaaaauuuauuauaaagaagagguugggcuuuuuugaaauauuauacauauuuuggugg

SEQ ID NO: 384035 - RNA, 64 nt, Homo Sapiens
ggccuaagggucauuuuuuccucaugucaagguuuuuuuugauaucuuaaaauaauuugucuua

SEQ ID NO: 384036 - RNA, 64 nt, Homo Sapiens
gguuuuuuuugauaucuuaaaauaauuugucuuauuuuuugaugguuugaaugcuugcuuucuu

SEQ ID NO: 384037 - RNA, 64 nt, Homo Sapiens
gaguguaagaguguaaagaaaugccuuuuuuuuuuuuuuugaguuggaguuuugcucuugucgc

SEQ ID NO: 384038 - RNA, 64 nt, Homo Sapiens
auggucaguuuuuucuuuuuucuuuucuuuucuuuuuuuugagacagaguuucgcuuuuguugc

SEQ ID NO: 384039 - RNA, 64 nt, Homo Sapiens
caaagucucgcacugucuccuuuuuuuuuuuuuuuuuuuugagagugaaacaagauucuuuuuc

SEQ ID NO: 384040 - RNA, 64 nt, Homo Sapiens
ugcuuccugaaauagcacaagaguuggaaaauauuuuuuugaaagcucccagaauaaaaucaua

SEQ ID NO: 384041 - RNA, 64 nt, Homo Sapiens
uucagccuucucucucuuuuuuuuuuuuuuuuuuuuuuuugagauggaauuuugcucuuuugcc

SEQ ID NO: 384042 - RNA, 64 nt, Homo Sapiens
uggugaugagcagaaaucagaccuuuuucuaugcuuuuuugaauaucagaguaggaugaacacc

SEQ ID NO: 384043 - RNA, 64 nt, Homo Sapiens
uggagucuugcucugucgccuguuuguuuguuuguuuuuugagaacauuuuuuguuuguuuguu

SEQ ID NO: 384044 - RNA, 64 nt, Homo Sapiens
cggaguuucccucuugucacuuuuuuuauuuuaauuuuuugagauuccuucuuuuucuuuuuuu

SEQ ID NO: 384045 - RNA, 64 nt, Homo Sapiens
ggagucucgcucugucgccccuaauuuuuuuuuuuuuuuugagagcaugcaccaccacacccag

SEQ ID NO: 384046 - RNA, 64 nt, Homo Sapiens
cggagucuuguucuguugcccucuuuuuuuuuuuuuuuuugagaugucuugccuaaugcauauu

SEQ ID NO: 384047 - RNA, 64 nt, Homo Sapiens
gaaaugucuacuuuuccuguuccuguuuccugacuuuuuugagauuguaagcauugguacagug

SEQ ID NO: 384048 - RNA, 64 nt, Homo Sapiens
uggagucuugcucuguugccacugguuucuuucuuuuuuugagagagaguuucuguauaacaua

SEQ ID NO: 384049 - RNA, 64 nt, Homo Sapiens
ugcaaagcuuuauguauuaaacuaaagugucuaguuuuuugaaaaaaaccuuuguaauauuguu

SEQ ID NO: 384050 - RNA, 64 nt, Homo Sapiens
gcuauaaccuaaccucgacucuugaacuagucgauuuuuugaagggccuuuccuuggugugaca

SEQ ID NO: 384051 - RNA, 64 nt, Homo Sapiens
augaagaaguuagagcuuuacaugcuuauuuguguuuuuugaaaauggguaacuuuauuuuuuu

SEQ ID NO: 384052 - RNA, 64 nt, Homo Sapiens
agcuuuuauuuucaacaugucaacaaaaauaacauuuuuugaaaaagacauguauguggacugu

SEQ ID NO: 384053 - RNA, 64 nt, Homo Sapiens
auuuucagcuuugugggccuaaauuuuugcauaauuuuuugauguuaauauuggagcuaaauac

SEQ ID NO: 384054 - RNA, 64 nt, Homo Sapiens
cucaauucuuuuguuguuuuuugguuuuugaaucuuuuuugagauggaaucucgcucugucgcc

SEQ ID NO: 384055 - RNA, 64 nt, Homo Sapiens
auuuugccauuaagcauaguauuugaugcagguuuuuuuugauugaugcaggggaucaaauuua

SEQ ID NO: 384056 - RNA, 64 nt, Homo Sapiens
agcugcuaugacuuugguagagaggugcaauauguuuuuugaaccagcuauaaaagaaauuaag

SEQ ID NO: 384057 - RNA, 64 nt, Homo Sapiens
uuuggguuuuuucuguuuuuuuuuuuuuuuuuuuuuuuuugaagguggggaggggaauauacac

SEQ ID NO: 384058 - RNA, 64 nt, Homo Sapiens
ugauuuuuuuaaauuaaagaauucagaauaaacauuuuuugauccacuugcgugauuugcuuug

SEQ ID NO: 384059 - RNA, 64 nt, Homo Sapiens
cagagucucacucugucccccuuuuuuuuuuuuuuuuuuugagacucccagguucaagcgauuc

SEQ ID NO: 384060 - RNA, 64 nt, Homo Sapiens
cuugcucugucacugaggcuccagcugccuuuuuuuuuuugaguacaggcaugagccaccgcgc

SEQ ID NO: 384061 - RNA, 64 nt, Homo Sapiens
uuuaguagagacaggguuucaugccuggcuaauuuuuuuugauugacuacaggcgccuaucacc

SEQ ID NO: 384062 - RNA, 64 nt, Homo Sapiens
cagagucucacucugucaccuuuuaaucuuuuauuuuuuugagaaaguuccuacccuuuuuuuu

SEQ ID NO: 384063 - RNA, 64 nt, Homo Sapiens
cacuuugagaaauuaauuuuucagauuuaauuuguuuuuugaagaucaguuaaacaaaaaggag

SEQ ID NO: 384064 - RNA, 64 nt, Homo Sapiens
auauuaucaguuaaacaaaaaaaacaucaaagauuuuuuugacuguuuauguuaguuuauuaug

SEQ ID NO: 384065 - RNA, 64 nt, Homo Sapiens
uuuguaggacaaaacauagcuugcguuuaauauauuuuuugaacgacauuauguaaaagaaagg

SEQ ID NO: 384066 - RNA, 64 nt, Homo Sapiens
uugcugacuuuaaaaggauuaauaucucuugugcuuuuuugauuagauucaaguugugucugaa

SEQ ID NO: 384067 - RNA, 64 nt, Homo Sapiens
aagaagagaaauaccccaaguucuugaaaaaaaauuuuuugauaugacuacucuaacaguaaua

SEQ ID NO: 384068 - RNA, 64 nt, Homo Sapiens
auauauuuuuuaaaaaacaauucuuguaaaauacuuuuuugauuagccuucugaccaugauuaa

SEQ ID NO: 384069 - RNA, 64 nt, Homo Sapiens
uuuuuuuuuguuuuuuuuuuguuuuuuuuuguuuuuuuuugagacggagucucgcucugucacc

SEQ ID NO: 384070 - RNA, 64 nt, Homo Sapiens
uaaagugaauuaacauuuggugauuaugccuagcuuuuuugacuaauauaaagaucauagcucc

SEQ ID NO: 384071 - RNA, 64 nt, Homo Sapiens
augagggaugggggaaaguaaaagauguuuuuuuuuuuuugagacucgcuuugucacccaggcu

SEQ ID NO: 384072 - RNA, 64 nt, Homo Sapiens
uuuaucuugguguaguuuuggcuuuuuuguuuguuuuuuugagacagcaucucacacugucgcc

SEQ ID NO: 384073 - RNA, 64 nt, Homo Sapiens
acccagaaaaauguauggaugaauuuuuuuuuuuuuuuuugagacaaagucucacugugucaug

SEQ ID NO: 384074 - RNA, 64 nt, Homo Sapiens
agagagccuacuaggaaaugugcagaauaaacuauuuuuugaaggaaacacuuuggccuugacu

SEQ ID NO: 384075 - RNA, 64 nt, Homo Sapiens
uauuaaauuaucccacaaguggguuuuaggcuccuuuuuugagccaaaauggaagcugggaauc

SEQ ID NO: 384076 - RNA, 64 nt, Homo Sapiens
ggggaacaaaccccuaugcacuuuucuuuuuuuuuuuuuugagauggaguuucucuugucaacc

SEQ ID NO: 384077 - RNA, 64 nt, Homo Sapiens
acugacuuucucucucucucucucucucuuuuuuuuuuuugacagagucucgcacuguugccug

SEQ ID NO: 384078 - RNA, 64 nt, Homo Sapiens
agccugaguuucucuuucucucuuuuuaacuuuauuuuuugaaaaacccgguagacuuuuugug

SEQ ID NO: 384079 - RNA, 64 nt, Homo Sapiens
auuuguauacacauaaugagagaauuguuuugcauuuuuugaauuaucugaaaugcuugaaacc

SEQ ID NO: 384080 - RNA, 64 nt, Homo Sapiens
cggggucuggcuguguugccuuuuuuuuuuuuuuuuuuuugagaaaaaaggcuguuuuuuguuu

SEQ ID NO: 384081 - RNA, 64 nt, Homo Sapiens
cagaguuucgcucuuguugcuuuuuuuuuuuuuuuuuuuugagaccauaucucuaauagaaucu

SEQ ID NO: 384082 - RNA, 64 nt, Homo Sapiens
uagggucucacuuuguuaccuuuuauuuauuuauuuuuuugagagccaagcuugaguuuuuauu

SEQ ID NO: 384083 - RNA, 64 nt, Homo Sapiens
acacaucaguagaaaccaagccgagcuugucagcuuuuuugaaauucaguuucuacauuucaga

SEQ ID NO: 384084 - RNA, 64 nt, Homo Sapiens
guccuccaaguccguguuaauccucccaucacuguuuuuugaagaagacuuuuaaaacuggauu

SEQ ID NO: 384085 - RNA, 64 nt, Homo Sapiens
uugcuuccagcaguggaaaauuuugggccagcccuuuuuugacaauugacagcucugggucuuu

SEQ ID NO: 384086 - RNA, 64 nt, Homo Sapiens
uuuauucagaagcaguuaucuuuuaagaaauugcuuuuuugaacccucagaagcacucuuuuac

SEQ ID NO: 384087 - RNA, 64 nt, Homo Sapiens
ugucacagaggcuguguguguaagagaaugcagcuuuuuugaguauaaucguuggugguccuac

SEQ ID NO: 384088 - RNA, 64 nt, Homo Sapiens
caauaaaauguuauaugaaauuauuuuauuuuuauuuuuugaccuagaauccugguguaggguu

SEQ ID NO: 384089 - RNA, 64 nt, Homo Sapiens
aaaaagaauuuuuuuuuuccgaaugugcuuugcuuuuuuugauuuuuuguuuuuuuccucuuuc

SEQ ID NO: 384090 - RNA, 64 nt, Homo Sapiens
aaaacaaggccagccccaacugauuaaaaaaauuuuuuuugaaagccaaaauaaauauucuucc

SEQ ID NO: 384091 - RNA, 64 nt, Homo Sapiens
gcaugcaguaaagaucacuuuuuuuuuuuuuuuuuuuuuugagauggagucuugcucugucgcc

SEQ ID NO: 384092 - RNA, 64 nt, Homo Sapiens
acagagauggugauuuguuuaguuucaucuuagauuuuuugagaacucaccagcuuuuauuacc

SEQ ID NO: 384093 - RNA, 64 nt, Homo Sapiens
uguuuuugaaaauuaugacuuagacuauuucauauuuuuugaaauucagucagcucucagucac

SEQ ID NO: 384094 - RNA, 64 nt, Homo Sapiens
cacagucucacucucacccaacuguuccccauuuuuuuuugaacuacuuuaaauuuuggugaua

SEQ ID NO: 384095 - RNA, 64 nt, Homo Sapiens
uuauguuuaaaauucauucucuuacucaacuugcuuuuuugaguauagugucugaaugugaagu

SEQ ID NO: 384096 - RNA, 64 nt, Homo Sapiens
cuuucuacauauagugucugaacauacuguuucauuuuuugaagucacacauguauguucucca

SEQ ID NO: 384097 - RNA, 64 nt, Homo Sapiens
gauagcacagugauaaaucaccuuucaauguuguuuuuuugauugugagauuuaaaaauuuuuc

SEQ ID NO: 384098 - RNA, 64 nt, Homo Sapiens
aguaaaauugacuucauauauuauuagacuaacauuuuuugagaggaaauagauuucaggucuu

SEQ ID NO: 384099 - RNA, 64 nt, Homo Sapiens
uuuuccaaucacaccuuggcgccugagguugcaauuuuuugaaugauguccuuaacccauuuau

SEQ ID NO: 384100 - RNA, 64 nt, Homo Sapiens
cagagucucacuauguugcccuuuuuuuuuuuuuuuuuuugagagcuuacaugguuaguuguau

SEQ ID NO: 384101 - RNA, 64 nt, Homo Sapiens
uuucaauggugugaaauaaaaggccaguaaugauuuuuuugaagucgaaagacagcucagguga

SEQ ID NO: 384102 - RNA, 64 nt, Homo Sapiens
cagaguuuugcucuuguuguuuuuuuuuuuuuuuuuuuuugagauuuuucuuuuucuuuucuuu

SEQ ID NO: 384103 - RNA, 64 nt, Homo Sapiens
uacacaggaauaguuaaaugcauuuguuuguuuguuuuuugagacagaguuucacucuuguugc

SEQ ID NO: 384104 - RNA, 64 nt, Homo Sapiens
ccacgcccagccaucaaugcauuuuuuuuauuuuuuuuuugagacagaguuucgcacuucuugc

SEQ ID NO: 384105 - RNA, 64 nt, Homo Sapiens
gguuuugcuauagaaauuggaaaauaaaggccacuuuuuugaaauccccaguuuaauuaaacca

SEQ ID NO: 384106 - RNA, 64 nt, Homo Sapiens
ugcaguacaucuggaauuguagucgaugaauugcuuuuuugacuuagaagcugaagaaaauaga

SEQ ID NO: 384107 - RNA, 64 nt, Homo Sapiens
guucuauauggucagcuucaucuuccuuuuuuuuuuuuuugagauggaguuucgcucuuguugc

SEQ ID NO: 384108 - RNA, 64 nt, Homo Sapiens
ccuuuaaaagcauauugcauuuaguacagagcucuuuuuugaaaugaaggcuggagaugugcau

SEQ ID NO: 384109 - RNA, 64 nt, Homo Sapiens
uugaugcacuguugccaaggaaggcuuuuucugauuuuuugacaaaugaauuuuugcacacuuu

SEQ ID NO: 384110 - RNA, 64 nt, Homo Sapiens
caaaugguuaagcccucuucuuuacucuuaauuuuuuuuugagacagagucacccaggcuggag

SEQ ID NO: 384111 - RNA, 64 nt, Homo Sapiens
aucugauggguguuuuuuuuuguuuuguuuuuuguuuuuugagauggaguuuugcucuuguugc

SEQ ID NO: 384112 - RNA, 64 nt, Homo Sapiens
uggagucucgcucuguugcccuugcuuuuuuuuuuuuuuugagagguguuagauguuagcacau

SEQ ID NO: 384113 - RNA, 64 nt, Homo Sapiens
aagucuugggucucaaacacccucuuuuucagcauuuuuugagacauauauauaugcacacaca

SEQ ID NO: 384114 - RNA, 64 nt, Homo Sapiens
ugaaaagacuuuuuaaaaaaaaaugcaaaacuuuuuuuuugaaacuauuugagucucuugagac

SEQ ID NO: 384115 - RNA, 64 nt, Homo Sapiens
uuuaagcuaagcauguguaaagggguggugcugcuuuuuugaaauuaaauuauaauuugggggg

SEQ ID NO: 384116 - RNA, 64 nt, Homo Sapiens
aucccaguccaaauuuuuuuuuuuuuuuuuuuuuuuuuuugagacagagucuugcucugucacc

SEQ ID NO: 384117 - RNA, 64 nt, Homo Sapiens
uccuuagugucuugaaguuuugcacaaaauucuuuuuuuugagauggagucucacucugucacc

SEQ ID NO: 384118 - RNA, 64 nt, Homo Sapiens
gaaaacuuuuuauacucuaauucuuuuuuuuuuuuuuuuugagacagaguuuuagucuuguuuc

SEQ ID NO: 384119 - RNA, 64 nt, Homo Sapiens
gcuagacuuacaaauuauuuuaaaugcauuuaucuuuuuugacacuauucaguggaauguguaa

SEQ ID NO: 384120 - RNA, 64 nt, Homo Sapiens
uuacacuaauuugaacucuuaaagauugcugcuuuuuuuugauauugucaauaaugaaacccaa

SEQ ID NO: 384121 - RNA, 64 nt, Homo Sapiens
aaagacacaauaagaagaguuuaauuuuuuuuuuuuuuuugagccugggcgacagagugagacu

SEQ ID NO: 384122 - RNA, 64 nt, Homo Sapiens
cccaauguguagucuuuguuuuuuucuuuuuuuuuuuuuugagacugagucucauucuaucacc

SEQ ID NO: 384123 - RNA, 64 nt, Homo Sapiens
ggcaucuuggugggggcaccuuuuuaaacauuuuuuuuuugagagagagccuuguucugucacc

SEQ ID NO: 384124 - RNA, 64 nt, Homo Sapiens
ugccaccacaccuggcuaacuuuuuuuuuuuuuuuuuuuugagauggcaucuugcucugucgcc

SEQ ID NO: 384125 - RNA, 64 nt, Homo Sapiens
cacugacuuugacguccaggccuuccgggucaccuuuuuugaugaaaccaggugaugcagccgc

SEQ ID NO: 384126 - RNA, 64 nt, Homo Sapiens
cuuucuuuuuuuuuuuuuuucuuuucuuuuuuuuuuuuuugagacggagucucgcucugucacc

SEQ ID NO: 384127 - RNA, 64 nt, Homo Sapiens
agccccaggggcagaagagacccaaccacuucuauuuuuugaggcuaugaauauaguaccugaa

SEQ ID NO: 384128 - RNA, 64 nt, Homo Sapiens
caaaguuuugcucuugucacucuuuuuuuuuuuuuuuuuugagacacugugcccggccuaugau

SEQ ID NO: 384129 - RNA, 64 nt, Homo Sapiens
ccaaaucuugcucuguggccgauuuuuuuuuuuuuuuuuugagauaccuggauuaaugaacuau

SEQ ID NO: 384130 - RNA, 64 nt, Homo Sapiens
aaaggaaaagucaacaucuucucucuuuuuuuuuuuuuuugagacagggucucacuauguugcc

SEQ ID NO: 384131 - RNA, 64 nt, Homo Sapiens
caacuccuccuugccugcuuuucuuuuuuuuucuuuuuuugagacggcgcaccuaucacccagg

SEQ ID NO: 384132 - RNA, 64 nt, Homo Sapiens
gagaaucacaaauggaaaauaauuccauaauuauuuuuuugaccuugccuaugauugauuagga

SEQ ID NO: 384133 - RNA, 64 nt, Homo Sapiens
uuuuuuucuuuuuuucuuuuuucuuuucuuuuuuuuuuuugagauggagucucacucugucacc

SEQ ID NO: 384134 - RNA, 64 nt, Homo Sapiens
aucuuucagccaaucaagucguuguaaacguggcuuuuuugaaaguguuauggcuauguuuuau

SEQ ID NO: 384135 - RNA, 64 nt, Homo Sapiens
ccuucccuuucuccuucuuuucccuuuuuuuuuuuuuuuugaccugggaguaauaaaguuacuu

SEQ ID NO: 384136 - RNA, 64 nt, Homo Sapiens
caucauuauuggcaguuucugcagccaguuguguuuuuuugaaacagggugauaaugucaauug

SEQ ID NO: 384137 - RNA, 64 nt, Homo Sapiens
uucccaaccuuguuugaagcaauauuuuaagcacuuuuuugaacuguagauuucaaauuuuauu

SEQ ID NO: 384138 - RNA, 64 nt, Homo Sapiens
cuguucucuuuuucuagcuuccacaucagcuuccuuuuuugagaacauauagaagaagaaggcu

SEQ ID NO: 384139 - RNA, 64 nt, Homo Sapiens
aauaauuauuuuuuaaaaaaaauuuuuaaaaagguuuuuugagacagauucuugcucugucacc

SEQ ID NO: 384140 - RNA, 64 nt, Homo Sapiens
cagagucucucucugucccccaucuuuuuuucuuuuuuuugagaaagaagauugauuauuuccu

SEQ ID NO: 384141 - RNA, 64 nt, Homo Sapiens
uuuacaaauugccccauucuguagaguucugcaguuuuuugaagauuuaggacaacauaagcaa

SEQ ID NO: 384142 - RNA, 64 nt, Homo Sapiens
uuacuagacuuuucuuuuuaaggaagugcuguuuuuuuuugaggguuuucaaaacauuuugaaa

SEQ ID NO: 384143 - RNA, 64 nt, Homo Sapiens
ugaggguuuucaaaacauuuugaaaagcauuuacuuuuuugaccacgagccaugaguuuucaaa

SEQ ID NO: 384144 - RNA, 64 nt, Homo Sapiens
acaagacuuugacaggggugccuaauuuuuuuuuuuuuuugagauggagucucgcucuguugcc

SEQ ID NO: 384145 - RNA, 64 nt, Homo Sapiens
ucuuguauauggauauccaauuguuucacacaauuuuuuugaaaagaauauccuuggcagggca

SEQ ID NO: 384146 - RNA, 64 nt, Homo Sapiens
aaaguauacuuuauuucuugaaaaauauuacagauuuuuugaaaauugaauaaugucaucauuc

SEQ ID NO: 384147 - RNA, 64 nt, Homo Sapiens
aagagagagauucuuuuguuuguuuguucguuuguuuuuugagacugaguuucacucuuucgcc

SEQ ID NO: 384148 - RNA, 64 nt, Homo Sapiens
aauauacaaaaucauauauauauauauguucuuguuuuuugagacagagucucacacuguugcc

SEQ ID NO: 384149 - RNA, 64 nt, Homo Sapiens
uaaacagaaucauacaauauuugauuuuuuuuuuuuuuuugaaacuaagccuugcucugucucc

SEQ ID NO: 384150 - RNA, 64 nt, Homo Sapiens
uuuuuaaguuauuauuauuauuauuauuuuuuuuuuuuuugagauggagucucgcucugucgcc

SEQ ID NO: 384151 - RNA, 64 nt, Homo Sapiens
ugugagccacugcgccuggcuaaguuauuauuauuuuuuugagacagucuccuggugucaccca

SEQ ID NO: 384152 - RNA, 64 nt, Homo Sapiens
gaaugugggaaauuauuuugucacuuuuuuuuuuuuuuuugagauggaauuuugcucgucaccc

SEQ ID NO: 384153 - RNA, 64 nt, Homo Sapiens
ucugaguucugcuggcagcuuccagaggauugccuuuuuugaggacauuguugaucucaggcga

SEQ ID NO: 384154 - RNA, 64 nt, Homo Sapiens
agguuauguccugucagggauuauuucuuuuuuauuuuuugaagguugguuuggcuguaggcuu

SEQ ID NO: 384155 - RNA, 64 nt, Homo Sapiens
uggaguuuugcucuuguugcuuuuuuuuuuuuuuuuuuuugagaaaaaacacaggauuuuuuuu

SEQ ID NO: 384156 - RNA, 64 nt, Homo Sapiens
cggagucucacucugucgccuuccuuuuuuuuuuuuuuuugagaaucgugcccagcuagacguc

SEQ ID NO: 384157 - RNA, 64 nt, Homo Sapiens
cagaguuucacucuuguuguaucuuuuuuuuuuuuuuuuugagaaaugaaauguggggacauag

SEQ ID NO: 384158 - RNA, 64 nt, Homo Sapiens
cacagucucgcucugucaccuguuuguuuguuguuuuuuugagacucugccuggcugguuauuu

SEQ ID NO: 384159 - RNA, 64 nt, Homo Sapiens
uggauucucacuguugccaguuuuuuuuuuuuuuuuuuuugagauauggaaugcuuuuagguuu

SEQ ID NO: 384160 - RNA, 64 nt, Homo Sapiens
cggaguccuugcccaggcugaguucuuuuuuuuuuuuuuugagaagccaccacacccggccccc

SEQ ID NO: 384161 - RNA, 64 nt, Homo Sapiens
uggagucuuacucuguugccuuuuuuuuuuuuuuuuuuuugagcucccaaauuguucguuuuac

SEQ ID NO: 384162 - RNA, 64 nt, Homo Sapiens
cagagucucacucuuguugcuuuuuuuuuuuuuuuuuuuugagagacgagaaaguugguuguuu

SEQ ID NO: 384163 - RNA, 64 nt, Homo Sapiens
auguuuccugucugccugcauuuucuaauauuuauuuuuugagccugaauaaguauuuuuaaag

SEQ ID NO: 384164 - RNA, 64 nt, Homo Sapiens
agugaguaauaauguaauucuugaaaaaauuagauuuuuugaaauucaaaguaugcuuaacuuu

SEQ ID NO: 384165 - RNA, 64 nt, Homo Sapiens
auuuucuauuugagauugguuauuuuuauuguuuuuuuuugagugcauuauuuuuauuguauuu

SEQ ID NO: 384166 - RNA, 64 nt, Homo Sapiens
aagucuaauaaaucuagaagugaauggguuuuucuuuuuugaagcaaaaaaaaaauuuguuuuu

SEQ ID NO: 384167 - RNA, 64 nt, Homo Sapiens
ggguuuuucuuuuuugaagaaaaaaaaaaauuuguuuuuugaauacagagugagacccugucuc

SEQ ID NO: 384168 - RNA, 64 nt, Homo Sapiens
cagggugucacuuugucccccaccaauguauaauuuuuuugagaaccuaugaaagaugcuagag

SEQ ID NO: 384169 - RNA, 64 nt, Homo Sapiens
uaguacuuuauaaaagggaguaaagagauaguacuuuuuugauauuuuuugagauaguacuuuu

SEQ ID NO: 384170 - RNA, 64 nt, Homo Sapiens
uaguacuuuuuaaagagauaauuuucuauuuuucuuuuuugagacagccuguuuuuugauucuu

SEQ ID NO: 384171 - RNA, 64 nt, Homo Sapiens
cuuauuuucuauuuuucuuucuuuucccagccuguuuuuugauuuggccaacagaugucagcca

SEQ ID NO: 384172 - RNA, 64 nt, Homo Sapiens
ccccuuccacuuugaguaccaaauccacaagccauuuuuugaggagagugaaagagaguaccau

SEQ ID NO: 384173 - RNA, 64 nt, Homo Sapiens
acuagcauuuucuugaaccaauaauguauuaaaauuuuuugaugucagccuugcaucaagggcu

SEQ ID NO: 384174 - RNA, 64 nt, Homo Sapiens
gacaaguacuggcucuuuauucauuaagcuuuuuuuuuuugaaccccauucuuuccuucucuga

SEQ ID NO: 384175 - RNA, 64 nt, Homo Sapiens
uggggucuguaaauacuggugcacuucuuacgacuuuuuugagacaugggauccaauuuuaaua

SEQ ID NO: 384176 - RNA, 64 nt, Homo Sapiens
uggaguuucacccuuauugcuauuuuauuuuuauuuuuuugagaauuguuucuuuucauuuguu

SEQ ID NO: 384177 - RNA, 64 nt, Homo Sapiens
guguguggcaagucccccuucucaugagaucugguuuuuugaaaucauaagaucucagugaguu

SEQ ID NO: 384178 - RNA, 64 nt, Homo Sapiens
cggaguuucacgcuuauugcaaacuuuuuuuuuuuuuuuugagauuuaaacagacucgcuuuuu

SEQ ID NO: 384179 - RNA, 64 nt, Homo Sapiens
uggagucucgcucugcugcccuuuuuuuuuuuuuuuuuuugagaaguggcaagaaugaaauacu

SEQ ID NO: 384180 - RNA, 64 nt, Homo Sapiens
aauuaugcugugaauuuuacaaaaauuuauuuucuuuuuugauaauuuauuguaccaaagcugu

SEQ ID NO: 384181 - RNA, 64 nt, Homo Sapiens
uauuuuguaauuaacugucaagccuguggaugauuuuuuugaacuugguaguucauaaagguuu

SEQ ID NO: 384182 - RNA, 64 nt, Homo Sapiens
aggaaacuuucccuugguugucuuaauuuuuuuuuuuuuugauggaagaccaaggguugccagg

SEQ ID NO: 384183 - RNA, 64 nt, Homo Sapiens
uacagugugaauaaaugcuugcagcucuuagcucuuuuuugaucgaugaagcacuuuuuuauua

SEQ ID NO: 384184 - RNA, 64 nt, Homo Sapiens
gauaagggguuauuuuaugcuaauucacaaguuuuuuuuugaagugaauucuuuugaaaaaaaa

SEQ ID NO: 384185 - RNA, 64 nt, Homo Sapiens
auaauuucuaacuguaaaauugucauuuuguacuuuuuuugauguaauauccuuagaaaucugu

SEQ ID NO: 384186 - RNA, 64 nt, Homo Sapiens
ggugugagccgcugcacccugccccaguacaaucuuuuuugaacucaaauuuuugcugacaucu

SEQ ID NO: 384187 - RNA, 64 nt, Homo Sapiens
aaaagcuaucaccauuguaguagaaucauccuucuuuuuugaaauuugaagcaucccaggcuua

SEQ ID NO: 384188 - RNA, 64 nt, Homo Sapiens
ugaauuauguuugcauguucacuuccaagagccuuuuuuugaaaaaaagcuuuuuuugaaucau

SEQ ID NO: 384189 - RNA, 64 nt, Homo Sapiens
uucacuuccaagagccuuuuuuugaaaaaaagcuuuuuuugaaucaucaagucuuucacauuua

SEQ ID NO: 384190 - RNA, 64 nt, Homo Sapiens
acaaauaacaacuuuuuuuucuuuuuuucuuuuguuuuuugaaguguugggguuugguuuuguu

SEQ ID NO: 384191 - RNA, 64 nt, Homo Sapiens
cuuuuguuuuuugaaguguugggguuugguuuuguuuuuugagucuuuuuuuuuuaagugaaau

SEQ ID NO: 384192 - RNA, 64 nt, Homo Sapiens
uuuaaaaaugugauugcucuaaauauaguuauaauuuuuugaauaguauuauucaaaugaucaa

SEQ ID NO: 384193 - RNA, 64 nt, Homo Sapiens
cuuuccuaagaucauuuuuauuacacagcuuuguuuuuuugaauauaugaaaaaucaacuaaga

SEQ ID NO: 384194 - RNA, 64 nt, Homo Sapiens
cagcugcagcaagaguuggcuuacuuaaauuuauuuuuuugaaauguagaaauguguaucgcaa

SEQ ID NO: 384195 - RNA, 64 nt, Homo Sapiens
gauugaaaucuuuugccaacuaaaguccuuuuuuuuuuuugauccucuucccucacaaugcuuu

SEQ ID NO: 384196 - RNA, 64 nt, Homo Sapiens
uggaguuucgcucuguugucgggguuuuuuuuuuuuuuuugagaauucagauagguugaucuuu

SEQ ID NO: 384197 - RNA, 64 nt, Homo Sapiens
uggagucuugcuccuguuguuuuuuguuuuuuguuuuuuugagauuguggguuuuuguuuuugu

SEQ ID NO: 384198 - RNA, 64 nt, Homo Sapiens
uggagucuugcuccuguuguagcucgcuuuuuuuuuuuuugagauuacuuaaaaauugggaaua

SEQ ID NO: 384199 - RNA, 64 nt, Homo Sapiens
uucaggaauacacagagagauuucauuuguuucauuuuuugaaaaacaaguuuuaugguucugu

SEQ ID NO: 384200 - RNA, 64 nt, Homo Sapiens
aaaaaugugaacaagaaaauuuuaugacuaauaguuuuuugauucagacacuugaacucaucuu

SEQ ID NO: 384201 - RNA, 64 nt, Homo Sapiens
ugcugaaaauugccuuucugaagaggaaaguacauuuuuugaaacuguaauuauuugaaugacu

SEQ ID NO: 384202 - RNA, 64 nt, Homo Sapiens
cuuugagaucuaaaaauaacgaaauugagcugcuuuuuuugaaaucuaguaauauauuuaaagg

SEQ ID NO: 384203 - RNA, 64 nt, Homo Sapiens
aaaucagaaauguuuguauucuuuuuuaacugaauuuuuugaauacagaaugcuaguuuaauga

SEQ ID NO: 384204 - RNA, 64 nt, Homo Sapiens
aguuggcaugaagccauagaggaacaacuguacuuuuuuugauccuagugugccaaaugguaua

SEQ ID NO: 384205 - RNA, 64 nt, Homo Sapiens
accauaugcuuggagguagauuacaguggaguauuuuuuugaagguuucuugggaaaauucaag

SEQ ID NO: 384206 - RNA, 64 nt, Homo Sapiens
acuuacuuucaaagcacacauuuuuagaguuucuuuuuuugaucgaccaccuacuucuauuuuu

SEQ ID NO: 384207 - RNA, 64 nt, Homo Sapiens
gccccauggcuugaugugaagacagcaaggaaagaagcaccagucaaguugugaacaagcacca

SEQ ID NO: 384208 - RNA, 64 nt, Homo Sapiens
cagcaaggaaagaagcaccagucaaguugugaacaagcaccaaauuaaaagaccuaaaccuuac

SEQ ID NO: 384209 - RNA, 64 nt, Homo Sapiens
acagauugaggaaauuccuagaucacugagagcuaagcaccaugcauagacaacaguuuguucu

SEQ ID NO: 384210 - RNA, 64 nt, Homo Sapiens
ccuuuuggaccaagaagcugucacuaucacacauaagcaccauucccuuagaguggauccaggu

SEQ ID NO: 384211 - RNA, 64 nt, Homo Sapiens
gucccugccucccgugggcccucucccucucccaaagcaccagcccagaaggacaaggagaugu

SEQ ID NO: 384212 - RNA, 64 nt, Homo Sapiens
caggaggccacucuugucuccucugacugcggccaagcaccacguguccccggaccagcccuug

SEQ ID NO: 384213 - RNA, 64 nt, Homo Sapiens
uggucucucagcaaacacuccuuguuggguggguaagcaccaccaaacccaaagauggaaagug

SEQ ID NO: 384214 - RNA, 64 nt, Homo Sapiens
ucggacacaccagggauugacugugaaucuuuccaagcaccacugggugggccccucuugguau

SEQ ID NO: 384215 - RNA, 64 nt, Homo Sapiens; identical to SEQ ID NO: 356088

SEQ ID NO: 384216 - RNA, 64 nt, Homo Sapiens; identical to SEQ ID NO: 356089

SEQ ID NO: 384217 - RNA, 64 nt, Homo Sapiens; identical to SEQ ID NO: 356090

SEQ ID NO: 384218 - RNA, 64 nt, Homo Sapiens; identical to SEQ ID NO: 356091

SEQ ID NO: 384219 - RNA, 64 nt, Homo Sapiens; identical to SEQ ID NO: 356092

SEQ ID NO: 384220 - RNA, 64 nt, Homo Sapiens; identical to SEQ ID NO: 356093

SEQ ID NO: 384221 - RNA, 64 nt, Homo Sapiens; identical to SEQ ID NO: 356094

SEQ ID NO: 384222 - RNA, 64 nt, Homo Sapiens; identical to SEQ ID NO: 356095

SEQ ID NO: 384223 - RNA, 64 nt, Homo Sapiens; identical to SEQ ID NO: 356096

SEQ ID NO: 384224 - RNA, 64 nt, Homo Sapiens; identical to SEQ ID NO: 356097

SEQ ID NO: 384225 - RNA, 64 nt, Homo Sapiens; identical to SEQ ID NO: 356098

SEQ ID NO: 384226 - RNA, 64 nt, Homo Sapiens; identical to SEQ ID NO: 356099

SEQ ID NO: 384227 - RNA, 64 nt, Homo Sapiens; identical to SEQ ID NO: 356100

SEQ ID NO: 384228 - RNA, 64 nt, Homo Sapiens; identical to SEQ ID NO: 356101

SEQ ID NO: 384229 - RNA, 64 nt, Homo Sapiens; identical to SEQ ID NO: 356102

SEQ ID NO: 384230 - RNA, 64 nt, Homo Sapiens; identical to SEQ ID NO: 356103

SEQ ID NO: 384231 - RNA, 64 nt, Homo Sapiens; identical to SEQ ID NO: 356104

SEQ ID NO: 384232 - RNA, 64 nt, Homo Sapiens; identical to SEQ ID NO: 356105

SEQ ID NO: 384233 - RNA, 64 nt, Homo Sapiens; identical to SEQ ID NO: 356106

SEQ ID NO: 384234 - RNA, 64 nt, Homo Sapiens; identical to SEQ ID NO: 356107

SEQ ID NO: 384235 - RNA, 64 nt, Homo Sapiens; identical to SEQ ID NO: 356108

SEQ ID NO: 384236 - RNA, 64 nt, Homo Sapiens; identical to SEQ ID NO: 356109

SEQ ID NO: 384237 - RNA, 64 nt, Homo Sapiens; identical to SEQ ID NO: 356110

SEQ ID NO: 384238 - RNA, 64 nt, Homo Sapiens; identical to SEQ ID NO: 356111

SEQ ID NO: 384239 - RNA, 64 nt, Homo Sapiens; identical to SEQ ID NO: 356112

SEQ ID NO: 384240 - RNA, 64 nt, Homo Sapiens; identical to SEQ ID NO: 356113

SEQ ID NO: 384241 - RNA, 64 nt, Homo Sapiens; identical to SEQ ID NO: 356114

SEQ ID NO: 384242 - RNA, 64 nt, Homo Sapiens; identical to SEQ ID NO: 356115

SEQ ID NO: 384243 - RNA, 64 nt, Homo Sapiens; identical to SEQ ID NO: 356116

SEQ ID NO: 384244 - RNA, 64 nt, Homo Sapiens; identical to SEQ ID NO: 356117

SEQ ID NO: 384245 - RNA, 64 nt, Homo Sapiens; identical to SEQ ID NO: 356118

SEQ ID NO: 384246 - RNA, 64 nt, Homo Sapiens; identical to SEQ ID NO: 356119

SEQ ID NO: 384247 - RNA, 64 nt, Homo Sapiens; identical to SEQ ID NO: 356120

SEQ ID NO: 384248 - RNA, 64 nt, Homo Sapiens; identical to SEQ ID NO: 356121

SEQ ID NO: 384249 - RNA, 64 nt, Homo Sapiens; identical to SEQ ID NO: 356122

SEQ ID NO: 384250 - RNA, 64 nt, Homo Sapiens; identical to SEQ ID NO: 356123

SEQ ID NO: 384251 - RNA, 64 nt, Homo Sapiens; identical to SEQ ID NO: 356124

SEQ ID NO: 384252 - RNA, 64 nt, Homo Sapiens; identical to SEQ ID NO: 356125

SEQ ID NO: 384253 - RNA, 64 nt, Homo Sapiens; identical to SEQ ID NO: 356126

SEQ ID NO: 384254 - RNA, 64 nt, Homo Sapiens; identical to SEQ ID NO: 356127

SEQ ID NO: 384255 - RNA, 64 nt, Homo Sapiens; identical to SEQ ID NO: 356128

SEQ ID NO: 384256 - RNA, 64 nt, Homo Sapiens; identical to SEQ ID NO: 356129

SEQ ID NO: 384257 - RNA, 64 nt, Homo Sapiens; identical to SEQ ID NO: 356130

SEQ ID NO: 384258 - RNA, 64 nt, Homo Sapiens; identical to SEQ ID NO: 356131

SEQ ID NO: 384259 - RNA, 64 nt, Homo Sapiens; identical to SEQ ID NO: 356132

SEQ ID NO: 384260 - RNA, 64 nt, Homo Sapiens; identical to SEQ ID NO: 356133

SEQ ID NO: 384261 - RNA, 64 nt, Homo Sapiens; identical to SEQ ID NO: 356134

SEQ ID NO: 384262 - RNA, 64 nt, Homo Sapiens; identical to SEQ ID NO: 356135

SEQ ID NO: 384263 - RNA, 64 nt, Homo Sapiens; identical to SEQ ID NO: 356136

SEQ ID NO: 384264 - RNA, 64 nt, Homo Sapiens; identical to SEQ ID NO: 356137

SEQ ID NO: 384265 - RNA, 64 nt, Homo Sapiens; identical to SEQ ID NO: 356138

SEQ ID NO: 384266 - RNA, 64 nt, Homo Sapiens; identical to SEQ ID NO: 356139

SEQ ID NO: 384267 - RNA, 64 nt, Homo Sapiens; identical to SEQ ID NO: 356140

SEQ ID NO: 384268 - RNA, 64 nt, Homo Sapiens; identical to SEQ ID NO: 356141

SEQ ID NO: 384269 - RNA, 64 nt, Homo Sapiens; identical to SEQ ID NO: 356142

SEQ ID NO: 384270 - RNA, 64 nt, Homo Sapiens; identical to SEQ ID NO: 356143

SEQ ID NO: 384271 - RNA, 64 nt, Homo Sapiens; identical to SEQ ID NO: 356144

SEQ ID NO: 384272 - RNA, 64 nt, Homo Sapiens; identical to SEQ ID NO: 356145

SEQ ID NO: 384273 - RNA, 64 nt, Homo Sapiens; identical to SEQ ID NO: 356146

SEQ ID NO: 384274 - RNA, 64 nt, Homo Sapiens; identical to SEQ ID NO: 356147

SEQ ID NO: 384275 - RNA, 64 nt, Homo Sapiens; identical to SEQ ID NO: 356148

SEQ ID NO: 384276 - RNA, 64 nt, Homo Sapiens; identical to SEQ ID NO: 356149

SEQ ID NO: 384277 - RNA, 64 nt, Homo Sapiens; identical to SEQ ID NO: 356150

SEQ ID NO: 384278 - RNA, 64 nt, Homo Sapiens; identical to SEQ ID NO: 356151

SEQ ID NO: 384279 - RNA, 64 nt, Homo Sapiens; identical to SEQ ID NO: 356152

SEQ ID NO: 384280 - RNA, 64 nt, Homo Sapiens; identical to SEQ ID NO: 356153

SEQ ID NO: 384281 - RNA, 64 nt, Homo Sapiens; identical to SEQ ID NO: 356154

SEQ ID NO: 384282 - RNA, 64 nt, Homo Sapiens; identical to SEQ ID NO: 356155

SEQ ID NO: 384283 - RNA, 64 nt, Homo Sapiens; identical to SEQ ID NO: 356156

SEQ ID NO: 384284 - RNA, 64 nt, Homo Sapiens; identical to SEQ ID NO: 356157

SEQ ID NO: 384285 - RNA, 64 nt, Homo Sapiens; identical to SEQ ID NO: 356158

SEQ ID NO: 384286 - RNA, 64 nt, Homo Sapiens; identical to SEQ ID NO: 356159

SEQ ID NO: 384287 - RNA, 64 nt, Homo Sapiens; identical to SEQ ID NO: 356160

SEQ ID NO: 384288 - RNA, 64 nt, Homo Sapiens; identical to SEQ ID NO: 356161

SEQ ID NO: 384289 - RNA, 64 nt, Homo Sapiens; identical to SEQ ID NO: 356162

SEQ ID NO: 384290 - RNA, 64 nt, Homo Sapiens; identical to SEQ ID NO: 356163

SEQ ID NO: 384291 - RNA, 64 nt, Homo Sapiens; identical to SEQ ID NO: 356164

SEQ ID NO: 384292 - RNA, 64 nt, Homo Sapiens; identical to SEQ ID NO: 356165

SEQ ID NO: 384293 - RNA, 64 nt, Homo Sapiens; identical to SEQ ID NO: 356166

SEQ ID NO: 384294 - RNA, 64 nt, Homo Sapiens; identical to SEQ ID NO: 356167

SEQ ID NO: 384295 - RNA, 64 nt, Homo Sapiens; identical to SEQ ID NO: 356168

SEQ ID NO: 384296 - RNA, 64 nt, Homo Sapiens; identical to SEQ ID NO: 356169

SEQ ID NO: 384297 - RNA, 64 nt, Homo Sapiens; identical to SEQ ID NO: 356170

SEQ ID NO: 384298 - RNA, 64 nt, Homo Sapiens; identical to SEQ ID NO: 356171

SEQ ID NO: 384299 - RNA, 64 nt, Homo Sapiens; identical to SEQ ID NO: 356172

SEQ ID NO: 384300 - RNA, 64 nt, Homo Sapiens; identical to SEQ ID NO: 356173

SEQ ID NO: 384301 - RNA, 64 nt, Homo Sapiens; identical to SEQ ID NO: 356174

SEQ ID NO: 384302 - RNA, 64 nt, Homo Sapiens; identical to SEQ ID NO: 356175

SEQ ID NO: 384303 - RNA, 64 nt, Homo Sapiens; identical to SEQ ID NO: 356176

SEQ ID NO: 384304 - RNA, 64 nt, Homo Sapiens; identical to SEQ ID NO: 356177

SEQ ID NO: 384305 - RNA, 64 nt, Homo Sapiens; identical to SEQ ID NO: 356178

SEQ ID NO: 384306 - RNA, 64 nt, Homo Sapiens; identical to SEQ ID NO: 356179

SEQ ID NO: 384307 - RNA, 64 nt, Homo Sapiens; identical to SEQ ID NO: 356180

SEQ ID NO: 384308 - RNA, 64 nt, Homo Sapiens; identical to SEQ ID NO: 356181

SEQ ID NO: 384309 - RNA, 64 nt, Homo Sapiens; identical to SEQ ID NO: 356182

SEQ ID NO: 384310 - RNA, 64 nt, Homo Sapiens; identical to SEQ ID NO: 356183

SEQ ID NO: 384311 - RNA, 64 nt, Homo Sapiens; identical to SEQ ID NO: 356184

SEQ ID NO: 384312 - RNA, 64 nt, Homo Sapiens; identical to SEQ ID NO: 356185

SEQ ID NO: 384313 - RNA, 64 nt, Homo Sapiens; identical to SEQ ID NO: 356186

SEQ ID NO: 384314 - RNA, 64 nt, Homo Sapiens; identical to SEQ ID NO: 356187

SEQ ID NO: 384315 - RNA, 64 nt, Homo Sapiens; identical to SEQ ID NO: 356188

SEQ ID NO: 384316 - RNA, 64 nt, Homo Sapiens; identical to SEQ ID NO: 356189

SEQ ID NO: 384317 - RNA, 64 nt, Homo Sapiens; identical to SEQ ID NO: 356190

SEQ ID NO: 384318 - RNA, 64 nt, Homo Sapiens; identical to SEQ ID NO: 356191

SEQ ID NO: 384319 - RNA, 64 nt, Homo Sapiens; identical to SEQ ID NO: 356192

SEQ ID NO: 384320 - RNA, 64 nt, Homo Sapiens; identical to SEQ ID NO: 356193

SEQ ID NO: 384321 - RNA, 64 nt, Homo Sapiens; identical to SEQ ID NO: 356194

SEQ ID NO: 384322 - RNA, 64 nt, Homo Sapiens; identical to SEQ ID NO: 356195

SEQ ID NO: 384323 - RNA, 64 nt, Homo Sapiens; identical to SEQ ID NO: 356196

SEQ ID NO: 384324 - RNA, 64 nt, Homo Sapiens; identical to SEQ ID NO: 356197

SEQ ID NO: 384325 - RNA, 64 nt, Homo Sapiens; identical to SEQ ID NO: 356198

SEQ ID NO: 384326 - RNA, 64 nt, Homo Sapiens; identical to SEQ ID NO: 356199

SEQ ID NO: 384327 - RNA, 64 nt, Homo Sapiens; identical to SEQ ID NO: 356200

SEQ ID NO: 384328 - RNA, 64 nt, Homo Sapiens; identical to SEQ ID NO: 356201

SEQ ID NO: 384329 - RNA, 64 nt, Homo Sapiens; identical to SEQ ID NO: 356202

SEQ ID NO: 384330 - RNA, 64 nt, Homo Sapiens; identical to SEQ ID NO: 356203

SEQ ID NO: 384331 - RNA, 64 nt, Homo Sapiens; identical to SEQ ID NO: 356204

SEQ ID NO: 384332 - RNA, 64 nt, Homo Sapiens; identical to SEQ ID NO: 356205

SEQ ID NO: 384333 - RNA, 64 nt, Homo Sapiens; identical to SEQ ID NO: 356206

SEQ ID NO: 384334 - RNA, 64 nt, Homo Sapiens; identical to SEQ ID NO: 356207

SEQ ID NO: 384335 - RNA, 64 nt, Homo Sapiens; identical to SEQ ID NO: 356208

SEQ ID NO: 384336 - RNA, 64 nt, Homo Sapiens; identical to SEQ ID NO: 356209

SEQ ID NO: 384337 - RNA, 64 nt, Homo Sapiens; identical to SEQ ID NO: 356210

SEQ ID NO: 384338 - RNA, 64 nt, Homo Sapiens; identical to SEQ ID NO: 356211

SEQ ID NO: 384339 - RNA, 64 nt, Homo Sapiens; identical to SEQ ID NO: 356212

SEQ ID NO: 384340 - RNA, 64 nt, Homo Sapiens; identical to SEQ ID NO: 356213

SEQ ID NO: 384341 - RNA, 64 nt, Homo Sapiens; identical to SEQ ID NO: 356214

SEQ ID NO: 384342 - RNA, 64 nt, Homo Sapiens; identical to SEQ ID NO: 356215

SEQ ID NO: 384343 - RNA, 64 nt, Homo Sapiens; identical to SEQ ID NO: 356216

SEQ ID NO: 384344 - RNA, 64 nt, Homo Sapiens; identical to SEQ ID NO: 356217

SEQ ID NO: 384345 - RNA, 64 nt, Homo Sapiens; identical to SEQ ID NO: 356218

SEQ ID NO: 384346 - RNA, 64 nt, Homo Sapiens; identical to SEQ ID NO: 356219

SEQ ID NO: 384347 - RNA, 64 nt, Homo Sapiens; identical to SEQ ID NO: 356220

SEQ ID NO: 384348 - RNA, 64 nt, Homo Sapiens; identical to SEQ ID NO: 356221

SEQ ID NO: 384349 - RNA, 64 nt, Homo Sapiens; identical to SEQ ID NO: 356222

SEQ ID NO: 384350 - RNA, 64 nt, Homo Sapiens; identical to SEQ ID NO: 356223

SEQ ID NO: 384351 - RNA, 64 nt, Homo Sapiens; identical to SEQ ID NO: 356224

SEQ ID NO: 384352 - RNA, 64 nt, Homo Sapiens; identical to SEQ ID NO: 356225

SEQ ID NO: 384353 - RNA, 64 nt, Homo Sapiens; identical to SEQ ID NO: 356226

SEQ ID NO: 384354 - RNA, 64 nt, Homo Sapiens; identical to SEQ ID NO: 356227

SEQ ID NO: 384355 - RNA, 64 nt, Homo Sapiens; identical to SEQ ID NO: 356228

SEQ ID NO: 384356 - RNA, 64 nt, Homo Sapiens; identical to SEQ ID NO: 356229

SEQ ID NO: 384357 - RNA, 64 nt, Homo Sapiens; identical to SEQ ID NO: 356230

SEQ ID NO: 384358 - RNA, 64 nt, Homo Sapiens; identical to SEQ ID NO: 356231

SEQ ID NO: 384359 - RNA, 64 nt, Homo Sapiens; identical to SEQ ID NO: 356232

SEQ ID NO: 384360 - RNA, 64 nt, Homo Sapiens; identical to SEQ ID NO: 356233

SEQ ID NO: 384361 - RNA, 64 nt, Homo Sapiens; identical to SEQ ID NO: 356234

SEQ ID NO: 384362 - RNA, 64 nt, Homo Sapiens; identical to SEQ ID NO: 356235

SEQ ID NO: 384363 - RNA, 64 nt, Homo Sapiens; identical to SEQ ID NO: 356236

SEQ ID NO: 384364 - RNA, 64 nt, Homo Sapiens; identical to SEQ ID NO: 356237

SEQ ID NO: 384365 - RNA, 64 nt, Homo Sapiens; identical to SEQ ID NO: 356238

SEQ ID NO: 384366 - RNA, 64 nt, Homo Sapiens; identical to SEQ ID NO: 356239

SEQ ID NO: 384367 - RNA, 64 nt, Homo Sapiens; identical to SEQ ID NO: 356240

SEQ ID NO: 384368 - RNA, 64 nt, Homo Sapiens; identical to SEQ ID NO: 356241

SEQ ID NO: 384369 - RNA, 64 nt, Homo Sapiens; identical to SEQ ID NO: 356242

SEQ ID NO: 384370 - RNA, 64 nt, Homo Sapiens; identical to SEQ ID NO: 356243

SEQ ID NO: 384371 - RNA, 64 nt, Homo Sapiens; identical to SEQ ID NO: 356244

SEQ ID NO: 384372 - RNA, 64 nt, Homo Sapiens; identical to SEQ ID NO: 356245

SEQ ID NO: 384373 - RNA, 64 nt, Homo Sapiens; identical to SEQ ID NO: 356246

SEQ ID NO: 384374 - RNA, 64 nt, Homo Sapiens; identical to SEQ ID NO: 356247

SEQ ID NO: 384375 - RNA, 64 nt, Homo Sapiens; identical to SEQ ID NO: 356248

SEQ ID NO: 384376 - RNA, 64 nt, Homo Sapiens; identical to SEQ ID NO: 356249

SEQ ID NO: 384377 - RNA, 64 nt, Homo Sapiens; identical to SEQ ID NO: 356250

SEQ ID NO: 384378 - RNA, 64 nt, Homo Sapiens; identical to SEQ ID NO: 356251

SEQ ID NO: 384379 - RNA, 64 nt, Homo Sapiens; identical to SEQ ID NO: 356252

SEQ ID NO: 384380 - RNA, 64 nt, Homo Sapiens; identical to SEQ ID NO: 356253

SEQ ID NO: 384381 - RNA, 64 nt, Homo Sapiens; identical to SEQ ID NO: 356254

SEQ ID NO: 384382 - RNA, 64 nt, Homo Sapiens; identical to SEQ ID NO: 356255

SEQ ID NO: 384383 - RNA, 64 nt, Homo Sapiens; identical to SEQ ID NO: 356256

SEQ ID NO: 384384 - RNA, 64 nt, Homo Sapiens; identical to SEQ ID NO: 356257

SEQ ID NO: 384385 - RNA, 64 nt, Homo Sapiens; identical to SEQ ID NO: 356258

SEQ ID NO: 384386 - RNA, 64 nt, Homo Sapiens; identical to SEQ ID NO: 356259

SEQ ID NO: 384387 - RNA, 64 nt, Homo Sapiens; identical to SEQ ID NO: 356260

SEQ ID NO: 384388 - RNA, 64 nt, Homo Sapiens; identical to SEQ ID NO: 356261

SEQ ID NO: 384389 - RNA, 64 nt, Homo Sapiens; identical to SEQ ID NO: 356262

SEQ ID NO: 384390 - RNA, 64 nt, Homo Sapiens; identical to SEQ ID NO: 356263

SEQ ID NO: 384391 - RNA, 64 nt, Homo Sapiens; identical to SEQ ID NO: 356264

SEQ ID NO: 384392 - RNA, 64 nt, Homo Sapiens; identical to SEQ ID NO: 356265

SEQ ID NO: 384393 - RNA, 64 nt, Homo Sapiens; identical to SEQ ID NO: 356266

SEQ ID NO: 384394 - RNA, 64 nt, Homo Sapiens; identical to SEQ ID NO: 356267

SEQ ID NO: 384395 - RNA, 64 nt, Homo Sapiens; identical to SEQ ID NO: 356268

SEQ ID NO: 384396 - RNA, 64 nt, Homo Sapiens; identical to SEQ ID NO: 356269

SEQ ID NO: 384397 - RNA, 64 nt, Homo Sapiens; identical to SEQ ID NO: 356270

SEQ ID NO: 384398 - RNA, 64 nt, Homo Sapiens; identical to SEQ ID NO: 356271

SEQ ID NO: 384399 - RNA, 64 nt, Homo Sapiens; identical to SEQ ID NO: 356272

SEQ ID NO: 384400 - RNA, 64 nt, Homo Sapiens; identical to SEQ ID NO: 356273

SEQ ID NO: 384401 - RNA, 64 nt, Homo Sapiens; identical to SEQ ID NO: 356274

SEQ ID NO: 384402 - RNA, 64 nt, Homo Sapiens; identical to SEQ ID NO: 356275

SEQ ID NO: 384403 - RNA, 64 nt, Homo Sapiens; identical to SEQ ID NO: 356276

SEQ ID NO: 384404 - RNA, 64 nt, Homo Sapiens; identical to SEQ ID NO: 356277

SEQ ID NO: 384405 - RNA, 64 nt, Homo Sapiens; identical to SEQ ID NO: 356278

SEQ ID NO: 384406 - RNA, 64 nt, Homo Sapiens; identical to SEQ ID NO: 356279

SEQ ID NO: 384407 - RNA, 64 nt, Homo Sapiens; identical to SEQ ID NO: 356280

SEQ ID NO: 384408 - RNA, 64 nt, Homo Sapiens; identical to SEQ ID NO: 356281

SEQ ID NO: 384409 - RNA, 64 nt, Homo Sapiens; identical to SEQ ID NO: 356270

SEQ ID NO: 384410 - RNA, 64 nt, Homo Sapiens
uugaguaaaaaaaaaaaacacacaaaccuguuaguuucaaaaaugacauugcuugcuuaaaggu

SEQ ID NO: 384411 - RNA, 64 nt, Homo Sapiens
aaguuguaguugcagaaucccaaacuaggcuacauuucaaaauucagggcuguuuaagauuuaa

SEQ ID NO: 384412 - RNA, 64 nt, Homo Sapiens
cacacaugauuuugauuaugcuacaugauauauguuucaaaaagaauuagcauagaaauccugg

SEQ ID NO: 384413 - RNA, 64 nt, Homo Sapiens
aauccuggucuccuagccaaaaaaaucaaaggauuuucaaaaaaacgaaucuguauguugaggc

SEQ ID NO: 384414 - RNA, 64 nt, Homo Sapiens
gguuacagagagccuccucagaucuguuugugccuuucaaaaguacugggggcagauucucaaa

SEQ ID NO: 384415 - RNA, 64 nt, Homo Sapiens
ccugguaaaacucuguuuucauuaauuuguuauuuuucaaaaaccgagccacaccuuuggaagu

SEQ ID NO: 384416 - RNA, 64 nt, Homo Sapiens
ugccaauaacaaauuccuacuucgacauaugucuuuucaaaaagccucccagacacaagacauc

SEQ ID NO: 384417 - RNA, 64 nt, Homo Sapiens
gugugagccaccgcacccggccaacuuucugaaauuucaaaacugaauugauccuucuccaaau

SEQ ID NO: 384418 - RNA, 64 nt, Homo Sapiens
guaaauaaccaauucagaaaaguugucuuugugguuucaaaaguaaaauauggggagacuuggg

SEQ ID NO: 384419 - RNA, 64 nt, Homo Sapiens
auagcugagcuugucuaacuuuguaaaguugguguuucaaaaacuccaaagcaaagcauuuuua

SEQ ID NO: 384420 - RNA, 64 nt, Homo Sapiens
ggcuuagguauucauggaccuguccucuuuuacuuuucaaaacuggucugguagguaggacaaa

SEQ ID NO: 384421 - RNA, 64 nt, Homo Sapiens
cucuccaguuucacucuucuuauaccaggagcaauuucaaaaccacauccccgccucccagaca

SEQ ID NO: 384422 - RNA, 64 nt, Homo Sapiens
uuaggguagggaagggauacuaauuacuuauuucuuucaaaacauuuuugguuuuugguuuuua

SEQ ID NO: 384423 - RNA, 64 nt, Homo Sapiens
uaaugcaauuuuacagacacaauaccuucaugaauuucaaaauucauauaaaauuugaucuuau

SEQ ID NO: 384424 - RNA, 64 nt, Homo Sapiens
uuugguaccugucucucuccuacuguauugucauuuucaaaauguguuuguuuucuggcgcgug

SEQ ID NO: 384425 - RNA, 64 nt, Homo Sapiens
cuaagacauauuuccuuucacuuggcaggauuccuuucaaaauggaaucugaguauuagacacu

SEQ ID NO: 384426 - RNA, 64 nt, Homo Sapiens
uguaacaaaauauuuuguagauuacauauugauuuuucaaaaauuaaaaauguauuucaaacua

SEQ ID NO: 384427 - RNA, 64 nt, Homo Sapiens
aaauguuguagagauagagccauauaacgucacguuucaaaacuagcucuacaguuuugcuucu

SEQ ID NO: 384428 - RNA, 64 nt, Homo Sapiens
ggcuuuugauucuaaugauaauuguaccuuuaucuuucaaaagcugauauuuccuaccuaagca

SEQ ID NO: 384429 - RNA, 64 nt, Homo Sapiens
gcccaaagcaacaguuugucuccaguccacaaucuuucaaaaaugccauuuaugcuacuacuga

SEQ ID NO: 384430 - RNA, 64 nt, Homo Sapiens
uauauagaauaauauuuauguuuacaauguaacuuuucaaaauuuacaaaucaggauuauauac

SEQ ID NO: 384431 - RNA, 64 nt, Homo Sapiens
acauuucagaagagcacaauaugcauaaaacauuuuucaaaauugaaauauuuuccugggcauu

SEQ ID NO: 384432 - RNA, 64 nt, Homo Sapiens
gaauaaaaaguuugaauagcuagagaaucuuguuuuucaaaaaacaauggcuaaaacguuuuua

SEQ ID NO: 384433 - RNA, 64 nt, Homo Sapiens
cauuagugagaguaacagcuucagccaguuaggauuucaaaauaucaaccuuauuaaaaauucu

SEQ ID NO: 384434 - RNA, 64 nt, Homo Sapiens
aaaacaagagggcauagaugguuuucacacaaaauuucaaaacaaaaugugaaauauaaggcac

SEQ ID NO: 384435 - RNA, 64 nt, Homo Sapiens
gugaaauauaaggcacguuuuauggaggccuuauuuucaaaaauugugagagaggaaaaaaaag

SEQ ID NO: 384436 - RNA, 64 nt, Homo Sapiens
uuuuauaacuugaaaaacacccugacacuauacauuucaaaauuauguuuguguauugguugcu

SEQ ID NO: 384437 - RNA, 64 nt, Homo Sapiens
acugcuuaccauggaagugccaccucuaccuugcuuucaaaaggugaaagugaacuuguucauu

SEQ ID NO: 384438 - RNA, 64 nt, Homo Sapiens
aaaaaaaaaagccuacauucacugagcaagacucuuucaaaaaaacugcacuucagucugugug

SEQ ID NO: 384439 - RNA, 64 nt, Homo Sapiens
uccagauguaggggaagagaaauaccaaagacuauuucaaaauguucaaagcacaauaacuagu

SEQ ID NO: 384440 - RNA, 64 nt, Homo Sapiens
uggguuuuguucuuguauugcuuucuuucaacaguuucaaaauaaaauaucauauaaauauuga

SEQ ID NO: 384441 - RNA, 64 nt, Homo Sapiens
aucauauaaauauugagggaaauguuuucauauuuuucaaaauagguuuuuauuguugaaugua

SEQ ID NO: 384442 - RNA, 64 nt, Homo Sapiens
gagaauagcccccuucgauacacaucagcuggauuuucaaaagcuucaaagucuuggucuguga

SEQ ID NO: 384443 - RNA, 64 nt, Homo Sapiens
gggagcugggucuguggcuuugaucagaagguacuuucaaaagagggcuuuccagggcucagcu

SEQ ID NO: 384444 - RNA, 64 nt, Homo Sapiens
uuucccgauguguccagccagcuccgcagcagcuuuucaaaaugcacuaugccugauugcugau

SEQ ID NO: 384445 - RNA, 64 nt, Homo Sapiens
gugugaaauaguuuuuauugaaagucaagugacauuucaaaagaaguucuauaacaauuauguu

SEQ ID NO: 384446 - RNA, 64 nt, Homo Sapiens
aguuuuugccacaucugcaaugauuauuguuuaauuucaaaagaauccucaggcucuacaaucu

SEQ ID NO: 384447 - RNA, 64 nt, Homo Sapiens
uuacaaaguauuuuucccaaagauagcuuuacuauuucaaaaauugucaaauuaaugcaugcuc

SEQ ID NO: 384448 - RNA, 64 nt, Homo Sapiens
caaaucacaguuuauuuaaauaauuuuaaugacuuuucaaaaacaauuuauugaugcaaaaagc

SEQ ID NO: 384449 - RNA, 64 nt, Homo Sapiens
uugcaaaggaauugcuuugcaggaaauauuuaauuuucaaaaacauaaugauuaauguuccaau

SEQ ID NO: 384450 - RNA, 64 nt, Homo Sapiens
caagaggcccuaagacugguagaaauuaaaaggauuucaaaaacuuucuauuccuuucuuaaac

SEQ ID NO: 384451 - RNA, 64 nt, Homo Sapiens
accaucuuuguaacuuccugugaauuuauaauaauuucaaaauaaaacaaguuaaaaaaaaacc

SEQ ID NO: 384452 - RNA, 64 nt, Homo Sapiens
aaaaaaacaaacuauaauaagcuuuucugauucuuuucaaaacauuccugguaaguuccuaaag

SEQ ID NO: 384453 - RNA, 64 nt, Homo Sapiens
auagacuuguuuuauuagauuuuaccaaugaauuuuucaaaauacaaaaaaaaguaguuuuucc

SEQ ID NO: 384454 - RNA, 64 nt, Homo Sapiens
aaggugaaaucauggaucagauauuccuuacauuuuucaaaacuacugcauguuuaaaacuuca

SEQ ID NO: 384455 - RNA, 64 nt, Homo Sapiens
cagcacuuuugguuugaguuaucugagauuguauuuucaaaaugaauuuuaaguagauauuugg

SEQ ID NO: 384456 - RNA, 64 nt, Homo Sapiens
uagauauuugguguuuuuaucuugucaaagacaguuucaaaauuugauucaguuuauguuuuau

SEQ ID NO: 384457 - RNA, 64 nt, Homo Sapiens
gaaaauuaauucuaaacuuauaaaguccugaaccuuucaaaaugaagaguaaggguaaaaaaga

SEQ ID NO: 384458 - RNA, 64 nt, Homo Sapiens
auguuuuuaaaaaccuauuuaagcaaauacugauuuucaaaaaauuggcauuuuaaguguuuaa

SEQ ID NO: 384459 - RNA, 64 nt, Homo Sapiens
guacacggaaaucuggacagcaaguuauugugcuuuucaaaaauuguguuaagugcaauuaaua

SEQ ID NO: 384460 - RNA, 64 nt, Homo Sapiens
auaauuuacaauggaaggaccuugcuuucugcauuuucaaaauguuccccagcagggcugcuag

SEQ ID NO: 384461 - RNA, 64 nt, Homo Sapiens
agugguagaaaauuugauaauuuuuuuuaauaauuuucaaaagcagacagccugcguuaauuuu

SEQ ID NO: 384462 - RNA, 64 nt, Homo Sapiens
uaauuuuauguucaauggguucauguugcauagauuucaaaacauuuuuauaucaaacuauauu

SEQ ID NO: 384463 - RNA, 64 nt, Homo Sapiens
aacuggugugugcucugccuugaucuguguugcauuucaaaauaaaguuguauucauaaaauac

SEQ ID NO: 384464 - RNA, 64 nt, Homo Sapiens
ggucucaaccccaguguguagcacacagcucccuuuucaaaaagacuuuggcaaugagaacaca

SEQ ID NO: 384465 - RNA, 64 nt, Homo Sapiens
aaaaaaaaaaaaaacuucagagagcgagacuugguuucaaaaaacuacacuccagccuggcgac

SEQ ID NO: 384466 - RNA, 64 nt, Homo Sapiens
ucugaccaaaacaaacaaacacacuaugaagauguuucaaaaaauauucaguuuucaggaugau

SEQ ID NO: 384467 - RNA, 64 nt, Homo Sapiens
uguguuuguaaagagcauucacaauacgguggaauuucaaaagcuggaagagcucgagaucaug

SEQ ID NO: 384468 - RNA, 64 nt, Homo Sapiens
caagauauucaggggugccccaagagucugggacuuucaaaaaaaaaagaucaggcugaaacug

SEQ ID NO: 384469 - RNA, 64 nt, Homo Sapiens
auauucaauuaugaaacaaaaaaauuaugauguuuuucaaaaugcaagugagguuugauuuuuu

SEQ ID NO: 384470 - RNA, 64 nt, Homo Sapiens
ggagaucuaacaaaaacacuugaauauuuuuuauuuucaaaacuaaacacauaaaaugcuuuua

SEQ ID NO: 384471 - RNA, 64 nt, Homo Sapiens
acugacaguagccugaucaaagugauacaaucaauuucaaaacaaucuuccagagaccacuuga

SEQ ID NO: 384472 - RNA, 64 nt, Homo Sapiens
gaaauagucucuuacauaagcugauuucgagaacuuucaaaaucucacauagcuaauggaaguu

SEQ ID NO: 384473 - RNA, 64 nt, Homo Sapiens
uguggccucagcucuggagguuuugaaaagucuguuucaaaaagaaaauguggagauuuacucc

SEQ ID NO: 384474 - RNA, 64 nt, Homo Sapiens
ggugcccuggaggggccugaugguccauggagccuuucaaaaugaacguuaacaaaccccaucg

SEQ ID NO: 384475 - RNA, 64 nt, Homo Sapiens
gcuaaauuuuucuuaaucaaaaaugcagccuucuuuucaaaacuuuguuacagcuaugcacugu

SEQ ID NO: 384476 - RNA, 64 nt, Homo Sapiens
cuugucaauggucaagcgugucuuccacugcaaauuucaaaagcguaaauguccaaaauguuga

SEQ ID NO: 384477 - RNA, 64 nt, Homo Sapiens
uguguguacguguguauaugucuucugaaauauauuucaaaauaauguaaauuauauuuauaca

SEQ ID NO: 384478 - RNA, 64 nt, Homo Sapiens
acaaaaaauaugacagccguauuaaggugacuauuuucaaaaagugagauaucaucucauccua

SEQ ID NO: 384479 - RNA, 64 nt, Homo Sapiens
auguuuauaucacauagacauuucuuuauuuauuuuucaaaaaauuuuuaaguuaauugaacuu

SEQ ID NO: 384480 - RNA, 64 nt, Homo Sapiens
cucagagauauuacucuuugcuauugcuaaaacauuucaaaaaacaguuuagcaguacaagcuu

SEQ ID NO: 384481 - RNA, 64 nt, Homo Sapiens
aaagugacaauuguagcauucuucugagcuuccuuuucaaaauaucucucuaagaguuuuuuuc

SEQ ID NO: 384482 - RNA, 64 nt, Homo Sapiens
agguuaggagcaaauuaucauggaaucuuuccuuuuucaaaaguaccauuuuuucaagaauguu

SEQ ID NO: 384483 - RNA, 64 nt, Homo Sapiens
gauuaaaaaacugacaaugcaugcuacuguucucuuucaaaaggaagagcaaccguguugaaua

SEQ ID NO: 384484 - RNA, 64 nt, Homo Sapiens
ggcaaaggugcccuuauaaaaaaggaaacuggcuuuucaaaaugggcuaugggagcacaagcug

SEQ ID NO: 384485 - RNA, 64 nt, Homo Sapiens
uacauguuauguuuccugaauuguaguaugugacuuucaaaauggugguuuuccacacucuacc

SEQ ID NO: 384486 - RNA, 64 nt, Homo Sapiens
caaggcuuuuuuauuuuuuuuuuuugucauuuucuuucaaaacuugaguggucucugagcuccu

SEQ ID NO: 384487 - RNA, 64 nt, Homo Sapiens
ggaagcucaggacuuuuuucuuuaaagcuagucauuucaaaagcauauuguauuuuuuugaaug

SEQ ID NO: 384488 - RNA, 64 nt, Homo Sapiens
auuguauuuuuuugaaugacuacaguauggacaauuucaaaaaccaaaacccacuuuggauugg

SEQ ID NO: 384489 - RNA, 64 nt, Homo Sapiens
uuuccauuuaugaagcaguaugaauuagauguauuuucaaaacaggucccuaagacaauucuuc

SEQ ID NO: 384490 - RNA, 64 nt, Homo Sapiens
uaaaaacuaguauguuuucacgguguauauuuuuuuucaaaaauucuguaacaaauauauuuaa

SEQ ID NO: 384491 - RNA, 64 nt, Homo Sapiens
gucaaaaaaugagcaacagaggagucacucuggauuucaaaaauauuuauuauccauaauuaua

SEQ ID NO: 384492 - RNA, 64 nt, Homo Sapiens
cugcugauguaguucccgggugaacugagagcaauuucaaaaggauuugaguaacaaacagcuu

SEQ ID NO: 384493 - RNA, 64 nt, Homo Sapiens
uauuuucacccugacagugaaucuuuaaaaagcuuuucaaaauauuaaagcauaauaauaacau

SEQ ID NO: 384494 - RNA, 64 nt, Homo Sapiens
cauuauuauuuuuuaauuucuaaaaagugcaauuuuucaaaacaccugcugaaggauuuauuua

SEQ ID NO: 384495 - RNA, 64 nt, Homo Sapiens
auuaccaguuuauuaauaauuaggauccuaauuauuucaaaaaauccuacaaauauugucagcu

SEQ ID NO: 384496 - RNA, 64 nt, Homo Sapiens
uauuccuaacaaaaauaaguacucaggacuuuuuuuucaaaaugaaauauuuauguacuguuuu

SEQ ID NO: 384497 - RNA, 64 nt, Homo Sapiens
aaauugaaaacauguaaccacaagaaguugucauuuucaaaaacuucuauauagguggaaaaca

SEQ ID NO: 384498 - RNA, 64 nt, Homo Sapiens
uuuauuuugcuaaacaguuuacuaacacauuacauuucaaaaacuauuuugguaccuuucaaau

SEQ ID NO: 384499 - RNA, 64 nt, Homo Sapiens
aaguuacuagcacugacacacugauuuugaaauguuucaaaaugaguagauaugauuagauccu

SEQ ID NO: 384500 - RNA, 64 nt, Homo Sapiens
aaaugauaguaauaucuuuugaagaacuaugcuuuuucaaaagcaaaaucaacucuguauaaua

SEQ ID NO: 384501 - RNA, 64 nt, Homo Sapiens
acugcuauuauaauucucaaucauagaaggugcuuuucaaaacaaaaucaguggaaauaaauga

SEQ ID NO: 384502 - RNA, 64 nt, Homo Sapiens
gaccaucuuaaacacaugauguuuggaaaacucuuuucaaaacugcauagcaugacuuauucuu

SEQ ID NO: 384503 - RNA, 64 nt, Homo Sapiens
aaauaaaacauuucuguaaauucuacaagguaauuuucaaaaagauuugauagaaaagucacau

SEQ ID NO: 384504 - RNA, 64 nt, Homo Sapiens
gagaaagaaguauauauggauaaauauuuauagauuucaaaauuugucaaauaaagaacaucua

SEQ ID NO: 384505 - RNA, 64 nt, Homo Sapiens
uguuuauuguuuugacuauacucaacuuuuuuaauuucaaaaauaaaaaaugaauuucaagauu

SEQ ID NO: 384506 - RNA, 64 nt, Homo Sapiens
uauguaauguggggcuuuuauaagccaauaaacuuuucaaaauucuguuucaccuguaacuguu

SEQ ID NO: 384507 - RNA, 64 nt, Homo Sapiens
uaugaaaaucaugaacuaccauugugauuaaugcuuucaaaacuuauugcaggaauguauacau

SEQ ID NO: 384508 - RNA, 64 nt, Homo Sapiens
aauagcaugauugaagauacgaaagaaucucaaauuucaaaagauuacuacacuggguaccuuu

SEQ ID NO: 384509 - RNA, 64 nt, Homo Sapiens
auauuuaucaacaaucuuuccuuguaugcagugcuuucaaaagaugguuuugaguguccaguga

SEQ ID NO: 384510 - RNA, 64 nt, Homo Sapiens
cauucauaucucuguuuugaaaucaaaaaucauauuucaaaauucuuuccuaggaccaucuaug

SEQ ID NO: 384511 - RNA, 64 nt, Homo Sapiens
caguguuaacaaauugcugagaucccacggagucuuucaaaaaucucuguagaguuagucuucu

SEQ ID NO: 384512 - RNA, 64 nt, Homo Sapiens
auuuaaauaugaaucuauucaugcuaacauuauuuuucaaaacauacauggaaauuuagcccag

SEQ ID NO: 384513 - RNA, 64 nt, Homo Sapiens
gcagcauaaccuuggcuugauuaaggaauucuacuuucaaaaauuaaucugauaauaguaacaa

SEQ ID NO: 384514 - RNA, 64 nt, Homo Sapiens
aucaacaaaagauugguccuuggugaaauaaacuuuucaaaaaugaauguucuuuucaaaaaau

SEQ ID NO: 384515 - RNA, 64 nt, Homo Sapiens
uuggugaaauaaacuuuucaaaaaugaauguucuuuucaaaaaauaaaguagaaaaaugcacuu

SEQ ID NO: 384516 - RNA, 64 nt, Homo Sapiens
aaaaagaaaaaaagaaaaaagaaaaaucucauuauuucaaaaugauagacauauaccaaaaaca

SEQ ID NO: 384517 - RNA, 64 nt, Homo Sapiens
acgcuaauaagugacaaauaagauuaauaagauuuuucaaaaucgccaggacuggugaauauaa

SEQ ID NO: 384518 - RNA, 64 nt, Homo Sapiens
cucauauccuuuugaagguaguugcaaagagacauuucaaaacugcccuaggccauugcagcau

SEQ ID NO: 384519 - RNA, 64 nt, Homo Sapiens
caugacuuccuuauuucugaacaguacugguuacuuucaaaaugaauuuuuauugagauuuucc

SEQ ID NO: 384520 - RNA, 64 nt, Homo Sapiens
ccccagaacaggccacucauuuagaauucuaguguuucaaaacacuuuuguguguuguaugguc

SEQ ID NO: 384521 - RNA, 64 nt, Homo Sapiens
guuggaagaauauuuauaggcaauacagucaaaguuucaaaauagcaucacacaaaacauguuu

SEQ ID NO: 384522 - RNA, 64 nt, Homo Sapiens
gcuguuaauguauacuacugaaaagaaaauuuuuuuucaaaaauaacauaacucugcugaaugu

SEQ ID NO: 384523 - RNA, 64 nt, Homo Sapiens
uaaugguacauacguucacuggagacauucugucuuucaaaaggaaaguaagaaaacaauauga

SEQ ID NO: 384524 - RNA, 64 nt, Homo Sapiens
aaucuguauuuucugggauauuccccacaaauuauuucaaaaaaaaggcaggcauuuuucuauu

SEQ ID NO: 384525 - RNA, 64 nt, Homo Sapiens
caaagcauuguauucaaaguauuuuauucaaguguuucaaaauuuuuauucaaagcauucaaac

SEQ ID NO: 384526 - RNA, 64 nt, Homo Sapiens
cuuuuuucaauguuauuuuacuaugaccucaacuuuucaaaagauuucaauggugccuugaaau

SEQ ID NO: 384527 - RNA, 64 nt, Homo Sapiens
cccccccuuuuuuuacagaguguaaguuauugcauuucaaaagaguguaaagcuuuuuuuugca

SEQ ID NO: 384528 - RNA, 64 nt, Homo Sapiens
uauuuuuuuauuuauucauuagaaauuuuccucauuucaaaauaauuuaugacucauggaaugu

SEQ ID NO: 384529 - RNA, 64 nt, Homo Sapiens
cagccaguaauaauaauuuaaauauaauuuauuauuucaaaagaauaugucuuaaaagggaaaa

SEQ ID NO: 384530 - RNA, 64 nt, Homo Sapiens
ggaugguauuuagauuuuuuuccucuuaaccuuuuuucaaaaacuauuuucaacugugaggaaa

SEQ ID NO: 384531 - RNA, 64 nt, Homo Sapiens
gaaacccuuauuuuucuuucuuuguggauaaaacuuucaaaagcaauuuaagauauucauagug

SEQ ID NO: 384532 - RNA, 64 nt, Homo Sapiens
auauuuuuguuugguauauuuacuaagugcacucuuucaaaacuuauucuauaacuuuaucaau

SEQ ID NO: 384533 - RNA, 64 nt, Homo Sapiens
aaucucuauccacguaucagguuauagacugguuuuucaaaagugaacaauccugugauaaguu

SEQ ID NO: 384534 - RNA, 64 nt, Homo Sapiens
uuaugaaaaauacauauuugcauguaaacaaugauuucaaaauacuugaaaaauaaaauuuuaa

SEQ ID NO: 384535 - RNA, 64 nt, Homo Sapiens
acaaacucuucuugagaauguuuguuguaaaugguuucaaaaauacaaauuauagccaaucaaa

SEQ ID NO: 384536 - RNA, 64 nt, Homo Sapiens
ugucauuuuccaugcucucuggcucauugugucauuucaaaauguauugauaucuauaaggaau

SEQ ID NO: 384537 - RNA, 64 nt, Homo Sapiens
uaauauuucugcaugcuauugcaagugguaagguuuucaaaaagcuguuuucuaguuauugcua

SEQ ID NO: 384538 - RNA, 64 nt, Homo Sapiens
aaaacaucucugcaguuuuuauccagcgagagaguuucaaaagcgacauggguggggugucccc

SEQ ID NO: 384539 - RNA, 64 nt, Homo Sapiens
cauaguuaaaaaagaaacaagagaaggcaguaguuuucaaaacagagacggcgauuuucgggcu

SEQ ID NO: 384540 - RNA, 64 nt, Homo Sapiens
aaaguacauuuuugaaauaaaagauuuuguuuuauuucaaaaacauuuugucaguucauaguug

SEQ ID NO: 384541 - RNA, 64 nt, Homo Sapiens
uauuuuuucuguuuuuauaauuuuaugguaccuguuucaaaacaguagggagaccauauaauaa

SEQ ID NO: 384542 - RNA, 64 nt, Homo Sapiens
ggcuaggaagugaaaggaucauuggaagaaagaauuucaaaaauaccuggaagcuuggugaaua

SEQ ID NO: 384543 - RNA, 64 nt, Homo Sapiens
guuuguaaaccaaguucaaauguuucucuaacccuuucaaaagucuucucagguugccaggaaa

SEQ ID NO: 384544 - RNA, 64 nt, Homo Sapiens
aaaaugcugauucaguucaaaauuaaugcaaauguuucaaaacuggguuucugauauuuguaaa

SEQ ID NO: 384545 - RNA, 64 nt, Homo Sapiens
uguauuaccauuaaagucauuaguauaauauugcuuucaaaaagaaaugguagacaaaacuaua

SEQ ID NO: 384546 - RNA, 64 nt, Homo Sapiens
guugcaucccccuuagaaugauugcucuaauucuuuucaaaauuuaauguaauacuguagaaau

SEQ ID NO: 384547 - RNA, 64 nt, Homo Sapiens
aaaguuaugguuuccucauuccucauuuaauauuuuucaaaaucgaauuuauagaauaauuucu

SEQ ID NO: 384548 - RNA, 64 nt, Homo Sapiens
agaagcaggcaaucacagaaaagcugaagagaauuuucaaaaauuguuaugcaugaaaccagug

SEQ ID NO: 384549 - RNA, 64 nt, Homo Sapiens
agacauacauuuccacuauggucgguuucaggaauuucaaaagaaaucugacgucaaugcaauu

SEQ ID NO: 384550 - RNA, 64 nt, Homo Sapiens
uuuuguuaauuaaaauuaaauuuuuaagagauauuuucaaaacccuauuuauuuucuuguucac

SEQ ID NO: 384551 - RNA, 64 nt, Homo Sapiens
uuuuauaaaauucaaugacgacuacuagaauucuuuucaaaaguuaacuuaucuccaaaguggc

SEQ ID NO: 384552 - RNA, 64 nt, Homo Sapiens
auguuaugaacaccaaauuuuuccuaacuuuauuuuucaaaauguaaagugauuuucuaaguau

SEQ ID NO: 384553 - RNA, 64 nt, Homo Sapiens
ugcaaaaaaaaagauucugucagcaaaggcaguguuucaaaaagaacuuuggguuuuguaaaau

SEQ ID NO: 384554 - RNA, 64 nt, Homo Sapiens
uccaacuguuuguuauaaaguaaauacuguaauguuucaaaacacaguucauagcguagacugc

SEQ ID NO: 384555 - RNA, 64 nt, Homo Sapiens
acaacauaaaaaggugaucuuggcguauaauaauuuucaaaagauccuuuuucuccuccaaccu

SEQ ID NO: 384556 - RNA, 64 nt, Homo Sapiens
aucaggcgugccaacucuuguaagguaaauagucuuucaaaaauaauucuaaaugcacaccucc

SEQ ID NO: 384557 - RNA, 64 nt, Homo Sapiens
auuguuuguuuucucauuucugugucaaagaguguuucaaaagaaucuaaaaauaguuaagcac

SEQ ID NO: 384558 - RNA, 64 nt, Homo Sapiens
uuacuaaccagaauucuguuuauaugugaauuuuuuucaaaauuuguagucguuuaaugugaau

SEQ ID NO: 384559 - RNA, 64 nt, Homo Sapiens
auggguuugaaaaaccucaguggauuaaaaggccuuucaaaagauaaauugguuuacaugaaag

SEQ ID NO: 384560 - RNA, 64 nt, Homo Sapiens
uggcagauuuuuuuuuuuguguauucuagacaguuuucaaaaguguuaugcacuacuacuuuuu

SEQ ID NO: 384561 - RNA, 64 nt, Homo Sapiens
gaaaaacaaaauaguuuuuuaagcuauaguuuguuuucaaaaagaguugcaauuacuggcucuc

SEQ ID NO: 384562 - RNA, 64 nt, Homo Sapiens
gaugaauuguuauuauguguggagaaguuacucauuucaaaauguauacuagcaacacuacaaa

SEQ ID NO: 384563 - RNA, 64 nt, Homo Sapiens
ugaauuuuaaaauuucuuaugcucaggggaaauuuuucaaaaauguauauaaaaagcagccaaa

SEQ ID NO: 384564 - RNA, 64 nt, Homo Sapiens
guguauauaugauuucuauaauacuaaacuaauauuucaaaaauuugaaauguuaauauguuaa

SEQ ID NO: 384565 - RNA, 64 nt, Homo Sapiens
acaugcaaaaaaagcugaauccugacagcuucuuuuucaaaauauucuuauguaucuucugcuu

SEQ ID NO: 384566 - RNA, 64 nt, Homo Sapiens
aauugauguuuuaaaaauguguuaaauuguaaauuuucaaaauuguuauugauaggaucauguu

SEQ ID NO: 384567 - RNA, 64 nt, Homo Sapiens
aaagucaaucagcauuguuaaguuuucaaugauuuuucaaaauagagucucagaugauuauucc

SEQ ID NO: 384568 - RNA, 54 nt, Homo Sapiens
ugauauuucauuuugcguuuuacauuucaaaacuaacgcaggcaacagaccuaa

SEQ ID NO: 384569 - RNA, 64 nt, Homo Sapiens
acuuuaauguacaaguguaauauaugacuuuccuuuucaaaaaugauacauuauuuuaaucaua

SEQ ID NO: 384570 - RNA, 64 nt, Homo Sapiens
aaagguugucuuuuaaguuucuaaaaaaauaaaauuucaaaagauuguuuucuucuuuuguguu

SEQ ID NO: 384571 - RNA, 64 nt, Homo Sapiens
auauuuaaaaucuuugaaagguuuaucaauacccuuucaaaaaugaucaaaucugcuuuucaaa

SEQ ID NO: 384572 - RNA, 64 nt, Homo Sapiens
cuaaaauauuacaaaauaaguuccauauuuuauuuuucaaaacccaaaauuaaaaaaaauugau

SEQ ID NO: 384573 - RNA, 64 nt, Homo Sapiens
cuccaacagcugacucucguaagcuugucaaugauuucaaaauuaagaaucuuaaugaacacac

SEQ ID NO: 384574 - RNA, 64 nt, Homo Sapiens
aaaauuugucucaucuuuuaauuucuuuaacuuauuucaaaaucaucucaugacccuugugugc

SEQ ID NO: 384575 - RNA, 64 nt, Homo Sapiens
guacacucuggccgaagggaguccuuauguuuaguuucaaaauauauuacuuuccuggauucuc

SEQ ID NO: 384576 - RNA, 64 nt, Homo Sapiens
uugugaccuaaggacgauggugaaaagaucacguuuucaaaacaaucuggugaucagaauguuc

SEQ ID NO: 384577 - RNA, 64 nt, Homo Sapiens
cccaccccaccccacccuucacaccuggcugauuuuucaaaaaguuuuuuuguagaaacagggu

SEQ ID NO: 384578 - RNA, 64 nt, Homo Sapiens
aucaaaauuuaacauggcuucaguaugagaucuuuuucaaaacuauuuucuuaaacauuuauuu

SEQ ID NO: 384579 - RNA, 64 nt, Homo Sapiens
guuuauuugaaaaauuucuagauggucucaugaguuucaaaauaauaauuuuuguguaugaaca

SEQ ID NO: 384580 - RNA, 64 nt, Homo Sapiens
gguaauuuaaagacaacaauuuaaugucacuaauuuucaaaauuaaauaguuuaagcucaauuu

SEQ ID NO: 384581 - RNA, 64 nt, Homo Sapiens
aagggaacuauaaccuuaggauuccugaaaagaauuucaaaaaaaaaauaaagacacuguugcc

SEQ ID NO: 384582 - RNA, 64 nt, Homo Sapiens
gcauuuaaaaucauacauguguucuacucuaagauuucaaaagucaaguauuacuagaguggug

SEQ ID NO: 384583 - RNA, 64 nt, Homo Sapiens
ggauaaauccucugugguaauaugggaugaaauauuucaaaagaaaggcagagcuucuauucuu

SEQ ID NO: 384584 - RNA, 64 nt, Homo Sapiens
caguaaucaaaaugugaucuaauaaggaauacauuuucaaaauggaucucuuauuuaaaauuua

SEQ ID NO: 384585 - RNA, 64 nt, Homo Sapiens
cucaccuacuggaagugugacagagaguacacuuuuucaaaauguaggccaaaauuauuguguc

SEQ ID NO: 384586 - RNA, 64 nt, Homo Sapiens
uuuaaagcauaaccuaacuguuaaggauaccugauuucaaaauauucuaaaaggaaaucaguag

SEQ ID NO: 384587 - RNA, 64 nt, Homo Sapiens
cuaauccguaguaauuccuaaaaggaaacuuuauuuucaaaaacgaauguagaccauuuuccaa

SEQ ID NO: 384588 - RNA, 64 nt, Homo Sapiens
uaauuucaguuuggagcuuucagccaaguuuucauuucaaaaugauuuuaaaaauauuuuacug

SEQ ID NO: 384589 - RNA, 64 nt, Homo Sapiens
accuuuuaaaaugaucucaguccaucuuggaagguuucaaaauuggugccauguaucugacagu

SEQ ID NO: 384590 - RNA, 64 nt, Homo Sapiens
ccaagaauuucuaguauauuuagcuuuccuuucauuucaaaagugggcaugaaaaacuaacugc

SEQ ID NO: 384591 - RNA, 64 nt, Homo Sapiens
guugucugcaacauuuuugucaacaccaauacccuuucaaaagaagaaaacacacuuccugcac

SEQ ID NO: 384592 - RNA, 64 nt, Homo Sapiens
aaaaucgggacaagugaacaacaaaaacaaaaucuuucaaaaaacuucacugugucaaguggaa

SEQ ID NO: 384593 - RNA, 64 nt, Homo Sapiens
gggagauucuuugcucagcuaacacauuucuguuuuucaaaauugaugcuuaauuguagcuguu

SEQ ID NO: 384594 - RNA, 64 nt, Homo Sapiens
gcuaugguuguagugugacccguggcuaaccugcuuucaaaaucaaguauuugcuguagcagag

SEQ ID NO: 384595 - RNA, 64 nt, Homo Sapiens
cauuugauuauuuuuuuuaagaagagaacaggucuuucaaaaagguaugaauauguguggcagu

SEQ ID NO: 384596 - RNA, 64 nt, Homo Sapiens
agcacaaauuaaaguaguaaacuugaaaacuuuuuuucaaaaaaguauguuuacuauugcucuu

SEQ ID NO: 384597 - RNA, 64 nt, Homo Sapiens
ggcaucuaaauguguuccuaagacuaaaacguucuuucaaaagauuuuuaaacucaguuuaaaa

SEQ ID NO: 384598 - RNA, 64 nt, Homo Sapiens
guguuuaaaaauugcauugucugcacuuuuaaguuuucaaaacaaaaggaaacuaaguauauug

SEQ ID NO: 384599 - RNA, 64 nt, Homo Sapiens
aguugaguaacagcaacauauauaggacauuuguuuucaaaagcgcgucguuucuauaaaacac

SEQ ID NO: 384600 - RNA, 64 nt, Homo Sapiens
cacagugcaucaugagcaacccauuucuagccucuuucaaaaaggccuccauuucaucucaugu

SEQ ID NO: 384601 - RNA, 64 nt, Homo Sapiens
ugguugcagcauagagaagaaacacugguccuucuuucaaaauuaagcaacuauuaaaagcgcc

SEQ ID NO: 384602 - RNA, 64 nt, Homo Sapiens
accuaaacuagagacuagacguaaagccuucaguuuucaaaaucuuucuggucacuauaaagau

SEQ ID NO: 384603 - RNA, 64 nt, Homo Sapiens
uuguggguuugucauuuauugguuaaugcucuaguuucaaaaccacccuguugaaaguuccagu

SEQ ID NO: 384604 - RNA, 64 nt, Homo Sapiens
gaauuucugacugugcccuuuagggccuccugaguuucaaaaggaggaaguguucgugcuugug

SEQ ID NO: 384605 - RNA, 64 nt, Homo Sapiens
agaugugucaugaaaacagcauuucacaugcacauuucaaaacauuacagagguucggacuaac

SEQ ID NO: 384606 - RNA, 64 nt, Homo Sapiens
uauuguuuagcacuuaacuccaaagaugacuucuuuucaaaaugauggcaaagaaaaaguaaau

SEQ ID NO: 384607 - RNA, 64 nt, Homo Sapiens
acaacugaggugugcgggcuagcuuuguaccuguuuucaaaagcagucacagcucccaugccuc

SEQ ID NO: 384608 - RNA, 64 nt, Homo Sapiens
agcuuuuuucuauauauaaaguauaaaucuggguuuucaaaaccacagaaaaaaaauguuuugg

SEQ ID NO: 384609 - RNA, 64 nt, Homo Sapiens
cuuucuaaggaugauauuggaaacacgauaaaccuuucaaaagagugguagagcaaaaaaaccc

SEQ ID NO: 384610 - RNA, 64 nt, Homo Sapiens
ugaaucuuuggaagccuugauaaauccauagaguuuucaaaauggcaaaccuggagaacccucc

SEQ ID NO: 384611 - RNA, 64 nt, Homo Sapiens
cagauuugaauagcagcauugaguaacucaguaauuucaaaauaaaaauaagacuaauuuuuaa

SEQ ID NO: 384612 - RNA, 64 nt, Homo Sapiens
aauauaaacaggaucucaaaacaugggccagguuuuucaaaaggauaugcuuucuuuugcaugg

SEQ ID NO: 384613 - RNA, 64 nt, Homo Sapiens
auuuccaaucacaaggaaagaucaguuuacuucauuucaaaacuagcagcugugacaaccucca

SEQ ID NO: 384614 - RNA, 64 nt, Homo Sapiens
augggucccaaagccuaaccguauacgucuaagauuucaaaacagugugagccuaugaaaaagu

SEQ ID NO: 384615 - RNA, 64 nt, Homo Sapiens
ucuuuuuaaggaagugcuguuuuuuuuugaggguuuucaaaacauuuugaaaagcauuuacuuu

SEQ ID NO: 384616 - RNA, 64 nt, Homo Sapiens
aaagcauuuacuuuuuugaccacgagccaugaguuuucaaaaaaaucggggguuguguggguuu

SEQ ID NO: 384617 - RNA, 64 nt, Homo Sapiens
cuccugugguauugauugagcagagcagaagagauuucaaaaaaagaccuaugcauuuauuaga

SEQ ID NO: 384618 - RNA, 64 nt, Homo Sapiens
ggacuucagcuuuuuauauaaacauccacuucucuuucaaaagacuucaaguaaauauaagaag

SEQ ID NO: 384619 - RNA, 64 nt, Homo Sapiens
uacagcuuagaaaacaccaguuggaaaaauacuuuuucaaaaacacugugcgaauguaauaaag

SEQ ID NO: 384620 - RNA, 64 nt, Homo Sapiens
uaaaucauaguguugagaaaaaacaccucaaacuuuucaaaacaaagaugugacagugcuuuga

SEQ ID NO: 384621 - RNA, 64 nt, Homo Sapiens
gguccauuagggcuucguuguguccagcuucuaauuucaaaacgaagagaccaaagccuguaac

SEQ ID NO: 384622 - RNA, 64 nt, Homo Sapiens
cugagugagucugacugaaacucgugaugauucauuucaaaaucuucaacuuuaaaacaaauuu

SEQ ID NO: 384623 - RNA, 64 nt, Homo Sapiens
gaaaacuuuuacuuguggggcaaaguucaauguguuucaaaaggaagccuuucaguaggauauc

SEQ ID NO: 384624 - RNA, 64 nt, Homo Sapiens
agguauuagagcacuaucagaucauugcuuaauauuucaaaaauugggcaaggccauucucuac

SEQ ID NO: 384625 - RNA, 64 nt, Homo Sapiens
caagugucucuugacagcccgcuuucauguccuguuucaaaaacuuugaauuuaggugggauuu

SEQ ID NO: 384626 - RNA, 64 nt, Homo Sapiens
agauuauuuaaaacaugagugcuaaggcuuauuauuucaaaagaccuaguugccugcaaagcca

SEQ ID NO: 384627 - RNA, 64 nt, Homo Sapiens
uucacuuaaaauuauuaugcaaaaaugaauguuuuuucaaaaaaugugaaauguauuuuauuuu

SEQ ID NO: 384628 - RNA, 64 nt, Homo Sapiens
ucuacaaauuacagguuuauccauuugcaaauauuuucaaaauggaaaucacuguuuauauuga

SEQ ID NO: 384629 - RNA, 64 nt, Homo Sapiens
gauggaaguguaagaaauugaagaguucuaaggcuuucaaaaacacucagucaaaaauuuaaaa

SEQ ID NO: 384630 - RNA, 64 nt, Homo Sapiens
uggaaauuggaauggagucuccugucccaaucauuuucaaaaucuagccaggcaaauuucuguu

SEQ ID NO: 384631 - RNA, 64 nt, Homo Sapiens
uuaauaugccauuggguuuuuguguguaugugauuuucaaaauucaugacuugaagugcaagga

SEQ ID NO: 384632 - RNA, 64 nt, Homo Sapiens
gacauuauuugauaaguauauaacauuuacaucauuucaaaaaauacugccguuacugucuuuu

SEQ ID NO: 384633 - RNA, 64 nt, Homo Sapiens
uauguauauuuuguuccuguuauauuggcuuuauuuucaaaauuguaguuuguaguauuaguuu

SEQ ID NO: 384634 - RNA, 64 nt, Homo Sapiens
uaaaaagguccucacaggugcuuggcuugccauuuuucaaaaaguaguuggcaguuguuaaguc

SEQ ID NO: 384635 - RNA, 64 nt, Homo Sapiens
auuuagucuaacaacugcccugauuggaagggcuuuucaaaaucuuacaauccauauaagcccu

SEQ ID NO: 384636 - RNA, 64 nt, Homo Sapiens
uugcacauauuguucuguguguuagucacaguauuuucaaaaguuuauuguuugucggugaagu

SEQ ID NO: 384637 - RNA, 64 nt, Homo Sapiens
auaagaaaaguucaaaaacuaguuaaaacauauguuucaaaaauuguauuuuucuuguaguguu

SEQ ID NO: 384638 - RNA, 64 nt, Homo Sapiens
uauuuaaguuguuaucaccuaccauuuuuuuuuauuucaaaacuuuaaccugaaaguugaaaca

SEQ ID NO: 384639 - RNA, 64 nt, Homo Sapiens
aguuaucauagaaucuugugugaaguuuauucucuuucaaaauauuggugcuaaagugcuuuuu

SEQ ID NO: 384640 - RNA, 64 nt, Homo Sapiens
cuugcauuuuaaguguuuaaaagcaaauacugacuuucaaaaaaguuuuuaaaaccugauuuga

SEQ ID NO: 384641 - RNA, 64 nt, Homo Sapiens
uuaauagaguaagguaaagaagauauuaagucccuuucaaaauggaaaauuaauucuaaacuga

SEQ ID NO: 384642 - RNA, 64 nt, Homo Sapiens; identical to SEQ ID NO: 384640

SEQ ID NO: 384643 - RNA, 64 nt, Homo Sapiens; identical to SEQ ID NO: 384641

SEQ ID NO: 384644 - RNA, 64 nt, Homo Sapiens; identical to SEQ ID NO: 294347

SEQ ID NO: 384645 - RNA, 64 nt, Homo Sapiens; identical to SEQ ID NO: 294348

SEQ ID NO: 384646 - RNA, 64 nt, Homo Sapiens; identical to SEQ ID NO: 294349

SEQ ID NO: 384647 - RNA, 64 nt, Homo Sapiens; identical to SEQ ID NO: 294350

SEQ ID NO: 384648 - RNA, 64 nt, Homo Sapiens; identical to SEQ ID NO: 294351

SEQ ID NO: 384649 - RNA, 64 nt, Homo Sapiens; identical to SEQ ID NO: 294352

SEQ ID NO: 384650 - RNA, 64 nt, Homo Sapiens; identical to SEQ ID NO: 294353

SEQ ID NO: 384651 - RNA, 64 nt, Homo Sapiens; identical to SEQ ID NO: 294354

SEQ ID NO: 384652 - RNA, 64 nt, Homo Sapiens; identical to SEQ ID NO: 294355

SEQ ID NO: 384653 - RNA, 64 nt, Homo Sapiens; identical to SEQ ID NO: 294356

SEQ ID NO: 384654 - RNA, 64 nt, Homo Sapiens
caggacacauuauuguucugauagaugcucacagggaaucaagcuucucgcccacuccacggcu

SEQ ID NO: 384655 - RNA, 64 nt, Homo Sapiens
ggaucuccugggccuuggagcaccucacgcugggggaaucaaucccugagggacucagaaucuu

SEQ ID NO: 384656 - RNA, 64 nt, Homo Sapiens
acuugaaguugcuuuuuugacucuuuuggacaaaggaaucaauucauauacuuuaauguuuuaa

SEQ ID NO: 384657 - RNA, 64 nt, Homo Sapiens
auaguaacucuuucuuuccguagacacagcccgaggaaucaacaccauucagaauaucaucuuu

SEQ ID NO: 384658 - RNA, 59 nt, Homo Sapiens
aauuuuuuucccuuucagucauugucuuauaugcuuagcauagauuugcagcucaguag

SEQ ID NO: 384659 - RNA, 59 nt, Homo Sapiens
uucucccauuccuugucugccauucugaauaugcuuauuaaaauauuuuuuuaaacaua

SEQ ID NO: 384660 - RNA, 59 nt, Homo Sapiens
cugggcacuuuuuaacauugcugauguaguaugcuuaagagaaaugaccuaaauaagga

SEQ ID NO: 384661 - RNA, 59 nt, Homo Sapiens
ucagaauauaacuucaggacaauucaaacuaugcuuaauguaugauuuucgagcuucug

SEQ ID NO: 384662 - RNA, 59 nt, Homo Sapiens
uuacaggcggcuauugcagacggcuaauuuaugcuuaacuuaggaagagauaaggcaag

SEQ ID NO: 384663 - RNA, 59 nt, Homo Sapiens
uuccuacuggaggauuuauuuaaauaaaauaugcuuauuaaacacuccugcaaagaugg

SEQ ID NO: 384664 - RNA, 59 nt, Homo Sapiens
agagagugguuggagccccccccgccccguaugcuuacauuauugcucuuuuaguuuga

SEQ ID NO: 384665 - RNA, 59 nt, Homo Sapiens
uaguuuugccagaacaguuuguacagacguaugcuuauuuuaaaauuuuaucucuuauu

SEQ ID NO: 384666 - RNA, 59 nt, Homo Sapiens
auacuauuuauaacaguauaugauugauuuaugcuuaugugguuguucaguuuguuccc

SEQ ID NO: 384667 - RNA, 59 nt, Homo Sapiens
uauuuguaaaaaauuucauuuaucucuaauaugcuuaugugauugccccuaggggagua

SEQ ID NO: 384668 - RNA, 59 nt, Homo Sapiens
uguacauuuuccugcugguacuugugguuuaugcuuaaacuggucucaccgugugcagc

SEQ ID NO: 384669 - RNA, 59 nt, Homo Sapiens
ccugggcaacuauuuuuuguaaaccuguguaugcuuaugaccauauguguauaauuaac

SEQ ID NO: 384670 - RNA, 59 nt, Homo Sapiens
uaugaaagugaauaaagcagacuggcaucuaugcuuagcggugccaagggcaggugacc

SEQ ID NO: 384671 - RNA, 59 nt, Homo Sapiens
uugugcugccagaaacuguaaaauaaggcuaugcuuauugagcugauggacacaagauc

SEQ ID NO: 384672 - RNA, 59 nt, Homo Sapiens
gugguaagaaauggacuugaaucuguuaauaugcuuauaacaaguauguuuugauauau

SEQ ID NO: 384673 - RNA, 59 nt, Homo Sapiens
uuauuuauuuauugcauuuuacaguucucuaugcuuaacgaccggggagucaguuucag

SEQ ID NO: 384674 - RNA, 59 nt, Homo Sapiens
guguuaucugugaaugcacauuagaaucuuaugcuuacaaauguuaaauaucuaacagu

SEQ ID NO: 384675 - RNA, 59 nt, Homo Sapiens
gcgcuguggacaaucugauuauaauguguuaugcuuaugaaauguccccuuaacuugau

SEQ ID NO: 384676 - RNA, 59 nt, Homo Sapiens
auugucaugucuagauuuaaacugagugguaugcuuacaucacugaauaguuuuaaaug

SEQ ID NO: 384677 - RNA, 59 nt, Homo Sapiens
aaacagauuuaugagaaaagguuauuauauaugcuuaugcaauuaagaauauauaugau

SEQ ID NO: 384678 - RNA, 59 nt, Homo Sapiens
gggcuguugucuaaacugagaaaauggccuaugcuuaagaggaaaaugaaaguguuccu

SEQ ID NO: 384679 - RNA, 59 nt, Homo Sapiens
ugcacuagacacacagaguggaacagccguaugcuuaaaguacaugggccagugggacu

SEQ ID NO: 384680 - RNA, 59 nt, Homo Sapiens
ugcuuguugugaaagacacagauacccaguaugcuuaacgugaaaagaaaauguguucu

SEQ ID NO: 384681 - RNA, 59 nt, Homo Sapiens
auaagugcaauucuuucauugucuauuauuaugcuuaagaaaauauucaguuaauaaaa

SEQ ID NO: 384682 - RNA, 59 nt, Homo Sapiens
gucacuaccucuaaccuuuuuaaucgcaauaugcuuauuauuuaguucccuaauuuccc

SEQ ID NO: 384683 - RNA, 59 nt, Homo Sapiens
acaaugcaaugaaacagaugauaaauauuuaugcuuaaaauauguaugucuaauugagu

SEQ ID NO: 384684 - RNA, 59 nt, Homo Sapiens
gauuguguauuauuuaugucuguaguuuauaugcuuaguuguugccuauagugaucugg

SEQ ID NO: 384685 - RNA, 59 nt, Homo Sapiens
ugaacgauagaaauaugcagcaugcaauauaugcuuauauuucauuuuaauuucugaua

SEQ ID NO: 384686 - RNA, 59 nt, Homo Sapiens
guacauuuucacuaggaaaagaaaucaaauaugcuuaugcaauauauauuuguguguuu

SEQ ID NO: 384687 - RNA, 59 nt, Homo Sapiens
auucaaucaaucagcugugauugauugauuaugcuuagaaauacuauaguaacuagaug

SEQ ID NO: 384688 - RNA, 59 nt, Homo Sapiens
uuuaaaguauuccauuuagauuugauagauaugcuuaagcaaucuauaaaucauuuuca

SEQ ID NO: 384689 - RNA, 59 nt, Homo Sapiens
uaacaacaauaacacugucuccuuucucuuaugcuuaaggcuuugggaauguuuuuagc

SEQ ID NO: 384690 - RNA, 59 nt, Homo Sapiens
auuuaacccuuaguuuaagaagaagucaauaugcuuauuuaaauauuauggaugguggg

SEQ ID NO: 384691 - RNA, 59 nt, Homo Sapiens
agacuucauaaugauuuuauaaacaguguuaugcuuacauuuauuucuguuugaauuug

SEQ ID NO: 384692 - RNA, 59 nt, Homo Sapiens
accuaguuaaagaaaggaaacuuauuuaauaugcuuauaggugcuuggaguuuaccugg

SEQ ID NO: 384693 - RNA, 59 nt, Homo Sapiens
guacuuguuaucaacacguuuaaauuuucuaugcuuauucuuuuaauuaauauguucau

SEQ ID NO: 384694 - RNA, 59 nt, Homo Sapiens
guuuuggcaccaaugcuguagaaucacucuaugcuuagacuauggauaauuucaaagua

SEQ ID NO: 384695 - RNA, 59 nt, Homo Sapiens
agcaaaaaaguuuugauggguguuguauuuaugcuuaagaauuuuauauguaugcuauu

SEQ ID NO: 384696 - RNA, 59 nt, Homo Sapiens
uugacacauuaacuaaaugcuuagguuauuaugcuuaaucuuauucagauaguccaaau

SEQ ID NO: 384697 - RNA, 59 nt, Homo Sapiens
cguguuuguauuguaggugguguuuguauuaugcuuaugacuauguaugguuugaaaau

SEQ ID NO: 384698 - RNA, 59 nt, Homo Sapiens
gaaaaugguccaauuaguuuccuuuuuaauaugcuuaaaauaagcagguggaucuauuu

SEQ ID NO: 384699 - RNA, 59 nt, Homo Sapiens
cugagagaguuuuauacauggaaaauggguaugcuuaaagauugcaggguagggaggga

SEQ ID NO: 384700 - RNA, 59 nt, Homo Sapiens
cccaaaaggaaacuuuaguucacuugcaguaugcuuauccuugacugcacaugagaaug

SEQ ID NO: 384701 - RNA, 59 nt, Homo Sapiens
uuuuuaauucaagaaaaguuuaccuuucuuaugcuuauguuagcuaugccagcucuuaa

SEQ ID NO: 384702 - RNA, 59 nt, Homo Sapiens
agguguaaccacugccaauaggcuguuucuaugcuuauuuccuauuuugauuuuuacuu

SEQ ID NO: 384703 - RNA, 59 nt, Homo Sapiens
accucaguguauaagaugugcaagacaaauaugcuuauuuccuuuucuagaauauaagu

SEQ ID NO: 384704 - RNA, 59 nt, Homo Sapiens
uguauuuugucuugggcugcaauuuguuuuaugcuuauuuuauuauuacugcaguaguu

SEQ ID NO: 384705 - RNA, 59 nt, Homo Sapiens
cucuagcaguauggaaaugugcuuuaaaauaugcuuaccuuuugaaugaucauggcuau

SEQ ID NO: 384706 - RNA, 59 nt, Homo Sapiens
agcuguuuccuguuucucuuaaaugugauuaugcuuaacugauuuuuuuuuaaaucaca

SEQ ID NO: 384707 - RNA, 59 nt, Homo Sapiens
guugugcauauacuggcaauuuauaguucuaugcuuacucuguuaauuacauuguguau

SEQ ID NO: 384708 - RNA, 59 nt, Homo Sapiens
uuuguuugaaauuuguuuuuccauuugguuaugcuuauuauuuauuuauucuuuuauuu

SEQ ID NO: 384709 - RNA, 59 nt, Homo Sapiens
uucuuagcaguugauaaaaugaaagagguuaugcuuaucgagggugauauguuuuaaag

SEQ ID NO: 384710 - RNA, 59 nt, Homo Sapiens
ggagcugguggccaggggugcuacuuagguaugcuuaggccaguugugcauguacccgg

SEQ ID NO: 384711 - RNA, 59 nt, Homo Sapiens
auaaaugugucacuucuaaaucacgcauguaugcuuaguucugugcuuauuuuuuuugc

SEQ ID NO: 384712 - RNA, 59 nt, Homo Sapiens
guaaauauuuccuagcuuguauuucacaauaugcuuacauugauaguaugucuuccaga

SEQ ID NO: 384713 - RNA, 59 nt, Homo Sapiens
uuuuuaaggaaguaaguuauuuuuugugauaugcuuauauauauauauuuauucuuuag

SEQ ID NO: 384714 - RNA, 59 nt, Homo Sapiens
cugaacaccuuucauauuggaaaugauuguaugcuuaugucauaaagagcaguuuuacu

SEQ ID NO: 384715 - RNA, 59 nt, Homo Sapiens
cccucacacuguguuaugcucugaugugcuaugcuuagcuaucugucagagauuaguaa

SEQ ID NO: 384716 - RNA, 59 nt, Homo Sapiens
gaaaagcacuuuuuacuacauacacauuuuaugcuuaaaaaguuaacaugauacgaaac

SEQ ID NO: 384717 - RNA, 59 nt, Homo Sapiens
aaagaaggaauggucuuccaugaacugauuaugcuuaauuaagcaaaguaaggaaauua

SEQ ID NO: 384718 - RNA, 59 nt, Homo Sapiens
auaaaguauuuuaauagaaaaaucacuuguaugcuuauauuuucaguaauuauuguaug

SEQ ID NO: 384719 - RNA, 59 nt, Homo Sapiens
ugccaaacuuuuuaaaauacaauauaaauuaugcuuauuuauuauuuucuuuaguuuaa

SEQ ID NO: 384720 - RNA, 59 nt, Homo Sapiens
cauuuaaggagcauuuaaaaaaauuugucuaugcuuagggaauuugccuauugauaggc

SEQ ID NO: 384721 - RNA, 59 nt, Homo Sapiens
cuaguuaaaaagaaaauaaacaaaacagauaugcuuacucuaagaagaugagaaucaaa

SEQ ID NO: 384722 - RNA, 59 nt, Homo Sapiens
guuuucaaaccaacaaacucuugcuucaauaugcuuauuauguaaauauugaaacaaga

SEQ ID NO: 384723 - RNA, 59 nt, Homo Sapiens
gcaagcuaggauagugauuuguuucagccuaugcuuaaugccuaaucaaggcaaguguu

SEQ ID NO: 384724 - RNA, 59 nt, Homo Sapiens
uacaacugauggcaugaaaauaugauggauaugcuuaagaccaucuuuugcaacugaaa

SEQ ID NO: 384725 - RNA, 59 nt, Homo Sapiens
aaauggugauggcuuauggacuugccuguuaugcuuacauaacaguuaucuuugacucu

SEQ ID NO: 384726 - RNA, 59 nt, Homo Sapiens
ucagguuucuuuagugugcuuguacagauuaugcuuacccaaaaaggacaguuuaauuu

SEQ ID NO: 384727 - RNA, 59 nt, Homo Sapiens
ucuuuucaaaagacuugacauggcauauuuaugcuuaggcccuuuacuacacucaugag

SEQ ID NO: 384728 - RNA, 59 nt, Homo Sapiens
gguucuuuguacaauuuugacuuuaucaauaugcuuaauuguuuugucuguaaaacugu

SEQ ID NO: 384729 - RNA, 59 nt, Homo Sapiens
uuuuaaggcauuuuaaauaauauguauauuaugcuuagcauacuaggaaaaggaguuac

SEQ ID NO: 384730 - RNA, 59 nt, Homo Sapiens
uuaucuuacugguucaacauccuuuucuuuaugcuuagaauuugggguucauuuugcuu

SEQ ID NO: 384731 - RNA, 59 nt, Homo Sapiens
ugucuucuauaaauccaaugguaacaugcuaugcuuauauuugacgugugccauacaug

SEQ ID NO: 384732 - RNA, 59 nt, Homo Sapiens
ucacucuuuauucuuuucuuugauuaugguaugcuuauuuggaaagucagugaaacugu

SEQ ID NO: 384733 - RNA, 59 nt, Homo Sapiens
aucuuuaccguaguaguucaggccaagauuaugcuuaguuuuaguucuccagguaguua

SEQ ID NO: 384734 - RNA, 59 nt, Homo Sapiens
cacuuccaaugagauaaaauauuuacuauuaugcuuauuagaacaaaagguguuuaagg

SEQ ID NO: 384735 - RNA, 59 nt, Homo Sapiens
ccuuuuauuaauugucaauuuagagaaacuaugcuuaagcuggucuuuugcauugcuaa

SEQ ID NO: 384736 - RNA, 59 nt, Homo Sapiens
uaauugaugucaauauuaguaguccacuuuaugcuuaaaauaaaaucauaaaaaaucaa

SEQ ID NO: 384737 - RNA, 59 nt, Homo Sapiens
caggagccuacuucuagcuguauuuuuuguaugcuuaaauaaaaauaaaaauucauaac

SEQ ID NO: 384738 - RNA, 59 nt, Homo Sapiens
uauauguguaauguuuuaugucaaacaauuaugcuuaauauacagucuauuaaauguaa

SEQ ID NO: 384739 - RNA, 59 nt, Homo Sapiens
uuguuugauucaucuucaacuuugcguauuaugcuuaacuucacaaguuaacuuuuucu

SEQ ID NO: 384740 - RNA, 59 nt, Homo Sapiens
ugcauguguaaugguuuaugucaaacaauuaugcuuaauauaaagucuauuaaguggua

SEQ ID NO: 384741 - RNA, 59 nt, Homo Sapiens
ccuaucuuuagcugaacuucacccacuauuaugcuuaugguaaaauuaaauagagcaau

SEQ ID NO: 384742 - RNA, 59 nt, Homo Sapiens
aaacuuuuuaauuaaagaaccuaguuugcuaugcuuaaaauuaccaagaauuuuuuauu

SEQ ID NO: 384743 - RNA, 59 nt, Homo Sapiens
agugagagcugaaaugagacgauguggauuaugcuuaacaaauuuuuaucugagauugg

SEQ ID NO: 384744 - RNA, 59 nt, Homo Sapiens
ucugugccuacuguauaauguugauaaaguaugcuuauuacagcgauuuaguguuuugu

SEQ ID NO: 384745 - RNA, 59 nt, Homo Sapiens
aagucuccagucaccuacaauucucucaauaugcuuacauuacuaaccuucuggcuucc

SEQ ID NO: 384746 - RNA, 59 nt, Homo Sapiens
auauccuuuguggcaccuuuaugaauucuuaugcuuauaucugaagugguuguuuuguc

SEQ ID NO: 384747 - RNA, 59 nt, Homo Sapiens
aaagcaauuuauuuaaguaauucuacauauaugcuuacauaucaauuacuaaugggaau

SEQ ID NO: 384748 - RNA, 59 nt, Homo Sapiens
augaaaagauauuuuuuguaggcuuuauauaugcuuauagauauguaauaguugcagaa

SEQ ID NO: 384749 - RNA, 59 nt, Homo Sapiens
uugauguuaauauuuaacuuuuaaucuaguaugcuuaacggguggguucagaguaccuu

SEQ ID NO: 384750 - RNA, 59 nt, Homo Sapiens
cuaaguggaaaucaggauugcuugugauuuaugcuuacuaacaguuucugcaauacaag

SEQ ID NO: 384751 - RNA, 59 nt, Homo Sapiens
uuguguucauuugcacucggugcagcgguuaugcuuaugaaaauaccuggcagcuuugu

SEQ ID NO: 384752 - RNA, 59 nt, Homo Sapiens
ccgcugaggagcauaccccaaaccagacauaugcuuaggauucaugcugagauaucaau

SEQ ID NO: 384753 - RNA, 59 nt, Homo Sapiens
ggugcuugcaguagagugauaggacauucuaugcuuacagaaaauauagccaugauuga

SEQ ID NO: 384754 - RNA, 59 nt, Homo Sapiens
auaaaugaaguacuuguaccuauauuaauuaugcuuacgccaugauaaccaauauacag

SEQ ID NO: 384755 - RNA, 59 nt, Homo Sapiens
aggaaaauuuuacagacacuuaaaguauuuaugcuuaagugugcauuuuuuuauucuaa

SEQ ID NO: 384756 - RNA, 59 nt, Homo Sapiens
aaagagagacaagugcucuucucucuaucuaugcuuaaugccuuuauguaaguuacuua

SEQ ID NO: 384757 - RNA, 59 nt, Homo Sapiens
caagagauauaauguuucuuuuaauugucuaugcuuaaucaucuuuaaacacuuuuuaa

SEQ ID NO: 384758 - RNA, 59 nt, Homo Sapiens
ggacuuuuagauuaaaaaaaaaucagaauuaugcuuaacuuucccuacaaagaaaguag

SEQ ID NO: 384759 - RNA, 59 nt, Homo Sapiens
uguuuaauuuaguuugcuuaugaugugacuaugcuuaagguugguuucuuauguuccug

SEQ ID NO: 384760 - RNA, 59 nt, Homo Sapiens
ggccuggggcucaauacaguuuugauauauaugcuuaaugggaauguagccacugagga

SEQ ID NO: 384761 - RNA, 59 nt, Homo Sapiens
ugaguuuaucaagacuuuuucugcuaagguaugcuuauuaauuguagguguuucgugug

SEQ ID NO: 384762 - RNA, 59 nt, Homo Sapiens
cauaaagagacuuaaacuacaacaaacaauaugcuuaaugaugaaauagugaacauuuc

SEQ ID NO: 384763 - RNA, 59 nt, Homo Sapiens
aaauacacauggaaaaaaaaaaaacccuauaugcuuacugugcaccuagagcuuuuuua

SEQ ID NO: 384764 - RNA, 59 nt, Homo Sapiens
gguuuugcuaugugcucacauuucaacuuuaugcuuaacaugaauggaaaaauaugaaa

SEQ ID NO: 384765 - RNA, 59 nt, Homo Sapiens
uuauuccuuaaauuccacucuuuuaacacuaugcuuaaccacuuaaugugaugaaauau

SEQ ID NO: 384766 - RNA, 59 nt, Homo Sapiens
uacugguccaaaagauugcugaaauuuuauaugcuuacugauauauuuuacaauuuuuu

SEQ ID NO: 384767 - RNA, 59 nt, Homo Sapiens
gauuaauugaauucucuuuucacauuaguuaugcuuaacucauaagguuauuauaauaa

SEQ ID NO: 384768 - RNA, 59 nt, Homo Sapiens
uuuuagcauggaaaaauaauuucaggcaauaugcuuaaaaauugggggaagacaaaaga

SEQ ID NO: 384769 - RNA, 59 nt, Homo Sapiens
ugucauuucacaagaaaaaaugcacacaguaugcuuaugcucucuucucuuugccugua

SEQ ID NO: 384770 - RNA, 59 nt, Homo Sapiens
ucuagcacauuccaggggguaggaugccuuaugcuuaucaggguggagugggcacagac

SEQ ID NO: 384771 - RNA, 59 nt, Homo Sapiens
aagauuucucaggaagacaggauuguuuauaugcuuacaaauuacuauuuuuuguuaaa

SEQ ID NO: 384772 - RNA, 59 nt, Homo Sapiens
cauccguguauuuggcugggaguuucagguaugcuuaagguaauaaauaaauauacuca

SEQ ID NO: 384773 - RNA, 59 nt, Homo Sapiens
uuuaauuggaggaaaugaauccuaggguuuaugcuuaauauaugugcagaagguuacua

SEQ ID NO: 384774 - RNA, 59 nt, Homo Sapiens
uguuuugucauuuacgugaccugucauuauaugcuuauuuuauuuugccacuuacuuuu

SEQ ID NO: 384775 - RNA, 59 nt, Homo Sapiens
agcuucuucacuguuuugaagacaaauuuuaugcuuagcucaucaccuuuguagcauuu

SEQ ID NO: 384776 - RNA, 59 nt, Homo Sapiens
ggaauucugccacagcaggauauauaauguaugcuuauuauuuccaacuggaaaauaac

SEQ ID NO: 384777 - RNA, 59 nt, Homo Sapiens
gguguuacauacaaauaaacuagaugcuauaugcuuauauuguaaauacacuuaaaaug

SEQ ID NO: 384778 - RNA, 56 nt, Homo Sapiens
uucucauaaaugaaggucugugaguauaugcuuaugcauucuuuucaaaauuguga

SEQ ID NO: 384779 - RNA, 59 nt, Homo Sapiens
aguuugcauuaugacuccugguauauauuuaugcuuauauugccauuugguagcaucau

SEQ ID NO: 384780 - RNA, 59 nt, Homo Sapiens
uauuaagucuaugggcugguuuucuuguauaugcuuauauacagaguggggagagacuu

SEQ ID NO: 384781 - RNA, 59 nt, Homo Sapiens
cacuguugguggaaauguaaagaaaaagauaugcuuauaagaugcuggugagguugugg

SEQ ID NO: 384782 - RNA, 59 nt, Homo Sapiens
ucucuggggucggggggauuaaaaggguuuaugcuuacgcagaguauuuggaaaaagaa

SEQ ID NO: 384783 - RNA, 59 nt, Homo Sapiens
gagaaaaauugauguuugauguugauagauaugcuuauaccuaauuuuuaguuuuuaaa

SEQ ID NO: 384784 - RNA, 59 nt, Homo Sapiens
gugcuggacuuucucauggccaucaucaguaugcuuauggauuugaugacaggcauagc

SEQ ID NO: 384785 - RNA, 59 nt, Homo Sapiens
accuucaaagauaggcauagacacauaauuaugcuuaagcuuuuaacagcauuuuaacc

SEQ ID NO: 384786 - RNA, 59 nt, Homo Sapiens
cacagaacuuguaccauuugaaucuguuuuaugcuuaaaucaaagugcuuugaucaaau

SEQ ID NO: 384787 - RNA, 59 nt, Homo Sapiens
auuggacuuugggcauaaaagaacuuuuuuaugcuuaccaucuuuuuuuuuucuuuaac

SEQ ID NO: 384788 - RNA, 59 nt, Homo Sapiens
uuggcuauaagcacuuggaaaauaugaaauaugcuuauaacauauggauaacuauuucu

SEQ ID NO: 384789 - RNA, 59 nt, Homo Sapiens
aauaaaguauuuauuaagacaugaauaauuaugcuuaaucauuucucagucaccaacag

SEQ ID NO: 384790 - RNA, 59 nt, Homo Sapiens
caguuagucuuuauuacaguaauaauguuuaugcuuauguuuucuagcaaauaauagag

SEQ ID NO: 384791 - RNA, 59 nt, Homo Sapiens
auucaggcuggacagccuggaagaauugcuaugcuuaugcugcugcgcagaauaauauu

SEQ ID NO: 384792 - RNA, 59 nt, Homo Sapiens
gaaaauuuguucagguauaaaauuagcaguaugcuuaauuuuuuauuacaucauuugaa

SEQ ID NO: 384793 - RNA, 59 nt, Homo Sapiens
uaauauacucuuuuuuaugguaaaaagcuuaugcuuacauugcauugcuaaggccuuuu

SEQ ID NO: 384794 - RNA, 59 nt, Homo Sapiens
guuaacaugauucuguuuguccaaaccacuaugcuuaaucuguuuuuagaauuaauuuu

SEQ ID NO: 384795 - RNA, 59 nt, Homo Sapiens
agagccaaguagucaguggaaagaauucuuaugcuuauggaguuugugggaaauagggc

SEQ ID NO: 384796 - RNA, 59 nt, Homo Sapiens
aaaaaaaaauuuuuuuuuaaacuggagucuaugcuuaaacagcuuguuguaccgaauca

SEQ ID NO: 384797 - RNA, 59 nt, Homo Sapiens
uucaaguuuaguuugaggaagcauaagcuuaugcuuaaauagcaaauaguaaucuguaa

SEQ ID NO: 384798 - RNA, 59 nt, Homo Sapiens
ccagucaguacacccaauuuaagaaagucuaugcuuaggguaaccauaugauugaaaag

SEQ ID NO: 384799 - RNA, 59 nt, Homo Sapiens
caagacuugauggacaaacacgucauggauaugcuuauauuuuacaagaaguauguaag

SEQ ID NO: 384800 - RNA, 59 nt, Homo Sapiens
acacuagugccaguuauuuuguccauuaauaugcuuauaccaucacuuuucccuaccag

SEQ ID NO: 384801 - RNA, 59 nt, Homo Sapiens
augauaaacauauauccucuucacauuguuaugcuuaaguuaauuuuuaagcucuuaac

SEQ ID NO: 384802 - RNA, 59 nt, Homo Sapiens
augcacuuaagaauagagugaacugcucauaugcuuauuuaagcuuggacaguuuucag

SEQ ID NO: 384803 - RNA, 59 nt, Homo Sapiens
uuaauuugugggaaggaguaggcaaagaauaugcuuacaugauuacaccuguaaaguaa

SEQ ID NO: 384804 - RNA, 59 nt, Homo Sapiens
cucugacugcugugggggauugaaaagaauaugcuuauguuugaugaaagauauuuaac

SEQ ID NO: 384805 - RNA, 59 nt, Homo Sapiens
gaaaaggaacagggauuuaauaccuuuuuuaugcuuauuuuugucaaacauguacuccu

SEQ ID NO: 384806 - RNA, 59 nt, Homo Sapiens
aggauuugaugcuuuucucucagcauagguaugcuuacuaugaccuuccaaguuugacu

SEQ ID NO: 384807 - RNA, 59 nt, Homo Sapiens
acuaaaagcuguccacuguaagccauuuuuaugcuuacucagagaacaugagaacauaa

SEQ ID NO: 384808 - RNA, 59 nt, Homo Sapiens
aaaaugaaguaaggaaaacauauaacuacuaugcuuauauaauuuuaaguaaauugaca

SEQ ID NO: 384809 - RNA, 59 nt, Homo Sapiens
agaaauaaugaaaaguucaucaaaaccaauaugcuuauaaguuuuaaacucaagcaggc

SEQ ID NO: 384810 - RNA, 59 nt, Homo Sapiens
uagaucuuccaguacaauguaguacuauuuaugcuuaaacagauuaguaauuggugcuu

SEQ ID NO: 384811 - RNA, 59 nt, Homo Sapiens
cuuguuuuagugagccacugaggaaagaauaugcuuauuacaaagacaaaauguggugc

SEQ ID NO: 384812 - RNA, 59 nt, Homo Sapiens
gugcugugcgaaacaugcacgauuuuuauuaugcuuacugcguagaauuuuaucuacuu

SEQ ID NO: 384813 - RNA, 59 nt, Homo Sapiens
uauucucugaugaucccuuugcacagaacuaugcuuaucucauguuuguccuccauaaa

SEQ ID NO: 384814 - RNA, 59 nt, Homo Sapiens
agcaccuggccagagcagcccagccccaauaugcuuaggaggagacagaguucccucug

SEQ ID NO: 384815 - RNA, 59 nt, Homo Sapiens
ugugauaaacauaacuugccaacagucucuaugcuuauuuacaucuucuacuguucaaa

SEQ ID NO: 384816 - RNA, 59 nt, Homo Sapiens
aauaaagacauacuugcuuuuuucaguaauaugcuuacacacuucuguucauuugaucg

SEQ ID NO: 384817 - RNA, 59 nt, Homo Sapiens
uacuuacuuacacauuuuuaauaacugauuaugcuuaugauuuauacaagaagcugucc

SEQ ID NO: 384818 - RNA, 59 nt, Homo Sapiens
acuaauucacagaguuggcuugugauaguuaugcuuaauggauaacucgcguuuacaua

SEQ ID NO: 384819 - RNA, 59 nt, Homo Sapiens
gggcacuuggguaucuucuuacuuuuuuauaugcuuauuaacauguaauaagguugaac

SEQ ID NO: 384820 - RNA, 59 nt, Homo Sapiens
gauuugauaaaucuuauacuauuuaguaguaugcuuaugucuuaguaguaugcuuaugg

SEQ ID NO: 384821 - RNA, 59 nt, Homo Sapiens
gauuuaguaguaugcuuaugucuuaguaguaugcuuauguuuacucugacuugcuuuua

SEQ ID NO: 384822 - RNA, 59 nt, Homo Sapiens
auacauagccuacuuuuuuuaaauguuuauaugcuuaaggcaccuuuuaagaaaggguc

SEQ ID NO: 384823 - RNA, 59 nt, Homo Sapiens
uuauguucugaaaauuacccauggaacaauaugcuuaggauuacaggaagcaguccuua

SEQ ID NO: 384824 - RNA, 55 nt, Homo Sapiens
ugagucuuucugauaccugaguuuuuaugcuuauaauuuuuguucuuugaaaaaa

SEQ ID NO: 384825 - RNA, 59 nt, Homo Sapiens
cacauaucucuccaagggaugaccaguuuuaugcuuacugugugcuucucauccccugg

SEQ ID NO: 384826 - RNA, 59 nt, Homo Sapiens
uggaggcaggggaggguauauucuuuaaauaugcuuaaguguuauagggaaagacgggg

SEQ ID NO: 384827 - RNA, 59 nt, Homo Sapiens
agaugcugugaacaccaggacuuuaaucuuaugcuuaaaaugccagauguuguucgggg

SEQ ID NO: 384828 - RNA, 59 nt, Homo Sapiens
gaucuugucugguuauggccacuauagucuaugcuuagaucccauucagaccucucuag

SEQ ID NO: 384829 - RNA, 59 nt, Homo Sapiens
gguagcaacugaaagaagacgauaugcaguaugcuuaauaugugguuauggccgaaaag

SEQ ID NO: 384830 - RNA, 59 nt, Homo Sapiens
ugggcuuguguaccucagugcuugcuugguaugcuuaccagacaaaaggugugaggggg

SEQ ID NO: 384831 - RNA, 59 nt, Homo Sapiens
uuuuccccucuuuuguuaaauaauauggcuaugcuuaaaagguugcauacugagccaag

SEQ ID NO: 384832 - RNA, 59 nt, Homo Sapiens
uuuuuaaauccaguauuuaggauaauauuuaugcuuaguguaaacauucugugaaugaa

SEQ ID NO: 384833 - RNA, 59 nt, Homo Sapiens
auuugauacauaauccuauuauuaauucguaugcuuagucaaccuaggaaaucaaaaua

SEQ ID NO: 384834 - RNA, 59 nt, Homo Sapiens
aacauuuucuugaguccuucauuucugaguaugcuuaagacaucuuaaaaauauagaga

SEQ ID NO: 384835 - RNA, 59 nt, Homo Sapiens
uucuucuggggugcuaaucaggccccuguuaugcuuagggggagcccuggugcuacuug

SEQ ID NO: 384836 - RNA, 59 nt, Homo Sapiens
uggucuguguuauuuucuauuuccuuuuuuaugcuuagaacaccaggguuuaaaaaaaa

SEQ ID NO: 384837 - RNA, 59 nt, Homo Sapiens
aacaguuuuaggaaaauauuguuaauguauaugcuuaaaauuaagaguugaccuuuuaa

SEQ ID NO: 384838 - RNA, 59 nt, Homo Sapiens
uaugaauguaauuaccaaaauauuuugguuaugcuuaaaauguuuucaguuuucuuuuu

SEQ ID NO: 384839 - RNA, 59 nt, Homo Sapiens
uucugauacguguuauuuagaaauaauuuuaugcuuauuauacaaauguuuuuaugauu

SEQ ID NO: 384840 - RNA, 59 nt, Homo Sapiens
caacuggauggauaaugauguuucaaauguaugcuuaagagaaacagaccaaggauaac

SEQ ID NO: 384841 - RNA, 59 nt, Homo Sapiens
uuauuuagugacaaacguggcuuucaaacuaugcuuaaaaaguuccggcuggacacggu

SEQ ID NO: 384842 - RNA, 59 nt, Homo Sapiens
gcuaucucauauaugaguauuaaauaugguaugcuuaguauauuccaaccuaagauagu

SEQ ID NO: 384843 - RNA, 59 nt, Homo Sapiens
uuagauccuuucugcaaaguacagaacuuuaugcuuaauuccuuuguguaaaauaaaca

SEQ ID NO: 384844 - RNA, 59 nt, Homo Sapiens
gcuuggagaaauuucuuaguaaacacucauaugcuuaugauuaucucuuuuccaguauu

SEQ ID NO: 384845 - RNA, 59 nt, Homo Sapiens
caacuauuucuugauguaucuuuagguaauaugcuuauauucuguugguaaccucugug

SEQ ID NO: 384846 - RNA, 59 nt, Homo Sapiens
cuuuacuauguauuagccuuacauaguaguaugcuuaggaaguuauguauuauaauauu

SEQ ID NO: 384847 - RNA, 59 nt, Homo Sapiens
gugguuguggacaaaugugaaaguaacuuuaugcuuaaauaaauuauaguugauuuaaa

SEQ ID NO: 384848 - RNA, 59 nt, Homo Sapiens
auccuugaacugucagcccacagcagcaauaugcuuauucuauccacaucccuaacauc

SEQ ID NO: 384849 - RNA, 59 nt, Homo Sapiens
uaguucauauuugcauuuucguucaaggauaugcuuagcaauaaaauguucuucccaaa

SEQ ID NO: 384850 - RNA, 59 nt, Homo Sapiens
uaaauauguaagacuaggcuuuacugucuuaugcuuauggacauuguauauuuguauuu

SEQ ID NO: 384851 - RNA, 59 nt, Homo Sapiens
agugugcauauuguacacuuuuuuggggauaugcuuaguaaugcuacgugugauuuuuc

SEQ ID NO: 384852 - RNA, 59 nt, Homo Sapiens
aggacaguuuuaaugauugugcuaugauauaugcuuagguacugcaaauaaaagguggu

SEQ ID NO: 384853 - RNA, 59 nt, Homo Sapiens
aauaaauucuguuuacuggcggucugacuuaugcuuacucugucuccuugggccaugcu

SEQ ID NO: 384854 - RNA, 59 nt, Homo Sapiens
guucuaaucuggugguaaagauugguuauuaugcuuacuaagacauuacuuauuaagaa

SEQ ID NO: 384855 - RNA, 59 nt, Homo Sapiens
uugaaucaagucagauacaaggagcuuuuuaugcuuauggagcuucaacuggagcagga

SEQ ID NO: 384856 - RNA, 59 nt, Homo Sapiens
uguugaguauauauauuuggcccugaguguaugcuuaguuuuugauuuuuuuuuuccuc

SEQ ID NO: 384857 - RNA, 59 nt, Homo Sapiens
agagaggaaaaaaaugugguucaagaaaauaugcuuaacguaccaugcuuuaccucauu

SEQ ID NO: 384858 - RNA, 59 nt, Homo Sapiens
aaagaagugauguaucaguacguuuuacauaugcuuauacuucgacuuucaguagcacu

SEQ ID NO: 384859 - RNA, 59 nt, Homo Sapiens
ugcaauguugacuguugaaaaagcagcaguaugcuuacagguuugcuuaguuuggggac

SEQ ID NO: 384860 - RNA, 59 nt, Homo Sapiens
aauucugcuugcuugcuuuuuaauauugauaugcuuauacacuuacacuuuaugcacaa

SEQ ID NO: 384861 - RNA, 59 nt, Homo Sapiens
acaggauagccuaauuuuauuuguuuaaauaugcuuaauaugccccagauugcaaaugc

SEQ ID NO: 384862 - RNA, 59 nt, Homo Sapiens
ucuaaauuuuguuucuguuaacugcaguuuaugcuuacaugcucugguuugcucaaaua

SEQ ID NO: 384863 - RNA, 59 nt, Homo Sapiens
aaagcuguaaaaaugaacuuguaauauuguaugcuuacaguaaaagucauuuuuuuaaa

SEQ ID NO: 384864 - RNA, 59 nt, Homo Sapiens
ugauggagaggucauaaaaacugugguaguaugcuuagaaacuguugauuuaaaauauc

SEQ ID NO: 384865 - RNA, 59 nt, Homo Sapiens
acuuaaaccuccugcugugccucgcauccuaugcuuaauaaaagaacaugcuugaauau

SEQ ID NO: 384866 - RNA, 59 nt, Homo Sapiens
uccccucuaugcugucaucaaccuuaccauaugcuuaggggauccaugucucaucaaua

SEQ ID NO: 384867 - RNA, 59 nt, Homo Sapiens
uguuggacaggauagggguaugguacuacuaugcuuagguugaggagacagacucccag

SEQ ID NO: 384868 - RNA, 59 nt, Homo Sapiens
aauaaaauggguuuggcaucauguuguuuuaugcuuauaaagcauuuucauaugaacag

SEQ ID NO: 384869 - RNA, 59 nt, Homo Sapiens
agcauuuuucuaaaaccuuagucaucagauaugcuuacuaaaucuucagcauagaagga

SEQ ID NO: 384870 - RNA, 59 nt, Homo Sapiens
uuuuuguacauaaagaugucacuuaaacuuaugcuuacaaacuaaagacuaaucgcuca

SEQ ID NO: 384871 - RNA, 59 nt, Homo Sapiens
uggaacuaagcaguuuguaacucaccucuuaugcuuaguguggcccugcaguguacguu

SEQ ID NO: 384872 - RNA, 59 nt, Homo Sapiens
aagaacauuauauuuuguucuucuuggcauaugcuuacaaaaucacaguuuuuacuacc

SEQ ID NO: 384873 - RNA, 59 nt, Homo Sapiens
uuagggguuuugcaaccugaauugaaugcuaugcuuagagguagaaacagagggccaaa

SEQ ID NO: 384874 - RNA, 59 nt, Homo Sapiens
ggugcaguaugccauaaaagauuauguauuaugcuuaaagugagaacugaugauugugc

SEQ ID NO: 384875 - RNA, 59 nt, Homo Sapiens
uacaaaaguaaauagguaaaauaaaugcuuaugcuuaaguaaauaugaggauuuuggua

SEQ ID NO: 384876 - RNA, 59 nt, Homo Sapiens
aagugaacaguaaucuucauuuuaguauuuaugcuuagaugugaaaauaaauguuauuu

SEQ ID NO: 384877 - RNA, 59 nt, Homo Sapiens
uuugugcaaaagagaugaagacuucucaauaugcuuauuuugcuuugcauaauuggcuc

SEQ ID NO: 384878 - RNA, 59 nt, Homo Sapiens
auauuuguacuuuaacauguugcauaauauaugcuuauguagcuuuccaggacuaacag

SEQ ID NO: 384879 - RNA, 59 nt, Homo Sapiens
acaaaaaaaaaagaagcagcagcuuguaguaugcuuaagcuuuggggaauuuuuuuuua

SEQ ID NO: 384880 - RNA, 59 nt, Homo Sapiens
uaaaaaagccugcgaccuauucaauacauuaugcuuaaauuagcaguuucucuggaauu

SEQ ID NO: 384881 - RNA, 59 nt, Homo Sapiens
uaaauuaauaaauuuaaaaugagaugcaguaugcuuacucacaugauuuauccauaaag

SEQ ID NO: 384882 - RNA, 59 nt, Homo Sapiens
aaugacuaaccaaucaaauuuuauuuugguaugcuuacacauacgugggcuauacugua

SEQ ID NO: 384883 - RNA, 59 nt, Homo Sapiens
cugucaaauuagcacaacaacacgcaaaauaugcuuagguaauauaauuuacauauguu

SEQ ID NO: 384884 - RNA, 59 nt, Homo Sapiens
uuaagguagauggugauuagcacauguaguaugcuuaacauuuaauauuauaauaagac

SEQ ID NO: 384885 - RNA, 59 nt, Homo Sapiens
uuuuugaaaaaauuagauuucauucaaaguaugcuuaacgaaauuuuuugcaguuauug

SEQ ID NO: 384886 - RNA, 59 nt, Homo Sapiens
cuccauccaaaccuaacucucuaccuuuuuaugcuuacaugaacacaaagucccucaug

SEQ ID NO: 384887 - RNA, 59 nt, Homo Sapiens
ugucaaaagauuuaccaggucuacaccauuaugcuuauuauuuuuuuaauuauccuuuu

SEQ ID NO: 384888 - RNA, 59 nt, Homo Sapiens
auguagaaaaagagauagaaggaaccaccuaugcuuaaaauacuguaaauaugcaguga

SEQ ID NO: 384889 - RNA, 59 nt, Homo Sapiens
cgaagccacaggaagggaaguagacauuguaugcuuaugguuucucauuaugaaggugc

SEQ ID NO: 384890 - RNA, 59 nt, Homo Sapiens
cugaagguaagaucauuuaauaucuuugauaugcuuacgaguaagugaauccugauuau

SEQ ID NO: 384891 - RNA, 59 nt, Homo Sapiens
uaauuggucagauaaaacuuuuuuucuuguaugcuuaaauaaagcaauuagugaagcac

SEQ ID NO: 384892 - RNA, 59 nt, Homo Sapiens
gaggccaugagaaccugaggucacuucaguaugcuuacuccugcacucaguacccgaac

SEQ ID NO: 384893 - RNA, 59 nt, Homo Sapiens
uguaacagucaaaagcugucgauaauaccuaugcuuaaauuggauugggacucuaagca

SEQ ID NO: 384894 - RNA, 59 nt, Homo Sapiens
auuauguucuacauguugcuuuaucaguauaugcuuagcuguaagugacaaguauuuuu

SEQ ID NO: 384895 - RNA, 59 nt, Homo Sapiens
uugaacauucaauccguucauuuuguauguaugcuuaauacgugucggucauauacagu

SEQ ID NO: 384896 - RNA, 59 nt, Homo Sapiens
guucuauccccaagcuggccacuaucacauaugcuuacucuugcuuaaaauuaauaaau

SEQ ID NO: 384897 - RNA, 59 nt, Homo Sapiens
uuuuucacuuuugcuaaaaaagaaaaauauaugcuuacaauccaauucaaaaauaaauu

SEQ ID NO: 384898 - RNA, 59 nt, Homo Sapiens
aaaccuggaggaauacuuacguacuacuauaugcuuaaauuuuacuuuuuccugcuuau

SEQ ID NO: 384899 - RNA, 59 nt, Homo Sapiens
guuuacaauaugaaguuauuuuaacucuguaugcuuaauauauaauguggccuugaauu

SEQ ID NO: 384900 - RNA, 59 nt, Homo Sapiens
guuaaaagaaaaacgaauggcauugaauauaugcuuaugcaaggcuauuucaaguuuuc

SEQ ID NO: 384901 - RNA, 59 nt, Homo Sapiens
ugcucuguccccaguguuccuagcagagguaugcuuaccagcugucagcacagacccuc

SEQ ID NO: 384902 - RNA, 59 nt, Homo Sapiens
auucucuuuccuagucaaaauuauauuucuaugcuuaaaauaagguaguacuuuucuuu

SEQ ID NO: 384903 - RNA, 59 nt, Homo Sapiens
gaaacgcuguugaaccuugugccucuauuuaugcuuaauccauuugagugccucacaca

SEQ ID NO: 384904 - RNA, 59 nt, Homo Sapiens
cccaguguuuaguuguuacaaggacaugauaugcuuacuuacuaucaguuuaugaugua

SEQ ID NO: 384905 - RNA, 59 nt, Homo Sapiens
cagguauauaccuccauguuucuaaguaauaugcuuauauuguucacuucuuuuuuuuu

SEQ ID NO: 384906 - RNA, 59 nt, Homo Sapiens
uuaagaugaauuguuauacaagaggugcuuaugcuuagcuugaugaccaggauguuauu

SEQ ID NO: 384907 - RNA, 59 nt, Homo Sapiens
auuuuucucuaaggagaauaugacaugcuuaugcuuaccaagaucaagugcauugaggg

SEQ ID NO: 384908 - RNA, 59 nt, Homo Sapiens
uuaaagaucuauuuagguggauacuuguguaugcuuauuauauuuguagauaauaguca

SEQ ID NO: 384909 - RNA, 59 nt, Homo Sapiens
accuuucugucaaguauuagucucaucuguaugcuuaugucuauuucccugauuucauu

SEQ ID NO: 384910 - RNA, 59 nt, Homo Sapiens
gaguaccucuaaagacagaucuauuuugguaugcuuaggaauaccaugugaacaccagu

SEQ ID NO: 384911 - RNA, 59 nt, Homo Sapiens
gaccaggucacauaaaauccaugaaucccuaugcuuaauauuugccaugagcucacaaa

SEQ ID NO: 384912 - RNA, 59 nt, Homo Sapiens
ggacaagaguuugaacucaagaugacauuuaugcuuaggccaagaugaugcugaggccu

SEQ ID NO: 384913 - RNA, 64 nt, Homo Sapiens
uuucuuaaauccaaguuggccguuuuauuaguauguuucaaauguguauuaccaaugugggugu

SEQ ID NO: 384914 - RNA, 64 nt, Homo Sapiens
acaauuuuuggaauaugucauaauuuuuuucccuguuucaaauguguucagaggaaauagaaug

SEQ ID NO: 384915 - RNA, 64 nt, Homo Sapiens
uguaaauaaccaauucagaagaguugucuuugugguuucaaaaguaaaauauggggagacuugg

SEQ ID NO: 384916 - RNA, 64 nt, Homo Sapiens
cauagcugagcuugucuaacauuguaaaguugguguuucaaaaacuccaaagcaaagcauuuuu

SEQ ID NO: 384917 - RNA, 64 nt, Homo Sapiens
ucccauucaggcuacaagugacgacaaagauucuguuucaaauauagccacagaaauaaaggag

SEQ ID NO: 384918 - RNA, 64 nt, Homo Sapiens
ucccauucaggcuacaagugacgagaaagauucuguuucaaauauagccacagaaauaaagaag

SEQ ID NO: 384919 - RNA, 64 nt, Homo Sapiens
gucaguucugugaucugggucucuaaucugugcuguuucaaaguucucuguggcaaagcagcaa

SEQ ID NO: 384920 - RNA, 64 nt, Homo Sapiens
gaacugaacugagguucauggauuuuccaggacuguuucaaacaugcccauuacuaacggcaaa

SEQ ID NO: 384921 - RNA, 64 nt, Homo Sapiens
gauuuguggcuguucuuuucagucacccuaucagguuucaaacaaacaaaacaaaaaccaaaaa

SEQ ID NO: 384922 - RNA, 64 nt, Homo Sapiens
uagcucccuggguggaaugagaagcaacaguuuaguuucaaacccucauuuucaucugcaaauu

SEQ ID NO: 384923 - RNA, 64 nt, Homo Sapiens
ucuugaucuagauacaggacugguuccuuccuuaguuucaaagugucucauucucagaguaaaa

SEQ ID NO: 384924 - RNA, 64 nt, Homo Sapiens
guagagacaguguuucgucauguuggccaggcugguuucaaacuccugaccucaggugauccgc

SEQ ID NO: 384925 - RNA, 64 nt, Homo Sapiens
cccucauuaacaagaauaacauuuaaaggagauuguuucaaaauauuuuugcaaauugagauaa

SEQ ID NO: 384926 - RNA, 64 nt, Homo Sapiens
uauaauuaaauguaaaauugaaaauucauuugcuguuucaaagugugauaucuuucacaauagc

SEQ ID NO: 384927 - RNA, 64 nt, Homo Sapiens
aaaaaaaaaaaaaaacuucacagagcgagacuugguuucaaaaaacuacacuccagccuggcga

SEQ ID NO: 384928 - RNA, 64 nt, Homo Sapiens
aucugaccaaaacaaacaaauacacuaugaagauguuucaaaaacuauucaguuuucaggauga

SEQ ID NO: 384929 - RNA, 64 nt, Homo Sapiens
acauaugugccaaugugacaaaguguuugaaaacguuucaaagcugccacaugacagcaguguu

SEQ ID NO: 384930 - RNA, 64 nt, Homo Sapiens
agccagcucauuugguucagcugacuucuuugugguuucaaaucagagagauacaucuuauaaa

SEQ ID NO: 384931 - RNA, 64 nt, Homo Sapiens
gccccagaacaggccacucauuuagaauucuaguguuucaaaacacuuuuguguguuguauggu

SEQ ID NO: 384932 - RNA, 64 nt, Homo Sapiens
guagagacgggguuuugccauguugccaaggcugguuucaaacuccuggacucaagaaauccac

SEQ ID NO: 384933 - RNA, 64 nt, Homo Sapiens
gguuggaagaauauuuauaggcaauacagucaaaguuucaaaauagcaucacacaaaacauguu

SEQ ID NO: 384934 - RNA, 64 nt, Homo Sapiens
aaaauagauccccuuaaagagcuuuccagcaauuguuucaaaggcuauuaccuuucugaggcug

SEQ ID NO: 384935 - RNA, 64 nt, Homo Sapiens
acaggaaaaacauuccuauuauggaaaauuuuuuguuucaaaauauaauugaauggauauuccu

SEQ ID NO: 384936 - RNA, 64 nt, Homo Sapiens
uaugugaccaucuucagguaugggauuucugaacguuucaaauuucaaucaaugagcacuguca

SEQ ID NO: 384937 - RNA, 64 nt, Homo Sapiens
auucccuuuagaaaauuagccuccaaaaucuuuuguuucaaaauauuauauuauuucauaaaua

SEQ ID NO: 384938 - RNA, 64 nt, Homo Sapiens
aauuguuuguuuucucauuucugugucaaagaguguuucaaaagaaucuaaaaauaguuaagca

SEQ ID NO: 384939 - RNA, 64 nt, Homo Sapiens
uuuuauucaaaccacaaauuaauacuaauggaauguuucaaaggauucucauugugagaauuuu

SEQ ID NO: 384940 - RNA, 64 nt, Homo Sapiens
cuuguggguuugucauuuauugguuaaugcucuaguuucaaaaccacccuguugaaaguuccag

SEQ ID NO: 384941 - RNA, 64 nt, Homo Sapiens
ggaauuucugacugugcccuuuagggccuccugaguuucaaaaggaggaaguguucgugcuugu

SEQ ID NO: 384942 - RNA, 64 nt, Homo Sapiens
ugguugcuuucuugccaaaauaaguguuaacuguguuucaaacuugauuuucuuuccuuuuucu

SEQ ID NO: 384943 - RNA, 64 nt, Homo Sapiens
gauuuuuuuuucuucaaacuuguauguugccuagguuucaaauucuuugccgcaaggcugaucu

SEQ ID NO: 384944 - RNA, 64 nt, Homo Sapiens
cuauuuaacugcaauugaggaaggaaauuucccuguuucaaaaugggaccuaggugcaagugca

SEQ ID NO: 384945 - RNA, 64 nt, Homo Sapiens
auguggcacucgccccccacuaugagaucuuguuguuucaaaguguguccuuaagauaaugagu

SEQ ID NO: 384946 - RNA, 64 nt, Homo Sapiens
ugaagcugaaagggguguuuuacaucuguaaacgguuucaaacagguagagagaaaaacaccac

SEQ ID NO: 384947 - RNA, 64 nt, Homo Sapiens
cuauauaaugaauauuuauagaucuguaacauuuguuucaaaaugcuguuucauuuuuauaaag

SEQ ID NO: 384948 - RNA, 64 nt, Homo Sapiens
auuggaucuuugaaagcuucugguugugaagacuguuucaaaugauaacugccuaggauacuga

SEQ ID NO: 384949 - RNA, 64 nt, Homo Sapiens
ucagacucuguaucaaaaguagaggaguucaccaguuucaaagagaacuaugguaaugggugga

SEQ ID NO: 384950 - RNA, 64 nt, Homo Sapiens
ccuagaucuuguuaacccaucaggugcagugucaguuucaaaucaaauuaucuaagaaaacaag

SEQ ID NO: 384951 - RNA, 64 nt, Homo Sapiens
aagucauuacaaacuccuuguacauucacugugaguuucaaagggagucagucccuaauuuaca

SEQ ID NO: 384952 - RNA, 64 nt, Homo Sapiens
gccagucauuugcuccguuuagaauacauucaagguuucaaagcacuugaugcucaguauuugc

SEQ ID NO: 384953 - RNA, 64 nt, Homo Sapiens
ugcauguggagccauguggcaucaggguaguucuguuucaaacuugagaggcauccagaaaagu

SEQ ID NO: 384954 - RNA, 64 nt, Homo Sapiens
ucucccaacucuguucugcaguccuccucuagaaguuucaaaucuccuuucagaaaaauucaag

SEQ ID NO: 384955 - RNA, 64 nt, Homo Sapiens
ucuccuuucagggcuuuauuguucugccucagugguuucaaaucuaaagguucccucuccaccc

SEQ ID NO: 384956 - RNA, 64 nt, Homo Sapiens
aaacguuuugaucaaaauggagacuuuuguagucguuucaaaagagcaccugagucauguguau

SEQ ID NO: 384957 - RNA, 64 nt, Homo Sapiens
auucccggccuuuauaaaugacccggucaaguugguuucaaaguccgacaggcuugucuguuua

SEQ ID NO: 384958 - RNA, 64 nt, Homo Sapiens
uuucuccacucaccgcagcguacuuggcacuucaguuucaaacacguaguccuuuaaaacuuga

SEQ ID NO: 384959 - RNA, 64 nt, Homo Sapiens
gaagcuguuuugcuaaauuauuuuuacuuggaauguuucaaacagauuucaggcugcaaacuug

SEQ ID NO: 384960 - RNA, 62 nt, Homo Sapiens
ucauuuaccagugcaggaagucucauaaaacucagauguacucccacaaaaauuuuauuggc

SEQ ID NO: 384961 - RNA, 62 nt, Homo Sapiens
cccucuguaaauguguugagugauauagcuaucagauguauugaaggcaaaguucucgcaga

SEQ ID NO: 384962 - RNA, 62 nt, Homo Sapiens
aauuguacuuagauuuaagaaaaagagaaaaucagauguauuuauuugacuucauuccguau

SEQ ID NO: 384963 - RNA, 62 nt, Homo Sapiens
aaugccuaaaagacuuuauuguucuaauuauccagauguaccuuuguaaaauagcucuuuua

SEQ ID NO: 384964 - RNA, 62 nt, Homo Sapiens
gauaggauacauacugaaaucagcaaacaaaacagauguauagauuagaguguggagaaaac

SEQ ID NO: 384965 - RNA, 62 nt, Homo Sapiens
aguucaaacagauacagcaugguccagagucccagauguacaaaaacagggauucaucacaa

SEQ ID NO: 384966 - RNA, 62 nt, Homo Sapiens
guacaccaugcccauguauauacaaguacacacagauguacacacagauguacacaugcucc

SEQ ID NO: 384967 - RNA, 62 nt, Homo Sapiens
cauguauauacaaguacacacagauguacacacagauguacacaugcuccagccccagcucu

SEQ ID NO: 384968 - RNA, 62 nt, Homo Sapiens
uucaaccucuguuauucugguuggcacuuauucagauguaucugaaacagcugcagcaagag

SEQ ID NO: 384969 - RNA, 62 nt, Homo Sapiens
acagaaugggaaagccagcauaagagaugguucagauguauauacaugacaauuuguaauca

SEQ ID NO: 384970 - RNA, 64 nt, Homo Sapiens; identical to SEQ ID NO: 245089

SEQ ID NO: 384971 - RNA, 64 nt, Homo Sapiens; identical to SEQ ID NO: 245090

SEQ ID NO: 384972 - RNA, 64 nt, Homo Sapiens; identical to SEQ ID NO: 245091

SEQ ID NO: 384973 - RNA, 56 nt, Homo Sapiens; identical to SEQ ID NO: 238493

SEQ ID NO: 384974 - RNA, 64 nt, Homo Sapiens; identical to SEQ ID NO: 245093

SEQ ID NO: 384975 - RNA, 64 nt, Homo Sapiens; identical to SEQ ID NO: 245094

SEQ ID NO: 384976 - RNA, 64 nt, Homo Sapiens; identical to SEQ ID NO: 245095

SEQ ID NO: 384977 - RNA, 64 nt, Homo Sapiens; identical to SEQ ID NO: 245096

SEQ ID NO: 384978 - RNA, 64 nt, Homo Sapiens; identical to SEQ ID NO: 245097

SEQ ID NO: 384979 - RNA, 64 nt, Homo Sapiens; identical to SEQ ID NO: 245098

SEQ ID NO: 384980 - RNA, 64 nt, Homo Sapiens; identical to SEQ ID NO: 245099

SEQ ID NO: 384981 - RNA, 64 nt, Homo Sapiens; identical to SEQ ID NO: 245100

SEQ ID NO: 384982 - RNA, 64 nt, Homo Sapiens; identical to SEQ ID NO: 245101

SEQ ID NO: 384983 - RNA, 64 nt, Homo Sapiens; identical to SEQ ID NO: 245102

SEQ ID NO: 384984 - RNA, 64 nt, Homo Sapiens; identical to SEQ ID NO: 119910

SEQ ID NO: 384985 - RNA, 64 nt, Homo Sapiens; identical to SEQ ID NO: 119911

SEQ ID NO: 384986 - RNA, 64 nt, Homo Sapiens; identical to SEQ ID NO: 119912

SEQ ID NO: 384987 - RNA, 64 nt, Homo Sapiens; identical to SEQ ID NO: 119913

SEQ ID NO: 384988 - RNA, 64 nt, Homo Sapiens; identical to SEQ ID NO: 119914

SEQ ID NO: 384989 - RNA, 64 nt, Homo Sapiens; identical to SEQ ID NO: 119915

SEQ ID NO: 384990 - RNA, 64 nt, Homo Sapiens; identical to SEQ ID NO: 119916

SEQ ID NO: 384991 - RNA, 64 nt, Homo Sapiens; identical to SEQ ID NO: 119917

SEQ ID NO: 384992 - RNA, 64 nt, Homo Sapiens; identical to SEQ ID NO: 119918

SEQ ID NO: 384993 - RNA, 64 nt, Homo Sapiens; identical to SEQ ID NO: 119919

SEQ ID NO: 384994 - RNA, 64 nt, Homo Sapiens; identical to SEQ ID NO: 119920

SEQ ID NO: 384995 - RNA, 64 nt, Homo Sapiens; identical to SEQ ID NO: 119921

SEQ ID NO: 384996 - RNA, 64 nt, Homo Sapiens; identical to SEQ ID NO: 119922

SEQ ID NO: 384997 - RNA, 64 nt, Homo Sapiens; identical to SEQ ID NO: 119923

SEQ ID NO: 384998 - RNA, 64 nt, Homo Sapiens; identical to SEQ ID NO: 119924

SEQ ID NO: 384999 - RNA, 64 nt, Homo Sapiens; identical to SEQ ID NO: 119925

SEQ ID NO: 385000 - RNA, 64 nt, Homo Sapiens; identical to SEQ ID NO: 119926

SEQ ID NO: 385001 - RNA, 64 nt, Homo Sapiens; identical to SEQ ID NO: 119927

SEQ ID NO: 385002 - RNA, 64 nt, Homo Sapiens; identical to SEQ ID NO: 119928

SEQ ID NO: 385003 - RNA, 64 nt, Homo Sapiens; identical to SEQ ID NO: 119929

SEQ ID NO: 385004 - RNA, 64 nt, Homo Sapiens; identical to SEQ ID NO: 119930

SEQ ID NO: 385005 - RNA, 64 nt, Homo Sapiens; identical to SEQ ID NO: 119931

SEQ ID NO: 385006 - RNA, 64 nt, Homo Sapiens; identical to SEQ ID NO: 119932

SEQ ID NO: 385007 - RNA, 64 nt, Homo Sapiens; identical to SEQ ID NO: 119933

SEQ ID NO: 385008 - RNA, 64 nt, Homo Sapiens; identical to SEQ ID NO: 119934

SEQ ID NO: 385009 - RNA, 64 nt, Homo Sapiens; identical to SEQ ID NO: 119935

SEQ ID NO: 385010 - RNA, 64 nt, Homo Sapiens; identical to SEQ ID NO: 119936

SEQ ID NO: 385011 - RNA, 64 nt, Homo Sapiens; identical to SEQ ID NO: 119937

SEQ ID NO: 385012 - RNA, 64 nt, Homo Sapiens; identical to SEQ ID NO: 119938

SEQ ID NO: 385013 - RNA, 64 nt, Homo Sapiens; identical to SEQ ID NO: 119939

SEQ ID NO: 385014 - RNA, 64 nt, Homo Sapiens; identical to SEQ ID NO: 119940

SEQ ID NO: 385015 - RNA, 64 nt, Homo Sapiens; identical to SEQ ID NO: 119941

SEQ ID NO: 385016 - RNA, 64 nt, Homo Sapiens; identical to SEQ ID NO: 119942

SEQ ID NO: 385017 - RNA, 64 nt, Homo Sapiens; identical to SEQ ID NO: 119943

SEQ ID NO: 385018 - RNA, 64 nt, Homo Sapiens; identical to SEQ ID NO: 119944

SEQ ID NO: 385019 - RNA, 64 nt, Homo Sapiens; identical to SEQ ID NO: 119945

SEQ ID NO: 385020 - RNA, 64 nt, Homo Sapiens; identical to SEQ ID NO: 119946

SEQ ID NO: 385021 - RNA, 64 nt, Homo Sapiens; identical to SEQ ID NO: 119947

SEQ ID NO: 385022 - RNA, 64 nt, Homo Sapiens; identical to SEQ ID NO: 119948

SEQ ID NO: 385023 - RNA, 64 nt, Homo Sapiens; identical to SEQ ID NO: 119949

SEQ ID NO: 385024 - RNA, 64 nt, Homo Sapiens; identical to SEQ ID NO: 119950

SEQ ID NO: 385025 - RNA, 64 nt, Homo Sapiens; identical to SEQ ID NO: 119951

SEQ ID NO: 385026 - RNA, 64 nt, Homo Sapiens; identical to SEQ ID NO: 119952

SEQ ID NO: 385027 - RNA, 64 nt, Homo Sapiens; identical to SEQ ID NO: 119953

SEQ ID NO: 385028 - RNA, 64 nt, Homo Sapiens; identical to SEQ ID NO: 119954

SEQ ID NO: 385029 - RNA, 64 nt, Homo Sapiens; identical to SEQ ID NO: 119955

SEQ ID NO: 385030 - RNA, 64 nt, Homo Sapiens; identical to SEQ ID NO: 119956

SEQ ID NO: 385031 - RNA, 64 nt, Homo Sapiens; identical to SEQ ID NO: 119957

SEQ ID NO: 385032 - RNA, 64 nt, Homo Sapiens; identical to SEQ ID NO: 119958

SEQ ID NO: 385033 - RNA, 64 nt, Homo Sapiens; identical to SEQ ID NO: 119959

SEQ ID NO: 385034 - RNA, 64 nt, Homo Sapiens; identical to SEQ ID NO: 119960

SEQ ID NO: 385035 - RNA, 64 nt, Homo Sapiens; identical to SEQ ID NO: 119961

SEQ ID NO: 385036 - RNA, 58 nt, Homo Sapiens; identical to SEQ ID NO: 119962

SEQ ID NO: 385037 - RNA, 64 nt, Homo Sapiens; identical to SEQ ID NO: 119963

SEQ ID NO: 385038 - RNA, 64 nt, Homo Sapiens; identical to SEQ ID NO: 119964

SEQ ID NO: 385039 - RNA, 64 nt, Homo Sapiens; identical to SEQ ID NO: 119965

SEQ ID NO: 385040 - RNA, 64 nt, Homo Sapiens; identical to SEQ ID NO: 119966

SEQ ID NO: 385041 - RNA, 64 nt, Homo Sapiens; identical to SEQ ID NO: 119967

SEQ ID NO: 385042 - RNA, 64 nt, Homo Sapiens; identical to SEQ ID NO: 119968

SEQ ID NO: 385043 - RNA, 64 nt, Homo Sapiens; identical to SEQ ID NO: 119969

SEQ ID NO: 385044 - RNA, 64 nt, Homo Sapiens; identical to SEQ ID NO: 119970

SEQ ID NO: 385045 - RNA, 55 nt, Homo Sapiens; identical to SEQ ID NO: 119971

SEQ ID NO: 385046 - RNA, 64 nt, Homo Sapiens; identical to SEQ ID NO: 119972

SEQ ID NO: 385047 - RNA, 64 nt, Homo Sapiens; identical to SEQ ID NO: 119973

SEQ ID NO: 385048 - RNA, 64 nt, Homo Sapiens; identical to SEQ ID NO: 119974

SEQ ID NO: 385049 - RNA, 64 nt, Homo Sapiens; identical to SEQ ID NO: 119975

SEQ ID NO: 385050 - RNA, 64 nt, Homo Sapiens; identical to SEQ ID NO: 119976

SEQ ID NO: 385051 - RNA, 64 nt, Homo Sapiens; identical to SEQ ID NO: 119977

SEQ ID NO: 385052 - RNA, 64 nt, Homo Sapiens; identical to SEQ ID NO: 119978

SEQ ID NO: 385053 - RNA, 64 nt, Homo Sapiens; identical to SEQ ID NO: 119979

SEQ ID NO: 385054 - RNA, 64 nt, Homo Sapiens; identical to SEQ ID NO: 119980

SEQ ID NO: 385055 - RNA, 64 nt, Homo Sapiens; identical to SEQ ID NO: 119981

SEQ ID NO: 385056 - RNA, 64 nt, Homo Sapiens; identical to SEQ ID NO: 119982

SEQ ID NO: 385057 - RNA, 64 nt, Homo Sapiens; identical to SEQ ID NO: 119983

SEQ ID NO: 385058 - RNA, 64 nt, Homo Sapiens; identical to SEQ ID NO: 119984

SEQ ID NO: 385059 - RNA, 64 nt, Homo Sapiens; identical to SEQ ID NO: 119985

SEQ ID NO: 385060 - RNA, 64 nt, Homo Sapiens; identical to SEQ ID NO: 119986

SEQ ID NO: 385061 - RNA, 64 nt, Homo Sapiens; identical to SEQ ID NO: 119987

SEQ ID NO: 385062 - RNA, 55 nt, Homo Sapiens; identical to SEQ ID NO: 119988

SEQ ID NO: 385063 - RNA, 64 nt, Homo Sapiens; identical to SEQ ID NO: 119989

SEQ ID NO: 385064 - RNA, 64 nt, Homo Sapiens; identical to SEQ ID NO: 119990

SEQ ID NO: 385065 - RNA, 64 nt, Homo Sapiens; identical to SEQ ID NO: 119991

SEQ ID NO: 385066 - RNA, 64 nt, Homo Sapiens; identical to SEQ ID NO: 119992

SEQ ID NO: 385067 - RNA, 64 nt, Homo Sapiens; identical to SEQ ID NO: 119993

SEQ ID NO: 385068 - RNA, 64 nt, Homo Sapiens; identical to SEQ ID NO: 119994

SEQ ID NO: 385069 - RNA, 64 nt, Homo Sapiens; identical to SEQ ID NO: 119995

SEQ ID NO: 385070 - RNA, 64 nt, Homo Sapiens; identical to SEQ ID NO: 119996

SEQ ID NO: 385071 - RNA, 64 nt, Homo Sapiens; identical to SEQ ID NO: 119997

SEQ ID NO: 385072 - RNA, 64 nt, Homo Sapiens; identical to SEQ ID NO: 119998

SEQ ID NO: 385073 - RNA, 62 nt, Homo Sapiens; identical to SEQ ID NO: 119999

SEQ ID NO: 385074 - RNA, 64 nt, Homo Sapiens; identical to SEQ ID NO: 120000

SEQ ID NO: 385075 - RNA, 64 nt, Homo Sapiens; identical to SEQ ID NO: 120001

SEQ ID NO: 385076 - RNA, 64 nt, Homo Sapiens; identical to SEQ ID NO: 120002

SEQ ID NO: 385077 - RNA, 64 nt, Homo Sapiens; identical to SEQ ID NO: 120003

SEQ ID NO: 385078 - RNA, 64 nt, Homo Sapiens; identical to SEQ ID NO: 120004

SEQ ID NO: 385079 - RNA, 64 nt, Homo Sapiens; identical to SEQ ID NO: 120005

SEQ ID NO: 385080 - RNA, 64 nt, Homo Sapiens; identical to SEQ ID NO: 120006

SEQ ID NO: 385081 - RNA, 64 nt, Homo Sapiens; identical to SEQ ID NO: 120007

SEQ ID NO: 385082 - RNA, 64 nt, Homo Sapiens; identical to SEQ ID NO: 120008

SEQ ID NO: 385083 - RNA, 64 nt, Homo Sapiens; identical to SEQ ID NO: 156945

SEQ ID NO: 385084 - RNA, 64 nt, Homo Sapiens; identical to SEQ ID NO: 156946

SEQ ID NO: 385085 - RNA, 64 nt, Homo Sapiens; identical to SEQ ID NO: 156947

SEQ ID NO: 385086 - RNA, 64 nt, Homo Sapiens; identical to SEQ ID NO: 156948

SEQ ID NO: 385087 - RNA, 64 nt, Homo Sapiens; identical to SEQ ID NO: 156949

SEQ ID NO: 385088 - RNA, 64 nt, Homo Sapiens; identical to SEQ ID NO: 156950

SEQ ID NO: 385089 - RNA, 64 nt, Homo Sapiens; identical to SEQ ID NO: 156951

SEQ ID NO: 385090 - RNA, 64 nt, Homo Sapiens; identical to SEQ ID NO: 156952

SEQ ID NO: 385091 - RNA, 64 nt, Homo Sapiens; identical to SEQ ID NO: 156953

SEQ ID NO: 385092 - RNA, 64 nt, Homo Sapiens; identical to SEQ ID NO: 156954

SEQ ID NO: 385093 - RNA, 64 nt, Homo Sapiens; identical to SEQ ID NO: 156955

SEQ ID NO: 385094 - RNA, 64 nt, Homo Sapiens; identical to SEQ ID NO: 156956

SEQ ID NO: 385095 - RNA, 64 nt, Homo Sapiens; identical to SEQ ID NO: 156957

SEQ ID NO: 385096 - RNA, 64 nt, Homo Sapiens; identical to SEQ ID NO: 156958

SEQ ID NO: 385097 - RNA, 64 nt, Homo Sapiens; identical to SEQ ID NO: 156959

SEQ ID NO: 385098 - RNA, 64 nt, Homo Sapiens; identical to SEQ ID NO: 156960

SEQ ID NO: 385099 - RNA, 64 nt, Homo Sapiens; identical to SEQ ID NO: 156961

SEQ ID NO: 385100 - RNA, 64 nt, Homo Sapiens; identical to SEQ ID NO: 156962

SEQ ID NO: 385101 - RNA, 64 nt, Homo Sapiens; identical to SEQ ID NO: 156963

SEQ ID NO: 385102 - RNA, 64 nt, Homo Sapiens; identical to SEQ ID NO: 156964

SEQ ID NO: 385103 - RNA, 64 nt, Homo Sapiens; identical to SEQ ID NO: 156965

SEQ ID NO: 385104 - RNA, 64 nt, Homo Sapiens; identical to SEQ ID NO: 156966

SEQ ID NO: 385105 - RNA, 64 nt, Homo Sapiens; identical to SEQ ID NO: 156967

SEQ ID NO: 385106 - RNA, 64 nt, Homo Sapiens; identical to SEQ ID NO: 156968

SEQ ID NO: 385107 - RNA, 64 nt, Homo Sapiens; identical to SEQ ID NO: 156969

SEQ ID NO: 385108 - RNA, 64 nt, Homo Sapiens; identical to SEQ ID NO: 156970

SEQ ID NO: 385109 - RNA, 64 nt, Homo Sapiens; identical to SEQ ID NO: 156971

SEQ ID NO: 385110 - RNA, 64 nt, Homo Sapiens; identical to SEQ ID NO: 156972

SEQ ID NO: 385111 - RNA, 64 nt, Homo Sapiens; identical to SEQ ID NO: 156973

SEQ ID NO: 385112 - RNA, 64 nt, Homo Sapiens; identical to SEQ ID NO: 156974

SEQ ID NO: 385113 - RNA, 64 nt, Homo Sapiens; identical to SEQ ID NO: 156975

SEQ ID NO: 385114 - RNA, 64 nt, Homo Sapiens; identical to SEQ ID NO: 156976

SEQ ID NO: 385115 - RNA, 64 nt, Homo Sapiens; identical to SEQ ID NO: 156977

SEQ ID NO: 385116 - RNA, 64 nt, Homo Sapiens; identical to SEQ ID NO: 156978

SEQ ID NO: 385117 - RNA, 64 nt, Homo Sapiens; identical to SEQ ID NO: 156979

SEQ ID NO: 385118 - RNA, 64 nt, Homo Sapiens; identical to SEQ ID NO: 156980

SEQ ID NO: 385119 - RNA, 64 nt, Homo Sapiens; identical to SEQ ID NO: 156981

SEQ ID NO: 385120 - RNA, 64 nt, Homo Sapiens; identical to SEQ ID NO: 156982

SEQ ID NO: 385121 - RNA, 64 nt, Homo Sapiens; identical to SEQ ID NO: 156983

SEQ ID NO: 385122 - RNA, 64 nt, Homo Sapiens; identical to SEQ ID NO: 156984

SEQ ID NO: 385123 - RNA, 64 nt, Homo Sapiens; identical to SEQ ID NO: 156985

SEQ ID NO: 385124 - RNA, 64 nt, Homo Sapiens; identical to SEQ ID NO: 156986

SEQ ID NO: 385125 - RNA, 64 nt, Homo Sapiens; identical to SEQ ID NO: 156987

SEQ ID NO: 385126 - RNA, 64 nt, Homo Sapiens; identical to SEQ ID NO: 156988

SEQ ID NO: 385127 - RNA, 64 nt, Homo Sapiens; identical to SEQ ID NO: 156989

SEQ ID NO: 385128 - RNA, 64 nt, Homo Sapiens; identical to SEQ ID NO: 156990

SEQ ID NO: 385129 - RNA, 64 nt, Homo Sapiens; identical to SEQ ID NO: 118878

SEQ ID NO: 385130 - RNA, 64 nt, Homo Sapiens; identical to SEQ ID NO: 118879

SEQ ID NO: 385131 - RNA, 64 nt, Homo Sapiens; identical to SEQ ID NO: 118880

SEQ ID NO: 385132 - RNA, 64 nt, Homo Sapiens; identical to SEQ ID NO: 118881

SEQ ID NO: 385133 - RNA, 64 nt, Homo Sapiens; identical to SEQ ID NO: 118882

SEQ ID NO: 385134 - RNA, 64 nt, Homo Sapiens; identical to SEQ ID NO: 118883

SEQ ID NO: 385135 - RNA, 64 nt, Homo Sapiens; identical to SEQ ID NO: 118884

SEQ ID NO: 385136 - RNA, 64 nt, Homo Sapiens; identical to SEQ ID NO: 118885

SEQ ID NO: 385137 - RNA, 64 nt, Homo Sapiens; identical to SEQ ID NO: 118886

SEQ ID NO: 385138 - RNA, 64 nt, Homo Sapiens; identical to SEQ ID NO: 118887

SEQ ID NO: 385139 - RNA, 64 nt, Homo Sapiens; identical to SEQ ID NO: 118888

SEQ ID NO: 385140 - RNA, 64 nt, Homo Sapiens; identical to SEQ ID NO: 118889

SEQ ID NO: 385141 - RNA, 64 nt, Homo Sapiens; identical to SEQ ID NO: 118890

SEQ ID NO: 385142 - RNA, 56 nt, Homo Sapiens; identical to SEQ ID NO: 118891

SEQ ID NO: 385143 - RNA, 64 nt, Homo Sapiens; identical to SEQ ID NO: 132265

SEQ ID NO: 385144 - RNA, 64 nt, Homo Sapiens; identical to SEQ ID NO: 132266

SEQ ID NO: 385145 - RNA, 64 nt, Homo Sapiens; identical to SEQ ID NO: 132267

SEQ ID NO: 385146 - RNA, 64 nt, Homo Sapiens; identical to SEQ ID NO: 132268

SEQ ID NO: 385147 - RNA, 64 nt, Homo Sapiens; identical to SEQ ID NO: 132269

SEQ ID NO: 385148 - RNA, 64 nt, Homo Sapiens; identical to SEQ ID NO: 132270

SEQ ID NO: 385149 - RNA, 64 nt, Homo Sapiens; identical to SEQ ID NO: 132271

SEQ ID NO: 385150 - RNA, 64 nt, Homo Sapiens; identical to SEQ ID NO: 132272

SEQ ID NO: 385151 - RNA, 64 nt, Homo Sapiens; identical to SEQ ID NO: 132273

SEQ ID NO: 385152 - RNA, 64 nt, Homo Sapiens; identical to SEQ ID NO: 132274

SEQ ID NO: 385153 - RNA, 64 nt, Homo Sapiens; identical to SEQ ID NO: 132275

SEQ ID NO: 385154 - RNA, 64 nt, Homo Sapiens; identical to SEQ ID NO: 132276

SEQ ID NO: 385155 - RNA, 64 nt, Homo Sapiens; identical to SEQ ID NO: 132277

SEQ ID NO: 385156 - RNA, 64 nt, Homo Sapiens; identical to SEQ ID NO: 132278

SEQ ID NO: 385157 - RNA, 64 nt, Homo Sapiens; identical to SEQ ID NO: 132279

SEQ ID NO: 385158 - RNA, 64 nt, Homo Sapiens; identical to SEQ ID NO: 132280

SEQ ID NO: 385159 - RNA, 64 nt, Homo Sapiens; identical to SEQ ID NO: 132281

SEQ ID NO: 385160 - RNA, 64 nt, Homo Sapiens; identical to SEQ ID NO: 132282

SEQ ID NO: 385161 - RNA, 64 nt, Homo Sapiens; identical to SEQ ID NO: 132283

SEQ ID NO: 385162 - RNA, 64 nt, Homo Sapiens; identical to SEQ ID NO: 132284

SEQ ID NO: 385163 - RNA, 64 nt, Homo Sapiens; identical to SEQ ID NO: 132285

SEQ ID NO: 385164 - RNA, 64 nt, Homo Sapiens; identical to SEQ ID NO: 132286

SEQ ID NO: 385165 - RNA, 64 nt, Homo Sapiens; identical to SEQ ID NO: 132287

SEQ ID NO: 385166 - RNA, 64 nt, Homo Sapiens; identical to SEQ ID NO: 132288

SEQ ID NO: 385167 - RNA, 64 nt, Homo Sapiens; identical to SEQ ID NO: 132289

SEQ ID NO: 385168 - RNA, 64 nt, Homo Sapiens; identical to SEQ ID NO: 132290

SEQ ID NO: 385169 - RNA, 64 nt, Homo Sapiens; identical to SEQ ID NO: 132291

SEQ ID NO: 385170 - RNA, 64 nt, Homo Sapiens; identical to SEQ ID NO: 132292

SEQ ID NO: 385171 - RNA, 64 nt, Homo Sapiens; identical to SEQ ID NO: 132293

SEQ ID NO: 385172 - RNA, 64 nt, Homo Sapiens; identical to SEQ ID NO: 132294

SEQ ID NO: 385173 - RNA, 64 nt, Homo Sapiens; identical to SEQ ID NO: 132295

SEQ ID NO: 385174 - RNA, 64 nt, Homo Sapiens; identical to SEQ ID NO: 132296

SEQ ID NO: 385175 - RNA, 64 nt, Homo Sapiens; identical to SEQ ID NO: 132297

SEQ ID NO: 385176 - RNA, 64 nt, Homo Sapiens; identical to SEQ ID NO: 132298

SEQ ID NO: 385177 - RNA, 64 nt, Homo Sapiens; identical to SEQ ID NO: 132299

SEQ ID NO: 385178 - RNA, 64 nt, Homo Sapiens; identical to SEQ ID NO: 132300

SEQ ID NO: 385179 - RNA, 64 nt, Homo Sapiens; identical to SEQ ID NO: 132301

SEQ ID NO: 385180 - RNA, 64 nt, Homo Sapiens; identical to SEQ ID NO: 132302

SEQ ID NO: 385181 - RNA, 64 nt, Homo Sapiens; identical to SEQ ID NO: 132303

SEQ ID NO: 385182 - RNA, 64 nt, Homo Sapiens; identical to SEQ ID NO: 132304

SEQ ID NO: 385183 - RNA, 64 nt, Homo Sapiens; identical to SEQ ID NO: 132305

SEQ ID NO: 385184 - RNA, 64 nt, Homo Sapiens; identical to SEQ ID NO: 132306

SEQ ID NO: 385185 - RNA, 64 nt, Homo Sapiens; identical to SEQ ID NO: 132307

SEQ ID NO: 385186 - RNA, 64 nt, Homo Sapiens; identical to SEQ ID NO: 132308

SEQ ID NO: 385187 - RNA, 64 nt, Homo Sapiens; identical to SEQ ID NO: 132309

SEQ ID NO: 385188 - RNA, 64 nt, Homo Sapiens; identical to SEQ ID NO: 132310

SEQ ID NO: 385189 - RNA, 64 nt, Homo Sapiens; identical to SEQ ID NO: 132311

SEQ ID NO: 385190 - RNA, 64 nt, Homo Sapiens; identical to SEQ ID NO: 132312

SEQ ID NO: 385191 - RNA, 64 nt, Homo Sapiens; identical to SEQ ID NO: 132313

SEQ ID NO: 385192 - RNA, 64 nt, Homo Sapiens; identical to SEQ ID NO: 132314

SEQ ID NO: 385193 - RNA, 64 nt, Homo Sapiens; identical to SEQ ID NO: 132315

SEQ ID NO: 385194 - RNA, 64 nt, Homo Sapiens; identical to SEQ ID NO: 132316

SEQ ID NO: 385195 - RNA, 64 nt, Homo Sapiens; identical to SEQ ID NO: 132317

SEQ ID NO: 385196 - RNA, 64 nt, Homo Sapiens; identical to SEQ ID NO: 132318

SEQ ID NO: 385197 - RNA, 64 nt, Homo Sapiens; identical to SEQ ID NO: 132319

SEQ ID NO: 385198 - RNA, 64 nt, Homo Sapiens; identical to SEQ ID NO: 132320

SEQ ID NO: 385199 - RNA, 64 nt, Homo Sapiens; identical to SEQ ID NO: 132321

SEQ ID NO: 385200 - RNA, 64 nt, Homo Sapiens; identical to SEQ ID NO: 132322

SEQ ID NO: 385201 - RNA, 64 nt, Homo Sapiens; identical to SEQ ID NO: 132323

SEQ ID NO: 385202 - RNA, 64 nt, Homo Sapiens; identical to SEQ ID NO: 132324

SEQ ID NO: 385203 - RNA, 64 nt, Homo Sapiens; identical to SEQ ID NO: 132325

SEQ ID NO: 385204 - RNA, 64 nt, Homo Sapiens
cuuugccaccuuuugggugugugcugauccuuccuauuccuauugcuuccucacuccaaaauag

SEQ ID NO: 385205 - RNA, 64 nt, Homo Sapiens
aguauaauacuaaaauguaaaagagauuauccuauauuccuaucggaaaccaaauaggcuuuag

SEQ ID NO: 385206 - RNA, 64 nt, Homo Sapiens
aaaagaaaacgugccuucuguauaaguuuauguuuauuccuacauuuuauucauuuuuaaugua

SEQ ID NO: 385207 - RNA, 64 nt, Homo Sapiens
cuaauauuuguguggagguucuuuugaccaauuuuauuccuaagaauaaacaaaccccuacagu

SEQ ID NO: 385208 - RNA, 64 nt, Homo Sapiens
caagauaguuacaaagauuuccugccuuccauuuuauuccuaaaugggaacugcgucagacaaa

SEQ ID NO: 385209 - RNA, 64 nt, Homo Sapiens
uauuucuuacuuuaaguucucaacuuuuuucauuuauuccuaagauuugaagguagaaacuucu

SEQ ID NO: 385210 - RNA, 64 nt, Homo Sapiens
cccucccccuaauucucaucugucagauccaguguauuccuaagcugggacaaagccucuguuu

SEQ ID NO: 385211 - RNA, 64 nt, Homo Sapiens
gcuuccucuucuuccucuucuuuucacaggugcuuauuccuaauaaacaucuugcaacccaaac

SEQ ID NO: 385212 - RNA, 64 nt, Homo Sapiens; identical to SEQ ID NO: 74512

SEQ ID NO: 385213 - RNA, 64 nt, Homo Sapiens; identical to SEQ ID NO: 74513

SEQ ID NO: 385214 - RNA, 64 nt, Homo Sapiens; identical to SEQ ID NO: 74514

SEQ ID NO: 385215 - RNA, 64 nt, Homo Sapiens; identical to SEQ ID NO: 74515

SEQ ID NO: 385216 - RNA, 64 nt, Homo Sapiens; identical to SEQ ID NO: 74516

SEQ ID NO: 385217 - RNA, 64 nt, Homo Sapiens; identical to SEQ ID NO: 74517

SEQ ID NO: 385218 - RNA, 64 nt, Homo Sapiens; identical to SEQ ID NO: 74518

SEQ ID NO: 385219 - RNA, 64 nt, Homo Sapiens; identical to SEQ ID NO: 74519

SEQ ID NO: 385220 - RNA, 64 nt, Homo Sapiens; identical to SEQ ID NO: 74520

SEQ ID NO: 385221 - RNA, 64 nt, Homo Sapiens; identical to SEQ ID NO: 74521

SEQ ID NO: 385222 - RNA, 64 nt, Homo Sapiens; identical to SEQ ID NO: 74522

SEQ ID NO: 385223 - RNA, 64 nt, Homo Sapiens; identical to SEQ ID NO: 74523

SEQ ID NO: 385224 - RNA, 64 nt, Homo Sapiens; identical to SEQ ID NO: 74524

SEQ ID NO: 385225 - RNA, 64 nt, Homo Sapiens; identical to SEQ ID NO: 74525

SEQ ID NO: 385226 - RNA, 64 nt, Homo Sapiens; identical to SEQ ID NO: 74526

SEQ ID NO: 385227 - RNA, 64 nt, Homo Sapiens; identical to SEQ ID NO: 74527

SEQ ID NO: 385228 - RNA, 64 nt, Homo Sapiens; identical to SEQ ID NO: 74528

SEQ ID NO: 385229 - RNA, 64 nt, Homo Sapiens; identical to SEQ ID NO: 74529

SEQ ID NO: 385230 - RNA, 64 nt, Homo Sapiens; identical to SEQ ID NO: 74530

SEQ ID NO: 385231 - RNA, 64 nt, Homo Sapiens; identical to SEQ ID NO: 74531

SEQ ID NO: 385232 - RNA, 64 nt, Homo Sapiens; identical to SEQ ID NO: 74532

SEQ ID NO: 385233 - RNA, 64 nt, Homo Sapiens; identical to SEQ ID NO: 74533

SEQ ID NO: 385234 - RNA, 54 nt, Homo Sapiens; identical to SEQ ID NO: 74534

SEQ ID NO: 385235 - RNA, 64 nt, Homo Sapiens; identical to SEQ ID NO: 74535

SEQ ID NO: 385236 - RNA, 64 nt, Homo Sapiens; identical to SEQ ID NO: 74536

SEQ ID NO: 385237 - RNA, 64 nt, Homo Sapiens; identical to SEQ ID NO: 74537

SEQ ID NO: 385238 - RNA, 64 nt, Homo Sapiens; identical to SEQ ID NO: 74538

SEQ ID NO: 385239 - RNA, 64 nt, Homo Sapiens; identical to SEQ ID NO: 74539

SEQ ID NO: 385240 - RNA, 64 nt, Homo Sapiens; identical to SEQ ID NO: 74540

SEQ ID NO: 385241 - RNA, 64 nt, Homo Sapiens; identical to SEQ ID NO: 74541

SEQ ID NO: 385242 - RNA, 64 nt, Homo Sapiens; identical to SEQ ID NO: 74542

SEQ ID NO: 385243 - RNA, 64 nt, Homo Sapiens
accugcugugagagugcugagguaccagaagugugagaacgagggggcgugcugggaucuuucu

SEQ ID NO: 385244 - RNA, 64 nt, Homo Sapiens
uuccuaaaaaugaaaaguuuguuucauauagugagagaacgaaaucucuaucggccagucagau

SEQ ID NO: 385245 - RNA, 64 nt, Homo Sapiens
agaggcuguaggguccuuggguuacagagccggggagaacgaaguucugugacccaggggugga

SEQ ID NO: 385246 - RNA, 64 nt, Homo Sapiens
ucucgcuucagucacucugcggcaucucacuucugagaacgaaacccuggucccucgaaaucgu

SEQ ID NO: 385247 - RNA, 64 nt, Homo Sapiens
guuagccacaugcccaaguucuuuuuaccagagagagaacgaauucaucagagaugaauaauau

SEQ ID NO: 385248 - RNA, 64 nt, Homo Sapiens
agacugcaggggaggccaugugaagcccuguucugagaacgagcagucugauaaaagauuccag

SEQ ID NO: 385249 - RNA, 64 nt, Homo Sapiens
cagaguucacuccuuccuccgcuuuuuuauacaagagaacgagcguccaguccaggacacuggu

SEQ ID NO: 385250 - RNA, 64 nt, Homo Sapiens
augauuuaaugguguuuacuauccgcugugggcagagaacgaugccccaguucuccuaagaaaa

SEQ ID NO: 385251 - RNA, 64 nt, Homo Sapiens
guuuccaguuucacauucuacuacuucugcgcuagagaacgaugcucugugagaggcauucacu

SEQ ID NO: 385252 - RNA, 64 nt, Homo Sapiens
agagaaagagagagagagagagagaagggaggaugagaacgaauggggggaagagauaaacuuu

SEQ ID NO: 385253 - RNA, 64 nt, Homo Sapiens
auaggcuauacuacaauugcacuuccagcacuuugagaacgaguugaauaccaagaauuauuca

SEQ ID NO: 385254 - RNA, 64 nt, Homo Sapiens
auauguacuagucugugaacaaugucaaauaaaagagaacgaacagguaguuugguggagcuga

SEQ ID NO: 385255 - RNA, 64 nt, Homo Sapiens
ucugggaacacugagaagggugaccaaugcguuggagaacgagggagggcuucauagcagaaga

SEQ ID NO: 385256 - RNA, 64 nt, Homo Sapiens
aggcucaucaaacagguaaagucucgaaggaagcgagaacgaaaucucucauugugugccgugu

SEQ ID NO: 385257 - RNA, 64 nt, Homo Sapiens
aucgucaccucugugccugacuaugugccccacagagaacgaugaccuguuuccggcugcauca

SEQ ID NO: 385258 - RNA, 64 nt, Homo Sapiens
gaagacucccggauucuaccccaggauacuucaugagaacgaaccccuucagagaggcccuaca

SEQ ID NO: 385259 - RNA, 64 nt, Homo Sapiens
ccaaaggcucucuccugauagucuuucaguuaaggagaacgaccccugcuucugacacugaaac

SEQ ID NO: 385260 - RNA, 64 nt, Homo Sapiens
agaaauggaaagacuccuugggggcuuuuccuaggagaacgauauuuggggaggggggaaaaga

SEQ ID NO: 385261 - RNA, 64 nt, Homo Sapiens
acacccuguacacacagaaaaugguauaaaauaugagaacgaaguuuaaaauugugacucugau

SEQ ID NO: 385262 - RNA, 64 nt, Homo Sapiens
ucuuaaucacauuuuccccagagauaaacauugagagaacgaaagccaaagugucauuuaagag

SEQ ID NO: 385263 - RNA, 64 nt, Homo Sapiens
gacacaucggcuguucacacguuccccgcaaucugagaacgaacaggaauggagagaggacuca

SEQ ID NO: 385264 - RNA, 64 nt, Homo Sapiens
augcacaucagcugguggagcaggccuggccuuggagaacgagaccugugugccaggggcagau

SEQ ID NO: 385265 - RNA, 64 nt, Homo Sapiens
cuucggugagagagcaccccguucugcuuucgacgagaacgaccgcaaccccugaggcuguggg

SEQ ID NO: 385266 - RNA, 64 nt, Homo Sapiens
gaaucuucacuauaaacagagaagccuggagcuggagaacgaaacccagagaguuuuaccguau

SEQ ID NO: 385267 - RNA, 64 nt, Homo Sapiens
cugcccguguacccucaacugccuccuuuuugcagagaacgauccccacaggaacuggucuaag

SEQ ID NO: 385268 - RNA, 64 nt, Homo Sapiens
agaaauagggagauggugucagguuaagucaagugagaacgaugcuuccagcuccacuucugca

SEQ ID NO: 385269 - RNA, 64 nt, Homo Sapiens
aagaccaaauuauggaaaaucaugaagacaacuggagaacgacugccaugggccacuuuauuua

SEQ ID NO: 385270 - RNA, 64 nt, Homo Sapiens
ugcuuugggugaaggagacuguaagcugguacuugagaacgaauuugccagcaugugcuguugu

SEQ ID NO: 385271 - RNA, 64 nt, Homo Sapiens
cucuggccaucugcaacccugaacgugcagguuggagaacgaaugaauacaaauuuuauuguaa

SEQ ID NO: 385272 - RNA, 64 nt, Homo Sapiens
aaggaaugaagagcuacaggcuggcauggagagugagaacgacaggaucuagaaaugagacaua

SEQ ID NO: 385273 - RNA, 64 nt, Homo Sapiens
auuguuauauuuugaaaguacaccuguuauaugggagaacgaaauuuuugguuuucuuguuagc

SEQ ID NO: 385274 - RNA, 64 nt, Homo Sapiens
aucagugugaguccugaagcacuuucagugcugugagaacgacauccacuuuggguuucauucg

SEQ ID NO: 385275 - RNA, 64 nt, Homo Sapiens
gcaugugacuuagcaagggcucugaaaugacaaagagaacgagcaccacaaaugagaacaggau

SEQ ID NO: 385276 - RNA, 64 nt, Homo Sapiens
ccagggagcauauugcuguaggauugggggaagggagaacgaacacccaaaggcacaguuuaga

SEQ ID NO: 385277 - RNA, 64 nt, Homo Sapiens
gcuuugggaaaagcaucauuuuaccaaacauaccgagaacgaaaacuucaaggaugauguuaga

SEQ ID NO: 385278 - RNA, 64 nt, Homo Sapiens
ugucucccaaccucuacuguaaacuuucugguccgagaacgagccgaacacagcgcgacgcagg

SEQ ID NO: 385279 - RNA, 64 nt, Homo Sapiens
cugaauacagcagauguagguuaccaaaaacagagagaacgagcuggaagaagcugagcauguc

SEQ ID NO: 385280 - RNA, 64 nt, Homo Sapiens
auuaagucacauacuuuucuaggugcuggggauugagaacgaaucgauguaagauuccuccuuu

SEQ ID NO: 385281 - RNA, 64 nt, Homo Sapiens
cuccaccucagguuuucacuuuucgcuccggagcgagaacgaaacgacaaaaacgcaagaaaac

SEQ ID NO: 385282 - RNA, 64 nt, Homo Sapiens
uuuuuuuuaaauaauauaucgcagaauauuuuuggagaacgauuaacaacugaggaaggccagu

SEQ ID NO: 385283 - RNA, 64 nt, Homo Sapiens
ucuuuggggaugacauuuuccccacgggucuagggagaacgaacacggugaaggcuggguugcc

SEQ ID NO: 385284 - RNA, 64 nt, Homo Sapiens
aggccauucauggccaugggaccacgcauaaauggagaacgaguaaauuuugcuaaguccaagg

SEQ ID NO: 385285 - RNA, 64 nt, Homo Sapiens
ggaucugggcaccccaggaaacaaucugagccaugagaacgaggagauagccgagaccccagca

SEQ ID NO: 385286 - RNA, 64 nt, Homo Sapiens
caacaucccgcucauugacgacacggacguggacgagaacgaggagcgccuccgggcccccccg

SEQ ID NO: 385287 - RNA, 64 nt, Homo Sapiens
uuucuuucuuuauuucucagucgaggucuggcuugagaacgaccuuuuccccaagacaagacaa

SEQ ID NO: 385288 - RNA, 64 nt, Homo Sapiens
aagguacagcuacuauucucaacuuucacaacaacccuaggagaauguacaccuuaauuuauuu

SEQ ID NO: 385289 - RNA, 64 nt, Homo Sapiens
ggcugaguuaucagagcagccacccuagcacuggcccuaggagggggucccuuggcuuuucgac

SEQ ID NO: 385290 - RNA, 64 nt, Homo Sapiens
aucugcuuuaacuugguauuccucuaauuguguucccuaggaaaugacugucccaagagccagu

SEQ ID NO: 385291 - RNA, 64 nt, Homo Sapiens
cuauaauauggaacaaauaucugaaugaaauccacccuaggagacggagucaaacuaaacuugu

SEQ ID NO: 385292 - RNA, 64 nt, Homo Sapiens
ccauucuugccaggaggaggcgcgggcccuaggacccuaggauguuuagaauucuugcaucacu

SEQ ID NO: 385293 - RNA, 64 nt, Homo Sapiens
cuaggaugccauucuugccagcaucacucgcgggcccuaggaccaacuagguuuuagaauucuu

SEQ ID NO: 385294 - RNA, 64 nt, Homo Sapiens
gccuccuguccuggaccccacgucugcaaggaaacccuaggaccauggauaccucugugauuca

SEQ ID NO: 385295 - RNA, 64 nt, Homo Sapiens
gcauguagggcaagaaggaaggcugaagcgcugucccuaggaggaauuucuccuucaggggagc

SEQ ID NO: 385296 - RNA, 64 nt, Homo Sapiens
auucucucuuaacacaacagaauucugcugucuagaucaggaauuucuaucuguuauaucgacc

SEQ ID NO: 385297 - RNA, 64 nt, Homo Sapiens
uggcauuaagaagugggccuuugggaagugauuagaucaggagugcagagcccucaugauuagg

SEQ ID NO: 385298 - RNA, 64 nt, Homo Sapiens
gcagccaggacccgccugcucccauccucacccagaucaggaaccagggccucccuguucacgg

SEQ ID NO: 385299 - RNA, 64 nt, Homo Sapiens
cuuguucucuggaaccugacuuuagauguuuugggaucaggagcccccaacacaggcaagucca

SEQ ID NO: 385300 - RNA, 64 nt, Homo Sapiens; identical to SEQ ID NO: 290771

SEQ ID NO: 385301 - RNA, 64 nt, Homo Sapiens; identical to SEQ ID NO: 290772

SEQ ID NO: 385302 - RNA, 64 nt, Homo Sapiens; identical to SEQ ID NO: 290773

SEQ ID NO: 385303 - RNA, 64 nt, Homo Sapiens; identical to SEQ ID NO: 290774

SEQ ID NO: 385304 - RNA, 64 nt, Homo Sapiens; identical to SEQ ID NO: 290775

SEQ ID NO: 385305 - RNA, 64 nt, Homo Sapiens; identical to SEQ ID NO: 290776

SEQ ID NO: 385306 - RNA, 64 nt, Homo Sapiens
aggauugaaccuggaagucugggacuuuaucauagaaacaaagucucagauauuuuaguucuuu

SEQ ID NO: 385307 - RNA, 64 nt, Homo Sapiens
auagaaacaaagucucagauauuuuaguucuuuggaaacaaaugcuguaauucaaaagcauuug

SEQ ID NO: 385308 - RNA, 64 nt, Homo Sapiens
aaugggaaggagccagaaaugccaucuucacccagaaacaaagaauacugaagccacucaagac

SEQ ID NO: 385309 - RNA, 64 nt, Homo Sapiens
uagcagagacaaacuuuuuuuagaauugaagucugaaacaaacaaaagcaauucaaugucaaua

SEQ ID NO: 385310 - RNA, 64 nt, Homo Sapiens
aguauuuuaugacuagagaucacaggcacaaguugaaacaaacuaacaugacaagaaagcuaua

SEQ ID NO: 385311 - RNA, 64 nt, Homo Sapiens
aacuauuagcuuagaauuugcaacaagcgaaacugaaacaaacagaugcucagaugaaaaacag

SEQ ID NO: 385312 - RNA, 64 nt, Homo Sapiens
gcuggucaccugauuuaggcgagaaaccuggucagaaacaaaggaaugauucucuaucucaggu

SEQ ID NO: 385313 - RNA, 64 nt, Homo Sapiens
auucucuaucucaggugagaauuugaacuauuuggaaacaaaugggaggccuguggaugggggg

SEQ ID NO: 385314 - RNA, 64 nt, Homo Sapiens
auuuuaaaagcuugcaguaaaauugaaaaaaguugaaacaaauggauguuuuuacaaaaugacu

SEQ ID NO: 385315 - RNA, 57 nt, Homo Sapiens
auauucaucuguugacaauugucuaaugaaacaaaaaacucccgacauaggcuuuga

SEQ ID NO: 385316 - RNA, 64 nt, Homo Sapiens
ugacauuuauuuuagaaaguccuauaauguggaagaaacaaacaguugcuaccaaagauucuuc

SEQ ID NO: 385317 - RNA, 64 nt, Homo Sapiens
uuguauucauuuaucuuagggggaacauuguaaagaaacaaaaagguccagaugaauguaugcu

SEQ ID NO: 385318 - RNA, 64 nt, Homo Sapiens
aguuuuauaccuacuuuuaaaauucugcuuuccagaaacaaaauuccugcaguggucuaauuua

SEQ ID NO: 385319 - RNA, 64 nt, Homo Sapiens
uaaaaaucuugcacaaauuguaaugugauacugugaaacaaauugaaaacauugccucuuugca

SEQ ID NO: 385320 - RNA, 64 nt, Homo Sapiens
cccuugguccuggaacauuuauguuccuuuuaaagaaacaaaaaucaaacuuuacagaaagauu

SEQ ID NO: 385321 - RNA, 64 nt, Homo Sapiens
ccaaaaaaaggaaggaagggacacauaucaaacugaaacaaaauuagaaauguaauuauguucu

SEQ ID NO: 385322 - RNA, 64 nt, Homo Sapiens
uacaagaugugguuagaaacauuucuuuguucuggaaacaaaguacuguugaaaccagcuugga

SEQ ID NO: 385323 - RNA, 64 nt, Homo Sapiens
aaaguuuucuuaucuucugugcuuuuggucccuggaaacaaauccgccuauguaugaagcuagu

SEQ ID NO: 385324 - RNA, 64 nt, Homo Sapiens
agugcucaacuauuugaacuguugagugauaaaggaaacaaauauaacuguaaaugaaucuugg

SEQ ID NO: 385325 - RNA, 64 nt, Homo Sapiens
aggacucuaauaaaaaaucacuucauuguauuuggaaacaaaaacaucauucauuaauuacuua

SEQ ID NO: 385326 - RNA, 64 nt, Homo Sapiens
cugagaaguaggcuaagagaacugcuuccacuuagaaacaaacuugguagugcuuugguggagg

SEQ ID NO: 385327 - RNA, 64 nt, Homo Sapiens
cuggaauaucugcccaugcuaucuaggccuugaagaaacaaaggaggagagacuuguagguaca

SEQ ID NO: 385328 - RNA, 64 nt, Homo Sapiens
uguauugaaauacauauuggcacugggaaaaguggaaacaaacauuuugugugugugugugugg

SEQ ID NO: 385329 - RNA, 64 nt, Homo Sapiens
acauagaugguagacuuuuaguuucaaaauguuugaaacaaaaggaagaaucaauacauauuuu

SEQ ID NO: 385330 - RNA, 64 nt, Homo Sapiens
uuuacuuagaguggaaggaccuuguguucugugagaaacaaauacaagaggcccuuugaacugc

SEQ ID NO: 385331 - RNA, 64 nt, Homo Sapiens
acccucuggggguaauuuacuuuuaaggaaugaggaaacaaaccguuuauuuguuuuuguuuuu

SEQ ID NO: 385332 - RNA, 64 nt, Homo Sapiens
aaacaauuaacugcccucugaaauaaugggauuagaaacaaacaaaacucuuaaguccuaaaag

SEQ ID NO: 385333 - RNA, 64 nt, Homo Sapiens
aaacacugacuuagguuucaggaaguugccaugggaaacaaauaauuugaacuuuggaacaggg

SEQ ID NO: 385334 - RNA, 64 nt, Homo Sapiens
uacauaucgaagacaggucuggcuauucauuugugaaacaaauaauaugcauaagauuguacaa

SEQ ID NO: 385335 - RNA, 64 nt, Homo Sapiens
uauuuaaaaccaucauuugauaaguucagaaguagaaacaaacuuuaguuuagcuuuaguuuag

SEQ ID NO: 385336 - RNA, 64 nt, Homo Sapiens
gacacucaauuucaugugaauuuuagcaaaacaggaaacaaagauaaugacucaguucagagga

SEQ ID NO: 385337 - RNA, 64 nt, Homo Sapiens
agaaaaguauuuuuauguaucauaaauguauuuugaaacaaaugagaagaagaaagguagaagg

SEQ ID NO: 385338 - RNA, 64 nt, Homo Sapiens
cuuuguuaggaaaauguaacagcagaaaaggaaagaaacaaagaacaugaacaaaaagcauuaa

SEQ ID NO: 385339 - RNA, 64 nt, Homo Sapiens
auuuuuugguguaauucuugaaauuuucugacaggaaacaaauaaagauagaugugucugagag

SEQ ID NO: 385340 - RNA, 64 nt, Homo Sapiens
cauuuuaauuaaacaaucuauguaacagaaucaagaaacaaauacaaauuuuaauuaaacaauc

SEQ ID NO: 385341 - RNA, 64 nt, Homo Sapiens
uuaauuaaacaaucuguaacuauaacagaaucaagaaacaaauuucacaugguuucuccaugua

SEQ ID NO: 385342 - RNA, 64 nt, Homo Sapiens
uguucuggggggugaaaauagacuaacuacuggagaaacaaagagagaaagaaaacccaguguu

SEQ ID NO: 385343 - RNA, 64 nt, Homo Sapiens
agagcaaauacucuucagauccuauguagucagugaaacaaaauggagagcguauucugauaga

SEQ ID NO: 385344 - RNA, 64 nt, Homo Sapiens
ucucgguggcagguucccaccucgcaagcaauuggaaacaaaacuuuuggggaguuuuauuuug

SEQ ID NO: 385345 - RNA, 64 nt, Homo Sapiens
aggguguguuuuauguuaagcaaaacauacuuuagaaacaaaugaaaaaggcaauugaaaaucc

SEQ ID NO: 385346 - RNA, 64 nt, Homo Sapiens
cugccugcaaagaauuaacauccgucuagugggagaaacaaacacaccccacucacuaaguaug

SEQ ID NO: 385347 - RNA, 64 nt, Homo Sapiens
cagccugggaacaagagugaaacucucaaaagcagaaacaaaaacccaacauauaugggcuguu

SEQ ID NO: 385348 - RNA, 64 nt, Homo Sapiens
caucccggcccaaggcgcagugcugugcacggaagaaacaaagaagggcgcaggggcugccgag

SEQ ID NO: 385349 - RNA, 64 nt, Homo Sapiens
gaaauaaaguuuuuauucugugcucacauucugagaaacaaaaagagaguucuucauuccuugc

SEQ ID NO: 385350 - RNA, 64 nt, Homo Sapiens
gcagcuguuguccuuaaaaauugguguuaagcaugaaacaaacaacuauaagucauuuugagug

SEQ ID NO: 385351 - RNA, 64 nt, Homo Sapiens
acugaaauaaaaaacauguucaaguucauuugcagaaacaaauacaguagguacauggauacau

SEQ ID NO: 385352 - RNA, 64 nt, Homo Sapiens
ccaaccaacaaauacaacacacaaaucuaaaagugaaacaaaaaaaauuaaacaauuaaaugaa

SEQ ID NO: 385353 - RNA, 64 nt, Homo Sapiens
uaaaagugaaacaaaaaccauuaaacaauuaaaugaaacaaaucuugcaccagaagagggaaaa

SEQ ID NO: 385354 - RNA, 58 nt, Homo Sapiens
aggcuccaacaauggagugagagccaaagaaacaaagauccacacacauccucacccc

SEQ ID NO: 385355 - RNA, 64 nt, Homo Sapiens
cauucucguguucagugaugcccucuucuuguuugaaacaaaagaaaauaaugcauuguguuuu

SEQ ID NO: 385356 - RNA, 64 nt, Homo Sapiens
uacaucugugaacuagcuaaaauauucaacuauugaaacaaaugauauauauuuuuaaauguuc

SEQ ID NO: 385357 - RNA, 64 nt, Homo Sapiens
uagaauauccucuuagacaugaguaguaaccugugaaacaaacagccagccuggauauacaaca

SEQ ID NO: 385358 - RNA, 64 nt, Homo Sapiens
gagaguuagguuauucaaaaaaccucucuuaguagaaacaaaggguuacuuguagccaaaaaga

SEQ ID NO: 385359 - RNA, 64 nt, Homo Sapiens
ucaggguuuguugaauuagcuagccauagauggagaaacaaagcugguuagagugauauguauu

SEQ ID NO: 385360 - RNA, 64 nt, Homo Sapiens
ugaucagacacugccuuuugauuccuuuuauuuugaaacaaaaaaauagcauauaaauaaguau

SEQ ID NO: 385361 - RNA, 64 nt, Homo Sapiens
agacaaugacauaaacggcuggacuuuucccugcgaaacaaauggagugaggagaggauugcag

SEQ ID NO: 385362 - RNA, 64 nt, Homo Sapiens
caaauaucauaaaaggagcuccuugagaaauugugaaacaaacagcaaacugagcugcuuuagu

SEQ ID NO: 385363 - RNA, 64 nt, Homo Sapiens
gaaguaguuaaaugcuuuggaccuuugagaaaaagaaacaaaagagaaaaaggguuguuugaca

SEQ ID NO: 385364 - RNA, 64 nt, Homo Sapiens
ucgucaaagaccugcucaagaaauuuuuaaaaaagaaacaaaguuaugggguuaaucuccuaca

SEQ ID NO: 385365 - RNA, 64 nt, Homo Sapiens
uguuauaaacuaauauaugugagagugcuuaguugaaacaaaaaggaguuuuaguagacaguau

SEQ ID NO: 385366 - RNA, 64 nt, Homo Sapiens
gcuaucugauuucauagcagcagucacuaaauuggaaacaaaagguugcaacgugacaaaaaaa

SEQ ID NO: 385367 - RNA, 64 nt, Homo Sapiens
aacuuauuuuuauuugccugauuuaagugucugagaaacaaaucuuuguucucuuaggcugcaa

SEQ ID NO: 385368 - RNA, 64 nt, Homo Sapiens
ggaauuuuaguagacaguaugagaguacuuaguugaaacaaaaauauuauaaacuaauauaugu

SEQ ID NO: 385369 - RNA, 64 nt, Homo Sapiens
uaugggguuaaucuccuacaaaauuuuuaaaaacgaaacaaaguucaucaaagagcugcucaag

SEQ ID NO: 385370 - RNA, 64 nt, Homo Sapiens
ggccgggugcgguggcucacuuaacauagaauaugaaacaaauuagguagauaaaugugagggc

SEQ ID NO: 385371 - RNA, 64 nt, Homo Sapiens
uuuacuuaacuucuuucuuucaugauaauaggaagaaacaaaaagaaucgaaagaacaaguuaa

SEQ ID NO: 385372 - RNA, 64 nt, Homo Sapiens
agcucgucucagaggccagcaggcuucagggauggaaacaaaccaccucauccagcucguccaa

SEQ ID NO: 385373 - RNA, 64 nt, Homo Sapiens
gaggcuggaacuuuguggucgugcuugccgcucugaaacaaacagacccccugacucccaugcu

SEQ ID NO: 385374 - RNA, 64 nt, Homo Sapiens
cauggaucaagagauacucuuuugggcaguauuagaaacaaaauuuuauuaaaggcuagguuua

SEQ ID NO: 385375 - RNA, 64 nt, Homo Sapiens
gagugcucgucacuggguucagauaauuaaaaaugaaacaaaguaucgguacaguuauucuuaa

SEQ ID NO: 385376 - RNA, 64 nt, Homo Sapiens
guucugcuagcuuguuuucuaucaccuuagugaggaaacaaaauggcaaaggcaucucaggaac

SEQ ID NO: 385377 - RNA, 64 nt, Homo Sapiens
ccaaaagucacuuuugaaugucuggguccuuaaagaaacaaagugugcaacauucucugcccac

SEQ ID NO: 385378 - RNA, 64 nt, Homo Sapiens
augguugaguuuccauauaaguggaccagacacagaaacaaacagaaugagcuaguaagcgaug

SEQ ID NO: 385379 - RNA, 64 nt, Homo Sapiens
uuucaauuuuauuuuaguucuaaauuauguuucagaaacaaaagacaaugcuguacaguuuuau

SEQ ID NO: 385380 - RNA, 64 nt, Homo Sapiens
ugcaguccaaaauucaggaauuuuuuuuggaaaugaaacaaauauguuugacacuccauauuuc

SEQ ID NO: 385381 - RNA, 64 nt, Homo Sapiens
cagagcacuccaucaaaauuugaacaguuugucugaaacaaacaaaguguuuggagcaaagaga

SEQ ID NO: 385382 - RNA, 64 nt, Homo Sapiens
cuaccuauaguuauauggauaaauacagaauuuagaaacaaaaugugugaucauuucugugaua

SEQ ID NO: 385383 - RNA, 64 nt, Homo Sapiens
ugacaaagcaaguagagaagaaacacaaauagcugaaacaaacuuuuuauguggaaaaguaaag

SEQ ID NO: 385384 - RNA, 64 nt, Homo Sapiens
uauccugggauuaggugaaaaaugucuagcaaaagaaacaaagucuuuaauagaguggccucuu

SEQ ID NO: 385385 - RNA, 64 nt, Homo Sapiens
aaugauugacauaaacucuuugugccuugaaaaugaaacaaauuauaaaaauguuuaaauggaa

SEQ ID NO: 385386 - RNA, 64 nt, Homo Sapiens
uaucagggcaagcucauagcacauguuuuacaaagaaacaaaauauaaaucacagauuuccaaa

SEQ ID NO: 385387 - RNA, 64 nt, Homo Sapiens
gugugcuauucguaaguucugugcaguuugguaugaaacaaauauacucauuuggauauaaauc

SEQ ID NO: 385388 - RNA, 64 nt, Homo Sapiens
cagucauuagaaauggucuguguuuacuucuggugaaacaaaacaaaaaauacccuaaguacuc

SEQ ID NO: 385389 - RNA, 64 nt, Homo Sapiens
aacgaccaaaaaaaaaaaaauaugcuuggagguagaaacaaaccgaguauuuuuuugaagacca

SEQ ID NO: 385390 - RNA, 64 nt, Homo Sapiens
uucccuacaauuuucuucacuucaaaaaaggaaagaaacaaaacagucgacuggauucugucag

SEQ ID NO: 385391 - RNA, 64 nt, Homo Sapiens
gucccaugcaaauuacccuaauuaccagcuguaugaaacaaauuaugaacacccuugugauaga

SEQ ID NO: 385392 - RNA, 64 nt, Homo Sapiens
augucucuuacguaacauacucuaagaaugaaacugucaccacagguaaauccuuguuagcaag

SEQ ID NO: 385393 - RNA, 64 nt, Homo Sapiens
ucauuaacauacauaugauacggagucucuuuguugucaccaagugaacauacuucucauggug

SEQ ID NO: 385394 - RNA, 64 nt, Homo Sapiens
agcccauucuuccuugucagucuuggcccaaagaugucaccauuccuaguuauuugucaccaca

SEQ ID NO: 385395 - RNA, 64 nt, Homo Sapiens
ucuuggcccaaagaugucaccauuccuaguuauuugucaccacauaauugguguugauuggaaa

SEQ ID NO: 385396 - RNA, 64 nt, Homo Sapiens
caauaaaaagcagucuuagaacaauugugaaacuugucaccacagaggaucccggaucaucagc

SEQ ID NO: 385397 - RNA, 64 nt, Homo Sapiens
aacgauggauauguacacaugcugaguugaaguuugucaccaagucagaaugcaaccaaaauca

SEQ ID NO: 385398 - RNA, 64 nt, Homo Sapiens
aaaaagugcauugauagggauaagguuuccagugugucaccaacgcaucagacaacuugauucc

SEQ ID NO: 385399 - RNA, 64 nt, Homo Sapiens
uuuuuauuaauguaaaaaaagguuuuauaauguuugucaccagaguaaagacuguccagcauuu

SEQ ID NO: 385400 - RNA, 64 nt, Homo Sapiens
cggaauagugaauguggaguaccgcaguguccccugucaccacacaaggagacccgggggagga

SEQ ID NO: 385401 - RNA, 64 nt, Homo Sapiens
guguugugguggacagggaauacuagugcagcgaugucaccagggggauuucauuucugcuuuu

SEQ ID NO: 385402 - RNA, 64 nt, Homo Sapiens
aaauccaacacacauuucuuucagggaaaaacaaugucaccaaauuuucagaguucuaaacucc

SEQ ID NO: 385403 - RNA, 64 nt, Homo Sapiens
cuggcuguggcuggaaucugccuuuuaucacagcugucaccauucucacgugauucuugugaga

SEQ ID NO: 385404 - RNA, 64 nt, Homo Sapiens
uguuugugccauuuuuagugccauuucucacuugugucaccagccaguguucacaucuuguucc

SEQ ID NO: 385405 - RNA, 64 nt, Homo Sapiens
uuuuuauaauagcagaguggauacaauuucuugcugucaccaauaaaaauuccacauaucagug

SEQ ID NO: 385406 - RNA, 64 nt, Homo Sapiens
uucccagcucucccucuggcauuugucuuuguaaugucaccaccuugccucaucuauaacaugc

SEQ ID NO: 385407 - RNA, 64 nt, Homo Sapiens
cucacaguuccucgcccuggaugacagcugucccugucaccaagaaacagccucacagaagaau

SEQ ID NO: 385408 - RNA, 64 nt, Homo Sapiens
ucuuggcacaugcacagcaggcuccccauagcuuugucaccacaaagggcacuguucuauucac

SEQ ID NO: 385409 - RNA, 64 nt, Homo Sapiens
cgugcuggggugguuuggggagagggcugagauuugucaccagugagcccuuggcacggucucu

SEQ ID NO: 385410 - RNA, 64 nt, Homo Sapiens
gugcccaacucuggcacgggcaagccaauguucuugucaccaaagcacaguugugaguguuaaa

SEQ ID NO: 385411 - RNA, 64 nt, Homo Sapiens
ggggaucagugcggguggggaggggaaggauuuaugucaccaguaagcuuucacucgcgagugg

SEQ ID NO: 385412 - RNA, 64 nt, Homo Sapiens
ccugugugcaggacuguccacacgguucacaccuugucaccaucaggccuuucuggcuccugau

SEQ ID NO: 385413 - RNA, 64 nt, Homo Sapiens
cucagugacauguagaugacugacugccaauacuugucaccauucccuggaagcagcuaccuag

SEQ ID NO: 385414 - RNA, 62 nt, Homo Sapiens
gguaauaaaccuucauccuccaccaacaggaugaugucaccagagauguaucaccaccuugu

SEQ ID NO: 385415 - RNA, 64 nt, Homo Sapiens
aggaugaugucaccagguaaauguaucaccaccuugucaccaacugagggaagucccauuagag

SEQ ID NO: 385416 - RNA, 64 nt, Homo Sapiens
agcuuucccagcuucucuguugaucccagcugugugucaccagcgggucccaccagcccagggc

SEQ ID NO: 385417 - RNA, 64 nt, Homo Sapiens
agcuuucccggcuucucuguugaucccagcugugugucaccagagugucgcaccagcccugggc

SEQ ID NO: 385418 - RNA, 64 nt, Homo Sapiens
gcaaccaguccugcugcuacgccuugggucccacugucaccaagacuaguuaugcagagcaguu

SEQ ID NO: 385419 - RNA, 64 nt, Homo Sapiens
cagaccaucuucccaggccugucccuuucccaacugucaccaaaaacccacccuguccucugac

SEQ ID NO: 385420 - RNA, 64 nt, Homo Sapiens
uuugcagcagaaggucacuaucuuugcaccaaacugucaccauccaucuacccaacugucacca

SEQ ID NO: 385421 - RNA, 64 nt, Homo Sapiens
uuugcaccaaacugucaccauccaucuacccaacugucaccaucgguccccagcucuaauucca

SEQ ID NO: 385422 - RNA, 64 nt, Homo Sapiens
cauguccauacaccaugucacuuuacucuucauuugucaccaucuuuucccaugcacgcauacu

SEQ ID NO: 385423 - RNA, 64 nt, Homo Sapiens
auauuugaauagagcagauuguagaaugucgugcugucaccagaaagcugcuguuuuggguucu

SEQ ID NO: 385424 - RNA, 64 nt, Homo Sapiens
uuuaauuugauguuuaccuaagccuuuaaggcugugucaccaagguauggccacaaggaagaau

SEQ ID NO: 385425 - RNA, 64 nt, Homo Sapiens
uaauuccaauaauuagggaaaauugauaaauaucugucaccaaaccacaagaaauccaaaauca

SEQ ID NO: 385426 - RNA, 64 nt, Homo Sapiens
auugccccgugcaaagcaggggcauuggggacugucuugagacccugagggggucaagccccuc

SEQ ID NO: 385427 - RNA, 64 nt, Homo Sapiens
uaucuucucagugagcauagguuggggacugugaucuugagaagccaugggccagcaauaccug

SEQ ID NO: 385428 - RNA, 64 nt, Homo Sapiens
uacauuugaacuucuuuauaguuuaaauauaacgucuugagauggcacauuccuacgauugaag

SEQ ID NO: 385429 - RNA, 64 nt, Homo Sapiens
uugagauggcacauuccuacgauugaagaaggggucuugagauccccuaaacuugcauacccag

SEQ ID NO: 385430 - RNA, 64 nt, Homo Sapiens
cugauucuuuuccaaacaguuuaagaaaaauagaucuugagauuggguuucagagcuuucccau

SEQ ID NO: 385431 - RNA, 64 nt, Homo Sapiens
cucagguguucuauaaacagauugaauaguaauuucuugagaacauguaagcaaaaacagaacc

SEQ ID NO: 385432 - RNA, 64 nt, Homo Sapiens
gaacucauucccuguuccacaucucugaaacuugucuugagauuguguugugaagggguagaag

SEQ ID NO: 385433 - RNA, 64 nt, Homo Sapiens
cauuguccugcuaacccacauacucuguugccuuucuugagauggucaacuccuguacuucccu

SEQ ID NO: 385434 - RNA, 64 nt, Homo Sapiens
ugggggaggcaggcaauggaauauaauggaauauucuugagacugaucacaaaaaaaaaaaccu

SEQ ID NO: 385435 - RNA, 64 nt, Homo Sapiens
uuuuuaagagcccuuagaacguggguauuuuuuuucuugagaaaagcuaaugcaccuacagaug

SEQ ID NO: 385436 - RNA, 64 nt, Homo Sapiens
agccucuuauacuuaauaagcacuuucuaaaaagucuugagaucccaccauucugaggaauuca

SEQ ID NO: 385437 - RNA, 64 nt, Homo Sapiens
uggcaaauucuccuuggugauucuuuggggcuugucuugagacgcuagccucaggaacugaaac

SEQ ID NO: 385438 - RNA, 64 nt, Homo Sapiens
auuacagguagacuugguuuucugcugaaagaugucuugagaguaaaaagagccaguucuuuuc

SEQ ID NO: 385439 - RNA, 64 nt, Homo Sapiens
ucauuucucacguccuaagaauuuuguccugcccucuugagaggaaugcagaccacacuuuucc

SEQ ID NO: 385440 - RNA, 64 nt, Homo Sapiens
gcucacagcuguggucuuaaucauaccuauggcuucuugagaagggcacccuccugcccccgau

SEQ ID NO: 385441 - RNA, 64 nt, Homo Sapiens
uucauuuguuuacagggucgggaaugucuucaguucuugagagucaacaguaaugauugguugu

SEQ ID NO: 385442 - RNA, 64 nt, Homo Sapiens
gaguuuuucccuaugaaggcuccuuuugaaugugucuugagacccaaauugagcauguugcugu

SEQ ID NO: 385443 - RNA, 64 nt, Homo Sapiens; identical to SEQ ID NO: 243529

SEQ ID NO: 385444 - RNA, 64 nt, Homo Sapiens; identical to SEQ ID NO: 243530

SEQ ID NO: 385445 - RNA, 64 nt, Homo Sapiens; identical to SEQ ID NO: 243531

SEQ ID NO: 385446 - RNA, 64 nt, Homo Sapiens; identical to SEQ ID NO: 243532

SEQ ID NO: 385447 - RNA, 64 nt, Homo Sapiens; identical to SEQ ID NO: 243533

SEQ ID NO: 385448 - RNA, 64 nt, Homo Sapiens; identical to SEQ ID NO: 243534

SEQ ID NO: 385449 - RNA, 64 nt, Homo Sapiens; identical to SEQ ID NO: 243535

SEQ ID NO: 385450 - RNA, 64 nt, Homo Sapiens; identical to SEQ ID NO: 243536

SEQ ID NO: 385451 - RNA, 64 nt, Homo Sapiens; identical to SEQ ID NO: 53673

SEQ ID NO: 385452 - RNA, 64 nt, Homo Sapiens; identical to SEQ ID NO: 53674

SEQ ID NO: 385453 - RNA, 64 nt, Homo Sapiens; identical to SEQ ID NO: 53675

SEQ ID NO: 385454 - RNA, 64 nt, Homo Sapiens; identical to SEQ ID NO: 53676

SEQ ID NO: 385455 - RNA, 64 nt, Homo Sapiens; identical to SEQ ID NO: 53677

SEQ ID NO: 385456 - RNA, 64 nt, Homo Sapiens; identical to SEQ ID NO: 53678

SEQ ID NO: 385457 - RNA, 64 nt, Homo Sapiens; identical to SEQ ID NO: 53679

SEQ ID NO: 385458 - RNA, 64 nt, Homo Sapiens; identical to SEQ ID NO: 53680

SEQ ID NO: 385459 - RNA, 64 nt, Homo Sapiens; identical to SEQ ID NO: 53681

SEQ ID NO: 385460 - RNA, 64 nt, Homo Sapiens; identical to SEQ ID NO: 53682

SEQ ID NO: 385461 - RNA, 64 nt, Homo Sapiens; identical to SEQ ID NO: 53683

SEQ ID NO: 385462 - RNA, 64 nt, Homo Sapiens; identical to SEQ ID NO: 53684

SEQ ID NO: 385463 - RNA, 64 nt, Homo Sapiens; identical to SEQ ID NO: 168567

SEQ ID NO: 385464 - RNA, 64 nt, Homo Sapiens; identical to SEQ ID NO: 168568

SEQ ID NO: 385465 - RNA, 64 nt, Homo Sapiens; identical to SEQ ID NO: 168569

SEQ ID NO: 385466 - RNA, 64 nt, Homo Sapiens; identical to SEQ ID NO: 168570

SEQ ID NO: 385467 - RNA, 64 nt, Homo Sapiens; identical to SEQ ID NO: 168571

SEQ ID NO: 385468 - RNA, 64 nt, Homo Sapiens; identical to SEQ ID NO: 168572

SEQ ID NO: 385469 - RNA, 64 nt, Homo Sapiens; identical to SEQ ID NO: 168573

SEQ ID NO: 385470 - RNA, 64 nt, Homo Sapiens; identical to SEQ ID NO: 168574

SEQ ID NO: 385471 - RNA, 64 nt, Homo Sapiens; identical to SEQ ID NO: 168575

SEQ ID NO: 385472 - RNA, 64 nt, Homo Sapiens; identical to SEQ ID NO: 168576

SEQ ID NO: 385473 - RNA, 64 nt, Homo Sapiens; identical to SEQ ID NO: 168577

SEQ ID NO: 385474 - RNA, 64 nt, Homo Sapiens; identical to SEQ ID NO: 168578

SEQ ID NO: 385475 - RNA, 64 nt, Homo Sapiens; identical to SEQ ID NO: 168579

SEQ ID NO: 385476 - RNA, 64 nt, Homo Sapiens; identical to SEQ ID NO: 168580

SEQ ID NO: 385477 - RNA, 64 nt, Homo Sapiens; identical to SEQ ID NO: 168581

SEQ ID NO: 385478 - RNA, 64 nt, Homo Sapiens; identical to SEQ ID NO: 168582

SEQ ID NO: 385479 - RNA, 64 nt, Homo Sapiens; identical to SEQ ID NO: 168583

SEQ ID NO: 385480 - RNA, 64 nt, Homo Sapiens; identical to SEQ ID NO: 168584

SEQ ID NO: 385481 - RNA, 64 nt, Homo Sapiens; identical to SEQ ID NO: 168585

SEQ ID NO: 385482 - RNA, 64 nt, Homo Sapiens; identical to SEQ ID NO: 168586

SEQ ID NO: 385483 - RNA, 64 nt, Homo Sapiens; identical to SEQ ID NO: 168587

SEQ ID NO: 385484 - RNA, 64 nt, Homo Sapiens; identical to SEQ ID NO: 168588

SEQ ID NO: 385485 - RNA, 64 nt, Homo Sapiens; identical to SEQ ID NO: 168589

SEQ ID NO: 385486 - RNA, 64 nt, Homo Sapiens; identical to SEQ ID NO: 168590

SEQ ID NO: 385487 - RNA, 64 nt, Homo Sapiens; identical to SEQ ID NO: 168591

SEQ ID NO: 385488 - RNA, 64 nt, Homo Sapiens
gaggaaauguuuaauuaaugcuuuuuaguuuaaauaaauugaaucauuuauaauaaucaguguu

SEQ ID NO: 385489 - RNA, 64 nt, Homo Sapiens
gucugucaagaaacagcaguaauuauuacugaguuaaauugaaaaguccaguggaccaggcauu

SEQ ID NO: 385490 - RNA, 64 nt, Homo Sapiens
gaauuaaauccuccagcuuuauuuugggccuugcuaaauugauucauuuucauuaccagguuuc

SEQ ID NO: 385491 - RNA, 64 nt, Homo Sapiens
aguucaugacccaggauaucauggggcugaaggguaaauugagcggaaaguccagucugaaucc

SEQ ID NO: 385492 - RNA, 64 nt, Homo Sapiens
guaaauaacuuuggaaaacaaccacagaaacuguuaaauugaacuguugagcaaggggagugaa

SEQ ID NO: 385493 - RNA, 64 nt, Homo Sapiens
uuuuugguaaggaauucauuagguggaaucuucuuaaauugaaauuacucagucccuuuaccuu

SEQ ID NO: 385494 - RNA, 64 nt, Homo Sapiens
aguauuuuucauuuugguuauuaaguacauuuuuuaaauugaacaaacuuuuucagguucuugu

SEQ ID NO: 385495 - RNA, 64 nt, Homo Sapiens
gaaaaaugauugaauggucaauuauuuuucuguuuaaauugaugaggcuguaauacagugucau

SEQ ID NO: 385496 - RNA, 64 nt, Homo Sapiens
uagaucuugccgugcucuguauuacuuaaagcuauaaauugaacaaauuguccgauuuaugugu

SEQ ID NO: 385497 - RNA, 64 nt, Homo Sapiens
ccaagaaaacuuguuuuuagaggcaaaaugugaguaaauugaaagggagggauuuacuuuuaag

SEQ ID NO: 385498 - RNA, 64 nt, Homo Sapiens
aucuguuuaaaugguaauguagcauuuauuuugcuaaauugaaagggaacauagauggaauucc

SEQ ID NO: 385499 - RNA, 64 nt, Homo Sapiens
ucaauguauuucucugccuugacauuuaaauacauaaauugagauaaguagauuagaaaaucau

SEQ ID NO: 385500 - RNA, 64 nt, Homo Sapiens
uggucuguuaguguuugccaagaaccauugcaaauaaauugaacaucaaagauccaaguuugua

SEQ ID NO: 385501 - RNA, 64 nt, Homo Sapiens
gauaauugaaaaugaaacauguucuuauuuuccuuaaauugaagaaaacccuuuaguugucuac

SEQ ID NO: 385502 - RNA, 64 nt, Homo Sapiens
ggguuuuguuagcccuuuuguacuacuuucuuuuuaaauugagaacaugguucuuuacauauaa

SEQ ID NO: 385503 - RNA, 64 nt, Homo Sapiens
uuugaacagcuucuccaccuuauuuggacagugauaaauugaaccaagaguguagauuuacaag

SEQ ID NO: 385504 - RNA, 64 nt, Homo Sapiens
guacuaggccuacuggggauaagcuaucuucauguaaauugacuacauugccguggcaucuuaa

SEQ ID NO: 385505 - RNA, 64 nt, Homo Sapiens
uuuagguauuacacaagaccggaucaaguauuacuaaauugaccccaucccuccuuaagagauu

SEQ ID NO: 385506 - RNA, 64 nt, Homo Sapiens
uaauguucauaauguuucugcauucaucuguucuuaaauugaaaaacauauaauuuacuucuua

SEQ ID NO: 385507 - RNA, 64 nt, Homo Sapiens
uucuuaaauugaaaaacauauaauuuacuucuuauaaauugaagucuuaaaugugaaaccaaga

SEQ ID NO: 385508 - RNA, 64 nt, Homo Sapiens
acucucucuaucaugggggggcauguuuugacauuaaauugacuuuuaagaaaaacaugucacu

SEQ ID NO: 385509 - RNA, 64 nt, Homo Sapiens
cuagcaaaaacuuugcuaguuuaguacuugucucuaaauugauguucacccauuucaauauugc

SEQ ID NO: 385510 - RNA, 64 nt, Homo Sapiens
caguaauuaauaaccuuccaauauaucuauuaaauaaauugaagagguagaucucaguaggcau

SEQ ID NO: 385511 - RNA, 64 nt, Homo Sapiens
aaucagggcaacagcauuaauuguaaagcauagauaaauugaauccacuugacuaugaagcuuu

SEQ ID NO: 385512 - RNA, 64 nt, Homo Sapiens
agcaauguuauaaaaauauuuuuuuucugaaauuuaaauugacauuuuauaugauuuguacaaa

SEQ ID NO: 385513 - RNA, 64 nt, Homo Sapiens
augggccagauucucaaugaaucauuuaaauguuuaaauugaaaugaccuuugaagcaagcuaa

SEQ ID NO: 385514 - RNA, 64 nt, Homo Sapiens
uuauuuaucuauguccagauuucuguuucuguccuaaauugaucuguguuuuuagguggaucaa

SEQ ID NO: 385515 - RNA, 64 nt, Homo Sapiens
agguggaucaacuuggaucuuuagaccucaucuauaaauugaaauuauauuuuuagucauaagc

SEQ ID NO: 385516 - RNA, 64 nt, Homo Sapiens
acaugacuaugucauuaaaacuauauuugaaauguaaauugauaaagacauuugugcauagcuc

SEQ ID NO: 385517 - RNA, 64 nt, Homo Sapiens
aucgccccaauaacaauguuauuagaaauggaaauaaauugaagugauuuaugccuguugacuc

SEQ ID NO: 385518 - RNA, 64 nt, Homo Sapiens
uuuguaacuuuaucuuaguaauguaaagauucaguaaauugaugagucagguugcagcccucau

SEQ ID NO: 385519 - RNA, 64 nt, Homo Sapiens
gaaaucggggacuucaaagugcuugauuccuuccuaaauugaauuuuaugcaaugucaaauuuc

SEQ ID NO: 385520 - RNA, 64 nt, Homo Sapiens
uaugguucacuguuacucuuauugacaaugucaauaaauugaaaaaauccugucuuguucauaa

SEQ ID NO: 385521 - RNA, 64 nt, Homo Sapiens
augucaauaaauugaaauauuccugucuuguucauaaauugacauuccaugggaaaaaaaaaaa

SEQ ID NO: 385522 - RNA, 64 nt, Homo Sapiens
aaauuuaagcugcaaaaccauguugauguacccuuaaauugaagcuguauuucaauaaauuccu

SEQ ID NO: 385523 - RNA, 64 nt, Homo Sapiens
aacauggaaaauggagggccauagguucuuuggguaaauugaggccuuuaaaaaauggaggagg

SEQ ID NO: 385524 - RNA, 64 nt, Homo Sapiens; identical to SEQ ID NO: 229370

SEQ ID NO: 385525 - RNA, 64 nt, Homo Sapiens; identical to SEQ ID NO: 229371

SEQ ID NO: 385526 - RNA, 64 nt, Homo Sapiens; identical to SEQ ID NO: 229372

SEQ ID NO: 385527 - RNA, 64 nt, Homo Sapiens; identical to SEQ ID NO: 229373

SEQ ID NO: 385528 - RNA, 64 nt, Homo Sapiens; identical to SEQ ID NO: 229374

SEQ ID NO: 385529 - RNA, 64 nt, Homo Sapiens; identical to SEQ ID NO: 229375

SEQ ID NO: 385530 - RNA, 64 nt, Homo Sapiens
gccaucaucccgugugcgcacucugcauccaccuauguaacaaggcaccgcuaagcaagcauug

SEQ ID NO: 385531 - RNA, 64 nt, Homo Sapiens
aaucaaguacacuaaauuagaauauuuuuaaaguauguaacauucccaguuucagccacaauuu

SEQ ID NO: 385532 - RNA, 64 nt, Homo Sapiens
cagaaauaacguuaugcaucuagauggaagcugcauguaacaaaucauuauuaucuauuuuuaa

SEQ ID NO: 385533 - RNA, 64 nt, Homo Sapiens
aaaaaaagaauaauaauuugaacagugaauguugauguaacaucuuaauaauagagcaccagaa

SEQ ID NO: 385534 - RNA, 64 nt, Homo Sapiens
uccucucacagauagaggucuuaaagguuggaucauguaacauugcuuaguagaagaaucuucu

SEQ ID NO: 385535 - RNA, 64 nt, Homo Sapiens
ccaaaaagggcauuucaacaaugggaauuauuuaauguaacagugggcacagauuacuuaucuu

SEQ ID NO: 385536 - RNA, 64 nt, Homo Sapiens
auaauuacauuccuaacuagguggauuauaaaaaauguaacaucgugauuuccuaaacauaauu

SEQ ID NO: 385537 - RNA, 64 nt, Homo Sapiens
ggugaaggauccaggaauauuuguuuuuuuccucauguaacauuguuuuucauuuguuuugcuu

SEQ ID NO: 385538 - RNA, 64 nt, Homo Sapiens
uagaaaagaaaacauuuaacauaaugguugugaaauguaacaugaagcaaacuaacuuuuuuuu

SEQ ID NO: 385539 - RNA, 64 nt, Homo Sapiens
gcugcuauauauuuuaagccuucauuugcaauucauguaacaguugugucauaaauuacacaau

SEQ ID NO: 385540 - RNA, 64 nt, Homo Sapiens
aacucaguuguaugaaucugaucuacuacuuuaaauguaacaucuacuccauauacaaccccaa

SEQ ID NO: 385541 - RNA, 64 nt, Homo Sapiens
cuucccugaguagaaaguaauauacagucauuagauguaacaucacuaauuuacaaaaucacuc

SEQ ID NO: 385542 - RNA, 64 nt, Homo Sapiens
aucuuccaaauauggaguccuuucauaaaugggaauguaacaauuuauagaugcuuaucuaggu

SEQ ID NO: 385543 - RNA, 64 nt, Homo Sapiens
auagccaaaagcauaggauuuuaacucaaaauucauguaacaagaaacucauaaacucaguauu

SEQ ID NO: 385544 - RNA, 64 nt, Homo Sapiens
aggcaagaugccuagaucuucuguuaucuuugacauguaacauccuuuuuagaggcucagaaca

SEQ ID NO: 385545 - RNA, 64 nt, Homo Sapiens
cuaaaggaagaacuguguagcaccauugaucacaauguaacauuuccaugcugcauuaagggug

SEQ ID NO: 385546 - RNA, 64 nt, Homo Sapiens
acacuguaaugcagacaggugcuuuucaucauucauguaacauucucacacaguugaggauauu

SEQ ID NO: 385547 - RNA, 64 nt, Homo Sapiens
uuaacaagagugucuuugcuggguggugauugggauguaacagaucaguucuacuggacuugua

SEQ ID NO: 385548 - RNA, 64 nt, Homo Sapiens
ggagggggcaaaggggacuuuuuacagugauggaauguaacauuauauacauguguauauaaga

SEQ ID NO: 385549 - RNA, 64 nt, Homo Sapiens
uucauuuuaguuauaauaaauuuaauauuuguaaauguaacauaguuucagugugauuucuaga

SEQ ID NO: 385550 - RNA, 64 nt, Homo Sapiens
accuuaaugcuaaugagguccacuaaaaaggggaggaaggcagaccuccugggagacccacgaa

SEQ ID NO: 385551 - RNA, 64 nt, Homo Sapiens
cucuaacaguccagauguacacccagccucagggggaaggcagcucucuccagacagagucuca

SEQ ID NO: 385552 - RNA, 64 nt, Homo Sapiens
gggcgguaccugcagaugaaaagaagcgcuuugaggaaggcaaaagcccgagaccgaggacgag

SEQ ID NO: 385553 - RNA, 64 nt, Homo Sapiens
ucgcugccugugccccagcugugucgcugagccaggaaggcaggccagugccuucuucaccuac

SEQ ID NO: 385554 - RNA, 64 nt, Homo Sapiens
ugcucuuagugcccgccuaguuaagguggguccaggaaggcagcgggaguugagucacaagagg

SEQ ID NO: 385555 - RNA, 64 nt, Homo Sapiens
gcagagggaauguucccugccuguggccagagcuggaaggcaggcagcuacucuguccaggcca

SEQ ID NO: 385556 - RNA, 64 nt, Homo Sapiens
aucagauccuggaggacuuucgcacuggucagucggaaggcaagcaagagaagcagaagucgcu

SEQ ID NO: 385557 - RNA, 64 nt, Homo Sapiens
ggguggcugggauuuaaggacacacccagcuucuggaaggcaugucucauuucccauauuccuu

SEQ ID NO: 385558 - RNA, 64 nt, Homo Sapiens
cucccuuacccccggugccgcauguggggaccacggaaggcacagguccuaugccagccucacc

SEQ ID NO: 385559 - RNA, 64 nt, Homo Sapiens
acacaggacacagcagcuuuggaagccacgccugggaaggcaggugagggagaaucagggcucg

SEQ ID NO: 385560 - RNA, 64 nt, Homo Sapiens
cugucuagacuggaccucccagccccuuguguugggaaggcaaagcuuuuguggagucaggggg

SEQ ID NO: 385561 - RNA, 64 nt, Homo Sapiens
gucccauuuuugucaucagcaccaguguccgucaggaaggcaggugguggugcagaaacaugau

SEQ ID NO: 385562 - RNA, 64 nt, Homo Sapiens
cauggagacacaggcagacagauaagcuucauggggaaggcauggggcauccucugucuuggga

SEQ ID NO: 385563 - RNA, 64 nt, Homo Sapiens
ccugcuugguaguggugugggggugcaguguggaggaaggcacgugaguccucacuccuggccu

SEQ ID NO: 385564 - RNA, 64 nt, Homo Sapiens
ggcaggcagggauacaaggcagucuggaaagaagggaaggcaggaguuucagucuugggcucuu

SEQ ID NO: 385565 - RNA, 64 nt, Homo Sapiens
ucccgcauaccaggauaaccuccccagccuuauuggaaggcagcacccagacucaggcuugggu

SEQ ID NO: 385566 - RNA, 64 nt, Homo Sapiens
gcugucuguccauccguccggaccgaggaaggaaggaaggcaaggaucccaggagaaaggagug

SEQ ID NO: 385567 - RNA, 64 nt, Homo Sapiens
ccauuugcaggggcuaaaggucuagaugagacuuggaaggcaaggagcaucgaaauuugagaua

SEQ ID NO: 385568 - RNA, 64 nt, Homo Sapiens
acgacuuaaugaaugauacaucagucagauuuuaggaaggcagucaauuauggauauuuuaaug

SEQ ID NO: 385569 - RNA, 64 nt, Homo Sapiens
gcuguccaccuugggcaccacaggaagagcagcaggaaggcacccggcucagugacagcaagag

SEQ ID NO: 385570 - RNA, 64 nt, Homo Sapiens
cccagaugagccucuauuuuguggagccagagaaggaaggcaguaagcucugaagaagucaagg

SEQ ID NO: 385571 - RNA, 64 nt, Homo Sapiens
auaaauccuugggagucauugaggcccagccgcaggaaggcagaguagaauaaaugaagaaagg

SEQ ID NO: 385572 - RNA, 64 nt, Homo Sapiens
auuccaugaccagaaacagguucaugccagguuaggaaggcagcgcaaauauuagcaaagaagc

SEQ ID NO: 385573 - RNA, 64 nt, Homo Sapiens
aggaugauggggacgggguccaggagggccacugggaaggcacuauccagaaauaguggacaga

SEQ ID NO: 385574 - RNA, 64 nt, Homo Sapiens
ggcauguggaaaccuuggaucucggucacagggaggaaggcagcuagaaaugggagggaagcuu

SEQ ID NO: 385575 - RNA, 64 nt, Homo Sapiens
uuuucagaaaauaacagacaucacuuccucacauggaaggcagcagugugaaaugaaaaauuag

SEQ ID NO: 385576 - RNA, 64 nt, Homo Sapiens
cagaugggauuuguuagaagaaugcauccugaugggaaggcaugaggaaaacauaaugauguau

SEQ ID NO: 385577 - RNA, 64 nt, Homo Sapiens
cuuuauucuccgcacauggaggcugcccuaccugggaaggcaccccagcaccugugaaggacau

SEQ ID NO: 385578 - RNA, 64 nt, Homo Sapiens
aggucuucuugcugaccucgucuacaaaggcaaaggaaggcaaaggaagcugucucggguguuu

SEQ ID NO: 385579 - RNA, 64 nt, Homo Sapiens
caaauuuaauaacuuuaugggggguuuggcaaugggaaggcaaagacaccuagauuuagcuaau

SEQ ID NO: 385580 - RNA, 64 nt, Homo Sapiens
aagcuucuguguaagccaggguuaucuucugcuaggaaggcagauuguuucuacacauaauuua

SEQ ID NO: 385581 - RNA, 64 nt, Homo Sapiens
agggauggguuuugggacagcuccaugggcauggggaaggcacugaaacagaggacuauaaaac

SEQ ID NO: 385582 - RNA, 64 nt, Homo Sapiens
cccaguccugcuaguggcaaguuucuuugaaucaggaaggcaggugagguaagggccaaaucac

SEQ ID NO: 385583 - RNA, 64 nt, Homo Sapiens
ugaguguacguuuucuuccaaucugcugcaggcaggaaggcaugcuugucccaccacucccgcc

SEQ ID NO: 385584 - RNA, 64 nt, Homo Sapiens
gggauuuaugaauggggcuuuuacacuuuaaaugggaaggcauaagucuaccugagggguuuug

SEQ ID NO: 385585 - RNA, 64 nt, Homo Sapiens
ggcuguaggaggaggcagggauuccagggugucaggaaggcaggggugccaggucccaccuagu

SEQ ID NO: 385586 - RNA, 64 nt, Homo Sapiens
ggcucuaggaggaggcagggacuccagggugucaggaaggcaggggugccgggucccacccagu

SEQ ID NO: 385587 - RNA, 64 nt, Homo Sapiens
cugauggggcacacccuuggucugugaccugcugggaaggcagggccagccagaguggggaugg

SEQ ID NO: 385588 - RNA, 64 nt, Homo Sapiens
gcgcagugguugaaacaucaugggcgucgagacaggaaggcaggccaccuuggaguuggaaccc

SEQ ID NO: 385589 - RNA, 64 nt, Homo Sapiens
cauuuauugcugggagaauauugcauacauuuaaguaauuaaggaacuguaaagauaguagucu

SEQ ID NO: 385590 - RNA, 64 nt, Homo Sapiens
uuuaauuuuuauuucuguauaaagccuaaugucuguaauuaaccucuuuaauuuugccuucaca

SEQ ID NO: 385591 - RNA, 64 nt, Homo Sapiens
aucaucugaugauuauucuuuauuaugccucuagguaauuaaguaaaggugaaauugcauacac

SEQ ID NO: 385592 - RNA, 64 nt, Homo Sapiens
gacuauuucuuuuucuggguaacuauugaaguuuguaauuaaaugggggcucuuacugacuuua

SEQ ID NO: 385593 - RNA, 64 nt, Homo Sapiens
ugggacaguuagauuuauaauuugaagcuauucuguaauuaaaauauaaccugaauucagcuug

SEQ ID NO: 385594 - RNA, 64 nt, Homo Sapiens
guucuaauuguaagucagauuguauauucaaauuguaauuaagagauuuaaauauuagaacggu

SEQ ID NO: 385595 - RNA, 64 nt, Homo Sapiens
auguuuauaugaaauaacuuauugauauaacgcuguaauuaaaaagauuucaacuguguaagcc

SEQ ID NO: 385596 - RNA, 64 nt, Homo Sapiens
gcuuguuuuaagugauuauauaacucauguuuagguaauuaacuacuccauuuaagagcaaagg

SEQ ID NO: 385597 - RNA, 64 nt, Homo Sapiens
uuuaauuuuuuuguguacuuauguauccuauuguguaauuaauucaaaaagcugcacauauuua

SEQ ID NO: 385598 - RNA, 64 nt, Homo Sapiens
gcagaaaagcuggagaguugaggccacaucuaugguaauuaaugggaauagaauaucaggaaaa

SEQ ID NO: 385599 - RNA, 64 nt, Homo Sapiens
gccuuuuguuaacuaauuuucuuuuuuccuuuuaguaauuaagcacgaucaugucccuuuuuaa

SEQ ID NO: 385600 - RNA, 64 nt, Homo Sapiens
auuuuguauaugggaagaaauaugacaauccuagguaauuaaaccauagacccaaagcccuuac

SEQ ID NO: 385601 - RNA, 64 nt, Homo Sapiens
gaguucaagagaucuguuguacagcuuggugacuguaauuaacaacaauguauuuugaaaguca

SEQ ID NO: 385602 - RNA, 64 nt, Homo Sapiens
auugaagaaccauaccuuuuaaaguuauuauuuuguaauuaaguaugucaacaguaaaaaauaa

SEQ ID NO: 385603 - RNA, 64 nt, Homo Sapiens
uuuaauccauaaaaauacauauucaguauuuaauguaauuaaucauuuuagcacucauuccaaa

SEQ ID NO: 385604 - RNA, 64 nt, Homo Sapiens
agggacugaaccacugcccugccagcaaagguuuguaauuaagaucagagugauccugcugacu

SEQ ID NO: 385605 - RNA, 64 nt, Homo Sapiens
acaucauggaggagagaaacuuacuuguaacagcguaauuaaaccacaugcuaaaaaauuaguc

SEQ ID NO: 385606 - RNA, 64 nt, Homo Sapiens
augcugucacaacauuuaggacuaauguaccucaguaauuaaauauaccuauaaaaagauguaa

SEQ ID NO: 385607 - RNA, 64 nt, Homo Sapiens
gcuaaggagacagaaagacaaauggcacuauguaguaauuaagauugcagauauauauuuuuua

SEQ ID NO: 385608 - RNA, 64 nt, Homo Sapiens
ugauuauuggcauguuuuuguacccaacugcguuguaauuaacaucgcagugaagcucaagugg

SEQ ID NO: 385609 - RNA, 64 nt, Homo Sapiens
augcuugggaaauagucauaauuacccacauauaguaauuaauagaugguaauuaauugauccu

SEQ ID NO: 385610 - RNA, 64 nt, Homo Sapiens
gucauaauuacccacauauaguaauuaauagaugguaauuaauugauccuugaugugauguucu

SEQ ID NO: 385611 - RNA, 64 nt, Homo Sapiens
cccuauauguggcauuccuuucuuuaaacuauagguaauuaaggcagcugaaaaguaaauugcc

SEQ ID NO: 385612 - RNA, 64 nt, Homo Sapiens
caguugugaaagcaccaucaucauagaggaugauguaauuaaaaaauggucagugugcaaagaa

SEQ ID NO: 385613 - RNA, 64 nt, Homo Sapiens
guacaagauccacugaggguggccaccacagccuuggcuccaugguggcggguagacaagggau

SEQ ID NO: 385614 - RNA, 64 nt, Homo Sapiens
ucacucagguagaguugagauucaaacccacauguggcuccaaagucugcaucuggauuugggg

SEQ ID NO: 385615 - RNA, 64 nt, Homo Sapiens
cacacauauuaaugacagccuguuguauuaaugauggcuccaggucagugucuggaguuucauu

SEQ ID NO: 385616 - RNA, 64 nt, Homo Sapiens
aauuggucagacaugcugucugcccucaugaaauuggcuccaaaugaaugaacuacuuucauga

SEQ ID NO: 385617 - RNA, 64 nt, Homo Sapiens
aucagucuggguauugauuuccuuuuccagugacuggcuccaggccaugucuaaugaccagcuc

SEQ ID NO: 385618 - RNA, 64 nt, Homo Sapiens
cccugacccuagccagggacucccaugcugcuguuggcuccaucucuccacacugccucuuucu

SEQ ID NO: 385619 - RNA, 64 nt, Homo Sapiens
gcugguuuuagaacaagaaucacucuucaacagcuggcuccaguagauaacuguauuuauaaac

SEQ ID NO: 385620 - RNA, 64 nt, Homo Sapiens
gugccaugcccagccaaaacccucuggccuaggcuggcuccaguuugcuaccugaacgcaccac

SEQ ID NO: 385621 - RNA, 64 nt, Homo Sapiens
ggggagggaccagcccgggcugcaccagugggaguggcuccacccuucccaccucagagccaug

SEQ ID NO: 385622 - RNA, 64 nt, Homo Sapiens
ccuuuuucuguuucuuaacucaacagcuaaaaaauggcuccagguagugagucaaugaaguuca

SEQ ID NO: 385623 - RNA, 64 nt, Homo Sapiens
ccucucuggaaaaucgaagucccugccccaauccuggcuccaacuucucggugacaugucaccu

SEQ ID NO: 385624 - RNA, 64 nt, Homo Sapiens
cuugucacucauguccagaucucuggugaccuguuggcuccacucacucccugggcaccaugcc

SEQ ID NO: 385625 - RNA, 64 nt, Homo Sapiens
cccugggugcgcugaggccuggaggcgucuacacuggcuccacauccacuucccccgcagcucg

SEQ ID NO: 385626 - RNA, 64 nt, Homo Sapiens
cuggaacccgggugcuggggucaugcugccuccguggcuccaaggugagggucaucuucacgag

SEQ ID NO: 385627 - RNA, 64 nt, Homo Sapiens
acaguggcugccacucacuucccaacucugguccuggcuccacaacacaugauuaggccucaga

SEQ ID NO: 385628 - RNA, 64 nt, Homo Sapiens
aagugccuguggucaggccccugcuuugcgucuguggcuccaagagaacaauccccgagggcug

SEQ ID NO: 385629 - RNA, 64 nt, Homo Sapiens
gcucaagcuuagaagccagcccuugacucuuuccuggcuccagagaagaucugggcaauuuugg

SEQ ID NO: 385630 - RNA, 64 nt, Homo Sapiens
ugcucacauuucucccucccagcuaauguaguauuggcuccaccugccuucacacccccuagag

SEQ ID NO: 385631 - RNA, 64 nt, Homo Sapiens
gcucuguguguggaggacaaagcuucuuccugcguggcuccaggaaaagauguggcucacguag

SEQ ID NO: 385632 - RNA, 64 nt, Homo Sapiens
gaaacugaggccagagggaggagagaauugcucauggcuccagaacugguggcaaguuucucug

SEQ ID NO: 385633 - RNA, 64 nt, Homo Sapiens
uaacagucccugggacugagcagcugcauagacauggcuccaggugugcaguguggcuucugac

SEQ ID NO: 385634 - RNA, 64 nt, Homo Sapiens
gcccauucuuuuaaucagagugaaccaggcauccuggcuccagauaaguagcagugcugguauu

SEQ ID NO: 385635 - RNA, 64 nt, Homo Sapiens
uuccugggggcguggccaaguucucccucccaauuggcuccagccaccguccgcuuuuccugag

SEQ ID NO: 385636 - RNA, 64 nt, Homo Sapiens
cccuagucgcuggacagcucugcucgcacggcauuggcuccaucccgccuagcgacaagggauu

SEQ ID NO: 385637 - RNA, 63 nt, Homo Sapiens
accuucccaaaccuaauucuuguagaugcauuaguguugaaccaaugcuuucucaugucucaa

SEQ ID NO: 385638 - RNA, 63 nt, Homo Sapiens
cacgcugugagaucaccgcaaaccuaccuuacuguguugaaacgggacaaaugcaauagaacg

SEQ ID NO: 385639 - RNA, 63 nt, Homo Sapiens
agauggaaagaggugaaaaugaagaaggaagcuguguugaaacagaaaaauaagucaaaagga

SEQ ID NO: 385640 - RNA, 63 nt, Homo Sapiens
ggagaaaauguguaauucaaagaagauacugauguguugaaaaaauggaauuuuugguacugu

SEQ ID NO: 385641 - RNA, 63 nt, Homo Sapiens
cuugaauggagaccucccuaccaagugaugaaaguguugaaaaacuuaauaacaaaugcuugu

SEQ ID NO: 385642 - RNA, 63 nt, Homo Sapiens
aaaaaugaugugugaaauagaaugagugcuaugguguugaaaacugcaguguccguuaugagu

SEQ ID NO: 385643 - RNA, 63 nt, Homo Sapiens
aagaggcgggguuucaccauguuggccaggcugguguugaacuccugaccucaagugaucugc

SEQ ID NO: 385644 - RNA, 63 nt, Homo Sapiens
gggagagccggccacgcccuuggcuuuagagcuguguugaaauccauuuuggugguugguuuu

SEQ ID NO: 385645 - RNA, 63 nt, Homo Sapiens
cuugggaugaaaaaggauauugcagcuucagcaguguugaacuguguguuuaaaaaugugaau

SEQ ID NO: 385646 - RNA, 63 nt, Homo Sapiens
cuguuccagagagagguggggaugcccucacuaguguugaagccccaccagaacagggguuuu

SEQ ID NO: 385647 - RNA, 63 nt, Homo Sapiens
caaguuuaauuaccauggagcuguuaccauaugguguugaaugaucuuauccuuugccaucuu

SEQ ID NO: 385648 - RNA, 63 nt, Homo Sapiens
ugcugaagcagguggaugcuggcuuugcaccugguguugaaccgcuguugggcacaccuggau

SEQ ID NO: 385649 - RNA, 63 nt, Homo Sapiens
aaugagggcagaaguucagacacaaaucuuaauguguugaaagguucuccuacauucauccgc

SEQ ID NO: 385650 - RNA, 63 nt, Homo Sapiens
agaaccucauacauuuauuaauaaaggggaaugguguugaaauggcauacaaauagaaaguua

SEQ ID NO: 385651 - RNA, 63 nt, Homo Sapiens
uuaaaaagacaagaccacuuaauuguucaagaaguguugaacuugguccuacagccaggagcu

SEQ ID NO: 385652 - RNA, 63 nt, Homo Sapiens
aaaaguuucagagaaguucuauuaacuuagcauguguugaaaacaaaacucuccuacacuucc

SEQ ID NO: 385653 - RNA, 63 nt, Homo Sapiens
aaugugccuaugaagccacagcuagauaaauguguguugaaugugcugugaaccuuggcagau

SEQ ID NO: 385654 - RNA, 62 nt, Homo Sapiens
aauuuauuuuucucugacuuaaauaaaaugucaguguugaauaaaaaugauaaaacuucaga

SEQ ID NO: 385655 - RNA, 63 nt, Homo Sapiens
uagguuuacuucuugucucucauuuagcaugguguguugaaauagugcucacucauauccugg

SEQ ID NO: 385656 - RNA, 63 nt, Homo Sapiens
aagguagaggguggggcuucacccaagguuaggguguugaaggugauaauuccaaaugcuguu

SEQ ID NO: 385657 - RNA, 63 nt, Homo Sapiens
cuugguuccaugagccaugcuucaaaugcuguaguguugaauaccaaccuuuaaagacugaua

SEQ ID NO: 385658 - RNA, 63 nt, Homo Sapiens
augcuauauuucccaucaucaaaaaaaaaaccaguguugaaucuaaacugacaaaaaaaaaaa

SEQ ID NO: 385659 - RNA, 58 nt, Homo Sapiens
cuuuggauuucauugcaugagaauugaaguguugaaggaugauuuuuuuuccccucau

SEQ ID NO: 385660 - RNA, 63 nt, Homo Sapiens
gauccuggaaugugguaggugcucaguaaauguguguugaauaaaugaaugaaugaaugaaca

SEQ ID NO: 385661 - RNA, 63 nt, Homo Sapiens
uuuuuuuauggcauuuuuuuaaagaugcccuaaguguugaagaagaguuugcaaaugcaacaa

SEQ ID NO: 385662 - RNA, 63 nt, Homo Sapiens
ucuggaauucagaagagagcuauugaguuugcuguguugaagcuauuaaacauggaucuauaa

SEQ ID NO: 385663 - RNA, 63 nt, Homo Sapiens
guggagaugaggucucaguauguucccaggcuaguguugaacuccugagcucaagaaauccuc

SEQ ID NO: 385664 - RNA, 63 nt, Homo Sapiens
uucauuuccacuugugccaucuucuuugcugaaguguugaauaaggcccacgugaagaguuug

SEQ ID NO: 385665 - RNA, 63 nt, Homo Sapiens
uacaguuuuaugaaagcauauuuuauuuacuugguguugaaauagcccucauaaaaccuaagc

SEQ ID NO: 385666 - RNA, 63 nt, Homo Sapiens
uggggcugcuuuugucacacuagcauagagaauguguugaaauuuaacuuuguaagcuuguau

SEQ ID NO: 385667 - RNA, 63 nt, Homo Sapiens
ccucaccauuuguucaugcuucaguuaauucagguguugaaggagcuuagguuuuagaggcac

SEQ ID NO: 385668 - RNA, 63 nt, Homo Sapiens
ccuguggugccaucuccccaaguguggcaggguguguugaaggggcggggacucccaggccuc

SEQ ID NO: 385669 - RNA, 63 nt, Homo Sapiens
acuaaaccauaaaaguuuaaggaagugaagcuaguguugaaccguucuuuauauaagccucug

SEQ ID NO: 385670 - RNA, 63 nt, Homo Sapiens
aauacaacaggauuuaaguuaguaucauugcuuguguugaaagcuuuugagcagacucugaga

SEQ ID NO: 385671 - RNA, 63 nt, Homo Sapiens
gugguuuaaaccugagacuacuacuguuuugugguguugaaaauguuuuuguuuuccugcuug

SEQ ID NO: 385672 - RNA, 63 nt, Homo Sapiens
uucacaguuuuaaguuugauuuggguaagaauaguguugaaaaggaaaugaaaccugaaaagg

SEQ ID NO: 385673 - RNA, 63 nt, Homo Sapiens
ugugcuccccuuaaaucgugcuucguuuuugaaguguugaagccuuucuuucccaugauagug

SEQ ID NO: 385674 - RNA, 63 nt, Homo Sapiens
caguugaauucacuaaauuaaaaugagcugcuuguguugaaauaauacuuuacaccuuugaca

SEQ ID NO: 385675 - RNA, 63 nt, Homo Sapiens
guuuuuguaagccuuggcaugcuuuagucuuauguguugaaauaaaccacaacgcuguuucaa

SEQ ID NO: 385676 - RNA, 63 nt, Homo Sapiens
uggaaaggacuuuguguuaugcaaaaaagaacaguguugaaauucuggagucuuccuguagug

SEQ ID NO: 385677 - RNA, 63 nt, Homo Sapiens
uacugcagucauuuuuguaagugcaacucaaauguguugaagaaugacuggaacgaaguagga

SEQ ID NO: 385678 - RNA, 63 nt, Homo Sapiens
gccugcaagauuucaguuuagucuagcuaagcaguguugaaaaguagaaacucaguagagaaa

SEQ ID NO: 385679 - RNA, 63 nt, Homo Sapiens
ggcugcaauuguggaccuucccuaccaaagggaguguugaaacucaagucccgcccuggcucu

SEQ ID NO: 385680 - RNA, 63 nt, Homo Sapiens
cacuccugugugcagugggcauucaguaaauguguguugaaggacugggacguacguggaggc

SEQ ID NO: 385681 - RNA, 63 nt, Homo Sapiens
gccaauuaaacaaguuucauauguauuuuuccaguguugaaucucacacacuguacuuugaaa

SEQ ID NO: 385682 - RNA, 63 nt, Homo Sapiens
guuuagucugaguugaucuuuuuaaaacugcaaguguugaauacuagagguuguuagacccuu

SEQ ID NO: 385683 - RNA, 63 nt, Homo Sapiens
aacguaucugcuaaaucaggugaaucaugcacuguguugaauacuguggaauauccgaugcuu

SEQ ID NO: 385684 - RNA, 63 nt, Homo Sapiens
auuauaaaugguauuguguuagagauugagguaguguugaaaucucuuuggcacugucuguac

SEQ ID NO: 385685 - RNA, 63 nt, Homo Sapiens
auaguugaaaguaaaaaaauagaaacugguucuguguugaaauucuucauuagauguuuauuu

SEQ ID NO: 385686 - RNA, 63 nt, Homo Sapiens
ccucuuuuaaguuuccuuuugaggaaucaguacguguugaaccgcaacuuucccagggugacc

SEQ ID NO: 385687 - RNA, 63 nt, Homo Sapiens
guaauauucuauuuauugagauuguuagacuuuguguugaaauuuguguagagcagcuucuaa

SEQ ID NO: 385688 - RNA, 63 nt, Homo Sapiens
guccaccuucuuaaauuuuuaaugcacuugaugguguugaaauuaacuuaaacaugucaccua

SEQ ID NO: 385689 - RNA, 63 nt, Homo Sapiens
aaaaagcaagaaucaauuacggcccacccacuuguguugaagccugggaggagcucccucacu

SEQ ID NO: 385690 - RNA, 63 nt, Homo Sapiens
uaaauaagcuuaaacaaauaguuguggcugaugguguugaagaucuugggcuaaaauaaacag

SEQ ID NO: 385691 - RNA, 63 nt, Homo Sapiens
guggaaaucaguauuucuguacugucaugaacuguguugaauguucaacugaacccuaaagac

SEQ ID NO: 385692 - RNA, 63 nt, Homo Sapiens
aagaaauacuuaauauugucaaaguacugcaacguguugaaauugauaaguuuuggaaauuca

SEQ ID NO: 385693 - RNA, 63 nt, Homo Sapiens
cagaugcccugcuauauaaauuguaacaguuuuguguugaaccaacguguauuuaccuaacgu

SEQ ID NO: 385694 - RNA, 63 nt, Homo Sapiens
agcaucaagucuccagaaacacaguaagagauaguguugaaccuuccaucaaacuucuccaau

SEQ ID NO: 385695 - RNA, 63 nt, Homo Sapiens
cucuuuccacaaguugcaagauaaaguaacuguguguugaauagagacucaagacaaaccaag

SEQ ID NO: 385696 - RNA, 63 nt, Homo Sapiens
agucuugucauugccagcuguguugguagugcuguguugaauuacggaauaaugaguuagaac

SEQ ID NO: 385697 - RNA, 63 nt, Homo Sapiens
uuugauagagguaacuuaauuugggaauuuguuguguugaaauggcauuuaauuucaaccuaa

SEQ ID NO: 385698 - RNA, 63 nt, Homo Sapiens
aggacuauggucucaagguucaccaugagaaauguguugaacauuuuaguaugcucuauugua

SEQ ID NO: 385699 - RNA, 63 nt, Homo Sapiens
gaugucugucucccuaguguaagccggaauucuguguugaacaauaugcauugcaguucagca

SEQ ID NO: 385700 - RNA, 63 nt, Homo Sapiens
uccuuuuuaugcaucaaacguaacaacguguuuguguugaauucgcaucuucuggcacgguuu

SEQ ID NO: 385701 - RNA, 63 nt, Homo Sapiens
guucugacugcacaaaccagaaggcucccugccguguugaagaaaagaaaggacauucagcuc

SEQ ID NO: 385702 - RNA, 63 nt, Homo Sapiens
ugggaaggauuugcagggcuguaaguguucgagguguugaagauagaagauaaaccaggcaau

SEQ ID NO: 385703 - RNA, 63 nt, Homo Sapiens
aggauucauuuuacuuagcagaaugggaaacuaguguugaaauaacaucugaauaacaacgau

SEQ ID NO: 385704 - RNA, 63 nt, Homo Sapiens
ccccaacuacuauuguagaguauugaaagugggguguugaagacuuaaguggcugugauuaau

SEQ ID NO: 385705 - RNA, 63 nt, Homo Sapiens
ucagcuggggaauugaagccagaacuaaauaaaguguugaacaaaauguuuaaaauccaaaug

SEQ ID NO: 385706 - RNA, 63 nt, Homo Sapiens
ucagcuggggaauugaagccagaaguaaauaaaguguugaacagaaaauuuaaaauucaagug

SEQ ID NO: 385707 - RNA, 63 nt, Homo Sapiens
ucaacuggggaauugaagccagaacuaaauaaaguguugaacaaaauguuuaaaauccaaaug

SEQ ID NO: 385708 - RNA, 63 nt, Homo Sapiens
cgcuaagaacaauuugaauuugugugaaugguuguguugaacaugccauauaucuguauuacu

SEQ ID NO: 385709 - RNA, 63 nt, Homo Sapiens
cugucuuuaaacuagaaaaaccccuguucuuaaguguugaauaugccuuuauaagcucaguuu

SEQ ID NO: 385710 - RNA, 63 nt, Homo Sapiens
gacuuaucuaugugggauauuugucaugaggcuguguugaaguguacuguuuuggugugggag

SEQ ID NO: 385711 - RNA, 63 nt, Homo Sapiens
auuacuguagaucaaguuugaacuuagcaugugguguugaaguaguguuuuuuuuacacuuuu

SEQ ID NO: 385712 - RNA, 63 nt, Homo Sapiens
gcccaauauuacuauauuauguggcauaccauuguguugaaaauugucugcuuugacauuaca

SEQ ID NO: 385713 - RNA, 63 nt, Homo Sapiens
uauuccuguuuauuuuucuaucacuuuuuguaaguguugaauaacuuuauauucuuuaucaua

SEQ ID NO: 385714 - RNA, 63 nt, Homo Sapiens
uaaaaaaaaaauacuuuacuauuauguuccuguguguugaauuuuuaaaaaaaaacaauguau

SEQ ID NO: 385715 - RNA, 63 nt, Homo Sapiens
auaugaagaaaaccaagaauguuuuguugggcuguguugaacauuauuucuuuguaaaugaau

SEQ ID NO: 385716 - RNA, 63 nt, Homo Sapiens
ugcuacuguucucuuucaaaaggaagagcaaccguguugaauacuaauaaugaugaauuagua

SEQ ID NO: 385717 - RNA, 63 nt, Homo Sapiens
uauuaauuuacucuugauuaucaaacauuaccaguguugaacuauuaaaagcacacaaugugu

SEQ ID NO: 385718 - RNA, 63 nt, Homo Sapiens
ugauugguccaacaguuugaugcugagucaugcguguugaaucccacuucagugcaccugugg

SEQ ID NO: 385719 - RNA, 63 nt, Homo Sapiens
guugcaaucauucauacuaguuagaaaaauuauguguugaaauaaguggaaaagugcaaucca

SEQ ID NO: 385720 - RNA, 63 nt, Homo Sapiens
uugguuguggcaaacaaacaaaaaaugcuuucaguguugaaauaucucuauuuuccaaagaug

SEQ ID NO: 385721 - RNA, 63 nt, Homo Sapiens
acuuauuucaacaauucuuagagaugcuagcuaguguugaagcuaaaaauagcuuuauuuaug

SEQ ID NO: 385722 - RNA, 63 nt, Homo Sapiens
auggauuugucuguugaacuucaugcuguccaaguguugaaaagucaauuuuauuucauugca

SEQ ID NO: 385723 - RNA, 63 nt, Homo Sapiens
aacaguuccucuuucccgaguaaggugguugggguguugaaguaccaaguaaccuacaagccu

SEQ ID NO: 385724 - RNA, 63 nt, Homo Sapiens
ggaacuuuaaagaagaaaagaaaaacuugaauuguguugaauuacuguaucuuuuacuuuuuu

SEQ ID NO: 385725 - RNA, 63 nt, Homo Sapiens
uauaaauaaaauucuagcuuugaaaggcguuauguguugaacaguaugcuucagggguaaauu

SEQ ID NO: 385726 - RNA, 63 nt, Homo Sapiens
ggccgaggacgaguggucaccuccaaagcccuuguguugaaaaccgauaacagcccaucacaa

SEQ ID NO: 385727 - RNA, 63 nt, Homo Sapiens
uucugcuuguguauucucuccaccagguaagcgguguugaacuuggaaacgcuuguaggguuu

SEQ ID NO: 385728 - RNA, 63 nt, Homo Sapiens
auaucccuuacaggcaaaaccccugcuaguugcguguugaauuuuuuuuccccucuccuguug

SEQ ID NO: 385729 - RNA, 63 nt, Homo Sapiens
auuuuuaauuuuuuaaaugacuuaguuuuugaaguguugaaguuuuuccaaacuaaguggaga

SEQ ID NO: 385730 - RNA, 63 nt, Homo Sapiens
cccacguguuuuacacagaauauauuuauagcaguguugaaaaauaacuccaggugacguuuc

SEQ ID NO: 385731 - RNA, 63 nt, Homo Sapiens
guuuuuguuucugacuugaauaauuuaucaaugguguugaauaaaagcaaguucaauaauguc

SEQ ID NO: 385732 - RNA, 63 nt, Homo Sapiens
auaucaccucucuucagccccuagugcuauucuguguugaacacaauugauacuucaggugcu

SEQ ID NO: 385733 - RNA, 63 nt, Homo Sapiens
ggugucuaguguuuuuuucccucuccuguccuuguguugaaggcaguaaacuaagggugucaa

SEQ ID NO: 385734 - RNA, 63 nt, Homo Sapiens
gaaauuaaugaauaaacauuuugaguuucccuaguguugaaggaagguguacuuuuucuuguc

SEQ ID NO: 385735 - RNA, 63 nt, Homo Sapiens
agaaggaaaaaaagcagcgcugguugacaaaggguguugaagauuuuugcugcagaaucaguu

SEQ ID NO: 385736 - RNA, 63 nt, Homo Sapiens
agggaagacacuucacaaauuaugaaugaucauguguugaaagccacauuauuuuaugcuaua

SEQ ID NO: 385737 - RNA, 63 nt, Homo Sapiens
cuaaauagcgccccauuugggaacagagcaagaguguugaacugaagaccaaaaugcccucaa

SEQ ID NO: 385738 - RNA, 63 nt, Homo Sapiens
acaaaacuaggucuuguuuuguaaucuuuucucguguugaaucagaucugcuuacuuauuuag

SEQ ID NO: 385739 - RNA, 63 nt, Homo Sapiens
agcuguguuaaugccuuuauccaaauaacuguuguguugaauccuuucucacauuuuccauuu

SEQ ID NO: 385740 - RNA, 63 nt, Homo Sapiens
ggaugauuucuaugcugaguuauagauuagagaguguugaaaccuguauagauuagaauucug

SEQ ID NO: 385741 - RNA, 63 nt, Homo Sapiens
aaguguucagauggauaaggggcacauggguugguguugaaugaccaguggauuuuuuuaccu

SEQ ID NO: 385742 - RNA, 63 nt, Homo Sapiens
auaucuuugcaucauagaacuugcaccaauuaaguguugaaaaaugacacaaugacacauuug

SEQ ID NO: 385743 - RNA, 63 nt, Homo Sapiens
uccugcagucacagggucagagggagagggggcguguugaacaaguagauugcacauggaggg

SEQ ID NO: 385744 - RNA, 63 nt, Homo Sapiens
cauacugcuuguguaucagaaucagguaucaguguguugaauauucuuuuuuccugacaugcu

SEQ ID NO: 385745 - RNA, 63 nt, Homo Sapiens
uuaaaugugauaaccuuugaaagaaggugauaaguguugaaaaucuccauaaauugagagaag

SEQ ID NO: 385746 - RNA, 63 nt, Homo Sapiens
caacugaaggcgaggaauguuacucccuuaacaguguugaauucugacccaagucuuugccuc

SEQ ID NO: 385747 - RNA, 63 nt, Homo Sapiens
ucucauuuacaggucagauaaggcuugggggagguguugaaauagaucacgcgccgcgccgcg

SEQ ID NO: 385748 - RNA, 63 nt, Homo Sapiens
uguaaagcuuuuaugacucuauuguguguauguguguugaaacuaaagauuuuuaauucugug

SEQ ID NO: 385749 - RNA, 63 nt, Homo Sapiens
cucuuaaaggaaugcuugaacauuuagcuuguaguguugaauuacgaauacacucagaaagua

SEQ ID NO: 385750 - RNA, 63 nt, Homo Sapiens
aggaaguauccuaguauguauuuguaggugcauguguugaaauguuaugugcauggccaugug

SEQ ID NO: 385751 - RNA, 63 nt, Homo Sapiens
cuuuuuaggaaauuuugacaaaaagauacuacuguguugaaagauaguuauauucaguacaug

SEQ ID NO: 385752 - RNA, 63 nt, Homo Sapiens
ugggaagagcauuuguagguuggcuuuugguuaguguugaaggguuguauguaauacucacaa

SEQ ID NO: 385753 - RNA, 63 nt, Homo Sapiens
auccaagauguucuguaucuuuguguugcuaugguguugaaauuauacaugaagaaauuaauu

SEQ ID NO: 385754 - RNA, 63 nt, Homo Sapiens
ugcucccuggcggcccccaauuguccuguaaggguguugaagagggaacacacggguccuuca

SEQ ID NO: 385755 - RNA, 63 nt, Homo Sapiens
ugcaggugcagaggggucagcagcaggagaagcguguugaacacguggcucucagacacuccu

SEQ ID NO: 385756 - RNA, 63 nt, Homo Sapiens
uaaguauuccaggguuuggggucaacacgugaaguguugaauuuuaaaaaauacaaaaagcag

SEQ ID NO: 385757 - RNA, 63 nt, Homo Sapiens
uguguaugauggaugugaccauuuauaugucauguguugaaauuaaagggugucuggaugcca

SEQ ID NO: 385758 - RNA, 63 nt, Homo Sapiens
aaugccagccucucuugucccugguuuccuuauguguugaaugugguugaguuuguccauugc

SEQ ID NO: 385759 - RNA, 63 nt, Homo Sapiens
ucccuguuuugaaauacguaaacagccuaaaauguguugaaauuauuuuguaaauccaugacu

SEQ ID NO: 385760 - RNA, 63 nt, Homo Sapiens
ccucuaaauucuuucauuuuagggguagcauuuguguugaagagguuuuaaagcuuccauugu

SEQ ID NO: 385761 - RNA, 63 nt, Homo Sapiens
uguguuugguuccagccuaaaaaugauuuuguaguguugaaaucauagcuacuuacauagcuu

SEQ ID NO: 385762 - RNA, 63 nt, Homo Sapiens
uaaaccuuucaagaagguuauuuagcuagcuuaguguugaacuaaauuuuuuuuaaacaaggc

SEQ ID NO: 385763 - RNA, 63 nt, Homo Sapiens
acagaaaaagcacacagauggcuugucucaggaguguugaaugugugccccgcugcugucugg

SEQ ID NO: 385764 - RNA, 63 nt, Homo Sapiens
aaauugugaacacccccacccccgcauuuuuguguguugaaauucuugaagguuacauuaaau

SEQ ID NO: 385765 - RNA, 63 nt, Homo Sapiens
ugauuuaaaaaugccagcaauuuuaaucuagcaguguugaagcugggaauuuuuuggcgcaau

SEQ ID NO: 385766 - RNA, 62 nt, Homo Sapiens
aaccuaaacuugaccugcuucauccagaagaaguguugaaguauaagauggagacuucauag

SEQ ID NO: 385767 - RNA, 63 nt, Homo Sapiens
uucauuaagaaauaaaguccuaucuuuuccucaguguugaacuuugugagucaacgacuuugc

SEQ ID NO: 385768 - RNA, 63 nt, Homo Sapiens
ucugauucuacaaaggccaaaauuuauuagauuguguugaaggaccuuuucagcucccuagcu

SEQ ID NO: 385769 - RNA, 63 nt, Homo Sapiens
uuuaguuuuuacucuuuguugcuuuuuaauaauguguugaaguuuguaguugaguccaguuuu

SEQ ID NO: 385770 - RNA, 63 nt, Homo Sapiens
uaucauguaauuuauugaauauuuuauaaucgaguguugaauaaaucaucuaacacaaacucu

SEQ ID NO: 385771 - RNA, 63 nt, Homo Sapiens
ugggaacagcccagugcagucuaaacuucaauuguguugaaacuacuuuaauagacaaaguaa

SEQ ID NO: 385772 - RNA, 63 nt, Homo Sapiens
cacucuccuuagagccgacagguugauccugcuguguugaaggcugugguuaauaaaacacaa

SEQ ID NO: 385773 - RNA, 63 nt, Homo Sapiens
caagauuauauuauaauaauguucucuggguagguguugaaaaugagccuguaauccucagcu

SEQ ID NO: 385774 - RNA, 63 nt, Homo Sapiens
ugggaugaacguuuuacugcuacacccagauuuguguugaacgaaaacauugugguuuggaaa

SEQ ID NO: 385775 - RNA, 63 nt, Homo Sapiens
uaaguugugaacaagaguguuuuuauagcauauguguugaaguaacagcuugugcccgagaaa

SEQ ID NO: 385776 - RNA, 63 nt, Homo Sapiens
gaaggcauuuuggaguacacuuaucucuuguuuguguugaacugaaggcuaagucucagugga

SEQ ID NO: 385777 - RNA, 63 nt, Homo Sapiens
cacuugacaugcggucaccgguggcagcgcgguguguugaagggaaacgguagcuauucauuc

SEQ ID NO: 385778 - RNA, 63 nt, Homo Sapiens
cauucauuguuuuuuaucuuaguuugcagaaagguguugaaaugcuucucuagcccaaacagc

SEQ ID NO: 385779 - RNA, 63 nt, Homo Sapiens
uuaaggaauagagccuaauuagcgcaugaauacguguugaacugugaaugaaucaaugaguau

SEQ ID NO: 385780 - RNA, 63 nt, Homo Sapiens
uaccagauuccaggaggcagaagauaacuaauuguguugaagaaacuuagacuucacccacca

SEQ ID NO: 385781 - RNA, 63 nt, Homo Sapiens
uccccuuaccugggugggaaauaaauuucugcuguguugaagcuaguuauuuggggugucugu

SEQ ID NO: 385782 - RNA, 63 nt, Homo Sapiens
cagcacgucugugugaguaaagauucagcguggguguugaauccaccuccguggaauaaaugg

SEQ ID NO: 385783 - RNA, 63 nt, Homo Sapiens
acucggcuagcaucagcaccgacauuuagaguaguguugaaauuaccuugcuacaguauuucu

SEQ ID NO: 385784 - RNA, 63 nt, Homo Sapiens
ucaauaccaaauacaguaaaaccaggguagagaguguugaaauuuuucuagagcagcugugcg

SEQ ID NO: 385785 - RNA, 63 nt, Homo Sapiens
aaaaagacccaaauuacugcaaaaugcugcguuguguugaaugucuuuugugaauuuauuaug

SEQ ID NO: 385786 - RNA, 63 nt, Homo Sapiens
gggccuuugagaaucagacuauuuugguagcugguguugaauaggaauagagggaggagugua

SEQ ID NO: 385787 - RNA, 63 nt, Homo Sapiens
uaguauguaucuagaauacuuaaaguccagguaguguugaagaccaaauuuaaguugaugacc

SEQ ID NO: 385788 - RNA, 63 nt, Homo Sapiens
uuuugugggaaaaaaaaaucaguucuagcuuaaguguugaaacagggcaaaguuaacacugaa

SEQ ID NO: 385789 - RNA, 63 nt, Homo Sapiens
cucuugauaucaugugcuugaauggaauccacuguguugaagaucuauuuuuuuucuuaauaa

SEQ ID NO: 385790 - RNA, 63 nt, Homo Sapiens
auccauugcauccauuuuuuacaucucucagauguguugaagcacauauuguguuaugaaugc

SEQ ID NO: 385791 - RNA, 59 nt, Homo Sapiens
uucuuuuguaugugugugugcgacgagccguguugaaacgagaagacuuugaauucuaa

SEQ ID NO: 385792 - RNA, 63 nt, Homo Sapiens
guaguaauauuuucagacguuuccccaauaaguguguugaagcauacaucuuuacgcugcuaa

SEQ ID NO: 385793 - RNA, 63 nt, Homo Sapiens
agaccugaauaucuuuccuaguaaaaauaggauguguugaaauauuuauauguacuuugaucu

SEQ ID NO: 385794 - RNA, 63 nt, Homo Sapiens
aaccauuuaacacaaagccuauuuuauaaugaaguguugaauagcucauguuauuuacugaau

SEQ ID NO: 385795 - RNA, 63 nt, Homo Sapiens
aagaagucaaggauguaagucuauuaggacugaguguugaauggucuugauggugaagaagga

SEQ ID NO: 385796 - RNA, 63 nt, Homo Sapiens
augcaacuuuuuauuuaaaaagggguugccaugguguugaacagguccaaaaaugcugaucua

SEQ ID NO: 385797 - RNA, 63 nt, Homo Sapiens
accccauccccucacguucuaaaggacaguucuguguugaaacaggugagcccugaaaacaca

SEQ ID NO: 385798 - RNA, 63 nt, Homo Sapiens
ucuuuagcuggggugaccugagccuuuuggcugguguugaaugaacccuucaaacuaaacuuu

SEQ ID NO: 385799 - RNA, 63 nt, Homo Sapiens
aguuuuggauuagaaaugauuuauguuagccauguguugaagaugaaauuggcaucaguguag

SEQ ID NO: 385800 - RNA, 63 nt, Homo Sapiens
auuuuuauuucagauuuugauaacuguuuauauguguugaaaaccaaaaugacaucuuuuuaa

SEQ ID NO: 385801 - RNA, 63 nt, Homo Sapiens
aaaaagaagcuuuucuagggguuuguauaaauaguguugaaacuuuauuuuauguauuuaauu

SEQ ID NO: 385802 - RNA, 63 nt, Homo Sapiens
uguuaaaauuccaauuuguuuauaugcaggugaguguugaaacagguugauuuuuuauuuuau

SEQ ID NO: 385803 - RNA, 63 nt, Homo Sapiens
uuccuuuuugccaguuauguuaaacuacuuguuguguugaaaggacauaaaaaaaaaaaaaac

SEQ ID NO: 385804 - RNA, 63 nt, Homo Sapiens
uguugcauguccauguuagaugcggugagcguaguguugaauagaaggcuuuuccaagcaaac

SEQ ID NO: 385805 - RNA, 63 nt, Homo Sapiens
acuacauuugcuguacauauuugauaaauagauguguugaauucuucauugcaguggauugau

SEQ ID NO: 385806 - RNA, 63 nt, Homo Sapiens
uaaagauggggggccgcgggacggacuguguguguguugaaaguuaaggagggcaguucugcg

SEQ ID NO: 385807 - RNA, 63 nt, Homo Sapiens
cuuuugcucauauaaacaagggccagaaaacugguguugaagggcaaaauucuagggaaacuu

SEQ ID NO: 385808 - RNA, 63 nt, Homo Sapiens
uuacaagggcuuuuauaaaaguauucauaagaaguguugaacacuaaacaacuuaauuugcuu

SEQ ID NO: 385809 - RNA, 63 nt, Homo Sapiens
uacaagagcuagaaaacugacauugauguugcaguguugaaaccugauucuggacauaugcau

SEQ ID NO: 385810 - RNA, 63 nt, Homo Sapiens
gcuugcauuaauuguauauuuuggauucuguuuguguugaauuuuuuaaucauugugcacaga

SEQ ID NO: 385811 - RNA, 63 nt, Homo Sapiens
aguacuccaucucuccaaauguauuuccauaauguguugaaaacaugcuaacauuuguaugau

SEQ ID NO: 385812 - RNA, 63 nt, Homo Sapiens
ucaaagugauguaaugugaucacagcuuuuguuguguugaaugaaaauauguggacugucauu

SEQ ID NO: 385813 - RNA, 63 nt, Homo Sapiens
uauauuuugaacuaacagaacuuggcagaauguguguugaauauucuuuacauuuaacaauua

SEQ ID NO: 385814 - RNA, 63 nt, Homo Sapiens
auccuuuguacagauaaagguuauagauuucuuguguugaauauuaaaaaagcaaggaugucu

SEQ ID NO: 385815 - RNA, 63 nt, Homo Sapiens
augguaacuaguaugcucuuugagauuuuuacaguguugaaacuuaagaauuuugagagggug

SEQ ID NO: 385816 - RNA, 63 nt, Homo Sapiens
ggcuauguaauucuuguaauuuuuauuuaggaaguguugaagggagguggcaagaguguggag

SEQ ID NO: 385817 - RNA, 63 nt, Homo Sapiens
uugcccuauccuugugucuccacccccuuccauguguugaauaauaaaaggugggaaagugcu

SEQ ID NO: 385818 - RNA, 63 nt, Homo Sapiens
uaaaaacuuguauguuuuugcaaaucccuggaaguguugaauugguuaaaauuuuacauuuuc

SEQ ID NO: 385819 - RNA, 63 nt, Homo Sapiens
auuaauuguguaauucagaauucauaccaaucaguguugaaacucaaacauugcaaaaguggg

SEQ ID NO: 385820 - RNA, 63 nt, Homo Sapiens
cuucacucugcugaagcucccugccuguuugcuguguugaacucacauauacaaaggagcugc

SEQ ID NO: 385821 - RNA, 63 nt, Homo Sapiens
uuuuaguaaguugaguaagcuaaaucuuuuuugguguugaaacuucagaacuuucagccaagu

SEQ ID NO: 385822 - RNA, 63 nt, Homo Sapiens
uucuuccuggagcagaugucgagaugaauuuugguguugaaagcuuuucccaucuguaaaauu

SEQ ID NO: 385823 - RNA, 63 nt, Homo Sapiens
acuggacuuggauaugggguagagguagcugugguguugaaacgaaaugucgcuccacuuuac

SEQ ID NO: 385824 - RNA, 63 nt, Homo Sapiens
gggacacuggggagaaaggggguagcgugcacgguguugaacucccgugcgccguuucuccuu

SEQ ID NO: 385825 - RNA, 63 nt, Homo Sapiens
uacuacggugugguaguaguaguaaaaggcaaaguguugaagaaacuuccauauucuucauau

SEQ ID NO: 385826 - RNA, 63 nt, Homo Sapiens
acgccagaagaccugaaauggcaguguauuaagguguugaauuuucacuagaaaaggcagaaa

SEQ ID NO: 385827 - RNA, 63 nt, Homo Sapiens
ugggacccugaggaauucacgacaucacggaaaguguugaacccaucccugacugaguacucu

SEQ ID NO: 385828 - RNA, 63 nt, Homo Sapiens
uuuuuucuuuuuucuuuuuuuuuauuugaagccguguugaaauccuugucuccuguagaccca

SEQ ID NO: 385829 - RNA, 63 nt, Homo Sapiens
auguuuuuguuuuuauauccuuuuagcucuuaaguguugaacacuguugacagugaagaacuu

SEQ ID NO: 385830 - RNA, 63 nt, Homo Sapiens
auuguuucucacccugcugauucugugguaucuguguugaauaaagaaaaagguagcagugcu

SEQ ID NO: 385831 - RNA, 63 nt, Homo Sapiens
aagcaaauguggacugaaucugcuuguugaucaguguugaagaaagugcaaaaggaacuuuua

SEQ ID NO: 385832 - RNA, 63 nt, Homo Sapiens
uguuuugaagugaauaaaauuuuguaaauagguguguugaauuaaagugggcucuggaauccc

SEQ ID NO: 385833 - RNA, 63 nt, Homo Sapiens
gaccaagguugcaaggccaguauagcuuauuagguguugaagaaaaagauuauuugggccagu

SEQ ID NO: 385834 - RNA, 63 nt, Homo Sapiens
agaauggaaaugacaagaaaguauuguucugcaguguugaaacuucgccauugggccuccagu

SEQ ID NO: 385835 - RNA, 63 nt, Homo Sapiens
acuucucauuuuuggagcuuguaauggaaaaugguguugaaggucauugauuuggugagaaca

SEQ ID NO: 385836 - RNA, 63 nt, Homo Sapiens
cacaggguuugguuucgaaucguaaauguuuggguguugaaguuguacaguaaaacguaagaa

SEQ ID NO: 385837 - RNA, 63 nt, Homo Sapiens
uucaaauaauguucauuacaguuaaccuuucauguguugaaugacaccaaguucauagccuuu

SEQ ID NO: 385838 - RNA, 63 nt, Homo Sapiens
cuagguuacuuauaaugcaacaugcuaauauggguguugaaaaagguuagaaaaccacgccca

SEQ ID NO: 385839 - RNA, 63 nt, Homo Sapiens
auuuuaauacaauauuaaaucgguuuuaguucaguguugaagauucaaacuaacaaauguaua

SEQ ID NO: 385840 - RNA, 63 nt, Homo Sapiens
agugcaggggguugggaggauuaaaugaauaagguguugaaaggaagagaaaguuccauucau

SEQ ID NO: 385841 - RNA, 63 nt, Homo Sapiens
cuuucugcuuguuuugauucuuaugaacagcaaguguugaacuacguuaaauuuucaguccag

SEQ ID NO: 385842 - RNA, 63 nt, Homo Sapiens
gcaaaggccggcggagaggccgcgugugggagcguguugaagauuuuaaguggucucuacacc

SEQ ID NO: 385843 - RNA, 63 nt, Homo Sapiens
ucuauauuuuguaauucuggaugaaagauaacuguguugaacaaacaggugcuccaggcuuug

SEQ ID NO: 385844 - RNA, 63 nt, Homo Sapiens
uugagaguaaugcauacagaaauauaauaaaauguguugaaacugcaugaacauacuauuuuu

SEQ ID NO: 385845 - RNA, 63 nt, Homo Sapiens
ccugucaugaauccuugguaaagcccccauuguguguugaaauuggguaauuauaccucuccc

SEQ ID NO: 385846 - RNA, 63 nt, Homo Sapiens
ugagccagguacauaacgcgguucaugguuaguguguugaagaguccccuaauggcuauuagu

SEQ ID NO: 385847 - RNA, 63 nt, Homo Sapiens
acauuuuuucuuuugaccaaaagaugacaagcuguguugaaauauuaugauugauuuuuucca

SEQ ID NO: 385848 - RNA, 63 nt, Homo Sapiens
guugcauuuauugcagcaaguuacaaagggaaaguguugaagcuuuucauauuugcugcguga

SEQ ID NO: 385849 - RNA, 63 nt, Homo Sapiens
uguccaggcacagcuccguccccagcgcucaugguguugaaacugucugucaugcaccacggu

SEQ ID NO: 385850 - RNA, 63 nt, Homo Sapiens
gagugcgucagcagaccuguccuggccuggcugguguugaaauacacaccgguuugcccaagu

SEQ ID NO: 385851 - RNA, 63 nt, Homo Sapiens
auaaagugcaauacuuuauugcuacaucauuuuguguugaauaguaccuguauguuacuguug

SEQ ID NO: 385852 - RNA, 63 nt, Homo Sapiens
cuucacuuuauuuuguuguuuaaacugccccaaguguugaaguaaauggugaaagcuuccuuc

SEQ ID NO: 385853 - RNA, 63 nt, Homo Sapiens
uuuauuucaaaaaaaauguauuuucugccuuggguguugaauugucggaguuuuaguaaauuu

SEQ ID NO: 385854 - RNA, 63 nt, Homo Sapiens
gucaauauuuucgauuauguuuugcuuagaucaguguugaacuaaguuggcauagcacacacu

SEQ ID NO: 385855 - RNA, 63 nt, Homo Sapiens
aauucuuugucuaauauauuggagucuuuaaaaguguugaagaauaaaauauuaauuagaaca

SEQ ID NO: 385856 - RNA, 63 nt, Homo Sapiens
uaucagaccauuuuguaaauaaaggcagaauuuguguugaagauucuuauaugaauaaccuuc

SEQ ID NO: 385857 - RNA, 63 nt, Homo Sapiens
uuuuuuguaugucuuuuuuuuuuuuaagcaaucguguugaauuaggaguauacuuggugugga

SEQ ID NO: 385858 - RNA, 63 nt, Homo Sapiens
ucaguacucacucuucuugcuuaggcucucuguguguugaaagccaucccguguugcaugugu

SEQ ID NO: 385859 - RNA, 63 nt, Homo Sapiens
aacauugaaagucagaauugucauauuuuuucgguguugaaacucauaccaaagaauaagcca

SEQ ID NO: 385860 - RNA, 63 nt, Homo Sapiens
aggggggauauugcuguccuuucccaaagguggguguugaacucucccccacccucuuuuccc

SEQ ID NO: 385861 - RNA, 63 nt, Homo Sapiens
uuauucuuguacauucauuccuuuugcacugauguguugaaccgucauguaaauucauaaauc

SEQ ID NO: 385862 - RNA, 63 nt, Homo Sapiens
aauuugcaucugcacagucagcagagauaacaaguguugaacugaccuugccacaugcuuagu

SEQ ID NO: 385863 - RNA, 63 nt, Homo Sapiens
agccuagaaguccaaucacccuguaauaaauauguguugaaugaagaaaugggugaaugagcu

SEQ ID NO: 385864 - RNA, 63 nt, Homo Sapiens
agccuuacucccaaaguaccugcucacuguuccguguugaacaauugccgguguuuccucucu

SEQ ID NO: 385865 - RNA, 63 nt, Homo Sapiens
cauauuagacauucuuaacagggcggcagucuaguguugaaaguuuuauuuuuccauuuuucu

SEQ ID NO: 385866 - RNA, 63 nt, Homo Sapiens
guucuugagcugccucuuaggaaacagaagacaguguugaaguuuucccugcuucugguuugc

SEQ ID NO: 385867 - RNA, 63 nt, Homo Sapiens
uguuauuuuacuauauauaaauauuaaaauauuguguugaaguauagggauguauuuaauuuu

SEQ ID NO: 385868 - RNA, 63 nt, Homo Sapiens
acaguccaagcccuggauaaugcuuuacuuucuguguugaagcacuguugguuguuugguuag

SEQ ID NO: 385869 - RNA, 63 nt, Homo Sapiens
ugucaaagaggauggacuaaaugaucucugaaaguguugaagcgcggacccuucuggguccag

SEQ ID NO: 385870 - RNA, 63 nt, Homo Sapiens
aacccaagaucggaaugcaagaguggaagaauuguguugaauauguuuguacuuuguugugua

SEQ ID NO: 385871 - RNA, 63 nt, Homo Sapiens
gaauuguuuacuuuggaauaguuuaagucuugaguguugaaagauaacccucuaagaauaccu

SEQ ID NO: 385872 - RNA, 63 nt, Homo Sapiens
aauggugaugcuuauuacaaacacaguauuacaguguugaaguagaccucuucuccucauggu

SEQ ID NO: 385873 - RNA, 63 nt, Homo Sapiens
cuaaaguaugugaugucuucaucauaguaugaaguguugaaaauuaauaacgagccuaguuua

SEQ ID NO: 385874 - RNA, 63 nt, Homo Sapiens
aucaaaaacagaguuuucuguguuuccaugauaguguugaagccuaaugacaagccaggucuu

SEQ ID NO: 385875 - RNA, 63 nt, Homo Sapiens
gacaaguuauuuagccauucaccuagagaguaaguguugaagccagagccaccuccaacucug

SEQ ID NO: 385876 - RNA, 63 nt, Homo Sapiens
uaagagauggccgcugugugcuggucacaggaaguguugaauggauuggcuugcaaagggggu

SEQ ID NO: 385877 - RNA, 63 nt, Homo Sapiens
cuuucaaguuaguuauuucagucaggauauacaguguugaaaucucaaugcaguugaaaucug

SEQ ID NO: 385878 - RNA, 63 nt, Homo Sapiens
uacaacacaaugauuuuccagacaaaugguaugguguugaaaaauaacuguuacuucuuaaag

SEQ ID NO: 385879 - RNA, 63 nt, Homo Sapiens
auguugcuucugaaucacuguugaguucugauuguguugaagaaggguuauccuuucauuagg

SEQ ID NO: 385880 - RNA, 63 nt, Homo Sapiens
uugucauguggaaccugcuuuauccauugcugaguguugaauguggguaaugguuagggcuuu

SEQ ID NO: 385881 - RNA, 63 nt, Homo Sapiens
guguaguuuuccuuuuguguaauuuuaaagucaguguugaauuuuauugaaagcucaugaugc

SEQ ID NO: 385882 - RNA, 63 nt, Homo Sapiens
ccgagaaauuugucuuuuuguauaaaugacaaaguguugaaaauguauuuccugaaauaaaug

SEQ ID NO: 385883 - RNA, 63 nt, Homo Sapiens
ccugaaagauaacacuccuugggucuggacuagguguugaagaucagacaacuuucucuggaa

SEQ ID NO: 385884 - RNA, 63 nt, Homo Sapiens
cuuaccaaguccugggaauaacagcacuacgauguguugaauguucccacuccauacuuuccc

SEQ ID NO: 385885 - RNA, 63 nt, Homo Sapiens
aggaagguuuaaggagaaucaaccuggccuuugguguugaaaucuuaagacaucugaagcugc

SEQ ID NO: 385886 - RNA, 63 nt, Homo Sapiens
ccagaaccugaauccaucccuuuggcucacucuguguugaaaccugagccuguucaccugguc

SEQ ID NO: 385887 - RNA, 63 nt, Homo Sapiens
cuggaaaaaauaacucauccaaaaucuuuauugguguugaaaacugaugugguggcuuuugca

SEQ ID NO: 385888 - RNA, 63 nt, Homo Sapiens
cacgacagccacugcucuaccugauucaaccagguguugaaggugaguuucgauguugaugaa

SEQ ID NO: 385889 - RNA, 63 nt, Homo Sapiens
gcauucuuguaauauccccuagaaugggcuaaaguguugaauuuaauucaaacuguuuuguuc

SEQ ID NO: 385890 - RNA, 63 nt, Homo Sapiens
uuaguuuucuuuuaacaugcggugaauggauguguguugaauuaaugcuuggaguagucugug

SEQ ID NO: 385891 - RNA, 63 nt, Homo Sapiens
accaaauagauaucauguuauuaccaccaagaaguguugaaacccaaguuucccccuuuugaa

SEQ ID NO: 385892 - RNA, 63 nt, Homo Sapiens
cagggauucucacaauagccgauaucagaauuuguguugaaggaacuugucucuucaucuaau

SEQ ID NO: 385893 - RNA, 63 nt, Homo Sapiens
augucuuuuuaaaugguccauuuucaaaagacaguguugaauaaacauaccugugugauaaaa

SEQ ID NO: 385894 - RNA, 63 nt, Homo Sapiens
gcccuaugaaguagcaauuuuuggaggcaaaauguguugaaguacuaccaaauucauuugacu

SEQ ID NO: 385895 - RNA, 63 nt, Homo Sapiens
cuucaacaaaugugucauucccauccagagaugguguugaaucaagccuaaaauauauuuuaa

SEQ ID NO: 385896 - RNA, 63 nt, Homo Sapiens
caaauguaaacauaaggguaguagcggauggcaguguugaaggauaacacuagggaaaaauuu

SEQ ID NO: 385897 - RNA, 63 nt, Homo Sapiens
uccucaggcucaugauaacuaucuauaaagcauguguugaaaagaauuaauagagagaaaaaa

SEQ ID NO: 385898 - RNA, 63 nt, Homo Sapiens
uuaaaauaaagcaaaucugcggcuuuguucuugguguugaaaauuaguuguuuauuuuugacu

SEQ ID NO: 385899 - RNA, 63 nt, Homo Sapiens
ugcaggcuucugccugggccccaggcccugccuguguugaaagcucuggggacugggccaggg

SEQ ID NO: 385900 - RNA, 63 nt, Homo Sapiens
gugaaccccagguccucaacucccccccuuuauguguugaaaguuaaugguuucagaugugaa

SEQ ID NO: 385901 - RNA, 63 nt, Homo Sapiens
gacccuugggggcggggagacuggguggggaggguguugaauaaaagggaaaauaaauguguc

SEQ ID NO: 385902 - RNA, 63 nt, Homo Sapiens
gauauaaaugcacguccucuggcuguaaggaauguguugaaaccuuucacucugccuuauacc

SEQ ID NO: 385903 - RNA, 63 nt, Homo Sapiens
caugaaaugacucacuagagaaaaccccuaugaguguugaacaugugagaaagccuuaaguac

SEQ ID NO: 385904 - RNA, 63 nt, Homo Sapiens
uagaggcgggguuucgccauguugcacuggcugguguugaacuccuaaccucaggugauccac

SEQ ID NO: 385905 - RNA, 63 nt, Homo Sapiens
gagauuuuaauucgcauuuuccagugacuaaggguguugaaccacucgugccuuccugugccu

SEQ ID NO: 385906 - RNA, 63 nt, Homo Sapiens
guaaagucaagagaagaauguauacacauauguguguugaauaauuacuauuggcauagguau

SEQ ID NO: 385907 - RNA, 63 nt, Homo Sapiens
caaaauggucaggacuuuaauggaggaggugagguguugaaagcacaggcagaguggucaggg

SEQ ID NO: 385908 - RNA, 63 nt, Homo Sapiens
agggcugugaacggaguggguggcagcaaauguguguugaaaggggaaugaagccauucacuu

SEQ ID NO: 385909 - RNA, 63 nt, Homo Sapiens
aagaugcucuagaggaauuaaugcuggaaugggguguugaaggaugaguaggaguuaguuagg

SEQ ID NO: 385910 - RNA, 63 nt, Homo Sapiens
cuugacuguugauauguauuuuuugugaaguguguguugaagccuugcagauuauuuuuuaaa

SEQ ID NO: 385911 - RNA, 63 nt, Homo Sapiens
uagaaacaagguuucaccauguuggucaggcugguguugaacuccugaccucagguaauccac

SEQ ID NO: 385912 - RNA, 63 nt, Homo Sapiens
agugugcccagugcccuuggccugggcuguucuguguugaaggcagggccuggaagcagcgga

SEQ ID NO: 385913 - RNA, 63 nt, Homo Sapiens
caucuuucaagcccucgcucccuagaagagucuguguugaagggucccaaaacuggcuggauu

SEQ ID NO: 385914 - RNA, 63 nt, Homo Sapiens
uaugaaauauggcuauuuuuuguaaauagaauaguguugaagauuauuuauuauauaaaguau

SEQ ID NO: 385915 - RNA, 63 nt, Homo Sapiens
guacaaccauaugagccuugagcgaguugaguuguguugaauuuggacauuuuucguggccac

SEQ ID NO: 385916 - RNA, 63 nt, Homo Sapiens
uucuaaucucaucccucucccugcacaagcaguguguugaacugggucuugacuuuaucuccg

SEQ ID NO: 385917 - RNA, 63 nt, Homo Sapiens
uaaaucacauucgguuauauuucuaugaguauuguguugaaucuaacaaaaaguuauggggau

SEQ ID NO: 385918 - RNA, 63 nt, Homo Sapiens
uacaucacauucaguuauaauucucuggguauuguguugaaucuaacaaaaaguuauagaaau

SEQ ID NO: 385919 - RNA, 63 nt, Homo Sapiens
gguaacucccucuuggagaacauggguaaauauguguugaauuagaagagccaccguggaagu

SEQ ID NO: 385920 - RNA, 63 nt, Homo Sapiens
agagcacaggagcaugggcugccucugagugugguguugaacuucgggaggagcagggagccc

SEQ ID NO: 385921 - RNA, 63 nt, Homo Sapiens
aacaacagcaacgugaucuuggcugucugucauguguugaaguccaugguugggucuugugaa

SEQ ID NO: 385922 - RNA, 63 nt, Homo Sapiens
acacuguccauguucuuuuuauugccagggcccguguugaagugucaagagagcaaucaucaa

SEQ ID NO: 385923 - RNA, 63 nt, Homo Sapiens
gaagaacugaggcacagauuaaaggacuugccuguguugaauaccaguccuguucuaggacau

SEQ ID NO: 385924 - RNA, 63 nt, Homo Sapiens
ggagcuaggggcuccagaaagaaucuuacacauguguugaagacauugaugucauagggagcg

SEQ ID NO: 385925 - RNA, 63 nt, Homo Sapiens
uguucagaagguugcucuagcuuauuuuugacaguguugaaaauuccuuuuuuguuauuauua

SEQ ID NO: 385926 - RNA, 63 nt, Homo Sapiens
caaaccugccgcaacagaaauacagauucaacuguguugaaaucagaaacgagcuuugguuuu

SEQ ID NO: 385927 - RNA, 63 nt, Homo Sapiens
caagcugcuugucaagaagcgacacuaaggcagguguugaagaagggagaugucccuggggca

SEQ ID NO: 385928 - RNA, 63 nt, Homo Sapiens
acaguuacaacccacuggggaagugagcacucaguguugaaucuugagcuccaccuccuuucc

SEQ ID NO: 385929 - RNA, 63 nt, Homo Sapiens
aguggguugaccaauuuggugaacaagcggcugguguugaaagucagcuagagaaggaugcug

SEQ ID NO: 385930 - RNA, 63 nt, Homo Sapiens
agcaaaccaaugagugcugcauaaaaguguguuguguugaagcuugacaccuuuuagaucugu

SEQ ID NO: 385931 - RNA, 63 nt, Homo Sapiens
ccaguguccucagcuucaugucaugacaacucaguguugaagcgaggacagagccugucccuc

SEQ ID NO: 385932 - RNA, 63 nt, Homo Sapiens
augguugguguauuuugucacggugugaaucaaguguugaaaaaucaucaaaagacuguuucu

SEQ ID NO: 385933 - RNA, 63 nt, Homo Sapiens
uagucacacuucacuaaagugucauccaccaguguguugaauccgaagaaugacaauuuucua

SEQ ID NO: 385934 - RNA, 63 nt, Homo Sapiens
gcccccuaggggacacacagugcacugagguggguguugaagaccagcccuucccuguguggc

SEQ ID NO: 385935 - RNA, 63 nt, Homo Sapiens
cucuuacucaccuuccuuuagucucguccugugguguugaagggaaaucagccaguuguaaau

SEQ ID NO: 385936 - RNA, 63 nt, Homo Sapiens
uaaacuaauauauccagagauuuugcacaauucguguugaaccuuccaaaacaaaaauaaaga

SEQ ID NO: 385937 - RNA, 63 nt, Homo Sapiens
uggcuuugcaugcccagcgaggcuggggcugggguguugaagugugggcaggaggagcugagg

SEQ ID NO: 385938 - RNA, 63 nt, Homo Sapiens
aacuguaugggaagaagccaggaaaaccucugaguguugaaggggcaacccaaggcaucacag

SEQ ID NO: 385939 - RNA, 63 nt, Homo Sapiens
uuuagagcuaggguggggucuggucacacacagguguugaagaaauuauaaagauaaagcugc

SEQ ID NO: 385940 - RNA, 63 nt, Homo Sapiens
uuccuuacauuuaccaagaggaaagcuuuuacuguguugaagcuaaaaaaauaauggcucuuu

SEQ ID NO: 385941 - RNA, 63 nt, Homo Sapiens
aaaauacaauaacuacuuaaucaucagaacaauguguugaauucuguggaaauagaaaagcau

SEQ ID NO: 385942 - RNA, 63 nt, Homo Sapiens
cccgaaucauuguuuuauuuccugauuacacagguguugaauggggaaaggggcuaguauauc

SEQ ID NO: 385943 - RNA, 63 nt, Homo Sapiens
acagaucuggagguaugauaggucaggggcuagguguugaacuuaguuaauggaagacugaga

SEQ ID NO: 385944 - RNA, 63 nt, Homo Sapiens
gcagcuccuuccuagccuuggcggagucauuuuguguugaagaucuucuucaaaccuuugugu

SEQ ID NO: 385945 - RNA, 63 nt, Homo Sapiens
ccaguggaaauuguauaauugcagaauuaaaccguguugaagacaugcaaaggaaaggacagu

SEQ ID NO: 385946 - RNA, 63 nt, Homo Sapiens
gaaucaaacuacauuugcuguagggccuuuuugguguugaaggaagauuauuaaucacauaua

SEQ ID NO: 385947 - RNA, 63 nt, Homo Sapiens
gugacaugcuuuaaugauaauaaggaggaguugguguugaaguauuuauucugaugucccuuu

SEQ ID NO: 385948 - RNA, 63 nt, Homo Sapiens
auguaucauccagagugaugcuuucagcugccaguguugaauagcucauauaguaaagggauc

SEQ ID NO: 385949 - RNA, 63 nt, Homo Sapiens
gcaaaccgaguacugcuguauucuguugucaguguguugaauucagucuguuggucccuuugc

SEQ ID NO: 385950 - RNA, 64 nt, Homo Sapiens
caccuucccaaaccuaauucuuguagaugcauuaguguugaaccaaugcuuucucaugucucaa

SEQ ID NO: 385951 - RNA, 64 nt, Homo Sapiens
acacgcugugagaucaccgcaaaccuaccuuacuguguugaaacgggacaaaugcaauagaacg

SEQ ID NO: 385952 - RNA, 64 nt, Homo Sapiens
cagauggaaagaggugaaaaugaagaaggaagcuguguugaaacagaaaaauaagucaaaagga

SEQ ID NO: 385953 - RNA, 64 nt, Homo Sapiens
gggagaaaauguguaauucaaagaagauacugauguguugaaaaaauggaauuuuugguacugu

SEQ ID NO: 385954 - RNA, 64 nt, Homo Sapiens
ucuugaauggagaccucccuaccaagugaugaaaguguugaaaaacuuaauaacaaaugcuugu

SEQ ID NO: 385955 - RNA, 64 nt, Homo Sapiens
uaaaaaugaugugugaaauagaaugagugcuaugguguugaaaacugcaguguccguuaugagu

SEQ ID NO: 385956 - RNA, 64 nt, Homo Sapiens
gaagaggcgggguuucaccauguuggccaggcugguguugaacuccugaccucaagugaucugc

SEQ ID NO: 385957 - RNA, 64 nt, Homo Sapiens
ugggagagccggccacgcccuuggcuuuagagcuguguugaaauccauuuuggugguugguuuu

SEQ ID NO: 385958 - RNA, 64 nt, Homo Sapiens
gcuugggaugaaaaaggauauugcagcuucagcaguguugaacuguguguuuaaaaaugugaau

SEQ ID NO: 385959 - RNA, 64 nt, Homo Sapiens
cuguuccagagagaggugggugaugcccucacuaguguugaagcacccaccagaacagggguuu

SEQ ID NO: 385960 - RNA, 64 nt, Homo Sapiens
caaguuuaauuaccauggagucuguuaccauaugguguugaaugaaucuuauccuuugccaucu

SEQ ID NO: 385961 - RNA, 64 nt, Homo Sapiens
ugcugaagcagguggaugcuuggcuuugcaccugguguugaaccugcuguugggcacaccugga

SEQ ID NO: 385962 - RNA, 64 nt, Homo Sapiens
aaugagggcagaaguucagaccacaaaucuuaauguguugaaagaguucuccuacauucauccg

SEQ ID NO: 385963 - RNA, 64 nt, Homo Sapiens
agaaccucauacauuuauuaaauaaaggggaaugguguugaaaugggcauacaaauagaaaguu

SEQ ID NO: 385964 - RNA, 64 nt, Homo Sapiens
uuaaaaagacaagaccacuuuaauuguucaagaaguguugaacucugguccuacagccaggagc

SEQ ID NO: 385965 - RNA, 64 nt, Homo Sapiens
aaaaguuucagagaaguucucauuaacuuagcauguguugaaaaucaaaacucuccuacacuuc

SEQ ID NO: 385966 - RNA, 64 nt, Homo Sapiens
aaugugccuaugaagccacaugcuagauaaauguguguugaauggugcugugaaccuuggcaga

SEQ ID NO: 385967 - RNA, 63 nt, Homo Sapiens
aauuuauuuuucucugacuuaaaauaaaaugucaguguugaauuaaaaaugauaaaacuucag

SEQ ID NO: 385968 - RNA, 64 nt, Homo Sapiens
uagguuuacuucuugucucugcauuuagcaugguguguugaaaucagugcucacucauauccug

SEQ ID NO: 385969 - RNA, 64 nt, Homo Sapiens
aagguagaggguggggcuucuacccaagguuaggguguugaaggaugauaauuccaaaugcugu

SEQ ID NO: 385970 - RNA, 64 nt, Homo Sapiens
cuugguuccaugagccaugcauucaaaugcuguaguguugaauaaccaaccuuuaaagacugau

SEQ ID NO: 385971 - RNA, 64 nt, Homo Sapiens
augcuauauuucccaucaucaaaaaaaaaaaccaguguugaaucguaaacugacaaaaaaaaaa

SEQ ID NO: 385972 - RNA, 58 nt, Homo Sapiens; identical to SEQ ID NO: 385659

SEQ ID NO: 385973 - RNA, 64 nt, Homo Sapiens
agauccuggaaugugguaggugcucaguaaauguguguugaauaaaugaaugaaugaaugaaca

SEQ ID NO: 385974 - RNA, 64 nt, Homo Sapiens
guuuuuuuauggcauuuuuuuaaagaugcccuaaguguugaagaagaguuugcaaaugcaacaa

SEQ ID NO: 385975 - RNA, 64 nt, Homo Sapiens
uucuggaauucagaagagagcuauugaguuugcuguguugaagcuauuaaacauggaucuauaa

SEQ ID NO: 385976 - RNA, 64 nt, Homo Sapiens
uguggagaugaggucucaguauguucccaggcuaguguugaacuccugagcucaagaaauccuc

SEQ ID NO: 385977 - RNA, 64 nt, Homo Sapiens
uuucauuuccacuugugccaucuucuuugcugaaguguugaauaaggcccacgugaagaguuug

SEQ ID NO: 385978 - RNA, 64 nt, Homo Sapiens
uuacaguuuuaugaaagcauauuuuauuuacuugguguugaaauagcccucauaaaaccuaagc

SEQ ID NO: 385979 - RNA, 64 nt, Homo Sapiens
auggggcugcuuuugucacacuagcauagagaauguguugaaauuuaacuuuguaagcuuguau

SEQ ID NO: 385980 - RNA, 64 nt, Homo Sapiens
cccucaccauuuguucaugcuucaguuaauucagguguugaaggagcuuagguuuuagaggcac

SEQ ID NO: 385981 - RNA, 64 nt, Homo Sapiens
ccuguggugccaucuccccacaguguggcaggguguguugaagggggcggggacucccaggccu

SEQ ID NO: 385982 - RNA, 64 nt, Homo Sapiens
acuaaaccauaaaaguuuaagggaagugaagcuaguguugaaccaguucuuuauauaagccucu

SEQ ID NO: 385983 - RNA, 64 nt, Homo Sapiens
aauacaacaggauuuaaguuaaguaucauugcuuguguugaaaggcuuuugagcagacucugag

SEQ ID NO: 385984 - RNA, 64 nt, Homo Sapiens
gugguuuaaaccugagacuagcuacuguuuugugguguugaaaauuguuuuuguuuuccugcuu

SEQ ID NO: 385985 - RNA, 64 nt, Homo Sapiens
uucacaguuuuaaguuugauguuggguaagaauaguguugaaaaaggaaaugaaaccugaaaag

SEQ ID NO: 385986 - RNA, 64 nt, Homo Sapiens
ugugcuccccuuaaaucguggcuucguuuuugaaguguugaagcgcuuucuuucccaugauagu

SEQ ID NO: 385987 - RNA, 64 nt, Homo Sapiens
caguugaauucacuaaauuaaaaaugagcugcuuguguugaaauaaauacuuuacaccuuugac

SEQ ID NO: 385988 - RNA, 64 nt, Homo Sapiens
guuuuuguaagccuuggcauagcuuuagucuuauguguugaaauaaaaccacaacgcuguuuca

SEQ ID NO: 385989 - RNA, 64 nt, Homo Sapiens
uggaaaggacuuuguguuauggcaaaaaagaacaguguugaaauaucuggagucuuccuguagu

SEQ ID NO: 385990 - RNA, 64 nt, Homo Sapiens
uacugcagucauuuuuguaaagugcaacucaaauguguugaagacaugacuggaacgaaguagg

SEQ ID NO: 385991 - RNA, 64 nt, Homo Sapiens
gccugcaagauuucaguuuaagucuagcuaagcaguguugaaaauguagaaacucaguagagaa

SEQ ID NO: 385992 - RNA, 64 nt, Homo Sapiens
cggcugcaauuguggaccuucccuaccaaagggaguguugaaacucaagucccgcccuggcucu

SEQ ID NO: 385993 - RNA, 64 nt, Homo Sapiens
acacuccugugugcagugggcauucaguaaauguguguugaaggacugggacguacguggaggc

SEQ ID NO: 385994 - RNA, 64 nt, Homo Sapiens
agccaauuaaacaaguuucauauguauuuuuccaguguugaaucucacacacuguacuuugaaa

SEQ ID NO: 385995 - RNA, 64 nt, Homo Sapiens
cguuuagucugaguugaucuuuuuaaaacugcaaguguugaauacuagagguuguuagacccuu

SEQ ID NO: 385996 - RNA, 64 nt, Homo Sapiens
aacguaucugcuaaaucagguugaaucaugcacuguguugaauagcuguggaauauccgaugcu

SEQ ID NO: 385997 - RNA, 64 nt, Homo Sapiens
auuauaaaugguauuguguucagagauugagguaguguugaaauucucuuuggcacugucugua

SEQ ID NO: 385998 - RNA, 64 nt, Homo Sapiens
auaguugaaaguaaaaaaauuagaaacugguucuguguugaaauuucuucauuagauguuuauu

SEQ ID NO: 385999 - RNA, 64 nt, Homo Sapiens
ccucuuuuaaguuuccuuuucgaggaaucaguacguguugaaccagcaacuuucccagggugac

SEQ ID NO: 386000 - RNA, 64 nt, Homo Sapiens
guaauauucuauuuauugagaauuguuagacuuuguguugaaauauuguguagagcagcuucua

SEQ ID NO: 386001 - RNA, 64 nt, Homo Sapiens
guccaccuucuuaaauuuuuaaaugcacuugaugguguugaaauuuaacuuaaacaugucaccu

SEQ ID NO: 386002 - RNA, 64 nt, Homo Sapiens
aaaaagcaagaaucaauuacuggcccacccacuuguguugaagcucugggaggagcucccucac

SEQ ID NO: 386003 - RNA, 64 nt, Homo Sapiens
uaaauaagcuuaaacaaauagguuguggcugaugguguugaagagucuugggcuaaaauaaaca

SEQ ID NO: 386004 - RNA, 64 nt, Homo Sapiens
guggaaaucaguauuucugucacugucaugaacuguguugaaugcuucaacugaacccuaaaga

SEQ ID NO: 386005 - RNA, 64 nt, Homo Sapiens
aagaaauacuuaauauugucaaaaguacugcaacguguugaaaugugauaaguuuuggaaauuc

SEQ ID NO: 386006 - RNA, 64 nt, Homo Sapiens
cagaugcccugcuauauaaauuuguaacaguuuuguguugaaccaaacguguauuuaccuaacg

SEQ ID NO: 386007 - RNA, 64 nt, Homo Sapiens
agcaucaagucuccagaaacuacaguaagagauaguguugaaccuuuccaucaaacuucuccaa

SEQ ID NO: 386008 - RNA, 64 nt, Homo Sapiens
cucuuuccacaaguugcaaggauaaaguaacuguguguugaauaagagacucaagacaaaccaa

SEQ ID NO: 386009 - RNA, 64 nt, Homo Sapiens
cagucuugucauugccagcuguguugguagugcuguguugaauuacggaauaaugaguuagaac

SEQ ID NO: 386010 - RNA, 64 nt, Homo Sapiens
uuuugauagagguaacuuaauuugggaauuuguuguguugaaauggcauuuaauuucaaccuaa

SEQ ID NO: 386011 - RNA, 64 nt, Homo Sapiens
gaggacuauggucucaagguucaccaugagaaauguguugaacauuuuaguaugcucuauugua

SEQ ID NO: 386012 - RNA, 64 nt, Homo Sapiens
gaugucugucucccuaguguaaagccggaauucuguguugaacaaauaugcauugcaguucagc

SEQ ID NO: 386013 - RNA, 64 nt, Homo Sapiens
uccuuuuuaugcaucaaacguuaacaacguguuuguguugaauugcgcaucuucuggcacgguu

SEQ ID NO: 386014 - RNA, 64 nt, Homo Sapiens
guucugacugcacaaaccagcaaggcucccugccguguugaagacaaagaaaggacauucagcu

SEQ ID NO: 386015 - RNA, 64 nt, Homo Sapiens
ugggaaggauuugcagggcuuguaaguguucgagguguugaagacuagaagauaaaccaggcaa

SEQ ID NO: 386016 - RNA, 64 nt, Homo Sapiens
aggauucauuuuacuuagcaugaaugggaaacuaguguugaaauaaacaucugaauaacaacga

SEQ ID NO: 386017 - RNA, 64 nt, Homo Sapiens
ccccaacuacuauuguagaguuauugaaagugggguguugaagaccuuaaguggcugugauuaa

SEQ ID NO: 386018 - RNA, 64 nt, Homo Sapiens
ucagcuggggaauugaagccgagaacuaaauaaaguguugaacacaaauguuuaaaauccaaau

SEQ ID NO: 386019 - RNA, 64 nt, Homo Sapiens
ucagcuggggaauugaagccgagaaguaaauaaaguguugaacaggaaaauuuaaaauucaagu

SEQ ID NO: 386020 - RNA, 64 nt, Homo Sapiens
ucaacuggggaauugaagccgagaacuaaauaaaguguugaacacaaauguuuaaaauccaaau

SEQ ID NO: 386021 - RNA, 64 nt, Homo Sapiens
cgcuaagaacaauuugaauuuugugugaaugguuguguugaacauugccauauaucuguauuac

SEQ ID NO: 386022 - RNA, 64 nt, Homo Sapiens
cugucuuuaaacuagaaaaauccccuguucuuaaguguugaauaaugccuuuauaagcucaguu

SEQ ID NO: 386023 - RNA, 64 nt, Homo Sapiens
gacuuaucuaugugggauauguugucaugaggcuguguugaaguaguacuguuuugguguggga

SEQ ID NO: 386024 - RNA, 64 nt, Homo Sapiens
auuacuguagaucaaguuuguaacuuagcaugugguguugaagugaguguuuuuuuuacacuuu

SEQ ID NO: 386025 - RNA, 64 nt, Homo Sapiens
gcccaauauuacuauauuauaguggcauaccauuguguugaaaauuugucugcuuugacauuac

SEQ ID NO: 386026 - RNA, 64 nt, Homo Sapiens
uauuccuguuuauuuuucuaaucacuuuuuguaaguguugaauauacuuuauauucuuuaucau

SEQ ID NO: 386027 - RNA, 64 nt, Homo Sapiens
uaaaaaaaaaauacuuuacuuauuauguuccuguguguugaauuuuuuaaaaaaaaacaaugua

SEQ ID NO: 386028 - RNA, 64 nt, Homo Sapiens
aauaugaagaaaaccaagaauguuuuguugggcuguguugaacauuauuucuuuguaaaugaau

SEQ ID NO: 386029 - RNA, 64 nt, Homo Sapiens
augcuacuguucucuuucaaaaggaagagcaaccguguugaauacuaauaaugaugaauuagua

SEQ ID NO: 386030 - RNA, 64 nt, Homo Sapiens
cuauuaauuuacucuugauuaucaaacauuaccaguguugaacuauuaaaagcacacaaugugu

SEQ ID NO: 386031 - RNA, 64 nt, Homo Sapiens
cugauugguccaacaguuugaugcugagucaugcguguugaaucccacuucagugcaccugugg

SEQ ID NO: 386032 - RNA, 64 nt, Homo Sapiens
gguugcaaucauucauacuaguuagaaaaauuauguguugaaauaaguggaaaagugcaaucca

SEQ ID NO: 386033 - RNA, 64 nt, Homo Sapiens
cuugguuguggcaaacaaacaaaaaaugcuuucaguguugaaauaucucuauuuuccaaagaug

SEQ ID NO: 386034 - RNA, 64 nt, Homo Sapiens
uacuuauuucaacaauucuuagagaugcuagcuaguguugaagcuaaaaauagcuuuauuuaug

SEQ ID NO: 386035 - RNA, 64 nt, Homo Sapiens
aauggauuugucuguugaacuucaugcuguccaaguguugaaaagucaauuuuauuucauugca

SEQ ID NO: 386036 - RNA, 64 nt, Homo Sapiens
caacaguuccucuuucccgaguaaggugguugggguguugaaguaccaaguaaccuacaagccu

SEQ ID NO: 386037 - RNA, 64 nt, Homo Sapiens
gggaacuuuaaagaagaaaagaaaaacuugaauuguguugaauuacuguaucuuuuacuuuuuu

SEQ ID NO: 386038 - RNA, 64 nt, Homo Sapiens
uuauaaauaaaauucuagcuuugaaaggcguuauguguugaacaguaugcuucagggguaaauu

SEQ ID NO: 386039 - RNA, 64 nt, Homo Sapiens
ggccgaggacgaguggucacacuccaaagcccuuguguugaaaacccgauaacagcccaucaca

SEQ ID NO: 386040 - RNA, 64 nt, Homo Sapiens
uucugcuuguguauucucucucaccagguaagcgguguugaacuguggaaacgcuuguaggguu

SEQ ID NO: 386041 - RNA, 64 nt, Homo Sapiens
auaucccuuacaggcaaaacgcccugcuaguugcguguugaauuuuuuuuuccccucuccuguu

SEQ ID NO: 386042 - RNA, 64 nt, Homo Sapiens
auuuuuaauuuuuuaaaugaacuuaguuuuugaaguguugaaguauuuuccaaacuaaguggag

SEQ ID NO: 386043 - RNA, 64 nt, Homo Sapiens
cccacguguuuuacacagaacuauauuuauagcaguguugaaaauauaacuccaggugacguuu

SEQ ID NO: 386044 - RNA, 64 nt, Homo Sapiens
uguuuuuguuucugacuugaauaauuuaucaaugguguugaauaaaagcaaguucaauaauguc

SEQ ID NO: 386045 - RNA, 64 nt, Homo Sapiens
gauaucaccucucuucagccccuagugcuauucuguguugaacacaauugauacuucaggugcu

SEQ ID NO: 386046 - RNA, 64 nt, Homo Sapiens
uggugucuaguguuuuuuucccucuccuguccuuguguugaaggcaguaaacuaagggugucaa

SEQ ID NO: 386047 - RNA, 64 nt, Homo Sapiens
ggaaauuaaugaauaaacauuuugaguuucccuaguguugaaggaagguguacuuuuucuuguc

SEQ ID NO: 386048 - RNA, 64 nt, Homo Sapiens
cagaaggaaaaaaagcagcgcugguugacaaaggguguugaagauuuuugcugcagaaucaguu

SEQ ID NO: 386049 - RNA, 64 nt, Homo Sapiens
uagggaagacacuucacaaauuaugaaugaucauguguugaaagccacauuauuuuaugcuaua

SEQ ID NO: 386050 - RNA, 64 nt, Homo Sapiens
ccuaaauagcgccccauuugggaacagagcaagaguguugaacugaagaccaaaaugcccucaa

SEQ ID NO: 386051 - RNA, 64 nt, Homo Sapiens
uacaaaacuaggucuuguuuuguaaucuuuucucguguugaaucagaucugcuuacuuauuuag

SEQ ID NO: 386052 - RNA, 64 nt, Homo Sapiens
agcuguguuaaugccuuuauuccaaauaacuguuguguugaaucgcuuucucacauuuuccauu

SEQ ID NO: 386053 - RNA, 64 nt, Homo Sapiens
ggaugauuucuaugcugaguguauagauuagagaguguugaaacucuguauagauuagaauucu

SEQ ID NO: 386054 - RNA, 64 nt, Homo Sapiens
aaguguucagauggauaagguggcacauggguugguguugaauggaccaguggauuuuuuuacc

SEQ ID NO: 386055 - RNA, 64 nt, Homo Sapiens
auaucuuugcaucauagaacguugcaccaauuaaguguugaaaauaugacacaaugacacauuu

SEQ ID NO: 386056 - RNA, 64 nt, Homo Sapiens
uccugcagucacagggucaggagggagagggggcguguugaacagaguagauugcacauggagg

SEQ ID NO: 386057 - RNA, 64 nt, Homo Sapiens
cauacugcuuguguaucagauaucagguaucaguguguugaauaauucuuuuuuccugacaugc

SEQ ID NO: 386058 - RNA, 64 nt, Homo Sapiens
uuaaaugugauaaccuuugagaagaaggugauaaguguugaaaaaucuccauaaauugagagaa

SEQ ID NO: 386059 - RNA, 64 nt, Homo Sapiens
caacugaaggcgaggaaugucuacucccuuaacaguguugaauuccugacccaagucuuugccu

SEQ ID NO: 386060 - RNA, 64 nt, Homo Sapiens
ucucauuuacaggucagauagaggcuugggggagguguugaaaugagaucacgcgccgcgccgc

SEQ ID NO: 386061 - RNA, 64 nt, Homo Sapiens
uguaaagcuuuuaugacucugauuguguguauguguguugaaacguaaagauuuuuaauucugu

SEQ ID NO: 386062 - RNA, 64 nt, Homo Sapiens
cucuuaaaggaaugcuugaaacauuuagcuuguaguguugaauuuacgaauacacucagaaagu

SEQ ID NO: 386063 - RNA, 64 nt, Homo Sapiens
aggaaguauccuaguauguaguuuguaggugcauguguugaaaugguuaugugcauggccaugu

SEQ ID NO: 386064 - RNA, 64 nt, Homo Sapiens
cuuuuuaggaaauuuugacagaaaagauacuacuguguugaaagaauaguuauauucaguacau

SEQ ID NO: 386065 - RNA, 64 nt, Homo Sapiens
ugggaagagcauuuguagguauggcuuuugguuaguguugaagguguuguauguaauacucaca

SEQ ID NO: 386066 - RNA, 64 nt, Homo Sapiens
auccaagauguucuguaucuuuuguguugcuaugguguugaaauuuauacaugaagaaauuaau

SEQ ID NO: 386067 - RNA, 64 nt, Homo Sapiens
ugcucccuggcggcccccaaauuguccuguaaggguguugaagaagggaacacacggguccuuc

SEQ ID NO: 386068 - RNA, 64 nt, Homo Sapiens
cugcaggugcagaggggucagcagcaggagaagcguguugaacacguggcucucagacacuccu

SEQ ID NO: 386069 - RNA, 64 nt, Homo Sapiens
uuaaguauuccaggguuuggggucaacacgugaaguguugaauuuuaaaaaauacaaaaagcag

SEQ ID NO: 386070 - RNA, 64 nt, Homo Sapiens
guguguaugauggaugugaccauuuauaugucauguguugaaauuaaagggugucuggaugcca

SEQ ID NO: 386071 - RNA, 64 nt, Homo Sapiens
gaaugccagccucucuugucccugguuuccuuauguguugaaugugguugaguuuguccauugc

SEQ ID NO: 386072 - RNA, 64 nt, Homo Sapiens
aucccuguuuugaaauacguaaacagccuaaaauguguugaaauuauuuuguaaauccaugacu

SEQ ID NO: 386073 - RNA, 64 nt, Homo Sapiens
accucuaaauucuuucauuuuagggguagcauuuguguugaagagguuuuaaagcuuccauugu

SEQ ID NO: 386074 - RNA, 64 nt, Homo Sapiens
auguguuugguuccagccuaaaaaugauuuuguaguguugaaaucauagcuacuuacauagcuu

SEQ ID NO: 386075 - RNA, 64 nt, Homo Sapiens
uuaaaccuuucaagaagguuauuuagcuagcuuaguguugaacuaaauuuuuuuuaaacaaggc

SEQ ID NO: 386076 - RNA, 64 nt, Homo Sapiens
uacagaaaaagcacacagauggcuugucucaggaguguugaaugugugccccgcugcugucugg

SEQ ID NO: 386077 - RNA, 64 nt, Homo Sapiens
aaaauugugaacacccccacccccgcauuuuuguguguugaaauucuugaagguuacauuaaau

SEQ ID NO: 386078 - RNA, 64 nt, Homo Sapiens
gugauuuaaaaaugccagcaauuuuaaucuagcaguguugaagcugggaauuuuuuggcgcaau

SEQ ID NO: 386079 - RNA, 62 nt, Homo Sapiens; identical to SEQ ID NO: 385766

SEQ ID NO: 386080 - RNA, 64 nt, Homo Sapiens
uucauuaagaaauaaagucccuaucuuuuccucaguguugaacuauugugagucaacgacuuug

SEQ ID NO: 386081 - RNA, 64 nt, Homo Sapiens
ucugauucuacaaaggccaauaauuuauuagauuguguugaagggaccuuuucagcucccuagc

SEQ ID NO: 386082 - RNA, 64 nt, Homo Sapiens
uuuaguuuuuacucuuuguuugcuuuuuaauaauguguugaaguauuguaguugaguccaguuu

SEQ ID NO: 386083 - RNA, 64 nt, Homo Sapiens
uaucauguaauuuauugaauuauuuuauaaucgaguguugaauagaaucaucuaacacaaacuc

SEQ ID NO: 386084 - RNA, 64 nt, Homo Sapiens
augggaacagcccagugcagucuaaacuucaauuguguugaaacuacuuuaauagacaaaguaa

SEQ ID NO: 386085 - RNA, 64 nt, Homo Sapiens
acacucuccuuagagccgacagguugauccugcuguguugaaggcugugguuaauaaaacacaa

SEQ ID NO: 386086 - RNA, 64 nt, Homo Sapiens
ucaagauuauauuauaauaauguucucuggguagguguugaaaaugagccuguaauccucagcu

SEQ ID NO: 386087 - RNA, 64 nt, Homo Sapiens
augggaugaacguuuuacugcuacacccagauuuguguugaacgaaaacauugugguuuggaaa

SEQ ID NO: 386088 - RNA, 64 nt, Homo Sapiens
cuaaguugugaacaagaguguuuuuauagcauauguguugaaguaacagcuugugcccgagaaa

SEQ ID NO: 386089 - RNA, 64 nt, Homo Sapiens
agaaggcauuuuggaguacacuuaucucuuguuuguguugaacugaaggcuaagucucagugga

SEQ ID NO: 386090 - RNA, 64 nt, Homo Sapiens
gcacuugacaugcggucaccgguggcagcgcgguguguugaagggaaacgguagcuauucauuc

SEQ ID NO: 386091 - RNA, 64 nt, Homo Sapiens
ucauucauuguuuuuuaucuuaguuugcagaaagguguugaaaugcuucucuagcccaaacagc

SEQ ID NO: 386092 - RNA, 64 nt, Homo Sapiens
uuuaaggaauagagccuaauuagcgcaugaauacguguugaacugugaaugaaucaaugaguau

SEQ ID NO: 386093 - RNA, 64 nt, Homo Sapiens
cuaccagauuccaggaggcagaagauaacuaauuguguugaagaaacuuagacuucacccacca

SEQ ID NO: 386094 - RNA, 64 nt, Homo Sapiens
guccccuuaccugggugggaaauaaauuucugcuguguugaagcuaguuauuuggggugucugu

SEQ ID NO: 386095 - RNA, 64 nt, Homo Sapiens
cagcacgucugugugaguaagagauucagcguggguguugaaucccaccuccguggaauaaaug

SEQ ID NO: 386096 - RNA, 64 nt, Homo Sapiens
acucggcuagcaucagcaccugacauuuagaguaguguugaaauguaccuugcuacaguauuuc

SEQ ID NO: 386097 - RNA, 64 nt, Homo Sapiens
ucaauaccaaauacaguaaagaccaggguagagaguguugaaaucuuuucuagagcagcugugc

SEQ ID NO: 386098 - RNA, 64 nt, Homo Sapiens
aaaaagacccaaauuacugcgaaaaugcugcguuguguugaauggucuuuugugaauuuauuau

SEQ ID NO: 386099 - RNA, 64 nt, Homo Sapiens
gggccuuugagaaucagacuaauuuugguagcugguguugaauaaggaauagagggaggagugu

SEQ ID NO: 386100 - RNA, 64 nt, Homo Sapiens
uaguauguaucuagaauacucuaaaguccagguaguguugaagaaccaaauuuaaguugaugac

SEQ ID NO: 386101 - RNA, 64 nt, Homo Sapiens
uuuugugggaaaaaaaaaucaaguucuagcuuaaguguugaaacuagggcaaaguuaacacuga

SEQ ID NO: 386102 - RNA, 64 nt, Homo Sapiens
cucuugauaucaugugcuugaaauggaauccacuguguugaagauucuauuuuuuuucuuaaua

SEQ ID NO: 386103 - RNA, 64 nt, Homo Sapiens
auccauugcauccauuuuuucacaucucucagauguguugaagcgacauauuguguuaugaaug

SEQ ID NO: 386104 - RNA, 59 nt, Homo Sapiens; identical to SEQ ID NO: 385791

SEQ ID NO: 386105 - RNA, 64 nt, Homo Sapiens
uguaguaauauuuucagacguuuccccaauaaguguguugaagcauacaucuuuacgcugcuaa

SEQ ID NO: 386106 - RNA, 64 nt, Homo Sapiens
aagaccugaauaucuuuccuaguaaaaauaggauguguugaaauauuuauauguacuuugaucu

SEQ ID NO: 386107 - RNA, 64 nt, Homo Sapiens
aaaccauuuaacacaaagccuauuuuauaaugaaguguugaauagcucauguuauuuacugaau

SEQ ID NO: 386108 - RNA, 64 nt, Homo Sapiens
uaagaagucaaggauguaagucuauuaggacugaguguugaauggucuugauggugaagaagga

SEQ ID NO: 386109 - RNA, 64 nt, Homo Sapiens
augcaacuuuuuauuuaaaaaagggguugccaugguguugaacaggguccaaaaaugcugaucu

SEQ ID NO: 386110 - RNA, 64 nt, Homo Sapiens
accccauccccucacguucuaaaaggacaguucuguguugaaaccaggugagcccugaaaacac

SEQ ID NO: 386111 - RNA, 64 nt, Homo Sapiens
ucuuuagcuggggugaccuguagccuuuuggcugguguugaauggaacccuucaaacuaaacuu

SEQ ID NO: 386112 - RNA, 64 nt, Homo Sapiens
uaguuuuggauuagaaaugauuuauguuagccauguguugaagaugaaauuggcaucaguguag

SEQ ID NO: 386113 - RNA, 64 nt, Homo Sapiens
cauuuuuauuucagauuuugauaacuguuuauauguguugaaaaccaaaaugacaucuuuuuaa

SEQ ID NO: 386114 - RNA, 64 nt, Homo Sapiens
gaaaaagaagcuuuucuagggguuuguauaaauaguguugaaacuuuauuuuauguauuuaauu

SEQ ID NO: 386115 - RNA, 64 nt, Homo Sapiens
uguuaaaauuccaauuuguuuuauaugcaggugaguguugaaaccagguugauuuuuuauuuua

SEQ ID NO: 386116 - RNA, 64 nt, Homo Sapiens
uuccuuuuugccaguuaugucuaaacuacuuguuguguugaaagugacauaaaaaaaaaaaaaa

SEQ ID NO: 386117 - RNA, 64 nt, Homo Sapiens
uguugcauguccauguuagacugcggugagcguaguguugaauaagaaggcuuuuccaagcaaa

SEQ ID NO: 386118 - RNA, 64 nt, Homo Sapiens
acuacauuugcuguacauauuuugauaaauagauguguugaauuucuucauugcaguggauuga

SEQ ID NO: 386119 - RNA, 64 nt, Homo Sapiens
uaaagauggggggccgcggggacggacuguguguguguugaaaguuuaaggagggcaguucugc

SEQ ID NO: 386120 - RNA, 64 nt, Homo Sapiens
cuuuugcucauauaaacaaguggccagaaaacugguguugaaggggcaaaauucuagggaaacu

SEQ ID NO: 386121 - RNA, 64 nt, Homo Sapiens
uuacaagggcuuuuauaaaauguauucauaagaaguguugaacaucuaaacaacuuaauuugcu

SEQ ID NO: 386122 - RNA, 64 nt, Homo Sapiens
uacaagagcuagaaaacugaucauugauguugcaguguugaaacacugauucuggacauaugca

SEQ ID NO: 386123 - RNA, 64 nt, Homo Sapiens
agcuugcauuaauuguauauuuuggauucuguuuguguugaauuuuuuaaucauugugcacaga

SEQ ID NO: 386124 - RNA, 64 nt, Homo Sapiens
gaguacuccaucucuccaaauguauuuccauaauguguugaaaacaugcuaacauuuguaugau

SEQ ID NO: 386125 - RNA, 64 nt, Homo Sapiens
cucaaagugauguaaugugaucacagcuuuuguuguguugaaugaaaauauguggacugucauu

SEQ ID NO: 386126 - RNA, 64 nt, Homo Sapiens
auauauuuugaacuaacagaacuuggcagaauguguguugaauauucuuuacauuuaacaauua

SEQ ID NO: 386127 - RNA, 64 nt, Homo Sapiens
gauccuuuguacagauaaagguuauagauuucuuguguugaauauuaaaaaagcaaggaugucu

SEQ ID NO: 386128 - RNA, 64 nt, Homo Sapiens
caugguaacuaguaugcucuuugagauuuuuacaguguugaaacuuaagaauuuugagagggug

SEQ ID NO: 386129 - RNA, 64 nt, Homo Sapiens
uggcuauguaauucuuguaauuuuuauuuaggaaguguugaagggagguggcaagaguguggag

SEQ ID NO: 386130 - RNA, 64 nt, Homo Sapiens
auugcccuauccuugugucuccacccccuuccauguguugaauaauaaaaggugggaaagugcu

SEQ ID NO: 386131 - RNA, 64 nt, Homo Sapiens
uuaaaaacuuguauguuuuugcaaaucccuggaaguguugaauugguuaaaauuuuacauuuuc

SEQ ID NO: 386132 - RNA, 64 nt, Homo Sapiens
aauuaauuguguaauucagaauucauaccaaucaguguugaaacucaaacauugcaaaaguggg

SEQ ID NO: 386133 - RNA, 64 nt, Homo Sapiens
cuucacucugcugaagcuccccugccuguuugcuguguugaacuucacauauacaaaggagcug

SEQ ID NO: 386134 - RNA, 64 nt, Homo Sapiens
uuuuaguaaguugaguaagcuuaaaucuuuuuugguguugaaacuuucagaacuuucagccaag

SEQ ID NO: 386135 - RNA, 64 nt, Homo Sapiens
uucuuccuggagcagaugucugagaugaauuuugguguugaaagacuuuucccaucuguaaaau

SEQ ID NO: 386136 - RNA, 64 nt, Homo Sapiens
acuggacuuggauauggggucagagguagcugugguguugaaacagaaaugucgcuccacuuua

SEQ ID NO: 386137 - RNA, 64 nt, Homo Sapiens
gggacacuggggagaaagggugguagcgugcacgguguugaacugcccgugcgccguuucuccu

SEQ ID NO: 386138 - RNA, 64 nt, Homo Sapiens
uacuacggugugguaguaguuaguaaaaggcaaaguguugaagacaacuuccauauucuucaua

SEQ ID NO: 386139 - RNA, 64 nt, Homo Sapiens
acgccagaagaccugaaaugagcaguguauuaagguguugaauuuuucacuagaaaaggcagaa

SEQ ID NO: 386140 - RNA, 64 nt, Homo Sapiens
ugggacccugaggaauucacugacaucacggaaaguguugaaccucaucccugacugaguacuc

SEQ ID NO: 386141 - RNA, 64 nt, Homo Sapiens
uuuuuuucuuuuuucuuuuuuuuuauuugaagccguguugaaauccuugucuccuguagaccca

SEQ ID NO: 386142 - RNA, 64 nt, Homo Sapiens
aauguuuuuguuuuuauauccuuuuagcucuuaaguguugaacacuguugacagugaagaacuu

SEQ ID NO: 386143 - RNA, 64 nt, Homo Sapiens
aauuguuucucacccugcugauucugugguaucuguguugaauaaagaaaaagguagcagugcu

SEQ ID NO: 386144 - RNA, 64 nt, Homo Sapiens
aaagcaaauguggacugaaucugcuuguugaucaguguugaagaaagugcaaaaggaacuuuua

SEQ ID NO: 386145 - RNA, 64 nt, Homo Sapiens
uguuuugaagugaauaaaaucuuuguaaauagguguguugaauuaaaagugggcucuggaaucc

SEQ ID NO: 386146 - RNA, 64 nt, Homo Sapiens
gaccaagguugcaaggccaguuauagcuuauuagguguugaagauaaaagauuauuugggccag

SEQ ID NO: 386147 - RNA, 64 nt, Homo Sapiens
agaauggaaaugacaagaaauguauuguucugcaguguugaaaccuucgccauugggccuccag

SEQ ID NO: 386148 - RNA, 64 nt, Homo Sapiens
acuucucauuuuuggagcuuaguaauggaaaaugguguugaagggucauugauuuggugagaac

SEQ ID NO: 386149 - RNA, 64 nt, Homo Sapiens
cacaggguuugguuucgaauacguaaauguuuggguguugaagucuguacaguaaaacguaaga

SEQ ID NO: 386150 - RNA, 64 nt, Homo Sapiens
uucaaauaauguucauuacauguuaaccuuucauguguugaauguacaccaaguucauagccuu

SEQ ID NO: 386151 - RNA, 64 nt, Homo Sapiens
cuagguuacuuauaaugcaaacaugcuaauauggguguugaaaaaagguuagaaaaccacgccc

SEQ ID NO: 386152 - RNA, 64 nt, Homo Sapiens
auuuuaauacaauauuaaauacgguuuuaguucaguguugaagauuucaaacuaacaaauguau

SEQ ID NO: 386153 - RNA, 64 nt, Homo Sapiens
agugcaggggguugggaggauuuaaaugaauaagguguugaaagggaagagaaaguuccauuca

SEQ ID NO: 386154 - RNA, 64 nt, Homo Sapiens
cuuucugcuuguuuugauucguuaugaacagcaaguguugaacuuacguuaaauuuucagucca

SEQ ID NO: 386155 - RNA, 64 nt, Homo Sapiens
agcaaaggccggcggagaggccgcgugugggagcguguugaagauuuuaaguggucucuacacc

SEQ ID NO: 386156 - RNA, 64 nt, Homo Sapiens
uucuauauuuuguaauucuggaugaaagauaacuguguugaacaaacaggugcuccaggcuuug

SEQ ID NO: 386157 - RNA, 64 nt, Homo Sapiens
uuugagaguaaugcauacagaaauauaauaaaauguguugaaacugcaugaacauacuauuuuu

SEQ ID NO: 386158 - RNA, 64 nt, Homo Sapiens
ccugucaugaauccuugguacaagcccccauuguguguugaaaucuggguaauuauaccucucc

SEQ ID NO: 386159 - RNA, 64 nt, Homo Sapiens
ugagccagguacauaacgcguguucaugguuaguguguugaagauguccccuaauggcuauuag

SEQ ID NO: 386160 - RNA, 64 nt, Homo Sapiens
acauuuuuucuuuugaccaaaaagaugacaagcuguguugaaauaauuaugauugauuuuuucc

SEQ ID NO: 386161 - RNA, 64 nt, Homo Sapiens
aguugcauuuauugcagcaaguuacaaagggaaaguguugaagcuuuucauauuugcugcguga

SEQ ID NO: 386162 - RNA, 64 nt, Homo Sapiens
cuguccaggcacagcuccguccccagcgcucaugguguugaaacugucugucaugcaccacggu

SEQ ID NO: 386163 - RNA, 64 nt, Homo Sapiens
agagugcgucagcagaccuguccuggccuggcugguguugaaauacacaccgguuugcccaagu

SEQ ID NO: 386164 - RNA, 64 nt, Homo Sapiens
auaaagugcaauacuuuauuggcuacaucauuuuguguugaauauguaccuguauguuacuguu

SEQ ID NO: 386165 - RNA, 64 nt, Homo Sapiens
cuucacuuuauuuuguuguucuaaacugccccaaguguugaaguaaaauggugaaagcuuccuu

SEQ ID NO: 386166 - RNA, 64 nt, Homo Sapiens
uuuauuucaaaaaaaauguauuuuucugccuuggguguugaauuagucggaguuuuaguaaauu

SEQ ID NO: 386167 - RNA, 64 nt, Homo Sapiens
agucaauauuuucgauuauguuuugcuuagaucaguguugaacuaaguuggcauagcacacacu

SEQ ID NO: 386168 - RNA, 64 nt, Homo Sapiens
aaauucuuugucuaauauauuggagucuuuaaaaguguugaagaauaaaauauuaauuagaaca

SEQ ID NO: 386169 - RNA, 64 nt, Homo Sapiens
uuaucagaccauuuuguaaauaaaggcagaauuuguguugaagauucuuauaugaauaaccuuc

SEQ ID NO: 386170 - RNA, 64 nt, Homo Sapiens
uuuuuuuguaugucuuuuuuuuuuuuaagcaaucguguugaauuaggaguauacuuggugugga

SEQ ID NO: 386171 - RNA, 64 nt, Homo Sapiens
uucaguacucacucuucuugcuuaggcucucuguguguugaaagccaucccguguugcaugugu

SEQ ID NO: 386172 - RNA, 64 nt, Homo Sapiens
aacauugaaagucagaauugaucauauuuuuucgguguugaaaccucauaccaaagaauaagcc

SEQ ID NO: 386173 - RNA, 64 nt, Homo Sapiens
aggggggauauugcuguccucuucccaaagguggguguugaacuucucccccacccucuuuucc

SEQ ID NO: 386174 - RNA, 64 nt, Homo Sapiens
uuauucuuguacauucauucccuuuugcacugauguguugaaccagucauguaaauucauaaau

SEQ ID NO: 386175 - RNA, 64 nt, Homo Sapiens
gaauuugcaucugcacagucagcagagauaacaaguguugaacugaccuugccacaugcuuagu

SEQ ID NO: 386176 - RNA, 64 nt, Homo Sapiens
cagccuagaaguccaaucacccuguaauaaauauguguugaaugaagaaaugggugaaugagcu

SEQ ID NO: 386177 - RNA, 64 nt, Homo Sapiens
gagccuuacucccaaaguaccugcucacuguuccguguugaacaauugccgguguuuccucucu

SEQ ID NO: 386178 - RNA, 64 nt, Homo Sapiens
gcauauuagacauucuuaacagggcggcagucuaguguugaaaguuuuauuuuuccauuuuucu

SEQ ID NO: 386179 - RNA, 64 nt, Homo Sapiens
uguucuugagcugccucuuaggaaacagaagacaguguugaaguuuucccugcuucugguuugc

SEQ ID NO: 386180 - RNA, 64 nt, Homo Sapiens
cuguuauuuuacuauauauaaauauuaaaauauuguguugaaguauagggauguauuuaauuuu

SEQ ID NO: 386181 - RNA, 64 nt, Homo Sapiens
gacaguccaagcccuggauaaugcuuuacuuucuguguugaagcacuguugguuguuugguuag

SEQ ID NO: 386182 - RNA, 64 nt, Homo Sapiens
uugucaaagaggauggacuaaaugaucucugaaaguguugaagcgcggacccuucuggguccag

SEQ ID NO: 386183 - RNA, 64 nt, Homo Sapiens
aacccaagaucggaaugcaaagaguggaagaauuguguugaauaguguuuguacuuuguugugu

SEQ ID NO: 386184 - RNA, 64 nt, Homo Sapiens
gaauuguuuacuuuggaauauguuuaagucuugaguguugaaaguauaacccucuaagaauacc

SEQ ID NO: 386185 - RNA, 64 nt, Homo Sapiens
aauggugaugcuuauuacaauacacaguauuacaguguugaagucagaccucuucuccucaugg

SEQ ID NO: 386186 - RNA, 64 nt, Homo Sapiens
ucuaaaguaugugaugucuucaucauaguaugaaguguugaaaauuaauaacgagccuaguuua

SEQ ID NO: 386187 - RNA, 64 nt, Homo Sapiens
aaucaaaaacagaguuuucuguguuuccaugauaguguugaagccuaaugacaagccaggucuu

SEQ ID NO: 386188 - RNA, 64 nt, Homo Sapiens
agacaaguuauuuagccauucaccuagagaguaaguguugaagccagagccaccuccaacucug

SEQ ID NO: 386189 - RNA, 64 nt, Homo Sapiens
uuaagagauggccgcugugugcuggucacaggaaguguugaauggauuggcuugcaaagggggu

SEQ ID NO: 386190 - RNA, 64 nt, Homo Sapiens
gcuuucaaguuaguuauuucagucaggauauacaguguugaaaucucaaugcaguugaaaucug

SEQ ID NO: 386191 - RNA, 64 nt, Homo Sapiens
uuacaacacaaugauuuuccagacaaaugguaugguguugaaaaauaacuguuacuucuuaaag

SEQ ID NO: 386192 - RNA, 64 nt, Homo Sapiens
gauguugcuucugaaucacuguugaguucugauuguguugaagaaggguuauccuuucauuagg

SEQ ID NO: 386193 - RNA, 64 nt, Homo Sapiens
guugucauguggaaccugcuuuauccauugcugaguguugaauguggguaaugguuagggcuuu

SEQ ID NO: 386194 - RNA, 64 nt, Homo Sapiens
aguguaguuuuccuuuuguguaauuuuaaagucaguguugaauuuuauugaaagcucaugaugc

SEQ ID NO: 386195 - RNA, 64 nt, Homo Sapiens
cccgagaaauuugucuuuuuguauaaaugacaaaguguugaaaauguauuuccugaaauaaaug

SEQ ID NO: 386196 - RNA, 64 nt, Homo Sapiens
ccugaaagauaacacuccuuagggucuggacuagguguugaagauucagacaacuuucucugga

SEQ ID NO: 386197 - RNA, 64 nt, Homo Sapiens
cuuaccaaguccugggaauacacagcacuacgauguguugaaugguucccacuccauacuuucc

SEQ ID NO: 386198 - RNA, 64 nt, Homo Sapiens
aggaagguuuaaggagaauccaaccuggccuuugguguugaaauccuuaagacaucugaagcug

SEQ ID NO: 386199 - RNA, 64 nt, Homo Sapiens
ccagaaccugaauccauccccuuuggcucacucuguguugaaacacugagccuguucaccuggu

SEQ ID NO: 386200 - RNA, 64 nt, Homo Sapiens
cuggaaaaaauaacucauccaaaaaucuuuauugguguugaaaaucugaugugguggcuuuugc

SEQ ID NO: 386201 - RNA, 64 nt, Homo Sapiens
cacgacagccacugcucuacacugauucaaccagguguugaagguugaguuucgauguugauga

SEQ ID NO: 386202 - RNA, 64 nt, Homo Sapiens
gcauucuuguaauauccccucagaaugggcuaaaguguugaauuuuaauucaaacuguuuuguu

SEQ ID NO: 386203 - RNA, 64 nt, Homo Sapiens
uuaguuuucuuuuaacaugcgggugaauggauguguguugaauuuaaugcuuggaguagucugu

SEQ ID NO: 386204 - RNA, 64 nt, Homo Sapiens
accaaauagauaucauguuaauuaccaccaagaaguguugaaacaccaaguuucccccuuuuga

SEQ ID NO: 386205 - RNA, 64 nt, Homo Sapiens
acagggauucucacaauagccgauaucagaauuuguguugaaggaacuugucucuucaucuaau

SEQ ID NO: 386206 - RNA, 64 nt, Homo Sapiens
uaugucuuuuuaaaugguccauuuucaaaagacaguguugaauaaacauaccugugugauaaaa

SEQ ID NO: 386207 - RNA, 64 nt, Homo Sapiens
gcccuaugaaguagcaauuuuuuggaggcaaaauguguugaagucacuaccaaauucauuugac

SEQ ID NO: 386208 - RNA, 64 nt, Homo Sapiens
cuucaacaaaugugucauucaccauccagagaugguguugaaucaaagccuaaaauauauuuua

SEQ ID NO: 386209 - RNA, 64 nt, Homo Sapiens
caaauguaaacauaaggguauguagcggauggcaguguugaagguauaacacuagggaaaaauu

SEQ ID NO: 386210 - RNA, 64 nt, Homo Sapiens
uccucaggcucaugauaacuaaucuauaaagcauguguugaaaaagaauuaauagagagaaaaa

SEQ ID NO: 386211 - RNA, 64 nt, Homo Sapiens
uuaaaauaaagcaaaucugcuggcuuuguucuugguguugaaaauuuaguuguuuauuuuugac

SEQ ID NO: 386212 - RNA, 64 nt, Homo Sapiens
gugcaggcuucugccugggccccaggcccugccuguguugaaagcucuggggacugggccaggg

SEQ ID NO: 386213 - RNA, 64 nt, Homo Sapiens
ggugaaccccagguccucaacucccccccuuuauguguugaaaguuaaugguuucagaugugaa

SEQ ID NO: 386214 - RNA, 64 nt, Homo Sapiens
ggacccuugggggcggggagacuggguggggaggguguugaauaaaagggaaaauaaauguguc

SEQ ID NO: 386215 - RNA, 64 nt, Homo Sapiens
ggauauaaaugcacguccucuggcuguaaggaauguguugaaaccuuucacucugccuuauacc

SEQ ID NO: 386216 - RNA, 64 nt, Homo Sapiens
acaugaaaugacucacuagagaaaaccccuaugaguguugaacaugugagaaagccuuaaguac

SEQ ID NO: 386217 - RNA, 64 nt, Homo Sapiens
auagaggcgggguuucgccauguugcacuggcugguguugaacuccuaaccucaggugauccac

SEQ ID NO: 386218 - RNA, 64 nt, Homo Sapiens
ugagauuuuaauucgcauuuuccagugacuaaggguguugaaccacucgugccuuccugugccu

SEQ ID NO: 386219 - RNA, 64 nt, Homo Sapiens
uguaaagucaagagaagaauguauacacauauguguguugaauaauuacuauuggcauagguau

SEQ ID NO: 386220 - RNA, 64 nt, Homo Sapiens
ccaaaauggucaggacuuuaauggaggaggugagguguugaaagcacaggcagaguggucaggg

SEQ ID NO: 386221 - RNA, 64 nt, Homo Sapiens
cagggcugugaacggaguggguggcagcaaauguguguugaaaggggaaugaagccauucacuu

SEQ ID NO: 386222 - RNA, 64 nt, Homo Sapiens
gaagaugcucuagaggaauuaaugcuggaaugggguguugaaggaugaguaggaguuaguuagg

SEQ ID NO: 386223 - RNA, 64 nt, Homo Sapiens
ccuugacuguugauauguauuuuuugugaaguguguguugaagccuugcagauuauuuuuuaaa

SEQ ID NO: 386224 - RNA, 64 nt, Homo Sapiens
auagaaacaagguuucaccauguuggucaggcugguguugaacuccugaccucagguaauccac

SEQ ID NO: 386225 - RNA, 64 nt, Homo Sapiens
agugugcccagugcccuuggaccugggcuguucuguguugaagggcagggccuggaagcagcgg

SEQ ID NO: 386226 - RNA, 64 nt, Homo Sapiens
caucuuucaagcccucgcucuccuagaagagucuguguugaaggcgucccaaaacuggcuggau

SEQ ID NO: 386227 - RNA, 64 nt, Homo Sapiens
uaugaaauauggcuauuuuuuuguaaauagaauaguguugaagaguuauuuauuauauaaagua

SEQ ID NO: 386228 - RNA, 64 nt, Homo Sapiens
guacaaccauaugagccuugcagcgaguugaguuguguugaauucuggacauuuuucguggcca

SEQ ID NO: 386229 - RNA, 64 nt, Homo Sapiens
uucuaaucucaucccucuccgcugcacaagcaguguguugaacuagggucuugacuuuaucucc

SEQ ID NO: 386230 - RNA, 64 nt, Homo Sapiens
uaaaucacauucgguuauauuuucuaugaguauuguguugaaucuuaacaaaaaguuaugggga

SEQ ID NO: 386231 - RNA, 64 nt, Homo Sapiens
uacaucacauucaguuauaauuucucuggguauuguguugaaucuuaacaaaaaguuauagaaa

SEQ ID NO: 386232 - RNA, 64 nt, Homo Sapiens
gguaacucccucuuggagaaucauggguaaauauguguugaauucagaagagccaccguggaag

SEQ ID NO: 386233 - RNA, 64 nt, Homo Sapiens
cagagcacaggagcaugggcugccucugagugugguguugaacuucgggaggagcagggagccc

SEQ ID NO: 386234 - RNA, 64 nt, Homo Sapiens
aaacaacagcaacgugaucuuggcugucugucauguguugaaguccaugguugggucuugugaa

SEQ ID NO: 386235 - RNA, 64 nt, Homo Sapiens
cacacuguccauguucuuuuuauugccagggcccguguugaagugucaagagagcaaucaucaa

SEQ ID NO: 386236 - RNA, 64 nt, Homo Sapiens
ugaagaacugaggcacagauuaaaggacuugccuguguugaauaccaguccuguucuaggacau

SEQ ID NO: 386237 - RNA, 64 nt, Homo Sapiens
aggagcuaggggcuccagaaagaaucuuacacauguguugaagacauugaugucauagggagcg

SEQ ID NO: 386238 - RNA, 64 nt, Homo Sapiens
uguucagaagguugcucuagacuuauuuuugacaguguugaaaauuuccuuuuuuguuauuauu

SEQ ID NO: 386239 - RNA, 64 nt, Homo Sapiens
caaaccugccgcaacagaaauuacagauucaacuguguugaaauucagaaacgagcuuugguuu

SEQ ID NO: 386240 - RNA, 64 nt, Homo Sapiens
caagcugcuugucaagaagcagacacuaaggcagguguugaagacagggagaugucccuggggc

SEQ ID NO: 386241 - RNA, 64 nt, Homo Sapiens
acaguuacaacccacuggggcaagugagcacucaguguugaaucguugagcuccaccuccuuuc

SEQ ID NO: 386242 - RNA, 64 nt, Homo Sapiens
aguggguugaccaauuugguggaacaagcggcugguguugaaaguucagcuagagaaggaugcu

SEQ ID NO: 386243 - RNA, 64 nt, Homo Sapiens
agcaaaccaaugagugcugcuauaaaaguguguuguguugaagcuuugacaccuuuuagaucug

SEQ ID NO: 386244 - RNA, 64 nt, Homo Sapiens
ccaguguccucagcuucaugcucaugacaacucaguguugaagcugaggacagagccugucccu

SEQ ID NO: 386245 - RNA, 64 nt, Homo Sapiens
augguugguguauuuugucaucggugugaaucaaguguugaaaaaaucaucaaaagacuguuuc

SEQ ID NO: 386246 - RNA, 64 nt, Homo Sapiens
guagucacacuucacuaaagugucauccaccaguguguugaauccgaagaaugacaauuuucua

SEQ ID NO: 386247 - RNA, 64 nt, Homo Sapiens
gcccccuaggggacacacagcugcacugagguggguguugaagagccagcccuucccugugugg

SEQ ID NO: 386248 - RNA, 64 nt, Homo Sapiens
acucuuacucaccuuccuuuagucucguccugugguguugaagggaaaucagccaguuguaaau

SEQ ID NO: 386249 - RNA, 64 nt, Homo Sapiens
cuaaacuaauauauccagagauuuugcacaauucguguugaaccuuccaaaacaaaaauaaaga

SEQ ID NO: 386250 - RNA, 64 nt, Homo Sapiens
uggcuuugcaugcccagcgagggcuggggcugggguguugaaguggugggcaggaggagcugag

SEQ ID NO: 386251 - RNA, 64 nt, Homo Sapiens
gaacuguaugggaagaagccaggaaaaccucugaguguugaaggggcaacccaaggcaucacag

SEQ ID NO: 386252 - RNA, 64 nt, Homo Sapiens
cuuuagagcuaggguggggucuggucacacacagguguugaagaaauuauaaagauaaagcugc

SEQ ID NO: 386253 - RNA, 64 nt, Homo Sapiens
auuccuuacauuuaccaagaggaaagcuuuuacuguguugaagcuaaaaaaauaauggcucuuu

SEQ ID NO: 386254 - RNA, 63 nt, Homo Sapiens; identical to SEQ ID NO: 385941

SEQ ID NO: 386255 - RNA, 64 nt, Homo Sapiens
acccgaaucauuguuuuauuuccugauuacacagguguugaauggggaaaggggcuaguauauc

SEQ ID NO: 386256 - RNA, 64 nt, Homo Sapiens
cacagaucuggagguaugauaggucaggggcuagguguugaacuuaguuaauggaagacugaga

SEQ ID NO: 386257 - RNA, 64 nt, Homo Sapiens
gcagcuccuuccuagccuugugcggagucauuuuguguugaagauucuucuucaaaccuuugug

SEQ ID NO: 386258 - RNA, 64 nt, Homo Sapiens
ccaguggaaauuguauaauuugcagaauuaaaccguguugaagaacaugcaaaggaaaggacag

SEQ ID NO: 386259 - RNA, 64 nt, Homo Sapiens
gaaucaaacuacauuugcugauagggccuuuuugguguugaaggaaagauuauuaaucacauau

SEQ ID NO: 386260 - RNA, 64 nt, Homo Sapiens
gugacaugcuuuaaugauaauuaaggaggaguugguguugaagucauuuauucugaugucccuu

SEQ ID NO: 386261 - RNA, 64 nt, Homo Sapiens
auguaucauccagagugaugccuuucagcugccaguguugaauaugcucauauaguaaagggau

SEQ ID NO: 386262 - RNA, 64 nt, Homo Sapiens
gcaaaccgaguacugcuguacuucuguugucaguguguugaauuacagucuguuggucccuuug

SEQ ID NO: 386263 - RNA, 64 nt, Homo Sapiens
ccaccuucccaaaccuaauucuuguagaugcauuaguguugaaccaaugcuuucucaugucuca

SEQ ID NO: 386264 - RNA, 64 nt, Homo Sapiens
ccuucacaucuaggugcccucaagcagcugugugaguguugagaucucugccaucucuggcuga

SEQ ID NO: 386265 - RNA, 64 nt, Homo Sapiens
cgccccgagaccucaucuuccggugagugccuucaguguugaccuaaguccucgccgggccaug

SEQ ID NO: 386266 - RNA, 64 nt, Homo Sapiens
auacauaucuaaguaaaucaaaguuuuggguggaaguguugagaaguaugaguuuuuuguuguu

SEQ ID NO: 386267 - RNA, 64 nt, Homo Sapiens
ucagcagagaauuuauuucauacaguuacuuaagaguguugaugucuugugaacagagauauaa

SEQ ID NO: 386268 - RNA, 64 nt, Homo Sapiens
agaauauucuucucuucuaguuacuacaguguggaguguugagaccagacaccuuuugcugucu

SEQ ID NO: 386269 - RNA, 64 nt, Homo Sapiens
aagcagaagguuuuucucugggggaaccugucucaguguugacugcauuguuguagucuuccca

SEQ ID NO: 386270 - RNA, 64 nt, Homo Sapiens
caauuucaagccauuuucagaucagaacuccagaaguguugacaagaugccuauucguagaguu

SEQ ID NO: 386271 - RNA, 64 nt, Homo Sapiens
cacuuuuuuauugcacuggcuugaauacaguagcaguguugauagaaucauuuuauucaauaaa

SEQ ID NO: 386272 - RNA, 64 nt, Homo Sapiens
gcugcucuccaucucuuguaccagcccaggcaauaguguugaggaggggagcaaggcugcuaag

SEQ ID NO: 386273 - RNA, 64 nt, Homo Sapiens
aucuugaauggagaccucccuaccaagugaugaaaguguugaaaaacuuaauaacaaaugcuug

SEQ ID NO: 386274 - RNA, 64 nt, Homo Sapiens
ucuagagauggacugagccuugcuucucacuggcaguguugagcuuuggagaugggaugguugc

SEQ ID NO: 386275 - RNA, 64 nt, Homo Sapiens
aacgggguggacgagggagugucuguaaggacucaguguugacuguaggcgccccugggguggg

SEQ ID NO: 386276 - RNA, 64 nt, Homo Sapiens
ucacauuuguguaaaaugguauauucuuuaaaauaguguugauaacuggaauauuguauguaug

SEQ ID NO: 386277 - RNA, 64 nt, Homo Sapiens
uugggacuguuucacagcacaaacucaucuuuacaguguugaucaaugcaucaguuaagaaaua

SEQ ID NO: 386278 - RNA, 64 nt, Homo Sapiens
caucacuuuagaaaccacacucacacuuuugcagaguguugagcuuaauaacuaccugccacag

SEQ ID NO: 386279 - RNA, 64 nt, Homo Sapiens
aaauacaguugacaacuuagccaauugcaacuccaguguugauaauuaaaaugaaaugguaaag

SEQ ID NO: 386280 - RNA, 64 nt, Homo Sapiens
ugcuugggaugaaaaaggauauugcagcuucagcaguguugaacuguguguuuaaaaaugugaa

SEQ ID NO: 386281 - RNA, 64 nt, Homo Sapiens
gugaacgaaaagaugugaaggcuguuuguuuuuaaguguugauauggacuugauuuuuauuaag

SEQ ID NO: 386282 - RNA, 64 nt, Homo Sapiens
cuauccaagcauguugggguuaagaaauaucucaaguguugaugaucucaguccagguaggaau

SEQ ID NO: 386283 - RNA, 64 nt, Homo Sapiens
ugacaggcacgagccaccagccucggccucccaaaguguugagaugaccucaagugauccacca

SEQ ID NO: 386284 - RNA, 64 nt, Homo Sapiens
ccuguuccagagagaggugguugaugcccucacuaguguugaaguacccaccagaacagggguu

SEQ ID NO: 386285 - RNA, 64 nt, Homo Sapiens
uguacugugaucaacaguguucacaauggaauaaaguguugagucaaucuuacauguauaccaa

SEQ ID NO: 386286 - RNA, 64 nt, Homo Sapiens
aacacucauaacuagggagucucaggaaggcaucaguguugauucuucaaggguuccuguggau

SEQ ID NO: 386287 - RNA, 64 nt, Homo Sapiens
ugugcugagaucaagaggcaaccugaaauuguauaguguugauuaccuuuccuuaugucuccug

SEQ ID NO: 386288 - RNA, 64 nt, Homo Sapiens
uuuaaaaagacaagaccacucuaauuguucaagaaguguugaacacugguccuacagccaggag

SEQ ID NO: 386289 - RNA, 64 nt, Homo Sapiens
agaagacccuauacucagagccuguaauguucagaguguugaugaggaaggaaauuuuuuguuu

SEQ ID NO: 386290 - RNA, 64 nt, Homo Sapiens
ugaauaucugggagcagagagggcuggcuuuuggaguguugagggcaggacugaagaccugaag

SEQ ID NO: 386291 - RNA, 64 nt, Homo Sapiens
aucugucccccuuuagaucucccauuugggugggaguguugagcgaccugaaggguugacuuua

SEQ ID NO: 386292 - RNA, 64 nt, Homo Sapiens
gacuguguguguguggagggugugugccugugugaguguugacucaggucacugugugugugca

SEQ ID NO: 386293 - RNA, 64 nt, Homo Sapiens
gauaaauuagaauguauagauuuacuuaagggauaguguugauaacuuaagagauauguugcuu

SEQ ID NO: 386294 - RNA, 64 nt, Homo Sapiens
aaaacgaggcaaagagaggucuugucuccauuuuaguguugaggcuccugaggaaagugcuauu

SEQ ID NO: 386295 - RNA, 64 nt, Homo Sapiens
aauuuauuuuucucugacuugaaaauaaaaugucaguguugaauguaaaaaugauaaaacuuca

SEQ ID NO: 386296 - RNA, 64 nt, Homo Sapiens
aaacuuuugaucaaaaccaccaagggggaaagcuaguguugaugaccccgggacaggacuaacc

SEQ ID NO: 386297 - RNA, 64 nt, Homo Sapiens
acuugguuccaugagccauguauucaaaugcuguaguguugaauuaccaaccuuuaaagacuga

SEQ ID NO: 386298 - RNA, 64 nt, Homo Sapiens
caugcuauauuucccaucauaaaaaaaaaaaaccaguguugaauuguaaacugacaaaaaaaaa

SEQ ID NO: 386299 - RNA, 64 nt, Homo Sapiens
uacgcaaaacaagacagcuuauuggaagcagcauaguguugaugccuguggaauggcuaggaau

SEQ ID NO: 386300 - RNA, 64 nt, Homo Sapiens
cuucguuagguuaugguagugcucagacaucugcaguguugaggccagucacuguuggaaguca

SEQ ID NO: 386301 - RNA, 64 nt, Homo Sapiens
uaggcagguacuuuacuauguuacuguacccugcaguguugauuuuuaaaauagaguuuucugc

SEQ ID NO: 386302 - RNA, 57 nt, Homo Sapiens
cuuuggauuucauugcaugagaauugaaguguugaaggaugauuuuuuuuccccuca

SEQ ID NO: 386303 - RNA, 64 nt, Homo Sapiens
aguuuuuuuauggcauuuuuuuaaagaugcccuaaguguugaagaagaguuugcaaaugcaaca

SEQ ID NO: 386304 - RNA, 64 nt, Homo Sapiens
aguuucaucuugaaguaaaaguacaacagcuugaaguguugauagcaggccacagcccucuaac

SEQ ID NO: 386305 - RNA, 64 nt, Homo Sapiens
aauaacuguaagauauauauguacuacauuaaaaaguguugauuaauagaugaaauuuuuaaau

SEQ ID NO: 386306 - RNA, 64 nt, Homo Sapiens
uuguggagaugaggucucaguauguucccaggcuaguguugaacuccugagcucaagaaauccu

SEQ ID NO: 386307 - RNA, 64 nt, Homo Sapiens
guuucauuuccacuugugccaucuucuuugcugaaguguugaauaaggcccacgugaagaguuu

SEQ ID NO: 386308 - RNA, 64 nt, Homo Sapiens
gauaaagagaggagaauaugggacuccaugaaccaguguugauauguuugauuaagacuuuuca

SEQ ID NO: 386309 - RNA, 64 nt, Homo Sapiens
ccgcaugcauaaaguaaguaaggugcaaugaagaaguguugauugccaaauugacauguuguca

SEQ ID NO: 386310 - RNA, 64 nt, Homo Sapiens
uuuauuuugcuuuuucauagagacauguugaggaaguguugagcuguuuugcuuauagaauuac

SEQ ID NO: 386311 - RNA, 64 nt, Homo Sapiens
cacuaaaccauaaaaguuuaugggaagugaagcuaguguugaacaaguucuuuauauaagccuc

SEQ ID NO: 386312 - RNA, 64 nt, Homo Sapiens
agggagucgguuucucucuucuauuuuuccuucaaguguugacucugucuuaauguaaauguaa

SEQ ID NO: 386313 - RNA, 64 nt, Homo Sapiens
uugcucucagaugaacacaaucugcugugaugcuaguguugauugauuugcugaaaugggcacu

SEQ ID NO: 386314 - RNA, 64 nt, Homo Sapiens
auucacaguuuuaaguuugagguuggguaagaauaguguugaaacaggaaaugaaaccugaaaa

SEQ ID NO: 386315 - RNA, 64 nt, Homo Sapiens
ccaggccacagcccucuaacguacaacagcuugaaguguugauaaguuucaacuugaaguaaaa

SEQ ID NO: 386316 - RNA, 64 nt, Homo Sapiens
guucauauguaccauguacaugucucacuugugcaguguugacacguaggucuggagucucacu

SEQ ID NO: 386317 - RNA, 64 nt, Homo Sapiens
cugugcuccccuuaaaucguugcuucguuuuugaaguguugaagagcuuucuuucccaugauag

SEQ ID NO: 386318 - RNA, 64 nt, Homo Sapiens
uauaauauacauaaauauguauuauuauucuuuaaguguugauacaccguacucugugaaucua

SEQ ID NO: 386319 - RNA, 64 nt, Homo Sapiens
uuggaaaggacuuuguguuauggcaaaaaagaacaguguugaaacaucuggagucuuccuguag

SEQ ID NO: 386320 - RNA, 64 nt, Homo Sapiens
uaaauguguuuuguaguguuuuccccaggucuucaguguugaugauaaaauuguuggauuucau

SEQ ID NO: 386321 - RNA, 64 nt, Homo Sapiens
aagccagguugaauauuugcuuuuuucuuugagcaguguugaucuugcacauuuuguauaauuu

SEQ ID NO: 386322 - RNA, 64 nt, Homo Sapiens
agccugcaagauuucaguuuaagucuagcuaagcaguguugaaauuguagaaacucaguagaga

SEQ ID NO: 386323 - RNA, 64 nt, Homo Sapiens
ucggcugcaauuguggaccuucccuaccaaagggaguguugaaacucaagucccgcccuggcuc

SEQ ID NO: 386324 - RNA, 64 nt, Homo Sapiens
uuuuagaagggagaagucaucgaaguauuuucugaguguugagaagaaugaguuaaaccauuua

SEQ ID NO: 386325 - RNA, 64 nt, Homo Sapiens
aaaaaugcugggacuuuucaugaacuuugucuuaaguguugacaugaaucauucuaaaaggcua

SEQ ID NO: 386326 - RNA, 64 nt, Homo Sapiens
cagauguauauauggugcucacuuuaggaucagcaguguugaccauuuaugcugcauagcugua

SEQ ID NO: 386327 - RNA, 64 nt, Homo Sapiens
uggugaugcuuacagcaguuuguacgagcucuuaaguguugauuccauggaacugacggcuuug

SEQ ID NO: 386328 - RNA, 64 nt, Homo Sapiens
ucuuauauuuguaguaaaauauugaacaauuaaaaguguugacuccaaauauuuggcuuaugau

SEQ ID NO: 386329 - RNA, 64 nt, Homo Sapiens
gagccaauuaaacaaguuucauauguauuuuuccaguguugaaucucacacacuguacuuugaa

SEQ ID NO: 386330 - RNA, 64 nt, Homo Sapiens
gcguuuagucugaguugaucuuuuuaaaacugcaaguguugaauacuagagguuguuagacccu

SEQ ID NO: 386331 - RNA, 64 nt, Homo Sapiens
uaggucccuugguugcugucacuugcccuuuaauaguguugauguagucagugccguugccuuu

SEQ ID NO: 386332 - RNA, 64 nt, Homo Sapiens
uaaauagguguuaguuucucaggaguagauuguuaguguugacuuuuccuguaaagcagacauc

SEQ ID NO: 386333 - RNA, 64 nt, Homo Sapiens
uauuauaaaugguauuguguacagagauugagguaguguugaaauucucuuuggcacugucugu

SEQ ID NO: 386334 - RNA, 64 nt, Homo Sapiens
uuggacacauagauggugauaacaacuucaucacaguguugaugggaauaaaagccuaaacagg

SEQ ID NO: 386335 - RNA, 64 nt, Homo Sapiens
ccuccauugaggaugcccaccccaggcucacuucaguguugaguuuggaagaggcccccagaug

SEQ ID NO: 386336 - RNA, 64 nt, Homo Sapiens
cagcaucaagucuccagaaaauacaguaagagauaguguugaacauuuccaucaaacuucucca

SEQ ID NO: 386337 - RNA, 57 nt, Homo Sapiens
cuuucgucuccagccccuucagcauggaguguugaugagcuccccaaagccugcuga

SEQ ID NO: 386338 - RNA, 64 nt, Homo Sapiens
guaaucugaggcaaucuaagggcagcuuuuucaaaguguugauggggaugacaggcgugcaccu

SEQ ID NO: 386339 - RNA, 64 nt, Homo Sapiens
agcaaacccuugggacaauccuucaugugagcaaaguguugaucuuaauauugguugucugugg

SEQ ID NO: 386340 - RNA, 64 nt, Homo Sapiens
ugauccucuuuuucauucaucugugucuucucccaguguugacccuugugacccaagaaugugu

SEQ ID NO: 386341 - RNA, 64 nt, Homo Sapiens
uaggauucauuuuacuuagcaugaaugggaaacuaguguugaaagaaacaucugaauaacaacg

SEQ ID NO: 386342 - RNA, 64 nt, Homo Sapiens
gaggauuaaagaaauauauacauagaugaauucaaguguugagguuuagagcugugguggacuu

SEQ ID NO: 386343 - RNA, 64 nt, Homo Sapiens
aucagcuggggaauugaagcugagaacuaaauaaaguguugaacgcaaauguuuaaaauccaaa

SEQ ID NO: 386344 - RNA, 64 nt, Homo Sapiens
aucagcuggggaauugaagcugagaaguaaauaaaguguugaacaggaaaauuuaaaauucaag

SEQ ID NO: 386345 - RNA, 64 nt, Homo Sapiens
aucaacuggggaauugaagcugagaacuaaauaaaguguugaacgcaaauguuuaaaauccaaa

SEQ ID NO: 386346 - RNA, 64 nt, Homo Sapiens
acugucuuuaaacuagaaaauuccccuguucuuaaguguugaaugaugccuuuauaagcucagu

SEQ ID NO: 386347 - RNA, 64 nt, Homo Sapiens
auauuccuguuuauuuuucuuaucacuuuuuguaaguguugaauguacuuuauauucuuuauca

SEQ ID NO: 386348 - RNA, 64 nt, Homo Sapiens
uguuacuauauuacuaugcauuuaaacuuugaagaguguugauucaauaccagcuuccuuuucc

SEQ ID NO: 386349 - RNA, 64 nt, Homo Sapiens
uagucuuaccgaauaagguaccaagaucacaaauaguguugaucagaucuuacaaguuuaugug

SEQ ID NO: 386350 - RNA, 64 nt, Homo Sapiens
cuauucuagagugguaaacucucuauaaguguucaguguugacauagccuuugugcaaaaaaaa

SEQ ID NO: 386351 - RNA, 64 nt, Homo Sapiens
ccuauuaauuuacucuugauuaucaaacauuaccaguguugaacuauuaaaagcacacaaugug

SEQ ID NO: 386352 - RNA, 64 nt, Homo Sapiens
acuugguuguggcaaacaaacaaaaaaugcuuucaguguugaaauaucucuauuuuccaaagau

SEQ ID NO: 386353 - RNA, 64 nt, Homo Sapiens
augaacacugcuugucuucuuccauugaccauuuaguguugaguacuguauguguuuuguuaau

SEQ ID NO: 386354 - RNA, 64 nt, Homo Sapiens
guacuuauuucaacaauucuuagagaugcuagcuaguguugaagcuaaaaauagcuuuauuuau

SEQ ID NO: 386355 - RNA, 64 nt, Homo Sapiens
uaauggauuugucuguugaacuucaugcuguccaaguguugaaaagucaauuuuauuucauugc

SEQ ID NO: 386356 - RNA, 64 nt, Homo Sapiens
uccccacgaaauuuaguuuuaucaguagucuuaaaguguugaucucaaacaaguacauuagaaa

SEQ ID NO: 386357 - RNA, 64 nt, Homo Sapiens
agcccaggaaauacuugaaaucagcauuccaauuaguguugagucucuugauugugucauuuac

SEQ ID NO: 386358 - RNA, 64 nt, Homo Sapiens
agaugaggccccuucuagaaucuaggauaacaagaguguugacaguuugaggagucgaauugag

SEQ ID NO: 386359 - RNA, 64 nt, Homo Sapiens
cugucuacccuucauucaugagaacuccagaaugaguguugaccacugaagcaucuuuuaaguc

SEQ ID NO: 386360 - RNA, 64 nt, Homo Sapiens
gcuggguacauuucucugagacucacggaauguaaguguugagguuucugcaaagagggcgcag

SEQ ID NO: 386361 - RNA, 64 nt, Homo Sapiens
uauuuuuaauuuuuuaaauggacuuaguuuuugaaguguugaagaauuuuccaaacuaagugga

SEQ ID NO: 386362 - RNA, 64 nt, Homo Sapiens
gcguguguagugcugcaucugucugcucuaucauaguguugagacaggccacuaagguaaaaga

SEQ ID NO: 386363 - RNA, 64 nt, Homo Sapiens
uggguagggccaagaugaccuugugcacggcuccaguguugagaauaauccacaagccagaaag

SEQ ID NO: 386364 - RNA, 64 nt, Homo Sapiens
acccacguguuuuacacagaucuauauuuauagcaguguugaaaauauaacuccaggugacguu

SEQ ID NO: 386365 - RNA, 64 nt, Homo Sapiens
cgugauugaguggacugugggggucuguagagacaguguugagaggaaaggggagguccugcug

SEQ ID NO: 386366 - RNA, 64 nt, Homo Sapiens
gcucccacaauuacaaagaaugcuuccuggguggaguguugaguuggaaccauuguaaaggugg

SEQ ID NO: 386367 - RNA, 64 nt, Homo Sapiens
ugagcucaagugaucuuccugccuuggcacccaaaguguugagauuuacaggugugagccacca

SEQ ID NO: 386368 - RNA, 64 nt, Homo Sapiens
uggccccucugaccugcacuggggagcccgucucaguguugagccuuuucccucuuuggcuccc

SEQ ID NO: 386369 - RNA, 64 nt, Homo Sapiens
uggaaauuaaugaauaaacauuuugaguuucccuaguguugaaggaagguguacuuuuucuugu

SEQ ID NO: 386370 - RNA, 64 nt, Homo Sapiens
cccuaaauagcgccccauuugggaacagagcaagaguguugaacugaagaccaaaaugcccuca

SEQ ID NO: 386371 - RNA, 64 nt, Homo Sapiens
gauuucucuuuccugagcucaccaaacuuauuccaguguugaucgcaagcuguugaugcacagg

SEQ ID NO: 386372 - RNA, 64 nt, Homo Sapiens
guauaauuuaaucccauacauucgaguuaaguuuaguguugauguuccaucauucuggaccucc

SEQ ID NO: 386373 - RNA, 64 nt, Homo Sapiens
accaccuuuacugugcuuauuuuuuuaagaaaaaaguguugaucaaccauucgaccuauaagaa

SEQ ID NO: 386374 - RNA, 64 nt, Homo Sapiens
uauggguaggauguuacaaagcaucauugcccacaguguugauaccaagaaaugcauuuucuua

SEQ ID NO: 386375 - RNA, 64 nt, Homo Sapiens
gaagaaaucauuuuuaaugucaguuugaauuuauaguguugaugcaaaaugcauaaacauccga

SEQ ID NO: 386376 - RNA, 64 nt, Homo Sapiens
cggaugauuucuaugcugaguguauagauuagagaguguugaaauucuguauagauuagaauuc

SEQ ID NO: 386377 - RNA, 64 nt, Homo Sapiens
aauaucuuugcaucauagaauguugcaccaauuaaguguugaaauuaugacacaaugacacauu

SEQ ID NO: 386378 - RNA, 64 nt, Homo Sapiens
cuagaugaucaacauaaugggaguuugguuaaucaguguugauuguuggggcucuuggcuuuca

SEQ ID NO: 386379 - RNA, 64 nt, Homo Sapiens
gggguuaccagcuugauccaaugcugcuuuucugaguguugauggucccccaucuaaaauaccc

SEQ ID NO: 386380 - RNA, 64 nt, Homo Sapiens
ccaaaauacccacggggucugaggggaggggagcaguguugaugaacugcagugacugggaugg

SEQ ID NO: 386381 - RNA, 64 nt, Homo Sapiens
auuaaaugugauaaccuuugagaagaaggugauaaguguugaaauaucuccauaaauugagaga

SEQ ID NO: 386382 - RNA, 64 nt, Homo Sapiens
ucuuaaucuugauaaauauaguauuuuuaacaguaguguugauuaagucugaauagaaucugga

SEQ ID NO: 386383 - RNA, 64 nt, Homo Sapiens
ucaacugaaggcgaggaaugucuacucccuuaacaguguugaaucccugacccaagucuuugcc

SEQ ID NO: 386384 - RNA, 64 nt, Homo Sapiens
gugccuguugugaagcuaauaagugcuuuaccuaaguguugauuucuaaaguuuugcaacaauu

SEQ ID NO: 386385 - RNA, 64 nt, Homo Sapiens
gugccuguugugaagcuaauaaguacuuuaccuaaguguugauuucuaaaguuuugcaacaaua

SEQ ID NO: 386386 - RNA, 64 nt, Homo Sapiens
gugccuguuguaaagcuaauaagugcuuuacuuaaguguugauuucuaaaguuuugcaacaaug

SEQ ID NO: 386387 - RNA, 64 nt, Homo Sapiens
cuacaggcaugagccacuguucucggccucacaaaguguugagaggcuucaagcgauccuccug

SEQ ID NO: 386388 - RNA, 64 nt, Homo Sapiens
ucucuuaaaggaaugcuugauacauuuagcuuguaguguugaauauacgaauacacucagaaag

SEQ ID NO: 386389 - RNA, 64 nt, Homo Sapiens
ggggcccuuaaacuggauucagacaagcucucaaaguguugaguuaguugaaauaaucggaagu

SEQ ID NO: 386390 - RNA, 64 nt, Homo Sapiens
uugaaauuauaacauguauaaaaacuuaugugcuaguguugacuuaguauguauuuagauauga

SEQ ID NO: 386391 - RNA, 64 nt, Homo Sapiens
ggcacugauaacuggugaagaaggcauuuuugaaaguguugagucuguguagaacuuuaaaaaa

SEQ ID NO: 386392 - RNA, 64 nt, Homo Sapiens
gugggaagagcauuuguaggaauggcuuuugguuaguguugaagcuguuguauguaauacucac

SEQ ID NO: 386393 - RNA, 64 nt, Homo Sapiens
uuuaaguauuccaggguuuggggucaacacgugaaguguugaauuuuaaaaaauacaaaaagca

SEQ ID NO: 386394 - RNA, 64 nt, Homo Sapiens
aucauuagaaaagcacugguaguuguacaauaucaguguugacuuugaacuucuuuaacgagau

SEQ ID NO: 386395 - RNA, 64 nt, Homo Sapiens
aaacuaaauaacaauuguccucguuugaguuaagaguguugauguaggcuuuauuuuaagcagu

SEQ ID NO: 386396 - RNA, 64 nt, Homo Sapiens
guuguaauuugcagggaaauugacugcaggugauaguguugacgucugacgucugacaaccucc

SEQ ID NO: 386397 - RNA, 64 nt, Homo Sapiens
ucacauuugauguacauguguagggaaaguuaaaaguguugauuacauaaucaaagcuaccugu

SEQ ID NO: 386398 - RNA, 64 nt, Homo Sapiens
aggcacugauacuucagacauuacacuaaauuagaguguugaguauaggagauccaaaacuaaa

SEQ ID NO: 386399 - RNA, 64 nt, Homo Sapiens
gcgcaguggggaagguaggggaaagaugaggcacaguguugauggggcagugaccagacagucc

SEQ ID NO: 386400 - RNA, 64 nt, Homo Sapiens
uauguguuugguuccagccuaaaaaugauuuuguaguguugaaaucauagcuacuuacauagcu

SEQ ID NO: 386401 - RNA, 64 nt, Homo Sapiens
uuuaggaaacaaacccacauaauaguugggaaccaguguugaucucucucccuuaccuucucca

SEQ ID NO: 386402 - RNA, 64 nt, Homo Sapiens
uuuaaaccuuucaagaagguuauuuagcuagcuuaguguugaacuaaauuuuuuuuaaacaagg

SEQ ID NO: 386403 - RNA, 64 nt, Homo Sapiens
gaugggugcccuuuccuggcagucucaguccaaaaguguugacugugucauuaguccuuugucu

SEQ ID NO: 386404 - RNA, 64 nt, Homo Sapiens
gucuagaagcagagaaguaaagugagcaaaauccaguguugaggagucaugacaguacuuugau

SEQ ID NO: 386405 - RNA, 64 nt, Homo Sapiens
guacagaaaaagcacacagauggcuugucucaggaguguugaaugugugccccgcugcugucug

SEQ ID NO: 386406 - RNA, 64 nt, Homo Sapiens
ugugauuuaaaaaugccagcaauuuuaaucuagcaguguugaagcugggaauuuuuuggcgcaa

SEQ ID NO: 386407 - RNA, 64 nt, Homo Sapiens
gcaccucuccuccccucuuagcgccacugcagugaguguugagguccccccauccaaaacccgu

SEQ ID NO: 386408 - RNA, 64 nt, Homo Sapiens
auuuucuguuuagugauuccccuucccuccuuuaaguguugagguauuuucuucuugaccuacc

SEQ ID NO: 386409 - RNA, 61 nt, Homo Sapiens
uaaccuaaacuugaccugcucauccagaagaaguguugaagauaagauggagacuucauag

SEQ ID NO: 386410 - RNA, 64 nt, Homo Sapiens
uuucauuaagaaauaaagucgcuaucuuuuccucaguguugaacgauugugagucaacgacuuu

SEQ ID NO: 386411 - RNA, 64 nt, Homo Sapiens
auaucauguaauuuauugaacuauuuuauaaucgaguguugaauagaaucaucuaacacaaacu

SEQ ID NO: 386412 - RNA, 64 nt, Homo Sapiens
guaaaaccaaaaguucuaaugguuuuuaaaaaccaguguugaguggaaaaguguuucuuuaguu

SEQ ID NO: 386413 - RNA, 64 nt, Homo Sapiens
uacucggcuagcaucagcaccugacauuuagaguaguguugaaagguaccuugcuacaguauuu

SEQ ID NO: 386414 - RNA, 64 nt, Homo Sapiens
uucaauaccaaauacaguaacgaccaggguagagaguguugaaagcuuuucuagagcagcugug

SEQ ID NO: 386415 - RNA, 64 nt, Homo Sapiens
auaguauguaucuagaauacccuaaaguccagguaguguugaaguaccaaauuuaaguugauga

SEQ ID NO: 386416 - RNA, 64 nt, Homo Sapiens
cuuuugugggaaaaaaaaauaaaguucuagcuuaaguguugaaauuagggcaaaguuaacacug

SEQ ID NO: 386417 - RNA, 64 nt, Homo Sapiens
aaaaccauuuaacacaaagccuauuuuauaaugaaguguugaauagcucauguuauuuacugaa

SEQ ID NO: 386418 - RNA, 64 nt, Homo Sapiens
ccagcugcacguuggagucuccugggaagcuucuaguguugaucucccuccuagaggcucagug

SEQ ID NO: 386419 - RNA, 64 nt, Homo Sapiens
cuaagaagucaaggauguaagucuauuaggacugaguguugaauggucuugauggugaagaagg

SEQ ID NO: 386420 - RNA, 64 nt, Homo Sapiens
uaacgcacauuuccuuugcuucuuuuauuagacuaguguugacuuuggggggggacauuuauuc

SEQ ID NO: 386421 - RNA, 64 nt, Homo Sapiens
uauauauauaaaguguaacaaggaacacuaaaacaguguugauucuugucucugaagacaaaua

SEQ ID NO: 386422 - RNA, 64 nt, Homo Sapiens
uccuaugucuuuuggcucaagcaacauguauaucaguguugacuuuuucuuucuuagaucuagu

SEQ ID NO: 386423 - RNA, 64 nt, Homo Sapiens
guggcccccugcccgauccaccguccugaggcagaguguugagccucauaccuguaccaggucc

SEQ ID NO: 386424 - RNA, 64 nt, Homo Sapiens
cauuuuaaugcuguuuaugauuacugcccauacaaguguugauuggcuucuaggggucugaacc

SEQ ID NO: 386425 - RNA, 64 nt, Homo Sapiens
uggggauaaaaugacuacuuugucuuuguaagucaguguugagaaaacuuuauacauuaguaaa

SEQ ID NO: 386426 - RNA, 64 nt, Homo Sapiens
auaauaauaaaaugaaacaagccaaaaaggggacaguguugauaaaaggaacuauuuuacaggu

SEQ ID NO: 386427 - RNA, 64 nt, Homo Sapiens
cauaagaaauauuguuacauuuaccuuccguuacaguguugauuaguuguagggacuccuauuu

SEQ ID NO: 386428 - RNA, 64 nt, Homo Sapiens
ccaaggggggauuuguagaaaucccuacucaccgaguguugagcguccuagcaauaaccucuug

SEQ ID NO: 386429 - RNA, 64 nt, Homo Sapiens
gcaagaguccagugucgugcuucacccagaguaaaguguugaucguguccuuaaauaugcaguc

SEQ ID NO: 386430 - RNA, 64 nt, Homo Sapiens
aucaguuuuuauuguaucgauauaauugucucuaaguguugacugucuucauugcaauaugaaa

SEQ ID NO: 386431 - RNA, 64 nt, Homo Sapiens
aaaagcccgauuauaauggugaucaauucaagucaguguugacuauucugugaaauauauuugg

SEQ ID NO: 386432 - RNA, 64 nt, Homo Sapiens
agccaucaugggugugauccaagaucccugucguaguguugaugauguuaguacaugauuuuaa

SEQ ID NO: 386433 - RNA, 64 nt, Homo Sapiens
ucuguguuccuaguuuuguacagacuuguuuuugaguguugaguagcagggacaaaauaaggga

SEQ ID NO: 386434 - RNA, 64 nt, Homo Sapiens
agaaaaagaagcuuuucuagggguuuguauaaauaguguugaaacuuuauuuuauguauuuaau

SEQ ID NO: 386435 - RNA, 64 nt, Homo Sapiens
cuguuaaaauuccaauuuguauuauaugcaggugaguguugaaaccagguugauuuuuuauuuu

SEQ ID NO: 386436 - RNA, 64 nt, Homo Sapiens
gcuauuagcaugauaaugaaucccaccccuucacaguguugauugacacuugaugggcugaggu

SEQ ID NO: 386437 - RNA, 64 nt, Homo Sapiens
auguugcauguccauguuagacugcggugagcguaguguugaaucagaaggcuuuuccaagcaa

SEQ ID NO: 386438 - RNA, 64 nt, Homo Sapiens
gugcgcgacugaccaggauuuauauuucuaaucaaguguugauuaacuacuuucccuuaauuug

SEQ ID NO: 386439 - RNA, 64 nt, Homo Sapiens
gugccccuccuguaggaauuccugccugacacccaguguugagaccaccagcucucacccccuu

SEQ ID NO: 386440 - RNA, 64 nt, Homo Sapiens
auuacaagggcuuuuauaaauuguauucauaagaaguguugaacaucuaaacaacuuaauuugc

SEQ ID NO: 386441 - RNA, 64 nt, Homo Sapiens
cuacaagagcuagaaaacugaucauugauguugcaguguugaaaaacugauucuggacauaugc

SEQ ID NO: 386442 - RNA, 64 nt, Homo Sapiens
aauuccuuacucugucccuauccaggauucccgcaguguugagguuugugaauuacuucguuuc

SEQ ID NO: 386443 - RNA, 64 nt, Homo Sapiens
ccauggcaucccacuugcccacucuccuuccuggaguguugaggucacacauugacuccccuga

SEQ ID NO: 386444 - RNA, 64 nt, Homo Sapiens
ucaugguaacuaguaugcucuuugagauuuuuacaguguugaaacuuaagaauuuugagagggu

SEQ ID NO: 386445 - RNA, 64 nt, Homo Sapiens
uuggcuauguaauucuuguaauuuuuauuuaggaaguguugaagggagguggcaagagugugga

SEQ ID NO: 386446 - RNA, 64 nt, Homo Sapiens
uuuaaaaacuuguauguuuuugcaaaucccuggaaguguugaauugguuaaaauuuuacauuuu

SEQ ID NO: 386447 - RNA, 64 nt, Homo Sapiens
uaauuaauuguguaauucagaauucauaccaaucaguguugaaacucaaacauugcaaaagugg

SEQ ID NO: 386448 - RNA, 64 nt, Homo Sapiens
ggaagcuagaaggguuaugguuggaguucuguacaguguugaguuuccgacagggaaagaggau

SEQ ID NO: 386449 - RNA, 64 nt, Homo Sapiens
uuguucuggccugguguucagugcgacugcagucaguguugaguggugccaugugggccgcucu

SEQ ID NO: 386450 - RNA, 64 nt, Homo Sapiens
agucggggaaaauggugacuuacugagugagagcaguguugagagagagguuuucuagggcaca

SEQ ID NO: 386451 - RNA, 64 nt, Homo Sapiens
auacuacggugugguaguagauaguaaaaggcaaaguguugaagucaacuuccauauucuucau

SEQ ID NO: 386452 - RNA, 64 nt, Homo Sapiens
cugggacccugaggaauucacugacaucacggaaaguguugaacaucaucccugacugaguacu

SEQ ID NO: 386453 - RNA, 64 nt, Homo Sapiens
uggugaaaccgggucgcauuugcgcggaggcggcaguguugauacaugcgcagacggaggcggg

SEQ ID NO: 386454 - RNA, 64 nt, Homo Sapiens
gaagguacagugaugaaggagaccauaauucuguaguguugaugauccuggauuauaaucuuuu

SEQ ID NO: 386455 - RNA, 64 nt, Homo Sapiens
uguuauuaaauagcauuaaacuggaauugacaagaguguugagcaucccugucuaaccugcucu

SEQ ID NO: 386456 - RNA, 64 nt, Homo Sapiens
gggaaaagaaaacucuugcgauuugggaggguucaguguugagauauugguguuuuagaguuag

SEQ ID NO: 386457 - RNA, 64 nt, Homo Sapiens
uaauguuuuuguuuuuauauccuuuuagcucuuaaguguugaacacuguugacagugaagaacu

SEQ ID NO: 386458 - RNA, 64 nt, Homo Sapiens
caaagcaaauguggacugaaucugcuuguugaucaguguugaagaaagugcaaaaggaacuuuu

SEQ ID NO: 386459 - RNA, 64 nt, Homo Sapiens
aggguggguugggcaacagccugagaguggacucaguguugauucucuaucgugaugcgaaauu

SEQ ID NO: 386460 - RNA, 64 nt, Homo Sapiens
aaguucauuuuuucucuuuacaaauuuguacugaaguguugacccuacaucuuugagcaagugc

SEQ ID NO: 386461 - RNA, 64 nt, Homo Sapiens
cagaauggaaaugacaagaaguguauuguucugcaguguugaaagcuucgccauugggccucca

SEQ ID NO: 386462 - RNA, 64 nt, Homo Sapiens
ggcacaaccuuguaaaugugauuaggucuuuaauaguguugaguguguagcuuugauuuggaug

SEQ ID NO: 386463 - RNA, 64 nt, Homo Sapiens
aaacucaacuacuaugaaauguccaucugaugccaguguugaguaccacucaaacucaaacuca

SEQ ID NO: 386464 - RNA, 64 nt, Homo Sapiens
gguucucuguaaaaguauaauggccauuuaauacaguguugaguagguguuugcugacauucau

SEQ ID NO: 386465 - RNA, 64 nt, Homo Sapiens
ggcacaaccuuguaaaugugauuaggucuuuaauaguguugagugcguagcuuugauuuggaug

SEQ ID NO: 386466 - RNA, 64 nt, Homo Sapiens
uuugucuauggagaaagcugcacaggaugaauaaaguguugagaccauguccccuucuugcugc

SEQ ID NO: 386467 - RNA, 64 nt, Homo Sapiens
aauuuuaauacaauauuaaauacgguuuuaguucaguguugaagauuucaaacuaacaaaugua

SEQ ID NO: 386468 - RNA, 64 nt, Homo Sapiens
ucuuucugcuuguuuugauuaguuaugaacagcaaguguugaacuuacguuaaauuuucagucc

SEQ ID NO: 386469 - RNA, 64 nt, Homo Sapiens
ccucccccuaucuuguccgugugggcacacacugaguguugaguugccguguggaguuaaugua

SEQ ID NO: 386470 - RNA, 64 nt, Homo Sapiens
aaagaaucugguaguugcuuaugugaauucuguuaguguugacuugcuuuguugacuagcugaa

SEQ ID NO: 386471 - RNA, 64 nt, Homo Sapiens
auguaaucuccuuugccaucucuuggaagcugucaguguugaggggaacaaucucuuuucuaag

SEQ ID NO: 386472 - RNA, 64 nt, Homo Sapiens
aaguugcauuuauugcagcaaguuacaaagggaaaguguugaagcuuuucauauuugcugcgug

SEQ ID NO: 386473 - RNA, 64 nt, Homo Sapiens
uuacuccauugaauuuaaggcauuuguucauuccaguguugagaugcuuugcaucucugcagaa

SEQ ID NO: 386474 - RNA, 64 nt, Homo Sapiens
agauucugugccaaucaugggccuagagagggugaguguugauuuagaauagggugcuucccua

SEQ ID NO: 386475 - RNA, 64 nt, Homo Sapiens
ucuucacuuuauuuuguuguucuaaacugccccaaguguugaaguaaaauggugaaagcuuccu

SEQ ID NO: 386476 - RNA, 64 nt, Homo Sapiens
ccgugguccagcaaacuccucugcagauggcuggaguguugacccaggcuuguggcccagguau

SEQ ID NO: 386477 - RNA, 64 nt, Homo Sapiens
aagucaauauuuucgauuauguuuugcuuagaucaguguugaacuaaguuggcauagcacacac

SEQ ID NO: 386478 - RNA, 64 nt, Homo Sapiens
auucuuuuuuaaaauaugaagcuauuagauuuuaaguguugaggagcagaggugagaagagaga

SEQ ID NO: 386479 - RNA, 64 nt, Homo Sapiens
aaaauucuuugucuaauauauuggagucuuuaaaaguguugaagaauaaaauauuaauuagaac

SEQ ID NO: 386480 - RNA, 64 nt, Homo Sapiens
aaagaggcuaaauaaaaugagaauagcuuccuaaaguguugaguaacauuucuaaagucucaag

SEQ ID NO: 386481 - RNA, 64 nt, Homo Sapiens
uucucuugcaaaagaaaguauauguaaaaaaaucaguguugaucaugugugucccuguacuuuc

SEQ ID NO: 386482 - RNA, 64 nt, Homo Sapiens
ccguauguguauuuuuauucugugaaauaauuuuaguguugauagagguaaaaccuaaaugcga

SEQ ID NO: 386483 - RNA, 64 nt, Homo Sapiens
accuuuuuaauuguaaaauguguauaguugcuaaaguguugagaugaaauaaaccuucauauuc

SEQ ID NO: 386484 - RNA, 64 nt, Homo Sapiens
cccaggccuguggccccaccacaccaguccagguaguguugagauugaguugaugggggccagg

SEQ ID NO: 386485 - RNA, 64 nt, Homo Sapiens
uuagaaguggugugugcucuucuaguuggugagcaguguugagcaugugcuuaaccgaggugcu

SEQ ID NO: 386486 - RNA, 64 nt, Homo Sapiens
ucuucccugaacacauuccuuguuuuucccggccaguguugacaugagugaggugaaagccuga

SEQ ID NO: 386487 - RNA, 64 nt, Homo Sapiens
ugaauuugcaucugcacagucagcagagauaacaaguguugaacugaccuugccacaugcuuag

SEQ ID NO: 386488 - RNA, 64 nt, Homo Sapiens
aggggccuggcccaaagcaguguugguugcuuacaguguugauugauuuuguucuuuuuucuua

SEQ ID NO: 386489 - RNA, 64 nt, Homo Sapiens
uuauaagguuuguuuuuuuuuuuuuaaacucugcaguguugauuuuucucuggguuguuuuuuc

SEQ ID NO: 386490 - RNA, 64 nt, Homo Sapiens
acaggcaggagccacugagcccagccaagacuucaguguugacugcuuuggaggcacaaaccca

SEQ ID NO: 386491 - RNA, 64 nt, Homo Sapiens
gauuuuuucuuuaauaauuaauuguaaauaccccaguguugagugcaucaauaacuuacugacc

SEQ ID NO: 386492 - RNA, 64 nt, Homo Sapiens
agucccugaggguuuacugugaagugcugaggacaguguugacaacuaacucguuuuccuagau

SEQ ID NO: 386493 - RNA, 64 nt, Homo Sapiens
ugcauauuagacauucuuaacagggcggcagucuaguguugaaaguuuuauuuuuccauuuuuc

SEQ ID NO: 386494 - RNA, 64 nt, Homo Sapiens
uuguucuugagcugccucuuaggaaacagaagacaguguugaaguuuucccugcuucugguuug

SEQ ID NO: 386495 - RNA, 64 nt, Homo Sapiens
ugcugaaagaugcugugccuaugggguucuagagaguguugagugugguacauuaacucuccau

SEQ ID NO: 386496 - RNA, 64 nt, Homo Sapiens
uuugucaaagaggauggacuaaaugaucucugaaaguguugaagcgcggacccuucugggucca

SEQ ID NO: 386497 - RNA, 64 nt, Homo Sapiens
ucaucaggccaagacccggacagagcuucagaggaguguugagugacaccugaggaugcggcug

SEQ ID NO: 386498 - RNA, 64 nt, Homo Sapiens
ggaauuguuuacuuuggaaucuguuuaagucuugaguguugaaaauauaacccucuaagaauac

SEQ ID NO: 386499 - RNA, 64 nt, Homo Sapiens
ugggaaaguaucaggagugcgguggggcauugagaguguugauucccacuauggugaggacgag

SEQ ID NO: 386500 - RNA, 64 nt, Homo Sapiens
aaguggaaaauggaaagccaaguguacuuuguggaguguugaguugaauaaauaccauguagca

SEQ ID NO: 386501 - RNA, 64 nt, Homo Sapiens
uaauggugaugcuuauuacaguacacaguauuacaguguugaagacagaccucuucuccucaug

SEQ ID NO: 386502 - RNA, 64 nt, Homo Sapiens
auguuaauguacauaaauagaguguaaauaaaauaguguugauguacugaaauaugaacuguau

SEQ ID NO: 386503 - RNA, 64 nt, Homo Sapiens
gucuaaaguaugugaugucuucaucauaguaugaaguguugaaaauuaauaacgagccuaguuu

SEQ ID NO: 386504 - RNA, 64 nt, Homo Sapiens
caaucaaaaacagaguuuucuguguuuccaugauaguguugaagccuaaugacaagccaggucu

SEQ ID NO: 386505 - RNA, 64 nt, Homo Sapiens
cagacaaguuauuuagccauucaccuagagaguaaguguugaagccagagccaccuccaacucu

SEQ ID NO: 386506 - RNA, 64 nt, Homo Sapiens
uuuaagagauggccgcugugugcuggucacaggaaguguugaauggauuggcuugcaaaggggg

SEQ ID NO: 386507 - RNA, 64 nt, Homo Sapiens
agcuuucaaguuaguuauuucagucaggauauacaguguugaaaucucaaugcaguugaaaucu

SEQ ID NO: 386508 - RNA, 64 nt, Homo Sapiens
uugauacuuguuuucaaauauguuuacuaacuguaguguugacugccugaccaaauuccaguga

SEQ ID NO: 386509 - RNA, 64 nt, Homo Sapiens
ugauuucauaauucagaacuaaauuuuucauagaaguguugagccaugcuacaguuagucuugu

SEQ ID NO: 386510 - RNA, 64 nt, Homo Sapiens
uguugucauguggaaccugcuuuauccauugcugaguguugaauguggguaaugguuagggcuu

SEQ ID NO: 386511 - RNA, 64 nt, Homo Sapiens
caguguaguuuuccuuuuguguaauuuuaaagucaguguugaauuuuauugaaagcucaugaug

SEQ ID NO: 386512 - RNA, 64 nt, Homo Sapiens
ucccgagaaauuugucuuuuuguauaaaugacaaaguguugaaaauguauuuccugaaauaaau

SEQ ID NO: 386513 - RNA, 64 nt, Homo Sapiens
uacugaaauaugaacuguauaguguaaauaaaauaguguugaugauguuaaugugcauaaauag

SEQ ID NO: 386514 - RNA, 64 nt, Homo Sapiens
uuuauccccucuucaguaauagguauuuguaagcaguguugacuugacugugcucuccauguuc

SEQ ID NO: 386515 - RNA, 64 nt, Homo Sapiens
ggaccaaagccaccaagacaugggggcugacccaaguguugagggaugagaaaggccugagggc

SEQ ID NO: 386516 - RNA, 64 nt, Homo Sapiens
ugcauucuuguaauauccccucagaaugggcuaaaguguugaauuuuaauucaaacuguuuugu

SEQ ID NO: 386517 - RNA, 64 nt, Homo Sapiens
uaccgaaauaugaacuguauaguguaaauaaaauaguguugaugauguuaauguacauaaauag

SEQ ID NO: 386518 - RNA, 64 nt, Homo Sapiens
uguaauguaauagaaaaucuaucugaacuggaccaguguugaucaggaaaggacugucagauuc

SEQ ID NO: 386519 - RNA, 64 nt, Homo Sapiens
caccaaauagauaucauguuaauuaccaccaagaaguguugaaacaccaaguuucccccuuuug

SEQ ID NO: 386520 - RNA, 64 nt, Homo Sapiens
aaacucauucugagaacacugaaauguuauacucaguguugauuucuucggucacuacacaacg

SEQ ID NO: 386521 - RNA, 64 nt, Homo Sapiens
cuaugucuuuuuaaaugguccauuuucaaaagacaguguugaauaaacauaccugugugauaaa

SEQ ID NO: 386522 - RNA, 64 nt, Homo Sapiens
gagcugcacucuuaacaucacuuuugguaugcugaguguugacaugccauaagcugcuccagag

SEQ ID NO: 386523 - RNA, 64 nt, Homo Sapiens
gcaaauguaaacauaaggguuuguagcggauggcaguguugaaguuauaacacuagggaaaaau

SEQ ID NO: 386524 - RNA, 64 nt, Homo Sapiens
aggcaguuuagcuugccaggacuuuugcagggacaguguugaugaugaaucaacuucuacagaa

SEQ ID NO: 386525 - RNA, 64 nt, Homo Sapiens
gcaacagcuuggaagaugauggugaauuguucugaguguugauggcggucucaacaagauacca

SEQ ID NO: 386526 - RNA, 64 nt, Homo Sapiens
cccuucuuucccaugagagacuaccucucuacaaaguguugaucagcuguuaccugaagacgug

SEQ ID NO: 386527 - RNA, 64 nt, Homo Sapiens
aacaugaaaugacucacuagagaaaaccccuaugaguguugaacaugugagaaagccuuaagua

SEQ ID NO: 386528 - RNA, 64 nt, Homo Sapiens
uuguguaauguguuuuuaucuguuaaaauuuuucaguguugacacuuaaaauuaaacacaugca

SEQ ID NO: 386529 - RNA, 64 nt, Homo Sapiens
gcugccugcgagccccgcacggcgacgcuggccaaguguugagaaacuuguuagaagagaugaa

SEQ ID NO: 386530 - RNA, 64 nt, Homo Sapiens
ccguccuugggcucugguccccccaccuugacugaguguugagcuguugucuggccgucgucaa

SEQ ID NO: 386531 - RNA, 64 nt, Homo Sapiens
aauccuagaaaugugaagaaaaaacauaaaucauaguguugagagaaaacaccucaaacuuuuc

SEQ ID NO: 386532 - RNA, 64 nt, Homo Sapiens
auaugaaauauggcuauuuuauuguaaauagaauaguguugaagaguuauuuauuauauaaagu

SEQ ID NO: 386533 - RNA, 64 nt, Homo Sapiens
uagguuuggucguaucauuugagccuuuugggguaguguugagaugaguugugcaaagcucaug

SEQ ID NO: 386534 - RNA, 64 nt, Homo Sapiens
accaccggugugggucacgagggcccuggcccacaguguugaggguccucucuuucgggggcuc

SEQ ID NO: 386535 - RNA, 64 nt, Homo Sapiens
auuuugccaaccguugcuuucguagccccugcuaaguguugacuuuuuaaaauauaaguuuauu

SEQ ID NO: 386536 - RNA, 64 nt, Homo Sapiens
gcacacaucuugcuauguauuagccgaugucuuuaguguugagccucuggauucuggggucugg

SEQ ID NO: 386537 - RNA, 64 nt, Homo Sapiens
cauccucuuugcccccucaggagugcugagggccaguguugacccacacuacccucccuugacc

SEQ ID NO: 386538 - RNA, 64 nt, Homo Sapiens
gagaauccacuuucuggaaguucucagcauaauuaguguugagagugguucaguugucuuuaau

SEQ ID NO: 386539 - RNA, 64 nt, Homo Sapiens
agggaccguccucaccgagcuccugcaucccuugaguguugaucaggaggcguccacagcauug

SEQ ID NO: 386540 - RNA, 64 nt, Homo Sapiens
auguucagaagguugcucuauacuuauuuuugacaguguugaaaauuuccuuuuuuguuauuau

SEQ ID NO: 386541 - RNA, 64 nt, Homo Sapiens
cacaguuacaacccacugggccaagugagcacucaguguugaauaguugagcuccaccuccuuu

SEQ ID NO: 386542 - RNA, 64 nt, Homo Sapiens
cccaguguccucagcuucauucucaugacaacucaguguugaaguugaggacagagccuguccc

SEQ ID NO: 386543 - RNA, 64 nt, Homo Sapiens
aaugguugguguauuuuguccucggugugaaucaaguguugaaagaaucaucaaaagacuguuu

SEQ ID NO: 386544 - RNA, 64 nt, Homo Sapiens
aacccaguuuuaaugguacagaggaguaguuuauaguguugauuucaccaaaaucagagggcug

SEQ ID NO: 386545 - RNA, 64 nt, Homo Sapiens
acuuguuugguugcaaaaacggaauaaaugacugaguguugagauuuuaaauaaaauuuaaagu

SEQ ID NO: 386546 - RNA, 64 nt, Homo Sapiens
ggguuguaccugccagacuucccucccucccuggaguguugagguucauggcuuccuguggauu

SEQ ID NO: 386547 - RNA, 64 nt, Homo Sapiens
agucaccuccccagaagggccacacuccaggaggaguguugagagucauuugagguagucuugc

SEQ ID NO: 386548 - RNA, 64 nt, Homo Sapiens
uccuucuggacucugugccuuugccugcacagcuaguguugauggcuuguuuguuguuuucacc

SEQ ID NO: 386549 - RNA, 64 nt, Homo Sapiens
ccaucugcacgccaggcggcauccuuuucuaugaaguguugacuuuguaaaucugcccacaccc

SEQ ID NO: 386550 - RNA, 64 nt, Homo Sapiens
ugggcucccagugugguuggccugaacaaaauaaaguguugacuccugggcaucugugccuucu

SEQ ID NO: 386551 - RNA, 64 nt, Homo Sapiens
uuucccagaugugugcuugugaccaguaucuugcaguguugacgugaugagugaagaagaaucu

SEQ ID NO: 386552 - RNA, 64 nt, Homo Sapiens
agccacuguaccccgauaccccucagccucccaaaguguugaugggccucaagcaauccucacg

SEQ ID NO: 386553 - RNA, 64 nt, Homo Sapiens
acccaaagcuguucuccagucuggcuggagggggaguguugacaagaugucgucugugacuggc

SEQ ID NO: 386554 - RNA, 64 nt, Homo Sapiens
agcuguacauguuuguauaucgggucuuguccauaguguugauaugacggcccggccgccagcg

SEQ ID NO: 386555 - RNA, 64 nt, Homo Sapiens
aaggcugauguuuguaacuuaugaacacacgugaaguguugaguccaaaagacaaaggggcauc

SEQ ID NO: 386556 - RNA, 64 nt, Homo Sapiens
agaacuguaugggaagaagccaggaaaaccucugaguguugaaggggcaacccaaggcaucaca

SEQ ID NO: 386557 - RNA, 64 nt, Homo Sapiens
gcccuggaugauuuuuggucuaauaacgcaugcuaguguugauguuuuuuggucaagaggguau

SEQ ID NO: 386558 - RNA, 64 nt, Homo Sapiens
cuacugccacccggcuuuggggagaugggcgauaaguguugagguaggcucgagaacugcuccc

SEQ ID NO: 386559 - RNA, 64 nt, Homo Sapiens
ccgcccuuugcagcagccccgcuaucuugagauuaguguugacagggaggggaggauugugagg

SEQ ID NO: 386560 - RNA, 64 nt, Homo Sapiens
ucaacaugcaaugacaacuggcaucacucuccucaguguugauguauguuuauaucuaucgucu

SEQ ID NO: 386561 - RNA, 64 nt, Homo Sapiens
uuugugauguccuuuggucaguuuggugcuacacaguguugauucaauuaucuaaagcauguua

SEQ ID NO: 386562 - RNA, 64 nt, Homo Sapiens
aauguaucauccagagugauuccuuucagcugccaguguugaauuugcucauauaguaaaggga

SEQ ID NO: 386563 - RNA, 64 nt, Homo Sapiens
uuggguaguguagaagcaacuauuguugaugauaaguguugacaguuccgaucuaauucuauug

SEQ ID NO: 386564 - RNA, 64 nt, Homo Sapiens
uuacugggaucugcaguaagaaacagauuuuuccaguguugauuccucaaaguaguuagaaaau

SEQ ID NO: 386565 - RNA, 64 nt, Homo Sapiens
acuaccuggauuuguauauaccaccagaugugacaguguugagagugacauuuagucccucaag

SEQ ID NO: 386566 - RNA, 64 nt, Homo Sapiens
aggccugguuggauucuggucuuuaaugcaugcuaguguugauguuuuuuggucaagaacgguu

SEQ ID NO: 386567 - RNA, 64 nt, Homo Sapiens; identical to SEQ ID NO: 240065

SEQ ID NO: 386568 - RNA, 64 nt, Homo Sapiens; identical to SEQ ID NO: 240066

SEQ ID NO: 386569 - RNA, 64 nt, Homo Sapiens; identical to SEQ ID NO: 240067

SEQ ID NO: 386570 - RNA, 64 nt, Homo Sapiens; identical to SEQ ID NO: 240068

SEQ ID NO: 386571 - RNA, 64 nt, Homo Sapiens; identical to SEQ ID NO: 240069

SEQ ID NO: 386572 - RNA, 64 nt, Homo Sapiens; identical to SEQ ID NO: 240070

SEQ ID NO: 386573 - RNA, 61 nt, Homo Sapiens; identical to SEQ ID NO: 240071

SEQ ID NO: 386574 - RNA, 64 nt, Homo Sapiens; identical to SEQ ID NO: 240072

SEQ ID NO: 386575 - RNA, 64 nt, Homo Sapiens; identical to SEQ ID NO: 240073

SEQ ID NO: 386576 - RNA, 64 nt, Homo Sapiens; identical to SEQ ID NO: 240074

SEQ ID NO: 386577 - RNA, 64 nt, Homo Sapiens; identical to SEQ ID NO: 240075

SEQ ID NO: 386578 - RNA, 64 nt, Homo Sapiens; identical to SEQ ID NO: 240076

SEQ ID NO: 386579 - RNA, 64 nt, Homo Sapiens; identical to SEQ ID NO: 240077

SEQ ID NO: 386580 - RNA, 64 nt, Homo Sapiens; identical to SEQ ID NO: 240078

SEQ ID NO: 386581 - RNA, 64 nt, Homo Sapiens; identical to SEQ ID NO: 240079

SEQ ID NO: 386582 - RNA, 64 nt, Homo Sapiens; identical to SEQ ID NO: 240080

SEQ ID NO: 386583 - RNA, 64 nt, Homo Sapiens; identical to SEQ ID NO: 240081

SEQ ID NO: 386584 - RNA, 64 nt, Homo Sapiens; identical to SEQ ID NO: 240082

SEQ ID NO: 386585 - RNA, 64 nt, Homo Sapiens; identical to SEQ ID NO: 240083

SEQ ID NO: 386586 - RNA, 64 nt, Homo Sapiens; identical to SEQ ID NO: 240084

SEQ ID NO: 386587 - RNA, 64 nt, Homo Sapiens; identical to SEQ ID NO: 240085

SEQ ID NO: 386588 - RNA, 64 nt, Homo Sapiens; identical to SEQ ID NO: 240086

SEQ ID NO: 386589 - RNA, 64 nt, Homo Sapiens; identical to SEQ ID NO: 265473

SEQ ID NO: 386590 - RNA, 64 nt, Homo Sapiens; identical to SEQ ID NO: 265474

SEQ ID NO: 386591 - RNA, 64 nt, Homo Sapiens; identical to SEQ ID NO: 265475

SEQ ID NO: 386592 - RNA, 64 nt, Homo Sapiens; identical to SEQ ID NO: 265476

SEQ ID NO: 386593 - RNA, 64 nt, Homo Sapiens; identical to SEQ ID NO: 265477

SEQ ID NO: 386594 - RNA, 64 nt, Homo Sapiens; identical to SEQ ID NO: 265478

SEQ ID NO: 386595 - RNA, 64 nt, Homo Sapiens; identical to SEQ ID NO: 265479

SEQ ID NO: 386596 - RNA, 64 nt, Homo Sapiens; identical to SEQ ID NO: 265480

SEQ ID NO: 386597 - RNA, 64 nt, Homo Sapiens; identical to SEQ ID NO: 265481

SEQ ID NO: 386598 - RNA, 60 nt, Homo Sapiens; identical to SEQ ID NO: 265482

SEQ ID NO: 386599 - RNA, 64 nt, Homo Sapiens; identical to SEQ ID NO: 265483

SEQ ID NO: 386600 - RNA, 64 nt, Homo Sapiens; identical to SEQ ID NO: 265484

SEQ ID NO: 386601 - RNA, 64 nt, Homo Sapiens; identical to SEQ ID NO: 265485

SEQ ID NO: 386602 - RNA, 64 nt, Homo Sapiens; identical to SEQ ID NO: 265486

SEQ ID NO: 386603 - RNA, 64 nt, Homo Sapiens; identical to SEQ ID NO: 265487

SEQ ID NO: 386604 - RNA, 64 nt, Homo Sapiens; identical to SEQ ID NO: 265488

SEQ ID NO: 386605 - RNA, 64 nt, Homo Sapiens; identical to SEQ ID NO: 265489

SEQ ID NO: 386606 - RNA, 64 nt, Homo Sapiens; identical to SEQ ID NO: 265490

SEQ ID NO: 386607 - RNA, 64 nt, Homo Sapiens; identical to SEQ ID NO: 265491

SEQ ID NO: 386608 - RNA, 64 nt, Homo Sapiens; identical to SEQ ID NO: 265492

SEQ ID NO: 386609 - RNA, 64 nt, Homo Sapiens; identical to SEQ ID NO: 265493

SEQ ID NO: 386610 - RNA, 64 nt, Homo Sapiens; identical to SEQ ID NO: 265494

SEQ ID NO: 386611 - RNA, 64 nt, Homo Sapiens; identical to SEQ ID NO: 265495

SEQ ID NO: 386612 - RNA, 64 nt, Homo Sapiens; identical to SEQ ID NO: 265496

SEQ ID NO: 386613 - RNA, 64 nt, Homo Sapiens; identical to SEQ ID NO: 265497

SEQ ID NO: 386614 - RNA, 64 nt, Homo Sapiens; identical to SEQ ID NO: 265498

SEQ ID NO: 386615 - RNA, 64 nt, Homo Sapiens; identical to SEQ ID NO: 265499

SEQ ID NO: 386616 - RNA, 64 nt, Homo Sapiens; identical to SEQ ID NO: 265500

SEQ ID NO: 386617 - RNA, 64 nt, Homo Sapiens; identical to SEQ ID NO: 265501

SEQ ID NO: 386618 - RNA, 64 nt, Homo Sapiens; identical to SEQ ID NO: 265502

SEQ ID NO: 386619 - RNA, 64 nt, Homo Sapiens; identical to SEQ ID NO: 265503

SEQ ID NO: 386620 - RNA, 64 nt, Homo Sapiens; identical to SEQ ID NO: 265504

SEQ ID NO: 386621 - RNA, 64 nt, Homo Sapiens; identical to SEQ ID NO: 265505

SEQ ID NO: 386622 - RNA, 64 nt, Homo Sapiens; identical to SEQ ID NO: 265506

SEQ ID NO: 386623 - RNA, 64 nt, Homo Sapiens; identical to SEQ ID NO: 265507

SEQ ID NO: 386624 - RNA, 64 nt, Homo Sapiens; identical to SEQ ID NO: 265508

SEQ ID NO: 386625 - RNA, 64 nt, Homo Sapiens; identical to SEQ ID NO: 265509

SEQ ID NO: 386626 - RNA, 64 nt, Homo Sapiens; identical to SEQ ID NO: 265510

SEQ ID NO: 386627 - RNA, 64 nt, Homo Sapiens; identical to SEQ ID NO: 265511

SEQ ID NO: 386628 - RNA, 64 nt, Homo Sapiens; identical to SEQ ID NO: 265512

SEQ ID NO: 386629 - RNA, 64 nt, Homo Sapiens; identical to SEQ ID NO: 265513

SEQ ID NO: 386630 - RNA, 64 nt, Homo Sapiens; identical to SEQ ID NO: 265514

SEQ ID NO: 386631 - RNA, 64 nt, Homo Sapiens; identical to SEQ ID NO: 265515

SEQ ID NO: 386632 - RNA, 64 nt, Homo Sapiens; identical to SEQ ID NO: 265516

SEQ ID NO: 386633 - RNA, 64 nt, Homo Sapiens; identical to SEQ ID NO: 265517

SEQ ID NO: 386634 - RNA, 64 nt, Homo Sapiens; identical to SEQ ID NO: 265518

SEQ ID NO: 386635 - RNA, 64 nt, Homo Sapiens; identical to SEQ ID NO: 265519

SEQ ID NO: 386636 - RNA, 64 nt, Homo Sapiens; identical to SEQ ID NO: 265520

SEQ ID NO: 386637 - RNA, 64 nt, Homo Sapiens; identical to SEQ ID NO: 265521

SEQ ID NO: 386638 - RNA, 64 nt, Homo Sapiens; identical to SEQ ID NO: 265522

SEQ ID NO: 386639 - RNA, 64 nt, Homo Sapiens; identical to SEQ ID NO: 265523

SEQ ID NO: 386640 - RNA, 64 nt, Homo Sapiens; identical to SEQ ID NO: 265524

SEQ ID NO: 386641 - RNA, 64 nt, Homo Sapiens; identical to SEQ ID NO: 265525

SEQ ID NO: 386642 - RNA, 64 nt, Homo Sapiens; identical to SEQ ID NO: 265526

SEQ ID NO: 386643 - RNA, 64 nt, Homo Sapiens; identical to SEQ ID NO: 265527

SEQ ID NO: 386644 - RNA, 64 nt, Homo Sapiens; identical to SEQ ID NO: 265528

SEQ ID NO: 386645 - RNA, 64 nt, Homo Sapiens; identical to SEQ ID NO: 265529

SEQ ID NO: 386646 - RNA, 64 nt, Homo Sapiens; identical to SEQ ID NO: 265530

SEQ ID NO: 386647 - RNA, 64 nt, Homo Sapiens; identical to SEQ ID NO: 265531

SEQ ID NO: 386648 - RNA, 64 nt, Homo Sapiens; identical to SEQ ID NO: 265532

SEQ ID NO: 386649 - RNA, 64 nt, Homo Sapiens; identical to SEQ ID NO: 265533

SEQ ID NO: 386650 - RNA, 64 nt, Homo Sapiens; identical to SEQ ID NO: 265534

SEQ ID NO: 386651 - RNA, 64 nt, Homo Sapiens; identical to SEQ ID NO: 265535

SEQ ID NO: 386652 - RNA, 64 nt, Homo Sapiens; identical to SEQ ID NO: 265536

SEQ ID NO: 386653 - RNA, 64 nt, Homo Sapiens; identical to SEQ ID NO: 265537

SEQ ID NO: 386654 - RNA, 64 nt, Homo Sapiens; identical to SEQ ID NO: 265538

SEQ ID NO: 386655 - RNA, 64 nt, Homo Sapiens; identical to SEQ ID NO: 265539

SEQ ID NO: 386656 - RNA, 64 nt, Homo Sapiens; identical to SEQ ID NO: 265540

SEQ ID NO: 386657 - RNA, 64 nt, Homo Sapiens; identical to SEQ ID NO: 265541

SEQ ID NO: 386658 - RNA, 64 nt, Homo Sapiens; identical to SEQ ID NO: 265542

SEQ ID NO: 386659 - RNA, 64 nt, Homo Sapiens; identical to SEQ ID NO: 265543

SEQ ID NO: 386660 - RNA, 64 nt, Homo Sapiens; identical to SEQ ID NO: 265544

SEQ ID NO: 386661 - RNA, 64 nt, Homo Sapiens; identical to SEQ ID NO: 265545

SEQ ID NO: 386662 - RNA, 64 nt, Homo Sapiens; identical to SEQ ID NO: 265546

SEQ ID NO: 386663 - RNA, 64 nt, Homo Sapiens; identical to SEQ ID NO: 265547

SEQ ID NO: 386664 - RNA, 64 nt, Homo Sapiens; identical to SEQ ID NO: 265548

SEQ ID NO: 386665 - RNA, 64 nt, Homo Sapiens; identical to SEQ ID NO: 265549

SEQ ID NO: 386666 - RNA, 64 nt, Homo Sapiens; identical to SEQ ID NO: 265550

SEQ ID NO: 386667 - RNA, 64 nt, Homo Sapiens; identical to SEQ ID NO: 265551

SEQ ID NO: 386668 - RNA, 64 nt, Homo Sapiens; identical to SEQ ID NO: 265552

SEQ ID NO: 386669 - RNA, 64 nt, Homo Sapiens; identical to SEQ ID NO: 265553

SEQ ID NO: 386670 - RNA, 64 nt, Homo Sapiens; identical to SEQ ID NO: 265554

SEQ ID NO: 386671 - RNA, 64 nt, Homo Sapiens; identical to SEQ ID NO: 265555

SEQ ID NO: 386672 - RNA, 64 nt, Homo Sapiens; identical to SEQ ID NO: 265556

SEQ ID NO: 386673 - RNA, 64 nt, Homo Sapiens; identical to SEQ ID NO: 265557

SEQ ID NO: 386674 - RNA, 64 nt, Homo Sapiens; identical to SEQ ID NO: 265558

SEQ ID NO: 386675 - RNA, 64 nt, Homo Sapiens; identical to SEQ ID NO: 265559

SEQ ID NO: 386676 - RNA, 64 nt, Homo Sapiens; identical to SEQ ID NO: 265560

SEQ ID NO: 386677 - RNA, 64 nt, Homo Sapiens; identical to SEQ ID NO: 265561

SEQ ID NO: 386678 - RNA, 64 nt, Homo Sapiens; identical to SEQ ID NO: 265562

SEQ ID NO: 386679 - RNA, 64 nt, Homo Sapiens; identical to SEQ ID NO: 265563

SEQ ID NO: 386680 - RNA, 64 nt, Homo Sapiens; identical to SEQ ID NO: 265564

SEQ ID NO: 386681 - RNA, 64 nt, Homo Sapiens; identical to SEQ ID NO: 265565

SEQ ID NO: 386682 - RNA, 64 nt, Homo Sapiens; identical to SEQ ID NO: 265566

SEQ ID NO: 386683 - RNA, 64 nt, Homo Sapiens; identical to SEQ ID NO: 265567

SEQ ID NO: 386684 - RNA, 64 nt, Homo Sapiens; identical to SEQ ID NO: 265568

SEQ ID NO: 386685 - RNA, 64 nt, Homo Sapiens; identical to SEQ ID NO: 265569

SEQ ID NO: 386686 - RNA, 64 nt, Homo Sapiens; identical to SEQ ID NO: 265570

SEQ ID NO: 386687 - RNA, 64 nt, Homo Sapiens; identical to SEQ ID NO: 265571

SEQ ID NO: 386688 - RNA, 64 nt, Homo Sapiens; identical to SEQ ID NO: 265572

SEQ ID NO: 386689 - RNA, 64 nt, Homo Sapiens; identical to SEQ ID NO: 265573

SEQ ID NO: 386690 - RNA, 64 nt, Homo Sapiens; identical to SEQ ID NO: 265574

SEQ ID NO: 386691 - RNA, 64 nt, Homo Sapiens; identical to SEQ ID NO: 328787

SEQ ID NO: 386692 - RNA, 64 nt, Homo Sapiens; identical to SEQ ID NO: 328788

SEQ ID NO: 386693 - RNA, 64 nt, Homo Sapiens; identical to SEQ ID NO: 328789

SEQ ID NO: 386694 - RNA, 64 nt, Homo Sapiens; identical to SEQ ID NO: 328790

SEQ ID NO: 386695 - RNA, 64 nt, Homo Sapiens; identical to SEQ ID NO: 328791

SEQ ID NO: 386696 - RNA, 64 nt, Homo Sapiens; identical to SEQ ID NO: 328792

SEQ ID NO: 386697 - RNA, 64 nt, Homo Sapiens; identical to SEQ ID NO: 328793

SEQ ID NO: 386698 - RNA, 64 nt, Homo Sapiens; identical to SEQ ID NO: 328794

SEQ ID NO: 386699 - RNA, 64 nt, Homo Sapiens; identical to SEQ ID NO: 328795

SEQ ID NO: 386700 - RNA, 64 nt, Homo Sapiens; identical to SEQ ID NO: 328796

SEQ ID NO: 386701 - RNA, 64 nt, Homo Sapiens; identical to SEQ ID NO: 328797

SEQ ID NO: 386702 - RNA, 64 nt, Homo Sapiens; identical to SEQ ID NO: 328798

SEQ ID NO: 386703 - RNA, 64 nt, Homo Sapiens; identical to SEQ ID NO: 328799

SEQ ID NO: 386704 - RNA, 64 nt, Homo Sapiens; identical to SEQ ID NO: 328800

SEQ ID NO: 386705 - RNA, 64 nt, Homo Sapiens; identical to SEQ ID NO: 328801

SEQ ID NO: 386706 - RNA, 64 nt, Homo Sapiens; identical to SEQ ID NO: 328802

SEQ ID NO: 386707 - RNA, 64 nt, Homo Sapiens; identical to SEQ ID NO: 328803

SEQ ID NO: 386708 - RNA, 64 nt, Homo Sapiens; identical to SEQ ID NO: 328804

SEQ ID NO: 386709 - RNA, 64 nt, Homo Sapiens
uguaacguccuuauagguguaucuguaaagucuggaacuagaucacuugagaaaauagaacuag

SEQ ID NO: 386710 - RNA, 64 nt, Homo Sapiens
uguaaagucuggaacuagauaacuugagaaaauagaacuagaucgccucaguuuccccaucugu

SEQ ID NO: 386711 - RNA, 64 nt, Homo Sapiens
gaacaaaauauauuuucucaaccugcugucuguugaacuagacuguaagccuucauuaagggcc

SEQ ID NO: 386712 - RNA, 64 nt, Homo Sapiens
acuuuuuaaggaauuaaaaguuuuaggauuuucagaacuagaauguagaauauguagcaaagcu

SEQ ID NO: 386713 - RNA, 64 nt, Homo Sapiens
gugcuguuuuuacaccacuucuggccaacucagaauaauuuagauuguucuuuuaacaaaaaag

SEQ ID NO: 386714 - RNA, 64 nt, Homo Sapiens
gaaucuaaucaaaaugugaauaguagucaaaaggauaauuuaauaagcauuuuacguuacuaaa

SEQ ID NO: 386715 - RNA, 64 nt, Homo Sapiens
gaacaagaauuaaaaaugaauaagcuaucaauauauaauuuaaguacaaguuuaggcugggcgu

SEQ ID NO: 386716 - RNA, 64 nt, Homo Sapiens
ucuagcauuuaaauuuaaauuuuauuaaaauuaaauaauuuaaaucuagcauuuaaauuuaaau

SEQ ID NO: 386717 - RNA, 64 nt, Homo Sapiens
aauuaaauaauuuaaaucuagcauuuaaauuuaaauaauuuaagucuagcauuuacuuuuaaau

SEQ ID NO: 386718 - RNA, 64 nt, Homo Sapiens
ugaauuugauuuaaauguuugcuuuuuugacaacauaauuuaaaaccacaccuggcaauucccu

SEQ ID NO: 386719 - RNA, 64 nt, Homo Sapiens
caaugggcuaagguccaagaauauucuacugaauauaauuuaaggcacauauuaguuagugcua

SEQ ID NO: 386720 - RNA, 64 nt, Homo Sapiens
caacuugaaaauuucgguaggggcccaggucaguauaauuuagucuuuuuauucuacuuacuug

SEQ ID NO: 386721 - RNA, 64 nt, Homo Sapiens
uuauauaaaugcuagaaauacuauacccugacacauaauuuaaaauaauuuaaaugggaaagaa

SEQ ID NO: 386722 - RNA, 64 nt, Homo Sapiens
ugggaaagaacuauacccugacuaaagauuccacauaauuuaaacacucuuaggcuuuuuuacu

SEQ ID NO: 386723 - RNA, 64 nt, Homo Sapiens
agucuuucuguuauuuaaaguugcuacaauaaugauaauuuauuuugacacaguucauaccagc

SEQ ID NO: 386724 - RNA, 64 nt, Homo Sapiens
ccuuuuauggacucugaagaaaaauugacagaagauaauuuauauucacuagaaaaauucuuuu

SEQ ID NO: 386725 - RNA, 64 nt, Homo Sapiens
aagugcaggaauguguuaauaaucuguaaauugaauaauuuaucgcagauagcaguuagcacuu

SEQ ID NO: 386726 - RNA, 64 nt, Homo Sapiens
guuuuaaauuaauuuuuuaguuuauuuugugagcauaauuuauuuuagccucauucagaauuuu

SEQ ID NO: 386727 - RNA, 64 nt, Homo Sapiens
uguaacuaguugggauuuuagcuucuacagaucaauaauuuaaagacuagaagacucuaaauug

SEQ ID NO: 386728 - RNA, 64 nt, Homo Sapiens
gaagguaaaguuaggggacugauuuuauuuuuguauaauuuaagacuugaaaucaaaacuauca

SEQ ID NO: 386729 - RNA, 64 nt, Homo Sapiens
gauuuaagaggauucacacucaacagguuuuaggauaauuuaaauaucaaaaauugauuguuau

SEQ ID NO: 386730 - RNA, 64 nt, Homo Sapiens
ucaaaaauugauuguuauacuuaacacauuagguauaauuuaucauuuaucugaaaucacaugu

SEQ ID NO: 386731 - RNA, 64 nt, Homo Sapiens
guuuauguaugucaauguuuuugucuuuaacagcauaauuuauauugcuuuuucaaaugaugua

SEQ ID NO: 386732 - RNA, 64 nt, Homo Sapiens
uauaaauaauggcaacucuuuguuuuauacauauauaauuuauaacugaaucuaaguauuagac

SEQ ID NO: 386733 - RNA, 64 nt, Homo Sapiens
cauagaccuaucuagggucaucauagaagccuuuauaauuuagaaagagacugcguugagacau

SEQ ID NO: 386734 - RNA, 64 nt, Homo Sapiens
ucucccacaccacaacuuuauuaagguauaguggauaauuuaaaacuguauauauugacgguac

SEQ ID NO: 386735 - RNA, 64 nt, Homo Sapiens
uagagcugcugaauuuguuuuguguuuuucuguaauaauuuaauguuacuuauuaucagaauuu

SEQ ID NO: 386736 - RNA, 64 nt, Homo Sapiens
gaauauuuccucuugacuucuuuuuguaacaaggauaauuuagggauuuauaaaguuguaagga

SEQ ID NO: 386737 - RNA, 64 nt, Homo Sapiens
uuaggaguuggauuuguuaucuucaaaacuacauauaauuuauuuacuuuuaugucaccucuac

SEQ ID NO: 386738 - RNA, 64 nt, Homo Sapiens
caaaagaaauuaagaaaauuaaaacagaggcaagauaauuuaauugauaaaauauuugucuaau

SEQ ID NO: 386739 - RNA, 64 nt, Homo Sapiens
uucucauugauguucuguauaggucucaagagauauaauuuagagaccucccuuggaaugaggg

SEQ ID NO: 386740 - RNA, 64 nt, Homo Sapiens
uuuauuauaugugcuaagcaaacaauggcuaaugauaauuuagcuaauuaauaauaaucauagu

SEQ ID NO: 386741 - RNA, 64 nt, Homo Sapiens
ccuaugagaagauagacuguuaauagccaugacuauaauuuaagcuggaugcuguuaauuucuu

SEQ ID NO: 386742 - RNA, 64 nt, Homo Sapiens
uaucuacuuuuuaggugcucaauaacaaaggugcauaauuuauugguaaucccaaaaacuaaca

SEQ ID NO: 386743 - RNA, 64 nt, Homo Sapiens
guuuuaucuucagaaauucucugcgauuaagaagauaauuuauuaaaggugguccuuccuaccu

SEQ ID NO: 386744 - RNA, 64 nt, Homo Sapiens
aaaaaaggaaagagcuccaaauugaaucaccuuuauaauuuacccauuucuauacaacaggcag

SEQ ID NO: 386745 - RNA, 64 nt, Homo Sapiens
acaggugugggccacugcaccuggcccagaugauauaauuuaacuguguuuuagguaacauguu

SEQ ID NO: 386746 - RNA, 64 nt, Homo Sapiens
aaggaaacuggauauuuuuagcacgaugugcaugauaauuuauaugcuugguggcugugcugcu

SEQ ID NO: 386747 - RNA, 64 nt, Homo Sapiens
uccuguuuuuaauguucuuuucaaucccaucuagauaauuuauagaaauauaacccuaauugga

SEQ ID NO: 386748 - RNA, 64 nt, Homo Sapiens
acauauauugauuuuuaaauagacagugacagauauaauuuacucaaagauagcauucauugag

SEQ ID NO: 386749 - RNA, 64 nt, Homo Sapiens
aaaaucaaaugaguauugaggauuugacaagagaauaauuuacaaugaaugggguugugaaacu

SEQ ID NO: 386750 - RNA, 64 nt, Homo Sapiens
ccauuucucucugugucuguugagugucagaacuauaauuuauucauaauuucuacauuguccc

SEQ ID NO: 386751 - RNA, 64 nt, Homo Sapiens
uggagauugaggaggcuuuguauaauuuauuuccauaauuuauuauccacuggacugugaagac

SEQ ID NO: 386752 - RNA, 64 nt, Homo Sapiens
uccauaauuuauuuggagauggacugugaagacuauaauuuauucauggguggcuaaauccacu

SEQ ID NO: 386753 - RNA, 64 nt, Homo Sapiens
cauugcagauacuuuuuagggugcuucacuggaaauaauuuauucugguguguguggaucugca

SEQ ID NO: 386754 - RNA, 64 nt, Homo Sapiens
aucuguccaaccagaaaagacccagguggugggaauaauuuacaagauaaacgugugccugucc

SEQ ID NO: 386755 - RNA, 64 nt, Homo Sapiens
ucauuuguucaggguaaaauuaugugaguaucuuauaauuuaguuuucauuucuuuugauguca

SEQ ID NO: 386756 - RNA, 64 nt, Homo Sapiens
aucaaggcuucagaaaaugcuauuuuuuaaaaaaauaauuuagucaugcaguaugaauacugug

SEQ ID NO: 386757 - RNA, 64 nt, Homo Sapiens
ugauaccacucuuuuucuucuaagccuguguguuauaauuuaccaguuccccaaaaugccauuu

SEQ ID NO: 386758 - RNA, 64 nt, Homo Sapiens
uauuuuguuagauauuuuauuuuuaauguuuucuauaauuuaaaaauguauagccugccaaaug

SEQ ID NO: 386759 - RNA, 64 nt, Homo Sapiens
uugagaaccaaagcaaccacaaaugcauaaaugcauaauuuauggucuucaaccaaggccacau

SEQ ID NO: 386760 - RNA, 64 nt, Homo Sapiens
auuguguaccuuaagauauugaaggagaaaauagauaauuuacaagauauuauuaauuuuuauu

SEQ ID NO: 386761 - RNA, 64 nt, Homo Sapiens
uuuuagucauuaacuucaaaauauauauauauauauaauuuaaaggaaaaauaggugccuccuu

SEQ ID NO: 386762 - RNA, 64 nt, Homo Sapiens
caugcauggauauuaguuuugauuaauguguacaauaauuuacacaguauacucuagucaauuu

SEQ ID NO: 386763 - RNA, 64 nt, Homo Sapiens
gaauuuauuggaacuugauuuggggaguuauauaauaauuuauuaaaaaaucuuccucuuucuc

SEQ ID NO: 386764 - RNA, 64 nt, Homo Sapiens
guguguucccagcuaacucuuaauuaauuuauuuauaauuuacuuaucuaguuuuuuaaauuuu

SEQ ID NO: 386765 - RNA, 64 nt, Homo Sapiens
ucaguagucaccuugcucacgcaauaaugugcuaauaauuuaugcaaccacaaugcaucugacu

SEQ ID NO: 386766 - RNA, 64 nt, Homo Sapiens
ggauuggugucuuaguacacugccuucuauacuuauaauuuaaaacagauaucagcuuaccuau

SEQ ID NO: 386767 - RNA, 64 nt, Homo Sapiens
cuugugcuaggugaggaaauuauuuuuaauuuugauaauuuaauauuccuagugugaucagcau

SEQ ID NO: 386768 - RNA, 64 nt, Homo Sapiens
gguauaucguaaggguaguguuuguuuuugaacgauaauuuagaaguucucauagaaagcguau

SEQ ID NO: 386769 - RNA, 64 nt, Homo Sapiens
uuuauuuugacauaaaguugauaaagauuuuuuaauaauuuagacuucaagcauggcuauuuua

SEQ ID NO: 386770 - RNA, 64 nt, Homo Sapiens
cuacuuugcugcuaugguuuucuccaagagcuacauaauuuaguuucauauaaaguaucaucag

SEQ ID NO: 386771 - RNA, 64 nt, Homo Sapiens
aauugaagaaauaaaauauuucggauaagguuucauaauuuacaaaugggaauuucauuuauaa

SEQ ID NO: 386772 - RNA, 64 nt, Homo Sapiens
ugccuaguagaagugauaaauuguguuauauaugauaauuuauauaaaaccacuaauuguuccg

SEQ ID NO: 386773 - RNA, 64 nt, Homo Sapiens
gucacaugaugugcauagagauagcuacaguguaauaauuuacacuauuuugugcuccaaacaa

SEQ ID NO: 386774 - RNA, 64 nt, Homo Sapiens
cugaaggaaaauaaacugacacuuauuaacuaagauaauuuacuuaauauaucuucccugauuu

SEQ ID NO: 386775 - RNA, 64 nt, Homo Sapiens
gucucaaaguaagauuugggccaaaaacaaaaagauaauuuagacauuugugaauuuacagacu

SEQ ID NO: 386776 - RNA, 64 nt, Homo Sapiens
caugaaaaugagaacacugacuucccauuucuguauaauuuaaggugaguagcuaacuuccaag

SEQ ID NO: 386777 - RNA, 64 nt, Homo Sapiens
acacuacaaugggggcaaauagaaauauuacagaauaauuuaaguaucagacuuuguaacaggu

SEQ ID NO: 386778 - RNA, 64 nt, Homo Sapiens
ccagcuaugcuauuuuuucauguuuuugggguuuauaauuuaaacuuagaaaaugucagacuuu

SEQ ID NO: 386779 - RNA, 64 nt, Homo Sapiens
aaacaugaaugucauuagaugggcaguguaaucaauaauuuaaaaaagccacacagagcugaau

SEQ ID NO: 386780 - RNA, 64 nt, Homo Sapiens
cucugguauggccaaagauuccucacagggagggauaauuuagacuuagacuuugaauguugac

SEQ ID NO: 386781 - RNA, 64 nt, Homo Sapiens
aggcuucaaaaauauaauuuuuuucucagcagcaauaauuuaaguugaaaaucacuaaaccucg

SEQ ID NO: 386782 - RNA, 64 nt, Homo Sapiens
uauucuucuucaauguuugucugucaacuaucccauaauuuauuaacaguguuugaaaugaaga

SEQ ID NO: 386783 - RNA, 64 nt, Homo Sapiens
gagacaaaauguauacaaauauauuccuuauggcauaauuuauugcauuucugacugaaaucaa

SEQ ID NO: 386784 - RNA, 64 nt, Homo Sapiens
agauaauguacaugcuucaugucaugucuuuaaaauaauuuaaucaacuuuauugucuuaguau

SEQ ID NO: 386785 - RNA, 64 nt, Homo Sapiens
uauguccauuuaacuagaauauauuauuuuagguauaauuuacaaaugucacaccuaauaaucu

SEQ ID NO: 386786 - RNA, 64 nt, Homo Sapiens
accugugagauguuugauauuaugaacaggaaacauaauuuaauguaugaauagaugugaauuu

SEQ ID NO: 386787 - RNA, 64 nt, Homo Sapiens
uuggucugcauuuuucuuuuugauuacaaaauuuauaauuuaauaaauacuagaguuuaucaaa

SEQ ID NO: 386788 - RNA, 64 nt, Homo Sapiens
auucuauucaaggcauagggccaaagcauuaaguauaauuuaaucccauacauucgaguuaagu

SEQ ID NO: 386789 - RNA, 64 nt, Homo Sapiens
aagugagacauaugggugagucauaauaaucaaaauaauuuaugaagagcugggucugcaauag

SEQ ID NO: 386790 - RNA, 64 nt, Homo Sapiens
gggguuucuccccacugauauuuuacauagagucauaauuuauaugucuuauaaauuauaaguc

SEQ ID NO: 386791 - RNA, 64 nt, Homo Sapiens
auaauuuauaugucuuauaaauuauaagucuuauauaauuuauaagucucccacaaucuuccag

SEQ ID NO: 386792 - RNA, 64 nt, Homo Sapiens
uauguuaauuuuuuugcuuccugaugugcaaauuauaauuuaaagacacaucugaaaaaguaau

SEQ ID NO: 386793 - RNA, 64 nt, Homo Sapiens
uaugaaagcuuacgcuauauugaugaaaugacauauaauuuauaagacugaugauacuaacagu

SEQ ID NO: 386794 - RNA, 64 nt, Homo Sapiens
uucugcauucaucuguucuuaaauugaaaaacauauaauuuacuucuuauaaauugaagucuua

SEQ ID NO: 386795 - RNA, 64 nt, Homo Sapiens
uuuuuuaaaguagauaugaagauuuuguuaauuuauaauuuauucauguguuauuacuguaauu

SEQ ID NO: 386796 - RNA, 64 nt, Homo Sapiens
guuaucagugaauaggugguguacuuuacuugguauaauuuaaaguugcacaguaaguacuguu

SEQ ID NO: 386797 - RNA, 64 nt, Homo Sapiens
cuuuaaucaguccucacaccuuucuacacauaagauaauuuauacuggagaggaacucuauagu

SEQ ID NO: 386798 - RNA, 64 nt, Homo Sapiens
aaaauauauuuuugcaagugaaguaaauauaaaaauaauuuaauccaaaauuaagucuauauaa

SEQ ID NO: 386799 - RNA, 64 nt, Homo Sapiens
gcugaguauagaaucagaaugcugaguauagaaaauaauuuaaaacuaaaguugguagguaaau

SEQ ID NO: 386800 - RNA, 64 nt, Homo Sapiens
uuagauaacuuuuguagcagugguuauauugcuuauaauuuaauguacaauacuauugaaacug

SEQ ID NO: 386801 - RNA, 64 nt, Homo Sapiens
guaaacauguauaaaguauuuguaauguuuggucauaauuuauuuaugaagacagcaaaagacu

SEQ ID NO: 386802 - RNA, 64 nt, Homo Sapiens
agucccauuugugauuuugccuaaaauaugcauuauaauuuagcgaaaagauauguuucucauu

SEQ ID NO: 386803 - RNA, 64 nt, Homo Sapiens
aucuuaagaaauuaucaaguuagcugaguacuauauaauuuacacuauuuaugaagaaauauuu

SEQ ID NO: 386804 - RNA, 64 nt, Homo Sapiens
uuauuuauucauuagaaauuuuccucauuucaaaauaauuuaugacucauggaauguugaucgc

SEQ ID NO: 386805 - RNA, 64 nt, Homo Sapiens
ccacuugaaaagugaugcuaaacagccaguaauaauaauuuaaauauaauuuauuauuucaaaa

SEQ ID NO: 386806 - RNA, 64 nt, Homo Sapiens
gugaugcuaaacagccaguaauaauaauuuaaauauaauuuauuauuucaaaagaauaugucuu

SEQ ID NO: 386807 - RNA, 64 nt, Homo Sapiens
gacagguaaaugugaguuaauaauuuauagacagauaauuuauagacaguuaaguaaaaaugga

SEQ ID NO: 386808 - RNA, 64 nt, Homo Sapiens
gacagauaauuuauagacaguuaaguaaaaauggauaauuuauaacaguuaaauuuauagacag

SEQ ID NO: 386809 - RNA, 64 nt, Homo Sapiens
gacaguuaaauuuauagacauuuaaaauuaauggauaauuuauagccucuacuccagccaacau

SEQ ID NO: 386810 - RNA, 64 nt, Homo Sapiens
auggaaagaaaauuuaauaacuuuuuaaagugacauaauuuacaugcaauauguuuaucaacuc

SEQ ID NO: 386811 - RNA, 64 nt, Homo Sapiens
guucaggggaauuuuaaagucaaaucuuuuguagauaauuuaaaaaaucagugugguuuauuuu

SEQ ID NO: 386812 - RNA, 64 nt, Homo Sapiens
gaaaaaugucuaucauuuacaguuucaauagcacauaauuuauuuucuaugcauuauaaauggc

SEQ ID NO: 386813 - RNA, 64 nt, Homo Sapiens
agcuccauguuucuuuaguuucacaaaaaugaccauaauuuaguguuauuuuuacuuuauuuag

SEQ ID NO: 386814 - RNA, 64 nt, Homo Sapiens
cugaucuauauauuuuuucuuucuaaaauuaaaaauaauuuauaaacuguacuucaaucucagu

SEQ ID NO: 386815 - RNA, 64 nt, Homo Sapiens
auccuuccagaugaucuuuuugcuggauuuguaaauaauuuaaagccauuauggcagaugaacc

SEQ ID NO: 386816 - RNA, 64 nt, Homo Sapiens
ugaauaauacuaugugcauggauuaugcaguaagauaauuuaacaaaauugccuccccggcaga

SEQ ID NO: 386817 - RNA, 64 nt, Homo Sapiens
auuaaguaaauuauuaccacuuccuagccuguggauaauuuacuuuguuauaaucaaauuugac

SEQ ID NO: 386818 - RNA, 64 nt, Homo Sapiens
aaaauaagagggaaagugcaucuuuuuaccaauaauaauuuauccuuaacauaaugugucuugu

SEQ ID NO: 386819 - RNA, 64 nt, Homo Sapiens
aaggauuagauuauuuaaugaacaucguuuaaaaauaauuuacuuguuuuaacauuuuuuaauc

SEQ ID NO: 386820 - RNA, 64 nt, Homo Sapiens
uuuccagggaguaaauauuuuacgcuuugcauauauaauuuauggagguguugagaggauagau

SEQ ID NO: 386821 - RNA, 64 nt, Homo Sapiens
acuggcagaaaaccaggaaucagagaaagaaaauauaauuuaacuuuaaagauguaaauuauau

SEQ ID NO: 386822 - RNA, 64 nt, Homo Sapiens
aaauccacaccacacucuaaguggacagcucagaauaauuuagcauauuuccuuucacacuuaa

SEQ ID NO: 386823 - RNA, 64 nt, Homo Sapiens
cuacuugugcugucguuuuguuuguuuuucuaugauaauuuaaaauacauagguagggcuacug

SEQ ID NO: 386824 - RNA, 64 nt, Homo Sapiens
acaauuauauaugaugcuauuguuugguuuuuccauaauuuacuuaaccaauccuugucacuga

SEQ ID NO: 386825 - RNA, 64 nt, Homo Sapiens
acucuaacaguaauaacuauaaaucucacuuuaaauaauuuaaaacaaauuaaagugauauaug

SEQ ID NO: 386826 - RNA, 64 nt, Homo Sapiens
caaaagguauaaagaugucaguuuaauuucuuugauaauuuaaccuauguuguaugugaauuau

SEQ ID NO: 386827 - RNA, 64 nt, Homo Sapiens
uuacucuugaaaugccagucauugacugauguagauaauuuaggauuuucauauaaaaauagcu

SEQ ID NO: 386828 - RNA, 64 nt, Homo Sapiens
gaugguuuggguagacuuuuuuuuuauaucaaguauaauuuaaaacaucagauuaaauaauuac

SEQ ID NO: 386829 - RNA, 64 nt, Homo Sapiens
uguagaaauggcccuaaagcaugcugcauaauuaauaauuuauauuuucauuauuauaaguguu

SEQ ID NO: 386830 - RNA, 64 nt, Homo Sapiens
gguaacagauauuauuguacguuuaaaauuuuauauaauuuaaaaauuuauuaaucuggagaau

SEQ ID NO: 386831 - RNA, 64 nt, Homo Sapiens
aaucuggagaauguuuaaaauguugauacuauguauaauuuauuacagaggugccagcuauuuc

SEQ ID NO: 386832 - RNA, 64 nt, Homo Sapiens
aauugacuaaaauuggguauaaauaauauaauuuauaauuuacaaaugucacaaacuguagcac

SEQ ID NO: 386833 - RNA, 64 nt, Homo Sapiens
auuuacaaauugacuaaaauguagcacaaauaauauaauuuauaagauuuaaaugucacaaacu

SEQ ID NO: 386834 - RNA, 64 nt, Homo Sapiens
aaccagauuuauuuucuauauguuugcuuugaacauaauuuaagaugagacauuacuguuuuaa

SEQ ID NO: 386835 - RNA, 64 nt, Homo Sapiens
accucuaauugcuuuauuucgaacuacuguauuuauaauuuauuuaaugcuuaaaacaauauuu

SEQ ID NO: 386836 - RNA, 64 nt, Homo Sapiens
ggaaagcuaugacuucucaguguauguaugauguauaauuuaagaauuuucuauauucuuacaa

SEQ ID NO: 386837 - RNA, 64 nt, Homo Sapiens
guguuugaguauuuucucauauuuagauuauucuauaauuuacccuucguuuuuaguuuuuaaa

SEQ ID NO: 386838 - RNA, 64 nt, Homo Sapiens
aguaggcgagaggcuaggaucuaucuuucucaaaauaauuuaaauuuuuuucucccagcuagug

SEQ ID NO: 386839 - RNA, 64 nt, Homo Sapiens
cucauucauuuuuuaaaggaugauggcuguacaaauaauuuagcuauugaaaaauauaaaucca

SEQ ID NO: 386840 - RNA, 64 nt, Homo Sapiens
uuuuacuuguuacccaugucuuauugugcaucagauaauuuauaugggagugaaacccuacaaa

SEQ ID NO: 386841 - RNA, 64 nt, Homo Sapiens
uuuguacagaauaaucuaaaggcaaaauaauuagauaauuuauuugcuuauauguuuuaaagua

SEQ ID NO: 386842 - RNA, 64 nt, Homo Sapiens
uuuauuauaacauccacaaagagauuauuuuuaaauaauuuaaagcauaauauuucuuaaaaag

SEQ ID NO: 386843 - RNA, 64 nt, Homo Sapiens
uuugaaaaaaaauuucaaaaagaaaaaaauauauauaauuuaaaacuacuuagucuuauucuuc

SEQ ID NO: 386844 - RNA, 64 nt, Homo Sapiens
uuuugugaguuuaaaugccuuauauuuaacaaucauaauuuaugacuaacuuguagauaucgug

SEQ ID NO: 386845 - RNA, 64 nt, Homo Sapiens
uaauuauuuuuauaguuguuuugcauuuuuaauuauaauuuauuuauuuagaaaggauacuaau

SEQ ID NO: 386846 - RNA, 64 nt, Homo Sapiens
uuuaagacaguaaaaauaaauucccuuuguguuaauaauuuaguaauggcagacuaaacacaca

SEQ ID NO: 386847 - RNA, 64 nt, Homo Sapiens
caugaacauauauuacaccagcuuagaggccucuauaauuuaaauguaagaaacaguuugcggu

SEQ ID NO: 386848 - RNA, 64 nt, Homo Sapiens
agcauugucuuaaaauacguuaguaucuaaaagcauaauuuaauauuauaaugucuucuauaug

SEQ ID NO: 386849 - RNA, 64 nt, Homo Sapiens
agaauuaucuuaaaauacauuucuuucuaaaaguauaauuuaauugguguuaauuacuaaaauu

SEQ ID NO: 386850 - RNA, 64 nt, Homo Sapiens
ucaagagaaugcuuuuauuuuuauacuaaaaucuauaauuuaauucccuccgaagagaaaauuu

SEQ ID NO: 386851 - RNA, 64 nt, Homo Sapiens
aaugaaauugcuguuugcccuucuuaagugucacauaauuuaaauucagaauaguugauuaacu

SEQ ID NO: 386852 - RNA, 64 nt, Homo Sapiens
cuuguauuacaaucuuuuuauauaaucuuuuucgauaauuuauuauauuaaaagauuauaauua

SEQ ID NO: 386853 - RNA, 64 nt, Homo Sapiens
uggaguguuuuguucauggauuggcaacauguugauaauuuaagaaagagagcuggaaacuaaa

SEQ ID NO: 386854 - RNA, 64 nt, Homo Sapiens
cuagguaaaauuuagauuguagaaauuauuaaacauaauuuauuaaugccuccugucaccucuc

SEQ ID NO: 386855 - RNA, 64 nt, Homo Sapiens
caauuuugaaagaaguuuugccuuguaaugaguaauaauuuagaaaguagacagugguuguguu

SEQ ID NO: 386856 - RNA, 64 nt, Homo Sapiens
uaaaaaggaagccugaaaaagacucauacuacaaauaauuuaauugauggcauauaagaauaug

SEQ ID NO: 386857 - RNA, 64 nt, Homo Sapiens
caguuuugcaauuuuuuaaagaucuauuucuguuauaauuuagguucugcagaaauaugauucu

SEQ ID NO: 386858 - RNA, 64 nt, Homo Sapiens
guaggugauuauccaaacaaguaaauuugaguguauaauuuaauuuuuaaccuguuaaauaaac

SEQ ID NO: 386859 - RNA, 64 nt, Homo Sapiens
gaaaaauaaauacuagacauucuuuaaauaagagauaauuuaaaaacaauccagagaaaguagu

SEQ ID NO: 386860 - RNA, 64 nt, Homo Sapiens
uuuaagaacuuuuuauuaaauguacauuugccauauaauuuauaacugaaaaaaagcaauguac

SEQ ID NO: 386861 - RNA, 64 nt, Homo Sapiens
cucugacccagcagaaaucaucaucaugaugaugauaauuuauuaacuuuuuggaagggugaau

SEQ ID NO: 386862 - RNA, 64 nt, Homo Sapiens
cacgaaaagacguucagccgccgauggcuugguuauaauuuauaacuuacuuauuuuuaucuaa

SEQ ID NO: 386863 - RNA, 64 nt, Homo Sapiens
uuuaauccuauuuaaauguucuuucaaaucucuaauaauuuaaacuuuccucagugcuccauga

SEQ ID NO: 386864 - RNA, 64 nt, Homo Sapiens
uuaaagcacuguuucccaaaucuaccugaucauaauaauuuaccaggaagcagaggagagcuac

SEQ ID NO: 386865 - RNA, 64 nt, Homo Sapiens
ugaacaccagguuggguuaauuaaagcuuuugguauaauuuaaaauuaaauuuauaaaugcagu

SEQ ID NO: 386866 - RNA, 64 nt, Homo Sapiens
aguaaaaguuaauugauauuaaaaauuauuagagauaauuuacuuaguaaaagcuucuaacucu

SEQ ID NO: 386867 - RNA, 64 nt, Homo Sapiens
gaagaaaaauaaaacaccuuguacuuuauuuucuauaauuuaaauauaugcuaagucuuauaua

SEQ ID NO: 386868 - RNA, 64 nt, Homo Sapiens
aaaauccacagaccaaccuggaguugaaaaucuuauaauuuaaaauaugcucuaaacauguuua

SEQ ID NO: 386869 - RNA, 64 nt, Homo Sapiens
uuggauuuaggcaggaagugccaguggaaauuguauaauuuaacgaauuaaaccguguugaaga

SEQ ID NO: 386870 - RNA, 64 nt, Homo Sapiens
auauacacuugucaauuuuucaucacuguuacugauaauuuauccguaccaguuaaauugguag

SEQ ID NO: 386871 - RNA, 64 nt, Homo Sapiens
cacaggcuaccuggaaacugcccauggcggggucauaauuuaaaugucccaaugucauauagag

SEQ ID NO: 386872 - RNA, 64 nt, Homo Sapiens
aucaaaaugagcuaaaacauggaacaaucacugaauaauuuaaaaagaguuuaccuggcagagu

SEQ ID NO: 386873 - RNA, 64 nt, Homo Sapiens
aaauguaaguuauauauauucuuuugaacguuggccuuacaaucgagagcucaucucauuuuua

SEQ ID NO: 386874 - RNA, 64 nt, Homo Sapiens
cucuggcaacagagaggcaacucuucccuuacccccuuacaaauaauguugcuuucuguacucc

SEQ ID NO: 386875 - RNA, 64 nt, Homo Sapiens
ugcaugucaucauagacuucauacuggagagaaaccuuacaaaugugaagcaugugacaaaguu

SEQ ID NO: 386876 - RNA, 64 nt, Homo Sapiens
uaaaagacauaggagaauucauacuggagagaaaccuuacaaguguaaugaguguggcaaagcc

SEQ ID NO: 386877 - RNA, 64 nt, Homo Sapiens
ugcaguucaucagugaacucauacuggagagaaaccuuacaaaugucaugacuguggcaagguc

SEQ ID NO: 386878 - RNA, 64 nt, Homo Sapiens
gucaugacugugccaaggucauacuggagagaaaccuuacaaauugcaggucaucggugaacuc

SEQ ID NO: 386879 - RNA, 64 nt, Homo Sapiens
guaaugaguguggcaaagccacacuggagagaaaccuuacaaguggaacaacauacuggacuuc

SEQ ID NO: 386880 - RNA, 64 nt, Homo Sapiens
gcaaugaguguggcaaagccacacuggagagaaaccuuacaaguggcacaccauacuagaauuc

SEQ ID NO: 386881 - RNA, 64 nt, Homo Sapiens
gugaugaguguggcaacaccaaacuggagagaaaccuuacaaauggcaaaacauauuagaauuc

SEQ ID NO: 386882 - RNA, 64 nt, Homo Sapiens
gcaaugaguguggcaaacccacacuggagagaaaccuuacaaguggcaccccauacuagaauuc

SEQ ID NO: 386883 - RNA, 64 nt, Homo Sapiens
acaaugaaugugacaugguuauaguggagagaaaccuuacaagcaaauucacaccuuguaauuc

SEQ ID NO: 386884 - RNA, 64 nt, Homo Sapiens
gggaggaaugugacaaaaguauacuggagagaaaccuuacaaauugcacaucaccauagacuuc

SEQ ID NO: 386885 - RNA, 64 nt, Homo Sapiens
auaaugaauguggcaagguuauacuggagagaaaccuuacaagcuguaagucauaaggcaauuc

SEQ ID NO: 386886 - RNA, 64 nt, Homo Sapiens
gagugcggccaguuuuucagaaaaaaaaaaguaaccuuacaaaguccaucuccaaaaaaaaaaa

SEQ ID NO: 386887 - RNA, 53 nt, Homo Sapiens
gacgccgggcgugguggcucaaaccuuacaaaggaagaauucauaguggauag

SEQ ID NO: 386888 - RNA, 64 nt, Homo Sapiens
augugacuucucccaaaggaucuguacuuucuuuccuuacaacagcuugaaaaucauuauuuua

SEQ ID NO: 386889 - RNA, 64 nt, Homo Sapiens
uaaucauguuuucgucacaugcugaguaaaagugccuuacaauguaaaaauuguacaguacuua

SEQ ID NO: 386890 - RNA, 64 nt, Homo Sapiens
uuaacacgagaaauuugaugugaccuuuuucugcgaaguucacgaaguucacagguuuugaaac

SEQ ID NO: 386891 - RNA, 64 nt, Homo Sapiens
gguuuugaaacugaccuuuuaagugcgcagcugggaaguucacauuaaaaaacuaagaugaaaa

SEQ ID NO: 386892 - RNA, 64 nt, Homo Sapiens
ggcgaugaagcgcuuacucuuugauccuucuccugaaguucagccacccugaggccucuggaaa

SEQ ID NO: 386893 - RNA, 64 nt, Homo Sapiens
uuacaaaggugaaaauuguuuguaagugaagugagaaguucauauuucuuuggcuuuuuugugu

SEQ ID NO: 386894 - RNA, 64 nt, Homo Sapiens
aucuaaagcagcaggucuaggcuuuuuugauucugaaguucagcuuacaugagacuuuccgacu

SEQ ID NO: 386895 - RNA, 64 nt, Homo Sapiens
uaacuggguuggcucucaaucuuucugcuuucccgaaguucagaucuuugagucuaacacacca

SEQ ID NO: 386896 - RNA, 64 nt, Homo Sapiens
gauguuacaguucuuaaaggcagugcuuuaaagugaaguucauucuguuuccaaaggcucuacu

SEQ ID NO: 386897 - RNA, 64 nt, Homo Sapiens
caguaaauacaugcuuaacaaaaggaaugagccugaaguucauaaagaauacauaucaauauuc

SEQ ID NO: 386898 - RNA, 64 nt, Homo Sapiens
uaucccauuuuagcaucuacaaccaugaugaccugaaguucaccgaauuuacaguuccuucaau

SEQ ID NO: 386899 - RNA, 64 nt, Homo Sapiens
uccugacaguauuauuaauacaagcaaggggcuagaaguucaccgcucuucaggaauguggcug

SEQ ID NO: 386900 - RNA, 64 nt, Homo Sapiens
aguucaauacugaaagaaaaucuccuuguuaucagagaaauauuuaggcucagccaguucaaug

SEQ ID NO: 386901 - RNA, 64 nt, Homo Sapiens
acagacagauacagucauuaaauugcugcagagggagaaauaagauucaggcuguuggccaggu

SEQ ID NO: 386902 - RNA, 64 nt, Homo Sapiens
ucacagaauuauuguggggacaccaucuacagaagagaaauacugucacuccuaguaucuauuu

SEQ ID NO: 386903 - RNA, 64 nt, Homo Sapiens
uaagaugauaaauaaaaugaauaguaauuaaaaugagaaauacaacuugaaauagaccuauaaa

SEQ ID NO: 386904 - RNA, 64 nt, Homo Sapiens
uaugaaguauuguuauuaaaugucuuuuuaaaaagagaaauauaaacauauauuuuuacuauua

SEQ ID NO: 386905 - RNA, 64 nt, Homo Sapiens
ucugcugguaaagcuucugaauauugaguuugcugagaaauaaaaaucaaaacuucuuuaagcu

SEQ ID NO: 386906 - RNA, 64 nt, Homo Sapiens
ucuuuuucgaauauaaccagaggaaaaaaggauggagaaauaucuaggaaagguaauuuugcga

SEQ ID NO: 386907 - RNA, 64 nt, Homo Sapiens
ucuuuuucgaauauaaccagagaaaaaaaggauggagaaauaucuaggaaagguaauuuugcga

SEQ ID NO: 386908 - RNA, 64 nt, Homo Sapiens
uuaggaaauagugaauaaggugcauuuaacuuuggagaaauacuuuuauggcuuugguggagau

SEQ ID NO: 386909 - RNA, 64 nt, Homo Sapiens
gaccuaagucuaguguauccauacaauuggugcagagaaauaagguguaaauggugcuuuguuc

SEQ ID NO: 386910 - RNA, 64 nt, Homo Sapiens
gcaaggaaugaaauuugauaaagcaaauauaaaugagaaauaugaggauugugaauuauugaaa

SEQ ID NO: 386911 - RNA, 64 nt, Homo Sapiens
uauauauauauauauauaugucugcaacuucagggagaaauaagauuguguuugaauauuguag

SEQ ID NO: 386912 - RNA, 64 nt, Homo Sapiens
aguaagucaaaucuguuugauaugaaaacaaauagagaaauaucagcugaaaauaaucaguucu

SEQ ID NO: 386913 - RNA, 64 nt, Homo Sapiens
ucuuaauguuuugguuacuucauaucugcaguaagagaaauauuuaauucagaugagacugagc

SEQ ID NO: 386914 - RNA, 64 nt, Homo Sapiens
aaauuuuuuauucuauuuucguuuuguucaacuugagaaauauuuaauguaaaucuuggaaagg

SEQ ID NO: 386915 - RNA, 64 nt, Homo Sapiens
accuuacuuuucuaugauuugggaggacuuauuugagaaauacucgucacugugguuuuagcau

SEQ ID NO: 386916 - RNA, 64 nt, Homo Sapiens
auggaugaagagcucuguagagaaagucuaagaggagaaauaugugaaaaugagucaugaacac

SEQ ID NO: 386917 - RNA, 64 nt, Homo Sapiens
uacugucuggggaugugugguuauaguucugugggagaaauaauuuugucaguguucaccagcu

SEQ ID NO: 386918 - RNA, 64 nt, Homo Sapiens
auaauuuugaaccaauuuauuauuguguacugaggagaaauaauguauaguagaggacagccuu

SEQ ID NO: 386919 - RNA, 64 nt, Homo Sapiens
acaugacaucacucccaauucucuccaaaccccagagaaauacugacgaaguuuucugaugugg

SEQ ID NO: 386920 - RNA, 64 nt, Homo Sapiens
ugggaaauauauuucacaccauugccuuuguguagagaaauauuucuuuuccuguguuaaugag

SEQ ID NO: 386921 - RNA, 64 nt, Homo Sapiens
caagaacauauuuaauuuaagaguuacuauuccugagaaauaauaaauaccagguaggaaagaa

SEQ ID NO: 386922 - RNA, 64 nt, Homo Sapiens
agguaggaaagaagaguuaccucaguaaacaaaagagaaauaccagauacccauuacauaguua

SEQ ID NO: 386923 - RNA, 64 nt, Homo Sapiens
gaucuagagucauuuccugcacacggcuguaauugagaaauacugauuaggaagaaaaugucuu

SEQ ID NO: 386924 - RNA, 64 nt, Homo Sapiens
aguccuaaauaacuaagaauuguuucccagaagagagaaauaaacaguggaagauauucuuucc

SEQ ID NO: 386925 - RNA, 64 nt, Homo Sapiens
caauuuaagaaaauguggaaaaaauauuuuuauugagaaauagcauuuuacuuuguuaauaucu

SEQ ID NO: 386926 - RNA, 64 nt, Homo Sapiens
aggggaacagggaugauuccuagucagagauugggagaaauacaagaugagccugaaucaucuc

SEQ ID NO: 386927 - RNA, 64 nt, Homo Sapiens
aauuucuacugcuuacacugacuauaaaauaucagagaaauaacaauuugguaaaauauaugca

SEQ ID NO: 386928 - RNA, 64 nt, Homo Sapiens
uucaguauucguaacacugucaguuauucccagugagaaauauuccuguggcccaugacauuug

SEQ ID NO: 386929 - RNA, 64 nt, Homo Sapiens
aaguccuauugauugcuucuguucugugaucauggagaaauacaaucagggagcugagagccug

SEQ ID NO: 386930 - RNA, 64 nt, Homo Sapiens
gaaaagagaccauguuuauuugauggggcaugcugagaaauagaggguggaccaguacuccagg

SEQ ID NO: 386931 - RNA, 64 nt, Homo Sapiens
gucguuaauaauuauguacuuaaaaauugcagaugagaaauauuguuauuugagaaagcauguu

SEQ ID NO: 386932 - RNA, 64 nt, Homo Sapiens
ucauuuguccacuggaugucaaauaugggaauuugagaaauauugcaacuuuuguuuaugauuc

SEQ ID NO: 386933 - RNA, 64 nt, Homo Sapiens
ucauuugcauauguaucuaguccacuuguguguggagaaauacauuagagggucucuggucauu

SEQ ID NO: 386934 - RNA, 64 nt, Homo Sapiens
gcacauuugacucuaagaagggacuugaaucauugagaaauaaauggguuugggaguaagcuug

SEQ ID NO: 386935 - RNA, 64 nt, Homo Sapiens
ggaggggagaagaucuaaccagcaacagggaaaagagaaauauuaucuuucaaugacauguaua

SEQ ID NO: 386936 - RNA, 64 nt, Homo Sapiens
agggaaaucacaauaauauagcaguaguuauacagagaaauacuacaaugaaaacauuuggggc

SEQ ID NO: 386937 - RNA, 64 nt, Homo Sapiens
aaaguguguucuuaacuccacucuuugagaaauagagaaauauagugugauuuacuuuucugau

SEQ ID NO: 386938 - RNA, 64 nt, Homo Sapiens
gaaauauaaaaguguguucuuuucugaucucuuugagaaauagaugcaaugugugugauuuacu

SEQ ID NO: 386939 - RNA, 64 nt, Homo Sapiens
auauacacuuaugccuuacauuaaaguccaauaugagaaauacauguuuaacauucaauaauaa

SEQ ID NO: 386940 - RNA, 64 nt, Homo Sapiens
cauguuuaacauucaauaauaauuuuaaaaauuugagaaauaaacucucauaaaugcacacauu

SEQ ID NO: 386941 - RNA, 64 nt, Homo Sapiens
gggacagaguacaaaagagagugucagccaacuugagaaauaaauucuuuucuauuuucccuaa

SEQ ID NO: 386942 - RNA, 64 nt, Homo Sapiens
augaauguaaggauaugagugaauucacacuggggagaaauacuaugccuaaguaugcaugaaa

SEQ ID NO: 386943 - RNA, 64 nt, Homo Sapiens
uuuaauguaacaacagcuagcuuuuaauggaggugagaaauaaaaaaacuccaaagcaaaaacc

SEQ ID NO: 386944 - RNA, 64 nt, Homo Sapiens
auuacuccaaagaacgaaagagcgccauacacaagagaaauauuuauuauugacaaauguauuc

SEQ ID NO: 386945 - RNA, 64 nt, Homo Sapiens
caggcuguaaauggguugccaacauaagcuggcugagaaauaaaagaaaacaagacaguuguuc

SEQ ID NO: 386946 - RNA, 64 nt, Homo Sapiens
guuuuccuaaauuguaugagagcuuucacacagugagaaauagagcaggcugccccauaaaugg

SEQ ID NO: 386947 - RNA, 64 nt, Homo Sapiens
uugaaagacaaaauuuagauuuaauuuacgucuugagaaauacuauauauacaauauauauuuu

SEQ ID NO: 386948 - RNA, 64 nt, Homo Sapiens
ccagcuuuuauaccaucaugaguggugacuuaaggagaaauagcuguauagaugaguuuuucau

SEQ ID NO: 386949 - RNA, 64 nt, Homo Sapiens
auauuuggauagggauuucaugucagagcagcaugagaaauaugucuugcaguuaauugcauau

SEQ ID NO: 386950 - RNA, 64 nt, Homo Sapiens
aaaaucuggggcagagugucugaagcaauuuuuugagaaauagugauaguauuauagagucuuu

SEQ ID NO: 386951 - RNA, 64 nt, Homo Sapiens; identical to SEQ ID NO: 110487

SEQ ID NO: 386952 - RNA, 64 nt, Homo Sapiens; identical to SEQ ID NO: 110488

SEQ ID NO: 386953 - RNA, 64 nt, Homo Sapiens; identical to SEQ ID NO: 110489

SEQ ID NO: 386954 - RNA, 64 nt, Homo Sapiens; identical to SEQ ID NO: 110490

SEQ ID NO: 386955 - RNA, 64 nt, Homo Sapiens; identical to SEQ ID NO: 110491

SEQ ID NO: 386956 - RNA, 64 nt, Homo Sapiens; identical to SEQ ID NO: 110492

SEQ ID NO: 386957 - RNA, 64 nt, Homo Sapiens; identical to SEQ ID NO: 110493

SEQ ID NO: 386958 - RNA, 64 nt, Homo Sapiens; identical to SEQ ID NO: 110494

SEQ ID NO: 386959 - RNA, 64 nt, Homo Sapiens; identical to SEQ ID NO: 110495

SEQ ID NO: 386960 - RNA, 64 nt, Homo Sapiens; identical to SEQ ID NO: 110496

SEQ ID NO: 386961 - RNA, 64 nt, Homo Sapiens; identical to SEQ ID NO: 110497

SEQ ID NO: 386962 - RNA, 64 nt, Homo Sapiens; identical to SEQ ID NO: 110498

SEQ ID NO: 386963 - RNA, 64 nt, Homo Sapiens; identical to SEQ ID NO: 110499

SEQ ID NO: 386964 - RNA, 64 nt, Homo Sapiens; identical to SEQ ID NO: 110500

SEQ ID NO: 386965 - RNA, 64 nt, Homo Sapiens; identical to SEQ ID NO: 110501

SEQ ID NO: 386966 - RNA, 64 nt, Homo Sapiens; identical to SEQ ID NO: 110502

SEQ ID NO: 386967 - RNA, 56 nt, Homo Sapiens; identical to SEQ ID NO: 110503

SEQ ID NO: 386968 - RNA, 64 nt, Homo Sapiens; identical to SEQ ID NO: 110504

SEQ ID NO: 386969 - RNA, 64 nt, Homo Sapiens; identical to SEQ ID NO: 110505

SEQ ID NO: 386970 - RNA, 64 nt, Homo Sapiens; identical to SEQ ID NO: 110506

SEQ ID NO: 386971 - RNA, 64 nt, Homo Sapiens; identical to SEQ ID NO: 110507

SEQ ID NO: 386972 - RNA, 64 nt, Homo Sapiens; identical to SEQ ID NO: 110508

SEQ ID NO: 386973 - RNA, 64 nt, Homo Sapiens; identical to SEQ ID NO: 110509

SEQ ID NO: 386974 - RNA, 64 nt, Homo Sapiens; identical to SEQ ID NO: 110510

SEQ ID NO: 386975 - RNA, 64 nt, Homo Sapiens; identical to SEQ ID NO: 110511

SEQ ID NO: 386976 - RNA, 64 nt, Homo Sapiens; identical to SEQ ID NO: 110512

SEQ ID NO: 386977 - RNA, 64 nt, Homo Sapiens; identical to SEQ ID NO: 110513

SEQ ID NO: 386978 - RNA, 64 nt, Homo Sapiens; identical to SEQ ID NO: 110514

SEQ ID NO: 386979 - RNA, 64 nt, Homo Sapiens; identical to SEQ ID NO: 110515

SEQ ID NO: 386980 - RNA, 64 nt, Homo Sapiens; identical to SEQ ID NO: 110516

SEQ ID NO: 386981 - RNA, 64 nt, Homo Sapiens; identical to SEQ ID NO: 110517

SEQ ID NO: 386982 - RNA, 64 nt, Homo Sapiens; identical to SEQ ID NO: 110518

SEQ ID NO: 386983 - RNA, 64 nt, Homo Sapiens; identical to SEQ ID NO: 110519

SEQ ID NO: 386984 - RNA, 64 nt, Homo Sapiens; identical to SEQ ID NO: 110520

SEQ ID NO: 386985 - RNA, 64 nt, Homo Sapiens; identical to SEQ ID NO: 110521

SEQ ID NO: 386986 - RNA, 64 nt, Homo Sapiens; identical to SEQ ID NO: 110522

SEQ ID NO: 386987 - RNA, 64 nt, Homo Sapiens; identical to SEQ ID NO: 110523

SEQ ID NO: 386988 - RNA, 64 nt, Homo Sapiens
cugcucucccugauagaugcugagagcauccagaaacuuccagaccagcccucucaccacaccc

SEQ ID NO: 386989 - RNA, 64 nt, Homo Sapiens
cacagccaggaggggccuuucccaccuggagagaaacuuccagaccagccccucauaccacagc

SEQ ID NO: 386990 - RNA, 64 nt, Homo Sapiens
cacagccaggagaggccuuucccaccgguagagaaacuuccagaccagccccucacaccacagc

SEQ ID NO: 386991 - RNA, 64 nt, Homo Sapiens
cacagccaagagaagccuuuccagccuggagagaaacuuccagaccagcccucucacuacagcc

SEQ ID NO: 386992 - RNA, 64 nt, Homo Sapiens
cacagccaggagaggccuuucccaccuggacagaaacuuccagaccagccccucucaccacagc

SEQ ID NO: 386993 - RNA, 64 nt, Homo Sapiens
cacagccaggagaggccuuucccaccuggagagaaacuuccagaccagccccucauaccacagc

SEQ ID NO: 386994 - RNA, 64 nt, Homo Sapiens
cacagccaagaggggccuuucucaccuggagagaaacuuccagaccagccccucacaccaccgc

SEQ ID NO: 386995 - RNA, 64 nt, Homo Sapiens
caccgccaggagaggccuuucccaccgggagagaaacuuccagaccagccccucacaccacagc

SEQ ID NO: 386996 - RNA, 64 nt, Homo Sapiens
cacagccaggagaggccuuucccaccgggagagaaacuuccagaccagcccucucacuacagcc

SEQ ID NO: 386997 - RNA, 64 nt, Homo Sapiens
uacagccagaagaggccuuucccaccgggagaggaacuuccagaccagccccucacaccacagc

SEQ ID NO: 386998 - RNA, 64 nt, Homo Sapiens
cacagccaggagaggccuuucccaccuggagagaaacuuccagaccagccccucucaccacagc

SEQ ID NO: 386999 - RNA, 64 nt, Homo Sapiens
acuagaagguggaaaccaaauaacuuucuaacagaacuuccauauccgacacaacuuccauuac

SEQ ID NO: 387000 - RNA, 64 nt, Homo Sapiens
acuaacuuucuaacagaacuaaacuuuccgacacaacuuccauuuauaugggaugaacacuuuu

SEQ ID NO: 387001 - RNA, 64 nt, Homo Sapiens
uuauacauuugauguauugagguauucuuaagggaacuuccacaaguuuaacauguguggucuu

SEQ ID NO: 387002 - RNA, 64 nt, Homo Sapiens
auugaucauagguauuucaacaagcaggaaguucaacuuccagaacaugugaaggggaugagcu

SEQ ID NO: 387003 - RNA, 64 nt, Homo Sapiens
uccuggguuccagcaguucuucucggcucacugcaacuuccaccgcuggagugcaguggcguga

SEQ ID NO: 387004 - RNA, 64 nt, Homo Sapiens
uuaaugaaaguugaccauaguaacauuaucagucaacuuccacauucuuuuucacuuugacucu

SEQ ID NO: 387005 - RNA, 64 nt, Homo Sapiens
aggguccuuccuaccuuugagccuuugccuugcaaacuuccaucccugucaugucuucaguuau

SEQ ID NO: 387006 - RNA, 64 nt, Homo Sapiens
ggagccgcgaagggcgcugggcaguguggccgccaacuuccaccccggcaagccccucuguccu

SEQ ID NO: 387007 - RNA, 64 nt, Homo Sapiens
cuccagccugugugucuugaugucugacugguucaacuuccacggucacaugugcaucgccuuu

SEQ ID NO: 387008 - RNA, 64 nt, Homo Sapiens
gggcaagaacaccuuugaguuccugaaggagaauaacuuccagccuuacccccuaccacauguc

SEQ ID NO: 387009 - RNA, 64 nt, Homo Sapiens
gauuuuauugugaacuuacacucuuuccaauuugaacuuccagggagcccaugaccccaaacug

SEQ ID NO: 387010 - RNA, 64 nt, Homo Sapiens
aauaucuagguuuguccucauuagaacuggaagaaacuuccaaaugugaucugaucauaggcaa

SEQ ID NO: 387011 - RNA, 64 nt, Homo Sapiens
ucugacacauuucuauuuuauucuaacauaaaaaaacuuccauuauauauuuacuaaguauauu

SEQ ID NO: 387012 - RNA, 64 nt, Homo Sapiens
guuugggguguucauuagacacuuaauaaaacuuaacuuccaaugaaaaagaaaucuuuuguaa

SEQ ID NO: 387013 - RNA, 64 nt, Homo Sapiens
gauaaauaccuuucaagugugagcuuagacgucaacccuaaaauacuuaaccguaaugcuaauu

SEQ ID NO: 387014 - RNA, 64 nt, Homo Sapiens
uuucugcaguuauuucucuuguucuggccaaacaacccuaaaaauccuuaccauuccacaaagu

SEQ ID NO: 387015 - RNA, 64 nt, Homo Sapiens
ugaauagcucuagcaacuauuauuauucccccaaacccuaaaauucuaccuauuaggugucagg

SEQ ID NO: 387016 - RNA, 64 nt, Homo Sapiens
cugauuaauugauuuauaagguucaacacugucuacccuaaauaauuuuuauaugcucaaggca

SEQ ID NO: 387017 - RNA, 64 nt, Homo Sapiens
auguguugccuggaagcacaccccaaaaguacuuacccuaaaacuauuaaauaacaguguguga

SEQ ID NO: 387018 - RNA, 64 nt, Homo Sapiens
uggacaucaugaagcaucaaaacaaugaaugcugacccuaaaugggacccaguguucuuagcug

SEQ ID NO: 387019 - RNA, 64 nt, Homo Sapiens
ugcucuaaaaaaugaaguguucaauuuuucuguaacccuaaagcgaauucucuguacuuuuugc

SEQ ID NO: 387020 - RNA, 64 nt, Homo Sapiens
cuuauuguuaagugaaaaccaaagacauauaggaacccuaaaugaauuagacaucaagucauua

SEQ ID NO: 387021 - RNA, 64 nt, Homo Sapiens
auuacaaaauaagucccgcauuuuauuuuucaaaacccuaaaauaaaaaaaauugauuuccaua

SEQ ID NO: 387022 - RNA, 64 nt, Homo Sapiens
gagaagaaucuuaaugaacaagagaaggggagaaacccuaaaaaacaaggaaggaaaagaaaga

SEQ ID NO: 387023 - RNA, 64 nt, Homo Sapiens
guucucccugaguugauugauaggcuuaauggucacccuaaaaacacccacauaugcuuuucga

SEQ ID NO: 387024 - RNA, 64 nt, Homo Sapiens
ugcauucaucauaauaauuccagacauuuucaucacccuaaaaggaaacccugaaacccauuag

SEQ ID NO: 387025 - RNA, 64 nt, Homo Sapiens
uucuccaagacagauuuucggaacacauuucccuacccuaaagcgacaucccaguaguguuugg

SEQ ID NO: 387026 - RNA, 64 nt, Homo Sapiens
uugucuuuguuauaaaugaggucacuauggacuuacccuaaagaucuucuguacuucucucuuc

SEQ ID NO: 387027 - RNA, 64 nt, Homo Sapiens; identical to SEQ ID NO: 73390

SEQ ID NO: 387028 - RNA, 64 nt, Homo Sapiens; identical to SEQ ID NO: 73391

SEQ ID NO: 387029 - RNA, 64 nt, Homo Sapiens; identical to SEQ ID NO: 73392

SEQ ID NO: 387030 - RNA, 64 nt, Homo Sapiens; identical to SEQ ID NO: 73393

SEQ ID NO: 387031 - RNA, 64 nt, Homo Sapiens; identical to SEQ ID NO: 73394

SEQ ID NO: 387032 - RNA, 64 nt, Homo Sapiens; identical to SEQ ID NO: 73395

SEQ ID NO: 387033 - RNA, 64 nt, Homo Sapiens; identical to SEQ ID NO: 73396

SEQ ID NO: 387034 - RNA, 64 nt, Homo Sapiens; identical to SEQ ID NO: 73397

SEQ ID NO: 387035 - RNA, 64 nt, Homo Sapiens; identical to SEQ ID NO: 73398

SEQ ID NO: 387036 - RNA, 64 nt, Homo Sapiens; identical to SEQ ID NO: 73399

SEQ ID NO: 387037 - RNA, 64 nt, Homo Sapiens; identical to SEQ ID NO: 73400

SEQ ID NO: 387038 - RNA, 64 nt, Homo Sapiens; identical to SEQ ID NO: 73401

SEQ ID NO: 387039 - RNA, 64 nt, Homo Sapiens; identical to SEQ ID NO: 73402

SEQ ID NO: 387040 - RNA, 64 nt, Homo Sapiens; identical to SEQ ID NO: 73403

SEQ ID NO: 387041 - RNA, 64 nt, Homo Sapiens; identical to SEQ ID NO: 73404

SEQ ID NO: 387042 - RNA, 64 nt, Homo Sapiens; identical to SEQ ID NO: 73405

SEQ ID NO: 387043 - RNA, 64 nt, Homo Sapiens; identical to SEQ ID NO: 73406

SEQ ID NO: 387044 - RNA, 64 nt, Homo Sapiens; identical to SEQ ID NO: 73407

SEQ ID NO: 387045 - RNA, 64 nt, Homo Sapiens; identical to SEQ ID NO: 73408

SEQ ID NO: 387046 - RNA, 64 nt, Homo Sapiens; identical to SEQ ID NO: 73409

SEQ ID NO: 387047 - RNA, 64 nt, Homo Sapiens
aaacuagauuugguauguuugaaugaacaaguuaaugaacaaacaaauucucauuauuugcaaa

SEQ ID NO: 387048 - RNA, 64 nt, Homo Sapiens
uaaugaacaaacaaacuagaauuauuugcaaagaaugaacaaguuaauggaaaaaaaaauucuc

SEQ ID NO: 387049 - RNA, 64 nt, Homo Sapiens
ucuggaaauggauagcgaugaguuucuguuugggaugaacaaauuuauuguuuaacgaguacau

SEQ ID NO: 387050 - RNA, 64 nt, Homo Sapiens
auuaaugucgauaauaaaacccuaaaucuucagcaugaacaaauuuuuugcccauuacuucauc

SEQ ID NO: 387051 - RNA, 64 nt, Homo Sapiens
guuugcuauaagaaacauacagcacaaguguugcaugaacaacaauccugugccuuccccuuug

SEQ ID NO: 387052 - RNA, 64 nt, Homo Sapiens
uauuuugagccacuuuagggagauguaggcagccaugaacaaucuuuuagaaucuuuuuaucuu

SEQ ID NO: 387053 - RNA, 64 nt, Homo Sapiens
cauauucagggcauguuuaaugcuaaagaugagaaugaacaaaggcauacuaaaaugaacaagu

SEQ ID NO: 387054 - RNA, 64 nt, Homo Sapiens
ugcuaaagaugagaaugaacgcaagcauacuaaaaugaacaagugauggagcgcagauauccag

SEQ ID NO: 387055 - RNA, 64 nt, Homo Sapiens
ugauuugguuacugcaaugcagauggauguuuggaugaacaacugauacauuuuaguuagaaug

SEQ ID NO: 387056 - RNA, 64 nt, Homo Sapiens
gagauuugcuuuaaagaaaugcuuuaguaagaauaugaacaauuuccugaugucuccuauaaau

SEQ ID NO: 387057 - RNA, 64 nt, Homo Sapiens
ccaugagcgcuccagugaacagaacaggaaucugaugaacaagcuggugaauaaccuuggcagu

SEQ ID NO: 387058 - RNA, 64 nt, Homo Sapiens
ccuuuccccuucagauggagacuucauuauguuaaugaacaagauaugaagaaaauggcacuca

SEQ ID NO: 387059 - RNA, 64 nt, Homo Sapiens
aaauuaaaaucauaauauaaacgcuugguuuuacaugaacaaaaaguggugugcucgaaaaaga

SEQ ID NO: 387060 - RNA, 64 nt, Homo Sapiens
gugugugugcaugcacucaggugcccuuuguuucaugaacaaauacauuucauuguacauguuu

SEQ ID NO: 387061 - RNA, 64 nt, Homo Sapiens
gacuuaaugcuuuuuaagcaaguacacgguuguuaugaacaaaucugaaaaauaagaagaugag

SEQ ID NO: 387062 - RNA, 64 nt, Homo Sapiens
gauuaaacuccaaauauuaauauguagauuauuaaugaacaaaaucuaggaguuucuuagaccc

SEQ ID NO: 387063 - RNA, 64 nt, Homo Sapiens
aaaaauucccagaccacagaaaugccuugaaagaaugaacaaauagaaauuauccuuucuuacu

SEQ ID NO: 387064 - RNA, 64 nt, Homo Sapiens
guacauacacucaggaaggucagaggcccaauaaaugaacaaauauucauuuucauuuguuggg

SEQ ID NO: 387065 - RNA, 64 nt, Homo Sapiens
uuuaauguauaguuuugaauuaagacacaaaugcaugaacaagugaggguagggaauaaaaucc

SEQ ID NO: 387066 - RNA, 64 nt, Homo Sapiens
ccaaaacccaugugggaaaaauuuccaguguucuaugaacaacuaaacucuugaagagucgauu

SEQ ID NO: 387067 - RNA, 64 nt, Homo Sapiens; identical to SEQ ID NO: 338022

SEQ ID NO: 387068 - RNA, 64 nt, Homo Sapiens; identical to SEQ ID NO: 338023

SEQ ID NO: 387069 - RNA, 64 nt, Homo Sapiens; identical to SEQ ID NO: 338024

SEQ ID NO: 387070 - RNA, 64 nt, Homo Sapiens; identical to SEQ ID NO: 338025

SEQ ID NO: 387071 - RNA, 64 nt, Homo Sapiens; identical to SEQ ID NO: 338026

SEQ ID NO: 387072 - RNA, 64 nt, Homo Sapiens; identical to SEQ ID NO: 338027

SEQ ID NO: 387073 - RNA, 64 nt, Homo Sapiens; identical to SEQ ID NO: 338028

SEQ ID NO: 387074 - RNA, 64 nt, Homo Sapiens; identical to SEQ ID NO: 338029

SEQ ID NO: 387075 - RNA, 64 nt, Homo Sapiens; identical to SEQ ID NO: 338030

SEQ ID NO: 387076 - RNA, 64 nt, Homo Sapiens; identical to SEQ ID NO: 338031

SEQ ID NO: 387077 - RNA, 64 nt, Homo Sapiens; identical to SEQ ID NO: 338032

SEQ ID NO: 387078 - RNA, 64 nt, Homo Sapiens; identical to SEQ ID NO: 338033

SEQ ID NO: 387079 - RNA, 64 nt, Homo Sapiens; identical to SEQ ID NO: 338034

SEQ ID NO: 387080 - RNA, 64 nt, Homo Sapiens; identical to SEQ ID NO: 338035

SEQ ID NO: 387081 - RNA, 64 nt, Homo Sapiens; identical to SEQ ID NO: 338036

SEQ ID NO: 387082 - RNA, 64 nt, Homo Sapiens; identical to SEQ ID NO: 338037

SEQ ID NO: 387083 - RNA, 64 nt, Homo Sapiens; identical to SEQ ID NO: 338038

SEQ ID NO: 387084 - RNA, 64 nt, Homo Sapiens; identical to SEQ ID NO: 338039

SEQ ID NO: 387085 - RNA, 64 nt, Homo Sapiens; identical to SEQ ID NO: 338040

SEQ ID NO: 387086 - RNA, 64 nt, Homo Sapiens; identical to SEQ ID NO: 338041

SEQ ID NO: 387087 - RNA, 64 nt, Homo Sapiens; identical to SEQ ID NO: 338042

SEQ ID NO: 387088 - RNA, 64 nt, Homo Sapiens; identical to SEQ ID NO: 338043

SEQ ID NO: 387089 - RNA, 64 nt, Homo Sapiens; identical to SEQ ID NO: 338044

SEQ ID NO: 387090 - RNA, 64 nt, Homo Sapiens; identical to SEQ ID NO: 338045

SEQ ID NO: 387091 - RNA, 64 nt, Homo Sapiens; identical to SEQ ID NO: 338046

SEQ ID NO: 387092 - RNA, 64 nt, Homo Sapiens; identical to SEQ ID NO: 338047

SEQ ID NO: 387093 - RNA, 64 nt, Homo Sapiens; identical to SEQ ID NO: 338048

SEQ ID NO: 387094 - RNA, 64 nt, Homo Sapiens; identical to SEQ ID NO: 338049

SEQ ID NO: 387095 - RNA, 64 nt, Homo Sapiens; identical to SEQ ID NO: 338050

SEQ ID NO: 387096 - RNA, 64 nt, Homo Sapiens; identical to SEQ ID NO: 338051

SEQ ID NO: 387097 - RNA, 64 nt, Homo Sapiens; identical to SEQ ID NO: 275791

SEQ ID NO: 387098 - RNA, 64 nt, Homo Sapiens; identical to SEQ ID NO: 275792

SEQ ID NO: 387099 - RNA, 64 nt, Homo Sapiens; identical to SEQ ID NO: 275793

SEQ ID NO: 387100 - RNA, 64 nt, Homo Sapiens; identical to SEQ ID NO: 275794

SEQ ID NO: 387101 - RNA, 64 nt, Homo Sapiens; identical to SEQ ID NO: 275795

SEQ ID NO: 387102 - RNA, 64 nt, Homo Sapiens; identical to SEQ ID NO: 275796

SEQ ID NO: 387103 - RNA, 64 nt, Homo Sapiens; identical to SEQ ID NO: 275797

SEQ ID NO: 387104 - RNA, 64 nt, Homo Sapiens; identical to SEQ ID NO: 275798

SEQ ID NO: 387105 - RNA, 64 nt, Homo Sapiens; identical to SEQ ID NO: 275799

SEQ ID NO: 387106 - RNA, 64 nt, Homo Sapiens; identical to SEQ ID NO: 275800

SEQ ID NO: 387107 - RNA, 64 nt, Homo Sapiens; identical to SEQ ID NO: 275801

SEQ ID NO: 387108 - RNA, 64 nt, Homo Sapiens; identical to SEQ ID NO: 275802

SEQ ID NO: 387109 - RNA, 64 nt, Homo Sapiens; identical to SEQ ID NO: 275803

SEQ ID NO: 387110 - RNA, 64 nt, Homo Sapiens; identical to SEQ ID NO: 275804

SEQ ID NO: 387111 - RNA, 64 nt, Homo Sapiens; identical to SEQ ID NO: 275805

SEQ ID NO: 387112 - RNA, 64 nt, Homo Sapiens; identical to SEQ ID NO: 275806

SEQ ID NO: 387113 - RNA, 64 nt, Homo Sapiens; identical to SEQ ID NO: 275807

SEQ ID NO: 387114 - RNA, 64 nt, Homo Sapiens; identical to SEQ ID NO: 275808

SEQ ID NO: 387115 - RNA, 64 nt, Homo Sapiens; identical to SEQ ID NO: 275809

SEQ ID NO: 387116 - RNA, 64 nt, Homo Sapiens; identical to SEQ ID NO: 275810

SEQ ID NO: 387117 - RNA, 64 nt, Homo Sapiens; identical to SEQ ID NO: 275811

SEQ ID NO: 387118 - RNA, 64 nt, Homo Sapiens; identical to SEQ ID NO: 275812

SEQ ID NO: 387119 - RNA, 64 nt, Homo Sapiens; identical to SEQ ID NO: 275813

SEQ ID NO: 387120 - RNA, 64 nt, Homo Sapiens; identical to SEQ ID NO: 275814

SEQ ID NO: 387121 - RNA, 64 nt, Homo Sapiens; identical to SEQ ID NO: 275815

SEQ ID NO: 387122 - RNA, 64 nt, Homo Sapiens; identical to SEQ ID NO: 275816

SEQ ID NO: 387123 - RNA, 64 nt, Homo Sapiens; identical to SEQ ID NO: 275817

SEQ ID NO: 387124 - RNA, 64 nt, Homo Sapiens; identical to SEQ ID NO: 275818

SEQ ID NO: 387125 - RNA, 64 nt, Homo Sapiens; identical to SEQ ID NO: 275819

SEQ ID NO: 387126 - RNA, 64 nt, Homo Sapiens; identical to SEQ ID NO: 275820

SEQ ID NO: 387127 - RNA, 64 nt, Homo Sapiens; identical to SEQ ID NO: 275821

SEQ ID NO: 387128 - RNA, 64 nt, Homo Sapiens; identical to SEQ ID NO: 275822

SEQ ID NO: 387129 - RNA, 64 nt, Homo Sapiens; identical to SEQ ID NO: 275823

SEQ ID NO: 387130 - RNA, 64 nt, Homo Sapiens; identical to SEQ ID NO: 275824

SEQ ID NO: 387131 - RNA, 64 nt, Homo Sapiens; identical to SEQ ID NO: 275825

SEQ ID NO: 387132 - RNA, 64 nt, Homo Sapiens; identical to SEQ ID NO: 275826

SEQ ID NO: 387133 - RNA, 64 nt, Homo Sapiens; identical to SEQ ID NO: 275827

SEQ ID NO: 387134 - RNA, 64 nt, Homo Sapiens; identical to SEQ ID NO: 275828

SEQ ID NO: 387135 - RNA, 64 nt, Homo Sapiens; identical to SEQ ID NO: 275829

SEQ ID NO: 387136 - RNA, 64 nt, Homo Sapiens; identical to SEQ ID NO: 275830

SEQ ID NO: 387137 - RNA, 64 nt, Homo Sapiens; identical to SEQ ID NO: 275831

SEQ ID NO: 387138 - RNA, 64 nt, Homo Sapiens; identical to SEQ ID NO: 275832

SEQ ID NO: 387139 - RNA, 64 nt, Homo Sapiens; identical to SEQ ID NO: 275833

SEQ ID NO: 387140 - RNA, 64 nt, Homo Sapiens; identical to SEQ ID NO: 275834

SEQ ID NO: 387141 - RNA, 64 nt, Homo Sapiens; identical to SEQ ID NO: 275835

SEQ ID NO: 387142 - RNA, 64 nt, Homo Sapiens; identical to SEQ ID NO: 275836

SEQ ID NO: 387143 - RNA, 64 nt, Homo Sapiens; identical to SEQ ID NO: 275837

SEQ ID NO: 387144 - RNA, 64 nt, Homo Sapiens; identical to SEQ ID NO: 275838

SEQ ID NO: 387145 - RNA, 64 nt, Homo Sapiens; identical to SEQ ID NO: 275839

SEQ ID NO: 387146 - RNA, 64 nt, Homo Sapiens; identical to SEQ ID NO: 275840

SEQ ID NO: 387147 - RNA, 64 nt, Homo Sapiens; identical to SEQ ID NO: 223465

SEQ ID NO: 387148 - RNA, 64 nt, Homo Sapiens; identical to SEQ ID NO: 223466

SEQ ID NO: 387149 - RNA, 64 nt, Homo Sapiens; identical to SEQ ID NO: 223467

SEQ ID NO: 387150 - RNA, 64 nt, Homo Sapiens; identical to SEQ ID NO: 223468

SEQ ID NO: 387151 - RNA, 64 nt, Homo Sapiens; identical to SEQ ID NO: 223469

SEQ ID NO: 387152 - RNA, 64 nt, Homo Sapiens; identical to SEQ ID NO: 223470

SEQ ID NO: 387153 - RNA, 64 nt, Homo Sapiens; identical to SEQ ID NO: 223471

SEQ ID NO: 387154 - RNA, 64 nt, Homo Sapiens; identical to SEQ ID NO: 223472

SEQ ID NO: 387155 - RNA, 64 nt, Homo Sapiens; identical to SEQ ID NO: 223473

SEQ ID NO: 387156 - RNA, 64 nt, Homo Sapiens; identical to SEQ ID NO: 223474

SEQ ID NO: 387157 - RNA, 64 nt, Homo Sapiens; identical to SEQ ID NO: 223475

SEQ ID NO: 387158 - RNA, 64 nt, Homo Sapiens; identical to SEQ ID NO: 223476

SEQ ID NO: 387159 - RNA, 64 nt, Homo Sapiens; identical to SEQ ID NO: 223477

SEQ ID NO: 387160 - RNA, 64 nt, Homo Sapiens; identical to SEQ ID NO: 223478

SEQ ID NO: 387161 - RNA, 64 nt, Homo Sapiens; identical to SEQ ID NO: 223479

SEQ ID NO: 387162 - RNA, 64 nt, Homo Sapiens; identical to SEQ ID NO: 223480

SEQ ID NO: 387163 - RNA, 64 nt, Homo Sapiens; identical to SEQ ID NO: 223481

SEQ ID NO: 387164 - RNA, 64 nt, Homo Sapiens; identical to SEQ ID NO: 223482

SEQ ID NO: 387165 - RNA, 64 nt, Homo Sapiens; identical to SEQ ID NO: 223483

SEQ ID NO: 387166 - RNA, 64 nt, Homo Sapiens; identical to SEQ ID NO: 223484

SEQ ID NO: 387167 - RNA, 64 nt, Homo Sapiens; identical to SEQ ID NO: 223485

SEQ ID NO: 387168 - RNA, 64 nt, Homo Sapiens; identical to SEQ ID NO: 223486

SEQ ID NO: 387169 - RNA, 64 nt, Homo Sapiens; identical to SEQ ID NO: 223487

SEQ ID NO: 387170 - RNA, 64 nt, Homo Sapiens; identical to SEQ ID NO: 223488

SEQ ID NO: 387171 - RNA, 64 nt, Homo Sapiens; identical to SEQ ID NO: 223489

SEQ ID NO: 387172 - RNA, 64 nt, Homo Sapiens; identical to SEQ ID NO: 223490

SEQ ID NO: 387173 - RNA, 64 nt, Homo Sapiens; identical to SEQ ID NO: 223491

SEQ ID NO: 387174 - RNA, 64 nt, Homo Sapiens; identical to SEQ ID NO: 223492

SEQ ID NO: 387175 - RNA, 64 nt, Homo Sapiens; identical to SEQ ID NO: 223493

SEQ ID NO: 387176 - RNA, 64 nt, Homo Sapiens; identical to SEQ ID NO: 223494

SEQ ID NO: 387177 - RNA, 64 nt, Homo Sapiens; identical to SEQ ID NO: 223495

SEQ ID NO: 387178 - RNA, 64 nt, Homo Sapiens; identical to SEQ ID NO: 223496

SEQ ID NO: 387179 - RNA, 64 nt, Homo Sapiens; identical to SEQ ID NO: 223497

SEQ ID NO: 387180 - RNA, 64 nt, Homo Sapiens; identical to SEQ ID NO: 223498

SEQ ID NO: 387181 - RNA, 64 nt, Homo Sapiens; identical to SEQ ID NO: 223499

SEQ ID NO: 387182 - RNA, 64 nt, Homo Sapiens; identical to SEQ ID NO: 223500

SEQ ID NO: 387183 - RNA, 64 nt, Homo Sapiens; identical to SEQ ID NO: 223501

SEQ ID NO: 387184 - RNA, 64 nt, Homo Sapiens; identical to SEQ ID NO: 223502

SEQ ID NO: 387185 - RNA, 64 nt, Homo Sapiens; identical to SEQ ID NO: 223503

SEQ ID NO: 387186 - RNA, 64 nt, Homo Sapiens; identical to SEQ ID NO: 223504

SEQ ID NO: 387187 - RNA, 64 nt, Homo Sapiens; identical to SEQ ID NO: 223505

SEQ ID NO: 387188 - RNA, 64 nt, Homo Sapiens; identical to SEQ ID NO: 223506

SEQ ID NO: 387189 - RNA, 64 nt, Homo Sapiens; identical to SEQ ID NO: 223507

SEQ ID NO: 387190 - RNA, 64 nt, Homo Sapiens; identical to SEQ ID NO: 223508

SEQ ID NO: 387191 - RNA, 64 nt, Homo Sapiens; identical to SEQ ID NO: 223509

SEQ ID NO: 387192 - RNA, 64 nt, Homo Sapiens; identical to SEQ ID NO: 223510

SEQ ID NO: 387193 - RNA, 64 nt, Homo Sapiens; identical to SEQ ID NO: 223511

SEQ ID NO: 387194 - RNA, 64 nt, Homo Sapiens; identical to SEQ ID NO: 223512

SEQ ID NO: 387195 - RNA, 64 nt, Homo Sapiens; identical to SEQ ID NO: 223513

SEQ ID NO: 387196 - RNA, 64 nt, Homo Sapiens; identical to SEQ ID NO: 223514

SEQ ID NO: 387197 - RNA, 64 nt, Homo Sapiens; identical to SEQ ID NO: 223515

SEQ ID NO: 387198 - RNA, 64 nt, Homo Sapiens; identical to SEQ ID NO: 223516

SEQ ID NO: 387199 - RNA, 64 nt, Homo Sapiens; identical to SEQ ID NO: 223517

SEQ ID NO: 387200 - RNA, 64 nt, Homo Sapiens; identical to SEQ ID NO: 223518

SEQ ID NO: 387201 - RNA, 64 nt, Homo Sapiens; identical to SEQ ID NO: 223519

SEQ ID NO: 387202 - RNA, 64 nt, Homo Sapiens; identical to SEQ ID NO: 223520

SEQ ID NO: 387203 - RNA, 64 nt, Homo Sapiens; identical to SEQ ID NO: 223521

SEQ ID NO: 387204 - RNA, 64 nt, Homo Sapiens; identical to SEQ ID NO: 223522

SEQ ID NO: 387205 - RNA, 64 nt, Homo Sapiens; identical to SEQ ID NO: 223523

SEQ ID NO: 387206 - RNA, 64 nt, Homo Sapiens; identical to SEQ ID NO: 223524

SEQ ID NO: 387207 - RNA, 64 nt, Homo Sapiens; identical to SEQ ID NO: 223525

SEQ ID NO: 387208 - RNA, 64 nt, Homo Sapiens; identical to SEQ ID NO: 223526

SEQ ID NO: 387209 - RNA, 64 nt, Homo Sapiens; identical to SEQ ID NO: 223527

SEQ ID NO: 387210 - RNA, 64 nt, Homo Sapiens; identical to SEQ ID NO: 223528

SEQ ID NO: 387211 - RNA, 64 nt, Homo Sapiens; identical to SEQ ID NO: 223529

SEQ ID NO: 387212 - RNA, 64 nt, Homo Sapiens; identical to SEQ ID NO: 223530

SEQ ID NO: 387213 - RNA, 64 nt, Homo Sapiens; identical to SEQ ID NO: 223531

SEQ ID NO: 387214 - RNA, 64 nt, Homo Sapiens; identical to SEQ ID NO: 223532

SEQ ID NO: 387215 - RNA, 64 nt, Homo Sapiens; identical to SEQ ID NO: 223533

SEQ ID NO: 387216 - RNA, 64 nt, Homo Sapiens; identical to SEQ ID NO: 223534

SEQ ID NO: 387217 - RNA, 64 nt, Homo Sapiens; identical to SEQ ID NO: 223535

SEQ ID NO: 387218 - RNA, 64 nt, Homo Sapiens; identical to SEQ ID NO: 223536

SEQ ID NO: 387219 - RNA, 64 nt, Homo Sapiens; identical to SEQ ID NO: 223537

SEQ ID NO: 387220 - RNA, 64 nt, Homo Sapiens; identical to SEQ ID NO: 223538

SEQ ID NO: 387221 - RNA, 64 nt, Homo Sapiens; identical to SEQ ID NO: 223539

SEQ ID NO: 387222 - RNA, 64 nt, Homo Sapiens; identical to SEQ ID NO: 223540

SEQ ID NO: 387223 - RNA, 64 nt, Homo Sapiens; identical to SEQ ID NO: 223541

SEQ ID NO: 387224 - RNA, 64 nt, Homo Sapiens; identical to SEQ ID NO: 223542

SEQ ID NO: 387225 - RNA, 64 nt, Homo Sapiens; identical to SEQ ID NO: 223543

SEQ ID NO: 387226 - RNA, 64 nt, Homo Sapiens; identical to SEQ ID NO: 223544

SEQ ID NO: 387227 - RNA, 64 nt, Homo Sapiens; identical to SEQ ID NO: 223545

SEQ ID NO: 387228 - RNA, 64 nt, Homo Sapiens; identical to SEQ ID NO: 223546

SEQ ID NO: 387229 - RNA, 64 nt, Homo Sapiens; identical to SEQ ID NO: 223547

SEQ ID NO: 387230 - RNA, 64 nt, Homo Sapiens; identical to SEQ ID NO: 223548

SEQ ID NO: 387231 - RNA, 64 nt, Homo Sapiens; identical to SEQ ID NO: 223549

SEQ ID NO: 387232 - RNA, 64 nt, Homo Sapiens; identical to SEQ ID NO: 223550

SEQ ID NO: 387233 - RNA, 64 nt, Homo Sapiens; identical to SEQ ID NO: 223551

SEQ ID NO: 387234 - RNA, 64 nt, Homo Sapiens; identical to SEQ ID NO: 223552

SEQ ID NO: 387235 - RNA, 64 nt, Homo Sapiens; identical to SEQ ID NO: 223553

SEQ ID NO: 387236 - RNA, 64 nt, Homo Sapiens; identical to SEQ ID NO: 223554

SEQ ID NO: 387237 - RNA, 64 nt, Homo Sapiens; identical to SEQ ID NO: 223555

SEQ ID NO: 387238 - RNA, 64 nt, Homo Sapiens; identical to SEQ ID NO: 223556

SEQ ID NO: 387239 - RNA, 64 nt, Homo Sapiens; identical to SEQ ID NO: 223557

SEQ ID NO: 387240 - RNA, 64 nt, Homo Sapiens; identical to SEQ ID NO: 223558

SEQ ID NO: 387241 - RNA, 64 nt, Homo Sapiens; identical to SEQ ID NO: 223559

SEQ ID NO: 387242 - RNA, 64 nt, Homo Sapiens; identical to SEQ ID NO: 223560

SEQ ID NO: 387243 - RNA, 64 nt, Homo Sapiens; identical to SEQ ID NO: 223561

SEQ ID NO: 387244 - RNA, 64 nt, Homo Sapiens; identical to SEQ ID NO: 223562

SEQ ID NO: 387245 - RNA, 64 nt, Homo Sapiens; identical to SEQ ID NO: 223563

SEQ ID NO: 387246 - RNA, 64 nt, Homo Sapiens; identical to SEQ ID NO: 223564

SEQ ID NO: 387247 - RNA, 64 nt, Homo Sapiens; identical to SEQ ID NO: 223565

SEQ ID NO: 387248 - RNA, 64 nt, Homo Sapiens; identical to SEQ ID NO: 223566

SEQ ID NO: 387249 - RNA, 64 nt, Homo Sapiens; identical to SEQ ID NO: 223567

SEQ ID NO: 387250 - RNA, 64 nt, Homo Sapiens; identical to SEQ ID NO: 223568

SEQ ID NO: 387251 - RNA, 64 nt, Homo Sapiens; identical to SEQ ID NO: 223569

SEQ ID NO: 387252 - RNA, 64 nt, Homo Sapiens; identical to SEQ ID NO: 223570

SEQ ID NO: 387253 - RNA, 64 nt, Homo Sapiens; identical to SEQ ID NO: 223571

SEQ ID NO: 387254 - RNA, 64 nt, Homo Sapiens
aaauguugauuauuuucuaaugcuuuguagcaaagcauaucaauugaaaagggaauaucagcac

SEQ ID NO: 387255 - RNA, 64 nt, Homo Sapiens
cucuaccuccagggaaagccuucuuaccacacuggcauaucagaugaaagcauugcacuguacc

SEQ ID NO: 387256 - RNA, 64 nt, Homo Sapiens
guucuaugaggauugcaagucauagguguguguggcauaucaguccaucucccucaucuccauu

SEQ ID NO: 387257 - RNA, 64 nt, Homo Sapiens
aaacgaauguucuuaaaucaagugugauuuuuuugcauaucauugaaaagaacauuaaaagcaa

SEQ ID NO: 387258 - RNA, 64 nt, Homo Sapiens
auauuuuaaaggccugugaauauacuuauaaccugcauaucacaaaauaaaacauuuuucucuc

SEQ ID NO: 387259 - RNA, 64 nt, Homo Sapiens
gguuuauauucagaaaugguauauaucaaugacagcauaucaaacuuccuaugggaaaaagucu

SEQ ID NO: 387260 - RNA, 64 nt, Homo Sapiens
ugugaauuugcauuuguuacauuacauugccagcgcauaucauuuagcaaguuggcauuaacau

SEQ ID NO: 387261 - RNA, 64 nt, Homo Sapiens
gaugcacuuuuagcacacauuuguauuucccuuggcauaucagauugagcuaauggugauguua

SEQ ID NO: 387262 - RNA, 64 nt, Homo Sapiens
uaauguuuaucauaggccagacauugugcuaugugcauaucauauguauuauuucauuuaauuc

SEQ ID NO: 387263 - RNA, 64 nt, Homo Sapiens
uagcagaaguuucacacaucaaaguaaaagauuugcauaucauuauacuaaaugcaaaugaguc

SEQ ID NO: 387264 - RNA, 64 nt, Homo Sapiens
gaggaagacacagcuuaguagcuuaagcaguuaugcauaucaggauacugugagcaacauggug

SEQ ID NO: 387265 - RNA, 64 nt, Homo Sapiens
ugaggauguuucacucaugucugucauuuuauaagcauaucauuuaaaaagcuucuaaaaagcu

SEQ ID NO: 387266 - RNA, 64 nt, Homo Sapiens
uugaggccaggaguuaaagaggaggccaaggcaggcauaucaacgccuguaaucccaguacuug

SEQ ID NO: 387267 - RNA, 64 nt, Homo Sapiens
augaguuuguuuugcuuuucugaauggaauaacugcauaucacccugucuucauuuuaacaugu

SEQ ID NO: 387268 - RNA, 64 nt, Homo Sapiens
agucaaguaugauguuucuucuuguuuuauauuugcauaucaagaaaacaauaaauuuuaugaa

SEQ ID NO: 387269 - RNA, 64 nt, Homo Sapiens
accauaccccuugccuuuuuccacaucauuccuagcauaucaagguuuuucucucccuuauuuu

SEQ ID NO: 387270 - RNA, 64 nt, Homo Sapiens
aauugauaauuuugcaaaauauuuuguaucagaggcauaucauauuuuccuuaucugacuucuc

SEQ ID NO: 387271 - RNA, 64 nt, Homo Sapiens
cuaugcucugaggauaaagcaaguauguacgcacgcauaucaaacacuuugugaaacaaaucgu

SEQ ID NO: 387272 - RNA, 64 nt, Homo Sapiens
cagaccuggauuaaaaucugccauuuaauuagcugcauaucaccuuaggguacagcacuuaacg

SEQ ID NO: 387273 - RNA, 64 nt, Homo Sapiens
ccuguaaucccagcacuuugggaggcugaggugggcauaucaccugaggucagcaguuaaagac

SEQ ID NO: 387274 - RNA, 64 nt, Homo Sapiens
auauuugaaacucaaccaguaugcccagccuauugcauaucauugucagaccauuuuugcugcu

SEQ ID NO: 387275 - RNA, 64 nt, Homo Sapiens
cuguacauauuuuucuuagaaauuagcuauuugugcauaucaguauuuguaacuuuaacacauu

SEQ ID NO: 387276 - RNA, 64 nt, Homo Sapiens
uauaucugugaucaggaaugcuguuuauaaaacugcauaucaguaggaacaaggaguaaaagag

SEQ ID NO: 387277 - RNA, 64 nt, Homo Sapiens
ccauuguaaagcgacuucaacagcaagaucaugugcauaucaucaagucucuuuggcaagauug

SEQ ID NO: 387278 - RNA, 64 nt, Homo Sapiens
gugguggagaaagggaaggggcaacaugaaaagagcauaucaauacuuuaaagucugaaggaca

SEQ ID NO: 387279 - RNA, 64 nt, Homo Sapiens
cucugagggcuuccuuugggccaguucccagaaggcauaucaguggcuugcugagaggggcugu

SEQ ID NO: 387280 - RNA, 64 nt, Homo Sapiens
gaaaauuaaccagaaaguauugaauguauaauuggcauaucauggguagcaucugaaauuuuaa

SEQ ID NO: 387281 - RNA, 64 nt, Homo Sapiens
aacuuuuucagguucuuguuuugaacaauguuaugcauaucauauaauacuagugcaauuuugc

SEQ ID NO: 387282 - RNA, 64 nt, Homo Sapiens
ugauaugugcaccaauaccugagaaugaugcugugcauaucacugauguccuguccaccuaaaa

SEQ ID NO: 387283 - RNA, 64 nt, Homo Sapiens
aaaaaaaguggcuugaguuuuaccagaauguuuugcauaucaacaauucaacuucaaaugaacu

SEQ ID NO: 387284 - RNA, 64 nt, Homo Sapiens
aaaaaguacacagugaguucagcaauuaaucacagcauaucaggaaaacaauuuuaaaauaacu

SEQ ID NO: 387285 - RNA, 64 nt, Homo Sapiens
cuuugaaaaaucacuugauuccauuucuaccaaggcauaucaugugugggaauuuaagagcagu

SEQ ID NO: 387286 - RNA, 64 nt, Homo Sapiens
uguaggucauguauuuuacugaaggaaagcuguugcauaucaaugguauauugugucaaucuug

SEQ ID NO: 387287 - RNA, 64 nt, Homo Sapiens
cuaccuuucuuuuuuucugaucaugcaccaucaagcauaucagugcccugcugucaccaccuug

SEQ ID NO: 387288 - RNA, 64 nt, Homo Sapiens
aauguauuuauuaacacuuguauuuuauuauugagcauaucaauaaaaauauuaaaaaauaaca

SEQ ID NO: 387289 - RNA, 64 nt, Homo Sapiens
uugcuuuuuacuccagaucagaauaccugggauugcauaucaaagcauaauaauaaauacaugu

SEQ ID NO: 387290 - RNA, 64 nt, Homo Sapiens
ucacaccugugucguuaccucagccaucggucuagcauaucagucacugggcccaacauaucca

SEQ ID NO: 387291 - RNA, 64 nt, Homo Sapiens
uuuucuucuacuggauuagacaagagagauagcagcauaucagagcugaucuccuccaccuuuc

SEQ ID NO: 387292 - RNA, 64 nt, Homo Sapiens
caguuuuguauuuuguaaacaaaaaucaaauaaugcauaucagaaucuuuauauggaagaaauc

SEQ ID NO: 387293 - RNA, 64 nt, Homo Sapiens
augagcuuacauuccuucuucccauaucuuaucagcauaucauauccauuucacuccaacacuc

SEQ ID NO: 387294 - RNA, 64 nt, Homo Sapiens
gccaguucaaaaacacccgacgucauguauuugagcauaucaguaacccccuuaaauuuaauac

SEQ ID NO: 387295 - RNA, 64 nt, Homo Sapiens
uugguacuuaauuuuacaaaugcuguaauauaaagcauaucaaguuuaugugauacguaucauu

SEQ ID NO: 387296 - RNA, 64 nt, Homo Sapiens
auuuauacauggaacuggaggcccuggccgaugugcauaucaacgauuggcugauucauccugg

SEQ ID NO: 387297 - RNA, 64 nt, Homo Sapiens
guguagugaacagagauaaaauacaaacacaaaugcauaucauugcuugcuacaaugguuaagu

SEQ ID NO: 387298 - RNA, 64 nt, Homo Sapiens
ugggcuaccucagggucaccaucuaaaauucagagcauaucaucuaccauugugauuuagaccu

SEQ ID NO: 387299 - RNA, 64 nt, Homo Sapiens
gcuucauugucauuguguuuggacuguuccuaaggcauaucaguuuuaagucagcacugauuug

SEQ ID NO: 387300 - RNA, 64 nt, Homo Sapiens
uccaauauuuuauaaccaaaugagugcuaaggaagcauaucaauacuucaauguaccauuuuac

SEQ ID NO: 387301 - RNA, 64 nt, Homo Sapiens
aaucucuuggacuuuguuaacauaggucauuauugcauaucaguucacuccauuaauguaaagu

SEQ ID NO: 387302 - RNA, 64 nt, Homo Sapiens
aagagauucagccauccaauugguuuuaggucuugcauaucaguuuuauuacugcaccauguuu

SEQ ID NO: 387303 - RNA, 64 nt, Homo Sapiens
aggaaauuguucuuuuugaguuaucuacuuaauagcauaucauucuuuuucuuaagcuaaauuu

SEQ ID NO: 387304 - RNA, 64 nt, Homo Sapiens
uuuaaaagcaagauagccuggguugggaguuagugcauaucaucagcccuccaucuaaugugau

SEQ ID NO: 387305 - RNA, 64 nt, Homo Sapiens
cuuuuuuaaacuaaaguaauuguauugaugugaagcauaucauuuuuucaaauaugaaagugau

SEQ ID NO: 387306 - RNA, 64 nt, Homo Sapiens
uuugcaauucugacuuauuaaaauuucaaauucugcauaucacaaaaucuccuuauacuuuugg

SEQ ID NO: 387307 - RNA, 64 nt, Homo Sapiens
ccagcuuccuccucagcuccagcucuuuuaaugggcauaucaaaacugaugacuuuuuccuucc

SEQ ID NO: 387308 - RNA, 64 nt, Homo Sapiens
uuaaaaugguuuuuacuccuguuuguuucauaaagcauaucacucaauaaauguacauauuguu

SEQ ID NO: 387309 - RNA, 64 nt, Homo Sapiens
aaacaaauaaaauacuuuuucagaagaaaagcaugcauaucauuaaaaauuuauuauauauuua

SEQ ID NO: 387310 - RNA, 64 nt, Homo Sapiens
ugacuuuuuguuuguuuuagcuggaaccaauugugcauaucagcucucugaagcagaaaaggga

SEQ ID NO: 387311 - RNA, 64 nt, Homo Sapiens
aguuggauguucuugccucuugauggggauugcugcauaucagcuuuuuuugagcugcggggca

SEQ ID NO: 387312 - RNA, 64 nt, Homo Sapiens
gauacugguucuuacucccaaacugcacaauuuugcauaucaauuccuaaugauuugcagagau

SEQ ID NO: 387313 - RNA, 64 nt, Homo Sapiens
cuuauuaccagagcaaauccuucuuacagcuugagcauaucagcauuuuugauauucaaauuaa

SEQ ID NO: 387314 - RNA, 64 nt, Homo Sapiens
aaaaucaggggcugcuccuuccccgaaaagcuaugcauaucaagaaagccaugucuaauaccaa

SEQ ID NO: 387315 - RNA, 64 nt, Homo Sapiens
ugagcuucauauaccagcaaugauuugucccuaugcauaucagucuaccagcauaaauaucuuc

SEQ ID NO: 387316 - RNA, 64 nt, Homo Sapiens
acaaaaacuguuuucccaaauaggucacauucacgcauaucagauggacagauguaucauuuug

SEQ ID NO: 387317 - RNA, 64 nt, Homo Sapiens
aggcggccaggccuauuuucaauuuucaaguauugcauaucauugugaauaacauuguaaaucc

SEQ ID NO: 387318 - RNA, 62 nt, Homo Sapiens
uuuauaaagcaguuuagguaaguuaaauuucagcauaucaguagcguaagcgaaaacaguaa

SEQ ID NO: 387319 - RNA, 64 nt, Homo Sapiens
cguuuaacuuuauuuaaaaaaagagaaguaggaagcauaucaaauuucucaaugcuaacuaauc

SEQ ID NO: 387320 - RNA, 64 nt, Homo Sapiens
ggcguauggcacucauuaaaucacaaaccugcaggcauaucauuaccugacaucccaagaaugc

SEQ ID NO: 387321 - RNA, 64 nt, Homo Sapiens
aaguauuaaaacuaaaaagguuuccaauauuggagcauaucaaaauaugaaguguuagauagaa

SEQ ID NO: 387322 - RNA, 64 nt, Homo Sapiens
ugguaguuagcucagacaguuuuugcgccuuaaagcauaucaaauagaaaaacuaagggucggc

SEQ ID NO: 387323 - RNA, 64 nt, Homo Sapiens
ccuguaaucccagcacuuugggaguccaaggcaggcauaucauuugaggucaggaguuuaagac

SEQ ID NO: 387324 - RNA, 64 nt, Homo Sapiens
caggauaauauucugcccaauucuagugcugggugcauaucaucucauucuaaugaaaggugua

SEQ ID NO: 387325 - RNA, 64 nt, Homo Sapiens
ucaugggguccagaguggagccuggaguaccagcgcauaucaucgcuucccaggccauuuaaag

SEQ ID NO: 387326 - RNA, 64 nt, Homo Sapiens
gaaagaaaaguugaugauagcucuuuauucuggagcauaucaggcacggcuguuccacccaccc

SEQ ID NO: 387327 - RNA, 64 nt, Homo Sapiens
ugugagaauuucucauuaauaucauuuccuaaaugcauaucauuaacuauuuaaggaaagcaaa

SEQ ID NO: 387328 - RNA, 64 nt, Homo Sapiens
uuaguuacuguacacucuguuuguucaauaaacugcauaucaacuucccacaaaagcugacuuu

SEQ ID NO: 387329 - RNA, 64 nt, Homo Sapiens
gaaaucauagccaaggggaaauuggaacuguuuugcauaucaggguauauacaugucaccaugg

SEQ ID NO: 387330 - RNA, 64 nt, Homo Sapiens
gagggagaaaagucaaacuuccucauggaacagagcauaucauauucucuggugccuccauugc

SEQ ID NO: 387331 - RNA, 64 nt, Homo Sapiens
uauacuuuuuuuuuuuuaaacguuuucuuuccuagcauaucaguaacugaacauuuuaugaugc

SEQ ID NO: 387332 - RNA, 64 nt, Homo Sapiens
ucccaggggcugccaaguccuggcccuggcccuggcauaucaccccgcacuguggggccaggca

SEQ ID NO: 387333 - RNA, 64 nt, Homo Sapiens
uaugcuuauggauuugaugacaggcauagccugggcauaucaccucauugguaaagggcuagag

SEQ ID NO: 387334 - RNA, 64 nt, Homo Sapiens
uuugguuggugcauuuaaguauccaacucaaaaagcauaucaaauauuuuggguacuaggcagu

SEQ ID NO: 387335 - RNA, 64 nt, Homo Sapiens
uuguuguaauacagaaagcauccaauuucuuauugcauaucauuacucuccuuugcucccuuuu

SEQ ID NO: 387336 - RNA, 64 nt, Homo Sapiens
aacuaacacuccaaacaaagaggggaauggcggugcauaucauucgguuagcaaaaccauggga

SEQ ID NO: 387337 - RNA, 64 nt, Homo Sapiens
uaaauuaaagguacaaaauccaagacuuacuaacgcauaucaaaccaaaagccaaaaaccaaag

SEQ ID NO: 387338 - RNA, 64 nt, Homo Sapiens
aucuuccagaagauauugagauauauuacuguuugcauaucagguugaacaaaaugcuuggaac

SEQ ID NO: 387339 - RNA, 64 nt, Homo Sapiens
uguauggguacucaaaguauaauuucuacugaaugcauaucacuugugcacuguuguaaagcug

SEQ ID NO: 387340 - RNA, 64 nt, Homo Sapiens
agccugggcccacagagcugcugggauguggggggcauaucaaguugaagauggcaacucugau

SEQ ID NO: 387341 - RNA, 64 nt, Homo Sapiens
aauuaugguccaauuauugugguugugauuuuaugcauaucaucaaauguuuuuuucuuaugcg

SEQ ID NO: 387342 - RNA, 64 nt, Homo Sapiens
cuucccugcucccaccaccaacacagucccauuugcauaucaccucucacacacacacacacac

SEQ ID NO: 387343 - RNA, 64 nt, Homo Sapiens
uauguaugaacugcuacugcauccuggugugaaagcauaucagauauuuauuguuguuuacuga

SEQ ID NO: 387344 - RNA, 64 nt, Homo Sapiens
acccugugguaguaugaaauaauauuuuaaauuugcauaucacauuguaaagguuucuguuuaa

SEQ ID NO: 387345 - RNA, 64 nt, Homo Sapiens
uuuaggcagcaagggaaagggugucacuuucucagcauaucaagguaaccuccccucugcuuag

SEQ ID NO: 387346 - RNA, 64 nt, Homo Sapiens
caugacuagugccuagaaagucuuauguaaguuugcauaucagucugccccacuauuuuuauuu

SEQ ID NO: 387347 - RNA, 64 nt, Homo Sapiens
aguuguuaauuaucucuaaaauuggaauuaggaagcauaucaccaauacugauuaacauucucu

SEQ ID NO: 387348 - RNA, 64 nt, Homo Sapiens
cuuuuuguacuaccauacucuggccaauaccagagcauaucagcagaguaggagagcaaggauu

SEQ ID NO: 387349 - RNA, 64 nt, Homo Sapiens
aaaaaccccaagguaacccgauaugauuuaggaugcauaucaguucuaacaauucaaucagaag

SEQ ID NO: 387350 - RNA, 64 nt, Homo Sapiens
aucugguuaauuccaucaagcucagaguuaaaaggcauaucagccuggaguauuugggagagac

SEQ ID NO: 387351 - RNA, 64 nt, Homo Sapiens
gccauuuuacaguacuguuuuguuuugaauucaugcauaucauugaaaauuucucguuuucauu

SEQ ID NO: 387352 - RNA, 64 nt, Homo Sapiens
aaguaagccuuucuggugaauuucuguucuguuagcauaucauaguaucuugucccaaccugcu

SEQ ID NO: 387353 - RNA, 64 nt, Homo Sapiens
cccguuugcaucgcuaaguaggccuagaaaugaugcauaucauuggagaggcacguacaggcca

SEQ ID NO: 387354 - RNA, 64 nt, Homo Sapiens
uucucauuuuucuuuuucugauuaaacgucugaugcauaucauuuuucuauaaguaaucaguug

SEQ ID NO: 387355 - RNA, 64 nt, Homo Sapiens
aaaaauuuuaaaaacacgugauguaaacuugcaagcauaucaaccaggcaagucuugcuguaaa

SEQ ID NO: 387356 - RNA, 64 nt, Homo Sapiens
gucuguuuccugcugagccaauagugauuuguuugcauaucaccuaaugugaaaagugcucauc

SEQ ID NO: 387357 - RNA, 64 nt, Homo Sapiens
uccaggaccaagacuccccuagagaacagaacaagcauaucaaacuacccucaucuuuugagaa

SEQ ID NO: 387358 - RNA, 64 nt, Homo Sapiens
gugcucaaggauuggagagguuaccccccauguugcauaucaggaggcugccuccuccuucuga

SEQ ID NO: 387359 - RNA, 64 nt, Homo Sapiens
cuggacaaacaguuggagauuaguuugcaaauaagcauaucauaucaaauacaauauuccagcc

SEQ ID NO: 387360 - RNA, 64 nt, Homo Sapiens
gacgcguggauucuacucaagccuccaaguaguggcauaucagucuuggagcuccuagcuggug

SEQ ID NO: 387361 - RNA, 64 nt, Homo Sapiens
uaugagcucaaaguacuacagcaaagccuagccugcauaucauucacccaaaacaaaguaauag

SEQ ID NO: 387362 - RNA, 64 nt, Homo Sapiens
uauacaggauauaucaaacaacuauguaaauuuagcauaucaauuuauuuuuuccauauagagc

SEQ ID NO: 387363 - RNA, 64 nt, Homo Sapiens
gugauacuuuauaagugaauuauacuauuaaauggcauaucaguaccauuauuucaaaaacuca

SEQ ID NO: 387364 - RNA, 64 nt, Homo Sapiens
guaacauuaacaaucaguguuagacaacagugaggcauaucauguguuuuuauuaaaaaugaua

SEQ ID NO: 387365 - RNA, 64 nt, Homo Sapiens
uaaaaagucuugcuuuuuaaaacaaguugguaaugcauaucauggaaggcauauuuuguaugua

SEQ ID NO: 387366 - RNA, 64 nt, Homo Sapiens
auggggguaaaguuaaguugugucuacacacccugcauaucauaguuagcuaauaaaaagcuuu

SEQ ID NO: 387367 - RNA, 64 nt, Homo Sapiens
uguauaguaguuauaugcaucaguagggguuucugcauaucaccaacuaaugaaauggauuucc

SEQ ID NO: 387368 - RNA, 64 nt, Homo Sapiens
uuucccaccuaaaaaugucuuuguaguggauucugcauaucaucauacgauuuucuguugcacc

SEQ ID NO: 387369 - RNA, 64 nt, Homo Sapiens
gccuggacuucccucccuucuuuggaauaaacgagcauaucauaauucuguuucaauaaagaca

SEQ ID NO: 387370 - RNA, 50 nt, Homo Sapiens
cagcaucucacauuauucuggcauaucauuaagguuuuaaaaaagccuga

SEQ ID NO: 387371 - RNA, 64 nt, Homo Sapiens
aacugcccagcagagcuauagaauucccaggagggcauaucagcagaggcacgcuaugcugcca

SEQ ID NO: 387372 - RNA, 64 nt, Homo Sapiens
cgccuugguucuguuuguacgggcuuugaagauagcauaucagaaaccaauauaugguggugcu

SEQ ID NO: 387373 - RNA, 64 nt, Homo Sapiens
guguugcaugcagcuacccguaggaagacuucgcgcauaucacuaauaaaccugaagucgugau

SEQ ID NO: 387374 - RNA, 64 nt, Homo Sapiens
cacugggauaaucagcagcguaacuacccuaaaagcauaucacuagccaaagagggaaauaucu

SEQ ID NO: 387375 - RNA, 64 nt, Homo Sapiens
acaagggcagugccuggacggacccggagcccccgcauaucagcaguucacccaguacuccuca

SEQ ID NO: 387376 - RNA, 64 nt, Homo Sapiens
acauugguuauuuuaugcuuugcacauccagauugcauaucaggauguuguuugcuguaaaugc

SEQ ID NO: 387377 - RNA, 64 nt, Homo Sapiens
cucccggugccuugguugacuauuuuggaaauaggcauaucaagguuccugauucagcacuuug

SEQ ID NO: 387378 - RNA, 64 nt, Homo Sapiens
cuguuguccagccucaaugcuucauuuuccccuugcauaucaacugcccuaaucugacuuuuuu

SEQ ID NO: 387379 - RNA, 64 nt, Homo Sapiens
gacaaagcccuuucaucugaggacuuucaucugugcauaucacggccccccagggcaguuccug

SEQ ID NO: 387380 - RNA, 64 nt, Homo Sapiens
uagauuuugagugcaugaaucugugauaauguuugcauaucagaaugcauucuccccuuaaaag

SEQ ID NO: 387381 - RNA, 64 nt, Homo Sapiens
aucuguggguccuggccuuucuucaugugugcgugcauaucagcccguguggcugacugaugua

SEQ ID NO: 387382 - RNA, 64 nt, Homo Sapiens
ucuuaauucacuuuccuuccuaaauuuguuauuugcauaucaaauucuguaaauguuuuguaaa

SEQ ID NO: 387383 - RNA, 64 nt, Homo Sapiens
uuucacacuuuccccaugcacccucggcacacaggcauaucagccccaccacugucccagcagu

SEQ ID NO: 387384 - RNA, 64 nt, Homo Sapiens
uugacccacacaaaagauuuucugcaucuagccugcauaucacaugcaaagugggggccgggga

SEQ ID NO: 387385 - RNA, 64 nt, Homo Sapiens
ugcauagacaccucugauccuuugcauggacuuugcauaucauuggcucuaccugcugugcuua

SEQ ID NO: 387386 - RNA, 64 nt, Homo Sapiens
gauacccucaagcuggacuguuuguauucauugugcauaucagggaaaucugcauccgccgugg

SEQ ID NO: 387387 - RNA, 64 nt, Homo Sapiens
aaacaacacauuucauuuauaugauuugaaaggggcauaucagaucacugcaccucuuuggauc

SEQ ID NO: 387388 - RNA, 64 nt, Homo Sapiens
ccaaaucuccaucucaggcgcuacuucuggcaaggcauaucaugaggcuagugaagcaccuaca

SEQ ID NO: 387389 - RNA, 64 nt, Homo Sapiens
aaaagaaaugaauggguucaaagaccauaaucaugcauaucacauaagaccagaaguggcccag

SEQ ID NO: 387390 - RNA, 64 nt, Homo Sapiens
gauccaacagacagaaauucacccucauacaucugcauaucacuaguugaaagauucacuacaa

SEQ ID NO: 387391 - RNA, 64 nt, Homo Sapiens
aagauguccuuccugggaagaaggagucacgcuggcauaucaggaagaggcaucuucgagccca

SEQ ID NO: 387392 - RNA, 64 nt, Homo Sapiens
guucuguuuuuauuggccacauccaaguuguucugcauaucauuagcagauuaaccugaaaucc

SEQ ID NO: 387393 - RNA, 64 nt, Homo Sapiens
aauccuuuuuauaaccucuuaauaaguggcacuugcauaucaacgaaccauuuugcaucccaga

SEQ ID NO: 387394 - RNA, 64 nt, Homo Sapiens
cugccuuuuauauguaugaauauuucauaguuuugcauaucagauguaggcauacagacaaaua

SEQ ID NO: 387395 - RNA, 64 nt, Homo Sapiens
uccagaauguugaccuaauuuuacaaaacaagcugcauaucagcugaugaaugcaugagaaauu

SEQ ID NO: 387396 - RNA, 64 nt, Homo Sapiens
gcuauucagaauaaguaggagaaugaaaacugcagcauaucagacagcaauuuaacagcuugaa

SEQ ID NO: 387397 - RNA, 64 nt, Homo Sapiens
uuuggacguuugcgucuuugaagaggcgaugggagcauaucaugacugccugccaccauugcuu

SEQ ID NO: 387398 - RNA, 64 nt, Homo Sapiens
aagcuaggucuaggucuacacuccuaggacgcacgcauaucagcccguguacccugugacagug

SEQ ID NO: 387399 - RNA, 64 nt, Homo Sapiens
accaugucaugcagaauuaacaagguagcaccgagcauaucaauaaauauuauucugauaauca

SEQ ID NO: 387400 - RNA, 64 nt, Homo Sapiens
ggggacugggaaguugggaguguguauauauguagcauaucaugucugcuucccauccugggag

SEQ ID NO: 387401 - RNA, 64 nt, Homo Sapiens
uggugccgaauugcacugaaggcucccaccccgagcauaucacaauaagcguccaggagccacg

SEQ ID NO: 387402 - RNA, 64 nt, Homo Sapiens
ggaauaugcuaaauguuaccaccagagggcacaagcauaucacuuuuaguaaggaaauuacuag

SEQ ID NO: 387403 - RNA, 64 nt, Homo Sapiens
cacagggaaauaccuuuccugggcuuguuuucuagcauaucacugaccugggaucuuuggguga

SEQ ID NO: 387404 - RNA, 64 nt, Homo Sapiens
ucugacuaggcaugauuucacgaaggcaagauuggcauaucauuguaacuaaaaaagcugacau

SEQ ID NO: 387405 - RNA, 64 nt, Homo Sapiens
ugggauuuugccaauauacgauacuuagaauuuggcauaucaucucuaaucuuacauagcaucc

SEQ ID NO: 387406 - RNA, 64 nt, Homo Sapiens
ccuuuguuuaaaaguacaaucagucaggaacuaggcauaucauguuuuaaaaugugauuuguag

SEQ ID NO: 387407 - RNA, 64 nt, Homo Sapiens
gaguuggaggugauuauucucagccgcagaauaugcauaucaauggaaccagccaaauacugug

SEQ ID NO: 387408 - RNA, 64 nt, Homo Sapiens
gaggcaaauucuuaaagaauaauacagagagugagcauaucagauauuucugauauaaauaaua

SEQ ID NO: 387409 - RNA, 64 nt, Homo Sapiens
gggaagguguaaggaggggcuggggucuaugggugcuucucagucaagagagacugcacaccac

SEQ ID NO: 387410 - RNA, 64 nt, Homo Sapiens
aggcuggggugggaagaucaugccuguagucccagcuucucaggcagcuggguguggugccaca

SEQ ID NO: 387411 - RNA, 64 nt, Homo Sapiens
uuugcuaacagugggagcucagacacaggcaugugcuucucaguugcacaugccgguaugaaga

SEQ ID NO: 387412 - RNA, 64 nt, Homo Sapiens
cuugggucuuguuuuuugauuguaaaccuacccagcuucucagagauguuaaauuuugauacca

SEQ ID NO: 387413 - RNA, 64 nt, Homo Sapiens
acacucuccuaauaagcagaaaagcuuuaucuaagcuucucagaucucccagcauguuucuacc

SEQ ID NO: 387414 - RNA, 64 nt, Homo Sapiens
cuaugcuguuuccuguuggagcuauuaaguaacagcuucucaacacacucguggugacaaugaa

SEQ ID NO: 387415 - RNA, 64 nt, Homo Sapiens
cuuguauuaagaaggauuccugguuugcucuucugcuucucacuucugagcuggaauuccuuug

SEQ ID NO: 387416 - RNA, 64 nt, Homo Sapiens
cuggagauggcaguuacucccuccuccgaccgaggcuucucaccgaacccuaagugggugucau

SEQ ID NO: 387417 - RNA, 64 nt, Homo Sapiens
ggaacuagcccaucccugguggggcucccaccccgcuucucagugggcucuaugcuugccucgu

SEQ ID NO: 387418 - RNA, 64 nt, Homo Sapiens
ccagcucggguccucuagucugccuggcuaccaugcuucucacucuccugcaucugcagacccu

SEQ ID NO: 387419 - RNA, 64 nt, Homo Sapiens
aaaguacaauguguuuuucuccagugcuguccaugcuucucaucuugugaaauggccaggaucc

SEQ ID NO: 387420 - RNA, 64 nt, Homo Sapiens
ccauuuuucauucacuucucuuaaacuugugaaugcuucucacuuuuuuuuuuuguuugaugca

SEQ ID NO: 387421 - RNA, 64 nt, Homo Sapiens
cagcccggcggaucccaggccagcacgccugccggcuucucaucgucagggagcccgcccagag

SEQ ID NO: 387422 - RNA, 64 nt, Homo Sapiens
agggaucuguaagcccuguggcuccacaggugcugcuucucacuggcccagacucugagcucca

SEQ ID NO: 387423 - RNA, 64 nt, Homo Sapiens
gcaugccacaaguuaaagguggucccagaggauggcuucucagguuuagaaacacucagucucu

SEQ ID NO: 387424 - RNA, 64 nt, Homo Sapiens
ccuagacaaagccuuuggcccacccagccaaauugcuucucaacguuuaggagggcagugagac

SEQ ID NO: 387425 - RNA, 64 nt, Homo Sapiens
uaaaauacaauuuugucuauacaugaaaauuguugcuucucaucuuacuaacaaucucaguaca

SEQ ID NO: 387426 - RNA, 64 nt, Homo Sapiens
augugguuagaaauuggugcacuuggagacaugugcuucucauuucccugggaagagagucaag

SEQ ID NO: 387427 - RNA, 64 nt, Homo Sapiens
gugauuuauaaacaagagugauauuuugcuagggcuuucaaaguuaaccgguuuucuagccuca

SEQ ID NO: 387428 - RNA, 64 nt, Homo Sapiens
acuagugauuucuucuaaauaggauguaaaacuucuuucaaauuacucuuccucaguccugccu

SEQ ID NO: 387429 - RNA, 64 nt, Homo Sapiens
aaaagagcauaaguuacaaccccuaggagcucugcuuucaaaacaaaaagagauugggggagug

SEQ ID NO: 387430 - RNA, 64 nt, Homo Sapiens
aguguuaauuaauauuaagggaaaugacuacaaacuuucaaagcaaaugcuccauagcuaaagc

SEQ ID NO: 387431 - RNA, 64 nt, Homo Sapiens
gaucaauuuggcacuuuuuuaguguuuuacuccacuuucaaaaauguauuuguuuuaagcccac

SEQ ID NO: 387432 - RNA, 64 nt, Homo Sapiens
auuuagauaaccacuugaugguaguauaucaauccuuucaaacuauuuauuuuugacguauaau

SEQ ID NO: 387433 - RNA, 64 nt, Homo Sapiens
cauuuggguagauggccuaugaauuuguaguagacuuucaaaaugagugauuuguuagcuuggu

SEQ ID NO: 387434 - RNA, 64 nt, Homo Sapiens
guacccauauucucuaagacaggguagcauuugucuuucaaacugcaggguuugaaaucaguuu

SEQ ID NO: 387435 - RNA, 64 nt, Homo Sapiens
ugcccaaagcaacaguuugucuccaguccacaaucuuucaaaaaugccauuuaugcuacuacug

SEQ ID NO: 387436 - RNA, 64 nt, Homo Sapiens
uacaaauaucuuaauuuucaguaauuguuuugcacuuucaaagauuguaaauaguucauucaau

SEQ ID NO: 387437 - RNA, 64 nt, Homo Sapiens
gauaacauaaaaguucuguugugcuccuuucauucuuucaaacaaauuugaauucaggauuaca

SEQ ID NO: 387438 - RNA, 64 nt, Homo Sapiens
gaauuaaacccauugugaggauguugccuuuaugcuuucaaacuaggauaauucuguuugcuaa

SEQ ID NO: 387439 - RNA, 64 nt, Homo Sapiens
cacaacaaaaccucaguuuuggauuccaauggaccuuucaaaacuugacaugcuuugcaaaucu

SEQ ID NO: 387440 - RNA, 64 nt, Homo Sapiens
uaugcaauaauaaggaaagaaaacgcaacaguggcuuucaaaguaacucuaaccucaucgcaac

SEQ ID NO: 387441 - RNA, 64 nt, Homo Sapiens
uacaaaauaaaacugugcaguuuuguuugguuuacuuucaaaagaguagaaagcuugaaaagau

SEQ ID NO: 387442 - RNA, 64 nt, Homo Sapiens
auuuucauaucaucaaugugacauuuacaccacacuuucaaagacaaucacugaaacaaaaauu

SEQ ID NO: 387443 - RNA, 64 nt, Homo Sapiens
gguugcccagagaaaagcugacagggaauagaaccuuucaaagauuuuaagcaaggcaugggga

SEQ ID NO: 387444 - RNA, 64 nt, Homo Sapiens
uuggggccuucuuaacaaaacaggauuagaaccacuuucaaacauguuuacuaaugaucauagc

SEQ ID NO: 387445 - RNA, 64 nt, Homo Sapiens
uaaaagauccagguggaaaucuuuaaugugaucacuuucaaauuggucccuuguaaccucaggu

SEQ ID NO: 387446 - RNA, 64 nt, Homo Sapiens
cucagguuugccucuaaccacaauugagauuugccuuucaaaccaaagcaaaaaaauaaaacca

SEQ ID NO: 387447 - RNA, 64 nt, Homo Sapiens
ucaaguaucugugguuucaugccccucucuauaccuuucaaagaacuccugaagcaacuuaacu

SEQ ID NO: 387448 - RNA, 64 nt, Homo Sapiens
ugggaacccagggaaguuuuuaaaaaugucauuacuuucaaaggaacagaaguaguuaaccaaa

SEQ ID NO: 387449 - RNA, 64 nt, Homo Sapiens
cuacauguuauguuuccugaauuguaguaugugacuuucaaaauggugguuuuccacacucuac

SEQ ID NO: 387450 - RNA, 64 nt, Homo Sapiens
ccaaggcuuuuuuauuuuuuuuuuuugucauuuucuuucaaaacuugaguggucucugagcucc

SEQ ID NO: 387451 - RNA, 64 nt, Homo Sapiens
gcaguguuaacaaauugcugagaucccacggagucuuucaaaaaucucuguagaguuagucuuc

SEQ ID NO: 387452 - RNA, 64 nt, Homo Sapiens
agcagcauaaccuuggcuugauuaaggaauucuacuuucaaaaauuaaucugauaauaguaaca

SEQ ID NO: 387453 - RNA, 64 nt, Homo Sapiens
acauuuggaaauuugaauuaaauacuguaucauacuuucaaaggauaaaaagacuaccccucug

SEQ ID NO: 387454 - RNA, 64 nt, Homo Sapiens
uuguucucugagaaauuauguuggaagcagcauacuuucaaauuauuaccaugaguauaauuuu

SEQ ID NO: 387455 - RNA, 64 nt, Homo Sapiens
auaaaauaucuauuugaauaaauuaugagcuauccuuucaaacagcuauuggcaaguuuuaaac

SEQ ID NO: 387456 - RNA, 64 nt, Homo Sapiens
acaugacuuccuuauuucugaacaguacugguuacuuucaaaaugaauuuuuauugagauuuuc

SEQ ID NO: 387457 - RNA, 64 nt, Homo Sapiens
guuuuguuguaguuggcuauaauuuucaccuuuacuuucaaaguuugaauuuuucccuuuauau

SEQ ID NO: 387458 - RNA, 64 nt, Homo Sapiens
ccugcugguaguaaaaggggauagcauugaaacacuuucaaacucucuagauucauacauuuau

SEQ ID NO: 387459 - RNA, 64 nt, Homo Sapiens
aaugaucauucacuguuccuaugguucuauguaucuuucaaaccgauaccuuuacuauuuaaag

SEQ ID NO: 387460 - RNA, 64 nt, Homo Sapiens
guagacugaugauuaaguaggcaaacuacuucuacuuucaaagagccccaagggcuuaaugacc

SEQ ID NO: 387461 - RNA, 64 nt, Homo Sapiens
aagaccuugagaaaacagcauauuguauacauuccuuucaaauagauaucaguugaaugccuua

SEQ ID NO: 387462 - RNA, 64 nt, Homo Sapiens
agcuuuccacagggauuucuuuaaagcauguuuacuuucaaauuacaagaucuauauuuaaguu

SEQ ID NO: 387463 - RNA, 64 nt, Homo Sapiens
agcccggcaaaagcuagacuacauccaccuaauccuuucaaauccuggugagggcuggcccuaa

SEQ ID NO: 387464 - RNA, 64 nt, Homo Sapiens
cgcuaugcgugauaauuuuuaauguuacuguuaacuuucaaacaacaacccugugguaguauga

SEQ ID NO: 387465 - RNA, 64 nt, Homo Sapiens
auuggaggagaguagcucccuucucacacaaacgcuuucaaaguugggcaaaaguggcccagug

SEQ ID NO: 387466 - RNA, 64 nt, Homo Sapiens
caagaagcuugaaaauaaggccauaaaggaggggcuuucaaauuccuaaauccacauauagggc

SEQ ID NO: 387467 - RNA, 64 nt, Homo Sapiens
uuacuuuuucauguauauccaggcuauaaauauccuuucaaaucauguucuuauaccuaauuuu

SEQ ID NO: 387468 - RNA, 64 nt, Homo Sapiens
ccuuucaaaucauguucuuauaccuaauuuuagucuuucaaaugaauguacuguaaugcuugua

SEQ ID NO: 387469 - RNA, 64 nt, Homo Sapiens
aguugucugcaacauuuuugccaacaccaauacccuuucaaaaguagaaaacacacuuccugca

SEQ ID NO: 387470 - RNA, 64 nt, Homo Sapiens
aaaaaucgggacaagugaacaacaaaaacaaaaucuuucaaaaaccuucacugugucaagugga

SEQ ID NO: 387471 - RNA, 64 nt, Homo Sapiens
uuuucaauaccuguuuucauauacaauuacaaaccuuucaaaccuguauuccuucuuuauacuc

SEQ ID NO: 387472 - RNA, 64 nt, Homo Sapiens
gacucauccugugacuuuguaaccacacucauuccuuucaaacacagaggaggaauuauugcuu

SEQ ID NO: 387473 - RNA, 64 nt, Homo Sapiens
agagccauauauaugucugucaaaauugucuucucuuucaaaccugauaaaucauaauacuaga

SEQ ID NO: 387474 - RNA, 64 nt, Homo Sapiens
acgagcugcagagaacucagaguuaaguggaauccuuucaaaugcuuucaugcaguuuguuuga

SEQ ID NO: 387475 - RNA, 64 nt, Homo Sapiens
aaaaccuuauuuuggcaaagcuuucaucaaaugacuuucaaaauccucagugucuuucaaauga

SEQ ID NO: 387476 - RNA, 64 nt, Homo Sapiens
acuuucaucaaaugacuuucucccuccucagugucuuucaaauguguugggucuuaggccuccu

SEQ ID NO: 387477 - RNA, 64 nt, Homo Sapiens
caguuauccccuaauauuuguuaagccucaguuucuuucaaauacacauaguaaagccuuaauu

SEQ ID NO: 387478 - RNA, 64 nt, Homo Sapiens
caugaaauaucucacacuggcauaauuuuuauuccuuucaaaauguaaaugugggaaagccuuu

SEQ ID NO: 387479 - RNA, 64 nt, Homo Sapiens
gaucugauccuuuugaauuuauggacuauggacucuuucaaaggcccagguaauuuuuuguuuc

SEQ ID NO: 387480 - RNA, 64 nt, Homo Sapiens
cgcacacuagacuucagugggcauauauuacaaucuuucaaaguacugcugaauguuuuccaga

SEQ ID NO: 387481 - RNA, 64 nt, Homo Sapiens
ugauggaaguguaagaaauugaagaguucuaaggcuuucaaaaacacucagucaaaaauuuaaa

SEQ ID NO: 387482 - RNA, 64 nt, Homo Sapiens
cucugagaaccagugaaacagaaaaguuaaucugcuuucaaauuacaauggugggaacaggcau

SEQ ID NO: 387483 - RNA, 64 nt, Homo Sapiens
cagcuaauugcuagcaaauccaccccuucuugaucuuucaaaggccagcccuuuuguccauuaa

SEQ ID NO: 387484 - RNA, 64 nt, Homo Sapiens
aaaggugauuccuaucacuuccaacuucacuuaccuuucaaaagccagaaguggccuagaaaug

SEQ ID NO: 387485 - RNA, 64 nt, Homo Sapiens
uuuucaguuugaaagaacuuuuagcaagguugugcuuucaaacacauauuaguccuaccaccuu

SEQ ID NO: 387486 - RNA, 64 nt, Homo Sapiens
gaaacacaguagcaaugguugcucuauauuuugucuuucaaagauuacugcauuaccaagaaac

SEQ ID NO: 387487 - RNA, 64 nt, Homo Sapiens
acuugcauuuuaaguguuuaaaagcaaauacugacuuucaaaaaaguuuuuaaaaccugauuug

SEQ ID NO: 387488 - RNA, 64 nt, Homo Sapiens
uuuaauagaguaagguaaagaagauauuaagucccuuucaaaauggaaaauuaauucuaaacug

SEQ ID NO: 387489 - RNA, 64 nt, Homo Sapiens; identical to SEQ ID NO: 387487

SEQ ID NO: 387490 - RNA, 64 nt, Homo Sapiens; identical to SEQ ID NO: 387488

SEQ ID NO: 387491 - RNA, 64 nt, Homo Sapiens
caacagcagcuauuuuggggagcagcuguggcuguuacauaaauagagaugcagccaaaauuuu

SEQ ID NO: 387492 - RNA, 64 nt, Homo Sapiens
aaagaaaaaggauauuagauugcacacuauaauuuuacauaagaucugccuuccacacuucccu

SEQ ID NO: 387493 - RNA, 64 nt, Homo Sapiens
uaaauuccagguguuacacugaccucaauccaauuuacauaauuuacauaaaugcaucucggug

SEQ ID NO: 387494 - RNA, 64 nt, Homo Sapiens
gguguuacacugaccucaauccaauuuacauaauuuacauaaaugcaucucgguggaaaaauaa

SEQ ID NO: 387495 - RNA, 64 nt, Homo Sapiens
aacaauggacccaagagaagaacuguacuggcuauuacauaagaaaagcuaacacaggaaaagg

SEQ ID NO: 387496 - RNA, 64 nt, Homo Sapiens
auacuuaaaagguuuucuuuaaaaacuucugugcuuacauaaacuuuuuccuuucaugccucuu

SEQ ID NO: 387497 - RNA, 64 nt, Homo Sapiens
uuaaauuaauacucuuauuuuuuauuuaauuuaauuacauaaauuaaaccuuaccaugaccaaa

SEQ ID NO: 387498 - RNA, 64 nt, Homo Sapiens
uuuagcacuguaucagaaugaagaaacuaauauuuuacauaaaaacuaauacuuucaauuuuuu

SEQ ID NO: 387499 - RNA, 64 nt, Homo Sapiens
uuauaacuauaguaaaaaauuaauauauauccuauuacauaaauguuauuucuuagguguucca

SEQ ID NO: 387500 - RNA, 64 nt, Homo Sapiens
aagggcaaauaaugaucgaaaaaauaauuauuuauuacauaauuuaguuguuucuagacuauaa

SEQ ID NO: 387501 - RNA, 64 nt, Homo Sapiens
ucuauuuuuacauuuaaaccuuuuauuauaagucuuacauaaaccauuuuuguuacucucuucc

SEQ ID NO: 387502 - RNA, 64 nt, Homo Sapiens
ugcuaaaauuuauuauaggaagaaaagaaacauuuuacauaaaaaaauaaagugacuauuaacc

SEQ ID NO: 387503 - RNA, 64 nt, Homo Sapiens
uuaacuaauuuuuuaaauaaugacuggauaaacuuuacauaaaaaauuauucuacauacucauu

SEQ ID NO: 387504 - RNA, 64 nt, Homo Sapiens
auguaggaaaaaacauauuguuaaagagccuugauuacauaaauuaccuaccaccugucuuugc

SEQ ID NO: 387505 - RNA, 64 nt, Homo Sapiens
ccugugccuuuccuagaaagacuuugcugcuuuuuuacauaaagaauauauugguggguuuaaa

SEQ ID NO: 387506 - RNA, 64 nt, Homo Sapiens
uccuccuuuugacuuauuugguauguuguauauauuacauaaaauaacuuuucaaauauaguuu

SEQ ID NO: 387507 - RNA, 64 nt, Homo Sapiens
uaaggauauuuguuuguauguuuauucaguauacuuacauaaaaauuauuucgccaucagccaa

SEQ ID NO: 387508 - RNA, 64 nt, Homo Sapiens
uacucuuuuuuauggacacguaaaaagcuuaugcuuacauaauauugcauugcuaaggccuuuu

SEQ ID NO: 387509 - RNA, 64 nt, Homo Sapiens
auugaguuucuuuuuaugauaguucucccuuuuuuuacauaagggguguuaguauuucacacuc

SEQ ID NO: 387510 - RNA, 64 nt, Homo Sapiens
gugguuuuuaauuugaagaccccagagaauuccauuacauaaugauuuugcccuuguuauaaau

SEQ ID NO: 387511 - RNA, 64 nt, Homo Sapiens
cuagagcuucuuuguuaucucaggcaggaggcguuuacauaacagauguuuccucagcugggug

SEQ ID NO: 387512 - RNA, 64 nt, Homo Sapiens
guaaguccuguuugguuguuuuuuuaaauaauguuuacauaacugaguauuuauguuggaauaa

SEQ ID NO: 387513 - RNA, 64 nt, Homo Sapiens
uuagcaccucaagguauaauguagaggaugauguuuacauaauuggcacuuguucuagagaagu

SEQ ID NO: 387514 - RNA, 64 nt, Homo Sapiens
aaacuauuucugcuauuauucuaauguacuucuguuacauaauuuaucucaagacuaucuuaag

SEQ ID NO: 387515 - RNA, 64 nt, Homo Sapiens
agaacucauuuaaaaguaugauuggggauauguuuuacauaaauaaccaagaugucaguuuugu

SEQ ID NO: 387516 - RNA, 64 nt, Homo Sapiens
aauagagcagaugguugccuggcuugguuucagguuacauaaauauuccaggaaugaagaauua

SEQ ID NO: 387517 - RNA, 64 nt, Homo Sapiens
uucaguugggauggaaaucucuguuuccaggaaauuacauaacgcguuugccuccacgagccug

SEQ ID NO: 387518 - RNA, 64 nt, Homo Sapiens
ccaaguuuuacuaaauacuuacuuuguauauuuguuacauaaaaggcccaaagacuccucuaag

SEQ ID NO: 387519 - RNA, 64 nt, Homo Sapiens
aguugaaaaauuuuuacaccuuuuuuuucacauuuuacauaaauaauaaugcuuugccagcagu

SEQ ID NO: 387520 - RNA, 64 nt, Homo Sapiens
cuguaugguuuauuauuuaaauggguaaagccauuuacauaauauagaaagauaugcauauauc

SEQ ID NO: 387521 - RNA, 64 nt, Homo Sapiens
caaugcuugaaaaugcugcagcagaauuucccucuuacauaaacagaacccuuggagucaugug

SEQ ID NO: 387522 - RNA, 64 nt, Homo Sapiens
augauguuuuccacuugauucucugcaguguaguuuacauaaaauacugagauuaauuacaugg

SEQ ID NO: 387523 - RNA, 64 nt, Homo Sapiens
uuuaacuguuaaaauaauuuaaaaauuaauuauuuuacauaauuaaagaaguuaaaaacuauua

SEQ ID NO: 387524 - RNA, 64 nt, Homo Sapiens
gcuguuuggaggacaggaaaauuuaucgggaaaauuacauaaucccucugauuccacuauccag

SEQ ID NO: 387525 - RNA, 64 nt, Homo Sapiens
aggauccuacuggcuccuuagcagcugauugguguuacauaauuaacuuaauuggagaugcauu

SEQ ID NO: 387526 - RNA, 64 nt, Homo Sapiens
cgaaaugcaggucaugagugugaaauucucaaauuuacauaaaaaguagaaguauagacaguuu

SEQ ID NO: 387527 - RNA, 64 nt, Homo Sapiens; identical to SEQ ID NO: 219214

SEQ ID NO: 387528 - RNA, 64 nt, Homo Sapiens; identical to SEQ ID NO: 219215

SEQ ID NO: 387529 - RNA, 64 nt, Homo Sapiens; identical to SEQ ID NO: 219216

SEQ ID NO: 387530 - RNA, 64 nt, Homo Sapiens; identical to SEQ ID NO: 219217

SEQ ID NO: 387531 - RNA, 64 nt, Homo Sapiens; identical to SEQ ID NO: 219218

SEQ ID NO: 387532 - RNA, 64 nt, Homo Sapiens; identical to SEQ ID NO: 219219

SEQ ID NO: 387533 - RNA, 64 nt, Homo Sapiens; identical to SEQ ID NO: 219220

SEQ ID NO: 387534 - RNA, 64 nt, Homo Sapiens; identical to SEQ ID NO: 219221

SEQ ID NO: 387535 - RNA, 64 nt, Homo Sapiens; identical to SEQ ID NO: 219222

SEQ ID NO: 387536 - RNA, 64 nt, Homo Sapiens; identical to SEQ ID NO: 219223

SEQ ID NO: 387537 - RNA, 64 nt, Homo Sapiens; identical to SEQ ID NO: 219224

SEQ ID NO: 387538 - RNA, 64 nt, Homo Sapiens; identical to SEQ ID NO: 219225

SEQ ID NO: 387539 - RNA, 64 nt, Homo Sapiens; identical to SEQ ID NO: 219226

SEQ ID NO: 387540 - RNA, 64 nt, Homo Sapiens; identical to SEQ ID NO: 219227

SEQ ID NO: 387541 - RNA, 64 nt, Homo Sapiens; identical to SEQ ID NO: 187011

SEQ ID NO: 387542 - RNA, 64 nt, Homo Sapiens; identical to SEQ ID NO: 187012

SEQ ID NO: 387543 - RNA, 64 nt, Homo Sapiens; identical to SEQ ID NO: 187013

SEQ ID NO: 387544 - RNA, 64 nt, Homo Sapiens; identical to SEQ ID NO: 187014

SEQ ID NO: 387545 - RNA, 64 nt, Homo Sapiens; identical to SEQ ID NO: 187015

SEQ ID NO: 387546 - RNA, 64 nt, Homo Sapiens; identical to SEQ ID NO: 187016

SEQ ID NO: 387547 - RNA, 56 nt, Homo Sapiens; identical to SEQ ID NO: 187017

SEQ ID NO: 387548 - RNA, 64 nt, Homo Sapiens; identical to SEQ ID NO: 187018

SEQ ID NO: 387549 - RNA, 64 nt, Homo Sapiens; identical to SEQ ID NO: 187019

SEQ ID NO: 387550 - RNA, 64 nt, Homo Sapiens; identical to SEQ ID NO: 187020

SEQ ID NO: 387551 - RNA, 64 nt, Homo Sapiens; identical to SEQ ID NO: 187021

SEQ ID NO: 387552 - RNA, 64 nt, Homo Sapiens; identical to SEQ ID NO: 187022

SEQ ID NO: 387553 - RNA, 64 nt, Homo Sapiens; identical to SEQ ID NO: 187023

SEQ ID NO: 387554 - RNA, 64 nt, Homo Sapiens; identical to SEQ ID NO: 187024

SEQ ID NO: 387555 - RNA, 64 nt, Homo Sapiens; identical to SEQ ID NO: 187025

SEQ ID NO: 387556 - RNA, 64 nt, Homo Sapiens; identical to SEQ ID NO: 187026

SEQ ID NO: 387557 - RNA, 64 nt, Homo Sapiens; identical to SEQ ID NO: 187027

SEQ ID NO: 387558 - RNA, 64 nt, Homo Sapiens; identical to SEQ ID NO: 187028

SEQ ID NO: 387559 - RNA, 64 nt, Homo Sapiens; identical to SEQ ID NO: 187029

SEQ ID NO: 387560 - RNA, 64 nt, Homo Sapiens; identical to SEQ ID NO: 187030

SEQ ID NO: 387561 - RNA, 64 nt, Homo Sapiens; identical to SEQ ID NO: 187031

SEQ ID NO: 387562 - RNA, 64 nt, Homo Sapiens; identical to SEQ ID NO: 187032

SEQ ID NO: 387563 - RNA, 64 nt, Homo Sapiens; identical to SEQ ID NO: 187033

SEQ ID NO: 387564 - RNA, 64 nt, Homo Sapiens; identical to SEQ ID NO: 187034

SEQ ID NO: 387565 - RNA, 64 nt, Homo Sapiens; identical to SEQ ID NO: 187035

SEQ ID NO: 387566 - RNA, 64 nt, Homo Sapiens; identical to SEQ ID NO: 187036

SEQ ID NO: 387567 - RNA, 64 nt, Homo Sapiens; identical to SEQ ID NO: 187037

SEQ ID NO: 387568 - RNA, 64 nt, Homo Sapiens; identical to SEQ ID NO: 187038

SEQ ID NO: 387569 - RNA, 64 nt, Homo Sapiens; identical to SEQ ID NO: 187039

SEQ ID NO: 387570 - RNA, 64 nt, Homo Sapiens; identical to SEQ ID NO: 187040

SEQ ID NO: 387571 - RNA, 64 nt, Homo Sapiens; identical to SEQ ID NO: 187041

SEQ ID NO: 387572 - RNA, 64 nt, Homo Sapiens; identical to SEQ ID NO: 187042

SEQ ID NO: 387573 - RNA, 64 nt, Homo Sapiens; identical to SEQ ID NO: 187043

SEQ ID NO: 387574 - RNA, 64 nt, Homo Sapiens; identical to SEQ ID NO: 187044

SEQ ID NO: 387575 - RNA, 64 nt, Homo Sapiens; identical to SEQ ID NO: 187045

SEQ ID NO: 387576 - RNA, 64 nt, Homo Sapiens; identical to SEQ ID NO: 187046

SEQ ID NO: 387577 - RNA, 64 nt, Homo Sapiens; identical to SEQ ID NO: 187047

SEQ ID NO: 387578 - RNA, 64 nt, Homo Sapiens; identical to SEQ ID NO: 187048

SEQ ID NO: 387579 - RNA, 64 nt, Homo Sapiens; identical to SEQ ID NO: 187049

SEQ ID NO: 387580 - RNA, 64 nt, Homo Sapiens; identical to SEQ ID NO: 187050

SEQ ID NO: 387581 - RNA, 64 nt, Homo Sapiens; identical to SEQ ID NO: 187051

SEQ ID NO: 387582 - RNA, 64 nt, Homo Sapiens; identical to SEQ ID NO: 187052

SEQ ID NO: 387583 - RNA, 64 nt, Homo Sapiens; identical to SEQ ID NO: 187053

SEQ ID NO: 387584 - RNA, 64 nt, Homo Sapiens; identical to SEQ ID NO: 187054

SEQ ID NO: 387585 - RNA, 64 nt, Homo Sapiens; identical to SEQ ID NO: 187055

SEQ ID NO: 387586 - RNA, 64 nt, Homo Sapiens; identical to SEQ ID NO: 187056

SEQ ID NO: 387587 - RNA, 64 nt, Homo Sapiens; identical to SEQ ID NO: 187057

SEQ ID NO: 387588 - RNA, 64 nt, Homo Sapiens; identical to SEQ ID NO: 187058

SEQ ID NO: 387589 - RNA, 64 nt, Homo Sapiens; identical to SEQ ID NO: 187059

SEQ ID NO: 387590 - RNA, 64 nt, Homo Sapiens; identical to SEQ ID NO: 187060

SEQ ID NO: 387591 - RNA, 64 nt, Homo Sapiens; identical to SEQ ID NO: 187061

SEQ ID NO: 387592 - RNA, 64 nt, Homo Sapiens; identical to SEQ ID NO: 187062

SEQ ID NO: 387593 - RNA, 64 nt, Homo Sapiens; identical to SEQ ID NO: 187063

SEQ ID NO: 387594 - RNA, 64 nt, Homo Sapiens; identical to SEQ ID NO: 187064

SEQ ID NO: 387595 - RNA, 64 nt, Homo Sapiens; identical to SEQ ID NO: 187065

SEQ ID NO: 387596 - RNA, 64 nt, Homo Sapiens; identical to SEQ ID NO: 187066

SEQ ID NO: 387597 - RNA, 64 nt, Homo Sapiens; identical to SEQ ID NO: 187067

SEQ ID NO: 387598 - RNA, 64 nt, Homo Sapiens; identical to SEQ ID NO: 187068

SEQ ID NO: 387599 - RNA, 64 nt, Homo Sapiens; identical to SEQ ID NO: 187069

SEQ ID NO: 387600 - RNA, 64 nt, Homo Sapiens; identical to SEQ ID NO: 187070

SEQ ID NO: 387601 - RNA, 64 nt, Homo Sapiens; identical to SEQ ID NO: 187071

SEQ ID NO: 387602 - RNA, 64 nt, Homo Sapiens; identical to SEQ ID NO: 187072

SEQ ID NO: 387603 - RNA, 64 nt, Homo Sapiens; identical to SEQ ID NO: 187073

SEQ ID NO: 387604 - RNA, 64 nt, Homo Sapiens; identical to SEQ ID NO: 187074

SEQ ID NO: 387605 - RNA, 64 nt, Homo Sapiens; identical to SEQ ID NO: 187075

SEQ ID NO: 387606 - RNA, 64 nt, Homo Sapiens; identical to SEQ ID NO: 187076

SEQ ID NO: 387607 - RNA, 64 nt, Homo Sapiens; identical to SEQ ID NO: 187077

SEQ ID NO: 387608 - RNA, 64 nt, Homo Sapiens; identical to SEQ ID NO: 187078

SEQ ID NO: 387609 - RNA, 64 nt, Homo Sapiens; identical to SEQ ID NO: 187079

SEQ ID NO: 387610 - RNA, 64 nt, Homo Sapiens; identical to SEQ ID NO: 187080

SEQ ID NO: 387611 - RNA, 64 nt, Homo Sapiens; identical to SEQ ID NO: 187081

SEQ ID NO: 387612 - RNA, 64 nt, Homo Sapiens; identical to SEQ ID NO: 187082

SEQ ID NO: 387613 - RNA, 64 nt, Homo Sapiens; identical to SEQ ID NO: 187083

SEQ ID NO: 387614 - RNA, 57 nt, Homo Sapiens; identical to SEQ ID NO: 187084

SEQ ID NO: 387615 - RNA, 64 nt, Homo Sapiens; identical to SEQ ID NO: 187085

SEQ ID NO: 387616 - RNA, 64 nt, Homo Sapiens; identical to SEQ ID NO: 187086

SEQ ID NO: 387617 - RNA, 64 nt, Homo Sapiens; identical to SEQ ID NO: 187087

SEQ ID NO: 387618 - RNA, 64 nt, Homo Sapiens; identical to SEQ ID NO: 187088

SEQ ID NO: 387619 - RNA, 64 nt, Homo Sapiens; identical to SEQ ID NO: 187089

SEQ ID NO: 387620 - RNA, 64 nt, Homo Sapiens; identical to SEQ ID NO: 187090

SEQ ID NO: 387621 - RNA, 64 nt, Homo Sapiens; identical to SEQ ID NO: 187091

SEQ ID NO: 387622 - RNA, 64 nt, Homo Sapiens; identical to SEQ ID NO: 187092

SEQ ID NO: 387623 - RNA, 64 nt, Homo Sapiens; identical to SEQ ID NO: 187093

SEQ ID NO: 387624 - RNA, 64 nt, Homo Sapiens; identical to SEQ ID NO: 187094

SEQ ID NO: 387625 - RNA, 64 nt, Homo Sapiens; identical to SEQ ID NO: 187095

SEQ ID NO: 387626 - RNA, 64 nt, Homo Sapiens; identical to SEQ ID NO: 187096

SEQ ID NO: 387627 - RNA, 64 nt, Homo Sapiens; identical to SEQ ID NO: 187097

SEQ ID NO: 387628 - RNA, 64 nt, Homo Sapiens; identical to SEQ ID NO: 187098

SEQ ID NO: 387629 - RNA, 64 nt, Homo Sapiens; identical to SEQ ID NO: 187099

SEQ ID NO: 387630 - RNA, 64 nt, Homo Sapiens; identical to SEQ ID NO: 187100

SEQ ID NO: 387631 - RNA, 64 nt, Homo Sapiens; identical to SEQ ID NO: 187101

SEQ ID NO: 387632 - RNA, 64 nt, Homo Sapiens; identical to SEQ ID NO: 187102

SEQ ID NO: 387633 - RNA, 64 nt, Homo Sapiens; identical to SEQ ID NO: 187103

SEQ ID NO: 387634 - RNA, 64 nt, Homo Sapiens; identical to SEQ ID NO: 187104

SEQ ID NO: 387635 - RNA, 64 nt, Homo Sapiens; identical to SEQ ID NO: 187105

SEQ ID NO: 387636 - RNA, 64 nt, Homo Sapiens; identical to SEQ ID NO: 187106

SEQ ID NO: 387637 - RNA, 64 nt, Homo Sapiens; identical to SEQ ID NO: 187107

SEQ ID NO: 387638 - RNA, 64 nt, Homo Sapiens; identical to SEQ ID NO: 187108

SEQ ID NO: 387639 - RNA, 64 nt, Homo Sapiens; identical to SEQ ID NO: 187109

SEQ ID NO: 387640 - RNA, 64 nt, Homo Sapiens; identical to SEQ ID NO: 187110

SEQ ID NO: 387641 - RNA, 64 nt, Homo Sapiens; identical to SEQ ID NO: 187111

SEQ ID NO: 387642 - RNA, 64 nt, Homo Sapiens; identical to SEQ ID NO: 187112

SEQ ID NO: 387643 - RNA, 64 nt, Homo Sapiens; identical to SEQ ID NO: 187113

SEQ ID NO: 387644 - RNA, 64 nt, Homo Sapiens; identical to SEQ ID NO: 187114

SEQ ID NO: 387645 - RNA, 64 nt, Homo Sapiens; identical to SEQ ID NO: 219214

SEQ ID NO: 387646 - RNA, 64 nt, Homo Sapiens; identical to SEQ ID NO: 219215

SEQ ID NO: 387647 - RNA, 64 nt, Homo Sapiens; identical to SEQ ID NO: 219216

SEQ ID NO: 387648 - RNA, 64 nt, Homo Sapiens; identical to SEQ ID NO: 219217

SEQ ID NO: 387649 - RNA, 64 nt, Homo Sapiens; identical to SEQ ID NO: 219218

SEQ ID NO: 387650 - RNA, 64 nt, Homo Sapiens; identical to SEQ ID NO: 219219

SEQ ID NO: 387651 - RNA, 64 nt, Homo Sapiens; identical to SEQ ID NO: 219220

SEQ ID NO: 387652 - RNA, 64 nt, Homo Sapiens; identical to SEQ ID NO: 219221

SEQ ID NO: 387653 - RNA, 64 nt, Homo Sapiens; identical to SEQ ID NO: 219222

SEQ ID NO: 387654 - RNA, 64 nt, Homo Sapiens; identical to SEQ ID NO: 219223

SEQ ID NO: 387655 - RNA, 64 nt, Homo Sapiens; identical to SEQ ID NO: 219224

SEQ ID NO: 387656 - RNA, 64 nt, Homo Sapiens; identical to SEQ ID NO: 219225

SEQ ID NO: 387657 - RNA, 64 nt, Homo Sapiens; identical to SEQ ID NO: 219226

SEQ ID NO: 387658 - RNA, 64 nt, Homo Sapiens; identical to SEQ ID NO: 219227

SEQ ID NO: 387659 - RNA, 64 nt, Homo Sapiens; identical to SEQ ID NO: 187011

SEQ ID NO: 387660 - RNA, 64 nt, Homo Sapiens; identical to SEQ ID NO: 187012

SEQ ID NO: 387661 - RNA, 64 nt, Homo Sapiens; identical to SEQ ID NO: 187013

SEQ ID NO: 387662 - RNA, 64 nt, Homo Sapiens; identical to SEQ ID NO: 187014

SEQ ID NO: 387663 - RNA, 64 nt, Homo Sapiens; identical to SEQ ID NO: 187015

SEQ ID NO: 387664 - RNA, 64 nt, Homo Sapiens; identical to SEQ ID NO: 187016

SEQ ID NO: 387665 - RNA, 56 nt, Homo Sapiens; identical to SEQ ID NO: 187017

SEQ ID NO: 387666 - RNA, 64 nt, Homo Sapiens; identical to SEQ ID NO: 187018

SEQ ID NO: 387667 - RNA, 64 nt, Homo Sapiens; identical to SEQ ID NO: 187019

SEQ ID NO: 387668 - RNA, 64 nt, Homo Sapiens; identical to SEQ ID NO: 187020

SEQ ID NO: 387669 - RNA, 64 nt, Homo Sapiens; identical to SEQ ID NO: 187021

SEQ ID NO: 387670 - RNA, 64 nt, Homo Sapiens; identical to SEQ ID NO: 187022

SEQ ID NO: 387671 - RNA, 64 nt, Homo Sapiens; identical to SEQ ID NO: 187023

SEQ ID NO: 387672 - RNA, 64 nt, Homo Sapiens; identical to SEQ ID NO: 187024

SEQ ID NO: 387673 - RNA, 64 nt, Homo Sapiens; identical to SEQ ID NO: 187025

SEQ ID NO: 387674 - RNA, 64 nt, Homo Sapiens; identical to SEQ ID NO: 187026

SEQ ID NO: 387675 - RNA, 64 nt, Homo Sapiens; identical to SEQ ID NO: 187027

SEQ ID NO: 387676 - RNA, 64 nt, Homo Sapiens; identical to SEQ ID NO: 187028

SEQ ID NO: 387677 - RNA, 64 nt, Homo Sapiens; identical to SEQ ID NO: 187029

SEQ ID NO: 387678 - RNA, 64 nt, Homo Sapiens; identical to SEQ ID NO: 187030

SEQ ID NO: 387679 - RNA, 64 nt, Homo Sapiens; identical to SEQ ID NO: 187031

SEQ ID NO: 387680 - RNA, 64 nt, Homo Sapiens; identical to SEQ ID NO: 187032

SEQ ID NO: 387681 - RNA, 64 nt, Homo Sapiens; identical to SEQ ID NO: 187033

SEQ ID NO: 387682 - RNA, 64 nt, Homo Sapiens; identical to SEQ ID NO: 187034

SEQ ID NO: 387683 - RNA, 64 nt, Homo Sapiens; identical to SEQ ID NO: 187035

SEQ ID NO: 387684 - RNA, 64 nt, Homo Sapiens; identical to SEQ ID NO: 187036

SEQ ID NO: 387685 - RNA, 64 nt, Homo Sapiens; identical to SEQ ID NO: 187037

SEQ ID NO: 387686 - RNA, 64 nt, Homo Sapiens; identical to SEQ ID NO: 187038

SEQ ID NO: 387687 - RNA, 64 nt, Homo Sapiens; identical to SEQ ID NO: 187039

SEQ ID NO: 387688 - RNA, 64 nt, Homo Sapiens; identical to SEQ ID NO: 187040

SEQ ID NO: 387689 - RNA, 64 nt, Homo Sapiens; identical to SEQ ID NO: 187041

SEQ ID NO: 387690 - RNA, 64 nt, Homo Sapiens; identical to SEQ ID NO: 187042

SEQ ID NO: 387691 - RNA, 64 nt, Homo Sapiens; identical to SEQ ID NO: 187043

SEQ ID NO: 387692 - RNA, 64 nt, Homo Sapiens; identical to SEQ ID NO: 187044

SEQ ID NO: 387693 - RNA, 64 nt, Homo Sapiens; identical to SEQ ID NO: 187045

SEQ ID NO: 387694 - RNA, 64 nt, Homo Sapiens; identical to SEQ ID NO: 187046

SEQ ID NO: 387695 - RNA, 64 nt, Homo Sapiens; identical to SEQ ID NO: 187047

SEQ ID NO: 387696 - RNA, 64 nt, Homo Sapiens; identical to SEQ ID NO: 187048

SEQ ID NO: 387697 - RNA, 64 nt, Homo Sapiens; identical to SEQ ID NO: 187049

SEQ ID NO: 387698 - RNA, 64 nt, Homo Sapiens; identical to SEQ ID NO: 187050

SEQ ID NO: 387699 - RNA, 64 nt, Homo Sapiens; identical to SEQ ID NO: 187051

SEQ ID NO: 387700 - RNA, 64 nt, Homo Sapiens; identical to SEQ ID NO: 187052

SEQ ID NO: 387701 - RNA, 64 nt, Homo Sapiens; identical to SEQ ID NO: 187053

SEQ ID NO: 387702 - RNA, 64 nt, Homo Sapiens; identical to SEQ ID NO: 187054

SEQ ID NO: 387703 - RNA, 64 nt, Homo Sapiens; identical to SEQ ID NO: 187055

SEQ ID NO: 387704 - RNA, 64 nt, Homo Sapiens; identical to SEQ ID NO: 187056

SEQ ID NO: 387705 - RNA, 64 nt, Homo Sapiens; identical to SEQ ID NO: 187057

SEQ ID NO: 387706 - RNA, 64 nt, Homo Sapiens; identical to SEQ ID NO: 187058

SEQ ID NO: 387707 - RNA, 64 nt, Homo Sapiens; identical to SEQ ID NO: 187059

SEQ ID NO: 387708 - RNA, 64 nt, Homo Sapiens; identical to SEQ ID NO: 187060

SEQ ID NO: 387709 - RNA, 64 nt, Homo Sapiens; identical to SEQ ID NO: 187061

SEQ ID NO: 387710 - RNA, 64 nt, Homo Sapiens; identical to SEQ ID NO: 187062

SEQ ID NO: 387711 - RNA, 64 nt, Homo Sapiens; identical to SEQ ID NO: 187063

SEQ ID NO: 387712 - RNA, 64 nt, Homo Sapiens; identical to SEQ ID NO: 187064

SEQ ID NO: 387713 - RNA, 64 nt, Homo Sapiens; identical to SEQ ID NO: 187065

SEQ ID NO: 387714 - RNA, 64 nt, Homo Sapiens; identical to SEQ ID NO: 187066

SEQ ID NO: 387715 - RNA, 64 nt, Homo Sapiens; identical to SEQ ID NO: 187067

SEQ ID NO: 387716 - RNA, 64 nt, Homo Sapiens; identical to SEQ ID NO: 187068

SEQ ID NO: 387717 - RNA, 64 nt, Homo Sapiens; identical to SEQ ID NO: 187069

SEQ ID NO: 387718 - RNA, 64 nt, Homo Sapiens; identical to SEQ ID NO: 187070

SEQ ID NO: 387719 - RNA, 64 nt, Homo Sapiens; identical to SEQ ID NO: 187071

SEQ ID NO: 387720 - RNA, 64 nt, Homo Sapiens; identical to SEQ ID NO: 187072

SEQ ID NO: 387721 - RNA, 64 nt, Homo Sapiens; identical to SEQ ID NO: 187073

SEQ ID NO: 387722 - RNA, 64 nt, Homo Sapiens; identical to SEQ ID NO: 187074

SEQ ID NO: 387723 - RNA, 64 nt, Homo Sapiens; identical to SEQ ID NO: 187075

SEQ ID NO: 387724 - RNA, 64 nt, Homo Sapiens; identical to SEQ ID NO: 187076

SEQ ID NO: 387725 - RNA, 64 nt, Homo Sapiens; identical to SEQ ID NO: 187077

SEQ ID NO: 387726 - RNA, 64 nt, Homo Sapiens; identical to SEQ ID NO: 187078

SEQ ID NO: 387727 - RNA, 64 nt, Homo Sapiens; identical to SEQ ID NO: 187079

SEQ ID NO: 387728 - RNA, 64 nt, Homo Sapiens; identical to SEQ ID NO: 187080

SEQ ID NO: 387729 - RNA, 64 nt, Homo Sapiens; identical to SEQ ID NO: 187081

SEQ ID NO: 387730 - RNA, 64 nt, Homo Sapiens; identical to SEQ ID NO: 187082

SEQ ID NO: 387731 - RNA, 64 nt, Homo Sapiens; identical to SEQ ID NO: 187083

SEQ ID NO: 387732 - RNA, 57 nt, Homo Sapiens; identical to SEQ ID NO: 187084

SEQ ID NO: 387733 - RNA, 64 nt, Homo Sapiens; identical to SEQ ID NO: 187085

SEQ ID NO: 387734 - RNA, 64 nt, Homo Sapiens; identical to SEQ ID NO: 187086

SEQ ID NO: 387735 - RNA, 64 nt, Homo Sapiens; identical to SEQ ID NO: 187087

SEQ ID NO: 387736 - RNA, 64 nt, Homo Sapiens; identical to SEQ ID NO: 187088

SEQ ID NO: 387737 - RNA, 64 nt, Homo Sapiens; identical to SEQ ID NO: 187089

SEQ ID NO: 387738 - RNA, 64 nt, Homo Sapiens; identical to SEQ ID NO: 187090

SEQ ID NO: 387739 - RNA, 64 nt, Homo Sapiens; identical to SEQ ID NO: 187091

SEQ ID NO: 387740 - RNA, 64 nt, Homo Sapiens; identical to SEQ ID NO: 187092

SEQ ID NO: 387741 - RNA, 64 nt, Homo Sapiens; identical to SEQ ID NO: 187093

SEQ ID NO: 387742 - RNA, 64 nt, Homo Sapiens; identical to SEQ ID NO: 187094

SEQ ID NO: 387743 - RNA, 64 nt, Homo Sapiens; identical to SEQ ID NO: 187095

SEQ ID NO: 387744 - RNA, 64 nt, Homo Sapiens; identical to SEQ ID NO: 187096

SEQ ID NO: 387745 - RNA, 64 nt, Homo Sapiens; identical to SEQ ID NO: 187097

SEQ ID NO: 387746 - RNA, 64 nt, Homo Sapiens; identical to SEQ ID NO: 187098

SEQ ID NO: 387747 - RNA, 64 nt, Homo Sapiens; identical to SEQ ID NO: 187099

SEQ ID NO: 387748 - RNA, 64 nt, Homo Sapiens; identical to SEQ ID NO: 187100

SEQ ID NO: 387749 - RNA, 64 nt, Homo Sapiens; identical to SEQ ID NO: 187101

SEQ ID NO: 387750 - RNA, 64 nt, Homo Sapiens; identical to SEQ ID NO: 187102

SEQ ID NO: 387751 - RNA, 64 nt, Homo Sapiens; identical to SEQ ID NO: 187103

SEQ ID NO: 387752 - RNA, 64 nt, Homo Sapiens; identical to SEQ ID NO: 187104

SEQ ID NO: 387753 - RNA, 64 nt, Homo Sapiens; identical to SEQ ID NO: 187105

SEQ ID NO: 387754 - RNA, 64 nt, Homo Sapiens; identical to SEQ ID NO: 187106

SEQ ID NO: 387755 - RNA, 64 nt, Homo Sapiens; identical to SEQ ID NO: 187107

SEQ ID NO: 387756 - RNA, 64 nt, Homo Sapiens; identical to SEQ ID NO: 187108

SEQ ID NO: 387757 - RNA, 64 nt, Homo Sapiens; identical to SEQ ID NO: 187109

SEQ ID NO: 387758 - RNA, 64 nt, Homo Sapiens; identical to SEQ ID NO: 187110

SEQ ID NO: 387759 - RNA, 64 nt, Homo Sapiens; identical to SEQ ID NO: 187111

SEQ ID NO: 387760 - RNA, 64 nt, Homo Sapiens; identical to SEQ ID NO: 187112

SEQ ID NO: 387761 - RNA, 64 nt, Homo Sapiens; identical to SEQ ID NO: 187113

SEQ ID NO: 387762 - RNA, 64 nt, Homo Sapiens; identical to SEQ ID NO: 187114

SEQ ID NO: 387763 - RNA, 64 nt, Homo Sapiens; identical to SEQ ID NO: 377795

SEQ ID NO: 387764 - RNA, 64 nt, Homo Sapiens; identical to SEQ ID NO: 377796

SEQ ID NO: 387765 - RNA, 64 nt, Homo Sapiens; identical to SEQ ID NO: 377797

SEQ ID NO: 387766 - RNA, 64 nt, Homo Sapiens; identical to SEQ ID NO: 377798

SEQ ID NO: 387767 - RNA, 64 nt, Homo Sapiens; identical to SEQ ID NO: 377799

SEQ ID NO: 387768 - RNA, 64 nt, Homo Sapiens; identical to SEQ ID NO: 377800

SEQ ID NO: 387769 - RNA, 64 nt, Homo Sapiens; identical to SEQ ID NO: 377801

SEQ ID NO: 387770 - RNA, 62 nt, Homo Sapiens; identical to SEQ ID NO: 377802

SEQ ID NO: 387771 - RNA, 64 nt, Homo Sapiens; identical to SEQ ID NO: 377803

SEQ ID NO: 387772 - RNA, 64 nt, Homo Sapiens; identical to SEQ ID NO: 377804

SEQ ID NO: 387773 - RNA, 64 nt, Homo Sapiens; identical to SEQ ID NO: 377805

SEQ ID NO: 387774 - RNA, 64 nt, Homo Sapiens; identical to SEQ ID NO: 377806

SEQ ID NO: 387775 - RNA, 64 nt, Homo Sapiens; identical to SEQ ID NO: 377807

SEQ ID NO: 387776 - RNA, 64 nt, Homo Sapiens; identical to SEQ ID NO: 377808

SEQ ID NO: 387777 - RNA, 64 nt, Homo Sapiens; identical to SEQ ID NO: 377809

SEQ ID NO: 387778 - RNA, 64 nt, Homo Sapiens; identical to SEQ ID NO: 377810

SEQ ID NO: 387779 - RNA, 64 nt, Homo Sapiens; identical to SEQ ID NO: 377811

SEQ ID NO: 387780 - RNA, 64 nt, Homo Sapiens; identical to SEQ ID NO: 377812

SEQ ID NO: 387781 - RNA, 64 nt, Homo Sapiens; identical to SEQ ID NO: 377813

SEQ ID NO: 387782 - RNA, 64 nt, Homo Sapiens; identical to SEQ ID NO: 377814

SEQ ID NO: 387783 - RNA, 64 nt, Homo Sapiens; identical to SEQ ID NO: 377815

SEQ ID NO: 387784 - RNA, 64 nt, Homo Sapiens; identical to SEQ ID NO: 377816

SEQ ID NO: 387785 - RNA, 64 nt, Homo Sapiens; identical to SEQ ID NO: 377817

SEQ ID NO: 387786 - RNA, 64 nt, Homo Sapiens; identical to SEQ ID NO: 377818

SEQ ID NO: 387787 - RNA, 64 nt, Homo Sapiens; identical to SEQ ID NO: 377819

SEQ ID NO: 387788 - RNA, 64 nt, Homo Sapiens; identical to SEQ ID NO: 377820

SEQ ID NO: 387789 - RNA, 64 nt, Homo Sapiens; identical to SEQ ID NO: 91485

SEQ ID NO: 387790 - RNA, 64 nt, Homo Sapiens; identical to SEQ ID NO: 91486

SEQ ID NO: 387791 - RNA, 64 nt, Homo Sapiens; identical to SEQ ID NO: 91487

SEQ ID NO: 387792 - RNA, 64 nt, Homo Sapiens; identical to SEQ ID NO: 91488

SEQ ID NO: 387793 - RNA, 64 nt, Homo Sapiens; identical to SEQ ID NO: 91489

SEQ ID NO: 387794 - RNA, 64 nt, Homo Sapiens; identical to SEQ ID NO: 91490

SEQ ID NO: 387795 - RNA, 64 nt, Homo Sapiens; identical to SEQ ID NO: 91491

SEQ ID NO: 387796 - RNA, 64 nt, Homo Sapiens; identical to SEQ ID NO: 91492

SEQ ID NO: 387797 - RNA, 64 nt, Homo Sapiens
aguccuaaacugucauuuucggacuuucugugauucauaccaaccugugauucauaccaacaga

SEQ ID NO: 387798 - RNA, 64 nt, Homo Sapiens
agaggacuuucugugauucaguacuuucugugauucauaccaaccuuuucacuguauauaaacg

SEQ ID NO: 387799 - RNA, 64 nt, Homo Sapiens
uucccaccuggagagaaacuuccagaccagccccucauaccacagccaagaggggccuuucuca

SEQ ID NO: 387800 - RNA, 64 nt, Homo Sapiens; identical to SEQ ID NO: 387799

SEQ ID NO: 387801 - RNA, 64 nt, Homo Sapiens
uugccugcucacuuuauguuuacaucucccacauucauaccaauauacgucagguuugcuuaac

SEQ ID NO: 387802 - RNA, 64 nt, Homo Sapiens
caccuuguguuucaaagaauuuaguuccaccucuucauaccaguuuaacacuuaauauauuuca

SEQ ID NO: 387803 - RNA, 64 nt, Homo Sapiens; identical to SEQ ID NO: 161149

SEQ ID NO: 387804 - RNA, 64 nt, Homo Sapiens; identical to SEQ ID NO: 161150

SEQ ID NO: 387805 - RNA, 64 nt, Homo Sapiens; identical to SEQ ID NO: 161151

SEQ ID NO: 387806 - RNA, 64 nt, Homo Sapiens; identical to SEQ ID NO: 161152

SEQ ID NO: 387807 - RNA, 64 nt, Homo Sapiens; identical to SEQ ID NO: 161153

SEQ ID NO: 387808 - RNA, 64 nt, Homo Sapiens; identical to SEQ ID NO: 161154

SEQ ID NO: 387809 - RNA, 64 nt, Homo Sapiens; identical to SEQ ID NO: 161155

SEQ ID NO: 387810 - RNA, 64 nt, Homo Sapiens; identical to SEQ ID NO: 161156

SEQ ID NO: 387811 - RNA, 64 nt, Homo Sapiens; identical to SEQ ID NO: 161157

SEQ ID NO: 387812 - RNA, 64 nt, Homo Sapiens; identical to SEQ ID NO: 161158

SEQ ID NO: 387813 - RNA, 64 nt, Homo Sapiens; identical to SEQ ID NO: 161159

SEQ ID NO: 387814 - RNA, 64 nt, Homo Sapiens; identical to SEQ ID NO: 161160

SEQ ID NO: 387815 - RNA, 64 nt, Homo Sapiens; identical to SEQ ID NO: 161161

SEQ ID NO: 387816 - RNA, 64 nt, Homo Sapiens; identical to SEQ ID NO: 161162

SEQ ID NO: 387817 - RNA, 64 nt, Homo Sapiens; identical to SEQ ID NO: 161163

SEQ ID NO: 387818 - RNA, 64 nt, Homo Sapiens; identical to SEQ ID NO: 161164

SEQ ID NO: 387819 - RNA, 64 nt, Homo Sapiens; identical to SEQ ID NO: 161165

SEQ ID NO: 387820 - RNA, 64 nt, Homo Sapiens; identical to SEQ ID NO: 161166

SEQ ID NO: 387821 - RNA, 64 nt, Homo Sapiens; identical to SEQ ID NO: 161167

SEQ ID NO: 387822 - RNA, 64 nt, Homo Sapiens; identical to SEQ ID NO: 161168

SEQ ID NO: 387823 - RNA, 64 nt, Homo Sapiens; identical to SEQ ID NO: 161169

SEQ ID NO: 387824 - RNA, 64 nt, Homo Sapiens; identical to SEQ ID NO: 161170

SEQ ID NO: 387825 - RNA, 64 nt, Homo Sapiens; identical to SEQ ID NO: 161171

SEQ ID NO: 387826 - RNA, 64 nt, Homo Sapiens; identical to SEQ ID NO: 161172

SEQ ID NO: 387827 - RNA, 64 nt, Homo Sapiens; identical to SEQ ID NO: 161173

SEQ ID NO: 387828 - RNA, 64 nt, Homo Sapiens; identical to SEQ ID NO: 161174

SEQ ID NO: 387829 - RNA, 64 nt, Homo Sapiens; identical to SEQ ID NO: 161175

SEQ ID NO: 387830 - RNA, 64 nt, Homo Sapiens; identical to SEQ ID NO: 161176

SEQ ID NO: 387831 - RNA, 64 nt, Homo Sapiens; identical to SEQ ID NO: 161177

SEQ ID NO: 387832 - RNA, 64 nt, Homo Sapiens; identical to SEQ ID NO: 161178

SEQ ID NO: 387833 - RNA, 64 nt, Homo Sapiens; identical to SEQ ID NO: 161179

SEQ ID NO: 387834 - RNA, 64 nt, Homo Sapiens; identical to SEQ ID NO: 161180

SEQ ID NO: 387835 - RNA, 64 nt, Homo Sapiens; identical to SEQ ID NO: 161181

SEQ ID NO: 387836 - RNA, 64 nt, Homo Sapiens; identical to SEQ ID NO: 161182

SEQ ID NO: 387837 - RNA, 64 nt, Homo Sapiens; identical to SEQ ID NO: 161183

SEQ ID NO: 387838 - RNA, 64 nt, Homo Sapiens; identical to SEQ ID NO: 82429

SEQ ID NO: 387839 - RNA, 64 nt, Homo Sapiens; identical to SEQ ID NO: 82430

SEQ ID NO: 387840 - RNA, 64 nt, Homo Sapiens; identical to SEQ ID NO: 82431

SEQ ID NO: 387841 - RNA, 64 nt, Homo Sapiens; identical to SEQ ID NO: 82432

SEQ ID NO: 387842 - RNA, 64 nt, Homo Sapiens; identical to SEQ ID NO: 82433

SEQ ID NO: 387843 - RNA, 64 nt, Homo Sapiens; identical to SEQ ID NO: 82434

SEQ ID NO: 387844 - RNA, 64 nt, Homo Sapiens; identical to SEQ ID NO: 82435

SEQ ID NO: 387845 - RNA, 64 nt, Homo Sapiens; identical to SEQ ID NO: 82436

SEQ ID NO: 387846 - RNA, 64 nt, Homo Sapiens; identical to SEQ ID NO: 82437

SEQ ID NO: 387847 - RNA, 64 nt, Homo Sapiens; identical to SEQ ID NO: 82438

SEQ ID NO: 387848 - RNA, 64 nt, Homo Sapiens; identical to SEQ ID NO: 82439

SEQ ID NO: 387849 - RNA, 64 nt, Homo Sapiens; identical to SEQ ID NO: 82440

SEQ ID NO: 387850 - RNA, 64 nt, Homo Sapiens; identical to SEQ ID NO: 82441

SEQ ID NO: 387851 - RNA, 64 nt, Homo Sapiens; identical to SEQ ID NO: 82442

SEQ ID NO: 387852 - RNA, 64 nt, Homo Sapiens; identical to SEQ ID NO: 82443

SEQ ID NO: 387853 - RNA, 64 nt, Homo Sapiens; identical to SEQ ID NO: 82444

SEQ ID NO: 387854 - RNA, 64 nt, Homo Sapiens; identical to SEQ ID NO: 82445

SEQ ID NO: 387855 - RNA, 64 nt, Homo Sapiens; identical to SEQ ID NO: 82446

SEQ ID NO: 387856 - RNA, 64 nt, Homo Sapiens; identical to SEQ ID NO: 82447

SEQ ID NO: 387857 - RNA, 64 nt, Homo Sapiens; identical to SEQ ID NO: 82448

SEQ ID NO: 387858 - RNA, 64 nt, Homo Sapiens; identical to SEQ ID NO: 82449

SEQ ID NO: 387859 - RNA, 64 nt, Homo Sapiens; identical to SEQ ID NO: 82450

SEQ ID NO: 387860 - RNA, 64 nt, Homo Sapiens; identical to SEQ ID NO: 82451

SEQ ID NO: 387861 - RNA, 64 nt, Homo Sapiens; identical to SEQ ID NO: 82452

SEQ ID NO: 387862 - RNA, 64 nt, Homo Sapiens; identical to SEQ ID NO: 82453

SEQ ID NO: 387863 - RNA, 64 nt, Homo Sapiens; identical to SEQ ID NO: 82454

SEQ ID NO: 387864 - RNA, 64 nt, Homo Sapiens; identical to SEQ ID NO: 82455

SEQ ID NO: 387865 - RNA, 64 nt, Homo Sapiens; identical to SEQ ID NO: 82456

SEQ ID NO: 387866 - RNA, 64 nt, Homo Sapiens; identical to SEQ ID NO: 82457

SEQ ID NO: 387867 - RNA, 64 nt, Homo Sapiens; identical to SEQ ID NO: 82458

SEQ ID NO: 387868 - RNA, 64 nt, Homo Sapiens; identical to SEQ ID NO: 82459

SEQ ID NO: 387869 - RNA, 64 nt, Homo Sapiens; identical to SEQ ID NO: 82460

SEQ ID NO: 387870 - RNA, 64 nt, Homo Sapiens; identical to SEQ ID NO: 82461

SEQ ID NO: 387871 - RNA, 64 nt, Homo Sapiens; identical to SEQ ID NO: 82462

SEQ ID NO: 387872 - RNA, 64 nt, Homo Sapiens; identical to SEQ ID NO: 82463

SEQ ID NO: 387873 - RNA, 64 nt, Homo Sapiens; identical to SEQ ID NO: 82464

SEQ ID NO: 387874 - RNA, 64 nt, Homo Sapiens
gaugaugguaaaacccagguuagucaucaguaaccuucucuauuauuauuauuuuuuagaaacu

SEQ ID NO: 387875 - RNA, 64 nt, Homo Sapiens
gagaacaaaucugauaaauuguguaaccuagucucuucucuacauggugaugcauuucagcaau

SEQ ID NO: 387876 - RNA, 64 nt, Homo Sapiens
gggcuuucauuuucuccucccagcccccugcugccuucucuaugcagccugcccuccaucaucc

SEQ ID NO: 387877 - RNA, 64 nt, Homo Sapiens
cucuuugcuuucuucugacugacauuuauucagccuucucuacaggaaucucuuauguuccccc

SEQ ID NO: 387878 - RNA, 64 nt, Homo Sapiens
auguuuaaucaauugcaagccaaaucaaagaacucuucucuauuuaucuuuacuucuaucaucc

SEQ ID NO: 387879 - RNA, 64 nt, Homo Sapiens
cuuuaaauuacacaacuuugauuuaaacuucuuucuucucuagcaauauuuacugugggaucca

SEQ ID NO: 387880 - RNA, 64 nt, Homo Sapiens
aauaucacaagggaggagagaggaaaacaauuaucuucucuacuuggauuaugagauaaccuuu

SEQ ID NO: 387881 - RNA, 64 nt, Homo Sapiens
caccccacuaaauguauguuauugaaugccaguacuucucuaguggaugcacacuuguuaaaua

SEQ ID NO: 387882 - RNA, 64 nt, Homo Sapiens
ccucucccugcaugucuuaaguaucuuucccuuccuucucuacccucaccuccauccugucuac

SEQ ID NO: 387883 - RNA, 64 nt, Homo Sapiens
cuacuucauauaaauugcucaggcccucccaccccuucucuaacacuagcuucaaggcagaagc

SEQ ID NO: 387884 - RNA, 64 nt, Homo Sapiens
ugggaaacaauacucucuuaucuaccaccauucccuucucuauucccuucucuauuugagaauc

SEQ ID NO: 387885 - RNA, 64 nt, Homo Sapiens
ugagaaucucuaccaccauuucuaccaccauucccuucucuauucaaaauggaggcugagaauc

SEQ ID NO: 387886 - RNA, 64 nt, Homo Sapiens
aaucuguagagaacuuaaugaaccugaacccaggcuucucuagcucugguaacgugugauuguu

SEQ ID NO: 387887 - RNA, 64 nt, Homo Sapiens
caacuugcagagguacuuuucuugauuaaauagccuucucuagcaacaucauuuucagacuaac

SEQ ID NO: 387888 - RNA, 64 nt, Homo Sapiens
uacuacuaauaguugggucagguucggagacccgcuucucuaccuuccaaagccagauuaccua

SEQ ID NO: 387889 - RNA, 64 nt, Homo Sapiens
uguuucuacuagaccuaggguguguuagcauagacuucucuauaacaauaguccucuuuccaag

SEQ ID NO: 387890 - RNA, 64 nt, Homo Sapiens
uguagcuacuuucucugggcagcgguuuuccucucuucucuaucgaggcggggcuguggcagcc

SEQ ID NO: 387891 - RNA, 64 nt, Homo Sapiens
ggaggccccgggaucucucggucaggaccuugcucuucucuauuuugugucgggcaguguggaa

SEQ ID NO: 387892 - RNA, 64 nt, Homo Sapiens
ggccuuuuccccuacaaacuguuguugaacagugcuucucuaaaaugcaauaauaaugggccag

SEQ ID NO: 387893 - RNA, 64 nt, Homo Sapiens
guucaagaccagccuggccaacauggugaaaccccuucucuacuaaaauacacaaauuagcuag

SEQ ID NO: 387894 - RNA, 64 nt, Homo Sapiens
ccgguucaugacagacccuugaaaauuuucucaucuucucuaacuuuuugagauggagucuucu

SEQ ID NO: 387895 - RNA, 64 nt, Homo Sapiens
aaaaauacauaaauuagcugaauggugaaaccaccuucucuacacucaagaccagccugggcag

SEQ ID NO: 387896 - RNA, 64 nt, Homo Sapiens
cuuucuuuucucccauauuggcauggauuucugucuucucuaacaccuugugaccuucucuaua

SEQ ID NO: 387897 - RNA, 64 nt, Homo Sapiens
gcauggauuucugucuucucuaacaccuugugaccuucucuauaucaugcuuuaaaguguaaua

SEQ ID NO: 387898 - RNA, 64 nt, Homo Sapiens
cuuccccagcaccaugccaaccugugcccacucccuucucuacuaacccagcugccuucucugc

SEQ ID NO: 387899 - RNA, 64 nt, Homo Sapiens
aacccuggcuuuuaucuucucacccauucccugccuucucuaggccugacugcuccuuuccgcu

SEQ ID NO: 387900 - RNA, 64 nt, Homo Sapiens; identical to SEQ ID NO: 105816

SEQ ID NO: 387901 - RNA, 64 nt, Homo Sapiens; identical to SEQ ID NO: 105817

SEQ ID NO: 387902 - RNA, 64 nt, Homo Sapiens; identical to SEQ ID NO: 105818

SEQ ID NO: 387903 - RNA, 64 nt, Homo Sapiens; identical to SEQ ID NO: 105819

SEQ ID NO: 387904 - RNA, 64 nt, Homo Sapiens; identical to SEQ ID NO: 105820

SEQ ID NO: 387905 - RNA, 64 nt, Homo Sapiens; identical to SEQ ID NO: 105821

SEQ ID NO: 387906 - RNA, 64 nt, Homo Sapiens; identical to SEQ ID NO: 105822

SEQ ID NO: 387907 - RNA, 64 nt, Homo Sapiens; identical to SEQ ID NO: 105823

SEQ ID NO: 387908 - RNA, 64 nt, Homo Sapiens; identical to SEQ ID NO: 105824

SEQ ID NO: 387909 - RNA, 64 nt, Homo Sapiens; identical to SEQ ID NO: 105825

SEQ ID NO: 387910 - RNA, 64 nt, Homo Sapiens; identical to SEQ ID NO: 105826

SEQ ID NO: 387911 - RNA, 64 nt, Homo Sapiens; identical to SEQ ID NO: 105827

SEQ ID NO: 387912 - RNA, 64 nt, Homo Sapiens; identical to SEQ ID NO: 105828

SEQ ID NO: 387913 - RNA, 64 nt, Homo Sapiens; identical to SEQ ID NO: 105829

SEQ ID NO: 387914 - RNA, 64 nt, Homo Sapiens; identical to SEQ ID NO: 105830

SEQ ID NO: 387915 - RNA, 64 nt, Homo Sapiens; identical to SEQ ID NO: 105831

SEQ ID NO: 387916 - RNA, 64 nt, Homo Sapiens; identical to SEQ ID NO: 105832

SEQ ID NO: 387917 - RNA, 64 nt, Homo Sapiens; identical to SEQ ID NO: 105833

SEQ ID NO: 387918 - RNA, 64 nt, Homo Sapiens; identical to SEQ ID NO: 105834

SEQ ID NO: 387919 - RNA, 64 nt, Homo Sapiens; identical to SEQ ID NO: 105835

SEQ ID NO: 387920 - RNA, 64 nt, Homo Sapiens; identical to SEQ ID NO: 105836

SEQ ID NO: 387921 - RNA, 64 nt, Homo Sapiens; identical to SEQ ID NO: 105837

SEQ ID NO: 387922 - RNA, 64 nt, Homo Sapiens; identical to SEQ ID NO: 105838

SEQ ID NO: 387923 - RNA, 64 nt, Homo Sapiens; identical to SEQ ID NO: 105839

SEQ ID NO: 387924 - RNA, 64 nt, Homo Sapiens; identical to SEQ ID NO: 105840

SEQ ID NO: 387925 - RNA, 64 nt, Homo Sapiens; identical to SEQ ID NO: 105841

SEQ ID NO: 387926 - RNA, 64 nt, Homo Sapiens; identical to SEQ ID NO: 105842

SEQ ID NO: 387927 - RNA, 64 nt, Homo Sapiens; identical to SEQ ID NO: 105843

SEQ ID NO: 387928 - RNA, 64 nt, Homo Sapiens; identical to SEQ ID NO: 105844

SEQ ID NO: 387929 - RNA, 64 nt, Homo Sapiens; identical to SEQ ID NO: 105845

SEQ ID NO: 387930 - RNA, 64 nt, Homo Sapiens; identical to SEQ ID NO: 105846

SEQ ID NO: 387931 - RNA, 64 nt, Homo Sapiens; identical to SEQ ID NO: 105847

SEQ ID NO: 387932 - RNA, 64 nt, Homo Sapiens; identical to SEQ ID NO: 105848

SEQ ID NO: 387933 - RNA, 64 nt, Homo Sapiens; identical to SEQ ID NO: 105849

SEQ ID NO: 387934 - RNA, 64 nt, Homo Sapiens; identical to SEQ ID NO: 105850

SEQ ID NO: 387935 - RNA, 64 nt, Homo Sapiens; identical to SEQ ID NO: 105851

SEQ ID NO: 387936 - RNA, 64 nt, Homo Sapiens; identical to SEQ ID NO: 105852

SEQ ID NO: 387937 - RNA, 64 nt, Homo Sapiens; identical to SEQ ID NO: 105853

SEQ ID NO: 387938 - RNA, 64 nt, Homo Sapiens; identical to SEQ ID NO: 105854

SEQ ID NO: 387939 - RNA, 64 nt, Homo Sapiens; identical to SEQ ID NO: 105855

SEQ ID NO: 387940 - RNA, 64 nt, Homo Sapiens; identical to SEQ ID NO: 105856

SEQ ID NO: 387941 - RNA, 64 nt, Homo Sapiens; identical to SEQ ID NO: 105857

SEQ ID NO: 387942 - RNA, 64 nt, Homo Sapiens; identical to SEQ ID NO: 105858

SEQ ID NO: 387943 - RNA, 64 nt, Homo Sapiens; identical to SEQ ID NO: 105859

SEQ ID NO: 387944 - RNA, 64 nt, Homo Sapiens; identical to SEQ ID NO: 105860

SEQ ID NO: 387945 - RNA, 64 nt, Homo Sapiens; identical to SEQ ID NO: 105861

SEQ ID NO: 387946 - RNA, 64 nt, Homo Sapiens; identical to SEQ ID NO: 105862

SEQ ID NO: 387947 - RNA, 64 nt, Homo Sapiens; identical to SEQ ID NO: 105863

SEQ ID NO: 387948 - RNA, 64 nt, Homo Sapiens; identical to SEQ ID NO: 105864

SEQ ID NO: 387949 - RNA, 64 nt, Homo Sapiens; identical to SEQ ID NO: 105865

SEQ ID NO: 387950 - RNA, 64 nt, Homo Sapiens; identical to SEQ ID NO: 105866

SEQ ID NO: 387951 - RNA, 64 nt, Homo Sapiens; identical to SEQ ID NO: 105867

SEQ ID NO: 387952 - RNA, 64 nt, Homo Sapiens; identical to SEQ ID NO: 105868

SEQ ID NO: 387953 - RNA, 64 nt, Homo Sapiens; identical to SEQ ID NO: 105869

SEQ ID NO: 387954 - RNA, 64 nt, Homo Sapiens; identical to SEQ ID NO: 105870

SEQ ID NO: 387955 - RNA, 64 nt, Homo Sapiens; identical to SEQ ID NO: 105871

SEQ ID NO: 387956 - RNA, 64 nt, Homo Sapiens; identical to SEQ ID NO: 105872

SEQ ID NO: 387957 - RNA, 64 nt, Homo Sapiens; identical to SEQ ID NO: 105873

SEQ ID NO: 387958 - RNA, 64 nt, Homo Sapiens; identical to SEQ ID NO: 105874

SEQ ID NO: 387959 - RNA, 64 nt, Homo Sapiens; identical to SEQ ID NO: 105875

SEQ ID NO: 387960 - RNA, 64 nt, Homo Sapiens; identical to SEQ ID NO: 105876

SEQ ID NO: 387961 - RNA, 64 nt, Homo Sapiens; identical to SEQ ID NO: 105877

SEQ ID NO: 387962 - RNA, 64 nt, Homo Sapiens; identical to SEQ ID NO: 105878

SEQ ID NO: 387963 - RNA, 64 nt, Homo Sapiens; identical to SEQ ID NO: 105879

SEQ ID NO: 387964 - RNA, 64 nt, Homo Sapiens; identical to SEQ ID NO: 105880

SEQ ID NO: 387965 - RNA, 64 nt, Homo Sapiens; identical to SEQ ID NO: 105881

SEQ ID NO: 387966 - RNA, 64 nt, Homo Sapiens; identical to SEQ ID NO: 105882

SEQ ID NO: 387967 - RNA, 64 nt, Homo Sapiens; identical to SEQ ID NO: 105883

SEQ ID NO: 387968 - RNA, 64 nt, Homo Sapiens; identical to SEQ ID NO: 105884

SEQ ID NO: 387969 - RNA, 64 nt, Homo Sapiens; identical to SEQ ID NO: 105885

SEQ ID NO: 387970 - RNA, 64 nt, Homo Sapiens; identical to SEQ ID NO: 105886

SEQ ID NO: 387971 - RNA, 64 nt, Homo Sapiens; identical to SEQ ID NO: 105887

SEQ ID NO: 387972 - RNA, 64 nt, Homo Sapiens; identical to SEQ ID NO: 105888

SEQ ID NO: 387973 - RNA, 64 nt, Homo Sapiens; identical to SEQ ID NO: 105889

SEQ ID NO: 387974 - RNA, 64 nt, Homo Sapiens; identical to SEQ ID NO: 105890

SEQ ID NO: 387975 - RNA, 64 nt, Homo Sapiens; identical to SEQ ID NO: 105891

SEQ ID NO: 387976 - RNA, 64 nt, Homo Sapiens; identical to SEQ ID NO: 105892

SEQ ID NO: 387977 - RNA, 64 nt, Homo Sapiens; identical to SEQ ID NO: 105893

SEQ ID NO: 387978 - RNA, 64 nt, Homo Sapiens; identical to SEQ ID NO: 105894

SEQ ID NO: 387979 - RNA, 64 nt, Homo Sapiens; identical to SEQ ID NO: 105895

SEQ ID NO: 387980 - RNA, 64 nt, Homo Sapiens; identical to SEQ ID NO: 105896

SEQ ID NO: 387981 - RNA, 64 nt, Homo Sapiens; identical to SEQ ID NO: 105897

SEQ ID NO: 387982 - RNA, 64 nt, Homo Sapiens; identical to SEQ ID NO: 105898

SEQ ID NO: 387983 - RNA, 64 nt, Homo Sapiens; identical to SEQ ID NO: 105899

SEQ ID NO: 387984 - RNA, 64 nt, Homo Sapiens; identical to SEQ ID NO: 105900

SEQ ID NO: 387985 - RNA, 64 nt, Homo Sapiens; identical to SEQ ID NO: 105901

SEQ ID NO: 387986 - RNA, 64 nt, Homo Sapiens; identical to SEQ ID NO: 105902

SEQ ID NO: 387987 - RNA, 64 nt, Homo Sapiens; identical to SEQ ID NO: 105903

SEQ ID NO: 387988 - RNA, 64 nt, Homo Sapiens; identical to SEQ ID NO: 105904

SEQ ID NO: 387989 - RNA, 64 nt, Homo Sapiens; identical to SEQ ID NO: 105905

SEQ ID NO: 387990 - RNA, 64 nt, Homo Sapiens; identical to SEQ ID NO: 105906

SEQ ID NO: 387991 - RNA, 64 nt, Homo Sapiens; identical to SEQ ID NO: 105907

SEQ ID NO: 387992 - RNA, 64 nt, Homo Sapiens; identical to SEQ ID NO: 105908

SEQ ID NO: 387993 - RNA, 64 nt, Homo Sapiens; identical to SEQ ID NO: 105909

SEQ ID NO: 387994 - RNA, 64 nt, Homo Sapiens; identical to SEQ ID NO: 105910

SEQ ID NO: 387995 - RNA, 64 nt, Homo Sapiens; identical to SEQ ID NO: 105911

SEQ ID NO: 387996 - RNA, 64 nt, Homo Sapiens; identical to SEQ ID NO: 105912

SEQ ID NO: 387997 - RNA, 64 nt, Homo Sapiens; identical to SEQ ID NO: 105913

SEQ ID NO: 387998 - RNA, 64 nt, Homo Sapiens; identical to SEQ ID NO: 105914

SEQ ID NO: 387999 - RNA, 64 nt, Homo Sapiens; identical to SEQ ID NO: 105915

SEQ ID NO: 388000 - RNA, 64 nt, Homo Sapiens; identical to SEQ ID NO: 105916

SEQ ID NO: 388001 - RNA, 64 nt, Homo Sapiens; identical to SEQ ID NO: 105917

SEQ ID NO: 388002 - RNA, 64 nt, Homo Sapiens; identical to SEQ ID NO: 105918

SEQ ID NO: 388003 - RNA, 64 nt, Homo Sapiens; identical to SEQ ID NO: 105919

SEQ ID NO: 388004 - RNA, 64 nt, Homo Sapiens; identical to SEQ ID NO: 105920

SEQ ID NO: 388005 - RNA, 64 nt, Homo Sapiens; identical to SEQ ID NO: 105921

SEQ ID NO: 388006 - RNA, 64 nt, Homo Sapiens; identical to SEQ ID NO: 105922

SEQ ID NO: 388007 - RNA, 64 nt, Homo Sapiens; identical to SEQ ID NO: 105923

SEQ ID NO: 388008 - RNA, 64 nt, Homo Sapiens; identical to SEQ ID NO: 105924

SEQ ID NO: 388009 - RNA, 64 nt, Homo Sapiens; identical to SEQ ID NO: 105925

SEQ ID NO: 388010 - RNA, 64 nt, Homo Sapiens; identical to SEQ ID NO: 105926

SEQ ID NO: 388011 - RNA, 64 nt, Homo Sapiens; identical to SEQ ID NO: 105927

SEQ ID NO: 388012 - RNA, 64 nt, Homo Sapiens; identical to SEQ ID NO: 105928

SEQ ID NO: 388013 - RNA, 64 nt, Homo Sapiens; identical to SEQ ID NO: 105929

SEQ ID NO: 388014 - RNA, 61 nt, Homo Sapiens; identical to SEQ ID NO: 105930

SEQ ID NO: 388015 - RNA, 64 nt, Homo Sapiens; identical to SEQ ID NO: 105931

SEQ ID NO: 388016 - RNA, 64 nt, Homo Sapiens; identical to SEQ ID NO: 105932

SEQ ID NO: 388017 - RNA, 64 nt, Homo Sapiens; identical to SEQ ID NO: 105933

SEQ ID NO: 388018 - RNA, 64 nt, Homo Sapiens; identical to SEQ ID NO: 105934

SEQ ID NO: 388019 - RNA, 64 nt, Homo Sapiens; identical to SEQ ID NO: 105935

SEQ ID NO: 388020 - RNA, 64 nt, Homo Sapiens; identical to SEQ ID NO: 105936

SEQ ID NO: 388021 - RNA, 64 nt, Homo Sapiens; identical to SEQ ID NO: 105937

SEQ ID NO: 388022 - RNA, 64 nt, Homo Sapiens; identical to SEQ ID NO: 105938

SEQ ID NO: 388023 - RNA, 64 nt, Homo Sapiens; identical to SEQ ID NO: 105939

SEQ ID NO: 388024 - RNA, 64 nt, Homo Sapiens; identical to SEQ ID NO: 105940

SEQ ID NO: 388025 - RNA, 64 nt, Homo Sapiens; identical to SEQ ID NO: 105941

SEQ ID NO: 388026 - RNA, 64 nt, Homo Sapiens; identical to SEQ ID NO: 105942

SEQ ID NO: 388027 - RNA, 64 nt, Homo Sapiens; identical to SEQ ID NO: 105943

SEQ ID NO: 388028 - RNA, 64 nt, Homo Sapiens; identical to SEQ ID NO: 105944

SEQ ID NO: 388029 - RNA, 64 nt, Homo Sapiens; identical to SEQ ID NO: 105945

SEQ ID NO: 388030 - RNA, 64 nt, Homo Sapiens; identical to SEQ ID NO: 105946

SEQ ID NO: 388031 - RNA, 64 nt, Homo Sapiens; identical to SEQ ID NO: 105947

SEQ ID NO: 388032 - RNA, 64 nt, Homo Sapiens; identical to SEQ ID NO: 105948

SEQ ID NO: 388033 - RNA, 64 nt, Homo Sapiens; identical to SEQ ID NO: 105949

SEQ ID NO: 388034 - RNA, 64 nt, Homo Sapiens; identical to SEQ ID NO: 105950

SEQ ID NO: 388035 - RNA, 64 nt, Homo Sapiens; identical to SEQ ID NO: 105951

SEQ ID NO: 388036 - RNA, 64 nt, Homo Sapiens; identical to SEQ ID NO: 105952

SEQ ID NO: 388037 - RNA, 64 nt, Homo Sapiens; identical to SEQ ID NO: 105953

SEQ ID NO: 388038 - RNA, 64 nt, Homo Sapiens; identical to SEQ ID NO: 105954

SEQ ID NO: 388039 - RNA, 61 nt, Homo Sapiens; identical to SEQ ID NO: 105955

SEQ ID NO: 388040 - RNA, 64 nt, Homo Sapiens; identical to SEQ ID NO: 105956

SEQ ID NO: 388041 - RNA, 64 nt, Homo Sapiens; identical to SEQ ID NO: 105957

SEQ ID NO: 388042 - RNA, 64 nt, Homo Sapiens; identical to SEQ ID NO: 105958

SEQ ID NO: 388043 - RNA, 64 nt, Homo Sapiens; identical to SEQ ID NO: 105959

SEQ ID NO: 388044 - RNA, 64 nt, Homo Sapiens; identical to SEQ ID NO: 105960

SEQ ID NO: 388045 - RNA, 64 nt, Homo Sapiens; identical to SEQ ID NO: 105961

SEQ ID NO: 388046 - RNA, 64 nt, Homo Sapiens; identical to SEQ ID NO: 105962

SEQ ID NO: 388047 - RNA, 64 nt, Homo Sapiens; identical to SEQ ID NO: 105963

SEQ ID NO: 388048 - RNA, 64 nt, Homo Sapiens; identical to SEQ ID NO: 105964

SEQ ID NO: 388049 - RNA, 64 nt, Homo Sapiens; identical to SEQ ID NO: 105965

SEQ ID NO: 388050 - RNA, 64 nt, Homo Sapiens; identical to SEQ ID NO: 105966

SEQ ID NO: 388051 - RNA, 64 nt, Homo Sapiens; identical to SEQ ID NO: 105967

SEQ ID NO: 388052 - RNA, 64 nt, Homo Sapiens; identical to SEQ ID NO: 105968

SEQ ID NO: 388053 - RNA, 64 nt, Homo Sapiens; identical to SEQ ID NO: 105969

SEQ ID NO: 388054 - RNA, 64 nt, Homo Sapiens; identical to SEQ ID NO: 105970

SEQ ID NO: 388055 - RNA, 64 nt, Homo Sapiens; identical to SEQ ID NO: 105971

SEQ ID NO: 388056 - RNA, 64 nt, Homo Sapiens; identical to SEQ ID NO: 105972

SEQ ID NO: 388057 - RNA, 59 nt, Homo Sapiens; identical to SEQ ID NO: 105973

SEQ ID NO: 388058 - RNA, 64 nt, Homo Sapiens; identical to SEQ ID NO: 105974

SEQ ID NO: 388059 - RNA, 64 nt, Homo Sapiens; identical to SEQ ID NO: 105975

SEQ ID NO: 388060 - RNA, 64 nt, Homo Sapiens; identical to SEQ ID NO: 105976

SEQ ID NO: 388061 - RNA, 64 nt, Homo Sapiens; identical to SEQ ID NO: 105977

SEQ ID NO: 388062 - RNA, 64 nt, Homo Sapiens; identical to SEQ ID NO: 105978

SEQ ID NO: 388063 - RNA, 64 nt, Homo Sapiens; identical to SEQ ID NO: 105979

SEQ ID NO: 388064 - RNA, 64 nt, Homo Sapiens; identical to SEQ ID NO: 105980

SEQ ID NO: 388065 - RNA, 64 nt, Homo Sapiens; identical to SEQ ID NO: 105981

SEQ ID NO: 388066 - RNA, 64 nt, Homo Sapiens; identical to SEQ ID NO: 105982

SEQ ID NO: 388067 - RNA, 64 nt, Homo Sapiens; identical to SEQ ID NO: 105983

SEQ ID NO: 388068 - RNA, 64 nt, Homo Sapiens; identical to SEQ ID NO: 105984

SEQ ID NO: 388069 - RNA, 64 nt, Homo Sapiens; identical to SEQ ID NO: 105985

SEQ ID NO: 388070 - RNA, 64 nt, Homo Sapiens; identical to SEQ ID NO: 105986

SEQ ID NO: 388071 - RNA, 64 nt, Homo Sapiens; identical to SEQ ID NO: 105987

SEQ ID NO: 388072 - RNA, 64 nt, Homo Sapiens; identical to SEQ ID NO: 105988

SEQ ID NO: 388073 - RNA, 64 nt, Homo Sapiens; identical to SEQ ID NO: 105989

SEQ ID NO: 388074 - RNA, 64 nt, Homo Sapiens; identical to SEQ ID NO: 105990

SEQ ID NO: 388075 - RNA, 64 nt, Homo Sapiens; identical to SEQ ID NO: 105991

SEQ ID NO: 388076 - RNA, 64 nt, Homo Sapiens; identical to SEQ ID NO: 105992

SEQ ID NO: 388077 - RNA, 64 nt, Homo Sapiens; identical to SEQ ID NO: 105993

SEQ ID NO: 388078 - RNA, 64 nt, Homo Sapiens; identical to SEQ ID NO: 105994

SEQ ID NO: 388079 - RNA, 64 nt, Homo Sapiens; identical to SEQ ID NO: 105995

SEQ ID NO: 388080 - RNA, 64 nt, Homo Sapiens; identical to SEQ ID NO: 105996

SEQ ID NO: 388081 - RNA, 64 nt, Homo Sapiens; identical to SEQ ID NO: 105997

SEQ ID NO: 388082 - RNA, 64 nt, Homo Sapiens; identical to SEQ ID NO: 105998

SEQ ID NO: 388083 - RNA, 64 nt, Homo Sapiens; identical to SEQ ID NO: 105999

SEQ ID NO: 388084 - RNA, 64 nt, Homo Sapiens; identical to SEQ ID NO: 106000

SEQ ID NO: 388085 - RNA, 64 nt, Homo Sapiens; identical to SEQ ID NO: 106001

SEQ ID NO: 388086 - RNA, 64 nt, Homo Sapiens; identical to SEQ ID NO: 106002

SEQ ID NO: 388087 - RNA, 64 nt, Homo Sapiens; identical to SEQ ID NO: 106003

SEQ ID NO: 388088 - RNA, 64 nt, Homo Sapiens; identical to SEQ ID NO: 106004

SEQ ID NO: 388089 - RNA, 64 nt, Homo Sapiens; identical to SEQ ID NO: 106005

SEQ ID NO: 388090 - RNA, 64 nt, Homo Sapiens; identical to SEQ ID NO: 106006

SEQ ID NO: 388091 - RNA, 64 nt, Homo Sapiens; identical to SEQ ID NO: 106007

SEQ ID NO: 388092 - RNA, 64 nt, Homo Sapiens; identical to SEQ ID NO: 106008

SEQ ID NO: 388093 - RNA, 64 nt, Homo Sapiens; identical to SEQ ID NO: 106009

SEQ ID NO: 388094 - RNA, 64 nt, Homo Sapiens; identical to SEQ ID NO: 106010

SEQ ID NO: 388095 - RNA, 64 nt, Homo Sapiens; identical to SEQ ID NO: 106011

SEQ ID NO: 388096 - RNA, 64 nt, Homo Sapiens; identical to SEQ ID NO: 106012

SEQ ID NO: 388097 - RNA, 64 nt, Homo Sapiens; identical to SEQ ID NO: 106013

SEQ ID NO: 388098 - RNA, 64 nt, Homo Sapiens; identical to SEQ ID NO: 275072

SEQ ID NO: 388099 - RNA, 64 nt, Homo Sapiens; identical to SEQ ID NO: 275073

SEQ ID NO: 388100 - RNA, 64 nt, Homo Sapiens; identical to SEQ ID NO: 275074

SEQ ID NO: 388101 - RNA, 64 nt, Homo Sapiens; identical to SEQ ID NO: 275075

SEQ ID NO: 388102 - RNA, 64 nt, Homo Sapiens; identical to SEQ ID NO: 275076

SEQ ID NO: 388103 - RNA, 64 nt, Homo Sapiens; identical to SEQ ID NO: 275077

SEQ ID NO: 388104 - RNA, 64 nt, Homo Sapiens; identical to SEQ ID NO: 275078

SEQ ID NO: 388105 - RNA, 64 nt, Homo Sapiens; identical to SEQ ID NO: 275079

SEQ ID NO: 388106 - RNA, 64 nt, Homo Sapiens; identical to SEQ ID NO: 275080

SEQ ID NO: 388107 - RNA, 64 nt, Homo Sapiens; identical to SEQ ID NO: 275081

SEQ ID NO: 388108 - RNA, 64 nt, Homo Sapiens; identical to SEQ ID NO: 275082

SEQ ID NO: 388109 - RNA, 64 nt, Homo Sapiens; identical to SEQ ID NO: 219214

SEQ ID NO: 388110 - RNA, 64 nt, Homo Sapiens; identical to SEQ ID NO: 219215

SEQ ID NO: 388111 - RNA, 64 nt, Homo Sapiens; identical to SEQ ID NO: 219216

SEQ ID NO: 388112 - RNA, 64 nt, Homo Sapiens; identical to SEQ ID NO: 219217

SEQ ID NO: 388113 - RNA, 64 nt, Homo Sapiens; identical to SEQ ID NO: 219218

SEQ ID NO: 388114 - RNA, 64 nt, Homo Sapiens; identical to SEQ ID NO: 219219

SEQ ID NO: 388115 - RNA, 64 nt, Homo Sapiens; identical to SEQ ID NO: 219220

SEQ ID NO: 388116 - RNA, 64 nt, Homo Sapiens; identical to SEQ ID NO: 219221

SEQ ID NO: 388117 - RNA, 64 nt, Homo Sapiens; identical to SEQ ID NO: 219222

SEQ ID NO: 388118 - RNA, 64 nt, Homo Sapiens; identical to SEQ ID NO: 219223

SEQ ID NO: 388119 - RNA, 64 nt, Homo Sapiens; identical to SEQ ID NO: 219224

SEQ ID NO: 388120 - RNA, 64 nt, Homo Sapiens; identical to SEQ ID NO: 219225

SEQ ID NO: 388121 - RNA, 64 nt, Homo Sapiens; identical to SEQ ID NO: 219226

SEQ ID NO: 388122 - RNA, 64 nt, Homo Sapiens; identical to SEQ ID NO: 219227

SEQ ID NO: 388123 - RNA, 64 nt, Homo Sapiens; identical to SEQ ID NO: 187011

SEQ ID NO: 388124 - RNA, 64 nt, Homo Sapiens; identical to SEQ ID NO: 187012

SEQ ID NO: 388125 - RNA, 64 nt, Homo Sapiens; identical to SEQ ID NO: 187013

SEQ ID NO: 388126 - RNA, 64 nt, Homo Sapiens; identical to SEQ ID NO: 187014

SEQ ID NO: 388127 - RNA, 64 nt, Homo Sapiens; identical to SEQ ID NO: 187015

SEQ ID NO: 388128 - RNA, 64 nt, Homo Sapiens; identical to SEQ ID NO: 187016

SEQ ID NO: 388129 - RNA, 56 nt, Homo Sapiens; identical to SEQ ID NO: 187017

SEQ ID NO: 388130 - RNA, 64 nt, Homo Sapiens; identical to SEQ ID NO: 187018

SEQ ID NO: 388131 - RNA, 64 nt, Homo Sapiens; identical to SEQ ID NO: 187019

SEQ ID NO: 388132 - RNA, 64 nt, Homo Sapiens; identical to SEQ ID NO: 187020

SEQ ID NO: 388133 - RNA, 64 nt, Homo Sapiens; identical to SEQ ID NO: 187021

SEQ ID NO: 388134 - RNA, 64 nt, Homo Sapiens; identical to SEQ ID NO: 187022

SEQ ID NO: 388135 - RNA, 64 nt, Homo Sapiens; identical to SEQ ID NO: 187023

SEQ ID NO: 388136 - RNA, 64 nt, Homo Sapiens; identical to SEQ ID NO: 187024

SEQ ID NO: 388137 - RNA, 64 nt, Homo Sapiens; identical to SEQ ID NO: 187025

SEQ ID NO: 388138 - RNA, 64 nt, Homo Sapiens; identical to SEQ ID NO: 187026

SEQ ID NO: 388139 - RNA, 64 nt, Homo Sapiens; identical to SEQ ID NO: 187027

SEQ ID NO: 388140 - RNA, 64 nt, Homo Sapiens; identical to SEQ ID NO: 187028

SEQ ID NO: 388141 - RNA, 64 nt, Homo Sapiens; identical to SEQ ID NO: 187029

SEQ ID NO: 388142 - RNA, 64 nt, Homo Sapiens; identical to SEQ ID NO: 187030

SEQ ID NO: 388143 - RNA, 64 nt, Homo Sapiens; identical to SEQ ID NO: 187031

SEQ ID NO: 388144 - RNA, 64 nt, Homo Sapiens; identical to SEQ ID NO: 187032

SEQ ID NO: 388145 - RNA, 64 nt, Homo Sapiens; identical to SEQ ID NO: 187033

SEQ ID NO: 388146 - RNA, 64 nt, Homo Sapiens; identical to SEQ ID NO: 187034

SEQ ID NO: 388147 - RNA, 64 nt, Homo Sapiens; identical to SEQ ID NO: 187035

SEQ ID NO: 388148 - RNA, 64 nt, Homo Sapiens; identical to SEQ ID NO: 187036

SEQ ID NO: 388149 - RNA, 64 nt, Homo Sapiens; identical to SEQ ID NO: 187037

SEQ ID NO: 388150 - RNA, 64 nt, Homo Sapiens; identical to SEQ ID NO: 187038

SEQ ID NO: 388151 - RNA, 64 nt, Homo Sapiens; identical to SEQ ID NO: 187039

SEQ ID NO: 388152 - RNA, 64 nt, Homo Sapiens; identical to SEQ ID NO: 187040

SEQ ID NO: 388153 - RNA, 64 nt, Homo Sapiens; identical to SEQ ID NO: 187041

SEQ ID NO: 388154 - RNA, 64 nt, Homo Sapiens; identical to SEQ ID NO: 187042

SEQ ID NO: 388155 - RNA, 64 nt, Homo Sapiens; identical to SEQ ID NO: 187043

SEQ ID NO: 388156 - RNA, 64 nt, Homo Sapiens; identical to SEQ ID NO: 187044

SEQ ID NO: 388157 - RNA, 64 nt, Homo Sapiens; identical to SEQ ID NO: 187045

SEQ ID NO: 388158 - RNA, 64 nt, Homo Sapiens; identical to SEQ ID NO: 187046

SEQ ID NO: 388159 - RNA, 64 nt, Homo Sapiens; identical to SEQ ID NO: 187047

SEQ ID NO: 388160 - RNA, 64 nt, Homo Sapiens; identical to SEQ ID NO: 187048

SEQ ID NO: 388161 - RNA, 64 nt, Homo Sapiens; identical to SEQ ID NO: 187049

SEQ ID NO: 388162 - RNA, 64 nt, Homo Sapiens; identical to SEQ ID NO: 187050

SEQ ID NO: 388163 - RNA, 64 nt, Homo Sapiens; identical to SEQ ID NO: 187051

SEQ ID NO: 388164 - RNA, 64 nt, Homo Sapiens; identical to SEQ ID NO: 187052

SEQ ID NO: 388165 - RNA, 64 nt, Homo Sapiens; identical to SEQ ID NO: 187053

SEQ ID NO: 388166 - RNA, 64 nt, Homo Sapiens; identical to SEQ ID NO: 187054

SEQ ID NO: 388167 - RNA, 64 nt, Homo Sapiens; identical to SEQ ID NO: 187055

SEQ ID NO: 388168 - RNA, 64 nt, Homo Sapiens; identical to SEQ ID NO: 187056

SEQ ID NO: 388169 - RNA, 64 nt, Homo Sapiens; identical to SEQ ID NO: 187057

SEQ ID NO: 388170 - RNA, 64 nt, Homo Sapiens; identical to SEQ ID NO: 187058

SEQ ID NO: 388171 - RNA, 64 nt, Homo Sapiens; identical to SEQ ID NO: 187059

SEQ ID NO: 388172 - RNA, 64 nt, Homo Sapiens; identical to SEQ ID NO: 187060

SEQ ID NO: 388173 - RNA, 64 nt, Homo Sapiens; identical to SEQ ID NO: 187061

SEQ ID NO: 388174 - RNA, 64 nt, Homo Sapiens; identical to SEQ ID NO: 187062

SEQ ID NO: 388175 - RNA, 64 nt, Homo Sapiens; identical to SEQ ID NO: 187063

SEQ ID NO: 388176 - RNA, 64 nt, Homo Sapiens; identical to SEQ ID NO: 187064

SEQ ID NO: 388177 - RNA, 64 nt, Homo Sapiens; identical to SEQ ID NO: 187065

SEQ ID NO: 388178 - RNA, 64 nt, Homo Sapiens; identical to SEQ ID NO: 187066

SEQ ID NO: 388179 - RNA, 64 nt, Homo Sapiens; identical to SEQ ID NO: 187067

SEQ ID NO: 388180 - RNA, 64 nt, Homo Sapiens; identical to SEQ ID NO: 187068

SEQ ID NO: 388181 - RNA, 64 nt, Homo Sapiens; identical to SEQ ID NO: 187069

SEQ ID NO: 388182 - RNA, 64 nt, Homo Sapiens; identical to SEQ ID NO: 187070

SEQ ID NO: 388183 - RNA, 64 nt, Homo Sapiens; identical to SEQ ID NO: 187071

SEQ ID NO: 388184 - RNA, 64 nt, Homo Sapiens; identical to SEQ ID NO: 187072

SEQ ID NO: 388185 - RNA, 64 nt, Homo Sapiens; identical to SEQ ID NO: 187073

SEQ ID NO: 388186 - RNA, 64 nt, Homo Sapiens; identical to SEQ ID NO: 187074

SEQ ID NO: 388187 - RNA, 64 nt, Homo Sapiens; identical to SEQ ID NO: 187075

SEQ ID NO: 388188 - RNA, 64 nt, Homo Sapiens; identical to SEQ ID NO: 187076

SEQ ID NO: 388189 - RNA, 64 nt, Homo Sapiens; identical to SEQ ID NO: 187077

SEQ ID NO: 388190 - RNA, 64 nt, Homo Sapiens; identical to SEQ ID NO: 187078

SEQ ID NO: 388191 - RNA, 64 nt, Homo Sapiens; identical to SEQ ID NO: 187079

SEQ ID NO: 388192 - RNA, 64 nt, Homo Sapiens; identical to SEQ ID NO: 187080

SEQ ID NO: 388193 - RNA, 64 nt, Homo Sapiens; identical to SEQ ID NO: 187081

SEQ ID NO: 388194 - RNA, 64 nt, Homo Sapiens; identical to SEQ ID NO: 187082

SEQ ID NO: 388195 - RNA, 64 nt, Homo Sapiens; identical to SEQ ID NO: 187083

SEQ ID NO: 388196 - RNA, 57 nt, Homo Sapiens; identical to SEQ ID NO: 187084

SEQ ID NO: 388197 - RNA, 64 nt, Homo Sapiens; identical to SEQ ID NO: 187085

SEQ ID NO: 388198 - RNA, 64 nt, Homo Sapiens; identical to SEQ ID NO: 187086

SEQ ID NO: 388199 - RNA, 64 nt, Homo Sapiens; identical to SEQ ID NO: 187087

SEQ ID NO: 388200 - RNA, 64 nt, Homo Sapiens; identical to SEQ ID NO: 187088

SEQ ID NO: 388201 - RNA, 64 nt, Homo Sapiens; identical to SEQ ID NO: 187089

SEQ ID NO: 388202 - RNA, 64 nt, Homo Sapiens; identical to SEQ ID NO: 187090

SEQ ID NO: 388203 - RNA, 64 nt, Homo Sapiens; identical to SEQ ID NO: 187091

SEQ ID NO: 388204 - RNA, 64 nt, Homo Sapiens; identical to SEQ ID NO: 187092

SEQ ID NO: 388205 - RNA, 64 nt, Homo Sapiens; identical to SEQ ID NO: 187093

SEQ ID NO: 388206 - RNA, 64 nt, Homo Sapiens; identical to SEQ ID NO: 187094

SEQ ID NO: 388207 - RNA, 64 nt, Homo Sapiens; identical to SEQ ID NO: 187095

SEQ ID NO: 388208 - RNA, 64 nt, Homo Sapiens; identical to SEQ ID NO: 187096

SEQ ID NO: 388209 - RNA, 64 nt, Homo Sapiens; identical to SEQ ID NO: 187097

SEQ ID NO: 388210 - RNA, 64 nt, Homo Sapiens; identical to SEQ ID NO: 187098

SEQ ID NO: 388211 - RNA, 64 nt, Homo Sapiens; identical to SEQ ID NO: 187099

SEQ ID NO: 388212 - RNA, 64 nt, Homo Sapiens; identical to SEQ ID NO: 187100

SEQ ID NO: 388213 - RNA, 64 nt, Homo Sapiens; identical to SEQ ID NO: 187101

SEQ ID NO: 388214 - RNA, 64 nt, Homo Sapiens; identical to SEQ ID NO: 187102

SEQ ID NO: 388215 - RNA, 64 nt, Homo Sapiens; identical to SEQ ID NO: 187103

SEQ ID NO: 388216 - RNA, 64 nt, Homo Sapiens; identical to SEQ ID NO: 187104

SEQ ID NO: 388217 - RNA, 64 nt, Homo Sapiens; identical to SEQ ID NO: 187105

SEQ ID NO: 388218 - RNA, 64 nt, Homo Sapiens; identical to SEQ ID NO: 187106

SEQ ID NO: 388219 - RNA, 64 nt, Homo Sapiens; identical to SEQ ID NO: 187107

SEQ ID NO: 388220 - RNA, 64 nt, Homo Sapiens; identical to SEQ ID NO: 187108

SEQ ID NO: 388221 - RNA, 64 nt, Homo Sapiens; identical to SEQ ID NO: 187109

SEQ ID NO: 388222 - RNA, 64 nt, Homo Sapiens; identical to SEQ ID NO: 187110

SEQ ID NO: 388223 - RNA, 64 nt, Homo Sapiens; identical to SEQ ID NO: 187111

SEQ ID NO: 388224 - RNA, 64 nt, Homo Sapiens; identical to SEQ ID NO: 187112

SEQ ID NO: 388225 - RNA, 64 nt, Homo Sapiens; identical to SEQ ID NO: 187113

SEQ ID NO: 388226 - RNA, 64 nt, Homo Sapiens; identical to SEQ ID NO: 187114

SEQ ID NO: 388227 - RNA, 64 nt, Homo Sapiens
cgcagcuuccuggggcuuguccagaggccagcuaggagggaaaccaaguggggcugcacucggu

SEQ ID NO: 388228 - RNA, 64 nt, Homo Sapiens
ggagacaaguggggcugcacgagccugacaugguggagggaaaguaccuggccugacccagucg

SEQ ID NO: 388229 - RNA, 64 nt, Homo Sapiens
uggaccagaaugaaaacugucaguauaaggauaaggagggaagggaaaaguagagaaauggauu

SEQ ID NO: 388230 - RNA, 64 nt, Homo Sapiens
auugguagcaaaggaugggguagccugaauuugaggagggaauguuuguuugacuccuuaccaa

SEQ ID NO: 388231 - RNA, 64 nt, Homo Sapiens
guuuccuucugucccccggggccguggagcugucggagggaaggaggacggugcggggccgcag

SEQ ID NO: 388232 - RNA, 64 nt, Homo Sapiens
acaccagcgcuggcuucccgggcccgcgggccggggagggaagccucggggcugcggggugaga

SEQ ID NO: 388233 - RNA, 64 nt, Homo Sapiens
ccccaaggcucuugcagagcuagggcucugaaggggagggaaggcaacggcucugcccagagcc

SEQ ID NO: 388234 - RNA, 64 nt, Homo Sapiens
gcucaagagggaagcaauuauaagguggguggcaggagggaacaggugccaccugcuggacaau

SEQ ID NO: 388235 - RNA, 64 nt, Homo Sapiens
ucugggguacauguuaaguguccccuuauacaguggagggaagucuuccuuccugaaggaaaau

SEQ ID NO: 388236 - RNA, 64 nt, Homo Sapiens
uuuuagugauaagauucauacacucuguauuuggggagggaaaaccuuuuuaagcauggugggg

SEQ ID NO: 388237 - RNA, 64 nt, Homo Sapiens
ugaggauagagcuccagaaauagucccugaggguggagggaagcugcucuuccaaucccccacc

SEQ ID NO: 388238 - RNA, 64 nt, Homo Sapiens
ccucagcccaggcuguugucuggcugggagagugggagggaagccguagggggugaguugagug

SEQ ID NO: 388239 - RNA, 64 nt, Homo Sapiens
gacaaucucaggcugaaaucccauaaaggaacuuggagggaauauuaugauggagggaagugag

SEQ ID NO: 388240 - RNA, 64 nt, Homo Sapiens
aucccauaaaggaacuuggagggaauauuaugauggagggaagugaggugaauccaggcacaug

SEQ ID NO: 388241 - RNA, 64 nt, Homo Sapiens
gaccaaaaucaaaccgcaauuccacuugacccccggagggaaagcugucugagagaucucagac

SEQ ID NO: 388242 - RNA, 64 nt, Homo Sapiens
gggaggcugcacgcucggccgcggugccgggccgggagggaagaggagagcggcgggaggggcc

SEQ ID NO: 388243 - RNA, 64 nt, Homo Sapiens
uggugggccucagggaggauaaggagucccaucaggagggaagagaaaaggaaccaagaaguag

SEQ ID NO: 388244 - RNA, 64 nt, Homo Sapiens
ggaaccaagaaguagaaggaguaagagcuacaaaggagggaaaauggggaacaaaacaauuaac

SEQ ID NO: 388245 - RNA, 64 nt, Homo Sapiens
auagaauggcacuguccagccguguagacaagugggagggaagagagcaaguaguaauaaccac

SEQ ID NO: 388246 - RNA, 64 nt, Homo Sapiens
gcccuuugugucuuugaucugcguuguuaugaaaggagggaauauguuguaggcacuuacagcu

SEQ ID NO: 388247 - RNA, 64 nt, Homo Sapiens
caaaauugggagggggaagaauucugccucaucuggagggaaacuuuuuggaaccaacauucaa

SEQ ID NO: 388248 - RNA, 64 nt, Homo Sapiens
caugucuugcuaaaccuguugggugguaguggugggagggaaacaccugggggacggggguggg

SEQ ID NO: 388249 - RNA, 64 nt, Homo Sapiens
guaauuggggagagggagugugccccucggggcaggagggaagggcaucuggggaagggcagga

SEQ ID NO: 388250 - RNA, 64 nt, Homo Sapiens
cggggcaggagggaagggcaucuggggaagggcaggagggaagagcuguccaugcagccacgcc

SEQ ID NO: 388251 - RNA, 64 nt, Homo Sapiens
ugguuacuuuuggccuccccuuucauuugcuuuuggagggaagcgauuagaagaccaacaggug

SEQ ID NO: 388252 - RNA, 64 nt, Homo Sapiens
ggcugucucuguuugugggaugguagagaaugcuggagggaaggcugacaagguuugaagggcu

SEQ ID NO: 388253 - RNA, 64 nt, Homo Sapiens
ccccugccuagagcucccucuuucaaaguauaagggagggaagaaguggugagaaguuugccua

SEQ ID NO: 388254 - RNA, 64 nt, Homo Sapiens
uuucuugcugguggucaggaggcauagggaggcaggagggaaggaagcuuuaccuguaaaaugg

SEQ ID NO: 388255 - RNA, 64 nt, Homo Sapiens
ggccgggagugcccaccccgcccugcugcccuguggagggaagaggauugagcuuugugucacc

SEQ ID NO: 388256 - RNA, 64 nt, Homo Sapiens
agccuugcucagcuguggguugcccugcugggaaggagggaaucacguccaccugggucccaag

SEQ ID NO: 388257 - RNA, 64 nt, Homo Sapiens
acaccaaugaaucagcuuggguggucugagcuggggagggaagggucacugacccuggccugug

SEQ ID NO: 388258 - RNA, 64 nt, Homo Sapiens
agugaaggagaggcuuuggaagggccucugaggaggagggaaaaauaggagggcaggguagggu

SEQ ID NO: 388259 - RNA, 64 nt, Homo Sapiens
uagcuuaugcuucuuuagauggaauaaugggaaaggagggaaaugggaaauggauggaaauggg

SEQ ID NO: 388260 - RNA, 64 nt, Homo Sapiens
aggagggaaaugggaaauggauggaaaugggaaaggagggaaaauaauagcccagugagagcug

SEQ ID NO: 388261 - RNA, 64 nt, Homo Sapiens
ggacuccuuccuccagagugcuguggcuacagguggagggaagauugaggguuugccaaccaca

SEQ ID NO: 388262 - RNA, 64 nt, Homo Sapiens
ggcaaccagggaguccucgaggagcaucgagguaggagggaaacccccagugaccugcgaaagu

SEQ ID NO: 388263 - RNA, 64 nt, Homo Sapiens
gagaugaccuuaacuuuuaaaugcgugaggagagggagggaacaguacuguggcucaggauaug

SEQ ID NO: 388264 - RNA, 64 nt, Homo Sapiens
uuuaaaacaaaaacacccagucuuccauccaaguggagggaaacaaaucucuaaaagaauauga

SEQ ID NO: 388265 - RNA, 64 nt, Homo Sapiens
gggagcauuuuugguggucuugggggaggggaggggagggaagggcugguguugauuuuccucc

SEQ ID NO: 388266 - RNA, 64 nt, Homo Sapiens
gcagagggaaucauugcuggacuggauuucuucuggagggaagcaccaugaauuaaaggugcca

SEQ ID NO: 388267 - RNA, 64 nt, Homo Sapiens
uggccaggcucgaagcagucaagcagccggcacaggagggaaggcgucccacagcaucuccuag

SEQ ID NO: 388268 - RNA, 64 nt, Homo Sapiens
ugcugacugugauuaggugcagaucacugucaguggagggaagcccgccaggaauggaccaugc

SEQ ID NO: 388269 - RNA, 64 nt, Homo Sapiens
uuauuuuagcuauuuauuuguaggagugacugggggagggaagaaauguuuggugucuguuucu

SEQ ID NO: 388270 - RNA, 64 nt, Homo Sapiens
aguuuugugggaaauauucauagggagagggaagggagggaaacggaggggggugggaggggug

SEQ ID NO: 388271 - RNA, 64 nt, Homo Sapiens
uggagggggcgcuggaggagggccuaggagacuaggagggaaucgagucuagacagacggcaca

SEQ ID NO: 388272 - RNA, 64 nt, Homo Sapiens
acaagaugcaacuaggaagaagauggauggaaagggagggaaaggaugacggggggugggaaca

SEQ ID NO: 388273 - RNA, 64 nt, Homo Sapiens
accugaggagacuuuggggacagggcaggggcagggagggaaacugaggaaaucuuccauuccu

SEQ ID NO: 388274 - RNA, 64 nt, Homo Sapiens
gaugggcggguuugugcuaugugcaggguggaagggagggaaguugacaggucagaagaucagg

SEQ ID NO: 388275 - RNA, 64 nt, Homo Sapiens
ccuauaauuguguggaauguauguaauucauacuggagggaauuucaauccuuacuaaacauuc

SEQ ID NO: 388276 - RNA, 64 nt, Homo Sapiens
ccuacaaaugugaagaauguagggaauuuauacaggagggaaaccucaacccuuacugaacaua

SEQ ID NO: 388277 - RNA, 64 nt, Homo Sapiens
acucacagaacuguccccugcuccguggugggcaggagggaaguggugcagggcugcgugcauu

SEQ ID NO: 388278 - RNA, 64 nt, Homo Sapiens
uauuuccucugagguuugaggaugaagauaaguuggagggaaagagaguaacuaauaggggaug

SEQ ID NO: 388279 - RNA, 64 nt, Homo Sapiens
auauaauuuucaugacaaugucacaguuuuccagggagggaaugauuucuacccaggauaauag

SEQ ID NO: 388280 - RNA, 64 nt, Homo Sapiens
ggaaaggacccugaagccaacuguuuggggcauuggagggaaaacacagauguugaaugaacau

SEQ ID NO: 388281 - RNA, 64 nt, Homo Sapiens
ugcugcuucuccaacucuugcugggcagggaaggggagggaaauagcugagcaucucccgaguc

SEQ ID NO: 388282 - RNA, 64 nt, Homo Sapiens
ggacaaagaccccaggaggccccagcuccagccuggagggaaggagucuccaggacauuccuuu

SEQ ID NO: 388283 - RNA, 64 nt, Homo Sapiens
gaagucagcucugggagcagguaaaaccacgaagggagggaaggggacacaaaggccgaguggg

SEQ ID NO: 388284 - RNA, 64 nt, Homo Sapiens
agccuugagccaggcagaaggcugacuuggugauggagggaaaaugcuuuuggcagcauaacgg

SEQ ID NO: 388285 - RNA, 64 nt, Homo Sapiens
gugggaggaaugggaagcaggaugggagggaaggggagggaaaggggagggagggcuggggaug

SEQ ID NO: 388286 - RNA, 64 nt, Homo Sapiens
ggagggaaaggugggaggaagcuggggauggaugggagggaagggaggaagagugggagggagg

SEQ ID NO: 388287 - RNA, 64 nt, Homo Sapiens
gccuugauguccagcacacauaagcuuuccuuggggagggaagaaacccaggagcacugggagu

SEQ ID NO: 388288 - RNA, 64 nt, Homo Sapiens
cuuugcccaagauuacucaccacugagaacuagaggagggaacaugccacuuugaagaaaagaa

SEQ ID NO: 388289 - RNA, 64 nt, Homo Sapiens; identical to SEQ ID NO: 166169

SEQ ID NO: 388290 - RNA, 64 nt, Homo Sapiens; identical to SEQ ID NO: 166170

SEQ ID NO: 388291 - RNA, 64 nt, Homo Sapiens; identical to SEQ ID NO: 166171

SEQ ID NO: 388292 - RNA, 64 nt, Homo Sapiens; identical to SEQ ID NO: 166172

SEQ ID NO: 388293 - RNA, 64 nt, Homo Sapiens; identical to SEQ ID NO: 166173

SEQ ID NO: 388294 - RNA, 64 nt, Homo Sapiens; identical to SEQ ID NO: 166174

SEQ ID NO: 388295 - RNA, 64 nt, Homo Sapiens; identical to SEQ ID NO: 166175

SEQ ID NO: 388296 - RNA, 64 nt, Homo Sapiens; identical to SEQ ID NO: 166176

SEQ ID NO: 388297 - RNA, 64 nt, Homo Sapiens; identical to SEQ ID NO: 166177

SEQ ID NO: 388298 - RNA, 64 nt, Homo Sapiens; identical to SEQ ID NO: 166178

SEQ ID NO: 388299 - RNA, 64 nt, Homo Sapiens; identical to SEQ ID NO: 166179

SEQ ID NO: 388300 - RNA, 64 nt, Homo Sapiens; identical to SEQ ID NO: 166180

SEQ ID NO: 388301 - RNA, 64 nt, Homo Sapiens; identical to SEQ ID NO: 166181

SEQ ID NO: 388302 - RNA, 64 nt, Homo Sapiens; identical to SEQ ID NO: 166182

SEQ ID NO: 388303 - RNA, 64 nt, Homo Sapiens; identical to SEQ ID NO: 166183

SEQ ID NO: 388304 - RNA, 64 nt, Homo Sapiens
uuugaaccugucuugauaagugcuugaauucaagacuggucaguccaagagcagacaaaaauau

SEQ ID NO: 388305 - RNA, 64 nt, Homo Sapiens
uccuacuaaaacugucauuguuucuuuuuuuuuaacuggucagucauucacaauaagcuaugag

SEQ ID NO: 388306 - RNA, 64 nt, Homo Sapiens
uuugaaaaguuguggccugcuugucccucuguugacuggucaucuggaccaucguacuugcugu

SEQ ID NO: 388307 - RNA, 64 nt, Homo Sapiens
ccugagauuugauccuugacaauuucuggaaagcacuggucagucacacuguccuggacagagu

SEQ ID NO: 388308 - RNA, 64 nt, Homo Sapiens
ugagaauuuuuuuuguacaguuacuaaucucugcacuggucauuuucuaggguaaaaacagcua

SEQ ID NO: 388309 - RNA, 64 nt, Homo Sapiens
uggucaacuuuuuucaguauugaaaguauuauccacuggucagagauaagcuaauugaaugccu

SEQ ID NO: 388310 - RNA, 64 nt, Homo Sapiens; identical to SEQ ID NO: 171997

SEQ ID NO: 388311 - RNA, 64 nt, Homo Sapiens; identical to SEQ ID NO: 171998

SEQ ID NO: 388312 - RNA, 64 nt, Homo Sapiens; identical to SEQ ID NO: 171999

SEQ ID NO: 388313 - RNA, 64 nt, Homo Sapiens; identical to SEQ ID NO: 172000

SEQ ID NO: 388314 - RNA, 64 nt, Homo Sapiens; identical to SEQ ID NO: 172001

SEQ ID NO: 388315 - RNA, 64 nt, Homo Sapiens; identical to SEQ ID NO: 172002

SEQ ID NO: 388316 - RNA, 64 nt, Homo Sapiens; identical to SEQ ID NO: 172003

SEQ ID NO: 388317 - RNA, 64 nt, Homo Sapiens; identical to SEQ ID NO: 172004

SEQ ID NO: 388318 - RNA, 64 nt, Homo Sapiens
acugaaaauaggcauauagauauauuccaagccgccugacgaucuaauuguaaaaaguaaagca

SEQ ID NO: 388319 - RNA, 64 nt, Homo Sapiens
cugggcuguagggugaguggcuugcuuggugggaccugacgaguugguggcaugggaaggaugu

SEQ ID NO: 388320 - RNA, 64 nt, Homo Sapiens
gucccccauagagucaagccuagugcuugaagguccugacgacacccacaacauacaugagagu

SEQ ID NO: 388321 - RNA, 64 nt, Homo Sapiens
augaagacccagcaguccucaccaguucacuugcccugacgaguccacacuucuucccaccagg

SEQ ID NO: 388322 - RNA, 64 nt, Homo Sapiens
ugcgcccucagggcuuccagcaggauugagucacccugacgaugaccggggagaagccgugugc

SEQ ID NO: 388323 - RNA, 64 nt, Homo Sapiens
acucuugacacuuuuauguaaaggaauuucgcacccugacgauugccaugggcaucuggccacc

SEQ ID NO: 388324 - RNA, 64 nt, Homo Sapiens
cccaccccauaagcccugagacucccgccuuugaccugacgaucuucccccuucccgccuucag

SEQ ID NO: 388325 - RNA, 64 nt, Homo Sapiens
gaguauauaaaacuugagacauuuuuguaggaugccugacgagguguagccuuuuaucuuguuu

SEQ ID NO: 388326 - RNA, 64 nt, Homo Sapiens
guggcuggugccaguagaggucagucaagggaucccugacgagaauaaagagcccagaaacagg

SEQ ID NO: 388327 - RNA, 64 nt, Homo Sapiens
uucaggagagaguugaaccuaaacauagaaauugccugacgaacuccuugauuuuagccuucuc

SEQ ID NO: 388328 - RNA, 64 nt, Homo Sapiens
gcacucugagauagcacugcuuaccauaaauucaccugacgaggcugucggaaucuuuuuuguu

SEQ ID NO: 388329 - RNA, 64 nt, Homo Sapiens
uguuuugguuguuuucuuaaaaaacaaguuaaaaccugacgauuucugcaggcuguguaagcau

SEQ ID NO: 388330 - RNA, 64 nt, Homo Sapiens
uggaaacacacacagacacagacaagaacagccgccugacgaaaauauuuuugaaagcuacgca

SEQ ID NO: 388331 - RNA, 64 nt, Homo Sapiens
ugaaauaauuggggguuuuguuuaaaguaagcuuccugacgacacagccaggccaagcuauucu

SEQ ID NO: 388332 - RNA, 64 nt, Homo Sapiens
gggccaugugacccaaggagucuacccuccagaaccugacgacuggauuccccggcugugacac

SEQ ID NO: 388333 - RNA, 64 nt, Homo Sapiens
ggccccggccggucacauugacugauggccaccgccugacgaaucgagugccugugugucuacc

SEQ ID NO: 388334 - RNA, 64 nt, Homo Sapiens
agccaggccugagccccacaauggugucuucacaccugacgaugcauacauccaucggcucccc

SEQ ID NO: 388335 - RNA, 64 nt, Homo Sapiens
cuggccccggaucagagcagagccccgcccucuuccugacgaaacccagccuaugagcauccug

SEQ ID NO: 388336 - RNA, 64 nt, Homo Sapiens
cugaagaaucaagagggcaggcucguaaauauucccugacgacaugggcccaugugaggcuggg

SEQ ID NO: 388337 - RNA, 64 nt, Homo Sapiens
accgaugugaacgcaaaaugccuuguucauuauuccugacgagaucuugagguuguuugaugcu

SEQ ID NO: 388338 - RNA, 64 nt, Homo Sapiens
aaucauaucuuuaaccagccauaauuuugagcuaccugacgacaaaaaacaaaaaccuguaaaa

SEQ ID NO: 388339 - RNA, 64 nt, Homo Sapiens
ccacaacugggacagaggcucaauccaccaucauccugacgauccagacaccccuuuccagcca

SEQ ID NO: 388340 - RNA, 64 nt, Homo Sapiens
uaucgaaaagaugagagugagcccuucugcccugccugacgaugcgaaugcucugcggcguagu

SEQ ID NO: 388341 - RNA, 64 nt, Homo Sapiens
cccuugcugccuacccuuuuuuguggauuuuauuccugacgauuuggcuuugggauugaucauc

SEQ ID NO: 388342 - RNA, 64 nt, Homo Sapiens
ccacuguaacuaccaaucuugccgcccuguacucccugacgauucucagcucccuccaguggug

SEQ ID NO: 388343 - RNA, 64 nt, Homo Sapiens
ccccaaaugccuuuccuggaguggcuaagccucuccugacgaggcuccucaugcggggagaggg

SEQ ID NO: 388344 - RNA, 64 nt, Homo Sapiens
ugguuucucaguugcugggcgagccuguacucugccugacgaggaacgcuggcuccgaagaggc

SEQ ID NO: 388345 - RNA, 64 nt, Homo Sapiens
ccggauucggaccacuuggggaucccagaaccucccugacgauauccuggaaggacugaggaag

SEQ ID NO: 388346 - RNA, 64 nt, Homo Sapiens
ccggcugccucccaccccagccucaaaaccucuuccugacgacccccgccccgugugauuuguu

SEQ ID NO: 388347 - RNA, 64 nt, Homo Sapiens
gcacaaugaaaaaagaaaacuucaggcugguacuccugacgaauauaggugccaaaauccucag

SEQ ID NO: 388348 - RNA, 62 nt, Homo Sapiens
accgccccucuucccaguagcucuucuaugacccugacgagugcgggcugaugaagaaggca

SEQ ID NO: 388349 - RNA, 64 nt, Homo Sapiens
uaagcaguuaugugaccucaggucuugcaaaauuccugacgagacaucugguuuucucuccagg

SEQ ID NO: 388350 - RNA, 64 nt, Homo Sapiens
cuuguccagauggcaggaagcagaucccacauccccugacgaagauccauggccuggaccaccc

SEQ ID NO: 388351 - RNA, 61 nt, Homo Sapiens
gagcuagguuuucucagagggccugccauccaccccucaggcucagggguuggucugagag

SEQ ID NO: 388352 - RNA, 61 nt, Homo Sapiens
gcucacucagaccccaaggauuaaggacuccaccccucagauuauugaaggggaugguuca

SEQ ID NO: 388353 - RNA, 61 nt, Homo Sapiens
auccuuccucaggacuuggcccucaccccucaccccucaccugcccaccucguuccccagc

SEQ ID NO: 388354 - RNA, 61 nt, Homo Sapiens
ccucaccauccuuccucaggccccagcccucaccccucacccaucagcugcccaccucguu

SEQ ID NO: 388355 - RNA, 61 nt, Homo Sapiens
acuguggggaucauucucucucagagugcugaccccucaucugucuggcgucaacuggcuu

SEQ ID NO: 388356 - RNA, 61 nt, Homo Sapiens
cccucuguccucauuguuuggcccuggacacaccccucagcuccugcugaggugggacugg

SEQ ID NO: 388357 - RNA, 61 nt, Homo Sapiens
caucauggagacccgcaggcggggcuuagccaccccucaaacccagggcccccuggcaccu

SEQ ID NO: 388358 - RNA, 61 nt, Homo Sapiens
cuuggauauuucccaagaaccccccacauacaccccucacaagccaccccuccugagaggc

SEQ ID NO: 388359 - RNA, 61 nt, Homo Sapiens
cuguccuccggacuuaggaagggaauagcucaccccucauugacuuccgcaggaauugaga

SEQ ID NO: 388360 - RNA, 61 nt, Homo Sapiens
gcuuccguucuuacugccuuucuucagcugcaccccucaccguggggugcagcccuggcgg

SEQ ID NO: 388361 - RNA, 61 nt, Homo Sapiens
auuuucucccugagcuguaggguggaccuggaccccucagagaugcucgacugcagggucc

SEQ ID NO: 388362 - RNA, 61 nt, Homo Sapiens
cguccagugucacccacacauugguccggggaccccucagugcagagccugaaguuggggg

SEQ ID NO: 388363 - RNA, 61 nt, Homo Sapiens
gguuuaagagaccaggucuugugugggguuuaccccucacagguguuucucucuguaauuu

SEQ ID NO: 388364 - RNA, 61 nt, Homo Sapiens
gguuucauuguuuccuucugcuuuuguggugaccccucaggggguucagcggggccucugu

SEQ ID NO: 388365 - RNA, 61 nt, Homo Sapiens
uuucccucucccuucuucccgcaaaauuuacaccccucacgacugucuuaagugagccagg

SEQ ID NO: 388366 - RNA, 61 nt, Homo Sapiens
caugucgcaaaaugaaccaauuucucuaaggaccccucaaaagaccucagggaggguugag

SEQ ID NO: 388367 - RNA, 61 nt, Homo Sapiens
uucugcccauagacggggaugacucagcacuaccccucaacagagaugacuuugaugacuc

SEQ ID NO: 388368 - RNA, 61 nt, Homo Sapiens
agggaugacucagcagggaugacucagcaccaccccucaacagggaugacucagcagggau

SEQ ID NO: 388369 - RNA, 61 nt, Homo Sapiens
ggggacagggccaguguuggugggggcucggaccccucacuugucuauucagacgcuggua

SEQ ID NO: 388370 - RNA, 61 nt, Homo Sapiens
caacagccgcccccgcaggcuccagaggcccaccccucaugcagcacacucaucccgcgcc

SEQ ID NO: 388371 - RNA, 61 nt, Homo Sapiens
cagagacuuccuucauuaaccuuagauuccaaccccucaaucccauggucacccugaagcc

SEQ ID NO: 388372 - RNA, 61 nt, Homo Sapiens
gcagauucccagauuaacagcccuauccccaaccccucagaaguagcaccuucaggcuagu

SEQ ID NO: 388373 - RNA, 64 nt, Homo Sapiens; identical to SEQ ID NO: 153237

SEQ ID NO: 388374 - RNA, 64 nt, Homo Sapiens; identical to SEQ ID NO: 153238

SEQ ID NO: 388375 - RNA, 64 nt, Homo Sapiens; identical to SEQ ID NO: 153239

SEQ ID NO: 388376 - RNA, 64 nt, Homo Sapiens; identical to SEQ ID NO: 153240

SEQ ID NO: 388377 - RNA, 64 nt, Homo Sapiens; identical to SEQ ID NO: 153241

SEQ ID NO: 388378 - RNA, 64 nt, Homo Sapiens; identical to SEQ ID NO: 153242

SEQ ID NO: 388379 - RNA, 64 nt, Homo Sapiens; identical to SEQ ID NO: 153243

SEQ ID NO: 388380 - RNA, 64 nt, Homo Sapiens; identical to SEQ ID NO: 153244

SEQ ID NO: 388381 - RNA, 64 nt, Homo Sapiens; identical to SEQ ID NO: 153245

SEQ ID NO: 388382 - RNA, 64 nt, Homo Sapiens; identical to SEQ ID NO: 153246

SEQ ID NO: 388383 - RNA, 64 nt, Homo Sapiens
ucauuagcugugugcauauaaaaagauuuucagcugaauggaacucaucuuuaaagcuuuuacu

SEQ ID NO: 388384 - RNA, 64 nt, Homo Sapiens
uucuuucacuucauuauauggauugagagguugaugaauggaaaguuuuucuuugaaaaccugg

SEQ ID NO: 388385 - RNA, 64 nt, Homo Sapiens
cccuauacaaagauuuuccaaaccuugagucaaaugaauggagcugaauacgguggaagucuau

SEQ ID NO: 388386 - RNA, 64 nt, Homo Sapiens
augaugggaaauaugacuucgauccaacuagaaaugaauggaagucaguuguguggaaauguau

SEQ ID NO: 388387 - RNA, 64 nt, Homo Sapiens
guuauacaucguugguggcuaggagugugugcucugaauggaaaagaacuaaccguuguaaugc

SEQ ID NO: 388388 - RNA, 64 nt, Homo Sapiens
auccgaaggcguauggcugaucugaccuccgagaugaauggaggcuuaaaggcugagcugcagg

SEQ ID NO: 388389 - RNA, 64 nt, Homo Sapiens
cuccggguugaauuccaguguaucccacugggagugaauggaucaugaggugggauggccccau

SEQ ID NO: 388390 - RNA, 64 nt, Homo Sapiens
uacagaugccauauaguguuaugagccaggcuguugaauggaauuucucaguagcagccuacaa

SEQ ID NO: 388391 - RNA, 64 nt, Homo Sapiens
uggaggguucagagaggagugaucgucagaugugugaauggacgguuuaggugaaaauaaucaa

SEQ ID NO: 388392 - RNA, 64 nt, Homo Sapiens
uucaaaacaggaucuaagauaaucgaauguaaugugaauggaauaaaaaaaaggcauucuagua

SEQ ID NO: 388393 - RNA, 64 nt, Homo Sapiens
cagaaaaaugugauuuguauaaacauccauagcaugaauggacucucuauguuuaugcauaaga

SEQ ID NO: 388394 - RNA, 64 nt, Homo Sapiens
uuuaaagucacugguacuauggacaacuccauagugaauggagauacuugcagagcuugucaug

SEQ ID NO: 388395 - RNA, 64 nt, Homo Sapiens
ucugucacauagcagcauuccgauucuauguaacugaauggagaugauaagugcuuuccccucu

SEQ ID NO: 388396 - RNA, 64 nt, Homo Sapiens
agacagggaggcugcagaagagaacauaguaucaugaauggaguuugaaaguaauuauaucuua

SEQ ID NO: 388397 - RNA, 64 nt, Homo Sapiens
uaaacauagcaauugucaagaauggaauguuaacugaauggaauccaauuuuuuaaacuaacaa

SEQ ID NO: 388398 - RNA, 64 nt, Homo Sapiens
gacauagggaagaaugggcuguugaagaaauaaaugaauggaaauaguaguaugaaaacuauuu

SEQ ID NO: 388399 - RNA, 64 nt, Homo Sapiens
acgccaguaaaaaaacaaaaccuauguaaauguuugaauggaggaagcacaaaagaaaucccua

SEQ ID NO: 388400 - RNA, 64 nt, Homo Sapiens
uuacaagaucugucuuuccagaugagcgcacggaugaauggagcucgguaaacacgaaugaaug

SEQ ID NO: 388401 - RNA, 64 nt, Homo Sapiens
agcgcacggaugaauggagcucgguaaacacgaaugaauggaugucccaacacugagcaggcac

SEQ ID NO: 388402 - RNA, 64 nt, Homo Sapiens
auacucauauuucuacauaggaugggauuuuaccugaauggagcgagagaaaaaucugacagga

SEQ ID NO: 388403 - RNA, 64 nt, Homo Sapiens
aucucauuaaaguuuauuuuagaagccucaucauugaauggagaaggucaucuucacccagagg

SEQ ID NO: 388404 - RNA, 64 nt, Homo Sapiens
ugcccgcacaguaauguagauucuugaaugggcaugaauggagauagugggaucaacaaugauu

SEQ ID NO: 388405 - RNA, 64 nt, Homo Sapiens
aagcucaggaauccuacgcugccaauggagaaaaugaauggacaggaagaaaggcuguggaagg

SEQ ID NO: 388406 - RNA, 64 nt, Homo Sapiens
gagauggccgcugugugcuggucacaggaaguguugaauggauuggcuugcaaaggggguaggu

SEQ ID NO: 388407 - RNA, 64 nt, Homo Sapiens
ggcggcagaguccagcccagcauaugacuugcccugaauggaagcugcugaaacgggugccuuu

SEQ ID NO: 388408 - RNA, 64 nt, Homo Sapiens
guuguucagauuuacuuugaaagaaucaaguaugugaauggauggaugaauggaauugugaagc

SEQ ID NO: 388409 - RNA, 64 nt, Homo Sapiens
uacuuugaaagaaucaaguaugugaauggauggaugaauggaauugugaagcacagaugagcuc

SEQ ID NO: 388410 - RNA, 64 nt, Homo Sapiens
uauaguguggcuuuagaauauaucaaguacaaccugaauggacuuuuugauuuuacauuuccua

SEQ ID NO: 388411 - RNA, 64 nt, Homo Sapiens
aagaggugauugggccaugaggucugugcccuccugaauggauuaauccauucauggauuaaug

SEQ ID NO: 388412 - RNA, 64 nt, Homo Sapiens; identical to SEQ ID NO: 171800

SEQ ID NO: 388413 - RNA, 64 nt, Homo Sapiens; identical to SEQ ID NO: 171801

SEQ ID NO: 388414 - RNA, 64 nt, Homo Sapiens; identical to SEQ ID NO: 171802

SEQ ID NO: 388415 - RNA, 64 nt, Homo Sapiens; identical to SEQ ID NO: 171803

SEQ ID NO: 388416 - RNA, 64 nt, Homo Sapiens; identical to SEQ ID NO: 171804

SEQ ID NO: 388417 - RNA, 64 nt, Homo Sapiens; identical to SEQ ID NO: 171805

SEQ ID NO: 388418 - RNA, 64 nt, Homo Sapiens; identical to SEQ ID NO: 171806

SEQ ID NO: 388419 - RNA, 64 nt, Homo Sapiens; identical to SEQ ID NO: 171807

SEQ ID NO: 388420 - RNA, 64 nt, Homo Sapiens; identical to SEQ ID NO: 171808

SEQ ID NO: 388421 - RNA, 64 nt, Homo Sapiens; identical to SEQ ID NO: 171809

SEQ ID NO: 388422 - RNA, 64 nt, Homo Sapiens; identical to SEQ ID NO: 171810

SEQ ID NO: 388423 - RNA, 64 nt, Homo Sapiens; identical to SEQ ID NO: 171811

SEQ ID NO: 388424 - RNA, 64 nt, Homo Sapiens; identical to SEQ ID NO: 171812

SEQ ID NO: 388425 - RNA, 64 nt, Homo Sapiens; identical to SEQ ID NO: 171813

SEQ ID NO: 388426 - RNA, 64 nt, Homo Sapiens; identical to SEQ ID NO: 171814

SEQ ID NO: 388427 - RNA, 64 nt, Homo Sapiens; identical to SEQ ID NO: 171815

SEQ ID NO: 388428 - RNA, 64 nt, Homo Sapiens; identical to SEQ ID NO: 171816

SEQ ID NO: 388429 - RNA, 64 nt, Homo Sapiens; identical to SEQ ID NO: 171817

SEQ ID NO: 388430 - RNA, 64 nt, Homo Sapiens; identical to SEQ ID NO: 171818

SEQ ID NO: 388431 - RNA, 64 nt, Homo Sapiens
cguucauuuaaacguauauuuagaacugcacuuuguccacaaccuucccuucucuuucuauucc

SEQ ID NO: 388432 - RNA, 64 nt, Homo Sapiens
gaagaacauggaugggaugcuggugguggaagcgguccacaaccucaaggcugucuucaagggg

SEQ ID NO: 388433 - RNA, 64 nt, Homo Sapiens
gucaauauaaaaauugguaaacuagaaguaacuuguccacaacccucaguuaugauacuuaugu

SEQ ID NO: 388434 - RNA, 64 nt, Homo Sapiens
guuccccgcugacccuugguuagggguccucuuaguccacaagguccggaugucacucauguac

SEQ ID NO: 388435 - RNA, 64 nt, Homo Sapiens
cugagaguuaggacaggucaggaagucccccaggguccacaaaggugccugaggcucugguaag

SEQ ID NO: 388436 - RNA, 64 nt, Homo Sapiens
guacaacuauuaagagauuuugaacauuaaguuaguccacaaauauucagugggcaucuacuag

SEQ ID NO: 388437 - RNA, 64 nt, Homo Sapiens
gguauaucuuguaguuuucauuuauuuucacacaguccacaagguucaaauacauaaagauaaa

SEQ ID NO: 388438 - RNA, 64 nt, Homo Sapiens
accuagagugcauccugcucagagcuccgugccuguccacaauguccuuugagcagugcucuca

SEQ ID NO: 388439 - RNA, 64 nt, Homo Sapiens
cacagauuugagcucagcccgggccuaugcagagguccacaacagccucagucucccucccuug

SEQ ID NO: 388440 - RNA, 64 nt, Homo Sapiens
ucaaacaaugguuugaaacaacuacuggaauauuguccacaauaagcuggaaguuuguuguagu

SEQ ID NO: 388441 - RNA, 64 nt, Homo Sapiens
uacagcacaauauuuauuuuaaagugaauaaaauguccacaagcaguguugucauguagucaau

SEQ ID NO: 388442 - RNA, 64 nt, Homo Sapiens
cuggagcagcucucgagaacuaccuguugguauuguccacaagcucucccgagcgccccaucuu

SEQ ID NO: 388443 - RNA, 57 nt, Homo Sapiens
cuuugcuccaaaaaaaauaguguuauuguccacaagauuguuuugguguuucucaag

SEQ ID NO: 388444 - RNA, 64 nt, Homo Sapiens
cauuucaaaugcccaaagcaacaguuugucuccaguccacaaucuuucaaaaaugccauuuaug

SEQ ID NO: 388445 - RNA, 64 nt, Homo Sapiens
ugagaaccacuaaguuggagugcugaugcuccugguccacaauguugaacaauuccccagauga

SEQ ID NO: 388446 - RNA, 64 nt, Homo Sapiens
auaugaaguacagcagaagcugccuccaccagauguccacaacaugaugagguuacaugcugcu

SEQ ID NO: 388447 - RNA, 64 nt, Homo Sapiens
ucaucgauuuucuuuaguaggcuguuuccagcucguccacaagcgcugugcucaccuucauggg

SEQ ID NO: 388448 - RNA, 64 nt, Homo Sapiens
aggugugcacuguucacugcgucgugccaaagagguccacaaccauaacaaagaagaagcaaug

SEQ ID NO: 388449 - RNA, 64 nt, Homo Sapiens
uuuaaaauauuucauaggcgagcuuuuugguagcguccacaaugaaaauuuuuauauaccaaug

SEQ ID NO: 388450 - RNA, 64 nt, Homo Sapiens
aaaaggaaaugcuccuccagaggaagaucccuuuguccacaagucaugcccauaccccuggcca

SEQ ID NO: 388451 - RNA, 64 nt, Homo Sapiens
uaauuuugugagcccagauagaggauggaauucuguccacaaaaaccauauaaagaauucuuuu

SEQ ID NO: 388452 - RNA, 64 nt, Homo Sapiens
ccuaccacuucugucuugggcugaaguugcccacguccacaaaaucuguacucccagcgggggu

SEQ ID NO: 388453 - RNA, 64 nt, Homo Sapiens
aaauucacaucaaagucaaacccacaaccaagucguccacaaauacuucacugccugaugauaa

SEQ ID NO: 388454 - RNA, 64 nt, Homo Sapiens
aaauuuaaaugagauaaugcaguugcaacuguguguccacaaguauggacaucaaaucuguggg

SEQ ID NO: 388455 - RNA, 64 nt, Homo Sapiens
aguuaauuuggaaugauaauuccagagauaaaguguccacaacaguuagggaaaugaugcuaga

SEQ ID NO: 388456 - RNA, 64 nt, Homo Sapiens
augccagugcccagaagcagugagauuagucuguguccacaagcagaggcccccucgaugggag

SEQ ID NO: 388457 - RNA, 64 nt, Homo Sapiens
uaggagaguggaugauagaugcaaaauaauaccuguccacaacaaacucuuaaugcuguguuug

SEQ ID NO: 388458 - RNA, 64 nt, Homo Sapiens
uacuguuuggauguagcauagucuugagucuagcguccacaaagaauuauucaaaugauauuua

SEQ ID NO: 388459 - RNA, 64 nt, Homo Sapiens
acucaggauggcaucaguuaaggcaggaacagguguccacaagauaggauagauugugggaccc

SEQ ID NO: 388460 - RNA, 64 nt, Homo Sapiens
acuuaguggcccacaauauacguuagcagcaucaguccacaaacacuagcuaacuccaagagau

SEQ ID NO: 388461 - RNA, 64 nt, Homo Sapiens
gcagauuuucuugcaguaaaacauucuucuuaaaguccacaacauccacucuaauggauagugu

SEQ ID NO: 388462 - RNA, 64 nt, Homo Sapiens
gaggggagaaaaggcgacgaucaggugagaaggcguccacaaaaucaucugugaagugguggug

SEQ ID NO: 388463 - RNA, 64 nt, Homo Sapiens
augccacuugcaugggagccacaugcagcucucuguccacaacccagcccccugaggcccagag

SEQ ID NO: 388464 - RNA, 64 nt, Homo Sapiens
acaaaugugaagaauauggcaaagccugugaaugguccacaaaccugaaugagcagaagaaaau

SEQ ID NO: 388465 - RNA, 64 nt, Homo Sapiens
uuaauauauaauacuuuaaauuuuaaaaauucuuguccacaaggaaauuugucuggguuauugg

SEQ ID NO: 388466 - RNA, 64 nt, Homo Sapiens
cguguaaaccaaagcccuaaaauuccacugcguuguccacaagacagaagcugaagugcaucca

SEQ ID NO: 388467 - RNA, 64 nt, Homo Sapiens
agaaugagguugacuaaugcauauuaugaauugaguccacaaaggaacacaaaacucuuuguaa

SEQ ID NO: 388468 - RNA, 64 nt, Homo Sapiens
uuugcaggaaggcagacgagacaguguuuaaaaaguccacaagaaugaucaaguaagauuuguu

SEQ ID NO: 388469 - RNA, 64 nt, Homo Sapiens
uaucuuuaccaacaucuugaauauauauucuaguguccacaagauuuagcaaaaagauaaagcu

SEQ ID NO: 388470 - RNA, 64 nt, Homo Sapiens
uacuguagcuacggaaccagauucuggugaauuuguccacaaucagccauuggccugucugggg

SEQ ID NO: 388471 - RNA, 64 nt, Homo Sapiens
aaauuaauaucugcucugaagaguuucuuuuucuguccacaaguuugugaccaguaccaaucuu

SEQ ID NO: 388472 - RNA, 64 nt, Homo Sapiens
uuaaacagaauacugugagccauugggauaaaugguccacaaucagauaaaguuugagugaguu

SEQ ID NO: 388473 - RNA, 64 nt, Homo Sapiens
ucacgggacguggccagacuaacugaaacauuuuguccacaacucacgcacagaggugaacaga

SEQ ID NO: 388474 - RNA, 64 nt, Homo Sapiens
uuuuuucccagcccaaauucuccucucuaaaaguguccacaagaagggguguuuauucuuccaa

SEQ ID NO: 388475 - RNA, 64 nt, Homo Sapiens
ucaucuguugggaaccugugauauaccuccauuuguccacaagaugguguuuaaaacaauuugu

SEQ ID NO: 388476 - RNA, 64 nt, Homo Sapiens
uuaauauaagcuuuuaagcaguuaucuaacuaguguccacaacccuguaaccauacuuccacau

SEQ ID NO: 388477 - RNA, 64 nt, Homo Sapiens
agaugggcauaauaccaagcguaagaucagauucguccacaaagcagguuaaugacuccagaga

SEQ ID NO: 388478 - RNA, 64 nt, Homo Sapiens
augucauuuuaaaaucugaaggaaagaauuugaaguccacaaaaaguguuugagguucuuuggu

SEQ ID NO: 388479 - RNA, 64 nt, Homo Sapiens
aaaaaauagagaugagacuuuuugugucaacucuguccacaagagugaguuaucuaguaugauu

SEQ ID NO: 388480 - RNA, 64 nt, Homo Sapiens
acuguacuuggagaaaucguguuuuaaagcaguaguccacaaaguauucugcucaugugccccc

SEQ ID NO: 388481 - RNA, 64 nt, Homo Sapiens
uggugagaccacuaaauuuucuuugagggcccaaguccacaauuaaagaaaauugauaagaaaa

SEQ ID NO: 388482 - RNA, 64 nt, Homo Sapiens
auauuuggaagcaaaugauauuuccucuugcaguguccacaaaucugaauauuaggggcaugaa

SEQ ID NO: 388483 - RNA, 64 nt, Homo Sapiens
gauuuggcaggaaauaaggcgauuaacccuauguguccacaagccucaagccuuguuucagguc

SEQ ID NO: 388484 - RNA, 64 nt, Homo Sapiens
cccacauuauagauaaagcugcuuaaacuuaaaaguccacaaagcuacgccgaccagaaaaaaa

SEQ ID NO: 388485 - RNA, 64 nt, Homo Sapiens
guggaccucccuaucaugcuccaucaagguuugaguccacaaaaguugugacugcucaacaucc

SEQ ID NO: 388486 - RNA, 64 nt, Homo Sapiens
uuaaucacuuguagggaaccaaaaaaaaaaaaaaguccacaaaucuggucuugaccaaaauaga

SEQ ID NO: 388487 - RNA, 64 nt, Homo Sapiens
gcaaaguaaagggguggaauugcacgggaguuguguccacaaaggagccccguggagcgcggcc

SEQ ID NO: 388488 - RNA, 64 nt, Homo Sapiens
ugcuugcacauugccugucccagagccccuguggguccacaagccccuguccucuuccuucaua

SEQ ID NO: 388489 - RNA, 64 nt, Homo Sapiens
cugcugcugguccucaguaccagcgcccggggguguccacaaccacuugggacagaagaaggug

SEQ ID NO: 388490 - RNA, 64 nt, Homo Sapiens
uggagaaggaacuuuauguucccucuccugcuguguccacaaccuuagaaaucuguagcuagau

SEQ ID NO: 388491 - RNA, 64 nt, Homo Sapiens
uaaccaauccuggacaugaaguuuuuaaaacccaguccacaaaagcauucacaacuuguuuuug

SEQ ID NO: 388492 - RNA, 64 nt, Homo Sapiens
caacuccagaagaaagaagcuugucucaaauccuguccacaaggccagagaaaccuggccuggg

SEQ ID NO: 388493 - RNA, 64 nt, Homo Sapiens
acauccacuucccccgcagcucgugugggcgcucguccacaaacacuccguggcugagaggcag

SEQ ID NO: 388494 - RNA, 64 nt, Homo Sapiens
uuaaugugggaauugauacacaagaagguacuuaguccacaagaucaggauguacaagauaacc

SEQ ID NO: 388495 - RNA, 64 nt, Homo Sapiens
gccagggagcugggagcgagcaagcugaggccacguccacaaggagcuuuucaugccccugugc

SEQ ID NO: 388496 - RNA, 64 nt, Homo Sapiens
uagcagcauccuugggggaagggaaaggugcaugguccacaauguaugguuuggucccauggga

SEQ ID NO: 388497 - RNA, 64 nt, Homo Sapiens
ucccaaauguauucuacuuguucuaaaacaaucuguccacaaauauaaaacuauaaguaauaaa

SEQ ID NO: 388498 - RNA, 64 nt, Homo Sapiens
acuauggcccccggcucaaggccucgccguccuuguccacaagcgcugcugcuggcucuccuug

SEQ ID NO: 388499 - RNA, 64 nt, Homo Sapiens
ccuuccaauuauauuucccaauauaucuuuaucaguccacaagucuacugacugcacaucuuaa

SEQ ID NO: 388500 - RNA, 64 nt, Homo Sapiens
guccucagagggucccuagguacucuccaggauuguccacaaaugcccaccugggcccuaggca

SEQ ID NO: 388501 - RNA, 64 nt, Homo Sapiens
uggcugggucuucagaccccaaauacugaguuguguccacaacauugucuccugguacccaaag

SEQ ID NO: 388502 - RNA, 64 nt, Homo Sapiens
aaguugagaaaacaccaagccuuacccuucuccuguccacaauaauaaaaaaccuucaagucua

SEQ ID NO: 388503 - RNA, 64 nt, Homo Sapiens
acaggaacuggguuaauaauaguaagaaucugauguccacaagaaaccaaagacauuuaagcau

SEQ ID NO: 388504 - RNA, 64 nt, Homo Sapiens
uguuucugcaucccagggcuuccgacacgacgagguccacaaacuguuugggcuggcaagcaaa

SEQ ID NO: 388505 - RNA, 64 nt, Homo Sapiens
uuauaucagucacuugccacucccccacccuccuguccacaacuccuuuccacuuuaggccaau

SEQ ID NO: 388506 - RNA, 64 nt, Homo Sapiens
ucuguaggcuucugggaggucccuuuucagggguguccacaaagucaaagcuauuuucauaaua

SEQ ID NO: 388507 - RNA, 64 nt, Homo Sapiens
uuugaaacuucuguccucuuuggaugagaucaguguccacaaguggccgacauggaacaugcug

SEQ ID NO: 388508 - RNA, 64 nt, Homo Sapiens
gaauagaagaaaaucccauuaggugaggguagcaguccacaaugaaccauaucugcuuuauccu

SEQ ID NO: 388509 - RNA, 64 nt, Homo Sapiens
acauaaauggaaagaugaagaugugaaacugggaguccacaaagauuauggccuauugaacaaa

SEQ ID NO: 388510 - RNA, 64 nt, Homo Sapiens
caguaauuggucacuuguuauucuaugaaaaaauguccacaacauuuaguuuacaguauaugga

SEQ ID NO: 388511 - RNA, 64 nt, Homo Sapiens
cuaacuuauucacucucuggucagagaguauaugguccacaagcgugagaguugaauaguugca

SEQ ID NO: 388512 - RNA, 64 nt, Homo Sapiens
uggaaagucgcggugaaugcgugcaugucucaauguccacaaaggauucuggcuacccuuuggu

SEQ ID NO: 388513 - RNA, 64 nt, Homo Sapiens
ccuaacaucaugcauucacaaggucaaaguucugguccacaaacccuucccuauagaaguucaa

SEQ ID NO: 388514 - RNA, 64 nt, Homo Sapiens
ugaauuaaauacaguugucuugaggguaugauaaguccacaaaaaauuggaaagcaucuuaccc

SEQ ID NO: 388515 - RNA, 64 nt, Homo Sapiens
ugaauccuacaguuuccaggcuuuagcagacagcguccacaaugaauggucuuaauggugcuca

SEQ ID NO: 388516 - RNA, 64 nt, Homo Sapiens
gucaauccuaauuguggucccguuucaucaccucguccacaauaaaaucucaccuuuggggcug

SEQ ID NO: 388517 - RNA, 64 nt, Homo Sapiens
gcuuucaagcgcuuggcagaaucuuguacuucguguccacaaugguacugaauuugcaucugca

SEQ ID NO: 388518 - RNA, 64 nt, Homo Sapiens
guggguguuguugcccuggguggccuguggcuccguccacaagucaugcugaguuuugcagccu

SEQ ID NO: 388519 - RNA, 64 nt, Homo Sapiens
uucuguccugcccccaaggaggucccuccaagugguccacaagcgugucuagaggcagguaggg

SEQ ID NO: 388520 - RNA, 64 nt, Homo Sapiens
acggaugguucucaagaguuaccuuagagccauuguccacaaucaaagaacagaaguuguuugg

SEQ ID NO: 388521 - RNA, 64 nt, Homo Sapiens
aauuucccuggacgcuaauuuccgucuguccuuuguccacaaggccagagggaugacuuccagu

SEQ ID NO: 388522 - RNA, 64 nt, Homo Sapiens
agucauggcaauaaugguguaguuaugugaaacuguccacaaaaccgagcagccuggacuuuac

SEQ ID NO: 388523 - RNA, 64 nt, Homo Sapiens
cagaccccuccacacaaaccgaugacaguucuguguccacaaccauggugggcaccaucucucu

SEQ ID NO: 388524 - RNA, 64 nt, Homo Sapiens
augaaaguagugguuuuuaauccacgugggacuuguccacaagagucguuuuuuuggcaauucu

SEQ ID NO: 388525 - RNA, 64 nt, Homo Sapiens
gaucucugcccacggaaaggauuuaauccaaaugguccacaagaggaaugugcuuaauuccuac

SEQ ID NO: 388526 - RNA, 64 nt, Homo Sapiens
uaaccauuuuuuuuaaguuugacuacauagucaaguccacaagccaucaagcacuccuaccuua

SEQ ID NO: 388527 - RNA, 64 nt, Homo Sapiens
gucacagucugaggugcuggugcaaggaucuuauguccacaaaauaaucuuaacuaauuacauu

SEQ ID NO: 388528 - RNA, 64 nt, Homo Sapiens
aauaccucucguuccagcagacugccugguuggcguccacaagcaccuaaacuauuccugcaga

SEQ ID NO: 388529 - RNA, 64 nt, Homo Sapiens
auguaauccaaaucuauuuuacuguaucguagccguccacaaagccugagauaaugguuuccaa

SEQ ID NO: 388530 - RNA, 64 nt, Homo Sapiens
agucccaggugggacucuucuggggacacuugggguccacaaucccagguccauacucuagguu

SEQ ID NO: 388531 - RNA, 64 nt, Homo Sapiens
ugcaggcuggaaacaugcaggagcugucccugaaguccacaaguggaauuucuucuucaucaug

SEQ ID NO: 388532 - RNA, 64 nt, Homo Sapiens
ccagggacucucagcaaacacgggacuguguucaguccacaaaggaaaagcguuuuugaagcuc

SEQ ID NO: 388533 - RNA, 64 nt, Homo Sapiens
auggcuucagagagguggucuuccuacaucauuuguccacaaagcaagccugcauuuuuuugag

SEQ ID NO: 388534 - RNA, 64 nt, Homo Sapiens
cuucaguauuuucuccacuucuugacuguuaguuguccacaaaucaggcuagacagaaacaugu

SEQ ID NO: 388535 - RNA, 64 nt, Homo Sapiens
gaaauacugucacaguagacuuaaagcuacuuuuguccacaaauaaauuuuccagauacuugcu

SEQ ID NO: 388536 - RNA, 64 nt, Homo Sapiens
ggcuuuucccaccuucaccuguuucaccguccacguccacaaggcugcccgaggcgccagcuca

SEQ ID NO: 388537 - RNA, 64 nt, Homo Sapiens
aauggggacuuucuaccagaccaaggcugaguagguccacaaaucuguugggaccagccacuca

SEQ ID NO: 388538 - RNA, 64 nt, Homo Sapiens
uuguagucuuuaaauucuuggucccugaggccaaguccacaacuugccuucuagucacuugccu

SEQ ID NO: 388539 - RNA, 64 nt, Homo Sapiens
cagugcucccugggucauaccaggaucugccucuguccacaaagaugagggaaaaugaugacug

SEQ ID NO: 388540 - RNA, 64 nt, Homo Sapiens
cauuuucauuucuaauggcccaccguccucagcaguccacaaaggcugggaaaccucacccuug

SEQ ID NO: 388541 - RNA, 64 nt, Homo Sapiens
cuguccaggaguugugucuuuauuccccagauguguccacaaaccuggcugcaaaggagguuca

SEQ ID NO: 388542 - RNA, 64 nt, Homo Sapiens
gcagccgggcccucugccuauccacacacucccuguccacaacucccuguccacacacucccug

SEQ ID NO: 388543 - RNA, 64 nt, Homo Sapiens
cuccauucacucccaggugagaauucaggcaaacguccacaaaggucacaggcagcguacauac

SEQ ID NO: 388544 - RNA, 64 nt, Homo Sapiens
gcuaauacccuacagauggggccugaaaugugauguccacaagaauaccacaacagcagcaggg

SEQ ID NO: 388545 - RNA, 64 nt, Homo Sapiens
uucauacuauguguuugcagaaaaccauucacagguccacaauauuaggggaagugagauuuaa

SEQ ID NO: 388546 - RNA, 64 nt, Homo Sapiens
cccugagguagggaaugugucagauguuggcugcuguacuuacuuuucccagcagcucugagac

SEQ ID NO: 388547 - RNA, 64 nt, Homo Sapiens
acaguauuuugcacuugauuccuuauucauucucuguacuuaccacucuucacuuuccuuucca

SEQ ID NO: 388548 - RNA, 64 nt, Homo Sapiens
aacaucuguaucuguaaacaugaaucaccguguguguacuuacagggcuaggauuucaguguug

SEQ ID NO: 388549 - RNA, 64 nt, Homo Sapiens
agugcaaucuuuauuuauuguaaaauuuuuuaaguguacuuauguacuaauuuucccuuguagc

SEQ ID NO: 388550 - RNA, 64 nt, Homo Sapiens
aguuguacuguguauguguuaucugauugagcaguguacuuacacuguucuugauccagaugaa

SEQ ID NO: 388551 - RNA, 64 nt, Homo Sapiens
agauaccuguguagugucgagcaaaauauuacuauguacuuaagauuuuuuaguccaauaauua

SEQ ID NO: 388552 - RNA, 64 nt, Homo Sapiens
acuguuuugauuuuauuucuuugguggauauauauguacuuauacacuuaguuaacaugcagau

SEQ ID NO: 388553 - RNA, 64 nt, Homo Sapiens
aaacuacacaaugucuaaacucuauguugcucaguguacuuaaaauuuuacaguuauauuugua

SEQ ID NO: 388554 - RNA, 64 nt, Homo Sapiens
ccuuucaugaaaagggauuugugaaaugucaucuuguacuuacagauucuuuuuuuaaaaaaau

SEQ ID NO: 388555 - RNA, 64 nt, Homo Sapiens
cacuaaccaaugacaguauugaaaagucaacucauguacuuaaaagguggggugugagagagga

SEQ ID NO: 388556 - RNA, 64 nt, Homo Sapiens
augauaggaaauauaaugugaugaaguacuuaaauguacuuacucagcuuugucuuuuuuaaau

SEQ ID NO: 388557 - RNA, 64 nt, Homo Sapiens
gguuuguuuguuuguuuuuguguuuuggaacuacuguacuuaaaauuucauaacuuuagcagug

SEQ ID NO: 388558 - RNA, 64 nt, Homo Sapiens
auauguguggagaccuacuguugcaaaguaccuguguacuuaaaaggccuugugcauuucaagu

SEQ ID NO: 388559 - RNA, 64 nt, Homo Sapiens
uggaauacuauuuuauauagauuuugcuauaaaauguacuuauuagucuuaggaaaaaugcaua

SEQ ID NO: 388560 - RNA, 64 nt, Homo Sapiens
uucuuuguauuacuuagguuucuuaauuaaagguaauccuuacuuuucuuuguauuacuuaggu

SEQ ID NO: 388561 - RNA, 64 nt, Homo Sapiens
uucuuuguauuacuuagguuuauugauuaaagguaauccuuacuuccaaaaguuuaucuuuguu

SEQ ID NO: 388562 - RNA, 64 nt, Homo Sapiens
auauuugcacaauuuuauagcauuggugggucucaauccuuaacagcgaaauauuacaguagug

SEQ ID NO: 388563 - RNA, 64 nt, Homo Sapiens
uauauaucaguuauaauuaugccuuuuuuuaguaaauccuuauuuuaaaauaucaccccuugaa

SEQ ID NO: 388564 - RNA, 64 nt, Homo Sapiens
gucaacacacuuaaacuacacaugcauauaaaaaaauccuuaauaaauuguaauaacugugaua

SEQ ID NO: 388565 - RNA, 64 nt, Homo Sapiens
caaaaaucauguuaucaaaaguagggcaaacacaaauccuuaaauuguugcacuuucagccugu

SEQ ID NO: 388566 - RNA, 64 nt, Homo Sapiens
aauauucauaaauuuuaauuuaacuuucuuuuauaauccuuaaugugaggcuaagguauaagga

SEQ ID NO: 388567 - RNA, 64 nt, Homo Sapiens
auuaaugcaaaucuaagccuucauagacuuuuccaauccuuaguuaaauauuaaaaacugagua

SEQ ID NO: 388568 - RNA, 64 nt, Homo Sapiens
guacggacaaaagcaaauugaccauaacuggcaaaauccuuaguuccaccuuaauccuuaaagg

SEQ ID NO: 388569 - RNA, 64 nt, Homo Sapiens
ggaccauaacuggcaaaaucggaaucuccaccuuaauccuuaaagaaauccccuucuuuggcug

SEQ ID NO: 388570 - RNA, 64 nt, Homo Sapiens
ucuuguaaaaagcugagacaguuuguaagaaaagaauccuuaaaaucuagauuuauaccauuuu

SEQ ID NO: 388571 - RNA, 64 nt, Homo Sapiens
cccaccuuucaauguuuaauaaaacaaaaagagaaauccuuaaucuaaaagcuaaauuauuuuu

SEQ ID NO: 388572 - RNA, 64 nt, Homo Sapiens
cugggaagccagccuucugaacuuuuugguacuaaauccuuauuggaaccaagacaaaggaagc

SEQ ID NO: 388573 - RNA, 64 nt, Homo Sapiens
aucucugaacuaccuuuguauccaacauguuuuaaauccuuaaaugaauugcuuucucccaaaa

SEQ ID NO: 388574 - RNA, 64 nt, Homo Sapiens
gucaauucugugccuaggauauuauaaaugcauuaauccuuauaucugugggauuuagggaagc

SEQ ID NO: 388575 - RNA, 64 nt, Homo Sapiens
uccagcaaaauccaaacugcugcucaagcagcaaaauccuuacuaauuacuccaaaaagacaag

SEQ ID NO: 388576 - RNA, 64 nt, Homo Sapiens
aaaauuuggauuuaauuuuaaguauguaaccugaaauccuuaauauuccauucuagaaauuuga

SEQ ID NO: 388577 - RNA, 64 nt, Homo Sapiens
caauuauaauagcuuuuuuuaacuuacuacuggaaauccuuaaccauuccucuccugagauuuu

SEQ ID NO: 388578 - RNA, 64 nt, Homo Sapiens
uuuaaaaaaagcuucuagucugcuuuggauaagaaauccuuaccacuuuuucaacuuuuugcuu

SEQ ID NO: 388579 - RNA, 64 nt, Homo Sapiens
uaaccauucaaguaaucaacaaggccaaccuuggaauccuuauuauccaggucucagaggucuc

SEQ ID NO: 388580 - RNA, 64 nt, Homo Sapiens
caguugguggcagugguuggaggcuguuuagggaaauccuuauucugguuagucucucaaauug

SEQ ID NO: 388581 - RNA, 64 nt, Homo Sapiens
guaggaaaucauuguuguauggucaguaaagaccaauccuuacuuuuuaagcccuaucucaguu

SEQ ID NO: 388582 - RNA, 64 nt, Homo Sapiens
uuggaauaaggauuugguccuguuuucuggaccaaauccuuacucuggcucugcuuacacuuuc

SEQ ID NO: 388583 - RNA, 64 nt, Homo Sapiens
cucuggcucugcuuacacuuucucuccaucaccaaauccuuacuccaaauccagaagucagagc

SEQ ID NO: 388584 - RNA, 64 nt, Homo Sapiens
ccugguuaaucacuaugcaugcagaacaugggagaauccuuauugaucuguuugcucuuaacag

SEQ ID NO: 388585 - RNA, 64 nt, Homo Sapiens
ugucugauuaggcaucacuuaggaucaaguucagaauccuuaaaacuacauauugugaagagac

SEQ ID NO: 388586 - RNA, 64 nt, Homo Sapiens
uucuccccauuuuguuuuuuauaucaaagucuagaauccuuaacauguagagaaccugagacac

SEQ ID NO: 388587 - RNA, 64 nt, Homo Sapiens
aauuacccaauccaacuuucgaaguaaacacauaaauccuuauaaucauaguauuuuagaacua

SEQ ID NO: 388588 - RNA, 64 nt, Homo Sapiens
uggggauuaucugucauucaaggaaaaaugauccaguggacacuucauuuguguggaaagucag

SEQ ID NO: 388589 - RNA, 64 nt, Homo Sapiens
aucaggugggaaaguggaguagcaggggcuggggaguggacagcguggguccgcgcugcucugc

SEQ ID NO: 388590 - RNA, 64 nt, Homo Sapiens
uccucacugcugucaacgaugaugugagucgaagaguggacaaacagggaacaaagaaacagau

SEQ ID NO: 388591 - RNA, 64 nt, Homo Sapiens
gauguccucagggcuggcagaugcaguagacugcaguggacaguccccaccuuguuacugcuac

SEQ ID NO: 388592 - RNA, 64 nt, Homo Sapiens
gaacuugcagaacucccucggagacgcagguugcaguggacauugggauuguugcuugaaaaau

SEQ ID NO: 388593 - RNA, 64 nt, Homo Sapiens
gguaugacuggacagacuuugaauauacucuaaaaguggacagaaaauuuacgaaaaucuuaga

SEQ ID NO: 388594 - RNA, 64 nt, Homo Sapiens
aagccuguggcuacggggugcagggaucuaaguuaguggacagcuauguucuuucucaagugcu

SEQ ID NO: 388595 - RNA, 64 nt, Homo Sapiens
auucuugcccuaagagacacgguccauugcuggcaguggacauuguaguuggaucugggugucu

SEQ ID NO: 388596 - RNA, 64 nt, Homo Sapiens
cccaggcccugucuucuggaaagcauuacugggaaguggacacuaggaauugcagccacugggc

SEQ ID NO: 388597 - RNA, 64 nt, Homo Sapiens
ugaaccuugaggagggaaagcuugccuucuauucaguggacaaucaggagaagcuucuguauga

SEQ ID NO: 388598 - RNA, 64 nt, Homo Sapiens
cuuuugcucuuacgaacauaagaauuuuggccuucugcacuacuguuuugaaacuuuaguacuu

SEQ ID NO: 388599 - RNA, 64 nt, Homo Sapiens
auuucuguaaggaguaauuugaagagaguaacaacugcacuaggauggcccacaccaaaacgcu

SEQ ID NO: 388600 - RNA, 64 nt, Homo Sapiens
gcuuaaaaucacccaaauuucaguucuuuaccuacugcacuaacaauggcaagggggguauucu

SEQ ID NO: 388601 - RNA, 64 nt, Homo Sapiens
auuggaauauuguuuuucuagaggacauucauaucugcacuauuaucugaugacauguugguaa

SEQ ID NO: 388602 - RNA, 64 nt, Homo Sapiens
uguuucaacacaaaaucucuguuuugugagaauacugcacuauggaauaauugacaaauugaaa

SEQ ID NO: 388603 - RNA, 64 nt, Homo Sapiens
gacaaagugaaaaagaaauuauauucagauaggacugcacuacauuauuugucacacauggauc

SEQ ID NO: 388604 - RNA, 64 nt, Homo Sapiens
ggccguggaagcuugaccagaguucacccuuagccugcacuaaggucuguuggagcaaaggcac

SEQ ID NO: 388605 - RNA, 64 nt, Homo Sapiens
ccagggaguaggggacccuugcugagggcaaggacugcacuaguccacccaucucuggucuggg

SEQ ID NO: 388606 - RNA, 64 nt, Homo Sapiens
uuggagaaguuagugucagacuaacuuguggagucugcacuaaccugcacuaacuuggacugca

SEQ ID NO: 388607 - RNA, 64 nt, Homo Sapiens
uuguggagucugcacuaacuugcacuaacuuggacugcacuaaccugcacuaacuaacuugcac

SEQ ID NO: 388608 - RNA, 64 nt, Homo Sapiens
uuggacugcacuaacuugugcuaacuaacuugcacugcacuaaccugcacuaauuuagacugca

SEQ ID NO: 388609 - RNA, 64 nt, Homo Sapiens
uaacuugcacugcacuaacuugcacuaauuuagacugcacuaacgccccuuaacuuguggaguc

SEQ ID NO: 388610 - RNA, 64 nt, Homo Sapiens
uuagacugcacuaacuaacuuuaacuuguggagucugcacuaaugaagucuuggacugagcccc

SEQ ID NO: 388611 - RNA, 64 nt, Homo Sapiens; identical to SEQ ID NO: 267277

SEQ ID NO: 388612 - RNA, 64 nt, Homo Sapiens; identical to SEQ ID NO: 267278

SEQ ID NO: 388613 - RNA, 64 nt, Homo Sapiens; identical to SEQ ID NO: 267279

SEQ ID NO: 388614 - RNA, 64 nt, Homo Sapiens; identical to SEQ ID NO: 267280

SEQ ID NO: 388615 - RNA, 64 nt, Homo Sapiens; identical to SEQ ID NO: 267281

SEQ ID NO: 388616 - RNA, 64 nt, Homo Sapiens; identical to SEQ ID NO: 267282

SEQ ID NO: 388617 - RNA, 64 nt, Homo Sapiens; identical to SEQ ID NO: 267283

SEQ ID NO: 388618 - RNA, 64 nt, Homo Sapiens; identical to SEQ ID NO: 267284

SEQ ID NO: 388619 - RNA, 64 nt, Homo Sapiens; identical to SEQ ID NO: 267285

SEQ ID NO: 388620 - RNA, 64 nt, Homo Sapiens; identical to SEQ ID NO: 267286

SEQ ID NO: 388621 - RNA, 64 nt, Homo Sapiens; identical to SEQ ID NO: 267287

SEQ ID NO: 388622 - RNA, 64 nt, Homo Sapiens; identical to SEQ ID NO: 267288

SEQ ID NO: 388623 - RNA, 64 nt, Homo Sapiens; identical to SEQ ID NO: 267289

SEQ ID NO: 388624 - RNA, 64 nt, Homo Sapiens; identical to SEQ ID NO: 267290

SEQ ID NO: 388625 - RNA, 64 nt, Homo Sapiens; identical to SEQ ID NO: 267291

SEQ ID NO: 388626 - RNA, 64 nt, Homo Sapiens; identical to SEQ ID NO: 267292

SEQ ID NO: 388627 - RNA, 64 nt, Homo Sapiens; identical to SEQ ID NO: 267293

SEQ ID NO: 388628 - RNA, 64 nt, Homo Sapiens; identical to SEQ ID NO: 267294

SEQ ID NO: 388629 - RNA, 64 nt, Homo Sapiens; identical to SEQ ID NO: 267295

SEQ ID NO: 388630 - RNA, 64 nt, Homo Sapiens; identical to SEQ ID NO: 267296

SEQ ID NO: 388631 - RNA, 64 nt, Homo Sapiens; identical to SEQ ID NO: 267297

SEQ ID NO: 388632 - RNA, 64 nt, Homo Sapiens; identical to SEQ ID NO: 267298

SEQ ID NO: 388633 - RNA, 64 nt, Homo Sapiens; identical to SEQ ID NO: 267299

SEQ ID NO: 388634 - RNA, 64 nt, Homo Sapiens; identical to SEQ ID NO: 267300

SEQ ID NO: 388635 - RNA, 64 nt, Homo Sapiens; identical to SEQ ID NO: 267301

SEQ ID NO: 388636 - RNA, 64 nt, Homo Sapiens; identical to SEQ ID NO: 267302

SEQ ID NO: 388637 - RNA, 64 nt, Homo Sapiens; identical to SEQ ID NO: 267303

SEQ ID NO: 388638 - RNA, 64 nt, Homo Sapiens; identical to SEQ ID NO: 267304

SEQ ID NO: 388639 - RNA, 64 nt, Homo Sapiens; identical to SEQ ID NO: 267305

SEQ ID NO: 388640 - RNA, 64 nt, Homo Sapiens; identical to SEQ ID NO: 267306

SEQ ID NO: 388641 - RNA, 64 nt, Homo Sapiens; identical to SEQ ID NO: 376674

SEQ ID NO: 388642 - RNA, 64 nt, Homo Sapiens; identical to SEQ ID NO: 376675

SEQ ID NO: 388643 - RNA, 64 nt, Homo Sapiens; identical to SEQ ID NO: 376676

SEQ ID NO: 388644 - RNA, 64 nt, Homo Sapiens; identical to SEQ ID NO: 376677

SEQ ID NO: 388645 - RNA, 64 nt, Homo Sapiens; identical to SEQ ID NO: 376678

SEQ ID NO: 388646 - RNA, 64 nt, Homo Sapiens; identical to SEQ ID NO: 376679

SEQ ID NO: 388647 - RNA, 64 nt, Homo Sapiens; identical to SEQ ID NO: 376680

SEQ ID NO: 388648 - RNA, 64 nt, Homo Sapiens; identical to SEQ ID NO: 376681

SEQ ID NO: 388649 - RNA, 64 nt, Homo Sapiens; identical to SEQ ID NO: 376682

SEQ ID NO: 388650 - RNA, 64 nt, Homo Sapiens; identical to SEQ ID NO: 376683

SEQ ID NO: 388651 - RNA, 64 nt, Homo Sapiens; identical to SEQ ID NO: 376684

SEQ ID NO: 388652 - RNA, 64 nt, Homo Sapiens; identical to SEQ ID NO: 376685

SEQ ID NO: 388653 - RNA, 64 nt, Homo Sapiens; identical to SEQ ID NO: 376686

SEQ ID NO: 388654 - RNA, 64 nt, Homo Sapiens; identical to SEQ ID NO: 376687

SEQ ID NO: 388655 - RNA, 64 nt, Homo Sapiens; identical to SEQ ID NO: 376688

SEQ ID NO: 388656 - RNA, 64 nt, Homo Sapiens; identical to SEQ ID NO: 376689

SEQ ID NO: 388657 - RNA, 64 nt, Homo Sapiens; identical to SEQ ID NO: 376690

SEQ ID NO: 388658 - RNA, 64 nt, Homo Sapiens; identical to SEQ ID NO: 376691

SEQ ID NO: 388659 - RNA, 64 nt, Homo Sapiens; identical to SEQ ID NO: 376692

SEQ ID NO: 388660 - RNA, 64 nt, Homo Sapiens; identical to SEQ ID NO: 376693

SEQ ID NO: 388661 - RNA, 64 nt, Homo Sapiens; identical to SEQ ID NO: 376694

SEQ ID NO: 388662 - RNA, 64 nt, Homo Sapiens; identical to SEQ ID NO: 376695

SEQ ID NO: 388663 - RNA, 64 nt, Homo Sapiens; identical to SEQ ID NO: 376696

SEQ ID NO: 388664 - RNA, 64 nt, Homo Sapiens; identical to SEQ ID NO: 376697

SEQ ID NO: 388665 - RNA, 64 nt, Homo Sapiens; identical to SEQ ID NO: 376698

SEQ ID NO: 388666 - RNA, 64 nt, Homo Sapiens; identical to SEQ ID NO: 376699

SEQ ID NO: 388667 - RNA, 64 nt, Homo Sapiens; identical to SEQ ID NO: 376700

SEQ ID NO: 388668 - RNA, 64 nt, Homo Sapiens; identical to SEQ ID NO: 376701

SEQ ID NO: 388669 - RNA, 64 nt, Homo Sapiens; identical to SEQ ID NO: 376702

SEQ ID NO: 388670 - RNA, 64 nt, Homo Sapiens; identical to SEQ ID NO: 376703

SEQ ID NO: 388671 - RNA, 64 nt, Homo Sapiens; identical to SEQ ID NO: 376704

SEQ ID NO: 388672 - RNA, 64 nt, Homo Sapiens; identical to SEQ ID NO: 376705

SEQ ID NO: 388673 - RNA, 64 nt, Homo Sapiens; identical to SEQ ID NO: 376706

SEQ ID NO: 388674 - RNA, 64 nt, Homo Sapiens; identical to SEQ ID NO: 376707

SEQ ID NO: 388675 - RNA, 64 nt, Homo Sapiens; identical to SEQ ID NO: 376708

SEQ ID NO: 388676 - RNA, 64 nt, Homo Sapiens; identical to SEQ ID NO: 376709

SEQ ID NO: 388677 - RNA, 64 nt, Homo Sapiens; identical to SEQ ID NO: 376710

SEQ ID NO: 388678 - RNA, 64 nt, Homo Sapiens; identical to SEQ ID NO: 376711

SEQ ID NO: 388679 - RNA, 64 nt, Homo Sapiens; identical to SEQ ID NO: 376712

SEQ ID NO: 388680 - RNA, 64 nt, Homo Sapiens; identical to SEQ ID NO: 376713

SEQ ID NO: 388681 - RNA, 64 nt, Homo Sapiens; identical to SEQ ID NO: 376714

SEQ ID NO: 388682 - RNA, 64 nt, Homo Sapiens; identical to SEQ ID NO: 376715

SEQ ID NO: 388683 - RNA, 64 nt, Homo Sapiens; identical to SEQ ID NO: 376716

SEQ ID NO: 388684 - RNA, 64 nt, Homo Sapiens; identical to SEQ ID NO: 376717

SEQ ID NO: 388685 - RNA, 64 nt, Homo Sapiens; identical to SEQ ID NO: 376718

SEQ ID NO: 388686 - RNA, 64 nt, Homo Sapiens; identical to SEQ ID NO: 376719

SEQ ID NO: 388687 - RNA, 64 nt, Homo Sapiens; identical to SEQ ID NO: 376720

SEQ ID NO: 388688 - RNA, 64 nt, Homo Sapiens; identical to SEQ ID NO: 376721

SEQ ID NO: 388689 - RNA, 64 nt, Homo Sapiens; identical to SEQ ID NO: 376722

SEQ ID NO: 388690 - RNA, 64 nt, Homo Sapiens; identical to SEQ ID NO: 376723

SEQ ID NO: 388691 - RNA, 64 nt, Homo Sapiens; identical to SEQ ID NO: 376724

SEQ ID NO: 388692 - RNA, 64 nt, Homo Sapiens; identical to SEQ ID NO: 376725

SEQ ID NO: 388693 - RNA, 64 nt, Homo Sapiens; identical to SEQ ID NO: 376726

SEQ ID NO: 388694 - RNA, 64 nt, Homo Sapiens; identical to SEQ ID NO: 376727

SEQ ID NO: 388695 - RNA, 64 nt, Homo Sapiens; identical to SEQ ID NO: 376728

SEQ ID NO: 388696 - RNA, 64 nt, Homo Sapiens; identical to SEQ ID NO: 376729

SEQ ID NO: 388697 - RNA, 64 nt, Homo Sapiens; identical to SEQ ID NO: 376730

SEQ ID NO: 388698 - RNA, 64 nt, Homo Sapiens; identical to SEQ ID NO: 376731

SEQ ID NO: 388699 - RNA, 62 nt, Homo Sapiens; identical to SEQ ID NO: 376732

SEQ ID NO: 388700 - RNA, 64 nt, Homo Sapiens; identical to SEQ ID NO: 376733

SEQ ID NO: 388701 - RNA, 64 nt, Homo Sapiens; identical to SEQ ID NO: 376734

SEQ ID NO: 388702 - RNA, 55 nt, Homo Sapiens; identical to SEQ ID NO: 376735

SEQ ID NO: 388703 - RNA, 64 nt, Homo Sapiens; identical to SEQ ID NO: 376736

SEQ ID NO: 388704 - RNA, 64 nt, Homo Sapiens; identical to SEQ ID NO: 376737

SEQ ID NO: 388705 - RNA, 64 nt, Homo Sapiens; identical to SEQ ID NO: 376738

SEQ ID NO: 388706 - RNA, 64 nt, Homo Sapiens; identical to SEQ ID NO: 376739

SEQ ID NO: 388707 - RNA, 64 nt, Homo Sapiens; identical to SEQ ID NO: 376740

SEQ ID NO: 388708 - RNA, 64 nt, Homo Sapiens; identical to SEQ ID NO: 376741

SEQ ID NO: 388709 - RNA, 64 nt, Homo Sapiens; identical to SEQ ID NO: 376742

SEQ ID NO: 388710 - RNA, 64 nt, Homo Sapiens; identical to SEQ ID NO: 376743

SEQ ID NO: 388711 - RNA, 64 nt, Homo Sapiens; identical to SEQ ID NO: 376744

SEQ ID NO: 388712 - RNA, 64 nt, Homo Sapiens; identical to SEQ ID NO: 376745

SEQ ID NO: 388713 - RNA, 64 nt, Homo Sapiens; identical to SEQ ID NO: 376746

SEQ ID NO: 388714 - RNA, 64 nt, Homo Sapiens; identical to SEQ ID NO: 376747

SEQ ID NO: 388715 - RNA, 64 nt, Homo Sapiens; identical to SEQ ID NO: 376748

SEQ ID NO: 388716 - RNA, 64 nt, Homo Sapiens; identical to SEQ ID NO: 376749

SEQ ID NO: 388717 - RNA, 64 nt, Homo Sapiens; identical to SEQ ID NO: 376750

SEQ ID NO: 388718 - RNA, 64 nt, Homo Sapiens; identical to SEQ ID NO: 376751

SEQ ID NO: 388719 - RNA, 64 nt, Homo Sapiens; identical to SEQ ID NO: 376752

SEQ ID NO: 388720 - RNA, 64 nt, Homo Sapiens; identical to SEQ ID NO: 376753

SEQ ID NO: 388721 - RNA, 64 nt, Homo Sapiens; identical to SEQ ID NO: 376754

SEQ ID NO: 388722 - RNA, 64 nt, Homo Sapiens; identical to SEQ ID NO: 376755

SEQ ID NO: 388723 - RNA, 64 nt, Homo Sapiens; identical to SEQ ID NO: 376756

SEQ ID NO: 388724 - RNA, 64 nt, Homo Sapiens; identical to SEQ ID NO: 376757

SEQ ID NO: 388725 - RNA, 64 nt, Homo Sapiens; identical to SEQ ID NO: 376758

SEQ ID NO: 388726 - RNA, 64 nt, Homo Sapiens; identical to SEQ ID NO: 376759

SEQ ID NO: 388727 - RNA, 64 nt, Homo Sapiens; identical to SEQ ID NO: 376760

SEQ ID NO: 388728 - RNA, 64 nt, Homo Sapiens; identical to SEQ ID NO: 376761

SEQ ID NO: 388729 - RNA, 64 nt, Homo Sapiens; identical to SEQ ID NO: 376762

SEQ ID NO: 388730 - RNA, 64 nt, Homo Sapiens; identical to SEQ ID NO: 376763

SEQ ID NO: 388731 - RNA, 64 nt, Homo Sapiens; identical to SEQ ID NO: 376764

SEQ ID NO: 388732 - RNA, 64 nt, Homo Sapiens; identical to SEQ ID NO: 376765

SEQ ID NO: 388733 - RNA, 64 nt, Homo Sapiens; identical to SEQ ID NO: 376766

SEQ ID NO: 388734 - RNA, 64 nt, Homo Sapiens; identical to SEQ ID NO: 376767

SEQ ID NO: 388735 - RNA, 64 nt, Homo Sapiens; identical to SEQ ID NO: 376768

SEQ ID NO: 388736 - RNA, 64 nt, Homo Sapiens; identical to SEQ ID NO: 376769

SEQ ID NO: 388737 - RNA, 64 nt, Homo Sapiens; identical to SEQ ID NO: 376770

SEQ ID NO: 388738 - RNA, 64 nt, Homo Sapiens; identical to SEQ ID NO: 376771

SEQ ID NO: 388739 - RNA, 64 nt, Homo Sapiens; identical to SEQ ID NO: 376772

SEQ ID NO: 388740 - RNA, 64 nt, Homo Sapiens; identical to SEQ ID NO: 376773

SEQ ID NO: 388741 - RNA, 64 nt, Homo Sapiens; identical to SEQ ID NO: 376774

SEQ ID NO: 388742 - RNA, 64 nt, Homo Sapiens; identical to SEQ ID NO: 376775

SEQ ID NO: 388743 - RNA, 64 nt, Homo Sapiens; identical to SEQ ID NO: 376776

SEQ ID NO: 388744 - RNA, 64 nt, Homo Sapiens; identical to SEQ ID NO: 376777

SEQ ID NO: 388745 - RNA, 64 nt, Homo Sapiens; identical to SEQ ID NO: 376778

SEQ ID NO: 388746 - RNA, 64 nt, Homo Sapiens; identical to SEQ ID NO: 376779

SEQ ID NO: 388747 - RNA, 64 nt, Homo Sapiens; identical to SEQ ID NO: 376780

SEQ ID NO: 388748 - RNA, 64 nt, Homo Sapiens; identical to SEQ ID NO: 376781

SEQ ID NO: 388749 - RNA, 64 nt, Homo Sapiens; identical to SEQ ID NO: 376782

SEQ ID NO: 388750 - RNA, 64 nt, Homo Sapiens; identical to SEQ ID NO: 376783

SEQ ID NO: 388751 - RNA, 64 nt, Homo Sapiens; identical to SEQ ID NO: 376784

SEQ ID NO: 388752 - RNA, 64 nt, Homo Sapiens; identical to SEQ ID NO: 376785

SEQ ID NO: 388753 - RNA, 64 nt, Homo Sapiens
aggcccgcccuggggccucuuugcagcaggguccaccugugagcagguggccccugacccugcg

SEQ ID NO: 388754 - RNA, 64 nt, Homo Sapiens
aagggcuaaugaugaggguucgcccacuuccaggaccugugaaugacucaugcuggagaggagc

SEQ ID NO: 388755 - RNA, 64 nt, Homo Sapiens
ugugcaaaaccgagggcuccaguaacaccuucuaaccugugaauuggcagaaaaggguagcggu

SEQ ID NO: 388756 - RNA, 64 nt, Homo Sapiens
cuucuguuaauuuguaaaagcacauuagugcuuuaccugugaaauuccccgccccccugcacac

SEQ ID NO: 388757 - RNA, 64 nt, Homo Sapiens
cugucccuuugaaaauccuggggucggggguggcaccugugagagccuggggcuccuggugccg

SEQ ID NO: 388758 - RNA, 64 nt, Homo Sapiens
ccagguguggugacggggggggggcggggccuccaccugugacagccaggcuugaggguggacg

SEQ ID NO: 388759 - RNA, 64 nt, Homo Sapiens
uccuccagggccacaggagcccgcuccacaagacaccugugacagaucggcucuuauuagcucc

SEQ ID NO: 388760 - RNA, 64 nt, Homo Sapiens
uggaaaucuaccaccaauccccgcuccacaagacaccugugaucgaucggcucuuauuagcucc

SEQ ID NO: 388761 - RNA, 64 nt, Homo Sapiens
ccagaaaaguagauccuauuuccaaagcacccaaaccugugauucuauauaaugauaaaacaua

SEQ ID NO: 388762 - RNA, 64 nt, Homo Sapiens
cuggagcacuggguugucucgaacuggcuggaugaccugugacuuaagaagaggaaacagcaga

SEQ ID NO: 388763 - RNA, 64 nt, Homo Sapiens
ccaugggcagguagugcccugcugggcuggcuggaccugugaagagacaccagcacuucugcuu

SEQ ID NO: 388764 - RNA, 64 nt, Homo Sapiens
uguaaccccccgcuuuggagauugccuaaugugcaccugugaggaccaauagugccaaaaagau

SEQ ID NO: 388765 - RNA, 64 nt, Homo Sapiens
augguuuuugcacauuauuuuuuuauaaauugccaccugugaaaggacuuuucuaucauuucca

SEQ ID NO: 388766 - RNA, 64 nt, Homo Sapiens
agggcuguguugaccacaguuuaggaccauacgcaccugugacagaaagacagaggccagcuau

SEQ ID NO: 388767 - RNA, 64 nt, Homo Sapiens
gggcuuuguggugaauuacuucccuggucuucauaccugugaguccucuggguacuggugagca

SEQ ID NO: 388768 - RNA, 64 nt, Homo Sapiens
caaacauagaauauccucuuacaacagaguaguaaccugugaaaauaugggccagccuggauau

SEQ ID NO: 388769 - RNA, 64 nt, Homo Sapiens
cccacucccggccccacucaccccacucacaccaaccugugagcccugugagccccacucccag

SEQ ID NO: 388770 - RNA, 64 nt, Homo Sapiens
cccacucccggccccacucaccccacucacaccaaccugugagcuccugugagcccaugcccgg

SEQ ID NO: 388771 - RNA, 64 nt, Homo Sapiens
cccugaguccaaacccuuguccucagaggggacaaccugugacauccuuccggggggagccugu

SEQ ID NO: 388772 - RNA, 64 nt, Homo Sapiens
cccugccacaauccuuagccccaucccccuccugaccugugaccuugaaacccagaaccugaau

SEQ ID NO: 388773 - RNA, 64 nt, Homo Sapiens
auuuccuuuuaguguaauuauacugaaggaguacaccugugagagagacaaguaccugauuugg

SEQ ID NO: 388774 - RNA, 64 nt, Homo Sapiens
caguuucugaggcagaagccguaucaugucuaccaccugugagguccacacaguguguaucauu

SEQ ID NO: 388775 - RNA, 64 nt, Homo Sapiens
gaacaaugaagucguuccucuaggugaauaaauuaccugugaaucucguugcaggagggcaaac

SEQ ID NO: 388776 - RNA, 64 nt, Homo Sapiens
gcauucagaacaugauuggaacaccacagagagaaccugugaauaaugugcaaacaugggggug

SEQ ID NO: 388777 - RNA, 64 nt, Homo Sapiens
ugcccagcaucaagggauaaacuccuuaauaaggaccugugacacuccuuaauagggaccugug

SEQ ID NO: 388778 - RNA, 64 nt, Homo Sapiens
ccuuaauaaggaccugugacacuccuuaauagggaccugugacucacucaauggaauaugucac

SEQ ID NO: 388779 - RNA, 64 nt, Homo Sapiens
gaauuaaggguuaccccacccugcccacucccaucccuucaaccccacuuccuacuguaauaga

SEQ ID NO: 388780 - RNA, 64 nt, Homo Sapiens
cuuagguggcagggcuguucccuccaggcaaaugcccuucaaaccgacgaucauugugcccacu

SEQ ID NO: 388781 - RNA, 64 nt, Homo Sapiens
uggggcuuaaucuuguuuaaagaaaggauuuaaucccuucaauuauauucccgaggcauuagga

SEQ ID NO: 388782 - RNA, 64 nt, Homo Sapiens
aguuguuucccauucccaacgguauucuguauaccccuucaagcuuuuuaauacauuauuauuu

SEQ ID NO: 388783 - RNA, 64 nt, Homo Sapiens
guuucuguuccucuucccaucuacuccccuacgccccuucaaccuuuuuucucugucugcuuca

SEQ ID NO: 388784 - RNA, 64 nt, Homo Sapiens
cuaaaggaaaccuuucuuaaagacaggcugaaaccccuucaaaggcagaugaggagguacagac

SEQ ID NO: 388785 - RNA, 64 nt, Homo Sapiens
ucaugagacaacucauaugguagugaucuuuauucccuucaaaauguaaaugugggaaagccuu

SEQ ID NO: 388786 - RNA, 64 nt, Homo Sapiens
acgugaaaccacucacagugcagugcuuccacuucccuucaaagaaacaaugugggaaagccuu

SEQ ID NO: 388787 - RNA, 64 nt, Homo Sapiens
ggacgaaggguuggacgggaugaccuccagaagucccuucaauuucuaguaccugugacucuua

SEQ ID NO: 388788 - RNA, 64 nt, Homo Sapiens
gugccuucccuuucuaagcaaccacacugcuuggcccuucaagggucagggugagacgugaugg

SEQ ID NO: 388789 - RNA, 64 nt, Homo Sapiens; identical to SEQ ID NO: 296379

SEQ ID NO: 388790 - RNA, 64 nt, Homo Sapiens; identical to SEQ ID NO: 296380

SEQ ID NO: 388791 - RNA, 64 nt, Homo Sapiens; identical to SEQ ID NO: 296381

SEQ ID NO: 388792 - RNA, 64 nt, Homo Sapiens; identical to SEQ ID NO: 296382

SEQ ID NO: 388793 - RNA, 64 nt, Homo Sapiens; identical to SEQ ID NO: 296383

SEQ ID NO: 388794 - RNA, 64 nt, Homo Sapiens; identical to SEQ ID NO: 296384

SEQ ID NO: 388795 - RNA, 64 nt, Homo Sapiens; identical to SEQ ID NO: 296385

SEQ ID NO: 388796 - RNA, 64 nt, Homo Sapiens; identical to SEQ ID NO: 296386

SEQ ID NO: 388797 - RNA, 64 nt, Homo Sapiens; identical to SEQ ID NO: 296387

SEQ ID NO: 388798 - RNA, 64 nt, Homo Sapiens; identical to SEQ ID NO: 296388

SEQ ID NO: 388799 - RNA, 64 nt, Homo Sapiens; identical to SEQ ID NO: 296389

SEQ ID NO: 388800 - RNA, 64 nt, Homo Sapiens; identical to SEQ ID NO: 296390

SEQ ID NO: 388801 - RNA, 64 nt, Homo Sapiens; identical to SEQ ID NO: 296391

SEQ ID NO: 388802 - RNA, 64 nt, Homo Sapiens; identical to SEQ ID NO: 296392

SEQ ID NO: 388803 - RNA, 64 nt, Homo Sapiens; identical to SEQ ID NO: 296393

SEQ ID NO: 388804 - RNA, 64 nt, Homo Sapiens; identical to SEQ ID NO: 296394

SEQ ID NO: 388805 - RNA, 64 nt, Homo Sapiens; identical to SEQ ID NO: 296395

SEQ ID NO: 388806 - RNA, 64 nt, Homo Sapiens; identical to SEQ ID NO: 296396

SEQ ID NO: 388807 - RNA, 64 nt, Homo Sapiens; identical to SEQ ID NO: 296397

SEQ ID NO: 388808 - RNA, 64 nt, Homo Sapiens; identical to SEQ ID NO: 296398

SEQ ID NO: 388809 - RNA, 64 nt, Homo Sapiens; identical to SEQ ID NO: 296399

SEQ ID NO: 388810 - RNA, 64 nt, Homo Sapiens; identical to SEQ ID NO: 296400

SEQ ID NO: 388811 - RNA, 64 nt, Homo Sapiens; identical to SEQ ID NO: 296401

SEQ ID NO: 388812 - RNA, 64 nt, Homo Sapiens; identical to SEQ ID NO: 296402

SEQ ID NO: 388813 - RNA, 64 nt, Homo Sapiens; identical to SEQ ID NO: 296403

SEQ ID NO: 388814 - RNA, 64 nt, Homo Sapiens; identical to SEQ ID NO: 296404

SEQ ID NO: 388815 - RNA, 64 nt, Homo Sapiens; identical to SEQ ID NO: 296405

SEQ ID NO: 388816 - RNA, 64 nt, Homo Sapiens; identical to SEQ ID NO: 296406

SEQ ID NO: 388817 - RNA, 64 nt, Homo Sapiens; identical to SEQ ID NO: 296407

SEQ ID NO: 388818 - RNA, 64 nt, Homo Sapiens; identical to SEQ ID NO: 296408

SEQ ID NO: 388819 - RNA, 64 nt, Homo Sapiens; identical to SEQ ID NO: 296409

SEQ ID NO: 388820 - RNA, 64 nt, Homo Sapiens; identical to SEQ ID NO: 296410

SEQ ID NO: 388821 - RNA, 64 nt, Homo Sapiens; identical to SEQ ID NO: 296402

SEQ ID NO: 388822 - RNA, 64 nt, Homo Sapiens; identical to SEQ ID NO: 296403

SEQ ID NO: 388823 - RNA, 64 nt, Homo Sapiens; identical to SEQ ID NO: 296404

SEQ ID NO: 388824 - RNA, 64 nt, Homo Sapiens; identical to SEQ ID NO: 296414

SEQ ID NO: 388825 - RNA, 64 nt, Homo Sapiens; identical to SEQ ID NO: 296415

SEQ ID NO: 388826 - RNA, 64 nt, Homo Sapiens; identical to SEQ ID NO: 296416

SEQ ID NO: 388827 - RNA, 64 nt, Homo Sapiens; identical to SEQ ID NO: 296417

SEQ ID NO: 388828 - RNA, 64 nt, Homo Sapiens; identical to SEQ ID NO: 296418

SEQ ID NO: 388829 - RNA, 64 nt, Homo Sapiens; identical to SEQ ID NO: 296419

SEQ ID NO: 388830 - RNA, 64 nt, Homo Sapiens; identical to SEQ ID NO: 296420

SEQ ID NO: 388831 - RNA, 64 nt, Homo Sapiens; identical to SEQ ID NO: 296421

SEQ ID NO: 388832 - RNA, 64 nt, Homo Sapiens; identical to SEQ ID NO: 296422

SEQ ID NO: 388833 - RNA, 64 nt, Homo Sapiens; identical to SEQ ID NO: 296423

SEQ ID NO: 388834 - RNA, 64 nt, Homo Sapiens; identical to SEQ ID NO: 296424

SEQ ID NO: 388835 - RNA, 64 nt, Homo Sapiens; identical to SEQ ID NO: 296425

SEQ ID NO: 388836 - RNA, 64 nt, Homo Sapiens; identical to SEQ ID NO: 296426

SEQ ID NO: 388837 - RNA, 64 nt, Homo Sapiens; identical to SEQ ID NO: 296427

SEQ ID NO: 388838 - RNA, 64 nt, Homo Sapiens; identical to SEQ ID NO: 296428

SEQ ID NO: 388839 - RNA, 64 nt, Homo Sapiens; identical to SEQ ID NO: 296429

SEQ ID NO: 388840 - RNA, 64 nt, Homo Sapiens; identical to SEQ ID NO: 296430

SEQ ID NO: 388841 - RNA, 64 nt, Homo Sapiens; identical to SEQ ID NO: 296431

SEQ ID NO: 388842 - RNA, 64 nt, Homo Sapiens
agauagcuuucaagggcccaauggaggcggcgguggcacugaagugccauggccugugccuugc

SEQ ID NO: 388843 - RNA, 64 nt, Homo Sapiens
cuggaggacucuguccaugcuuucuguaccucaaggcacugaagguuccuugacugucuuugug

SEQ ID NO: 388844 - RNA, 64 nt, Homo Sapiens
uuucauuguucuggauguauaagucuguucugauggcacugagugccuacagccauccgcccaa

SEQ ID NO: 388845 - RNA, 64 nt, Homo Sapiens
acuggugaagccuacagccaugaaaguguugaguggcacugauacuuuaaaaaaaaggcauuuu

SEQ ID NO: 388846 - RNA, 64 nt, Homo Sapiens
gauaaggaauaucugggacaggguuuagaucaugacucuacacagauaccaugaugagaguaua

SEQ ID NO: 388847 - RNA, 64 nt, Homo Sapiens
aauuuuaaacugaagcauuuuaauauggguagaaacucuacaccaaauacacuaaacauuuugg

SEQ ID NO: 388848 - RNA, 64 nt, Homo Sapiens
uaugacuauacgggacauauggcccauucuugucacucuacacaacaacaauuaacaaugcagu

SEQ ID NO: 388849 - RNA, 64 nt, Homo Sapiens
caguguaagaucugcugggaccuccacaggggacacucuacacucguguuugugugcguguuua

SEQ ID NO: 388850 - RNA, 64 nt, Homo Sapiens
uggagugucaagggugagaggccuuggccacucccagcacaauuuuagggccauuucuaacaaa

SEQ ID NO: 388851 - RNA, 64 nt, Homo Sapiens
gugaaacuugucaccacacaggaucccggaucaucagcacaauuaucuguguacguguccucga

SEQ ID NO: 388852 - RNA, 64 nt, Homo Sapiens
cugcuucauacucuugagcacauccuuaaaauaucagcacaaguugggggaggcaggcaaugga

SEQ ID NO: 388853 - RNA, 64 nt, Homo Sapiens
agagugcauggcaccugguguguaacgacacaaucagcacaacuggagagaggcauuaaagaac

SEQ ID NO: 388854 - RNA, 64 nt, Homo Sapiens
ucaggacauggaggugccgggugcucuccugacgcagcacaagcgcugcaugagcugcaagugu

SEQ ID NO: 388855 - RNA, 64 nt, Homo Sapiens
ugcggaagcugaacccuccuugcgugagauccggcagcacaagcggaugccuucuacacguugg

SEQ ID NO: 388856 - RNA, 64 nt, Homo Sapiens
uucgccucuggaucugcugcauccaggacugugccagcacaaagugggagcccgauaaauauuu

SEQ ID NO: 388857 - RNA, 64 nt, Homo Sapiens
gccuguaguccagucucuccagcaucaauuccaucagcacaaagacauaauuuaauuccuucua

SEQ ID NO: 388858 - RNA, 64 nt, Homo Sapiens
uaggcauucuaagucacaggaugagacaggaggucagcacaagauacacgucacaaagaccuug

SEQ ID NO: 388859 - RNA, 64 nt, Homo Sapiens
uucauaaaacuaaccgaaguuuuguuuacugaugcagcacaagagauguaaaaaaaaaaaaaaa

SEQ ID NO: 388860 - RNA, 64 nt, Homo Sapiens
ccaaacaaaccaaaauuuaaaugaucagaauuggcagcacaaagaaaacgcccucuccugacuu

SEQ ID NO: 388861 - RNA, 64 nt, Homo Sapiens
gcgcuuccuuugcacagaaucggccaccaggucucagcacaagagcuuucgaaguggccagcug

SEQ ID NO: 388862 - RNA, 64 nt, Homo Sapiens
gaccucaccaccacaccugccguggggugauucacagcacaaaaagaaacccuggccaggcgaa

SEQ ID NO: 388863 - RNA, 64 nt, Homo Sapiens; identical to SEQ ID NO: 236642

SEQ ID NO: 388864 - RNA, 64 nt, Homo Sapiens; identical to SEQ ID NO: 236643

SEQ ID NO: 388865 - RNA, 64 nt, Homo Sapiens; identical to SEQ ID NO: 236644

SEQ ID NO: 388866 - RNA, 64 nt, Homo Sapiens; identical to SEQ ID NO: 236645

SEQ ID NO: 388867 - RNA, 64 nt, Homo Sapiens
uugaggucuaaugccuuuacuuggccuauuugccagagaacaucuuaaugcagccugcauagug

SEQ ID NO: 388868 - RNA, 64 nt, Homo Sapiens
aaaaggugcuuuaccuugagccauuauuugugucagagaacaaaagaaacagaaucaauauaua

SEQ ID NO: 388869 - RNA, 64 nt, Homo Sapiens
ccagggaaccuacauuuauuaauguggcagccaaagagaacaaugggccuccacucaggcucca

SEQ ID NO: 388870 - RNA, 64 nt, Homo Sapiens
uuagaaaguuaacuaacaauggcugaagcuaaauagagaacaaugccauuguagaccugacuca

SEQ ID NO: 388871 - RNA, 64 nt, Homo Sapiens
gccaugauggcaccacugcacucuagccugggcaagagaacaagauccugucucaaaaaacaaa

SEQ ID NO: 388872 - RNA, 64 nt, Homo Sapiens
gaaauuaaaaguggauagcuuucaggaaagauaaagagaacaugcuuagaauguaagcuaaaca

SEQ ID NO: 388873 - RNA, 64 nt, Homo Sapiens
uuuagacggggagaaacaucuggaaggaugcucgagagaacaaauggagguggugaaaaucaag

SEQ ID NO: 388874 - RNA, 64 nt, Homo Sapiens
gagacuugaccccaggacuguacuacgacucuuaagagaacacugcacagcacucaaagucccc

SEQ ID NO: 388875 - RNA, 64 nt, Homo Sapiens
uuuacaauagacauugcaaagcuacuaagaggauagagaacagugaacaacaugacccuggaug

SEQ ID NO: 388876 - RNA, 64 nt, Homo Sapiens
augacccuggauggcuacuagcuuaugagagaguagagaacaacaaaaggcaugaaccugggug

SEQ ID NO: 388877 - RNA, 64 nt, Homo Sapiens
agauuuuuuuuuaauguuccagaagauggccaauagagaacauucaagggaaauggggaaacau

SEQ ID NO: 388878 - RNA, 64 nt, Homo Sapiens
gagaacauucaagggaaauggggaaacauaauuuagagaacaagaacaaaccaugucucaaauu

SEQ ID NO: 388879 - RNA, 64 nt, Homo Sapiens
ugaacaguacuugugcaggauuguuguggcuacuagagaacaagagggaaaguagggcagaaac

SEQ ID NO: 388880 - RNA, 64 nt, Homo Sapiens
uucauguuaagauacuacuacauuugaagugggcagagaacaucagaugauugaaauguucgcc

SEQ ID NO: 388881 - RNA, 64 nt, Homo Sapiens
aaaaaaaauuacugguauuuguacuccuauaugaagagaacagucuucaagcaccucuaucucu

SEQ ID NO: 388882 - RNA, 64 nt, Homo Sapiens
acauuacuuuaugaacacaguaucucauuauugcagagaacacuggguuuuagucaacaugcca

SEQ ID NO: 388883 - RNA, 64 nt, Homo Sapiens
agggaagaugggaaacaaaacuuuggaggaugggagagaacagguagcaguuaauauaaaacau

SEQ ID NO: 388884 - RNA, 64 nt, Homo Sapiens
ugugaguuaauuacuuuaggugaucaucuccuucagagaacauguuucucaugauuauucugau

SEQ ID NO: 388885 - RNA, 64 nt, Homo Sapiens
aggucuaauauuuuuuaagugaggaggaaaugcuagagaacagcugaauaacugagucuacaug

SEQ ID NO: 388886 - RNA, 64 nt, Homo Sapiens
ggcuucugaaaaaaaaaaaggaagcugcagauuuagagaacauuauucuguaaagcuguggaau

SEQ ID NO: 388887 - RNA, 64 nt, Homo Sapiens
ucauuuuucaacuaaucuuauguggaauugaauuagagaacaaggcauuauucuuuuagggaag

SEQ ID NO: 388888 - RNA, 64 nt, Homo Sapiens
cuuucuggagcuuggcagauuuuccucugacaccagagaacaauaguagucucaagaauggaaa

SEQ ID NO: 388889 - RNA, 64 nt, Homo Sapiens
uguuguaccuaaaauccaggaccaagacuccccuagagaacagaacaagcauaucaaacuaccc

SEQ ID NO: 388890 - RNA, 64 nt, Homo Sapiens
ccugagacauagacgacuuuucauggauauugagagagaacaaguuaaagaacaacaaaggcaa

SEQ ID NO: 388891 - RNA, 64 nt, Homo Sapiens
auuugauuauauguugauugauaacauauuaaauagagaacaaauaagagagguccuuuacaug

SEQ ID NO: 388892 - RNA, 64 nt, Homo Sapiens
uauuuuucaucuuguuauaaugcagagcaaauguagagaacagcaaaugauugaugcaguuaaa

SEQ ID NO: 388893 - RNA, 64 nt, Homo Sapiens
ucagaaacugcagugguaauuaaauuaauagaaaagagaacaaacugcagguuuagaaaaaugg

SEQ ID NO: 388894 - RNA, 64 nt, Homo Sapiens
aagacucauugcuggagguagagaggugucaaccagagaacagcuccccuagacauggccucug

SEQ ID NO: 388895 - RNA, 64 nt, Homo Sapiens
cugguuucugcccuuuaagagcacccggucagucagagaacagagaucacacacaccaaaccag

SEQ ID NO: 388896 - RNA, 64 nt, Homo Sapiens
auagugauacucugccauaguucuuacugcaugaagagaacaagagucacacaaguucaccacu

SEQ ID NO: 388897 - RNA, 64 nt, Homo Sapiens
caauuuuguuuuuacagaaaagauaaaacucaaaagagaacaguguauuccuucugaggggcuu

SEQ ID NO: 388898 - RNA, 64 nt, Homo Sapiens
cccugcuacguaacucucugcaguggaauaaaucagagaacaucuaaauauucacuaauggugc

SEQ ID NO: 388899 - RNA, 64 nt, Homo Sapiens
aggccgaauccaaguuucauucauguaguaggacagagaacagagugaaggcugaauccaaguu

SEQ ID NO: 388900 - RNA, 64 nt, Homo Sapiens; identical to SEQ ID NO: 346411

SEQ ID NO: 388901 - RNA, 64 nt, Homo Sapiens; identical to SEQ ID NO: 346412

SEQ ID NO: 388902 - RNA, 64 nt, Homo Sapiens; identical to SEQ ID NO: 346413

SEQ ID NO: 388903 - RNA, 64 nt, Homo Sapiens; identical to SEQ ID NO: 346414

SEQ ID NO: 388904 - RNA, 64 nt, Homo Sapiens; identical to SEQ ID NO: 346415

SEQ ID NO: 388905 - RNA, 64 nt, Homo Sapiens; identical to SEQ ID NO: 346416

SEQ ID NO: 388906 - RNA, 64 nt, Homo Sapiens; identical to SEQ ID NO: 346417

SEQ ID NO: 388907 - RNA, 64 nt, Homo Sapiens; identical to SEQ ID NO: 346418

SEQ ID NO: 388908 - RNA, 64 nt, Homo Sapiens; identical to SEQ ID NO: 346419

SEQ ID NO: 388909 - RNA, 64 nt, Homo Sapiens; identical to SEQ ID NO: 346420

SEQ ID NO: 388910 - RNA, 64 nt, Homo Sapiens; identical to SEQ ID NO: 346421

SEQ ID NO: 388911 - RNA, 64 nt, Homo Sapiens; identical to SEQ ID NO: 346422

SEQ ID NO: 388912 - RNA, 64 nt, Homo Sapiens; identical to SEQ ID NO: 346423

SEQ ID NO: 388913 - RNA, 64 nt, Homo Sapiens; identical to SEQ ID NO: 346424

SEQ ID NO: 388914 - RNA, 64 nt, Homo Sapiens; identical to SEQ ID NO: 346425

SEQ ID NO: 388915 - RNA, 64 nt, Homo Sapiens; identical to SEQ ID NO: 346426

SEQ ID NO: 388916 - RNA, 64 nt, Homo Sapiens; identical to SEQ ID NO: 346427

SEQ ID NO: 388917 - RNA, 64 nt, Homo Sapiens; identical to SEQ ID NO: 346428

SEQ ID NO: 388918 - RNA, 64 nt, Homo Sapiens; identical to SEQ ID NO: 225572

SEQ ID NO: 388919 - RNA, 64 nt, Homo Sapiens; identical to SEQ ID NO: 225573

SEQ ID NO: 388920 - RNA, 64 nt, Homo Sapiens; identical to SEQ ID NO: 225574

SEQ ID NO: 388921 - RNA, 64 nt, Homo Sapiens; identical to SEQ ID NO: 225575

SEQ ID NO: 388922 - RNA, 64 nt, Homo Sapiens; identical to SEQ ID NO: 225576

SEQ ID NO: 388923 - RNA, 64 nt, Homo Sapiens; identical to SEQ ID NO: 225577

SEQ ID NO: 388924 - RNA, 64 nt, Homo Sapiens; identical to SEQ ID NO: 225578

SEQ ID NO: 388925 - RNA, 64 nt, Homo Sapiens; identical to SEQ ID NO: 225579

SEQ ID NO: 388926 - RNA, 64 nt, Homo Sapiens; identical to SEQ ID NO: 225580

SEQ ID NO: 388927 - RNA, 64 nt, Homo Sapiens; identical to SEQ ID NO: 225581

SEQ ID NO: 388928 - RNA, 64 nt, Homo Sapiens; identical to SEQ ID NO: 225582

SEQ ID NO: 388929 - RNA, 64 nt, Homo Sapiens; identical to SEQ ID NO: 225583

SEQ ID NO: 388930 - RNA, 64 nt, Homo Sapiens; identical to SEQ ID NO: 225584

SEQ ID NO: 388931 - RNA, 64 nt, Homo Sapiens; identical to SEQ ID NO: 245914

SEQ ID NO: 388932 - RNA, 64 nt, Homo Sapiens; identical to SEQ ID NO: 245915

SEQ ID NO: 388933 - RNA, 64 nt, Homo Sapiens
cccuucacauaauugauaaugguaccaccuucuauaauaauaauauaaaauaaaaacaucugau

SEQ ID NO: 388934 - RNA, 64 nt, Homo Sapiens
uucacauaauugauaaugguaccaccuucuauaauaauaauauaaaauaaaaacaucugauguc

SEQ ID NO: 388935 - RNA, 64 nt, Homo Sapiens
ccugggugacagagcgagacucuggcucauaaaauaauaauaauaauaaauaaauaaaaaauaa

SEQ ID NO: 388936 - RNA, 64 nt, Homo Sapiens
gggugacagagcgagacucuggcucauaaaauaauaauaauaauaaauaaauaaaaaauaaaug

SEQ ID NO: 388937 - RNA, 64 nt, Homo Sapiens
ugacagagcgagacucuggcucauaaaauaauaauaauaauaaauaaauaaaaaauaaauguuu

SEQ ID NO: 388938 - RNA, 64 nt, Homo Sapiens
ggaguucaagaccagccuggcuaacaugugaaacuaauaauaauacaaaaauuagcugggcgug

SEQ ID NO: 388939 - RNA, 64 nt, Homo Sapiens
guucaagaccagccuggcuaacaugugaaacuaauaauaauacaaaaauuagcugggcguggug

SEQ ID NO: 388940 - RNA, 64 nt, Homo Sapiens
cauuuuguucucugcuaguuuaaaguaauucguuuaauaauagauguguuuuuagaggaaaugc

SEQ ID NO: 388941 - RNA, 64 nt, Homo Sapiens
uaauuuuccaguuauacagucuucuauaacuuacuaauaauauucuauauguacuuuauguaau

SEQ ID NO: 388942 - RNA, 64 nt, Homo Sapiens
acuaauccaguccaauacuaauccaauccaauacuaauaauacuauugguacaauccaauacua

SEQ ID NO: 388943 - RNA, 64 nt, Homo Sapiens
caauacuaauaauacuauugguacaauccaauacuaauaauacuauugguacaauccaauacua

SEQ ID NO: 388944 - RNA, 64 nt, Homo Sapiens
caauacuaauaauacuauugguacaauccaauacuaauaauacuaacaguaguauugauacaau

SEQ ID NO: 388945 - RNA, 64 nt, Homo Sapiens
agugauuuugugagaucagcugaaccacuuaugauaauaauaauaaaaaagacugcuuugcccu

SEQ ID NO: 388946 - RNA, 64 nt, Homo Sapiens
gauuuugugagaucagcugaaccacuuaugauaauaauaauaaaaaagacugcuuugcccucac

SEQ ID NO: 388947 - RNA, 64 nt, Homo Sapiens
ugggugacagagcaagacuccaucucaaaaaaaauaauaauaauaaauaaauaaaaaaucccaa

SEQ ID NO: 388948 - RNA, 64 nt, Homo Sapiens
gugacagagcaagacuccaucucaaaaaaaauaauaauaauaaauaaauaaaaaaucccaauua

SEQ ID NO: 388949 - RNA, 64 nt, Homo Sapiens
aaggaguuccucuaacauuugcaaaauggaaauguaauaauaaugaaugucaugcaccgcugca

SEQ ID NO: 388950 - RNA, 64 nt, Homo Sapiens
accagauaguuauauuaaauuuauaucuuauauauaauaauaugugaugauuaauacaauauua

SEQ ID NO: 388951 - RNA, 64 nt, Homo Sapiens
cuggacaguuuacaaucguugccaucaaaaauaauaauaauaaagagagcccacauugucugua

SEQ ID NO: 388952 - RNA, 64 nt, Homo Sapiens
aaacuggacaguuuacaaucguagccaucaaaaauaauaauaauugugagagcccacauugucu

SEQ ID NO: 388953 - RNA, 64 nt, Homo Sapiens
uguaggcucagcucuuucccuguuuugauaguaauaauaauaaacuucaugaaaaguauguugu

SEQ ID NO: 388954 - RNA, 64 nt, Homo Sapiens
aaauguaggcucagcucuuuuguuguuuugauaguaauaauaauuuucuucaugaaaaguaugu

SEQ ID NO: 388955 - RNA, 64 nt, Homo Sapiens
aaccuauauaguauguucucaauucauaaagcaauaauaauaaaugauucaaagugguaaccca

SEQ ID NO: 388956 - RNA, 64 nt, Homo Sapiens
guaggccuuuuguuuauuaauacuuucucuuaguuaauaauacauguuaacaugauucacauua

SEQ ID NO: 388957 - RNA, 64 nt, Homo Sapiens
cuuucugaugaggcugccauuuaaacuuagagaauaauaauaguuccuaaacugaucacaacua

SEQ ID NO: 388958 - RNA, 64 nt, Homo Sapiens
gacgauaauacuucuuuuccguaguucucagcaauaauaauaaucaaaaccaaaugauaucuaa

SEQ ID NO: 388959 - RNA, 64 nt, Homo Sapiens
uauauuaaacuccuuauguuuuaauuuaauuauuuaauaauauuauuuauaugaaccaugucua

SEQ ID NO: 388960 - RNA, 64 nt, Homo Sapiens
auuguauuuaguuacuauugaguaaagugaaauauaauaauauauuuuuuggaauacaucucuu

SEQ ID NO: 388961 - RNA, 64 nt, Homo Sapiens
guccguccuaaugcuuuaaacuuuaggguucuuuuaauaauaauuugauuuuugaagguauuua

SEQ ID NO: 388962 - RNA, 64 nt, Homo Sapiens
accaugucuauagcuguagaaaaaauaauaauaauaauaauaaaguugcauuauagccaguagu

SEQ ID NO: 388963 - RNA, 64 nt, Homo Sapiens
aaaaccaugucuauagcuguaguaaaaauaauaauaauaauaauggaguugcauuauagccagu

SEQ ID NO: 388964 - RNA, 64 nt, Homo Sapiens
aauaaaaccaugucuauagcaguaguaaaaauaauaauaauaauccaggaguugcauuauagcc

SEQ ID NO: 388965 - RNA, 64 nt, Homo Sapiens
aauaauaaaaccaugucuaugccaguaguaaaaauaauaauaauaauccaggaguugcauuaua

SEQ ID NO: 388966 - RNA, 64 nt, Homo Sapiens
uucaaaacaaggaauaauuuacacaucaaaaucauaauaauauuaguauucauuaugaacagau

SEQ ID NO: 388967 - RNA, 64 nt, Homo Sapiens
uaagagauugaaacuccaaaaauaagguucuuccuaauaauaauauauucuauuccuuaccagu

SEQ ID NO: 388968 - RNA, 64 nt, Homo Sapiens
uucuauuguguaauucuuggugggcucuguaguuuaauaauaagaaaaaggccauuucauuuua

SEQ ID NO: 388969 - RNA, 64 nt, Homo Sapiens
ccgauuccugcucgggcuguuugcuguuggcugguaauaauauauuugauuuaaaugcuguuga

SEQ ID NO: 388970 - RNA, 64 nt, Homo Sapiens
aacugcagcgccgauuugaggguggagauauagauaauaauaauauuaauaauaauaauggcca

SEQ ID NO: 388971 - RNA, 64 nt, Homo Sapiens
ugcagcgccgauuugaggguggagauauagauaauaauaauauuaauaauaauaauggccacau

SEQ ID NO: 388972 - RNA, 64 nt, Homo Sapiens
gauuugaggguggagauauagauaauaauaauauuaauaauaauaauggccacauggaucgaac

SEQ ID NO: 388973 - RNA, 64 nt, Homo Sapiens
uugaggguggagauauagauaauaauaauauuaauaauaauaauggccacauggaucgaacacu

SEQ ID NO: 388974 - RNA, 64 nt, Homo Sapiens
cuaaauuuuuuauauuuaauaauuuguuuaauaauaauaauaucuuucucuugauucuugguua

SEQ ID NO: 388975 - RNA, 64 nt, Homo Sapiens
auccuaaauuuuuuauauuuuuaaauuuguuuaauaauaauaauguauuucucuugauucuugg

SEQ ID NO: 388976 - RNA, 64 nt, Homo Sapiens
aauauccuaaauuuuuuauaugguuaaauuuguuuaauaauaauaaaguauuucucuugauucu

SEQ ID NO: 388977 - RNA, 64 nt, Homo Sapiens
cauaguaacaauggcuaaugaggauaauuauaauuaauaauaauucaugcucagauauguaucu

SEQ ID NO: 388978 - RNA, 64 nt, Homo Sapiens
uugaaucauguaauauuuaauuuguaaaaaaaaauaauaauaauauccuuuacagguuuauuuc

SEQ ID NO: 388979 - RNA, 64 nt, Homo Sapiens
uauuuucauaaucacugcagccuuggacuuguaauaauaauaagacacuuccucaggugcagac

SEQ ID NO: 388980 - RNA, 64 nt, Homo Sapiens
aaguauuuucauaaucacuggacccuuggacuuguaauaauaauaggacacuuccucaggugca

SEQ ID NO: 388981 - RNA, 64 nt, Homo Sapiens
gccugcuguguaagcugacaaaaaaaaauaauaauaauaauaagucuuggacuugucagcaaaa

SEQ ID NO: 388982 - RNA, 64 nt, Homo Sapiens
aaggccugcuguguaagcugaaaaaaaaaaauaauaauaauaauccaucuuggacuugucagca

SEQ ID NO: 388983 - RNA, 64 nt, Homo Sapiens
aauaaggccugcuguguaaggcaaaaaaaaaaaauaauaauaaucugccaucuuggacuuguca

SEQ ID NO: 388984 - RNA, 64 nt, Homo Sapiens
uagagaacagcaauaccagaauauaaauacaaauuaauaauacaggacuaauagccagaguuaa

SEQ ID NO: 388985 - RNA, 64 nt, Homo Sapiens
aacccuugucucccucuucucacacaggaaugccuaauaauagcaauugucuccaccauuguca

SEQ ID NO: 388986 - RNA, 64 nt, Homo Sapiens
acacaguaaacauucuauuuucuacacagaguaauaauaauaaaacaugauagauaaauaugua

SEQ ID NO: 388987 - RNA, 64 nt, Homo Sapiens
aaaacacaguaaacauucuaguaucuacacagaguaauaauaauuugacaugauagauaaauau

SEQ ID NO: 388988 - RNA, 64 nt, Homo Sapiens
guaaaaauaaaaauaaaaaaaaaaauaauaauaauaauaauaaaacagagugagacuccaucuc

SEQ ID NO: 388989 - RNA, 64 nt, Homo Sapiens
aaaguaaaaauaaaaauaaacucaaaaauaauaauaauaauaaugugacagagugagacuccau

SEQ ID NO: 388990 - RNA, 64 nt, Homo Sapiens
aauaaaguaaaaauaaaaaucaucucaaaaauaauaauaauaauugggugacagagugagacuc

SEQ ID NO: 388991 - RNA, 64 nt, Homo Sapiens
aauaauaaaguaaaaauaaacuccaucucaaaaauaauaauaaugccugggugacagagugaga

SEQ ID NO: 388992 - RNA, 64 nt, Homo Sapiens
aauggcugcgguagccuaguaggaauggacuauauaauaauauagcaggugcucaauaacuguu

SEQ ID NO: 388993 - RNA, 64 nt, Homo Sapiens
ggccugggcaacagagcaagacccugucucaaaauaauaauaauauauaauuuuacaccaaaag

SEQ ID NO: 388994 - RNA, 64 nt, Homo Sapiens
cugggcaacagagcaagacccugucucaaaauaauaauaauauauaauuuuacaccaaaaguuu

SEQ ID NO: 388995 - RNA, 64 nt, Homo Sapiens
gacaacguguuucugaaaaacagauuuucauaaguaauaauaaaaauaauaauaaaaaaguuuu

SEQ ID NO: 388996 - RNA, 64 nt, Homo Sapiens
cugaaaaacagauuuucauaaguaauaauaaaaauaauaauaaaaaaguuuugguaugguaagc

SEQ ID NO: 388997 - RNA, 64 nt, Homo Sapiens
gaaagggugauaaaguaauagauaacuuuuaguuuaauaauaauuauuguuauuauacuacuaa

SEQ ID NO: 388998 - RNA, 64 nt, Homo Sapiens
uuuaguuuaauaauaauuauuguuauuauacuacuaauaauagagcacuuguaagcacuaaguu

SEQ ID NO: 388999 - RNA, 64 nt, Homo Sapiens
aaauguuugucagacuuauuaacuggucauauuauaauaauacugauaaugaccaacugcucau

SEQ ID NO: 389000 - RNA, 64 nt, Homo Sapiens
aacauuuuugcuuugcugccagaguaacccugacuaauaauacaauaacagcaauuuuuuuaaa

SEQ ID NO: 389001 - RNA, 64 nt, Homo Sapiens
uuguuugcuuuccuuaacugaauaauaauaauaauaauaauaugauaauaauaauaauaauaau

SEQ ID NO: 389002 - RNA, 64 nt, Homo Sapiens
auguuguuugcuuuccuuaaaauaauaauaauaauaauaauaauauaauaauaauaauaauaau

SEQ ID NO: 389003 - RNA, 64 nt, Homo Sapiens
aauauguuguuugcuuuccuaauaauaauaauaauaauaauaauaugauaauaauaauaauaau

SEQ ID NO: 389004 - RNA, 64 nt, Homo Sapiens
aauaauauguuguuugcuuuaauaauaauaauaauaauaauaauaugaugauaauaauaauaau

SEQ ID NO: 389005 - RNA, 64 nt, Homo Sapiens
aauaauaauauguuguuugcaauaauaauaauaauaauaauaauauaaugaugauaauaauaau

SEQ ID NO: 389006 - RNA, 64 nt, Homo Sapiens
aauaauaauaauauguuguuaauaauaauaauaauaauaauaauauaauaaugaugauaauaau

SEQ ID NO: 389007 - RNA, 64 nt, Homo Sapiens
aauaauaauaauaauauguuaauaauaauaauaauaauaauaauaugauaauaaugaugauaau

SEQ ID NO: 389008 - RNA, 64 nt, Homo Sapiens
aauaauaauaauaauaauauaauaauaauaauaauaauaauaauacaaugauaauaaugaugau

SEQ ID NO: 389009 - RNA, 64 nt, Homo Sapiens
aauaauaauaauaauaauaagauaauaauaauaauaauaauaaucacacaaugauaauaaugau

SEQ ID NO: 389010 - RNA, 64 nt, Homo Sapiens
aauaauaauaauaauaauaagaugauaauaauaauaauaauaauuugcacacaaugauaauaau

SEQ ID NO: 389011 - RNA, 64 nt, Homo Sapiens
aauaauaauaauaauaauaaaaugaugauaauaauaauaauaaucauuugcacacaaugauaau

SEQ ID NO: 389012 - RNA, 64 nt, Homo Sapiens
aauaauaauaauaauaauaaaauaaugaugauaauaauaauaauuuucauuugcacacaaugau

SEQ ID NO: 389013 - RNA, 64 nt, Homo Sapiens
aauaauaauaauaauaauaagauaauaaugaugauaauaauaauuuauuucauuugcacacaau

SEQ ID NO: 389014 - RNA, 64 nt, Homo Sapiens
uuguuccaaauacugcuuagcuaauaauaauagcuaauaauaccucucgcuagguagaacacug

SEQ ID NO: 389015 - RNA, 64 nt, Homo Sapiens
uaauaauaccuuguuccaaauagaacacugcuaauaauaauagcaguauuuugaucucgcuagg

SEQ ID NO: 389016 - RNA, 64 nt, Homo Sapiens
agcuaauaauaccuuguuccagguagaacacugcuaauaauaaucacaguauuuugaucucgcu

SEQ ID NO: 389017 - RNA, 64 nt, Homo Sapiens
uaguguuuaugaauagaaucccuauguuaaauaauaauaauaacuguuauauauaugaauauuc

SEQ ID NO: 389018 - RNA, 64 nt, Homo Sapiens
aacuaguguuuaugaauagauucccuauguuaaauaauaauaauaccuguuauauauaugaaua

SEQ ID NO: 389019 - RNA, 64 nt, Homo Sapiens
acauugccuaaaguagaauguguaaguaaugcuguaauaauacauaucauaguauauuauaauc

SEQ ID NO: 389020 - RNA, 64 nt, Homo Sapiens
uaacuuaaauauauuuuguuuaauaggaaauauauaauaauagcauuuuauguaauaaaauaug

SEQ ID NO: 389021 - RNA, 64 nt, Homo Sapiens
auaucuuuaaaaagcuuuucaugauguuaaagcauaauaauaacgugugccaagaauaaaugaa

SEQ ID NO: 389022 - RNA, 64 nt, Homo Sapiens
uugcuaaaaggccuuuuagauaguuuggugcuguuaauaauaaucacuauuuaguaaaaaguuu

SEQ ID NO: 389023 - RNA, 64 nt, Homo Sapiens
uaaauaaauaaaaauccaaaaauaauaauaauaauaauaauaaaaaaacauccuuuagaugcaa

SEQ ID NO: 389024 - RNA, 64 nt, Homo Sapiens
aaauaaauaaauaaaaaucccaaaauaauaauaauaauaauaauuccaaaacauccuuuagaug

SEQ ID NO: 389025 - RNA, 64 nt, Homo Sapiens
aauaaauaaauaaauaaaaaaugcaaaauaauaauaauaauaauuccuccaaaacauccuuuag

SEQ ID NO: 389026 - RNA, 64 nt, Homo Sapiens
aauaauaaauaaauaaauaauagaugcaaaauaauaauaauaauugcuccuccaaaacauccuu

SEQ ID NO: 389027 - RNA, 64 nt, Homo Sapiens
aauaauaauaaauaaauaaacuuuagaugcaaaauaauaauaaucugugcuccuccaaaacauc

SEQ ID NO: 389028 - RNA, 64 nt, Homo Sapiens
uugagccccugucaagugccagucaugauaguaguaauaauaauaauaaacaucuauuggacca

SEQ ID NO: 389029 - RNA, 64 nt, Homo Sapiens
agccccugucaagugccagucaugauaguaguaauaauaauaauaaacaucuauuggaccaggc

SEQ ID NO: 389030 - RNA, 64 nt, Homo Sapiens
cccugucaagugccagucaugauaguaguaauaauaauaauaaacaucuauuggaccaggcucu

SEQ ID NO: 389031 - RNA, 64 nt, Homo Sapiens
accuccacauagauguuuuuauauuacaugaauuuaauaauaaacuaaacuuuuuuuugucucc

SEQ ID NO: 389032 - RNA, 64 nt, Homo Sapiens
uacacauauaauauauaugcuaaaguauaaagaguaauaauaaugacaauaaacaaaccccugu

SEQ ID NO: 389033 - RNA, 64 nt, Homo Sapiens
uaacagcgagacucugucuuaaaaauaauaacaauaauaauaauaauaaagacuuacuuaacca

SEQ ID NO: 389034 - RNA, 64 nt, Homo Sapiens
cagcgagacucugucuuaaaaauaauaacaauaauaauaauaauaaagacuuacuuaaccaaua

SEQ ID NO: 389035 - RNA, 64 nt, Homo Sapiens
cgagacucugucuuaaaaauaauaacaauaauaauaauaauaaagacuuacuuaaccaauauua

SEQ ID NO: 389036 - RNA, 64 nt, Homo Sapiens
caaaugagagugugagagaaaguaccuucuauuuuaauaauaauauuauuauaaaaauaauaaa

SEQ ID NO: 389037 - RNA, 64 nt, Homo Sapiens
augagagugugagagaaaguaccuucuauuuuaauaauaauauuauuauaaaaauaauaaaucu

SEQ ID NO: 389038 - RNA, 64 nt, Homo Sapiens
uugcauucugaacaaauaacuugccuugguguauuaauaauaugccuaaugacuugguaaauua

SEQ ID NO: 389039 - RNA, 64 nt, Homo Sapiens
aaugcaguauugcaacaggggauuuugaaaaauguaauaauauuuccagauaauauuuucuaca

SEQ ID NO: 389040 - RNA, 64 nt, Homo Sapiens
cuuuuucagaaagaauugagcuuuauuuccuuaauaauaauaaauuuccuaugauccuuccaca

SEQ ID NO: 389041 - RNA, 64 nt, Homo Sapiens
aaacuuuuucagaaagaauuacacuuuauuuccuuaauaauaauguauuuccuaugauccuucc

SEQ ID NO: 389042 - RNA, 64 nt, Homo Sapiens
uuauauuucauaaucaggcaaaaauacuuacaguuaauaauauagauauaauguuaaaaacaau

SEQ ID NO: 389043 - RNA, 64 nt, Homo Sapiens
uacuuucuaacugagcccucuauuuucuuuauuuuaauaauauuucuccccacuugagaaucac

SEQ ID NO: 389044 - RNA, 64 nt, Homo Sapiens
uaagauacugauagcauugagucuugaaaugauuuaauaauaugagugaggauuugcuuucucc

SEQ ID NO: 389045 - RNA, 64 nt, Homo Sapiens
auuuuucuuccaaacuucauauaugucuaucagguaauaauaggcuugaaaauugauauccugu

SEQ ID NO: 389046 - RNA, 64 nt, Homo Sapiens
ggaguauaaaggcuacacccuuauuguaaaaaaauaauaauaauaaaaugaaagaaacaaucac

SEQ ID NO: 389047 - RNA, 64 nt, Homo Sapiens
guauaaaggcuacacccuuauuguaaaaaaauaauaauaauaaaaugaaagaaacaaucaccac

SEQ ID NO: 389048 - RNA, 64 nt, Homo Sapiens
uaaaaacucugaagaaacuuuguuauuaaaauaauaauaauaauggaaguucugggauucaggu

SEQ ID NO: 389049 - RNA, 64 nt, Homo Sapiens
aauuaaaaacucugaagaaagguuguuauuaaaauaauaauaauucuggaaguucugggauuca

SEQ ID NO: 389050 - RNA, 64 nt, Homo Sapiens
uuuuuaaagaaacauaaccacaaaccuuuucaaauaauaauaauaauaauaauaaaaaauguau

SEQ ID NO: 389051 - RNA, 64 nt, Homo Sapiens
uuaaagaaacauaaccacaaaccuuuucaaauaauaauaauaauaauaauaaaaaauguauuuu

SEQ ID NO: 389052 - RNA, 64 nt, Homo Sapiens
aagaaacauaaccacaaaccuuuucaaauaauaauaauaauaauaauaaaaaauguauuuuaaa

SEQ ID NO: 389053 - RNA, 64 nt, Homo Sapiens
aaacauaaccacaaaccuuuucaaauaauaauaauaauaauaauaaaaaauguauuuuaaagau

SEQ ID NO: 389054 - RNA, 64 nt, Homo Sapiens
cauaaccacaaaccuuuucaaauaauaauaauaauaauaauaaaaaauguauuuuaaagauggc

SEQ ID NO: 389055 - RNA, 64 nt, Homo Sapiens
uuuuaaacaaguuuuuuguagaucccuuguaaaauaauaauaauaauguugugaaucuccaugc

SEQ ID NO: 389056 - RNA, 64 nt, Homo Sapiens
uaaacaaguuuuuuguagaucccuuguaaaauaauaauaauaauguugugaaucuccaugccaa

SEQ ID NO: 389057 - RNA, 64 nt, Homo Sapiens
auuaauaaaaauuuaugaauauuaaaauuaucauuaauaauauaaaacacuuauuugagauuaa

SEQ ID NO: 389058 - RNA, 64 nt, Homo Sapiens
guauauuuguuauucuaacucuauuuuuuaaaguuaauaauauaaaguggccauguaaaauauu

SEQ ID NO: 389059 - RNA, 64 nt, Homo Sapiens
acuauugcuaguacuaguacauuuaccuuuaaaauaauaauaguuauuuuuauuuuaaaauaaa

SEQ ID NO: 389060 - RNA, 64 nt, Homo Sapiens
acuauuacuauuacuauuuuaguauuauuaacacuaauaauaguaacuguuaguauuaacuauu

SEQ ID NO: 389061 - RNA, 64 nt, Homo Sapiens
gccauauucuaaguugaguaaccaccauuuauaauaauaauagcuaucuuaaugugaauuaaaa

SEQ ID NO: 389062 - RNA, 64 nt, Homo Sapiens
agcgccauauucuaaguugaaaaaccaccauuuauaauaauaauaccuaucuuaaugugaauua

SEQ ID NO: 389063 - RNA, 64 nt, Homo Sapiens
auauuuaaucuuauuaagugguuuuuuaaaaaaauaauaauaaauccuuacgcugggaaagcug

SEQ ID NO: 389064 - RNA, 64 nt, Homo Sapiens
ucuuuuuuaaaaucugcugauggagagcaaaacuuaauaauaaugcugaagcacacggccaugu

SEQ ID NO: 389065 - RNA, 64 nt, Homo Sapiens
ggcaaacuuaacaccccacuccacauaguaauaauaauaauaauaucaaaagagacuuagacuc

SEQ ID NO: 389066 - RNA, 64 nt, Homo Sapiens
aauggcaaacuuaacacccccucccacauaguaauaauaauaaugugaucaaaagagacuuaga

SEQ ID NO: 389067 - RNA, 64 nt, Homo Sapiens
aauaauggcaaacuuaacacagacucccacauaguaauaauaauagugugaucaaaagagacuu

SEQ ID NO: 389068 - RNA, 64 nt, Homo Sapiens
ugaucuggcaguuuaugcauucuucagaguaauguaauaauaccuaugugaugcuguaauuuua

SEQ ID NO: 389069 - RNA, 64 nt, Homo Sapiens
ccugggugacagagcgacccucugucucaaaaaauaauaauaauaauaaauaaaacaacaacaa

SEQ ID NO: 389070 - RNA, 64 nt, Homo Sapiens
gggugacagagcgacccucugucucaaaaaauaauaauaauaauaaauaaaacaacaacaaaau

SEQ ID NO: 389071 - RNA, 64 nt, Homo Sapiens
ugacagagcgacccucugucucaaaaaauaauaauaauaauaaauaaaacaacaacaaaaugca

SEQ ID NO: 389072 - RNA, 64 nt, Homo Sapiens
accuuuacuauuuccaauguauguuuguuaaaaauaauaauaauaaaaccaaaagccuuugugg

SEQ ID NO: 389073 - RNA, 64 nt, Homo Sapiens
uuuacuauuuccaauguauguuuguuaaaaauaauaauaauaaaaccaaaagccuuuguggaaa

SEQ ID NO: 389074 - RNA, 64 nt, Homo Sapiens
augaaacaaucugauugggggacaguguugauaauaauaauaaauuuacaggugccaaaaaggg

SEQ ID NO: 389075 - RNA, 64 nt, Homo Sapiens
aaaaugaaacaaucugauugggggacaguguugauaauaauaauuauuuuacaggugccaaaaa

SEQ ID NO: 389076 - RNA, 64 nt, Homo Sapiens
gagaggccucaggaaagucauuccuuuuuaaaaauaauaauaaauguaaggggguacagugcag

SEQ ID NO: 389077 - RNA, 64 nt, Homo Sapiens
ggugaagucugggcuuuuaguguaaccaucacccuaauaauauacguuguacccauuaaguuau

SEQ ID NO: 389078 - RNA, 64 nt, Homo Sapiens
ugauucuuuuucuuuugugcacauaagaaauaaauaauaauaauaaauaaagaauaaaauuuug

SEQ ID NO: 389079 - RNA, 64 nt, Homo Sapiens
uucuuuuucuuuugugcacauaagaaauaaauaauaauaauaaauaaagaauaaaauuuuguau

SEQ ID NO: 389080 - RNA, 64 nt, Homo Sapiens
cuuugccaaugauagugaccacagcaaaagcaaauaauaauaauauuaauaauaauaaagagaa

SEQ ID NO: 389081 - RNA, 64 nt, Homo Sapiens
ugccaaugauagugaccacagcaaaagcaaauaauaauaauauuaauaauaauaaagagaaaua

SEQ ID NO: 389082 - RNA, 64 nt, Homo Sapiens
uagugaccacagcaaaagcaaauaauaauaauauuaauaauaauaaagagaaauaaaauaauaa

SEQ ID NO: 389083 - RNA, 64 nt, Homo Sapiens
ugaccacagcaaaagcaaauaauaauaauauuaauaauaauaaagagaaauaaaauaauaaaau

SEQ ID NO: 389084 - RNA, 64 nt, Homo Sapiens
accuuccaaaaaaagugccgcucaauaaaauuaauaauaauaaagugacagagugagacuccau

SEQ ID NO: 389085 - RNA, 64 nt, Homo Sapiens
aaaaccuuccaaaaaaagugcaucucaauaaaauuaauaauaauugggugacagagugagacuc

SEQ ID NO: 389086 - RNA, 64 nt, Homo Sapiens
accuuggugaugcauuacaacuuguuuucuuauguaauaauaaugaugaugaugaugauaauaa

SEQ ID NO: 389087 - RNA, 64 nt, Homo Sapiens
uuuucuuauguaauaauaaugaugaugaugaugauaauaauaaauauuuuugagugcuuacuau

SEQ ID NO: 389088 - RNA, 64 nt, Homo Sapiens
gguuuucuaaacuccaaaauggucaucuuaucaauaauaauaauauugaccauuuccuaucugc

SEQ ID NO: 389089 - RNA, 64 nt, Homo Sapiens
uuucuaaacuccaaaauggucaucuuaucaauaauaauaauauugaccauuuccuaucugccag

SEQ ID NO: 389090 - RNA, 64 nt, Homo Sapiens
aauauauguauuagaugaauuaccaaaguaauaauaauaauauacuucagaugaagaaauuugg

SEQ ID NO: 389091 - RNA, 64 nt, Homo Sapiens
auaaauauauguauuagaugugguaccaaaguaauaauaauaauuuccuucagaugaagaaauu

SEQ ID NO: 389092 - RNA, 64 nt, Homo Sapiens
aauauaaauauauguauuagauuugguaccaaaguaauaauaauccauuccuucagaugaagaa

SEQ ID NO: 389093 - RNA, 64 nt, Homo Sapiens
agugcuuuagaaauuaaaucccaaaaccaugccauaauaauauauggacuauaauaaccugucu

SEQ ID NO: 389094 - RNA, 64 nt, Homo Sapiens
guuugagguuauauaugcacuauaggauugcauuuaauaauaguucaacuucuauaccuaagaa

SEQ ID NO: 389095 - RNA, 64 nt, Homo Sapiens
caauaauuauuaugaccccuaggaacuggguuaauaauaauagaaaucugauguccacaagaac

SEQ ID NO: 389096 - RNA, 64 nt, Homo Sapiens
agacaauaauuauuaugaccaacaggaacuggguuaauaauaauaagaaucugauguccacaag

SEQ ID NO: 389097 - RNA, 64 nt, Homo Sapiens
uguuagugcucagaaaucaccauaaucacgaaaauaauaauaauaaaucuuuaacauacuaccu

SEQ ID NO: 389098 - RNA, 64 nt, Homo Sapiens
uagugcucagaaaucaccauaaucacgaaaauaauaauaauaaaucuuuaacauacuaccuaaa

SEQ ID NO: 389099 - RNA, 64 nt, Homo Sapiens
ugcucgaaagaaaaaaauguuaaaaauauaucuauaauaauaauuuuuugucauuugucuuuau

SEQ ID NO: 389100 - RNA, 64 nt, Homo Sapiens
ugguccaaguacuuuguauuguauacgugagucauaauaauaaaaagaagaagaaaaauaauag

SEQ ID NO: 389101 - RNA, 64 nt, Homo Sapiens
ccuacaugacaaugugacacuccaucucaaaaaauaauaauaauaacaauauaagaacuagcug

SEQ ID NO: 389102 - RNA, 64 nt, Homo Sapiens
acaugacaaugugacacuccaucucaaaaaauaauaauaauaacaauauaagaacuagcugggc

SEQ ID NO: 389103 - RNA, 64 nt, Homo Sapiens
aaugacugcuaucauaggcauccauauuuaauauuaauaauaauaauuaauaauaauaauaaac

SEQ ID NO: 389104 - RNA, 64 nt, Homo Sapiens
gacugcuaucauaggcauccauauuuaauauuaauaauaauaauuaauaauaauaauaaaccca

SEQ ID NO: 389105 - RNA, 64 nt, Homo Sapiens
auaggcauccauauuuaauauuaauaauaauaauuaauaauaauaauaaacccaacacccaucc

SEQ ID NO: 389106 - RNA, 64 nt, Homo Sapiens
ggcauccauauuuaauauuaauaauaauaauuaauaauaauaauaaacccaacacccauccccc

SEQ ID NO: 389107 - RNA, 64 nt, Homo Sapiens
auccauauuuaauauuaauaauaauaauuaauaauaauaauaaacccaacacccaucccccaga

SEQ ID NO: 389108 - RNA, 64 nt, Homo Sapiens
ugaaagugacuuucacgguuccuucauaaaacuauaauaauauccgacacuuugauagaaaaaa

SEQ ID NO: 389109 - RNA, 64 nt, Homo Sapiens
ugcuguuguuuagggguaaauaacaguaaauaauuaauaauaauaauaauaauaauaaaggagc

SEQ ID NO: 389110 - RNA, 64 nt, Homo Sapiens
uguuguuuagggguaaauaacaguaaauaauuaauaauaauaauaauaauaauaaaggagcuga

SEQ ID NO: 389111 - RNA, 64 nt, Homo Sapiens
uguuuagggguaaauaacaguaaauaauuaauaauaauaauaauaauaauaaaggagcugacgu

SEQ ID NO: 389112 - RNA, 64 nt, Homo Sapiens
uuagggguaaauaacaguaaauaauuaauaauaauaauaauaauaauaaaggagcugacguucu

SEQ ID NO: 389113 - RNA, 64 nt, Homo Sapiens
gggguaaauaacaguaaauaauuaauaauaauaauaauaauaauaaaggagcugacguucuuag

SEQ ID NO: 389114 - RNA, 64 nt, Homo Sapiens
guaaauaacaguaaauaauuaauaauaauaauaauaauaauaaaggagcugacguucuuagccu

SEQ ID NO: 389115 - RNA, 64 nt, Homo Sapiens
aaacuuacugauauccucaucuguaaauuagcgauaauaauaguacuuaccugguaggauuaug

SEQ ID NO: 389116 - RNA, 64 nt, Homo Sapiens
uauuauguucucuguaguuacuggcugugauuauuaauaauauugccgcacccuaauaucuguu

SEQ ID NO: 389117 - RNA, 64 nt, Homo Sapiens
cauaaaagagugccuggcacauaguaggugccauuaauaauauuacuauuguuaacaccuuaag

SEQ ID NO: 389118 - RNA, 64 nt, Homo Sapiens
uguaaauacugugaaguguguacugaagauuuaauaauaauaaaccauauuuauaccuuucagg

SEQ ID NO: 389119 - RNA, 64 nt, Homo Sapiens
aaauguaaauacugugaaguagguacugaagauuuaauaauaaugacccauauuuauaccuuuc

SEQ ID NO: 389120 - RNA, 64 nt, Homo Sapiens
caaauuaauucuaaaggcccacuucaaugcuuaauaauaauaaacuauaaauauuaauaauaca

SEQ ID NO: 389121 - RNA, 64 nt, Homo Sapiens
aaacaaauuaauucuaaaggacaacuucaaugcuuaauaauaauauacuauaaauauuaauaau

SEQ ID NO: 389122 - RNA, 64 nt, Homo Sapiens
acuucaaugcuuaauaauaauauacuauaaauauuaauaauacauuuucagcaacauauagaaa

SEQ ID NO: 389123 - RNA, 64 nt, Homo Sapiens
ugaugauaaagauguuucugagucauaauaacaauaauaauaaagcagcagcaauaguagaagu

SEQ ID NO: 389124 - RNA, 64 nt, Homo Sapiens
uccaacaaggaauucagagucaucauuaaguaguuaauaauaauguguuucuuaaagcucugaa

SEQ ID NO: 389125 - RNA, 64 nt, Homo Sapiens
gcucugaauuuuucgaaaggaauuuaagaaggauuaauaauaaugcaugcuuggcccugcauuu

SEQ ID NO: 389126 - RNA, 64 nt, Homo Sapiens
auaagugagcugaacucaccucaaaaaaaaaaaauaauaauaaacgacagagcaagacucuguc

SEQ ID NO: 389127 - RNA, 64 nt, Homo Sapiens
ugccaagggggagagagacaaaagcaaaaaauaauaauaauaaauaccaccaaucugugaaagu

SEQ ID NO: 389128 - RNA, 64 nt, Homo Sapiens
aaaugccaagggggagagagaguaaagcaaaaaauaauaauaaucauuaccaccaaucugugaa

SEQ ID NO: 389129 - RNA, 64 nt, Homo Sapiens
auugccaaccucacugacacagggucauaguguauaauaauauacuguacuauauaauauauca

SEQ ID NO: 389130 - RNA, 64 nt, Homo Sapiens
agaaguaauuuugcuccuugauaaaguauuauauuaauaauaaaucugccugcaacuuuuugcc

SEQ ID NO: 389131 - RNA, 64 nt, Homo Sapiens
ugacagaccaguuauuagguauuagcaugugugguaauaauaauaguggaacuucacacuuaca

SEQ ID NO: 389132 - RNA, 64 nt, Homo Sapiens
cagaccaguuauuagguauuagcaugugugguaauaauaauaguggaacuucacacuuacauca

SEQ ID NO: 389133 - RNA, 64 nt, Homo Sapiens
ccagucugggcaacagagugagacccugucucaauaauaauaauaauaauaaugaugauacucu

SEQ ID NO: 389134 - RNA, 64 nt, Homo Sapiens
gucugggcaacagagugagacccugucucaauaauaauaauaauaauaaugaugauacucuaag

SEQ ID NO: 389135 - RNA, 64 nt, Homo Sapiens
ugggcaacagagugagacccugucucaauaauaauaauaauaauaaugaugauacucuaagaaa

SEQ ID NO: 389136 - RNA, 64 nt, Homo Sapiens
gcaacagagugagacccugucucaauaauaauaauaauaauaaugaugauacucuaagaaaaaa

SEQ ID NO: 389137 - RNA, 64 nt, Homo Sapiens
gcaauaugucauaauagaguagccacugguugcauaauaauagagaccuaaauucucaaauagg

SEQ ID NO: 389138 - RNA, 63 nt, Homo Sapiens
ugaaauaauaagugggagucaauuuauuauuaauaauaauaaguugugcggacgauacauuag

SEQ ID NO: 389139 - RNA, 60 nt, Homo Sapiens
aagugaaauaauaagugggaaauuuauuauuaauaauaauuugugcggacgauacauuag

SEQ ID NO: 389140 - RNA, 64 nt, Homo Sapiens
caucuguuuuuucauuugauccuaucgacaaucauaauaauaauaaauuauauauauaacccau

SEQ ID NO: 389141 - RNA, 64 nt, Homo Sapiens
cuguuuuuucauuugauccuaucgacaaucauaauaauaauaaauuauauauauaacccauaua

SEQ ID NO: 389142 - RNA, 64 nt, Homo Sapiens
guguuugugagcuuuuuguucccucauucugcauuaauaauagcuaauaauaaaugcauagagc

SEQ ID NO: 389143 - RNA, 64 nt, Homo Sapiens
gcuuuuuguucccucauucugcauuaauaauagcuaauaauaaaugcauagagcaauuaaacug

SEQ ID NO: 389144 - RNA, 64 nt, Homo Sapiens
uaaauauuccuaucugcuuauaaaauggcugcuauaauaauaauaauacagauguuguuauaua

SEQ ID NO: 389145 - RNA, 64 nt, Homo Sapiens
auauuccuaucugcuuauaaaauggcugcuauaauaauaauaauacagauguuguuauauaagg

SEQ ID NO: 389146 - RNA, 64 nt, Homo Sapiens
uuccuaucugcuuauaaaauggcugcuauaauaauaauaauacagauguuguuauauaagguau

SEQ ID NO: 389147 - RNA, 64 nt, Homo Sapiens
agccugggcaacaagagcaaaacucagucucaaauaauaauaauaacaacaacuuaaugugcug

SEQ ID NO: 389148 - RNA, 64 nt, Homo Sapiens
cugggcaacaagagcaaaacucagucucaaauaauaauaauaacaacaacuuaaugugcugcug

SEQ ID NO: 389149 - RNA, 64 nt, Homo Sapiens
ugggcucauuuaguugccugucuauuaugaagguuaauaauaaaaguaacaauccugugaguuu

SEQ ID NO: 389150 - RNA, 64 nt, Homo Sapiens
aaacuacccauauuccaaaacagccaaagcuugcuaauaauagacaaacugacuuacuuuguuc

SEQ ID NO: 389151 - RNA, 64 nt, Homo Sapiens
auugcuuuuccucggcagcuuucaaaaaaccaaauaauaauaguuauccgucuucuacuucaug

SEQ ID NO: 389152 - RNA, 64 nt, Homo Sapiens
cuugggaaccuuggguucuuagguuuggauucuuuaauaauaucuaaaaagcuaaauuuuaaau

SEQ ID NO: 389153 - RNA, 64 nt, Homo Sapiens
ugguaauuccugcuccacaccccuauuuuccucuuaauaauacguuugggugaagacaaauuag

SEQ ID NO: 389154 - RNA, 64 nt, Homo Sapiens
uugggaaugcauuauuacauccauuucuguaacauaauaauauguugcaugcaguuauauuuuc

SEQ ID NO: 389155 - RNA, 64 nt, Homo Sapiens
gcaugcuugauuuaggagagaauaaagggcuauauaauaauaaauccagauuuccggauaagaa

SEQ ID NO: 389156 - RNA, 64 nt, Homo Sapiens
aagcaaacucuauugguguguuguaaaacaauaauaauaauaaaagcauagcuauuuguuuuua

SEQ ID NO: 389157 - RNA, 64 nt, Homo Sapiens
aaaaagcaaacucuauugguuuauuguaaaacaauaauaauaaugagagcauagcuauuuguuu

SEQ ID NO: 389158 - RNA, 64 nt, Homo Sapiens
ccuuauaaaauuggguucauccaaaugggaguaauaauaauaauagccucaguuuucucaucug

SEQ ID NO: 389159 - RNA, 64 nt, Homo Sapiens
aauccuuauaaaauuggguucugccaaaugggaguaauaauaaucugagccucaguuuucucau

SEQ ID NO: 389160 - RNA, 64 nt, Homo Sapiens
aauauaauacugaaaaggauuaauaauaacauaauaauaauaaauugauggcaaaaagacagug

SEQ ID NO: 389161 - RNA, 64 nt, Homo Sapiens
aaaaauauaauacugaaaagguguaauaauaacauaauaauaauauuuugauggcaaaaagaca

SEQ ID NO: 389162 - RNA, 64 nt, Homo Sapiens
auaauaauaauaaaaauauagcaaaaagacaguguaauaauaacucacaggccucauuuugaug

SEQ ID NO: 389163 - RNA, 64 nt, Homo Sapiens
aacaacaacaacaauaauaagaugauaauaauaauaauaauaacaugaugaugaugaugaugau

SEQ ID NO: 389164 - RNA, 64 nt, Homo Sapiens
aacaacaacaacaacaauaagaugaugauaauaauaauaauaauucgaugaugaugaugaugau

SEQ ID NO: 389165 - RNA, 64 nt, Homo Sapiens
aauaacaacaacaacaacaagaugaugaugauaauaauaauaauacuucgaugaugaugaugau

SEQ ID NO: 389166 - RNA, 64 nt, Homo Sapiens
aauaauaacaacaacaacaagaugaugaugaugauaauaauaauaauacuucgaugaugaugau

SEQ ID NO: 389167 - RNA, 64 nt, Homo Sapiens
cucugguugcuuauuuuuagaaaaugaggacauuuaauaauaauaaaaaaaaagggauuaauag

SEQ ID NO: 389168 - RNA, 64 nt, Homo Sapiens
ugguugcuuauuuuuagaaaaugaggacauuuaauaauaauaaaaaaaaagggauuaauagcuu

SEQ ID NO: 389169 - RNA, 64 nt, Homo Sapiens
uuaauguuugaaucuaaaucauugggcaaacuucuaauaauaacaauuaauaauagguuacagg

SEQ ID NO: 389170 - RNA, 64 nt, Homo Sapiens
cuaaaucauugggcaaacuucuaauaauaacaauuaauaauagguuacaggaaagccagccaga

SEQ ID NO: 389171 - RNA, 64 nt, Homo Sapiens
ccucuguucacauuuacuggucuuaauuaacagguaauaauaauacauguacuuuuagccugaa

SEQ ID NO: 389172 - RNA, 64 nt, Homo Sapiens
cuguucacauuuacuggucuuaauuaacagguaauaauaauacauguacuuuuagccugaaacc

SEQ ID NO: 389173 - RNA, 64 nt, Homo Sapiens
ugcaaaauagaggccaaauccagggaccaggcccuaauaauagaaguuguaccaaaaugccugu

SEQ ID NO: 389174 - RNA, 64 nt, Homo Sapiens
auugaaauuuuaaaauuuugaauugcuuuuauuauaauaauaggaacauaggccuaauugagau

SEQ ID NO: 389175 - RNA, 64 nt, Homo Sapiens
uaccaacccacuuuguggaugcagaaauuugcacuaauaauacuggacuaaaugcugcagguca

SEQ ID NO: 389176 - RNA, 64 nt, Homo Sapiens
gccugggcaacagagugaaacucugucucaaaaauaauaauaauaaaaaaaagcuuccaucucc

SEQ ID NO: 389177 - RNA, 64 nt, Homo Sapiens
ugggcaacagagugaaacucugucucaaaaauaauaauaauaaaaaaaagcuuccaucucccag

SEQ ID NO: 389178 - RNA, 64 nt, Homo Sapiens
ucuucuuacuuugauaacucuucuuaguuuaaaauaauaauaauaacacaucuuuggucaucua

SEQ ID NO: 389179 - RNA, 64 nt, Homo Sapiens
ucuuacuuugauaacucuucuuaguuuaaaauaauaauaauaacacaucuuuggucaucuaugu

SEQ ID NO: 389180 - RNA, 64 nt, Homo Sapiens
gcuggagacuuggccacaccucaaauaauaauaauaauaauaaacaagagagcaagacucuguc

SEQ ID NO: 389181 - RNA, 64 nt, Homo Sapiens
aaagcuggagacuuggccacgucucaaauaauaauaauaauaaugggcaagagagcaagacucu

SEQ ID NO: 389182 - RNA, 64 nt, Homo Sapiens
aauaaagcuggagacuuggcucugucucaaauaauaauaauaauccugggcaagagagcaagac

SEQ ID NO: 389183 - RNA, 64 nt, Homo Sapiens
aauaauaaagcuggagacuugacucugucucaaauaauaauaaucagccugggcaagagagcaa

SEQ ID NO: 389184 - RNA, 64 nt, Homo Sapiens
ccgugugacucuuuccauauguauaacguggggauaauaauaauagcugcuucacaggaugaaa

SEQ ID NO: 389185 - RNA, 64 nt, Homo Sapiens
ugugacucuuuccauauguauaacguggggauaauaauaauagcugcuucacaggaugaaauga

SEQ ID NO: 389186 - RNA, 64 nt, Homo Sapiens
aaaagcauaauugaaaguucugaaaaaagaaaaauaauaauauguagaaaaauguaacuuagag

SEQ ID NO: 389187 - RNA, 64 nt, Homo Sapiens
auuacagacugucugaaauugaagaagaaugaacuaauaauagcauucauaaccaaacacaaug

SEQ ID NO: 389188 - RNA, 64 nt, Homo Sapiens
gcaucauugaaacuacuacaaugauacuaucauuuaauaauauuaauauuacuugaaauagacu

SEQ ID NO: 389189 - RNA, 64 nt, Homo Sapiens
auggugaauuaucucuacuaaaaauacaaaaaaauaauaauaauagccaggcgugguggcacau

SEQ ID NO: 389190 - RNA, 64 nt, Homo Sapiens
gugaauuaucucuacuaaaaauacaaaaaaauaauaauaauagccaggcgugguggcacaugcc

SEQ ID NO: 389191 - RNA, 64 nt, Homo Sapiens
aaauauuaaaaagguauuauaaagguauuuaaaauaauaauaauaaaguguuauuuuccuggga

SEQ ID NO: 389192 - RNA, 64 nt, Homo Sapiens
uauuaaaaagguauuauaaagguauuuaaaauaauaauaauaaaguguuauuuuccugggauuc

SEQ ID NO: 389193 - RNA, 64 nt, Homo Sapiens
guagcauggacauuugaucaaccuuuaguuggaauaauaauauucauauuugcuaugaauccuu

SEQ ID NO: 389194 - RNA, 64 nt, Homo Sapiens
uuuguguguuuguguguuuuuuuaagugcuguauuaauaauacuuucugaaagaaaaggacacu

SEQ ID NO: 389195 - RNA, 64 nt, Homo Sapiens
gugucuuccauuguuaaaugaugauuaaaaauaauaauaauaaaaagaguugaaauguugagag

SEQ ID NO: 389196 - RNA, 64 nt, Homo Sapiens
aaagugucuuccauuguuaagagaugauuaaaaauaauaauaauaccaagaguugaaauguuga

SEQ ID NO: 389197 - RNA, 64 nt, Homo Sapiens
uuucauagccaaacuuguauauuuaaauucuuuguaauaauaauauccaaaucaucaucuugug

SEQ ID NO: 389198 - RNA, 64 nt, Homo Sapiens
cauagccaaacuuguauauuuaaauucuuuguaauaauaauauccaaaucaucaucuuguguca

SEQ ID NO: 389199 - RNA, 64 nt, Homo Sapiens
gggccaagugcaguccugucuugauuaaauuacuuaauaauauuauuaaauaauaauaggucug

SEQ ID NO: 389200 - RNA, 64 nt, Homo Sapiens
ugucuugauuaaauuacuuaauaauauuauuaaauaauaauaggucugggcaguauuguuuuua

SEQ ID NO: 389201 - RNA, 64 nt, Homo Sapiens
cauugacccagacauauuguacucuuucuaaaaauaauaauaauaaugcuaacagaaagaagag

SEQ ID NO: 389202 - RNA, 64 nt, Homo Sapiens
ugacccagacauauuguacucuuucuaaaaauaauaauaauaaugcuaacagaaagaagagaac

SEQ ID NO: 389203 - RNA, 64 nt, Homo Sapiens
aaaaauaugauaaagugaaacacaguaauaauaauaauaauaacaggaaagauaaugaugguaa

SEQ ID NO: 389204 - RNA, 64 nt, Homo Sapiens
aacaaaaauaugauaaaguguaacacaguaauaauaauaauaauuagaggaaagauaaugaugg

SEQ ID NO: 389205 - RNA, 64 nt, Homo Sapiens
aauaacaaaaauaugauaaaugguaacacaguaauaauaauaaucucuagaggaaagauaauga

SEQ ID NO: 389206 - RNA, 64 nt, Homo Sapiens
aauaauaacaaaaauaugauugaugguaacacaguaauaauaaucugcucuagaggaaagauaa

SEQ ID NO: 389207 - RNA, 64 nt, Homo Sapiens
ucaguuuagcuaccuccuguccacacugaaagggcaccuacagggacugcucagaugacccuag

SEQ ID NO: 389208 - RNA, 64 nt, Homo Sapiens
uuuguuuuaguuuggugccaggcagaaugcagaacaccuacauuuguuucagcauuauaagaaa

SEQ ID NO: 389209 - RNA, 64 nt, Homo Sapiens
cagcauuugggaugccagggaacagagagugagacaccuacaaucaccagucucaaaugcgcua

SEQ ID NO: 389210 - RNA, 64 nt, Homo Sapiens
ucauuugcagugguuagucaucagauauuuuagccaccuacacaaaagcaaacugcauuuuuaa

SEQ ID NO: 389211 - RNA, 64 nt, Homo Sapiens
agccgugcaggacucuagcucaugaguggaaagucaccuacaggacugggccgggcccagggcc

SEQ ID NO: 389212 - RNA, 64 nt, Homo Sapiens
gggacaugggaaugaauugaaauggggcgcuggacaccuacagcagcacgcaugucccuccaag

SEQ ID NO: 389213 - RNA, 64 nt, Homo Sapiens
gccaacucucugaucagggugugcgguguggaugcaccuacaagaaaugugucuguucacggag

SEQ ID NO: 389214 - RNA, 64 nt, Homo Sapiens
gccauuagaguaucuaucggcccugaguaaucaucaccuacaugacuucaaaagaagacaguuu

SEQ ID NO: 389215 - RNA, 64 nt, Homo Sapiens; identical to SEQ ID NO: 376628

SEQ ID NO: 389216 - RNA, 64 nt, Homo Sapiens; identical to SEQ ID NO: 376629

SEQ ID NO: 389217 - RNA, 64 nt, Homo Sapiens; identical to SEQ ID NO: 376630

SEQ ID NO: 389218 - RNA, 64 nt, Homo Sapiens; identical to SEQ ID NO: 376631

SEQ ID NO: 389219 - RNA, 64 nt, Homo Sapiens; identical to SEQ ID NO: 376632

SEQ ID NO: 389220 - RNA, 64 nt, Homo Sapiens; identical to SEQ ID NO: 376633

SEQ ID NO: 389221 - RNA, 64 nt, Homo Sapiens; identical to SEQ ID NO: 376634

SEQ ID NO: 389222 - RNA, 64 nt, Homo Sapiens; identical to SEQ ID NO: 376635

SEQ ID NO: 389223 - RNA, 64 nt, Homo Sapiens; identical to SEQ ID NO: 376636

SEQ ID NO: 389224 - RNA, 64 nt, Homo Sapiens; identical to SEQ ID NO: 376637

SEQ ID NO: 389225 - RNA, 64 nt, Homo Sapiens; identical to SEQ ID NO: 376638

SEQ ID NO: 389226 - RNA, 64 nt, Homo Sapiens; identical to SEQ ID NO: 376639

SEQ ID NO: 389227 - RNA, 64 nt, Homo Sapiens; identical to SEQ ID NO: 376640

SEQ ID NO: 389228 - RNA, 64 nt, Homo Sapiens; identical to SEQ ID NO: 376641

SEQ ID NO: 389229 - RNA, 64 nt, Homo Sapiens; identical to SEQ ID NO: 376642

SEQ ID NO: 389230 - RNA, 64 nt, Homo Sapiens; identical to SEQ ID NO: 376643

SEQ ID NO: 389231 - RNA, 64 nt, Homo Sapiens; identical to SEQ ID NO: 376644

SEQ ID NO: 389232 - RNA, 64 nt, Homo Sapiens; identical to SEQ ID NO: 376645

SEQ ID NO: 389233 - RNA, 64 nt, Homo Sapiens; identical to SEQ ID NO: 376646

SEQ ID NO: 389234 - RNA, 64 nt, Homo Sapiens; identical to SEQ ID NO: 376647

SEQ ID NO: 389235 - RNA, 64 nt, Homo Sapiens; identical to SEQ ID NO: 376648

SEQ ID NO: 389236 - RNA, 64 nt, Homo Sapiens; identical to SEQ ID NO: 376649

SEQ ID NO: 389237 - RNA, 64 nt, Homo Sapiens; identical to SEQ ID NO: 376650

SEQ ID NO: 389238 - RNA, 64 nt, Homo Sapiens; identical to SEQ ID NO: 376651

SEQ ID NO: 389239 - RNA, 64 nt, Homo Sapiens; identical to SEQ ID NO: 376652

SEQ ID NO: 389240 - RNA, 64 nt, Homo Sapiens; identical to SEQ ID NO: 376653

SEQ ID NO: 389241 - RNA, 64 nt, Homo Sapiens; identical to SEQ ID NO: 376654

SEQ ID NO: 389242 - RNA, 64 nt, Homo Sapiens; identical to SEQ ID NO: 376655

SEQ ID NO: 389243 - RNA, 64 nt, Homo Sapiens; identical to SEQ ID NO: 376656

SEQ ID NO: 389244 - RNA, 64 nt, Homo Sapiens; identical to SEQ ID NO: 376657

SEQ ID NO: 389245 - RNA, 64 nt, Homo Sapiens; identical to SEQ ID NO: 376658

SEQ ID NO: 389246 - RNA, 58 nt, Homo Sapiens; identical to SEQ ID NO: 376659

SEQ ID NO: 389247 - RNA, 64 nt, Homo Sapiens; identical to SEQ ID NO: 376660

SEQ ID NO: 389248 - RNA, 64 nt, Homo Sapiens; identical to SEQ ID NO: 376661

SEQ ID NO: 389249 - RNA, 64 nt, Homo Sapiens; identical to SEQ ID NO: 376662

SEQ ID NO: 389250 - RNA, 64 nt, Homo Sapiens; identical to SEQ ID NO: 376663

SEQ ID NO: 389251 - RNA, 64 nt, Homo Sapiens; identical to SEQ ID NO: 376664

SEQ ID NO: 389252 - RNA, 64 nt, Homo Sapiens; identical to SEQ ID NO: 376665

SEQ ID NO: 389253 - RNA, 64 nt, Homo Sapiens; identical to SEQ ID NO: 376666

SEQ ID NO: 389254 - RNA, 64 nt, Homo Sapiens; identical to SEQ ID NO: 376667

SEQ ID NO: 389255 - RNA, 64 nt, Homo Sapiens; identical to SEQ ID NO: 332949

SEQ ID NO: 389256 - RNA, 64 nt, Homo Sapiens; identical to SEQ ID NO: 332950

SEQ ID NO: 389257 - RNA, 64 nt, Homo Sapiens; identical to SEQ ID NO: 332951

SEQ ID NO: 389258 - RNA, 64 nt, Homo Sapiens; identical to SEQ ID NO: 332952

SEQ ID NO: 389259 - RNA, 64 nt, Homo Sapiens; identical to SEQ ID NO: 332953

SEQ ID NO: 389260 - RNA, 64 nt, Homo Sapiens; identical to SEQ ID NO: 332954

SEQ ID NO: 389261 - RNA, 64 nt, Homo Sapiens; identical to SEQ ID NO: 332955

SEQ ID NO: 389262 - RNA, 64 nt, Homo Sapiens; identical to SEQ ID NO: 332956

SEQ ID NO: 389263 - RNA, 64 nt, Homo Sapiens; identical to SEQ ID NO: 332957

SEQ ID NO: 389264 - RNA, 64 nt, Homo Sapiens; identical to SEQ ID NO: 332958

SEQ ID NO: 389265 - RNA, 64 nt, Homo Sapiens; identical to SEQ ID NO: 332959

SEQ ID NO: 389266 - RNA, 64 nt, Homo Sapiens; identical to SEQ ID NO: 332960

SEQ ID NO: 389267 - RNA, 64 nt, Homo Sapiens; identical to SEQ ID NO: 332961

SEQ ID NO: 389268 - RNA, 64 nt, Homo Sapiens; identical to SEQ ID NO: 332962

SEQ ID NO: 389269 - RNA, 64 nt, Homo Sapiens; identical to SEQ ID NO: 332963

SEQ ID NO: 389270 - RNA, 64 nt, Homo Sapiens; identical to SEQ ID NO: 332964

SEQ ID NO: 389271 - RNA, 64 nt, Homo Sapiens; identical to SEQ ID NO: 332965

SEQ ID NO: 389272 - RNA, 64 nt, Homo Sapiens; identical to SEQ ID NO: 332966

SEQ ID NO: 389273 - RNA, 64 nt, Homo Sapiens; identical to SEQ ID NO: 332967

SEQ ID NO: 389274 - RNA, 64 nt, Homo Sapiens; identical to SEQ ID NO: 332968

SEQ ID NO: 389275 - RNA, 64 nt, Homo Sapiens; identical to SEQ ID NO: 332969

SEQ ID NO: 389276 - RNA, 64 nt, Homo Sapiens; identical to SEQ ID NO: 332970

SEQ ID NO: 389277 - RNA, 64 nt, Homo Sapiens; identical to SEQ ID NO: 332971

SEQ ID NO: 389278 - RNA, 64 nt, Homo Sapiens; identical to SEQ ID NO: 332972

SEQ ID NO: 389279 - RNA, 64 nt, Homo Sapiens; identical to SEQ ID NO: 332973

SEQ ID NO: 389280 - RNA, 64 nt, Homo Sapiens; identical to SEQ ID NO: 332974

SEQ ID NO: 389281 - RNA, 64 nt, Homo Sapiens; identical to SEQ ID NO: 332975

SEQ ID NO: 389282 - RNA, 64 nt, Homo Sapiens; identical to SEQ ID NO: 332976

SEQ ID NO: 389283 - RNA, 64 nt, Homo Sapiens; identical to SEQ ID NO: 332977

SEQ ID NO: 389284 - RNA, 53 nt, Homo Sapiens; identical to SEQ ID NO: 332978

SEQ ID NO: 389285 - RNA, 64 nt, Homo Sapiens; identical to SEQ ID NO: 332979

SEQ ID NO: 389286 - RNA, 64 nt, Homo Sapiens; identical to SEQ ID NO: 332980

SEQ ID NO: 389287 - RNA, 64 nt, Homo Sapiens; identical to SEQ ID NO: 332981

SEQ ID NO: 389288 - RNA, 64 nt, Homo Sapiens; identical to SEQ ID NO: 332982

SEQ ID NO: 389289 - RNA, 64 nt, Homo Sapiens; identical to SEQ ID NO: 332983

SEQ ID NO: 389290 - RNA, 64 nt, Homo Sapiens; identical to SEQ ID NO: 332984

SEQ ID NO: 389291 - RNA, 64 nt, Homo Sapiens; identical to SEQ ID NO: 332985

SEQ ID NO: 389292 - RNA, 64 nt, Homo Sapiens; identical to SEQ ID NO: 332986

SEQ ID NO: 389293 - RNA, 64 nt, Homo Sapiens; identical to SEQ ID NO: 332987

SEQ ID NO: 389294 - RNA, 64 nt, Homo Sapiens; identical to SEQ ID NO: 332988

SEQ ID NO: 389295 - RNA, 64 nt, Homo Sapiens; identical to SEQ ID NO: 332989

SEQ ID NO: 389296 - RNA, 64 nt, Homo Sapiens; identical to SEQ ID NO: 332990

SEQ ID NO: 389297 - RNA, 64 nt, Homo Sapiens; identical to SEQ ID NO: 332991

SEQ ID NO: 389298 - RNA, 64 nt, Homo Sapiens; identical to SEQ ID NO: 332992

SEQ ID NO: 389299 - RNA, 64 nt, Homo Sapiens; identical to SEQ ID NO: 332993

SEQ ID NO: 389300 - RNA, 64 nt, Homo Sapiens; identical to SEQ ID NO: 332994

SEQ ID NO: 389301 - RNA, 64 nt, Homo Sapiens; identical to SEQ ID NO: 332995

SEQ ID NO: 389302 - RNA, 64 nt, Homo Sapiens
aaagcuuuuuugcauguacuugauacucagucuguaaacucagacuucgcuuuuuuugugagac

SEQ ID NO: 389303 - RNA, 64 nt, Homo Sapiens
acuaggugaaaugcaaaacaaccaucaauuuuuuuaaacucaauaauuuugugaaaaaaaaaac

SEQ ID NO: 389304 - RNA, 64 nt, Homo Sapiens
aaaucuucauuaugaaauauuaucaguugcuuuauaaacucacucuuuuuauggauccuucaug

SEQ ID NO: 389305 - RNA, 64 nt, Homo Sapiens
gcuccaguaucuaaaaauuuuaucaccaggggaauaaacucaauacacauucauuaaacuuuug

SEQ ID NO: 389306 - RNA, 64 nt, Homo Sapiens
ucuuuucccuuuauucaagcuaagccagaagcuguaaacucaucaaucaaauagaguuacucuc

SEQ ID NO: 389307 - RNA, 64 nt, Homo Sapiens
gagauuauuuuuucaucugugggcaagucaccuauaaacucacuaauuucaggucuguagucuu

SEQ ID NO: 389308 - RNA, 64 nt, Homo Sapiens
ccuuuaauuaaccaauucauagcuucuuuuccauuaaacucauacuacucacucuuucauucau

SEQ ID NO: 389309 - RNA, 64 nt, Homo Sapiens
augcuuuggugaguuuuucuccacaacacaggucuaaacucagcaaaaaaacaaaggugagaaa

SEQ ID NO: 389310 - RNA, 64 nt, Homo Sapiens
caagaaauauguucagccaaacacaaaagccacauaaacucaagccaugaacuucagccugucc

SEQ ID NO: 389311 - RNA, 64 nt, Homo Sapiens
ggagucuaguuccaaauuugguguuuguuuuaacuaaacucauugaagaaaguucuucaccaua

SEQ ID NO: 389312 - RNA, 64 nt, Homo Sapiens
cuuaauauauuucuaaauguuuggcauguaaauguaaacucagcaucaaaauauuucagugaau

SEQ ID NO: 389313 - RNA, 64 nt, Homo Sapiens
agugaauuugcacuguuuaaucauaguuacuguguaaacucaucugaaauguuacaaaaauaaa

SEQ ID NO: 389314 - RNA, 64 nt, Homo Sapiens
ugauuuuaaauuaaagaucuguuuucuccaugaauaaacucacucccaaggguguuuuguuacu

SEQ ID NO: 389315 - RNA, 64 nt, Homo Sapiens
cacuuugcucagagaaguguaacccacgcagaaguaaacucagcugaucacacuguugccuugg

SEQ ID NO: 389316 - RNA, 64 nt, Homo Sapiens
aaacucauaauguugauauacuuugauuagaaaauaaacucauaaaacaggcugacacuauucu

SEQ ID NO: 389317 - RNA, 64 nt, Homo Sapiens
gguugaugaaagccaaaaccaaucaaagauggauuaaacucaguuauaauacuaaaacucagag

SEQ ID NO: 389318 - RNA, 64 nt, Homo Sapiens
ggguucgaggcugcuugcuuuuguuguuguuuuguaaacucagacccuuguaagccccuuccuu

SEQ ID NO: 389319 - RNA, 64 nt, Homo Sapiens
gcuaggaggcuggaaagccauuuauccuaggacauaaacucagauuuugggggucaguuugugu

SEQ ID NO: 389320 - RNA, 64 nt, Homo Sapiens
gagccacuggcccggcggcacaaccaaaucuuauuaaacucacccuaggcuggccgcggugacu

SEQ ID NO: 389321 - RNA, 64 nt, Homo Sapiens
agaucgagacccugccugaaaauaaaucaauaaauaaacucaaccgaaauggguaugaaaguug

SEQ ID NO: 389322 - RNA, 64 nt, Homo Sapiens
cuuccagcuguuccauucucuccaccaccagcguaacuggcaaguuaccaagguuguuccugaa

SEQ ID NO: 389323 - RNA, 64 nt, Homo Sapiens
agucugguaaauaaccacaguguaggaacuaucuaacuggcauuuguguuucuugcgaguauuu

SEQ ID NO: 389324 - RNA, 64 nt, Homo Sapiens
uguuauuuuuaggauucugcauagauuucuuuuaaacuggcauucuugccuaaugauguuaucu

SEQ ID NO: 389325 - RNA, 64 nt, Homo Sapiens
caccuauuuuuuagugaugaaauuuuucuuugagaacuggcaaggaugcagucagcuguuugca

SEQ ID NO: 389326 - RNA, 64 nt, Homo Sapiens
gggaccuccuaguuccacgugcuaucauucuacuaacuggcacccuaagguugaaagugcuuau

SEQ ID NO: 389327 - RNA, 64 nt, Homo Sapiens
uacagucuggaacugacaauaugcaggagcaguaaacuggcagaaaaccaggaaucagagaaag

SEQ ID NO: 389328 - RNA, 62 nt, Homo Sapiens
cagagcagagaagcagagauguuccuugaacugcccacaaguuuucaauaacuuuuauuucu

SEQ ID NO: 389329 - RNA, 62 nt, Homo Sapiens
uaaacccaugaguuuaugcccugggcuccuuagcccacaauaguguaauaaaagugccccgg

SEQ ID NO: 389330 - RNA, 62 nt, Homo Sapiens
auaacuauuauuuuagccuuuagcuauuuggggcccacaaaauaaagaaagaaauucaaaag

SEQ ID NO: 389331 - RNA, 62 nt, Homo Sapiens
uugcuucuuugcuuuugcuccucuuccgaguugcccacaaacggaaaugagaauaugauccc

SEQ ID NO: 389332 - RNA, 62 nt, Homo Sapiens
gcuucaguuguccuccacagcacugauuugcagcccacaagcuggcagguuuaucugucuca

SEQ ID NO: 389333 - RNA, 62 nt, Homo Sapiens
gaagauuaaaugugcaaaaccugcuugacugugcccacaaauccugauuguaggaauaaauu

SEQ ID NO: 389334 - RNA, 64 nt, Homo Sapiens; identical to SEQ ID NO: 48842

SEQ ID NO: 389335 - RNA, 64 nt, Homo Sapiens; identical to SEQ ID NO: 48843

SEQ ID NO: 389336 - RNA, 64 nt, Homo Sapiens; identical to SEQ ID NO: 48844

SEQ ID NO: 389337 - RNA, 64 nt, Homo Sapiens; identical to SEQ ID NO: 48845

SEQ ID NO: 389338 - RNA, 64 nt, Homo Sapiens; identical to SEQ ID NO: 361784

SEQ ID NO: 389339 - RNA, 64 nt, Homo Sapiens; identical to SEQ ID NO: 361785

SEQ ID NO: 389340 - RNA, 64 nt, Homo Sapiens; identical to SEQ ID NO: 361786

SEQ ID NO: 389341 - RNA, 64 nt, Homo Sapiens; identical to SEQ ID NO: 361787

SEQ ID NO: 389342 - RNA, 64 nt, Homo Sapiens; identical to SEQ ID NO: 361788

SEQ ID NO: 389343 - RNA, 64 nt, Homo Sapiens; identical to SEQ ID NO: 361789

SEQ ID NO: 389344 - RNA, 64 nt, Homo Sapiens; identical to SEQ ID NO: 361790

SEQ ID NO: 389345 - RNA, 64 nt, Homo Sapiens; identical to SEQ ID NO: 361791

SEQ ID NO: 389346 - RNA, 64 nt, Homo Sapiens; identical to SEQ ID NO: 361792

SEQ ID NO: 389347 - RNA, 64 nt, Homo Sapiens; identical to SEQ ID NO: 361793

SEQ ID NO: 389348 - RNA, 64 nt, Homo Sapiens; identical to SEQ ID NO: 361794

SEQ ID NO: 389349 - RNA, 64 nt, Homo Sapiens; identical to SEQ ID NO: 361795

SEQ ID NO: 389350 - RNA, 64 nt, Homo Sapiens; identical to SEQ ID NO: 361796

SEQ ID NO: 389351 - RNA, 64 nt, Homo Sapiens; identical to SEQ ID NO: 361797

SEQ ID NO: 389352 - RNA, 64 nt, Homo Sapiens; identical to SEQ ID NO: 361798

SEQ ID NO: 389353 - RNA, 64 nt, Homo Sapiens; identical to SEQ ID NO: 361799

SEQ ID NO: 389354 - RNA, 64 nt, Homo Sapiens; identical to SEQ ID NO: 361800

SEQ ID NO: 389355 - RNA, 64 nt, Homo Sapiens; identical to SEQ ID NO: 361801

SEQ ID NO: 389356 - RNA, 64 nt, Homo Sapiens; identical to SEQ ID NO: 361802

SEQ ID NO: 389357 - RNA, 64 nt, Homo Sapiens; identical to SEQ ID NO: 361803

SEQ ID NO: 389358 - RNA, 64 nt, Homo Sapiens; identical to SEQ ID NO: 361804

SEQ ID NO: 389359 - RNA, 64 nt, Homo Sapiens; identical to SEQ ID NO: 361805

SEQ ID NO: 389360 - RNA, 64 nt, Homo Sapiens; identical to SEQ ID NO: 361806

SEQ ID NO: 389361 - RNA, 64 nt, Homo Sapiens; identical to SEQ ID NO: 361807

SEQ ID NO: 389362 - RNA, 64 nt, Homo Sapiens; identical to SEQ ID NO: 361808

SEQ ID NO: 389363 - RNA, 64 nt, Homo Sapiens; identical to SEQ ID NO: 361809

SEQ ID NO: 389364 - RNA, 64 nt, Homo Sapiens
cacccagcuuucucccagccacagccaagauucccaaagucaaggcccaaagauuuccaagguu

SEQ ID NO: 389365 - RNA, 64 nt, Homo Sapiens
cccaaagucaaggcccaaagauuuccaagguucccaaagucaaggccaggccaaggccugguug

SEQ ID NO: 389366 - RNA, 64 nt, Homo Sapiens
uaaaaggugucuugguuugacguugauaaaaaugcaaagucaaaguugugugauuuuuugccau

SEQ ID NO: 389367 - RNA, 64 nt, Homo Sapiens
uauaccagaggcuuaggaggaugaagugcacagccaaagucaugaacaaaaaggugaagucuaa

SEQ ID NO: 389368 - RNA, 64 nt, Homo Sapiens
gagucaaggaaaaagagaagauguuugacuugcucaaagucaagcagguaaugucagaauugaa

SEQ ID NO: 389369 - RNA, 64 nt, Homo Sapiens
cuuuauagauuugcaguucugguuuauauaauaccaaagucacauacagguaauuucccaccau

SEQ ID NO: 389370 - RNA, 64 nt, Homo Sapiens
uuuauuuugagucaugagauaaucaauuuuaacccaaagucauuggauuauuuauaugaagucc

SEQ ID NO: 389371 - RNA, 64 nt, Homo Sapiens
caguauccuguacuagcuuauaauauucccauaccaaagucauggggaaacaaacauuauuuug

SEQ ID NO: 389372 - RNA, 64 nt, Homo Sapiens
uugauuugcccccagcuguccccaucuuaguucacaaagucaggccuccagccccuacuucccu

SEQ ID NO: 389373 - RNA, 64 nt, Homo Sapiens
uggacugcugagugagaggguuaaaaugaagggacaaagucaacuggggguuuuuuuuguuuuu

SEQ ID NO: 389374 - RNA, 64 nt, Homo Sapiens
cccaacgcguccucucacaccaagcccacauuuccaaagucaccaggagagguucuguagaauc

SEQ ID NO: 389375 - RNA, 64 nt, Homo Sapiens
aauuguguuaaccacguguacuggggaccaguuccaaagucagugaagacuugcaauuugaaaa

SEQ ID NO: 389376 - RNA, 64 nt, Homo Sapiens
aaaucuuuugaucuuucccuaucuugauuagauccaaagucaaagcaaccauacuucaccuaga

SEQ ID NO: 389377 - RNA, 64 nt, Homo Sapiens
ggcaaucaugacaccuguaauaaaaacuugaauccaaagucaaaacuuaagcaagauacaaaug

SEQ ID NO: 389378 - RNA, 64 nt, Homo Sapiens
agccauaaaaauuaacuugugauuuuuuuuuucccaaagucaugcuuuuccuuaauuauauuuu

SEQ ID NO: 389379 - RNA, 64 nt, Homo Sapiens
uauacaaccaaccguucgugagucaucaaaaagucaaagucagccuggccaacauggcaaaacu

SEQ ID NO: 389380 - RNA, 64 nt, Homo Sapiens
gaccuugucucaaaaaacaacaacaacaaaaagucaaagucauaauaagcaaauuauuggcuuc

SEQ ID NO: 389381 - RNA, 64 nt, Homo Sapiens
uuggagacagaaaaagacaaaguuucaaaaaugacaaagucaguuugagaggaauguuuacagc

SEQ ID NO: 389382 - RNA, 64 nt, Homo Sapiens
gucacaugccacauuugaucguuccacucaucuacaaagucacacagaaagaguuauggcagag

SEQ ID NO: 389383 - RNA, 64 nt, Homo Sapiens
aacauuagccuagaaguuuuuuaaauuuauuuuucaaagucaagugggauuacuuagccaaggc

SEQ ID NO: 389384 - RNA, 52 nt, Homo Sapiens
guuuucuccucuuauauuuugacaaagucaggcuguugaaaauuccauuuga

SEQ ID NO: 389385 - RNA, 64 nt, Homo Sapiens
ugggaguacugcaaccugacuacacgauggaucccaaagucagacuguggaaggcccuuggugu

SEQ ID NO: 389386 - RNA, 64 nt, Homo Sapiens
ugggaguacugcaaccugacuauacaacggaucccaaagucaggguucggcaggcccuuggugu

SEQ ID NO: 389387 - RNA, 64 nt, Homo Sapiens
gaguacaacuugcauaugucuuuaccuguaagggcaaagucaauuagaaaaagcaaucuguuua

SEQ ID NO: 389388 - RNA, 64 nt, Homo Sapiens
gcguucauaggcaaaaucugcuucuuuauagcuacaaagucagggcacacacacacacacauac

SEQ ID NO: 389389 - RNA, 64 nt, Homo Sapiens
ugcaggaaggacaauguugguuaauaauaaaucucaaagucaauuguagaaaaaaaauugucuu

SEQ ID NO: 389390 - RNA, 64 nt, Homo Sapiens
auuguuacguucaaaguuuaaagugauauauuaacaaagucaccuaguuauacaaacaauuguc

SEQ ID NO: 389391 - RNA, 64 nt, Homo Sapiens
caggaugggagaaugaggaguaaaaugcucacggcaaagucagcagcacugguaagccaagacu

SEQ ID NO: 389392 - RNA, 64 nt, Homo Sapiens
gaagcugccucuuguaauucaugcaggaagaugucaaagucagccccaucuuggcugaucaggg

SEQ ID NO: 389393 - RNA, 64 nt, Homo Sapiens
gaaagacaaucuuuauaguugaaagaaagcaaagcaaagucaguuuucccucacagaaagaaac

SEQ ID NO: 389394 - RNA, 64 nt, Homo Sapiens
aacacucgguccccuugaaguuguagccuaagaucaaagucaaccauuguuuuuaaaaagcaca

SEQ ID NO: 389395 - RNA, 64 nt, Homo Sapiens
uaucuccauuugauggggguuuaaaugauuugcucaaagucauuuagggguaauaaauacuugg

SEQ ID NO: 389396 - RNA, 64 nt, Homo Sapiens
cagcaguuuuccuugcuuuuuauaugcagaauaucaaagucauuucuaauuuaguugucaaaaa

SEQ ID NO: 389397 - RNA, 64 nt, Homo Sapiens
aaccaacaguuuccauuuaugucaaugcuaaauccaaagucacuucagaguuuguuuuccacca

SEQ ID NO: 389398 - RNA, 64 nt, Homo Sapiens
auuugccauuuggacaguuaacauccagguguuacaaagucaguguuaauucuaaagaugauca

SEQ ID NO: 389399 - RNA, 64 nt, Homo Sapiens
aaagaugguuuuaccuuuacuuucuuagacacaucaaagucaagugguuugauugauuuccuuu

SEQ ID NO: 389400 - RNA, 64 nt, Homo Sapiens
ggauuugaaccugcaucuggucaucagucaaauccaaagucaaauaauccacuguccauguucc

SEQ ID NO: 389401 - RNA, 64 nt, Homo Sapiens
agaccuuaggccaggagaugaaggaguucaguagcaaagucacaccuguccaauucccugagcu

SEQ ID NO: 389402 - RNA, 64 nt, Homo Sapiens
gugacucuacacacacuucaggugguuugugcuucaaagucauugaugcaacuugaaaggaaac

SEQ ID NO: 389403 - RNA, 64 nt, Homo Sapiens
cucaaaaaaaaaaaaaaaaaaaaaaaaaaagcuccaaagucaccucugucaaagccacagucug

SEQ ID NO: 389404 - RNA, 64 nt, Homo Sapiens
ccaggcagggucuggccccgggcugcugggcucacaaagucacacuagaccacagugacgaucu

SEQ ID NO: 389405 - RNA, 63 nt, Homo Sapiens
uugacugguggggcaacugaaucugcuuugcagcaaagucacccuuacaaagaagcuaauaug

SEQ ID NO: 389406 - RNA, 64 nt, Homo Sapiens
ccagcugugauucuccugauaauucaagggagcucaaagucacaagaagaaaaaugaaaggaaa

SEQ ID NO: 389407 - RNA, 64 nt, Homo Sapiens
cugucacccuugaagugaguuccaccugaccagucuugagcagccaacaggcucaauuaagccc

SEQ ID NO: 389408 - RNA, 64 nt, Homo Sapiens
cccagcuacucaggaggcugaggcaggaggaucacuugagcacaggaguuugaggcugcaguga

SEQ ID NO: 389409 - RNA, 64 nt, Homo Sapiens
aaagcuacagaacuguauuguuuuuauuuuccuucuugagcacauguuaacaaacuaagcuuca

SEQ ID NO: 389410 - RNA, 64 nt, Homo Sapiens
guuuugcuuaugaaaugucauuuaaaguucacuucuugagcaucaauaaaaagggaagcugugu

SEQ ID NO: 389411 - RNA, 64 nt, Homo Sapiens
uuaagccaggcgggcugggaagcuugaagugcaccuugagcagguucuccuggcagcguuuaaa

SEQ ID NO: 389412 - RNA, 64 nt, Homo Sapiens
ccugugccagauccuccccuaugcugaccucacucuugagcagcgcuuucagcuggaccacuca

SEQ ID NO: 389413 - RNA, 64 nt, Homo Sapiens
aaccaagauguagacuaacauaaagaaacacuuucuugagcaccagguguuaaaaaccauuaua

SEQ ID NO: 389414 - RNA, 64 nt, Homo Sapiens
ugaggacagacagaaggcaaaguuuccauguggccuugagcaagucccaucucaccucuaggcc

SEQ ID NO: 389415 - RNA, 64 nt, Homo Sapiens
aggauauaaauaacucccacaccuuggcgaugaccuugagcaguuuuugaauuuuuccaaucac

SEQ ID NO: 389416 - RNA, 64 nt, Homo Sapiens
ggaguucaagaccagcguggaggugggaggauaacuugagcacacccagcuacuugggaggcug

SEQ ID NO: 389417 - RNA, 64 nt, Homo Sapiens
cucccacugcuggagugcgaacggaaugccuggucuugagcaacaagggacaccccagccaggg

SEQ ID NO: 389418 - RNA, 64 nt, Homo Sapiens
cucagaucaucucugucacucccuuccagcucaccuugagcagcccaccuaccagugcccaugu

SEQ ID NO: 389419 - RNA, 64 nt, Homo Sapiens
cucgugccugucuccuuugcguguugcgcugccucuugagcagccucaaggaguccaggugacg

SEQ ID NO: 389420 - RNA, 64 nt, Homo Sapiens
gcucuuauuucuggugaggagccuucuuaggcuucuugagcagauaugggaguugcuaaauuug

SEQ ID NO: 389421 - RNA, 64 nt, Homo Sapiens
uucucuguuugacucucaaccaacuucagaucuaugacauuauucugaucacuggcuccaucau

SEQ ID NO: 389422 - RNA, 64 nt, Homo Sapiens
uagugaggaacauuuuacaauuauuuacaguguuugacauuaauugcuguccuaugauacagua

SEQ ID NO: 389423 - RNA, 64 nt, Homo Sapiens
aacacugaccucauguaggcaccuuaccaauauaugacauuaagugagagugaaucccuuagga

SEQ ID NO: 389424 - RNA, 64 nt, Homo Sapiens
gaaaucaauaucugcagccacuguuacuuuuaauugacauuaagagacacuucauagguuccca

SEQ ID NO: 389425 - RNA, 64 nt, Homo Sapiens
ugacauuugcuuuuuuucaacuuguucuuuugggugacauuaacgaaauauuugaguaaaaucc

SEQ ID NO: 389426 - RNA, 64 nt, Homo Sapiens
caacucagugaaacaacaucacagcagaaucucuugacauuacauuguguguucuauuuuagua

SEQ ID NO: 389427 - RNA, 64 nt, Homo Sapiens
aaucuaaaggauauuauugugccauuucaauaaaugacauuaaacauaaguuucuguuaugauu

SEQ ID NO: 389428 - RNA, 64 nt, Homo Sapiens
uuucauaaaugaagcauaaccccugaaauacuguugacauuaacaaacuuguuuccuugaugag

SEQ ID NO: 389429 - RNA, 64 nt, Homo Sapiens
acacuauaagugauaguuucccccauccuuucauugacauuauuugccaaugcugccagucauu

SEQ ID NO: 389430 - RNA, 64 nt, Homo Sapiens
auaguuuacuuaucugacuuugauauuagauggcugacauuagugcacauaaugcagaguuuaa

SEQ ID NO: 389431 - RNA, 64 nt, Homo Sapiens
cuguuuauguuaagaggacuguuuaagcauuaauugacauuaaauugaguugacuuaacauuga

SEQ ID NO: 389432 - RNA, 64 nt, Homo Sapiens
guuaaaugagcacugaccugcaucaagcauuaauugacauuacaaugccauuaguauagcaagc

SEQ ID NO: 389433 - RNA, 64 nt, Homo Sapiens
ggaagagaauauuuuccauuguuuuuggugacucugacauuaauauguguaaauuuuauugucu

SEQ ID NO: 389434 - RNA, 64 nt, Homo Sapiens
uucucauuugcuuuguauggggguagaaaugaauugacauuauuucuccuaagaacuagguuug

SEQ ID NO: 389435 - RNA, 64 nt, Homo Sapiens; identical to SEQ ID NO: 219904

SEQ ID NO: 389436 - RNA, 64 nt, Homo Sapiens; identical to SEQ ID NO: 219905

SEQ ID NO: 389437 - RNA, 64 nt, Homo Sapiens; identical to SEQ ID NO: 219906

SEQ ID NO: 389438 - RNA, 64 nt, Homo Sapiens; identical to SEQ ID NO: 219907

SEQ ID NO: 389439 - RNA, 64 nt, Homo Sapiens; identical to SEQ ID NO: 219908

SEQ ID NO: 389440 - RNA, 64 nt, Homo Sapiens; identical to SEQ ID NO: 219909

SEQ ID NO: 389441 - RNA, 64 nt, Homo Sapiens; identical to SEQ ID NO: 219910

SEQ ID NO: 389442 - RNA, 64 nt, Homo Sapiens; identical to SEQ ID NO: 219911

SEQ ID NO: 389443 - RNA, 64 nt, Homo Sapiens
caucuuggcucacugcaaccucuaccuccuggguucaagcaaaucuccugccucagccuccaaa

SEQ ID NO: 389444 - RNA, 64 nt, Homo Sapiens
aaucucggcucacugcaaccuccgccucccagguucaagcaauucuccugccucagccucccga

SEQ ID NO: 389445 - RNA, 64 nt, Homo Sapiens
auucagcccugaaaucaggccccgaggcuuguggucaagcaaaaucauaggcgaaucuguucug

SEQ ID NO: 389446 - RNA, 64 nt, Homo Sapiens
aucgacuugaucaguucagcaguuggugaguuugucaagcaacuuagacgauuggccauucuaa

SEQ ID NO: 389447 - RNA, 64 nt, Homo Sapiens
uauugaauuuuaaaauaaccucaaacuccugggcucaagcaaugccguuuugcccaggcugguc

SEQ ID NO: 389448 - RNA, 64 nt, Homo Sapiens
cucucaccucagccugcugaccugccucucaggcucaagcaaacaaucuugccucacugcaacg

SEQ ID NO: 389449 - RNA, 64 nt, Homo Sapiens
ccauuuacuuaaugugaaguagucuucucaaguuucaagcaagacuuaaaccucacuagaggga

SEQ ID NO: 389450 - RNA, 64 nt, Homo Sapiens
guugaagggaaggugcauauggaauuuaacuuacucaagcaauauucagccauuuauuaauaug

SEQ ID NO: 389451 - RNA, 64 nt, Homo Sapiens
cuauguugcccaggcuggucuugaacuccuggccucaagcaauccucucuccucagccucccaa

SEQ ID NO: 389452 - RNA, 64 nt, Homo Sapiens
caucauagcucacuguagccucgaccuuccgggaucaagcaaucccacuucagccucuugaaua

SEQ ID NO: 389453 - RNA, 64 nt, Homo Sapiens
cuauguuguccagccuagucucaaacuccuggguucaagcaauccucccaccucggccucccaa

SEQ ID NO: 389454 - RNA, 64 nt, Homo Sapiens
cuccugccucggccucccaaucaaccuccugggcucaagcaaucccauguugcccaggcugguc

SEQ ID NO: 389455 - RNA, 64 nt, Homo Sapiens
cucccaccucagccucccaaucugccuccugggcucaagcaauuaaucucggcucacugcaacc

SEQ ID NO: 389456 - RNA, 64 nt, Homo Sapiens
cuccugccucagccucccgauccgucucuuagguucaagcaauugaucucagcucacugcaacc

SEQ ID NO: 389457 - RNA, 64 nt, Homo Sapiens
cuccugccucagucuccugauccaccucccagguucaagcaauuaaucucggcucacugcaacc

SEQ ID NO: 389458 - RNA, 64 nt, Homo Sapiens
uguuucaaaauauuauauuauuucauaaauaauuucaagcaaauacagacauccacaauguaga

SEQ ID NO: 389459 - RNA, 64 nt, Homo Sapiens
ggcuuacugcagccucacccucgauuuccugggcucaagcaauccucccaccucagcccccaag

SEQ ID NO: 389460 - RNA, 64 nt, Homo Sapiens
caccugccuuggccucccaaucaaacuuguggccucaagcaaucuuuuguugccaaagcugguc

SEQ ID NO: 389461 - RNA, 64 nt, Homo Sapiens
cuccugccucagccuuccaaucauacuccugggcucaagcaaucgaucauagcucacugcagcc

SEQ ID NO: 389462 - RNA, 64 nt, Homo Sapiens
acacagaaauccugaguucuucucauugguggacucaagcaauucuguagcaaauaaauccuuu

SEQ ID NO: 389463 - RNA, 64 nt, Homo Sapiens
gaucucugcucacugcaacauccaccucccagguucaagcaauucuccugccucagccucccaa

SEQ ID NO: 389464 - RNA, 64 nt, Homo Sapiens
uuuaugguuacuaugauuguuauuauuuguccaaucaagcaaagcaccauuauuucuaacauau

SEQ ID NO: 389465 - RNA, 64 nt, Homo Sapiens
cugcuuauauauuuucauauucuaacuugucuuuucaagcaaauaacuaauauauaugugcaug

SEQ ID NO: 389466 - RNA, 64 nt, Homo Sapiens
ugccagccucagccucucaauugaacuccugggcucaagcaaucccaugucgcccaggcugauc

SEQ ID NO: 389467 - RNA, 64 nt, Homo Sapiens
cucaugccucggccucuccaucugccucuuggguucaagcaauugaucucggcucacugcaacc

SEQ ID NO: 389468 - RNA, 64 nt, Homo Sapiens
gaaccacagagccaggaggaaugucugagcagagucaagcaacuggcuugaccacagucugaag

SEQ ID NO: 389469 - RNA, 64 nt, Homo Sapiens
caacagccucacucuaagaggcuuuuuugcugagucaagcaaacacuugccugcucugccccuu

SEQ ID NO: 389470 - RNA, 64 nt, Homo Sapiens
gaucucggcucaccacaaucgcugccuccuggguucaagcaauucuccugccucagccucccga

SEQ ID NO: 389471 - RNA, 64 nt, Homo Sapiens
aaucauaccucauugcagccucagacuccuggguucaagcaauccuccugccucagccucccaa

SEQ ID NO: 389472 - RNA, 64 nt, Homo Sapiens
ucuugacauucacucauuagaagaccuuacuccuucaagcaaauguuuggggucaaauuuacca

SEQ ID NO: 389473 - RNA, 64 nt, Homo Sapiens
cuuggugaaauauaaugaauuuguuccuaccuugucaagcaagaaugucgucuucuccuaugga

SEQ ID NO: 389474 - RNA, 64 nt, Homo Sapiens
uuaaucaaugaucaucucacuuugacuagccaucucaagcaaguaucucaagcaaguuucgacg

SEQ ID NO: 389475 - RNA, 64 nt, Homo Sapiens
uucgacguuugacuagccauuuugacuagccaucucaagcaaguuuuuucuuugauuuucgacg

SEQ ID NO: 389476 - RNA, 64 nt, Homo Sapiens
aucauagcucacugcagccucgaacucuugggcuucaagcaauccuccugugucagccaccaga

SEQ ID NO: 389477 - RNA, 64 nt, Homo Sapiens
cuuuguuucccaggcuggucuugaauuccugggaucaagcaauccuuccaccuugcccucccaa

SEQ ID NO: 389478 - RNA, 64 nt, Homo Sapiens
cuccugccuuggccucccaaucaaaccccugggcucaagcaagcaccauuugccccagcugguc

SEQ ID NO: 389479 - RNA, 64 nt, Homo Sapiens
cuccugccucugccucccaauggaccucccaagcucaagcaaucugauuacagcucauguagcc

SEQ ID NO: 389480 - RNA, 64 nt, Homo Sapiens
cuccugccucagccuccugauccacuucucagguucaagcaauuaaucuuggcucacugcaacc

SEQ ID NO: 389481 - RNA, 64 nt, Homo Sapiens
cuucugccucagccuuccaauguaaccucuggguucaagcaauuguggugugauccuggcucac

SEQ ID NO: 389482 - RNA, 64 nt, Homo Sapiens
cuccugccgcagccucccaauccgccucccggauucaagcaauugaucgcggcucaccgcaacc

SEQ ID NO: 389483 - RNA, 64 nt, Homo Sapiens
agcaggcugggcaccccuuacaucuagcacugagucaagcaaucgauucugaggucucuucucu

SEQ ID NO: 389484 - RNA, 64 nt, Homo Sapiens
cuccugccucagccucccaaucugccucccagguucaagcaauuaaucucggcucacugcaacc

SEQ ID NO: 389485 - RNA, 64 nt, Homo Sapiens
cuccugccucagucucccaauccuccucccagguucaagcaauugaucucagcucacugcaacc

SEQ ID NO: 389486 - RNA, 64 nt, Homo Sapiens
caugguauagggaaacuugaccacuuauucaccaucaagcaaucaacccuuuagugggcaguca

SEQ ID NO: 389487 - RNA, 64 nt, Homo Sapiens
uacaugacuguuggaccugcucaaaccauuuucuucaagcaaagucuugaccauaacauauuca

SEQ ID NO: 389488 - RNA, 64 nt, Homo Sapiens
caaagauuaucuauacacaaugaaaauagaauuuucaagcaacuaauaaacugggaaaagaguu

SEQ ID NO: 389489 - RNA, 64 nt, Homo Sapiens
cuccugccucagccucccaaucugccuccugacuucaagcaauugcaguuguuucaccguaacc

SEQ ID NO: 389490 - RNA, 64 nt, Homo Sapiens
cuccuucuucagccucccgauccaccuccuggguucaagcaauuagucuuggcucacugcaacc

SEQ ID NO: 389491 - RNA, 64 nt, Homo Sapiens
cuccuucuucagccucccgauccaccucccggguucaagcaauugaucuuggcucacugcaacc

SEQ ID NO: 389492 - RNA, 64 nt, Homo Sapiens; identical to SEQ ID NO: 265069

SEQ ID NO: 389493 - RNA, 64 nt, Homo Sapiens; identical to SEQ ID NO: 265070

SEQ ID NO: 389494 - RNA, 64 nt, Homo Sapiens; identical to SEQ ID NO: 265071

SEQ ID NO: 389495 - RNA, 64 nt, Homo Sapiens; identical to SEQ ID NO: 265072

SEQ ID NO: 389496 - RNA, 64 nt, Homo Sapiens; identical to SEQ ID NO: 265073

SEQ ID NO: 389497 - RNA, 64 nt, Homo Sapiens; identical to SEQ ID NO: 265074

SEQ ID NO: 389498 - RNA, 64 nt, Homo Sapiens; identical to SEQ ID NO: 265075

SEQ ID NO: 389499 - RNA, 64 nt, Homo Sapiens; identical to SEQ ID NO: 265076

SEQ ID NO: 389500 - RNA, 64 nt, Homo Sapiens
acauuagcuuuguaucauguuuggauaauucaucaauguucacaguuuaaaacaucauuaaaca

SEQ ID NO: 389501 - RNA, 64 nt, Homo Sapiens
uuugaccugucacuguacuaucuacauguggaagaauguucaaguugaauccuaaugccgugaa

SEQ ID NO: 389502 - RNA, 64 nt, Homo Sapiens
aacucccauuugguaaaccaguugauuauuuggaaauguucacugccaaaauaguaagugcuau

SEQ ID NO: 389503 - RNA, 64 nt, Homo Sapiens
aaacugugauaagacaugaaaauuauauuauuaaaauguucaauuguaaugguaaucaugagua

SEQ ID NO: 389504 - RNA, 64 nt, Homo Sapiens
ucaaguuuuuaaacaugauuuauauguucuguauaauguucaguuuguaacuuuuuaaaaguuu

SEQ ID NO: 389505 - RNA, 64 nt, Homo Sapiens
aguugauaauuggucucuaguagcuuacugucaaaauguucaaugaagucuucuguucaucugu

SEQ ID NO: 389506 - RNA, 64 nt, Homo Sapiens
uuaagagcagacuuaaaguagcuuuguacgccuuaauguucauuuugauuuauuuuaaaucuuu

SEQ ID NO: 389507 - RNA, 64 nt, Homo Sapiens
ugcaaucacuuuaauaguuucuuuuuagcaaauaaauguucauugaugaagugccuggguauuu

SEQ ID NO: 389508 - RNA, 64 nt, Homo Sapiens
uaagagaaucacucuccuuaccuaguuaucuacaaauguucauuccagaaauguuuaguuacug

SEQ ID NO: 389509 - RNA, 64 nt, Homo Sapiens
ugucaucaucaaaacaacucauaacauacuuuaaaauguucagguagcagugagcauuguucau

SEQ ID NO: 389510 - RNA, 64 nt, Homo Sapiens
uauaauuauauuugacauuuuguucacaucaacuaauguucaccuguagaagagaacaaauuuc

SEQ ID NO: 389511 - RNA, 64 nt, Homo Sapiens
uaugugcaaauugucaaaauguaaauuaaauauaaauguucaugcuuuaccaaaauuugucuag

SEQ ID NO: 389512 - RNA, 64 nt, Homo Sapiens
cuguauuacucuuugccguccauuuuuaaaaccaaauguucaaucgcuaaguggagacauuuca

SEQ ID NO: 389513 - RNA, 64 nt, Homo Sapiens
ugggaagaggguugcugaaauuacauuacaaggaaauguucaugagaagauuaaaagucauaca

SEQ ID NO: 389514 - RNA, 64 nt, Homo Sapiens
ggacauacuugaucuguauuuccauuuggaugcuaauguucauuuuuuacacuuucugcacauc

SEQ ID NO: 389515 - RNA, 64 nt, Homo Sapiens
gccauagguuauggucuugcuucuguaagguuuaaauguucacagggggcauugaucucaguuu

SEQ ID NO: 389516 - RNA, 64 nt, Homo Sapiens
ugcagucccagcuacuuggguagccaagugugguaauguucaccacccugucucuacuaaaaau

SEQ ID NO: 389517 - RNA, 64 nt, Homo Sapiens
cuuuauagauaacuuuauugaaagaaugcuaaagaauguucaaagaagaaugugguugcuaaac

SEQ ID NO: 389518 - RNA, 64 nt, Homo Sapiens
uucacguucuagugaaacuggacaauuaugaaaaaauguucaaauuauuuuuauaaaacugccu

SEQ ID NO: 389519 - RNA, 64 nt, Homo Sapiens
uagccagggauugaaguuuauguauaaguccaugaauguucauacacaauaauuuguuuucauu

SEQ ID NO: 389520 - RNA, 64 nt, Homo Sapiens
guauuugaaguuuuccucagguuuuuuaaaauaaaauguucauuccaaguggugaguuaguuag

SEQ ID NO: 389521 - RNA, 64 nt, Homo Sapiens
cuccuuccaagaacaaaguguuuaaguucuguuuaauguucauuuaauauaaauagucucugau

SEQ ID NO: 389522 - RNA, 64 nt, Homo Sapiens
gaaagauagacagaaaaaugucaucauauugaaaaauguucaaagaguagcacuauuuauuuuu

SEQ ID NO: 389523 - RNA, 64 nt, Homo Sapiens
acguugauacuuugacgaguaaauuguacagucaaauguucauugauuucauguuauuucaaag

SEQ ID NO: 389524 - RNA, 64 nt, Homo Sapiens
uuauucuauugacagacaugguguacugaucagaaauguucaguuuuaacuaaaacuaaauuua

SEQ ID NO: 389525 - RNA, 64 nt, Homo Sapiens
uacugugauguugucuucaaaggcaggagaaaauaauguucacaauaaaaugugcuaacaaugu

SEQ ID NO: 389526 - RNA, 64 nt, Homo Sapiens
acacuuaagaauacuggccuuugaauguucaaauaauguucauucuuuguuaaccuuucaugug

SEQ ID NO: 389527 - RNA, 64 nt, Homo Sapiens
uaauguucauuacacuuaagccuuucauguguugaauguucaaaaaguucauagccuuuguuaa

SEQ ID NO: 389528 - RNA, 64 nt, Homo Sapiens
augucauuuaguguccaacugaguuucaacuuuaaauguucacugaaaauauuugguagacaaa

SEQ ID NO: 389529 - RNA, 64 nt, Homo Sapiens
ccaguugugaagcuggagaauugagcaguugagcaauguucaguuuuugacauagguaauguug

SEQ ID NO: 389530 - RNA, 64 nt, Homo Sapiens
cauuuuuguaaugcuguacagcaguucacaaaaaaauguucauuguagauuuuguuauguucaa

SEQ ID NO: 389531 - RNA, 64 nt, Homo Sapiens
uugcuaacaauuguuagcaaacuauuucagugauaauguucauuuugaaaauauguacuguaua

SEQ ID NO: 389532 - RNA, 64 nt, Homo Sapiens
aaauacaaaaaaaaacuuauaaaauguuuaaaaaaauguucaaagcuugggagaaaagcuuucu

SEQ ID NO: 389533 - RNA, 64 nt, Homo Sapiens
uuccccccaaaauacacaaagcaaauaaggccaaaauguucauuguugaaucugcaguggcugg

SEQ ID NO: 389534 - RNA, 64 nt, Homo Sapiens
cacugcauuaaauaacaacaccuccacuguguuuaauguucacuuggacuguucccucuucucc

SEQ ID NO: 389535 - RNA, 64 nt, Homo Sapiens
uaucucauccacucaguuuucaguagucuccuugaauguucaagguguacccugugcuguugcu

SEQ ID NO: 389536 - RNA, 64 nt, Homo Sapiens
ugugugccuguuucaucuaaucaagcagagcuaaaauguucauaccgaauaaauuuauauuaau

SEQ ID NO: 389537 - RNA, 64 nt, Homo Sapiens
uguaccuuagaaguacaagaauuuaaguaaaagaaauguucauuuuuguuuuaaaauuuguuuu

SEQ ID NO: 389538 - RNA, 64 nt, Homo Sapiens
gaggaaaaaaaggggaaguuaaaacauucagacaaauguucaguaaaacauguucagugaggaa

SEQ ID NO: 389539 - RNA, 64 nt, Homo Sapiens
gugagugaggaaaacauguucacaguuucagacaaauguucaguucuugaagcaacaaagcagc

SEQ ID NO: 389540 - RNA, 64 nt, Homo Sapiens
auuuugggugggaggcuacuggcauauauuuuuaaauguucauauugcguagaaucuccacuag

SEQ ID NO: 389541 - RNA, 64 nt, Homo Sapiens
uauaugaaaccuuguucauuccuccgaguacuguaauguucacacuuguacaaucuucccuguc

SEQ ID NO: 389542 - RNA, 64 nt, Homo Sapiens; identical to SEQ ID NO: 125533

SEQ ID NO: 389543 - RNA, 64 nt, Homo Sapiens; identical to SEQ ID NO: 125534

SEQ ID NO: 389544 - RNA, 64 nt, Homo Sapiens; identical to SEQ ID NO: 125535

SEQ ID NO: 389545 - RNA, 64 nt, Homo Sapiens; identical to SEQ ID NO: 125536

SEQ ID NO: 389546 - RNA, 64 nt, Homo Sapiens; identical to SEQ ID NO: 125537

SEQ ID NO: 389547 - RNA, 64 nt, Homo Sapiens; identical to SEQ ID NO: 125538

SEQ ID NO: 389548 - RNA, 64 nt, Homo Sapiens; identical to SEQ ID NO: 125539

SEQ ID NO: 389549 - RNA, 64 nt, Homo Sapiens; identical to SEQ ID NO: 125540

SEQ ID NO: 389550 - RNA, 64 nt, Homo Sapiens; identical to SEQ ID NO: 125541

SEQ ID NO: 389551 - RNA, 64 nt, Homo Sapiens; identical to SEQ ID NO: 125542

SEQ ID NO: 389552 - RNA, 64 nt, Homo Sapiens; identical to SEQ ID NO: 125543

SEQ ID NO: 389553 - RNA, 64 nt, Homo Sapiens; identical to SEQ ID NO: 125544

SEQ ID NO: 389554 - RNA, 64 nt, Homo Sapiens; identical to SEQ ID NO: 125545

SEQ ID NO: 389555 - RNA, 64 nt, Homo Sapiens; identical to SEQ ID NO: 125546

SEQ ID NO: 389556 - RNA, 64 nt, Homo Sapiens; identical to SEQ ID NO: 125547

SEQ ID NO: 389557 - RNA, 64 nt, Homo Sapiens; identical to SEQ ID NO: 125548

SEQ ID NO: 389558 - RNA, 64 nt, Homo Sapiens; identical to SEQ ID NO: 125549

SEQ ID NO: 389559 - RNA, 64 nt, Homo Sapiens; identical to SEQ ID NO: 125550

SEQ ID NO: 389560 - RNA, 64 nt, Homo Sapiens; identical to SEQ ID NO: 125551

SEQ ID NO: 389561 - RNA, 64 nt, Homo Sapiens; identical to SEQ ID NO: 125552

SEQ ID NO: 389562 - RNA, 64 nt, Homo Sapiens; identical to SEQ ID NO: 125553

SEQ ID NO: 389563 - RNA, 64 nt, Homo Sapiens; identical to SEQ ID NO: 125554

SEQ ID NO: 389564 - RNA, 64 nt, Homo Sapiens; identical to SEQ ID NO: 125555

SEQ ID NO: 389565 - RNA, 64 nt, Homo Sapiens; identical to SEQ ID NO: 125556

SEQ ID NO: 389566 - RNA, 64 nt, Homo Sapiens; identical to SEQ ID NO: 125557

SEQ ID NO: 389567 - RNA, 64 nt, Homo Sapiens; identical to SEQ ID NO: 125558

SEQ ID NO: 389568 - RNA, 64 nt, Homo Sapiens; identical to SEQ ID NO: 125559

SEQ ID NO: 389569 - RNA, 64 nt, Homo Sapiens; identical to SEQ ID NO: 125560

SEQ ID NO: 389570 - RNA, 64 nt, Homo Sapiens; identical to SEQ ID NO: 125561

SEQ ID NO: 389571 - RNA, 64 nt, Homo Sapiens; identical to SEQ ID NO: 125562

SEQ ID NO: 389572 - RNA, 64 nt, Homo Sapiens; identical to SEQ ID NO: 125563

SEQ ID NO: 389573 - RNA, 64 nt, Homo Sapiens; identical to SEQ ID NO: 125564

SEQ ID NO: 389574 - RNA, 64 nt, Homo Sapiens; identical to SEQ ID NO: 125565

SEQ ID NO: 389575 - RNA, 64 nt, Homo Sapiens; identical to SEQ ID NO: 125566

SEQ ID NO: 389576 - RNA, 64 nt, Homo Sapiens; identical to SEQ ID NO: 125567

SEQ ID NO: 389577 - RNA, 64 nt, Homo Sapiens; identical to SEQ ID NO: 125568

SEQ ID NO: 389578 - RNA, 64 nt, Homo Sapiens; identical to SEQ ID NO: 270835

SEQ ID NO: 389579 - RNA, 64 nt, Homo Sapiens; identical to SEQ ID NO: 270836

SEQ ID NO: 389580 - RNA, 64 nt, Homo Sapiens; identical to SEQ ID NO: 270837

SEQ ID NO: 389581 - RNA, 64 nt, Homo Sapiens; identical to SEQ ID NO: 270838

SEQ ID NO: 389582 - RNA, 64 nt, Homo Sapiens
aggcgugagaguguggguuuuaaauucgaagcucaggccauaguuucagagaaucacccuuacc

SEQ ID NO: 389583 - RNA, 64 nt, Homo Sapiens
ucugugugccucaguuuuccuauuuguaaaauagaggccauagugguaccuauuuugaagacua

SEQ ID NO: 389584 - RNA, 64 nt, Homo Sapiens
aacuccccuacaucaaaugcagaaacaccgagugaggccauagcaagagaaagucaccugccca

SEQ ID NO: 389585 - RNA, 64 nt, Homo Sapiens
aauuccccuacaucaaaugccgaaacaccaagugaggccauagcgaaauuaagaaaaagucgcc

SEQ ID NO: 389586 - RNA, 64 nt, Homo Sapiens
ggggauaggauuuugcaacaaaaagcugacccagaggccauacagagcaggaauaucccauugc

SEQ ID NO: 389587 - RNA, 64 nt, Homo Sapiens
uaaugauuggcacucuucagccaggggaguggguaggccauagccaaggaucgauuccccaacc

SEQ ID NO: 389588 - RNA, 64 nt, Homo Sapiens
ggcuauuugccuaguaggauuuaaaaaauauuuucaaagugaagcugagagagaaucuuggaaa

SEQ ID NO: 389589 - RNA, 64 nt, Homo Sapiens
ggauguucugcaggcccagcaaacucaucauguccaaagugaaacuuuuucucuuuccugucuc

SEQ ID NO: 389590 - RNA, 64 nt, Homo Sapiens
gcuguugauaccucagagccuucucuuuacucuccaaagugaaagggaagcccccgucucucua

SEQ ID NO: 389591 - RNA, 64 nt, Homo Sapiens
cauuccaggcagaggaacaggaugugcacugccccaaagugagaacuugcucuacguggucagg

SEQ ID NO: 389592 - RNA, 64 nt, Homo Sapiens
uuuauaaagguaacuccagugauuccugcuacugcaaagugaauucaucaagaaccugcaugau

SEQ ID NO: 389593 - RNA, 64 nt, Homo Sapiens
ucuugcauccauaacaucuucauuuugaguggaacaaagugaccuucuuuuuaguuuuggggau

SEQ ID NO: 389594 - RNA, 64 nt, Homo Sapiens
agguuaggaaggcagacucuaagcuuuaguaaaacaaagugaugggaacuucuuguuuaaaauu

SEQ ID NO: 389595 - RNA, 64 nt, Homo Sapiens
guaccuaggauuguaacuuaauauagcuaguucccaaagugauuuuugauuaucuuuagaugug

SEQ ID NO: 389596 - RNA, 64 nt, Homo Sapiens
ggguuuucgacuuccuaucguuugcagaaagaugcaaagugauuguugauuggguggggaauuu

SEQ ID NO: 389597 - RNA, 64 nt, Homo Sapiens
uagaaguuguuuucucuuaccuguaaaguuuugucaaagugaguugucuaauuaggggccaagu

SEQ ID NO: 389598 - RNA, 64 nt, Homo Sapiens
gagccuugccugaccucuucggugcugaccuucccaaagugaugccuuacugguuuuguacuaa

SEQ ID NO: 389599 - RNA, 64 nt, Homo Sapiens
gucauauuuuuacuuuagugucacucaccuuuuacaaagugacuuuguacucauuuagggcucu

SEQ ID NO: 389600 - RNA, 64 nt, Homo Sapiens
cuccagaaggaccuaggagaguaggugagcuuuccaaagugagagacgaaucuuucuuucuuuu

SEQ ID NO: 389601 - RNA, 64 nt, Homo Sapiens
uguggccccggaggaaggagagacugaggcaaggcaaagugauaguacacggaagcagaaccgg

SEQ ID NO: 389602 - RNA, 64 nt, Homo Sapiens
gugcuuguggugcaaagaucuucaugcccaguuccaaagugaggucccucccaaaguuguuuuc

SEQ ID NO: 389603 - RNA, 64 nt, Homo Sapiens
cuucaguucucgugguccauaggggcagagaugucaaagugaagguugccugagugaagggaga

SEQ ID NO: 389604 - RNA, 64 nt, Homo Sapiens
ugccuggauucacauuaaaaucuuuucaaaaaaacaaagugaaauagggaagaagauuaaacuc

SEQ ID NO: 389605 - RNA, 64 nt, Homo Sapiens
ucuaagaaaaugugaggcuaaagggggaaaaugacaaagugagcuaaauuuggcagaguaucaa

SEQ ID NO: 389606 - RNA, 64 nt, Homo Sapiens
gaaugauggguucuugccugacagggguaacagucaaagugaaguccugucccucuuccuaagg

SEQ ID NO: 389607 - RNA, 64 nt, Homo Sapiens
agaagauuguacuuccuagaggccccuccuuuuccaaagugaccgaugaugucuggcaucgucu

SEQ ID NO: 389608 - RNA, 64 nt, Homo Sapiens
guagugagcaaaacaucagauuucaccaaagaaccaaagugacuccacaauugggaugccgaca

SEQ ID NO: 389609 - RNA, 64 nt, Homo Sapiens
augaagcagaugaguuuguagcagggccacaaaacaaagugaaacguccaggggaacccaacag

SEQ ID NO: 389610 - RNA, 64 nt, Homo Sapiens; identical to SEQ ID NO: 91802

SEQ ID NO: 389611 - RNA, 64 nt, Homo Sapiens; identical to SEQ ID NO: 91803

SEQ ID NO: 389612 - RNA, 64 nt, Homo Sapiens; identical to SEQ ID NO: 91804

SEQ ID NO: 389613 - RNA, 64 nt, Homo Sapiens; identical to SEQ ID NO: 91805

SEQ ID NO: 389614 - RNA, 64 nt, Homo Sapiens; identical to SEQ ID NO: 91806

SEQ ID NO: 389615 - RNA, 64 nt, Homo Sapiens; identical to SEQ ID NO: 91807

SEQ ID NO: 389616 - RNA, 64 nt, Homo Sapiens; identical to SEQ ID NO: 91808

SEQ ID NO: 389617 - RNA, 64 nt, Homo Sapiens; identical to SEQ ID NO: 91809

SEQ ID NO: 389618 - RNA, 64 nt, Homo Sapiens; identical to SEQ ID NO: 91810

SEQ ID NO: 389619 - RNA, 64 nt, Homo Sapiens; identical to SEQ ID NO: 91811

SEQ ID NO: 389620 - RNA, 64 nt, Homo Sapiens; identical to SEQ ID NO: 91812

SEQ ID NO: 389621 - RNA, 64 nt, Homo Sapiens; identical to SEQ ID NO: 91813

SEQ ID NO: 389622 - RNA, 64 nt, Homo Sapiens; identical to SEQ ID NO: 91814

SEQ ID NO: 389623 - RNA, 64 nt, Homo Sapiens; identical to SEQ ID NO: 91815

SEQ ID NO: 389624 - RNA, 64 nt, Homo Sapiens; identical to SEQ ID NO: 91816

SEQ ID NO: 389625 - RNA, 64 nt, Homo Sapiens; identical to SEQ ID NO: 91817

SEQ ID NO: 389626 - RNA, 64 nt, Homo Sapiens; identical to SEQ ID NO: 91818

SEQ ID NO: 389627 - RNA, 64 nt, Homo Sapiens; identical to SEQ ID NO: 91819

SEQ ID NO: 389628 - RNA, 64 nt, Homo Sapiens; identical to SEQ ID NO: 91820

SEQ ID NO: 389629 - RNA, 64 nt, Homo Sapiens; identical to SEQ ID NO: 91821

SEQ ID NO: 389630 - RNA, 64 nt, Homo Sapiens; identical to SEQ ID NO: 91822

SEQ ID NO: 389631 - RNA, 64 nt, Homo Sapiens; identical to SEQ ID NO: 91823

SEQ ID NO: 389632 - RNA, 64 nt, Homo Sapiens; identical to SEQ ID NO: 91824

SEQ ID NO: 389633 - RNA, 64 nt, Homo Sapiens; identical to SEQ ID NO: 91825

SEQ ID NO: 389634 - RNA, 64 nt, Homo Sapiens; identical to SEQ ID NO: 91826

SEQ ID NO: 389635 - RNA, 64 nt, Homo Sapiens; identical to SEQ ID NO: 91827

SEQ ID NO: 389636 - RNA, 64 nt, Homo Sapiens; identical to SEQ ID NO: 91828

SEQ ID NO: 389637 - RNA, 64 nt, Homo Sapiens; identical to SEQ ID NO: 91829

SEQ ID NO: 389638 - RNA, 64 nt, Homo Sapiens; identical to SEQ ID NO: 91830

SEQ ID NO: 389639 - RNA, 64 nt, Homo Sapiens; identical to SEQ ID NO: 91831

SEQ ID NO: 389640 - RNA, 64 nt, Homo Sapiens; identical to SEQ ID NO: 91832

SEQ ID NO: 389641 - RNA, 64 nt, Homo Sapiens; identical to SEQ ID NO: 91833

SEQ ID NO: 389642 - RNA, 64 nt, Homo Sapiens; identical to SEQ ID NO: 91834

SEQ ID NO: 389643 - RNA, 64 nt, Homo Sapiens; identical to SEQ ID NO: 91835

SEQ ID NO: 389644 - RNA, 64 nt, Homo Sapiens; identical to SEQ ID NO: 91836

SEQ ID NO: 389645 - RNA, 64 nt, Homo Sapiens; identical to SEQ ID NO: 91837

SEQ ID NO: 389646 - RNA, 64 nt, Homo Sapiens; identical to SEQ ID NO: 91838

SEQ ID NO: 389647 - RNA, 64 nt, Homo Sapiens; identical to SEQ ID NO: 91839

SEQ ID NO: 389648 - RNA, 64 nt, Homo Sapiens; identical to SEQ ID NO: 91840

SEQ ID NO: 389649 - RNA, 64 nt, Homo Sapiens; identical to SEQ ID NO: 91841

SEQ ID NO: 389650 - RNA, 64 nt, Homo Sapiens; identical to SEQ ID NO: 91842

SEQ ID NO: 389651 - RNA, 64 nt, Homo Sapiens; identical to SEQ ID NO: 91843

SEQ ID NO: 389652 - RNA, 64 nt, Homo Sapiens; identical to SEQ ID NO: 91844

SEQ ID NO: 389653 - RNA, 64 nt, Homo Sapiens; identical to SEQ ID NO: 91845

SEQ ID NO: 389654 - RNA, 64 nt, Homo Sapiens; identical to SEQ ID NO: 91846

SEQ ID NO: 389655 - RNA, 64 nt, Homo Sapiens; identical to SEQ ID NO: 91847

SEQ ID NO: 389656 - RNA, 64 nt, Homo Sapiens; identical to SEQ ID NO: 91848

SEQ ID NO: 389657 - RNA, 64 nt, Homo Sapiens; identical to SEQ ID NO: 91849

SEQ ID NO: 389658 - RNA, 64 nt, Homo Sapiens; identical to SEQ ID NO: 91850

SEQ ID NO: 389659 - RNA, 64 nt, Homo Sapiens; identical to SEQ ID NO: 91851

SEQ ID NO: 389660 - RNA, 64 nt, Homo Sapiens; identical to SEQ ID NO: 91852

SEQ ID NO: 389661 - RNA, 64 nt, Homo Sapiens; identical to SEQ ID NO: 91853

SEQ ID NO: 389662 - RNA, 64 nt, Homo Sapiens; identical to SEQ ID NO: 91854

SEQ ID NO: 389663 - RNA, 64 nt, Homo Sapiens; identical to SEQ ID NO: 91855

SEQ ID NO: 389664 - RNA, 64 nt, Homo Sapiens; identical to SEQ ID NO: 91856

SEQ ID NO: 389665 - RNA, 64 nt, Homo Sapiens; identical to SEQ ID NO: 91857

SEQ ID NO: 389666 - RNA, 64 nt, Homo Sapiens; identical to SEQ ID NO: 91858

SEQ ID NO: 389667 - RNA, 64 nt, Homo Sapiens; identical to SEQ ID NO: 91859

SEQ ID NO: 389668 - RNA, 64 nt, Homo Sapiens; identical to SEQ ID NO: 91860

SEQ ID NO: 389669 - RNA, 64 nt, Homo Sapiens; identical to SEQ ID NO: 91861

SEQ ID NO: 389670 - RNA, 64 nt, Homo Sapiens; identical to SEQ ID NO: 91862

SEQ ID NO: 389671 - RNA, 64 nt, Homo Sapiens; identical to SEQ ID NO: 111411

SEQ ID NO: 389672 - RNA, 64 nt, Homo Sapiens; identical to SEQ ID NO: 111412

SEQ ID NO: 389673 - RNA, 64 nt, Homo Sapiens; identical to SEQ ID NO: 111413

SEQ ID NO: 389674 - RNA, 64 nt, Homo Sapiens; identical to SEQ ID NO: 111414

SEQ ID NO: 389675 - RNA, 64 nt, Homo Sapiens; identical to SEQ ID NO: 111415

SEQ ID NO: 389676 - RNA, 64 nt, Homo Sapiens; identical to SEQ ID NO: 111416

SEQ ID NO: 389677 - RNA, 64 nt, Homo Sapiens; identical to SEQ ID NO: 111417

SEQ ID NO: 389678 - RNA, 64 nt, Homo Sapiens; identical to SEQ ID NO: 111418

SEQ ID NO: 389679 - RNA, 64 nt, Homo Sapiens; identical to SEQ ID NO: 111419

SEQ ID NO: 389680 - RNA, 64 nt, Homo Sapiens; identical to SEQ ID NO: 111420

SEQ ID NO: 389681 - RNA, 64 nt, Homo Sapiens; identical to SEQ ID NO: 111421

SEQ ID NO: 389682 - RNA, 64 nt, Homo Sapiens; identical to SEQ ID NO: 111422

SEQ ID NO: 389683 - RNA, 64 nt, Homo Sapiens; identical to SEQ ID NO: 111423

SEQ ID NO: 389684 - RNA, 64 nt, Homo Sapiens; identical to SEQ ID NO: 111424

SEQ ID NO: 389685 - RNA, 64 nt, Homo Sapiens; identical to SEQ ID NO: 111425

SEQ ID NO: 389686 - RNA, 64 nt, Homo Sapiens; identical to SEQ ID NO: 111426

SEQ ID NO: 389687 - RNA, 64 nt, Homo Sapiens; identical to SEQ ID NO: 111427

SEQ ID NO: 389688 - RNA, 64 nt, Homo Sapiens; identical to SEQ ID NO: 111428

SEQ ID NO: 389689 - RNA, 64 nt, Homo Sapiens; identical to SEQ ID NO: 111429

SEQ ID NO: 389690 - RNA, 64 nt, Homo Sapiens; identical to SEQ ID NO: 111430

SEQ ID NO: 389691 - RNA, 64 nt, Homo Sapiens; identical to SEQ ID NO: 111431

SEQ ID NO: 389692 - RNA, 64 nt, Homo Sapiens; identical to SEQ ID NO: 111432

SEQ ID NO: 389693 - RNA, 64 nt, Homo Sapiens; identical to SEQ ID NO: 111433

SEQ ID NO: 389694 - RNA, 64 nt, Homo Sapiens; identical to SEQ ID NO: 111434

SEQ ID NO: 389695 - RNA, 58 nt, Homo Sapiens; identical to SEQ ID NO: 111435

SEQ ID NO: 389696 - RNA, 64 nt, Homo Sapiens; identical to SEQ ID NO: 111436

SEQ ID NO: 389697 - RNA, 64 nt, Homo Sapiens; identical to SEQ ID NO: 111437

SEQ ID NO: 389698 - RNA, 64 nt, Homo Sapiens; identical to SEQ ID NO: 111438

SEQ ID NO: 389699 - RNA, 64 nt, Homo Sapiens; identical to SEQ ID NO: 111439

SEQ ID NO: 389700 - RNA, 64 nt, Homo Sapiens; identical to SEQ ID NO: 111440

SEQ ID NO: 389701 - RNA, 64 nt, Homo Sapiens; identical to SEQ ID NO: 111441

SEQ ID NO: 389702 - RNA, 64 nt, Homo Sapiens; identical to SEQ ID NO: 111442

SEQ ID NO: 389703 - RNA, 64 nt, Homo Sapiens; identical to SEQ ID NO: 111443

SEQ ID NO: 389704 - RNA, 64 nt, Homo Sapiens; identical to SEQ ID NO: 111444

SEQ ID NO: 389705 - RNA, 64 nt, Homo Sapiens; identical to SEQ ID NO: 111445

SEQ ID NO: 389706 - RNA, 64 nt, Homo Sapiens; identical to SEQ ID NO: 111446

SEQ ID NO: 389707 - RNA, 64 nt, Homo Sapiens; identical to SEQ ID NO: 111447

SEQ ID NO: 389708 - RNA, 64 nt, Homo Sapiens; identical to SEQ ID NO: 111448

SEQ ID NO: 389709 - RNA, 64 nt, Homo Sapiens; identical to SEQ ID NO: 111449

SEQ ID NO: 389710 - RNA, 64 nt, Homo Sapiens; identical to SEQ ID NO: 111450

SEQ ID NO: 389711 - RNA, 64 nt, Homo Sapiens; identical to SEQ ID NO: 111451

SEQ ID NO: 389712 - RNA, 64 nt, Homo Sapiens; identical to SEQ ID NO: 111452

SEQ ID NO: 389713 - RNA, 64 nt, Homo Sapiens; identical to SEQ ID NO: 111453

SEQ ID NO: 389714 - RNA, 64 nt, Homo Sapiens; identical to SEQ ID NO: 111454

SEQ ID NO: 389715 - RNA, 64 nt, Homo Sapiens; identical to SEQ ID NO: 111455

SEQ ID NO: 389716 - RNA, 64 nt, Homo Sapiens; identical to SEQ ID NO: 111456

SEQ ID NO: 389717 - RNA, 64 nt, Homo Sapiens; identical to SEQ ID NO: 111457

SEQ ID NO: 389718 - RNA, 64 nt, Homo Sapiens; identical to SEQ ID NO: 111458

SEQ ID NO: 389719 - RNA, 64 nt, Homo Sapiens; identical to SEQ ID NO: 111459

SEQ ID NO: 389720 - RNA, 52 nt, Homo Sapiens; identical to SEQ ID NO: 111460

SEQ ID NO: 389721 - RNA, 64 nt, Homo Sapiens; identical to SEQ ID NO: 111461

SEQ ID NO: 389722 - RNA, 64 nt, Homo Sapiens; identical to SEQ ID NO: 111462

SEQ ID NO: 389723 - RNA, 64 nt, Homo Sapiens; identical to SEQ ID NO: 111463

SEQ ID NO: 389724 - RNA, 64 nt, Homo Sapiens; identical to SEQ ID NO: 111464

SEQ ID NO: 389725 - RNA, 64 nt, Homo Sapiens; identical to SEQ ID NO: 111465

SEQ ID NO: 389726 - RNA, 64 nt, Homo Sapiens; identical to SEQ ID NO: 111466

SEQ ID NO: 389727 - RNA, 64 nt, Homo Sapiens; identical to SEQ ID NO: 111467

SEQ ID NO: 389728 - RNA, 64 nt, Homo Sapiens; identical to SEQ ID NO: 344017

SEQ ID NO: 389729 - RNA, 64 nt, Homo Sapiens; identical to SEQ ID NO: 344018

SEQ ID NO: 389730 - RNA, 64 nt, Homo Sapiens; identical to SEQ ID NO: 344019

SEQ ID NO: 389731 - RNA, 64 nt, Homo Sapiens; identical to SEQ ID NO: 344020

SEQ ID NO: 389732 - RNA, 64 nt, Homo Sapiens; identical to SEQ ID NO: 344021

SEQ ID NO: 389733 - RNA, 64 nt, Homo Sapiens; identical to SEQ ID NO: 344022

SEQ ID NO: 389734 - RNA, 64 nt, Homo Sapiens; identical to SEQ ID NO: 344023

SEQ ID NO: 389735 - RNA, 64 nt, Homo Sapiens; identical to SEQ ID NO: 344024

SEQ ID NO: 389736 - RNA, 64 nt, Homo Sapiens; identical to SEQ ID NO: 344025

SEQ ID NO: 389737 - RNA, 64 nt, Homo Sapiens; identical to SEQ ID NO: 344026

SEQ ID NO: 389738 - RNA, 64 nt, Homo Sapiens; identical to SEQ ID NO: 344027

SEQ ID NO: 389739 - RNA, 64 nt, Homo Sapiens; identical to SEQ ID NO: 344028

SEQ ID NO: 389740 - RNA, 64 nt, Homo Sapiens; identical to SEQ ID NO: 344029

SEQ ID NO: 389741 - RNA, 64 nt, Homo Sapiens; identical to SEQ ID NO: 344030

SEQ ID NO: 389742 - RNA, 64 nt, Homo Sapiens; identical to SEQ ID NO: 344031

SEQ ID NO: 389743 - RNA, 64 nt, Homo Sapiens; identical to SEQ ID NO: 344032

SEQ ID NO: 389744 - RNA, 64 nt, Homo Sapiens; identical to SEQ ID NO: 344033

SEQ ID NO: 389745 - RNA, 64 nt, Homo Sapiens; identical to SEQ ID NO: 344034

SEQ ID NO: 389746 - RNA, 64 nt, Homo Sapiens; identical to SEQ ID NO: 344035

SEQ ID NO: 389747 - RNA, 64 nt, Homo Sapiens; identical to SEQ ID NO: 344036

SEQ ID NO: 389748 - RNA, 64 nt, Homo Sapiens; identical to SEQ ID NO: 344037

SEQ ID NO: 389749 - RNA, 64 nt, Homo Sapiens; identical to SEQ ID NO: 344038

SEQ ID NO: 389750 - RNA, 64 nt, Homo Sapiens; identical to SEQ ID NO: 344039

SEQ ID NO: 389751 - RNA, 64 nt, Homo Sapiens; identical to SEQ ID NO: 344040

SEQ ID NO: 389752 - RNA, 64 nt, Homo Sapiens; identical to SEQ ID NO: 344041

SEQ ID NO: 389753 - RNA, 64 nt, Homo Sapiens; identical to SEQ ID NO: 344042

SEQ ID NO: 389754 - RNA, 64 nt, Homo Sapiens; identical to SEQ ID NO: 115828

SEQ ID NO: 389755 - RNA, 64 nt, Homo Sapiens; identical to SEQ ID NO: 115829

SEQ ID NO: 389756 - RNA, 64 nt, Homo Sapiens; identical to SEQ ID NO: 115830

SEQ ID NO: 389757 - RNA, 64 nt, Homo Sapiens; identical to SEQ ID NO: 115831

SEQ ID NO: 389758 - RNA, 64 nt, Homo Sapiens; identical to SEQ ID NO: 115832

SEQ ID NO: 389759 - RNA, 64 nt, Homo Sapiens; identical to SEQ ID NO: 115833

SEQ ID NO: 389760 - RNA, 64 nt, Homo Sapiens; identical to SEQ ID NO: 115834

SEQ ID NO: 389761 - RNA, 64 nt, Homo Sapiens; identical to SEQ ID NO: 115835

SEQ ID NO: 389762 - RNA, 64 nt, Homo Sapiens; identical to SEQ ID NO: 115836

SEQ ID NO: 389763 - RNA, 64 nt, Homo Sapiens; identical to SEQ ID NO: 115837

SEQ ID NO: 389764 - RNA, 64 nt, Homo Sapiens; identical to SEQ ID NO: 115838

SEQ ID NO: 389765 - RNA, 64 nt, Homo Sapiens; identical to SEQ ID NO: 115839

SEQ ID NO: 389766 - RNA, 64 nt, Homo Sapiens; identical to SEQ ID NO: 115840

SEQ ID NO: 389767 - RNA, 64 nt, Homo Sapiens; identical to SEQ ID NO: 115841

SEQ ID NO: 389768 - RNA, 64 nt, Homo Sapiens; identical to SEQ ID NO: 115842

SEQ ID NO: 389769 - RNA, 64 nt, Homo Sapiens; identical to SEQ ID NO: 115843

SEQ ID NO: 389770 - RNA, 64 nt, Homo Sapiens; identical to SEQ ID NO: 115844

SEQ ID NO: 389771 - RNA, 64 nt, Homo Sapiens; identical to SEQ ID NO: 115845

SEQ ID NO: 389772 - RNA, 64 nt, Homo Sapiens; identical to SEQ ID NO: 115846

SEQ ID NO: 389773 - RNA, 64 nt, Homo Sapiens; identical to SEQ ID NO: 115847

SEQ ID NO: 389774 - RNA, 64 nt, Homo Sapiens; identical to SEQ ID NO: 115848

SEQ ID NO: 389775 - RNA, 64 nt, Homo Sapiens; identical to SEQ ID NO: 115849

SEQ ID NO: 389776 - RNA, 64 nt, Homo Sapiens; identical to SEQ ID NO: 115850

SEQ ID NO: 389777 - RNA, 64 nt, Homo Sapiens; identical to SEQ ID NO: 115851

SEQ ID NO: 389778 - RNA, 64 nt, Homo Sapiens; identical to SEQ ID NO: 115852

SEQ ID NO: 389779 - RNA, 64 nt, Homo Sapiens
cucagcucugacacauugaaccugcuccuuucccuguguucaccggaccccaacuccugucuuc

SEQ ID NO: 389780 - RNA, 64 nt, Homo Sapiens
agggcaucugguguuuaugucacguguaccugaguguguucaugggggccucuacgcagguaca

SEQ ID NO: 389781 - RNA, 64 nt, Homo Sapiens
uagccauaggcacauggagcagggucucuguuuuuguguucauggugaggcagagguucugaaa

SEQ ID NO: 389782 - RNA, 64 nt, Homo Sapiens
auuguucuugauugcuuuauuaucaucauacuaguguguucauuauagaguaucuguagaggug

SEQ ID NO: 389783 - RNA, 64 nt, Homo Sapiens
acaggcagcaaaaaccacugucugaaacuaaaucuguguucaaagaugaagaccccucauuaaa

SEQ ID NO: 389784 - RNA, 64 nt, Homo Sapiens
caagaaauagugugaggugaucuuaucacacugauguguucaacuguuuaugggaaaaggaaac

SEQ ID NO: 389785 - RNA, 64 nt, Homo Sapiens
gaccacauguguucucuauuaguaaauccuauuauguguucaaguuuuuaagaaaucgagauuu

SEQ ID NO: 389786 - RNA, 64 nt, Homo Sapiens
uaguguaauugcuacauucuagaacucucugagauguguucagaauuacuaaugagaguugggu

SEQ ID NO: 389787 - RNA, 64 nt, Homo Sapiens
ucaugggaggauauuacaaaaaagaaauuuaaauuguguucauagucuuucagaguagcucacu

SEQ ID NO: 389788 - RNA, 64 nt, Homo Sapiens
cacuuuaguccuguaacuuuauugggugauauuuuguguucaguguaauugucuucucuuugcu

SEQ ID NO: 389789 - RNA, 57 nt, Homo Sapiens
acgacccauccacaaccuaaagaucucuguguucauacgccccagauaugugaguua

SEQ ID NO: 389790 - RNA, 64 nt, Homo Sapiens
uucgucauagauaucugggaccuuucucaggaucuguguucacacagccaauagauuuggaauc

SEQ ID NO: 389791 - RNA, 64 nt, Homo Sapiens
gauaaagaagauuuggcguugacugcccuagggcuguguucagcugugggcaauauaaugggug

SEQ ID NO: 389792 - RNA, 64 nt, Homo Sapiens
auuccugucucacuauguguaagauuuugucauauguguucauagaaacauggaauucucugau

SEQ ID NO: 389793 - RNA, 64 nt, Homo Sapiens
acugcagccccaagcucuuauuaaccuucuuuuauguguucauuaaaugcagucaugugacaac

SEQ ID NO: 389794 - RNA, 64 nt, Homo Sapiens
uuuauguguucauuaaaugcagucaugugacaacuguguucaaaguuagaaauaguggucgggg

SEQ ID NO: 389795 - RNA, 64 nt, Homo Sapiens
gaaaguaccugaccaacagauggggggcagggacuguguucagguuggggagggggacauuuuu

SEQ ID NO: 389796 - RNA, 64 nt, Homo Sapiens
gaaugauuugcaagaaguugcaauccaggcuaucuguguucaggcagugcucuccaggagauuu

SEQ ID NO: 389797 - RNA, 64 nt, Homo Sapiens
ucuuaauguguguguguguguguguguguguguguguguucauggguuuuaaaagaacaguauu

SEQ ID NO: 389798 - RNA, 64 nt, Homo Sapiens
aaacugucuucuuguucuacucagggccuuuagguguguucauucacgguauggaaauacagua

SEQ ID NO: 389799 - RNA, 64 nt, Homo Sapiens
uccucccucagccaguuacugggucacccauccauguguucaugaaucaaucaucacggccugc

SEQ ID NO: 389800 - RNA, 64 nt, Homo Sapiens
cuuccaucuuggcuaguugugauagauacagaaauguguucaacugauacaggaaacauauuaa

SEQ ID NO: 389801 - RNA, 64 nt, Homo Sapiens
uucauuugccucuuaaaggcauucaccuguguuuuguguucaugcugucuuagaaccaagcaag

SEQ ID NO: 389802 - RNA, 64 nt, Homo Sapiens
ugcuuggauuuccgucuguauuagaguuaggaauuguguucaaggugaugugcaauaacugagc

SEQ ID NO: 389803 - RNA, 64 nt, Homo Sapiens
gaacgguuucuugcuugcuuaagaagcuuaaccauguguucaaagggaauuagggccaugcugg

SEQ ID NO: 389804 - RNA, 64 nt, Homo Sapiens
agggcugaaagcuuuuauucugagaccucagauguguguucagcgcuaucuugucugguuuucu

SEQ ID NO: 389805 - RNA, 64 nt, Homo Sapiens
aggccacauauacagccccucgcuggucucccgcuguguucagguguacgugucuccagguggc

SEQ ID NO: 389806 - RNA, 64 nt, Homo Sapiens
accguuuagauuguacacagacaacaacacugucuguguucaucuacuaacagacaccaaagga

SEQ ID NO: 389807 - RNA, 64 nt, Homo Sapiens
ucuaguugugcaggugguucugauuuuguuauacuguguucauuaugucauauauguauggguu

SEQ ID NO: 389808 - RNA, 64 nt, Homo Sapiens
aaacagcuuuaagaacaguuacucagcguagauguguguucacacaaauugcucugcauucagu

SEQ ID NO: 389809 - RNA, 64 nt, Homo Sapiens
gcagcauauuaaaugacuccaccugcgcaguccuuguguucaguggaugaauaccugugggcuc

SEQ ID NO: 389810 - RNA, 64 nt, Homo Sapiens
uacauucgaaugacugacuauuggagggaggugguguguucacgugagccuacauccgagggug

SEQ ID NO: 389811 - RNA, 64 nt, Homo Sapiens
gccuuggcaggugcacagacgggcgggcgucacguguguucagagcuugucuccaccucacggc

SEQ ID NO: 389812 - RNA, 64 nt, Homo Sapiens
ucauuuuaaugacuggacagcgcucggugaaggcuguguucacuguagugggccaucauuuguu

SEQ ID NO: 389813 - RNA, 64 nt, Homo Sapiens
aggaguccaaaggaagaguaaacaagaauggagcuguguucacacugaauuuggggucaaucua

SEQ ID NO: 389814 - RNA, 64 nt, Homo Sapiens
aaaguguauuuuagauauacauguuuuaauauucuguguucaucguucacuucuauagcauaua

SEQ ID NO: 389815 - RNA, 64 nt, Homo Sapiens
ucuauagcauauaauguuuuggagaaaauguauuuguguucacuccuuagacuauugaaauuuu

SEQ ID NO: 389816 - RNA, 64 nt, Homo Sapiens
auguacuccacaauggccagcuucggaagcacauuguguucauaucugaaaaugagagagaaga

SEQ ID NO: 389817 - RNA, 64 nt, Homo Sapiens
caccaaaggagaaggguagggucccgcuagccuguguguucacaaugucuuugaagcaaagccu

SEQ ID NO: 389818 - RNA, 64 nt, Homo Sapiens
cagggaggcuuacuggagccacaccugcaggcgcuguguucaggcaccaccuuccuccuugagc

SEQ ID NO: 389819 - RNA, 64 nt, Homo Sapiens
ggccuagaauauacuugagaaagcacuaguggcuuguguucagggagaggagcuggcaguuuuu

SEQ ID NO: 389820 - RNA, 64 nt, Homo Sapiens
uaaauuugguauaguaauuuuguguguauauguauguguucaugacuccccauuuuccuauauu

SEQ ID NO: 389821 - RNA, 64 nt, Homo Sapiens
ggggcuuaaacagucauucuauccuugaccuuaauguguucaguaaaguggauuaacuuuugaa

SEQ ID NO: 389822 - RNA, 64 nt, Homo Sapiens
gauggauggguccuaaccccugauuuugaugggauguguucauguccuaucuccucuccuggac

SEQ ID NO: 389823 - RNA, 64 nt, Homo Sapiens
acucuaacccaucccagaauaaauggagacuucauguguucauuguuucauucacucaacaugc

SEQ ID NO: 389824 - RNA, 64 nt, Homo Sapiens
caagcugcaugccuuaaagcggaaacucuaggacuguguucaugggagagcaguucaucuguuc

SEQ ID NO: 389825 - RNA, 64 nt, Homo Sapiens
aaaaacuuggcuccaaguucuauuaaccacagguuguguucauucuuuuccuggaaaugaugac

SEQ ID NO: 389826 - RNA, 64 nt, Homo Sapiens
uaauucaagauuacaacaucuguuacauucuaaguguguucaggcuucugaagguaaagggaca

SEQ ID NO: 389827 - RNA, 64 nt, Homo Sapiens
guaaacauaaacagcauggaaaagguuaaauaccuguguucagauuguaagaucuaguccggac

SEQ ID NO: 389828 - RNA, 64 nt, Homo Sapiens
cgugagucacacuacaugcccuucacagugauuuuguguucagcgcccagggcuguagcacagg

SEQ ID NO: 389829 - RNA, 50 nt, Homo Sapiens
ugggcagaucccccaaauccuguguucaccgugaugaauuucagagcuga

SEQ ID NO: 389830 - RNA, 64 nt, Homo Sapiens
uucuccugauucagauauuuuuaguaauuugcuuauauguaaaaguuguuuuuguggagucagu

SEQ ID NO: 389831 - RNA, 64 nt, Homo Sapiens
uacugauauuuuagaauagacuuuuuaaaaugccauauguaauuuuaugcaaguugacuauaua

SEQ ID NO: 389832 - RNA, 64 nt, Homo Sapiens
uuacagauaacuaaggcaaaaagcuaaauaaacaauauguaaccucuaacauuugguaaaagga

SEQ ID NO: 389833 - RNA, 64 nt, Homo Sapiens
auuacagaaaaaguuugauaauuccugcuuuauaauauguaaggcauugucccauuuugcauaa

SEQ ID NO: 389834 - RNA, 64 nt, Homo Sapiens
gagaaaaacaauaaauuuuaagaauggaacuaauauauguaacaaauuguuaaaaacugaaggc

SEQ ID NO: 389835 - RNA, 64 nt, Homo Sapiens
cucucauauuuaaaaacguaaacuagauggaaauauauguaauuaguuuugcuggcacgaaaga

SEQ ID NO: 389836 - RNA, 64 nt, Homo Sapiens
auuucucuaaaaaaccaguauauauagucuguucauauguaaaauucaauggaagagaggugga

SEQ ID NO: 389837 - RNA, 64 nt, Homo Sapiens
auggaagaguuuauaagcuuacguuaguauuguaauauguaaaguaagcccaacaaaaauuuuu

SEQ ID NO: 389838 - RNA, 64 nt, Homo Sapiens
uagcaagaguuuaugaugacagcccacuugucaaauauguaauucaccgaaaccacaccaaguc

SEQ ID NO: 389839 - RNA, 64 nt, Homo Sapiens
gugggaaucacaagaguuuauccacuaaaaaaagauauguaaaaaagauacuuuccagcacaua

SEQ ID NO: 389840 - RNA, 64 nt, Homo Sapiens
uuuuaaauaauagauuuauuauguaaauuauaguauauguaaguagcuaaugaaguaaagauca

SEQ ID NO: 389841 - RNA, 64 nt, Homo Sapiens
gaaauugauagguguaaaugagagaccauguaaaauauguaaauucuaguaccugaaauccuuu

SEQ ID NO: 389842 - RNA, 64 nt, Homo Sapiens
cauuuucuacauagauaguacuagguauuaauagauauguaaagaaagaaaucacaccauuaau

SEQ ID NO: 389843 - RNA, 64 nt, Homo Sapiens
aauuuucagaaaauuuguaugcguauauaagcaaauauguaaucuuuauuuuuuaaauaaaugg

SEQ ID NO: 389844 - RNA, 64 nt, Homo Sapiens
uagacauuaauccacuaaacuugucuuuauuacuauauguaaauaauauguaaagauucaaagu

SEQ ID NO: 389845 - RNA, 64 nt, Homo Sapiens
auucaaaguuugucuuuauuaaagugggcauuuaauauguaaagaaacaauuacaccaugguau

SEQ ID NO: 389846 - RNA, 64 nt, Homo Sapiens
caaguuuagaauguaugcuaagggagcucaaacuauauguaaaauuaaccaacuucagugguuc

SEQ ID NO: 389847 - RNA, 64 nt, Homo Sapiens
ucugauuugcuaguucuuccuuuagugagauguuauauguaagagucacuuuccaugcauaaag

SEQ ID NO: 389848 - RNA, 64 nt, Homo Sapiens
cuaaauacuuuccucuccaauaaauucacaguaaauauguaaagauguguuucuuauuaauaug

SEQ ID NO: 389849 - RNA, 64 nt, Homo Sapiens
ucacaguaaauauguaaagcuguguuucuuauuaauauguaaauguggcagggcaagguuuaaa

SEQ ID NO: 389850 - RNA, 64 nt, Homo Sapiens
aauuuuaauguauagauuuugcaaauauuaugcuauauguaauaccuaacuguaucuguagugu

SEQ ID NO: 389851 - RNA, 64 nt, Homo Sapiens
ugcuauauguaauaccuaacuguaucuguaguguauauguaauauauuuaugcccaauaaaugu

SEQ ID NO: 389852 - RNA, 64 nt, Homo Sapiens
ugugauuugguccucuggaagcuuuuagaauguaauauguaaacauguaacugccauaaguaua

SEQ ID NO: 389853 - RNA, 64 nt, Homo Sapiens
gccauaaguauagcuuuuagccuauccauaaguaauauguaacuagaaaucaggagauuuuuau

SEQ ID NO: 389854 - RNA, 64 nt, Homo Sapiens
uguguguguguguguguguguauccauaaaaugcauauguaaauuuuuuuuuguuuuuaagcau

SEQ ID NO: 389855 - RNA, 64 nt, Homo Sapiens
uugcuacauugacuaaaaggucaugaugaauggaauauguaagacuuggcucauagaaaccuaa

SEQ ID NO: 389856 - RNA, 64 nt, Homo Sapiens
uaauuguaaagauagaaauuauauugauaaguaaauauguaaaauuguaaauauguaaaaaaaa

SEQ ID NO: 389857 - RNA, 64 nt, Homo Sapiens
aauuauauugauaaguaaauauguaaaauuguaaauauguaaaaaaaagaauggugucugcugu

SEQ ID NO: 389858 - RNA, 64 nt, Homo Sapiens
gauaaugguaauuuaguguauaugugauuuucaaauauguaaacuuuaacuuccacuuuguaua

SEQ ID NO: 389859 - RNA, 64 nt, Homo Sapiens
cuauguaacuuguugcagacugguguuaaugaguauauguaacaguuuaaaaaaaaaguuggua

SEQ ID NO: 389860 - RNA, 64 nt, Homo Sapiens
guuauauguacucauguuccacauacagguauguauauguaauguauauguaacuaauauacau

SEQ ID NO: 389861 - RNA, 64 nt, Homo Sapiens
aauauacauacauacagguauacuguacauauguauauguaacuucaauauauauacauguaua

SEQ ID NO: 389862 - RNA, 64 nt, Homo Sapiens
aaugacuguaacguguuauaagucaggcauauggauauguaaacccuagaguuguucacagccu

SEQ ID NO: 389863 - RNA, 64 nt, Homo Sapiens
ucuuccaauucuuuuaaaauauguaguauguaauauauguaacaaggcugacaugugccauuau

SEQ ID NO: 389864 - RNA, 64 nt, Homo Sapiens
agaagaggagaaaaaggauuuccucaaauuuuaaauauguaacuucagggauucaauccccaaa

SEQ ID NO: 389865 - RNA, 64 nt, Homo Sapiens
acacccucaagguaaacuuauaacuuauaauuugauauguaaacuuccagaucuuuuuucuaug

SEQ ID NO: 389866 - RNA, 64 nt, Homo Sapiens
uuacaguuaaaaacaaagguagucauuauuuaaaauauguaaacgugagccaguuauuaaaagc

SEQ ID NO: 389867 - RNA, 64 nt, Homo Sapiens
auauuucuacacacauacuuauauguuuguguguauauguaaauaauuauauauguguauguac

SEQ ID NO: 389868 - RNA, 64 nt, Homo Sapiens
gcuuucaagaaaaauuaaaagacuucuuguuugaauauguaaaagucagaaauuuguagaaaau

SEQ ID NO: 389869 - RNA, 64 nt, Homo Sapiens
auauggguauuuuuuauuuuuuguuuaaaguauuauauguaaacuuuauuuuuaaaaaggaaaa

SEQ ID NO: 389870 - RNA, 64 nt, Homo Sapiens
ggugaaagguuauauuuuuuauuuuaaacaaaguauauguaaaacuuugggaugaaucagcauc

SEQ ID NO: 389871 - RNA, 64 nt, Homo Sapiens
guaaagaaacgauccuaugcuuauuugacuauguauauguaauuuuugguuaaaguuuucauuc

SEQ ID NO: 389872 - RNA, 64 nt, Homo Sapiens
auucuaauccaguggaaucuccuucuaccuuguaauauguaacuuugaggaguaagcagcauaa

SEQ ID NO: 389873 - RNA, 64 nt, Homo Sapiens
uauuaaaagugaaaaucacucuuuuuguaguauuauauguaauaauuuuccuuaaaacuucagu

SEQ ID NO: 389874 - RNA, 64 nt, Homo Sapiens
ucuacuagugaguguuguuaacaagccacgggaaauauguaauaucucaauaacaugcaaacaa

SEQ ID NO: 389875 - RNA, 64 nt, Homo Sapiens
uacuguaacaaaggagcuucucuacauaagagccauauguaauggacucugaugucuauuuuau

SEQ ID NO: 389876 - RNA, 64 nt, Homo Sapiens
acaugauuaugauacuaaucagugaaguaacuccauauguaauuguagcagugcagguggcuua

SEQ ID NO: 389877 - RNA, 64 nt, Homo Sapiens
gcuuuaauaaacauguaaggaaagauaggaccaaauauguaagugcagggggaaacacauuuca

SEQ ID NO: 389878 - RNA, 64 nt, Homo Sapiens
cgagauguucugcuauuuacucugugguuuugucauauguaaaagucauaacaccuguuuuaag

SEQ ID NO: 389879 - RNA, 64 nt, Homo Sapiens
ugugacuugauauuuuguuugaauuaauguaaauauauguaaucguacugugcuuuggacauuu

SEQ ID NO: 389880 - RNA, 64 nt, Homo Sapiens
cuuaaauuaugugaacuauuucaugugcuuguguauauguaaauucuagcaaacuaauauuggu

SEQ ID NO: 389881 - RNA, 64 nt, Homo Sapiens
gucaauaccaaaaugucugaauuuguugccauaaauauguaagugaaaauuuaaagucaucaua

SEQ ID NO: 389882 - RNA, 64 nt, Homo Sapiens
gacuuugaauguuauuuaccaacuuuguagccauauauguaauucuuuauaacacauaauuacu

SEQ ID NO: 389883 - RNA, 64 nt, Homo Sapiens
uauuuucuucauaaaacaggucaaucuuauaaauauauguaaucguucauaacaaaaaaugcua

SEQ ID NO: 389884 - RNA, 64 nt, Homo Sapiens
uaggaacugagaacuguauuggaauagguucaaaauauguaagaaaugcuaaugugggagauaa

SEQ ID NO: 389885 - RNA, 64 nt, Homo Sapiens
aucaaacauuuuaauaugugcauguuauauauaaauauguaaauucugugauacucuaugauca

SEQ ID NO: 389886 - RNA, 64 nt, Homo Sapiens
uguuacacagaugaauagcuagauguggaaagagauauguaaacaagaaaccuuuggguauugu

SEQ ID NO: 389887 - RNA, 64 nt, Homo Sapiens
ugagacacuuuuuuacaaaaagugccguauauacauauguaacaggugaguguguguuuaacau

SEQ ID NO: 389888 - RNA, 64 nt, Homo Sapiens
uguacuuguauaggauucuagcaauucauaauaaauauguaagacuaggcuuuacugucuuaug

SEQ ID NO: 389889 - RNA, 64 nt, Homo Sapiens
aucuacuauuuuagauaaauguacuguuauauauauauguaaacuacuauugcucucuuuauaa

SEQ ID NO: 389890 - RNA, 64 nt, Homo Sapiens
uagcagacgucauguugcaugguuuuugauauuuauauguaaguuuuucaaauuuugcuuaauu

SEQ ID NO: 389891 - RNA, 64 nt, Homo Sapiens
cuuuaguguuuucuagaauuuuuuucuggauauuauauguaagaauuuauuguuugagggaaau

SEQ ID NO: 389892 - RNA, 64 nt, Homo Sapiens
uuuuugguugaaccuuuagaaaaaauacucaaaaauauguaagugauaaacuauuaaaacuuua

SEQ ID NO: 389893 - RNA, 64 nt, Homo Sapiens
uucaauauuuuuauauuccccucaagacucugaaauauguaaaaaaauacugcacuuuaaguuu

SEQ ID NO: 389894 - RNA, 64 nt, Homo Sapiens
uuacgugguccaguaaugucauggucagguaguuauauguaaggcagcaacuucaugugaaaau

SEQ ID NO: 389895 - RNA, 64 nt, Homo Sapiens
gaaaccugcagucaucuuuuauuccuagauuuggauauguaagaaucugcuauggaaugaacuu

SEQ ID NO: 389896 - RNA, 64 nt, Homo Sapiens
auaaguaucuguguguuuguguauugaaaacucaauauguaaucuuguguuuuuauauguauac

SEQ ID NO: 389897 - RNA, 64 nt, Homo Sapiens
uggccaacauggugaaaccccaucacuacuaaaaauauguaaauuagucgggcguggugucacg

SEQ ID NO: 389898 - RNA, 64 nt, Homo Sapiens
ggaaagagagauugaucuggguguauguguguguauauguaaggggguuuggguguuuuucagu

SEQ ID NO: 389899 - RNA, 64 nt, Homo Sapiens
aacaugcacuuuauugguuaaaggggcagguguaauauguaaggucuagaagaaauguuuguaa

SEQ ID NO: 389900 - RNA, 64 nt, Homo Sapiens
aaacuaaagcaaaauuuagaagaaagaacuacacauauguaaauaccauauuuuugauaaaaau

SEQ ID NO: 389901 - RNA, 64 nt, Homo Sapiens
uugacuugaauugugaggcaauaagauaccuucuauauguaaugaucacagaacuaacccuuau

SEQ ID NO: 389902 - RNA, 63 nt, Homo Sapiens
agaaugagguuggaccuuuaagacaaugauaugcaagugcaaacuuuucaacaaauggcaccg

SEQ ID NO: 389903 - RNA, 63 nt, Homo Sapiens
acugaaaacuacaaaauuggcaacuuaacaaaacaagugcaagagaaagaauaaaauaggaau

SEQ ID NO: 389904 - RNA, 63 nt, Homo Sapiens
gguggguauggacaguggaggcagcuggaauggcaagugcagaaaauaggaacaguucuauac

SEQ ID NO: 389905 - RNA, 63 nt, Homo Sapiens
uugaaacacgagaagcagcaaagacagagcacacaagugcauaaggcuguugucuucggcuug

SEQ ID NO: 389906 - RNA, 63 nt, Homo Sapiens
cgacuggaggcaggacuccucagcucucaguuacaagugcaggaugcugcuauggacgaccuc

SEQ ID NO: 389907 - RNA, 63 nt, Homo Sapiens
gaccaaagggggcccuggcugaacaaagcaccucaagugcaaggccacuccugacccagcccu

SEQ ID NO: 389908 - RNA, 63 nt, Homo Sapiens
gagcacacugcacacaugcacacacagcacacacaagugcacaaugcacacaggugcacagac

SEQ ID NO: 389909 - RNA, 63 nt, Homo Sapiens
gaccacacacagcacuaacaguauacacauacacaagugcacaacacguguagcucacacaca

SEQ ID NO: 389910 - RNA, 64 nt, Homo Sapiens
aacaacaacaacauuuuuucaacaauuucaacaaugacacaaaaauucacauggaaauggggaa

SEQ ID NO: 389911 - RNA, 64 nt, Homo Sapiens
auguccuccaggugacagaggguggcaaggugacugacacaaagugacuuucagggcugugguc

SEQ ID NO: 389912 - RNA, 64 nt, Homo Sapiens
gaagggcaggagcucacaccgcaccgggcuggccugacacaaugguagcucugaagggagggga

SEQ ID NO: 389913 - RNA, 64 nt, Homo Sapiens
gugagagcugggauggggccagagauuauaaguuugacacaacaucugagacacuaggaugaau

SEQ ID NO: 389914 - RNA, 64 nt, Homo Sapiens
acugcugaaaagaacccaagagaauugucacacaugacacaagauguacauaauaucaugcuca

SEQ ID NO: 389915 - RNA, 64 nt, Homo Sapiens
uguuuuauuuugguguccuauuaaaggaauaaaaugacacaacuugucccuuuuuugucccauu

SEQ ID NO: 389916 - RNA, 64 nt, Homo Sapiens
aagcaguuccagucagccccugccacugugagaaugacacaaccauuuccuacacaguuugcac

SEQ ID NO: 389917 - RNA, 64 nt, Homo Sapiens
acaaagacuuuuagcaggugaacuguuccaagacugacacaaggauguuucaaacuugccucug

SEQ ID NO: 389918 - RNA, 64 nt, Homo Sapiens
agcuucuugggguugcuaggacagagagcuccuuugacacaaaagacaggagcaggguccaggu

SEQ ID NO: 389919 - RNA, 64 nt, Homo Sapiens
gacaggggggcaguugugaggccacagagugccuugacacaaagauuacauuuuucagaccccc

SEQ ID NO: 389920 - RNA, 64 nt, Homo Sapiens
gaaauuauuacaagcagauuaaucccucuuuuugugacacaaguacaaucuaaaaguuauauug

SEQ ID NO: 389921 - RNA, 64 nt, Homo Sapiens
ggaaguuuguguucuguuuguuaaaacuggcaucugacacaaaaaaaguugaaggccuuauucu

SEQ ID NO: 389922 - RNA, 64 nt, Homo Sapiens
caccaucccaaaguagccgggcacuuggggucucugacacaacaaguccuggggccuagauucu

SEQ ID NO: 389923 - RNA, 64 nt, Homo Sapiens
ugcuuuuguacggguucccauggagagaucugugugacacaagaguauauucccuauaggcagc

SEQ ID NO: 389924 - RNA, 64 nt, Homo Sapiens
ggcagggagcugcugggggaagggaggggaggaaugacacaaauuguacacugcagucaagggc

SEQ ID NO: 389925 - RNA, 64 nt, Homo Sapiens
cuugagccacuuggauguuuagaaugaaaccuucugacacaaaacaacuugucauugaauguaa

SEQ ID NO: 389926 - RNA, 64 nt, Homo Sapiens
gaaaagaaacuguagaccuucucuuugucacugaugacacaacaaugggaguuuccuuuuuuua

SEQ ID NO: 389927 - RNA, 64 nt, Homo Sapiens
gaauugaggguaggaggaggacuuucucccucuaugacacaaauaaaccaaagcugagcuuuua

SEQ ID NO: 389928 - RNA, 64 nt, Homo Sapiens
ucucuuauccuugaggccacgagacacaugaaccugacacaaucacagcaaucaugcaguucca

SEQ ID NO: 389929 - RNA, 64 nt, Homo Sapiens
ccagugcuuugcuuauggguuggacccagggcuuugacacaaacccccacccuacugccucagc

SEQ ID NO: 389930 - RNA, 64 nt, Homo Sapiens
ucggcucacugaaaccucugagacuggaaugcagugacacaaucaaagucucacugugucaccc

SEQ ID NO: 389931 - RNA, 64 nt, Homo Sapiens
cccaucagugggcauuaaaaauuuuaaaaaguauugacacaaagaucuauuguaaauaaaaagc

SEQ ID NO: 389932 - RNA, 64 nt, Homo Sapiens
cugcaagaauaguuauucuaauuucugucaggguugacacaaucgcuguucauuucuaucugcc

SEQ ID NO: 389933 - RNA, 64 nt, Homo Sapiens
gaugagauuacaccuacaguaccuaaauguucacugacacaaagcuuaacaugagcuccaguuu

SEQ ID NO: 389934 - RNA, 64 nt, Homo Sapiens
acucauauacugucuuuuagaguuuccugaaguaugacacaaauuggaagugagggaauauuuc

SEQ ID NO: 389935 - RNA, 64 nt, Homo Sapiens
uuaaaugaagucuuuuggucagaaauuaccuuuuugacacaagccuacugaaugcuguguauau

SEQ ID NO: 389936 - RNA, 64 nt, Homo Sapiens
ccuguuaacuugccccuuaguaucagcuguuacuugacacaaauguguguguuauucagagguu

SEQ ID NO: 389937 - RNA, 64 nt, Homo Sapiens
caccauuagagguugauggggcaacugcagcccaugacacaagaucucauuguucucgauguag

SEQ ID NO: 389938 - RNA, 64 nt, Homo Sapiens
aguaagucaggucccuaagccccgucccaagaagugacacaaguggccaacauccacacuguag

SEQ ID NO: 389939 - RNA, 64 nt, Homo Sapiens
accauucucucuuuguaggcaugcuguauguaauugacacaagggaacaguauuugcauuugua

SEQ ID NO: 389940 - RNA, 64 nt, Homo Sapiens
gcuacauauauucauguggugauagggaucaacuugacacaacuuugaaacugcauaaaguaga

SEQ ID NO: 389941 - RNA, 64 nt, Homo Sapiens
gaauccaggaggcagaggcuguggugagccaagaugacacaacugcacuccagcuugggcaaca

SEQ ID NO: 389942 - RNA, 64 nt, Homo Sapiens
uaggguacaagaagccuguucuguccagcuucagugacacaagcugcuuuagcuaaagucccgc

SEQ ID NO: 389943 - RNA, 64 nt, Homo Sapiens
gcuguccacuggguguuugcucgggugcuaugggugacacaagaaugagccacuuugaccaccc

SEQ ID NO: 389944 - RNA, 64 nt, Homo Sapiens
gugugauuaaaagguauacuuguguuuuuagcugugacacaacuuagcaguauauguuaauuug

SEQ ID NO: 389945 - RNA, 64 nt, Homo Sapiens
ucccucacauacaagaugguguguaauuccccucugacacaauauagcccugguuauuuugaaa

SEQ ID NO: 389946 - RNA, 64 nt, Homo Sapiens
uuuuugcaaaaaaacccugauucauguucauggaugacacaauguauguuuaguugguaaaugc

SEQ ID NO: 389947 - RNA, 64 nt, Homo Sapiens
agaaugaagcagaaguagaguacacauacuaaagugacacaaaguacagagagcacccaggagg

SEQ ID NO: 389948 - RNA, 64 nt, Homo Sapiens
aguagauuaagagauggguuuccuuccuuaucacugacacaaaaauacuguauuuuuaccuuuu

SEQ ID NO: 389949 - RNA, 64 nt, Homo Sapiens
uuguaauaauccaugauuuuauuuuuuuugcauuugacacaauaguuuagauacauuagcugca

SEQ ID NO: 389950 - RNA, 64 nt, Homo Sapiens
gcaaguuugauuuuugcagcauuucguaauggucugacacaaaauguuugcaaggggaaggacc

SEQ ID NO: 389951 - RNA, 64 nt, Homo Sapiens
agcaaaucauucuguauauaugcucuccagccucugacacaagaugcguucuuaauacagacuu

SEQ ID NO: 389952 - RNA, 64 nt, Homo Sapiens
aucauagaaguauguuaaaaccacuuuaaauuguugacacaaagugguaaggaaguuuugucug

SEQ ID NO: 389953 - RNA, 64 nt, Homo Sapiens
ccuuguuaagauuggugcuuuugguaacuuguacugacacaacagacaugugcuaguaucugau

SEQ ID NO: 389954 - RNA, 64 nt, Homo Sapiens
uacguguuaucaauaauaagauuuugcaacuggaugacacaagauuuuacuugaacagugaagg

SEQ ID NO: 389955 - RNA, 64 nt, Homo Sapiens
cacccugaaagugauucccuggucuacuugaauuugacacaagagaaaagcaggaggaaaaggg

SEQ ID NO: 389956 - RNA, 64 nt, Homo Sapiens
cccuuuuaguacuguuuugaugacuuuuguccauugacacaaacggggcccuaccuagagggac

SEQ ID NO: 389957 - RNA, 64 nt, Homo Sapiens
uugcacugaaaacccaggccuauuuagcacauuuugacacaaugagcagaguucuuugcaagcu

SEQ ID NO: 389958 - RNA, 64 nt, Homo Sapiens
uguuuuacaucaacuguuguguuaagauucuuguugacacaaauggguuuaucccuuuuaauca

SEQ ID NO: 389959 - RNA, 64 nt, Homo Sapiens
aauucaauuacugucaucuagcuuagaugggcugugacacaaaauaaaaaauaccuaaaaggaa

SEQ ID NO: 389960 - RNA, 64 nt, Homo Sapiens
cucauauuuuaggagauuauguaacccuaagaauugacacaaaugaaccaaaccaccuuaguga

SEQ ID NO: 389961 - RNA, 64 nt, Homo Sapiens
ucuucuauauaugaaccuauugaagagguauuacugacacaauuaggggcauauuuuauauuag

SEQ ID NO: 389962 - RNA, 64 nt, Homo Sapiens
cuuaaaaccaauaggaaacuuaagcgagguuucaugacacaaccuuucaugucgugaaaggcag

SEQ ID NO: 389963 - RNA, 64 nt, Homo Sapiens
agaauuaaagcaaguuauuuucuuauuuguauaaugacacaaagcauugggagucagacugcuu

SEQ ID NO: 389964 - RNA, 64 nt, Homo Sapiens
acaauaaagggcucauaauaaauaaauauauuuuugacacaauuaaauauuacauagaguaugu

SEQ ID NO: 389965 - RNA, 64 nt, Homo Sapiens
cauauguuucuuucuccaucggccaaaaacauuuugacacaauguuugugaaacaccuuuggag

SEQ ID NO: 389966 - RNA, 64 nt, Homo Sapiens
aauaauuaacuggggauaaaagaauggcaaggggugacacaaaguagcaaacugaauacuucuc

SEQ ID NO: 389967 - RNA, 64 nt, Homo Sapiens
uuaaacagaacgccaguugcuccaguccauuuucugacacaauaaauuuuuaccugucuuuuaa

SEQ ID NO: 389968 - RNA, 64 nt, Homo Sapiens
ugcaaggaaaugaagcggaaguuucaauagaaugugacacaacgacaaaguacgugaaaaucag

SEQ ID NO: 389969 - RNA, 64 nt, Homo Sapiens
guugcuacaaaaauacaacauuuugggccugaugugacacaacaauucgaggaggaggcuguua

SEQ ID NO: 389970 - RNA, 64 nt, Homo Sapiens
aggcagcuacggggagguaauugauucaaucaguugacacaaggugcuaacauuagguuauuua

SEQ ID NO: 389971 - RNA, 64 nt, Homo Sapiens
gacaaaaauauaaaguuauucaugaauuaagaacugacacaaagaaaaucaugcuuauaagcaa

SEQ ID NO: 389972 - RNA, 64 nt, Homo Sapiens
guggaauaaacauuaauuuuaggauccaggaauaugacacaaaguccucauguaacauugguga

SEQ ID NO: 389973 - RNA, 64 nt, Homo Sapiens
uucaagacaacauuauacauggcucugaaauaucugacacaauguaaacauugcaggcaccugc

SEQ ID NO: 389974 - RNA, 64 nt, Homo Sapiens
ugucauuacaaccuggaaaauaaaucacccuaagugacacaaauugaagcauguacaaauuaua

SEQ ID NO: 389975 - RNA, 64 nt, Homo Sapiens
ggcaaaccagacuuaucuugcaauaugagaaugcugacacaaugcaggaaagccaguuucccuu

SEQ ID NO: 389976 - RNA, 64 nt, Homo Sapiens
guagcaucccuaccacccaggacacuggugcgaaugacacaacucaaguugggaggggaacagg

SEQ ID NO: 389977 - RNA, 64 nt, Homo Sapiens
uuucugccaacugugaaguauccuccuggagcagugacacaaucuuggcggagcauugcuaccc

SEQ ID NO: 389978 - RNA, 64 nt, Homo Sapiens
ucuuuauaauuuuacaaauauugcuggauuuuuaugacacaauccucagggagauaagaccuuc

SEQ ID NO: 389979 - RNA, 64 nt, Homo Sapiens
aaauauaaauugcaagauguaauacauuagauaaugacacaaucggagcuuagaguccaggagg

SEQ ID NO: 389980 - RNA, 64 nt, Homo Sapiens
acacaugagcauacaugucuucaccuuauuauccugacacaaaaugcaugugucuuagucuuag

SEQ ID NO: 389981 - RNA, 64 nt, Homo Sapiens
ggggucuugcucugucucccaggcuggagugcagugacacaaucucagcucacugugaccuccg

SEQ ID NO: 389982 - RNA, 64 nt, Homo Sapiens
cgccgcugcacgagagcgaggcugaagaacuuugugacacaauaguccaccucccugcaaaggc

SEQ ID NO: 389983 - RNA, 64 nt, Homo Sapiens
gacuauuagaaaaguacaggguauugggcguuccugacacaaacugaggccuccuagcaagacu

SEQ ID NO: 389984 - RNA, 64 nt, Homo Sapiens
ugcugcaggacuugagaagaccucaccuagaaauugacacaaguggaccuuaggccuuccucuc

SEQ ID NO: 389985 - RNA, 64 nt, Homo Sapiens
caugccuguucuccuuccuugcuauggaauuugcugacacaauaucuuccgccuggugcugggc

SEQ ID NO: 389986 - RNA, 64 nt, Homo Sapiens
ccaccucccacccacagaccuucccuuuagcuguugacacaacuucccagcucugcaagugugc

SEQ ID NO: 389987 - RNA, 64 nt, Homo Sapiens
uuagcuguucaaaucuguuugucucuugaaacagugacacaaagguguaauucucuaugguuug

SEQ ID NO: 389988 - RNA, 64 nt, Homo Sapiens
ugccuuuguuguugaaaaaguguugcacucugugugacacaauuacagcugauugcagccucaa

SEQ ID NO: 389989 - RNA, 64 nt, Homo Sapiens
gugugaugcauauuacaaaguggacuugucacaaugacacaaacucauuuuuuguaacugggaa

SEQ ID NO: 389990 - RNA, 64 nt, Homo Sapiens
ugacaaaauuuauuuuauuuuuaaacagugguuuugacacaaauuauguuauugaaaagcauua

SEQ ID NO: 389991 - RNA, 64 nt, Homo Sapiens
gggaauguguagccuucaggaaaaaaaugccaauugacacaaagcauuccaguagcuaugaccu

SEQ ID NO: 389992 - RNA, 64 nt, Homo Sapiens
aggaaggggaagugggcaaagcagacccucaaacugacacaagaccuacagagaaaacccuuug

SEQ ID NO: 389993 - RNA, 64 nt, Homo Sapiens
cagauucauuuuaacaaauuaagggaagauauuuugacacaagaaagcaggaacguggagaaau

SEQ ID NO: 389994 - RNA, 64 nt, Homo Sapiens
cugaaaagacaaggugugaaggagcaacuucaguugacacaaaauuugaaaugcucacagauca

SEQ ID NO: 389995 - RNA, 64 nt, Homo Sapiens
aacaacaguauuuuaagggucacuugccuccuguugacacaauuguugcuaaaucaaaagaagc

SEQ ID NO: 389996 - RNA, 64 nt, Homo Sapiens
cagcauuggggccauacuaagguuuguaucuagaugacacaaacgauauucugauuuugcacau

SEQ ID NO: 389997 - RNA, 64 nt, Homo Sapiens
guaggucacauuaaauacugacuugagcagugggugacacaacacaguguuugucuuccacagg

SEQ ID NO: 389998 - RNA, 64 nt, Homo Sapiens
agguugaaauuaaagaugaauaaauaaaauaaaaugacacaaggccaaaaacaaauggguuuaa

SEQ ID NO: 389999 - RNA, 64 nt, Homo Sapiens
acacauuuguugcaccaauuaaacaugcuguuuaugacacaauguuuauuaaaucugaauuuua

SEQ ID NO: 390000 - RNA, 64 nt, Homo Sapiens
agacaugggcuagggaaggcggccagggccuacgugacacaagggagccaaagaagaucaccug

SEQ ID NO: 390001 - RNA, 64 nt, Homo Sapiens
gcaaaaugaauuccuggcuuaucuuuaaaauaauugacacaauuaaaguuuacuuaauaauggu

SEQ ID NO: 390002 - RNA, 64 nt, Homo Sapiens
cucagaaacagaaucaguguggaguacugcaaccugacacaaugacugauccgugugugaggug

SEQ ID NO: 390003 - RNA, 64 nt, Homo Sapiens
accagagcacagauucaaguucucagccuccggaugacacaaaugcgacaccaccaacaggcgu

SEQ ID NO: 390004 - RNA, 64 nt, Homo Sapiens
uccugucuuauccuccaccgucuuucuuuuauacugacacaagaauggucuuucugaauugcac

SEQ ID NO: 390005 - RNA, 64 nt, Homo Sapiens
uacuucaacaguuucauaaaacgauuccccugagugacacaagaacauaaaauguuaauaucac

SEQ ID NO: 390006 - RNA, 64 nt, Homo Sapiens
uugcuuuaaaucucugguaguuuuuccaccccugugacacaauccuaauagacaguguccugua

SEQ ID NO: 390007 - RNA, 64 nt, Homo Sapiens
uuaggcauaccuccuuuuuuucaccuuuggaacgugacacaaugauaucguugaccugcaaaau

SEQ ID NO: 390008 - RNA, 64 nt, Homo Sapiens
cauaagaaguccauauacugaaauagcuuuucuaugacacaagucugaagcaauaggcagagga

SEQ ID NO: 390009 - RNA, 64 nt, Homo Sapiens
gacagaauuccuuucccagucgaaggugccagaaugacacaaagguaaauuaagaauugcuacu

SEQ ID NO: 390010 - RNA, 64 nt, Homo Sapiens
ccucacucaggccccgggcucucagagcgagagaugacacaauggugucugccucuaggaugag

SEQ ID NO: 390011 - RNA, 64 nt, Homo Sapiens
caaaugggagagcaaaauguuggccuacagagaaugacacaauuuuauucgccuuugguguuag

SEQ ID NO: 390012 - RNA, 64 nt, Homo Sapiens
aauaaaaugugaagacuagaccaauugucaugcuugacacaacugcuguggcugguuggugcuu

SEQ ID NO: 390013 - RNA, 64 nt, Homo Sapiens
cccuccaguggccugugggugagggaagccagaaugacacaaagcaaugcaaagacaagauugc

SEQ ID NO: 390014 - RNA, 64 nt, Homo Sapiens
uuauaucccaucaacagggcguuuuccaauguggugacacaauuccuugagggacucccaaacu

SEQ ID NO: 390015 - RNA, 64 nt, Homo Sapiens
guuagggaacgguuagaacgccggccuuucgcggugacacaaugcgggacgguuccacacagcc

SEQ ID NO: 390016 - RNA, 64 nt, Homo Sapiens
cuauacuucauaugcugcuuuggaagagaagaagugacacaaacgucuggagacguuucuucug

SEQ ID NO: 390017 - RNA, 64 nt, Homo Sapiens
uaugauaccuuuaaaaagguaaauuauuucuauaugacacaaagcccaacacauacuguuucca

SEQ ID NO: 390018 - RNA, 58 nt, Homo Sapiens
auccauucucacagaaacugcccauggcugacacaagaaagugcacagaaaguuguga

SEQ ID NO: 390019 - RNA, 64 nt, Homo Sapiens
ugaacagcuuccccuccagcccacugcuuuaggaugacacaaugaauaacaccuagucauagaa

SEQ ID NO: 390020 - RNA, 64 nt, Homo Sapiens
caguggcaggaggccgugcuguguuuuacuuggaugacacaaugcaguuuacuugccucuucau

SEQ ID NO: 390021 - RNA, 64 nt, Homo Sapiens
cuuguaaucaagccuuuauggcugcugggcugagugacacaagcacuuuaauggccuggaggga

SEQ ID NO: 390022 - RNA, 64 nt, Homo Sapiens
cacuccuaccacugagcgcccaccugggaugagaugacacaaggucuguugggagcuauugagc

SEQ ID NO: 390023 - RNA, 64 nt, Homo Sapiens
cacaccaaaaccuagagcgguucacuaaaguagcugacacaaaaguuccuuuauguuucguuua

SEQ ID NO: 390024 - RNA, 62 nt, Homo Sapiens
ucgggcucgguggagcagcuaauaaaauauuuuaugacacaaaagacggugacuuuuuuucc

SEQ ID NO: 390025 - RNA, 64 nt, Homo Sapiens
guauuauuucuggcuuuuugucaagauguuuaucugacacaagucuaacaugguacacugcauc

SEQ ID NO: 390026 - RNA, 64 nt, Homo Sapiens
gcaagaugucuuagaguaggguuaagguucucagugacacaagaauucaguauuaaguacauag

SEQ ID NO: 390027 - RNA, 64 nt, Homo Sapiens
ugccaaacacacacuaacuguccuggccucuccgugacacaagucucuucccagccuuccucac

SEQ ID NO: 390028 - RNA, 64 nt, Homo Sapiens
cuuuugcuagauggaauggaaaagcaacuucauuugacacaaagcuucuaaagcagguaaauug

SEQ ID NO: 390029 - RNA, 64 nt, Homo Sapiens
caaaguguuuaauuguauaaaacaguguuuccagugacacaacucauccagaacugucuuaguc

SEQ ID NO: 390030 - RNA, 64 nt, Homo Sapiens
aaaauggaagcacuuuaguguugcuaaguaguuuugacacaauguuuauuuuccucugccaucc

SEQ ID NO: 390031 - RNA, 64 nt, Homo Sapiens
aguucuuguucuucaggagaucaccuaguuacccugacacaagagccaaccucucgaacaguau

SEQ ID NO: 390032 - RNA, 64 nt, Homo Sapiens
acacacaaaagggaacccagauaaacuaaacacgugacacaaaccauaguauucaugacuaugg

SEQ ID NO: 390033 - RNA, 64 nt, Homo Sapiens
acuaaccccaacgcacaggaaaagguagcuuaccugacacaagaggaauaagaauggagcagua

SEQ ID NO: 390034 - RNA, 64 nt, Homo Sapiens
ccaucugagaacuuuauuaugucauuuuuuuccaugacacaaaauaagaauuuucuuaauauga

SEQ ID NO: 390035 - RNA, 64 nt, Homo Sapiens
aacagacaaaugcuccagaaaucuaugcugacugugacacaagagccucacaugagaaauuacc

SEQ ID NO: 390036 - RNA, 64 nt, Homo Sapiens
agcaaggagcccgacacugauuugaucgauucugugacacaaaccccaccaauuguuaaugcaa

SEQ ID NO: 390037 - RNA, 64 nt, Homo Sapiens
ucuggcuccugcuaggugagaccuggccaucaaaugacacaaacaacuaaacgauggaagagag

SEQ ID NO: 390038 - RNA, 64 nt, Homo Sapiens
gcuuggaccuugguacuaccucagcugaggguggugacacaaccccuuccauuugucagcacuu

SEQ ID NO: 390039 - RNA, 64 nt, Homo Sapiens
agugaaagcugcacuuaacccuuugugauaaugaugacacaaaaugaauauuaauggaggauau

SEQ ID NO: 390040 - RNA, 64 nt, Homo Sapiens
gaagaaauaaauaaucuacaauaauguucuccacugacacaaaaauauguauacauauagauag

SEQ ID NO: 390041 - RNA, 64 nt, Homo Sapiens
gacugggcuaaaucuacugucaguuuauuaaaaaugacacaaaucaaacaaucaaaaaaaaaga

SEQ ID NO: 390042 - RNA, 64 nt, Homo Sapiens
cccacaggcuggggggcuccccucuguucagggcugacacaagccaguccccuugaacuucugc

SEQ ID NO: 390043 - RNA, 64 nt, Homo Sapiens
cuccugcuccucuucggaguagaaauaaaggcugugacacaaggaagccaguggggugggaggg

SEQ ID NO: 390044 - RNA, 64 nt, Homo Sapiens
auuccauucaaucuuuggaggcuuuuaaacauuuugacacaaaauucuuaugguauguagccag

SEQ ID NO: 390045 - RNA, 64 nt, Homo Sapiens
cuuucuacucaaugguccccacuccaagaugaguugacacaaccccuucccccaauuuuugugg

SEQ ID NO: 390046 - RNA, 64 nt, Homo Sapiens
gcagaucccagcugugaagaggccacugcauggcugacacaaaacaccucuuggccauucacag

SEQ ID NO: 390047 - RNA, 64 nt, Homo Sapiens
uccagcuuccugucuuuacaccaaaauaaaguauugacacaagagaucucuuccugccaagguu

SEQ ID NO: 390048 - RNA, 64 nt, Homo Sapiens
uaccuuaggacucagucaucuccacuuaaauugaugacacaagcagcuaauaaccauuucuggg

SEQ ID NO: 390049 - RNA, 64 nt, Homo Sapiens
caccgccccugagugcucauguugcugggauuacugacacaagcaacacaucuuggccucccaa

SEQ ID NO: 390050 - RNA, 64 nt, Homo Sapiens
agucauacuuugguggcuaaggcauauagguuugugacacaagaaauuucuuucuuuuaauugu

SEQ ID NO: 390051 - RNA, 64 nt, Homo Sapiens
gggcaugaaaaacuaacugcaguuuucaauguagugacacaaaauucuacaaccguaagaugac

SEQ ID NO: 390052 - RNA, 64 nt, Homo Sapiens
ggaaggguacugaaaacaccccuggagccaaagaugacacaaggaagcaaaacaauaggggaag

SEQ ID NO: 390053 - RNA, 64 nt, Homo Sapiens
uaacaccagcauugugugugagacgcacucgcauugacacaacgguggagaacugggcuugcuc

SEQ ID NO: 390054 - RNA, 64 nt, Homo Sapiens
cccagcugccuuuguggaagggaggagacggucaugacacaaagcuuuauccuacacagaaaca

SEQ ID NO: 390055 - RNA, 64 nt, Homo Sapiens
cauuugauuuucaaggaugccgucaagacgggguugacacaaugcugcacgugucuggucacac

SEQ ID NO: 390056 - RNA, 64 nt, Homo Sapiens
aggagugugggaaugaaggaauucuggagcuuuuugacacaaaaccuauuaccacauuuagcag

SEQ ID NO: 390057 - RNA, 64 nt, Homo Sapiens
cugguagaaagaagccugauccuagucuggccuuugacacaaauuaguuuccuuuccauuucuu

SEQ ID NO: 390058 - RNA, 64 nt, Homo Sapiens
ugcaagucugugcaaaacccuugaugucacauucugacacaagagaccccaucaaacugagccu

SEQ ID NO: 390059 - RNA, 64 nt, Homo Sapiens
cuaugagagugacaaaauggucucaaacaauggaugacacaaaaauaguacugugccucuuucu

SEQ ID NO: 390060 - RNA, 64 nt, Homo Sapiens
aaaguaacuuaaaaacaagauucauugguggaacugacacaaaaaaaguacaagccaaaugauu

SEQ ID NO: 390061 - RNA, 64 nt, Homo Sapiens
gaccucuguugggauaugguauuauuuuacauacugacacaaccuaaauuuucuuuggguagua

SEQ ID NO: 390062 - RNA, 64 nt, Homo Sapiens
gagcccuuaaaauaccaccuccucauguguaaauugacacaaucacuaaucugguaauuuaaac

SEQ ID NO: 390063 - RNA, 64 nt, Homo Sapiens
auacagagcaacaccuguugagccagggaguaggugacacaaggaaaccuucauggaucuuccc

SEQ ID NO: 390064 - RNA, 64 nt, Homo Sapiens
auaguuuacagcuguacuuuccagaucuucuaugugacacaaugcacuguccuuguggguuugu

SEQ ID NO: 390065 - RNA, 64 nt, Homo Sapiens
caaggacuggguagcagacuccucagaguccucuugacacaaaugucagauuugugucacucuu

SEQ ID NO: 390066 - RNA, 64 nt, Homo Sapiens
gaagugcccccuccccggcaaacccacuugucacugacacaaaggaggaaagagucuucaacau

SEQ ID NO: 390067 - RNA, 64 nt, Homo Sapiens
ccuuaagcugugguuucaguacaaaaccaacaacugacacaacucaguucucugucaucguuua

SEQ ID NO: 390068 - RNA, 64 nt, Homo Sapiens
gcaaauaagcuuuaaaaucgcuuugacaaaagacugacacaagauaaaaaguaaauguauuugc

SEQ ID NO: 390069 - RNA, 64 nt, Homo Sapiens
guuauuuacauauuauauauuuuggguguguaaaugacacaaaacucucacaucuugcacacuu

SEQ ID NO: 390070 - RNA, 64 nt, Homo Sapiens
uacaaguugauaucguugaaaauuaaaacucaagugacacaaguguggaggugauuuacugcug

SEQ ID NO: 390071 - RNA, 64 nt, Homo Sapiens
cgaaccauccagcgcacagaagcaagugcaaaaaugacacaagcacaacucuccagacguggcu

SEQ ID NO: 390072 - RNA, 64 nt, Homo Sapiens
ggcaucaccuccaccauacuccaucaguuagagcugacacaaaccugccuggguuuaaggggag

SEQ ID NO: 390073 - RNA, 64 nt, Homo Sapiens
aauacugcauuuagaaaaauugucuuuucuuaaaugacacaagcagguuuagaguggagaauuu

SEQ ID NO: 390074 - RNA, 64 nt, Homo Sapiens
auuauuugcugauacaugaaaagaugagcuuauaugacacaauuaaguauuuacauccucuuuc

SEQ ID NO: 390075 - RNA, 64 nt, Homo Sapiens
uuuagagauaaaauguacauuauauggacuuuaaugacacaaugauugauuuuacggaagaugu

SEQ ID NO: 390076 - RNA, 64 nt, Homo Sapiens
ccuggggcugugcauucccagggaagcauguggaugacacaaucuuuguucccagguaccucau

SEQ ID NO: 390077 - RNA, 64 nt, Homo Sapiens
cuggaaggaauggaggagucucaacauguguuucugacacaagauccgugguuuguacucaaag

SEQ ID NO: 390078 - RNA, 64 nt, Homo Sapiens
gaugguuuugcuacuaauuccuaucccauacauuugacacaaaagaaguguugguaauggauaa

SEQ ID NO: 390079 - RNA, 64 nt, Homo Sapiens
gaguuuugcucuuguugcccaggcuggagugcagugacacaaucucuacucacugcaaccucca

SEQ ID NO: 390080 - RNA, 64 nt, Homo Sapiens
acuggguaauuucuaauauauguuaacagcuuuuugacacaauuuuuaauauguacauuuuuug

SEQ ID NO: 390081 - RNA, 64 nt, Homo Sapiens
ggcaucgagaguacugacgacagcaaggcaaauuugacacaaaaacaucaugcacagcagccuc

SEQ ID NO: 390082 - RNA, 64 nt, Homo Sapiens
uugccuuaaagaguacuagaaaaauaaugagaacugacacaacuuguaaacacuacaaaauguc

SEQ ID NO: 390083 - RNA, 64 nt, Homo Sapiens
guuccccagauuguuaagaguucacugaagauauugacacaauuuuaaaaaaucaguaaaggaa

SEQ ID NO: 390084 - RNA, 64 nt, Homo Sapiens
aaaauuacaaaacacugcugaaagaaaucagagaugacacaaauggaaaaacauuccauacuua

SEQ ID NO: 390085 - RNA, 64 nt, Homo Sapiens
uauauuguguguguguguggguguguguguguuuugacacaaaaacaaugcaagcaugugucau

SEQ ID NO: 390086 - RNA, 64 nt, Homo Sapiens
gcuucuugcugaaauccuccagguccuauguccuugacacaaauaucuccagccucaggccggc

SEQ ID NO: 390087 - RNA, 64 nt, Homo Sapiens
ucacacaaccaugacgcacuaccuacagcaaguuugacacaaaccugggcagauccucaagcag

SEQ ID NO: 390088 - RNA, 64 nt, Homo Sapiens
cauguguucugauuuuugguacagaaaaacccuuugacacaaacucagcacucccagacguagc

SEQ ID NO: 390089 - RNA, 64 nt, Homo Sapiens
ccacaaucaucaucauaaucauaaaacaaaacaaugacacaaaaaaguaagugaauagaauaca

SEQ ID NO: 390090 - RNA, 64 nt, Homo Sapiens
augcauugaucaugaauaggugaucaagccauggugacacaaaaauugaaacagugauuaaguu

SEQ ID NO: 390091 - RNA, 64 nt, Homo Sapiens
auauguacguuuaggugugguuuuaacaaagugaugacacaacaaauuuaauuuaaaauuuaaa

SEQ ID NO: 390092 - RNA, 64 nt, Homo Sapiens
gagacccgaggggcggcggcgcgguuuuuuauggugacacaaauguauauuuugcuaacagcaa

SEQ ID NO: 390093 - RNA, 64 nt, Homo Sapiens
uucucuccaggaaguuuugaguuucucuccaccgugacacaauccucaaacauggaagaugaaa

SEQ ID NO: 390094 - RNA, 64 nt, Homo Sapiens
gcuuugaaccuccuuccacagccgcaucuucucaugacacaaagcuuuugauaaguacuuuccu

SEQ ID NO: 390095 - RNA, 64 nt, Homo Sapiens
ccaaguuaguaaacaaaauaucuuaacaguuugaugacacaagcuacugaugaggguuuggaau

SEQ ID NO: 390096 - RNA, 64 nt, Homo Sapiens
gagugauccuccuuccuucccuggcccuuggcugugacacaagauccuccugcagggcuaggcg

SEQ ID NO: 390097 - RNA, 64 nt, Homo Sapiens
ccucuucucuguuuuuacuggaauugcuacacucugacacaaacauuuacugcuggaucgacca

SEQ ID NO: 390098 - RNA, 64 nt, Homo Sapiens
auaccaaaagaguguacaaaguguugcagggcugugacacaauagggacucuauggaaaacugg

SEQ ID NO: 390099 - RNA, 64 nt, Homo Sapiens
ggagggguggggcccacccuggaagaguggacagugacacaagguggacacucucuacagauca

SEQ ID NO: 390100 - RNA, 64 nt, Homo Sapiens
ucaaucagauguugaauuucauguaucugaacauugacacaaaggagauaccuuauggugccag

SEQ ID NO: 390101 - RNA, 64 nt, Homo Sapiens
ccccugggggcugcgguagggacuccgcagcuucugacacaacuaggacaguguccccccgagu

SEQ ID NO: 390102 - RNA, 64 nt, Homo Sapiens
cugggugguuuucccacgaacacacggacgcgcgugacacaaugagccuguuugguggucucuu

SEQ ID NO: 390103 - RNA, 64 nt, Homo Sapiens
gacgugccuuaaggaacccggcagcugcaaacucugacacaaaaucagugggcugggcggagcc

SEQ ID NO: 390104 - RNA, 64 nt, Homo Sapiens
uaucauucuucuuuuuauuuauauaucagucaugugacacaaaaggacacugagcuugaacuuc

SEQ ID NO: 390105 - RNA, 64 nt, Homo Sapiens
aggagcaauuaaaucuaaaaaagaguaaauuacaugacacaaaaagagaaaauucaaggaaugg

SEQ ID NO: 390106 - RNA, 64 nt, Homo Sapiens
ggcagaaaguagaacuuacuauucauuaaauguuugacacaauuggaauugucuuuaauuucug

SEQ ID NO: 390107 - RNA, 64 nt, Homo Sapiens
cgugguucugcuuccugcugcaucgucugccaucugacacaaggccugucguggccuccugguu

SEQ ID NO: 390108 - RNA, 64 nt, Homo Sapiens
uugagagagcguuauuuacauuauuuauuuguuuugacacaagugcuuucaguguuuuauccua

SEQ ID NO: 390109 - RNA, 64 nt, Homo Sapiens
acuccacacugugcucucuaggaccaaagcaccuugacacaaggugacagguggcuguucaggu

SEQ ID NO: 390110 - RNA, 64 nt, Homo Sapiens
uugagguagugucuagaauuuucaugacaauggaugacacaaguuuuucuuugaaacaauuaag

SEQ ID NO: 390111 - RNA, 64 nt, Homo Sapiens
ccucaaagcagacgugagagcugcacagccccauugacacaaacggcaagaucacagguugaug

SEQ ID NO: 390112 - RNA, 64 nt, Homo Sapiens
ggccaguucacaggaaguacaggaguacagguuuugacacaagaacaguuggccaauacuggug

SEQ ID NO: 390113 - RNA, 64 nt, Homo Sapiens
uuuuuugccaacccugugucacuuagugaggaccugacacaaucccuacagggugucugucagu

SEQ ID NO: 390114 - RNA, 64 nt, Homo Sapiens
gaguuuugcucuugucucccaggcuggagugcagugacacaaucucggcucacugcaaccucca

SEQ ID NO: 390115 - RNA, 64 nt, Homo Sapiens
ugucuguaaccaauaauguagcaguucugcacuuugacacaagguguaacuagaccauuuuuaa

SEQ ID NO: 390116 - RNA, 64 nt, Homo Sapiens
aagauacugacaucaaauugcuuaaaaaaguuaaugacacaauuaaauuuugauaaucuguucu

SEQ ID NO: 390117 - RNA, 64 nt, Homo Sapiens
gacgccaccccgccccaucagcacuuaagccacaugacacaaagucuguaccgcacgggaaaug

SEQ ID NO: 390118 - RNA, 64 nt, Homo Sapiens
cuucuaugccuggaugugguccuugagcuauguaugacacaacuucuccugcuguucuggguaa

SEQ ID NO: 390119 - RNA, 64 nt, Homo Sapiens
uauuuauguuuucuuaguauguggggacagauguugacacaaauugccgcugggcccuggggcg

SEQ ID NO: 390120 - RNA, 64 nt, Homo Sapiens
guuuaucacuguuguggagauuuccuuuuauucuugacacaauuugaugaccuaaaguguguuu

SEQ ID NO: 390121 - RNA, 64 nt, Homo Sapiens
agaggggaaugaauacuucagaugcuuucaggagugacacaagaacacaaugauuuuugcuuau

SEQ ID NO: 390122 - RNA, 64 nt, Homo Sapiens
aaggaaauaaaugugacucacauuucuuuuacugugacacaauaaugugauccuaaaacuggcu

SEQ ID NO: 390123 - RNA, 64 nt, Homo Sapiens
gacuuaauugauugguauauuagugacaucaacuugacacaagauuagacaaaaaauuccuuac

SEQ ID NO: 390124 - RNA, 64 nt, Homo Sapiens
agggucuugcucugucacccagacuggaguacaaugacacaaucauagcucacugcagccuuua

SEQ ID NO: 390125 - RNA, 64 nt, Homo Sapiens
uaccugguaacugcccaugguucagcauuugaagugacacaagccuuuggaccaucacacacau

SEQ ID NO: 390126 - RNA, 64 nt, Homo Sapiens
gaaauccaguucaccuacagacacuucucaaaagugacacaagaacacuuaguguucuucuuuc

SEQ ID NO: 390127 - RNA, 64 nt, Homo Sapiens
augauuacugcauagaaaucuucuuuugcccaagugacacaaaaaaaggggaaaucuauaacau

SEQ ID NO: 390128 - RNA, 64 nt, Homo Sapiens
ccuuaugaaaauauuuauggaaaaaauguuguaaugacacaaaguguuaaaaaauguuuaacaa

SEQ ID NO: 390129 - RNA, 64 nt, Homo Sapiens
aaggaugaauuaccauaacauuucccucugaagcugacacaauuaauauugguguggcugcaaa

SEQ ID NO: 390130 - RNA, 64 nt, Homo Sapiens
acacaaugauuuuugcuuacguugcuuucagggaugacacaagcgaacugaaguaaacacuuua

SEQ ID NO: 390131 - RNA, 64 nt, Homo Sapiens
aaucgcaaagagacaccacucugggcagagcagagcaggguaugggguggggagagagggugga

SEQ ID NO: 390132 - RNA, 64 nt, Homo Sapiens
augcacugucucagccaacccgcuccacuacccggcaggguacacauucgcaccccuacuucac

SEQ ID NO: 390133 - RNA, 64 nt, Homo Sapiens
ucugguuucuccagcugcuguaggaggcuaaugggcaggguacuugcccuuugucccacuagac

SEQ ID NO: 390134 - RNA, 64 nt, Homo Sapiens
cacagccagugcugagaggcuccuucuaccugccgcaggguaggagggccaggcaaaguucacc

SEQ ID NO: 390135 - RNA, 64 nt, Homo Sapiens
aaaaacuaagagugucuuuaagaagaaaacuauagcaggguacaaugcuugggcucaggaaguu

SEQ ID NO: 390136 - RNA, 64 nt, Homo Sapiens
auuccuuuugcaggucugagcuaagccccugaaagcaggguaaugcucauaaaaggacuguucc

SEQ ID NO: 390137 - RNA, 64 nt, Homo Sapiens
cauucuuuaccauggguguacuuuuccauggagggcaggguauccauuuauuuuugcaggcaau

SEQ ID NO: 390138 - RNA, 64 nt, Homo Sapiens
aagcugacacuaaauauuuugcuggggucuccaggcaggguaguaaagaaaagaaagagaagaa

SEQ ID NO: 390139 - RNA, 64 nt, Homo Sapiens
gauauaaacuacugcaucuuccauaacuaauaaagcaggguacaugagaagcaaauuuacagua

SEQ ID NO: 390140 - RNA, 64 nt, Homo Sapiens
ugaggcugagcaaaaggucuuacgaggcugggcugcaggguaugucucuccagacucugccucc

SEQ ID NO: 390141 - RNA, 64 nt, Homo Sapiens
accacgugccaucucacacaugugcucugacucugcaggguaggcugugcuacacuuggaauuc

SEQ ID NO: 390142 - RNA, 64 nt, Homo Sapiens
uagcacguguaauuuauuauuuuuucaucguaaugcaggguaacuauuauugcgcauuuucauu

SEQ ID NO: 390143 - RNA, 64 nt, Homo Sapiens
gaggcccugagugggccuugaaugcuaaaaagaagcaggguacgcagggcuacauguagauacc

SEQ ID NO: 390144 - RNA, 57 nt, Homo Sapiens
ucguucaagaccggcgcuugugcuuaggcaggguacuucaagcgcuuuaggaaauga

SEQ ID NO: 390145 - RNA, 64 nt, Homo Sapiens
aacauugacaagagguugcuugcaacucugugaagcaggguaucugaagugaccucucugucac

SEQ ID NO: 390146 - RNA, 64 nt, Homo Sapiens
ccuaacccuguagaaauguauuuguauaaauuaugcaggguacuuuuuuaauauacacuuuaca

SEQ ID NO: 390147 - RNA, 64 nt, Homo Sapiens
gaccguguacagcuugauaagaacucggagcggagcaggguaggaguggugaauugcgcugccc

SEQ ID NO: 390148 - RNA, 64 nt, Homo Sapiens
ggucuuguguuugacaugauuuauaaugacagaagcaggguaauacaugccgcuccagugacau

SEQ ID NO: 390149 - RNA, 64 nt, Homo Sapiens
guguaaguuaacacacuggagugugcuccaguuugcaggguagcccagugcaagguucagaucc

SEQ ID NO: 390150 - RNA, 64 nt, Homo Sapiens
ugucccaccuuaacccgcaagcgccuggguggaggcaggguagggcaggggccuggagacgaca

SEQ ID NO: 390151 - RNA, 64 nt, Homo Sapiens
ggcucuggagcuguagaggcuuccugaacugggagcaggguagggcugucgccuuagaucccgc

SEQ ID NO: 390152 - RNA, 64 nt, Homo Sapiens
gggcauugcucuagcccucagagcguccggagcagcaggguacaugggugggagguucauucag

SEQ ID NO: 390153 - RNA, 64 nt, Homo Sapiens
uuuuauacauggaaaauggguaugcuuaaagauugcaggguagggagggauuuuccuucauccu

SEQ ID NO: 390154 - RNA, 64 nt, Homo Sapiens
ugggcuuauuucccuggcuggguuaugggggagggcaggguaaagggauccuuaaaaaaguuua

SEQ ID NO: 390155 - RNA, 64 nt, Homo Sapiens
gguacgugaggggucugagagugagugugugugagcaggguaaguggcugagucucugacagcu

SEQ ID NO: 390156 - RNA, 64 nt, Homo Sapiens
gugcagaccuuaaaaacagcccuugauuuacagugcaggguaaauuaguaaccucuuuguccag

SEQ ID NO: 390157 - RNA, 64 nt, Homo Sapiens
cugguuucuagacuugugcucuuccaugagaacagcaggguaguuuuaaaugugauacccauag

SEQ ID NO: 390158 - RNA, 64 nt, Homo Sapiens
ggccuuccuugcuggugggcaguguauccugauggcaggguacaaguaccauuaaugaaggguc

SEQ ID NO: 390159 - RNA, 64 nt, Homo Sapiens
aaggcaguaucacagaauuuauacuauaaaaagggcaggguaggccacuuggccuauuuacuuu

SEQ ID NO: 390160 - RNA, 64 nt, Homo Sapiens
agcaucuucaggucuuuagaucuuggacaaguuggcaggguauuuuaaaagcuauaacuacugu

SEQ ID NO: 390161 - RNA, 64 nt, Homo Sapiens
ggguaaguuagauaaaauagcauauacuuucucugcaggguagguaagauaggucagucaaguu

SEQ ID NO: 390162 - RNA, 64 nt, Homo Sapiens
aaugauaccuaccuuacaaauuuccacaucuagagcaggguaauauucugucucugagauucua

SEQ ID NO: 390163 - RNA, 64 nt, Homo Sapiens
uauuaggggauggagaggggauaauuguauuuuagcaggguacauaaaauuuuaugugcuucac

SEQ ID NO: 390164 - RNA, 64 nt, Homo Sapiens
ccauccuguuaguaugucaaaucaacuaagacuggcaggguauuaacuccauuccaggugacau

SEQ ID NO: 390165 - RNA, 64 nt, Homo Sapiens
cacagaccgggacuauuccauuagccuguggucugcaggguaggcccgcaggaaaugaggaaug

SEQ ID NO: 390166 - RNA, 64 nt, Homo Sapiens
agcucccagaagguguccuuaacugcaaagcugugcaggguacuccuccagauggaaucaggaa

SEQ ID NO: 390167 - RNA, 64 nt, Homo Sapiens
uccacagcaugcaccauucucauucggucuacuugcaggguaucguacuccuguggcuuucuca

SEQ ID NO: 390168 - RNA, 64 nt, Homo Sapiens
cauguagcccugagguuuccuucccaggacagcugcaggguagagaucauuuuaagugcuugug

SEQ ID NO: 390169 - RNA, 64 nt, Homo Sapiens
ggagaggcucugcaguguggggcgggggcuggccgcaggguagggguuuauacuaccucccugg

SEQ ID NO: 390170 - RNA, 64 nt, Homo Sapiens
guaagaugauaacguuagagucuugauaaauauagcaggguaaucaguaguguugauuucuuaa

SEQ ID NO: 390171 - RNA, 64 nt, Homo Sapiens
guuaacccauugcuggcagugggagcugauuuaggcaggguaaacaggaaagcauuaaaaguua

SEQ ID NO: 390172 - RNA, 64 nt, Homo Sapiens
uguuuacauuugauuaacuguguugccuauuuaugcaggguaauccagcuaaaggaagcuuucu

SEQ ID NO: 390173 - RNA, 64 nt, Homo Sapiens
gcccauucccccagcccugggugccuggggaggagcaggguacaggagccccggggggacaguc

SEQ ID NO: 390174 - RNA, 64 nt, Homo Sapiens
uggggcuuucccuaauuuauggaggggggggggggcaggguagggaggaagacgauuugggggg

SEQ ID NO: 390175 - RNA, 64 nt, Homo Sapiens
caagaagucagacuguggucgggagaaguuuggggcaggguaucaacuuccuagugggaaugau

SEQ ID NO: 390176 - RNA, 64 nt, Homo Sapiens
acgcaagccuuaaaauuuuuuaaaauagucuuuugcaggguacuaauuuuguugauauacauca

SEQ ID NO: 390177 - RNA, 64 nt, Homo Sapiens
cugaauugcuuucugcucuuagccagcacaaaaggcaggguagccugacaccgaccggaguacu

SEQ ID NO: 390178 - RNA, 64 nt, Homo Sapiens
aaagaccaagauuugggguuccaggcugagagcagcaggguagauguucuccaggcucuguggc

SEQ ID NO: 390179 - RNA, 64 nt, Homo Sapiens
aacccagugauguuucuuacgugcuuugucaccugcaggguaguuuagcacagauguggacuga

SEQ ID NO: 390180 - RNA, 64 nt, Homo Sapiens
auaaaaaggccccuguggucuggaauaggguccugcaggguagacucucugaaaguugucaccc

SEQ ID NO: 390181 - RNA, 64 nt, Homo Sapiens
cuaaaaaggccccuguggucuggaauacgauccugcaggguagacucucugaaaguugucaccc

SEQ ID NO: 390182 - RNA, 64 nt, Homo Sapiens
gaaagauugucauagaugguagggcuuugaaaaugcaggguaucagcugccacuccuggcuuca

SEQ ID NO: 390183 - RNA, 64 nt, Homo Sapiens
ugcgcacagccacgggggacgccaccgcgacguugcaggguaccggacuuggccgaggagcggg

SEQ ID NO: 390184 - RNA, 64 nt, Homo Sapiens
gugggccuuacagacaggcuacucugggaguggggcaggguaagccauucacccgcuuccuugc

SEQ ID NO: 390185 - RNA, 64 nt, Homo Sapiens
cacaggugcagccuaagaagucugggaucuacaggcaggguaggagccuauaggucauucuugc

SEQ ID NO: 390186 - RNA, 64 nt, Homo Sapiens
ggcaaacaaauugaagugccaaacagcacucgcugcaggguauuuuuagagucauagcugagag

SEQ ID NO: 390187 - RNA, 64 nt, Homo Sapiens
cagaccugagguugggaaaagagguuuuucuccugcaggguacugggccaggcccucagccuca

SEQ ID NO: 390188 - RNA, 64 nt, Homo Sapiens
acaccagccagcaugguggcccuguucugggggagcaggguaaggcaggaggaagugggugagc

SEQ ID NO: 390189 - RNA, 64 nt, Homo Sapiens
cuugggugccuccaucugggugcugaauggaccugcaggguaaaagugaugacccagcucuacc

SEQ ID NO: 390190 - RNA, 64 nt, Homo Sapiens
cuguuguucccugaggcugacuucuguauacccugcaggguaaggguaucagaccuuccuccag

SEQ ID NO: 390191 - RNA, 64 nt, Homo Sapiens
ucuuaaacuuuuuagaggguucagugcaauguuugcaggguaauguaagucgugacagccuuca

SEQ ID NO: 390192 - RNA, 64 nt, Homo Sapiens
uaagugcuagggcuggucacuuucuguauauucagcaggguauuuuuaaaauaauucuucuacu

SEQ ID NO: 390193 - RNA, 64 nt, Homo Sapiens
ucaggcagugcacuccuggagccaagagggaagggcaggguagagaggguauguccaguagccu

SEQ ID NO: 390194 - RNA, 64 nt, Homo Sapiens
uuaacuuucugcaagaccuuuggcucacagaacugcaggguauggugagaaaccaacuacggau

SEQ ID NO: 390195 - RNA, 64 nt, Homo Sapiens
cuggggcaggaggaggccaacucacugaacuagugcaggguauguggguggcacugaccuguuc

SEQ ID NO: 390196 - RNA, 64 nt, Homo Sapiens
uccucuuuccucugcugcuuuccuuccuucuguggcaggguauuuuaauauauuuuucaaauuu

SEQ ID NO: 390197 - RNA, 64 nt, Homo Sapiens
aggaaagaaugacuagcuagcuuccaaagauccagcaggguauccccacacauagauucuuaca

SEQ ID NO: 390198 - RNA, 64 nt, Homo Sapiens
ugggagaaaggcccuguuucgccacugagccugugcaggguacugaaggcaaguggccagugcu

SEQ ID NO: 390199 - RNA, 64 nt, Homo Sapiens
ugaaagucuagagaaagaggcugucucaaggagagcaggguaggcgcccccuccagccccaucu

SEQ ID NO: 390200 - RNA, 64 nt, Homo Sapiens
aacgagucuggccuggugccgcguaugucagaucgcaggguagggcuugugcccaugggcugug

SEQ ID NO: 390201 - RNA, 64 nt, Homo Sapiens
cagauccuaggaagucuguuccuguccucccugugcaggguauccuguagggugaccuggaauu

SEQ ID NO: 390202 - RNA, 64 nt, Homo Sapiens
cgcagcuagugggccuggcugggggugcagaagggcaggguaguucuuuccauuuccccuugca

SEQ ID NO: 390203 - RNA, 64 nt, Homo Sapiens
aguggcuuucagcaaaccucagucauauucuuaugcaggguauugcgaaacaacuuguguucua

SEQ ID NO: 390204 - RNA, 64 nt, Homo Sapiens
gucuugcaguggacggagagccuuggcgagggcagcaggguagagaggacaaagaauguggggc

SEQ ID NO: 390205 - RNA, 60 nt, Homo Sapiens
ccaaaguucugaggcauuaagccagcagaagcaggguacccuuuggggagcaggaggcca

SEQ ID NO: 390206 - RNA, 64 nt, Homo Sapiens
ggaggaagcagauagaugguccagcaggcuugaagcaggguaagcaggcuggcccaggguaagg

SEQ ID NO: 390207 - RNA, 64 nt, Homo Sapiens
cuucuucguguagucucuuucaguggccuggcuggcaggguagcuagaccucucacaugcagcu

SEQ ID NO: 390208 - RNA, 64 nt, Homo Sapiens
agcuuugacagucaguuuugaugucagcuccucggcaggguaggccugaugacagcccuguccc

SEQ ID NO: 390209 - RNA, 64 nt, Homo Sapiens
guagggccucugaggaggaggcagccauaggagggcaggguagggcaggagggcagggauggug

SEQ ID NO: 390210 - RNA, 64 nt, Homo Sapiens
acugggaacaggagacccacaaggaggccgcuaugcaggguagcgcgcugccccagagccuggg

SEQ ID NO: 390211 - RNA, 64 nt, Homo Sapiens
ugcauguuaauucuaccaugagguuucaaucugugcaggguauaaauaaaaauauaccuuuuuc

SEQ ID NO: 390212 - RNA, 64 nt, Homo Sapiens
ucguccugucaaagggaguuugugcuucuuuguagcaggguaaauuuuaagcaacaccacaucu

SEQ ID NO: 390213 - RNA, 64 nt, Homo Sapiens
guuagccucaucauuuugugcugcuccaacaccagcaggguaucucccaauaaaguguuccuaa

SEQ ID NO: 390214 - RNA, 64 nt, Homo Sapiens
uuuuuccuccugacuuuguguugauuggugaaaugcaggguauguggaaguuaucuaauuaacc

SEQ ID NO: 390215 - RNA, 64 nt, Homo Sapiens
cccaaagauguucccuguaguguuauguugggaagcaggguacccaaagggcuaguagaaacag

SEQ ID NO: 390216 - RNA, 64 nt, Homo Sapiens
uauuacuguccacauuuuaccucccaaccaaccagcaggguagcuugauagauuacgucuaauc

SEQ ID NO: 390217 - RNA, 64 nt, Homo Sapiens
ggcgcucccgggccgcgcgucugcguuaggcagggcaggguagugcagggcacaccuuccccgg

SEQ ID NO: 390218 - RNA, 64 nt, Homo Sapiens
aaucgacuugcagaguaguugaaguggguaagcagcaggguaccuuguauaaugcacgacaguu

SEQ ID NO: 390219 - RNA, 64 nt, Homo Sapiens
gcagacucuacuccuaacugacuucaauauuucagcaggguacacaggcguuuccaaguuucag

SEQ ID NO: 390220 - RNA, 64 nt, Homo Sapiens
uaggggaagugaugucguggauggggaggggugggcaggguaguuucccccgcuuguuuugggu

SEQ ID NO: 390221 - RNA, 64 nt, Homo Sapiens
aaagaucuuacaggagcuucgcucacucacccacgcaggguacuugguguugggguagaaauaa

SEQ ID NO: 390222 - RNA, 64 nt, Homo Sapiens
ugcacacccuuuucccauucaauuugugagccaggcaggguagggauuagugucccccuuugac

SEQ ID NO: 390223 - RNA, 64 nt, Homo Sapiens
ucagaggccuggcccuucuuuacagauguagauagcaggguaggacgcccaggccuucucacau

SEQ ID NO: 390224 - RNA, 64 nt, Homo Sapiens
gcuggaggauaagagaugcaacugcuuuaaggaagcaggguagaauuuggagaugugaagauac

SEQ ID NO: 390225 - RNA, 64 nt, Homo Sapiens
ucugugcuugcccucgcccuggcaaggggcccccgcaggguacuauuuuuggcuccgagaagag

SEQ ID NO: 390226 - RNA, 64 nt, Homo Sapiens
cccaggccucuaaccaucugacacgccucuccuggcaggguagauccaucugccuguuacccaa

SEQ ID NO: 390227 - RNA, 64 nt, Homo Sapiens
ucugguccuuucugagggaggcuggugccgcucugcaggguauuugaaccuguggaauuggagg

SEQ ID NO: 390228 - RNA, 64 nt, Homo Sapiens
gcaaaacgcauuugccaucacaguuggcacaaacgcaggguaaacgggcugugugagaaaacgg

SEQ ID NO: 390229 - RNA, 64 nt, Homo Sapiens
ccgcccccuccuccccaccagccucccgcguccugcaggguaguacaucaccacagucugagca

SEQ ID NO: 390230 - RNA, 64 nt, Homo Sapiens
uuuucaaaucauuuuugagacugguugcauaacagcaggguaccugaaagagccuucugggagu

SEQ ID NO: 390231 - RNA, 64 nt, Homo Sapiens
ugucuugagagcgcuggccucuuccucccucccugcaggguagggggccugaguugaggggcuu

SEQ ID NO: 390232 - RNA, 64 nt, Homo Sapiens
aagaaggagagcauaggaaaccacacagacuugggcaggguacagacacucccacuuggcauca

SEQ ID NO: 390233 - RNA, 64 nt, Homo Sapiens
uguccaggugcacauaggugguauugaaugcucagcaggguaggggcugaccacugucccugau

SEQ ID NO: 390234 - RNA, 64 nt, Homo Sapiens
uggggcuuuguagguagacggagccacacuacaggcaggguaugagcagagggauguauggagu

SEQ ID NO: 390235 - RNA, 64 nt, Homo Sapiens
gcauggucacgagugagggcaaaauguuuauguugcaggguauuccugcagauccuuggaaaag

SEQ ID NO: 390236 - RNA, 64 nt, Homo Sapiens
aacgugucagggcugaguguagccucugaucugugcaggguauuggugagucuguguggccagc

SEQ ID NO: 390237 - RNA, 64 nt, Homo Sapiens
uggccuuuuuuauuggauaaauugggccagaaaggcaggguagauuucgaagcacugguucugu

SEQ ID NO: 390238 - RNA, 64 nt, Homo Sapiens
aggcgauauuggugaugaaauucacccaacaaaagcaggguauacacucaugagauaacugcau

SEQ ID NO: 390239 - RNA, 64 nt, Homo Sapiens
cauacaccugucucccaccagcggggcccuccuggcaggguagggaaggaggaccccgggcacc

SEQ ID NO: 390240 - RNA, 64 nt, Homo Sapiens
uuuuuuccuuaaguagcauuuauuccuaagguaggcaggguauuuccuaguaagcauacuuucu

SEQ ID NO: 390241 - RNA, 64 nt, Homo Sapiens
cucucccugcuacaggggguggggguccugcucagcaggguagguggugguuuuaggucuuguc

SEQ ID NO: 390242 - RNA, 64 nt, Homo Sapiens
gugacaggaccuauggaccacuauacucggggaggcaggguagcaguucuuccagaaucccaag

SEQ ID NO: 390243 - RNA, 64 nt, Homo Sapiens
uagggcccaggagacaccagcgggggcugccgcugcaggguaaaugggauuccuugccacccaa

SEQ ID NO: 390244 - RNA, 64 nt, Homo Sapiens
ggcagcugcugcucaggugccaugcccugaagaggcaggguacacauggggcugggagggcaaa

SEQ ID NO: 390245 - RNA, 64 nt, Homo Sapiens
gaggggccaugggggucagggugguuuugagagagcaggguaaggaaggaaugugcuagaagug

SEQ ID NO: 390246 - RNA, 64 nt, Homo Sapiens
uucccgcagggcgcacaugcuuggagaguccucagcaggguagccgaggccaggccacuucugc

SEQ ID NO: 390247 - RNA, 64 nt, Homo Sapiens
ucagcguuauucucagaaggcggccguggcaugggcaggguauagugaggaguggaaggagacg

SEQ ID NO: 390248 - RNA, 64 nt, Homo Sapiens
auguaggauuuucuauauuguauccuagccacaugcaggguaacguacaaacuccguuaugaua

SEQ ID NO: 390249 - RNA, 64 nt, Homo Sapiens
caaauacugagugguggucuaggugguguuggcugcaggguacagugaaccugugaagcccagg

SEQ ID NO: 390250 - RNA, 64 nt, Homo Sapiens
uugggauaccuuuuuaaaaaguguuuugauuuaggcaggguagcagaagcaauuuggaguaagu

SEQ ID NO: 390251 - RNA, 64 nt, Homo Sapiens
ugaugacauauuuauucuuuuuacucaaagcugugcaggguaaaugugacaggguccuauggug

SEQ ID NO: 390252 - RNA, 64 nt, Homo Sapiens
augaacacauaaguuuagaucgcaaugaggaguagcaggguagcugguugcuagaguuacggug

SEQ ID NO: 390253 - RNA, 64 nt, Homo Sapiens
ugccagccagcugcuggugauccucagccggagggcaggguaccagguaagcuuaacuccaucu

SEQ ID NO: 390254 - RNA, 64 nt, Homo Sapiens
ggaggaucccuugccuuguaggugccccaagaccgcaggguagaaaucagccgggaugccugca

SEQ ID NO: 390255 - RNA, 64 nt, Homo Sapiens
uuagggcugucuuaaacaucacugccgucuugaagcaggguacacacguuagguauugugaaga

SEQ ID NO: 390256 - RNA, 64 nt, Homo Sapiens
uugacaucugagcauacuccaguuuacuaauacagcaggguaacugggccagauguucuuucua

SEQ ID NO: 390257 - RNA, 64 nt, Homo Sapiens
ccagggcuggcccuagccacaaaggaacuuuagggcaggguagggaaaaaaggggcagcagggg

SEQ ID NO: 390258 - RNA, 64 nt, Homo Sapiens
gccuuugauucaacuguuuuuuuaaauacaaguagcaggguauugaaagaacaucaccauugau

SEQ ID NO: 390259 - RNA, 64 nt, Homo Sapiens
uugcugcaggaaacguuuugaccuuucacagaaggcaggguaaccacauguuugucuuagguuu

SEQ ID NO: 390260 - RNA, 64 nt, Homo Sapiens; identical to SEQ ID NO: 227775

SEQ ID NO: 390261 - RNA, 64 nt, Homo Sapiens; identical to SEQ ID NO: 227776

SEQ ID NO: 390262 - RNA, 64 nt, Homo Sapiens; identical to SEQ ID NO: 227777

SEQ ID NO: 390263 - RNA, 64 nt, Homo Sapiens; identical to SEQ ID NO: 227778

SEQ ID NO: 390264 - RNA, 64 nt, Homo Sapiens; identical to SEQ ID NO: 227779

SEQ ID NO: 390265 - RNA, 64 nt, Homo Sapiens; identical to SEQ ID NO: 227780

SEQ ID NO: 390266 - RNA, 64 nt, Homo Sapiens; identical to SEQ ID NO: 227781

SEQ ID NO: 390267 - RNA, 64 nt, Homo Sapiens; identical to SEQ ID NO: 227782

SEQ ID NO: 390268 - RNA, 64 nt, Homo Sapiens; identical to SEQ ID NO: 227783

SEQ ID NO: 390269 - RNA, 64 nt, Homo Sapiens; identical to SEQ ID NO: 227784

SEQ ID NO: 390270 - RNA, 64 nt, Homo Sapiens; identical to SEQ ID NO: 227785

SEQ ID NO: 390271 - RNA, 64 nt, Homo Sapiens
gaaaccucugccuuccaggugcagugacacaaucucggcucacuugugucacccagacuggaau

SEQ ID NO: 390272 - RNA, 64 nt, Homo Sapiens
gcaaccuccgccucccaggugcaguggcgcaaucucggcucacuacugucgcccaggcuggagu

SEQ ID NO: 390273 - RNA, 64 nt, Homo Sapiens
ucugucacccaggcuggagugcaguggugcgaucucggcucacugcaagcuccgccucccgggu

SEQ ID NO: 390274 - RNA, 64 nt, Homo Sapiens
gcugcccaggcuggagugcaauggugcaaugaccucggcucacugcaaccucugccuccugggu

SEQ ID NO: 390275 - RNA, 64 nt, Homo Sapiens
acaaccuccgccucccaggugcaguggcacgaucucggcucacucuugucacccaggcuggagu

SEQ ID NO: 390276 - RNA, 64 nt, Homo Sapiens
gcaaccucuaccuccugggugcaguagcgcagucucggcucacucuuguugcccaggcuggagu

SEQ ID NO: 390277 - RNA, 64 nt, Homo Sapiens
gcacgcuccgccucccgggugcaguggcacgaucucggcucacgucuguugcccaggcuggagu

SEQ ID NO: 390278 - RNA, 64 nt, Homo Sapiens
gcaagcuccgccucucgggugcaguggcgcgaucucggcucacuucugucgcccaggcuggagu

SEQ ID NO: 390279 - RNA, 64 nt, Homo Sapiens
ucugucacccaggcuagagugcaauggcacgaucucggcucacugcaagcucugcguccugggu

SEQ ID NO: 390280 - RNA, 64 nt, Homo Sapiens
uguccugcuaaugcuguacaggggcucuugggguucggcucagcucaacauggcuugacauggu

SEQ ID NO: 390281 - RNA, 64 nt, Homo Sapiens
cuuugucgccaggcuggagugcaguggugccaucucggcucacugcagcacugucucggcucac

SEQ ID NO: 390282 - RNA, 64 nt, Homo Sapiens
caguggugccaucucggcucacugcagcacugucucggcucacugcagccuccgccucccguau

SEQ ID NO: 390283 - RNA, 64 nt, Homo Sapiens
gcagccuccgccucccguauacugcagcacugucucggcucacucaguggugccaucucggcuc

SEQ ID NO: 390284 - RNA, 64 nt, Homo Sapiens
gcagcacugucucggcucacgcaguggugccaucucggcucacuguuugucgccaggcuggagu

SEQ ID NO: 390285 - RNA, 64 nt, Homo Sapiens
ucugucgcccaggcuggaaugcaguugugagaucucggcucacugcaagcuccgccucccgggu

SEQ ID NO: 390286 - RNA, 64 nt, Homo Sapiens
ucugucacccaggcuggagugcaguggcaugauuucggcucacugcaaccucugucuccugggu

SEQ ID NO: 390287 - RNA, 64 nt, Homo Sapiens
ugccgagccgaagcuggacuguacugcugccaucucggcucacugcaaccucccugccugauuc

SEQ ID NO: 390288 - RNA, 64 nt, Homo Sapiens
aauggugcccaggcuggagugcaguggcgugaucucggcucacuacaaccuccaccucccagcc

SEQ ID NO: 390289 - RNA, 64 nt, Homo Sapiens
gcaagcuccgccucccagaugcaguggugggaucucggcucacucggccuaaccaggcuggagu

SEQ ID NO: 390290 - RNA, 64 nt, Homo Sapiens
gcauccuccaccuccuggguccaguggcacaaucucggcucacuacugucgcccagacuggagu

SEQ ID NO: 390291 - RNA, 64 nt, Homo Sapiens; identical to SEQ ID NO: 115977

SEQ ID NO: 390292 - RNA, 64 nt, Homo Sapiens; identical to SEQ ID NO: 115978

SEQ ID NO: 390293 - RNA, 64 nt, Homo Sapiens; identical to SEQ ID NO: 115979

SEQ ID NO: 390294 - RNA, 64 nt, Homo Sapiens; identical to SEQ ID NO: 115980

SEQ ID NO: 390295 - RNA, 64 nt, Homo Sapiens; identical to SEQ ID NO: 115981

SEQ ID NO: 390296 - RNA, 64 nt, Homo Sapiens; identical to SEQ ID NO: 115982

SEQ ID NO: 390297 - RNA, 64 nt, Homo Sapiens; identical to SEQ ID NO: 115983

SEQ ID NO: 390298 - RNA, 64 nt, Homo Sapiens; identical to SEQ ID NO: 115984

SEQ ID NO: 390299 - RNA, 64 nt, Homo Sapiens; identical to SEQ ID NO: 115985

SEQ ID NO: 390300 - RNA, 64 nt, Homo Sapiens; identical to SEQ ID NO: 115986

SEQ ID NO: 390301 - RNA, 64 nt, Homo Sapiens; identical to SEQ ID NO: 115987

SEQ ID NO: 390302 - RNA, 64 nt, Homo Sapiens; identical to SEQ ID NO: 115988

SEQ ID NO: 390303 - RNA, 64 nt, Homo Sapiens; identical to SEQ ID NO: 115989

SEQ ID NO: 390304 - RNA, 64 nt, Homo Sapiens; identical to SEQ ID NO: 115990

SEQ ID NO: 390305 - RNA, 64 nt, Homo Sapiens; identical to SEQ ID NO: 115991

SEQ ID NO: 390306 - RNA, 64 nt, Homo Sapiens; identical to SEQ ID NO: 115992

SEQ ID NO: 390307 - RNA, 64 nt, Homo Sapiens; identical to SEQ ID NO: 115993

SEQ ID NO: 390308 - RNA, 64 nt, Homo Sapiens; identical to SEQ ID NO: 115994

SEQ ID NO: 390309 - RNA, 64 nt, Homo Sapiens; identical to SEQ ID NO: 115995

SEQ ID NO: 390310 - RNA, 64 nt, Homo Sapiens; identical to SEQ ID NO: 115996

SEQ ID NO: 390311 - RNA, 64 nt, Homo Sapiens; identical to SEQ ID NO: 115997

SEQ ID NO: 390312 - RNA, 64 nt, Homo Sapiens; identical to SEQ ID NO: 115998

SEQ ID NO: 390313 - RNA, 64 nt, Homo Sapiens; identical to SEQ ID NO: 115999

SEQ ID NO: 390314 - RNA, 64 nt, Homo Sapiens; identical to SEQ ID NO: 116000

SEQ ID NO: 390315 - RNA, 64 nt, Homo Sapiens; identical to SEQ ID NO: 116001

SEQ ID NO: 390316 - RNA, 64 nt, Homo Sapiens; identical to SEQ ID NO: 116002

SEQ ID NO: 390317 - RNA, 64 nt, Homo Sapiens; identical to SEQ ID NO: 116003

SEQ ID NO: 390318 - RNA, 64 nt, Homo Sapiens; identical to SEQ ID NO: 116004

SEQ ID NO: 390319 - RNA, 64 nt, Homo Sapiens; identical to SEQ ID NO: 116005

SEQ ID NO: 390320 - RNA, 64 nt, Homo Sapiens; identical to SEQ ID NO: 116006

SEQ ID NO: 390321 - RNA, 64 nt, Homo Sapiens; identical to SEQ ID NO: 116007

SEQ ID NO: 390322 - RNA, 64 nt, Homo Sapiens; identical to SEQ ID NO: 116008

SEQ ID NO: 390323 - RNA, 64 nt, Homo Sapiens; identical to SEQ ID NO: 116009

SEQ ID NO: 390324 - RNA, 64 nt, Homo Sapiens; identical to SEQ ID NO: 116010

SEQ ID NO: 390325 - RNA, 64 nt, Homo Sapiens; identical to SEQ ID NO: 116011

SEQ ID NO: 390326 - RNA, 64 nt, Homo Sapiens; identical to SEQ ID NO: 116012

SEQ ID NO: 390327 - RNA, 64 nt, Homo Sapiens; identical to SEQ ID NO: 116013

SEQ ID NO: 390328 - RNA, 64 nt, Homo Sapiens; identical to SEQ ID NO: 116014

SEQ ID NO: 390329 - RNA, 64 nt, Homo Sapiens; identical to SEQ ID NO: 116015

SEQ ID NO: 390330 - RNA, 64 nt, Homo Sapiens; identical to SEQ ID NO: 116016

SEQ ID NO: 390331 - RNA, 64 nt, Homo Sapiens; identical to SEQ ID NO: 116017

SEQ ID NO: 390332 - RNA, 64 nt, Homo Sapiens; identical to SEQ ID NO: 116018

SEQ ID NO: 390333 - RNA, 64 nt, Homo Sapiens; identical to SEQ ID NO: 116019

SEQ ID NO: 390334 - RNA, 64 nt, Homo Sapiens; identical to SEQ ID NO: 116020

SEQ ID NO: 390335 - RNA, 64 nt, Homo Sapiens; identical to SEQ ID NO: 116021

SEQ ID NO: 390336 - RNA, 64 nt, Homo Sapiens; identical to SEQ ID NO: 116022

SEQ ID NO: 390337 - RNA, 64 nt, Homo Sapiens; identical to SEQ ID NO: 116023

SEQ ID NO: 390338 - RNA, 64 nt, Homo Sapiens; identical to SEQ ID NO: 116024

SEQ ID NO: 390339 - RNA, 64 nt, Homo Sapiens; identical to SEQ ID NO: 116025

SEQ ID NO: 390340 - RNA, 64 nt, Homo Sapiens; identical to SEQ ID NO: 116026

SEQ ID NO: 390341 - RNA, 64 nt, Homo Sapiens; identical to SEQ ID NO: 116027

SEQ ID NO: 390342 - RNA, 64 nt, Homo Sapiens; identical to SEQ ID NO: 116028

SEQ ID NO: 390343 - RNA, 64 nt, Homo Sapiens; identical to SEQ ID NO: 116029

SEQ ID NO: 390344 - RNA, 64 nt, Homo Sapiens; identical to SEQ ID NO: 116030

SEQ ID NO: 390345 - RNA, 64 nt, Homo Sapiens; identical to SEQ ID NO: 116031

SEQ ID NO: 390346 - RNA, 64 nt, Homo Sapiens; identical to SEQ ID NO: 116032

SEQ ID NO: 390347 - RNA, 64 nt, Homo Sapiens; identical to SEQ ID NO: 116033

SEQ ID NO: 390348 - RNA, 64 nt, Homo Sapiens; identical to SEQ ID NO: 116034

SEQ ID NO: 390349 - RNA, 64 nt, Homo Sapiens; identical to SEQ ID NO: 116035

SEQ ID NO: 390350 - RNA, 64 nt, Homo Sapiens; identical to SEQ ID NO: 116036

SEQ ID NO: 390351 - RNA, 64 nt, Homo Sapiens; identical to SEQ ID NO: 116037

SEQ ID NO: 390352 - RNA, 64 nt, Homo Sapiens; identical to SEQ ID NO: 116038

SEQ ID NO: 390353 - RNA, 64 nt, Homo Sapiens; identical to SEQ ID NO: 116039

SEQ ID NO: 390354 - RNA, 64 nt, Homo Sapiens; identical to SEQ ID NO: 116040

SEQ ID NO: 390355 - RNA, 64 nt, Homo Sapiens; identical to SEQ ID NO: 116041

SEQ ID NO: 390356 - RNA, 64 nt, Homo Sapiens; identical to SEQ ID NO: 116042

SEQ ID NO: 390357 - RNA, 64 nt, Homo Sapiens; identical to SEQ ID NO: 116043

SEQ ID NO: 390358 - RNA, 64 nt, Homo Sapiens; identical to SEQ ID NO: 116044

SEQ ID NO: 390359 - RNA, 64 nt, Homo Sapiens; identical to SEQ ID NO: 116045

SEQ ID NO: 390360 - RNA, 64 nt, Homo Sapiens; identical to SEQ ID NO: 116046

SEQ ID NO: 390361 - RNA, 64 nt, Homo Sapiens; identical to SEQ ID NO: 116047

SEQ ID NO: 390362 - RNA, 64 nt, Homo Sapiens; identical to SEQ ID NO: 116048

SEQ ID NO: 390363 - RNA, 64 nt, Homo Sapiens; identical to SEQ ID NO: 116049

SEQ ID NO: 390364 - RNA, 64 nt, Homo Sapiens; identical to SEQ ID NO: 116050

SEQ ID NO: 390365 - RNA, 64 nt, Homo Sapiens; identical to SEQ ID NO: 116051

SEQ ID NO: 390366 - RNA, 64 nt, Homo Sapiens; identical to SEQ ID NO: 116052

SEQ ID NO: 390367 - RNA, 64 nt, Homo Sapiens; identical to SEQ ID NO: 116053

SEQ ID NO: 390368 - RNA, 64 nt, Homo Sapiens; identical to SEQ ID NO: 116054

SEQ ID NO: 390369 - RNA, 64 nt, Homo Sapiens; identical to SEQ ID NO: 116055

SEQ ID NO: 390370 - RNA, 64 nt, Homo Sapiens; identical to SEQ ID NO: 116056

SEQ ID NO: 390371 - RNA, 64 nt, Homo Sapiens; identical to SEQ ID NO: 116057

SEQ ID NO: 390372 - RNA, 64 nt, Homo Sapiens; identical to SEQ ID NO: 116058

SEQ ID NO: 390373 - RNA, 64 nt, Homo Sapiens; identical to SEQ ID NO: 116059

SEQ ID NO: 390374 - RNA, 64 nt, Homo Sapiens; identical to SEQ ID NO: 116060

SEQ ID NO: 390375 - RNA, 64 nt, Homo Sapiens; identical to SEQ ID NO: 116061

SEQ ID NO: 390376 - RNA, 64 nt, Homo Sapiens; identical to SEQ ID NO: 116062

SEQ ID NO: 390377 - RNA, 64 nt, Homo Sapiens; identical to SEQ ID NO: 116063

SEQ ID NO: 390378 - RNA, 64 nt, Homo Sapiens; identical to SEQ ID NO: 116064

SEQ ID NO: 390379 - RNA, 64 nt, Homo Sapiens; identical to SEQ ID NO: 116065

SEQ ID NO: 390380 - RNA, 64 nt, Homo Sapiens; identical to SEQ ID NO: 116066

SEQ ID NO: 390381 - RNA, 64 nt, Homo Sapiens; identical to SEQ ID NO: 116067

SEQ ID NO: 390382 - RNA, 64 nt, Homo Sapiens; identical to SEQ ID NO: 116068

SEQ ID NO: 390383 - RNA, 64 nt, Homo Sapiens; identical to SEQ ID NO: 116069

SEQ ID NO: 390384 - RNA, 64 nt, Homo Sapiens; identical to SEQ ID NO: 116070

SEQ ID NO: 390385 - RNA, 64 nt, Homo Sapiens; identical to SEQ ID NO: 116071

SEQ ID NO: 390386 - RNA, 64 nt, Homo Sapiens; identical to SEQ ID NO: 116072

SEQ ID NO: 390387 - RNA, 64 nt, Homo Sapiens; identical to SEQ ID NO: 116073

SEQ ID NO: 390388 - RNA, 64 nt, Homo Sapiens; identical to SEQ ID NO: 116074

SEQ ID NO: 390389 - RNA, 64 nt, Homo Sapiens; identical to SEQ ID NO: 116075

SEQ ID NO: 390390 - RNA, 64 nt, Homo Sapiens; identical to SEQ ID NO: 116076

SEQ ID NO: 390391 - RNA, 64 nt, Homo Sapiens; identical to SEQ ID NO: 116077

SEQ ID NO: 390392 - RNA, 64 nt, Homo Sapiens; identical to SEQ ID NO: 116078

SEQ ID NO: 390393 - RNA, 64 nt, Homo Sapiens; identical to SEQ ID NO: 116079

SEQ ID NO: 390394 - RNA, 64 nt, Homo Sapiens; identical to SEQ ID NO: 116080

SEQ ID NO: 390395 - RNA, 64 nt, Homo Sapiens; identical to SEQ ID NO: 116081

SEQ ID NO: 390396 - RNA, 64 nt, Homo Sapiens; identical to SEQ ID NO: 116082

SEQ ID NO: 390397 - RNA, 64 nt, Homo Sapiens; identical to SEQ ID NO: 116083

SEQ ID NO: 390398 - RNA, 64 nt, Homo Sapiens; identical to SEQ ID NO: 116084

SEQ ID NO: 390399 - RNA, 64 nt, Homo Sapiens; identical to SEQ ID NO: 116085

SEQ ID NO: 390400 - RNA, 64 nt, Homo Sapiens; identical to SEQ ID NO: 116086

SEQ ID NO: 390401 - RNA, 64 nt, Homo Sapiens; identical to SEQ ID NO: 116087

SEQ ID NO: 390402 - RNA, 64 nt, Homo Sapiens; identical to SEQ ID NO: 116088

SEQ ID NO: 390403 - RNA, 64 nt, Homo Sapiens; identical to SEQ ID NO: 116089

SEQ ID NO: 390404 - RNA, 64 nt, Homo Sapiens; identical to SEQ ID NO: 116090

SEQ ID NO: 390405 - RNA, 64 nt, Homo Sapiens; identical to SEQ ID NO: 116091

SEQ ID NO: 390406 - RNA, 64 nt, Homo Sapiens; identical to SEQ ID NO: 116092

SEQ ID NO: 390407 - RNA, 64 nt, Homo Sapiens; identical to SEQ ID NO: 116093

SEQ ID NO: 390408 - RNA, 64 nt, Homo Sapiens; identical to SEQ ID NO: 116094

SEQ ID NO: 390409 - RNA, 64 nt, Homo Sapiens; identical to SEQ ID NO: 116095

SEQ ID NO: 390410 - RNA, 64 nt, Homo Sapiens; identical to SEQ ID NO: 116096

SEQ ID NO: 390411 - RNA, 64 nt, Homo Sapiens; identical to SEQ ID NO: 116097

SEQ ID NO: 390412 - RNA, 64 nt, Homo Sapiens; identical to SEQ ID NO: 116098

SEQ ID NO: 390413 - RNA, 64 nt, Homo Sapiens; identical to SEQ ID NO: 116099

SEQ ID NO: 390414 - RNA, 64 nt, Homo Sapiens; identical to SEQ ID NO: 116100

SEQ ID NO: 390415 - RNA, 64 nt, Homo Sapiens; identical to SEQ ID NO: 116101

SEQ ID NO: 390416 - RNA, 64 nt, Homo Sapiens; identical to SEQ ID NO: 116102

SEQ ID NO: 390417 - RNA, 64 nt, Homo Sapiens; identical to SEQ ID NO: 116103

SEQ ID NO: 390418 - RNA, 64 nt, Homo Sapiens; identical to SEQ ID NO: 116104

SEQ ID NO: 390419 - RNA, 64 nt, Homo Sapiens; identical to SEQ ID NO: 116105

SEQ ID NO: 390420 - RNA, 64 nt, Homo Sapiens; identical to SEQ ID NO: 116106

SEQ ID NO: 390421 - RNA, 64 nt, Homo Sapiens; identical to SEQ ID NO: 116107

SEQ ID NO: 390422 - RNA, 64 nt, Homo Sapiens; identical to SEQ ID NO: 116108

SEQ ID NO: 390423 - RNA, 64 nt, Homo Sapiens; identical to SEQ ID NO: 116109

SEQ ID NO: 390424 - RNA, 64 nt, Homo Sapiens; identical to SEQ ID NO: 116110

SEQ ID NO: 390425 - RNA, 64 nt, Homo Sapiens; identical to SEQ ID NO: 116111

SEQ ID NO: 390426 - RNA, 64 nt, Homo Sapiens; identical to SEQ ID NO: 116112

SEQ ID NO: 390427 - RNA, 64 nt, Homo Sapiens; identical to SEQ ID NO: 116113

SEQ ID NO: 390428 - RNA, 64 nt, Homo Sapiens; identical to SEQ ID NO: 116114

SEQ ID NO: 390429 - RNA, 64 nt, Homo Sapiens; identical to SEQ ID NO: 116115

SEQ ID NO: 390430 - RNA, 64 nt, Homo Sapiens; identical to SEQ ID NO: 116116

SEQ ID NO: 390431 - RNA, 64 nt, Homo Sapiens; identical to SEQ ID NO: 116117

SEQ ID NO: 390432 - RNA, 64 nt, Homo Sapiens; identical to SEQ ID NO: 116118

SEQ ID NO: 390433 - RNA, 64 nt, Homo Sapiens; identical to SEQ ID NO: 116119

SEQ ID NO: 390434 - RNA, 64 nt, Homo Sapiens; identical to SEQ ID NO: 116120

SEQ ID NO: 390435 - RNA, 64 nt, Homo Sapiens; identical to SEQ ID NO: 116121

SEQ ID NO: 390436 - RNA, 64 nt, Homo Sapiens; identical to SEQ ID NO: 116122

SEQ ID NO: 390437 - RNA, 64 nt, Homo Sapiens; identical to SEQ ID NO: 116123

SEQ ID NO: 390438 - RNA, 64 nt, Homo Sapiens; identical to SEQ ID NO: 116124

SEQ ID NO: 390439 - RNA, 64 nt, Homo Sapiens; identical to SEQ ID NO: 116125

SEQ ID NO: 390440 - RNA, 64 nt, Homo Sapiens; identical to SEQ ID NO: 116126

SEQ ID NO: 390441 - RNA, 64 nt, Homo Sapiens; identical to SEQ ID NO: 116127

SEQ ID NO: 390442 - RNA, 64 nt, Homo Sapiens; identical to SEQ ID NO: 116128

SEQ ID NO: 390443 - RNA, 64 nt, Homo Sapiens; identical to SEQ ID NO: 116129

SEQ ID NO: 390444 - RNA, 64 nt, Homo Sapiens; identical to SEQ ID NO: 116130

SEQ ID NO: 390445 - RNA, 64 nt, Homo Sapiens; identical to SEQ ID NO: 116131

SEQ ID NO: 390446 - RNA, 64 nt, Homo Sapiens; identical to SEQ ID NO: 116132

SEQ ID NO: 390447 - RNA, 64 nt, Homo Sapiens; identical to SEQ ID NO: 116133

SEQ ID NO: 390448 - RNA, 64 nt, Homo Sapiens; identical to SEQ ID NO: 116134

SEQ ID NO: 390449 - RNA, 64 nt, Homo Sapiens; identical to SEQ ID NO: 116135

SEQ ID NO: 390450 - RNA, 64 nt, Homo Sapiens; identical to SEQ ID NO: 116136

SEQ ID NO: 390451 - RNA, 64 nt, Homo Sapiens; identical to SEQ ID NO: 116137

SEQ ID NO: 390452 - RNA, 64 nt, Homo Sapiens; identical to SEQ ID NO: 116138

SEQ ID NO: 390453 - RNA, 64 nt, Homo Sapiens; identical to SEQ ID NO: 116139

SEQ ID NO: 390454 - RNA, 64 nt, Homo Sapiens; identical to SEQ ID NO: 116140

SEQ ID NO: 390455 - RNA, 64 nt, Homo Sapiens; identical to SEQ ID NO: 116141

SEQ ID NO: 390456 - RNA, 64 nt, Homo Sapiens; identical to SEQ ID NO: 116142

SEQ ID NO: 390457 - RNA, 64 nt, Homo Sapiens; identical to SEQ ID NO: 116143

SEQ ID NO: 390458 - RNA, 64 nt, Homo Sapiens; identical to SEQ ID NO: 116144

SEQ ID NO: 390459 - RNA, 64 nt, Homo Sapiens; identical to SEQ ID NO: 116145

SEQ ID NO: 390460 - RNA, 64 nt, Homo Sapiens; identical to SEQ ID NO: 116146

SEQ ID NO: 390461 - RNA, 64 nt, Homo Sapiens; identical to SEQ ID NO: 116147

SEQ ID NO: 390462 - RNA, 64 nt, Homo Sapiens; identical to SEQ ID NO: 116148

SEQ ID NO: 390463 - RNA, 64 nt, Homo Sapiens; identical to SEQ ID NO: 116149

SEQ ID NO: 390464 - RNA, 64 nt, Homo Sapiens; identical to SEQ ID NO: 116150

SEQ ID NO: 390465 - RNA, 64 nt, Homo Sapiens; identical to SEQ ID NO: 116151

SEQ ID NO: 390466 - RNA, 64 nt, Homo Sapiens; identical to SEQ ID NO: 116152

SEQ ID NO: 390467 - RNA, 64 nt, Homo Sapiens; identical to SEQ ID NO: 116153

SEQ ID NO: 390468 - RNA, 64 nt, Homo Sapiens; identical to SEQ ID NO: 116154

SEQ ID NO: 390469 - RNA, 64 nt, Homo Sapiens; identical to SEQ ID NO: 116155

SEQ ID NO: 390470 - RNA, 64 nt, Homo Sapiens; identical to SEQ ID NO: 116156

SEQ ID NO: 390471 - RNA, 64 nt, Homo Sapiens; identical to SEQ ID NO: 116157

SEQ ID NO: 390472 - RNA, 64 nt, Homo Sapiens; identical to SEQ ID NO: 116158

SEQ ID NO: 390473 - RNA, 64 nt, Homo Sapiens; identical to SEQ ID NO: 116159

SEQ ID NO: 390474 - RNA, 64 nt, Homo Sapiens; identical to SEQ ID NO: 116160

SEQ ID NO: 390475 - RNA, 64 nt, Homo Sapiens; identical to SEQ ID NO: 116161

SEQ ID NO: 390476 - RNA, 64 nt, Homo Sapiens; identical to SEQ ID NO: 116162

SEQ ID NO: 390477 - RNA, 64 nt, Homo Sapiens; identical to SEQ ID NO: 116163

SEQ ID NO: 390478 - RNA, 64 nt, Homo Sapiens; identical to SEQ ID NO: 116164

SEQ ID NO: 390479 - RNA, 64 nt, Homo Sapiens; identical to SEQ ID NO: 116165

SEQ ID NO: 390480 - RNA, 64 nt, Homo Sapiens; identical to SEQ ID NO: 116166

SEQ ID NO: 390481 - RNA, 64 nt, Homo Sapiens; identical to SEQ ID NO: 116167

SEQ ID NO: 390482 - RNA, 64 nt, Homo Sapiens; identical to SEQ ID NO: 116168

SEQ ID NO: 390483 - RNA, 64 nt, Homo Sapiens; identical to SEQ ID NO: 116169

SEQ ID NO: 390484 - RNA, 64 nt, Homo Sapiens; identical to SEQ ID NO: 116170

SEQ ID NO: 390485 - RNA, 64 nt, Homo Sapiens; identical to SEQ ID NO: 116171

SEQ ID NO: 390486 - RNA, 64 nt, Homo Sapiens; identical to SEQ ID NO: 116172

SEQ ID NO: 390487 - RNA, 64 nt, Homo Sapiens; identical to SEQ ID NO: 116173

SEQ ID NO: 390488 - RNA, 64 nt, Homo Sapiens; identical to SEQ ID NO: 116174

SEQ ID NO: 390489 - RNA, 64 nt, Homo Sapiens; identical to SEQ ID NO: 116175

SEQ ID NO: 390490 - RNA, 64 nt, Homo Sapiens; identical to SEQ ID NO: 116176

SEQ ID NO: 390491 - RNA, 64 nt, Homo Sapiens; identical to SEQ ID NO: 116177

SEQ ID NO: 390492 - RNA, 64 nt, Homo Sapiens; identical to SEQ ID NO: 116178

SEQ ID NO: 390493 - RNA, 64 nt, Homo Sapiens; identical to SEQ ID NO: 116179

SEQ ID NO: 390494 - RNA, 64 nt, Homo Sapiens; identical to SEQ ID NO: 116180

SEQ ID NO: 390495 - RNA, 64 nt, Homo Sapiens; identical to SEQ ID NO: 116181

SEQ ID NO: 390496 - RNA, 64 nt, Homo Sapiens; identical to SEQ ID NO: 116182

SEQ ID NO: 390497 - RNA, 64 nt, Homo Sapiens; identical to SEQ ID NO: 116183

SEQ ID NO: 390498 - RNA, 64 nt, Homo Sapiens; identical to SEQ ID NO: 116184

SEQ ID NO: 390499 - RNA, 64 nt, Homo Sapiens; identical to SEQ ID NO: 116185

SEQ ID NO: 390500 - RNA, 64 nt, Homo Sapiens; identical to SEQ ID NO: 116186

SEQ ID NO: 390501 - RNA, 64 nt, Homo Sapiens; identical to SEQ ID NO: 116187

SEQ ID NO: 390502 - RNA, 64 nt, Homo Sapiens; identical to SEQ ID NO: 116188

SEQ ID NO: 390503 - RNA, 64 nt, Homo Sapiens; identical to SEQ ID NO: 116189

SEQ ID NO: 390504 - RNA, 64 nt, Homo Sapiens; identical to SEQ ID NO: 116190

SEQ ID NO: 390505 - RNA, 64 nt, Homo Sapiens; identical to SEQ ID NO: 116191

SEQ ID NO: 390506 - RNA, 64 nt, Homo Sapiens; identical to SEQ ID NO: 116192

SEQ ID NO: 390507 - RNA, 64 nt, Homo Sapiens; identical to SEQ ID NO: 116193

SEQ ID NO: 390508 - RNA, 64 nt, Homo Sapiens; identical to SEQ ID NO: 116194

SEQ ID NO: 390509 - RNA, 64 nt, Homo Sapiens; identical to SEQ ID NO: 116195

SEQ ID NO: 390510 - RNA, 64 nt, Homo Sapiens; identical to SEQ ID NO: 116196

SEQ ID NO: 390511 - RNA, 64 nt, Homo Sapiens; identical to SEQ ID NO: 116197

SEQ ID NO: 390512 - RNA, 64 nt, Homo Sapiens; identical to SEQ ID NO: 116198

SEQ ID NO: 390513 - RNA, 64 nt, Homo Sapiens; identical to SEQ ID NO: 116199

SEQ ID NO: 390514 - RNA, 64 nt, Homo Sapiens; identical to SEQ ID NO: 116200

SEQ ID NO: 390515 - RNA, 64 nt, Homo Sapiens; identical to SEQ ID NO: 116201

SEQ ID NO: 390516 - RNA, 64 nt, Homo Sapiens; identical to SEQ ID NO: 116202

SEQ ID NO: 390517 - RNA, 64 nt, Homo Sapiens; identical to SEQ ID NO: 116203

SEQ ID NO: 390518 - RNA, 64 nt, Homo Sapiens; identical to SEQ ID NO: 116204

SEQ ID NO: 390519 - RNA, 64 nt, Homo Sapiens; identical to SEQ ID NO: 116205

SEQ ID NO: 390520 - RNA, 64 nt, Homo Sapiens; identical to SEQ ID NO: 116206

SEQ ID NO: 390521 - RNA, 64 nt, Homo Sapiens; identical to SEQ ID NO: 116207

SEQ ID NO: 390522 - RNA, 64 nt, Homo Sapiens; identical to SEQ ID NO: 116208

SEQ ID NO: 390523 - RNA, 64 nt, Homo Sapiens; identical to SEQ ID NO: 116209

SEQ ID NO: 390524 - RNA, 64 nt, Homo Sapiens; identical to SEQ ID NO: 116210

SEQ ID NO: 390525 - RNA, 64 nt, Homo Sapiens; identical to SEQ ID NO: 116211

SEQ ID NO: 390526 - RNA, 64 nt, Homo Sapiens; identical to SEQ ID NO: 116212

SEQ ID NO: 390527 - RNA, 64 nt, Homo Sapiens; identical to SEQ ID NO: 116213

SEQ ID NO: 390528 - RNA, 64 nt, Homo Sapiens; identical to SEQ ID NO: 116214

SEQ ID NO: 390529 - RNA, 64 nt, Homo Sapiens; identical to SEQ ID NO: 116215

SEQ ID NO: 390530 - RNA, 64 nt, Homo Sapiens; identical to SEQ ID NO: 116216

SEQ ID NO: 390531 - RNA, 64 nt, Homo Sapiens; identical to SEQ ID NO: 116217

SEQ ID NO: 390532 - RNA, 64 nt, Homo Sapiens; identical to SEQ ID NO: 116218

SEQ ID NO: 390533 - RNA, 64 nt, Homo Sapiens; identical to SEQ ID NO: 116219

SEQ ID NO: 390534 - RNA, 64 nt, Homo Sapiens; identical to SEQ ID NO: 116220

SEQ ID NO: 390535 - RNA, 64 nt, Homo Sapiens; identical to SEQ ID NO: 116221

SEQ ID NO: 390536 - RNA, 64 nt, Homo Sapiens; identical to SEQ ID NO: 116222

SEQ ID NO: 390537 - RNA, 64 nt, Homo Sapiens; identical to SEQ ID NO: 116223

SEQ ID NO: 390538 - RNA, 64 nt, Homo Sapiens; identical to SEQ ID NO: 116224

SEQ ID NO: 390539 - RNA, 64 nt, Homo Sapiens; identical to SEQ ID NO: 116225

SEQ ID NO: 390540 - RNA, 64 nt, Homo Sapiens; identical to SEQ ID NO: 116226

SEQ ID NO: 390541 - RNA, 64 nt, Homo Sapiens; identical to SEQ ID NO: 116227

SEQ ID NO: 390542 - RNA, 64 nt, Homo Sapiens; identical to SEQ ID NO: 116228

SEQ ID NO: 390543 - RNA, 64 nt, Homo Sapiens; identical to SEQ ID NO: 116229

SEQ ID NO: 390544 - RNA, 64 nt, Homo Sapiens; identical to SEQ ID NO: 116230

SEQ ID NO: 390545 - RNA, 64 nt, Homo Sapiens; identical to SEQ ID NO: 116231

SEQ ID NO: 390546 - RNA, 64 nt, Homo Sapiens; identical to SEQ ID NO: 116232

SEQ ID NO: 390547 - RNA, 64 nt, Homo Sapiens; identical to SEQ ID NO: 116233

SEQ ID NO: 390548 - RNA, 64 nt, Homo Sapiens; identical to SEQ ID NO: 116234

SEQ ID NO: 390549 - RNA, 64 nt, Homo Sapiens; identical to SEQ ID NO: 116235

SEQ ID NO: 390550 - RNA, 64 nt, Homo Sapiens; identical to SEQ ID NO: 116236

SEQ ID NO: 390551 - RNA, 64 nt, Homo Sapiens; identical to SEQ ID NO: 116237

SEQ ID NO: 390552 - RNA, 64 nt, Homo Sapiens; identical to SEQ ID NO: 116238

SEQ ID NO: 390553 - RNA, 64 nt, Homo Sapiens; identical to SEQ ID NO: 116239

SEQ ID NO: 390554 - RNA, 64 nt, Homo Sapiens; identical to SEQ ID NO: 116240

SEQ ID NO: 390555 - RNA, 64 nt, Homo Sapiens; identical to SEQ ID NO: 116241

SEQ ID NO: 390556 - RNA, 64 nt, Homo Sapiens; identical to SEQ ID NO: 116242

SEQ ID NO: 390557 - RNA, 64 nt, Homo Sapiens; identical to SEQ ID NO: 116243

SEQ ID NO: 390558 - RNA, 64 nt, Homo Sapiens; identical to SEQ ID NO: 116244

SEQ ID NO: 390559 - RNA, 64 nt, Homo Sapiens; identical to SEQ ID NO: 116245

SEQ ID NO: 390560 - RNA, 64 nt, Homo Sapiens; identical to SEQ ID NO: 116246

SEQ ID NO: 390561 - RNA, 64 nt, Homo Sapiens; identical to SEQ ID NO: 116247

SEQ ID NO: 390562 - RNA, 64 nt, Homo Sapiens; identical to SEQ ID NO: 116248

SEQ ID NO: 390563 - RNA, 64 nt, Homo Sapiens; identical to SEQ ID NO: 116249

SEQ ID NO: 390564 - RNA, 64 nt, Homo Sapiens; identical to SEQ ID NO: 116250

SEQ ID NO: 390565 - RNA, 64 nt, Homo Sapiens; identical to SEQ ID NO: 116251

SEQ ID NO: 390566 - RNA, 64 nt, Homo Sapiens; identical to SEQ ID NO: 116252

SEQ ID NO: 390567 - RNA, 64 nt, Homo Sapiens; identical to SEQ ID NO: 116253

SEQ ID NO: 390568 - RNA, 64 nt, Homo Sapiens; identical to SEQ ID NO: 116254

SEQ ID NO: 390569 - RNA, 64 nt, Homo Sapiens; identical to SEQ ID NO: 116255

SEQ ID NO: 390570 - RNA, 64 nt, Homo Sapiens; identical to SEQ ID NO: 116256

SEQ ID NO: 390571 - RNA, 64 nt, Homo Sapiens; identical to SEQ ID NO: 116257

SEQ ID NO: 390572 - RNA, 64 nt, Homo Sapiens; identical to SEQ ID NO: 116258

SEQ ID NO: 390573 - RNA, 64 nt, Homo Sapiens; identical to SEQ ID NO: 116259

SEQ ID NO: 390574 - RNA, 64 nt, Homo Sapiens; identical to SEQ ID NO: 116260

SEQ ID NO: 390575 - RNA, 64 nt, Homo Sapiens; identical to SEQ ID NO: 116261

SEQ ID NO: 390576 - RNA, 64 nt, Homo Sapiens; identical to SEQ ID NO: 116262

SEQ ID NO: 390577 - RNA, 64 nt, Homo Sapiens; identical to SEQ ID NO: 116263

SEQ ID NO: 390578 - RNA, 64 nt, Homo Sapiens; identical to SEQ ID NO: 116264

SEQ ID NO: 390579 - RNA, 64 nt, Homo Sapiens; identical to SEQ ID NO: 116265

SEQ ID NO: 390580 - RNA, 64 nt, Homo Sapiens; identical to SEQ ID NO: 116266

SEQ ID NO: 390581 - RNA, 64 nt, Homo Sapiens; identical to SEQ ID NO: 116267

SEQ ID NO: 390582 - RNA, 64 nt, Homo Sapiens; identical to SEQ ID NO: 116268

SEQ ID NO: 390583 - RNA, 64 nt, Homo Sapiens; identical to SEQ ID NO: 116269

SEQ ID NO: 390584 - RNA, 64 nt, Homo Sapiens; identical to SEQ ID NO: 116270

SEQ ID NO: 390585 - RNA, 64 nt, Homo Sapiens; identical to SEQ ID NO: 116271

SEQ ID NO: 390586 - RNA, 64 nt, Homo Sapiens; identical to SEQ ID NO: 116272

SEQ ID NO: 390587 - RNA, 64 nt, Homo Sapiens; identical to SEQ ID NO: 116273

SEQ ID NO: 390588 - RNA, 64 nt, Homo Sapiens; identical to SEQ ID NO: 116274

SEQ ID NO: 390589 - RNA, 64 nt, Homo Sapiens; identical to SEQ ID NO: 116275

SEQ ID NO: 390590 - RNA, 64 nt, Homo Sapiens; identical to SEQ ID NO: 116276

SEQ ID NO: 390591 - RNA, 64 nt, Homo Sapiens; identical to SEQ ID NO: 116277

SEQ ID NO: 390592 - RNA, 64 nt, Homo Sapiens; identical to SEQ ID NO: 116278

SEQ ID NO: 390593 - RNA, 64 nt, Homo Sapiens; identical to SEQ ID NO: 116279

SEQ ID NO: 390594 - RNA, 64 nt, Homo Sapiens; identical to SEQ ID NO: 116280

SEQ ID NO: 390595 - RNA, 64 nt, Homo Sapiens; identical to SEQ ID NO: 116281

SEQ ID NO: 390596 - RNA, 64 nt, Homo Sapiens; identical to SEQ ID NO: 116282

SEQ ID NO: 390597 - RNA, 64 nt, Homo Sapiens; identical to SEQ ID NO: 116283

SEQ ID NO: 390598 - RNA, 64 nt, Homo Sapiens; identical to SEQ ID NO: 116284

SEQ ID NO: 390599 - RNA, 64 nt, Homo Sapiens; identical to SEQ ID NO: 116285

SEQ ID NO: 390600 - RNA, 64 nt, Homo Sapiens; identical to SEQ ID NO: 116286

SEQ ID NO: 390601 - RNA, 64 nt, Homo Sapiens; identical to SEQ ID NO: 116287

SEQ ID NO: 390602 - RNA, 64 nt, Homo Sapiens; identical to SEQ ID NO: 116288

SEQ ID NO: 390603 - RNA, 64 nt, Homo Sapiens; identical to SEQ ID NO: 116289

SEQ ID NO: 390604 - RNA, 64 nt, Homo Sapiens; identical to SEQ ID NO: 116290

SEQ ID NO: 390605 - RNA, 64 nt, Homo Sapiens; identical to SEQ ID NO: 116291

SEQ ID NO: 390606 - RNA, 64 nt, Homo Sapiens; identical to SEQ ID NO: 116292

SEQ ID NO: 390607 - RNA, 64 nt, Homo Sapiens; identical to SEQ ID NO: 116293

SEQ ID NO: 390608 - RNA, 64 nt, Homo Sapiens; identical to SEQ ID NO: 116294

SEQ ID NO: 390609 - RNA, 64 nt, Homo Sapiens; identical to SEQ ID NO: 116295

SEQ ID NO: 390610 - RNA, 64 nt, Homo Sapiens; identical to SEQ ID NO: 116296

SEQ ID NO: 390611 - RNA, 64 nt, Homo Sapiens; identical to SEQ ID NO: 116297

SEQ ID NO: 390612 - RNA, 64 nt, Homo Sapiens; identical to SEQ ID NO: 116298

SEQ ID NO: 390613 - RNA, 64 nt, Homo Sapiens; identical to SEQ ID NO: 116299

SEQ ID NO: 390614 - RNA, 64 nt, Homo Sapiens; identical to SEQ ID NO: 116300

SEQ ID NO: 390615 - RNA, 64 nt, Homo Sapiens; identical to SEQ ID NO: 116301

SEQ ID NO: 390616 - RNA, 64 nt, Homo Sapiens; identical to SEQ ID NO: 116302

SEQ ID NO: 390617 - RNA, 64 nt, Homo Sapiens; identical to SEQ ID NO: 116303

SEQ ID NO: 390618 - RNA, 64 nt, Homo Sapiens; identical to SEQ ID NO: 116304

SEQ ID NO: 390619 - RNA, 64 nt, Homo Sapiens; identical to SEQ ID NO: 116305

SEQ ID NO: 390620 - RNA, 64 nt, Homo Sapiens; identical to SEQ ID NO: 116306

SEQ ID NO: 390621 - RNA, 64 nt, Homo Sapiens; identical to SEQ ID NO: 116307

SEQ ID NO: 390622 - RNA, 64 nt, Homo Sapiens; identical to SEQ ID NO: 116308

SEQ ID NO: 390623 - RNA, 64 nt, Homo Sapiens; identical to SEQ ID NO: 116309

SEQ ID NO: 390624 - RNA, 64 nt, Homo Sapiens; identical to SEQ ID NO: 116310

SEQ ID NO: 390625 - RNA, 64 nt, Homo Sapiens; identical to SEQ ID NO: 116311

SEQ ID NO: 390626 - RNA, 64 nt, Homo Sapiens; identical to SEQ ID NO: 116312

SEQ ID NO: 390627 - RNA, 64 nt, Homo Sapiens; identical to SEQ ID NO: 116313

SEQ ID NO: 390628 - RNA, 64 nt, Homo Sapiens; identical to SEQ ID NO: 116314

SEQ ID NO: 390629 - RNA, 64 nt, Homo Sapiens; identical to SEQ ID NO: 116315

SEQ ID NO: 390630 - RNA, 64 nt, Homo Sapiens; identical to SEQ ID NO: 116316

SEQ ID NO: 390631 - RNA, 64 nt, Homo Sapiens; identical to SEQ ID NO: 116317

SEQ ID NO: 390632 - RNA, 64 nt, Homo Sapiens; identical to SEQ ID NO: 116318

SEQ ID NO: 390633 - RNA, 64 nt, Homo Sapiens; identical to SEQ ID NO: 116319

SEQ ID NO: 390634 - RNA, 64 nt, Homo Sapiens; identical to SEQ ID NO: 116320

SEQ ID NO: 390635 - RNA, 64 nt, Homo Sapiens; identical to SEQ ID NO: 116321

SEQ ID NO: 390636 - RNA, 64 nt, Homo Sapiens; identical to SEQ ID NO: 116322

SEQ ID NO: 390637 - RNA, 64 nt, Homo Sapiens; identical to SEQ ID NO: 116323

SEQ ID NO: 390638 - RNA, 64 nt, Homo Sapiens; identical to SEQ ID NO: 116324

SEQ ID NO: 390639 - RNA, 64 nt, Homo Sapiens; identical to SEQ ID NO: 116325

SEQ ID NO: 390640 - RNA, 64 nt, Homo Sapiens; identical to SEQ ID NO: 116326

SEQ ID NO: 390641 - RNA, 64 nt, Homo Sapiens; identical to SEQ ID NO: 116327

SEQ ID NO: 390642 - RNA, 64 nt, Homo Sapiens; identical to SEQ ID NO: 116328

SEQ ID NO: 390643 - RNA, 64 nt, Homo Sapiens; identical to SEQ ID NO: 116329

SEQ ID NO: 390644 - RNA, 64 nt, Homo Sapiens; identical to SEQ ID NO: 116330

SEQ ID NO: 390645 - RNA, 64 nt, Homo Sapiens; identical to SEQ ID NO: 116331

SEQ ID NO: 390646 - RNA, 64 nt, Homo Sapiens; identical to SEQ ID NO: 116332

SEQ ID NO: 390647 - RNA, 64 nt, Homo Sapiens; identical to SEQ ID NO: 116333

SEQ ID NO: 390648 - RNA, 64 nt, Homo Sapiens; identical to SEQ ID NO: 116334

SEQ ID NO: 390649 - RNA, 64 nt, Homo Sapiens; identical to SEQ ID NO: 116335

SEQ ID NO: 390650 - RNA, 64 nt, Homo Sapiens; identical to SEQ ID NO: 116336

SEQ ID NO: 390651 - RNA, 64 nt, Homo Sapiens; identical to SEQ ID NO: 116337

SEQ ID NO: 390652 - RNA, 64 nt, Homo Sapiens; identical to SEQ ID NO: 116338

SEQ ID NO: 390653 - RNA, 64 nt, Homo Sapiens; identical to SEQ ID NO: 116339

SEQ ID NO: 390654 - RNA, 64 nt, Homo Sapiens; identical to SEQ ID NO: 116340

SEQ ID NO: 390655 - RNA, 64 nt, Homo Sapiens; identical to SEQ ID NO: 116341

SEQ ID NO: 390656 - RNA, 64 nt, Homo Sapiens; identical to SEQ ID NO: 116342

SEQ ID NO: 390657 - RNA, 64 nt, Homo Sapiens; identical to SEQ ID NO: 116343

SEQ ID NO: 390658 - RNA, 64 nt, Homo Sapiens; identical to SEQ ID NO: 116344

SEQ ID NO: 390659 - RNA, 64 nt, Homo Sapiens; identical to SEQ ID NO: 116345

SEQ ID NO: 390660 - RNA, 64 nt, Homo Sapiens; identical to SEQ ID NO: 116346

SEQ ID NO: 390661 - RNA, 64 nt, Homo Sapiens; identical to SEQ ID NO: 116347

SEQ ID NO: 390662 - RNA, 64 nt, Homo Sapiens; identical to SEQ ID NO: 116348

SEQ ID NO: 390663 - RNA, 64 nt, Homo Sapiens; identical to SEQ ID NO: 116349

SEQ ID NO: 390664 - RNA, 64 nt, Homo Sapiens; identical to SEQ ID NO: 116350

SEQ ID NO: 390665 - RNA, 64 nt, Homo Sapiens; identical to SEQ ID NO: 116351

SEQ ID NO: 390666 - RNA, 64 nt, Homo Sapiens; identical to SEQ ID NO: 116352

SEQ ID NO: 390667 - RNA, 64 nt, Homo Sapiens; identical to SEQ ID NO: 116353

SEQ ID NO: 390668 - RNA, 64 nt, Homo Sapiens; identical to SEQ ID NO: 116354

SEQ ID NO: 390669 - RNA, 64 nt, Homo Sapiens; identical to SEQ ID NO: 116355

SEQ ID NO: 390670 - RNA, 64 nt, Homo Sapiens; identical to SEQ ID NO: 116356

SEQ ID NO: 390671 - RNA, 64 nt, Homo Sapiens; identical to SEQ ID NO: 116357

SEQ ID NO: 390672 - RNA, 64 nt, Homo Sapiens; identical to SEQ ID NO: 116358

SEQ ID NO: 390673 - RNA, 64 nt, Homo Sapiens; identical to SEQ ID NO: 116359

SEQ ID NO: 390674 - RNA, 64 nt, Homo Sapiens; identical to SEQ ID NO: 116360

SEQ ID NO: 390675 - RNA, 64 nt, Homo Sapiens; identical to SEQ ID NO: 116361

SEQ ID NO: 390676 - RNA, 64 nt, Homo Sapiens; identical to SEQ ID NO: 116362

SEQ ID NO: 390677 - RNA, 64 nt, Homo Sapiens; identical to SEQ ID NO: 116363

SEQ ID NO: 390678 - RNA, 64 nt, Homo Sapiens; identical to SEQ ID NO: 116364

SEQ ID NO: 390679 - RNA, 64 nt, Homo Sapiens; identical to SEQ ID NO: 116365

SEQ ID NO: 390680 - RNA, 64 nt, Homo Sapiens; identical to SEQ ID NO: 116366

SEQ ID NO: 390681 - RNA, 64 nt, Homo Sapiens; identical to SEQ ID NO: 116367

SEQ ID NO: 390682 - RNA, 64 nt, Homo Sapiens; identical to SEQ ID NO: 116368

SEQ ID NO: 390683 - RNA, 64 nt, Homo Sapiens
aaugcagauaguuaaaaucuaaaggauagaaugcuuuccuaaaacagaacauuagccuuuaagg

SEQ ID NO: 390684 - RNA, 64 nt, Homo Sapiens
ugcucuucaaauaucuaugugcuuggagccacaguuuccuaagcgcauaguuuuugguccugcc

SEQ ID NO: 390685 - RNA, 64 nt, Homo Sapiens
uuaucuuuuccuuaaauaucccucuagagguauuuuuccuaagugguauuguacgguguauacu

SEQ ID NO: 390686 - RNA, 64 nt, Homo Sapiens
cauaauauauuugagcagucccugcugacauuuuuuuccuaaccuuuugcuauuauaaauaaug

SEQ ID NO: 390687 - RNA, 64 nt, Homo Sapiens
agugagaaaggguauacuuugugguauguuuugcuuuccuaauagggacaugaaggaaacccag

SEQ ID NO: 390688 - RNA, 64 nt, Homo Sapiens
acaaaaaggaacuuuauaaaaguuugggauuuuuuuuccuaaucauaaaaauagccccagaaag

SEQ ID NO: 390689 - RNA, 64 nt, Homo Sapiens
aaauagaacaacuugcagaauugagagugauuccuuuccuaaaaguguaagaaagcauagagau

SEQ ID NO: 390690 - RNA, 64 nt, Homo Sapiens
aaaguugaagaagauaugugaagaaaaauguauuuuuccuaaauagaaauaaaugaucccauuu

SEQ ID NO: 390691 - RNA, 64 nt, Homo Sapiens
caucugagagauaagcuucgagagaaacaaaaaauuuccuaaugagauguuuucaguguugcug

SEQ ID NO: 390692 - RNA, 64 nt, Homo Sapiens
acaucaauucguaguaaaugaaggcaguuguuucuuuccuaagcuguuuaaccucagaauuuua

SEQ ID NO: 390693 - RNA, 64 nt, Homo Sapiens
uuugugcaguguaaucacuacuauuucugcucgguuuccuaaaaggaaaaaaaaggcgcagugg

SEQ ID NO: 390694 - RNA, 64 nt, Homo Sapiens
gaaaagcaugugacauauugcuacaaagauuuuuuuuccuaaaugauucaguaauugaaugauu

SEQ ID NO: 390695 - RNA, 64 nt, Homo Sapiens
auuuuaucuuuauauaguuuguuugcaagaguauuuuccuaauaacuucacaguaugaaugugc

SEQ ID NO: 390696 - RNA, 64 nt, Homo Sapiens
aacuuucaauggaagagaauuuuagugcuuuuuuuuuccuaaaauagauauuaagcugcuguug

SEQ ID NO: 390697 - RNA, 64 nt, Homo Sapiens
acuagacuaccagggaugaguuuaaguuuucuguuuuccuaaccaauugaguugucuuuuuuuu

SEQ ID NO: 390698 - RNA, 64 nt, Homo Sapiens
ccugcaguccaaggcagccaucugucacuccugcuuuccuaacuguaaaaccccguacccuugg

SEQ ID NO: 390699 - RNA, 64 nt, Homo Sapiens
ugcgugcguguguauguucugaguccacuucuuuuuuccuaaauaacacuacagggauuuuguc

SEQ ID NO: 390700 - RNA, 64 nt, Homo Sapiens
cuuuacaugauagcauuaucuuuuuauaauuuuuuuuccuaagauaaacaaaugcauaguuuuc

SEQ ID NO: 390701 - RNA, 64 nt, Homo Sapiens
uuuacaaaagaggagcacuuccaaaauucuuauuuuuccuaacaaaagaugaaagcagggaauu

SEQ ID NO: 390702 - RNA, 64 nt, Homo Sapiens
uauuuuggaaagaagaaagacucuauucucaaaguuuccuaaucagaaauuuuuaucaguuucc

SEQ ID NO: 390703 - RNA, 64 nt, Homo Sapiens
ucagaguagaagauuuuaugcagagacuaucugauuuccuaaugguccaauaacaggucaacuu

SEQ ID NO: 390704 - RNA, 64 nt, Homo Sapiens
cuggugcucuuucccuuuaucgccagaacccagauuuccuaacuacccgaauuauaaaggccag

SEQ ID NO: 390705 - RNA, 64 nt, Homo Sapiens
aaaacaacuuccuucucuccuuggaacugcugacuuuccuaaccaguuacugguacaugaacag

SEQ ID NO: 390706 - RNA, 64 nt, Homo Sapiens
gccucagaaaauacgacugauucauauuuguggauuuccuaaaaauagauacauacuauauaua

SEQ ID NO: 390707 - RNA, 64 nt, Homo Sapiens
uccucuuguaguaauucucacuuuccaauccugguuuccuaaccugguuuccucucccuucccu

SEQ ID NO: 390708 - RNA, 64 nt, Homo Sapiens
auguuuuuaaagcaauuauuuagggucaccucauuuuccuaaaugacauauaaauaagcucauc

SEQ ID NO: 390709 - RNA, 64 nt, Homo Sapiens
uccugaagaaucuggcaaagcgggccaaucuguguuuccuaaggccuggaaaauuggggaauga

SEQ ID NO: 390710 - RNA, 64 nt, Homo Sapiens
caagcaacauuaacaucuucauuuuagaugaguguuuccuaauauaacccuguaauguguuucu

SEQ ID NO: 390711 - RNA, 64 nt, Homo Sapiens
ccaccaccuaacagagaacaccuaauaggcuuuuuuuccuaauauuaaauccaugaguaacuuu

SEQ ID NO: 390712 - RNA, 64 nt, Homo Sapiens
ggcuuuuuuuccuaauaccaaauccaugaguaacuuuccuaauaguuccaccaauuauaaauua

SEQ ID NO: 390713 - RNA, 64 nt, Homo Sapiens
aaaaagacaaagaauuuacuuuuagcaugauuauuuuccuaaauuauauaaaguacaacuugcu

SEQ ID NO: 390714 - RNA, 64 nt, Homo Sapiens
augagaagcagacuauaauacagaaagacuauuauuuccuaaccuagaaaaagcaccugcuuuu

SEQ ID NO: 390715 - RNA, 64 nt, Homo Sapiens
ugucgauuaccagaacguuauguaauaucuguuguuuccuaacauuuauuuccuaaguuucaga

SEQ ID NO: 390716 - RNA, 64 nt, Homo Sapiens
uucagauguaauaucuguuguuuuguguauuuuauuuccuaaguacuuuaaaauaguccuuuua

SEQ ID NO: 390717 - RNA, 64 nt, Homo Sapiens
gagucacauagguaaaucauuauuuaacuuagguuuuccuaaaguuagaauagucgaauguucu

SEQ ID NO: 390718 - RNA, 64 nt, Homo Sapiens
guucuugcauuagcucaauugaugucaucacugauuuccuaaacuagaaacuauggaagcaucu

SEQ ID NO: 390719 - RNA, 64 nt, Homo Sapiens
uguggcaaaaacguuucuuucuuauuuuuuuucuuuuccuaaaacagacuugaaaguauuauac

SEQ ID NO: 390720 - RNA, 64 nt, Homo Sapiens
uggcaggacagucucuugagggguuuuguuucuguuuccuaaauacuccuaaauaauauuucua

SEQ ID NO: 390721 - RNA, 64 nt, Homo Sapiens
uugagaaagucuuauuuauuuuugaugaacaaaauuuccuaauuacuugcuccuaauguugaau

SEQ ID NO: 390722 - RNA, 64 nt, Homo Sapiens
gauuguaugaauuuaugcucuagauauuaccaguuuuccuaaguaagcauguauucagcuuuag

SEQ ID NO: 390723 - RNA, 64 nt, Homo Sapiens
ggaguuugaggccccuaagcuccgguguccggacuuuccuaauuauuggggguuucucuuucug

SEQ ID NO: 390724 - RNA, 64 nt, Homo Sapiens
ggggguuucucuuucuguccuuuuuuuuuuuuuuuuuccuaauucugccaugucuuuuuuuuuu

SEQ ID NO: 390725 - RNA, 64 nt, Homo Sapiens
aucagaugcugugcagaauucugauuuauuuuuguuuccuaaaauuaagauagcuugaauauua

SEQ ID NO: 390726 - RNA, 64 nt, Homo Sapiens
uuauaaauuauuaacuauaauauaugauggauuuuuuccuaauuuuuuauauuuccuuacaauu

SEQ ID NO: 390727 - RNA, 64 nt, Homo Sapiens
ucuucucagcucuuccaugauggauuccccccccuuuccuaaagccaucaugccuugauaaaua

SEQ ID NO: 390728 - RNA, 64 nt, Homo Sapiens
auuuaacugacaugcauauugauucugaaauuuuuuuccuaaguuuuuuucauuuuuuugaaug

SEQ ID NO: 390729 - RNA, 64 nt, Homo Sapiens
ggguuuaguucugucuuuuuucccucggucccuuuuuccuaaacggauuacuuaaccacugcug

SEQ ID NO: 390730 - RNA, 64 nt, Homo Sapiens
gacuuguccaagugcuuggccaugugccacccccuuuccuaacauuuuccagauggcggaagag

SEQ ID NO: 390731 - RNA, 64 nt, Homo Sapiens
aagauacagaaauacagcaagccuuaauauaaaguuuccuaaaguuucuucaaguauuuuuuaa

SEQ ID NO: 390732 - RNA, 64 nt, Homo Sapiens
uuguucacaccaaaaugugacaguucuuucauguuuuccuaaaccaaguuaaaauuacauguau

SEQ ID NO: 390733 - RNA, 64 nt, Homo Sapiens
uguauaacuagcaacauuuaugguuauagguugauuuccuaaguguggcugaugguagccucua

SEQ ID NO: 390734 - RNA, 64 nt, Homo Sapiens
ugcuacagccaagaccugcucuuguggagguacauuuccuaagccggaacacucaagcuuuuuu

SEQ ID NO: 390735 - RNA, 64 nt, Homo Sapiens
gcucaguggucuucaacuugaggacgagggugauuuuccuaagaaaucagcaaagagggaaggc

SEQ ID NO: 390736 - RNA, 64 nt, Homo Sapiens
caauauaucauugacuccuggguuccucaggucauuuccuaauaucugucccuauccaaugccu

SEQ ID NO: 390737 - RNA, 64 nt, Homo Sapiens
agugaagcuuaguuugacaaagggugucauaugcuuuccuaaccugauuuguaguuaacauuca

SEQ ID NO: 390738 - RNA, 64 nt, Homo Sapiens
uccaagaaugcugaaaaauacuguucuauccagguuuccuaaacuauaaaagcagauuuugcuu

SEQ ID NO: 390739 - RNA, 64 nt, Homo Sapiens
uguuuuuaacaugaaaauuaaaaguaauucugucuuuccuaaaguucagaacauuuuauaccua

SEQ ID NO: 390740 - RNA, 64 nt, Homo Sapiens
cagcucauaggugcuagcuauauuaucugagccuuuuccuaaugaaacccuuauacuaucuuuu

SEQ ID NO: 390741 - RNA, 64 nt, Homo Sapiens
ccuuauacuaucuuuuuauucugccauugaugcuuuuccuaaacaagauuccuacacuuuauuu

SEQ ID NO: 390742 - RNA, 64 nt, Homo Sapiens
acuuuguuacugugcugugaugugguaguccuguuuuccuaauaugugcacucuguaacaucuu

SEQ ID NO: 390743 - RNA, 64 nt, Homo Sapiens
aaaaccacucuuugaucauguuuuaguagaauuguuuccuaaagacuucuauuaccauguuguu

SEQ ID NO: 390744 - RNA, 64 nt, Homo Sapiens; identical to SEQ ID NO: 352415

SEQ ID NO: 390745 - RNA, 64 nt, Homo Sapiens; identical to SEQ ID NO: 352416

SEQ ID NO: 390746 - RNA, 64 nt, Homo Sapiens; identical to SEQ ID NO: 352417

SEQ ID NO: 390747 - RNA, 64 nt, Homo Sapiens; identical to SEQ ID NO: 352418

SEQ ID NO: 390748 - RNA, 64 nt, Homo Sapiens; identical to SEQ ID NO: 352419

SEQ ID NO: 390749 - RNA, 64 nt, Homo Sapiens; identical to SEQ ID NO: 352420

SEQ ID NO: 390750 - RNA, 64 nt, Homo Sapiens; identical to SEQ ID NO: 352421

SEQ ID NO: 390751 - RNA, 64 nt, Homo Sapiens; identical to SEQ ID NO: 352422

SEQ ID NO: 390752 - RNA, 64 nt, Homo Sapiens; identical to SEQ ID NO: 352423

SEQ ID NO: 390753 - RNA, 64 nt, Homo Sapiens; identical to SEQ ID NO: 352424

SEQ ID NO: 390754 - RNA, 64 nt, Homo Sapiens; identical to SEQ ID NO: 352425

SEQ ID NO: 390755 - RNA, 64 nt, Homo Sapiens; identical to SEQ ID NO: 352426

SEQ ID NO: 390756 - RNA, 64 nt, Homo Sapiens; identical to SEQ ID NO: 352427

SEQ ID NO: 390757 - RNA, 64 nt, Homo Sapiens; identical to SEQ ID NO: 352428

SEQ ID NO: 390758 - RNA, 64 nt, Homo Sapiens; identical to SEQ ID NO: 352429

SEQ ID NO: 390759 - RNA, 64 nt, Homo Sapiens; identical to SEQ ID NO: 352430

SEQ ID NO: 390760 - RNA, 64 nt, Homo Sapiens; identical to SEQ ID NO: 352431

SEQ ID NO: 390761 - RNA, 64 nt, Homo Sapiens; identical to SEQ ID NO: 352432

SEQ ID NO: 390762 - RNA, 64 nt, Homo Sapiens; identical to SEQ ID NO: 352433

SEQ ID NO: 390763 - RNA, 64 nt, Homo Sapiens; identical to SEQ ID NO: 352434

SEQ ID NO: 390764 - RNA, 64 nt, Homo Sapiens; identical to SEQ ID NO: 352435

SEQ ID NO: 390765 - RNA, 64 nt, Homo Sapiens; identical to SEQ ID NO: 352436

SEQ ID NO: 390766 - RNA, 64 nt, Homo Sapiens; identical to SEQ ID NO: 352437

SEQ ID NO: 390767 - RNA, 64 nt, Homo Sapiens; identical to SEQ ID NO: 352438

SEQ ID NO: 390768 - RNA, 64 nt, Homo Sapiens; identical to SEQ ID NO: 352439

SEQ ID NO: 390769 - RNA, 64 nt, Homo Sapiens; identical to SEQ ID NO: 352440

SEQ ID NO: 390770 - RNA, 64 nt, Homo Sapiens; identical to SEQ ID NO: 352441

SEQ ID NO: 390771 - RNA, 64 nt, Homo Sapiens; identical to SEQ ID NO: 352442

SEQ ID NO: 390772 - RNA, 64 nt, Homo Sapiens; identical to SEQ ID NO: 352443

SEQ ID NO: 390773 - RNA, 64 nt, Homo Sapiens; identical to SEQ ID NO: 352444

SEQ ID NO: 390774 - RNA, 64 nt, Homo Sapiens; identical to SEQ ID NO: 352445

SEQ ID NO: 390775 - RNA, 64 nt, Homo Sapiens; identical to SEQ ID NO: 352446

SEQ ID NO: 390776 - RNA, 64 nt, Homo Sapiens; identical to SEQ ID NO: 352447

SEQ ID NO: 390777 - RNA, 64 nt, Homo Sapiens; identical to SEQ ID NO: 352448

SEQ ID NO: 390778 - RNA, 64 nt, Homo Sapiens; identical to SEQ ID NO: 352449

SEQ ID NO: 390779 - RNA, 64 nt, Homo Sapiens; identical to SEQ ID NO: 352450

SEQ ID NO: 390780 - RNA, 64 nt, Homo Sapiens; identical to SEQ ID NO: 352451

SEQ ID NO: 390781 - RNA, 64 nt, Homo Sapiens; identical to SEQ ID NO: 352452

SEQ ID NO: 390782 - RNA, 64 nt, Homo Sapiens; identical to SEQ ID NO: 352453

SEQ ID NO: 390783 - RNA, 64 nt, Homo Sapiens; identical to SEQ ID NO: 352454

SEQ ID NO: 390784 - RNA, 64 nt, Homo Sapiens; identical to SEQ ID NO: 352455

SEQ ID NO: 390785 - RNA, 64 nt, Homo Sapiens; identical to SEQ ID NO: 352456

SEQ ID NO: 390786 - RNA, 64 nt, Homo Sapiens; identical to SEQ ID NO: 352457

SEQ ID NO: 390787 - RNA, 64 nt, Homo Sapiens; identical to SEQ ID NO: 352458

SEQ ID NO: 390788 - RNA, 64 nt, Homo Sapiens; identical to SEQ ID NO: 352459

SEQ ID NO: 390789 - RNA, 64 nt, Homo Sapiens; identical to SEQ ID NO: 352460

SEQ ID NO: 390790 - RNA, 64 nt, Homo Sapiens; identical to SEQ ID NO: 352461

SEQ ID NO: 390791 - RNA, 64 nt, Homo Sapiens; identical to SEQ ID NO: 352462

SEQ ID NO: 390792 - RNA, 64 nt, Homo Sapiens; identical to SEQ ID NO: 352463

SEQ ID NO: 390793 - RNA, 64 nt, Homo Sapiens; identical to SEQ ID NO: 352464

SEQ ID NO: 390794 - RNA, 64 nt, Homo Sapiens; identical to SEQ ID NO: 352465

SEQ ID NO: 390795 - RNA, 64 nt, Homo Sapiens; identical to SEQ ID NO: 352466

SEQ ID NO: 390796 - RNA, 64 nt, Homo Sapiens; identical to SEQ ID NO: 196427

SEQ ID NO: 390797 - RNA, 64 nt, Homo Sapiens; identical to SEQ ID NO: 196428

SEQ ID NO: 390798 - RNA, 64 nt, Homo Sapiens; identical to SEQ ID NO: 196429

SEQ ID NO: 390799 - RNA, 64 nt, Homo Sapiens; identical to SEQ ID NO: 196430

SEQ ID NO: 390800 - RNA, 64 nt, Homo Sapiens; identical to SEQ ID NO: 196431

SEQ ID NO: 390801 - RNA, 64 nt, Homo Sapiens; identical to SEQ ID NO: 196432

SEQ ID NO: 390802 - RNA, 64 nt, Homo Sapiens; identical to SEQ ID NO: 196433

SEQ ID NO: 390803 - RNA, 64 nt, Homo Sapiens; identical to SEQ ID NO: 196434

SEQ ID NO: 390804 - RNA, 64 nt, Homo Sapiens; identical to SEQ ID NO: 196435

SEQ ID NO: 390805 - RNA, 64 nt, Homo Sapiens; identical to SEQ ID NO: 196436

SEQ ID NO: 390806 - RNA, 64 nt, Homo Sapiens; identical to SEQ ID NO: 196437

SEQ ID NO: 390807 - RNA, 64 nt, Homo Sapiens; identical to SEQ ID NO: 196438

SEQ ID NO: 390808 - RNA, 64 nt, Homo Sapiens; identical to SEQ ID NO: 196439

SEQ ID NO: 390809 - RNA, 64 nt, Homo Sapiens; identical to SEQ ID NO: 196440

SEQ ID NO: 390810 - RNA, 64 nt, Homo Sapiens; identical to SEQ ID NO: 196441

SEQ ID NO: 390811 - RNA, 57 nt, Homo Sapiens; identical to SEQ ID NO: 196442

SEQ ID NO: 390812 - RNA, 64 nt, Homo Sapiens; identical to SEQ ID NO: 196443

SEQ ID NO: 390813 - RNA, 64 nt, Homo Sapiens; identical to SEQ ID NO: 196444

SEQ ID NO: 390814 - RNA, 64 nt, Homo Sapiens; identical to SEQ ID NO: 196445

SEQ ID NO: 390815 - RNA, 64 nt, Homo Sapiens; identical to SEQ ID NO: 196446

SEQ ID NO: 390816 - RNA, 64 nt, Homo Sapiens; identical to SEQ ID NO: 196447

SEQ ID NO: 390817 - RNA, 64 nt, Homo Sapiens
augagaugggaccagguagcuggaaggcaggugaggaugucaggagccucauuccuucacaaga

SEQ ID NO: 390818 - RNA, 64 nt, Homo Sapiens
gaagcuggaccaccuggagugaagccuuccuccuggaugucaggguugggcagugugccauccu

SEQ ID NO: 390819 - RNA, 64 nt, Homo Sapiens; identical to SEQ ID NO: 311264

SEQ ID NO: 390820 - RNA, 64 nt, Homo Sapiens; identical to SEQ ID NO: 311265

SEQ ID NO: 390821 - RNA, 64 nt, Homo Sapiens; identical to SEQ ID NO: 311266

SEQ ID NO: 390822 - RNA, 64 nt, Homo Sapiens; identical to SEQ ID NO: 311267

SEQ ID NO: 390823 - RNA, 64 nt, Homo Sapiens; identical to SEQ ID NO: 311268

SEQ ID NO: 390824 - RNA, 64 nt, Homo Sapiens; identical to SEQ ID NO: 311269

SEQ ID NO: 390825 - RNA, 64 nt, Homo Sapiens; identical to SEQ ID NO: 311270

SEQ ID NO: 390826 - RNA, 64 nt, Homo Sapiens; identical to SEQ ID NO: 311271

SEQ ID NO: 390827 - RNA, 64 nt, Homo Sapiens; identical to SEQ ID NO: 311272

SEQ ID NO: 390828 - RNA, 64 nt, Homo Sapiens; identical to SEQ ID NO: 311273

SEQ ID NO: 390829 - RNA, 64 nt, Homo Sapiens; identical to SEQ ID NO: 311274

SEQ ID NO: 390830 - RNA, 64 nt, Homo Sapiens; identical to SEQ ID NO: 311275

SEQ ID NO: 390831 - RNA, 64 nt, Homo Sapiens; identical to SEQ ID NO: 311276

SEQ ID NO: 390832 - RNA, 64 nt, Homo Sapiens; identical to SEQ ID NO: 311277

SEQ ID NO: 390833 - RNA, 64 nt, Homo Sapiens; identical to SEQ ID NO: 311278

SEQ ID NO: 390834 - RNA, 64 nt, Homo Sapiens; identical to SEQ ID NO: 311279

SEQ ID NO: 390835 - RNA, 64 nt, Homo Sapiens; identical to SEQ ID NO: 311280

SEQ ID NO: 390836 - RNA, 64 nt, Homo Sapiens; identical to SEQ ID NO: 311281

SEQ ID NO: 390837 - RNA, 64 nt, Homo Sapiens; identical to SEQ ID NO: 311282

SEQ ID NO: 390838 - RNA, 64 nt, Homo Sapiens; identical to SEQ ID NO: 311283

SEQ ID NO: 390839 - RNA, 64 nt, Homo Sapiens; identical to SEQ ID NO: 311284

SEQ ID NO: 390840 - RNA, 64 nt, Homo Sapiens; identical to SEQ ID NO: 311285

SEQ ID NO: 390841 - RNA, 64 nt, Homo Sapiens; identical to SEQ ID NO: 311286

SEQ ID NO: 390842 - RNA, 64 nt, Homo Sapiens; identical to SEQ ID NO: 311287

SEQ ID NO: 390843 - RNA, 64 nt, Homo Sapiens; identical to SEQ ID NO: 311288

SEQ ID NO: 390844 - RNA, 64 nt, Homo Sapiens; identical to SEQ ID NO: 311289

SEQ ID NO: 390845 - RNA, 55 nt, Homo Sapiens; identical to SEQ ID NO: 244290

SEQ ID NO: 390846 - RNA, 64 nt, Homo Sapiens; identical to SEQ ID NO: 311291

SEQ ID NO: 390847 - RNA, 64 nt, Homo Sapiens; identical to SEQ ID NO: 311292

SEQ ID NO: 390848 - RNA, 64 nt, Homo Sapiens; identical to SEQ ID NO: 311293

SEQ ID NO: 390849 - RNA, 64 nt, Homo Sapiens; identical to SEQ ID NO: 311294

SEQ ID NO: 390850 - RNA, 64 nt, Homo Sapiens; identical to SEQ ID NO: 311295

SEQ ID NO: 390851 - RNA, 64 nt, Homo Sapiens; identical to SEQ ID NO: 311296

SEQ ID NO: 390852 - RNA, 64 nt, Homo Sapiens; identical to SEQ ID NO: 311297

SEQ ID NO: 390853 - RNA, 64 nt, Homo Sapiens; identical to SEQ ID NO: 311298

SEQ ID NO: 390854 - RNA, 64 nt, Homo Sapiens; identical to SEQ ID NO: 311299

SEQ ID NO: 390855 - RNA, 64 nt, Homo Sapiens; identical to SEQ ID NO: 311300

SEQ ID NO: 390856 - RNA, 64 nt, Homo Sapiens; identical to SEQ ID NO: 311301

SEQ ID NO: 390857 - RNA, 64 nt, Homo Sapiens; identical to SEQ ID NO: 81735

SEQ ID NO: 390858 - RNA, 64 nt, Homo Sapiens; identical to SEQ ID NO: 81736

SEQ ID NO: 390859 - RNA, 64 nt, Homo Sapiens; identical to SEQ ID NO: 81737

SEQ ID NO: 390860 - RNA, 64 nt, Homo Sapiens; identical to SEQ ID NO: 81738

SEQ ID NO: 390861 - RNA, 64 nt, Homo Sapiens; identical to SEQ ID NO: 81739

SEQ ID NO: 390862 - RNA, 64 nt, Homo Sapiens; identical to SEQ ID NO: 81740

SEQ ID NO: 390863 - RNA, 64 nt, Homo Sapiens; identical to SEQ ID NO: 81741

SEQ ID NO: 390864 - RNA, 64 nt, Homo Sapiens; identical to SEQ ID NO: 81742

SEQ ID NO: 390865 - RNA, 64 nt, Homo Sapiens
agccgugcaggccuuugcaguugcccuggccaacgugacucagcgccucaaaugaagagacugg

SEQ ID NO: 390866 - RNA, 64 nt, Homo Sapiens
auacacagguucacaucacucugcagacagcaaugugacucagcgugugacuuguagcagcagu

SEQ ID NO: 390867 - RNA, 64 nt, Homo Sapiens
gaccuaccaggacagaacuuuccccaauuacagggugacucacagccgcauuggugacucacuu

SEQ ID NO: 390868 - RNA, 64 nt, Homo Sapiens
uuccccaauuacagggugacucacagccgcauuggugacucacuucaaugugucauuuccggcu

SEQ ID NO: 390869 - RNA, 64 nt, Homo Sapiens
uaaggccacucaacaaguuuucuagagugcuuaugugacucaccuuugcaauaaggaagcuaua

SEQ ID NO: 390870 - RNA, 64 nt, Homo Sapiens
caaauuuguaguuuguaaaauucaccuuuucagagugacucaauugcagaggucaagggccaca

SEQ ID NO: 390871 - RNA, 64 nt, Homo Sapiens
agggcacaguguuguggagggcuaaguugguucugugacucauuccucauacccuaacuccauc

SEQ ID NO: 390872 - RNA, 64 nt, Homo Sapiens
gucccugccucuacccccaccccuuuugagucgggugacucauuuuucuguguagagacucggu

SEQ ID NO: 390873 - RNA, 64 nt, Homo Sapiens
cgcaucggccucccaaaguggaucucuugaccuugugacucaccaaguuggccaggauggucuc

SEQ ID NO: 390874 - RNA, 64 nt, Homo Sapiens
uugcauugguaauuuuuuuuaauuuuguccacaugugacucaaauacauuucauaugaaagcau

SEQ ID NO: 390875 - RNA, 64 nt, Homo Sapiens
uccacccucccuggucccuacccccaagucacaggugacucagcagugacccugugugccaggc

SEQ ID NO: 390876 - RNA, 64 nt, Homo Sapiens
gaacaaacccucaggcaccagcacagggcucugggugacucaguaaaacuaacguuugucucug

SEQ ID NO: 390877 - RNA, 64 nt, Homo Sapiens; identical to SEQ ID NO: 178899

SEQ ID NO: 390878 - RNA, 64 nt, Homo Sapiens; identical to SEQ ID NO: 178900

SEQ ID NO: 390879 - RNA, 64 nt, Homo Sapiens; identical to SEQ ID NO: 178901

SEQ ID NO: 390880 - RNA, 64 nt, Homo Sapiens; identical to SEQ ID NO: 178902

SEQ ID NO: 390881 - RNA, 64 nt, Homo Sapiens; identical to SEQ ID NO: 178903

SEQ ID NO: 390882 - RNA, 64 nt, Homo Sapiens; identical to SEQ ID NO: 178904

SEQ ID NO: 390883 - RNA, 64 nt, Homo Sapiens; identical to SEQ ID NO: 178905

SEQ ID NO: 390884 - RNA, 64 nt, Homo Sapiens; identical to SEQ ID NO: 178906

SEQ ID NO: 390885 - RNA, 64 nt, Homo Sapiens; identical to SEQ ID NO: 178907

SEQ ID NO: 390886 - RNA, 64 nt, Homo Sapiens; identical to SEQ ID NO: 178908

SEQ ID NO: 390887 - RNA, 64 nt, Homo Sapiens; identical to SEQ ID NO: 178909

SEQ ID NO: 390888 - RNA, 64 nt, Homo Sapiens; identical to SEQ ID NO: 178910

SEQ ID NO: 390889 - RNA, 64 nt, Homo Sapiens; identical to SEQ ID NO: 178911

SEQ ID NO: 390890 - RNA, 64 nt, Homo Sapiens; identical to SEQ ID NO: 178912

SEQ ID NO: 390891 - RNA, 64 nt, Homo Sapiens; identical to SEQ ID NO: 178913

SEQ ID NO: 390892 - RNA, 64 nt, Homo Sapiens; identical to SEQ ID NO: 178914

SEQ ID NO: 390893 - RNA, 64 nt, Homo Sapiens; identical to SEQ ID NO: 178915

SEQ ID NO: 390894 - RNA, 64 nt, Homo Sapiens; identical to SEQ ID NO: 178916

SEQ ID NO: 390895 - RNA, 64 nt, Homo Sapiens; identical to SEQ ID NO: 178917

SEQ ID NO: 390896 - RNA, 64 nt, Homo Sapiens; identical to SEQ ID NO: 178918

SEQ ID NO: 390897 - RNA, 64 nt, Homo Sapiens; identical to SEQ ID NO: 178919

SEQ ID NO: 390898 - RNA, 64 nt, Homo Sapiens; identical to SEQ ID NO: 178920

SEQ ID NO: 390899 - RNA, 64 nt, Homo Sapiens; identical to SEQ ID NO: 178921

SEQ ID NO: 390900 - RNA, 64 nt, Homo Sapiens; identical to SEQ ID NO: 178922

SEQ ID NO: 390901 - RNA, 64 nt, Homo Sapiens; identical to SEQ ID NO: 178923

SEQ ID NO: 390902 - RNA, 64 nt, Homo Sapiens; identical to SEQ ID NO: 178924

SEQ ID NO: 390903 - RNA, 58 nt, Homo Sapiens; identical to SEQ ID NO: 178925

SEQ ID NO: 390904 - RNA, 64 nt, Homo Sapiens; identical to SEQ ID NO: 178926

SEQ ID NO: 390905 - RNA, 64 nt, Homo Sapiens; identical to SEQ ID NO: 178927

SEQ ID NO: 390906 - RNA, 64 nt, Homo Sapiens; identical to SEQ ID NO: 178928

SEQ ID NO: 390907 - RNA, 64 nt, Homo Sapiens; identical to SEQ ID NO: 178929

SEQ ID NO: 390908 - RNA, 64 nt, Homo Sapiens; identical to SEQ ID NO: 178930

SEQ ID NO: 390909 - RNA, 64 nt, Homo Sapiens; identical to SEQ ID NO: 178931

SEQ ID NO: 390910 - RNA, 64 nt, Homo Sapiens; identical to SEQ ID NO: 178932

SEQ ID NO: 390911 - RNA, 64 nt, Homo Sapiens; identical to SEQ ID NO: 178933

SEQ ID NO: 390912 - RNA, 64 nt, Homo Sapiens; identical to SEQ ID NO: 178934

SEQ ID NO: 390913 - RNA, 64 nt, Homo Sapiens; identical to SEQ ID NO: 178935

SEQ ID NO: 390914 - RNA, 64 nt, Homo Sapiens; identical to SEQ ID NO: 178936

SEQ ID NO: 390915 - RNA, 64 nt, Homo Sapiens; identical to SEQ ID NO: 178937

SEQ ID NO: 390916 - RNA, 64 nt, Homo Sapiens; identical to SEQ ID NO: 178938

SEQ ID NO: 390917 - RNA, 64 nt, Homo Sapiens; identical to SEQ ID NO: 178939

SEQ ID NO: 390918 - RNA, 64 nt, Homo Sapiens; identical to SEQ ID NO: 178940

SEQ ID NO: 390919 - RNA, 64 nt, Homo Sapiens; identical to SEQ ID NO: 178941

SEQ ID NO: 390920 - RNA, 64 nt, Homo Sapiens; identical to SEQ ID NO: 178942

SEQ ID NO: 390921 - RNA, 64 nt, Homo Sapiens; identical to SEQ ID NO: 178943

SEQ ID NO: 390922 - RNA, 64 nt, Homo Sapiens; identical to SEQ ID NO: 178944

SEQ ID NO: 390923 - RNA, 60 nt, Homo Sapiens; identical to SEQ ID NO: 178945

SEQ ID NO: 390924 - RNA, 64 nt, Homo Sapiens; identical to SEQ ID NO: 178946

SEQ ID NO: 390925 - RNA, 64 nt, Homo Sapiens; identical to SEQ ID NO: 178947

SEQ ID NO: 390926 - RNA, 64 nt, Homo Sapiens; identical to SEQ ID NO: 178948

SEQ ID NO: 390927 - RNA, 64 nt, Homo Sapiens; identical to SEQ ID NO: 178949

SEQ ID NO: 390928 - RNA, 64 nt, Homo Sapiens; identical to SEQ ID NO: 178950

SEQ ID NO: 390929 - RNA, 64 nt, Homo Sapiens; identical to SEQ ID NO: 178951

SEQ ID NO: 390930 - RNA, 64 nt, Homo Sapiens; identical to SEQ ID NO: 178952

SEQ ID NO: 390931 - RNA, 64 nt, Homo Sapiens; identical to SEQ ID NO: 178953

SEQ ID NO: 390932 - RNA, 64 nt, Homo Sapiens; identical to SEQ ID NO: 178954

SEQ ID NO: 390933 - RNA, 64 nt, Homo Sapiens; identical to SEQ ID NO: 178955

SEQ ID NO: 390934 - RNA, 64 nt, Homo Sapiens; identical to SEQ ID NO: 178956

SEQ ID NO: 390935 - RNA, 64 nt, Homo Sapiens; identical to SEQ ID NO: 178957

SEQ ID NO: 390936 - RNA, 64 nt, Homo Sapiens; identical to SEQ ID NO: 178958

SEQ ID NO: 390937 - RNA, 64 nt, Homo Sapiens; identical to SEQ ID NO: 178959

SEQ ID NO: 390938 - RNA, 64 nt, Homo Sapiens; identical to SEQ ID NO: 178960

SEQ ID NO: 390939 - RNA, 64 nt, Homo Sapiens; identical to SEQ ID NO: 178961

SEQ ID NO: 390940 - RNA, 64 nt, Homo Sapiens; identical to SEQ ID NO: 178962

SEQ ID NO: 390941 - RNA, 64 nt, Homo Sapiens; identical to SEQ ID NO: 178963

SEQ ID NO: 390942 - RNA, 64 nt, Homo Sapiens; identical to SEQ ID NO: 178964

SEQ ID NO: 390943 - RNA, 64 nt, Homo Sapiens; identical to SEQ ID NO: 178965

SEQ ID NO: 390944 - RNA, 64 nt, Homo Sapiens; identical to SEQ ID NO: 178966

SEQ ID NO: 390945 - RNA, 64 nt, Homo Sapiens; identical to SEQ ID NO: 178967

SEQ ID NO: 390946 - RNA, 64 nt, Homo Sapiens; identical to SEQ ID NO: 178968

SEQ ID NO: 390947 - RNA, 64 nt, Homo Sapiens; identical to SEQ ID NO: 178969

SEQ ID NO: 390948 - RNA, 64 nt, Homo Sapiens; identical to SEQ ID NO: 178970

SEQ ID NO: 390949 - RNA, 64 nt, Homo Sapiens; identical to SEQ ID NO: 178971

SEQ ID NO: 390950 - RNA, 64 nt, Homo Sapiens; identical to SEQ ID NO: 178972

SEQ ID NO: 390951 - RNA, 64 nt, Homo Sapiens; identical to SEQ ID NO: 178973

SEQ ID NO: 390952 - RNA, 64 nt, Homo Sapiens; identical to SEQ ID NO: 178974

SEQ ID NO: 390953 - RNA, 64 nt, Homo Sapiens; identical to SEQ ID NO: 178975

SEQ ID NO: 390954 - RNA, 64 nt, Homo Sapiens; identical to SEQ ID NO: 178976

SEQ ID NO: 390955 - RNA, 64 nt, Homo Sapiens; identical to SEQ ID NO: 178977

SEQ ID NO: 390956 - RNA, 64 nt, Homo Sapiens; identical to SEQ ID NO: 178978

SEQ ID NO: 390957 - RNA, 64 nt, Homo Sapiens; identical to SEQ ID NO: 178979

SEQ ID NO: 390958 - RNA, 64 nt, Homo Sapiens; identical to SEQ ID NO: 178980

SEQ ID NO: 390959 - RNA, 64 nt, Homo Sapiens; identical to SEQ ID NO: 178981

SEQ ID NO: 390960 - RNA, 64 nt, Homo Sapiens; identical to SEQ ID NO: 178982

SEQ ID NO: 390961 - RNA, 64 nt, Homo Sapiens; identical to SEQ ID NO: 178983

SEQ ID NO: 390962 - RNA, 64 nt, Homo Sapiens; identical to SEQ ID NO: 178984

SEQ ID NO: 390963 - RNA, 64 nt, Homo Sapiens; identical to SEQ ID NO: 178985

SEQ ID NO: 390964 - RNA, 64 nt, Homo Sapiens; identical to SEQ ID NO: 178986

SEQ ID NO: 390965 - RNA, 64 nt, Homo Sapiens; identical to SEQ ID NO: 178987

SEQ ID NO: 390966 - RNA, 64 nt, Homo Sapiens; identical to SEQ ID NO: 178988

SEQ ID NO: 390967 - RNA, 64 nt, Homo Sapiens; identical to SEQ ID NO: 178989

SEQ ID NO: 390968 - RNA, 64 nt, Homo Sapiens; identical to SEQ ID NO: 178990

SEQ ID NO: 390969 - RNA, 64 nt, Homo Sapiens; identical to SEQ ID NO: 178991

SEQ ID NO: 390970 - RNA, 64 nt, Homo Sapiens; identical to SEQ ID NO: 106208

SEQ ID NO: 390971 - RNA, 64 nt, Homo Sapiens; identical to SEQ ID NO: 106209

SEQ ID NO: 390972 - RNA, 64 nt, Homo Sapiens; identical to SEQ ID NO: 106210

SEQ ID NO: 390973 - RNA, 64 nt, Homo Sapiens; identical to SEQ ID NO: 106211

SEQ ID NO: 390974 - RNA, 64 nt, Homo Sapiens; identical to SEQ ID NO: 106212

SEQ ID NO: 390975 - RNA, 64 nt, Homo Sapiens; identical to SEQ ID NO: 106213

SEQ ID NO: 390976 - RNA, 64 nt, Homo Sapiens; identical to SEQ ID NO: 106214

SEQ ID NO: 390977 - RNA, 64 nt, Homo Sapiens; identical to SEQ ID NO: 106215

SEQ ID NO: 390978 - RNA, 64 nt, Homo Sapiens; identical to SEQ ID NO: 106216

SEQ ID NO: 390979 - RNA, 64 nt, Homo Sapiens; identical to SEQ ID NO: 106217

SEQ ID NO: 390980 - RNA, 64 nt, Homo Sapiens; identical to SEQ ID NO: 106218

SEQ ID NO: 390981 - RNA, 64 nt, Homo Sapiens; identical to SEQ ID NO: 106219

SEQ ID NO: 390982 - RNA, 64 nt, Homo Sapiens; identical to SEQ ID NO: 106220

SEQ ID NO: 390983 - RNA, 64 nt, Homo Sapiens; identical to SEQ ID NO: 106221

SEQ ID NO: 390984 - RNA, 64 nt, Homo Sapiens; identical to SEQ ID NO: 106222

SEQ ID NO: 390985 - RNA, 64 nt, Homo Sapiens; identical to SEQ ID NO: 106223

SEQ ID NO: 390986 - RNA, 64 nt, Homo Sapiens; identical to SEQ ID NO: 106224

SEQ ID NO: 390987 - RNA, 64 nt, Homo Sapiens; identical to SEQ ID NO: 106225

SEQ ID NO: 390988 - RNA, 64 nt, Homo Sapiens; identical to SEQ ID NO: 106226

SEQ ID NO: 390989 - RNA, 64 nt, Homo Sapiens; identical to SEQ ID NO: 106227

SEQ ID NO: 390990 - RNA, 64 nt, Homo Sapiens; identical to SEQ ID NO: 338022

SEQ ID NO: 390991 - RNA, 64 nt, Homo Sapiens; identical to SEQ ID NO: 338023

SEQ ID NO: 390992 - RNA, 64 nt, Homo Sapiens; identical to SEQ ID NO: 338024

SEQ ID NO: 390993 - RNA, 64 nt, Homo Sapiens; identical to SEQ ID NO: 338025

SEQ ID NO: 390994 - RNA, 64 nt, Homo Sapiens; identical to SEQ ID NO: 338026

SEQ ID NO: 390995 - RNA, 64 nt, Homo Sapiens; identical to SEQ ID NO: 338027

SEQ ID NO: 390996 - RNA, 64 nt, Homo Sapiens; identical to SEQ ID NO: 338028

SEQ ID NO: 390997 - RNA, 64 nt, Homo Sapiens; identical to SEQ ID NO: 338029

SEQ ID NO: 390998 - RNA, 64 nt, Homo Sapiens; identical to SEQ ID NO: 338030

SEQ ID NO: 390999 - RNA, 64 nt, Homo Sapiens; identical to SEQ ID NO: 338031

SEQ ID NO: 391000 - RNA, 64 nt, Homo Sapiens; identical to SEQ ID NO: 338032

SEQ ID NO: 391001 - RNA, 64 nt, Homo Sapiens; identical to SEQ ID NO: 338033

SEQ ID NO: 391002 - RNA, 64 nt, Homo Sapiens; identical to SEQ ID NO: 338034

SEQ ID NO: 391003 - RNA, 64 nt, Homo Sapiens; identical to SEQ ID NO: 338035

SEQ ID NO: 391004 - RNA, 64 nt, Homo Sapiens; identical to SEQ ID NO: 338036

SEQ ID NO: 391005 - RNA, 64 nt, Homo Sapiens; identical to SEQ ID NO: 338037

SEQ ID NO: 391006 - RNA, 64 nt, Homo Sapiens; identical to SEQ ID NO: 338038

SEQ ID NO: 391007 - RNA, 64 nt, Homo Sapiens; identical to SEQ ID NO: 338039

SEQ ID NO: 391008 - RNA, 64 nt, Homo Sapiens; identical to SEQ ID NO: 338040

SEQ ID NO: 391009 - RNA, 64 nt, Homo Sapiens; identical to SEQ ID NO: 338041

SEQ ID NO: 391010 - RNA, 64 nt, Homo Sapiens; identical to SEQ ID NO: 338042

SEQ ID NO: 391011 - RNA, 64 nt, Homo Sapiens; identical to SEQ ID NO: 338043

SEQ ID NO: 391012 - RNA, 64 nt, Homo Sapiens; identical to SEQ ID NO: 338044

SEQ ID NO: 391013 - RNA, 64 nt, Homo Sapiens; identical to SEQ ID NO: 338045

SEQ ID NO: 391014 - RNA, 64 nt, Homo Sapiens; identical to SEQ ID NO: 338046

SEQ ID NO: 391015 - RNA, 64 nt, Homo Sapiens; identical to SEQ ID NO: 338047

SEQ ID NO: 391016 - RNA, 64 nt, Homo Sapiens; identical to SEQ ID NO: 338048

SEQ ID NO: 391017 - RNA, 64 nt, Homo Sapiens; identical to SEQ ID NO: 338049

SEQ ID NO: 391018 - RNA, 64 nt, Homo Sapiens; identical to SEQ ID NO: 338050

SEQ ID NO: 391019 - RNA, 64 nt, Homo Sapiens; identical to SEQ ID NO: 338051

SEQ ID NO: 391020 - RNA, 64 nt, Homo Sapiens
ucuuucauuggauuuuggaauguguauuugaaaauaaugagacauuucuuaaaccuagcaccuc

SEQ ID NO: 391021 - RNA, 64 nt, Homo Sapiens
aguaauggcaaggccuuuacguccuacuauuuaauaaugagagaucaauauccagguuuauugu

SEQ ID NO: 391022 - RNA, 64 nt, Homo Sapiens
uucaaucacuguagucuaaguuucuugauggcuguaaugagaacuagguaaugauuaugugucc

SEQ ID NO: 391023 - RNA, 64 nt, Homo Sapiens
uggguagaacucucugagauccggguuacauuacuaaugagaguuucuuucugaggagcggaca

SEQ ID NO: 391024 - RNA, 64 nt, Homo Sapiens
ucugguauuugaggugagauggcugcucuuuuauuaaugagacaugaauugugucucaacagaa

SEQ ID NO: 391025 - RNA, 64 nt, Homo Sapiens
uaucuaccccuuaccuguguuuauaacuuccagguaaugagaaugauuuuuuuuaaagcuaaaa

SEQ ID NO: 391026 - RNA, 64 nt, Homo Sapiens
ccaucaaauccugagugucaaauguauagcauuguaaugagagcacugauguuuguuccuguua

SEQ ID NO: 391027 - RNA, 64 nt, Homo Sapiens
ccauuuucagagacauucuaaguucccaguaagguaaugagauggagaagagugcucaauagac

SEQ ID NO: 391028 - RNA, 64 nt, Homo Sapiens
gaccugaagugaaggcuagaggacaauucuggacuaaugagaaaguagcaaguagcuuacaagg

SEQ ID NO: 391029 - RNA, 64 nt, Homo Sapiens
auaaaucuaugcuggugcaguaagucauaaagaauaaugagaaauggagauggugagcacaagg

SEQ ID NO: 391030 - RNA, 64 nt, Homo Sapiens
cugugaaaagagccaaguguuuuuuaaaacuuaguaaugagaaauaauuaucaguuaggcaaug

SEQ ID NO: 391031 - RNA, 64 nt, Homo Sapiens
ccacaaggccugccucugacaaccccuugaaggauaaugagaaaacaagaauuaguccaaaugg

SEQ ID NO: 391032 - RNA, 64 nt, Homo Sapiens
augugauauuauacauaacaagauacaugcuuuuuaaugagauaauacacacaguuaugccgcu

SEQ ID NO: 391033 - RNA, 64 nt, Homo Sapiens
uuaaaccauguaaagaacaucucuguuuucuuucuaaugagauauuuguaacuuucucuaugaa

SEQ ID NO: 391034 - RNA, 64 nt, Homo Sapiens
auucaccucuguuuuuuugugauuauuucacagauaaugagaccuuaauaacaaauaggcguaa

SEQ ID NO: 391035 - RNA, 64 nt, Homo Sapiens
gcuuuaauauuaaaguuaacaaguuuucauuuuauaaugagaucaaagcauuggaaucugcccu

SEQ ID NO: 391036 - RNA, 64 nt, Homo Sapiens
ugaggccaggaguuugagaccauccuaggcaacauaaugagacaccgucucuaaaauaaaauua

SEQ ID NO: 391037 - RNA, 64 nt, Homo Sapiens
ggugggcaagggguuugucuagcacaccagcauauaaugagaugcuugaugaauggugcauauu

SEQ ID NO: 391038 - RNA, 64 nt, Homo Sapiens
gcuuaucugucuuauuuaugcuuugagugaaucaucuguugaggucuaaugccuuuacuuggcc

SEQ ID NO: 391039 - RNA, 64 nt, Homo Sapiens
cuuuacacacauauacacacagacaucagaaaauucuguugagagcagguucauuaaauuugua

SEQ ID NO: 391040 - RNA, 64 nt, Homo Sapiens
cuauuuauuuauguauuuagagaucaggucucacucuguugaccaggcuggagugcagugguga

SEQ ID NO: 391041 - RNA, 64 nt, Homo Sapiens
ugggcaauucggauuuccugcuggaccacaagguucuguugauauuacauagaacggguauucc

SEQ ID NO: 391042 - RNA, 64 nt, Homo Sapiens
acugcauuccagccugggagagagagaggaccugucuguugaaaaaaacacaaaaacaaaugaa

SEQ ID NO: 391043 - RNA, 64 nt, Homo Sapiens
ggcuagcagggaagggccugggcuugaaugugacucuguugagacauggccagcaauucuggca

SEQ ID NO: 391044 - RNA, 64 nt, Homo Sapiens
ggaagaauauuaaaauuuuaaucaauaaaguaugucuguugaagcaagcaagcaaacaaaucca

SEQ ID NO: 391045 - RNA, 64 nt, Homo Sapiens
aacaaaacucucggugaaugaaccacugucauuuucuguugagucuauucuuaagaggccuuca

SEQ ID NO: 391046 - RNA, 64 nt, Homo Sapiens
gcugcugugcgcgugugagguucccuugcccagcucuguugaauauccuugacucucucucccc

SEQ ID NO: 391047 - RNA, 64 nt, Homo Sapiens
auuuagguuuuuuuuuaaacuauagaaagcaacaucuguugauccaaacagaacaaaggaaaaa

SEQ ID NO: 391048 - RNA, 64 nt, Homo Sapiens
ccguccaggaacuaacuuacugugugccccaggcucuguugaccgccaggcgcucugugugcug

SEQ ID NO: 391049 - RNA, 64 nt, Homo Sapiens
caggaaucccaagugaggggggucuccugcccucucuguugagccagccuugcaagaggacugg

SEQ ID NO: 391050 - RNA, 64 nt, Homo Sapiens
gaaucaacaaaccacaauacugucauuugggcuuucuguugaaucuccugaccacuaauagcau

SEQ ID NO: 391051 - RNA, 64 nt, Homo Sapiens
guaagccuuuugguuugggcuggaaggcuaacccucuguugacuuuuuuuggauuucucauuua

SEQ ID NO: 391052 - RNA, 64 nt, Homo Sapiens
cucgcgaguguaacuuucauauuaacauucuuuuucuguugaaaccuggccuggccuccaaaau

SEQ ID NO: 391053 - RNA, 64 nt, Homo Sapiens
agcacacacaauaaagaaccugauuggaauucuuucuguugaaaaaaugauuauauucacagac

SEQ ID NO: 391054 - RNA, 64 nt, Homo Sapiens
uguguuuucauuuacaucucucccuucuggugugucuguugaucuuccccgcggaaacaacgcu

SEQ ID NO: 391055 - RNA, 64 nt, Homo Sapiens
cuuuaagggagaaaugucggaaacuucucuugugucuguugagaugucagugcuugcuugaugg

SEQ ID NO: 391056 - RNA, 64 nt, Homo Sapiens; identical to SEQ ID NO: 283920

SEQ ID NO: 391057 - RNA, 64 nt, Homo Sapiens; identical to SEQ ID NO: 283921

SEQ ID NO: 391058 - RNA, 64 nt, Homo Sapiens; identical to SEQ ID NO: 283922

SEQ ID NO: 391059 - RNA, 64 nt, Homo Sapiens; identical to SEQ ID NO: 283923

SEQ ID NO: 391060 - RNA, 64 nt, Homo Sapiens; identical to SEQ ID NO: 283924

SEQ ID NO: 391061 - RNA, 64 nt, Homo Sapiens; identical to SEQ ID NO: 283925

SEQ ID NO: 391062 - RNA, 64 nt, Homo Sapiens; identical to SEQ ID NO: 283926

SEQ ID NO: 391063 - RNA, 64 nt, Homo Sapiens; identical to SEQ ID NO: 283927

SEQ ID NO: 391064 - RNA, 64 nt, Homo Sapiens; identical to SEQ ID NO: 283928

SEQ ID NO: 391065 - RNA, 64 nt, Homo Sapiens; identical to SEQ ID NO: 283929

SEQ ID NO: 391066 - RNA, 64 nt, Homo Sapiens; identical to SEQ ID NO: 283930

SEQ ID NO: 391067 - RNA, 64 nt, Homo Sapiens; identical to SEQ ID NO: 283931

SEQ ID NO: 391068 - RNA, 64 nt, Homo Sapiens; identical to SEQ ID NO: 283932

SEQ ID NO: 391069 - RNA, 64 nt, Homo Sapiens; identical to SEQ ID NO: 283933

SEQ ID NO: 391070 - RNA, 64 nt, Homo Sapiens; identical to SEQ ID NO: 283934

SEQ ID NO: 391071 - RNA, 64 nt, Homo Sapiens; identical to SEQ ID NO: 283935

SEQ ID NO: 391072 - RNA, 64 nt, Homo Sapiens; identical to SEQ ID NO: 283930

SEQ ID NO: 391073 - RNA, 64 nt, Homo Sapiens; identical to SEQ ID NO: 283937

SEQ ID NO: 391074 - RNA, 64 nt, Homo Sapiens; identical to SEQ ID NO: 283938

SEQ ID NO: 391075 - RNA, 64 nt, Homo Sapiens; identical to SEQ ID NO: 283939

SEQ ID NO: 391076 - RNA, 64 nt, Homo Sapiens; identical to SEQ ID NO: 283940

SEQ ID NO: 391077 - RNA, 64 nt, Homo Sapiens; identical to SEQ ID NO: 283941

SEQ ID NO: 391078 - RNA, 64 nt, Homo Sapiens; identical to SEQ ID NO: 283942

SEQ ID NO: 391079 - RNA, 64 nt, Homo Sapiens; identical to SEQ ID NO: 283943

SEQ ID NO: 391080 - RNA, 64 nt, Homo Sapiens; identical to SEQ ID NO: 283944

SEQ ID NO: 391081 - RNA, 60 nt, Homo Sapiens; identical to SEQ ID NO: 283945

SEQ ID NO: 391082 - RNA, 64 nt, Homo Sapiens; identical to SEQ ID NO: 283946

SEQ ID NO: 391083 - RNA, 64 nt, Homo Sapiens; identical to SEQ ID NO: 283947

SEQ ID NO: 391084 - RNA, 64 nt, Homo Sapiens; identical to SEQ ID NO: 283948

SEQ ID NO: 391085 - RNA, 64 nt, Homo Sapiens; identical to SEQ ID NO: 283949

SEQ ID NO: 391086 - RNA, 64 nt, Homo Sapiens; identical to SEQ ID NO: 283950

SEQ ID NO: 391087 - RNA, 64 nt, Homo Sapiens; identical to SEQ ID NO: 283951

SEQ ID NO: 391088 - RNA, 64 nt, Homo Sapiens; identical to SEQ ID NO: 283952

SEQ ID NO: 391089 - RNA, 64 nt, Homo Sapiens; identical to SEQ ID NO: 283953

SEQ ID NO: 391090 - RNA, 64 nt, Homo Sapiens; identical to SEQ ID NO: 283954

SEQ ID NO: 391091 - RNA, 64 nt, Homo Sapiens; identical to SEQ ID NO: 283955

SEQ ID NO: 391092 - RNA, 64 nt, Homo Sapiens; identical to SEQ ID NO: 283956

SEQ ID NO: 391093 - RNA, 64 nt, Homo Sapiens; identical to SEQ ID NO: 283957

SEQ ID NO: 391094 - RNA, 64 nt, Homo Sapiens; identical to SEQ ID NO: 283958

SEQ ID NO: 391095 - RNA, 64 nt, Homo Sapiens; identical to SEQ ID NO: 283959

SEQ ID NO: 391096 - RNA, 64 nt, Homo Sapiens; identical to SEQ ID NO: 283960

SEQ ID NO: 391097 - RNA, 64 nt, Homo Sapiens; identical to SEQ ID NO: 283961

SEQ ID NO: 391098 - RNA, 64 nt, Homo Sapiens; identical to SEQ ID NO: 283962

SEQ ID NO: 391099 - RNA, 64 nt, Homo Sapiens; identical to SEQ ID NO: 283963

SEQ ID NO: 391100 - RNA, 64 nt, Homo Sapiens; identical to SEQ ID NO: 283964

SEQ ID NO: 391101 - RNA, 64 nt, Homo Sapiens; identical to SEQ ID NO: 283965

SEQ ID NO: 391102 - RNA, 64 nt, Homo Sapiens; identical to SEQ ID NO: 283966

SEQ ID NO: 391103 - RNA, 64 nt, Homo Sapiens; identical to SEQ ID NO: 283967

SEQ ID NO: 391104 - RNA, 64 nt, Homo Sapiens; identical to SEQ ID NO: 283968

SEQ ID NO: 391105 - RNA, 64 nt, Homo Sapiens; identical to SEQ ID NO: 283969

SEQ ID NO: 391106 - RNA, 64 nt, Homo Sapiens; identical to SEQ ID NO: 283970

SEQ ID NO: 391107 - RNA, 64 nt, Homo Sapiens; identical to SEQ ID NO: 283971

SEQ ID NO: 391108 - RNA, 64 nt, Homo Sapiens; identical to SEQ ID NO: 283972

SEQ ID NO: 391109 - RNA, 64 nt, Homo Sapiens; identical to SEQ ID NO: 283973

SEQ ID NO: 391110 - RNA, 64 nt, Homo Sapiens; identical to SEQ ID NO: 283974

SEQ ID NO: 391111 - RNA, 64 nt, Homo Sapiens; identical to SEQ ID NO: 283975

SEQ ID NO: 391112 - RNA, 64 nt, Homo Sapiens; identical to SEQ ID NO: 283976

SEQ ID NO: 391113 - RNA, 64 nt, Homo Sapiens; identical to SEQ ID NO: 283977

SEQ ID NO: 391114 - RNA, 64 nt, Homo Sapiens; identical to SEQ ID NO: 283978

SEQ ID NO: 391115 - RNA, 64 nt, Homo Sapiens; identical to SEQ ID NO: 283979

SEQ ID NO: 391116 - RNA, 64 nt, Homo Sapiens; identical to SEQ ID NO: 283980

SEQ ID NO: 391117 - RNA, 64 nt, Homo Sapiens; identical to SEQ ID NO: 283981

SEQ ID NO: 391118 - RNA, 64 nt, Homo Sapiens; identical to SEQ ID NO: 283982

SEQ ID NO: 391119 - RNA, 64 nt, Homo Sapiens; identical to SEQ ID NO: 283983

SEQ ID NO: 391120 - RNA, 64 nt, Homo Sapiens; identical to SEQ ID NO: 283984

SEQ ID NO: 391121 - RNA, 64 nt, Homo Sapiens; identical to SEQ ID NO: 245291

SEQ ID NO: 391122 - RNA, 64 nt, Homo Sapiens; identical to SEQ ID NO: 245292

SEQ ID NO: 391123 - RNA, 64 nt, Homo Sapiens; identical to SEQ ID NO: 245293

SEQ ID NO: 391124 - RNA, 64 nt, Homo Sapiens; identical to SEQ ID NO: 245294

SEQ ID NO: 391125 - RNA, 64 nt, Homo Sapiens
guucugguguuauucugucuccucuucuuugucaucagccaaaacgugguuuuuaaagagaguc

SEQ ID NO: 391126 - RNA, 64 nt, Homo Sapiens
uauccuaguguuccuauagugaaauaaguaggguucagccaaagcuuucuuuguuuuguaccuu

SEQ ID NO: 391127 - RNA, 64 nt, Homo Sapiens
ccacacaaucguagcuuauaagauuggaacgaucucagccaaauauuuuagguguaauucauau

SEQ ID NO: 391128 - RNA, 64 nt, Homo Sapiens
agacaccuagauuagcagcucaauuuguacuacuucagccaaucugugaauguaaaaacuacac

SEQ ID NO: 391129 - RNA, 64 nt, Homo Sapiens
uguuuauguccccccuucucuuccugagugauucucagccaaguccagacagugcucggcgggu

SEQ ID NO: 391130 - RNA, 64 nt, Homo Sapiens
uugcccugcuggccacacucuggagaagcacuucucagccaaggcaccccugcccugggacugg

SEQ ID NO: 391131 - RNA, 64 nt, Homo Sapiens
acauuccaaaacaauauauacacacacacauaaaucagccaaaaucagagaaaaggaacaggga

SEQ ID NO: 391132 - RNA, 64 nt, Homo Sapiens
aauaugggaauuuucauaauaguucauacauuugucagccaacauuaaaagguaaccaacuccu

SEQ ID NO: 391133 - RNA, 64 nt, Homo Sapiens
cacacugcagggcugcuguggcccagucguccgcucagccaaggagucagauggcaauggguac

SEQ ID NO: 391134 - RNA, 64 nt, Homo Sapiens
cucucucuggaaagacccaacuuucucacugcugucagccaagucaugguugguaaccauguag

SEQ ID NO: 391135 - RNA, 64 nt, Homo Sapiens
agaucaggauguacaagauaaccccagagggcgcucagccaagcuuagagcagcuaucaaauua

SEQ ID NO: 391136 - RNA, 64 nt, Homo Sapiens
ucuuguauuuuuuaauugagcuaaucaaaauaauucagccaagucuauuugaaauagaaaacug

SEQ ID NO: 391137 - RNA, 64 nt, Homo Sapiens
uagcaccacugcacuccaggggcggagguugcagucagccaagaagaaucgcuagaaccuggga

SEQ ID NO: 391138 - RNA, 64 nt, Homo Sapiens
uuuuauuguuccuuugcuacgggccacucaccagucagccaaucgagcuaugcacucuaaugug

SEQ ID NO: 391139 - RNA, 64 nt, Homo Sapiens
acuucauccggcaccuucugaugacaucucagaaucagccaaagguuugacucuccuuucuggg

SEQ ID NO: 391140 - RNA, 64 nt, Homo Sapiens
cccuggcacccccagggugagcugagugccugggucagccaaacugaguggggcugaaggccag

SEQ ID NO: 391141 - RNA, 64 nt, Homo Sapiens; identical to SEQ ID NO: 266922

SEQ ID NO: 391142 - RNA, 64 nt, Homo Sapiens; identical to SEQ ID NO: 266923

SEQ ID NO: 391143 - RNA, 64 nt, Homo Sapiens; identical to SEQ ID NO: 266924

SEQ ID NO: 391144 - RNA, 64 nt, Homo Sapiens; identical to SEQ ID NO: 266925

SEQ ID NO: 391145 - RNA, 64 nt, Homo Sapiens; identical to SEQ ID NO: 266926

SEQ ID NO: 391146 - RNA, 64 nt, Homo Sapiens; identical to SEQ ID NO: 266927

SEQ ID NO: 391147 - RNA, 64 nt, Homo Sapiens; identical to SEQ ID NO: 266928

SEQ ID NO: 391148 - RNA, 64 nt, Homo Sapiens; identical to SEQ ID NO: 266929

SEQ ID NO: 391149 - RNA, 64 nt, Homo Sapiens; identical to SEQ ID NO: 266930

SEQ ID NO: 391150 - RNA, 64 nt, Homo Sapiens; identical to SEQ ID NO: 266931

SEQ ID NO: 391151 - RNA, 64 nt, Homo Sapiens; identical to SEQ ID NO: 266932

SEQ ID NO: 391152 - RNA, 64 nt, Homo Sapiens; identical to SEQ ID NO: 266933

SEQ ID NO: 391153 - RNA, 64 nt, Homo Sapiens; identical to SEQ ID NO: 266934

SEQ ID NO: 391154 - RNA, 64 nt, Homo Sapiens; identical to SEQ ID NO: 266935

SEQ ID NO: 391155 - RNA, 64 nt, Homo Sapiens; identical to SEQ ID NO: 266936

SEQ ID NO: 391156 - RNA, 64 nt, Homo Sapiens; identical to SEQ ID NO: 266937

SEQ ID NO: 391157 - RNA, 64 nt, Homo Sapiens; identical to SEQ ID NO: 266938

SEQ ID NO: 391158 - RNA, 64 nt, Homo Sapiens; identical to SEQ ID NO: 266939

SEQ ID NO: 391159 - RNA, 64 nt, Homo Sapiens; identical to SEQ ID NO: 266940

SEQ ID NO: 391160 - RNA, 64 nt, Homo Sapiens; identical to SEQ ID NO: 266941

SEQ ID NO: 391161 - RNA, 64 nt, Homo Sapiens; identical to SEQ ID NO: 266942

SEQ ID NO: 391162 - RNA, 64 nt, Homo Sapiens; identical to SEQ ID NO: 266943

SEQ ID NO: 391163 - RNA, 64 nt, Homo Sapiens; identical to SEQ ID NO: 266944

SEQ ID NO: 391164 - RNA, 64 nt, Homo Sapiens; identical to SEQ ID NO: 266945

SEQ ID NO: 391165 - RNA, 64 nt, Homo Sapiens; identical to SEQ ID NO: 266946

SEQ ID NO: 391166 - RNA, 64 nt, Homo Sapiens; identical to SEQ ID NO: 266947

SEQ ID NO: 391167 - RNA, 64 nt, Homo Sapiens; identical to SEQ ID NO: 266948

SEQ ID NO: 391168 - RNA, 64 nt, Homo Sapiens; identical to SEQ ID NO: 266949

SEQ ID NO: 391169 - RNA, 64 nt, Homo Sapiens; identical to SEQ ID NO: 266950

SEQ ID NO: 391170 - RNA, 64 nt, Homo Sapiens; identical to SEQ ID NO: 266951

SEQ ID NO: 391171 - RNA, 64 nt, Homo Sapiens; identical to SEQ ID NO: 266952

SEQ ID NO: 391172 - RNA, 64 nt, Homo Sapiens; identical to SEQ ID NO: 266953

SEQ ID NO: 391173 - RNA, 64 nt, Homo Sapiens; identical to SEQ ID NO: 266954

SEQ ID NO: 391174 - RNA, 64 nt, Homo Sapiens; identical to SEQ ID NO: 266955

SEQ ID NO: 391175 - RNA, 64 nt, Homo Sapiens; identical to SEQ ID NO: 266956

SEQ ID NO: 391176 - RNA, 64 nt, Homo Sapiens; identical to SEQ ID NO: 266957

SEQ ID NO: 391177 - RNA, 64 nt, Homo Sapiens; identical to SEQ ID NO: 266958

SEQ ID NO: 391178 - RNA, 63 nt, Homo Sapiens; identical to SEQ ID NO: 266959

SEQ ID NO: 391179 - RNA, 64 nt, Homo Sapiens; identical to SEQ ID NO: 266960

SEQ ID NO: 391180 - RNA, 64 nt, Homo Sapiens; identical to SEQ ID NO: 266961

SEQ ID NO: 391181 - RNA, 64 nt, Homo Sapiens; identical to SEQ ID NO: 266962

SEQ ID NO: 391182 - RNA, 64 nt, Homo Sapiens; identical to SEQ ID NO: 266963

SEQ ID NO: 391183 - RNA, 64 nt, Homo Sapiens; identical to SEQ ID NO: 266964

SEQ ID NO: 391184 - RNA, 64 nt, Homo Sapiens; identical to SEQ ID NO: 266965

SEQ ID NO: 391185 - RNA, 64 nt, Homo Sapiens; identical to SEQ ID NO: 266966

SEQ ID NO: 391186 - RNA, 64 nt, Homo Sapiens; identical to SEQ ID NO: 266967

SEQ ID NO: 391187 - RNA, 64 nt, Homo Sapiens; identical to SEQ ID NO: 266968

SEQ ID NO: 391188 - RNA, 64 nt, Homo Sapiens; identical to SEQ ID NO: 266969

SEQ ID NO: 391189 - RNA, 64 nt, Homo Sapiens; identical to SEQ ID NO: 266970

SEQ ID NO: 391190 - RNA, 64 nt, Homo Sapiens; identical to SEQ ID NO: 266971

SEQ ID NO: 391191 - RNA, 64 nt, Homo Sapiens; identical to SEQ ID NO: 266972

SEQ ID NO: 391192 - RNA, 64 nt, Homo Sapiens; identical to SEQ ID NO: 266973

SEQ ID NO: 391193 - RNA, 64 nt, Homo Sapiens; identical to SEQ ID NO: 266974

SEQ ID NO: 391194 - RNA, 64 nt, Homo Sapiens; identical to SEQ ID NO: 266975

SEQ ID NO: 391195 - RNA, 64 nt, Homo Sapiens; identical to SEQ ID NO: 266976

SEQ ID NO: 391196 - RNA, 64 nt, Homo Sapiens; identical to SEQ ID NO: 266977

SEQ ID NO: 391197 - RNA, 64 nt, Homo Sapiens; identical to SEQ ID NO: 266978

SEQ ID NO: 391198 - RNA, 64 nt, Homo Sapiens; identical to SEQ ID NO: 266979

SEQ ID NO: 391199 - RNA, 64 nt, Homo Sapiens; identical to SEQ ID NO: 266980

SEQ ID NO: 391200 - RNA, 64 nt, Homo Sapiens; identical to SEQ ID NO: 266981

SEQ ID NO: 391201 - RNA, 64 nt, Homo Sapiens; identical to SEQ ID NO: 266982

SEQ ID NO: 391202 - RNA, 64 nt, Homo Sapiens; identical to SEQ ID NO: 266983

SEQ ID NO: 391203 - RNA, 64 nt, Homo Sapiens
ggcucaggaggaauuccugcggguccucggcuccaugugccagaggcuccgguccaugcaguac

SEQ ID NO: 391204 - RNA, 64 nt, Homo Sapiens
cggcucagccucccgaguagcugggauuacaggcaugugccaccacgcccggcuaauguuugua

SEQ ID NO: 391205 - RNA, 64 nt, Homo Sapiens
ugaauuggugagauggaaucuuagaucgucccccaugugccagccucauucgaauucuacucuu

SEQ ID NO: 391206 - RNA, 64 nt, Homo Sapiens
ccuccuucaaacuccaaacauaauuuuuaagacuaugugccaguggacucuucccuuauaucuc

SEQ ID NO: 391207 - RNA, 64 nt, Homo Sapiens
gugcacauugugcagguuaguuacauauguauacaugugccaugcuggugugcugcacccgcua

SEQ ID NO: 391208 - RNA, 64 nt, Homo Sapiens
auuuuuuauggcugcaugguauuccaugguguauaugugccacauuuucuuaauccagucuauc

SEQ ID NO: 391209 - RNA, 64 nt, Homo Sapiens
uuuucuuaauccagucuaucauuccaugguguauaugugccacacuuuuuuauggcugcauagu

SEQ ID NO: 391210 - RNA, 64 nt, Homo Sapiens
uuggugugcugcacccauuauuacauauguauacaugugccauagugcacaaugugcagguuug

SEQ ID NO: 391211 - RNA, 64 nt, Homo Sapiens
cuauacugucauuccaaauuaaggaaacugaagcaugugccauuggguuggguagagaaacaca

SEQ ID NO: 391212 - RNA, 64 nt, Homo Sapiens
augauugcaccugcgaauagagcucgaggcuguaaugugccauggcaagaggcuugagaccagg

SEQ ID NO: 391213 - RNA, 64 nt, Homo Sapiens
uuuucuuaauccagucuaucauuccaugguguauaugugccacaauuuuuuauggcugcauagu

SEQ ID NO: 391214 - RNA, 64 nt, Homo Sapiens
cuggugcgcugcacccacuauuacauauguauacaugugccauggugcacauugugcagguuag

SEQ ID NO: 391215 - RNA, 64 nt, Homo Sapiens
gugcacaaugugcagguuaguuacauauguauacaugugccaugcuggugugcugcacccauua

SEQ ID NO: 391216 - RNA, 64 nt, Homo Sapiens
auuuuuuauggcugcauaguauuccaugguguauaugugccacauuuucuuaauccagucuauu

SEQ ID NO: 391217 - RNA, 64 nt, Homo Sapiens
ucauuaaaaacaaacuggcuugcagaaggguccgaugugccaagugaucaugauucugcuggaa

SEQ ID NO: 391218 - RNA, 64 nt, Homo Sapiens
uuuuauugccuuuugagauucuccaacuugacaaaugugccaaagaucaacagacagaaaauau

SEQ ID NO: 391219 - RNA, 64 nt, Homo Sapiens
caccuugacaaaaucuuuuaaccgagcacauaccaugugccacaacuacacacaaaggcuauug

SEQ ID NO: 391220 - RNA, 64 nt, Homo Sapiens
ucuuaggaugugucuuggggucauuaaaauuaacaugugccagguaauacauucacccagauaa

SEQ ID NO: 391221 - RNA, 64 nt, Homo Sapiens
ugacaggcaauaauauauuggccccuuaacauggaugugccacauccgugccagggacgccuca

SEQ ID NO: 391222 - RNA, 64 nt, Homo Sapiens
uuguucauucauuuauuuaugccuaagauggcccaugugccacuaaucuacaaaacuacaccaa

SEQ ID NO: 391223 - RNA, 64 nt, Homo Sapiens
agaagacucagcagccuacauucccauuccugguaugugccauuggguuggauguccccacuac

SEQ ID NO: 391224 - RNA, 64 nt, Homo Sapiens
cccacuacuuccguuaacccuucccauugucaagaugugccacgggugccacugggggcacacu

SEQ ID NO: 391225 - RNA, 64 nt, Homo Sapiens
agcuucaaagaccccugagcugccaaccacggagaugugccaagcaucucaucucuccugcaca

SEQ ID NO: 391226 - RNA, 64 nt, Homo Sapiens
uaugcuccucuuggcuaauuuucuuuugacuuuaaugugccaauguaacuuccuuuaaaggauc

SEQ ID NO: 391227 - RNA, 64 nt, Homo Sapiens
augcccggccggcuuaugaucugggauuauaggcaugugccacccgccucggccucccaaagug

SEQ ID NO: 391228 - RNA, 64 nt, Homo Sapiens
cagaagcacaagaguuccuauuaaaaaguagauaaugugccaacucuguauuaauuucacauac

SEQ ID NO: 391229 - RNA, 64 nt, Homo Sapiens
cccagaggucgcacuccgcaggaggacugaggccaugugccauucucccgggcccagcgcccgg

SEQ ID NO: 391230 - RNA, 64 nt, Homo Sapiens
ucaucuccucugccugugucugcgacccccauccaugugccaaagugucccuugggucacacag

SEQ ID NO: 391231 - RNA, 64 nt, Homo Sapiens
cucucugacuagaagcuucuguuccugacaccaaaugugccagguuagcaaaugagcacaagau

SEQ ID NO: 391232 - RNA, 64 nt, Homo Sapiens
gacauggggugcccucaaguuuccaaggggaccaaugugccacuguucuuccuuggggaugagg

SEQ ID NO: 391233 - RNA, 64 nt, Homo Sapiens
ggcuuuaagugguuucuauuucuucuuaguuauuaugugccaccuucuuaguuauuaugugcca

SEQ ID NO: 391234 - RNA, 64 nt, Homo Sapiens
uucuuaguuauuaugugccaccuucuuaguuauuaugugccaccuccccuaugagugacguguu

SEQ ID NO: 391235 - RNA, 64 nt, Homo Sapiens
uuuugcugugagugaccuuaaauaaauaauucuaaugugccauauuuauauguauaaagcauuu

SEQ ID NO: 391236 - RNA, 64 nt, Homo Sapiens
gggcgaucuugccuggaauaucccagaacagaacaugugccaauacgcaaggaaauaaucuauc

SEQ ID NO: 391237 - RNA, 64 nt, Homo Sapiens
aggcuccgguccaugcaguacaauggcagcuacuucgacagaggagccaagggcggcagccgcc

SEQ ID NO: 391238 - RNA, 64 nt, Homo Sapiens
aagguuuuuaaaaguaaguuuuaaggaguauuucucgacagaugauuuucuucuccauuaauac

SEQ ID NO: 391239 - RNA, 64 nt, Homo Sapiens
augaggccccugccucuucuuuucacaaucuagcucgacagagccuugccccauuccuggccag

SEQ ID NO: 391240 - RNA, 64 nt, Homo Sapiens
agugggaggugagaagcccgcuuucccccuguccucgacagaagcggguuuauuuauugacugu

SEQ ID NO: 391241 - RNA, 64 nt, Homo Sapiens
gaguuugucaaaaguaucucgugcaguagcaugaucgacagagugcucugucacccaggcugga

SEQ ID NO: 391242 - RNA, 64 nt, Homo Sapiens
gaagucucuucuaaaaauuguugaugagcauuggucgacagaaaagccuauaucuaggagucuc

SEQ ID NO: 391243 - RNA, 64 nt, Homo Sapiens
uuagauguauccuagcuuuuggacccagaguuggucgacagaugagacagcuagagauaacucg

SEQ ID NO: 391244 - RNA, 64 nt, Homo Sapiens
gaugguguguaugccccuccagccgaagaucaauucgacagacaaggcagugggaaaagaggug

SEQ ID NO: 391245 - RNA, 64 nt, Homo Sapiens
aaaaugacaacacuuggugacucuaggugacuggucgacagauguucauuguacuaucaaugug

SEQ ID NO: 391246 - RNA, 64 nt, Homo Sapiens
ugaccuaggucuugacccucauccagcaagggacucgacagacccaagggucccuggaacguag

SEQ ID NO: 391247 - RNA, 64 nt, Homo Sapiens
augugugcagagcagacaggcuacaaagcagagaucgacagacagccagguaguuggaacuuuc

SEQ ID NO: 391248 - RNA, 64 nt, Homo Sapiens
ucuauucaguagguguuucuaaaacaugaauugcucgacagaguuugguauagaguccaacuuu

SEQ ID NO: 391249 - RNA, 64 nt, Homo Sapiens
acccggcgcguccucgguuucucgccugucaucaucgacagacaugucagccgcuaccugcugg

SEQ ID NO: 391250 - RNA, 64 nt, Homo Sapiens
ggucuucucugccugagacccgccacaccagauaucgacagagucauacacacaccagagcaac

SEQ ID NO: 391251 - RNA, 64 nt, Homo Sapiens
guuacauuccucgccagggucucucagugggucuucgacagagagcuuuugcaguuuaaaaugu

SEQ ID NO: 391252 - RNA, 64 nt, Homo Sapiens
cagaugcacauucaguguugcuucuuggccauguucgacagaugcugagaccaucguacaggca

SEQ ID NO: 391253 - RNA, 64 nt, Homo Sapiens
agggcgcacagaccaagcgugagcuccacgcgggucgacagaccucccuguguuccguuccuaa

SEQ ID NO: 391254 - RNA, 64 nt, Homo Sapiens
ugagccgauaucgcaccacagcgcuccagccuggucgacagagugagacuccaucucaagaaaa

SEQ ID NO: 391255 - RNA, 64 nt, Homo Sapiens
uauugaguucacuuauuauuuuuagcuauuucuuucgacagaauccuuggaauuuucuauauag

SEQ ID NO: 391256 - RNA, 64 nt, Homo Sapiens
cuggaggagauagccgagaccuccggcuaaugauucgacagagguugucuccagguacaccgug

SEQ ID NO: 391257 - RNA, 64 nt, Homo Sapiens
gagcagagauugcccccgcuacacuccagccuggucgacagagugaacucugucucaaaaaaaa

SEQ ID NO: 391258 - RNA, 64 nt, Homo Sapiens; identical to SEQ ID NO: 296924

SEQ ID NO: 391259 - RNA, 64 nt, Homo Sapiens; identical to SEQ ID NO: 296925

SEQ ID NO: 391260 - RNA, 64 nt, Homo Sapiens; identical to SEQ ID NO: 296926

SEQ ID NO: 391261 - RNA, 64 nt, Homo Sapiens; identical to SEQ ID NO: 296927

SEQ ID NO: 391262 - RNA, 64 nt, Homo Sapiens; identical to SEQ ID NO: 296928

SEQ ID NO: 391263 - RNA, 64 nt, Homo Sapiens; identical to SEQ ID NO: 296929

SEQ ID NO: 391264 - RNA, 64 nt, Homo Sapiens; identical to SEQ ID NO: 296930

SEQ ID NO: 391265 - RNA, 64 nt, Homo Sapiens; identical to SEQ ID NO: 296931

SEQ ID NO: 391266 - RNA, 64 nt, Homo Sapiens; identical to SEQ ID NO: 296932

SEQ ID NO: 391267 - RNA, 64 nt, Homo Sapiens; identical to SEQ ID NO: 296933

SEQ ID NO: 391268 - RNA, 64 nt, Homo Sapiens; identical to SEQ ID NO: 294188

SEQ ID NO: 391269 - RNA, 64 nt, Homo Sapiens; identical to SEQ ID NO: 294189

SEQ ID NO: 391270 - RNA, 64 nt, Homo Sapiens; identical to SEQ ID NO: 294190

SEQ ID NO: 391271 - RNA, 64 nt, Homo Sapiens; identical to SEQ ID NO: 294191

SEQ ID NO: 391272 - RNA, 64 nt, Homo Sapiens; identical to SEQ ID NO: 115576

SEQ ID NO: 391273 - RNA, 64 nt, Homo Sapiens; identical to SEQ ID NO: 115577

SEQ ID NO: 391274 - RNA, 64 nt, Homo Sapiens; identical to SEQ ID NO: 115578

SEQ ID NO: 391275 - RNA, 64 nt, Homo Sapiens; identical to SEQ ID NO: 115579

SEQ ID NO: 391276 - RNA, 64 nt, Homo Sapiens; identical to SEQ ID NO: 115580

SEQ ID NO: 391277 - RNA, 64 nt, Homo Sapiens; identical to SEQ ID NO: 115581

SEQ ID NO: 391278 - RNA, 64 nt, Homo Sapiens; identical to SEQ ID NO: 115582

SEQ ID NO: 391279 - RNA, 64 nt, Homo Sapiens; identical to SEQ ID NO: 115583

SEQ ID NO: 391280 - RNA, 64 nt, Homo Sapiens; identical to SEQ ID NO: 115584

SEQ ID NO: 391281 - RNA, 64 nt, Homo Sapiens; identical to SEQ ID NO: 115585

SEQ ID NO: 391282 - RNA, 64 nt, Homo Sapiens; identical to SEQ ID NO: 115586

SEQ ID NO: 391283 - RNA, 64 nt, Homo Sapiens; identical to SEQ ID NO: 115587

SEQ ID NO: 391284 - RNA, 64 nt, Homo Sapiens; identical to SEQ ID NO: 115588

SEQ ID NO: 391285 - RNA, 64 nt, Homo Sapiens; identical to SEQ ID NO: 115589

SEQ ID NO: 391286 - RNA, 64 nt, Homo Sapiens; identical to SEQ ID NO: 115590

SEQ ID NO: 391287 - RNA, 64 nt, Homo Sapiens; identical to SEQ ID NO: 115591

SEQ ID NO: 391288 - RNA, 64 nt, Homo Sapiens
uugugccauagucacauggccuaugcacauauggacucugcacaugaaucccacccacauguga

SEQ ID NO: 391289 - RNA, 64 nt, Homo Sapiens
cuugugucuguacacguguccuguaguugcguggacucugcacaugucuuguacauguguagcc

SEQ ID NO: 391290 - RNA, 64 nt, Homo Sapiens
aagcagcucgauccaccaacucacagcagucuggacucugcaccaguagcagaagagaacaggc

SEQ ID NO: 391291 - RNA, 64 nt, Homo Sapiens
uagaacuauuuuuauauaaaagcgauuccuaaacacucugcaagaugagagcuagacucuauaa

SEQ ID NO: 391292 - RNA, 64 nt, Homo Sapiens
guuuuucauuagaaacaaaucaugaacuaugcaaacucugcauaaaaccaaaaugaaacuuugc

SEQ ID NO: 391293 - RNA, 64 nt, Homo Sapiens
aaaccuaaguaguuucucacuuuuugaaacaauaacucugcaccaaauauugcaucgcaugcug

SEQ ID NO: 391294 - RNA, 64 nt, Homo Sapiens
agacagccuguagaauggggaaaacuauuugcaaacucugcaucugaugaagguccaauaucca

SEQ ID NO: 391295 - RNA, 64 nt, Homo Sapiens
aaaacaaauggguuuaacugaccagagcgagagaacucugcacuaugaacccaaacccagcuca

SEQ ID NO: 391296 - RNA, 64 nt, Homo Sapiens
cugccuuuuagugagugaggguucugcuuaugauacucugcacgcucacugagcucauggaaug

SEQ ID NO: 391297 - RNA, 64 nt, Homo Sapiens
aucgucccuuguggagaaugugauuucagaggagacucugcaaaaccaagggaaaauaccacaa

SEQ ID NO: 391298 - RNA, 64 nt, Homo Sapiens
cuucucuaacaacgugacuacugccuggguucaaacucugcaucgacuaugucaucuuguucuc

SEQ ID NO: 391299 - RNA, 64 nt, Homo Sapiens
uaauuuuguaaucugggaagcuccccuccgagcaacucugcauuaauagagaggguggcccugg

SEQ ID NO: 391300 - RNA, 64 nt, Homo Sapiens
agggaugacucagcaccgccccucaacaggcaugacucugcagagaugacucagcacugucccu

SEQ ID NO: 391301 - RNA, 64 nt, Homo Sapiens
agggaugacucagcaccgccccucaacaggcaugacucugcagagaugacuuaguacugccccu

SEQ ID NO: 391302 - RNA, 64 nt, Homo Sapiens
agggaugacucagcaccgccccucaacaggcaugacucugcagagaugacucagcacugccccu

SEQ ID NO: 391303 - RNA, 64 nt, Homo Sapiens
aaaucagagcuggcagccucccgccuccuucuuaacucugcaggcgccugggugacccccacug

SEQ ID NO: 391304 - RNA, 64 nt, Homo Sapiens
cagauuuacugucccaggagucauaagcuguagaacucugcaggcuugccuggggccacauagc

SEQ ID NO: 391305 - RNA, 64 nt, Homo Sapiens
cugcggaacuguuuuaauuagccucuaucucagaacucugcaucuuuuuucacuaacucugcau

SEQ ID NO: 391306 - RNA, 64 nt, Homo Sapiens
ccucuaucucagaacucugcuuuuuuuuucacuaacucugcaugugaugacuuugagcugcuuu

SEQ ID NO: 391307 - RNA, 64 nt, Homo Sapiens
guauucauuaugcuacagaaacauuuaauaugauuaugauuaauuuuaaaauacuaucaguuaa

SEQ ID NO: 391308 - RNA, 64 nt, Homo Sapiens
auuaauguauucauuaugcuaguuaaacauuuaauaugauuauggauucuuuuaaaauacuauc

SEQ ID NO: 391309 - RNA, 64 nt, Homo Sapiens
uaauuuuaaaaauguuaaaauagauaaauaaauauaugauuaacucaaaaauaaauaaauaaaa

SEQ ID NO: 391310 - RNA, 64 nt, Homo Sapiens
caggcacgguggcugacacccuuaauauuaaauauaugauuagcacuuuucuaaagccuuaagu

SEQ ID NO: 391311 - RNA, 64 nt, Homo Sapiens
aacgauguccaacccgucugauuuagaagccaacuaugauuauugaagucaucuugcuaccagu

SEQ ID NO: 391312 - RNA, 64 nt, Homo Sapiens
ggccuuuuucauuuaucuauuauuaaucuuaguguaugauuacuguuaauuuugaagugcuguu

SEQ ID NO: 391313 - RNA, 64 nt, Homo Sapiens
uuguauuuucucagauaagauauuuugagggagauaugauuauacuuucuaauguuaucaggag

SEQ ID NO: 391314 - RNA, 64 nt, Homo Sapiens
cacuucagaacuuucuaaugaugguggcauuauauaugauuaaaaguucugaauucaugugaua

SEQ ID NO: 391315 - RNA, 64 nt, Homo Sapiens
uuucauuuuaaaauuucuguagaagcucaggaauuaugauuaaucaccaucugccuccaggccu

SEQ ID NO: 391316 - RNA, 64 nt, Homo Sapiens
cacucuguuaaauguucauacuguuucaagcccauaugauuagauuuauguuuuuaaaaucugu

SEQ ID NO: 391317 - RNA, 64 nt, Homo Sapiens
aaaacuagauaauucccauauuuuguugguaguauaugauuagagggaacaugcuuguguuuau

SEQ ID NO: 391318 - RNA, 64 nt, Homo Sapiens
gggaacaugcuuguguuuauaugguggaggauaauaugauuaaagccaaugccuuuuggaagua

SEQ ID NO: 391319 - RNA, 64 nt, Homo Sapiens
ccacugcacuccagccugggaggcugcauugagcuaugauuacaagcuuaagcccaggauuuca

SEQ ID NO: 391320 - RNA, 64 nt, Homo Sapiens
uaauuuuaugcuuauuuucucauacaaauguuuuuaugauuaaaauaagagaaauauuuagaua

SEQ ID NO: 391321 - RNA, 64 nt, Homo Sapiens
augcuauuuuaaaaaauauaaagucccuauaguauaugauuauaagcugagguuuaguaaucua

SEQ ID NO: 391322 - RNA, 53 nt, Homo Sapiens
agagagcuuauuguuuuaaaagguaugauuauaaaacuagauuagcugguuaa

SEQ ID NO: 391323 - RNA, 64 nt, Homo Sapiens
gcuuuuagcaaaaaacaacuaccaguguuacucauaugauuaugaaaaucguccauucuuuuaa

SEQ ID NO: 391324 - RNA, 64 nt, Homo Sapiens
uucaaauccucaccaacauccaggauugugucuuuaugauuauagccauuuuuguagguacaaa

SEQ ID NO: 391325 - RNA, 64 nt, Homo Sapiens
ugguauagcuauuuaaagacuacuucguaaguaguaugauuauuugaauaaauuacacauuguu

SEQ ID NO: 391326 - RNA, 64 nt, Homo Sapiens
uuaguuaagcuaaauuaaagggacuccauccuguuaugauuauauuauuauuauuauuauuauu

SEQ ID NO: 391327 - RNA, 64 nt, Homo Sapiens
aguguuagcuuaguucucuuuugauguagguuauuaugauuagcuuugucacuguuucacuacu

SEQ ID NO: 391328 - RNA, 64 nt, Homo Sapiens
uacauaacuaauacagcugagcuauguaguaugcuaugauuaaauuuacuuauguaacuuuuau

SEQ ID NO: 391329 - RNA, 64 nt, Homo Sapiens; identical to SEQ ID NO: 377425

SEQ ID NO: 391330 - RNA, 64 nt, Homo Sapiens; identical to SEQ ID NO: 377426

SEQ ID NO: 391331 - RNA, 64 nt, Homo Sapiens; identical to SEQ ID NO: 377427

SEQ ID NO: 391332 - RNA, 64 nt, Homo Sapiens; identical to SEQ ID NO: 377428

SEQ ID NO: 391333 - RNA, 64 nt, Homo Sapiens; identical to SEQ ID NO: 377429

SEQ ID NO: 391334 - RNA, 64 nt, Homo Sapiens; identical to SEQ ID NO: 377430

SEQ ID NO: 391335 - RNA, 64 nt, Homo Sapiens
cccuuaucuuccuacucugccccucccccuaaugaaaucauauuaaguuguuuuuuuuuuuuuu

SEQ ID NO: 391336 - RNA, 64 nt, Homo Sapiens
aagguuuuauugaaauaaagccucuuaaaaugaaaaaucauauacuuuuaacaucacuuuuaag

SEQ ID NO: 391337 - RNA, 64 nt, Homo Sapiens
uuaucgguccuguuuacauuaaggaaagacaauaaaaucauaaaaacauguuaaaggccggaca

SEQ ID NO: 391338 - RNA, 64 nt, Homo Sapiens
cuccuuucuuagucacaacaaucauaaccaccagaaaucauacucuucgaugagccagagugau

SEQ ID NO: 391339 - RNA, 64 nt, Homo Sapiens
gcuucuucuccuauguguaaauaaaacauuaagaaaaucauauugcucccccucccccacugcc

SEQ ID NO: 391340 - RNA, 64 nt, Homo Sapiens
uggggguuggggguggugggucauccacuagugcaaaucauagccccaugauguagugccucuu

SEQ ID NO: 391341 - RNA, 64 nt, Homo Sapiens
uuuuacagauuuauuuuguuuuucugcucacuaaaaaucauauauucaagcacuaauuuggcuc

SEQ ID NO: 391342 - RNA, 64 nt, Homo Sapiens
cuuugacgugugccauacauaagauggguuucagaaaucauaaacacuuuuuaaacugccauua

SEQ ID NO: 391343 - RNA, 64 nt, Homo Sapiens
uugaucccaauagaauaccucccucauuuaagaaaaaucauaacucacuuuaaauaugaaagcc

SEQ ID NO: 391344 - RNA, 64 nt, Homo Sapiens
uuauuuuuauggaaauuauuacucugucauaauuaaaucauagcuaguauaacuuuacagauaa

SEQ ID NO: 391345 - RNA, 64 nt, Homo Sapiens
caaauuuauugaguacugcauguaugcuucaguaaaaucauauucuacuuuugcuuugaaauga

SEQ ID NO: 391346 - RNA, 64 nt, Homo Sapiens
uuuagguuuaacacguagauuuaauagacuuuuaaaaucauaauaaugcaugacauucuuguuu

SEQ ID NO: 391347 - RNA, 64 nt, Homo Sapiens
ccacaacauucauuguaaggugucacacaauggaaaaucauaugucggaugccagcuaauaaau

SEQ ID NO: 391348 - RNA, 64 nt, Homo Sapiens
gcccaacagaaaccuuaggcaaguagcucuuuaaaaaucauauuuuguuuagguuauaugggaa

SEQ ID NO: 391349 - RNA, 64 nt, Homo Sapiens
uucaaagaaucacagaauucuaguacauguagguaaaucauaaaucuguucuaagacauaugau

SEQ ID NO: 391350 - RNA, 64 nt, Homo Sapiens
acaauaaaguaagcuagagaaaauguuauuuagaaaaucauaagaaagagaaaauauauuuacu

SEQ ID NO: 391351 - RNA, 64 nt, Homo Sapiens
accauaugggauuggagaaagacaaauguggaagaaaucauagagcuggagacuacuuuugugc

SEQ ID NO: 391352 - RNA, 64 nt, Homo Sapiens
guaaacaugugccuguaacuuacuuccaaaaacaaaaucauacuuauuagaagaaaauucugau

SEQ ID NO: 391353 - RNA, 64 nt, Homo Sapiens
gaaguuaacauucauaucucuguuuugaaaucaaaaaucauauuucaaaauucuuuccuaggac

SEQ ID NO: 391354 - RNA, 64 nt, Homo Sapiens
guaaacuuuaguguguaaguugaguuugucauuaaaaucauaaaccagcugcgguaacagacaa

SEQ ID NO: 391355 - RNA, 64 nt, Homo Sapiens
uuaaaauuuucuaacauaauuauuggcccuaccaaaaucauauaaaagcuaugucuuuacuaug

SEQ ID NO: 391356 - RNA, 64 nt, Homo Sapiens
augguuauguacauuguuaauuuccugguuuugaaaaucauauuaaacacuacuguaauguuaa

SEQ ID NO: 391357 - RNA, 64 nt, Homo Sapiens
cuauuaccaauuuuucagaauacugcaauugaaaaaaucauacuauuuuacauuauguauauuu

SEQ ID NO: 391358 - RNA, 64 nt, Homo Sapiens
acaagauuuuaauucaaauuagaaacaaguccagaaaucauauucaaagagaagagagaugaaa

SEQ ID NO: 391359 - RNA, 64 nt, Homo Sapiens
gagaauaauuauuucagauuaaugaguugcuggaaaaucauauucaaagcaaauuucauuaucu

SEQ ID NO: 391360 - RNA, 64 nt, Homo Sapiens
auaugauuguauuuaaagguaugagacuauuaugaaaucauaguauaauuucuuuuugguaaau

SEQ ID NO: 391361 - RNA, 64 nt, Homo Sapiens
ucuacccacccgccucccaccagaucccaucuggaaaucauaauaaagacauaugccacuuuga

SEQ ID NO: 391362 - RNA, 64 nt, Homo Sapiens
uaucuuaagcauuuggaauuuuuuuuaucuucugaaaucauauaaaaagaaugucauuaguaaa

SEQ ID NO: 391363 - RNA, 64 nt, Homo Sapiens
aucagaagaaaaggaaaugaacauuggggauugaaaaucauauugguauuugcaccaacauagu

SEQ ID NO: 391364 - RNA, 64 nt, Homo Sapiens
augggaugugugaugcaaaugcucaaaaccucuuaaaucauagcugucugaccucuacggaccu

SEQ ID NO: 391365 - RNA, 64 nt, Homo Sapiens
gcugugaagacuugccuuugagcuuuggcugcugaaaucauacaaauguuucaguccaucaucc

SEQ ID NO: 391366 - RNA, 64 nt, Homo Sapiens
aagaucuuuuauuuuuuuaguuaauggauuguuaaaaucauagaugugauuuugcacuaaaagc

SEQ ID NO: 391367 - RNA, 64 nt, Homo Sapiens
ggucccagguacaacagagaauuccuccugaccucaagggaauucuggcugcccaagggaaugg

SEQ ID NO: 391368 - RNA, 64 nt, Homo Sapiens
gauuccuccugaccucaagggagggcuggcugcccaagggaaugggauaugaggggauggaaga

SEQ ID NO: 391369 - RNA, 64 nt, Homo Sapiens
cuucagucaacauauuuucauugacuccuuaguacaagggaaccuuaaugaccaacaggugaua

SEQ ID NO: 391370 - RNA, 64 nt, Homo Sapiens
guuauugaaacaaaguaugaacugguaacaucaucaagggaagaagcuuggaucacugucucaa

SEQ ID NO: 391371 - RNA, 64 nt, Homo Sapiens
ugagaaaagggcccaaggagggaagggcucagagcaagggaaauucggauauaggguuugcaag

SEQ ID NO: 391372 - RNA, 64 nt, Homo Sapiens
gcucagagcaagggaaauugggauauaggguuugcaagggaaggcaauucacggaacuguuauc

SEQ ID NO: 391373 - RNA, 64 nt, Homo Sapiens
aaaagcagagcuuauuuuucgauggagcaugaggcaagggaaggcucuucacauggggacaggg

SEQ ID NO: 391374 - RNA, 64 nt, Homo Sapiens
acggacuggaggccucaccggggucaagcaucuucaagggaaggguucugcccaucgcggcugc

SEQ ID NO: 391375 - RNA, 64 nt, Homo Sapiens
acccuucuuacagauacguuuaauguaauaagaacaagggaacauguaaacuaacauaaccaau

SEQ ID NO: 391376 - RNA, 64 nt, Homo Sapiens
aacuuucgaucuaggugggugauguguagcaguucaagggaagggugcuguguuuucauagcau

SEQ ID NO: 391377 - RNA, 64 nt, Homo Sapiens
ccacaguaucuuagaggagagacuucucugcccucaagggaaccugucuccaaagaugaaaaag

SEQ ID NO: 391378 - RNA, 64 nt, Homo Sapiens
ggacgauggagaaggcacggcuucuggcuggcggcaagggaaagcccgggagccucagaguuug

SEQ ID NO: 391379 - RNA, 64 nt, Homo Sapiens
gucucuuguaauccgaaucucagucuuccauuugcaagggaaaaaagcaauaugcauuuaaaua

SEQ ID NO: 391380 - RNA, 64 nt, Homo Sapiens
cggugugcaccaggguugacccaugggcagagcccaagggaauuaucacaaaaacauggugggu

SEQ ID NO: 391381 - RNA, 64 nt, Homo Sapiens
aagugcaaggagucggggaucucccuccccuagccaagggaagccaugagggacugugccauga

SEQ ID NO: 391382 - RNA, 64 nt, Homo Sapiens
ucuucuccuccaaaggaucacaacuccuugccggcaagggaacaaaacuggauagagaaugagu

SEQ ID NO: 391383 - RNA, 64 nt, Homo Sapiens
gauugagggggaaaagaaugaucuuuauuaaugacaagggaaaccaugaguaaugccacaaugg

SEQ ID NO: 391384 - RNA, 64 nt, Homo Sapiens
agaagcgagggcaccagcaguuguggguggggagcaagggaagagagaaacucuucagcgaauc

SEQ ID NO: 391385 - RNA, 64 nt, Homo Sapiens
uguccccaaauuggccucggccugcucccuuucucaagggaacccagcucccuaagagcggggc

SEQ ID NO: 391386 - RNA, 64 nt, Homo Sapiens
uucuccuggaccaaggcuuggucgucgucaaagucaagggaaaguuuaugcuggugggccacuu

SEQ ID NO: 391387 - RNA, 64 nt, Homo Sapiens
uggaaggcauggauuuauauagauaaugugacgucaagggaaguagugacuaucucuuaagaga

SEQ ID NO: 391388 - RNA, 64 nt, Homo Sapiens
ucugaauguaaggacaggccggaauuacaaguagcaagggaaggaccacaaugucuucugucaa

SEQ ID NO: 391389 - RNA, 64 nt, Homo Sapiens; identical to SEQ ID NO: 193776

SEQ ID NO: 391390 - RNA, 64 nt, Homo Sapiens; identical to SEQ ID NO: 193777

SEQ ID NO: 391391 - RNA, 64 nt, Homo Sapiens; identical to SEQ ID NO: 193778

SEQ ID NO: 391392 - RNA, 64 nt, Homo Sapiens; identical to SEQ ID NO: 193779

SEQ ID NO: 391393 - RNA, 64 nt, Homo Sapiens; identical to SEQ ID NO: 193780

SEQ ID NO: 391394 - RNA, 64 nt, Homo Sapiens; identical to SEQ ID NO: 193781

SEQ ID NO: 391395 - RNA, 64 nt, Homo Sapiens; identical to SEQ ID NO: 193782

SEQ ID NO: 391396 - RNA, 64 nt, Homo Sapiens; identical to SEQ ID NO: 193783

SEQ ID NO: 391397 - RNA, 64 nt, Homo Sapiens; identical to SEQ ID NO: 193784

SEQ ID NO: 391398 - RNA, 64 nt, Homo Sapiens; identical to SEQ ID NO: 193785

SEQ ID NO: 391399 - RNA, 64 nt, Homo Sapiens; identical to SEQ ID NO: 193786

SEQ ID NO: 391400 - RNA, 64 nt, Homo Sapiens; identical to SEQ ID NO: 193787

SEQ ID NO: 391401 - RNA, 64 nt, Homo Sapiens; identical to SEQ ID NO: 193788

SEQ ID NO: 391402 - RNA, 64 nt, Homo Sapiens; identical to SEQ ID NO: 193789

SEQ ID NO: 391403 - RNA, 64 nt, Homo Sapiens; identical to SEQ ID NO: 193790

SEQ ID NO: 391404 - RNA, 64 nt, Homo Sapiens
uauucuuuaauguuauuucaauaaaugugugaaauguagggaagacucacuggagagauacucu

SEQ ID NO: 391405 - RNA, 64 nt, Homo Sapiens
ccuucagucauuuugguaacgugaguguaaaauauguagggaagucacagagcagaaaaacucu

SEQ ID NO: 391406 - RNA, 64 nt, Homo Sapiens
aaagugagaaaauauuugaaagggauuauauuaauugcuaaauauuuuauucacaaaggucaau

SEQ ID NO: 391407 - RNA, 64 nt, Homo Sapiens
guacuuuauuuuaaauguucuuuaggagaacauuuugcuaaagcaugacuaaacugcaaaaaaa

SEQ ID NO: 391408 - RNA, 64 nt, Homo Sapiens
auuaaagaucaagaagcuugccaguaucagaagguugcuaaaagccacaccuaggaagguaaau

SEQ ID NO: 391409 - RNA, 64 nt, Homo Sapiens
aauuaagcaaccuagaagauccuaagcuguggauuugcuaaaugucccuccccucgagguggua

SEQ ID NO: 391410 - RNA, 64 nt, Homo Sapiens
uucuuuccaagaagucugaacccaucaucccagauugcuaaauguguugaaucaugcuauauuu

SEQ ID NO: 391411 - RNA, 64 nt, Homo Sapiens
aaagaggagaaaggcuuagguuuuccacaauacauugcuaaaauuaucaagauaaagucgcaca

SEQ ID NO: 391412 - RNA, 64 nt, Homo Sapiens
aaaucaugauaugaacaaaaucugugaaagaaguuugcuaaagccaaaaguuauccuuacucca

SEQ ID NO: 391413 - RNA, 64 nt, Homo Sapiens
ucacacacgcgcccgguggacugugugggccgacuugcuaaagguuuaaaacaguggugagcuc

SEQ ID NO: 391414 - RNA, 64 nt, Homo Sapiens
gaauggugagcuacgucauugcagggaauugcuauugcuaaaaaaguguauugaagaacugcau

SEQ ID NO: 391415 - RNA, 64 nt, Homo Sapiens
uaugucuaaaacuuguuuaacuauucuucauauuuugcuaaaaaauacugccuacugacaaaac

SEQ ID NO: 391416 - RNA, 64 nt, Homo Sapiens
ugcagauucucaggcuuucucaucaccugggaacuugcuaaaaacuggacuaucagcaucaaag

SEQ ID NO: 391417 - RNA, 64 nt, Homo Sapiens
aagaaaguuuaaaaaaaaaaccugggcauuacuguugcuaaaaguauuaaggacucucuagcug

SEQ ID NO: 391418 - RNA, 64 nt, Homo Sapiens
guucauaaggaggugagaaguaguaacuggccgauugcuaaagaaaagacaaauucaucuguag

SEQ ID NO: 391419 - RNA, 64 nt, Homo Sapiens
caugggggaaagcaguggucucauuuacgugagauugcuaaaugcagaaguuugaaaaccaggu

SEQ ID NO: 391420 - RNA, 64 nt, Homo Sapiens
ugagaauuucuuuuuaccuagauggaaaaugacauugcuaaauuuguaaauuagauggauguug

SEQ ID NO: 391421 - RNA, 64 nt, Homo Sapiens
gcacaugcacuacaagaggaaauacugaauagacuugcuaaaugaaugagaaugguacuggaaa

SEQ ID NO: 391422 - RNA, 64 nt, Homo Sapiens
aucaagcgaauuagaaggccuguaagaguaagguuugcuaaaacgugaaacacuguaacacuuu

SEQ ID NO: 391423 - RNA, 64 nt, Homo Sapiens
aaagugcugaguagguaauagugacccaacuuguuugcuaaaugauuauuuguuuaaaucugua

SEQ ID NO: 391424 - RNA, 64 nt, Homo Sapiens
gauuuuaaauaauauacgaauggugcuauuaauauugcuaaaaucaacgugugaaguguguugu

SEQ ID NO: 391425 - RNA, 64 nt, Homo Sapiens
uucgguaucauuaaccaaaauuucacacucauaguugcuaaagagaauguuauucaaucauuaa

SEQ ID NO: 391426 - RNA, 64 nt, Homo Sapiens
cuguuaagaaaggauauaaaaggauguuacaaguuugcuaaaagaagagaggggaagaauuuaa

SEQ ID NO: 391427 - RNA, 64 nt, Homo Sapiens
ucuuuuucuuuuuuugguaaauuuuugaaaaauauugcuaaaagugcauuuaaggagauuggga

SEQ ID NO: 391428 - RNA, 64 nt, Homo Sapiens
ggaaauaggcagacuguuuauguuaaaaaaauucuugcuaaaugauuucaucuuuaggaaaaaa

SEQ ID NO: 391429 - RNA, 64 nt, Homo Sapiens
uauuuacaaguauggacucaugagcuauuguugguugcuaaaugugaaucacgcgggagugagu

SEQ ID NO: 391430 - RNA, 64 nt, Homo Sapiens
uauauuuagaaugacaucaucuaagaagcugauuuugcuaaacuccuguucccuacaaugggaa

SEQ ID NO: 391431 - RNA, 64 nt, Homo Sapiens
augaaaugcacauggaggggauguaguugcauuuuugcuaaaaaaaaaaaaaaaccuuuaaaaa

SEQ ID NO: 391432 - RNA, 64 nt, Homo Sapiens
cauguaauauuauguaaaggccuggaaauuacuguugcuaaaaaaagucauguaguuucaugua

SEQ ID NO: 391433 - RNA, 64 nt, Homo Sapiens
uugaagugguuguaacaauugauaaggguggugguugcuaaauaaaugucauuggcugcuggcu

SEQ ID NO: 391434 - RNA, 64 nt, Homo Sapiens
uacuaauaaugaucuuagccauaaaaauacuuuauugcuaaaaaauuuuuuaaaaagaaauuau

SEQ ID NO: 391435 - RNA, 64 nt, Homo Sapiens
uucuguauuucaaucauaucaugaacauuuuauuuugcuaaaucuugugucauguguaggcugu

SEQ ID NO: 391436 - RNA, 64 nt, Homo Sapiens
agaucucgaacccugucuagaaggaauguauuuguugcuaaauuucguagcacuguuuacaguu

SEQ ID NO: 391437 - RNA, 64 nt, Homo Sapiens; identical to SEQ ID NO: 73518

SEQ ID NO: 391438 - RNA, 64 nt, Homo Sapiens; identical to SEQ ID NO: 73519

SEQ ID NO: 391439 - RNA, 64 nt, Homo Sapiens; identical to SEQ ID NO: 73520

SEQ ID NO: 391440 - RNA, 64 nt, Homo Sapiens; identical to SEQ ID NO: 73521

SEQ ID NO: 391441 - RNA, 64 nt, Homo Sapiens; identical to SEQ ID NO: 73522

SEQ ID NO: 391442 - RNA, 64 nt, Homo Sapiens; identical to SEQ ID NO: 73523

SEQ ID NO: 391443 - RNA, 64 nt, Homo Sapiens; identical to SEQ ID NO: 73524

SEQ ID NO: 391444 - RNA, 64 nt, Homo Sapiens; identical to SEQ ID NO: 73525

SEQ ID NO: 391445 - RNA, 64 nt, Homo Sapiens; identical to SEQ ID NO: 73526

SEQ ID NO: 391446 - RNA, 64 nt, Homo Sapiens; identical to SEQ ID NO: 73527

SEQ ID NO: 391447 - RNA, 64 nt, Homo Sapiens; identical to SEQ ID NO: 73528

SEQ ID NO: 391448 - RNA, 64 nt, Homo Sapiens; identical to SEQ ID NO: 73529

SEQ ID NO: 391449 - RNA, 64 nt, Homo Sapiens; identical to SEQ ID NO: 73530

SEQ ID NO: 391450 - RNA, 64 nt, Homo Sapiens; identical to SEQ ID NO: 73531

SEQ ID NO: 391451 - RNA, 64 nt, Homo Sapiens; identical to SEQ ID NO: 73532

SEQ ID NO: 391452 - RNA, 64 nt, Homo Sapiens; identical to SEQ ID NO: 73533

SEQ ID NO: 391453 - RNA, 64 nt, Homo Sapiens; identical to SEQ ID NO: 73534

SEQ ID NO: 391454 - RNA, 64 nt, Homo Sapiens; identical to SEQ ID NO: 73535

SEQ ID NO: 391455 - RNA, 64 nt, Homo Sapiens; identical to SEQ ID NO: 73536

SEQ ID NO: 391456 - RNA, 64 nt, Homo Sapiens; identical to SEQ ID NO: 73537

SEQ ID NO: 391457 - RNA, 64 nt, Homo Sapiens; identical to SEQ ID NO: 73538

SEQ ID NO: 391458 - RNA, 64 nt, Homo Sapiens; identical to SEQ ID NO: 73539

SEQ ID NO: 391459 - RNA, 64 nt, Homo Sapiens; identical to SEQ ID NO: 73540

SEQ ID NO: 391460 - RNA, 64 nt, Homo Sapiens; identical to SEQ ID NO: 73541

SEQ ID NO: 391461 - RNA, 64 nt, Homo Sapiens; identical to SEQ ID NO: 73542

SEQ ID NO: 391462 - RNA, 64 nt, Homo Sapiens; identical to SEQ ID NO: 73543

SEQ ID NO: 391463 - RNA, 64 nt, Homo Sapiens; identical to SEQ ID NO: 73544

SEQ ID NO: 391464 - RNA, 64 nt, Homo Sapiens; identical to SEQ ID NO: 73545

SEQ ID NO: 391465 - RNA, 64 nt, Homo Sapiens; identical to SEQ ID NO: 73546

SEQ ID NO: 391466 - RNA, 64 nt, Homo Sapiens; identical to SEQ ID NO: 73547

SEQ ID NO: 391467 - RNA, 64 nt, Homo Sapiens; identical to SEQ ID NO: 73548

SEQ ID NO: 391468 - RNA, 64 nt, Homo Sapiens; identical to SEQ ID NO: 73549

SEQ ID NO: 391469 - RNA, 64 nt, Homo Sapiens; identical to SEQ ID NO: 73550

SEQ ID NO: 391470 - RNA, 64 nt, Homo Sapiens; identical to SEQ ID NO: 73551

SEQ ID NO: 391471 - RNA, 64 nt, Homo Sapiens; identical to SEQ ID NO: 73552

SEQ ID NO: 391472 - RNA, 64 nt, Homo Sapiens; identical to SEQ ID NO: 73553

SEQ ID NO: 391473 - RNA, 64 nt, Homo Sapiens; identical to SEQ ID NO: 73554

SEQ ID NO: 391474 - RNA, 64 nt, Homo Sapiens; identical to SEQ ID NO: 73555

SEQ ID NO: 391475 - RNA, 64 nt, Homo Sapiens; identical to SEQ ID NO: 73556

SEQ ID NO: 391476 - RNA, 64 nt, Homo Sapiens; identical to SEQ ID NO: 73557

SEQ ID NO: 391477 - RNA, 64 nt, Homo Sapiens; identical to SEQ ID NO: 73558

SEQ ID NO: 391478 - RNA, 64 nt, Homo Sapiens; identical to SEQ ID NO: 73559

SEQ ID NO: 391479 - RNA, 64 nt, Homo Sapiens; identical to SEQ ID NO: 73560

SEQ ID NO: 391480 - RNA, 64 nt, Homo Sapiens; identical to SEQ ID NO: 73561

SEQ ID NO: 391481 - RNA, 64 nt, Homo Sapiens; identical to SEQ ID NO: 73562

SEQ ID NO: 391482 - RNA, 64 nt, Homo Sapiens; identical to SEQ ID NO: 73563

SEQ ID NO: 391483 - RNA, 64 nt, Homo Sapiens; identical to SEQ ID NO: 73564

SEQ ID NO: 391484 - RNA, 64 nt, Homo Sapiens; identical to SEQ ID NO: 73565

SEQ ID NO: 391485 - RNA, 64 nt, Homo Sapiens; identical to SEQ ID NO: 73566

SEQ ID NO: 391486 - RNA, 64 nt, Homo Sapiens; identical to SEQ ID NO: 73567

SEQ ID NO: 391487 - RNA, 64 nt, Homo Sapiens; identical to SEQ ID NO: 73568

SEQ ID NO: 391488 - RNA, 64 nt, Homo Sapiens; identical to SEQ ID NO: 73569

SEQ ID NO: 391489 - RNA, 64 nt, Homo Sapiens; identical to SEQ ID NO: 73570

SEQ ID NO: 391490 - RNA, 64 nt, Homo Sapiens; identical to SEQ ID NO: 73571

SEQ ID NO: 391491 - RNA, 64 nt, Homo Sapiens; identical to SEQ ID NO: 73572

SEQ ID NO: 391492 - RNA, 64 nt, Homo Sapiens; identical to SEQ ID NO: 73573

SEQ ID NO: 391493 - RNA, 64 nt, Homo Sapiens; identical to SEQ ID NO: 73574

SEQ ID NO: 391494 - RNA, 64 nt, Homo Sapiens; identical to SEQ ID NO: 73575

SEQ ID NO: 391495 - RNA, 64 nt, Homo Sapiens; identical to SEQ ID NO: 73576

SEQ ID NO: 391496 - RNA, 64 nt, Homo Sapiens; identical to SEQ ID NO: 73577

SEQ ID NO: 391497 - RNA, 64 nt, Homo Sapiens; identical to SEQ ID NO: 73578

SEQ ID NO: 391498 - RNA, 64 nt, Homo Sapiens; identical to SEQ ID NO: 73579

SEQ ID NO: 391499 - RNA, 64 nt, Homo Sapiens; identical to SEQ ID NO: 73580

SEQ ID NO: 391500 - RNA, 64 nt, Homo Sapiens; identical to SEQ ID NO: 73581

SEQ ID NO: 391501 - RNA, 64 nt, Homo Sapiens; identical to SEQ ID NO: 73582

SEQ ID NO: 391502 - RNA, 64 nt, Homo Sapiens; identical to SEQ ID NO: 73583

SEQ ID NO: 391503 - RNA, 64 nt, Homo Sapiens; identical to SEQ ID NO: 73584

SEQ ID NO: 391504 - RNA, 64 nt, Homo Sapiens; identical to SEQ ID NO: 73585

SEQ ID NO: 391505 - RNA, 64 nt, Homo Sapiens; identical to SEQ ID NO: 73586

SEQ ID NO: 391506 - RNA, 64 nt, Homo Sapiens; identical to SEQ ID NO: 73587

SEQ ID NO: 391507 - RNA, 64 nt, Homo Sapiens; identical to SEQ ID NO: 73588

SEQ ID NO: 391508 - RNA, 64 nt, Homo Sapiens; identical to SEQ ID NO: 73589

SEQ ID NO: 391509 - RNA, 64 nt, Homo Sapiens; identical to SEQ ID NO: 73590

SEQ ID NO: 391510 - RNA, 64 nt, Homo Sapiens; identical to SEQ ID NO: 73591

SEQ ID NO: 391511 - RNA, 64 nt, Homo Sapiens; identical to SEQ ID NO: 73592

SEQ ID NO: 391512 - RNA, 64 nt, Homo Sapiens; identical to SEQ ID NO: 73593

SEQ ID NO: 391513 - RNA, 64 nt, Homo Sapiens; identical to SEQ ID NO: 73594

SEQ ID NO: 391514 - RNA, 64 nt, Homo Sapiens; identical to SEQ ID NO: 73595

SEQ ID NO: 391515 - RNA, 64 nt, Homo Sapiens; identical to SEQ ID NO: 73596

SEQ ID NO: 391516 - RNA, 64 nt, Homo Sapiens; identical to SEQ ID NO: 73597

SEQ ID NO: 391517 - RNA, 64 nt, Homo Sapiens; identical to SEQ ID NO: 73598

SEQ ID NO: 391518 - RNA, 64 nt, Homo Sapiens; identical to SEQ ID NO: 73599

SEQ ID NO: 391519 - RNA, 64 nt, Homo Sapiens; identical to SEQ ID NO: 73600

SEQ ID NO: 391520 - RNA, 64 nt, Homo Sapiens; identical to SEQ ID NO: 73601

SEQ ID NO: 391521 - RNA, 64 nt, Homo Sapiens; identical to SEQ ID NO: 385550

SEQ ID NO: 391522 - RNA, 64 nt, Homo Sapiens; identical to SEQ ID NO: 385551

SEQ ID NO: 391523 - RNA, 64 nt, Homo Sapiens; identical to SEQ ID NO: 385552

SEQ ID NO: 391524 - RNA, 64 nt, Homo Sapiens; identical to SEQ ID NO: 385553

SEQ ID NO: 391525 - RNA, 64 nt, Homo Sapiens; identical to SEQ ID NO: 385554

SEQ ID NO: 391526 - RNA, 64 nt, Homo Sapiens; identical to SEQ ID NO: 385555

SEQ ID NO: 391527 - RNA, 64 nt, Homo Sapiens; identical to SEQ ID NO: 385556

SEQ ID NO: 391528 - RNA, 64 nt, Homo Sapiens; identical to SEQ ID NO: 385557

SEQ ID NO: 391529 - RNA, 64 nt, Homo Sapiens; identical to SEQ ID NO: 385558

SEQ ID NO: 391530 - RNA, 64 nt, Homo Sapiens; identical to SEQ ID NO: 385559

SEQ ID NO: 391531 - RNA, 64 nt, Homo Sapiens; identical to SEQ ID NO: 385560

SEQ ID NO: 391532 - RNA, 64 nt, Homo Sapiens; identical to SEQ ID NO: 385561

SEQ ID NO: 391533 - RNA, 64 nt, Homo Sapiens; identical to SEQ ID NO: 385562

SEQ ID NO: 391534 - RNA, 64 nt, Homo Sapiens; identical to SEQ ID NO: 385563

SEQ ID NO: 391535 - RNA, 64 nt, Homo Sapiens; identical to SEQ ID NO: 385564

SEQ ID NO: 391536 - RNA, 64 nt, Homo Sapiens; identical to SEQ ID NO: 385565

SEQ ID NO: 391537 - RNA, 64 nt, Homo Sapiens; identical to SEQ ID NO: 385566

SEQ ID NO: 391538 - RNA, 64 nt, Homo Sapiens; identical to SEQ ID NO: 385567

SEQ ID NO: 391539 - RNA, 64 nt, Homo Sapiens; identical to SEQ ID NO: 385568

SEQ ID NO: 391540 - RNA, 64 nt, Homo Sapiens; identical to SEQ ID NO: 385569

SEQ ID NO: 391541 - RNA, 64 nt, Homo Sapiens; identical to SEQ ID NO: 385570

SEQ ID NO: 391542 - RNA, 64 nt, Homo Sapiens; identical to SEQ ID NO: 385571

SEQ ID NO: 391543 - RNA, 64 nt, Homo Sapiens; identical to SEQ ID NO: 385572

SEQ ID NO: 391544 - RNA, 64 nt, Homo Sapiens; identical to SEQ ID NO: 385573

SEQ ID NO: 391545 - RNA, 64 nt, Homo Sapiens; identical to SEQ ID NO: 385574

SEQ ID NO: 391546 - RNA, 64 nt, Homo Sapiens; identical to SEQ ID NO: 385575

SEQ ID NO: 391547 - RNA, 64 nt, Homo Sapiens; identical to SEQ ID NO: 385576

SEQ ID NO: 391548 - RNA, 64 nt, Homo Sapiens; identical to SEQ ID NO: 385577

SEQ ID NO: 391549 - RNA, 64 nt, Homo Sapiens; identical to SEQ ID NO: 385578

SEQ ID NO: 391550 - RNA, 64 nt, Homo Sapiens; identical to SEQ ID NO: 385579

SEQ ID NO: 391551 - RNA, 64 nt, Homo Sapiens; identical to SEQ ID NO: 385580

SEQ ID NO: 391552 - RNA, 64 nt, Homo Sapiens; identical to SEQ ID NO: 385581

SEQ ID NO: 391553 - RNA, 64 nt, Homo Sapiens; identical to SEQ ID NO: 385582

SEQ ID NO: 391554 - RNA, 64 nt, Homo Sapiens; identical to SEQ ID NO: 385583

SEQ ID NO: 391555 - RNA, 64 nt, Homo Sapiens; identical to SEQ ID NO: 385584

SEQ ID NO: 391556 - RNA, 64 nt, Homo Sapiens; identical to SEQ ID NO: 385585

SEQ ID NO: 391557 - RNA, 64 nt, Homo Sapiens; identical to SEQ ID NO: 385586

SEQ ID NO: 391558 - RNA, 64 nt, Homo Sapiens; identical to SEQ ID NO: 385587

SEQ ID NO: 391559 - RNA, 64 nt, Homo Sapiens; identical to SEQ ID NO: 385588

SEQ ID NO: 391560 - RNA, 64 nt, Homo Sapiens
caagagggcguuugggcacugauaugugggugagggcauggaggagggugaguucuccaaggcc

SEQ ID NO: 391561 - RNA, 64 nt, Homo Sapiens
uaugacugcccuggagaaggauuacaaggaggugggcauggauaguguggaguggggggaagaa

SEQ ID NO: 391562 - RNA, 64 nt, Homo Sapiens
gcuucagaggaguuuuugaaucccuaaugcccagggcauggaugggcccugaccuuugugggcc

SEQ ID NO: 391563 - RNA, 64 nt, Homo Sapiens
uauugcugccugcccucucucccccaggaggguuggcauggaccaaauagccuuccucacccua

SEQ ID NO: 391564 - RNA, 64 nt, Homo Sapiens
agccucagggaaaggccugcgccugguacccuguggcauggagacucccacugacgggcacuga

SEQ ID NO: 391565 - RNA, 64 nt, Homo Sapiens
aauuuguauuuaaaaaaccucgggcauuugagggggcauggaguacuucaagcaucuugaggag

SEQ ID NO: 391566 - RNA, 64 nt, Homo Sapiens
guccccaucccccccauguguguguugugauuguggcauggagacgguccgaacgcgggcgucg

SEQ ID NO: 391567 - RNA, 64 nt, Homo Sapiens
gggccaggguugcggucgcggcguccaaccccggggcauggacaucugucuguccuacccgccc

SEQ ID NO: 391568 - RNA, 64 nt, Homo Sapiens
aaaccaugcggagaauuagaguucagcucagcugggcauggaguuaagaucccucacaggaccc

SEQ ID NO: 391569 - RNA, 64 nt, Homo Sapiens
uuucuucagccccuucucuggcccagacccugugggcauggagauggacagaccugggccuggc

SEQ ID NO: 391570 - RNA, 64 nt, Homo Sapiens
aaggugacccugaucccaaauagaaaagggucagggcauggagacuuccucuucuguugccaaa

SEQ ID NO: 391571 - RNA, 64 nt, Homo Sapiens
aucucuuccucuucuguugcucugcugacaagggggcauggagcgccccagugcucucuugcug

SEQ ID NO: 391572 - RNA, 64 nt, Homo Sapiens
cauguguguguaacaaacacuauacucacacacaggcauggaugccucgggacacaccaacccc

SEQ ID NO: 391573 - RNA, 64 nt, Homo Sapiens
cucaggaaggaacacacaccuggccugcccaggaggcauggauagcuggacuagugguccuugc

SEQ ID NO: 391574 - RNA, 64 nt, Homo Sapiens
cucgguggaggaggcccguggggucccaacacggaagagccaugggccgugugcauggugucgc

SEQ ID NO: 391575 - RNA, 64 nt, Homo Sapiens
acuggggagauguagugugcauacaaaacaguaaaagagccaucucaaggacagagagcauaga

SEQ ID NO: 391576 - RNA, 64 nt, Homo Sapiens
acauucuuggcccaggagcaagggggugcuggccaagagccaacagucuucuuagaguuaaagg

SEQ ID NO: 391577 - RNA, 64 nt, Homo Sapiens
cauguuaacucuuccuuaucuucuuuaccuggcaaagagccaauuugguaaaucugccuuaucc

SEQ ID NO: 391578 - RNA, 64 nt, Homo Sapiens
aaaagccuagagagacuggauuuaaugugggauuaagagccaagucuuaguucugacuucucag

SEQ ID NO: 391579 - RNA, 64 nt, Homo Sapiens
cugaaacaugucuuguacaggaauaagaacagaaaagagccauagucuucauacaaaacaaaag

SEQ ID NO: 391580 - RNA, 64 nt, Homo Sapiens
acagcaguggucaaauaucuagauuuauuuugaaaagagccaauaggauuugcugagaguuuga

SEQ ID NO: 391581 - RNA, 64 nt, Homo Sapiens
gauugucucugaguauuacugagaagcaacagaaaagagccauggauggagcccuugggcucuc

SEQ ID NO: 391582 - RNA, 64 nt, Homo Sapiens
ucuaaaaagaggcgaaaggaagcaagcaguucagaagagccaaggaauaaacaugcaaugaacc

SEQ ID NO: 391583 - RNA, 64 nt, Homo Sapiens
uggagaaaguaccgggaagaaggagguggcugagaagagccagaucaaccucauugauaagaaa

SEQ ID NO: 391584 - RNA, 64 nt, Homo Sapiens
gcccaccaaggaguuuuccaccucugggacaacuaagagccaaggagccuugcaggauggagca

SEQ ID NO: 391585 - RNA, 64 nt, Homo Sapiens
cggggcacguguguguacacgaaugaauuuauucaagagccauuacccccacacucugcuagag

SEQ ID NO: 391586 - RNA, 64 nt, Homo Sapiens
ugcaucuugguaucucuuccauggucuucagcuaaagagccagcguggagccuucagccaggug

SEQ ID NO: 391587 - RNA, 64 nt, Homo Sapiens
auaaauauacuuuggcacuugaccauaggcccuaaagagccaaaaguugaguaauugugacaug

SEQ ID NO: 391588 - RNA, 64 nt, Homo Sapiens
gucuccagacucauggcguugcuccaccgcacagaagagccacacucagggggcacguggucag

SEQ ID NO: 391589 - RNA, 64 nt, Homo Sapiens
cuguaaaauaaccaaccacuauagugacguccugaagagccagugaaguccaccugucuggucc

SEQ ID NO: 391590 - RNA, 64 nt, Homo Sapiens
acucugaaaucuggugacuuugacacugaagcggaagagccaaugaaggacugcaguauuugug

SEQ ID NO: 391591 - RNA, 64 nt, Homo Sapiens
agaggacagaaaauuacuuggguuuacuaauucaaagagccaucucugaugggagagggugagg

SEQ ID NO: 391592 - RNA, 64 nt, Homo Sapiens
uguaaggaccuucagagcaucccaggguuacagcaagagccacugagguguggcuggcagagca

SEQ ID NO: 391593 - RNA, 64 nt, Homo Sapiens
cauacaggcggcuccagcccugggcagcggcuucaagagccagagugggaagucaggccucucu

SEQ ID NO: 391594 - RNA, 64 nt, Homo Sapiens
gguggcugcuggcuuucaagcgugguuuuuugcuaagagccagaggcaggucuucuggaguucu

SEQ ID NO: 391595 - RNA, 64 nt, Homo Sapiens
ugucauguaauacugaaccauaaaauauuuuccaaagagccauguugugguuguauauaucagg

SEQ ID NO: 391596 - RNA, 64 nt, Homo Sapiens
aguugaugugggaagaaguaaguguuguggagaaaagagccagacuuuccuuugcaccauguga

SEQ ID NO: 391597 - RNA, 64 nt, Homo Sapiens
ccugugcucagguugccuugaauguggacucuggaagagccaggggcccagaaugccgggggag

SEQ ID NO: 391598 - RNA, 64 nt, Homo Sapiens
cuagggauuauacaguauuugcugacuacuuccuaagagccaaaaauaaaaaaucugaauucca

SEQ ID NO: 391599 - RNA, 64 nt, Homo Sapiens
guaagagauuaagggguuucugaguuccaugcucaagagccauucagccauugaugcugcuaca

SEQ ID NO: 391600 - RNA, 64 nt, Homo Sapiens
cauugaugcugcuacaugaguuuccaaauuguuaaagagccagccauaguaaaacaaccuuuua

SEQ ID NO: 391601 - RNA, 64 nt, Homo Sapiens
caucgauuggguaguguccuucaaguggguggcgaagagccagucgggcauaugucaugaaggu

SEQ ID NO: 391602 - RNA, 64 nt, Homo Sapiens
gucccguucuguuaguaggucucccgugccugagaagagccagaaacgugguucuucaaguaga

SEQ ID NO: 391603 - RNA, 64 nt, Homo Sapiens
gggaaagaguaacagcaauugaaaaaagagauucaagagccaaguacucagcccuggcagggga

SEQ ID NO: 391604 - RNA, 64 nt, Homo Sapiens
cgugccucugaacagacugcugagauacccaaucaagagccaauccuugcuucccuagacucuc

SEQ ID NO: 391605 - RNA, 64 nt, Homo Sapiens
ccuuggccuuaaggaaaucuuuacuccuguaagcaagagccaaccucacaggauuaggagcugg

SEQ ID NO: 391606 - RNA, 64 nt, Homo Sapiens
uguacauaaaaguuucuuuccuaaaccauucaccaagagccaauaucuaggcauuuucuuggua

SEQ ID NO: 391607 - RNA, 64 nt, Homo Sapiens
aaaaaguaucuucauuuaaauauuuccaguucagaagagccaaaacggugaacagcacuuuuau

SEQ ID NO: 391608 - RNA, 64 nt, Homo Sapiens
aguccacaguguuuacagagcccuuuucucugagaagagccagcugauuggcugugucacagug

SEQ ID NO: 391609 - RNA, 64 nt, Homo Sapiens
cccuuugacgagccucaaacugcucagcucaucaaagagccauugccaacuuccguaugugguu

SEQ ID NO: 391610 - RNA, 64 nt, Homo Sapiens
ccaucucacagucaagauaaaggccucgagaauaaagagccagcccccuuccauuuagucuccu

SEQ ID NO: 391611 - RNA, 63 nt, Homo Sapiens
ugggauuuuuuuuuuuuuaaaauacuuuagggacuguuguaauuucucauauggugcuggaaa

SEQ ID NO: 391612 - RNA, 63 nt, Homo Sapiens
gcuagcggaggacuacccuugcucacugacuuccuguuguaacacacuuuccuuacggagccu

SEQ ID NO: 391613 - RNA, 63 nt, Homo Sapiens
cacugcuaauaguggauuguaauaauuuuuuugcuguuguacuuuaguauguguaaauuguac

SEQ ID NO: 391614 - RNA, 63 nt, Homo Sapiens
uugagauuucccaaauuaagauuugguuucucccuguuguaaugggcucaaguacacauccug

SEQ ID NO: 391615 - RNA, 63 nt, Homo Sapiens
cccuuucauauuauuuuuaaauuuuuuaauuaccuguuguaggguguuccuccagaagcaaag

SEQ ID NO: 391616 - RNA, 63 nt, Homo Sapiens
gguucuuucguagaacaauuuccauguuguuaacuguuguagacuuaauugaaucacauuuug

SEQ ID NO: 391617 - RNA, 63 nt, Homo Sapiens
uuuugcuuuccaucuguuacgaacuuaagauagcuguuguacuaaccagcaauguugagagcu

SEQ ID NO: 391618 - RNA, 63 nt, Homo Sapiens
aacuaaucuuugcuuguuuuauguauauagucacuguuguauagcuagcauguuuucccucug

SEQ ID NO: 391619 - RNA, 63 nt, Homo Sapiens
auaacaguauuacaugucaacucacaaguuuaacuguuguauucagaugacuucuguuguaga

SEQ ID NO: 391620 - RNA, 63 nt, Homo Sapiens
cucacaaguuuaacuguugucuacagaugacuucuguuguagacaacuuuguuuccuguuuaa

SEQ ID NO: 391621 - RNA, 63 nt, Homo Sapiens
uucaguuagacaaggcaacugaguucaagagaucuguuguacagcuuggugacuguaauuaac

SEQ ID NO: 391622 - RNA, 63 nt, Homo Sapiens
uauaaaaaauuagccaggcauaguggcgcaugccuguuguagccccagcuacucaagaggcug

SEQ ID NO: 391623 - RNA, 63 nt, Homo Sapiens
uucucuuugccuggaguaaacaagauccuaugucuguuguauugaggagaacuacguugaaau

SEQ ID NO: 391624 - RNA, 63 nt, Homo Sapiens
gcaucucugcuacagcagucgucccuucucuugcuguuguaauccauggucuuggaaaagauu

SEQ ID NO: 391625 - RNA, 63 nt, Homo Sapiens
caauaaguuuauugcugugauguucaaguaugucuguuguaacccuuucuucccauccuuaac

SEQ ID NO: 391626 - RNA, 63 nt, Homo Sapiens
aacaguuuaacacaauacuaaaaagaaaaaacucuguuguaaauuacuggguuuaauuaaaaa

SEQ ID NO: 391627 - RNA, 63 nt, Homo Sapiens
uguccaacaaacacacacggguagauugcuggccuguuguaggugguagggacacagaugacc

SEQ ID NO: 391628 - RNA, 63 nt, Homo Sapiens
uagaagagaaucaagaagaaaaauaaaaaucagcuguuguaaucaccuagcaaacuggcguaa

SEQ ID NO: 391629 - RNA, 63 nt, Homo Sapiens
acacacacacacacacacacacacucccuuacacuguuguacuuccgugggcccuccuuccag

SEQ ID NO: 391630 - RNA, 63 nt, Homo Sapiens
uguuuaguuuacucagguggccacauacagucucuguuguauauucuugguuuuguuuuaaua

SEQ ID NO: 391631 - RNA, 64 nt, Homo Sapiens
guaauaccaaggaaucucccagguaaaacaaaacaaaaacgacaaauaaguuuauauucuugcu

SEQ ID NO: 391632 - RNA, 64 nt, Homo Sapiens
ugacuuaguaaugcgaaccuccauuuaaaaauguaaaaacgaccuauuuauaugaccuuuguaa

SEQ ID NO: 391633 - RNA, 64 nt, Homo Sapiens
gguuuuauaauucuguguaucuuaugguuaaaagaaaaacgaauaguuuuccauugaauauaug

SEQ ID NO: 391634 - RNA, 64 nt, Homo Sapiens
cuacaaaauccuuuuaagaaguuagauguauuaaaaaaacgaaauuuuacuuguggggguggga

SEQ ID NO: 391635 - RNA, 64 nt, Homo Sapiens
uuacacagaaaauuuugacuuaaaacaucugcugaauuccaaauuucuguaauagcuacuguau

SEQ ID NO: 391636 - RNA, 64 nt, Homo Sapiens
guguucuuggcacauguauauuacuaaaguagauaauuccaaugagaaauacuaccagauuauu

SEQ ID NO: 391637 - RNA, 64 nt, Homo Sapiens
cagagauuauuaauaugguagaacccuguuauguaauuccaaaacuuaagaaccauauuuacau

SEQ ID NO: 391638 - RNA, 64 nt, Homo Sapiens
acuguuacauauaaucauaucucugaaagucgagaauuccaagacauauacaaaauuucauuuu

SEQ ID NO: 391639 - RNA, 64 nt, Homo Sapiens
gaaagacuagaacaaauuggacauuguagcagaaaauuccaaaagguaaguuaagcacuucuua

SEQ ID NO: 391640 - RNA, 64 nt, Homo Sapiens
ucauuucugcuuccgcuaaguauuauuuacacugaauuccaauuagaacucaucuguaguccuu

SEQ ID NO: 391641 - RNA, 64 nt, Homo Sapiens
guuacaaucuggacuugguagcuuccaggagaaaaauuccaagaggacagaaauauaacuaaau

SEQ ID NO: 391642 - RNA, 64 nt, Homo Sapiens
uggaugucccugaaugaaaaguccuggggaucagaauuccaaaaaaacaacacauuagcuuaua

SEQ ID NO: 391643 - RNA, 64 nt, Homo Sapiens
agccuaccugaggucccuacaggacaacaguuccaauuccaaggaacagaggcuugcccucuuc

SEQ ID NO: 391644 - RNA, 64 nt, Homo Sapiens
uggauacagucaugacagcucauugaaaaugaugaauuccaaucgacucauucuaagggcaaga

SEQ ID NO: 391645 - RNA, 64 nt, Homo Sapiens
ccuuguaacuacugcuucuacuacccaaaauaugaauuccaacacugcuuccaagagacauuua

SEQ ID NO: 391646 - RNA, 64 nt, Homo Sapiens
auaaaauugcuuccauuuuuggaugagaaugaaaaauuccaaaagugcugagcuuuggggagaa

SEQ ID NO: 391647 - RNA, 64 nt, Homo Sapiens
uuuuaaauacugaauucauaguuguuguuuuuuaaauuccaacaguaacagcugaaugguuuaa

SEQ ID NO: 391648 - RNA, 64 nt, Homo Sapiens
ugaaagauuccaacuaguugucagugcuucuugaaauuccaaacagaaagauacauuggucaaa

SEQ ID NO: 391649 - RNA, 64 nt, Homo Sapiens
gccuuucuacugaaucugguugaaccuuguaggaaauuccaagggaaguggagcuguucagaac

SEQ ID NO: 391650 - RNA, 64 nt, Homo Sapiens
ugacugcaugacgugguacaagagugcaugcaguaauuccaauggguacauuaagcuuuaguga

SEQ ID NO: 391651 - RNA, 64 nt, Homo Sapiens
acagagacuggugguguuacucuuacaaguuccgaauuccaaauugaaucaggaaaaggcaguu

SEQ ID NO: 391652 - RNA, 64 nt, Homo Sapiens
cucagaucuugugcuuuaguuccccaacaugguuaauuccaacuauuugucucuuuaggggaca

SEQ ID NO: 391653 - RNA, 64 nt, Homo Sapiens
ugucugaguuuugaauaguggguuacuaugcugaaauuccaaaacauacgaagaaaacuucuca

SEQ ID NO: 391654 - RNA, 64 nt, Homo Sapiens
aucugcuugcauuggugaaucuucauauuuuaaaaauuccaacugaaauuuguaauaaaaucaa

SEQ ID NO: 391655 - RNA, 64 nt, Homo Sapiens
guaauuagacaaaaaucauuuagaagcaaauuccaauuccaaaugacuggugacuggucuguga

SEQ ID NO: 391656 - RNA, 64 nt, Homo Sapiens
ccaaauguaauuagacaaaacugugauagaagcaaauuccaauuacugaggacuggugacuggu

SEQ ID NO: 391657 - RNA, 64 nt, Homo Sapiens
uagagcaguaaauucaaauggauaaugacaggaaaauuccaaacacauguauugguuuaaacuc

SEQ ID NO: 391658 - RNA, 64 nt, Homo Sapiens
cuaaaaaaagaaauauuuuuagaaaccuauugugaauuccaaauauuuacaaaggaggaacgga

SEQ ID NO: 391659 - RNA, 64 nt, Homo Sapiens; identical to SEQ ID NO: 52875

SEQ ID NO: 391660 - RNA, 64 nt, Homo Sapiens; identical to SEQ ID NO: 52876

SEQ ID NO: 391661 - RNA, 64 nt, Homo Sapiens; identical to SEQ ID NO: 52877

SEQ ID NO: 391662 - RNA, 64 nt, Homo Sapiens; identical to SEQ ID NO: 52878

SEQ ID NO: 391663 - RNA, 64 nt, Homo Sapiens; identical to SEQ ID NO: 52879

SEQ ID NO: 391664 - RNA, 64 nt, Homo Sapiens; identical to SEQ ID NO: 52880

SEQ ID NO: 391665 - RNA, 64 nt, Homo Sapiens; identical to SEQ ID NO: 52881

SEQ ID NO: 391666 - RNA, 64 nt, Homo Sapiens; identical to SEQ ID NO: 52882

SEQ ID NO: 391667 - RNA, 64 nt, Homo Sapiens; identical to SEQ ID NO: 52883

SEQ ID NO: 391668 - RNA, 64 nt, Homo Sapiens; identical to SEQ ID NO: 52884

SEQ ID NO: 391669 - RNA, 64 nt, Homo Sapiens; identical to SEQ ID NO: 52885

SEQ ID NO: 391670 - RNA, 64 nt, Homo Sapiens; identical to SEQ ID NO: 52886

SEQ ID NO: 391671 - RNA, 64 nt, Homo Sapiens; identical to SEQ ID NO: 52887

SEQ ID NO: 391672 - RNA, 64 nt, Homo Sapiens; identical to SEQ ID NO: 52888

SEQ ID NO: 391673 - RNA, 64 nt, Homo Sapiens; identical to SEQ ID NO: 52889

SEQ ID NO: 391674 - RNA, 64 nt, Homo Sapiens; identical to SEQ ID NO: 52890

SEQ ID NO: 391675 - RNA, 64 nt, Homo Sapiens; identical to SEQ ID NO: 52891

SEQ ID NO: 391676 - RNA, 64 nt, Homo Sapiens; identical to SEQ ID NO: 52892

SEQ ID NO: 391677 - RNA, 64 nt, Homo Sapiens; identical to SEQ ID NO: 52893

SEQ ID NO: 391678 - RNA, 64 nt, Homo Sapiens; identical to SEQ ID NO: 52894

SEQ ID NO: 391679 - RNA, 64 nt, Homo Sapiens; identical to SEQ ID NO: 52895

SEQ ID NO: 391680 - RNA, 64 nt, Homo Sapiens; identical to SEQ ID NO: 52896

SEQ ID NO: 391681 - RNA, 64 nt, Homo Sapiens; identical to SEQ ID NO: 52897

SEQ ID NO: 391682 - RNA, 64 nt, Homo Sapiens; identical to SEQ ID NO: 52898

SEQ ID NO: 391683 - RNA, 64 nt, Homo Sapiens; identical to SEQ ID NO: 52899

SEQ ID NO: 391684 - RNA, 64 nt, Homo Sapiens; identical to SEQ ID NO: 52900

SEQ ID NO: 391685 - RNA, 64 nt, Homo Sapiens; identical to SEQ ID NO: 52901

SEQ ID NO: 391686 - RNA, 64 nt, Homo Sapiens; identical to SEQ ID NO: 52902

SEQ ID NO: 391687 - RNA, 64 nt, Homo Sapiens; identical to SEQ ID NO: 52903

SEQ ID NO: 391688 - RNA, 64 nt, Homo Sapiens; identical to SEQ ID NO: 52904

SEQ ID NO: 391689 - RNA, 64 nt, Homo Sapiens; identical to SEQ ID NO: 52905

SEQ ID NO: 391690 - RNA, 64 nt, Homo Sapiens; identical to SEQ ID NO: 52906

SEQ ID NO: 391691 - RNA, 64 nt, Homo Sapiens; identical to SEQ ID NO: 52907

SEQ ID NO: 391692 - RNA, 64 nt, Homo Sapiens; identical to SEQ ID NO: 52908

SEQ ID NO: 391693 - RNA, 64 nt, Homo Sapiens; identical to SEQ ID NO: 52909

SEQ ID NO: 391694 - RNA, 64 nt, Homo Sapiens; identical to SEQ ID NO: 52910

SEQ ID NO: 391695 - RNA, 64 nt, Homo Sapiens; identical to SEQ ID NO: 52911

SEQ ID NO: 391696 - RNA, 64 nt, Homo Sapiens; identical to SEQ ID NO: 52912

SEQ ID NO: 391697 - RNA, 64 nt, Homo Sapiens; identical to SEQ ID NO: 52913

SEQ ID NO: 391698 - RNA, 64 nt, Homo Sapiens; identical to SEQ ID NO: 52914

SEQ ID NO: 391699 - RNA, 64 nt, Homo Sapiens; identical to SEQ ID NO: 52915

SEQ ID NO: 391700 - RNA, 64 nt, Homo Sapiens; identical to SEQ ID NO: 52916

SEQ ID NO: 391701 - RNA, 64 nt, Homo Sapiens; identical to SEQ ID NO: 279900

SEQ ID NO: 391702 - RNA, 64 nt, Homo Sapiens; identical to SEQ ID NO: 279901

SEQ ID NO: 391703 - RNA, 64 nt, Homo Sapiens; identical to SEQ ID NO: 279902

SEQ ID NO: 391704 - RNA, 64 nt, Homo Sapiens; identical to SEQ ID NO: 279903

SEQ ID NO: 391705 - RNA, 64 nt, Homo Sapiens; identical to SEQ ID NO: 279904

SEQ ID NO: 391706 - RNA, 64 nt, Homo Sapiens; identical to SEQ ID NO: 279905

SEQ ID NO: 391707 - RNA, 64 nt, Homo Sapiens; identical to SEQ ID NO: 279906

SEQ ID NO: 391708 - RNA, 64 nt, Homo Sapiens; identical to SEQ ID NO: 279907

SEQ ID NO: 391709 - RNA, 64 nt, Homo Sapiens; identical to SEQ ID NO: 279908

SEQ ID NO: 391710 - RNA, 64 nt, Homo Sapiens; identical to SEQ ID NO: 279909

SEQ ID NO: 391711 - RNA, 64 nt, Homo Sapiens; identical to SEQ ID NO: 279910

SEQ ID NO: 391712 - RNA, 64 nt, Homo Sapiens; identical to SEQ ID NO: 279911

SEQ ID NO: 391713 - RNA, 64 nt, Homo Sapiens; identical to SEQ ID NO: 279912

SEQ ID NO: 391714 - RNA, 64 nt, Homo Sapiens; identical to SEQ ID NO: 279913

SEQ ID NO: 391715 - RNA, 64 nt, Homo Sapiens; identical to SEQ ID NO: 279914

SEQ ID NO: 391716 - RNA, 64 nt, Homo Sapiens; identical to SEQ ID NO: 279915

SEQ ID NO: 391717 - RNA, 64 nt, Homo Sapiens; identical to SEQ ID NO: 279916

SEQ ID NO: 391718 - RNA, 64 nt, Homo Sapiens; identical to SEQ ID NO: 279917

SEQ ID NO: 391719 - RNA, 64 nt, Homo Sapiens; identical to SEQ ID NO: 279918

SEQ ID NO: 391720 - RNA, 64 nt, Homo Sapiens; identical to SEQ ID NO: 279919

SEQ ID NO: 391721 - RNA, 64 nt, Homo Sapiens; identical to SEQ ID NO: 279920

SEQ ID NO: 391722 - RNA, 64 nt, Homo Sapiens; identical to SEQ ID NO: 279921

SEQ ID NO: 391723 - RNA, 64 nt, Homo Sapiens; identical to SEQ ID NO: 279922

SEQ ID NO: 391724 - RNA, 57 nt, Homo Sapiens; identical to SEQ ID NO: 244788

SEQ ID NO: 391725 - RNA, 64 nt, Homo Sapiens; identical to SEQ ID NO: 279924

SEQ ID NO: 391726 - RNA, 64 nt, Homo Sapiens; identical to SEQ ID NO: 279925

SEQ ID NO: 391727 - RNA, 64 nt, Homo Sapiens; identical to SEQ ID NO: 279926

SEQ ID NO: 391728 - RNA, 64 nt, Homo Sapiens; identical to SEQ ID NO: 279927

SEQ ID NO: 391729 - RNA, 64 nt, Homo Sapiens; identical to SEQ ID NO: 279928

SEQ ID NO: 391730 - RNA, 64 nt, Homo Sapiens; identical to SEQ ID NO: 279929

SEQ ID NO: 391731 - RNA, 64 nt, Homo Sapiens; identical to SEQ ID NO: 279930

SEQ ID NO: 391732 - RNA, 64 nt, Homo Sapiens; identical to SEQ ID NO: 279931

SEQ ID NO: 391733 - RNA, 64 nt, Homo Sapiens; identical to SEQ ID NO: 279932

SEQ ID NO: 391734 - RNA, 64 nt, Homo Sapiens; identical to SEQ ID NO: 279933

SEQ ID NO: 391735 - RNA, 64 nt, Homo Sapiens; identical to SEQ ID NO: 279934

SEQ ID NO: 391736 - RNA, 64 nt, Homo Sapiens; identical to SEQ ID NO: 279935

SEQ ID NO: 391737 - RNA, 64 nt, Homo Sapiens; identical to SEQ ID NO: 279936

SEQ ID NO: 391738 - RNA, 64 nt, Homo Sapiens; identical to SEQ ID NO: 279937

SEQ ID NO: 391739 - RNA, 64 nt, Homo Sapiens; identical to SEQ ID NO: 279938

SEQ ID NO: 391740 - RNA, 64 nt, Homo Sapiens; identical to SEQ ID NO: 129470

SEQ ID NO: 391741 - RNA, 64 nt, Homo Sapiens; identical to SEQ ID NO: 129471

SEQ ID NO: 391742 - RNA, 64 nt, Homo Sapiens; identical to SEQ ID NO: 129472

SEQ ID NO: 391743 - RNA, 64 nt, Homo Sapiens; identical to SEQ ID NO: 129473

SEQ ID NO: 391744 - RNA, 64 nt, Homo Sapiens; identical to SEQ ID NO: 129474

SEQ ID NO: 391745 - RNA, 64 nt, Homo Sapiens; identical to SEQ ID NO: 129475

SEQ ID NO: 391746 - RNA, 64 nt, Homo Sapiens; identical to SEQ ID NO: 129476

SEQ ID NO: 391747 - RNA, 64 nt, Homo Sapiens; identical to SEQ ID NO: 129477

SEQ ID NO: 391748 - RNA, 64 nt, Homo Sapiens; identical to SEQ ID NO: 129478

SEQ ID NO: 391749 - RNA, 64 nt, Homo Sapiens; identical to SEQ ID NO: 129479

SEQ ID NO: 391750 - RNA, 64 nt, Homo Sapiens
aauuuuugauugucugacagauacuuauccauuaugugucuauaguucagaugcuuguguaaga

SEQ ID NO: 391751 - RNA, 64 nt, Homo Sapiens
ggaguuugagaugcgccugggcaacauagaaaccugugucuacaaaaaauuuaaaaauuagcca

SEQ ID NO: 391752 - RNA, 64 nt, Homo Sapiens
cacuggagagagagagaacuguuuacaguuaaucugugucuaauuaucugauuuuuuuuauugg

SEQ ID NO: 391753 - RNA, 64 nt, Homo Sapiens
aucucuccagggggaaaacugucuaguucccuucugugucuaaauuuuccaaaacguugauuug

SEQ ID NO: 391754 - RNA, 64 nt, Homo Sapiens
ugugaaaaaagcagacaaguugugugugugugugugugucuaagaaaacuugugugcuuuucaa

SEQ ID NO: 391755 - RNA, 64 nt, Homo Sapiens
caaagaacauuauuaaggaauuauuuagaaacaaugugucuaguuuaagaaagugguuuucagu

SEQ ID NO: 391756 - RNA, 64 nt, Homo Sapiens
ucauuguagagucugaggguuagaaggaagucauugugucuaacauaacaacagagcaguuugu

SEQ ID NO: 391757 - RNA, 64 nt, Homo Sapiens
guccagaacauuucaucuaugauggguuagauaaugugucuaguuguuugcaugccaauuucag

SEQ ID NO: 391758 - RNA, 64 nt, Homo Sapiens
gaugcauuuuaaucuuuuauaaugaaguaaaaguugugucuauaauuaaaaaaaaauauauaua

SEQ ID NO: 391759 - RNA, 64 nt, Homo Sapiens
caggucccagauuucuuaaggcuuuguuugaccaugugucuaguuacuugcugaaaagugaaua

SEQ ID NO: 391760 - RNA, 64 nt, Homo Sapiens
guagcuggugacuauaaauaauauuuuaaaaugcugugucuacaccaucaagacugugucuaca

SEQ ID NO: 391761 - RNA, 64 nt, Homo Sapiens
auauuuuaaaaugcugugucuacaccaucaagacugugucuacacuaucuuggcugaacgagaa

SEQ ID NO: 391762 - RNA, 64 nt, Homo Sapiens
ucaucaguuacugucaugcaucccaaagggcccaugugucuacaggguugaaaaaaauaucagc

SEQ ID NO: 391763 - RNA, 64 nt, Homo Sapiens
agccaacaggcagagcagggaaagauuugacucgugugucuacuccaacuaugcccuuagguag

SEQ ID NO: 391764 - RNA, 64 nt, Homo Sapiens
agcucaagguuuguaaacacaccaaucagcacccugugucuagcucaguguuugugaaugcacc

SEQ ID NO: 391765 - RNA, 64 nt, Homo Sapiens
aucuagcuaaucuaguggggauguggagaaccuuugugucuagcucagggaucguaaacgcacc

SEQ ID NO: 391766 - RNA, 64 nt, Homo Sapiens
ugcgucagccugaaaauggaucagagacaaguccugugucuacccuuuucuuugcucgaggugu

SEQ ID NO: 391767 - RNA, 64 nt, Homo Sapiens
gcuugggcugaucuaguggcgccuuggcuacaucugugucuagggucaugccccccuccacuga

SEQ ID NO: 391768 - RNA, 64 nt, Homo Sapiens
ggguuuuaacuuauuuuucuaagcaucucguaggugugucuacucaugaaaugagggacaaaga

SEQ ID NO: 391769 - RNA, 64 nt, Homo Sapiens
ggucggucgguuuaccacugcauccugacugaacugugucuaaguuucuagcccucucgcaggg

SEQ ID NO: 391770 - RNA, 62 nt, Homo Sapiens
uacccuccucucacaucuccuccugcccaagauguaaggaagcauuguaaggauuucuuccc

SEQ ID NO: 391771 - RNA, 62 nt, Homo Sapiens
caucuccuccugcccaagauguaaggaagcauuguaaggauuucuucccaucguacccuucc

SEQ ID NO: 391772 - RNA, 62 nt, Homo Sapiens
acuucaguccuggucugcucaggaauugaagauguaaggaauugaagauaggagagauaccu

SEQ ID NO: 391773 - RNA, 62 nt, Homo Sapiens
uaagagcugaugugagugugugugaugggaucuguaaggaacuggaacacacauguccuauc

SEQ ID NO: 391774 - RNA, 62 nt, Homo Sapiens
uuggucuaugccaggcccauuuccugcuuuuguguaaggaaggugcucacauaggaaguuuu

SEQ ID NO: 391775 - RNA, 62 nt, Homo Sapiens
gggaugucuggcuugccugaagggaguggcucuguaaggacgccuugaugcuuucuucauua

SEQ ID NO: 391776 - RNA, 62 nt, Homo Sapiens
ugcaaaacaaaagaaagugauguggacagaccuguaaggacuaaaaggugccccagaguugc

SEQ ID NO: 391777 - RNA, 62 nt, Homo Sapiens
ggugggagguuuaauuccagugacaucuggaauguaaggagacuuaugacuuuugacuguaa

SEQ ID NO: 391778 - RNA, 62 nt, Homo Sapiens
uaacaauuccaauagaagagaagacauaugaauguaaggaaugugggaaaaucuuggcuccu

SEQ ID NO: 391779 - RNA, 62 nt, Homo Sapiens
agcacauuggauauaaaugcacguccucuggcuguaaggaauguguugaaaccuuucacucu

SEQ ID NO: 391780 - RNA, 62 nt, Homo Sapiens
ugcaaaacacacacuggagagaaaccuaugaauguaaggaaugcaaacaagcauucaauuau

SEQ ID NO: 391781 - RNA, 62 nt, Homo Sapiens
aaaggacucauacgagagagaauccguaugaauguaaggauugugggaaagcauucagcuug

SEQ ID NO: 391782 - RNA, 62 nt, Homo Sapiens
ugguaggacucacuggagagaaacccuaugaguguaaggaaugugggaaagccuucagaucu

SEQ ID NO: 391783 - RNA, 62 nt, Homo Sapiens
guagaacucacacuggagagaaacccuaugaguguaaggaaugugggaaagccuucagaucu

SEQ ID NO: 391784 - RNA, 62 nt, Homo Sapiens
guggcaacgccuucauuuggaaaccuuauaaauguaaggauuugagaaugcacacuggagag

SEQ ID NO: 391785 - RNA, 62 nt, Homo Sapiens
gugggaaagccuuuuauuguaaacccuacaaauguaaggaauaaaggacucauacuggagag

SEQ ID NO: 391786 - RNA, 62 nt, Homo Sapiens
gugggaaacccuucauuuacaaacccuacaaauguaaggaauaaaaggcucauacuggagag

SEQ ID NO: 391787 - RNA, 62 nt, Homo Sapiens
guggaaaagcauugaguucuaagcuaugugaauguaaggaauaaagaacucauaccgcaaag

SEQ ID NO: 391788 - RNA, 62 nt, Homo Sapiens
gcaggaaagcauucucuuggaagccguaugaauguaaggaauaaaggauucacacuggagag

SEQ ID NO: 391789 - RNA, 62 nt, Homo Sapiens
guaggaaguccuucaauucuaaaccauaugauuguaaggaauaaauuucucacacaggacac

SEQ ID NO: 391790 - RNA, 62 nt, Homo Sapiens
guuuaucauuuuauauuuugaaaggauuauuuuguaaggaauaacuuuuaauacuauaguuu

SEQ ID NO: 391791 - RNA, 62 nt, Homo Sapiens
auugucaaauauuaaaagaaagauauucuuccuguaaggaauacaguuuuuagucaaagugg

SEQ ID NO: 391792 - RNA, 64 nt, Homo Sapiens
cuaaggaacucuccaaagccuauuccacauauuuaaaccgcauuaaucauggcaaucaagcccc

SEQ ID NO: 391793 - RNA, 64 nt, Homo Sapiens
uuccuggggcuugugugugagccagcuaggagggaaaccgcagcgggcugcacucgguccagag

SEQ ID NO: 391794 - RNA, 64 nt, Homo Sapiens
cgugaaauucuauugaaaacugaaacagagaaccaaaccgcaaaucugaaaagcaguucauguc

SEQ ID NO: 391795 - RNA, 64 nt, Homo Sapiens
acccaucaccacuucaauagugccuuuauggcugaaaccgcaacuucuugccuacuaugccaga

SEQ ID NO: 391796 - RNA, 64 nt, Homo Sapiens
uggaccuguguagggccucacugcuggagcggggaaaccgcagcucagcccaggcccagcuggg

SEQ ID NO: 391797 - RNA, 64 nt, Homo Sapiens
cuuuuuaaacauugaaaagaaauauggaggcuuuaaaccgcaaacugaaaaagcugaguagaac

SEQ ID NO: 391798 - RNA, 64 nt, Homo Sapiens
uaacucugugacauuuucuucccauaccagauaaaaaccgcauauugguaacuguuucuuguuc

SEQ ID NO: 391799 - RNA, 64 nt, Homo Sapiens
guaaacagagagugaacagccccacacuccacgaaaaccgcaucauacucaaggucuugcauaa

SEQ ID NO: 391800 - RNA, 64 nt, Homo Sapiens
auaacuagagaauacagaugccugaacaaaacuaaaaccgcaugauccucacgaucuuuccuac

SEQ ID NO: 391801 - RNA, 64 nt, Homo Sapiens
ugaaaauauacaugcuguugacccucucuguagaaaaccgcacacauaaaacuuaccaacagau

SEQ ID NO: 391802 - RNA, 64 nt, Homo Sapiens
auucacucccacacccaagaagaaaugcuuuccaaaaccgcaaggguagacugguuuauccacc

SEQ ID NO: 391803 - RNA, 64 nt, Homo Sapiens
uggaacucuuuccucuccccauacaauaaaguaaaaaccgcaguuucugaaggcuuuaaaaaaa

SEQ ID NO: 391804 - RNA, 64 nt, Homo Sapiens
uguaguauuacuaauuggaaagacuaugcaauuaaaaccgcaucuuauuuuucaugauucuaaa

SEQ ID NO: 391805 - RNA, 64 nt, Homo Sapiens
cauaauaaaagacauuguugaagaaauaauuuuaaaaccgcauagccuguguauggagagauuc

SEQ ID NO: 391806 - RNA, 64 nt, Homo Sapiens
cagucugaauacuuucuguuucaaggcacugauaaaaccgcaacaaaaacauguaagaaauaaa

SEQ ID NO: 391807 - RNA, 64 nt, Homo Sapiens
gccucugucgggggcggggcgguagguccgaaagaaaccgcagacacuacgaugcacuccucaa

SEQ ID NO: 391808 - RNA, 64 nt, Homo Sapiens
aaagccccaaaggcucuuuuaagcuggcgugugaaaaccgcaacggcugccaaaaagaaguagg

SEQ ID NO: 391809 - RNA, 64 nt, Homo Sapiens
uucuaggugguagcaaagggaaaggaccaaaaucaaaccgcaauuccacuugacccccggaggg

SEQ ID NO: 391810 - RNA, 64 nt, Homo Sapiens
cucuuacccacacuacgcagacacugcaugcggcaaaccgcaugacacaaucaaaagauuaaca

SEQ ID NO: 391811 - RNA, 64 nt, Homo Sapiens
gccugcccucagggaucuugcauucccaguggucaaaccgcacucacccaugugccaagguggg

SEQ ID NO: 391812 - RNA, 64 nt, Homo Sapiens
uaaaugguauuaguugaccagggcagugaaaaugaaaccgcauuuugggugccauuaaauaggg

SEQ ID NO: 391813 - RNA, 64 nt, Homo Sapiens
caagcauggcccagcccaacugcaugucuaucucaaaccgcagaaaggcuuuaauacuggaaaa

SEQ ID NO: 391814 - RNA, 64 nt, Homo Sapiens
uccaaaccucuaccgucaccuagcugcugagcagaaaccgcaccccgagagaaaaucccauccu

SEQ ID NO: 391815 - RNA, 64 nt, Homo Sapiens
uuuuaaucuacugaacaaauauugggauaacuccaaaccgcaugaaaggguguaauugcagcau

SEQ ID NO: 391816 - RNA, 64 nt, Homo Sapiens
auuuaaagcaaauacaaaacagaacagaggauucaaaccgcaaguaugggagauuuaggcccug

SEQ ID NO: 391817 - RNA, 64 nt, Homo Sapiens
gguggagaaggaaaaaacccuacaaaacaaaaacaaaccgcauacacguucaccgagaaaggga

SEQ ID NO: 391818 - RNA, 64 nt, Homo Sapiens
aauguggcauaaauacugcggcagcauucuucgaaaaccgcauuuucaaauuuauccccguaau

SEQ ID NO: 391819 - RNA, 64 nt, Homo Sapiens
ugagcaggugucacaagcugaugcaagauuaaggaaaccgcagcggaagggcaggggaacagga

SEQ ID NO: 391820 - RNA, 64 nt, Homo Sapiens
acuauucagauggcuacugaaaggauguauucuuaaaccgcaugauuuguaugucagauuauac

SEQ ID NO: 391821 - RNA, 64 nt, Homo Sapiens
uacuuuugcaccagccuaacacuuucaauggcaaaaaccgcaauguaauugugguuuuuccauu

SEQ ID NO: 391822 - RNA, 64 nt, Homo Sapiens
uccuccacagaaacacaaacaauuaaaacaaacaaaaccgcaaccauuggggcagcgugggcca

SEQ ID NO: 391823 - RNA, 64 nt, Homo Sapiens
cuggccuagccuucaaguugaggggcuggaaaauaaaccgcaugggcaaugcucuagguccugu

SEQ ID NO: 391824 - RNA, 62 nt, Homo Sapiens
uuucacacguguuuacacauaaacuacugaaaucaaaccgcacacugcuuugucuccaaaau

SEQ ID NO: 391825 - RNA, 64 nt, Homo Sapiens
cgcuccagauaaccucagggaaccagcacuucccaaaccgcagacuacaucuuuagaggaagca

SEQ ID NO: 391826 - RNA, 64 nt, Homo Sapiens
gcuuuucagauacucugaccaaaaagccugcuuuaaaccgcaagauggggccugggcaugcgca

SEQ ID NO: 391827 - RNA, 64 nt, Homo Sapiens
cagugcaccugccucagcuaacacagaaccaacaaaaccgcauucugccccucuccgaaagaag

SEQ ID NO: 391828 - RNA, 64 nt, Homo Sapiens
caaacgggucgugauggcguggugggccagauccaaaccgcaggacugaggaggcugccuuaug

SEQ ID NO: 391829 - RNA, 64 nt, Homo Sapiens
cguguggauuuuuuuauucauuccugccccaaccaaaccgcauuaccaggaacauaggagugga

SEQ ID NO: 391830 - RNA, 64 nt, Homo Sapiens
ugaucuccaccaccguccuuagccucccacaauuaaaccgcauguugguaaaaaugcugcucuc

SEQ ID NO: 391831 - RNA, 64 nt, Homo Sapiens
cagggucacugugggagcccugggguggagugacaaaccgcauuguccugugcccgccauggca

SEQ ID NO: 391832 - RNA, 64 nt, Homo Sapiens
uuuaacuuugcagaccuuccccuucugacucuggaaaccgcaccaggaggagccccgcuucacc

SEQ ID NO: 391833 - RNA, 64 nt, Homo Sapiens
uguacucccuaaaucuauagauauccauguaacaaaaccgcacuagacuucaccacuacgcaau

SEQ ID NO: 391834 - RNA, 64 nt, Homo Sapiens
cuauggcuuucuagugucucaguuaaacaugaugaaaccgcaugcucaggcaaccacaggugac

SEQ ID NO: 391835 - RNA, 64 nt, Homo Sapiens
agcgauuucuagaccugggcaucuccauugcugaaaaccgcagugccuucagcuaccauugcaa

SEQ ID NO: 391836 - RNA, 64 nt, Homo Sapiens
uugugguuuuugccauaaccuuuaauugcagcaaaaaccgcaauuacuuuugcuccaaccugac

SEQ ID NO: 391837 - RNA, 64 nt, Homo Sapiens
gagaacguggcagcaagcugauacccgccccgccaaaccgcauaucccagcuguaggcuuguaa

SEQ ID NO: 391838 - RNA, 64 nt, Homo Sapiens
ugacaucucgacccaagagaaggggaaguucuagaaaccgcagcucugggcuccugagcauacc

SEQ ID NO: 391839 - RNA, 64 nt, Homo Sapiens
cacaguguguuuuuggaagaugugauugauuuguaaaccgcauuaaaugcucugaaauaaaaug

SEQ ID NO: 391840 - RNA, 64 nt, Homo Sapiens
gcccuucccccgcccccggacggucacagcacccaaaccgcaggcccugcucuggcaggcaggc

SEQ ID NO: 391841 - RNA, 64 nt, Homo Sapiens
aucgcccuuucucagagcagagggccagguauagaaaccgcagugggccugcaagccgcccgag

SEQ ID NO: 391842 - RNA, 64 nt, Homo Sapiens
cacacauuaggguuaguauuacagagcucuuuguaaaccgcaguugaaagcuaucccaggugau

SEQ ID NO: 391843 - RNA, 64 nt, Homo Sapiens
caaugugucauucugcauuggaaggaggacauuuuagagcaaggccuaagggcacagguauuag

SEQ ID NO: 391844 - RNA, 64 nt, Homo Sapiens
uugaucagaauucaaccuuuguucuaacacauacuagagcaagaauuuacuugauuuggaauaa

SEQ ID NO: 391845 - RNA, 64 nt, Homo Sapiens
uggcacagugauagagaauugcuguggagaguuauagagcaaagggauggguccuugaggccug

SEQ ID NO: 391846 - RNA, 64 nt, Homo Sapiens
acuguuuaguugaggcuagucuggaaccuuucauuagagcaauauuugguuauugcacuucauu

SEQ ID NO: 391847 - RNA, 64 nt, Homo Sapiens
auaaaauuuccuuagagacuuuuugaagggaaaauagagcaacagggaaaaaugaaagaaaugu

SEQ ID NO: 391848 - RNA, 64 nt, Homo Sapiens
uuccacuguauguguauuauggcucuuuuccuauuagagcaacuuguguuucccugauaaugug

SEQ ID NO: 391849 - RNA, 64 nt, Homo Sapiens
ccaagaucaugccaucccacucuagcuugggcaauagagcaaggcuccgucucaagaaaagaag

SEQ ID NO: 391850 - RNA, 64 nt, Homo Sapiens
ucuuccucccauuuccgugcuauuaaucacuuguuagagcaacaugacaugcccagcaucccac

SEQ ID NO: 391851 - RNA, 64 nt, Homo Sapiens
ucugaauacaugccacaaggaugaagcuugugaguagagcaaacaaacguuuuuccaaagaauu

SEQ ID NO: 391852 - RNA, 64 nt, Homo Sapiens
ccacaucccacaaaauggcccuugguggcagcaauagagcaaagguuaccuuuuuguaugguga

SEQ ID NO: 391853 - RNA, 64 nt, Homo Sapiens
cccuaucucaaaaaaaaaaauccagccugggugauagagcaagacaaagaucguaccgcugcac

SEQ ID NO: 391854 - RNA, 64 nt, Homo Sapiens
uauacuugauugaaguagcuuggaaucuggaacuuagagcaagcucucuguuguguaauacaga

SEQ ID NO: 391855 - RNA, 64 nt, Homo Sapiens
augaaaaucaguauuucaaauaacuuaaaaaaugcuuuacuacuaaaauguaaaaaauuaaugu

SEQ ID NO: 391856 - RNA, 64 nt, Homo Sapiens
uaauuuucuuacaaaguauuuuucccaaagauagcuuuacuauuucaaaaauugucaaauuaau

SEQ ID NO: 391857 - RNA, 64 nt, Homo Sapiens
aggcaauugaaggaaugguuuaaaaaauaaaaaucuuuacuaauuaaaauuguaucauuggucc

SEQ ID NO: 391858 - RNA, 64 nt, Homo Sapiens
agaacauuucaguauaaaaacuauuuucuaaacacuuuacuagaacugcccacaaugaauguaa

SEQ ID NO: 391859 - RNA, 64 nt, Homo Sapiens
uacauccaguuaccuccacuuucuagaacauauucuuuacuaauguuauugaaaccaauuucua

SEQ ID NO: 391860 - RNA, 64 nt, Homo Sapiens
aguaaaugagauuagcgucuaaugaguagcaccccuuuacuaacuuaguaguaguauaaaauca

SEQ ID NO: 391861 - RNA, 64 nt, Homo Sapiens
ccuuuaguggacaccuagagccacagauucccuucuuuacuaaacaaaucccauggauucugau

SEQ ID NO: 391862 - RNA, 64 nt, Homo Sapiens
uuuuuauauacuuuuucagauuuuuuauaugcuucuuuacuacuuacaucauaaugcacaauuu

SEQ ID NO: 391863 - RNA, 64 nt, Homo Sapiens
uaaaaguuuaucgguaucuuaucuccauuuuuuucuuuacuaucacuggggaaauagaauaaca

SEQ ID NO: 391864 - RNA, 64 nt, Homo Sapiens
ucacuuucuacaaaagucucgaauuauguagugccuuuacuauuguaaguagaguuaggagaaa

SEQ ID NO: 391865 - RNA, 64 nt, Homo Sapiens
gaacauggaugaguggacuucauauuaugacuagcuuuacuauuuuaauucaccuugcauaacu

SEQ ID NO: 391866 - RNA, 64 nt, Homo Sapiens
accacguauguguggaagacauucguacucuuaucuuuacuauaaauaaauucauaaaaguuaa

SEQ ID NO: 391867 - RNA, 64 nt, Homo Sapiens
aaccuaauuucagaucauguggguacucggccaacuuuacuauccgcuuuuuaagacuacugau

SEQ ID NO: 391868 - RNA, 64 nt, Homo Sapiens
uguuuuccauuagaauuagauguacuuugggaugcuuuacuagggaauagaugguaucuucagg

SEQ ID NO: 391869 - RNA, 64 nt, Homo Sapiens
ccuauguauccuaagcauucacggcagugagcuccuuuacuaacauucauguuauggcaagagu

SEQ ID NO: 391870 - RNA, 64 nt, Homo Sapiens
ugaauauaaacagguuauaauacuacccuguucacuuuacuaaauauaaguacaguaaugaugc

SEQ ID NO: 391871 - RNA, 64 nt, Homo Sapiens
uauucuuuacacuuguacaauguauagcacuugccuuuacuagaccuugaagaacuaaaugaag

SEQ ID NO: 391872 - RNA, 64 nt, Homo Sapiens
gaguaaacuacaauauauuuuggaaaaagaaauacuuuacuauuugagauggaaaacugaaauu

SEQ ID NO: 391873 - RNA, 64 nt, Homo Sapiens
cgcacauuuaagcaucuuugaauaucagugaaugcuuuacuauuaguccuauucagauacauca

SEQ ID NO: 391874 - RNA, 64 nt, Homo Sapiens
aauacaaaaaaaauuagccgcggugaaaccccgucuuuacuaaacgagaccauccuggcuaaca

SEQ ID NO: 391875 - RNA, 64 nt, Homo Sapiens
ggaaaacuugcaguuacgaagacuggcaacuuggcuuuacuaaguuuucagacuggcaggaagu

SEQ ID NO: 391876 - RNA, 64 nt, Homo Sapiens
acucugauuuccgugggggaaugucauggucuugcuuuacuaaguuuugagacuggcagguagu

SEQ ID NO: 391877 - RNA, 64 nt, Homo Sapiens
agagaaucaccuucuuucgcuuuuuuuuuuuuuuuugagguagagucucacuauguugcccaga

SEQ ID NO: 391878 - RNA, 64 nt, Homo Sapiens
accaugaaaaccacauagcugaccagggcugugcuugagguacagaggacacacauuguagaca

SEQ ID NO: 391879 - RNA, 64 nt, Homo Sapiens
cccggacuguggggccccaccuguugcuuaccuuuugagguaauuuugcaaaugugguuuuuuu

SEQ ID NO: 391880 - RNA, 64 nt, Homo Sapiens
agggauaaauugcuuacauuucaaccucuggagauugagguaacuuuuugugucugggucuugu

SEQ ID NO: 391881 - RNA, 64 nt, Homo Sapiens
ggcaaagcccaccauuaggugaggcggucccgaguugagguagaguggggcagaggaagauggc

SEQ ID NO: 391882 - RNA, 64 nt, Homo Sapiens
aacuucuaacagccaguacacacacuguuucauuuugagguaacguucaguuuugcauuuuguu

SEQ ID NO: 391883 - RNA, 64 nt, Homo Sapiens; identical to SEQ ID NO: 84166

SEQ ID NO: 391884 - RNA, 64 nt, Homo Sapiens; identical to SEQ ID NO: 84167

SEQ ID NO: 391885 - RNA, 64 nt, Homo Sapiens; identical to SEQ ID NO: 84168

SEQ ID NO: 391886 - RNA, 64 nt, Homo Sapiens; identical to SEQ ID NO: 84169

SEQ ID NO: 391887 - RNA, 64 nt, Homo Sapiens; identical to SEQ ID NO: 84170

SEQ ID NO: 391888 - RNA, 64 nt, Homo Sapiens; identical to SEQ ID NO: 84171

SEQ ID NO: 391889 - RNA, 64 nt, Homo Sapiens; identical to SEQ ID NO: 84172

SEQ ID NO: 391890 - RNA, 64 nt, Homo Sapiens; identical to SEQ ID NO: 84173

SEQ ID NO: 391891 - RNA, 64 nt, Homo Sapiens; identical to SEQ ID NO: 84174

SEQ ID NO: 391892 - RNA, 64 nt, Homo Sapiens; identical to SEQ ID NO: 84175

SEQ ID NO: 391893 - RNA, 64 nt, Homo Sapiens; identical to SEQ ID NO: 84176

SEQ ID NO: 391894 - RNA, 64 nt, Homo Sapiens; identical to SEQ ID NO: 84177

SEQ ID NO: 391895 - RNA, 64 nt, Homo Sapiens; identical to SEQ ID NO: 84178

SEQ ID NO: 391896 - RNA, 64 nt, Homo Sapiens; identical to SEQ ID NO: 84179

SEQ ID NO: 391897 - RNA, 64 nt, Homo Sapiens; identical to SEQ ID NO: 84180

SEQ ID NO: 391898 - RNA, 64 nt, Homo Sapiens; identical to SEQ ID NO: 84181

SEQ ID NO: 391899 - RNA, 64 nt, Homo Sapiens; identical to SEQ ID NO: 84182

SEQ ID NO: 391900 - RNA, 64 nt, Homo Sapiens; identical to SEQ ID NO: 84183

SEQ ID NO: 391901 - RNA, 64 nt, Homo Sapiens; identical to SEQ ID NO: 84184

SEQ ID NO: 391902 - RNA, 64 nt, Homo Sapiens; identical to SEQ ID NO: 84185

SEQ ID NO: 391903 - RNA, 64 nt, Homo Sapiens; identical to SEQ ID NO: 84186

SEQ ID NO: 391904 - RNA, 64 nt, Homo Sapiens; identical to SEQ ID NO: 84187

SEQ ID NO: 391905 - RNA, 64 nt, Homo Sapiens; identical to SEQ ID NO: 84188

SEQ ID NO: 391906 - RNA, 64 nt, Homo Sapiens; identical to SEQ ID NO: 84189

SEQ ID NO: 391907 - RNA, 64 nt, Homo Sapiens; identical to SEQ ID NO: 84190

SEQ ID NO: 391908 - RNA, 64 nt, Homo Sapiens; identical to SEQ ID NO: 84191

SEQ ID NO: 391909 - RNA, 64 nt, Homo Sapiens; identical to SEQ ID NO: 84192

SEQ ID NO: 391910 - RNA, 64 nt, Homo Sapiens; identical to SEQ ID NO: 84193

SEQ ID NO: 391911 - RNA, 64 nt, Homo Sapiens; identical to SEQ ID NO: 84194

SEQ ID NO: 391912 - RNA, 64 nt, Homo Sapiens; identical to SEQ ID NO: 84195

SEQ ID NO: 391913 - RNA, 64 nt, Homo Sapiens; identical to SEQ ID NO: 84196

SEQ ID NO: 391914 - RNA, 64 nt, Homo Sapiens; identical to SEQ ID NO: 84197

SEQ ID NO: 391915 - RNA, 64 nt, Homo Sapiens; identical to SEQ ID NO: 84198

SEQ ID NO: 391916 - RNA, 64 nt, Homo Sapiens; identical to SEQ ID NO: 84199

SEQ ID NO: 391917 - RNA, 64 nt, Homo Sapiens; identical to SEQ ID NO: 84200

SEQ ID NO: 391918 - RNA, 64 nt, Homo Sapiens; identical to SEQ ID NO: 84201

SEQ ID NO: 391919 - RNA, 64 nt, Homo Sapiens; identical to SEQ ID NO: 84202

SEQ ID NO: 391920 - RNA, 64 nt, Homo Sapiens; identical to SEQ ID NO: 84203

SEQ ID NO: 391921 - RNA, 64 nt, Homo Sapiens; identical to SEQ ID NO: 84204

SEQ ID NO: 391922 - RNA, 64 nt, Homo Sapiens; identical to SEQ ID NO: 84205

SEQ ID NO: 391923 - RNA, 64 nt, Homo Sapiens; identical to SEQ ID NO: 84206

SEQ ID NO: 391924 - RNA, 64 nt, Homo Sapiens; identical to SEQ ID NO: 84207

SEQ ID NO: 391925 - RNA, 64 nt, Homo Sapiens; identical to SEQ ID NO: 84208

SEQ ID NO: 391926 - RNA, 64 nt, Homo Sapiens; identical to SEQ ID NO: 84209

SEQ ID NO: 391927 - RNA, 64 nt, Homo Sapiens; identical to SEQ ID NO: 84210

SEQ ID NO: 391928 - RNA, 64 nt, Homo Sapiens; identical to SEQ ID NO: 84211

SEQ ID NO: 391929 - RNA, 64 nt, Homo Sapiens; identical to SEQ ID NO: 84212

SEQ ID NO: 391930 - RNA, 64 nt, Homo Sapiens; identical to SEQ ID NO: 84213

SEQ ID NO: 391931 - RNA, 64 nt, Homo Sapiens; identical to SEQ ID NO: 84214

SEQ ID NO: 391932 - RNA, 64 nt, Homo Sapiens; identical to SEQ ID NO: 84215

SEQ ID NO: 391933 - RNA, 64 nt, Homo Sapiens; identical to SEQ ID NO: 84216

SEQ ID NO: 391934 - RNA, 64 nt, Homo Sapiens; identical to SEQ ID NO: 84217

SEQ ID NO: 391935 - RNA, 64 nt, Homo Sapiens; identical to SEQ ID NO: 84218

SEQ ID NO: 391936 - RNA, 64 nt, Homo Sapiens; identical to SEQ ID NO: 84219

SEQ ID NO: 391937 - RNA, 64 nt, Homo Sapiens; identical to SEQ ID NO: 84220

SEQ ID NO: 391938 - RNA, 64 nt, Homo Sapiens; identical to SEQ ID NO: 84221

SEQ ID NO: 391939 - RNA, 64 nt, Homo Sapiens; identical to SEQ ID NO: 84222

SEQ ID NO: 391940 - RNA, 64 nt, Homo Sapiens; identical to SEQ ID NO: 84223

SEQ ID NO: 391941 - RNA, 64 nt, Homo Sapiens; identical to SEQ ID NO: 84224

SEQ ID NO: 391942 - RNA, 64 nt, Homo Sapiens; identical to SEQ ID NO: 84225

SEQ ID NO: 391943 - RNA, 64 nt, Homo Sapiens; identical to SEQ ID NO: 84226

SEQ ID NO: 391944 - RNA, 64 nt, Homo Sapiens; identical to SEQ ID NO: 84227

SEQ ID NO: 391945 - RNA, 64 nt, Homo Sapiens; identical to SEQ ID NO: 84228

SEQ ID NO: 391946 - RNA, 64 nt, Homo Sapiens; identical to SEQ ID NO: 84229

SEQ ID NO: 391947 - RNA, 64 nt, Homo Sapiens; identical to SEQ ID NO: 84230

SEQ ID NO: 391948 - RNA, 64 nt, Homo Sapiens; identical to SEQ ID NO: 84231

SEQ ID NO: 391949 - RNA, 64 nt, Homo Sapiens; identical to SEQ ID NO: 84232

SEQ ID NO: 391950 - RNA, 64 nt, Homo Sapiens; identical to SEQ ID NO: 84233

SEQ ID NO: 391951 - RNA, 60 nt, Homo Sapiens
gcgucccuacugccucccgacuccucaguggaggaggagcugcggucccucuggugucug

SEQ ID NO: 391952 - RNA, 60 nt, Homo Sapiens
aaucccauggcgagaugggggcucacuccggaggaggagccaggcagcagggccuuccug

SEQ ID NO: 391953 - RNA, 60 nt, Homo Sapiens
gagguuccaaccuggagccacagugugugagaggaggaggagagggagaauucuguucuc

SEQ ID NO: 391954 - RNA, 60 nt, Homo Sapiens
guuccaaccuggagccacagugugugagaggaggaggagagggagaauucuguucuccca

SEQ ID NO: 391955 - RNA, 60 nt, Homo Sapiens
uggauaggcaguagauauuuuugcccaccugaggaggaacucagucaagcuguugcuuaa

SEQ ID NO: 391956 - RNA, 60 nt, Homo Sapiens
uguucuuuccagagcuaacugauaagaguggaggaggaaugccuucuccuaagagucagu

SEQ ID NO: 391957 - RNA, 60 nt, Homo Sapiens
uacauggggaacugcauaucggaggugguggaggaggaggaggaggaggaaggcaaagcc

SEQ ID NO: 391958 - RNA, 60 nt, Homo Sapiens
auggggaacugcauaucggaggugguggaggaggaggaggaggaggaaggcaaagccccu

SEQ ID NO: 391959 - RNA, 60 nt, Homo Sapiens
gggaacugcauaucggaggugguggaggaggaggaggaggaggaaggcaaagccccugga

SEQ ID NO: 391960 - RNA, 60 nt, Homo Sapiens
aacugcauaucggaggugguggaggaggaggaggaggaggaaggcaaagccccuggaaau

SEQ ID NO: 391961 - RNA, 60 nt, Homo Sapiens
ugcauaucggaggugguggaggaggaggaggaggaggaaggcaaagccccuggaaaugug

SEQ ID NO: 391962 - RNA, 60 nt, Homo Sapiens
agcuucaugacccacccugaauucgccauagaggaggaguugccacgaacaccacuccug

SEQ ID NO: 391963 - RNA, 60 nt, Homo Sapiens
uugccacgaacaccacuccuggaugaggaagaggaggaaaauccugacaaggcuucuaag

SEQ ID NO: 391964 - RNA, 60 nt, Homo Sapiens
uuaggacagauucucagaugggaugaucuggaggaggaggaaaaagauacacucccuugg

SEQ ID NO: 391965 - RNA, 60 nt, Homo Sapiens
ggacagauucucagaugggaugaucuggaggaggaggaaaaagauacacucccuuggggc

SEQ ID NO: 391966 - RNA, 60 nt, Homo Sapiens
gcgaggacaguggcacuucaggaggaggaggaggaggaagcaggaggaggaagaggagga

SEQ ID NO: 391967 - RNA, 60 nt, Homo Sapiens
aaggcgaggacaguggcacuggaggaggaggaggaggagggagcaggaggaggaagagga

SEQ ID NO: 391968 - RNA, 60 nt, Homo Sapiens
aggaaggcgaggacaguggcggaggaggaggaggaggagggaugagcaggaggaggaaga

SEQ ID NO: 391969 - RNA, 60 nt, Homo Sapiens
aggaggaaggcgaggacaguagaggaggaggaggaggagggaggaugagcaggaggagga

SEQ ID NO: 391970 - RNA, 60 nt, Homo Sapiens
aggaggaggaaggcgaggacggaagaggaggaggaggagggaggaggaugagcaggagga

SEQ ID NO: 391971 - RNA, 60 nt, Homo Sapiens
aggaggaggaggaaggcgagggaggaagaggaggaggagggaggaggaggaugagcagga

SEQ ID NO: 391972 - RNA, 60 nt, Homo Sapiens
aggaggaggaggaggaaggcggaggaggaagaggaggagggaagaggaggaggaugagca

SEQ ID NO: 391973 - RNA, 60 nt, Homo Sapiens
aggaggaggaggaggaggagggaugagcaggaggaggaagcagagccuggaagaggagga

SEQ ID NO: 391974 - RNA, 60 nt, Homo Sapiens
agcaggaggaggaagaggagccuggaagaggaggaggaugagucagcagccccugcagag

SEQ ID NO: 391975 - RNA, 60 nt, Homo Sapiens
augagcaggaggaggaagaggagccuggaagaggaggaggggcagucagcagccccugca

SEQ ID NO: 391976 - RNA, 60 nt, Homo Sapiens
aggcucugggcuccucugcaggaggaggaggaggaggagagggagacagaugaggcgaga

SEQ ID NO: 391977 - RNA, 60 nt, Homo Sapiens
agaaggcucugggcuccucuagaggaggaggaggaggagggccgggagacagaugaggcg

SEQ ID NO: 391978 - RNA, 60 nt, Homo Sapiens
aggagaaggcucugggcuccgcgagaggaggaggaggaggcaggccgggagacagaugag

SEQ ID NO: 391979 - RNA, 60 nt, Homo Sapiens
aggaggagaaggcucugggcgaggcgagaggaggaggagguaucaggccgggagacagau

SEQ ID NO: 391980 - RNA, 60 nt, Homo Sapiens
aggaggaggagaaggcucuggaugaggcgagaggaggaggugguaucaggccgggagaca

SEQ ID NO: 391981 - RNA, 60 nt, Homo Sapiens
aggaggcgagggaaucagaaaagcagcccugaggaggaagacacugaccuucugcuggga

SEQ ID NO: 391982 - RNA, 60 nt, Homo Sapiens
cagaagauggcgucagcuucggaggaggaugaggaggacagaccuugcagaggacgaaga

SEQ ID NO: 391983 - RNA, 60 nt, Homo Sapiens
aggaggacacagaagauggcggacgaagaggaggaggauguggaagaaggaccuugcaga

SEQ ID NO: 391984 - RNA, 60 nt, Homo Sapiens
augaggaggacacagaagauagaggacgaagaggaggaggagauggaagaaggaccuugc

SEQ ID NO: 391985 - RNA, 60 nt, Homo Sapiens
cagguggucuaagugcugacuuuauagggggaggaggaggaggaggaggggagugguggg

SEQ ID NO: 391986 - RNA, 60 nt, Homo Sapiens
uuuagauuuagugaagauggggaagcuauggaggaggacucaacaaacaaacuuuguuug

SEQ ID NO: 391987 - RNA, 60 nt, Homo Sapiens
ucuuggauguaagggaugaggcaucaagaggaggaggacaagcaagaagaaaagacagca

SEQ ID NO: 391988 - RNA, 60 nt, Homo Sapiens
acaucuuggauguaagggaugcagcaucaagaggaggaggaaaagcaagaagaaaagaca

SEQ ID NO: 391989 - RNA, 60 nt, Homo Sapiens
ugaaccuagaagauagaggugcaacaggaggaggaggacuagccgaagaaagaagaggca

SEQ ID NO: 391990 - RNA, 60 nt, Homo Sapiens
acuugaaccuagaagauagagcagcaacaggaggaggaggugcagccgaagaaagaagag

SEQ ID NO: 391991 - RNA, 60 nt, Homo Sapiens
aagcuacagcaucugaaagggaggcagaaagaggaggaagaaaaaaaagaaaaagaaaag

SEQ ID NO: 391992 - RNA, 60 nt, Homo Sapiens
uggggcccacucaacacaccagacccaugggaggaggaggagcaaacacgugggugcaga

SEQ ID NO: 391993 - RNA, 60 nt, Homo Sapiens
gggugagaacaccuuuccucacaaguggaggaggaggaggcucagccaccccguggugua

SEQ ID NO: 391994 - RNA, 60 nt, Homo Sapiens
agggggugagaacaccuuucguaacaaguggaggaggaggcuucucagccaccccguggu

SEQ ID NO: 391995 - RNA, 60 nt, Homo Sapiens
aauggguucaagaucaucaugaccgugcuugaggaggaaguguugccaucagaggaggau

SEQ ID NO: 391996 - RNA, 60 nt, Homo Sapiens
accgugcuugaggaggaagaguugccaucagaggaggaugccuuucccagagguucugcu

SEQ ID NO: 391997 - RNA, 60 nt, Homo Sapiens
gccugccguuccaacuugccggggcaagaggaggaggagacgcaggacucggucaaggga

SEQ ID NO: 391998 - RNA, 60 nt, Homo Sapiens
agagccugccguuccaacuuggaggggcaagaggaggagggggcgcaggacucggucaag

SEQ ID NO: 391999 - RNA, 60 nt, Homo Sapiens
aagagguuucuguaaccccugcccuggugugaggaggaaauggcucuggccuggcugccu

SEQ ID NO: 392000 - RNA, 60 nt, Homo Sapiens
caagcuggaacuuggguggggaggggacaugaggaggauaaacagcugacuguggcuuca

SEQ ID NO: 392001 - RNA, 60 nt, Homo Sapiens
ucccagcuccaggaaggggaguucuggguggaggaggaggaguuccucagggaguuugac

SEQ ID NO: 392002 - RNA, 60 nt, Homo Sapiens
cagcuccaggaaggggaguucuggguggaggaggaggaguuccucagggaguuugacgag

SEQ ID NO: 392003 - RNA, 60 nt, Homo Sapiens
aaggcugguggacagacccacaggagccuagaggaggaaaccucuggccugggaaaaggg

SEQ ID NO: 392004 - RNA, 60 nt, Homo Sapiens
uaacauagaugccugggccuuacaguucuggaggaggagguugaccuuugccaaacacuu

SEQ ID NO: 392005 - RNA, 60 nt, Homo Sapiens
cacuggcagccuccacuagaauuuggugaagaggaggaggaggagauugaugacaagcaa

SEQ ID NO: 392006 - RNA, 60 nt, Homo Sapiens
uggcagccuccacuagaauuuggugaagaggaggaggaggagauugaugacaagcaaguu

SEQ ID NO: 392007 - RNA, 60 nt, Homo Sapiens
cagccuccacuagaauuuggugaagaggaggaggaggagauugaugacaagcaaguuacu

SEQ ID NO: 392008 - RNA, 60 nt, Homo Sapiens
aaacccuugaaaagacaucaagcacagaaggaggaggaggagguuuaggucaagaagaag

SEQ ID NO: 392009 - RNA, 60 nt, Homo Sapiens
cccuugaaaagacaucaagcacagaaggaggaggaggagguuuaggucaagaagaagaug

SEQ ID NO: 392010 - RNA, 60 nt, Homo Sapiens
gcacgccuguccucccccggggccaaggcagaggaggaggacgacauccugaccugcugc

SEQ ID NO: 392011 - RNA, 60 nt, Homo Sapiens
cgccuguccucccccggggccaaggcagaggaggaggacgacauccugaccugcugcuga

SEQ ID NO: 392012 - RNA, 52 nt, Homo Sapiens; identical to SEQ ID NO: 133611

SEQ ID NO: 392013 - RNA, 55 nt, Homo Sapiens; identical to SEQ ID NO: 133612

SEQ ID NO: 392014 - RNA, 60 nt, Homo Sapiens
uggaaaccugggguggguugccugagugaggaggaggagcccucccucaccgcgcaggac

SEQ ID NO: 392015 - RNA, 60 nt, Homo Sapiens
agcuggaaaccugggguggggacccugagugaggaggaggacaccucccucaccgcgcag

SEQ ID NO: 392016 - RNA, 60 nt, Homo Sapiens
caaagaaucacaaggaaccuaggaagaggagaggaggaaggaaguuccuuagcagggagg

SEQ ID NO: 392017 - RNA, 60 nt, Homo Sapiens
aggagaggaggaagcaaagaccuuagcagggaggaggaaguuuguaccccuggagaaguu

SEQ ID NO: 392018 - RNA, 60 nt, Homo Sapiens
cuggaggccaggacacuguuguuuucuggggaggaggaggugagaacaggcuuggaaaag

SEQ ID NO: 392019 - RNA, 60 nt, Homo Sapiens
aagacacagagacaaggugaccaggcccuggaggaggaugguugccuuagagcgcaaggg

SEQ ID NO: 392020 - RNA, 60 nt, Homo Sapiens
ucccugggccagggucugugugcuucauaugaggaggaugcaguacagcaugugccuuaa

SEQ ID NO: 392021 - RNA, 60 nt, Homo Sapiens
accuccgccagauccugcaggcagcgggaggaggaggagccauaacuuccuacguauccu

SEQ ID NO: 392022 - RNA, 60 nt, Homo Sapiens
agcaccuccgccagauccugccugcagcgggaggaggaggcuacauaacuuccuacguau

SEQ ID NO: 392023 - RNA, 60 nt, Homo Sapiens
acaagauccucagcaacgaaaaaacgaagggaggaggagcccucugggaaguuacucuag

SEQ ID NO: 392024 - RNA, 60 nt, Homo Sapiens
ggaugggggcugaagagcagcagaggaggagaggaggaaagggaggucagcuggucaagg

SEQ ID NO: 392025 - RNA, 60 nt, Homo Sapiens
ggaggaaaggaugggggcugggucaaggcagaggaggagaugucugcugggaggucagcu

SEQ ID NO: 392026 - RNA, 60 nt, Homo Sapiens
aaaugaaaaguuguucccagcagaggggaggaggaggacuguuucucaggcuggggagca

SEQ ID NO: 392027 - RNA, 60 nt, Homo Sapiens
acuaaaugaaaaguuguuccgcacagaggggaggaggaggccaguuucucaggcugggga

SEQ ID NO: 392028 - RNA, 60 nt, Homo Sapiens
agggggugcugcguggaaggaggggcugaggaggaggagccuuaggagucagagcccggc

SEQ ID NO: 392029 - RNA, 60 nt, Homo Sapiens
agcagggggugcugcguggaggcaggggcugaggaggaggugacuuaggagucagagccc

SEQ ID NO: 392030 - RNA, 60 nt, Homo Sapiens
auguggaagagguaaaaagcacuuauggaggaggaggagauuaguuaaauaauuccaucc

SEQ ID NO: 392031 - RNA, 60 nt, Homo Sapiens
agaauguggaagagguaaaauccacuuauggaggaggaggaacuuaguuaaauaauucca

SEQ ID NO: 392032 - RNA, 60 nt, Homo Sapiens
gcuugacuuugagcuaaggcugaaguacaggaggaggaggaggagagggccggauguggg

SEQ ID NO: 392033 - RNA, 60 nt, Homo Sapiens
ugacuuugagcuaaggcugaaguacaggaggaggaggaggagagggccggaugugggugu

SEQ ID NO: 392034 - RNA, 60 nt, Homo Sapiens
cuuugagcuaaggcugaaguacaggaggaggaggaggagagggccggaugugggugugga

SEQ ID NO: 392035 - RNA, 60 nt, Homo Sapiens
cccacugcaggacccacuuugagaaggaccgaggaggaggauuuggguuguuuuguuagg

SEQ ID NO: 392036 - RNA, 60 nt, Homo Sapiens
acugcaggacccacuuugagaaggaccgaggaggaggauuuggguuguuuuguuaggggu

SEQ ID NO: 392037 - RNA, 60 nt, Homo Sapiens
gugcugaaagucagcccacgucggagcggugaggaggagccacagcacauggggugccac

SEQ ID NO: 392038 - RNA, 60 nt, Homo Sapiens
agaguguucucagcuagauuugauuugguugaggaggaacuguggcccuccguaaguuau

SEQ ID NO: 392039 - RNA, 60 nt, Homo Sapiens
gcgcgagugagcaggggccaggagaaggaggaggaggagaagcucaagcagugaggagga

SEQ ID NO: 392040 - RNA, 60 nt, Homo Sapiens
agagcgcgagugagcaggggggaggagaaggaggaggagguggagcucaagcagugagga

SEQ ID NO: 392041 - RNA, 51 nt, Homo Sapiens; identical to SEQ ID NO: 133640

SEQ ID NO: 392042 - RNA, 60 nt, Homo Sapiens
cuccaauugacccgccugggaacaagggaugaggaggaguugggggcuggggggaauccu

SEQ ID NO: 392043 - RNA, 60 nt, Homo Sapiens
aagcugcuuagaaggcccuggaagggaagugaggaggagggacaaggaagaugacuaguu

SEQ ID NO: 392044 - RNA, 60 nt, Homo Sapiens
gggaaggcuggcagguagguuuguugggaggaggaggaaaggacagaagggcccauguac

SEQ ID NO: 392045 - RNA, 60 nt, Homo Sapiens
aaagggaaggcuggcagguauacuuguugggaggaggagguggggacagaagggcccaug

SEQ ID NO: 392046 - RNA, 60 nt, Homo Sapiens
ggacccacucugcccagccggagggacgcggaggaggaagaggguagacaggggcgaccu

SEQ ID NO: 392047 - RNA, 60 nt, Homo Sapiens
ccucuuuuccccuugcccccucugcagccggaggaggagauguugaggggaggaggccag

SEQ ID NO: 392048 - RNA, 60 nt, Homo Sapiens
gcgcagcagcgggagcuaggggcgggggcggaggaggacacgaacuggaaggggguucac

SEQ ID NO: 392049 - RNA, 60 nt, Homo Sapiens
gccuuuggcgagagcuccacggaaagugaugaggaggaagaagagggcuguggucauaca

SEQ ID NO: 392050 - RNA, 60 nt, Homo Sapiens
cucucuucugccugauagagggaagaggaagaggaggacgaacagagauccugaaauucu

SEQ ID NO: 392051 - RNA, 60 nt, Homo Sapiens
ucugucucaauuaauuuuuuuuuuuuaaaggaggaggaucuccauggguaagugguuucu

SEQ ID NO: 392052 - RNA, 60 nt, Homo Sapiens
gcagagaagugaugaagggaaauguucuuagaggaggaaauauccuuuguccuguucaga

SEQ ID NO: 392053 - RNA, 60 nt, Homo Sapiens
gcuggagggaggcugggcggguacagcgcggaggaggagggaggccaggcgggcauggcg

SEQ ID NO: 392054 - RNA, 60 nt, Homo Sapiens
ggaggagggaggccaggcgggcauggcguggaggaggagggaggccgggcggucacagca

SEQ ID NO: 392055 - RNA, 60 nt, Homo Sapiens
ggaggagggaggccgggcggucacagcauggaggaggagggaggcgcugcugguguucuu

SEQ ID NO: 392056 - RNA, 60 nt, Homo Sapiens
ccgggugccuguuugguggcgcagccugaggaggaggaggcccacagcucuccucccagg

SEQ ID NO: 392057 - RNA, 60 nt, Homo Sapiens
aggccgggugccuguuugguagggcagccugaggaggaggggucccacagcucuccuccc

SEQ ID NO: 392058 - RNA, 60 nt, Homo Sapiens
cagcucccucgcuccaguggugccccagaggaggaggaaugccacguuuacaggaaggug

SEQ ID NO: 392059 - RNA, 60 nt, Homo Sapiens
aaucagcucccucgcuccaggugugccccagaggaggaggccagccacguuuacaggaag

SEQ ID NO: 392060 - RNA, 60 nt, Homo Sapiens
uccaccccaugggcccacacccaggugggggaggaggaagccacugcaucuguuggcuca

SEQ ID NO: 392061 - RNA, 60 nt, Homo Sapiens
aucugucugugggagcccagaggcugcagggaggaggaggagggagguaucuggugugag

SEQ ID NO: 392062 - RNA, 60 nt, Homo Sapiens
ugucugugggagcccagaggcugcagggaggaggaggagggagguaucuggugugagcgu

SEQ ID NO: 392063 - RNA, 60 nt, Homo Sapiens
gcccaggcaggcggccuauccugauccuuggaggaggaggaagaggaggccacuguggcc

SEQ ID NO: 392064 - RNA, 60 nt, Homo Sapiens
caggcaggcggccuauccugauccuuggaggaggaggaagaggaggccacuguggcccgu

SEQ ID NO: 392065 - RNA, 60 nt, Homo Sapiens
cuguagugaagaggucugacaccauguguggaggaggaggaacgaucagucaagagaugu

SEQ ID NO: 392066 - RNA, 60 nt, Homo Sapiens
uagugaagaggucugacaccauguguggaggaggaggaacgaucagucaagagauguccu

SEQ ID NO: 392067 - RNA, 60 nt, Homo Sapiens
ggggaggagggggaggaagacaagaaggaagaggaggaggagaaggaagacgaggagcug

SEQ ID NO: 392068 - RNA, 60 nt, Homo Sapiens
gaggagggggaggaagacaagaaggaagaggaggaggagaaggaagacgaggagcuggac

SEQ ID NO: 392069 - RNA, 60 nt, Homo Sapiens
aaagggaagaauuagguuuggguugggugggaggaggaagcucaucuugagaagcaggcg

SEQ ID NO: 392070 - RNA, 60 nt, Homo Sapiens
aaagggaagaauuagguuuggguugggugggaggaggaaguugccacugagaagcaggcg

SEQ ID NO: 392071 - RNA, 60 nt, Homo Sapiens
aaagaugaggauugcauacagaaugacagagaggaggaaacuaaauuuuaaugaacgaau

SEQ ID NO: 392072 - RNA, 60 nt, Homo Sapiens
ugcuagagaacagcaggucuagucuacauggaggaggaaauuaaguggauugaauaacug

SEQ ID NO: 392073 - RNA, 60 nt, Homo Sapiens
uugguggguuucauacacccucucaaggcagaggaggagugcacauuucugaccgaaccc

SEQ ID NO: 392074 - RNA, 60 nt, Homo Sapiens
uguuuauugucacugggaauacauugaagagaggaggauuguuaacuggcuuuacaguaa

SEQ ID NO: 392075 - RNA, 60 nt, Homo Sapiens
guaccuucccaagcccgcccagugggaugggaggaggaggagaaggggggccuugggccg

SEQ ID NO: 392076 - RNA, 60 nt, Homo Sapiens
ccuucccaagcccgcccagugggaugggaggaggaggagaaggggggccuugggccgcug

SEQ ID NO: 392077 - RNA, 60 nt, Homo Sapiens
gagcucugcuggcaugagccgcgccugcuggaggaggagauuuuagccugcccuugcaug

SEQ ID NO: 392078 - RNA, 50 nt, Homo Sapiens; identical to SEQ ID NO: 133677

SEQ ID NO: 392079 - RNA, 60 nt, Homo Sapiens
gcccuucagguuugcugaaauuggggaaaggaggaggagaucccuuacagaccugguagu

SEQ ID NO: 392080 - RNA, 60 nt, Homo Sapiens
cagguacccucuaugccaauacaggccuuggaggaggagguggcuuccaacuggagacuc

SEQ ID NO: 392081 - RNA, 60 nt, Homo Sapiens
agaaaagagaagaaggagaaggagaugaaggaggaggaggaggagaaggagaagaagaag

SEQ ID NO: 392082 - RNA, 60 nt, Homo Sapiens
aaagagaagaaggagaaggagaugaaggaggaggaggaggagaaggagaagaagaagaag

SEQ ID NO: 392083 - RNA, 60 nt, Homo Sapiens
gagaagaaggagaaggagaugaaggaggaggaggaggagaaggagaagaagaagaagaag

SEQ ID NO: 392084 - RNA, 60 nt, Homo Sapiens
acagaagaagaggaugaggaugagauggaagaggaggaggaggaggagcuggaggaggag

SEQ ID NO: 392085 - RNA, 60 nt, Homo Sapiens
gaagaagaggaugaggaugagauggaagaggaggaggaggaggagcuggaggaggagguc

SEQ ID NO: 392086 - RNA, 60 nt, Homo Sapiens
gaagaggaugaggaugagauggaagaggaggaggaggaggagcuggaggaggaggucgac

SEQ ID NO: 392087 - RNA, 60 nt, Homo Sapiens
gaggaugaggaugagauggaagaggaggaggaggaggagcuggaggaggaggucgacgag

SEQ ID NO: 392088 - RNA, 60 nt, Homo Sapiens
gagauggaagaggaggaggaggaggagcuggaggaggaggucgacgagcugcagacgaca

SEQ ID NO: 392089 - RNA, 60 nt, Homo Sapiens
cagcccuggaggaacuggggcuccuggaaggaggaggaggcucuccacuguccacccuaa

SEQ ID NO: 392090 - RNA, 60 nt, Homo Sapiens
ggacgaguucauggggaucugggggguggggaggaggaagccguugaaucugggagggaa

SEQ ID NO: 392091 - RNA, 60 nt, Homo Sapiens
uuagcucuguggaauucagugacaaaaugggaggaggaaagagaguuuguaaggucaugc

SEQ ID NO: 392092 - RNA, 60 nt, Homo Sapiens
gugccacccucagagaagaagaaaggagcugaggaggagaagccaaagaggaggaggcag

SEQ ID NO: 392093 - RNA, 60 nt, Homo Sapiens
gaagaaaggagcugaggaggagaagccaaagaggaggaggcaggagaagcaggcagccug

SEQ ID NO: 392094 - RNA, 60 nt, Homo Sapiens
accagcaacucgagagcugggaaacucaaggaggaggaagaaaaucaaaaccacccuacu

SEQ ID NO: 392095 - RNA, 60 nt, Homo Sapiens
acucccuggggugaggaaagaacaggaggggaggaggaggagugugcucugcacuugccu

SEQ ID NO: 392096 - RNA, 60 nt, Homo Sapiens
cccuggggugaggaaagaacaggaggggaggaggaggagugugcucugcacuugccuugc

SEQ ID NO: 392097 - RNA, 60 nt, Homo Sapiens
gggcucuccacagccccaucaaagaacagagaggaggaggagggagaaauggccaccaca

SEQ ID NO: 392098 - RNA, 60 nt, Homo Sapiens
cucuccacagccccaucaaagaacagagaggaggaggagggagaaauggccaccacauca

SEQ ID NO: 392099 - RNA, 60 nt, Homo Sapiens
agcgacuauuacgacccgucagagccgacggaggaggaggagccuuccaaacagagaggu

SEQ ID NO: 392100 - RNA, 60 nt, Homo Sapiens
gacuauuacgacccgucagagccgacggaggaggaggagccuuccaaacagagaggugag

SEQ ID NO: 392101 - RNA, 60 nt, Homo Sapiens
gcacagcccucagcaucaaccgauggggaugaggaggagaagugaggggccccgccagcc

SEQ ID NO: 392102 - RNA, 60 nt, Homo Sapiens
ccucccugucggagagugagggcugccgucgaggaggacagggcggaagcgggagcgcaa

SEQ ID NO: 392103 - RNA, 60 nt, Homo Sapiens
cagggccaaaggaauccucauucgagagaggaggaggacccagaagcccucgucugggaa

SEQ ID NO: 392104 - RNA, 60 nt, Homo Sapiens
acccagggccaaaggaauccgaauucgagagaggaggaggcuccagaagcccucgucugg

SEQ ID NO: 392105 - RNA, 60 nt, Homo Sapiens
caggugaggaggcugcagaaauuagaggaggaggaggaguucugugacaagaagcugcuu

SEQ ID NO: 392106 - RNA, 60 nt, Homo Sapiens
agucaggugaggaggcugcacuuauuagaggaggaggaggaagucugugacaagaagcug

SEQ ID NO: 392107 - RNA, 60 nt, Homo Sapiens
aggagucaggugaggaggcucugcuuauuagaggaggaggcagaagucugugacaagaag

SEQ ID NO: 392108 - RNA, 60 nt, Homo Sapiens
cagagguguaccugcggaagcgccaaugaggaggaggaggaugaagacuguccggagcuu

SEQ ID NO: 392109 - RNA, 60 nt, Homo Sapiens
aggcagagguguaccugcggcuucgccaaugaggaggagggccaugaagacuguccggag

SEQ ID NO: 392110 - RNA, 60 nt, Homo Sapiens
ugaaguuuacugaaucagaggaaucagacagaggaggauagcucuuuccagaauccacac

SEQ ID NO: 392111 - RNA, 60 nt, Homo Sapiens
cuugugcugcagaagcucguugacaagacugaggaggauuucaagagcaaccaaguaaag

SEQ ID NO: 392112 - RNA, 60 nt, Homo Sapiens
uguguguaugcauguguuugguaacacacagaggaggaugggacagaaugugaggaggaa

SEQ ID NO: 392113 - RNA, 60 nt, Homo Sapiens
uaacacacagaggaggaugugacagaaugugaggaggaaguguaacuauuuguaccguag

SEQ ID NO: 392114 - RNA, 60 nt, Homo Sapiens
uuuuuuaauugccauuugauuuuuauuguggaggaggaggaucuaauauauaauauucaa

SEQ ID NO: 392115 - RNA, 60 nt, Homo Sapiens
uuuaauugccauuugauuuuuauuguggaggaggaggaucuaauauauaauauucaauac

SEQ ID NO: 392116 - RNA, 60 nt, Homo Sapiens
gaagaagugaccaugggcugggaggagguggaggaggaggaagaggagaaggaaaaguga

SEQ ID NO: 392117 - RNA, 60 nt, Homo Sapiens
gaagugaccaugggcugggaggagguggaggaggaggaagaggagaaggaaaagugacga

SEQ ID NO: 392118 - RNA, 60 nt, Homo Sapiens
ggaagaggagaaggaaaagugacgaagagagaggaggaggggggccccagauggcccuuc

SEQ ID NO: 392119 - RNA, 60 nt, Homo Sapiens
ucgguuaugcagucaauuauuucuuuuuaagaggaggaggauucacuuggguguugggau

SEQ ID NO: 392120 - RNA, 60 nt, Homo Sapiens
guuaugcagucaauuauuucuuuuuaagaggaggaggauucacuuggguguugggaucaa

SEQ ID NO: 392121 - RNA, 60 nt, Homo Sapiens
gccuccggcagaagaaugaggaagaaagaggaggaggagcuuucguaagaucagugaugu

SEQ ID NO: 392122 - RNA, 60 nt, Homo Sapiens
agcgccuccggcagaagaauugugaagaaagaggaggaggaucuuucguaagaucaguga

SEQ ID NO: 392123 - RNA, 60 nt, Homo Sapiens
gcaaacccgagggcccagcgagagcuggaggaggaggaggagcaaugaguuggcacuggc

SEQ ID NO: 392124 - RNA, 60 nt, Homo Sapiens
agggcaaacccgagggcccaggcagagcuggaggaggagggccagcaaugaguuggcacu

SEQ ID NO: 392125 - RNA, 60 nt, Homo Sapiens
cccucgucccccuaggagcaaauugaggaggaggaggaacugagugaaggcacauaaagc

SEQ ID NO: 392126 - RNA, 60 nt, Homo Sapiens
aaccccucgucccccuaggaagcaauugaggaggaggaggcacugagugaaggcacauaa

SEQ ID NO: 392127 - RNA, 60 nt, Homo Sapiens
aggaaccccucgucccccuauaaagcaauugaggaggaggguucacugagugaaggcaca

SEQ ID NO: 392128 - RNA, 60 nt, Homo Sapiens
uagcagacacauccaguaucauaaagggaggaggaggagccaaauauuggggaaaguggg

SEQ ID NO: 392129 - RNA, 60 nt, Homo Sapiens
agcuagcagacacauccagugggauaaagggaggaggagguaccaaauauuggggaaagu

SEQ ID NO: 392130 - RNA, 60 nt, Homo Sapiens
cuugguccaugcugagcaucgagugaggaggaggaggagccccauaggagauggacugga

SEQ ID NO: 392131 - RNA, 60 nt, Homo Sapiens
agccuugguccaugcugagcggagagugaggaggaggaggacccccauaggagauggacu

SEQ ID NO: 392132 - RNA, 60 nt, Homo Sapiens
aggagccuugguccaugcugacuggagagugaggaggaggcccacccccauaggagaugg

SEQ ID NO: 392133 - RNA, 60 nt, Homo Sapiens
cacugcacaggcaguuauuugcugaucucugaggaggaggcugcagcaguacuaucagca

SEQ ID NO: 392134 - RNA, 60 nt, Homo Sapiens
ccagcuuucugguuaagguuuugcggggaggaggaggaaagaacucuuggccaaagguuu

SEQ ID NO: 392135 - RNA, 60 nt, Homo Sapiens
aaaccagcuuucugguuaaguuuuugcggggaggaggaggggagaacucuuggccaaagg

SEQ ID NO: 392136 - RNA, 60 nt, Homo Sapiens
cauugccauccaguggggagauggguuagggaggaggacgggcugacuccucuccuguaa

SEQ ID NO: 392137 - RNA, 60 nt, Homo Sapiens
guuguggggcauaagacaccgggaaugagggaggaggaagacaguuguguuuucucuuua

SEQ ID NO: 392138 - RNA, 60 nt, Homo Sapiens
gugguggcaauggucguggaggccgagggcgaggaggacccaugggccguggaggcuaug

SEQ ID NO: 392139 - RNA, 60 nt, Homo Sapiens
auggaggugguggcagugguggugguggccgaggaggauuucccaguggaggugguggcg

SEQ ID NO: 392140 - RNA, 60 nt, Homo Sapiens
acuagccgagagaugcugccucuaggcagagaggaggagagguguugccggcuggagggc

SEQ ID NO: 392141 - RNA, 60 nt, Homo Sapiens
cagugaacaccagcugugaaggccuugggagaggaggaacaggcccuugggcagaugcag

SEQ ID NO: 392142 - RNA, 60 nt, Homo Sapiens
cugagcaacagacugcuugucuugcuaggagaggaggauggggggcugagcacucaggcu

SEQ ID NO: 392143 - RNA, 60 nt, Homo Sapiens
cuuggcccaccgcagaucuguagccagucagaggaggaggagaaggagccccucagcaga

SEQ ID NO: 392144 - RNA, 60 nt, Homo Sapiens
ggcccaccgcagaucuguagccagucagaggaggaggagaaggagccccucagcagagug

SEQ ID NO: 392145 - RNA, 60 nt, Homo Sapiens
guaucuaucgucaucuggagggauaaguuugaggaggaucuuuuuuacauuccgagcaag

SEQ ID NO: 392146 - RNA, 60 nt, Homo Sapiens
gaagggaauuagaaaagucagccucagagggaggaggagggauauccaguaaugaucaag

SEQ ID NO: 392147 - RNA, 60 nt, Homo Sapiens
caauugggauggcgcuaggcgguagagauggaggaggaggugcagacuggaggggacgcu

SEQ ID NO: 392148 - RNA, 60 nt, Homo Sapiens
gagagaaggggaggagggcggcguuagaaugaggaggaagaggggcauggccagcagcuu

SEQ ID NO: 392149 - RNA, 60 nt, Homo Sapiens
aaaaacaggccgagugaaggcagugccgaggaggaggaagcugcucagcgcgucucagcu

SEQ ID NO: 392150 - RNA, 60 nt, Homo Sapiens
aagaaaaacaggccgagugagcucagugccgaggaggaggaaacugcucagcgcgucuca

SEQ ID NO: 392151 - RNA, 60 nt, Homo Sapiens
aaggggaaggaagagagaggucagaggagggaggaggaaucaccaggaaaggggugguag

SEQ ID NO: 392152 - RNA, 60 nt, Homo Sapiens
ugggcagggccugcaccagguggguugcaggaggaggagcgagcagggcuuacugagcag

SEQ ID NO: 392153 - RNA, 60 nt, Homo Sapiens
ugguggagaccagggacaggucuucuaagggaggaggacacucccugccccagaccuguu

SEQ ID NO: 392154 - RNA, 60 nt, Homo Sapiens
uccgccccacccucuacagcgaggcguucggaggaggaguuagaguccagcacacugcag

SEQ ID NO: 392155 - RNA, 60 nt, Homo Sapiens
ggggcagagucguuggagacugaagaggaagaggaggaggagaaggggagugagcggccg

SEQ ID NO: 392156 - RNA, 60 nt, Homo Sapiens
gcagagucguuggagacugaagaggaagaggaggaggagaaggggagugagcggccgccc

SEQ ID NO: 392157 - RNA, 60 nt, Homo Sapiens
aacaaacacaugggggagagagacuuggaagaggaggaggaggaggagaaggaggagaga

SEQ ID NO: 392158 - RNA, 60 nt, Homo Sapiens
aaacacaugggggagagagacuuggaagaggaggaggaggaggagaaggaggagagagag

SEQ ID NO: 392159 - RNA, 60 nt, Homo Sapiens
cacaugggggagagagacuuggaagaggaggaggaggaggagaaggaggagagagagggg

SEQ ID NO: 392160 - RNA, 60 nt, Homo Sapiens
augggggagagagacuuggaagaggaggaggaggaggagaaggaggagagagaggggaag

SEQ ID NO: 392161 - RNA, 60 nt, Homo Sapiens
ggucgggacagugcccuggccuuugccggggaggaggaugcucugagauucagggugggg

SEQ ID NO: 392162 - RNA, 60 nt, Homo Sapiens
ugacuuccccaggaguguggaggggguggugaggaggagcaccugggcucucuaccccuc

SEQ ID NO: 392163 - RNA, 60 nt, Homo Sapiens
cagcuggcgcaccaggcccagcagcagcuggaggaggaggaggaggauacgccagucagc

SEQ ID NO: 392164 - RNA, 60 nt, Homo Sapiens
cuggcgcaccaggcccagcagcagcuggaggaggaggaggaggauacgccagucagcccc

SEQ ID NO: 392165 - RNA, 60 nt, Homo Sapiens
gcgcaccaggcccagcagcagcuggaggaggaggaggaggauacgccagucagccccaag

SEQ ID NO: 392166 - RNA, 60 nt, Homo Sapiens
caccaggcccagcagcagcuggaggaggaggaggaggauacgccagucagccccaaggag

SEQ ID NO: 392167 - RNA, 60 nt, Homo Sapiens; identical to SEQ ID NO: 133766

SEQ ID NO: 392168 - RNA, 57 nt, Homo Sapiens; identical to SEQ ID NO: 133767

SEQ ID NO: 392169 - RNA, 60 nt, Homo Sapiens
agaugcgcaguuaccucaugggggagggaggaggaggagaaaguugggggcccaggaggc

SEQ ID NO: 392170 - RNA, 60 nt, Homo Sapiens
agaagaugcgcaguuaccucggcggggagggaggaggagggccaaguugggggcccagga

SEQ ID NO: 392171 - RNA, 60 nt, Homo Sapiens
auaacuuaggccuagccucugggcugugaggaggaggauuuaaugccccuuggggaaaug

SEQ ID NO: 392172 - RNA, 60 nt, Homo Sapiens
auuauaacuuaggccuagccauggggcugugaggaggaggugcuaaugccccuuggggaa

SEQ ID NO: 392173 - RNA, 60 nt, Homo Sapiens
gucuagaggccugaaauccucacugaagaggaggaggaggucuggaaguuaaagugaggc

SEQ ID NO: 392174 - RNA, 60 nt, Homo Sapiens
agggucuagaggccugaaauggccacugaagaggaggaggucaucuggaaguuaaaguga

SEQ ID NO: 392175 - RNA, 60 nt, Homo Sapiens
ugggagcuggaggugugacagugggggcgagaggaggacuggagugaaagagucacugug

SEQ ID NO: 392176 - RNA, 60 nt, Homo Sapiens
caggaucgaauggaaggggggggcacuucagaggaggagcagccugucacgacagagccu

SEQ ID NO: 392177 - RNA, 60 nt, Homo Sapiens
uccaaggagcuacugacauuccuaagaguggaggaggaggaggagccuugcugggccagg

SEQ ID NO: 392178 - RNA, 60 nt, Homo Sapiens
aaggagcuacugacauuccuaagaguggaggaggaggaggagccuugcugggccagggaa

SEQ ID NO: 392179 - RNA, 60 nt, Homo Sapiens
gagcuacugacauuccuaagaguggaggaggaggaggagccuugcugggccagggaaaca

SEQ ID NO: 392180 - RNA, 60 nt, Homo Sapiens
gccugcauggagaaggguucugcccugccugaggaggaggacacagcacaagggcacauu

SEQ ID NO: 392181 - RNA, 60 nt, Homo Sapiens
ugcauggagaaggguucugcccugccugaggaggaggacacagcacaagggcacauugcc

SEQ ID NO: 392182 - RNA, 60 nt, Homo Sapiens
uucaacuaaauccaggaggagcuguggucagaggaggagccggcgccuggccacgccaac

SEQ ID NO: 392183 - RNA, 60 nt, Homo Sapiens
aguugcagaggucccuguagagauaaagcugaggaggaggcugugugugauggcucuggc

SEQ ID NO: 392184 - RNA, 60 nt, Homo Sapiens
uucccugugggccagggaugcucggucccagaggaggaccuagugacaucaugggacagg

SEQ ID NO: 392185 - RNA, 60 nt, Homo Sapiens
uuggcagaacccugggugggcaggcacccggaggaggagcagcagcugugucauccugug

SEQ ID NO: 392186 - RNA, 60 nt, Homo Sapiens
gacgggaggggaccauuuggggcaacgguggaggaggagacaucgccgggggagguugug

SEQ ID NO: 392187 - RNA, 60 nt, Homo Sapiens
ccagcugggcucggucccccgagagaaggggaggaggacugccagagagaccugcugccg

SEQ ID NO: 392188 - RNA, 60 nt, Homo Sapiens
uuaucgucugcaaguguucuccaagggaaggaggaggaaacugugguguuccuuucuucc

SEQ ID NO: 392189 - RNA, 60 nt, Homo Sapiens
guagcaagagcugcaaagcaggcaggaagggaggaggagagccaggugagcaguggagag

SEQ ID NO: 392190 - RNA, 60 nt, Homo Sapiens
gccugaggcaggagaauugcaugaacccgggaggaggaggaggagguugcagugagccga

SEQ ID NO: 392191 - RNA, 60 nt, Homo Sapiens
ugaggcaggagaauugcaugaacccgggaggaggaggaggagguugcagugagccgagau

SEQ ID NO: 392192 - RNA, 60 nt, Homo Sapiens
ggcaggagaauugcaugaacccgggaggaggaggaggagguugcagugagccgagauagc

SEQ ID NO: 392193 - RNA, 60 nt, Homo Sapiens
aggcagagaaggaggagaccggugaagaaggaggaggaagcgugugauuguagacagagg

SEQ ID NO: 392194 - RNA, 60 nt, Homo Sapiens
cuaaaaaugucacgaauaugcuacagaaaugaggaggaugagggaguuacugaagucuua

SEQ ID NO: 392195 - RNA, 60 nt, Homo Sapiens
gaccuguuggcugaaaaggcccagaucaccgaggaggaggcaaaacuucuggcccagaag

SEQ ID NO: 392196 - RNA, 60 nt, Homo Sapiens
cagcgcaucaaggccacagcgauucgcacggaggaggagaagcgccugauggagcagaag

SEQ ID NO: 392197 - RNA, 60 nt, Homo Sapiens
ccgaccguggcguuggcccugcuguccucagaggaggaggaggaggaggcagcuccggca

SEQ ID NO: 392198 - RNA, 60 nt, Homo Sapiens
accguggcguuggcccugcuguccucagaggaggaggaggaggaggcagcuccggcagcc

SEQ ID NO: 392199 - RNA, 60 nt, Homo Sapiens
guggcguuggcccugcuguccucagaggaggaggaggaggaggcagcuccggcagccaca

SEQ ID NO: 392200 - RNA, 60 nt, Homo Sapiens
gcguuggcccugcuguccucagaggaggaggaggaggaggcagcuccggcagccacagaa

SEQ ID NO: 392201 - RNA, 60 nt, Homo Sapiens
gggaggcugcagaugccugguugcucccaagaggaggagacuggggggaucagcugccca

SEQ ID NO: 392202 - RNA, 60 nt, Homo Sapiens
ggccuggaaagcuuugguagaagacacugggaggaggagacaccuucaggccugggaagg

SEQ ID NO: 392203 - RNA, 60 nt, Homo Sapiens
caagggagcagggcagcucucuuggcagaggaggaggaguccagaggauuauuuuccugc

SEQ ID NO: 392204 - RNA, 60 nt, Homo Sapiens
agucaagggagcagggcagcugccuuggcagaggaggaggugaccagaggauuauuuucc

SEQ ID NO: 392205 - RNA, 60 nt, Homo Sapiens
gggggguccaggucuuuucagaagcaggaggaggaggagaaggguggaaggcccuggcag

SEQ ID NO: 392206 - RNA, 60 nt, Homo Sapiens
agagggggguccaggucuuucaggaagcaggaggaggaggcagaggguggaaggcccugg

SEQ ID NO: 392207 - RNA, 60 nt, Homo Sapiens
accucuccauauacuuucuaagcucugggggaggaggaggaugggaccuccuggacccag

SEQ ID NO: 392208 - RNA, 60 nt, Homo Sapiens
ucuccauauacuuucuaagcucugggggaggaggaggaugggaccuccuggacccagcuu

SEQ ID NO: 392209 - RNA, 60 nt, Homo Sapiens
gugaagaaacuccuuucaucucagcagguagaggaggacugaugacacgagcugccaugg

SEQ ID NO: 392210 - RNA, 60 nt, Homo Sapiens
uccugagagaacuccaucaauccaguccaagaggaggaggacgaaggccuagacucagcu

SEQ ID NO: 392211 - RNA, 60 nt, Homo Sapiens
ugagagaacuccaucaauccaguccaagaggaggaggacgaaggccuagacucagcugaa

SEQ ID NO: 392212 - RNA, 60 nt, Homo Sapiens
uggcugugaagggaagucuuuguugcaaaggaggaggaggaaaagggaggacuugguagg

SEQ ID NO: 392213 - RNA, 60 nt, Homo Sapiens
cugugaagggaagucuuuguugcaaaggaggaggaggaaaagggaggacuugguaggguu

SEQ ID NO: 392214 - RNA, 60 nt, Homo Sapiens
cucauccggacugaggaagacgaggacagggaggaggaaaaggaggaagaggaggacaaa

SEQ ID NO: 392215 - RNA, 60 nt, Homo Sapiens
gacgaggacagggaggaggaaaaggaggaagaggaggacaaaaagggggaggagaagguu

SEQ ID NO: 392216 - RNA, 60 nt, Homo Sapiens
ccagguccugguggagccuuggaggaggaggaggaggagggaggaggaggaggaggagga

SEQ ID NO: 392217 - RNA, 60 nt, Homo Sapiens
aggccagguccugguggagcggaggaggaggaggaggagggaagaggaggaggaggagga

SEQ ID NO: 392218 - RNA, 60 nt, Homo Sapiens
aggaggccagguccugguggggaggaggaggaggaggagggaagaagaggaggaggagga

SEQ ID NO: 392219 - RNA, 60 nt, Homo Sapiens
aggaggaggccagguccuggggaggaggaggaggaggagggaggaagaagaggaggagga

SEQ ID NO: 392220 - RNA, 60 nt, Homo Sapiens
aggaggaggaggccagguccggaggaggaggaggaggagggaggaggaagaagaggagga

SEQ ID NO: 392221 - RNA, 60 nt, Homo Sapiens
aggaggaggaggaggccaggggaggaggaggaggaggagggaggaggaggaagaagagga

SEQ ID NO: 392222 - RNA, 60 nt, Homo Sapiens
aggaggaggaggaggaggccggaggaggaggaggaggagggaggaggaggaggaagaaga

SEQ ID NO: 392223 - RNA, 60 nt, Homo Sapiens
aggaggaggaggaggaggagagaggaggaggaggaggagggaggaggaggaggaggaaga

SEQ ID NO: 392224 - RNA, 60 nt, Homo Sapiens
aggaggaggaggaggaggagggaagaggaggaggaggaggccaaccccaugggaggagga

SEQ ID NO: 392225 - RNA, 60 nt, Homo Sapiens
aggaggaggaggaggaggagggaggaagaggaggaggaggaccccaaccccaugggagga

SEQ ID NO: 392226 - RNA, 60 nt, Homo Sapiens
aggaggaggaggaggaggagggaggaggaagaggaggaggccaaccccaaccccauggga

SEQ ID NO: 392227 - RNA, 60 nt, Homo Sapiens
aggaggaggaggaggaggagcccaugggaggaggaggaaggcccuaaucccaaccccaac

SEQ ID NO: 392228 - RNA, 60 nt, Homo Sapiens
aggaggaagaagaggaggagaaccccaugggaggaggaggauggcccuaaucccaacccc

SEQ ID NO: 392229 - RNA, 60 nt, Homo Sapiens
aaggauccucacaggaggauaguccaagaggaggaggacgugagagaacuccaucaaucc

SEQ ID NO: 392230 - RNA, 60 nt, Homo Sapiens
acgaaggauccucacaggaguccaguccaagaggaggagguccugagagaacuccaucaa

SEQ ID NO: 392231 - RNA, 64 nt, Homo Sapiens; identical to SEQ ID NO: 102083

SEQ ID NO: 392232 - RNA, 64 nt, Homo Sapiens; identical to SEQ ID NO: 102084

SEQ ID NO: 392233 - RNA, 64 nt, Homo Sapiens
auaccuguaacuggaaguuuacuucacugucucugcucaauaaauugaaauaacagcauaagga

SEQ ID NO: 392234 - RNA, 51 nt, Homo Sapiens
ucuuuguaaauugucuuuuuagcucaauaaucagacucugaugaugauuag

SEQ ID NO: 392235 - RNA, 64 nt, Homo Sapiens
gggcauugggguugcaagauaaugcacaguccgagcucaauacaugucuucauguaccuguaug

SEQ ID NO: 392236 - RNA, 64 nt, Homo Sapiens
auguaacacuugauauaauaacccaaauuaauuagcucaauauuaucuucugugguuuauugau

SEQ ID NO: 392237 - RNA, 64 nt, Homo Sapiens
uuaaaucuauuuaaaaggaugucuucccccaaagaguugaaaucuuguuuguuuggacuucccu

SEQ ID NO: 392238 - RNA, 64 nt, Homo Sapiens
gggugugucauaaagucaguaaguuucacaucuaaguugaaacauuuucauuaauguguucauc

SEQ ID NO: 392239 - RNA, 64 nt, Homo Sapiens
cacagaguuaagugaccucaguugaaagccacagaguugaaagcucuuacacgaaagccacaga

SEQ ID NO: 392240 - RNA, 64 nt, Homo Sapiens
cacagaguugaaagccacagcacgaaagccacagaguugaaagcggcccuauaccgccaucuua

SEQ ID NO: 392241 - RNA, 64 nt, Homo Sapiens
uggacauauuuguuugaagagauaggugaaagauaguugaaaagccuggggguauauucaaggu

SEQ ID NO: 392242 - RNA, 64 nt, Homo Sapiens
cugaugauuucugacuuggggaaaaauggggaagaguugaaauacguccuuccacccaaaccuu

SEQ ID NO: 392243 - RNA, 64 nt, Homo Sapiens
ugcucuucuccccauuuuacaaaugagaaaucugaguugaaagagguuauaaaacucauucagg

SEQ ID NO: 392244 - RNA, 64 nt, Homo Sapiens
acucauucaggguugcucaguuaguaaguuauagaguugaaauuggagccaggccuaucugacu

SEQ ID NO: 392245 - RNA, 64 nt, Homo Sapiens
auauaacaugcucaugauaaaaaagaauugaaauaguugaaaaggguguucagugaaaaguaaa

SEQ ID NO: 392246 - RNA, 64 nt, Homo Sapiens
uuaaugcuuuguuagauagcuucauccagucaauaguugaaaaguuuucacauaauccaguauu

SEQ ID NO: 392247 - RNA, 64 nt, Homo Sapiens
gaacaugcucuucaaaaagaugcacuuaguauuaaguugaaacuugaacaaauagauggucaca

SEQ ID NO: 392248 - RNA, 64 nt, Homo Sapiens
ggacaguguuucaacaagccuaggcuaucucguaaguugaaaaauaucccacuauaguugcuuc

SEQ ID NO: 392249 - RNA, 64 nt, Homo Sapiens
cacguucauauuccaguggucaauguagauuucaaguugaaaggcagucccuuuaguugggggc

SEQ ID NO: 392250 - RNA, 64 nt, Homo Sapiens
gagggaaaaguccuuggcucguuugauccaguugaguugaaaggguugccuuggcagcagaggc

SEQ ID NO: 392251 - RNA, 64 nt, Homo Sapiens
cugcaagcaucacagcuuuguguauaauugcaaaaguugaaaucaacaugaaugcccaaaauag

SEQ ID NO: 392252 - RNA, 64 nt, Homo Sapiens
ucaacauaacucacuuuucaguuaaguuaggcugaguugaaauucuacuaaguuuucccauauu

SEQ ID NO: 392253 - RNA, 64 nt, Homo Sapiens
aucagugcaauugaccuucucccucacuccugccaguugaaaauggauuuuuaaauuauacugu

SEQ ID NO: 392254 - RNA, 64 nt, Homo Sapiens
gccaacuuuaauugcuuaaaagacauuuuuauuuaguugaaaaaucuaguuuuuuuuguaaacu

SEQ ID NO: 392255 - RNA, 64 nt, Homo Sapiens
ggcacucuuggacucucggcaaccacaacauaauaguugaaagaucaagauuggcuccacgaaa

SEQ ID NO: 392256 - RNA, 64 nt, Homo Sapiens
uucaaaaguucuuggcccgcugaagucuguuaacaguugaaacauucuacaguuaaccauuagc

SEQ ID NO: 392257 - RNA, 64 nt, Homo Sapiens
aacuuguauguaucuguauggacgacauggcagaaguugaaacauaaaaaguaaaaaugaaaaa

SEQ ID NO: 392258 - RNA, 64 nt, Homo Sapiens
ugguuuuguuauuucuugauucuagguugcaguaaguugaaauaacuuuaugaagggaagauug

SEQ ID NO: 392259 - RNA, 64 nt, Homo Sapiens
agauuuuucuguagauuuuuuguucagccaugucaguugaaacuacuucuuggcaguuuuucag

SEQ ID NO: 392260 - RNA, 64 nt, Homo Sapiens
agcaggcaaaagaauccucgacagcucuuaaugcaguugaaaagcuucgagaaaaaauuuauuu

SEQ ID NO: 392261 - RNA, 64 nt, Homo Sapiens
cagugugaacgcaucccaacauagguuaagagcaaguugaaaacaaaggccauggcauucugcc

SEQ ID NO: 392262 - RNA, 64 nt, Homo Sapiens
ggugucuguuuauguaacucugacuugcuggaaaaguugaaacuccaaauaaucugaaacuaga

SEQ ID NO: 392263 - RNA, 64 nt, Homo Sapiens
aaaggcacaguuaacaaaaauaacaaggacaaaaaguugaaagaguuggacaaauuuugaguuu

SEQ ID NO: 392264 - RNA, 64 nt, Homo Sapiens
gggaauauuuggccacauacucuccaucuuaccaaguugaaaagugaaacaugucuguuacccc

SEQ ID NO: 392265 - RNA, 64 nt, Homo Sapiens
augaucauaagucaaaaaugaaaauaugaucauaaguugaaaaugauaaacccaucauaaguug

SEQ ID NO: 392266 - RNA, 64 nt, Homo Sapiens
augaucauaaguugaaaauaauaaacccaucauaaguugaaaauugugauggguuugcauccug

SEQ ID NO: 392267 - RNA, 64 nt, Homo Sapiens
ugccgcaauuccacuggaaguaucccuggguuagaguugaaauugggaaugaggccuagaucga

SEQ ID NO: 392268 - RNA, 64 nt, Homo Sapiens
auagcagaaugugcuucucuugaggacagaccuuaguugaaaugagaugccuuaauccauuccu

SEQ ID NO: 392269 - RNA, 64 nt, Homo Sapiens
uuguaaucuuccccaggaggguaaagauuuauacaguugaaaacgaaaaguaaucagcauaugu

SEQ ID NO: 392270 - RNA, 64 nt, Homo Sapiens
ugcaucugauaagauacugcugauauucuaaacaaguugaaauaaucuugccuuagugaucaug

SEQ ID NO: 392271 - RNA, 64 nt, Homo Sapiens
gaggugcacugccaauaaguaucucuaauucaauaguugaaagcaaccugcaugcuaaucgugg

SEQ ID NO: 392272 - RNA, 64 nt, Homo Sapiens
aggauuuggggagagaagccaauuuugcauggcuaguugaaaaugguauuagauacuuauuucc

SEQ ID NO: 392273 - RNA, 64 nt, Homo Sapiens
gaguuaauuuaaacuuucaaacacuguuuagaucaguugaaaacuaauucuuaauagccauugu

SEQ ID NO: 392274 - RNA, 64 nt, Homo Sapiens
ccugauaaaauaaucauaagucaaaaauauugucaguugaaaauacauuuaauaucccaauuaa

SEQ ID NO: 392275 - RNA, 64 nt, Homo Sapiens
aaauacauuuaauaucccaauuaacccaucauaaaguugaaaaauccuaaguggaaccaucaaa

SEQ ID NO: 392276 - RNA, 64 nt, Homo Sapiens
gucgcuuccugggauuccagcacgaugccuccauaguugaaagacuacacaaaaagccacaauc

SEQ ID NO: 392277 - RNA, 64 nt, Homo Sapiens
auuagagaaaagccuagacuuuuaguugauagccaguugaaauaucauugauagaauuuuaguu

SEQ ID NO: 392278 - RNA, 64 nt, Homo Sapiens
uuugguuauaaauguaauacuucaaucugguaccaguugaaauuuguguguucgacagugaaua

SEQ ID NO: 392279 - RNA, 64 nt, Homo Sapiens
augugccauuuugcauuuucuugacacuggaaugaguugaaaaauuagauuuuuugguuaagcu

SEQ ID NO: 392280 - RNA, 64 nt, Homo Sapiens
aucaauaaauaaacucaaccgaaauggguaugaaaguugaaauggguauguaaguugaaaacca

SEQ ID NO: 392281 - RNA, 64 nt, Homo Sapiens
ccgaaauggguaugaaaguugaaauggguauguaaguugaaaaccagaaguuuugagaaacauc

SEQ ID NO: 392282 - RNA, 64 nt, Homo Sapiens
acagguaccccaaggaguagaugccaggguccuaaguugaaaaugaugucgauugggggcgggg

SEQ ID NO: 392283 - RNA, 64 nt, Homo Sapiens
guacagcacuuauagaaauaagcuguucuuuugaaguugaaauacccaguaaaauguugaagaa

SEQ ID NO: 392284 - RNA, 64 nt, Homo Sapiens
gcaccaacaaaugaagcucacuaaaugugcugaaaguugaaaccaugacagggagcucucauag

SEQ ID NO: 392285 - RNA, 64 nt, Homo Sapiens
guugaaaccaugacagggagcucucauagauacuaguugaaaaaagucucugaacaauucucuc

SEQ ID NO: 392286 - RNA, 64 nt, Homo Sapiens
cuguaccuguguguauagaaauagaucagagcacaguugaaauucauggaacuggcauuauuua

SEQ ID NO: 392287 - RNA, 64 nt, Homo Sapiens
ccugcacagggaaauggcuaccuauuaaagucccaguugaaauuuuuugaaaaaauacaccucc

SEQ ID NO: 392288 - RNA, 64 nt, Homo Sapiens
uuccccuauuucugaccuacaacuauaaacuacucucuauuaggagaacuagaccacuuucuuc

SEQ ID NO: 392289 - RNA, 64 nt, Homo Sapiens
agaucuucugacucgaaguugagaguucuuuauacucuauuaugcugccucuccaguguaauau

SEQ ID NO: 392290 - RNA, 64 nt, Homo Sapiens
aacuggacuauugaucauuaccacgugacguuggcucuauuacuuucuguucccaauguccuuc

SEQ ID NO: 392291 - RNA, 64 nt, Homo Sapiens
cucuaucuguaaagaucauuuggaagacuuuagacucuauuaauuuuaaaaggaauauuuauua

SEQ ID NO: 392292 - RNA, 64 nt, Homo Sapiens
aaauaaagggaccauaagcagaacgguucuagcccucuauuaagauuaguguguuaccccaaau

SEQ ID NO: 392293 - RNA, 64 nt, Homo Sapiens
aauacaaaaauuagcuggguuagugaaaccccgucucuauuaaaugagaccagccuggccaaca

SEQ ID NO: 392294 - RNA, 64 nt, Homo Sapiens; identical to SEQ ID NO: 107827

SEQ ID NO: 392295 - RNA, 64 nt, Homo Sapiens; identical to SEQ ID NO: 107828

SEQ ID NO: 392296 - RNA, 64 nt, Homo Sapiens; identical to SEQ ID NO: 107829

SEQ ID NO: 392297 - RNA, 64 nt, Homo Sapiens; identical to SEQ ID NO: 107830

SEQ ID NO: 392298 - RNA, 64 nt, Homo Sapiens; identical to SEQ ID NO: 107831

SEQ ID NO: 392299 - RNA, 64 nt, Homo Sapiens; identical to SEQ ID NO: 107832

SEQ ID NO: 392300 - RNA, 64 nt, Homo Sapiens; identical to SEQ ID NO: 107833

SEQ ID NO: 392301 - RNA, 64 nt, Homo Sapiens; identical to SEQ ID NO: 107834

SEQ ID NO: 392302 - RNA, 64 nt, Homo Sapiens; identical to SEQ ID NO: 107835

SEQ ID NO: 392303 - RNA, 64 nt, Homo Sapiens; identical to SEQ ID NO: 107836

SEQ ID NO: 392304 - RNA, 64 nt, Homo Sapiens; identical to SEQ ID NO: 107837

SEQ ID NO: 392305 - RNA, 64 nt, Homo Sapiens; identical to SEQ ID NO: 107838

SEQ ID NO: 392306 - RNA, 64 nt, Homo Sapiens; identical to SEQ ID NO: 107839

SEQ ID NO: 392307 - RNA, 64 nt, Homo Sapiens; identical to SEQ ID NO: 107840

SEQ ID NO: 392308 - RNA, 64 nt, Homo Sapiens; identical to SEQ ID NO: 305621

SEQ ID NO: 392309 - RNA, 64 nt, Homo Sapiens; identical to SEQ ID NO: 305622

SEQ ID NO: 392310 - RNA, 64 nt, Homo Sapiens; identical to SEQ ID NO: 305623

SEQ ID NO: 392311 - RNA, 64 nt, Homo Sapiens; identical to SEQ ID NO: 305624

SEQ ID NO: 392312 - RNA, 64 nt, Homo Sapiens; identical to SEQ ID NO: 305625

SEQ ID NO: 392313 - RNA, 64 nt, Homo Sapiens; identical to SEQ ID NO: 305626

SEQ ID NO: 392314 - RNA, 64 nt, Homo Sapiens; identical to SEQ ID NO: 305627

SEQ ID NO: 392315 - RNA, 64 nt, Homo Sapiens; identical to SEQ ID NO: 305628

SEQ ID NO: 392316 - RNA, 64 nt, Homo Sapiens; identical to SEQ ID NO: 305629

SEQ ID NO: 392317 - RNA, 64 nt, Homo Sapiens; identical to SEQ ID NO: 305630

SEQ ID NO: 392318 - RNA, 64 nt, Homo Sapiens; identical to SEQ ID NO: 305631

SEQ ID NO: 392319 - RNA, 64 nt, Homo Sapiens; identical to SEQ ID NO: 305632

SEQ ID NO: 392320 - RNA, 64 nt, Homo Sapiens; identical to SEQ ID NO: 305633

SEQ ID NO: 392321 - RNA, 64 nt, Homo Sapiens; identical to SEQ ID NO: 305634

SEQ ID NO: 392322 - RNA, 64 nt, Homo Sapiens; identical to SEQ ID NO: 305635

SEQ ID NO: 392323 - RNA, 64 nt, Homo Sapiens; identical to SEQ ID NO: 305636

SEQ ID NO: 392324 - RNA, 64 nt, Homo Sapiens; identical to SEQ ID NO: 305637

SEQ ID NO: 392325 - RNA, 64 nt, Homo Sapiens
gccaucaugugacgccugcgcgccccucgggcugcaccggcacuggccgagcggagggcggggc

SEQ ID NO: 392326 - RNA, 64 nt, Homo Sapiens
ucuuugugaggccaggccuucugacugucagcaccaccggcacagggcagagaugcggguggcc

SEQ ID NO: 392327 - RNA, 64 nt, Homo Sapiens; identical to SEQ ID NO: 167924

SEQ ID NO: 392328 - RNA, 64 nt, Homo Sapiens; identical to SEQ ID NO: 167925

SEQ ID NO: 392329 - RNA, 64 nt, Homo Sapiens; identical to SEQ ID NO: 167926

SEQ ID NO: 392330 - RNA, 64 nt, Homo Sapiens; identical to SEQ ID NO: 167927

SEQ ID NO: 392331 - RNA, 64 nt, Homo Sapiens; identical to SEQ ID NO: 167928

SEQ ID NO: 392332 - RNA, 64 nt, Homo Sapiens; identical to SEQ ID NO: 167929

SEQ ID NO: 392333 - RNA, 64 nt, Homo Sapiens; identical to SEQ ID NO: 167930

SEQ ID NO: 392334 - RNA, 64 nt, Homo Sapiens; identical to SEQ ID NO: 167931

SEQ ID NO: 392335 - RNA, 64 nt, Homo Sapiens; identical to SEQ ID NO: 167932

SEQ ID NO: 392336 - RNA, 64 nt, Homo Sapiens; identical to SEQ ID NO: 167933

SEQ ID NO: 392337 - RNA, 64 nt, Homo Sapiens; identical to SEQ ID NO: 167934

SEQ ID NO: 392338 - RNA, 64 nt, Homo Sapiens; identical to SEQ ID NO: 167935

SEQ ID NO: 392339 - RNA, 64 nt, Homo Sapiens; identical to SEQ ID NO: 167936

SEQ ID NO: 392340 - RNA, 64 nt, Homo Sapiens; identical to SEQ ID NO: 167937

SEQ ID NO: 392341 - RNA, 64 nt, Homo Sapiens; identical to SEQ ID NO: 167938

SEQ ID NO: 392342 - RNA, 64 nt, Homo Sapiens; identical to SEQ ID NO: 167939

SEQ ID NO: 392343 - RNA, 64 nt, Homo Sapiens; identical to SEQ ID NO: 167940

SEQ ID NO: 392344 - RNA, 64 nt, Homo Sapiens; identical to SEQ ID NO: 167941

SEQ ID NO: 392345 - RNA, 64 nt, Homo Sapiens; identical to SEQ ID NO: 167942

SEQ ID NO: 392346 - RNA, 64 nt, Homo Sapiens; identical to SEQ ID NO: 167942

SEQ ID NO: 392347 - RNA, 64 nt, Homo Sapiens; identical to SEQ ID NO: 167944

SEQ ID NO: 392348 - RNA, 64 nt, Homo Sapiens; identical to SEQ ID NO: 167945

SEQ ID NO: 392349 - RNA, 64 nt, Homo Sapiens; identical to SEQ ID NO: 167946

SEQ ID NO: 392350 - RNA, 64 nt, Homo Sapiens; identical to SEQ ID NO: 167947

SEQ ID NO: 392351 - RNA, 64 nt, Homo Sapiens; identical to SEQ ID NO: 167948

SEQ ID NO: 392352 - RNA, 64 nt, Homo Sapiens; identical to SEQ ID NO: 167949

SEQ ID NO: 392353 - RNA, 64 nt, Homo Sapiens
ccauguuggucaggcuggucucaaacuccugaccucaggugauccgcccaccucagccucccaa

SEQ ID NO: 392354 - RNA, 64 nt, Homo Sapiens
ccauguuggccaggcuguucucgaacuccugaccucaggugaucugcccgccucggucucccaa

SEQ ID NO: 392355 - RNA, 64 nt, Homo Sapiens
ugaacauagcucacuguuaccuugaauucugggcucaggugauccuuccgccucacccuccuga

SEQ ID NO: 392356 - RNA, 64 nt, Homo Sapiens
cuauguugcccaggcuggucucaaacuccuggccucaggugauccucuugucucagccucccaa

SEQ ID NO: 392357 - RNA, 64 nt, Homo Sapiens
cgcccgccucggccucccaaucgaacuccugaccucaggugaucccauguuggccaggcugguc

SEQ ID NO: 392358 - RNA, 64 nt, Homo Sapiens
auccuuaccugggggugcugaaugccuucuagauucaggugacuccuuccaguuaugagaaacc

SEQ ID NO: 392359 - RNA, 64 nt, Homo Sapiens
cacuugccucggccucccaaucaaacuccugaccucaggugaucccauguuggccaggcugguc

SEQ ID NO: 392360 - RNA, 64 nt, Homo Sapiens
cacccaccccggccucccaauugaacucccgaccucaggugaucccauguuggucaggcugguc

SEQ ID NO: 392361 - RNA, 64 nt, Homo Sapiens
aaucucggcuccccacaaccucugacuccaggguucaggugauuauuuugccucagccucccaa

SEQ ID NO: 392362 - RNA, 64 nt, Homo Sapiens
ccauguuggccaggcuggucuugaacuccugaccucaggugauccgcccgccucggccucccaa

SEQ ID NO: 392363 - RNA, 64 nt, Homo Sapiens
uacccaccucggccucccaaucgagcuccugaccucaggugaucccauguuggucaggcugauc

SEQ ID NO: 392364 - RNA, 64 nt, Homo Sapiens
cuccugccucagccuccugaucugccucccagguucaggugauuaaucucagcucacugcaacc

SEQ ID NO: 392365 - RNA, 64 nt, Homo Sapiens
ggaaguugcacacauugugcccuaaagaaggcccucaggugaaagagcagagcugugaagaacu

SEQ ID NO: 392366 - RNA, 64 nt, Homo Sapiens
guguuacaggugaggaguguaauccuaggaagcaucaggugaaaagcaggagaccaaagaagug

SEQ ID NO: 392367 - RNA, 64 nt, Homo Sapiens
ugguagaggggagacauuaguucauucuguuaucucaggugagcaaucuggcuguccuuccauu

SEQ ID NO: 392368 - RNA, 57 nt, Homo Sapiens
accauuaugaucaaaaacugugccagcucaggugacaggagcccagcuuuuugguaa

SEQ ID NO: 392369 - RNA, 64 nt, Homo Sapiens
caccugccuuggccuuccagucaaacuccugaccucaggugaucccauguuggccaggcuggcc

SEQ ID NO: 392370 - RNA, 64 nt, Homo Sapiens
cuccugccucagccucccaauccagcuccuggguucaggugauugaucuuggcuaacugcaacc

SEQ ID NO: 392371 - RNA, 64 nt, Homo Sapiens
agcucugguggccccuccguaaacucaggaagugucaggugauuuccuagggagagguucccag

SEQ ID NO: 392372 - RNA, 64 nt, Homo Sapiens
ccaugcuggccaggcuggucucgaacuccugaccucaggugaucccccccaccucagccuccca

SEQ ID NO: 392373 - RNA, 64 nt, Homo Sapiens
cacccaccucagccucccaaucaaacuccugaccucaggugaugucauguuggccaggccgguc

SEQ ID NO: 392374 - RNA, 64 nt, Homo Sapiens
cacccgccucagccucccaaucgaacuccugaccucaggugaucccauguuagccaggcugguc

SEQ ID NO: 392375 - RNA, 64 nt, Homo Sapiens
ugcccgccuuggccucccaaucgaacucuugaccucaggugaucccauguuggccaggcugguc

SEQ ID NO: 392376 - RNA, 64 nt, Homo Sapiens
cgcccaccucggccucccaaucgaacuccugaccucaggugaucccauguuggccaggcugguc

SEQ ID NO: 392377 - RNA, 64 nt, Homo Sapiens
caccugccucggccucccaaucgaacuccugaccucaggugaucccauguuggccaggcugguc

SEQ ID NO: 392378 - RNA, 64 nt, Homo Sapiens
cgcccaccuuggccucccaaucgaacuccugaccucaggugaucccaugcuggccaggcucguc

SEQ ID NO: 392379 - RNA, 64 nt, Homo Sapiens
uuuuguauuuuuagguggucuugaacuccugaugucaggugauucuccuagcuccaaauguuuu

SEQ ID NO: 392380 - RNA, 64 nt, Homo Sapiens
acauguuggccaggcugguggugagcuccuggccucaggugauccacccaccucaguguuccaa

SEQ ID NO: 392381 - RNA, 64 nt, Homo Sapiens
agguguccacugcgggucuucaaacguaccccccucaggugagaggggacugcuguacaaagaa

SEQ ID NO: 392382 - RNA, 64 nt, Homo Sapiens
accauguuguccaggcuggucucaacuccugaccucaggugauccacccaccuugcccucccaa

SEQ ID NO: 392383 - RNA, 64 nt, Homo Sapiens
cgcccaccuuggccucccgauugaacucccgaccucaggugaucgguuucuccaaaggcugguc

SEQ ID NO: 392384 - RNA, 64 nt, Homo Sapiens
caccugcuucggccucccaauugaauuccugaccucaggugaucccauguuggccaggcugguc

SEQ ID NO: 392385 - RNA, 64 nt, Homo Sapiens
ccauguuggccaggcuggucuugaacuccugaccucaggugauccacccaccugggccucccau

SEQ ID NO: 392386 - RNA, 64 nt, Homo Sapiens
ccauguuggccaggcuggucucgaacuccugacaucaggugauccaccugccucggccucccaa

SEQ ID NO: 392387 - RNA, 64 nt, Homo Sapiens
uuuucaaagcuccuucugcauugucacucacugaucaggugaugaauucuuccuagauagucgc

SEQ ID NO: 392388 - RNA, 64 nt, Homo Sapiens
ccauguuggucaggcuggcuuugaacuccugaccucaggugauccacccgccuuggccucccaa

SEQ ID NO: 392389 - RNA, 64 nt, Homo Sapiens
gggcagcuuuaauggugguuuagccccacccagaucaggugaaaaaacuucucguuuccucguu

SEQ ID NO: 392390 - RNA, 64 nt, Homo Sapiens
cgcgggaggggccuccacgcaacguggcccugcuucaggugaucauacugugcaacugcaaugc

SEQ ID NO: 392391 - RNA, 64 nt, Homo Sapiens
cauuuaccaguguucuuguuguguggccugcaguucaggugauaagggacacacucgugagcau

SEQ ID NO: 392392 - RNA, 64 nt, Homo Sapiens
cccucccgauccugaaagggcugagaauauacccucaggugacucgcaugucauguuuagccca

SEQ ID NO: 392393 - RNA, 64 nt, Homo Sapiens; identical to SEQ ID NO: 73453

SEQ ID NO: 392394 - RNA, 64 nt, Homo Sapiens; identical to SEQ ID NO: 73454

SEQ ID NO: 392395 - RNA, 64 nt, Homo Sapiens; identical to SEQ ID NO: 73455

SEQ ID NO: 392396 - RNA, 64 nt, Homo Sapiens; identical to SEQ ID NO: 73456

SEQ ID NO: 392397 - RNA, 64 nt, Homo Sapiens; identical to SEQ ID NO: 73457

SEQ ID NO: 392398 - RNA, 64 nt, Homo Sapiens; identical to SEQ ID NO: 73458

SEQ ID NO: 392399 - RNA, 64 nt, Homo Sapiens; identical to SEQ ID NO: 73459

SEQ ID NO: 392400 - RNA, 64 nt, Homo Sapiens; identical to SEQ ID NO: 73460

SEQ ID NO: 392401 - RNA, 64 nt, Homo Sapiens; identical to SEQ ID NO: 73461

SEQ ID NO: 392402 - RNA, 64 nt, Homo Sapiens; identical to SEQ ID NO: 73462

SEQ ID NO: 392403 - RNA, 64 nt, Homo Sapiens; identical to SEQ ID NO: 73463

SEQ ID NO: 392404 - RNA, 64 nt, Homo Sapiens; identical to SEQ ID NO: 73464

SEQ ID NO: 392405 - RNA, 64 nt, Homo Sapiens; identical to SEQ ID NO: 73465

SEQ ID NO: 392406 - RNA, 64 nt, Homo Sapiens; identical to SEQ ID NO: 73466

SEQ ID NO: 392407 - RNA, 64 nt, Homo Sapiens; identical to SEQ ID NO: 73467

SEQ ID NO: 392408 - RNA, 64 nt, Homo Sapiens; identical to SEQ ID NO: 73468

SEQ ID NO: 392409 - RNA, 64 nt, Homo Sapiens; identical to SEQ ID NO: 73469

SEQ ID NO: 392410 - RNA, 64 nt, Homo Sapiens; identical to SEQ ID NO: 73470

SEQ ID NO: 392411 - RNA, 64 nt, Homo Sapiens; identical to SEQ ID NO: 73471

SEQ ID NO: 392412 - RNA, 64 nt, Homo Sapiens; identical to SEQ ID NO: 73472

SEQ ID NO: 392413 - RNA, 64 nt, Homo Sapiens; identical to SEQ ID NO: 73473

SEQ ID NO: 392414 - RNA, 64 nt, Homo Sapiens; identical to SEQ ID NO: 73474

SEQ ID NO: 392415 - RNA, 64 nt, Homo Sapiens; identical to SEQ ID NO: 73475

SEQ ID NO: 392416 - RNA, 64 nt, Homo Sapiens; identical to SEQ ID NO: 73476

SEQ ID NO: 392417 - RNA, 64 nt, Homo Sapiens; identical to SEQ ID NO: 73477

SEQ ID NO: 392418 - RNA, 64 nt, Homo Sapiens; identical to SEQ ID NO: 73478

SEQ ID NO: 392419 - RNA, 64 nt, Homo Sapiens; identical to SEQ ID NO: 73479

SEQ ID NO: 392420 - RNA, 64 nt, Homo Sapiens; identical to SEQ ID NO: 73480

SEQ ID NO: 392421 - RNA, 64 nt, Homo Sapiens; identical to SEQ ID NO: 73481

SEQ ID NO: 392422 - RNA, 64 nt, Homo Sapiens; identical to SEQ ID NO: 73482

SEQ ID NO: 392423 - RNA, 64 nt, Homo Sapiens; identical to SEQ ID NO: 73483

SEQ ID NO: 392424 - RNA, 64 nt, Homo Sapiens; identical to SEQ ID NO: 73484

SEQ ID NO: 392425 - RNA, 64 nt, Homo Sapiens; identical to SEQ ID NO: 73485

SEQ ID NO: 392426 - RNA, 64 nt, Homo Sapiens; identical to SEQ ID NO: 73486

SEQ ID NO: 392427 - RNA, 64 nt, Homo Sapiens; identical to SEQ ID NO: 73487

SEQ ID NO: 392428 - RNA, 64 nt, Homo Sapiens; identical to SEQ ID NO: 73488

SEQ ID NO: 392429 - RNA, 64 nt, Homo Sapiens; identical to SEQ ID NO: 73489

SEQ ID NO: 392430 - RNA, 64 nt, Homo Sapiens; identical to SEQ ID NO: 73490

SEQ ID NO: 392431 - RNA, 64 nt, Homo Sapiens; identical to SEQ ID NO: 73491

SEQ ID NO: 392432 - RNA, 64 nt, Homo Sapiens; identical to SEQ ID NO: 73492

SEQ ID NO: 392433 - RNA, 64 nt, Homo Sapiens; identical to SEQ ID NO: 73493

SEQ ID NO: 392434 - RNA, 64 nt, Homo Sapiens; identical to SEQ ID NO: 73494

SEQ ID NO: 392435 - RNA, 64 nt, Homo Sapiens; identical to SEQ ID NO: 73495

SEQ ID NO: 392436 - RNA, 64 nt, Homo Sapiens; identical to SEQ ID NO: 73496

SEQ ID NO: 392437 - RNA, 64 nt, Homo Sapiens; identical to SEQ ID NO: 73497

SEQ ID NO: 392438 - RNA, 64 nt, Homo Sapiens; identical to SEQ ID NO: 73498

SEQ ID NO: 392439 - RNA, 64 nt, Homo Sapiens; identical to SEQ ID NO: 73499

SEQ ID NO: 392440 - RNA, 64 nt, Homo Sapiens; identical to SEQ ID NO: 73500

SEQ ID NO: 392441 - RNA, 64 nt, Homo Sapiens; identical to SEQ ID NO: 73501

SEQ ID NO: 392442 - RNA, 64 nt, Homo Sapiens; identical to SEQ ID NO: 73502

SEQ ID NO: 392443 - RNA, 64 nt, Homo Sapiens; identical to SEQ ID NO: 73503

SEQ ID NO: 392444 - RNA, 64 nt, Homo Sapiens; identical to SEQ ID NO: 73504

SEQ ID NO: 392445 - RNA, 64 nt, Homo Sapiens; identical to SEQ ID NO: 73505

SEQ ID NO: 392446 - RNA, 64 nt, Homo Sapiens; identical to SEQ ID NO: 73506

SEQ ID NO: 392447 - RNA, 64 nt, Homo Sapiens; identical to SEQ ID NO: 73507

SEQ ID NO: 392448 - RNA, 64 nt, Homo Sapiens; identical to SEQ ID NO: 73508

SEQ ID NO: 392449 - RNA, 64 nt, Homo Sapiens; identical to SEQ ID NO: 73509

SEQ ID NO: 392450 - RNA, 64 nt, Homo Sapiens; identical to SEQ ID NO: 73510

SEQ ID NO: 392451 - RNA, 64 nt, Homo Sapiens; identical to SEQ ID NO: 73511

SEQ ID NO: 392452 - RNA, 64 nt, Homo Sapiens; identical to SEQ ID NO: 73512

SEQ ID NO: 392453 - RNA, 64 nt, Homo Sapiens; identical to SEQ ID NO: 73513

SEQ ID NO: 392454 - RNA, 64 nt, Homo Sapiens; identical to SEQ ID NO: 165842

SEQ ID NO: 392455 - RNA, 64 nt, Homo Sapiens; identical to SEQ ID NO: 165843

SEQ ID NO: 392456 - RNA, 64 nt, Homo Sapiens; identical to SEQ ID NO: 305640

SEQ ID NO: 392457 - RNA, 64 nt, Homo Sapiens; identical to SEQ ID NO: 305641

SEQ ID NO: 392458 - RNA, 64 nt, Homo Sapiens
ugaugauugcuugagcaacaggcagguuaucugccugguugaauucugguugaaccguguauuc

SEQ ID NO: 392459 - RNA, 64 nt, Homo Sapiens
ugagcaacaggcagguuaucugccugguugaauucugguugaaccguguauucuaauauuucug

SEQ ID NO: 392460 - RNA, 64 nt, Homo Sapiens
cugacaagugcgagguucccaaauccaagcugcucugguugaagggagguucagggugcugacg

SEQ ID NO: 392461 - RNA, 64 nt, Homo Sapiens
cucaaguccuacagguuccucugucucaccucuucugguugaucgcucagucccugcacuguga

SEQ ID NO: 392462 - RNA, 64 nt, Homo Sapiens; identical to SEQ ID NO: 164794

SEQ ID NO: 392463 - RNA, 64 nt, Homo Sapiens; identical to SEQ ID NO: 164795

SEQ ID NO: 392464 - RNA, 64 nt, Homo Sapiens; identical to SEQ ID NO: 164796

SEQ ID NO: 392465 - RNA, 64 nt, Homo Sapiens; identical to SEQ ID NO: 164797

SEQ ID NO: 392466 - RNA, 64 nt, Homo Sapiens; identical to SEQ ID NO: 164798

SEQ ID NO: 392467 - RNA, 64 nt, Homo Sapiens; identical to SEQ ID NO: 164799

SEQ ID NO: 392468 - RNA, 64 nt, Homo Sapiens; identical to SEQ ID NO: 164800

SEQ ID NO: 392469 - RNA, 64 nt, Homo Sapiens; identical to SEQ ID NO: 164801

SEQ ID NO: 392470 - RNA, 64 nt, Homo Sapiens; identical to SEQ ID NO: 164802

SEQ ID NO: 392471 - RNA, 64 nt, Homo Sapiens; identical to SEQ ID NO: 164803

SEQ ID NO: 392472 - RNA, 64 nt, Homo Sapiens; identical to SEQ ID NO: 164804

SEQ ID NO: 392473 - RNA, 64 nt, Homo Sapiens; identical to SEQ ID NO: 164805

SEQ ID NO: 392474 - RNA, 64 nt, Homo Sapiens; identical to SEQ ID NO: 164806

SEQ ID NO: 392475 - RNA, 64 nt, Homo Sapiens; identical to SEQ ID NO: 164807

SEQ ID NO: 392476 - RNA, 64 nt, Homo Sapiens; identical to SEQ ID NO: 164808

SEQ ID NO: 392477 - RNA, 64 nt, Homo Sapiens; identical to SEQ ID NO: 164809

SEQ ID NO: 392478 - RNA, 64 nt, Homo Sapiens; identical to SEQ ID NO: 164810

SEQ ID NO: 392479 - RNA, 64 nt, Homo Sapiens; identical to SEQ ID NO: 164811

SEQ ID NO: 392480 - RNA, 64 nt, Homo Sapiens; identical to SEQ ID NO: 164812

SEQ ID NO: 392481 - RNA, 64 nt, Homo Sapiens; identical to SEQ ID NO: 164813

SEQ ID NO: 392482 - RNA, 64 nt, Homo Sapiens; identical to SEQ ID NO: 164814

SEQ ID NO: 392483 - RNA, 64 nt, Homo Sapiens; identical to SEQ ID NO: 164815

SEQ ID NO: 392484 - RNA, 64 nt, Homo Sapiens; identical to SEQ ID NO: 164816

SEQ ID NO: 392485 - RNA, 64 nt, Homo Sapiens; identical to SEQ ID NO: 164817

SEQ ID NO: 392486 - RNA, 64 nt, Homo Sapiens; identical to SEQ ID NO: 164818

SEQ ID NO: 392487 - RNA, 64 nt, Homo Sapiens; identical to SEQ ID NO: 164819

SEQ ID NO: 392488 - RNA, 64 nt, Homo Sapiens; identical to SEQ ID NO: 164820

SEQ ID NO: 392489 - RNA, 64 nt, Homo Sapiens; identical to SEQ ID NO: 164821

SEQ ID NO: 392490 - RNA, 64 nt, Homo Sapiens; identical to SEQ ID NO: 164822

SEQ ID NO: 392491 - RNA, 64 nt, Homo Sapiens; identical to SEQ ID NO: 164823

SEQ ID NO: 392492 - RNA, 64 nt, Homo Sapiens; identical to SEQ ID NO: 164824

SEQ ID NO: 392493 - RNA, 64 nt, Homo Sapiens; identical to SEQ ID NO: 164825

SEQ ID NO: 392494 - RNA, 64 nt, Homo Sapiens; identical to SEQ ID NO: 164826

SEQ ID NO: 392495 - RNA, 64 nt, Homo Sapiens; identical to SEQ ID NO: 164827

SEQ ID NO: 392496 - RNA, 64 nt, Homo Sapiens; identical to SEQ ID NO: 164828

SEQ ID NO: 392497 - RNA, 64 nt, Homo Sapiens; identical to SEQ ID NO: 365141

SEQ ID NO: 392498 - RNA, 64 nt, Homo Sapiens; identical to SEQ ID NO: 365142

SEQ ID NO: 392499 - RNA, 64 nt, Homo Sapiens; identical to SEQ ID NO: 365143

SEQ ID NO: 392500 - RNA, 64 nt, Homo Sapiens; identical to SEQ ID NO: 365144

SEQ ID NO: 392501 - RNA, 64 nt, Homo Sapiens; identical to SEQ ID NO: 365145

SEQ ID NO: 392502 - RNA, 64 nt, Homo Sapiens; identical to SEQ ID NO: 365146

SEQ ID NO: 392503 - RNA, 64 nt, Homo Sapiens; identical to SEQ ID NO: 365147

SEQ ID NO: 392504 - RNA, 64 nt, Homo Sapiens; identical to SEQ ID NO: 365148

SEQ ID NO: 392505 - RNA, 64 nt, Homo Sapiens; identical to SEQ ID NO: 365149

SEQ ID NO: 392506 - RNA, 64 nt, Homo Sapiens; identical to SEQ ID NO: 365150

SEQ ID NO: 392507 - RNA, 64 nt, Homo Sapiens; identical to SEQ ID NO: 365151

SEQ ID NO: 392508 - RNA, 64 nt, Homo Sapiens; identical to SEQ ID NO: 365152

SEQ ID NO: 392509 - RNA, 64 nt, Homo Sapiens; identical to SEQ ID NO: 365153

SEQ ID NO: 392510 - RNA, 64 nt, Homo Sapiens; identical to SEQ ID NO: 365154

SEQ ID NO: 392511 - RNA, 64 nt, Homo Sapiens; identical to SEQ ID NO: 365155

SEQ ID NO: 392512 - RNA, 64 nt, Homo Sapiens; identical to SEQ ID NO: 365156

SEQ ID NO: 392513 - RNA, 64 nt, Homo Sapiens; identical to SEQ ID NO: 365157

SEQ ID NO: 392514 - RNA, 64 nt, Homo Sapiens; identical to SEQ ID NO: 365158

SEQ ID NO: 392515 - RNA, 64 nt, Homo Sapiens; identical to SEQ ID NO: 365159

SEQ ID NO: 392516 - RNA, 64 nt, Homo Sapiens; identical to SEQ ID NO: 365160

SEQ ID NO: 392517 - RNA, 64 nt, Homo Sapiens; identical to SEQ ID NO: 365161

SEQ ID NO: 392518 - RNA, 64 nt, Homo Sapiens; identical to SEQ ID NO: 365162

SEQ ID NO: 392519 - RNA, 64 nt, Homo Sapiens; identical to SEQ ID NO: 365163

SEQ ID NO: 392520 - RNA, 64 nt, Homo Sapiens; identical to SEQ ID NO: 365164

SEQ ID NO: 392521 - RNA, 64 nt, Homo Sapiens; identical to SEQ ID NO: 365165

SEQ ID NO: 392522 - RNA, 64 nt, Homo Sapiens; identical to SEQ ID NO: 365166

SEQ ID NO: 392523 - RNA, 64 nt, Homo Sapiens; identical to SEQ ID NO: 365167

SEQ ID NO: 392524 - RNA, 64 nt, Homo Sapiens
ucucauguuuacagugcacggaguguggaagggggucuaggagagggagagcuggaaaaggagc

SEQ ID NO: 392525 - RNA, 64 nt, Homo Sapiens
ggaagauggcuuuggccuggagguagcuaggguggucuaggaagcucacuccucucuuagucuc

SEQ ID NO: 392526 - RNA, 64 nt, Homo Sapiens
ucaccuugcugugucuucucucggagccuggcuagucuaggacagggacagacagcucuuccuu

SEQ ID NO: 392527 - RNA, 64 nt, Homo Sapiens
agcugcuuuaucagggagcuaacuccaaaaggcugucuaggaugugaggaaggacaguuacgcu

SEQ ID NO: 392528 - RNA, 64 nt, Homo Sapiens
auucaacguguggucauaugauaaauaagugauuuauaaacaagagugauauuuugcuagggcu

SEQ ID NO: 392529 - RNA, 64 nt, Homo Sapiens
cauugucuccuucccaucuuaguaccauuguaguuauaaacaucugcauuuuuuagaagcauuu

SEQ ID NO: 392530 - RNA, 64 nt, Homo Sapiens
gagcaguucuugaugaaccucaccccuucucccuuauaaacaauagggacuaugcuccuuggcu

SEQ ID NO: 392531 - RNA, 64 nt, Homo Sapiens
agcaucugaaauaauugugccuuauuagaacugcuauaaacaaauuaagcagaaguucuaccac

SEQ ID NO: 392532 - RNA, 64 nt, Homo Sapiens
uuggauuuuuuuaaucacucauaugguagaauuuuauaaacacauacaugauaccauccaaauu

SEQ ID NO: 392533 - RNA, 64 nt, Homo Sapiens
aauuucaaaguugucauuaauuuaguaagccuaauauaaacaaauauuuguauuauuuuuguua

SEQ ID NO: 392534 - RNA, 64 nt, Homo Sapiens
uuagcaaucauuuuauauaauuccauuucuacuguauaaacaaaguaaauauaaauuuuguccc

SEQ ID NO: 392535 - RNA, 64 nt, Homo Sapiens
aagggaaaauuagcuuuuagaccuagcuaaggucuauaaacauguacccuuauugccccaagag

SEQ ID NO: 392536 - RNA, 64 nt, Homo Sapiens
uauauauguauauauauauacauauauauauauauauaaacaugaaauauauauauauggcucc

SEQ ID NO: 392537 - RNA, 64 nt, Homo Sapiens
aucaguucaaauaaguuuuaauugucaaaugaaguauaaacacaugaacuuucuagaaauauuu

SEQ ID NO: 392538 - RNA, 64 nt, Homo Sapiens
aacccuuucuaggcuuuaacauuguaaauaauccuauaaacaguuugauuuuuuaagaugauuu

SEQ ID NO: 392539 - RNA, 64 nt, Homo Sapiens
uugaacuuauuuuaauucuuauaauuugcaccuauauaaacaaagcuccuacuguauucuucuc

SEQ ID NO: 392540 - RNA, 64 nt, Homo Sapiens
auauauaauuuaaaggaaaaauaggugccuccuuuauaaacaguaauagcuacguuugggaagg

SEQ ID NO: 392541 - RNA, 64 nt, Homo Sapiens
ugugcuuacauacuuaaaaggauaucauuaaguauauaaacaaucauuacuucuguauuuuuaa

SEQ ID NO: 392542 - RNA, 64 nt, Homo Sapiens
uauuuacaugauuaauccaccaggcaugacuagguauaaacauauaauuacuuucaauuuccuc

SEQ ID NO: 392543 - RNA, 64 nt, Homo Sapiens
gaucaauagaguaaaauaucaggaaauggaauaguauaaacacuuuaaauuaaacauuggcaaa

SEQ ID NO: 392544 - RNA, 64 nt, Homo Sapiens
uauucuuuacuaaaauaaaauaaauguuuuuaaauauaaacaaagaaaaugcagaaugucuuuu

SEQ ID NO: 392545 - RNA, 64 nt, Homo Sapiens
gagcuagaaucauauuaucauuuguaauacugaauauaaacauaauauuuuagaaaauauuccu

SEQ ID NO: 392546 - RNA, 64 nt, Homo Sapiens
uaaagucuugugagcaccuggaauuauuaaccuuuauaaacauuagacauagaacccuuauaaa

SEQ ID NO: 392547 - RNA, 64 nt, Homo Sapiens
gaucaagaauucuaccaucccuugggucuuuguguauaaacaauguuaaauaaagguagacuca

SEQ ID NO: 392548 - RNA, 64 nt, Homo Sapiens
auuagacaguuuuuuuaguccaugggauuguaaauauaaacauuaacuuuccuauaagaauauu

SEQ ID NO: 392549 - RNA, 64 nt, Homo Sapiens
gaguacuuacugaauuuaguuuuuucaauauuuuuauaaacauuagcuuauuuccuuucagucu

SEQ ID NO: 392550 - RNA, 64 nt, Homo Sapiens
aagccaggcuuuugaacugugugacuuacaguuguauaaacaggaccuuguagcuagcaauaag

SEQ ID NO: 392551 - RNA, 64 nt, Homo Sapiens
agcucugccugagguaaaguaaacuucagccucuuauaaacaagagugauagagagcugcaggc

SEQ ID NO: 392552 - RNA, 64 nt, Homo Sapiens
uagggguuaggauuuaacaugaauuuuggggacauauaaacauuaagucuguaguagcagcagc

SEQ ID NO: 392553 - RNA, 64 nt, Homo Sapiens
uuauguauuuacuuacuaauuuuacuuuuuaaaguauaaacaaaauaauugcaguuucacaagg

SEQ ID NO: 392554 - RNA, 64 nt, Homo Sapiens
aaugcacugugagauaugugauucaggacacacuuauaaacacagucaaaauccugcaugugcu

SEQ ID NO: 392555 - RNA, 64 nt, Homo Sapiens
uuuuucagaccaaaaaaaacauauuaguuuugaauauaaacauccuuucuguuacaccucuauu

SEQ ID NO: 392556 - RNA, 64 nt, Homo Sapiens
uguagaaguacacuguucaccuacaauacuucuauauaaacacuauuacugcugggggugcaug

SEQ ID NO: 392557 - RNA, 64 nt, Homo Sapiens
acuaauuucugaugaaaauaacuauaaacaaauuuauaaacauucugauaauaauuuacaaacu

SEQ ID NO: 392558 - RNA, 64 nt, Homo Sapiens
uuuauaaacauuacuaauuuaauuuacaaacuacuauaaacaaaacauuacuauuucugauaau

SEQ ID NO: 392559 - RNA, 64 nt, Homo Sapiens
gaacuuaauauguuucugugaaauuauuuuugccuauaaacagugcuuuuuuaguguagaccua

SEQ ID NO: 392560 - RNA, 64 nt, Homo Sapiens
uugcuuuuuuucaguuuugauuucaggagugagauauaaacauuaagucugauguuaauuuuug

SEQ ID NO: 392561 - RNA, 64 nt, Homo Sapiens
acagaaggagagauagaugaaaaaugugucacauuauaaacaauuuucccuagucaaugcucug

SEQ ID NO: 392562 - RNA, 64 nt, Homo Sapiens
acggaaggggagauaggugagugucacauuauauuauaaacaaucuagucagugcucugaagau

SEQ ID NO: 392563 - RNA, 64 nt, Homo Sapiens
uauauaaagauguugacucuaguuuauuauaaaauauaaacagaaucuguugcauguacuuuaa

SEQ ID NO: 392564 - RNA, 64 nt, Homo Sapiens
gauaccugauaauagauauuuugggaaacacauuuauaaacaugucugauguugaugcaugucu

SEQ ID NO: 392565 - RNA, 64 nt, Homo Sapiens
aucaaaauggcagaaccauuuucacacccuguuuuauaaacaaccugaaguugugguuguuagg

SEQ ID NO: 392566 - RNA, 64 nt, Homo Sapiens
cuuaaguauagccuaagaaguuaucuuagcauuguauaaacagcaaguuggagaagucuugcag

SEQ ID NO: 392567 - RNA, 64 nt, Homo Sapiens
gguccucaguuugcagugcucuagcuccuggcagaagcaagagggaaacauuccuaauuuaguu

SEQ ID NO: 392568 - RNA, 64 nt, Homo Sapiens
uuaaaagcaaccauggggagaaaaagaucagugaaagcaagacagucaaauacuuaguaggcuu

SEQ ID NO: 392569 - RNA, 64 nt, Homo Sapiens
cuagucucaugagcccuuugcauucuuuccccuuaagcaagaauagaauguaguggaaauuuau

SEQ ID NO: 392570 - RNA, 64 nt, Homo Sapiens
uacugacuaccugggguaggcacauuauguguuaaagcaagacagaggccagagaggggcaggu

SEQ ID NO: 392571 - RNA, 64 nt, Homo Sapiens
aaaagacagcagcaucaagaggaagaagcaggaaaagcaagaagagagcagagcaugcagugau

SEQ ID NO: 392572 - RNA, 64 nt, Homo Sapiens
aagaaaaggcgacaucaagacagaacaucagaaaaagcaagaagagcacccagaacaugcugag

SEQ ID NO: 392573 - RNA, 64 nt, Homo Sapiens
ucuauauuuguuuuuuuaaaaaaaaguuacguggaagcaagauuaacaauggacauuaguuuuu

SEQ ID NO: 392574 - RNA, 64 nt, Homo Sapiens
aaucuggaaggaacaaaaauauaauugucuacagaagcaagagcuguugaauaauaauuagcau

SEQ ID NO: 392575 - RNA, 64 nt, Homo Sapiens
ccuaugguuucacauagacgugcagugugaaccaaagcaagacugaaugugacuguaaauaauu

SEQ ID NO: 392576 - RNA, 64 nt, Homo Sapiens
gaguauaaaagaucucuggcuuugcugaaauuuuaagcaagaaguucuauuuaauggagauguc

SEQ ID NO: 392577 - RNA, 64 nt, Homo Sapiens
aaauguguuacaugggaagaaaaagauuaagaaaaagcaagauaauuuugaagaaggacgagag

SEQ ID NO: 392578 - RNA, 64 nt, Homo Sapiens
uuucaugauuuugcaaaugggaaggauuucuuuaaagcaagacacaaaagcauacacaggaaaa

SEQ ID NO: 392579 - RNA, 64 nt, Homo Sapiens
ugucuugauaccuugguuugucccagcugaagugaagcaagagaguuugaauuaauuuuuccau

SEQ ID NO: 392580 - RNA, 64 nt, Homo Sapiens
caugauugcgccacugcacucagcccgggugacaaagcaagacccugucucagaaaaaaagaaa

SEQ ID NO: 392581 - RNA, 64 nt, Homo Sapiens
caauaaacugguuguauggccauagcuauccgaaaagcaagagacaaagcaagacaaauauuca

SEQ ID NO: 392582 - RNA, 64 nt, Homo Sapiens
uguauggccauagcuauccgaaaagcaagagacaaagcaagacaaauauucacacaaaaaugaa

SEQ ID NO: 392583 - RNA, 64 nt, Homo Sapiens
ugggugggagaauguauccuaaucuuuguccgggaagcaagaagcaucugcuaaugggagacca

SEQ ID NO: 392584 - RNA, 64 nt, Homo Sapiens
ccugaucuuucaugcugcacugaggcugguuaggaagcaagaguaggucccuguccucugucuu

SEQ ID NO: 392585 - RNA, 64 nt, Homo Sapiens
aaggaagaaagaaaaagacaaaaagaaaaagaaaaagcaagaagucuugcuuucuuucuuaaaa

SEQ ID NO: 392586 - RNA, 64 nt, Homo Sapiens
caaaucucuugcuuucuuucggaggcccccccagaagcaagauuaugacaauagagggccacgg

SEQ ID NO: 392587 - RNA, 64 nt, Homo Sapiens
ccacuugaaugcaaaggaaaacacuugcacagcaaagcaagagaagucacagcagcaagacacg

SEQ ID NO: 392588 - RNA, 64 nt, Homo Sapiens
gaugacucuccuuugaaaugagaaaaagaaaagaaagcaagaacagaaaacgaagccacaggaa

SEQ ID NO: 392589 - RNA, 64 nt, Homo Sapiens; identical to SEQ ID NO: 21897

SEQ ID NO: 392590 - RNA, 64 nt, Homo Sapiens; identical to SEQ ID NO: 21898

SEQ ID NO: 392591 - RNA, 64 nt, Homo Sapiens; identical to SEQ ID NO: 21899

SEQ ID NO: 392592 - RNA, 64 nt, Homo Sapiens; identical to SEQ ID NO: 21900

SEQ ID NO: 392593 - RNA, 64 nt, Homo Sapiens; identical to SEQ ID NO: 21901

SEQ ID NO: 392594 - RNA, 64 nt, Homo Sapiens; identical to SEQ ID NO: 21902

SEQ ID NO: 392595 - RNA, 64 nt, Homo Sapiens; identical to SEQ ID NO: 21903

SEQ ID NO: 392596 - RNA, 64 nt, Homo Sapiens; identical to SEQ ID NO: 21904

SEQ ID NO: 392597 - RNA, 64 nt, Homo Sapiens; identical to SEQ ID NO: 21905

SEQ ID NO: 392598 - RNA, 64 nt, Homo Sapiens; identical to SEQ ID NO: 21906

SEQ ID NO: 392599 - RNA, 64 nt, Homo Sapiens; identical to SEQ ID NO: 21907

SEQ ID NO: 392600 - RNA, 64 nt, Homo Sapiens; identical to SEQ ID NO: 21908

SEQ ID NO: 392601 - RNA, 64 nt, Homo Sapiens; identical to SEQ ID NO: 21909

SEQ ID NO: 392602 - RNA, 64 nt, Homo Sapiens; identical to SEQ ID NO: 21910

SEQ ID NO: 392603 - RNA, 64 nt, Homo Sapiens; identical to SEQ ID NO: 21911

SEQ ID NO: 392604 - RNA, 64 nt, Homo Sapiens; identical to SEQ ID NO: 21912

SEQ ID NO: 392605 - RNA, 64 nt, Homo Sapiens; identical to SEQ ID NO: 21913

SEQ ID NO: 392606 - RNA, 64 nt, Homo Sapiens; identical to SEQ ID NO: 21914

SEQ ID NO: 392607 - RNA, 64 nt, Homo Sapiens; identical to SEQ ID NO: 21915

SEQ ID NO: 392608 - RNA, 64 nt, Homo Sapiens; identical to SEQ ID NO: 21916

SEQ ID NO: 392609 - RNA, 64 nt, Homo Sapiens; identical to SEQ ID NO: 21917

SEQ ID NO: 392610 - RNA, 64 nt, Homo Sapiens; identical to SEQ ID NO: 21918

SEQ ID NO: 392611 - RNA, 64 nt, Homo Sapiens; identical to SEQ ID NO: 21919

SEQ ID NO: 392612 - RNA, 64 nt, Homo Sapiens; identical to SEQ ID NO: 21920

SEQ ID NO: 392613 - RNA, 64 nt, Homo Sapiens; identical to SEQ ID NO: 21921

SEQ ID NO: 392614 - RNA, 64 nt, Homo Sapiens; identical to SEQ ID NO: 21922

SEQ ID NO: 392615 - RNA, 64 nt, Homo Sapiens; identical to SEQ ID NO: 21923

SEQ ID NO: 392616 - RNA, 64 nt, Homo Sapiens; identical to SEQ ID NO: 21924

SEQ ID NO: 392617 - RNA, 64 nt, Homo Sapiens; identical to SEQ ID NO: 21925

SEQ ID NO: 392618 - RNA, 64 nt, Homo Sapiens; identical to SEQ ID NO: 21926

SEQ ID NO: 392619 - RNA, 64 nt, Homo Sapiens; identical to SEQ ID NO: 21927

SEQ ID NO: 392620 - RNA, 64 nt, Homo Sapiens; identical to SEQ ID NO: 21928

SEQ ID NO: 392621 - RNA, 64 nt, Homo Sapiens; identical to SEQ ID NO: 21929

SEQ ID NO: 392622 - RNA, 64 nt, Homo Sapiens; identical to SEQ ID NO: 21930

SEQ ID NO: 392623 - RNA, 64 nt, Homo Sapiens; identical to SEQ ID NO: 21931

SEQ ID NO: 392624 - RNA, 64 nt, Homo Sapiens; identical to SEQ ID NO: 21932

SEQ ID NO: 392625 - RNA, 64 nt, Homo Sapiens; identical to SEQ ID NO: 21933

SEQ ID NO: 392626 - RNA, 64 nt, Homo Sapiens; identical to SEQ ID NO: 21934

SEQ ID NO: 392627 - RNA, 64 nt, Homo Sapiens; identical to SEQ ID NO: 21935

SEQ ID NO: 392628 - RNA, 64 nt, Homo Sapiens; identical to SEQ ID NO: 21936

SEQ ID NO: 392629 - RNA, 64 nt, Homo Sapiens; identical to SEQ ID NO: 21897

SEQ ID NO: 392630 - RNA, 64 nt, Homo Sapiens; identical to SEQ ID NO: 21898

SEQ ID NO: 392631 - RNA, 64 nt, Homo Sapiens; identical to SEQ ID NO: 21899

SEQ ID NO: 392632 - RNA, 64 nt, Homo Sapiens; identical to SEQ ID NO: 21900

SEQ ID NO: 392633 - RNA, 64 nt, Homo Sapiens; identical to SEQ ID NO: 21901

SEQ ID NO: 392634 - RNA, 64 nt, Homo Sapiens; identical to SEQ ID NO: 21902

SEQ ID NO: 392635 - RNA, 64 nt, Homo Sapiens; identical to SEQ ID NO: 21903

SEQ ID NO: 392636 - RNA, 64 nt, Homo Sapiens; identical to SEQ ID NO: 21904

SEQ ID NO: 392637 - RNA, 64 nt, Homo Sapiens; identical to SEQ ID NO: 21905

SEQ ID NO: 392638 - RNA, 64 nt, Homo Sapiens; identical to SEQ ID NO: 21906

SEQ ID NO: 392639 - RNA, 64 nt, Homo Sapiens; identical to SEQ ID NO: 21907

SEQ ID NO: 392640 - RNA, 64 nt, Homo Sapiens; identical to SEQ ID NO: 21908

SEQ ID NO: 392641 - RNA, 64 nt, Homo Sapiens; identical to SEQ ID NO: 21909

SEQ ID NO: 392642 - RNA, 64 nt, Homo Sapiens; identical to SEQ ID NO: 21910

SEQ ID NO: 392643 - RNA, 64 nt, Homo Sapiens; identical to SEQ ID NO: 21911

SEQ ID NO: 392644 - RNA, 64 nt, Homo Sapiens; identical to SEQ ID NO: 21912

SEQ ID NO: 392645 - RNA, 64 nt, Homo Sapiens; identical to SEQ ID NO: 21913

SEQ ID NO: 392646 - RNA, 64 nt, Homo Sapiens; identical to SEQ ID NO: 21914

SEQ ID NO: 392647 - RNA, 64 nt, Homo Sapiens; identical to SEQ ID NO: 21915

SEQ ID NO: 392648 - RNA, 64 nt, Homo Sapiens; identical to SEQ ID NO: 21916

SEQ ID NO: 392649 - RNA, 64 nt, Homo Sapiens; identical to SEQ ID NO: 21917

SEQ ID NO: 392650 - RNA, 64 nt, Homo Sapiens; identical to SEQ ID NO: 21918

SEQ ID NO: 392651 - RNA, 64 nt, Homo Sapiens; identical to SEQ ID NO: 21919

SEQ ID NO: 392652 - RNA, 64 nt, Homo Sapiens; identical to SEQ ID NO: 21920

SEQ ID NO: 392653 - RNA, 64 nt, Homo Sapiens; identical to SEQ ID NO: 21921

SEQ ID NO: 392654 - RNA, 64 nt, Homo Sapiens; identical to SEQ ID NO: 21922

SEQ ID NO: 392655 - RNA, 64 nt, Homo Sapiens; identical to SEQ ID NO: 21923

SEQ ID NO: 392656 - RNA, 64 nt, Homo Sapiens; identical to SEQ ID NO: 21924

SEQ ID NO: 392657 - RNA, 64 nt, Homo Sapiens; identical to SEQ ID NO: 21925

SEQ ID NO: 392658 - RNA, 64 nt, Homo Sapiens; identical to SEQ ID NO: 21926

SEQ ID NO: 392659 - RNA, 64 nt, Homo Sapiens; identical to SEQ ID NO: 21927

SEQ ID NO: 392660 - RNA, 64 nt, Homo Sapiens; identical to SEQ ID NO: 21928

SEQ ID NO: 392661 - RNA, 64 nt, Homo Sapiens; identical to SEQ ID NO: 21929

SEQ ID NO: 392662 - RNA, 64 nt, Homo Sapiens; identical to SEQ ID NO: 21930

SEQ ID NO: 392663 - RNA, 64 nt, Homo Sapiens; identical to SEQ ID NO: 21931

SEQ ID NO: 392664 - RNA, 64 nt, Homo Sapiens; identical to SEQ ID NO: 21932

SEQ ID NO: 392665 - RNA, 64 nt, Homo Sapiens; identical to SEQ ID NO: 21933

SEQ ID NO: 392666 - RNA, 64 nt, Homo Sapiens; identical to SEQ ID NO: 21934

SEQ ID NO: 392667 - RNA, 64 nt, Homo Sapiens; identical to SEQ ID NO: 21935

SEQ ID NO: 392668 - RNA, 64 nt, Homo Sapiens; identical to SEQ ID NO: 21936

SEQ ID NO: 392669 - RNA, 64 nt, Homo Sapiens; identical to SEQ ID NO: 21897

SEQ ID NO: 392670 - RNA, 64 nt, Homo Sapiens; identical to SEQ ID NO: 21898

SEQ ID NO: 392671 - RNA, 64 nt, Homo Sapiens; identical to SEQ ID NO: 21899

SEQ ID NO: 392672 - RNA, 64 nt, Homo Sapiens; identical to SEQ ID NO: 21900

SEQ ID NO: 392673 - RNA, 64 nt, Homo Sapiens; identical to SEQ ID NO: 21901

SEQ ID NO: 392674 - RNA, 64 nt, Homo Sapiens; identical to SEQ ID NO: 21902

SEQ ID NO: 392675 - RNA, 64 nt, Homo Sapiens; identical to SEQ ID NO: 21903

SEQ ID NO: 392676 - RNA, 64 nt, Homo Sapiens; identical to SEQ ID NO: 21904

SEQ ID NO: 392677 - RNA, 64 nt, Homo Sapiens; identical to SEQ ID NO: 21905

SEQ ID NO: 392678 - RNA, 64 nt, Homo Sapiens; identical to SEQ ID NO: 21906

SEQ ID NO: 392679 - RNA, 64 nt, Homo Sapiens; identical to SEQ ID NO: 21907

SEQ ID NO: 392680 - RNA, 64 nt, Homo Sapiens; identical to SEQ ID NO: 21908

SEQ ID NO: 392681 - RNA, 64 nt, Homo Sapiens; identical to SEQ ID NO: 21909

SEQ ID NO: 392682 - RNA, 64 nt, Homo Sapiens; identical to SEQ ID NO: 21910

SEQ ID NO: 392683 - RNA, 64 nt, Homo Sapiens; identical to SEQ ID NO: 21911

SEQ ID NO: 392684 - RNA, 64 nt, Homo Sapiens; identical to SEQ ID NO: 21912

SEQ ID NO: 392685 - RNA, 64 nt, Homo Sapiens; identical to SEQ ID NO: 21913

SEQ ID NO: 392686 - RNA, 64 nt, Homo Sapiens; identical to SEQ ID NO: 21914

SEQ ID NO: 392687 - RNA, 64 nt, Homo Sapiens; identical to SEQ ID NO: 21915

SEQ ID NO: 392688 - RNA, 64 nt, Homo Sapiens; identical to SEQ ID NO: 21916

SEQ ID NO: 392689 - RNA, 64 nt, Homo Sapiens; identical to SEQ ID NO: 21917

SEQ ID NO: 392690 - RNA, 64 nt, Homo Sapiens; identical to SEQ ID NO: 21918

SEQ ID NO: 392691 - RNA, 64 nt, Homo Sapiens; identical to SEQ ID NO: 21919

SEQ ID NO: 392692 - RNA, 64 nt, Homo Sapiens; identical to SEQ ID NO: 21920

SEQ ID NO: 392693 - RNA, 64 nt, Homo Sapiens; identical to SEQ ID NO: 21921

SEQ ID NO: 392694 - RNA, 64 nt, Homo Sapiens; identical to SEQ ID NO: 21922

SEQ ID NO: 392695 - RNA, 64 nt, Homo Sapiens; identical to SEQ ID NO: 21923

SEQ ID NO: 392696 - RNA, 64 nt, Homo Sapiens; identical to SEQ ID NO: 21924

SEQ ID NO: 392697 - RNA, 64 nt, Homo Sapiens; identical to SEQ ID NO: 21925

SEQ ID NO: 392698 - RNA, 64 nt, Homo Sapiens; identical to SEQ ID NO: 21926

SEQ ID NO: 392699 - RNA, 64 nt, Homo Sapiens; identical to SEQ ID NO: 21927

SEQ ID NO: 392700 - RNA, 64 nt, Homo Sapiens; identical to SEQ ID NO: 21928

SEQ ID NO: 392701 - RNA, 64 nt, Homo Sapiens; identical to SEQ ID NO: 21929

SEQ ID NO: 392702 - RNA, 64 nt, Homo Sapiens; identical to SEQ ID NO: 21930

SEQ ID NO: 392703 - RNA, 64 nt, Homo Sapiens; identical to SEQ ID NO: 21931

SEQ ID NO: 392704 - RNA, 64 nt, Homo Sapiens; identical to SEQ ID NO: 21932

SEQ ID NO: 392705 - RNA, 64 nt, Homo Sapiens; identical to SEQ ID NO: 21933

SEQ ID NO: 392706 - RNA, 64 nt, Homo Sapiens; identical to SEQ ID NO: 21934

SEQ ID NO: 392707 - RNA, 64 nt, Homo Sapiens; identical to SEQ ID NO: 21935

SEQ ID NO: 392708 - RNA, 64 nt, Homo Sapiens; identical to SEQ ID NO: 21936

SEQ ID NO: 392709 - RNA, 64 nt, Homo Sapiens
uuugugaucuugcugaagacuacaggcagccaaaugguuccagauacuucagcuuuguguaucu

SEQ ID NO: 392710 - RNA, 64 nt, Homo Sapiens
cauuauuucucauagcaggaaauguagagguagaugguuccaguaucagcauagugacuaaacu

SEQ ID NO: 392711 - RNA, 64 nt, Homo Sapiens
auugaccaaagaccaaaaaaaaaaaaaagaccugugguuccagaaagcucauuaguugagauuc

SEQ ID NO: 392712 - RNA, 64 nt, Homo Sapiens
aagcaguggcaauucuagauaucugagauuuugcugguuccaguuugcccaauggaguugagaa

SEQ ID NO: 392713 - RNA, 64 nt, Homo Sapiens
ugaggugggaggaucacuuggguuccaucaccugugguuccagcaaaauacaaaaaauuagccg

SEQ ID NO: 392714 - RNA, 64 nt, Homo Sapiens
ugugcagcugacuucugugaaggaaucuacggcuugguuccagccaaguggccgaaucaggcug

SEQ ID NO: 392715 - RNA, 64 nt, Homo Sapiens
uuuuuuuaaguucacuuuuuaacagcuaauagcaugguuccaauacuucuuauucacuuuugua

SEQ ID NO: 392716 - RNA, 64 nt, Homo Sapiens
caaauguccugcaauuuaggagaaaggaaaugaaugguuccacuuaaacagaaaugcucugauu

SEQ ID NO: 392717 - RNA, 64 nt, Homo Sapiens
guguccuauuuuauucaugcgcagaacugcccauucucauuacuugcuugagaaaguguacacu

SEQ ID NO: 392718 - RNA, 64 nt, Homo Sapiens
ugacaguaugcccauuuguuugugcaguuguauuucucauuaacagaguaauauuaauugugca

SEQ ID NO: 392719 - RNA, 64 nt, Homo Sapiens
gaugcuuaucuagguuuucaugcuuaccuaggauucucauuauaaaaaagauucucauuauaaa

SEQ ID NO: 392720 - RNA, 64 nt, Homo Sapiens
aaugcuuaccuaggauucucgaaugaaaaaagauucucauuauaacagauuaaaugaugcugag

SEQ ID NO: 392721 - RNA, 64 nt, Homo Sapiens
uuucagugugaugaaucacuguugcuuugaaaaaucucauuauuucugggccgggcaugguggc

SEQ ID NO: 392722 - RNA, 64 nt, Homo Sapiens
aaaaagaaaaaaagaaaaaaagaaaaaagaaaaaucucauuauuucaaaaugauagacauauac

SEQ ID NO: 392723 - RNA, 64 nt, Homo Sapiens
ugccuucuuucuucuguacuuugucuuuuuaaaaucucauuacuaucuauuauuuaguucuaac

SEQ ID NO: 392724 - RNA, 64 nt, Homo Sapiens
auuuuuuacuagugugucuuauauaauucuuucuucucauuaauucagugccuuuuuccucuaa

SEQ ID NO: 392725 - RNA, 64 nt, Homo Sapiens
gaagcugugccgcggagucgcuuacagaacaguuucucauuagaugaguguuucuccugcagca

SEQ ID NO: 392726 - RNA, 64 nt, Homo Sapiens
gcugcaguguccuucucaguuauggaggacaucgucucauuagggaacuuuuacaguucaaauu

SEQ ID NO: 392727 - RNA, 64 nt, Homo Sapiens
acguagguagagaauacaacaaagaguucuaagacuuagaaaagacaauuuuguggugucauuu

SEQ ID NO: 392728 - RNA, 64 nt, Homo Sapiens
cuauaauauacaaauuuuccuguaauaaagucaacuuagaaacuccaaggagguuacauguuuu

SEQ ID NO: 392729 - RNA, 64 nt, Homo Sapiens
aucaauauaacgcacaaucacaaguguaugaggacuuagaaauuaauccuuugugguaggaguu

SEQ ID NO: 392730 - RNA, 64 nt, Homo Sapiens
aauuugaaaaaucaucuagugugugaccuacaggcuuagaaaugguauagucaaagacauuuua

SEQ ID NO: 392731 - RNA, 64 nt, Homo Sapiens
aacuuuuuggauuuuguaaaagcauuuucauucucuuagaaauucaaguauuuucaaggggagu

SEQ ID NO: 392732 - RNA, 64 nt, Homo Sapiens
auacaaguuguucucuggagguuucuaugagguucuuagaaaaauuugguuuuaaaaucauuug

SEQ ID NO: 392733 - RNA, 64 nt, Homo Sapiens
caaccaaaggcaugugauugauuaaugauucccccuuagaaagcaaguguuaccaaaguugugu

SEQ ID NO: 392734 - RNA, 64 nt, Homo Sapiens
uuuuuuugcacaacauuucaauuauauuugugaacuuagaaauuaacuuacaaucuaaccagcc

SEQ ID NO: 392735 - RNA, 64 nt, Homo Sapiens
cuguugguuaaggcagcugcaagggggauaguaucuuagaaaacugaaagaggcagaaacaggu

SEQ ID NO: 392736 - RNA, 64 nt, Homo Sapiens
aacuuuuuuuuuuuuuugagacauacaggaagcucuuagaaaagguacuuuagggagcagccac

SEQ ID NO: 392737 - RNA, 64 nt, Homo Sapiens
guggaggugguacucaacagccuuauucaugaggcuuagaaaacacaaagacauuagaauaccu

SEQ ID NO: 392738 - RNA, 64 nt, Homo Sapiens
acuguaaacaggcuuuagucauuaaugugagagacuuagaaaaaaugcuuagaguggacuauua

SEQ ID NO: 392739 - RNA, 64 nt, Homo Sapiens
agaccacuuauacugucugucuggugguaggaaucuuagaaacaggauacuuggcccaaaguaa

SEQ ID NO: 392740 - RNA, 64 nt, Homo Sapiens
guaggcauggaaaauuccacuguuggaugucuuccuuagaaaggaagccagagcccacaugaac

SEQ ID NO: 392741 - RNA, 64 nt, Homo Sapiens
gcagauuuuagaucuaaugucuaaacauggugugcuuagaaacuugcagaaggaucugaaagau

SEQ ID NO: 392742 - RNA, 64 nt, Homo Sapiens
gauacuaaauccagagcuacuuacauagggccagcuuagaaauauaauucaaauaccaaauagu

SEQ ID NO: 392743 - RNA, 64 nt, Homo Sapiens
gaaagcaaacacaaaaccuuugcaaauucaggggcuuagaaaauuuagucagugauucuuuacu

SEQ ID NO: 392744 - RNA, 64 nt, Homo Sapiens
ucuacagucgucgauuuuuacaaauugugguacacuuagaaaauuguuacucugguuguugugc

SEQ ID NO: 392745 - RNA, 64 nt, Homo Sapiens
uuuuggauaugccacugcaaaaccuaaaagcccacuuagaaacucacaaggaggaaggaagggc

SEQ ID NO: 392746 - RNA, 64 nt, Homo Sapiens
acuaguggcugcccaauugcugcugaccaguugucuuagaaauggucaauuggauucaacuuua

SEQ ID NO: 392747 - RNA, 64 nt, Homo Sapiens
caaagauggcucaccaaucaccugccuguuuuuacuuagaaagcaggcuugggcaggaggggaa

SEQ ID NO: 392748 - RNA, 64 nt, Homo Sapiens
guuucacgcagauccuugguauuugagaugguaccuuagaaaaagcaguuccgugguugaauau

SEQ ID NO: 392749 - RNA, 64 nt, Homo Sapiens
guuacacgcaguuccgugguauuugagaugguaccuuagaaaaaucccaaucccaggccuugug

SEQ ID NO: 392750 - RNA, 64 nt, Homo Sapiens
augaaggugccauuuggcugacagaggcugcgaucuuagaaauauaauuuuaugaaaauuaagu

SEQ ID NO: 392751 - RNA, 64 nt, Homo Sapiens
ccuccauuuuuaugguaaaugcccaaaaauaagucuuagaaaauggagauuaaugaaaaugaau

SEQ ID NO: 392752 - RNA, 64 nt, Homo Sapiens
gcaguucuuacaccguuuggugauuuucauguuucuuagaaacuuuaaaccuuuaacuucaaac

SEQ ID NO: 392753 - RNA, 64 nt, Homo Sapiens
acauuaaaauacaagucuuuuaaguacaugagugcuuagaaauguacauaauguuuauauacac

SEQ ID NO: 392754 - RNA, 64 nt, Homo Sapiens
gaauuccuaaggggauugacccugagaccccugccuuagaaacauauguaugcaugugauggug

SEQ ID NO: 392755 - RNA, 64 nt, Homo Sapiens
uaaggaauaagucuuugaaccuugaaguuuuuuacuuagaaauaaaacugacuuuaaaagccuc

SEQ ID NO: 392756 - RNA, 64 nt, Homo Sapiens
guucugaaaaucaacaaccuuagaaggauuuugucuuagaaaauuuccuuggcuuuaguuuuau

SEQ ID NO: 392757 - RNA, 64 nt, Homo Sapiens
guucauucuuuuccuggaaaugaugacuuuauugcuuagaaaguuguaaauaauuaaaagcuuc

SEQ ID NO: 392758 - RNA, 64 nt, Homo Sapiens
acauacgcagcuaggaaguuugucauaaaaucaacuuagaaaugagaugaggcuguucaguuug

SEQ ID NO: 392759 - RNA, 64 nt, Homo Sapiens
ccuacuggagggauuuuugucuugaauuuguuuccuuagaaauucuacaaaaaaauguuguuaa

SEQ ID NO: 392760 - RNA, 64 nt, Homo Sapiens
uaagugacaaguauuuuuucugaacagaaguuuacuuagaaauaccaugcacuuggggguacca

SEQ ID NO: 392761 - RNA, 64 nt, Homo Sapiens
auuauucauuacugcauccccaguaaugaaaguacuuagaaaauaauuauugaaugaaugaaau

SEQ ID NO: 392762 - RNA, 64 nt, Homo Sapiens
ggaaauacuagauuugggagcuguuugggaagagcuuagaaacuaacacuguuaucauuuuuuc

SEQ ID NO: 392763 - RNA, 64 nt, Homo Sapiens
gugauaaaaucauaaguauuggcaaacauuuucucuuagaaaagaggaagguaaaaaguuaaca

SEQ ID NO: 392764 - RNA, 64 nt, Homo Sapiens; identical to SEQ ID NO: 282757

SEQ ID NO: 392765 - RNA, 64 nt, Homo Sapiens; identical to SEQ ID NO: 282758

SEQ ID NO: 392766 - RNA, 64 nt, Homo Sapiens; identical to SEQ ID NO: 282759

SEQ ID NO: 392767 - RNA, 64 nt, Homo Sapiens; identical to SEQ ID NO: 282760

SEQ ID NO: 392768 - RNA, 64 nt, Homo Sapiens; identical to SEQ ID NO: 282761

SEQ ID NO: 392769 - RNA, 64 nt, Homo Sapiens; identical to SEQ ID NO: 282762

SEQ ID NO: 392770 - RNA, 64 nt, Homo Sapiens; identical to SEQ ID NO: 282763

SEQ ID NO: 392771 - RNA, 64 nt, Homo Sapiens; identical to SEQ ID NO: 282764

SEQ ID NO: 392772 - RNA, 64 nt, Homo Sapiens; identical to SEQ ID NO: 282765

SEQ ID NO: 392773 - RNA, 64 nt, Homo Sapiens; identical to SEQ ID NO: 282766

SEQ ID NO: 392774 - RNA, 64 nt, Homo Sapiens; identical to SEQ ID NO: 282767

SEQ ID NO: 392775 - RNA, 64 nt, Homo Sapiens; identical to SEQ ID NO: 282768

SEQ ID NO: 392776 - RNA, 64 nt, Homo Sapiens; identical to SEQ ID NO: 282769

SEQ ID NO: 392777 - RNA, 64 nt, Homo Sapiens; identical to SEQ ID NO: 282770

SEQ ID NO: 392778 - RNA, 64 nt, Homo Sapiens; identical to SEQ ID NO: 282771

SEQ ID NO: 392779 - RNA, 64 nt, Homo Sapiens; identical to SEQ ID NO: 282772

SEQ ID NO: 392780 - RNA, 64 nt, Homo Sapiens; identical to SEQ ID NO: 90763

SEQ ID NO: 392781 - RNA, 64 nt, Homo Sapiens; identical to SEQ ID NO: 90764

SEQ ID NO: 392782 - RNA, 64 nt, Homo Sapiens; identical to SEQ ID NO: 90765

SEQ ID NO: 392783 - RNA, 64 nt, Homo Sapiens; identical to SEQ ID NO: 90766

SEQ ID NO: 392784 - RNA, 64 nt, Homo Sapiens; identical to SEQ ID NO: 90767

SEQ ID NO: 392785 - RNA, 64 nt, Homo Sapiens; identical to SEQ ID NO: 90768

SEQ ID NO: 392786 - RNA, 64 nt, Homo Sapiens; identical to SEQ ID NO: 90769

SEQ ID NO: 392787 - RNA, 64 nt, Homo Sapiens; identical to SEQ ID NO: 90770

SEQ ID NO: 392788 - RNA, 64 nt, Homo Sapiens; identical to SEQ ID NO: 90771

SEQ ID NO: 392789 - RNA, 64 nt, Homo Sapiens; identical to SEQ ID NO: 90772

SEQ ID NO: 392790 - RNA, 64 nt, Homo Sapiens; identical to SEQ ID NO: 90773

SEQ ID NO: 392791 - RNA, 64 nt, Homo Sapiens; identical to SEQ ID NO: 90774

SEQ ID NO: 392792 - RNA, 64 nt, Homo Sapiens; identical to SEQ ID NO: 90775

SEQ ID NO: 392793 - RNA, 64 nt, Homo Sapiens; identical to SEQ ID NO: 90776

SEQ ID NO: 392794 - RNA, 64 nt, Homo Sapiens; identical to SEQ ID NO: 90777

SEQ ID NO: 392795 - RNA, 64 nt, Homo Sapiens; identical to SEQ ID NO: 90778

SEQ ID NO: 392796 - RNA, 64 nt, Homo Sapiens; identical to SEQ ID NO: 90779

SEQ ID NO: 392797 - RNA, 64 nt, Homo Sapiens; identical to SEQ ID NO: 90780

SEQ ID NO: 392798 - RNA, 64 nt, Homo Sapiens; identical to SEQ ID NO: 90781

SEQ ID NO: 392799 - RNA, 64 nt, Homo Sapiens; identical to SEQ ID NO: 90782

SEQ ID NO: 392800 - RNA, 64 nt, Homo Sapiens; identical to SEQ ID NO: 90783

SEQ ID NO: 392801 - RNA, 64 nt, Homo Sapiens; identical to SEQ ID NO: 90784

SEQ ID NO: 392802 - RNA, 64 nt, Homo Sapiens; identical to SEQ ID NO: 90785

SEQ ID NO: 392803 - RNA, 64 nt, Homo Sapiens; identical to SEQ ID NO: 90786

SEQ ID NO: 392804 - RNA, 64 nt, Homo Sapiens; identical to SEQ ID NO: 90787

SEQ ID NO: 392805 - RNA, 64 nt, Homo Sapiens; identical to SEQ ID NO: 90788

SEQ ID NO: 392806 - RNA, 64 nt, Homo Sapiens; identical to SEQ ID NO: 90789

SEQ ID NO: 392807 - RNA, 64 nt, Homo Sapiens; identical to SEQ ID NO: 90790

SEQ ID NO: 392808 - RNA, 64 nt, Homo Sapiens; identical to SEQ ID NO: 90791

SEQ ID NO: 392809 - RNA, 64 nt, Homo Sapiens; identical to SEQ ID NO: 90792

SEQ ID NO: 392810 - RNA, 64 nt, Homo Sapiens; identical to SEQ ID NO: 90793

SEQ ID NO: 392811 - RNA, 64 nt, Homo Sapiens; identical to SEQ ID NO: 90794

SEQ ID NO: 392812 - RNA, 64 nt, Homo Sapiens; identical to SEQ ID NO: 90795

SEQ ID NO: 392813 - RNA, 64 nt, Homo Sapiens; identical to SEQ ID NO: 90796

SEQ ID NO: 392814 - RNA, 64 nt, Homo Sapiens; identical to SEQ ID NO: 90797

SEQ ID NO: 392815 - RNA, 64 nt, Homo Sapiens; identical to SEQ ID NO: 90798

SEQ ID NO: 392816 - RNA, 64 nt, Homo Sapiens; identical to SEQ ID NO: 90799

SEQ ID NO: 392817 - RNA, 64 nt, Homo Sapiens; identical to SEQ ID NO: 90800

SEQ ID NO: 392818 - RNA, 64 nt, Homo Sapiens; identical to SEQ ID NO: 90801

SEQ ID NO: 392819 - RNA, 64 nt, Homo Sapiens; identical to SEQ ID NO: 90802

SEQ ID NO: 392820 - RNA, 64 nt, Homo Sapiens; identical to SEQ ID NO: 90803

SEQ ID NO: 392821 - RNA, 64 nt, Homo Sapiens; identical to SEQ ID NO: 90804

SEQ ID NO: 392822 - RNA, 64 nt, Homo Sapiens; identical to SEQ ID NO: 90805

SEQ ID NO: 392823 - RNA, 64 nt, Homo Sapiens; identical to SEQ ID NO: 90806

SEQ ID NO: 392824 - RNA, 64 nt, Homo Sapiens; identical to SEQ ID NO: 90807

SEQ ID NO: 392825 - RNA, 64 nt, Homo Sapiens; identical to SEQ ID NO: 90808

SEQ ID NO: 392826 - RNA, 64 nt, Homo Sapiens; identical to SEQ ID NO: 90809

SEQ ID NO: 392827 - RNA, 64 nt, Homo Sapiens; identical to SEQ ID NO: 90810

SEQ ID NO: 392828 - RNA, 64 nt, Homo Sapiens; identical to SEQ ID NO: 90811

SEQ ID NO: 392829 - RNA, 64 nt, Homo Sapiens; identical to SEQ ID NO: 90812

SEQ ID NO: 392830 - RNA, 64 nt, Homo Sapiens; identical to SEQ ID NO: 90813

SEQ ID NO: 392831 - RNA, 64 nt, Homo Sapiens; identical to SEQ ID NO: 90814

SEQ ID NO: 392832 - RNA, 64 nt, Homo Sapiens; identical to SEQ ID NO: 90815

SEQ ID NO: 392833 - RNA, 64 nt, Homo Sapiens; identical to SEQ ID NO: 90816

SEQ ID NO: 392834 - RNA, 64 nt, Homo Sapiens; identical to SEQ ID NO: 90817

SEQ ID NO: 392835 - RNA, 64 nt, Homo Sapiens; identical to SEQ ID NO: 90818

SEQ ID NO: 392836 - RNA, 64 nt, Homo Sapiens; identical to SEQ ID NO: 90819

SEQ ID NO: 392837 - RNA, 64 nt, Homo Sapiens; identical to SEQ ID NO: 90820

SEQ ID NO: 392838 - RNA, 64 nt, Homo Sapiens; identical to SEQ ID NO: 90821

SEQ ID NO: 392839 - RNA, 64 nt, Homo Sapiens; identical to SEQ ID NO: 90822

SEQ ID NO: 392840 - RNA, 64 nt, Homo Sapiens; identical to SEQ ID NO: 90823

SEQ ID NO: 392841 - RNA, 64 nt, Homo Sapiens; identical to SEQ ID NO: 90824

SEQ ID NO: 392842 - RNA, 64 nt, Homo Sapiens; identical to SEQ ID NO: 90825

SEQ ID NO: 392843 - RNA, 64 nt, Homo Sapiens; identical to SEQ ID NO: 90826

SEQ ID NO: 392844 - RNA, 64 nt, Homo Sapiens; identical to SEQ ID NO: 90827

SEQ ID NO: 392845 - RNA, 64 nt, Homo Sapiens; identical to SEQ ID NO: 90828

SEQ ID NO: 392846 - RNA, 64 nt, Homo Sapiens; identical to SEQ ID NO: 90829

SEQ ID NO: 392847 - RNA, 64 nt, Homo Sapiens; identical to SEQ ID NO: 90830

SEQ ID NO: 392848 - RNA, 64 nt, Homo Sapiens; identical to SEQ ID NO: 90831

SEQ ID NO: 392849 - RNA, 64 nt, Homo Sapiens; identical to SEQ ID NO: 90832

SEQ ID NO: 392850 - RNA, 64 nt, Homo Sapiens; identical to SEQ ID NO: 90833

SEQ ID NO: 392851 - RNA, 64 nt, Homo Sapiens; identical to SEQ ID NO: 90834

SEQ ID NO: 392852 - RNA, 64 nt, Homo Sapiens; identical to SEQ ID NO: 90835

SEQ ID NO: 392853 - RNA, 64 nt, Homo Sapiens; identical to SEQ ID NO: 90836

SEQ ID NO: 392854 - RNA, 64 nt, Homo Sapiens; identical to SEQ ID NO: 90837

SEQ ID NO: 392855 - RNA, 64 nt, Homo Sapiens; identical to SEQ ID NO: 90838

SEQ ID NO: 392856 - RNA, 64 nt, Homo Sapiens; identical to SEQ ID NO: 90839

SEQ ID NO: 392857 - RNA, 64 nt, Homo Sapiens; identical to SEQ ID NO: 90840

SEQ ID NO: 392858 - RNA, 64 nt, Homo Sapiens; identical to SEQ ID NO: 90841

SEQ ID NO: 392859 - RNA, 64 nt, Homo Sapiens; identical to SEQ ID NO: 90842

SEQ ID NO: 392860 - RNA, 64 nt, Homo Sapiens; identical to SEQ ID NO: 90843

SEQ ID NO: 392861 - RNA, 64 nt, Homo Sapiens; identical to SEQ ID NO: 90844

SEQ ID NO: 392862 - RNA, 64 nt, Homo Sapiens; identical to SEQ ID NO: 90845

SEQ ID NO: 392863 - RNA, 64 nt, Homo Sapiens; identical to SEQ ID NO: 90846

SEQ ID NO: 392864 - RNA, 64 nt, Homo Sapiens; identical to SEQ ID NO: 90847

SEQ ID NO: 392865 - RNA, 64 nt, Homo Sapiens; identical to SEQ ID NO: 90848

SEQ ID NO: 392866 - RNA, 64 nt, Homo Sapiens; identical to SEQ ID NO: 90849

SEQ ID NO: 392867 - RNA, 64 nt, Homo Sapiens; identical to SEQ ID NO: 90850

SEQ ID NO: 392868 - RNA, 64 nt, Homo Sapiens; identical to SEQ ID NO: 90851

SEQ ID NO: 392869 - RNA, 64 nt, Homo Sapiens; identical to SEQ ID NO: 90852

SEQ ID NO: 392870 - RNA, 64 nt, Homo Sapiens; identical to SEQ ID NO: 90853

SEQ ID NO: 392871 - RNA, 64 nt, Homo Sapiens; identical to SEQ ID NO: 90854

SEQ ID NO: 392872 - RNA, 64 nt, Homo Sapiens; identical to SEQ ID NO: 90855

SEQ ID NO: 392873 - RNA, 64 nt, Homo Sapiens; identical to SEQ ID NO: 90856

SEQ ID NO: 392874 - RNA, 64 nt, Homo Sapiens; identical to SEQ ID NO: 90857

SEQ ID NO: 392875 - RNA, 64 nt, Homo Sapiens; identical to SEQ ID NO: 90858

SEQ ID NO: 392876 - RNA, 64 nt, Homo Sapiens; identical to SEQ ID NO: 90859

SEQ ID NO: 392877 - RNA, 64 nt, Homo Sapiens; identical to SEQ ID NO: 90860

SEQ ID NO: 392878 - RNA, 64 nt, Homo Sapiens; identical to SEQ ID NO: 90861

SEQ ID NO: 392879 - RNA, 64 nt, Homo Sapiens; identical to SEQ ID NO: 90862

SEQ ID NO: 392880 - RNA, 64 nt, Homo Sapiens; identical to SEQ ID NO: 90863

SEQ ID NO: 392881 - RNA, 64 nt, Homo Sapiens; identical to SEQ ID NO: 90864

SEQ ID NO: 392882 - RNA, 64 nt, Homo Sapiens; identical to SEQ ID NO: 90865

SEQ ID NO: 392883 - RNA, 64 nt, Homo Sapiens; identical to SEQ ID NO: 90866

SEQ ID NO: 392884 - RNA, 64 nt, Homo Sapiens; identical to SEQ ID NO: 90867

SEQ ID NO: 392885 - RNA, 64 nt, Homo Sapiens; identical to SEQ ID NO: 90868

SEQ ID NO: 392886 - RNA, 64 nt, Homo Sapiens; identical to SEQ ID NO: 90869

SEQ ID NO: 392887 - RNA, 64 nt, Homo Sapiens; identical to SEQ ID NO: 90870

SEQ ID NO: 392888 - RNA, 64 nt, Homo Sapiens; identical to SEQ ID NO: 90871

SEQ ID NO: 392889 - RNA, 64 nt, Homo Sapiens; identical to SEQ ID NO: 90872

SEQ ID NO: 392890 - RNA, 64 nt, Homo Sapiens; identical to SEQ ID NO: 90873

SEQ ID NO: 392891 - RNA, 64 nt, Homo Sapiens; identical to SEQ ID NO: 90874

SEQ ID NO: 392892 - RNA, 64 nt, Homo Sapiens; identical to SEQ ID NO: 90875

SEQ ID NO: 392893 - RNA, 64 nt, Homo Sapiens; identical to SEQ ID NO: 90876

SEQ ID NO: 392894 - RNA, 64 nt, Homo Sapiens; identical to SEQ ID NO: 90877

SEQ ID NO: 392895 - RNA, 64 nt, Homo Sapiens; identical to SEQ ID NO: 90878

SEQ ID NO: 392896 - RNA, 64 nt, Homo Sapiens; identical to SEQ ID NO: 90879

SEQ ID NO: 392897 - RNA, 64 nt, Homo Sapiens; identical to SEQ ID NO: 90880

SEQ ID NO: 392898 - RNA, 64 nt, Homo Sapiens; identical to SEQ ID NO: 90881

SEQ ID NO: 392899 - RNA, 64 nt, Homo Sapiens; identical to SEQ ID NO: 90882

SEQ ID NO: 392900 - RNA, 64 nt, Homo Sapiens; identical to SEQ ID NO: 90883

SEQ ID NO: 392901 - RNA, 64 nt, Homo Sapiens; identical to SEQ ID NO: 90884

SEQ ID NO: 392902 - RNA, 64 nt, Homo Sapiens; identical to SEQ ID NO: 90885

SEQ ID NO: 392903 - RNA, 64 nt, Homo Sapiens; identical to SEQ ID NO: 90886

SEQ ID NO: 392904 - RNA, 64 nt, Homo Sapiens; identical to SEQ ID NO: 90887

SEQ ID NO: 392905 - RNA, 64 nt, Homo Sapiens; identical to SEQ ID NO: 90888

SEQ ID NO: 392906 - RNA, 64 nt, Homo Sapiens; identical to SEQ ID NO: 90889

SEQ ID NO: 392907 - RNA, 64 nt, Homo Sapiens; identical to SEQ ID NO: 90890

SEQ ID NO: 392908 - RNA, 64 nt, Homo Sapiens; identical to SEQ ID NO: 90891

SEQ ID NO: 392909 - RNA, 64 nt, Homo Sapiens; identical to SEQ ID NO: 90892

SEQ ID NO: 392910 - RNA, 64 nt, Homo Sapiens; identical to SEQ ID NO: 90893

SEQ ID NO: 392911 - RNA, 64 nt, Homo Sapiens; identical to SEQ ID NO: 90894

SEQ ID NO: 392912 - RNA, 64 nt, Homo Sapiens; identical to SEQ ID NO: 90895

SEQ ID NO: 392913 - RNA, 64 nt, Homo Sapiens; identical to SEQ ID NO: 90896

SEQ ID NO: 392914 - RNA, 64 nt, Homo Sapiens; identical to SEQ ID NO: 90897

SEQ ID NO: 392915 - RNA, 64 nt, Homo Sapiens; identical to SEQ ID NO: 90898

SEQ ID NO: 392916 - RNA, 64 nt, Homo Sapiens; identical to SEQ ID NO: 90899

SEQ ID NO: 392917 - RNA, 54 nt, Homo Sapiens; identical to SEQ ID NO: 90900

SEQ ID NO: 392918 - RNA, 64 nt, Homo Sapiens; identical to SEQ ID NO: 90901

SEQ ID NO: 392919 - RNA, 64 nt, Homo Sapiens; identical to SEQ ID NO: 90902

SEQ ID NO: 392920 - RNA, 64 nt, Homo Sapiens; identical to SEQ ID NO: 90903

SEQ ID NO: 392921 - RNA, 64 nt, Homo Sapiens; identical to SEQ ID NO: 90904

SEQ ID NO: 392922 - RNA, 64 nt, Homo Sapiens; identical to SEQ ID NO: 90905

SEQ ID NO: 392923 - RNA, 64 nt, Homo Sapiens; identical to SEQ ID NO: 90906

SEQ ID NO: 392924 - RNA, 64 nt, Homo Sapiens; identical to SEQ ID NO: 90907

SEQ ID NO: 392925 - RNA, 64 nt, Homo Sapiens; identical to SEQ ID NO: 90908

SEQ ID NO: 392926 - RNA, 64 nt, Homo Sapiens; identical to SEQ ID NO: 90909

SEQ ID NO: 392927 - RNA, 64 nt, Homo Sapiens; identical to SEQ ID NO: 90910

SEQ ID NO: 392928 - RNA, 64 nt, Homo Sapiens; identical to SEQ ID NO: 90911

SEQ ID NO: 392929 - RNA, 64 nt, Homo Sapiens; identical to SEQ ID NO: 90912

SEQ ID NO: 392930 - RNA, 64 nt, Homo Sapiens; identical to SEQ ID NO: 90913

SEQ ID NO: 392931 - RNA, 64 nt, Homo Sapiens; identical to SEQ ID NO: 90914

SEQ ID NO: 392932 - RNA, 64 nt, Homo Sapiens; identical to SEQ ID NO: 90915

SEQ ID NO: 392933 - RNA, 64 nt, Homo Sapiens; identical to SEQ ID NO: 90916

SEQ ID NO: 392934 - RNA, 64 nt, Homo Sapiens; identical to SEQ ID NO: 90917

SEQ ID NO: 392935 - RNA, 64 nt, Homo Sapiens; identical to SEQ ID NO: 90918

SEQ ID NO: 392936 - RNA, 64 nt, Homo Sapiens; identical to SEQ ID NO: 90919

SEQ ID NO: 392937 - RNA, 64 nt, Homo Sapiens; identical to SEQ ID NO: 90920

SEQ ID NO: 392938 - RNA, 64 nt, Homo Sapiens; identical to SEQ ID NO: 90921

SEQ ID NO: 392939 - RNA, 64 nt, Homo Sapiens; identical to SEQ ID NO: 90922

SEQ ID NO: 392940 - RNA, 64 nt, Homo Sapiens; identical to SEQ ID NO: 90923

SEQ ID NO: 392941 - RNA, 64 nt, Homo Sapiens; identical to SEQ ID NO: 90924

SEQ ID NO: 392942 - RNA, 64 nt, Homo Sapiens; identical to SEQ ID NO: 90925

SEQ ID NO: 392943 - RNA, 64 nt, Homo Sapiens; identical to SEQ ID NO: 90926

SEQ ID NO: 392944 - RNA, 64 nt, Homo Sapiens; identical to SEQ ID NO: 90927

SEQ ID NO: 392945 - RNA, 64 nt, Homo Sapiens; identical to SEQ ID NO: 90928

SEQ ID NO: 392946 - RNA, 64 nt, Homo Sapiens; identical to SEQ ID NO: 90929

SEQ ID NO: 392947 - RNA, 64 nt, Homo Sapiens; identical to SEQ ID NO: 90811

SEQ ID NO: 392948 - RNA, 64 nt, Homo Sapiens; identical to SEQ ID NO: 90931

SEQ ID NO: 392949 - RNA, 64 nt, Homo Sapiens; identical to SEQ ID NO: 90932

SEQ ID NO: 392950 - RNA, 64 nt, Homo Sapiens; identical to SEQ ID NO: 90933

SEQ ID NO: 392951 - RNA, 64 nt, Homo Sapiens; identical to SEQ ID NO: 90934

SEQ ID NO: 392952 - RNA, 64 nt, Homo Sapiens; identical to SEQ ID NO: 90935

SEQ ID NO: 392953 - RNA, 64 nt, Homo Sapiens; identical to SEQ ID NO: 90936

SEQ ID NO: 392954 - RNA, 64 nt, Homo Sapiens; identical to SEQ ID NO: 90937

SEQ ID NO: 392955 - RNA, 64 nt, Homo Sapiens; identical to SEQ ID NO: 90938

SEQ ID NO: 392956 - RNA, 64 nt, Homo Sapiens; identical to SEQ ID NO: 90939

SEQ ID NO: 392957 - RNA, 64 nt, Homo Sapiens; identical to SEQ ID NO: 90940

SEQ ID NO: 392958 - RNA, 64 nt, Homo Sapiens; identical to SEQ ID NO: 90941

SEQ ID NO: 392959 - RNA, 64 nt, Homo Sapiens; identical to SEQ ID NO: 90942

SEQ ID NO: 392960 - RNA, 64 nt, Homo Sapiens; identical to SEQ ID NO: 90943

SEQ ID NO: 392961 - RNA, 64 nt, Homo Sapiens; identical to SEQ ID NO: 90944

SEQ ID NO: 392962 - RNA, 64 nt, Homo Sapiens; identical to SEQ ID NO: 90945

SEQ ID NO: 392963 - RNA, 64 nt, Homo Sapiens; identical to SEQ ID NO: 90946

SEQ ID NO: 392964 - RNA, 64 nt, Homo Sapiens; identical to SEQ ID NO: 90947

SEQ ID NO: 392965 - RNA, 64 nt, Homo Sapiens; identical to SEQ ID NO: 90948

SEQ ID NO: 392966 - RNA, 64 nt, Homo Sapiens; identical to SEQ ID NO: 90949

SEQ ID NO: 392967 - RNA, 64 nt, Homo Sapiens; identical to SEQ ID NO: 90950

SEQ ID NO: 392968 - RNA, 64 nt, Homo Sapiens; identical to SEQ ID NO: 90951

SEQ ID NO: 392969 - RNA, 64 nt, Homo Sapiens; identical to SEQ ID NO: 90952

SEQ ID NO: 392970 - RNA, 64 nt, Homo Sapiens; identical to SEQ ID NO: 90953

SEQ ID NO: 392971 - RNA, 64 nt, Homo Sapiens; identical to SEQ ID NO: 90954

SEQ ID NO: 392972 - RNA, 64 nt, Homo Sapiens; identical to SEQ ID NO: 90955

SEQ ID NO: 392973 - RNA, 64 nt, Homo Sapiens; identical to SEQ ID NO: 90956

SEQ ID NO: 392974 - RNA, 64 nt, Homo Sapiens; identical to SEQ ID NO: 90957

SEQ ID NO: 392975 - RNA, 64 nt, Homo Sapiens; identical to SEQ ID NO: 90958

SEQ ID NO: 392976 - RNA, 64 nt, Homo Sapiens; identical to SEQ ID NO: 90959

SEQ ID NO: 392977 - RNA, 64 nt, Homo Sapiens; identical to SEQ ID NO: 90960

SEQ ID NO: 392978 - RNA, 64 nt, Homo Sapiens; identical to SEQ ID NO: 90961

SEQ ID NO: 392979 - RNA, 64 nt, Homo Sapiens; identical to SEQ ID NO: 90962

SEQ ID NO: 392980 - RNA, 64 nt, Homo Sapiens; identical to SEQ ID NO: 90963

SEQ ID NO: 392981 - RNA, 64 nt, Homo Sapiens; identical to SEQ ID NO: 90964

SEQ ID NO: 392982 - RNA, 64 nt, Homo Sapiens; identical to SEQ ID NO: 90965

SEQ ID NO: 392983 - RNA, 64 nt, Homo Sapiens; identical to SEQ ID NO: 90966

SEQ ID NO: 392984 - RNA, 64 nt, Homo Sapiens; identical to SEQ ID NO: 90967

SEQ ID NO: 392985 - RNA, 64 nt, Homo Sapiens; identical to SEQ ID NO: 90968

SEQ ID NO: 392986 - RNA, 64 nt, Homo Sapiens; identical to SEQ ID NO: 90969

SEQ ID NO: 392987 - RNA, 64 nt, Homo Sapiens; identical to SEQ ID NO: 90970

SEQ ID NO: 392988 - RNA, 64 nt, Homo Sapiens; identical to SEQ ID NO: 90971

SEQ ID NO: 392989 - RNA, 64 nt, Homo Sapiens; identical to SEQ ID NO: 90972

SEQ ID NO: 392990 - RNA, 64 nt, Homo Sapiens; identical to SEQ ID NO: 90973

SEQ ID NO: 392991 - RNA, 64 nt, Homo Sapiens; identical to SEQ ID NO: 90974

SEQ ID NO: 392992 - RNA, 64 nt, Homo Sapiens; identical to SEQ ID NO: 90975

SEQ ID NO: 392993 - RNA, 64 nt, Homo Sapiens; identical to SEQ ID NO: 90976

SEQ ID NO: 392994 - RNA, 64 nt, Homo Sapiens; identical to SEQ ID NO: 90977

SEQ ID NO: 392995 - RNA, 64 nt, Homo Sapiens; identical to SEQ ID NO: 90978

SEQ ID NO: 392996 - RNA, 64 nt, Homo Sapiens; identical to SEQ ID NO: 90979

SEQ ID NO: 392997 - RNA, 64 nt, Homo Sapiens; identical to SEQ ID NO: 90980

SEQ ID NO: 392998 - RNA, 64 nt, Homo Sapiens; identical to SEQ ID NO: 90981

SEQ ID NO: 392999 - RNA, 64 nt, Homo Sapiens; identical to SEQ ID NO: 90982

SEQ ID NO: 393000 - RNA, 64 nt, Homo Sapiens; identical to SEQ ID NO: 90983

SEQ ID NO: 393001 - RNA, 64 nt, Homo Sapiens; identical to SEQ ID NO: 90984

SEQ ID NO: 393002 - RNA, 64 nt, Homo Sapiens; identical to SEQ ID NO: 90985

SEQ ID NO: 393003 - RNA, 64 nt, Homo Sapiens; identical to SEQ ID NO: 90986

SEQ ID NO: 393004 - RNA, 64 nt, Homo Sapiens; identical to SEQ ID NO: 90987

SEQ ID NO: 393005 - RNA, 64 nt, Homo Sapiens; identical to SEQ ID NO: 90988

SEQ ID NO: 393006 - RNA, 64 nt, Homo Sapiens; identical to SEQ ID NO: 90989

SEQ ID NO: 393007 - RNA, 64 nt, Homo Sapiens; identical to SEQ ID NO: 90990

SEQ ID NO: 393008 - RNA, 64 nt, Homo Sapiens; identical to SEQ ID NO: 90991

SEQ ID NO: 393009 - RNA, 64 nt, Homo Sapiens; identical to SEQ ID NO: 90992

SEQ ID NO: 393010 - RNA, 64 nt, Homo Sapiens; identical to SEQ ID NO: 90993

SEQ ID NO: 393011 - RNA, 64 nt, Homo Sapiens; identical to SEQ ID NO: 90994

SEQ ID NO: 393012 - RNA, 64 nt, Homo Sapiens; identical to SEQ ID NO: 90995

SEQ ID NO: 393013 - RNA, 64 nt, Homo Sapiens; identical to SEQ ID NO: 90996

SEQ ID NO: 393014 - RNA, 64 nt, Homo Sapiens; identical to SEQ ID NO: 90997

SEQ ID NO: 393015 - RNA, 64 nt, Homo Sapiens; identical to SEQ ID NO: 90998

SEQ ID NO: 393016 - RNA, 64 nt, Homo Sapiens; identical to SEQ ID NO: 90999

SEQ ID NO: 393017 - RNA, 64 nt, Homo Sapiens; identical to SEQ ID NO: 91000

SEQ ID NO: 393018 - RNA, 64 nt, Homo Sapiens; identical to SEQ ID NO: 91001

SEQ ID NO: 393019 - RNA, 64 nt, Homo Sapiens; identical to SEQ ID NO: 91002

SEQ ID NO: 393020 - RNA, 64 nt, Homo Sapiens; identical to SEQ ID NO: 91003

SEQ ID NO: 393021 - RNA, 64 nt, Homo Sapiens; identical to SEQ ID NO: 91004

SEQ ID NO: 393022 - RNA, 64 nt, Homo Sapiens; identical to SEQ ID NO: 91005

SEQ ID NO: 393023 - RNA, 64 nt, Homo Sapiens; identical to SEQ ID NO: 91006

SEQ ID NO: 393024 - RNA, 64 nt, Homo Sapiens; identical to SEQ ID NO: 91007

SEQ ID NO: 393025 - RNA, 64 nt, Homo Sapiens; identical to SEQ ID NO: 91008

SEQ ID NO: 393026 - RNA, 64 nt, Homo Sapiens; identical to SEQ ID NO: 91009

SEQ ID NO: 393027 - RNA, 64 nt, Homo Sapiens; identical to SEQ ID NO: 91010

SEQ ID NO: 393028 - RNA, 64 nt, Homo Sapiens; identical to SEQ ID NO: 91011

SEQ ID NO: 393029 - RNA, 64 nt, Homo Sapiens; identical to SEQ ID NO: 91012

SEQ ID NO: 393030 - RNA, 64 nt, Homo Sapiens; identical to SEQ ID NO: 91013

SEQ ID NO: 393031 - RNA, 64 nt, Homo Sapiens; identical to SEQ ID NO: 91014

SEQ ID NO: 393032 - RNA, 64 nt, Homo Sapiens; identical to SEQ ID NO: 91015

SEQ ID NO: 393033 - RNA, 64 nt, Homo Sapiens; identical to SEQ ID NO: 91016

SEQ ID NO: 393034 - RNA, 64 nt, Homo Sapiens; identical to SEQ ID NO: 91017

SEQ ID NO: 393035 - RNA, 64 nt, Homo Sapiens; identical to SEQ ID NO: 91018

SEQ ID NO: 393036 - RNA, 64 nt, Homo Sapiens; identical to SEQ ID NO: 91019

SEQ ID NO: 393037 - RNA, 64 nt, Homo Sapiens; identical to SEQ ID NO: 91020

SEQ ID NO: 393038 - RNA, 64 nt, Homo Sapiens; identical to SEQ ID NO: 91021

SEQ ID NO: 393039 - RNA, 64 nt, Homo Sapiens; identical to SEQ ID NO: 91022

SEQ ID NO: 393040 - RNA, 64 nt, Homo Sapiens; identical to SEQ ID NO: 91023

SEQ ID NO: 393041 - RNA, 64 nt, Homo Sapiens; identical to SEQ ID NO: 91024

SEQ ID NO: 393042 - RNA, 64 nt, Homo Sapiens; identical to SEQ ID NO: 91025

SEQ ID NO: 393043 - RNA, 64 nt, Homo Sapiens; identical to SEQ ID NO: 91026

SEQ ID NO: 393044 - RNA, 64 nt, Homo Sapiens; identical to SEQ ID NO: 91027

SEQ ID NO: 393045 - RNA, 64 nt, Homo Sapiens; identical to SEQ ID NO: 91028

SEQ ID NO: 393046 - RNA, 64 nt, Homo Sapiens; identical to SEQ ID NO: 91029

SEQ ID NO: 393047 - RNA, 64 nt, Homo Sapiens
cgugccuguagucccagcuacuugggaggcugaggcaggagaaucacuugaccccagguggugg

SEQ ID NO: 393048 - RNA, 64 nt, Homo Sapiens
cauaacuauaaucccagcuacuugggaggcugaggcaggagaaucgcuugaacccgggaggcac

SEQ ID NO: 393049 - RNA, 64 nt, Homo Sapiens
ggcuccuguagucccagcuacuugggaggcugaggcaggagaaucgcuugaaccugggaggcag

SEQ ID NO: 393050 - RNA, 64 nt, Homo Sapiens
caacccuaaaaccagaccacuccacgcaggacaggcaggagagauucuuccuaaagccuccccc

SEQ ID NO: 393051 - RNA, 64 nt, Homo Sapiens
gccuuuggucagcguuuccacauccugcucugcugcaggagagggggcuaaggggcuggaucca

SEQ ID NO: 393052 - RNA, 64 nt, Homo Sapiens
aagaaaggcaagggccgugcugcugcugggcggggcaggagaggagccuggccagugugccaca

SEQ ID NO: 393053 - RNA, 64 nt, Homo Sapiens
uuccggccugaaagcccucccugcaagaaggugugcaggagagaagaggccccggcauggggau

SEQ ID NO: 393054 - RNA, 64 nt, Homo Sapiens
cacgccuguagucccaguuacuugggaggcugaggcaggagaauugcuugaaccugggaggugg

SEQ ID NO: 393055 - RNA, 64 nt, Homo Sapiens
ccugccuguaaucccagcuacuugggaggcugaggcaggagaaucgcuugaacccgggaggcgg

SEQ ID NO: 393056 - RNA, 64 nt, Homo Sapiens
aagacccauucugcacagucccuccaggguuugggcaggagauggccaaucaugcgcccaccuc

SEQ ID NO: 393057 - RNA, 64 nt, Homo Sapiens
gggauuugggaaaggugaagcugugacuggaggggcaggagaugguccaaguguccauccagag

SEQ ID NO: 393058 - RNA, 64 nt, Homo Sapiens
ugcuugaaccggggaggcagcucgggaggcugaggcaggagaauggagccuguagucccagcua

SEQ ID NO: 393059 - RNA, 64 nt, Homo Sapiens
ggcaugaaccugggaggcagcuugggaggcugaggcaggagaauggcgccuguaaucccagcua

SEQ ID NO: 393060 - RNA, 64 nt, Homo Sapiens
cgcacagaaggcccaguucugagucaggagagcagcaggagaggucauugcacuccccaaaaga

SEQ ID NO: 393061 - RNA, 64 nt, Homo Sapiens
ggcgugaauccgggaggcggcucagggggcugaggcaggagaauggcaccuguagucccagcua

SEQ ID NO: 393062 - RNA, 64 nt, Homo Sapiens
ugcuugagcccaagagguggcuugggaggcugaggcaggagaaucacgccuguagucccagcua

SEQ ID NO: 393063 - RNA, 64 nt, Homo Sapiens
cgcuugaaccugggagguggcuugggaggcugaggcaggagaaugguaccuauaaucccagcua

SEQ ID NO: 393064 - RNA, 64 nt, Homo Sapiens
ugcuugaacccaggaggaagcucaggaggcugaggcaggagaauuacgccuguagucccagcua

SEQ ID NO: 393065 - RNA, 64 nt, Homo Sapiens
cgcuugaacccgggaggcggcucaggaggcugaggcaggagaauggcgccuguaaucccagcua

SEQ ID NO: 393066 - RNA, 64 nt, Homo Sapiens
cacuugaacccgggaggcagcuugggaggcugaggcaggagaaucgcaccaguaaucccagcua

SEQ ID NO: 393067 - RNA, 64 nt, Homo Sapiens
cgcuugaaccugggaggcggcucaggaggcugaggcaggagaaucaugccuguaauccaagaua

SEQ ID NO: 393068 - RNA, 64 nt, Homo Sapiens
cuggaauuggagauaggauguuuugcuucccacugcaggagagcugcccccuuucacgggguug

SEQ ID NO: 393069 - RNA, 64 nt, Homo Sapiens
agaugaauccaagcagcagaaugagccaggaguagcaggagaugggcaaagaaaacuggggugc

SEQ ID NO: 393070 - RNA, 64 nt, Homo Sapiens
cacugcagcccaggaggcagagaauuacuugaacgcaggagaauacucagaaggccgaggcagg

SEQ ID NO: 393071 - RNA, 64 nt, Homo Sapiens
uacuugaacgcaggagaauccucagaaggccgaggcaggagaauuaugccuguaaucccaacua

SEQ ID NO: 393072 - RNA, 64 nt, Homo Sapiens
gaccuuaaauuaugacaacucaaguguauuacuagcaggagaugcuauaaauuaucaaauuugg

SEQ ID NO: 393073 - RNA, 64 nt, Homo Sapiens
cgcuugaaucugggaggcagcucaggaggcugaggcaggagaauggugccuguaaucccagcua

SEQ ID NO: 393074 - RNA, 64 nt, Homo Sapiens
ugcuugaacccaggaagcagcucaggaggcugaggcaggagaauggcacccguaaucccagcua

SEQ ID NO: 393075 - RNA, 64 nt, Homo Sapiens
cgcuugaaccugggagguggcucaggaggcugaggcaggagaauguugccuguaauccuagcua

SEQ ID NO: 393076 - RNA, 64 nt, Homo Sapiens
cacuugaacccgggaggcggcuugggacacugaggcaggagaauggugccuguaaucccagcua

SEQ ID NO: 393077 - RNA, 64 nt, Homo Sapiens
uggaucguggcauuuguuuccagguggauguggagcaggagagcaauggauccuccaacaccac

SEQ ID NO: 393078 - RNA, 64 nt, Homo Sapiens
ggcaccuguaaucccaguuacuugggaagcugaggcaggagaaucccuugaaccugggaggcag

SEQ ID NO: 393079 - RNA, 64 nt, Homo Sapiens
uguaccuguagucccagcuacccaggaagcuaaggcaggagaaucgcuugaauccaggaggcgg

SEQ ID NO: 393080 - RNA, 64 nt, Homo Sapiens
caugccuauaaucccggcuacucgggaggcugaggcaggagaaucaccugaacccgggaggcaa

SEQ ID NO: 393081 - RNA, 64 nt, Homo Sapiens
caugccuguagucccaacuacuagggaggcugaggcaggagaaucacuugaacccaggaggugg

SEQ ID NO: 393082 - RNA, 64 nt, Homo Sapiens
ugcuugaaccugggagacggcuagggaggcugaggcaggagaaucaugccuguaaucccagcua

SEQ ID NO: 393083 - RNA, 64 nt, Homo Sapiens
cgcuugaaccugggaggcagcuugagaggcugaggcaggagaauugugccuguagucuuagcua

SEQ ID NO: 393084 - RNA, 64 nt, Homo Sapiens
cagcagcacuuccagcauuuuuucuacugaccaagcaggagagcucauguucagcugugcugug

SEQ ID NO: 393085 - RNA, 64 nt, Homo Sapiens
ggcaucccccagccccugcauccaagcaggugcugcaggagauuucugauacgacugggcuacu

SEQ ID NO: 393086 - RNA, 64 nt, Homo Sapiens
ugcaccuguagucccagcuauuugggaggcugaugcaggagaauagcuuaagcccaggaauuug

SEQ ID NO: 393087 - RNA, 64 nt, Homo Sapiens
cacaccuauagucgcagcuacuugggaggcuggggcaggagaauugccugagccugggaagugg

SEQ ID NO: 393088 - RNA, 64 nt, Homo Sapiens
agacguaaaccuaccccagcaccaugcaccaagagcaggagaaauccaagcuugagagcucagc

SEQ ID NO: 393089 - RNA, 64 nt, Homo Sapiens
cgcuugaaccuagaaggcggcucgggaggcugaggcaggagaauggcaccuguaaucccagcua

SEQ ID NO: 393090 - RNA, 64 nt, Homo Sapiens
uaugccuguaauugcagcacuuuuagaggcugaggcaggagaauugguugaacccaggaggcgg

SEQ ID NO: 393091 - RNA, 64 nt, Homo Sapiens
caugccuguaaucccagcuacucgggaggcugaggcaggagaauugcuugaacucgggaggugg

SEQ ID NO: 393092 - RNA, 64 nt, Homo Sapiens
gcgcagggugcaacuggcuaccuagaagcugauggcaggagacuguuucacacacaggagauug

SEQ ID NO: 393093 - RNA, 64 nt, Homo Sapiens
ggcaccuguaaucccagcuacuugggaggcugaggcaggagaaucacuugaacccaggaggcag

SEQ ID NO: 393094 - RNA, 64 nt, Homo Sapiens
cacagagugcacugucauuggcccuccccacaaugcaggagagguuuacuuugccuuaagaagu

SEQ ID NO: 393095 - RNA, 64 nt, Homo Sapiens
cacuugaacccaggagguggcucgggaggcugaggcaggagaauaggcgccuguaauccagcua

SEQ ID NO: 393096 - RNA, 64 nt, Homo Sapiens
ggcgggaaccugggaggcggcuugggaggcugaggcaggagaauggcgccuguagucccagcua

SEQ ID NO: 393097 - RNA, 64 nt, Homo Sapiens
gagcuguggccugucuuucaggacuucugcggcugcaggagaagccugacagcgcagcuccuga

SEQ ID NO: 393098 - RNA, 64 nt, Homo Sapiens
cugcgaacgcaaaagugaaugauagaaaacaagcgcaggagagcaagaagcggggagagagagg

SEQ ID NO: 393099 - RNA, 64 nt, Homo Sapiens
cauaccuguagucccagcuacuugggaggcugaggcaggagaaucacuugaacucgggaggcga

SEQ ID NO: 393100 - RNA, 64 nt, Homo Sapiens
cgugccuguagucucagcuacucaggaggcugaggcaggagaaucgccugaacccgggcggcgg

SEQ ID NO: 393101 - RNA, 64 nt, Homo Sapiens
aaacgaugguuugaaaaggaaaccuaugauacaugcaggagaagcaaaacccaagugauuggug

SEQ ID NO: 393102 - RNA, 64 nt, Homo Sapiens
ugcaccuguaaucccaguuaccugggaggcugaggcaggagaaucucuugagcccaggaggcgg

SEQ ID NO: 393103 - RNA, 64 nt, Homo Sapiens
ggcgccuguaaucccagcuacucagaaggcugaggcaggagaaucacuugaaccuaggaggcgg

SEQ ID NO: 393104 - RNA, 64 nt, Homo Sapiens
caugccuguaaucccagcuacucgggaggcugaggcaggagaaucgcuugaacccaggaggcgg

SEQ ID NO: 393105 - RNA, 64 nt, Homo Sapiens
cugcaaggacgcagaauaagcagugagggcggcugcaggagaggaaggggcucccacagccccc

SEQ ID NO: 393106 - RNA, 64 nt, Homo Sapiens
ugcguguguauaagcccaccugaguggggcucgugcaggagaacugaggcaugaaacucuggcu

SEQ ID NO: 393107 - RNA, 64 nt, Homo Sapiens
acacacgagcacguauuuggaaggcuuauccugggcaggagagaagagaggggugggcuggggc

SEQ ID NO: 393108 - RNA, 64 nt, Homo Sapiens
acuccaaagguggcuaugcucccaggggacagcagcaggagacugcuagguuaugacgaccuga

SEQ ID NO: 393109 - RNA, 64 nt, Homo Sapiens
agugaggagcugcugugugacuccugagggaggggcaggagagcucugggggacagaggaaggc

SEQ ID NO: 393110 - RNA, 64 nt, Homo Sapiens
aucugaucccagccaaggaggggcuggaugggacgcaggagaucauuguggacuuugaauguga

SEQ ID NO: 393111 - RNA, 64 nt, Homo Sapiens
ugcgcuuguagucucagcuacuccggaggcugaggcaggagaauugcuugaaccuggaaggcag

SEQ ID NO: 393112 - RNA, 64 nt, Homo Sapiens
ggugucuguaaucccagcuauucgggaggcugaggcaggagaaucgcuugaacccaggaggugg

SEQ ID NO: 393113 - RNA, 64 nt, Homo Sapiens
aacuaagaacauauugagcuggagcuucuugagggcaggagaguauuggaaaaggaauccagaa

SEQ ID NO: 393114 - RNA, 64 nt, Homo Sapiens
ggcgccuguaaucccagcuccucaggaggcugaggcaggagaauugcuugaaaccaggaggcgg

SEQ ID NO: 393115 - RNA, 64 nt, Homo Sapiens
aaagagagaucuacuuugguuucauuuuaauggagcaggagagauuuuucauuuucauggaggu

SEQ ID NO: 393116 - RNA, 64 nt, Homo Sapiens
gaaaucgauauuaauuccuggaaacuuugaaggagcaggagacuagucucgccaucgucaaaga

SEQ ID NO: 393117 - RNA, 64 nt, Homo Sapiens
cuggcagucacgucaguuauguagauacugcauggcaggagagcuuuacgcuaaagacaaaaga

SEQ ID NO: 393118 - RNA, 64 nt, Homo Sapiens
ggcgccuguaaucccagcuacuugggaggcugaggcaggagaaucacuugaacgugggaggcgg

SEQ ID NO: 393119 - RNA, 64 nt, Homo Sapiens
aaaacauguuuggaaagagaauuucugagauauagcaggagaccuuaaaagcagcuauugguaa

SEQ ID NO: 393120 - RNA, 64 nt, Homo Sapiens
cgcuagaaccugggaggcggccggggaggcugaggcaggagaaucacaccuguaaucccagcua

SEQ ID NO: 393121 - RNA, 64 nt, Homo Sapiens
aaggagcugaggaggagaagccaaagaggaggaggcaggagaagcaggcagccugccccuucua

SEQ ID NO: 393122 - RNA, 64 nt, Homo Sapiens
gcaugcccuuccccaacaucaggucugcagagcugcaggagaagauggccuacuuggaucaaac

SEQ ID NO: 393123 - RNA, 64 nt, Homo Sapiens
cguuuaaacacaggagguggcucaggaggcugaagcaggagaauagggccuguaauuccagcua

SEQ ID NO: 393124 - RNA, 64 nt, Homo Sapiens
ggcgugaacccgcgaggcgguacaggaggcugaggcaggagaauggcgugguggcgggugccug

SEQ ID NO: 393125 - RNA, 64 nt, Homo Sapiens
ucgccugaacccagaaggcacuugggaggcugaggcaggagaaaggcaccuguaaucccagcua

SEQ ID NO: 393126 - RNA, 64 nt, Homo Sapiens
cgcuugaaccugggaggcagcuggggaggcugaggcaggagaaucaugccuguaaucccagcua

SEQ ID NO: 393127 - RNA, 64 nt, Homo Sapiens
cacugucagcuuuccuggucaccugauggacaaagcaggagauuaagugagagacacuuuuagg

SEQ ID NO: 393128 - RNA, 64 nt, Homo Sapiens
cuugggcuguuugccuugggcuucuggaggaggggcaggagacaccuuagaagucauccagaug

SEQ ID NO: 393129 - RNA, 64 nt, Homo Sapiens
cgcuagaaacugggagguggcuugggaggcugaggcaggagaaucacgccuguaaucccaucuu

SEQ ID NO: 393130 - RNA, 64 nt, Homo Sapiens
cgcuugaacccgggagguggcucaggaggcugaggcaggagaaucacgccuguaguuccagcua

SEQ ID NO: 393131 - RNA, 64 nt, Homo Sapiens
cgcuugaaccugggaggcagcucaggaggcugaggcaggagaaugcaagugccuuuaaucccac

SEQ ID NO: 393132 - RNA, 64 nt, Homo Sapiens
cgcuugaaccugggaggcggcuugggaggcugaggcaggagaaugaugccuguaaucccagcua

SEQ ID NO: 393133 - RNA, 64 nt, Homo Sapiens
agaggcuucggcaacaggaugagaggcuguggcagcaggagacucugcaggagcuggagaggcu

SEQ ID NO: 393134 - RNA, 64 nt, Homo Sapiens
agaagcuguugguacaggagaggcggcaggaggagcaggagaggcugcaugccauucuuuucgg

SEQ ID NO: 393135 - RNA, 64 nt, Homo Sapiens
gagcggguggagaaacuggauuuauggagcucaugcaggagaauuauuuugacuccagagccgc

SEQ ID NO: 393136 - RNA, 64 nt, Homo Sapiens
caggaaagggaguugcugaggccugccaagaguugcaggagaccagaaaagaguagcagagaug

SEQ ID NO: 393137 - RNA, 64 nt, Homo Sapiens
cugcuagagcagaagcggaaagguugcuggagcugcaggagagggguugcuggagcaagaggag

SEQ ID NO: 393138 - RNA, 64 nt, Homo Sapiens
cugcuagagcagaagcggaaaggcuacuggagcugcaggagagcgguugcuggagcaagaggag

SEQ ID NO: 393139 - RNA, 64 nt, Homo Sapiens
ggcuuugggaggccaaggcgggcagaucaugagggcaggagauugagacccuccuggccaacau

SEQ ID NO: 393140 - RNA, 64 nt, Homo Sapiens
caugcuuguaaucccagcuacucaggaggcagaggcaggagaaucacuugaacccgggaggugg

SEQ ID NO: 393141 - RNA, 64 nt, Homo Sapiens
accgagggaagggcucagcugaaggaccccgucugcaggagagucgggggaccagguuugggaa

SEQ ID NO: 393142 - RNA, 64 nt, Homo Sapiens
uguguguaggaggcggaggcccgcagagcacagagcaggagaagggcuugggcccuggaggaga

SEQ ID NO: 393143 - RNA, 64 nt, Homo Sapiens
gggugccuguaauccagcuacuugggagacugaggcaggagaauugcuugaacccaggaggcag

SEQ ID NO: 393144 - RNA, 64 nt, Homo Sapiens
guccccuguagucccagcuacucgggaggcugaggcaggagaaucguuugaaccugggaggugg

SEQ ID NO: 393145 - RNA, 64 nt, Homo Sapiens
gguaccuguaguccuagcuacuugggaggcugaggcaggagaauggcgugaaccugggaggugg

SEQ ID NO: 393146 - RNA, 64 nt, Homo Sapiens
auuagggccaaaauuuuaggaggagauguaggaugcaggagaaaauuaaaguguuuucuuuaua

SEQ ID NO: 393147 - RNA, 64 nt, Homo Sapiens
ggggugaacccgggaggaagcucgggagguugaggcaggagaaugacgccuguauucacagcua

SEQ ID NO: 393148 - RNA, 64 nt, Homo Sapiens
cucuugaacccaggaggcggcuugggaggcugaggcaggagaauggcaccuguaaucccagcua

SEQ ID NO: 393149 - RNA, 64 nt, Homo Sapiens
cgccugaacccaggaggcgguaaucguagcugaggcaggagaauggcaugguggcacacaccug

SEQ ID NO: 393150 - RNA, 64 nt, Homo Sapiens
cgcuugaaccugggaggcaacucaagaggcugaggcaggagaauggcgccugaaaucccagcua

SEQ ID NO: 393151 - RNA, 64 nt, Homo Sapiens
cuacacaaaauacaaaaacagagcugcggcggaugcaggagauguuauccgagagaaagaugag

SEQ ID NO: 393152 - RNA, 64 nt, Homo Sapiens
cuggccugggcaaauccacauuacccucaugguggcaggagagucgugaagaaaggcuuugacu

SEQ ID NO: 393153 - RNA, 64 nt, Homo Sapiens
cgcuugaacucaggagguggcucgggaggcugaggcaggagaauucaagggcccuccccagcua

SEQ ID NO: 393154 - RNA, 64 nt, Homo Sapiens
ggccugaacccgggaggcggcuugggaggcugaggcaggagaauggcgccuguagucccagcua

SEQ ID NO: 393155 - RNA, 64 nt, Homo Sapiens
ccagaauggcgacuguccccauccgccuggcugagcaggagagagggagcuggcggugcccagc

SEQ ID NO: 393156 - RNA, 64 nt, Homo Sapiens
accugcaggcagaaagugggggaaguggcuccuggcaggagauuucucccagcacuaauauccu

SEQ ID NO: 393157 - RNA, 64 nt, Homo Sapiens
gccagauggaguauguggagaaauguaccuguuggcaggagaagaaaaaaaaaaagaaaaaaag

SEQ ID NO: 393158 - RNA, 64 nt, Homo Sapiens
ggcaugaaccugggaggcagcacgggaggcugaggcaggagaauggcaccuguagucccagcua

SEQ ID NO: 393159 - RNA, 64 nt, Homo Sapiens
ggcuugaaccugggaagcggcucgggaggcagaggcaggagaaucacaccugucgucucagcua

SEQ ID NO: 393160 - RNA, 64 nt, Homo Sapiens
cagcagauguacgacaugaucagcugaaggagcagcaggagauguuucagacgcccagaagaag

SEQ ID NO: 393161 - RNA, 64 nt, Homo Sapiens
ugcuugaacuugggagguggcuugggaggcugaggcaggagaauggugccuguaauccuagcua

SEQ ID NO: 393162 - RNA, 64 nt, Homo Sapiens
ugcuugaacccaugagguggcucgggaggcugaggcaggagaauugcgcuuguaaucccagcua

SEQ ID NO: 393163 - RNA, 64 nt, Homo Sapiens
ugcuugaauccaagaggcagcuugggaggcugaggcaggagaaucaugccuguagucucagcua

SEQ ID NO: 393164 - RNA, 64 nt, Homo Sapiens
gcuugaacccaggaggcggacuugggaggcugaggcaggagaguggugccuguaaucccagcua

SEQ ID NO: 393165 - RNA, 64 nt, Homo Sapiens
ggcgugaaccugggaggcggcucgggaggcugaggcaggagaauggugccuguagucccagcua

SEQ ID NO: 393166 - RNA, 64 nt, Homo Sapiens
gguuugaacacagggauggucuuaggagccugaggcaggagaauugcaucuguagucucagcaa

SEQ ID NO: 393167 - RNA, 64 nt, Homo Sapiens
gcauuugcuguauagagcugccacccaacucuaagcaggagaaacuguacagaaagggcuuugc

SEQ ID NO: 393168 - RNA, 64 nt, Homo Sapiens
caugccuguauucccagcugcuugggaggcugaggcaggagaauggcuugaaccugggaggugg

SEQ ID NO: 393169 - RNA, 64 nt, Homo Sapiens
acgaucuuccuggcuccaacacugcugcuccagugcaggagacuuuacauggaugccaaccggu

SEQ ID NO: 393170 - RNA, 64 nt, Homo Sapiens
cccaggaggauggcaaagagagucgcaucucagugcaggagagacagugaggcugcacccaccc

SEQ ID NO: 393171 - RNA, 64 nt, Homo Sapiens
gcucacagccucgcgaagguggagaagggcaggggcaggagagggcugcggaggaggggccacg

SEQ ID NO: 393172 - RNA, 64 nt, Homo Sapiens
cccuccgcaggcauagcguggcgucagcccagcugcaggagaagcuggcaggagcccagcgcca

SEQ ID NO: 393173 - RNA, 64 nt, Homo Sapiens
ggcgugaacccaggaggcggcucugaagacugaggcaggagaauggcgccuguagucccagcua

SEQ ID NO: 393174 - RNA, 64 nt, Homo Sapiens
cgcuugaacccgggaggcagcucaggaggcugaggcaggagaaucacgccuguagucucagcua

SEQ ID NO: 393175 - RNA, 64 nt, Homo Sapiens
ggcaccuguagucccagauacucgggaggcuaaggcaggagaaucgcuugacgggaagcggagg

SEQ ID NO: 393176 - RNA, 64 nt, Homo Sapiens
ggggccuguaauccuagcuacuuggggugcugaggcaggagaaucaacugaacccgggaggcgg

SEQ ID NO: 393177 - RNA, 64 nt, Homo Sapiens; identical to SEQ ID NO: 295046

SEQ ID NO: 393178 - RNA, 64 nt, Homo Sapiens; identical to SEQ ID NO: 295047

SEQ ID NO: 393179 - RNA, 64 nt, Homo Sapiens; identical to SEQ ID NO: 295048

SEQ ID NO: 393180 - RNA, 64 nt, Homo Sapiens; identical to SEQ ID NO: 295049

SEQ ID NO: 393181 - RNA, 64 nt, Homo Sapiens; identical to SEQ ID NO: 295050

SEQ ID NO: 393182 - RNA, 64 nt, Homo Sapiens; identical to SEQ ID NO: 295051

SEQ ID NO: 393183 - RNA, 64 nt, Homo Sapiens; identical to SEQ ID NO: 295052

SEQ ID NO: 393184 - RNA, 64 nt, Homo Sapiens; identical to SEQ ID NO: 295053

SEQ ID NO: 393185 - RNA, 64 nt, Homo Sapiens; identical to SEQ ID NO: 295054

SEQ ID NO: 393186 - RNA, 64 nt, Homo Sapiens; identical to SEQ ID NO: 295055

SEQ ID NO: 393187 - RNA, 64 nt, Homo Sapiens; identical to SEQ ID NO: 295056

SEQ ID NO: 393188 - RNA, 64 nt, Homo Sapiens; identical to SEQ ID NO: 295057

SEQ ID NO: 393189 - RNA, 64 nt, Homo Sapiens; identical to SEQ ID NO: 295058

SEQ ID NO: 393190 - RNA, 64 nt, Homo Sapiens; identical to SEQ ID NO: 295059

SEQ ID NO: 393191 - RNA, 64 nt, Homo Sapiens; identical to SEQ ID NO: 295060

SEQ ID NO: 393192 - RNA, 64 nt, Homo Sapiens; identical to SEQ ID NO: 295061

SEQ ID NO: 393193 - RNA, 64 nt, Homo Sapiens; identical to SEQ ID NO: 295062

SEQ ID NO: 393194 - RNA, 64 nt, Homo Sapiens; identical to SEQ ID NO: 295063

SEQ ID NO: 393195 - RNA, 64 nt, Homo Sapiens; identical to SEQ ID NO: 295064

SEQ ID NO: 393196 - RNA, 64 nt, Homo Sapiens; identical to SEQ ID NO: 295065

SEQ ID NO: 393197 - RNA, 64 nt, Homo Sapiens; identical to SEQ ID NO: 295066

SEQ ID NO: 393198 - RNA, 64 nt, Homo Sapiens; identical to SEQ ID NO: 295067

SEQ ID NO: 393199 - RNA, 64 nt, Homo Sapiens; identical to SEQ ID NO: 295068

SEQ ID NO: 393200 - RNA, 64 nt, Homo Sapiens; identical to SEQ ID NO: 295069

SEQ ID NO: 393201 - RNA, 64 nt, Homo Sapiens; identical to SEQ ID NO: 295070

SEQ ID NO: 393202 - RNA, 64 nt, Homo Sapiens; identical to SEQ ID NO: 295071

SEQ ID NO: 393203 - RNA, 64 nt, Homo Sapiens; identical to SEQ ID NO: 295072

SEQ ID NO: 393204 - RNA, 64 nt, Homo Sapiens; identical to SEQ ID NO: 295073

SEQ ID NO: 393205 - RNA, 64 nt, Homo Sapiens; identical to SEQ ID NO: 295074

SEQ ID NO: 393206 - RNA, 64 nt, Homo Sapiens; identical to SEQ ID NO: 295075

SEQ ID NO: 393207 - RNA, 64 nt, Homo Sapiens; identical to SEQ ID NO: 295076

SEQ ID NO: 393208 - RNA, 64 nt, Homo Sapiens; identical to SEQ ID NO: 295077

SEQ ID NO: 393209 - RNA, 64 nt, Homo Sapiens; identical to SEQ ID NO: 295078

SEQ ID NO: 393210 - RNA, 64 nt, Homo Sapiens; identical to SEQ ID NO: 295079

SEQ ID NO: 393211 - RNA, 64 nt, Homo Sapiens; identical to SEQ ID NO: 295080

SEQ ID NO: 393212 - RNA, 64 nt, Homo Sapiens; identical to SEQ ID NO: 295081

SEQ ID NO: 393213 - RNA, 64 nt, Homo Sapiens; identical to SEQ ID NO: 295082

SEQ ID NO: 393214 - RNA, 64 nt, Homo Sapiens; identical to SEQ ID NO: 295083

SEQ ID NO: 393215 - RNA, 64 nt, Homo Sapiens; identical to SEQ ID NO: 295084

SEQ ID NO: 393216 - RNA, 64 nt, Homo Sapiens; identical to SEQ ID NO: 295085

SEQ ID NO: 393217 - RNA, 64 nt, Homo Sapiens; identical to SEQ ID NO: 315726

SEQ ID NO: 393218 - RNA, 64 nt, Homo Sapiens; identical to SEQ ID NO: 315727

SEQ ID NO: 393219 - RNA, 64 nt, Homo Sapiens; identical to SEQ ID NO: 315728

SEQ ID NO: 393220 - RNA, 64 nt, Homo Sapiens; identical to SEQ ID NO: 315729

SEQ ID NO: 393221 - RNA, 64 nt, Homo Sapiens; identical to SEQ ID NO: 315730

SEQ ID NO: 393222 - RNA, 64 nt, Homo Sapiens; identical to SEQ ID NO: 315731

SEQ ID NO: 393223 - RNA, 64 nt, Homo Sapiens; identical to SEQ ID NO: 315732

SEQ ID NO: 393224 - RNA, 64 nt, Homo Sapiens; identical to SEQ ID NO: 315733

SEQ ID NO: 393225 - RNA, 64 nt, Homo Sapiens; identical to SEQ ID NO: 315734

SEQ ID NO: 393226 - RNA, 64 nt, Homo Sapiens; identical to SEQ ID NO: 315735

SEQ ID NO: 393227 - RNA, 64 nt, Homo Sapiens; identical to SEQ ID NO: 315736

SEQ ID NO: 393228 - RNA, 64 nt, Homo Sapiens; identical to SEQ ID NO: 315737

SEQ ID NO: 393229 - RNA, 64 nt, Homo Sapiens; identical to SEQ ID NO: 315738

SEQ ID NO: 393230 - RNA, 64 nt, Homo Sapiens; identical to SEQ ID NO: 315739

SEQ ID NO: 393231 - RNA, 64 nt, Homo Sapiens; identical to SEQ ID NO: 315740

SEQ ID NO: 393232 - RNA, 64 nt, Homo Sapiens; identical to SEQ ID NO: 315741

SEQ ID NO: 393233 - RNA, 64 nt, Homo Sapiens; identical to SEQ ID NO: 315742

SEQ ID NO: 393234 - RNA, 64 nt, Homo Sapiens; identical to SEQ ID NO: 315743

SEQ ID NO: 393235 - RNA, 64 nt, Homo Sapiens; identical to SEQ ID NO: 315744

SEQ ID NO: 393236 - RNA, 55 nt, Homo Sapiens; identical to SEQ ID NO: 315745

SEQ ID NO: 393237 - RNA, 64 nt, Homo Sapiens; identical to SEQ ID NO: 112566

SEQ ID NO: 393238 - RNA, 64 nt, Homo Sapiens; identical to SEQ ID NO: 112567

SEQ ID NO: 393239 - RNA, 64 nt, Homo Sapiens; identical to SEQ ID NO: 112568

SEQ ID NO: 393240 - RNA, 64 nt, Homo Sapiens; identical to SEQ ID NO: 112569

SEQ ID NO: 393241 - RNA, 64 nt, Homo Sapiens; identical to SEQ ID NO: 112570

SEQ ID NO: 393242 - RNA, 64 nt, Homo Sapiens; identical to SEQ ID NO: 112571

SEQ ID NO: 393243 - RNA, 64 nt, Homo Sapiens; identical to SEQ ID NO: 112572

SEQ ID NO: 393244 - RNA, 64 nt, Homo Sapiens; identical to SEQ ID NO: 112573

SEQ ID NO: 393245 - RNA, 64 nt, Homo Sapiens; identical to SEQ ID NO: 112574

SEQ ID NO: 393246 - RNA, 64 nt, Homo Sapiens; identical to SEQ ID NO: 112575

SEQ ID NO: 393247 - RNA, 64 nt, Homo Sapiens; identical to SEQ ID NO: 112576

SEQ ID NO: 393248 - RNA, 64 nt, Homo Sapiens; identical to SEQ ID NO: 112577

SEQ ID NO: 393249 - RNA, 64 nt, Homo Sapiens; identical to SEQ ID NO: 112578

SEQ ID NO: 393250 - RNA, 64 nt, Homo Sapiens; identical to SEQ ID NO: 112579

SEQ ID NO: 393251 - RNA, 64 nt, Homo Sapiens; identical to SEQ ID NO: 112580

SEQ ID NO: 393252 - RNA, 64 nt, Homo Sapiens; identical to SEQ ID NO: 112581

SEQ ID NO: 393253 - RNA, 64 nt, Homo Sapiens; identical to SEQ ID NO: 112582

SEQ ID NO: 393254 - RNA, 64 nt, Homo Sapiens; identical to SEQ ID NO: 112583

SEQ ID NO: 393255 - RNA, 64 nt, Homo Sapiens; identical to SEQ ID NO: 112584

SEQ ID NO: 393256 - RNA, 64 nt, Homo Sapiens; identical to SEQ ID NO: 112585

SEQ ID NO: 393257 - RNA, 64 nt, Homo Sapiens; identical to SEQ ID NO: 112586

SEQ ID NO: 393258 - RNA, 64 nt, Homo Sapiens; identical to SEQ ID NO: 112587

SEQ ID NO: 393259 - RNA, 64 nt, Homo Sapiens; identical to SEQ ID NO: 112588

SEQ ID NO: 393260 - RNA, 64 nt, Homo Sapiens; identical to SEQ ID NO: 112589

SEQ ID NO: 393261 - RNA, 64 nt, Homo Sapiens; identical to SEQ ID NO: 112590

SEQ ID NO: 393262 - RNA, 64 nt, Homo Sapiens; identical to SEQ ID NO: 112591

SEQ ID NO: 393263 - RNA, 64 nt, Homo Sapiens; identical to SEQ ID NO: 112592

SEQ ID NO: 393264 - RNA, 64 nt, Homo Sapiens; identical to SEQ ID NO: 112593

SEQ ID NO: 393265 - RNA, 64 nt, Homo Sapiens; identical to SEQ ID NO: 112594

SEQ ID NO: 393266 - RNA, 64 nt, Homo Sapiens; identical to SEQ ID NO: 112595

SEQ ID NO: 393267 - RNA, 64 nt, Homo Sapiens; identical to SEQ ID NO: 112596

SEQ ID NO: 393268 - RNA, 64 nt, Homo Sapiens; identical to SEQ ID NO: 112597

SEQ ID NO: 393269 - RNA, 64 nt, Homo Sapiens; identical to SEQ ID NO: 112598

SEQ ID NO: 393270 - RNA, 64 nt, Homo Sapiens; identical to SEQ ID NO: 112599

SEQ ID NO: 393271 - RNA, 64 nt, Homo Sapiens; identical to SEQ ID NO: 112600

SEQ ID NO: 393272 - RNA, 64 nt, Homo Sapiens; identical to SEQ ID NO: 112601

SEQ ID NO: 393273 - RNA, 64 nt, Homo Sapiens; identical to SEQ ID NO: 112602

SEQ ID NO: 393274 - RNA, 64 nt, Homo Sapiens; identical to SEQ ID NO: 112603

SEQ ID NO: 393275 - RNA, 64 nt, Homo Sapiens; identical to SEQ ID NO: 112604

SEQ ID NO: 393276 - RNA, 64 nt, Homo Sapiens; identical to SEQ ID NO: 112605

SEQ ID NO: 393277 - RNA, 64 nt, Homo Sapiens; identical to SEQ ID NO: 112606

SEQ ID NO: 393278 - RNA, 64 nt, Homo Sapiens; identical to SEQ ID NO: 112607

SEQ ID NO: 393279 - RNA, 64 nt, Homo Sapiens; identical to SEQ ID NO: 112608

SEQ ID NO: 393280 - RNA, 64 nt, Homo Sapiens; identical to SEQ ID NO: 112609

SEQ ID NO: 393281 - RNA, 64 nt, Homo Sapiens; identical to SEQ ID NO: 112610

SEQ ID NO: 393282 - RNA, 64 nt, Homo Sapiens; identical to SEQ ID NO: 112611

SEQ ID NO: 393283 - RNA, 64 nt, Homo Sapiens; identical to SEQ ID NO: 112612

SEQ ID NO: 393284 - RNA, 64 nt, Homo Sapiens; identical to SEQ ID NO: 112613

SEQ ID NO: 393285 - RNA, 64 nt, Homo Sapiens; identical to SEQ ID NO: 112614

SEQ ID NO: 393286 - RNA, 64 nt, Homo Sapiens; identical to SEQ ID NO: 112615

SEQ ID NO: 393287 - RNA, 64 nt, Homo Sapiens; identical to SEQ ID NO: 112616

SEQ ID NO: 393288 - RNA, 64 nt, Homo Sapiens; identical to SEQ ID NO: 112617

SEQ ID NO: 393289 - RNA, 64 nt, Homo Sapiens; identical to SEQ ID NO: 112618

SEQ ID NO: 393290 - RNA, 64 nt, Homo Sapiens; identical to SEQ ID NO: 112619

SEQ ID NO: 393291 - RNA, 64 nt, Homo Sapiens; identical to SEQ ID NO: 112620

SEQ ID NO: 393292 - RNA, 64 nt, Homo Sapiens; identical to SEQ ID NO: 112621

SEQ ID NO: 393293 - RNA, 64 nt, Homo Sapiens; identical to SEQ ID NO: 112622

SEQ ID NO: 393294 - RNA, 64 nt, Homo Sapiens; identical to SEQ ID NO: 112623

SEQ ID NO: 393295 - RNA, 64 nt, Homo Sapiens; identical to SEQ ID NO: 112624

SEQ ID NO: 393296 - RNA, 64 nt, Homo Sapiens; identical to SEQ ID NO: 112625

SEQ ID NO: 393297 - RNA, 64 nt, Homo Sapiens; identical to SEQ ID NO: 112626

SEQ ID NO: 393298 - RNA, 64 nt, Homo Sapiens; identical to SEQ ID NO: 112627

SEQ ID NO: 393299 - RNA, 64 nt, Homo Sapiens; identical to SEQ ID NO: 112628

SEQ ID NO: 393300 - RNA, 64 nt, Homo Sapiens; identical to SEQ ID NO: 112629

SEQ ID NO: 393301 - RNA, 64 nt, Homo Sapiens; identical to SEQ ID NO: 112630

SEQ ID NO: 393302 - RNA, 64 nt, Homo Sapiens; identical to SEQ ID NO: 112631

SEQ ID NO: 393303 - RNA, 64 nt, Homo Sapiens; identical to SEQ ID NO: 112632

SEQ ID NO: 393304 - RNA, 64 nt, Homo Sapiens; identical to SEQ ID NO: 112633

SEQ ID NO: 393305 - RNA, 64 nt, Homo Sapiens; identical to SEQ ID NO: 112634

SEQ ID NO: 393306 - RNA, 64 nt, Homo Sapiens; identical to SEQ ID NO: 112635

SEQ ID NO: 393307 - RNA, 64 nt, Homo Sapiens; identical to SEQ ID NO: 112636

SEQ ID NO: 393308 - RNA, 64 nt, Homo Sapiens; identical to SEQ ID NO: 112637

SEQ ID NO: 393309 - RNA, 64 nt, Homo Sapiens; identical to SEQ ID NO: 112638

SEQ ID NO: 393310 - RNA, 64 nt, Homo Sapiens; identical to SEQ ID NO: 112639

SEQ ID NO: 393311 - RNA, 64 nt, Homo Sapiens; identical to SEQ ID NO: 112640

SEQ ID NO: 393312 - RNA, 64 nt, Homo Sapiens; identical to SEQ ID NO: 112641

SEQ ID NO: 393313 - RNA, 64 nt, Homo Sapiens; identical to SEQ ID NO: 112642

SEQ ID NO: 393314 - RNA, 64 nt, Homo Sapiens; identical to SEQ ID NO: 112643

SEQ ID NO: 393315 - RNA, 64 nt, Homo Sapiens; identical to SEQ ID NO: 112644

SEQ ID NO: 393316 - RNA, 64 nt, Homo Sapiens; identical to SEQ ID NO: 112645

SEQ ID NO: 393317 - RNA, 64 nt, Homo Sapiens; identical to SEQ ID NO: 112646

SEQ ID NO: 393318 - RNA, 64 nt, Homo Sapiens; identical to SEQ ID NO: 112647

SEQ ID NO: 393319 - RNA, 64 nt, Homo Sapiens; identical to SEQ ID NO: 112648

SEQ ID NO: 393320 - RNA, 64 nt, Homo Sapiens; identical to SEQ ID NO: 112649

SEQ ID NO: 393321 - RNA, 64 nt, Homo Sapiens; identical to SEQ ID NO: 112650

SEQ ID NO: 393322 - RNA, 64 nt, Homo Sapiens; identical to SEQ ID NO: 112651

SEQ ID NO: 393323 - RNA, 64 nt, Homo Sapiens; identical to SEQ ID NO: 112652

SEQ ID NO: 393324 - RNA, 64 nt, Homo Sapiens; identical to SEQ ID NO: 112653

SEQ ID NO: 393325 - RNA, 64 nt, Homo Sapiens; identical to SEQ ID NO: 112654

SEQ ID NO: 393326 - RNA, 64 nt, Homo Sapiens; identical to SEQ ID NO: 112655

SEQ ID NO: 393327 - RNA, 64 nt, Homo Sapiens; identical to SEQ ID NO: 112656

SEQ ID NO: 393328 - RNA, 64 nt, Homo Sapiens; identical to SEQ ID NO: 112657

SEQ ID NO: 393329 - RNA, 64 nt, Homo Sapiens; identical to SEQ ID NO: 112658

SEQ ID NO: 393330 - RNA, 64 nt, Homo Sapiens; identical to SEQ ID NO: 112659

SEQ ID NO: 393331 - RNA, 64 nt, Homo Sapiens; identical to SEQ ID NO: 112660

SEQ ID NO: 393332 - RNA, 64 nt, Homo Sapiens; identical to SEQ ID NO: 112661

SEQ ID NO: 393333 - RNA, 64 nt, Homo Sapiens; identical to SEQ ID NO: 112662

SEQ ID NO: 393334 - RNA, 64 nt, Homo Sapiens; identical to SEQ ID NO: 112663

SEQ ID NO: 393335 - RNA, 64 nt, Homo Sapiens; identical to SEQ ID NO: 112664

SEQ ID NO: 393336 - RNA, 64 nt, Homo Sapiens; identical to SEQ ID NO: 112665

SEQ ID NO: 393337 - RNA, 64 nt, Homo Sapiens; identical to SEQ ID NO: 112666

SEQ ID NO: 393338 - RNA, 64 nt, Homo Sapiens; identical to SEQ ID NO: 112667

SEQ ID NO: 393339 - RNA, 64 nt, Homo Sapiens; identical to SEQ ID NO: 112668

SEQ ID NO: 393340 - RNA, 64 nt, Homo Sapiens; identical to SEQ ID NO: 112669

SEQ ID NO: 393341 - RNA, 64 nt, Homo Sapiens; identical to SEQ ID NO: 112670

SEQ ID NO: 393342 - RNA, 64 nt, Homo Sapiens; identical to SEQ ID NO: 112671

SEQ ID NO: 393343 - RNA, 64 nt, Homo Sapiens; identical to SEQ ID NO: 112672

SEQ ID NO: 393344 - RNA, 64 nt, Homo Sapiens; identical to SEQ ID NO: 112673

SEQ ID NO: 393345 - RNA, 64 nt, Homo Sapiens; identical to SEQ ID NO: 112674

SEQ ID NO: 393346 - RNA, 64 nt, Homo Sapiens; identical to SEQ ID NO: 112675

SEQ ID NO: 393347 - RNA, 64 nt, Homo Sapiens; identical to SEQ ID NO: 112676

SEQ ID NO: 393348 - RNA, 64 nt, Homo Sapiens; identical to SEQ ID NO: 112677

SEQ ID NO: 393349 - RNA, 64 nt, Homo Sapiens; identical to SEQ ID NO: 112678

SEQ ID NO: 393350 - RNA, 64 nt, Homo Sapiens; identical to SEQ ID NO: 112679

SEQ ID NO: 393351 - RNA, 64 nt, Homo Sapiens; identical to SEQ ID NO: 112680

SEQ ID NO: 393352 - RNA, 64 nt, Homo Sapiens; identical to SEQ ID NO: 112681

SEQ ID NO: 393353 - RNA, 64 nt, Homo Sapiens; identical to SEQ ID NO: 112682

SEQ ID NO: 393354 - RNA, 64 nt, Homo Sapiens; identical to SEQ ID NO: 112683

SEQ ID NO: 393355 - RNA, 64 nt, Homo Sapiens; identical to SEQ ID NO: 112684

SEQ ID NO: 393356 - RNA, 64 nt, Homo Sapiens; identical to SEQ ID NO: 112685

SEQ ID NO: 393357 - RNA, 64 nt, Homo Sapiens; identical to SEQ ID NO: 112686

SEQ ID NO: 393358 - RNA, 64 nt, Homo Sapiens; identical to SEQ ID NO: 112687

SEQ ID NO: 393359 - RNA, 64 nt, Homo Sapiens; identical to SEQ ID NO: 112688

SEQ ID NO: 393360 - RNA, 64 nt, Homo Sapiens; identical to SEQ ID NO: 112689

SEQ ID NO: 393361 - RNA, 64 nt, Homo Sapiens; identical to SEQ ID NO: 112690

SEQ ID NO: 393362 - RNA, 64 nt, Homo Sapiens; identical to SEQ ID NO: 112691

SEQ ID NO: 393363 - RNA, 64 nt, Homo Sapiens; identical to SEQ ID NO: 112692

SEQ ID NO: 393364 - RNA, 64 nt, Homo Sapiens; identical to SEQ ID NO: 112693

SEQ ID NO: 393365 - RNA, 64 nt, Homo Sapiens; identical to SEQ ID NO: 112694

SEQ ID NO: 393366 - RNA, 64 nt, Homo Sapiens; identical to SEQ ID NO: 112695

SEQ ID NO: 393367 - RNA, 64 nt, Homo Sapiens; identical to SEQ ID NO: 112696

SEQ ID NO: 393368 - RNA, 64 nt, Homo Sapiens; identical to SEQ ID NO: 112697

SEQ ID NO: 393369 - RNA, 64 nt, Homo Sapiens; identical to SEQ ID NO: 112698

SEQ ID NO: 393370 - RNA, 64 nt, Homo Sapiens; identical to SEQ ID NO: 112699

SEQ ID NO: 393371 - RNA, 64 nt, Homo Sapiens; identical to SEQ ID NO: 112700

SEQ ID NO: 393372 - RNA, 64 nt, Homo Sapiens; identical to SEQ ID NO: 112701

SEQ ID NO: 393373 - RNA, 64 nt, Homo Sapiens; identical to SEQ ID NO: 112702

SEQ ID NO: 393374 - RNA, 64 nt, Homo Sapiens; identical to SEQ ID NO: 112703

SEQ ID NO: 393375 - RNA, 64 nt, Homo Sapiens; identical to SEQ ID NO: 112704

SEQ ID NO: 393376 - RNA, 64 nt, Homo Sapiens; identical to SEQ ID NO: 112705

SEQ ID NO: 393377 - RNA, 64 nt, Homo Sapiens; identical to SEQ ID NO: 112706

SEQ ID NO: 393378 - RNA, 64 nt, Homo Sapiens; identical to SEQ ID NO: 112707

SEQ ID NO: 393379 - RNA, 64 nt, Homo Sapiens; identical to SEQ ID NO: 112708

SEQ ID NO: 393380 - RNA, 64 nt, Homo Sapiens; identical to SEQ ID NO: 112709

SEQ ID NO: 393381 - RNA, 64 nt, Homo Sapiens; identical to SEQ ID NO: 112710

SEQ ID NO: 393382 - RNA, 64 nt, Homo Sapiens; identical to SEQ ID NO: 112711

SEQ ID NO: 393383 - RNA, 64 nt, Homo Sapiens; identical to SEQ ID NO: 112712

SEQ ID NO: 393384 - RNA, 60 nt, Homo Sapiens; identical to SEQ ID NO: 112713

SEQ ID NO: 393385 - RNA, 64 nt, Homo Sapiens; identical to SEQ ID NO: 112714

SEQ ID NO: 393386 - RNA, 64 nt, Homo Sapiens; identical to SEQ ID NO: 112715

SEQ ID NO: 393387 - RNA, 64 nt, Homo Sapiens; identical to SEQ ID NO: 112716

SEQ ID NO: 393388 - RNA, 64 nt, Homo Sapiens; identical to SEQ ID NO: 112717

SEQ ID NO: 393389 - RNA, 64 nt, Homo Sapiens; identical to SEQ ID NO: 112718

SEQ ID NO: 393390 - RNA, 64 nt, Homo Sapiens; identical to SEQ ID NO: 112719

SEQ ID NO: 393391 - RNA, 64 nt, Homo Sapiens; identical to SEQ ID NO: 112720

SEQ ID NO: 393392 - RNA, 64 nt, Homo Sapiens; identical to SEQ ID NO: 112721

SEQ ID NO: 393393 - RNA, 64 nt, Homo Sapiens; identical to SEQ ID NO: 112722

SEQ ID NO: 393394 - RNA, 64 nt, Homo Sapiens; identical to SEQ ID NO: 112723

SEQ ID NO: 393395 - RNA, 64 nt, Homo Sapiens; identical to SEQ ID NO: 112724

SEQ ID NO: 393396 - RNA, 64 nt, Homo Sapiens; identical to SEQ ID NO: 112725

SEQ ID NO: 393397 - RNA, 64 nt, Homo Sapiens; identical to SEQ ID NO: 112726

SEQ ID NO: 393398 - RNA, 64 nt, Homo Sapiens; identical to SEQ ID NO: 112727

SEQ ID NO: 393399 - RNA, 64 nt, Homo Sapiens; identical to SEQ ID NO: 112728

SEQ ID NO: 393400 - RNA, 64 nt, Homo Sapiens; identical to SEQ ID NO: 112729

SEQ ID NO: 393401 - RNA, 64 nt, Homo Sapiens; identical to SEQ ID NO: 112730

SEQ ID NO: 393402 - RNA, 64 nt, Homo Sapiens; identical to SEQ ID NO: 112731

SEQ ID NO: 393403 - RNA, 64 nt, Homo Sapiens; identical to SEQ ID NO: 112732

SEQ ID NO: 393404 - RNA, 64 nt, Homo Sapiens; identical to SEQ ID NO: 112733

SEQ ID NO: 393405 - RNA, 64 nt, Homo Sapiens; identical to SEQ ID NO: 112734

SEQ ID NO: 393406 - RNA, 64 nt, Homo Sapiens; identical to SEQ ID NO: 112735

SEQ ID NO: 393407 - RNA, 64 nt, Homo Sapiens; identical to SEQ ID NO: 112736

SEQ ID NO: 393408 - RNA, 64 nt, Homo Sapiens; identical to SEQ ID NO: 112737

SEQ ID NO: 393409 - RNA, 64 nt, Homo Sapiens; identical to SEQ ID NO: 112738

SEQ ID NO: 393410 - RNA, 64 nt, Homo Sapiens; identical to SEQ ID NO: 112739

SEQ ID NO: 393411 - RNA, 64 nt, Homo Sapiens; identical to SEQ ID NO: 112740

SEQ ID NO: 393412 - RNA, 64 nt, Homo Sapiens; identical to SEQ ID NO: 112741

SEQ ID NO: 393413 - RNA, 64 nt, Homo Sapiens; identical to SEQ ID NO: 112742

SEQ ID NO: 393414 - RNA, 64 nt, Homo Sapiens; identical to SEQ ID NO: 112743

SEQ ID NO: 393415 - RNA, 64 nt, Homo Sapiens; identical to SEQ ID NO: 112744

SEQ ID NO: 393416 - RNA, 64 nt, Homo Sapiens; identical to SEQ ID NO: 112745

SEQ ID NO: 393417 - RNA, 64 nt, Homo Sapiens; identical to SEQ ID NO: 112746

SEQ ID NO: 393418 - RNA, 64 nt, Homo Sapiens; identical to SEQ ID NO: 112747

SEQ ID NO: 393419 - RNA, 64 nt, Homo Sapiens; identical to SEQ ID NO: 112748

SEQ ID NO: 393420 - RNA, 64 nt, Homo Sapiens; identical to SEQ ID NO: 112749

SEQ ID NO: 393421 - RNA, 64 nt, Homo Sapiens; identical to SEQ ID NO: 112750

SEQ ID NO: 393422 - RNA, 64 nt, Homo Sapiens; identical to SEQ ID NO: 112751

SEQ ID NO: 393423 - RNA, 64 nt, Homo Sapiens; identical to SEQ ID NO: 112752

SEQ ID NO: 393424 - RNA, 64 nt, Homo Sapiens; identical to SEQ ID NO: 112753

SEQ ID NO: 393425 - RNA, 64 nt, Homo Sapiens; identical to SEQ ID NO: 112754

SEQ ID NO: 393426 - RNA, 64 nt, Homo Sapiens; identical to SEQ ID NO: 112755

SEQ ID NO: 393427 - RNA, 64 nt, Homo Sapiens; identical to SEQ ID NO: 112756

SEQ ID NO: 393428 - RNA, 64 nt, Homo Sapiens; identical to SEQ ID NO: 112757

SEQ ID NO: 393429 - RNA, 64 nt, Homo Sapiens; identical to SEQ ID NO: 112758

SEQ ID NO: 393430 - RNA, 64 nt, Homo Sapiens; identical to SEQ ID NO: 112759

SEQ ID NO: 393431 - RNA, 64 nt, Homo Sapiens; identical to SEQ ID NO: 112760

SEQ ID NO: 393432 - RNA, 64 nt, Homo Sapiens; identical to SEQ ID NO: 112761

SEQ ID NO: 393433 - RNA, 64 nt, Homo Sapiens; identical to SEQ ID NO: 112762

SEQ ID NO: 393434 - RNA, 64 nt, Homo Sapiens; identical to SEQ ID NO: 112763

SEQ ID NO: 393435 - RNA, 64 nt, Homo Sapiens; identical to SEQ ID NO: 112764

SEQ ID NO: 393436 - RNA, 64 nt, Homo Sapiens; identical to SEQ ID NO: 112765

SEQ ID NO: 393437 - RNA, 64 nt, Homo Sapiens; identical to SEQ ID NO: 112766

SEQ ID NO: 393438 - RNA, 64 nt, Homo Sapiens; identical to SEQ ID NO: 112767

SEQ ID NO: 393439 - RNA, 64 nt, Homo Sapiens; identical to SEQ ID NO: 112768

SEQ ID NO: 393440 - RNA, 64 nt, Homo Sapiens; identical to SEQ ID NO: 112769

SEQ ID NO: 393441 - RNA, 64 nt, Homo Sapiens; identical to SEQ ID NO: 112770

SEQ ID NO: 393442 - RNA, 64 nt, Homo Sapiens; identical to SEQ ID NO: 112771

SEQ ID NO: 393443 - RNA, 64 nt, Homo Sapiens; identical to SEQ ID NO: 112772

SEQ ID NO: 393444 - RNA, 64 nt, Homo Sapiens; identical to SEQ ID NO: 112773

SEQ ID NO: 393445 - RNA, 64 nt, Homo Sapiens; identical to SEQ ID NO: 112774

SEQ ID NO: 393446 - RNA, 64 nt, Homo Sapiens; identical to SEQ ID NO: 112775

SEQ ID NO: 393447 - RNA, 64 nt, Homo Sapiens; identical to SEQ ID NO: 112776

SEQ ID NO: 393448 - RNA, 64 nt, Homo Sapiens; identical to SEQ ID NO: 112777

SEQ ID NO: 393449 - RNA, 64 nt, Homo Sapiens; identical to SEQ ID NO: 112778

SEQ ID NO: 393450 - RNA, 64 nt, Homo Sapiens; identical to SEQ ID NO: 112779

SEQ ID NO: 393451 - RNA, 64 nt, Homo Sapiens; identical to SEQ ID NO: 112780

SEQ ID NO: 393452 - RNA, 64 nt, Homo Sapiens; identical to SEQ ID NO: 112781

SEQ ID NO: 393453 - RNA, 64 nt, Homo Sapiens; identical to SEQ ID NO: 112782

SEQ ID NO: 393454 - RNA, 64 nt, Homo Sapiens; identical to SEQ ID NO: 112783

SEQ ID NO: 393455 - RNA, 64 nt, Homo Sapiens; identical to SEQ ID NO: 112784

SEQ ID NO: 393456 - RNA, 64 nt, Homo Sapiens; identical to SEQ ID NO: 112785

SEQ ID NO: 393457 - RNA, 64 nt, Homo Sapiens; identical to SEQ ID NO: 112786

SEQ ID NO: 393458 - RNA, 64 nt, Homo Sapiens; identical to SEQ ID NO: 112787

SEQ ID NO: 393459 - RNA, 64 nt, Homo Sapiens; identical to SEQ ID NO: 112788

SEQ ID NO: 393460 - RNA, 64 nt, Homo Sapiens; identical to SEQ ID NO: 112789

SEQ ID NO: 393461 - RNA, 64 nt, Homo Sapiens; identical to SEQ ID NO: 112790

SEQ ID NO: 393462 - RNA, 64 nt, Homo Sapiens; identical to SEQ ID NO: 112791

SEQ ID NO: 393463 - RNA, 64 nt, Homo Sapiens; identical to SEQ ID NO: 112792

SEQ ID NO: 393464 - RNA, 64 nt, Homo Sapiens; identical to SEQ ID NO: 112793

SEQ ID NO: 393465 - RNA, 64 nt, Homo Sapiens; identical to SEQ ID NO: 112794

SEQ ID NO: 393466 - RNA, 64 nt, Homo Sapiens; identical to SEQ ID NO: 112795

SEQ ID NO: 393467 - RNA, 64 nt, Homo Sapiens; identical to SEQ ID NO: 112796

SEQ ID NO: 393468 - RNA, 64 nt, Homo Sapiens; identical to SEQ ID NO: 112797

SEQ ID NO: 393469 - RNA, 64 nt, Homo Sapiens; identical to SEQ ID NO: 112798

SEQ ID NO: 393470 - RNA, 64 nt, Homo Sapiens; identical to SEQ ID NO: 112799

SEQ ID NO: 393471 - RNA, 64 nt, Homo Sapiens; identical to SEQ ID NO: 112800

SEQ ID NO: 393472 - RNA, 64 nt, Homo Sapiens; identical to SEQ ID NO: 112801

SEQ ID NO: 393473 - RNA, 64 nt, Homo Sapiens; identical to SEQ ID NO: 112802

SEQ ID NO: 393474 - RNA, 64 nt, Homo Sapiens; identical to SEQ ID NO: 112803

SEQ ID NO: 393475 - RNA, 64 nt, Homo Sapiens; identical to SEQ ID NO: 112804

SEQ ID NO: 393476 - RNA, 64 nt, Homo Sapiens; identical to SEQ ID NO: 112805

SEQ ID NO: 393477 - RNA, 64 nt, Homo Sapiens
uuucacacucuccaugcuuaugucaaugcaggacucaucacaucuauucggauauucuguuuac

SEQ ID NO: 393478 - RNA, 64 nt, Homo Sapiens
uucuuugguauucuugcccaggaaauggguugauucaucacagauuuuauauauauacuuuuuu

SEQ ID NO: 393479 - RNA, 64 nt, Homo Sapiens
cucacuccucccacagccuucugucuuggccuugucaucacaucaauccuguuguguggugcug

SEQ ID NO: 393480 - RNA, 64 nt, Homo Sapiens
auccuauuagauuugcuuugccgauugucacucuucaucacaggcacauuucaaaaagagguua

SEQ ID NO: 393481 - RNA, 64 nt, Homo Sapiens
cuagaguuaaguaaagucaaaagugucuauaagcucaucacagcaugcugcuugcccucccuug

SEQ ID NO: 393482 - RNA, 64 nt, Homo Sapiens
ugcuucucaucgaaacccuggucuaguucuuccuucaucacacgagacuccaauucugaaaguu

SEQ ID NO: 393483 - RNA, 64 nt, Homo Sapiens
uauauacggacuauccauugaguuuggguguuccucaucacaugaaccuaagaagcacaaauuu

SEQ ID NO: 393484 - RNA, 64 nt, Homo Sapiens; identical to SEQ ID NO: 87818

SEQ ID NO: 393485 - RNA, 64 nt, Homo Sapiens; identical to SEQ ID NO: 87819

SEQ ID NO: 393486 - RNA, 64 nt, Homo Sapiens; identical to SEQ ID NO: 87820

SEQ ID NO: 393487 - RNA, 64 nt, Homo Sapiens; identical to SEQ ID NO: 87821

SEQ ID NO: 393488 - RNA, 64 nt, Homo Sapiens; identical to SEQ ID NO: 87822

SEQ ID NO: 393489 - RNA, 64 nt, Homo Sapiens; identical to SEQ ID NO: 87823

SEQ ID NO: 393490 - RNA, 64 nt, Homo Sapiens; identical to SEQ ID NO: 87824

SEQ ID NO: 393491 - RNA, 64 nt, Homo Sapiens; identical to SEQ ID NO: 87825

SEQ ID NO: 393492 - RNA, 64 nt, Homo Sapiens; identical to SEQ ID NO: 87826

SEQ ID NO: 393493 - RNA, 64 nt, Homo Sapiens; identical to SEQ ID NO: 87827

SEQ ID NO: 393494 - RNA, 64 nt, Homo Sapiens; identical to SEQ ID NO: 87828

SEQ ID NO: 393495 - RNA, 64 nt, Homo Sapiens; identical to SEQ ID NO: 87829

SEQ ID NO: 393496 - RNA, 64 nt, Homo Sapiens; identical to SEQ ID NO: 87830

SEQ ID NO: 393497 - RNA, 64 nt, Homo Sapiens; identical to SEQ ID NO: 87831

SEQ ID NO: 393498 - RNA, 64 nt, Homo Sapiens; identical to SEQ ID NO: 87832

SEQ ID NO: 393499 - RNA, 64 nt, Homo Sapiens; identical to SEQ ID NO: 87833

SEQ ID NO: 393500 - RNA, 64 nt, Homo Sapiens; identical to SEQ ID NO: 87834

SEQ ID NO: 393501 - RNA, 64 nt, Homo Sapiens; identical to SEQ ID NO: 87835

SEQ ID NO: 393502 - RNA, 64 nt, Homo Sapiens; identical to SEQ ID NO: 87836

SEQ ID NO: 393503 - RNA, 64 nt, Homo Sapiens; identical to SEQ ID NO: 87837

SEQ ID NO: 393504 - RNA, 64 nt, Homo Sapiens; identical to SEQ ID NO: 87838

SEQ ID NO: 393505 - RNA, 64 nt, Homo Sapiens; identical to SEQ ID NO: 87839

SEQ ID NO: 393506 - RNA, 64 nt, Homo Sapiens; identical to SEQ ID NO: 87840

SEQ ID NO: 393507 - RNA, 64 nt, Homo Sapiens; identical to SEQ ID NO: 87841

SEQ ID NO: 393508 - RNA, 64 nt, Homo Sapiens; identical to SEQ ID NO: 87842

SEQ ID NO: 393509 - RNA, 64 nt, Homo Sapiens; identical to SEQ ID NO: 87843

SEQ ID NO: 393510 - RNA, 64 nt, Homo Sapiens; identical to SEQ ID NO: 87844

SEQ ID NO: 393511 - RNA, 64 nt, Homo Sapiens; identical to SEQ ID NO: 87845

SEQ ID NO: 393512 - RNA, 64 nt, Homo Sapiens; identical to SEQ ID NO: 87846

SEQ ID NO: 393513 - RNA, 64 nt, Homo Sapiens; identical to SEQ ID NO: 87847

SEQ ID NO: 393514 - RNA, 64 nt, Homo Sapiens; identical to SEQ ID NO: 87848

SEQ ID NO: 393515 - RNA, 64 nt, Homo Sapiens; identical to SEQ ID NO: 87849

SEQ ID NO: 393516 - RNA, 64 nt, Homo Sapiens; identical to SEQ ID NO: 87850

SEQ ID NO: 393517 - RNA, 64 nt, Homo Sapiens; identical to SEQ ID NO: 87851

SEQ ID NO: 393518 - RNA, 58 nt, Homo Sapiens
aagagugucuugcugcuuggugggugcucaucgcaauguucugaaggcuccagggcca

SEQ ID NO: 393519 - RNA, 58 nt, Homo Sapiens
gaugugagagagacucugagacuucuuccaucgcaaugaccuguauuaaacacaagcc

SEQ ID NO: 393520 - RNA, 58 nt, Homo Sapiens
uauuaaaguaagguucucauuuagcagacaucgcaacaaguaccuucugugaaguuuc

SEQ ID NO: 393521 - RNA, 58 nt, Homo Sapiens
cgcguugggcagacugguugccucugggcaucgcaaacugcccccgggcgcaucuggc

SEQ ID NO: 393522 - RNA, 58 nt, Homo Sapiens
uaagacucgggauuaguacauagugaggcaucgcaauguagggauggggcugugggga

SEQ ID NO: 393523 - RNA, 58 nt, Homo Sapiens
cggacacagagggggccuucacagugaccaucgcaaccaggauugacagguggggcuc

SEQ ID NO: 393524 - RNA, 58 nt, Homo Sapiens
gaaagguuauuccaguaaaaaaaguuaccaucgcaaaggccuauacucccaagacuac

SEQ ID NO: 393525 - RNA, 58 nt, Homo Sapiens
accuuauguaaagcagaacuguuaccuacaucgcaauuuaaaagaaaacauuauccca

SEQ ID NO: 393526 - RNA, 53 nt, Homo Sapiens
aacgcaacaguggcuuucaaccucaucgcaacaucaugucaacaaaacucuaa

SEQ ID NO: 393527 - RNA, 58 nt, Homo Sapiens
ggaauccuuaccagagauccagaaagaacaucgcaaucugcuucaagaauuaaaaguu

SEQ ID NO: 393528 - RNA, 58 nt, Homo Sapiens
ucagagcgaacggccacaucacaaaagucaucgcaacuucaagaaaaccugcuuguuc

SEQ ID NO: 393529 - RNA, 58 nt, Homo Sapiens
ucaagcuucugaacuuaggcaaaauauucaucgcaaagucucuagcgucauauuuuuc

SEQ ID NO: 393530 - RNA, 58 nt, Homo Sapiens
auguuccuguguguuauacauauuaaaacaucgcaauaaagugaggauaucgugacag

SEQ ID NO: 393531 - RNA, 58 nt, Homo Sapiens
guuuuuuacuucucuuagguagugacaacaucgcaauaugauucagcaaaaaucuccc

SEQ ID NO: 393532 - RNA, 58 nt, Homo Sapiens
guguucacaggugacccgugucagccugcaucgcaagcacacacccugcgggccuuca

SEQ ID NO: 393533 - RNA, 58 nt, Homo Sapiens
cugagcaauggcaggaugugaacuuccccaucgcaaaugcaguucucagcccacugca

SEQ ID NO: 393534 - RNA, 58 nt, Homo Sapiens
ucccucccacaguuaccauuggccuugucaucgcaagcauuugacaaagacuugcuug

SEQ ID NO: 393535 - RNA, 58 nt, Homo Sapiens
aaacagccaaaaugaaugucuagcuaugcaucgcaauaaaugauaaaugacauaucau

SEQ ID NO: 393536 - RNA, 58 nt, Homo Sapiens
aaaaaaaaaaaaaaagaaaaugagacuccaucgcaaaauucagccuggaugaugagag

SEQ ID NO: 393537 - RNA, 58 nt, Homo Sapiens
ugauagacugcuguuuuucuggucugaccaucgcaacccucaugaaguacaaccagca

SEQ ID NO: 393538 - RNA, 58 nt, Homo Sapiens
cacagaaaaugcaccucauugugugggccaucgcaagucauucugcaaugagccauga

SEQ ID NO: 393539 - RNA, 58 nt, Homo Sapiens
uuuguuucugacccauuuugauuaugagcaucgcaaacuguugccacugcugaagaug

SEQ ID NO: 393540 - RNA, 58 nt, Homo Sapiens
uuagugagugcuuucaaacuaggcucgccaucgcaagaggcucaggaaagcggacgcg

SEQ ID NO: 393541 - RNA, 58 nt, Homo Sapiens
uuugguccaucaucuccugcaauaaacccaucgcaagaaugaccuucaagauguguga

SEQ ID NO: 393542 - RNA, 58 nt, Homo Sapiens
uuauucugaagcuucugcagaugggaaccaucgcaaaaaaauguguuucccucaaauc

SEQ ID NO: 393543 - RNA, 58 nt, Homo Sapiens
gacgagacaucguucauaaggcacagcacaucgcaagaugaacaguuguuaauaaaag

SEQ ID NO: 393544 - RNA, 58 nt, Homo Sapiens
ucuauugguccaugauaguggcccugaucaucgcaaacauuuucucuuuaggguaaau

SEQ ID NO: 393545 - RNA, 58 nt, Homo Sapiens
ggcacuaagggaguaccuuauuauccuacaucgcaaauuucaacagcuacauuauauu

SEQ ID NO: 393546 - RNA, 64 nt, Homo Sapiens
acuguguuuucaaaacuuugcaaauucaucuguuacacagaaaauuuugacuuaaaacaucugc

SEQ ID NO: 393547 - RNA, 64 nt, Homo Sapiens
uuccaaaacuuaagaaccauauuuacauugcuuaacacagaauuuuacaucuaagcaaggacug

SEQ ID NO: 393548 - RNA, 64 nt, Homo Sapiens
aaauaggcuuuacaggcuccccuccuccaaacacacacagaaugggcugguuucuuucaaguuu

SEQ ID NO: 393549 - RNA, 64 nt, Homo Sapiens
ucgaaggucucccaggagcucuguacugaggcagacacagaaagacacaaaacggucgucuuuc

SEQ ID NO: 393550 - RNA, 64 nt, Homo Sapiens
augaauauauauauauauauauauauacacacacacacagaaaguuuuauauguguguguggau

SEQ ID NO: 393551 - RNA, 64 nt, Homo Sapiens
aaaauaauguucuuuuuaugaaauacuuauauauacacagaacagaaacaaguuaaggaaacaa

SEQ ID NO: 393552 - RNA, 64 nt, Homo Sapiens
uuuuuaaaaugaauuuuacccacaauuuauuucuacacagaaagguuacauguauauuacuugg

SEQ ID NO: 393553 - RNA, 64 nt, Homo Sapiens
uuguacuuuucagcucuuaacgccaauuuaaaugacacagaacuauugacugaagagagacacu

SEQ ID NO: 393554 - RNA, 64 nt, Homo Sapiens
guugcagucaagugucugucauguguugauauccacacagaauuaggcccuaaugagagccuua

SEQ ID NO: 393555 - RNA, 64 nt, Homo Sapiens
gcuguuagggacgggcccagcuccugcaccacggacacagaaugucuggagagggccagcaggc

SEQ ID NO: 393556 - RNA, 64 nt, Homo Sapiens
uaugcuaccagauauuauauacaaugaucaucaaacacagaacaaagcaaaaaacaaacucccc

SEQ ID NO: 393557 - RNA, 64 nt, Homo Sapiens
aacagcaugugcucauuucauuuuucugugucuuacacagaaacuuaaaauauuucaaacuuuu

SEQ ID NO: 393558 - RNA, 64 nt, Homo Sapiens
agugagagcuuuuucccuuugcuaaccaacgagcacacagaagaucuccagucaccccauagag

SEQ ID NO: 393559 - RNA, 64 nt, Homo Sapiens
accggcucauuuggucacuagucuauagaagaugacacagaaauuggaaccaacaaaacugcua

SEQ ID NO: 393560 - RNA, 64 nt, Homo Sapiens
ccaaaccacuaaaaacuaccacaggcaugcacacacacagaaccaugcaacagaagacaaaagc

SEQ ID NO: 393561 - RNA, 64 nt, Homo Sapiens
aggcuggaggagccacuggaauaucucuaacaccacacagaaagcagccuaggaaaccuuaacc

SEQ ID NO: 393562 - RNA, 64 nt, Homo Sapiens
uuagaugcuuugugacuuaaucuguuuuuucuguacacagaagugaguugucaagacugaucau

SEQ ID NO: 393563 - RNA, 64 nt, Homo Sapiens
gggagcuaaauugaauacacgcauucaggguuauacacagaaaaucaaagaaaacauagcacua

SEQ ID NO: 393564 - RNA, 64 nt, Homo Sapiens
aaagggcaucucagccucucauuaucuucugaugacacagaauguggcauucaaucguuggcag

SEQ ID NO: 393565 - RNA, 64 nt, Homo Sapiens
uaucuuuuggaaaguuuagccuaguaaccagaggacacagaaaggguuuagugcucaguuggcu

SEQ ID NO: 393566 - RNA, 64 nt, Homo Sapiens
uuaaaaucucauuacuaucuauuauuuaguucuaacacagaagcuuuaaaaauacauagucauc

SEQ ID NO: 393567 - RNA, 64 nt, Homo Sapiens
guugaguugcuuuaagugaauuuuaacaaauaugacacagaaaaggucagaugcuguuguauaa

SEQ ID NO: 393568 - RNA, 64 nt, Homo Sapiens
acacacacagacacaaaaucacauacacagacacacacagaaagcgccacagagacacaccauu

SEQ ID NO: 393569 - RNA, 64 nt, Homo Sapiens
acacacacagacacacaauccauuacacacacauacacagaaaguuccggccacagaaacacac

SEQ ID NO: 393570 - RNA, 64 nt, Homo Sapiens
acacagacacaaaaucacacacauacacagacacacacagaaagcccgccacagagacaccauu

SEQ ID NO: 393571 - RNA, 64 nt, Homo Sapiens
acacacacagacacaaaaucacauacacagacacacacagaaagcccaccacagagacaccauu

SEQ ID NO: 393572 - RNA, 64 nt, Homo Sapiens
cagaaaggaaaaauaaaacauacuucacauuagaacacagaaucauuuacauccuaauacugac

SEQ ID NO: 393573 - RNA, 64 nt, Homo Sapiens
caccuuucgaggcauugcgaggcuagaugguaacacacagaaagcucccacagugggaccuuga

SEQ ID NO: 393574 - RNA, 64 nt, Homo Sapiens
uguaguuuuguuuuaauaaaguguauugcaagaaacacagaaaaauugauuuuuaugcuuguua

SEQ ID NO: 393575 - RNA, 64 nt, Homo Sapiens
guagcuguguucuggaacugaauuacugugauggacacagaaauaaguacaacuuuuaaggacu

SEQ ID NO: 393576 - RNA, 64 nt, Homo Sapiens
uccuugugcaaauaaaugcugcaaaguuaaccugacacagaaaaagcuacacagaaucuacaca

SEQ ID NO: 393577 - RNA, 64 nt, Homo Sapiens
uacacagcaaaguuaaccuggaauucagguagcuacacagaaucugugagacuuuuucuuggac

SEQ ID NO: 393578 - RNA, 64 nt, Homo Sapiens
cuuauauauuuguuacacuguauugcaagauagcacacagaaguuggcugcgucaaguagaggc

SEQ ID NO: 393579 - RNA, 64 nt, Homo Sapiens
ucuauauauaucuguauaucuuauacauguccauacacagaaacauaauaaacaaucuucacac

SEQ ID NO: 393580 - RNA, 64 nt, Homo Sapiens
aaacgggcaaaauaauugugcuggauucucacacacacagaaauaucgaccaucacccuccccc

SEQ ID NO: 393581 - RNA, 64 nt, Homo Sapiens
accaccuuauuuccuuguuuuguugauuagaacaacacagaaaaaagcaaauauaaauuuuuaa

SEQ ID NO: 393582 - RNA, 64 nt, Homo Sapiens
uguuuuaauuagcugcaauauauacggccuguguacacagaauuuaaucacuucggcagguuga

SEQ ID NO: 393583 - RNA, 64 nt, Homo Sapiens
agcagccacccgugucuacuacuacacagugcagacacagaacauaucaucacugcagauaguu

SEQ ID NO: 393584 - RNA, 64 nt, Homo Sapiens
caccaggcauaaccuaauuuuauccauggaagaaacacagaaaggcaucuaaguuagagcuggc

SEQ ID NO: 393585 - RNA, 64 nt, Homo Sapiens
uccagcuggccccggagccagagcuucuuguacuacacagaauugccccugccauuuccacccu

SEQ ID NO: 393586 - RNA, 64 nt, Homo Sapiens
gcacaggggaggccgagcauggggacacuuacggacacagaaauuguggacacagaaaugcaca

SEQ ID NO: 393587 - RNA, 64 nt, Homo Sapiens
gcacaggggacacuuacggauaguagucuuguggacacagaaauugaggugucuacaggguuua

SEQ ID NO: 393588 - RNA, 64 nt, Homo Sapiens
caaccuauuucucuacucuuuaguagaguucgagacacagaagugcaauaacugcccuaauuaa

SEQ ID NO: 393589 - RNA, 64 nt, Homo Sapiens
gcuucuugcagucaacaagaaauaccaauaacacacacagaacaaaaaccaucaaaaucucaua

SEQ ID NO: 393590 - RNA, 64 nt, Homo Sapiens; identical to SEQ ID NO: 393588

SEQ ID NO: 393591 - RNA, 64 nt, Homo Sapiens
gcuucuugcagucaagaagaaauaccaauaacacacacagaacaaaaaccaucaaaaucucaua

SEQ ID NO: 393592 - RNA, 64 nt, Homo Sapiens
cuuuuuaaaaauagacacucacaacugccucgaaacacagaaacgauucugcaguaaaucuuuu

SEQ ID NO: 393593 - RNA, 64 nt, Homo Sapiens
uguugagaaucccaaauuugcacaccuuuuauugacacagaaaauucaucgaaucuacuaauuc

SEQ ID NO: 393594 - RNA, 64 nt, Homo Sapiens
aauuuuuucucaguguguguguuuauuccuuauagguguaaaugagaagacguguuuuuuuccu

SEQ ID NO: 393595 - RNA, 64 nt, Homo Sapiens
uuuuuguaaaaaauauauaaaggggguguuaaucgguguaaaucgcuguuuggauuuccugauu

SEQ ID NO: 393596 - RNA, 64 nt, Homo Sapiens
gaaaaccuuucuagggauuuauuugcguuaaugaagacuacacaagagugaaacauucacaaag

SEQ ID NO: 393597 - RNA, 64 nt, Homo Sapiens
gcaaauaagauauacugagcaaaggaaugacagcagacuacaaacaugugcugugugcucuuug

SEQ ID NO: 393598 - RNA, 65 nt, Homo Sapiens
aauggagcaaaacuguauaaacugauuuguaacuaacacuggaccauuggaucgauauuauaugc

SEQ ID NO: 393599 - RNA, 65 nt, Homo Sapiens
cucacugugaaaaauaacaguccaccccaagucauacacuggacccagugccugcggggacagga

SEQ ID NO: 393600 - RNA, 65 nt, Homo Sapiens
cuuugauucacccuccacagccagacaauaaacuuacacuggaaguuuuggcucugguguuuucg

SEQ ID NO: 393601 - RNA, 65 nt, Homo Sapiens
cucaaacucuuaggcucaggagaugugaugauagcacacuggagcauagggcaguggcuauucac

SEQ ID NO: 393602 - RNA, 65 nt, Homo Sapiens
ucccuuggggaaggguggggagaaauauaggauagacacuggacauggcccauuggagcaccugg

SEQ ID NO: 393603 - RNA, 65 nt, Homo Sapiens
gguggcugcgcccccagcuucucucucccugucacacacuggaccccacuggcugagaaucuggg

SEQ ID NO: 393604 - RNA, 65 nt, Homo Sapiens
cucagcuugggcuucuuccuccuccaucaccugaaacacuggaccuggggguagccccgccccag

SEQ ID NO: 393605 - RNA, 65 nt, Homo Sapiens
cucugggacaagaaaaagaaaacacaagaauguauacacuggaagauuugggccuccugccugcc

SEQ ID NO: 393606 - RNA, 65 nt, Homo Sapiens
agaugaggagguacagacacgugaccuuuuggugcacacuggagcuacuuggacaagaccagcau

SEQ ID NO: 393607 - RNA, 65 nt, Homo Sapiens
cucuuaggaaguaucaaaauuaaaaugaucugauuacacuggacacuagggucaauaacccauua

SEQ ID NO: 393608 - RNA, 65 nt, Homo Sapiens
gcaugguugaaugugucuuuucauuaagguauugaacacuggauuucaaucagcauuguuauuua

SEQ ID NO: 393609 - RNA, 65 nt, Homo Sapiens
ggggaccugcgcccccacaugcacaggaagccuucacacuggaagggggucaggaacacuacacu

SEQ ID NO: 393610 - RNA, 65 nt, Homo Sapiens
aggagcugggucagccucuggaggagucacagcauacacuggaacccgagcuccagcugccuuag

SEQ ID NO: 393611 - RNA, 65 nt, Homo Sapiens
uucuuaauagguucaaaagcaaucuggucugaauaacacuggauuuguuucugugaucucugagg

SEQ ID NO: 393612 - RNA, 65 nt, Homo Sapiens
ucuugcugauuuucagacagggaagucucucuauuacacuggagcuguuuuauagauaagucaau

SEQ ID NO: 393613 - RNA, 65 nt, Homo Sapiens
ggaagcuucuacgcgcuagagaggaucaaggggccacacuggaccaugugaacagccauccugaa

SEQ ID NO: 393614 - RNA, 65 nt, Homo Sapiens
augugaacagccauccugaacugccaucagcuaccacacuggacucugcagggcagccauccugg

SEQ ID NO: 393615 - RNA, 65 nt, Homo Sapiens
auguguuuaaacaaauguaauauuuuguacaagauacacuggagaacaaagggaacucaagauuc

SEQ ID NO: 393616 - RNA, 65 nt, Homo Sapiens
uggccccucuggccagggccccuguggcuuccugcacacuggacaggugacuguaugguagagac

SEQ ID NO: 393617 - RNA, 65 nt, Homo Sapiens
uucugccaagucauuucaaauacaugaaaaaucuuacacuggagagaaacccuaugaguguaagc

SEQ ID NO: 393618 - RNA, 65 nt, Homo Sapiens
uuccuucacuuccuuucgauaucaugaaaggacucacacuggagagaaccccuaugaguguaagc

SEQ ID NO: 393619 - RNA, 65 nt, Homo Sapiens
aucugucaaaaaucuucgauuucauaaaaggacacacacuggagagaaacccugugaauguaaga

SEQ ID NO: 393620 - RNA, 65 nt, Homo Sapiens
cuugccuacuuccuuucauagacaugaaaagacucacacuggaaggaaacacuaugaaugcaagc

SEQ ID NO: 393621 - RNA, 65 nt, Homo Sapiens
uucuucuaguucccuucaauaucaugaaaggacucacacuggagagaagcccuaugaauauaagc

SEQ ID NO: 393622 - RNA, 65 nt, Homo Sapiens
aucagccucgcaccuucaaaugcauggaaggacucacacuggagaaaaacccuaugaauguaagc

SEQ ID NO: 393623 - RNA, 65 nt, Homo Sapiens
uucugccaaguuauuucaaacacaugaaaaaauucacacuggagagaaacccuauaaaugcaagc

SEQ ID NO: 393624 - RNA, 65 nt, Homo Sapiens
aucugucaagaaccuuucaauuuaugaaaggacacacacuggagagaaacccuaugaauguaaga

SEQ ID NO: 393625 - RNA, 65 nt, Homo Sapiens
uaucugccaagaucguuugaauacaugcaaaacacacacuggagagaaaccuaugaauguaagga

SEQ ID NO: 393626 - RNA, 65 nt, Homo Sapiens
uucugccaagucauuucgaagacaugaaaaaacucacacuggagagaaacccuauaaaugcaugc

SEQ ID NO: 393627 - RNA, 65 nt, Homo Sapiens
ucuuuccaguuccuuucaguaucaugaaaggacucacacuggagagaaacccuaugaguguaagc

SEQ ID NO: 393628 - RNA, 65 nt, Homo Sapiens
uaguuccaguuccuuuugguaccaugaaaggacucacacuggagagaaacccuaugaguguaagc

SEQ ID NO: 393629 - RNA, 65 nt, Homo Sapiens
aucugccccacaccuucgaauccaugguagaacucacacuggagagaaacccuaugaguguaagg

SEQ ID NO: 393630 - RNA, 65 nt, Homo Sapiens
uucugccaagucauuucaaauaccugaaaaaucuuacacuggagagaaacccuaugaguguaagc

SEQ ID NO: 393631 - RNA, 65 nt, Homo Sapiens
uucuuucacuucuuuucgauaacaugaaaggacucacacuggagagaaacccuaugaguguaagc

SEQ ID NO: 393632 - RNA, 65 nt, Homo Sapiens
aucuaccucacaccuucgaaaacaugguaggacucacacuggauagaaaccaaagcaggugaauc

SEQ ID NO: 393633 - RNA, 65 nt, Homo Sapiens
ggguuccagacugguuggacuuguucgucuggacgacacuggaguggaacacugccucccacuuu

SEQ ID NO: 393634 - RNA, 65 nt, Homo Sapiens
ccacuuucuugggacuuggagggagguggaacagcacacuggacuucucccgucucuagggcugc

SEQ ID NO: 393635 - RNA, 65 nt, Homo Sapiens
ucaccaacauauuguggcuggacagcaggcaguacacacuggagaaagacugaaugccgugaacg

SEQ ID NO: 393636 - RNA, 65 nt, Homo Sapiens
cuacuacuccacacuacuuagacaucauguaguucacacuggaaaaaggccacguaugugccuug

SEQ ID NO: 393637 - RNA, 65 nt, Homo Sapiens
ggacagcuguacacugaagagucaucagagaguucacacuggagaaagaccuuuugaaugcagca

SEQ ID NO: 393638 - RNA, 65 nt, Homo Sapiens
auacaacuccagccucauuaaacaucggagaauucacacuggagagagaccuuaucagugcagug

SEQ ID NO: 393639 - RNA, 65 nt, Homo Sapiens
uggaaauccguuagccacaccuccagucucauucaacacuggacaguuuacaauguggacaaugu

SEQ ID NO: 393640 - RNA, 65 nt, Homo Sapiens
ccaaaggccuaacccuauucaacaccagaaaguuuacacuggagaaaggccuuagggugacaggu

SEQ ID NO: 393641 - RNA, 65 nt, Homo Sapiens
gagcuggcaauugaacaucauucaucuaaauaugcacacuggaggcaagaugagaauuccugaca

SEQ ID NO: 393642 - RNA, 65 nt, Homo Sapiens
ccgaaaaucuagccuuauuauacaucugagaguucacacuggagaaaggccuuaugagugcagug

SEQ ID NO: 393643 - RNA, 65 nt, Homo Sapiens
ugaaaacuccagccuuauuaaacacuugagaguucacacuggagaaaggccauaugaaugcauug

SEQ ID NO: 393644 - RNA, 65 nt, Homo Sapiens
agauguggagguaauauuauuuuuucuucaauauaacacuggaggaaaccccuuaugaggaugcc

SEQ ID NO: 393645 - RNA, 65 nt, Homo Sapiens
gaaaccuuauaaauguaaggugcacaugagaaugcacacuggagauuuccuuacaggcuuucgag

SEQ ID NO: 393646 - RNA, 65 nt, Homo Sapiens
gaaaccuuaugaauguaaacuacaugaaagaacccacacuggagauacucuugcagguuuccaga

SEQ ID NO: 393647 - RNA, 65 nt, Homo Sapiens
uaaacccuuugaguguaaaacacaugaaaguacucacacuggagagucuccuuuagguuuucaag

SEQ ID NO: 393648 - RNA, 65 nt, Homo Sapiens
aaaacccuaugaauguaaaacacaugaaagaacucacacuggagaaucuucuguagguuuucaag

SEQ ID NO: 393649 - RNA, 65 nt, Homo Sapiens
uaaacccuuuaaguguaaaguacauggaaggacucacacuggagauugucaacguucuuuccaaa

SEQ ID NO: 393650 - RNA, 65 nt, Homo Sapiens
gaugcuguaugauauaaggaaucaugaaauaucucacacuggagauaauuuuuauuccuuucaaa

SEQ ID NO: 393651 - RNA, 65 nt, Homo Sapiens
gaaacccuauaaauguaaauaucaugaauaaacuuacacuggacauauuuccaguucccuuugau

SEQ ID NO: 393652 - RNA, 65 nt, Homo Sapiens
gaagccguaugaauguaaggaacaugaaaggauucacacuggagaucauuuuggucacuuaaagc

SEQ ID NO: 393653 - RNA, 65 nt, Homo Sapiens
uggaccucacaaaaugcaaggacacaugacaaugcacacuggagaucauagcucaagcuuucgaa

SEQ ID NO: 393654 - RNA, 65 nt, Homo Sapiens
gaagaaacucuaugaaugcagucaugaaagaacucacacuggagauuguuccaguacacugcaaa

SEQ ID NO: 393655 - RNA, 65 nt, Homo Sapiens
gaaacucuguacauguaaacgacaugaaaaaacucacacuggagaugauuacaguucuugucuaa

SEQ ID NO: 393656 - RNA, 65 nt, Homo Sapiens
gaaaccuuacaagugcaaugcccauacuagaauucacacuggagagaaugauucacacguggcac

SEQ ID NO: 393657 - RNA, 65 nt, Homo Sapiens
aaagccauagaaauguaagguacauaggagaauucacacuggagauucacaaauccagcuucaaa

SEQ ID NO: 393658 - RNA, 65 nt, Homo Sapiens
gaaacucauuauaaguguaaaacauacuagaauucacacuggagaauauaaugcauaucuggcaa

SEQ ID NO: 393659 - RNA, 65 nt, Homo Sapiens
uacaaaugagaagagucuacuuauuaauguucaaaacacuggaauguuuuuaacagaacguguau

SEQ ID NO: 393660 - RNA, 65 nt, Homo Sapiens
uuuuuaacagaacguguauuuaugggagagauuagacacuggaggauuuuuauuacuuaagacuu

SEQ ID NO: 393661 - RNA, 62 nt, Homo Sapiens; identical to SEQ ID NO: 53842

SEQ ID NO: 393662 - RNA, 62 nt, Homo Sapiens; identical to SEQ ID NO: 53843

SEQ ID NO: 393663 - RNA, 62 nt, Homo Sapiens; identical to SEQ ID NO: 53844

SEQ ID NO: 393664 - RNA, 62 nt, Homo Sapiens; identical to SEQ ID NO: 53845

SEQ ID NO: 393665 - RNA, 62 nt, Homo Sapiens; identical to SEQ ID NO: 53846

SEQ ID NO: 393666 - RNA, 62 nt, Homo Sapiens; identical to SEQ ID NO: 53847

SEQ ID NO: 393667 - RNA, 62 nt, Homo Sapiens; identical to SEQ ID NO: 53848

SEQ ID NO: 393668 - RNA, 62 nt, Homo Sapiens; identical to SEQ ID NO: 53849

SEQ ID NO: 393669 - RNA, 62 nt, Homo Sapiens; identical to SEQ ID NO: 53850

SEQ ID NO: 393670 - RNA, 62 nt, Homo Sapiens; identical to SEQ ID NO: 53851

SEQ ID NO: 393671 - RNA, 62 nt, Homo Sapiens; identical to SEQ ID NO: 53852

SEQ ID NO: 393672 - RNA, 62 nt, Homo Sapiens; identical to SEQ ID NO: 53853

SEQ ID NO: 393673 - RNA, 62 nt, Homo Sapiens; identical to SEQ ID NO: 53854

SEQ ID NO: 393674 - RNA, 62 nt, Homo Sapiens; identical to SEQ ID NO: 53855

SEQ ID NO: 393675 - RNA, 62 nt, Homo Sapiens; identical to SEQ ID NO: 53856

SEQ ID NO: 393676 - RNA, 62 nt, Homo Sapiens; identical to SEQ ID NO: 53857

SEQ ID NO: 393677 - RNA, 62 nt, Homo Sapiens; identical to SEQ ID NO: 53858

SEQ ID NO: 393678 - RNA, 62 nt, Homo Sapiens; identical to SEQ ID NO: 53859

SEQ ID NO: 393679 - RNA, 62 nt, Homo Sapiens; identical to SEQ ID NO: 53860

SEQ ID NO: 393680 - RNA, 62 nt, Homo Sapiens; identical to SEQ ID NO: 53861

SEQ ID NO: 393681 - RNA, 62 nt, Homo Sapiens; identical to SEQ ID NO: 53862

SEQ ID NO: 393682 - RNA, 62 nt, Homo Sapiens; identical to SEQ ID NO: 53863

SEQ ID NO: 393683 - RNA, 62 nt, Homo Sapiens; identical to SEQ ID NO: 53864

SEQ ID NO: 393684 - RNA, 62 nt, Homo Sapiens; identical to SEQ ID NO: 53865

SEQ ID NO: 393685 - RNA, 62 nt, Homo Sapiens; identical to SEQ ID NO: 53866

SEQ ID NO: 393686 - RNA, 62 nt, Homo Sapiens; identical to SEQ ID NO: 53867

SEQ ID NO: 393687 - RNA, 62 nt, Homo Sapiens; identical to SEQ ID NO: 53868

SEQ ID NO: 393688 - RNA, 62 nt, Homo Sapiens; identical to SEQ ID NO: 53869

SEQ ID NO: 393689 - RNA, 62 nt, Homo Sapiens; identical to SEQ ID NO: 53870

SEQ ID NO: 393690 - RNA, 62 nt, Homo Sapiens; identical to SEQ ID NO: 53871

SEQ ID NO: 393691 - RNA, 62 nt, Homo Sapiens; identical to SEQ ID NO: 53872

SEQ ID NO: 393692 - RNA, 62 nt, Homo Sapiens; identical to SEQ ID NO: 53873

SEQ ID NO: 393693 - RNA, 62 nt, Homo Sapiens; identical to SEQ ID NO: 53874

SEQ ID NO: 393694 - RNA, 62 nt, Homo Sapiens; identical to SEQ ID NO: 53875

SEQ ID NO: 393695 - RNA, 62 nt, Homo Sapiens; identical to SEQ ID NO: 53876

SEQ ID NO: 393696 - RNA, 62 nt, Homo Sapiens; identical to SEQ ID NO: 53877

SEQ ID NO: 393697 - RNA, 62 nt, Homo Sapiens; identical to SEQ ID NO: 53878

SEQ ID NO: 393698 - RNA, 62 nt, Homo Sapiens; identical to SEQ ID NO: 53879

SEQ ID NO: 393699 - RNA, 62 nt, Homo Sapiens; identical to SEQ ID NO: 53880

SEQ ID NO: 393700 - RNA, 62 nt, Homo Sapiens; identical to SEQ ID NO: 53881

SEQ ID NO: 393701 - RNA, 62 nt, Homo Sapiens; identical to SEQ ID NO: 53882

SEQ ID NO: 393702 - RNA, 64 nt, Homo Sapiens; identical to SEQ ID NO: 53883

SEQ ID NO: 393703 - RNA, 64 nt, Homo Sapiens; identical to SEQ ID NO: 53884

SEQ ID NO: 393704 - RNA, 64 nt, Homo Sapiens; identical to SEQ ID NO: 53885

SEQ ID NO: 393705 - RNA, 64 nt, Homo Sapiens; identical to SEQ ID NO: 53886

SEQ ID NO: 393706 - RNA, 64 nt, Homo Sapiens; identical to SEQ ID NO: 53887

SEQ ID NO: 393707 - RNA, 64 nt, Homo Sapiens; identical to SEQ ID NO: 53888

SEQ ID NO: 393708 - RNA, 64 nt, Homo Sapiens; identical to SEQ ID NO: 53889

SEQ ID NO: 393709 - RNA, 64 nt, Homo Sapiens; identical to SEQ ID NO: 53890

SEQ ID NO: 393710 - RNA, 64 nt, Homo Sapiens; identical to SEQ ID NO: 53891

SEQ ID NO: 393711 - RNA, 64 nt, Homo Sapiens; identical to SEQ ID NO: 53892

SEQ ID NO: 393712 - RNA, 64 nt, Homo Sapiens; identical to SEQ ID NO: 53893

SEQ ID NO: 393713 - RNA, 64 nt, Homo Sapiens; identical to SEQ ID NO: 53894

SEQ ID NO: 393714 - RNA, 64 nt, Homo Sapiens; identical to SEQ ID NO: 53895

SEQ ID NO: 393715 - RNA, 64 nt, Homo Sapiens; identical to SEQ ID NO: 53896

SEQ ID NO: 393716 - RNA, 64 nt, Homo Sapiens; identical to SEQ ID NO: 53897

SEQ ID NO: 393717 - RNA, 64 nt, Homo Sapiens; identical to SEQ ID NO: 53898

SEQ ID NO: 393718 - RNA, 64 nt, Homo Sapiens; identical to SEQ ID NO: 53899

SEQ ID NO: 393719 - RNA, 64 nt, Homo Sapiens; identical to SEQ ID NO: 53900

SEQ ID NO: 393720 - RNA, 64 nt, Homo Sapiens; identical to SEQ ID NO: 53901

SEQ ID NO: 393721 - RNA, 64 nt, Homo Sapiens; identical to SEQ ID NO: 53902

SEQ ID NO: 393722 - RNA, 64 nt, Homo Sapiens; identical to SEQ ID NO: 53903

SEQ ID NO: 393723 - RNA, 64 nt, Homo Sapiens; identical to SEQ ID NO: 53904

SEQ ID NO: 393724 - RNA, 64 nt, Homo Sapiens; identical to SEQ ID NO: 53905

SEQ ID NO: 393725 - RNA, 64 nt, Homo Sapiens; identical to SEQ ID NO: 53906

SEQ ID NO: 393726 - RNA, 64 nt, Homo Sapiens; identical to SEQ ID NO: 53907

SEQ ID NO: 393727 - RNA, 64 nt, Homo Sapiens; identical to SEQ ID NO: 53908

SEQ ID NO: 393728 - RNA, 64 nt, Homo Sapiens; identical to SEQ ID NO: 53909

SEQ ID NO: 393729 - RNA, 64 nt, Homo Sapiens; identical to SEQ ID NO: 53910

SEQ ID NO: 393730 - RNA, 64 nt, Homo Sapiens; identical to SEQ ID NO: 53911

SEQ ID NO: 393731 - RNA, 64 nt, Homo Sapiens; identical to SEQ ID NO: 53912

SEQ ID NO: 393732 - RNA, 64 nt, Homo Sapiens; identical to SEQ ID NO: 53913

SEQ ID NO: 393733 - RNA, 64 nt, Homo Sapiens; identical to SEQ ID NO: 53914

SEQ ID NO: 393734 - RNA, 64 nt, Homo Sapiens; identical to SEQ ID NO: 53915

SEQ ID NO: 393735 - RNA, 64 nt, Homo Sapiens; identical to SEQ ID NO: 53916

SEQ ID NO: 393736 - RNA, 64 nt, Homo Sapiens; identical to SEQ ID NO: 53917

SEQ ID NO: 393737 - RNA, 64 nt, Homo Sapiens; identical to SEQ ID NO: 53918

SEQ ID NO: 393738 - RNA, 64 nt, Homo Sapiens; identical to SEQ ID NO: 53919

SEQ ID NO: 393739 - RNA, 64 nt, Homo Sapiens; identical to SEQ ID NO: 53920

SEQ ID NO: 393740 - RNA, 64 nt, Homo Sapiens; identical to SEQ ID NO: 53921

SEQ ID NO: 393741 - RNA, 64 nt, Homo Sapiens; identical to SEQ ID NO: 53922

SEQ ID NO: 393742 - RNA, 64 nt, Homo Sapiens; identical to SEQ ID NO: 53923

SEQ ID NO: 393743 - RNA, 65 nt, Homo Sapiens; identical to SEQ ID NO: 53924

SEQ ID NO: 393744 - RNA, 65 nt, Homo Sapiens; identical to SEQ ID NO: 53925

SEQ ID NO: 393745 - RNA, 65 nt, Homo Sapiens; identical to SEQ ID NO: 53926

SEQ ID NO: 393746 - RNA, 65 nt, Homo Sapiens; identical to SEQ ID NO: 53927

SEQ ID NO: 393747 - RNA, 65 nt, Homo Sapiens; identical to SEQ ID NO: 53928

SEQ ID NO: 393748 - RNA, 65 nt, Homo Sapiens; identical to SEQ ID NO: 53929

SEQ ID NO: 393749 - RNA, 65 nt, Homo Sapiens; identical to SEQ ID NO: 53930

SEQ ID NO: 393750 - RNA, 65 nt, Homo Sapiens; identical to SEQ ID NO: 53931

SEQ ID NO: 393751 - RNA, 65 nt, Homo Sapiens; identical to SEQ ID NO: 53932

SEQ ID NO: 393752 - RNA, 65 nt, Homo Sapiens; identical to SEQ ID NO: 53933

SEQ ID NO: 393753 - RNA, 65 nt, Homo Sapiens; identical to SEQ ID NO: 53934

SEQ ID NO: 393754 - RNA, 65 nt, Homo Sapiens; identical to SEQ ID NO: 53935

SEQ ID NO: 393755 - RNA, 65 nt, Homo Sapiens; identical to SEQ ID NO: 53936

SEQ ID NO: 393756 - RNA, 65 nt, Homo Sapiens; identical to SEQ ID NO: 53937

SEQ ID NO: 393757 - RNA, 65 nt, Homo Sapiens; identical to SEQ ID NO: 53938

SEQ ID NO: 393758 - RNA, 65 nt, Homo Sapiens; identical to SEQ ID NO: 53939

SEQ ID NO: 393759 - RNA, 65 nt, Homo Sapiens; identical to SEQ ID NO: 53940

SEQ ID NO: 393760 - RNA, 65 nt, Homo Sapiens; identical to SEQ ID NO: 53941

SEQ ID NO: 393761 - RNA, 65 nt, Homo Sapiens; identical to SEQ ID NO: 53942

SEQ ID NO: 393762 - RNA, 65 nt, Homo Sapiens; identical to SEQ ID NO: 53943

SEQ ID NO: 393763 - RNA, 65 nt, Homo Sapiens; identical to SEQ ID NO: 53944

SEQ ID NO: 393764 - RNA, 65 nt, Homo Sapiens; identical to SEQ ID NO: 53945

SEQ ID NO: 393765 - RNA, 65 nt, Homo Sapiens; identical to SEQ ID NO: 53946

SEQ ID NO: 393766 - RNA, 65 nt, Homo Sapiens; identical to SEQ ID NO: 53947

SEQ ID NO: 393767 - RNA, 65 nt, Homo Sapiens; identical to SEQ ID NO: 53948

SEQ ID NO: 393768 - RNA, 65 nt, Homo Sapiens; identical to SEQ ID NO: 53949

SEQ ID NO: 393769 - RNA, 65 nt, Homo Sapiens; identical to SEQ ID NO: 53950

SEQ ID NO: 393770 - RNA, 65 nt, Homo Sapiens; identical to SEQ ID NO: 53951

SEQ ID NO: 393771 - RNA, 65 nt, Homo Sapiens; identical to SEQ ID NO: 53952

SEQ ID NO: 393772 - RNA, 65 nt, Homo Sapiens; identical to SEQ ID NO: 53953

SEQ ID NO: 393773 - RNA, 65 nt, Homo Sapiens; identical to SEQ ID NO: 53954

SEQ ID NO: 393774 - RNA, 65 nt, Homo Sapiens; identical to SEQ ID NO: 53955

SEQ ID NO: 393775 - RNA, 65 nt, Homo Sapiens; identical to SEQ ID NO: 53956

SEQ ID NO: 393776 - RNA, 65 nt, Homo Sapiens; identical to SEQ ID NO: 53957

SEQ ID NO: 393777 - RNA, 65 nt, Homo Sapiens; identical to SEQ ID NO: 53958

SEQ ID NO: 393778 - RNA, 65 nt, Homo Sapiens; identical to SEQ ID NO: 53959

SEQ ID NO: 393779 - RNA, 65 nt, Homo Sapiens; identical to SEQ ID NO: 53960

SEQ ID NO: 393780 - RNA, 65 nt, Homo Sapiens; identical to SEQ ID NO: 53961

SEQ ID NO: 393781 - RNA, 65 nt, Homo Sapiens; identical to SEQ ID NO: 53962

SEQ ID NO: 393782 - RNA, 65 nt, Homo Sapiens; identical to SEQ ID NO: 53963

SEQ ID NO: 393783 - RNA, 65 nt, Homo Sapiens; identical to SEQ ID NO: 53964

SEQ ID NO: 393784 - RNA, 64 nt, Homo Sapiens; identical to SEQ ID NO: 53965

SEQ ID NO: 393785 - RNA, 64 nt, Homo Sapiens; identical to SEQ ID NO: 53966

SEQ ID NO: 393786 - RNA, 64 nt, Homo Sapiens; identical to SEQ ID NO: 53967

SEQ ID NO: 393787 - RNA, 64 nt, Homo Sapiens; identical to SEQ ID NO: 53968

SEQ ID NO: 393788 - RNA, 64 nt, Homo Sapiens; identical to SEQ ID NO: 53969

SEQ ID NO: 393789 - RNA, 64 nt, Homo Sapiens; identical to SEQ ID NO: 53970

SEQ ID NO: 393790 - RNA, 64 nt, Homo Sapiens; identical to SEQ ID NO: 53971

SEQ ID NO: 393791 - RNA, 64 nt, Homo Sapiens; identical to SEQ ID NO: 53972

SEQ ID NO: 393792 - RNA, 64 nt, Homo Sapiens; identical to SEQ ID NO: 53973

SEQ ID NO: 393793 - RNA, 64 nt, Homo Sapiens; identical to SEQ ID NO: 53974

SEQ ID NO: 393794 - RNA, 64 nt, Homo Sapiens; identical to SEQ ID NO: 53975

SEQ ID NO: 393795 - RNA, 64 nt, Homo Sapiens; identical to SEQ ID NO: 53976

SEQ ID NO: 393796 - RNA, 64 nt, Homo Sapiens; identical to SEQ ID NO: 53977

SEQ ID NO: 393797 - RNA, 64 nt, Homo Sapiens; identical to SEQ ID NO: 53978

SEQ ID NO: 393798 - RNA, 64 nt, Homo Sapiens; identical to SEQ ID NO: 53979

SEQ ID NO: 393799 - RNA, 64 nt, Homo Sapiens; identical to SEQ ID NO: 53980

SEQ ID NO: 393800 - RNA, 64 nt, Homo Sapiens; identical to SEQ ID NO: 53981

SEQ ID NO: 393801 - RNA, 64 nt, Homo Sapiens; identical to SEQ ID NO: 53982

SEQ ID NO: 393802 - RNA, 64 nt, Homo Sapiens; identical to SEQ ID NO: 53983

SEQ ID NO: 393803 - RNA, 64 nt, Homo Sapiens; identical to SEQ ID NO: 53984

SEQ ID NO: 393804 - RNA, 64 nt, Homo Sapiens; identical to SEQ ID NO: 53985

SEQ ID NO: 393805 - RNA, 64 nt, Homo Sapiens; identical to SEQ ID NO: 53986

SEQ ID NO: 393806 - RNA, 64 nt, Homo Sapiens; identical to SEQ ID NO: 53987

SEQ ID NO: 393807 - RNA, 64 nt, Homo Sapiens; identical to SEQ ID NO: 53988

SEQ ID NO: 393808 - RNA, 64 nt, Homo Sapiens; identical to SEQ ID NO: 53989

SEQ ID NO: 393809 - RNA, 64 nt, Homo Sapiens; identical to SEQ ID NO: 53990

SEQ ID NO: 393810 - RNA, 64 nt, Homo Sapiens; identical to SEQ ID NO: 53991

SEQ ID NO: 393811 - RNA, 64 nt, Homo Sapiens; identical to SEQ ID NO: 53992

SEQ ID NO: 393812 - RNA, 64 nt, Homo Sapiens; identical to SEQ ID NO: 53993

SEQ ID NO: 393813 - RNA, 64 nt, Homo Sapiens; identical to SEQ ID NO: 53994

SEQ ID NO: 393814 - RNA, 64 nt, Homo Sapiens; identical to SEQ ID NO: 53995

SEQ ID NO: 393815 - RNA, 64 nt, Homo Sapiens; identical to SEQ ID NO: 53996

SEQ ID NO: 393816 - RNA, 64 nt, Homo Sapiens; identical to SEQ ID NO: 53997

SEQ ID NO: 393817 - RNA, 64 nt, Homo Sapiens; identical to SEQ ID NO: 53998

SEQ ID NO: 393818 - RNA, 64 nt, Homo Sapiens; identical to SEQ ID NO: 53999

SEQ ID NO: 393819 - RNA, 64 nt, Homo Sapiens; identical to SEQ ID NO: 54000

SEQ ID NO: 393820 - RNA, 64 nt, Homo Sapiens; identical to SEQ ID NO: 54001

SEQ ID NO: 393821 - RNA, 64 nt, Homo Sapiens; identical to SEQ ID NO: 54002

SEQ ID NO: 393822 - RNA, 64 nt, Homo Sapiens; identical to SEQ ID NO: 54003

SEQ ID NO: 393823 - RNA, 64 nt, Homo Sapiens; identical to SEQ ID NO: 54004

SEQ ID NO: 393824 - RNA, 64 nt, Homo Sapiens; identical to SEQ ID NO: 54005

SEQ ID NO: 393825 - RNA, 64 nt, Homo Sapiens; identical to SEQ ID NO: 54006

SEQ ID NO: 393826 - RNA, 64 nt, Homo Sapiens; identical to SEQ ID NO: 54007

SEQ ID NO: 393827 - RNA, 64 nt, Homo Sapiens; identical to SEQ ID NO: 54008

SEQ ID NO: 393828 - RNA, 64 nt, Homo Sapiens; identical to SEQ ID NO: 54009

SEQ ID NO: 393829 - RNA, 64 nt, Homo Sapiens; identical to SEQ ID NO: 54010

SEQ ID NO: 393830 - RNA, 64 nt, Homo Sapiens; identical to SEQ ID NO: 54011

SEQ ID NO: 393831 - RNA, 64 nt, Homo Sapiens; identical to SEQ ID NO: 54012

SEQ ID NO: 393832 - RNA, 64 nt, Homo Sapiens; identical to SEQ ID NO: 54013

SEQ ID NO: 393833 - RNA, 64 nt, Homo Sapiens; identical to SEQ ID NO: 54014

SEQ ID NO: 393834 - RNA, 64 nt, Homo Sapiens; identical to SEQ ID NO: 54015

SEQ ID NO: 393835 - RNA, 64 nt, Homo Sapiens; identical to SEQ ID NO: 54016

SEQ ID NO: 393836 - RNA, 64 nt, Homo Sapiens; identical to SEQ ID NO: 54017

SEQ ID NO: 393837 - RNA, 64 nt, Homo Sapiens; identical to SEQ ID NO: 54018

SEQ ID NO: 393838 - RNA, 64 nt, Homo Sapiens; identical to SEQ ID NO: 54019

SEQ ID NO: 393839 - RNA, 64 nt, Homo Sapiens; identical to SEQ ID NO: 54020

SEQ ID NO: 393840 - RNA, 64 nt, Homo Sapiens; identical to SEQ ID NO: 54021

SEQ ID NO: 393841 - RNA, 64 nt, Homo Sapiens; identical to SEQ ID NO: 54022

SEQ ID NO: 393842 - RNA, 64 nt, Homo Sapiens; identical to SEQ ID NO: 54023

SEQ ID NO: 393843 - RNA, 64 nt, Homo Sapiens; identical to SEQ ID NO: 54024

SEQ ID NO: 393844 - RNA, 64 nt, Homo Sapiens; identical to SEQ ID NO: 54025

SEQ ID NO: 393845 - RNA, 64 nt, Homo Sapiens; identical to SEQ ID NO: 54026

SEQ ID NO: 393846 - RNA, 64 nt, Homo Sapiens; identical to SEQ ID NO: 54027

SEQ ID NO: 393847 - RNA, 64 nt, Homo Sapiens; identical to SEQ ID NO: 54028

SEQ ID NO: 393848 - RNA, 64 nt, Homo Sapiens; identical to SEQ ID NO: 54029

SEQ ID NO: 393849 - RNA, 64 nt, Homo Sapiens; identical to SEQ ID NO: 54030

SEQ ID NO: 393850 - RNA, 64 nt, Homo Sapiens; identical to SEQ ID NO: 54031

SEQ ID NO: 393851 - RNA, 64 nt, Homo Sapiens; identical to SEQ ID NO: 54032

SEQ ID NO: 393852 - RNA, 64 nt, Homo Sapiens; identical to SEQ ID NO: 54033

SEQ ID NO: 393853 - RNA, 64 nt, Homo Sapiens; identical to SEQ ID NO: 54034

SEQ ID NO: 393854 - RNA, 64 nt, Homo Sapiens; identical to SEQ ID NO: 54035

SEQ ID NO: 393855 - RNA, 64 nt, Homo Sapiens; identical to SEQ ID NO: 54036

SEQ ID NO: 393856 - RNA, 64 nt, Homo Sapiens; identical to SEQ ID NO: 54037

SEQ ID NO: 393857 - RNA, 64 nt, Homo Sapiens; identical to SEQ ID NO: 54038

SEQ ID NO: 393858 - RNA, 64 nt, Homo Sapiens; identical to SEQ ID NO: 54039

SEQ ID NO: 393859 - RNA, 64 nt, Homo Sapiens; identical to SEQ ID NO: 54040

SEQ ID NO: 393860 - RNA, 64 nt, Homo Sapiens; identical to SEQ ID NO: 54041

SEQ ID NO: 393861 - RNA, 64 nt, Homo Sapiens; identical to SEQ ID NO: 54042

SEQ ID NO: 393862 - RNA, 64 nt, Homo Sapiens; identical to SEQ ID NO: 54043

SEQ ID NO: 393863 - RNA, 64 nt, Homo Sapiens; identical to SEQ ID NO: 54044

SEQ ID NO: 393864 - RNA, 64 nt, Homo Sapiens; identical to SEQ ID NO: 54045

SEQ ID NO: 393865 - RNA, 64 nt, Homo Sapiens; identical to SEQ ID NO: 54046

SEQ ID NO: 393866 - RNA, 64 nt, Homo Sapiens; identical to SEQ ID NO: 54047

SEQ ID NO: 393867 - RNA, 64 nt, Homo Sapiens; identical to SEQ ID NO: 54048

SEQ ID NO: 393868 - RNA, 64 nt, Homo Sapiens; identical to SEQ ID NO: 54049

SEQ ID NO: 393869 - RNA, 64 nt, Homo Sapiens; identical to SEQ ID NO: 54050

SEQ ID NO: 393870 - RNA, 64 nt, Homo Sapiens; identical to SEQ ID NO: 54051

SEQ ID NO: 393871 - RNA, 64 nt, Homo Sapiens; identical to SEQ ID NO: 54052

SEQ ID NO: 393872 - RNA, 64 nt, Homo Sapiens; identical to SEQ ID NO: 54053

SEQ ID NO: 393873 - RNA, 64 nt, Homo Sapiens; identical to SEQ ID NO: 54054

SEQ ID NO: 393874 - RNA, 64 nt, Homo Sapiens; identical to SEQ ID NO: 54055

SEQ ID NO: 393875 - RNA, 64 nt, Homo Sapiens; identical to SEQ ID NO: 54056

SEQ ID NO: 393876 - RNA, 64 nt, Homo Sapiens; identical to SEQ ID NO: 54057

SEQ ID NO: 393877 - RNA, 64 nt, Homo Sapiens; identical to SEQ ID NO: 54058

SEQ ID NO: 393878 - RNA, 64 nt, Homo Sapiens; identical to SEQ ID NO: 54059

SEQ ID NO: 393879 - RNA, 64 nt, Homo Sapiens; identical to SEQ ID NO: 54060

SEQ ID NO: 393880 - RNA, 64 nt, Homo Sapiens; identical to SEQ ID NO: 54061

SEQ ID NO: 393881 - RNA, 64 nt, Homo Sapiens; identical to SEQ ID NO: 54062

SEQ ID NO: 393882 - RNA, 64 nt, Homo Sapiens; identical to SEQ ID NO: 54063

SEQ ID NO: 393883 - RNA, 64 nt, Homo Sapiens; identical to SEQ ID NO: 54064

SEQ ID NO: 393884 - RNA, 64 nt, Homo Sapiens; identical to SEQ ID NO: 54065

SEQ ID NO: 393885 - RNA, 64 nt, Homo Sapiens; identical to SEQ ID NO: 54066

SEQ ID NO: 393886 - RNA, 64 nt, Homo Sapiens; identical to SEQ ID NO: 54067

SEQ ID NO: 393887 - RNA, 64 nt, Homo Sapiens; identical to SEQ ID NO: 54068

SEQ ID NO: 393888 - RNA, 64 nt, Homo Sapiens; identical to SEQ ID NO: 54069

SEQ ID NO: 393889 - RNA, 64 nt, Homo Sapiens; identical to SEQ ID NO: 54070

SEQ ID NO: 393890 - RNA, 64 nt, Homo Sapiens; identical to SEQ ID NO: 54071

SEQ ID NO: 393891 - RNA, 64 nt, Homo Sapiens; identical to SEQ ID NO: 54072

SEQ ID NO: 393892 - RNA, 64 nt, Homo Sapiens; identical to SEQ ID NO: 54073

SEQ ID NO: 393893 - RNA, 64 nt, Homo Sapiens; identical to SEQ ID NO: 54074

SEQ ID NO: 393894 - RNA, 64 nt, Homo Sapiens; identical to SEQ ID NO: 54075

SEQ ID NO: 393895 - RNA, 64 nt, Homo Sapiens; identical to SEQ ID NO: 54076

SEQ ID NO: 393896 - RNA, 64 nt, Homo Sapiens; identical to SEQ ID NO: 54077

SEQ ID NO: 393897 - RNA, 64 nt, Homo Sapiens; identical to SEQ ID NO: 54078

SEQ ID NO: 393898 - RNA, 64 nt, Homo Sapiens; identical to SEQ ID NO: 54079

SEQ ID NO: 393899 - RNA, 64 nt, Homo Sapiens; identical to SEQ ID NO: 54080

SEQ ID NO: 393900 - RNA, 64 nt, Homo Sapiens; identical to SEQ ID NO: 54081

SEQ ID NO: 393901 - RNA, 64 nt, Homo Sapiens; identical to SEQ ID NO: 54082

SEQ ID NO: 393902 - RNA, 64 nt, Homo Sapiens; identical to SEQ ID NO: 54083

SEQ ID NO: 393903 - RNA, 64 nt, Homo Sapiens; identical to SEQ ID NO: 54084

SEQ ID NO: 393904 - RNA, 64 nt, Homo Sapiens; identical to SEQ ID NO: 54085

SEQ ID NO: 393905 - RNA, 64 nt, Homo Sapiens; identical to SEQ ID NO: 54086

SEQ ID NO: 393906 - RNA, 53 nt, Homo Sapiens; identical to SEQ ID NO: 54087

SEQ ID NO: 393907 - RNA, 64 nt, Homo Sapiens; identical to SEQ ID NO: 54088

SEQ ID NO: 393908 - RNA, 64 nt, Homo Sapiens; identical to SEQ ID NO: 54089

SEQ ID NO: 393909 - RNA, 64 nt, Homo Sapiens; identical to SEQ ID NO: 54090

SEQ ID NO: 393910 - RNA, 64 nt, Homo Sapiens; identical to SEQ ID NO: 54091

SEQ ID NO: 393911 - RNA, 64 nt, Homo Sapiens; identical to SEQ ID NO: 54092

SEQ ID NO: 393912 - RNA, 64 nt, Homo Sapiens; identical to SEQ ID NO: 54093

SEQ ID NO: 393913 - RNA, 64 nt, Homo Sapiens; identical to SEQ ID NO: 54094

SEQ ID NO: 393914 - RNA, 64 nt, Homo Sapiens; identical to SEQ ID NO: 54095

SEQ ID NO: 393915 - RNA, 64 nt, Homo Sapiens; identical to SEQ ID NO: 54096

SEQ ID NO: 393916 - RNA, 64 nt, Homo Sapiens; identical to SEQ ID NO: 54097

SEQ ID NO: 393917 - RNA, 64 nt, Homo Sapiens; identical to SEQ ID NO: 54098

SEQ ID NO: 393918 - RNA, 64 nt, Homo Sapiens; identical to SEQ ID NO: 54099

SEQ ID NO: 393919 - RNA, 64 nt, Homo Sapiens; identical to SEQ ID NO: 54100

SEQ ID NO: 393920 - RNA, 64 nt, Homo Sapiens; identical to SEQ ID NO: 54101

SEQ ID NO: 393921 - RNA, 64 nt, Homo Sapiens; identical to SEQ ID NO: 54102

SEQ ID NO: 393922 - RNA, 64 nt, Homo Sapiens; identical to SEQ ID NO: 54103

SEQ ID NO: 393923 - RNA, 64 nt, Homo Sapiens; identical to SEQ ID NO: 54104

SEQ ID NO: 393924 - RNA, 64 nt, Homo Sapiens; identical to SEQ ID NO: 54105

SEQ ID NO: 393925 - RNA, 64 nt, Homo Sapiens; identical to SEQ ID NO: 54106

SEQ ID NO: 393926 - RNA, 64 nt, Homo Sapiens; identical to SEQ ID NO: 54107

SEQ ID NO: 393927 - RNA, 64 nt, Homo Sapiens; identical to SEQ ID NO: 54108

SEQ ID NO: 393928 - RNA, 64 nt, Homo Sapiens; identical to SEQ ID NO: 54109

SEQ ID NO: 393929 - RNA, 64 nt, Homo Sapiens; identical to SEQ ID NO: 54110

SEQ ID NO: 393930 - RNA, 64 nt, Homo Sapiens; identical to SEQ ID NO: 54111

SEQ ID NO: 393931 - RNA, 64 nt, Homo Sapiens; identical to SEQ ID NO: 54112

SEQ ID NO: 393932 - RNA, 64 nt, Homo Sapiens; identical to SEQ ID NO: 54113

SEQ ID NO: 393933 - RNA, 64 nt, Homo Sapiens; identical to SEQ ID NO: 54114

SEQ ID NO: 393934 - RNA, 64 nt, Homo Sapiens; identical to SEQ ID NO: 54115

SEQ ID NO: 393935 - RNA, 64 nt, Homo Sapiens; identical to SEQ ID NO: 54116

SEQ ID NO: 393936 - RNA, 64 nt, Homo Sapiens; identical to SEQ ID NO: 54117

SEQ ID NO: 393937 - RNA, 64 nt, Homo Sapiens; identical to SEQ ID NO: 54118

SEQ ID NO: 393938 - RNA, 64 nt, Homo Sapiens; identical to SEQ ID NO: 54119

SEQ ID NO: 393939 - RNA, 64 nt, Homo Sapiens; identical to SEQ ID NO: 54120

SEQ ID NO: 393940 - RNA, 64 nt, Homo Sapiens; identical to SEQ ID NO: 54121

SEQ ID NO: 393941 - RNA, 64 nt, Homo Sapiens; identical to SEQ ID NO: 54122

SEQ ID NO: 393942 - RNA, 64 nt, Homo Sapiens; identical to SEQ ID NO: 54123

SEQ ID NO: 393943 - RNA, 64 nt, Homo Sapiens; identical to SEQ ID NO: 54124

SEQ ID NO: 393944 - RNA, 64 nt, Homo Sapiens; identical to SEQ ID NO: 54125

SEQ ID NO: 393945 - RNA, 64 nt, Homo Sapiens; identical to SEQ ID NO: 54126

SEQ ID NO: 393946 - RNA, 64 nt, Homo Sapiens; identical to SEQ ID NO: 54127

SEQ ID NO: 393947 - RNA, 64 nt, Homo Sapiens; identical to SEQ ID NO: 54128

SEQ ID NO: 393948 - RNA, 64 nt, Homo Sapiens; identical to SEQ ID NO: 54129

SEQ ID NO: 393949 - RNA, 64 nt, Homo Sapiens; identical to SEQ ID NO: 54130

SEQ ID NO: 393950 - RNA, 64 nt, Homo Sapiens; identical to SEQ ID NO: 54131

SEQ ID NO: 393951 - RNA, 64 nt, Homo Sapiens; identical to SEQ ID NO: 54132

SEQ ID NO: 393952 - RNA, 64 nt, Homo Sapiens; identical to SEQ ID NO: 54133

SEQ ID NO: 393953 - RNA, 64 nt, Homo Sapiens; identical to SEQ ID NO: 54134

SEQ ID NO: 393954 - RNA, 64 nt, Homo Sapiens; identical to SEQ ID NO: 54135

SEQ ID NO: 393955 - RNA, 64 nt, Homo Sapiens; identical to SEQ ID NO: 54136

SEQ ID NO: 393956 - RNA, 64 nt, Homo Sapiens; identical to SEQ ID NO: 54137

SEQ ID NO: 393957 - RNA, 64 nt, Homo Sapiens; identical to SEQ ID NO: 54138

SEQ ID NO: 393958 - RNA, 64 nt, Homo Sapiens; identical to SEQ ID NO: 54139

SEQ ID NO: 393959 - RNA, 64 nt, Homo Sapiens; identical to SEQ ID NO: 54140

SEQ ID NO: 393960 - RNA, 64 nt, Homo Sapiens; identical to SEQ ID NO: 54141

SEQ ID NO: 393961 - RNA, 64 nt, Homo Sapiens; identical to SEQ ID NO: 54142

SEQ ID NO: 393962 - RNA, 64 nt, Homo Sapiens; identical to SEQ ID NO: 54143

SEQ ID NO: 393963 - RNA, 64 nt, Homo Sapiens; identical to SEQ ID NO: 54144

SEQ ID NO: 393964 - RNA, 64 nt, Homo Sapiens; identical to SEQ ID NO: 54145

SEQ ID NO: 393965 - RNA, 64 nt, Homo Sapiens; identical to SEQ ID NO: 54146

SEQ ID NO: 393966 - RNA, 64 nt, Homo Sapiens; identical to SEQ ID NO: 54147

SEQ ID NO: 393967 - RNA, 64 nt, Homo Sapiens; identical to SEQ ID NO: 54148

SEQ ID NO: 393968 - RNA, 52 nt, Homo Sapiens; identical to SEQ ID NO: 54149

SEQ ID NO: 393969 - RNA, 64 nt, Homo Sapiens; identical to SEQ ID NO: 54150

SEQ ID NO: 393970 - RNA, 64 nt, Homo Sapiens; identical to SEQ ID NO: 54151

SEQ ID NO: 393971 - RNA, 64 nt, Homo Sapiens; identical to SEQ ID NO: 54152

SEQ ID NO: 393972 - RNA, 64 nt, Homo Sapiens; identical to SEQ ID NO: 54153

SEQ ID NO: 393973 - RNA, 64 nt, Homo Sapiens; identical to SEQ ID NO: 54154

SEQ ID NO: 393974 - RNA, 64 nt, Homo Sapiens; identical to SEQ ID NO: 54155

SEQ ID NO: 393975 - RNA, 64 nt, Homo Sapiens; identical to SEQ ID NO: 54156

SEQ ID NO: 393976 - RNA, 64 nt, Homo Sapiens; identical to SEQ ID NO: 54157

SEQ ID NO: 393977 - RNA, 64 nt, Homo Sapiens; identical to SEQ ID NO: 54158

SEQ ID NO: 393978 - RNA, 64 nt, Homo Sapiens; identical to SEQ ID NO: 54159

SEQ ID NO: 393979 - RNA, 64 nt, Homo Sapiens; identical to SEQ ID NO: 54160

SEQ ID NO: 393980 - RNA, 64 nt, Homo Sapiens; identical to SEQ ID NO: 54161

SEQ ID NO: 393981 - RNA, 64 nt, Homo Sapiens; identical to SEQ ID NO: 54162

SEQ ID NO: 393982 - RNA, 64 nt, Homo Sapiens; identical to SEQ ID NO: 54163

SEQ ID NO: 393983 - RNA, 64 nt, Homo Sapiens; identical to SEQ ID NO: 54164

SEQ ID NO: 393984 - RNA, 64 nt, Homo Sapiens; identical to SEQ ID NO: 54165

SEQ ID NO: 393985 - RNA, 64 nt, Homo Sapiens; identical to SEQ ID NO: 54166

SEQ ID NO: 393986 - RNA, 64 nt, Homo Sapiens; identical to SEQ ID NO: 54167

SEQ ID NO: 393987 - RNA, 64 nt, Homo Sapiens; identical to SEQ ID NO: 54168

SEQ ID NO: 393988 - RNA, 64 nt, Homo Sapiens; identical to SEQ ID NO: 54169

SEQ ID NO: 393989 - RNA, 64 nt, Homo Sapiens; identical to SEQ ID NO: 54170

SEQ ID NO: 393990 - RNA, 64 nt, Homo Sapiens; identical to SEQ ID NO: 54171

SEQ ID NO: 393991 - RNA, 64 nt, Homo Sapiens; identical to SEQ ID NO: 54172

SEQ ID NO: 393992 - RNA, 64 nt, Homo Sapiens; identical to SEQ ID NO: 54173

SEQ ID NO: 393993 - RNA, 64 nt, Homo Sapiens; identical to SEQ ID NO: 54174

SEQ ID NO: 393994 - RNA, 64 nt, Homo Sapiens; identical to SEQ ID NO: 54175

SEQ ID NO: 393995 - RNA, 64 nt, Homo Sapiens; identical to SEQ ID NO: 54176

SEQ ID NO: 393996 - RNA, 64 nt, Homo Sapiens; identical to SEQ ID NO: 54177

SEQ ID NO: 393997 - RNA, 64 nt, Homo Sapiens; identical to SEQ ID NO: 54178

SEQ ID NO: 393998 - RNA, 64 nt, Homo Sapiens; identical to SEQ ID NO: 54179

SEQ ID NO: 393999 - RNA, 64 nt, Homo Sapiens; identical to SEQ ID NO: 54180

SEQ ID NO: 394000 - RNA, 64 nt, Homo Sapiens; identical to SEQ ID NO: 54181

SEQ ID NO: 394001 - RNA, 64 nt, Homo Sapiens; identical to SEQ ID NO: 54182

SEQ ID NO: 394002 - RNA, 64 nt, Homo Sapiens; identical to SEQ ID NO: 54183

SEQ ID NO: 394003 - RNA, 64 nt, Homo Sapiens; identical to SEQ ID NO: 54184

SEQ ID NO: 394004 - RNA, 64 nt, Homo Sapiens; identical to SEQ ID NO: 54185

SEQ ID NO: 394005 - RNA, 64 nt, Homo Sapiens; identical to SEQ ID NO: 54186

SEQ ID NO: 394006 - RNA, 64 nt, Homo Sapiens; identical to SEQ ID NO: 54187

SEQ ID NO: 394007 - RNA, 64 nt, Homo Sapiens; identical to SEQ ID NO: 54188

SEQ ID NO: 394008 - RNA, 64 nt, Homo Sapiens; identical to SEQ ID NO: 54189

SEQ ID NO: 394009 - RNA, 64 nt, Homo Sapiens; identical to SEQ ID NO: 54190

SEQ ID NO: 394010 - RNA, 64 nt, Homo Sapiens; identical to SEQ ID NO: 54191

SEQ ID NO: 394011 - RNA, 64 nt, Homo Sapiens; identical to SEQ ID NO: 54192

SEQ ID NO: 394012 - RNA, 64 nt, Homo Sapiens; identical to SEQ ID NO: 54193

SEQ ID NO: 394013 - RNA, 64 nt, Homo Sapiens; identical to SEQ ID NO: 54194

SEQ ID NO: 394014 - RNA, 64 nt, Homo Sapiens; identical to SEQ ID NO: 54195

SEQ ID NO: 394015 - RNA, 64 nt, Homo Sapiens; identical to SEQ ID NO: 54196

SEQ ID NO: 394016 - RNA, 64 nt, Homo Sapiens; identical to SEQ ID NO: 54197

SEQ ID NO: 394017 - RNA, 64 nt, Homo Sapiens; identical to SEQ ID NO: 54198

SEQ ID NO: 394018 - RNA, 64 nt, Homo Sapiens; identical to SEQ ID NO: 54199

SEQ ID NO: 394019 - RNA, 64 nt, Homo Sapiens; identical to SEQ ID NO: 54200

SEQ ID NO: 394020 - RNA, 64 nt, Homo Sapiens; identical to SEQ ID NO: 54201

SEQ ID NO: 394021 - RNA, 64 nt, Homo Sapiens; identical to SEQ ID NO: 54202

SEQ ID NO: 394022 - RNA, 64 nt, Homo Sapiens; identical to SEQ ID NO: 54203

SEQ ID NO: 394023 - RNA, 64 nt, Homo Sapiens; identical to SEQ ID NO: 54204

SEQ ID NO: 394024 - RNA, 64 nt, Homo Sapiens; identical to SEQ ID NO: 54205

SEQ ID NO: 394025 - RNA, 64 nt, Homo Sapiens; identical to SEQ ID NO: 54206

SEQ ID NO: 394026 - RNA, 64 nt, Homo Sapiens; identical to SEQ ID NO: 54207

SEQ ID NO: 394027 - RNA, 64 nt, Homo Sapiens; identical to SEQ ID NO: 54208

SEQ ID NO: 394028 - RNA, 64 nt, Homo Sapiens; identical to SEQ ID NO: 54209

SEQ ID NO: 394029 - RNA, 64 nt, Homo Sapiens; identical to SEQ ID NO: 54210

SEQ ID NO: 394030 - RNA, 64 nt, Homo Sapiens; identical to SEQ ID NO: 54211

SEQ ID NO: 394031 - RNA, 64 nt, Homo Sapiens; identical to SEQ ID NO: 54212

SEQ ID NO: 394032 - RNA, 64 nt, Homo Sapiens; identical to SEQ ID NO: 54213

SEQ ID NO: 394033 - RNA, 64 nt, Homo Sapiens; identical to SEQ ID NO: 54214

SEQ ID NO: 394034 - RNA, 64 nt, Homo Sapiens; identical to SEQ ID NO: 54215

SEQ ID NO: 394035 - RNA, 64 nt, Homo Sapiens; identical to SEQ ID NO: 54216

SEQ ID NO: 394036 - RNA, 64 nt, Homo Sapiens; identical to SEQ ID NO: 54217

SEQ ID NO: 394037 - RNA, 64 nt, Homo Sapiens; identical to SEQ ID NO: 54218

SEQ ID NO: 394038 - RNA, 64 nt, Homo Sapiens; identical to SEQ ID NO: 54219

SEQ ID NO: 394039 - RNA, 64 nt, Homo Sapiens; identical to SEQ ID NO: 54220

SEQ ID NO: 394040 - RNA, 64 nt, Homo Sapiens; identical to SEQ ID NO: 54221

SEQ ID NO: 394041 - RNA, 64 nt, Homo Sapiens; identical to SEQ ID NO: 54222

SEQ ID NO: 394042 - RNA, 64 nt, Homo Sapiens; identical to SEQ ID NO: 54223

SEQ ID NO: 394043 - RNA, 64 nt, Homo Sapiens; identical to SEQ ID NO: 54224

SEQ ID NO: 394044 - RNA, 64 nt, Homo Sapiens; identical to SEQ ID NO: 54225

SEQ ID NO: 394045 - RNA, 64 nt, Homo Sapiens; identical to SEQ ID NO: 54226

SEQ ID NO: 394046 - RNA, 64 nt, Homo Sapiens; identical to SEQ ID NO: 54227

SEQ ID NO: 394047 - RNA, 64 nt, Homo Sapiens; identical to SEQ ID NO: 54228

SEQ ID NO: 394048 - RNA, 64 nt, Homo Sapiens; identical to SEQ ID NO: 54229

SEQ ID NO: 394049 - RNA, 64 nt, Homo Sapiens; identical to SEQ ID NO: 54230

SEQ ID NO: 394050 - RNA, 64 nt, Homo Sapiens; identical to SEQ ID NO: 54231

SEQ ID NO: 394051 - RNA, 64 nt, Homo Sapiens; identical to SEQ ID NO: 54232

SEQ ID NO: 394052 - RNA, 64 nt, Homo Sapiens; identical to SEQ ID NO: 54233

SEQ ID NO: 394053 - RNA, 64 nt, Homo Sapiens; identical to SEQ ID NO: 54234

SEQ ID NO: 394054 - RNA, 64 nt, Homo Sapiens; identical to SEQ ID NO: 54235

SEQ ID NO: 394055 - RNA, 64 nt, Homo Sapiens; identical to SEQ ID NO: 54236

SEQ ID NO: 394056 - RNA, 64 nt, Homo Sapiens; identical to SEQ ID NO: 54237

SEQ ID NO: 394057 - RNA, 64 nt, Homo Sapiens; identical to SEQ ID NO: 54238

SEQ ID NO: 394058 - RNA, 64 nt, Homo Sapiens; identical to SEQ ID NO: 54239

SEQ ID NO: 394059 - RNA, 64 nt, Homo Sapiens; identical to SEQ ID NO: 54240

SEQ ID NO: 394060 - RNA, 64 nt, Homo Sapiens; identical to SEQ ID NO: 54241

SEQ ID NO: 394061 - RNA, 64 nt, Homo Sapiens; identical to SEQ ID NO: 54242

SEQ ID NO: 394062 - RNA, 64 nt, Homo Sapiens; identical to SEQ ID NO: 54243

SEQ ID NO: 394063 - RNA, 64 nt, Homo Sapiens; identical to SEQ ID NO: 54244

SEQ ID NO: 394064 - RNA, 64 nt, Homo Sapiens; identical to SEQ ID NO: 54245

SEQ ID NO: 394065 - RNA, 64 nt, Homo Sapiens; identical to SEQ ID NO: 54246

SEQ ID NO: 394066 - RNA, 64 nt, Homo Sapiens; identical to SEQ ID NO: 54247

SEQ ID NO: 394067 - RNA, 64 nt, Homo Sapiens; identical to SEQ ID NO: 54248

SEQ ID NO: 394068 - RNA, 64 nt, Homo Sapiens; identical to SEQ ID NO: 54249

SEQ ID NO: 394069 - RNA, 64 nt, Homo Sapiens; identical to SEQ ID NO: 54250

SEQ ID NO: 394070 - RNA, 64 nt, Homo Sapiens; identical to SEQ ID NO: 54251

SEQ ID NO: 394071 - RNA, 64 nt, Homo Sapiens; identical to SEQ ID NO: 54252

SEQ ID NO: 394072 - RNA, 64 nt, Homo Sapiens; identical to SEQ ID NO: 54253

SEQ ID NO: 394073 - RNA, 64 nt, Homo Sapiens; identical to SEQ ID NO: 54254

SEQ ID NO: 394074 - RNA, 64 nt, Homo Sapiens; identical to SEQ ID NO: 54255

SEQ ID NO: 394075 - RNA, 64 nt, Homo Sapiens; identical to SEQ ID NO: 54256

SEQ ID NO: 394076 - RNA, 64 nt, Homo Sapiens; identical to SEQ ID NO: 54257

SEQ ID NO: 394077 - RNA, 64 nt, Homo Sapiens; identical to SEQ ID NO: 54258

SEQ ID NO: 394078 - RNA, 64 nt, Homo Sapiens; identical to SEQ ID NO: 54259

SEQ ID NO: 394079 - RNA, 64 nt, Homo Sapiens; identical to SEQ ID NO: 54260

SEQ ID NO: 394080 - RNA, 64 nt, Homo Sapiens; identical to SEQ ID NO: 54261

SEQ ID NO: 394081 - RNA, 64 nt, Homo Sapiens; identical to SEQ ID NO: 54262

SEQ ID NO: 394082 - RNA, 64 nt, Homo Sapiens; identical to SEQ ID NO: 54263

SEQ ID NO: 394083 - RNA, 64 nt, Homo Sapiens; identical to SEQ ID NO: 54264

SEQ ID NO: 394084 - RNA, 64 nt, Homo Sapiens; identical to SEQ ID NO: 54265

SEQ ID NO: 394085 - RNA, 64 nt, Homo Sapiens; identical to SEQ ID NO: 54266

SEQ ID NO: 394086 - RNA, 64 nt, Homo Sapiens; identical to SEQ ID NO: 54267

SEQ ID NO: 394087 - RNA, 64 nt, Homo Sapiens; identical to SEQ ID NO: 54268

SEQ ID NO: 394088 - RNA, 64 nt, Homo Sapiens; identical to SEQ ID NO: 54269

SEQ ID NO: 394089 - RNA, 64 nt, Homo Sapiens; identical to SEQ ID NO: 54270

SEQ ID NO: 394090 - RNA, 64 nt, Homo Sapiens; identical to SEQ ID NO: 54271

SEQ ID NO: 394091 - RNA, 64 nt, Homo Sapiens; identical to SEQ ID NO: 54272

SEQ ID NO: 394092 - RNA, 64 nt, Homo Sapiens; identical to SEQ ID NO: 54273

SEQ ID NO: 394093 - RNA, 64 nt, Homo Sapiens; identical to SEQ ID NO: 54274

SEQ ID NO: 394094 - RNA, 64 nt, Homo Sapiens; identical to SEQ ID NO: 54275

SEQ ID NO: 394095 - RNA, 64 nt, Homo Sapiens; identical to SEQ ID NO: 141261

SEQ ID NO: 394096 - RNA, 64 nt, Homo Sapiens; identical to SEQ ID NO: 141262

SEQ ID NO: 394097 - RNA, 64 nt, Homo Sapiens; identical to SEQ ID NO: 141263

SEQ ID NO: 394098 - RNA, 64 nt, Homo Sapiens; identical to SEQ ID NO: 141264

SEQ ID NO: 394099 - RNA, 64 nt, Homo Sapiens; identical to SEQ ID NO: 141265

SEQ ID NO: 394100 - RNA, 64 nt, Homo Sapiens; identical to SEQ ID NO: 141266

SEQ ID NO: 394101 - RNA, 64 nt, Homo Sapiens; identical to SEQ ID NO: 141267

SEQ ID NO: 394102 - RNA, 64 nt, Homo Sapiens; identical to SEQ ID NO: 141268

SEQ ID NO: 394103 - RNA, 64 nt, Homo Sapiens; identical to SEQ ID NO: 141269

SEQ ID NO: 394104 - RNA, 64 nt, Homo Sapiens; identical to SEQ ID NO: 141270

SEQ ID NO: 394105 - RNA, 64 nt, Homo Sapiens; identical to SEQ ID NO: 141271

SEQ ID NO: 394106 - RNA, 64 nt, Homo Sapiens; identical to SEQ ID NO: 141272

SEQ ID NO: 394107 - RNA, 64 nt, Homo Sapiens; identical to SEQ ID NO: 141273

SEQ ID NO: 394108 - RNA, 64 nt, Homo Sapiens; identical to SEQ ID NO: 141274

SEQ ID NO: 394109 - RNA, 64 nt, Homo Sapiens; identical to SEQ ID NO: 141275

SEQ ID NO: 394110 - RNA, 64 nt, Homo Sapiens; identical to SEQ ID NO: 141276

SEQ ID NO: 394111 - RNA, 64 nt, Homo Sapiens; identical to SEQ ID NO: 141277

SEQ ID NO: 394112 - RNA, 64 nt, Homo Sapiens; identical to SEQ ID NO: 141278

SEQ ID NO: 394113 - RNA, 64 nt, Homo Sapiens; identical to SEQ ID NO: 141279

SEQ ID NO: 394114 - RNA, 56 nt, Homo Sapiens; identical to SEQ ID NO: 141280

SEQ ID NO: 394115 - RNA, 64 nt, Homo Sapiens; identical to SEQ ID NO: 141281

SEQ ID NO: 394116 - RNA, 64 nt, Homo Sapiens; identical to SEQ ID NO: 141282

SEQ ID NO: 394117 - RNA, 64 nt, Homo Sapiens; identical to SEQ ID NO: 141283

SEQ ID NO: 394118 - RNA, 64 nt, Homo Sapiens; identical to SEQ ID NO: 141284

SEQ ID NO: 394119 - RNA, 64 nt, Homo Sapiens; identical to SEQ ID NO: 141285

SEQ ID NO: 394120 - RNA, 64 nt, Homo Sapiens; identical to SEQ ID NO: 141286

SEQ ID NO: 394121 - RNA, 64 nt, Homo Sapiens; identical to SEQ ID NO: 141287

SEQ ID NO: 394122 - RNA, 64 nt, Homo Sapiens; identical to SEQ ID NO: 141288

SEQ ID NO: 394123 - RNA, 64 nt, Homo Sapiens; identical to SEQ ID NO: 141289

SEQ ID NO: 394124 - RNA, 64 nt, Homo Sapiens; identical to SEQ ID NO: 141290

SEQ ID NO: 394125 - RNA, 64 nt, Homo Sapiens; identical to SEQ ID NO: 141291

SEQ ID NO: 394126 - RNA, 64 nt, Homo Sapiens; identical to SEQ ID NO: 141292

SEQ ID NO: 394127 - RNA, 64 nt, Homo Sapiens; identical to SEQ ID NO: 141293

SEQ ID NO: 394128 - RNA, 64 nt, Homo Sapiens; identical to SEQ ID NO: 141294

SEQ ID NO: 394129 - RNA, 64 nt, Homo Sapiens; identical to SEQ ID NO: 141295

SEQ ID NO: 394130 - RNA, 64 nt, Homo Sapiens; identical to SEQ ID NO: 141296

SEQ ID NO: 394131 - RNA, 64 nt, Homo Sapiens; identical to SEQ ID NO: 141297

SEQ ID NO: 394132 - RNA, 64 nt, Homo Sapiens; identical to SEQ ID NO: 141298

SEQ ID NO: 394133 - RNA, 64 nt, Homo Sapiens; identical to SEQ ID NO: 141299

SEQ ID NO: 394134 - RNA, 50 nt, Homo Sapiens; identical to SEQ ID NO: 141300

SEQ ID NO: 394135 - RNA, 64 nt, Homo Sapiens; identical to SEQ ID NO: 141301

SEQ ID NO: 394136 - RNA, 64 nt, Homo Sapiens; identical to SEQ ID NO: 141302

SEQ ID NO: 394137 - RNA, 64 nt, Homo Sapiens; identical to SEQ ID NO: 141303

SEQ ID NO: 394138 - RNA, 64 nt, Homo Sapiens; identical to SEQ ID NO: 141304

SEQ ID NO: 394139 - RNA, 64 nt, Homo Sapiens; identical to SEQ ID NO: 141305

SEQ ID NO: 394140 - RNA, 64 nt, Homo Sapiens; identical to SEQ ID NO: 141306

SEQ ID NO: 394141 - RNA, 64 nt, Homo Sapiens; identical to SEQ ID NO: 141307

SEQ ID NO: 394142 - RNA, 64 nt, Homo Sapiens; identical to SEQ ID NO: 141308

SEQ ID NO: 394143 - RNA, 64 nt, Homo Sapiens; identical to SEQ ID NO: 141309

SEQ ID NO: 394144 - RNA, 64 nt, Homo Sapiens; identical to SEQ ID NO: 141310

SEQ ID NO: 394145 - RNA, 64 nt, Homo Sapiens; identical to SEQ ID NO: 141311

SEQ ID NO: 394146 - RNA, 64 nt, Homo Sapiens; identical to SEQ ID NO: 141312

SEQ ID NO: 394147 - RNA, 64 nt, Homo Sapiens; identical to SEQ ID NO: 141313

SEQ ID NO: 394148 - RNA, 64 nt, Homo Sapiens; identical to SEQ ID NO: 141314

SEQ ID NO: 394149 - RNA, 64 nt, Homo Sapiens; identical to SEQ ID NO: 141315

SEQ ID NO: 394150 - RNA, 64 nt, Homo Sapiens; identical to SEQ ID NO: 141316

SEQ ID NO: 394151 - RNA, 64 nt, Homo Sapiens; identical to SEQ ID NO: 141317

SEQ ID NO: 394152 - RNA, 64 nt, Homo Sapiens; identical to SEQ ID NO: 141318

SEQ ID NO: 394153 - RNA, 64 nt, Homo Sapiens; identical to SEQ ID NO: 141319

SEQ ID NO: 394154 - RNA, 64 nt, Homo Sapiens; identical to SEQ ID NO: 141320

SEQ ID NO: 394155 - RNA, 53 nt, Homo Sapiens; identical to SEQ ID NO: 167525

SEQ ID NO: 394156 - RNA, 60 nt, Homo Sapiens
auaacauacuccuuuuugaaaguugccuuuucucuccacccuugaguagauccaguauuu

SEQ ID NO: 394157 - RNA, 60 nt, Homo Sapiens
cagauguggagucugugucugcccccgucuucucuccauccucaaagcccccacuucucu

SEQ ID NO: 394158 - RNA, 60 nt, Homo Sapiens
cgucuucucuccauccucaaagcccccacuucucuccaggcuguuucuuuuuuuaugacu

SEQ ID NO: 394159 - RNA, 60 nt, Homo Sapiens
ugucugggccagagaaccuagccuuugaaaucucuccaucauaugaaacauaacgggaug

SEQ ID NO: 394160 - RNA, 60 nt, Homo Sapiens
aaacugguacccacacuugcccuuucucccucucuccagcacacuccccucuaagaaagu

SEQ ID NO: 394161 - RNA, 60 nt, Homo Sapiens
cucugccuccuacgaggcugacaucauccaucucuccagauuucuguucucuccaaccac

SEQ ID NO: 394162 - RNA, 60 nt, Homo Sapiens
cacacaucauccaucucuccuuuuuucuguucucuccaacggaaacagccugcaccauuu

SEQ ID NO: 394163 - RNA, 60 nt, Homo Sapiens
agcuggcucccuagccuaccucucuggugaucucuccaucugaggcuccuucacuuucuc

SEQ ID NO: 394164 - RNA, 60 nt, Homo Sapiens
gugaucucuccaucugaggcuccuucacuuucucuccaugggauagggguuggggguacu

SEQ ID NO: 394165 - RNA, 60 nt, Homo Sapiens
gaacuccagguucugcuggccguggcauccucucuccaggucugcucccuuaccggagcu

SEQ ID NO: 394166 - RNA, 60 nt, Homo Sapiens
ugcguccacagggaacaaagcccugaccucucucuccacauuacccuuacaaaaacaggc

SEQ ID NO: 394167 - RNA, 60 nt, Homo Sapiens
aauccauuccauugucugugaaauugacacucucuccaaacccuguauuucuuuagcccu

SEQ ID NO: 394168 - RNA, 60 nt, Homo Sapiens
uuuaggucacuuaccaguuuuccucaccugucucuccauaagcauuuacuauguauuuuc

SEQ ID NO: 394169 - RNA, 60 nt, Homo Sapiens
uuaaagaucauuuaucagaggcuuccucagucucuccaucugaacaugaacauucacuua

SEQ ID NO: 394170 - RNA, 60 nt, Homo Sapiens
cagauugucagcuccuugagguuuauccuaucucuccaacugguuaacuaauucuugggu

SEQ ID NO: 394171 - RNA, 60 nt, Homo Sapiens
gcaccugucauaugcucugagugccuuucuucucuccagucuccauccuaccacaaugca

SEQ ID NO: 394172 - RNA, 60 nt, Homo Sapiens
ucccauuuuuauuacccuucuuuccauuucucucuccagucuuccaccuggaagcccucu

SEQ ID NO: 394173 - RNA, 60 nt, Homo Sapiens
ccucucuggcuaaggacaggcaggugccccucucuccaucagaggacaccuguacuggag

SEQ ID NO: 394174 - RNA, 60 nt, Homo Sapiens
auaacugcuggagugucugggauugguagcucucuccaacugccugcuugcucuuuacag

SEQ ID NO: 394175 - RNA, 60 nt, Homo Sapiens
gcucuuuacagccucucucugugacuggaaucucuccaccucaucguaucuaaggauaac

SEQ ID NO: 394176 - RNA, 60 nt, Homo Sapiens
ugcauugaauugaauaugaauuucucuaacucucuccagaaaauggauggagauaacuug

SEQ ID NO: 394177 - RNA, 60 nt, Homo Sapiens
ugagauucuuuagccacuuuggggagccugucucuccagaagccuuucuuaguggugccc

SEQ ID NO: 394178 - RNA, 60 nt, Homo Sapiens
gagugggacugugucuugcuucaugauuccucucuccauuacucucccugcccuucucug

SEQ ID NO: 394179 - RNA, 60 nt, Homo Sapiens
caugaugcuuccugcucaccugggccacccucucuccaggacuugucagcuggugguuca

SEQ ID NO: 394180 - RNA, 60 nt, Homo Sapiens
ugugagugacuuauuguacccaacucuauuucucuccauacugaaacaugucuuucauag

SEQ ID NO: 394181 - RNA, 60 nt, Homo Sapiens
augaaacagcuaaaagaaaacaucggggaaucucuccaggacauuggagugggcaaagau

SEQ ID NO: 394182 - RNA, 60 nt, Homo Sapiens
aguugaugcgguuuguagcuuccucccuacucucuccaacaccugcaugcaaagacuacu

SEQ ID NO: 394183 - RNA, 60 nt, Homo Sapiens
acucuggaagucucuuccuccuccuccucuucucuccaccccuagacccuggcugacuug

SEQ ID NO: 394184 - RNA, 60 nt, Homo Sapiens
gacuuucucacccgguucccccagaacauuucucuccacuaggauagggcgggagaggca

SEQ ID NO: 394185 - RNA, 60 nt, Homo Sapiens
uuggaagccauccagcugauuaucucugcaucucuccaauucccuaagugcucccccacu

SEQ ID NO: 394186 - RNA, 60 nt, Homo Sapiens
aauucucuacccucaccccacagagccaucucucuccagaccaaaagcuggaaggagagu

SEQ ID NO: 394187 - RNA, 60 nt, Homo Sapiens
uuuuacaacugcauguuuauuaugauacuuucucuccaaaggaaacuuuuaaaucaaugg

SEQ ID NO: 394188 - RNA, 60 nt, Homo Sapiens
aaacuccggagggucggacgggaccugggcucucuccacgauucuggcuguuugcccagg

SEQ ID NO: 394189 - RNA, 60 nt, Homo Sapiens
agcugaacauggagcaaggggagggugacuucucuccacauagggagggcuuagagcuca

SEQ ID NO: 394190 - RNA, 60 nt, Homo Sapiens
gggaaaaccccugguucuccaugccacaccucucuccaggugcccucugccucuucaccc

SEQ ID NO: 394191 - RNA, 60 nt, Homo Sapiens
caccccacaagaagccuuauccuacguccuucucuccaucuaucggaccccaguuuccau

SEQ ID NO: 394192 - RNA, 60 nt, Homo Sapiens
gcccggggggaccaggaugacaccuccauuucucuccaggaaguuuugaguuucucucca

SEQ ID NO: 394193 - RNA, 60 nt, Homo Sapiens
ccuccauuucucuccaggaaguuuugaguuucucuccaccgugacacaauccucaaacau

SEQ ID NO: 394194 - RNA, 60 nt, Homo Sapiens
uccucccccaaaugugcaaccuguaaaaggucucuccacaccaggggccaggauccaguu

SEQ ID NO: 394195 - RNA, 60 nt, Homo Sapiens
caaauccuuacucuggcucugcuuacacuuucucuccaucaccaaauccuuacuccaaau

SEQ ID NO: 394196 - RNA, 60 nt, Homo Sapiens
cagaggcucacagguggcacacaggcgcugucucuccagagccauccuucagaguggacc

SEQ ID NO: 394197 - RNA, 60 nt, Homo Sapiens
aagcacagaucccagcacuuuucccagcuuucucuccagcaucagucccugcagcagcug

SEQ ID NO: 394198 - RNA, 60 nt, Homo Sapiens
gcggggcucggagcauggcaaccaugugggucucuccacagaagcugcccuuuguucugu

SEQ ID NO: 394199 - RNA, 60 nt, Homo Sapiens
cuccuguucugucuguacccuccccugcucucucuccaccagggcuggggcuuuucuucc

SEQ ID NO: 394200 - RNA, 60 nt, Homo Sapiens
cucggacaaucaaagggagacuuccuuguaucucuccagacaacuuccucccugcccagc

SEQ ID NO: 394201 - RNA, 60 nt, Homo Sapiens
ugccccucagccaugggcccggugggccacucucuccagggacagauggaggcaguggcu

SEQ ID NO: 394202 - RNA, 60 nt, Homo Sapiens
gcuggagacucuggcucagccagaguuguuucucuccacucugccucaucucuguacgaa

SEQ ID NO: 394203 - RNA, 60 nt, Homo Sapiens
gagagcccaggcguccgcggcgacuugccgucucuccauuccacugccuguugcagaguu

SEQ ID NO: 394204 - RNA, 60 nt, Homo Sapiens
ucccuuccuucuuuuuuuccucuacugacuucucuccauacucuuuccccucuauuucuu

SEQ ID NO: 394205 - RNA, 60 nt, Homo Sapiens
uggcucuuaagaaucaggcagucgcccacuucucuccagaugaagggaagacauucauag

SEQ ID NO: 394206 - RNA, 64 nt, Homo Sapiens
uaagcaguaagcguauuuagcucaaguuaguuauaggauguacuaaacuuaaguuccagcuuuu

SEQ ID NO: 394207 - RNA, 64 nt, Homo Sapiens
agugaagcugaguaaacuauuacaauacucaucuaggauguaacuaaggcccaguauuuuugaa

SEQ ID NO: 394208 - RNA, 64 nt, Homo Sapiens
uuuugccauugacuucuucccaagauucaaucccaggauguacaaggacagccccuccuccaua

SEQ ID NO: 394209 - RNA, 64 nt, Homo Sapiens
aggcaguuccauuucauuugugccagaaugcuuuaggauguacaguuauggauugaaaguuuac

SEQ ID NO: 394210 - RNA, 64 nt, Homo Sapiens
uuagcugcacuccaacauuggccuaaauagcuucaggauguaucuuucuccaccuguguuuaug

SEQ ID NO: 394211 - RNA, 64 nt, Homo Sapiens
cccuguguuucuuuggugguuugggcugaccuguaggauguaacccaccucccuggggcagggc

SEQ ID NO: 394212 - RNA, 64 nt, Homo Sapiens
gugguggucuucaaaaugguggccagccagaucaaggauguaguaucucauaguucccagguga

SEQ ID NO: 394213 - RNA, 64 nt, Homo Sapiens
guguccuccaucaauucuguauuccagacuugggaggauguacaguugcuguugugugaucaaa

SEQ ID NO: 394214 - RNA, 64 nt, Homo Sapiens
cgugauuaaucaguaauucacauugccgauaugcauaugcaacuuauaaucaaauagaacuaga

SEQ ID NO: 394215 - RNA, 64 nt, Homo Sapiens
aacugaaacuaauuugauuuugauuucauauucaauaugcaauaauuauguucuaucagagaua

SEQ ID NO: 394216 - RNA, 64 nt, Homo Sapiens
uccauuccuauuauaauugaagggauggugcagcauaugcaauuagauaaaauuccacaaaaau

SEQ ID NO: 394217 - RNA, 64 nt, Homo Sapiens
guuggcauuuaaccauccaacuaaaagggggaauauaugcaaugcauaagcuacaguauguaaa

SEQ ID NO: 394218 - RNA, 64 nt, Homo Sapiens
acugugguucaaauuagaaucuaaguauguuggaauaugcaaggcguuuauuuuuuguaucacu

SEQ ID NO: 394219 - RNA, 64 nt, Homo Sapiens
cauauacuuuuggagaugaagaaugcgaacgaauauaugcaauuccugcauaaauggacuuguu

SEQ ID NO: 394220 - RNA, 64 nt, Homo Sapiens
ggcuacuaagcacaugaaaauuucuccaaagaagauaugcaaaugcuaacgguuugaauagaca

SEQ ID NO: 394221 - RNA, 64 nt, Homo Sapiens
gcaaaagaaugagguuggacgcaccgagacaaugauaugcaagugagagucuuuucaacaaaug

SEQ ID NO: 394222 - RNA, 64 nt, Homo Sapiens
cuucaaguuuaaaaaaucgucuuacauguguacaauaugcaaauuaguuuuagauuagagagug

SEQ ID NO: 394223 - RNA, 64 nt, Homo Sapiens
gaguguuuggauuguaauuauaaaugguucuuugauaugcaaauuaauauuuucaguugauuuu

SEQ ID NO: 394224 - RNA, 64 nt, Homo Sapiens
ugccuauuuauuucugcuuuguucucagugauguauaugcaacauuuuguugaaagccacgaug

SEQ ID NO: 394225 - RNA, 64 nt, Homo Sapiens
caucuagggaguuucugcuuauaccacuuuaaaaauaugcaaucauaagugauuugguuacugc

SEQ ID NO: 394226 - RNA, 64 nt, Homo Sapiens
uuugaugaaacugcugguuuaaaaauauuuacugauaugcaaaugucaugcaaaacuccacuuu

SEQ ID NO: 394227 - RNA, 64 nt, Homo Sapiens
aaucgauaccuauaacaauuaguguucuauaaugauaugcaauuaccauuugcauucuuucugu

SEQ ID NO: 394228 - RNA, 64 nt, Homo Sapiens
agaucauuuuuaaguuugauuggaaugagagaaaauaugcaaagcaggaaaucaaaggaguggg

SEQ ID NO: 394229 - RNA, 64 nt, Homo Sapiens
gaagcuuauccuuagccuauaguaaaaaauggugauaugcaauccaggcugcgggccuuccaaa

SEQ ID NO: 394230 - RNA, 64 nt, Homo Sapiens
auugcuaugauuuuuacucagaguuuuauaugaaauaugcaaguaaaucuuaucguuaguucuu

SEQ ID NO: 394231 - RNA, 64 nt, Homo Sapiens
gguacagcucaacaaaggaaaaccacaggacuggauaugcaacuagugcucagaccaaagaguu

SEQ ID NO: 394232 - RNA, 64 nt, Homo Sapiens
agauacuuuuuccugccucagcucuguacacaugauaugcaacaaagggcagcaagaaaugcug

SEQ ID NO: 394233 - RNA, 64 nt, Homo Sapiens
auuauucaaccaagcuucuaaucaaauguaaaucauaugcaaaugcaaaaaugaguaugaggaa

SEQ ID NO: 394234 - RNA, 64 nt, Homo Sapiens
augaguaugaggaaaucaaaaaugccugcaaacuauaugcaaaaaugaaauuacuauacauuga

SEQ ID NO: 394235 - RNA, 64 nt, Homo Sapiens
gcucuaggcugugcagggggggagagauuaugucauaugcaacuaagcugugauacuaaggaga

SEQ ID NO: 394236 - RNA, 64 nt, Homo Sapiens
cuuuccuuaacaguaaagggucuucuauaucuacauaugcaaaguuaguauuuacguagcuuau

SEQ ID NO: 394237 - RNA, 64 nt, Homo Sapiens
auauuuauugaauuccuagaauggaaagcacaacauaugcaauugcauuugaggauuuuaauuu

SEQ ID NO: 394238 - RNA, 64 nt, Homo Sapiens
auauauaucauuagauuccuaugaaauuuuaaauauaugcaaauaguuuauuaccuuuucccuc

SEQ ID NO: 394239 - RNA, 64 nt, Homo Sapiens
ucuguuucuacuacaauguuaauuaccuuuucacauaugcaaaaagugauuaauguauuuuaua

SEQ ID NO: 394240 - RNA, 64 nt, Homo Sapiens
aaugaaaccagcauuuaguaccagcauaugguucauaugcaaauaauacuuuccccaaaaucuu

SEQ ID NO: 394241 - RNA, 64 nt, Homo Sapiens
cugguuuuguuucauuuugcucuguuuuaaauccauaugcaaauaaaacugcuucucucuuaca

SEQ ID NO: 394242 - RNA, 64 nt, Homo Sapiens
gaguugccuauauuugcuauucaaaauuuuguaaauaugcaaaucagcuuuauagguuuauuac

SEQ ID NO: 394243 - RNA, 64 nt, Homo Sapiens
auauguugaaaacuuaaggaagcaaaugcuacauauaugcaauauaaaauaguaaugugaugcu

SEQ ID NO: 394244 - RNA, 64 nt, Homo Sapiens
aaauaaaguacauuauuuauccuccuuaauagccauaugcaauaucuguauugaucauggaugc

SEQ ID NO: 394245 - RNA, 64 nt, Homo Sapiens
uuuacauuuuuaauuuaguuuuucacaaaaaggcauaugcaauaauuuuccucuauccuguaca

SEQ ID NO: 394246 - RNA, 64 nt, Homo Sapiens
aaaagcauacgugcuaugacucucuccaguuugaauaugcaauuguuuucacaggcaggauguc

SEQ ID NO: 394247 - RNA, 64 nt, Homo Sapiens
aguauuaaccacuguguucaagaguaaaaacaauauaugcaauuuucauugaacuuaaagagug

SEQ ID NO: 394248 - RNA, 64 nt, Homo Sapiens
cacugcauccaugcauucugagccugguagauuuauaugcaaugauauauagauauauauccau

SEQ ID NO: 394249 - RNA, 64 nt, Homo Sapiens
aggguccuauuauguuuuuuauuccugugguuacauaugcaaguuagcuuuuuuuuaauguaga

SEQ ID NO: 394250 - RNA, 64 nt, Homo Sapiens
aguugugccuguguauuugauaaaaucaauaauaauaugcaaacuaaacuaugggaguguauua

SEQ ID NO: 394251 - RNA, 64 nt, Homo Sapiens
auauaucugauauauauuauauauaagguacauaauaugcaauuauucaacuuauauauaauau

SEQ ID NO: 394252 - RNA, 64 nt, Homo Sapiens
ucccccuuuaaauaaaaauauuagaucaaauacuauaugcaagaaaucauagcaaaguuuuuuu

SEQ ID NO: 394253 - RNA, 64 nt, Homo Sapiens
ccauuguacauguggguuauauaccauauguuaaauaugcaauaaaguguuuacaggaugcccu

SEQ ID NO: 394254 - RNA, 64 nt, Homo Sapiens
caaauacguagcuuugguaacaaacaaaauccguauaugcaaaucaacauauccaaacaugcca

SEQ ID NO: 394255 - RNA, 64 nt, Homo Sapiens
aauuucuucuagaaacuuccuguauggaacguuuauaugcaauuaacaugcauaugaaaaacau

SEQ ID NO: 394256 - RNA, 64 nt, Homo Sapiens
cccccaucaucugcacacccgcuagucccugcaaauaugcaaacgcaaaccuccugccugacuc

SEQ ID NO: 394257 - RNA, 64 nt, Homo Sapiens
cuccugccugacucgcuaguaguucuauauucacauaugcaaaccugcucaugaggggcugcgg

SEQ ID NO: 394258 - RNA, 64 nt, Homo Sapiens
gaaauaguuuauucaaagaguaugcaagugucaaauaugcaaaaacuaguguagacucaaaaga

SEQ ID NO: 394259 - RNA, 64 nt, Homo Sapiens
gucaaauaugcaaaagaaauuguagacucaaaagauaugcaagucgcuuucuuuacaucacuag

SEQ ID NO: 394260 - RNA, 64 nt, Homo Sapiens
ucuccaaggagcacaaaaaaaucauauguaccaaggauguuacaguaaacaggaugaacuauuu

SEQ ID NO: 394261 - RNA, 64 nt, Homo Sapiens
cagcccauuccucccauuuuuugcaaugaugucuggauguuauuuuaaacagugugucugugug

SEQ ID NO: 394262 - RNA, 64 nt, Homo Sapiens
ccauauuaguuaacaagaggugucuuuaggcccuggauguuaccaucucauuuggucaagcccc

SEQ ID NO: 394263 - RNA, 64 nt, Homo Sapiens
cugcucuuguggaggucacaaucuagcggagaaaggauguuacuagaaguacacaaauugggcc

SEQ ID NO: 394264 - RNA, 64 nt, Homo Sapiens
agaaaacucaauccaugaccagggagaacuuacaggauguuagagacaaaacaagcagacaccu

SEQ ID NO: 394265 - RNA, 64 nt, Homo Sapiens
uaaaaaugauugauuuacuugcagauuuuucagaggauguuaugucuuugucauucauuaaaug

SEQ ID NO: 394266 - RNA, 64 nt, Homo Sapiens
ccaaaucuuuuugacuucugagguuuuuagcuuaggauguuaauuuguccuuuugucuuucuuu

SEQ ID NO: 394267 - RNA, 57 nt, Homo Sapiens
aggaauguggacuuuauugagaagcauggauguuagugaaagguaaaguuucauaca

SEQ ID NO: 394268 - RNA, 64 nt, Homo Sapiens
uuucuggugcugcccagccagugccuucugccauggauguuacuggcuacuugagaaaaaggag

SEQ ID NO: 394269 - RNA, 64 nt, Homo Sapiens
uuuauaucuaauaugaagaagacaccucuaaucuggauguuaagaaugaaguucugcuacauua

SEQ ID NO: 394270 - RNA, 64 nt, Homo Sapiens
uacuguauuuaguguuucuauuucaauuuuucuaggauguuaauuuauaugaaaauaaaaugaa

SEQ ID NO: 394271 - RNA, 64 nt, Homo Sapiens
aguuuauugaccuaauauuuagcuaucuuuuuauggauguuagcuucuugcauuuuaguaagaa

SEQ ID NO: 394272 - RNA, 64 nt, Homo Sapiens
uauucuuauaaccuguuuccugacucuugaacauggauguuauacucugcccuccagaacucag

SEQ ID NO: 394273 - RNA, 64 nt, Homo Sapiens
uuaugaagaguucuagagcauauaggccacaucaggauguuauuaaaauauaaagucucugauc

SEQ ID NO: 394274 - RNA, 64 nt, Homo Sapiens
agguauuucaguacaacuggugcugccaccugcuggauguuaaaaguauggaauuguuacuuag

SEQ ID NO: 394275 - RNA, 64 nt, Homo Sapiens
caacuccuuccaguugucuuuugcaggacucacuggauguuauuagguaguagagccugaaguc

SEQ ID NO: 394276 - RNA, 64 nt, Homo Sapiens
cugcaaacaacauuaggggaguugcaguagcaguggauguuagcuuuugccucugcccaaccag

SEQ ID NO: 394277 - RNA, 64 nt, Homo Sapiens
uaaauacucagcaggcugagauauggauauuuggggauguuauucuaggccagccaaaguccac

SEQ ID NO: 394278 - RNA, 64 nt, Homo Sapiens
cugcgggaggggagggcugcuggggaggauggggggauguuauauaaauauagauauaauuuua

SEQ ID NO: 394279 - RNA, 64 nt, Homo Sapiens
uuucaaaagaaagcuaaaugcugauugugguuuaggauguuacaguacuaauaccaucauguua

SEQ ID NO: 394280 - RNA, 64 nt, Homo Sapiens
uuuuacaaccugauguauauauuagacaguucuaggauguuaguucccuucauuccagagcuau

SEQ ID NO: 394281 - RNA, 64 nt, Homo Sapiens
cuccaucuagagauuuucuuggcaguauuccaugggauguuaagcaaaggaaaccaaaggaauc

SEQ ID NO: 394282 - RNA, 64 nt, Homo Sapiens
uccccaucccuuugggccuguacaaagaaauucuggauguuaaaauaauauauacucaucacag

SEQ ID NO: 394283 - RNA, 64 nt, Homo Sapiens
uguaacaauggaccuaaauggacuauaguauauuggauguuaaauccauauaugauguauauuu

SEQ ID NO: 394284 - RNA, 64 nt, Homo Sapiens
uccccgaguggauggauggauggauggaugguagggauguuaauaauuuuaguggaacaaagcc

SEQ ID NO: 394285 - RNA, 64 nt, Homo Sapiens
caugcauuuaaaaauaaagcuuaaacaacuguauggauguuacauuuacuuucuuuugauuuuu

SEQ ID NO: 394286 - RNA, 64 nt, Homo Sapiens
cguccauaggagaagugagaauacugugaaaaagggauguuagcauucauuagaguaugaggau

SEQ ID NO: 394287 - RNA, 64 nt, Homo Sapiens
acaucuuacucuaaauaaacaauuuugucaugcuggauguuaacuaaauugugaacuuuguaca

SEQ ID NO: 394288 - RNA, 64 nt, Homo Sapiens
gacauuauacacugaagucuauuuuaaaaaggcaggauguuauuuuuaacaaauguuuuaagca

SEQ ID NO: 394289 - RNA, 64 nt, Homo Sapiens
aaaucuagucaucuucccuguaaauuucacucauggauguuaggagucagagaguauacuucua

SEQ ID NO: 394290 - RNA, 64 nt, Homo Sapiens
uugccuuuuguuuguuuugaccccucacagcuugggauguuaccugcaccuaggagagacucag

SEQ ID NO: 394291 - RNA, 64 nt, Homo Sapiens
uaaauauuuuugcauguaucguuaauauauuuuaggauguuaugccuccuuuaauauugauaaa

SEQ ID NO: 394292 - RNA, 64 nt, Homo Sapiens
cugauuauuaauaagaaauuugauuguuauuguuggauguuauaauguuaaccccuaugguaag

SEQ ID NO: 394293 - RNA, 64 nt, Homo Sapiens
acugacccacuaccugcauugaguauaaaugccuggauguuaaggauuccaauuuaacuuugaa

SEQ ID NO: 394294 - RNA, 64 nt, Homo Sapiens
uuuugaguuuuucauuuuauugcauaucuggguuggauguuagacuaaaggaaacccaggaaua

SEQ ID NO: 394295 - RNA, 64 nt, Homo Sapiens
uuuaacuaugucaugcaacauauauauguugguaggauguuauuagagagauaugugugcauau

SEQ ID NO: 394296 - RNA, 64 nt, Homo Sapiens
acccuguccuccaccugccuuccauuuugaagugggauguuaaugaaaucaaguuccaguaacc

SEQ ID NO: 394297 - RNA, 64 nt, Homo Sapiens
ggucagaucauuuugugcauaugcagccuggauuggauguuaaguaaaugcuuguucagugccg

SEQ ID NO: 394298 - RNA, 64 nt, Homo Sapiens
gcugcucgauucccaggaucaguuccuggcccguggauguuaaaccaguuaugccuccuccuca

SEQ ID NO: 394299 - RNA, 64 nt, Homo Sapiens
guacccuuugauaaacuaaauguuuuuccuuuucggauguuagaugugaauuagucuggaaacg

SEQ ID NO: 394300 - RNA, 64 nt, Homo Sapiens
agaaaaguccacauaacccuaaggaacuaagucaggauguuaacguuuuuuuugcugcuaaaga

SEQ ID NO: 394301 - RNA, 64 nt, Homo Sapiens
cggucuccacacccuuacgguuuccuagaaucagggauguuaguguaagucuauaggaauauag

SEQ ID NO: 394302 - RNA, 64 nt, Homo Sapiens
ucacuaggagacguggaauugagacuaauaacuuggauguuaacacuguuuacuguuuuuucac

SEQ ID NO: 394303 - RNA, 64 nt, Homo Sapiens
caugguaaaaaguuaaccuuuucuauuuuuuaauggauguuauaccaacuauucagaggaacuc

SEQ ID NO: 394304 - RNA, 64 nt, Homo Sapiens
uaugccuacgauguaauaacgagucagcccgaaaggauguuaauugacaagcucaaauaauuau

SEQ ID NO: 394305 - RNA, 64 nt, Homo Sapiens
uucauuggaaaaacaaaccauauugaauacuuugggauguuaaaacuuuuguuaauaaacucaa

SEQ ID NO: 394306 - RNA, 64 nt, Homo Sapiens
caguaucaauaaaucacuucuaccuguauauaauggauguuaacuguacaauuuugaaaguuuc

SEQ ID NO: 394307 - RNA, 64 nt, Homo Sapiens
uguuuaggagugucuaaguuuugucaucaauccaggauguuauucuuccuucccaacucacugu

SEQ ID NO: 394308 - RNA, 64 nt, Homo Sapiens
uacuuguuuauuaguuagcacuguguuacacuggggauguuauucugccucucucacuuggaag

SEQ ID NO: 394309 - RNA, 64 nt, Homo Sapiens
gacauacuuaucaccgugaaccccugaaccauuuggauguuacauauguauauaugcuuuuuuc

SEQ ID NO: 394310 - RNA, 64 nt, Homo Sapiens
acagauuuuacuaaagcuagauugcagauuuauuggauguuauguugugauagcuaugucuuuu

SEQ ID NO: 394311 - RNA, 64 nt, Homo Sapiens
uaccuucaucaaaucccaacuuugacuuccauguggauguuauaucccuuccucccauccccag

SEQ ID NO: 394312 - RNA, 64 nt, Homo Sapiens
gcucaaacgggcuuuuauauagacuguuaaucauggauguuagaaacagaguuacccaacccag

SEQ ID NO: 394313 - RNA, 64 nt, Homo Sapiens
agauguuauuuuauuggaacaacugacaaaugagggauguuagcuuuguggcagaauucccugc

SEQ ID NO: 394314 - RNA, 64 nt, Homo Sapiens
cugagauuccacauaacacaugguugucaaaauuggauguuaaggauucuuagaaaaacagcaa

SEQ ID NO: 394315 - RNA, 64 nt, Homo Sapiens
agaaauaaaaaaauccgucaccaaauuguaaccuggauguuauagcccagcaucuagaaauccu

SEQ ID NO: 394316 - RNA, 64 nt, Homo Sapiens
caggagaggggucuauccaccccugcucauugguggauguuaaaccaauauuccuuucaacugc

SEQ ID NO: 394317 - RNA, 64 nt, Homo Sapiens
cuggaaauaggucuguccacuccuggucauugguggauguuaaacccauauuccuuucaacugc

SEQ ID NO: 394318 - RNA, 64 nt, Homo Sapiens
guucagggccauuucagguuuggguguuuucuggggauguuaacaugggauucaggcucaacuc

SEQ ID NO: 394319 - RNA, 64 nt, Homo Sapiens
cagggaacgugauuagugaaaggaagauaaacguggauguuacuccaaaacuucguuuaaugaa

SEQ ID NO: 394320 - RNA, 64 nt, Homo Sapiens
cucaagccaguauaguuuggaaguugggggucggggauguuaaggguggggaguauccugccug

SEQ ID NO: 394321 - RNA, 64 nt, Homo Sapiens
ggacauuauuucgaugcuaaaguaaggauucuguggauguuacuuaaagagaaaagcauaagag

SEQ ID NO: 394322 - RNA, 64 nt, Homo Sapiens
uguuaaucuaaaauauagcuagaucacaagggggggauguuaaaaccugaauauccaacgguau

SEQ ID NO: 394323 - RNA, 64 nt, Homo Sapiens
aaguauugaauaaacuauuuuugauauauggguaggauguuacauagcaucauugcccacagug

SEQ ID NO: 394324 - RNA, 64 nt, Homo Sapiens
gauguugcugggauccugcccagggugccgguggggauguuauauuggcuaacaguccuguguc

SEQ ID NO: 394325 - RNA, 64 nt, Homo Sapiens
cauaaaacagauaaucaaauaugauuaauugaggggauguuacuaugcugucucuugcucuuca

SEQ ID NO: 394326 - RNA, 64 nt, Homo Sapiens
gaugccguuagugcuuuuuuuguaaacaaugaauggauguuacuauuauuuguguauuguacga

SEQ ID NO: 394327 - RNA, 64 nt, Homo Sapiens
ucuguuauacaucugaauuuacauucuauucugcggauguuauuucaaagcgagaauucuaucu

SEQ ID NO: 394328 - RNA, 64 nt, Homo Sapiens
uuuuucagauccaagcauauuagaaugucauuguggauguuaccugauuguaagaacucuguaa

SEQ ID NO: 394329 - RNA, 64 nt, Homo Sapiens
ugguaucuaccugugauuucuuugccaaccuaguggauguuaagcuuaaguucagacuuaaaaa

SEQ ID NO: 394330 - RNA, 64 nt, Homo Sapiens
auagaaaguaucuguguuuaagaagauaauuaaaggauguuaucauaggcuauauguguuuuac

SEQ ID NO: 394331 - RNA, 64 nt, Homo Sapiens
agccauauuggaacugagaacggggaagacauauggauguuagcguagcuuuuaaagagaugug

SEQ ID NO: 394332 - RNA, 64 nt, Homo Sapiens
gauuugaaauguuuuguacuuaucucuaaauuauggauguuaaagguguaaauaaagaccuugc

SEQ ID NO: 394333 - RNA, 64 nt, Homo Sapiens
ucucuguauuuuucuuucaguugucuuugggaggggauguuaagucaaaucacuaaaacagggu

SEQ ID NO: 394334 - RNA, 64 nt, Homo Sapiens
uguauagauuucacaacacaaaaaggacauuuguggauguuacugcacauuuuaaauucuuaac

SEQ ID NO: 394335 - RNA, 64 nt, Homo Sapiens
aaugaagccauauguuuauguaauggacuauacaggauguuaauugauaauggaaauaauuuag

SEQ ID NO: 394336 - RNA, 64 nt, Homo Sapiens
gggcaaaguuaugauuuacaugaaagccuuugguggauguuaugccgccaaagucaauuauguu

SEQ ID NO: 394337 - RNA, 64 nt, Homo Sapiens
aucaaacaucaguacacuugccgaauucucaucuggauguuaccguagugccacuaguuaaaug

SEQ ID NO: 394338 - RNA, 64 nt, Homo Sapiens
acuguuuuaauuuucuugggaaauugaguccaguggauguuaauggaguggguugcccaucccu

SEQ ID NO: 394339 - RNA, 64 nt, Homo Sapiens
gcgugcgcacugcaugggaaauagcggcccuggaggauguuagacuugcucccucuccaagaca

SEQ ID NO: 394340 - RNA, 64 nt, Homo Sapiens
gcauaaaaugcaaggucucuggaccucagggcagggauguuagacagcggcuucuguuggcucc

SEQ ID NO: 394341 - RNA, 64 nt, Homo Sapiens
gaugaggcagucugacugucuucucagaucccuuggauguuacaacaccuggacugaaugucug

SEQ ID NO: 394342 - RNA, 64 nt, Homo Sapiens
gcuguuuugcuuggagaagagguuuuuaaaacauggauguuaagaaggacagcguggauaaaaa

SEQ ID NO: 394343 - RNA, 64 nt, Homo Sapiens
gacgaguuccagcccugccacugcuggggcucagggauguuaggucgcuucuaacacagggcac

SEQ ID NO: 394344 - RNA, 64 nt, Homo Sapiens
ccacugucacagugugccugaggaaggcugcuagggauguuagaccucggccaggacccaccac

SEQ ID NO: 394345 - RNA, 64 nt, Homo Sapiens
uacccauggcauggguggaauuagaguggaauaaggauguuaacuugguucucagacucuuucu

SEQ ID NO: 394346 - RNA, 64 nt, Homo Sapiens
uugagggcucuuaucccaggggacuuuuuaauucggauguuacuuaauguggcuucucuaaugu

SEQ ID NO: 394347 - RNA, 64 nt, Homo Sapiens
acaauuauuguguucuuuucauggaacauaaguaggauguuacauuuccagggugggaagggua

SEQ ID NO: 394348 - RNA, 64 nt, Homo Sapiens
cuucugacagauuucagucuggcuugaaauuuggggauguuaaugaggguccucugguuuuugg

SEQ ID NO: 394349 - RNA, 64 nt, Homo Sapiens
caucucaggagaaauauuggaauaaagcuugucaggauguuaagugguaguguuggcaguuguu

SEQ ID NO: 394350 - RNA, 64 nt, Homo Sapiens
guggcaggggguggggcucaccacaccugccaugggauguuaauagcauuucaaggccacagcu

SEQ ID NO: 394351 - RNA, 64 nt, Homo Sapiens
gagucuguugucuuaagcagcuuuuuuacuaaaaggauguuauauauuuuuugcuaugauaaaa

SEQ ID NO: 394352 - RNA, 64 nt, Homo Sapiens
uucugccacaaugugaagaaccaucuuccugaaaggauguuagucugcaccuuugcccuagugc

SEQ ID NO: 394353 - RNA, 64 nt, Homo Sapiens
ucugccauauuucaaaauggauaugcauugaacuggauguuauuuccauacuuuugauguuuca

SEQ ID NO: 394354 - RNA, 64 nt, Homo Sapiens
guccccucagccaaaaaggcccccacccacuccaggauguuaggagaggagaccaugggcccug

SEQ ID NO: 394355 - RNA, 64 nt, Homo Sapiens
uaccagucugucuucuguaggaugugucacuguuggauguuacaccagccuuuccaggguuaac

SEQ ID NO: 394356 - RNA, 64 nt, Homo Sapiens
uaaaauuugagguacuguaguuuauauaaaagucggauguuaagauauuauauuucaguacuag

SEQ ID NO: 394357 - RNA, 64 nt, Homo Sapiens
ugccccuagacucuagacuauguuaacuaguuaaggauguuacauuuugaaaggauguauguua

SEQ ID NO: 394358 - RNA, 64 nt, Homo Sapiens
ugcuuauauucuuauaauuuucucuucugacauuggauguuauucugcaaauggucacccugaa

SEQ ID NO: 394359 - RNA, 64 nt, Homo Sapiens
uuucucaguggaagcagcacaugagugggugacaggauguuagauaaaggcucuaguuagggug

SEQ ID NO: 394360 - RNA, 64 nt, Homo Sapiens
auuaaaagaauaguuuauguagagaaacauuaguggauguuaauugucuccccaccuauauuua

SEQ ID NO: 394361 - RNA, 64 nt, Homo Sapiens
caaaugcaguuacaauccauagauagccagcaguggauguuacuccaggaaaaugcaggauuaa

SEQ ID NO: 394362 - RNA, 64 nt, Homo Sapiens
agcuccugagaauuuaaaaacacaguaauucucuggauguuaggaccuaggggaacauugggca

SEQ ID NO: 394363 - RNA, 64 nt, Homo Sapiens
uaaggggugagacacaacaggagaaaucucacuuggauguuauguguugccaagguagcacugu

SEQ ID NO: 394364 - RNA, 64 nt, Homo Sapiens
uucacauguccuauuacugauucaaauacuuuugggauguuaccauagucuuuguuuacaugag

SEQ ID NO: 394365 - RNA, 64 nt, Homo Sapiens
cucuugcaccaaauuaucuugauuaaauacauauggauguuacuuuaauguuccucaaagcuug

SEQ ID NO: 394366 - RNA, 64 nt, Homo Sapiens
aguuaggggaagacuuuuauuauauuuauaauguggauguuaccuagcucuggaguaggaaggu

SEQ ID NO: 394367 - RNA, 64 nt, Homo Sapiens
gucgcuuuucagaauguauuuccccuggaaaaguggauguuauauuugcucuucaggaaaauua

SEQ ID NO: 394368 - RNA, 64 nt, Homo Sapiens
ccacuucuuauuaccacguugaugggaugagaugggauguuaaagugccaaauucugaaugcca

SEQ ID NO: 394369 - RNA, 64 nt, Homo Sapiens
gcucaaaagauuuauaaaagauuauuguuaacauggauguuacauuaauauagcaacagacaaa

SEQ ID NO: 394370 - RNA, 64 nt, Homo Sapiens
agagauuugauuuaauugacugcagauauauuaaggauguuagguuuguuggugcugcccacac

SEQ ID NO: 394371 - RNA, 64 nt, Homo Sapiens
cauggguguuacuugucuguaccucagagucugaggauguuaacuuuggaacucgcaguccucu

SEQ ID NO: 394372 - RNA, 64 nt, Homo Sapiens
acuaauguuauugacuuuuguaacuuacuaauagggauguuaaaaguaacaaaaccaagucaaa

SEQ ID NO: 394373 - RNA, 64 nt, Homo Sapiens
gcuccaccuaugagcgucugucucugugggcuugggauguuaacaggagccaaaaggagggaaa

SEQ ID NO: 394374 - RNA, 64 nt, Homo Sapiens
uauaguauggaaaguccaaaugacuuccuugauuggauguuaacagcugacuggugugagacuu

SEQ ID NO: 394375 - RNA, 64 nt, Homo Sapiens
cuuuggcaccuuguuaaaauuucuagucaucuguggauguuaccuugcuuguccacagcagcca

SEQ ID NO: 394376 - RNA, 64 nt, Homo Sapiens
auuacacuacucacuacucauguuuuacuuucuuggauguuaaccugcugcagaggugacuauu

SEQ ID NO: 394377 - RNA, 64 nt, Homo Sapiens
aaaaauacaguaaaguugcagaacggggggacggggauguuaggaaggggaacugccucaguga

SEQ ID NO: 394378 - RNA, 64 nt, Homo Sapiens
ugguguuuguaaagauacguggcuucagucucauggauguuauucuaugggaaaaaaacaaaag

SEQ ID NO: 394379 - RNA, 64 nt, Homo Sapiens
aacauugugacuuggaccuuuucaggaguggcgcggauguuacaggaaaugcugucggagagcg

SEQ ID NO: 394380 - RNA, 64 nt, Homo Sapiens
ucuaauaagcugcucugccccuugugcucagaguggauguuaugggauucuuuuuuucucuguu

SEQ ID NO: 394381 - RNA, 64 nt, Homo Sapiens
agauccacagggagaggucucacccuccagcuguggauguuaaacccugccagaugucccagcc

SEQ ID NO: 394382 - RNA, 64 nt, Homo Sapiens
aaaaguaauuauguuuauaaauagacuaacugcuggauguuaccaccaaguaagaaagcaacag

SEQ ID NO: 394383 - RNA, 64 nt, Homo Sapiens
agaggaagggagggaugaggagguggagugcaggggauguuagggcagugaaagguucuguaug

SEQ ID NO: 394384 - RNA, 64 nt, Homo Sapiens
cuguuuucugaaacacacgagcaaacccagagguggauguuaugaacagcugugucugccaaac

SEQ ID NO: 394385 - RNA, 64 nt, Homo Sapiens
uuaauuuuaaauuaucccagcuauuagauagaagggauguuacugcacuuauguguaaucagau

SEQ ID NO: 394386 - RNA, 64 nt, Homo Sapiens
cuggagcacgugcagcuguuugaccugaugaggaggauguuagaauuugacccugcccagcgca

SEQ ID NO: 394387 - RNA, 64 nt, Homo Sapiens
gauccagcucccugccuagcauccaugaccuguuggauguuaccuccaaucaguuuccuguccu

SEQ ID NO: 394388 - RNA, 64 nt, Homo Sapiens
ccuauuccucccacuaaguacaguuaacaacccuggauguuacauauaaaacaaacaaaaagac

SEQ ID NO: 394389 - RNA, 64 nt, Homo Sapiens
gcuuaauuuccuucuguuaagaaaggauauaaaaggauguuacaaguuugcuaaaagaagagag

SEQ ID NO: 394390 - RNA, 64 nt, Homo Sapiens
uugcaucucaguguuaaaucauaucagauauuacggauguuagaccugcauugccaucuacaua

SEQ ID NO: 394391 - RNA, 64 nt, Homo Sapiens
uauucacccccaaccauccaaucuguggauaauuggauguuagcgguacucuuccacuuccggg

SEQ ID NO: 394392 - RNA, 64 nt, Homo Sapiens
cuacugggcccuggccccgcagccuuccuaugagggauguuacugggcugugguccuguaccca

SEQ ID NO: 394393 - RNA, 64 nt, Homo Sapiens
agaauuguuuaaacccuuaccaaggaaaaaaaagggauguuaccaacugagaucgaucaguuca

SEQ ID NO: 394394 - RNA, 64 nt, Homo Sapiens
gugauuuaucaggaugugagcacucguugugucuggauguuacaaauaugggugguuuuauuuu

SEQ ID NO: 394395 - RNA, 64 nt, Homo Sapiens
gcuuccuaaagcugacccugggucuggugaaugaggauguuagggugguccaguaccuggcuga

SEQ ID NO: 394396 - RNA, 64 nt, Homo Sapiens
gucaguuuaauaucuuucuucugcugagucuucaggauguuagcuagucuuucaaaagccauug

SEQ ID NO: 394397 - RNA, 64 nt, Homo Sapiens
gccccgcugagaugcccuucugcuccagcuugcuggauguuaccuguccucuucccuccacaag

SEQ ID NO: 394398 - RNA, 64 nt, Homo Sapiens
cugggguuuuggcuggauucaucugcaggcaucuggauguuagccuuuaaaaggauuuuagcug

SEQ ID NO: 394399 - RNA, 64 nt, Homo Sapiens
cuguggguaaaauaugcaaaucagccuguaaaaaggauguuaaguucuaucagccugagugagu

SEQ ID NO: 394400 - RNA, 64 nt, Homo Sapiens
cuugcguucaaccaaaauugucuguuuuggauggggauguuacccuucauaccaugagaacauu

SEQ ID NO: 394401 - RNA, 64 nt, Homo Sapiens
ucuccacccucgagguguacauccaggugugcuuggauguuaguagaagugggucccauccacc

SEQ ID NO: 394402 - RNA, 64 nt, Homo Sapiens
cuacuacuacugguauuuagucagcagggauaagggauguuagcuguccugcaaaguuuugguc

SEQ ID NO: 394403 - RNA, 64 nt, Homo Sapiens
aagaggaaggagcaagacucaagacaugauugauggauguuaaagucuagccugaugagagggg

SEQ ID NO: 394404 - RNA, 64 nt, Homo Sapiens
gucccagccacuucugggucccagccagcagcacggauguuacuguccugcuccuucccccagc

SEQ ID NO: 394405 - RNA, 64 nt, Homo Sapiens
gcccacuggguacugugaggacugcuacauugauggauguuauuggcuaauccacugcaugguu

SEQ ID NO: 394406 - RNA, 64 nt, Homo Sapiens
ggguuuugggagaaaggagaugcuaccaagucuuggauguuagggcgagacccugcaaguugag

SEQ ID NO: 394407 - RNA, 64 nt, Homo Sapiens
gaaggcgugcuaggcauucagucagcaauaugaaggauguuauguguuucaagaaauucaccau

SEQ ID NO: 394408 - RNA, 64 nt, Homo Sapiens
uuugagaaaauacagagaaucaaggcuuugauugggauguuauauaaaacauugguuauauuac

SEQ ID NO: 394409 - RNA, 64 nt, Homo Sapiens
uuaaaaacauagauagaaugcaaugcuuugauucggauguuauagaaaucauugguuauauuac

SEQ ID NO: 394410 - RNA, 64 nt, Homo Sapiens
acaccaugcugguuauuuugagcccccacuggggggauguuacaaggucaccauggggaauucu

SEQ ID NO: 394411 - RNA, 64 nt, Homo Sapiens
ugacaaaaggaaggacaaaaacauuuaggcuauaggauguuaaaauugucaguauuauucaaga

SEQ ID NO: 394412 - RNA, 64 nt, Homo Sapiens
ccagaugcagugcuauaagaacagaacgcauuuuggauguuauuauuaagaaccaaaugucaau

SEQ ID NO: 394413 - RNA, 64 nt, Homo Sapiens
acccacucggucccaguuuuguugccccagaaagggauguuauuauccuugggggcucccaggg

SEQ ID NO: 394414 - RNA, 64 nt, Homo Sapiens
uagagaagaaaagggucaaacaucgagauuacauggauguuaaauuauauggagacgcuaagaa

SEQ ID NO: 394415 - RNA, 64 nt, Homo Sapiens
gucgcgcgcgucuauaauuacucugccgucauguggauguuauucaagcugaugggcgucuugg

SEQ ID NO: 394416 - RNA, 64 nt, Homo Sapiens
uuaaagcauauaccauacacacuguuguuuaaagggauguuauuaaugauuauuuuuauuacuu

SEQ ID NO: 394417 - RNA, 64 nt, Homo Sapiens
auaaacauauuguuacugucuuguauucuuggcuggauguuauaaauuaagaguuauuuugugu

SEQ ID NO: 394418 - RNA, 64 nt, Homo Sapiens
cuuggugaaggcaagggguugguucuucaggucaggauguuaauggagcuggaaguucagaaaa

SEQ ID NO: 394419 - RNA, 64 nt, Homo Sapiens
cuugcucugcucuaccauguuuaaagaaauauuuggauguuaaauuaacucacuaugguuuuuc

SEQ ID NO: 394420 - RNA, 64 nt, Homo Sapiens
gagcuucaagaaucgaguuacauaauaggaaaauggauguuauggcauguuuauuuccucugcu

SEQ ID NO: 394421 - RNA, 64 nt, Homo Sapiens
ucauuaaauuugguuuaaugagccuuaagcaaaaggauguuauuaaugaaacagcuuuaaaaau

SEQ ID NO: 394422 - RNA, 64 nt, Homo Sapiens
gagcacuacacaugauccuuuuuuaguacuguauggauguuacuuuucauuuauauuuuucuau

SEQ ID NO: 394423 - RNA, 64 nt, Homo Sapiens
cuccugggaugcccuccuccgcauaggucggguuggauguuagagcguggucacccgucauucu

SEQ ID NO: 394424 - RNA, 64 nt, Homo Sapiens
agcaguagggagguagaauaucuugguggggaggggauguuaucagcuucugggagaugaagaa

SEQ ID NO: 394425 - RNA, 64 nt, Homo Sapiens
ugauucuuggaauuugcuucaaaauaauaagucuggauguuaagugcauuggaaauauugauga

SEQ ID NO: 394426 - RNA, 64 nt, Homo Sapiens
aaacaaaacaauuuuuaaaguaccuuaaaauugaggauguuacucaguguuaacacaugggaac

SEQ ID NO: 394427 - RNA, 64 nt, Homo Sapiens
aucagggcuaguuuaaacaaauguguauaggaaaggauguuauuuauauauucuuacaagagug

SEQ ID NO: 394428 - RNA, 64 nt, Homo Sapiens
auacaagaggugcuuaugcuuagcuugaugaccaggauguuauuuuuaacaaaaugauugcuga

SEQ ID NO: 394429 - RNA, 64 nt, Homo Sapiens
aacugucauuguuguugccccagucuuuguggguggauguuauuuaaguugaaaauuuuagaaa

SEQ ID NO: 394430 - RNA, 64 nt, Homo Sapiens
aaugucuuaguucaaggacagcuuuagaacacaaggauguuagaucagggugcgucuuuuggga

SEQ ID NO: 394431 - RNA, 64 nt, Homo Sapiens
augacgagcaagaguccagguguccagcggaucaggauguuagggagaaaguguguucauguuu

SEQ ID NO: 394432 - RNA, 64 nt, Homo Sapiens
gacuuuguuaaaugguuaucuccuuguauucugaggauguuaaagaagcugcacaguguugguu

SEQ ID NO: 394433 - RNA, 64 nt, Homo Sapiens
aauauacauauacauuuuuguuauuguauauagaggauguuauaauuuucucugucuauacuga

SEQ ID NO: 394434 - RNA, 64 nt, Homo Sapiens
uacuaaacugaaaacauucauguccauuguuugaggauguuaccuuuguaauuuucacaaccgc

SEQ ID NO: 394435 - RNA, 64 nt, Homo Sapiens
cagcauuuaaugaccaccuacuagaaacacuucuguaugucaguugaauauggauugcuguuaa

SEQ ID NO: 394436 - RNA, 64 nt, Homo Sapiens
caguacagacauagcaagcccaucagucaacaguguaugucauguagugauguuauauuggugg

SEQ ID NO: 394437 - RNA, 64 nt, Homo Sapiens
acggauuuguggaauuuucaauaaaaguuuauccguaugucagagguuucucuuugguauguca

SEQ ID NO: 394438 - RNA, 64 nt, Homo Sapiens
aaaaguuuauccguaugucauugguuucucuuugguaugucaauucggcagccuucagugaaua

SEQ ID NO: 394439 - RNA, 64 nt, Homo Sapiens
ccauauauaagaaauuaucgaauuaaaacuuaauguaugucaauuauuuucaaaugucuaaauu

SEQ ID NO: 394440 - RNA, 64 nt, Homo Sapiens
augaauucuaauguacaaguuuguuuuaaaaaguguaugucaagcuuuuauuuacacaauaaaa

SEQ ID NO: 394441 - RNA, 64 nt, Homo Sapiens
uggagauuuguauguguuaucagguucaccugcuugauauuagauacauuaaagcacugaauuu

SEQ ID NO: 394442 - RNA, 64 nt, Homo Sapiens
auuaacuaaauuucccucaucaaagcaaucuuugugauauuacuucgcuauuaaauaaagaaaa

SEQ ID NO: 394443 - RNA, 64 nt, Homo Sapiens
uuaaaguugauaacuguuauuuuuuucuccuuuaugauauuacaggcuaucauuuauuaaugau

SEQ ID NO: 394444 - RNA, 64 nt, Homo Sapiens
cuuuccauauuucccauuaauaaaaaauuuauagugauauuaauccauaaugaaauaggaguua

SEQ ID NO: 394445 - RNA, 64 nt, Homo Sapiens
aguuacuuaauaaagacuuggaguuuuauuuuucugauauuaaaugcuguaaagagaauuauaa

SEQ ID NO: 394446 - RNA, 64 nt, Homo Sapiens
uauuugcuguaaagagaauugauggccaaagcacugauauuauaauaaagggccuuuaacuuaa

SEQ ID NO: 394447 - RNA, 64 nt, Homo Sapiens
aaccuauuaaaaaugauacucggccagcccacaaugauauuacaauuacaggcaugagccacca

SEQ ID NO: 394448 - RNA, 64 nt, Homo Sapiens
uaucacagaaaugaagugaaacuugaauuuaccaugauauuauuaauccaaaauguagaacaag

SEQ ID NO: 394449 - RNA, 64 nt, Homo Sapiens
augagcccucacuagaaggcugaguuugacauguugauauuacguagcuauaguuugcaguuuc

SEQ ID NO: 394450 - RNA, 64 nt, Homo Sapiens
uucuuuuuucuuuuuuuguuuuguuuuuuguuauugauauuaaacaguguaaucuuugcaagcg

SEQ ID NO: 394451 - RNA, 64 nt, Homo Sapiens
ucccugcugagugaacauaucccaaguacugcuacuugggcagcgcugccugcuacuggcuauu

SEQ ID NO: 394452 - RNA, 64 nt, Homo Sapiens
agcauuagguaugcccuuuacagcuggaccugagcuugggcaacagaagguugccugccaccac

SEQ ID NO: 394453 - RNA, 64 nt, Homo Sapiens
aguuguugaaaauagguuauuuugaucuucaugucuugggcaggcacuuaccucagaaaccuga

SEQ ID NO: 394454 - RNA, 64 nt, Homo Sapiens
uaaccauuuacugucuggcugcuguaggacaaaccuugggcauuguaugaaauuaaguacuuga

SEQ ID NO: 394455 - RNA, 64 nt, Homo Sapiens
ugcugugccucacagcgcugugagccagacccuccuugggcagacaggcugacuggcagcacca

SEQ ID NO: 394456 - RNA, 64 nt, Homo Sapiens
gcaccagcuuugggggcagaguccuaggaugaggcuugggcagugcugguaggguuucaaggug

SEQ ID NO: 394457 - RNA, 64 nt, Homo Sapiens
agcugaguuccagggcuguguccugcagugggaccuugggcaacuccuuucccuaugagaagcu

SEQ ID NO: 394458 - RNA, 64 nt, Homo Sapiens
caaucccagaaucugccccucacgaggaugugaccuugggcagaugacuucaccucacucagcc

SEQ ID NO: 394459 - RNA, 64 nt, Homo Sapiens
ccuuguacucagggaauuuugagauaacaagucccuugggcaccuuaagcucaguuuuuucagg

SEQ ID NO: 394460 - RNA, 64 nt, Homo Sapiens
uuugcauuauuucuaaacagaaccuagcacagugcuugggcagccaauaggcauuaaucaguau

SEQ ID NO: 394461 - RNA, 64 nt, Homo Sapiens
agcuuuucuggacagccuggccacuuuguagcaacuugggcacccuccuuggcaagggcaggca

SEQ ID NO: 394462 - RNA, 64 nt, Homo Sapiens
gguuuacagaccagggaccgagggucuggggcagcuugggcacaccugcggaacccggggcucc

SEQ ID NO: 394463 - RNA, 64 nt, Homo Sapiens
ggagagggaaguggcagcauauagccaugucugccuugggcacggugagacagugccgagauag

SEQ ID NO: 394464 - RNA, 64 nt, Homo Sapiens
cugaggccaggacagauguuugagcaaauggugucuugggcaauuuggggcaugguggccuccg

SEQ ID NO: 394465 - RNA, 64 nt, Homo Sapiens
cacgcuucuguccacuucugcugucuguggcccacuugggcaccugggguguggggguuggaag

SEQ ID NO: 394466 - RNA, 64 nt, Homo Sapiens
ggugggccugggcuucugagagcccugacaugugcuugggcacuuugguugaggccuuguucug

SEQ ID NO: 394467 - RNA, 64 nt, Homo Sapiens
gagucacuaauguuucaaucucuauuucuguaaucuugggcaauaaugcauaggaguucuugau

SEQ ID NO: 394468 - RNA, 64 nt, Homo Sapiens
ugauuucuagcuuuauuacuauuagguaugugagcuugggcaaaucgcuuaaucuuugagucua

SEQ ID NO: 394469 - RNA, 64 nt, Homo Sapiens
cccaaagauggaaagugcuuuuuaugguaaacaucuugggcaaauccuuuccccaccccuuuca

SEQ ID NO: 394470 - RNA, 64 nt, Homo Sapiens
guuaaacacuguggccuaugugaagaaucacaggcuugggcagugauaugcaugauucagggaa

SEQ ID NO: 394471 - RNA, 64 nt, Homo Sapiens
uuggaggauuuaguuuugggauaaaauuuugguccuugggcacagagacauucacuauuaauga

SEQ ID NO: 394472 - RNA, 64 nt, Homo Sapiens
gggcacagagacauucacuauuaaugaaguaacccuugggcaugacuccaaucccagaauugcu

SEQ ID NO: 394473 - RNA, 64 nt, Homo Sapiens
gcaauauggacucagcucuggcucucugugugaccuugggcagcuccgugccucucucuguacu

SEQ ID NO: 394474 - RNA, 64 nt, Homo Sapiens
ugcauuucaaagaaccacugagugggugagcuaccuugggcaaaccccccacuccugacucuga

SEQ ID NO: 394475 - RNA, 64 nt, Homo Sapiens
gaggagaggggcccauucaccucaguccuguccccuugggcacucaugggccagguggggcugc

SEQ ID NO: 394476 - RNA, 64 nt, Homo Sapiens
cugguucucccggaggaccucugcagcuccuccccuugggcagcugcggucccagcgggugcgu

SEQ ID NO: 394477 - RNA, 64 nt, Homo Sapiens
uggggaacagauggagggggcaguggggacagggcuugggcagacaccagcaggaauaauuuga

SEQ ID NO: 394478 - RNA, 64 nt, Homo Sapiens
aaaugugugaggugacuccccggagggccuugggcuugggcauuugggaaaagaaugaugucug

SEQ ID NO: 394479 - RNA, 64 nt, Homo Sapiens
ucaggagagaccuggacagggguggugggaagagcuugggcagaaguggcugaaaaacuaaggc

SEQ ID NO: 394480 - RNA, 64 nt, Homo Sapiens
auauagucagagaacccagcaauacagauccguccuugggcaaggcgcggugcuggaugauggg

SEQ ID NO: 394481 - RNA, 64 nt, Homo Sapiens
ucccagcucugccaguuaugcccagcuguggggacuugggcagcucguuuaguagcaccgugcc

SEQ ID NO: 394482 - RNA, 64 nt, Homo Sapiens
gggucagggcucugcugcucgguggcugugcaaccuugggcaaguuccucaaccucucuguguc

SEQ ID NO: 394483 - RNA, 64 nt, Homo Sapiens
cuuguuuacaagaugacgacaguccaagggcagccuugggcaccugccaugucccuccuuuccc

SEQ ID NO: 394484 - RNA, 64 nt, Homo Sapiens
ggggcccauuuccagcuuggccgccgucugugaccuugggcaagucacuugaccucugugugcc

SEQ ID NO: 394485 - RNA, 64 nt, Homo Sapiens
guggggcacggugggggcgggcagcucccaggcccuugggcaggcuggggugacggcagaggcc

SEQ ID NO: 394486 - RNA, 64 nt, Homo Sapiens
ccuucaguuucaguuucucauccaggaagguaaccuugggcauuggcaguggguuucccuaugg

SEQ ID NO: 394487 - RNA, 64 nt, Homo Sapiens
aggaacccccaggacccagucgcugcuguggucccuugggcaggagcgggcacccugugccuug

SEQ ID NO: 394488 - RNA, 64 nt, Homo Sapiens
ccgcucccaugccccagcugugccaucccaaauacuugggcagcagcucagcaugggcagacau

SEQ ID NO: 394489 - RNA, 64 nt, Homo Sapiens
aguccagaagcaucaggggcgcugauuccauguucuugggcaacgcuguauuuggagaucaugg

SEQ ID NO: 394490 - RNA, 64 nt, Homo Sapiens
ccuucugccccccccacugacagagaggggcaggcuugggcaccaaagccauauuuuugggagg

SEQ ID NO: 394491 - RNA, 64 nt, Homo Sapiens
cagcugcaguguuucuguccggaggaaauggaucuuaggccacuggacaagaaccugcacccaa

SEQ ID NO: 394492 - RNA, 64 nt, Homo Sapiens
gcugccacaaucagcaugguuguauagugccccauuaggccauuuacauacccagaguuauacu

SEQ ID NO: 394493 - RNA, 64 nt, Homo Sapiens; identical to SEQ ID NO: 376786

SEQ ID NO: 394494 - RNA, 64 nt, Homo Sapiens; identical to SEQ ID NO: 376787

SEQ ID NO: 394495 - RNA, 64 nt, Homo Sapiens; identical to SEQ ID NO: 376788

SEQ ID NO: 394496 - RNA, 64 nt, Homo Sapiens; identical to SEQ ID NO: 376789

SEQ ID NO: 394497 - RNA, 64 nt, Homo Sapiens; identical to SEQ ID NO: 376790

SEQ ID NO: 394498 - RNA, 64 nt, Homo Sapiens; identical to SEQ ID NO: 376791

SEQ ID NO: 394499 - RNA, 64 nt, Homo Sapiens; identical to SEQ ID NO: 376792

SEQ ID NO: 394500 - RNA, 64 nt, Homo Sapiens; identical to SEQ ID NO: 376793

SEQ ID NO: 394501 - RNA, 64 nt, Homo Sapiens; identical to SEQ ID NO: 376794

SEQ ID NO: 394502 - RNA, 64 nt, Homo Sapiens; identical to SEQ ID NO: 376795

SEQ ID NO: 394503 - RNA, 64 nt, Homo Sapiens; identical to SEQ ID NO: 376796

SEQ ID NO: 394504 - RNA, 64 nt, Homo Sapiens; identical to SEQ ID NO: 376797

SEQ ID NO: 394505 - RNA, 64 nt, Homo Sapiens; identical to SEQ ID NO: 376798

SEQ ID NO: 394506 - RNA, 64 nt, Homo Sapiens; identical to SEQ ID NO: 376799

SEQ ID NO: 394507 - RNA, 64 nt, Homo Sapiens; identical to SEQ ID NO: 376800

SEQ ID NO: 394508 - RNA, 64 nt, Homo Sapiens; identical to SEQ ID NO: 376801

SEQ ID NO: 394509 - RNA, 64 nt, Homo Sapiens; identical to SEQ ID NO: 376802

SEQ ID NO: 394510 - RNA, 64 nt, Homo Sapiens; identical to SEQ ID NO: 376803

SEQ ID NO: 394511 - RNA, 64 nt, Homo Sapiens; identical to SEQ ID NO: 376804

SEQ ID NO: 394512 - RNA, 64 nt, Homo Sapiens; identical to SEQ ID NO: 376805

SEQ ID NO: 394513 - RNA, 64 nt, Homo Sapiens; identical to SEQ ID NO: 376806

SEQ ID NO: 394514 - RNA, 64 nt, Homo Sapiens; identical to SEQ ID NO: 376807

SEQ ID NO: 394515 - RNA, 64 nt, Homo Sapiens; identical to SEQ ID NO: 376808

SEQ ID NO: 394516 - RNA, 64 nt, Homo Sapiens; identical to SEQ ID NO: 376809

SEQ ID NO: 394517 - RNA, 64 nt, Homo Sapiens; identical to SEQ ID NO: 376810

SEQ ID NO: 394518 - RNA, 64 nt, Homo Sapiens; identical to SEQ ID NO: 376811

SEQ ID NO: 394519 - RNA, 64 nt, Homo Sapiens; identical to SEQ ID NO: 376812

SEQ ID NO: 394520 - RNA, 64 nt, Homo Sapiens; identical to SEQ ID NO: 376813

SEQ ID NO: 394521 - RNA, 64 nt, Homo Sapiens; identical to SEQ ID NO: 376814

SEQ ID NO: 394522 - RNA, 64 nt, Homo Sapiens; identical to SEQ ID NO: 376815

SEQ ID NO: 394523 - RNA, 64 nt, Homo Sapiens; identical to SEQ ID NO: 376816

SEQ ID NO: 394524 - RNA, 64 nt, Homo Sapiens; identical to SEQ ID NO: 376817

SEQ ID NO: 394525 - RNA, 64 nt, Homo Sapiens; identical to SEQ ID NO: 376818

SEQ ID NO: 394526 - RNA, 64 nt, Homo Sapiens; identical to SEQ ID NO: 376819

SEQ ID NO: 394527 - RNA, 64 nt, Homo Sapiens; identical to SEQ ID NO: 376820

SEQ ID NO: 394528 - RNA, 64 nt, Homo Sapiens; identical to SEQ ID NO: 376821

SEQ ID NO: 394529 - RNA, 64 nt, Homo Sapiens; identical to SEQ ID NO: 376822

SEQ ID NO: 394530 - RNA, 64 nt, Homo Sapiens; identical to SEQ ID NO: 376823

SEQ ID NO: 394531 - RNA, 64 nt, Homo Sapiens; identical to SEQ ID NO: 376824

SEQ ID NO: 394532 - RNA, 64 nt, Homo Sapiens; identical to SEQ ID NO: 376825

SEQ ID NO: 394533 - RNA, 64 nt, Homo Sapiens; identical to SEQ ID NO: 376826

SEQ ID NO: 394534 - RNA, 64 nt, Homo Sapiens; identical to SEQ ID NO: 376827

SEQ ID NO: 394535 - RNA, 64 nt, Homo Sapiens; identical to SEQ ID NO: 376828

SEQ ID NO: 394536 - RNA, 64 nt, Homo Sapiens; identical to SEQ ID NO: 376829

SEQ ID NO: 394537 - RNA, 64 nt, Homo Sapiens; identical to SEQ ID NO: 376830

SEQ ID NO: 394538 - RNA, 64 nt, Homo Sapiens; identical to SEQ ID NO: 376831

SEQ ID NO: 394539 - RNA, 64 nt, Homo Sapiens; identical to SEQ ID NO: 376832

SEQ ID NO: 394540 - RNA, 64 nt, Homo Sapiens; identical to SEQ ID NO: 376833

SEQ ID NO: 394541 - RNA, 64 nt, Homo Sapiens; identical to SEQ ID NO: 376834

SEQ ID NO: 394542 - RNA, 64 nt, Homo Sapiens; identical to SEQ ID NO: 376835

SEQ ID NO: 394543 - RNA, 64 nt, Homo Sapiens; identical to SEQ ID NO: 376836

SEQ ID NO: 394544 - RNA, 64 nt, Homo Sapiens
ccauuucucuguguaauacaggcuuuagauuagugccuuauauugguuuugguuuggggcacug

SEQ ID NO: 394545 - RNA, 64 nt, Homo Sapiens
guggaaacauuuugcagaacuguuguagaaagcugccuuauaguuggcuugacaaagcauaauu

SEQ ID NO: 394546 - RNA, 64 nt, Homo Sapiens
ugaaagugccauugcaaucgcuaaaauauuaauugccuuauauuaaaguaaaaguugcugcuuu

SEQ ID NO: 394547 - RNA, 64 nt, Homo Sapiens
uaaaauaaguugccagaucuucuuggucacagaugccuuauauauacauuuaauucauaacguc

SEQ ID NO: 394548 - RNA, 64 nt, Homo Sapiens
caaauguagagaauugauguaaaaguugccaucugccuuauagacauauuuuagaucuuguaua

SEQ ID NO: 394549 - RNA, 64 nt, Homo Sapiens
caaaauuguacccuguugcuccuauaguucuauugccuuauaugagcauuugaacuuguuccuc

SEQ ID NO: 394550 - RNA, 64 nt, Homo Sapiens
auuauguuguagaaaaaaaaccaauuaaauuuaugccuuauaaauccaaagguuagggaagauu

SEQ ID NO: 394551 - RNA, 64 nt, Homo Sapiens
accaucaaaggaauuucaggaaaucugugcagcugccuuauagucaggaaacauggcuccuuau

SEQ ID NO: 394552 - RNA, 64 nt, Homo Sapiens
cuguggucauuauuuuuucugaaucugagcaggagccuuauaaccauacuuggccucucccuga

SEQ ID NO: 394553 - RNA, 64 nt, Homo Sapiens
ugaggccccuguggcuccuggucaggcugcccguuguggggaggggcaguguuagagcagggcu

SEQ ID NO: 394554 - RNA, 64 nt, Homo Sapiens
guagauaugacuacugaccuaccucgcagggggcuguggggaggcauaagcugauguuuguaaa

SEQ ID NO: 394555 - RNA, 64 nt, Homo Sapiens
acucagaggcaaagaggagcuggaagagggaacauguggggacuggccuggcaguugaaaucuc

SEQ ID NO: 394556 - RNA, 64 nt, Homo Sapiens
gagugccuccuuaguggugcaccccuuggguugguguggggaaggggccgagugaucugggggu

SEQ ID NO: 394557 - RNA, 64 nt, Homo Sapiens
gugguucugcuuauucuucaaguuuaucugaaucuguggggagugcaugauccccauguugcaa

SEQ ID NO: 394558 - RNA, 64 nt, Homo Sapiens
aaauguuguuuguacaugugugucuguaugucucuguggggagguuuuauggcuuuugucagau

SEQ ID NO: 394559 - RNA, 64 nt, Homo Sapiens
ccuugccaaccagaagcccaaaggggagggaggguguggggaugucuuauuccccguggacaug

SEQ ID NO: 394560 - RNA, 64 nt, Homo Sapiens
ucggugugaagggaagggacccagcaggccugucuguggggacacuuccaugcuggccccuggc

SEQ ID NO: 394561 - RNA, 64 nt, Homo Sapiens
ugggggcaggaugggguuuggauucggcaguuuguguggggaggagaaugccaguguuguuuaa

SEQ ID NO: 394562 - RNA, 64 nt, Homo Sapiens
gcccugucccauccugaauauguugucacgugucuguggggaggcaggaaaugcauguuugauc

SEQ ID NO: 394563 - RNA, 64 nt, Homo Sapiens
agggacacugaggagagguggcccugauccggucuguggggacgcaggcacagaggcucgccag

SEQ ID NO: 394564 - RNA, 64 nt, Homo Sapiens
ccggucacauggacacaccugcgccuggcacauguguggggaagccaccuggcgggggugcugg

SEQ ID NO: 394565 - RNA, 64 nt, Homo Sapiens
ccggaaacaccuggcccaugacgcgugcugcagauguggggagcagucuggaaacacccggccc

SEQ ID NO: 394566 - RNA, 64 nt, Homo Sapiens
cuggaaacacccggcccacgacgcgugcugcagauguggggaguagccuggaaacacccggccc

SEQ ID NO: 394567 - RNA, 64 nt, Homo Sapiens
cuggaaacacccggcccacgacgcgugcugcagauguggggagcagccuggaaacacccggccc

SEQ ID NO: 394568 - RNA, 64 nt, Homo Sapiens; identical to SEQ ID NO: 394567

SEQ ID NO: 394569 - RNA, 64 nt, Homo Sapiens
aaugauuuuugcccugcagggaguccauucauaguguggggaagccugcuuauuaugauacuug

SEQ ID NO: 394570 - RNA, 64 nt, Homo Sapiens
ucaaaugcuaccugacucaccucaguuguguauauguggggaaaggaugccaauggcagggcac

SEQ ID NO: 394571 - RNA, 64 nt, Homo Sapiens
uuugggaccccacacacuccaccucuguggggacuguggggacuggagagagagagauccugau

SEQ ID NO: 394572 - RNA, 64 nt, Homo Sapiens
guggggacuuuugggaccccgauccugauaccucuguggggacugagccagcuggagagagaga

SEQ ID NO: 394573 - RNA, 64 nt, Homo Sapiens
acugccaaguauacacaacuucccaguaaaugguuguggggaggaaagagguggagccucccca

SEQ ID NO: 394574 - RNA, 64 nt, Homo Sapiens
ggagaaucagccuugccuggccuuuaggaacuuuuguggggaagagagcuuugaagagaggagg

SEQ ID NO: 394575 - RNA, 64 nt, Homo Sapiens
agccaccuccaacucuggagccuaccaagagaacuguggggaugugggauguggcgggacaggg

SEQ ID NO: 394576 - RNA, 64 nt, Homo Sapiens
ucagcugccauguugauccacaaaggugggaggauguggggaagggggaaagcggugaggacgc

SEQ ID NO: 394577 - RNA, 64 nt, Homo Sapiens
ccuggguguguacggagggucuagucugagugcguguggggaccucagaacacugugaccuuag

SEQ ID NO: 394578 - RNA, 64 nt, Homo Sapiens
aggauauccagcuuccccggucuggggugaggaauguggggagcuugggcauccuccuccagcc

SEQ ID NO: 394579 - RNA, 64 nt, Homo Sapiens
agccugccugccugccugccugcccgcccagagcuguggggaugaguguccccaccccagggcc

SEQ ID NO: 394580 - RNA, 64 nt, Homo Sapiens
ucuucccaggccucagguguugucuuuugugcuguguggggaugcauugcugccuguauuuaug

SEQ ID NO: 394581 - RNA, 64 nt, Homo Sapiens
cuguucccuggaaccacucccccccucccagcccuguggggaaaaccccaccucugcauggcca

SEQ ID NO: 394582 - RNA, 64 nt, Homo Sapiens
gaagcccagguccuggcugcuggucgagggagucuguggggaagucucaugacaugaaauugca

SEQ ID NO: 394583 - RNA, 64 nt, Homo Sapiens
auggacaaggacuuaggaaaagaaauucugcauguguggggagaagccccagaguauauugaau

SEQ ID NO: 394584 - RNA, 64 nt, Homo Sapiens
cuguggagcucugcccagauagggagaaucugcauguggggacacuuuugugaucacacaccac

SEQ ID NO: 394585 - RNA, 64 nt, Homo Sapiens
ugggcugcggucacugucgggcucugauuaaggauguggggaagguggggaugaacugcaugag

SEQ ID NO: 394586 - RNA, 64 nt, Homo Sapiens
aacugcaugaggcucugauuuuauguuuggguaauguggggaugcuacguguagcacuacgacg

SEQ ID NO: 394587 - RNA, 64 nt, Homo Sapiens
gaacugcccaguccucccugggggcagguagaccuguggggauggcucgguccaagcccaacac

SEQ ID NO: 394588 - RNA, 64 nt, Homo Sapiens
agcacaaacuugcccuaacccacaugggccuggcuguggggaaaguggggacccaggucccuga

SEQ ID NO: 394589 - RNA, 64 nt, Homo Sapiens
gcuguggucugacggaaugggcaacuuucgccccuguggggaggggacggggaaggaagaaaga

SEQ ID NO: 394590 - RNA, 64 nt, Homo Sapiens
gaacacuugagugguuagagcuguagauagacauuguggggaagugugccaggguggcuuccag

SEQ ID NO: 394591 - RNA, 64 nt, Homo Sapiens
ugaaguucuacuccucuuggugaagccucugggagucugggaaggagcuggaaaggcaaggagc

SEQ ID NO: 394592 - RNA, 64 nt, Homo Sapiens
gggauuuacguuauagcaauaccugcagcugucugucugggacuuccagcugggaacucuuuua

SEQ ID NO: 394593 - RNA, 64 nt, Homo Sapiens
gccaagagugcagccucugcccggccgccaccccgucugggaagugaggagcgucucugccugg

SEQ ID NO: 394594 - RNA, 64 nt, Homo Sapiens
ggaagugaggagcgucucugccuggcugcccauugucugggacgugagcagccccucugccugg

SEQ ID NO: 394595 - RNA, 64 nt, Homo Sapiens
gaagugaggagccccucugcccagcagccacccugucugggaagugaggagcgucuccgcccgg

SEQ ID NO: 394596 - RNA, 64 nt, Homo Sapiens
gaagugaggagccccucugcccggccaccaccccgucugggagguguacccaacagcucauuga

SEQ ID NO: 394597 - RNA, 64 nt, Homo Sapiens
cccucccuacuuugagaaucucucauaccuugcagucugggacagucuugugucuggagaauag

SEQ ID NO: 394598 - RNA, 64 nt, Homo Sapiens
guccagaaauaaccagugaggguccaguuggacagucugggaauuaaagcugcuuucuucugaa

SEQ ID NO: 394599 - RNA, 64 nt, Homo Sapiens
ccaaguccgggcuggagccgaggccggagcagcugucugggagucaaggcugcaguagcguuuc

SEQ ID NO: 394600 - RNA, 64 nt, Homo Sapiens
uuccucugugaaccccuccuuucuuugugcuggugucugggaccaaaaagggggaauaugggag

SEQ ID NO: 394601 - RNA, 64 nt, Homo Sapiens
ucgagagaggaggaggaccccuccagaagcccucgucugggaaucagugcagagguucucugcc

SEQ ID NO: 394602 - RNA, 64 nt, Homo Sapiens
acaguucuccagcuucuacgagggcauccucucagucugggacaaaaggagcuggggcuugugg

SEQ ID NO: 394603 - RNA, 64 nt, Homo Sapiens
ugagauguggggagcgccucugccccgccgccccgucugggaugugaggagcuccucugcccgg

SEQ ID NO: 394604 - RNA, 64 nt, Homo Sapiens
gaugugaggagcuccucugcccggccgcgaccccgucugggaggugaggagcgucucugucugg

SEQ ID NO: 394605 - RNA, 64 nt, Homo Sapiens
gggaggagcaacggccccaguuccgggacaaguggucugggacagaaucgauucccaagcuccc

SEQ ID NO: 394606 - RNA, 64 nt, Homo Sapiens
uauucaagugaauggggaaggcaaagccagugcugucugggaugcucuuaguuaugugacgacu

SEQ ID NO: 394607 - RNA, 64 nt, Homo Sapiens
cuucgcucagcuucuccgcgccccugcucccugcgucugggagagcgaggccgagcaaggaaag

SEQ ID NO: 394608 - RNA, 64 nt, Homo Sapiens
gaggcagaaaaagaccaguuaggcggugcagacggucugggacguggcagacggacggacccuc

SEQ ID NO: 394609 - RNA, 64 nt, Homo Sapiens
ggcacagugggagcugccacgaccugcugacccagucugggacaugcagugugcuguccagaga

SEQ ID NO: 394610 - RNA, 64 nt, Homo Sapiens
accugucuguuguagaaaacccuguaccccaacggucugggagccugugguguagacggccugg

SEQ ID NO: 394611 - RNA, 64 nt, Homo Sapiens; identical to SEQ ID NO: 141970

SEQ ID NO: 394612 - RNA, 64 nt, Homo Sapiens; identical to SEQ ID NO: 141971

SEQ ID NO: 394613 - RNA, 64 nt, Homo Sapiens; identical to SEQ ID NO: 141972

SEQ ID NO: 394614 - RNA, 64 nt, Homo Sapiens; identical to SEQ ID NO: 141973

SEQ ID NO: 394615 - RNA, 64 nt, Homo Sapiens; identical to SEQ ID NO: 141974

SEQ ID NO: 394616 - RNA, 64 nt, Homo Sapiens; identical to SEQ ID NO: 141975

SEQ ID NO: 394617 - RNA, 64 nt, Homo Sapiens; identical to SEQ ID NO: 141976

SEQ ID NO: 394618 - RNA, 64 nt, Homo Sapiens; identical to SEQ ID NO: 141977

SEQ ID NO: 394619 - RNA, 64 nt, Homo Sapiens; identical to SEQ ID NO: 141978

SEQ ID NO: 394620 - RNA, 64 nt, Homo Sapiens; identical to SEQ ID NO: 141979

SEQ ID NO: 394621 - RNA, 64 nt, Homo Sapiens; identical to SEQ ID NO: 141980

SEQ ID NO: 394622 - RNA, 64 nt, Homo Sapiens; identical to SEQ ID NO: 141981

SEQ ID NO: 394623 - RNA, 64 nt, Homo Sapiens; identical to SEQ ID NO: 141982

SEQ ID NO: 394624 - RNA, 64 nt, Homo Sapiens; identical to SEQ ID NO: 141983

SEQ ID NO: 394625 - RNA, 64 nt, Homo Sapiens; identical to SEQ ID NO: 141984

SEQ ID NO: 394626 - RNA, 64 nt, Homo Sapiens; identical to SEQ ID NO: 141985

SEQ ID NO: 394627 - RNA, 64 nt, Homo Sapiens; identical to SEQ ID NO: 141986

SEQ ID NO: 394628 - RNA, 64 nt, Homo Sapiens; identical to SEQ ID NO: 141987

SEQ ID NO: 394629 - RNA, 64 nt, Homo Sapiens; identical to SEQ ID NO: 141988

SEQ ID NO: 394630 - RNA, 64 nt, Homo Sapiens; identical to SEQ ID NO: 141989

SEQ ID NO: 394631 - RNA, 64 nt, Homo Sapiens; identical to SEQ ID NO: 141990

SEQ ID NO: 394632 - RNA, 64 nt, Homo Sapiens; identical to SEQ ID NO: 141991

SEQ ID NO: 394633 - RNA, 64 nt, Homo Sapiens; identical to SEQ ID NO: 141992

SEQ ID NO: 394634 - RNA, 64 nt, Homo Sapiens; identical to SEQ ID NO: 141993

SEQ ID NO: 394635 - RNA, 64 nt, Homo Sapiens; identical to SEQ ID NO: 141994

SEQ ID NO: 394636 - RNA, 64 nt, Homo Sapiens; identical to SEQ ID NO: 141995

SEQ ID NO: 394637 - RNA, 64 nt, Homo Sapiens; identical to SEQ ID NO: 141996

SEQ ID NO: 394638 - RNA, 64 nt, Homo Sapiens; identical to SEQ ID NO: 141997

SEQ ID NO: 394639 - RNA, 64 nt, Homo Sapiens; identical to SEQ ID NO: 141998

SEQ ID NO: 394640 - RNA, 64 nt, Homo Sapiens; identical to SEQ ID NO: 141999

SEQ ID NO: 394641 - RNA, 64 nt, Homo Sapiens; identical to SEQ ID NO: 142000

SEQ ID NO: 394642 - RNA, 64 nt, Homo Sapiens; identical to SEQ ID NO: 142001

SEQ ID NO: 394643 - RNA, 64 nt, Homo Sapiens; identical to SEQ ID NO: 142002

SEQ ID NO: 394644 - RNA, 64 nt, Homo Sapiens; identical to SEQ ID NO: 142003

SEQ ID NO: 394645 - RNA, 64 nt, Homo Sapiens; identical to SEQ ID NO: 142004

SEQ ID NO: 394646 - RNA, 64 nt, Homo Sapiens; identical to SEQ ID NO: 142005

SEQ ID NO: 394647 - RNA, 64 nt, Homo Sapiens; identical to SEQ ID NO: 142006

SEQ ID NO: 394648 - RNA, 64 nt, Homo Sapiens; identical to SEQ ID NO: 142007

SEQ ID NO: 394649 - RNA, 64 nt, Homo Sapiens; identical to SEQ ID NO: 142008

SEQ ID NO: 394650 - RNA, 64 nt, Homo Sapiens; identical to SEQ ID NO: 142009

SEQ ID NO: 394651 - RNA, 64 nt, Homo Sapiens; identical to SEQ ID NO: 142010

SEQ ID NO: 394652 - RNA, 64 nt, Homo Sapiens; identical to SEQ ID NO: 142011

SEQ ID NO: 394653 - RNA, 64 nt, Homo Sapiens; identical to SEQ ID NO: 142012

SEQ ID NO: 394654 - RNA, 64 nt, Homo Sapiens; identical to SEQ ID NO: 142013

SEQ ID NO: 394655 - RNA, 64 nt, Homo Sapiens; identical to SEQ ID NO: 142014

SEQ ID NO: 394656 - RNA, 64 nt, Homo Sapiens; identical to SEQ ID NO: 142015

SEQ ID NO: 394657 - RNA, 64 nt, Homo Sapiens; identical to SEQ ID NO: 142016

SEQ ID NO: 394658 - RNA, 64 nt, Homo Sapiens; identical to SEQ ID NO: 142017

SEQ ID NO: 394659 - RNA, 64 nt, Homo Sapiens; identical to SEQ ID NO: 142018

SEQ ID NO: 394660 - RNA, 64 nt, Homo Sapiens; identical to SEQ ID NO: 142019

SEQ ID NO: 394661 - RNA, 64 nt, Homo Sapiens; identical to SEQ ID NO: 142020

SEQ ID NO: 394662 - RNA, 64 nt, Homo Sapiens; identical to SEQ ID NO: 142021

SEQ ID NO: 394663 - RNA, 64 nt, Homo Sapiens; identical to SEQ ID NO: 142022

SEQ ID NO: 394664 - RNA, 64 nt, Homo Sapiens; identical to SEQ ID NO: 142023

SEQ ID NO: 394665 - RNA, 64 nt, Homo Sapiens; identical to SEQ ID NO: 142024

SEQ ID NO: 394666 - RNA, 64 nt, Homo Sapiens; identical to SEQ ID NO: 142025

SEQ ID NO: 394667 - RNA, 64 nt, Homo Sapiens; identical to SEQ ID NO: 142026

SEQ ID NO: 394668 - RNA, 64 nt, Homo Sapiens; identical to SEQ ID NO: 142027

SEQ ID NO: 394669 - RNA, 64 nt, Homo Sapiens; identical to SEQ ID NO: 142028

SEQ ID NO: 394670 - RNA, 64 nt, Homo Sapiens; identical to SEQ ID NO: 142029

SEQ ID NO: 394671 - RNA, 64 nt, Homo Sapiens; identical to SEQ ID NO: 142030

SEQ ID NO: 394672 - RNA, 64 nt, Homo Sapiens; identical to SEQ ID NO: 142031

SEQ ID NO: 394673 - RNA, 64 nt, Homo Sapiens; identical to SEQ ID NO: 142032

SEQ ID NO: 394674 - RNA, 64 nt, Homo Sapiens; identical to SEQ ID NO: 142033

SEQ ID NO: 394675 - RNA, 64 nt, Homo Sapiens; identical to SEQ ID NO: 142034

SEQ ID NO: 394676 - RNA, 64 nt, Homo Sapiens; identical to SEQ ID NO: 142035

SEQ ID NO: 394677 - RNA, 64 nt, Homo Sapiens; identical to SEQ ID NO: 142036

SEQ ID NO: 394678 - RNA, 64 nt, Homo Sapiens; identical to SEQ ID NO: 142037

SEQ ID NO: 394679 - RNA, 64 nt, Homo Sapiens; identical to SEQ ID NO: 142038

SEQ ID NO: 394680 - RNA, 64 nt, Homo Sapiens; identical to SEQ ID NO: 142039

SEQ ID NO: 394681 - RNA, 64 nt, Homo Sapiens; identical to SEQ ID NO: 142040

SEQ ID NO: 394682 - RNA, 64 nt, Homo Sapiens; identical to SEQ ID NO: 142041

SEQ ID NO: 394683 - RNA, 64 nt, Homo Sapiens; identical to SEQ ID NO: 142042

SEQ ID NO: 394684 - RNA, 64 nt, Homo Sapiens; identical to SEQ ID NO: 142043

SEQ ID NO: 394685 - RNA, 64 nt, Homo Sapiens; identical to SEQ ID NO: 142044

SEQ ID NO: 394686 - RNA, 64 nt, Homo Sapiens
gaugauuguuugcuagauuuuccuuugugaaguacuauguaacauuauaagucuuagcauuauu

SEQ ID NO: 394687 - RNA, 64 nt, Homo Sapiens
cugaaauauuuuguacuucauuucuuguuuaucacuauguaaauuaaguccuccugauaagugc

SEQ ID NO: 394688 - RNA, 64 nt, Homo Sapiens
cuuuggaguugcauagcagcuucacuauacguaacuauguaacuccaccuauuuguguugucca

SEQ ID NO: 394689 - RNA, 64 nt, Homo Sapiens
ggcucacaagucaauugcaagucuguacuauccacuauguaaauugugaucugaccugugacaa

SEQ ID NO: 394690 - RNA, 64 nt, Homo Sapiens
uaagaucauaauauguggaaaauugagaucagcccuauguaaguauguuugauauuccaugaau

SEQ ID NO: 394691 - RNA, 64 nt, Homo Sapiens
uuuuuaauuaaaguuauuucgauauuauaaucuucuauguaagucucaaaucuuugucacgucu

SEQ ID NO: 394692 - RNA, 64 nt, Homo Sapiens
guaggaaagaugggaggaaaacagguuaagaaaacuauguaaauaaaaaaauaggugacaggga

SEQ ID NO: 394693 - RNA, 64 nt, Homo Sapiens
cagcuauugguguaccuauaauuuaagaaauagucuauguaaagucacaaauuaaugaaaaaaa

SEQ ID NO: 394694 - RNA, 64 nt, Homo Sapiens
uugcaauguaaaauaaaguguuucugauuauuuucuauguaaaggaacccucuccuuuccccuu

SEQ ID NO: 394695 - RNA, 64 nt, Homo Sapiens
agcuagaaacuaaaguacaauuuauuugcauuuccuauguaaugagugguaucucauuguguuu

SEQ ID NO: 394696 - RNA, 64 nt, Homo Sapiens
uauauuuuuuaaugguuggaugauuauauacgagcuauguaacuuagugcaguaauaaguaagu

SEQ ID NO: 394697 - RNA, 64 nt, Homo Sapiens
aucggaggcauauacgugguaaaacccaaacacccuauguaacuucaaagugaaaaccaaacca

SEQ ID NO: 394698 - RNA, 64 nt, Homo Sapiens
uuaagugguaaugucauaguaaauuuugaccugccuauguaagaggcaaaaguaauuuauauua

SEQ ID NO: 394699 - RNA, 64 nt, Homo Sapiens
aucacuaugauuucugaauuagacaaggaaacuucuauguaaaaaggugccugaacuaguucac

SEQ ID NO: 394700 - RNA, 64 nt, Homo Sapiens
uauauuccauuuacauaagguuuuuuuuuuacaacuauguaauugucaucucaaacucuuaguu

SEQ ID NO: 394701 - RNA, 64 nt, Homo Sapiens
uggugguuauuagggcuuuuucugaaauguguaucuauguaacaucacuuaagugugcuuaaua

SEQ ID NO: 394702 - RNA, 64 nt, Homo Sapiens
ugauaaggcuacaauucagaaucuucugaaccaucuauguaaugaauggggauuauacauugga

SEQ ID NO: 394703 - RNA, 64 nt, Homo Sapiens
auguucugccuuaucggggcauguauaauuuucuacaaccuaagauauucccaguaaagauacc

SEQ ID NO: 394704 - RNA, 64 nt, Homo Sapiens
gaaugggaaaacauauuugcagaaagugaaaaaaacaaccuacaacuaaauuuaugauuauuca

SEQ ID NO: 394705 - RNA, 63 nt, Homo Sapiens
guuguauacauuucuuauuuacgauuuucauuuguuauauauauauauaaauauacuguauau

SEQ ID NO: 394706 - RNA, 63 nt, Homo Sapiens
agaucuggauugauaauagauauauaugugucuguuauauauuuuagaguucauuccauuggg

SEQ ID NO: 394707 - RNA, 63 nt, Homo Sapiens
gcaguaguaaucuuaugcacacggugauuucauguuauauaugcaaaguaggcaacuguuuuc

SEQ ID NO: 394708 - RNA, 63 nt, Homo Sapiens
aaguuauuguaauaaauauuaccuguauuuuuuguuauauacaacuuuauacuuugaagcuug

SEQ ID NO: 394709 - RNA, 63 nt, Homo Sapiens
ccuaaugcaaagcucuuuaccucuugcuauuuuguuauauauauuacagaugaaaucucacug

SEQ ID NO: 394710 - RNA, 63 nt, Homo Sapiens
uguuugucuauauuauauaaauauauauauacaguuauauauauauauauuauuuuuugguuc

SEQ ID NO: 394711 - RNA, 63 nt, Homo Sapiens
guugggauuuuuuaccaaagcagcauaauauguguuauauaaacauaauaauacucagauauc

SEQ ID NO: 394712 - RNA, 63 nt, Homo Sapiens
auuacaagauauuagcuaauugugccaggggcuguuauauacauauauacacaaccaaggugu

SEQ ID NO: 394713 - RNA, 63 nt, Homo Sapiens
gauccaaaaauaagugauaaugaaaaccacugaguuauauacuuugcaaggguaaauuacauc

SEQ ID NO: 394714 - RNA, 63 nt, Homo Sapiens
gcuaaauuauaauauuuuuguugguaaaguugaguuauauacuuguacauacaauggaaaugc

SEQ ID NO: 394715 - RNA, 63 nt, Homo Sapiens
uucuuagagcauccccaaucaauaguuucagaaguuauauaugcauguguaugugcauguaug

SEQ ID NO: 394716 - RNA, 63 nt, Homo Sapiens
augugcauguaugguguauacaaacauauuuuuguuauauacaauauugcugaugaacugaaa

SEQ ID NO: 394717 - RNA, 63 nt, Homo Sapiens
ccaaagaggcuuacggguucgaauuuuuucauuguuauauauaucuagauuucauggcuuaau

SEQ ID NO: 394718 - RNA, 63 nt, Homo Sapiens
cacagugacugguauuuaaucagcacaaauuaaguuauauaaacauguacagaacuuugucua

SEQ ID NO: 394719 - RNA, 63 nt, Homo Sapiens
auuaucccuuuaauuaaagguuuuuaauaaaaaguuauauauaugacagaauacagaguugau

SEQ ID NO: 394720 - RNA, 63 nt, Homo Sapiens
cuuauaaccuguuuccauuccuugaacauggauguuauauauucccuccagaacucagugacu

SEQ ID NO: 394721 - RNA, 63 nt, Homo Sapiens
uaugcuaaaucuuuauauacucucaugauagcuguuauauauagggaaaaaucuuuuuucacu

SEQ ID NO: 394722 - RNA, 63 nt, Homo Sapiens
aaaagcuuauguaacauaaaucucagagauuaaguuauauauuggccucucaaccaaauaaca

SEQ ID NO: 394723 - RNA, 63 nt, Homo Sapiens
uuaaaacuuccaaaauauaugucuggaaugcauguuauauauuaaaguaucacucaguugaua

SEQ ID NO: 394724 - RNA, 63 nt, Homo Sapiens
augaucaugugauguguacauuuuaaauguaauguuauauaagaauugucacucagauauauu

SEQ ID NO: 394725 - RNA, 63 nt, Homo Sapiens
aagaacaaccuauuucgcucauuccugauucuuguuauauaagaugaaaucuguuugcuggga

SEQ ID NO: 394726 - RNA, 63 nt, Homo Sapiens
aauaugcaugcuucuuuauaaaaagauaaguuuguuauauauuaauacaguuauuaaaauguu

SEQ ID NO: 394727 - RNA, 63 nt, Homo Sapiens
aagcacuggggauaccaugguaauugagucucuguuauauaccuguuuggucauucagcaagc

SEQ ID NO: 394728 - RNA, 63 nt, Homo Sapiens
cuugcaaugugacaugguucuuuacaaguauauguuauauauauauagaugggaaauguggac

SEQ ID NO: 394729 - RNA, 63 nt, Homo Sapiens
uacauagagauaaauuaagaacuuuuaaagaaaguuauauaacugguuauuaauauauaugag

SEQ ID NO: 394730 - RNA, 63 nt, Homo Sapiens
augaaugcuaugcagauguuguaauuagaagugguuauauaugaaggacaguuucccauauga

SEQ ID NO: 394731 - RNA, 63 nt, Homo Sapiens
uaucauuuuuuuuuuuuugagcugcucuugaaaguuauauaauuccuucuaagaaaaaugugg

SEQ ID NO: 394732 - RNA, 63 nt, Homo Sapiens
aacguaggguaacuacaguucauucuguuccagguuauauaaaacugcauuuccugaauuugg

SEQ ID NO: 394733 - RNA, 63 nt, Homo Sapiens
ggaggggagggcugcuggggaggauggggggauguuauauaaauauagauauaauuuuauuuu

SEQ ID NO: 394734 - RNA, 63 nt, Homo Sapiens
uuuuaguuguuauuuucaaaauuauauguauaaguuauauaagucauaguaauagcuaaaaau

SEQ ID NO: 394735 - RNA, 63 nt, Homo Sapiens
uguguugugguuuuuaaacauuaaacauguaaaguuauauacgaaauaucugcuuuuggaaua

SEQ ID NO: 394736 - RNA, 63 nt, Homo Sapiens
aaucgguacuguaaaacauuuaacauucauacaguuauauauaauauccuuuuuuuuaaagaa

SEQ ID NO: 394737 - RNA, 63 nt, Homo Sapiens
aauguuaaaauuaagguguuaaaauuaagccuaguuauauagacgaaauaaaaugcuaaguca

SEQ ID NO: 394738 - RNA, 63 nt, Homo Sapiens
ugaaauuuauuuucuaaaauugaggagaaggaaguuauauauuugcagaauguuuuaaaguga

SEQ ID NO: 394739 - RNA, 63 nt, Homo Sapiens
uacuauaauucaaaauuauguaugugacuuagaguuauauaaucauaauuuauguuuauuuca

SEQ ID NO: 394740 - RNA, 54 nt, Homo Sapiens
augaagacaaaagcggaugagugaguuauauaaacuuacuuccauucuguuucg

SEQ ID NO: 394741 - RNA, 63 nt, Homo Sapiens
agcaaucccugguacuuuggacuuccauggcuuguuauauaaaauuacauuuuuacauguaaa

SEQ ID NO: 394742 - RNA, 63 nt, Homo Sapiens
gaguuagcagagugcugcugguuccuucgguuaguuauauaacuguuccugcaguauuggaua

SEQ ID NO: 394743 - RNA, 63 nt, Homo Sapiens
cuuuuuuuucgauuaucagaguacuuaguaaauguuauauaguuuaguucuaagauaguucca

SEQ ID NO: 394744 - RNA, 63 nt, Homo Sapiens
aguaaaaugcugaucaguaaaccaaucccuugaguuauauaacaagauuuuuaaauaaauguu

SEQ ID NO: 394745 - RNA, 63 nt, Homo Sapiens
ucccccuuagugaauuaguuuuaaaaugauauuguuauauacauacuaugaaauauguauaac

SEQ ID NO: 394746 - RNA, 63 nt, Homo Sapiens
agaacuugauuguaaauaauaauaaagaaaucuguuauauacuuuucaaacuccaugccucuu

SEQ ID NO: 394747 - RNA, 63 nt, Homo Sapiens
uauaaaauugcuauaaaucguccaagugacaaaguuauauauuuuuauuauuuugcuucagga

SEQ ID NO: 394748 - RNA, 63 nt, Homo Sapiens
aaugugacccgugauaauguuggccaucuccugguuauauacaucacugcaguagauguuauu

SEQ ID NO: 394749 - RNA, 63 nt, Homo Sapiens
uguaaaagaguguauaaacuauuuguuuaauauguuauauaaauaaggcuuaauauuuaauug

SEQ ID NO: 394750 - RNA, 63 nt, Homo Sapiens
auauagaacuuacugucagucuagagaauuaguguuauauaccucguagauaugcccagaaga

SEQ ID NO: 394751 - RNA, 63 nt, Homo Sapiens
uuuaagccaccagggccuaaauuuuucuauuuuguuauauaauguaggggauauuaguuuucc

SEQ ID NO: 394752 - RNA, 63 nt, Homo Sapiens
gagaaaauugaauuuaacaagaaauuuuaccaaguuauauaaauuuuggaaucuagaagaaau

SEQ ID NO: 394753 - RNA, 63 nt, Homo Sapiens
cuggguauuaaaauuaaaagugaacaucucaaaguuauauauaauucagauugccuagcuauu

SEQ ID NO: 394754 - RNA, 63 nt, Homo Sapiens
cuaccugccaaaaaagaauaucaaaaucacauaguuauauagcuaauccagagcaguuaaauu

SEQ ID NO: 394755 - RNA, 63 nt, Homo Sapiens
aucauucgaaucauccuuaaaaaaugcaggauuguuauauaccaauccacauacaguauuggu

SEQ ID NO: 394756 - RNA, 63 nt, Homo Sapiens
auaaauacucagugaugagauucccauguauuuguuauauauacacacaauauaguuuuuucu

SEQ ID NO: 394757 - RNA, 63 nt, Homo Sapiens
ccauucauuugccugagcguagacucucguguuguuauauagaauaacaaauagcccaucucu

SEQ ID NO: 394758 - RNA, 63 nt, Homo Sapiens
uuugaaagagaauuaguguguuauguggauaauguuauauacagccaaaguggauguuucuau

SEQ ID NO: 394759 - RNA, 63 nt, Homo Sapiens
uuuguaucgauguuuuauuauuucuauuaaauaguuauauaauucacucaagcacugauaucu

SEQ ID NO: 394760 - RNA, 63 nt, Homo Sapiens
uucagccaggguguaccugcucggugggaguugguuauauauguauguccaaguugcaggggc

SEQ ID NO: 394761 - RNA, 63 nt, Homo Sapiens
auucaucauagauggcuaauuggagaguaccuuguuauauauacagauacuuucauggucauu

SEQ ID NO: 394762 - RNA, 63 nt, Homo Sapiens
gaacauugaguuagcaauuuacaugggcuguauguuauauaagagaaugacauacuguggcua

SEQ ID NO: 394763 - RNA, 63 nt, Homo Sapiens
uaauguauaaaguauauauaauauaauauauauguuauauaaacugcacauuauauucaaacu

SEQ ID NO: 394764 - RNA, 63 nt, Homo Sapiens
gcguggggacuucuggggacagacaaggugccuguuauauauuuacucagucuuugcccugaa

SEQ ID NO: 394765 - RNA, 63 nt, Homo Sapiens
guaaaaccagagauuauuuguaugcucaaaauaguuauauauucauuaaugaauucaauaucc

SEQ ID NO: 394766 - RNA, 63 nt, Homo Sapiens
ggggcaaauucuuauaaaaauguuuauuguaaaguuauauauuuugucuacgaugggauuaug

SEQ ID NO: 394767 - RNA, 63 nt, Homo Sapiens
auauguuaaaaacauuuugccucaaauggaaguguuauauauaucaucuuagcagcuaggauu

SEQ ID NO: 394768 - RNA, 63 nt, Homo Sapiens
auuuaaauugggcuaaaaauaauaaaaccagagguuauauacaaauuuaugccacaauuuaaa

SEQ ID NO: 394769 - RNA, 63 nt, Homo Sapiens
acuacaaggaaaaaaaugcaaauggaaccagagguuauauacauagcccauccaaauuugaua

SEQ ID NO: 394770 - RNA, 63 nt, Homo Sapiens
auuccauuguauaguuauauauucuuuuuaaugguuauauaaaaugacaaguagagcuaccuc

SEQ ID NO: 394771 - RNA, 63 nt, Homo Sapiens
uagcaugcagcucacaucugcuccugugugacaguuauauaaaagaauuugccucacucauua

SEQ ID NO: 394772 - RNA, 63 nt, Homo Sapiens
guggccugaaauaauuugagagcaauaaguuccguuauauacuuuuuuaaugaaacuucaaau

SEQ ID NO: 394773 - RNA, 63 nt, Homo Sapiens
caauagcuuaaacucaugaucucacaaacugauguuauauacuaaaggauuuggagaauugaa

SEQ ID NO: 394774 - RNA, 63 nt, Homo Sapiens
uuauguugccuuuagcuucuugaagauuuagaaguuauauaaaaaauuaauuuaaaagcaaac

SEQ ID NO: 394775 - RNA, 63 nt, Homo Sapiens
uaagauaugcaaauuuauguagagaaaauaaauguuauauacccuauaaucuuucaccuaauu

SEQ ID NO: 394776 - RNA, 63 nt, Homo Sapiens
gugucucuuagaccaugaccccuuuucacuuuuguuauauagguuuaauccccaagccaagga

SEQ ID NO: 394777 - RNA, 63 nt, Homo Sapiens
cauguuaacugcacuguagauguaaaaauucagguuauauauaggauugccaucuucagaggu

SEQ ID NO: 394778 - RNA, 63 nt, Homo Sapiens
agcugcuuuucaccaucucaagaagccuaagaaguuauauauuuaaucagguagacaaaacag

SEQ ID NO: 394779 - RNA, 63 nt, Homo Sapiens
uccaaaagcaaaacaaaaacaaaaucuauuguaguuauauacuucauuuaaccuaggucacaa

SEQ ID NO: 394780 - RNA, 63 nt, Homo Sapiens
cugaaguuuaacugucccauuguaaagguguaaguuauauaggcuugaaaaaaauuggcgggu

SEQ ID NO: 394781 - RNA, 63 nt, Homo Sapiens
gauggcagcuuggaucucagguuuucuggccuuguuauauacagggagaaggugccuucccuu

SEQ ID NO: 394782 - RNA, 63 nt, Homo Sapiens
auccaucucagaaguugaaguucuuuaggacauguuauauauacucacaagcuccaucccuuu

SEQ ID NO: 394783 - RNA, 63 nt, Homo Sapiens
guacuccuguggcaugaaaaaaguuuuauccauguuauauauuuucacuacguagagcauucg

SEQ ID NO: 394784 - RNA, 63 nt, Homo Sapiens
uacagaagaaaaaaaguugaaaucuccuucaacguuauauaugaaagguaucucuuagaagua

SEQ ID NO: 394785 - RNA, 63 nt, Homo Sapiens
aauuuauugaauuuauuggacuuucucuggggaguuauauaauuuuuuuuaaaaaaucuuccu

SEQ ID NO: 394786 - RNA, 63 nt, Homo Sapiens
uaugagaaacacgaauugucuauaauauauaaaguuauauauucuguauauauuguaaauaua

SEQ ID NO: 394787 - RNA, 63 nt, Homo Sapiens
uauuuauuagagcauuugaauuuuuucacuuuuguuauauaugccucaucucacuauaguuac

SEQ ID NO: 394788 - RNA, 63 nt, Homo Sapiens
cuuauaagacaaaacaaaacugugaggauaggaguuauauauugaggccuuauggacuaacuc

SEQ ID NO: 394789 - RNA, 63 nt, Homo Sapiens
ugaauauucccuauguuaaaagacuuuguaccuguuauauauaaaaagagcuuuaaauauuau

SEQ ID NO: 394790 - RNA, 63 nt, Homo Sapiens
uuacauugacaacuugauauuauaaaaauaaaaguuauauaaauuucuguacaugugaaauua

SEQ ID NO: 394791 - RNA, 63 nt, Homo Sapiens
cauacagguguauacuuaugcacuaaaauaauaguuauauauaguguaaaauacacagacuau

SEQ ID NO: 394792 - RNA, 63 nt, Homo Sapiens
uuucagugggagggguugggcauucuguaagagguuauauaguacuaagacuuggaacacuaa

SEQ ID NO: 394793 - RNA, 63 nt, Homo Sapiens
aucucauaauaguagacaugaauguguuuauauguuauauaauuaaguggaagcuuuacugcc

SEQ ID NO: 394794 - RNA, 63 nt, Homo Sapiens
auagccuguacauuuuaaaaauguugucaccaaguuauauaaauccacaucucuguaaacaac

SEQ ID NO: 394795 - RNA, 63 nt, Homo Sapiens
agcucaguguuuccaaacgucaaguccucaucuguuauauaaaauccuuucugcuuuguaagu

SEQ ID NO: 394796 - RNA, 63 nt, Homo Sapiens
uuagcauuugugucuucaaauuucucuccuuugguuauauaccuugcguauuccgcacauuga

SEQ ID NO: 394797 - RNA, 63 nt, Homo Sapiens
gugaugaucuaccagccucccuauuuuuuuucuguuauauaaaugguuaaaagagguuuuucu

SEQ ID NO: 394798 - RNA, 63 nt, Homo Sapiens
uccuuuauuugccuaguagaagugauaaauuguguuauauaugauaauuuauauaaaaccacu

SEQ ID NO: 394799 - RNA, 63 nt, Homo Sapiens
uuauugguauucugauuacucucaauucuaauuguuauauauuugagcccauacaguguauua

SEQ ID NO: 394800 - RNA, 63 nt, Homo Sapiens
uagaaagcaguacaguaucuuaagugucaaccaguuauauaccuaaucugguuuuuuauaacu

SEQ ID NO: 394801 - RNA, 63 nt, Homo Sapiens
cauguauaauuuguguuuacuuguaacuuucugguuauauacugcuuauaucuguggauucaa

SEQ ID NO: 394802 - RNA, 63 nt, Homo Sapiens
gaguuuauacccugggugcuggggucgcacuguguuauauauauauauauauauauauaaugu

SEQ ID NO: 394803 - RNA, 63 nt, Homo Sapiens
ugaggcucaaggagguuaaguaacauuuccaggguuauauaaacuaguaaauggcagagcuaa

SEQ ID NO: 394804 - RNA, 63 nt, Homo Sapiens
acguguuauaaauuuauucauauauuauuacguguuauauauuaauuuacauaaaggccuuca

SEQ ID NO: 394805 - RNA, 63 nt, Homo Sapiens
guaaggccuucuuuaggccuucuucuauuuacuguuauauacuuuauuguauaaagauguuac

SEQ ID NO: 394806 - RNA, 63 nt, Homo Sapiens
gcagguaugucaaguguauaaauauuacuguauguuauauaaagaauuucuguauuaggucua

SEQ ID NO: 394807 - RNA, 63 nt, Homo Sapiens
ggcaacagucugaacucucccuuuucuaaauuuguuauauagagggacuagaaagaauaaagc

SEQ ID NO: 394808 - RNA, 63 nt, Homo Sapiens
aauguuuggacuguacaucuccuauguugcgcuguuauauaugaaagaagcagaucagauugu

SEQ ID NO: 394809 - RNA, 63 nt, Homo Sapiens
uuagugguauguaucagacaaaugccauacuuuguuauauaugucuuuucucucugugaaaua

SEQ ID NO: 394810 - RNA, 63 nt, Homo Sapiens
uuuuguaggggucaaagaaauuuaucaugacauguuauauauuugauuuuuagaugagauugu

SEQ ID NO: 394811 - RNA, 63 nt, Homo Sapiens
ugaagaacauuuuuaauaugaugauggaaaauaguuauauaaagccuaacuuuuccagcaaag

SEQ ID NO: 394812 - RNA, 63 nt, Homo Sapiens
uucaucaaaucccaacaucucuuccauguggauguuauauaccuccucccauccccaguuuga

SEQ ID NO: 394813 - RNA, 63 nt, Homo Sapiens
auaaugcucagugaaaauagcaaguuguagaaaguuauauacaaauuauauauauguacaaaa

SEQ ID NO: 394814 - RNA, 63 nt, Homo Sapiens
uuuuugagggggguauggauauuaaauguuuucguuauauacuuaucccuauuaaaacaggca

SEQ ID NO: 394815 - RNA, 63 nt, Homo Sapiens
auagauuuccuaacuccaccaugccuauuucugguuauauaauugcucuccaauugucauguc

SEQ ID NO: 394816 - RNA, 63 nt, Homo Sapiens
agguugauggugggguguguuuauagugauccuguuauauauacagaucugggaucuuucguc

SEQ ID NO: 394817 - RNA, 63 nt, Homo Sapiens
uaaaauugauagagaaaagaaacugucgagcaaguuauauaacaacuaacaacauugcacuuu

SEQ ID NO: 394818 - RNA, 63 nt, Homo Sapiens
ccauagugcaggcuuggggagcuuuaagccucaguuauauaacccacgaaaaacagagccucc

SEQ ID NO: 394819 - RNA, 63 nt, Homo Sapiens
acaauuugcuucaugaaucaagguguggaaaugguuauauauggauugauuuagaaaaugguu

SEQ ID NO: 394820 - RNA, 63 nt, Homo Sapiens
agauuaguuuuuacuauaaagguggucccaaaaguuauauaaaaacauuucaguaggguucaa

SEQ ID NO: 394821 - RNA, 63 nt, Homo Sapiens
uuauugugaggaccuucucaaauguacuguacuguuauauaauauuuuuacgauuuccaaaca

SEQ ID NO: 394822 - RNA, 63 nt, Homo Sapiens
uaguuaauauguuguacaucuugcaguauuauuguuauauauaaguagcuuaauuacccccca

SEQ ID NO: 394823 - RNA, 63 nt, Homo Sapiens
cauggucaauaaaauaaaacagaaauaucugauguuauauauacagguucucuucucuuucuu

SEQ ID NO: 394824 - RNA, 63 nt, Homo Sapiens
aauaccccggccaggcacgguuacuaggcguuuguuauauaaauguguauuuucuauagaugu

SEQ ID NO: 394825 - RNA, 63 nt, Homo Sapiens
auugucuuuaagggaaaagaguggggugguguuguuauauauuagaaguuuaugguuauuugu

SEQ ID NO: 394826 - RNA, 63 nt, Homo Sapiens
uuucuauagaauaauaacauuacauaagaauuuguuauauaugauuaaugaucacaguauaau

SEQ ID NO: 394827 - RNA, 63 nt, Homo Sapiens
cauaaugguuguguacugaaccacuucauauuuguuauauauaauauauauauauauaaucuc

SEQ ID NO: 394828 - RNA, 63 nt, Homo Sapiens
uaguuauuauggaaauguugucuuuuauacuuaguuauauaagaaaaaagggaguuaugcaau

SEQ ID NO: 394829 - RNA, 63 nt, Homo Sapiens
guggguuuggugcacaggcacacaccuccacuuguuauauaaccuguuuguguaaguucauac

SEQ ID NO: 394830 - RNA, 63 nt, Homo Sapiens
uguuccuguaguuuuuugaugagaguuauaguuguuauauauacauaaagauaauuuucuuuu

SEQ ID NO: 394831 - RNA, 63 nt, Homo Sapiens
guuucuauaaagcugugugaugguauuauaacuguuauauacacauacauauaauuuuguuuu

SEQ ID NO: 394832 - RNA, 63 nt, Homo Sapiens
ucaucugugaauauuauugguuuuguaaucuuuguuauauaagaggauguuuaggcuguauau

SEQ ID NO: 394833 - RNA, 63 nt, Homo Sapiens
caaaaacgacauugggacaugcugcucaagguaguuauauauacgauaaguuguauauaugau

SEQ ID NO: 394834 - RNA, 63 nt, Homo Sapiens
aauguuucuuaggacucacccacuccauucaauguuauauauaaaauagugugaucaaucaca

SEQ ID NO: 394835 - RNA, 63 nt, Homo Sapiens
cuuaaaccaccauuuauuuccaugugaaaaaguguuauauaugacaaguguuuuuugauugua

SEQ ID NO: 394836 - RNA, 63 nt, Homo Sapiens
acuaagaugugaauacagaauagacauugagagguuauauauguccaaaacucaucuguccag

SEQ ID NO: 394837 - RNA, 63 nt, Homo Sapiens
uuguuuuuaaaagggggggaauagugacaugcaguuauauauugaucuguuuuggauguugcu

SEQ ID NO: 394838 - RNA, 63 nt, Homo Sapiens
cacaucuuauugaaccauccauauuuguuuuaaguuauauauauuccagaggaaauaauccaa

SEQ ID NO: 394839 - RNA, 63 nt, Homo Sapiens
aauccgacagcugaacuaggacauaaagagaguguuauauaaaaggacucuggagucuagcuc

SEQ ID NO: 394840 - RNA, 63 nt, Homo Sapiens
ccuuacuagaaauauauucauuucugaagacuaguuauauauuagcuauguuuccaucuucag

SEQ ID NO: 394841 - RNA, 63 nt, Homo Sapiens
aaaacagauaaaaugcaucuuguuacuacaaauguuauauauauaaaaucaaguugagcuuug

SEQ ID NO: 394842 - RNA, 63 nt, Homo Sapiens
aauagacccuucacacaggaaaugugaacaauuguuauauaugaacacucaaaucuuuuacug

SEQ ID NO: 394843 - RNA, 63 nt, Homo Sapiens
auagcacugggaacucuggcuccgaaaaacuuuguuauauauaucaaggauguucuggcuuua

SEQ ID NO: 394844 - RNA, 63 nt, Homo Sapiens
auucuucaucuauuuuaguuagcacuuuguaucguuauauacaguuuacaauacauguauaac

SEQ ID NO: 394845 - RNA, 63 nt, Homo Sapiens
uuucugauaauuuacagauuuagcuuuucuuuuguuauauaaacugcuagccacaaauuuuag

SEQ ID NO: 394846 - RNA, 63 nt, Homo Sapiens
auggaagaaagugcugcucaaaggaaguaugaaguuauauauuuaauuuuuuaauuuuaauuu

SEQ ID NO: 394847 - RNA, 63 nt, Homo Sapiens
aacuucuguauuuauauuuaaucagugguucauguuauauaauacacccuuaacuaguuaaau

SEQ ID NO: 394848 - RNA, 63 nt, Homo Sapiens
ccauaguuugucaaccacugguguaaaaccuuaguuauauaugaucugcauuuucuugaacug

SEQ ID NO: 394849 - RNA, 63 nt, Homo Sapiens
aaauacucauauguuuaugacacauaacaccugguuauauauguuuauacccgggccaaauag

SEQ ID NO: 394850 - RNA, 63 nt, Homo Sapiens
ucucaaggguuaaccagaccgucauuuuuaaauguuauauacauguuugcagcucccaauguu

SEQ ID NO: 394851 - RNA, 63 nt, Homo Sapiens
uuauuuaauuuaaaagaaauuuuuaacaaguuuguuauauauuaacguuuaauuugcuaaaua

SEQ ID NO: 394852 - RNA, 63 nt, Homo Sapiens
uuuucccaaugcuaauuuccuggaauuuccucuguuauauagcgaacacuguuugauuuuacu

SEQ ID NO: 394853 - RNA, 63 nt, Homo Sapiens
ucaguugaaacucuugguuaauugaagaaaaugguuauauaauuaaaauuggcacauguaagu

SEQ ID NO: 394854 - RNA, 63 nt, Homo Sapiens
uaauauuuuucuaauggaaaaguggaacaaaauguuauauagauuugagaucaaggagaagau

SEQ ID NO: 394855 - RNA, 63 nt, Homo Sapiens
gcuuaaugcagcucauuugccauaugcaaugugguuauauaaauaaauuucauuuuuuuucuu

SEQ ID NO: 394856 - RNA, 63 nt, Homo Sapiens
ggaugauauacacaguggcaucucuuuuauucuguuauauaguucacuuuuguuaacaguauu

SEQ ID NO: 394857 - RNA, 63 nt, Homo Sapiens
augauuuuguuaaaaauugcuauggaguacuuuguuauauaacagaagccauccugaaaugaa

SEQ ID NO: 394858 - RNA, 63 nt, Homo Sapiens; identical to SEQ ID NO: 394737

SEQ ID NO: 394859 - RNA, 63 nt, Homo Sapiens
aaagucaguguuuagaaauguuacccuuucuaaguuauauacagaucaaaugcuuuuuucuuu

SEQ ID NO: 394860 - RNA, 63 nt, Homo Sapiens
gaagcuaauaaaauucgcuuucuaaaguuaccuguuauauaucucuuuuggucccauccucua

SEQ ID NO: 394861 - RNA, 63 nt, Homo Sapiens
cuucaauaggaugcaaagaucaaugcaaaaauuguuauauaugaacauauaacuggagucguc

SEQ ID NO: 394862 - RNA, 63 nt, Homo Sapiens
cgaaauaaaaugcuaagucaaaaauuaagccuaguuauauagaaauguuaaaauuaagguguu

SEQ ID NO: 394863 - RNA, 63 nt, Homo Sapiens
auauccuuuuuuuuaaagaauaacauucauacaguuauauauaaaucaguacuguaaaacauu

SEQ ID NO: 394864 - RNA, 63 nt, Homo Sapiens
gaaacucaccuauuugaaauaauaugaauaaauguuauauaagaucaugaugcuuauacaaua

SEQ ID NO: 394865 - RNA, 63 nt, Homo Sapiens
auuguagaugacugugguaagucuuuuugugauguuauauaaaacguagaaaaauguuuagau

SEQ ID NO: 394866 - RNA, 63 nt, Homo Sapiens
uuuucuccuaaauggagaauauguguaaacauuguuauauaucgugaaauaaguuauuaaagc

SEQ ID NO: 394867 - RNA, 63 nt, Homo Sapiens
uucucuuuggcuuuucuucagagaaacuugccaguuauauaacguggugcaggcggggagcca

SEQ ID NO: 394868 - RNA, 63 nt, Homo Sapiens
auacuuuuaacaguacagacagguuuuauuacuguuauauacuuaaccaaaaaugccccacac

SEQ ID NO: 394869 - RNA, 63 nt, Homo Sapiens
gaaaaucaaacacuuuacuacagcaucaucuugguuauauacuuuucuguguuuauuacuguu

SEQ ID NO: 394870 - RNA, 63 nt, Homo Sapiens
uggcauaaaauacggcuuacucuuccagauuuuguuauauauuuauuuagaagaagauguaua

SEQ ID NO: 394871 - RNA, 63 nt, Homo Sapiens
uaaaaaauguuaacaggaaauuuuaaaaggguuguuauauauguucugcaucagcagaaaucu

SEQ ID NO: 394872 - RNA, 63 nt, Homo Sapiens
cugacaguuccuguguuucuaauggagaaacaaguuauauaugauuauuugaauauucaaagc

SEQ ID NO: 394873 - RNA, 63 nt, Homo Sapiens
uauuugaauagcugaaggacucuauaugcaauuguuauauaucuaauaaaauuuucucuacgu

SEQ ID NO: 394874 - RNA, 63 nt, Homo Sapiens
guuuguauuauucuauuacguaaucacagacuuguuauauaaaggcaaagucuacuauaauua

SEQ ID NO: 394875 - RNA, 63 nt, Homo Sapiens
ugugaauaauaagagauuuuauccaaaucucccguuauauaucaaaaaguuuguaauuauuuc

SEQ ID NO: 394876 - RNA, 63 nt, Homo Sapiens
gguaucauugcagucaguauucacguguauauuguuauauaaguuguauaauaugcuuguaaa

SEQ ID NO: 394877 - RNA, 63 nt, Homo Sapiens
uauacagggcacuugaaggagacucugaugcuaguuauauaagugcauuaacuuaagacacgg

SEQ ID NO: 394878 - RNA, 63 nt, Homo Sapiens
cagaucuauuuuguuugccauuagucaccauuaguuauauaaauuuuauuguuuuagguuagu

SEQ ID NO: 394879 - RNA, 63 nt, Homo Sapiens
uuauguuuccuuuaugccaaacauaacaaaacaguuauauagacugcuuuagcaaaguacaca

SEQ ID NO: 394880 - RNA, 63 nt, Homo Sapiens
cuacaguucugaaggggaaauauaacaucuaugguuauauauuuuaaaaacuuagauuauagg

SEQ ID NO: 394881 - RNA, 63 nt, Homo Sapiens
ugugcuuaacccaauuuaaacucaauguaaaauguuauauaugcaucaguacagcauuuucaa

SEQ ID NO: 394882 - RNA, 63 nt, Homo Sapiens
aguguuugaaaguaugaaauguguugcuucugaguuauauaaggcuacuucaugacaagacug

SEQ ID NO: 394883 - RNA, 63 nt, Homo Sapiens
gaaugaauuuucauuaauaacugguauucaaagguuauauaguuuguacauauugaaguuucu

SEQ ID NO: 394884 - RNA, 63 nt, Homo Sapiens
agccauuccuaagacuccuggcucuaaaccuagguuauauauucuuaguuuauuugaauaaaa

SEQ ID NO: 394885 - RNA, 63 nt, Homo Sapiens
gugaaauuuauuuuauauaguuugcggugcucuguuauauauuguggaugguagaugaaguac

SEQ ID NO: 394886 - RNA, 63 nt, Homo Sapiens
cccucagcgauacaugcacaaaggguaguguaaguuauauaagauuuugucauucuucuguga

SEQ ID NO: 394887 - RNA, 63 nt, Homo Sapiens
uuuguaacuucaaauauagagauauuuuuguacguuauauauuguauuaagggcauuuuaaaa

SEQ ID NO: 394888 - RNA, 63 nt, Homo Sapiens
uugccccuugagccagguggauguuuaccguguguuauauaacuuccuggcuccuucacugaa

SEQ ID NO: 394889 - RNA, 63 nt, Homo Sapiens
auugugccuuuacuacuucuuuauguaauagaaguuauauaccuaagcuuauauaauacaugg

SEQ ID NO: 394890 - RNA, 63 nt, Homo Sapiens
uuuacaaagugcucucaaugcauuuacccauucguuauauaaauauguuacaucaggacaacu

SEQ ID NO: 394891 - RNA, 63 nt, Homo Sapiens
uaugacuagcuacacguuuugccaaaaaugcuuguuauauaaaggguacuuuugggaggguga

SEQ ID NO: 394892 - RNA, 63 nt, Homo Sapiens
guauucuaugaaaauaauuuuuuuaaauaaaauguuauauaauaaaagugucuucuaugcuuu

SEQ ID NO: 394893 - RNA, 63 nt, Homo Sapiens
uguaggguuaguuaaggaaaaagacagguaaauguuauauaaucaugguaaaagaaaaaaaaa

SEQ ID NO: 394894 - RNA, 63 nt, Homo Sapiens
aauaaaaaaaugggggaaguuguccuuaaauguguuauauagacaaacguuuuaguacauuaa

SEQ ID NO: 394895 - RNA, 63 nt, Homo Sapiens
cacaaacacacacagaaauaaauaguguuugagguuauauaugaauauaggauugcauuuaau

SEQ ID NO: 394896 - RNA, 63 nt, Homo Sapiens
augguuucauaugggcauacaacugcuacugaaguuauauagccuugaaaacucagugcaggu

SEQ ID NO: 394897 - RNA, 63 nt, Homo Sapiens
auuauuauucuuauauuauuauuauuauuauugguuauauacuguccauagucuccugucccu

SEQ ID NO: 394898 - RNA, 63 nt, Homo Sapiens
uuucauccaccccuuuccuuuuuuuggaaggggguuauauaugagaguucauugaagaagucc

SEQ ID NO: 394899 - RNA, 63 nt, Homo Sapiens
uaaauggcaaugauaaugacaguuuauuuuuauguuauauaaaaaccucaacaaauuuuccaa

SEQ ID NO: 394900 - RNA, 63 nt, Homo Sapiens
aauacauggaauuuuauacagguuuucuccuguguuauauaugcauuaugugcagguaugaua

SEQ ID NO: 394901 - RNA, 63 nt, Homo Sapiens
auagucuacaacauagagacuguauaauucuguguuauauaugugccuagugcucuguuggca

SEQ ID NO: 394902 - RNA, 63 nt, Homo Sapiens
uugcauuuguuugcugaaauuuaccuuuuuuuaguuauauauauguguguguguguguguaau

SEQ ID NO: 394903 - RNA, 63 nt, Homo Sapiens
ugugggauauauauauauauauauauggauaugguuauauauaugggaugguuugguuggucc

SEQ ID NO: 394904 - RNA, 63 nt, Homo Sapiens
uaaaaaguuauagcuuuugcaacuuuauuacugguuauauacauuuggccauuaugaugugca

SEQ ID NO: 394905 - RNA, 63 nt, Homo Sapiens
acaguggagguuguauuccuuaggagacaacaaguuauauaugaauggaauucaaauaggagc

SEQ ID NO: 394906 - RNA, 63 nt, Homo Sapiens
uauguaauaauuguugauuuuaacaguaucaauguuauauaacaauauauacauccacauauc

SEQ ID NO: 394907 - RNA, 63 nt, Homo Sapiens
guuuggcaaugcucuucuucauuugaaaccuaaguuauauauaaaugucuggggauaauuuaa

SEQ ID NO: 394908 - RNA, 63 nt, Homo Sapiens
uaaaauguuaaccauauagugcauuccuugcuuguuauauacccuccauuuuuucucauccuu

SEQ ID NO: 394909 - RNA, 63 nt, Homo Sapiens
aaaugauaauauauuuuuuuuaauguugacauuguuauauaaugucugucccugucuuggugu

SEQ ID NO: 394910 - RNA, 63 nt, Homo Sapiens
caaugccuagaagaggaccuaacuuuguucacuguuauauaccguacauuccugaggcaucag

SEQ ID NO: 394911 - RNA, 63 nt, Homo Sapiens
uuaucauuuacuuuuuuuaagauucagaccucaguuauauaaauuucaguuuaauaucaacca

SEQ ID NO: 394912 - RNA, 63 nt, Homo Sapiens
uacauaaugggccacugaaaucugucaagaguaguuauauaauuguugaacagguguuuuucc

SEQ ID NO: 394913 - RNA, 63 nt, Homo Sapiens
ggccugugaaguaacacuggggcagauauguauguuauauacaacuauuuuuuuaaaaaacuu

SEQ ID NO: 394914 - RNA, 63 nt, Homo Sapiens
uguuucuaagaucaaacauuuuaauaugugcauguuauauauaaauauguaaauucugugaua

SEQ ID NO: 394915 - RNA, 63 nt, Homo Sapiens
ucaucuggcaguucuacacaugaaacaucuuuuguuauauaagguguauugaaaccugcagug

SEQ ID NO: 394916 - RNA, 63 nt, Homo Sapiens
gauuguauggauguaaguguucuuacauaguuaguuauauacuaaucauuuucuguuguggcu

SEQ ID NO: 394917 - RNA, 63 nt, Homo Sapiens
gugccauacuuuuaauaaagaauuauuucugcuguuauauaaauucuggaugugaaaucaugu

SEQ ID NO: 394918 - RNA, 63 nt, Homo Sapiens
aaauacuuacauugaaccugugacugcuacuuuguuauauacaccauccaucaacaaauaucc

SEQ ID NO: 394919 - RNA, 63 nt, Homo Sapiens
uuagacuuggauucuuuccaggagugcuguuuuguuauauaauauuuuacacgcuuuugugau

SEQ ID NO: 394920 - RNA, 63 nt, Homo Sapiens
gggaugguaguuuuuucaucacagcacaaauuaguuauauaugaagcagguucuuguuggugc

SEQ ID NO: 394921 - RNA, 63 nt, Homo Sapiens
agacuuuuauaggcuugaaaacuuuauacuuggguuauauauuuuucacaacuuguuggucgu

SEQ ID NO: 394922 - RNA, 63 nt, Homo Sapiens
caucuacucccaacauggauguauuuccaaacuguuauauaccaaauacauucuccaaagaua

SEQ ID NO: 394923 - RNA, 63 nt, Homo Sapiens
gcuggcucuaggaagaagcccccuugugggcauguuauauaggaugaacugugauaacuguug

SEQ ID NO: 394924 - RNA, 63 nt, Homo Sapiens
aaaugaccauugaguauuuaugaaugaguuuaaguuauauaauaaaacaguuauuuaauguau

SEQ ID NO: 394925 - RNA, 53 nt, Homo Sapiens
aguggaucaguagcaauuaaauuguuauauacuuuacauauuuaguauguuuu

SEQ ID NO: 394926 - RNA, 63 nt, Homo Sapiens
ugaccuuugaggucaguaguuuaaaaguucuuaguuauauagcaucuggaagaucauuuugaa

SEQ ID NO: 394927 - RNA, 63 nt, Homo Sapiens
acacacacaucuacuauuuuagauaaauguacuguuauauauauauguaaacuacuauugcuc

SEQ ID NO: 394928 - RNA, 63 nt, Homo Sapiens
acuucaaaaguauuuuccuguaaaaaaaaaaaaguuauauagguuuuguuugcuaucuuaauu

SEQ ID NO: 394929 - RNA, 63 nt, Homo Sapiens
aagacauaaacagauuauaaagacaauacugcuguuauauagcaggcucuuaaaaguauugaa

SEQ ID NO: 394930 - RNA, 63 nt, Homo Sapiens
uuauaggcauuuaguugcuuuucaaaauauuaaguuauauauucaaacuuuacaauagcauuc

SEQ ID NO: 394931 - RNA, 63 nt, Homo Sapiens
cauaaaccuuuucuuccuggguuaaauggaaaaguuauauaugugucguuuaugcuugcagau

SEQ ID NO: 394932 - RNA, 63 nt, Homo Sapiens
cuauauauauauauauaacuggggagguuuuuaguuauauaugacccauccaacaagagagau

SEQ ID NO: 394933 - RNA, 63 nt, Homo Sapiens
uuacuaggacuuuugauagagaacaaaugaggaguuauauauuugaagaaaagacuuggcuua

SEQ ID NO: 394934 - RNA, 63 nt, Homo Sapiens
uuuguacugaugaaaauuuacaaucaaauguaaguuauauauaacuuuugaacguuggccuua

SEQ ID NO: 394935 - RNA, 63 nt, Homo Sapiens
caaauuaaaauauuuuaaaauucuaaauuugaaguuauauauaguucuuguucauacugagug

SEQ ID NO: 394936 - RNA, 63 nt, Homo Sapiens
ggcaaggaaauuaagaacugauuguuuuaaaaaguuauauaaaguaugauuauaagagagcuu

SEQ ID NO: 394937 - RNA, 63 nt, Homo Sapiens
uguggucugaaaagacccuaggauuuugaacaaguuauauaaucuguuaagaagaaacuagug

SEQ ID NO: 394938 - RNA, 63 nt, Homo Sapiens
aauguacaaagaaaacaaaccauugcuuaugcuguuauauacuagagaaauuuuguuuugcuu

SEQ ID NO: 394939 - RNA, 63 nt, Homo Sapiens
aauggcugcuauaauaauaauaauacagauguuguuauauaagguauaucagaccuacaggcu

SEQ ID NO: 394940 - RNA, 63 nt, Homo Sapiens
cacaaauuauacugucaaccuacuguugcuaugguuauauacucccacuucauacauuaccaa

SEQ ID NO: 394941 - RNA, 63 nt, Homo Sapiens
uuuugguaccucugauguagcagcacuugccauguuauauauauguaguuggcauuugguucc

SEQ ID NO: 394942 - RNA, 63 nt, Homo Sapiens
uaaauuaaaaacacaaucaguguucaggcuucaguuauauaauguaagcacaacuaaaaugaa

SEQ ID NO: 394943 - RNA, 63 nt, Homo Sapiens
gcuuuucuuguuucucuuccauuguacauguggguuauauaccauauguuaaauaugcaauaa

SEQ ID NO: 394944 - RNA, 63 nt, Homo Sapiens
uuucuccuucccuacuuuguacaaaggaccagaguuauauauauauauauauguauaugucug

SEQ ID NO: 394945 - RNA, 63 nt, Homo Sapiens
aaagaucaucuucaacuguuuauugacuucugaguuauauaguucaugcccugccaaggcauu

SEQ ID NO: 394946 - RNA, 63 nt, Homo Sapiens
aauaugucauuuuauguaagcggaugugcguugguuauauacacuagggauaaaguauacagg

SEQ ID NO: 394947 - RNA, 63 nt, Homo Sapiens
ccuggauuauagauuaaaagucugugcugcaugguuauauacuuuuugcauuuggcuaauugg

SEQ ID NO: 394948 - RNA, 63 nt, Homo Sapiens
caauauaacuaucucuacugccacuuuacuuguguuauauagcauggaggaacuuuccaaaca

SEQ ID NO: 394949 - RNA, 63 nt, Homo Sapiens
uauauuuguaaugagagcaaaauguaaagaucaguuauauauaucacugcuguggucauuugu

SEQ ID NO: 394950 - RNA, 63 nt, Homo Sapiens
uauuuuuuuauaaaucaagaguaaauuugucauguuauauauuucagagcuccaggaucauca

SEQ ID NO: 394951 - RNA, 63 nt, Homo Sapiens
gcuaguuuggguuuguuuuuuugaaagauucuuguuauauauagucuuucaauaguuugggaa

SEQ ID NO: 394952 - RNA, 63 nt, Homo Sapiens
ucaguuuuaaauuguaguuccuagauggcaccuguuauauaauugcaguuuuaauuuauaaca

SEQ ID NO: 394953 - RNA, 63 nt, Homo Sapiens
ucacauugggcuaaguggauuccuuaucccuuuguuauauauauuuuuugcaacuuggauuuc

SEQ ID NO: 394954 - RNA, 63 nt, Homo Sapiens
cuuuugggaauguuuuaaauucuccaguuuuuuguuauauagggaucaaccagcuaagaaaag

SEQ ID NO: 394955 - RNA, 63 nt, Homo Sapiens
aagacuaccuuugacuugguauuauaagcuggaguuauauauguauuugaaaacagaguaaau

SEQ ID NO: 394956 - RNA, 63 nt, Homo Sapiens
uuucuuccauuaauucuggaaaaaacguucacaguuauauauaugguauuuugcaaaaggacu

SEQ ID NO: 394957 - RNA, 63 nt, Homo Sapiens
uaaacagauauccuguaucaaauaaaaguauuuguuauauauuugaaguuaugcauggaaagg

SEQ ID NO: 394958 - RNA, 63 nt, Homo Sapiens
cauuauuacuuuugcuguaauucacuugucauuguuauauaauguguaagggccagaaauauc

SEQ ID NO: 394959 - RNA, 63 nt, Homo Sapiens
gaauuaccauuugacucagcaaucccauuauugguuauauacccaaaggaaucuaaaucauuc

SEQ ID NO: 394960 - RNA, 63 nt, Homo Sapiens
ugaauuuaaauaaaagugaaccauauuuaucugguuauauaaaacuaaaaauggggguguuua

SEQ ID NO: 394961 - RNA, 63 nt, Homo Sapiens
aaaaugguaaacguguguauuauaucuggccucguuauauaguguauauauauguauacauau

SEQ ID NO: 394962 - RNA, 63 nt, Homo Sapiens
uugagguaaaguuguuuuugaaauuucugaaguguuauauaccaaaaugccaacauuuccacg

SEQ ID NO: 394963 - RNA, 63 nt, Homo Sapiens
aaccgucugauagcauggcauccagaaauaaacguuauauagguugcuguaucuacuuuaacu

SEQ ID NO: 394964 - RNA, 63 nt, Homo Sapiens
aaaauguuuaauuuuaauaaaacuuuaacucuuguuauauaauuguugauguuaauuuucaaa

SEQ ID NO: 394965 - RNA, 63 nt, Homo Sapiens
ugcugcauuaauguuauagcauagcacuuuuguguuauauaauugaacauuucccaugucauu

SEQ ID NO: 394966 - RNA, 63 nt, Homo Sapiens
gcugacuuuuuuuguuugaaaaaauuucauuuuguuauauaguuggauuuggauauuugaggu

SEQ ID NO: 394967 - RNA, 63 nt, Homo Sapiens
ccuuuauuuaaaagagagaaaccuauuugugugguuauauagccccgugucacuguuuacaug

SEQ ID NO: 394968 - RNA, 63 nt, Homo Sapiens
gaggaagaacuucuguuuacagaaaacuguauuguuauauaugucaggcuguguauugugacu

SEQ ID NO: 394969 - RNA, 63 nt, Homo Sapiens
gcauuuucauagugugcucauuucuaugguuuuguuauauagcauuuuucaacauuuaauggu

SEQ ID NO: 394970 - RNA, 63 nt, Homo Sapiens
ccuccucaagcugggccugcccuccaagugcuuguuauauaccuccacgggugucagcccaga

SEQ ID NO: 394971 - RNA, 63 nt, Homo Sapiens
uauauacacauauguguguaugcaguuugucagguuauauauagaauuucuauuaaggauuuu

SEQ ID NO: 394972 - RNA, 63 nt, Homo Sapiens
auggucuuuggagaaaaaauaauaaaacagaguguuauauauauauuuuuuggugcaagauaa

SEQ ID NO: 394973 - RNA, 63 nt, Homo Sapiens
aauauauuauuacuuguaaaaaauguauuuuauguuauauauacugagauuuauuaaagaaaa

SEQ ID NO: 394974 - RNA, 63 nt, Homo Sapiens
uugccacauucuaaaauucaucauauauuuacuguuauauagaaagauagaaaagaaucacag

SEQ ID NO: 394975 - RNA, 63 nt, Homo Sapiens
ugggucggcuaucaagaagguucuugaaugucuguuauauaacuuuuacuaaguuauugcuga

SEQ ID NO: 394976 - RNA, 63 nt, Homo Sapiens
aaugcuuuugguaaauauacauguuuuaaagagguuauauaucauuaauaaaaauaucuagcu

SEQ ID NO: 394977 - RNA, 63 nt, Homo Sapiens
uguauuuugcuacuguugauauggauugcuuauguuauauaaacgauuuucauuaaauuuuuu

SEQ ID NO: 394978 - RNA, 63 nt, Homo Sapiens
guuuaccauugacuauuguaauuggguaguaauguuauauaaauuccacauuuuuaugcaacu

SEQ ID NO: 394979 - RNA, 63 nt, Homo Sapiens
ucauuaaaagugagauuaauaaaaucugaaaauguuauauaauaacuuuaaaaagccagguaa

SEQ ID NO: 394980 - RNA, 63 nt, Homo Sapiens
cauugagcaauacuaauuuuuaaaucacauucgguuauauaauuaugaguauuguguugaauc

SEQ ID NO: 394981 - RNA, 63 nt, Homo Sapiens
uuagauuuucuagcagcaaaguccgaaaagauaguuauauacaaaauucuguuuucugaaaac

SEQ ID NO: 394982 - RNA, 63 nt, Homo Sapiens
uucuauauuuguaacuuugcauguucuuguuuuguuauauaaaaaaauuguaaauguuuaaua

SEQ ID NO: 394983 - RNA, 63 nt, Homo Sapiens
gaaaaugggggcuggauaucccaagaaucagagguuauauaaaaauacugcaaauagaccgca

SEQ ID NO: 394984 - RNA, 63 nt, Homo Sapiens
auccugucucuggcccacugaccuggccagaggguuauauaccaagggguugguucccauagu

SEQ ID NO: 394985 - RNA, 63 nt, Homo Sapiens
cauuucuuuuaauccuuuuauaacagauuaaauguuauauaaggaagauugagucauuauuag

SEQ ID NO: 394986 - RNA, 63 nt, Homo Sapiens
auuuguuuugugauuugaacaaguuagagaucuguuauauaacgacaaguguaaagcaugcaa

SEQ ID NO: 394987 - RNA, 63 nt, Homo Sapiens
cccuaccgaaggagacaccuagguuaucaccacguuauauauuggaugcuucugccuagugac

SEQ ID NO: 394988 - RNA, 63 nt, Homo Sapiens
uaauauuaagugaaccucccuaugaaagugaauguuauauauucuugccaaaaagguuuuggu

SEQ ID NO: 394989 - RNA, 63 nt, Homo Sapiens
acaaaccaucacacuuagaacaucuuuucauuuguuauauauucuuuucuuauaaucuaauua

SEQ ID NO: 394990 - RNA, 63 nt, Homo Sapiens
guuuguuuuuauucuuucauuuuuacaagggacguuauauaaagaacugaacucaacauucag

SEQ ID NO: 394991 - RNA, 63 nt, Homo Sapiens
agagaucauuaaauguauuuugcaaagccuaaaguuauauauuuaacaguuuuuauauguugu

SEQ ID NO: 394992 - RNA, 63 nt, Homo Sapiens
gacugccugcuaauaugaaccaauggagaauggguuauauaaaucuuguuugauuuuugacag

SEQ ID NO: 394993 - RNA, 63 nt, Homo Sapiens
gacaccccagugucaucaguuugucaucacaauguuauauauuauugccgggugaaaguccaa

SEQ ID NO: 394994 - RNA, 63 nt, Homo Sapiens
gaaccuaugcacauuuuuauguacacauauccaguuauauaauugcuuccuaguugcauuaua

SEQ ID NO: 394995 - RNA, 63 nt, Homo Sapiens
aauacuuuuuguuuuucaaaaauaaaaugcaauguuauauaaagcuauaaacuaaguucuuua

SEQ ID NO: 394996 - RNA, 63 nt, Homo Sapiens
uuugcucaguaaauauuuuggggcagcuuuccgguuauauaacacauugacaaguauauguau

SEQ ID NO: 394997 - RNA, 63 nt, Homo Sapiens
uguccggccauauauuuucgucuuuugaagacuguuauauacaugaaauuauaugguauguag

SEQ ID NO: 394998 - RNA, 63 nt, Homo Sapiens
agaaaaaaaaaaacauucaauuucggacacugaguuauauaugaaauuaauuaggcucuaguc

SEQ ID NO: 394999 - RNA, 63 nt, Homo Sapiens
aauauuauaguaaucagaaacuacauaaggaauguuauauaggcuugucaguucccauuuuuc

SEQ ID NO: 395000 - RNA, 63 nt, Homo Sapiens
ucuucaccuuugcacugucugccacuuaguuugguuauauagucauuaacuugaauuuggucu

SEQ ID NO: 395001 - RNA, 63 nt, Homo Sapiens
cacuuguaaaaguaguuaguugcuuuugauugaguuauauagcaguuuuucauuuggucuucc

SEQ ID NO: 395002 - RNA, 63 nt, Homo Sapiens
gggucuaucuugcuuccuacuugauugcuccuaguuauauacaguugcuacauguaucgagcc

SEQ ID NO: 395003 - RNA, 63 nt, Homo Sapiens
uaaagagauacgaauuucuauauaaauacuauaguuauauagauaucuauaugucuauaagua

SEQ ID NO: 395004 - RNA, 63 nt, Homo Sapiens
uuugguuuuuuuaauaaaauguguuguuuuaguguuauauaucagguggggagaaguccgcug

SEQ ID NO: 395005 - RNA, 63 nt, Homo Sapiens
aguaagauauauuugugugcuaauauaauuguuguuauauagccuaaccauuguuauaaaggc

SEQ ID NO: 395006 - RNA, 63 nt, Homo Sapiens
aauaaaggucauucugaauagguuuaaaccauaguuauauaaaacugggaucugcaguaaggu

SEQ ID NO: 395007 - RNA, 64 nt, Homo Sapiens; identical to SEQ ID NO: 276902

SEQ ID NO: 395008 - RNA, 64 nt, Homo Sapiens; identical to SEQ ID NO: 276903

SEQ ID NO: 395009 - RNA, 64 nt, Homo Sapiens; identical to SEQ ID NO: 276904

SEQ ID NO: 395010 - RNA, 64 nt, Homo Sapiens; identical to SEQ ID NO: 276905

SEQ ID NO: 395011 - RNA, 64 nt, Homo Sapiens; identical to SEQ ID NO: 276906

SEQ ID NO: 395012 - RNA, 64 nt, Homo Sapiens; identical to SEQ ID NO: 276907

SEQ ID NO: 395013 - RNA, 64 nt, Homo Sapiens; identical to SEQ ID NO: 276908

SEQ ID NO: 395014 - RNA, 64 nt, Homo Sapiens; identical to SEQ ID NO: 276909

SEQ ID NO: 395015 - RNA, 64 nt, Homo Sapiens; identical to SEQ ID NO: 276910

SEQ ID NO: 395016 - RNA, 64 nt, Homo Sapiens; identical to SEQ ID NO: 276911

SEQ ID NO: 395017 - RNA, 64 nt, Homo Sapiens; identical to SEQ ID NO: 276912

SEQ ID NO: 395018 - RNA, 64 nt, Homo Sapiens; identical to SEQ ID NO: 276913

SEQ ID NO: 395019 - RNA, 64 nt, Homo Sapiens; identical to SEQ ID NO: 276914

SEQ ID NO: 395020 - RNA, 64 nt, Homo Sapiens; identical to SEQ ID NO: 276915

SEQ ID NO: 395021 - RNA, 64 nt, Homo Sapiens; identical to SEQ ID NO: 276916

SEQ ID NO: 395022 - RNA, 64 nt, Homo Sapiens; identical to SEQ ID NO: 276917

SEQ ID NO: 395023 - RNA, 64 nt, Homo Sapiens; identical to SEQ ID NO: 276918

SEQ ID NO: 395024 - RNA, 64 nt, Homo Sapiens; identical to SEQ ID NO: 276919

SEQ ID NO: 395025 - RNA, 64 nt, Homo Sapiens; identical to SEQ ID NO: 276920

SEQ ID NO: 395026 - RNA, 64 nt, Homo Sapiens; identical to SEQ ID NO: 276921

SEQ ID NO: 395027 - RNA, 64 nt, Homo Sapiens; identical to SEQ ID NO: 276922

SEQ ID NO: 395028 - RNA, 64 nt, Homo Sapiens; identical to SEQ ID NO: 276923

SEQ ID NO: 395029 - RNA, 64 nt, Homo Sapiens; identical to SEQ ID NO: 276924

SEQ ID NO: 395030 - RNA, 64 nt, Homo Sapiens; identical to SEQ ID NO: 276925

SEQ ID NO: 395031 - RNA, 64 nt, Homo Sapiens; identical to SEQ ID NO: 276926

SEQ ID NO: 395032 - RNA, 64 nt, Homo Sapiens; identical to SEQ ID NO: 276927

SEQ ID NO: 395033 - RNA, 64 nt, Homo Sapiens; identical to SEQ ID NO: 276928

SEQ ID NO: 395034 - RNA, 64 nt, Homo Sapiens; identical to SEQ ID NO: 276929

SEQ ID NO: 395035 - RNA, 64 nt, Homo Sapiens; identical to SEQ ID NO: 276930

SEQ ID NO: 395036 - RNA, 64 nt, Homo Sapiens; identical to SEQ ID NO: 276931

SEQ ID NO: 395037 - RNA, 64 nt, Homo Sapiens; identical to SEQ ID NO: 276932

SEQ ID NO: 395038 - RNA, 64 nt, Homo Sapiens; identical to SEQ ID NO: 276933

SEQ ID NO: 395039 - RNA, 64 nt, Homo Sapiens; identical to SEQ ID NO: 276934

SEQ ID NO: 395040 - RNA, 64 nt, Homo Sapiens; identical to SEQ ID NO: 276935

SEQ ID NO: 395041 - RNA, 64 nt, Homo Sapiens; identical to SEQ ID NO: 276936

SEQ ID NO: 395042 - RNA, 64 nt, Homo Sapiens; identical to SEQ ID NO: 276937

SEQ ID NO: 395043 - RNA, 64 nt, Homo Sapiens; identical to SEQ ID NO: 276938

SEQ ID NO: 395044 - RNA, 64 nt, Homo Sapiens; identical to SEQ ID NO: 276939

SEQ ID NO: 395045 - RNA, 64 nt, Homo Sapiens; identical to SEQ ID NO: 276940

SEQ ID NO: 395046 - RNA, 64 nt, Homo Sapiens; identical to SEQ ID NO: 276941

SEQ ID NO: 395047 - RNA, 56 nt, Homo Sapiens; identical to SEQ ID NO: 276942

SEQ ID NO: 395048 - RNA, 64 nt, Homo Sapiens; identical to SEQ ID NO: 276943

SEQ ID NO: 395049 - RNA, 64 nt, Homo Sapiens; identical to SEQ ID NO: 276944

SEQ ID NO: 395050 - RNA, 64 nt, Homo Sapiens; identical to SEQ ID NO: 276945

SEQ ID NO: 395051 - RNA, 64 nt, Homo Sapiens; identical to SEQ ID NO: 276946

SEQ ID NO: 395052 - RNA, 64 nt, Homo Sapiens; identical to SEQ ID NO: 276947

SEQ ID NO: 395053 - RNA, 64 nt, Homo Sapiens; identical to SEQ ID NO: 276948

SEQ ID NO: 395054 - RNA, 64 nt, Homo Sapiens; identical to SEQ ID NO: 276949

SEQ ID NO: 395055 - RNA, 64 nt, Homo Sapiens; identical to SEQ ID NO: 276950

SEQ ID NO: 395056 - RNA, 64 nt, Homo Sapiens; identical to SEQ ID NO: 276951

SEQ ID NO: 395057 - RNA, 64 nt, Homo Sapiens; identical to SEQ ID NO: 276952

SEQ ID NO: 395058 - RNA, 64 nt, Homo Sapiens; identical to SEQ ID NO: 276953

SEQ ID NO: 395059 - RNA, 64 nt, Homo Sapiens; identical to SEQ ID NO: 276954

SEQ ID NO: 395060 - RNA, 64 nt, Homo Sapiens; identical to SEQ ID NO: 276955

SEQ ID NO: 395061 - RNA, 64 nt, Homo Sapiens; identical to SEQ ID NO: 276956

SEQ ID NO: 395062 - RNA, 64 nt, Homo Sapiens; identical to SEQ ID NO: 276957

SEQ ID NO: 395063 - RNA, 64 nt, Homo Sapiens; identical to SEQ ID NO: 276958

SEQ ID NO: 395064 - RNA, 64 nt, Homo Sapiens; identical to SEQ ID NO: 276959

SEQ ID NO: 395065 - RNA, 64 nt, Homo Sapiens; identical to SEQ ID NO: 276960

SEQ ID NO: 395066 - RNA, 57 nt, Homo Sapiens; identical to SEQ ID NO: 276961

SEQ ID NO: 395067 - RNA, 64 nt, Homo Sapiens; identical to SEQ ID NO: 276962

SEQ ID NO: 395068 - RNA, 64 nt, Homo Sapiens; identical to SEQ ID NO: 276963

SEQ ID NO: 395069 - RNA, 64 nt, Homo Sapiens; identical to SEQ ID NO: 276964

SEQ ID NO: 395070 - RNA, 64 nt, Homo Sapiens; identical to SEQ ID NO: 276965

SEQ ID NO: 395071 - RNA, 64 nt, Homo Sapiens; identical to SEQ ID NO: 276966

SEQ ID NO: 395072 - RNA, 64 nt, Homo Sapiens; identical to SEQ ID NO: 276967

SEQ ID NO: 395073 - RNA, 64 nt, Homo Sapiens; identical to SEQ ID NO: 276968

SEQ ID NO: 395074 - RNA, 64 nt, Homo Sapiens; identical to SEQ ID NO: 276969

SEQ ID NO: 395075 - RNA, 64 nt, Homo Sapiens; identical to SEQ ID NO: 276970

SEQ ID NO: 395076 - RNA, 64 nt, Homo Sapiens; identical to SEQ ID NO: 276971

SEQ ID NO: 395077 - RNA, 64 nt, Homo Sapiens; identical to SEQ ID NO: 276972

SEQ ID NO: 395078 - RNA, 64 nt, Homo Sapiens; identical to SEQ ID NO: 276973

SEQ ID NO: 395079 - RNA, 64 nt, Homo Sapiens; identical to SEQ ID NO: 276974

SEQ ID NO: 395080 - RNA, 64 nt, Homo Sapiens; identical to SEQ ID NO: 276975

SEQ ID NO: 395081 - RNA, 64 nt, Homo Sapiens; identical to SEQ ID NO: 276976

SEQ ID NO: 395082 - RNA, 64 nt, Homo Sapiens; identical to SEQ ID NO: 276977

SEQ ID NO: 395083 - RNA, 64 nt, Homo Sapiens; identical to SEQ ID NO: 276978

SEQ ID NO: 395084 - RNA, 64 nt, Homo Sapiens; identical to SEQ ID NO: 276979

SEQ ID NO: 395085 - RNA, 64 nt, Homo Sapiens; identical to SEQ ID NO: 276980

SEQ ID NO: 395086 - RNA, 64 nt, Homo Sapiens; identical to SEQ ID NO: 276981

SEQ ID NO: 395087 - RNA, 64 nt, Homo Sapiens; identical to SEQ ID NO: 276982

SEQ ID NO: 395088 - RNA, 64 nt, Homo Sapiens; identical to SEQ ID NO: 276983

SEQ ID NO: 395089 - RNA, 64 nt, Homo Sapiens; identical to SEQ ID NO: 276984

SEQ ID NO: 395090 - RNA, 64 nt, Homo Sapiens; identical to SEQ ID NO: 276985

SEQ ID NO: 395091 - RNA, 64 nt, Homo Sapiens; identical to SEQ ID NO: 276986

SEQ ID NO: 395092 - RNA, 64 nt, Homo Sapiens; identical to SEQ ID NO: 276987

SEQ ID NO: 395093 - RNA, 64 nt, Homo Sapiens; identical to SEQ ID NO: 276988

SEQ ID NO: 395094 - RNA, 64 nt, Homo Sapiens; identical to SEQ ID NO: 247574

SEQ ID NO: 395095 - RNA, 64 nt, Homo Sapiens; identical to SEQ ID NO: 247575

SEQ ID NO: 395096 - RNA, 64 nt, Homo Sapiens; identical to SEQ ID NO: 247576

SEQ ID NO: 395097 - RNA, 64 nt, Homo Sapiens; identical to SEQ ID NO: 247577

SEQ ID NO: 395098 - RNA, 64 nt, Homo Sapiens; identical to SEQ ID NO: 247578

SEQ ID NO: 395099 - RNA, 64 nt, Homo Sapiens; identical to SEQ ID NO: 247579

SEQ ID NO: 395100 - RNA, 64 nt, Homo Sapiens; identical to SEQ ID NO: 247580

SEQ ID NO: 395101 - RNA, 64 nt, Homo Sapiens; identical to SEQ ID NO: 247581

SEQ ID NO: 395102 - RNA, 64 nt, Homo Sapiens; identical to SEQ ID NO: 247582

SEQ ID NO: 395103 - RNA, 64 nt, Homo Sapiens; identical to SEQ ID NO: 247583

SEQ ID NO: 395104 - RNA, 64 nt, Homo Sapiens; identical to SEQ ID NO: 247584

SEQ ID NO: 395105 - RNA, 64 nt, Homo Sapiens; identical to SEQ ID NO: 247585

SEQ ID NO: 395106 - RNA, 64 nt, Homo Sapiens; identical to SEQ ID NO: 247586

SEQ ID NO: 395107 - RNA, 64 nt, Homo Sapiens; identical to SEQ ID NO: 247587

SEQ ID NO: 395108 - RNA, 64 nt, Homo Sapiens; identical to SEQ ID NO: 247588

SEQ ID NO: 395109 - RNA, 64 nt, Homo Sapiens; identical to SEQ ID NO: 247589

SEQ ID NO: 395110 - RNA, 64 nt, Homo Sapiens; identical to SEQ ID NO: 247590

SEQ ID NO: 395111 - RNA, 64 nt, Homo Sapiens; identical to SEQ ID NO: 247591

SEQ ID NO: 395112 - RNA, 64 nt, Homo Sapiens; identical to SEQ ID NO: 247592

SEQ ID NO: 395113 - RNA, 64 nt, Homo Sapiens; identical to SEQ ID NO: 247593

SEQ ID NO: 395114 - RNA, 64 nt, Homo Sapiens; identical to SEQ ID NO: 247594

SEQ ID NO: 395115 - RNA, 64 nt, Homo Sapiens; identical to SEQ ID NO: 247595

SEQ ID NO: 395116 - RNA, 64 nt, Homo Sapiens; identical to SEQ ID NO: 247596

SEQ ID NO: 395117 - RNA, 64 nt, Homo Sapiens; identical to SEQ ID NO: 247597

SEQ ID NO: 395118 - RNA, 64 nt, Homo Sapiens; identical to SEQ ID NO: 276902

SEQ ID NO: 395119 - RNA, 64 nt, Homo Sapiens; identical to SEQ ID NO: 276903

SEQ ID NO: 395120 - RNA, 64 nt, Homo Sapiens; identical to SEQ ID NO: 276904

SEQ ID NO: 395121 - RNA, 64 nt, Homo Sapiens; identical to SEQ ID NO: 276905

SEQ ID NO: 395122 - RNA, 64 nt, Homo Sapiens; identical to SEQ ID NO: 276906

SEQ ID NO: 395123 - RNA, 64 nt, Homo Sapiens; identical to SEQ ID NO: 276907

SEQ ID NO: 395124 - RNA, 64 nt, Homo Sapiens; identical to SEQ ID NO: 276908

SEQ ID NO: 395125 - RNA, 64 nt, Homo Sapiens; identical to SEQ ID NO: 276909

SEQ ID NO: 395126 - RNA, 64 nt, Homo Sapiens; identical to SEQ ID NO: 276910

SEQ ID NO: 395127 - RNA, 64 nt, Homo Sapiens; identical to SEQ ID NO: 276911

SEQ ID NO: 395128 - RNA, 64 nt, Homo Sapiens; identical to SEQ ID NO: 276912

SEQ ID NO: 395129 - RNA, 64 nt, Homo Sapiens; identical to SEQ ID NO: 276913

SEQ ID NO: 395130 - RNA, 64 nt, Homo Sapiens; identical to SEQ ID NO: 276914

SEQ ID NO: 395131 - RNA, 64 nt, Homo Sapiens; identical to SEQ ID NO: 276915

SEQ ID NO: 395132 - RNA, 64 nt, Homo Sapiens; identical to SEQ ID NO: 276916

SEQ ID NO: 395133 - RNA, 64 nt, Homo Sapiens; identical to SEQ ID NO: 276917

SEQ ID NO: 395134 - RNA, 64 nt, Homo Sapiens; identical to SEQ ID NO: 276918

SEQ ID NO: 395135 - RNA, 64 nt, Homo Sapiens; identical to SEQ ID NO: 276919

SEQ ID NO: 395136 - RNA, 64 nt, Homo Sapiens; identical to SEQ ID NO: 276920

SEQ ID NO: 395137 - RNA, 64 nt, Homo Sapiens; identical to SEQ ID NO: 276921

SEQ ID NO: 395138 - RNA, 64 nt, Homo Sapiens; identical to SEQ ID NO: 276922

SEQ ID NO: 395139 - RNA, 64 nt, Homo Sapiens; identical to SEQ ID NO: 276923

SEQ ID NO: 395140 - RNA, 64 nt, Homo Sapiens; identical to SEQ ID NO: 276924

SEQ ID NO: 395141 - RNA, 64 nt, Homo Sapiens; identical to SEQ ID NO: 276925

SEQ ID NO: 395142 - RNA, 64 nt, Homo Sapiens; identical to SEQ ID NO: 276926

SEQ ID NO: 395143 - RNA, 64 nt, Homo Sapiens; identical to SEQ ID NO: 276927

SEQ ID NO: 395144 - RNA, 64 nt, Homo Sapiens; identical to SEQ ID NO: 276928

SEQ ID NO: 395145 - RNA, 64 nt, Homo Sapiens; identical to SEQ ID NO: 276929

SEQ ID NO: 395146 - RNA, 64 nt, Homo Sapiens; identical to SEQ ID NO: 276930

SEQ ID NO: 395147 - RNA, 64 nt, Homo Sapiens; identical to SEQ ID NO: 276931

SEQ ID NO: 395148 - RNA, 64 nt, Homo Sapiens; identical to SEQ ID NO: 276932

SEQ ID NO: 395149 - RNA, 64 nt, Homo Sapiens; identical to SEQ ID NO: 276933

SEQ ID NO: 395150 - RNA, 64 nt, Homo Sapiens; identical to SEQ ID NO: 276934

SEQ ID NO: 395151 - RNA, 64 nt, Homo Sapiens; identical to SEQ ID NO: 276935

SEQ ID NO: 395152 - RNA, 64 nt, Homo Sapiens; identical to SEQ ID NO: 276936

SEQ ID NO: 395153 - RNA, 64 nt, Homo Sapiens; identical to SEQ ID NO: 276937

SEQ ID NO: 395154 - RNA, 64 nt, Homo Sapiens; identical to SEQ ID NO: 276938

SEQ ID NO: 395155 - RNA, 64 nt, Homo Sapiens; identical to SEQ ID NO: 276939

SEQ ID NO: 395156 - RNA, 64 nt, Homo Sapiens; identical to SEQ ID NO: 276940

SEQ ID NO: 395157 - RNA, 64 nt, Homo Sapiens; identical to SEQ ID NO: 276941

SEQ ID NO: 395158 - RNA, 56 nt, Homo Sapiens; identical to SEQ ID NO: 276942

SEQ ID NO: 395159 - RNA, 64 nt, Homo Sapiens; identical to SEQ ID NO: 276943

SEQ ID NO: 395160 - RNA, 64 nt, Homo Sapiens; identical to SEQ ID NO: 276944

SEQ ID NO: 395161 - RNA, 64 nt, Homo Sapiens; identical to SEQ ID NO: 276945

SEQ ID NO: 395162 - RNA, 64 nt, Homo Sapiens; identical to SEQ ID NO: 276946

SEQ ID NO: 395163 - RNA, 64 nt, Homo Sapiens; identical to SEQ ID NO: 276947

SEQ ID NO: 395164 - RNA, 64 nt, Homo Sapiens; identical to SEQ ID NO: 276948

SEQ ID NO: 395165 - RNA, 64 nt, Homo Sapiens; identical to SEQ ID NO: 276949

SEQ ID NO: 395166 - RNA, 64 nt, Homo Sapiens; identical to SEQ ID NO: 276950

SEQ ID NO: 395167 - RNA, 64 nt, Homo Sapiens; identical to SEQ ID NO: 276951

SEQ ID NO: 395168 - RNA, 64 nt, Homo Sapiens; identical to SEQ ID NO: 276952

SEQ ID NO: 395169 - RNA, 64 nt, Homo Sapiens; identical to SEQ ID NO: 276953

SEQ ID NO: 395170 - RNA, 64 nt, Homo Sapiens; identical to SEQ ID NO: 276954

SEQ ID NO: 395171 - RNA, 64 nt, Homo Sapiens; identical to SEQ ID NO: 276955

SEQ ID NO: 395172 - RNA, 64 nt, Homo Sapiens; identical to SEQ ID NO: 276956

SEQ ID NO: 395173 - RNA, 64 nt, Homo Sapiens; identical to SEQ ID NO: 276957

SEQ ID NO: 395174 - RNA, 64 nt, Homo Sapiens; identical to SEQ ID NO: 276958

SEQ ID NO: 395175 - RNA, 64 nt, Homo Sapiens; identical to SEQ ID NO: 276959

SEQ ID NO: 395176 - RNA, 64 nt, Homo Sapiens; identical to SEQ ID NO: 276960

SEQ ID NO: 395177 - RNA, 57 nt, Homo Sapiens; identical to SEQ ID NO: 276961

SEQ ID NO: 395178 - RNA, 64 nt, Homo Sapiens; identical to SEQ ID NO: 276962

SEQ ID NO: 395179 - RNA, 64 nt, Homo Sapiens; identical to SEQ ID NO: 276963

SEQ ID NO: 395180 - RNA, 64 nt, Homo Sapiens; identical to SEQ ID NO: 276964

SEQ ID NO: 395181 - RNA, 64 nt, Homo Sapiens; identical to SEQ ID NO: 276965

SEQ ID NO: 395182 - RNA, 64 nt, Homo Sapiens; identical to SEQ ID NO: 276966

SEQ ID NO: 395183 - RNA, 64 nt, Homo Sapiens; identical to SEQ ID NO: 276967

SEQ ID NO: 395184 - RNA, 64 nt, Homo Sapiens; identical to SEQ ID NO: 276968

SEQ ID NO: 395185 - RNA, 64 nt, Homo Sapiens; identical to SEQ ID NO: 276969

SEQ ID NO: 395186 - RNA, 64 nt, Homo Sapiens; identical to SEQ ID NO: 276970

SEQ ID NO: 395187 - RNA, 64 nt, Homo Sapiens; identical to SEQ ID NO: 276971

SEQ ID NO: 395188 - RNA, 64 nt, Homo Sapiens; identical to SEQ ID NO: 276972

SEQ ID NO: 395189 - RNA, 64 nt, Homo Sapiens; identical to SEQ ID NO: 276973

SEQ ID NO: 395190 - RNA, 64 nt, Homo Sapiens; identical to SEQ ID NO: 276974

SEQ ID NO: 395191 - RNA, 64 nt, Homo Sapiens; identical to SEQ ID NO: 276975

SEQ ID NO: 395192 - RNA, 64 nt, Homo Sapiens; identical to SEQ ID NO: 276976

SEQ ID NO: 395193 - RNA, 64 nt, Homo Sapiens; identical to SEQ ID NO: 276977

SEQ ID NO: 395194 - RNA, 64 nt, Homo Sapiens; identical to SEQ ID NO: 276978

SEQ ID NO: 395195 - RNA, 64 nt, Homo Sapiens; identical to SEQ ID NO: 276979

SEQ ID NO: 395196 - RNA, 64 nt, Homo Sapiens; identical to SEQ ID NO: 276980

SEQ ID NO: 395197 - RNA, 64 nt, Homo Sapiens; identical to SEQ ID NO: 276981

SEQ ID NO: 395198 - RNA, 64 nt, Homo Sapiens; identical to SEQ ID NO: 276982

SEQ ID NO: 395199 - RNA, 64 nt, Homo Sapiens; identical to SEQ ID NO: 276983

SEQ ID NO: 395200 - RNA, 64 nt, Homo Sapiens; identical to SEQ ID NO: 276984

SEQ ID NO: 395201 - RNA, 64 nt, Homo Sapiens; identical to SEQ ID NO: 276985

SEQ ID NO: 395202 - RNA, 64 nt, Homo Sapiens; identical to SEQ ID NO: 276986

SEQ ID NO: 395203 - RNA, 64 nt, Homo Sapiens; identical to SEQ ID NO: 276987

SEQ ID NO: 395204 - RNA, 64 nt, Homo Sapiens; identical to SEQ ID NO: 276988

SEQ ID NO: 395205 - RNA, 64 nt, Homo Sapiens; identical to SEQ ID NO: 247574

SEQ ID NO: 395206 - RNA, 64 nt, Homo Sapiens; identical to SEQ ID NO: 247575

SEQ ID NO: 395207 - RNA, 64 nt, Homo Sapiens; identical to SEQ ID NO: 247576

SEQ ID NO: 395208 - RNA, 64 nt, Homo Sapiens; identical to SEQ ID NO: 247577

SEQ ID NO: 395209 - RNA, 64 nt, Homo Sapiens; identical to SEQ ID NO: 247578

SEQ ID NO: 395210 - RNA, 64 nt, Homo Sapiens; identical to SEQ ID NO: 247579

SEQ ID NO: 395211 - RNA, 64 nt, Homo Sapiens; identical to SEQ ID NO: 247580

SEQ ID NO: 395212 - RNA, 64 nt, Homo Sapiens; identical to SEQ ID NO: 247581

SEQ ID NO: 395213 - RNA, 64 nt, Homo Sapiens; identical to SEQ ID NO: 247582

SEQ ID NO: 395214 - RNA, 64 nt, Homo Sapiens; identical to SEQ ID NO: 247583

SEQ ID NO: 395215 - RNA, 64 nt, Homo Sapiens; identical to SEQ ID NO: 247584

SEQ ID NO: 395216 - RNA, 64 nt, Homo Sapiens; identical to SEQ ID NO: 247585

SEQ ID NO: 395217 - RNA, 64 nt, Homo Sapiens; identical to SEQ ID NO: 247586

SEQ ID NO: 395218 - RNA, 64 nt, Homo Sapiens; identical to SEQ ID NO: 247587

SEQ ID NO: 395219 - RNA, 64 nt, Homo Sapiens; identical to SEQ ID NO: 247588

SEQ ID NO: 395220 - RNA, 64 nt, Homo Sapiens; identical to SEQ ID NO: 247589

SEQ ID NO: 395221 - RNA, 64 nt, Homo Sapiens; identical to SEQ ID NO: 247590

SEQ ID NO: 395222 - RNA, 64 nt, Homo Sapiens; identical to SEQ ID NO: 247591

SEQ ID NO: 395223 - RNA, 64 nt, Homo Sapiens; identical to SEQ ID NO: 247592

SEQ ID NO: 395224 - RNA, 64 nt, Homo Sapiens; identical to SEQ ID NO: 247593

SEQ ID NO: 395225 - RNA, 64 nt, Homo Sapiens; identical to SEQ ID NO: 247594

SEQ ID NO: 395226 - RNA, 64 nt, Homo Sapiens; identical to SEQ ID NO: 247595

SEQ ID NO: 395227 - RNA, 64 nt, Homo Sapiens; identical to SEQ ID NO: 247596

SEQ ID NO: 395228 - RNA, 64 nt, Homo Sapiens; identical to SEQ ID NO: 247597

SEQ ID NO: 395229 - RNA, 64 nt, Homo Sapiens
uuuauugagcaucuucuacauuuuaaauaauaaugauaacuaucaacaccaucucagcuuuaac

SEQ ID NO: 395230 - RNA, 64 nt, Homo Sapiens
aauuguucacaauguggugguuauuugaaauaaugauaacuaucaauauuuuguaaaagaaugu

SEQ ID NO: 395231 - RNA, 64 nt, Homo Sapiens; identical to SEQ ID NO: 99180

SEQ ID NO: 395232 - RNA, 64 nt, Homo Sapiens; identical to SEQ ID NO: 99181

SEQ ID NO: 395233 - RNA, 64 nt, Homo Sapiens; identical to SEQ ID NO: 99182

SEQ ID NO: 395234 - RNA, 64 nt, Homo Sapiens; identical to SEQ ID NO: 99183

SEQ ID NO: 395235 - RNA, 64 nt, Homo Sapiens; identical to SEQ ID NO: 99184

SEQ ID NO: 395236 - RNA, 64 nt, Homo Sapiens; identical to SEQ ID NO: 99185

SEQ ID NO: 395237 - RNA, 64 nt, Homo Sapiens; identical to SEQ ID NO: 99186

SEQ ID NO: 395238 - RNA, 64 nt, Homo Sapiens; identical to SEQ ID NO: 99187

SEQ ID NO: 395239 - RNA, 64 nt, Homo Sapiens; identical to SEQ ID NO: 99188

SEQ ID NO: 395240 - RNA, 64 nt, Homo Sapiens; identical to SEQ ID NO: 99189

SEQ ID NO: 395241 - RNA, 64 nt, Homo Sapiens; identical to SEQ ID NO: 99190

SEQ ID NO: 395242 - RNA, 64 nt, Homo Sapiens; identical to SEQ ID NO: 99191

SEQ ID NO: 395243 - RNA, 64 nt, Homo Sapiens; identical to SEQ ID NO: 99192

SEQ ID NO: 395244 - RNA, 64 nt, Homo Sapiens; identical to SEQ ID NO: 99193

SEQ ID NO: 395245 - RNA, 64 nt, Homo Sapiens; identical to SEQ ID NO: 99194

SEQ ID NO: 395246 - RNA, 64 nt, Homo Sapiens; identical to SEQ ID NO: 99195

SEQ ID NO: 395247 - RNA, 64 nt, Homo Sapiens; identical to SEQ ID NO: 99196

SEQ ID NO: 395248 - RNA, 64 nt, Homo Sapiens; identical to SEQ ID NO: 99197

SEQ ID NO: 395249 - RNA, 64 nt, Homo Sapiens; identical to SEQ ID NO: 99198

SEQ ID NO: 395250 - RNA, 64 nt, Homo Sapiens; identical to SEQ ID NO: 99199

SEQ ID NO: 395251 - RNA, 64 nt, Homo Sapiens; identical to SEQ ID NO: 99200

SEQ ID NO: 395252 - RNA, 64 nt, Homo Sapiens; identical to SEQ ID NO: 99201

SEQ ID NO: 395253 - RNA, 64 nt, Homo Sapiens; identical to SEQ ID NO: 99202

SEQ ID NO: 395254 - RNA, 64 nt, Homo Sapiens; identical to SEQ ID NO: 99203

SEQ ID NO: 395255 - RNA, 64 nt, Homo Sapiens; identical to SEQ ID NO: 99204

SEQ ID NO: 395256 - RNA, 64 nt, Homo Sapiens; identical to SEQ ID NO: 99205

SEQ ID NO: 395257 - RNA, 64 nt, Homo Sapiens; identical to SEQ ID NO: 99206

SEQ ID NO: 395258 - RNA, 64 nt, Homo Sapiens; identical to SEQ ID NO: 99207

SEQ ID NO: 395259 - RNA, 64 nt, Homo Sapiens; identical to SEQ ID NO: 99208

SEQ ID NO: 395260 - RNA, 64 nt, Homo Sapiens; identical to SEQ ID NO: 99209

SEQ ID NO: 395261 - RNA, 64 nt, Homo Sapiens; identical to SEQ ID NO: 99210

SEQ ID NO: 395262 - RNA, 64 nt, Homo Sapiens; identical to SEQ ID NO: 99211

SEQ ID NO: 395263 - RNA, 64 nt, Homo Sapiens; identical to SEQ ID NO: 99212

SEQ ID NO: 395264 - RNA, 64 nt, Homo Sapiens; identical to SEQ ID NO: 99213

SEQ ID NO: 395265 - RNA, 64 nt, Homo Sapiens; identical to SEQ ID NO: 99214

SEQ ID NO: 395266 - RNA, 64 nt, Homo Sapiens; identical to SEQ ID NO: 99215

SEQ ID NO: 395267 - RNA, 64 nt, Homo Sapiens; identical to SEQ ID NO: 99216

SEQ ID NO: 395268 - RNA, 64 nt, Homo Sapiens; identical to SEQ ID NO: 99217

SEQ ID NO: 395269 - RNA, 64 nt, Homo Sapiens; identical to SEQ ID NO: 243585

SEQ ID NO: 395270 - RNA, 64 nt, Homo Sapiens; identical to SEQ ID NO: 243586

SEQ ID NO: 395271 - RNA, 64 nt, Homo Sapiens; identical to SEQ ID NO: 243587

SEQ ID NO: 395272 - RNA, 64 nt, Homo Sapiens; identical to SEQ ID NO: 243588

SEQ ID NO: 395273 - RNA, 64 nt, Homo Sapiens; identical to SEQ ID NO: 243589

SEQ ID NO: 395274 - RNA, 64 nt, Homo Sapiens; identical to SEQ ID NO: 243590

SEQ ID NO: 395275 - RNA, 64 nt, Homo Sapiens; identical to SEQ ID NO: 243591

SEQ ID NO: 395276 - RNA, 64 nt, Homo Sapiens; identical to SEQ ID NO: 243592

SEQ ID NO: 395277 - RNA, 64 nt, Homo Sapiens; identical to SEQ ID NO: 243593

SEQ ID NO: 395278 - RNA, 64 nt, Homo Sapiens; identical to SEQ ID NO: 243594

SEQ ID NO: 395279 - RNA, 64 nt, Homo Sapiens; identical to SEQ ID NO: 243595

SEQ ID NO: 395280 - RNA, 64 nt, Homo Sapiens; identical to SEQ ID NO: 243596

SEQ ID NO: 395281 - RNA, 64 nt, Homo Sapiens; identical to SEQ ID NO: 243597

SEQ ID NO: 395282 - RNA, 64 nt, Homo Sapiens; identical to SEQ ID NO: 243598

SEQ ID NO: 395283 - RNA, 64 nt, Homo Sapiens; identical to SEQ ID NO: 243599

SEQ ID NO: 395284 - RNA, 64 nt, Homo Sapiens; identical to SEQ ID NO: 243600

SEQ ID NO: 395285 - RNA, 64 nt, Homo Sapiens; identical to SEQ ID NO: 243601

SEQ ID NO: 395286 - RNA, 64 nt, Homo Sapiens; identical to SEQ ID NO: 243602

SEQ ID NO: 395287 - RNA, 64 nt, Homo Sapiens; identical to SEQ ID NO: 243603

SEQ ID NO: 395288 - RNA, 64 nt, Homo Sapiens; identical to SEQ ID NO: 243604

SEQ ID NO: 395289 - RNA, 64 nt, Homo Sapiens; identical to SEQ ID NO: 243605

SEQ ID NO: 395290 - RNA, 64 nt, Homo Sapiens; identical to SEQ ID NO: 243606

SEQ ID NO: 395291 - RNA, 64 nt, Homo Sapiens; identical to SEQ ID NO: 243607

SEQ ID NO: 395292 - RNA, 64 nt, Homo Sapiens; identical to SEQ ID NO: 243608

SEQ ID NO: 395293 - RNA, 64 nt, Homo Sapiens; identical to SEQ ID NO: 243609

SEQ ID NO: 395294 - RNA, 64 nt, Homo Sapiens; identical to SEQ ID NO: 243610

SEQ ID NO: 395295 - RNA, 57 nt, Homo Sapiens; identical to SEQ ID NO: 243611

SEQ ID NO: 395296 - RNA, 64 nt, Homo Sapiens; identical to SEQ ID NO: 243612

SEQ ID NO: 395297 - RNA, 64 nt, Homo Sapiens; identical to SEQ ID NO: 243613

SEQ ID NO: 395298 - RNA, 64 nt, Homo Sapiens; identical to SEQ ID NO: 243614

SEQ ID NO: 395299 - RNA, 64 nt, Homo Sapiens; identical to SEQ ID NO: 243615

SEQ ID NO: 395300 - RNA, 64 nt, Homo Sapiens; identical to SEQ ID NO: 243616

SEQ ID NO: 395301 - RNA, 64 nt, Homo Sapiens; identical to SEQ ID NO: 243617

SEQ ID NO: 395302 - RNA, 64 nt, Homo Sapiens; identical to SEQ ID NO: 243618

SEQ ID NO: 395303 - RNA, 64 nt, Homo Sapiens; identical to SEQ ID NO: 243619

SEQ ID NO: 395304 - RNA, 64 nt, Homo Sapiens; identical to SEQ ID NO: 243620

SEQ ID NO: 395305 - RNA, 64 nt, Homo Sapiens; identical to SEQ ID NO: 243621

SEQ ID NO: 395306 - RNA, 64 nt, Homo Sapiens; identical to SEQ ID NO: 243622

SEQ ID NO: 395307 - RNA, 64 nt, Homo Sapiens; identical to SEQ ID NO: 243623

SEQ ID NO: 395308 - RNA, 64 nt, Homo Sapiens; identical to SEQ ID NO: 243624

SEQ ID NO: 395309 - RNA, 64 nt, Homo Sapiens; identical to SEQ ID NO: 243625

SEQ ID NO: 395310 - RNA, 64 nt, Homo Sapiens; identical to SEQ ID NO: 243626

SEQ ID NO: 395311 - RNA, 64 nt, Homo Sapiens; identical to SEQ ID NO: 243627

SEQ ID NO: 395312 - RNA, 64 nt, Homo Sapiens; identical to SEQ ID NO: 243628

SEQ ID NO: 395313 - RNA, 64 nt, Homo Sapiens; identical to SEQ ID NO: 243629

SEQ ID NO: 395314 - RNA, 64 nt, Homo Sapiens; identical to SEQ ID NO: 243630

SEQ ID NO: 395315 - RNA, 64 nt, Homo Sapiens; identical to SEQ ID NO: 243631

SEQ ID NO: 395316 - RNA, 64 nt, Homo Sapiens; identical to SEQ ID NO: 243632

SEQ ID NO: 395317 - RNA, 64 nt, Homo Sapiens; identical to SEQ ID NO: 243633

SEQ ID NO: 395318 - RNA, 59 nt, Homo Sapiens; identical to SEQ ID NO: 243634

SEQ ID NO: 395319 - RNA, 64 nt, Homo Sapiens; identical to SEQ ID NO: 243635

SEQ ID NO: 395320 - RNA, 64 nt, Homo Sapiens; identical to SEQ ID NO: 243636

SEQ ID NO: 395321 - RNA, 64 nt, Homo Sapiens; identical to SEQ ID NO: 243637

SEQ ID NO: 395322 - RNA, 64 nt, Homo Sapiens; identical to SEQ ID NO: 243638

SEQ ID NO: 395323 - RNA, 64 nt, Homo Sapiens; identical to SEQ ID NO: 243639

SEQ ID NO: 395324 - RNA, 64 nt, Homo Sapiens; identical to SEQ ID NO: 243640

SEQ ID NO: 395325 - RNA, 64 nt, Homo Sapiens; identical to SEQ ID NO: 243641

SEQ ID NO: 395326 - RNA, 64 nt, Homo Sapiens; identical to SEQ ID NO: 243642

SEQ ID NO: 395327 - RNA, 64 nt, Homo Sapiens; identical to SEQ ID NO: 243643

SEQ ID NO: 395328 - RNA, 60 nt, Homo Sapiens
agcuaccuuccuguguaugcugagguacagaagccccauguguaccuacagagcagccag

SEQ ID NO: 395329 - RNA, 60 nt, Homo Sapiens
aagaagccacugguucuaggcauuucugggaagccccagggacugcaaguggccauuacc

SEQ ID NO: 395330 - RNA, 60 nt, Homo Sapiens
guuuuuaauucaguccuacaaaauggugguaagccccagucucaggggucacccugucuu

SEQ ID NO: 395331 - RNA, 60 nt, Homo Sapiens
uuuugaggcccuaggccugcugucuuuuugaagccccacauucugaauuugucagauugu

SEQ ID NO: 395332 - RNA, 60 nt, Homo Sapiens
uuuucuugucuuuaucuaaucaauuuccccaagccccauuccuuaaaaccccagaagccc

SEQ ID NO: 395333 - RNA, 60 nt, Homo Sapiens
uuccccaagccccauuuuuuaaaaccccagaagccccaauguucuuucagcaugcuccuu

SEQ ID NO: 395334 - RNA, 60 nt, Homo Sapiens
aggggagucggaagagcuuguaguguuaggaagccccagcgaugaaaaaagagucuauuu

SEQ ID NO: 395335 - RNA, 60 nt, Homo Sapiens
gcucugccuggaaaccugguguuugugucgaagccccagucccgacaagccuuucugaca

SEQ ID NO: 395336 - RNA, 60 nt, Homo Sapiens
aaauuccuguuacccgcugaaggcaaggaaaagccccacagucauuuccacaugaaggag

SEQ ID NO: 395337 - RNA, 60 nt, Homo Sapiens
ugucaacuaaaagagacggaagguuuccucaagccccauuauaaugucaacagucacaac

SEQ ID NO: 395338 - RNA, 60 nt, Homo Sapiens
cggcguggggacuggacagaaaaccacugcaagccccaaggagccagcugaagccuccca

SEQ ID NO: 395339 - RNA, 60 nt, Homo Sapiens
caucccucaccugccaguuauguggcugccaagccccacaggcugucaugguggcucuug

SEQ ID NO: 395340 - RNA, 60 nt, Homo Sapiens
gaguggcucgagcccugggggugcuccuggaagccccaagagcauccaggauugccuccc

SEQ ID NO: 395341 - RNA, 60 nt, Homo Sapiens
ccggcucugcccugcacauccuguugagccaagccccagugacccggagagcuggccuga

SEQ ID NO: 395342 - RNA, 60 nt, Homo Sapiens
cccccugccaccgggcgauccacacuucagaagccccaucccgggcauaaggccccugac

SEQ ID NO: 395343 - RNA, 60 nt, Homo Sapiens
cuucccgccuccgggcauaauacacugcagaagccccauccucugcauaaggccccuggg

SEQ ID NO: 395344 - RNA, 60 nt, Homo Sapiens
ugccuuccuuuuggauucccccugcccuccaagccccagcggugugccgauaccuccucg

SEQ ID NO: 395345 - RNA, 60 nt, Homo Sapiens
uucucuuuucuuauugaggagaaggaagaaaagccccaggacuaacuuccagggugccaa

SEQ ID NO: 395346 - RNA, 60 nt, Homo Sapiens
acuugagcaugugaauauucucacggagagaagccccagcgagauuuuccggugaauacg

SEQ ID NO: 395347 - RNA, 60 nt, Homo Sapiens
cuuucaucacggaaacagaccccccgagagaagccccaacgagauuuuccggugaauacg

SEQ ID NO: 395348 - RNA, 60 nt, Homo Sapiens
auguagcaaaagcauuucuuaaaaagaaaaaagccccagcggagugagacucccucucaa

SEQ ID NO: 395349 - RNA, 60 nt, Homo Sapiens
auggccgggcaugguggcucguucuuagaaaagccccagcuuacccuccggugugcuugu

SEQ ID NO: 395350 - RNA, 60 nt, Homo Sapiens
agagaaggccggagggagggugggugugugaagccccagcgaacauucccugcucuguac

SEQ ID NO: 395351 - RNA, 60 nt, Homo Sapiens
ccccaccuguccuuccucuaagggaguaggaagccccauuuugggccucccaugggccca

SEQ ID NO: 395352 - RNA, 60 nt, Homo Sapiens
ugguuuucuccugauaagaagaaaggaagaaagccccagacgcuugguuuuucucagaac

SEQ ID NO: 395353 - RNA, 60 nt, Homo Sapiens
uauacauuaccuuguagcagcaguaccuggaagccccagcccgucacagaaguguggagg

SEQ ID NO: 395354 - RNA, 64 nt, Homo Sapiens
gcccccaugcaggcagccugguacuaccccaggacgcaugcaggcagggcccccacaggagcgu

SEQ ID NO: 395355 - RNA, 64 nt, Homo Sapiens
gcccccacaggagcguguacguacuaccccaggacgcaugcaggcagggcccccacaggagcgu

SEQ ID NO: 395356 - RNA, 64 nt, Homo Sapiens
gcccccacaggagcguguacauccccggaccggacgcaugcaggcccccacaggagcguguccu

SEQ ID NO: 395357 - RNA, 64 nt, Homo Sapiens
gcccccacaggagcguguccguacuaccccaggacgcaugcaggcagggcccccacuggagcgu

SEQ ID NO: 395358 - RNA, 64 nt, Homo Sapiens
gcccccacuggagcguguacguacuaccccaggacgcaugcaggcagggcccccacaggagcgu

SEQ ID NO: 395359 - RNA, 64 nt, Homo Sapiens
gcccccacaggagcguguacguacuaccccagaacgcaugcaggcagggcccccacaggagcgu

SEQ ID NO: 395360 - RNA, 64 nt, Homo Sapiens
gcccccacaggagcguguacguccuaucccuggacgcaugcaggcagggcccccacaggagcau

SEQ ID NO: 395361 - RNA, 64 nt, Homo Sapiens
gcccccacaggagcauguccguccuauccccggacgcaugcaggcagggcccccacaggagcgu

SEQ ID NO: 395362 - RNA, 64 nt, Homo Sapiens
gcccccacaggagcguguccguccuauccccggacgcaugcagggaacggccugagaggagcgu

SEQ ID NO: 395363 - RNA, 64 nt, Homo Sapiens
cuuugcuuaaacuacaaacacaagcaaaacuucacggggucauacuacauacaagcauaagcaa

SEQ ID NO: 395364 - RNA, 64 nt, Homo Sapiens
uuccauccaggacuucucuuacacuuggggguagcggggucaggacaaucaucucaguccugca

SEQ ID NO: 395365 - RNA, 64 nt, Homo Sapiens
agccccuggaugucgaccucgugccuuuggugggcggggucaaguuuuggaaaccaauuaaaau

SEQ ID NO: 395366 - RNA, 64 nt, Homo Sapiens
cugcuucuugcccugcuguguggugcgguggcgccggggucacccugcgcugccccuguggggu

SEQ ID NO: 395367 - RNA, 64 nt, Homo Sapiens
ccugugacucacacccaguggacagugcugagcacggggucagggcuggagggcacaggcagag

SEQ ID NO: 395368 - RNA, 64 nt, Homo Sapiens
uaguagaaagguggcuuuuacuauugacaaaagccggggucaaaaaaaguaguuuaagucuuaa

SEQ ID NO: 395369 - RNA, 64 nt, Homo Sapiens
ggagacgaggccaagcugagagcaugcacggaggcggggucaggcugagaaggcaaacugaggc

SEQ ID NO: 395370 - RNA, 64 nt, Homo Sapiens
uaagccucaguauucuuagcaaaaucauacgaaucggggucaguaagucugaacauuuuauuuc

SEQ ID NO: 395371 - RNA, 64 nt, Homo Sapiens
ugcuacauccugugaguccugacauguggagcaucggggucaucagcccaucggcuacgccaca

SEQ ID NO: 395372 - RNA, 64 nt, Homo Sapiens
uuuccccaugcugccucaaaaguucugugaguuucggggucagugucccacccuucacuucccg

SEQ ID NO: 395373 - RNA, 64 nt, Homo Sapiens
uucuacccuccaugugagaaccaguccccuuucucggggucaggaugauuugggcucuagaauu

SEQ ID NO: 395374 - RNA, 64 nt, Homo Sapiens
uuaggcucugcuucccagugaccagcccaguggccggggucagccaugccuuggaugugguccc

SEQ ID NO: 395375 - RNA, 64 nt, Homo Sapiens
cauccgauuccccaucagcuccagagugaggacucggggucaggaguuauccuaagcucgagcc

SEQ ID NO: 395376 - RNA, 64 nt, Homo Sapiens
guggucugcaaaugggagcggcuguuuuugaacacggggucauucugcagucaggacgaaccgg

SEQ ID NO: 395377 - RNA, 64 nt, Homo Sapiens
uuuucuguggaucagaaaaaacagaagccaaacucggggucaucuuuguuuuuaaagcugaagu

SEQ ID NO: 395378 - RNA, 64 nt, Homo Sapiens
aaggcaguuuugcuugggaaacaagcuccuuccccggggucaucacucacggccuccauggcac

SEQ ID NO: 395379 - RNA, 64 nt, Homo Sapiens
acuuucaggaggcccccagugaagagccccaccucggggucacaauaaaguugccuggucagga

SEQ ID NO: 395380 - RNA, 64 nt, Homo Sapiens
uuaagaaguuuucuuuguggggcuggggaggggccggggucagggagagucuuuuuuuuuuuuu

SEQ ID NO: 395381 - RNA, 64 nt, Homo Sapiens
uuugcuugucuucuugacugucuucccucucuaucggggucacuugcaauuguuaaucaaagau

SEQ ID NO: 395382 - RNA, 64 nt, Homo Sapiens
ggcuccagcauccgagcuggcacggauugggcugcggggucaggccagaagggugggaagcuac

SEQ ID NO: 395383 - RNA, 64 nt, Homo Sapiens
aaagaaucuagccuuuggucucucucucucucaucggggucauuugcuauuccccucugauauu

SEQ ID NO: 395384 - RNA, 64 nt, Homo Sapiens
agcaaaccugagggaaagagagaagauuagugcucggggucaccaugaugccuuugaucgaugc

SEQ ID NO: 395385 - RNA, 64 nt, Homo Sapiens
ccuagcacuuugggaggccgaggcaggcagaucacggggucaggagaucaagaccauccuggcu

SEQ ID NO: 395386 - RNA, 64 nt, Homo Sapiens
ccccugccccaagggccacuagggugauggagcacggggucacacugccagcagaugcugugug

SEQ ID NO: 395387 - RNA, 64 nt, Homo Sapiens
agaggagaccaauggcaguucagguucaagauaacggggucaggccuuuaacuuccucaaacag

SEQ ID NO: 395388 - RNA, 64 nt, Homo Sapiens
gagguggugcugccccaguggguccuccacccaacggggucaggucaugcugccacuuuuaaug

SEQ ID NO: 395389 - RNA, 64 nt, Homo Sapiens
cacuguugcccaggcuggaggugugaaucagagacggggucaaaaguugccauuuuaauguuca

SEQ ID NO: 395390 - RNA, 64 nt, Homo Sapiens
uacgucaucuauggguucugaguccaucuccauucggggucaccaggagagcuccaucccccac

SEQ ID NO: 395391 - RNA, 64 nt, Homo Sapiens
cguuucuggcccugacauaagggucaggacaugucggggucauggcugguggcagcucagucug

SEQ ID NO: 395392 - RNA, 64 nt, Homo Sapiens
gaucuuucaucugaguucuuuuucaugggcgggucggggucaguauccuguuuguuauuguuaa

SEQ ID NO: 395393 - RNA, 64 nt, Homo Sapiens
uagcacugcaccguccgaccuccgaggcaggggccggggucacaccugccaggacuccgcuucu

SEQ ID NO: 395394 - RNA, 64 nt, Homo Sapiens
caaaggaggggaaacaaugacaucuuuuggugaucggggucaggcuggagcgccacacacugca

SEQ ID NO: 395395 - RNA, 64 nt, Homo Sapiens
augacccacacgcugcagugggggcuccgggucacggggucaaaaugagcuguuccugggucag

SEQ ID NO: 395396 - RNA, 64 nt, Homo Sapiens
caggaauggccuugaugaagaugacaggcauggccggggucagcucuuucagccgcgcuucagc

SEQ ID NO: 395397 - RNA, 64 nt, Homo Sapiens
acacgggaugacgggaagcaagaaacagcaagggcggggucaagccgcugcguuuccuacucag

SEQ ID NO: 395398 - RNA, 64 nt, Homo Sapiens
aaaagcauggaaagacaauacaucugcuguccuccggggucaagcuuuggggauuuuagaacag

SEQ ID NO: 395399 - RNA, 64 nt, Homo Sapiens
cucucugccugacugaccccccuuggugggugcccggggucacacugcagaugcuccaggccca

SEQ ID NO: 395400 - RNA, 64 nt, Homo Sapiens
gagguguuagcgagccuuuggugcuagaagccugcggggucaugugcuaagaggacagucuuuc

SEQ ID NO: 395401 - RNA, 64 nt, Homo Sapiens
ccccgggccuaccaagcccccgcccuucccaccccggggucagccggccgugugcgucccccga

SEQ ID NO: 395402 - RNA, 64 nt, Homo Sapiens
cuggugccuggcacagggaacagcaugcccccuccggggucaugccacccagagacugucgcug

SEQ ID NO: 395403 - RNA, 64 nt, Homo Sapiens
cuugcagggaaagugaaugggccuauggcccacccggggucaccuggaaaggaucugaauaaag

SEQ ID NO: 395404 - RNA, 64 nt, Homo Sapiens
gugcugugagaaguucuccccugggguggggacucggggucaggggagcucaggaauguggggu

SEQ ID NO: 395405 - RNA, 64 nt, Homo Sapiens
guucaagaaggaaagcaguucaagcgggggcucccggggucaguaugugauguuuacuuugacu

SEQ ID NO: 395406 - RNA, 64 nt, Homo Sapiens
gcgggguucgcggaagaggcgggccagggaaaggcggggucaggcggugcaggucuggugggcg

SEQ ID NO: 395407 - RNA, 64 nt, Homo Sapiens
aggaaaggaucugaauaaaggccuguggcccacccggggucacccuugcaaggaaagugaaugg

SEQ ID NO: 395408 - RNA, 64 nt, Homo Sapiens
agaucgagaccauccuggccgugggggaggaucacggggucaggcacuuugggaggucgggggg

SEQ ID NO: 395409 - RNA, 64 nt, Homo Sapiens
gcccaucguguuacuccauugucagaggaggaaacggggucaggcaggaaagcaacuuaaagga

SEQ ID NO: 395410 - RNA, 64 nt, Homo Sapiens
agggcugcccaaggcaggguuuccagccaggccucggggucaucuuuucaccaggagcaaaccc

SEQ ID NO: 395411 - RNA, 64 nt, Homo Sapiens
ccccugcaagcugcaacucuaggcuuuuaucuugcggggucagagcgcccucuagagggaaaag

SEQ ID NO: 395412 - RNA, 64 nt, Homo Sapiens
ggcuggcucucaguggaggccagagaucuggaaucggggucagcggggcuacaguccuuccagg

SEQ ID NO: 395413 - RNA, 64 nt, Homo Sapiens
cuugcugaaccuugugcuccugaccagcaagucccggggucaccgccugcugcaguccccaguc

SEQ ID NO: 395414 - RNA, 64 nt, Homo Sapiens
cuggaaaggccagcagccuucacagcaaggcugucggggucaagcgaggacagccugccucugc

SEQ ID NO: 395415 - RNA, 64 nt, Homo Sapiens
ucaggaaaacucuggcuggacaagggucagucuucggggucagcagcgagauugcucugcagcc

SEQ ID NO: 395416 - RNA, 64 nt, Homo Sapiens
agacaugauaugcgcaucauucagacaugauaugcggggucaaguucuuaagggcuguuugccu

SEQ ID NO: 395417 - RNA, 64 nt, Homo Sapiens
acccuugccauggcugaccccacccauuccaaggcggggucacgguaccagcagcacuuggggu

SEQ ID NO: 395418 - RNA, 64 nt, Homo Sapiens
guuuaaauggcccaaugucaguaacugcccauggcggggucauagaagugacacaagcuaccug

SEQ ID NO: 395419 - RNA, 64 nt, Homo Sapiens
gaagagacacaggcuaccuggaaacugcccauggcggggucauaauuuaaaugucccaauguca

SEQ ID NO: 395420 - RNA, 64 nt, Homo Sapiens; identical to SEQ ID NO: 123075

SEQ ID NO: 395421 - RNA, 64 nt, Homo Sapiens; identical to SEQ ID NO: 123076

SEQ ID NO: 395422 - RNA, 64 nt, Homo Sapiens; identical to SEQ ID NO: 123077

SEQ ID NO: 395423 - RNA, 64 nt, Homo Sapiens; identical to SEQ ID NO: 123078

SEQ ID NO: 395424 - RNA, 64 nt, Homo Sapiens; identical to SEQ ID NO: 123079

SEQ ID NO: 395425 - RNA, 64 nt, Homo Sapiens; identical to SEQ ID NO: 123080

SEQ ID NO: 395426 - RNA, 64 nt, Homo Sapiens; identical to SEQ ID NO: 123081

SEQ ID NO: 395427 - RNA, 64 nt, Homo Sapiens; identical to SEQ ID NO: 123082

SEQ ID NO: 395428 - RNA, 64 nt, Homo Sapiens; identical to SEQ ID NO: 123083

SEQ ID NO: 395429 - RNA, 64 nt, Homo Sapiens; identical to SEQ ID NO: 123084

SEQ ID NO: 395430 - RNA, 64 nt, Homo Sapiens; identical to SEQ ID NO: 123085

SEQ ID NO: 395431 - RNA, 64 nt, Homo Sapiens; identical to SEQ ID NO: 123086

SEQ ID NO: 395432 - RNA, 64 nt, Homo Sapiens; identical to SEQ ID NO: 123087

SEQ ID NO: 395433 - RNA, 64 nt, Homo Sapiens; identical to SEQ ID NO: 123088

SEQ ID NO: 395434 - RNA, 64 nt, Homo Sapiens; identical to SEQ ID NO: 123089

SEQ ID NO: 395435 - RNA, 64 nt, Homo Sapiens; identical to SEQ ID NO: 123090

SEQ ID NO: 395436 - RNA, 64 nt, Homo Sapiens; identical to SEQ ID NO: 123091

SEQ ID NO: 395437 - RNA, 64 nt, Homo Sapiens; identical to SEQ ID NO: 123092

SEQ ID NO: 395438 - RNA, 64 nt, Homo Sapiens; identical to SEQ ID NO: 123093

SEQ ID NO: 395439 - RNA, 64 nt, Homo Sapiens; identical to SEQ ID NO: 123094

SEQ ID NO: 395440 - RNA, 64 nt, Homo Sapiens; identical to SEQ ID NO: 123095

SEQ ID NO: 395441 - RNA, 64 nt, Homo Sapiens; identical to SEQ ID NO: 123096

SEQ ID NO: 395442 - RNA, 64 nt, Homo Sapiens; identical to SEQ ID NO: 123097

SEQ ID NO: 395443 - RNA, 64 nt, Homo Sapiens; identical to SEQ ID NO: 123098

SEQ ID NO: 395444 - RNA, 64 nt, Homo Sapiens; identical to SEQ ID NO: 123099

SEQ ID NO: 395445 - RNA, 64 nt, Homo Sapiens; identical to SEQ ID NO: 123100

SEQ ID NO: 395446 - RNA, 64 nt, Homo Sapiens; identical to SEQ ID NO: 123101

SEQ ID NO: 395447 - RNA, 64 nt, Homo Sapiens; identical to SEQ ID NO: 123102

SEQ ID NO: 395448 - RNA, 64 nt, Homo Sapiens; identical to SEQ ID NO: 123103

SEQ ID NO: 395449 - RNA, 64 nt, Homo Sapiens; identical to SEQ ID NO: 123104

SEQ ID NO: 395450 - RNA, 64 nt, Homo Sapiens; identical to SEQ ID NO: 123105

SEQ ID NO: 395451 - RNA, 64 nt, Homo Sapiens; identical to SEQ ID NO: 123106

SEQ ID NO: 395452 - RNA, 64 nt, Homo Sapiens; identical to SEQ ID NO: 123107

SEQ ID NO: 395453 - RNA, 64 nt, Homo Sapiens; identical to SEQ ID NO: 123108

SEQ ID NO: 395454 - RNA, 64 nt, Homo Sapiens; identical to SEQ ID NO: 123109

SEQ ID NO: 395455 - RNA, 64 nt, Homo Sapiens; identical to SEQ ID NO: 123110

SEQ ID NO: 395456 - RNA, 64 nt, Homo Sapiens; identical to SEQ ID NO: 123111

SEQ ID NO: 395457 - RNA, 64 nt, Homo Sapiens; identical to SEQ ID NO: 123112

SEQ ID NO: 395458 - RNA, 64 nt, Homo Sapiens; identical to SEQ ID NO: 123113

SEQ ID NO: 395459 - RNA, 64 nt, Homo Sapiens; identical to SEQ ID NO: 123114

SEQ ID NO: 395460 - RNA, 64 nt, Homo Sapiens; identical to SEQ ID NO: 123115

SEQ ID NO: 395461 - RNA, 64 nt, Homo Sapiens; identical to SEQ ID NO: 123116

SEQ ID NO: 395462 - RNA, 64 nt, Homo Sapiens; identical to SEQ ID NO: 123117

SEQ ID NO: 395463 - RNA, 64 nt, Homo Sapiens; identical to SEQ ID NO: 123118

SEQ ID NO: 395464 - RNA, 64 nt, Homo Sapiens; identical to SEQ ID NO: 123119

SEQ ID NO: 395465 - RNA, 64 nt, Homo Sapiens; identical to SEQ ID NO: 123120

SEQ ID NO: 395466 - RNA, 64 nt, Homo Sapiens; identical to SEQ ID NO: 123121

SEQ ID NO: 395467 - RNA, 64 nt, Homo Sapiens; identical to SEQ ID NO: 123122

SEQ ID NO: 395468 - RNA, 64 nt, Homo Sapiens; identical to SEQ ID NO: 123123

SEQ ID NO: 395469 - RNA, 64 nt, Homo Sapiens; identical to SEQ ID NO: 123124

SEQ ID NO: 395470 - RNA, 54 nt, Homo Sapiens; identical to SEQ ID NO: 123125

SEQ ID NO: 395471 - RNA, 64 nt, Homo Sapiens; identical to SEQ ID NO: 123126

SEQ ID NO: 395472 - RNA, 64 nt, Homo Sapiens; identical to SEQ ID NO: 123127

SEQ ID NO: 395473 - RNA, 64 nt, Homo Sapiens; identical to SEQ ID NO: 123128

SEQ ID NO: 395474 - RNA, 64 nt, Homo Sapiens; identical to SEQ ID NO: 123129

SEQ ID NO: 395475 - RNA, 64 nt, Homo Sapiens; identical to SEQ ID NO: 123130

SEQ ID NO: 395476 - RNA, 64 nt, Homo Sapiens; identical to SEQ ID NO: 123131

SEQ ID NO: 395477 - RNA, 64 nt, Homo Sapiens; identical to SEQ ID NO: 123132

SEQ ID NO: 395478 - RNA, 64 nt, Homo Sapiens; identical to SEQ ID NO: 123133

SEQ ID NO: 395479 - RNA, 64 nt, Homo Sapiens; identical to SEQ ID NO: 123134

SEQ ID NO: 395480 - RNA, 64 nt, Homo Sapiens; identical to SEQ ID NO: 123135

SEQ ID NO: 395481 - RNA, 54 nt, Homo Sapiens; identical to SEQ ID NO: 123136

SEQ ID NO: 395482 - RNA, 64 nt, Homo Sapiens; identical to SEQ ID NO: 123137

SEQ ID NO: 395483 - RNA, 64 nt, Homo Sapiens; identical to SEQ ID NO: 123138

SEQ ID NO: 395484 - RNA, 64 nt, Homo Sapiens; identical to SEQ ID NO: 123139

SEQ ID NO: 395485 - RNA, 64 nt, Homo Sapiens; identical to SEQ ID NO: 123140

SEQ ID NO: 395486 - RNA, 64 nt, Homo Sapiens; identical to SEQ ID NO: 123141

SEQ ID NO: 395487 - RNA, 64 nt, Homo Sapiens; identical to SEQ ID NO: 123142

SEQ ID NO: 395488 - RNA, 64 nt, Homo Sapiens; identical to SEQ ID NO: 123143

SEQ ID NO: 395489 - RNA, 64 nt, Homo Sapiens; identical to SEQ ID NO: 123144

SEQ ID NO: 395490 - RNA, 64 nt, Homo Sapiens; identical to SEQ ID NO: 123145

SEQ ID NO: 395491 - RNA, 64 nt, Homo Sapiens; identical to SEQ ID NO: 123146

SEQ ID NO: 395492 - RNA, 53 nt, Homo Sapiens; identical to SEQ ID NO: 123147

SEQ ID NO: 395493 - RNA, 64 nt, Homo Sapiens; identical to SEQ ID NO: 123148

SEQ ID NO: 395494 - RNA, 64 nt, Homo Sapiens; identical to SEQ ID NO: 123149

SEQ ID NO: 395495 - RNA, 64 nt, Homo Sapiens; identical to SEQ ID NO: 123150

SEQ ID NO: 395496 - RNA, 64 nt, Homo Sapiens; identical to SEQ ID NO: 123151

SEQ ID NO: 395497 - RNA, 64 nt, Homo Sapiens; identical to SEQ ID NO: 123152

SEQ ID NO: 395498 - RNA, 64 nt, Homo Sapiens; identical to SEQ ID NO: 123153

SEQ ID NO: 395499 - RNA, 64 nt, Homo Sapiens; identical to SEQ ID NO: 123154

SEQ ID NO: 395500 - RNA, 64 nt, Homo Sapiens; identical to SEQ ID NO: 123155

SEQ ID NO: 395501 - RNA, 64 nt, Homo Sapiens; identical to SEQ ID NO: 123156

SEQ ID NO: 395502 - RNA, 64 nt, Homo Sapiens; identical to SEQ ID NO: 123157

SEQ ID NO: 395503 - RNA, 64 nt, Homo Sapiens; identical to SEQ ID NO: 123158

SEQ ID NO: 395504 - RNA, 64 nt, Homo Sapiens; identical to SEQ ID NO: 123159

SEQ ID NO: 395505 - RNA, 64 nt, Homo Sapiens; identical to SEQ ID NO: 123160

SEQ ID NO: 395506 - RNA, 64 nt, Homo Sapiens; identical to SEQ ID NO: 123161

SEQ ID NO: 395507 - RNA, 62 nt, Homo Sapiens
agaggauuuuagcuaggauuugaacacuuggugcugggaaccucaggguauugcuugccacu

SEQ ID NO: 395508 - RNA, 62 nt, Homo Sapiens
ccaugccuguggcugcgcuuccuauuucuagggcugggaaacacuccuugcaucaagggguc

SEQ ID NO: 395509 - RNA, 62 nt, Homo Sapiens
ccgcagcccgugaagcagugggcaccuggccugcugggaaccgugcugccaugccacugcca

SEQ ID NO: 395510 - RNA, 62 nt, Homo Sapiens
uguacucagagcagagcaaaaucugauggugagcugggaagcaaugcacaagcucagaauag

SEQ ID NO: 395511 - RNA, 62 nt, Homo Sapiens
acugauguugauuuggaaacuggaugcaggaagcugggaaagucugcccugacccucugcau

SEQ ID NO: 395512 - RNA, 62 nt, Homo Sapiens
uugcuugucauauccagacucuuuuaacaaacgcugggaauuaagaacagucugaagauggc

SEQ ID NO: 395513 - RNA, 62 nt, Homo Sapiens
uggcuagugaccagcacugaccaccaucccaagcugggaagagcaauuggugaagagugugu

SEQ ID NO: 395514 - RNA, 62 nt, Homo Sapiens
cuggauggaggcugcccuggaagcagccccgggcugggaaagggcugagugucaacaggccu

SEQ ID NO: 395515 - RNA, 62 nt, Homo Sapiens
caggccaaagugggggcaacgcugggaagauggcugggaagcguuccuaugaaagaaccaga

SEQ ID NO: 395516 - RNA, 62 nt, Homo Sapiens
uggcugggaagccaggccaagaaagaaccagagcugggaagaaagcaauaacuaguuccuau

SEQ ID NO: 395517 - RNA, 62 nt, Homo Sapiens
agaagaugggguaggaggagagagcaccccuggcugggaagaggcagggccugugaguggac

SEQ ID NO: 395518 - RNA, 62 nt, Homo Sapiens
ugaggauuugggauuucuguggucaacccuaugcugggaaagaaacuucgagcccaucagca

SEQ ID NO: 395519 - RNA, 62 nt, Homo Sapiens
uuuuugauaccuguaguggaccaagacuuagagcugggaauccaguggagccuuauuaauau

SEQ ID NO: 395520 - RNA, 62 nt, Homo Sapiens
gagcgcucucuugauucugguuuggaggcagggcugggaaggaaacuuccuucaaucuucau

SEQ ID NO: 395521 - RNA, 62 nt, Homo Sapiens
acaugcuauccaaucucaucuccccauccccagcugggaagagggacucaggaagcaggggg

SEQ ID NO: 395522 - RNA, 62 nt, Homo Sapiens
uuccuugcuuaugagaccaagcugcugcugcugcugggaaucauuuucuaugguuacaaggg

SEQ ID NO: 395523 - RNA, 62 nt, Homo Sapiens
cacaggugagggggugccugcuguggcacagagcugggaaggccuuacagaagaggugacau

SEQ ID NO: 395524 - RNA, 62 nt, Homo Sapiens
acaacagaaauuuauguuuuacaguucuggaggcugggaaguccaagaugagggugucaaca

SEQ ID NO: 395525 - RNA, 62 nt, Homo Sapiens
ugacugcuggagccugagagcaagagaacggagcugggaaugcugggccuaccaagguucaa

SEQ ID NO: 395526 - RNA, 62 nt, Homo Sapiens
agggaugugcagugacguggugucagcuuguggcugggaaagugcuucucggugcggacuaa

SEQ ID NO: 395527 - RNA, 62 nt, Homo Sapiens
gcaaacgauuuuacuagacucagcuuuaaccugcugggaauguuguccaggaaagaaacuug

SEQ ID NO: 395528 - RNA, 62 nt, Homo Sapiens
guguugaugaccacugagccuucacuauacaggcugggaaguagcuggggagcuguugaucu

SEQ ID NO: 395529 - RNA, 62 nt, Homo Sapiens
gaaguucgguaaggaaauguaauaggauucuugcugggaaaguuuuuaaaagucccccaaca

SEQ ID NO: 395530 - RNA, 62 nt, Homo Sapiens
caaggucgguuuccgcccucgcuguggggccugcugggaaaccagccuccagagaccgagca

SEQ ID NO: 395531 - RNA, 62 nt, Homo Sapiens
caugucuggaaucccgaggguuauauuuaggagcugggaagauuacccccaaagauguucuc

SEQ ID NO: 395532 - RNA, 62 nt, Homo Sapiens
caaaugaaaauaccagaccaagaaaugagugagcugggaaguguuuccaaauacaguuagug

SEQ ID NO: 395533 - RNA, 62 nt, Homo Sapiens
gagcggagaaugcccauggcggaggagggcaggcugggaacaggauaagcccaggugcaagg

SEQ ID NO: 395534 - RNA, 62 nt, Homo Sapiens
uggcagcucacucaguacugagcuagggaggggcugggaagaaaaaccuggccacugguagg

SEQ ID NO: 395535 - RNA, 62 nt, Homo Sapiens
gaggcccagaaguuggaaagagauggaauguggcugggaacauugcaucccaaagagcuucu

SEQ ID NO: 395536 - RNA, 62 nt, Homo Sapiens
uugauggccuacgagaggccaaguuccacugggcugggaaaagucacuuugucugucuuguu

SEQ ID NO: 395537 - RNA, 62 nt, Homo Sapiens
uccauucagaaguuuuguuguuuuacucuaaagcugggaaaggaaaugagagggaaaagacc

SEQ ID NO: 395538 - RNA, 62 nt, Homo Sapiens
caccaagcaggagaguuaaggauucaccaugagcugggaaaugcuuuugccaugaguaugag

SEQ ID NO: 395539 - RNA, 62 nt, Homo Sapiens
gagggguuaaacaacuugucuuaggcuccacagcugggaacaaguggggcugggaagcugac

SEQ ID NO: 395540 - RNA, 62 nt, Homo Sapiens
ugucuuaggcuccacagcugggaacaaguggggcugggaagcugacuucgugcucuucacca

SEQ ID NO: 395541 - RNA, 62 nt, Homo Sapiens
cguaucaaggucacuggguuuuacuggcuggugcugggaaaaugaagcuaagugaggagcuu

SEQ ID NO: 395542 - RNA, 62 nt, Homo Sapiens
ugccuccugggcuauuccucuccacccagaaggcugggaaucccagcugauucccugacagg

SEQ ID NO: 395543 - RNA, 62 nt, Homo Sapiens
cuccuagaauccuuagagucugaauuccuuuagcugggaacagcugucauggucaccccugg

SEQ ID NO: 395544 - RNA, 62 nt, Homo Sapiens
gacccugggcugugucuccucuuggaggcagggcugggaaggaacagaggggacaugaacuc

SEQ ID NO: 395545 - RNA, 62 nt, Homo Sapiens
uuccccuuuguucaaggccuaagagcagcugggcugggaaucaaugaaaccuguucaugucu

SEQ ID NO: 395546 - RNA, 62 nt, Homo Sapiens
cccaggccgcaggagugggacccaccccaucagcugggaaaggacuaaagaaaugggugucc

SEQ ID NO: 395547 - RNA, 62 nt, Homo Sapiens
ucuagagcccccuuuggccccugucauuccaggcugggaaagaccccgccuuccagcacuuu

SEQ ID NO: 395548 - RNA, 62 nt, Homo Sapiens
cuugucuccugccugccugccugugagugaccgcugggaaggugggcgucaucuccuacauc

SEQ ID NO: 395549 - RNA, 62 nt, Homo Sapiens
ugcuaggcaccgccuguggguccaaaauccaggcugggaacauggucucugacuuuggacuc

SEQ ID NO: 395550 - RNA, 64 nt, Homo Sapiens; identical to SEQ ID NO: 392717

SEQ ID NO: 395551 - RNA, 64 nt, Homo Sapiens; identical to SEQ ID NO: 392718

SEQ ID NO: 395552 - RNA, 64 nt, Homo Sapiens; identical to SEQ ID NO: 392719

SEQ ID NO: 395553 - RNA, 64 nt, Homo Sapiens; identical to SEQ ID NO: 392720

SEQ ID NO: 395554 - RNA, 64 nt, Homo Sapiens; identical to SEQ ID NO: 392721

SEQ ID NO: 395555 - RNA, 64 nt, Homo Sapiens; identical to SEQ ID NO: 392722

SEQ ID NO: 395556 - RNA, 64 nt, Homo Sapiens; identical to SEQ ID NO: 392723

SEQ ID NO: 395557 - RNA, 64 nt, Homo Sapiens; identical to SEQ ID NO: 392724

SEQ ID NO: 395558 - RNA, 64 nt, Homo Sapiens; identical to SEQ ID NO: 392725

SEQ ID NO: 395559 - RNA, 64 nt, Homo Sapiens; identical to SEQ ID NO: 392726

SEQ ID NO: 395560 - RNA, 64 nt, Homo Sapiens; identical to SEQ ID NO: 327831

SEQ ID NO: 395561 - RNA, 64 nt, Homo Sapiens; identical to SEQ ID NO: 327832

SEQ ID NO: 395562 - RNA, 64 nt, Homo Sapiens; identical to SEQ ID NO: 327833

SEQ ID NO: 395563 - RNA, 64 nt, Homo Sapiens; identical to SEQ ID NO: 327834

SEQ ID NO: 395564 - RNA, 64 nt, Homo Sapiens
ucuuccugucuggcuucuagagaugugccugugggagggggaggaaguuggcugagccauugag

SEQ ID NO: 395565 - RNA, 64 nt, Homo Sapiens
agaaggaaagggaagagucuuccaaggccagaaggagggggacaaccccccaagaccaucccug

SEQ ID NO: 395566 - RNA, 64 nt, Homo Sapiens
ugggguagaggaggguucugucaaaggcagggcagagggggauccacugaaauugcuggcauuc

SEQ ID NO: 395567 - RNA, 64 nt, Homo Sapiens
uuuauucucauuuucaggacggucugugaguggggagggggagaauuuguuuuaugagaaguga

SEQ ID NO: 395568 - RNA, 64 nt, Homo Sapiens
ggcccucacggagaggaagggaaggaaggagagggagggggaggauagagcccaucccagccgg

SEQ ID NO: 395569 - RNA, 64 nt, Homo Sapiens
agggagggggaggauagagcccaucccagccggggagggggagcccucuguacauuuguaaaua

SEQ ID NO: 395570 - RNA, 64 nt, Homo Sapiens
caaaggcuugguacccaaggugcgguagggggucgagggggaggaggccaccugaccaaaugcc

SEQ ID NO: 395571 - RNA, 64 nt, Homo Sapiens
uugggggaggggggagggaccggaugggcggggggagggggagggggaggggugggcggccgaa

SEQ ID NO: 395572 - RNA, 64 nt, Homo Sapiens
gaggggggagggaccggaugggcggggggagggggagggggaggggugggcggccgaaagccaa

SEQ ID NO: 395573 - RNA, 64 nt, Homo Sapiens
uuucauaaagaauugugaacuucuugaaucuagggagggggaauguagugaagggauguaucaa

SEQ ID NO: 395574 - RNA, 64 nt, Homo Sapiens
auguagugaagggauguaucaagugggguggugggagggggaggcaagguuauaugcacuuucu

SEQ ID NO: 395575 - RNA, 64 nt, Homo Sapiens
aaacaggaaauuccacagcuugcggcaggcaggagagggggagccuuccccguguguccucauc

SEQ ID NO: 395576 - RNA, 64 nt, Homo Sapiens
agccagggugauagcccagagcuuccuuuaaagggagggggagacggcucgcaggaaaaugugg

SEQ ID NO: 395577 - RNA, 64 nt, Homo Sapiens
aguucugggugaggcaggagcugggagggguggggagggggagggggaagugucugccuuuaug

SEQ ID NO: 395578 - RNA, 64 nt, Homo Sapiens
gggugaggcaggagcugggagggguggggagggggagggggaagugucugccuuuauguccuuu

SEQ ID NO: 395579 - RNA, 64 nt, Homo Sapiens
acuucacacucacugccucaaaccugugacagcagagggggacgaaaaguaggguguggacgca

SEQ ID NO: 395580 - RNA, 64 nt, Homo Sapiens
ggggacuuuuguugguggcuccuuucuguugggggagggggaugggggaaaggguugucucucu

SEQ ID NO: 395581 - RNA, 64 nt, Homo Sapiens
aauccuacuaauaauuguggauuuggcuagugcugagggggagaggagggguuagggguugggu

SEQ ID NO: 395582 - RNA, 64 nt, Homo Sapiens
agccaggagaaaaacuugaaauguugacuuaagugagggggaaauaaaacccagagagagagag

SEQ ID NO: 395583 - RNA, 64 nt, Homo Sapiens
cggcguugggauagguaugaccuucuacacaccugagggggagagacucuguguauucaucuuc

SEQ ID NO: 395584 - RNA, 64 nt, Homo Sapiens
gucgucccuacuuccuccucuaauuaaaaauggggagggggaaauucuuuucuguuuuauuugc

SEQ ID NO: 395585 - RNA, 64 nt, Homo Sapiens
gggaugucagggaggcaagugaucuagauugggugagggggacgaggggagagcaagggggaga

SEQ ID NO: 395586 - RNA, 64 nt, Homo Sapiens
gacugucuggguucaggggcgaggacauugccuagagggggaggguguucuaucuagccuaggg

SEQ ID NO: 395587 - RNA, 64 nt, Homo Sapiens
uugguuccuuggggggccaaccuuaccucggggagagggggaggguggcucacuggcugggagu

SEQ ID NO: 395588 - RNA, 64 nt, Homo Sapiens
ugucccccacucucucacccccaguggggacagggagggggaccacgaggccacucagaggccc

SEQ ID NO: 395589 - RNA, 64 nt, Homo Sapiens
ccgagagggggcugggccaccagggggagggggagagggggaagcccccacccugaacaucccg

SEQ ID NO: 395590 - RNA, 64 nt, Homo Sapiens
gggggaagccgagagggggcacaucccgcagggggagggggagaucaauucucccccacccuga

SEQ ID NO: 395591 - RNA, 64 nt, Homo Sapiens
ccccauuauggccaaauaguauagggccacuggggagggggaagggaaucauuuuguguucauu

SEQ ID NO: 395592 - RNA, 64 nt, Homo Sapiens
uucuccucggcucuguggcaaggauagcccuuuggagggggacucuugaccucggcuguuaggg

SEQ ID NO: 395593 - RNA, 64 nt, Homo Sapiens
ugccaggagccagcugugugaccauccagggguggagggggaaaaccaggcaauuucguuccug

SEQ ID NO: 395594 - RNA, 64 nt, Homo Sapiens
cuuggauggaagugucaaaggcagaagggugugggagggggacaaggucaguauuuaccaaagu

SEQ ID NO: 395595 - RNA, 64 nt, Homo Sapiens
gcagcguuuccucaugcaguagaaacugcucccugagggggagcagcugugcucagcuggcuuc

SEQ ID NO: 395596 - RNA, 64 nt, Homo Sapiens
aggagcagggccacagcaccugcugggaggagcugagggggaaccuccacuggaggagacccau

SEQ ID NO: 395597 - RNA, 64 nt, Homo Sapiens
ugaacucagguuuauucuaaacccagugagaggugagggggagugaugaaaggggaucagcugu

SEQ ID NO: 395598 - RNA, 64 nt, Homo Sapiens
acacagagaaaucagagaguggcugccauggucagagggggaugucaacaacagaucaagccgu

SEQ ID NO: 395599 - RNA, 64 nt, Homo Sapiens
gaggugguagggagcagccagccggcaaaggaaggagggggaaaaaaaccgccaccgggcugac

SEQ ID NO: 395600 - RNA, 64 nt, Homo Sapiens
uugaguccuuuauuauaaguaguuguagcugcgggagggggagggggagugggcgggcagugga

SEQ ID NO: 395601 - RNA, 64 nt, Homo Sapiens
ccuuuauuauaaguaguuguagcugcgggagggggagggggagugggcgggcaguggauaguaa

SEQ ID NO: 395602 - RNA, 64 nt, Homo Sapiens
gccucccuggcuugggagaccgcucucugcaagggagggggagagaagcagagggagagagaag

SEQ ID NO: 395603 - RNA, 64 nt, Homo Sapiens
cacaucuguaaucccagcacuuugggaguccaaggagggggaucgcuugaguccaggaguuuga

SEQ ID NO: 395604 - RNA, 62 nt, Homo Sapiens
cccaagguuucugauucugacccagcagugguccugaagagagcugauggcaagucuuguag

SEQ ID NO: 395605 - RNA, 62 nt, Homo Sapiens
ucugggcacauuuccuguucuugaauucugcuccugaagagggugaacaaauggggcauuca

SEQ ID NO: 395606 - RNA, 62 nt, Homo Sapiens
aagccuucccguccuugccuuaccacguugugccugaagaacaaccagguuucuucucccca

SEQ ID NO: 395607 - RNA, 62 nt, Homo Sapiens
ugagauuuuauuaucccucugauccucuggugccugaagaaaaaucaaagccuugucacaug

SEQ ID NO: 395608 - RNA, 62 nt, Homo Sapiens
accuggcacgugcacugcuugaucaugcacgcccugaagaugacugggaccuccuuccagga

SEQ ID NO: 395609 - RNA, 62 nt, Homo Sapiens
ucaagguacagggacgggcaggaugaggagcaccugaagaaagcccucucagugcaagaccc

SEQ ID NO: 395610 - RNA, 62 nt, Homo Sapiens
uggccucccaugucagguagggugagagaggcccugaagauagaagccaggcccgaaggcca

SEQ ID NO: 395611 - RNA, 62 nt, Homo Sapiens
gacggggcugugucugccucagacugggaaucccugaagauggggccgugucucccucaaag

SEQ ID NO: 395612 - RNA, 62 nt, Homo Sapiens
gacggggcugugucucccucagacuggggcucccugaagaaagggcugcuucucccucagac

SEQ ID NO: 395613 - RNA, 62 nt, Homo Sapiens
gaaagggcugcuucucccucagacuggagcucccugaagauggggcugugucccccucagac

SEQ ID NO: 395614 - RNA, 62 nt, Homo Sapiens
uaaaaugccaacaccaaaccaaugaccagaagccugaagaauuuuaugcuacaacugguaac

SEQ ID NO: 395615 - RNA, 62 nt, Homo Sapiens
uuuugaccguuccaagucuuacuuugugaaccccugaagauucauuuuuuaaacaacacuca

SEQ ID NO: 395616 - RNA, 62 nt, Homo Sapiens
ugacucugggagggcccggcgagccugggugcccugaagaagcaggcccaagagacccugaa

SEQ ID NO: 395617 - RNA, 62 nt, Homo Sapiens
cugggugcccugaagaagugggcccaagagacccugaagagccugcagcagcagcugaccca

SEQ ID NO: 395618 - RNA, 62 nt, Homo Sapiens
gguugacaguuggaggacuucaccguaccaacccugaagagauuguauuacacauuaaggac

SEQ ID NO: 395619 - RNA, 62 nt, Homo Sapiens
uaccauccaauguggaaggaaaacaagaacugccugaagaagaguccaagcuacagauacac

SEQ ID NO: 395620 - RNA, 62 nt, Homo Sapiens
acccaaauuggauuguauuugaacuuagaaaaccugaagaguagucuuauuauucagaugga

SEQ ID NO: 395621 - RNA, 62 nt, Homo Sapiens
ccuuugacuucuaggaagaaugaccuuuccuaccugaagagcaagcuugaugcaaaaccucc

SEQ ID NO: 395622 - RNA, 62 nt, Homo Sapiens
uguucauucuuaucuucugcuaguuaauauagccugaagacagaggauaaauaguugucaau

SEQ ID NO: 395623 - RNA, 62 nt, Homo Sapiens
aaauccuguccucuuggugggagguuaccuuaccugaagaccaucucucccaagcacuguag

SEQ ID NO: 395624 - RNA, 62 nt, Homo Sapiens
aacccuacagaaauaugggccugcugccauuuccugaagaccggggcaucggggugggguga

SEQ ID NO: 395625 - RNA, 62 nt, Homo Sapiens
aaguuauuaaagaggcugcaaaguccagccacccugaagauacuccccagugcuccccuccu

SEQ ID NO: 395626 - RNA, 62 nt, Homo Sapiens
ggccacgccuccugagaccaaacccgcaggcuccugaagacuggaccucaggaggccagcag

SEQ ID NO: 395627 - RNA, 62 nt, Homo Sapiens
ggcuaguccuggcagaacaggccccuggggucccugaagacugucccuuacaaacuaacugu

SEQ ID NO: 395628 - RNA, 64 nt, Homo Sapiens
ugcuguaguaacuuuuugaacgcuguaagcuguguacuguuauaagugugcuuccuauauuguu

SEQ ID NO: 395629 - RNA, 64 nt, Homo Sapiens
ggcucucugucguuuguggugcugugauggugucuacuguuagaauagcuuuucuggagguggg

SEQ ID NO: 395630 - RNA, 64 nt, Homo Sapiens
gaauuguauugaauucuuuuauuguaguuuuauguacuguuaaauucugccauuuucuuuugca

SEQ ID NO: 395631 - RNA, 64 nt, Homo Sapiens
gaauuguacugaauucuuuuauuuuaguuuuauguacuguuaaaaaguuucauuuucuuuugca

SEQ ID NO: 395632 - RNA, 64 nt, Homo Sapiens
auuuuaacagacaacuucaucuuucagagagaacuacuguuaacaaaacucucaacaaucccuu

SEQ ID NO: 395633 - RNA, 64 nt, Homo Sapiens
accuaauuaaauaugcuuuaauuaaguucucccuuacuguuaaacuuuuuaagggcuguguuau

SEQ ID NO: 395634 - RNA, 64 nt, Homo Sapiens
aucauagucuaguaaaauuuugacagugcauauguacuguuacuaaaagcuuuauaugaaauua

SEQ ID NO: 395635 - RNA, 64 nt, Homo Sapiens
uccaguucaaaaauggagaauacuucgccuaaaauacuguuaaguggguuaauugauacaaguu

SEQ ID NO: 395636 - RNA, 64 nt, Homo Sapiens
uuguuuuuuuuuuuuuuuuuuuuucaaagcacaguacuguuagcuguuuuuguggacaggauuc

SEQ ID NO: 395637 - RNA, 64 nt, Homo Sapiens
aaaagagggauuuuuauccuuuacucuucuagaguacuguuaaugccccuuucccacagucuuu

SEQ ID NO: 395638 - RNA, 64 nt, Homo Sapiens
uuuuuuaaaaaagaagcaauggcuuuuuucauacuacuguuaacagacagcuggcuuugugggu

SEQ ID NO: 395639 - RNA, 64 nt, Homo Sapiens
uguuccauuagaagcugauuaauaccacuguuucuacuguuacucuucauuaaacacauccaug

SEQ ID NO: 395640 - RNA, 64 nt, Homo Sapiens
uagguaugacuuuggaagugcagaaacagaaggauacuguuagaaaauccuaacauuggucucc

SEQ ID NO: 395641 - RNA, 64 nt, Homo Sapiens
ggaacauuuuuucucaauauuuguaugauucgcuuacuguuauugugcugagugagcuccugug

SEQ ID NO: 395642 - RNA, 64 nt, Homo Sapiens
uauuuuuggcuaucuuuucagcaaugccccacucuacuguuagcaguuuacuguauuagucugu

SEQ ID NO: 395643 - RNA, 64 nt, Homo Sapiens
uuccaaggcucaugcaguugcuuagaauaaucauuacuguuauaugagaaacauuuuaguaauu

SEQ ID NO: 395644 - RNA, 64 nt, Homo Sapiens
cuaaaaauucgucuaucgaauuagggcugaaaauuacuguuaaagaguguugcaguaugucugg

SEQ ID NO: 395645 - RNA, 64 nt, Homo Sapiens
uaaaugucuuucacagacuuaagggacuauguacuacuguuaauaucucuaagaacaaaacaca

SEQ ID NO: 395646 - RNA, 64 nt, Homo Sapiens
uaauccuuuugcugcuuaucugauguugguuugauacuguuaacacaccaaaaagaauauggaa

SEQ ID NO: 395647 - RNA, 64 nt, Homo Sapiens
gucuaaagguguaguuuccacuguaacuguugaguacuguuaaguacuguuaaucuuuuacaua

SEQ ID NO: 395648 - RNA, 64 nt, Homo Sapiens
guaguuuccacuguaacuguugaguacuguuaaguacuguuaaucuuuuacauauuugcacuug

SEQ ID NO: 395649 - RNA, 64 nt, Homo Sapiens
ugugucacgggucagcgugcgcugcugagcccuguacuguuaacagugcaaagcuagugaguag

SEQ ID NO: 395650 - RNA, 64 nt, Homo Sapiens
uucagcugcugucccaaaguaacaaaacaauaccuacuguuaaguaggaagucaaucugugugc

SEQ ID NO: 395651 - RNA, 64 nt, Homo Sapiens
acauuuguaccacuuaaaguugucuuuucuauucuacuguuauccucagucagccaguuuguua

SEQ ID NO: 395652 - RNA, 64 nt, Homo Sapiens
agaacaauguaaauguauuuacuuuaucuauggcuacuguuauuuuguauguuaggacuuuaac

SEQ ID NO: 395653 - RNA, 64 nt, Homo Sapiens
aauaaaaauccuaugaacauuucccgguuuuucuuacuguuacaacugaaggacauuaguuuug

SEQ ID NO: 395654 - RNA, 64 nt, Homo Sapiens
uacagaauuuauuuggaaauugaaauuguuacaauacuguuaaccauuaccaaauacaggaaag

SEQ ID NO: 395655 - RNA, 63 nt, Homo Sapiens
acugcuaggaagugauuuuuuaaaauuaggacuccuuaagaauaaacuuuuccagaagcacga

SEQ ID NO: 395656 - RNA, 63 nt, Homo Sapiens
gugcauaguuugacgugcagcaugcacaccaggccuuaagaugggaauguagcuuaaugauuu

SEQ ID NO: 395657 - RNA, 63 nt, Homo Sapiens
uaacugaucaauguacuuuguaaucucccccacccuuaagaagguacuuuguaaucuucccca

SEQ ID NO: 395658 - RNA, 63 nt, Homo Sapiens
acccuuaagaagguacuuuguaaucuuccccacccuuaagaagguucuuuguaauucucccca

SEQ ID NO: 395659 - RNA, 63 nt, Homo Sapiens
caauuuaaaauuacuucagucuuuuuaagaguuccuuaagaacaauuuaauauuuuuaaggga

SEQ ID NO: 395660 - RNA, 63 nt, Homo Sapiens
cuagugcagcuagauuucauauguuaguuggcaccuuaagauauuauugaugggcauuaaucu

SEQ ID NO: 395661 - RNA, 63 nt, Homo Sapiens
uccuuuguccccagcggugaccuuuguuucgauccuuaagacucugaaaucuggugacuuuga

SEQ ID NO: 395662 - RNA, 63 nt, Homo Sapiens
ggugguuccuaccuucuguaaaacgaacagauuccuuaagauuagcuuuaaaucccuuuucag

SEQ ID NO: 395663 - RNA, 63 nt, Homo Sapiens
cacaauaaaucacuguuuaauuuuguuguuuuaccuuaagaaaguuacaauuuuagaauuugu

SEQ ID NO: 395664 - RNA, 63 nt, Homo Sapiens
aaaaacuguaauauccuuuacuuagucuuuauuccuuaagaccguuuucaucuccuuuuccau

SEQ ID NO: 395665 - RNA, 63 nt, Homo Sapiens
auuguauuucagucuuuuacauguuuaucagauccuuaagaacguuuucuuuucaucccagcc

SEQ ID NO: 395666 - RNA, 62 nt, Homo Sapiens
guccacauccuucaugcaagcaaaacgcagaaccuuaagauuuucauauccugucugacuag

SEQ ID NO: 395667 - RNA, 63 nt, Homo Sapiens
ugccuguucauaaaacggugcuuucugugaaagccuuaagaagauaaaugagcgcagcagaga

SEQ ID NO: 395668 - RNA, 63 nt, Homo Sapiens
uagaaaccagcucauguguaccucauaucccauccuuaagagaagaaauguuauaaaguagaa

SEQ ID NO: 395669 - RNA, 63 nt, Homo Sapiens
aauguccuugggauaaacuccaguugcauuuaaccuuaagaaaaagaaauuaauacccuuaug

SEQ ID NO: 395670 - RNA, 63 nt, Homo Sapiens
ugcaguggagcaaauuggucgcgacuaaaacagccuuaagaauccagccaggaaauuaaagug

SEQ ID NO: 395671 - RNA, 63 nt, Homo Sapiens
gagggcuagugugggggagggaggcuuccccagccuuaagagacccucucagcccagugacug

SEQ ID NO: 395672 - RNA, 63 nt, Homo Sapiens
caccauguggaaucucgugggggucggggauccccuuaagaagugguaauggggacaagaugc

SEQ ID NO: 395673 - RNA, 63 nt, Homo Sapiens
agggcugcuucgcaguaaagugguguugagccaccuuaagaugcaugggcuagaucucaggug

SEQ ID NO: 395674 - RNA, 63 nt, Homo Sapiens
agcaaagacaagcaaggcaaccugaaauagaguccuuaagacagucugaggaucaaguauugg

SEQ ID NO: 395675 - RNA, 64 nt, Homo Sapiens; identical to SEQ ID NO: 107827

SEQ ID NO: 395676 - RNA, 64 nt, Homo Sapiens; identical to SEQ ID NO: 107828

SEQ ID NO: 395677 - RNA, 64 nt, Homo Sapiens; identical to SEQ ID NO: 107829

SEQ ID NO: 395678 - RNA, 64 nt, Homo Sapiens; identical to SEQ ID NO: 107830

SEQ ID NO: 395679 - RNA, 64 nt, Homo Sapiens; identical to SEQ ID NO: 107831

SEQ ID NO: 395680 - RNA, 64 nt, Homo Sapiens; identical to SEQ ID NO: 107832

SEQ ID NO: 395681 - RNA, 64 nt, Homo Sapiens; identical to SEQ ID NO: 107833

SEQ ID NO: 395682 - RNA, 64 nt, Homo Sapiens; identical to SEQ ID NO: 107834

SEQ ID NO: 395683 - RNA, 64 nt, Homo Sapiens; identical to SEQ ID NO: 107835

SEQ ID NO: 395684 - RNA, 64 nt, Homo Sapiens; identical to SEQ ID NO: 107836

SEQ ID NO: 395685 - RNA, 64 nt, Homo Sapiens; identical to SEQ ID NO: 107837

SEQ ID NO: 395686 - RNA, 64 nt, Homo Sapiens; identical to SEQ ID NO: 107838

SEQ ID NO: 395687 - RNA, 64 nt, Homo Sapiens; identical to SEQ ID NO: 107839

SEQ ID NO: 395688 - RNA, 64 nt, Homo Sapiens; identical to SEQ ID NO: 107840

SEQ ID NO: 395689 - RNA, 64 nt, Homo Sapiens
uaaccauauggaucaaccacgcagaccuuucaaaggguuaaaugaaugcguuuagaucuuggau

SEQ ID NO: 395690 - RNA, 64 nt, Homo Sapiens
ucgguagagaguuucccucaugggcagaacauauggguuaaauccaguucuugguagguucugc

SEQ ID NO: 395691 - RNA, 64 nt, Homo Sapiens
cucucugugccuccguuuucugcaucugccaaagggguuaaacacuucugccccacuucaaauu

SEQ ID NO: 395692 - RNA, 64 nt, Homo Sapiens
gggauaauaaaacuaauauugcaggggaguuacaggguuaaauaagauccuguguguaacccca

SEQ ID NO: 395693 - RNA, 64 nt, Homo Sapiens
aaaagaggaaaagccaaacgagggugcagcccccggguuaaaccccagcauaucucuacccauu

SEQ ID NO: 395694 - RNA, 64 nt, Homo Sapiens
aaaauugaacuaauuuauacuuuaaaguauuucuggguuaaaugaaacaaugaaauuuuuuagu

SEQ ID NO: 395695 - RNA, 64 nt, Homo Sapiens
aacucuuugacaucuucacuuuuaacaacggaaaggguuaaauuuaacagaacgaguguaaaau

SEQ ID NO: 395696 - RNA, 64 nt, Homo Sapiens
uaguguacuacaacauugaucuuucuggccacugggguuaaauuuuuggagaggugcauuauuu

SEQ ID NO: 395697 - RNA, 64 nt, Homo Sapiens
caccagcacuucugcuugcuucuuuaagaaaccuggguuaaagaguugguucuauugaagccag

SEQ ID NO: 395698 - RNA, 64 nt, Homo Sapiens
aacuaacaguugucccuuuacuccuugcuugaguggguuaaaggagauaaaccucugcccucca

SEQ ID NO: 395699 - RNA, 64 nt, Homo Sapiens; identical to SEQ ID NO: 73514

SEQ ID NO: 395700 - RNA, 64 nt, Homo Sapiens; identical to SEQ ID NO: 73515

SEQ ID NO: 395701 - RNA, 64 nt, Homo Sapiens; identical to SEQ ID NO: 325317

SEQ ID NO: 395702 - RNA, 64 nt, Homo Sapiens; identical to SEQ ID NO: 325318

SEQ ID NO: 395703 - RNA, 64 nt, Homo Sapiens; identical to SEQ ID NO: 325319

SEQ ID NO: 395704 - RNA, 64 nt, Homo Sapiens; identical to SEQ ID NO: 325320

SEQ ID NO: 395705 - RNA, 64 nt, Homo Sapiens; identical to SEQ ID NO: 325321

SEQ ID NO: 395706 - RNA, 64 nt, Homo Sapiens; identical to SEQ ID NO: 325322

SEQ ID NO: 395707 - RNA, 64 nt, Homo Sapiens; identical to SEQ ID NO: 325323

SEQ ID NO: 395708 - RNA, 64 nt, Homo Sapiens; identical to SEQ ID NO: 325324

SEQ ID NO: 395709 - RNA, 64 nt, Homo Sapiens; identical to SEQ ID NO: 325325

SEQ ID NO: 395710 - RNA, 64 nt, Homo Sapiens; identical to SEQ ID NO: 325326

SEQ ID NO: 395711 - RNA, 64 nt, Homo Sapiens; identical to SEQ ID NO: 325327

SEQ ID NO: 395712 - RNA, 64 nt, Homo Sapiens; identical to SEQ ID NO: 325328

SEQ ID NO: 395713 - RNA, 64 nt, Homo Sapiens; identical to SEQ ID NO: 325329

SEQ ID NO: 395714 - RNA, 64 nt, Homo Sapiens; identical to SEQ ID NO: 325330

SEQ ID NO: 395715 - RNA, 64 nt, Homo Sapiens
ggugaugauugucucagcacucacgcacugcacaagauggcagcaggauacagcacugcacaag

SEQ ID NO: 395716 - RNA, 64 nt, Homo Sapiens
ugcacaagauggcagcaggauacagcacugcacaagauggcagcuccucugcagcuuccuccuc

SEQ ID NO: 395717 - RNA, 64 nt, Homo Sapiens
uccucucaugaaugaaaugcaguguagggagaggagauggcaggacacagcaaacaggacacau

SEQ ID NO: 395718 - RNA, 64 nt, Homo Sapiens
ugguuacugcacuguaguuucaaauggauccuccagauggcauucaugucuuacucagaaaggg

SEQ ID NO: 395719 - RNA, 64 nt, Homo Sapiens
aacacagugacucccuggaguagucgggcagcccagauggcacugaucacugagcaggagagga

SEQ ID NO: 395720 - RNA, 64 nt, Homo Sapiens
gagugagaucuggacucaccaaaucccugaggauagauggcacccauggcccccacccacggaa

SEQ ID NO: 395721 - RNA, 64 nt, Homo Sapiens
ggagucccuucuggguugacuccaagagccaaggagauggcagacccugggcuaggaaccauau

SEQ ID NO: 395722 - RNA, 64 nt, Homo Sapiens
uuuuuucuggcagcuauguguuguuuuguucgaaagauggcaaguguacaaccaaaccaaucca

SEQ ID NO: 395723 - RNA, 64 nt, Homo Sapiens
agcaguuuccugcuucucguuuggcacgcauguuagauggcagagaccaagaauucaagauggu

SEQ ID NO: 395724 - RNA, 64 nt, Homo Sapiens
ggaagagcaaguucuggauagauaccaaugauuuagauggcacacaaagauuagaugggagaua

SEQ ID NO: 395725 - RNA, 64 nt, Homo Sapiens
cacaguggcaagacaacauuuuuucacuugggagagauggcaaaauuuuuuuuaaaaaguguuc

SEQ ID NO: 395726 - RNA, 64 nt, Homo Sapiens
ccugucugccccgaauaacuuucaguaguauggcagauggcacagagaaagggaaggggcucug

SEQ ID NO: 395727 - RNA, 64 nt, Homo Sapiens
aaaugucuuuugagcuucugaccugaccaugcccagauggcauaacuuuucccuaggacccuca

SEQ ID NO: 395728 - RNA, 64 nt, Homo Sapiens
uugcuaugucguccaggcuguuuuuuuuuuaaagagauggcaucgcccuuuuuuuuuuuuuuuu

SEQ ID NO: 395729 - RNA, 64 nt, Homo Sapiens
gaaaggcggagggaugauggguuggaaucgcugaagauggcaaucccagacucucccuccagcc

SEQ ID NO: 395730 - RNA, 64 nt, Homo Sapiens
cagauugggcucuaagucaugugacggcucagggagauggcaggcgcgcuaucuucagugacgg

SEQ ID NO: 395731 - RNA, 64 nt, Homo Sapiens
agggaaaggugugccauaagcaucgugucugaagagauggcaccaugcgguuguaaugagcuca

SEQ ID NO: 395732 - RNA, 64 nt, Homo Sapiens
gggccuuucuuuaacugccuuccuggcuuagcucagauggcagaugagaguguagucaagggcc

SEQ ID NO: 395733 - RNA, 64 nt, Homo Sapiens
uugcaugugacaauugacaaucuggacuaccccaagauggcacccaaguguuuggcuucuggcu

SEQ ID NO: 395734 - RNA, 64 nt, Homo Sapiens
aagaugauggagugccacuuccgauuccgccaccagauggcacuaggugacugacgggagggcu

SEQ ID NO: 395735 - RNA, 64 nt, Homo Sapiens
ucuacccagugcccugugugcugacccucaaucaagauggcaccgugugggugacagcugugca

SEQ ID NO: 395736 - RNA, 64 nt, Homo Sapiens
gcuccuuacugcaaggcauccaugugccuguuccagauggcaggcaggucauuuugccuuccua

SEQ ID NO: 395737 - RNA, 64 nt, Homo Sapiens
aaggagaacggaugcuugucgacgaagcuuguccagauggcaggccccagaucccacauccccu

SEQ ID NO: 395738 - RNA, 64 nt, Homo Sapiens; identical to SEQ ID NO: 300541

SEQ ID NO: 395739 - RNA, 64 nt, Homo Sapiens; identical to SEQ ID NO: 300542

SEQ ID NO: 395740 - RNA, 64 nt, Homo Sapiens; identical to SEQ ID NO: 300543

SEQ ID NO: 395741 - RNA, 64 nt, Homo Sapiens; identical to SEQ ID NO: 300544

SEQ ID NO: 395742 - RNA, 64 nt, Homo Sapiens; identical to SEQ ID NO: 300545

SEQ ID NO: 395743 - RNA, 64 nt, Homo Sapiens; identical to SEQ ID NO: 300546

SEQ ID NO: 395744 - RNA, 64 nt, Homo Sapiens; identical to SEQ ID NO: 300547

SEQ ID NO: 395745 - RNA, 64 nt, Homo Sapiens; identical to SEQ ID NO: 300548

SEQ ID NO: 395746 - RNA, 64 nt, Homo Sapiens; identical to SEQ ID NO: 300549

SEQ ID NO: 395747 - RNA, 64 nt, Homo Sapiens; identical to SEQ ID NO: 300550

SEQ ID NO: 395748 - RNA, 64 nt, Homo Sapiens; identical to SEQ ID NO: 300551

SEQ ID NO: 395749 - RNA, 64 nt, Homo Sapiens; identical to SEQ ID NO: 300552

SEQ ID NO: 395750 - RNA, 64 nt, Homo Sapiens; identical to SEQ ID NO: 300553

SEQ ID NO: 395751 - RNA, 64 nt, Homo Sapiens; identical to SEQ ID NO: 300554

SEQ ID NO: 395752 - RNA, 64 nt, Homo Sapiens; identical to SEQ ID NO: 300555

SEQ ID NO: 395753 - RNA, 64 nt, Homo Sapiens; identical to SEQ ID NO: 300556

SEQ ID NO: 395754 - RNA, 64 nt, Homo Sapiens; identical to SEQ ID NO: 300557

SEQ ID NO: 395755 - RNA, 64 nt, Homo Sapiens; identical to SEQ ID NO: 300558

SEQ ID NO: 395756 - RNA, 64 nt, Homo Sapiens; identical to SEQ ID NO: 300559

SEQ ID NO: 395757 - RNA, 64 nt, Homo Sapiens; identical to SEQ ID NO: 300560

SEQ ID NO: 395758 - RNA, 64 nt, Homo Sapiens; identical to SEQ ID NO: 300561

SEQ ID NO: 395759 - RNA, 64 nt, Homo Sapiens; identical to SEQ ID NO: 300562

SEQ ID NO: 395760 - RNA, 64 nt, Homo Sapiens; identical to SEQ ID NO: 300563

SEQ ID NO: 395761 - RNA, 64 nt, Homo Sapiens; identical to SEQ ID NO: 300564

SEQ ID NO: 395762 - RNA, 64 nt, Homo Sapiens; identical to SEQ ID NO: 300565

SEQ ID NO: 395763 - RNA, 64 nt, Homo Sapiens; identical to SEQ ID NO: 300566

SEQ ID NO: 395764 - RNA, 64 nt, Homo Sapiens; identical to SEQ ID NO: 300567

SEQ ID NO: 395765 - RNA, 64 nt, Homo Sapiens; identical to SEQ ID NO: 300568

SEQ ID NO: 395766 - RNA, 64 nt, Homo Sapiens; identical to SEQ ID NO: 300569

SEQ ID NO: 395767 - RNA, 64 nt, Homo Sapiens; identical to SEQ ID NO: 300570

SEQ ID NO: 395768 - RNA, 64 nt, Homo Sapiens; identical to SEQ ID NO: 300571

SEQ ID NO: 395769 - RNA, 64 nt, Homo Sapiens; identical to SEQ ID NO: 300572

SEQ ID NO: 395770 - RNA, 64 nt, Homo Sapiens; identical to SEQ ID NO: 300573

SEQ ID NO: 395771 - RNA, 64 nt, Homo Sapiens; identical to SEQ ID NO: 300574

SEQ ID NO: 395772 - RNA, 64 nt, Homo Sapiens; identical to SEQ ID NO: 300575

SEQ ID NO: 395773 - RNA, 64 nt, Homo Sapiens; identical to SEQ ID NO: 300576

SEQ ID NO: 395774 - RNA, 64 nt, Homo Sapiens; identical to SEQ ID NO: 300577

SEQ ID NO: 395775 - RNA, 64 nt, Homo Sapiens
cgaaccccggagugcugacgcgguuccccaacuuccgccuuaagaaaacaggaccagccggcac

SEQ ID NO: 395776 - RNA, 64 nt, Homo Sapiens
acagugccgcgugcgagaugagcucgaacacugcccgccuuacugccgccuaccccgcccgcca

SEQ ID NO: 395777 - RNA, 64 nt, Homo Sapiens
cccaggcccugacuucggcuucccagagaucucuccgccuuaguuaagagcaugugucgggaaa

SEQ ID NO: 395778 - RNA, 64 nt, Homo Sapiens
agaugcagaugcuguugugacugcccagauauggccgccuuaaauuuucucugggacaugucuu

SEQ ID NO: 395779 - RNA, 64 nt, Homo Sapiens
ccugcccggccgucugucucagcugcagcgccacccgccuuacauuuagacucuucuccauguc

SEQ ID NO: 395780 - RNA, 64 nt, Homo Sapiens
uagcuugagaucuuugcagcuucuccaaaucuuuccgccuuauuaaagaauuuccuucuuuugu

SEQ ID NO: 395781 - RNA, 64 nt, Homo Sapiens
gcugaucucaaacuccuaggcuuaagugauccucccgccuuagccucccaagugcuaggauuac

SEQ ID NO: 395782 - RNA, 64 nt, Homo Sapiens
gccucgucccucccucacugcugccccacacuccccgccuuagaucuucgccuuucccacccuc

SEQ ID NO: 395783 - RNA, 64 nt, Homo Sapiens
agcugcgucguuucgauaucacacccucugugugccgccuuacuuccugcuucgagaauguaua

SEQ ID NO: 395784 - RNA, 64 nt, Homo Sapiens
aagaaauugcuucucuuuuaauuacaggcaugagccgccuuaccccgccucccaacgugcuggg

SEQ ID NO: 395785 - RNA, 64 nt, Homo Sapiens
caccccuguccccggggcucgcuggcccugcacuccgccuuaguccuggggccggcgacacagu

SEQ ID NO: 395786 - RNA, 64 nt, Homo Sapiens
cuauguauguauggaggccagaagacaucaaccuccgccuuaagugaauagacuauguccuagu

SEQ ID NO: 395787 - RNA, 64 nt, Homo Sapiens
cggaggcaggaguuucguuacgagcguuagagugccgccuuagaacguggugcuaucucugaaa

SEQ ID NO: 395788 - RNA, 64 nt, Homo Sapiens
uucccucucuaggccuguugccucgggccuggguccgccuuaaucuggaaggccccucccagca

SEQ ID NO: 395789 - RNA, 64 nt, Homo Sapiens
cuggagccaacaugacugucgaugggggaaaaugccgccuuagguacaggagccgcggcuuucu

SEQ ID NO: 395790 - RNA, 61 nt, Homo Sapiens
cugauccugcggagaacaccggccucagcagccgccuuaagcggagcugaauacagccuga

SEQ ID NO: 395791 - RNA, 64 nt, Homo Sapiens
acucccgaugcgcuccuggagccugcccgcccacccgccuuaggcagacucaccucccaagaac

SEQ ID NO: 395792 - RNA, 64 nt, Homo Sapiens
augcuggcaauguuaauuacuagugaugaaaggaccgccuuaucgucggaaggacuaguggcaa

SEQ ID NO: 395793 - RNA, 64 nt, Homo Sapiens
uuagaucacucggguccccaccuuagaaggguccccgccuuagaucaaucacguggacacuaag

SEQ ID NO: 395794 - RNA, 64 nt, Homo Sapiens
guggauucagaacugcagcguucaaagccccugcccgccuuagauucucauggcuaccuccucu

SEQ ID NO: 395795 - RNA, 64 nt, Homo Sapiens
uaccaguucuggaucagucauuccuguuugaucaccgccuuagucuaaacugagaagaaaagca

SEQ ID NO: 395796 - RNA, 64 nt, Homo Sapiens
cucccaaagugcuaggauuacugaagcuaucuacccgccuuagugcuagucucaaauuccugga

SEQ ID NO: 395797 - RNA, 64 nt, Homo Sapiens
gaguauacgggcaaccauggauggguggcaaguaccgccuuaugguauggacaguauauggcaa

SEQ ID NO: 395798 - RNA, 64 nt, Homo Sapiens
uugccgaaauaagcaacucugucaugcaaugaccccgccuuaugggaccucgugccuucuugcu

SEQ ID NO: 395799 - RNA, 64 nt, Homo Sapiens
cucccaaagugcugggauuaaccucgugauccacccgccuuagcaggcuggucuugaacuccug

SEQ ID NO: 395800 - RNA, 64 nt, Homo Sapiens
ccuggucccacugucccaguguaggaacagagacccgccuuaagagacuggaucgcacaccuuu

SEQ ID NO: 395801 - RNA, 64 nt, Homo Sapiens
gucgaugccauugauucugccagcggcuccuaaaccgccuuacagcugaguuagaagaugagga

SEQ ID NO: 395802 - RNA, 64 nt, Homo Sapiens
ccucaccaucggagaacuuaucauccuugccacuccgccuuauagaagcgguugucuguucacc

SEQ ID NO: 395803 - RNA, 64 nt, Homo Sapiens
cguuucacgaggucagugaggacaccccuuccugccgccuuacucuguacauagauuugcacuc

SEQ ID NO: 395804 - RNA, 64 nt, Homo Sapiens
cacaccccagguguccauggcuuggggccagaggccgccuuacaagccacuuccagcuuuugau

SEQ ID NO: 395805 - RNA, 64 nt, Homo Sapiens
aggagaagaaccugaagaacguuugguguguccuccgccuuaccccccugacagggccagugca

SEQ ID NO: 395806 - RNA, 64 nt, Homo Sapiens
cacaaccuugaacucccaggcucaagcgauccucccgccuuaacugccugaguagcugggacua

SEQ ID NO: 395807 - RNA, 64 nt, Homo Sapiens
uauagcagugacacuuguugaagauaucuucuguccgccuuacaggaauauucaguuccaaaac

SEQ ID NO: 395808 - RNA, 64 nt, Homo Sapiens
uaagcuuccuucaaaaaaaaaagugcuuggaaaaccgccuuaggaacagaaagagcucagacca

SEQ ID NO: 395809 - RNA, 56 nt, Homo Sapiens
uccgauguguucuucugugaggaacaccgccuuacucugagccucgcucagcccag

SEQ ID NO: 395810 - RNA, 64 nt, Homo Sapiens
cccgggcacagggaaggcagaccuucugucccggccgccuuagcgagccaggggcgacaucaug

SEQ ID NO: 395811 - RNA, 64 nt, Homo Sapiens
uuuccccgauuuggggcucggcccugaagaugccccgccuuaguggggagaggcaccugaggug

SEQ ID NO: 395812 - RNA, 64 nt, Homo Sapiens
ccucuccuccauguacuugaaccagggccuaaguccgccuuacuucccuucacccuuucuccau

SEQ ID NO: 395813 - RNA, 64 nt, Homo Sapiens
gcugggcaggugccuggacagugaugaggucuugccgccuuaacugucccccccagucacuucu

SEQ ID NO: 395814 - RNA, 64 nt, Homo Sapiens
ucugaagcuacuccaguuauuggggugaauguggccgccuuaguuggagcuaacuccuaagcgg

SEQ ID NO: 395815 - RNA, 64 nt, Homo Sapiens
uccacaccacaugggagcccagaggaggaggggcccgccuuagccaugugaagguggauugguc

SEQ ID NO: 395816 - RNA, 64 nt, Homo Sapiens
gcagaaugaggcaauaauacggaccaacaagaagccgccuuaucaaugccagcauuagcgacug

SEQ ID NO: 395817 - RNA, 64 nt, Homo Sapiens
aaauaggugagauaaauuaaaagauacuuaauucccgccuuaugccucagucuauucuguaaaa

SEQ ID NO: 395818 - RNA, 64 nt, Homo Sapiens
auucggaaguguuuuggaauuugaugcaguuaugccgccuuagauuucuccagggcccccuucu

SEQ ID NO: 395819 - RNA, 61 nt, Homo Sapiens
cccaggagugccccacguucugagaaggggccggccggagggaggggacccggcagggaga

SEQ ID NO: 395820 - RNA, 61 nt, Homo Sapiens
ccguggagagcgggcuuaagaaguggcgguucggccggagguuccaucguauccaaaaggc

SEQ ID NO: 395821 - RNA, 61 nt, Homo Sapiens
cucugggcccggccccucccugacggcaucgcggccggaacagucacucugccgaaggcgc

SEQ ID NO: 395822 - RNA, 61 nt, Homo Sapiens
uuggcugagaucgcgguauuucucaacuucucggccggagucgagagggggugaagacauu

SEQ ID NO: 395823 - RNA, 61 nt, Homo Sapiens
gcugaggggaggggggcguugccgagggacucggccggagacgcacguguaggaggcugcc

SEQ ID NO: 395824 - RNA, 61 nt, Homo Sapiens
gauucaucauuucaaaguuacuuucuauaugcggccggaacagggugguugacaucaguuu

SEQ ID NO: 395825 - RNA, 61 nt, Homo Sapiens
gacuuucucgcacccccuuggacugucccggcggccggagucugcggcgacgacuugcuca

SEQ ID NO: 395826 - RNA, 53 nt, Homo Sapiens
cggacacggacaugcgcugaagccggccggagcggggccugcaugggcggguc

SEQ ID NO: 395827 - RNA, 61 nt, Homo Sapiens
ggggaagggcgcgggcgcggacgcgggccggcggccggagcgcugaccgccccgccgcacc

SEQ ID NO: 395828 - RNA, 61 nt, Homo Sapiens
caguagcuuacgccuguuaugguccuaauuacggccggacggcguucagcuuuaaaaagcc

SEQ ID NO: 395829 - RNA, 61 nt, Homo Sapiens
uucuauuucucuuaagucagcaucaauacaacggccggaguuucuguuuuugcaauaagaa

SEQ ID NO: 395830 - RNA, 61 nt, Homo Sapiens
ucccuccccggcuuccuccggaggcccggcccggccggaggauguucagcaccucugccuu

SEQ ID NO: 395831 - RNA, 61 nt, Homo Sapiens
agaaagacaauaauuuuguugcuaagcccaucggccggaaaggcgacuucaguaagcuaca

SEQ ID NO: 395832 - RNA, 61 nt, Homo Sapiens
cgcccaccgucuugggucgcguagcacuacccggccggagcauucaaagaauacuagaaug

SEQ ID NO: 395833 - RNA, 61 nt, Homo Sapiens
gcggguacaaggcugucuggccaaggagcggcggccggaggggcggugagguccauccuga

SEQ ID NO: 395834 - RNA, 61 nt, Homo Sapiens
aggccauggagcccgaguagugcauccacugcggccggaggccccggcucccccgcacgca

SEQ ID NO: 395835 - RNA, 61 nt, Homo Sapiens
uugauccccccgaagucuucuccgcccaccccggccggacuugugcagcugcccgaggguc

SEQ ID NO: 395836 - RNA, 61 nt, Homo Sapiens
ucugagcacauaguguccugggacagacggccggccggaccuuggcagcuuuuucugugga

SEQ ID NO: 395837 - RNA, 61 nt, Homo Sapiens
gugaggacgcccgcuuccugcugauugccgccggccggaccaucaaggugugggacuacgc

SEQ ID NO: 395838 - RNA, 61 nt, Homo Sapiens
agaggucacugcacuugguacuuccuagagacggccggagccaggcccaagacacagcaga

SEQ ID NO: 395839 - RNA, 61 nt, Homo Sapiens
acccuccccccaccccccgugggcuccugugcggccggagccuccccaaggagcgccgccc

SEQ ID NO: 395840 - RNA, 61 nt, Homo Sapiens
uugcagaggcugccguaguaauccaccccaacggccggaggagccgccggagcccgccugc

SEQ ID NO: 395841 - RNA, 61 nt, Homo Sapiens
gcauucccagagguggggaagagagccugcccggccggagaacaucugccuugcugcaccu

SEQ ID NO: 395842 - RNA, 61 nt, Homo Sapiens
cagacuagccccgcccaccaccuccacgcagcggccggagccgccucucccgcuccggauc

SEQ ID NO: 395843 - RNA, 61 nt, Homo Sapiens
cgucccuccacgaccccgccugggccaggggcggccggaccgccagcacgugccccacccg

SEQ ID NO: 395844 - RNA, 61 nt, Homo Sapiens
ugcgcucucgggucacccugcuuuggcggcccggccggagggcaggacccucaccucuccc

SEQ ID NO: 395845 - RNA, 61 nt, Homo Sapiens
cuacuggagaagaggagcaacaccugugccgcggccggaggaguuuuguuguugguuuuag

SEQ ID NO: 395846 - RNA, 61 nt, Homo Sapiens
gggcaggggggcgggggcgaucaaccgugcgcggccggaggaccauuuaugcuuuuguaca

SEQ ID NO: 395847 - RNA, 61 nt, Homo Sapiens
accucccaggcagggcucugggggucugagacggccggagagaccuggcagagccuggugu

SEQ ID NO: 395848 - RNA, 61 nt, Homo Sapiens
gugccucuccccucugccaucuggagguucccggccggagagcagcagccagggaugggcc

SEQ ID NO: 395849 - RNA, 61 nt, Homo Sapiens
uuuggcuguuuccuaaugaauauuccuuuaacggccggacuaaucaagauguucugcagau

SEQ ID NO: 395850 - RNA, 61 nt, Homo Sapiens
caucuccacgcgcgcccgugggagguggguccggccggagaggccucccgcggacgccguc

SEQ ID NO: 395851 - RNA, 61 nt, Homo Sapiens
gcugccccugaaggacagucuccaggacaggcggccggagagccagugaaccugccagccu

SEQ ID NO: 395852 - RNA, 61 nt, Homo Sapiens
augcccugcagacugcucuggaaaugaggaccggccggacgaagcagguucuucccuccag

SEQ ID NO: 395853 - RNA, 61 nt, Homo Sapiens
gccuucagugccuggaugucugcggccacaccggccggacacgugguagaugcccaccucc

SEQ ID NO: 395854 - RNA, 61 nt, Homo Sapiens
agcggcuucauggcagacagcagcgagccagcggccggacucuguauuucggaccccacuc

SEQ ID NO: 395855 - RNA, 61 nt, Homo Sapiens
gaagaaaaggcccuuaacuugagaugagacucggccggagacaugcaucccccaauaagaa

SEQ ID NO: 395856 - RNA, 64 nt, Homo Sapiens
acauuuauggaaucagucguuggcaccuucaauacuucaugauuuuugucgaguuuacuucaug

SEQ ID NO: 395857 - RNA, 64 nt, Homo Sapiens
caccuucaauacuucaugauuuuugucgaguuuacuucaugaggaggucagcccauuggcuccc

SEQ ID NO: 395858 - RNA, 64 nt, Homo Sapiens
auuauauaauugcuauuggcaauguagccuggugcuucaugagaccuaugcuaaauguuacugg

SEQ ID NO: 395859 - RNA, 64 nt, Homo Sapiens
acaaauaauucugugugaauuuucuuguagcgugcuucaugaaaauaucuacuuauccagguuu

SEQ ID NO: 395860 - RNA, 64 nt, Homo Sapiens
ugaaacuuuguaacuuauugcugcuuaacuucaucuucaugaaagagggagggaggguuuauca

SEQ ID NO: 395861 - RNA, 64 nt, Homo Sapiens
aauuccauuuuauugacugacaaacagccuacuucuucaugaacaacuauuaagaaucaacaug

SEQ ID NO: 395862 - RNA, 64 nt, Homo Sapiens
gcuucauggggcuccaggaauuuuaaaugucuuucuucaugaauuacauauguaucuagacugu

SEQ ID NO: 395863 - RNA, 64 nt, Homo Sapiens
ucucacagucgacgcuccuguugugacauucugucuucaugagggcuuguccuguggugacagu

SEQ ID NO: 395864 - RNA, 64 nt, Homo Sapiens
cagcaggcccccuuguccuuccuggguccugguccuucaugaggaacuagcccaucccuggugg

SEQ ID NO: 395865 - RNA, 64 nt, Homo Sapiens
gggcucaccccuuuaauccaggggagccucuccacuucaugauuuucagcuaacuugcuucugc

SEQ ID NO: 395866 - RNA, 64 nt, Homo Sapiens; identical to SEQ ID NO: 158129

SEQ ID NO: 395867 - RNA, 64 nt, Homo Sapiens; identical to SEQ ID NO: 158130

SEQ ID NO: 395868 - RNA, 64 nt, Homo Sapiens; identical to SEQ ID NO: 158131

SEQ ID NO: 395869 - RNA, 64 nt, Homo Sapiens; identical to SEQ ID NO: 158132

SEQ ID NO: 395870 - RNA, 64 nt, Homo Sapiens; identical to SEQ ID NO: 158133

SEQ ID NO: 395871 - RNA, 64 nt, Homo Sapiens; identical to SEQ ID NO: 158134

SEQ ID NO: 395872 - RNA, 64 nt, Homo Sapiens; identical to SEQ ID NO: 158135

SEQ ID NO: 395873 - RNA, 64 nt, Homo Sapiens; identical to SEQ ID NO: 158136

SEQ ID NO: 395874 - RNA, 64 nt, Homo Sapiens; identical to SEQ ID NO: 158137

SEQ ID NO: 395875 - RNA, 64 nt, Homo Sapiens; identical to SEQ ID NO: 158138

SEQ ID NO: 395876 - RNA, 64 nt, Homo Sapiens; identical to SEQ ID NO: 158139

SEQ ID NO: 395877 - RNA, 64 nt, Homo Sapiens; identical to SEQ ID NO: 158140

SEQ ID NO: 395878 - RNA, 64 nt, Homo Sapiens; identical to SEQ ID NO: 158141

SEQ ID NO: 395879 - RNA, 64 nt, Homo Sapiens; identical to SEQ ID NO: 158142

SEQ ID NO: 395880 - RNA, 64 nt, Homo Sapiens; identical to SEQ ID NO: 158143

SEQ ID NO: 395881 - RNA, 64 nt, Homo Sapiens; identical to SEQ ID NO: 158144

SEQ ID NO: 395882 - RNA, 64 nt, Homo Sapiens; identical to SEQ ID NO: 168425

SEQ ID NO: 395883 - RNA, 64 nt, Homo Sapiens; identical to SEQ ID NO: 168426

SEQ ID NO: 395884 - RNA, 64 nt, Homo Sapiens; identical to SEQ ID NO: 168427

SEQ ID NO: 395885 - RNA, 64 nt, Homo Sapiens; identical to SEQ ID NO: 168428

SEQ ID NO: 395886 - RNA, 64 nt, Homo Sapiens; identical to SEQ ID NO: 168429

SEQ ID NO: 395887 - RNA, 64 nt, Homo Sapiens; identical to SEQ ID NO: 168430

SEQ ID NO: 395888 - RNA, 64 nt, Homo Sapiens; identical to SEQ ID NO: 168431

SEQ ID NO: 395889 - RNA, 64 nt, Homo Sapiens; identical to SEQ ID NO: 168432

SEQ ID NO: 395890 - RNA, 64 nt, Homo Sapiens; identical to SEQ ID NO: 168433

SEQ ID NO: 395891 - RNA, 64 nt, Homo Sapiens; identical to SEQ ID NO: 168434

SEQ ID NO: 395892 - RNA, 64 nt, Homo Sapiens; identical to SEQ ID NO: 168435

SEQ ID NO: 395893 - RNA, 64 nt, Homo Sapiens; identical to SEQ ID NO: 168436

SEQ ID NO: 395894 - RNA, 64 nt, Homo Sapiens; identical to SEQ ID NO: 168437

SEQ ID NO: 395895 - RNA, 64 nt, Homo Sapiens; identical to SEQ ID NO: 168438

SEQ ID NO: 395896 - RNA, 64 nt, Homo Sapiens; identical to SEQ ID NO: 168439

SEQ ID NO: 395897 - RNA, 64 nt, Homo Sapiens; identical to SEQ ID NO: 168440

SEQ ID NO: 395898 - RNA, 64 nt, Homo Sapiens; identical to SEQ ID NO: 168441

SEQ ID NO: 395899 - RNA, 64 nt, Homo Sapiens; identical to SEQ ID NO: 168442

SEQ ID NO: 395900 - RNA, 64 nt, Homo Sapiens; identical to SEQ ID NO: 168443

SEQ ID NO: 395901 - RNA, 64 nt, Homo Sapiens; identical to SEQ ID NO: 168444

SEQ ID NO: 395902 - RNA, 64 nt, Homo Sapiens; identical to SEQ ID NO: 168445

SEQ ID NO: 395903 - RNA, 64 nt, Homo Sapiens; identical to SEQ ID NO: 168446

SEQ ID NO: 395904 - RNA, 64 nt, Homo Sapiens
cacugcccacacucagagcaucucagcccacucucccuguuacacccuguuacacacuguccgc

SEQ ID NO: 395905 - RNA, 64 nt, Homo Sapiens
cacuguccgcucucagcccacccagucugcuucucccuguuacaccccucauuguggccccaca

SEQ ID NO: 395906 - RNA, 64 nt, Homo Sapiens
gugagaguauuaacguuuuuguucuccuccggcccccuguuacaaugaaggggcaaaaguauuu

SEQ ID NO: 395907 - RNA, 64 nt, Homo Sapiens
gccucgacaucaaacugccuggauuuuucuaccacccuguuacaucauaacaacuucugaaaca

SEQ ID NO: 395908 - RNA, 64 nt, Homo Sapiens
aacgcaauuauuucuguguuuugguaauuugacacccuguuaauuuaguaacugguuguucuac

SEQ ID NO: 395909 - RNA, 64 nt, Homo Sapiens
uacauugccuggaccuuguuuuuagaugugugcucccuguuauccauauguuaagcacacauac

SEQ ID NO: 395910 - RNA, 64 nt, Homo Sapiens; identical to SEQ ID NO: 132617

SEQ ID NO: 395911 - RNA, 64 nt, Homo Sapiens; identical to SEQ ID NO: 132618

SEQ ID NO: 395912 - RNA, 64 nt, Homo Sapiens; identical to SEQ ID NO: 132619

SEQ ID NO: 395913 - RNA, 64 nt, Homo Sapiens; identical to SEQ ID NO: 132620

SEQ ID NO: 395914 - RNA, 64 nt, Homo Sapiens; identical to SEQ ID NO: 132621

SEQ ID NO: 395915 - RNA, 64 nt, Homo Sapiens; identical to SEQ ID NO: 132622

SEQ ID NO: 395916 - RNA, 64 nt, Homo Sapiens; identical to SEQ ID NO: 132623

SEQ ID NO: 395917 - RNA, 64 nt, Homo Sapiens; identical to SEQ ID NO: 132624

SEQ ID NO: 395918 - RNA, 64 nt, Homo Sapiens; identical to SEQ ID NO: 132625

SEQ ID NO: 395919 - RNA, 64 nt, Homo Sapiens; identical to SEQ ID NO: 132626

SEQ ID NO: 395920 - RNA, 64 nt, Homo Sapiens; identical to SEQ ID NO: 132627

SEQ ID NO: 395921 - RNA, 64 nt, Homo Sapiens; identical to SEQ ID NO: 132628

SEQ ID NO: 395922 - RNA, 64 nt, Homo Sapiens; identical to SEQ ID NO: 132629

SEQ ID NO: 395923 - RNA, 64 nt, Homo Sapiens; identical to SEQ ID NO: 132630

SEQ ID NO: 395924 - RNA, 64 nt, Homo Sapiens; identical to SEQ ID NO: 132631

SEQ ID NO: 395925 - RNA, 64 nt, Homo Sapiens; identical to SEQ ID NO: 132632

SEQ ID NO: 395926 - RNA, 64 nt, Homo Sapiens; identical to SEQ ID NO: 132633

SEQ ID NO: 395927 - RNA, 64 nt, Homo Sapiens; identical to SEQ ID NO: 132634

SEQ ID NO: 395928 - RNA, 64 nt, Homo Sapiens; identical to SEQ ID NO: 132635

SEQ ID NO: 395929 - RNA, 64 nt, Homo Sapiens; identical to SEQ ID NO: 132636

SEQ ID NO: 395930 - RNA, 64 nt, Homo Sapiens; identical to SEQ ID NO: 132637

SEQ ID NO: 395931 - RNA, 64 nt, Homo Sapiens; identical to SEQ ID NO: 132638

SEQ ID NO: 395932 - RNA, 64 nt, Homo Sapiens; identical to SEQ ID NO: 132639

SEQ ID NO: 395933 - RNA, 64 nt, Homo Sapiens; identical to SEQ ID NO: 132640

SEQ ID NO: 395934 - RNA, 64 nt, Homo Sapiens; identical to SEQ ID NO: 132641

SEQ ID NO: 395935 - RNA, 64 nt, Homo Sapiens; identical to SEQ ID NO: 132642

SEQ ID NO: 395936 - RNA, 64 nt, Homo Sapiens; identical to SEQ ID NO: 132643

SEQ ID NO: 395937 - RNA, 64 nt, Homo Sapiens; identical to SEQ ID NO: 132644

SEQ ID NO: 395938 - RNA, 64 nt, Homo Sapiens; identical to SEQ ID NO: 132645

SEQ ID NO: 395939 - RNA, 64 nt, Homo Sapiens; identical to SEQ ID NO: 132646

SEQ ID NO: 395940 - RNA, 64 nt, Homo Sapiens; identical to SEQ ID NO: 132647

SEQ ID NO: 395941 - RNA, 64 nt, Homo Sapiens; identical to SEQ ID NO: 132648

SEQ ID NO: 395942 - RNA, 64 nt, Homo Sapiens; identical to SEQ ID NO: 132649

SEQ ID NO: 395943 - RNA, 64 nt, Homo Sapiens; identical to SEQ ID NO: 132650

SEQ ID NO: 395944 - RNA, 64 nt, Homo Sapiens; identical to SEQ ID NO: 132651

SEQ ID NO: 395945 - RNA, 64 nt, Homo Sapiens; identical to SEQ ID NO: 132652

SEQ ID NO: 395946 - RNA, 64 nt, Homo Sapiens; identical to SEQ ID NO: 132653

SEQ ID NO: 395947 - RNA, 64 nt, Homo Sapiens; identical to SEQ ID NO: 132654

SEQ ID NO: 395948 - RNA, 64 nt, Homo Sapiens; identical to SEQ ID NO: 132655

SEQ ID NO: 395949 - RNA, 64 nt, Homo Sapiens; identical to SEQ ID NO: 132656

SEQ ID NO: 395950 - RNA, 64 nt, Homo Sapiens; identical to SEQ ID NO: 132657

SEQ ID NO: 395951 - RNA, 64 nt, Homo Sapiens; identical to SEQ ID NO: 132658

SEQ ID NO: 395952 - RNA, 64 nt, Homo Sapiens; identical to SEQ ID NO: 132659

SEQ ID NO: 395953 - RNA, 64 nt, Homo Sapiens; identical to SEQ ID NO: 132660

SEQ ID NO: 395954 - RNA, 64 nt, Homo Sapiens; identical to SEQ ID NO: 132661

SEQ ID NO: 395955 - RNA, 64 nt, Homo Sapiens; identical to SEQ ID NO: 132662

SEQ ID NO: 395956 - RNA, 64 nt, Homo Sapiens; identical to SEQ ID NO: 132663

SEQ ID NO: 395957 - RNA, 64 nt, Homo Sapiens; identical to SEQ ID NO: 132664

SEQ ID NO: 395958 - RNA, 64 nt, Homo Sapiens; identical to SEQ ID NO: 132665

SEQ ID NO: 395959 - RNA, 64 nt, Homo Sapiens; identical to SEQ ID NO: 132666

SEQ ID NO: 395960 - RNA, 64 nt, Homo Sapiens; identical to SEQ ID NO: 132667

SEQ ID NO: 395961 - RNA, 64 nt, Homo Sapiens; identical to SEQ ID NO: 132668

SEQ ID NO: 395962 - RNA, 64 nt, Homo Sapiens; identical to SEQ ID NO: 132669

SEQ ID NO: 395963 - RNA, 64 nt, Homo Sapiens; identical to SEQ ID NO: 132670

SEQ ID NO: 395964 - RNA, 64 nt, Homo Sapiens; identical to SEQ ID NO: 132671

SEQ ID NO: 395965 - RNA, 64 nt, Homo Sapiens; identical to SEQ ID NO: 132672

SEQ ID NO: 395966 - RNA, 64 nt, Homo Sapiens; identical to SEQ ID NO: 132673

SEQ ID NO: 395967 - RNA, 64 nt, Homo Sapiens; identical to SEQ ID NO: 132674

SEQ ID NO: 395968 - RNA, 64 nt, Homo Sapiens; identical to SEQ ID NO: 132675

SEQ ID NO: 395969 - RNA, 64 nt, Homo Sapiens; identical to SEQ ID NO: 132676

SEQ ID NO: 395970 - RNA, 64 nt, Homo Sapiens; identical to SEQ ID NO: 132677

SEQ ID NO: 395971 - RNA, 57 nt, Homo Sapiens; identical to SEQ ID NO: 132678

SEQ ID NO: 395972 - RNA, 64 nt, Homo Sapiens; identical to SEQ ID NO: 132679

SEQ ID NO: 395973 - RNA, 64 nt, Homo Sapiens; identical to SEQ ID NO: 132680

SEQ ID NO: 395974 - RNA, 64 nt, Homo Sapiens; identical to SEQ ID NO: 132681

SEQ ID NO: 395975 - RNA, 64 nt, Homo Sapiens; identical to SEQ ID NO: 132682

SEQ ID NO: 395976 - RNA, 64 nt, Homo Sapiens; identical to SEQ ID NO: 132683

SEQ ID NO: 395977 - RNA, 64 nt, Homo Sapiens; identical to SEQ ID NO: 132684

SEQ ID NO: 395978 - RNA, 64 nt, Homo Sapiens; identical to SEQ ID NO: 132685

SEQ ID NO: 395979 - RNA, 64 nt, Homo Sapiens; identical to SEQ ID NO: 132686

SEQ ID NO: 395980 - RNA, 64 nt, Homo Sapiens; identical to SEQ ID NO: 132687

SEQ ID NO: 395981 - RNA, 64 nt, Homo Sapiens; identical to SEQ ID NO: 132688

SEQ ID NO: 395982 - RNA, 64 nt, Homo Sapiens; identical to SEQ ID NO: 132689

SEQ ID NO: 395983 - RNA, 64 nt, Homo Sapiens; identical to SEQ ID NO: 132690

SEQ ID NO: 395984 - RNA, 55 nt, Homo Sapiens; identical to SEQ ID NO: 132691

SEQ ID NO: 395985 - RNA, 64 nt, Homo Sapiens; identical to SEQ ID NO: 132692

SEQ ID NO: 395986 - RNA, 64 nt, Homo Sapiens; identical to SEQ ID NO: 132693

SEQ ID NO: 395987 - RNA, 64 nt, Homo Sapiens; identical to SEQ ID NO: 132694

SEQ ID NO: 395988 - RNA, 64 nt, Homo Sapiens; identical to SEQ ID NO: 132695

SEQ ID NO: 395989 - RNA, 64 nt, Homo Sapiens; identical to SEQ ID NO: 132696

SEQ ID NO: 395990 - RNA, 64 nt, Homo Sapiens; identical to SEQ ID NO: 132697

SEQ ID NO: 395991 - RNA, 64 nt, Homo Sapiens; identical to SEQ ID NO: 132698

SEQ ID NO: 395992 - RNA, 64 nt, Homo Sapiens; identical to SEQ ID NO: 132699

SEQ ID NO: 395993 - RNA, 64 nt, Homo Sapiens; identical to SEQ ID NO: 132700

SEQ ID NO: 395994 - RNA, 64 nt, Homo Sapiens; identical to SEQ ID NO: 132701

SEQ ID NO: 395995 - RNA, 64 nt, Homo Sapiens; identical to SEQ ID NO: 132702

SEQ ID NO: 395996 - RNA, 64 nt, Homo Sapiens; identical to SEQ ID NO: 132703

SEQ ID NO: 395997 - RNA, 64 nt, Homo Sapiens; identical to SEQ ID NO: 132704

SEQ ID NO: 395998 - RNA, 64 nt, Homo Sapiens; identical to SEQ ID NO: 132705

SEQ ID NO: 395999 - RNA, 64 nt, Homo Sapiens; identical to SEQ ID NO: 132706

SEQ ID NO: 396000 - RNA, 64 nt, Homo Sapiens; identical to SEQ ID NO: 132707

SEQ ID NO: 396001 - RNA, 64 nt, Homo Sapiens; identical to SEQ ID NO: 132708

SEQ ID NO: 396002 - RNA, 64 nt, Homo Sapiens; identical to SEQ ID NO: 132709

SEQ ID NO: 396003 - RNA, 64 nt, Homo Sapiens; identical to SEQ ID NO: 132710

SEQ ID NO: 396004 - RNA, 64 nt, Homo Sapiens; identical to SEQ ID NO: 132711

SEQ ID NO: 396005 - RNA, 64 nt, Homo Sapiens; identical to SEQ ID NO: 132712

SEQ ID NO: 396006 - RNA, 64 nt, Homo Sapiens
ucagauguuugaauuucagaucuuuuuuuauagaguacccaaacccuccuuucugcuugccuca

SEQ ID NO: 396007 - RNA, 64 nt, Homo Sapiens
acauccagccuuaguucuuggggugcaguaguauguacccaagggcagaugccucuuggggaag

SEQ ID NO: 396008 - RNA, 64 nt, Homo Sapiens
ucaaauacuuaguaggcuuccuaacagcaacaauguacccaaaagaggguagaauucugagaaa

SEQ ID NO: 396009 - RNA, 64 nt, Homo Sapiens
uagccuuggcuugaguuuuuaguuuccccucaaaguacccaaaggguuucucuuggaaaugguc

SEQ ID NO: 396010 - RNA, 64 nt, Homo Sapiens
cuguguaucuccuguuccugagguauuauggaaaguacccaaguuccuggcguucuaggagucu

SEQ ID NO: 396011 - RNA, 64 nt, Homo Sapiens
aacaauggcuaucauguacugcaagccugccccaguacccaaaaguccuugagagaacagggga

SEQ ID NO: 396012 - RNA, 64 nt, Homo Sapiens
cuuacguuucccaauaaagaugguuuuauuugauguacccaaguugauuuuuucccccagaaau

SEQ ID NO: 396013 - RNA, 64 nt, Homo Sapiens
gcugcccauuucgugagcccguccauauuuauagguacccaauauggccuguguggccacuucu

SEQ ID NO: 396014 - RNA, 64 nt, Homo Sapiens
cccugccaauucucagugugcaaaugcuacacccguacccaaaggggguauauuaauccucagg

SEQ ID NO: 396015 - RNA, 64 nt, Homo Sapiens
ugauuucucaucuggucaauugcaggcaugggcuguacccaagcgagccacccacugaaagggc

SEQ ID NO: 396016 - RNA, 64 nt, Homo Sapiens
gagauucauguuaccucaucuucuuuuuuaaacuguacccaacuugugaggguacucugucuaa

SEQ ID NO: 396017 - RNA, 64 nt, Homo Sapiens
ccccucugcccggccaccaccccgucugggagguguacccaacagcucauugagagcgggcgau

SEQ ID NO: 396018 - RNA, 64 nt, Homo Sapiens
ucauagcgggggccuaaaaaaaaaaagcuucacaguacccaaacugcuuuuuccaacucagaaa

SEQ ID NO: 396019 - RNA, 64 nt, Homo Sapiens
uaggauaaacuccauuauugccauggcugucaugguacccaagugacuuggaagaugcauuuaa

SEQ ID NO: 396020 - RNA, 64 nt, Homo Sapiens
auaauugaaauacaauaaacuguacauauuuaaaguacccaauaugauaaguuuugucauaugc

SEQ ID NO: 396021 - RNA, 64 nt, Homo Sapiens
auauuuuaaccuguuaaguguguguguguuuucuguacccaaccagacuuuaaauaaaacaaac

SEQ ID NO: 396022 - RNA, 64 nt, Homo Sapiens
ccgacgaaucucugcaaucuagccaacaucaucuguacccaaccaauggaccaccugagaaggu

SEQ ID NO: 396023 - RNA, 64 nt, Homo Sapiens
guuacuuuucugguccugucagguacuaagccuaguacccaauauacagauuauuuagugaccc

SEQ ID NO: 396024 - RNA, 64 nt, Homo Sapiens
gaugucacuaccaaggccaaugucugucaucacuguacccaaguugagguccagccccuuaggc

SEQ ID NO: 396025 - RNA, 64 nt, Homo Sapiens
gaggagcaaauugagguucagcaaggugagagagguacccaaggucacauagcuaguuauguga

SEQ ID NO: 396026 - RNA, 64 nt, Homo Sapiens
aaagacagguuacugaccauugaguguuuacuauguacccaauguguauauuuuucuuuuuaau

SEQ ID NO: 396027 - RNA, 64 nt, Homo Sapiens
gcuacucccuaaaugguuccauccaaggcuuagaguacccaaaggcuaagaaauucuaaagaac

SEQ ID NO: 396028 - RNA, 64 nt, Homo Sapiens
uguguggaugcugagcugugauggcgggcacuggguacccaagugaagguucccaaggacauga

SEQ ID NO: 396029 - RNA, 56 nt, Homo Sapiens
acgagcugacgggcuuuuagcagcauguacccaaaguguucugauuccuucaacug

SEQ ID NO: 396030 - RNA, 64 nt, Homo Sapiens
uuaggaaugcuuggccucuggcaggcaggcagcuguacccaagcuggugggcagggggcuggaa

SEQ ID NO: 396031 - RNA, 64 nt, Homo Sapiens
cuuucauuauuuuucuuuuuuuggcaaaggcuugguacccaaggugcgguagggggucgagggg

SEQ ID NO: 396032 - RNA, 64 nt, Homo Sapiens
aaaaauacauuaucagugauugaaacguuuacauguacccaaaaaccauaaucaucucuuggaa

SEQ ID NO: 396033 - RNA, 64 nt, Homo Sapiens
gacuugcuuagguaccuggcuggcguguccugcuguacccaacuuaccagcuacccuggaaugg

SEQ ID NO: 396034 - RNA, 64 nt, Homo Sapiens
acacaaaaggugucccuuuaaaguuuucauuugaguacccaaauuggucaaagaaugcauuccu

SEQ ID NO: 396035 - RNA, 64 nt, Homo Sapiens
ugaaguaccuagcacagugucuucaacauagaagguacccaauaaauauauaucaauucauuuu

SEQ ID NO: 396036 - RNA, 64 nt, Homo Sapiens
agguuuucuggccugaagcagucugcacugaaagguacccaaguggccugaaacaguguaggga

SEQ ID NO: 396037 - RNA, 64 nt, Homo Sapiens
uaauuauauuaugaauaaaauuguuauuucaauaguacccaaccaaagaugcuuaaaaaccuuc

SEQ ID NO: 396038 - RNA, 64 nt, Homo Sapiens
gguaauuuuucauccauuacgagugauguacauuguacccaauauuuuaauguacuugucaccu

SEQ ID NO: 396039 - RNA, 64 nt, Homo Sapiens
cuuaagcuggucuuuugcauugcuaaugugacauguacccaacuuuucauuaauuuguauuucc

SEQ ID NO: 396040 - RNA, 64 nt, Homo Sapiens
gaauuuucuuucuuaaaaauuguaaaacauaaugguacccaaguuuuaaacuuagaugugcuuc

SEQ ID NO: 396041 - RNA, 64 nt, Homo Sapiens
uauuuuagcuauuuuaguagugcacucaugacaaguacccaaugaacagugugaucuuuacuga

SEQ ID NO: 396042 - RNA, 64 nt, Homo Sapiens
gcaucucuccaucuacaaagguuauuucucauaaguacccaauggucagauucugaauuccaaa

SEQ ID NO: 396043 - RNA, 64 nt, Homo Sapiens
uaaccaaucugugcaacaacauagacugaccucaguacccaagagaguguaaauauuucugggc

SEQ ID NO: 396044 - RNA, 64 nt, Homo Sapiens
gaggaaggcugagaggggggccaccccauuucugguacccaauuugguucuucagcccaacuug

SEQ ID NO: 396045 - RNA, 64 nt, Homo Sapiens
ugaaggaggaauacgagggcuuugggcaggcuggguacccaauauacaaagagcagcacuggug

SEQ ID NO: 396046 - RNA, 64 nt, Homo Sapiens
auggaucugcaacuuuggacuaaggucauucaauguacccaaacuugaacaggggguucauugu

SEQ ID NO: 396047 - RNA, 64 nt, Homo Sapiens
uugaauagaaauaauggcuuagcacuguaguuaaguacccaaaaacugcauaaacuuuacaucc

SEQ ID NO: 396048 - RNA, 64 nt, Homo Sapiens
gaaaugucgugaacaugaaaguuaaaugacuugaguacccaaaaacuccgucucaaaaaaaaaa

SEQ ID NO: 396049 - RNA, 64 nt, Homo Sapiens
auuuaaaaaugacucucuuacauauuauucaguuguacccaaguauaaaagaaauggcaggacu

SEQ ID NO: 396050 - RNA, 64 nt, Homo Sapiens
gcguacgucuuuguucuuuaaggaccucagaaaaguacccaaauugacaccacaccagcacagu

SEQ ID NO: 396051 - RNA, 64 nt, Homo Sapiens
aaaaaaaaaaaaauaaagaaccaucucgauucucguacccaacuuguuggguuuuguucccccu

SEQ ID NO: 396052 - RNA, 64 nt, Homo Sapiens
cugaguaguuucugaggaggaacaaauuacaaguguacccaauaacugaaaauguuuuaacuca

SEQ ID NO: 396053 - RNA, 64 nt, Homo Sapiens
aacgccugcgugugaacagaugaaaaauccuucaguacccaagucccagucuguccuaugggga

SEQ ID NO: 396054 - RNA, 64 nt, Homo Sapiens
gauacuuuuuugauaccccaagguaauaagcauaguacccaauauacauauuauuucauuaccc

SEQ ID NO: 396055 - RNA, 64 nt, Homo Sapiens
augaugguacaguuaggugagauuuucuguuaugguacccaaacucaccauuugguccucuuua

SEQ ID NO: 396056 - RNA, 64 nt, Homo Sapiens
gaagcauguuuacggagaaaacuacaaccuaucaguacccaagggcaauucuauccguugaucu

SEQ ID NO: 396057 - RNA, 64 nt, Homo Sapiens
gaugccagaauacuaguauuauauaaaagggccuguacccaaaggucauuguagacaucuauaa

SEQ ID NO: 396058 - RNA, 64 nt, Homo Sapiens
cuuaguugauggaaaccugugagucuuggguugaguacccaaaugcuaccacuggagaaggaau

SEQ ID NO: 396059 - RNA, 64 nt, Homo Sapiens
cccaaaaaggaaaaauaaaaaaaaaggaauauuuguacccaacagcuagaaggauugcaaggua

SEQ ID NO: 396060 - RNA, 64 nt, Homo Sapiens
gagcaauacauaagcucaauuugauuugagacuaguacccaagugcaguuuuaguauggcucaa

SEQ ID NO: 396061 - RNA, 64 nt, Homo Sapiens
uuccacauuuauugagcuccaccuguguguauguguacccaagcacacaugugugaagggcuau

SEQ ID NO: 396062 - RNA, 64 nt, Homo Sapiens
aaaugagaagcuucuauccuuauacauuuggaaaguacccaaauuauuuuucuacuuugaauug

SEQ ID NO: 396063 - RNA, 64 nt, Homo Sapiens
auaagccaggacauucugcugugagugacuuauuguacccaacucuauuucucuccauacugaa

SEQ ID NO: 396064 - RNA, 64 nt, Homo Sapiens
auuugugcuuaguccaauuccuugcacauaguagguacccaauucaauuacuauugaaugaauu

SEQ ID NO: 396065 - RNA, 64 nt, Homo Sapiens
gaaaauaccuuauuaucugcagggacucaaagcuguacccaaaucaagaaagacaaaauaacaa

SEQ ID NO: 396066 - RNA, 64 nt, Homo Sapiens
gagguuacaugguguuaaaucgguaccugauaauguacccaaauacuauggccagauaauaaau

SEQ ID NO: 396067 - RNA, 64 nt, Homo Sapiens
aacuucaucaagaguaaaugcaguggcaugcuaaguacccaaauaggaguguaugcagaggaug

SEQ ID NO: 396068 - RNA, 64 nt, Homo Sapiens
gcguuguaauuaacaugauugugaagcucaagugguacccaacucugugaggauuuuuaucgca

SEQ ID NO: 396069 - RNA, 64 nt, Homo Sapiens
gaagagaacgucaugaguguaccgaguacacagaguacccaaguuuuuuuuuuuuuuuuuuuuu

SEQ ID NO: 396070 - RNA, 64 nt, Homo Sapiens
ucuggaggcacaacgcccauccuuaggccaaacaguacccaaggccucagcccacaccaagacu

SEQ ID NO: 396071 - RNA, 64 nt, Homo Sapiens
uucagauuucauuugcuguugcuuuauacguuacguacccaaggacauugccucaggguugcaa

SEQ ID NO: 396072 - RNA, 64 nt, Homo Sapiens
aaauacugaguuguguccacggguuugucuccugguacccaaaggagcaucaaccccacuccau

SEQ ID NO: 396073 - RNA, 64 nt, Homo Sapiens
agaucuucuguuaauacacauugguuguuaaagaguacccaaauucuaggacaaugcuuaaagu

SEQ ID NO: 396074 - RNA, 64 nt, Homo Sapiens
ucaugggaaugaugugccugccauccuccuggugguacccaaugcaagucagcuguaucaggag

SEQ ID NO: 396075 - RNA, 64 nt, Homo Sapiens
ggaaaguaacucauuuguuaugacaacugugacuguacccaaaucuggugcuuccaaauauugu

SEQ ID NO: 396076 - RNA, 64 nt, Homo Sapiens
caccucccugcccaacgccuuguggucaaaccagguacccaagccacaaucaugauauucuaac

SEQ ID NO: 396077 - RNA, 64 nt, Homo Sapiens
augguccugaacaguguauuguggaucaucaguaguacccaagcuaacucagcguaagugaccu

SEQ ID NO: 396078 - RNA, 64 nt, Homo Sapiens
aagauggagcucccccauccagucuccuccccauguacccaaggccgcuucuccuggucacugg

SEQ ID NO: 396079 - RNA, 64 nt, Homo Sapiens
ccccgcgccaucagccuggaggcuggaggggcguguacccaaaucccaccgcaggcaccccggg

SEQ ID NO: 396080 - RNA, 64 nt, Homo Sapiens
ggcucugggcacuccagcccugaaagccccagguguacccaauuggcagccucucacuacucuu

SEQ ID NO: 396081 - RNA, 64 nt, Homo Sapiens
ggugccuaaaguguuuccaaucucugggaccucuguacccaaacugaaacucuaaauuggggcc

SEQ ID NO: 396082 - RNA, 64 nt, Homo Sapiens
gaauauacuuguaguuuuacuucuuucuguuuauguacccaauuccuuaugauuauuuuguuuc

SEQ ID NO: 396083 - RNA, 64 nt, Homo Sapiens
ggaaaaagagaaaagcugauagaagggagagaagguacccaaaggccuaaaaaggccccugcaa

SEQ ID NO: 396084 - RNA, 64 nt, Homo Sapiens
uuugaccaucaaaaugaugaacuuuacuuaugugguacccaaugccagaauguaagaguugcaa

SEQ ID NO: 396085 - RNA, 64 nt, Homo Sapiens
cacccaaggguagucuuuuuuauccaucaagucuguacccaauguguagucuuuguuuuuuucu

SEQ ID NO: 396086 - RNA, 64 nt, Homo Sapiens
aaaguuccucaguaagaaaacauaaaauugaauaguacccaauuguagauuaggugaaguagaa

SEQ ID NO: 396087 - RNA, 64 nt, Homo Sapiens
uggauuguauuuuaauggacagaaaaccugaagaguacccaaauauuauucagauggagaacuu

SEQ ID NO: 396088 - RNA, 64 nt, Homo Sapiens
gccgccuugugucuugcucguccaugaagcugugguacccaauugcaaauucccaccacuuacu

SEQ ID NO: 396089 - RNA, 58 nt, Homo Sapiens
uccuggugaagagccagugaggccccugguacccaagcccccuccccugaccugggug

SEQ ID NO: 396090 - RNA, 64 nt, Homo Sapiens
caaagcuuuuagaaauacugcaagaaaaugauguguacccaaacgugagcauaggaggcuucug

SEQ ID NO: 396091 - RNA, 64 nt, Homo Sapiens
ggaugcaauaggcugauuguauuuaaaaaucaaaguacccaaaacugagucccuuugggcucag

SEQ ID NO: 396092 - RNA, 64 nt, Homo Sapiens
aauggcuagagggagaguccaguuucugagcucuguacccaaauuaaaauccugauguucaggu

SEQ ID NO: 396093 - RNA, 64 nt, Homo Sapiens
uucgcacgaguguguugcacucgagccggguccaguacccaaccagugucccggcacaggccca

SEQ ID NO: 396094 - RNA, 64 nt, Homo Sapiens
uaccuuacagcucacaaccucagcuggguuuuagguacccaaaaagggccugucuagauuuuuu

SEQ ID NO: 396095 - RNA, 64 nt, Homo Sapiens
uauccccaagggguucagggacuacagaccauuaguacccaagugaagucuucugacgauccag

SEQ ID NO: 396096 - RNA, 64 nt, Homo Sapiens
augaugugauuuauagaaaaacugggaaauacagguacccaaagaguaaaucaacaucuguaua

SEQ ID NO: 396097 - RNA, 64 nt, Homo Sapiens
ucuuccuuaaagacauuuaagcuaaaggcaacucguacccaaauuuccaagacacaaacaugac

SEQ ID NO: 396098 - RNA, 64 nt, Homo Sapiens
cucagccagucucuauuuaacuagcacuauggagguacccaagguaacccaucguuagggcacu

SEQ ID NO: 396099 - RNA, 64 nt, Homo Sapiens
cauccccaccccauaugggaucaccccuccuccuguacccaacccucccugaaccuagacaguu

SEQ ID NO: 396100 - RNA, 64 nt, Homo Sapiens
gccccugccccacuucucccaaacacagacccucguacccaaagacccucccaugcagugggag

SEQ ID NO: 396101 - RNA, 64 nt, Homo Sapiens
ucacauagcugggauuugaaauuugucuuugaacguacccaaggacuguucuauagcagucauc

SEQ ID NO: 396102 - RNA, 64 nt, Homo Sapiens
caauaaggaaaguuaauucccuuugagcacccagguacccaagcuuuuaauauuuguacacauu

SEQ ID NO: 396103 - RNA, 64 nt, Homo Sapiens
acuuguauuuaugcuuuugacuaacuuucaauguguacccaaauaagaagaaauugguuaaguc

SEQ ID NO: 396104 - RNA, 64 nt, Homo Sapiens
acuaaaccagggagggcucggcccucagcuacugguacccaauguguuccugggagccgagaga

SEQ ID NO: 396105 - RNA, 64 nt, Homo Sapiens
cugaguguuaauuuaacucucagucguguguacuguacccaagcugacgugucucgccucuccu

SEQ ID NO: 396106 - RNA, 64 nt, Homo Sapiens
aggacugucuaugcaugcacgagcccccuuaugaguacccaagaucaggggcaccugagggucu

SEQ ID NO: 396107 - RNA, 64 nt, Homo Sapiens
uccaucaguccaaauggggguucugagaaggaaaguacccaacauuggcuucggaguauuugac

SEQ ID NO: 396108 - RNA, 64 nt, Homo Sapiens
uaauuccauaaucaaucuaucgggauuugaagcuguacccaauuccccagugccacagagaaga

SEQ ID NO: 396109 - RNA, 64 nt, Homo Sapiens
cguugagguagaggggaaggaaaucuccucuuuuguacccaauacuuauguuguauuguuggug

SEQ ID NO: 396110 - RNA, 64 nt, Homo Sapiens
acauuacagaccauggauauguuguauuaacuggguacccaaaacacauuuuccauauuuggau

SEQ ID NO: 396111 - RNA, 64 nt, Homo Sapiens
cccaaauccucuccagcuauaacaguagggaugaguacccaaaagcucagccagccccaucagg

SEQ ID NO: 396112 - RNA, 64 nt, Homo Sapiens
ugauucuugugucaucaaguaguaguacuuaauaguacccaaccugguaauuauccucaaguug

SEQ ID NO: 396113 - RNA, 64 nt, Homo Sapiens; identical to SEQ ID NO: 179815

SEQ ID NO: 396114 - RNA, 64 nt, Homo Sapiens; identical to SEQ ID NO: 179816

SEQ ID NO: 396115 - RNA, 64 nt, Homo Sapiens; identical to SEQ ID NO: 179817

SEQ ID NO: 396116 - RNA, 64 nt, Homo Sapiens; identical to SEQ ID NO: 179818

SEQ ID NO: 396117 - RNA, 64 nt, Homo Sapiens; identical to SEQ ID NO: 179819

SEQ ID NO: 396118 - RNA, 64 nt, Homo Sapiens; identical to SEQ ID NO: 179820

SEQ ID NO: 396119 - RNA, 64 nt, Homo Sapiens; identical to SEQ ID NO: 179821

SEQ ID NO: 396120 - RNA, 64 nt, Homo Sapiens; identical to SEQ ID NO: 179822

SEQ ID NO: 396121 - RNA, 64 nt, Homo Sapiens; identical to SEQ ID NO: 179823

SEQ ID NO: 396122 - RNA, 64 nt, Homo Sapiens; identical to SEQ ID NO: 179824

SEQ ID NO: 396123 - RNA, 64 nt, Homo Sapiens; identical to SEQ ID NO: 179825

SEQ ID NO: 396124 - RNA, 64 nt, Homo Sapiens; identical to SEQ ID NO: 179826

SEQ ID NO: 396125 - RNA, 64 nt, Homo Sapiens; identical to SEQ ID NO: 179827

SEQ ID NO: 396126 - RNA, 64 nt, Homo Sapiens; identical to SEQ ID NO: 179828

SEQ ID NO: 396127 - RNA, 64 nt, Homo Sapiens; identical to SEQ ID NO: 179829

SEQ ID NO: 396128 - RNA, 64 nt, Homo Sapiens; identical to SEQ ID NO: 179830

SEQ ID NO: 396129 - RNA, 64 nt, Homo Sapiens; identical to SEQ ID NO: 179831

SEQ ID NO: 396130 - RNA, 64 nt, Homo Sapiens; identical to SEQ ID NO: 179832

SEQ ID NO: 396131 - RNA, 64 nt, Homo Sapiens; identical to SEQ ID NO: 179833

SEQ ID NO: 396132 - RNA, 64 nt, Homo Sapiens; identical to SEQ ID NO: 179834

SEQ ID NO: 396133 - RNA, 64 nt, Homo Sapiens; identical to SEQ ID NO: 179835

SEQ ID NO: 396134 - RNA, 64 nt, Homo Sapiens; identical to SEQ ID NO: 179836

SEQ ID NO: 396135 - RNA, 64 nt, Homo Sapiens; identical to SEQ ID NO: 179837

SEQ ID NO: 396136 - RNA, 53 nt, Homo Sapiens; identical to SEQ ID NO: 86549

SEQ ID NO: 396137 - RNA, 64 nt, Homo Sapiens; identical to SEQ ID NO: 179839

SEQ ID NO: 396138 - RNA, 64 nt, Homo Sapiens; identical to SEQ ID NO: 179840

SEQ ID NO: 396139 - RNA, 64 nt, Homo Sapiens; identical to SEQ ID NO: 179841

SEQ ID NO: 396140 - RNA, 64 nt, Homo Sapiens; identical to SEQ ID NO: 179842

SEQ ID NO: 396141 - RNA, 64 nt, Homo Sapiens; identical to SEQ ID NO: 179843

SEQ ID NO: 396142 - RNA, 64 nt, Homo Sapiens; identical to SEQ ID NO: 179844

SEQ ID NO: 396143 - RNA, 64 nt, Homo Sapiens; identical to SEQ ID NO: 179845

SEQ ID NO: 396144 - RNA, 64 nt, Homo Sapiens; identical to SEQ ID NO: 179846

SEQ ID NO: 396145 - RNA, 64 nt, Homo Sapiens; identical to SEQ ID NO: 179847

SEQ ID NO: 396146 - RNA, 64 nt, Homo Sapiens; identical to SEQ ID NO: 179848

SEQ ID NO: 396147 - RNA, 64 nt, Homo Sapiens; identical to SEQ ID NO: 179849

SEQ ID NO: 396148 - RNA, 64 nt, Homo Sapiens; identical to SEQ ID NO: 179850

SEQ ID NO: 396149 - RNA, 64 nt, Homo Sapiens; identical to SEQ ID NO: 179851

SEQ ID NO: 396150 - RNA, 64 nt, Homo Sapiens; identical to SEQ ID NO: 179852

SEQ ID NO: 396151 - RNA, 64 nt, Homo Sapiens; identical to SEQ ID NO: 179853

SEQ ID NO: 396152 - RNA, 64 nt, Homo Sapiens; identical to SEQ ID NO: 179854

SEQ ID NO: 396153 - RNA, 64 nt, Homo Sapiens; identical to SEQ ID NO: 179855

SEQ ID NO: 396154 - RNA, 64 nt, Homo Sapiens; identical to SEQ ID NO: 179856

SEQ ID NO: 396155 - RNA, 64 nt, Homo Sapiens; identical to SEQ ID NO: 179857

SEQ ID NO: 396156 - RNA, 64 nt, Homo Sapiens; identical to SEQ ID NO: 179858

SEQ ID NO: 396157 - RNA, 64 nt, Homo Sapiens; identical to SEQ ID NO: 179859

SEQ ID NO: 396158 - RNA, 64 nt, Homo Sapiens; identical to SEQ ID NO: 179860

SEQ ID NO: 396159 - RNA, 64 nt, Homo Sapiens; identical to SEQ ID NO: 179861

SEQ ID NO: 396160 - RNA, 64 nt, Homo Sapiens; identical to SEQ ID NO: 179862

SEQ ID NO: 396161 - RNA, 64 nt, Homo Sapiens; identical to SEQ ID NO: 179863

SEQ ID NO: 396162 - RNA, 64 nt, Homo Sapiens; identical to SEQ ID NO: 179864

SEQ ID NO: 396163 - RNA, 64 nt, Homo Sapiens; identical to SEQ ID NO: 179865

SEQ ID NO: 396164 - RNA, 64 nt, Homo Sapiens; identical to SEQ ID NO: 179866

SEQ ID NO: 396165 - RNA, 64 nt, Homo Sapiens; identical to SEQ ID NO: 179867

SEQ ID NO: 396166 - RNA, 64 nt, Homo Sapiens; identical to SEQ ID NO: 179868

SEQ ID NO: 396167 - RNA, 64 nt, Homo Sapiens; identical to SEQ ID NO: 179869

SEQ ID NO: 396168 - RNA, 64 nt, Homo Sapiens; identical to SEQ ID NO: 163490

SEQ ID NO: 396169 - RNA, 64 nt, Homo Sapiens; identical to SEQ ID NO: 163491

SEQ ID NO: 396170 - RNA, 64 nt, Homo Sapiens; identical to SEQ ID NO: 163492

SEQ ID NO: 396171 - RNA, 64 nt, Homo Sapiens; identical to SEQ ID NO: 163493

SEQ ID NO: 396172 - RNA, 64 nt, Homo Sapiens; identical to SEQ ID NO: 163494

SEQ ID NO: 396173 - RNA, 64 nt, Homo Sapiens; identical to SEQ ID NO: 163495

SEQ ID NO: 396174 - RNA, 64 nt, Homo Sapiens; identical to SEQ ID NO: 163496

SEQ ID NO: 396175 - RNA, 64 nt, Homo Sapiens; identical to SEQ ID NO: 163497

SEQ ID NO: 396176 - RNA, 64 nt, Homo Sapiens; identical to SEQ ID NO: 163498

SEQ ID NO: 396177 - RNA, 64 nt, Homo Sapiens; identical to SEQ ID NO: 163499

SEQ ID NO: 396178 - RNA, 64 nt, Homo Sapiens; identical to SEQ ID NO: 163500

SEQ ID NO: 396179 - RNA, 64 nt, Homo Sapiens; identical to SEQ ID NO: 163501

SEQ ID NO: 396180 - RNA, 64 nt, Homo Sapiens; identical to SEQ ID NO: 163502

SEQ ID NO: 396181 - RNA, 64 nt, Homo Sapiens; identical to SEQ ID NO: 163503

SEQ ID NO: 396182 - RNA, 64 nt, Homo Sapiens; identical to SEQ ID NO: 163504

SEQ ID NO: 396183 - RNA, 64 nt, Homo Sapiens; identical to SEQ ID NO: 163505

SEQ ID NO: 396184 - RNA, 64 nt, Homo Sapiens; identical to SEQ ID NO: 163506

SEQ ID NO: 396185 - RNA, 64 nt, Homo Sapiens; identical to SEQ ID NO: 163507

SEQ ID NO: 396186 - RNA, 64 nt, Homo Sapiens; identical to SEQ ID NO: 163508

SEQ ID NO: 396187 - RNA, 64 nt, Homo Sapiens; identical to SEQ ID NO: 163509

SEQ ID NO: 396188 - RNA, 64 nt, Homo Sapiens; identical to SEQ ID NO: 163510

SEQ ID NO: 396189 - RNA, 64 nt, Homo Sapiens; identical to SEQ ID NO: 163511

SEQ ID NO: 396190 - RNA, 64 nt, Homo Sapiens; identical to SEQ ID NO: 163512

SEQ ID NO: 396191 - RNA, 64 nt, Homo Sapiens; identical to SEQ ID NO: 163513

SEQ ID NO: 396192 - RNA, 64 nt, Homo Sapiens; identical to SEQ ID NO: 163514

SEQ ID NO: 396193 - RNA, 64 nt, Homo Sapiens; identical to SEQ ID NO: 163515

SEQ ID NO: 396194 - RNA, 64 nt, Homo Sapiens; identical to SEQ ID NO: 163516

SEQ ID NO: 396195 - RNA, 64 nt, Homo Sapiens; identical to SEQ ID NO: 163517

SEQ ID NO: 396196 - RNA, 64 nt, Homo Sapiens; identical to SEQ ID NO: 163518

SEQ ID NO: 396197 - RNA, 64 nt, Homo Sapiens; identical to SEQ ID NO: 163519

SEQ ID NO: 396198 - RNA, 64 nt, Homo Sapiens; identical to SEQ ID NO: 163520

SEQ ID NO: 396199 - RNA, 64 nt, Homo Sapiens; identical to SEQ ID NO: 163521

SEQ ID NO: 396200 - RNA, 64 nt, Homo Sapiens; identical to SEQ ID NO: 163522

SEQ ID NO: 396201 - RNA, 64 nt, Homo Sapiens; identical to SEQ ID NO: 163523

SEQ ID NO: 396202 - RNA, 64 nt, Homo Sapiens; identical to SEQ ID NO: 163524

SEQ ID NO: 396203 - RNA, 64 nt, Homo Sapiens; identical to SEQ ID NO: 163525

SEQ ID NO: 396204 - RNA, 64 nt, Homo Sapiens; identical to SEQ ID NO: 163526

SEQ ID NO: 396205 - RNA, 64 nt, Homo Sapiens; identical to SEQ ID NO: 163527

SEQ ID NO: 396206 - RNA, 64 nt, Homo Sapiens; identical to SEQ ID NO: 163528

SEQ ID NO: 396207 - RNA, 64 nt, Homo Sapiens; identical to SEQ ID NO: 163529

SEQ ID NO: 396208 - RNA, 64 nt, Homo Sapiens; identical to SEQ ID NO: 163530

SEQ ID NO: 396209 - RNA, 64 nt, Homo Sapiens; identical to SEQ ID NO: 163531

SEQ ID NO: 396210 - RNA, 64 nt, Homo Sapiens; identical to SEQ ID NO: 163532

SEQ ID NO: 396211 - RNA, 64 nt, Homo Sapiens; identical to SEQ ID NO: 163533

SEQ ID NO: 396212 - RNA, 64 nt, Homo Sapiens; identical to SEQ ID NO: 163534

SEQ ID NO: 396213 - RNA, 64 nt, Homo Sapiens; identical to SEQ ID NO: 163535

SEQ ID NO: 396214 - RNA, 64 nt, Homo Sapiens; identical to SEQ ID NO: 163536

SEQ ID NO: 396215 - RNA, 64 nt, Homo Sapiens; identical to SEQ ID NO: 163537

SEQ ID NO: 396216 - RNA, 64 nt, Homo Sapiens; identical to SEQ ID NO: 163538

SEQ ID NO: 396217 - RNA, 64 nt, Homo Sapiens; identical to SEQ ID NO: 163539

SEQ ID NO: 396218 - RNA, 64 nt, Homo Sapiens; identical to SEQ ID NO: 163540

SEQ ID NO: 396219 - RNA, 64 nt, Homo Sapiens; identical to SEQ ID NO: 163541

SEQ ID NO: 396220 - RNA, 64 nt, Homo Sapiens; identical to SEQ ID NO: 163542

SEQ ID NO: 396221 - RNA, 64 nt, Homo Sapiens; identical to SEQ ID NO: 163543

SEQ ID NO: 396222 - RNA, 64 nt, Homo Sapiens; identical to SEQ ID NO: 163544

SEQ ID NO: 396223 - RNA, 64 nt, Homo Sapiens; identical to SEQ ID NO: 163545

SEQ ID NO: 396224 - RNA, 64 nt, Homo Sapiens; identical to SEQ ID NO: 163546

SEQ ID NO: 396225 - RNA, 64 nt, Homo Sapiens; identical to SEQ ID NO: 163547

SEQ ID NO: 396226 - RNA, 64 nt, Homo Sapiens; identical to SEQ ID NO: 163548

SEQ ID NO: 396227 - RNA, 64 nt, Homo Sapiens; identical to SEQ ID NO: 163549

SEQ ID NO: 396228 - RNA, 64 nt, Homo Sapiens; identical to SEQ ID NO: 163550

SEQ ID NO: 396229 - RNA, 64 nt, Homo Sapiens; identical to SEQ ID NO: 163551

SEQ ID NO: 396230 - RNA, 65 nt, Homo Sapiens; identical to SEQ ID NO: 306964

SEQ ID NO: 396231 - RNA, 65 nt, Homo Sapiens; identical to SEQ ID NO: 306965

SEQ ID NO: 396232 - RNA, 65 nt, Homo Sapiens; identical to SEQ ID NO: 306966

SEQ ID NO: 396233 - RNA, 65 nt, Homo Sapiens; identical to SEQ ID NO: 306967

SEQ ID NO: 396234 - RNA, 65 nt, Homo Sapiens; identical to SEQ ID NO: 306968

SEQ ID NO: 396235 - RNA, 65 nt, Homo Sapiens; identical to SEQ ID NO: 306969

SEQ ID NO: 396236 - RNA, 65 nt, Homo Sapiens; identical to SEQ ID NO: 306970

SEQ ID NO: 396237 - RNA, 65 nt, Homo Sapiens; identical to SEQ ID NO: 306971

SEQ ID NO: 396238 - RNA, 65 nt, Homo Sapiens; identical to SEQ ID NO: 306972

SEQ ID NO: 396239 - RNA, 65 nt, Homo Sapiens; identical to SEQ ID NO: 306973

SEQ ID NO: 396240 - RNA, 65 nt, Homo Sapiens; identical to SEQ ID NO: 306974

SEQ ID NO: 396241 - RNA, 65 nt, Homo Sapiens; identical to SEQ ID NO: 306975

SEQ ID NO: 396242 - RNA, 65 nt, Homo Sapiens; identical to SEQ ID NO: 306976

SEQ ID NO: 396243 - RNA, 65 nt, Homo Sapiens; identical to SEQ ID NO: 306977

SEQ ID NO: 396244 - RNA, 65 nt, Homo Sapiens; identical to SEQ ID NO: 306978

SEQ ID NO: 396245 - RNA, 65 nt, Homo Sapiens; identical to SEQ ID NO: 306979

SEQ ID NO: 396246 - RNA, 65 nt, Homo Sapiens; identical to SEQ ID NO: 306980

SEQ ID NO: 396247 - RNA, 65 nt, Homo Sapiens; identical to SEQ ID NO: 306981

SEQ ID NO: 396248 - RNA, 65 nt, Homo Sapiens; identical to SEQ ID NO: 306982

SEQ ID NO: 396249 - RNA, 65 nt, Homo Sapiens; identical to SEQ ID NO: 306983

SEQ ID NO: 396250 - RNA, 64 nt, Homo Sapiens; identical to SEQ ID NO: 79755

SEQ ID NO: 396251 - RNA, 64 nt, Homo Sapiens; identical to SEQ ID NO: 79756

SEQ ID NO: 396252 - RNA, 64 nt, Homo Sapiens; identical to SEQ ID NO: 79757

SEQ ID NO: 396253 - RNA, 64 nt, Homo Sapiens; identical to SEQ ID NO: 79758

SEQ ID NO: 396254 - RNA, 64 nt, Homo Sapiens; identical to SEQ ID NO: 79759

SEQ ID NO: 396255 - RNA, 64 nt, Homo Sapiens; identical to SEQ ID NO: 79760

SEQ ID NO: 396256 - RNA, 64 nt, Homo Sapiens; identical to SEQ ID NO: 79761

SEQ ID NO: 396257 - RNA, 64 nt, Homo Sapiens; identical to SEQ ID NO: 79762

SEQ ID NO: 396258 - RNA, 64 nt, Homo Sapiens; identical to SEQ ID NO: 79763

SEQ ID NO: 396259 - RNA, 64 nt, Homo Sapiens; identical to SEQ ID NO: 79764

SEQ ID NO: 396260 - RNA, 64 nt, Homo Sapiens; identical to SEQ ID NO: 79765

SEQ ID NO: 396261 - RNA, 64 nt, Homo Sapiens; identical to SEQ ID NO: 79766

SEQ ID NO: 396262 - RNA, 64 nt, Homo Sapiens; identical to SEQ ID NO: 79767

SEQ ID NO: 396263 - RNA, 64 nt, Homo Sapiens; identical to SEQ ID NO: 79768

SEQ ID NO: 396264 - RNA, 64 nt, Homo Sapiens; identical to SEQ ID NO: 79769

SEQ ID NO: 396265 - RNA, 64 nt, Homo Sapiens; identical to SEQ ID NO: 79770

SEQ ID NO: 396266 - RNA, 64 nt, Homo Sapiens; identical to SEQ ID NO: 79771

SEQ ID NO: 396267 - RNA, 64 nt, Homo Sapiens; identical to SEQ ID NO: 79772

SEQ ID NO: 396268 - RNA, 64 nt, Homo Sapiens; identical to SEQ ID NO: 79773

SEQ ID NO: 396269 - RNA, 64 nt, Homo Sapiens; identical to SEQ ID NO: 79774

SEQ ID NO: 396270 - RNA, 64 nt, Homo Sapiens; identical to SEQ ID NO: 79775

SEQ ID NO: 396271 - RNA, 64 nt, Homo Sapiens; identical to SEQ ID NO: 79776

SEQ ID NO: 396272 - RNA, 64 nt, Homo Sapiens; identical to SEQ ID NO: 79777

SEQ ID NO: 396273 - RNA, 64 nt, Homo Sapiens; identical to SEQ ID NO: 79778

SEQ ID NO: 396274 - RNA, 64 nt, Homo Sapiens; identical to SEQ ID NO: 79779

SEQ ID NO: 396275 - RNA, 64 nt, Homo Sapiens; identical to SEQ ID NO: 79780

SEQ ID NO: 396276 - RNA, 64 nt, Homo Sapiens; identical to SEQ ID NO: 79781

SEQ ID NO: 396277 - RNA, 64 nt, Homo Sapiens; identical to SEQ ID NO: 79782

SEQ ID NO: 396278 - RNA, 64 nt, Homo Sapiens; identical to SEQ ID NO: 79783

SEQ ID NO: 396279 - RNA, 64 nt, Homo Sapiens; identical to SEQ ID NO: 79784

SEQ ID NO: 396280 - RNA, 64 nt, Homo Sapiens; identical to SEQ ID NO: 79785

SEQ ID NO: 396281 - RNA, 64 nt, Homo Sapiens; identical to SEQ ID NO: 79786

SEQ ID NO: 396282 - RNA, 64 nt, Homo Sapiens; identical to SEQ ID NO: 79787

SEQ ID NO: 396283 - RNA, 64 nt, Homo Sapiens; identical to SEQ ID NO: 79788

SEQ ID NO: 396284 - RNA, 64 nt, Homo Sapiens; identical to SEQ ID NO: 79789

SEQ ID NO: 396285 - RNA, 64 nt, Homo Sapiens; identical to SEQ ID NO: 79790

SEQ ID NO: 396286 - RNA, 64 nt, Homo Sapiens; identical to SEQ ID NO: 79791

SEQ ID NO: 396287 - RNA, 64 nt, Homo Sapiens; identical to SEQ ID NO: 79792

SEQ ID NO: 396288 - RNA, 64 nt, Homo Sapiens; identical to SEQ ID NO: 79793

SEQ ID NO: 396289 - RNA, 64 nt, Homo Sapiens; identical to SEQ ID NO: 79794

SEQ ID NO: 396290 - RNA, 64 nt, Homo Sapiens; identical to SEQ ID NO: 79795

SEQ ID NO: 396291 - RNA, 64 nt, Homo Sapiens; identical to SEQ ID NO: 79796

SEQ ID NO: 396292 - RNA, 64 nt, Homo Sapiens; identical to SEQ ID NO: 79797

SEQ ID NO: 396293 - RNA, 64 nt, Homo Sapiens; identical to SEQ ID NO: 79798

SEQ ID NO: 396294 - RNA, 64 nt, Homo Sapiens; identical to SEQ ID NO: 79799

SEQ ID NO: 396295 - RNA, 64 nt, Homo Sapiens; identical to SEQ ID NO: 79800

SEQ ID NO: 396296 - RNA, 64 nt, Homo Sapiens; identical to SEQ ID NO: 79801

SEQ ID NO: 396297 - RNA, 64 nt, Homo Sapiens; identical to SEQ ID NO: 79802

SEQ ID NO: 396298 - RNA, 64 nt, Homo Sapiens; identical to SEQ ID NO: 79803

SEQ ID NO: 396299 - RNA, 64 nt, Homo Sapiens; identical to SEQ ID NO: 206373

SEQ ID NO: 396300 - RNA, 64 nt, Homo Sapiens; identical to SEQ ID NO: 206374

SEQ ID NO: 396301 - RNA, 64 nt, Homo Sapiens; identical to SEQ ID NO: 206375

SEQ ID NO: 396302 - RNA, 64 nt, Homo Sapiens; identical to SEQ ID NO: 206376

SEQ ID NO: 396303 - RNA, 64 nt, Homo Sapiens; identical to SEQ ID NO: 206377

SEQ ID NO: 396304 - RNA, 64 nt, Homo Sapiens; identical to SEQ ID NO: 206378

SEQ ID NO: 396305 - RNA, 64 nt, Homo Sapiens; identical to SEQ ID NO: 206379

SEQ ID NO: 396306 - RNA, 64 nt, Homo Sapiens; identical to SEQ ID NO: 206380

SEQ ID NO: 396307 - RNA, 64 nt, Homo Sapiens; identical to SEQ ID NO: 206381

SEQ ID NO: 396308 - RNA, 64 nt, Homo Sapiens; identical to SEQ ID NO: 206382

SEQ ID NO: 396309 - RNA, 64 nt, Homo Sapiens; identical to SEQ ID NO: 206383

SEQ ID NO: 396310 - RNA, 64 nt, Homo Sapiens; identical to SEQ ID NO: 206384

SEQ ID NO: 396311 - RNA, 64 nt, Homo Sapiens; identical to SEQ ID NO: 206385

SEQ ID NO: 396312 - RNA, 64 nt, Homo Sapiens; identical to SEQ ID NO: 206386

SEQ ID NO: 396313 - RNA, 59 nt, Homo Sapiens
aauccccacaugucaugggacuugaauuguaguuccaauuguucccacucaaaucucau

SEQ ID NO: 396314 - RNA, 59 nt, Homo Sapiens
acauccuguaacauuggcuugaauaggaauaguuccacaccuaguggcuacuuauggaa

SEQ ID NO: 396315 - RNA, 59 nt, Homo Sapiens
ccacugcucucuagccugggcaaaaaaacuaguuccaaaaaagacacuuguacacgcau

SEQ ID NO: 396316 - RNA, 59 nt, Homo Sapiens
auauaaaaagaaagagaaagaaaagaaaauaguuccaauuuaucaugccaaauuguuug

SEQ ID NO: 396317 - RNA, 64 nt, Homo Sapiens
cauuggcugcaaagccccucaaaguuucccauugucacggaaaaccaccuuuguacaguuguuu

SEQ ID NO: 396318 - RNA, 64 nt, Homo Sapiens
agcacaaccgaacgucuuguuguaauguaugaguucacggaagaccggcaucgagugcugaccu

SEQ ID NO: 396319 - RNA, 64 nt, Homo Sapiens; identical to SEQ ID NO: 285102

SEQ ID NO: 396320 - RNA, 64 nt, Homo Sapiens; identical to SEQ ID NO: 285103

SEQ ID NO: 396321 - RNA, 64 nt, Homo Sapiens; identical to SEQ ID NO: 285104

SEQ ID NO: 396322 - RNA, 64 nt, Homo Sapiens; identical to SEQ ID NO: 285105

SEQ ID NO: 396323 - RNA, 64 nt, Homo Sapiens; identical to SEQ ID NO: 285106

SEQ ID NO: 396324 - RNA, 64 nt, Homo Sapiens; identical to SEQ ID NO: 285107

SEQ ID NO: 396325 - RNA, 64 nt, Homo Sapiens; identical to SEQ ID NO: 285108

SEQ ID NO: 396326 - RNA, 64 nt, Homo Sapiens; identical to SEQ ID NO: 285109

SEQ ID NO: 396327 - RNA, 64 nt, Homo Sapiens; identical to SEQ ID NO: 285110

SEQ ID NO: 396328 - RNA, 64 nt, Homo Sapiens; identical to SEQ ID NO: 285111

SEQ ID NO: 396329 - RNA, 64 nt, Homo Sapiens; identical to SEQ ID NO: 285112

SEQ ID NO: 396330 - RNA, 64 nt, Homo Sapiens; identical to SEQ ID NO: 285113

SEQ ID NO: 396331 - RNA, 64 nt, Homo Sapiens; identical to SEQ ID NO: 285114

SEQ ID NO: 396332 - RNA, 64 nt, Homo Sapiens; identical to SEQ ID NO: 285115

SEQ ID NO: 396333 - RNA, 64 nt, Homo Sapiens; identical to SEQ ID NO: 285116

SEQ ID NO: 396334 - RNA, 64 nt, Homo Sapiens; identical to SEQ ID NO: 285117

SEQ ID NO: 396335 - RNA, 64 nt, Homo Sapiens; identical to SEQ ID NO: 285118

SEQ ID NO: 396336 - RNA, 64 nt, Homo Sapiens; identical to SEQ ID NO: 285119

SEQ ID NO: 396337 - RNA, 64 nt, Homo Sapiens; identical to SEQ ID NO: 285120

SEQ ID NO: 396338 - RNA, 64 nt, Homo Sapiens; identical to SEQ ID NO: 285121

SEQ ID NO: 396339 - RNA, 64 nt, Homo Sapiens; identical to SEQ ID NO: 285122

SEQ ID NO: 396340 - RNA, 64 nt, Homo Sapiens; identical to SEQ ID NO: 285123

SEQ ID NO: 396341 - RNA, 64 nt, Homo Sapiens; identical to SEQ ID NO: 285124

SEQ ID NO: 396342 - RNA, 64 nt, Homo Sapiens; identical to SEQ ID NO: 285125

SEQ ID NO: 396343 - RNA, 64 nt, Homo Sapiens; identical to SEQ ID NO: 285126

SEQ ID NO: 396344 - RNA, 64 nt, Homo Sapiens; identical to SEQ ID NO: 285127

SEQ ID NO: 396345 - RNA, 64 nt, Homo Sapiens; identical to SEQ ID NO: 285128

SEQ ID NO: 396346 - RNA, 64 nt, Homo Sapiens; identical to SEQ ID NO: 285129

SEQ ID NO: 396347 - RNA, 64 nt, Homo Sapiens; identical to SEQ ID NO: 285130

SEQ ID NO: 396348 - RNA, 64 nt, Homo Sapiens; identical to SEQ ID NO: 285131

SEQ ID NO: 396349 - RNA, 64 nt, Homo Sapiens; identical to SEQ ID NO: 285132

SEQ ID NO: 396350 - RNA, 64 nt, Homo Sapiens; identical to SEQ ID NO: 285133

SEQ ID NO: 396351 - RNA, 64 nt, Homo Sapiens; identical to SEQ ID NO: 285134

SEQ ID NO: 396352 - RNA, 64 nt, Homo Sapiens; identical to SEQ ID NO: 285135

SEQ ID NO: 396353 - RNA, 64 nt, Homo Sapiens; identical to SEQ ID NO: 285136

SEQ ID NO: 396354 - RNA, 64 nt, Homo Sapiens; identical to SEQ ID NO: 285137

SEQ ID NO: 396355 - RNA, 64 nt, Homo Sapiens; identical to SEQ ID NO: 285138

SEQ ID NO: 396356 - RNA, 64 nt, Homo Sapiens; identical to SEQ ID NO: 285139

SEQ ID NO: 396357 - RNA, 64 nt, Homo Sapiens; identical to SEQ ID NO: 285140

SEQ ID NO: 396358 - RNA, 64 nt, Homo Sapiens; identical to SEQ ID NO: 285141

SEQ ID NO: 396359 - RNA, 64 nt, Homo Sapiens; identical to SEQ ID NO: 285142

SEQ ID NO: 396360 - RNA, 64 nt, Homo Sapiens; identical to SEQ ID NO: 285143

SEQ ID NO: 396361 - RNA, 64 nt, Homo Sapiens; identical to SEQ ID NO: 285144

SEQ ID NO: 396362 - RNA, 64 nt, Homo Sapiens; identical to SEQ ID NO: 285145

SEQ ID NO: 396363 - RNA, 64 nt, Homo Sapiens; identical to SEQ ID NO: 285146

SEQ ID NO: 396364 - RNA, 64 nt, Homo Sapiens; identical to SEQ ID NO: 285147

SEQ ID NO: 396365 - RNA, 64 nt, Homo Sapiens; identical to SEQ ID NO: 285148

SEQ ID NO: 396366 - RNA, 64 nt, Homo Sapiens; identical to SEQ ID NO: 285149

SEQ ID NO: 396367 - RNA, 64 nt, Homo Sapiens; identical to SEQ ID NO: 285150

SEQ ID NO: 396368 - RNA, 64 nt, Homo Sapiens; identical to SEQ ID NO: 285151

SEQ ID NO: 396369 - RNA, 64 nt, Homo Sapiens; identical to SEQ ID NO: 285152

SEQ ID NO: 396370 - RNA, 64 nt, Homo Sapiens; identical to SEQ ID NO: 285153

SEQ ID NO: 396371 - RNA, 64 nt, Homo Sapiens; identical to SEQ ID NO: 285154

SEQ ID NO: 396372 - RNA, 64 nt, Homo Sapiens; identical to SEQ ID NO: 285155

SEQ ID NO: 396373 - RNA, 64 nt, Homo Sapiens; identical to SEQ ID NO: 285156

SEQ ID NO: 396374 - RNA, 64 nt, Homo Sapiens; identical to SEQ ID NO: 285157

SEQ ID NO: 396375 - RNA, 64 nt, Homo Sapiens; identical to SEQ ID NO: 285158

SEQ ID NO: 396376 - RNA, 64 nt, Homo Sapiens; identical to SEQ ID NO: 285159

SEQ ID NO: 396377 - RNA, 64 nt, Homo Sapiens; identical to SEQ ID NO: 146879

SEQ ID NO: 396378 - RNA, 64 nt, Homo Sapiens; identical to SEQ ID NO: 146880

SEQ ID NO: 396379 - RNA, 64 nt, Homo Sapiens; identical to SEQ ID NO: 146881

SEQ ID NO: 396380 - RNA, 64 nt, Homo Sapiens; identical to SEQ ID NO: 146882

SEQ ID NO: 396381 - RNA, 64 nt, Homo Sapiens; identical to SEQ ID NO: 146883

SEQ ID NO: 396382 - RNA, 64 nt, Homo Sapiens; identical to SEQ ID NO: 146884

SEQ ID NO: 396383 - RNA, 64 nt, Homo Sapiens; identical to SEQ ID NO: 146885

SEQ ID NO: 396384 - RNA, 64 nt, Homo Sapiens; identical to SEQ ID NO: 146886

SEQ ID NO: 396385 - RNA, 64 nt, Homo Sapiens; identical to SEQ ID NO: 146887

SEQ ID NO: 396386 - RNA, 64 nt, Homo Sapiens; identical to SEQ ID NO: 146888

SEQ ID NO: 396387 - RNA, 64 nt, Homo Sapiens; identical to SEQ ID NO: 146889

SEQ ID NO: 396388 - RNA, 64 nt, Homo Sapiens; identical to SEQ ID NO: 146890

SEQ ID NO: 396389 - RNA, 64 nt, Homo Sapiens; identical to SEQ ID NO: 146891

SEQ ID NO: 396390 - RNA, 64 nt, Homo Sapiens; identical to SEQ ID NO: 146892

SEQ ID NO: 396391 - RNA, 64 nt, Homo Sapiens; identical to SEQ ID NO: 146893

SEQ ID NO: 396392 - RNA, 64 nt, Homo Sapiens; identical to SEQ ID NO: 146894

SEQ ID NO: 396393 - RNA, 64 nt, Homo Sapiens; identical to SEQ ID NO: 146895

SEQ ID NO: 396394 - RNA, 64 nt, Homo Sapiens; identical to SEQ ID NO: 146896

SEQ ID NO: 396395 - RNA, 64 nt, Homo Sapiens; identical to SEQ ID NO: 146897

SEQ ID NO: 396396 - RNA, 64 nt, Homo Sapiens; identical to SEQ ID NO: 146898

SEQ ID NO: 396397 - RNA, 64 nt, Homo Sapiens; identical to SEQ ID NO: 146899

SEQ ID NO: 396398 - RNA, 64 nt, Homo Sapiens; identical to SEQ ID NO: 146900

SEQ ID NO: 396399 - RNA, 64 nt, Homo Sapiens; identical to SEQ ID NO: 146901

SEQ ID NO: 396400 - RNA, 64 nt, Homo Sapiens; identical to SEQ ID NO: 146902

SEQ ID NO: 396401 - RNA, 64 nt, Homo Sapiens; identical to SEQ ID NO: 146903

SEQ ID NO: 396402 - RNA, 64 nt, Homo Sapiens; identical to SEQ ID NO: 146904

SEQ ID NO: 396403 - RNA, 64 nt, Homo Sapiens; identical to SEQ ID NO: 146905

SEQ ID NO: 396404 - RNA, 64 nt, Homo Sapiens; identical to SEQ ID NO: 146906

SEQ ID NO: 396405 - RNA, 64 nt, Homo Sapiens; identical to SEQ ID NO: 146907

SEQ ID NO: 396406 - RNA, 64 nt, Homo Sapiens; identical to SEQ ID NO: 146908

SEQ ID NO: 396407 - RNA, 64 nt, Homo Sapiens; identical to SEQ ID NO: 146909

SEQ ID NO: 396408 - RNA, 64 nt, Homo Sapiens; identical to SEQ ID NO: 146910

SEQ ID NO: 396409 - RNA, 64 nt, Homo Sapiens; identical to SEQ ID NO: 146911

SEQ ID NO: 396410 - RNA, 64 nt, Homo Sapiens; identical to SEQ ID NO: 146912

SEQ ID NO: 396411 - RNA, 64 nt, Homo Sapiens; identical to SEQ ID NO: 146913

SEQ ID NO: 396412 - RNA, 64 nt, Homo Sapiens; identical to SEQ ID NO: 146914

SEQ ID NO: 396413 - RNA, 64 nt, Homo Sapiens; identical to SEQ ID NO: 146915

SEQ ID NO: 396414 - RNA, 64 nt, Homo Sapiens; identical to SEQ ID NO: 146916

SEQ ID NO: 396415 - RNA, 58 nt, Homo Sapiens; identical to SEQ ID NO: 146917

SEQ ID NO: 396416 - RNA, 64 nt, Homo Sapiens; identical to SEQ ID NO: 146918

SEQ ID NO: 396417 - RNA, 64 nt, Homo Sapiens
agcagugggcccuggcucugucagagaagcagcaucaaccuagggccagcuccuuagacaccua

SEQ ID NO: 396418 - RNA, 64 nt, Homo Sapiens
guggagggagacugacccaucccugggagagugcucaaccuacaaaccccagcaguccugggcc

SEQ ID NO: 396419 - RNA, 64 nt, Homo Sapiens
cuaaagguccucucccaaacugaccaggcugaugucaaccuaacccccucaggggcagggaaca

SEQ ID NO: 396420 - RNA, 64 nt, Homo Sapiens
cuagcuaauuuuguggccaauguaaaauucgucaucaaccuaacaaacacaaccuucucagcag

SEQ ID NO: 396421 - RNA, 64 nt, Homo Sapiens
aaaggguuugcuaacucugcuucaacauccaacaacacaaaacuauaugauuuuuaaaaucaug

SEQ ID NO: 396422 - RNA, 64 nt, Homo Sapiens
uugaucucugugccaaauacauuauaucaggauuacacaaaaaguaucacaaaggauggucuug

SEQ ID NO: 396423 - RNA, 64 nt, Homo Sapiens
aaagaggcugagaugagcagugaacuaagaggccacacaaaagcagagguuugggaauuccaga

SEQ ID NO: 396424 - RNA, 64 nt, Homo Sapiens
gaaauugacgcaagugaacugaaaacuuauguucacacaaaaacucgcacaugacuguuuauag

SEQ ID NO: 396425 - RNA, 64 nt, Homo Sapiens
guauugaagcaacaaauauuacuaaauauuuuuuacacaaaaauaggcaggguaguaagcugac

SEQ ID NO: 396426 - RNA, 64 nt, Homo Sapiens
auacagacaaucaaaacauuuaugacuugcacagacacaaaaauaaggcuggcagagauuuaug

SEQ ID NO: 396427 - RNA, 64 nt, Homo Sapiens
aaagcaaaguaauaaaaucacaaauguuuggaaaacacaaaaguaacuuguuuaucucagucug

SEQ ID NO: 396428 - RNA, 64 nt, Homo Sapiens
cuggccagcuuaaccuggucugaggugagacuaaacacaaaaacaguagauaaaucucucccua

SEQ ID NO: 396429 - RNA, 64 nt, Homo Sapiens
ucaaaacaaaaacaagaggguaaggcacguuuucacacaaaauuauuuucaaaaaugugaaaua

SEQ ID NO: 396430 - RNA, 64 nt, Homo Sapiens
gaagcuaccuaugauccuggcaacacaaaacauaacacaaaaaaucaaggcacaacacaaaaac

SEQ ID NO: 396431 - RNA, 64 nt, Homo Sapiens
uaacacaaaaaagaagcuaccaacacaaaaaccaacacaaaacaaguacuacagcaucaaggca

SEQ ID NO: 396432 - RNA, 64 nt, Homo Sapiens
caacacaaaacauaacacaaagcaucaaggcacaacacaaaaacauaaagcaaaggaguacuac

SEQ ID NO: 396433 - RNA, 64 nt, Homo Sapiens
gcagagcaccuaagccuguccaaugaaaaacagaacacaaaagaucccugcagggccccuguuc

SEQ ID NO: 396434 - RNA, 64 nt, Homo Sapiens
aagauaaauguauggcaucaaaguuuaaaucuggacacaaaaauuccaugcaaaggaauucuuc

SEQ ID NO: 396435 - RNA, 64 nt, Homo Sapiens
uuuuaguuguuucccuucacuuucagucuuccacacacaaaaaauaccucacagagcuucacca

SEQ ID NO: 396436 - RNA, 64 nt, Homo Sapiens
caaucaguuguuuuucucuucgcuucaggcccuuacacaaaagccaugaagagauguucaccua

SEQ ID NO: 396437 - RNA, 64 nt, Homo Sapiens
aaugccacacaucacccuuaguacuauucugauuacacaaaacaccaagaaguuggaugggugg

SEQ ID NO: 396438 - RNA, 64 nt, Homo Sapiens
acccuagaguguuguugagagauggacccaaugcacacaaaacaauuucuuacaggcacaaaau

SEQ ID NO: 396439 - RNA, 64 nt, Homo Sapiens
uuaacaacuccacucauagucacauuguauuugaacacaaaacacugagcuuccuuauguuuca

SEQ ID NO: 396440 - RNA, 64 nt, Homo Sapiens
uacugagcuuccuuauguuuccaaaaguuaccccacacaaaaguuugaaauuuauuauucuaau

SEQ ID NO: 396441 - RNA, 64 nt, Homo Sapiens
ugcagauacuucauauagccuagcagggaaaaauacacaaaaacaaaggaauauucacuuuacc

SEQ ID NO: 396442 - RNA, 64 nt, Homo Sapiens
cguuuuccauacagcagugcuacaauuuguagaaacacaaaaugacucaaaaggcauuuccgcu

SEQ ID NO: 396443 - RNA, 64 nt, Homo Sapiens
aaaaugaaguaguauauaugaaaaugcuuuuuaaacacaaaagcuuuauacaaaauauuguuga

SEQ ID NO: 396444 - RNA, 64 nt, Homo Sapiens
auuuugcaaaugggaaggauuucuuuaaagcaagacacaaaagcauacacaggaaaaaaugaug

SEQ ID NO: 396445 - RNA, 64 nt, Homo Sapiens
ugaaauucauauaaugacuucacuacagugaaauacacaaaaaaaugucauuuuguugucacag

SEQ ID NO: 396446 - RNA, 64 nt, Homo Sapiens
uuauccugccauucgagugcugugaaggauuacaacacaaaaaggcagaguuuguuuuucuaua

SEQ ID NO: 396447 - RNA, 64 nt, Homo Sapiens
caaaaaggaaaaaaaauccaccaaaccaugauaaacacaaaaugcagcuuccugaugcuuagag

SEQ ID NO: 396448 - RNA, 64 nt, Homo Sapiens
ugaccuuaucuuaauggaaaacgguuaacuccaaacacaaaagacucuacuggaaaguguaggu

SEQ ID NO: 396449 - RNA, 64 nt, Homo Sapiens
ugaccaauauggagaaacccugucucuacuaagaacacaaaauuagcugggcaugguggugcau

SEQ ID NO: 396450 - RNA, 64 nt, Homo Sapiens
gaaagauaucuaugaaauauggugguuuuuuaaaacacaaaaauuauagaauaugggaucccgu

SEQ ID NO: 396451 - RNA, 64 nt, Homo Sapiens
gacaaugcauccaaaaaaucuuuuuaaacagauuacacaaaaauuauuuccagaaaggcuacca

SEQ ID NO: 396452 - RNA, 64 nt, Homo Sapiens
uaaagucaaacaggauuccauccccugugaaauaacacaaaauuucacucucuaaaagcaacag

SEQ ID NO: 396453 - RNA, 64 nt, Homo Sapiens
accucagcagaaaugaauauccaaaauggcuuagacacaaaaacauauuuacuaauccuaucug

SEQ ID NO: 396454 - RNA, 64 nt, Homo Sapiens
uuuucuuaauccuaguacauacaucccacucaagacacaaaacaaugugaguuaaauauaacuc

SEQ ID NO: 396455 - RNA, 64 nt, Homo Sapiens
agaauguucaugucaggcacuaaagcuuagugaaacacaaaauuaaauagaagaaauauauuua

SEQ ID NO: 396456 - RNA, 64 nt, Homo Sapiens
ggcauugguuucuuaggaguagugaacaacagcaacacaaaacguaaaaaugcagcagcauagg

SEQ ID NO: 396457 - RNA, 64 nt, Homo Sapiens
acacacacacccuccccgccacagaaagacacagacacaaaauccauuacauacacagacacac

SEQ ID NO: 396458 - RNA, 64 nt, Homo Sapiens
acacacacacccuccccgccaaagacacacacagacacaaaaucacauacacagacacacacag

SEQ ID NO: 396459 - RNA, 64 nt, Homo Sapiens
aaauacagccauuccaaaugggagaaauuggccaacacaaaaggguaacagggcccaugcaagu

SEQ ID NO: 396460 - RNA, 64 nt, Homo Sapiens
gccaaguuaguauuguuagagauuucauuuuacaacacaaaaauaagccugugucaaagauuuu

SEQ ID NO: 396461 - RNA, 64 nt, Homo Sapiens
aguguggauuuaucuaaaugguauaagcagcccaacacaaaacggcagucaagccgagcaaccu

SEQ ID NO: 396462 - RNA, 64 nt, Homo Sapiens
agacaguuaaaaggucaguacuagauaccaugagacacaaaaugaggacagaauuuuggcugau

SEQ ID NO: 396463 - RNA, 64 nt, Homo Sapiens
uuguggaaggcaguuuuaaccuugugccauauacacacaaaauuucacacuuuuuggcugucac

SEQ ID NO: 396464 - RNA, 64 nt, Homo Sapiens
caggaauugguggcuuaauuuuucuaugaacugaacacaaaacucuuuuaguuguaugagucuc

SEQ ID NO: 396465 - RNA, 64 nt, Homo Sapiens
guguuuacugaaagccgaaaccacaccaaugccaacacaaaacuucucgccaaagaaaccacgc

SEQ ID NO: 396466 - RNA, 64 nt, Homo Sapiens
augagucccaccccccacuaacuuaaaaaaacaaacacaaaaagcuuucuuguuuugucucaaa

SEQ ID NO: 396467 - RNA, 64 nt, Homo Sapiens
aaacaaauaaaugaauaaagcugcugugacacacacacaaaaggaauuuaauaguauaauauau

SEQ ID NO: 396468 - RNA, 64 nt, Homo Sapiens
ccgaaaagcaagagacaaagcaagacaaauauucacacaaaaaugaaguguguccucuggaggg

SEQ ID NO: 396469 - RNA, 64 nt, Homo Sapiens
cagcccagccaggcccccuccuucuuuuucuaaaacacaaaacucccccaagacugggagggga

SEQ ID NO: 396470 - RNA, 64 nt, Homo Sapiens
agacaaaaaaaaaaaaagaacuugaaaaaaaaaaacacaaaaaauuuuacuggggauucuugaa

SEQ ID NO: 396471 - RNA, 64 nt, Homo Sapiens
ucauucuucuuuuuauuuguauaucagucaugugacacaaaauaacacugagcuugaacuucau

SEQ ID NO: 396472 - RNA, 64 nt, Homo Sapiens
uggcuugaugguuaagacaggaaagaggaaagaaacacaaaaagaggucaguguaagaauuaaa

SEQ ID NO: 396473 - RNA, 64 nt, Homo Sapiens
gucauuuaccuguauuugcaacaaauauauauauacacaaaacuauauauacaacuauauauac

SEQ ID NO: 396474 - RNA, 64 nt, Homo Sapiens
acugaucugugauugcucucacacaacaaaacaaacacaaaaccguuaaauaacaaugacacac

SEQ ID NO: 396475 - RNA, 64 nt, Homo Sapiens; identical to SEQ ID NO: 312055

SEQ ID NO: 396476 - RNA, 64 nt, Homo Sapiens; identical to SEQ ID NO: 312056

SEQ ID NO: 396477 - RNA, 64 nt, Homo Sapiens; identical to SEQ ID NO: 312057

SEQ ID NO: 396478 - RNA, 64 nt, Homo Sapiens; identical to SEQ ID NO: 312058

SEQ ID NO: 396479 - RNA, 64 nt, Homo Sapiens; identical to SEQ ID NO: 312059

SEQ ID NO: 396480 - RNA, 64 nt, Homo Sapiens; identical to SEQ ID NO: 312060

SEQ ID NO: 396481 - RNA, 64 nt, Homo Sapiens; identical to SEQ ID NO: 312061

SEQ ID NO: 396482 - RNA, 64 nt, Homo Sapiens; identical to SEQ ID NO: 312062

SEQ ID NO: 396483 - RNA, 64 nt, Homo Sapiens; identical to SEQ ID NO: 312063

SEQ ID NO: 396484 - RNA, 64 nt, Homo Sapiens; identical to SEQ ID NO: 312064

SEQ ID NO: 396485 - RNA, 64 nt, Homo Sapiens; identical to SEQ ID NO: 312065

SEQ ID NO: 396486 - RNA, 64 nt, Homo Sapiens; identical to SEQ ID NO: 312066

SEQ ID NO: 396487 - RNA, 64 nt, Homo Sapiens; identical to SEQ ID NO: 312067

SEQ ID NO: 396488 - RNA, 64 nt, Homo Sapiens; identical to SEQ ID NO: 312068

SEQ ID NO: 396489 - RNA, 64 nt, Homo Sapiens; identical to SEQ ID NO: 312069

SEQ ID NO: 396490 - RNA, 64 nt, Homo Sapiens; identical to SEQ ID NO: 312070

SEQ ID NO: 396491 - RNA, 62 nt, Homo Sapiens; identical to SEQ ID NO: 312071

SEQ ID NO: 396492 - RNA, 64 nt, Homo Sapiens; identical to SEQ ID NO: 312072

SEQ ID NO: 396493 - RNA, 64 nt, Homo Sapiens; identical to SEQ ID NO: 312073

SEQ ID NO: 396494 - RNA, 64 nt, Homo Sapiens; identical to SEQ ID NO: 312074

SEQ ID NO: 396495 - RNA, 64 nt, Homo Sapiens; identical to SEQ ID NO: 312075

SEQ ID NO: 396496 - RNA, 64 nt, Homo Sapiens; identical to SEQ ID NO: 312076

SEQ ID NO: 396497 - RNA, 64 nt, Homo Sapiens; identical to SEQ ID NO: 312077

SEQ ID NO: 396498 - RNA, 64 nt, Homo Sapiens; identical to SEQ ID NO: 312078

SEQ ID NO: 396499 - RNA, 64 nt, Homo Sapiens; identical to SEQ ID NO: 312079

SEQ ID NO: 396500 - RNA, 64 nt, Homo Sapiens; identical to SEQ ID NO: 312080

SEQ ID NO: 396501 - RNA, 64 nt, Homo Sapiens; identical to SEQ ID NO: 312081

SEQ ID NO: 396502 - RNA, 64 nt, Homo Sapiens; identical to SEQ ID NO: 312082

SEQ ID NO: 396503 - RNA, 64 nt, Homo Sapiens; identical to SEQ ID NO: 312083

SEQ ID NO: 396504 - RNA, 64 nt, Homo Sapiens; identical to SEQ ID NO: 312084

SEQ ID NO: 396505 - RNA, 64 nt, Homo Sapiens; identical to SEQ ID NO: 312085

SEQ ID NO: 396506 - RNA, 64 nt, Homo Sapiens; identical to SEQ ID NO: 312086

SEQ ID NO: 396507 - RNA, 64 nt, Homo Sapiens; identical to SEQ ID NO: 312087

SEQ ID NO: 396508 - RNA, 64 nt, Homo Sapiens; identical to SEQ ID NO: 312088

SEQ ID NO: 396509 - RNA, 64 nt, Homo Sapiens; identical to SEQ ID NO: 312089

SEQ ID NO: 396510 - RNA, 64 nt, Homo Sapiens; identical to SEQ ID NO: 312090

SEQ ID NO: 396511 - RNA, 64 nt, Homo Sapiens; identical to SEQ ID NO: 312091

SEQ ID NO: 396512 - RNA, 64 nt, Homo Sapiens; identical to SEQ ID NO: 312092

SEQ ID NO: 396513 - RNA, 64 nt, Homo Sapiens; identical to SEQ ID NO: 312093

SEQ ID NO: 396514 - RNA, 64 nt, Homo Sapiens; identical to SEQ ID NO: 312094

SEQ ID NO: 396515 - RNA, 64 nt, Homo Sapiens; identical to SEQ ID NO: 312095

SEQ ID NO: 396516 - RNA, 64 nt, Homo Sapiens; identical to SEQ ID NO: 312096

SEQ ID NO: 396517 - RNA, 64 nt, Homo Sapiens; identical to SEQ ID NO: 312097

SEQ ID NO: 396518 - RNA, 64 nt, Homo Sapiens; identical to SEQ ID NO: 312098

SEQ ID NO: 396519 - RNA, 64 nt, Homo Sapiens; identical to SEQ ID NO: 312099

SEQ ID NO: 396520 - RNA, 64 nt, Homo Sapiens; identical to SEQ ID NO: 312100

SEQ ID NO: 396521 - RNA, 64 nt, Homo Sapiens; identical to SEQ ID NO: 312101

SEQ ID NO: 396522 - RNA, 64 nt, Homo Sapiens; identical to SEQ ID NO: 312102

SEQ ID NO: 396523 - RNA, 64 nt, Homo Sapiens; identical to SEQ ID NO: 312103

SEQ ID NO: 396524 - RNA, 64 nt, Homo Sapiens; identical to SEQ ID NO: 312104

SEQ ID NO: 396525 - RNA, 64 nt, Homo Sapiens; identical to SEQ ID NO: 312105

SEQ ID NO: 396526 - RNA, 64 nt, Homo Sapiens; identical to SEQ ID NO: 312106

SEQ ID NO: 396527 - RNA, 64 nt, Homo Sapiens; identical to SEQ ID NO: 312107

SEQ ID NO: 396528 - RNA, 64 nt, Homo Sapiens; identical to SEQ ID NO: 312108

SEQ ID NO: 396529 - RNA, 64 nt, Homo Sapiens; identical to SEQ ID NO: 312109

SEQ ID NO: 396530 - RNA, 64 nt, Homo Sapiens; identical to SEQ ID NO: 312110

SEQ ID NO: 396531 - RNA, 64 nt, Homo Sapiens; identical to SEQ ID NO: 312111

SEQ ID NO: 396532 - RNA, 64 nt, Homo Sapiens; identical to SEQ ID NO: 312112

SEQ ID NO: 396533 - RNA, 54 nt, Homo Sapiens; identical to SEQ ID NO: 312113

SEQ ID NO: 396534 - RNA, 64 nt, Homo Sapiens; identical to SEQ ID NO: 312114

SEQ ID NO: 396535 - RNA, 64 nt, Homo Sapiens; identical to SEQ ID NO: 114759

SEQ ID NO: 396536 - RNA, 64 nt, Homo Sapiens; identical to SEQ ID NO: 114760

SEQ ID NO: 396537 - RNA, 64 nt, Homo Sapiens; identical to SEQ ID NO: 114761

SEQ ID NO: 396538 - RNA, 64 nt, Homo Sapiens; identical to SEQ ID NO: 114762

SEQ ID NO: 396539 - RNA, 64 nt, Homo Sapiens; identical to SEQ ID NO: 114763

SEQ ID NO: 396540 - RNA, 64 nt, Homo Sapiens; identical to SEQ ID NO: 114764

SEQ ID NO: 396541 - RNA, 64 nt, Homo Sapiens; identical to SEQ ID NO: 114765

SEQ ID NO: 396542 - RNA, 64 nt, Homo Sapiens; identical to SEQ ID NO: 114766

SEQ ID NO: 396543 - RNA, 64 nt, Homo Sapiens; identical to SEQ ID NO: 114767

SEQ ID NO: 396544 - RNA, 64 nt, Homo Sapiens; identical to SEQ ID NO: 114768

SEQ ID NO: 396545 - RNA, 64 nt, Homo Sapiens; identical to SEQ ID NO: 114769

SEQ ID NO: 396546 - RNA, 64 nt, Homo Sapiens; identical to SEQ ID NO: 114770

SEQ ID NO: 396547 - RNA, 64 nt, Homo Sapiens; identical to SEQ ID NO: 114771

SEQ ID NO: 396548 - RNA, 64 nt, Homo Sapiens; identical to SEQ ID NO: 114772

SEQ ID NO: 396549 - RNA, 64 nt, Homo Sapiens; identical to SEQ ID NO: 114773

SEQ ID NO: 396550 - RNA, 64 nt, Homo Sapiens; identical to SEQ ID NO: 114774

SEQ ID NO: 396551 - RNA, 64 nt, Homo Sapiens; identical to SEQ ID NO: 114775

SEQ ID NO: 396552 - RNA, 64 nt, Homo Sapiens; identical to SEQ ID NO: 114776

SEQ ID NO: 396553 - RNA, 64 nt, Homo Sapiens; identical to SEQ ID NO: 114777

SEQ ID NO: 396554 - RNA, 64 nt, Homo Sapiens; identical to SEQ ID NO: 114778

SEQ ID NO: 396555 - RNA, 64 nt, Homo Sapiens; identical to SEQ ID NO: 114779

SEQ ID NO: 396556 - RNA, 64 nt, Homo Sapiens; identical to SEQ ID NO: 114780

SEQ ID NO: 396557 - RNA, 64 nt, Homo Sapiens; identical to SEQ ID NO: 114781

SEQ ID NO: 396558 - RNA, 64 nt, Homo Sapiens; identical to SEQ ID NO: 114782

SEQ ID NO: 396559 - RNA, 64 nt, Homo Sapiens; identical to SEQ ID NO: 114783

SEQ ID NO: 396560 - RNA, 64 nt, Homo Sapiens; identical to SEQ ID NO: 114784

SEQ ID NO: 396561 - RNA, 64 nt, Homo Sapiens; identical to SEQ ID NO: 114785

SEQ ID NO: 396562 - RNA, 64 nt, Homo Sapiens; identical to SEQ ID NO: 114786

SEQ ID NO: 396563 - RNA, 64 nt, Homo Sapiens; identical to SEQ ID NO: 114787

SEQ ID NO: 396564 - RNA, 64 nt, Homo Sapiens; identical to SEQ ID NO: 114788

SEQ ID NO: 396565 - RNA, 64 nt, Homo Sapiens; identical to SEQ ID NO: 114789

SEQ ID NO: 396566 - RNA, 64 nt, Homo Sapiens; identical to SEQ ID NO: 114790

SEQ ID NO: 396567 - RNA, 64 nt, Homo Sapiens; identical to SEQ ID NO: 114791

SEQ ID NO: 396568 - RNA, 64 nt, Homo Sapiens; identical to SEQ ID NO: 114792

SEQ ID NO: 396569 - RNA, 64 nt, Homo Sapiens; identical to SEQ ID NO: 114793

SEQ ID NO: 396570 - RNA, 64 nt, Homo Sapiens; identical to SEQ ID NO: 114794

SEQ ID NO: 396571 - RNA, 64 nt, Homo Sapiens; identical to SEQ ID NO: 114795

SEQ ID NO: 396572 - RNA, 64 nt, Homo Sapiens; identical to SEQ ID NO: 114796

SEQ ID NO: 396573 - RNA, 64 nt, Homo Sapiens; identical to SEQ ID NO: 114797

SEQ ID NO: 396574 - RNA, 64 nt, Homo Sapiens; identical to SEQ ID NO: 114798

SEQ ID NO: 396575 - RNA, 64 nt, Homo Sapiens; identical to SEQ ID NO: 114799

SEQ ID NO: 396576 - RNA, 64 nt, Homo Sapiens; identical to SEQ ID NO: 114800

SEQ ID NO: 396577 - RNA, 64 nt, Homo Sapiens; identical to SEQ ID NO: 114801

SEQ ID NO: 396578 - RNA, 64 nt, Homo Sapiens; identical to SEQ ID NO: 114802

SEQ ID NO: 396579 - RNA, 64 nt, Homo Sapiens; identical to SEQ ID NO: 114803

SEQ ID NO: 396580 - RNA, 64 nt, Homo Sapiens; identical to SEQ ID NO: 114804

SEQ ID NO: 396581 - RNA, 64 nt, Homo Sapiens; identical to SEQ ID NO: 114805

SEQ ID NO: 396582 - RNA, 64 nt, Homo Sapiens; identical to SEQ ID NO: 114806

SEQ ID NO: 396583 - RNA, 64 nt, Homo Sapiens; identical to SEQ ID NO: 114807

SEQ ID NO: 396584 - RNA, 64 nt, Homo Sapiens
ugucgcuggaaaccagggcacaugggaccaaggaggccagaacccuaggugcagcagcuccaag

SEQ ID NO: 396585 - RNA, 64 nt, Homo Sapiens
uagcucacucaaggcugccaucuccuggcuuacuggccagaaaccaagaucucuuacugcugcu

SEQ ID NO: 396586 - RNA, 64 nt, Homo Sapiens
aauguccauugggcauagggcccaccucccacuuggccagaaccccaguacccugucuucuagc

SEQ ID NO: 396587 - RNA, 64 nt, Homo Sapiens
ggcauggccaccucccaaccggggcagggucccuggccagaagggcagaaguagaagcugguga

SEQ ID NO: 396588 - RNA, 64 nt, Homo Sapiens
ccaccuucggagacggcuucuggaggaacggcuuggccagaagacagggugugagugagacagu

SEQ ID NO: 396589 - RNA, 64 nt, Homo Sapiens
cagggccuugacaggaauccagggaguagcuccuggccagaaccagccucugcggggcuugugc

SEQ ID NO: 396590 - RNA, 64 nt, Homo Sapiens
cuggaguccuuauccucccccucagugaggcuccggccagaaacccuggggaaccuacuuucug

SEQ ID NO: 396591 - RNA, 64 nt, Homo Sapiens
cuggagcuuugguuugaggacccuguccugccuuggccagaagcgagggucugcaauggcaucg

SEQ ID NO: 396592 - RNA, 64 nt, Homo Sapiens
ccagggcugcacugugguguaggagaaggaaguaggccagaaguuccagagagagucaugcugg

SEQ ID NO: 396593 - RNA, 64 nt, Homo Sapiens
uuagugcuaggggaagaugaccauccugggccaaggccagaacuccuucucccacugggcuccc

SEQ ID NO: 396594 - RNA, 64 nt, Homo Sapiens
auugcuuagcagggcauuugacuacuuuaucugaggccagaacucucacacacagcuaucaagu

SEQ ID NO: 396595 - RNA, 64 nt, Homo Sapiens
agauaaaggaacuuuuauuaaagccugagacucaggccagaauuaggagggagcuuuuugaagg

SEQ ID NO: 396596 - RNA, 64 nt, Homo Sapiens
gucucaauuacuguugucgcgguuucuccauguuggccagaaugugcauuuuuaguagagaugg

SEQ ID NO: 396597 - RNA, 64 nt, Homo Sapiens
aauucugacucccaugcaccaggggcaauuagauggccagaaagcauuagacuaugccuuugga

SEQ ID NO: 396598 - RNA, 64 nt, Homo Sapiens
ugaaaggucccucugacccaggucaccaaauuugggccagaacuggcacuuccgagugcccacu

SEQ ID NO: 396599 - RNA, 64 nt, Homo Sapiens
cgccggacggcgcagcuggccaagaggcgggcggggccagaaauaccucaugccccugcaccag

SEQ ID NO: 396600 - RNA, 64 nt, Homo Sapiens
ucuucacuugaaaucaugucccuauuucuaccccggccagaacauggacagaggccagaagccu

SEQ ID NO: 396601 - RNA, 64 nt, Homo Sapiens
ucccuauuucuaccccggccagaacauggacagaggccagaagccuuccggacaggcgcugcug

SEQ ID NO: 396602 - RNA, 64 nt, Homo Sapiens
auacauacacugcauccuguauacaguuacagcaggccagaaacugcauaaauguuauauuuau

SEQ ID NO: 396603 - RNA, 64 nt, Homo Sapiens
uacauucuuuacagcaaauggagccaccgugcccggccagaaaaagugcugggauuacaggcgu

SEQ ID NO: 396604 - RNA, 64 nt, Homo Sapiens
uuuaauugugaaaggagacuuugcagauaaaugaggccagaauggcauguuuuauaauuaacug

SEQ ID NO: 396605 - RNA, 64 nt, Homo Sapiens
gagacaccagcucucagggcagagauuggcuuggggccagaaggacccuccccaacccuggaga

SEQ ID NO: 396606 - RNA, 64 nt, Homo Sapiens
gugggugaaguccuggggucagggggugggguggggccagaaggccugauagaagggucagggc

SEQ ID NO: 396607 - RNA, 64 nt, Homo Sapiens
aaucacuuuuaugagggcuaaagauaaagaauuuggccagaaaaugcagccauccuugugugau

SEQ ID NO: 396608 - RNA, 64 nt, Homo Sapiens
ccacacauuucacugucugucgaugcagacagggggccagaacaggcaauguuuugcuuuugcu

SEQ ID NO: 396609 - RNA, 64 nt, Homo Sapiens
agcuuugcacuuuucuaaacgaagaccuaaccagggccagaaguccgacaagcacagucagguu

SEQ ID NO: 396610 - RNA, 64 nt, Homo Sapiens; identical to SEQ ID NO: 122997

SEQ ID NO: 396611 - RNA, 64 nt, Homo Sapiens; identical to SEQ ID NO: 122998

SEQ ID NO: 396612 - RNA, 64 nt, Homo Sapiens; identical to SEQ ID NO: 122999

SEQ ID NO: 396613 - RNA, 64 nt, Homo Sapiens; identical to SEQ ID NO: 123000

SEQ ID NO: 396614 - RNA, 64 nt, Homo Sapiens; identical to SEQ ID NO: 123001

SEQ ID NO: 396615 - RNA, 64 nt, Homo Sapiens; identical to SEQ ID NO: 123002

SEQ ID NO: 396616 - RNA, 64 nt, Homo Sapiens; identical to SEQ ID NO: 123003

SEQ ID NO: 396617 - RNA, 64 nt, Homo Sapiens; identical to SEQ ID NO: 123004

SEQ ID NO: 396618 - RNA, 64 nt, Homo Sapiens; identical to SEQ ID NO: 123005

SEQ ID NO: 396619 - RNA, 64 nt, Homo Sapiens; identical to SEQ ID NO: 123006

SEQ ID NO: 396620 - RNA, 64 nt, Homo Sapiens; identical to SEQ ID NO: 123007

SEQ ID NO: 396621 - RNA, 64 nt, Homo Sapiens; identical to SEQ ID NO: 123008

SEQ ID NO: 396622 - RNA, 64 nt, Homo Sapiens; identical to SEQ ID NO: 123009

SEQ ID NO: 396623 - RNA, 64 nt, Homo Sapiens; identical to SEQ ID NO: 123010

SEQ ID NO: 396624 - RNA, 64 nt, Homo Sapiens
cugccucccucuuggccucuggcugcugcggcccagccccgagccuggcucagccugucuccag

SEQ ID NO: 396625 - RNA, 64 nt, Homo Sapiens
caccacuuuccugaggcugucucgcccuguggacagccccgacaaccgcccuuucccagcugca

SEQ ID NO: 396626 - RNA, 64 nt, Homo Sapiens
ugccgcagccucaggcagaauccccuaccagcucagccccgagcucucugaacaaagcaguucc

SEQ ID NO: 396627 - RNA, 64 nt, Homo Sapiens
gacgcccccagaggaccgggccggagguggcagcagccccgagggugacgcacagccccgcccc

SEQ ID NO: 396628 - RNA, 64 nt, Homo Sapiens
ugguaacuauggcuuuauguagaauaacaaucuuauuuuccacuacccuuuacugauuuaauac

SEQ ID NO: 396629 - RNA, 64 nt, Homo Sapiens
uuguccuuucucuuaaaauaacucugaagucucuauuuuccaaguucucagcuuggaauaaugg

SEQ ID NO: 396630 - RNA, 64 nt, Homo Sapiens
aauguauaguuuuagucuccuaaauugaucuguuauuuuccaaacuauucucuuguagaaaauu

SEQ ID NO: 396631 - RNA, 64 nt, Homo Sapiens
aucuguuauuuuccaaacuauucucuuguagaaaauuuuccagugggcacuuaauggugcccuu

SEQ ID NO: 396632 - RNA, 64 nt, Homo Sapiens
agacauauucuuggagaacuuuccaucugcuuguauuuuccauacacauccccagccagaaguu

SEQ ID NO: 396633 - RNA, 64 nt, Homo Sapiens
uacagcaugcaucacggaucaauagacuguacuuauuuuccaauaaaauuuucaaacuuuguac

SEQ ID NO: 396634 - RNA, 64 nt, Homo Sapiens
guucuauuuaguuagcaucuugaaauuuguauucauuuuccagauggcuaguuuauuaaugauu

SEQ ID NO: 396635 - RNA, 64 nt, Homo Sapiens
aaucuguauuuguuuuguuaaagucaaaaaucucauuuuccaaaaaaaaaaaaaaaacccaguu

SEQ ID NO: 396636 - RNA, 64 nt, Homo Sapiens
cugauggaacacagaacugaacugagguucauggauuuuccaggacuguuucaaacaugcccau

SEQ ID NO: 396637 - RNA, 64 nt, Homo Sapiens
uuuacuuagcaguaaauuauagcucaugugcauuauuuuccagauaacuuagcuuaugaguagc

SEQ ID NO: 396638 - RNA, 64 nt, Homo Sapiens
uguaauaaacuuuaauauaaucccuguacaguagauuuuccaaauacuuaauccaauggguuuu

SEQ ID NO: 396639 - RNA, 64 nt, Homo Sapiens
gagugauagucuuuugcuuucuggaaucaggaauauuuuccaaagccccacccugggcccuggg

SEQ ID NO: 396640 - RNA, 64 nt, Homo Sapiens
uuaaaaaauuuucauuuauuuacaaauugacaugauuuuccauaauccuauccauauuccaugu

SEQ ID NO: 396641 - RNA, 64 nt, Homo Sapiens
ucuacaugaugcaauuaagacucuuuaucucuacauuuuccacuguagaauuacaagccuugug

SEQ ID NO: 396642 - RNA, 64 nt, Homo Sapiens
ccucuacucaugucugaggucuugaauuccauccauuuuccagagaaaauaugguauucuguaa

SEQ ID NO: 396643 - RNA, 64 nt, Homo Sapiens
uacauuacaacugguuuuuuaucugcugugcacaauuuuccaugcuuuuuauaaaaaaaaaaaa

SEQ ID NO: 396644 - RNA, 64 nt, Homo Sapiens
uguaaaagucaccaaaaacuauuuaccuuauguaauuuuccaaacuuuguaaucucuacaaaua

SEQ ID NO: 396645 - RNA, 64 nt, Homo Sapiens
gucuucauauucaccuuuugauuauuuauauaacauuuuccauuagaaugacuuuugaguggca

SEQ ID NO: 396646 - RNA, 64 nt, Homo Sapiens
auuucaaaccacaaacaaaagacagcagaggaguauuuuccaucagauuccaucagcccugaag

SEQ ID NO: 396647 - RNA, 64 nt, Homo Sapiens
cuaaguggagacuuaguuuuugacauuaagccuaauuuuccaaauaucuaauuuuuaccaaugg

SEQ ID NO: 396648 - RNA, 64 nt, Homo Sapiens
agggauccauuuuaaagagcuacuuagagaaauaauuuuccacaguuccaaacgauaggcucaa

SEQ ID NO: 396649 - RNA, 64 nt, Homo Sapiens
ucuacuacauuguuuauauuauugaauaaaguauauuuuccaaauguaugugagacuauaauga

SEQ ID NO: 396650 - RNA, 64 nt, Homo Sapiens
uuccguaucucccaggcaugauuggucuuccagaauuuuccaucguagaaauucaucagugccu

SEQ ID NO: 396651 - RNA, 64 nt, Homo Sapiens
uccaaauagccaggcccucuuucuaggucaccacauuuuccaucgucuagacugggccugcuca

SEQ ID NO: 396652 - RNA, 64 nt, Homo Sapiens
uuguauuuucauauaauuuauauuguguuugacuauuuuccaacuagggaugaaaaagauguua

SEQ ID NO: 396653 - RNA, 64 nt, Homo Sapiens
aguccuccauuuuuugcaccuucuuuuaugucuuauuuuccaagaaacuaacacucuguaauuu

SEQ ID NO: 396654 - RNA, 64 nt, Homo Sapiens
acucauuuuuuaccuucagguuauucuauuuuuuauuuuccagaggacucugaauuuugaauug

SEQ ID NO: 396655 - RNA, 64 nt, Homo Sapiens
aucaauauguuuucuaccauuugugaagaaaugaauuuuccaguuucaaguaccuauucaaaau

SEQ ID NO: 396656 - RNA, 64 nt, Homo Sapiens
gaucuucaauuucuucaaaaaaugaaggaucaaaauuuuccaguucuuuuuucagcuucuuuau

SEQ ID NO: 396657 - RNA, 64 nt, Homo Sapiens
uaucuccccacaaaaggagggaguuuguucagcuauuuuccagaacuuuguuucgccacaugua

SEQ ID NO: 396658 - RNA, 64 nt, Homo Sapiens
agcuacuaagucauuagagacuuauauugucuuuauuuuccaugcugacaguguauagauuuac

SEQ ID NO: 396659 - RNA, 64 nt, Homo Sapiens
ucacagacccaagcuuccauggacccauaguagaauuuuccaggcaguggucagaggcuguguu

SEQ ID NO: 396660 - RNA, 64 nt, Homo Sapiens
gccuacauuuaauuccugguuauauuuugcauucauuuuccaacauguagccuuaugaucugga

SEQ ID NO: 396661 - RNA, 64 nt, Homo Sapiens
auucauucaucaaauacaugggacuucacaaacaauuuuccauaacuuuuuagccugucuuuug

SEQ ID NO: 396662 - RNA, 64 nt, Homo Sapiens
aaagauauuuuuccagagaguuagguauaucauaauuuuccauuucaaguccuguuuauaaguc

SEQ ID NO: 396663 - RNA, 64 nt, Homo Sapiens
agaaacuggcauaaacaugauuguaguagaauuuauuuuccaguaccaauagggaaauuauuuu

SEQ ID NO: 396664 - RNA, 64 nt, Homo Sapiens
gaagaaucccuagaggaagauaaggaaaauaaguauuuuccaguuuugcuugacaguuucuaaa

SEQ ID NO: 396665 - RNA, 64 nt, Homo Sapiens
uuccauuuucucuuucaccucaauguucaaacauauuuuccacugguggccuuuucacauucuc

SEQ ID NO: 396666 - RNA, 64 nt, Homo Sapiens
uaauauuuuuggaccaagguuguuuauuucuggaauuuuccacauuaugauuuaaaacaugaau

SEQ ID NO: 396667 - RNA, 64 nt, Homo Sapiens
acaagauguagugcuauugccgauaacaaguaagauuuuccacacuacagcuggguguuucucu

SEQ ID NO: 396668 - RNA, 64 nt, Homo Sapiens
ccccuuagaaaguagcuguaggcaaagauuugugauuuuccaauuacagucucagcucuaguuu

SEQ ID NO: 396669 - RNA, 64 nt, Homo Sapiens
caacuuauacaugcuuuuuaucuaugaaaaaugcauuuuccaaaauaucacaguguuuguaaau

SEQ ID NO: 396670 - RNA, 64 nt, Homo Sapiens
gccaggguucugaaauucauuugugucuuguaucauuuuccagucuauagagcaguuuacagac

SEQ ID NO: 396671 - RNA, 64 nt, Homo Sapiens
ucauuuucagccugauccagugccauguggcgccauuuuccaaccaaggggggguuccggguuu

SEQ ID NO: 396672 - RNA, 64 nt, Homo Sapiens
gagccacugggcagaauucaaaccacaaaucaucauuuuccaccacauuguuguauuucaaaua

SEQ ID NO: 396673 - RNA, 64 nt, Homo Sapiens
aaagcccucugagaagugagucagcuguugcuuuauuuuccaucaguuccgaggcccgugagcg

SEQ ID NO: 396674 - RNA, 64 nt, Homo Sapiens
uugguuuguuagaggugggacugccugaauugucauuuuccauugagagugagccaauuaacag

SEQ ID NO: 396675 - RNA, 64 nt, Homo Sapiens
cuugcaaaauugccacauuuucacuuuaaaaauuauuuuccaccgaaagaauuucuggaagugg

SEQ ID NO: 396676 - RNA, 64 nt, Homo Sapiens
agauuuaauuuuuuuuccucuaauggaagagaauauuuuccauuguuuuuggugacucugacau

SEQ ID NO: 396677 - RNA, 64 nt, Homo Sapiens
aaugcccaaaaccuucagagauugacacgcugucauuuuccauuuccguuccuggaucuacgga

SEQ ID NO: 396678 - RNA, 63 nt, Homo Sapiens
agauagugugauaaacacagucaugaauaaaguuauuuuccacaaaaggacuuugcaguuuua

SEQ ID NO: 396679 - RNA, 64 nt, Homo Sapiens
uucuucuuaacuuuacuucucaucuuuuuuuuuaauuuuccacuuaugcauguaaaaacuuuga

SEQ ID NO: 396680 - RNA, 64 nt, Homo Sapiens
cagacagcugcugugagcaacaucugugaaauuaauuuuccaucuucccaguuuaacuggggac

SEQ ID NO: 396681 - RNA, 64 nt, Homo Sapiens
agccaaauggauuucuuacuugcacuuugacuggcuaccagauaaucacagugcguuuacugug

SEQ ID NO: 396682 - RNA, 64 nt, Homo Sapiens
auaaugauacugaaucaagaacuuccuucugcuucuaccagauggcccaaggaagcacaucguc

SEQ ID NO: 396683 - RNA, 64 nt, Homo Sapiens
gagaggauguucaacaccacgugccuaugugcuccuaccagaugaggugauggcacugggcaua

SEQ ID NO: 396684 - RNA, 64 nt, Homo Sapiens
ccgcagacccgggcacuucucagggguguggccccuaccagaccgcauccagagaugccucccu

SEQ ID NO: 396685 - RNA, 64 nt, Homo Sapiens
uauuuuaaaggggguccauuauagauaauuuuaagguguauagcuuauuggggaacuguuuauu

SEQ ID NO: 396686 - RNA, 64 nt, Homo Sapiens
guucuucccuuuuuugugcuauauacuauaacuggguguauagagagcuguaucuuuaauugaa

SEQ ID NO: 396687 - RNA, 64 nt, Homo Sapiens
uguguguguguguguguguguguguguguguguguauguguauguguauguacacauacauaua

SEQ ID NO: 396688 - RNA, 64 nt, Homo Sapiens
uguguguguguguguguguguguguguguauguguauguguauguacacauacauauauauagu

SEQ ID NO: 396689 - RNA, 64 nt, Homo Sapiens
agguugagcuaugauaugugcuuguguguaugucuauguguauauauuauauauacauuagaca

SEQ ID NO: 396690 - RNA, 64 nt, Homo Sapiens
ugaugggaaagacccuaggugcucauaacuagaguauguguauguacuuacauggguguuuuga

SEQ ID NO: 396691 - RNA, 64 nt, Homo Sapiens
gacugagaaggcaggaauauccuguaaaugauaauauguguacaucuguauaguaugugacuau

SEQ ID NO: 396692 - RNA, 64 nt, Homo Sapiens
uaacuuucaaaacuucuuuuauuuaaaugaaaccuauguguauauaauaaaagauugcugcaua

SEQ ID NO: 396693 - RNA, 64 nt, Homo Sapiens
ggcccaauaugauaagagcaauaaaggaaguggguauguguaaaagcugggaaaguuaugggaa

SEQ ID NO: 396694 - RNA, 64 nt, Homo Sapiens
caucauaagacaaggagaaucauauacaacuugauauguguauauacaguaaaguguucaccac

SEQ ID NO: 396695 - RNA, 64 nt, Homo Sapiens
uucaugccaguauaggaaacuacgauaaaaauuguauguguacuauucacauuuuagucuuuuc

SEQ ID NO: 396696 - RNA, 64 nt, Homo Sapiens
acuuaaagcuauaaauugaauaaauuguccgauuuauguguauugccagagaguaguacaacgu

SEQ ID NO: 396697 - RNA, 64 nt, Homo Sapiens
uagagagagagcugagaguucauauauguauguguauguguauaaguguguguauauauguaua

SEQ ID NO: 396698 - RNA, 64 nt, Homo Sapiens
uguauauagagagagagcuguguauacauauauguauguguaugcuguacaguguguguauaua

SEQ ID NO: 396699 - RNA, 64 nt, Homo Sapiens
uguguguguacacgugcaugguaguguccagcuauauguguaugccugguaugauguuauucag

SEQ ID NO: 396700 - RNA, 64 nt, Homo Sapiens
gaauauuaagcacauuauuguagagaaaaaaaaauauguguacacauaugaacgcacaacaugc

SEQ ID NO: 396701 - RNA, 64 nt, Homo Sapiens
uuaaguguuguacaauuacugugagaacugugaauauguguaacuuuuuuuuaguauuugcccg

SEQ ID NO: 396702 - RNA, 64 nt, Homo Sapiens
uauauaaguauauacaccacuaugcauauauguguauguguauggguguguaugugugugugug

SEQ ID NO: 396703 - RNA, 64 nt, Homo Sapiens
uguauguauauaaguauauauguguguaugcauauauguguauguucugugguguguaugugug

SEQ ID NO: 396704 - RNA, 64 nt, Homo Sapiens
caggcauguccuggacaccgggccaguaucuauauauguguauguacguuuguauguguguaga

SEQ ID NO: 396705 - RNA, 64 nt, Homo Sapiens
uccuugaaaauauuuuuuauauauacaguaacuuuauguguaaauacauaagcggcguaaguuu

SEQ ID NO: 396706 - RNA, 64 nt, Homo Sapiens
cauaaaaauauuuuuuaccauuuuuauauauguguauguguacaauugaaauuuaaaacuugca

SEQ ID NO: 396707 - RNA, 64 nt, Homo Sapiens
uguacacauaaaaauauuuucuugcauuuuuauauauguguaugauuuuuauugaaauuuaaaa

SEQ ID NO: 396708 - RNA, 64 nt, Homo Sapiens
acauaacaagcgaacgucuaguacaauucuuacuuauguguaugggauuuuucccuuugagguu

SEQ ID NO: 396709 - RNA, 64 nt, Homo Sapiens
uauauauauauauauguguguguauauauauauauauguguauauauauauguauauacauaua

SEQ ID NO: 396710 - RNA, 64 nt, Homo Sapiens
auuaaagauuauucaacaccauuuuagugugguuuauguguaauucuuuuacuuauugaaaggc

SEQ ID NO: 396711 - RNA, 64 nt, Homo Sapiens
auccuuuaauagaucucauaucucaugacuuuuuuauguguaccuuuauuacaaaacagaaaug

SEQ ID NO: 396712 - RNA, 64 nt, Homo Sapiens
uauaugcaugcauguguauaugugcguguguauguauguguaugauuuaaauauaaguauaugg

SEQ ID NO: 396713 - RNA, 64 nt, Homo Sapiens
uccuuagccccacucuaagaugccuuuuaaaauauauguguauuagagcagccaucgcugagcc

SEQ ID NO: 396714 - RNA, 64 nt, Homo Sapiens
uguguguguguguguguauagccauauauguauguauguguauguuuuggaaauggggaauagc

SEQ ID NO: 396715 - RNA, 64 nt, Homo Sapiens
ugugcccuagaugaccauuuucauuacagaaauguauguguagcuaggauucugggacauggau

SEQ ID NO: 396716 - RNA, 64 nt, Homo Sapiens
ucauaaagacaaauaaauuuguguguuuaauuauuauguguaaauugacaguguuuuuucuuuu

SEQ ID NO: 396717 - RNA, 64 nt, Homo Sapiens
ucuaauagcugaacugauucauuguuucauguuuuauguguagauacaaauguaauuuguuaau

SEQ ID NO: 396718 - RNA, 64 nt, Homo Sapiens
uggaaacaaaaaugagcguguuuagaaagcuaaguauguguagcuaaauuauucaguuuuugug

SEQ ID NO: 396719 - RNA, 64 nt, Homo Sapiens
caguggugauuuggugccugaugcaaaaugcacuuauguguaacuauuauaucccuguauagug

SEQ ID NO: 396720 - RNA, 64 nt, Homo Sapiens
caauaugcauauuaaccugcuauaacuagggcuauauguguagguauguguauacauauacaca

SEQ ID NO: 396721 - RNA, 64 nt, Homo Sapiens
auuaaccugcuauaacuagggcuauauguguagguauguguauacauauacacaaaugcacaua

SEQ ID NO: 396722 - RNA, 64 nt, Homo Sapiens
aagaacaaaugcuaaauagaguaacaguuaaauguauguguacacucuucccaaaugccaagag

SEQ ID NO: 396723 - RNA, 64 nt, Homo Sapiens
ucucucuuuucuucauguguuuuugucucuagccuauguguauuuguguagaauaaugugggau

SEQ ID NO: 396724 - RNA, 64 nt, Homo Sapiens
uaaaauguacaaugaauguauauaaauuuguauuuauguguauaagguuaauuuguuuauuucc

SEQ ID NO: 396725 - RNA, 64 nt, Homo Sapiens
aucuagauauuugaaguuugaauuauuacaaaucuauguguaaagugguuuugguuuuuuuuuu

SEQ ID NO: 396726 - RNA, 64 nt, Homo Sapiens
cacaggaaaaucacaauuacaccacuuuagacccuauguguagcaggucacaacuuacccuugu

SEQ ID NO: 396727 - RNA, 64 nt, Homo Sapiens
cccgcaugcgucuguccacuuggcuaacuuuuaauauguguauuuuuacauuauguauauucuu

SEQ ID NO: 396728 - RNA, 64 nt, Homo Sapiens
aguuguuuuuauaaugggcguuuucacaugcacauauguguaugcauguauacgcccauacaga

SEQ ID NO: 396729 - RNA, 64 nt, Homo Sapiens
ugucgggcuuccggggaaagcaaucauugguguguauguguaugugcaugcacacacgugcaua

SEQ ID NO: 396730 - RNA, 64 nt, Homo Sapiens
cuccauggaugaaagcuguuuauuuuguuuccuuuauguguaaacaagaugauaucugaaacca

SEQ ID NO: 396731 - RNA, 64 nt, Homo Sapiens
uuuagcauaaugaaaaacccucucucuauauauauauguguauaugaauuaugugggcauucuu

SEQ ID NO: 396732 - RNA, 64 nt, Homo Sapiens
uccucuuacagggggaugcauauaacagaucauguauguguaguuauuucuaaguaguaauucu

SEQ ID NO: 396733 - RNA, 64 nt, Homo Sapiens
ugaucaauuuacuucucccccaauuuuaaagaaguauguguauauuuaauaggggaagguaguu

SEQ ID NO: 396734 - RNA, 64 nt, Homo Sapiens
auauacauauguagacuauauacauguguguauauauguguauauauacauacacuuguauaaa

SEQ ID NO: 396735 - RNA, 64 nt, Homo Sapiens
auaaauguauauacacauauaccuauaauguguguauguguauuuauugaagaaacagauacca

SEQ ID NO: 396736 - RNA, 64 nt, Homo Sapiens
uuggaucuuuuuacuuugagcauauauuuuagaauauguguauguuaaaggaucuccacaaugu

SEQ ID NO: 396737 - RNA, 64 nt, Homo Sapiens
uacuuuuccacuuguuuuccuuuuccauauuauauauguguauucauauagcuguauacauauu

SEQ ID NO: 396738 - RNA, 64 nt, Homo Sapiens
uauauaauacauacaaacacgaaaaaaguauagguauguguacaugaaaggcauugcuuuaaag

SEQ ID NO: 396739 - RNA, 64 nt, Homo Sapiens
uuggaaauaaggaaaaacccguacagaguuggacuauguguauaaaaacaccacuauuugaugu

SEQ ID NO: 396740 - RNA, 64 nt, Homo Sapiens
guggucugaagaagaaaaagaaauuuuauguauguauguguaaauauguguauauauuucuauc

SEQ ID NO: 396741 - RNA, 64 nt, Homo Sapiens
gaagaaaaagaaauuuuauguauguauguguaaauauguguauauauuucuaucucuugcuaca

SEQ ID NO: 396742 - RNA, 64 nt, Homo Sapiens
aaaaguuuagguucuaauuuauguaaauaccuaguauguguauuuuugacuuuacaaagucuuu

SEQ ID NO: 396743 - RNA, 64 nt, Homo Sapiens
cacauguauaauauauacaguuuauauguguguguauguguacaaaccuaaugauuauauguau

SEQ ID NO: 396744 - RNA, 64 nt, Homo Sapiens
uaaaacugcuuaguauuauaccuauuacauuuuauauguguagacuguaguuuuaaacacuacu

SEQ ID NO: 396745 - RNA, 64 nt, Homo Sapiens
cauuuaaaaaugguaguggaggugguguuacaagacuuguuaucuuuuaggguuccauugucuu

SEQ ID NO: 396746 - RNA, 64 nt, Homo Sapiens
aacuuguagcuuaauucagccgaugguucuuucuacuuguuauauggaucuauuaaaaccacau

SEQ ID NO: 396747 - RNA, 64 nt, Homo Sapiens
ugaaagaccauaugaagaagcauuuuuaauauuaacuuguuacauacuuugauccacuuuacau

SEQ ID NO: 396748 - RNA, 64 nt, Homo Sapiens
aguauuaagauccaauuucuauaagcaagaucagacuuguuaaguaugccgcaaguaagagcua

SEQ ID NO: 396749 - RNA, 64 nt, Homo Sapiens
gcaagcuaccuuaauuucccuuauggugcucaacacuuguuacuauuuauugagcaccuacuua

SEQ ID NO: 396750 - RNA, 64 nt, Homo Sapiens
ugaaucaguagaugaaucuuaauaccaucuuaaaacuuguuaccccuguucaugugaugugagc

SEQ ID NO: 396751 - RNA, 64 nt, Homo Sapiens
gaaaagugauaggaugaaaguccauaguacauggacuuguuacacucacaagucacuucucuuc

SEQ ID NO: 396752 - RNA, 64 nt, Homo Sapiens
gauauugacauaaaauaugaauuguaauuggcuaacuuguuacuuuaacuuuuuaauuuuggcu

SEQ ID NO: 396753 - RNA, 64 nt, Homo Sapiens
acauauauauauuuuacaucugggaucaugauagacuuguuagggcuucaaggcccucagagau

SEQ ID NO: 396754 - RNA, 64 nt, Homo Sapiens
auaauuguuggaguauuuauugucaguuuuguucacuuguuaucuaauacaaaauuauaaagcc

SEQ ID NO: 396755 - RNA, 64 nt, Homo Sapiens
aauauuuuuuuaaauucuuuacagauaauauuauacuuguuacccuucacaauaccacaugaga

SEQ ID NO: 396756 - RNA, 64 nt, Homo Sapiens
auguuagacuuuuaucauaccuguaaguuaaaauacuuguuaucaauaacuugucauguuguga

SEQ ID NO: 396757 - RNA, 64 nt, Homo Sapiens
uuacaaguaugcugucaaauuaucguggguugaaacuuguuaaaugagauuucaacugacuuag

SEQ ID NO: 396758 - RNA, 64 nt, Homo Sapiens
uuauuuuaauaauauuucuccccacuugagaaucacuuguuaguucuugguaggaauucaguug

SEQ ID NO: 396759 - RNA, 64 nt, Homo Sapiens
ucuuauguaccagaaccaaauaaguauauuuagaacuuguuaaaaauacauuuuaauuuaugau

SEQ ID NO: 396760 - RNA, 64 nt, Homo Sapiens
cauuuuaauuuaugauauacauauuauuuuaauuacuuguuaaaauuuugaguuaaguugcauu

SEQ ID NO: 396761 - RNA, 64 nt, Homo Sapiens
guagaccuucuaauacucugcuaaaugaaaccacacuuguuaucugaaagugugugaaagaaac

SEQ ID NO: 396762 - RNA, 64 nt, Homo Sapiens
aagaguuaaaugaagguuaugaugacucuugauaacuuguuaaucuguugcugacuagcauuag

SEQ ID NO: 396763 - RNA, 64 nt, Homo Sapiens
guugaagcuaaaaaaauaauggcucuuugacaaaacuuguuauguugaucgcgguaugucaaaa

SEQ ID NO: 396764 - RNA, 64 nt, Homo Sapiens
uuaggauaugugugcuauauaaaaaaaaaaaaagacuuguuaaguuuuaaaauaacaaaaaugg

SEQ ID NO: 396765 - RNA, 64 nt, Homo Sapiens; identical to SEQ ID NO: 25175

SEQ ID NO: 396766 - RNA, 64 nt, Homo Sapiens; identical to SEQ ID NO: 25176

SEQ ID NO: 396767 - RNA, 64 nt, Homo Sapiens; identical to SEQ ID NO: 25177

SEQ ID NO: 396768 - RNA, 64 nt, Homo Sapiens; identical to SEQ ID NO: 25178

SEQ ID NO: 396769 - RNA, 64 nt, Homo Sapiens; identical to SEQ ID NO: 25179

SEQ ID NO: 396770 - RNA, 64 nt, Homo Sapiens; identical to SEQ ID NO: 25180

SEQ ID NO: 396771 - RNA, 64 nt, Homo Sapiens; identical to SEQ ID NO: 25181

SEQ ID NO: 396772 - RNA, 64 nt, Homo Sapiens; identical to SEQ ID NO: 25182

SEQ ID NO: 396773 - RNA, 64 nt, Homo Sapiens; identical to SEQ ID NO: 25183

SEQ ID NO: 396774 - RNA, 64 nt, Homo Sapiens; identical to SEQ ID NO: 25184

SEQ ID NO: 396775 - RNA, 64 nt, Homo Sapiens; identical to SEQ ID NO: 25185

SEQ ID NO: 396776 - RNA, 64 nt, Homo Sapiens; identical to SEQ ID NO: 25186

SEQ ID NO: 396777 - RNA, 64 nt, Homo Sapiens; identical to SEQ ID NO: 25187

SEQ ID NO: 396778 - RNA, 64 nt, Homo Sapiens; identical to SEQ ID NO: 25188

SEQ ID NO: 396779 - RNA, 64 nt, Homo Sapiens; identical to SEQ ID NO: 25189

SEQ ID NO: 396780 - RNA, 64 nt, Homo Sapiens; identical to SEQ ID NO: 25190

SEQ ID NO: 396781 - RNA, 64 nt, Homo Sapiens; identical to SEQ ID NO: 25191

SEQ ID NO: 396782 - RNA, 64 nt, Homo Sapiens; identical to SEQ ID NO: 25192

SEQ ID NO: 396783 - RNA, 64 nt, Homo Sapiens; identical to SEQ ID NO: 25193

SEQ ID NO: 396784 - RNA, 64 nt, Homo Sapiens; identical to SEQ ID NO: 25194

SEQ ID NO: 396785 - RNA, 64 nt, Homo Sapiens; identical to SEQ ID NO: 25195

SEQ ID NO: 396786 - RNA, 64 nt, Homo Sapiens; identical to SEQ ID NO: 25196

SEQ ID NO: 396787 - RNA, 64 nt, Homo Sapiens; identical to SEQ ID NO: 25197

SEQ ID NO: 396788 - RNA, 64 nt, Homo Sapiens; identical to SEQ ID NO: 25198

SEQ ID NO: 396789 - RNA, 64 nt, Homo Sapiens; identical to SEQ ID NO: 25199

SEQ ID NO: 396790 - RNA, 64 nt, Homo Sapiens; identical to SEQ ID NO: 25200

SEQ ID NO: 396791 - RNA, 64 nt, Homo Sapiens; identical to SEQ ID NO: 25201

SEQ ID NO: 396792 - RNA, 64 nt, Homo Sapiens; identical to SEQ ID NO: 25202

SEQ ID NO: 396793 - RNA, 64 nt, Homo Sapiens; identical to SEQ ID NO: 25203

SEQ ID NO: 396794 - RNA, 64 nt, Homo Sapiens; identical to SEQ ID NO: 25204

SEQ ID NO: 396795 - RNA, 64 nt, Homo Sapiens; identical to SEQ ID NO: 25205

SEQ ID NO: 396796 - RNA, 64 nt, Homo Sapiens; identical to SEQ ID NO: 25206

SEQ ID NO: 396797 - RNA, 64 nt, Homo Sapiens; identical to SEQ ID NO: 25207

SEQ ID NO: 396798 - RNA, 64 nt, Homo Sapiens; identical to SEQ ID NO: 25208

SEQ ID NO: 396799 - RNA, 64 nt, Homo Sapiens; identical to SEQ ID NO: 25209

SEQ ID NO: 396800 - RNA, 64 nt, Homo Sapiens; identical to SEQ ID NO: 25210

SEQ ID NO: 396801 - RNA, 64 nt, Homo Sapiens; identical to SEQ ID NO: 25211

SEQ ID NO: 396802 - RNA, 64 nt, Homo Sapiens; identical to SEQ ID NO: 25212

SEQ ID NO: 396803 - RNA, 64 nt, Homo Sapiens; identical to SEQ ID NO: 25213

SEQ ID NO: 396804 - RNA, 64 nt, Homo Sapiens; identical to SEQ ID NO: 25214

SEQ ID NO: 396805 - RNA, 64 nt, Homo Sapiens; identical to SEQ ID NO: 25215

SEQ ID NO: 396806 - RNA, 64 nt, Homo Sapiens; identical to SEQ ID NO: 25216

SEQ ID NO: 396807 - RNA, 64 nt, Homo Sapiens; identical to SEQ ID NO: 25217

SEQ ID NO: 396808 - RNA, 64 nt, Homo Sapiens; identical to SEQ ID NO: 25218

SEQ ID NO: 396809 - RNA, 64 nt, Homo Sapiens; identical to SEQ ID NO: 25219

SEQ ID NO: 396810 - RNA, 64 nt, Homo Sapiens; identical to SEQ ID NO: 25220

SEQ ID NO: 396811 - RNA, 64 nt, Homo Sapiens; identical to SEQ ID NO: 25221

SEQ ID NO: 396812 - RNA, 64 nt, Homo Sapiens; identical to SEQ ID NO: 25222

SEQ ID NO: 396813 - RNA, 64 nt, Homo Sapiens; identical to SEQ ID NO: 25223

SEQ ID NO: 396814 - RNA, 64 nt, Homo Sapiens; identical to SEQ ID NO: 25224

SEQ ID NO: 396815 - RNA, 64 nt, Homo Sapiens; identical to SEQ ID NO: 25225

SEQ ID NO: 396816 - RNA, 64 nt, Homo Sapiens; identical to SEQ ID NO: 25226

SEQ ID NO: 396817 - RNA, 64 nt, Homo Sapiens; identical to SEQ ID NO: 25227

SEQ ID NO: 396818 - RNA, 64 nt, Homo Sapiens; identical to SEQ ID NO: 25228

SEQ ID NO: 396819 - RNA, 64 nt, Homo Sapiens; identical to SEQ ID NO: 25229

SEQ ID NO: 396820 - RNA, 64 nt, Homo Sapiens; identical to SEQ ID NO: 25230

SEQ ID NO: 396821 - RNA, 64 nt, Homo Sapiens; identical to SEQ ID NO: 25231

SEQ ID NO: 396822 - RNA, 64 nt, Homo Sapiens; identical to SEQ ID NO: 25232

SEQ ID NO: 396823 - RNA, 64 nt, Homo Sapiens; identical to SEQ ID NO: 25233

SEQ ID NO: 396824 - RNA, 64 nt, Homo Sapiens; identical to SEQ ID NO: 25234

SEQ ID NO: 396825 - RNA, 64 nt, Homo Sapiens; identical to SEQ ID NO: 25235

SEQ ID NO: 396826 - RNA, 64 nt, Homo Sapiens; identical to SEQ ID NO: 25236

SEQ ID NO: 396827 - RNA, 64 nt, Homo Sapiens; identical to SEQ ID NO: 25237

SEQ ID NO: 396828 - RNA, 64 nt, Homo Sapiens; identical to SEQ ID NO: 25238

SEQ ID NO: 396829 - RNA, 64 nt, Homo Sapiens; identical to SEQ ID NO: 25239

SEQ ID NO: 396830 - RNA, 64 nt, Homo Sapiens; identical to SEQ ID NO: 25240

SEQ ID NO: 396831 - RNA, 64 nt, Homo Sapiens; identical to SEQ ID NO: 25241

SEQ ID NO: 396832 - RNA, 64 nt, Homo Sapiens; identical to SEQ ID NO: 25242

SEQ ID NO: 396833 - RNA, 64 nt, Homo Sapiens; identical to SEQ ID NO: 25243

SEQ ID NO: 396834 - RNA, 64 nt, Homo Sapiens; identical to SEQ ID NO: 25244

SEQ ID NO: 396835 - RNA, 64 nt, Homo Sapiens; identical to SEQ ID NO: 25245

SEQ ID NO: 396836 - RNA, 64 nt, Homo Sapiens; identical to SEQ ID NO: 25246

SEQ ID NO: 396837 - RNA, 64 nt, Homo Sapiens; identical to SEQ ID NO: 25247

SEQ ID NO: 396838 - RNA, 64 nt, Homo Sapiens; identical to SEQ ID NO: 25248

SEQ ID NO: 396839 - RNA, 64 nt, Homo Sapiens; identical to SEQ ID NO: 25249

SEQ ID NO: 396840 - RNA, 64 nt, Homo Sapiens; identical to SEQ ID NO: 25250

SEQ ID NO: 396841 - RNA, 64 nt, Homo Sapiens; identical to SEQ ID NO: 25251

SEQ ID NO: 396842 - RNA, 64 nt, Homo Sapiens; identical to SEQ ID NO: 25252

SEQ ID NO: 396843 - RNA, 64 nt, Homo Sapiens; identical to SEQ ID NO: 25253

SEQ ID NO: 396844 - RNA, 64 nt, Homo Sapiens; identical to SEQ ID NO: 25254

SEQ ID NO: 396845 - RNA, 64 nt, Homo Sapiens; identical to SEQ ID NO: 25255

SEQ ID NO: 396846 - RNA, 64 nt, Homo Sapiens; identical to SEQ ID NO: 25256

SEQ ID NO: 396847 - RNA, 64 nt, Homo Sapiens; identical to SEQ ID NO: 25257

SEQ ID NO: 396848 - RNA, 64 nt, Homo Sapiens; identical to SEQ ID NO: 25258

SEQ ID NO: 396849 - RNA, 64 nt, Homo Sapiens; identical to SEQ ID NO: 25259

SEQ ID NO: 396850 - RNA, 64 nt, Homo Sapiens; identical to SEQ ID NO: 25260

SEQ ID NO: 396851 - RNA, 64 nt, Homo Sapiens; identical to SEQ ID NO: 25261

SEQ ID NO: 396852 - RNA, 64 nt, Homo Sapiens; identical to SEQ ID NO: 25262

SEQ ID NO: 396853 - RNA, 64 nt, Homo Sapiens; identical to SEQ ID NO: 25263

SEQ ID NO: 396854 - RNA, 64 nt, Homo Sapiens; identical to SEQ ID NO: 25264

SEQ ID NO: 396855 - RNA, 63 nt, Homo Sapiens; identical to SEQ ID NO: 25265

SEQ ID NO: 396856 - RNA, 64 nt, Homo Sapiens; identical to SEQ ID NO: 25266

SEQ ID NO: 396857 - RNA, 64 nt, Homo Sapiens; identical to SEQ ID NO: 25267

SEQ ID NO: 396858 - RNA, 64 nt, Homo Sapiens; identical to SEQ ID NO: 25268

SEQ ID NO: 396859 - RNA, 64 nt, Homo Sapiens; identical to SEQ ID NO: 25269

SEQ ID NO: 396860 - RNA, 64 nt, Homo Sapiens; identical to SEQ ID NO: 25270

SEQ ID NO: 396861 - RNA, 64 nt, Homo Sapiens; identical to SEQ ID NO: 25271

SEQ ID NO: 396862 - RNA, 64 nt, Homo Sapiens; identical to SEQ ID NO: 25272

SEQ ID NO: 396863 - RNA, 64 nt, Homo Sapiens; identical to SEQ ID NO: 25273

SEQ ID NO: 396864 - RNA, 64 nt, Homo Sapiens; identical to SEQ ID NO: 25274

SEQ ID NO: 396865 - RNA, 64 nt, Homo Sapiens; identical to SEQ ID NO: 25275

SEQ ID NO: 396866 - RNA, 64 nt, Homo Sapiens; identical to SEQ ID NO: 25276

SEQ ID NO: 396867 - RNA, 64 nt, Homo Sapiens; identical to SEQ ID NO: 25277

SEQ ID NO: 396868 - RNA, 64 nt, Homo Sapiens; identical to SEQ ID NO: 25278

SEQ ID NO: 396869 - RNA, 64 nt, Homo Sapiens; identical to SEQ ID NO: 25279

SEQ ID NO: 396870 - RNA, 64 nt, Homo Sapiens; identical to SEQ ID NO: 25280

SEQ ID NO: 396871 - RNA, 64 nt, Homo Sapiens; identical to SEQ ID NO: 25281

SEQ ID NO: 396872 - RNA, 64 nt, Homo Sapiens; identical to SEQ ID NO: 25282

SEQ ID NO: 396873 - RNA, 64 nt, Homo Sapiens; identical to SEQ ID NO: 25283

SEQ ID NO: 396874 - RNA, 64 nt, Homo Sapiens; identical to SEQ ID NO: 25284

SEQ ID NO: 396875 - RNA, 64 nt, Homo Sapiens; identical to SEQ ID NO: 25285

SEQ ID NO: 396876 - RNA, 64 nt, Homo Sapiens; identical to SEQ ID NO: 25286

SEQ ID NO: 396877 - RNA, 64 nt, Homo Sapiens; identical to SEQ ID NO: 25287

SEQ ID NO: 396878 - RNA, 64 nt, Homo Sapiens; identical to SEQ ID NO: 25288

SEQ ID NO: 396879 - RNA, 64 nt, Homo Sapiens; identical to SEQ ID NO: 25289

SEQ ID NO: 396880 - RNA, 64 nt, Homo Sapiens; identical to SEQ ID NO: 25290

SEQ ID NO: 396881 - RNA, 64 nt, Homo Sapiens; identical to SEQ ID NO: 25291

SEQ ID NO: 396882 - RNA, 64 nt, Homo Sapiens; identical to SEQ ID NO: 25292

SEQ ID NO: 396883 - RNA, 64 nt, Homo Sapiens; identical to SEQ ID NO: 25293

SEQ ID NO: 396884 - RNA, 64 nt, Homo Sapiens; identical to SEQ ID NO: 25294

SEQ ID NO: 396885 - RNA, 64 nt, Homo Sapiens; identical to SEQ ID NO: 25295

SEQ ID NO: 396886 - RNA, 64 nt, Homo Sapiens; identical to SEQ ID NO: 25296

SEQ ID NO: 396887 - RNA, 64 nt, Homo Sapiens; identical to SEQ ID NO: 25297

SEQ ID NO: 396888 - RNA, 64 nt, Homo Sapiens; identical to SEQ ID NO: 25298

SEQ ID NO: 396889 - RNA, 64 nt, Homo Sapiens; identical to SEQ ID NO: 25299

SEQ ID NO: 396890 - RNA, 64 nt, Homo Sapiens; identical to SEQ ID NO: 25300

SEQ ID NO: 396891 - RNA, 64 nt, Homo Sapiens; identical to SEQ ID NO: 25301

SEQ ID NO: 396892 - RNA, 64 nt, Homo Sapiens; identical to SEQ ID NO: 25302

SEQ ID NO: 396893 - RNA, 64 nt, Homo Sapiens; identical to SEQ ID NO: 25303

SEQ ID NO: 396894 - RNA, 64 nt, Homo Sapiens; identical to SEQ ID NO: 25304

SEQ ID NO: 396895 - RNA, 64 nt, Homo Sapiens; identical to SEQ ID NO: 25305

SEQ ID NO: 396896 - RNA, 64 nt, Homo Sapiens; identical to SEQ ID NO: 25306

SEQ ID NO: 396897 - RNA, 64 nt, Homo Sapiens; identical to SEQ ID NO: 25307

SEQ ID NO: 396898 - RNA, 64 nt, Homo Sapiens; identical to SEQ ID NO: 25308

SEQ ID NO: 396899 - RNA, 64 nt, Homo Sapiens; identical to SEQ ID NO: 25309

SEQ ID NO: 396900 - RNA, 64 nt, Homo Sapiens; identical to SEQ ID NO: 25310

SEQ ID NO: 396901 - RNA, 64 nt, Homo Sapiens; identical to SEQ ID NO: 25311

SEQ ID NO: 396902 - RNA, 64 nt, Homo Sapiens; identical to SEQ ID NO: 25312

SEQ ID NO: 396903 - RNA, 64 nt, Homo Sapiens; identical to SEQ ID NO: 25313

SEQ ID NO: 396904 - RNA, 64 nt, Homo Sapiens; identical to SEQ ID NO: 25314

SEQ ID NO: 396905 - RNA, 64 nt, Homo Sapiens; identical to SEQ ID NO: 25315

SEQ ID NO: 396906 - RNA, 64 nt, Homo Sapiens; identical to SEQ ID NO: 25316

SEQ ID NO: 396907 - RNA, 64 nt, Homo Sapiens; identical to SEQ ID NO: 25317

SEQ ID NO: 396908 - RNA, 64 nt, Homo Sapiens; identical to SEQ ID NO: 25318

SEQ ID NO: 396909 - RNA, 64 nt, Homo Sapiens; identical to SEQ ID NO: 25319

SEQ ID NO: 396910 - RNA, 64 nt, Homo Sapiens; identical to SEQ ID NO: 25320

SEQ ID NO: 396911 - RNA, 64 nt, Homo Sapiens; identical to SEQ ID NO: 25321

SEQ ID NO: 396912 - RNA, 64 nt, Homo Sapiens; identical to SEQ ID NO: 25322

SEQ ID NO: 396913 - RNA, 64 nt, Homo Sapiens; identical to SEQ ID NO: 25323

SEQ ID NO: 396914 - RNA, 64 nt, Homo Sapiens; identical to SEQ ID NO: 25324

SEQ ID NO: 396915 - RNA, 64 nt, Homo Sapiens; identical to SEQ ID NO: 25325

SEQ ID NO: 396916 - RNA, 64 nt, Homo Sapiens; identical to SEQ ID NO: 25326

SEQ ID NO: 396917 - RNA, 64 nt, Homo Sapiens; identical to SEQ ID NO: 25327

SEQ ID NO: 396918 - RNA, 64 nt, Homo Sapiens; identical to SEQ ID NO: 25328

SEQ ID NO: 396919 - RNA, 64 nt, Homo Sapiens; identical to SEQ ID NO: 25329

SEQ ID NO: 396920 - RNA, 64 nt, Homo Sapiens; identical to SEQ ID NO: 25330

SEQ ID NO: 396921 - RNA, 64 nt, Homo Sapiens; identical to SEQ ID NO: 25331

SEQ ID NO: 396922 - RNA, 64 nt, Homo Sapiens; identical to SEQ ID NO: 25332

SEQ ID NO: 396923 - RNA, 64 nt, Homo Sapiens; identical to SEQ ID NO: 25333

SEQ ID NO: 396924 - RNA, 64 nt, Homo Sapiens; identical to SEQ ID NO: 25334

SEQ ID NO: 396925 - RNA, 64 nt, Homo Sapiens; identical to SEQ ID NO: 25335

SEQ ID NO: 396926 - RNA, 64 nt, Homo Sapiens; identical to SEQ ID NO: 25336

SEQ ID NO: 396927 - RNA, 64 nt, Homo Sapiens; identical to SEQ ID NO: 25337

SEQ ID NO: 396928 - RNA, 64 nt, Homo Sapiens; identical to SEQ ID NO: 25338

SEQ ID NO: 396929 - RNA, 64 nt, Homo Sapiens; identical to SEQ ID NO: 25339

SEQ ID NO: 396930 - RNA, 64 nt, Homo Sapiens; identical to SEQ ID NO: 25340

SEQ ID NO: 396931 - RNA, 64 nt, Homo Sapiens; identical to SEQ ID NO: 25341

SEQ ID NO: 396932 - RNA, 64 nt, Homo Sapiens; identical to SEQ ID NO: 25342

SEQ ID NO: 396933 - RNA, 64 nt, Homo Sapiens; identical to SEQ ID NO: 25343

SEQ ID NO: 396934 - RNA, 64 nt, Homo Sapiens; identical to SEQ ID NO: 25344

SEQ ID NO: 396935 - RNA, 64 nt, Homo Sapiens; identical to SEQ ID NO: 25345

SEQ ID NO: 396936 - RNA, 64 nt, Homo Sapiens; identical to SEQ ID NO: 25346

SEQ ID NO: 396937 - RNA, 64 nt, Homo Sapiens; identical to SEQ ID NO: 25347

SEQ ID NO: 396938 - RNA, 64 nt, Homo Sapiens; identical to SEQ ID NO: 25348

SEQ ID NO: 396939 - RNA, 64 nt, Homo Sapiens; identical to SEQ ID NO: 25349

SEQ ID NO: 396940 - RNA, 64 nt, Homo Sapiens; identical to SEQ ID NO: 25350

SEQ ID NO: 396941 - RNA, 64 nt, Homo Sapiens; identical to SEQ ID NO: 25351

SEQ ID NO: 396942 - RNA, 64 nt, Homo Sapiens; identical to SEQ ID NO: 25352

SEQ ID NO: 396943 - RNA, 64 nt, Homo Sapiens; identical to SEQ ID NO: 25353

SEQ ID NO: 396944 - RNA, 64 nt, Homo Sapiens; identical to SEQ ID NO: 25354

SEQ ID NO: 396945 - RNA, 64 nt, Homo Sapiens; identical to SEQ ID NO: 25355

SEQ ID NO: 396946 - RNA, 64 nt, Homo Sapiens; identical to SEQ ID NO: 25356

SEQ ID NO: 396947 - RNA, 64 nt, Homo Sapiens; identical to SEQ ID NO: 25357

SEQ ID NO: 396948 - RNA, 64 nt, Homo Sapiens; identical to SEQ ID NO: 25358

SEQ ID NO: 396949 - RNA, 64 nt, Homo Sapiens; identical to SEQ ID NO: 25359

SEQ ID NO: 396950 - RNA, 64 nt, Homo Sapiens; identical to SEQ ID NO: 25360

SEQ ID NO: 396951 - RNA, 64 nt, Homo Sapiens; identical to SEQ ID NO: 25361

SEQ ID NO: 396952 - RNA, 64 nt, Homo Sapiens; identical to SEQ ID NO: 25362

SEQ ID NO: 396953 - RNA, 64 nt, Homo Sapiens; identical to SEQ ID NO: 25363

SEQ ID NO: 396954 - RNA, 64 nt, Homo Sapiens; identical to SEQ ID NO: 25364

SEQ ID NO: 396955 - RNA, 64 nt, Homo Sapiens; identical to SEQ ID NO: 25365

SEQ ID NO: 396956 - RNA, 64 nt, Homo Sapiens; identical to SEQ ID NO: 25366

SEQ ID NO: 396957 - RNA, 64 nt, Homo Sapiens; identical to SEQ ID NO: 25367

SEQ ID NO: 396958 - RNA, 64 nt, Homo Sapiens; identical to SEQ ID NO: 25368

SEQ ID NO: 396959 - RNA, 64 nt, Homo Sapiens; identical to SEQ ID NO: 25369

SEQ ID NO: 396960 - RNA, 64 nt, Homo Sapiens; identical to SEQ ID NO: 25370

SEQ ID NO: 396961 - RNA, 64 nt, Homo Sapiens; identical to SEQ ID NO: 25371

SEQ ID NO: 396962 - RNA, 64 nt, Homo Sapiens; identical to SEQ ID NO: 25372

SEQ ID NO: 396963 - RNA, 64 nt, Homo Sapiens; identical to SEQ ID NO: 25373

SEQ ID NO: 396964 - RNA, 64 nt, Homo Sapiens; identical to SEQ ID NO: 25374

SEQ ID NO: 396965 - RNA, 64 nt, Homo Sapiens; identical to SEQ ID NO: 25375

SEQ ID NO: 396966 - RNA, 64 nt, Homo Sapiens; identical to SEQ ID NO: 25376

SEQ ID NO: 396967 - RNA, 64 nt, Homo Sapiens; identical to SEQ ID NO: 25377

SEQ ID NO: 396968 - RNA, 64 nt, Homo Sapiens; identical to SEQ ID NO: 25378

SEQ ID NO: 396969 - RNA, 64 nt, Homo Sapiens; identical to SEQ ID NO: 25379

SEQ ID NO: 396970 - RNA, 64 nt, Homo Sapiens; identical to SEQ ID NO: 25380

SEQ ID NO: 396971 - RNA, 64 nt, Homo Sapiens; identical to SEQ ID NO: 25381

SEQ ID NO: 396972 - RNA, 64 nt, Homo Sapiens; identical to SEQ ID NO: 25382

SEQ ID NO: 396973 - RNA, 64 nt, Homo Sapiens; identical to SEQ ID NO: 25383

SEQ ID NO: 396974 - RNA, 64 nt, Homo Sapiens; identical to SEQ ID NO: 25384

SEQ ID NO: 396975 - RNA, 64 nt, Homo Sapiens; identical to SEQ ID NO: 25385

SEQ ID NO: 396976 - RNA, 64 nt, Homo Sapiens; identical to SEQ ID NO: 25386

SEQ ID NO: 396977 - RNA, 64 nt, Homo Sapiens; identical to SEQ ID NO: 25387

SEQ ID NO: 396978 - RNA, 64 nt, Homo Sapiens; identical to SEQ ID NO: 25388

SEQ ID NO: 396979 - RNA, 64 nt, Homo Sapiens; identical to SEQ ID NO: 25389

SEQ ID NO: 396980 - RNA, 64 nt, Homo Sapiens; identical to SEQ ID NO: 25390

SEQ ID NO: 396981 - RNA, 64 nt, Homo Sapiens; identical to SEQ ID NO: 25391

SEQ ID NO: 396982 - RNA, 64 nt, Homo Sapiens; identical to SEQ ID NO: 25392

SEQ ID NO: 396983 - RNA, 64 nt, Homo Sapiens; identical to SEQ ID NO: 25393

SEQ ID NO: 396984 - RNA, 64 nt, Homo Sapiens; identical to SEQ ID NO: 25394

SEQ ID NO: 396985 - RNA, 64 nt, Homo Sapiens; identical to SEQ ID NO: 25395

SEQ ID NO: 396986 - RNA, 64 nt, Homo Sapiens; identical to SEQ ID NO: 25396

SEQ ID NO: 396987 - RNA, 64 nt, Homo Sapiens; identical to SEQ ID NO: 25397

SEQ ID NO: 396988 - RNA, 64 nt, Homo Sapiens; identical to SEQ ID NO: 25398

SEQ ID NO: 396989 - RNA, 64 nt, Homo Sapiens; identical to SEQ ID NO: 25399

SEQ ID NO: 396990 - RNA, 64 nt, Homo Sapiens; identical to SEQ ID NO: 25400

SEQ ID NO: 396991 - RNA, 64 nt, Homo Sapiens; identical to SEQ ID NO: 25401

SEQ ID NO: 396992 - RNA, 64 nt, Homo Sapiens; identical to SEQ ID NO: 25402

SEQ ID NO: 396993 - RNA, 64 nt, Homo Sapiens; identical to SEQ ID NO: 25403

SEQ ID NO: 396994 - RNA, 64 nt, Homo Sapiens; identical to SEQ ID NO: 25404

SEQ ID NO: 396995 - RNA, 64 nt, Homo Sapiens; identical to SEQ ID NO: 25405

SEQ ID NO: 396996 - RNA, 64 nt, Homo Sapiens; identical to SEQ ID NO: 25406

SEQ ID NO: 396997 - RNA, 64 nt, Homo Sapiens; identical to SEQ ID NO: 25407

SEQ ID NO: 396998 - RNA, 64 nt, Homo Sapiens; identical to SEQ ID NO: 25408

SEQ ID NO: 396999 - RNA, 64 nt, Homo Sapiens; identical to SEQ ID NO: 25409

SEQ ID NO: 397000 - RNA, 64 nt, Homo Sapiens; identical to SEQ ID NO: 25410

SEQ ID NO: 397001 - RNA, 64 nt, Homo Sapiens; identical to SEQ ID NO: 25411

SEQ ID NO: 397002 - RNA, 64 nt, Homo Sapiens; identical to SEQ ID NO: 25412

SEQ ID NO: 397003 - RNA, 64 nt, Homo Sapiens; identical to SEQ ID NO: 25413

SEQ ID NO: 397004 - RNA, 64 nt, Homo Sapiens; identical to SEQ ID NO: 25414

SEQ ID NO: 397005 - RNA, 64 nt, Homo Sapiens; identical to SEQ ID NO: 25415

SEQ ID NO: 397006 - RNA, 64 nt, Homo Sapiens; identical to SEQ ID NO: 25416

SEQ ID NO: 397007 - RNA, 64 nt, Homo Sapiens; identical to SEQ ID NO: 25417

SEQ ID NO: 397008 - RNA, 64 nt, Homo Sapiens; identical to SEQ ID NO: 25418

SEQ ID NO: 397009 - RNA, 64 nt, Homo Sapiens; identical to SEQ ID NO: 25419

SEQ ID NO: 397010 - RNA, 64 nt, Homo Sapiens; identical to SEQ ID NO: 25420

SEQ ID NO: 397011 - RNA, 64 nt, Homo Sapiens; identical to SEQ ID NO: 25421

SEQ ID NO: 397012 - RNA, 64 nt, Homo Sapiens; identical to SEQ ID NO: 25422

SEQ ID NO: 397013 - RNA, 64 nt, Homo Sapiens; identical to SEQ ID NO: 25423

SEQ ID NO: 397014 - RNA, 64 nt, Homo Sapiens; identical to SEQ ID NO: 25424

SEQ ID NO: 397015 - RNA, 64 nt, Homo Sapiens; identical to SEQ ID NO: 25425

SEQ ID NO: 397016 - RNA, 64 nt, Homo Sapiens; identical to SEQ ID NO: 25426

SEQ ID NO: 397017 - RNA, 64 nt, Homo Sapiens; identical to SEQ ID NO: 25427

SEQ ID NO: 397018 - RNA, 64 nt, Homo Sapiens; identical to SEQ ID NO: 25428

SEQ ID NO: 397019 - RNA, 64 nt, Homo Sapiens; identical to SEQ ID NO: 25429

SEQ ID NO: 397020 - RNA, 64 nt, Homo Sapiens; identical to SEQ ID NO: 25430

SEQ ID NO: 397021 - RNA, 64 nt, Homo Sapiens; identical to SEQ ID NO: 25431

SEQ ID NO: 397022 - RNA, 64 nt, Homo Sapiens; identical to SEQ ID NO: 25432

SEQ ID NO: 397023 - RNA, 64 nt, Homo Sapiens; identical to SEQ ID NO: 25433

SEQ ID NO: 397024 - RNA, 64 nt, Homo Sapiens; identical to SEQ ID NO: 25434

SEQ ID NO: 397025 - RNA, 64 nt, Homo Sapiens; identical to SEQ ID NO: 25435

SEQ ID NO: 397026 - RNA, 64 nt, Homo Sapiens; identical to SEQ ID NO: 25436

SEQ ID NO: 397027 - RNA, 64 nt, Homo Sapiens; identical to SEQ ID NO: 25437

SEQ ID NO: 397028 - RNA, 64 nt, Homo Sapiens; identical to SEQ ID NO: 25438

SEQ ID NO: 397029 - RNA, 64 nt, Homo Sapiens; identical to SEQ ID NO: 25439

SEQ ID NO: 397030 - RNA, 64 nt, Homo Sapiens; identical to SEQ ID NO: 25440

SEQ ID NO: 397031 - RNA, 64 nt, Homo Sapiens; identical to SEQ ID NO: 25441

SEQ ID NO: 397032 - RNA, 64 nt, Homo Sapiens; identical to SEQ ID NO: 25442

SEQ ID NO: 397033 - RNA, 64 nt, Homo Sapiens; identical to SEQ ID NO: 25443

SEQ ID NO: 397034 - RNA, 64 nt, Homo Sapiens; identical to SEQ ID NO: 25444

SEQ ID NO: 397035 - RNA, 64 nt, Homo Sapiens; identical to SEQ ID NO: 25445

SEQ ID NO: 397036 - RNA, 64 nt, Homo Sapiens; identical to SEQ ID NO: 25446

SEQ ID NO: 397037 - RNA, 64 nt, Homo Sapiens; identical to SEQ ID NO: 25447

SEQ ID NO: 397038 - RNA, 64 nt, Homo Sapiens; identical to SEQ ID NO: 25448

SEQ ID NO: 397039 - RNA, 64 nt, Homo Sapiens; identical to SEQ ID NO: 25449

SEQ ID NO: 397040 - RNA, 64 nt, Homo Sapiens; identical to SEQ ID NO: 25450

SEQ ID NO: 397041 - RNA, 64 nt, Homo Sapiens; identical to SEQ ID NO: 25451

SEQ ID NO: 397042 - RNA, 64 nt, Homo Sapiens; identical to SEQ ID NO: 25452

SEQ ID NO: 397043 - RNA, 64 nt, Homo Sapiens; identical to SEQ ID NO: 25453

SEQ ID NO: 397044 - RNA, 64 nt, Homo Sapiens; identical to SEQ ID NO: 25454

SEQ ID NO: 397045 - RNA, 64 nt, Homo Sapiens; identical to SEQ ID NO: 25455

SEQ ID NO: 397046 - RNA, 64 nt, Homo Sapiens; identical to SEQ ID NO: 25456

SEQ ID NO: 397047 - RNA, 64 nt, Homo Sapiens; identical to SEQ ID NO: 25457

SEQ ID NO: 397048 - RNA, 64 nt, Homo Sapiens; identical to SEQ ID NO: 25458

SEQ ID NO: 397049 - RNA, 64 nt, Homo Sapiens; identical to SEQ ID NO: 25459

SEQ ID NO: 397050 - RNA, 64 nt, Homo Sapiens; identical to SEQ ID NO: 25460

SEQ ID NO: 397051 - RNA, 64 nt, Homo Sapiens; identical to SEQ ID NO: 25461

SEQ ID NO: 397052 - RNA, 64 nt, Homo Sapiens; identical to SEQ ID NO: 25462

SEQ ID NO: 397053 - RNA, 64 nt, Homo Sapiens; identical to SEQ ID NO: 25463

SEQ ID NO: 397054 - RNA, 64 nt, Homo Sapiens; identical to SEQ ID NO: 25464

SEQ ID NO: 397055 - RNA, 64 nt, Homo Sapiens; identical to SEQ ID NO: 25465

SEQ ID NO: 397056 - RNA, 64 nt, Homo Sapiens; identical to SEQ ID NO: 25466

SEQ ID NO: 397057 - RNA, 64 nt, Homo Sapiens; identical to SEQ ID NO: 25467

SEQ ID NO: 397058 - RNA, 64 nt, Homo Sapiens; identical to SEQ ID NO: 25468

SEQ ID NO: 397059 - RNA, 64 nt, Homo Sapiens; identical to SEQ ID NO: 25469

SEQ ID NO: 397060 - RNA, 64 nt, Homo Sapiens; identical to SEQ ID NO: 25470

SEQ ID NO: 397061 - RNA, 64 nt, Homo Sapiens; identical to SEQ ID NO: 25471

SEQ ID NO: 397062 - RNA, 64 nt, Homo Sapiens; identical to SEQ ID NO: 25472

SEQ ID NO: 397063 - RNA, 64 nt, Homo Sapiens; identical to SEQ ID NO: 25473

SEQ ID NO: 397064 - RNA, 64 nt, Homo Sapiens; identical to SEQ ID NO: 25474

SEQ ID NO: 397065 - RNA, 64 nt, Homo Sapiens; identical to SEQ ID NO: 25475

SEQ ID NO: 397066 - RNA, 64 nt, Homo Sapiens; identical to SEQ ID NO: 25476

SEQ ID NO: 397067 - RNA, 64 nt, Homo Sapiens; identical to SEQ ID NO: 25477

SEQ ID NO: 397068 - RNA, 64 nt, Homo Sapiens; identical to SEQ ID NO: 25478

SEQ ID NO: 397069 - RNA, 64 nt, Homo Sapiens; identical to SEQ ID NO: 25479

SEQ ID NO: 397070 - RNA, 64 nt, Homo Sapiens; identical to SEQ ID NO: 25480

SEQ ID NO: 397071 - RNA, 64 nt, Homo Sapiens; identical to SEQ ID NO: 25481

SEQ ID NO: 397072 - RNA, 64 nt, Homo Sapiens; identical to SEQ ID NO: 25482

SEQ ID NO: 397073 - RNA, 64 nt, Homo Sapiens; identical to SEQ ID NO: 25483

SEQ ID NO: 397074 - RNA, 64 nt, Homo Sapiens; identical to SEQ ID NO: 25484

SEQ ID NO: 397075 - RNA, 64 nt, Homo Sapiens; identical to SEQ ID NO: 25485

SEQ ID NO: 397076 - RNA, 64 nt, Homo Sapiens; identical to SEQ ID NO: 25486

SEQ ID NO: 397077 - RNA, 64 nt, Homo Sapiens; identical to SEQ ID NO: 25487

SEQ ID NO: 397078 - RNA, 64 nt, Homo Sapiens; identical to SEQ ID NO: 25488

SEQ ID NO: 397079 - RNA, 64 nt, Homo Sapiens; identical to SEQ ID NO: 25489

SEQ ID NO: 397080 - RNA, 64 nt, Homo Sapiens; identical to SEQ ID NO: 25490

SEQ ID NO: 397081 - RNA, 64 nt, Homo Sapiens; identical to SEQ ID NO: 25491

SEQ ID NO: 397082 - RNA, 64 nt, Homo Sapiens; identical to SEQ ID NO: 25492

SEQ ID NO: 397083 - RNA, 64 nt, Homo Sapiens; identical to SEQ ID NO: 25493

SEQ ID NO: 397084 - RNA, 64 nt, Homo Sapiens; identical to SEQ ID NO: 25494

SEQ ID NO: 397085 - RNA, 64 nt, Homo Sapiens; identical to SEQ ID NO: 25495

SEQ ID NO: 397086 - RNA, 64 nt, Homo Sapiens; identical to SEQ ID NO: 25496

SEQ ID NO: 397087 - RNA, 64 nt, Homo Sapiens; identical to SEQ ID NO: 25497

SEQ ID NO: 397088 - RNA, 64 nt, Homo Sapiens; identical to SEQ ID NO: 25498

SEQ ID NO: 397089 - RNA, 64 nt, Homo Sapiens; identical to SEQ ID NO: 25499

SEQ ID NO: 397090 - RNA, 64 nt, Homo Sapiens; identical to SEQ ID NO: 25500

SEQ ID NO: 397091 - RNA, 64 nt, Homo Sapiens; identical to SEQ ID NO: 25501

SEQ ID NO: 397092 - RNA, 64 nt, Homo Sapiens; identical to SEQ ID NO: 25502

SEQ ID NO: 397093 - RNA, 64 nt, Homo Sapiens; identical to SEQ ID NO: 25503

SEQ ID NO: 397094 - RNA, 64 nt, Homo Sapiens; identical to SEQ ID NO: 25504

SEQ ID NO: 397095 - RNA, 64 nt, Homo Sapiens; identical to SEQ ID NO: 25505

SEQ ID NO: 397096 - RNA, 64 nt, Homo Sapiens; identical to SEQ ID NO: 25506

SEQ ID NO: 397097 - RNA, 64 nt, Homo Sapiens; identical to SEQ ID NO: 25507

SEQ ID NO: 397098 - RNA, 64 nt, Homo Sapiens; identical to SEQ ID NO: 25508

SEQ ID NO: 397099 - RNA, 64 nt, Homo Sapiens; identical to SEQ ID NO: 25509

SEQ ID NO: 397100 - RNA, 64 nt, Homo Sapiens; identical to SEQ ID NO: 25510

SEQ ID NO: 397101 - RNA, 64 nt, Homo Sapiens; identical to SEQ ID NO: 25511

SEQ ID NO: 397102 - RNA, 64 nt, Homo Sapiens; identical to SEQ ID NO: 25512

SEQ ID NO: 397103 - RNA, 64 nt, Homo Sapiens; identical to SEQ ID NO: 25513

SEQ ID NO: 397104 - RNA, 64 nt, Homo Sapiens; identical to SEQ ID NO: 25514

SEQ ID NO: 397105 - RNA, 64 nt, Homo Sapiens; identical to SEQ ID NO: 25515

SEQ ID NO: 397106 - RNA, 64 nt, Homo Sapiens; identical to SEQ ID NO: 25516

SEQ ID NO: 397107 - RNA, 64 nt, Homo Sapiens; identical to SEQ ID NO: 25517

SEQ ID NO: 397108 - RNA, 64 nt, Homo Sapiens; identical to SEQ ID NO: 25518

SEQ ID NO: 397109 - RNA, 64 nt, Homo Sapiens; identical to SEQ ID NO: 25519

SEQ ID NO: 397110 - RNA, 64 nt, Homo Sapiens; identical to SEQ ID NO: 25520

SEQ ID NO: 397111 - RNA, 64 nt, Homo Sapiens; identical to SEQ ID NO: 25521

SEQ ID NO: 397112 - RNA, 64 nt, Homo Sapiens; identical to SEQ ID NO: 25522

SEQ ID NO: 397113 - RNA, 64 nt, Homo Sapiens; identical to SEQ ID NO: 25523

SEQ ID NO: 397114 - RNA, 64 nt, Homo Sapiens; identical to SEQ ID NO: 25524

SEQ ID NO: 397115 - RNA, 64 nt, Homo Sapiens; identical to SEQ ID NO: 25525

SEQ ID NO: 397116 - RNA, 64 nt, Homo Sapiens; identical to SEQ ID NO: 25526

SEQ ID NO: 397117 - RNA, 64 nt, Homo Sapiens; identical to SEQ ID NO: 25527

SEQ ID NO: 397118 - RNA, 64 nt, Homo Sapiens; identical to SEQ ID NO: 25528

SEQ ID NO: 397119 - RNA, 64 nt, Homo Sapiens; identical to SEQ ID NO: 25529

SEQ ID NO: 397120 - RNA, 64 nt, Homo Sapiens; identical to SEQ ID NO: 25530

SEQ ID NO: 397121 - RNA, 64 nt, Homo Sapiens; identical to SEQ ID NO: 25531

SEQ ID NO: 397122 - RNA, 64 nt, Homo Sapiens; identical to SEQ ID NO: 25532

SEQ ID NO: 397123 - RNA, 64 nt, Homo Sapiens; identical to SEQ ID NO: 25533

SEQ ID NO: 397124 - RNA, 64 nt, Homo Sapiens; identical to SEQ ID NO: 25534

SEQ ID NO: 397125 - RNA, 64 nt, Homo Sapiens; identical to SEQ ID NO: 25535

SEQ ID NO: 397126 - RNA, 64 nt, Homo Sapiens; identical to SEQ ID NO: 25536

SEQ ID NO: 397127 - RNA, 64 nt, Homo Sapiens; identical to SEQ ID NO: 25537

SEQ ID NO: 397128 - RNA, 64 nt, Homo Sapiens; identical to SEQ ID NO: 25538

SEQ ID NO: 397129 - RNA, 64 nt, Homo Sapiens; identical to SEQ ID NO: 25539

SEQ ID NO: 397130 - RNA, 64 nt, Homo Sapiens; identical to SEQ ID NO: 25540

SEQ ID NO: 397131 - RNA, 64 nt, Homo Sapiens; identical to SEQ ID NO: 25541

SEQ ID NO: 397132 - RNA, 64 nt, Homo Sapiens; identical to SEQ ID NO: 25542

SEQ ID NO: 397133 - RNA, 64 nt, Homo Sapiens; identical to SEQ ID NO: 25543

SEQ ID NO: 397134 - RNA, 64 nt, Homo Sapiens; identical to SEQ ID NO: 25544

SEQ ID NO: 397135 - RNA, 64 nt, Homo Sapiens; identical to SEQ ID NO: 25545

SEQ ID NO: 397136 - RNA, 64 nt, Homo Sapiens; identical to SEQ ID NO: 25546

SEQ ID NO: 397137 - RNA, 64 nt, Homo Sapiens; identical to SEQ ID NO: 25547

SEQ ID NO: 397138 - RNA, 64 nt, Homo Sapiens; identical to SEQ ID NO: 25548

SEQ ID NO: 397139 - RNA, 64 nt, Homo Sapiens; identical to SEQ ID NO: 25549

SEQ ID NO: 397140 - RNA, 64 nt, Homo Sapiens; identical to SEQ ID NO: 25550

SEQ ID NO: 397141 - RNA, 64 nt, Homo Sapiens; identical to SEQ ID NO: 25551

SEQ ID NO: 397142 - RNA, 64 nt, Homo Sapiens; identical to SEQ ID NO: 25552

SEQ ID NO: 397143 - RNA, 64 nt, Homo Sapiens; identical to SEQ ID NO: 25553

SEQ ID NO: 397144 - RNA, 64 nt, Homo Sapiens; identical to SEQ ID NO: 25554

SEQ ID NO: 397145 - RNA, 64 nt, Homo Sapiens; identical to SEQ ID NO: 25555

SEQ ID NO: 397146 - RNA, 64 nt, Homo Sapiens; identical to SEQ ID NO: 25556

SEQ ID NO: 397147 - RNA, 64 nt, Homo Sapiens; identical to SEQ ID NO: 25557

SEQ ID NO: 397148 - RNA, 64 nt, Homo Sapiens; identical to SEQ ID NO: 25558

SEQ ID NO: 397149 - RNA, 64 nt, Homo Sapiens; identical to SEQ ID NO: 25559

SEQ ID NO: 397150 - RNA, 64 nt, Homo Sapiens; identical to SEQ ID NO: 25560

SEQ ID NO: 397151 - RNA, 63 nt, Homo Sapiens; identical to SEQ ID NO: 25561

SEQ ID NO: 397152 - RNA, 62 nt, Homo Sapiens; identical to SEQ ID NO: 25562

SEQ ID NO: 397153 - RNA, 64 nt, Homo Sapiens; identical to SEQ ID NO: 25563

SEQ ID NO: 397154 - RNA, 64 nt, Homo Sapiens; identical to SEQ ID NO: 25564

SEQ ID NO: 397155 - RNA, 64 nt, Homo Sapiens; identical to SEQ ID NO: 25565

SEQ ID NO: 397156 - RNA, 64 nt, Homo Sapiens; identical to SEQ ID NO: 25566

SEQ ID NO: 397157 - RNA, 64 nt, Homo Sapiens; identical to SEQ ID NO: 25567

SEQ ID NO: 397158 - RNA, 64 nt, Homo Sapiens; identical to SEQ ID NO: 25568

SEQ ID NO: 397159 - RNA, 64 nt, Homo Sapiens; identical to SEQ ID NO: 25569

SEQ ID NO: 397160 - RNA, 64 nt, Homo Sapiens; identical to SEQ ID NO: 25570

SEQ ID NO: 397161 - RNA, 64 nt, Homo Sapiens; identical to SEQ ID NO: 25571

SEQ ID NO: 397162 - RNA, 64 nt, Homo Sapiens; identical to SEQ ID NO: 25572

SEQ ID NO: 397163 - RNA, 64 nt, Homo Sapiens; identical to SEQ ID NO: 25573

SEQ ID NO: 397164 - RNA, 64 nt, Homo Sapiens; identical to SEQ ID NO: 25574

SEQ ID NO: 397165 - RNA, 64 nt, Homo Sapiens; identical to SEQ ID NO: 25575

SEQ ID NO: 397166 - RNA, 64 nt, Homo Sapiens; identical to SEQ ID NO: 25576

SEQ ID NO: 397167 - RNA, 64 nt, Homo Sapiens; identical to SEQ ID NO: 25577

SEQ ID NO: 397168 - RNA, 64 nt, Homo Sapiens; identical to SEQ ID NO: 25578

SEQ ID NO: 397169 - RNA, 64 nt, Homo Sapiens; identical to SEQ ID NO: 25579

SEQ ID NO: 397170 - RNA, 64 nt, Homo Sapiens; identical to SEQ ID NO: 25580

SEQ ID NO: 397171 - RNA, 64 nt, Homo Sapiens; identical to SEQ ID NO: 25581

SEQ ID NO: 397172 - RNA, 64 nt, Homo Sapiens; identical to SEQ ID NO: 25582

SEQ ID NO: 397173 - RNA, 64 nt, Homo Sapiens; identical to SEQ ID NO: 25583

SEQ ID NO: 397174 - RNA, 64 nt, Homo Sapiens; identical to SEQ ID NO: 25584

SEQ ID NO: 397175 - RNA, 64 nt, Homo Sapiens; identical to SEQ ID NO: 25585

SEQ ID NO: 397176 - RNA, 64 nt, Homo Sapiens; identical to SEQ ID NO: 25586

SEQ ID NO: 397177 - RNA, 64 nt, Homo Sapiens; identical to SEQ ID NO: 25587

SEQ ID NO: 397178 - RNA, 64 nt, Homo Sapiens; identical to SEQ ID NO: 25588

SEQ ID NO: 397179 - RNA, 64 nt, Homo Sapiens; identical to SEQ ID NO: 25589

SEQ ID NO: 397180 - RNA, 64 nt, Homo Sapiens; identical to SEQ ID NO: 25590

SEQ ID NO: 397181 - RNA, 64 nt, Homo Sapiens; identical to SEQ ID NO: 25591

SEQ ID NO: 397182 - RNA, 64 nt, Homo Sapiens; identical to SEQ ID NO: 25592

SEQ ID NO: 397183 - RNA, 64 nt, Homo Sapiens; identical to SEQ ID NO: 25593

SEQ ID NO: 397184 - RNA, 64 nt, Homo Sapiens; identical to SEQ ID NO: 25594

SEQ ID NO: 397185 - RNA, 64 nt, Homo Sapiens; identical to SEQ ID NO: 25595

SEQ ID NO: 397186 - RNA, 64 nt, Homo Sapiens; identical to SEQ ID NO: 25596

SEQ ID NO: 397187 - RNA, 64 nt, Homo Sapiens; identical to SEQ ID NO: 25597

SEQ ID NO: 397188 - RNA, 64 nt, Homo Sapiens; identical to SEQ ID NO: 25598

SEQ ID NO: 397189 - RNA, 64 nt, Homo Sapiens; identical to SEQ ID NO: 25599

SEQ ID NO: 397190 - RNA, 64 nt, Homo Sapiens; identical to SEQ ID NO: 25600

SEQ ID NO: 397191 - RNA, 64 nt, Homo Sapiens; identical to SEQ ID NO: 25601

SEQ ID NO: 397192 - RNA, 64 nt, Homo Sapiens; identical to SEQ ID NO: 25602

SEQ ID NO: 397193 - RNA, 64 nt, Homo Sapiens; identical to SEQ ID NO: 25603

SEQ ID NO: 397194 - RNA, 64 nt, Homo Sapiens; identical to SEQ ID NO: 25604

SEQ ID NO: 397195 - RNA, 64 nt, Homo Sapiens; identical to SEQ ID NO: 25605

SEQ ID NO: 397196 - RNA, 64 nt, Homo Sapiens; identical to SEQ ID NO: 25606

SEQ ID NO: 397197 - RNA, 64 nt, Homo Sapiens; identical to SEQ ID NO: 25607

SEQ ID NO: 397198 - RNA, 64 nt, Homo Sapiens; identical to SEQ ID NO: 25608

SEQ ID NO: 397199 - RNA, 64 nt, Homo Sapiens; identical to SEQ ID NO: 25609

SEQ ID NO: 397200 - RNA, 64 nt, Homo Sapiens; identical to SEQ ID NO: 25610

SEQ ID NO: 397201 - RNA, 64 nt, Homo Sapiens; identical to SEQ ID NO: 25611

SEQ ID NO: 397202 - RNA, 64 nt, Homo Sapiens; identical to SEQ ID NO: 25612

SEQ ID NO: 397203 - RNA, 64 nt, Homo Sapiens; identical to SEQ ID NO: 25613

SEQ ID NO: 397204 - RNA, 64 nt, Homo Sapiens; identical to SEQ ID NO: 25614

SEQ ID NO: 397205 - RNA, 64 nt, Homo Sapiens; identical to SEQ ID NO: 25615

SEQ ID NO: 397206 - RNA, 64 nt, Homo Sapiens; identical to SEQ ID NO: 25616

SEQ ID NO: 397207 - RNA, 64 nt, Homo Sapiens; identical to SEQ ID NO: 25617

SEQ ID NO: 397208 - RNA, 64 nt, Homo Sapiens; identical to SEQ ID NO: 25618

SEQ ID NO: 397209 - RNA, 64 nt, Homo Sapiens; identical to SEQ ID NO: 25619

SEQ ID NO: 397210 - RNA, 64 nt, Homo Sapiens; identical to SEQ ID NO: 25620

SEQ ID NO: 397211 - RNA, 64 nt, Homo Sapiens; identical to SEQ ID NO: 25621

SEQ ID NO: 397212 - RNA, 64 nt, Homo Sapiens; identical to SEQ ID NO: 25622

SEQ ID NO: 397213 - RNA, 64 nt, Homo Sapiens; identical to SEQ ID NO: 25623

SEQ ID NO: 397214 - RNA, 64 nt, Homo Sapiens; identical to SEQ ID NO: 25624

SEQ ID NO: 397215 - RNA, 64 nt, Homo Sapiens; identical to SEQ ID NO: 25625

SEQ ID NO: 397216 - RNA, 64 nt, Homo Sapiens; identical to SEQ ID NO: 25626

SEQ ID NO: 397217 - RNA, 64 nt, Homo Sapiens; identical to SEQ ID NO: 25627

SEQ ID NO: 397218 - RNA, 64 nt, Homo Sapiens; identical to SEQ ID NO: 25628

SEQ ID NO: 397219 - RNA, 64 nt, Homo Sapiens; identical to SEQ ID NO: 25629

SEQ ID NO: 397220 - RNA, 64 nt, Homo Sapiens; identical to SEQ ID NO: 25630

SEQ ID NO: 397221 - RNA, 64 nt, Homo Sapiens; identical to SEQ ID NO: 25631

SEQ ID NO: 397222 - RNA, 64 nt, Homo Sapiens; identical to SEQ ID NO: 25632

SEQ ID NO: 397223 - RNA, 64 nt, Homo Sapiens; identical to SEQ ID NO: 25633

SEQ ID NO: 397224 - RNA, 64 nt, Homo Sapiens; identical to SEQ ID NO: 25634

SEQ ID NO: 397225 - RNA, 64 nt, Homo Sapiens; identical to SEQ ID NO: 25635

SEQ ID NO: 397226 - RNA, 64 nt, Homo Sapiens; identical to SEQ ID NO: 25636

SEQ ID NO: 397227 - RNA, 64 nt, Homo Sapiens; identical to SEQ ID NO: 25637

SEQ ID NO: 397228 - RNA, 64 nt, Homo Sapiens; identical to SEQ ID NO: 25638

SEQ ID NO: 397229 - RNA, 64 nt, Homo Sapiens; identical to SEQ ID NO: 25639

SEQ ID NO: 397230 - RNA, 64 nt, Homo Sapiens; identical to SEQ ID NO: 25640

SEQ ID NO: 397231 - RNA, 64 nt, Homo Sapiens; identical to SEQ ID NO: 25641

SEQ ID NO: 397232 - RNA, 64 nt, Homo Sapiens; identical to SEQ ID NO: 25642

SEQ ID NO: 397233 - RNA, 64 nt, Homo Sapiens; identical to SEQ ID NO: 25643

SEQ ID NO: 397234 - RNA, 64 nt, Homo Sapiens; identical to SEQ ID NO: 25644

SEQ ID NO: 397235 - RNA, 64 nt, Homo Sapiens; identical to SEQ ID NO: 25645

SEQ ID NO: 397236 - RNA, 64 nt, Homo Sapiens; identical to SEQ ID NO: 25646

SEQ ID NO: 397237 - RNA, 64 nt, Homo Sapiens; identical to SEQ ID NO: 25647

SEQ ID NO: 397238 - RNA, 64 nt, Homo Sapiens; identical to SEQ ID NO: 25648

SEQ ID NO: 397239 - RNA, 64 nt, Homo Sapiens; identical to SEQ ID NO: 25649

SEQ ID NO: 397240 - RNA, 64 nt, Homo Sapiens; identical to SEQ ID NO: 25650

SEQ ID NO: 397241 - RNA, 64 nt, Homo Sapiens; identical to SEQ ID NO: 25651

SEQ ID NO: 397242 - RNA, 64 nt, Homo Sapiens; identical to SEQ ID NO: 25652

SEQ ID NO: 397243 - RNA, 64 nt, Homo Sapiens; identical to SEQ ID NO: 25653

SEQ ID NO: 397244 - RNA, 64 nt, Homo Sapiens; identical to SEQ ID NO: 25654

SEQ ID NO: 397245 - RNA, 64 nt, Homo Sapiens; identical to SEQ ID NO: 25655

SEQ ID NO: 397246 - RNA, 64 nt, Homo Sapiens; identical to SEQ ID NO: 25656

SEQ ID NO: 397247 - RNA, 64 nt, Homo Sapiens; identical to SEQ ID NO: 25657

SEQ ID NO: 397248 - RNA, 64 nt, Homo Sapiens; identical to SEQ ID NO: 25658

SEQ ID NO: 397249 - RNA, 64 nt, Homo Sapiens; identical to SEQ ID NO: 25659

SEQ ID NO: 397250 - RNA, 64 nt, Homo Sapiens; identical to SEQ ID NO: 25660

SEQ ID NO: 397251 - RNA, 64 nt, Homo Sapiens; identical to SEQ ID NO: 25661

SEQ ID NO: 397252 - RNA, 64 nt, Homo Sapiens; identical to SEQ ID NO: 25662

SEQ ID NO: 397253 - RNA, 64 nt, Homo Sapiens; identical to SEQ ID NO: 25663

SEQ ID NO: 397254 - RNA, 64 nt, Homo Sapiens; identical to SEQ ID NO: 25664

SEQ ID NO: 397255 - RNA, 64 nt, Homo Sapiens; identical to SEQ ID NO: 25665

SEQ ID NO: 397256 - RNA, 64 nt, Homo Sapiens; identical to SEQ ID NO: 25666

SEQ ID NO: 397257 - RNA, 64 nt, Homo Sapiens; identical to SEQ ID NO: 25667

SEQ ID NO: 397258 - RNA, 64 nt, Homo Sapiens; identical to SEQ ID NO: 25668

SEQ ID NO: 397259 - RNA, 64 nt, Homo Sapiens; identical to SEQ ID NO: 25669

SEQ ID NO: 397260 - RNA, 64 nt, Homo Sapiens; identical to SEQ ID NO: 25670

SEQ ID NO: 397261 - RNA, 64 nt, Homo Sapiens; identical to SEQ ID NO: 25671

SEQ ID NO: 397262 - RNA, 64 nt, Homo Sapiens; identical to SEQ ID NO: 25672

SEQ ID NO: 397263 - RNA, 64 nt, Homo Sapiens; identical to SEQ ID NO: 25673

SEQ ID NO: 397264 - RNA, 64 nt, Homo Sapiens; identical to SEQ ID NO: 25674

SEQ ID NO: 397265 - RNA, 64 nt, Homo Sapiens; identical to SEQ ID NO: 25675

SEQ ID NO: 397266 - RNA, 64 nt, Homo Sapiens; identical to SEQ ID NO: 25676

SEQ ID NO: 397267 - RNA, 64 nt, Homo Sapiens; identical to SEQ ID NO: 25677

SEQ ID NO: 397268 - RNA, 64 nt, Homo Sapiens; identical to SEQ ID NO: 25678

SEQ ID NO: 397269 - RNA, 64 nt, Homo Sapiens; identical to SEQ ID NO: 25679

SEQ ID NO: 397270 - RNA, 64 nt, Homo Sapiens; identical to SEQ ID NO: 25680

SEQ ID NO: 397271 - RNA, 64 nt, Homo Sapiens; identical to SEQ ID NO: 25681

SEQ ID NO: 397272 - RNA, 64 nt, Homo Sapiens; identical to SEQ ID NO: 25682

SEQ ID NO: 397273 - RNA, 64 nt, Homo Sapiens; identical to SEQ ID NO: 25683

SEQ ID NO: 397274 - RNA, 64 nt, Homo Sapiens; identical to SEQ ID NO: 25684

SEQ ID NO: 397275 - RNA, 64 nt, Homo Sapiens; identical to SEQ ID NO: 25685

SEQ ID NO: 397276 - RNA, 64 nt, Homo Sapiens; identical to SEQ ID NO: 25686

SEQ ID NO: 397277 - RNA, 64 nt, Homo Sapiens; identical to SEQ ID NO: 25687

SEQ ID NO: 397278 - RNA, 64 nt, Homo Sapiens; identical to SEQ ID NO: 25688

SEQ ID NO: 397279 - RNA, 64 nt, Homo Sapiens; identical to SEQ ID NO: 25689

SEQ ID NO: 397280 - RNA, 64 nt, Homo Sapiens; identical to SEQ ID NO: 25690

SEQ ID NO: 397281 - RNA, 64 nt, Homo Sapiens; identical to SEQ ID NO: 25691

SEQ ID NO: 397282 - RNA, 64 nt, Homo Sapiens; identical to SEQ ID NO: 25692

SEQ ID NO: 397283 - RNA, 64 nt, Homo Sapiens; identical to SEQ ID NO: 25693

SEQ ID NO: 397284 - RNA, 64 nt, Homo Sapiens; identical to SEQ ID NO: 25694

SEQ ID NO: 397285 - RNA, 64 nt, Homo Sapiens; identical to SEQ ID NO: 25695

SEQ ID NO: 397286 - RNA, 64 nt, Homo Sapiens; identical to SEQ ID NO: 25696

SEQ ID NO: 397287 - RNA, 64 nt, Homo Sapiens; identical to SEQ ID NO: 25697

SEQ ID NO: 397288 - RNA, 64 nt, Homo Sapiens; identical to SEQ ID NO: 25698

SEQ ID NO: 397289 - RNA, 64 nt, Homo Sapiens; identical to SEQ ID NO: 25699

SEQ ID NO: 397290 - RNA, 64 nt, Homo Sapiens; identical to SEQ ID NO: 25700

SEQ ID NO: 397291 - RNA, 64 nt, Homo Sapiens; identical to SEQ ID NO: 25701

SEQ ID NO: 397292 - RNA, 64 nt, Homo Sapiens; identical to SEQ ID NO: 25702

SEQ ID NO: 397293 - RNA, 64 nt, Homo Sapiens; identical to SEQ ID NO: 25703

SEQ ID NO: 397294 - RNA, 64 nt, Homo Sapiens; identical to SEQ ID NO: 25704

SEQ ID NO: 397295 - RNA, 64 nt, Homo Sapiens; identical to SEQ ID NO: 25705

SEQ ID NO: 397296 - RNA, 64 nt, Homo Sapiens; identical to SEQ ID NO: 25706

SEQ ID NO: 397297 - RNA, 64 nt, Homo Sapiens; identical to SEQ ID NO: 25707

SEQ ID NO: 397298 - RNA, 64 nt, Homo Sapiens; identical to SEQ ID NO: 25708

SEQ ID NO: 397299 - RNA, 64 nt, Homo Sapiens; identical to SEQ ID NO: 25709

SEQ ID NO: 397300 - RNA, 64 nt, Homo Sapiens; identical to SEQ ID NO: 25710

SEQ ID NO: 397301 - RNA, 64 nt, Homo Sapiens; identical to SEQ ID NO: 25711

SEQ ID NO: 397302 - RNA, 64 nt, Homo Sapiens; identical to SEQ ID NO: 25712

SEQ ID NO: 397303 - RNA, 64 nt, Homo Sapiens; identical to SEQ ID NO: 25713

SEQ ID NO: 397304 - RNA, 64 nt, Homo Sapiens; identical to SEQ ID NO: 25714

SEQ ID NO: 397305 - RNA, 64 nt, Homo Sapiens; identical to SEQ ID NO: 25715

SEQ ID NO: 397306 - RNA, 64 nt, Homo Sapiens; identical to SEQ ID NO: 25716

SEQ ID NO: 397307 - RNA, 64 nt, Homo Sapiens; identical to SEQ ID NO: 25717

SEQ ID NO: 397308 - RNA, 64 nt, Homo Sapiens; identical to SEQ ID NO: 25718

SEQ ID NO: 397309 - RNA, 64 nt, Homo Sapiens; identical to SEQ ID NO: 25719

SEQ ID NO: 397310 - RNA, 64 nt, Homo Sapiens; identical to SEQ ID NO: 25720

SEQ ID NO: 397311 - RNA, 64 nt, Homo Sapiens; identical to SEQ ID NO: 25721

SEQ ID NO: 397312 - RNA, 64 nt, Homo Sapiens; identical to SEQ ID NO: 25722

SEQ ID NO: 397313 - RNA, 64 nt, Homo Sapiens; identical to SEQ ID NO: 25723

SEQ ID NO: 397314 - RNA, 64 nt, Homo Sapiens; identical to SEQ ID NO: 25724

SEQ ID NO: 397315 - RNA, 64 nt, Homo Sapiens; identical to SEQ ID NO: 25725

SEQ ID NO: 397316 - RNA, 64 nt, Homo Sapiens; identical to SEQ ID NO: 25726

SEQ ID NO: 397317 - RNA, 64 nt, Homo Sapiens; identical to SEQ ID NO: 25727

SEQ ID NO: 397318 - RNA, 64 nt, Homo Sapiens; identical to SEQ ID NO: 25728

SEQ ID NO: 397319 - RNA, 64 nt, Homo Sapiens; identical to SEQ ID NO: 25729

SEQ ID NO: 397320 - RNA, 64 nt, Homo Sapiens; identical to SEQ ID NO: 25730

SEQ ID NO: 397321 - RNA, 64 nt, Homo Sapiens; identical to SEQ ID NO: 25731

SEQ ID NO: 397322 - RNA, 64 nt, Homo Sapiens; identical to SEQ ID NO: 25732

SEQ ID NO: 397323 - RNA, 64 nt, Homo Sapiens; identical to SEQ ID NO: 25733

SEQ ID NO: 397324 - RNA, 64 nt, Homo Sapiens; identical to SEQ ID NO: 25734

SEQ ID NO: 397325 - RNA, 64 nt, Homo Sapiens; identical to SEQ ID NO: 25735

SEQ ID NO: 397326 - RNA, 64 nt, Homo Sapiens; identical to SEQ ID NO: 25736

SEQ ID NO: 397327 - RNA, 64 nt, Homo Sapiens; identical to SEQ ID NO: 25737

SEQ ID NO: 397328 - RNA, 64 nt, Homo Sapiens; identical to SEQ ID NO: 25738

SEQ ID NO: 397329 - RNA, 64 nt, Homo Sapiens; identical to SEQ ID NO: 25739

SEQ ID NO: 397330 - RNA, 64 nt, Homo Sapiens; identical to SEQ ID NO: 25740

SEQ ID NO: 397331 - RNA, 64 nt, Homo Sapiens; identical to SEQ ID NO: 25741

SEQ ID NO: 397332 - RNA, 64 nt, Homo Sapiens; identical to SEQ ID NO: 25742

SEQ ID NO: 397333 - RNA, 64 nt, Homo Sapiens; identical to SEQ ID NO: 25743

SEQ ID NO: 397334 - RNA, 64 nt, Homo Sapiens; identical to SEQ ID NO: 25744

SEQ ID NO: 397335 - RNA, 64 nt, Homo Sapiens; identical to SEQ ID NO: 25745

SEQ ID NO: 397336 - RNA, 64 nt, Homo Sapiens; identical to SEQ ID NO: 25746

SEQ ID NO: 397337 - RNA, 64 nt, Homo Sapiens; identical to SEQ ID NO: 25747

SEQ ID NO: 397338 - RNA, 64 nt, Homo Sapiens; identical to SEQ ID NO: 25748

SEQ ID NO: 397339 - RNA, 64 nt, Homo Sapiens; identical to SEQ ID NO: 25749

SEQ ID NO: 397340 - RNA, 64 nt, Homo Sapiens; identical to SEQ ID NO: 25750

SEQ ID NO: 397341 - RNA, 64 nt, Homo Sapiens; identical to SEQ ID NO: 25751

SEQ ID NO: 397342 - RNA, 64 nt, Homo Sapiens; identical to SEQ ID NO: 25752

SEQ ID NO: 397343 - RNA, 64 nt, Homo Sapiens; identical to SEQ ID NO: 25753

SEQ ID NO: 397344 - RNA, 64 nt, Homo Sapiens; identical to SEQ ID NO: 25754

SEQ ID NO: 397345 - RNA, 64 nt, Homo Sapiens; identical to SEQ ID NO: 25755

SEQ ID NO: 397346 - RNA, 64 nt, Homo Sapiens; identical to SEQ ID NO: 25756

SEQ ID NO: 397347 - RNA, 64 nt, Homo Sapiens; identical to SEQ ID NO: 25757

SEQ ID NO: 397348 - RNA, 64 nt, Homo Sapiens; identical to SEQ ID NO: 25758

SEQ ID NO: 397349 - RNA, 64 nt, Homo Sapiens; identical to SEQ ID NO: 25759

SEQ ID NO: 397350 - RNA, 64 nt, Homo Sapiens; identical to SEQ ID NO: 25760

SEQ ID NO: 397351 - RNA, 64 nt, Homo Sapiens; identical to SEQ ID NO: 25761

SEQ ID NO: 397352 - RNA, 64 nt, Homo Sapiens; identical to SEQ ID NO: 25762

SEQ ID NO: 397353 - RNA, 64 nt, Homo Sapiens; identical to SEQ ID NO: 25763

SEQ ID NO: 397354 - RNA, 64 nt, Homo Sapiens; identical to SEQ ID NO: 25764

SEQ ID NO: 397355 - RNA, 64 nt, Homo Sapiens; identical to SEQ ID NO: 25765

SEQ ID NO: 397356 - RNA, 64 nt, Homo Sapiens; identical to SEQ ID NO: 25766

SEQ ID NO: 397357 - RNA, 64 nt, Homo Sapiens; identical to SEQ ID NO: 25767

SEQ ID NO: 397358 - RNA, 64 nt, Homo Sapiens; identical to SEQ ID NO: 25768

SEQ ID NO: 397359 - RNA, 64 nt, Homo Sapiens; identical to SEQ ID NO: 25769

SEQ ID NO: 397360 - RNA, 64 nt, Homo Sapiens; identical to SEQ ID NO: 25770

SEQ ID NO: 397361 - RNA, 64 nt, Homo Sapiens; identical to SEQ ID NO: 25771

SEQ ID NO: 397362 - RNA, 64 nt, Homo Sapiens; identical to SEQ ID NO: 25772

SEQ ID NO: 397363 - RNA, 64 nt, Homo Sapiens; identical to SEQ ID NO: 25773

SEQ ID NO: 397364 - RNA, 64 nt, Homo Sapiens; identical to SEQ ID NO: 25774

SEQ ID NO: 397365 - RNA, 64 nt, Homo Sapiens; identical to SEQ ID NO: 25775

SEQ ID NO: 397366 - RNA, 64 nt, Homo Sapiens; identical to SEQ ID NO: 25776

SEQ ID NO: 397367 - RNA, 64 nt, Homo Sapiens; identical to SEQ ID NO: 25777

SEQ ID NO: 397368 - RNA, 64 nt, Homo Sapiens; identical to SEQ ID NO: 25778

SEQ ID NO: 397369 - RNA, 64 nt, Homo Sapiens; identical to SEQ ID NO: 25779

SEQ ID NO: 397370 - RNA, 64 nt, Homo Sapiens; identical to SEQ ID NO: 25780

SEQ ID NO: 397371 - RNA, 64 nt, Homo Sapiens; identical to SEQ ID NO: 25781

SEQ ID NO: 397372 - RNA, 64 nt, Homo Sapiens; identical to SEQ ID NO: 25782

SEQ ID NO: 397373 - RNA, 64 nt, Homo Sapiens; identical to SEQ ID NO: 25783

SEQ ID NO: 397374 - RNA, 64 nt, Homo Sapiens; identical to SEQ ID NO: 25784

SEQ ID NO: 397375 - RNA, 64 nt, Homo Sapiens; identical to SEQ ID NO: 25785

SEQ ID NO: 397376 - RNA, 64 nt, Homo Sapiens; identical to SEQ ID NO: 25786

SEQ ID NO: 397377 - RNA, 64 nt, Homo Sapiens; identical to SEQ ID NO: 25787

SEQ ID NO: 397378 - RNA, 64 nt, Homo Sapiens; identical to SEQ ID NO: 25788

SEQ ID NO: 397379 - RNA, 64 nt, Homo Sapiens; identical to SEQ ID NO: 25789

SEQ ID NO: 397380 - RNA, 64 nt, Homo Sapiens; identical to SEQ ID NO: 25790

SEQ ID NO: 397381 - RNA, 64 nt, Homo Sapiens; identical to SEQ ID NO: 25791

SEQ ID NO: 397382 - RNA, 64 nt, Homo Sapiens; identical to SEQ ID NO: 25792

SEQ ID NO: 397383 - RNA, 64 nt, Homo Sapiens; identical to SEQ ID NO: 25793

SEQ ID NO: 397384 - RNA, 64 nt, Homo Sapiens; identical to SEQ ID NO: 25794

SEQ ID NO: 397385 - RNA, 64 nt, Homo Sapiens; identical to SEQ ID NO: 25795

SEQ ID NO: 397386 - RNA, 64 nt, Homo Sapiens; identical to SEQ ID NO: 25796

SEQ ID NO: 397387 - RNA, 64 nt, Homo Sapiens; identical to SEQ ID NO: 25797

SEQ ID NO: 397388 - RNA, 64 nt, Homo Sapiens; identical to SEQ ID NO: 25798

SEQ ID NO: 397389 - RNA, 64 nt, Homo Sapiens; identical to SEQ ID NO: 25799

SEQ ID NO: 397390 - RNA, 64 nt, Homo Sapiens; identical to SEQ ID NO: 25800

SEQ ID NO: 397391 - RNA, 64 nt, Homo Sapiens; identical to SEQ ID NO: 25801

SEQ ID NO: 397392 - RNA, 64 nt, Homo Sapiens; identical to SEQ ID NO: 25802

SEQ ID NO: 397393 - RNA, 64 nt, Homo Sapiens; identical to SEQ ID NO: 25803

SEQ ID NO: 397394 - RNA, 64 nt, Homo Sapiens; identical to SEQ ID NO: 25804

SEQ ID NO: 397395 - RNA, 64 nt, Homo Sapiens; identical to SEQ ID NO: 25805

SEQ ID NO: 397396 - RNA, 64 nt, Homo Sapiens; identical to SEQ ID NO: 25806

SEQ ID NO: 397397 - RNA, 64 nt, Homo Sapiens; identical to SEQ ID NO: 25807

SEQ ID NO: 397398 - RNA, 64 nt, Homo Sapiens; identical to SEQ ID NO: 25808

SEQ ID NO: 397399 - RNA, 64 nt, Homo Sapiens; identical to SEQ ID NO: 25809

SEQ ID NO: 397400 - RNA, 64 nt, Homo Sapiens; identical to SEQ ID NO: 25810

SEQ ID NO: 397401 - RNA, 64 nt, Homo Sapiens; identical to SEQ ID NO: 25811

SEQ ID NO: 397402 - RNA, 64 nt, Homo Sapiens; identical to SEQ ID NO: 25812

SEQ ID NO: 397403 - RNA, 64 nt, Homo Sapiens; identical to SEQ ID NO: 25813

SEQ ID NO: 397404 - RNA, 64 nt, Homo Sapiens; identical to SEQ ID NO: 25814

SEQ ID NO: 397405 - RNA, 64 nt, Homo Sapiens; identical to SEQ ID NO: 25815

SEQ ID NO: 397406 - RNA, 64 nt, Homo Sapiens; identical to SEQ ID NO: 25816

SEQ ID NO: 397407 - RNA, 64 nt, Homo Sapiens; identical to SEQ ID NO: 25817

SEQ ID NO: 397408 - RNA, 64 nt, Homo Sapiens; identical to SEQ ID NO: 25818

SEQ ID NO: 397409 - RNA, 64 nt, Homo Sapiens; identical to SEQ ID NO: 25819

SEQ ID NO: 397410 - RNA, 64 nt, Homo Sapiens; identical to SEQ ID NO: 25820

SEQ ID NO: 397411 - RNA, 64 nt, Homo Sapiens; identical to SEQ ID NO: 25821

SEQ ID NO: 397412 - RNA, 62 nt, Homo Sapiens; identical to SEQ ID NO: 25822

SEQ ID NO: 397413 - RNA, 64 nt, Homo Sapiens; identical to SEQ ID NO: 25823

SEQ ID NO: 397414 - RNA, 64 nt, Homo Sapiens; identical to SEQ ID NO: 25824

SEQ ID NO: 397415 - RNA, 64 nt, Homo Sapiens; identical to SEQ ID NO: 25825

SEQ ID NO: 397416 - RNA, 64 nt, Homo Sapiens; identical to SEQ ID NO: 25826

SEQ ID NO: 397417 - RNA, 64 nt, Homo Sapiens; identical to SEQ ID NO: 25827

SEQ ID NO: 397418 - RNA, 64 nt, Homo Sapiens; identical to SEQ ID NO: 25828

SEQ ID NO: 397419 - RNA, 64 nt, Homo Sapiens; identical to SEQ ID NO: 25829

SEQ ID NO: 397420 - RNA, 64 nt, Homo Sapiens; identical to SEQ ID NO: 25830

SEQ ID NO: 397421 - RNA, 64 nt, Homo Sapiens; identical to SEQ ID NO: 25831

SEQ ID NO: 397422 - RNA, 64 nt, Homo Sapiens; identical to SEQ ID NO: 25832

SEQ ID NO: 397423 - RNA, 64 nt, Homo Sapiens; identical to SEQ ID NO: 25833

SEQ ID NO: 397424 - RNA, 64 nt, Homo Sapiens; identical to SEQ ID NO: 25834

SEQ ID NO: 397425 - RNA, 64 nt, Homo Sapiens; identical to SEQ ID NO: 25835

SEQ ID NO: 397426 - RNA, 64 nt, Homo Sapiens; identical to SEQ ID NO: 25836

SEQ ID NO: 397427 - RNA, 64 nt, Homo Sapiens; identical to SEQ ID NO: 25837

SEQ ID NO: 397428 - RNA, 64 nt, Homo Sapiens; identical to SEQ ID NO: 25838

SEQ ID NO: 397429 - RNA, 64 nt, Homo Sapiens; identical to SEQ ID NO: 25839

SEQ ID NO: 397430 - RNA, 64 nt, Homo Sapiens; identical to SEQ ID NO: 25840

SEQ ID NO: 397431 - RNA, 64 nt, Homo Sapiens; identical to SEQ ID NO: 25841

SEQ ID NO: 397432 - RNA, 64 nt, Homo Sapiens; identical to SEQ ID NO: 25842

SEQ ID NO: 397433 - RNA, 64 nt, Homo Sapiens; identical to SEQ ID NO: 25843

SEQ ID NO: 397434 - RNA, 64 nt, Homo Sapiens; identical to SEQ ID NO: 25844

SEQ ID NO: 397435 - RNA, 64 nt, Homo Sapiens; identical to SEQ ID NO: 25845

SEQ ID NO: 397436 - RNA, 64 nt, Homo Sapiens; identical to SEQ ID NO: 25846

SEQ ID NO: 397437 - RNA, 64 nt, Homo Sapiens; identical to SEQ ID NO: 25847

SEQ ID NO: 397438 - RNA, 64 nt, Homo Sapiens; identical to SEQ ID NO: 25848

SEQ ID NO: 397439 - RNA, 64 nt, Homo Sapiens; identical to SEQ ID NO: 25849

SEQ ID NO: 397440 - RNA, 64 nt, Homo Sapiens; identical to SEQ ID NO: 25850

SEQ ID NO: 397441 - RNA, 64 nt, Homo Sapiens; identical to SEQ ID NO: 25851

SEQ ID NO: 397442 - RNA, 64 nt, Homo Sapiens; identical to SEQ ID NO: 25852

SEQ ID NO: 397443 - RNA, 64 nt, Homo Sapiens; identical to SEQ ID NO: 25853

SEQ ID NO: 397444 - RNA, 64 nt, Homo Sapiens; identical to SEQ ID NO: 25854

SEQ ID NO: 397445 - RNA, 64 nt, Homo Sapiens; identical to SEQ ID NO: 25855

SEQ ID NO: 397446 - RNA, 64 nt, Homo Sapiens; identical to SEQ ID NO: 25856

SEQ ID NO: 397447 - RNA, 64 nt, Homo Sapiens; identical to SEQ ID NO: 25857

SEQ ID NO: 397448 - RNA, 64 nt, Homo Sapiens; identical to SEQ ID NO: 25858

SEQ ID NO: 397449 - RNA, 64 nt, Homo Sapiens; identical to SEQ ID NO: 25859

SEQ ID NO: 397450 - RNA, 64 nt, Homo Sapiens; identical to SEQ ID NO: 25860

SEQ ID NO: 397451 - RNA, 64 nt, Homo Sapiens; identical to SEQ ID NO: 25861

SEQ ID NO: 397452 - RNA, 64 nt, Homo Sapiens; identical to SEQ ID NO: 25862

SEQ ID NO: 397453 - RNA, 64 nt, Homo Sapiens; identical to SEQ ID NO: 25863

SEQ ID NO: 397454 - RNA, 64 nt, Homo Sapiens; identical to SEQ ID NO: 25864

SEQ ID NO: 397455 - RNA, 64 nt, Homo Sapiens; identical to SEQ ID NO: 25865

SEQ ID NO: 397456 - RNA, 64 nt, Homo Sapiens; identical to SEQ ID NO: 25866

SEQ ID NO: 397457 - RNA, 64 nt, Homo Sapiens; identical to SEQ ID NO: 25867

SEQ ID NO: 397458 - RNA, 64 nt, Homo Sapiens; identical to SEQ ID NO: 25868

SEQ ID NO: 397459 - RNA, 64 nt, Homo Sapiens; identical to SEQ ID NO: 25869

SEQ ID NO: 397460 - RNA, 64 nt, Homo Sapiens; identical to SEQ ID NO: 25870

SEQ ID NO: 397461 - RNA, 64 nt, Homo Sapiens; identical to SEQ ID NO: 25871

SEQ ID NO: 397462 - RNA, 64 nt, Homo Sapiens; identical to SEQ ID NO: 25872

SEQ ID NO: 397463 - RNA, 64 nt, Homo Sapiens; identical to SEQ ID NO: 25873

SEQ ID NO: 397464 - RNA, 64 nt, Homo Sapiens; identical to SEQ ID NO: 25874

SEQ ID NO: 397465 - RNA, 64 nt, Homo Sapiens; identical to SEQ ID NO: 25875

SEQ ID NO: 397466 - RNA, 64 nt, Homo Sapiens; identical to SEQ ID NO: 25876

SEQ ID NO: 397467 - RNA, 64 nt, Homo Sapiens; identical to SEQ ID NO: 25877

SEQ ID NO: 397468 - RNA, 64 nt, Homo Sapiens; identical to SEQ ID NO: 25878

SEQ ID NO: 397469 - RNA, 64 nt, Homo Sapiens; identical to SEQ ID NO: 25879

SEQ ID NO: 397470 - RNA, 64 nt, Homo Sapiens; identical to SEQ ID NO: 25880

SEQ ID NO: 397471 - RNA, 64 nt, Homo Sapiens; identical to SEQ ID NO: 25881

SEQ ID NO: 397472 - RNA, 64 nt, Homo Sapiens; identical to SEQ ID NO: 25882

SEQ ID NO: 397473 - RNA, 64 nt, Homo Sapiens; identical to SEQ ID NO: 25883

SEQ ID NO: 397474 - RNA, 64 nt, Homo Sapiens; identical to SEQ ID NO: 25884

SEQ ID NO: 397475 - RNA, 64 nt, Homo Sapiens; identical to SEQ ID NO: 25885

SEQ ID NO: 397476 - RNA, 64 nt, Homo Sapiens; identical to SEQ ID NO: 25886

SEQ ID NO: 397477 - RNA, 64 nt, Homo Sapiens; identical to SEQ ID NO: 25887

SEQ ID NO: 397478 - RNA, 64 nt, Homo Sapiens; identical to SEQ ID NO: 25888

SEQ ID NO: 397479 - RNA, 64 nt, Homo Sapiens; identical to SEQ ID NO: 25889

SEQ ID NO: 397480 - RNA, 64 nt, Homo Sapiens; identical to SEQ ID NO: 25890

SEQ ID NO: 397481 - RNA, 64 nt, Homo Sapiens; identical to SEQ ID NO: 25891

SEQ ID NO: 397482 - RNA, 64 nt, Homo Sapiens; identical to SEQ ID NO: 25892

SEQ ID NO: 397483 - RNA, 64 nt, Homo Sapiens; identical to SEQ ID NO: 25893

SEQ ID NO: 397484 - RNA, 64 nt, Homo Sapiens; identical to SEQ ID NO: 25894

SEQ ID NO: 397485 - RNA, 64 nt, Homo Sapiens; identical to SEQ ID NO: 25895

SEQ ID NO: 397486 - RNA, 64 nt, Homo Sapiens; identical to SEQ ID NO: 25896

SEQ ID NO: 397487 - RNA, 64 nt, Homo Sapiens; identical to SEQ ID NO: 25897

SEQ ID NO: 397488 - RNA, 64 nt, Homo Sapiens; identical to SEQ ID NO: 25898

SEQ ID NO: 397489 - RNA, 64 nt, Homo Sapiens; identical to SEQ ID NO: 25899

SEQ ID NO: 397490 - RNA, 64 nt, Homo Sapiens; identical to SEQ ID NO: 25900

SEQ ID NO: 397491 - RNA, 64 nt, Homo Sapiens; identical to SEQ ID NO: 25901

SEQ ID NO: 397492 - RNA, 64 nt, Homo Sapiens; identical to SEQ ID NO: 25902

SEQ ID NO: 397493 - RNA, 64 nt, Homo Sapiens; identical to SEQ ID NO: 25903

SEQ ID NO: 397494 - RNA, 64 nt, Homo Sapiens; identical to SEQ ID NO: 25904

SEQ ID NO: 397495 - RNA, 64 nt, Homo Sapiens; identical to SEQ ID NO: 25905

SEQ ID NO: 397496 - RNA, 64 nt, Homo Sapiens; identical to SEQ ID NO: 25906

SEQ ID NO: 397497 - RNA, 64 nt, Homo Sapiens; identical to SEQ ID NO: 25907

SEQ ID NO: 397498 - RNA, 64 nt, Homo Sapiens; identical to SEQ ID NO: 25908

SEQ ID NO: 397499 - RNA, 64 nt, Homo Sapiens; identical to SEQ ID NO: 25909

SEQ ID NO: 397500 - RNA, 64 nt, Homo Sapiens; identical to SEQ ID NO: 25910

SEQ ID NO: 397501 - RNA, 64 nt, Homo Sapiens; identical to SEQ ID NO: 25911

SEQ ID NO: 397502 - RNA, 64 nt, Homo Sapiens; identical to SEQ ID NO: 25912

SEQ ID NO: 397503 - RNA, 64 nt, Homo Sapiens; identical to SEQ ID NO: 25913

SEQ ID NO: 397504 - RNA, 64 nt, Homo Sapiens; identical to SEQ ID NO: 25914

SEQ ID NO: 397505 - RNA, 64 nt, Homo Sapiens; identical to SEQ ID NO: 25915

SEQ ID NO: 397506 - RNA, 64 nt, Homo Sapiens; identical to SEQ ID NO: 25916

SEQ ID NO: 397507 - RNA, 64 nt, Homo Sapiens; identical to SEQ ID NO: 25917

SEQ ID NO: 397508 - RNA, 64 nt, Homo Sapiens; identical to SEQ ID NO: 25918

SEQ ID NO: 397509 - RNA, 64 nt, Homo Sapiens; identical to SEQ ID NO: 25919

SEQ ID NO: 397510 - RNA, 64 nt, Homo Sapiens; identical to SEQ ID NO: 25920

SEQ ID NO: 397511 - RNA, 64 nt, Homo Sapiens; identical to SEQ ID NO: 25921

SEQ ID NO: 397512 - RNA, 64 nt, Homo Sapiens; identical to SEQ ID NO: 25922

SEQ ID NO: 397513 - RNA, 64 nt, Homo Sapiens; identical to SEQ ID NO: 25923

SEQ ID NO: 397514 - RNA, 64 nt, Homo Sapiens; identical to SEQ ID NO: 25924

SEQ ID NO: 397515 - RNA, 64 nt, Homo Sapiens; identical to SEQ ID NO: 25925

SEQ ID NO: 397516 - RNA, 64 nt, Homo Sapiens; identical to SEQ ID NO: 25926

SEQ ID NO: 397517 - RNA, 64 nt, Homo Sapiens; identical to SEQ ID NO: 25927

SEQ ID NO: 397518 - RNA, 64 nt, Homo Sapiens; identical to SEQ ID NO: 25928

SEQ ID NO: 397519 - RNA, 64 nt, Homo Sapiens; identical to SEQ ID NO: 25929

SEQ ID NO: 397520 - RNA, 64 nt, Homo Sapiens; identical to SEQ ID NO: 25930

SEQ ID NO: 397521 - RNA, 64 nt, Homo Sapiens; identical to SEQ ID NO: 25931

SEQ ID NO: 397522 - RNA, 64 nt, Homo Sapiens; identical to SEQ ID NO: 25932

SEQ ID NO: 397523 - RNA, 64 nt, Homo Sapiens; identical to SEQ ID NO: 25933

SEQ ID NO: 397524 - RNA, 64 nt, Homo Sapiens; identical to SEQ ID NO: 25934

SEQ ID NO: 397525 - RNA, 64 nt, Homo Sapiens; identical to SEQ ID NO: 25935

SEQ ID NO: 397526 - RNA, 64 nt, Homo Sapiens; identical to SEQ ID NO: 25936

SEQ ID NO: 397527 - RNA, 64 nt, Homo Sapiens; identical to SEQ ID NO: 25937

SEQ ID NO: 397528 - RNA, 64 nt, Homo Sapiens; identical to SEQ ID NO: 25938

SEQ ID NO: 397529 - RNA, 64 nt, Homo Sapiens; identical to SEQ ID NO: 25939

SEQ ID NO: 397530 - RNA, 64 nt, Homo Sapiens; identical to SEQ ID NO: 25940

SEQ ID NO: 397531 - RNA, 64 nt, Homo Sapiens; identical to SEQ ID NO: 25941

SEQ ID NO: 397532 - RNA, 64 nt, Homo Sapiens; identical to SEQ ID NO: 25942

SEQ ID NO: 397533 - RNA, 64 nt, Homo Sapiens; identical to SEQ ID NO: 25943

SEQ ID NO: 397534 - RNA, 64 nt, Homo Sapiens; identical to SEQ ID NO: 25944

SEQ ID NO: 397535 - RNA, 64 nt, Homo Sapiens; identical to SEQ ID NO: 25945

SEQ ID NO: 397536 - RNA, 64 nt, Homo Sapiens; identical to SEQ ID NO: 25946

SEQ ID NO: 397537 - RNA, 64 nt, Homo Sapiens; identical to SEQ ID NO: 25947

SEQ ID NO: 397538 - RNA, 64 nt, Homo Sapiens; identical to SEQ ID NO: 25948

SEQ ID NO: 397539 - RNA, 64 nt, Homo Sapiens; identical to SEQ ID NO: 25949

SEQ ID NO: 397540 - RNA, 64 nt, Homo Sapiens; identical to SEQ ID NO: 25950

SEQ ID NO: 397541 - RNA, 64 nt, Homo Sapiens; identical to SEQ ID NO: 25951

SEQ ID NO: 397542 - RNA, 64 nt, Homo Sapiens; identical to SEQ ID NO: 25952

SEQ ID NO: 397543 - RNA, 64 nt, Homo Sapiens; identical to SEQ ID NO: 25953

SEQ ID NO: 397544 - RNA, 64 nt, Homo Sapiens; identical to SEQ ID NO: 25954

SEQ ID NO: 397545 - RNA, 64 nt, Homo Sapiens; identical to SEQ ID NO: 25955

SEQ ID NO: 397546 - RNA, 64 nt, Homo Sapiens; identical to SEQ ID NO: 25956

SEQ ID NO: 397547 - RNA, 64 nt, Homo Sapiens; identical to SEQ ID NO: 25957

SEQ ID NO: 397548 - RNA, 64 nt, Homo Sapiens; identical to SEQ ID NO: 25958

SEQ ID NO: 397549 - RNA, 64 nt, Homo Sapiens; identical to SEQ ID NO: 25959

SEQ ID NO: 397550 - RNA, 64 nt, Homo Sapiens; identical to SEQ ID NO: 25960

SEQ ID NO: 397551 - RNA, 64 nt, Homo Sapiens; identical to SEQ ID NO: 25961

SEQ ID NO: 397552 - RNA, 64 nt, Homo Sapiens; identical to SEQ ID NO: 25962

SEQ ID NO: 397553 - RNA, 64 nt, Homo Sapiens; identical to SEQ ID NO: 25963

SEQ ID NO: 397554 - RNA, 64 nt, Homo Sapiens; identical to SEQ ID NO: 25964

SEQ ID NO: 397555 - RNA, 64 nt, Homo Sapiens; identical to SEQ ID NO: 25965

SEQ ID NO: 397556 - RNA, 64 nt, Homo Sapiens; identical to SEQ ID NO: 25966

SEQ ID NO: 397557 - RNA, 64 nt, Homo Sapiens; identical to SEQ ID NO: 25967

SEQ ID NO: 397558 - RNA, 64 nt, Homo Sapiens; identical to SEQ ID NO: 25968

SEQ ID NO: 397559 - RNA, 64 nt, Homo Sapiens; identical to SEQ ID NO: 25969

SEQ ID NO: 397560 - RNA, 64 nt, Homo Sapiens; identical to SEQ ID NO: 25970

SEQ ID NO: 397561 - RNA, 64 nt, Homo Sapiens; identical to SEQ ID NO: 25971

SEQ ID NO: 397562 - RNA, 64 nt, Homo Sapiens; identical to SEQ ID NO: 25972

SEQ ID NO: 397563 - RNA, 64 nt, Homo Sapiens; identical to SEQ ID NO: 25973

SEQ ID NO: 397564 - RNA, 64 nt, Homo Sapiens; identical to SEQ ID NO: 25974

SEQ ID NO: 397565 - RNA, 64 nt, Homo Sapiens; identical to SEQ ID NO: 25975

SEQ ID NO: 397566 - RNA, 64 nt, Homo Sapiens; identical to SEQ ID NO: 25976

SEQ ID NO: 397567 - RNA, 64 nt, Homo Sapiens; identical to SEQ ID NO: 25977

SEQ ID NO: 397568 - RNA, 64 nt, Homo Sapiens; identical to SEQ ID NO: 25978

SEQ ID NO: 397569 - RNA, 64 nt, Homo Sapiens; identical to SEQ ID NO: 25979

SEQ ID NO: 397570 - RNA, 64 nt, Homo Sapiens; identical to SEQ ID NO: 25980

SEQ ID NO: 397571 - RNA, 64 nt, Homo Sapiens; identical to SEQ ID NO: 25981

SEQ ID NO: 397572 - RNA, 64 nt, Homo Sapiens; identical to SEQ ID NO: 25982

SEQ ID NO: 397573 - RNA, 64 nt, Homo Sapiens; identical to SEQ ID NO: 25983

SEQ ID NO: 397574 - RNA, 64 nt, Homo Sapiens; identical to SEQ ID NO: 25984

SEQ ID NO: 397575 - RNA, 64 nt, Homo Sapiens; identical to SEQ ID NO: 25985

SEQ ID NO: 397576 - RNA, 64 nt, Homo Sapiens; identical to SEQ ID NO: 25986

SEQ ID NO: 397577 - RNA, 64 nt, Homo Sapiens; identical to SEQ ID NO: 25987

SEQ ID NO: 397578 - RNA, 64 nt, Homo Sapiens; identical to SEQ ID NO: 25988

SEQ ID NO: 397579 - RNA, 64 nt, Homo Sapiens; identical to SEQ ID NO: 25989

SEQ ID NO: 397580 - RNA, 64 nt, Homo Sapiens; identical to SEQ ID NO: 25990

SEQ ID NO: 397581 - RNA, 64 nt, Homo Sapiens; identical to SEQ ID NO: 25991

SEQ ID NO: 397582 - RNA, 64 nt, Homo Sapiens; identical to SEQ ID NO: 25992

SEQ ID NO: 397583 - RNA, 64 nt, Homo Sapiens; identical to SEQ ID NO: 25993

SEQ ID NO: 397584 - RNA, 64 nt, Homo Sapiens; identical to SEQ ID NO: 25994

SEQ ID NO: 397585 - RNA, 64 nt, Homo Sapiens; identical to SEQ ID NO: 25995

SEQ ID NO: 397586 - RNA, 64 nt, Homo Sapiens; identical to SEQ ID NO: 25996

SEQ ID NO: 397587 - RNA, 64 nt, Homo Sapiens; identical to SEQ ID NO: 25997

SEQ ID NO: 397588 - RNA, 64 nt, Homo Sapiens; identical to SEQ ID NO: 25998

SEQ ID NO: 397589 - RNA, 64 nt, Homo Sapiens; identical to SEQ ID NO: 25999

SEQ ID NO: 397590 - RNA, 64 nt, Homo Sapiens; identical to SEQ ID NO: 26000

SEQ ID NO: 397591 - RNA, 64 nt, Homo Sapiens; identical to SEQ ID NO: 26001

SEQ ID NO: 397592 - RNA, 64 nt, Homo Sapiens; identical to SEQ ID NO: 26002

SEQ ID NO: 397593 - RNA, 64 nt, Homo Sapiens; identical to SEQ ID NO: 26003

SEQ ID NO: 397594 - RNA, 64 nt, Homo Sapiens; identical to SEQ ID NO: 26004

SEQ ID NO: 397595 - RNA, 64 nt, Homo Sapiens; identical to SEQ ID NO: 26005

SEQ ID NO: 397596 - RNA, 64 nt, Homo Sapiens; identical to SEQ ID NO: 26006

SEQ ID NO: 397597 - RNA, 64 nt, Homo Sapiens; identical to SEQ ID NO: 26007

SEQ ID NO: 397598 - RNA, 64 nt, Homo Sapiens; identical to SEQ ID NO: 26008

SEQ ID NO: 397599 - RNA, 64 nt, Homo Sapiens; identical to SEQ ID NO: 26009

SEQ ID NO: 397600 - RNA, 64 nt, Homo Sapiens; identical to SEQ ID NO: 26010

SEQ ID NO: 397601 - RNA, 64 nt, Homo Sapiens; identical to SEQ ID NO: 26011

SEQ ID NO: 397602 - RNA, 64 nt, Homo Sapiens; identical to SEQ ID NO: 26012

SEQ ID NO: 397603 - RNA, 64 nt, Homo Sapiens; identical to SEQ ID NO: 26013

SEQ ID NO: 397604 - RNA, 64 nt, Homo Sapiens; identical to SEQ ID NO: 26014

SEQ ID NO: 397605 - RNA, 64 nt, Homo Sapiens; identical to SEQ ID NO: 26015

SEQ ID NO: 397606 - RNA, 64 nt, Homo Sapiens; identical to SEQ ID NO: 26016

SEQ ID NO: 397607 - RNA, 64 nt, Homo Sapiens; identical to SEQ ID NO: 26017

SEQ ID NO: 397608 - RNA, 64 nt, Homo Sapiens; identical to SEQ ID NO: 26018

SEQ ID NO: 397609 - RNA, 64 nt, Homo Sapiens; identical to SEQ ID NO: 26019

SEQ ID NO: 397610 - RNA, 64 nt, Homo Sapiens; identical to SEQ ID NO: 26020

SEQ ID NO: 397611 - RNA, 64 nt, Homo Sapiens; identical to SEQ ID NO: 26021

SEQ ID NO: 397612 - RNA, 64 nt, Homo Sapiens; identical to SEQ ID NO: 26022

SEQ ID NO: 397613 - RNA, 64 nt, Homo Sapiens; identical to SEQ ID NO: 26023

SEQ ID NO: 397614 - RNA, 64 nt, Homo Sapiens; identical to SEQ ID NO: 26024

SEQ ID NO: 397615 - RNA, 64 nt, Homo Sapiens; identical to SEQ ID NO: 26025

SEQ ID NO: 397616 - RNA, 64 nt, Homo Sapiens; identical to SEQ ID NO: 26026

SEQ ID NO: 397617 - RNA, 64 nt, Homo Sapiens; identical to SEQ ID NO: 26027

SEQ ID NO: 397618 - RNA, 64 nt, Homo Sapiens; identical to SEQ ID NO: 26028

SEQ ID NO: 397619 - RNA, 64 nt, Homo Sapiens; identical to SEQ ID NO: 26029

SEQ ID NO: 397620 - RNA, 64 nt, Homo Sapiens; identical to SEQ ID NO: 26030

SEQ ID NO: 397621 - RNA, 64 nt, Homo Sapiens; identical to SEQ ID NO: 26031

SEQ ID NO: 397622 - RNA, 64 nt, Homo Sapiens; identical to SEQ ID NO: 26032

SEQ ID NO: 397623 - RNA, 64 nt, Homo Sapiens; identical to SEQ ID NO: 26033

SEQ ID NO: 397624 - RNA, 64 nt, Homo Sapiens; identical to SEQ ID NO: 26034

SEQ ID NO: 397625 - RNA, 64 nt, Homo Sapiens; identical to SEQ ID NO: 26035

SEQ ID NO: 397626 - RNA, 64 nt, Homo Sapiens; identical to SEQ ID NO: 26036

SEQ ID NO: 397627 - RNA, 64 nt, Homo Sapiens; identical to SEQ ID NO: 26037

SEQ ID NO: 397628 - RNA, 64 nt, Homo Sapiens; identical to SEQ ID NO: 26038

SEQ ID NO: 397629 - RNA, 64 nt, Homo Sapiens; identical to SEQ ID NO: 26039

SEQ ID NO: 397630 - RNA, 64 nt, Homo Sapiens; identical to SEQ ID NO: 26040

SEQ ID NO: 397631 - RNA, 64 nt, Homo Sapiens; identical to SEQ ID NO: 26041

SEQ ID NO: 397632 - RNA, 64 nt, Homo Sapiens; identical to SEQ ID NO: 26042

SEQ ID NO: 397633 - RNA, 64 nt, Homo Sapiens; identical to SEQ ID NO: 26043

SEQ ID NO: 397634 - RNA, 64 nt, Homo Sapiens; identical to SEQ ID NO: 26044

SEQ ID NO: 397635 - RNA, 64 nt, Homo Sapiens; identical to SEQ ID NO: 26045

SEQ ID NO: 397636 - RNA, 64 nt, Homo Sapiens; identical to SEQ ID NO: 26046

SEQ ID NO: 397637 - RNA, 64 nt, Homo Sapiens; identical to SEQ ID NO: 26047

SEQ ID NO: 397638 - RNA, 64 nt, Homo Sapiens; identical to SEQ ID NO: 26048

SEQ ID NO: 397639 - RNA, 64 nt, Homo Sapiens; identical to SEQ ID NO: 26049

SEQ ID NO: 397640 - RNA, 64 nt, Homo Sapiens; identical to SEQ ID NO: 26050

SEQ ID NO: 397641 - RNA, 64 nt, Homo Sapiens; identical to SEQ ID NO: 26051

SEQ ID NO: 397642 - RNA, 64 nt, Homo Sapiens; identical to SEQ ID NO: 26052

SEQ ID NO: 397643 - RNA, 64 nt, Homo Sapiens; identical to SEQ ID NO: 26053

SEQ ID NO: 397644 - RNA, 64 nt, Homo Sapiens; identical to SEQ ID NO: 26054

SEQ ID NO: 397645 - RNA, 64 nt, Homo Sapiens; identical to SEQ ID NO: 26055

SEQ ID NO: 397646 - RNA, 64 nt, Homo Sapiens; identical to SEQ ID NO: 26056

SEQ ID NO: 397647 - RNA, 64 nt, Homo Sapiens; identical to SEQ ID NO: 26057

SEQ ID NO: 397648 - RNA, 64 nt, Homo Sapiens; identical to SEQ ID NO: 26058

SEQ ID NO: 397649 - RNA, 64 nt, Homo Sapiens; identical to SEQ ID NO: 26059

SEQ ID NO: 397650 - RNA, 64 nt, Homo Sapiens; identical to SEQ ID NO: 26060

SEQ ID NO: 397651 - RNA, 64 nt, Homo Sapiens; identical to SEQ ID NO: 26061

SEQ ID NO: 397652 - RNA, 64 nt, Homo Sapiens; identical to SEQ ID NO: 26062

SEQ ID NO: 397653 - RNA, 64 nt, Homo Sapiens; identical to SEQ ID NO: 26063

SEQ ID NO: 397654 - RNA, 64 nt, Homo Sapiens; identical to SEQ ID NO: 26064

SEQ ID NO: 397655 - RNA, 64 nt, Homo Sapiens; identical to SEQ ID NO: 26065

SEQ ID NO: 397656 - RNA, 64 nt, Homo Sapiens; identical to SEQ ID NO: 26066

SEQ ID NO: 397657 - RNA, 64 nt, Homo Sapiens; identical to SEQ ID NO: 26067

SEQ ID NO: 397658 - RNA, 64 nt, Homo Sapiens; identical to SEQ ID NO: 26068

SEQ ID NO: 397659 - RNA, 64 nt, Homo Sapiens; identical to SEQ ID NO: 26069

SEQ ID NO: 397660 - RNA, 64 nt, Homo Sapiens; identical to SEQ ID NO: 26070

SEQ ID NO: 397661 - RNA, 64 nt, Homo Sapiens; identical to SEQ ID NO: 26071

SEQ ID NO: 397662 - RNA, 64 nt, Homo Sapiens; identical to SEQ ID NO: 26072

SEQ ID NO: 397663 - RNA, 64 nt, Homo Sapiens; identical to SEQ ID NO: 26073

SEQ ID NO: 397664 - RNA, 64 nt, Homo Sapiens; identical to SEQ ID NO: 26074

SEQ ID NO: 397665 - RNA, 64 nt, Homo Sapiens; identical to SEQ ID NO: 26075

SEQ ID NO: 397666 - RNA, 64 nt, Homo Sapiens; identical to SEQ ID NO: 26076

SEQ ID NO: 397667 - RNA, 64 nt, Homo Sapiens; identical to SEQ ID NO: 26077

SEQ ID NO: 397668 - RNA, 64 nt, Homo Sapiens; identical to SEQ ID NO: 26078

SEQ ID NO: 397669 - RNA, 64 nt, Homo Sapiens; identical to SEQ ID NO: 26079

SEQ ID NO: 397670 - RNA, 64 nt, Homo Sapiens; identical to SEQ ID NO: 26080

SEQ ID NO: 397671 - RNA, 64 nt, Homo Sapiens; identical to SEQ ID NO: 26081

SEQ ID NO: 397672 - RNA, 64 nt, Homo Sapiens; identical to SEQ ID NO: 26082

SEQ ID NO: 397673 - RNA, 64 nt, Homo Sapiens; identical to SEQ ID NO: 26083

SEQ ID NO: 397674 - RNA, 64 nt, Homo Sapiens; identical to SEQ ID NO: 26084

SEQ ID NO: 397675 - RNA, 64 nt, Homo Sapiens; identical to SEQ ID NO: 26085

SEQ ID NO: 397676 - RNA, 64 nt, Homo Sapiens; identical to SEQ ID NO: 26086

SEQ ID NO: 397677 - RNA, 64 nt, Homo Sapiens; identical to SEQ ID NO: 26087

SEQ ID NO: 397678 - RNA, 64 nt, Homo Sapiens; identical to SEQ ID NO: 26088

SEQ ID NO: 397679 - RNA, 64 nt, Homo Sapiens; identical to SEQ ID NO: 26089

SEQ ID NO: 397680 - RNA, 64 nt, Homo Sapiens; identical to SEQ ID NO: 26090

SEQ ID NO: 397681 - RNA, 64 nt, Homo Sapiens; identical to SEQ ID NO: 26091

SEQ ID NO: 397682 - RNA, 64 nt, Homo Sapiens; identical to SEQ ID NO: 26092

SEQ ID NO: 397683 - RNA, 64 nt, Homo Sapiens; identical to SEQ ID NO: 26093

SEQ ID NO: 397684 - RNA, 64 nt, Homo Sapiens; identical to SEQ ID NO: 26094

SEQ ID NO: 397685 - RNA, 64 nt, Homo Sapiens; identical to SEQ ID NO: 26095

SEQ ID NO: 397686 - RNA, 64 nt, Homo Sapiens; identical to SEQ ID NO: 26096

SEQ ID NO: 397687 - RNA, 64 nt, Homo Sapiens; identical to SEQ ID NO: 26097

SEQ ID NO: 397688 - RNA, 64 nt, Homo Sapiens; identical to SEQ ID NO: 26098

SEQ ID NO: 397689 - RNA, 64 nt, Homo Sapiens; identical to SEQ ID NO: 26099

SEQ ID NO: 397690 - RNA, 64 nt, Homo Sapiens; identical to SEQ ID NO: 26100

SEQ ID NO: 397691 - RNA, 64 nt, Homo Sapiens; identical to SEQ ID NO: 26101

SEQ ID NO: 397692 - RNA, 64 nt, Homo Sapiens; identical to SEQ ID NO: 26102

SEQ ID NO: 397693 - RNA, 64 nt, Homo Sapiens; identical to SEQ ID NO: 26103

SEQ ID NO: 397694 - RNA, 64 nt, Homo Sapiens; identical to SEQ ID NO: 26104

SEQ ID NO: 397695 - RNA, 64 nt, Homo Sapiens; identical to SEQ ID NO: 26105

SEQ ID NO: 397696 - RNA, 64 nt, Homo Sapiens; identical to SEQ ID NO: 26106

SEQ ID NO: 397697 - RNA, 64 nt, Homo Sapiens; identical to SEQ ID NO: 26107

SEQ ID NO: 397698 - RNA, 64 nt, Homo Sapiens; identical to SEQ ID NO: 26108

SEQ ID NO: 397699 - RNA, 64 nt, Homo Sapiens; identical to SEQ ID NO: 26109

SEQ ID NO: 397700 - RNA, 64 nt, Homo Sapiens; identical to SEQ ID NO: 26110

SEQ ID NO: 397701 - RNA, 64 nt, Homo Sapiens; identical to SEQ ID NO: 26111

SEQ ID NO: 397702 - RNA, 64 nt, Homo Sapiens; identical to SEQ ID NO: 26112

SEQ ID NO: 397703 - RNA, 64 nt, Homo Sapiens; identical to SEQ ID NO: 26113

SEQ ID NO: 397704 - RNA, 64 nt, Homo Sapiens; identical to SEQ ID NO: 26114

SEQ ID NO: 397705 - RNA, 64 nt, Homo Sapiens; identical to SEQ ID NO: 26115

SEQ ID NO: 397706 - RNA, 64 nt, Homo Sapiens; identical to SEQ ID NO: 26116

SEQ ID NO: 397707 - RNA, 64 nt, Homo Sapiens; identical to SEQ ID NO: 26117

SEQ ID NO: 397708 - RNA, 64 nt, Homo Sapiens; identical to SEQ ID NO: 26118

SEQ ID NO: 397709 - RNA, 64 nt, Homo Sapiens; identical to SEQ ID NO: 26119

SEQ ID NO: 397710 - RNA, 64 nt, Homo Sapiens; identical to SEQ ID NO: 26120

SEQ ID NO: 397711 - RNA, 64 nt, Homo Sapiens; identical to SEQ ID NO: 26121

SEQ ID NO: 397712 - RNA, 64 nt, Homo Sapiens; identical to SEQ ID NO: 26122

SEQ ID NO: 397713 - RNA, 64 nt, Homo Sapiens; identical to SEQ ID NO: 26123

SEQ ID NO: 397714 - RNA, 64 nt, Homo Sapiens; identical to SEQ ID NO: 26124

SEQ ID NO: 397715 - RNA, 64 nt, Homo Sapiens; identical to SEQ ID NO: 26125

SEQ ID NO: 397716 - RNA, 64 nt, Homo Sapiens; identical to SEQ ID NO: 26126

SEQ ID NO: 397717 - RNA, 64 nt, Homo Sapiens; identical to SEQ ID NO: 26127

SEQ ID NO: 397718 - RNA, 64 nt, Homo Sapiens; identical to SEQ ID NO: 26128

SEQ ID NO: 397719 - RNA, 64 nt, Homo Sapiens; identical to SEQ ID NO: 26129

SEQ ID NO: 397720 - RNA, 64 nt, Homo Sapiens; identical to SEQ ID NO: 26130

SEQ ID NO: 397721 - RNA, 64 nt, Homo Sapiens; identical to SEQ ID NO: 26131

SEQ ID NO: 397722 - RNA, 64 nt, Homo Sapiens; identical to SEQ ID NO: 26132

SEQ ID NO: 397723 - RNA, 64 nt, Homo Sapiens; identical to SEQ ID NO: 26133

SEQ ID NO: 397724 - RNA, 64 nt, Homo Sapiens; identical to SEQ ID NO: 26134

SEQ ID NO: 397725 - RNA, 64 nt, Homo Sapiens; identical to SEQ ID NO: 26135

SEQ ID NO: 397726 - RNA, 64 nt, Homo Sapiens; identical to SEQ ID NO: 26136

SEQ ID NO: 397727 - RNA, 64 nt, Homo Sapiens; identical to SEQ ID NO: 26137

SEQ ID NO: 397728 - RNA, 64 nt, Homo Sapiens; identical to SEQ ID NO: 26138

SEQ ID NO: 397729 - RNA, 64 nt, Homo Sapiens; identical to SEQ ID NO: 26139

SEQ ID NO: 397730 - RNA, 64 nt, Homo Sapiens; identical to SEQ ID NO: 26140

SEQ ID NO: 397731 - RNA, 64 nt, Homo Sapiens; identical to SEQ ID NO: 26141

SEQ ID NO: 397732 - RNA, 64 nt, Homo Sapiens; identical to SEQ ID NO: 26142

SEQ ID NO: 397733 - RNA, 64 nt, Homo Sapiens; identical to SEQ ID NO: 26143

SEQ ID NO: 397734 - RNA, 64 nt, Homo Sapiens; identical to SEQ ID NO: 26144

SEQ ID NO: 397735 - RNA, 64 nt, Homo Sapiens; identical to SEQ ID NO: 26145

SEQ ID NO: 397736 - RNA, 64 nt, Homo Sapiens; identical to SEQ ID NO: 26146

SEQ ID NO: 397737 - RNA, 64 nt, Homo Sapiens; identical to SEQ ID NO: 26147

SEQ ID NO: 397738 - RNA, 64 nt, Homo Sapiens; identical to SEQ ID NO: 26148

SEQ ID NO: 397739 - RNA, 64 nt, Homo Sapiens; identical to SEQ ID NO: 26149

SEQ ID NO: 397740 - RNA, 64 nt, Homo Sapiens; identical to SEQ ID NO: 26150

SEQ ID NO: 397741 - RNA, 64 nt, Homo Sapiens; identical to SEQ ID NO: 26151

SEQ ID NO: 397742 - RNA, 64 nt, Homo Sapiens; identical to SEQ ID NO: 26152

SEQ ID NO: 397743 - RNA, 64 nt, Homo Sapiens; identical to SEQ ID NO: 26153

SEQ ID NO: 397744 - RNA, 64 nt, Homo Sapiens; identical to SEQ ID NO: 26154

SEQ ID NO: 397745 - RNA, 64 nt, Homo Sapiens; identical to SEQ ID NO: 26155

SEQ ID NO: 397746 - RNA, 64 nt, Homo Sapiens; identical to SEQ ID NO: 26156

SEQ ID NO: 397747 - RNA, 64 nt, Homo Sapiens; identical to SEQ ID NO: 26157

SEQ ID NO: 397748 - RNA, 64 nt, Homo Sapiens; identical to SEQ ID NO: 26158

SEQ ID NO: 397749 - RNA, 64 nt, Homo Sapiens; identical to SEQ ID NO: 26159

SEQ ID NO: 397750 - RNA, 64 nt, Homo Sapiens; identical to SEQ ID NO: 26160

SEQ ID NO: 397751 - RNA, 64 nt, Homo Sapiens; identical to SEQ ID NO: 26161

SEQ ID NO: 397752 - RNA, 64 nt, Homo Sapiens; identical to SEQ ID NO: 26162

SEQ ID NO: 397753 - RNA, 64 nt, Homo Sapiens; identical to SEQ ID NO: 26163

SEQ ID NO: 397754 - RNA, 64 nt, Homo Sapiens; identical to SEQ ID NO: 26164

SEQ ID NO: 397755 - RNA, 64 nt, Homo Sapiens; identical to SEQ ID NO: 26165

SEQ ID NO: 397756 - RNA, 64 nt, Homo Sapiens; identical to SEQ ID NO: 26166

SEQ ID NO: 397757 - RNA, 64 nt, Homo Sapiens; identical to SEQ ID NO: 26167

SEQ ID NO: 397758 - RNA, 64 nt, Homo Sapiens; identical to SEQ ID NO: 26168

SEQ ID NO: 397759 - RNA, 64 nt, Homo Sapiens; identical to SEQ ID NO: 26169

SEQ ID NO: 397760 - RNA, 64 nt, Homo Sapiens; identical to SEQ ID NO: 26170

SEQ ID NO: 397761 - RNA, 64 nt, Homo Sapiens; identical to SEQ ID NO: 26171

SEQ ID NO: 397762 - RNA, 64 nt, Homo Sapiens; identical to SEQ ID NO: 26172

SEQ ID NO: 397763 - RNA, 64 nt, Homo Sapiens; identical to SEQ ID NO: 26173

SEQ ID NO: 397764 - RNA, 64 nt, Homo Sapiens; identical to SEQ ID NO: 26174

SEQ ID NO: 397765 - RNA, 64 nt, Homo Sapiens; identical to SEQ ID NO: 26175

SEQ ID NO: 397766 - RNA, 64 nt, Homo Sapiens; identical to SEQ ID NO: 26176

SEQ ID NO: 397767 - RNA, 64 nt, Homo Sapiens; identical to SEQ ID NO: 26177

SEQ ID NO: 397768 - RNA, 64 nt, Homo Sapiens; identical to SEQ ID NO: 26178

SEQ ID NO: 397769 - RNA, 64 nt, Homo Sapiens; identical to SEQ ID NO: 26179

SEQ ID NO: 397770 - RNA, 64 nt, Homo Sapiens; identical to SEQ ID NO: 26180

SEQ ID NO: 397771 - RNA, 64 nt, Homo Sapiens; identical to SEQ ID NO: 26181

SEQ ID NO: 397772 - RNA, 64 nt, Homo Sapiens; identical to SEQ ID NO: 26182

SEQ ID NO: 397773 - RNA, 64 nt, Homo Sapiens; identical to SEQ ID NO: 26183

SEQ ID NO: 397774 - RNA, 64 nt, Homo Sapiens; identical to SEQ ID NO: 26184

SEQ ID NO: 397775 - RNA, 64 nt, Homo Sapiens; identical to SEQ ID NO: 26185

SEQ ID NO: 397776 - RNA, 64 nt, Homo Sapiens; identical to SEQ ID NO: 26186

SEQ ID NO: 397777 - RNA, 64 nt, Homo Sapiens; identical to SEQ ID NO: 26187

SEQ ID NO: 397778 - RNA, 64 nt, Homo Sapiens; identical to SEQ ID NO: 26188

SEQ ID NO: 397779 - RNA, 64 nt, Homo Sapiens; identical to SEQ ID NO: 26189

SEQ ID NO: 397780 - RNA, 64 nt, Homo Sapiens; identical to SEQ ID NO: 26190

SEQ ID NO: 397781 - RNA, 64 nt, Homo Sapiens; identical to SEQ ID NO: 26191

SEQ ID NO: 397782 - RNA, 62 nt, Homo Sapiens; identical to SEQ ID NO: 26192

SEQ ID NO: 397783 - RNA, 61 nt, Homo Sapiens; identical to SEQ ID NO: 26193

SEQ ID NO: 397784 - RNA, 64 nt, Homo Sapiens; identical to SEQ ID NO: 26194

SEQ ID NO: 397785 - RNA, 64 nt, Homo Sapiens; identical to SEQ ID NO: 26195

SEQ ID NO: 397786 - RNA, 64 nt, Homo Sapiens; identical to SEQ ID NO: 26196

SEQ ID NO: 397787 - RNA, 64 nt, Homo Sapiens; identical to SEQ ID NO: 26197

SEQ ID NO: 397788 - RNA, 64 nt, Homo Sapiens; identical to SEQ ID NO: 26198

SEQ ID NO: 397789 - RNA, 64 nt, Homo Sapiens; identical to SEQ ID NO: 26199

SEQ ID NO: 397790 - RNA, 64 nt, Homo Sapiens; identical to SEQ ID NO: 26200

SEQ ID NO: 397791 - RNA, 64 nt, Homo Sapiens; identical to SEQ ID NO: 26201

SEQ ID NO: 397792 - RNA, 64 nt, Homo Sapiens; identical to SEQ ID NO: 26202

SEQ ID NO: 397793 - RNA, 64 nt, Homo Sapiens; identical to SEQ ID NO: 26203

SEQ ID NO: 397794 - RNA, 64 nt, Homo Sapiens; identical to SEQ ID NO: 26204

SEQ ID NO: 397795 - RNA, 64 nt, Homo Sapiens; identical to SEQ ID NO: 26205

SEQ ID NO: 397796 - RNA, 64 nt, Homo Sapiens; identical to SEQ ID NO: 26206

SEQ ID NO: 397797 - RNA, 64 nt, Homo Sapiens; identical to SEQ ID NO: 26207

SEQ ID NO: 397798 - RNA, 64 nt, Homo Sapiens; identical to SEQ ID NO: 26208

SEQ ID NO: 397799 - RNA, 64 nt, Homo Sapiens; identical to SEQ ID NO: 26209

SEQ ID NO: 397800 - RNA, 64 nt, Homo Sapiens; identical to SEQ ID NO: 26210

SEQ ID NO: 397801 - RNA, 64 nt, Homo Sapiens; identical to SEQ ID NO: 26211

SEQ ID NO: 397802 - RNA, 64 nt, Homo Sapiens; identical to SEQ ID NO: 26212

SEQ ID NO: 397803 - RNA, 64 nt, Homo Sapiens; identical to SEQ ID NO: 26213

SEQ ID NO: 397804 - RNA, 64 nt, Homo Sapiens; identical to SEQ ID NO: 26214

SEQ ID NO: 397805 - RNA, 64 nt, Homo Sapiens; identical to SEQ ID NO: 26215

SEQ ID NO: 397806 - RNA, 64 nt, Homo Sapiens; identical to SEQ ID NO: 26216

SEQ ID NO: 397807 - RNA, 64 nt, Homo Sapiens; identical to SEQ ID NO: 26217

SEQ ID NO: 397808 - RNA, 64 nt, Homo Sapiens; identical to SEQ ID NO: 26218

SEQ ID NO: 397809 - RNA, 64 nt, Homo Sapiens; identical to SEQ ID NO: 26219

SEQ ID NO: 397810 - RNA, 64 nt, Homo Sapiens; identical to SEQ ID NO: 26220

SEQ ID NO: 397811 - RNA, 64 nt, Homo Sapiens; identical to SEQ ID NO: 26221

SEQ ID NO: 397812 - RNA, 64 nt, Homo Sapiens; identical to SEQ ID NO: 26222

SEQ ID NO: 397813 - RNA, 64 nt, Homo Sapiens; identical to SEQ ID NO: 26223

SEQ ID NO: 397814 - RNA, 64 nt, Homo Sapiens; identical to SEQ ID NO: 26224

SEQ ID NO: 397815 - RNA, 64 nt, Homo Sapiens; identical to SEQ ID NO: 26225

SEQ ID NO: 397816 - RNA, 64 nt, Homo Sapiens; identical to SEQ ID NO: 26226

SEQ ID NO: 397817 - RNA, 64 nt, Homo Sapiens; identical to SEQ ID NO: 26227

SEQ ID NO: 397818 - RNA, 64 nt, Homo Sapiens; identical to SEQ ID NO: 26228

SEQ ID NO: 397819 - RNA, 64 nt, Homo Sapiens; identical to SEQ ID NO: 26229

SEQ ID NO: 397820 - RNA, 64 nt, Homo Sapiens; identical to SEQ ID NO: 26230

SEQ ID NO: 397821 - RNA, 64 nt, Homo Sapiens; identical to SEQ ID NO: 26231

SEQ ID NO: 397822 - RNA, 64 nt, Homo Sapiens; identical to SEQ ID NO: 26232

SEQ ID NO: 397823 - RNA, 64 nt, Homo Sapiens; identical to SEQ ID NO: 26233

SEQ ID NO: 397824 - RNA, 64 nt, Homo Sapiens; identical to SEQ ID NO: 26234

SEQ ID NO: 397825 - RNA, 64 nt, Homo Sapiens; identical to SEQ ID NO: 26235

SEQ ID NO: 397826 - RNA, 64 nt, Homo Sapiens; identical to SEQ ID NO: 26236

SEQ ID NO: 397827 - RNA, 64 nt, Homo Sapiens; identical to SEQ ID NO: 26237

SEQ ID NO: 397828 - RNA, 64 nt, Homo Sapiens; identical to SEQ ID NO: 26238

SEQ ID NO: 397829 - RNA, 64 nt, Homo Sapiens; identical to SEQ ID NO: 26239

SEQ ID NO: 397830 - RNA, 64 nt, Homo Sapiens; identical to SEQ ID NO: 26240

SEQ ID NO: 397831 - RNA, 64 nt, Homo Sapiens; identical to SEQ ID NO: 26241

SEQ ID NO: 397832 - RNA, 64 nt, Homo Sapiens; identical to SEQ ID NO: 26242

SEQ ID NO: 397833 - RNA, 64 nt, Homo Sapiens; identical to SEQ ID NO: 26243

SEQ ID NO: 397834 - RNA, 64 nt, Homo Sapiens; identical to SEQ ID NO: 26244

SEQ ID NO: 397835 - RNA, 64 nt, Homo Sapiens; identical to SEQ ID NO: 26245

SEQ ID NO: 397836 - RNA, 64 nt, Homo Sapiens; identical to SEQ ID NO: 26246

SEQ ID NO: 397837 - RNA, 64 nt, Homo Sapiens; identical to SEQ ID NO: 26247

SEQ ID NO: 397838 - RNA, 64 nt, Homo Sapiens; identical to SEQ ID NO: 26248

SEQ ID NO: 397839 - RNA, 64 nt, Homo Sapiens; identical to SEQ ID NO: 26249

SEQ ID NO: 397840 - RNA, 64 nt, Homo Sapiens; identical to SEQ ID NO: 26250

SEQ ID NO: 397841 - RNA, 64 nt, Homo Sapiens; identical to SEQ ID NO: 26251

SEQ ID NO: 397842 - RNA, 64 nt, Homo Sapiens; identical to SEQ ID NO: 26252

SEQ ID NO: 397843 - RNA, 64 nt, Homo Sapiens; identical to SEQ ID NO: 26253

SEQ ID NO: 397844 - RNA, 64 nt, Homo Sapiens; identical to SEQ ID NO: 26254

SEQ ID NO: 397845 - RNA, 64 nt, Homo Sapiens; identical to SEQ ID NO: 26255

SEQ ID NO: 397846 - RNA, 64 nt, Homo Sapiens; identical to SEQ ID NO: 26256

SEQ ID NO: 397847 - RNA, 64 nt, Homo Sapiens; identical to SEQ ID NO: 26257

SEQ ID NO: 397848 - RNA, 64 nt, Homo Sapiens; identical to SEQ ID NO: 26258

SEQ ID NO: 397849 - RNA, 64 nt, Homo Sapiens; identical to SEQ ID NO: 26259

SEQ ID NO: 397850 - RNA, 64 nt, Homo Sapiens; identical to SEQ ID NO: 26260

SEQ ID NO: 397851 - RNA, 64 nt, Homo Sapiens; identical to SEQ ID NO: 26261

SEQ ID NO: 397852 - RNA, 64 nt, Homo Sapiens; identical to SEQ ID NO: 26262

SEQ ID NO: 397853 - RNA, 64 nt, Homo Sapiens; identical to SEQ ID NO: 26263

SEQ ID NO: 397854 - RNA, 64 nt, Homo Sapiens; identical to SEQ ID NO: 26264

SEQ ID NO: 397855 - RNA, 64 nt, Homo Sapiens; identical to SEQ ID NO: 26265

SEQ ID NO: 397856 - RNA, 64 nt, Homo Sapiens; identical to SEQ ID NO: 26266

SEQ ID NO: 397857 - RNA, 64 nt, Homo Sapiens; identical to SEQ ID NO: 26267

SEQ ID NO: 397858 - RNA, 64 nt, Homo Sapiens; identical to SEQ ID NO: 26268

SEQ ID NO: 397859 - RNA, 64 nt, Homo Sapiens; identical to SEQ ID NO: 26269

SEQ ID NO: 397860 - RNA, 64 nt, Homo Sapiens; identical to SEQ ID NO: 26270

SEQ ID NO: 397861 - RNA, 64 nt, Homo Sapiens; identical to SEQ ID NO: 26271

SEQ ID NO: 397862 - RNA, 64 nt, Homo Sapiens; identical to SEQ ID NO: 26272

SEQ ID NO: 397863 - RNA, 64 nt, Homo Sapiens; identical to SEQ ID NO: 26273

SEQ ID NO: 397864 - RNA, 64 nt, Homo Sapiens; identical to SEQ ID NO: 26274

SEQ ID NO: 397865 - RNA, 64 nt, Homo Sapiens; identical to SEQ ID NO: 26275

SEQ ID NO: 397866 - RNA, 64 nt, Homo Sapiens; identical to SEQ ID NO: 26276

SEQ ID NO: 397867 - RNA, 64 nt, Homo Sapiens; identical to SEQ ID NO: 26277

SEQ ID NO: 397868 - RNA, 64 nt, Homo Sapiens; identical to SEQ ID NO: 26278

SEQ ID NO: 397869 - RNA, 64 nt, Homo Sapiens; identical to SEQ ID NO: 26279

SEQ ID NO: 397870 - RNA, 64 nt, Homo Sapiens; identical to SEQ ID NO: 26280

SEQ ID NO: 397871 - RNA, 64 nt, Homo Sapiens; identical to SEQ ID NO: 26281

SEQ ID NO: 397872 - RNA, 64 nt, Homo Sapiens; identical to SEQ ID NO: 26282

SEQ ID NO: 397873 - RNA, 64 nt, Homo Sapiens; identical to SEQ ID NO: 26283

SEQ ID NO: 397874 - RNA, 64 nt, Homo Sapiens; identical to SEQ ID NO: 26284

SEQ ID NO: 397875 - RNA, 64 nt, Homo Sapiens; identical to SEQ ID NO: 26285

SEQ ID NO: 397876 - RNA, 64 nt, Homo Sapiens; identical to SEQ ID NO: 26286

SEQ ID NO: 397877 - RNA, 64 nt, Homo Sapiens; identical to SEQ ID NO: 26287

SEQ ID NO: 397878 - RNA, 64 nt, Homo Sapiens; identical to SEQ ID NO: 26288

SEQ ID NO: 397879 - RNA, 64 nt, Homo Sapiens; identical to SEQ ID NO: 26289

SEQ ID NO: 397880 - RNA, 64 nt, Homo Sapiens; identical to SEQ ID NO: 26290

SEQ ID NO: 397881 - RNA, 64 nt, Homo Sapiens; identical to SEQ ID NO: 26291

SEQ ID NO: 397882 - RNA, 64 nt, Homo Sapiens; identical to SEQ ID NO: 26292

SEQ ID NO: 397883 - RNA, 64 nt, Homo Sapiens; identical to SEQ ID NO: 26293

SEQ ID NO: 397884 - RNA, 64 nt, Homo Sapiens; identical to SEQ ID NO: 26294

SEQ ID NO: 397885 - RNA, 64 nt, Homo Sapiens; identical to SEQ ID NO: 26295

SEQ ID NO: 397886 - RNA, 64 nt, Homo Sapiens; identical to SEQ ID NO: 26296

SEQ ID NO: 397887 - RNA, 64 nt, Homo Sapiens; identical to SEQ ID NO: 26297

SEQ ID NO: 397888 - RNA, 64 nt, Homo Sapiens; identical to SEQ ID NO: 26298

SEQ ID NO: 397889 - RNA, 64 nt, Homo Sapiens; identical to SEQ ID NO: 26299

SEQ ID NO: 397890 - RNA, 64 nt, Homo Sapiens; identical to SEQ ID NO: 26300

SEQ ID NO: 397891 - RNA, 64 nt, Homo Sapiens; identical to SEQ ID NO: 26301

SEQ ID NO: 397892 - RNA, 64 nt, Homo Sapiens; identical to SEQ ID NO: 26302

SEQ ID NO: 397893 - RNA, 64 nt, Homo Sapiens; identical to SEQ ID NO: 26303

SEQ ID NO: 397894 - RNA, 64 nt, Homo Sapiens; identical to SEQ ID NO: 26304

SEQ ID NO: 397895 - RNA, 64 nt, Homo Sapiens; identical to SEQ ID NO: 26305

SEQ ID NO: 397896 - RNA, 64 nt, Homo Sapiens; identical to SEQ ID NO: 26306

SEQ ID NO: 397897 - RNA, 64 nt, Homo Sapiens; identical to SEQ ID NO: 26307

SEQ ID NO: 397898 - RNA, 64 nt, Homo Sapiens; identical to SEQ ID NO: 26308

SEQ ID NO: 397899 - RNA, 64 nt, Homo Sapiens; identical to SEQ ID NO: 26309

SEQ ID NO: 397900 - RNA, 64 nt, Homo Sapiens; identical to SEQ ID NO: 26310

SEQ ID NO: 397901 - RNA, 64 nt, Homo Sapiens; identical to SEQ ID NO: 26311

SEQ ID NO: 397902 - RNA, 64 nt, Homo Sapiens; identical to SEQ ID NO: 26312

SEQ ID NO: 397903 - RNA, 64 nt, Homo Sapiens; identical to SEQ ID NO: 26313

SEQ ID NO: 397904 - RNA, 64 nt, Homo Sapiens; identical to SEQ ID NO: 26314

SEQ ID NO: 397905 - RNA, 64 nt, Homo Sapiens; identical to SEQ ID NO: 26315

SEQ ID NO: 397906 - RNA, 64 nt, Homo Sapiens; identical to SEQ ID NO: 26316

SEQ ID NO: 397907 - RNA, 64 nt, Homo Sapiens; identical to SEQ ID NO: 26317

SEQ ID NO: 397908 - RNA, 64 nt, Homo Sapiens; identical to SEQ ID NO: 26318

SEQ ID NO: 397909 - RNA, 64 nt, Homo Sapiens; identical to SEQ ID NO: 26319

SEQ ID NO: 397910 - RNA, 64 nt, Homo Sapiens; identical to SEQ ID NO: 26320

SEQ ID NO: 397911 - RNA, 64 nt, Homo Sapiens; identical to SEQ ID NO: 26321

SEQ ID NO: 397912 - RNA, 64 nt, Homo Sapiens; identical to SEQ ID NO: 26322

SEQ ID NO: 397913 - RNA, 64 nt, Homo Sapiens; identical to SEQ ID NO: 26323

SEQ ID NO: 397914 - RNA, 64 nt, Homo Sapiens; identical to SEQ ID NO: 26324

SEQ ID NO: 397915 - RNA, 64 nt, Homo Sapiens; identical to SEQ ID NO: 26325

SEQ ID NO: 397916 - RNA, 64 nt, Homo Sapiens; identical to SEQ ID NO: 26326

SEQ ID NO: 397917 - RNA, 64 nt, Homo Sapiens; identical to SEQ ID NO: 26327

SEQ ID NO: 397918 - RNA, 64 nt, Homo Sapiens; identical to SEQ ID NO: 26328

SEQ ID NO: 397919 - RNA, 64 nt, Homo Sapiens; identical to SEQ ID NO: 26329

SEQ ID NO: 397920 - RNA, 64 nt, Homo Sapiens; identical to SEQ ID NO: 26330

SEQ ID NO: 397921 - RNA, 64 nt, Homo Sapiens; identical to SEQ ID NO: 26331

SEQ ID NO: 397922 - RNA, 64 nt, Homo Sapiens; identical to SEQ ID NO: 26332

SEQ ID NO: 397923 - RNA, 64 nt, Homo Sapiens; identical to SEQ ID NO: 26333

SEQ ID NO: 397924 - RNA, 64 nt, Homo Sapiens; identical to SEQ ID NO: 26334

SEQ ID NO: 397925 - RNA, 64 nt, Homo Sapiens; identical to SEQ ID NO: 26335

SEQ ID NO: 397926 - RNA, 64 nt, Homo Sapiens; identical to SEQ ID NO: 26336

SEQ ID NO: 397927 - RNA, 64 nt, Homo Sapiens; identical to SEQ ID NO: 26337

SEQ ID NO: 397928 - RNA, 64 nt, Homo Sapiens; identical to SEQ ID NO: 26338

SEQ ID NO: 397929 - RNA, 64 nt, Homo Sapiens; identical to SEQ ID NO: 26339

SEQ ID NO: 397930 - RNA, 64 nt, Homo Sapiens; identical to SEQ ID NO: 26340

SEQ ID NO: 397931 - RNA, 64 nt, Homo Sapiens; identical to SEQ ID NO: 26341

SEQ ID NO: 397932 - RNA, 64 nt, Homo Sapiens; identical to SEQ ID NO: 26342

SEQ ID NO: 397933 - RNA, 64 nt, Homo Sapiens; identical to SEQ ID NO: 26343

SEQ ID NO: 397934 - RNA, 64 nt, Homo Sapiens; identical to SEQ ID NO: 26344

SEQ ID NO: 397935 - RNA, 64 nt, Homo Sapiens; identical to SEQ ID NO: 26345

SEQ ID NO: 397936 - RNA, 64 nt, Homo Sapiens; identical to SEQ ID NO: 26346

SEQ ID NO: 397937 - RNA, 64 nt, Homo Sapiens; identical to SEQ ID NO: 26347

SEQ ID NO: 397938 - RNA, 64 nt, Homo Sapiens; identical to SEQ ID NO: 26348

SEQ ID NO: 397939 - RNA, 64 nt, Homo Sapiens; identical to SEQ ID NO: 26349

SEQ ID NO: 397940 - RNA, 64 nt, Homo Sapiens; identical to SEQ ID NO: 26350

SEQ ID NO: 397941 - RNA, 64 nt, Homo Sapiens; identical to SEQ ID NO: 26351

SEQ ID NO: 397942 - RNA, 64 nt, Homo Sapiens; identical to SEQ ID NO: 26352

SEQ ID NO: 397943 - RNA, 64 nt, Homo Sapiens; identical to SEQ ID NO: 26353

SEQ ID NO: 397944 - RNA, 64 nt, Homo Sapiens; identical to SEQ ID NO: 26354

SEQ ID NO: 397945 - RNA, 64 nt, Homo Sapiens; identical to SEQ ID NO: 26355

SEQ ID NO: 397946 - RNA, 64 nt, Homo Sapiens; identical to SEQ ID NO: 26356

SEQ ID NO: 397947 - RNA, 64 nt, Homo Sapiens; identical to SEQ ID NO: 26357

SEQ ID NO: 397948 - RNA, 64 nt, Homo Sapiens; identical to SEQ ID NO: 26358

SEQ ID NO: 397949 - RNA, 64 nt, Homo Sapiens; identical to SEQ ID NO: 26359

SEQ ID NO: 397950 - RNA, 64 nt, Homo Sapiens; identical to SEQ ID NO: 26360

SEQ ID NO: 397951 - RNA, 64 nt, Homo Sapiens; identical to SEQ ID NO: 26361

SEQ ID NO: 397952 - RNA, 64 nt, Homo Sapiens; identical to SEQ ID NO: 26362

SEQ ID NO: 397953 - RNA, 64 nt, Homo Sapiens; identical to SEQ ID NO: 26363

SEQ ID NO: 397954 - RNA, 64 nt, Homo Sapiens; identical to SEQ ID NO: 26364

SEQ ID NO: 397955 - RNA, 64 nt, Homo Sapiens; identical to SEQ ID NO: 26365

SEQ ID NO: 397956 - RNA, 64 nt, Homo Sapiens; identical to SEQ ID NO: 26366

SEQ ID NO: 397957 - RNA, 64 nt, Homo Sapiens; identical to SEQ ID NO: 26367

SEQ ID NO: 397958 - RNA, 64 nt, Homo Sapiens; identical to SEQ ID NO: 26368

SEQ ID NO: 397959 - RNA, 64 nt, Homo Sapiens; identical to SEQ ID NO: 26369

SEQ ID NO: 397960 - RNA, 64 nt, Homo Sapiens; identical to SEQ ID NO: 26370

SEQ ID NO: 397961 - RNA, 64 nt, Homo Sapiens; identical to SEQ ID NO: 26371

SEQ ID NO: 397962 - RNA, 64 nt, Homo Sapiens; identical to SEQ ID NO: 26372

SEQ ID NO: 397963 - RNA, 64 nt, Homo Sapiens; identical to SEQ ID NO: 26373

SEQ ID NO: 397964 - RNA, 64 nt, Homo Sapiens; identical to SEQ ID NO: 26374

SEQ ID NO: 397965 - RNA, 64 nt, Homo Sapiens; identical to SEQ ID NO: 26375

SEQ ID NO: 397966 - RNA, 64 nt, Homo Sapiens; identical to SEQ ID NO: 26376

SEQ ID NO: 397967 - RNA, 64 nt, Homo Sapiens; identical to SEQ ID NO: 26377

SEQ ID NO: 397968 - RNA, 64 nt, Homo Sapiens; identical to SEQ ID NO: 26378

SEQ ID NO: 397969 - RNA, 64 nt, Homo Sapiens; identical to SEQ ID NO: 26379

SEQ ID NO: 397970 - RNA, 64 nt, Homo Sapiens; identical to SEQ ID NO: 26380

SEQ ID NO: 397971 - RNA, 64 nt, Homo Sapiens; identical to SEQ ID NO: 26381

SEQ ID NO: 397972 - RNA, 64 nt, Homo Sapiens; identical to SEQ ID NO: 26382

SEQ ID NO: 397973 - RNA, 64 nt, Homo Sapiens; identical to SEQ ID NO: 26383

SEQ ID NO: 397974 - RNA, 64 nt, Homo Sapiens; identical to SEQ ID NO: 26384

SEQ ID NO: 397975 - RNA, 64 nt, Homo Sapiens; identical to SEQ ID NO: 26385

SEQ ID NO: 397976 - RNA, 64 nt, Homo Sapiens; identical to SEQ ID NO: 26386

SEQ ID NO: 397977 - RNA, 64 nt, Homo Sapiens; identical to SEQ ID NO: 26387

SEQ ID NO: 397978 - RNA, 64 nt, Homo Sapiens; identical to SEQ ID NO: 26388

SEQ ID NO: 397979 - RNA, 64 nt, Homo Sapiens; identical to SEQ ID NO: 26389

SEQ ID NO: 397980 - RNA, 64 nt, Homo Sapiens; identical to SEQ ID NO: 26390

SEQ ID NO: 397981 - RNA, 64 nt, Homo Sapiens; identical to SEQ ID NO: 26391

SEQ ID NO: 397982 - RNA, 64 nt, Homo Sapiens; identical to SEQ ID NO: 26392

SEQ ID NO: 397983 - RNA, 64 nt, Homo Sapiens; identical to SEQ ID NO: 26393

SEQ ID NO: 397984 - RNA, 64 nt, Homo Sapiens; identical to SEQ ID NO: 26394

SEQ ID NO: 397985 - RNA, 64 nt, Homo Sapiens; identical to SEQ ID NO: 26395

SEQ ID NO: 397986 - RNA, 64 nt, Homo Sapiens; identical to SEQ ID NO: 26396

SEQ ID NO: 397987 - RNA, 64 nt, Homo Sapiens; identical to SEQ ID NO: 26397

SEQ ID NO: 397988 - RNA, 64 nt, Homo Sapiens; identical to SEQ ID NO: 26398

SEQ ID NO: 397989 - RNA, 64 nt, Homo Sapiens; identical to SEQ ID NO: 26399

SEQ ID NO: 397990 - RNA, 64 nt, Homo Sapiens; identical to SEQ ID NO: 26400

SEQ ID NO: 397991 - RNA, 64 nt, Homo Sapiens; identical to SEQ ID NO: 26401

SEQ ID NO: 397992 - RNA, 64 nt, Homo Sapiens; identical to SEQ ID NO: 26402

SEQ ID NO: 397993 - RNA, 64 nt, Homo Sapiens; identical to SEQ ID NO: 26403

SEQ ID NO: 397994 - RNA, 64 nt, Homo Sapiens; identical to SEQ ID NO: 26404

SEQ ID NO: 397995 - RNA, 64 nt, Homo Sapiens; identical to SEQ ID NO: 26405

SEQ ID NO: 397996 - RNA, 64 nt, Homo Sapiens; identical to SEQ ID NO: 26406

SEQ ID NO: 397997 - RNA, 64 nt, Homo Sapiens; identical to SEQ ID NO: 26407

SEQ ID NO: 397998 - RNA, 64 nt, Homo Sapiens; identical to SEQ ID NO: 26408

SEQ ID NO: 397999 - RNA, 64 nt, Homo Sapiens; identical to SEQ ID NO: 26409

SEQ ID NO: 398000 - RNA, 64 nt, Homo Sapiens; identical to SEQ ID NO: 26410

SEQ ID NO: 398001 - RNA, 64 nt, Homo Sapiens; identical to SEQ ID NO: 26411

SEQ ID NO: 398002 - RNA, 64 nt, Homo Sapiens; identical to SEQ ID NO: 26412

SEQ ID NO: 398003 - RNA, 64 nt, Homo Sapiens; identical to SEQ ID NO: 26413

SEQ ID NO: 398004 - RNA, 64 nt, Homo Sapiens; identical to SEQ ID NO: 26414

SEQ ID NO: 398005 - RNA, 64 nt, Homo Sapiens; identical to SEQ ID NO: 26415

SEQ ID NO: 398006 - RNA, 64 nt, Homo Sapiens; identical to SEQ ID NO: 26416

SEQ ID NO: 398007 - RNA, 64 nt, Homo Sapiens; identical to SEQ ID NO: 26417

SEQ ID NO: 398008 - RNA, 64 nt, Homo Sapiens; identical to SEQ ID NO: 26418

SEQ ID NO: 398009 - RNA, 64 nt, Homo Sapiens; identical to SEQ ID NO: 26419

SEQ ID NO: 398010 - RNA, 64 nt, Homo Sapiens; identical to SEQ ID NO: 26420

SEQ ID NO: 398011 - RNA, 64 nt, Homo Sapiens; identical to SEQ ID NO: 26421

SEQ ID NO: 398012 - RNA, 64 nt, Homo Sapiens; identical to SEQ ID NO: 26422

SEQ ID NO: 398013 - RNA, 64 nt, Homo Sapiens; identical to SEQ ID NO: 26423

SEQ ID NO: 398014 - RNA, 64 nt, Homo Sapiens; identical to SEQ ID NO: 26424

SEQ ID NO: 398015 - RNA, 64 nt, Homo Sapiens; identical to SEQ ID NO: 26425

SEQ ID NO: 398016 - RNA, 64 nt, Homo Sapiens; identical to SEQ ID NO: 26426

SEQ ID NO: 398017 - RNA, 64 nt, Homo Sapiens; identical to SEQ ID NO: 26427

SEQ ID NO: 398018 - RNA, 64 nt, Homo Sapiens; identical to SEQ ID NO: 26428

SEQ ID NO: 398019 - RNA, 64 nt, Homo Sapiens; identical to SEQ ID NO: 26429

SEQ ID NO: 398020 - RNA, 64 nt, Homo Sapiens; identical to SEQ ID NO: 26430

SEQ ID NO: 398021 - RNA, 64 nt, Homo Sapiens; identical to SEQ ID NO: 26431

SEQ ID NO: 398022 - RNA, 64 nt, Homo Sapiens; identical to SEQ ID NO: 26432

SEQ ID NO: 398023 - RNA, 64 nt, Homo Sapiens; identical to SEQ ID NO: 26433

SEQ ID NO: 398024 - RNA, 64 nt, Homo Sapiens; identical to SEQ ID NO: 26434

SEQ ID NO: 398025 - RNA, 64 nt, Homo Sapiens; identical to SEQ ID NO: 26435

SEQ ID NO: 398026 - RNA, 64 nt, Homo Sapiens; identical to SEQ ID NO: 26436

SEQ ID NO: 398027 - RNA, 64 nt, Homo Sapiens; identical to SEQ ID NO: 26437

SEQ ID NO: 398028 - RNA, 64 nt, Homo Sapiens; identical to SEQ ID NO: 26438

SEQ ID NO: 398029 - RNA, 64 nt, Homo Sapiens; identical to SEQ ID NO: 26439

SEQ ID NO: 398030 - RNA, 64 nt, Homo Sapiens; identical to SEQ ID NO: 26440

SEQ ID NO: 398031 - RNA, 64 nt, Homo Sapiens; identical to SEQ ID NO: 26441

SEQ ID NO: 398032 - RNA, 64 nt, Homo Sapiens; identical to SEQ ID NO: 26442

SEQ ID NO: 398033 - RNA, 64 nt, Homo Sapiens; identical to SEQ ID NO: 26443

SEQ ID NO: 398034 - RNA, 64 nt, Homo Sapiens; identical to SEQ ID NO: 26444

SEQ ID NO: 398035 - RNA, 64 nt, Homo Sapiens; identical to SEQ ID NO: 26445

SEQ ID NO: 398036 - RNA, 64 nt, Homo Sapiens; identical to SEQ ID NO: 26446

SEQ ID NO: 398037 - RNA, 64 nt, Homo Sapiens; identical to SEQ ID NO: 26447

SEQ ID NO: 398038 - RNA, 64 nt, Homo Sapiens; identical to SEQ ID NO: 26448

SEQ ID NO: 398039 - RNA, 64 nt, Homo Sapiens; identical to SEQ ID NO: 26449

SEQ ID NO: 398040 - RNA, 64 nt, Homo Sapiens; identical to SEQ ID NO: 26450

SEQ ID NO: 398041 - RNA, 64 nt, Homo Sapiens; identical to SEQ ID NO: 26451

SEQ ID NO: 398042 - RNA, 64 nt, Homo Sapiens; identical to SEQ ID NO: 26452

SEQ ID NO: 398043 - RNA, 64 nt, Homo Sapiens; identical to SEQ ID NO: 26453

SEQ ID NO: 398044 - RNA, 64 nt, Homo Sapiens; identical to SEQ ID NO: 26454

SEQ ID NO: 398045 - RNA, 64 nt, Homo Sapiens; identical to SEQ ID NO: 26455

SEQ ID NO: 398046 - RNA, 64 nt, Homo Sapiens; identical to SEQ ID NO: 26456

SEQ ID NO: 398047 - RNA, 64 nt, Homo Sapiens; identical to SEQ ID NO: 26457

SEQ ID NO: 398048 - RNA, 64 nt, Homo Sapiens; identical to SEQ ID NO: 26458

SEQ ID NO: 398049 - RNA, 64 nt, Homo Sapiens; identical to SEQ ID NO: 26459

SEQ ID NO: 398050 - RNA, 64 nt, Homo Sapiens; identical to SEQ ID NO: 26460

SEQ ID NO: 398051 - RNA, 64 nt, Homo Sapiens; identical to SEQ ID NO: 26461

SEQ ID NO: 398052 - RNA, 64 nt, Homo Sapiens; identical to SEQ ID NO: 26462

SEQ ID NO: 398053 - RNA, 64 nt, Homo Sapiens; identical to SEQ ID NO: 26463

SEQ ID NO: 398054 - RNA, 64 nt, Homo Sapiens; identical to SEQ ID NO: 26464

SEQ ID NO: 398055 - RNA, 64 nt, Homo Sapiens; identical to SEQ ID NO: 26465

SEQ ID NO: 398056 - RNA, 64 nt, Homo Sapiens; identical to SEQ ID NO: 26466

SEQ ID NO: 398057 - RNA, 64 nt, Homo Sapiens; identical to SEQ ID NO: 26467

SEQ ID NO: 398058 - RNA, 64 nt, Homo Sapiens; identical to SEQ ID NO: 26468

SEQ ID NO: 398059 - RNA, 64 nt, Homo Sapiens; identical to SEQ ID NO: 26469

SEQ ID NO: 398060 - RNA, 64 nt, Homo Sapiens; identical to SEQ ID NO: 26470

SEQ ID NO: 398061 - RNA, 64 nt, Homo Sapiens; identical to SEQ ID NO: 26471

SEQ ID NO: 398062 - RNA, 64 nt, Homo Sapiens; identical to SEQ ID NO: 26472

SEQ ID NO: 398063 - RNA, 64 nt, Homo Sapiens; identical to SEQ ID NO: 26473

SEQ ID NO: 398064 - RNA, 64 nt, Homo Sapiens; identical to SEQ ID NO: 26474

SEQ ID NO: 398065 - RNA, 64 nt, Homo Sapiens; identical to SEQ ID NO: 26475

SEQ ID NO: 398066 - RNA, 64 nt, Homo Sapiens; identical to SEQ ID NO: 26476

SEQ ID NO: 398067 - RNA, 64 nt, Homo Sapiens; identical to SEQ ID NO: 26477

SEQ ID NO: 398068 - RNA, 64 nt, Homo Sapiens; identical to SEQ ID NO: 26478

SEQ ID NO: 398069 - RNA, 64 nt, Homo Sapiens; identical to SEQ ID NO: 26479

SEQ ID NO: 398070 - RNA, 64 nt, Homo Sapiens; identical to SEQ ID NO: 26480

SEQ ID NO: 398071 - RNA, 64 nt, Homo Sapiens; identical to SEQ ID NO: 26481

SEQ ID NO: 398072 - RNA, 63 nt, Homo Sapiens; identical to SEQ ID NO: 26482

SEQ ID NO: 398073 - RNA, 63 nt, Homo Sapiens; identical to SEQ ID NO: 26483

SEQ ID NO: 398074 - RNA, 64 nt, Homo Sapiens; identical to SEQ ID NO: 26484

SEQ ID NO: 398075 - RNA, 64 nt, Homo Sapiens; identical to SEQ ID NO: 26485

SEQ ID NO: 398076 - RNA, 64 nt, Homo Sapiens; identical to SEQ ID NO: 26486

SEQ ID NO: 398077 - RNA, 64 nt, Homo Sapiens; identical to SEQ ID NO: 26487

SEQ ID NO: 398078 - RNA, 64 nt, Homo Sapiens; identical to SEQ ID NO: 26488

SEQ ID NO: 398079 - RNA, 64 nt, Homo Sapiens; identical to SEQ ID NO: 26489

SEQ ID NO: 398080 - RNA, 64 nt, Homo Sapiens; identical to SEQ ID NO: 26490

SEQ ID NO: 398081 - RNA, 64 nt, Homo Sapiens; identical to SEQ ID NO: 26491

SEQ ID NO: 398082 - RNA, 64 nt, Homo Sapiens; identical to SEQ ID NO: 26492

SEQ ID NO: 398083 - RNA, 64 nt, Homo Sapiens; identical to SEQ ID NO: 26493

SEQ ID NO: 398084 - RNA, 64 nt, Homo Sapiens; identical to SEQ ID NO: 26494

SEQ ID NO: 398085 - RNA, 64 nt, Homo Sapiens; identical to SEQ ID NO: 26495

SEQ ID NO: 398086 - RNA, 64 nt, Homo Sapiens; identical to SEQ ID NO: 26496

SEQ ID NO: 398087 - RNA, 64 nt, Homo Sapiens; identical to SEQ ID NO: 26497

SEQ ID NO: 398088 - RNA, 64 nt, Homo Sapiens; identical to SEQ ID NO: 26498

SEQ ID NO: 398089 - RNA, 64 nt, Homo Sapiens; identical to SEQ ID NO: 26499

SEQ ID NO: 398090 - RNA, 64 nt, Homo Sapiens; identical to SEQ ID NO: 26500

SEQ ID NO: 398091 - RNA, 64 nt, Homo Sapiens; identical to SEQ ID NO: 26501

SEQ ID NO: 398092 - RNA, 64 nt, Homo Sapiens; identical to SEQ ID NO: 26502

SEQ ID NO: 398093 - RNA, 64 nt, Homo Sapiens; identical to SEQ ID NO: 26503

SEQ ID NO: 398094 - RNA, 64 nt, Homo Sapiens; identical to SEQ ID NO: 26504

SEQ ID NO: 398095 - RNA, 64 nt, Homo Sapiens; identical to SEQ ID NO: 26505

SEQ ID NO: 398096 - RNA, 64 nt, Homo Sapiens; identical to SEQ ID NO: 26506

SEQ ID NO: 398097 - RNA, 64 nt, Homo Sapiens; identical to SEQ ID NO: 26507

SEQ ID NO: 398098 - RNA, 64 nt, Homo Sapiens; identical to SEQ ID NO: 26508

SEQ ID NO: 398099 - RNA, 64 nt, Homo Sapiens; identical to SEQ ID NO: 26509

SEQ ID NO: 398100 - RNA, 64 nt, Homo Sapiens; identical to SEQ ID NO: 26510

SEQ ID NO: 398101 - RNA, 64 nt, Homo Sapiens; identical to SEQ ID NO: 26511

SEQ ID NO: 398102 - RNA, 64 nt, Homo Sapiens; identical to SEQ ID NO: 26512

SEQ ID NO: 398103 - RNA, 64 nt, Homo Sapiens; identical to SEQ ID NO: 26513

SEQ ID NO: 398104 - RNA, 64 nt, Homo Sapiens; identical to SEQ ID NO: 26514

SEQ ID NO: 398105 - RNA, 64 nt, Homo Sapiens; identical to SEQ ID NO: 26515

SEQ ID NO: 398106 - RNA, 64 nt, Homo Sapiens; identical to SEQ ID NO: 26516

SEQ ID NO: 398107 - RNA, 64 nt, Homo Sapiens; identical to SEQ ID NO: 26517

SEQ ID NO: 398108 - RNA, 64 nt, Homo Sapiens; identical to SEQ ID NO: 26518

SEQ ID NO: 398109 - RNA, 64 nt, Homo Sapiens; identical to SEQ ID NO: 26519

SEQ ID NO: 398110 - RNA, 64 nt, Homo Sapiens; identical to SEQ ID NO: 26520

SEQ ID NO: 398111 - RNA, 64 nt, Homo Sapiens; identical to SEQ ID NO: 26521

SEQ ID NO: 398112 - RNA, 64 nt, Homo Sapiens; identical to SEQ ID NO: 26522

SEQ ID NO: 398113 - RNA, 64 nt, Homo Sapiens; identical to SEQ ID NO: 26523

SEQ ID NO: 398114 - RNA, 64 nt, Homo Sapiens; identical to SEQ ID NO: 26524

SEQ ID NO: 398115 - RNA, 64 nt, Homo Sapiens; identical to SEQ ID NO: 26525

SEQ ID NO: 398116 - RNA, 64 nt, Homo Sapiens; identical to SEQ ID NO: 26526

SEQ ID NO: 398117 - RNA, 64 nt, Homo Sapiens; identical to SEQ ID NO: 26527

SEQ ID NO: 398118 - RNA, 64 nt, Homo Sapiens; identical to SEQ ID NO: 26528

SEQ ID NO: 398119 - RNA, 64 nt, Homo Sapiens; identical to SEQ ID NO: 26529

SEQ ID NO: 398120 - RNA, 64 nt, Homo Sapiens; identical to SEQ ID NO: 26530

SEQ ID NO: 398121 - RNA, 64 nt, Homo Sapiens; identical to SEQ ID NO: 26531

SEQ ID NO: 398122 - RNA, 64 nt, Homo Sapiens; identical to SEQ ID NO: 26532

SEQ ID NO: 398123 - RNA, 64 nt, Homo Sapiens; identical to SEQ ID NO: 26533

SEQ ID NO: 398124 - RNA, 64 nt, Homo Sapiens; identical to SEQ ID NO: 26534

SEQ ID NO: 398125 - RNA, 64 nt, Homo Sapiens; identical to SEQ ID NO: 26535

SEQ ID NO: 398126 - RNA, 64 nt, Homo Sapiens; identical to SEQ ID NO: 26536

SEQ ID NO: 398127 - RNA, 64 nt, Homo Sapiens; identical to SEQ ID NO: 26537

SEQ ID NO: 398128 - RNA, 64 nt, Homo Sapiens; identical to SEQ ID NO: 26538

SEQ ID NO: 398129 - RNA, 64 nt, Homo Sapiens; identical to SEQ ID NO: 26539

SEQ ID NO: 398130 - RNA, 64 nt, Homo Sapiens; identical to SEQ ID NO: 26540

SEQ ID NO: 398131 - RNA, 64 nt, Homo Sapiens; identical to SEQ ID NO: 26541

SEQ ID NO: 398132 - RNA, 64 nt, Homo Sapiens; identical to SEQ ID NO: 26542

SEQ ID NO: 398133 - RNA, 64 nt, Homo Sapiens; identical to SEQ ID NO: 26543

SEQ ID NO: 398134 - RNA, 64 nt, Homo Sapiens; identical to SEQ ID NO: 26544

SEQ ID NO: 398135 - RNA, 64 nt, Homo Sapiens; identical to SEQ ID NO: 26545

SEQ ID NO: 398136 - RNA, 64 nt, Homo Sapiens; identical to SEQ ID NO: 26546

SEQ ID NO: 398137 - RNA, 64 nt, Homo Sapiens; identical to SEQ ID NO: 26547

SEQ ID NO: 398138 - RNA, 64 nt, Homo Sapiens; identical to SEQ ID NO: 26548

SEQ ID NO: 398139 - RNA, 64 nt, Homo Sapiens; identical to SEQ ID NO: 26549

SEQ ID NO: 398140 - RNA, 64 nt, Homo Sapiens; identical to SEQ ID NO: 26550

SEQ ID NO: 398141 - RNA, 64 nt, Homo Sapiens; identical to SEQ ID NO: 26551

SEQ ID NO: 398142 - RNA, 64 nt, Homo Sapiens; identical to SEQ ID NO: 26552

SEQ ID NO: 398143 - RNA, 64 nt, Homo Sapiens; identical to SEQ ID NO: 26553

SEQ ID NO: 398144 - RNA, 64 nt, Homo Sapiens; identical to SEQ ID NO: 26554

SEQ ID NO: 398145 - RNA, 64 nt, Homo Sapiens; identical to SEQ ID NO: 26555

SEQ ID NO: 398146 - RNA, 64 nt, Homo Sapiens; identical to SEQ ID NO: 26556

SEQ ID NO: 398147 - RNA, 64 nt, Homo Sapiens; identical to SEQ ID NO: 26557

SEQ ID NO: 398148 - RNA, 64 nt, Homo Sapiens; identical to SEQ ID NO: 26558

SEQ ID NO: 398149 - RNA, 50 nt, Homo Sapiens; identical to SEQ ID NO: 26559

SEQ ID NO: 398150 - RNA, 51 nt, Homo Sapiens; identical to SEQ ID NO: 26560

SEQ ID NO: 398151 - RNA, 52 nt, Homo Sapiens; identical to SEQ ID NO: 26561

SEQ ID NO: 398152 - RNA, 53 nt, Homo Sapiens; identical to SEQ ID NO: 26562

SEQ ID NO: 398153 - RNA, 54 nt, Homo Sapiens; identical to SEQ ID NO: 26563

SEQ ID NO: 398154 - RNA, 64 nt, Homo Sapiens; identical to SEQ ID NO: 26564

SEQ ID NO: 398155 - RNA, 64 nt, Homo Sapiens; identical to SEQ ID NO: 26565

SEQ ID NO: 398156 - RNA, 64 nt, Homo Sapiens; identical to SEQ ID NO: 26566

SEQ ID NO: 398157 - RNA, 64 nt, Homo Sapiens; identical to SEQ ID NO: 26567

SEQ ID NO: 398158 - RNA, 64 nt, Homo Sapiens; identical to SEQ ID NO: 26568

SEQ ID NO: 398159 - RNA, 64 nt, Homo Sapiens; identical to SEQ ID NO: 26569

SEQ ID NO: 398160 - RNA, 64 nt, Homo Sapiens; identical to SEQ ID NO: 26570

SEQ ID NO: 398161 - RNA, 64 nt, Homo Sapiens; identical to SEQ ID NO: 26571

SEQ ID NO: 398162 - RNA, 64 nt, Homo Sapiens; identical to SEQ ID NO: 26572

SEQ ID NO: 398163 - RNA, 64 nt, Homo Sapiens; identical to SEQ ID NO: 26573

SEQ ID NO: 398164 - RNA, 64 nt, Homo Sapiens; identical to SEQ ID NO: 26574

SEQ ID NO: 398165 - RNA, 64 nt, Homo Sapiens; identical to SEQ ID NO: 26575

SEQ ID NO: 398166 - RNA, 64 nt, Homo Sapiens; identical to SEQ ID NO: 26576

SEQ ID NO: 398167 - RNA, 64 nt, Homo Sapiens; identical to SEQ ID NO: 26577

SEQ ID NO: 398168 - RNA, 64 nt, Homo Sapiens; identical to SEQ ID NO: 26578

SEQ ID NO: 398169 - RNA, 64 nt, Homo Sapiens; identical to SEQ ID NO: 26579

SEQ ID NO: 398170 - RNA, 64 nt, Homo Sapiens; identical to SEQ ID NO: 26580

SEQ ID NO: 398171 - RNA, 64 nt, Homo Sapiens; identical to SEQ ID NO: 26581

SEQ ID NO: 398172 - RNA, 64 nt, Homo Sapiens; identical to SEQ ID NO: 26582

SEQ ID NO: 398173 - RNA, 64 nt, Homo Sapiens; identical to SEQ ID NO: 26583

SEQ ID NO: 398174 - RNA, 64 nt, Homo Sapiens; identical to SEQ ID NO: 26584

SEQ ID NO: 398175 - RNA, 64 nt, Homo Sapiens; identical to SEQ ID NO: 26585

SEQ ID NO: 398176 - RNA, 64 nt, Homo Sapiens; identical to SEQ ID NO: 26586

SEQ ID NO: 398177 - RNA, 64 nt, Homo Sapiens; identical to SEQ ID NO: 26587

SEQ ID NO: 398178 - RNA, 64 nt, Homo Sapiens; identical to SEQ ID NO: 26588

SEQ ID NO: 398179 - RNA, 64 nt, Homo Sapiens; identical to SEQ ID NO: 26589

SEQ ID NO: 398180 - RNA, 64 nt, Homo Sapiens; identical to SEQ ID NO: 26590

SEQ ID NO: 398181 - RNA, 64 nt, Homo Sapiens; identical to SEQ ID NO: 26591

SEQ ID NO: 398182 - RNA, 64 nt, Homo Sapiens; identical to SEQ ID NO: 26592

SEQ ID NO: 398183 - RNA, 64 nt, Homo Sapiens; identical to SEQ ID NO: 26593

SEQ ID NO: 398184 - RNA, 64 nt, Homo Sapiens; identical to SEQ ID NO: 26594

SEQ ID NO: 398185 - RNA, 64 nt, Homo Sapiens; identical to SEQ ID NO: 26595

SEQ ID NO: 398186 - RNA, 64 nt, Homo Sapiens; identical to SEQ ID NO: 26596

SEQ ID NO: 398187 - RNA, 64 nt, Homo Sapiens; identical to SEQ ID NO: 26597

SEQ ID NO: 398188 - RNA, 64 nt, Homo Sapiens; identical to SEQ ID NO: 26598

SEQ ID NO: 398189 - RNA, 64 nt, Homo Sapiens; identical to SEQ ID NO: 26599

SEQ ID NO: 398190 - RNA, 64 nt, Homo Sapiens; identical to SEQ ID NO: 26600

SEQ ID NO: 398191 - RNA, 64 nt, Homo Sapiens; identical to SEQ ID NO: 26601

SEQ ID NO: 398192 - RNA, 64 nt, Homo Sapiens; identical to SEQ ID NO: 26602

SEQ ID NO: 398193 - RNA, 64 nt, Homo Sapiens; identical to SEQ ID NO: 26603

SEQ ID NO: 398194 - RNA, 64 nt, Homo Sapiens; identical to SEQ ID NO: 26604

SEQ ID NO: 398195 - RNA, 64 nt, Homo Sapiens; identical to SEQ ID NO: 26605

SEQ ID NO: 398196 - RNA, 64 nt, Homo Sapiens; identical to SEQ ID NO: 26606

SEQ ID NO: 398197 - RNA, 64 nt, Homo Sapiens; identical to SEQ ID NO: 26607

SEQ ID NO: 398198 - RNA, 64 nt, Homo Sapiens; identical to SEQ ID NO: 26608

SEQ ID NO: 398199 - RNA, 64 nt, Homo Sapiens; identical to SEQ ID NO: 26609

SEQ ID NO: 398200 - RNA, 64 nt, Homo Sapiens; identical to SEQ ID NO: 26610

SEQ ID NO: 398201 - RNA, 64 nt, Homo Sapiens; identical to SEQ ID NO: 26611

SEQ ID NO: 398202 - RNA, 64 nt, Homo Sapiens; identical to SEQ ID NO: 26612

SEQ ID NO: 398203 - RNA, 64 nt, Homo Sapiens; identical to SEQ ID NO: 26613

SEQ ID NO: 398204 - RNA, 64 nt, Homo Sapiens; identical to SEQ ID NO: 26614

SEQ ID NO: 398205 - RNA, 64 nt, Homo Sapiens; identical to SEQ ID NO: 26615

SEQ ID NO: 398206 - RNA, 64 nt, Homo Sapiens; identical to SEQ ID NO: 26616

SEQ ID NO: 398207 - RNA, 64 nt, Homo Sapiens; identical to SEQ ID NO: 26617

SEQ ID NO: 398208 - RNA, 64 nt, Homo Sapiens; identical to SEQ ID NO: 26618

SEQ ID NO: 398209 - RNA, 64 nt, Homo Sapiens; identical to SEQ ID NO: 26619

SEQ ID NO: 398210 - RNA, 64 nt, Homo Sapiens; identical to SEQ ID NO: 26620

SEQ ID NO: 398211 - RNA, 64 nt, Homo Sapiens; identical to SEQ ID NO: 26621

SEQ ID NO: 398212 - RNA, 64 nt, Homo Sapiens; identical to SEQ ID NO: 26622

SEQ ID NO: 398213 - RNA, 64 nt, Homo Sapiens; identical to SEQ ID NO: 26623

SEQ ID NO: 398214 - RNA, 64 nt, Homo Sapiens; identical to SEQ ID NO: 26624

SEQ ID NO: 398215 - RNA, 64 nt, Homo Sapiens; identical to SEQ ID NO: 26625

SEQ ID NO: 398216 - RNA, 64 nt, Homo Sapiens; identical to SEQ ID NO: 26626

SEQ ID NO: 398217 - RNA, 64 nt, Homo Sapiens; identical to SEQ ID NO: 26627

SEQ ID NO: 398218 - RNA, 64 nt, Homo Sapiens; identical to SEQ ID NO: 26628

SEQ ID NO: 398219 - RNA, 64 nt, Homo Sapiens; identical to SEQ ID NO: 26629

SEQ ID NO: 398220 - RNA, 64 nt, Homo Sapiens; identical to SEQ ID NO: 26630

SEQ ID NO: 398221 - RNA, 64 nt, Homo Sapiens; identical to SEQ ID NO: 26631

SEQ ID NO: 398222 - RNA, 64 nt, Homo Sapiens; identical to SEQ ID NO: 26632

SEQ ID NO: 398223 - RNA, 64 nt, Homo Sapiens; identical to SEQ ID NO: 26633

SEQ ID NO: 398224 - RNA, 64 nt, Homo Sapiens; identical to SEQ ID NO: 26634

SEQ ID NO: 398225 - RNA, 64 nt, Homo Sapiens; identical to SEQ ID NO: 26635

SEQ ID NO: 398226 - RNA, 64 nt, Homo Sapiens; identical to SEQ ID NO: 26636

SEQ ID NO: 398227 - RNA, 64 nt, Homo Sapiens; identical to SEQ ID NO: 26637

SEQ ID NO: 398228 - RNA, 64 nt, Homo Sapiens; identical to SEQ ID NO: 26638

SEQ ID NO: 398229 - RNA, 64 nt, Homo Sapiens; identical to SEQ ID NO: 26639

SEQ ID NO: 398230 - RNA, 64 nt, Homo Sapiens; identical to SEQ ID NO: 26640

SEQ ID NO: 398231 - RNA, 64 nt, Homo Sapiens; identical to SEQ ID NO: 26641

SEQ ID NO: 398232 - RNA, 64 nt, Homo Sapiens; identical to SEQ ID NO: 26642

SEQ ID NO: 398233 - RNA, 64 nt, Homo Sapiens; identical to SEQ ID NO: 26643

SEQ ID NO: 398234 - RNA, 64 nt, Homo Sapiens; identical to SEQ ID NO: 26644

SEQ ID NO: 398235 - RNA, 64 nt, Homo Sapiens; identical to SEQ ID NO: 26645

SEQ ID NO: 398236 - RNA, 64 nt, Homo Sapiens; identical to SEQ ID NO: 26646

SEQ ID NO: 398237 - RNA, 64 nt, Homo Sapiens; identical to SEQ ID NO: 26647

SEQ ID NO: 398238 - RNA, 64 nt, Homo Sapiens; identical to SEQ ID NO: 26648

SEQ ID NO: 398239 - RNA, 64 nt, Homo Sapiens; identical to SEQ ID NO: 26649

SEQ ID NO: 398240 - RNA, 64 nt, Homo Sapiens; identical to SEQ ID NO: 26650

SEQ ID NO: 398241 - RNA, 64 nt, Homo Sapiens; identical to SEQ ID NO: 26651

SEQ ID NO: 398242 - RNA, 64 nt, Homo Sapiens; identical to SEQ ID NO: 26652

SEQ ID NO: 398243 - RNA, 64 nt, Homo Sapiens; identical to SEQ ID NO: 26653

SEQ ID NO: 398244 - RNA, 64 nt, Homo Sapiens; identical to SEQ ID NO: 26654

SEQ ID NO: 398245 - RNA, 59 nt, Homo Sapiens; identical to SEQ ID NO: 26655

SEQ ID NO: 398246 - RNA, 60 nt, Homo Sapiens; identical to SEQ ID NO: 26656

SEQ ID NO: 398247 - RNA, 64 nt, Homo Sapiens; identical to SEQ ID NO: 26657

SEQ ID NO: 398248 - RNA, 64 nt, Homo Sapiens; identical to SEQ ID NO: 26658

SEQ ID NO: 398249 - RNA, 64 nt, Homo Sapiens; identical to SEQ ID NO: 26659

SEQ ID NO: 398250 - RNA, 64 nt, Homo Sapiens; identical to SEQ ID NO: 26660

SEQ ID NO: 398251 - RNA, 64 nt, Homo Sapiens; identical to SEQ ID NO: 26661

SEQ ID NO: 398252 - RNA, 64 nt, Homo Sapiens; identical to SEQ ID NO: 26662

SEQ ID NO: 398253 - RNA, 64 nt, Homo Sapiens; identical to SEQ ID NO: 26663

SEQ ID NO: 398254 - RNA, 64 nt, Homo Sapiens; identical to SEQ ID NO: 26664

SEQ ID NO: 398255 - RNA, 64 nt, Homo Sapiens; identical to SEQ ID NO: 26665

SEQ ID NO: 398256 - RNA, 64 nt, Homo Sapiens; identical to SEQ ID NO: 26666

SEQ ID NO: 398257 - RNA, 64 nt, Homo Sapiens; identical to SEQ ID NO: 26667

SEQ ID NO: 398258 - RNA, 64 nt, Homo Sapiens; identical to SEQ ID NO: 26668

SEQ ID NO: 398259 - RNA, 64 nt, Homo Sapiens; identical to SEQ ID NO: 26669

SEQ ID NO: 398260 - RNA, 64 nt, Homo Sapiens; identical to SEQ ID NO: 26670

SEQ ID NO: 398261 - RNA, 64 nt, Homo Sapiens; identical to SEQ ID NO: 26671

SEQ ID NO: 398262 - RNA, 64 nt, Homo Sapiens; identical to SEQ ID NO: 26672

SEQ ID NO: 398263 - RNA, 64 nt, Homo Sapiens; identical to SEQ ID NO: 26673

SEQ ID NO: 398264 - RNA, 64 nt, Homo Sapiens; identical to SEQ ID NO: 26674

SEQ ID NO: 398265 - RNA, 64 nt, Homo Sapiens; identical to SEQ ID NO: 26675

SEQ ID NO: 398266 - RNA, 64 nt, Homo Sapiens; identical to SEQ ID NO: 26676

SEQ ID NO: 398267 - RNA, 64 nt, Homo Sapiens; identical to SEQ ID NO: 26677

SEQ ID NO: 398268 - RNA, 64 nt, Homo Sapiens; identical to SEQ ID NO: 26678

SEQ ID NO: 398269 - RNA, 64 nt, Homo Sapiens; identical to SEQ ID NO: 26679

SEQ ID NO: 398270 - RNA, 64 nt, Homo Sapiens; identical to SEQ ID NO: 26680

SEQ ID NO: 398271 - RNA, 64 nt, Homo Sapiens; identical to SEQ ID NO: 26681

SEQ ID NO: 398272 - RNA, 64 nt, Homo Sapiens; identical to SEQ ID NO: 26682

SEQ ID NO: 398273 - RNA, 64 nt, Homo Sapiens; identical to SEQ ID NO: 26683

SEQ ID NO: 398274 - RNA, 64 nt, Homo Sapiens; identical to SEQ ID NO: 26684

SEQ ID NO: 398275 - RNA, 64 nt, Homo Sapiens; identical to SEQ ID NO: 26685

SEQ ID NO: 398276 - RNA, 64 nt, Homo Sapiens; identical to SEQ ID NO: 26686

SEQ ID NO: 398277 - RNA, 64 nt, Homo Sapiens; identical to SEQ ID NO: 26687

SEQ ID NO: 398278 - RNA, 64 nt, Homo Sapiens; identical to SEQ ID NO: 26688

SEQ ID NO: 398279 - RNA, 64 nt, Homo Sapiens; identical to SEQ ID NO: 26689

SEQ ID NO: 398280 - RNA, 64 nt, Homo Sapiens; identical to SEQ ID NO: 26690

SEQ ID NO: 398281 - RNA, 64 nt, Homo Sapiens; identical to SEQ ID NO: 26691

SEQ ID NO: 398282 - RNA, 64 nt, Homo Sapiens; identical to SEQ ID NO: 26692

SEQ ID NO: 398283 - RNA, 64 nt, Homo Sapiens; identical to SEQ ID NO: 26693

SEQ ID NO: 398284 - RNA, 64 nt, Homo Sapiens; identical to SEQ ID NO: 26694

SEQ ID NO: 398285 - RNA, 64 nt, Homo Sapiens; identical to SEQ ID NO: 26695

SEQ ID NO: 398286 - RNA, 64 nt, Homo Sapiens; identical to SEQ ID NO: 26696

SEQ ID NO: 398287 - RNA, 64 nt, Homo Sapiens; identical to SEQ ID NO: 26697

SEQ ID NO: 398288 - RNA, 64 nt, Homo Sapiens; identical to SEQ ID NO: 26698

SEQ ID NO: 398289 - RNA, 64 nt, Homo Sapiens; identical to SEQ ID NO: 26699

SEQ ID NO: 398290 - RNA, 64 nt, Homo Sapiens; identical to SEQ ID NO: 26700

SEQ ID NO: 398291 - RNA, 64 nt, Homo Sapiens; identical to SEQ ID NO: 26701

SEQ ID NO: 398292 - RNA, 64 nt, Homo Sapiens; identical to SEQ ID NO: 26702

SEQ ID NO: 398293 - RNA, 64 nt, Homo Sapiens; identical to SEQ ID NO: 26703

SEQ ID NO: 398294 - RNA, 64 nt, Homo Sapiens; identical to SEQ ID NO: 26704

SEQ ID NO: 398295 - RNA, 64 nt, Homo Sapiens; identical to SEQ ID NO: 26705

SEQ ID NO: 398296 - RNA, 64 nt, Homo Sapiens; identical to SEQ ID NO: 26706

SEQ ID NO: 398297 - RNA, 64 nt, Homo Sapiens; identical to SEQ ID NO: 26707

SEQ ID NO: 398298 - RNA, 64 nt, Homo Sapiens; identical to SEQ ID NO: 26708

SEQ ID NO: 398299 - RNA, 64 nt, Homo Sapiens; identical to SEQ ID NO: 26709

SEQ ID NO: 398300 - RNA, 64 nt, Homo Sapiens; identical to SEQ ID NO: 26710

SEQ ID NO: 398301 - RNA, 64 nt, Homo Sapiens; identical to SEQ ID NO: 26711

SEQ ID NO: 398302 - RNA, 64 nt, Homo Sapiens; identical to SEQ ID NO: 26712

SEQ ID NO: 398303 - RNA, 64 nt, Homo Sapiens; identical to SEQ ID NO: 26713

SEQ ID NO: 398304 - RNA, 64 nt, Homo Sapiens; identical to SEQ ID NO: 26714

SEQ ID NO: 398305 - RNA, 64 nt, Homo Sapiens; identical to SEQ ID NO: 26715

SEQ ID NO: 398306 - RNA, 64 nt, Homo Sapiens; identical to SEQ ID NO: 26716

SEQ ID NO: 398307 - RNA, 64 nt, Homo Sapiens; identical to SEQ ID NO: 26717

SEQ ID NO: 398308 - RNA, 64 nt, Homo Sapiens; identical to SEQ ID NO: 26718

SEQ ID NO: 398309 - RNA, 64 nt, Homo Sapiens; identical to SEQ ID NO: 26719

SEQ ID NO: 398310 - RNA, 64 nt, Homo Sapiens; identical to SEQ ID NO: 26720

SEQ ID NO: 398311 - RNA, 64 nt, Homo Sapiens; identical to SEQ ID NO: 26721

SEQ ID NO: 398312 - RNA, 64 nt, Homo Sapiens; identical to SEQ ID NO: 26722

SEQ ID NO: 398313 - RNA, 64 nt, Homo Sapiens; identical to SEQ ID NO: 26723

SEQ ID NO: 398314 - RNA, 64 nt, Homo Sapiens; identical to SEQ ID NO: 26724

SEQ ID NO: 398315 - RNA, 64 nt, Homo Sapiens; identical to SEQ ID NO: 26725

SEQ ID NO: 398316 - RNA, 64 nt, Homo Sapiens; identical to SEQ ID NO: 26726

SEQ ID NO: 398317 - RNA, 64 nt, Homo Sapiens; identical to SEQ ID NO: 26727

SEQ ID NO: 398318 - RNA, 64 nt, Homo Sapiens; identical to SEQ ID NO: 26728

SEQ ID NO: 398319 - RNA, 64 nt, Homo Sapiens; identical to SEQ ID NO: 26729

SEQ ID NO: 398320 - RNA, 64 nt, Homo Sapiens; identical to SEQ ID NO: 26730

SEQ ID NO: 398321 - RNA, 64 nt, Homo Sapiens; identical to SEQ ID NO: 26731

SEQ ID NO: 398322 - RNA, 64 nt, Homo Sapiens; identical to SEQ ID NO: 26732

SEQ ID NO: 398323 - RNA, 64 nt, Homo Sapiens; identical to SEQ ID NO: 26733

SEQ ID NO: 398324 - RNA, 64 nt, Homo Sapiens; identical to SEQ ID NO: 26734

SEQ ID NO: 398325 - RNA, 64 nt, Homo Sapiens; identical to SEQ ID NO: 26735

SEQ ID NO: 398326 - RNA, 64 nt, Homo Sapiens; identical to SEQ ID NO: 26736

SEQ ID NO: 398327 - RNA, 64 nt, Homo Sapiens; identical to SEQ ID NO: 26737

SEQ ID NO: 398328 - RNA, 64 nt, Homo Sapiens; identical to SEQ ID NO: 26738

SEQ ID NO: 398329 - RNA, 64 nt, Homo Sapiens; identical to SEQ ID NO: 26739

SEQ ID NO: 398330 - RNA, 64 nt, Homo Sapiens; identical to SEQ ID NO: 26740

SEQ ID NO: 398331 - RNA, 64 nt, Homo Sapiens; identical to SEQ ID NO: 26741

SEQ ID NO: 398332 - RNA, 64 nt, Homo Sapiens; identical to SEQ ID NO: 26742

SEQ ID NO: 398333 - RNA, 64 nt, Homo Sapiens; identical to SEQ ID NO: 26743

SEQ ID NO: 398334 - RNA, 64 nt, Homo Sapiens; identical to SEQ ID NO: 26744

SEQ ID NO: 398335 - RNA, 64 nt, Homo Sapiens; identical to SEQ ID NO: 26745

SEQ ID NO: 398336 - RNA, 64 nt, Homo Sapiens; identical to SEQ ID NO: 26746

SEQ ID NO: 398337 - RNA, 64 nt, Homo Sapiens; identical to SEQ ID NO: 26747

SEQ ID NO: 398338 - RNA, 64 nt, Homo Sapiens; identical to SEQ ID NO: 26748

SEQ ID NO: 398339 - RNA, 64 nt, Homo Sapiens; identical to SEQ ID NO: 26749

SEQ ID NO: 398340 - RNA, 64 nt, Homo Sapiens; identical to SEQ ID NO: 26750

SEQ ID NO: 398341 - RNA, 64 nt, Homo Sapiens; identical to SEQ ID NO: 26751

SEQ ID NO: 398342 - RNA, 64 nt, Homo Sapiens; identical to SEQ ID NO: 26752

SEQ ID NO: 398343 - RNA, 64 nt, Homo Sapiens; identical to SEQ ID NO: 26753

SEQ ID NO: 398344 - RNA, 64 nt, Homo Sapiens; identical to SEQ ID NO: 26754

SEQ ID NO: 398345 - RNA, 64 nt, Homo Sapiens; identical to SEQ ID NO: 26755

SEQ ID NO: 398346 - RNA, 64 nt, Homo Sapiens; identical to SEQ ID NO: 26756

SEQ ID NO: 398347 - RNA, 64 nt, Homo Sapiens; identical to SEQ ID NO: 26757

SEQ ID NO: 398348 - RNA, 64 nt, Homo Sapiens; identical to SEQ ID NO: 26758

SEQ ID NO: 398349 - RNA, 64 nt, Homo Sapiens; identical to SEQ ID NO: 26759

SEQ ID NO: 398350 - RNA, 64 nt, Homo Sapiens; identical to SEQ ID NO: 26760

SEQ ID NO: 398351 - RNA, 64 nt, Homo Sapiens; identical to SEQ ID NO: 26761

SEQ ID NO: 398352 - RNA, 64 nt, Homo Sapiens; identical to SEQ ID NO: 26762

SEQ ID NO: 398353 - RNA, 64 nt, Homo Sapiens; identical to SEQ ID NO: 26763

SEQ ID NO: 398354 - RNA, 64 nt, Homo Sapiens; identical to SEQ ID NO: 26764

SEQ ID NO: 398355 - RNA, 64 nt, Homo Sapiens; identical to SEQ ID NO: 26765

SEQ ID NO: 398356 - RNA, 64 nt, Homo Sapiens; identical to SEQ ID NO: 26766

SEQ ID NO: 398357 - RNA, 64 nt, Homo Sapiens; identical to SEQ ID NO: 26767

SEQ ID NO: 398358 - RNA, 64 nt, Homo Sapiens; identical to SEQ ID NO: 26768

SEQ ID NO: 398359 - RNA, 64 nt, Homo Sapiens; identical to SEQ ID NO: 26769

SEQ ID NO: 398360 - RNA, 64 nt, Homo Sapiens; identical to SEQ ID NO: 26770

SEQ ID NO: 398361 - RNA, 64 nt, Homo Sapiens; identical to SEQ ID NO: 26771

SEQ ID NO: 398362 - RNA, 64 nt, Homo Sapiens; identical to SEQ ID NO: 26772

SEQ ID NO: 398363 - RNA, 64 nt, Homo Sapiens; identical to SEQ ID NO: 26773

SEQ ID NO: 398364 - RNA, 64 nt, Homo Sapiens; identical to SEQ ID NO: 26774

SEQ ID NO: 398365 - RNA, 64 nt, Homo Sapiens; identical to SEQ ID NO: 26775

SEQ ID NO: 398366 - RNA, 64 nt, Homo Sapiens; identical to SEQ ID NO: 26776

SEQ ID NO: 398367 - RNA, 64 nt, Homo Sapiens; identical to SEQ ID NO: 26777

SEQ ID NO: 398368 - RNA, 64 nt, Homo Sapiens; identical to SEQ ID NO: 26778

SEQ ID NO: 398369 - RNA, 64 nt, Homo Sapiens; identical to SEQ ID NO: 26779

SEQ ID NO: 398370 - RNA, 64 nt, Homo Sapiens; identical to SEQ ID NO: 26780

SEQ ID NO: 398371 - RNA, 64 nt, Homo Sapiens; identical to SEQ ID NO: 26781

SEQ ID NO: 398372 - RNA, 64 nt, Homo Sapiens; identical to SEQ ID NO: 26782

SEQ ID NO: 398373 - RNA, 64 nt, Homo Sapiens; identical to SEQ ID NO: 26783

SEQ ID NO: 398374 - RNA, 64 nt, Homo Sapiens; identical to SEQ ID NO: 26784

SEQ ID NO: 398375 - RNA, 64 nt, Homo Sapiens; identical to SEQ ID NO: 26785

SEQ ID NO: 398376 - RNA, 64 nt, Homo Sapiens; identical to SEQ ID NO: 26786

SEQ ID NO: 398377 - RNA, 64 nt, Homo Sapiens; identical to SEQ ID NO: 26787

SEQ ID NO: 398378 - RNA, 64 nt, Homo Sapiens; identical to SEQ ID NO: 26788

SEQ ID NO: 398379 - RNA, 64 nt, Homo Sapiens; identical to SEQ ID NO: 26789

SEQ ID NO: 398380 - RNA, 64 nt, Homo Sapiens; identical to SEQ ID NO: 26790

SEQ ID NO: 398381 - RNA, 64 nt, Homo Sapiens; identical to SEQ ID NO: 26791

SEQ ID NO: 398382 - RNA, 64 nt, Homo Sapiens; identical to SEQ ID NO: 26792

SEQ ID NO: 398383 - RNA, 64 nt, Homo Sapiens; identical to SEQ ID NO: 26793

SEQ ID NO: 398384 - RNA, 64 nt, Homo Sapiens; identical to SEQ ID NO: 26794

SEQ ID NO: 398385 - RNA, 64 nt, Homo Sapiens; identical to SEQ ID NO: 26795

SEQ ID NO: 398386 - RNA, 64 nt, Homo Sapiens; identical to SEQ ID NO: 26796

SEQ ID NO: 398387 - RNA, 64 nt, Homo Sapiens; identical to SEQ ID NO: 26797

SEQ ID NO: 398388 - RNA, 64 nt, Homo Sapiens; identical to SEQ ID NO: 26798

SEQ ID NO: 398389 - RNA, 64 nt, Homo Sapiens; identical to SEQ ID NO: 26799

SEQ ID NO: 398390 - RNA, 64 nt, Homo Sapiens; identical to SEQ ID NO: 26800

SEQ ID NO: 398391 - RNA, 64 nt, Homo Sapiens; identical to SEQ ID NO: 26801

SEQ ID NO: 398392 - RNA, 64 nt, Homo Sapiens; identical to SEQ ID NO: 26802

SEQ ID NO: 398393 - RNA, 64 nt, Homo Sapiens; identical to SEQ ID NO: 26803

SEQ ID NO: 398394 - RNA, 64 nt, Homo Sapiens; identical to SEQ ID NO: 26804

SEQ ID NO: 398395 - RNA, 64 nt, Homo Sapiens; identical to SEQ ID NO: 26805

SEQ ID NO: 398396 - RNA, 64 nt, Homo Sapiens; identical to SEQ ID NO: 26806

SEQ ID NO: 398397 - RNA, 64 nt, Homo Sapiens; identical to SEQ ID NO: 26807

SEQ ID NO: 398398 - RNA, 64 nt, Homo Sapiens; identical to SEQ ID NO: 26808

SEQ ID NO: 398399 - RNA, 64 nt, Homo Sapiens; identical to SEQ ID NO: 26809

SEQ ID NO: 398400 - RNA, 64 nt, Homo Sapiens; identical to SEQ ID NO: 26810

SEQ ID NO: 398401 - RNA, 64 nt, Homo Sapiens; identical to SEQ ID NO: 26811

SEQ ID NO: 398402 - RNA, 64 nt, Homo Sapiens; identical to SEQ ID NO: 26812

SEQ ID NO: 398403 - RNA, 64 nt, Homo Sapiens; identical to SEQ ID NO: 26813

SEQ ID NO: 398404 - RNA, 64 nt, Homo Sapiens; identical to SEQ ID NO: 26814

SEQ ID NO: 398405 - RNA, 64 nt, Homo Sapiens; identical to SEQ ID NO: 26815

SEQ ID NO: 398406 - RNA, 64 nt, Homo Sapiens; identical to SEQ ID NO: 26816

SEQ ID NO: 398407 - RNA, 64 nt, Homo Sapiens; identical to SEQ ID NO: 26817

SEQ ID NO: 398408 - RNA, 64 nt, Homo Sapiens; identical to SEQ ID NO: 26818

SEQ ID NO: 398409 - RNA, 64 nt, Homo Sapiens; identical to SEQ ID NO: 26819

SEQ ID NO: 398410 - RNA, 64 nt, Homo Sapiens; identical to SEQ ID NO: 26820

SEQ ID NO: 398411 - RNA, 64 nt, Homo Sapiens; identical to SEQ ID NO: 26821

SEQ ID NO: 398412 - RNA, 64 nt, Homo Sapiens; identical to SEQ ID NO: 26822

SEQ ID NO: 398413 - RNA, 64 nt, Homo Sapiens; identical to SEQ ID NO: 26823

SEQ ID NO: 398414 - RNA, 64 nt, Homo Sapiens; identical to SEQ ID NO: 26824

SEQ ID NO: 398415 - RNA, 64 nt, Homo Sapiens; identical to SEQ ID NO: 26825

SEQ ID NO: 398416 - RNA, 64 nt, Homo Sapiens; identical to SEQ ID NO: 26826

SEQ ID NO: 398417 - RNA, 64 nt, Homo Sapiens; identical to SEQ ID NO: 26827

SEQ ID NO: 398418 - RNA, 64 nt, Homo Sapiens; identical to SEQ ID NO: 26828

SEQ ID NO: 398419 - RNA, 64 nt, Homo Sapiens; identical to SEQ ID NO: 26829

SEQ ID NO: 398420 - RNA, 64 nt, Homo Sapiens; identical to SEQ ID NO: 26830

SEQ ID NO: 398421 - RNA, 64 nt, Homo Sapiens; identical to SEQ ID NO: 26831

SEQ ID NO: 398422 - RNA, 64 nt, Homo Sapiens; identical to SEQ ID NO: 26832

SEQ ID NO: 398423 - RNA, 64 nt, Homo Sapiens; identical to SEQ ID NO: 26833

SEQ ID NO: 398424 - RNA, 64 nt, Homo Sapiens; identical to SEQ ID NO: 26834

SEQ ID NO: 398425 - RNA, 64 nt, Homo Sapiens; identical to SEQ ID NO: 26835

SEQ ID NO: 398426 - RNA, 64 nt, Homo Sapiens; identical to SEQ ID NO: 26836

SEQ ID NO: 398427 - RNA, 64 nt, Homo Sapiens; identical to SEQ ID NO: 26837

SEQ ID NO: 398428 - RNA, 64 nt, Homo Sapiens; identical to SEQ ID NO: 26838

SEQ ID NO: 398429 - RNA, 64 nt, Homo Sapiens; identical to SEQ ID NO: 26839

SEQ ID NO: 398430 - RNA, 64 nt, Homo Sapiens; identical to SEQ ID NO: 26840

SEQ ID NO: 398431 - RNA, 64 nt, Homo Sapiens; identical to SEQ ID NO: 26841

SEQ ID NO: 398432 - RNA, 64 nt, Homo Sapiens; identical to SEQ ID NO: 26842

SEQ ID NO: 398433 - RNA, 64 nt, Homo Sapiens; identical to SEQ ID NO: 26843

SEQ ID NO: 398434 - RNA, 64 nt, Homo Sapiens; identical to SEQ ID NO: 26844

SEQ ID NO: 398435 - RNA, 64 nt, Homo Sapiens; identical to SEQ ID NO: 26845

SEQ ID NO: 398436 - RNA, 64 nt, Homo Sapiens; identical to SEQ ID NO: 26846

SEQ ID NO: 398437 - RNA, 64 nt, Homo Sapiens; identical to SEQ ID NO: 26847

SEQ ID NO: 398438 - RNA, 64 nt, Homo Sapiens; identical to SEQ ID NO: 26848

SEQ ID NO: 398439 - RNA, 64 nt, Homo Sapiens; identical to SEQ ID NO: 26849

SEQ ID NO: 398440 - RNA, 64 nt, Homo Sapiens; identical to SEQ ID NO: 26850

SEQ ID NO: 398441 - RNA, 64 nt, Homo Sapiens; identical to SEQ ID NO: 26851

SEQ ID NO: 398442 - RNA, 64 nt, Homo Sapiens; identical to SEQ ID NO: 26852

SEQ ID NO: 398443 - RNA, 64 nt, Homo Sapiens; identical to SEQ ID NO: 26853

SEQ ID NO: 398444 - RNA, 64 nt, Homo Sapiens; identical to SEQ ID NO: 26854

SEQ ID NO: 398445 - RNA, 64 nt, Homo Sapiens; identical to SEQ ID NO: 26855

SEQ ID NO: 398446 - RNA, 64 nt, Homo Sapiens; identical to SEQ ID NO: 26856

SEQ ID NO: 398447 - RNA, 64 nt, Homo Sapiens; identical to SEQ ID NO: 26857

SEQ ID NO: 398448 - RNA, 64 nt, Homo Sapiens; identical to SEQ ID NO: 26858

SEQ ID NO: 398449 - RNA, 64 nt, Homo Sapiens; identical to SEQ ID NO: 26859

SEQ ID NO: 398450 - RNA, 64 nt, Homo Sapiens; identical to SEQ ID NO: 26860

SEQ ID NO: 398451 - RNA, 64 nt, Homo Sapiens; identical to SEQ ID NO: 26861

SEQ ID NO: 398452 - RNA, 64 nt, Homo Sapiens; identical to SEQ ID NO: 26862

SEQ ID NO: 398453 - RNA, 55 nt, Homo Sapiens; identical to SEQ ID NO: 26863

SEQ ID NO: 398454 - RNA, 54 nt, Homo Sapiens; identical to SEQ ID NO: 26864

SEQ ID NO: 398455 - RNA, 53 nt, Homo Sapiens; identical to SEQ ID NO: 26865

SEQ ID NO: 398456 - RNA, 64 nt, Homo Sapiens; identical to SEQ ID NO: 26866

SEQ ID NO: 398457 - RNA, 64 nt, Homo Sapiens; identical to SEQ ID NO: 26867

SEQ ID NO: 398458 - RNA, 64 nt, Homo Sapiens; identical to SEQ ID NO: 26868

SEQ ID NO: 398459 - RNA, 64 nt, Homo Sapiens; identical to SEQ ID NO: 26869

SEQ ID NO: 398460 - RNA, 64 nt, Homo Sapiens; identical to SEQ ID NO: 26870

SEQ ID NO: 398461 - RNA, 64 nt, Homo Sapiens; identical to SEQ ID NO: 26871

SEQ ID NO: 398462 - RNA, 64 nt, Homo Sapiens; identical to SEQ ID NO: 26872

SEQ ID NO: 398463 - RNA, 64 nt, Homo Sapiens; identical to SEQ ID NO: 26873

SEQ ID NO: 398464 - RNA, 64 nt, Homo Sapiens; identical to SEQ ID NO: 26874

SEQ ID NO: 398465 - RNA, 64 nt, Homo Sapiens; identical to SEQ ID NO: 26875

SEQ ID NO: 398466 - RNA, 64 nt, Homo Sapiens; identical to SEQ ID NO: 26876

SEQ ID NO: 398467 - RNA, 64 nt, Homo Sapiens; identical to SEQ ID NO: 26877

SEQ ID NO: 398468 - RNA, 64 nt, Homo Sapiens; identical to SEQ ID NO: 26878

SEQ ID NO: 398469 - RNA, 64 nt, Homo Sapiens; identical to SEQ ID NO: 26879

SEQ ID NO: 398470 - RNA, 64 nt, Homo Sapiens; identical to SEQ ID NO: 26880

SEQ ID NO: 398471 - RNA, 64 nt, Homo Sapiens; identical to SEQ ID NO: 26881

SEQ ID NO: 398472 - RNA, 64 nt, Homo Sapiens; identical to SEQ ID NO: 26882

SEQ ID NO: 398473 - RNA, 64 nt, Homo Sapiens; identical to SEQ ID NO: 26883

SEQ ID NO: 398474 - RNA, 64 nt, Homo Sapiens; identical to SEQ ID NO: 26884

SEQ ID NO: 398475 - RNA, 64 nt, Homo Sapiens; identical to SEQ ID NO: 26885

SEQ ID NO: 398476 - RNA, 64 nt, Homo Sapiens; identical to SEQ ID NO: 26886

SEQ ID NO: 398477 - RNA, 64 nt, Homo Sapiens; identical to SEQ ID NO: 26887

SEQ ID NO: 398478 - RNA, 64 nt, Homo Sapiens; identical to SEQ ID NO: 26888

SEQ ID NO: 398479 - RNA, 64 nt, Homo Sapiens; identical to SEQ ID NO: 26889

SEQ ID NO: 398480 - RNA, 64 nt, Homo Sapiens; identical to SEQ ID NO: 26890

SEQ ID NO: 398481 - RNA, 64 nt, Homo Sapiens; identical to SEQ ID NO: 26891

SEQ ID NO: 398482 - RNA, 64 nt, Homo Sapiens; identical to SEQ ID NO: 26892

SEQ ID NO: 398483 - RNA, 64 nt, Homo Sapiens; identical to SEQ ID NO: 26893

SEQ ID NO: 398484 - RNA, 64 nt, Homo Sapiens; identical to SEQ ID NO: 26894

SEQ ID NO: 398485 - RNA, 64 nt, Homo Sapiens; identical to SEQ ID NO: 26895

SEQ ID NO: 398486 - RNA, 64 nt, Homo Sapiens; identical to SEQ ID NO: 26896

SEQ ID NO: 398487 - RNA, 64 nt, Homo Sapiens; identical to SEQ ID NO: 26897

SEQ ID NO: 398488 - RNA, 64 nt, Homo Sapiens; identical to SEQ ID NO: 26898

SEQ ID NO: 398489 - RNA, 64 nt, Homo Sapiens; identical to SEQ ID NO: 26899

SEQ ID NO: 398490 - RNA, 64 nt, Homo Sapiens; identical to SEQ ID NO: 26900

SEQ ID NO: 398491 - RNA, 64 nt, Homo Sapiens; identical to SEQ ID NO: 26901

SEQ ID NO: 398492 - RNA, 64 nt, Homo Sapiens; identical to SEQ ID NO: 26902

SEQ ID NO: 398493 - RNA, 64 nt, Homo Sapiens; identical to SEQ ID NO: 26903

SEQ ID NO: 398494 - RNA, 64 nt, Homo Sapiens; identical to SEQ ID NO: 26904

SEQ ID NO: 398495 - RNA, 64 nt, Homo Sapiens; identical to SEQ ID NO: 26905

SEQ ID NO: 398496 - RNA, 64 nt, Homo Sapiens; identical to SEQ ID NO: 26906

SEQ ID NO: 398497 - RNA, 64 nt, Homo Sapiens; identical to SEQ ID NO: 26907

SEQ ID NO: 398498 - RNA, 64 nt, Homo Sapiens; identical to SEQ ID NO: 26908

SEQ ID NO: 398499 - RNA, 64 nt, Homo Sapiens; identical to SEQ ID NO: 26909

SEQ ID NO: 398500 - RNA, 64 nt, Homo Sapiens; identical to SEQ ID NO: 26910

SEQ ID NO: 398501 - RNA, 64 nt, Homo Sapiens; identical to SEQ ID NO: 26911

SEQ ID NO: 398502 - RNA, 64 nt, Homo Sapiens; identical to SEQ ID NO: 26912

SEQ ID NO: 398503 - RNA, 64 nt, Homo Sapiens; identical to SEQ ID NO: 26913

SEQ ID NO: 398504 - RNA, 64 nt, Homo Sapiens; identical to SEQ ID NO: 26914

SEQ ID NO: 398505 - RNA, 64 nt, Homo Sapiens; identical to SEQ ID NO: 26915

SEQ ID NO: 398506 - RNA, 64 nt, Homo Sapiens; identical to SEQ ID NO: 26916

SEQ ID NO: 398507 - RNA, 64 nt, Homo Sapiens; identical to SEQ ID NO: 26917

SEQ ID NO: 398508 - RNA, 64 nt, Homo Sapiens; identical to SEQ ID NO: 26918

SEQ ID NO: 398509 - RNA, 64 nt, Homo Sapiens; identical to SEQ ID NO: 26919

SEQ ID NO: 398510 - RNA, 64 nt, Homo Sapiens; identical to SEQ ID NO: 26920

SEQ ID NO: 398511 - RNA, 64 nt, Homo Sapiens; identical to SEQ ID NO: 26921

SEQ ID NO: 398512 - RNA, 64 nt, Homo Sapiens; identical to SEQ ID NO: 26922

SEQ ID NO: 398513 - RNA, 64 nt, Homo Sapiens; identical to SEQ ID NO: 26923

SEQ ID NO: 398514 - RNA, 64 nt, Homo Sapiens; identical to SEQ ID NO: 26924

SEQ ID NO: 398515 - RNA, 64 nt, Homo Sapiens; identical to SEQ ID NO: 26925

SEQ ID NO: 398516 - RNA, 64 nt, Homo Sapiens; identical to SEQ ID NO: 26926

SEQ ID NO: 398517 - RNA, 64 nt, Homo Sapiens; identical to SEQ ID NO: 26927

SEQ ID NO: 398518 - RNA, 64 nt, Homo Sapiens; identical to SEQ ID NO: 26928

SEQ ID NO: 398519 - RNA, 64 nt, Homo Sapiens; identical to SEQ ID NO: 26929

SEQ ID NO: 398520 - RNA, 64 nt, Homo Sapiens; identical to SEQ ID NO: 26930

SEQ ID NO: 398521 - RNA, 64 nt, Homo Sapiens; identical to SEQ ID NO: 26931

SEQ ID NO: 398522 - RNA, 64 nt, Homo Sapiens; identical to SEQ ID NO: 26932

SEQ ID NO: 398523 - RNA, 64 nt, Homo Sapiens; identical to SEQ ID NO: 26933

SEQ ID NO: 398524 - RNA, 64 nt, Homo Sapiens; identical to SEQ ID NO: 26934

SEQ ID NO: 398525 - RNA, 64 nt, Homo Sapiens; identical to SEQ ID NO: 26935

SEQ ID NO: 398526 - RNA, 64 nt, Homo Sapiens; identical to SEQ ID NO: 26936

SEQ ID NO: 398527 - RNA, 64 nt, Homo Sapiens; identical to SEQ ID NO: 26937

SEQ ID NO: 398528 - RNA, 64 nt, Homo Sapiens; identical to SEQ ID NO: 26938

SEQ ID NO: 398529 - RNA, 64 nt, Homo Sapiens; identical to SEQ ID NO: 26939

SEQ ID NO: 398530 - RNA, 64 nt, Homo Sapiens; identical to SEQ ID NO: 26940

SEQ ID NO: 398531 - RNA, 64 nt, Homo Sapiens; identical to SEQ ID NO: 26941

SEQ ID NO: 398532 - RNA, 64 nt, Homo Sapiens; identical to SEQ ID NO: 26942

SEQ ID NO: 398533 - RNA, 64 nt, Homo Sapiens; identical to SEQ ID NO: 26943

SEQ ID NO: 398534 - RNA, 64 nt, Homo Sapiens; identical to SEQ ID NO: 26944

SEQ ID NO: 398535 - RNA, 64 nt, Homo Sapiens; identical to SEQ ID NO: 26945

SEQ ID NO: 398536 - RNA, 64 nt, Homo Sapiens; identical to SEQ ID NO: 26946

SEQ ID NO: 398537 - RNA, 64 nt, Homo Sapiens; identical to SEQ ID NO: 26947

SEQ ID NO: 398538 - RNA, 64 nt, Homo Sapiens; identical to SEQ ID NO: 26948

SEQ ID NO: 398539 - RNA, 64 nt, Homo Sapiens; identical to SEQ ID NO: 26949

SEQ ID NO: 398540 - RNA, 64 nt, Homo Sapiens; identical to SEQ ID NO: 26950

SEQ ID NO: 398541 - RNA, 64 nt, Homo Sapiens; identical to SEQ ID NO: 26951

SEQ ID NO: 398542 - RNA, 64 nt, Homo Sapiens; identical to SEQ ID NO: 26952

SEQ ID NO: 398543 - RNA, 64 nt, Homo Sapiens; identical to SEQ ID NO: 26953

SEQ ID NO: 398544 - RNA, 64 nt, Homo Sapiens; identical to SEQ ID NO: 26954

SEQ ID NO: 398545 - RNA, 64 nt, Homo Sapiens; identical to SEQ ID NO: 26955

SEQ ID NO: 398546 - RNA, 64 nt, Homo Sapiens; identical to SEQ ID NO: 26956

SEQ ID NO: 398547 - RNA, 64 nt, Homo Sapiens; identical to SEQ ID NO: 26957

SEQ ID NO: 398548 - RNA, 64 nt, Homo Sapiens; identical to SEQ ID NO: 26958

SEQ ID NO: 398549 - RNA, 64 nt, Homo Sapiens; identical to SEQ ID NO: 26959

SEQ ID NO: 398550 - RNA, 64 nt, Homo Sapiens; identical to SEQ ID NO: 26960

SEQ ID NO: 398551 - RNA, 64 nt, Homo Sapiens; identical to SEQ ID NO: 26961

SEQ ID NO: 398552 - RNA, 64 nt, Homo Sapiens; identical to SEQ ID NO: 26962

SEQ ID NO: 398553 - RNA, 64 nt, Homo Sapiens; identical to SEQ ID NO: 26963

SEQ ID NO: 398554 - RNA, 64 nt, Homo Sapiens; identical to SEQ ID NO: 26964

SEQ ID NO: 398555 - RNA, 64 nt, Homo Sapiens; identical to SEQ ID NO: 26965

SEQ ID NO: 398556 - RNA, 64 nt, Homo Sapiens; identical to SEQ ID NO: 26966

SEQ ID NO: 398557 - RNA, 64 nt, Homo Sapiens; identical to SEQ ID NO: 26967

SEQ ID NO: 398558 - RNA, 64 nt, Homo Sapiens; identical to SEQ ID NO: 26968

SEQ ID NO: 398559 - RNA, 64 nt, Homo Sapiens; identical to SEQ ID NO: 26969

SEQ ID NO: 398560 - RNA, 64 nt, Homo Sapiens; identical to SEQ ID NO: 26970

SEQ ID NO: 398561 - RNA, 64 nt, Homo Sapiens; identical to SEQ ID NO: 26971

SEQ ID NO: 398562 - RNA, 64 nt, Homo Sapiens; identical to SEQ ID NO: 26972

SEQ ID NO: 398563 - RNA, 64 nt, Homo Sapiens; identical to SEQ ID NO: 26973

SEQ ID NO: 398564 - RNA, 64 nt, Homo Sapiens; identical to SEQ ID NO: 26974

SEQ ID NO: 398565 - RNA, 64 nt, Homo Sapiens; identical to SEQ ID NO: 26975

SEQ ID NO: 398566 - RNA, 64 nt, Homo Sapiens; identical to SEQ ID NO: 26976

SEQ ID NO: 398567 - RNA, 64 nt, Homo Sapiens; identical to SEQ ID NO: 26977

SEQ ID NO: 398568 - RNA, 64 nt, Homo Sapiens; identical to SEQ ID NO: 26978

SEQ ID NO: 398569 - RNA, 64 nt, Homo Sapiens; identical to SEQ ID NO: 26979

SEQ ID NO: 398570 - RNA, 64 nt, Homo Sapiens; identical to SEQ ID NO: 26980

SEQ ID NO: 398571 - RNA, 64 nt, Homo Sapiens; identical to SEQ ID NO: 26981

SEQ ID NO: 398572 - RNA, 64 nt, Homo Sapiens; identical to SEQ ID NO: 26982

SEQ ID NO: 398573 - RNA, 64 nt, Homo Sapiens; identical to SEQ ID NO: 26983

SEQ ID NO: 398574 - RNA, 64 nt, Homo Sapiens; identical to SEQ ID NO: 26984

SEQ ID NO: 398575 - RNA, 64 nt, Homo Sapiens; identical to SEQ ID NO: 26985

SEQ ID NO: 398576 - RNA, 64 nt, Homo Sapiens; identical to SEQ ID NO: 26986

SEQ ID NO: 398577 - RNA, 64 nt, Homo Sapiens; identical to SEQ ID NO: 26987

SEQ ID NO: 398578 - RNA, 64 nt, Homo Sapiens; identical to SEQ ID NO: 26988

SEQ ID NO: 398579 - RNA, 64 nt, Homo Sapiens; identical to SEQ ID NO: 26989

SEQ ID NO: 398580 - RNA, 64 nt, Homo Sapiens; identical to SEQ ID NO: 26990

SEQ ID NO: 398581 - RNA, 64 nt, Homo Sapiens; identical to SEQ ID NO: 26991

SEQ ID NO: 398582 - RNA, 64 nt, Homo Sapiens; identical to SEQ ID NO: 26992

SEQ ID NO: 398583 - RNA, 64 nt, Homo Sapiens; identical to SEQ ID NO: 26993

SEQ ID NO: 398584 - RNA, 64 nt, Homo Sapiens; identical to SEQ ID NO: 26994

SEQ ID NO: 398585 - RNA, 64 nt, Homo Sapiens; identical to SEQ ID NO: 26995

SEQ ID NO: 398586 - RNA, 64 nt, Homo Sapiens; identical to SEQ ID NO: 26996

SEQ ID NO: 398587 - RNA, 64 nt, Homo Sapiens; identical to SEQ ID NO: 26997

SEQ ID NO: 398588 - RNA, 64 nt, Homo Sapiens; identical to SEQ ID NO: 26998

SEQ ID NO: 398589 - RNA, 64 nt, Homo Sapiens; identical to SEQ ID NO: 26999

SEQ ID NO: 398590 - RNA, 64 nt, Homo Sapiens; identical to SEQ ID NO: 27000

SEQ ID NO: 398591 - RNA, 64 nt, Homo Sapiens; identical to SEQ ID NO: 27001

SEQ ID NO: 398592 - RNA, 64 nt, Homo Sapiens; identical to SEQ ID NO: 27002

SEQ ID NO: 398593 - RNA, 64 nt, Homo Sapiens; identical to SEQ ID NO: 27003

SEQ ID NO: 398594 - RNA, 64 nt, Homo Sapiens; identical to SEQ ID NO: 27004

SEQ ID NO: 398595 - RNA, 64 nt, Homo Sapiens; identical to SEQ ID NO: 27005

SEQ ID NO: 398596 - RNA, 64 nt, Homo Sapiens; identical to SEQ ID NO: 27006

SEQ ID NO: 398597 - RNA, 64 nt, Homo Sapiens; identical to SEQ ID NO: 27007

SEQ ID NO: 398598 - RNA, 64 nt, Homo Sapiens; identical to SEQ ID NO: 27008

SEQ ID NO: 398599 - RNA, 64 nt, Homo Sapiens; identical to SEQ ID NO: 27009

SEQ ID NO: 398600 - RNA, 64 nt, Homo Sapiens; identical to SEQ ID NO: 27010

SEQ ID NO: 398601 - RNA, 64 nt, Homo Sapiens; identical to SEQ ID NO: 27011

SEQ ID NO: 398602 - RNA, 64 nt, Homo Sapiens; identical to SEQ ID NO: 27012

SEQ ID NO: 398603 - RNA, 64 nt, Homo Sapiens; identical to SEQ ID NO: 27013

SEQ ID NO: 398604 - RNA, 64 nt, Homo Sapiens; identical to SEQ ID NO: 27014

SEQ ID NO: 398605 - RNA, 64 nt, Homo Sapiens; identical to SEQ ID NO: 27015

SEQ ID NO: 398606 - RNA, 64 nt, Homo Sapiens; identical to SEQ ID NO: 27016

SEQ ID NO: 398607 - RNA, 64 nt, Homo Sapiens; identical to SEQ ID NO: 27017

SEQ ID NO: 398608 - RNA, 64 nt, Homo Sapiens; identical to SEQ ID NO: 27018

SEQ ID NO: 398609 - RNA, 64 nt, Homo Sapiens; identical to SEQ ID NO: 27019

SEQ ID NO: 398610 - RNA, 64 nt, Homo Sapiens; identical to SEQ ID NO: 27020

SEQ ID NO: 398611 - RNA, 64 nt, Homo Sapiens; identical to SEQ ID NO: 27021

SEQ ID NO: 398612 - RNA, 64 nt, Homo Sapiens; identical to SEQ ID NO: 27022

SEQ ID NO: 398613 - RNA, 64 nt, Homo Sapiens; identical to SEQ ID NO: 27023

SEQ ID NO: 398614 - RNA, 64 nt, Homo Sapiens; identical to SEQ ID NO: 27024

SEQ ID NO: 398615 - RNA, 64 nt, Homo Sapiens; identical to SEQ ID NO: 27025

SEQ ID NO: 398616 - RNA, 64 nt, Homo Sapiens; identical to SEQ ID NO: 27026

SEQ ID NO: 398617 - RNA, 64 nt, Homo Sapiens; identical to SEQ ID NO: 27027

SEQ ID NO: 398618 - RNA, 64 nt, Homo Sapiens; identical to SEQ ID NO: 27028

SEQ ID NO: 398619 - RNA, 64 nt, Homo Sapiens; identical to SEQ ID NO: 27029

SEQ ID NO: 398620 - RNA, 64 nt, Homo Sapiens; identical to SEQ ID NO: 27030

SEQ ID NO: 398621 - RNA, 64 nt, Homo Sapiens; identical to SEQ ID NO: 27031

SEQ ID NO: 398622 - RNA, 64 nt, Homo Sapiens; identical to SEQ ID NO: 27032

SEQ ID NO: 398623 - RNA, 64 nt, Homo Sapiens; identical to SEQ ID NO: 27033

SEQ ID NO: 398624 - RNA, 64 nt, Homo Sapiens; identical to SEQ ID NO: 27034

SEQ ID NO: 398625 - RNA, 64 nt, Homo Sapiens; identical to SEQ ID NO: 27035

SEQ ID NO: 398626 - RNA, 64 nt, Homo Sapiens; identical to SEQ ID NO: 27036

SEQ ID NO: 398627 - RNA, 64 nt, Homo Sapiens; identical to SEQ ID NO: 27037

SEQ ID NO: 398628 - RNA, 64 nt, Homo Sapiens; identical to SEQ ID NO: 27038

SEQ ID NO: 398629 - RNA, 64 nt, Homo Sapiens; identical to SEQ ID NO: 27039

SEQ ID NO: 398630 - RNA, 64 nt, Homo Sapiens; identical to SEQ ID NO: 27040

SEQ ID NO: 398631 - RNA, 64 nt, Homo Sapiens; identical to SEQ ID NO: 27041

SEQ ID NO: 398632 - RNA, 64 nt, Homo Sapiens; identical to SEQ ID NO: 27042

SEQ ID NO: 398633 - RNA, 64 nt, Homo Sapiens; identical to SEQ ID NO: 27043

SEQ ID NO: 398634 - RNA, 64 nt, Homo Sapiens; identical to SEQ ID NO: 27044

SEQ ID NO: 398635 - RNA, 64 nt, Homo Sapiens; identical to SEQ ID NO: 27045

SEQ ID NO: 398636 - RNA, 64 nt, Homo Sapiens; identical to SEQ ID NO: 27046

SEQ ID NO: 398637 - RNA, 64 nt, Homo Sapiens; identical to SEQ ID NO: 27047

SEQ ID NO: 398638 - RNA, 64 nt, Homo Sapiens; identical to SEQ ID NO: 27048

SEQ ID NO: 398639 - RNA, 64 nt, Homo Sapiens; identical to SEQ ID NO: 27049

SEQ ID NO: 398640 - RNA, 64 nt, Homo Sapiens; identical to SEQ ID NO: 27050

SEQ ID NO: 398641 - RNA, 64 nt, Homo Sapiens; identical to SEQ ID NO: 27051

SEQ ID NO: 398642 - RNA, 64 nt, Homo Sapiens; identical to SEQ ID NO: 27052

SEQ ID NO: 398643 - RNA, 64 nt, Homo Sapiens; identical to SEQ ID NO: 27053

SEQ ID NO: 398644 - RNA, 64 nt, Homo Sapiens; identical to SEQ ID NO: 27054

SEQ ID NO: 398645 - RNA, 64 nt, Homo Sapiens; identical to SEQ ID NO: 27055

SEQ ID NO: 398646 - RNA, 64 nt, Homo Sapiens; identical to SEQ ID NO: 27056

SEQ ID NO: 398647 - RNA, 64 nt, Homo Sapiens; identical to SEQ ID NO: 27057

SEQ ID NO: 398648 - RNA, 64 nt, Homo Sapiens; identical to SEQ ID NO: 27058

SEQ ID NO: 398649 - RNA, 64 nt, Homo Sapiens; identical to SEQ ID NO: 27059

SEQ ID NO: 398650 - RNA, 64 nt, Homo Sapiens; identical to SEQ ID NO: 27060

SEQ ID NO: 398651 - RNA, 64 nt, Homo Sapiens; identical to SEQ ID NO: 27061

SEQ ID NO: 398652 - RNA, 64 nt, Homo Sapiens; identical to SEQ ID NO: 27062

SEQ ID NO: 398653 - RNA, 64 nt, Homo Sapiens; identical to SEQ ID NO: 27063

SEQ ID NO: 398654 - RNA, 64 nt, Homo Sapiens; identical to SEQ ID NO: 27064

SEQ ID NO: 398655 - RNA, 64 nt, Homo Sapiens; identical to SEQ ID NO: 27065

SEQ ID NO: 398656 - RNA, 64 nt, Homo Sapiens; identical to SEQ ID NO: 27066

SEQ ID NO: 398657 - RNA, 64 nt, Homo Sapiens; identical to SEQ ID NO: 27067

SEQ ID NO: 398658 - RNA, 64 nt, Homo Sapiens; identical to SEQ ID NO: 27068

SEQ ID NO: 398659 - RNA, 64 nt, Homo Sapiens; identical to SEQ ID NO: 27069

SEQ ID NO: 398660 - RNA, 64 nt, Homo Sapiens; identical to SEQ ID NO: 27070

SEQ ID NO: 398661 - RNA, 64 nt, Homo Sapiens; identical to SEQ ID NO: 27071

SEQ ID NO: 398662 - RNA, 64 nt, Homo Sapiens; identical to SEQ ID NO: 27072

SEQ ID NO: 398663 - RNA, 64 nt, Homo Sapiens; identical to SEQ ID NO: 27073

SEQ ID NO: 398664 - RNA, 64 nt, Homo Sapiens; identical to SEQ ID NO: 27074

SEQ ID NO: 398665 - RNA, 64 nt, Homo Sapiens; identical to SEQ ID NO: 27075

SEQ ID NO: 398666 - RNA, 64 nt, Homo Sapiens; identical to SEQ ID NO: 27076

SEQ ID NO: 398667 - RNA, 64 nt, Homo Sapiens; identical to SEQ ID NO: 27077

SEQ ID NO: 398668 - RNA, 64 nt, Homo Sapiens; identical to SEQ ID NO: 27078

SEQ ID NO: 398669 - RNA, 64 nt, Homo Sapiens; identical to SEQ ID NO: 27079

SEQ ID NO: 398670 - RNA, 64 nt, Homo Sapiens; identical to SEQ ID NO: 27080

SEQ ID NO: 398671 - RNA, 64 nt, Homo Sapiens; identical to SEQ ID NO: 27081

SEQ ID NO: 398672 - RNA, 64 nt, Homo Sapiens; identical to SEQ ID NO: 27082

SEQ ID NO: 398673 - RNA, 64 nt, Homo Sapiens; identical to SEQ ID NO: 27083

SEQ ID NO: 398674 - RNA, 64 nt, Homo Sapiens; identical to SEQ ID NO: 27084

SEQ ID NO: 398675 - RNA, 64 nt, Homo Sapiens; identical to SEQ ID NO: 27085

SEQ ID NO: 398676 - RNA, 64 nt, Homo Sapiens; identical to SEQ ID NO: 27086

SEQ ID NO: 398677 - RNA, 64 nt, Homo Sapiens; identical to SEQ ID NO: 27087

SEQ ID NO: 398678 - RNA, 64 nt, Homo Sapiens; identical to SEQ ID NO: 27088

SEQ ID NO: 398679 - RNA, 64 nt, Homo Sapiens; identical to SEQ ID NO: 27089

SEQ ID NO: 398680 - RNA, 64 nt, Homo Sapiens; identical to SEQ ID NO: 27090

SEQ ID NO: 398681 - RNA, 64 nt, Homo Sapiens; identical to SEQ ID NO: 27091

SEQ ID NO: 398682 - RNA, 64 nt, Homo Sapiens; identical to SEQ ID NO: 27092

SEQ ID NO: 398683 - RNA, 64 nt, Homo Sapiens; identical to SEQ ID NO: 27093

SEQ ID NO: 398684 - RNA, 64 nt, Homo Sapiens; identical to SEQ ID NO: 27094

SEQ ID NO: 398685 - RNA, 64 nt, Homo Sapiens; identical to SEQ ID NO: 27095

SEQ ID NO: 398686 - RNA, 64 nt, Homo Sapiens; identical to SEQ ID NO: 27096

SEQ ID NO: 398687 - RNA, 64 nt, Homo Sapiens; identical to SEQ ID NO: 27097

SEQ ID NO: 398688 - RNA, 64 nt, Homo Sapiens; identical to SEQ ID NO: 27098

SEQ ID NO: 398689 - RNA, 64 nt, Homo Sapiens; identical to SEQ ID NO: 27099

SEQ ID NO: 398690 - RNA, 64 nt, Homo Sapiens; identical to SEQ ID NO: 27100

SEQ ID NO: 398691 - RNA, 64 nt, Homo Sapiens; identical to SEQ ID NO: 27101

SEQ ID NO: 398692 - RNA, 64 nt, Homo Sapiens; identical to SEQ ID NO: 27102

SEQ ID NO: 398693 - RNA, 64 nt, Homo Sapiens; identical to SEQ ID NO: 27103

SEQ ID NO: 398694 - RNA, 64 nt, Homo Sapiens; identical to SEQ ID NO: 27104

SEQ ID NO: 398695 - RNA, 64 nt, Homo Sapiens; identical to SEQ ID NO: 27105

SEQ ID NO: 398696 - RNA, 64 nt, Homo Sapiens; identical to SEQ ID NO: 27106

SEQ ID NO: 398697 - RNA, 64 nt, Homo Sapiens; identical to SEQ ID NO: 27107

SEQ ID NO: 398698 - RNA, 64 nt, Homo Sapiens; identical to SEQ ID NO: 27108

SEQ ID NO: 398699 - RNA, 64 nt, Homo Sapiens; identical to SEQ ID NO: 27109

SEQ ID NO: 398700 - RNA, 64 nt, Homo Sapiens; identical to SEQ ID NO: 27110

SEQ ID NO: 398701 - RNA, 64 nt, Homo Sapiens; identical to SEQ ID NO: 27111

SEQ ID NO: 398702 - RNA, 64 nt, Homo Sapiens; identical to SEQ ID NO: 27112

SEQ ID NO: 398703 - RNA, 64 nt, Homo Sapiens; identical to SEQ ID NO: 27113

SEQ ID NO: 398704 - RNA, 64 nt, Homo Sapiens; identical to SEQ ID NO: 27114

SEQ ID NO: 398705 - RNA, 64 nt, Homo Sapiens; identical to SEQ ID NO: 27115

SEQ ID NO: 398706 - RNA, 64 nt, Homo Sapiens; identical to SEQ ID NO: 27116

SEQ ID NO: 398707 - RNA, 64 nt, Homo Sapiens; identical to SEQ ID NO: 27117

SEQ ID NO: 398708 - RNA, 64 nt, Homo Sapiens; identical to SEQ ID NO: 27118

SEQ ID NO: 398709 - RNA, 64 nt, Homo Sapiens; identical to SEQ ID NO: 27119

SEQ ID NO: 398710 - RNA, 64 nt, Homo Sapiens; identical to SEQ ID NO: 27120

SEQ ID NO: 398711 - RNA, 64 nt, Homo Sapiens; identical to SEQ ID NO: 27121

SEQ ID NO: 398712 - RNA, 64 nt, Homo Sapiens; identical to SEQ ID NO: 27122

SEQ ID NO: 398713 - RNA, 64 nt, Homo Sapiens; identical to SEQ ID NO: 27123

SEQ ID NO: 398714 - RNA, 64 nt, Homo Sapiens; identical to SEQ ID NO: 27124

SEQ ID NO: 398715 - RNA, 64 nt, Homo Sapiens; identical to SEQ ID NO: 27125

SEQ ID NO: 398716 - RNA, 64 nt, Homo Sapiens; identical to SEQ ID NO: 27126

SEQ ID NO: 398717 - RNA, 64 nt, Homo Sapiens; identical to SEQ ID NO: 27127

SEQ ID NO: 398718 - RNA, 64 nt, Homo Sapiens; identical to SEQ ID NO: 27128

SEQ ID NO: 398719 - RNA, 64 nt, Homo Sapiens; identical to SEQ ID NO: 27129

SEQ ID NO: 398720 - RNA, 64 nt, Homo Sapiens; identical to SEQ ID NO: 27130

SEQ ID NO: 398721 - RNA, 64 nt, Homo Sapiens; identical to SEQ ID NO: 27131

SEQ ID NO: 398722 - RNA, 64 nt, Homo Sapiens; identical to SEQ ID NO: 27132

SEQ ID NO: 398723 - RNA, 64 nt, Homo Sapiens; identical to SEQ ID NO: 27133

SEQ ID NO: 398724 - RNA, 64 nt, Homo Sapiens; identical to SEQ ID NO: 27134

SEQ ID NO: 398725 - RNA, 64 nt, Homo Sapiens; identical to SEQ ID NO: 27135

SEQ ID NO: 398726 - RNA, 64 nt, Homo Sapiens; identical to SEQ ID NO: 27136

SEQ ID NO: 398727 - RNA, 64 nt, Homo Sapiens; identical to SEQ ID NO: 27137

SEQ ID NO: 398728 - RNA, 64 nt, Homo Sapiens; identical to SEQ ID NO: 27138

SEQ ID NO: 398729 - RNA, 64 nt, Homo Sapiens; identical to SEQ ID NO: 27139

SEQ ID NO: 398730 - RNA, 64 nt, Homo Sapiens; identical to SEQ ID NO: 27140

SEQ ID NO: 398731 - RNA, 64 nt, Homo Sapiens; identical to SEQ ID NO: 27141

SEQ ID NO: 398732 - RNA, 64 nt, Homo Sapiens; identical to SEQ ID NO: 27142

SEQ ID NO: 398733 - RNA, 64 nt, Homo Sapiens; identical to SEQ ID NO: 27143

SEQ ID NO: 398734 - RNA, 64 nt, Homo Sapiens; identical to SEQ ID NO: 27144

SEQ ID NO: 398735 - RNA, 64 nt, Homo Sapiens; identical to SEQ ID NO: 27145

SEQ ID NO: 398736 - RNA, 64 nt, Homo Sapiens; identical to SEQ ID NO: 27146

SEQ ID NO: 398737 - RNA, 64 nt, Homo Sapiens; identical to SEQ ID NO: 27147

SEQ ID NO: 398738 - RNA, 64 nt, Homo Sapiens; identical to SEQ ID NO: 27148

SEQ ID NO: 398739 - RNA, 64 nt, Homo Sapiens; identical to SEQ ID NO: 27149

SEQ ID NO: 398740 - RNA, 64 nt, Homo Sapiens; identical to SEQ ID NO: 27150

SEQ ID NO: 398741 - RNA, 64 nt, Homo Sapiens; identical to SEQ ID NO: 27151

SEQ ID NO: 398742 - RNA, 64 nt, Homo Sapiens; identical to SEQ ID NO: 27152

SEQ ID NO: 398743 - RNA, 64 nt, Homo Sapiens; identical to SEQ ID NO: 27153

SEQ ID NO: 398744 - RNA, 64 nt, Homo Sapiens; identical to SEQ ID NO: 27154

SEQ ID NO: 398745 - RNA, 64 nt, Homo Sapiens; identical to SEQ ID NO: 27155

SEQ ID NO: 398746 - RNA, 64 nt, Homo Sapiens; identical to SEQ ID NO: 27156

SEQ ID NO: 398747 - RNA, 64 nt, Homo Sapiens; identical to SEQ ID NO: 27157

SEQ ID NO: 398748 - RNA, 64 nt, Homo Sapiens; identical to SEQ ID NO: 27158

SEQ ID NO: 398749 - RNA, 64 nt, Homo Sapiens; identical to SEQ ID NO: 27159

SEQ ID NO: 398750 - RNA, 64 nt, Homo Sapiens; identical to SEQ ID NO: 27160

SEQ ID NO: 398751 - RNA, 64 nt, Homo Sapiens; identical to SEQ ID NO: 27161

SEQ ID NO: 398752 - RNA, 64 nt, Homo Sapiens; identical to SEQ ID NO: 27162

SEQ ID NO: 398753 - RNA, 64 nt, Homo Sapiens; identical to SEQ ID NO: 27163

SEQ ID NO: 398754 - RNA, 64 nt, Homo Sapiens; identical to SEQ ID NO: 27164

SEQ ID NO: 398755 - RNA, 64 nt, Homo Sapiens; identical to SEQ ID NO: 27165

SEQ ID NO: 398756 - RNA, 64 nt, Homo Sapiens; identical to SEQ ID NO: 27166

SEQ ID NO: 398757 - RNA, 64 nt, Homo Sapiens; identical to SEQ ID NO: 27167

SEQ ID NO: 398758 - RNA, 64 nt, Homo Sapiens; identical to SEQ ID NO: 27168

SEQ ID NO: 398759 - RNA, 64 nt, Homo Sapiens; identical to SEQ ID NO: 27169

SEQ ID NO: 398760 - RNA, 64 nt, Homo Sapiens; identical to SEQ ID NO: 27170

SEQ ID NO: 398761 - RNA, 64 nt, Homo Sapiens; identical to SEQ ID NO: 27171

SEQ ID NO: 398762 - RNA, 64 nt, Homo Sapiens; identical to SEQ ID NO: 27172

SEQ ID NO: 398763 - RNA, 64 nt, Homo Sapiens; identical to SEQ ID NO: 27173

SEQ ID NO: 398764 - RNA, 64 nt, Homo Sapiens; identical to SEQ ID NO: 27174

SEQ ID NO: 398765 - RNA, 64 nt, Homo Sapiens; identical to SEQ ID NO: 27175

SEQ ID NO: 398766 - RNA, 64 nt, Homo Sapiens; identical to SEQ ID NO: 27176

SEQ ID NO: 398767 - RNA, 64 nt, Homo Sapiens; identical to SEQ ID NO: 27177

SEQ ID NO: 398768 - RNA, 64 nt, Homo Sapiens; identical to SEQ ID NO: 27178

SEQ ID NO: 398769 - RNA, 64 nt, Homo Sapiens; identical to SEQ ID NO: 27179

SEQ ID NO: 398770 - RNA, 64 nt, Homo Sapiens; identical to SEQ ID NO: 27180

SEQ ID NO: 398771 - RNA, 64 nt, Homo Sapiens; identical to SEQ ID NO: 27181

SEQ ID NO: 398772 - RNA, 64 nt, Homo Sapiens; identical to SEQ ID NO: 27182

SEQ ID NO: 398773 - RNA, 64 nt, Homo Sapiens; identical to SEQ ID NO: 27183

SEQ ID NO: 398774 - RNA, 64 nt, Homo Sapiens; identical to SEQ ID NO: 27184

SEQ ID NO: 398775 - RNA, 64 nt, Homo Sapiens; identical to SEQ ID NO: 27185

SEQ ID NO: 398776 - RNA, 64 nt, Homo Sapiens; identical to SEQ ID NO: 27186

SEQ ID NO: 398777 - RNA, 64 nt, Homo Sapiens; identical to SEQ ID NO: 27187

SEQ ID NO: 398778 - RNA, 64 nt, Homo Sapiens; identical to SEQ ID NO: 27188

SEQ ID NO: 398779 - RNA, 64 nt, Homo Sapiens; identical to SEQ ID NO: 27189

SEQ ID NO: 398780 - RNA, 64 nt, Homo Sapiens; identical to SEQ ID NO: 27190

SEQ ID NO: 398781 - RNA, 64 nt, Homo Sapiens; identical to SEQ ID NO: 27191

SEQ ID NO: 398782 - RNA, 64 nt, Homo Sapiens; identical to SEQ ID NO: 27192

SEQ ID NO: 398783 - RNA, 64 nt, Homo Sapiens; identical to SEQ ID NO: 27193

SEQ ID NO: 398784 - RNA, 64 nt, Homo Sapiens; identical to SEQ ID NO: 27194

SEQ ID NO: 398785 - RNA, 64 nt, Homo Sapiens; identical to SEQ ID NO: 27195

SEQ ID NO: 398786 - RNA, 64 nt, Homo Sapiens; identical to SEQ ID NO: 27196

SEQ ID NO: 398787 - RNA, 64 nt, Homo Sapiens; identical to SEQ ID NO: 27197

SEQ ID NO: 398788 - RNA, 64 nt, Homo Sapiens; identical to SEQ ID NO: 27198

SEQ ID NO: 398789 - RNA, 64 nt, Homo Sapiens; identical to SEQ ID NO: 27199

SEQ ID NO: 398790 - RNA, 64 nt, Homo Sapiens; identical to SEQ ID NO: 27200

SEQ ID NO: 398791 - RNA, 64 nt, Homo Sapiens; identical to SEQ ID NO: 27201

SEQ ID NO: 398792 - RNA, 64 nt, Homo Sapiens; identical to SEQ ID NO: 27202

SEQ ID NO: 398793 - RNA, 64 nt, Homo Sapiens; identical to SEQ ID NO: 27203

SEQ ID NO: 398794 - RNA, 64 nt, Homo Sapiens; identical to SEQ ID NO: 27204

SEQ ID NO: 398795 - RNA, 64 nt, Homo Sapiens; identical to SEQ ID NO: 27205

SEQ ID NO: 398796 - RNA, 64 nt, Homo Sapiens; identical to SEQ ID NO: 27206

SEQ ID NO: 398797 - RNA, 64 nt, Homo Sapiens; identical to SEQ ID NO: 27207

SEQ ID NO: 398798 - RNA, 64 nt, Homo Sapiens; identical to SEQ ID NO: 27208

SEQ ID NO: 398799 - RNA, 64 nt, Homo Sapiens; identical to SEQ ID NO: 27209

SEQ ID NO: 398800 - RNA, 64 nt, Homo Sapiens; identical to SEQ ID NO: 27210

SEQ ID NO: 398801 - RNA, 64 nt, Homo Sapiens; identical to SEQ ID NO: 27211

SEQ ID NO: 398802 - RNA, 64 nt, Homo Sapiens; identical to SEQ ID NO: 27212

SEQ ID NO: 398803 - RNA, 64 nt, Homo Sapiens; identical to SEQ ID NO: 27213

SEQ ID NO: 398804 - RNA, 64 nt, Homo Sapiens; identical to SEQ ID NO: 27214

SEQ ID NO: 398805 - RNA, 64 nt, Homo Sapiens; identical to SEQ ID NO: 27215

SEQ ID NO: 398806 - RNA, 64 nt, Homo Sapiens; identical to SEQ ID NO: 27216

SEQ ID NO: 398807 - RNA, 64 nt, Homo Sapiens; identical to SEQ ID NO: 27217

SEQ ID NO: 398808 - RNA, 64 nt, Homo Sapiens; identical to SEQ ID NO: 27218

SEQ ID NO: 398809 - RNA, 64 nt, Homo Sapiens; identical to SEQ ID NO: 27219

SEQ ID NO: 398810 - RNA, 64 nt, Homo Sapiens; identical to SEQ ID NO: 27220

SEQ ID NO: 398811 - RNA, 64 nt, Homo Sapiens; identical to SEQ ID NO: 27221

SEQ ID NO: 398812 - RNA, 64 nt, Homo Sapiens; identical to SEQ ID NO: 27222

SEQ ID NO: 398813 - RNA, 64 nt, Homo Sapiens; identical to SEQ ID NO: 27223

SEQ ID NO: 398814 - RNA, 64 nt, Homo Sapiens; identical to SEQ ID NO: 27224

SEQ ID NO: 398815 - RNA, 64 nt, Homo Sapiens; identical to SEQ ID NO: 27225

SEQ ID NO: 398816 - RNA, 64 nt, Homo Sapiens; identical to SEQ ID NO: 27226

SEQ ID NO: 398817 - RNA, 64 nt, Homo Sapiens; identical to SEQ ID NO: 27227

SEQ ID NO: 398818 - RNA, 64 nt, Homo Sapiens; identical to SEQ ID NO: 27228

SEQ ID NO: 398819 - RNA, 64 nt, Homo Sapiens; identical to SEQ ID NO: 27229

SEQ ID NO: 398820 - RNA, 64 nt, Homo Sapiens; identical to SEQ ID NO: 27230

SEQ ID NO: 398821 - RNA, 64 nt, Homo Sapiens; identical to SEQ ID NO: 27231

SEQ ID NO: 398822 - RNA, 64 nt, Homo Sapiens; identical to SEQ ID NO: 27232

SEQ ID NO: 398823 - RNA, 64 nt, Homo Sapiens; identical to SEQ ID NO: 27233

SEQ ID NO: 398824 - RNA, 64 nt, Homo Sapiens; identical to SEQ ID NO: 27234

SEQ ID NO: 398825 - RNA, 64 nt, Homo Sapiens; identical to SEQ ID NO: 27235

SEQ ID NO: 398826 - RNA, 64 nt, Homo Sapiens; identical to SEQ ID NO: 27236

SEQ ID NO: 398827 - RNA, 64 nt, Homo Sapiens; identical to SEQ ID NO: 27237

SEQ ID NO: 398828 - RNA, 64 nt, Homo Sapiens; identical to SEQ ID NO: 27238

SEQ ID NO: 398829 - RNA, 64 nt, Homo Sapiens; identical to SEQ ID NO: 27239

SEQ ID NO: 398830 - RNA, 64 nt, Homo Sapiens; identical to SEQ ID NO: 27240

SEQ ID NO: 398831 - RNA, 64 nt, Homo Sapiens; identical to SEQ ID NO: 27241

SEQ ID NO: 398832 - RNA, 64 nt, Homo Sapiens; identical to SEQ ID NO: 27242

SEQ ID NO: 398833 - RNA, 64 nt, Homo Sapiens; identical to SEQ ID NO: 27243

SEQ ID NO: 398834 - RNA, 64 nt, Homo Sapiens; identical to SEQ ID NO: 27244

SEQ ID NO: 398835 - RNA, 64 nt, Homo Sapiens; identical to SEQ ID NO: 27245

SEQ ID NO: 398836 - RNA, 64 nt, Homo Sapiens; identical to SEQ ID NO: 27246

SEQ ID NO: 398837 - RNA, 64 nt, Homo Sapiens; identical to SEQ ID NO: 27247

SEQ ID NO: 398838 - RNA, 64 nt, Homo Sapiens; identical to SEQ ID NO: 27248

SEQ ID NO: 398839 - RNA, 64 nt, Homo Sapiens; identical to SEQ ID NO: 27249

SEQ ID NO: 398840 - RNA, 64 nt, Homo Sapiens; identical to SEQ ID NO: 27250

SEQ ID NO: 398841 - RNA, 64 nt, Homo Sapiens; identical to SEQ ID NO: 27251

SEQ ID NO: 398842 - RNA, 64 nt, Homo Sapiens; identical to SEQ ID NO: 27252

SEQ ID NO: 398843 - RNA, 64 nt, Homo Sapiens; identical to SEQ ID NO: 27253

SEQ ID NO: 398844 - RNA, 64 nt, Homo Sapiens; identical to SEQ ID NO: 27254

SEQ ID NO: 398845 - RNA, 64 nt, Homo Sapiens; identical to SEQ ID NO: 27255

SEQ ID NO: 398846 - RNA, 64 nt, Homo Sapiens; identical to SEQ ID NO: 27256

SEQ ID NO: 398847 - RNA, 64 nt, Homo Sapiens; identical to SEQ ID NO: 27257

SEQ ID NO: 398848 - RNA, 64 nt, Homo Sapiens; identical to SEQ ID NO: 27258

SEQ ID NO: 398849 - RNA, 64 nt, Homo Sapiens; identical to SEQ ID NO: 27259

SEQ ID NO: 398850 - RNA, 64 nt, Homo Sapiens; identical to SEQ ID NO: 27260

SEQ ID NO: 398851 - RNA, 64 nt, Homo Sapiens; identical to SEQ ID NO: 27261

SEQ ID NO: 398852 - RNA, 64 nt, Homo Sapiens; identical to SEQ ID NO: 27262

SEQ ID NO: 398853 - RNA, 64 nt, Homo Sapiens; identical to SEQ ID NO: 27263

SEQ ID NO: 398854 - RNA, 64 nt, Homo Sapiens; identical to SEQ ID NO: 27264

SEQ ID NO: 398855 - RNA, 64 nt, Homo Sapiens; identical to SEQ ID NO: 27265

SEQ ID NO: 398856 - RNA, 64 nt, Homo Sapiens; identical to SEQ ID NO: 27266

SEQ ID NO: 398857 - RNA, 64 nt, Homo Sapiens; identical to SEQ ID NO: 27267

SEQ ID NO: 398858 - RNA, 64 nt, Homo Sapiens; identical to SEQ ID NO: 27268

SEQ ID NO: 398859 - RNA, 64 nt, Homo Sapiens; identical to SEQ ID NO: 27269

SEQ ID NO: 398860 - RNA, 64 nt, Homo Sapiens; identical to SEQ ID NO: 27270

SEQ ID NO: 398861 - RNA, 64 nt, Homo Sapiens; identical to SEQ ID NO: 27271

SEQ ID NO: 398862 - RNA, 64 nt, Homo Sapiens; identical to SEQ ID NO: 27272

SEQ ID NO: 398863 - RNA, 64 nt, Homo Sapiens; identical to SEQ ID NO: 27273

SEQ ID NO: 398864 - RNA, 64 nt, Homo Sapiens; identical to SEQ ID NO: 27274

SEQ ID NO: 398865 - RNA, 64 nt, Homo Sapiens; identical to SEQ ID NO: 27275

SEQ ID NO: 398866 - RNA, 64 nt, Homo Sapiens; identical to SEQ ID NO: 27276

SEQ ID NO: 398867 - RNA, 64 nt, Homo Sapiens; identical to SEQ ID NO: 27277

SEQ ID NO: 398868 - RNA, 64 nt, Homo Sapiens; identical to SEQ ID NO: 27278

SEQ ID NO: 398869 - RNA, 64 nt, Homo Sapiens; identical to SEQ ID NO: 27279

SEQ ID NO: 398870 - RNA, 64 nt, Homo Sapiens; identical to SEQ ID NO: 27280

SEQ ID NO: 398871 - RNA, 64 nt, Homo Sapiens; identical to SEQ ID NO: 27281

SEQ ID NO: 398872 - RNA, 64 nt, Homo Sapiens; identical to SEQ ID NO: 27282

SEQ ID NO: 398873 - RNA, 64 nt, Homo Sapiens; identical to SEQ ID NO: 27283

SEQ ID NO: 398874 - RNA, 64 nt, Homo Sapiens; identical to SEQ ID NO: 27284

SEQ ID NO: 398875 - RNA, 64 nt, Homo Sapiens; identical to SEQ ID NO: 27285

SEQ ID NO: 398876 - RNA, 64 nt, Homo Sapiens; identical to SEQ ID NO: 27286

SEQ ID NO: 398877 - RNA, 64 nt, Homo Sapiens; identical to SEQ ID NO: 27287

SEQ ID NO: 398878 - RNA, 64 nt, Homo Sapiens; identical to SEQ ID NO: 27288

SEQ ID NO: 398879 - RNA, 64 nt, Homo Sapiens; identical to SEQ ID NO: 27289

SEQ ID NO: 398880 - RNA, 64 nt, Homo Sapiens; identical to SEQ ID NO: 27290

SEQ ID NO: 398881 - RNA, 64 nt, Homo Sapiens; identical to SEQ ID NO: 27291

SEQ ID NO: 398882 - RNA, 64 nt, Homo Sapiens; identical to SEQ ID NO: 27292

SEQ ID NO: 398883 - RNA, 64 nt, Homo Sapiens; identical to SEQ ID NO: 27293

SEQ ID NO: 398884 - RNA, 64 nt, Homo Sapiens; identical to SEQ ID NO: 27294

SEQ ID NO: 398885 - RNA, 64 nt, Homo Sapiens; identical to SEQ ID NO: 27295

SEQ ID NO: 398886 - RNA, 64 nt, Homo Sapiens; identical to SEQ ID NO: 27296

SEQ ID NO: 398887 - RNA, 64 nt, Homo Sapiens; identical to SEQ ID NO: 27297

SEQ ID NO: 398888 - RNA, 64 nt, Homo Sapiens; identical to SEQ ID NO: 27298

SEQ ID NO: 398889 - RNA, 64 nt, Homo Sapiens; identical to SEQ ID NO: 27299

SEQ ID NO: 398890 - RNA, 64 nt, Homo Sapiens; identical to SEQ ID NO: 27300

SEQ ID NO: 398891 - RNA, 64 nt, Homo Sapiens; identical to SEQ ID NO: 27301

SEQ ID NO: 398892 - RNA, 64 nt, Homo Sapiens; identical to SEQ ID NO: 27302

SEQ ID NO: 398893 - RNA, 64 nt, Homo Sapiens; identical to SEQ ID NO: 27303

SEQ ID NO: 398894 - RNA, 64 nt, Homo Sapiens; identical to SEQ ID NO: 27304

SEQ ID NO: 398895 - RNA, 64 nt, Homo Sapiens; identical to SEQ ID NO: 27305

SEQ ID NO: 398896 - RNA, 64 nt, Homo Sapiens; identical to SEQ ID NO: 27306

SEQ ID NO: 398897 - RNA, 64 nt, Homo Sapiens; identical to SEQ ID NO: 27307

SEQ ID NO: 398898 - RNA, 64 nt, Homo Sapiens; identical to SEQ ID NO: 27308

SEQ ID NO: 398899 - RNA, 64 nt, Homo Sapiens; identical to SEQ ID NO: 27309

SEQ ID NO: 398900 - RNA, 64 nt, Homo Sapiens; identical to SEQ ID NO: 27310

SEQ ID NO: 398901 - RNA, 64 nt, Homo Sapiens; identical to SEQ ID NO: 27311

SEQ ID NO: 398902 - RNA, 64 nt, Homo Sapiens; identical to SEQ ID NO: 27312

SEQ ID NO: 398903 - RNA, 63 nt, Homo Sapiens; identical to SEQ ID NO: 27313

SEQ ID NO: 398904 - RNA, 64 nt, Homo Sapiens; identical to SEQ ID NO: 27314

SEQ ID NO: 398905 - RNA, 64 nt, Homo Sapiens; identical to SEQ ID NO: 27315

SEQ ID NO: 398906 - RNA, 64 nt, Homo Sapiens; identical to SEQ ID NO: 27316

SEQ ID NO: 398907 - RNA, 64 nt, Homo Sapiens; identical to SEQ ID NO: 27317

SEQ ID NO: 398908 - RNA, 64 nt, Homo Sapiens; identical to SEQ ID NO: 27318

SEQ ID NO: 398909 - RNA, 64 nt, Homo Sapiens; identical to SEQ ID NO: 27319

SEQ ID NO: 398910 - RNA, 64 nt, Homo Sapiens; identical to SEQ ID NO: 27320

SEQ ID NO: 398911 - RNA, 64 nt, Homo Sapiens; identical to SEQ ID NO: 27321

SEQ ID NO: 398912 - RNA, 64 nt, Homo Sapiens; identical to SEQ ID NO: 27322

SEQ ID NO: 398913 - RNA, 64 nt, Homo Sapiens; identical to SEQ ID NO: 27323

SEQ ID NO: 398914 - RNA, 64 nt, Homo Sapiens; identical to SEQ ID NO: 27324

SEQ ID NO: 398915 - RNA, 64 nt, Homo Sapiens; identical to SEQ ID NO: 27325

SEQ ID NO: 398916 - RNA, 64 nt, Homo Sapiens; identical to SEQ ID NO: 27326

SEQ ID NO: 398917 - RNA, 64 nt, Homo Sapiens; identical to SEQ ID NO: 27327

SEQ ID NO: 398918 - RNA, 64 nt, Homo Sapiens; identical to SEQ ID NO: 27328

SEQ ID NO: 398919 - RNA, 64 nt, Homo Sapiens; identical to SEQ ID NO: 27329

SEQ ID NO: 398920 - RNA, 64 nt, Homo Sapiens; identical to SEQ ID NO: 27330

SEQ ID NO: 398921 - RNA, 64 nt, Homo Sapiens; identical to SEQ ID NO: 27331

SEQ ID NO: 398922 - RNA, 64 nt, Homo Sapiens; identical to SEQ ID NO: 27332

SEQ ID NO: 398923 - RNA, 64 nt, Homo Sapiens; identical to SEQ ID NO: 27333

SEQ ID NO: 398924 - RNA, 64 nt, Homo Sapiens; identical to SEQ ID NO: 27334

SEQ ID NO: 398925 - RNA, 64 nt, Homo Sapiens; identical to SEQ ID NO: 27335

SEQ ID NO: 398926 - RNA, 64 nt, Homo Sapiens; identical to SEQ ID NO: 27336

SEQ ID NO: 398927 - RNA, 64 nt, Homo Sapiens; identical to SEQ ID NO: 27337

SEQ ID NO: 398928 - RNA, 64 nt, Homo Sapiens; identical to SEQ ID NO: 27338

SEQ ID NO: 398929 - RNA, 64 nt, Homo Sapiens; identical to SEQ ID NO: 27339

SEQ ID NO: 398930 - RNA, 64 nt, Homo Sapiens; identical to SEQ ID NO: 27340

SEQ ID NO: 398931 - RNA, 64 nt, Homo Sapiens; identical to SEQ ID NO: 27341

SEQ ID NO: 398932 - RNA, 64 nt, Homo Sapiens; identical to SEQ ID NO: 27342

SEQ ID NO: 398933 - RNA, 64 nt, Homo Sapiens; identical to SEQ ID NO: 27343

SEQ ID NO: 398934 - RNA, 64 nt, Homo Sapiens; identical to SEQ ID NO: 27344

SEQ ID NO: 398935 - RNA, 64 nt, Homo Sapiens; identical to SEQ ID NO: 27345

SEQ ID NO: 398936 - RNA, 64 nt, Homo Sapiens; identical to SEQ ID NO: 27346

SEQ ID NO: 398937 - RNA, 64 nt, Homo Sapiens; identical to SEQ ID NO: 27347

SEQ ID NO: 398938 - RNA, 64 nt, Homo Sapiens; identical to SEQ ID NO: 27348

SEQ ID NO: 398939 - RNA, 64 nt, Homo Sapiens; identical to SEQ ID NO: 27349

SEQ ID NO: 398940 - RNA, 64 nt, Homo Sapiens; identical to SEQ ID NO: 27350

SEQ ID NO: 398941 - RNA, 64 nt, Homo Sapiens; identical to SEQ ID NO: 27351

SEQ ID NO: 398942 - RNA, 64 nt, Homo Sapiens; identical to SEQ ID NO: 27352

SEQ ID NO: 398943 - RNA, 64 nt, Homo Sapiens; identical to SEQ ID NO: 27353

SEQ ID NO: 398944 - RNA, 64 nt, Homo Sapiens; identical to SEQ ID NO: 27354

SEQ ID NO: 398945 - RNA, 64 nt, Homo Sapiens; identical to SEQ ID NO: 27355

SEQ ID NO: 398946 - RNA, 64 nt, Homo Sapiens; identical to SEQ ID NO: 27356

SEQ ID NO: 398947 - RNA, 64 nt, Homo Sapiens; identical to SEQ ID NO: 27357

SEQ ID NO: 398948 - RNA, 64 nt, Homo Sapiens; identical to SEQ ID NO: 27358

SEQ ID NO: 398949 - RNA, 64 nt, Homo Sapiens; identical to SEQ ID NO: 27359

SEQ ID NO: 398950 - RNA, 64 nt, Homo Sapiens; identical to SEQ ID NO: 27360

SEQ ID NO: 398951 - RNA, 64 nt, Homo Sapiens; identical to SEQ ID NO: 27361

SEQ ID NO: 398952 - RNA, 64 nt, Homo Sapiens; identical to SEQ ID NO: 27362

SEQ ID NO: 398953 - RNA, 64 nt, Homo Sapiens; identical to SEQ ID NO: 27363

SEQ ID NO: 398954 - RNA, 64 nt, Homo Sapiens; identical to SEQ ID NO: 27364

SEQ ID NO: 398955 - RNA, 64 nt, Homo Sapiens; identical to SEQ ID NO: 27365

SEQ ID NO: 398956 - RNA, 64 nt, Homo Sapiens; identical to SEQ ID NO: 27366

SEQ ID NO: 398957 - RNA, 64 nt, Homo Sapiens; identical to SEQ ID NO: 27367

SEQ ID NO: 398958 - RNA, 64 nt, Homo Sapiens; identical to SEQ ID NO: 27368

SEQ ID NO: 398959 - RNA, 64 nt, Homo Sapiens; identical to SEQ ID NO: 27369

SEQ ID NO: 398960 - RNA, 64 nt, Homo Sapiens; identical to SEQ ID NO: 27370

SEQ ID NO: 398961 - RNA, 64 nt, Homo Sapiens; identical to SEQ ID NO: 27371

SEQ ID NO: 398962 - RNA, 64 nt, Homo Sapiens; identical to SEQ ID NO: 27372

SEQ ID NO: 398963 - RNA, 64 nt, Homo Sapiens; identical to SEQ ID NO: 27373

SEQ ID NO: 398964 - RNA, 64 nt, Homo Sapiens; identical to SEQ ID NO: 27374

SEQ ID NO: 398965 - RNA, 64 nt, Homo Sapiens; identical to SEQ ID NO: 27375

SEQ ID NO: 398966 - RNA, 64 nt, Homo Sapiens; identical to SEQ ID NO: 27376

SEQ ID NO: 398967 - RNA, 64 nt, Homo Sapiens; identical to SEQ ID NO: 27377

SEQ ID NO: 398968 - RNA, 64 nt, Homo Sapiens; identical to SEQ ID NO: 27378

SEQ ID NO: 398969 - RNA, 64 nt, Homo Sapiens; identical to SEQ ID NO: 27379

SEQ ID NO: 398970 - RNA, 64 nt, Homo Sapiens; identical to SEQ ID NO: 27380

SEQ ID NO: 398971 - RNA, 64 nt, Homo Sapiens; identical to SEQ ID NO: 27381

SEQ ID NO: 398972 - RNA, 64 nt, Homo Sapiens; identical to SEQ ID NO: 27382

SEQ ID NO: 398973 - RNA, 64 nt, Homo Sapiens; identical to SEQ ID NO: 27383

SEQ ID NO: 398974 - RNA, 64 nt, Homo Sapiens; identical to SEQ ID NO: 27384

SEQ ID NO: 398975 - RNA, 64 nt, Homo Sapiens; identical to SEQ ID NO: 27385

SEQ ID NO: 398976 - RNA, 64 nt, Homo Sapiens; identical to SEQ ID NO: 27386

SEQ ID NO: 398977 - RNA, 64 nt, Homo Sapiens; identical to SEQ ID NO: 27387

SEQ ID NO: 398978 - RNA, 64 nt, Homo Sapiens; identical to SEQ ID NO: 27388

SEQ ID NO: 398979 - RNA, 64 nt, Homo Sapiens; identical to SEQ ID NO: 27389

SEQ ID NO: 398980 - RNA, 64 nt, Homo Sapiens; identical to SEQ ID NO: 27390

SEQ ID NO: 398981 - RNA, 64 nt, Homo Sapiens; identical to SEQ ID NO: 27391

SEQ ID NO: 398982 - RNA, 64 nt, Homo Sapiens; identical to SEQ ID NO: 27392

SEQ ID NO: 398983 - RNA, 64 nt, Homo Sapiens; identical to SEQ ID NO: 27393

SEQ ID NO: 398984 - RNA, 64 nt, Homo Sapiens; identical to SEQ ID NO: 27394

SEQ ID NO: 398985 - RNA, 64 nt, Homo Sapiens; identical to SEQ ID NO: 27395

SEQ ID NO: 398986 - RNA, 64 nt, Homo Sapiens; identical to SEQ ID NO: 27396

SEQ ID NO: 398987 - RNA, 64 nt, Homo Sapiens; identical to SEQ ID NO: 27397

SEQ ID NO: 398988 - RNA, 64 nt, Homo Sapiens; identical to SEQ ID NO: 27398

SEQ ID NO: 398989 - RNA, 64 nt, Homo Sapiens; identical to SEQ ID NO: 27399

SEQ ID NO: 398990 - RNA, 64 nt, Homo Sapiens; identical to SEQ ID NO: 27400

SEQ ID NO: 398991 - RNA, 64 nt, Homo Sapiens; identical to SEQ ID NO: 27401

SEQ ID NO: 398992 - RNA, 64 nt, Homo Sapiens; identical to SEQ ID NO: 27402

SEQ ID NO: 398993 - RNA, 64 nt, Homo Sapiens; identical to SEQ ID NO: 27403

SEQ ID NO: 398994 - RNA, 64 nt, Homo Sapiens; identical to SEQ ID NO: 27404

SEQ ID NO: 398995 - RNA, 64 nt, Homo Sapiens; identical to SEQ ID NO: 27405

SEQ ID NO: 398996 - RNA, 64 nt, Homo Sapiens; identical to SEQ ID NO: 27406

SEQ ID NO: 398997 - RNA, 64 nt, Homo Sapiens; identical to SEQ ID NO: 27407

SEQ ID NO: 398998 - RNA, 64 nt, Homo Sapiens; identical to SEQ ID NO: 27408

SEQ ID NO: 398999 - RNA, 64 nt, Homo Sapiens; identical to SEQ ID NO: 27409

SEQ ID NO: 399000 - RNA, 64 nt, Homo Sapiens; identical to SEQ ID NO: 27410

SEQ ID NO: 399001 - RNA, 64 nt, Homo Sapiens; identical to SEQ ID NO: 27411

SEQ ID NO: 399002 - RNA, 64 nt, Homo Sapiens; identical to SEQ ID NO: 27412

SEQ ID NO: 399003 - RNA, 64 nt, Homo Sapiens; identical to SEQ ID NO: 27413

SEQ ID NO: 399004 - RNA, 64 nt, Homo Sapiens; identical to SEQ ID NO: 27414

SEQ ID NO: 399005 - RNA, 64 nt, Homo Sapiens; identical to SEQ ID NO: 27415

SEQ ID NO: 399006 - RNA, 64 nt, Homo Sapiens; identical to SEQ ID NO: 27416

SEQ ID NO: 399007 - RNA, 64 nt, Homo Sapiens; identical to SEQ ID NO: 27417

SEQ ID NO: 399008 - RNA, 64 nt, Homo Sapiens; identical to SEQ ID NO: 27418

SEQ ID NO: 399009 - RNA, 64 nt, Homo Sapiens; identical to SEQ ID NO: 27419

SEQ ID NO: 399010 - RNA, 64 nt, Homo Sapiens; identical to SEQ ID NO: 27420

SEQ ID NO: 399011 - RNA, 64 nt, Homo Sapiens; identical to SEQ ID NO: 27421

SEQ ID NO: 399012 - RNA, 64 nt, Homo Sapiens; identical to SEQ ID NO: 27422

SEQ ID NO: 399013 - RNA, 64 nt, Homo Sapiens; identical to SEQ ID NO: 27423

SEQ ID NO: 399014 - RNA, 64 nt, Homo Sapiens; identical to SEQ ID NO: 27424

SEQ ID NO: 399015 - RNA, 64 nt, Homo Sapiens; identical to SEQ ID NO: 27425

SEQ ID NO: 399016 - RNA, 64 nt, Homo Sapiens; identical to SEQ ID NO: 27426

SEQ ID NO: 399017 - RNA, 64 nt, Homo Sapiens; identical to SEQ ID NO: 27427

SEQ ID NO: 399018 - RNA, 64 nt, Homo Sapiens; identical to SEQ ID NO: 27428

SEQ ID NO: 399019 - RNA, 64 nt, Homo Sapiens; identical to SEQ ID NO: 27429

SEQ ID NO: 399020 - RNA, 64 nt, Homo Sapiens; identical to SEQ ID NO: 27430

SEQ ID NO: 399021 - RNA, 64 nt, Homo Sapiens; identical to SEQ ID NO: 27431

SEQ ID NO: 399022 - RNA, 64 nt, Homo Sapiens; identical to SEQ ID NO: 27432

SEQ ID NO: 399023 - RNA, 64 nt, Homo Sapiens; identical to SEQ ID NO: 27433

SEQ ID NO: 399024 - RNA, 64 nt, Homo Sapiens; identical to SEQ ID NO: 27434

SEQ ID NO: 399025 - RNA, 64 nt, Homo Sapiens; identical to SEQ ID NO: 27435

SEQ ID NO: 399026 - RNA, 64 nt, Homo Sapiens; identical to SEQ ID NO: 27436

SEQ ID NO: 399027 - RNA, 64 nt, Homo Sapiens; identical to SEQ ID NO: 27437

SEQ ID NO: 399028 - RNA, 64 nt, Homo Sapiens; identical to SEQ ID NO: 27438

SEQ ID NO: 399029 - RNA, 64 nt, Homo Sapiens; identical to SEQ ID NO: 27439

SEQ ID NO: 399030 - RNA, 64 nt, Homo Sapiens; identical to SEQ ID NO: 27440

SEQ ID NO: 399031 - RNA, 64 nt, Homo Sapiens; identical to SEQ ID NO: 27441

SEQ ID NO: 399032 - RNA, 64 nt, Homo Sapiens; identical to SEQ ID NO: 27442

SEQ ID NO: 399033 - RNA, 64 nt, Homo Sapiens; identical to SEQ ID NO: 27443

SEQ ID NO: 399034 - RNA, 64 nt, Homo Sapiens; identical to SEQ ID NO: 27444

SEQ ID NO: 399035 - RNA, 64 nt, Homo Sapiens; identical to SEQ ID NO: 27445

SEQ ID NO: 399036 - RNA, 64 nt, Homo Sapiens; identical to SEQ ID NO: 27446

SEQ ID NO: 399037 - RNA, 64 nt, Homo Sapiens; identical to SEQ ID NO: 27447

SEQ ID NO: 399038 - RNA, 64 nt, Homo Sapiens; identical to SEQ ID NO: 27448

SEQ ID NO: 399039 - RNA, 64 nt, Homo Sapiens; identical to SEQ ID NO: 27449

SEQ ID NO: 399040 - RNA, 64 nt, Homo Sapiens; identical to SEQ ID NO: 27450

SEQ ID NO: 399041 - RNA, 64 nt, Homo Sapiens; identical to SEQ ID NO: 27451

SEQ ID NO: 399042 - RNA, 64 nt, Homo Sapiens; identical to SEQ ID NO: 27452

SEQ ID NO: 399043 - RNA, 64 nt, Homo Sapiens; identical to SEQ ID NO: 27453

SEQ ID NO: 399044 - RNA, 64 nt, Homo Sapiens; identical to SEQ ID NO: 27454

SEQ ID NO: 399045 - RNA, 64 nt, Homo Sapiens; identical to SEQ ID NO: 27455

SEQ ID NO: 399046 - RNA, 64 nt, Homo Sapiens; identical to SEQ ID NO: 27456

SEQ ID NO: 399047 - RNA, 64 nt, Homo Sapiens; identical to SEQ ID NO: 27457

SEQ ID NO: 399048 - RNA, 64 nt, Homo Sapiens; identical to SEQ ID NO: 27458

SEQ ID NO: 399049 - RNA, 64 nt, Homo Sapiens; identical to SEQ ID NO: 27459

SEQ ID NO: 399050 - RNA, 64 nt, Homo Sapiens; identical to SEQ ID NO: 27460

SEQ ID NO: 399051 - RNA, 64 nt, Homo Sapiens; identical to SEQ ID NO: 27461

SEQ ID NO: 399052 - RNA, 64 nt, Homo Sapiens; identical to SEQ ID NO: 27462

SEQ ID NO: 399053 - RNA, 64 nt, Homo Sapiens; identical to SEQ ID NO: 27463

SEQ ID NO: 399054 - RNA, 64 nt, Homo Sapiens; identical to SEQ ID NO: 27464

SEQ ID NO: 399055 - RNA, 64 nt, Homo Sapiens; identical to SEQ ID NO: 27465

SEQ ID NO: 399056 - RNA, 64 nt, Homo Sapiens; identical to SEQ ID NO: 27466

SEQ ID NO: 399057 - RNA, 64 nt, Homo Sapiens; identical to SEQ ID NO: 27467

SEQ ID NO: 399058 - RNA, 64 nt, Homo Sapiens; identical to SEQ ID NO: 27468

SEQ ID NO: 399059 - RNA, 64 nt, Homo Sapiens; identical to SEQ ID NO: 27469

SEQ ID NO: 399060 - RNA, 64 nt, Homo Sapiens; identical to SEQ ID NO: 27470

SEQ ID NO: 399061 - RNA, 64 nt, Homo Sapiens; identical to SEQ ID NO: 27471

SEQ ID NO: 399062 - RNA, 64 nt, Homo Sapiens; identical to SEQ ID NO: 27472

SEQ ID NO: 399063 - RNA, 64 nt, Homo Sapiens; identical to SEQ ID NO: 27473

SEQ ID NO: 399064 - RNA, 64 nt, Homo Sapiens; identical to SEQ ID NO: 27474

SEQ ID NO: 399065 - RNA, 64 nt, Homo Sapiens; identical to SEQ ID NO: 27475

SEQ ID NO: 399066 - RNA, 64 nt, Homo Sapiens; identical to SEQ ID NO: 27476

SEQ ID NO: 399067 - RNA, 64 nt, Homo Sapiens; identical to SEQ ID NO: 27477

SEQ ID NO: 399068 - RNA, 64 nt, Homo Sapiens; identical to SEQ ID NO: 27478

SEQ ID NO: 399069 - RNA, 64 nt, Homo Sapiens; identical to SEQ ID NO: 27479

SEQ ID NO: 399070 - RNA, 64 nt, Homo Sapiens; identical to SEQ ID NO: 27480

SEQ ID NO: 399071 - RNA, 64 nt, Homo Sapiens; identical to SEQ ID NO: 27481

SEQ ID NO: 399072 - RNA, 64 nt, Homo Sapiens; identical to SEQ ID NO: 27482

SEQ ID NO: 399073 - RNA, 64 nt, Homo Sapiens; identical to SEQ ID NO: 27483

SEQ ID NO: 399074 - RNA, 64 nt, Homo Sapiens; identical to SEQ ID NO: 27484

SEQ ID NO: 399075 - RNA, 64 nt, Homo Sapiens; identical to SEQ ID NO: 27485

SEQ ID NO: 399076 - RNA, 64 nt, Homo Sapiens; identical to SEQ ID NO: 27486

SEQ ID NO: 399077 - RNA, 64 nt, Homo Sapiens; identical to SEQ ID NO: 27487

SEQ ID NO: 399078 - RNA, 64 nt, Homo Sapiens; identical to SEQ ID NO: 27488

SEQ ID NO: 399079 - RNA, 64 nt, Homo Sapiens; identical to SEQ ID NO: 27489

SEQ ID NO: 399080 - RNA, 64 nt, Homo Sapiens; identical to SEQ ID NO: 27490

SEQ ID NO: 399081 - RNA, 64 nt, Homo Sapiens; identical to SEQ ID NO: 27491

SEQ ID NO: 399082 - RNA, 64 nt, Homo Sapiens; identical to SEQ ID NO: 27492

SEQ ID NO: 399083 - RNA, 64 nt, Homo Sapiens; identical to SEQ ID NO: 27493

SEQ ID NO: 399084 - RNA, 64 nt, Homo Sapiens; identical to SEQ ID NO: 27494

SEQ ID NO: 399085 - RNA, 64 nt, Homo Sapiens; identical to SEQ ID NO: 27495

SEQ ID NO: 399086 - RNA, 64 nt, Homo Sapiens; identical to SEQ ID NO: 27496

SEQ ID NO: 399087 - RNA, 64 nt, Homo Sapiens; identical to SEQ ID NO: 27497

SEQ ID NO: 399088 - RNA, 64 nt, Homo Sapiens; identical to SEQ ID NO: 27498

SEQ ID NO: 399089 - RNA, 64 nt, Homo Sapiens; identical to SEQ ID NO: 27499

SEQ ID NO: 399090 - RNA, 64 nt, Homo Sapiens; identical to SEQ ID NO: 27500

SEQ ID NO: 399091 - RNA, 64 nt, Homo Sapiens; identical to SEQ ID NO: 27501

SEQ ID NO: 399092 - RNA, 64 nt, Homo Sapiens; identical to SEQ ID NO: 27502

SEQ ID NO: 399093 - RNA, 64 nt, Homo Sapiens; identical to SEQ ID NO: 27503

SEQ ID NO: 399094 - RNA, 64 nt, Homo Sapiens; identical to SEQ ID NO: 27504

SEQ ID NO: 399095 - RNA, 64 nt, Homo Sapiens; identical to SEQ ID NO: 27505

SEQ ID NO: 399096 - RNA, 64 nt, Homo Sapiens; identical to SEQ ID NO: 27506

SEQ ID NO: 399097 - RNA, 64 nt, Homo Sapiens; identical to SEQ ID NO: 27507

SEQ ID NO: 399098 - RNA, 64 nt, Homo Sapiens; identical to SEQ ID NO: 27508

SEQ ID NO: 399099 - RNA, 64 nt, Homo Sapiens; identical to SEQ ID NO: 27509

SEQ ID NO: 399100 - RNA, 64 nt, Homo Sapiens; identical to SEQ ID NO: 27510

SEQ ID NO: 399101 - RNA, 64 nt, Homo Sapiens; identical to SEQ ID NO: 27511

SEQ ID NO: 399102 - RNA, 64 nt, Homo Sapiens; identical to SEQ ID NO: 27512

SEQ ID NO: 399103 - RNA, 64 nt, Homo Sapiens; identical to SEQ ID NO: 27513

SEQ ID NO: 399104 - RNA, 64 nt, Homo Sapiens; identical to SEQ ID NO: 27514

SEQ ID NO: 399105 - RNA, 64 nt, Homo Sapiens; identical to SEQ ID NO: 27515

SEQ ID NO: 399106 - RNA, 64 nt, Homo Sapiens; identical to SEQ ID NO: 27516

SEQ ID NO: 399107 - RNA, 64 nt, Homo Sapiens; identical to SEQ ID NO: 27517

SEQ ID NO: 399108 - RNA, 64 nt, Homo Sapiens; identical to SEQ ID NO: 27518

SEQ ID NO: 399109 - RNA, 64 nt, Homo Sapiens; identical to SEQ ID NO: 27519

SEQ ID NO: 399110 - RNA, 64 nt, Homo Sapiens; identical to SEQ ID NO: 27520

SEQ ID NO: 399111 - RNA, 64 nt, Homo Sapiens; identical to SEQ ID NO: 27521

SEQ ID NO: 399112 - RNA, 64 nt, Homo Sapiens; identical to SEQ ID NO: 27522

SEQ ID NO: 399113 - RNA, 64 nt, Homo Sapiens; identical to SEQ ID NO: 27523

SEQ ID NO: 399114 - RNA, 64 nt, Homo Sapiens; identical to SEQ ID NO: 27524

SEQ ID NO: 399115 - RNA, 64 nt, Homo Sapiens; identical to SEQ ID NO: 27525

SEQ ID NO: 399116 - RNA, 64 nt, Homo Sapiens; identical to SEQ ID NO: 27526

SEQ ID NO: 399117 - RNA, 64 nt, Homo Sapiens; identical to SEQ ID NO: 27527

SEQ ID NO: 399118 - RNA, 64 nt, Homo Sapiens; identical to SEQ ID NO: 27528

SEQ ID NO: 399119 - RNA, 64 nt, Homo Sapiens; identical to SEQ ID NO: 27529

SEQ ID NO: 399120 - RNA, 64 nt, Homo Sapiens; identical to SEQ ID NO: 27530

SEQ ID NO: 399121 - RNA, 64 nt, Homo Sapiens; identical to SEQ ID NO: 27531

SEQ ID NO: 399122 - RNA, 64 nt, Homo Sapiens; identical to SEQ ID NO: 27532

SEQ ID NO: 399123 - RNA, 64 nt, Homo Sapiens; identical to SEQ ID NO: 27533

SEQ ID NO: 399124 - RNA, 64 nt, Homo Sapiens; identical to SEQ ID NO: 27534

SEQ ID NO: 399125 - RNA, 64 nt, Homo Sapiens; identical to SEQ ID NO: 27535

SEQ ID NO: 399126 - RNA, 64 nt, Homo Sapiens; identical to SEQ ID NO: 27536

SEQ ID NO: 399127 - RNA, 64 nt, Homo Sapiens; identical to SEQ ID NO: 27537

SEQ ID NO: 399128 - RNA, 64 nt, Homo Sapiens; identical to SEQ ID NO: 27538

SEQ ID NO: 399129 - RNA, 64 nt, Homo Sapiens; identical to SEQ ID NO: 27539

SEQ ID NO: 399130 - RNA, 64 nt, Homo Sapiens; identical to SEQ ID NO: 27540

SEQ ID NO: 399131 - RNA, 64 nt, Homo Sapiens; identical to SEQ ID NO: 27541

SEQ ID NO: 399132 - RNA, 64 nt, Homo Sapiens; identical to SEQ ID NO: 27542

SEQ ID NO: 399133 - RNA, 64 nt, Homo Sapiens; identical to SEQ ID NO: 27543

SEQ ID NO: 399134 - RNA, 64 nt, Homo Sapiens; identical to SEQ ID NO: 27544

SEQ ID NO: 399135 - RNA, 64 nt, Homo Sapiens; identical to SEQ ID NO: 27545

SEQ ID NO: 399136 - RNA, 64 nt, Homo Sapiens; identical to SEQ ID NO: 27546

SEQ ID NO: 399137 - RNA, 64 nt, Homo Sapiens; identical to SEQ ID NO: 27547

SEQ ID NO: 399138 - RNA, 64 nt, Homo Sapiens; identical to SEQ ID NO: 27548

SEQ ID NO: 399139 - RNA, 64 nt, Homo Sapiens; identical to SEQ ID NO: 27549

SEQ ID NO: 399140 - RNA, 64 nt, Homo Sapiens; identical to SEQ ID NO: 27550

SEQ ID NO: 399141 - RNA, 64 nt, Homo Sapiens; identical to SEQ ID NO: 27551

SEQ ID NO: 399142 - RNA, 64 nt, Homo Sapiens; identical to SEQ ID NO: 27552

SEQ ID NO: 399143 - RNA, 64 nt, Homo Sapiens; identical to SEQ ID NO: 27553

SEQ ID NO: 399144 - RNA, 64 nt, Homo Sapiens; identical to SEQ ID NO: 27554

SEQ ID NO: 399145 - RNA, 64 nt, Homo Sapiens; identical to SEQ ID NO: 27555

SEQ ID NO: 399146 - RNA, 64 nt, Homo Sapiens; identical to SEQ ID NO: 27556

SEQ ID NO: 399147 - RNA, 64 nt, Homo Sapiens; identical to SEQ ID NO: 27557

SEQ ID NO: 399148 - RNA, 64 nt, Homo Sapiens; identical to SEQ ID NO: 27558

SEQ ID NO: 399149 - RNA, 64 nt, Homo Sapiens; identical to SEQ ID NO: 27559

SEQ ID NO: 399150 - RNA, 64 nt, Homo Sapiens; identical to SEQ ID NO: 27560

SEQ ID NO: 399151 - RNA, 64 nt, Homo Sapiens; identical to SEQ ID NO: 27561

SEQ ID NO: 399152 - RNA, 64 nt, Homo Sapiens; identical to SEQ ID NO: 27562

SEQ ID NO: 399153 - RNA, 64 nt, Homo Sapiens; identical to SEQ ID NO: 27563

SEQ ID NO: 399154 - RNA, 64 nt, Homo Sapiens; identical to SEQ ID NO: 27564

SEQ ID NO: 399155 - RNA, 64 nt, Homo Sapiens; identical to SEQ ID NO: 27565

SEQ ID NO: 399156 - RNA, 64 nt, Homo Sapiens; identical to SEQ ID NO: 27566

SEQ ID NO: 399157 - RNA, 64 nt, Homo Sapiens; identical to SEQ ID NO: 27567

SEQ ID NO: 399158 - RNA, 64 nt, Homo Sapiens; identical to SEQ ID NO: 27568

SEQ ID NO: 399159 - RNA, 64 nt, Homo Sapiens; identical to SEQ ID NO: 27569

SEQ ID NO: 399160 - RNA, 64 nt, Homo Sapiens; identical to SEQ ID NO: 27570

SEQ ID NO: 399161 - RNA, 64 nt, Homo Sapiens; identical to SEQ ID NO: 27571

SEQ ID NO: 399162 - RNA, 64 nt, Homo Sapiens; identical to SEQ ID NO: 27572

SEQ ID NO: 399163 - RNA, 64 nt, Homo Sapiens; identical to SEQ ID NO: 27573

SEQ ID NO: 399164 - RNA, 64 nt, Homo Sapiens; identical to SEQ ID NO: 27574

SEQ ID NO: 399165 - RNA, 64 nt, Homo Sapiens; identical to SEQ ID NO: 27575

SEQ ID NO: 399166 - RNA, 64 nt, Homo Sapiens; identical to SEQ ID NO: 27576

SEQ ID NO: 399167 - RNA, 64 nt, Homo Sapiens; identical to SEQ ID NO: 27577

SEQ ID NO: 399168 - RNA, 64 nt, Homo Sapiens; identical to SEQ ID NO: 27578

SEQ ID NO: 399169 - RNA, 64 nt, Homo Sapiens; identical to SEQ ID NO: 27579

SEQ ID NO: 399170 - RNA, 64 nt, Homo Sapiens; identical to SEQ ID NO: 27580

SEQ ID NO: 399171 - RNA, 64 nt, Homo Sapiens; identical to SEQ ID NO: 27581

SEQ ID NO: 399172 - RNA, 64 nt, Homo Sapiens; identical to SEQ ID NO: 27582

SEQ ID NO: 399173 - RNA, 64 nt, Homo Sapiens; identical to SEQ ID NO: 27583

SEQ ID NO: 399174 - RNA, 64 nt, Homo Sapiens; identical to SEQ ID NO: 27584

SEQ ID NO: 399175 - RNA, 64 nt, Homo Sapiens; identical to SEQ ID NO: 27585

SEQ ID NO: 399176 - RNA, 64 nt, Homo Sapiens; identical to SEQ ID NO: 27586

SEQ ID NO: 399177 - RNA, 64 nt, Homo Sapiens; identical to SEQ ID NO: 27587

SEQ ID NO: 399178 - RNA, 64 nt, Homo Sapiens; identical to SEQ ID NO: 27588

SEQ ID NO: 399179 - RNA, 64 nt, Homo Sapiens; identical to SEQ ID NO: 27589

SEQ ID NO: 399180 - RNA, 64 nt, Homo Sapiens; identical to SEQ ID NO: 27590

SEQ ID NO: 399181 - RNA, 64 nt, Homo Sapiens; identical to SEQ ID NO: 27591

SEQ ID NO: 399182 - RNA, 64 nt, Homo Sapiens; identical to SEQ ID NO: 27592

SEQ ID NO: 399183 - RNA, 64 nt, Homo Sapiens; identical to SEQ ID NO: 27593

SEQ ID NO: 399184 - RNA, 64 nt, Homo Sapiens; identical to SEQ ID NO: 27594

SEQ ID NO: 399185 - RNA, 64 nt, Homo Sapiens; identical to SEQ ID NO: 27595

SEQ ID NO: 399186 - RNA, 64 nt, Homo Sapiens; identical to SEQ ID NO: 27596

SEQ ID NO: 399187 - RNA, 64 nt, Homo Sapiens; identical to SEQ ID NO: 27597

SEQ ID NO: 399188 - RNA, 64 nt, Homo Sapiens; identical to SEQ ID NO: 27598

SEQ ID NO: 399189 - RNA, 64 nt, Homo Sapiens; identical to SEQ ID NO: 27599

SEQ ID NO: 399190 - RNA, 64 nt, Homo Sapiens; identical to SEQ ID NO: 27600

SEQ ID NO: 399191 - RNA, 64 nt, Homo Sapiens; identical to SEQ ID NO: 27601

SEQ ID NO: 399192 - RNA, 64 nt, Homo Sapiens; identical to SEQ ID NO: 27602

SEQ ID NO: 399193 - RNA, 64 nt, Homo Sapiens; identical to SEQ ID NO: 27603

SEQ ID NO: 399194 - RNA, 64 nt, Homo Sapiens; identical to SEQ ID NO: 27604

SEQ ID NO: 399195 - RNA, 64 nt, Homo Sapiens; identical to SEQ ID NO: 27605

SEQ ID NO: 399196 - RNA, 64 nt, Homo Sapiens; identical to SEQ ID NO: 27606

SEQ ID NO: 399197 - RNA, 64 nt, Homo Sapiens; identical to SEQ ID NO: 27607

SEQ ID NO: 399198 - RNA, 64 nt, Homo Sapiens; identical to SEQ ID NO: 27608

SEQ ID NO: 399199 - RNA, 64 nt, Homo Sapiens; identical to SEQ ID NO: 27609

SEQ ID NO: 399200 - RNA, 64 nt, Homo Sapiens; identical to SEQ ID NO: 27610

SEQ ID NO: 399201 - RNA, 64 nt, Homo Sapiens; identical to SEQ ID NO: 27611

SEQ ID NO: 399202 - RNA, 64 nt, Homo Sapiens; identical to SEQ ID NO: 27612

SEQ ID NO: 399203 - RNA, 64 nt, Homo Sapiens; identical to SEQ ID NO: 27613

SEQ ID NO: 399204 - RNA, 64 nt, Homo Sapiens; identical to SEQ ID NO: 27614

SEQ ID NO: 399205 - RNA, 64 nt, Homo Sapiens; identical to SEQ ID NO: 27615

SEQ ID NO: 399206 - RNA, 64 nt, Homo Sapiens; identical to SEQ ID NO: 27616

SEQ ID NO: 399207 - RNA, 64 nt, Homo Sapiens; identical to SEQ ID NO: 27617

SEQ ID NO: 399208 - RNA, 64 nt, Homo Sapiens; identical to SEQ ID NO: 27618

SEQ ID NO: 399209 - RNA, 64 nt, Homo Sapiens; identical to SEQ ID NO: 27619

SEQ ID NO: 399210 - RNA, 64 nt, Homo Sapiens; identical to SEQ ID NO: 27620

SEQ ID NO: 399211 - RNA, 64 nt, Homo Sapiens; identical to SEQ ID NO: 27621

SEQ ID NO: 399212 - RNA, 64 nt, Homo Sapiens; identical to SEQ ID NO: 27622

SEQ ID NO: 399213 - RNA, 64 nt, Homo Sapiens; identical to SEQ ID NO: 27623

SEQ ID NO: 399214 - RNA, 64 nt, Homo Sapiens; identical to SEQ ID NO: 27624

SEQ ID NO: 399215 - RNA, 64 nt, Homo Sapiens; identical to SEQ ID NO: 27625

SEQ ID NO: 399216 - RNA, 64 nt, Homo Sapiens; identical to SEQ ID NO: 27626

SEQ ID NO: 399217 - RNA, 64 nt, Homo Sapiens; identical to SEQ ID NO: 27627

SEQ ID NO: 399218 - RNA, 64 nt, Homo Sapiens; identical to SEQ ID NO: 27628

SEQ ID NO: 399219 - RNA, 64 nt, Homo Sapiens; identical to SEQ ID NO: 27629

SEQ ID NO: 399220 - RNA, 64 nt, Homo Sapiens; identical to SEQ ID NO: 27630

SEQ ID NO: 399221 - RNA, 64 nt, Homo Sapiens; identical to SEQ ID NO: 27631

SEQ ID NO: 399222 - RNA, 64 nt, Homo Sapiens; identical to SEQ ID NO: 27632

SEQ ID NO: 399223 - RNA, 64 nt, Homo Sapiens; identical to SEQ ID NO: 27633

SEQ ID NO: 399224 - RNA, 64 nt, Homo Sapiens; identical to SEQ ID NO: 27634

SEQ ID NO: 399225 - RNA, 64 nt, Homo Sapiens; identical to SEQ ID NO: 27635

SEQ ID NO: 399226 - RNA, 64 nt, Homo Sapiens; identical to SEQ ID NO: 27636

SEQ ID NO: 399227 - RNA, 64 nt, Homo Sapiens; identical to SEQ ID NO: 27637

SEQ ID NO: 399228 - RNA, 64 nt, Homo Sapiens; identical to SEQ ID NO: 27638

SEQ ID NO: 399229 - RNA, 64 nt, Homo Sapiens; identical to SEQ ID NO: 27639

SEQ ID NO: 399230 - RNA, 64 nt, Homo Sapiens; identical to SEQ ID NO: 27640

SEQ ID NO: 399231 - RNA, 64 nt, Homo Sapiens; identical to SEQ ID NO: 27641

SEQ ID NO: 399232 - RNA, 64 nt, Homo Sapiens; identical to SEQ ID NO: 27642

SEQ ID NO: 399233 - RNA, 64 nt, Homo Sapiens; identical to SEQ ID NO: 27643

SEQ ID NO: 399234 - RNA, 64 nt, Homo Sapiens; identical to SEQ ID NO: 27644

SEQ ID NO: 399235 - RNA, 64 nt, Homo Sapiens; identical to SEQ ID NO: 27645

SEQ ID NO: 399236 - RNA, 64 nt, Homo Sapiens; identical to SEQ ID NO: 27646

SEQ ID NO: 399237 - RNA, 64 nt, Homo Sapiens; identical to SEQ ID NO: 27647

SEQ ID NO: 399238 - RNA, 64 nt, Homo Sapiens; identical to SEQ ID NO: 27648

SEQ ID NO: 399239 - RNA, 64 nt, Homo Sapiens; identical to SEQ ID NO: 27649

SEQ ID NO: 399240 - RNA, 64 nt, Homo Sapiens; identical to SEQ ID NO: 27650

SEQ ID NO: 399241 - RNA, 64 nt, Homo Sapiens; identical to SEQ ID NO: 27651

SEQ ID NO: 399242 - RNA, 64 nt, Homo Sapiens; identical to SEQ ID NO: 27652

SEQ ID NO: 399243 - RNA, 64 nt, Homo Sapiens; identical to SEQ ID NO: 27653

SEQ ID NO: 399244 - RNA, 64 nt, Homo Sapiens; identical to SEQ ID NO: 27654

SEQ ID NO: 399245 - RNA, 64 nt, Homo Sapiens; identical to SEQ ID NO: 27655

SEQ ID NO: 399246 - RNA, 64 nt, Homo Sapiens; identical to SEQ ID NO: 27656

SEQ ID NO: 399247 - RNA, 64 nt, Homo Sapiens; identical to SEQ ID NO: 27657

SEQ ID NO: 399248 - RNA, 64 nt, Homo Sapiens; identical to SEQ ID NO: 27658

SEQ ID NO: 399249 - RNA, 64 nt, Homo Sapiens; identical to SEQ ID NO: 27659

SEQ ID NO: 399250 - RNA, 64 nt, Homo Sapiens; identical to SEQ ID NO: 27660

SEQ ID NO: 399251 - RNA, 64 nt, Homo Sapiens; identical to SEQ ID NO: 27661

SEQ ID NO: 399252 - RNA, 64 nt, Homo Sapiens; identical to SEQ ID NO: 27662

SEQ ID NO: 399253 - RNA, 64 nt, Homo Sapiens; identical to SEQ ID NO: 27663

SEQ ID NO: 399254 - RNA, 64 nt, Homo Sapiens; identical to SEQ ID NO: 27664

SEQ ID NO: 399255 - RNA, 64 nt, Homo Sapiens; identical to SEQ ID NO: 27665

SEQ ID NO: 399256 - RNA, 64 nt, Homo Sapiens; identical to SEQ ID NO: 27666

SEQ ID NO: 399257 - RNA, 64 nt, Homo Sapiens; identical to SEQ ID NO: 27667

SEQ ID NO: 399258 - RNA, 64 nt, Homo Sapiens; identical to SEQ ID NO: 27668

SEQ ID NO: 399259 - RNA, 64 nt, Homo Sapiens; identical to SEQ ID NO: 27669

SEQ ID NO: 399260 - RNA, 64 nt, Homo Sapiens; identical to SEQ ID NO: 27670

SEQ ID NO: 399261 - RNA, 64 nt, Homo Sapiens; identical to SEQ ID NO: 27671

SEQ ID NO: 399262 - RNA, 64 nt, Homo Sapiens; identical to SEQ ID NO: 27672

SEQ ID NO: 399263 - RNA, 64 nt, Homo Sapiens; identical to SEQ ID NO: 27673

SEQ ID NO: 399264 - RNA, 64 nt, Homo Sapiens; identical to SEQ ID NO: 27674

SEQ ID NO: 399265 - RNA, 64 nt, Homo Sapiens; identical to SEQ ID NO: 27675

SEQ ID NO: 399266 - RNA, 64 nt, Homo Sapiens; identical to SEQ ID NO: 27676

SEQ ID NO: 399267 - RNA, 64 nt, Homo Sapiens; identical to SEQ ID NO: 27677

SEQ ID NO: 399268 - RNA, 64 nt, Homo Sapiens; identical to SEQ ID NO: 27678

SEQ ID NO: 399269 - RNA, 64 nt, Homo Sapiens; identical to SEQ ID NO: 27679

SEQ ID NO: 399270 - RNA, 64 nt, Homo Sapiens; identical to SEQ ID NO: 27680

SEQ ID NO: 399271 - RNA, 64 nt, Homo Sapiens; identical to SEQ ID NO: 27681

SEQ ID NO: 399272 - RNA, 64 nt, Homo Sapiens; identical to SEQ ID NO: 27682

SEQ ID NO: 399273 - RNA, 64 nt, Homo Sapiens; identical to SEQ ID NO: 27683

SEQ ID NO: 399274 - RNA, 64 nt, Homo Sapiens; identical to SEQ ID NO: 27684

SEQ ID NO: 399275 - RNA, 64 nt, Homo Sapiens; identical to SEQ ID NO: 27685

SEQ ID NO: 399276 - RNA, 64 nt, Homo Sapiens; identical to SEQ ID NO: 27686

SEQ ID NO: 399277 - RNA, 64 nt, Homo Sapiens; identical to SEQ ID NO: 27687

SEQ ID NO: 399278 - RNA, 64 nt, Homo Sapiens; identical to SEQ ID NO: 27688

SEQ ID NO: 399279 - RNA, 64 nt, Homo Sapiens; identical to SEQ ID NO: 27689

SEQ ID NO: 399280 - RNA, 64 nt, Homo Sapiens; identical to SEQ ID NO: 27690

SEQ ID NO: 399281 - RNA, 64 nt, Homo Sapiens; identical to SEQ ID NO: 27691

SEQ ID NO: 399282 - RNA, 64 nt, Homo Sapiens; identical to SEQ ID NO: 27692

SEQ ID NO: 399283 - RNA, 64 nt, Homo Sapiens; identical to SEQ ID NO: 27693

SEQ ID NO: 399284 - RNA, 64 nt, Homo Sapiens; identical to SEQ ID NO: 27694

SEQ ID NO: 399285 - RNA, 64 nt, Homo Sapiens; identical to SEQ ID NO: 27695

SEQ ID NO: 399286 - RNA, 64 nt, Homo Sapiens; identical to SEQ ID NO: 27696

SEQ ID NO: 399287 - RNA, 64 nt, Homo Sapiens; identical to SEQ ID NO: 27697

SEQ ID NO: 399288 - RNA, 64 nt, Homo Sapiens; identical to SEQ ID NO: 27698

SEQ ID NO: 399289 - RNA, 64 nt, Homo Sapiens; identical to SEQ ID NO: 27699

SEQ ID NO: 399290 - RNA, 64 nt, Homo Sapiens; identical to SEQ ID NO: 27700

SEQ ID NO: 399291 - RNA, 64 nt, Homo Sapiens; identical to SEQ ID NO: 27701

SEQ ID NO: 399292 - RNA, 64 nt, Homo Sapiens; identical to SEQ ID NO: 27702

SEQ ID NO: 399293 - RNA, 64 nt, Homo Sapiens; identical to SEQ ID NO: 27703

SEQ ID NO: 399294 - RNA, 64 nt, Homo Sapiens; identical to SEQ ID NO: 27704

SEQ ID NO: 399295 - RNA, 64 nt, Homo Sapiens; identical to SEQ ID NO: 27705

SEQ ID NO: 399296 - RNA, 64 nt, Homo Sapiens; identical to SEQ ID NO: 27706

SEQ ID NO: 399297 - RNA, 64 nt, Homo Sapiens; identical to SEQ ID NO: 27707

SEQ ID NO: 399298 - RNA, 64 nt, Homo Sapiens; identical to SEQ ID NO: 27708

SEQ ID NO: 399299 - RNA, 64 nt, Homo Sapiens; identical to SEQ ID NO: 27709

SEQ ID NO: 399300 - RNA, 64 nt, Homo Sapiens; identical to SEQ ID NO: 27710

SEQ ID NO: 399301 - RNA, 64 nt, Homo Sapiens; identical to SEQ ID NO: 27711

SEQ ID NO: 399302 - RNA, 64 nt, Homo Sapiens; identical to SEQ ID NO: 27712

SEQ ID NO: 399303 - RNA, 64 nt, Homo Sapiens; identical to SEQ ID NO: 27713

SEQ ID NO: 399304 - RNA, 64 nt, Homo Sapiens; identical to SEQ ID NO: 27714

SEQ ID NO: 399305 - RNA, 64 nt, Homo Sapiens; identical to SEQ ID NO: 27715

SEQ ID NO: 399306 - RNA, 64 nt, Homo Sapiens; identical to SEQ ID NO: 27716

SEQ ID NO: 399307 - RNA, 64 nt, Homo Sapiens; identical to SEQ ID NO: 27717

SEQ ID NO: 399308 - RNA, 64 nt, Homo Sapiens; identical to SEQ ID NO: 27718

SEQ ID NO: 399309 - RNA, 64 nt, Homo Sapiens; identical to SEQ ID NO: 27719

SEQ ID NO: 399310 - RNA, 64 nt, Homo Sapiens; identical to SEQ ID NO: 27720

SEQ ID NO: 399311 - RNA, 64 nt, Homo Sapiens; identical to SEQ ID NO: 27721

SEQ ID NO: 399312 - RNA, 64 nt, Homo Sapiens; identical to SEQ ID NO: 27722

SEQ ID NO: 399313 - RNA, 64 nt, Homo Sapiens; identical to SEQ ID NO: 27723

SEQ ID NO: 399314 - RNA, 64 nt, Homo Sapiens; identical to SEQ ID NO: 27724

SEQ ID NO: 399315 - RNA, 64 nt, Homo Sapiens; identical to SEQ ID NO: 27725

SEQ ID NO: 399316 - RNA, 64 nt, Homo Sapiens; identical to SEQ ID NO: 27726

SEQ ID NO: 399317 - RNA, 64 nt, Homo Sapiens; identical to SEQ ID NO: 27727

SEQ ID NO: 399318 - RNA, 64 nt, Homo Sapiens; identical to SEQ ID NO: 27728

SEQ ID NO: 399319 - RNA, 64 nt, Homo Sapiens; identical to SEQ ID NO: 27729

SEQ ID NO: 399320 - RNA, 64 nt, Homo Sapiens; identical to SEQ ID NO: 27730

SEQ ID NO: 399321 - RNA, 64 nt, Homo Sapiens; identical to SEQ ID NO: 27731

SEQ ID NO: 399322 - RNA, 64 nt, Homo Sapiens; identical to SEQ ID NO: 27732

SEQ ID NO: 399323 - RNA, 64 nt, Homo Sapiens; identical to SEQ ID NO: 27733

SEQ ID NO: 399324 - RNA, 64 nt, Homo Sapiens; identical to SEQ ID NO: 27734

SEQ ID NO: 399325 - RNA, 64 nt, Homo Sapiens; identical to SEQ ID NO: 27735

SEQ ID NO: 399326 - RNA, 64 nt, Homo Sapiens; identical to SEQ ID NO: 27736

SEQ ID NO: 399327 - RNA, 64 nt, Homo Sapiens; identical to SEQ ID NO: 27737

SEQ ID NO: 399328 - RNA, 64 nt, Homo Sapiens; identical to SEQ ID NO: 27738

SEQ ID NO: 399329 - RNA, 64 nt, Homo Sapiens; identical to SEQ ID NO: 27739

SEQ ID NO: 399330 - RNA, 64 nt, Homo Sapiens; identical to SEQ ID NO: 27740

SEQ ID NO: 399331 - RNA, 64 nt, Homo Sapiens; identical to SEQ ID NO: 27741

SEQ ID NO: 399332 - RNA, 64 nt, Homo Sapiens; identical to SEQ ID NO: 27742

SEQ ID NO: 399333 - RNA, 64 nt, Homo Sapiens; identical to SEQ ID NO: 27743

SEQ ID NO: 399334 - RNA, 64 nt, Homo Sapiens; identical to SEQ ID NO: 27744

SEQ ID NO: 399335 - RNA, 64 nt, Homo Sapiens; identical to SEQ ID NO: 27745

SEQ ID NO: 399336 - RNA, 64 nt, Homo Sapiens; identical to SEQ ID NO: 27746

SEQ ID NO: 399337 - RNA, 64 nt, Homo Sapiens; identical to SEQ ID NO: 27747

SEQ ID NO: 399338 - RNA, 64 nt, Homo Sapiens; identical to SEQ ID NO: 27748

SEQ ID NO: 399339 - RNA, 64 nt, Homo Sapiens; identical to SEQ ID NO: 27749

SEQ ID NO: 399340 - RNA, 64 nt, Homo Sapiens; identical to SEQ ID NO: 27750

SEQ ID NO: 399341 - RNA, 64 nt, Homo Sapiens; identical to SEQ ID NO: 27751

SEQ ID NO: 399342 - RNA, 64 nt, Homo Sapiens; identical to SEQ ID NO: 27752

SEQ ID NO: 399343 - RNA, 64 nt, Homo Sapiens; identical to SEQ ID NO: 27753

SEQ ID NO: 399344 - RNA, 64 nt, Homo Sapiens; identical to SEQ ID NO: 27754

SEQ ID NO: 399345 - RNA, 64 nt, Homo Sapiens; identical to SEQ ID NO: 27755

SEQ ID NO: 399346 - RNA, 64 nt, Homo Sapiens; identical to SEQ ID NO: 27756

SEQ ID NO: 399347 - RNA, 64 nt, Homo Sapiens; identical to SEQ ID NO: 27757

SEQ ID NO: 399348 - RNA, 64 nt, Homo Sapiens; identical to SEQ ID NO: 27758

SEQ ID NO: 399349 - RNA, 64 nt, Homo Sapiens; identical to SEQ ID NO: 27759

SEQ ID NO: 399350 - RNA, 64 nt, Homo Sapiens; identical to SEQ ID NO: 27760

SEQ ID NO: 399351 - RNA, 64 nt, Homo Sapiens; identical to SEQ ID NO: 27761

SEQ ID NO: 399352 - RNA, 64 nt, Homo Sapiens; identical to SEQ ID NO: 27762

SEQ ID NO: 399353 - RNA, 64 nt, Homo Sapiens; identical to SEQ ID NO: 27763

SEQ ID NO: 399354 - RNA, 64 nt, Homo Sapiens; identical to SEQ ID NO: 27764

SEQ ID NO: 399355 - RNA, 64 nt, Homo Sapiens; identical to SEQ ID NO: 27765

SEQ ID NO: 399356 - RNA, 64 nt, Homo Sapiens; identical to SEQ ID NO: 27766

SEQ ID NO: 399357 - RNA, 64 nt, Homo Sapiens; identical to SEQ ID NO: 27767

SEQ ID NO: 399358 - RNA, 64 nt, Homo Sapiens; identical to SEQ ID NO: 27768

SEQ ID NO: 399359 - RNA, 64 nt, Homo Sapiens; identical to SEQ ID NO: 27769

SEQ ID NO: 399360 - RNA, 64 nt, Homo Sapiens; identical to SEQ ID NO: 27770

SEQ ID NO: 399361 - RNA, 64 nt, Homo Sapiens; identical to SEQ ID NO: 27771

SEQ ID NO: 399362 - RNA, 64 nt, Homo Sapiens; identical to SEQ ID NO: 27772

SEQ ID NO: 399363 - RNA, 64 nt, Homo Sapiens; identical to SEQ ID NO: 27773

SEQ ID NO: 399364 - RNA, 64 nt, Homo Sapiens; identical to SEQ ID NO: 27774

SEQ ID NO: 399365 - RNA, 64 nt, Homo Sapiens; identical to SEQ ID NO: 27775

SEQ ID NO: 399366 - RNA, 64 nt, Homo Sapiens; identical to SEQ ID NO: 27776

SEQ ID NO: 399367 - RNA, 64 nt, Homo Sapiens; identical to SEQ ID NO: 27777

SEQ ID NO: 399368 - RNA, 64 nt, Homo Sapiens; identical to SEQ ID NO: 27778

SEQ ID NO: 399369 - RNA, 64 nt, Homo Sapiens; identical to SEQ ID NO: 27779

SEQ ID NO: 399370 - RNA, 64 nt, Homo Sapiens; identical to SEQ ID NO: 27780

SEQ ID NO: 399371 - RNA, 64 nt, Homo Sapiens; identical to SEQ ID NO: 27781

SEQ ID NO: 399372 - RNA, 64 nt, Homo Sapiens; identical to SEQ ID NO: 27782

SEQ ID NO: 399373 - RNA, 64 nt, Homo Sapiens; identical to SEQ ID NO: 27783

SEQ ID NO: 399374 - RNA, 64 nt, Homo Sapiens; identical to SEQ ID NO: 27784

SEQ ID NO: 399375 - RNA, 64 nt, Homo Sapiens; identical to SEQ ID NO: 27785

SEQ ID NO: 399376 - RNA, 64 nt, Homo Sapiens; identical to SEQ ID NO: 27786

SEQ ID NO: 399377 - RNA, 64 nt, Homo Sapiens; identical to SEQ ID NO: 27787

SEQ ID NO: 399378 - RNA, 64 nt, Homo Sapiens; identical to SEQ ID NO: 27788

SEQ ID NO: 399379 - RNA, 64 nt, Homo Sapiens; identical to SEQ ID NO: 27789

SEQ ID NO: 399380 - RNA, 64 nt, Homo Sapiens; identical to SEQ ID NO: 27790

SEQ ID NO: 399381 - RNA, 64 nt, Homo Sapiens; identical to SEQ ID NO: 27791

SEQ ID NO: 399382 - RNA, 64 nt, Homo Sapiens; identical to SEQ ID NO: 27792

SEQ ID NO: 399383 - RNA, 64 nt, Homo Sapiens; identical to SEQ ID NO: 27793

SEQ ID NO: 399384 - RNA, 64 nt, Homo Sapiens; identical to SEQ ID NO: 27794

SEQ ID NO: 399385 - RNA, 64 nt, Homo Sapiens; identical to SEQ ID NO: 27795

SEQ ID NO: 399386 - RNA, 64 nt, Homo Sapiens; identical to SEQ ID NO: 27796

SEQ ID NO: 399387 - RNA, 64 nt, Homo Sapiens; identical to SEQ ID NO: 27797

SEQ ID NO: 399388 - RNA, 64 nt, Homo Sapiens; identical to SEQ ID NO: 27798

SEQ ID NO: 399389 - RNA, 64 nt, Homo Sapiens; identical to SEQ ID NO: 27799

SEQ ID NO: 399390 - RNA, 64 nt, Homo Sapiens; identical to SEQ ID NO: 27800

SEQ ID NO: 399391 - RNA, 64 nt, Homo Sapiens; identical to SEQ ID NO: 27801

SEQ ID NO: 399392 - RNA, 64 nt, Homo Sapiens; identical to SEQ ID NO: 27802

SEQ ID NO: 399393 - RNA, 64 nt, Homo Sapiens; identical to SEQ ID NO: 27803

SEQ ID NO: 399394 - RNA, 64 nt, Homo Sapiens; identical to SEQ ID NO: 27804

SEQ ID NO: 399395 - RNA, 64 nt, Homo Sapiens; identical to SEQ ID NO: 27805

SEQ ID NO: 399396 - RNA, 64 nt, Homo Sapiens; identical to SEQ ID NO: 27806

SEQ ID NO: 399397 - RNA, 64 nt, Homo Sapiens; identical to SEQ ID NO: 27807

SEQ ID NO: 399398 - RNA, 64 nt, Homo Sapiens; identical to SEQ ID NO: 27808

SEQ ID NO: 399399 - RNA, 64 nt, Homo Sapiens; identical to SEQ ID NO: 27809

SEQ ID NO: 399400 - RNA, 64 nt, Homo Sapiens; identical to SEQ ID NO: 27810

SEQ ID NO: 399401 - RNA, 64 nt, Homo Sapiens; identical to SEQ ID NO: 27811

SEQ ID NO: 399402 - RNA, 64 nt, Homo Sapiens; identical to SEQ ID NO: 27812

SEQ ID NO: 399403 - RNA, 64 nt, Homo Sapiens; identical to SEQ ID NO: 27813

SEQ ID NO: 399404 - RNA, 64 nt, Homo Sapiens; identical to SEQ ID NO: 27814

SEQ ID NO: 399405 - RNA, 64 nt, Homo Sapiens; identical to SEQ ID NO: 27815

SEQ ID NO: 399406 - RNA, 64 nt, Homo Sapiens; identical to SEQ ID NO: 27816

SEQ ID NO: 399407 - RNA, 64 nt, Homo Sapiens; identical to SEQ ID NO: 27817

SEQ ID NO: 399408 - RNA, 64 nt, Homo Sapiens; identical to SEQ ID NO: 27818

SEQ ID NO: 399409 - RNA, 64 nt, Homo Sapiens; identical to SEQ ID NO: 27819

SEQ ID NO: 399410 - RNA, 64 nt, Homo Sapiens; identical to SEQ ID NO: 27820

SEQ ID NO: 399411 - RNA, 64 nt, Homo Sapiens; identical to SEQ ID NO: 27821

SEQ ID NO: 399412 - RNA, 64 nt, Homo Sapiens; identical to SEQ ID NO: 27822

SEQ ID NO: 399413 - RNA, 64 nt, Homo Sapiens; identical to SEQ ID NO: 27823

SEQ ID NO: 399414 - RNA, 64 nt, Homo Sapiens; identical to SEQ ID NO: 27824

SEQ ID NO: 399415 - RNA, 64 nt, Homo Sapiens; identical to SEQ ID NO: 27825

SEQ ID NO: 399416 - RNA, 64 nt, Homo Sapiens; identical to SEQ ID NO: 27826

SEQ ID NO: 399417 - RNA, 64 nt, Homo Sapiens; identical to SEQ ID NO: 27827

SEQ ID NO: 399418 - RNA, 64 nt, Homo Sapiens; identical to SEQ ID NO: 27828

SEQ ID NO: 399419 - RNA, 64 nt, Homo Sapiens; identical to SEQ ID NO: 27829

SEQ ID NO: 399420 - RNA, 64 nt, Homo Sapiens; identical to SEQ ID NO: 27830

SEQ ID NO: 399421 - RNA, 64 nt, Homo Sapiens; identical to SEQ ID NO: 27831

SEQ ID NO: 399422 - RNA, 64 nt, Homo Sapiens; identical to SEQ ID NO: 27832

SEQ ID NO: 399423 - RNA, 64 nt, Homo Sapiens; identical to SEQ ID NO: 27833

SEQ ID NO: 399424 - RNA, 64 nt, Homo Sapiens; identical to SEQ ID NO: 27834

SEQ ID NO: 399425 - RNA, 64 nt, Homo Sapiens; identical to SEQ ID NO: 27835

SEQ ID NO: 399426 - RNA, 64 nt, Homo Sapiens; identical to SEQ ID NO: 27836

SEQ ID NO: 399427 - RNA, 64 nt, Homo Sapiens; identical to SEQ ID NO: 27837

SEQ ID NO: 399428 - RNA, 64 nt, Homo Sapiens; identical to SEQ ID NO: 27838

SEQ ID NO: 399429 - RNA, 64 nt, Homo Sapiens; identical to SEQ ID NO: 27839

SEQ ID NO: 399430 - RNA, 64 nt, Homo Sapiens; identical to SEQ ID NO: 27840

SEQ ID NO: 399431 - RNA, 64 nt, Homo Sapiens; identical to SEQ ID NO: 27841

SEQ ID NO: 399432 - RNA, 64 nt, Homo Sapiens; identical to SEQ ID NO: 27842

SEQ ID NO: 399433 - RNA, 64 nt, Homo Sapiens; identical to SEQ ID NO: 27843

SEQ ID NO: 399434 - RNA, 64 nt, Homo Sapiens; identical to SEQ ID NO: 27844

SEQ ID NO: 399435 - RNA, 64 nt, Homo Sapiens; identical to SEQ ID NO: 27845

SEQ ID NO: 399436 - RNA, 64 nt, Homo Sapiens; identical to SEQ ID NO: 27846

SEQ ID NO: 399437 - RNA, 64 nt, Homo Sapiens; identical to SEQ ID NO: 27847

SEQ ID NO: 399438 - RNA, 64 nt, Homo Sapiens; identical to SEQ ID NO: 27848

SEQ ID NO: 399439 - RNA, 64 nt, Homo Sapiens; identical to SEQ ID NO: 27849

SEQ ID NO: 399440 - RNA, 64 nt, Homo Sapiens; identical to SEQ ID NO: 27850

SEQ ID NO: 399441 - RNA, 64 nt, Homo Sapiens; identical to SEQ ID NO: 27851

SEQ ID NO: 399442 - RNA, 64 nt, Homo Sapiens; identical to SEQ ID NO: 27852

SEQ ID NO: 399443 - RNA, 64 nt, Homo Sapiens; identical to SEQ ID NO: 27853

SEQ ID NO: 399444 - RNA, 64 nt, Homo Sapiens; identical to SEQ ID NO: 27854

SEQ ID NO: 399445 - RNA, 64 nt, Homo Sapiens; identical to SEQ ID NO: 27855

SEQ ID NO: 399446 - RNA, 64 nt, Homo Sapiens; identical to SEQ ID NO: 27856

SEQ ID NO: 399447 - RNA, 64 nt, Homo Sapiens; identical to SEQ ID NO: 27857

SEQ ID NO: 399448 - RNA, 64 nt, Homo Sapiens; identical to SEQ ID NO: 27858

SEQ ID NO: 399449 - RNA, 64 nt, Homo Sapiens; identical to SEQ ID NO: 27859

SEQ ID NO: 399450 - RNA, 64 nt, Homo Sapiens; identical to SEQ ID NO: 27860

SEQ ID NO: 399451 - RNA, 64 nt, Homo Sapiens; identical to SEQ ID NO: 27861

SEQ ID NO: 399452 - RNA, 64 nt, Homo Sapiens; identical to SEQ ID NO: 27862

SEQ ID NO: 399453 - RNA, 64 nt, Homo Sapiens; identical to SEQ ID NO: 27863

SEQ ID NO: 399454 - RNA, 64 nt, Homo Sapiens; identical to SEQ ID NO: 27864

SEQ ID NO: 399455 - RNA, 64 nt, Homo Sapiens; identical to SEQ ID NO: 27865

SEQ ID NO: 399456 - RNA, 64 nt, Homo Sapiens; identical to SEQ ID NO: 27866

SEQ ID NO: 399457 - RNA, 64 nt, Homo Sapiens; identical to SEQ ID NO: 27867

SEQ ID NO: 399458 - RNA, 64 nt, Homo Sapiens; identical to SEQ ID NO: 27868

SEQ ID NO: 399459 - RNA, 64 nt, Homo Sapiens; identical to SEQ ID NO: 27869

SEQ ID NO: 399460 - RNA, 64 nt, Homo Sapiens; identical to SEQ ID NO: 27870

SEQ ID NO: 399461 - RNA, 64 nt, Homo Sapiens; identical to SEQ ID NO: 27871

SEQ ID NO: 399462 - RNA, 64 nt, Homo Sapiens; identical to SEQ ID NO: 27872

SEQ ID NO: 399463 - RNA, 64 nt, Homo Sapiens; identical to SEQ ID NO: 27873

SEQ ID NO: 399464 - RNA, 64 nt, Homo Sapiens; identical to SEQ ID NO: 27874

SEQ ID NO: 399465 - RNA, 64 nt, Homo Sapiens; identical to SEQ ID NO: 27875

SEQ ID NO: 399466 - RNA, 64 nt, Homo Sapiens; identical to SEQ ID NO: 27876

SEQ ID NO: 399467 - RNA, 64 nt, Homo Sapiens; identical to SEQ ID NO: 27877

SEQ ID NO: 399468 - RNA, 64 nt, Homo Sapiens; identical to SEQ ID NO: 27878

SEQ ID NO: 399469 - RNA, 64 nt, Homo Sapiens; identical to SEQ ID NO: 27879

SEQ ID NO: 399470 - RNA, 64 nt, Homo Sapiens; identical to SEQ ID NO: 27880

SEQ ID NO: 399471 - RNA, 64 nt, Homo Sapiens; identical to SEQ ID NO: 27881

SEQ ID NO: 399472 - RNA, 64 nt, Homo Sapiens; identical to SEQ ID NO: 27882

SEQ ID NO: 399473 - RNA, 64 nt, Homo Sapiens; identical to SEQ ID NO: 27883

SEQ ID NO: 399474 - RNA, 64 nt, Homo Sapiens; identical to SEQ ID NO: 27884

SEQ ID NO: 399475 - RNA, 64 nt, Homo Sapiens; identical to SEQ ID NO: 27885

SEQ ID NO: 399476 - RNA, 64 nt, Homo Sapiens; identical to SEQ ID NO: 27886

SEQ ID NO: 399477 - RNA, 64 nt, Homo Sapiens; identical to SEQ ID NO: 27887

SEQ ID NO: 399478 - RNA, 64 nt, Homo Sapiens; identical to SEQ ID NO: 27888

SEQ ID NO: 399479 - RNA, 64 nt, Homo Sapiens; identical to SEQ ID NO: 27889

SEQ ID NO: 399480 - RNA, 64 nt, Homo Sapiens; identical to SEQ ID NO: 27890

SEQ ID NO: 399481 - RNA, 64 nt, Homo Sapiens; identical to SEQ ID NO: 27891

SEQ ID NO: 399482 - RNA, 64 nt, Homo Sapiens; identical to SEQ ID NO: 27892

SEQ ID NO: 399483 - RNA, 64 nt, Homo Sapiens; identical to SEQ ID NO: 27893

SEQ ID NO: 399484 - RNA, 64 nt, Homo Sapiens; identical to SEQ ID NO: 27894

SEQ ID NO: 399485 - RNA, 64 nt, Homo Sapiens; identical to SEQ ID NO: 27895

SEQ ID NO: 399486 - RNA, 64 nt, Homo Sapiens; identical to SEQ ID NO: 27896

SEQ ID NO: 399487 - RNA, 64 nt, Homo Sapiens; identical to SEQ ID NO: 27897

SEQ ID NO: 399488 - RNA, 64 nt, Homo Sapiens; identical to SEQ ID NO: 27898

SEQ ID NO: 399489 - RNA, 64 nt, Homo Sapiens; identical to SEQ ID NO: 27899

SEQ ID NO: 399490 - RNA, 55 nt, Homo Sapiens; identical to SEQ ID NO: 27900

SEQ ID NO: 399491 - RNA, 54 nt, Homo Sapiens; identical to SEQ ID NO: 27901

SEQ ID NO: 399492 - RNA, 53 nt, Homo Sapiens; identical to SEQ ID NO: 27902

SEQ ID NO: 399493 - RNA, 52 nt, Homo Sapiens; identical to SEQ ID NO: 27903

SEQ ID NO: 399494 - RNA, 51 nt, Homo Sapiens; identical to SEQ ID NO: 27904

SEQ ID NO: 399495 - RNA, 50 nt, Homo Sapiens; identical to SEQ ID NO: 27905

SEQ ID NO: 399496 - RNA, 64 nt, Homo Sapiens; identical to SEQ ID NO: 27906

SEQ ID NO: 399497 - RNA, 64 nt, Homo Sapiens; identical to SEQ ID NO: 27907

SEQ ID NO: 399498 - RNA, 64 nt, Homo Sapiens; identical to SEQ ID NO: 27908

SEQ ID NO: 399499 - RNA, 64 nt, Homo Sapiens; identical to SEQ ID NO: 27909

SEQ ID NO: 399500 - RNA, 64 nt, Homo Sapiens; identical to SEQ ID NO: 27910

SEQ ID NO: 399501 - RNA, 64 nt, Homo Sapiens; identical to SEQ ID NO: 27911

SEQ ID NO: 399502 - RNA, 64 nt, Homo Sapiens; identical to SEQ ID NO: 27912

SEQ ID NO: 399503 - RNA, 64 nt, Homo Sapiens; identical to SEQ ID NO: 27913

SEQ ID NO: 399504 - RNA, 64 nt, Homo Sapiens; identical to SEQ ID NO: 27914

SEQ ID NO: 399505 - RNA, 64 nt, Homo Sapiens; identical to SEQ ID NO: 27915

SEQ ID NO: 399506 - RNA, 64 nt, Homo Sapiens; identical to SEQ ID NO: 27916

SEQ ID NO: 399507 - RNA, 64 nt, Homo Sapiens; identical to SEQ ID NO: 27917

SEQ ID NO: 399508 - RNA, 64 nt, Homo Sapiens; identical to SEQ ID NO: 27918

SEQ ID NO: 399509 - RNA, 64 nt, Homo Sapiens; identical to SEQ ID NO: 27919

SEQ ID NO: 399510 - RNA, 64 nt, Homo Sapiens; identical to SEQ ID NO: 27920

SEQ ID NO: 399511 - RNA, 64 nt, Homo Sapiens; identical to SEQ ID NO: 27921

SEQ ID NO: 399512 - RNA, 64 nt, Homo Sapiens; identical to SEQ ID NO: 27922

SEQ ID NO: 399513 - RNA, 64 nt, Homo Sapiens; identical to SEQ ID NO: 27923

SEQ ID NO: 399514 - RNA, 64 nt, Homo Sapiens; identical to SEQ ID NO: 27924

SEQ ID NO: 399515 - RNA, 64 nt, Homo Sapiens; identical to SEQ ID NO: 27925

SEQ ID NO: 399516 - RNA, 64 nt, Homo Sapiens; identical to SEQ ID NO: 27926

SEQ ID NO: 399517 - RNA, 64 nt, Homo Sapiens; identical to SEQ ID NO: 27927

SEQ ID NO: 399518 - RNA, 64 nt, Homo Sapiens; identical to SEQ ID NO: 27928

SEQ ID NO: 399519 - RNA, 64 nt, Homo Sapiens; identical to SEQ ID NO: 27929

SEQ ID NO: 399520 - RNA, 64 nt, Homo Sapiens; identical to SEQ ID NO: 27930

SEQ ID NO: 399521 - RNA, 64 nt, Homo Sapiens; identical to SEQ ID NO: 27931

SEQ ID NO: 399522 - RNA, 64 nt, Homo Sapiens; identical to SEQ ID NO: 27932

SEQ ID NO: 399523 - RNA, 64 nt, Homo Sapiens; identical to SEQ ID NO: 27933

SEQ ID NO: 399524 - RNA, 64 nt, Homo Sapiens; identical to SEQ ID NO: 27934

SEQ ID NO: 399525 - RNA, 64 nt, Homo Sapiens; identical to SEQ ID NO: 27935

SEQ ID NO: 399526 - RNA, 64 nt, Homo Sapiens; identical to SEQ ID NO: 27936

SEQ ID NO: 399527 - RNA, 64 nt, Homo Sapiens; identical to SEQ ID NO: 27937

SEQ ID NO: 399528 - RNA, 64 nt, Homo Sapiens; identical to SEQ ID NO: 27938

SEQ ID NO: 399529 - RNA, 64 nt, Homo Sapiens; identical to SEQ ID NO: 27939

SEQ ID NO: 399530 - RNA, 64 nt, Homo Sapiens; identical to SEQ ID NO: 27940

SEQ ID NO: 399531 - RNA, 64 nt, Homo Sapiens; identical to SEQ ID NO: 27941

SEQ ID NO: 399532 - RNA, 64 nt, Homo Sapiens; identical to SEQ ID NO: 27942

SEQ ID NO: 399533 - RNA, 64 nt, Homo Sapiens; identical to SEQ ID NO: 27943

SEQ ID NO: 399534 - RNA, 64 nt, Homo Sapiens; identical to SEQ ID NO: 27944

SEQ ID NO: 399535 - RNA, 64 nt, Homo Sapiens; identical to SEQ ID NO: 27945

SEQ ID NO: 399536 - RNA, 64 nt, Homo Sapiens; identical to SEQ ID NO: 27946

SEQ ID NO: 399537 - RNA, 64 nt, Homo Sapiens; identical to SEQ ID NO: 27947

SEQ ID NO: 399538 - RNA, 64 nt, Homo Sapiens; identical to SEQ ID NO: 27948

SEQ ID NO: 399539 - RNA, 64 nt, Homo Sapiens; identical to SEQ ID NO: 27949

SEQ ID NO: 399540 - RNA, 64 nt, Homo Sapiens; identical to SEQ ID NO: 27950

SEQ ID NO: 399541 - RNA, 64 nt, Homo Sapiens; identical to SEQ ID NO: 27951

SEQ ID NO: 399542 - RNA, 64 nt, Homo Sapiens; identical to SEQ ID NO: 27952

SEQ ID NO: 399543 - RNA, 64 nt, Homo Sapiens; identical to SEQ ID NO: 27953

SEQ ID NO: 399544 - RNA, 64 nt, Homo Sapiens; identical to SEQ ID NO: 27954

SEQ ID NO: 399545 - RNA, 64 nt, Homo Sapiens; identical to SEQ ID NO: 27955

SEQ ID NO: 399546 - RNA, 64 nt, Homo Sapiens; identical to SEQ ID NO: 27956

SEQ ID NO: 399547 - RNA, 64 nt, Homo Sapiens; identical to SEQ ID NO: 27957

SEQ ID NO: 399548 - RNA, 64 nt, Homo Sapiens; identical to SEQ ID NO: 27958

SEQ ID NO: 399549 - RNA, 64 nt, Homo Sapiens; identical to SEQ ID NO: 27959

SEQ ID NO: 399550 - RNA, 64 nt, Homo Sapiens; identical to SEQ ID NO: 27960

SEQ ID NO: 399551 - RNA, 64 nt, Homo Sapiens; identical to SEQ ID NO: 27961

SEQ ID NO: 399552 - RNA, 64 nt, Homo Sapiens; identical to SEQ ID NO: 27962

SEQ ID NO: 399553 - RNA, 64 nt, Homo Sapiens; identical to SEQ ID NO: 27963

SEQ ID NO: 399554 - RNA, 64 nt, Homo Sapiens; identical to SEQ ID NO: 27964

SEQ ID NO: 399555 - RNA, 64 nt, Homo Sapiens; identical to SEQ ID NO: 27965

SEQ ID NO: 399556 - RNA, 64 nt, Homo Sapiens; identical to SEQ ID NO: 27966

SEQ ID NO: 399557 - RNA, 64 nt, Homo Sapiens; identical to SEQ ID NO: 27967

SEQ ID NO: 399558 - RNA, 64 nt, Homo Sapiens; identical to SEQ ID NO: 27968

SEQ ID NO: 399559 - RNA, 64 nt, Homo Sapiens; identical to SEQ ID NO: 27969

SEQ ID NO: 399560 - RNA, 64 nt, Homo Sapiens; identical to SEQ ID NO: 27970

SEQ ID NO: 399561 - RNA, 64 nt, Homo Sapiens; identical to SEQ ID NO: 27971

SEQ ID NO: 399562 - RNA, 64 nt, Homo Sapiens; identical to SEQ ID NO: 27972

SEQ ID NO: 399563 - RNA, 64 nt, Homo Sapiens; identical to SEQ ID NO: 27973

SEQ ID NO: 399564 - RNA, 64 nt, Homo Sapiens; identical to SEQ ID NO: 27974

SEQ ID NO: 399565 - RNA, 64 nt, Homo Sapiens; identical to SEQ ID NO: 27975

SEQ ID NO: 399566 - RNA, 64 nt, Homo Sapiens; identical to SEQ ID NO: 27976

SEQ ID NO: 399567 - RNA, 64 nt, Homo Sapiens; identical to SEQ ID NO: 27977

SEQ ID NO: 399568 - RNA, 64 nt, Homo Sapiens; identical to SEQ ID NO: 27978

SEQ ID NO: 399569 - RNA, 64 nt, Homo Sapiens; identical to SEQ ID NO: 27979

SEQ ID NO: 399570 - RNA, 64 nt, Homo Sapiens; identical to SEQ ID NO: 27980

SEQ ID NO: 399571 - RNA, 64 nt, Homo Sapiens; identical to SEQ ID NO: 27981

SEQ ID NO: 399572 - RNA, 64 nt, Homo Sapiens; identical to SEQ ID NO: 27982

SEQ ID NO: 399573 - RNA, 64 nt, Homo Sapiens; identical to SEQ ID NO: 27983

SEQ ID NO: 399574 - RNA, 64 nt, Homo Sapiens; identical to SEQ ID NO: 27984

SEQ ID NO: 399575 - RNA, 64 nt, Homo Sapiens; identical to SEQ ID NO: 27985

SEQ ID NO: 399576 - RNA, 64 nt, Homo Sapiens; identical to SEQ ID NO: 27986

SEQ ID NO: 399577 - RNA, 64 nt, Homo Sapiens; identical to SEQ ID NO: 27987

SEQ ID NO: 399578 - RNA, 64 nt, Homo Sapiens; identical to SEQ ID NO: 27988

SEQ ID NO: 399579 - RNA, 64 nt, Homo Sapiens; identical to SEQ ID NO: 27989

SEQ ID NO: 399580 - RNA, 64 nt, Homo Sapiens; identical to SEQ ID NO: 27990

SEQ ID NO: 399581 - RNA, 64 nt, Homo Sapiens; identical to SEQ ID NO: 27991

SEQ ID NO: 399582 - RNA, 64 nt, Homo Sapiens; identical to SEQ ID NO: 27992

SEQ ID NO: 399583 - RNA, 64 nt, Homo Sapiens; identical to SEQ ID NO: 27993

SEQ ID NO: 399584 - RNA, 64 nt, Homo Sapiens; identical to SEQ ID NO: 27994

SEQ ID NO: 399585 - RNA, 64 nt, Homo Sapiens; identical to SEQ ID NO: 27995

SEQ ID NO: 399586 - RNA, 64 nt, Homo Sapiens; identical to SEQ ID NO: 27996

SEQ ID NO: 399587 - RNA, 64 nt, Homo Sapiens; identical to SEQ ID NO: 27997

SEQ ID NO: 399588 - RNA, 64 nt, Homo Sapiens; identical to SEQ ID NO: 27998

SEQ ID NO: 399589 - RNA, 64 nt, Homo Sapiens; identical to SEQ ID NO: 27999

SEQ ID NO: 399590 - RNA, 64 nt, Homo Sapiens; identical to SEQ ID NO: 28000

SEQ ID NO: 399591 - RNA, 64 nt, Homo Sapiens; identical to SEQ ID NO: 28001

SEQ ID NO: 399592 - RNA, 64 nt, Homo Sapiens; identical to SEQ ID NO: 28002

SEQ ID NO: 399593 - RNA, 64 nt, Homo Sapiens; identical to SEQ ID NO: 28003

SEQ ID NO: 399594 - RNA, 64 nt, Homo Sapiens; identical to SEQ ID NO: 28004

SEQ ID NO: 399595 - RNA, 64 nt, Homo Sapiens; identical to SEQ ID NO: 28005

SEQ ID NO: 399596 - RNA, 64 nt, Homo Sapiens; identical to SEQ ID NO: 28006

SEQ ID NO: 399597 - RNA, 64 nt, Homo Sapiens; identical to SEQ ID NO: 28007

SEQ ID NO: 399598 - RNA, 64 nt, Homo Sapiens; identical to SEQ ID NO: 28008

SEQ ID NO: 399599 - RNA, 64 nt, Homo Sapiens; identical to SEQ ID NO: 28009

SEQ ID NO: 399600 - RNA, 64 nt, Homo Sapiens; identical to SEQ ID NO: 28010

SEQ ID NO: 399601 - RNA, 64 nt, Homo Sapiens; identical to SEQ ID NO: 28011

SEQ ID NO: 399602 - RNA, 64 nt, Homo Sapiens; identical to SEQ ID NO: 28012

SEQ ID NO: 399603 - RNA, 64 nt, Homo Sapiens; identical to SEQ ID NO: 28013

SEQ ID NO: 399604 - RNA, 64 nt, Homo Sapiens; identical to SEQ ID NO: 28014

SEQ ID NO: 399605 - RNA, 64 nt, Homo Sapiens; identical to SEQ ID NO: 28015

SEQ ID NO: 399606 - RNA, 64 nt, Homo Sapiens; identical to SEQ ID NO: 28016

SEQ ID NO: 399607 - RNA, 64 nt, Homo Sapiens; identical to SEQ ID NO: 28017

SEQ ID NO: 399608 - RNA, 64 nt, Homo Sapiens; identical to SEQ ID NO: 28018

SEQ ID NO: 399609 - RNA, 64 nt, Homo Sapiens; identical to SEQ ID NO: 28019

SEQ ID NO: 399610 - RNA, 64 nt, Homo Sapiens; identical to SEQ ID NO: 28020

SEQ ID NO: 399611 - RNA, 64 nt, Homo Sapiens; identical to SEQ ID NO: 28021

SEQ ID NO: 399612 - RNA, 64 nt, Homo Sapiens; identical to SEQ ID NO: 28022

SEQ ID NO: 399613 - RNA, 64 nt, Homo Sapiens; identical to SEQ ID NO: 28023

SEQ ID NO: 399614 - RNA, 64 nt, Homo Sapiens; identical to SEQ ID NO: 28024

SEQ ID NO: 399615 - RNA, 64 nt, Homo Sapiens; identical to SEQ ID NO: 28025

SEQ ID NO: 399616 - RNA, 64 nt, Homo Sapiens; identical to SEQ ID NO: 28026

SEQ ID NO: 399617 - RNA, 64 nt, Homo Sapiens; identical to SEQ ID NO: 28027

SEQ ID NO: 399618 - RNA, 64 nt, Homo Sapiens; identical to SEQ ID NO: 28028

SEQ ID NO: 399619 - RNA, 64 nt, Homo Sapiens; identical to SEQ ID NO: 28029

SEQ ID NO: 399620 - RNA, 64 nt, Homo Sapiens; identical to SEQ ID NO: 28030

SEQ ID NO: 399621 - RNA, 64 nt, Homo Sapiens; identical to SEQ ID NO: 28031

SEQ ID NO: 399622 - RNA, 64 nt, Homo Sapiens; identical to SEQ ID NO: 28032

SEQ ID NO: 399623 - RNA, 64 nt, Homo Sapiens; identical to SEQ ID NO: 28033

SEQ ID NO: 399624 - RNA, 64 nt, Homo Sapiens; identical to SEQ ID NO: 28034

SEQ ID NO: 399625 - RNA, 64 nt, Homo Sapiens; identical to SEQ ID NO: 28035

SEQ ID NO: 399626 - RNA, 64 nt, Homo Sapiens; identical to SEQ ID NO: 28036

SEQ ID NO: 399627 - RNA, 64 nt, Homo Sapiens; identical to SEQ ID NO: 28037

SEQ ID NO: 399628 - RNA, 64 nt, Homo Sapiens; identical to SEQ ID NO: 28038

SEQ ID NO: 399629 - RNA, 64 nt, Homo Sapiens; identical to SEQ ID NO: 28039

SEQ ID NO: 399630 - RNA, 64 nt, Homo Sapiens; identical to SEQ ID NO: 28040

SEQ ID NO: 399631 - RNA, 64 nt, Homo Sapiens; identical to SEQ ID NO: 28041

SEQ ID NO: 399632 - RNA, 64 nt, Homo Sapiens; identical to SEQ ID NO: 28042

SEQ ID NO: 399633 - RNA, 64 nt, Homo Sapiens; identical to SEQ ID NO: 28043

SEQ ID NO: 399634 - RNA, 64 nt, Homo Sapiens; identical to SEQ ID NO: 28044

SEQ ID NO: 399635 - RNA, 64 nt, Homo Sapiens; identical to SEQ ID NO: 28045

SEQ ID NO: 399636 - RNA, 64 nt, Homo Sapiens; identical to SEQ ID NO: 28046

SEQ ID NO: 399637 - RNA, 64 nt, Homo Sapiens; identical to SEQ ID NO: 28047

SEQ ID NO: 399638 - RNA, 64 nt, Homo Sapiens; identical to SEQ ID NO: 28048

SEQ ID NO: 399639 - RNA, 64 nt, Homo Sapiens; identical to SEQ ID NO: 28049

SEQ ID NO: 399640 - RNA, 64 nt, Homo Sapiens; identical to SEQ ID NO: 28050

SEQ ID NO: 399641 - RNA, 64 nt, Homo Sapiens; identical to SEQ ID NO: 28051

SEQ ID NO: 399642 - RNA, 64 nt, Homo Sapiens; identical to SEQ ID NO: 28052

SEQ ID NO: 399643 - RNA, 64 nt, Homo Sapiens; identical to SEQ ID NO: 28053

SEQ ID NO: 399644 - RNA, 64 nt, Homo Sapiens; identical to SEQ ID NO: 28054

SEQ ID NO: 399645 - RNA, 64 nt, Homo Sapiens; identical to SEQ ID NO: 28055

SEQ ID NO: 399646 - RNA, 64 nt, Homo Sapiens; identical to SEQ ID NO: 28056

SEQ ID NO: 399647 - RNA, 64 nt, Homo Sapiens; identical to SEQ ID NO: 28057

SEQ ID NO: 399648 - RNA, 64 nt, Homo Sapiens; identical to SEQ ID NO: 28058

SEQ ID NO: 399649 - RNA, 64 nt, Homo Sapiens; identical to SEQ ID NO: 28059

SEQ ID NO: 399650 - RNA, 64 nt, Homo Sapiens; identical to SEQ ID NO: 28060

SEQ ID NO: 399651 - RNA, 64 nt, Homo Sapiens; identical to SEQ ID NO: 28061

SEQ ID NO: 399652 - RNA, 64 nt, Homo Sapiens; identical to SEQ ID NO: 28062

SEQ ID NO: 399653 - RNA, 64 nt, Homo Sapiens; identical to SEQ ID NO: 28063

SEQ ID NO: 399654 - RNA, 64 nt, Homo Sapiens; identical to SEQ ID NO: 28064

SEQ ID NO: 399655 - RNA, 64 nt, Homo Sapiens; identical to SEQ ID NO: 28065

SEQ ID NO: 399656 - RNA, 64 nt, Homo Sapiens; identical to SEQ ID NO: 28066

SEQ ID NO: 399657 - RNA, 64 nt, Homo Sapiens; identical to SEQ ID NO: 28067

SEQ ID NO: 399658 - RNA, 64 nt, Homo Sapiens; identical to SEQ ID NO: 28068

SEQ ID NO: 399659 - RNA, 64 nt, Homo Sapiens; identical to SEQ ID NO: 28069

SEQ ID NO: 399660 - RNA, 64 nt, Homo Sapiens; identical to SEQ ID NO: 28070

SEQ ID NO: 399661 - RNA, 64 nt, Homo Sapiens; identical to SEQ ID NO: 28071

SEQ ID NO: 399662 - RNA, 64 nt, Homo Sapiens; identical to SEQ ID NO: 28072

SEQ ID NO: 399663 - RNA, 64 nt, Homo Sapiens; identical to SEQ ID NO: 28073

SEQ ID NO: 399664 - RNA, 64 nt, Homo Sapiens; identical to SEQ ID NO: 28074

SEQ ID NO: 399665 - RNA, 64 nt, Homo Sapiens; identical to SEQ ID NO: 28075

SEQ ID NO: 399666 - RNA, 64 nt, Homo Sapiens; identical to SEQ ID NO: 28076

SEQ ID NO: 399667 - RNA, 64 nt, Homo Sapiens; identical to SEQ ID NO: 28077

SEQ ID NO: 399668 - RNA, 64 nt, Homo Sapiens; identical to SEQ ID NO: 28078

SEQ ID NO: 399669 - RNA, 64 nt, Homo Sapiens; identical to SEQ ID NO: 28079

SEQ ID NO: 399670 - RNA, 64 nt, Homo Sapiens; identical to SEQ ID NO: 28080

SEQ ID NO: 399671 - RNA, 64 nt, Homo Sapiens; identical to SEQ ID NO: 28081

SEQ ID NO: 399672 - RNA, 64 nt, Homo Sapiens; identical to SEQ ID NO: 28082

SEQ ID NO: 399673 - RNA, 64 nt, Homo Sapiens; identical to SEQ ID NO: 28083

SEQ ID NO: 399674 - RNA, 64 nt, Homo Sapiens; identical to SEQ ID NO: 28084

SEQ ID NO: 399675 - RNA, 64 nt, Homo Sapiens; identical to SEQ ID NO: 28085

SEQ ID NO: 399676 - RNA, 64 nt, Homo Sapiens; identical to SEQ ID NO: 28086

SEQ ID NO: 399677 - RNA, 64 nt, Homo Sapiens; identical to SEQ ID NO: 28087

SEQ ID NO: 399678 - RNA, 64 nt, Homo Sapiens; identical to SEQ ID NO: 28088

SEQ ID NO: 399679 - RNA, 64 nt, Homo Sapiens; identical to SEQ ID NO: 28089

SEQ ID NO: 399680 - RNA, 64 nt, Homo Sapiens; identical to SEQ ID NO: 28090

SEQ ID NO: 399681 - RNA, 64 nt, Homo Sapiens; identical to SEQ ID NO: 28091

SEQ ID NO: 399682 - RNA, 64 nt, Homo Sapiens; identical to SEQ ID NO: 28092

SEQ ID NO: 399683 - RNA, 64 nt, Homo Sapiens; identical to SEQ ID NO: 28093

SEQ ID NO: 399684 - RNA, 64 nt, Homo Sapiens; identical to SEQ ID NO: 28094

SEQ ID NO: 399685 - RNA, 64 nt, Homo Sapiens; identical to SEQ ID NO: 28095

SEQ ID NO: 399686 - RNA, 64 nt, Homo Sapiens; identical to SEQ ID NO: 28096

SEQ ID NO: 399687 - RNA, 64 nt, Homo Sapiens; identical to SEQ ID NO: 28097

SEQ ID NO: 399688 - RNA, 64 nt, Homo Sapiens; identical to SEQ ID NO: 28098

SEQ ID NO: 399689 - RNA, 64 nt, Homo Sapiens; identical to SEQ ID NO: 28099

SEQ ID NO: 399690 - RNA, 64 nt, Homo Sapiens; identical to SEQ ID NO: 28100

SEQ ID NO: 399691 - RNA, 64 nt, Homo Sapiens; identical to SEQ ID NO: 28101

SEQ ID NO: 399692 - RNA, 64 nt, Homo Sapiens; identical to SEQ ID NO: 28102

SEQ ID NO: 399693 - RNA, 64 nt, Homo Sapiens; identical to SEQ ID NO: 28103

SEQ ID NO: 399694 - RNA, 64 nt, Homo Sapiens; identical to SEQ ID NO: 28104

SEQ ID NO: 399695 - RNA, 64 nt, Homo Sapiens; identical to SEQ ID NO: 28105

SEQ ID NO: 399696 - RNA, 64 nt, Homo Sapiens; identical to SEQ ID NO: 28106

SEQ ID NO: 399697 - RNA, 64 nt, Homo Sapiens; identical to SEQ ID NO: 28107

SEQ ID NO: 399698 - RNA, 64 nt, Homo Sapiens; identical to SEQ ID NO: 28108

SEQ ID NO: 399699 - RNA, 64 nt, Homo Sapiens; identical to SEQ ID NO: 28109

SEQ ID NO: 399700 - RNA, 64 nt, Homo Sapiens; identical to SEQ ID NO: 28110

SEQ ID NO: 399701 - RNA, 64 nt, Homo Sapiens; identical to SEQ ID NO: 28111

SEQ ID NO: 399702 - RNA, 64 nt, Homo Sapiens; identical to SEQ ID NO: 28112

SEQ ID NO: 399703 - RNA, 64 nt, Homo Sapiens; identical to SEQ ID NO: 28113

SEQ ID NO: 399704 - RNA, 64 nt, Homo Sapiens; identical to SEQ ID NO: 28114

SEQ ID NO: 399705 - RNA, 64 nt, Homo Sapiens; identical to SEQ ID NO: 28115

SEQ ID NO: 399706 - RNA, 64 nt, Homo Sapiens; identical to SEQ ID NO: 28116

SEQ ID NO: 399707 - RNA, 64 nt, Homo Sapiens; identical to SEQ ID NO: 28117

SEQ ID NO: 399708 - RNA, 64 nt, Homo Sapiens; identical to SEQ ID NO: 28118

SEQ ID NO: 399709 - RNA, 64 nt, Homo Sapiens; identical to SEQ ID NO: 28119

SEQ ID NO: 399710 - RNA, 64 nt, Homo Sapiens; identical to SEQ ID NO: 28120

SEQ ID NO: 399711 - RNA, 64 nt, Homo Sapiens; identical to SEQ ID NO: 28121

SEQ ID NO: 399712 - RNA, 64 nt, Homo Sapiens; identical to SEQ ID NO: 28122

SEQ ID NO: 399713 - RNA, 64 nt, Homo Sapiens; identical to SEQ ID NO: 28123

SEQ ID NO: 399714 - RNA, 64 nt, Homo Sapiens; identical to SEQ ID NO: 28124

SEQ ID NO: 399715 - RNA, 64 nt, Homo Sapiens; identical to SEQ ID NO: 28125

SEQ ID NO: 399716 - RNA, 64 nt, Homo Sapiens; identical to SEQ ID NO: 28126

SEQ ID NO: 399717 - RNA, 64 nt, Homo Sapiens; identical to SEQ ID NO: 28127

SEQ ID NO: 399718 - RNA, 64 nt, Homo Sapiens; identical to SEQ ID NO: 28128

SEQ ID NO: 399719 - RNA, 64 nt, Homo Sapiens; identical to SEQ ID NO: 28129

SEQ ID NO: 399720 - RNA, 64 nt, Homo Sapiens; identical to SEQ ID NO: 28130

SEQ ID NO: 399721 - RNA, 64 nt, Homo Sapiens; identical to SEQ ID NO: 28131

SEQ ID NO: 399722 - RNA, 64 nt, Homo Sapiens; identical to SEQ ID NO: 28132

SEQ ID NO: 399723 - RNA, 64 nt, Homo Sapiens; identical to SEQ ID NO: 28133

SEQ ID NO: 399724 - RNA, 64 nt, Homo Sapiens; identical to SEQ ID NO: 28134

SEQ ID NO: 399725 - RNA, 64 nt, Homo Sapiens; identical to SEQ ID NO: 28135

SEQ ID NO: 399726 - RNA, 64 nt, Homo Sapiens; identical to SEQ ID NO: 28136

SEQ ID NO: 399727 - RNA, 64 nt, Homo Sapiens; identical to SEQ ID NO: 28137

SEQ ID NO: 399728 - RNA, 64 nt, Homo Sapiens; identical to SEQ ID NO: 28138

SEQ ID NO: 399729 - RNA, 64 nt, Homo Sapiens; identical to SEQ ID NO: 28139

SEQ ID NO: 399730 - RNA, 64 nt, Homo Sapiens; identical to SEQ ID NO: 28140

SEQ ID NO: 399731 - RNA, 64 nt, Homo Sapiens; identical to SEQ ID NO: 28141

SEQ ID NO: 399732 - RNA, 64 nt, Homo Sapiens; identical to SEQ ID NO: 28142

SEQ ID NO: 399733 - RNA, 64 nt, Homo Sapiens; identical to SEQ ID NO: 28143

SEQ ID NO: 399734 - RNA, 64 nt, Homo Sapiens; identical to SEQ ID NO: 28144

SEQ ID NO: 399735 - RNA, 64 nt, Homo Sapiens; identical to SEQ ID NO: 28145

SEQ ID NO: 399736 - RNA, 64 nt, Homo Sapiens; identical to SEQ ID NO: 28146

SEQ ID NO: 399737 - RNA, 64 nt, Homo Sapiens; identical to SEQ ID NO: 28147

SEQ ID NO: 399738 - RNA, 64 nt, Homo Sapiens; identical to SEQ ID NO: 28148

SEQ ID NO: 399739 - RNA, 64 nt, Homo Sapiens; identical to SEQ ID NO: 28149

SEQ ID NO: 399740 - RNA, 64 nt, Homo Sapiens; identical to SEQ ID NO: 28150

SEQ ID NO: 399741 - RNA, 64 nt, Homo Sapiens; identical to SEQ ID NO: 28151

SEQ ID NO: 399742 - RNA, 64 nt, Homo Sapiens; identical to SEQ ID NO: 28152

SEQ ID NO: 399743 - RNA, 64 nt, Homo Sapiens; identical to SEQ ID NO: 28153

SEQ ID NO: 399744 - RNA, 64 nt, Homo Sapiens; identical to SEQ ID NO: 28154

SEQ ID NO: 399745 - RNA, 64 nt, Homo Sapiens; identical to SEQ ID NO: 28155

SEQ ID NO: 399746 - RNA, 64 nt, Homo Sapiens; identical to SEQ ID NO: 28156

SEQ ID NO: 399747 - RNA, 64 nt, Homo Sapiens; identical to SEQ ID NO: 28157

SEQ ID NO: 399748 - RNA, 64 nt, Homo Sapiens; identical to SEQ ID NO: 28158

SEQ ID NO: 399749 - RNA, 64 nt, Homo Sapiens; identical to SEQ ID NO: 28159

SEQ ID NO: 399750 - RNA, 64 nt, Homo Sapiens; identical to SEQ ID NO: 28160

SEQ ID NO: 399751 - RNA, 64 nt, Homo Sapiens; identical to SEQ ID NO: 28161

SEQ ID NO: 399752 - RNA, 64 nt, Homo Sapiens; identical to SEQ ID NO: 28162

SEQ ID NO: 399753 - RNA, 64 nt, Homo Sapiens; identical to SEQ ID NO: 28163

SEQ ID NO: 399754 - RNA, 64 nt, Homo Sapiens; identical to SEQ ID NO: 28164

SEQ ID NO: 399755 - RNA, 64 nt, Homo Sapiens; identical to SEQ ID NO: 28165

SEQ ID NO: 399756 - RNA, 64 nt, Homo Sapiens; identical to SEQ ID NO: 28166

SEQ ID NO: 399757 - RNA, 64 nt, Homo Sapiens; identical to SEQ ID NO: 28167

SEQ ID NO: 399758 - RNA, 64 nt, Homo Sapiens; identical to SEQ ID NO: 28168

SEQ ID NO: 399759 - RNA, 64 nt, Homo Sapiens; identical to SEQ ID NO: 28169

SEQ ID NO: 399760 - RNA, 64 nt, Homo Sapiens; identical to SEQ ID NO: 28170

SEQ ID NO: 399761 - RNA, 64 nt, Homo Sapiens; identical to SEQ ID NO: 28171

SEQ ID NO: 399762 - RNA, 64 nt, Homo Sapiens; identical to SEQ ID NO: 28172

SEQ ID NO: 399763 - RNA, 64 nt, Homo Sapiens; identical to SEQ ID NO: 28173

SEQ ID NO: 399764 - RNA, 64 nt, Homo Sapiens; identical to SEQ ID NO: 28174

SEQ ID NO: 399765 - RNA, 64 nt, Homo Sapiens; identical to SEQ ID NO: 28175

SEQ ID NO: 399766 - RNA, 64 nt, Homo Sapiens; identical to SEQ ID NO: 28176

SEQ ID NO: 399767 - RNA, 64 nt, Homo Sapiens; identical to SEQ ID NO: 28177

SEQ ID NO: 399768 - RNA, 64 nt, Homo Sapiens; identical to SEQ ID NO: 28178

SEQ ID NO: 399769 - RNA, 64 nt, Homo Sapiens; identical to SEQ ID NO: 28179

SEQ ID NO: 399770 - RNA, 64 nt, Homo Sapiens; identical to SEQ ID NO: 28180

SEQ ID NO: 399771 - RNA, 64 nt, Homo Sapiens; identical to SEQ ID NO: 28181

SEQ ID NO: 399772 - RNA, 64 nt, Homo Sapiens; identical to SEQ ID NO: 28182

SEQ ID NO: 399773 - RNA, 64 nt, Homo Sapiens; identical to SEQ ID NO: 28183

SEQ ID NO: 399774 - RNA, 64 nt, Homo Sapiens; identical to SEQ ID NO: 28184

SEQ ID NO: 399775 - RNA, 64 nt, Homo Sapiens; identical to SEQ ID NO: 28185

SEQ ID NO: 399776 - RNA, 64 nt, Homo Sapiens; identical to SEQ ID NO: 28186

SEQ ID NO: 399777 - RNA, 64 nt, Homo Sapiens; identical to SEQ ID NO: 28187

SEQ ID NO: 399778 - RNA, 64 nt, Homo Sapiens; identical to SEQ ID NO: 28188

SEQ ID NO: 399779 - RNA, 64 nt, Homo Sapiens; identical to SEQ ID NO: 28189

SEQ ID NO: 399780 - RNA, 64 nt, Homo Sapiens; identical to SEQ ID NO: 28190

SEQ ID NO: 399781 - RNA, 64 nt, Homo Sapiens; identical to SEQ ID NO: 28191

SEQ ID NO: 399782 - RNA, 64 nt, Homo Sapiens; identical to SEQ ID NO: 28192

SEQ ID NO: 399783 - RNA, 64 nt, Homo Sapiens; identical to SEQ ID NO: 28193

SEQ ID NO: 399784 - RNA, 64 nt, Homo Sapiens; identical to SEQ ID NO: 28194

SEQ ID NO: 399785 - RNA, 64 nt, Homo Sapiens; identical to SEQ ID NO: 28195

SEQ ID NO: 399786 - RNA, 64 nt, Homo Sapiens; identical to SEQ ID NO: 28196

SEQ ID NO: 399787 - RNA, 64 nt, Homo Sapiens; identical to SEQ ID NO: 28197

SEQ ID NO: 399788 - RNA, 64 nt, Homo Sapiens; identical to SEQ ID NO: 28198

SEQ ID NO: 399789 - RNA, 64 nt, Homo Sapiens; identical to SEQ ID NO: 28199

SEQ ID NO: 399790 - RNA, 64 nt, Homo Sapiens; identical to SEQ ID NO: 28200

SEQ ID NO: 399791 - RNA, 64 nt, Homo Sapiens; identical to SEQ ID NO: 28201

SEQ ID NO: 399792 - RNA, 64 nt, Homo Sapiens; identical to SEQ ID NO: 28202

SEQ ID NO: 399793 - RNA, 64 nt, Homo Sapiens; identical to SEQ ID NO: 28203

SEQ ID NO: 399794 - RNA, 64 nt, Homo Sapiens; identical to SEQ ID NO: 28204

SEQ ID NO: 399795 - RNA, 64 nt, Homo Sapiens; identical to SEQ ID NO: 28205

SEQ ID NO: 399796 - RNA, 64 nt, Homo Sapiens; identical to SEQ ID NO: 28206

SEQ ID NO: 399797 - RNA, 64 nt, Homo Sapiens; identical to SEQ ID NO: 28207

SEQ ID NO: 399798 - RNA, 64 nt, Homo Sapiens; identical to SEQ ID NO: 28208

SEQ ID NO: 399799 - RNA, 64 nt, Homo Sapiens; identical to SEQ ID NO: 28209

SEQ ID NO: 399800 - RNA, 64 nt, Homo Sapiens; identical to SEQ ID NO: 28210

SEQ ID NO: 399801 - RNA, 64 nt, Homo Sapiens; identical to SEQ ID NO: 28211

SEQ ID NO: 399802 - RNA, 64 nt, Homo Sapiens; identical to SEQ ID NO: 28212

SEQ ID NO: 399803 - RNA, 64 nt, Homo Sapiens; identical to SEQ ID NO: 28213

SEQ ID NO: 399804 - RNA, 64 nt, Homo Sapiens; identical to SEQ ID NO: 28214

SEQ ID NO: 399805 - RNA, 64 nt, Homo Sapiens; identical to SEQ ID NO: 28215

SEQ ID NO: 399806 - RNA, 64 nt, Homo Sapiens; identical to SEQ ID NO: 28216

SEQ ID NO: 399807 - RNA, 64 nt, Homo Sapiens; identical to SEQ ID NO: 28217

SEQ ID NO: 399808 - RNA, 64 nt, Homo Sapiens; identical to SEQ ID NO: 28218

SEQ ID NO: 399809 - RNA, 64 nt, Homo Sapiens; identical to SEQ ID NO: 28219

SEQ ID NO: 399810 - RNA, 64 nt, Homo Sapiens; identical to SEQ ID NO: 28220

SEQ ID NO: 399811 - RNA, 64 nt, Homo Sapiens; identical to SEQ ID NO: 28221

SEQ ID NO: 399812 - RNA, 64 nt, Homo Sapiens; identical to SEQ ID NO: 28222

SEQ ID NO: 399813 - RNA, 64 nt, Homo Sapiens; identical to SEQ ID NO: 28223

SEQ ID NO: 399814 - RNA, 64 nt, Homo Sapiens; identical to SEQ ID NO: 28224

SEQ ID NO: 399815 - RNA, 64 nt, Homo Sapiens; identical to SEQ ID NO: 28225

SEQ ID NO: 399816 - RNA, 64 nt, Homo Sapiens; identical to SEQ ID NO: 28226

SEQ ID NO: 399817 - RNA, 64 nt, Homo Sapiens; identical to SEQ ID NO: 28227

SEQ ID NO: 399818 - RNA, 64 nt, Homo Sapiens; identical to SEQ ID NO: 28228

SEQ ID NO: 399819 - RNA, 64 nt, Homo Sapiens; identical to SEQ ID NO: 28229

SEQ ID NO: 399820 - RNA, 64 nt, Homo Sapiens; identical to SEQ ID NO: 28230

SEQ ID NO: 399821 - RNA, 64 nt, Homo Sapiens; identical to SEQ ID NO: 28231

SEQ ID NO: 399822 - RNA, 64 nt, Homo Sapiens; identical to SEQ ID NO: 28232

SEQ ID NO: 399823 - RNA, 64 nt, Homo Sapiens; identical to SEQ ID NO: 28233

SEQ ID NO: 399824 - RNA, 64 nt, Homo Sapiens; identical to SEQ ID NO: 28234

SEQ ID NO: 399825 - RNA, 64 nt, Homo Sapiens; identical to SEQ ID NO: 28235

SEQ ID NO: 399826 - RNA, 64 nt, Homo Sapiens; identical to SEQ ID NO: 28236

SEQ ID NO: 399827 - RNA, 64 nt, Homo Sapiens; identical to SEQ ID NO: 28237

SEQ ID NO: 399828 - RNA, 64 nt, Homo Sapiens; identical to SEQ ID NO: 28238

SEQ ID NO: 399829 - RNA, 64 nt, Homo Sapiens; identical to SEQ ID NO: 28239

SEQ ID NO: 399830 - RNA, 64 nt, Homo Sapiens; identical to SEQ ID NO: 28240

SEQ ID NO: 399831 - RNA, 64 nt, Homo Sapiens; identical to SEQ ID NO: 28241

SEQ ID NO: 399832 - RNA, 64 nt, Homo Sapiens; identical to SEQ ID NO: 28242

SEQ ID NO: 399833 - RNA, 64 nt, Homo Sapiens; identical to SEQ ID NO: 28243

SEQ ID NO: 399834 - RNA, 64 nt, Homo Sapiens; identical to SEQ ID NO: 28244

SEQ ID NO: 399835 - RNA, 64 nt, Homo Sapiens; identical to SEQ ID NO: 28245

SEQ ID NO: 399836 - RNA, 64 nt, Homo Sapiens; identical to SEQ ID NO: 28246

SEQ ID NO: 399837 - RNA, 64 nt, Homo Sapiens; identical to SEQ ID NO: 28247

SEQ ID NO: 399838 - RNA, 64 nt, Homo Sapiens; identical to SEQ ID NO: 28248

SEQ ID NO: 399839 - RNA, 64 nt, Homo Sapiens; identical to SEQ ID NO: 28249

SEQ ID NO: 399840 - RNA, 64 nt, Homo Sapiens; identical to SEQ ID NO: 28250

SEQ ID NO: 399841 - RNA, 64 nt, Homo Sapiens; identical to SEQ ID NO: 28251

SEQ ID NO: 399842 - RNA, 64 nt, Homo Sapiens; identical to SEQ ID NO: 28252

SEQ ID NO: 399843 - RNA, 64 nt, Homo Sapiens; identical to SEQ ID NO: 28253

SEQ ID NO: 399844 - RNA, 64 nt, Homo Sapiens; identical to SEQ ID NO: 28254

SEQ ID NO: 399845 - RNA, 64 nt, Homo Sapiens; identical to SEQ ID NO: 28255

SEQ ID NO: 399846 - RNA, 64 nt, Homo Sapiens; identical to SEQ ID NO: 28256

SEQ ID NO: 399847 - RNA, 64 nt, Homo Sapiens; identical to SEQ ID NO: 28257

SEQ ID NO: 399848 - RNA, 64 nt, Homo Sapiens; identical to SEQ ID NO: 28258

SEQ ID NO: 399849 - RNA, 64 nt, Homo Sapiens; identical to SEQ ID NO: 28259

SEQ ID NO: 399850 - RNA, 64 nt, Homo Sapiens; identical to SEQ ID NO: 28260

SEQ ID NO: 399851 - RNA, 64 nt, Homo Sapiens; identical to SEQ ID NO: 28261

SEQ ID NO: 399852 - RNA, 64 nt, Homo Sapiens; identical to SEQ ID NO: 28262

SEQ ID NO: 399853 - RNA, 64 nt, Homo Sapiens; identical to SEQ ID NO: 28263

SEQ ID NO: 399854 - RNA, 64 nt, Homo Sapiens; identical to SEQ ID NO: 28264

SEQ ID NO: 399855 - RNA, 64 nt, Homo Sapiens; identical to SEQ ID NO: 28265

SEQ ID NO: 399856 - RNA, 64 nt, Homo Sapiens; identical to SEQ ID NO: 28266

SEQ ID NO: 399857 - RNA, 64 nt, Homo Sapiens; identical to SEQ ID NO: 28267

SEQ ID NO: 399858 - RNA, 64 nt, Homo Sapiens; identical to SEQ ID NO: 28268

SEQ ID NO: 399859 - RNA, 64 nt, Homo Sapiens; identical to SEQ ID NO: 28269

SEQ ID NO: 399860 - RNA, 64 nt, Homo Sapiens; identical to SEQ ID NO: 28270

SEQ ID NO: 399861 - RNA, 64 nt, Homo Sapiens; identical to SEQ ID NO: 28271

SEQ ID NO: 399862 - RNA, 64 nt, Homo Sapiens; identical to SEQ ID NO: 28272

SEQ ID NO: 399863 - RNA, 64 nt, Homo Sapiens; identical to SEQ ID NO: 28273

SEQ ID NO: 399864 - RNA, 64 nt, Homo Sapiens; identical to SEQ ID NO: 28274

SEQ ID NO: 399865 - RNA, 64 nt, Homo Sapiens; identical to SEQ ID NO: 28275

SEQ ID NO: 399866 - RNA, 64 nt, Homo Sapiens; identical to SEQ ID NO: 28276

SEQ ID NO: 399867 - RNA, 64 nt, Homo Sapiens; identical to SEQ ID NO: 28277

SEQ ID NO: 399868 - RNA, 64 nt, Homo Sapiens; identical to SEQ ID NO: 28278

SEQ ID NO: 399869 - RNA, 64 nt, Homo Sapiens; identical to SEQ ID NO: 28279

SEQ ID NO: 399870 - RNA, 64 nt, Homo Sapiens; identical to SEQ ID NO: 28280

SEQ ID NO: 399871 - RNA, 64 nt, Homo Sapiens; identical to SEQ ID NO: 28281

SEQ ID NO: 399872 - RNA, 64 nt, Homo Sapiens; identical to SEQ ID NO: 28282

SEQ ID NO: 399873 - RNA, 64 nt, Homo Sapiens; identical to SEQ ID NO: 28283

SEQ ID NO: 399874 - RNA, 64 nt, Homo Sapiens; identical to SEQ ID NO: 28284

SEQ ID NO: 399875 - RNA, 64 nt, Homo Sapiens; identical to SEQ ID NO: 28285

SEQ ID NO: 399876 - RNA, 64 nt, Homo Sapiens; identical to SEQ ID NO: 28286

SEQ ID NO: 399877 - RNA, 64 nt, Homo Sapiens; identical to SEQ ID NO: 28287

SEQ ID NO: 399878 - RNA, 64 nt, Homo Sapiens; identical to SEQ ID NO: 28288

SEQ ID NO: 399879 - RNA, 64 nt, Homo Sapiens; identical to SEQ ID NO: 28289

SEQ ID NO: 399880 - RNA, 64 nt, Homo Sapiens; identical to SEQ ID NO: 28290

SEQ ID NO: 399881 - RNA, 64 nt, Homo Sapiens; identical to SEQ ID NO: 28291

SEQ ID NO: 399882 - RNA, 64 nt, Homo Sapiens; identical to SEQ ID NO: 28292

SEQ ID NO: 399883 - RNA, 64 nt, Homo Sapiens; identical to SEQ ID NO: 28293

SEQ ID NO: 399884 - RNA, 64 nt, Homo Sapiens; identical to SEQ ID NO: 28294

SEQ ID NO: 399885 - RNA, 64 nt, Homo Sapiens; identical to SEQ ID NO: 28295

SEQ ID NO: 399886 - RNA, 64 nt, Homo Sapiens; identical to SEQ ID NO: 28296

SEQ ID NO: 399887 - RNA, 64 nt, Homo Sapiens; identical to SEQ ID NO: 28297

SEQ ID NO: 399888 - RNA, 64 nt, Homo Sapiens; identical to SEQ ID NO: 28298

SEQ ID NO: 399889 - RNA, 64 nt, Homo Sapiens; identical to SEQ ID NO: 28299

SEQ ID NO: 399890 - RNA, 64 nt, Homo Sapiens; identical to SEQ ID NO: 28300

SEQ ID NO: 399891 - RNA, 64 nt, Homo Sapiens; identical to SEQ ID NO: 28301

SEQ ID NO: 399892 - RNA, 64 nt, Homo Sapiens; identical to SEQ ID NO: 28302

SEQ ID NO: 399893 - RNA, 64 nt, Homo Sapiens; identical to SEQ ID NO: 28303

SEQ ID NO: 399894 - RNA, 64 nt, Homo Sapiens; identical to SEQ ID NO: 28304

SEQ ID NO: 399895 - RNA, 64 nt, Homo Sapiens; identical to SEQ ID NO: 28305

SEQ ID NO: 399896 - RNA, 64 nt, Homo Sapiens; identical to SEQ ID NO: 28306

SEQ ID NO: 399897 - RNA, 64 nt, Homo Sapiens; identical to SEQ ID NO: 28307

SEQ ID NO: 399898 - RNA, 64 nt, Homo Sapiens; identical to SEQ ID NO: 28308

SEQ ID NO: 399899 - RNA, 64 nt, Homo Sapiens; identical to SEQ ID NO: 28309

SEQ ID NO: 399900 - RNA, 64 nt, Homo Sapiens; identical to SEQ ID NO: 28310

SEQ ID NO: 399901 - RNA, 64 nt, Homo Sapiens; identical to SEQ ID NO: 28311

SEQ ID NO: 399902 - RNA, 64 nt, Homo Sapiens; identical to SEQ ID NO: 28312

SEQ ID NO: 399903 - RNA, 64 nt, Homo Sapiens; identical to SEQ ID NO: 28313

SEQ ID NO: 399904 - RNA, 64 nt, Homo Sapiens; identical to SEQ ID NO: 28314

SEQ ID NO: 399905 - RNA, 64 nt, Homo Sapiens; identical to SEQ ID NO: 28315

SEQ ID NO: 399906 - RNA, 64 nt, Homo Sapiens; identical to SEQ ID NO: 28316

SEQ ID NO: 399907 - RNA, 64 nt, Homo Sapiens; identical to SEQ ID NO: 28317

SEQ ID NO: 399908 - RNA, 64 nt, Homo Sapiens; identical to SEQ ID NO: 28318

SEQ ID NO: 399909 - RNA, 64 nt, Homo Sapiens; identical to SEQ ID NO: 28319

SEQ ID NO: 399910 - RNA, 64 nt, Homo Sapiens; identical to SEQ ID NO: 28320

SEQ ID NO: 399911 - RNA, 64 nt, Homo Sapiens; identical to SEQ ID NO: 28321

SEQ ID NO: 399912 - RNA, 64 nt, Homo Sapiens; identical to SEQ ID NO: 28322

SEQ ID NO: 399913 - RNA, 64 nt, Homo Sapiens; identical to SEQ ID NO: 28323

SEQ ID NO: 399914 - RNA, 64 nt, Homo Sapiens; identical to SEQ ID NO: 28324

SEQ ID NO: 399915 - RNA, 64 nt, Homo Sapiens; identical to SEQ ID NO: 28325

SEQ ID NO: 399916 - RNA, 64 nt, Homo Sapiens; identical to SEQ ID NO: 28326

SEQ ID NO: 399917 - RNA, 64 nt, Homo Sapiens; identical to SEQ ID NO: 28327

SEQ ID NO: 399918 - RNA, 64 nt, Homo Sapiens; identical to SEQ ID NO: 28328

SEQ ID NO: 399919 - RNA, 64 nt, Homo Sapiens; identical to SEQ ID NO: 28329

SEQ ID NO: 399920 - RNA, 64 nt, Homo Sapiens; identical to SEQ ID NO: 28330

SEQ ID NO: 399921 - RNA, 64 nt, Homo Sapiens; identical to SEQ ID NO: 28331

SEQ ID NO: 399922 - RNA, 64 nt, Homo Sapiens; identical to SEQ ID NO: 28332

SEQ ID NO: 399923 - RNA, 64 nt, Homo Sapiens; identical to SEQ ID NO: 28333

SEQ ID NO: 399924 - RNA, 64 nt, Homo Sapiens; identical to SEQ ID NO: 28334

SEQ ID NO: 399925 - RNA, 64 nt, Homo Sapiens; identical to SEQ ID NO: 28335

SEQ ID NO: 399926 - RNA, 64 nt, Homo Sapiens; identical to SEQ ID NO: 28336

SEQ ID NO: 399927 - RNA, 64 nt, Homo Sapiens; identical to SEQ ID NO: 28337

SEQ ID NO: 399928 - RNA, 64 nt, Homo Sapiens; identical to SEQ ID NO: 28338

SEQ ID NO: 399929 - RNA, 64 nt, Homo Sapiens; identical to SEQ ID NO: 28339

SEQ ID NO: 399930 - RNA, 64 nt, Homo Sapiens; identical to SEQ ID NO: 28340

SEQ ID NO: 399931 - RNA, 64 nt, Homo Sapiens; identical to SEQ ID NO: 28341

SEQ ID NO: 399932 - RNA, 64 nt, Homo Sapiens; identical to SEQ ID NO: 28342

SEQ ID NO: 399933 - RNA, 64 nt, Homo Sapiens; identical to SEQ ID NO: 28343

SEQ ID NO: 399934 - RNA, 64 nt, Homo Sapiens; identical to SEQ ID NO: 28344

SEQ ID NO: 399935 - RNA, 64 nt, Homo Sapiens; identical to SEQ ID NO: 28345

SEQ ID NO: 399936 - RNA, 64 nt, Homo Sapiens; identical to SEQ ID NO: 28346

SEQ ID NO: 399937 - RNA, 64 nt, Homo Sapiens; identical to SEQ ID NO: 28347

SEQ ID NO: 399938 - RNA, 64 nt, Homo Sapiens; identical to SEQ ID NO: 28348

SEQ ID NO: 399939 - RNA, 64 nt, Homo Sapiens; identical to SEQ ID NO: 28349

SEQ ID NO: 399940 - RNA, 64 nt, Homo Sapiens; identical to SEQ ID NO: 28350

SEQ ID NO: 399941 - RNA, 64 nt, Homo Sapiens; identical to SEQ ID NO: 28351

SEQ ID NO: 399942 - RNA, 64 nt, Homo Sapiens; identical to SEQ ID NO: 28352

SEQ ID NO: 399943 - RNA, 64 nt, Homo Sapiens; identical to SEQ ID NO: 28353

SEQ ID NO: 399944 - RNA, 64 nt, Homo Sapiens; identical to SEQ ID NO: 28354

SEQ ID NO: 399945 - RNA, 64 nt, Homo Sapiens; identical to SEQ ID NO: 28355

SEQ ID NO: 399946 - RNA, 64 nt, Homo Sapiens; identical to SEQ ID NO: 28356

SEQ ID NO: 399947 - RNA, 64 nt, Homo Sapiens; identical to SEQ ID NO: 28357

SEQ ID NO: 399948 - RNA, 64 nt, Homo Sapiens; identical to SEQ ID NO: 28358

SEQ ID NO: 399949 - RNA, 64 nt, Homo Sapiens; identical to SEQ ID NO: 28359

SEQ ID NO: 399950 - RNA, 64 nt, Homo Sapiens; identical to SEQ ID NO: 28360

SEQ ID NO: 399951 - RNA, 64 nt, Homo Sapiens; identical to SEQ ID NO: 28361

SEQ ID NO: 399952 - RNA, 64 nt, Homo Sapiens; identical to SEQ ID NO: 28362

SEQ ID NO: 399953 - RNA, 64 nt, Homo Sapiens; identical to SEQ ID NO: 28363

SEQ ID NO: 399954 - RNA, 64 nt, Homo Sapiens; identical to SEQ ID NO: 28364

SEQ ID NO: 399955 - RNA, 64 nt, Homo Sapiens; identical to SEQ ID NO: 28365

SEQ ID NO: 399956 - RNA, 64 nt, Homo Sapiens; identical to SEQ ID NO: 28366

SEQ ID NO: 399957 - RNA, 64 nt, Homo Sapiens; identical to SEQ ID NO: 28367

SEQ ID NO: 399958 - RNA, 64 nt, Homo Sapiens; identical to SEQ ID NO: 28368

SEQ ID NO: 399959 - RNA, 64 nt, Homo Sapiens; identical to SEQ ID NO: 28369

SEQ ID NO: 399960 - RNA, 64 nt, Homo Sapiens; identical to SEQ ID NO: 28370

SEQ ID NO: 399961 - RNA, 64 nt, Homo Sapiens; identical to SEQ ID NO: 28371

SEQ ID NO: 399962 - RNA, 64 nt, Homo Sapiens; identical to SEQ ID NO: 28372

SEQ ID NO: 399963 - RNA, 64 nt, Homo Sapiens; identical to SEQ ID NO: 28373

SEQ ID NO: 399964 - RNA, 64 nt, Homo Sapiens; identical to SEQ ID NO: 28374

SEQ ID NO: 399965 - RNA, 64 nt, Homo Sapiens; identical to SEQ ID NO: 28375

SEQ ID NO: 399966 - RNA, 64 nt, Homo Sapiens; identical to SEQ ID NO: 28376

SEQ ID NO: 399967 - RNA, 64 nt, Homo Sapiens; identical to SEQ ID NO: 28377

SEQ ID NO: 399968 - RNA, 64 nt, Homo Sapiens; identical to SEQ ID NO: 28378

SEQ ID NO: 399969 - RNA, 64 nt, Homo Sapiens; identical to SEQ ID NO: 28379

SEQ ID NO: 399970 - RNA, 64 nt, Homo Sapiens; identical to SEQ ID NO: 28380

SEQ ID NO: 399971 - RNA, 64 nt, Homo Sapiens; identical to SEQ ID NO: 28381

SEQ ID NO: 399972 - RNA, 64 nt, Homo Sapiens; identical to SEQ ID NO: 28382

SEQ ID NO: 399973 - RNA, 64 nt, Homo Sapiens; identical to SEQ ID NO: 28383

SEQ ID NO: 399974 - RNA, 64 nt, Homo Sapiens; identical to SEQ ID NO: 28384

SEQ ID NO: 399975 - RNA, 64 nt, Homo Sapiens; identical to SEQ ID NO: 28385

SEQ ID NO: 399976 - RNA, 64 nt, Homo Sapiens; identical to SEQ ID NO: 28386

SEQ ID NO: 399977 - RNA, 64 nt, Homo Sapiens; identical to SEQ ID NO: 28387

SEQ ID NO: 399978 - RNA, 64 nt, Homo Sapiens; identical to SEQ ID NO: 28388

SEQ ID NO: 399979 - RNA, 64 nt, Homo Sapiens; identical to SEQ ID NO: 28389

SEQ ID NO: 399980 - RNA, 64 nt, Homo Sapiens; identical to SEQ ID NO: 28390

SEQ ID NO: 399981 - RNA, 64 nt, Homo Sapiens; identical to SEQ ID NO: 28391

SEQ ID NO: 399982 - RNA, 64 nt, Homo Sapiens; identical to SEQ ID NO: 28392

SEQ ID NO: 399983 - RNA, 64 nt, Homo Sapiens; identical to SEQ ID NO: 28393

SEQ ID NO: 399984 - RNA, 64 nt, Homo Sapiens; identical to SEQ ID NO: 28394

SEQ ID NO: 399985 - RNA, 64 nt, Homo Sapiens; identical to SEQ ID NO: 28395

SEQ ID NO: 399986 - RNA, 64 nt, Homo Sapiens; identical to SEQ ID NO: 28396

SEQ ID NO: 399987 - RNA, 64 nt, Homo Sapiens; identical to SEQ ID NO: 28397

SEQ ID NO: 399988 - RNA, 64 nt, Homo Sapiens; identical to SEQ ID NO: 28398

SEQ ID NO: 399989 - RNA, 64 nt, Homo Sapiens; identical to SEQ ID NO: 28399

SEQ ID NO: 399990 - RNA, 64 nt, Homo Sapiens; identical to SEQ ID NO: 28400

SEQ ID NO: 399991 - RNA, 64 nt, Homo Sapiens; identical to SEQ ID NO: 28401

SEQ ID NO: 399992 - RNA, 64 nt, Homo Sapiens; identical to SEQ ID NO: 28402

SEQ ID NO: 399993 - RNA, 64 nt, Homo Sapiens; identical to SEQ ID NO: 28403

SEQ ID NO: 399994 - RNA, 64 nt, Homo Sapiens; identical to SEQ ID NO: 28404

SEQ ID NO: 399995 - RNA, 64 nt, Homo Sapiens; identical to SEQ ID NO: 28405

SEQ ID NO: 399996 - RNA, 64 nt, Homo Sapiens; identical to SEQ ID NO: 28406

SEQ ID NO: 399997 - RNA, 64 nt, Homo Sapiens; identical to SEQ ID NO: 28407

SEQ ID NO: 399998 - RNA, 64 nt, Homo Sapiens; identical to SEQ ID NO: 28408

SEQ ID NO: 399999 - RNA, 64 nt, Homo Sapiens; identical to SEQ ID NO: 28409

SEQ ID NO: 400000 - RNA, 64 nt, Homo Sapiens; identical to SEQ ID NO: 28410

SEQ ID NO: 400001 - RNA, 64 nt, Homo Sapiens; identical to SEQ ID NO: 28411

SEQ ID NO: 400002 - RNA, 64 nt, Homo Sapiens; identical to SEQ ID NO: 28412

SEQ ID NO: 400003 - RNA, 64 nt, Homo Sapiens; identical to SEQ ID NO: 28413

SEQ ID NO: 400004 - RNA, 64 nt, Homo Sapiens; identical to SEQ ID NO: 28414

SEQ ID NO: 400005 - RNA, 64 nt, Homo Sapiens; identical to SEQ ID NO: 28415

SEQ ID NO: 400006 - RNA, 64 nt, Homo Sapiens; identical to SEQ ID NO: 28416

SEQ ID NO: 400007 - RNA, 64 nt, Homo Sapiens; identical to SEQ ID NO: 28417

SEQ ID NO: 400008 - RNA, 64 nt, Homo Sapiens; identical to SEQ ID NO: 28418

SEQ ID NO: 400009 - RNA, 64 nt, Homo Sapiens; identical to SEQ ID NO: 28419

SEQ ID NO: 400010 - RNA, 64 nt, Homo Sapiens; identical to SEQ ID NO: 28420

SEQ ID NO: 400011 - RNA, 64 nt, Homo Sapiens; identical to SEQ ID NO: 28421

SEQ ID NO: 400012 - RNA, 64 nt, Homo Sapiens; identical to SEQ ID NO: 28422

SEQ ID NO: 400013 - RNA, 64 nt, Homo Sapiens; identical to SEQ ID NO: 28423

SEQ ID NO: 400014 - RNA, 64 nt, Homo Sapiens; identical to SEQ ID NO: 28424

SEQ ID NO: 400015 - RNA, 64 nt, Homo Sapiens; identical to SEQ ID NO: 28425

SEQ ID NO: 400016 - RNA, 64 nt, Homo Sapiens; identical to SEQ ID NO: 28426

SEQ ID NO: 400017 - RNA, 64 nt, Homo Sapiens; identical to SEQ ID NO: 28427

SEQ ID NO: 400018 - RNA, 64 nt, Homo Sapiens; identical to SEQ ID NO: 28428

SEQ ID NO: 400019 - RNA, 64 nt, Homo Sapiens; identical to SEQ ID NO: 28429

SEQ ID NO: 400020 - RNA, 64 nt, Homo Sapiens; identical to SEQ ID NO: 28430

SEQ ID NO: 400021 - RNA, 64 nt, Homo Sapiens; identical to SEQ ID NO: 28431

SEQ ID NO: 400022 - RNA, 64 nt, Homo Sapiens; identical to SEQ ID NO: 28432

SEQ ID NO: 400023 - RNA, 64 nt, Homo Sapiens; identical to SEQ ID NO: 28433

SEQ ID NO: 400024 - RNA, 64 nt, Homo Sapiens; identical to SEQ ID NO: 28434

SEQ ID NO: 400025 - RNA, 64 nt, Homo Sapiens; identical to SEQ ID NO: 28435

SEQ ID NO: 400026 - RNA, 64 nt, Homo Sapiens; identical to SEQ ID NO: 28436

SEQ ID NO: 400027 - RNA, 64 nt, Homo Sapiens; identical to SEQ ID NO: 28437

SEQ ID NO: 400028 - RNA, 64 nt, Homo Sapiens; identical to SEQ ID NO: 28438

SEQ ID NO: 400029 - RNA, 64 nt, Homo Sapiens; identical to SEQ ID NO: 28439

SEQ ID NO: 400030 - RNA, 64 nt, Homo Sapiens; identical to SEQ ID NO: 28440

SEQ ID NO: 400031 - RNA, 64 nt, Homo Sapiens; identical to SEQ ID NO: 28441

SEQ ID NO: 400032 - RNA, 64 nt, Homo Sapiens; identical to SEQ ID NO: 28442

SEQ ID NO: 400033 - RNA, 64 nt, Homo Sapiens; identical to SEQ ID NO: 28443

SEQ ID NO: 400034 - RNA, 64 nt, Homo Sapiens; identical to SEQ ID NO: 28444

SEQ ID NO: 400035 - RNA, 64 nt, Homo Sapiens; identical to SEQ ID NO: 28445

SEQ ID NO: 400036 - RNA, 64 nt, Homo Sapiens; identical to SEQ ID NO: 28446

SEQ ID NO: 400037 - RNA, 64 nt, Homo Sapiens; identical to SEQ ID NO: 28447

SEQ ID NO: 400038 - RNA, 64 nt, Homo Sapiens; identical to SEQ ID NO: 28448

SEQ ID NO: 400039 - RNA, 64 nt, Homo Sapiens; identical to SEQ ID NO: 28449

SEQ ID NO: 400040 - RNA, 64 nt, Homo Sapiens; identical to SEQ ID NO: 28450

SEQ ID NO: 400041 - RNA, 64 nt, Homo Sapiens; identical to SEQ ID NO: 28451

SEQ ID NO: 400042 - RNA, 64 nt, Homo Sapiens; identical to SEQ ID NO: 28452

SEQ ID NO: 400043 - RNA, 64 nt, Homo Sapiens; identical to SEQ ID NO: 28453

SEQ ID NO: 400044 - RNA, 64 nt, Homo Sapiens; identical to SEQ ID NO: 28454

SEQ ID NO: 400045 - RNA, 64 nt, Homo Sapiens; identical to SEQ ID NO: 28455

SEQ ID NO: 400046 - RNA, 64 nt, Homo Sapiens; identical to SEQ ID NO: 28456

SEQ ID NO: 400047 - RNA, 64 nt, Homo Sapiens; identical to SEQ ID NO: 28457

SEQ ID NO: 400048 - RNA, 64 nt, Homo Sapiens; identical to SEQ ID NO: 28458

SEQ ID NO: 400049 - RNA, 64 nt, Homo Sapiens; identical to SEQ ID NO: 28459

SEQ ID NO: 400050 - RNA, 64 nt, Homo Sapiens; identical to SEQ ID NO: 28460

SEQ ID NO: 400051 - RNA, 64 nt, Homo Sapiens; identical to SEQ ID NO: 28461

SEQ ID NO: 400052 - RNA, 64 nt, Homo Sapiens; identical to SEQ ID NO: 28462

SEQ ID NO: 400053 - RNA, 64 nt, Homo Sapiens; identical to SEQ ID NO: 28463

SEQ ID NO: 400054 - RNA, 64 nt, Homo Sapiens; identical to SEQ ID NO: 28464

SEQ ID NO: 400055 - RNA, 64 nt, Homo Sapiens; identical to SEQ ID NO: 28465

SEQ ID NO: 400056 - RNA, 64 nt, Homo Sapiens; identical to SEQ ID NO: 28466

SEQ ID NO: 400057 - RNA, 64 nt, Homo Sapiens; identical to SEQ ID NO: 28467

SEQ ID NO: 400058 - RNA, 64 nt, Homo Sapiens; identical to SEQ ID NO: 28468

SEQ ID NO: 400059 - RNA, 64 nt, Homo Sapiens; identical to SEQ ID NO: 28469

SEQ ID NO: 400060 - RNA, 64 nt, Homo Sapiens; identical to SEQ ID NO: 28470

SEQ ID NO: 400061 - RNA, 64 nt, Homo Sapiens; identical to SEQ ID NO: 28471

SEQ ID NO: 400062 - RNA, 64 nt, Homo Sapiens; identical to SEQ ID NO: 28472

SEQ ID NO: 400063 - RNA, 64 nt, Homo Sapiens; identical to SEQ ID NO: 28473

SEQ ID NO: 400064 - RNA, 64 nt, Homo Sapiens; identical to SEQ ID NO: 28474

SEQ ID NO: 400065 - RNA, 64 nt, Homo Sapiens; identical to SEQ ID NO: 28475

SEQ ID NO: 400066 - RNA, 64 nt, Homo Sapiens; identical to SEQ ID NO: 28476

SEQ ID NO: 400067 - RNA, 64 nt, Homo Sapiens; identical to SEQ ID NO: 28477

SEQ ID NO: 400068 - RNA, 64 nt, Homo Sapiens; identical to SEQ ID NO: 28478

SEQ ID NO: 400069 - RNA, 64 nt, Homo Sapiens; identical to SEQ ID NO: 28479

SEQ ID NO: 400070 - RNA, 64 nt, Homo Sapiens; identical to SEQ ID NO: 28480

SEQ ID NO: 400071 - RNA, 64 nt, Homo Sapiens; identical to SEQ ID NO: 28481

SEQ ID NO: 400072 - RNA, 64 nt, Homo Sapiens; identical to SEQ ID NO: 28482

SEQ ID NO: 400073 - RNA, 64 nt, Homo Sapiens; identical to SEQ ID NO: 28483

SEQ ID NO: 400074 - RNA, 64 nt, Homo Sapiens; identical to SEQ ID NO: 28484

SEQ ID NO: 400075 - RNA, 64 nt, Homo Sapiens; identical to SEQ ID NO: 28485

SEQ ID NO: 400076 - RNA, 64 nt, Homo Sapiens; identical to SEQ ID NO: 28486

SEQ ID NO: 400077 - RNA, 64 nt, Homo Sapiens; identical to SEQ ID NO: 28487

SEQ ID NO: 400078 - RNA, 64 nt, Homo Sapiens; identical to SEQ ID NO: 28488

SEQ ID NO: 400079 - RNA, 64 nt, Homo Sapiens; identical to SEQ ID NO: 28489

SEQ ID NO: 400080 - RNA, 64 nt, Homo Sapiens; identical to SEQ ID NO: 28490

SEQ ID NO: 400081 - RNA, 51 nt, Homo Sapiens; identical to SEQ ID NO: 28491

SEQ ID NO: 400082 - RNA, 50 nt, Homo Sapiens; identical to SEQ ID NO: 28492

SEQ ID NO: 400083 - RNA, 64 nt, Homo Sapiens; identical to SEQ ID NO: 28493

SEQ ID NO: 400084 - RNA, 64 nt, Homo Sapiens; identical to SEQ ID NO: 28494

SEQ ID NO: 400085 - RNA, 64 nt, Homo Sapiens; identical to SEQ ID NO: 28495

SEQ ID NO: 400086 - RNA, 64 nt, Homo Sapiens; identical to SEQ ID NO: 28496

SEQ ID NO: 400087 - RNA, 64 nt, Homo Sapiens; identical to SEQ ID NO: 28497

SEQ ID NO: 400088 - RNA, 64 nt, Homo Sapiens; identical to SEQ ID NO: 28498

SEQ ID NO: 400089 - RNA, 64 nt, Homo Sapiens; identical to SEQ ID NO: 28499

SEQ ID NO: 400090 - RNA, 64 nt, Homo Sapiens; identical to SEQ ID NO: 28500

SEQ ID NO: 400091 - RNA, 64 nt, Homo Sapiens; identical to SEQ ID NO: 28501

SEQ ID NO: 400092 - RNA, 64 nt, Homo Sapiens; identical to SEQ ID NO: 28502

SEQ ID NO: 400093 - RNA, 64 nt, Homo Sapiens; identical to SEQ ID NO: 28503

SEQ ID NO: 400094 - RNA, 64 nt, Homo Sapiens; identical to SEQ ID NO: 28504

SEQ ID NO: 400095 - RNA, 64 nt, Homo Sapiens; identical to SEQ ID NO: 28505

SEQ ID NO: 400096 - RNA, 64 nt, Homo Sapiens; identical to SEQ ID NO: 28506

SEQ ID NO: 400097 - RNA, 64 nt, Homo Sapiens; identical to SEQ ID NO: 28507

SEQ ID NO: 400098 - RNA, 64 nt, Homo Sapiens; identical to SEQ ID NO: 28508

SEQ ID NO: 400099 - RNA, 64 nt, Homo Sapiens; identical to SEQ ID NO: 28509

SEQ ID NO: 400100 - RNA, 64 nt, Homo Sapiens; identical to SEQ ID NO: 28510

SEQ ID NO: 400101 - RNA, 64 nt, Homo Sapiens; identical to SEQ ID NO: 28511

SEQ ID NO: 400102 - RNA, 64 nt, Homo Sapiens; identical to SEQ ID NO: 28512

SEQ ID NO: 400103 - RNA, 64 nt, Homo Sapiens; identical to SEQ ID NO: 28513

SEQ ID NO: 400104 - RNA, 64 nt, Homo Sapiens; identical to SEQ ID NO: 28514

SEQ ID NO: 400105 - RNA, 64 nt, Homo Sapiens; identical to SEQ ID NO: 28515

SEQ ID NO: 400106 - RNA, 64 nt, Homo Sapiens; identical to SEQ ID NO: 28516

SEQ ID NO: 400107 - RNA, 64 nt, Homo Sapiens; identical to SEQ ID NO: 28517

SEQ ID NO: 400108 - RNA, 64 nt, Homo Sapiens; identical to SEQ ID NO: 28518

SEQ ID NO: 400109 - RNA, 64 nt, Homo Sapiens; identical to SEQ ID NO: 28519

SEQ ID NO: 400110 - RNA, 64 nt, Homo Sapiens; identical to SEQ ID NO: 28520

SEQ ID NO: 400111 - RNA, 64 nt, Homo Sapiens; identical to SEQ ID NO: 28521

SEQ ID NO: 400112 - RNA, 64 nt, Homo Sapiens; identical to SEQ ID NO: 28522

SEQ ID NO: 400113 - RNA, 64 nt, Homo Sapiens; identical to SEQ ID NO: 28523

SEQ ID NO: 400114 - RNA, 64 nt, Homo Sapiens; identical to SEQ ID NO: 28524

SEQ ID NO: 400115 - RNA, 64 nt, Homo Sapiens; identical to SEQ ID NO: 28525

SEQ ID NO: 400116 - RNA, 64 nt, Homo Sapiens; identical to SEQ ID NO: 28526

SEQ ID NO: 400117 - RNA, 64 nt, Homo Sapiens; identical to SEQ ID NO: 28527

SEQ ID NO: 400118 - RNA, 64 nt, Homo Sapiens; identical to SEQ ID NO: 28528

SEQ ID NO: 400119 - RNA, 64 nt, Homo Sapiens; identical to SEQ ID NO: 28529

SEQ ID NO: 400120 - RNA, 64 nt, Homo Sapiens; identical to SEQ ID NO: 28530

SEQ ID NO: 400121 - RNA, 64 nt, Homo Sapiens; identical to SEQ ID NO: 28531

SEQ ID NO: 400122 - RNA, 64 nt, Homo Sapiens; identical to SEQ ID NO: 28532

SEQ ID NO: 400123 - RNA, 64 nt, Homo Sapiens; identical to SEQ ID NO: 28533

SEQ ID NO: 400124 - RNA, 64 nt, Homo Sapiens; identical to SEQ ID NO: 28534

SEQ ID NO: 400125 - RNA, 64 nt, Homo Sapiens; identical to SEQ ID NO: 28535

SEQ ID NO: 400126 - RNA, 64 nt, Homo Sapiens; identical to SEQ ID NO: 28536

SEQ ID NO: 400127 - RNA, 64 nt, Homo Sapiens; identical to SEQ ID NO: 28537

SEQ ID NO: 400128 - RNA, 64 nt, Homo Sapiens; identical to SEQ ID NO: 28538

SEQ ID NO: 400129 - RNA, 64 nt, Homo Sapiens; identical to SEQ ID NO: 28539

SEQ ID NO: 400130 - RNA, 64 nt, Homo Sapiens; identical to SEQ ID NO: 28540

SEQ ID NO: 400131 - RNA, 64 nt, Homo Sapiens; identical to SEQ ID NO: 28541

SEQ ID NO: 400132 - RNA, 64 nt, Homo Sapiens; identical to SEQ ID NO: 28542

SEQ ID NO: 400133 - RNA, 64 nt, Homo Sapiens; identical to SEQ ID NO: 28543

SEQ ID NO: 400134 - RNA, 64 nt, Homo Sapiens; identical to SEQ ID NO: 28544

SEQ ID NO: 400135 - RNA, 64 nt, Homo Sapiens; identical to SEQ ID NO: 28545

SEQ ID NO: 400136 - RNA, 64 nt, Homo Sapiens; identical to SEQ ID NO: 28546

SEQ ID NO: 400137 - RNA, 64 nt, Homo Sapiens; identical to SEQ ID NO: 28547

SEQ ID NO: 400138 - RNA, 64 nt, Homo Sapiens; identical to SEQ ID NO: 28548

SEQ ID NO: 400139 - RNA, 64 nt, Homo Sapiens; identical to SEQ ID NO: 28549

SEQ ID NO: 400140 - RNA, 64 nt, Homo Sapiens; identical to SEQ ID NO: 28550

SEQ ID NO: 400141 - RNA, 64 nt, Homo Sapiens; identical to SEQ ID NO: 28551

SEQ ID NO: 400142 - RNA, 64 nt, Homo Sapiens; identical to SEQ ID NO: 28552

SEQ ID NO: 400143 - RNA, 64 nt, Homo Sapiens; identical to SEQ ID NO: 28553

SEQ ID NO: 400144 - RNA, 64 nt, Homo Sapiens; identical to SEQ ID NO: 28554

SEQ ID NO: 400145 - RNA, 64 nt, Homo Sapiens; identical to SEQ ID NO: 28555

SEQ ID NO: 400146 - RNA, 64 nt, Homo Sapiens; identical to SEQ ID NO: 28556

SEQ ID NO: 400147 - RNA, 64 nt, Homo Sapiens; identical to SEQ ID NO: 28557

SEQ ID NO: 400148 - RNA, 64 nt, Homo Sapiens; identical to SEQ ID NO: 28558

SEQ ID NO: 400149 - RNA, 64 nt, Homo Sapiens; identical to SEQ ID NO: 28559

SEQ ID NO: 400150 - RNA, 64 nt, Homo Sapiens; identical to SEQ ID NO: 28560

SEQ ID NO: 400151 - RNA, 64 nt, Homo Sapiens; identical to SEQ ID NO: 28561

SEQ ID NO: 400152 - RNA, 64 nt, Homo Sapiens; identical to SEQ ID NO: 28562

SEQ ID NO: 400153 - RNA, 64 nt, Homo Sapiens; identical to SEQ ID NO: 28563

SEQ ID NO: 400154 - RNA, 64 nt, Homo Sapiens; identical to SEQ ID NO: 28564

SEQ ID NO: 400155 - RNA, 64 nt, Homo Sapiens; identical to SEQ ID NO: 28565

SEQ ID NO: 400156 - RNA, 64 nt, Homo Sapiens; identical to SEQ ID NO: 28566

SEQ ID NO: 400157 - RNA, 64 nt, Homo Sapiens; identical to SEQ ID NO: 28567

SEQ ID NO: 400158 - RNA, 64 nt, Homo Sapiens; identical to SEQ ID NO: 28568

SEQ ID NO: 400159 - RNA, 64 nt, Homo Sapiens; identical to SEQ ID NO: 28569

SEQ ID NO: 400160 - RNA, 64 nt, Homo Sapiens; identical to SEQ ID NO: 28570

SEQ ID NO: 400161 - RNA, 64 nt, Homo Sapiens; identical to SEQ ID NO: 28571

SEQ ID NO: 400162 - RNA, 64 nt, Homo Sapiens; identical to SEQ ID NO: 28572

SEQ ID NO: 400163 - RNA, 64 nt, Homo Sapiens; identical to SEQ ID NO: 28573

SEQ ID NO: 400164 - RNA, 64 nt, Homo Sapiens; identical to SEQ ID NO: 28574

SEQ ID NO: 400165 - RNA, 64 nt, Homo Sapiens; identical to SEQ ID NO: 28575

SEQ ID NO: 400166 - RNA, 64 nt, Homo Sapiens; identical to SEQ ID NO: 28576

SEQ ID NO: 400167 - RNA, 64 nt, Homo Sapiens; identical to SEQ ID NO: 28577

SEQ ID NO: 400168 - RNA, 64 nt, Homo Sapiens; identical to SEQ ID NO: 28578

SEQ ID NO: 400169 - RNA, 64 nt, Homo Sapiens; identical to SEQ ID NO: 28579

SEQ ID NO: 400170 - RNA, 64 nt, Homo Sapiens; identical to SEQ ID NO: 28580

SEQ ID NO: 400171 - RNA, 64 nt, Homo Sapiens; identical to SEQ ID NO: 28581

SEQ ID NO: 400172 - RNA, 64 nt, Homo Sapiens; identical to SEQ ID NO: 28582

SEQ ID NO: 400173 - RNA, 64 nt, Homo Sapiens; identical to SEQ ID NO: 28583

SEQ ID NO: 400174 - RNA, 64 nt, Homo Sapiens; identical to SEQ ID NO: 28584

SEQ ID NO: 400175 - RNA, 64 nt, Homo Sapiens; identical to SEQ ID NO: 28585

SEQ ID NO: 400176 - RNA, 64 nt, Homo Sapiens; identical to SEQ ID NO: 28586

SEQ ID NO: 400177 - RNA, 64 nt, Homo Sapiens; identical to SEQ ID NO: 28587

SEQ ID NO: 400178 - RNA, 64 nt, Homo Sapiens; identical to SEQ ID NO: 28588

SEQ ID NO: 400179 - RNA, 64 nt, Homo Sapiens; identical to SEQ ID NO: 28589

SEQ ID NO: 400180 - RNA, 64 nt, Homo Sapiens; identical to SEQ ID NO: 28590

SEQ ID NO: 400181 - RNA, 64 nt, Homo Sapiens; identical to SEQ ID NO: 28591

SEQ ID NO: 400182 - RNA, 64 nt, Homo Sapiens; identical to SEQ ID NO: 28592

SEQ ID NO: 400183 - RNA, 64 nt, Homo Sapiens; identical to SEQ ID NO: 28593

SEQ ID NO: 400184 - RNA, 64 nt, Homo Sapiens; identical to SEQ ID NO: 28594

SEQ ID NO: 400185 - RNA, 64 nt, Homo Sapiens; identical to SEQ ID NO: 28595

SEQ ID NO: 400186 - RNA, 64 nt, Homo Sapiens; identical to SEQ ID NO: 28596

SEQ ID NO: 400187 - RNA, 64 nt, Homo Sapiens; identical to SEQ ID NO: 28597

SEQ ID NO: 400188 - RNA, 64 nt, Homo Sapiens; identical to SEQ ID NO: 28598

SEQ ID NO: 400189 - RNA, 64 nt, Homo Sapiens; identical to SEQ ID NO: 28599

SEQ ID NO: 400190 - RNA, 64 nt, Homo Sapiens; identical to SEQ ID NO: 28600

SEQ ID NO: 400191 - RNA, 64 nt, Homo Sapiens; identical to SEQ ID NO: 28601

SEQ ID NO: 400192 - RNA, 64 nt, Homo Sapiens; identical to SEQ ID NO: 28602

SEQ ID NO: 400193 - RNA, 64 nt, Homo Sapiens; identical to SEQ ID NO: 28603

SEQ ID NO: 400194 - RNA, 64 nt, Homo Sapiens; identical to SEQ ID NO: 28604

SEQ ID NO: 400195 - RNA, 64 nt, Homo Sapiens; identical to SEQ ID NO: 28605

SEQ ID NO: 400196 - RNA, 64 nt, Homo Sapiens; identical to SEQ ID NO: 28606

SEQ ID NO: 400197 - RNA, 64 nt, Homo Sapiens; identical to SEQ ID NO: 28607

SEQ ID NO: 400198 - RNA, 64 nt, Homo Sapiens; identical to SEQ ID NO: 28608

SEQ ID NO: 400199 - RNA, 64 nt, Homo Sapiens; identical to SEQ ID NO: 28609

SEQ ID NO: 400200 - RNA, 64 nt, Homo Sapiens; identical to SEQ ID NO: 28610

SEQ ID NO: 400201 - RNA, 64 nt, Homo Sapiens; identical to SEQ ID NO: 28611

SEQ ID NO: 400202 - RNA, 64 nt, Homo Sapiens; identical to SEQ ID NO: 28612

SEQ ID NO: 400203 - RNA, 64 nt, Homo Sapiens; identical to SEQ ID NO: 28613

SEQ ID NO: 400204 - RNA, 64 nt, Homo Sapiens; identical to SEQ ID NO: 28614

SEQ ID NO: 400205 - RNA, 64 nt, Homo Sapiens; identical to SEQ ID NO: 28615

SEQ ID NO: 400206 - RNA, 64 nt, Homo Sapiens; identical to SEQ ID NO: 28616

SEQ ID NO: 400207 - RNA, 64 nt, Homo Sapiens; identical to SEQ ID NO: 28617

SEQ ID NO: 400208 - RNA, 64 nt, Homo Sapiens; identical to SEQ ID NO: 28618

SEQ ID NO: 400209 - RNA, 64 nt, Homo Sapiens; identical to SEQ ID NO: 28619

SEQ ID NO: 400210 - RNA, 64 nt, Homo Sapiens; identical to SEQ ID NO: 28620

SEQ ID NO: 400211 - RNA, 64 nt, Homo Sapiens; identical to SEQ ID NO: 28549

SEQ ID NO: 400212 - RNA, 64 nt, Homo Sapiens; identical to SEQ ID NO: 28622

SEQ ID NO: 400213 - RNA, 64 nt, Homo Sapiens; identical to SEQ ID NO: 28623

SEQ ID NO: 400214 - RNA, 64 nt, Homo Sapiens; identical to SEQ ID NO: 28624

SEQ ID NO: 400215 - RNA, 64 nt, Homo Sapiens; identical to SEQ ID NO: 28625

SEQ ID NO: 400216 - RNA, 64 nt, Homo Sapiens; identical to SEQ ID NO: 28626

SEQ ID NO: 400217 - RNA, 64 nt, Homo Sapiens; identical to SEQ ID NO: 28627

SEQ ID NO: 400218 - RNA, 64 nt, Homo Sapiens; identical to SEQ ID NO: 28628

SEQ ID NO: 400219 - RNA, 64 nt, Homo Sapiens; identical to SEQ ID NO: 28629

SEQ ID NO: 400220 - RNA, 64 nt, Homo Sapiens; identical to SEQ ID NO: 28630

SEQ ID NO: 400221 - RNA, 64 nt, Homo Sapiens; identical to SEQ ID NO: 28631

SEQ ID NO: 400222 - RNA, 64 nt, Homo Sapiens; identical to SEQ ID NO: 28632

SEQ ID NO: 400223 - RNA, 64 nt, Homo Sapiens; identical to SEQ ID NO: 28633

SEQ ID NO: 400224 - RNA, 64 nt, Homo Sapiens; identical to SEQ ID NO: 28634

SEQ ID NO: 400225 - RNA, 64 nt, Homo Sapiens; identical to SEQ ID NO: 28635

SEQ ID NO: 400226 - RNA, 64 nt, Homo Sapiens; identical to SEQ ID NO: 28636

SEQ ID NO: 400227 - RNA, 64 nt, Homo Sapiens; identical to SEQ ID NO: 28637

SEQ ID NO: 400228 - RNA, 64 nt, Homo Sapiens; identical to SEQ ID NO: 28638

SEQ ID NO: 400229 - RNA, 64 nt, Homo Sapiens; identical to SEQ ID NO: 28639

SEQ ID NO: 400230 - RNA, 64 nt, Homo Sapiens; identical to SEQ ID NO: 28640

SEQ ID NO: 400231 - RNA, 64 nt, Homo Sapiens; identical to SEQ ID NO: 28641

SEQ ID NO: 400232 - RNA, 64 nt, Homo Sapiens; identical to SEQ ID NO: 28642

SEQ ID NO: 400233 - RNA, 64 nt, Homo Sapiens; identical to SEQ ID NO: 28643

SEQ ID NO: 400234 - RNA, 64 nt, Homo Sapiens; identical to SEQ ID NO: 28644

SEQ ID NO: 400235 - RNA, 64 nt, Homo Sapiens; identical to SEQ ID NO: 28645

SEQ ID NO: 400236 - RNA, 64 nt, Homo Sapiens; identical to SEQ ID NO: 28646

SEQ ID NO: 400237 - RNA, 64 nt, Homo Sapiens; identical to SEQ ID NO: 28647

SEQ ID NO: 400238 - RNA, 64 nt, Homo Sapiens; identical to SEQ ID NO: 28648

SEQ ID NO: 400239 - RNA, 64 nt, Homo Sapiens; identical to SEQ ID NO: 28649

SEQ ID NO: 400240 - RNA, 64 nt, Homo Sapiens; identical to SEQ ID NO: 28650

SEQ ID NO: 400241 - RNA, 64 nt, Homo Sapiens; identical to SEQ ID NO: 28651

SEQ ID NO: 400242 - RNA, 64 nt, Homo Sapiens; identical to SEQ ID NO: 28652

SEQ ID NO: 400243 - RNA, 64 nt, Homo Sapiens; identical to SEQ ID NO: 28653

SEQ ID NO: 400244 - RNA, 64 nt, Homo Sapiens; identical to SEQ ID NO: 28654

SEQ ID NO: 400245 - RNA, 64 nt, Homo Sapiens; identical to SEQ ID NO: 28655

SEQ ID NO: 400246 - RNA, 64 nt, Homo Sapiens; identical to SEQ ID NO: 28656

SEQ ID NO: 400247 - RNA, 64 nt, Homo Sapiens; identical to SEQ ID NO: 28657

SEQ ID NO: 400248 - RNA, 64 nt, Homo Sapiens; identical to SEQ ID NO: 28658

SEQ ID NO: 400249 - RNA, 64 nt, Homo Sapiens; identical to SEQ ID NO: 28659

SEQ ID NO: 400250 - RNA, 64 nt, Homo Sapiens; identical to SEQ ID NO: 28660

SEQ ID NO: 400251 - RNA, 64 nt, Homo Sapiens; identical to SEQ ID NO: 28661

SEQ ID NO: 400252 - RNA, 64 nt, Homo Sapiens; identical to SEQ ID NO: 28662

SEQ ID NO: 400253 - RNA, 64 nt, Homo Sapiens; identical to SEQ ID NO: 28663

SEQ ID NO: 400254 - RNA, 64 nt, Homo Sapiens; identical to SEQ ID NO: 28664

SEQ ID NO: 400255 - RNA, 64 nt, Homo Sapiens; identical to SEQ ID NO: 28665

SEQ ID NO: 400256 - RNA, 64 nt, Homo Sapiens; identical to SEQ ID NO: 28666

SEQ ID NO: 400257 - RNA, 64 nt, Homo Sapiens; identical to SEQ ID NO: 28667

SEQ ID NO: 400258 - RNA, 64 nt, Homo Sapiens; identical to SEQ ID NO: 28668

SEQ ID NO: 400259 - RNA, 64 nt, Homo Sapiens; identical to SEQ ID NO: 28669

SEQ ID NO: 400260 - RNA, 64 nt, Homo Sapiens; identical to SEQ ID NO: 28670

SEQ ID NO: 400261 - RNA, 64 nt, Homo Sapiens; identical to SEQ ID NO: 28671

SEQ ID NO: 400262 - RNA, 64 nt, Homo Sapiens; identical to SEQ ID NO: 28672

SEQ ID NO: 400263 - RNA, 64 nt, Homo Sapiens; identical to SEQ ID NO: 28673

SEQ ID NO: 400264 - RNA, 64 nt, Homo Sapiens; identical to SEQ ID NO: 28674

SEQ ID NO: 400265 - RNA, 64 nt, Homo Sapiens; identical to SEQ ID NO: 28675

SEQ ID NO: 400266 - RNA, 64 nt, Homo Sapiens; identical to SEQ ID NO: 28676

SEQ ID NO: 400267 - RNA, 64 nt, Homo Sapiens; identical to SEQ ID NO: 28677

SEQ ID NO: 400268 - RNA, 64 nt, Homo Sapiens; identical to SEQ ID NO: 28678

SEQ ID NO: 400269 - RNA, 64 nt, Homo Sapiens; identical to SEQ ID NO: 28679

SEQ ID NO: 400270 - RNA, 64 nt, Homo Sapiens; identical to SEQ ID NO: 28680

SEQ ID NO: 400271 - RNA, 64 nt, Homo Sapiens; identical to SEQ ID NO: 28681

SEQ ID NO: 400272 - RNA, 64 nt, Homo Sapiens; identical to SEQ ID NO: 28682

SEQ ID NO: 400273 - RNA, 64 nt, Homo Sapiens; identical to SEQ ID NO: 28683

SEQ ID NO: 400274 - RNA, 64 nt, Homo Sapiens; identical to SEQ ID NO: 28684

SEQ ID NO: 400275 - RNA, 64 nt, Homo Sapiens; identical to SEQ ID NO: 28685

SEQ ID NO: 400276 - RNA, 64 nt, Homo Sapiens; identical to SEQ ID NO: 28686

SEQ ID NO: 400277 - RNA, 64 nt, Homo Sapiens; identical to SEQ ID NO: 28687

SEQ ID NO: 400278 - RNA, 64 nt, Homo Sapiens; identical to SEQ ID NO: 28688

SEQ ID NO: 400279 - RNA, 64 nt, Homo Sapiens; identical to SEQ ID NO: 28689

SEQ ID NO: 400280 - RNA, 64 nt, Homo Sapiens; identical to SEQ ID NO: 28690

SEQ ID NO: 400281 - RNA, 64 nt, Homo Sapiens; identical to SEQ ID NO: 28691

SEQ ID NO: 400282 - RNA, 64 nt, Homo Sapiens; identical to SEQ ID NO: 28692

SEQ ID NO: 400283 - RNA, 64 nt, Homo Sapiens; identical to SEQ ID NO: 28693

SEQ ID NO: 400284 - RNA, 64 nt, Homo Sapiens; identical to SEQ ID NO: 28694

SEQ ID NO: 400285 - RNA, 64 nt, Homo Sapiens; identical to SEQ ID NO: 28695

SEQ ID NO: 400286 - RNA, 64 nt, Homo Sapiens; identical to SEQ ID NO: 28696

SEQ ID NO: 400287 - RNA, 64 nt, Homo Sapiens; identical to SEQ ID NO: 28697

SEQ ID NO: 400288 - RNA, 64 nt, Homo Sapiens; identical to SEQ ID NO: 28698

SEQ ID NO: 400289 - RNA, 64 nt, Homo Sapiens; identical to SEQ ID NO: 28699

SEQ ID NO: 400290 - RNA, 64 nt, Homo Sapiens; identical to SEQ ID NO: 28700

SEQ ID NO: 400291 - RNA, 64 nt, Homo Sapiens; identical to SEQ ID NO: 28701

SEQ ID NO: 400292 - RNA, 64 nt, Homo Sapiens; identical to SEQ ID NO: 28702

SEQ ID NO: 400293 - RNA, 64 nt, Homo Sapiens; identical to SEQ ID NO: 28703

SEQ ID NO: 400294 - RNA, 64 nt, Homo Sapiens; identical to SEQ ID NO: 28704

SEQ ID NO: 400295 - RNA, 64 nt, Homo Sapiens; identical to SEQ ID NO: 28705

SEQ ID NO: 400296 - RNA, 64 nt, Homo Sapiens; identical to SEQ ID NO: 28706

SEQ ID NO: 400297 - RNA, 64 nt, Homo Sapiens; identical to SEQ ID NO: 28707

SEQ ID NO: 400298 - RNA, 64 nt, Homo Sapiens; identical to SEQ ID NO: 28708

SEQ ID NO: 400299 - RNA, 64 nt, Homo Sapiens; identical to SEQ ID NO: 28709

SEQ ID NO: 400300 - RNA, 64 nt, Homo Sapiens; identical to SEQ ID NO: 28710

SEQ ID NO: 400301 - RNA, 64 nt, Homo Sapiens; identical to SEQ ID NO: 28711

SEQ ID NO: 400302 - RNA, 64 nt, Homo Sapiens; identical to SEQ ID NO: 28712

SEQ ID NO: 400303 - RNA, 64 nt, Homo Sapiens; identical to SEQ ID NO: 28713

SEQ ID NO: 400304 - RNA, 64 nt, Homo Sapiens; identical to SEQ ID NO: 28714

SEQ ID NO: 400305 - RNA, 64 nt, Homo Sapiens; identical to SEQ ID NO: 28715

SEQ ID NO: 400306 - RNA, 64 nt, Homo Sapiens; identical to SEQ ID NO: 28716

SEQ ID NO: 400307 - RNA, 64 nt, Homo Sapiens; identical to SEQ ID NO: 28717

SEQ ID NO: 400308 - RNA, 64 nt, Homo Sapiens; identical to SEQ ID NO: 28718

SEQ ID NO: 400309 - RNA, 64 nt, Homo Sapiens; identical to SEQ ID NO: 28719

SEQ ID NO: 400310 - RNA, 64 nt, Homo Sapiens; identical to SEQ ID NO: 28720

SEQ ID NO: 400311 - RNA, 64 nt, Homo Sapiens; identical to SEQ ID NO: 28721

SEQ ID NO: 400312 - RNA, 64 nt, Homo Sapiens; identical to SEQ ID NO: 28722

SEQ ID NO: 400313 - RNA, 64 nt, Homo Sapiens; identical to SEQ ID NO: 28723

SEQ ID NO: 400314 - RNA, 64 nt, Homo Sapiens; identical to SEQ ID NO: 28724

SEQ ID NO: 400315 - RNA, 64 nt, Homo Sapiens; identical to SEQ ID NO: 28725

SEQ ID NO: 400316 - RNA, 64 nt, Homo Sapiens; identical to SEQ ID NO: 28726

SEQ ID NO: 400317 - RNA, 64 nt, Homo Sapiens; identical to SEQ ID NO: 28727

SEQ ID NO: 400318 - RNA, 64 nt, Homo Sapiens; identical to SEQ ID NO: 28728

SEQ ID NO: 400319 - RNA, 64 nt, Homo Sapiens; identical to SEQ ID NO: 28729

SEQ ID NO: 400320 - RNA, 64 nt, Homo Sapiens; identical to SEQ ID NO: 28730

SEQ ID NO: 400321 - RNA, 64 nt, Homo Sapiens; identical to SEQ ID NO: 28731

SEQ ID NO: 400322 - RNA, 64 nt, Homo Sapiens; identical to SEQ ID NO: 28732

SEQ ID NO: 400323 - RNA, 64 nt, Homo Sapiens; identical to SEQ ID NO: 28733

SEQ ID NO: 400324 - RNA, 64 nt, Homo Sapiens; identical to SEQ ID NO: 28734

SEQ ID NO: 400325 - RNA, 64 nt, Homo Sapiens; identical to SEQ ID NO: 28735

SEQ ID NO: 400326 - RNA, 64 nt, Homo Sapiens; identical to SEQ ID NO: 28736

SEQ ID NO: 400327 - RNA, 64 nt, Homo Sapiens; identical to SEQ ID NO: 28737

SEQ ID NO: 400328 - RNA, 64 nt, Homo Sapiens; identical to SEQ ID NO: 28738

SEQ ID NO: 400329 - RNA, 64 nt, Homo Sapiens; identical to SEQ ID NO: 28739

SEQ ID NO: 400330 - RNA, 64 nt, Homo Sapiens; identical to SEQ ID NO: 28740

SEQ ID NO: 400331 - RNA, 64 nt, Homo Sapiens; identical to SEQ ID NO: 28741

SEQ ID NO: 400332 - RNA, 64 nt, Homo Sapiens; identical to SEQ ID NO: 28742

SEQ ID NO: 400333 - RNA, 64 nt, Homo Sapiens; identical to SEQ ID NO: 28743

SEQ ID NO: 400334 - RNA, 64 nt, Homo Sapiens; identical to SEQ ID NO: 28744

SEQ ID NO: 400335 - RNA, 64 nt, Homo Sapiens; identical to SEQ ID NO: 28745

SEQ ID NO: 400336 - RNA, 64 nt, Homo Sapiens; identical to SEQ ID NO: 28746

SEQ ID NO: 400337 - RNA, 64 nt, Homo Sapiens; identical to SEQ ID NO: 28747

SEQ ID NO: 400338 - RNA, 64 nt, Homo Sapiens; identical to SEQ ID NO: 28748

SEQ ID NO: 400339 - RNA, 64 nt, Homo Sapiens; identical to SEQ ID NO: 28749

SEQ ID NO: 400340 - RNA, 64 nt, Homo Sapiens; identical to SEQ ID NO: 28750

SEQ ID NO: 400341 - RNA, 64 nt, Homo Sapiens; identical to SEQ ID NO: 28751

SEQ ID NO: 400342 - RNA, 64 nt, Homo Sapiens; identical to SEQ ID NO: 28752

SEQ ID NO: 400343 - RNA, 64 nt, Homo Sapiens; identical to SEQ ID NO: 28753

SEQ ID NO: 400344 - RNA, 64 nt, Homo Sapiens; identical to SEQ ID NO: 28754

SEQ ID NO: 400345 - RNA, 64 nt, Homo Sapiens; identical to SEQ ID NO: 28755

SEQ ID NO: 400346 - RNA, 64 nt, Homo Sapiens; identical to SEQ ID NO: 28756

SEQ ID NO: 400347 - RNA, 64 nt, Homo Sapiens; identical to SEQ ID NO: 28757

SEQ ID NO: 400348 - RNA, 64 nt, Homo Sapiens; identical to SEQ ID NO: 28758

SEQ ID NO: 400349 - RNA, 64 nt, Homo Sapiens; identical to SEQ ID NO: 28759

SEQ ID NO: 400350 - RNA, 64 nt, Homo Sapiens; identical to SEQ ID NO: 28760

SEQ ID NO: 400351 - RNA, 64 nt, Homo Sapiens; identical to SEQ ID NO: 28761

SEQ ID NO: 400352 - RNA, 64 nt, Homo Sapiens; identical to SEQ ID NO: 28762

SEQ ID NO: 400353 - RNA, 64 nt, Homo Sapiens; identical to SEQ ID NO: 28763

SEQ ID NO: 400354 - RNA, 64 nt, Homo Sapiens; identical to SEQ ID NO: 28764

SEQ ID NO: 400355 - RNA, 64 nt, Homo Sapiens; identical to SEQ ID NO: 28765

SEQ ID NO: 400356 - RNA, 64 nt, Homo Sapiens; identical to SEQ ID NO: 28766

SEQ ID NO: 400357 - RNA, 64 nt, Homo Sapiens; identical to SEQ ID NO: 28767

SEQ ID NO: 400358 - RNA, 64 nt, Homo Sapiens; identical to SEQ ID NO: 28768

SEQ ID NO: 400359 - RNA, 64 nt, Homo Sapiens; identical to SEQ ID NO: 28769

SEQ ID NO: 400360 - RNA, 64 nt, Homo Sapiens; identical to SEQ ID NO: 28770

SEQ ID NO: 400361 - RNA, 64 nt, Homo Sapiens; identical to SEQ ID NO: 28771

SEQ ID NO: 400362 - RNA, 64 nt, Homo Sapiens; identical to SEQ ID NO: 28772

SEQ ID NO: 400363 - RNA, 64 nt, Homo Sapiens; identical to SEQ ID NO: 28773

SEQ ID NO: 400364 - RNA, 64 nt, Homo Sapiens; identical to SEQ ID NO: 28774

SEQ ID NO: 400365 - RNA, 64 nt, Homo Sapiens; identical to SEQ ID NO: 28775

SEQ ID NO: 400366 - RNA, 64 nt, Homo Sapiens; identical to SEQ ID NO: 28776

SEQ ID NO: 400367 - RNA, 64 nt, Homo Sapiens; identical to SEQ ID NO: 28777

SEQ ID NO: 400368 - RNA, 64 nt, Homo Sapiens; identical to SEQ ID NO: 28778

SEQ ID NO: 400369 - RNA, 64 nt, Homo Sapiens; identical to SEQ ID NO: 28779

SEQ ID NO: 400370 - RNA, 64 nt, Homo Sapiens; identical to SEQ ID NO: 28780

SEQ ID NO: 400371 - RNA, 64 nt, Homo Sapiens; identical to SEQ ID NO: 28781

SEQ ID NO: 400372 - RNA, 64 nt, Homo Sapiens; identical to SEQ ID NO: 28782

SEQ ID NO: 400373 - RNA, 64 nt, Homo Sapiens; identical to SEQ ID NO: 28783

SEQ ID NO: 400374 - RNA, 64 nt, Homo Sapiens; identical to SEQ ID NO: 28784

SEQ ID NO: 400375 - RNA, 64 nt, Homo Sapiens; identical to SEQ ID NO: 28785

SEQ ID NO: 400376 - RNA, 64 nt, Homo Sapiens; identical to SEQ ID NO: 28786

SEQ ID NO: 400377 - RNA, 64 nt, Homo Sapiens; identical to SEQ ID NO: 28787

SEQ ID NO: 400378 - RNA, 64 nt, Homo Sapiens; identical to SEQ ID NO: 28788

SEQ ID NO: 400379 - RNA, 64 nt, Homo Sapiens; identical to SEQ ID NO: 28789

SEQ ID NO: 400380 - RNA, 64 nt, Homo Sapiens; identical to SEQ ID NO: 28790

SEQ ID NO: 400381 - RNA, 64 nt, Homo Sapiens; identical to SEQ ID NO: 28791

SEQ ID NO: 400382 - RNA, 64 nt, Homo Sapiens; identical to SEQ ID NO: 28792

SEQ ID NO: 400383 - RNA, 64 nt, Homo Sapiens; identical to SEQ ID NO: 28793

SEQ ID NO: 400384 - RNA, 64 nt, Homo Sapiens; identical to SEQ ID NO: 28794

SEQ ID NO: 400385 - RNA, 64 nt, Homo Sapiens; identical to SEQ ID NO: 28795

SEQ ID NO: 400386 - RNA, 64 nt, Homo Sapiens; identical to SEQ ID NO: 28796

SEQ ID NO: 400387 - RNA, 64 nt, Homo Sapiens; identical to SEQ ID NO: 28797

SEQ ID NO: 400388 - RNA, 64 nt, Homo Sapiens; identical to SEQ ID NO: 28798

SEQ ID NO: 400389 - RNA, 64 nt, Homo Sapiens; identical to SEQ ID NO: 28799

SEQ ID NO: 400390 - RNA, 64 nt, Homo Sapiens; identical to SEQ ID NO: 28800

SEQ ID NO: 400391 - RNA, 64 nt, Homo Sapiens; identical to SEQ ID NO: 28801

SEQ ID NO: 400392 - RNA, 64 nt, Homo Sapiens; identical to SEQ ID NO: 28802

SEQ ID NO: 400393 - RNA, 64 nt, Homo Sapiens; identical to SEQ ID NO: 28803

SEQ ID NO: 400394 - RNA, 64 nt, Homo Sapiens; identical to SEQ ID NO: 28804

SEQ ID NO: 400395 - RNA, 64 nt, Homo Sapiens; identical to SEQ ID NO: 28805

SEQ ID NO: 400396 - RNA, 64 nt, Homo Sapiens; identical to SEQ ID NO: 28806

SEQ ID NO: 400397 - RNA, 64 nt, Homo Sapiens; identical to SEQ ID NO: 28807

SEQ ID NO: 400398 - RNA, 64 nt, Homo Sapiens; identical to SEQ ID NO: 28808

SEQ ID NO: 400399 - RNA, 64 nt, Homo Sapiens; identical to SEQ ID NO: 28809

SEQ ID NO: 400400 - RNA, 64 nt, Homo Sapiens; identical to SEQ ID NO: 28810

SEQ ID NO: 400401 - RNA, 64 nt, Homo Sapiens; identical to SEQ ID NO: 28811

SEQ ID NO: 400402 - RNA, 64 nt, Homo Sapiens; identical to SEQ ID NO: 28812

SEQ ID NO: 400403 - RNA, 64 nt, Homo Sapiens; identical to SEQ ID NO: 28813

SEQ ID NO: 400404 - RNA, 64 nt, Homo Sapiens; identical to SEQ ID NO: 28814

SEQ ID NO: 400405 - RNA, 64 nt, Homo Sapiens; identical to SEQ ID NO: 28815

SEQ ID NO: 400406 - RNA, 64 nt, Homo Sapiens; identical to SEQ ID NO: 28816

SEQ ID NO: 400407 - RNA, 64 nt, Homo Sapiens; identical to SEQ ID NO: 28817

SEQ ID NO: 400408 - RNA, 64 nt, Homo Sapiens; identical to SEQ ID NO: 28818

SEQ ID NO: 400409 - RNA, 64 nt, Homo Sapiens; identical to SEQ ID NO: 28819

SEQ ID NO: 400410 - RNA, 64 nt, Homo Sapiens; identical to SEQ ID NO: 28820

SEQ ID NO: 400411 - RNA, 64 nt, Homo Sapiens; identical to SEQ ID NO: 28821

SEQ ID NO: 400412 - RNA, 64 nt, Homo Sapiens; identical to SEQ ID NO: 28822

SEQ ID NO: 400413 - RNA, 64 nt, Homo Sapiens; identical to SEQ ID NO: 28823

SEQ ID NO: 400414 - RNA, 64 nt, Homo Sapiens; identical to SEQ ID NO: 28824

SEQ ID NO: 400415 - RNA, 64 nt, Homo Sapiens; identical to SEQ ID NO: 28825

SEQ ID NO: 400416 - RNA, 64 nt, Homo Sapiens; identical to SEQ ID NO: 28826

SEQ ID NO: 400417 - RNA, 64 nt, Homo Sapiens; identical to SEQ ID NO: 28827

SEQ ID NO: 400418 - RNA, 64 nt, Homo Sapiens; identical to SEQ ID NO: 28828

SEQ ID NO: 400419 - RNA, 64 nt, Homo Sapiens; identical to SEQ ID NO: 28829

SEQ ID NO: 400420 - RNA, 64 nt, Homo Sapiens; identical to SEQ ID NO: 28830

SEQ ID NO: 400421 - RNA, 64 nt, Homo Sapiens; identical to SEQ ID NO: 28831

SEQ ID NO: 400422 - RNA, 64 nt, Homo Sapiens; identical to SEQ ID NO: 28832

SEQ ID NO: 400423 - RNA, 64 nt, Homo Sapiens; identical to SEQ ID NO: 28833

SEQ ID NO: 400424 - RNA, 64 nt, Homo Sapiens; identical to SEQ ID NO: 28834

SEQ ID NO: 400425 - RNA, 64 nt, Homo Sapiens; identical to SEQ ID NO: 28835

SEQ ID NO: 400426 - RNA, 64 nt, Homo Sapiens; identical to SEQ ID NO: 28836

SEQ ID NO: 400427 - RNA, 64 nt, Homo Sapiens; identical to SEQ ID NO: 28837

SEQ ID NO: 400428 - RNA, 64 nt, Homo Sapiens; identical to SEQ ID NO: 28838

SEQ ID NO: 400429 - RNA, 64 nt, Homo Sapiens; identical to SEQ ID NO: 28839

SEQ ID NO: 400430 - RNA, 64 nt, Homo Sapiens; identical to SEQ ID NO: 28840

SEQ ID NO: 400431 - RNA, 64 nt, Homo Sapiens; identical to SEQ ID NO: 28841

SEQ ID NO: 400432 - RNA, 64 nt, Homo Sapiens; identical to SEQ ID NO: 28842

SEQ ID NO: 400433 - RNA, 64 nt, Homo Sapiens; identical to SEQ ID NO: 28843

SEQ ID NO: 400434 - RNA, 64 nt, Homo Sapiens; identical to SEQ ID NO: 28844

SEQ ID NO: 400435 - RNA, 64 nt, Homo Sapiens; identical to SEQ ID NO: 28845

SEQ ID NO: 400436 - RNA, 64 nt, Homo Sapiens; identical to SEQ ID NO: 28846

SEQ ID NO: 400437 - RNA, 64 nt, Homo Sapiens; identical to SEQ ID NO: 28847

SEQ ID NO: 400438 - RNA, 64 nt, Homo Sapiens; identical to SEQ ID NO: 28848

SEQ ID NO: 400439 - RNA, 64 nt, Homo Sapiens; identical to SEQ ID NO: 28849

SEQ ID NO: 400440 - RNA, 64 nt, Homo Sapiens; identical to SEQ ID NO: 28850

SEQ ID NO: 400441 - RNA, 64 nt, Homo Sapiens; identical to SEQ ID NO: 28851

SEQ ID NO: 400442 - RNA, 64 nt, Homo Sapiens; identical to SEQ ID NO: 28852

SEQ ID NO: 400443 - RNA, 64 nt, Homo Sapiens; identical to SEQ ID NO: 28853

SEQ ID NO: 400444 - RNA, 64 nt, Homo Sapiens; identical to SEQ ID NO: 28854

SEQ ID NO: 400445 - RNA, 64 nt, Homo Sapiens; identical to SEQ ID NO: 28855

SEQ ID NO: 400446 - RNA, 64 nt, Homo Sapiens; identical to SEQ ID NO: 28856

SEQ ID NO: 400447 - RNA, 64 nt, Homo Sapiens; identical to SEQ ID NO: 28857

SEQ ID NO: 400448 - RNA, 63 nt, Homo Sapiens; identical to SEQ ID NO: 28858

SEQ ID NO: 400449 - RNA, 62 nt, Homo Sapiens; identical to SEQ ID NO: 28859

SEQ ID NO: 400450 - RNA, 64 nt, Homo Sapiens; identical to SEQ ID NO: 28860

SEQ ID NO: 400451 - RNA, 64 nt, Homo Sapiens; identical to SEQ ID NO: 28861

SEQ ID NO: 400452 - RNA, 64 nt, Homo Sapiens; identical to SEQ ID NO: 28862

SEQ ID NO: 400453 - RNA, 64 nt, Homo Sapiens; identical to SEQ ID NO: 28863

SEQ ID NO: 400454 - RNA, 64 nt, Homo Sapiens; identical to SEQ ID NO: 28864

SEQ ID NO: 400455 - RNA, 64 nt, Homo Sapiens; identical to SEQ ID NO: 28865

SEQ ID NO: 400456 - RNA, 64 nt, Homo Sapiens; identical to SEQ ID NO: 28866

SEQ ID NO: 400457 - RNA, 64 nt, Homo Sapiens; identical to SEQ ID NO: 28867

SEQ ID NO: 400458 - RNA, 64 nt, Homo Sapiens; identical to SEQ ID NO: 28868

SEQ ID NO: 400459 - RNA, 64 nt, Homo Sapiens; identical to SEQ ID NO: 28869

SEQ ID NO: 400460 - RNA, 64 nt, Homo Sapiens; identical to SEQ ID NO: 28870

SEQ ID NO: 400461 - RNA, 64 nt, Homo Sapiens; identical to SEQ ID NO: 28871

SEQ ID NO: 400462 - RNA, 64 nt, Homo Sapiens; identical to SEQ ID NO: 28872

SEQ ID NO: 400463 - RNA, 64 nt, Homo Sapiens; identical to SEQ ID NO: 28873

SEQ ID NO: 400464 - RNA, 64 nt, Homo Sapiens; identical to SEQ ID NO: 28874

SEQ ID NO: 400465 - RNA, 64 nt, Homo Sapiens; identical to SEQ ID NO: 28875

SEQ ID NO: 400466 - RNA, 64 nt, Homo Sapiens; identical to SEQ ID NO: 28876

SEQ ID NO: 400467 - RNA, 64 nt, Homo Sapiens; identical to SEQ ID NO: 28877

SEQ ID NO: 400468 - RNA, 64 nt, Homo Sapiens; identical to SEQ ID NO: 28878

SEQ ID NO: 400469 - RNA, 64 nt, Homo Sapiens; identical to SEQ ID NO: 28879

SEQ ID NO: 400470 - RNA, 64 nt, Homo Sapiens; identical to SEQ ID NO: 28880

SEQ ID NO: 400471 - RNA, 64 nt, Homo Sapiens; identical to SEQ ID NO: 28881

SEQ ID NO: 400472 - RNA, 64 nt, Homo Sapiens; identical to SEQ ID NO: 28882

SEQ ID NO: 400473 - RNA, 64 nt, Homo Sapiens; identical to SEQ ID NO: 28883

SEQ ID NO: 400474 - RNA, 64 nt, Homo Sapiens; identical to SEQ ID NO: 28884

SEQ ID NO: 400475 - RNA, 64 nt, Homo Sapiens; identical to SEQ ID NO: 28885

SEQ ID NO: 400476 - RNA, 64 nt, Homo Sapiens; identical to SEQ ID NO: 28886

SEQ ID NO: 400477 - RNA, 64 nt, Homo Sapiens; identical to SEQ ID NO: 28887

SEQ ID NO: 400478 - RNA, 64 nt, Homo Sapiens; identical to SEQ ID NO: 28888

SEQ ID NO: 400479 - RNA, 64 nt, Homo Sapiens; identical to SEQ ID NO: 28889

SEQ ID NO: 400480 - RNA, 64 nt, Homo Sapiens; identical to SEQ ID NO: 28890

SEQ ID NO: 400481 - RNA, 64 nt, Homo Sapiens; identical to SEQ ID NO: 28891

SEQ ID NO: 400482 - RNA, 64 nt, Homo Sapiens; identical to SEQ ID NO: 28892

SEQ ID NO: 400483 - RNA, 64 nt, Homo Sapiens; identical to SEQ ID NO: 28893

SEQ ID NO: 400484 - RNA, 64 nt, Homo Sapiens; identical to SEQ ID NO: 28894

SEQ ID NO: 400485 - RNA, 64 nt, Homo Sapiens; identical to SEQ ID NO: 28895

SEQ ID NO: 400486 - RNA, 64 nt, Homo Sapiens; identical to SEQ ID NO: 28896

SEQ ID NO: 400487 - RNA, 64 nt, Homo Sapiens; identical to SEQ ID NO: 28897

SEQ ID NO: 400488 - RNA, 64 nt, Homo Sapiens; identical to SEQ ID NO: 28898

SEQ ID NO: 400489 - RNA, 64 nt, Homo Sapiens; identical to SEQ ID NO: 28899

SEQ ID NO: 400490 - RNA, 64 nt, Homo Sapiens; identical to SEQ ID NO: 28900

SEQ ID NO: 400491 - RNA, 64 nt, Homo Sapiens; identical to SEQ ID NO: 28901

SEQ ID NO: 400492 - RNA, 64 nt, Homo Sapiens; identical to SEQ ID NO: 28902

SEQ ID NO: 400493 - RNA, 64 nt, Homo Sapiens; identical to SEQ ID NO: 28903

SEQ ID NO: 400494 - RNA, 64 nt, Homo Sapiens; identical to SEQ ID NO: 28904

SEQ ID NO: 400495 - RNA, 64 nt, Homo Sapiens; identical to SEQ ID NO: 28905

SEQ ID NO: 400496 - RNA, 64 nt, Homo Sapiens; identical to SEQ ID NO: 28906

SEQ ID NO: 400497 - RNA, 64 nt, Homo Sapiens; identical to SEQ ID NO: 28907

SEQ ID NO: 400498 - RNA, 64 nt, Homo Sapiens; identical to SEQ ID NO: 28908

SEQ ID NO: 400499 - RNA, 64 nt, Homo Sapiens; identical to SEQ ID NO: 28909

SEQ ID NO: 400500 - RNA, 64 nt, Homo Sapiens; identical to SEQ ID NO: 28910

SEQ ID NO: 400501 - RNA, 64 nt, Homo Sapiens; identical to SEQ ID NO: 28911

SEQ ID NO: 400502 - RNA, 64 nt, Homo Sapiens; identical to SEQ ID NO: 28912

SEQ ID NO: 400503 - RNA, 64 nt, Homo Sapiens; identical to SEQ ID NO: 28913

SEQ ID NO: 400504 - RNA, 64 nt, Homo Sapiens; identical to SEQ ID NO: 28914

SEQ ID NO: 400505 - RNA, 64 nt, Homo Sapiens; identical to SEQ ID NO: 28915

SEQ ID NO: 400506 - RNA, 64 nt, Homo Sapiens; identical to SEQ ID NO: 28916

SEQ ID NO: 400507 - RNA, 64 nt, Homo Sapiens; identical to SEQ ID NO: 28917

SEQ ID NO: 400508 - RNA, 64 nt, Homo Sapiens; identical to SEQ ID NO: 28918

SEQ ID NO: 400509 - RNA, 64 nt, Homo Sapiens; identical to SEQ ID NO: 28919

SEQ ID NO: 400510 - RNA, 64 nt, Homo Sapiens; identical to SEQ ID NO: 28920

SEQ ID NO: 400511 - RNA, 64 nt, Homo Sapiens; identical to SEQ ID NO: 28921

SEQ ID NO: 400512 - RNA, 64 nt, Homo Sapiens; identical to SEQ ID NO: 28922

SEQ ID NO: 400513 - RNA, 64 nt, Homo Sapiens; identical to SEQ ID NO: 28923

SEQ ID NO: 400514 - RNA, 64 nt, Homo Sapiens; identical to SEQ ID NO: 28924

SEQ ID NO: 400515 - RNA, 64 nt, Homo Sapiens; identical to SEQ ID NO: 28925

SEQ ID NO: 400516 - RNA, 64 nt, Homo Sapiens; identical to SEQ ID NO: 28926

SEQ ID NO: 400517 - RNA, 64 nt, Homo Sapiens; identical to SEQ ID NO: 28927

SEQ ID NO: 400518 - RNA, 64 nt, Homo Sapiens; identical to SEQ ID NO: 28928

SEQ ID NO: 400519 - RNA, 64 nt, Homo Sapiens; identical to SEQ ID NO: 28929

SEQ ID NO: 400520 - RNA, 64 nt, Homo Sapiens; identical to SEQ ID NO: 28930

SEQ ID NO: 400521 - RNA, 64 nt, Homo Sapiens; identical to SEQ ID NO: 28931

SEQ ID NO: 400522 - RNA, 64 nt, Homo Sapiens; identical to SEQ ID NO: 28932

SEQ ID NO: 400523 - RNA, 64 nt, Homo Sapiens; identical to SEQ ID NO: 28933

SEQ ID NO: 400524 - RNA, 64 nt, Homo Sapiens; identical to SEQ ID NO: 28934

SEQ ID NO: 400525 - RNA, 64 nt, Homo Sapiens; identical to SEQ ID NO: 28935

SEQ ID NO: 400526 - RNA, 64 nt, Homo Sapiens; identical to SEQ ID NO: 28936

SEQ ID NO: 400527 - RNA, 64 nt, Homo Sapiens; identical to SEQ ID NO: 28937

SEQ ID NO: 400528 - RNA, 64 nt, Homo Sapiens; identical to SEQ ID NO: 28938

SEQ ID NO: 400529 - RNA, 64 nt, Homo Sapiens; identical to SEQ ID NO: 28939

SEQ ID NO: 400530 - RNA, 64 nt, Homo Sapiens; identical to SEQ ID NO: 28940

SEQ ID NO: 400531 - RNA, 64 nt, Homo Sapiens; identical to SEQ ID NO: 28941

SEQ ID NO: 400532 - RNA, 64 nt, Homo Sapiens; identical to SEQ ID NO: 28942

SEQ ID NO: 400533 - RNA, 64 nt, Homo Sapiens; identical to SEQ ID NO: 28943

SEQ ID NO: 400534 - RNA, 64 nt, Homo Sapiens; identical to SEQ ID NO: 28944

SEQ ID NO: 400535 - RNA, 64 nt, Homo Sapiens; identical to SEQ ID NO: 28945

SEQ ID NO: 400536 - RNA, 64 nt, Homo Sapiens; identical to SEQ ID NO: 28946

SEQ ID NO: 400537 - RNA, 64 nt, Homo Sapiens; identical to SEQ ID NO: 28947

SEQ ID NO: 400538 - RNA, 64 nt, Homo Sapiens; identical to SEQ ID NO: 28948

SEQ ID NO: 400539 - RNA, 64 nt, Homo Sapiens; identical to SEQ ID NO: 28949

SEQ ID NO: 400540 - RNA, 64 nt, Homo Sapiens; identical to SEQ ID NO: 28950

SEQ ID NO: 400541 - RNA, 64 nt, Homo Sapiens; identical to SEQ ID NO: 28951

SEQ ID NO: 400542 - RNA, 64 nt, Homo Sapiens; identical to SEQ ID NO: 28952

SEQ ID NO: 400543 - RNA, 64 nt, Homo Sapiens; identical to SEQ ID NO: 28953

SEQ ID NO: 400544 - RNA, 64 nt, Homo Sapiens; identical to SEQ ID NO: 28954

SEQ ID NO: 400545 - RNA, 64 nt, Homo Sapiens; identical to SEQ ID NO: 28955

SEQ ID NO: 400546 - RNA, 64 nt, Homo Sapiens; identical to SEQ ID NO: 28956

SEQ ID NO: 400547 - RNA, 64 nt, Homo Sapiens; identical to SEQ ID NO: 28957

SEQ ID NO: 400548 - RNA, 64 nt, Homo Sapiens; identical to SEQ ID NO: 28958

SEQ ID NO: 400549 - RNA, 64 nt, Homo Sapiens; identical to SEQ ID NO: 28959

SEQ ID NO: 400550 - RNA, 64 nt, Homo Sapiens; identical to SEQ ID NO: 28960

SEQ ID NO: 400551 - RNA, 64 nt, Homo Sapiens; identical to SEQ ID NO: 28961

SEQ ID NO: 400552 - RNA, 64 nt, Homo Sapiens; identical to SEQ ID NO: 28962

SEQ ID NO: 400553 - RNA, 64 nt, Homo Sapiens; identical to SEQ ID NO: 28963

SEQ ID NO: 400554 - RNA, 64 nt, Homo Sapiens; identical to SEQ ID NO: 28964

SEQ ID NO: 400555 - RNA, 64 nt, Homo Sapiens; identical to SEQ ID NO: 28965

SEQ ID NO: 400556 - RNA, 64 nt, Homo Sapiens; identical to SEQ ID NO: 28966

SEQ ID NO: 400557 - RNA, 64 nt, Homo Sapiens; identical to SEQ ID NO: 28967

SEQ ID NO: 400558 - RNA, 64 nt, Homo Sapiens; identical to SEQ ID NO: 28968

SEQ ID NO: 400559 - RNA, 64 nt, Homo Sapiens; identical to SEQ ID NO: 28969

SEQ ID NO: 400560 - RNA, 64 nt, Homo Sapiens; identical to SEQ ID NO: 28970

SEQ ID NO: 400561 - RNA, 64 nt, Homo Sapiens; identical to SEQ ID NO: 28971

SEQ ID NO: 400562 - RNA, 64 nt, Homo Sapiens; identical to SEQ ID NO: 28972

SEQ ID NO: 400563 - RNA, 64 nt, Homo Sapiens; identical to SEQ ID NO: 28973

SEQ ID NO: 400564 - RNA, 64 nt, Homo Sapiens; identical to SEQ ID NO: 28974

SEQ ID NO: 400565 - RNA, 64 nt, Homo Sapiens; identical to SEQ ID NO: 28975

SEQ ID NO: 400566 - RNA, 64 nt, Homo Sapiens; identical to SEQ ID NO: 28976

SEQ ID NO: 400567 - RNA, 64 nt, Homo Sapiens; identical to SEQ ID NO: 28977

SEQ ID NO: 400568 - RNA, 64 nt, Homo Sapiens; identical to SEQ ID NO: 28978

SEQ ID NO: 400569 - RNA, 64 nt, Homo Sapiens; identical to SEQ ID NO: 28979

SEQ ID NO: 400570 - RNA, 64 nt, Homo Sapiens; identical to SEQ ID NO: 28980

SEQ ID NO: 400571 - RNA, 64 nt, Homo Sapiens; identical to SEQ ID NO: 28981

SEQ ID NO: 400572 - RNA, 64 nt, Homo Sapiens; identical to SEQ ID NO: 28982

SEQ ID NO: 400573 - RNA, 64 nt, Homo Sapiens; identical to SEQ ID NO: 28983

SEQ ID NO: 400574 - RNA, 64 nt, Homo Sapiens; identical to SEQ ID NO: 28984

SEQ ID NO: 400575 - RNA, 64 nt, Homo Sapiens; identical to SEQ ID NO: 28985

SEQ ID NO: 400576 - RNA, 64 nt, Homo Sapiens; identical to SEQ ID NO: 28986

SEQ ID NO: 400577 - RNA, 64 nt, Homo Sapiens; identical to SEQ ID NO: 28987

SEQ ID NO: 400578 - RNA, 64 nt, Homo Sapiens; identical to SEQ ID NO: 28988

SEQ ID NO: 400579 - RNA, 64 nt, Homo Sapiens; identical to SEQ ID NO: 28989

SEQ ID NO: 400580 - RNA, 64 nt, Homo Sapiens; identical to SEQ ID NO: 28990

SEQ ID NO: 400581 - RNA, 64 nt, Homo Sapiens; identical to SEQ ID NO: 28991

SEQ ID NO: 400582 - RNA, 64 nt, Homo Sapiens; identical to SEQ ID NO: 28992

SEQ ID NO: 400583 - RNA, 64 nt, Homo Sapiens; identical to SEQ ID NO: 28993

SEQ ID NO: 400584 - RNA, 64 nt, Homo Sapiens; identical to SEQ ID NO: 28994

SEQ ID NO: 400585 - RNA, 64 nt, Homo Sapiens; identical to SEQ ID NO: 28995

SEQ ID NO: 400586 - RNA, 64 nt, Homo Sapiens; identical to SEQ ID NO: 28996

SEQ ID NO: 400587 - RNA, 64 nt, Homo Sapiens; identical to SEQ ID NO: 28997

SEQ ID NO: 400588 - RNA, 64 nt, Homo Sapiens; identical to SEQ ID NO: 28998

SEQ ID NO: 400589 - RNA, 64 nt, Homo Sapiens; identical to SEQ ID NO: 28999

SEQ ID NO: 400590 - RNA, 64 nt, Homo Sapiens; identical to SEQ ID NO: 29000

SEQ ID NO: 400591 - RNA, 64 nt, Homo Sapiens; identical to SEQ ID NO: 29001

SEQ ID NO: 400592 - RNA, 64 nt, Homo Sapiens; identical to SEQ ID NO: 29002

SEQ ID NO: 400593 - RNA, 64 nt, Homo Sapiens; identical to SEQ ID NO: 29003

SEQ ID NO: 400594 - RNA, 64 nt, Homo Sapiens; identical to SEQ ID NO: 29004

SEQ ID NO: 400595 - RNA, 64 nt, Homo Sapiens; identical to SEQ ID NO: 29005

SEQ ID NO: 400596 - RNA, 64 nt, Homo Sapiens; identical to SEQ ID NO: 29006

SEQ ID NO: 400597 - RNA, 64 nt, Homo Sapiens; identical to SEQ ID NO: 29007

SEQ ID NO: 400598 - RNA, 64 nt, Homo Sapiens; identical to SEQ ID NO: 29008

SEQ ID NO: 400599 - RNA, 64 nt, Homo Sapiens; identical to SEQ ID NO: 29009

SEQ ID NO: 400600 - RNA, 64 nt, Homo Sapiens; identical to SEQ ID NO: 29010

SEQ ID NO: 400601 - RNA, 64 nt, Homo Sapiens; identical to SEQ ID NO: 29011

SEQ ID NO: 400602 - RNA, 64 nt, Homo Sapiens; identical to SEQ ID NO: 29012

SEQ ID NO: 400603 - RNA, 64 nt, Homo Sapiens; identical to SEQ ID NO: 29013

SEQ ID NO: 400604 - RNA, 64 nt, Homo Sapiens; identical to SEQ ID NO: 29014

SEQ ID NO: 400605 - RNA, 64 nt, Homo Sapiens; identical to SEQ ID NO: 29015

SEQ ID NO: 400606 - RNA, 64 nt, Homo Sapiens; identical to SEQ ID NO: 29016

SEQ ID NO: 400607 - RNA, 64 nt, Homo Sapiens; identical to SEQ ID NO: 29017

SEQ ID NO: 400608 - RNA, 64 nt, Homo Sapiens; identical to SEQ ID NO: 29018

SEQ ID NO: 400609 - RNA, 64 nt, Homo Sapiens; identical to SEQ ID NO: 29019

SEQ ID NO: 400610 - RNA, 64 nt, Homo Sapiens; identical to SEQ ID NO: 29020

SEQ ID NO: 400611 - RNA, 64 nt, Homo Sapiens; identical to SEQ ID NO: 29021

SEQ ID NO: 400612 - RNA, 64 nt, Homo Sapiens; identical to SEQ ID NO: 29022

SEQ ID NO: 400613 - RNA, 64 nt, Homo Sapiens; identical to SEQ ID NO: 29023

SEQ ID NO: 400614 - RNA, 64 nt, Homo Sapiens; identical to SEQ ID NO: 29024

SEQ ID NO: 400615 - RNA, 64 nt, Homo Sapiens; identical to SEQ ID NO: 29025

SEQ ID NO: 400616 - RNA, 64 nt, Homo Sapiens; identical to SEQ ID NO: 29026

SEQ ID NO: 400617 - RNA, 64 nt, Homo Sapiens; identical to SEQ ID NO: 29027

SEQ ID NO: 400618 - RNA, 64 nt, Homo Sapiens; identical to SEQ ID NO: 29028

SEQ ID NO: 400619 - RNA, 64 nt, Homo Sapiens; identical to SEQ ID NO: 29029

SEQ ID NO: 400620 - RNA, 64 nt, Homo Sapiens; identical to SEQ ID NO: 29030

SEQ ID NO: 400621 - RNA, 64 nt, Homo Sapiens; identical to SEQ ID NO: 29031

SEQ ID NO: 400622 - RNA, 64 nt, Homo Sapiens; identical to SEQ ID NO: 29032

SEQ ID NO: 400623 - RNA, 64 nt, Homo Sapiens; identical to SEQ ID NO: 29033

SEQ ID NO: 400624 - RNA, 64 nt, Homo Sapiens; identical to SEQ ID NO: 29034

SEQ ID NO: 400625 - RNA, 64 nt, Homo Sapiens; identical to SEQ ID NO: 29035

SEQ ID NO: 400626 - RNA, 64 nt, Homo Sapiens; identical to SEQ ID NO: 29036

SEQ ID NO: 400627 - RNA, 64 nt, Homo Sapiens; identical to SEQ ID NO: 29037

SEQ ID NO: 400628 - RNA, 64 nt, Homo Sapiens; identical to SEQ ID NO: 29038

SEQ ID NO: 400629 - RNA, 64 nt, Homo Sapiens; identical to SEQ ID NO: 29039

SEQ ID NO: 400630 - RNA, 64 nt, Homo Sapiens; identical to SEQ ID NO: 29040

SEQ ID NO: 400631 - RNA, 64 nt, Homo Sapiens; identical to SEQ ID NO: 29041

SEQ ID NO: 400632 - RNA, 64 nt, Homo Sapiens; identical to SEQ ID NO: 29042

SEQ ID NO: 400633 - RNA, 64 nt, Homo Sapiens; identical to SEQ ID NO: 29043

SEQ ID NO: 400634 - RNA, 64 nt, Homo Sapiens; identical to SEQ ID NO: 29044

SEQ ID NO: 400635 - RNA, 64 nt, Homo Sapiens; identical to SEQ ID NO: 29045

SEQ ID NO: 400636 - RNA, 64 nt, Homo Sapiens; identical to SEQ ID NO: 29046

SEQ ID NO: 400637 - RNA, 64 nt, Homo Sapiens; identical to SEQ ID NO: 29047

SEQ ID NO: 400638 - RNA, 64 nt, Homo Sapiens; identical to SEQ ID NO: 29048

SEQ ID NO: 400639 - RNA, 64 nt, Homo Sapiens; identical to SEQ ID NO: 29049

SEQ ID NO: 400640 - RNA, 64 nt, Homo Sapiens; identical to SEQ ID NO: 29050

SEQ ID NO: 400641 - RNA, 64 nt, Homo Sapiens; identical to SEQ ID NO: 29051

SEQ ID NO: 400642 - RNA, 64 nt, Homo Sapiens; identical to SEQ ID NO: 29052

SEQ ID NO: 400643 - RNA, 64 nt, Homo Sapiens; identical to SEQ ID NO: 29053

SEQ ID NO: 400644 - RNA, 64 nt, Homo Sapiens; identical to SEQ ID NO: 29054

SEQ ID NO: 400645 - RNA, 64 nt, Homo Sapiens; identical to SEQ ID NO: 29055

SEQ ID NO: 400646 - RNA, 64 nt, Homo Sapiens; identical to SEQ ID NO: 29056

SEQ ID NO: 400647 - RNA, 64 nt, Homo Sapiens; identical to SEQ ID NO: 29057

SEQ ID NO: 400648 - RNA, 64 nt, Homo Sapiens; identical to SEQ ID NO: 29058

SEQ ID NO: 400649 - RNA, 64 nt, Homo Sapiens; identical to SEQ ID NO: 29059

SEQ ID NO: 400650 - RNA, 64 nt, Homo Sapiens; identical to SEQ ID NO: 29060

SEQ ID NO: 400651 - RNA, 64 nt, Homo Sapiens; identical to SEQ ID NO: 29061

SEQ ID NO: 400652 - RNA, 64 nt, Homo Sapiens; identical to SEQ ID NO: 29062

SEQ ID NO: 400653 - RNA, 64 nt, Homo Sapiens; identical to SEQ ID NO: 29063

SEQ ID NO: 400654 - RNA, 64 nt, Homo Sapiens; identical to SEQ ID NO: 29064

SEQ ID NO: 400655 - RNA, 64 nt, Homo Sapiens; identical to SEQ ID NO: 29065

SEQ ID NO: 400656 - RNA, 64 nt, Homo Sapiens; identical to SEQ ID NO: 29066

SEQ ID NO: 400657 - RNA, 64 nt, Homo Sapiens; identical to SEQ ID NO: 29067

SEQ ID NO: 400658 - RNA, 64 nt, Homo Sapiens; identical to SEQ ID NO: 29068

SEQ ID NO: 400659 - RNA, 64 nt, Homo Sapiens; identical to SEQ ID NO: 29069

SEQ ID NO: 400660 - RNA, 64 nt, Homo Sapiens; identical to SEQ ID NO: 29070

SEQ ID NO: 400661 - RNA, 64 nt, Homo Sapiens; identical to SEQ ID NO: 29071

SEQ ID NO: 400662 - RNA, 64 nt, Homo Sapiens; identical to SEQ ID NO: 29072

SEQ ID NO: 400663 - RNA, 64 nt, Homo Sapiens; identical to SEQ ID NO: 29073

SEQ ID NO: 400664 - RNA, 64 nt, Homo Sapiens; identical to SEQ ID NO: 29074

SEQ ID NO: 400665 - RNA, 64 nt, Homo Sapiens; identical to SEQ ID NO: 29075

SEQ ID NO: 400666 - RNA, 64 nt, Homo Sapiens; identical to SEQ ID NO: 29076

SEQ ID NO: 400667 - RNA, 64 nt, Homo Sapiens; identical to SEQ ID NO: 29077

SEQ ID NO: 400668 - RNA, 64 nt, Homo Sapiens; identical to SEQ ID NO: 29078

SEQ ID NO: 400669 - RNA, 64 nt, Homo Sapiens; identical to SEQ ID NO: 29079

SEQ ID NO: 400670 - RNA, 64 nt, Homo Sapiens; identical to SEQ ID NO: 29080

SEQ ID NO: 400671 - RNA, 64 nt, Homo Sapiens; identical to SEQ ID NO: 29081

SEQ ID NO: 400672 - RNA, 64 nt, Homo Sapiens; identical to SEQ ID NO: 29082

SEQ ID NO: 400673 - RNA, 64 nt, Homo Sapiens; identical to SEQ ID NO: 29083

SEQ ID NO: 400674 - RNA, 64 nt, Homo Sapiens; identical to SEQ ID NO: 29084

SEQ ID NO: 400675 - RNA, 64 nt, Homo Sapiens; identical to SEQ ID NO: 29085

SEQ ID NO: 400676 - RNA, 64 nt, Homo Sapiens; identical to SEQ ID NO: 29086

SEQ ID NO: 400677 - RNA, 64 nt, Homo Sapiens; identical to SEQ ID NO: 29087

SEQ ID NO: 400678 - RNA, 64 nt, Homo Sapiens; identical to SEQ ID NO: 29088

SEQ ID NO: 400679 - RNA, 64 nt, Homo Sapiens; identical to SEQ ID NO: 29089

SEQ ID NO: 400680 - RNA, 64 nt, Homo Sapiens; identical to SEQ ID NO: 29090

SEQ ID NO: 400681 - RNA, 64 nt, Homo Sapiens; identical to SEQ ID NO: 29091

SEQ ID NO: 400682 - RNA, 64 nt, Homo Sapiens; identical to SEQ ID NO: 29092

SEQ ID NO: 400683 - RNA, 64 nt, Homo Sapiens; identical to SEQ ID NO: 29093

SEQ ID NO: 400684 - RNA, 64 nt, Homo Sapiens; identical to SEQ ID NO: 29094

SEQ ID NO: 400685 - RNA, 64 nt, Homo Sapiens; identical to SEQ ID NO: 29095

SEQ ID NO: 400686 - RNA, 64 nt, Homo Sapiens; identical to SEQ ID NO: 29096

SEQ ID NO: 400687 - RNA, 64 nt, Homo Sapiens; identical to SEQ ID NO: 29097

SEQ ID NO: 400688 - RNA, 64 nt, Homo Sapiens; identical to SEQ ID NO: 29098

SEQ ID NO: 400689 - RNA, 64 nt, Homo Sapiens; identical to SEQ ID NO: 29099

SEQ ID NO: 400690 - RNA, 64 nt, Homo Sapiens; identical to SEQ ID NO: 29100

SEQ ID NO: 400691 - RNA, 64 nt, Homo Sapiens; identical to SEQ ID NO: 29101

SEQ ID NO: 400692 - RNA, 64 nt, Homo Sapiens; identical to SEQ ID NO: 29102

SEQ ID NO: 400693 - RNA, 64 nt, Homo Sapiens; identical to SEQ ID NO: 29103

SEQ ID NO: 400694 - RNA, 64 nt, Homo Sapiens; identical to SEQ ID NO: 29104

SEQ ID NO: 400695 - RNA, 62 nt, Homo Sapiens; identical to SEQ ID NO: 29105

SEQ ID NO: 400696 - RNA, 63 nt, Homo Sapiens; identical to SEQ ID NO: 29106

SEQ ID NO: 400697 - RNA, 64 nt, Homo Sapiens; identical to SEQ ID NO: 29107

SEQ ID NO: 400698 - RNA, 64 nt, Homo Sapiens; identical to SEQ ID NO: 29108

SEQ ID NO: 400699 - RNA, 64 nt, Homo Sapiens; identical to SEQ ID NO: 29109

SEQ ID NO: 400700 - RNA, 64 nt, Homo Sapiens; identical to SEQ ID NO: 29110

SEQ ID NO: 400701 - RNA, 64 nt, Homo Sapiens; identical to SEQ ID NO: 29111

SEQ ID NO: 400702 - RNA, 64 nt, Homo Sapiens; identical to SEQ ID NO: 29112

SEQ ID NO: 400703 - RNA, 64 nt, Homo Sapiens; identical to SEQ ID NO: 29113

SEQ ID NO: 400704 - RNA, 64 nt, Homo Sapiens; identical to SEQ ID NO: 29114

SEQ ID NO: 400705 - RNA, 64 nt, Homo Sapiens; identical to SEQ ID NO: 29115

SEQ ID NO: 400706 - RNA, 64 nt, Homo Sapiens; identical to SEQ ID NO: 29116

SEQ ID NO: 400707 - RNA, 64 nt, Homo Sapiens; identical to SEQ ID NO: 29117

SEQ ID NO: 400708 - RNA, 64 nt, Homo Sapiens; identical to SEQ ID NO: 29118

SEQ ID NO: 400709 - RNA, 64 nt, Homo Sapiens; identical to SEQ ID NO: 29119

SEQ ID NO: 400710 - RNA, 64 nt, Homo Sapiens; identical to SEQ ID NO: 29120

SEQ ID NO: 400711 - RNA, 64 nt, Homo Sapiens; identical to SEQ ID NO: 29121

SEQ ID NO: 400712 - RNA, 64 nt, Homo Sapiens; identical to SEQ ID NO: 29122

SEQ ID NO: 400713 - RNA, 64 nt, Homo Sapiens; identical to SEQ ID NO: 29123

SEQ ID NO: 400714 - RNA, 64 nt, Homo Sapiens; identical to SEQ ID NO: 29124

SEQ ID NO: 400715 - RNA, 64 nt, Homo Sapiens; identical to SEQ ID NO: 29125

SEQ ID NO: 400716 - RNA, 64 nt, Homo Sapiens; identical to SEQ ID NO: 29126

SEQ ID NO: 400717 - RNA, 64 nt, Homo Sapiens; identical to SEQ ID NO: 29127

SEQ ID NO: 400718 - RNA, 64 nt, Homo Sapiens; identical to SEQ ID NO: 29128

SEQ ID NO: 400719 - RNA, 64 nt, Homo Sapiens; identical to SEQ ID NO: 29129

SEQ ID NO: 400720 - RNA, 64 nt, Homo Sapiens; identical to SEQ ID NO: 29130

SEQ ID NO: 400721 - RNA, 64 nt, Homo Sapiens; identical to SEQ ID NO: 29131

SEQ ID NO: 400722 - RNA, 64 nt, Homo Sapiens; identical to SEQ ID NO: 29132

SEQ ID NO: 400723 - RNA, 64 nt, Homo Sapiens; identical to SEQ ID NO: 29133

SEQ ID NO: 400724 - RNA, 64 nt, Homo Sapiens; identical to SEQ ID NO: 29134

SEQ ID NO: 400725 - RNA, 64 nt, Homo Sapiens; identical to SEQ ID NO: 29135

SEQ ID NO: 400726 - RNA, 64 nt, Homo Sapiens; identical to SEQ ID NO: 29136

SEQ ID NO: 400727 - RNA, 64 nt, Homo Sapiens; identical to SEQ ID NO: 29137

SEQ ID NO: 400728 - RNA, 64 nt, Homo Sapiens; identical to SEQ ID NO: 29138

SEQ ID NO: 400729 - RNA, 64 nt, Homo Sapiens; identical to SEQ ID NO: 29139

SEQ ID NO: 400730 - RNA, 64 nt, Homo Sapiens; identical to SEQ ID NO: 29140

SEQ ID NO: 400731 - RNA, 64 nt, Homo Sapiens; identical to SEQ ID NO: 29141

SEQ ID NO: 400732 - RNA, 64 nt, Homo Sapiens; identical to SEQ ID NO: 29142

SEQ ID NO: 400733 - RNA, 64 nt, Homo Sapiens; identical to SEQ ID NO: 29143

SEQ ID NO: 400734 - RNA, 64 nt, Homo Sapiens; identical to SEQ ID NO: 29144

SEQ ID NO: 400735 - RNA, 64 nt, Homo Sapiens; identical to SEQ ID NO: 29145

SEQ ID NO: 400736 - RNA, 64 nt, Homo Sapiens; identical to SEQ ID NO: 29146

SEQ ID NO: 400737 - RNA, 64 nt, Homo Sapiens; identical to SEQ ID NO: 29147

SEQ ID NO: 400738 - RNA, 64 nt, Homo Sapiens; identical to SEQ ID NO: 29148

SEQ ID NO: 400739 - RNA, 64 nt, Homo Sapiens; identical to SEQ ID NO: 29149

SEQ ID NO: 400740 - RNA, 64 nt, Homo Sapiens; identical to SEQ ID NO: 29150

SEQ ID NO: 400741 - RNA, 64 nt, Homo Sapiens; identical to SEQ ID NO: 29151

SEQ ID NO: 400742 - RNA, 64 nt, Homo Sapiens; identical to SEQ ID NO: 29152

SEQ ID NO: 400743 - RNA, 64 nt, Homo Sapiens; identical to SEQ ID NO: 29153

SEQ ID NO: 400744 - RNA, 64 nt, Homo Sapiens; identical to SEQ ID NO: 29154

SEQ ID NO: 400745 - RNA, 64 nt, Homo Sapiens; identical to SEQ ID NO: 29155

SEQ ID NO: 400746 - RNA, 64 nt, Homo Sapiens; identical to SEQ ID NO: 29156

SEQ ID NO: 400747 - RNA, 64 nt, Homo Sapiens; identical to SEQ ID NO: 29157

SEQ ID NO: 400748 - RNA, 64 nt, Homo Sapiens; identical to SEQ ID NO: 29158

SEQ ID NO: 400749 - RNA, 64 nt, Homo Sapiens; identical to SEQ ID NO: 29159

SEQ ID NO: 400750 - RNA, 64 nt, Homo Sapiens; identical to SEQ ID NO: 29160

SEQ ID NO: 400751 - RNA, 64 nt, Homo Sapiens; identical to SEQ ID NO: 29161

SEQ ID NO: 400752 - RNA, 64 nt, Homo Sapiens; identical to SEQ ID NO: 29162

SEQ ID NO: 400753 - RNA, 64 nt, Homo Sapiens; identical to SEQ ID NO: 29163

SEQ ID NO: 400754 - RNA, 64 nt, Homo Sapiens; identical to SEQ ID NO: 29164

SEQ ID NO: 400755 - RNA, 64 nt, Homo Sapiens; identical to SEQ ID NO: 29165

SEQ ID NO: 400756 - RNA, 64 nt, Homo Sapiens; identical to SEQ ID NO: 29166

SEQ ID NO: 400757 - RNA, 64 nt, Homo Sapiens; identical to SEQ ID NO: 29167

SEQ ID NO: 400758 - RNA, 64 nt, Homo Sapiens; identical to SEQ ID NO: 29168

SEQ ID NO: 400759 - RNA, 64 nt, Homo Sapiens; identical to SEQ ID NO: 29169

SEQ ID NO: 400760 - RNA, 64 nt, Homo Sapiens; identical to SEQ ID NO: 29170

SEQ ID NO: 400761 - RNA, 64 nt, Homo Sapiens; identical to SEQ ID NO: 29171

SEQ ID NO: 400762 - RNA, 64 nt, Homo Sapiens; identical to SEQ ID NO: 29172

SEQ ID NO: 400763 - RNA, 64 nt, Homo Sapiens; identical to SEQ ID NO: 29173

SEQ ID NO: 400764 - RNA, 64 nt, Homo Sapiens; identical to SEQ ID NO: 29174

SEQ ID NO: 400765 - RNA, 64 nt, Homo Sapiens; identical to SEQ ID NO: 29175

SEQ ID NO: 400766 - RNA, 64 nt, Homo Sapiens; identical to SEQ ID NO: 29176

SEQ ID NO: 400767 - RNA, 64 nt, Homo Sapiens; identical to SEQ ID NO: 29177

SEQ ID NO: 400768 - RNA, 64 nt, Homo Sapiens; identical to SEQ ID NO: 29178

SEQ ID NO: 400769 - RNA, 64 nt, Homo Sapiens; identical to SEQ ID NO: 29179

SEQ ID NO: 400770 - RNA, 64 nt, Homo Sapiens; identical to SEQ ID NO: 29180

SEQ ID NO: 400771 - RNA, 64 nt, Homo Sapiens; identical to SEQ ID NO: 29181

SEQ ID NO: 400772 - RNA, 64 nt, Homo Sapiens; identical to SEQ ID NO: 29182

SEQ ID NO: 400773 - RNA, 64 nt, Homo Sapiens; identical to SEQ ID NO: 29183

SEQ ID NO: 400774 - RNA, 64 nt, Homo Sapiens; identical to SEQ ID NO: 29184

SEQ ID NO: 400775 - RNA, 64 nt, Homo Sapiens; identical to SEQ ID NO: 29185

SEQ ID NO: 400776 - RNA, 64 nt, Homo Sapiens; identical to SEQ ID NO: 29186

SEQ ID NO: 400777 - RNA, 64 nt, Homo Sapiens; identical to SEQ ID NO: 29187

SEQ ID NO: 400778 - RNA, 64 nt, Homo Sapiens; identical to SEQ ID NO: 29188

SEQ ID NO: 400779 - RNA, 64 nt, Homo Sapiens; identical to SEQ ID NO: 29189

SEQ ID NO: 400780 - RNA, 64 nt, Homo Sapiens; identical to SEQ ID NO: 29190

SEQ ID NO: 400781 - RNA, 64 nt, Homo Sapiens; identical to SEQ ID NO: 29191

SEQ ID NO: 400782 - RNA, 64 nt, Homo Sapiens; identical to SEQ ID NO: 29192

SEQ ID NO: 400783 - RNA, 64 nt, Homo Sapiens; identical to SEQ ID NO: 29193

SEQ ID NO: 400784 - RNA, 64 nt, Homo Sapiens; identical to SEQ ID NO: 29194

SEQ ID NO: 400785 - RNA, 64 nt, Homo Sapiens; identical to SEQ ID NO: 29195

SEQ ID NO: 400786 - RNA, 64 nt, Homo Sapiens; identical to SEQ ID NO: 29196

SEQ ID NO: 400787 - RNA, 64 nt, Homo Sapiens; identical to SEQ ID NO: 29197

SEQ ID NO: 400788 - RNA, 64 nt, Homo Sapiens; identical to SEQ ID NO: 29198

SEQ ID NO: 400789 - RNA, 64 nt, Homo Sapiens; identical to SEQ ID NO: 29199

SEQ ID NO: 400790 - RNA, 64 nt, Homo Sapiens; identical to SEQ ID NO: 29200

SEQ ID NO: 400791 - RNA, 64 nt, Homo Sapiens; identical to SEQ ID NO: 29201

SEQ ID NO: 400792 - RNA, 64 nt, Homo Sapiens; identical to SEQ ID NO: 29202

SEQ ID NO: 400793 - RNA, 64 nt, Homo Sapiens; identical to SEQ ID NO: 29203

SEQ ID NO: 400794 - RNA, 64 nt, Homo Sapiens; identical to SEQ ID NO: 29204

SEQ ID NO: 400795 - RNA, 64 nt, Homo Sapiens; identical to SEQ ID NO: 29205

SEQ ID NO: 400796 - RNA, 64 nt, Homo Sapiens; identical to SEQ ID NO: 29206

SEQ ID NO: 400797 - RNA, 64 nt, Homo Sapiens; identical to SEQ ID NO: 29207

SEQ ID NO: 400798 - RNA, 64 nt, Homo Sapiens; identical to SEQ ID NO: 29208

SEQ ID NO: 400799 - RNA, 64 nt, Homo Sapiens; identical to SEQ ID NO: 29209

SEQ ID NO: 400800 - RNA, 64 nt, Homo Sapiens; identical to SEQ ID NO: 29210

SEQ ID NO: 400801 - RNA, 64 nt, Homo Sapiens; identical to SEQ ID NO: 29211

SEQ ID NO: 400802 - RNA, 64 nt, Homo Sapiens; identical to SEQ ID NO: 29212

SEQ ID NO: 400803 - RNA, 64 nt, Homo Sapiens; identical to SEQ ID NO: 29213

SEQ ID NO: 400804 - RNA, 64 nt, Homo Sapiens; identical to SEQ ID NO: 29214

SEQ ID NO: 400805 - RNA, 64 nt, Homo Sapiens; identical to SEQ ID NO: 29215

SEQ ID NO: 400806 - RNA, 64 nt, Homo Sapiens; identical to SEQ ID NO: 29216

SEQ ID NO: 400807 - RNA, 64 nt, Homo Sapiens; identical to SEQ ID NO: 29217

SEQ ID NO: 400808 - RNA, 64 nt, Homo Sapiens; identical to SEQ ID NO: 29218

SEQ ID NO: 400809 - RNA, 64 nt, Homo Sapiens; identical to SEQ ID NO: 29219

SEQ ID NO: 400810 - RNA, 64 nt, Homo Sapiens; identical to SEQ ID NO: 29220

SEQ ID NO: 400811 - RNA, 64 nt, Homo Sapiens; identical to SEQ ID NO: 29221

SEQ ID NO: 400812 - RNA, 64 nt, Homo Sapiens; identical to SEQ ID NO: 29222

SEQ ID NO: 400813 - RNA, 64 nt, Homo Sapiens; identical to SEQ ID NO: 29223

SEQ ID NO: 400814 - RNA, 64 nt, Homo Sapiens; identical to SEQ ID NO: 29224

SEQ ID NO: 400815 - RNA, 64 nt, Homo Sapiens; identical to SEQ ID NO: 29225

SEQ ID NO: 400816 - RNA, 64 nt, Homo Sapiens; identical to SEQ ID NO: 29226

SEQ ID NO: 400817 - RNA, 64 nt, Homo Sapiens; identical to SEQ ID NO: 29227

SEQ ID NO: 400818 - RNA, 64 nt, Homo Sapiens; identical to SEQ ID NO: 29228

SEQ ID NO: 400819 - RNA, 64 nt, Homo Sapiens; identical to SEQ ID NO: 29229

SEQ ID NO: 400820 - RNA, 64 nt, Homo Sapiens; identical to SEQ ID NO: 29230

SEQ ID NO: 400821 - RNA, 64 nt, Homo Sapiens; identical to SEQ ID NO: 29231

SEQ ID NO: 400822 - RNA, 64 nt, Homo Sapiens; identical to SEQ ID NO: 29232

SEQ ID NO: 400823 - RNA, 64 nt, Homo Sapiens; identical to SEQ ID NO: 29233

SEQ ID NO: 400824 - RNA, 64 nt, Homo Sapiens; identical to SEQ ID NO: 29234

SEQ ID NO: 400825 - RNA, 64 nt, Homo Sapiens; identical to SEQ ID NO: 29235

SEQ ID NO: 400826 - RNA, 64 nt, Homo Sapiens; identical to SEQ ID NO: 29236

SEQ ID NO: 400827 - RNA, 64 nt, Homo Sapiens; identical to SEQ ID NO: 29237

SEQ ID NO: 400828 - RNA, 64 nt, Homo Sapiens; identical to SEQ ID NO: 29238

SEQ ID NO: 400829 - RNA, 64 nt, Homo Sapiens; identical to SEQ ID NO: 29239

SEQ ID NO: 400830 - RNA, 64 nt, Homo Sapiens; identical to SEQ ID NO: 29240

SEQ ID NO: 400831 - RNA, 64 nt, Homo Sapiens; identical to SEQ ID NO: 29241

SEQ ID NO: 400832 - RNA, 64 nt, Homo Sapiens; identical to SEQ ID NO: 29242

SEQ ID NO: 400833 - RNA, 64 nt, Homo Sapiens; identical to SEQ ID NO: 29243

SEQ ID NO: 400834 - RNA, 64 nt, Homo Sapiens; identical to SEQ ID NO: 29244

SEQ ID NO: 400835 - RNA, 64 nt, Homo Sapiens; identical to SEQ ID NO: 29245

SEQ ID NO: 400836 - RNA, 64 nt, Homo Sapiens; identical to SEQ ID NO: 29246

SEQ ID NO: 400837 - RNA, 64 nt, Homo Sapiens; identical to SEQ ID NO: 29247

SEQ ID NO: 400838 - RNA, 64 nt, Homo Sapiens; identical to SEQ ID NO: 29248

SEQ ID NO: 400839 - RNA, 64 nt, Homo Sapiens; identical to SEQ ID NO: 29249

SEQ ID NO: 400840 - RNA, 64 nt, Homo Sapiens; identical to SEQ ID NO: 29250

SEQ ID NO: 400841 - RNA, 64 nt, Homo Sapiens; identical to SEQ ID NO: 29251

SEQ ID NO: 400842 - RNA, 64 nt, Homo Sapiens; identical to SEQ ID NO: 29252

SEQ ID NO: 400843 - RNA, 64 nt, Homo Sapiens; identical to SEQ ID NO: 29253

SEQ ID NO: 400844 - RNA, 64 nt, Homo Sapiens; identical to SEQ ID NO: 29254

SEQ ID NO: 400845 - RNA, 64 nt, Homo Sapiens; identical to SEQ ID NO: 29255

SEQ ID NO: 400846 - RNA, 64 nt, Homo Sapiens; identical to SEQ ID NO: 29256

SEQ ID NO: 400847 - RNA, 64 nt, Homo Sapiens; identical to SEQ ID NO: 29257

SEQ ID NO: 400848 - RNA, 64 nt, Homo Sapiens; identical to SEQ ID NO: 29258

SEQ ID NO: 400849 - RNA, 64 nt, Homo Sapiens; identical to SEQ ID NO: 29259

SEQ ID NO: 400850 - RNA, 64 nt, Homo Sapiens; identical to SEQ ID NO: 29260

SEQ ID NO: 400851 - RNA, 64 nt, Homo Sapiens; identical to SEQ ID NO: 29261

SEQ ID NO: 400852 - RNA, 64 nt, Homo Sapiens; identical to SEQ ID NO: 29262

SEQ ID NO: 400853 - RNA, 64 nt, Homo Sapiens; identical to SEQ ID NO: 29263

SEQ ID NO: 400854 - RNA, 64 nt, Homo Sapiens; identical to SEQ ID NO: 29264

SEQ ID NO: 400855 - RNA, 64 nt, Homo Sapiens; identical to SEQ ID NO: 29265

SEQ ID NO: 400856 - RNA, 64 nt, Homo Sapiens; identical to SEQ ID NO: 29266

SEQ ID NO: 400857 - RNA, 64 nt, Homo Sapiens; identical to SEQ ID NO: 29267

SEQ ID NO: 400858 - RNA, 64 nt, Homo Sapiens; identical to SEQ ID NO: 29268

SEQ ID NO: 400859 - RNA, 64 nt, Homo Sapiens; identical to SEQ ID NO: 29269

SEQ ID NO: 400860 - RNA, 64 nt, Homo Sapiens; identical to SEQ ID NO: 29270

SEQ ID NO: 400861 - RNA, 64 nt, Homo Sapiens; identical to SEQ ID NO: 29271

SEQ ID NO: 400862 - RNA, 64 nt, Homo Sapiens; identical to SEQ ID NO: 29272

SEQ ID NO: 400863 - RNA, 64 nt, Homo Sapiens; identical to SEQ ID NO: 29273

SEQ ID NO: 400864 - RNA, 64 nt, Homo Sapiens; identical to SEQ ID NO: 29274

SEQ ID NO: 400865 - RNA, 64 nt, Homo Sapiens; identical to SEQ ID NO: 29275

SEQ ID NO: 400866 - RNA, 64 nt, Homo Sapiens; identical to SEQ ID NO: 29276

SEQ ID NO: 400867 - RNA, 64 nt, Homo Sapiens; identical to SEQ ID NO: 29277

SEQ ID NO: 400868 - RNA, 64 nt, Homo Sapiens; identical to SEQ ID NO: 29278

SEQ ID NO: 400869 - RNA, 64 nt, Homo Sapiens; identical to SEQ ID NO: 29279

SEQ ID NO: 400870 - RNA, 64 nt, Homo Sapiens; identical to SEQ ID NO: 29280

SEQ ID NO: 400871 - RNA, 64 nt, Homo Sapiens; identical to SEQ ID NO: 29281

SEQ ID NO: 400872 - RNA, 64 nt, Homo Sapiens; identical to SEQ ID NO: 29282

SEQ ID NO: 400873 - RNA, 64 nt, Homo Sapiens; identical to SEQ ID NO: 29283

SEQ ID NO: 400874 - RNA, 64 nt, Homo Sapiens; identical to SEQ ID NO: 29284

SEQ ID NO: 400875 - RNA, 64 nt, Homo Sapiens; identical to SEQ ID NO: 29285

SEQ ID NO: 400876 - RNA, 64 nt, Homo Sapiens; identical to SEQ ID NO: 29286

SEQ ID NO: 400877 - RNA, 64 nt, Homo Sapiens; identical to SEQ ID NO: 29287

SEQ ID NO: 400878 - RNA, 64 nt, Homo Sapiens; identical to SEQ ID NO: 29288

SEQ ID NO: 400879 - RNA, 64 nt, Homo Sapiens; identical to SEQ ID NO: 29289

SEQ ID NO: 400880 - RNA, 64 nt, Homo Sapiens; identical to SEQ ID NO: 29290

SEQ ID NO: 400881 - RNA, 64 nt, Homo Sapiens; identical to SEQ ID NO: 29291

SEQ ID NO: 400882 - RNA, 64 nt, Homo Sapiens; identical to SEQ ID NO: 29292

SEQ ID NO: 400883 - RNA, 64 nt, Homo Sapiens; identical to SEQ ID NO: 29293

SEQ ID NO: 400884 - RNA, 64 nt, Homo Sapiens; identical to SEQ ID NO: 29294

SEQ ID NO: 400885 - RNA, 64 nt, Homo Sapiens; identical to SEQ ID NO: 29295

SEQ ID NO: 400886 - RNA, 64 nt, Homo Sapiens; identical to SEQ ID NO: 29296

SEQ ID NO: 400887 - RNA, 64 nt, Homo Sapiens; identical to SEQ ID NO: 29297

SEQ ID NO: 400888 - RNA, 64 nt, Homo Sapiens; identical to SEQ ID NO: 29298

SEQ ID NO: 400889 - RNA, 64 nt, Homo Sapiens; identical to SEQ ID NO: 29299

SEQ ID NO: 400890 - RNA, 64 nt, Homo Sapiens; identical to SEQ ID NO: 29300

SEQ ID NO: 400891 - RNA, 64 nt, Homo Sapiens; identical to SEQ ID NO: 29301

SEQ ID NO: 400892 - RNA, 64 nt, Homo Sapiens; identical to SEQ ID NO: 29302

SEQ ID NO: 400893 - RNA, 64 nt, Homo Sapiens; identical to SEQ ID NO: 29303

SEQ ID NO: 400894 - RNA, 64 nt, Homo Sapiens; identical to SEQ ID NO: 29304

SEQ ID NO: 400895 - RNA, 64 nt, Homo Sapiens; identical to SEQ ID NO: 29305

SEQ ID NO: 400896 - RNA, 64 nt, Homo Sapiens; identical to SEQ ID NO: 29306

SEQ ID NO: 400897 - RNA, 64 nt, Homo Sapiens; identical to SEQ ID NO: 29307

SEQ ID NO: 400898 - RNA, 64 nt, Homo Sapiens; identical to SEQ ID NO: 29308

SEQ ID NO: 400899 - RNA, 64 nt, Homo Sapiens; identical to SEQ ID NO: 29309

SEQ ID NO: 400900 - RNA, 64 nt, Homo Sapiens; identical to SEQ ID NO: 29310

SEQ ID NO: 400901 - RNA, 64 nt, Homo Sapiens; identical to SEQ ID NO: 29311

SEQ ID NO: 400902 - RNA, 64 nt, Homo Sapiens; identical to SEQ ID NO: 29312

SEQ ID NO: 400903 - RNA, 64 nt, Homo Sapiens; identical to SEQ ID NO: 29313

SEQ ID NO: 400904 - RNA, 64 nt, Homo Sapiens; identical to SEQ ID NO: 29314

SEQ ID NO: 400905 - RNA, 64 nt, Homo Sapiens; identical to SEQ ID NO: 29315

SEQ ID NO: 400906 - RNA, 64 nt, Homo Sapiens; identical to SEQ ID NO: 29316

SEQ ID NO: 400907 - RNA, 64 nt, Homo Sapiens; identical to SEQ ID NO: 29317

SEQ ID NO: 400908 - RNA, 64 nt, Homo Sapiens; identical to SEQ ID NO: 29318

SEQ ID NO: 400909 - RNA, 64 nt, Homo Sapiens; identical to SEQ ID NO: 29319

SEQ ID NO: 400910 - RNA, 64 nt, Homo Sapiens; identical to SEQ ID NO: 29320

SEQ ID NO: 400911 - RNA, 64 nt, Homo Sapiens; identical to SEQ ID NO: 29321

SEQ ID NO: 400912 - RNA, 64 nt, Homo Sapiens; identical to SEQ ID NO: 29322

SEQ ID NO: 400913 - RNA, 64 nt, Homo Sapiens; identical to SEQ ID NO: 29323

SEQ ID NO: 400914 - RNA, 64 nt, Homo Sapiens; identical to SEQ ID NO: 29324

SEQ ID NO: 400915 - RNA, 64 nt, Homo Sapiens; identical to SEQ ID NO: 29325

SEQ ID NO: 400916 - RNA, 64 nt, Homo Sapiens; identical to SEQ ID NO: 29326

SEQ ID NO: 400917 - RNA, 64 nt, Homo Sapiens; identical to SEQ ID NO: 29327

SEQ ID NO: 400918 - RNA, 64 nt, Homo Sapiens; identical to SEQ ID NO: 29328

SEQ ID NO: 400919 - RNA, 64 nt, Homo Sapiens; identical to SEQ ID NO: 29329

SEQ ID NO: 400920 - RNA, 64 nt, Homo Sapiens; identical to SEQ ID NO: 29330

SEQ ID NO: 400921 - RNA, 64 nt, Homo Sapiens; identical to SEQ ID NO: 29331

SEQ ID NO: 400922 - RNA, 64 nt, Homo Sapiens; identical to SEQ ID NO: 29332

SEQ ID NO: 400923 - RNA, 64 nt, Homo Sapiens; identical to SEQ ID NO: 29333

SEQ ID NO: 400924 - RNA, 64 nt, Homo Sapiens; identical to SEQ ID NO: 29334

SEQ ID NO: 400925 - RNA, 64 nt, Homo Sapiens; identical to SEQ ID NO: 29335

SEQ ID NO: 400926 - RNA, 64 nt, Homo Sapiens; identical to SEQ ID NO: 29336

SEQ ID NO: 400927 - RNA, 64 nt, Homo Sapiens; identical to SEQ ID NO: 29337

SEQ ID NO: 400928 - RNA, 64 nt, Homo Sapiens; identical to SEQ ID NO: 29338

SEQ ID NO: 400929 - RNA, 64 nt, Homo Sapiens; identical to SEQ ID NO: 29339

SEQ ID NO: 400930 - RNA, 64 nt, Homo Sapiens; identical to SEQ ID NO: 29340

SEQ ID NO: 400931 - RNA, 64 nt, Homo Sapiens; identical to SEQ ID NO: 29341

SEQ ID NO: 400932 - RNA, 64 nt, Homo Sapiens; identical to SEQ ID NO: 29342

SEQ ID NO: 400933 - RNA, 64 nt, Homo Sapiens; identical to SEQ ID NO: 29343

SEQ ID NO: 400934 - RNA, 64 nt, Homo Sapiens; identical to SEQ ID NO: 29344

SEQ ID NO: 400935 - RNA, 64 nt, Homo Sapiens; identical to SEQ ID NO: 29345

SEQ ID NO: 400936 - RNA, 64 nt, Homo Sapiens; identical to SEQ ID NO: 29346

SEQ ID NO: 400937 - RNA, 64 nt, Homo Sapiens; identical to SEQ ID NO: 29347

SEQ ID NO: 400938 - RNA, 64 nt, Homo Sapiens; identical to SEQ ID NO: 29348

SEQ ID NO: 400939 - RNA, 64 nt, Homo Sapiens; identical to SEQ ID NO: 29349

SEQ ID NO: 400940 - RNA, 64 nt, Homo Sapiens; identical to SEQ ID NO: 29350

SEQ ID NO: 400941 - RNA, 64 nt, Homo Sapiens; identical to SEQ ID NO: 29351

SEQ ID NO: 400942 - RNA, 64 nt, Homo Sapiens; identical to SEQ ID NO: 29352

SEQ ID NO: 400943 - RNA, 64 nt, Homo Sapiens; identical to SEQ ID NO: 29353

SEQ ID NO: 400944 - RNA, 64 nt, Homo Sapiens; identical to SEQ ID NO: 29354

SEQ ID NO: 400945 - RNA, 64 nt, Homo Sapiens; identical to SEQ ID NO: 29355

SEQ ID NO: 400946 - RNA, 64 nt, Homo Sapiens; identical to SEQ ID NO: 29356

SEQ ID NO: 400947 - RNA, 64 nt, Homo Sapiens; identical to SEQ ID NO: 29357

SEQ ID NO: 400948 - RNA, 64 nt, Homo Sapiens; identical to SEQ ID NO: 29358

SEQ ID NO: 400949 - RNA, 64 nt, Homo Sapiens; identical to SEQ ID NO: 29359

SEQ ID NO: 400950 - RNA, 64 nt, Homo Sapiens; identical to SEQ ID NO: 29360

SEQ ID NO: 400951 - RNA, 64 nt, Homo Sapiens; identical to SEQ ID NO: 29361

SEQ ID NO: 400952 - RNA, 64 nt, Homo Sapiens; identical to SEQ ID NO: 29362

SEQ ID NO: 400953 - RNA, 64 nt, Homo Sapiens; identical to SEQ ID NO: 29363

SEQ ID NO: 400954 - RNA, 64 nt, Homo Sapiens; identical to SEQ ID NO: 29364

SEQ ID NO: 400955 - RNA, 64 nt, Homo Sapiens; identical to SEQ ID NO: 29365

SEQ ID NO: 400956 - RNA, 64 nt, Homo Sapiens; identical to SEQ ID NO: 29366

SEQ ID NO: 400957 - RNA, 64 nt, Homo Sapiens; identical to SEQ ID NO: 29367

SEQ ID NO: 400958 - RNA, 64 nt, Homo Sapiens; identical to SEQ ID NO: 29368

SEQ ID NO: 400959 - RNA, 64 nt, Homo Sapiens; identical to SEQ ID NO: 29369

SEQ ID NO: 400960 - RNA, 64 nt, Homo Sapiens; identical to SEQ ID NO: 29370

SEQ ID NO: 400961 - RNA, 64 nt, Homo Sapiens; identical to SEQ ID NO: 29371

SEQ ID NO: 400962 - RNA, 64 nt, Homo Sapiens; identical to SEQ ID NO: 29372

SEQ ID NO: 400963 - RNA, 64 nt, Homo Sapiens; identical to SEQ ID NO: 29373

SEQ ID NO: 400964 - RNA, 64 nt, Homo Sapiens; identical to SEQ ID NO: 29374

SEQ ID NO: 400965 - RNA, 64 nt, Homo Sapiens; identical to SEQ ID NO: 29375

SEQ ID NO: 400966 - RNA, 64 nt, Homo Sapiens; identical to SEQ ID NO: 29376

SEQ ID NO: 400967 - RNA, 64 nt, Homo Sapiens; identical to SEQ ID NO: 29377

SEQ ID NO: 400968 - RNA, 64 nt, Homo Sapiens; identical to SEQ ID NO: 29378

SEQ ID NO: 400969 - RNA, 64 nt, Homo Sapiens; identical to SEQ ID NO: 29379

SEQ ID NO: 400970 - RNA, 64 nt, Homo Sapiens; identical to SEQ ID NO: 29380

SEQ ID NO: 400971 - RNA, 64 nt, Homo Sapiens; identical to SEQ ID NO: 29381

SEQ ID NO: 400972 - RNA, 64 nt, Homo Sapiens; identical to SEQ ID NO: 29382

SEQ ID NO: 400973 - RNA, 64 nt, Homo Sapiens; identical to SEQ ID NO: 29383

SEQ ID NO: 400974 - RNA, 64 nt, Homo Sapiens; identical to SEQ ID NO: 29384

SEQ ID NO: 400975 - RNA, 64 nt, Homo Sapiens; identical to SEQ ID NO: 29385

SEQ ID NO: 400976 - RNA, 64 nt, Homo Sapiens; identical to SEQ ID NO: 29386

SEQ ID NO: 400977 - RNA, 64 nt, Homo Sapiens; identical to SEQ ID NO: 29387

SEQ ID NO: 400978 - RNA, 64 nt, Homo Sapiens; identical to SEQ ID NO: 29388

SEQ ID NO: 400979 - RNA, 64 nt, Homo Sapiens; identical to SEQ ID NO: 29389

SEQ ID NO: 400980 - RNA, 64 nt, Homo Sapiens; identical to SEQ ID NO: 29390

SEQ ID NO: 400981 - RNA, 64 nt, Homo Sapiens; identical to SEQ ID NO: 29391

SEQ ID NO: 400982 - RNA, 64 nt, Homo Sapiens; identical to SEQ ID NO: 29392

SEQ ID NO: 400983 - RNA, 64 nt, Homo Sapiens; identical to SEQ ID NO: 29393

SEQ ID NO: 400984 - RNA, 64 nt, Homo Sapiens; identical to SEQ ID NO: 29394

SEQ ID NO: 400985 - RNA, 64 nt, Homo Sapiens; identical to SEQ ID NO: 29395

SEQ ID NO: 400986 - RNA, 64 nt, Homo Sapiens; identical to SEQ ID NO: 29396

SEQ ID NO: 400987 - RNA, 64 nt, Homo Sapiens; identical to SEQ ID NO: 29397

SEQ ID NO: 400988 - RNA, 64 nt, Homo Sapiens; identical to SEQ ID NO: 29398

SEQ ID NO: 400989 - RNA, 64 nt, Homo Sapiens; identical to SEQ ID NO: 29399

SEQ ID NO: 400990 - RNA, 64 nt, Homo Sapiens; identical to SEQ ID NO: 29400

SEQ ID NO: 400991 - RNA, 64 nt, Homo Sapiens; identical to SEQ ID NO: 29401

SEQ ID NO: 400992 - RNA, 64 nt, Homo Sapiens; identical to SEQ ID NO: 29402

SEQ ID NO: 400993 - RNA, 64 nt, Homo Sapiens; identical to SEQ ID NO: 29403

SEQ ID NO: 400994 - RNA, 64 nt, Homo Sapiens; identical to SEQ ID NO: 29404

SEQ ID NO: 400995 - RNA, 64 nt, Homo Sapiens; identical to SEQ ID NO: 29405

SEQ ID NO: 400996 - RNA, 64 nt, Homo Sapiens; identical to SEQ ID NO: 29406

SEQ ID NO: 400997 - RNA, 64 nt, Homo Sapiens; identical to SEQ ID NO: 29407

SEQ ID NO: 400998 - RNA, 64 nt, Homo Sapiens; identical to SEQ ID NO: 29408

SEQ ID NO: 400999 - RNA, 64 nt, Homo Sapiens; identical to SEQ ID NO: 29409

SEQ ID NO: 401000 - RNA, 64 nt, Homo Sapiens; identical to SEQ ID NO: 29410

SEQ ID NO: 401001 - RNA, 64 nt, Homo Sapiens; identical to SEQ ID NO: 29411

SEQ ID NO: 401002 - RNA, 64 nt, Homo Sapiens; identical to SEQ ID NO: 29412

SEQ ID NO: 401003 - RNA, 64 nt, Homo Sapiens; identical to SEQ ID NO: 29413

SEQ ID NO: 401004 - RNA, 64 nt, Homo Sapiens; identical to SEQ ID NO: 29414

SEQ ID NO: 401005 - RNA, 64 nt, Homo Sapiens; identical to SEQ ID NO: 29415

SEQ ID NO: 401006 - RNA, 64 nt, Homo Sapiens; identical to SEQ ID NO: 29416

SEQ ID NO: 401007 - RNA, 64 nt, Homo Sapiens; identical to SEQ ID NO: 29417

SEQ ID NO: 401008 - RNA, 64 nt, Homo Sapiens; identical to SEQ ID NO: 29418

SEQ ID NO: 401009 - RNA, 64 nt, Homo Sapiens; identical to SEQ ID NO: 29419

SEQ ID NO: 401010 - RNA, 64 nt, Homo Sapiens; identical to SEQ ID NO: 29420

SEQ ID NO: 401011 - RNA, 64 nt, Homo Sapiens; identical to SEQ ID NO: 29421

SEQ ID NO: 401012 - RNA, 64 nt, Homo Sapiens; identical to SEQ ID NO: 29422

SEQ ID NO: 401013 - RNA, 64 nt, Homo Sapiens; identical to SEQ ID NO: 29423

SEQ ID NO: 401014 - RNA, 64 nt, Homo Sapiens; identical to SEQ ID NO: 29424

SEQ ID NO: 401015 - RNA, 64 nt, Homo Sapiens; identical to SEQ ID NO: 29425

SEQ ID NO: 401016 - RNA, 64 nt, Homo Sapiens; identical to SEQ ID NO: 29426

SEQ ID NO: 401017 - RNA, 64 nt, Homo Sapiens; identical to SEQ ID NO: 29427

SEQ ID NO: 401018 - RNA, 64 nt, Homo Sapiens; identical to SEQ ID NO: 29428

SEQ ID NO: 401019 - RNA, 64 nt, Homo Sapiens; identical to SEQ ID NO: 29429

SEQ ID NO: 401020 - RNA, 64 nt, Homo Sapiens; identical to SEQ ID NO: 29430

SEQ ID NO: 401021 - RNA, 64 nt, Homo Sapiens; identical to SEQ ID NO: 29431

SEQ ID NO: 401022 - RNA, 64 nt, Homo Sapiens; identical to SEQ ID NO: 29432

SEQ ID NO: 401023 - RNA, 64 nt, Homo Sapiens; identical to SEQ ID NO: 29433

SEQ ID NO: 401024 - RNA, 64 nt, Homo Sapiens; identical to SEQ ID NO: 29434

SEQ ID NO: 401025 - RNA, 64 nt, Homo Sapiens; identical to SEQ ID NO: 29435

SEQ ID NO: 401026 - RNA, 64 nt, Homo Sapiens; identical to SEQ ID NO: 29436

SEQ ID NO: 401027 - RNA, 64 nt, Homo Sapiens; identical to SEQ ID NO: 29437

SEQ ID NO: 401028 - RNA, 64 nt, Homo Sapiens; identical to SEQ ID NO: 29438

SEQ ID NO: 401029 - RNA, 64 nt, Homo Sapiens; identical to SEQ ID NO: 29439

SEQ ID NO: 401030 - RNA, 64 nt, Homo Sapiens; identical to SEQ ID NO: 29440

SEQ ID NO: 401031 - RNA, 64 nt, Homo Sapiens; identical to SEQ ID NO: 29441

SEQ ID NO: 401032 - RNA, 64 nt, Homo Sapiens; identical to SEQ ID NO: 29442

SEQ ID NO: 401033 - RNA, 64 nt, Homo Sapiens; identical to SEQ ID NO: 29443

SEQ ID NO: 401034 - RNA, 64 nt, Homo Sapiens; identical to SEQ ID NO: 29444

SEQ ID NO: 401035 - RNA, 64 nt, Homo Sapiens; identical to SEQ ID NO: 29445

SEQ ID NO: 401036 - RNA, 64 nt, Homo Sapiens; identical to SEQ ID NO: 29446

SEQ ID NO: 401037 - RNA, 64 nt, Homo Sapiens; identical to SEQ ID NO: 29447

SEQ ID NO: 401038 - RNA, 64 nt, Homo Sapiens; identical to SEQ ID NO: 29448

SEQ ID NO: 401039 - RNA, 64 nt, Homo Sapiens; identical to SEQ ID NO: 29449

SEQ ID NO: 401040 - RNA, 64 nt, Homo Sapiens; identical to SEQ ID NO: 29450

SEQ ID NO: 401041 - RNA, 64 nt, Homo Sapiens; identical to SEQ ID NO: 29451

SEQ ID NO: 401042 - RNA, 64 nt, Homo Sapiens; identical to SEQ ID NO: 29452

SEQ ID NO: 401043 - RNA, 64 nt, Homo Sapiens; identical to SEQ ID NO: 29453

SEQ ID NO: 401044 - RNA, 64 nt, Homo Sapiens; identical to SEQ ID NO: 29454

SEQ ID NO: 401045 - RNA, 64 nt, Homo Sapiens; identical to SEQ ID NO: 29455

SEQ ID NO: 401046 - RNA, 64 nt, Homo Sapiens; identical to SEQ ID NO: 29456

SEQ ID NO: 401047 - RNA, 64 nt, Homo Sapiens; identical to SEQ ID NO: 29457

SEQ ID NO: 401048 - RNA, 64 nt, Homo Sapiens; identical to SEQ ID NO: 29458

SEQ ID NO: 401049 - RNA, 64 nt, Homo Sapiens; identical to SEQ ID NO: 29459

SEQ ID NO: 401050 - RNA, 64 nt, Homo Sapiens; identical to SEQ ID NO: 29460

SEQ ID NO: 401051 - RNA, 64 nt, Homo Sapiens; identical to SEQ ID NO: 29461

SEQ ID NO: 401052 - RNA, 64 nt, Homo Sapiens; identical to SEQ ID NO: 29462

SEQ ID NO: 401053 - RNA, 64 nt, Homo Sapiens; identical to SEQ ID NO: 29463

SEQ ID NO: 401054 - RNA, 64 nt, Homo Sapiens; identical to SEQ ID NO: 29464

SEQ ID NO: 401055 - RNA, 64 nt, Homo Sapiens; identical to SEQ ID NO: 29465

SEQ ID NO: 401056 - RNA, 64 nt, Homo Sapiens; identical to SEQ ID NO: 29466

SEQ ID NO: 401057 - RNA, 64 nt, Homo Sapiens; identical to SEQ ID NO: 29467

SEQ ID NO: 401058 - RNA, 64 nt, Homo Sapiens; identical to SEQ ID NO: 29468

SEQ ID NO: 401059 - RNA, 64 nt, Homo Sapiens; identical to SEQ ID NO: 29469

SEQ ID NO: 401060 - RNA, 64 nt, Homo Sapiens; identical to SEQ ID NO: 29470

SEQ ID NO: 401061 - RNA, 64 nt, Homo Sapiens; identical to SEQ ID NO: 29471

SEQ ID NO: 401062 - RNA, 64 nt, Homo Sapiens; identical to SEQ ID NO: 29472

SEQ ID NO: 401063 - RNA, 64 nt, Homo Sapiens; identical to SEQ ID NO: 29473

SEQ ID NO: 401064 - RNA, 64 nt, Homo Sapiens; identical to SEQ ID NO: 29474

SEQ ID NO: 401065 - RNA, 64 nt, Homo Sapiens; identical to SEQ ID NO: 29475

SEQ ID NO: 401066 - RNA, 64 nt, Homo Sapiens; identical to SEQ ID NO: 29476

SEQ ID NO: 401067 - RNA, 64 nt, Homo Sapiens; identical to SEQ ID NO: 29477

SEQ ID NO: 401068 - RNA, 64 nt, Homo Sapiens; identical to SEQ ID NO: 29478

SEQ ID NO: 401069 - RNA, 64 nt, Homo Sapiens; identical to SEQ ID NO: 29479

SEQ ID NO: 401070 - RNA, 64 nt, Homo Sapiens; identical to SEQ ID NO: 29480

SEQ ID NO: 401071 - RNA, 64 nt, Homo Sapiens; identical to SEQ ID NO: 29481

SEQ ID NO: 401072 - RNA, 64 nt, Homo Sapiens; identical to SEQ ID NO: 29482

SEQ ID NO: 401073 - RNA, 64 nt, Homo Sapiens; identical to SEQ ID NO: 29483

SEQ ID NO: 401074 - RNA, 64 nt, Homo Sapiens; identical to SEQ ID NO: 29484

SEQ ID NO: 401075 - RNA, 64 nt, Homo Sapiens; identical to SEQ ID NO: 29485

SEQ ID NO: 401076 - RNA, 64 nt, Homo Sapiens; identical to SEQ ID NO: 29486

SEQ ID NO: 401077 - RNA, 64 nt, Homo Sapiens; identical to SEQ ID NO: 29487

SEQ ID NO: 401078 - RNA, 64 nt, Homo Sapiens; identical to SEQ ID NO: 29488

SEQ ID NO: 401079 - RNA, 64 nt, Homo Sapiens; identical to SEQ ID NO: 29489

SEQ ID NO: 401080 - RNA, 64 nt, Homo Sapiens; identical to SEQ ID NO: 29490

SEQ ID NO: 401081 - RNA, 64 nt, Homo Sapiens; identical to SEQ ID NO: 29491

SEQ ID NO: 401082 - RNA, 64 nt, Homo Sapiens; identical to SEQ ID NO: 29492

SEQ ID NO: 401083 - RNA, 64 nt, Homo Sapiens; identical to SEQ ID NO: 29493

SEQ ID NO: 401084 - RNA, 64 nt, Homo Sapiens; identical to SEQ ID NO: 29494

SEQ ID NO: 401085 - RNA, 64 nt, Homo Sapiens; identical to SEQ ID NO: 29495

SEQ ID NO: 401086 - RNA, 64 nt, Homo Sapiens; identical to SEQ ID NO: 29496

SEQ ID NO: 401087 - RNA, 64 nt, Homo Sapiens; identical to SEQ ID NO: 29497

SEQ ID NO: 401088 - RNA, 64 nt, Homo Sapiens; identical to SEQ ID NO: 29498

SEQ ID NO: 401089 - RNA, 64 nt, Homo Sapiens; identical to SEQ ID NO: 29499

SEQ ID NO: 401090 - RNA, 64 nt, Homo Sapiens; identical to SEQ ID NO: 29500

SEQ ID NO: 401091 - RNA, 64 nt, Homo Sapiens; identical to SEQ ID NO: 29501

SEQ ID NO: 401092 - RNA, 64 nt, Homo Sapiens; identical to SEQ ID NO: 29502

SEQ ID NO: 401093 - RNA, 64 nt, Homo Sapiens; identical to SEQ ID NO: 29503

SEQ ID NO: 401094 - RNA, 64 nt, Homo Sapiens; identical to SEQ ID NO: 29504

SEQ ID NO: 401095 - RNA, 64 nt, Homo Sapiens; identical to SEQ ID NO: 29505

SEQ ID NO: 401096 - RNA, 64 nt, Homo Sapiens; identical to SEQ ID NO: 29506

SEQ ID NO: 401097 - RNA, 64 nt, Homo Sapiens; identical to SEQ ID NO: 29507

SEQ ID NO: 401098 - RNA, 64 nt, Homo Sapiens; identical to SEQ ID NO: 29508

SEQ ID NO: 401099 - RNA, 64 nt, Homo Sapiens; identical to SEQ ID NO: 29509

SEQ ID NO: 401100 - RNA, 64 nt, Homo Sapiens; identical to SEQ ID NO: 29510

SEQ ID NO: 401101 - RNA, 64 nt, Homo Sapiens; identical to SEQ ID NO: 29511

SEQ ID NO: 401102 - RNA, 64 nt, Homo Sapiens; identical to SEQ ID NO: 29512

SEQ ID NO: 401103 - RNA, 64 nt, Homo Sapiens; identical to SEQ ID NO: 29513

SEQ ID NO: 401104 - RNA, 54 nt, Homo Sapiens; identical to SEQ ID NO: 29514

SEQ ID NO: 401105 - RNA, 64 nt, Homo Sapiens; identical to SEQ ID NO: 29515

SEQ ID NO: 401106 - RNA, 64 nt, Homo Sapiens; identical to SEQ ID NO: 29516

SEQ ID NO: 401107 - RNA, 64 nt, Homo Sapiens; identical to SEQ ID NO: 29517

SEQ ID NO: 401108 - RNA, 64 nt, Homo Sapiens; identical to SEQ ID NO: 29518

SEQ ID NO: 401109 - RNA, 64 nt, Homo Sapiens; identical to SEQ ID NO: 29519

SEQ ID NO: 401110 - RNA, 64 nt, Homo Sapiens; identical to SEQ ID NO: 29520

SEQ ID NO: 401111 - RNA, 64 nt, Homo Sapiens; identical to SEQ ID NO: 29521

SEQ ID NO: 401112 - RNA, 64 nt, Homo Sapiens; identical to SEQ ID NO: 29522

SEQ ID NO: 401113 - RNA, 64 nt, Homo Sapiens; identical to SEQ ID NO: 29523

SEQ ID NO: 401114 - RNA, 64 nt, Homo Sapiens; identical to SEQ ID NO: 29524

SEQ ID NO: 401115 - RNA, 64 nt, Homo Sapiens; identical to SEQ ID NO: 29525

SEQ ID NO: 401116 - RNA, 64 nt, Homo Sapiens; identical to SEQ ID NO: 29526

SEQ ID NO: 401117 - RNA, 64 nt, Homo Sapiens; identical to SEQ ID NO: 29527

SEQ ID NO: 401118 - RNA, 64 nt, Homo Sapiens; identical to SEQ ID NO: 29528

SEQ ID NO: 401119 - RNA, 64 nt, Homo Sapiens; identical to SEQ ID NO: 29529

SEQ ID NO: 401120 - RNA, 64 nt, Homo Sapiens; identical to SEQ ID NO: 29530

SEQ ID NO: 401121 - RNA, 64 nt, Homo Sapiens; identical to SEQ ID NO: 29531

SEQ ID NO: 401122 - RNA, 64 nt, Homo Sapiens; identical to SEQ ID NO: 29532

SEQ ID NO: 401123 - RNA, 64 nt, Homo Sapiens; identical to SEQ ID NO: 29533

SEQ ID NO: 401124 - RNA, 64 nt, Homo Sapiens; identical to SEQ ID NO: 29534

SEQ ID NO: 401125 - RNA, 64 nt, Homo Sapiens; identical to SEQ ID NO: 29535

SEQ ID NO: 401126 - RNA, 64 nt, Homo Sapiens; identical to SEQ ID NO: 29536

SEQ ID NO: 401127 - RNA, 64 nt, Homo Sapiens; identical to SEQ ID NO: 29537

SEQ ID NO: 401128 - RNA, 64 nt, Homo Sapiens; identical to SEQ ID NO: 29538

SEQ ID NO: 401129 - RNA, 64 nt, Homo Sapiens; identical to SEQ ID NO: 29539

SEQ ID NO: 401130 - RNA, 64 nt, Homo Sapiens; identical to SEQ ID NO: 29540

SEQ ID NO: 401131 - RNA, 64 nt, Homo Sapiens; identical to SEQ ID NO: 29541

SEQ ID NO: 401132 - RNA, 64 nt, Homo Sapiens; identical to SEQ ID NO: 29542

SEQ ID NO: 401133 - RNA, 64 nt, Homo Sapiens; identical to SEQ ID NO: 29543

SEQ ID NO: 401134 - RNA, 64 nt, Homo Sapiens; identical to SEQ ID NO: 29544

SEQ ID NO: 401135 - RNA, 64 nt, Homo Sapiens; identical to SEQ ID NO: 29545

SEQ ID NO: 401136 - RNA, 64 nt, Homo Sapiens; identical to SEQ ID NO: 29546

SEQ ID NO: 401137 - RNA, 64 nt, Homo Sapiens; identical to SEQ ID NO: 29547

SEQ ID NO: 401138 - RNA, 64 nt, Homo Sapiens; identical to SEQ ID NO: 29548

SEQ ID NO: 401139 - RNA, 64 nt, Homo Sapiens; identical to SEQ ID NO: 29549

SEQ ID NO: 401140 - RNA, 64 nt, Homo Sapiens; identical to SEQ ID NO: 29550

SEQ ID NO: 401141 - RNA, 64 nt, Homo Sapiens; identical to SEQ ID NO: 29551

SEQ ID NO: 401142 - RNA, 64 nt, Homo Sapiens; identical to SEQ ID NO: 29552

SEQ ID NO: 401143 - RNA, 64 nt, Homo Sapiens; identical to SEQ ID NO: 29553

SEQ ID NO: 401144 - RNA, 64 nt, Homo Sapiens; identical to SEQ ID NO: 29554

SEQ ID NO: 401145 - RNA, 64 nt, Homo Sapiens; identical to SEQ ID NO: 29555

SEQ ID NO: 401146 - RNA, 64 nt, Homo Sapiens; identical to SEQ ID NO: 29556

SEQ ID NO: 401147 - RNA, 64 nt, Homo Sapiens; identical to SEQ ID NO: 29557

SEQ ID NO: 401148 - RNA, 64 nt, Homo Sapiens; identical to SEQ ID NO: 29558

SEQ ID NO: 401149 - RNA, 64 nt, Homo Sapiens; identical to SEQ ID NO: 29559

SEQ ID NO: 401150 - RNA, 64 nt, Homo Sapiens; identical to SEQ ID NO: 29560

SEQ ID NO: 401151 - RNA, 64 nt, Homo Sapiens; identical to SEQ ID NO: 29561

SEQ ID NO: 401152 - RNA, 64 nt, Homo Sapiens; identical to SEQ ID NO: 29562

SEQ ID NO: 401153 - RNA, 64 nt, Homo Sapiens; identical to SEQ ID NO: 29563

SEQ ID NO: 401154 - RNA, 64 nt, Homo Sapiens; identical to SEQ ID NO: 29564

SEQ ID NO: 401155 - RNA, 64 nt, Homo Sapiens; identical to SEQ ID NO: 29565

SEQ ID NO: 401156 - RNA, 64 nt, Homo Sapiens; identical to SEQ ID NO: 29566

SEQ ID NO: 401157 - RNA, 64 nt, Homo Sapiens; identical to SEQ ID NO: 29567

SEQ ID NO: 401158 - RNA, 64 nt, Homo Sapiens; identical to SEQ ID NO: 29568

SEQ ID NO: 401159 - RNA, 64 nt, Homo Sapiens; identical to SEQ ID NO: 29569

SEQ ID NO: 401160 - RNA, 64 nt, Homo Sapiens; identical to SEQ ID NO: 29570

SEQ ID NO: 401161 - RNA, 64 nt, Homo Sapiens; identical to SEQ ID NO: 29571

SEQ ID NO: 401162 - RNA, 64 nt, Homo Sapiens; identical to SEQ ID NO: 29572

SEQ ID NO: 401163 - RNA, 64 nt, Homo Sapiens; identical to SEQ ID NO: 29573

SEQ ID NO: 401164 - RNA, 64 nt, Homo Sapiens; identical to SEQ ID NO: 29574

SEQ ID NO: 401165 - RNA, 64 nt, Homo Sapiens; identical to SEQ ID NO: 29575

SEQ ID NO: 401166 - RNA, 64 nt, Homo Sapiens; identical to SEQ ID NO: 29576

SEQ ID NO: 401167 - RNA, 64 nt, Homo Sapiens; identical to SEQ ID NO: 29577

SEQ ID NO: 401168 - RNA, 64 nt, Homo Sapiens; identical to SEQ ID NO: 29578

SEQ ID NO: 401169 - RNA, 64 nt, Homo Sapiens; identical to SEQ ID NO: 29579

SEQ ID NO: 401170 - RNA, 64 nt, Homo Sapiens; identical to SEQ ID NO: 29580

SEQ ID NO: 401171 - RNA, 64 nt, Homo Sapiens; identical to SEQ ID NO: 29581

SEQ ID NO: 401172 - RNA, 64 nt, Homo Sapiens; identical to SEQ ID NO: 29582

SEQ ID NO: 401173 - RNA, 64 nt, Homo Sapiens; identical to SEQ ID NO: 29583

SEQ ID NO: 401174 - RNA, 64 nt, Homo Sapiens; identical to SEQ ID NO: 29584

SEQ ID NO: 401175 - RNA, 64 nt, Homo Sapiens; identical to SEQ ID NO: 29585

SEQ ID NO: 401176 - RNA, 64 nt, Homo Sapiens; identical to SEQ ID NO: 29586

SEQ ID NO: 401177 - RNA, 64 nt, Homo Sapiens; identical to SEQ ID NO: 29587

SEQ ID NO: 401178 - RNA, 64 nt, Homo Sapiens; identical to SEQ ID NO: 29588

SEQ ID NO: 401179 - RNA, 64 nt, Homo Sapiens; identical to SEQ ID NO: 29589

SEQ ID NO: 401180 - RNA, 64 nt, Homo Sapiens; identical to SEQ ID NO: 29590

SEQ ID NO: 401181 - RNA, 64 nt, Homo Sapiens; identical to SEQ ID NO: 29591

SEQ ID NO: 401182 - RNA, 64 nt, Homo Sapiens; identical to SEQ ID NO: 29592

SEQ ID NO: 401183 - RNA, 64 nt, Homo Sapiens; identical to SEQ ID NO: 29593

SEQ ID NO: 401184 - RNA, 64 nt, Homo Sapiens; identical to SEQ ID NO: 29594

SEQ ID NO: 401185 - RNA, 64 nt, Homo Sapiens; identical to SEQ ID NO: 29595

SEQ ID NO: 401186 - RNA, 64 nt, Homo Sapiens; identical to SEQ ID NO: 29596

SEQ ID NO: 401187 - RNA, 64 nt, Homo Sapiens; identical to SEQ ID NO: 29597

SEQ ID NO: 401188 - RNA, 64 nt, Homo Sapiens; identical to SEQ ID NO: 29598

SEQ ID NO: 401189 - RNA, 64 nt, Homo Sapiens; identical to SEQ ID NO: 29599

SEQ ID NO: 401190 - RNA, 64 nt, Homo Sapiens; identical to SEQ ID NO: 29600

SEQ ID NO: 401191 - RNA, 64 nt, Homo Sapiens; identical to SEQ ID NO: 29601

SEQ ID NO: 401192 - RNA, 64 nt, Homo Sapiens; identical to SEQ ID NO: 29602

SEQ ID NO: 401193 - RNA, 64 nt, Homo Sapiens; identical to SEQ ID NO: 29603

SEQ ID NO: 401194 - RNA, 64 nt, Homo Sapiens; identical to SEQ ID NO: 29604

SEQ ID NO: 401195 - RNA, 64 nt, Homo Sapiens; identical to SEQ ID NO: 29605

SEQ ID NO: 401196 - RNA, 64 nt, Homo Sapiens; identical to SEQ ID NO: 29606

SEQ ID NO: 401197 - RNA, 64 nt, Homo Sapiens; identical to SEQ ID NO: 29607

SEQ ID NO: 401198 - RNA, 64 nt, Homo Sapiens; identical to SEQ ID NO: 29608

SEQ ID NO: 401199 - RNA, 64 nt, Homo Sapiens; identical to SEQ ID NO: 29609

SEQ ID NO: 401200 - RNA, 64 nt, Homo Sapiens; identical to SEQ ID NO: 29610

SEQ ID NO: 401201 - RNA, 64 nt, Homo Sapiens; identical to SEQ ID NO: 29611

SEQ ID NO: 401202 - RNA, 64 nt, Homo Sapiens; identical to SEQ ID NO: 29612

SEQ ID NO: 401203 - RNA, 64 nt, Homo Sapiens; identical to SEQ ID NO: 29613

SEQ ID NO: 401204 - RNA, 64 nt, Homo Sapiens; identical to SEQ ID NO: 29614

SEQ ID NO: 401205 - RNA, 64 nt, Homo Sapiens; identical to SEQ ID NO: 29615

SEQ ID NO: 401206 - RNA, 64 nt, Homo Sapiens; identical to SEQ ID NO: 29616

SEQ ID NO: 401207 - RNA, 64 nt, Homo Sapiens; identical to SEQ ID NO: 29617

SEQ ID NO: 401208 - RNA, 64 nt, Homo Sapiens; identical to SEQ ID NO: 29618

SEQ ID NO: 401209 - RNA, 64 nt, Homo Sapiens; identical to SEQ ID NO: 29619

SEQ ID NO: 401210 - RNA, 64 nt, Homo Sapiens; identical to SEQ ID NO: 29620

SEQ ID NO: 401211 - RNA, 64 nt, Homo Sapiens; identical to SEQ ID NO: 29621

SEQ ID NO: 401212 - RNA, 64 nt, Homo Sapiens; identical to SEQ ID NO: 29622

SEQ ID NO: 401213 - RNA, 64 nt, Homo Sapiens; identical to SEQ ID NO: 29623

SEQ ID NO: 401214 - RNA, 64 nt, Homo Sapiens; identical to SEQ ID NO: 29624

SEQ ID NO: 401215 - RNA, 64 nt, Homo Sapiens; identical to SEQ ID NO: 29625

SEQ ID NO: 401216 - RNA, 64 nt, Homo Sapiens; identical to SEQ ID NO: 29626

SEQ ID NO: 401217 - RNA, 64 nt, Homo Sapiens; identical to SEQ ID NO: 29627

SEQ ID NO: 401218 - RNA, 64 nt, Homo Sapiens; identical to SEQ ID NO: 29628

SEQ ID NO: 401219 - RNA, 64 nt, Homo Sapiens; identical to SEQ ID NO: 29629

SEQ ID NO: 401220 - RNA, 64 nt, Homo Sapiens; identical to SEQ ID NO: 29630

SEQ ID NO: 401221 - RNA, 64 nt, Homo Sapiens; identical to SEQ ID NO: 29631

SEQ ID NO: 401222 - RNA, 64 nt, Homo Sapiens; identical to SEQ ID NO: 29632

SEQ ID NO: 401223 - RNA, 64 nt, Homo Sapiens; identical to SEQ ID NO: 29633

SEQ ID NO: 401224 - RNA, 64 nt, Homo Sapiens; identical to SEQ ID NO: 29634

SEQ ID NO: 401225 - RNA, 64 nt, Homo Sapiens; identical to SEQ ID NO: 29635

SEQ ID NO: 401226 - RNA, 64 nt, Homo Sapiens; identical to SEQ ID NO: 29636

SEQ ID NO: 401227 - RNA, 64 nt, Homo Sapiens; identical to SEQ ID NO: 29637

SEQ ID NO: 401228 - RNA, 64 nt, Homo Sapiens; identical to SEQ ID NO: 29638

SEQ ID NO: 401229 - RNA, 64 nt, Homo Sapiens; identical to SEQ ID NO: 29639

SEQ ID NO: 401230 - RNA, 64 nt, Homo Sapiens; identical to SEQ ID NO: 29640

SEQ ID NO: 401231 - RNA, 64 nt, Homo Sapiens; identical to SEQ ID NO: 29641

SEQ ID NO: 401232 - RNA, 64 nt, Homo Sapiens; identical to SEQ ID NO: 29642

SEQ ID NO: 401233 - RNA, 64 nt, Homo Sapiens; identical to SEQ ID NO: 29643

SEQ ID NO: 401234 - RNA, 64 nt, Homo Sapiens; identical to SEQ ID NO: 29644

SEQ ID NO: 401235 - RNA, 64 nt, Homo Sapiens; identical to SEQ ID NO: 29645

SEQ ID NO: 401236 - RNA, 64 nt, Homo Sapiens; identical to SEQ ID NO: 29646

SEQ ID NO: 401237 - RNA, 64 nt, Homo Sapiens; identical to SEQ ID NO: 29647

SEQ ID NO: 401238 - RNA, 64 nt, Homo Sapiens; identical to SEQ ID NO: 29648

SEQ ID NO: 401239 - RNA, 64 nt, Homo Sapiens; identical to SEQ ID NO: 29649

SEQ ID NO: 401240 - RNA, 64 nt, Homo Sapiens; identical to SEQ ID NO: 29650

SEQ ID NO: 401241 - RNA, 64 nt, Homo Sapiens; identical to SEQ ID NO: 29651

SEQ ID NO: 401242 - RNA, 64 nt, Homo Sapiens; identical to SEQ ID NO: 29652

SEQ ID NO: 401243 - RNA, 64 nt, Homo Sapiens; identical to SEQ ID NO: 29653

SEQ ID NO: 401244 - RNA, 64 nt, Homo Sapiens; identical to SEQ ID NO: 29654

SEQ ID NO: 401245 - RNA, 64 nt, Homo Sapiens; identical to SEQ ID NO: 29655

SEQ ID NO: 401246 - RNA, 64 nt, Homo Sapiens; identical to SEQ ID NO: 29656

SEQ ID NO: 401247 - RNA, 64 nt, Homo Sapiens; identical to SEQ ID NO: 29657

SEQ ID NO: 401248 - RNA, 64 nt, Homo Sapiens; identical to SEQ ID NO: 29658

SEQ ID NO: 401249 - RNA, 64 nt, Homo Sapiens; identical to SEQ ID NO: 29659

SEQ ID NO: 401250 - RNA, 64 nt, Homo Sapiens; identical to SEQ ID NO: 29660

SEQ ID NO: 401251 - RNA, 64 nt, Homo Sapiens; identical to SEQ ID NO: 29661

SEQ ID NO: 401252 - RNA, 64 nt, Homo Sapiens; identical to SEQ ID NO: 29662

SEQ ID NO: 401253 - RNA, 64 nt, Homo Sapiens; identical to SEQ ID NO: 29663

SEQ ID NO: 401254 - RNA, 64 nt, Homo Sapiens; identical to SEQ ID NO: 29664

SEQ ID NO: 401255 - RNA, 64 nt, Homo Sapiens; identical to SEQ ID NO: 29665

SEQ ID NO: 401256 - RNA, 64 nt, Homo Sapiens; identical to SEQ ID NO: 29666

SEQ ID NO: 401257 - RNA, 64 nt, Homo Sapiens; identical to SEQ ID NO: 29667

SEQ ID NO: 401258 - RNA, 64 nt, Homo Sapiens; identical to SEQ ID NO: 29668

SEQ ID NO: 401259 - RNA, 64 nt, Homo Sapiens; identical to SEQ ID NO: 29669

SEQ ID NO: 401260 - RNA, 64 nt, Homo Sapiens; identical to SEQ ID NO: 29670

SEQ ID NO: 401261 - RNA, 64 nt, Homo Sapiens; identical to SEQ ID NO: 29671

SEQ ID NO: 401262 - RNA, 64 nt, Homo Sapiens; identical to SEQ ID NO: 29672

SEQ ID NO: 401263 - RNA, 64 nt, Homo Sapiens; identical to SEQ ID NO: 29673

SEQ ID NO: 401264 - RNA, 64 nt, Homo Sapiens; identical to SEQ ID NO: 29674

SEQ ID NO: 401265 - RNA, 64 nt, Homo Sapiens; identical to SEQ ID NO: 29675

SEQ ID NO: 401266 - RNA, 64 nt, Homo Sapiens; identical to SEQ ID NO: 29676

SEQ ID NO: 401267 - RNA, 64 nt, Homo Sapiens; identical to SEQ ID NO: 29677

SEQ ID NO: 401268 - RNA, 64 nt, Homo Sapiens; identical to SEQ ID NO: 29678

SEQ ID NO: 401269 - RNA, 64 nt, Homo Sapiens; identical to SEQ ID NO: 29679

SEQ ID NO: 401270 - RNA, 64 nt, Homo Sapiens; identical to SEQ ID NO: 29680

SEQ ID NO: 401271 - RNA, 64 nt, Homo Sapiens; identical to SEQ ID NO: 29681

SEQ ID NO: 401272 - RNA, 64 nt, Homo Sapiens; identical to SEQ ID NO: 29682

SEQ ID NO: 401273 - RNA, 64 nt, Homo Sapiens; identical to SEQ ID NO: 29683

SEQ ID NO: 401274 - RNA, 64 nt, Homo Sapiens; identical to SEQ ID NO: 29684

SEQ ID NO: 401275 - RNA, 64 nt, Homo Sapiens; identical to SEQ ID NO: 29685

SEQ ID NO: 401276 - RNA, 64 nt, Homo Sapiens; identical to SEQ ID NO: 29686

SEQ ID NO: 401277 - RNA, 64 nt, Homo Sapiens; identical to SEQ ID NO: 29687

SEQ ID NO: 401278 - RNA, 64 nt, Homo Sapiens; identical to SEQ ID NO: 29688

SEQ ID NO: 401279 - RNA, 64 nt, Homo Sapiens; identical to SEQ ID NO: 29689

SEQ ID NO: 401280 - RNA, 64 nt, Homo Sapiens; identical to SEQ ID NO: 29690

SEQ ID NO: 401281 - RNA, 64 nt, Homo Sapiens; identical to SEQ ID NO: 29691

SEQ ID NO: 401282 - RNA, 64 nt, Homo Sapiens; identical to SEQ ID NO: 29692

SEQ ID NO: 401283 - RNA, 64 nt, Homo Sapiens; identical to SEQ ID NO: 29693

SEQ ID NO: 401284 - RNA, 64 nt, Homo Sapiens; identical to SEQ ID NO: 29694

SEQ ID NO: 401285 - RNA, 64 nt, Homo Sapiens; identical to SEQ ID NO: 29695

SEQ ID NO: 401286 - RNA, 64 nt, Homo Sapiens; identical to SEQ ID NO: 29696

SEQ ID NO: 401287 - RNA, 64 nt, Homo Sapiens; identical to SEQ ID NO: 29697

SEQ ID NO: 401288 - RNA, 64 nt, Homo Sapiens; identical to SEQ ID NO: 29698

SEQ ID NO: 401289 - RNA, 64 nt, Homo Sapiens; identical to SEQ ID NO: 29699

SEQ ID NO: 401290 - RNA, 64 nt, Homo Sapiens; identical to SEQ ID NO: 29700

SEQ ID NO: 401291 - RNA, 64 nt, Homo Sapiens; identical to SEQ ID NO: 29701

SEQ ID NO: 401292 - RNA, 64 nt, Homo Sapiens; identical to SEQ ID NO: 29702

SEQ ID NO: 401293 - RNA, 64 nt, Homo Sapiens; identical to SEQ ID NO: 29703

SEQ ID NO: 401294 - RNA, 64 nt, Homo Sapiens; identical to SEQ ID NO: 29704

SEQ ID NO: 401295 - RNA, 64 nt, Homo Sapiens; identical to SEQ ID NO: 29705

SEQ ID NO: 401296 - RNA, 64 nt, Homo Sapiens; identical to SEQ ID NO: 29706

SEQ ID NO: 401297 - RNA, 64 nt, Homo Sapiens; identical to SEQ ID NO: 29707

SEQ ID NO: 401298 - RNA, 64 nt, Homo Sapiens; identical to SEQ ID NO: 29708

SEQ ID NO: 401299 - RNA, 64 nt, Homo Sapiens; identical to SEQ ID NO: 29709

SEQ ID NO: 401300 - RNA, 64 nt, Homo Sapiens; identical to SEQ ID NO: 29710

SEQ ID NO: 401301 - RNA, 64 nt, Homo Sapiens; identical to SEQ ID NO: 29711

SEQ ID NO: 401302 - RNA, 64 nt, Homo Sapiens; identical to SEQ ID NO: 29712

SEQ ID NO: 401303 - RNA, 64 nt, Homo Sapiens; identical to SEQ ID NO: 29713

SEQ ID NO: 401304 - RNA, 64 nt, Homo Sapiens; identical to SEQ ID NO: 29714

SEQ ID NO: 401305 - RNA, 64 nt, Homo Sapiens; identical to SEQ ID NO: 29715

SEQ ID NO: 401306 - RNA, 64 nt, Homo Sapiens; identical to SEQ ID NO: 29716

SEQ ID NO: 401307 - RNA, 64 nt, Homo Sapiens; identical to SEQ ID NO: 29717

SEQ ID NO: 401308 - RNA, 64 nt, Homo Sapiens; identical to SEQ ID NO: 29718

SEQ ID NO: 401309 - RNA, 64 nt, Homo Sapiens; identical to SEQ ID NO: 29719

SEQ ID NO: 401310 - RNA, 64 nt, Homo Sapiens; identical to SEQ ID NO: 29720

SEQ ID NO: 401311 - RNA, 64 nt, Homo Sapiens; identical to SEQ ID NO: 29721

SEQ ID NO: 401312 - RNA, 64 nt, Homo Sapiens; identical to SEQ ID NO: 29722

SEQ ID NO: 401313 - RNA, 64 nt, Homo Sapiens; identical to SEQ ID NO: 29723

SEQ ID NO: 401314 - RNA, 64 nt, Homo Sapiens; identical to SEQ ID NO: 29724

SEQ ID NO: 401315 - RNA, 64 nt, Homo Sapiens; identical to SEQ ID NO: 29725

SEQ ID NO: 401316 - RNA, 64 nt, Homo Sapiens; identical to SEQ ID NO: 29726

SEQ ID NO: 401317 - RNA, 64 nt, Homo Sapiens; identical to SEQ ID NO: 29727

SEQ ID NO: 401318 - RNA, 64 nt, Homo Sapiens; identical to SEQ ID NO: 29728

SEQ ID NO: 401319 - RNA, 64 nt, Homo Sapiens; identical to SEQ ID NO: 29729

SEQ ID NO: 401320 - RNA, 64 nt, Homo Sapiens; identical to SEQ ID NO: 29730

SEQ ID NO: 401321 - RNA, 64 nt, Homo Sapiens; identical to SEQ ID NO: 29731

SEQ ID NO: 401322 - RNA, 64 nt, Homo Sapiens; identical to SEQ ID NO: 29732

SEQ ID NO: 401323 - RNA, 64 nt, Homo Sapiens; identical to SEQ ID NO: 29733

SEQ ID NO: 401324 - RNA, 64 nt, Homo Sapiens; identical to SEQ ID NO: 29734

SEQ ID NO: 401325 - RNA, 64 nt, Homo Sapiens; identical to SEQ ID NO: 29735

SEQ ID NO: 401326 - RNA, 64 nt, Homo Sapiens; identical to SEQ ID NO: 29736

SEQ ID NO: 401327 - RNA, 64 nt, Homo Sapiens; identical to SEQ ID NO: 29737

SEQ ID NO: 401328 - RNA, 64 nt, Homo Sapiens; identical to SEQ ID NO: 29738

SEQ ID NO: 401329 - RNA, 64 nt, Homo Sapiens; identical to SEQ ID NO: 29739

SEQ ID NO: 401330 - RNA, 64 nt, Homo Sapiens; identical to SEQ ID NO: 29740

SEQ ID NO: 401331 - RNA, 64 nt, Homo Sapiens; identical to SEQ ID NO: 29741

SEQ ID NO: 401332 - RNA, 64 nt, Homo Sapiens; identical to SEQ ID NO: 29742

SEQ ID NO: 401333 - RNA, 64 nt, Homo Sapiens; identical to SEQ ID NO: 29743

SEQ ID NO: 401334 - RNA, 64 nt, Homo Sapiens; identical to SEQ ID NO: 29744

SEQ ID NO: 401335 - RNA, 64 nt, Homo Sapiens; identical to SEQ ID NO: 29745

SEQ ID NO: 401336 - RNA, 64 nt, Homo Sapiens; identical to SEQ ID NO: 29746

SEQ ID NO: 401337 - RNA, 64 nt, Homo Sapiens; identical to SEQ ID NO: 29747

SEQ ID NO: 401338 - RNA, 64 nt, Homo Sapiens; identical to SEQ ID NO: 29748

SEQ ID NO: 401339 - RNA, 64 nt, Homo Sapiens; identical to SEQ ID NO: 29749

SEQ ID NO: 401340 - RNA, 64 nt, Homo Sapiens; identical to SEQ ID NO: 29750

SEQ ID NO: 401341 - RNA, 64 nt, Homo Sapiens; identical to SEQ ID NO: 29751

SEQ ID NO: 401342 - RNA, 64 nt, Homo Sapiens; identical to SEQ ID NO: 29752

SEQ ID NO: 401343 - RNA, 64 nt, Homo Sapiens; identical to SEQ ID NO: 29753

SEQ ID NO: 401344 - RNA, 64 nt, Homo Sapiens; identical to SEQ ID NO: 29754

SEQ ID NO: 401345 - RNA, 64 nt, Homo Sapiens; identical to SEQ ID NO: 29755

SEQ ID NO: 401346 - RNA, 64 nt, Homo Sapiens; identical to SEQ ID NO: 29756

SEQ ID NO: 401347 - RNA, 64 nt, Homo Sapiens; identical to SEQ ID NO: 29757

SEQ ID NO: 401348 - RNA, 64 nt, Homo Sapiens; identical to SEQ ID NO: 29758

SEQ ID NO: 401349 - RNA, 64 nt, Homo Sapiens; identical to SEQ ID NO: 29759

SEQ ID NO: 401350 - RNA, 64 nt, Homo Sapiens; identical to SEQ ID NO: 29760

SEQ ID NO: 401351 - RNA, 64 nt, Homo Sapiens; identical to SEQ ID NO: 29761

SEQ ID NO: 401352 - RNA, 64 nt, Homo Sapiens; identical to SEQ ID NO: 29762

SEQ ID NO: 401353 - RNA, 64 nt, Homo Sapiens; identical to SEQ ID NO: 29763

SEQ ID NO: 401354 - RNA, 64 nt, Homo Sapiens; identical to SEQ ID NO: 29764

SEQ ID NO: 401355 - RNA, 64 nt, Homo Sapiens; identical to SEQ ID NO: 29765

SEQ ID NO: 401356 - RNA, 64 nt, Homo Sapiens; identical to SEQ ID NO: 29766

SEQ ID NO: 401357 - RNA, 64 nt, Homo Sapiens; identical to SEQ ID NO: 29767

SEQ ID NO: 401358 - RNA, 64 nt, Homo Sapiens; identical to SEQ ID NO: 29768

SEQ ID NO: 401359 - RNA, 64 nt, Homo Sapiens; identical to SEQ ID NO: 29769

SEQ ID NO: 401360 - RNA, 64 nt, Homo Sapiens; identical to SEQ ID NO: 29770

SEQ ID NO: 401361 - RNA, 64 nt, Homo Sapiens; identical to SEQ ID NO: 29771

SEQ ID NO: 401362 - RNA, 64 nt, Homo Sapiens; identical to SEQ ID NO: 29772

SEQ ID NO: 401363 - RNA, 64 nt, Homo Sapiens; identical to SEQ ID NO: 29773

SEQ ID NO: 401364 - RNA, 64 nt, Homo Sapiens; identical to SEQ ID NO: 29774

SEQ ID NO: 401365 - RNA, 64 nt, Homo Sapiens; identical to SEQ ID NO: 29775

SEQ ID NO: 401366 - RNA, 64 nt, Homo Sapiens; identical to SEQ ID NO: 29776

SEQ ID NO: 401367 - RNA, 64 nt, Homo Sapiens; identical to SEQ ID NO: 29777

SEQ ID NO: 401368 - RNA, 64 nt, Homo Sapiens; identical to SEQ ID NO: 29778

SEQ ID NO: 401369 - RNA, 64 nt, Homo Sapiens; identical to SEQ ID NO: 29779

SEQ ID NO: 401370 - RNA, 64 nt, Homo Sapiens; identical to SEQ ID NO: 29780

SEQ ID NO: 401371 - RNA, 64 nt, Homo Sapiens; identical to SEQ ID NO: 29781

SEQ ID NO: 401372 - RNA, 64 nt, Homo Sapiens; identical to SEQ ID NO: 29782

SEQ ID NO: 401373 - RNA, 64 nt, Homo Sapiens; identical to SEQ ID NO: 29783

SEQ ID NO: 401374 - RNA, 64 nt, Homo Sapiens; identical to SEQ ID NO: 29784

SEQ ID NO: 401375 - RNA, 64 nt, Homo Sapiens; identical to SEQ ID NO: 29785

SEQ ID NO: 401376 - RNA, 64 nt, Homo Sapiens; identical to SEQ ID NO: 29786

SEQ ID NO: 401377 - RNA, 64 nt, Homo Sapiens; identical to SEQ ID NO: 29787

SEQ ID NO: 401378 - RNA, 64 nt, Homo Sapiens; identical to SEQ ID NO: 29788

SEQ ID NO: 401379 - RNA, 64 nt, Homo Sapiens; identical to SEQ ID NO: 29789

SEQ ID NO: 401380 - RNA, 64 nt, Homo Sapiens; identical to SEQ ID NO: 29790

SEQ ID NO: 401381 - RNA, 64 nt, Homo Sapiens; identical to SEQ ID NO: 29791

SEQ ID NO: 401382 - RNA, 64 nt, Homo Sapiens; identical to SEQ ID NO: 29792

SEQ ID NO: 401383 - RNA, 64 nt, Homo Sapiens; identical to SEQ ID NO: 29793

SEQ ID NO: 401384 - RNA, 64 nt, Homo Sapiens; identical to SEQ ID NO: 29794

SEQ ID NO: 401385 - RNA, 64 nt, Homo Sapiens; identical to SEQ ID NO: 29795

SEQ ID NO: 401386 - RNA, 64 nt, Homo Sapiens; identical to SEQ ID NO: 29796

SEQ ID NO: 401387 - RNA, 64 nt, Homo Sapiens; identical to SEQ ID NO: 29797

SEQ ID NO: 401388 - RNA, 64 nt, Homo Sapiens; identical to SEQ ID NO: 29798

SEQ ID NO: 401389 - RNA, 64 nt, Homo Sapiens; identical to SEQ ID NO: 29799

SEQ ID NO: 401390 - RNA, 64 nt, Homo Sapiens; identical to SEQ ID NO: 29800

SEQ ID NO: 401391 - RNA, 64 nt, Homo Sapiens; identical to SEQ ID NO: 29801

SEQ ID NO: 401392 - RNA, 64 nt, Homo Sapiens; identical to SEQ ID NO: 29802

SEQ ID NO: 401393 - RNA, 64 nt, Homo Sapiens; identical to SEQ ID NO: 29803

SEQ ID NO: 401394 - RNA, 64 nt, Homo Sapiens; identical to SEQ ID NO: 29804

SEQ ID NO: 401395 - RNA, 64 nt, Homo Sapiens; identical to SEQ ID NO: 29805

SEQ ID NO: 401396 - RNA, 64 nt, Homo Sapiens; identical to SEQ ID NO: 29806

SEQ ID NO: 401397 - RNA, 64 nt, Homo Sapiens; identical to SEQ ID NO: 29807

SEQ ID NO: 401398 - RNA, 64 nt, Homo Sapiens; identical to SEQ ID NO: 29808

SEQ ID NO: 401399 - RNA, 64 nt, Homo Sapiens; identical to SEQ ID NO: 29809

SEQ ID NO: 401400 - RNA, 64 nt, Homo Sapiens; identical to SEQ ID NO: 29810

SEQ ID NO: 401401 - RNA, 64 nt, Homo Sapiens; identical to SEQ ID NO: 29811

SEQ ID NO: 401402 - RNA, 64 nt, Homo Sapiens; identical to SEQ ID NO: 29812

SEQ ID NO: 401403 - RNA, 64 nt, Homo Sapiens; identical to SEQ ID NO: 29813

SEQ ID NO: 401404 - RNA, 64 nt, Homo Sapiens; identical to SEQ ID NO: 29814

SEQ ID NO: 401405 - RNA, 64 nt, Homo Sapiens; identical to SEQ ID NO: 29815

SEQ ID NO: 401406 - RNA, 64 nt, Homo Sapiens; identical to SEQ ID NO: 29816

SEQ ID NO: 401407 - RNA, 64 nt, Homo Sapiens; identical to SEQ ID NO: 29817

SEQ ID NO: 401408 - RNA, 64 nt, Homo Sapiens; identical to SEQ ID NO: 29818

SEQ ID NO: 401409 - RNA, 64 nt, Homo Sapiens; identical to SEQ ID NO: 29819

SEQ ID NO: 401410 - RNA, 64 nt, Homo Sapiens; identical to SEQ ID NO: 29820

SEQ ID NO: 401411 - RNA, 64 nt, Homo Sapiens; identical to SEQ ID NO: 29821

SEQ ID NO: 401412 - RNA, 64 nt, Homo Sapiens; identical to SEQ ID NO: 29822

SEQ ID NO: 401413 - RNA, 64 nt, Homo Sapiens; identical to SEQ ID NO: 29823

SEQ ID NO: 401414 - RNA, 64 nt, Homo Sapiens; identical to SEQ ID NO: 29824

SEQ ID NO: 401415 - RNA, 64 nt, Homo Sapiens; identical to SEQ ID NO: 29825

SEQ ID NO: 401416 - RNA, 64 nt, Homo Sapiens; identical to SEQ ID NO: 29826

SEQ ID NO: 401417 - RNA, 64 nt, Homo Sapiens; identical to SEQ ID NO: 29827

SEQ ID NO: 401418 - RNA, 64 nt, Homo Sapiens; identical to SEQ ID NO: 29828

SEQ ID NO: 401419 - RNA, 64 nt, Homo Sapiens; identical to SEQ ID NO: 29829

SEQ ID NO: 401420 - RNA, 64 nt, Homo Sapiens; identical to SEQ ID NO: 29830

SEQ ID NO: 401421 - RNA, 64 nt, Homo Sapiens; identical to SEQ ID NO: 29831

SEQ ID NO: 401422 - RNA, 64 nt, Homo Sapiens; identical to SEQ ID NO: 29832

SEQ ID NO: 401423 - RNA, 64 nt, Homo Sapiens; identical to SEQ ID NO: 29833

SEQ ID NO: 401424 - RNA, 64 nt, Homo Sapiens; identical to SEQ ID NO: 29834

SEQ ID NO: 401425 - RNA, 64 nt, Homo Sapiens; identical to SEQ ID NO: 29835

SEQ ID NO: 401426 - RNA, 64 nt, Homo Sapiens; identical to SEQ ID NO: 29836

SEQ ID NO: 401427 - RNA, 64 nt, Homo Sapiens; identical to SEQ ID NO: 29837

SEQ ID NO: 401428 - RNA, 64 nt, Homo Sapiens; identical to SEQ ID NO: 29838

SEQ ID NO: 401429 - RNA, 64 nt, Homo Sapiens; identical to SEQ ID NO: 29839

SEQ ID NO: 401430 - RNA, 64 nt, Homo Sapiens; identical to SEQ ID NO: 29840

SEQ ID NO: 401431 - RNA, 64 nt, Homo Sapiens; identical to SEQ ID NO: 29841

SEQ ID NO: 401432 - RNA, 64 nt, Homo Sapiens; identical to SEQ ID NO: 29842

SEQ ID NO: 401433 - RNA, 64 nt, Homo Sapiens; identical to SEQ ID NO: 29843

SEQ ID NO: 401434 - RNA, 64 nt, Homo Sapiens; identical to SEQ ID NO: 29844

SEQ ID NO: 401435 - RNA, 64 nt, Homo Sapiens; identical to SEQ ID NO: 29845

SEQ ID NO: 401436 - RNA, 64 nt, Homo Sapiens; identical to SEQ ID NO: 29846

SEQ ID NO: 401437 - RNA, 64 nt, Homo Sapiens; identical to SEQ ID NO: 29847

SEQ ID NO: 401438 - RNA, 64 nt, Homo Sapiens; identical to SEQ ID NO: 29848

SEQ ID NO: 401439 - RNA, 64 nt, Homo Sapiens; identical to SEQ ID NO: 29849

SEQ ID NO: 401440 - RNA, 64 nt, Homo Sapiens; identical to SEQ ID NO: 29850

SEQ ID NO: 401441 - RNA, 64 nt, Homo Sapiens; identical to SEQ ID NO: 29851

SEQ ID NO: 401442 - RNA, 64 nt, Homo Sapiens; identical to SEQ ID NO: 29852

SEQ ID NO: 401443 - RNA, 64 nt, Homo Sapiens; identical to SEQ ID NO: 29853

SEQ ID NO: 401444 - RNA, 64 nt, Homo Sapiens; identical to SEQ ID NO: 29854

SEQ ID NO: 401445 - RNA, 64 nt, Homo Sapiens; identical to SEQ ID NO: 29855

SEQ ID NO: 401446 - RNA, 64 nt, Homo Sapiens; identical to SEQ ID NO: 29856

SEQ ID NO: 401447 - RNA, 64 nt, Homo Sapiens; identical to SEQ ID NO: 29857

SEQ ID NO: 401448 - RNA, 64 nt, Homo Sapiens; identical to SEQ ID NO: 29858

SEQ ID NO: 401449 - RNA, 64 nt, Homo Sapiens; identical to SEQ ID NO: 29859

SEQ ID NO: 401450 - RNA, 64 nt, Homo Sapiens; identical to SEQ ID NO: 29860

SEQ ID NO: 401451 - RNA, 64 nt, Homo Sapiens; identical to SEQ ID NO: 29861

SEQ ID NO: 401452 - RNA, 64 nt, Homo Sapiens; identical to SEQ ID NO: 29862

SEQ ID NO: 401453 - RNA, 64 nt, Homo Sapiens; identical to SEQ ID NO: 29863

SEQ ID NO: 401454 - RNA, 64 nt, Homo Sapiens; identical to SEQ ID NO: 29864

SEQ ID NO: 401455 - RNA, 64 nt, Homo Sapiens; identical to SEQ ID NO: 29865

SEQ ID NO: 401456 - RNA, 64 nt, Homo Sapiens; identical to SEQ ID NO: 29866

SEQ ID NO: 401457 - RNA, 64 nt, Homo Sapiens; identical to SEQ ID NO: 29867

SEQ ID NO: 401458 - RNA, 64 nt, Homo Sapiens; identical to SEQ ID NO: 29868

SEQ ID NO: 401459 - RNA, 64 nt, Homo Sapiens; identical to SEQ ID NO: 29869

SEQ ID NO: 401460 - RNA, 64 nt, Homo Sapiens; identical to SEQ ID NO: 29870

SEQ ID NO: 401461 - RNA, 64 nt, Homo Sapiens; identical to SEQ ID NO: 29871

SEQ ID NO: 401462 - RNA, 64 nt, Homo Sapiens; identical to SEQ ID NO: 29872

SEQ ID NO: 401463 - RNA, 64 nt, Homo Sapiens; identical to SEQ ID NO: 29873

SEQ ID NO: 401464 - RNA, 64 nt, Homo Sapiens; identical to SEQ ID NO: 29874

SEQ ID NO: 401465 - RNA, 64 nt, Homo Sapiens; identical to SEQ ID NO: 29875

SEQ ID NO: 401466 - RNA, 64 nt, Homo Sapiens; identical to SEQ ID NO: 29876

SEQ ID NO: 401467 - RNA, 64 nt, Homo Sapiens; identical to SEQ ID NO: 29877

SEQ ID NO: 401468 - RNA, 64 nt, Homo Sapiens; identical to SEQ ID NO: 29878

SEQ ID NO: 401469 - RNA, 64 nt, Homo Sapiens; identical to SEQ ID NO: 29879

SEQ ID NO: 401470 - RNA, 64 nt, Homo Sapiens; identical to SEQ ID NO: 29880

SEQ ID NO: 401471 - RNA, 64 nt, Homo Sapiens; identical to SEQ ID NO: 29881

SEQ ID NO: 401472 - RNA, 64 nt, Homo Sapiens; identical to SEQ ID NO: 29882

SEQ ID NO: 401473 - RNA, 64 nt, Homo Sapiens; identical to SEQ ID NO: 29883

SEQ ID NO: 401474 - RNA, 64 nt, Homo Sapiens; identical to SEQ ID NO: 29884

SEQ ID NO: 401475 - RNA, 64 nt, Homo Sapiens; identical to SEQ ID NO: 29885

SEQ ID NO: 401476 - RNA, 64 nt, Homo Sapiens; identical to SEQ ID NO: 29886

SEQ ID NO: 401477 - RNA, 64 nt, Homo Sapiens; identical to SEQ ID NO: 29887

SEQ ID NO: 401478 - RNA, 64 nt, Homo Sapiens; identical to SEQ ID NO: 29888

SEQ ID NO: 401479 - RNA, 64 nt, Homo Sapiens; identical to SEQ ID NO: 29889

SEQ ID NO: 401480 - RNA, 64 nt, Homo Sapiens; identical to SEQ ID NO: 29890

SEQ ID NO: 401481 - RNA, 64 nt, Homo Sapiens; identical to SEQ ID NO: 29891

SEQ ID NO: 401482 - RNA, 64 nt, Homo Sapiens; identical to SEQ ID NO: 29892

SEQ ID NO: 401483 - RNA, 64 nt, Homo Sapiens; identical to SEQ ID NO: 29893

SEQ ID NO: 401484 - RNA, 64 nt, Homo Sapiens; identical to SEQ ID NO: 29894

SEQ ID NO: 401485 - RNA, 64 nt, Homo Sapiens; identical to SEQ ID NO: 29895

SEQ ID NO: 401486 - RNA, 64 nt, Homo Sapiens; identical to SEQ ID NO: 29896

SEQ ID NO: 401487 - RNA, 64 nt, Homo Sapiens; identical to SEQ ID NO: 29897

SEQ ID NO: 401488 - RNA, 64 nt, Homo Sapiens; identical to SEQ ID NO: 29898

SEQ ID NO: 401489 - RNA, 64 nt, Homo Sapiens; identical to SEQ ID NO: 29899

SEQ ID NO: 401490 - RNA, 64 nt, Homo Sapiens; identical to SEQ ID NO: 29900

SEQ ID NO: 401491 - RNA, 64 nt, Homo Sapiens; identical to SEQ ID NO: 29901

SEQ ID NO: 401492 - RNA, 64 nt, Homo Sapiens; identical to SEQ ID NO: 29902

SEQ ID NO: 401493 - RNA, 64 nt, Homo Sapiens; identical to SEQ ID NO: 29903

SEQ ID NO: 401494 - RNA, 64 nt, Homo Sapiens; identical to SEQ ID NO: 29904

SEQ ID NO: 401495 - RNA, 64 nt, Homo Sapiens; identical to SEQ ID NO: 29905

SEQ ID NO: 401496 - RNA, 64 nt, Homo Sapiens; identical to SEQ ID NO: 29906

SEQ ID NO: 401497 - RNA, 64 nt, Homo Sapiens; identical to SEQ ID NO: 29907

SEQ ID NO: 401498 - RNA, 64 nt, Homo Sapiens; identical to SEQ ID NO: 29908

SEQ ID NO: 401499 - RNA, 64 nt, Homo Sapiens; identical to SEQ ID NO: 29909

SEQ ID NO: 401500 - RNA, 64 nt, Homo Sapiens; identical to SEQ ID NO: 29910

SEQ ID NO: 401501 - RNA, 64 nt, Homo Sapiens; identical to SEQ ID NO: 29911

SEQ ID NO: 401502 - RNA, 64 nt, Homo Sapiens; identical to SEQ ID NO: 29912

SEQ ID NO: 401503 - RNA, 64 nt, Homo Sapiens; identical to SEQ ID NO: 29913

SEQ ID NO: 401504 - RNA, 64 nt, Homo Sapiens; identical to SEQ ID NO: 29914

SEQ ID NO: 401505 - RNA, 64 nt, Homo Sapiens; identical to SEQ ID NO: 29915

SEQ ID NO: 401506 - RNA, 64 nt, Homo Sapiens; identical to SEQ ID NO: 29916

SEQ ID NO: 401507 - RNA, 64 nt, Homo Sapiens; identical to SEQ ID NO: 29917

SEQ ID NO: 401508 - RNA, 64 nt, Homo Sapiens; identical to SEQ ID NO: 29918

SEQ ID NO: 401509 - RNA, 64 nt, Homo Sapiens; identical to SEQ ID NO: 29919

SEQ ID NO: 401510 - RNA, 64 nt, Homo Sapiens; identical to SEQ ID NO: 29920

SEQ ID NO: 401511 - RNA, 64 nt, Homo Sapiens; identical to SEQ ID NO: 29921

SEQ ID NO: 401512 - RNA, 64 nt, Homo Sapiens; identical to SEQ ID NO: 29922

SEQ ID NO: 401513 - RNA, 64 nt, Homo Sapiens; identical to SEQ ID NO: 29923

SEQ ID NO: 401514 - RNA, 64 nt, Homo Sapiens; identical to SEQ ID NO: 29924

SEQ ID NO: 401515 - RNA, 64 nt, Homo Sapiens; identical to SEQ ID NO: 29925

SEQ ID NO: 401516 - RNA, 64 nt, Homo Sapiens; identical to SEQ ID NO: 29926

SEQ ID NO: 401517 - RNA, 64 nt, Homo Sapiens; identical to SEQ ID NO: 29927

SEQ ID NO: 401518 - RNA, 64 nt, Homo Sapiens; identical to SEQ ID NO: 29928

SEQ ID NO: 401519 - RNA, 64 nt, Homo Sapiens; identical to SEQ ID NO: 29929

SEQ ID NO: 401520 - RNA, 64 nt, Homo Sapiens; identical to SEQ ID NO: 29930

SEQ ID NO: 401521 - RNA, 64 nt, Homo Sapiens; identical to SEQ ID NO: 29931

SEQ ID NO: 401522 - RNA, 64 nt, Homo Sapiens; identical to SEQ ID NO: 29932

SEQ ID NO: 401523 - RNA, 64 nt, Homo Sapiens; identical to SEQ ID NO: 29933

SEQ ID NO: 401524 - RNA, 64 nt, Homo Sapiens; identical to SEQ ID NO: 29934

SEQ ID NO: 401525 - RNA, 64 nt, Homo Sapiens; identical to SEQ ID NO: 29935

SEQ ID NO: 401526 - RNA, 64 nt, Homo Sapiens; identical to SEQ ID NO: 29936

SEQ ID NO: 401527 - RNA, 64 nt, Homo Sapiens; identical to SEQ ID NO: 29937

SEQ ID NO: 401528 - RNA, 64 nt, Homo Sapiens; identical to SEQ ID NO: 29938

SEQ ID NO: 401529 - RNA, 64 nt, Homo Sapiens; identical to SEQ ID NO: 29939

SEQ ID NO: 401530 - RNA, 64 nt, Homo Sapiens; identical to SEQ ID NO: 29940

SEQ ID NO: 401531 - RNA, 64 nt, Homo Sapiens; identical to SEQ ID NO: 29941

SEQ ID NO: 401532 - RNA, 64 nt, Homo Sapiens; identical to SEQ ID NO: 29942

SEQ ID NO: 401533 - RNA, 64 nt, Homo Sapiens; identical to SEQ ID NO: 29943

SEQ ID NO: 401534 - RNA, 64 nt, Homo Sapiens; identical to SEQ ID NO: 29944

SEQ ID NO: 401535 - RNA, 64 nt, Homo Sapiens; identical to SEQ ID NO: 29945

SEQ ID NO: 401536 - RNA, 64 nt, Homo Sapiens; identical to SEQ ID NO: 29946

SEQ ID NO: 401537 - RNA, 64 nt, Homo Sapiens; identical to SEQ ID NO: 29947

SEQ ID NO: 401538 - RNA, 64 nt, Homo Sapiens; identical to SEQ ID NO: 29948

SEQ ID NO: 401539 - RNA, 64 nt, Homo Sapiens; identical to SEQ ID NO: 29949

SEQ ID NO: 401540 - RNA, 64 nt, Homo Sapiens; identical to SEQ ID NO: 29950

SEQ ID NO: 401541 - RNA, 64 nt, Homo Sapiens; identical to SEQ ID NO: 29951

SEQ ID NO: 401542 - RNA, 64 nt, Homo Sapiens; identical to SEQ ID NO: 29952

SEQ ID NO: 401543 - RNA, 64 nt, Homo Sapiens; identical to SEQ ID NO: 29953

SEQ ID NO: 401544 - RNA, 64 nt, Homo Sapiens; identical to SEQ ID NO: 29954

SEQ ID NO: 401545 - RNA, 64 nt, Homo Sapiens; identical to SEQ ID NO: 29955

SEQ ID NO: 401546 - RNA, 64 nt, Homo Sapiens; identical to SEQ ID NO: 29956

SEQ ID NO: 401547 - RNA, 64 nt, Homo Sapiens; identical to SEQ ID NO: 29957

SEQ ID NO: 401548 - RNA, 64 nt, Homo Sapiens; identical to SEQ ID NO: 29958

SEQ ID NO: 401549 - RNA, 64 nt, Homo Sapiens; identical to SEQ ID NO: 29959

SEQ ID NO: 401550 - RNA, 64 nt, Homo Sapiens; identical to SEQ ID NO: 29960

SEQ ID NO: 401551 - RNA, 64 nt, Homo Sapiens; identical to SEQ ID NO: 29961

SEQ ID NO: 401552 - RNA, 64 nt, Homo Sapiens; identical to SEQ ID NO: 29962

SEQ ID NO: 401553 - RNA, 64 nt, Homo Sapiens; identical to SEQ ID NO: 29963

SEQ ID NO: 401554 - RNA, 64 nt, Homo Sapiens; identical to SEQ ID NO: 29964

SEQ ID NO: 401555 - RNA, 64 nt, Homo Sapiens; identical to SEQ ID NO: 29965

SEQ ID NO: 401556 - RNA, 64 nt, Homo Sapiens; identical to SEQ ID NO: 29966

SEQ ID NO: 401557 - RNA, 64 nt, Homo Sapiens; identical to SEQ ID NO: 29967

SEQ ID NO: 401558 - RNA, 64 nt, Homo Sapiens; identical to SEQ ID NO: 29968

SEQ ID NO: 401559 - RNA, 64 nt, Homo Sapiens; identical to SEQ ID NO: 29969

SEQ ID NO: 401560 - RNA, 64 nt, Homo Sapiens; identical to SEQ ID NO: 29970

SEQ ID NO: 401561 - RNA, 64 nt, Homo Sapiens; identical to SEQ ID NO: 29971

SEQ ID NO: 401562 - RNA, 64 nt, Homo Sapiens; identical to SEQ ID NO: 29972

SEQ ID NO: 401563 - RNA, 64 nt, Homo Sapiens; identical to SEQ ID NO: 29973

SEQ ID NO: 401564 - RNA, 64 nt, Homo Sapiens; identical to SEQ ID NO: 29974

SEQ ID NO: 401565 - RNA, 64 nt, Homo Sapiens; identical to SEQ ID NO: 29975

SEQ ID NO: 401566 - RNA, 64 nt, Homo Sapiens; identical to SEQ ID NO: 29976

SEQ ID NO: 401567 - RNA, 64 nt, Homo Sapiens; identical to SEQ ID NO: 29977

SEQ ID NO: 401568 - RNA, 64 nt, Homo Sapiens; identical to SEQ ID NO: 29978

SEQ ID NO: 401569 - RNA, 64 nt, Homo Sapiens; identical to SEQ ID NO: 29979

SEQ ID NO: 401570 - RNA, 64 nt, Homo Sapiens; identical to SEQ ID NO: 29980

SEQ ID NO: 401571 - RNA, 64 nt, Homo Sapiens; identical to SEQ ID NO: 29981

SEQ ID NO: 401572 - RNA, 64 nt, Homo Sapiens; identical to SEQ ID NO: 29982

SEQ ID NO: 401573 - RNA, 64 nt, Homo Sapiens; identical to SEQ ID NO: 29983

SEQ ID NO: 401574 - RNA, 64 nt, Homo Sapiens; identical to SEQ ID NO: 29984

SEQ ID NO: 401575 - RNA, 64 nt, Homo Sapiens; identical to SEQ ID NO: 29985

SEQ ID NO: 401576 - RNA, 64 nt, Homo Sapiens; identical to SEQ ID NO: 29986

SEQ ID NO: 401577 - RNA, 64 nt, Homo Sapiens; identical to SEQ ID NO: 29987

SEQ ID NO: 401578 - RNA, 64 nt, Homo Sapiens; identical to SEQ ID NO: 29988

SEQ ID NO: 401579 - RNA, 64 nt, Homo Sapiens; identical to SEQ ID NO: 29989

SEQ ID NO: 401580 - RNA, 64 nt, Homo Sapiens; identical to SEQ ID NO: 29990

SEQ ID NO: 401581 - RNA, 64 nt, Homo Sapiens; identical to SEQ ID NO: 29991

SEQ ID NO: 401582 - RNA, 64 nt, Homo Sapiens; identical to SEQ ID NO: 29992

SEQ ID NO: 401583 - RNA, 64 nt, Homo Sapiens; identical to SEQ ID NO: 29993

SEQ ID NO: 401584 - RNA, 64 nt, Homo Sapiens; identical to SEQ ID NO: 29994

SEQ ID NO: 401585 - RNA, 64 nt, Homo Sapiens; identical to SEQ ID NO: 29995

SEQ ID NO: 401586 - RNA, 64 nt, Homo Sapiens; identical to SEQ ID NO: 29996

SEQ ID NO: 401587 - RNA, 64 nt, Homo Sapiens; identical to SEQ ID NO: 29997

SEQ ID NO: 401588 - RNA, 64 nt, Homo Sapiens; identical to SEQ ID NO: 29998

SEQ ID NO: 401589 - RNA, 64 nt, Homo Sapiens; identical to SEQ ID NO: 29999

SEQ ID NO: 401590 - RNA, 64 nt, Homo Sapiens; identical to SEQ ID NO: 30000

SEQ ID NO: 401591 - RNA, 64 nt, Homo Sapiens; identical to SEQ ID NO: 30001

SEQ ID NO: 401592 - RNA, 64 nt, Homo Sapiens; identical to SEQ ID NO: 30002

SEQ ID NO: 401593 - RNA, 64 nt, Homo Sapiens; identical to SEQ ID NO: 30003

SEQ ID NO: 401594 - RNA, 64 nt, Homo Sapiens; identical to SEQ ID NO: 30004

SEQ ID NO: 401595 - RNA, 64 nt, Homo Sapiens; identical to SEQ ID NO: 30005

SEQ ID NO: 401596 - RNA, 64 nt, Homo Sapiens; identical to SEQ ID NO: 30006

SEQ ID NO: 401597 - RNA, 64 nt, Homo Sapiens; identical to SEQ ID NO: 30007

SEQ ID NO: 401598 - RNA, 64 nt, Homo Sapiens; identical to SEQ ID NO: 30008

SEQ ID NO: 401599 - RNA, 64 nt, Homo Sapiens; identical to SEQ ID NO: 30009

SEQ ID NO: 401600 - RNA, 64 nt, Homo Sapiens; identical to SEQ ID NO: 30010

SEQ ID NO: 401601 - RNA, 64 nt, Homo Sapiens; identical to SEQ ID NO: 30011

SEQ ID NO: 401602 - RNA, 64 nt, Homo Sapiens; identical to SEQ ID NO: 30012

SEQ ID NO: 401603 - RNA, 64 nt, Homo Sapiens; identical to SEQ ID NO: 30013

SEQ ID NO: 401604 - RNA, 64 nt, Homo Sapiens; identical to SEQ ID NO: 30014

SEQ ID NO: 401605 - RNA, 64 nt, Homo Sapiens; identical to SEQ ID NO: 30015

SEQ ID NO: 401606 - RNA, 64 nt, Homo Sapiens; identical to SEQ ID NO: 30016

SEQ ID NO: 401607 - RNA, 64 nt, Homo Sapiens; identical to SEQ ID NO: 30017

SEQ ID NO: 401608 - RNA, 64 nt, Homo Sapiens; identical to SEQ ID NO: 30018

SEQ ID NO: 401609 - RNA, 64 nt, Homo Sapiens; identical to SEQ ID NO: 30019

SEQ ID NO: 401610 - RNA, 64 nt, Homo Sapiens; identical to SEQ ID NO: 30020

SEQ ID NO: 401611 - RNA, 64 nt, Homo Sapiens; identical to SEQ ID NO: 30021

SEQ ID NO: 401612 - RNA, 64 nt, Homo Sapiens; identical to SEQ ID NO: 30022

SEQ ID NO: 401613 - RNA, 64 nt, Homo Sapiens; identical to SEQ ID NO: 30023

SEQ ID NO: 401614 - RNA, 64 nt, Homo Sapiens; identical to SEQ ID NO: 30024

SEQ ID NO: 401615 - RNA, 64 nt, Homo Sapiens; identical to SEQ ID NO: 30025

SEQ ID NO: 401616 - RNA, 64 nt, Homo Sapiens; identical to SEQ ID NO: 30026

SEQ ID NO: 401617 - RNA, 64 nt, Homo Sapiens; identical to SEQ ID NO: 30027

SEQ ID NO: 401618 - RNA, 64 nt, Homo Sapiens; identical to SEQ ID NO: 30028

SEQ ID NO: 401619 - RNA, 64 nt, Homo Sapiens; identical to SEQ ID NO: 30029

SEQ ID NO: 401620 - RNA, 64 nt, Homo Sapiens; identical to SEQ ID NO: 30030

SEQ ID NO: 401621 - RNA, 64 nt, Homo Sapiens; identical to SEQ ID NO: 30031

SEQ ID NO: 401622 - RNA, 64 nt, Homo Sapiens; identical to SEQ ID NO: 30032

SEQ ID NO: 401623 - RNA, 64 nt, Homo Sapiens; identical to SEQ ID NO: 30033

SEQ ID NO: 401624 - RNA, 64 nt, Homo Sapiens; identical to SEQ ID NO: 30034

SEQ ID NO: 401625 - RNA, 64 nt, Homo Sapiens; identical to SEQ ID NO: 30035

SEQ ID NO: 401626 - RNA, 64 nt, Homo Sapiens; identical to SEQ ID NO: 30036

SEQ ID NO: 401627 - RNA, 64 nt, Homo Sapiens; identical to SEQ ID NO: 30037

SEQ ID NO: 401628 - RNA, 64 nt, Homo Sapiens; identical to SEQ ID NO: 30038

SEQ ID NO: 401629 - RNA, 64 nt, Homo Sapiens; identical to SEQ ID NO: 30039

SEQ ID NO: 401630 - RNA, 64 nt, Homo Sapiens; identical to SEQ ID NO: 30040

SEQ ID NO: 401631 - RNA, 64 nt, Homo Sapiens; identical to SEQ ID NO: 30041

SEQ ID NO: 401632 - RNA, 64 nt, Homo Sapiens; identical to SEQ ID NO: 30042

SEQ ID NO: 401633 - RNA, 64 nt, Homo Sapiens; identical to SEQ ID NO: 30043

SEQ ID NO: 401634 - RNA, 64 nt, Homo Sapiens; identical to SEQ ID NO: 30044

SEQ ID NO: 401635 - RNA, 64 nt, Homo Sapiens; identical to SEQ ID NO: 30045

SEQ ID NO: 401636 - RNA, 64 nt, Homo Sapiens; identical to SEQ ID NO: 30046

SEQ ID NO: 401637 - RNA, 64 nt, Homo Sapiens; identical to SEQ ID NO: 30047

SEQ ID NO: 401638 - RNA, 64 nt, Homo Sapiens; identical to SEQ ID NO: 30048

SEQ ID NO: 401639 - RNA, 64 nt, Homo Sapiens; identical to SEQ ID NO: 30049

SEQ ID NO: 401640 - RNA, 64 nt, Homo Sapiens; identical to SEQ ID NO: 30050

SEQ ID NO: 401641 - RNA, 64 nt, Homo Sapiens; identical to SEQ ID NO: 30051

SEQ ID NO: 401642 - RNA, 64 nt, Homo Sapiens; identical to SEQ ID NO: 30052

SEQ ID NO: 401643 - RNA, 64 nt, Homo Sapiens; identical to SEQ ID NO: 30053

SEQ ID NO: 401644 - RNA, 64 nt, Homo Sapiens; identical to SEQ ID NO: 30054

SEQ ID NO: 401645 - RNA, 64 nt, Homo Sapiens; identical to SEQ ID NO: 30055

SEQ ID NO: 401646 - RNA, 64 nt, Homo Sapiens; identical to SEQ ID NO: 30056

SEQ ID NO: 401647 - RNA, 64 nt, Homo Sapiens; identical to SEQ ID NO: 30057

SEQ ID NO: 401648 - RNA, 64 nt, Homo Sapiens; identical to SEQ ID NO: 30058

SEQ ID NO: 401649 - RNA, 64 nt, Homo Sapiens; identical to SEQ ID NO: 30059

SEQ ID NO: 401650 - RNA, 64 nt, Homo Sapiens; identical to SEQ ID NO: 30060

SEQ ID NO: 401651 - RNA, 64 nt, Homo Sapiens; identical to SEQ ID NO: 30061

SEQ ID NO: 401652 - RNA, 64 nt, Homo Sapiens; identical to SEQ ID NO: 30062

SEQ ID NO: 401653 - RNA, 64 nt, Homo Sapiens; identical to SEQ ID NO: 30063

SEQ ID NO: 401654 - RNA, 64 nt, Homo Sapiens; identical to SEQ ID NO: 30064

SEQ ID NO: 401655 - RNA, 64 nt, Homo Sapiens; identical to SEQ ID NO: 30065

SEQ ID NO: 401656 - RNA, 64 nt, Homo Sapiens; identical to SEQ ID NO: 30066

SEQ ID NO: 401657 - RNA, 64 nt, Homo Sapiens; identical to SEQ ID NO: 30067

SEQ ID NO: 401658 - RNA, 64 nt, Homo Sapiens; identical to SEQ ID NO: 30068

SEQ ID NO: 401659 - RNA, 64 nt, Homo Sapiens; identical to SEQ ID NO: 30069

SEQ ID NO: 401660 - RNA, 64 nt, Homo Sapiens; identical to SEQ ID NO: 30070

SEQ ID NO: 401661 - RNA, 64 nt, Homo Sapiens; identical to SEQ ID NO: 30071

SEQ ID NO: 401662 - RNA, 64 nt, Homo Sapiens; identical to SEQ ID NO: 30072

SEQ ID NO: 401663 - RNA, 64 nt, Homo Sapiens; identical to SEQ ID NO: 30073

SEQ ID NO: 401664 - RNA, 64 nt, Homo Sapiens; identical to SEQ ID NO: 30074

SEQ ID NO: 401665 - RNA, 64 nt, Homo Sapiens; identical to SEQ ID NO: 30075

SEQ ID NO: 401666 - RNA, 64 nt, Homo Sapiens; identical to SEQ ID NO: 30076

SEQ ID NO: 401667 - RNA, 64 nt, Homo Sapiens; identical to SEQ ID NO: 30077

SEQ ID NO: 401668 - RNA, 64 nt, Homo Sapiens; identical to SEQ ID NO: 30078

SEQ ID NO: 401669 - RNA, 64 nt, Homo Sapiens; identical to SEQ ID NO: 30079

SEQ ID NO: 401670 - RNA, 64 nt, Homo Sapiens; identical to SEQ ID NO: 30080

SEQ ID NO: 401671 - RNA, 64 nt, Homo Sapiens; identical to SEQ ID NO: 30081

SEQ ID NO: 401672 - RNA, 64 nt, Homo Sapiens; identical to SEQ ID NO: 30082

SEQ ID NO: 401673 - RNA, 64 nt, Homo Sapiens; identical to SEQ ID NO: 30083

SEQ ID NO: 401674 - RNA, 64 nt, Homo Sapiens; identical to SEQ ID NO: 30084

SEQ ID NO: 401675 - RNA, 64 nt, Homo Sapiens; identical to SEQ ID NO: 30085

SEQ ID NO: 401676 - RNA, 64 nt, Homo Sapiens; identical to SEQ ID NO: 30086

SEQ ID NO: 401677 - RNA, 64 nt, Homo Sapiens; identical to SEQ ID NO: 30087

SEQ ID NO: 401678 - RNA, 64 nt, Homo Sapiens; identical to SEQ ID NO: 30088

SEQ ID NO: 401679 - RNA, 64 nt, Homo Sapiens; identical to SEQ ID NO: 30089

SEQ ID NO: 401680 - RNA, 64 nt, Homo Sapiens; identical to SEQ ID NO: 30090

SEQ ID NO: 401681 - RNA, 64 nt, Homo Sapiens; identical to SEQ ID NO: 30091

SEQ ID NO: 401682 - RNA, 64 nt, Homo Sapiens; identical to SEQ ID NO: 30092

SEQ ID NO: 401683 - RNA, 64 nt, Homo Sapiens; identical to SEQ ID NO: 30093

SEQ ID NO: 401684 - RNA, 64 nt, Homo Sapiens; identical to SEQ ID NO: 30094

SEQ ID NO: 401685 - RNA, 64 nt, Homo Sapiens; identical to SEQ ID NO: 30095

SEQ ID NO: 401686 - RNA, 64 nt, Homo Sapiens; identical to SEQ ID NO: 30096

SEQ ID NO: 401687 - RNA, 64 nt, Homo Sapiens; identical to SEQ ID NO: 30097

SEQ ID NO: 401688 - RNA, 64 nt, Homo Sapiens; identical to SEQ ID NO: 30098

SEQ ID NO: 401689 - RNA, 64 nt, Homo Sapiens; identical to SEQ ID NO: 30099

SEQ ID NO: 401690 - RNA, 64 nt, Homo Sapiens; identical to SEQ ID NO: 30100

SEQ ID NO: 401691 - RNA, 64 nt, Homo Sapiens; identical to SEQ ID NO: 30101

SEQ ID NO: 401692 - RNA, 64 nt, Homo Sapiens; identical to SEQ ID NO: 30102

SEQ ID NO: 401693 - RNA, 64 nt, Homo Sapiens; identical to SEQ ID NO: 30103

SEQ ID NO: 401694 - RNA, 64 nt, Homo Sapiens; identical to SEQ ID NO: 30104

SEQ ID NO: 401695 - RNA, 64 nt, Homo Sapiens; identical to SEQ ID NO: 30105

SEQ ID NO: 401696 - RNA, 64 nt, Homo Sapiens; identical to SEQ ID NO: 30106

SEQ ID NO: 401697 - RNA, 64 nt, Homo Sapiens; identical to SEQ ID NO: 30107

SEQ ID NO: 401698 - RNA, 64 nt, Homo Sapiens; identical to SEQ ID NO: 30108

SEQ ID NO: 401699 - RNA, 64 nt, Homo Sapiens; identical to SEQ ID NO: 30109

SEQ ID NO: 401700 - RNA, 64 nt, Homo Sapiens; identical to SEQ ID NO: 30110

SEQ ID NO: 401701 - RNA, 64 nt, Homo Sapiens; identical to SEQ ID NO: 30111

SEQ ID NO: 401702 - RNA, 64 nt, Homo Sapiens; identical to SEQ ID NO: 30112

SEQ ID NO: 401703 - RNA, 64 nt, Homo Sapiens; identical to SEQ ID NO: 30113

SEQ ID NO: 401704 - RNA, 64 nt, Homo Sapiens; identical to SEQ ID NO: 30114

SEQ ID NO: 401705 - RNA, 52 nt, Homo Sapiens; identical to SEQ ID NO: 30115

SEQ ID NO: 401706 - RNA, 64 nt, Homo Sapiens; identical to SEQ ID NO: 30116

SEQ ID NO: 401707 - RNA, 64 nt, Homo Sapiens; identical to SEQ ID NO: 30117

SEQ ID NO: 401708 - RNA, 64 nt, Homo Sapiens; identical to SEQ ID NO: 30118

SEQ ID NO: 401709 - RNA, 64 nt, Homo Sapiens; identical to SEQ ID NO: 30119

SEQ ID NO: 401710 - RNA, 64 nt, Homo Sapiens; identical to SEQ ID NO: 30120

SEQ ID NO: 401711 - RNA, 64 nt, Homo Sapiens; identical to SEQ ID NO: 30121

SEQ ID NO: 401712 - RNA, 64 nt, Homo Sapiens; identical to SEQ ID NO: 30122

SEQ ID NO: 401713 - RNA, 64 nt, Homo Sapiens; identical to SEQ ID NO: 30123

SEQ ID NO: 401714 - RNA, 64 nt, Homo Sapiens; identical to SEQ ID NO: 30124

SEQ ID NO: 401715 - RNA, 64 nt, Homo Sapiens; identical to SEQ ID NO: 30125

SEQ ID NO: 401716 - RNA, 64 nt, Homo Sapiens; identical to SEQ ID NO: 30126

SEQ ID NO: 401717 - RNA, 64 nt, Homo Sapiens; identical to SEQ ID NO: 30127

SEQ ID NO: 401718 - RNA, 64 nt, Homo Sapiens; identical to SEQ ID NO: 30128

SEQ ID NO: 401719 - RNA, 64 nt, Homo Sapiens; identical to SEQ ID NO: 30129

SEQ ID NO: 401720 - RNA, 64 nt, Homo Sapiens; identical to SEQ ID NO: 30130

SEQ ID NO: 401721 - RNA, 64 nt, Homo Sapiens; identical to SEQ ID NO: 30131

SEQ ID NO: 401722 - RNA, 64 nt, Homo Sapiens; identical to SEQ ID NO: 30132

SEQ ID NO: 401723 - RNA, 64 nt, Homo Sapiens; identical to SEQ ID NO: 30133

SEQ ID NO: 401724 - RNA, 64 nt, Homo Sapiens; identical to SEQ ID NO: 30134

SEQ ID NO: 401725 - RNA, 64 nt, Homo Sapiens; identical to SEQ ID NO: 30135

SEQ ID NO: 401726 - RNA, 64 nt, Homo Sapiens; identical to SEQ ID NO: 30136

SEQ ID NO: 401727 - RNA, 64 nt, Homo Sapiens; identical to SEQ ID NO: 30137

SEQ ID NO: 401728 - RNA, 64 nt, Homo Sapiens; identical to SEQ ID NO: 30138

SEQ ID NO: 401729 - RNA, 64 nt, Homo Sapiens; identical to SEQ ID NO: 30139

SEQ ID NO: 401730 - RNA, 64 nt, Homo Sapiens; identical to SEQ ID NO: 30140

SEQ ID NO: 401731 - RNA, 64 nt, Homo Sapiens; identical to SEQ ID NO: 30141

SEQ ID NO: 401732 - RNA, 64 nt, Homo Sapiens; identical to SEQ ID NO: 30142

SEQ ID NO: 401733 - RNA, 64 nt, Homo Sapiens; identical to SEQ ID NO: 30143

SEQ ID NO: 401734 - RNA, 64 nt, Homo Sapiens; identical to SEQ ID NO: 30144

SEQ ID NO: 401735 - RNA, 64 nt, Homo Sapiens; identical to SEQ ID NO: 30145

SEQ ID NO: 401736 - RNA, 64 nt, Homo Sapiens; identical to SEQ ID NO: 30146

SEQ ID NO: 401737 - RNA, 64 nt, Homo Sapiens; identical to SEQ ID NO: 30147

SEQ ID NO: 401738 - RNA, 64 nt, Homo Sapiens; identical to SEQ ID NO: 30148

SEQ ID NO: 401739 - RNA, 64 nt, Homo Sapiens; identical to SEQ ID NO: 30149

SEQ ID NO: 401740 - RNA, 64 nt, Homo Sapiens; identical to SEQ ID NO: 30150

SEQ ID NO: 401741 - RNA, 64 nt, Homo Sapiens; identical to SEQ ID NO: 30151

SEQ ID NO: 401742 - RNA, 64 nt, Homo Sapiens; identical to SEQ ID NO: 30152

SEQ ID NO: 401743 - RNA, 64 nt, Homo Sapiens; identical to SEQ ID NO: 30153

SEQ ID NO: 401744 - RNA, 64 nt, Homo Sapiens; identical to SEQ ID NO: 30154

SEQ ID NO: 401745 - RNA, 64 nt, Homo Sapiens; identical to SEQ ID NO: 30155

SEQ ID NO: 401746 - RNA, 64 nt, Homo Sapiens; identical to SEQ ID NO: 30156

SEQ ID NO: 401747 - RNA, 64 nt, Homo Sapiens; identical to SEQ ID NO: 30157

SEQ ID NO: 401748 - RNA, 64 nt, Homo Sapiens; identical to SEQ ID NO: 30158

SEQ ID NO: 401749 - RNA, 64 nt, Homo Sapiens; identical to SEQ ID NO: 30159

SEQ ID NO: 401750 - RNA, 64 nt, Homo Sapiens; identical to SEQ ID NO: 30160

SEQ ID NO: 401751 - RNA, 64 nt, Homo Sapiens; identical to SEQ ID NO: 30161

SEQ ID NO: 401752 - RNA, 64 nt, Homo Sapiens; identical to SEQ ID NO: 30162

SEQ ID NO: 401753 - RNA, 64 nt, Homo Sapiens; identical to SEQ ID NO: 30163

SEQ ID NO: 401754 - RNA, 64 nt, Homo Sapiens; identical to SEQ ID NO: 30164

SEQ ID NO: 401755 - RNA, 64 nt, Homo Sapiens; identical to SEQ ID NO: 30165

SEQ ID NO: 401756 - RNA, 64 nt, Homo Sapiens; identical to SEQ ID NO: 30166

SEQ ID NO: 401757 - RNA, 64 nt, Homo Sapiens; identical to SEQ ID NO: 30167

SEQ ID NO: 401758 - RNA, 64 nt, Homo Sapiens; identical to SEQ ID NO: 30168

SEQ ID NO: 401759 - RNA, 64 nt, Homo Sapiens; identical to SEQ ID NO: 30169

SEQ ID NO: 401760 - RNA, 64 nt, Homo Sapiens; identical to SEQ ID NO: 30170

SEQ ID NO: 401761 - RNA, 64 nt, Homo Sapiens; identical to SEQ ID NO: 30171

SEQ ID NO: 401762 - RNA, 64 nt, Homo Sapiens; identical to SEQ ID NO: 30172

SEQ ID NO: 401763 - RNA, 64 nt, Homo Sapiens; identical to SEQ ID NO: 30173

SEQ ID NO: 401764 - RNA, 64 nt, Homo Sapiens; identical to SEQ ID NO: 30174

SEQ ID NO: 401765 - RNA, 64 nt, Homo Sapiens; identical to SEQ ID NO: 30175

SEQ ID NO: 401766 - RNA, 64 nt, Homo Sapiens; identical to SEQ ID NO: 30176

SEQ ID NO: 401767 - RNA, 64 nt, Homo Sapiens; identical to SEQ ID NO: 30177

SEQ ID NO: 401768 - RNA, 64 nt, Homo Sapiens; identical to SEQ ID NO: 30178

SEQ ID NO: 401769 - RNA, 64 nt, Homo Sapiens; identical to SEQ ID NO: 30179

SEQ ID NO: 401770 - RNA, 64 nt, Homo Sapiens; identical to SEQ ID NO: 30180

SEQ ID NO: 401771 - RNA, 64 nt, Homo Sapiens; identical to SEQ ID NO: 30181

SEQ ID NO: 401772 - RNA, 64 nt, Homo Sapiens; identical to SEQ ID NO: 30182

SEQ ID NO: 401773 - RNA, 64 nt, Homo Sapiens; identical to SEQ ID NO: 30183

SEQ ID NO: 401774 - RNA, 64 nt, Homo Sapiens; identical to SEQ ID NO: 30184

SEQ ID NO: 401775 - RNA, 64 nt, Homo Sapiens; identical to SEQ ID NO: 30185

SEQ ID NO: 401776 - RNA, 64 nt, Homo Sapiens; identical to SEQ ID NO: 30186

SEQ ID NO: 401777 - RNA, 64 nt, Homo Sapiens; identical to SEQ ID NO: 30187

SEQ ID NO: 401778 - RNA, 64 nt, Homo Sapiens; identical to SEQ ID NO: 30188

SEQ ID NO: 401779 - RNA, 64 nt, Homo Sapiens; identical to SEQ ID NO: 30189

SEQ ID NO: 401780 - RNA, 64 nt, Homo Sapiens; identical to SEQ ID NO: 30190

SEQ ID NO: 401781 - RNA, 64 nt, Homo Sapiens; identical to SEQ ID NO: 30191

SEQ ID NO: 401782 - RNA, 64 nt, Homo Sapiens; identical to SEQ ID NO: 30192

SEQ ID NO: 401783 - RNA, 64 nt, Homo Sapiens; identical to SEQ ID NO: 30193

SEQ ID NO: 401784 - RNA, 64 nt, Homo Sapiens; identical to SEQ ID NO: 30194

SEQ ID NO: 401785 - RNA, 64 nt, Homo Sapiens; identical to SEQ ID NO: 30195

SEQ ID NO: 401786 - RNA, 64 nt, Homo Sapiens; identical to SEQ ID NO: 30196

SEQ ID NO: 401787 - RNA, 64 nt, Homo Sapiens; identical to SEQ ID NO: 30197

SEQ ID NO: 401788 - RNA, 64 nt, Homo Sapiens; identical to SEQ ID NO: 30198

SEQ ID NO: 401789 - RNA, 64 nt, Homo Sapiens; identical to SEQ ID NO: 30199

SEQ ID NO: 401790 - RNA, 64 nt, Homo Sapiens; identical to SEQ ID NO: 30200

SEQ ID NO: 401791 - RNA, 64 nt, Homo Sapiens; identical to SEQ ID NO: 30201

SEQ ID NO: 401792 - RNA, 64 nt, Homo Sapiens; identical to SEQ ID NO: 30202

SEQ ID NO: 401793 - RNA, 64 nt, Homo Sapiens; identical to SEQ ID NO: 30203

SEQ ID NO: 401794 - RNA, 64 nt, Homo Sapiens; identical to SEQ ID NO: 30204

SEQ ID NO: 401795 - RNA, 64 nt, Homo Sapiens; identical to SEQ ID NO: 30205

SEQ ID NO: 401796 - RNA, 64 nt, Homo Sapiens; identical to SEQ ID NO: 30206

SEQ ID NO: 401797 - RNA, 64 nt, Homo Sapiens; identical to SEQ ID NO: 30207

SEQ ID NO: 401798 - RNA, 64 nt, Homo Sapiens; identical to SEQ ID NO: 30208

SEQ ID NO: 401799 - RNA, 64 nt, Homo Sapiens; identical to SEQ ID NO: 30209

SEQ ID NO: 401800 - RNA, 64 nt, Homo Sapiens; identical to SEQ ID NO: 30210

SEQ ID NO: 401801 - RNA, 64 nt, Homo Sapiens; identical to SEQ ID NO: 30211

SEQ ID NO: 401802 - RNA, 64 nt, Homo Sapiens; identical to SEQ ID NO: 30212

SEQ ID NO: 401803 - RNA, 64 nt, Homo Sapiens; identical to SEQ ID NO: 30213

SEQ ID NO: 401804 - RNA, 64 nt, Homo Sapiens; identical to SEQ ID NO: 30214

SEQ ID NO: 401805 - RNA, 64 nt, Homo Sapiens; identical to SEQ ID NO: 30215

SEQ ID NO: 401806 - RNA, 64 nt, Homo Sapiens; identical to SEQ ID NO: 30216

SEQ ID NO: 401807 - RNA, 64 nt, Homo Sapiens; identical to SEQ ID NO: 30217

SEQ ID NO: 401808 - RNA, 64 nt, Homo Sapiens; identical to SEQ ID NO: 30218

SEQ ID NO: 401809 - RNA, 64 nt, Homo Sapiens; identical to SEQ ID NO: 30219

SEQ ID NO: 401810 - RNA, 64 nt, Homo Sapiens; identical to SEQ ID NO: 30220

SEQ ID NO: 401811 - RNA, 64 nt, Homo Sapiens; identical to SEQ ID NO: 30221

SEQ ID NO: 401812 - RNA, 64 nt, Homo Sapiens; identical to SEQ ID NO: 30222

SEQ ID NO: 401813 - RNA, 64 nt, Homo Sapiens; identical to SEQ ID NO: 30223

SEQ ID NO: 401814 - RNA, 64 nt, Homo Sapiens; identical to SEQ ID NO: 30224

SEQ ID NO: 401815 - RNA, 64 nt, Homo Sapiens; identical to SEQ ID NO: 30225

SEQ ID NO: 401816 - RNA, 64 nt, Homo Sapiens; identical to SEQ ID NO: 30226

SEQ ID NO: 401817 - RNA, 64 nt, Homo Sapiens; identical to SEQ ID NO: 30227

SEQ ID NO: 401818 - RNA, 64 nt, Homo Sapiens; identical to SEQ ID NO: 30228

SEQ ID NO: 401819 - RNA, 64 nt, Homo Sapiens; identical to SEQ ID NO: 30229

SEQ ID NO: 401820 - RNA, 64 nt, Homo Sapiens; identical to SEQ ID NO: 30230

SEQ ID NO: 401821 - RNA, 64 nt, Homo Sapiens; identical to SEQ ID NO: 30231

SEQ ID NO: 401822 - RNA, 64 nt, Homo Sapiens; identical to SEQ ID NO: 30232

SEQ ID NO: 401823 - RNA, 64 nt, Homo Sapiens; identical to SEQ ID NO: 30233

SEQ ID NO: 401824 - RNA, 64 nt, Homo Sapiens; identical to SEQ ID NO: 30234

SEQ ID NO: 401825 - RNA, 64 nt, Homo Sapiens; identical to SEQ ID NO: 30235

SEQ ID NO: 401826 - RNA, 64 nt, Homo Sapiens; identical to SEQ ID NO: 30236

SEQ ID NO: 401827 - RNA, 64 nt, Homo Sapiens; identical to SEQ ID NO: 30237

SEQ ID NO: 401828 - RNA, 64 nt, Homo Sapiens; identical to SEQ ID NO: 30238

SEQ ID NO: 401829 - RNA, 64 nt, Homo Sapiens; identical to SEQ ID NO: 30239

SEQ ID NO: 401830 - RNA, 64 nt, Homo Sapiens; identical to SEQ ID NO: 30240

SEQ ID NO: 401831 - RNA, 64 nt, Homo Sapiens; identical to SEQ ID NO: 30241

SEQ ID NO: 401832 - RNA, 64 nt, Homo Sapiens; identical to SEQ ID NO: 30242

SEQ ID NO: 401833 - RNA, 64 nt, Homo Sapiens; identical to SEQ ID NO: 30243

SEQ ID NO: 401834 - RNA, 64 nt, Homo Sapiens; identical to SEQ ID NO: 30244

SEQ ID NO: 401835 - RNA, 64 nt, Homo Sapiens; identical to SEQ ID NO: 30245

SEQ ID NO: 401836 - RNA, 64 nt, Homo Sapiens; identical to SEQ ID NO: 30246

SEQ ID NO: 401837 - RNA, 64 nt, Homo Sapiens; identical to SEQ ID NO: 30247

SEQ ID NO: 401838 - RNA, 64 nt, Homo Sapiens; identical to SEQ ID NO: 30248

SEQ ID NO: 401839 - RNA, 64 nt, Homo Sapiens; identical to SEQ ID NO: 30249

SEQ ID NO: 401840 - RNA, 64 nt, Homo Sapiens; identical to SEQ ID NO: 30250

SEQ ID NO: 401841 - RNA, 64 nt, Homo Sapiens; identical to SEQ ID NO: 30251

SEQ ID NO: 401842 - RNA, 64 nt, Homo Sapiens; identical to SEQ ID NO: 30252

SEQ ID NO: 401843 - RNA, 64 nt, Homo Sapiens; identical to SEQ ID NO: 30253

SEQ ID NO: 401844 - RNA, 64 nt, Homo Sapiens; identical to SEQ ID NO: 30254

SEQ ID NO: 401845 - RNA, 64 nt, Homo Sapiens; identical to SEQ ID NO: 30255

SEQ ID NO: 401846 - RNA, 63 nt, Homo Sapiens; identical to SEQ ID NO: 30256

SEQ ID NO: 401847 - RNA, 64 nt, Homo Sapiens; identical to SEQ ID NO: 30257

SEQ ID NO: 401848 - RNA, 64 nt, Homo Sapiens; identical to SEQ ID NO: 30258

SEQ ID NO: 401849 - RNA, 64 nt, Homo Sapiens; identical to SEQ ID NO: 30259

SEQ ID NO: 401850 - RNA, 64 nt, Homo Sapiens; identical to SEQ ID NO: 30260

SEQ ID NO: 401851 - RNA, 64 nt, Homo Sapiens; identical to SEQ ID NO: 30261

SEQ ID NO: 401852 - RNA, 64 nt, Homo Sapiens; identical to SEQ ID NO: 30262

SEQ ID NO: 401853 - RNA, 64 nt, Homo Sapiens; identical to SEQ ID NO: 30263

SEQ ID NO: 401854 - RNA, 64 nt, Homo Sapiens; identical to SEQ ID NO: 30264

SEQ ID NO: 401855 - RNA, 64 nt, Homo Sapiens; identical to SEQ ID NO: 30265

SEQ ID NO: 401856 - RNA, 64 nt, Homo Sapiens; identical to SEQ ID NO: 30266

SEQ ID NO: 401857 - RNA, 64 nt, Homo Sapiens; identical to SEQ ID NO: 30267

SEQ ID NO: 401858 - RNA, 64 nt, Homo Sapiens; identical to SEQ ID NO: 30268

SEQ ID NO: 401859 - RNA, 64 nt, Homo Sapiens; identical to SEQ ID NO: 30269

SEQ ID NO: 401860 - RNA, 64 nt, Homo Sapiens; identical to SEQ ID NO: 30270

SEQ ID NO: 401861 - RNA, 64 nt, Homo Sapiens; identical to SEQ ID NO: 30271

SEQ ID NO: 401862 - RNA, 64 nt, Homo Sapiens; identical to SEQ ID NO: 30272

SEQ ID NO: 401863 - RNA, 64 nt, Homo Sapiens; identical to SEQ ID NO: 30273

SEQ ID NO: 401864 - RNA, 64 nt, Homo Sapiens; identical to SEQ ID NO: 30274

SEQ ID NO: 401865 - RNA, 64 nt, Homo Sapiens; identical to SEQ ID NO: 30275

SEQ ID NO: 401866 - RNA, 64 nt, Homo Sapiens; identical to SEQ ID NO: 30276

SEQ ID NO: 401867 - RNA, 64 nt, Homo Sapiens; identical to SEQ ID NO: 30277

SEQ ID NO: 401868 - RNA, 64 nt, Homo Sapiens; identical to SEQ ID NO: 30278

SEQ ID NO: 401869 - RNA, 64 nt, Homo Sapiens; identical to SEQ ID NO: 30279

SEQ ID NO: 401870 - RNA, 64 nt, Homo Sapiens; identical to SEQ ID NO: 30280

SEQ ID NO: 401871 - RNA, 64 nt, Homo Sapiens; identical to SEQ ID NO: 30281

SEQ ID NO: 401872 - RNA, 64 nt, Homo Sapiens; identical to SEQ ID NO: 30282

SEQ ID NO: 401873 - RNA, 64 nt, Homo Sapiens; identical to SEQ ID NO: 30283

SEQ ID NO: 401874 - RNA, 64 nt, Homo Sapiens; identical to SEQ ID NO: 30284

SEQ ID NO: 401875 - RNA, 64 nt, Homo Sapiens; identical to SEQ ID NO: 30285

SEQ ID NO: 401876 - RNA, 64 nt, Homo Sapiens; identical to SEQ ID NO: 30286

SEQ ID NO: 401877 - RNA, 64 nt, Homo Sapiens; identical to SEQ ID NO: 30287

SEQ ID NO: 401878 - RNA, 64 nt, Homo Sapiens; identical to SEQ ID NO: 30288

SEQ ID NO: 401879 - RNA, 64 nt, Homo Sapiens; identical to SEQ ID NO: 30289

SEQ ID NO: 401880 - RNA, 64 nt, Homo Sapiens; identical to SEQ ID NO: 30290

SEQ ID NO: 401881 - RNA, 64 nt, Homo Sapiens; identical to SEQ ID NO: 30291

SEQ ID NO: 401882 - RNA, 64 nt, Homo Sapiens; identical to SEQ ID NO: 30292

SEQ ID NO: 401883 - RNA, 64 nt, Homo Sapiens; identical to SEQ ID NO: 30293

SEQ ID NO: 401884 - RNA, 64 nt, Homo Sapiens; identical to SEQ ID NO: 30294

SEQ ID NO: 401885 - RNA, 64 nt, Homo Sapiens; identical to SEQ ID NO: 30295

SEQ ID NO: 401886 - RNA, 64 nt, Homo Sapiens; identical to SEQ ID NO: 30296

SEQ ID NO: 401887 - RNA, 64 nt, Homo Sapiens; identical to SEQ ID NO: 30297

SEQ ID NO: 401888 - RNA, 64 nt, Homo Sapiens; identical to SEQ ID NO: 30298

SEQ ID NO: 401889 - RNA, 64 nt, Homo Sapiens; identical to SEQ ID NO: 30299

SEQ ID NO: 401890 - RNA, 64 nt, Homo Sapiens; identical to SEQ ID NO: 30300

SEQ ID NO: 401891 - RNA, 64 nt, Homo Sapiens; identical to SEQ ID NO: 30301

SEQ ID NO: 401892 - RNA, 64 nt, Homo Sapiens; identical to SEQ ID NO: 30302

SEQ ID NO: 401893 - RNA, 64 nt, Homo Sapiens; identical to SEQ ID NO: 30303

SEQ ID NO: 401894 - RNA, 64 nt, Homo Sapiens; identical to SEQ ID NO: 30304

SEQ ID NO: 401895 - RNA, 64 nt, Homo Sapiens; identical to SEQ ID NO: 30305

SEQ ID NO: 401896 - RNA, 64 nt, Homo Sapiens; identical to SEQ ID NO: 30306

SEQ ID NO: 401897 - RNA, 64 nt, Homo Sapiens; identical to SEQ ID NO: 30307

SEQ ID NO: 401898 - RNA, 64 nt, Homo Sapiens; identical to SEQ ID NO: 30308

SEQ ID NO: 401899 - RNA, 64 nt, Homo Sapiens; identical to SEQ ID NO: 30309

SEQ ID NO: 401900 - RNA, 64 nt, Homo Sapiens; identical to SEQ ID NO: 30310

SEQ ID NO: 401901 - RNA, 64 nt, Homo Sapiens; identical to SEQ ID NO: 30311

SEQ ID NO: 401902 - RNA, 64 nt, Homo Sapiens; identical to SEQ ID NO: 30312

SEQ ID NO: 401903 - RNA, 64 nt, Homo Sapiens; identical to SEQ ID NO: 30313

SEQ ID NO: 401904 - RNA, 64 nt, Homo Sapiens; identical to SEQ ID NO: 30314

SEQ ID NO: 401905 - RNA, 64 nt, Homo Sapiens; identical to SEQ ID NO: 30315

SEQ ID NO: 401906 - RNA, 64 nt, Homo Sapiens; identical to SEQ ID NO: 30316

SEQ ID NO: 401907 - RNA, 64 nt, Homo Sapiens; identical to SEQ ID NO: 30317

SEQ ID NO: 401908 - RNA, 64 nt, Homo Sapiens; identical to SEQ ID NO: 30318

SEQ ID NO: 401909 - RNA, 64 nt, Homo Sapiens; identical to SEQ ID NO: 30319

SEQ ID NO: 401910 - RNA, 64 nt, Homo Sapiens; identical to SEQ ID NO: 30320

SEQ ID NO: 401911 - RNA, 64 nt, Homo Sapiens; identical to SEQ ID NO: 30321

SEQ ID NO: 401912 - RNA, 64 nt, Homo Sapiens; identical to SEQ ID NO: 30322

SEQ ID NO: 401913 - RNA, 64 nt, Homo Sapiens; identical to SEQ ID NO: 30323

SEQ ID NO: 401914 - RNA, 64 nt, Homo Sapiens; identical to SEQ ID NO: 30324

SEQ ID NO: 401915 - RNA, 64 nt, Homo Sapiens; identical to SEQ ID NO: 30325

SEQ ID NO: 401916 - RNA, 64 nt, Homo Sapiens; identical to SEQ ID NO: 30326

SEQ ID NO: 401917 - RNA, 64 nt, Homo Sapiens; identical to SEQ ID NO: 30327

SEQ ID NO: 401918 - RNA, 64 nt, Homo Sapiens; identical to SEQ ID NO: 30328

SEQ ID NO: 401919 - RNA, 64 nt, Homo Sapiens; identical to SEQ ID NO: 30329

SEQ ID NO: 401920 - RNA, 64 nt, Homo Sapiens; identical to SEQ ID NO: 30330

SEQ ID NO: 401921 - RNA, 64 nt, Homo Sapiens; identical to SEQ ID NO: 30331

SEQ ID NO: 401922 - RNA, 64 nt, Homo Sapiens; identical to SEQ ID NO: 30332

SEQ ID NO: 401923 - RNA, 64 nt, Homo Sapiens; identical to SEQ ID NO: 30333

SEQ ID NO: 401924 - RNA, 64 nt, Homo Sapiens; identical to SEQ ID NO: 30334

SEQ ID NO: 401925 - RNA, 64 nt, Homo Sapiens; identical to SEQ ID NO: 30335

SEQ ID NO: 401926 - RNA, 64 nt, Homo Sapiens; identical to SEQ ID NO: 30336

SEQ ID NO: 401927 - RNA, 64 nt, Homo Sapiens; identical to SEQ ID NO: 30337

SEQ ID NO: 401928 - RNA, 64 nt, Homo Sapiens; identical to SEQ ID NO: 30338

SEQ ID NO: 401929 - RNA, 64 nt, Homo Sapiens; identical to SEQ ID NO: 30339

SEQ ID NO: 401930 - RNA, 64 nt, Homo Sapiens; identical to SEQ ID NO: 30340

SEQ ID NO: 401931 - RNA, 64 nt, Homo Sapiens; identical to SEQ ID NO: 30341

SEQ ID NO: 401932 - RNA, 64 nt, Homo Sapiens; identical to SEQ ID NO: 30342

SEQ ID NO: 401933 - RNA, 64 nt, Homo Sapiens; identical to SEQ ID NO: 30343

SEQ ID NO: 401934 - RNA, 64 nt, Homo Sapiens; identical to SEQ ID NO: 30344

SEQ ID NO: 401935 - RNA, 64 nt, Homo Sapiens; identical to SEQ ID NO: 30345

SEQ ID NO: 401936 - RNA, 64 nt, Homo Sapiens; identical to SEQ ID NO: 30346

SEQ ID NO: 401937 - RNA, 64 nt, Homo Sapiens; identical to SEQ ID NO: 30347

SEQ ID NO: 401938 - RNA, 64 nt, Homo Sapiens; identical to SEQ ID NO: 30348

SEQ ID NO: 401939 - RNA, 64 nt, Homo Sapiens; identical to SEQ ID NO: 30349

SEQ ID NO: 401940 - RNA, 64 nt, Homo Sapiens; identical to SEQ ID NO: 30350

SEQ ID NO: 401941 - RNA, 64 nt, Homo Sapiens; identical to SEQ ID NO: 30351

SEQ ID NO: 401942 - RNA, 64 nt, Homo Sapiens; identical to SEQ ID NO: 30352

SEQ ID NO: 401943 - RNA, 64 nt, Homo Sapiens; identical to SEQ ID NO: 30353

SEQ ID NO: 401944 - RNA, 64 nt, Homo Sapiens; identical to SEQ ID NO: 30354

SEQ ID NO: 401945 - RNA, 64 nt, Homo Sapiens; identical to SEQ ID NO: 30355

SEQ ID NO: 401946 - RNA, 64 nt, Homo Sapiens; identical to SEQ ID NO: 30356

SEQ ID NO: 401947 - RNA, 64 nt, Homo Sapiens; identical to SEQ ID NO: 30357

SEQ ID NO: 401948 - RNA, 64 nt, Homo Sapiens; identical to SEQ ID NO: 30358

SEQ ID NO: 401949 - RNA, 64 nt, Homo Sapiens; identical to SEQ ID NO: 30359

SEQ ID NO: 401950 - RNA, 64 nt, Homo Sapiens; identical to SEQ ID NO: 30360

SEQ ID NO: 401951 - RNA, 64 nt, Homo Sapiens; identical to SEQ ID NO: 30361

SEQ ID NO: 401952 - RNA, 64 nt, Homo Sapiens; identical to SEQ ID NO: 30362

SEQ ID NO: 401953 - RNA, 64 nt, Homo Sapiens; identical to SEQ ID NO: 30363

SEQ ID NO: 401954 - RNA, 64 nt, Homo Sapiens; identical to SEQ ID NO: 30364

SEQ ID NO: 401955 - RNA, 64 nt, Homo Sapiens; identical to SEQ ID NO: 30365

SEQ ID NO: 401956 - RNA, 64 nt, Homo Sapiens; identical to SEQ ID NO: 30366

SEQ ID NO: 401957 - RNA, 64 nt, Homo Sapiens; identical to SEQ ID NO: 30367

SEQ ID NO: 401958 - RNA, 64 nt, Homo Sapiens; identical to SEQ ID NO: 30368

SEQ ID NO: 401959 - RNA, 64 nt, Homo Sapiens; identical to SEQ ID NO: 30369

SEQ ID NO: 401960 - RNA, 64 nt, Homo Sapiens; identical to SEQ ID NO: 30370

SEQ ID NO: 401961 - RNA, 64 nt, Homo Sapiens; identical to SEQ ID NO: 30371

SEQ ID NO: 401962 - RNA, 64 nt, Homo Sapiens; identical to SEQ ID NO: 30372

SEQ ID NO: 401963 - RNA, 64 nt, Homo Sapiens; identical to SEQ ID NO: 30373

SEQ ID NO: 401964 - RNA, 64 nt, Homo Sapiens; identical to SEQ ID NO: 30374

SEQ ID NO: 401965 - RNA, 64 nt, Homo Sapiens; identical to SEQ ID NO: 30375

SEQ ID NO: 401966 - RNA, 64 nt, Homo Sapiens; identical to SEQ ID NO: 30376

SEQ ID NO: 401967 - RNA, 64 nt, Homo Sapiens; identical to SEQ ID NO: 30377

SEQ ID NO: 401968 - RNA, 64 nt, Homo Sapiens; identical to SEQ ID NO: 30378

SEQ ID NO: 401969 - RNA, 64 nt, Homo Sapiens; identical to SEQ ID NO: 30379

SEQ ID NO: 401970 - RNA, 64 nt, Homo Sapiens; identical to SEQ ID NO: 30380

SEQ ID NO: 401971 - RNA, 64 nt, Homo Sapiens; identical to SEQ ID NO: 30381

SEQ ID NO: 401972 - RNA, 64 nt, Homo Sapiens; identical to SEQ ID NO: 30382

SEQ ID NO: 401973 - RNA, 64 nt, Homo Sapiens; identical to SEQ ID NO: 30383

SEQ ID NO: 401974 - RNA, 64 nt, Homo Sapiens; identical to SEQ ID NO: 30384

SEQ ID NO: 401975 - RNA, 64 nt, Homo Sapiens; identical to SEQ ID NO: 30385

SEQ ID NO: 401976 - RNA, 64 nt, Homo Sapiens; identical to SEQ ID NO: 30386

SEQ ID NO: 401977 - RNA, 64 nt, Homo Sapiens; identical to SEQ ID NO: 30387

SEQ ID NO: 401978 - RNA, 64 nt, Homo Sapiens; identical to SEQ ID NO: 30388

SEQ ID NO: 401979 - RNA, 64 nt, Homo Sapiens; identical to SEQ ID NO: 30389

SEQ ID NO: 401980 - RNA, 64 nt, Homo Sapiens; identical to SEQ ID NO: 30390

SEQ ID NO: 401981 - RNA, 64 nt, Homo Sapiens; identical to SEQ ID NO: 30391

SEQ ID NO: 401982 - RNA, 64 nt, Homo Sapiens; identical to SEQ ID NO: 30392

SEQ ID NO: 401983 - RNA, 64 nt, Homo Sapiens; identical to SEQ ID NO: 30393

SEQ ID NO: 401984 - RNA, 64 nt, Homo Sapiens; identical to SEQ ID NO: 30394

SEQ ID NO: 401985 - RNA, 64 nt, Homo Sapiens; identical to SEQ ID NO: 30395

SEQ ID NO: 401986 - RNA, 64 nt, Homo Sapiens; identical to SEQ ID NO: 30396

SEQ ID NO: 401987 - RNA, 64 nt, Homo Sapiens; identical to SEQ ID NO: 30397

SEQ ID NO: 401988 - RNA, 64 nt, Homo Sapiens; identical to SEQ ID NO: 30398

SEQ ID NO: 401989 - RNA, 64 nt, Homo Sapiens; identical to SEQ ID NO: 30399

SEQ ID NO: 401990 - RNA, 64 nt, Homo Sapiens; identical to SEQ ID NO: 30400

SEQ ID NO: 401991 - RNA, 64 nt, Homo Sapiens; identical to SEQ ID NO: 30401

SEQ ID NO: 401992 - RNA, 64 nt, Homo Sapiens; identical to SEQ ID NO: 30402

SEQ ID NO: 401993 - RNA, 64 nt, Homo Sapiens; identical to SEQ ID NO: 30403

SEQ ID NO: 401994 - RNA, 64 nt, Homo Sapiens; identical to SEQ ID NO: 30404

SEQ ID NO: 401995 - RNA, 64 nt, Homo Sapiens; identical to SEQ ID NO: 30405

SEQ ID NO: 401996 - RNA, 64 nt, Homo Sapiens; identical to SEQ ID NO: 30406

SEQ ID NO: 401997 - RNA, 64 nt, Homo Sapiens; identical to SEQ ID NO: 30407

SEQ ID NO: 401998 - RNA, 64 nt, Homo Sapiens; identical to SEQ ID NO: 30408

SEQ ID NO: 401999 - RNA, 64 nt, Homo Sapiens; identical to SEQ ID NO: 30409

SEQ ID NO: 402000 - RNA, 64 nt, Homo Sapiens; identical to SEQ ID NO: 30410

SEQ ID NO: 402001 - RNA, 64 nt, Homo Sapiens; identical to SEQ ID NO: 30411

SEQ ID NO: 402002 - RNA, 64 nt, Homo Sapiens; identical to SEQ ID NO: 30412

SEQ ID NO: 402003 - RNA, 64 nt, Homo Sapiens; identical to SEQ ID NO: 30413

SEQ ID NO: 402004 - RNA, 64 nt, Homo Sapiens; identical to SEQ ID NO: 30414

SEQ ID NO: 402005 - RNA, 64 nt, Homo Sapiens; identical to SEQ ID NO: 30415

SEQ ID NO: 402006 - RNA, 64 nt, Homo Sapiens; identical to SEQ ID NO: 30416

SEQ ID NO: 402007 - RNA, 64 nt, Homo Sapiens; identical to SEQ ID NO: 30417

SEQ ID NO: 402008 - RNA, 64 nt, Homo Sapiens; identical to SEQ ID NO: 30418

SEQ ID NO: 402009 - RNA, 64 nt, Homo Sapiens; identical to SEQ ID NO: 30419

SEQ ID NO: 402010 - RNA, 64 nt, Homo Sapiens; identical to SEQ ID NO: 30420

SEQ ID NO: 402011 - RNA, 64 nt, Homo Sapiens; identical to SEQ ID NO: 30421

SEQ ID NO: 402012 - RNA, 64 nt, Homo Sapiens; identical to SEQ ID NO: 30422

SEQ ID NO: 402013 - RNA, 64 nt, Homo Sapiens; identical to SEQ ID NO: 30423

SEQ ID NO: 402014 - RNA, 64 nt, Homo Sapiens; identical to SEQ ID NO: 30424

SEQ ID NO: 402015 - RNA, 64 nt, Homo Sapiens; identical to SEQ ID NO: 30425

SEQ ID NO: 402016 - RNA, 64 nt, Homo Sapiens; identical to SEQ ID NO: 30426

SEQ ID NO: 402017 - RNA, 64 nt, Homo Sapiens; identical to SEQ ID NO: 30427

SEQ ID NO: 402018 - RNA, 64 nt, Homo Sapiens; identical to SEQ ID NO: 30428

SEQ ID NO: 402019 - RNA, 64 nt, Homo Sapiens; identical to SEQ ID NO: 30429

SEQ ID NO: 402020 - RNA, 64 nt, Homo Sapiens; identical to SEQ ID NO: 30430

SEQ ID NO: 402021 - RNA, 64 nt, Homo Sapiens; identical to SEQ ID NO: 30431

SEQ ID NO: 402022 - RNA, 64 nt, Homo Sapiens; identical to SEQ ID NO: 30432

SEQ ID NO: 402023 - RNA, 64 nt, Homo Sapiens; identical to SEQ ID NO: 30433

SEQ ID NO: 402024 - RNA, 64 nt, Homo Sapiens; identical to SEQ ID NO: 30434

SEQ ID NO: 402025 - RNA, 64 nt, Homo Sapiens; identical to SEQ ID NO: 30435

SEQ ID NO: 402026 - RNA, 64 nt, Homo Sapiens; identical to SEQ ID NO: 30436

SEQ ID NO: 402027 - RNA, 64 nt, Homo Sapiens; identical to SEQ ID NO: 30437

SEQ ID NO: 402028 - RNA, 64 nt, Homo Sapiens; identical to SEQ ID NO: 30438

SEQ ID NO: 402029 - RNA, 64 nt, Homo Sapiens; identical to SEQ ID NO: 30439

SEQ ID NO: 402030 - RNA, 64 nt, Homo Sapiens; identical to SEQ ID NO: 30440

SEQ ID NO: 402031 - RNA, 64 nt, Homo Sapiens; identical to SEQ ID NO: 30441

SEQ ID NO: 402032 - RNA, 64 nt, Homo Sapiens; identical to SEQ ID NO: 30442

SEQ ID NO: 402033 - RNA, 64 nt, Homo Sapiens; identical to SEQ ID NO: 30443

SEQ ID NO: 402034 - RNA, 64 nt, Homo Sapiens; identical to SEQ ID NO: 30444

SEQ ID NO: 402035 - RNA, 64 nt, Homo Sapiens; identical to SEQ ID NO: 30445

SEQ ID NO: 402036 - RNA, 64 nt, Homo Sapiens; identical to SEQ ID NO: 30446

SEQ ID NO: 402037 - RNA, 64 nt, Homo Sapiens; identical to SEQ ID NO: 30447

SEQ ID NO: 402038 - RNA, 64 nt, Homo Sapiens; identical to SEQ ID NO: 30448

SEQ ID NO: 402039 - RNA, 64 nt, Homo Sapiens; identical to SEQ ID NO: 30449

SEQ ID NO: 402040 - RNA, 64 nt, Homo Sapiens; identical to SEQ ID NO: 30450

SEQ ID NO: 402041 - RNA, 64 nt, Homo Sapiens; identical to SEQ ID NO: 30451

SEQ ID NO: 402042 - RNA, 64 nt, Homo Sapiens; identical to SEQ ID NO: 30452

SEQ ID NO: 402043 - RNA, 64 nt, Homo Sapiens; identical to SEQ ID NO: 30453

SEQ ID NO: 402044 - RNA, 64 nt, Homo Sapiens; identical to SEQ ID NO: 30454

SEQ ID NO: 402045 - RNA, 64 nt, Homo Sapiens; identical to SEQ ID NO: 30455

SEQ ID NO: 402046 - RNA, 64 nt, Homo Sapiens; identical to SEQ ID NO: 30456

SEQ ID NO: 402047 - RNA, 64 nt, Homo Sapiens; identical to SEQ ID NO: 30457

SEQ ID NO: 402048 - RNA, 64 nt, Homo Sapiens; identical to SEQ ID NO: 30458

SEQ ID NO: 402049 - RNA, 64 nt, Homo Sapiens; identical to SEQ ID NO: 30459

SEQ ID NO: 402050 - RNA, 64 nt, Homo Sapiens; identical to SEQ ID NO: 30460

SEQ ID NO: 402051 - RNA, 64 nt, Homo Sapiens; identical to SEQ ID NO: 30461

SEQ ID NO: 402052 - RNA, 64 nt, Homo Sapiens; identical to SEQ ID NO: 30462

SEQ ID NO: 402053 - RNA, 64 nt, Homo Sapiens; identical to SEQ ID NO: 30463

SEQ ID NO: 402054 - RNA, 64 nt, Homo Sapiens; identical to SEQ ID NO: 30464

SEQ ID NO: 402055 - RNA, 64 nt, Homo Sapiens; identical to SEQ ID NO: 30465

SEQ ID NO: 402056 - RNA, 64 nt, Homo Sapiens; identical to SEQ ID NO: 30466

SEQ ID NO: 402057 - RNA, 64 nt, Homo Sapiens; identical to SEQ ID NO: 30467

SEQ ID NO: 402058 - RNA, 64 nt, Homo Sapiens; identical to SEQ ID NO: 30468

SEQ ID NO: 402059 - RNA, 64 nt, Homo Sapiens; identical to SEQ ID NO: 30469

SEQ ID NO: 402060 - RNA, 64 nt, Homo Sapiens; identical to SEQ ID NO: 30470

SEQ ID NO: 402061 - RNA, 64 nt, Homo Sapiens; identical to SEQ ID NO: 30471

SEQ ID NO: 402062 - RNA, 64 nt, Homo Sapiens; identical to SEQ ID NO: 30472

SEQ ID NO: 402063 - RNA, 64 nt, Homo Sapiens; identical to SEQ ID NO: 30473

SEQ ID NO: 402064 - RNA, 64 nt, Homo Sapiens; identical to SEQ ID NO: 30474

SEQ ID NO: 402065 - RNA, 64 nt, Homo Sapiens; identical to SEQ ID NO: 30475

SEQ ID NO: 402066 - RNA, 64 nt, Homo Sapiens; identical to SEQ ID NO: 30476

SEQ ID NO: 402067 - RNA, 64 nt, Homo Sapiens; identical to SEQ ID NO: 30477

SEQ ID NO: 402068 - RNA, 64 nt, Homo Sapiens; identical to SEQ ID NO: 30478

SEQ ID NO: 402069 - RNA, 64 nt, Homo Sapiens; identical to SEQ ID NO: 30479

SEQ ID NO: 402070 - RNA, 64 nt, Homo Sapiens; identical to SEQ ID NO: 30480

SEQ ID NO: 402071 - RNA, 64 nt, Homo Sapiens; identical to SEQ ID NO: 30481

SEQ ID NO: 402072 - RNA, 64 nt, Homo Sapiens; identical to SEQ ID NO: 30482

SEQ ID NO: 402073 - RNA, 64 nt, Homo Sapiens; identical to SEQ ID NO: 30483

SEQ ID NO: 402074 - RNA, 64 nt, Homo Sapiens; identical to SEQ ID NO: 30484

SEQ ID NO: 402075 - RNA, 64 nt, Homo Sapiens; identical to SEQ ID NO: 30485

SEQ ID NO: 402076 - RNA, 64 nt, Homo Sapiens; identical to SEQ ID NO: 30486

SEQ ID NO: 402077 - RNA, 64 nt, Homo Sapiens; identical to SEQ ID NO: 30487

SEQ ID NO: 402078 - RNA, 64 nt, Homo Sapiens; identical to SEQ ID NO: 30488

SEQ ID NO: 402079 - RNA, 64 nt, Homo Sapiens; identical to SEQ ID NO: 30489

SEQ ID NO: 402080 - RNA, 64 nt, Homo Sapiens; identical to SEQ ID NO: 30490

SEQ ID NO: 402081 - RNA, 64 nt, Homo Sapiens; identical to SEQ ID NO: 30491

SEQ ID NO: 402082 - RNA, 64 nt, Homo Sapiens; identical to SEQ ID NO: 30492

SEQ ID NO: 402083 - RNA, 64 nt, Homo Sapiens; identical to SEQ ID NO: 30493

SEQ ID NO: 402084 - RNA, 64 nt, Homo Sapiens; identical to SEQ ID NO: 30494

SEQ ID NO: 402085 - RNA, 64 nt, Homo Sapiens; identical to SEQ ID NO: 30495

SEQ ID NO: 402086 - RNA, 64 nt, Homo Sapiens; identical to SEQ ID NO: 30496

SEQ ID NO: 402087 - RNA, 64 nt, Homo Sapiens; identical to SEQ ID NO: 30497

SEQ ID NO: 402088 - RNA, 64 nt, Homo Sapiens; identical to SEQ ID NO: 30498

SEQ ID NO: 402089 - RNA, 64 nt, Homo Sapiens; identical to SEQ ID NO: 30499

SEQ ID NO: 402090 - RNA, 64 nt, Homo Sapiens; identical to SEQ ID NO: 30500

SEQ ID NO: 402091 - RNA, 64 nt, Homo Sapiens; identical to SEQ ID NO: 30501

SEQ ID NO: 402092 - RNA, 64 nt, Homo Sapiens; identical to SEQ ID NO: 30502

SEQ ID NO: 402093 - RNA, 64 nt, Homo Sapiens; identical to SEQ ID NO: 30503

SEQ ID NO: 402094 - RNA, 64 nt, Homo Sapiens; identical to SEQ ID NO: 30504

SEQ ID NO: 402095 - RNA, 64 nt, Homo Sapiens; identical to SEQ ID NO: 30505

SEQ ID NO: 402096 - RNA, 64 nt, Homo Sapiens; identical to SEQ ID NO: 30506

SEQ ID NO: 402097 - RNA, 64 nt, Homo Sapiens; identical to SEQ ID NO: 30507

SEQ ID NO: 402098 - RNA, 64 nt, Homo Sapiens; identical to SEQ ID NO: 30508

SEQ ID NO: 402099 - RNA, 64 nt, Homo Sapiens; identical to SEQ ID NO: 30509

SEQ ID NO: 402100 - RNA, 64 nt, Homo Sapiens; identical to SEQ ID NO: 30510

SEQ ID NO: 402101 - RNA, 64 nt, Homo Sapiens; identical to SEQ ID NO: 30511

SEQ ID NO: 402102 - RNA, 64 nt, Homo Sapiens; identical to SEQ ID NO: 30512

SEQ ID NO: 402103 - RNA, 64 nt, Homo Sapiens; identical to SEQ ID NO: 30513

SEQ ID NO: 402104 - RNA, 64 nt, Homo Sapiens; identical to SEQ ID NO: 30514

SEQ ID NO: 402105 - RNA, 64 nt, Homo Sapiens; identical to SEQ ID NO: 30515

SEQ ID NO: 402106 - RNA, 64 nt, Homo Sapiens; identical to SEQ ID NO: 30516

SEQ ID NO: 402107 - RNA, 64 nt, Homo Sapiens; identical to SEQ ID NO: 30517

SEQ ID NO: 402108 - RNA, 64 nt, Homo Sapiens; identical to SEQ ID NO: 30518

SEQ ID NO: 402109 - RNA, 64 nt, Homo Sapiens; identical to SEQ ID NO: 30519

SEQ ID NO: 402110 - RNA, 64 nt, Homo Sapiens; identical to SEQ ID NO: 30520

SEQ ID NO: 402111 - RNA, 64 nt, Homo Sapiens; identical to SEQ ID NO: 30521

SEQ ID NO: 402112 - RNA, 64 nt, Homo Sapiens; identical to SEQ ID NO: 30522

SEQ ID NO: 402113 - RNA, 64 nt, Homo Sapiens; identical to SEQ ID NO: 30523

SEQ ID NO: 402114 - RNA, 63 nt, Homo Sapiens; identical to SEQ ID NO: 30524

SEQ ID NO: 402115 - RNA, 62 nt, Homo Sapiens; identical to SEQ ID NO: 30525

SEQ ID NO: 402116 - RNA, 64 nt, Homo Sapiens; identical to SEQ ID NO: 30526

SEQ ID NO: 402117 - RNA, 64 nt, Homo Sapiens; identical to SEQ ID NO: 30527

SEQ ID NO: 402118 - RNA, 64 nt, Homo Sapiens; identical to SEQ ID NO: 30528

SEQ ID NO: 402119 - RNA, 64 nt, Homo Sapiens; identical to SEQ ID NO: 30529

SEQ ID NO: 402120 - RNA, 64 nt, Homo Sapiens; identical to SEQ ID NO: 30530

SEQ ID NO: 402121 - RNA, 64 nt, Homo Sapiens; identical to SEQ ID NO: 30531

SEQ ID NO: 402122 - RNA, 64 nt, Homo Sapiens; identical to SEQ ID NO: 30532

SEQ ID NO: 402123 - RNA, 64 nt, Homo Sapiens; identical to SEQ ID NO: 30533

SEQ ID NO: 402124 - RNA, 64 nt, Homo Sapiens; identical to SEQ ID NO: 30534

SEQ ID NO: 402125 - RNA, 64 nt, Homo Sapiens; identical to SEQ ID NO: 30535

SEQ ID NO: 402126 - RNA, 64 nt, Homo Sapiens; identical to SEQ ID NO: 30536

SEQ ID NO: 402127 - RNA, 64 nt, Homo Sapiens; identical to SEQ ID NO: 30537

SEQ ID NO: 402128 - RNA, 64 nt, Homo Sapiens; identical to SEQ ID NO: 30538

SEQ ID NO: 402129 - RNA, 64 nt, Homo Sapiens; identical to SEQ ID NO: 30539

SEQ ID NO: 402130 - RNA, 64 nt, Homo Sapiens; identical to SEQ ID NO: 30540

SEQ ID NO: 402131 - RNA, 64 nt, Homo Sapiens; identical to SEQ ID NO: 30541

SEQ ID NO: 402132 - RNA, 64 nt, Homo Sapiens; identical to SEQ ID NO: 30542

SEQ ID NO: 402133 - RNA, 64 nt, Homo Sapiens; identical to SEQ ID NO: 30543

SEQ ID NO: 402134 - RNA, 64 nt, Homo Sapiens; identical to SEQ ID NO: 30544

SEQ ID NO: 402135 - RNA, 64 nt, Homo Sapiens; identical to SEQ ID NO: 30545

SEQ ID NO: 402136 - RNA, 64 nt, Homo Sapiens; identical to SEQ ID NO: 30546

SEQ ID NO: 402137 - RNA, 64 nt, Homo Sapiens; identical to SEQ ID NO: 30547

SEQ ID NO: 402138 - RNA, 64 nt, Homo Sapiens; identical to SEQ ID NO: 30548

SEQ ID NO: 402139 - RNA, 64 nt, Homo Sapiens; identical to SEQ ID NO: 30549

SEQ ID NO: 402140 - RNA, 64 nt, Homo Sapiens; identical to SEQ ID NO: 30550

SEQ ID NO: 402141 - RNA, 64 nt, Homo Sapiens; identical to SEQ ID NO: 30551

SEQ ID NO: 402142 - RNA, 64 nt, Homo Sapiens; identical to SEQ ID NO: 30552

SEQ ID NO: 402143 - RNA, 64 nt, Homo Sapiens; identical to SEQ ID NO: 30553

SEQ ID NO: 402144 - RNA, 64 nt, Homo Sapiens; identical to SEQ ID NO: 30554

SEQ ID NO: 402145 - RNA, 64 nt, Homo Sapiens; identical to SEQ ID NO: 30555

SEQ ID NO: 402146 - RNA, 64 nt, Homo Sapiens; identical to SEQ ID NO: 30556

SEQ ID NO: 402147 - RNA, 64 nt, Homo Sapiens; identical to SEQ ID NO: 30557

SEQ ID NO: 402148 - RNA, 64 nt, Homo Sapiens; identical to SEQ ID NO: 30558

SEQ ID NO: 402149 - RNA, 64 nt, Homo Sapiens; identical to SEQ ID NO: 30559

SEQ ID NO: 402150 - RNA, 64 nt, Homo Sapiens; identical to SEQ ID NO: 30560

SEQ ID NO: 402151 - RNA, 64 nt, Homo Sapiens; identical to SEQ ID NO: 30561

SEQ ID NO: 402152 - RNA, 64 nt, Homo Sapiens; identical to SEQ ID NO: 30562

SEQ ID NO: 402153 - RNA, 64 nt, Homo Sapiens; identical to SEQ ID NO: 30563

SEQ ID NO: 402154 - RNA, 64 nt, Homo Sapiens; identical to SEQ ID NO: 30564

SEQ ID NO: 402155 - RNA, 64 nt, Homo Sapiens; identical to SEQ ID NO: 30565

SEQ ID NO: 402156 - RNA, 64 nt, Homo Sapiens; identical to SEQ ID NO: 30566

SEQ ID NO: 402157 - RNA, 64 nt, Homo Sapiens; identical to SEQ ID NO: 30567

SEQ ID NO: 402158 - RNA, 64 nt, Homo Sapiens; identical to SEQ ID NO: 30568

SEQ ID NO: 402159 - RNA, 64 nt, Homo Sapiens; identical to SEQ ID NO: 30569

SEQ ID NO: 402160 - RNA, 64 nt, Homo Sapiens; identical to SEQ ID NO: 30570

SEQ ID NO: 402161 - RNA, 64 nt, Homo Sapiens; identical to SEQ ID NO: 30571

SEQ ID NO: 402162 - RNA, 64 nt, Homo Sapiens; identical to SEQ ID NO: 30572

SEQ ID NO: 402163 - RNA, 64 nt, Homo Sapiens; identical to SEQ ID NO: 30573

SEQ ID NO: 402164 - RNA, 64 nt, Homo Sapiens; identical to SEQ ID NO: 30574

SEQ ID NO: 402165 - RNA, 64 nt, Homo Sapiens; identical to SEQ ID NO: 30575

SEQ ID NO: 402166 - RNA, 64 nt, Homo Sapiens; identical to SEQ ID NO: 30576

SEQ ID NO: 402167 - RNA, 64 nt, Homo Sapiens; identical to SEQ ID NO: 30577

SEQ ID NO: 402168 - RNA, 64 nt, Homo Sapiens; identical to SEQ ID NO: 30578

SEQ ID NO: 402169 - RNA, 64 nt, Homo Sapiens; identical to SEQ ID NO: 30579

SEQ ID NO: 402170 - RNA, 64 nt, Homo Sapiens; identical to SEQ ID NO: 30580

SEQ ID NO: 402171 - RNA, 64 nt, Homo Sapiens; identical to SEQ ID NO: 30581

SEQ ID NO: 402172 - RNA, 64 nt, Homo Sapiens; identical to SEQ ID NO: 30582

SEQ ID NO: 402173 - RNA, 64 nt, Homo Sapiens; identical to SEQ ID NO: 30583

SEQ ID NO: 402174 - RNA, 64 nt, Homo Sapiens; identical to SEQ ID NO: 30584

SEQ ID NO: 402175 - RNA, 64 nt, Homo Sapiens; identical to SEQ ID NO: 30585

SEQ ID NO: 402176 - RNA, 64 nt, Homo Sapiens; identical to SEQ ID NO: 30586

SEQ ID NO: 402177 - RNA, 64 nt, Homo Sapiens; identical to SEQ ID NO: 30587

SEQ ID NO: 402178 - RNA, 64 nt, Homo Sapiens; identical to SEQ ID NO: 30588

SEQ ID NO: 402179 - RNA, 64 nt, Homo Sapiens; identical to SEQ ID NO: 30589

SEQ ID NO: 402180 - RNA, 64 nt, Homo Sapiens; identical to SEQ ID NO: 30590

SEQ ID NO: 402181 - RNA, 64 nt, Homo Sapiens; identical to SEQ ID NO: 30591

SEQ ID NO: 402182 - RNA, 64 nt, Homo Sapiens; identical to SEQ ID NO: 30592

SEQ ID NO: 402183 - RNA, 64 nt, Homo Sapiens; identical to SEQ ID NO: 30593

SEQ ID NO: 402184 - RNA, 64 nt, Homo Sapiens; identical to SEQ ID NO: 30594

SEQ ID NO: 402185 - RNA, 64 nt, Homo Sapiens; identical to SEQ ID NO: 30595

SEQ ID NO: 402186 - RNA, 64 nt, Homo Sapiens; identical to SEQ ID NO: 30596

SEQ ID NO: 402187 - RNA, 64 nt, Homo Sapiens; identical to SEQ ID NO: 30597

SEQ ID NO: 402188 - RNA, 64 nt, Homo Sapiens; identical to SEQ ID NO: 30598

SEQ ID NO: 402189 - RNA, 64 nt, Homo Sapiens; identical to SEQ ID NO: 30599

SEQ ID NO: 402190 - RNA, 64 nt, Homo Sapiens; identical to SEQ ID NO: 30600

SEQ ID NO: 402191 - RNA, 64 nt, Homo Sapiens; identical to SEQ ID NO: 30601

SEQ ID NO: 402192 - RNA, 64 nt, Homo Sapiens; identical to SEQ ID NO: 30602

SEQ ID NO: 402193 - RNA, 64 nt, Homo Sapiens; identical to SEQ ID NO: 30603

SEQ ID NO: 402194 - RNA, 64 nt, Homo Sapiens; identical to SEQ ID NO: 30604

SEQ ID NO: 402195 - RNA, 64 nt, Homo Sapiens; identical to SEQ ID NO: 30605

SEQ ID NO: 402196 - RNA, 64 nt, Homo Sapiens; identical to SEQ ID NO: 30606

SEQ ID NO: 402197 - RNA, 64 nt, Homo Sapiens; identical to SEQ ID NO: 30607

SEQ ID NO: 402198 - RNA, 64 nt, Homo Sapiens; identical to SEQ ID NO: 30608

SEQ ID NO: 402199 - RNA, 64 nt, Homo Sapiens; identical to SEQ ID NO: 30609

SEQ ID NO: 402200 - RNA, 64 nt, Homo Sapiens; identical to SEQ ID NO: 30610

SEQ ID NO: 402201 - RNA, 64 nt, Homo Sapiens; identical to SEQ ID NO: 30611

SEQ ID NO: 402202 - RNA, 64 nt, Homo Sapiens; identical to SEQ ID NO: 30612

SEQ ID NO: 402203 - RNA, 64 nt, Homo Sapiens; identical to SEQ ID NO: 30613

SEQ ID NO: 402204 - RNA, 64 nt, Homo Sapiens; identical to SEQ ID NO: 30614

SEQ ID NO: 402205 - RNA, 64 nt, Homo Sapiens; identical to SEQ ID NO: 30615

SEQ ID NO: 402206 - RNA, 64 nt, Homo Sapiens; identical to SEQ ID NO: 30616

SEQ ID NO: 402207 - RNA, 64 nt, Homo Sapiens; identical to SEQ ID NO: 30617

SEQ ID NO: 402208 - RNA, 64 nt, Homo Sapiens; identical to SEQ ID NO: 30618

SEQ ID NO: 402209 - RNA, 64 nt, Homo Sapiens; identical to SEQ ID NO: 30619

SEQ ID NO: 402210 - RNA, 64 nt, Homo Sapiens; identical to SEQ ID NO: 30620

SEQ ID NO: 402211 - RNA, 64 nt, Homo Sapiens; identical to SEQ ID NO: 30621

SEQ ID NO: 402212 - RNA, 64 nt, Homo Sapiens; identical to SEQ ID NO: 30622

SEQ ID NO: 402213 - RNA, 64 nt, Homo Sapiens; identical to SEQ ID NO: 30623

SEQ ID NO: 402214 - RNA, 64 nt, Homo Sapiens; identical to SEQ ID NO: 30624

SEQ ID NO: 402215 - RNA, 64 nt, Homo Sapiens; identical to SEQ ID NO: 30625

SEQ ID NO: 402216 - RNA, 64 nt, Homo Sapiens; identical to SEQ ID NO: 30626

SEQ ID NO: 402217 - RNA, 64 nt, Homo Sapiens; identical to SEQ ID NO: 30627

SEQ ID NO: 402218 - RNA, 64 nt, Homo Sapiens; identical to SEQ ID NO: 30628

SEQ ID NO: 402219 - RNA, 64 nt, Homo Sapiens; identical to SEQ ID NO: 30629

SEQ ID NO: 402220 - RNA, 64 nt, Homo Sapiens; identical to SEQ ID NO: 30630

SEQ ID NO: 402221 - RNA, 64 nt, Homo Sapiens; identical to SEQ ID NO: 30631

SEQ ID NO: 402222 - RNA, 64 nt, Homo Sapiens; identical to SEQ ID NO: 30632

SEQ ID NO: 402223 - RNA, 64 nt, Homo Sapiens; identical to SEQ ID NO: 30633

SEQ ID NO: 402224 - RNA, 64 nt, Homo Sapiens; identical to SEQ ID NO: 30634

SEQ ID NO: 402225 - RNA, 64 nt, Homo Sapiens; identical to SEQ ID NO: 30635

SEQ ID NO: 402226 - RNA, 64 nt, Homo Sapiens; identical to SEQ ID NO: 30636

SEQ ID NO: 402227 - RNA, 64 nt, Homo Sapiens; identical to SEQ ID NO: 30637

SEQ ID NO: 402228 - RNA, 64 nt, Homo Sapiens; identical to SEQ ID NO: 30638

SEQ ID NO: 402229 - RNA, 64 nt, Homo Sapiens; identical to SEQ ID NO: 30639

SEQ ID NO: 402230 - RNA, 64 nt, Homo Sapiens; identical to SEQ ID NO: 30640

SEQ ID NO: 402231 - RNA, 64 nt, Homo Sapiens; identical to SEQ ID NO: 30641

SEQ ID NO: 402232 - RNA, 64 nt, Homo Sapiens; identical to SEQ ID NO: 30642

SEQ ID NO: 402233 - RNA, 64 nt, Homo Sapiens; identical to SEQ ID NO: 30643

SEQ ID NO: 402234 - RNA, 64 nt, Homo Sapiens; identical to SEQ ID NO: 30644

SEQ ID NO: 402235 - RNA, 64 nt, Homo Sapiens; identical to SEQ ID NO: 30645

SEQ ID NO: 402236 - RNA, 64 nt, Homo Sapiens; identical to SEQ ID NO: 30646

SEQ ID NO: 402237 - RNA, 64 nt, Homo Sapiens; identical to SEQ ID NO: 30647

SEQ ID NO: 402238 - RNA, 64 nt, Homo Sapiens; identical to SEQ ID NO: 30648

SEQ ID NO: 402239 - RNA, 64 nt, Homo Sapiens; identical to SEQ ID NO: 30649

SEQ ID NO: 402240 - RNA, 64 nt, Homo Sapiens; identical to SEQ ID NO: 30650

SEQ ID NO: 402241 - RNA, 64 nt, Homo Sapiens; identical to SEQ ID NO: 30651

SEQ ID NO: 402242 - RNA, 64 nt, Homo Sapiens; identical to SEQ ID NO: 30652

SEQ ID NO: 402243 - RNA, 64 nt, Homo Sapiens; identical to SEQ ID NO: 30653

SEQ ID NO: 402244 - RNA, 64 nt, Homo Sapiens; identical to SEQ ID NO: 30654

SEQ ID NO: 402245 - RNA, 64 nt, Homo Sapiens; identical to SEQ ID NO: 30655

SEQ ID NO: 402246 - RNA, 64 nt, Homo Sapiens; identical to SEQ ID NO: 30656

SEQ ID NO: 402247 - RNA, 64 nt, Homo Sapiens; identical to SEQ ID NO: 30657

SEQ ID NO: 402248 - RNA, 64 nt, Homo Sapiens; identical to SEQ ID NO: 30658

SEQ ID NO: 402249 - RNA, 64 nt, Homo Sapiens; identical to SEQ ID NO: 30659

SEQ ID NO: 402250 - RNA, 64 nt, Homo Sapiens; identical to SEQ ID NO: 30660

SEQ ID NO: 402251 - RNA, 62 nt, Homo Sapiens; identical to SEQ ID NO: 30661

SEQ ID NO: 402252 - RNA, 63 nt, Homo Sapiens; identical to SEQ ID NO: 30662

SEQ ID NO: 402253 - RNA, 64 nt, Homo Sapiens; identical to SEQ ID NO: 30663

SEQ ID NO: 402254 - RNA, 64 nt, Homo Sapiens; identical to SEQ ID NO: 30664

SEQ ID NO: 402255 - RNA, 64 nt, Homo Sapiens; identical to SEQ ID NO: 30665

SEQ ID NO: 402256 - RNA, 64 nt, Homo Sapiens; identical to SEQ ID NO: 30666

SEQ ID NO: 402257 - RNA, 64 nt, Homo Sapiens; identical to SEQ ID NO: 30667

SEQ ID NO: 402258 - RNA, 64 nt, Homo Sapiens; identical to SEQ ID NO: 30668

SEQ ID NO: 402259 - RNA, 64 nt, Homo Sapiens; identical to SEQ ID NO: 30669

SEQ ID NO: 402260 - RNA, 64 nt, Homo Sapiens; identical to SEQ ID NO: 30670

SEQ ID NO: 402261 - RNA, 64 nt, Homo Sapiens; identical to SEQ ID NO: 30671

SEQ ID NO: 402262 - RNA, 64 nt, Homo Sapiens; identical to SEQ ID NO: 30672

SEQ ID NO: 402263 - RNA, 64 nt, Homo Sapiens; identical to SEQ ID NO: 30673

SEQ ID NO: 402264 - RNA, 64 nt, Homo Sapiens; identical to SEQ ID NO: 30674

SEQ ID NO: 402265 - RNA, 64 nt, Homo Sapiens; identical to SEQ ID NO: 30675

SEQ ID NO: 402266 - RNA, 64 nt, Homo Sapiens; identical to SEQ ID NO: 30676

SEQ ID NO: 402267 - RNA, 64 nt, Homo Sapiens; identical to SEQ ID NO: 30677

SEQ ID NO: 402268 - RNA, 64 nt, Homo Sapiens; identical to SEQ ID NO: 30678

SEQ ID NO: 402269 - RNA, 64 nt, Homo Sapiens; identical to SEQ ID NO: 30679

SEQ ID NO: 402270 - RNA, 64 nt, Homo Sapiens; identical to SEQ ID NO: 30680

SEQ ID NO: 402271 - RNA, 64 nt, Homo Sapiens; identical to SEQ ID NO: 30681

SEQ ID NO: 402272 - RNA, 64 nt, Homo Sapiens; identical to SEQ ID NO: 30682

SEQ ID NO: 402273 - RNA, 64 nt, Homo Sapiens; identical to SEQ ID NO: 30683

SEQ ID NO: 402274 - RNA, 64 nt, Homo Sapiens; identical to SEQ ID NO: 30684

SEQ ID NO: 402275 - RNA, 64 nt, Homo Sapiens; identical to SEQ ID NO: 30685

SEQ ID NO: 402276 - RNA, 64 nt, Homo Sapiens; identical to SEQ ID NO: 30686

SEQ ID NO: 402277 - RNA, 64 nt, Homo Sapiens; identical to SEQ ID NO: 30687

SEQ ID NO: 402278 - RNA, 64 nt, Homo Sapiens; identical to SEQ ID NO: 30688

SEQ ID NO: 402279 - RNA, 64 nt, Homo Sapiens; identical to SEQ ID NO: 30689

SEQ ID NO: 402280 - RNA, 64 nt, Homo Sapiens; identical to SEQ ID NO: 30690

SEQ ID NO: 402281 - RNA, 64 nt, Homo Sapiens; identical to SEQ ID NO: 30691

SEQ ID NO: 402282 - RNA, 64 nt, Homo Sapiens; identical to SEQ ID NO: 30692

SEQ ID NO: 402283 - RNA, 64 nt, Homo Sapiens; identical to SEQ ID NO: 30693

SEQ ID NO: 402284 - RNA, 64 nt, Homo Sapiens; identical to SEQ ID NO: 30694

SEQ ID NO: 402285 - RNA, 64 nt, Homo Sapiens; identical to SEQ ID NO: 30695

SEQ ID NO: 402286 - RNA, 64 nt, Homo Sapiens; identical to SEQ ID NO: 30696

SEQ ID NO: 402287 - RNA, 64 nt, Homo Sapiens; identical to SEQ ID NO: 30697

SEQ ID NO: 402288 - RNA, 64 nt, Homo Sapiens; identical to SEQ ID NO: 30698

SEQ ID NO: 402289 - RNA, 64 nt, Homo Sapiens; identical to SEQ ID NO: 30699

SEQ ID NO: 402290 - RNA, 64 nt, Homo Sapiens; identical to SEQ ID NO: 30700

SEQ ID NO: 402291 - RNA, 64 nt, Homo Sapiens; identical to SEQ ID NO: 30701

SEQ ID NO: 402292 - RNA, 64 nt, Homo Sapiens; identical to SEQ ID NO: 30702

SEQ ID NO: 402293 - RNA, 64 nt, Homo Sapiens; identical to SEQ ID NO: 30703

SEQ ID NO: 402294 - RNA, 64 nt, Homo Sapiens; identical to SEQ ID NO: 30704

SEQ ID NO: 402295 - RNA, 64 nt, Homo Sapiens; identical to SEQ ID NO: 30705

SEQ ID NO: 402296 - RNA, 64 nt, Homo Sapiens; identical to SEQ ID NO: 30706

SEQ ID NO: 402297 - RNA, 64 nt, Homo Sapiens; identical to SEQ ID NO: 30707

SEQ ID NO: 402298 - RNA, 64 nt, Homo Sapiens; identical to SEQ ID NO: 30708

SEQ ID NO: 402299 - RNA, 64 nt, Homo Sapiens; identical to SEQ ID NO: 30709

SEQ ID NO: 402300 - RNA, 64 nt, Homo Sapiens; identical to SEQ ID NO: 30710

SEQ ID NO: 402301 - RNA, 64 nt, Homo Sapiens; identical to SEQ ID NO: 30711

SEQ ID NO: 402302 - RNA, 64 nt, Homo Sapiens; identical to SEQ ID NO: 30712

SEQ ID NO: 402303 - RNA, 64 nt, Homo Sapiens; identical to SEQ ID NO: 30713

SEQ ID NO: 402304 - RNA, 64 nt, Homo Sapiens; identical to SEQ ID NO: 30714

SEQ ID NO: 402305 - RNA, 64 nt, Homo Sapiens; identical to SEQ ID NO: 30715

SEQ ID NO: 402306 - RNA, 64 nt, Homo Sapiens; identical to SEQ ID NO: 30716

SEQ ID NO: 402307 - RNA, 64 nt, Homo Sapiens; identical to SEQ ID NO: 30717

SEQ ID NO: 402308 - RNA, 64 nt, Homo Sapiens; identical to SEQ ID NO: 30718

SEQ ID NO: 402309 - RNA, 64 nt, Homo Sapiens; identical to SEQ ID NO: 30719

SEQ ID NO: 402310 - RNA, 64 nt, Homo Sapiens; identical to SEQ ID NO: 30720

SEQ ID NO: 402311 - RNA, 64 nt, Homo Sapiens; identical to SEQ ID NO: 30721

SEQ ID NO: 402312 - RNA, 58 nt, Homo Sapiens; identical to SEQ ID NO: 30722

SEQ ID NO: 402313 - RNA, 64 nt, Homo Sapiens; identical to SEQ ID NO: 30723

SEQ ID NO: 402314 - RNA, 64 nt, Homo Sapiens; identical to SEQ ID NO: 30724

SEQ ID NO: 402315 - RNA, 64 nt, Homo Sapiens; identical to SEQ ID NO: 30725

SEQ ID NO: 402316 - RNA, 64 nt, Homo Sapiens; identical to SEQ ID NO: 30726

SEQ ID NO: 402317 - RNA, 64 nt, Homo Sapiens; identical to SEQ ID NO: 30727

SEQ ID NO: 402318 - RNA, 64 nt, Homo Sapiens; identical to SEQ ID NO: 30728

SEQ ID NO: 402319 - RNA, 64 nt, Homo Sapiens; identical to SEQ ID NO: 30729

SEQ ID NO: 402320 - RNA, 64 nt, Homo Sapiens; identical to SEQ ID NO: 30730

SEQ ID NO: 402321 - RNA, 64 nt, Homo Sapiens; identical to SEQ ID NO: 30731

SEQ ID NO: 402322 - RNA, 64 nt, Homo Sapiens; identical to SEQ ID NO: 30732

SEQ ID NO: 402323 - RNA, 64 nt, Homo Sapiens; identical to SEQ ID NO: 30733

SEQ ID NO: 402324 - RNA, 64 nt, Homo Sapiens; identical to SEQ ID NO: 30734

SEQ ID NO: 402325 - RNA, 64 nt, Homo Sapiens; identical to SEQ ID NO: 30735

SEQ ID NO: 402326 - RNA, 64 nt, Homo Sapiens; identical to SEQ ID NO: 30736

SEQ ID NO: 402327 - RNA, 64 nt, Homo Sapiens; identical to SEQ ID NO: 30737

SEQ ID NO: 402328 - RNA, 64 nt, Homo Sapiens; identical to SEQ ID NO: 30738

SEQ ID NO: 402329 - RNA, 64 nt, Homo Sapiens; identical to SEQ ID NO: 30739

SEQ ID NO: 402330 - RNA, 64 nt, Homo Sapiens; identical to SEQ ID NO: 30740

SEQ ID NO: 402331 - RNA, 64 nt, Homo Sapiens; identical to SEQ ID NO: 30741

SEQ ID NO: 402332 - RNA, 64 nt, Homo Sapiens; identical to SEQ ID NO: 30742

SEQ ID NO: 402333 - RNA, 64 nt, Homo Sapiens; identical to SEQ ID NO: 30743

SEQ ID NO: 402334 - RNA, 64 nt, Homo Sapiens; identical to SEQ ID NO: 30744

SEQ ID NO: 402335 - RNA, 64 nt, Homo Sapiens; identical to SEQ ID NO: 30745

SEQ ID NO: 402336 - RNA, 64 nt, Homo Sapiens; identical to SEQ ID NO: 30746

SEQ ID NO: 402337 - RNA, 64 nt, Homo Sapiens; identical to SEQ ID NO: 30747

SEQ ID NO: 402338 - RNA, 64 nt, Homo Sapiens; identical to SEQ ID NO: 30748

SEQ ID NO: 402339 - RNA, 64 nt, Homo Sapiens; identical to SEQ ID NO: 30749

SEQ ID NO: 402340 - RNA, 64 nt, Homo Sapiens; identical to SEQ ID NO: 30750

SEQ ID NO: 402341 - RNA, 64 nt, Homo Sapiens; identical to SEQ ID NO: 30751

SEQ ID NO: 402342 - RNA, 64 nt, Homo Sapiens; identical to SEQ ID NO: 30752

SEQ ID NO: 402343 - RNA, 64 nt, Homo Sapiens; identical to SEQ ID NO: 30753

SEQ ID NO: 402344 - RNA, 64 nt, Homo Sapiens; identical to SEQ ID NO: 30754

SEQ ID NO: 402345 - RNA, 64 nt, Homo Sapiens; identical to SEQ ID NO: 30755

SEQ ID NO: 402346 - RNA, 64 nt, Homo Sapiens; identical to SEQ ID NO: 30756

SEQ ID NO: 402347 - RNA, 64 nt, Homo Sapiens; identical to SEQ ID NO: 30757

SEQ ID NO: 402348 - RNA, 64 nt, Homo Sapiens; identical to SEQ ID NO: 30758

SEQ ID NO: 402349 - RNA, 64 nt, Homo Sapiens; identical to SEQ ID NO: 30759

SEQ ID NO: 402350 - RNA, 64 nt, Homo Sapiens; identical to SEQ ID NO: 30760

SEQ ID NO: 402351 - RNA, 64 nt, Homo Sapiens; identical to SEQ ID NO: 30761

SEQ ID NO: 402352 - RNA, 64 nt, Homo Sapiens; identical to SEQ ID NO: 30762

SEQ ID NO: 402353 - RNA, 64 nt, Homo Sapiens; identical to SEQ ID NO: 30763

SEQ ID NO: 402354 - RNA, 64 nt, Homo Sapiens; identical to SEQ ID NO: 30764

SEQ ID NO: 402355 - RNA, 64 nt, Homo Sapiens; identical to SEQ ID NO: 30765

SEQ ID NO: 402356 - RNA, 64 nt, Homo Sapiens; identical to SEQ ID NO: 30766

SEQ ID NO: 402357 - RNA, 64 nt, Homo Sapiens; identical to SEQ ID NO: 30767

SEQ ID NO: 402358 - RNA, 64 nt, Homo Sapiens; identical to SEQ ID NO: 30768

SEQ ID NO: 402359 - RNA, 64 nt, Homo Sapiens; identical to SEQ ID NO: 30769

SEQ ID NO: 402360 - RNA, 64 nt, Homo Sapiens; identical to SEQ ID NO: 30770

SEQ ID NO: 402361 - RNA, 64 nt, Homo Sapiens; identical to SEQ ID NO: 30771

SEQ ID NO: 402362 - RNA, 64 nt, Homo Sapiens; identical to SEQ ID NO: 30772

SEQ ID NO: 402363 - RNA, 64 nt, Homo Sapiens; identical to SEQ ID NO: 30773

SEQ ID NO: 402364 - RNA, 64 nt, Homo Sapiens; identical to SEQ ID NO: 30774

SEQ ID NO: 402365 - RNA, 64 nt, Homo Sapiens; identical to SEQ ID NO: 30775

SEQ ID NO: 402366 - RNA, 64 nt, Homo Sapiens; identical to SEQ ID NO: 30776

SEQ ID NO: 402367 - RNA, 64 nt, Homo Sapiens; identical to SEQ ID NO: 30777

SEQ ID NO: 402368 - RNA, 64 nt, Homo Sapiens; identical to SEQ ID NO: 30778

SEQ ID NO: 402369 - RNA, 64 nt, Homo Sapiens; identical to SEQ ID NO: 30779

SEQ ID NO: 402370 - RNA, 64 nt, Homo Sapiens; identical to SEQ ID NO: 30780

SEQ ID NO: 402371 - RNA, 64 nt, Homo Sapiens; identical to SEQ ID NO: 30781

SEQ ID NO: 402372 - RNA, 64 nt, Homo Sapiens; identical to SEQ ID NO: 30782

SEQ ID NO: 402373 - RNA, 64 nt, Homo Sapiens; identical to SEQ ID NO: 30783

SEQ ID NO: 402374 - RNA, 64 nt, Homo Sapiens; identical to SEQ ID NO: 30784

SEQ ID NO: 402375 - RNA, 64 nt, Homo Sapiens; identical to SEQ ID NO: 30785

SEQ ID NO: 402376 - RNA, 64 nt, Homo Sapiens; identical to SEQ ID NO: 30786

SEQ ID NO: 402377 - RNA, 64 nt, Homo Sapiens; identical to SEQ ID NO: 30787

SEQ ID NO: 402378 - RNA, 64 nt, Homo Sapiens; identical to SEQ ID NO: 30788

SEQ ID NO: 402379 - RNA, 64 nt, Homo Sapiens; identical to SEQ ID NO: 30789

SEQ ID NO: 402380 - RNA, 64 nt, Homo Sapiens; identical to SEQ ID NO: 30790

SEQ ID NO: 402381 - RNA, 64 nt, Homo Sapiens; identical to SEQ ID NO: 30791

SEQ ID NO: 402382 - RNA, 64 nt, Homo Sapiens; identical to SEQ ID NO: 30792

SEQ ID NO: 402383 - RNA, 64 nt, Homo Sapiens; identical to SEQ ID NO: 30793

SEQ ID NO: 402384 - RNA, 64 nt, Homo Sapiens; identical to SEQ ID NO: 30794

SEQ ID NO: 402385 - RNA, 64 nt, Homo Sapiens; identical to SEQ ID NO: 30795

SEQ ID NO: 402386 - RNA, 64 nt, Homo Sapiens; identical to SEQ ID NO: 30796

SEQ ID NO: 402387 - RNA, 64 nt, Homo Sapiens; identical to SEQ ID NO: 30797

SEQ ID NO: 402388 - RNA, 64 nt, Homo Sapiens; identical to SEQ ID NO: 30798

SEQ ID NO: 402389 - RNA, 64 nt, Homo Sapiens; identical to SEQ ID NO: 30799

SEQ ID NO: 402390 - RNA, 64 nt, Homo Sapiens; identical to SEQ ID NO: 30800

SEQ ID NO: 402391 - RNA, 64 nt, Homo Sapiens; identical to SEQ ID NO: 30801

SEQ ID NO: 402392 - RNA, 64 nt, Homo Sapiens; identical to SEQ ID NO: 30802

SEQ ID NO: 402393 - RNA, 64 nt, Homo Sapiens; identical to SEQ ID NO: 30803

SEQ ID NO: 402394 - RNA, 64 nt, Homo Sapiens; identical to SEQ ID NO: 30804

SEQ ID NO: 402395 - RNA, 64 nt, Homo Sapiens; identical to SEQ ID NO: 30805

SEQ ID NO: 402396 - RNA, 64 nt, Homo Sapiens; identical to SEQ ID NO: 30806

SEQ ID NO: 402397 - RNA, 64 nt, Homo Sapiens; identical to SEQ ID NO: 30807

SEQ ID NO: 402398 - RNA, 64 nt, Homo Sapiens; identical to SEQ ID NO: 30808

SEQ ID NO: 402399 - RNA, 64 nt, Homo Sapiens; identical to SEQ ID NO: 30809

SEQ ID NO: 402400 - RNA, 64 nt, Homo Sapiens; identical to SEQ ID NO: 30810

SEQ ID NO: 402401 - RNA, 64 nt, Homo Sapiens; identical to SEQ ID NO: 30811

SEQ ID NO: 402402 - RNA, 64 nt, Homo Sapiens; identical to SEQ ID NO: 30812

SEQ ID NO: 402403 - RNA, 64 nt, Homo Sapiens; identical to SEQ ID NO: 30813

SEQ ID NO: 402404 - RNA, 64 nt, Homo Sapiens; identical to SEQ ID NO: 30814

SEQ ID NO: 402405 - RNA, 64 nt, Homo Sapiens; identical to SEQ ID NO: 30815

SEQ ID NO: 402406 - RNA, 64 nt, Homo Sapiens; identical to SEQ ID NO: 30816

SEQ ID NO: 402407 - RNA, 64 nt, Homo Sapiens; identical to SEQ ID NO: 30817

SEQ ID NO: 402408 - RNA, 64 nt, Homo Sapiens; identical to SEQ ID NO: 30818

SEQ ID NO: 402409 - RNA, 64 nt, Homo Sapiens; identical to SEQ ID NO: 30819

SEQ ID NO: 402410 - RNA, 64 nt, Homo Sapiens; identical to SEQ ID NO: 30820

SEQ ID NO: 402411 - RNA, 64 nt, Homo Sapiens; identical to SEQ ID NO: 30821

SEQ ID NO: 402412 - RNA, 64 nt, Homo Sapiens; identical to SEQ ID NO: 30822

SEQ ID NO: 402413 - RNA, 64 nt, Homo Sapiens; identical to SEQ ID NO: 30823

SEQ ID NO: 402414 - RNA, 64 nt, Homo Sapiens; identical to SEQ ID NO: 30824

SEQ ID NO: 402415 - RNA, 64 nt, Homo Sapiens; identical to SEQ ID NO: 30825

SEQ ID NO: 402416 - RNA, 64 nt, Homo Sapiens; identical to SEQ ID NO: 30826

SEQ ID NO: 402417 - RNA, 64 nt, Homo Sapiens; identical to SEQ ID NO: 30827

SEQ ID NO: 402418 - RNA, 64 nt, Homo Sapiens; identical to SEQ ID NO: 30828

SEQ ID NO: 402419 - RNA, 64 nt, Homo Sapiens; identical to SEQ ID NO: 30829

SEQ ID NO: 402420 - RNA, 64 nt, Homo Sapiens; identical to SEQ ID NO: 30830

SEQ ID NO: 402421 - RNA, 64 nt, Homo Sapiens; identical to SEQ ID NO: 30831

SEQ ID NO: 402422 - RNA, 64 nt, Homo Sapiens; identical to SEQ ID NO: 30832

SEQ ID NO: 402423 - RNA, 64 nt, Homo Sapiens; identical to SEQ ID NO: 30833

SEQ ID NO: 402424 - RNA, 64 nt, Homo Sapiens; identical to SEQ ID NO: 30834

SEQ ID NO: 402425 - RNA, 64 nt, Homo Sapiens; identical to SEQ ID NO: 30835

SEQ ID NO: 402426 - RNA, 64 nt, Homo Sapiens; identical to SEQ ID NO: 30836

SEQ ID NO: 402427 - RNA, 64 nt, Homo Sapiens; identical to SEQ ID NO: 30837

SEQ ID NO: 402428 - RNA, 64 nt, Homo Sapiens; identical to SEQ ID NO: 30838

SEQ ID NO: 402429 - RNA, 64 nt, Homo Sapiens; identical to SEQ ID NO: 30839

SEQ ID NO: 402430 - RNA, 64 nt, Homo Sapiens; identical to SEQ ID NO: 30840

SEQ ID NO: 402431 - RNA, 64 nt, Homo Sapiens; identical to SEQ ID NO: 30841

SEQ ID NO: 402432 - RNA, 64 nt, Homo Sapiens; identical to SEQ ID NO: 30842

SEQ ID NO: 402433 - RNA, 64 nt, Homo Sapiens; identical to SEQ ID NO: 30843

SEQ ID NO: 402434 - RNA, 64 nt, Homo Sapiens; identical to SEQ ID NO: 30844

SEQ ID NO: 402435 - RNA, 64 nt, Homo Sapiens; identical to SEQ ID NO: 30845

SEQ ID NO: 402436 - RNA, 64 nt, Homo Sapiens; identical to SEQ ID NO: 30846

SEQ ID NO: 402437 - RNA, 64 nt, Homo Sapiens; identical to SEQ ID NO: 30847

SEQ ID NO: 402438 - RNA, 64 nt, Homo Sapiens; identical to SEQ ID NO: 30848

SEQ ID NO: 402439 - RNA, 64 nt, Homo Sapiens; identical to SEQ ID NO: 30849

SEQ ID NO: 402440 - RNA, 64 nt, Homo Sapiens; identical to SEQ ID NO: 30850

SEQ ID NO: 402441 - RNA, 64 nt, Homo Sapiens; identical to SEQ ID NO: 30851

SEQ ID NO: 402442 - RNA, 64 nt, Homo Sapiens; identical to SEQ ID NO: 30852

SEQ ID NO: 402443 - RNA, 64 nt, Homo Sapiens; identical to SEQ ID NO: 30853

SEQ ID NO: 402444 - RNA, 64 nt, Homo Sapiens; identical to SEQ ID NO: 30854

SEQ ID NO: 402445 - RNA, 64 nt, Homo Sapiens; identical to SEQ ID NO: 30855

SEQ ID NO: 402446 - RNA, 64 nt, Homo Sapiens; identical to SEQ ID NO: 30856

SEQ ID NO: 402447 - RNA, 64 nt, Homo Sapiens; identical to SEQ ID NO: 30857

SEQ ID NO: 402448 - RNA, 64 nt, Homo Sapiens; identical to SEQ ID NO: 30858

SEQ ID NO: 402449 - RNA, 64 nt, Homo Sapiens; identical to SEQ ID NO: 30859

SEQ ID NO: 402450 - RNA, 64 nt, Homo Sapiens; identical to SEQ ID NO: 30860

SEQ ID NO: 402451 - RNA, 64 nt, Homo Sapiens; identical to SEQ ID NO: 30861

SEQ ID NO: 402452 - RNA, 64 nt, Homo Sapiens; identical to SEQ ID NO: 30862

SEQ ID NO: 402453 - RNA, 64 nt, Homo Sapiens; identical to SEQ ID NO: 30863

SEQ ID NO: 402454 - RNA, 64 nt, Homo Sapiens; identical to SEQ ID NO: 30864

SEQ ID NO: 402455 - RNA, 64 nt, Homo Sapiens; identical to SEQ ID NO: 30865

SEQ ID NO: 402456 - RNA, 64 nt, Homo Sapiens; identical to SEQ ID NO: 30866

SEQ ID NO: 402457 - RNA, 64 nt, Homo Sapiens; identical to SEQ ID NO: 30867

SEQ ID NO: 402458 - RNA, 64 nt, Homo Sapiens; identical to SEQ ID NO: 30868

SEQ ID NO: 402459 - RNA, 64 nt, Homo Sapiens; identical to SEQ ID NO: 30869

SEQ ID NO: 402460 - RNA, 64 nt, Homo Sapiens; identical to SEQ ID NO: 30870

SEQ ID NO: 402461 - RNA, 64 nt, Homo Sapiens; identical to SEQ ID NO: 30871

SEQ ID NO: 402462 - RNA, 64 nt, Homo Sapiens; identical to SEQ ID NO: 30872

SEQ ID NO: 402463 - RNA, 64 nt, Homo Sapiens; identical to SEQ ID NO: 30873

SEQ ID NO: 402464 - RNA, 64 nt, Homo Sapiens; identical to SEQ ID NO: 30874

SEQ ID NO: 402465 - RNA, 64 nt, Homo Sapiens; identical to SEQ ID NO: 30875

SEQ ID NO: 402466 - RNA, 64 nt, Homo Sapiens; identical to SEQ ID NO: 30876

SEQ ID NO: 402467 - RNA, 64 nt, Homo Sapiens; identical to SEQ ID NO: 30877

SEQ ID NO: 402468 - RNA, 64 nt, Homo Sapiens; identical to SEQ ID NO: 30878

SEQ ID NO: 402469 - RNA, 64 nt, Homo Sapiens; identical to SEQ ID NO: 30879

SEQ ID NO: 402470 - RNA, 64 nt, Homo Sapiens; identical to SEQ ID NO: 30880

SEQ ID NO: 402471 - RNA, 64 nt, Homo Sapiens; identical to SEQ ID NO: 30881

SEQ ID NO: 402472 - RNA, 64 nt, Homo Sapiens; identical to SEQ ID NO: 30882

SEQ ID NO: 402473 - RNA, 64 nt, Homo Sapiens; identical to SEQ ID NO: 30883

SEQ ID NO: 402474 - RNA, 64 nt, Homo Sapiens; identical to SEQ ID NO: 30884

SEQ ID NO: 402475 - RNA, 64 nt, Homo Sapiens; identical to SEQ ID NO: 30885

SEQ ID NO: 402476 - RNA, 64 nt, Homo Sapiens; identical to SEQ ID NO: 30886

SEQ ID NO: 402477 - RNA, 64 nt, Homo Sapiens; identical to SEQ ID NO: 30887

SEQ ID NO: 402478 - RNA, 64 nt, Homo Sapiens; identical to SEQ ID NO: 30888

SEQ ID NO: 402479 - RNA, 64 nt, Homo Sapiens; identical to SEQ ID NO: 30889

SEQ ID NO: 402480 - RNA, 64 nt, Homo Sapiens; identical to SEQ ID NO: 30890

SEQ ID NO: 402481 - RNA, 64 nt, Homo Sapiens; identical to SEQ ID NO: 30891

SEQ ID NO: 402482 - RNA, 64 nt, Homo Sapiens; identical to SEQ ID NO: 30892

SEQ ID NO: 402483 - RNA, 64 nt, Homo Sapiens; identical to SEQ ID NO: 30893

SEQ ID NO: 402484 - RNA, 64 nt, Homo Sapiens; identical to SEQ ID NO: 30894

SEQ ID NO: 402485 - RNA, 64 nt, Homo Sapiens; identical to SEQ ID NO: 30895

SEQ ID NO: 402486 - RNA, 64 nt, Homo Sapiens; identical to SEQ ID NO: 30896

SEQ ID NO: 402487 - RNA, 64 nt, Homo Sapiens; identical to SEQ ID NO: 30897

SEQ ID NO: 402488 - RNA, 64 nt, Homo Sapiens; identical to SEQ ID NO: 30898

SEQ ID NO: 402489 - RNA, 64 nt, Homo Sapiens; identical to SEQ ID NO: 30899

SEQ ID NO: 402490 - RNA, 64 nt, Homo Sapiens; identical to SEQ ID NO: 30900

SEQ ID NO: 402491 - RNA, 64 nt, Homo Sapiens; identical to SEQ ID NO: 30901

SEQ ID NO: 402492 - RNA, 64 nt, Homo Sapiens; identical to SEQ ID NO: 30902

SEQ ID NO: 402493 - RNA, 64 nt, Homo Sapiens; identical to SEQ ID NO: 30903

SEQ ID NO: 402494 - RNA, 64 nt, Homo Sapiens; identical to SEQ ID NO: 30904

SEQ ID NO: 402495 - RNA, 64 nt, Homo Sapiens; identical to SEQ ID NO: 30905

SEQ ID NO: 402496 - RNA, 64 nt, Homo Sapiens; identical to SEQ ID NO: 30906

SEQ ID NO: 402497 - RNA, 64 nt, Homo Sapiens; identical to SEQ ID NO: 30907

SEQ ID NO: 402498 - RNA, 64 nt, Homo Sapiens; identical to SEQ ID NO: 30908

SEQ ID NO: 402499 - RNA, 64 nt, Homo Sapiens; identical to SEQ ID NO: 30909

SEQ ID NO: 402500 - RNA, 64 nt, Homo Sapiens; identical to SEQ ID NO: 30910

SEQ ID NO: 402501 - RNA, 64 nt, Homo Sapiens; identical to SEQ ID NO: 30911

SEQ ID NO: 402502 - RNA, 64 nt, Homo Sapiens; identical to SEQ ID NO: 30912

SEQ ID NO: 402503 - RNA, 64 nt, Homo Sapiens; identical to SEQ ID NO: 30913

SEQ ID NO: 402504 - RNA, 64 nt, Homo Sapiens; identical to SEQ ID NO: 30914

SEQ ID NO: 402505 - RNA, 64 nt, Homo Sapiens; identical to SEQ ID NO: 30915

SEQ ID NO: 402506 - RNA, 64 nt, Homo Sapiens; identical to SEQ ID NO: 30916

SEQ ID NO: 402507 - RNA, 64 nt, Homo Sapiens; identical to SEQ ID NO: 30917

SEQ ID NO: 402508 - RNA, 64 nt, Homo Sapiens; identical to SEQ ID NO: 30918

SEQ ID NO: 402509 - RNA, 64 nt, Homo Sapiens; identical to SEQ ID NO: 30919

SEQ ID NO: 402510 - RNA, 64 nt, Homo Sapiens; identical to SEQ ID NO: 30920

SEQ ID NO: 402511 - RNA, 64 nt, Homo Sapiens; identical to SEQ ID NO: 30921

SEQ ID NO: 402512 - RNA, 64 nt, Homo Sapiens; identical to SEQ ID NO: 30922

SEQ ID NO: 402513 - RNA, 64 nt, Homo Sapiens; identical to SEQ ID NO: 30923

SEQ ID NO: 402514 - RNA, 64 nt, Homo Sapiens; identical to SEQ ID NO: 30924

SEQ ID NO: 402515 - RNA, 64 nt, Homo Sapiens; identical to SEQ ID NO: 30925

SEQ ID NO: 402516 - RNA, 64 nt, Homo Sapiens; identical to SEQ ID NO: 30926

SEQ ID NO: 402517 - RNA, 64 nt, Homo Sapiens; identical to SEQ ID NO: 30927

SEQ ID NO: 402518 - RNA, 64 nt, Homo Sapiens; identical to SEQ ID NO: 30928

SEQ ID NO: 402519 - RNA, 64 nt, Homo Sapiens; identical to SEQ ID NO: 30929

SEQ ID NO: 402520 - RNA, 64 nt, Homo Sapiens; identical to SEQ ID NO: 30930

SEQ ID NO: 402521 - RNA, 64 nt, Homo Sapiens; identical to SEQ ID NO: 30931

SEQ ID NO: 402522 - RNA, 64 nt, Homo Sapiens; identical to SEQ ID NO: 30932

SEQ ID NO: 402523 - RNA, 64 nt, Homo Sapiens; identical to SEQ ID NO: 30933

SEQ ID NO: 402524 - RNA, 64 nt, Homo Sapiens; identical to SEQ ID NO: 30934

SEQ ID NO: 402525 - RNA, 64 nt, Homo Sapiens; identical to SEQ ID NO: 30935

SEQ ID NO: 402526 - RNA, 64 nt, Homo Sapiens; identical to SEQ ID NO: 30936

SEQ ID NO: 402527 - RNA, 64 nt, Homo Sapiens; identical to SEQ ID NO: 30937

SEQ ID NO: 402528 - RNA, 64 nt, Homo Sapiens; identical to SEQ ID NO: 30938

SEQ ID NO: 402529 - RNA, 64 nt, Homo Sapiens; identical to SEQ ID NO: 30939

SEQ ID NO: 402530 - RNA, 64 nt, Homo Sapiens; identical to SEQ ID NO: 30940

SEQ ID NO: 402531 - RNA, 64 nt, Homo Sapiens; identical to SEQ ID NO: 30941

SEQ ID NO: 402532 - RNA, 64 nt, Homo Sapiens; identical to SEQ ID NO: 30942

SEQ ID NO: 402533 - RNA, 64 nt, Homo Sapiens; identical to SEQ ID NO: 30943

SEQ ID NO: 402534 - RNA, 64 nt, Homo Sapiens; identical to SEQ ID NO: 30944

SEQ ID NO: 402535 - RNA, 64 nt, Homo Sapiens; identical to SEQ ID NO: 30945

SEQ ID NO: 402536 - RNA, 64 nt, Homo Sapiens; identical to SEQ ID NO: 30946

SEQ ID NO: 402537 - RNA, 64 nt, Homo Sapiens; identical to SEQ ID NO: 30947

SEQ ID NO: 402538 - RNA, 64 nt, Homo Sapiens; identical to SEQ ID NO: 30948

SEQ ID NO: 402539 - RNA, 64 nt, Homo Sapiens; identical to SEQ ID NO: 30949

SEQ ID NO: 402540 - RNA, 64 nt, Homo Sapiens; identical to SEQ ID NO: 30950

SEQ ID NO: 402541 - RNA, 64 nt, Homo Sapiens; identical to SEQ ID NO: 30951

SEQ ID NO: 402542 - RNA, 64 nt, Homo Sapiens; identical to SEQ ID NO: 30952

SEQ ID NO: 402543 - RNA, 64 nt, Homo Sapiens; identical to SEQ ID NO: 30953

SEQ ID NO: 402544 - RNA, 64 nt, Homo Sapiens; identical to SEQ ID NO: 30954

SEQ ID NO: 402545 - RNA, 64 nt, Homo Sapiens; identical to SEQ ID NO: 30955

SEQ ID NO: 402546 - RNA, 64 nt, Homo Sapiens; identical to SEQ ID NO: 30956

SEQ ID NO: 402547 - RNA, 64 nt, Homo Sapiens; identical to SEQ ID NO: 30957

SEQ ID NO: 402548 - RNA, 64 nt, Homo Sapiens; identical to SEQ ID NO: 30958

SEQ ID NO: 402549 - RNA, 64 nt, Homo Sapiens; identical to SEQ ID NO: 30959

SEQ ID NO: 402550 - RNA, 64 nt, Homo Sapiens; identical to SEQ ID NO: 30960

SEQ ID NO: 402551 - RNA, 64 nt, Homo Sapiens; identical to SEQ ID NO: 30961

SEQ ID NO: 402552 - RNA, 64 nt, Homo Sapiens; identical to SEQ ID NO: 30962

SEQ ID NO: 402553 - RNA, 64 nt, Homo Sapiens; identical to SEQ ID NO: 30963

SEQ ID NO: 402554 - RNA, 64 nt, Homo Sapiens; identical to SEQ ID NO: 30964

SEQ ID NO: 402555 - RNA, 64 nt, Homo Sapiens; identical to SEQ ID NO: 30965

SEQ ID NO: 402556 - RNA, 64 nt, Homo Sapiens; identical to SEQ ID NO: 30966

SEQ ID NO: 402557 - RNA, 64 nt, Homo Sapiens; identical to SEQ ID NO: 30967

SEQ ID NO: 402558 - RNA, 64 nt, Homo Sapiens; identical to SEQ ID NO: 30968

SEQ ID NO: 402559 - RNA, 64 nt, Homo Sapiens; identical to SEQ ID NO: 30969

SEQ ID NO: 402560 - RNA, 64 nt, Homo Sapiens; identical to SEQ ID NO: 30970

SEQ ID NO: 402561 - RNA, 64 nt, Homo Sapiens; identical to SEQ ID NO: 30971

SEQ ID NO: 402562 - RNA, 64 nt, Homo Sapiens; identical to SEQ ID NO: 30972

SEQ ID NO: 402563 - RNA, 64 nt, Homo Sapiens; identical to SEQ ID NO: 30973

SEQ ID NO: 402564 - RNA, 64 nt, Homo Sapiens; identical to SEQ ID NO: 30974

SEQ ID NO: 402565 - RNA, 64 nt, Homo Sapiens; identical to SEQ ID NO: 30975

SEQ ID NO: 402566 - RNA, 64 nt, Homo Sapiens; identical to SEQ ID NO: 30976

SEQ ID NO: 402567 - RNA, 64 nt, Homo Sapiens; identical to SEQ ID NO: 30977

SEQ ID NO: 402568 - RNA, 64 nt, Homo Sapiens; identical to SEQ ID NO: 30978

SEQ ID NO: 402569 - RNA, 64 nt, Homo Sapiens; identical to SEQ ID NO: 30979

SEQ ID NO: 402570 - RNA, 64 nt, Homo Sapiens; identical to SEQ ID NO: 30980

SEQ ID NO: 402571 - RNA, 64 nt, Homo Sapiens; identical to SEQ ID NO: 30981

SEQ ID NO: 402572 - RNA, 64 nt, Homo Sapiens; identical to SEQ ID NO: 30982

SEQ ID NO: 402573 - RNA, 64 nt, Homo Sapiens; identical to SEQ ID NO: 30983

SEQ ID NO: 402574 - RNA, 64 nt, Homo Sapiens; identical to SEQ ID NO: 30984

SEQ ID NO: 402575 - RNA, 60 nt, Homo Sapiens; identical to SEQ ID NO: 30985

SEQ ID NO: 402576 - RNA, 61 nt, Homo Sapiens; identical to SEQ ID NO: 30986

SEQ ID NO: 402577 - RNA, 64 nt, Homo Sapiens; identical to SEQ ID NO: 30987

SEQ ID NO: 402578 - RNA, 64 nt, Homo Sapiens; identical to SEQ ID NO: 30988

SEQ ID NO: 402579 - RNA, 64 nt, Homo Sapiens; identical to SEQ ID NO: 30989

SEQ ID NO: 402580 - RNA, 64 nt, Homo Sapiens; identical to SEQ ID NO: 30990

SEQ ID NO: 402581 - RNA, 64 nt, Homo Sapiens; identical to SEQ ID NO: 30991

SEQ ID NO: 402582 - RNA, 64 nt, Homo Sapiens; identical to SEQ ID NO: 30992

SEQ ID NO: 402583 - RNA, 64 nt, Homo Sapiens; identical to SEQ ID NO: 30993

SEQ ID NO: 402584 - RNA, 64 nt, Homo Sapiens; identical to SEQ ID NO: 30994

SEQ ID NO: 402585 - RNA, 64 nt, Homo Sapiens; identical to SEQ ID NO: 30995

SEQ ID NO: 402586 - RNA, 64 nt, Homo Sapiens; identical to SEQ ID NO: 30996

SEQ ID NO: 402587 - RNA, 64 nt, Homo Sapiens; identical to SEQ ID NO: 30997

SEQ ID NO: 402588 - RNA, 64 nt, Homo Sapiens; identical to SEQ ID NO: 30998

SEQ ID NO: 402589 - RNA, 64 nt, Homo Sapiens; identical to SEQ ID NO: 30999

SEQ ID NO: 402590 - RNA, 64 nt, Homo Sapiens; identical to SEQ ID NO: 31000

SEQ ID NO: 402591 - RNA, 64 nt, Homo Sapiens; identical to SEQ ID NO: 31001

SEQ ID NO: 402592 - RNA, 64 nt, Homo Sapiens; identical to SEQ ID NO: 31002

SEQ ID NO: 402593 - RNA, 64 nt, Homo Sapiens; identical to SEQ ID NO: 31003

SEQ ID NO: 402594 - RNA, 64 nt, Homo Sapiens; identical to SEQ ID NO: 31004

SEQ ID NO: 402595 - RNA, 64 nt, Homo Sapiens; identical to SEQ ID NO: 31005

SEQ ID NO: 402596 - RNA, 64 nt, Homo Sapiens; identical to SEQ ID NO: 31006

SEQ ID NO: 402597 - RNA, 64 nt, Homo Sapiens; identical to SEQ ID NO: 31007

SEQ ID NO: 402598 - RNA, 64 nt, Homo Sapiens; identical to SEQ ID NO: 31008

SEQ ID NO: 402599 - RNA, 64 nt, Homo Sapiens; identical to SEQ ID NO: 31009

SEQ ID NO: 402600 - RNA, 64 nt, Homo Sapiens; identical to SEQ ID NO: 31010

SEQ ID NO: 402601 - RNA, 64 nt, Homo Sapiens; identical to SEQ ID NO: 31011

SEQ ID NO: 402602 - RNA, 64 nt, Homo Sapiens; identical to SEQ ID NO: 31012

SEQ ID NO: 402603 - RNA, 64 nt, Homo Sapiens; identical to SEQ ID NO: 31013

SEQ ID NO: 402604 - RNA, 64 nt, Homo Sapiens; identical to SEQ ID NO: 31014

SEQ ID NO: 402605 - RNA, 64 nt, Homo Sapiens; identical to SEQ ID NO: 31015

SEQ ID NO: 402606 - RNA, 64 nt, Homo Sapiens; identical to SEQ ID NO: 31016

SEQ ID NO: 402607 - RNA, 64 nt, Homo Sapiens; identical to SEQ ID NO: 31017

SEQ ID NO: 402608 - RNA, 64 nt, Homo Sapiens; identical to SEQ ID NO: 31018

SEQ ID NO: 402609 - RNA, 64 nt, Homo Sapiens; identical to SEQ ID NO: 31019

SEQ ID NO: 402610 - RNA, 64 nt, Homo Sapiens; identical to SEQ ID NO: 31020

SEQ ID NO: 402611 - RNA, 64 nt, Homo Sapiens; identical to SEQ ID NO: 31021

SEQ ID NO: 402612 - RNA, 64 nt, Homo Sapiens; identical to SEQ ID NO: 31022

SEQ ID NO: 402613 - RNA, 64 nt, Homo Sapiens; identical to SEQ ID NO: 31023

SEQ ID NO: 402614 - RNA, 64 nt, Homo Sapiens; identical to SEQ ID NO: 31024

SEQ ID NO: 402615 - RNA, 64 nt, Homo Sapiens; identical to SEQ ID NO: 31025

SEQ ID NO: 402616 - RNA, 64 nt, Homo Sapiens; identical to SEQ ID NO: 31026

SEQ ID NO: 402617 - RNA, 64 nt, Homo Sapiens; identical to SEQ ID NO: 31027

SEQ ID NO: 402618 - RNA, 64 nt, Homo Sapiens; identical to SEQ ID NO: 31028

SEQ ID NO: 402619 - RNA, 64 nt, Homo Sapiens; identical to SEQ ID NO: 31029

SEQ ID NO: 402620 - RNA, 64 nt, Homo Sapiens; identical to SEQ ID NO: 31030

SEQ ID NO: 402621 - RNA, 64 nt, Homo Sapiens; identical to SEQ ID NO: 31031

SEQ ID NO: 402622 - RNA, 64 nt, Homo Sapiens; identical to SEQ ID NO: 31032

SEQ ID NO: 402623 - RNA, 64 nt, Homo Sapiens; identical to SEQ ID NO: 31033

SEQ ID NO: 402624 - RNA, 64 nt, Homo Sapiens; identical to SEQ ID NO: 31034

SEQ ID NO: 402625 - RNA, 64 nt, Homo Sapiens; identical to SEQ ID NO: 31035

SEQ ID NO: 402626 - RNA, 64 nt, Homo Sapiens; identical to SEQ ID NO: 31036

SEQ ID NO: 402627 - RNA, 64 nt, Homo Sapiens; identical to SEQ ID NO: 31037

SEQ ID NO: 402628 - RNA, 64 nt, Homo Sapiens; identical to SEQ ID NO: 31038

SEQ ID NO: 402629 - RNA, 64 nt, Homo Sapiens; identical to SEQ ID NO: 31039

SEQ ID NO: 402630 - RNA, 64 nt, Homo Sapiens; identical to SEQ ID NO: 31040

SEQ ID NO: 402631 - RNA, 64 nt, Homo Sapiens; identical to SEQ ID NO: 31041

SEQ ID NO: 402632 - RNA, 64 nt, Homo Sapiens; identical to SEQ ID NO: 31042

SEQ ID NO: 402633 - RNA, 64 nt, Homo Sapiens; identical to SEQ ID NO: 31043

SEQ ID NO: 402634 - RNA, 64 nt, Homo Sapiens; identical to SEQ ID NO: 31044

SEQ ID NO: 402635 - RNA, 64 nt, Homo Sapiens; identical to SEQ ID NO: 31045

SEQ ID NO: 402636 - RNA, 64 nt, Homo Sapiens; identical to SEQ ID NO: 31046

SEQ ID NO: 402637 - RNA, 64 nt, Homo Sapiens; identical to SEQ ID NO: 31047

SEQ ID NO: 402638 - RNA, 64 nt, Homo Sapiens; identical to SEQ ID NO: 31048

SEQ ID NO: 402639 - RNA, 64 nt, Homo Sapiens; identical to SEQ ID NO: 31049

SEQ ID NO: 402640 - RNA, 64 nt, Homo Sapiens; identical to SEQ ID NO: 31050

SEQ ID NO: 402641 - RNA, 64 nt, Homo Sapiens; identical to SEQ ID NO: 31051

SEQ ID NO: 402642 - RNA, 64 nt, Homo Sapiens; identical to SEQ ID NO: 31052

SEQ ID NO: 402643 - RNA, 64 nt, Homo Sapiens; identical to SEQ ID NO: 31053

SEQ ID NO: 402644 - RNA, 64 nt, Homo Sapiens; identical to SEQ ID NO: 31054

SEQ ID NO: 402645 - RNA, 64 nt, Homo Sapiens; identical to SEQ ID NO: 31055

SEQ ID NO: 402646 - RNA, 64 nt, Homo Sapiens; identical to SEQ ID NO: 31056

SEQ ID NO: 402647 - RNA, 64 nt, Homo Sapiens; identical to SEQ ID NO: 31057

SEQ ID NO: 402648 - RNA, 64 nt, Homo Sapiens; identical to SEQ ID NO: 31058

SEQ ID NO: 402649 - RNA, 64 nt, Homo Sapiens; identical to SEQ ID NO: 31059

SEQ ID NO: 402650 - RNA, 64 nt, Homo Sapiens; identical to SEQ ID NO: 31060

SEQ ID NO: 402651 - RNA, 64 nt, Homo Sapiens; identical to SEQ ID NO: 31061

SEQ ID NO: 402652 - RNA, 64 nt, Homo Sapiens; identical to SEQ ID NO: 31062

SEQ ID NO: 402653 - RNA, 64 nt, Homo Sapiens; identical to SEQ ID NO: 31063

SEQ ID NO: 402654 - RNA, 64 nt, Homo Sapiens; identical to SEQ ID NO: 31064

SEQ ID NO: 402655 - RNA, 64 nt, Homo Sapiens; identical to SEQ ID NO: 31065

SEQ ID NO: 402656 - RNA, 64 nt, Homo Sapiens; identical to SEQ ID NO: 31066

SEQ ID NO: 402657 - RNA, 64 nt, Homo Sapiens; identical to SEQ ID NO: 31067

SEQ ID NO: 402658 - RNA, 64 nt, Homo Sapiens; identical to SEQ ID NO: 31068

SEQ ID NO: 402659 - RNA, 64 nt, Homo Sapiens; identical to SEQ ID NO: 31069

SEQ ID NO: 402660 - RNA, 64 nt, Homo Sapiens; identical to SEQ ID NO: 31070

SEQ ID NO: 402661 - RNA, 64 nt, Homo Sapiens; identical to SEQ ID NO: 31071

SEQ ID NO: 402662 - RNA, 64 nt, Homo Sapiens; identical to SEQ ID NO: 31072

SEQ ID NO: 402663 - RNA, 64 nt, Homo Sapiens; identical to SEQ ID NO: 31073

SEQ ID NO: 402664 - RNA, 64 nt, Homo Sapiens; identical to SEQ ID NO: 31074

SEQ ID NO: 402665 - RNA, 64 nt, Homo Sapiens; identical to SEQ ID NO: 31075

SEQ ID NO: 402666 - RNA, 64 nt, Homo Sapiens; identical to SEQ ID NO: 31076

SEQ ID NO: 402667 - RNA, 64 nt, Homo Sapiens; identical to SEQ ID NO: 31077

SEQ ID NO: 402668 - RNA, 64 nt, Homo Sapiens; identical to SEQ ID NO: 31078

SEQ ID NO: 402669 - RNA, 64 nt, Homo Sapiens; identical to SEQ ID NO: 31079

SEQ ID NO: 402670 - RNA, 64 nt, Homo Sapiens; identical to SEQ ID NO: 31080

SEQ ID NO: 402671 - RNA, 64 nt, Homo Sapiens; identical to SEQ ID NO: 31081

SEQ ID NO: 402672 - RNA, 64 nt, Homo Sapiens; identical to SEQ ID NO: 31082

SEQ ID NO: 402673 - RNA, 64 nt, Homo Sapiens; identical to SEQ ID NO: 31083

SEQ ID NO: 402674 - RNA, 64 nt, Homo Sapiens; identical to SEQ ID NO: 31084

SEQ ID NO: 402675 - RNA, 64 nt, Homo Sapiens; identical to SEQ ID NO: 31085

SEQ ID NO: 402676 - RNA, 64 nt, Homo Sapiens; identical to SEQ ID NO: 31086

SEQ ID NO: 402677 - RNA, 64 nt, Homo Sapiens; identical to SEQ ID NO: 31087

SEQ ID NO: 402678 - RNA, 64 nt, Homo Sapiens; identical to SEQ ID NO: 31088

SEQ ID NO: 402679 - RNA, 64 nt, Homo Sapiens; identical to SEQ ID NO: 31089

SEQ ID NO: 402680 - RNA, 64 nt, Homo Sapiens; identical to SEQ ID NO: 31090

SEQ ID NO: 402681 - RNA, 64 nt, Homo Sapiens; identical to SEQ ID NO: 31091

SEQ ID NO: 402682 - RNA, 64 nt, Homo Sapiens; identical to SEQ ID NO: 31092

SEQ ID NO: 402683 - RNA, 64 nt, Homo Sapiens; identical to SEQ ID NO: 31093

SEQ ID NO: 402684 - RNA, 64 nt, Homo Sapiens; identical to SEQ ID NO: 31094

SEQ ID NO: 402685 - RNA, 64 nt, Homo Sapiens; identical to SEQ ID NO: 31095

SEQ ID NO: 402686 - RNA, 64 nt, Homo Sapiens; identical to SEQ ID NO: 31096

SEQ ID NO: 402687 - RNA, 64 nt, Homo Sapiens; identical to SEQ ID NO: 31097

SEQ ID NO: 402688 - RNA, 64 nt, Homo Sapiens; identical to SEQ ID NO: 31098

SEQ ID NO: 402689 - RNA, 64 nt, Homo Sapiens; identical to SEQ ID NO: 31099

SEQ ID NO: 402690 - RNA, 64 nt, Homo Sapiens; identical to SEQ ID NO: 31100

SEQ ID NO: 402691 - RNA, 64 nt, Homo Sapiens; identical to SEQ ID NO: 31101

SEQ ID NO: 402692 - RNA, 64 nt, Homo Sapiens; identical to SEQ ID NO: 31102

SEQ ID NO: 402693 - RNA, 64 nt, Homo Sapiens; identical to SEQ ID NO: 31103

SEQ ID NO: 402694 - RNA, 64 nt, Homo Sapiens; identical to SEQ ID NO: 31104

SEQ ID NO: 402695 - RNA, 64 nt, Homo Sapiens; identical to SEQ ID NO: 31105

SEQ ID NO: 402696 - RNA, 64 nt, Homo Sapiens; identical to SEQ ID NO: 31106

SEQ ID NO: 402697 - RNA, 64 nt, Homo Sapiens; identical to SEQ ID NO: 31107

SEQ ID NO: 402698 - RNA, 64 nt, Homo Sapiens; identical to SEQ ID NO: 31108

SEQ ID NO: 402699 - RNA, 64 nt, Homo Sapiens; identical to SEQ ID NO: 31109

SEQ ID NO: 402700 - RNA, 64 nt, Homo Sapiens; identical to SEQ ID NO: 31110

SEQ ID NO: 402701 - RNA, 64 nt, Homo Sapiens; identical to SEQ ID NO: 31111

SEQ ID NO: 402702 - RNA, 64 nt, Homo Sapiens; identical to SEQ ID NO: 31112

SEQ ID NO: 402703 - RNA, 64 nt, Homo Sapiens; identical to SEQ ID NO: 31113

SEQ ID NO: 402704 - RNA, 64 nt, Homo Sapiens; identical to SEQ ID NO: 31114

SEQ ID NO: 402705 - RNA, 64 nt, Homo Sapiens; identical to SEQ ID NO: 31115

SEQ ID NO: 402706 - RNA, 64 nt, Homo Sapiens; identical to SEQ ID NO: 31116

SEQ ID NO: 402707 - RNA, 64 nt, Homo Sapiens; identical to SEQ ID NO: 31117

SEQ ID NO: 402708 - RNA, 64 nt, Homo Sapiens; identical to SEQ ID NO: 31118

SEQ ID NO: 402709 - RNA, 64 nt, Homo Sapiens; identical to SEQ ID NO: 31119

SEQ ID NO: 402710 - RNA, 64 nt, Homo Sapiens; identical to SEQ ID NO: 31120

SEQ ID NO: 402711 - RNA, 64 nt, Homo Sapiens; identical to SEQ ID NO: 31121

SEQ ID NO: 402712 - RNA, 64 nt, Homo Sapiens; identical to SEQ ID NO: 31122

SEQ ID NO: 402713 - RNA, 64 nt, Homo Sapiens; identical to SEQ ID NO: 31123

SEQ ID NO: 402714 - RNA, 64 nt, Homo Sapiens; identical to SEQ ID NO: 31124

SEQ ID NO: 402715 - RNA, 64 nt, Homo Sapiens; identical to SEQ ID NO: 31125

SEQ ID NO: 402716 - RNA, 64 nt, Homo Sapiens; identical to SEQ ID NO: 31126

SEQ ID NO: 402717 - RNA, 64 nt, Homo Sapiens; identical to SEQ ID NO: 31127

SEQ ID NO: 402718 - RNA, 64 nt, Homo Sapiens; identical to SEQ ID NO: 31128

SEQ ID NO: 402719 - RNA, 64 nt, Homo Sapiens; identical to SEQ ID NO: 31129

SEQ ID NO: 402720 - RNA, 64 nt, Homo Sapiens; identical to SEQ ID NO: 31130

SEQ ID NO: 402721 - RNA, 64 nt, Homo Sapiens; identical to SEQ ID NO: 31131

SEQ ID NO: 402722 - RNA, 64 nt, Homo Sapiens; identical to SEQ ID NO: 31132

SEQ ID NO: 402723 - RNA, 64 nt, Homo Sapiens; identical to SEQ ID NO: 31133

SEQ ID NO: 402724 - RNA, 64 nt, Homo Sapiens; identical to SEQ ID NO: 31134

SEQ ID NO: 402725 - RNA, 64 nt, Homo Sapiens; identical to SEQ ID NO: 31135

SEQ ID NO: 402726 - RNA, 64 nt, Homo Sapiens; identical to SEQ ID NO: 31136

SEQ ID NO: 402727 - RNA, 64 nt, Homo Sapiens; identical to SEQ ID NO: 31137

SEQ ID NO: 402728 - RNA, 64 nt, Homo Sapiens; identical to SEQ ID NO: 31138

SEQ ID NO: 402729 - RNA, 64 nt, Homo Sapiens; identical to SEQ ID NO: 31139

SEQ ID NO: 402730 - RNA, 64 nt, Homo Sapiens; identical to SEQ ID NO: 31140

SEQ ID NO: 402731 - RNA, 64 nt, Homo Sapiens; identical to SEQ ID NO: 31141

SEQ ID NO: 402732 - RNA, 64 nt, Homo Sapiens; identical to SEQ ID NO: 31142

SEQ ID NO: 402733 - RNA, 64 nt, Homo Sapiens; identical to SEQ ID NO: 31143

SEQ ID NO: 402734 - RNA, 64 nt, Homo Sapiens; identical to SEQ ID NO: 31144

SEQ ID NO: 402735 - RNA, 64 nt, Homo Sapiens; identical to SEQ ID NO: 31145

SEQ ID NO: 402736 - RNA, 64 nt, Homo Sapiens; identical to SEQ ID NO: 31146

SEQ ID NO: 402737 - RNA, 64 nt, Homo Sapiens; identical to SEQ ID NO: 31147

SEQ ID NO: 402738 - RNA, 64 nt, Homo Sapiens; identical to SEQ ID NO: 31148

SEQ ID NO: 402739 - RNA, 64 nt, Homo Sapiens; identical to SEQ ID NO: 31149

SEQ ID NO: 402740 - RNA, 64 nt, Homo Sapiens; identical to SEQ ID NO: 31150

SEQ ID NO: 402741 - RNA, 64 nt, Homo Sapiens; identical to SEQ ID NO: 31151

SEQ ID NO: 402742 - RNA, 64 nt, Homo Sapiens; identical to SEQ ID NO: 31152

SEQ ID NO: 402743 - RNA, 64 nt, Homo Sapiens; identical to SEQ ID NO: 31153

SEQ ID NO: 402744 - RNA, 64 nt, Homo Sapiens; identical to SEQ ID NO: 31154

SEQ ID NO: 402745 - RNA, 64 nt, Homo Sapiens; identical to SEQ ID NO: 31155

SEQ ID NO: 402746 - RNA, 64 nt, Homo Sapiens; identical to SEQ ID NO: 31156

SEQ ID NO: 402747 - RNA, 64 nt, Homo Sapiens; identical to SEQ ID NO: 31157

SEQ ID NO: 402748 - RNA, 64 nt, Homo Sapiens; identical to SEQ ID NO: 31158

SEQ ID NO: 402749 - RNA, 64 nt, Homo Sapiens; identical to SEQ ID NO: 31159

SEQ ID NO: 402750 - RNA, 64 nt, Homo Sapiens; identical to SEQ ID NO: 31160

SEQ ID NO: 402751 - RNA, 64 nt, Homo Sapiens; identical to SEQ ID NO: 31161

SEQ ID NO: 402752 - RNA, 64 nt, Homo Sapiens; identical to SEQ ID NO: 31162

SEQ ID NO: 402753 - RNA, 64 nt, Homo Sapiens; identical to SEQ ID NO: 31163

SEQ ID NO: 402754 - RNA, 64 nt, Homo Sapiens; identical to SEQ ID NO: 31164

SEQ ID NO: 402755 - RNA, 64 nt, Homo Sapiens; identical to SEQ ID NO: 31165

SEQ ID NO: 402756 - RNA, 64 nt, Homo Sapiens; identical to SEQ ID NO: 31166

SEQ ID NO: 402757 - RNA, 64 nt, Homo Sapiens; identical to SEQ ID NO: 31167

SEQ ID NO: 402758 - RNA, 64 nt, Homo Sapiens; identical to SEQ ID NO: 31168

SEQ ID NO: 402759 - RNA, 64 nt, Homo Sapiens; identical to SEQ ID NO: 31169

SEQ ID NO: 402760 - RNA, 64 nt, Homo Sapiens; identical to SEQ ID NO: 31170

SEQ ID NO: 402761 - RNA, 64 nt, Homo Sapiens; identical to SEQ ID NO: 31171

SEQ ID NO: 402762 - RNA, 64 nt, Homo Sapiens; identical to SEQ ID NO: 31172

SEQ ID NO: 402763 - RNA, 64 nt, Homo Sapiens; identical to SEQ ID NO: 31173

SEQ ID NO: 402764 - RNA, 64 nt, Homo Sapiens; identical to SEQ ID NO: 31174

SEQ ID NO: 402765 - RNA, 64 nt, Homo Sapiens; identical to SEQ ID NO: 31175

SEQ ID NO: 402766 - RNA, 64 nt, Homo Sapiens; identical to SEQ ID NO: 31176

SEQ ID NO: 402767 - RNA, 64 nt, Homo Sapiens; identical to SEQ ID NO: 31177

SEQ ID NO: 402768 - RNA, 64 nt, Homo Sapiens; identical to SEQ ID NO: 31178

SEQ ID NO: 402769 - RNA, 64 nt, Homo Sapiens; identical to SEQ ID NO: 31179

SEQ ID NO: 402770 - RNA, 64 nt, Homo Sapiens; identical to SEQ ID NO: 31180

SEQ ID NO: 402771 - RNA, 64 nt, Homo Sapiens; identical to SEQ ID NO: 31181

SEQ ID NO: 402772 - RNA, 64 nt, Homo Sapiens; identical to SEQ ID NO: 31182

SEQ ID NO: 402773 - RNA, 64 nt, Homo Sapiens; identical to SEQ ID NO: 31183

SEQ ID NO: 402774 - RNA, 64 nt, Homo Sapiens; identical to SEQ ID NO: 31184

SEQ ID NO: 402775 - RNA, 64 nt, Homo Sapiens; identical to SEQ ID NO: 31185

SEQ ID NO: 402776 - RNA, 64 nt, Homo Sapiens; identical to SEQ ID NO: 31186

SEQ ID NO: 402777 - RNA, 64 nt, Homo Sapiens; identical to SEQ ID NO: 31187

SEQ ID NO: 402778 - RNA, 64 nt, Homo Sapiens; identical to SEQ ID NO: 31188

SEQ ID NO: 402779 - RNA, 64 nt, Homo Sapiens; identical to SEQ ID NO: 31189

SEQ ID NO: 402780 - RNA, 64 nt, Homo Sapiens; identical to SEQ ID NO: 31190

SEQ ID NO: 402781 - RNA, 64 nt, Homo Sapiens; identical to SEQ ID NO: 31191

SEQ ID NO: 402782 - RNA, 64 nt, Homo Sapiens; identical to SEQ ID NO: 31192

SEQ ID NO: 402783 - RNA, 64 nt, Homo Sapiens; identical to SEQ ID NO: 31193

SEQ ID NO: 402784 - RNA, 64 nt, Homo Sapiens; identical to SEQ ID NO: 31194

SEQ ID NO: 402785 - RNA, 64 nt, Homo Sapiens; identical to SEQ ID NO: 31195

SEQ ID NO: 402786 - RNA, 64 nt, Homo Sapiens; identical to SEQ ID NO: 31196

SEQ ID NO: 402787 - RNA, 64 nt, Homo Sapiens; identical to SEQ ID NO: 31197

SEQ ID NO: 402788 - RNA, 64 nt, Homo Sapiens; identical to SEQ ID NO: 31198

SEQ ID NO: 402789 - RNA, 64 nt, Homo Sapiens; identical to SEQ ID NO: 31199

SEQ ID NO: 402790 - RNA, 64 nt, Homo Sapiens; identical to SEQ ID NO: 31200

SEQ ID NO: 402791 - RNA, 64 nt, Homo Sapiens; identical to SEQ ID NO: 31201

SEQ ID NO: 402792 - RNA, 64 nt, Homo Sapiens; identical to SEQ ID NO: 31202

SEQ ID NO: 402793 - RNA, 64 nt, Homo Sapiens; identical to SEQ ID NO: 31203

SEQ ID NO: 402794 - RNA, 64 nt, Homo Sapiens; identical to SEQ ID NO: 31204

SEQ ID NO: 402795 - RNA, 64 nt, Homo Sapiens; identical to SEQ ID NO: 31205

SEQ ID NO: 402796 - RNA, 64 nt, Homo Sapiens; identical to SEQ ID NO: 31206

SEQ ID NO: 402797 - RNA, 64 nt, Homo Sapiens; identical to SEQ ID NO: 31207

SEQ ID NO: 402798 - RNA, 64 nt, Homo Sapiens; identical to SEQ ID NO: 31208

SEQ ID NO: 402799 - RNA, 64 nt, Homo Sapiens; identical to SEQ ID NO: 31209

SEQ ID NO: 402800 - RNA, 64 nt, Homo Sapiens; identical to SEQ ID NO: 31210

SEQ ID NO: 402801 - RNA, 64 nt, Homo Sapiens; identical to SEQ ID NO: 31211

SEQ ID NO: 402802 - RNA, 64 nt, Homo Sapiens; identical to SEQ ID NO: 31212

SEQ ID NO: 402803 - RNA, 64 nt, Homo Sapiens; identical to SEQ ID NO: 31213

SEQ ID NO: 402804 - RNA, 64 nt, Homo Sapiens; identical to SEQ ID NO: 31214

SEQ ID NO: 402805 - RNA, 64 nt, Homo Sapiens; identical to SEQ ID NO: 31215

SEQ ID NO: 402806 - RNA, 64 nt, Homo Sapiens; identical to SEQ ID NO: 31216

SEQ ID NO: 402807 - RNA, 64 nt, Homo Sapiens; identical to SEQ ID NO: 31217

SEQ ID NO: 402808 - RNA, 64 nt, Homo Sapiens; identical to SEQ ID NO: 31218

SEQ ID NO: 402809 - RNA, 64 nt, Homo Sapiens; identical to SEQ ID NO: 31219

SEQ ID NO: 402810 - RNA, 64 nt, Homo Sapiens; identical to SEQ ID NO: 31220

SEQ ID NO: 402811 - RNA, 64 nt, Homo Sapiens; identical to SEQ ID NO: 31221

SEQ ID NO: 402812 - RNA, 64 nt, Homo Sapiens; identical to SEQ ID NO: 31222

SEQ ID NO: 402813 - RNA, 64 nt, Homo Sapiens; identical to SEQ ID NO: 31223

SEQ ID NO: 402814 - RNA, 64 nt, Homo Sapiens; identical to SEQ ID NO: 31224

SEQ ID NO: 402815 - RNA, 64 nt, Homo Sapiens; identical to SEQ ID NO: 31225

SEQ ID NO: 402816 - RNA, 64 nt, Homo Sapiens; identical to SEQ ID NO: 31226

SEQ ID NO: 402817 - RNA, 64 nt, Homo Sapiens; identical to SEQ ID NO: 31227

SEQ ID NO: 402818 - RNA, 64 nt, Homo Sapiens; identical to SEQ ID NO: 31228

SEQ ID NO: 402819 - RNA, 64 nt, Homo Sapiens; identical to SEQ ID NO: 31229

SEQ ID NO: 402820 - RNA, 64 nt, Homo Sapiens; identical to SEQ ID NO: 31230

SEQ ID NO: 402821 - RNA, 64 nt, Homo Sapiens; identical to SEQ ID NO: 31231

SEQ ID NO: 402822 - RNA, 64 nt, Homo Sapiens; identical to SEQ ID NO: 31232

SEQ ID NO: 402823 - RNA, 64 nt, Homo Sapiens; identical to SEQ ID NO: 31233

SEQ ID NO: 402824 - RNA, 64 nt, Homo Sapiens; identical to SEQ ID NO: 31234

SEQ ID NO: 402825 - RNA, 64 nt, Homo Sapiens; identical to SEQ ID NO: 31235

SEQ ID NO: 402826 - RNA, 64 nt, Homo Sapiens; identical to SEQ ID NO: 31236

SEQ ID NO: 402827 - RNA, 64 nt, Homo Sapiens; identical to SEQ ID NO: 31237

SEQ ID NO: 402828 - RNA, 64 nt, Homo Sapiens; identical to SEQ ID NO: 31238

SEQ ID NO: 402829 - RNA, 64 nt, Homo Sapiens; identical to SEQ ID NO: 31239

SEQ ID NO: 402830 - RNA, 64 nt, Homo Sapiens; identical to SEQ ID NO: 31240

SEQ ID NO: 402831 - RNA, 62 nt, Homo Sapiens; identical to SEQ ID NO: 31241

SEQ ID NO: 402832 - RNA, 63 nt, Homo Sapiens; identical to SEQ ID NO: 31242

SEQ ID NO: 402833 - RNA, 64 nt, Homo Sapiens; identical to SEQ ID NO: 31243

SEQ ID NO: 402834 - RNA, 64 nt, Homo Sapiens; identical to SEQ ID NO: 31244

SEQ ID NO: 402835 - RNA, 64 nt, Homo Sapiens; identical to SEQ ID NO: 31245

SEQ ID NO: 402836 - RNA, 64 nt, Homo Sapiens; identical to SEQ ID NO: 31246

SEQ ID NO: 402837 - RNA, 64 nt, Homo Sapiens; identical to SEQ ID NO: 31247

SEQ ID NO: 402838 - RNA, 64 nt, Homo Sapiens; identical to SEQ ID NO: 31248

SEQ ID NO: 402839 - RNA, 64 nt, Homo Sapiens; identical to SEQ ID NO: 31249

SEQ ID NO: 402840 - RNA, 64 nt, Homo Sapiens; identical to SEQ ID NO: 31250

SEQ ID NO: 402841 - RNA, 64 nt, Homo Sapiens; identical to SEQ ID NO: 31251

SEQ ID NO: 402842 - RNA, 64 nt, Homo Sapiens; identical to SEQ ID NO: 31252

SEQ ID NO: 402843 - RNA, 64 nt, Homo Sapiens; identical to SEQ ID NO: 31253

SEQ ID NO: 402844 - RNA, 64 nt, Homo Sapiens; identical to SEQ ID NO: 31254

SEQ ID NO: 402845 - RNA, 64 nt, Homo Sapiens; identical to SEQ ID NO: 31255

SEQ ID NO: 402846 - RNA, 64 nt, Homo Sapiens; identical to SEQ ID NO: 31256

SEQ ID NO: 402847 - RNA, 64 nt, Homo Sapiens; identical to SEQ ID NO: 31257

SEQ ID NO: 402848 - RNA, 64 nt, Homo Sapiens; identical to SEQ ID NO: 31258

SEQ ID NO: 402849 - RNA, 64 nt, Homo Sapiens; identical to SEQ ID NO: 31259

SEQ ID NO: 402850 - RNA, 64 nt, Homo Sapiens; identical to SEQ ID NO: 31260

SEQ ID NO: 402851 - RNA, 64 nt, Homo Sapiens; identical to SEQ ID NO: 31261

SEQ ID NO: 402852 - RNA, 64 nt, Homo Sapiens; identical to SEQ ID NO: 31262

SEQ ID NO: 402853 - RNA, 64 nt, Homo Sapiens; identical to SEQ ID NO: 31263

SEQ ID NO: 402854 - RNA, 64 nt, Homo Sapiens; identical to SEQ ID NO: 31264

SEQ ID NO: 402855 - RNA, 64 nt, Homo Sapiens; identical to SEQ ID NO: 31265

SEQ ID NO: 402856 - RNA, 64 nt, Homo Sapiens; identical to SEQ ID NO: 31266

SEQ ID NO: 402857 - RNA, 64 nt, Homo Sapiens; identical to SEQ ID NO: 31267

SEQ ID NO: 402858 - RNA, 64 nt, Homo Sapiens; identical to SEQ ID NO: 31268

SEQ ID NO: 402859 - RNA, 64 nt, Homo Sapiens; identical to SEQ ID NO: 31269

SEQ ID NO: 402860 - RNA, 64 nt, Homo Sapiens; identical to SEQ ID NO: 31270

SEQ ID NO: 402861 - RNA, 64 nt, Homo Sapiens; identical to SEQ ID NO: 31271

SEQ ID NO: 402862 - RNA, 64 nt, Homo Sapiens; identical to SEQ ID NO: 31272

SEQ ID NO: 402863 - RNA, 64 nt, Homo Sapiens; identical to SEQ ID NO: 31273

SEQ ID NO: 402864 - RNA, 64 nt, Homo Sapiens; identical to SEQ ID NO: 31274

SEQ ID NO: 402865 - RNA, 64 nt, Homo Sapiens; identical to SEQ ID NO: 31275

SEQ ID NO: 402866 - RNA, 64 nt, Homo Sapiens; identical to SEQ ID NO: 31276

SEQ ID NO: 402867 - RNA, 64 nt, Homo Sapiens; identical to SEQ ID NO: 31277

SEQ ID NO: 402868 - RNA, 64 nt, Homo Sapiens; identical to SEQ ID NO: 31278

SEQ ID NO: 402869 - RNA, 64 nt, Homo Sapiens; identical to SEQ ID NO: 31279

SEQ ID NO: 402870 - RNA, 64 nt, Homo Sapiens; identical to SEQ ID NO: 31280

SEQ ID NO: 402871 - RNA, 64 nt, Homo Sapiens; identical to SEQ ID NO: 31281

SEQ ID NO: 402872 - RNA, 64 nt, Homo Sapiens; identical to SEQ ID NO: 31282

SEQ ID NO: 402873 - RNA, 64 nt, Homo Sapiens; identical to SEQ ID NO: 31283

SEQ ID NO: 402874 - RNA, 64 nt, Homo Sapiens; identical to SEQ ID NO: 31284

SEQ ID NO: 402875 - RNA, 64 nt, Homo Sapiens; identical to SEQ ID NO: 31285

SEQ ID NO: 402876 - RNA, 64 nt, Homo Sapiens; identical to SEQ ID NO: 31286

SEQ ID NO: 402877 - RNA, 64 nt, Homo Sapiens; identical to SEQ ID NO: 31287

SEQ ID NO: 402878 - RNA, 64 nt, Homo Sapiens; identical to SEQ ID NO: 31288

SEQ ID NO: 402879 - RNA, 64 nt, Homo Sapiens; identical to SEQ ID NO: 31289

SEQ ID NO: 402880 - RNA, 64 nt, Homo Sapiens; identical to SEQ ID NO: 31290

SEQ ID NO: 402881 - RNA, 64 nt, Homo Sapiens; identical to SEQ ID NO: 31291

SEQ ID NO: 402882 - RNA, 64 nt, Homo Sapiens; identical to SEQ ID NO: 31292

SEQ ID NO: 402883 - RNA, 64 nt, Homo Sapiens; identical to SEQ ID NO: 31293

SEQ ID NO: 402884 - RNA, 64 nt, Homo Sapiens; identical to SEQ ID NO: 31294

SEQ ID NO: 402885 - RNA, 64 nt, Homo Sapiens; identical to SEQ ID NO: 31295

SEQ ID NO: 402886 - RNA, 64 nt, Homo Sapiens; identical to SEQ ID NO: 31296

SEQ ID NO: 402887 - RNA, 64 nt, Homo Sapiens; identical to SEQ ID NO: 31297

SEQ ID NO: 402888 - RNA, 64 nt, Homo Sapiens; identical to SEQ ID NO: 31298

SEQ ID NO: 402889 - RNA, 64 nt, Homo Sapiens; identical to SEQ ID NO: 31299

SEQ ID NO: 402890 - RNA, 64 nt, Homo Sapiens; identical to SEQ ID NO: 31300

SEQ ID NO: 402891 - RNA, 64 nt, Homo Sapiens; identical to SEQ ID NO: 31301

SEQ ID NO: 402892 - RNA, 64 nt, Homo Sapiens; identical to SEQ ID NO: 31302

SEQ ID NO: 402893 - RNA, 64 nt, Homo Sapiens; identical to SEQ ID NO: 31303

SEQ ID NO: 402894 - RNA, 64 nt, Homo Sapiens; identical to SEQ ID NO: 31304

SEQ ID NO: 402895 - RNA, 64 nt, Homo Sapiens; identical to SEQ ID NO: 31305

SEQ ID NO: 402896 - RNA, 64 nt, Homo Sapiens; identical to SEQ ID NO: 31306

SEQ ID NO: 402897 - RNA, 64 nt, Homo Sapiens; identical to SEQ ID NO: 31307

SEQ ID NO: 402898 - RNA, 64 nt, Homo Sapiens; identical to SEQ ID NO: 31308

SEQ ID NO: 402899 - RNA, 64 nt, Homo Sapiens; identical to SEQ ID NO: 31309

SEQ ID NO: 402900 - RNA, 64 nt, Homo Sapiens; identical to SEQ ID NO: 31310

SEQ ID NO: 402901 - RNA, 64 nt, Homo Sapiens; identical to SEQ ID NO: 31311

SEQ ID NO: 402902 - RNA, 64 nt, Homo Sapiens; identical to SEQ ID NO: 31312

SEQ ID NO: 402903 - RNA, 64 nt, Homo Sapiens; identical to SEQ ID NO: 31313

SEQ ID NO: 402904 - RNA, 64 nt, Homo Sapiens; identical to SEQ ID NO: 31314

SEQ ID NO: 402905 - RNA, 64 nt, Homo Sapiens; identical to SEQ ID NO: 31315

SEQ ID NO: 402906 - RNA, 64 nt, Homo Sapiens; identical to SEQ ID NO: 31316

SEQ ID NO: 402907 - RNA, 64 nt, Homo Sapiens; identical to SEQ ID NO: 31317

SEQ ID NO: 402908 - RNA, 64 nt, Homo Sapiens; identical to SEQ ID NO: 31318

SEQ ID NO: 402909 - RNA, 64 nt, Homo Sapiens; identical to SEQ ID NO: 31319

SEQ ID NO: 402910 - RNA, 64 nt, Homo Sapiens; identical to SEQ ID NO: 31320

SEQ ID NO: 402911 - RNA, 64 nt, Homo Sapiens; identical to SEQ ID NO: 31321

SEQ ID NO: 402912 - RNA, 64 nt, Homo Sapiens; identical to SEQ ID NO: 31322

SEQ ID NO: 402913 - RNA, 64 nt, Homo Sapiens; identical to SEQ ID NO: 31323

SEQ ID NO: 402914 - RNA, 64 nt, Homo Sapiens; identical to SEQ ID NO: 31324

SEQ ID NO: 402915 - RNA, 64 nt, Homo Sapiens; identical to SEQ ID NO: 31325

SEQ ID NO: 402916 - RNA, 64 nt, Homo Sapiens; identical to SEQ ID NO: 31326

SEQ ID NO: 402917 - RNA, 64 nt, Homo Sapiens; identical to SEQ ID NO: 31327

SEQ ID NO: 402918 - RNA, 64 nt, Homo Sapiens; identical to SEQ ID NO: 31328

SEQ ID NO: 402919 - RNA, 64 nt, Homo Sapiens; identical to SEQ ID NO: 31329

SEQ ID NO: 402920 - RNA, 64 nt, Homo Sapiens; identical to SEQ ID NO: 31330

SEQ ID NO: 402921 - RNA, 64 nt, Homo Sapiens; identical to SEQ ID NO: 31331

SEQ ID NO: 402922 - RNA, 64 nt, Homo Sapiens; identical to SEQ ID NO: 31332

SEQ ID NO: 402923 - RNA, 64 nt, Homo Sapiens; identical to SEQ ID NO: 31333

SEQ ID NO: 402924 - RNA, 64 nt, Homo Sapiens; identical to SEQ ID NO: 31334

SEQ ID NO: 402925 - RNA, 64 nt, Homo Sapiens; identical to SEQ ID NO: 31335

SEQ ID NO: 402926 - RNA, 64 nt, Homo Sapiens; identical to SEQ ID NO: 31336

SEQ ID NO: 402927 - RNA, 64 nt, Homo Sapiens; identical to SEQ ID NO: 31337

SEQ ID NO: 402928 - RNA, 64 nt, Homo Sapiens; identical to SEQ ID NO: 31338

SEQ ID NO: 402929 - RNA, 64 nt, Homo Sapiens; identical to SEQ ID NO: 31339

SEQ ID NO: 402930 - RNA, 64 nt, Homo Sapiens; identical to SEQ ID NO: 31340

SEQ ID NO: 402931 - RNA, 64 nt, Homo Sapiens; identical to SEQ ID NO: 31341

SEQ ID NO: 402932 - RNA, 64 nt, Homo Sapiens; identical to SEQ ID NO: 31342

SEQ ID NO: 402933 - RNA, 64 nt, Homo Sapiens; identical to SEQ ID NO: 31343

SEQ ID NO: 402934 - RNA, 64 nt, Homo Sapiens; identical to SEQ ID NO: 31344

SEQ ID NO: 402935 - RNA, 64 nt, Homo Sapiens; identical to SEQ ID NO: 31345

SEQ ID NO: 402936 - RNA, 64 nt, Homo Sapiens; identical to SEQ ID NO: 31346

SEQ ID NO: 402937 - RNA, 64 nt, Homo Sapiens; identical to SEQ ID NO: 31347

SEQ ID NO: 402938 - RNA, 64 nt, Homo Sapiens; identical to SEQ ID NO: 31348

SEQ ID NO: 402939 - RNA, 64 nt, Homo Sapiens; identical to SEQ ID NO: 31349

SEQ ID NO: 402940 - RNA, 64 nt, Homo Sapiens; identical to SEQ ID NO: 31350

SEQ ID NO: 402941 - RNA, 64 nt, Homo Sapiens; identical to SEQ ID NO: 31351

SEQ ID NO: 402942 - RNA, 64 nt, Homo Sapiens; identical to SEQ ID NO: 31352

SEQ ID NO: 402943 - RNA, 64 nt, Homo Sapiens; identical to SEQ ID NO: 31353

SEQ ID NO: 402944 - RNA, 64 nt, Homo Sapiens; identical to SEQ ID NO: 31354

SEQ ID NO: 402945 - RNA, 64 nt, Homo Sapiens; identical to SEQ ID NO: 31355

SEQ ID NO: 402946 - RNA, 64 nt, Homo Sapiens; identical to SEQ ID NO: 31356

SEQ ID NO: 402947 - RNA, 64 nt, Homo Sapiens; identical to SEQ ID NO: 31357

SEQ ID NO: 402948 - RNA, 64 nt, Homo Sapiens; identical to SEQ ID NO: 31358

SEQ ID NO: 402949 - RNA, 64 nt, Homo Sapiens; identical to SEQ ID NO: 31359

SEQ ID NO: 402950 - RNA, 64 nt, Homo Sapiens; identical to SEQ ID NO: 31360

SEQ ID NO: 402951 - RNA, 64 nt, Homo Sapiens; identical to SEQ ID NO: 31361

SEQ ID NO: 402952 - RNA, 64 nt, Homo Sapiens; identical to SEQ ID NO: 31362

SEQ ID NO: 402953 - RNA, 64 nt, Homo Sapiens; identical to SEQ ID NO: 31363

SEQ ID NO: 402954 - RNA, 64 nt, Homo Sapiens; identical to SEQ ID NO: 31364

SEQ ID NO: 402955 - RNA, 64 nt, Homo Sapiens; identical to SEQ ID NO: 31365

SEQ ID NO: 402956 - RNA, 64 nt, Homo Sapiens; identical to SEQ ID NO: 31366

SEQ ID NO: 402957 - RNA, 64 nt, Homo Sapiens; identical to SEQ ID NO: 31367

SEQ ID NO: 402958 - RNA, 64 nt, Homo Sapiens; identical to SEQ ID NO: 31368

SEQ ID NO: 402959 - RNA, 64 nt, Homo Sapiens; identical to SEQ ID NO: 31369

SEQ ID NO: 402960 - RNA, 64 nt, Homo Sapiens; identical to SEQ ID NO: 31370

SEQ ID NO: 402961 - RNA, 64 nt, Homo Sapiens; identical to SEQ ID NO: 31371

SEQ ID NO: 402962 - RNA, 64 nt, Homo Sapiens; identical to SEQ ID NO: 31372

SEQ ID NO: 402963 - RNA, 64 nt, Homo Sapiens; identical to SEQ ID NO: 31373

SEQ ID NO: 402964 - RNA, 64 nt, Homo Sapiens; identical to SEQ ID NO: 31374

SEQ ID NO: 402965 - RNA, 64 nt, Homo Sapiens; identical to SEQ ID NO: 31375

SEQ ID NO: 402966 - RNA, 64 nt, Homo Sapiens; identical to SEQ ID NO: 31376

SEQ ID NO: 402967 - RNA, 64 nt, Homo Sapiens; identical to SEQ ID NO: 31377

SEQ ID NO: 402968 - RNA, 64 nt, Homo Sapiens; identical to SEQ ID NO: 31378

SEQ ID NO: 402969 - RNA, 64 nt, Homo Sapiens; identical to SEQ ID NO: 31379

SEQ ID NO: 402970 - RNA, 64 nt, Homo Sapiens; identical to SEQ ID NO: 31380

SEQ ID NO: 402971 - RNA, 64 nt, Homo Sapiens; identical to SEQ ID NO: 31381

SEQ ID NO: 402972 - RNA, 64 nt, Homo Sapiens; identical to SEQ ID NO: 31382

SEQ ID NO: 402973 - RNA, 64 nt, Homo Sapiens; identical to SEQ ID NO: 31383

SEQ ID NO: 402974 - RNA, 64 nt, Homo Sapiens; identical to SEQ ID NO: 31384

SEQ ID NO: 402975 - RNA, 64 nt, Homo Sapiens; identical to SEQ ID NO: 31385

SEQ ID NO: 402976 - RNA, 64 nt, Homo Sapiens; identical to SEQ ID NO: 31386

SEQ ID NO: 402977 - RNA, 64 nt, Homo Sapiens; identical to SEQ ID NO: 31387

SEQ ID NO: 402978 - RNA, 64 nt, Homo Sapiens; identical to SEQ ID NO: 31388

SEQ ID NO: 402979 - RNA, 64 nt, Homo Sapiens; identical to SEQ ID NO: 31389

SEQ ID NO: 402980 - RNA, 64 nt, Homo Sapiens; identical to SEQ ID NO: 31390

SEQ ID NO: 402981 - RNA, 64 nt, Homo Sapiens; identical to SEQ ID NO: 31391

SEQ ID NO: 402982 - RNA, 64 nt, Homo Sapiens; identical to SEQ ID NO: 31392

SEQ ID NO: 402983 - RNA, 64 nt, Homo Sapiens; identical to SEQ ID NO: 31393

SEQ ID NO: 402984 - RNA, 64 nt, Homo Sapiens; identical to SEQ ID NO: 31394

SEQ ID NO: 402985 - RNA, 64 nt, Homo Sapiens; identical to SEQ ID NO: 31395

SEQ ID NO: 402986 - RNA, 64 nt, Homo Sapiens; identical to SEQ ID NO: 31396

SEQ ID NO: 402987 - RNA, 64 nt, Homo Sapiens; identical to SEQ ID NO: 31397

SEQ ID NO: 402988 - RNA, 64 nt, Homo Sapiens; identical to SEQ ID NO: 31398

SEQ ID NO: 402989 - RNA, 64 nt, Homo Sapiens; identical to SEQ ID NO: 31399

SEQ ID NO: 402990 - RNA, 64 nt, Homo Sapiens; identical to SEQ ID NO: 31400

SEQ ID NO: 402991 - RNA, 64 nt, Homo Sapiens; identical to SEQ ID NO: 31401

SEQ ID NO: 402992 - RNA, 64 nt, Homo Sapiens; identical to SEQ ID NO: 31402

SEQ ID NO: 402993 - RNA, 64 nt, Homo Sapiens; identical to SEQ ID NO: 31403

SEQ ID NO: 402994 - RNA, 64 nt, Homo Sapiens; identical to SEQ ID NO: 31404

SEQ ID NO: 402995 - RNA, 64 nt, Homo Sapiens; identical to SEQ ID NO: 31405

SEQ ID NO: 402996 - RNA, 64 nt, Homo Sapiens; identical to SEQ ID NO: 31406

SEQ ID NO: 402997 - RNA, 64 nt, Homo Sapiens; identical to SEQ ID NO: 31407

SEQ ID NO: 402998 - RNA, 64 nt, Homo Sapiens; identical to SEQ ID NO: 31408

SEQ ID NO: 402999 - RNA, 64 nt, Homo Sapiens; identical to SEQ ID NO: 31409

SEQ ID NO: 403000 - RNA, 64 nt, Homo Sapiens; identical to SEQ ID NO: 31410

SEQ ID NO: 403001 - RNA, 64 nt, Homo Sapiens; identical to SEQ ID NO: 31411

SEQ ID NO: 403002 - RNA, 64 nt, Homo Sapiens; identical to SEQ ID NO: 31412

SEQ ID NO: 403003 - RNA, 64 nt, Homo Sapiens; identical to SEQ ID NO: 31413

SEQ ID NO: 403004 - RNA, 64 nt, Homo Sapiens; identical to SEQ ID NO: 31414

SEQ ID NO: 403005 - RNA, 64 nt, Homo Sapiens; identical to SEQ ID NO: 31415

SEQ ID NO: 403006 - RNA, 64 nt, Homo Sapiens; identical to SEQ ID NO: 31416

SEQ ID NO: 403007 - RNA, 64 nt, Homo Sapiens; identical to SEQ ID NO: 31417

SEQ ID NO: 403008 - RNA, 64 nt, Homo Sapiens; identical to SEQ ID NO: 31418

SEQ ID NO: 403009 - RNA, 64 nt, Homo Sapiens; identical to SEQ ID NO: 31419

SEQ ID NO: 403010 - RNA, 64 nt, Homo Sapiens; identical to SEQ ID NO: 31420

SEQ ID NO: 403011 - RNA, 64 nt, Homo Sapiens; identical to SEQ ID NO: 31421

SEQ ID NO: 403012 - RNA, 64 nt, Homo Sapiens; identical to SEQ ID NO: 31422

SEQ ID NO: 403013 - RNA, 64 nt, Homo Sapiens; identical to SEQ ID NO: 31423

SEQ ID NO: 403014 - RNA, 64 nt, Homo Sapiens; identical to SEQ ID NO: 31424

SEQ ID NO: 403015 - RNA, 64 nt, Homo Sapiens; identical to SEQ ID NO: 31425

SEQ ID NO: 403016 - RNA, 64 nt, Homo Sapiens; identical to SEQ ID NO: 31426

SEQ ID NO: 403017 - RNA, 64 nt, Homo Sapiens; identical to SEQ ID NO: 31427

SEQ ID NO: 403018 - RNA, 64 nt, Homo Sapiens; identical to SEQ ID NO: 31428

SEQ ID NO: 403019 - RNA, 64 nt, Homo Sapiens; identical to SEQ ID NO: 31429

SEQ ID NO: 403020 - RNA, 64 nt, Homo Sapiens; identical to SEQ ID NO: 31430

SEQ ID NO: 403021 - RNA, 64 nt, Homo Sapiens; identical to SEQ ID NO: 31431

SEQ ID NO: 403022 - RNA, 64 nt, Homo Sapiens; identical to SEQ ID NO: 31432

SEQ ID NO: 403023 - RNA, 64 nt, Homo Sapiens; identical to SEQ ID NO: 31433

SEQ ID NO: 403024 - RNA, 64 nt, Homo Sapiens; identical to SEQ ID NO: 31434

SEQ ID NO: 403025 - RNA, 64 nt, Homo Sapiens; identical to SEQ ID NO: 31435

SEQ ID NO: 403026 - RNA, 64 nt, Homo Sapiens; identical to SEQ ID NO: 31436

SEQ ID NO: 403027 - RNA, 64 nt, Homo Sapiens; identical to SEQ ID NO: 31437

SEQ ID NO: 403028 - RNA, 64 nt, Homo Sapiens; identical to SEQ ID NO: 31438

SEQ ID NO: 403029 - RNA, 64 nt, Homo Sapiens; identical to SEQ ID NO: 31439

SEQ ID NO: 403030 - RNA, 64 nt, Homo Sapiens; identical to SEQ ID NO: 31440

SEQ ID NO: 403031 - RNA, 64 nt, Homo Sapiens; identical to SEQ ID NO: 31441

SEQ ID NO: 403032 - RNA, 64 nt, Homo Sapiens; identical to SEQ ID NO: 31442

SEQ ID NO: 403033 - RNA, 64 nt, Homo Sapiens; identical to SEQ ID NO: 31443

SEQ ID NO: 403034 - RNA, 64 nt, Homo Sapiens; identical to SEQ ID NO: 31444

SEQ ID NO: 403035 - RNA, 64 nt, Homo Sapiens; identical to SEQ ID NO: 31445

SEQ ID NO: 403036 - RNA, 64 nt, Homo Sapiens; identical to SEQ ID NO: 31446

SEQ ID NO: 403037 - RNA, 64 nt, Homo Sapiens; identical to SEQ ID NO: 31447

SEQ ID NO: 403038 - RNA, 64 nt, Homo Sapiens; identical to SEQ ID NO: 31448

SEQ ID NO: 403039 - RNA, 64 nt, Homo Sapiens; identical to SEQ ID NO: 31449

SEQ ID NO: 403040 - RNA, 64 nt, Homo Sapiens; identical to SEQ ID NO: 31450

SEQ ID NO: 403041 - RNA, 64 nt, Homo Sapiens; identical to SEQ ID NO: 31451

SEQ ID NO: 403042 - RNA, 64 nt, Homo Sapiens; identical to SEQ ID NO: 31452

SEQ ID NO: 403043 - RNA, 64 nt, Homo Sapiens; identical to SEQ ID NO: 31453

SEQ ID NO: 403044 - RNA, 64 nt, Homo Sapiens; identical to SEQ ID NO: 31454

SEQ ID NO: 403045 - RNA, 64 nt, Homo Sapiens; identical to SEQ ID NO: 31455

SEQ ID NO: 403046 - RNA, 64 nt, Homo Sapiens; identical to SEQ ID NO: 31456

SEQ ID NO: 403047 - RNA, 64 nt, Homo Sapiens; identical to SEQ ID NO: 31457

SEQ ID NO: 403048 - RNA, 64 nt, Homo Sapiens; identical to SEQ ID NO: 31458

SEQ ID NO: 403049 - RNA, 64 nt, Homo Sapiens; identical to SEQ ID NO: 31459

SEQ ID NO: 403050 - RNA, 64 nt, Homo Sapiens; identical to SEQ ID NO: 31460

SEQ ID NO: 403051 - RNA, 64 nt, Homo Sapiens; identical to SEQ ID NO: 31461

SEQ ID NO: 403052 - RNA, 64 nt, Homo Sapiens; identical to SEQ ID NO: 31462

SEQ ID NO: 403053 - RNA, 64 nt, Homo Sapiens; identical to SEQ ID NO: 31463

SEQ ID NO: 403054 - RNA, 64 nt, Homo Sapiens; identical to SEQ ID NO: 31464

SEQ ID NO: 403055 - RNA, 64 nt, Homo Sapiens; identical to SEQ ID NO: 31465

SEQ ID NO: 403056 - RNA, 64 nt, Homo Sapiens; identical to SEQ ID NO: 31466

SEQ ID NO: 403057 - RNA, 64 nt, Homo Sapiens; identical to SEQ ID NO: 31467

SEQ ID NO: 403058 - RNA, 64 nt, Homo Sapiens; identical to SEQ ID NO: 31468

SEQ ID NO: 403059 - RNA, 64 nt, Homo Sapiens; identical to SEQ ID NO: 31469

SEQ ID NO: 403060 - RNA, 64 nt, Homo Sapiens; identical to SEQ ID NO: 31470

SEQ ID NO: 403061 - RNA, 64 nt, Homo Sapiens; identical to SEQ ID NO: 31471

SEQ ID NO: 403062 - RNA, 64 nt, Homo Sapiens; identical to SEQ ID NO: 31472

SEQ ID NO: 403063 - RNA, 64 nt, Homo Sapiens; identical to SEQ ID NO: 31473

SEQ ID NO: 403064 - RNA, 64 nt, Homo Sapiens; identical to SEQ ID NO: 31474

SEQ ID NO: 403065 - RNA, 64 nt, Homo Sapiens; identical to SEQ ID NO: 31475

SEQ ID NO: 403066 - RNA, 64 nt, Homo Sapiens; identical to SEQ ID NO: 31476

SEQ ID NO: 403067 - RNA, 64 nt, Homo Sapiens; identical to SEQ ID NO: 31477

SEQ ID NO: 403068 - RNA, 64 nt, Homo Sapiens; identical to SEQ ID NO: 31478

SEQ ID NO: 403069 - RNA, 64 nt, Homo Sapiens; identical to SEQ ID NO: 31479

SEQ ID NO: 403070 - RNA, 64 nt, Homo Sapiens; identical to SEQ ID NO: 31480

SEQ ID NO: 403071 - RNA, 64 nt, Homo Sapiens; identical to SEQ ID NO: 31481

SEQ ID NO: 403072 - RNA, 64 nt, Homo Sapiens; identical to SEQ ID NO: 31482

SEQ ID NO: 403073 - RNA, 64 nt, Homo Sapiens; identical to SEQ ID NO: 31483

SEQ ID NO: 403074 - RNA, 64 nt, Homo Sapiens; identical to SEQ ID NO: 31484

SEQ ID NO: 403075 - RNA, 64 nt, Homo Sapiens; identical to SEQ ID NO: 31485

SEQ ID NO: 403076 - RNA, 64 nt, Homo Sapiens; identical to SEQ ID NO: 31486

SEQ ID NO: 403077 - RNA, 64 nt, Homo Sapiens; identical to SEQ ID NO: 31487

SEQ ID NO: 403078 - RNA, 64 nt, Homo Sapiens; identical to SEQ ID NO: 31488

SEQ ID NO: 403079 - RNA, 64 nt, Homo Sapiens; identical to SEQ ID NO: 31489

SEQ ID NO: 403080 - RNA, 64 nt, Homo Sapiens; identical to SEQ ID NO: 31490

SEQ ID NO: 403081 - RNA, 64 nt, Homo Sapiens; identical to SEQ ID NO: 31491

SEQ ID NO: 403082 - RNA, 64 nt, Homo Sapiens; identical to SEQ ID NO: 31492

SEQ ID NO: 403083 - RNA, 64 nt, Homo Sapiens; identical to SEQ ID NO: 31493

SEQ ID NO: 403084 - RNA, 64 nt, Homo Sapiens; identical to SEQ ID NO: 31494

SEQ ID NO: 403085 - RNA, 64 nt, Homo Sapiens; identical to SEQ ID NO: 31495

SEQ ID NO: 403086 - RNA, 64 nt, Homo Sapiens; identical to SEQ ID NO: 31496

SEQ ID NO: 403087 - RNA, 64 nt, Homo Sapiens; identical to SEQ ID NO: 31497

SEQ ID NO: 403088 - RNA, 64 nt, Homo Sapiens; identical to SEQ ID NO: 31498

SEQ ID NO: 403089 - RNA, 64 nt, Homo Sapiens; identical to SEQ ID NO: 31499

SEQ ID NO: 403090 - RNA, 64 nt, Homo Sapiens; identical to SEQ ID NO: 31500

SEQ ID NO: 403091 - RNA, 64 nt, Homo Sapiens; identical to SEQ ID NO: 31501

SEQ ID NO: 403092 - RNA, 64 nt, Homo Sapiens; identical to SEQ ID NO: 31502

SEQ ID NO: 403093 - RNA, 64 nt, Homo Sapiens; identical to SEQ ID NO: 31503

SEQ ID NO: 403094 - RNA, 64 nt, Homo Sapiens; identical to SEQ ID NO: 31504

SEQ ID NO: 403095 - RNA, 64 nt, Homo Sapiens; identical to SEQ ID NO: 31505

SEQ ID NO: 403096 - RNA, 64 nt, Homo Sapiens; identical to SEQ ID NO: 31506

SEQ ID NO: 403097 - RNA, 64 nt, Homo Sapiens; identical to SEQ ID NO: 31507

SEQ ID NO: 403098 - RNA, 64 nt, Homo Sapiens; identical to SEQ ID NO: 31508

SEQ ID NO: 403099 - RNA, 64 nt, Homo Sapiens; identical to SEQ ID NO: 31509

SEQ ID NO: 403100 - RNA, 64 nt, Homo Sapiens; identical to SEQ ID NO: 31510

SEQ ID NO: 403101 - RNA, 64 nt, Homo Sapiens; identical to SEQ ID NO: 31511

SEQ ID NO: 403102 - RNA, 64 nt, Homo Sapiens; identical to SEQ ID NO: 31512

SEQ ID NO: 403103 - RNA, 64 nt, Homo Sapiens; identical to SEQ ID NO: 31513

SEQ ID NO: 403104 - RNA, 64 nt, Homo Sapiens; identical to SEQ ID NO: 31514

SEQ ID NO: 403105 - RNA, 64 nt, Homo Sapiens; identical to SEQ ID NO: 31515

SEQ ID NO: 403106 - RNA, 64 nt, Homo Sapiens; identical to SEQ ID NO: 31516

SEQ ID NO: 403107 - RNA, 64 nt, Homo Sapiens; identical to SEQ ID NO: 31517

SEQ ID NO: 403108 - RNA, 64 nt, Homo Sapiens; identical to SEQ ID NO: 31518

SEQ ID NO: 403109 - RNA, 64 nt, Homo Sapiens; identical to SEQ ID NO: 31519

SEQ ID NO: 403110 - RNA, 64 nt, Homo Sapiens; identical to SEQ ID NO: 31520

SEQ ID NO: 403111 - RNA, 64 nt, Homo Sapiens; identical to SEQ ID NO: 31521

SEQ ID NO: 403112 - RNA, 64 nt, Homo Sapiens; identical to SEQ ID NO: 31522

SEQ ID NO: 403113 - RNA, 64 nt, Homo Sapiens; identical to SEQ ID NO: 31523

SEQ ID NO: 403114 - RNA, 64 nt, Homo Sapiens; identical to SEQ ID NO: 31524

SEQ ID NO: 403115 - RNA, 64 nt, Homo Sapiens; identical to SEQ ID NO: 31525

SEQ ID NO: 403116 - RNA, 64 nt, Homo Sapiens; identical to SEQ ID NO: 31526

SEQ ID NO: 403117 - RNA, 64 nt, Homo Sapiens; identical to SEQ ID NO: 31527

SEQ ID NO: 403118 - RNA, 64 nt, Homo Sapiens; identical to SEQ ID NO: 31528

SEQ ID NO: 403119 - RNA, 64 nt, Homo Sapiens; identical to SEQ ID NO: 31529

SEQ ID NO: 403120 - RNA, 64 nt, Homo Sapiens; identical to SEQ ID NO: 31530

SEQ ID NO: 403121 - RNA, 64 nt, Homo Sapiens; identical to SEQ ID NO: 31531

SEQ ID NO: 403122 - RNA, 64 nt, Homo Sapiens; identical to SEQ ID NO: 31532

SEQ ID NO: 403123 - RNA, 64 nt, Homo Sapiens; identical to SEQ ID NO: 31533

SEQ ID NO: 403124 - RNA, 64 nt, Homo Sapiens; identical to SEQ ID NO: 31534

SEQ ID NO: 403125 - RNA, 64 nt, Homo Sapiens; identical to SEQ ID NO: 31535

SEQ ID NO: 403126 - RNA, 64 nt, Homo Sapiens; identical to SEQ ID NO: 31536

SEQ ID NO: 403127 - RNA, 64 nt, Homo Sapiens; identical to SEQ ID NO: 31537

SEQ ID NO: 403128 - RNA, 64 nt, Homo Sapiens; identical to SEQ ID NO: 31538

SEQ ID NO: 403129 - RNA, 64 nt, Homo Sapiens; identical to SEQ ID NO: 31539

SEQ ID NO: 403130 - RNA, 64 nt, Homo Sapiens; identical to SEQ ID NO: 31540

SEQ ID NO: 403131 - RNA, 64 nt, Homo Sapiens; identical to SEQ ID NO: 31541

SEQ ID NO: 403132 - RNA, 64 nt, Homo Sapiens; identical to SEQ ID NO: 31542

SEQ ID NO: 403133 - RNA, 64 nt, Homo Sapiens; identical to SEQ ID NO: 31543

SEQ ID NO: 403134 - RNA, 64 nt, Homo Sapiens; identical to SEQ ID NO: 31544

SEQ ID NO: 403135 - RNA, 64 nt, Homo Sapiens; identical to SEQ ID NO: 31545

SEQ ID NO: 403136 - RNA, 64 nt, Homo Sapiens; identical to SEQ ID NO: 31546

SEQ ID NO: 403137 - RNA, 64 nt, Homo Sapiens; identical to SEQ ID NO: 31547

SEQ ID NO: 403138 - RNA, 64 nt, Homo Sapiens; identical to SEQ ID NO: 31548

SEQ ID NO: 403139 - RNA, 64 nt, Homo Sapiens; identical to SEQ ID NO: 31549

SEQ ID NO: 403140 - RNA, 64 nt, Homo Sapiens; identical to SEQ ID NO: 31550

SEQ ID NO: 403141 - RNA, 64 nt, Homo Sapiens; identical to SEQ ID NO: 31551

SEQ ID NO: 403142 - RNA, 64 nt, Homo Sapiens; identical to SEQ ID NO: 31552

SEQ ID NO: 403143 - RNA, 64 nt, Homo Sapiens; identical to SEQ ID NO: 31553

SEQ ID NO: 403144 - RNA, 64 nt, Homo Sapiens; identical to SEQ ID NO: 31554

SEQ ID NO: 403145 - RNA, 64 nt, Homo Sapiens; identical to SEQ ID NO: 31555

SEQ ID NO: 403146 - RNA, 64 nt, Homo Sapiens; identical to SEQ ID NO: 31556

SEQ ID NO: 403147 - RNA, 50 nt, Homo Sapiens; identical to SEQ ID NO: 31557

SEQ ID NO: 403148 - RNA, 51 nt, Homo Sapiens; identical to SEQ ID NO: 31558

SEQ ID NO: 403149 - RNA, 64 nt, Homo Sapiens; identical to SEQ ID NO: 31559

SEQ ID NO: 403150 - RNA, 64 nt, Homo Sapiens; identical to SEQ ID NO: 31560

SEQ ID NO: 403151 - RNA, 64 nt, Homo Sapiens; identical to SEQ ID NO: 31561

SEQ ID NO: 403152 - RNA, 64 nt, Homo Sapiens; identical to SEQ ID NO: 31562

SEQ ID NO: 403153 - RNA, 64 nt, Homo Sapiens; identical to SEQ ID NO: 31563

SEQ ID NO: 403154 - RNA, 64 nt, Homo Sapiens; identical to SEQ ID NO: 31564

SEQ ID NO: 403155 - RNA, 64 nt, Homo Sapiens; identical to SEQ ID NO: 31565

SEQ ID NO: 403156 - RNA, 64 nt, Homo Sapiens; identical to SEQ ID NO: 31566

SEQ ID NO: 403157 - RNA, 64 nt, Homo Sapiens; identical to SEQ ID NO: 31567

SEQ ID NO: 403158 - RNA, 64 nt, Homo Sapiens; identical to SEQ ID NO: 31568

SEQ ID NO: 403159 - RNA, 64 nt, Homo Sapiens; identical to SEQ ID NO: 31569

SEQ ID NO: 403160 - RNA, 64 nt, Homo Sapiens; identical to SEQ ID NO: 31570

SEQ ID NO: 403161 - RNA, 64 nt, Homo Sapiens; identical to SEQ ID NO: 31571

SEQ ID NO: 403162 - RNA, 64 nt, Homo Sapiens; identical to SEQ ID NO: 31572

SEQ ID NO: 403163 - RNA, 64 nt, Homo Sapiens; identical to SEQ ID NO: 31573

SEQ ID NO: 403164 - RNA, 64 nt, Homo Sapiens; identical to SEQ ID NO: 31574

SEQ ID NO: 403165 - RNA, 64 nt, Homo Sapiens; identical to SEQ ID NO: 31575

SEQ ID NO: 403166 - RNA, 64 nt, Homo Sapiens; identical to SEQ ID NO: 31576

SEQ ID NO: 403167 - RNA, 64 nt, Homo Sapiens; identical to SEQ ID NO: 31577

SEQ ID NO: 403168 - RNA, 64 nt, Homo Sapiens; identical to SEQ ID NO: 31578

SEQ ID NO: 403169 - RNA, 64 nt, Homo Sapiens; identical to SEQ ID NO: 31579

SEQ ID NO: 403170 - RNA, 64 nt, Homo Sapiens; identical to SEQ ID NO: 31580

SEQ ID NO: 403171 - RNA, 64 nt, Homo Sapiens; identical to SEQ ID NO: 31581

SEQ ID NO: 403172 - RNA, 64 nt, Homo Sapiens; identical to SEQ ID NO: 31582

SEQ ID NO: 403173 - RNA, 64 nt, Homo Sapiens; identical to SEQ ID NO: 31583

SEQ ID NO: 403174 - RNA, 64 nt, Homo Sapiens; identical to SEQ ID NO: 31584

SEQ ID NO: 403175 - RNA, 64 nt, Homo Sapiens; identical to SEQ ID NO: 31585

SEQ ID NO: 403176 - RNA, 64 nt, Homo Sapiens; identical to SEQ ID NO: 31586

SEQ ID NO: 403177 - RNA, 64 nt, Homo Sapiens; identical to SEQ ID NO: 31587

SEQ ID NO: 403178 - RNA, 64 nt, Homo Sapiens; identical to SEQ ID NO: 31588

SEQ ID NO: 403179 - RNA, 64 nt, Homo Sapiens; identical to SEQ ID NO: 31589

SEQ ID NO: 403180 - RNA, 64 nt, Homo Sapiens; identical to SEQ ID NO: 31590

SEQ ID NO: 403181 - RNA, 64 nt, Homo Sapiens; identical to SEQ ID NO: 31591

SEQ ID NO: 403182 - RNA, 64 nt, Homo Sapiens; identical to SEQ ID NO: 31592

SEQ ID NO: 403183 - RNA, 64 nt, Homo Sapiens; identical to SEQ ID NO: 31593

SEQ ID NO: 403184 - RNA, 64 nt, Homo Sapiens; identical to SEQ ID NO: 31594

SEQ ID NO: 403185 - RNA, 64 nt, Homo Sapiens; identical to SEQ ID NO: 31595

SEQ ID NO: 403186 - RNA, 64 nt, Homo Sapiens; identical to SEQ ID NO: 31596

SEQ ID NO: 403187 - RNA, 64 nt, Homo Sapiens; identical to SEQ ID NO: 31597

SEQ ID NO: 403188 - RNA, 64 nt, Homo Sapiens; identical to SEQ ID NO: 31598

SEQ ID NO: 403189 - RNA, 64 nt, Homo Sapiens; identical to SEQ ID NO: 31599

SEQ ID NO: 403190 - RNA, 64 nt, Homo Sapiens; identical to SEQ ID NO: 31600

SEQ ID NO: 403191 - RNA, 64 nt, Homo Sapiens; identical to SEQ ID NO: 31601

SEQ ID NO: 403192 - RNA, 64 nt, Homo Sapiens; identical to SEQ ID NO: 31602

SEQ ID NO: 403193 - RNA, 64 nt, Homo Sapiens; identical to SEQ ID NO: 31603

SEQ ID NO: 403194 - RNA, 64 nt, Homo Sapiens; identical to SEQ ID NO: 31604

SEQ ID NO: 403195 - RNA, 64 nt, Homo Sapiens; identical to SEQ ID NO: 31605

SEQ ID NO: 403196 - RNA, 64 nt, Homo Sapiens; identical to SEQ ID NO: 31606

SEQ ID NO: 403197 - RNA, 64 nt, Homo Sapiens; identical to SEQ ID NO: 31607

SEQ ID NO: 403198 - RNA, 64 nt, Homo Sapiens; identical to SEQ ID NO: 31608

SEQ ID NO: 403199 - RNA, 64 nt, Homo Sapiens; identical to SEQ ID NO: 31609

SEQ ID NO: 403200 - RNA, 64 nt, Homo Sapiens; identical to SEQ ID NO: 31610

SEQ ID NO: 403201 - RNA, 64 nt, Homo Sapiens; identical to SEQ ID NO: 31611

SEQ ID NO: 403202 - RNA, 64 nt, Homo Sapiens; identical to SEQ ID NO: 31612

SEQ ID NO: 403203 - RNA, 64 nt, Homo Sapiens; identical to SEQ ID NO: 31613

SEQ ID NO: 403204 - RNA, 64 nt, Homo Sapiens; identical to SEQ ID NO: 31614

SEQ ID NO: 403205 - RNA, 64 nt, Homo Sapiens; identical to SEQ ID NO: 31615

SEQ ID NO: 403206 - RNA, 64 nt, Homo Sapiens; identical to SEQ ID NO: 31616

SEQ ID NO: 403207 - RNA, 64 nt, Homo Sapiens; identical to SEQ ID NO: 31617

SEQ ID NO: 403208 - RNA, 64 nt, Homo Sapiens; identical to SEQ ID NO: 31618

SEQ ID NO: 403209 - RNA, 64 nt, Homo Sapiens; identical to SEQ ID NO: 31619

SEQ ID NO: 403210 - RNA, 64 nt, Homo Sapiens; identical to SEQ ID NO: 31620

SEQ ID NO: 403211 - RNA, 64 nt, Homo Sapiens; identical to SEQ ID NO: 31621

SEQ ID NO: 403212 - RNA, 55 nt, Homo Sapiens; identical to SEQ ID NO: 31622

SEQ ID NO: 403213 - RNA, 54 nt, Homo Sapiens; identical to SEQ ID NO: 31623

SEQ ID NO: 403214 - RNA, 64 nt, Homo Sapiens; identical to SEQ ID NO: 31624

SEQ ID NO: 403215 - RNA, 64 nt, Homo Sapiens; identical to SEQ ID NO: 31625

SEQ ID NO: 403216 - RNA, 64 nt, Homo Sapiens; identical to SEQ ID NO: 31626

SEQ ID NO: 403217 - RNA, 64 nt, Homo Sapiens; identical to SEQ ID NO: 31627

SEQ ID NO: 403218 - RNA, 64 nt, Homo Sapiens; identical to SEQ ID NO: 31628

SEQ ID NO: 403219 - RNA, 64 nt, Homo Sapiens; identical to SEQ ID NO: 31629

SEQ ID NO: 403220 - RNA, 64 nt, Homo Sapiens; identical to SEQ ID NO: 31630

SEQ ID NO: 403221 - RNA, 64 nt, Homo Sapiens; identical to SEQ ID NO: 31631

SEQ ID NO: 403222 - RNA, 64 nt, Homo Sapiens; identical to SEQ ID NO: 31632

SEQ ID NO: 403223 - RNA, 64 nt, Homo Sapiens; identical to SEQ ID NO: 31633

SEQ ID NO: 403224 - RNA, 64 nt, Homo Sapiens; identical to SEQ ID NO: 31634

SEQ ID NO: 403225 - RNA, 64 nt, Homo Sapiens; identical to SEQ ID NO: 31635

SEQ ID NO: 403226 - RNA, 64 nt, Homo Sapiens; identical to SEQ ID NO: 31636

SEQ ID NO: 403227 - RNA, 64 nt, Homo Sapiens; identical to SEQ ID NO: 31637

SEQ ID NO: 403228 - RNA, 64 nt, Homo Sapiens; identical to SEQ ID NO: 31638

SEQ ID NO: 403229 - RNA, 64 nt, Homo Sapiens; identical to SEQ ID NO: 31639

SEQ ID NO: 403230 - RNA, 64 nt, Homo Sapiens; identical to SEQ ID NO: 31640

SEQ ID NO: 403231 - RNA, 64 nt, Homo Sapiens; identical to SEQ ID NO: 31641

SEQ ID NO: 403232 - RNA, 64 nt, Homo Sapiens; identical to SEQ ID NO: 31642

SEQ ID NO: 403233 - RNA, 64 nt, Homo Sapiens; identical to SEQ ID NO: 31643

SEQ ID NO: 403234 - RNA, 64 nt, Homo Sapiens; identical to SEQ ID NO: 31644

SEQ ID NO: 403235 - RNA, 64 nt, Homo Sapiens; identical to SEQ ID NO: 31645

SEQ ID NO: 403236 - RNA, 64 nt, Homo Sapiens; identical to SEQ ID NO: 31646

SEQ ID NO: 403237 - RNA, 64 nt, Homo Sapiens; identical to SEQ ID NO: 31647

SEQ ID NO: 403238 - RNA, 64 nt, Homo Sapiens; identical to SEQ ID NO: 31648

SEQ ID NO: 403239 - RNA, 64 nt, Homo Sapiens; identical to SEQ ID NO: 31649

SEQ ID NO: 403240 - RNA, 64 nt, Homo Sapiens; identical to SEQ ID NO: 31650

SEQ ID NO: 403241 - RNA, 64 nt, Homo Sapiens; identical to SEQ ID NO: 31651

SEQ ID NO: 403242 - RNA, 64 nt, Homo Sapiens; identical to SEQ ID NO: 31652

SEQ ID NO: 403243 - RNA, 64 nt, Homo Sapiens; identical to SEQ ID NO: 31653

SEQ ID NO: 403244 - RNA, 64 nt, Homo Sapiens; identical to SEQ ID NO: 31654

SEQ ID NO: 403245 - RNA, 64 nt, Homo Sapiens; identical to SEQ ID NO: 31655

SEQ ID NO: 403246 - RNA, 64 nt, Homo Sapiens; identical to SEQ ID NO: 31656

SEQ ID NO: 403247 - RNA, 64 nt, Homo Sapiens; identical to SEQ ID NO: 31657

SEQ ID NO: 403248 - RNA, 64 nt, Homo Sapiens; identical to SEQ ID NO: 31658

SEQ ID NO: 403249 - RNA, 64 nt, Homo Sapiens; identical to SEQ ID NO: 31659

SEQ ID NO: 403250 - RNA, 64 nt, Homo Sapiens; identical to SEQ ID NO: 31660

SEQ ID NO: 403251 - RNA, 64 nt, Homo Sapiens; identical to SEQ ID NO: 31661

SEQ ID NO: 403252 - RNA, 64 nt, Homo Sapiens; identical to SEQ ID NO: 31662

SEQ ID NO: 403253 - RNA, 64 nt, Homo Sapiens; identical to SEQ ID NO: 31663

SEQ ID NO: 403254 - RNA, 64 nt, Homo Sapiens; identical to SEQ ID NO: 31664

SEQ ID NO: 403255 - RNA, 64 nt, Homo Sapiens; identical to SEQ ID NO: 31665

SEQ ID NO: 403256 - RNA, 64 nt, Homo Sapiens; identical to SEQ ID NO: 31666

SEQ ID NO: 403257 - RNA, 64 nt, Homo Sapiens; identical to SEQ ID NO: 31667

SEQ ID NO: 403258 - RNA, 64 nt, Homo Sapiens; identical to SEQ ID NO: 31668

SEQ ID NO: 403259 - RNA, 64 nt, Homo Sapiens; identical to SEQ ID NO: 31669

SEQ ID NO: 403260 - RNA, 64 nt, Homo Sapiens; identical to SEQ ID NO: 31670

SEQ ID NO: 403261 - RNA, 64 nt, Homo Sapiens; identical to SEQ ID NO: 31671

SEQ ID NO: 403262 - RNA, 64 nt, Homo Sapiens; identical to SEQ ID NO: 31672

SEQ ID NO: 403263 - RNA, 64 nt, Homo Sapiens; identical to SEQ ID NO: 31673

SEQ ID NO: 403264 - RNA, 60 nt, Homo Sapiens; identical to SEQ ID NO: 31674

SEQ ID NO: 403265 - RNA, 64 nt, Homo Sapiens; identical to SEQ ID NO: 31675

SEQ ID NO: 403266 - RNA, 64 nt, Homo Sapiens; identical to SEQ ID NO: 31676

SEQ ID NO: 403267 - RNA, 64 nt, Homo Sapiens; identical to SEQ ID NO: 31677

SEQ ID NO: 403268 - RNA, 64 nt, Homo Sapiens; identical to SEQ ID NO: 31678

SEQ ID NO: 403269 - RNA, 64 nt, Homo Sapiens; identical to SEQ ID NO: 31679

SEQ ID NO: 403270 - RNA, 64 nt, Homo Sapiens; identical to SEQ ID NO: 31680

SEQ ID NO: 403271 - RNA, 64 nt, Homo Sapiens; identical to SEQ ID NO: 31681

SEQ ID NO: 403272 - RNA, 64 nt, Homo Sapiens; identical to SEQ ID NO: 31682

SEQ ID NO: 403273 - RNA, 64 nt, Homo Sapiens; identical to SEQ ID NO: 31683

SEQ ID NO: 403274 - RNA, 64 nt, Homo Sapiens; identical to SEQ ID NO: 31684

SEQ ID NO: 403275 - RNA, 64 nt, Homo Sapiens; identical to SEQ ID NO: 31685

SEQ ID NO: 403276 - RNA, 64 nt, Homo Sapiens; identical to SEQ ID NO: 31686

SEQ ID NO: 403277 - RNA, 64 nt, Homo Sapiens; identical to SEQ ID NO: 31687

SEQ ID NO: 403278 - RNA, 64 nt, Homo Sapiens; identical to SEQ ID NO: 31688

SEQ ID NO: 403279 - RNA, 64 nt, Homo Sapiens; identical to SEQ ID NO: 31689

SEQ ID NO: 403280 - RNA, 64 nt, Homo Sapiens; identical to SEQ ID NO: 31690

SEQ ID NO: 403281 - RNA, 64 nt, Homo Sapiens; identical to SEQ ID NO: 31691

SEQ ID NO: 403282 - RNA, 64 nt, Homo Sapiens; identical to SEQ ID NO: 31692

SEQ ID NO: 403283 - RNA, 64 nt, Homo Sapiens; identical to SEQ ID NO: 31693

SEQ ID NO: 403284 - RNA, 64 nt, Homo Sapiens; identical to SEQ ID NO: 31694

SEQ ID NO: 403285 - RNA, 64 nt, Homo Sapiens; identical to SEQ ID NO: 31695

SEQ ID NO: 403286 - RNA, 64 nt, Homo Sapiens; identical to SEQ ID NO: 31696

SEQ ID NO: 403287 - RNA, 64 nt, Homo Sapiens; identical to SEQ ID NO: 31697

SEQ ID NO: 403288 - RNA, 64 nt, Homo Sapiens; identical to SEQ ID NO: 31698

SEQ ID NO: 403289 - RNA, 64 nt, Homo Sapiens; identical to SEQ ID NO: 31699

SEQ ID NO: 403290 - RNA, 64 nt, Homo Sapiens; identical to SEQ ID NO: 31700

SEQ ID NO: 403291 - RNA, 64 nt, Homo Sapiens; identical to SEQ ID NO: 31701

SEQ ID NO: 403292 - RNA, 64 nt, Homo Sapiens; identical to SEQ ID NO: 31702

SEQ ID NO: 403293 - RNA, 64 nt, Homo Sapiens; identical to SEQ ID NO: 31703

SEQ ID NO: 403294 - RNA, 64 nt, Homo Sapiens; identical to SEQ ID NO: 31704

SEQ ID NO: 403295 - RNA, 64 nt, Homo Sapiens; identical to SEQ ID NO: 31705

SEQ ID NO: 403296 - RNA, 64 nt, Homo Sapiens; identical to SEQ ID NO: 31706

SEQ ID NO: 403297 - RNA, 64 nt, Homo Sapiens; identical to SEQ ID NO: 31707

SEQ ID NO: 403298 - RNA, 64 nt, Homo Sapiens; identical to SEQ ID NO: 31708

SEQ ID NO: 403299 - RNA, 64 nt, Homo Sapiens; identical to SEQ ID NO: 31709

SEQ ID NO: 403300 - RNA, 64 nt, Homo Sapiens; identical to SEQ ID NO: 31710

SEQ ID NO: 403301 - RNA, 64 nt, Homo Sapiens; identical to SEQ ID NO: 31711

SEQ ID NO: 403302 - RNA, 64 nt, Homo Sapiens; identical to SEQ ID NO: 31712

SEQ ID NO: 403303 - RNA, 64 nt, Homo Sapiens; identical to SEQ ID NO: 31713

SEQ ID NO: 403304 - RNA, 64 nt, Homo Sapiens; identical to SEQ ID NO: 31714

SEQ ID NO: 403305 - RNA, 64 nt, Homo Sapiens; identical to SEQ ID NO: 31715

SEQ ID NO: 403306 - RNA, 64 nt, Homo Sapiens; identical to SEQ ID NO: 31716

SEQ ID NO: 403307 - RNA, 64 nt, Homo Sapiens; identical to SEQ ID NO: 31717

SEQ ID NO: 403308 - RNA, 64 nt, Homo Sapiens; identical to SEQ ID NO: 31718

SEQ ID NO: 403309 - RNA, 64 nt, Homo Sapiens; identical to SEQ ID NO: 31719

SEQ ID NO: 403310 - RNA, 64 nt, Homo Sapiens; identical to SEQ ID NO: 31720

SEQ ID NO: 403311 - RNA, 64 nt, Homo Sapiens; identical to SEQ ID NO: 31721

SEQ ID NO: 403312 - RNA, 64 nt, Homo Sapiens; identical to SEQ ID NO: 31722

SEQ ID NO: 403313 - RNA, 64 nt, Homo Sapiens; identical to SEQ ID NO: 31723

SEQ ID NO: 403314 - RNA, 64 nt, Homo Sapiens; identical to SEQ ID NO: 31724

SEQ ID NO: 403315 - RNA, 64 nt, Homo Sapiens; identical to SEQ ID NO: 31725

SEQ ID NO: 403316 - RNA, 64 nt, Homo Sapiens; identical to SEQ ID NO: 31726

SEQ ID NO: 403317 - RNA, 64 nt, Homo Sapiens; identical to SEQ ID NO: 31727

SEQ ID NO: 403318 - RNA, 64 nt, Homo Sapiens; identical to SEQ ID NO: 31728

SEQ ID NO: 403319 - RNA, 64 nt, Homo Sapiens; identical to SEQ ID NO: 31729

SEQ ID NO: 403320 - RNA, 64 nt, Homo Sapiens; identical to SEQ ID NO: 31730

SEQ ID NO: 403321 - RNA, 64 nt, Homo Sapiens; identical to SEQ ID NO: 31731

SEQ ID NO: 403322 - RNA, 64 nt, Homo Sapiens; identical to SEQ ID NO: 31732

SEQ ID NO: 403323 - RNA, 64 nt, Homo Sapiens; identical to SEQ ID NO: 31733

SEQ ID NO: 403324 - RNA, 64 nt, Homo Sapiens; identical to SEQ ID NO: 31734

SEQ ID NO: 403325 - RNA, 64 nt, Homo Sapiens; identical to SEQ ID NO: 31735

SEQ ID NO: 403326 - RNA, 64 nt, Homo Sapiens; identical to SEQ ID NO: 31736

SEQ ID NO: 403327 - RNA, 64 nt, Homo Sapiens; identical to SEQ ID NO: 31737

SEQ ID NO: 403328 - RNA, 64 nt, Homo Sapiens; identical to SEQ ID NO: 31738

SEQ ID NO: 403329 - RNA, 64 nt, Homo Sapiens; identical to SEQ ID NO: 31739

SEQ ID NO: 403330 - RNA, 64 nt, Homo Sapiens; identical to SEQ ID NO: 31740

SEQ ID NO: 403331 - RNA, 64 nt, Homo Sapiens; identical to SEQ ID NO: 31741

SEQ ID NO: 403332 - RNA, 64 nt, Homo Sapiens; identical to SEQ ID NO: 31742

SEQ ID NO: 403333 - RNA, 64 nt, Homo Sapiens; identical to SEQ ID NO: 31743

SEQ ID NO: 403334 - RNA, 64 nt, Homo Sapiens; identical to SEQ ID NO: 31744

SEQ ID NO: 403335 - RNA, 64 nt, Homo Sapiens; identical to SEQ ID NO: 31745

SEQ ID NO: 403336 - RNA, 64 nt, Homo Sapiens; identical to SEQ ID NO: 31746

SEQ ID NO: 403337 - RNA, 64 nt, Homo Sapiens; identical to SEQ ID NO: 31747

SEQ ID NO: 403338 - RNA, 64 nt, Homo Sapiens; identical to SEQ ID NO: 31748

SEQ ID NO: 403339 - RNA, 64 nt, Homo Sapiens; identical to SEQ ID NO: 31749

SEQ ID NO: 403340 - RNA, 64 nt, Homo Sapiens; identical to SEQ ID NO: 31750

SEQ ID NO: 403341 - RNA, 64 nt, Homo Sapiens; identical to SEQ ID NO: 31751

SEQ ID NO: 403342 - RNA, 64 nt, Homo Sapiens; identical to SEQ ID NO: 31752

SEQ ID NO: 403343 - RNA, 64 nt, Homo Sapiens; identical to SEQ ID NO: 31753

SEQ ID NO: 403344 - RNA, 64 nt, Homo Sapiens; identical to SEQ ID NO: 31754

SEQ ID NO: 403345 - RNA, 64 nt, Homo Sapiens; identical to SEQ ID NO: 31755

SEQ ID NO: 403346 - RNA, 64 nt, Homo Sapiens; identical to SEQ ID NO: 31756

SEQ ID NO: 403347 - RNA, 64 nt, Homo Sapiens; identical to SEQ ID NO: 31757

SEQ ID NO: 403348 - RNA, 64 nt, Homo Sapiens; identical to SEQ ID NO: 31758

SEQ ID NO: 403349 - RNA, 64 nt, Homo Sapiens; identical to SEQ ID NO: 31759

SEQ ID NO: 403350 - RNA, 64 nt, Homo Sapiens; identical to SEQ ID NO: 31760

SEQ ID NO: 403351 - RNA, 64 nt, Homo Sapiens; identical to SEQ ID NO: 31761

SEQ ID NO: 403352 - RNA, 64 nt, Homo Sapiens; identical to SEQ ID NO: 31762

SEQ ID NO: 403353 - RNA, 64 nt, Homo Sapiens; identical to SEQ ID NO: 31763

SEQ ID NO: 403354 - RNA, 64 nt, Homo Sapiens; identical to SEQ ID NO: 31764

SEQ ID NO: 403355 - RNA, 64 nt, Homo Sapiens; identical to SEQ ID NO: 31765

SEQ ID NO: 403356 - RNA, 64 nt, Homo Sapiens; identical to SEQ ID NO: 31766

SEQ ID NO: 403357 - RNA, 64 nt, Homo Sapiens; identical to SEQ ID NO: 31767

SEQ ID NO: 403358 - RNA, 64 nt, Homo Sapiens; identical to SEQ ID NO: 31768

SEQ ID NO: 403359 - RNA, 64 nt, Homo Sapiens; identical to SEQ ID NO: 31769

SEQ ID NO: 403360 - RNA, 64 nt, Homo Sapiens; identical to SEQ ID NO: 31770

SEQ ID NO: 403361 - RNA, 64 nt, Homo Sapiens; identical to SEQ ID NO: 31771

SEQ ID NO: 403362 - RNA, 64 nt, Homo Sapiens; identical to SEQ ID NO: 31772

SEQ ID NO: 403363 - RNA, 64 nt, Homo Sapiens; identical to SEQ ID NO: 31773

SEQ ID NO: 403364 - RNA, 64 nt, Homo Sapiens; identical to SEQ ID NO: 31774

SEQ ID NO: 403365 - RNA, 64 nt, Homo Sapiens; identical to SEQ ID NO: 31775

SEQ ID NO: 403366 - RNA, 64 nt, Homo Sapiens; identical to SEQ ID NO: 31776

SEQ ID NO: 403367 - RNA, 64 nt, Homo Sapiens; identical to SEQ ID NO: 31777

SEQ ID NO: 403368 - RNA, 64 nt, Homo Sapiens; identical to SEQ ID NO: 31778

SEQ ID NO: 403369 - RNA, 64 nt, Homo Sapiens; identical to SEQ ID NO: 31779

SEQ ID NO: 403370 - RNA, 64 nt, Homo Sapiens; identical to SEQ ID NO: 31780

SEQ ID NO: 403371 - RNA, 64 nt, Homo Sapiens; identical to SEQ ID NO: 31781

SEQ ID NO: 403372 - RNA, 64 nt, Homo Sapiens; identical to SEQ ID NO: 31782

SEQ ID NO: 403373 - RNA, 64 nt, Homo Sapiens; identical to SEQ ID NO: 31783

SEQ ID NO: 403374 - RNA, 64 nt, Homo Sapiens; identical to SEQ ID NO: 31784

SEQ ID NO: 403375 - RNA, 64 nt, Homo Sapiens; identical to SEQ ID NO: 31785

SEQ ID NO: 403376 - RNA, 64 nt, Homo Sapiens; identical to SEQ ID NO: 31786

SEQ ID NO: 403377 - RNA, 64 nt, Homo Sapiens; identical to SEQ ID NO: 31787

SEQ ID NO: 403378 - RNA, 64 nt, Homo Sapiens; identical to SEQ ID NO: 31788

SEQ ID NO: 403379 - RNA, 64 nt, Homo Sapiens; identical to SEQ ID NO: 31789

SEQ ID NO: 403380 - RNA, 64 nt, Homo Sapiens; identical to SEQ ID NO: 31790

SEQ ID NO: 403381 - RNA, 64 nt, Homo Sapiens; identical to SEQ ID NO: 31791

SEQ ID NO: 403382 - RNA, 64 nt, Homo Sapiens; identical to SEQ ID NO: 31792

SEQ ID NO: 403383 - RNA, 64 nt, Homo Sapiens; identical to SEQ ID NO: 31793

SEQ ID NO: 403384 - RNA, 64 nt, Homo Sapiens; identical to SEQ ID NO: 31794

SEQ ID NO: 403385 - RNA, 64 nt, Homo Sapiens; identical to SEQ ID NO: 31795

SEQ ID NO: 403386 - RNA, 64 nt, Homo Sapiens; identical to SEQ ID NO: 31796

SEQ ID NO: 403387 - RNA, 64 nt, Homo Sapiens; identical to SEQ ID NO: 31797

SEQ ID NO: 403388 - RNA, 64 nt, Homo Sapiens; identical to SEQ ID NO: 31798

SEQ ID NO: 403389 - RNA, 64 nt, Homo Sapiens; identical to SEQ ID NO: 31799

SEQ ID NO: 403390 - RNA, 64 nt, Homo Sapiens; identical to SEQ ID NO: 31800

SEQ ID NO: 403391 - RNA, 64 nt, Homo Sapiens; identical to SEQ ID NO: 31801

SEQ ID NO: 403392 - RNA, 64 nt, Homo Sapiens; identical to SEQ ID NO: 31802

SEQ ID NO: 403393 - RNA, 64 nt, Homo Sapiens; identical to SEQ ID NO: 31803

SEQ ID NO: 403394 - RNA, 64 nt, Homo Sapiens; identical to SEQ ID NO: 31804

SEQ ID NO: 403395 - RNA, 64 nt, Homo Sapiens; identical to SEQ ID NO: 31805

SEQ ID NO: 403396 - RNA, 64 nt, Homo Sapiens; identical to SEQ ID NO: 31806

SEQ ID NO: 403397 - RNA, 64 nt, Homo Sapiens; identical to SEQ ID NO: 31807

SEQ ID NO: 403398 - RNA, 64 nt, Homo Sapiens; identical to SEQ ID NO: 31808

SEQ ID NO: 403399 - RNA, 64 nt, Homo Sapiens; identical to SEQ ID NO: 31809

SEQ ID NO: 403400 - RNA, 64 nt, Homo Sapiens; identical to SEQ ID NO: 31810

SEQ ID NO: 403401 - RNA, 64 nt, Homo Sapiens; identical to SEQ ID NO: 31811

SEQ ID NO: 403402 - RNA, 64 nt, Homo Sapiens; identical to SEQ ID NO: 31812

SEQ ID NO: 403403 - RNA, 64 nt, Homo Sapiens; identical to SEQ ID NO: 31813

SEQ ID NO: 403404 - RNA, 64 nt, Homo Sapiens; identical to SEQ ID NO: 31814

SEQ ID NO: 403405 - RNA, 64 nt, Homo Sapiens; identical to SEQ ID NO: 31815

SEQ ID NO: 403406 - RNA, 64 nt, Homo Sapiens; identical to SEQ ID NO: 31816

SEQ ID NO: 403407 - RNA, 64 nt, Homo Sapiens; identical to SEQ ID NO: 31817

SEQ ID NO: 403408 - RNA, 64 nt, Homo Sapiens; identical to SEQ ID NO: 31818

SEQ ID NO: 403409 - RNA, 64 nt, Homo Sapiens; identical to SEQ ID NO: 31819

SEQ ID NO: 403410 - RNA, 64 nt, Homo Sapiens; identical to SEQ ID NO: 31820

SEQ ID NO: 403411 - RNA, 64 nt, Homo Sapiens; identical to SEQ ID NO: 31821

SEQ ID NO: 403412 - RNA, 64 nt, Homo Sapiens; identical to SEQ ID NO: 31822

SEQ ID NO: 403413 - RNA, 64 nt, Homo Sapiens; identical to SEQ ID NO: 31823

SEQ ID NO: 403414 - RNA, 64 nt, Homo Sapiens; identical to SEQ ID NO: 31824

SEQ ID NO: 403415 - RNA, 64 nt, Homo Sapiens; identical to SEQ ID NO: 31825

SEQ ID NO: 403416 - RNA, 64 nt, Homo Sapiens; identical to SEQ ID NO: 31826

SEQ ID NO: 403417 - RNA, 64 nt, Homo Sapiens; identical to SEQ ID NO: 31827

SEQ ID NO: 403418 - RNA, 64 nt, Homo Sapiens; identical to SEQ ID NO: 31828

SEQ ID NO: 403419 - RNA, 64 nt, Homo Sapiens; identical to SEQ ID NO: 31829

SEQ ID NO: 403420 - RNA, 64 nt, Homo Sapiens; identical to SEQ ID NO: 31830

SEQ ID NO: 403421 - RNA, 64 nt, Homo Sapiens; identical to SEQ ID NO: 31831

SEQ ID NO: 403422 - RNA, 64 nt, Homo Sapiens; identical to SEQ ID NO: 31832

SEQ ID NO: 403423 - RNA, 64 nt, Homo Sapiens; identical to SEQ ID NO: 31833

SEQ ID NO: 403424 - RNA, 64 nt, Homo Sapiens; identical to SEQ ID NO: 31834

SEQ ID NO: 403425 - RNA, 64 nt, Homo Sapiens; identical to SEQ ID NO: 31835

SEQ ID NO: 403426 - RNA, 64 nt, Homo Sapiens; identical to SEQ ID NO: 31836

SEQ ID NO: 403427 - RNA, 64 nt, Homo Sapiens; identical to SEQ ID NO: 31837

SEQ ID NO: 403428 - RNA, 64 nt, Homo Sapiens; identical to SEQ ID NO: 31838

SEQ ID NO: 403429 - RNA, 64 nt, Homo Sapiens; identical to SEQ ID NO: 31839

SEQ ID NO: 403430 - RNA, 64 nt, Homo Sapiens; identical to SEQ ID NO: 31840

SEQ ID NO: 403431 - RNA, 64 nt, Homo Sapiens; identical to SEQ ID NO: 31841

SEQ ID NO: 403432 - RNA, 64 nt, Homo Sapiens; identical to SEQ ID NO: 31842

SEQ ID NO: 403433 - RNA, 64 nt, Homo Sapiens; identical to SEQ ID NO: 31843

SEQ ID NO: 403434 - RNA, 64 nt, Homo Sapiens; identical to SEQ ID NO: 31844

SEQ ID NO: 403435 - RNA, 64 nt, Homo Sapiens; identical to SEQ ID NO: 31845

SEQ ID NO: 403436 - RNA, 64 nt, Homo Sapiens; identical to SEQ ID NO: 31846

SEQ ID NO: 403437 - RNA, 64 nt, Homo Sapiens; identical to SEQ ID NO: 31847

SEQ ID NO: 403438 - RNA, 64 nt, Homo Sapiens; identical to SEQ ID NO: 31848

SEQ ID NO: 403439 - RNA, 64 nt, Homo Sapiens; identical to SEQ ID NO: 31849

SEQ ID NO: 403440 - RNA, 64 nt, Homo Sapiens; identical to SEQ ID NO: 31850

SEQ ID NO: 403441 - RNA, 64 nt, Homo Sapiens; identical to SEQ ID NO: 31851

SEQ ID NO: 403442 - RNA, 64 nt, Homo Sapiens; identical to SEQ ID NO: 31852

SEQ ID NO: 403443 - RNA, 64 nt, Homo Sapiens; identical to SEQ ID NO: 31853

SEQ ID NO: 403444 - RNA, 64 nt, Homo Sapiens; identical to SEQ ID NO: 31854

SEQ ID NO: 403445 - RNA, 64 nt, Homo Sapiens; identical to SEQ ID NO: 31855

SEQ ID NO: 403446 - RNA, 64 nt, Homo Sapiens; identical to SEQ ID NO: 31856

SEQ ID NO: 403447 - RNA, 64 nt, Homo Sapiens; identical to SEQ ID NO: 31857

SEQ ID NO: 403448 - RNA, 64 nt, Homo Sapiens; identical to SEQ ID NO: 31858

SEQ ID NO: 403449 - RNA, 64 nt, Homo Sapiens; identical to SEQ ID NO: 31859

SEQ ID NO: 403450 - RNA, 64 nt, Homo Sapiens; identical to SEQ ID NO: 31860

SEQ ID NO: 403451 - RNA, 64 nt, Homo Sapiens; identical to SEQ ID NO: 31861

SEQ ID NO: 403452 - RNA, 64 nt, Homo Sapiens; identical to SEQ ID NO: 31862

SEQ ID NO: 403453 - RNA, 64 nt, Homo Sapiens; identical to SEQ ID NO: 31863

SEQ ID NO: 403454 - RNA, 64 nt, Homo Sapiens; identical to SEQ ID NO: 31864

SEQ ID NO: 403455 - RNA, 64 nt, Homo Sapiens; identical to SEQ ID NO: 31865

SEQ ID NO: 403456 - RNA, 64 nt, Homo Sapiens; identical to SEQ ID NO: 31866

SEQ ID NO: 403457 - RNA, 64 nt, Homo Sapiens; identical to SEQ ID NO: 31867

SEQ ID NO: 403458 - RNA, 64 nt, Homo Sapiens; identical to SEQ ID NO: 31868

SEQ ID NO: 403459 - RNA, 64 nt, Homo Sapiens; identical to SEQ ID NO: 31869

SEQ ID NO: 403460 - RNA, 64 nt, Homo Sapiens; identical to SEQ ID NO: 31870

SEQ ID NO: 403461 - RNA, 64 nt, Homo Sapiens; identical to SEQ ID NO: 31871

SEQ ID NO: 403462 - RNA, 64 nt, Homo Sapiens; identical to SEQ ID NO: 31872

SEQ ID NO: 403463 - RNA, 64 nt, Homo Sapiens; identical to SEQ ID NO: 31873

SEQ ID NO: 403464 - RNA, 64 nt, Homo Sapiens; identical to SEQ ID NO: 31874

SEQ ID NO: 403465 - RNA, 64 nt, Homo Sapiens; identical to SEQ ID NO: 31875

SEQ ID NO: 403466 - RNA, 64 nt, Homo Sapiens; identical to SEQ ID NO: 31876

SEQ ID NO: 403467 - RNA, 64 nt, Homo Sapiens; identical to SEQ ID NO: 31877

SEQ ID NO: 403468 - RNA, 64 nt, Homo Sapiens; identical to SEQ ID NO: 31878

SEQ ID NO: 403469 - RNA, 64 nt, Homo Sapiens; identical to SEQ ID NO: 31879

SEQ ID NO: 403470 - RNA, 64 nt, Homo Sapiens; identical to SEQ ID NO: 31880

SEQ ID NO: 403471 - RNA, 64 nt, Homo Sapiens; identical to SEQ ID NO: 31881

SEQ ID NO: 403472 - RNA, 64 nt, Homo Sapiens; identical to SEQ ID NO: 31882

SEQ ID NO: 403473 - RNA, 64 nt, Homo Sapiens; identical to SEQ ID NO: 31883

SEQ ID NO: 403474 - RNA, 64 nt, Homo Sapiens; identical to SEQ ID NO: 31884

SEQ ID NO: 403475 - RNA, 64 nt, Homo Sapiens; identical to SEQ ID NO: 31885

SEQ ID NO: 403476 - RNA, 64 nt, Homo Sapiens; identical to SEQ ID NO: 31886

SEQ ID NO: 403477 - RNA, 64 nt, Homo Sapiens; identical to SEQ ID NO: 31887

SEQ ID NO: 403478 - RNA, 64 nt, Homo Sapiens; identical to SEQ ID NO: 31888

SEQ ID NO: 403479 - RNA, 64 nt, Homo Sapiens; identical to SEQ ID NO: 31889

SEQ ID NO: 403480 - RNA, 64 nt, Homo Sapiens; identical to SEQ ID NO: 31890

SEQ ID NO: 403481 - RNA, 64 nt, Homo Sapiens; identical to SEQ ID NO: 31891

SEQ ID NO: 403482 - RNA, 64 nt, Homo Sapiens; identical to SEQ ID NO: 31892

SEQ ID NO: 403483 - RNA, 64 nt, Homo Sapiens; identical to SEQ ID NO: 31893

SEQ ID NO: 403484 - RNA, 64 nt, Homo Sapiens; identical to SEQ ID NO: 31894

SEQ ID NO: 403485 - RNA, 64 nt, Homo Sapiens; identical to SEQ ID NO: 31895

SEQ ID NO: 403486 - RNA, 64 nt, Homo Sapiens; identical to SEQ ID NO: 31896

SEQ ID NO: 403487 - RNA, 64 nt, Homo Sapiens; identical to SEQ ID NO: 31897

SEQ ID NO: 403488 - RNA, 64 nt, Homo Sapiens; identical to SEQ ID NO: 31898

SEQ ID NO: 403489 - RNA, 64 nt, Homo Sapiens; identical to SEQ ID NO: 31899

SEQ ID NO: 403490 - RNA, 64 nt, Homo Sapiens; identical to SEQ ID NO: 31900

SEQ ID NO: 403491 - RNA, 64 nt, Homo Sapiens; identical to SEQ ID NO: 31901

SEQ ID NO: 403492 - RNA, 64 nt, Homo Sapiens; identical to SEQ ID NO: 31902

SEQ ID NO: 403493 - RNA, 64 nt, Homo Sapiens; identical to SEQ ID NO: 31903

SEQ ID NO: 403494 - RNA, 64 nt, Homo Sapiens; identical to SEQ ID NO: 31904

SEQ ID NO: 403495 - RNA, 64 nt, Homo Sapiens; identical to SEQ ID NO: 31905

SEQ ID NO: 403496 - RNA, 64 nt, Homo Sapiens; identical to SEQ ID NO: 31906

SEQ ID NO: 403497 - RNA, 64 nt, Homo Sapiens; identical to SEQ ID NO: 31907

SEQ ID NO: 403498 - RNA, 64 nt, Homo Sapiens; identical to SEQ ID NO: 31908

SEQ ID NO: 403499 - RNA, 64 nt, Homo Sapiens; identical to SEQ ID NO: 31909

SEQ ID NO: 403500 - RNA, 64 nt, Homo Sapiens; identical to SEQ ID NO: 31910

SEQ ID NO: 403501 - RNA, 64 nt, Homo Sapiens; identical to SEQ ID NO: 31911

SEQ ID NO: 403502 - RNA, 64 nt, Homo Sapiens; identical to SEQ ID NO: 31912

SEQ ID NO: 403503 - RNA, 64 nt, Homo Sapiens; identical to SEQ ID NO: 31913

SEQ ID NO: 403504 - RNA, 64 nt, Homo Sapiens; identical to SEQ ID NO: 31914

SEQ ID NO: 403505 - RNA, 64 nt, Homo Sapiens; identical to SEQ ID NO: 31915

SEQ ID NO: 403506 - RNA, 64 nt, Homo Sapiens; identical to SEQ ID NO: 31916

SEQ ID NO: 403507 - RNA, 64 nt, Homo Sapiens; identical to SEQ ID NO: 31917

SEQ ID NO: 403508 - RNA, 64 nt, Homo Sapiens; identical to SEQ ID NO: 31918

SEQ ID NO: 403509 - RNA, 64 nt, Homo Sapiens; identical to SEQ ID NO: 31919

SEQ ID NO: 403510 - RNA, 64 nt, Homo Sapiens; identical to SEQ ID NO: 31920

SEQ ID NO: 403511 - RNA, 64 nt, Homo Sapiens; identical to SEQ ID NO: 31921

SEQ ID NO: 403512 - RNA, 64 nt, Homo Sapiens; identical to SEQ ID NO: 31922

SEQ ID NO: 403513 - RNA, 64 nt, Homo Sapiens; identical to SEQ ID NO: 31923

SEQ ID NO: 403514 - RNA, 64 nt, Homo Sapiens; identical to SEQ ID NO: 31924

SEQ ID NO: 403515 - RNA, 64 nt, Homo Sapiens; identical to SEQ ID NO: 31925

SEQ ID NO: 403516 - RNA, 64 nt, Homo Sapiens; identical to SEQ ID NO: 31926

SEQ ID NO: 403517 - RNA, 64 nt, Homo Sapiens; identical to SEQ ID NO: 31927

SEQ ID NO: 403518 - RNA, 64 nt, Homo Sapiens; identical to SEQ ID NO: 31928

SEQ ID NO: 403519 - RNA, 64 nt, Homo Sapiens; identical to SEQ ID NO: 31929

SEQ ID NO: 403520 - RNA, 64 nt, Homo Sapiens; identical to SEQ ID NO: 31930

SEQ ID NO: 403521 - RNA, 64 nt, Homo Sapiens; identical to SEQ ID NO: 31931

SEQ ID NO: 403522 - RNA, 64 nt, Homo Sapiens; identical to SEQ ID NO: 31932

SEQ ID NO: 403523 - RNA, 64 nt, Homo Sapiens; identical to SEQ ID NO: 31933

SEQ ID NO: 403524 - RNA, 64 nt, Homo Sapiens; identical to SEQ ID NO: 31934

SEQ ID NO: 403525 - RNA, 64 nt, Homo Sapiens; identical to SEQ ID NO: 31935

SEQ ID NO: 403526 - RNA, 64 nt, Homo Sapiens; identical to SEQ ID NO: 31936

SEQ ID NO: 403527 - RNA, 64 nt, Homo Sapiens; identical to SEQ ID NO: 31937

SEQ ID NO: 403528 - RNA, 64 nt, Homo Sapiens; identical to SEQ ID NO: 31938

SEQ ID NO: 403529 - RNA, 64 nt, Homo Sapiens; identical to SEQ ID NO: 31939

SEQ ID NO: 403530 - RNA, 64 nt, Homo Sapiens; identical to SEQ ID NO: 31940

SEQ ID NO: 403531 - RNA, 64 nt, Homo Sapiens; identical to SEQ ID NO: 31941

SEQ ID NO: 403532 - RNA, 64 nt, Homo Sapiens; identical to SEQ ID NO: 31942

SEQ ID NO: 403533 - RNA, 64 nt, Homo Sapiens; identical to SEQ ID NO: 31943

SEQ ID NO: 403534 - RNA, 64 nt, Homo Sapiens; identical to SEQ ID NO: 31944

SEQ ID NO: 403535 - RNA, 64 nt, Homo Sapiens; identical to SEQ ID NO: 31945

SEQ ID NO: 403536 - RNA, 64 nt, Homo Sapiens; identical to SEQ ID NO: 31946

SEQ ID NO: 403537 - RNA, 64 nt, Homo Sapiens; identical to SEQ ID NO: 31947

SEQ ID NO: 403538 - RNA, 64 nt, Homo Sapiens; identical to SEQ ID NO: 31948

SEQ ID NO: 403539 - RNA, 64 nt, Homo Sapiens; identical to SEQ ID NO: 31949

SEQ ID NO: 403540 - RNA, 64 nt, Homo Sapiens; identical to SEQ ID NO: 31950

SEQ ID NO: 403541 - RNA, 64 nt, Homo Sapiens; identical to SEQ ID NO: 31951

SEQ ID NO: 403542 - RNA, 64 nt, Homo Sapiens; identical to SEQ ID NO: 31952

SEQ ID NO: 403543 - RNA, 64 nt, Homo Sapiens; identical to SEQ ID NO: 31953

SEQ ID NO: 403544 - RNA, 64 nt, Homo Sapiens; identical to SEQ ID NO: 31954

SEQ ID NO: 403545 - RNA, 64 nt, Homo Sapiens; identical to SEQ ID NO: 31955

SEQ ID NO: 403546 - RNA, 64 nt, Homo Sapiens; identical to SEQ ID NO: 31956

SEQ ID NO: 403547 - RNA, 64 nt, Homo Sapiens; identical to SEQ ID NO: 31957

SEQ ID NO: 403548 - RNA, 64 nt, Homo Sapiens; identical to SEQ ID NO: 31958

SEQ ID NO: 403549 - RNA, 64 nt, Homo Sapiens; identical to SEQ ID NO: 31959

SEQ ID NO: 403550 - RNA, 64 nt, Homo Sapiens; identical to SEQ ID NO: 31960

SEQ ID NO: 403551 - RNA, 64 nt, Homo Sapiens; identical to SEQ ID NO: 31961

SEQ ID NO: 403552 - RNA, 64 nt, Homo Sapiens; identical to SEQ ID NO: 31962

SEQ ID NO: 403553 - RNA, 64 nt, Homo Sapiens; identical to SEQ ID NO: 31963

SEQ ID NO: 403554 - RNA, 64 nt, Homo Sapiens; identical to SEQ ID NO: 31964

SEQ ID NO: 403555 - RNA, 64 nt, Homo Sapiens; identical to SEQ ID NO: 31965

SEQ ID NO: 403556 - RNA, 64 nt, Homo Sapiens; identical to SEQ ID NO: 31966

SEQ ID NO: 403557 - RNA, 64 nt, Homo Sapiens; identical to SEQ ID NO: 31967

SEQ ID NO: 403558 - RNA, 64 nt, Homo Sapiens; identical to SEQ ID NO: 31968

SEQ ID NO: 403559 - RNA, 64 nt, Homo Sapiens; identical to SEQ ID NO: 31969

SEQ ID NO: 403560 - RNA, 64 nt, Homo Sapiens; identical to SEQ ID NO: 31970

SEQ ID NO: 403561 - RNA, 64 nt, Homo Sapiens; identical to SEQ ID NO: 31971

SEQ ID NO: 403562 - RNA, 64 nt, Homo Sapiens; identical to SEQ ID NO: 31972

SEQ ID NO: 403563 - RNA, 64 nt, Homo Sapiens; identical to SEQ ID NO: 31973

SEQ ID NO: 403564 - RNA, 64 nt, Homo Sapiens; identical to SEQ ID NO: 31974

SEQ ID NO: 403565 - RNA, 64 nt, Homo Sapiens; identical to SEQ ID NO: 31975

SEQ ID NO: 403566 - RNA, 64 nt, Homo Sapiens; identical to SEQ ID NO: 31976

SEQ ID NO: 403567 - RNA, 64 nt, Homo Sapiens; identical to SEQ ID NO: 31977

SEQ ID NO: 403568 - RNA, 64 nt, Homo Sapiens; identical to SEQ ID NO: 31978

SEQ ID NO: 403569 - RNA, 64 nt, Homo Sapiens; identical to SEQ ID NO: 31979

SEQ ID NO: 403570 - RNA, 64 nt, Homo Sapiens; identical to SEQ ID NO: 31980

SEQ ID NO: 403571 - RNA, 64 nt, Homo Sapiens; identical to SEQ ID NO: 31981

SEQ ID NO: 403572 - RNA, 64 nt, Homo Sapiens; identical to SEQ ID NO: 31982

SEQ ID NO: 403573 - RNA, 64 nt, Homo Sapiens; identical to SEQ ID NO: 31983

SEQ ID NO: 403574 - RNA, 64 nt, Homo Sapiens; identical to SEQ ID NO: 31984

SEQ ID NO: 403575 - RNA, 64 nt, Homo Sapiens; identical to SEQ ID NO: 31985

SEQ ID NO: 403576 - RNA, 64 nt, Homo Sapiens; identical to SEQ ID NO: 31986

SEQ ID NO: 403577 - RNA, 64 nt, Homo Sapiens; identical to SEQ ID NO: 31987

SEQ ID NO: 403578 - RNA, 64 nt, Homo Sapiens; identical to SEQ ID NO: 31988

SEQ ID NO: 403579 - RNA, 64 nt, Homo Sapiens; identical to SEQ ID NO: 31989

SEQ ID NO: 403580 - RNA, 64 nt, Homo Sapiens; identical to SEQ ID NO: 31990

SEQ ID NO: 403581 - RNA, 64 nt, Homo Sapiens; identical to SEQ ID NO: 31991

SEQ ID NO: 403582 - RNA, 64 nt, Homo Sapiens; identical to SEQ ID NO: 31992

SEQ ID NO: 403583 - RNA, 64 nt, Homo Sapiens; identical to SEQ ID NO: 31993

SEQ ID NO: 403584 - RNA, 64 nt, Homo Sapiens; identical to SEQ ID NO: 31994

SEQ ID NO: 403585 - RNA, 64 nt, Homo Sapiens; identical to SEQ ID NO: 31995

SEQ ID NO: 403586 - RNA, 64 nt, Homo Sapiens; identical to SEQ ID NO: 31996

SEQ ID NO: 403587 - RNA, 64 nt, Homo Sapiens; identical to SEQ ID NO: 31997

SEQ ID NO: 403588 - RNA, 64 nt, Homo Sapiens; identical to SEQ ID NO: 31998

SEQ ID NO: 403589 - RNA, 64 nt, Homo Sapiens; identical to SEQ ID NO: 31999

SEQ ID NO: 403590 - RNA, 64 nt, Homo Sapiens; identical to SEQ ID NO: 32000

SEQ ID NO: 403591 - RNA, 64 nt, Homo Sapiens; identical to SEQ ID NO: 32001

SEQ ID NO: 403592 - RNA, 64 nt, Homo Sapiens; identical to SEQ ID NO: 32002

SEQ ID NO: 403593 - RNA, 64 nt, Homo Sapiens; identical to SEQ ID NO: 32003

SEQ ID NO: 403594 - RNA, 64 nt, Homo Sapiens; identical to SEQ ID NO: 32004

SEQ ID NO: 403595 - RNA, 64 nt, Homo Sapiens; identical to SEQ ID NO: 32005

SEQ ID NO: 403596 - RNA, 64 nt, Homo Sapiens; identical to SEQ ID NO: 32006

SEQ ID NO: 403597 - RNA, 64 nt, Homo Sapiens; identical to SEQ ID NO: 32007

SEQ ID NO: 403598 - RNA, 64 nt, Homo Sapiens; identical to SEQ ID NO: 32008

SEQ ID NO: 403599 - RNA, 64 nt, Homo Sapiens; identical to SEQ ID NO: 32009

SEQ ID NO: 403600 - RNA, 64 nt, Homo Sapiens; identical to SEQ ID NO: 32010

SEQ ID NO: 403601 - RNA, 64 nt, Homo Sapiens; identical to SEQ ID NO: 32011

SEQ ID NO: 403602 - RNA, 64 nt, Homo Sapiens; identical to SEQ ID NO: 32012

SEQ ID NO: 403603 - RNA, 64 nt, Homo Sapiens; identical to SEQ ID NO: 32013

SEQ ID NO: 403604 - RNA, 64 nt, Homo Sapiens; identical to SEQ ID NO: 32014

SEQ ID NO: 403605 - RNA, 64 nt, Homo Sapiens; identical to SEQ ID NO: 32015

SEQ ID NO: 403606 - RNA, 64 nt, Homo Sapiens; identical to SEQ ID NO: 32016

SEQ ID NO: 403607 - RNA, 64 nt, Homo Sapiens; identical to SEQ ID NO: 32017

SEQ ID NO: 403608 - RNA, 64 nt, Homo Sapiens; identical to SEQ ID NO: 32018

SEQ ID NO: 403609 - RNA, 64 nt, Homo Sapiens; identical to SEQ ID NO: 32019

SEQ ID NO: 403610 - RNA, 64 nt, Homo Sapiens; identical to SEQ ID NO: 32020

SEQ ID NO: 403611 - RNA, 64 nt, Homo Sapiens; identical to SEQ ID NO: 32021

SEQ ID NO: 403612 - RNA, 64 nt, Homo Sapiens; identical to SEQ ID NO: 32022

SEQ ID NO: 403613 - RNA, 64 nt, Homo Sapiens; identical to SEQ ID NO: 32023

SEQ ID NO: 403614 - RNA, 64 nt, Homo Sapiens; identical to SEQ ID NO: 32024

SEQ ID NO: 403615 - RNA, 64 nt, Homo Sapiens; identical to SEQ ID NO: 32025

SEQ ID NO: 403616 - RNA, 64 nt, Homo Sapiens; identical to SEQ ID NO: 32026

SEQ ID NO: 403617 - RNA, 64 nt, Homo Sapiens; identical to SEQ ID NO: 32027

SEQ ID NO: 403618 - RNA, 64 nt, Homo Sapiens; identical to SEQ ID NO: 32028

SEQ ID NO: 403619 - RNA, 64 nt, Homo Sapiens; identical to SEQ ID NO: 32029

SEQ ID NO: 403620 - RNA, 64 nt, Homo Sapiens; identical to SEQ ID NO: 32030

SEQ ID NO: 403621 - RNA, 64 nt, Homo Sapiens; identical to SEQ ID NO: 32031

SEQ ID NO: 403622 - RNA, 64 nt, Homo Sapiens; identical to SEQ ID NO: 32032

SEQ ID NO: 403623 - RNA, 64 nt, Homo Sapiens; identical to SEQ ID NO: 32033

SEQ ID NO: 403624 - RNA, 64 nt, Homo Sapiens; identical to SEQ ID NO: 32034

SEQ ID NO: 403625 - RNA, 64 nt, Homo Sapiens; identical to SEQ ID NO: 32035

SEQ ID NO: 403626 - RNA, 64 nt, Homo Sapiens; identical to SEQ ID NO: 32036

SEQ ID NO: 403627 - RNA, 64 nt, Homo Sapiens; identical to SEQ ID NO: 32037

SEQ ID NO: 403628 - RNA, 64 nt, Homo Sapiens; identical to SEQ ID NO: 32038

SEQ ID NO: 403629 - RNA, 64 nt, Homo Sapiens; identical to SEQ ID NO: 32039

SEQ ID NO: 403630 - RNA, 64 nt, Homo Sapiens; identical to SEQ ID NO: 32040

SEQ ID NO: 403631 - RNA, 64 nt, Homo Sapiens; identical to SEQ ID NO: 32041

SEQ ID NO: 403632 - RNA, 64 nt, Homo Sapiens; identical to SEQ ID NO: 32042

SEQ ID NO: 403633 - RNA, 64 nt, Homo Sapiens; identical to SEQ ID NO: 32043

SEQ ID NO: 403634 - RNA, 63 nt, Homo Sapiens; identical to SEQ ID NO: 32044

SEQ ID NO: 403635 - RNA, 64 nt, Homo Sapiens; identical to SEQ ID NO: 32045

SEQ ID NO: 403636 - RNA, 64 nt, Homo Sapiens; identical to SEQ ID NO: 32046

SEQ ID NO: 403637 - RNA, 64 nt, Homo Sapiens; identical to SEQ ID NO: 32047

SEQ ID NO: 403638 - RNA, 64 nt, Homo Sapiens; identical to SEQ ID NO: 32048

SEQ ID NO: 403639 - RNA, 64 nt, Homo Sapiens; identical to SEQ ID NO: 32049

SEQ ID NO: 403640 - RNA, 64 nt, Homo Sapiens; identical to SEQ ID NO: 32050

SEQ ID NO: 403641 - RNA, 64 nt, Homo Sapiens; identical to SEQ ID NO: 32051

SEQ ID NO: 403642 - RNA, 64 nt, Homo Sapiens; identical to SEQ ID NO: 32052

SEQ ID NO: 403643 - RNA, 64 nt, Homo Sapiens; identical to SEQ ID NO: 32053

SEQ ID NO: 403644 - RNA, 64 nt, Homo Sapiens; identical to SEQ ID NO: 32054

SEQ ID NO: 403645 - RNA, 64 nt, Homo Sapiens; identical to SEQ ID NO: 32055

SEQ ID NO: 403646 - RNA, 64 nt, Homo Sapiens; identical to SEQ ID NO: 32056

SEQ ID NO: 403647 - RNA, 64 nt, Homo Sapiens; identical to SEQ ID NO: 32057

SEQ ID NO: 403648 - RNA, 64 nt, Homo Sapiens; identical to SEQ ID NO: 32058

SEQ ID NO: 403649 - RNA, 64 nt, Homo Sapiens; identical to SEQ ID NO: 32059

SEQ ID NO: 403650 - RNA, 64 nt, Homo Sapiens; identical to SEQ ID NO: 32060

SEQ ID NO: 403651 - RNA, 64 nt, Homo Sapiens; identical to SEQ ID NO: 32061

SEQ ID NO: 403652 - RNA, 64 nt, Homo Sapiens; identical to SEQ ID NO: 32062

SEQ ID NO: 403653 - RNA, 64 nt, Homo Sapiens; identical to SEQ ID NO: 32063

SEQ ID NO: 403654 - RNA, 64 nt, Homo Sapiens; identical to SEQ ID NO: 32064

SEQ ID NO: 403655 - RNA, 64 nt, Homo Sapiens; identical to SEQ ID NO: 32065

SEQ ID NO: 403656 - RNA, 64 nt, Homo Sapiens; identical to SEQ ID NO: 32066

SEQ ID NO: 403657 - RNA, 64 nt, Homo Sapiens; identical to SEQ ID NO: 32067

SEQ ID NO: 403658 - RNA, 64 nt, Homo Sapiens; identical to SEQ ID NO: 32068

SEQ ID NO: 403659 - RNA, 64 nt, Homo Sapiens; identical to SEQ ID NO: 32069

SEQ ID NO: 403660 - RNA, 64 nt, Homo Sapiens; identical to SEQ ID NO: 32070

SEQ ID NO: 403661 - RNA, 64 nt, Homo Sapiens; identical to SEQ ID NO: 32071

SEQ ID NO: 403662 - RNA, 64 nt, Homo Sapiens; identical to SEQ ID NO: 32072

SEQ ID NO: 403663 - RNA, 64 nt, Homo Sapiens; identical to SEQ ID NO: 32073

SEQ ID NO: 403664 - RNA, 64 nt, Homo Sapiens; identical to SEQ ID NO: 32074

SEQ ID NO: 403665 - RNA, 64 nt, Homo Sapiens; identical to SEQ ID NO: 32075

SEQ ID NO: 403666 - RNA, 64 nt, Homo Sapiens; identical to SEQ ID NO: 32076

SEQ ID NO: 403667 - RNA, 64 nt, Homo Sapiens; identical to SEQ ID NO: 32077

SEQ ID NO: 403668 - RNA, 64 nt, Homo Sapiens; identical to SEQ ID NO: 32078

SEQ ID NO: 403669 - RNA, 64 nt, Homo Sapiens; identical to SEQ ID NO: 32079

SEQ ID NO: 403670 - RNA, 64 nt, Homo Sapiens; identical to SEQ ID NO: 32080

SEQ ID NO: 403671 - RNA, 64 nt, Homo Sapiens; identical to SEQ ID NO: 32081

SEQ ID NO: 403672 - RNA, 64 nt, Homo Sapiens; identical to SEQ ID NO: 32082

SEQ ID NO: 403673 - RNA, 64 nt, Homo Sapiens; identical to SEQ ID NO: 32083

SEQ ID NO: 403674 - RNA, 64 nt, Homo Sapiens; identical to SEQ ID NO: 32084

SEQ ID NO: 403675 - RNA, 64 nt, Homo Sapiens; identical to SEQ ID NO: 32085

SEQ ID NO: 403676 - RNA, 64 nt, Homo Sapiens; identical to SEQ ID NO: 32086

SEQ ID NO: 403677 - RNA, 64 nt, Homo Sapiens; identical to SEQ ID NO: 32087

SEQ ID NO: 403678 - RNA, 64 nt, Homo Sapiens; identical to SEQ ID NO: 32088

SEQ ID NO: 403679 - RNA, 64 nt, Homo Sapiens; identical to SEQ ID NO: 32089

SEQ ID NO: 403680 - RNA, 64 nt, Homo Sapiens; identical to SEQ ID NO: 32090

SEQ ID NO: 403681 - RNA, 64 nt, Homo Sapiens; identical to SEQ ID NO: 32091

SEQ ID NO: 403682 - RNA, 64 nt, Homo Sapiens; identical to SEQ ID NO: 32092

SEQ ID NO: 403683 - RNA, 64 nt, Homo Sapiens; identical to SEQ ID NO: 32093

SEQ ID NO: 403684 - RNA, 64 nt, Homo Sapiens; identical to SEQ ID NO: 32094

SEQ ID NO: 403685 - RNA, 64 nt, Homo Sapiens; identical to SEQ ID NO: 32095

SEQ ID NO: 403686 - RNA, 64 nt, Homo Sapiens; identical to SEQ ID NO: 32096

SEQ ID NO: 403687 - RNA, 64 nt, Homo Sapiens; identical to SEQ ID NO: 32097

SEQ ID NO: 403688 - RNA, 64 nt, Homo Sapiens; identical to SEQ ID NO: 32098

SEQ ID NO: 403689 - RNA, 64 nt, Homo Sapiens; identical to SEQ ID NO: 32099

SEQ ID NO: 403690 - RNA, 64 nt, Homo Sapiens; identical to SEQ ID NO: 32100

SEQ ID NO: 403691 - RNA, 64 nt, Homo Sapiens; identical to SEQ ID NO: 32101

SEQ ID NO: 403692 - RNA, 64 nt, Homo Sapiens; identical to SEQ ID NO: 32102

SEQ ID NO: 403693 - RNA, 64 nt, Homo Sapiens; identical to SEQ ID NO: 32103

SEQ ID NO: 403694 - RNA, 64 nt, Homo Sapiens; identical to SEQ ID NO: 32104

SEQ ID NO: 403695 - RNA, 64 nt, Homo Sapiens; identical to SEQ ID NO: 32105

SEQ ID NO: 403696 - RNA, 64 nt, Homo Sapiens; identical to SEQ ID NO: 32106

SEQ ID NO: 403697 - RNA, 64 nt, Homo Sapiens; identical to SEQ ID NO: 32107

SEQ ID NO: 403698 - RNA, 64 nt, Homo Sapiens; identical to SEQ ID NO: 32108

SEQ ID NO: 403699 - RNA, 64 nt, Homo Sapiens; identical to SEQ ID NO: 32109

SEQ ID NO: 403700 - RNA, 64 nt, Homo Sapiens; identical to SEQ ID NO: 32110

SEQ ID NO: 403701 - RNA, 64 nt, Homo Sapiens; identical to SEQ ID NO: 32111

SEQ ID NO: 403702 - RNA, 64 nt, Homo Sapiens; identical to SEQ ID NO: 32112

SEQ ID NO: 403703 - RNA, 64 nt, Homo Sapiens; identical to SEQ ID NO: 32113

SEQ ID NO: 403704 - RNA, 64 nt, Homo Sapiens; identical to SEQ ID NO: 32114

SEQ ID NO: 403705 - RNA, 64 nt, Homo Sapiens; identical to SEQ ID NO: 32115

SEQ ID NO: 403706 - RNA, 64 nt, Homo Sapiens; identical to SEQ ID NO: 32116

SEQ ID NO: 403707 - RNA, 64 nt, Homo Sapiens; identical to SEQ ID NO: 32117

SEQ ID NO: 403708 - RNA, 64 nt, Homo Sapiens; identical to SEQ ID NO: 32118

SEQ ID NO: 403709 - RNA, 64 nt, Homo Sapiens; identical to SEQ ID NO: 32119

SEQ ID NO: 403710 - RNA, 64 nt, Homo Sapiens; identical to SEQ ID NO: 32120

SEQ ID NO: 403711 - RNA, 64 nt, Homo Sapiens; identical to SEQ ID NO: 32121

SEQ ID NO: 403712 - RNA, 64 nt, Homo Sapiens; identical to SEQ ID NO: 32122

SEQ ID NO: 403713 - RNA, 64 nt, Homo Sapiens; identical to SEQ ID NO: 32123

SEQ ID NO: 403714 - RNA, 64 nt, Homo Sapiens; identical to SEQ ID NO: 32124

SEQ ID NO: 403715 - RNA, 64 nt, Homo Sapiens; identical to SEQ ID NO: 32125

SEQ ID NO: 403716 - RNA, 64 nt, Homo Sapiens; identical to SEQ ID NO: 32126

SEQ ID NO: 403717 - RNA, 64 nt, Homo Sapiens; identical to SEQ ID NO: 32127

SEQ ID NO: 403718 - RNA, 64 nt, Homo Sapiens; identical to SEQ ID NO: 32128

SEQ ID NO: 403719 - RNA, 64 nt, Homo Sapiens; identical to SEQ ID NO: 32129

SEQ ID NO: 403720 - RNA, 64 nt, Homo Sapiens; identical to SEQ ID NO: 32130

SEQ ID NO: 403721 - RNA, 64 nt, Homo Sapiens; identical to SEQ ID NO: 32131

SEQ ID NO: 403722 - RNA, 64 nt, Homo Sapiens; identical to SEQ ID NO: 32132

SEQ ID NO: 403723 - RNA, 64 nt, Homo Sapiens; identical to SEQ ID NO: 32133

SEQ ID NO: 403724 - RNA, 64 nt, Homo Sapiens; identical to SEQ ID NO: 32134

SEQ ID NO: 403725 - RNA, 64 nt, Homo Sapiens; identical to SEQ ID NO: 32135

SEQ ID NO: 403726 - RNA, 64 nt, Homo Sapiens; identical to SEQ ID NO: 32136

SEQ ID NO: 403727 - RNA, 64 nt, Homo Sapiens; identical to SEQ ID NO: 32137

SEQ ID NO: 403728 - RNA, 64 nt, Homo Sapiens; identical to SEQ ID NO: 32138

SEQ ID NO: 403729 - RNA, 64 nt, Homo Sapiens; identical to SEQ ID NO: 32139

SEQ ID NO: 403730 - RNA, 64 nt, Homo Sapiens; identical to SEQ ID NO: 32140

SEQ ID NO: 403731 - RNA, 64 nt, Homo Sapiens; identical to SEQ ID NO: 32141

SEQ ID NO: 403732 - RNA, 64 nt, Homo Sapiens; identical to SEQ ID NO: 32142

SEQ ID NO: 403733 - RNA, 64 nt, Homo Sapiens; identical to SEQ ID NO: 32143

SEQ ID NO: 403734 - RNA, 64 nt, Homo Sapiens; identical to SEQ ID NO: 32144

SEQ ID NO: 403735 - RNA, 64 nt, Homo Sapiens; identical to SEQ ID NO: 32145

SEQ ID NO: 403736 - RNA, 64 nt, Homo Sapiens; identical to SEQ ID NO: 32146

SEQ ID NO: 403737 - RNA, 64 nt, Homo Sapiens; identical to SEQ ID NO: 32147

SEQ ID NO: 403738 - RNA, 64 nt, Homo Sapiens; identical to SEQ ID NO: 32148

SEQ ID NO: 403739 - RNA, 64 nt, Homo Sapiens; identical to SEQ ID NO: 32149

SEQ ID NO: 403740 - RNA, 64 nt, Homo Sapiens; identical to SEQ ID NO: 32150

SEQ ID NO: 403741 - RNA, 64 nt, Homo Sapiens; identical to SEQ ID NO: 32151

SEQ ID NO: 403742 - RNA, 64 nt, Homo Sapiens; identical to SEQ ID NO: 32152

SEQ ID NO: 403743 - RNA, 64 nt, Homo Sapiens; identical to SEQ ID NO: 32153

SEQ ID NO: 403744 - RNA, 64 nt, Homo Sapiens; identical to SEQ ID NO: 32154

SEQ ID NO: 403745 - RNA, 64 nt, Homo Sapiens; identical to SEQ ID NO: 32155

SEQ ID NO: 403746 - RNA, 64 nt, Homo Sapiens; identical to SEQ ID NO: 32156

SEQ ID NO: 403747 - RNA, 64 nt, Homo Sapiens; identical to SEQ ID NO: 32157

SEQ ID NO: 403748 - RNA, 64 nt, Homo Sapiens; identical to SEQ ID NO: 32158

SEQ ID NO: 403749 - RNA, 64 nt, Homo Sapiens; identical to SEQ ID NO: 32159

SEQ ID NO: 403750 - RNA, 64 nt, Homo Sapiens; identical to SEQ ID NO: 32160

SEQ ID NO: 403751 - RNA, 64 nt, Homo Sapiens; identical to SEQ ID NO: 32161

SEQ ID NO: 403752 - RNA, 64 nt, Homo Sapiens; identical to SEQ ID NO: 32162

SEQ ID NO: 403753 - RNA, 64 nt, Homo Sapiens; identical to SEQ ID NO: 32163

SEQ ID NO: 403754 - RNA, 64 nt, Homo Sapiens; identical to SEQ ID NO: 32164

SEQ ID NO: 403755 - RNA, 64 nt, Homo Sapiens; identical to SEQ ID NO: 32165

SEQ ID NO: 403756 - RNA, 64 nt, Homo Sapiens; identical to SEQ ID NO: 32166

SEQ ID NO: 403757 - RNA, 64 nt, Homo Sapiens; identical to SEQ ID NO: 32167

SEQ ID NO: 403758 - RNA, 64 nt, Homo Sapiens; identical to SEQ ID NO: 32168

SEQ ID NO: 403759 - RNA, 64 nt, Homo Sapiens; identical to SEQ ID NO: 32169

SEQ ID NO: 403760 - RNA, 64 nt, Homo Sapiens; identical to SEQ ID NO: 32170

SEQ ID NO: 403761 - RNA, 64 nt, Homo Sapiens; identical to SEQ ID NO: 32171

SEQ ID NO: 403762 - RNA, 64 nt, Homo Sapiens; identical to SEQ ID NO: 32172

SEQ ID NO: 403763 - RNA, 64 nt, Homo Sapiens; identical to SEQ ID NO: 32173

SEQ ID NO: 403764 - RNA, 64 nt, Homo Sapiens; identical to SEQ ID NO: 32174

SEQ ID NO: 403765 - RNA, 64 nt, Homo Sapiens; identical to SEQ ID NO: 32175

SEQ ID NO: 403766 - RNA, 64 nt, Homo Sapiens; identical to SEQ ID NO: 32176

SEQ ID NO: 403767 - RNA, 64 nt, Homo Sapiens; identical to SEQ ID NO: 32177

SEQ ID NO: 403768 - RNA, 64 nt, Homo Sapiens; identical to SEQ ID NO: 32178

SEQ ID NO: 403769 - RNA, 64 nt, Homo Sapiens; identical to SEQ ID NO: 32179

SEQ ID NO: 403770 - RNA, 64 nt, Homo Sapiens; identical to SEQ ID NO: 32180

SEQ ID NO: 403771 - RNA, 64 nt, Homo Sapiens; identical to SEQ ID NO: 32181

SEQ ID NO: 403772 - RNA, 64 nt, Homo Sapiens; identical to SEQ ID NO: 32182

SEQ ID NO: 403773 - RNA, 64 nt, Homo Sapiens; identical to SEQ ID NO: 32183

SEQ ID NO: 403774 - RNA, 64 nt, Homo Sapiens; identical to SEQ ID NO: 32184

SEQ ID NO: 403775 - RNA, 64 nt, Homo Sapiens; identical to SEQ ID NO: 32185

SEQ ID NO: 403776 - RNA, 64 nt, Homo Sapiens; identical to SEQ ID NO: 32186

SEQ ID NO: 403777 - RNA, 64 nt, Homo Sapiens; identical to SEQ ID NO: 32187

SEQ ID NO: 403778 - RNA, 64 nt, Homo Sapiens; identical to SEQ ID NO: 32188

SEQ ID NO: 403779 - RNA, 64 nt, Homo Sapiens; identical to SEQ ID NO: 32189

SEQ ID NO: 403780 - RNA, 64 nt, Homo Sapiens; identical to SEQ ID NO: 32190

SEQ ID NO: 403781 - RNA, 64 nt, Homo Sapiens; identical to SEQ ID NO: 32191

SEQ ID NO: 403782 - RNA, 64 nt, Homo Sapiens; identical to SEQ ID NO: 32192

SEQ ID NO: 403783 - RNA, 64 nt, Homo Sapiens; identical to SEQ ID NO: 32193

SEQ ID NO: 403784 - RNA, 64 nt, Homo Sapiens; identical to SEQ ID NO: 32194

SEQ ID NO: 403785 - RNA, 64 nt, Homo Sapiens; identical to SEQ ID NO: 32195

SEQ ID NO: 403786 - RNA, 64 nt, Homo Sapiens; identical to SEQ ID NO: 32196

SEQ ID NO: 403787 - RNA, 64 nt, Homo Sapiens; identical to SEQ ID NO: 32197

SEQ ID NO: 403788 - RNA, 64 nt, Homo Sapiens; identical to SEQ ID NO: 32198

SEQ ID NO: 403789 - RNA, 64 nt, Homo Sapiens; identical to SEQ ID NO: 32199

SEQ ID NO: 403790 - RNA, 64 nt, Homo Sapiens; identical to SEQ ID NO: 32200

SEQ ID NO: 403791 - RNA, 64 nt, Homo Sapiens; identical to SEQ ID NO: 32201

SEQ ID NO: 403792 - RNA, 64 nt, Homo Sapiens; identical to SEQ ID NO: 32202

SEQ ID NO: 403793 - RNA, 64 nt, Homo Sapiens; identical to SEQ ID NO: 32203

SEQ ID NO: 403794 - RNA, 64 nt, Homo Sapiens; identical to SEQ ID NO: 32204

SEQ ID NO: 403795 - RNA, 64 nt, Homo Sapiens; identical to SEQ ID NO: 32205

SEQ ID NO: 403796 - RNA, 64 nt, Homo Sapiens; identical to SEQ ID NO: 32206

SEQ ID NO: 403797 - RNA, 64 nt, Homo Sapiens; identical to SEQ ID NO: 32207

SEQ ID NO: 403798 - RNA, 64 nt, Homo Sapiens; identical to SEQ ID NO: 32208

SEQ ID NO: 403799 - RNA, 64 nt, Homo Sapiens; identical to SEQ ID NO: 32209

SEQ ID NO: 403800 - RNA, 64 nt, Homo Sapiens; identical to SEQ ID NO: 32210

SEQ ID NO: 403801 - RNA, 64 nt, Homo Sapiens; identical to SEQ ID NO: 32211

SEQ ID NO: 403802 - RNA, 64 nt, Homo Sapiens; identical to SEQ ID NO: 32212

SEQ ID NO: 403803 - RNA, 64 nt, Homo Sapiens; identical to SEQ ID NO: 32213

SEQ ID NO: 403804 - RNA, 64 nt, Homo Sapiens; identical to SEQ ID NO: 32214

SEQ ID NO: 403805 - RNA, 64 nt, Homo Sapiens; identical to SEQ ID NO: 32215

SEQ ID NO: 403806 - RNA, 64 nt, Homo Sapiens; identical to SEQ ID NO: 32216

SEQ ID NO: 403807 - RNA, 64 nt, Homo Sapiens; identical to SEQ ID NO: 32217

SEQ ID NO: 403808 - RNA, 64 nt, Homo Sapiens; identical to SEQ ID NO: 32218

SEQ ID NO: 403809 - RNA, 64 nt, Homo Sapiens; identical to SEQ ID NO: 32219

SEQ ID NO: 403810 - RNA, 64 nt, Homo Sapiens; identical to SEQ ID NO: 32220

SEQ ID NO: 403811 - RNA, 64 nt, Homo Sapiens; identical to SEQ ID NO: 32221

SEQ ID NO: 403812 - RNA, 64 nt, Homo Sapiens; identical to SEQ ID NO: 32222

SEQ ID NO: 403813 - RNA, 64 nt, Homo Sapiens; identical to SEQ ID NO: 32223

SEQ ID NO: 403814 - RNA, 64 nt, Homo Sapiens; identical to SEQ ID NO: 32224

SEQ ID NO: 403815 - RNA, 64 nt, Homo Sapiens; identical to SEQ ID NO: 32225

SEQ ID NO: 403816 - RNA, 64 nt, Homo Sapiens; identical to SEQ ID NO: 32226

SEQ ID NO: 403817 - RNA, 64 nt, Homo Sapiens; identical to SEQ ID NO: 32227

SEQ ID NO: 403818 - RNA, 64 nt, Homo Sapiens; identical to SEQ ID NO: 32228

SEQ ID NO: 403819 - RNA, 64 nt, Homo Sapiens; identical to SEQ ID NO: 32229

SEQ ID NO: 403820 - RNA, 64 nt, Homo Sapiens; identical to SEQ ID NO: 32230

SEQ ID NO: 403821 - RNA, 64 nt, Homo Sapiens; identical to SEQ ID NO: 32231

SEQ ID NO: 403822 - RNA, 64 nt, Homo Sapiens; identical to SEQ ID NO: 32232

SEQ ID NO: 403823 - RNA, 64 nt, Homo Sapiens; identical to SEQ ID NO: 32233

SEQ ID NO: 403824 - RNA, 64 nt, Homo Sapiens; identical to SEQ ID NO: 32234

SEQ ID NO: 403825 - RNA, 64 nt, Homo Sapiens; identical to SEQ ID NO: 32235

SEQ ID NO: 403826 - RNA, 64 nt, Homo Sapiens; identical to SEQ ID NO: 32236

SEQ ID NO: 403827 - RNA, 64 nt, Homo Sapiens; identical to SEQ ID NO: 32237

SEQ ID NO: 403828 - RNA, 64 nt, Homo Sapiens; identical to SEQ ID NO: 32238

SEQ ID NO: 403829 - RNA, 64 nt, Homo Sapiens; identical to SEQ ID NO: 32239

SEQ ID NO: 403830 - RNA, 64 nt, Homo Sapiens; identical to SEQ ID NO: 32240

SEQ ID NO: 403831 - RNA, 64 nt, Homo Sapiens; identical to SEQ ID NO: 32241

SEQ ID NO: 403832 - RNA, 64 nt, Homo Sapiens; identical to SEQ ID NO: 32242

SEQ ID NO: 403833 - RNA, 64 nt, Homo Sapiens; identical to SEQ ID NO: 32243

SEQ ID NO: 403834 - RNA, 64 nt, Homo Sapiens; identical to SEQ ID NO: 32244

SEQ ID NO: 403835 - RNA, 64 nt, Homo Sapiens; identical to SEQ ID NO: 32245

SEQ ID NO: 403836 - RNA, 64 nt, Homo Sapiens; identical to SEQ ID NO: 32246

SEQ ID NO: 403837 - RNA, 64 nt, Homo Sapiens; identical to SEQ ID NO: 32247

SEQ ID NO: 403838 - RNA, 64 nt, Homo Sapiens; identical to SEQ ID NO: 32248

SEQ ID NO: 403839 - RNA, 64 nt, Homo Sapiens; identical to SEQ ID NO: 32249

SEQ ID NO: 403840 - RNA, 64 nt, Homo Sapiens; identical to SEQ ID NO: 32250

SEQ ID NO: 403841 - RNA, 64 nt, Homo Sapiens; identical to SEQ ID NO: 32251

SEQ ID NO: 403842 - RNA, 64 nt, Homo Sapiens; identical to SEQ ID NO: 32252

SEQ ID NO: 403843 - RNA, 64 nt, Homo Sapiens; identical to SEQ ID NO: 32253

SEQ ID NO: 403844 - RNA, 64 nt, Homo Sapiens; identical to SEQ ID NO: 32254

SEQ ID NO: 403845 - RNA, 64 nt, Homo Sapiens; identical to SEQ ID NO: 32255

SEQ ID NO: 403846 - RNA, 64 nt, Homo Sapiens; identical to SEQ ID NO: 32256

SEQ ID NO: 403847 - RNA, 64 nt, Homo Sapiens; identical to SEQ ID NO: 32257

SEQ ID NO: 403848 - RNA, 64 nt, Homo Sapiens; identical to SEQ ID NO: 32258

SEQ ID NO: 403849 - RNA, 64 nt, Homo Sapiens; identical to SEQ ID NO: 32259

SEQ ID NO: 403850 - RNA, 64 nt, Homo Sapiens; identical to SEQ ID NO: 32260

SEQ ID NO: 403851 - RNA, 64 nt, Homo Sapiens; identical to SEQ ID NO: 32261

SEQ ID NO: 403852 - RNA, 64 nt, Homo Sapiens; identical to SEQ ID NO: 32262

SEQ ID NO: 403853 - RNA, 64 nt, Homo Sapiens; identical to SEQ ID NO: 32263

SEQ ID NO: 403854 - RNA, 64 nt, Homo Sapiens; identical to SEQ ID NO: 32264

SEQ ID NO: 403855 - RNA, 64 nt, Homo Sapiens; identical to SEQ ID NO: 32265

SEQ ID NO: 403856 - RNA, 64 nt, Homo Sapiens; identical to SEQ ID NO: 32266

SEQ ID NO: 403857 - RNA, 64 nt, Homo Sapiens; identical to SEQ ID NO: 32267

SEQ ID NO: 403858 - RNA, 64 nt, Homo Sapiens; identical to SEQ ID NO: 32268

SEQ ID NO: 403859 - RNA, 64 nt, Homo Sapiens; identical to SEQ ID NO: 32269

SEQ ID NO: 403860 - RNA, 64 nt, Homo Sapiens; identical to SEQ ID NO: 32270

SEQ ID NO: 403861 - RNA, 64 nt, Homo Sapiens; identical to SEQ ID NO: 32271

SEQ ID NO: 403862 - RNA, 64 nt, Homo Sapiens; identical to SEQ ID NO: 32272

SEQ ID NO: 403863 - RNA, 64 nt, Homo Sapiens; identical to SEQ ID NO: 32273

SEQ ID NO: 403864 - RNA, 64 nt, Homo Sapiens; identical to SEQ ID NO: 32274

SEQ ID NO: 403865 - RNA, 64 nt, Homo Sapiens; identical to SEQ ID NO: 32275

SEQ ID NO: 403866 - RNA, 64 nt, Homo Sapiens; identical to SEQ ID NO: 32276

SEQ ID NO: 403867 - RNA, 64 nt, Homo Sapiens; identical to SEQ ID NO: 32277

SEQ ID NO: 403868 - RNA, 64 nt, Homo Sapiens; identical to SEQ ID NO: 32278

SEQ ID NO: 403869 - RNA, 64 nt, Homo Sapiens; identical to SEQ ID NO: 32279

SEQ ID NO: 403870 - RNA, 64 nt, Homo Sapiens; identical to SEQ ID NO: 32280

SEQ ID NO: 403871 - RNA, 64 nt, Homo Sapiens; identical to SEQ ID NO: 32281

SEQ ID NO: 403872 - RNA, 64 nt, Homo Sapiens; identical to SEQ ID NO: 32282

SEQ ID NO: 403873 - RNA, 64 nt, Homo Sapiens; identical to SEQ ID NO: 32283

SEQ ID NO: 403874 - RNA, 64 nt, Homo Sapiens; identical to SEQ ID NO: 32284

SEQ ID NO: 403875 - RNA, 64 nt, Homo Sapiens; identical to SEQ ID NO: 32285

SEQ ID NO: 403876 - RNA, 64 nt, Homo Sapiens; identical to SEQ ID NO: 32286

SEQ ID NO: 403877 - RNA, 64 nt, Homo Sapiens; identical to SEQ ID NO: 32287

SEQ ID NO: 403878 - RNA, 64 nt, Homo Sapiens; identical to SEQ ID NO: 32288

SEQ ID NO: 403879 - RNA, 64 nt, Homo Sapiens; identical to SEQ ID NO: 32289

SEQ ID NO: 403880 - RNA, 64 nt, Homo Sapiens; identical to SEQ ID NO: 32290

SEQ ID NO: 403881 - RNA, 64 nt, Homo Sapiens; identical to SEQ ID NO: 32291

SEQ ID NO: 403882 - RNA, 64 nt, Homo Sapiens; identical to SEQ ID NO: 32292

SEQ ID NO: 403883 - RNA, 64 nt, Homo Sapiens; identical to SEQ ID NO: 32293

SEQ ID NO: 403884 - RNA, 64 nt, Homo Sapiens; identical to SEQ ID NO: 32294

SEQ ID NO: 403885 - RNA, 64 nt, Homo Sapiens; identical to SEQ ID NO: 32295

SEQ ID NO: 403886 - RNA, 64 nt, Homo Sapiens; identical to SEQ ID NO: 32296

SEQ ID NO: 403887 - RNA, 64 nt, Homo Sapiens; identical to SEQ ID NO: 32297

SEQ ID NO: 403888 - RNA, 64 nt, Homo Sapiens; identical to SEQ ID NO: 32298

SEQ ID NO: 403889 - RNA, 64 nt, Homo Sapiens; identical to SEQ ID NO: 32299

SEQ ID NO: 403890 - RNA, 64 nt, Homo Sapiens; identical to SEQ ID NO: 32300

SEQ ID NO: 403891 - RNA, 64 nt, Homo Sapiens; identical to SEQ ID NO: 32301

SEQ ID NO: 403892 - RNA, 64 nt, Homo Sapiens; identical to SEQ ID NO: 32302

SEQ ID NO: 403893 - RNA, 64 nt, Homo Sapiens; identical to SEQ ID NO: 32303

SEQ ID NO: 403894 - RNA, 64 nt, Homo Sapiens; identical to SEQ ID NO: 32304

SEQ ID NO: 403895 - RNA, 64 nt, Homo Sapiens; identical to SEQ ID NO: 32305

SEQ ID NO: 403896 - RNA, 64 nt, Homo Sapiens; identical to SEQ ID NO: 32306

SEQ ID NO: 403897 - RNA, 64 nt, Homo Sapiens; identical to SEQ ID NO: 32307

SEQ ID NO: 403898 - RNA, 64 nt, Homo Sapiens; identical to SEQ ID NO: 32308

SEQ ID NO: 403899 - RNA, 64 nt, Homo Sapiens; identical to SEQ ID NO: 32309

SEQ ID NO: 403900 - RNA, 64 nt, Homo Sapiens; identical to SEQ ID NO: 32310

SEQ ID NO: 403901 - RNA, 64 nt, Homo Sapiens; identical to SEQ ID NO: 32311

SEQ ID NO: 403902 - RNA, 64 nt, Homo Sapiens; identical to SEQ ID NO: 32312

SEQ ID NO: 403903 - RNA, 64 nt, Homo Sapiens; identical to SEQ ID NO: 32313

SEQ ID NO: 403904 - RNA, 64 nt, Homo Sapiens; identical to SEQ ID NO: 32314

SEQ ID NO: 403905 - RNA, 64 nt, Homo Sapiens; identical to SEQ ID NO: 32315

SEQ ID NO: 403906 - RNA, 64 nt, Homo Sapiens; identical to SEQ ID NO: 32316

SEQ ID NO: 403907 - RNA, 64 nt, Homo Sapiens; identical to SEQ ID NO: 32317

SEQ ID NO: 403908 - RNA, 64 nt, Homo Sapiens; identical to SEQ ID NO: 32318

SEQ ID NO: 403909 - RNA, 64 nt, Homo Sapiens; identical to SEQ ID NO: 32319

SEQ ID NO: 403910 - RNA, 64 nt, Homo Sapiens; identical to SEQ ID NO: 32320

SEQ ID NO: 403911 - RNA, 64 nt, Homo Sapiens; identical to SEQ ID NO: 32321

SEQ ID NO: 403912 - RNA, 64 nt, Homo Sapiens; identical to SEQ ID NO: 32322

SEQ ID NO: 403913 - RNA, 64 nt, Homo Sapiens; identical to SEQ ID NO: 32323

SEQ ID NO: 403914 - RNA, 64 nt, Homo Sapiens; identical to SEQ ID NO: 32324

SEQ ID NO: 403915 - RNA, 64 nt, Homo Sapiens; identical to SEQ ID NO: 32325

SEQ ID NO: 403916 - RNA, 64 nt, Homo Sapiens; identical to SEQ ID NO: 32326

SEQ ID NO: 403917 - RNA, 64 nt, Homo Sapiens; identical to SEQ ID NO: 32327

SEQ ID NO: 403918 - RNA, 64 nt, Homo Sapiens; identical to SEQ ID NO: 32328

SEQ ID NO: 403919 - RNA, 64 nt, Homo Sapiens; identical to SEQ ID NO: 32329

SEQ ID NO: 403920 - RNA, 64 nt, Homo Sapiens; identical to SEQ ID NO: 32330

SEQ ID NO: 403921 - RNA, 64 nt, Homo Sapiens; identical to SEQ ID NO: 32331

SEQ ID NO: 403922 - RNA, 64 nt, Homo Sapiens; identical to SEQ ID NO: 32332

SEQ ID NO: 403923 - RNA, 64 nt, Homo Sapiens; identical to SEQ ID NO: 32333

SEQ ID NO: 403924 - RNA, 64 nt, Homo Sapiens; identical to SEQ ID NO: 32334

SEQ ID NO: 403925 - RNA, 64 nt, Homo Sapiens; identical to SEQ ID NO: 32335

SEQ ID NO: 403926 - RNA, 64 nt, Homo Sapiens; identical to SEQ ID NO: 32336

SEQ ID NO: 403927 - RNA, 64 nt, Homo Sapiens; identical to SEQ ID NO: 32337

SEQ ID NO: 403928 - RNA, 64 nt, Homo Sapiens; identical to SEQ ID NO: 32338

SEQ ID NO: 403929 - RNA, 64 nt, Homo Sapiens; identical to SEQ ID NO: 32339

SEQ ID NO: 403930 - RNA, 64 nt, Homo Sapiens; identical to SEQ ID NO: 32340

SEQ ID NO: 403931 - RNA, 64 nt, Homo Sapiens; identical to SEQ ID NO: 32341

SEQ ID NO: 403932 - RNA, 64 nt, Homo Sapiens; identical to SEQ ID NO: 32342

SEQ ID NO: 403933 - RNA, 64 nt, Homo Sapiens; identical to SEQ ID NO: 32343

SEQ ID NO: 403934 - RNA, 64 nt, Homo Sapiens; identical to SEQ ID NO: 32344

SEQ ID NO: 403935 - RNA, 64 nt, Homo Sapiens; identical to SEQ ID NO: 32345

SEQ ID NO: 403936 - RNA, 64 nt, Homo Sapiens; identical to SEQ ID NO: 32346

SEQ ID NO: 403937 - RNA, 64 nt, Homo Sapiens; identical to SEQ ID NO: 32347

SEQ ID NO: 403938 - RNA, 64 nt, Homo Sapiens; identical to SEQ ID NO: 32348

SEQ ID NO: 403939 - RNA, 64 nt, Homo Sapiens; identical to SEQ ID NO: 32349

SEQ ID NO: 403940 - RNA, 64 nt, Homo Sapiens; identical to SEQ ID NO: 32350

SEQ ID NO: 403941 - RNA, 64 nt, Homo Sapiens; identical to SEQ ID NO: 32351

SEQ ID NO: 403942 - RNA, 64 nt, Homo Sapiens; identical to SEQ ID NO: 32352

SEQ ID NO: 403943 - RNA, 64 nt, Homo Sapiens; identical to SEQ ID NO: 32353

SEQ ID NO: 403944 - RNA, 64 nt, Homo Sapiens; identical to SEQ ID NO: 32354

SEQ ID NO: 403945 - RNA, 64 nt, Homo Sapiens; identical to SEQ ID NO: 32355

SEQ ID NO: 403946 - RNA, 64 nt, Homo Sapiens; identical to SEQ ID NO: 32356

SEQ ID NO: 403947 - RNA, 64 nt, Homo Sapiens; identical to SEQ ID NO: 32357

SEQ ID NO: 403948 - RNA, 64 nt, Homo Sapiens; identical to SEQ ID NO: 32358

SEQ ID NO: 403949 - RNA, 64 nt, Homo Sapiens; identical to SEQ ID NO: 32359

SEQ ID NO: 403950 - RNA, 64 nt, Homo Sapiens; identical to SEQ ID NO: 32360

SEQ ID NO: 403951 - RNA, 64 nt, Homo Sapiens; identical to SEQ ID NO: 32361

SEQ ID NO: 403952 - RNA, 64 nt, Homo Sapiens; identical to SEQ ID NO: 32362

SEQ ID NO: 403953 - RNA, 64 nt, Homo Sapiens; identical to SEQ ID NO: 32363

SEQ ID NO: 403954 - RNA, 64 nt, Homo Sapiens; identical to SEQ ID NO: 32364

SEQ ID NO: 403955 - RNA, 64 nt, Homo Sapiens; identical to SEQ ID NO: 32365

SEQ ID NO: 403956 - RNA, 64 nt, Homo Sapiens; identical to SEQ ID NO: 32366

SEQ ID NO: 403957 - RNA, 64 nt, Homo Sapiens; identical to SEQ ID NO: 32367

SEQ ID NO: 403958 - RNA, 64 nt, Homo Sapiens; identical to SEQ ID NO: 32368

SEQ ID NO: 403959 - RNA, 64 nt, Homo Sapiens; identical to SEQ ID NO: 32369

SEQ ID NO: 403960 - RNA, 64 nt, Homo Sapiens; identical to SEQ ID NO: 32370

SEQ ID NO: 403961 - RNA, 64 nt, Homo Sapiens; identical to SEQ ID NO: 32371

SEQ ID NO: 403962 - RNA, 64 nt, Homo Sapiens; identical to SEQ ID NO: 32372

SEQ ID NO: 403963 - RNA, 64 nt, Homo Sapiens; identical to SEQ ID NO: 32373

SEQ ID NO: 403964 - RNA, 64 nt, Homo Sapiens; identical to SEQ ID NO: 32374

SEQ ID NO: 403965 - RNA, 64 nt, Homo Sapiens; identical to SEQ ID NO: 32375

SEQ ID NO: 403966 - RNA, 64 nt, Homo Sapiens; identical to SEQ ID NO: 32376

SEQ ID NO: 403967 - RNA, 64 nt, Homo Sapiens; identical to SEQ ID NO: 32377

SEQ ID NO: 403968 - RNA, 64 nt, Homo Sapiens; identical to SEQ ID NO: 32378

SEQ ID NO: 403969 - RNA, 64 nt, Homo Sapiens; identical to SEQ ID NO: 32379

SEQ ID NO: 403970 - RNA, 64 nt, Homo Sapiens; identical to SEQ ID NO: 32380

SEQ ID NO: 403971 - RNA, 64 nt, Homo Sapiens; identical to SEQ ID NO: 32381

SEQ ID NO: 403972 - RNA, 64 nt, Homo Sapiens; identical to SEQ ID NO: 32382

SEQ ID NO: 403973 - RNA, 64 nt, Homo Sapiens; identical to SEQ ID NO: 32383

SEQ ID NO: 403974 - RNA, 64 nt, Homo Sapiens; identical to SEQ ID NO: 32384

SEQ ID NO: 403975 - RNA, 64 nt, Homo Sapiens; identical to SEQ ID NO: 32385

SEQ ID NO: 403976 - RNA, 64 nt, Homo Sapiens; identical to SEQ ID NO: 32386

SEQ ID NO: 403977 - RNA, 64 nt, Homo Sapiens; identical to SEQ ID NO: 32387

SEQ ID NO: 403978 - RNA, 64 nt, Homo Sapiens; identical to SEQ ID NO: 32388

SEQ ID NO: 403979 - RNA, 64 nt, Homo Sapiens; identical to SEQ ID NO: 32389

SEQ ID NO: 403980 - RNA, 64 nt, Homo Sapiens; identical to SEQ ID NO: 32390

SEQ ID NO: 403981 - RNA, 64 nt, Homo Sapiens; identical to SEQ ID NO: 32391

SEQ ID NO: 403982 - RNA, 64 nt, Homo Sapiens; identical to SEQ ID NO: 32392

SEQ ID NO: 403983 - RNA, 64 nt, Homo Sapiens; identical to SEQ ID NO: 32393

SEQ ID NO: 403984 - RNA, 64 nt, Homo Sapiens; identical to SEQ ID NO: 32394

SEQ ID NO: 403985 - RNA, 64 nt, Homo Sapiens; identical to SEQ ID NO: 32395

SEQ ID NO: 403986 - RNA, 64 nt, Homo Sapiens; identical to SEQ ID NO: 32396

SEQ ID NO: 403987 - RNA, 64 nt, Homo Sapiens; identical to SEQ ID NO: 32397

SEQ ID NO: 403988 - RNA, 64 nt, Homo Sapiens; identical to SEQ ID NO: 32398

SEQ ID NO: 403989 - RNA, 64 nt, Homo Sapiens; identical to SEQ ID NO: 32399

SEQ ID NO: 403990 - RNA, 64 nt, Homo Sapiens; identical to SEQ ID NO: 32400

SEQ ID NO: 403991 - RNA, 64 nt, Homo Sapiens; identical to SEQ ID NO: 32401

SEQ ID NO: 403992 - RNA, 64 nt, Homo Sapiens; identical to SEQ ID NO: 32402

SEQ ID NO: 403993 - RNA, 64 nt, Homo Sapiens; identical to SEQ ID NO: 32403

SEQ ID NO: 403994 - RNA, 64 nt, Homo Sapiens; identical to SEQ ID NO: 32404

SEQ ID NO: 403995 - RNA, 64 nt, Homo Sapiens; identical to SEQ ID NO: 32405

SEQ ID NO: 403996 - RNA, 64 nt, Homo Sapiens; identical to SEQ ID NO: 32406

SEQ ID NO: 403997 - RNA, 64 nt, Homo Sapiens; identical to SEQ ID NO: 32407

SEQ ID NO: 403998 - RNA, 64 nt, Homo Sapiens; identical to SEQ ID NO: 32408

SEQ ID NO: 403999 - RNA, 64 nt, Homo Sapiens; identical to SEQ ID NO: 32409

SEQ ID NO: 404000 - RNA, 64 nt, Homo Sapiens; identical to SEQ ID NO: 32410

SEQ ID NO: 404001 - RNA, 64 nt, Homo Sapiens; identical to SEQ ID NO: 32411

SEQ ID NO: 404002 - RNA, 64 nt, Homo Sapiens; identical to SEQ ID NO: 32412

SEQ ID NO: 404003 - RNA, 64 nt, Homo Sapiens; identical to SEQ ID NO: 32413

SEQ ID NO: 404004 - RNA, 64 nt, Homo Sapiens; identical to SEQ ID NO: 32414

SEQ ID NO: 404005 - RNA, 64 nt, Homo Sapiens; identical to SEQ ID NO: 32415

SEQ ID NO: 404006 - RNA, 64 nt, Homo Sapiens; identical to SEQ ID NO: 32416

SEQ ID NO: 404007 - RNA, 64 nt, Homo Sapiens; identical to SEQ ID NO: 32417

SEQ ID NO: 404008 - RNA, 64 nt, Homo Sapiens; identical to SEQ ID NO: 32418

SEQ ID NO: 404009 - RNA, 64 nt, Homo Sapiens; identical to SEQ ID NO: 32419

SEQ ID NO: 404010 - RNA, 64 nt, Homo Sapiens; identical to SEQ ID NO: 32420

SEQ ID NO: 404011 - RNA, 64 nt, Homo Sapiens; identical to SEQ ID NO: 32421

SEQ ID NO: 404012 - RNA, 64 nt, Homo Sapiens; identical to SEQ ID NO: 32422

SEQ ID NO: 404013 - RNA, 64 nt, Homo Sapiens; identical to SEQ ID NO: 32423

SEQ ID NO: 404014 - RNA, 64 nt, Homo Sapiens; identical to SEQ ID NO: 32424

SEQ ID NO: 404015 - RNA, 64 nt, Homo Sapiens; identical to SEQ ID NO: 32425

SEQ ID NO: 404016 - RNA, 64 nt, Homo Sapiens; identical to SEQ ID NO: 32426

SEQ ID NO: 404017 - RNA, 64 nt, Homo Sapiens; identical to SEQ ID NO: 32427

SEQ ID NO: 404018 - RNA, 64 nt, Homo Sapiens; identical to SEQ ID NO: 32428

SEQ ID NO: 404019 - RNA, 64 nt, Homo Sapiens; identical to SEQ ID NO: 32429

SEQ ID NO: 404020 - RNA, 64 nt, Homo Sapiens; identical to SEQ ID NO: 32430

SEQ ID NO: 404021 - RNA, 64 nt, Homo Sapiens; identical to SEQ ID NO: 32431

SEQ ID NO: 404022 - RNA, 64 nt, Homo Sapiens; identical to SEQ ID NO: 32432

SEQ ID NO: 404023 - RNA, 64 nt, Homo Sapiens; identical to SEQ ID NO: 32433

SEQ ID NO: 404024 - RNA, 64 nt, Homo Sapiens; identical to SEQ ID NO: 32434

SEQ ID NO: 404025 - RNA, 64 nt, Homo Sapiens; identical to SEQ ID NO: 32435

SEQ ID NO: 404026 - RNA, 64 nt, Homo Sapiens; identical to SEQ ID NO: 32436

SEQ ID NO: 404027 - RNA, 64 nt, Homo Sapiens; identical to SEQ ID NO: 32437

SEQ ID NO: 404028 - RNA, 64 nt, Homo Sapiens; identical to SEQ ID NO: 32438

SEQ ID NO: 404029 - RNA, 64 nt, Homo Sapiens; identical to SEQ ID NO: 32439

SEQ ID NO: 404030 - RNA, 64 nt, Homo Sapiens; identical to SEQ ID NO: 32440

SEQ ID NO: 404031 - RNA, 64 nt, Homo Sapiens; identical to SEQ ID NO: 32441

SEQ ID NO: 404032 - RNA, 64 nt, Homo Sapiens; identical to SEQ ID NO: 32442

SEQ ID NO: 404033 - RNA, 64 nt, Homo Sapiens; identical to SEQ ID NO: 32443

SEQ ID NO: 404034 - RNA, 64 nt, Homo Sapiens; identical to SEQ ID NO: 32444

SEQ ID NO: 404035 - RNA, 64 nt, Homo Sapiens; identical to SEQ ID NO: 32445

SEQ ID NO: 404036 - RNA, 64 nt, Homo Sapiens; identical to SEQ ID NO: 32446

SEQ ID NO: 404037 - RNA, 64 nt, Homo Sapiens; identical to SEQ ID NO: 32447

SEQ ID NO: 404038 - RNA, 64 nt, Homo Sapiens; identical to SEQ ID NO: 32448

SEQ ID NO: 404039 - RNA, 64 nt, Homo Sapiens; identical to SEQ ID NO: 32449

SEQ ID NO: 404040 - RNA, 64 nt, Homo Sapiens; identical to SEQ ID NO: 32450

SEQ ID NO: 404041 - RNA, 64 nt, Homo Sapiens; identical to SEQ ID NO: 32451

SEQ ID NO: 404042 - RNA, 64 nt, Homo Sapiens; identical to SEQ ID NO: 32452

SEQ ID NO: 404043 - RNA, 64 nt, Homo Sapiens; identical to SEQ ID NO: 32453

SEQ ID NO: 404044 - RNA, 64 nt, Homo Sapiens; identical to SEQ ID NO: 32454

SEQ ID NO: 404045 - RNA, 64 nt, Homo Sapiens; identical to SEQ ID NO: 32455

SEQ ID NO: 404046 - RNA, 64 nt, Homo Sapiens; identical to SEQ ID NO: 32456

SEQ ID NO: 404047 - RNA, 64 nt, Homo Sapiens; identical to SEQ ID NO: 32457

SEQ ID NO: 404048 - RNA, 64 nt, Homo Sapiens; identical to SEQ ID NO: 32458

SEQ ID NO: 404049 - RNA, 64 nt, Homo Sapiens; identical to SEQ ID NO: 32459

SEQ ID NO: 404050 - RNA, 64 nt, Homo Sapiens; identical to SEQ ID NO: 32460

SEQ ID NO: 404051 - RNA, 64 nt, Homo Sapiens; identical to SEQ ID NO: 32461

SEQ ID NO: 404052 - RNA, 64 nt, Homo Sapiens; identical to SEQ ID NO: 32462

SEQ ID NO: 404053 - RNA, 64 nt, Homo Sapiens; identical to SEQ ID NO: 32463

SEQ ID NO: 404054 - RNA, 64 nt, Homo Sapiens; identical to SEQ ID NO: 32464

SEQ ID NO: 404055 - RNA, 64 nt, Homo Sapiens; identical to SEQ ID NO: 32465

SEQ ID NO: 404056 - RNA, 64 nt, Homo Sapiens; identical to SEQ ID NO: 32466

SEQ ID NO: 404057 - RNA, 64 nt, Homo Sapiens; identical to SEQ ID NO: 32467

SEQ ID NO: 404058 - RNA, 64 nt, Homo Sapiens; identical to SEQ ID NO: 32468

SEQ ID NO: 404059 - RNA, 64 nt, Homo Sapiens; identical to SEQ ID NO: 32469

SEQ ID NO: 404060 - RNA, 64 nt, Homo Sapiens; identical to SEQ ID NO: 32470

SEQ ID NO: 404061 - RNA, 64 nt, Homo Sapiens; identical to SEQ ID NO: 32471

SEQ ID NO: 404062 - RNA, 64 nt, Homo Sapiens; identical to SEQ ID NO: 32472

SEQ ID NO: 404063 - RNA, 64 nt, Homo Sapiens; identical to SEQ ID NO: 32473

SEQ ID NO: 404064 - RNA, 64 nt, Homo Sapiens; identical to SEQ ID NO: 32474

SEQ ID NO: 404065 - RNA, 64 nt, Homo Sapiens; identical to SEQ ID NO: 32475

SEQ ID NO: 404066 - RNA, 64 nt, Homo Sapiens; identical to SEQ ID NO: 32476

SEQ ID NO: 404067 - RNA, 64 nt, Homo Sapiens; identical to SEQ ID NO: 32477

SEQ ID NO: 404068 - RNA, 64 nt, Homo Sapiens; identical to SEQ ID NO: 32478

SEQ ID NO: 404069 - RNA, 64 nt, Homo Sapiens; identical to SEQ ID NO: 32479

SEQ ID NO: 404070 - RNA, 64 nt, Homo Sapiens; identical to SEQ ID NO: 32480

SEQ ID NO: 404071 - RNA, 64 nt, Homo Sapiens; identical to SEQ ID NO: 32481

SEQ ID NO: 404072 - RNA, 64 nt, Homo Sapiens; identical to SEQ ID NO: 32482

SEQ ID NO: 404073 - RNA, 64 nt, Homo Sapiens; identical to SEQ ID NO: 32483

SEQ ID NO: 404074 - RNA, 64 nt, Homo Sapiens; identical to SEQ ID NO: 32484

SEQ ID NO: 404075 - RNA, 64 nt, Homo Sapiens; identical to SEQ ID NO: 32485

SEQ ID NO: 404076 - RNA, 64 nt, Homo Sapiens; identical to SEQ ID NO: 32486

SEQ ID NO: 404077 - RNA, 64 nt, Homo Sapiens; identical to SEQ ID NO: 32487

SEQ ID NO: 404078 - RNA, 64 nt, Homo Sapiens; identical to SEQ ID NO: 32488

SEQ ID NO: 404079 - RNA, 64 nt, Homo Sapiens; identical to SEQ ID NO: 32489

SEQ ID NO: 404080 - RNA, 64 nt, Homo Sapiens; identical to SEQ ID NO: 32490

SEQ ID NO: 404081 - RNA, 64 nt, Homo Sapiens; identical to SEQ ID NO: 32491

SEQ ID NO: 404082 - RNA, 64 nt, Homo Sapiens; identical to SEQ ID NO: 32492

SEQ ID NO: 404083 - RNA, 64 nt, Homo Sapiens; identical to SEQ ID NO: 32493

SEQ ID NO: 404084 - RNA, 64 nt, Homo Sapiens; identical to SEQ ID NO: 32494

SEQ ID NO: 404085 - RNA, 64 nt, Homo Sapiens; identical to SEQ ID NO: 32495

SEQ ID NO: 404086 - RNA, 64 nt, Homo Sapiens; identical to SEQ ID NO: 32496

SEQ ID NO: 404087 - RNA, 64 nt, Homo Sapiens; identical to SEQ ID NO: 32497

SEQ ID NO: 404088 - RNA, 64 nt, Homo Sapiens; identical to SEQ ID NO: 32498

SEQ ID NO: 404089 - RNA, 64 nt, Homo Sapiens; identical to SEQ ID NO: 32499

SEQ ID NO: 404090 - RNA, 64 nt, Homo Sapiens; identical to SEQ ID NO: 32500

SEQ ID NO: 404091 - RNA, 64 nt, Homo Sapiens; identical to SEQ ID NO: 32501

SEQ ID NO: 404092 - RNA, 64 nt, Homo Sapiens; identical to SEQ ID NO: 32502

SEQ ID NO: 404093 - RNA, 64 nt, Homo Sapiens; identical to SEQ ID NO: 32503

SEQ ID NO: 404094 - RNA, 64 nt, Homo Sapiens; identical to SEQ ID NO: 32504

SEQ ID NO: 404095 - RNA, 64 nt, Homo Sapiens; identical to SEQ ID NO: 32505

SEQ ID NO: 404096 - RNA, 64 nt, Homo Sapiens; identical to SEQ ID NO: 32506
